United States Patent 7,709,616 (MICRORNAS AND USES THEREOF) - sequence listing, part 14

SEQ ID NO: 401728 - RNA, 64 nt, hsa; identical to SEQ ID NO: 30138

SEQ ID NO: 401729 - RNA, 64 nt, hsa; identical to SEQ ID NO: 30139

SEQ ID NO: 401730 - RNA, 64 nt, hsa; identical to SEQ ID NO: 30140

SEQ ID NO: 401731 - RNA, 64 nt, hsa; identical to SEQ ID NO: 30141

SEQ ID NO: 401732 - RNA, 64 nt, hsa; identical to SEQ ID NO: 30142

SEQ ID NO: 401733 - RNA, 64 nt, hsa; identical to SEQ ID NO: 30143

SEQ ID NO: 401734 - RNA, 64 nt, hsa; identical to SEQ ID NO: 30144

SEQ ID NO: 401735 - RNA, 64 nt, hsa; identical to SEQ ID NO: 30145

SEQ ID NO: 401736 - RNA, 64 nt, hsa; identical to SEQ ID NO: 30146

SEQ ID NO: 401737 - RNA, 64 nt, hsa; identical to SEQ ID NO: 30147

SEQ ID NO: 401738 - RNA, 64 nt, hsa; identical to SEQ ID NO: 30148

SEQ ID NO: 401739 - RNA, 64 nt, hsa; identical to SEQ ID NO: 30149

SEQ ID NO: 401740 - RNA, 64 nt, hsa; identical to SEQ ID NO: 30150

SEQ ID NO: 401741 - RNA, 64 nt, hsa; identical to SEQ ID NO: 30151

SEQ ID NO: 401742 - RNA, 64 nt, hsa; identical to SEQ ID NO: 30152

SEQ ID NO: 401743 - RNA, 64 nt, hsa; identical to SEQ ID NO: 30153

SEQ ID NO: 401744 - RNA, 64 nt, hsa; identical to SEQ ID NO: 30154

SEQ ID NO: 401745 - RNA, 64 nt, hsa; identical to SEQ ID NO: 30155

SEQ ID NO: 401746 - RNA, 64 nt, hsa; identical to SEQ ID NO: 30156

SEQ ID NO: 401747 - RNA, 64 nt, hsa; identical to SEQ ID NO: 30157

SEQ ID NO: 401748 - RNA, 64 nt, hsa; identical to SEQ ID NO: 30158

SEQ ID NO: 401749 - RNA, 64 nt, hsa; identical to SEQ ID NO: 30159

SEQ ID NO: 401750 - RNA, 64 nt, hsa; identical to SEQ ID NO: 30160

SEQ ID NO: 401751 - RNA, 64 nt, hsa; identical to SEQ ID NO: 30161

SEQ ID NO: 401752 - RNA, 64 nt, hsa; identical to SEQ ID NO: 30162

SEQ ID NO: 401753 - RNA, 64 nt, hsa; identical to SEQ ID NO: 30163

SEQ ID NO: 401754 - RNA, 64 nt, hsa; identical to SEQ ID NO: 30164

SEQ ID NO: 401755 - RNA, 64 nt, hsa; identical to SEQ ID NO: 30165

SEQ ID NO: 401756 - RNA, 64 nt, hsa; identical to SEQ ID NO: 30166

SEQ ID NO: 401757 - RNA, 64 nt, hsa; identical to SEQ ID NO: 30167

SEQ ID NO: 401758 - RNA, 64 nt, hsa; identical to SEQ ID NO: 30168

SEQ ID NO: 401759 - RNA, 64 nt, hsa; identical to SEQ ID NO: 30169

SEQ ID NO: 401760 - RNA, 64 nt, hsa; identical to SEQ ID NO: 30170

SEQ ID NO: 401761 - RNA, 64 nt, hsa; identical to SEQ ID NO: 30171

SEQ ID NO: 401762 - RNA, 64 nt, hsa; identical to SEQ ID NO: 30172

SEQ ID NO: 401763 - RNA, 64 nt, hsa; identical to SEQ ID NO: 30173

SEQ ID NO: 401764 - RNA, 64 nt, hsa; identical to SEQ ID NO: 30174

SEQ ID NO: 401765 - RNA, 64 nt, hsa; identical to SEQ ID NO: 30175

SEQ ID NO: 401766 - RNA, 64 nt, hsa; identical to SEQ ID NO: 30176

SEQ ID NO: 401767 - RNA, 64 nt, hsa; identical to SEQ ID NO: 30177

SEQ ID NO: 401768 - RNA, 64 nt, hsa; identical to SEQ ID NO: 30178

SEQ ID NO: 401769 - RNA, 64 nt, hsa; identical to SEQ ID NO: 30179

SEQ ID NO: 401770 - RNA, 64 nt, hsa; identical to SEQ ID NO: 30180

SEQ ID NO: 401771 - RNA, 64 nt, hsa; identical to SEQ ID NO: 30181

SEQ ID NO: 401772 - RNA, 64 nt, hsa; identical to SEQ ID NO: 30182

SEQ ID NO: 401773 - RNA, 64 nt, hsa; identical to SEQ ID NO: 30183

SEQ ID NO: 401774 - RNA, 64 nt, hsa; identical to SEQ ID NO: 30184

SEQ ID NO: 401775 - RNA, 64 nt, hsa; identical to SEQ ID NO: 30185

SEQ ID NO: 401776 - RNA, 64 nt, hsa; identical to SEQ ID NO: 30186

SEQ ID NO: 401777 - RNA, 64 nt, hsa; identical to SEQ ID NO: 30187

SEQ ID NO: 401778 - RNA, 64 nt, hsa; identical to SEQ ID NO: 30188

SEQ ID NO: 401779 - RNA, 64 nt, hsa; identical to SEQ ID NO: 30189

SEQ ID NO: 401780 - RNA, 64 nt, hsa; identical to SEQ ID NO: 30190

SEQ ID NO: 401781 - RNA, 64 nt, hsa; identical to SEQ ID NO: 30191

SEQ ID NO: 401782 - RNA, 64 nt, hsa; identical to SEQ ID NO: 30192

SEQ ID NO: 401783 - RNA, 64 nt, hsa; identical to SEQ ID NO: 30193

SEQ ID NO: 401784 - RNA, 64 nt, hsa; identical to SEQ ID NO: 30194

SEQ ID NO: 401785 - RNA, 64 nt, hsa; identical to SEQ ID NO: 30195

SEQ ID NO: 401786 - RNA, 64 nt, hsa; identical to SEQ ID NO: 30196

SEQ ID NO: 401787 - RNA, 64 nt, hsa; identical to SEQ ID NO: 30197

SEQ ID NO: 401788 - RNA, 64 nt, hsa; identical to SEQ ID NO: 30198

SEQ ID NO: 401789 - RNA, 64 nt, hsa; identical to SEQ ID NO: 30199

SEQ ID NO: 401790 - RNA, 64 nt, hsa; identical to SEQ ID NO: 30200

SEQ ID NO: 401791 - RNA, 64 nt, hsa; identical to SEQ ID NO: 30201

SEQ ID NO: 401792 - RNA, 64 nt, hsa; identical to SEQ ID NO: 30202

SEQ ID NO: 401793 - RNA, 64 nt, hsa; identical to SEQ ID NO: 30203

SEQ ID NO: 401794 - RNA, 64 nt, hsa; identical to SEQ ID NO: 30204

SEQ ID NO: 401795 - RNA, 64 nt, hsa; identical to SEQ ID NO: 30205

SEQ ID NO: 401796 - RNA, 64 nt, hsa; identical to SEQ ID NO: 30206

SEQ ID NO: 401797 - RNA, 64 nt, hsa; identical to SEQ ID NO: 30207

SEQ ID NO: 401798 - RNA, 64 nt, hsa; identical to SEQ ID NO: 30208

SEQ ID NO: 401799 - RNA, 64 nt, hsa; identical to SEQ ID NO: 30209

SEQ ID NO: 401800 - RNA, 64 nt, hsa; identical to SEQ ID NO: 30210

SEQ ID NO: 401801 - RNA, 64 nt, hsa; identical to SEQ ID NO: 30211

SEQ ID NO: 401802 - RNA, 64 nt, hsa; identical to SEQ ID NO: 30212

SEQ ID NO: 401803 - RNA, 64 nt, hsa; identical to SEQ ID NO: 30213

SEQ ID NO: 401804 - RNA, 64 nt, hsa; identical to SEQ ID NO: 30214

SEQ ID NO: 401805 - RNA, 64 nt, hsa; identical to SEQ ID NO: 30215

SEQ ID NO: 401806 - RNA, 64 nt, hsa; identical to SEQ ID NO: 30216

SEQ ID NO: 401807 - RNA, 64 nt, hsa; identical to SEQ ID NO: 30217

SEQ ID NO: 401808 - RNA, 64 nt, hsa; identical to SEQ ID NO: 30218

SEQ ID NO: 401809 - RNA, 64 nt, hsa; identical to SEQ ID NO: 30219

SEQ ID NO: 401810 - RNA, 64 nt, hsa; identical to SEQ ID NO: 30220

SEQ ID NO: 401811 - RNA, 64 nt, hsa; identical to SEQ ID NO: 30221

SEQ ID NO: 401812 - RNA, 64 nt, hsa; identical to SEQ ID NO: 30222

SEQ ID NO: 401813 - RNA, 64 nt, hsa; identical to SEQ ID NO: 30223

SEQ ID NO: 401814 - RNA, 64 nt, hsa; identical to SEQ ID NO: 30224

SEQ ID NO: 401815 - RNA, 64 nt, hsa; identical to SEQ ID NO: 30225

SEQ ID NO: 401816 - RNA, 64 nt, hsa; identical to SEQ ID NO: 30226

SEQ ID NO: 401817 - RNA, 64 nt, hsa; identical to SEQ ID NO: 30227

SEQ ID NO: 401818 - RNA, 64 nt, hsa; identical to SEQ ID NO: 30228

SEQ ID NO: 401819 - RNA, 64 nt, hsa; identical to SEQ ID NO: 30229

SEQ ID NO: 401820 - RNA, 64 nt, hsa; identical to SEQ ID NO: 30230

SEQ ID NO: 401821 - RNA, 64 nt, hsa; identical to SEQ ID NO: 30231

SEQ ID NO: 401822 - RNA, 64 nt, hsa; identical to SEQ ID NO: 30232

SEQ ID NO: 401823 - RNA, 64 nt, hsa; identical to SEQ ID NO: 30233

SEQ ID NO: 401824 - RNA, 64 nt, hsa; identical to SEQ ID NO: 30234

SEQ ID NO: 401825 - RNA, 64 nt, hsa; identical to SEQ ID NO: 30235

SEQ ID NO: 401826 - RNA, 64 nt, hsa; identical to SEQ ID NO: 30236

SEQ ID NO: 401827 - RNA, 64 nt, hsa; identical to SEQ ID NO: 30237

SEQ ID NO: 401828 - RNA, 64 nt, hsa; identical to SEQ ID NO: 30238

SEQ ID NO: 401829 - RNA, 64 nt, hsa; identical to SEQ ID NO: 30239

SEQ ID NO: 401830 - RNA, 64 nt, hsa; identical to SEQ ID NO: 30240

SEQ ID NO: 401831 - RNA, 64 nt, hsa; identical to SEQ ID NO: 30241

SEQ ID NO: 401832 - RNA, 64 nt, hsa; identical to SEQ ID NO: 30242

SEQ ID NO: 401833 - RNA, 64 nt, hsa; identical to SEQ ID NO: 30243

SEQ ID NO: 401834 - RNA, 64 nt, hsa; identical to SEQ ID NO: 30244

SEQ ID NO: 401835 - RNA, 64 nt, hsa; identical to SEQ ID NO: 30245

SEQ ID NO: 401836 - RNA, 64 nt, hsa; identical to SEQ ID NO: 30246

SEQ ID NO: 401837 - RNA, 64 nt, hsa; identical to SEQ ID NO: 30247

SEQ ID NO: 401838 - RNA, 64 nt, hsa; identical to SEQ ID NO: 30248

SEQ ID NO: 401839 - RNA, 64 nt, hsa; identical to SEQ ID NO: 30249

SEQ ID NO: 401840 - RNA, 64 nt, hsa; identical to SEQ ID NO: 30250

SEQ ID NO: 401841 - RNA, 64 nt, hsa; identical to SEQ ID NO: 30251

SEQ ID NO: 401842 - RNA, 64 nt, hsa; identical to SEQ ID NO: 30252

SEQ ID NO: 401843 - RNA, 64 nt, hsa; identical to SEQ ID NO: 30253

SEQ ID NO: 401844 - RNA, 64 nt, hsa; identical to SEQ ID NO: 30254

SEQ ID NO: 401845 - RNA, 64 nt, hsa; identical to SEQ ID NO: 30255

SEQ ID NO: 401846 - RNA, 63 nt, hsa; identical to SEQ ID NO: 30256

SEQ ID NO: 401847 - RNA, 64 nt, hsa; identical to SEQ ID NO: 30257

SEQ ID NO: 401848 - RNA, 64 nt, hsa; identical to SEQ ID NO: 30258

SEQ ID NO: 401849 - RNA, 64 nt, hsa; identical to SEQ ID NO: 30259

SEQ ID NO: 401850 - RNA, 64 nt, hsa; identical to SEQ ID NO: 30260

SEQ ID NO: 401851 - RNA, 64 nt, hsa; identical to SEQ ID NO: 30261

SEQ ID NO: 401852 - RNA, 64 nt, hsa; identical to SEQ ID NO: 30262

SEQ ID NO: 401853 - RNA, 64 nt, hsa; identical to SEQ ID NO: 30263

SEQ ID NO: 401854 - RNA, 64 nt, hsa; identical to SEQ ID NO: 30264

SEQ ID NO: 401855 - RNA, 64 nt, hsa; identical to SEQ ID NO: 30265

SEQ ID NO: 401856 - RNA, 64 nt, hsa; identical to SEQ ID NO: 30266

SEQ ID NO: 401857 - RNA, 64 nt, hsa; identical to SEQ ID NO: 30267

SEQ ID NO: 401858 - RNA, 64 nt, hsa; identical to SEQ ID NO: 30268

SEQ ID NO: 401859 - RNA, 64 nt, hsa; identical to SEQ ID NO: 30269

SEQ ID NO: 401860 - RNA, 64 nt, hsa; identical to SEQ ID NO: 30270

SEQ ID NO: 401861 - RNA, 64 nt, hsa; identical to SEQ ID NO: 30271

SEQ ID NO: 401862 - RNA, 64 nt, hsa; identical to SEQ ID NO: 30272

SEQ ID NO: 401863 - RNA, 64 nt, hsa; identical to SEQ ID NO: 30273

SEQ ID NO: 401864 - RNA, 64 nt, hsa; identical to SEQ ID NO: 30274

SEQ ID NO: 401865 - RNA, 64 nt, hsa; identical to SEQ ID NO: 30275

SEQ ID NO: 401866 - RNA, 64 nt, hsa; identical to SEQ ID NO: 30276

SEQ ID NO: 401867 - RNA, 64 nt, hsa; identical to SEQ ID NO: 30277

SEQ ID NO: 401868 - RNA, 64 nt, hsa; identical to SEQ ID NO: 30278

SEQ ID NO: 401869 - RNA, 64 nt, hsa; identical to SEQ ID NO: 30279

SEQ ID NO: 401870 - RNA, 64 nt, hsa; identical to SEQ ID NO: 30280

SEQ ID NO: 401871 - RNA, 64 nt, hsa; identical to SEQ ID NO: 30281

SEQ ID NO: 401872 - RNA, 64 nt, hsa; identical to SEQ ID NO: 30282

SEQ ID NO: 401873 - RNA, 64 nt, hsa; identical to SEQ ID NO: 30283

SEQ ID NO: 401874 - RNA, 64 nt, hsa; identical to SEQ ID NO: 30284

SEQ ID NO: 401875 - RNA, 64 nt, hsa; identical to SEQ ID NO: 30285

SEQ ID NO: 401876 - RNA, 64 nt, hsa; identical to SEQ ID NO: 30286

SEQ ID NO: 401877 - RNA, 64 nt, hsa; identical to SEQ ID NO: 30287

SEQ ID NO: 401878 - RNA, 64 nt, hsa; identical to SEQ ID NO: 30288

SEQ ID NO: 401879 - RNA, 64 nt, hsa; identical to SEQ ID NO: 30289

SEQ ID NO: 401880 - RNA, 64 nt, hsa; identical to SEQ ID NO: 30290

SEQ ID NO: 401881 - RNA, 64 nt, hsa; identical to SEQ ID NO: 30291

SEQ ID NO: 401882 - RNA, 64 nt, hsa; identical to SEQ ID NO: 30292

SEQ ID NO: 401883 - RNA, 64 nt, hsa; identical to SEQ ID NO: 30293

SEQ ID NO: 401884 - RNA, 64 nt, hsa; identical to SEQ ID NO: 30294

SEQ ID NO: 401885 - RNA, 64 nt, hsa; identical to SEQ ID NO: 30295

SEQ ID NO: 401886 - RNA, 64 nt, hsa; identical to SEQ ID NO: 30296

SEQ ID NO: 401887 - RNA, 64 nt, hsa; identical to SEQ ID NO: 30297

SEQ ID NO: 401888 - RNA, 64 nt, hsa; identical to SEQ ID NO: 30298

SEQ ID NO: 401889 - RNA, 64 nt, hsa; identical to SEQ ID NO: 30299

SEQ ID NO: 401890 - RNA, 64 nt, hsa; identical to SEQ ID NO: 30300

SEQ ID NO: 401891 - RNA, 64 nt, hsa; identical to SEQ ID NO: 30301

SEQ ID NO: 401892 - RNA, 64 nt, hsa; identical to SEQ ID NO: 30302

SEQ ID NO: 401893 - RNA, 64 nt, hsa; identical to SEQ ID NO: 30303

SEQ ID NO: 401894 - RNA, 64 nt, hsa; identical to SEQ ID NO: 30304

SEQ ID NO: 401895 - RNA, 64 nt, hsa; identical to SEQ ID NO: 30305

SEQ ID NO: 401896 - RNA, 64 nt, hsa; identical to SEQ ID NO: 30306

SEQ ID NO: 401897 - RNA, 64 nt, hsa; identical to SEQ ID NO: 30307

SEQ ID NO: 401898 - RNA, 64 nt, hsa; identical to SEQ ID NO: 30308

SEQ ID NO: 401899 - RNA, 64 nt, hsa; identical to SEQ ID NO: 30309

SEQ ID NO: 401900 - RNA, 64 nt, hsa; identical to SEQ ID NO: 30310

SEQ ID NO: 401901 - RNA, 64 nt, hsa; identical to SEQ ID NO: 30311

SEQ ID NO: 401902 - RNA, 64 nt, hsa; identical to SEQ ID NO: 30312

SEQ ID NO: 401903 - RNA, 64 nt, hsa; identical to SEQ ID NO: 30313

SEQ ID NO: 401904 - RNA, 64 nt, hsa; identical to SEQ ID NO: 30314

SEQ ID NO: 401905 - RNA, 64 nt, hsa; identical to SEQ ID NO: 30315

SEQ ID NO: 401906 - RNA, 64 nt, hsa; identical to SEQ ID NO: 30316

SEQ ID NO: 401907 - RNA, 64 nt, hsa; identical to SEQ ID NO: 30317

SEQ ID NO: 401908 - RNA, 64 nt, hsa; identical to SEQ ID NO: 30318

SEQ ID NO: 401909 - RNA, 64 nt, hsa; identical to SEQ ID NO: 30319

SEQ ID NO: 401910 - RNA, 64 nt, hsa; identical to SEQ ID NO: 30320

SEQ ID NO: 401911 - RNA, 64 nt, hsa; identical to SEQ ID NO: 30321

SEQ ID NO: 401912 - RNA, 64 nt, hsa; identical to SEQ ID NO: 30322

SEQ ID NO: 401913 - RNA, 64 nt, hsa; identical to SEQ ID NO: 30323

SEQ ID NO: 401914 - RNA, 64 nt, hsa; identical to SEQ ID NO: 30324

SEQ ID NO: 401915 - RNA, 64 nt, hsa; identical to SEQ ID NO: 30325

SEQ ID NO: 401916 - RNA, 64 nt, hsa; identical to SEQ ID NO: 30326

SEQ ID NO: 401917 - RNA, 64 nt, hsa; identical to SEQ ID NO: 30327

SEQ ID NO: 401918 - RNA, 64 nt, hsa; identical to SEQ ID NO: 30328

SEQ ID NO: 401919 - RNA, 64 nt, hsa; identical to SEQ ID NO: 30329

SEQ ID NO: 401920 - RNA, 64 nt, hsa; identical to SEQ ID NO: 30330

SEQ ID NO: 401921 - RNA, 64 nt, hsa; identical to SEQ ID NO: 30331

SEQ ID NO: 401922 - RNA, 64 nt, hsa; identical to SEQ ID NO: 30332

SEQ ID NO: 401923 - RNA, 64 nt, hsa; identical to SEQ ID NO: 30333

SEQ ID NO: 401924 - RNA, 64 nt, hsa; identical to SEQ ID NO: 30334

SEQ ID NO: 401925 - RNA, 64 nt, hsa; identical to SEQ ID NO: 30335

SEQ ID NO: 401926 - RNA, 64 nt, hsa; identical to SEQ ID NO: 30336

SEQ ID NO: 401927 - RNA, 64 nt, hsa; identical to SEQ ID NO: 30337

SEQ ID NO: 401928 - RNA, 64 nt, hsa; identical to SEQ ID NO: 30338

SEQ ID NO: 401929 - RNA, 64 nt, hsa; identical to SEQ ID NO: 30339

SEQ ID NO: 401930 - RNA, 64 nt, hsa; identical to SEQ ID NO: 30340

SEQ ID NO: 401931 - RNA, 64 nt, hsa; identical to SEQ ID NO: 30341

SEQ ID NO: 401932 - RNA, 64 nt, hsa; identical to SEQ ID NO: 30342

SEQ ID NO: 401933 - RNA, 64 nt, hsa; identical to SEQ ID NO: 30343

SEQ ID NO: 401934 - RNA, 64 nt, hsa; identical to SEQ ID NO: 30344

SEQ ID NO: 401935 - RNA, 64 nt, hsa; identical to SEQ ID NO: 30345

SEQ ID NO: 401936 - RNA, 64 nt, hsa; identical to SEQ ID NO: 30346

SEQ ID NO: 401937 - RNA, 64 nt, hsa; identical to SEQ ID NO: 30347

SEQ ID NO: 401938 - RNA, 64 nt, hsa; identical to SEQ ID NO: 30348

SEQ ID NO: 401939 - RNA, 64 nt, hsa; identical to SEQ ID NO: 30349

SEQ ID NO: 401940 - RNA, 64 nt, hsa; identical to SEQ ID NO: 30350

SEQ ID NO: 401941 - RNA, 64 nt, hsa; identical to SEQ ID NO: 30351

SEQ ID NO: 401942 - RNA, 64 nt, hsa; identical to SEQ ID NO: 30352

SEQ ID NO: 401943 - RNA, 64 nt, hsa; identical to SEQ ID NO: 30353

SEQ ID NO: 401944 - RNA, 64 nt, hsa; identical to SEQ ID NO: 30354

SEQ ID NO: 401945 - RNA, 64 nt, hsa; identical to SEQ ID NO: 30355

SEQ ID NO: 401946 - RNA, 64 nt, hsa; identical to SEQ ID NO: 30356

SEQ ID NO: 401947 - RNA, 64 nt, hsa; identical to SEQ ID NO: 30357

SEQ ID NO: 401948 - RNA, 64 nt, hsa; identical to SEQ ID NO: 30358

SEQ ID NO: 401949 - RNA, 64 nt, hsa; identical to SEQ ID NO: 30359

SEQ ID NO: 401950 - RNA, 64 nt, hsa; identical to SEQ ID NO: 30360

SEQ ID NO: 401951 - RNA, 64 nt, hsa; identical to SEQ ID NO: 30361

SEQ ID NO: 401952 - RNA, 64 nt, hsa; identical to SEQ ID NO: 30362

SEQ ID NO: 401953 - RNA, 64 nt, hsa; identical to SEQ ID NO: 30363

SEQ ID NO: 401954 - RNA, 64 nt, hsa; identical to SEQ ID NO: 30364

SEQ ID NO: 401955 - RNA, 64 nt, hsa; identical to SEQ ID NO: 30365

SEQ ID NO: 401956 - RNA, 64 nt, hsa; identical to SEQ ID NO: 30366

SEQ ID NO: 401957 - RNA, 64 nt, hsa; identical to SEQ ID NO: 30367

SEQ ID NO: 401958 - RNA, 64 nt, hsa; identical to SEQ ID NO: 30368

SEQ ID NO: 401959 - RNA, 64 nt, hsa; identical to SEQ ID NO: 30369

SEQ ID NO: 401960 - RNA, 64 nt, hsa; identical to SEQ ID NO: 30370

SEQ ID NO: 401961 - RNA, 64 nt, hsa; identical to SEQ ID NO: 30371

SEQ ID NO: 401962 - RNA, 64 nt, hsa; identical to SEQ ID NO: 30372

SEQ ID NO: 401963 - RNA, 64 nt, hsa; identical to SEQ ID NO: 30373

SEQ ID NO: 401964 - RNA, 64 nt, hsa; identical to SEQ ID NO: 30374

SEQ ID NO: 401965 - RNA, 64 nt, hsa; identical to SEQ ID NO: 30375

SEQ ID NO: 401966 - RNA, 64 nt, hsa; identical to SEQ ID NO: 30376

SEQ ID NO: 401967 - RNA, 64 nt, hsa; identical to SEQ ID NO: 30377

SEQ ID NO: 401968 - RNA, 64 nt, hsa; identical to SEQ ID NO: 30378

SEQ ID NO: 401969 - RNA, 64 nt, hsa; identical to SEQ ID NO: 30379

SEQ ID NO: 401970 - RNA, 64 nt, hsa; identical to SEQ ID NO: 30380

SEQ ID NO: 401971 - RNA, 64 nt, hsa; identical to SEQ ID NO: 30381

SEQ ID NO: 401972 - RNA, 64 nt, hsa; identical to SEQ ID NO: 30382

SEQ ID NO: 401973 - RNA, 64 nt, hsa; identical to SEQ ID NO: 30383

SEQ ID NO: 401974 - RNA, 64 nt, hsa; identical to SEQ ID NO: 30384

SEQ ID NO: 401975 - RNA, 64 nt, hsa; identical to SEQ ID NO: 30385

SEQ ID NO: 401976 - RNA, 64 nt, hsa; identical to SEQ ID NO: 30386

SEQ ID NO: 401977 - RNA, 64 nt, hsa; identical to SEQ ID NO: 30387

SEQ ID NO: 401978 - RNA, 64 nt, hsa; identical to SEQ ID NO: 30388

SEQ ID NO: 401979 - RNA, 64 nt, hsa; identical to SEQ ID NO: 30389

SEQ ID NO: 401980 - RNA, 64 nt, hsa; identical to SEQ ID NO: 30390

SEQ ID NO: 401981 - RNA, 64 nt, hsa; identical to SEQ ID NO: 30391

SEQ ID NO: 401982 - RNA, 64 nt, hsa; identical to SEQ ID NO: 30392

SEQ ID NO: 401983 - RNA, 64 nt, hsa; identical to SEQ ID NO: 30393

SEQ ID NO: 401984 - RNA, 64 nt, hsa; identical to SEQ ID NO: 30394

SEQ ID NO: 401985 - RNA, 64 nt, hsa; identical to SEQ ID NO: 30395

SEQ ID NO: 401986 - RNA, 64 nt, hsa; identical to SEQ ID NO: 30396

SEQ ID NO: 401987 - RNA, 64 nt, hsa; identical to SEQ ID NO: 30397

SEQ ID NO: 401988 - RNA, 64 nt, hsa; identical to SEQ ID NO: 30398

SEQ ID NO: 401989 - RNA, 64 nt, hsa; identical to SEQ ID NO: 30399

SEQ ID NO: 401990 - RNA, 64 nt, hsa; identical to SEQ ID NO: 30400

SEQ ID NO: 401991 - RNA, 64 nt, hsa; identical to SEQ ID NO: 30401

SEQ ID NO: 401992 - RNA, 64 nt, hsa; identical to SEQ ID NO: 30402

SEQ ID NO: 401993 - RNA, 64 nt, hsa; identical to SEQ ID NO: 30403

SEQ ID NO: 401994 - RNA, 64 nt, hsa; identical to SEQ ID NO: 30404

SEQ ID NO: 401995 - RNA, 64 nt, hsa; identical to SEQ ID NO: 30405

SEQ ID NO: 401996 - RNA, 64 nt, hsa; identical to SEQ ID NO: 30406

SEQ ID NO: 401997 - RNA, 64 nt, hsa; identical to SEQ ID NO: 30407

SEQ ID NO: 401998 - RNA, 64 nt, hsa; identical to SEQ ID NO: 30408

SEQ ID NO: 401999 - RNA, 64 nt, hsa; identical to SEQ ID NO: 30409

SEQ ID NO: 402000 - RNA, 64 nt, hsa; identical to SEQ ID NO: 30410

SEQ ID NO: 402001 - RNA, 64 nt, hsa; identical to SEQ ID NO: 30411

SEQ ID NO: 402002 - RNA, 64 nt, hsa; identical to SEQ ID NO: 30412

SEQ ID NO: 402003 - RNA, 64 nt, hsa; identical to SEQ ID NO: 30413

SEQ ID NO: 402004 - RNA, 64 nt, hsa; identical to SEQ ID NO: 30414

SEQ ID NO: 402005 - RNA, 64 nt, hsa; identical to SEQ ID NO: 30415

SEQ ID NO: 402006 - RNA, 64 nt, hsa; identical to SEQ ID NO: 30416

SEQ ID NO: 402007 - RNA, 64 nt, hsa; identical to SEQ ID NO: 30417

SEQ ID NO: 402008 - RNA, 64 nt, hsa; identical to SEQ ID NO: 30418

SEQ ID NO: 402009 - RNA, 64 nt, hsa; identical to SEQ ID NO: 30419

SEQ ID NO: 402010 - RNA, 64 nt, hsa; identical to SEQ ID NO: 30420

SEQ ID NO: 402011 - RNA, 64 nt, hsa; identical to SEQ ID NO: 30421

SEQ ID NO: 402012 - RNA, 64 nt, hsa; identical to SEQ ID NO: 30422

SEQ ID NO: 402013 - RNA, 64 nt, hsa; identical to SEQ ID NO: 30423

SEQ ID NO: 402014 - RNA, 64 nt, hsa; identical to SEQ ID NO: 30424

SEQ ID NO: 402015 - RNA, 64 nt, hsa; identical to SEQ ID NO: 30425

SEQ ID NO: 402016 - RNA, 64 nt, hsa; identical to SEQ ID NO: 30426

SEQ ID NO: 402017 - RNA, 64 nt, hsa; identical to SEQ ID NO: 30427

SEQ ID NO: 402018 - RNA, 64 nt, hsa; identical to SEQ ID NO: 30428

SEQ ID NO: 402019 - RNA, 64 nt, hsa; identical to SEQ ID NO: 30429

SEQ ID NO: 402020 - RNA, 64 nt, hsa; identical to SEQ ID NO: 30430

SEQ ID NO: 402021 - RNA, 64 nt, hsa; identical to SEQ ID NO: 30431

SEQ ID NO: 402022 - RNA, 64 nt, hsa; identical to SEQ ID NO: 30432

SEQ ID NO: 402023 - RNA, 64 nt, hsa; identical to SEQ ID NO: 30433

SEQ ID NO: 402024 - RNA, 64 nt, hsa; identical to SEQ ID NO: 30434

SEQ ID NO: 402025 - RNA, 64 nt, hsa; identical to SEQ ID NO: 30435

SEQ ID NO: 402026 - RNA, 64 nt, hsa; identical to SEQ ID NO: 30436

SEQ ID NO: 402027 - RNA, 64 nt, hsa; identical to SEQ ID NO: 30437

SEQ ID NO: 402028 - RNA, 64 nt, hsa; identical to SEQ ID NO: 30438

SEQ ID NO: 402029 - RNA, 64 nt, hsa; identical to SEQ ID NO: 30439

SEQ ID NO: 402030 - RNA, 64 nt, hsa; identical to SEQ ID NO: 30440

SEQ ID NO: 402031 - RNA, 64 nt, hsa; identical to SEQ ID NO: 30441

SEQ ID NO: 402032 - RNA, 64 nt, hsa; identical to SEQ ID NO: 30442

SEQ ID NO: 402033 - RNA, 64 nt, hsa; identical to SEQ ID NO: 30443

SEQ ID NO: 402034 - RNA, 64 nt, hsa; identical to SEQ ID NO: 30444

SEQ ID NO: 402035 - RNA, 64 nt, hsa; identical to SEQ ID NO: 30445

SEQ ID NO: 402036 - RNA, 64 nt, hsa; identical to SEQ ID NO: 30446

SEQ ID NO: 402037 - RNA, 64 nt, hsa; identical to SEQ ID NO: 30447

SEQ ID NO: 402038 - RNA, 64 nt, hsa; identical to SEQ ID NO: 30448

SEQ ID NO: 402039 - RNA, 64 nt, hsa; identical to SEQ ID NO: 30449

SEQ ID NO: 402040 - RNA, 64 nt, hsa; identical to SEQ ID NO: 30450

SEQ ID NO: 402041 - RNA, 64 nt, hsa; identical to SEQ ID NO: 30451

SEQ ID NO: 402042 - RNA, 64 nt, hsa; identical to SEQ ID NO: 30452

SEQ ID NO: 402043 - RNA, 64 nt, hsa; identical to SEQ ID NO: 30453

SEQ ID NO: 402044 - RNA, 64 nt, hsa; identical to SEQ ID NO: 30454

SEQ ID NO: 402045 - RNA, 64 nt, hsa; identical to SEQ ID NO: 30455

SEQ ID NO: 402046 - RNA, 64 nt, hsa; identical to SEQ ID NO: 30456

SEQ ID NO: 402047 - RNA, 64 nt, hsa; identical to SEQ ID NO: 30457

SEQ ID NO: 402048 - RNA, 64 nt, hsa; identical to SEQ ID NO: 30458

SEQ ID NO: 402049 - RNA, 64 nt, hsa; identical to SEQ ID NO: 30459

SEQ ID NO: 402050 - RNA, 64 nt, hsa; identical to SEQ ID NO: 30460

SEQ ID NO: 402051 - RNA, 64 nt, hsa; identical to SEQ ID NO: 30461

SEQ ID NO: 402052 - RNA, 64 nt, hsa; identical to SEQ ID NO: 30462

SEQ ID NO: 402053 - RNA, 64 nt, hsa; identical to SEQ ID NO: 30463

SEQ ID NO: 402054 - RNA, 64 nt, hsa; identical to SEQ ID NO: 30464

SEQ ID NO: 402055 - RNA, 64 nt, hsa; identical to SEQ ID NO: 30465

SEQ ID NO: 402056 - RNA, 64 nt, hsa; identical to SEQ ID NO: 30466

SEQ ID NO: 402057 - RNA, 64 nt, hsa; identical to SEQ ID NO: 30467

SEQ ID NO: 402058 - RNA, 64 nt, hsa; identical to SEQ ID NO: 30468

SEQ ID NO: 402059 - RNA, 64 nt, hsa; identical to SEQ ID NO: 30469

SEQ ID NO: 402060 - RNA, 64 nt, hsa; identical to SEQ ID NO: 30470

SEQ ID NO: 402061 - RNA, 64 nt, hsa; identical to SEQ ID NO: 30471

SEQ ID NO: 402062 - RNA, 64 nt, hsa; identical to SEQ ID NO: 30472

SEQ ID NO: 402063 - RNA, 64 nt, hsa; identical to SEQ ID NO: 30473

SEQ ID NO: 402064 - RNA, 64 nt, hsa; identical to SEQ ID NO: 30474

SEQ ID NO: 402065 - RNA, 64 nt, hsa; identical to SEQ ID NO: 30475

SEQ ID NO: 402066 - RNA, 64 nt, hsa; identical to SEQ ID NO: 30476

SEQ ID NO: 402067 - RNA, 64 nt, hsa; identical to SEQ ID NO: 30477

SEQ ID NO: 402068 - RNA, 64 nt, hsa; identical to SEQ ID NO: 30478

SEQ ID NO: 402069 - RNA, 64 nt, hsa; identical to SEQ ID NO: 30479

SEQ ID NO: 402070 - RNA, 64 nt, hsa; identical to SEQ ID NO: 30480

SEQ ID NO: 402071 - RNA, 64 nt, hsa; identical to SEQ ID NO: 30481

SEQ ID NO: 402072 - RNA, 64 nt, hsa; identical to SEQ ID NO: 30482

SEQ ID NO: 402073 - RNA, 64 nt, hsa; identical to SEQ ID NO: 30483

SEQ ID NO: 402074 - RNA, 64 nt, hsa; identical to SEQ ID NO: 30484

SEQ ID NO: 402075 - RNA, 64 nt, hsa; identical to SEQ ID NO: 30485

SEQ ID NO: 402076 - RNA, 64 nt, hsa; identical to SEQ ID NO: 30486

SEQ ID NO: 402077 - RNA, 64 nt, hsa; identical to SEQ ID NO: 30487

SEQ ID NO: 402078 - RNA, 64 nt, hsa; identical to SEQ ID NO: 30488

SEQ ID NO: 402079 - RNA, 64 nt, hsa; identical to SEQ ID NO: 30489

SEQ ID NO: 402080 - RNA, 64 nt, hsa; identical to SEQ ID NO: 30490

SEQ ID NO: 402081 - RNA, 64 nt, hsa; identical to SEQ ID NO: 30491

SEQ ID NO: 402082 - RNA, 64 nt, hsa; identical to SEQ ID NO: 30492

SEQ ID NO: 402083 - RNA, 64 nt, hsa; identical to SEQ ID NO: 30493

SEQ ID NO: 402084 - RNA, 64 nt, hsa; identical to SEQ ID NO: 30494

SEQ ID NO: 402085 - RNA, 64 nt, hsa; identical to SEQ ID NO: 30495

SEQ ID NO: 402086 - RNA, 64 nt, hsa; identical to SEQ ID NO: 30496

SEQ ID NO: 402087 - RNA, 64 nt, hsa; identical to SEQ ID NO: 30497

SEQ ID NO: 402088 - RNA, 64 nt, hsa; identical to SEQ ID NO: 30498

SEQ ID NO: 402089 - RNA, 64 nt, hsa; identical to SEQ ID NO: 30499

SEQ ID NO: 402090 - RNA, 64 nt, hsa; identical to SEQ ID NO: 30500

SEQ ID NO: 402091 - RNA, 64 nt, hsa; identical to SEQ ID NO: 30501

SEQ ID NO: 402092 - RNA, 64 nt, hsa; identical to SEQ ID NO: 30502

SEQ ID NO: 402093 - RNA, 64 nt, hsa; identical to SEQ ID NO: 30503

SEQ ID NO: 402094 - RNA, 64 nt, hsa; identical to SEQ ID NO: 30504

SEQ ID NO: 402095 - RNA, 64 nt, hsa; identical to SEQ ID NO: 30505

SEQ ID NO: 402096 - RNA, 64 nt, hsa; identical to SEQ ID NO: 30506

SEQ ID NO: 402097 - RNA, 64 nt, hsa; identical to SEQ ID NO: 30507

SEQ ID NO: 402098 - RNA, 64 nt, hsa; identical to SEQ ID NO: 30508

SEQ ID NO: 402099 - RNA, 64 nt, hsa; identical to SEQ ID NO: 30509

SEQ ID NO: 402100 - RNA, 64 nt, hsa; identical to SEQ ID NO: 30510

SEQ ID NO: 402101 - RNA, 64 nt, hsa; identical to SEQ ID NO: 30511

SEQ ID NO: 402102 - RNA, 64 nt, hsa; identical to SEQ ID NO: 30512

SEQ ID NO: 402103 - RNA, 64 nt, hsa; identical to SEQ ID NO: 30513

SEQ ID NO: 402104 - RNA, 64 nt, hsa; identical to SEQ ID NO: 30514

SEQ ID NO: 402105 - RNA, 64 nt, hsa; identical to SEQ ID NO: 30515

SEQ ID NO: 402106 - RNA, 64 nt, hsa; identical to SEQ ID NO: 30516

SEQ ID NO: 402107 - RNA, 64 nt, hsa; identical to SEQ ID NO: 30517

SEQ ID NO: 402108 - RNA, 64 nt, hsa; identical to SEQ ID NO: 30518

SEQ ID NO: 402109 - RNA, 64 nt, hsa; identical to SEQ ID NO: 30519

SEQ ID NO: 402110 - RNA, 64 nt, hsa; identical to SEQ ID NO: 30520

SEQ ID NO: 402111 - RNA, 64 nt, hsa; identical to SEQ ID NO: 30521

SEQ ID NO: 402112 - RNA, 64 nt, hsa; identical to SEQ ID NO: 30522

SEQ ID NO: 402113 - RNA, 64 nt, hsa; identical to SEQ ID NO: 30523

SEQ ID NO: 402114 - RNA, 63 nt, hsa; identical to SEQ ID NO: 30524

SEQ ID NO: 402115 - RNA, 62 nt, hsa; identical to SEQ ID NO: 30525

SEQ ID NO: 402116 - RNA, 64 nt, hsa; identical to SEQ ID NO: 30526

SEQ ID NO: 402117 - RNA, 64 nt, hsa; identical to SEQ ID NO: 30527

SEQ ID NO: 402118 - RNA, 64 nt, hsa; identical to SEQ ID NO: 30528

SEQ ID NO: 402119 - RNA, 64 nt, hsa; identical to SEQ ID NO: 30529

SEQ ID NO: 402120 - RNA, 64 nt, hsa; identical to SEQ ID NO: 30530

SEQ ID NO: 402121 - RNA, 64 nt, hsa; identical to SEQ ID NO: 30531

SEQ ID NO: 402122 - RNA, 64 nt, hsa; identical to SEQ ID NO: 30532

SEQ ID NO: 402123 - RNA, 64 nt, hsa; identical to SEQ ID NO: 30533

SEQ ID NO: 402124 - RNA, 64 nt, hsa; identical to SEQ ID NO: 30534

SEQ ID NO: 402125 - RNA, 64 nt, hsa; identical to SEQ ID NO: 30535

SEQ ID NO: 402126 - RNA, 64 nt, hsa; identical to SEQ ID NO: 30536

SEQ ID NO: 402127 - RNA, 64 nt, hsa; identical to SEQ ID NO: 30537

SEQ ID NO: 402128 - RNA, 64 nt, hsa; identical to SEQ ID NO: 30538

SEQ ID NO: 402129 - RNA, 64 nt, hsa; identical to SEQ ID NO: 30539

SEQ ID NO: 402130 - RNA, 64 nt, hsa; identical to SEQ ID NO: 30540

SEQ ID NO: 402131 - RNA, 64 nt, hsa; identical to SEQ ID NO: 30541

SEQ ID NO: 402132 - RNA, 64 nt, hsa; identical to SEQ ID NO: 30542

SEQ ID NO: 402133 - RNA, 64 nt, hsa; identical to SEQ ID NO: 30543

SEQ ID NO: 402134 - RNA, 64 nt, hsa; identical to SEQ ID NO: 30544

SEQ ID NO: 402135 - RNA, 64 nt, hsa; identical to SEQ ID NO: 30545

SEQ ID NO: 402136 - RNA, 64 nt, hsa; identical to SEQ ID NO: 30546

SEQ ID NO: 402137 - RNA, 64 nt, hsa; identical to SEQ ID NO: 30547

SEQ ID NO: 402138 - RNA, 64 nt, hsa; identical to SEQ ID NO: 30548

SEQ ID NO: 402139 - RNA, 64 nt, hsa; identical to SEQ ID NO: 30549

SEQ ID NO: 402140 - RNA, 64 nt, hsa; identical to SEQ ID NO: 30550

SEQ ID NO: 402141 - RNA, 64 nt, hsa; identical to SEQ ID NO: 30551

SEQ ID NO: 402142 - RNA, 64 nt, hsa; identical to SEQ ID NO: 30552

SEQ ID NO: 402143 - RNA, 64 nt, hsa; identical to SEQ ID NO: 30553

SEQ ID NO: 402144 - RNA, 64 nt, hsa; identical to SEQ ID NO: 30554

SEQ ID NO: 402145 - RNA, 64 nt, hsa; identical to SEQ ID NO: 30555

SEQ ID NO: 402146 - RNA, 64 nt, hsa; identical to SEQ ID NO: 30556

SEQ ID NO: 402147 - RNA, 64 nt, hsa; identical to SEQ ID NO: 30557

SEQ ID NO: 402148 - RNA, 64 nt, hsa; identical to SEQ ID NO: 30558

SEQ ID NO: 402149 - RNA, 64 nt, hsa; identical to SEQ ID NO: 30559

SEQ ID NO: 402150 - RNA, 64 nt, hsa; identical to SEQ ID NO: 30560

SEQ ID NO: 402151 - RNA, 64 nt, hsa; identical to SEQ ID NO: 30561

SEQ ID NO: 402152 - RNA, 64 nt, hsa; identical to SEQ ID NO: 30562

SEQ ID NO: 402153 - RNA, 64 nt, hsa; identical to SEQ ID NO: 30563

SEQ ID NO: 402154 - RNA, 64 nt, hsa; identical to SEQ ID NO: 30564

SEQ ID NO: 402155 - RNA, 64 nt, hsa; identical to SEQ ID NO: 30565

SEQ ID NO: 402156 - RNA, 64 nt, hsa; identical to SEQ ID NO: 30566

SEQ ID NO: 402157 - RNA, 64 nt, hsa; identical to SEQ ID NO: 30567

SEQ ID NO: 402158 - RNA, 64 nt, hsa; identical to SEQ ID NO: 30568

SEQ ID NO: 402159 - RNA, 64 nt, hsa; identical to SEQ ID NO: 30569

SEQ ID NO: 402160 - RNA, 64 nt, hsa; identical to SEQ ID NO: 30570

SEQ ID NO: 402161 - RNA, 64 nt, hsa; identical to SEQ ID NO: 30571

SEQ ID NO: 402162 - RNA, 64 nt, hsa; identical to SEQ ID NO: 30572

SEQ ID NO: 402163 - RNA, 64 nt, hsa; identical to SEQ ID NO: 30573

SEQ ID NO: 402164 - RNA, 64 nt, hsa; identical to SEQ ID NO: 30574

SEQ ID NO: 402165 - RNA, 64 nt, hsa; identical to SEQ ID NO: 30575

SEQ ID NO: 402166 - RNA, 64 nt, hsa; identical to SEQ ID NO: 30576

SEQ ID NO: 402167 - RNA, 64 nt, hsa; identical to SEQ ID NO: 30577

SEQ ID NO: 402168 - RNA, 64 nt, hsa; identical to SEQ ID NO: 30578

SEQ ID NO: 402169 - RNA, 64 nt, hsa; identical to SEQ ID NO: 30579

SEQ ID NO: 402170 - RNA, 64 nt, hsa; identical to SEQ ID NO: 30580

SEQ ID NO: 402171 - RNA, 64 nt, hsa; identical to SEQ ID NO: 30581

SEQ ID NO: 402172 - RNA, 64 nt, hsa; identical to SEQ ID NO: 30582

SEQ ID NO: 402173 - RNA, 64 nt, hsa; identical to SEQ ID NO: 30583

SEQ ID NO: 402174 - RNA, 64 nt, hsa; identical to SEQ ID NO: 30584

SEQ ID NO: 402175 - RNA, 64 nt, hsa; identical to SEQ ID NO: 30585

SEQ ID NO: 402176 - RNA, 64 nt, hsa; identical to SEQ ID NO: 30586

SEQ ID NO: 402177 - RNA, 64 nt, hsa; identical to SEQ ID NO: 30587

SEQ ID NO: 402178 - RNA, 64 nt, hsa; identical to SEQ ID NO: 30588

SEQ ID NO: 402179 - RNA, 64 nt, hsa; identical to SEQ ID NO: 30589

SEQ ID NO: 402180 - RNA, 64 nt, hsa; identical to SEQ ID NO: 30590

SEQ ID NO: 402181 - RNA, 64 nt, hsa; identical to SEQ ID NO: 30591

SEQ ID NO: 402182 - RNA, 64 nt, hsa; identical to SEQ ID NO: 30592

SEQ ID NO: 402183 - RNA, 64 nt, hsa; identical to SEQ ID NO: 30593

SEQ ID NO: 402184 - RNA, 64 nt, hsa; identical to SEQ ID NO: 30594

SEQ ID NO: 402185 - RNA, 64 nt, hsa; identical to SEQ ID NO: 30595

SEQ ID NO: 402186 - RNA, 64 nt, hsa; identical to SEQ ID NO: 30596

SEQ ID NO: 402187 - RNA, 64 nt, hsa; identical to SEQ ID NO: 30597

SEQ ID NO: 402188 - RNA, 64 nt, hsa; identical to SEQ ID NO: 30598

SEQ ID NO: 402189 - RNA, 64 nt, hsa; identical to SEQ ID NO: 30599

SEQ ID NO: 402190 - RNA, 64 nt, hsa; identical to SEQ ID NO: 30600

SEQ ID NO: 402191 - RNA, 64 nt, hsa; identical to SEQ ID NO: 30601

SEQ ID NO: 402192 - RNA, 64 nt, hsa; identical to SEQ ID NO: 30602

SEQ ID NO: 402193 - RNA, 64 nt, hsa; identical to SEQ ID NO: 30603

SEQ ID NO: 402194 - RNA, 64 nt, hsa; identical to SEQ ID NO: 30604

SEQ ID NO: 402195 - RNA, 64 nt, hsa; identical to SEQ ID NO: 30605

SEQ ID NO: 402196 - RNA, 64 nt, hsa; identical to SEQ ID NO: 30606

SEQ ID NO: 402197 - RNA, 64 nt, hsa; identical to SEQ ID NO: 30607

SEQ ID NO: 402198 - RNA, 64 nt, hsa; identical to SEQ ID NO: 30608

SEQ ID NO: 402199 - RNA, 64 nt, hsa; identical to SEQ ID NO: 30609

SEQ ID NO: 402200 - RNA, 64 nt, hsa; identical to SEQ ID NO: 30610

SEQ ID NO: 402201 - RNA, 64 nt, hsa; identical to SEQ ID NO: 30611

SEQ ID NO: 402202 - RNA, 64 nt, hsa; identical to SEQ ID NO: 30612

SEQ ID NO: 402203 - RNA, 64 nt, hsa; identical to SEQ ID NO: 30613

SEQ ID NO: 402204 - RNA, 64 nt, hsa; identical to SEQ ID NO: 30614

SEQ ID NO: 402205 - RNA, 64 nt, hsa; identical to SEQ ID NO: 30615

SEQ ID NO: 402206 - RNA, 64 nt, hsa; identical to SEQ ID NO: 30616

SEQ ID NO: 402207 - RNA, 64 nt, hsa; identical to SEQ ID NO: 30617

SEQ ID NO: 402208 - RNA, 64 nt, hsa; identical to SEQ ID NO: 30618

SEQ ID NO: 402209 - RNA, 64 nt, hsa; identical to SEQ ID NO: 30619

SEQ ID NO: 402210 - RNA, 64 nt, hsa; identical to SEQ ID NO: 30620

SEQ ID NO: 402211 - RNA, 64 nt, hsa; identical to SEQ ID NO: 30621

SEQ ID NO: 402212 - RNA, 64 nt, hsa; identical to SEQ ID NO: 30622

SEQ ID NO: 402213 - RNA, 64 nt, hsa; identical to SEQ ID NO: 30623

SEQ ID NO: 402214 - RNA, 64 nt, hsa; identical to SEQ ID NO: 30624

SEQ ID NO: 402215 - RNA, 64 nt, hsa; identical to SEQ ID NO: 30625

SEQ ID NO: 402216 - RNA, 64 nt, hsa; identical to SEQ ID NO: 30626

SEQ ID NO: 402217 - RNA, 64 nt, hsa; identical to SEQ ID NO: 30627

SEQ ID NO: 402218 - RNA, 64 nt, hsa; identical to SEQ ID NO: 30628

SEQ ID NO: 402219 - RNA, 64 nt, hsa; identical to SEQ ID NO: 30629

SEQ ID NO: 402220 - RNA, 64 nt, hsa; identical to SEQ ID NO: 30630

SEQ ID NO: 402221 - RNA, 64 nt, hsa; identical to SEQ ID NO: 30631

SEQ ID NO: 402222 - RNA, 64 nt, hsa; identical to SEQ ID NO: 30632

SEQ ID NO: 402223 - RNA, 64 nt, hsa; identical to SEQ ID NO: 30633

SEQ ID NO: 402224 - RNA, 64 nt, hsa; identical to SEQ ID NO: 30634

SEQ ID NO: 402225 - RNA, 64 nt, hsa; identical to SEQ ID NO: 30635

SEQ ID NO: 402226 - RNA, 64 nt, hsa; identical to SEQ ID NO: 30636

SEQ ID NO: 402227 - RNA, 64 nt, hsa; identical to SEQ ID NO: 30637

SEQ ID NO: 402228 - RNA, 64 nt, hsa; identical to SEQ ID NO: 30638

SEQ ID NO: 402229 - RNA, 64 nt, hsa; identical to SEQ ID NO: 30639

SEQ ID NO: 402230 - RNA, 64 nt, hsa; identical to SEQ ID NO: 30640

SEQ ID NO: 402231 - RNA, 64 nt, hsa; identical to SEQ ID NO: 30641

SEQ ID NO: 402232 - RNA, 64 nt, hsa; identical to SEQ ID NO: 30642

SEQ ID NO: 402233 - RNA, 64 nt, hsa; identical to SEQ ID NO: 30643

SEQ ID NO: 402234 - RNA, 64 nt, hsa; identical to SEQ ID NO: 30644

SEQ ID NO: 402235 - RNA, 64 nt, hsa; identical to SEQ ID NO: 30645

SEQ ID NO: 402236 - RNA, 64 nt, hsa; identical to SEQ ID NO: 30646

SEQ ID NO: 402237 - RNA, 64 nt, hsa; identical to SEQ ID NO: 30647

SEQ ID NO: 402238 - RNA, 64 nt, hsa; identical to SEQ ID NO: 30648

SEQ ID NO: 402239 - RNA, 64 nt, hsa; identical to SEQ ID NO: 30649

SEQ ID NO: 402240 - RNA, 64 nt, hsa; identical to SEQ ID NO: 30650

SEQ ID NO: 402241 - RNA, 64 nt, hsa; identical to SEQ ID NO: 30651

SEQ ID NO: 402242 - RNA, 64 nt, hsa; identical to SEQ ID NO: 30652

SEQ ID NO: 402243 - RNA, 64 nt, hsa; identical to SEQ ID NO: 30653

SEQ ID NO: 402244 - RNA, 64 nt, hsa; identical to SEQ ID NO: 30654

SEQ ID NO: 402245 - RNA, 64 nt, hsa; identical to SEQ ID NO: 30655

SEQ ID NO: 402246 - RNA, 64 nt, hsa; identical to SEQ ID NO: 30656

SEQ ID NO: 402247 - RNA, 64 nt, hsa; identical to SEQ ID NO: 30657

SEQ ID NO: 402248 - RNA, 64 nt, hsa; identical to SEQ ID NO: 30658

SEQ ID NO: 402249 - RNA, 64 nt, hsa; identical to SEQ ID NO: 30659

SEQ ID NO: 402250 - RNA, 64 nt, hsa; identical to SEQ ID NO: 30660

SEQ ID NO: 402251 - RNA, 62 nt, hsa; identical to SEQ ID NO: 30661

SEQ ID NO: 402252 - RNA, 63 nt, hsa; identical to SEQ ID NO: 30662

SEQ ID NO: 402253 - RNA, 64 nt, hsa; identical to SEQ ID NO: 30663

SEQ ID NO: 402254 - RNA, 64 nt, hsa; identical to SEQ ID NO: 30664

SEQ ID NO: 402255 - RNA, 64 nt, hsa; identical to SEQ ID NO: 30665

SEQ ID NO: 402256 - RNA, 64 nt, hsa; identical to SEQ ID NO: 30666

SEQ ID NO: 402257 - RNA, 64 nt, hsa; identical to SEQ ID NO: 30667

SEQ ID NO: 402258 - RNA, 64 nt, hsa; identical to SEQ ID NO: 30668

SEQ ID NO: 402259 - RNA, 64 nt, hsa; identical to SEQ ID NO: 30669

SEQ ID NO: 402260 - RNA, 64 nt, hsa; identical to SEQ ID NO: 30670

SEQ ID NO: 402261 - RNA, 64 nt, hsa; identical to SEQ ID NO: 30671

SEQ ID NO: 402262 - RNA, 64 nt, hsa; identical to SEQ ID NO: 30672

SEQ ID NO: 402263 - RNA, 64 nt, hsa; identical to SEQ ID NO: 30673

SEQ ID NO: 402264 - RNA, 64 nt, hsa; identical to SEQ ID NO: 30674

SEQ ID NO: 402265 - RNA, 64 nt, hsa; identical to SEQ ID NO: 30675

SEQ ID NO: 402266 - RNA, 64 nt, hsa; identical to SEQ ID NO: 30676

SEQ ID NO: 402267 - RNA, 64 nt, hsa; identical to SEQ ID NO: 30677

SEQ ID NO: 402268 - RNA, 64 nt, hsa; identical to SEQ ID NO: 30678

SEQ ID NO: 402269 - RNA, 64 nt, hsa; identical to SEQ ID NO: 30679

SEQ ID NO: 402270 - RNA, 64 nt, hsa; identical to SEQ ID NO: 30680

SEQ ID NO: 402271 - RNA, 64 nt, hsa; identical to SEQ ID NO: 30681

SEQ ID NO: 402272 - RNA, 64 nt, hsa; identical to SEQ ID NO: 30682

SEQ ID NO: 402273 - RNA, 64 nt, hsa; identical to SEQ ID NO: 30683

SEQ ID NO: 402274 - RNA, 64 nt, hsa; identical to SEQ ID NO: 30684

SEQ ID NO: 402275 - RNA, 64 nt, hsa; identical to SEQ ID NO: 30685

SEQ ID NO: 402276 - RNA, 64 nt, hsa; identical to SEQ ID NO: 30686

SEQ ID NO: 402277 - RNA, 64 nt, hsa; identical to SEQ ID NO: 30687

SEQ ID NO: 402278 - RNA, 64 nt, hsa; identical to SEQ ID NO: 30688

SEQ ID NO: 402279 - RNA, 64 nt, hsa; identical to SEQ ID NO: 30689

SEQ ID NO: 402280 - RNA, 64 nt, hsa; identical to SEQ ID NO: 30690

SEQ ID NO: 402281 - RNA, 64 nt, hsa; identical to SEQ ID NO: 30691

SEQ ID NO: 402282 - RNA, 64 nt, hsa; identical to SEQ ID NO: 30692

SEQ ID NO: 402283 - RNA, 64 nt, hsa; identical to SEQ ID NO: 30693

SEQ ID NO: 402284 - RNA, 64 nt, hsa; identical to SEQ ID NO: 30694

SEQ ID NO: 402285 - RNA, 64 nt, hsa; identical to SEQ ID NO: 30695

SEQ ID NO: 402286 - RNA, 64 nt, hsa; identical to SEQ ID NO: 30696

SEQ ID NO: 402287 - RNA, 64 nt, hsa; identical to SEQ ID NO: 30697

SEQ ID NO: 402288 - RNA, 64 nt, hsa; identical to SEQ ID NO: 30698

SEQ ID NO: 402289 - RNA, 64 nt, hsa; identical to SEQ ID NO: 30699

SEQ ID NO: 402290 - RNA, 64 nt, hsa; identical to SEQ ID NO: 30700

SEQ ID NO: 402291 - RNA, 64 nt, hsa; identical to SEQ ID NO: 30701

SEQ ID NO: 402292 - RNA, 64 nt, hsa; identical to SEQ ID NO: 30702

SEQ ID NO: 402293 - RNA, 64 nt, hsa; identical to SEQ ID NO: 30703

SEQ ID NO: 402294 - RNA, 64 nt, hsa; identical to SEQ ID NO: 30704

SEQ ID NO: 402295 - RNA, 64 nt, hsa; identical to SEQ ID NO: 30705

SEQ ID NO: 402296 - RNA, 64 nt, hsa; identical to SEQ ID NO: 30706

SEQ ID NO: 402297 - RNA, 64 nt, hsa; identical to SEQ ID NO: 30707

SEQ ID NO: 402298 - RNA, 64 nt, hsa; identical to SEQ ID NO: 30708

SEQ ID NO: 402299 - RNA, 64 nt, hsa; identical to SEQ ID NO: 30709

SEQ ID NO: 402300 - RNA, 64 nt, hsa; identical to SEQ ID NO: 30710

SEQ ID NO: 402301 - RNA, 64 nt, hsa; identical to SEQ ID NO: 30711

SEQ ID NO: 402302 - RNA, 64 nt, hsa; identical to SEQ ID NO: 30712

SEQ ID NO: 402303 - RNA, 64 nt, hsa; identical to SEQ ID NO: 30713

SEQ ID NO: 402304 - RNA, 64 nt, hsa; identical to SEQ ID NO: 30714

SEQ ID NO: 402305 - RNA, 64 nt, hsa; identical to SEQ ID NO: 30715

SEQ ID NO: 402306 - RNA, 64 nt, hsa; identical to SEQ ID NO: 30716

SEQ ID NO: 402307 - RNA, 64 nt, hsa; identical to SEQ ID NO: 30717

SEQ ID NO: 402308 - RNA, 64 nt, hsa; identical to SEQ ID NO: 30718

SEQ ID NO: 402309 - RNA, 64 nt, hsa; identical to SEQ ID NO: 30719

SEQ ID NO: 402310 - RNA, 64 nt, hsa; identical to SEQ ID NO: 30720

SEQ ID NO: 402311 - RNA, 64 nt, hsa; identical to SEQ ID NO: 30721

SEQ ID NO: 402312 - RNA, 58 nt, hsa; identical to SEQ ID NO: 30722

SEQ ID NO: 402313 - RNA, 64 nt, hsa; identical to SEQ ID NO: 30723

SEQ ID NO: 402314 - RNA, 64 nt, hsa; identical to SEQ ID NO: 30724

SEQ ID NO: 402315 - RNA, 64 nt, hsa; identical to SEQ ID NO: 30725

SEQ ID NO: 402316 - RNA, 64 nt, hsa; identical to SEQ ID NO: 30726

SEQ ID NO: 402317 - RNA, 64 nt, hsa; identical to SEQ ID NO: 30727

SEQ ID NO: 402318 - RNA, 64 nt, hsa; identical to SEQ ID NO: 30728

SEQ ID NO: 402319 - RNA, 64 nt, hsa; identical to SEQ ID NO: 30729

SEQ ID NO: 402320 - RNA, 64 nt, hsa; identical to SEQ ID NO: 30730

SEQ ID NO: 402321 - RNA, 64 nt, hsa; identical to SEQ ID NO: 30731

SEQ ID NO: 402322 - RNA, 64 nt, hsa; identical to SEQ ID NO: 30732

SEQ ID NO: 402323 - RNA, 64 nt, hsa; identical to SEQ ID NO: 30733

SEQ ID NO: 402324 - RNA, 64 nt, hsa; identical to SEQ ID NO: 30734

SEQ ID NO: 402325 - RNA, 64 nt, hsa; identical to SEQ ID NO: 30735

SEQ ID NO: 402326 - RNA, 64 nt, hsa; identical to SEQ ID NO: 30736

SEQ ID NO: 402327 - RNA, 64 nt, hsa; identical to SEQ ID NO: 30737

SEQ ID NO: 402328 - RNA, 64 nt, hsa; identical to SEQ ID NO: 30738

SEQ ID NO: 402329 - RNA, 64 nt, hsa; identical to SEQ ID NO: 30739

SEQ ID NO: 402330 - RNA, 64 nt, hsa; identical to SEQ ID NO: 30740

SEQ ID NO: 402331 - RNA, 64 nt, hsa; identical to SEQ ID NO: 30741

SEQ ID NO: 402332 - RNA, 64 nt, hsa; identical to SEQ ID NO: 30742

SEQ ID NO: 402333 - RNA, 64 nt, hsa; identical to SEQ ID NO: 30743

SEQ ID NO: 402334 - RNA, 64 nt, hsa; identical to SEQ ID NO: 30744

SEQ ID NO: 402335 - RNA, 64 nt, hsa; identical to SEQ ID NO: 30745

SEQ ID NO: 402336 - RNA, 64 nt, hsa; identical to SEQ ID NO: 30746

SEQ ID NO: 402337 - RNA, 64 nt, hsa; identical to SEQ ID NO: 30747

SEQ ID NO: 402338 - RNA, 64 nt, hsa; identical to SEQ ID NO: 30748

SEQ ID NO: 402339 - RNA, 64 nt, hsa; identical to SEQ ID NO: 30749

SEQ ID NO: 402340 - RNA, 64 nt, hsa; identical to SEQ ID NO: 30750

SEQ ID NO: 402341 - RNA, 64 nt, hsa; identical to SEQ ID NO: 30751

SEQ ID NO: 402342 - RNA, 64 nt, hsa; identical to SEQ ID NO: 30752

SEQ ID NO: 402343 - RNA, 64 nt, hsa; identical to SEQ ID NO: 30753

SEQ ID NO: 402344 - RNA, 64 nt, hsa; identical to SEQ ID NO: 30754

SEQ ID NO: 402345 - RNA, 64 nt, hsa; identical to SEQ ID NO: 30755

SEQ ID NO: 402346 - RNA, 64 nt, hsa; identical to SEQ ID NO: 30756

SEQ ID NO: 402347 - RNA, 64 nt, hsa; identical to SEQ ID NO: 30757

SEQ ID NO: 402348 - RNA, 64 nt, hsa; identical to SEQ ID NO: 30758

SEQ ID NO: 402349 - RNA, 64 nt, hsa; identical to SEQ ID NO: 30759

SEQ ID NO: 402350 - RNA, 64 nt, hsa; identical to SEQ ID NO: 30760

SEQ ID NO: 402351 - RNA, 64 nt, hsa; identical to SEQ ID NO: 30761

SEQ ID NO: 402352 - RNA, 64 nt, hsa; identical to SEQ ID NO: 30762

SEQ ID NO: 402353 - RNA, 64 nt, hsa; identical to SEQ ID NO: 30763

SEQ ID NO: 402354 - RNA, 64 nt, hsa; identical to SEQ ID NO: 30764

SEQ ID NO: 402355 - RNA, 64 nt, hsa; identical to SEQ ID NO: 30765

SEQ ID NO: 402356 - RNA, 64 nt, hsa; identical to SEQ ID NO: 30766

SEQ ID NO: 402357 - RNA, 64 nt, hsa; identical to SEQ ID NO: 30767

SEQ ID NO: 402358 - RNA, 64 nt, hsa; identical to SEQ ID NO: 30768

SEQ ID NO: 402359 - RNA, 64 nt, hsa; identical to SEQ ID NO: 30769

SEQ ID NO: 402360 - RNA, 64 nt, hsa; identical to SEQ ID NO: 30770

SEQ ID NO: 402361 - RNA, 64 nt, hsa; identical to SEQ ID NO: 30771

SEQ ID NO: 402362 - RNA, 64 nt, hsa; identical to SEQ ID NO: 30772

SEQ ID NO: 402363 - RNA, 64 nt, hsa; identical to SEQ ID NO: 30773

SEQ ID NO: 402364 - RNA, 64 nt, hsa; identical to SEQ ID NO: 30774

SEQ ID NO: 402365 - RNA, 64 nt, hsa; identical to SEQ ID NO: 30775

SEQ ID NO: 402366 - RNA, 64 nt, hsa; identical to SEQ ID NO: 30776

SEQ ID NO: 402367 - RNA, 64 nt, hsa; identical to SEQ ID NO: 30777

SEQ ID NO: 402368 - RNA, 64 nt, hsa; identical to SEQ ID NO: 30778

SEQ ID NO: 402369 - RNA, 64 nt, hsa; identical to SEQ ID NO: 30779

SEQ ID NO: 402370 - RNA, 64 nt, hsa; identical to SEQ ID NO: 30780

SEQ ID NO: 402371 - RNA, 64 nt, hsa; identical to SEQ ID NO: 30781

SEQ ID NO: 402372 - RNA, 64 nt, hsa; identical to SEQ ID NO: 30782

SEQ ID NO: 402373 - RNA, 64 nt, hsa; identical to SEQ ID NO: 30783

SEQ ID NO: 402374 - RNA, 64 nt, hsa; identical to SEQ ID NO: 30784

SEQ ID NO: 402375 - RNA, 64 nt, hsa; identical to SEQ ID NO: 30785

SEQ ID NO: 402376 - RNA, 64 nt, hsa; identical to SEQ ID NO: 30786

SEQ ID NO: 402377 - RNA, 64 nt, hsa; identical to SEQ ID NO: 30787

SEQ ID NO: 402378 - RNA, 64 nt, hsa; identical to SEQ ID NO: 30788

SEQ ID NO: 402379 - RNA, 64 nt, hsa; identical to SEQ ID NO: 30789

SEQ ID NO: 402380 - RNA, 64 nt, hsa; identical to SEQ ID NO: 30790

SEQ ID NO: 402381 - RNA, 64 nt, hsa; identical to SEQ ID NO: 30791

SEQ ID NO: 402382 - RNA, 64 nt, hsa; identical to SEQ ID NO: 30792

SEQ ID NO: 402383 - RNA, 64 nt, hsa; identical to SEQ ID NO: 30793

SEQ ID NO: 402384 - RNA, 64 nt, hsa; identical to SEQ ID NO: 30794

SEQ ID NO: 402385 - RNA, 64 nt, hsa; identical to SEQ ID NO: 30795

SEQ ID NO: 402386 - RNA, 64 nt, hsa; identical to SEQ ID NO: 30796

SEQ ID NO: 402387 - RNA, 64 nt, hsa; identical to SEQ ID NO: 30797

SEQ ID NO: 402388 - RNA, 64 nt, hsa; identical to SEQ ID NO: 30798

SEQ ID NO: 402389 - RNA, 64 nt, hsa; identical to SEQ ID NO: 30799

SEQ ID NO: 402390 - RNA, 64 nt, hsa; identical to SEQ ID NO: 30800

SEQ ID NO: 402391 - RNA, 64 nt, hsa; identical to SEQ ID NO: 30801

SEQ ID NO: 402392 - RNA, 64 nt, hsa; identical to SEQ ID NO: 30802

SEQ ID NO: 402393 - RNA, 64 nt, hsa; identical to SEQ ID NO: 30803

SEQ ID NO: 402394 - RNA, 64 nt, hsa; identical to SEQ ID NO: 30804

SEQ ID NO: 402395 - RNA, 64 nt, hsa; identical to SEQ ID NO: 30805

SEQ ID NO: 402396 - RNA, 64 nt, hsa; identical to SEQ ID NO: 30806

SEQ ID NO: 402397 - RNA, 64 nt, hsa; identical to SEQ ID NO: 30807

SEQ ID NO: 402398 - RNA, 64 nt, hsa; identical to SEQ ID NO: 30808

SEQ ID NO: 402399 - RNA, 64 nt, hsa; identical to SEQ ID NO: 30809

SEQ ID NO: 402400 - RNA, 64 nt, hsa; identical to SEQ ID NO: 30810

SEQ ID NO: 402401 - RNA, 64 nt, hsa; identical to SEQ ID NO: 30811

SEQ ID NO: 402402 - RNA, 64 nt, hsa; identical to SEQ ID NO: 30812

SEQ ID NO: 402403 - RNA, 64 nt, hsa; identical to SEQ ID NO: 30813

SEQ ID NO: 402404 - RNA, 64 nt, hsa; identical to SEQ ID NO: 30814

SEQ ID NO: 402405 - RNA, 64 nt, hsa; identical to SEQ ID NO: 30815

SEQ ID NO: 402406 - RNA, 64 nt, hsa; identical to SEQ ID NO: 30816

SEQ ID NO: 402407 - RNA, 64 nt, hsa; identical to SEQ ID NO: 30817

SEQ ID NO: 402408 - RNA, 64 nt, hsa; identical to SEQ ID NO: 30818

SEQ ID NO: 402409 - RNA, 64 nt, hsa; identical to SEQ ID NO: 30819

SEQ ID NO: 402410 - RNA, 64 nt, hsa; identical to SEQ ID NO: 30820

SEQ ID NO: 402411 - RNA, 64 nt, hsa; identical to SEQ ID NO: 30821

SEQ ID NO: 402412 - RNA, 64 nt, hsa; identical to SEQ ID NO: 30822

SEQ ID NO: 402413 - RNA, 64 nt, hsa; identical to SEQ ID NO: 30823

SEQ ID NO: 402414 - RNA, 64 nt, hsa; identical to SEQ ID NO: 30824

SEQ ID NO: 402415 - RNA, 64 nt, hsa; identical to SEQ ID NO: 30825

SEQ ID NO: 402416 - RNA, 64 nt, hsa; identical to SEQ ID NO: 30826

SEQ ID NO: 402417 - RNA, 64 nt, hsa; identical to SEQ ID NO: 30827

SEQ ID NO: 402418 - RNA, 64 nt, hsa; identical to SEQ ID NO: 30828

SEQ ID NO: 402419 - RNA, 64 nt, hsa; identical to SEQ ID NO: 30829

SEQ ID NO: 402420 - RNA, 64 nt, hsa; identical to SEQ ID NO: 30830

SEQ ID NO: 402421 - RNA, 64 nt, hsa; identical to SEQ ID NO: 30831

SEQ ID NO: 402422 - RNA, 64 nt, hsa; identical to SEQ ID NO: 30832

SEQ ID NO: 402423 - RNA, 64 nt, hsa; identical to SEQ ID NO: 30833

SEQ ID NO: 402424 - RNA, 64 nt, hsa; identical to SEQ ID NO: 30834

SEQ ID NO: 402425 - RNA, 64 nt, hsa; identical to SEQ ID NO: 30835

SEQ ID NO: 402426 - RNA, 64 nt, hsa; identical to SEQ ID NO: 30836

SEQ ID NO: 402427 - RNA, 64 nt, hsa; identical to SEQ ID NO: 30837

SEQ ID NO: 402428 - RNA, 64 nt, hsa; identical to SEQ ID NO: 30838

SEQ ID NO: 402429 - RNA, 64 nt, hsa; identical to SEQ ID NO: 30839

SEQ ID NO: 402430 - RNA, 64 nt, hsa; identical to SEQ ID NO: 30840

SEQ ID NO: 402431 - RNA, 64 nt, hsa; identical to SEQ ID NO: 30841

SEQ ID NO: 402432 - RNA, 64 nt, hsa; identical to SEQ ID NO: 30842

SEQ ID NO: 402433 - RNA, 64 nt, hsa; identical to SEQ ID NO: 30843

SEQ ID NO: 402434 - RNA, 64 nt, hsa; identical to SEQ ID NO: 30844

SEQ ID NO: 402435 - RNA, 64 nt, hsa; identical to SEQ ID NO: 30845

SEQ ID NO: 402436 - RNA, 64 nt, hsa; identical to SEQ ID NO: 30846

SEQ ID NO: 402437 - RNA, 64 nt, hsa; identical to SEQ ID NO: 30847

SEQ ID NO: 402438 - RNA, 64 nt, hsa; identical to SEQ ID NO: 30848

SEQ ID NO: 402439 - RNA, 64 nt, hsa; identical to SEQ ID NO: 30849

SEQ ID NO: 402440 - RNA, 64 nt, hsa; identical to SEQ ID NO: 30850

SEQ ID NO: 402441 - RNA, 64 nt, hsa; identical to SEQ ID NO: 30851

SEQ ID NO: 402442 - RNA, 64 nt, hsa; identical to SEQ ID NO: 30852

SEQ ID NO: 402443 - RNA, 64 nt, hsa; identical to SEQ ID NO: 30853

SEQ ID NO: 402444 - RNA, 64 nt, hsa; identical to SEQ ID NO: 30854

SEQ ID NO: 402445 - RNA, 64 nt, hsa; identical to SEQ ID NO: 30855

SEQ ID NO: 402446 - RNA, 64 nt, hsa; identical to SEQ ID NO: 30856

SEQ ID NO: 402447 - RNA, 64 nt, hsa; identical to SEQ ID NO: 30857

SEQ ID NO: 402448 - RNA, 64 nt, hsa; identical to SEQ ID NO: 30858

SEQ ID NO: 402449 - RNA, 64 nt, hsa; identical to SEQ ID NO: 30859

SEQ ID NO: 402450 - RNA, 64 nt, hsa; identical to SEQ ID NO: 30860

SEQ ID NO: 402451 - RNA, 64 nt, hsa; identical to SEQ ID NO: 30861

SEQ ID NO: 402452 - RNA, 64 nt, hsa; identical to SEQ ID NO: 30862

SEQ ID NO: 402453 - RNA, 64 nt, hsa; identical to SEQ ID NO: 30863

SEQ ID NO: 402454 - RNA, 64 nt, hsa; identical to SEQ ID NO: 30864

SEQ ID NO: 402455 - RNA, 64 nt, hsa; identical to SEQ ID NO: 30865

SEQ ID NO: 402456 - RNA, 64 nt, hsa; identical to SEQ ID NO: 30866

SEQ ID NO: 402457 - RNA, 64 nt, hsa; identical to SEQ ID NO: 30867

SEQ ID NO: 402458 - RNA, 64 nt, hsa; identical to SEQ ID NO: 30868

SEQ ID NO: 402459 - RNA, 64 nt, hsa; identical to SEQ ID NO: 30869

SEQ ID NO: 402460 - RNA, 64 nt, hsa; identical to SEQ ID NO: 30870

SEQ ID NO: 402461 - RNA, 64 nt, hsa; identical to SEQ ID NO: 30871

SEQ ID NO: 402462 - RNA, 64 nt, hsa; identical to SEQ ID NO: 30872

SEQ ID NO: 402463 - RNA, 64 nt, hsa; identical to SEQ ID NO: 30873

SEQ ID NO: 402464 - RNA, 64 nt, hsa; identical to SEQ ID NO: 30874

SEQ ID NO: 402465 - RNA, 64 nt, hsa; identical to SEQ ID NO: 30875

SEQ ID NO: 402466 - RNA, 64 nt, hsa; identical to SEQ ID NO: 30876

SEQ ID NO: 402467 - RNA, 64 nt, hsa; identical to SEQ ID NO: 30877

SEQ ID NO: 402468 - RNA, 64 nt, hsa; identical to SEQ ID NO: 30878

SEQ ID NO: 402469 - RNA, 64 nt, hsa; identical to SEQ ID NO: 30879

SEQ ID NO: 402470 - RNA, 64 nt, hsa; identical to SEQ ID NO: 30880

SEQ ID NO: 402471 - RNA, 64 nt, hsa; identical to SEQ ID NO: 30881

SEQ ID NO: 402472 - RNA, 64 nt, hsa; identical to SEQ ID NO: 30882

SEQ ID NO: 402473 - RNA, 64 nt, hsa; identical to SEQ ID NO: 30883

SEQ ID NO: 402474 - RNA, 64 nt, hsa; identical to SEQ ID NO: 30884

SEQ ID NO: 402475 - RNA, 64 nt, hsa; identical to SEQ ID NO: 30885

SEQ ID NO: 402476 - RNA, 64 nt, hsa; identical to SEQ ID NO: 30886

SEQ ID NO: 402477 - RNA, 64 nt, hsa; identical to SEQ ID NO: 30887

SEQ ID NO: 402478 - RNA, 64 nt, hsa; identical to SEQ ID NO: 30888

SEQ ID NO: 402479 - RNA, 64 nt, hsa; identical to SEQ ID NO: 30889

SEQ ID NO: 402480 - RNA, 64 nt, hsa; identical to SEQ ID NO: 30890

SEQ ID NO: 402481 - RNA, 64 nt, hsa; identical to SEQ ID NO: 30891

SEQ ID NO: 402482 - RNA, 64 nt, hsa; identical to SEQ ID NO: 30892

SEQ ID NO: 402483 - RNA, 64 nt, hsa; identical to SEQ ID NO: 30893

SEQ ID NO: 402484 - RNA, 64 nt, hsa; identical to SEQ ID NO: 30894

SEQ ID NO: 402485 - RNA, 64 nt, hsa; identical to SEQ ID NO: 30895

SEQ ID NO: 402486 - RNA, 64 nt, hsa; identical to SEQ ID NO: 30896

SEQ ID NO: 402487 - RNA, 64 nt, hsa; identical to SEQ ID NO: 30897

SEQ ID NO: 402488 - RNA, 64 nt, hsa; identical to SEQ ID NO: 30898

SEQ ID NO: 402489 - RNA, 64 nt, hsa; identical to SEQ ID NO: 30899

SEQ ID NO: 402490 - RNA, 64 nt, hsa; identical to SEQ ID NO: 30900

SEQ ID NO: 402491 - RNA, 64 nt, hsa; identical to SEQ ID NO: 30901

SEQ ID NO: 402492 - RNA, 64 nt, hsa; identical to SEQ ID NO: 30902

SEQ ID NO: 402493 - RNA, 64 nt, hsa; identical to SEQ ID NO: 30903

SEQ ID NO: 402494 - RNA, 64 nt, hsa; identical to SEQ ID NO: 30904

SEQ ID NO: 402495 - RNA, 64 nt, hsa; identical to SEQ ID NO: 30905

SEQ ID NO: 402496 - RNA, 64 nt, hsa; identical to SEQ ID NO: 30906

SEQ ID NO: 402497 - RNA, 64 nt, hsa; identical to SEQ ID NO: 30907

SEQ ID NO: 402498 - RNA, 64 nt, hsa; identical to SEQ ID NO: 30908

SEQ ID NO: 402499 - RNA, 64 nt, hsa; identical to SEQ ID NO: 30909

SEQ ID NO: 402500 - RNA, 64 nt, hsa; identical to SEQ ID NO: 30910

SEQ ID NO: 402501 - RNA, 64 nt, hsa; identical to SEQ ID NO: 30911

SEQ ID NO: 402502 - RNA, 64 nt, hsa; identical to SEQ ID NO: 30912

SEQ ID NO: 402503 - RNA, 64 nt, hsa; identical to SEQ ID NO: 30913

SEQ ID NO: 402504 - RNA, 64 nt, hsa; identical to SEQ ID NO: 30914

SEQ ID NO: 402505 - RNA, 64 nt, hsa; identical to SEQ ID NO: 30915

SEQ ID NO: 402506 - RNA, 64 nt, hsa; identical to SEQ ID NO: 30916

SEQ ID NO: 402507 - RNA, 64 nt, hsa; identical to SEQ ID NO: 30917

SEQ ID NO: 402508 - RNA, 64 nt, hsa; identical to SEQ ID NO: 30918

SEQ ID NO: 402509 - RNA, 64 nt, hsa; identical to SEQ ID NO: 30919

SEQ ID NO: 402510 - RNA, 64 nt, hsa; identical to SEQ ID NO: 30920

SEQ ID NO: 402511 - RNA, 64 nt, hsa; identical to SEQ ID NO: 30921

SEQ ID NO: 402512 - RNA, 64 nt, hsa; identical to SEQ ID NO: 30922

SEQ ID NO: 402513 - RNA, 64 nt, hsa; identical to SEQ ID NO: 30923

SEQ ID NO: 402514 - RNA, 64 nt, hsa; identical to SEQ ID NO: 30924

SEQ ID NO: 402515 - RNA, 64 nt, hsa; identical to SEQ ID NO: 30925

SEQ ID NO: 402516 - RNA, 64 nt, hsa; identical to SEQ ID NO: 30926

SEQ ID NO: 402517 - RNA, 64 nt, hsa; identical to SEQ ID NO: 30927

SEQ ID NO: 402518 - RNA, 64 nt, hsa; identical to SEQ ID NO: 30928

SEQ ID NO: 402519 - RNA, 64 nt, hsa; identical to SEQ ID NO: 30929

SEQ ID NO: 402520 - RNA, 64 nt, hsa; identical to SEQ ID NO: 30930

SEQ ID NO: 402521 - RNA, 64 nt, hsa; identical to SEQ ID NO: 30931

SEQ ID NO: 402522 - RNA, 64 nt, hsa; identical to SEQ ID NO: 30932

SEQ ID NO: 402523 - RNA, 64 nt, hsa; identical to SEQ ID NO: 30933

SEQ ID NO: 402524 - RNA, 64 nt, hsa; identical to SEQ ID NO: 30934

SEQ ID NO: 402525 - RNA, 64 nt, hsa; identical to SEQ ID NO: 30935

SEQ ID NO: 402526 - RNA, 64 nt, hsa; identical to SEQ ID NO: 30936

SEQ ID NO: 402527 - RNA, 64 nt, hsa; identical to SEQ ID NO: 30937

SEQ ID NO: 402528 - RNA, 64 nt, hsa; identical to SEQ ID NO: 30938

SEQ ID NO: 402529 - RNA, 64 nt, hsa; identical to SEQ ID NO: 30939

SEQ ID NO: 402530 - RNA, 64 nt, hsa; identical to SEQ ID NO: 30940

SEQ ID NO: 402531 - RNA, 64 nt, hsa; identical to SEQ ID NO: 30941

SEQ ID NO: 402532 - RNA, 64 nt, hsa; identical to SEQ ID NO: 30942

SEQ ID NO: 402533 - RNA, 64 nt, hsa; identical to SEQ ID NO: 30943

SEQ ID NO: 402534 - RNA, 64 nt, hsa; identical to SEQ ID NO: 30944

SEQ ID NO: 402535 - RNA, 64 nt, hsa; identical to SEQ ID NO: 30945

SEQ ID NO: 402536 - RNA, 64 nt, hsa; identical to SEQ ID NO: 30946

SEQ ID NO: 402537 - RNA, 64 nt, hsa; identical to SEQ ID NO: 30947

SEQ ID NO: 402538 - RNA, 64 nt, hsa; identical to SEQ ID NO: 30948

SEQ ID NO: 402539 - RNA, 64 nt, hsa; identical to SEQ ID NO: 30949

SEQ ID NO: 402540 - RNA, 64 nt, hsa; identical to SEQ ID NO: 30950

SEQ ID NO: 402541 - RNA, 64 nt, hsa; identical to SEQ ID NO: 30951

SEQ ID NO: 402542 - RNA, 64 nt, hsa; identical to SEQ ID NO: 30952

SEQ ID NO: 402543 - RNA, 64 nt, hsa; identical to SEQ ID NO: 30953

SEQ ID NO: 402544 - RNA, 64 nt, hsa; identical to SEQ ID NO: 30954

SEQ ID NO: 402545 - RNA, 64 nt, hsa; identical to SEQ ID NO: 30955

SEQ ID NO: 402546 - RNA, 64 nt, hsa; identical to SEQ ID NO: 30956

SEQ ID NO: 402547 - RNA, 64 nt, hsa; identical to SEQ ID NO: 30957

SEQ ID NO: 402548 - RNA, 64 nt, hsa; identical to SEQ ID NO: 30958

SEQ ID NO: 402549 - RNA, 64 nt, hsa; identical to SEQ ID NO: 30959

SEQ ID NO: 402550 - RNA, 64 nt, hsa; identical to SEQ ID NO: 30960

SEQ ID NO: 402551 - RNA, 64 nt, hsa; identical to SEQ ID NO: 30961

SEQ ID NO: 402552 - RNA, 64 nt, hsa; identical to SEQ ID NO: 30962

SEQ ID NO: 402553 - RNA, 64 nt, hsa; identical to SEQ ID NO: 30963

SEQ ID NO: 402554 - RNA, 64 nt, hsa; identical to SEQ ID NO: 30964

SEQ ID NO: 402555 - RNA, 64 nt, hsa; identical to SEQ ID NO: 30965

SEQ ID NO: 402556 - RNA, 64 nt, hsa; identical to SEQ ID NO: 30966

SEQ ID NO: 402557 - RNA, 64 nt, hsa; identical to SEQ ID NO: 30967

SEQ ID NO: 402558 - RNA, 64 nt, hsa; identical to SEQ ID NO: 30968

SEQ ID NO: 402559 - RNA, 64 nt, hsa; identical to SEQ ID NO: 30969

SEQ ID NO: 402560 - RNA, 64 nt, hsa; identical to SEQ ID NO: 30970

SEQ ID NO: 402561 - RNA, 64 nt, hsa; identical to SEQ ID NO: 30971

SEQ ID NO: 402562 - RNA, 64 nt, hsa; identical to SEQ ID NO: 30972

SEQ ID NO: 402563 - RNA, 64 nt, hsa; identical to SEQ ID NO: 30973

SEQ ID NO: 402564 - RNA, 64 nt, hsa; identical to SEQ ID NO: 30974

SEQ ID NO: 402565 - RNA, 64 nt, hsa; identical to SEQ ID NO: 30975

SEQ ID NO: 402566 - RNA, 64 nt, hsa; identical to SEQ ID NO: 30976

SEQ ID NO: 402567 - RNA, 64 nt, hsa; identical to SEQ ID NO: 30977

SEQ ID NO: 402568 - RNA, 64 nt, hsa; identical to SEQ ID NO: 30978

SEQ ID NO: 402569 - RNA, 64 nt, hsa; identical to SEQ ID NO: 30979

SEQ ID NO: 402570 - RNA, 64 nt, hsa; identical to SEQ ID NO: 30980

SEQ ID NO: 402571 - RNA, 64 nt, hsa; identical to SEQ ID NO: 30981

SEQ ID NO: 402572 - RNA, 64 nt, hsa; identical to SEQ ID NO: 30982

SEQ ID NO: 402573 - RNA, 64 nt, hsa; identical to SEQ ID NO: 30983

SEQ ID NO: 402574 - RNA, 64 nt, hsa; identical to SEQ ID NO: 30984

SEQ ID NO: 402575 - RNA, 60 nt, hsa; identical to SEQ ID NO: 30985

SEQ ID NO: 402576 - RNA, 61 nt, hsa; identical to SEQ ID NO: 30986

SEQ ID NO: 402577 - RNA, 64 nt, hsa; identical to SEQ ID NO: 30987

SEQ ID NO: 402578 - RNA, 64 nt, hsa; identical to SEQ ID NO: 30988

SEQ ID NO: 402579 - RNA, 64 nt, hsa; identical to SEQ ID NO: 30989

SEQ ID NO: 402580 - RNA, 64 nt, hsa; identical to SEQ ID NO: 30990

SEQ ID NO: 402581 - RNA, 64 nt, hsa; identical to SEQ ID NO: 30991

SEQ ID NO: 402582 - RNA, 64 nt, hsa; identical to SEQ ID NO: 30992

SEQ ID NO: 402583 - RNA, 64 nt, hsa; identical to SEQ ID NO: 30993

SEQ ID NO: 402584 - RNA, 64 nt, hsa; identical to SEQ ID NO: 30994

SEQ ID NO: 402585 - RNA, 64 nt, hsa; identical to SEQ ID NO: 30995

SEQ ID NO: 402586 - RNA, 64 nt, hsa; identical to SEQ ID NO: 30996

SEQ ID NO: 402587 - RNA, 64 nt, hsa; identical to SEQ ID NO: 30997

SEQ ID NO: 402588 - RNA, 64 nt, hsa; identical to SEQ ID NO: 30998

SEQ ID NO: 402589 - RNA, 64 nt, hsa; identical to SEQ ID NO: 30999

SEQ ID NO: 402590 - RNA, 64 nt, hsa; identical to SEQ ID NO: 31000

SEQ ID NO: 402591 - RNA, 64 nt, hsa; identical to SEQ ID NO: 31001

SEQ ID NO: 402592 - RNA, 64 nt, hsa; identical to SEQ ID NO: 31002

SEQ ID NO: 402593 - RNA, 64 nt, hsa; identical to SEQ ID NO: 31003

SEQ ID NO: 402594 - RNA, 64 nt, hsa; identical to SEQ ID NO: 31004

SEQ ID NO: 402595 - RNA, 64 nt, hsa; identical to SEQ ID NO: 31005

SEQ ID NO: 402596 - RNA, 64 nt, hsa; identical to SEQ ID NO: 31006

SEQ ID NO: 402597 - RNA, 64 nt, hsa; identical to SEQ ID NO: 31007

SEQ ID NO: 402598 - RNA, 64 nt, hsa; identical to SEQ ID NO: 31008

SEQ ID NO: 402599 - RNA, 64 nt, hsa; identical to SEQ ID NO: 31009

SEQ ID NO: 402600 - RNA, 64 nt, hsa; identical to SEQ ID NO: 31010

SEQ ID NO: 402601 - RNA, 64 nt, hsa; identical to SEQ ID NO: 31011

SEQ ID NO: 402602 - RNA, 64 nt, hsa; identical to SEQ ID NO: 31012

SEQ ID NO: 402603 - RNA, 64 nt, hsa; identical to SEQ ID NO: 31013

SEQ ID NO: 402604 - RNA, 64 nt, hsa; identical to SEQ ID NO: 31014

SEQ ID NO: 402605 - RNA, 64 nt, hsa; identical to SEQ ID NO: 31015

SEQ ID NO: 402606 - RNA, 64 nt, hsa; identical to SEQ ID NO: 31016

SEQ ID NO: 402607 - RNA, 64 nt, hsa; identical to SEQ ID NO: 31017

SEQ ID NO: 402608 - RNA, 64 nt, hsa; identical to SEQ ID NO: 31018

SEQ ID NO: 402609 - RNA, 64 nt, hsa; identical to SEQ ID NO: 31019

SEQ ID NO: 402610 - RNA, 64 nt, hsa; identical to SEQ ID NO: 31020

SEQ ID NO: 402611 - RNA, 64 nt, hsa; identical to SEQ ID NO: 31021

SEQ ID NO: 402612 - RNA, 64 nt, hsa; identical to SEQ ID NO: 31022

SEQ ID NO: 402613 - RNA, 64 nt, hsa; identical to SEQ ID NO: 31023

SEQ ID NO: 402614 - RNA, 64 nt, hsa; identical to SEQ ID NO: 31024

SEQ ID NO: 402615 - RNA, 64 nt, hsa; identical to SEQ ID NO: 31025

SEQ ID NO: 402616 - RNA, 64 nt, hsa; identical to SEQ ID NO: 31026

SEQ ID NO: 402617 - RNA, 64 nt, hsa; identical to SEQ ID NO: 31027

SEQ ID NO: 402618 - RNA, 64 nt, hsa; identical to SEQ ID NO: 31028

SEQ ID NO: 402619 - RNA, 64 nt, hsa; identical to SEQ ID NO: 31029

SEQ ID NO: 402620 - RNA, 64 nt, hsa; identical to SEQ ID NO: 31030

SEQ ID NO: 402621 - RNA, 64 nt, hsa; identical to SEQ ID NO: 31031

SEQ ID NO: 402622 - RNA, 64 nt, hsa; identical to SEQ ID NO: 31032

SEQ ID NO: 402623 - RNA, 64 nt, hsa; identical to SEQ ID NO: 31033

SEQ ID NO: 402624 - RNA, 64 nt, hsa; identical to SEQ ID NO: 31034

SEQ ID NO: 402625 - RNA, 64 nt, hsa; identical to SEQ ID NO: 31035

SEQ ID NO: 402626 - RNA, 64 nt, hsa; identical to SEQ ID NO: 31036

SEQ ID NO: 402627 - RNA, 64 nt, hsa; identical to SEQ ID NO: 31037

SEQ ID NO: 402628 - RNA, 64 nt, hsa; identical to SEQ ID NO: 31038

SEQ ID NO: 402629 - RNA, 64 nt, hsa; identical to SEQ ID NO: 31039

SEQ ID NO: 402630 - RNA, 64 nt, hsa; identical to SEQ ID NO: 31040

SEQ ID NO: 402631 - RNA, 64 nt, hsa; identical to SEQ ID NO: 31041

SEQ ID NO: 402632 - RNA, 64 nt, hsa; identical to SEQ ID NO: 31042

SEQ ID NO: 402633 - RNA, 64 nt, hsa; identical to SEQ ID NO: 31043

SEQ ID NO: 402634 - RNA, 64 nt, hsa; identical to SEQ ID NO: 31044

SEQ ID NO: 402635 - RNA, 64 nt, hsa; identical to SEQ ID NO: 31045

SEQ ID NO: 402636 - RNA, 64 nt, hsa; identical to SEQ ID NO: 31046

SEQ ID NO: 402637 - RNA, 64 nt, hsa; identical to SEQ ID NO: 31047

SEQ ID NO: 402638 - RNA, 64 nt, hsa; identical to SEQ ID NO: 31048

SEQ ID NO: 402639 - RNA, 64 nt, hsa; identical to SEQ ID NO: 31049

SEQ ID NO: 402640 - RNA, 64 nt, hsa; identical to SEQ ID NO: 31050

SEQ ID NO: 402641 - RNA, 64 nt, hsa; identical to SEQ ID NO: 31051

SEQ ID NO: 402642 - RNA, 64 nt, hsa; identical to SEQ ID NO: 31052

SEQ ID NO: 402643 - RNA, 64 nt, hsa; identical to SEQ ID NO: 31053

SEQ ID NO: 402644 - RNA, 64 nt, hsa; identical to SEQ ID NO: 31054

SEQ ID NO: 402645 - RNA, 64 nt, hsa; identical to SEQ ID NO: 31055

SEQ ID NO: 402646 - RNA, 64 nt, hsa; identical to SEQ ID NO: 31056

SEQ ID NO: 402647 - RNA, 64 nt, hsa; identical to SEQ ID NO: 31057

SEQ ID NO: 402648 - RNA, 64 nt, hsa; identical to SEQ ID NO: 31058

SEQ ID NO: 402649 - RNA, 64 nt, hsa; identical to SEQ ID NO: 31059

SEQ ID NO: 402650 - RNA, 64 nt, hsa; identical to SEQ ID NO: 31060

SEQ ID NO: 402651 - RNA, 64 nt, hsa; identical to SEQ ID NO: 31061

SEQ ID NO: 402652 - RNA, 64 nt, hsa; identical to SEQ ID NO: 31062

SEQ ID NO: 402653 - RNA, 64 nt, hsa; identical to SEQ ID NO: 31063

SEQ ID NO: 402654 - RNA, 64 nt, hsa; identical to SEQ ID NO: 31064

SEQ ID NO: 402655 - RNA, 64 nt, hsa; identical to SEQ ID NO: 31065

SEQ ID NO: 402656 - RNA, 64 nt, hsa; identical to SEQ ID NO: 31066

SEQ ID NO: 402657 - RNA, 64 nt, hsa; identical to SEQ ID NO: 31067

SEQ ID NO: 402658 - RNA, 64 nt, hsa; identical to SEQ ID NO: 31068

SEQ ID NO: 402659 - RNA, 64 nt, hsa; identical to SEQ ID NO: 31069

SEQ ID NO: 402660 - RNA, 64 nt, hsa; identical to SEQ ID NO: 31070

SEQ ID NO: 402661 - RNA, 64 nt, hsa; identical to SEQ ID NO: 31071

SEQ ID NO: 402662 - RNA, 64 nt, hsa; identical to SEQ ID NO: 31072

SEQ ID NO: 402663 - RNA, 64 nt, hsa; identical to SEQ ID NO: 31073

SEQ ID NO: 402664 - RNA, 64 nt, hsa; identical to SEQ ID NO: 31074

SEQ ID NO: 402665 - RNA, 64 nt, hsa; identical to SEQ ID NO: 31075

SEQ ID NO: 402666 - RNA, 64 nt, hsa; identical to SEQ ID NO: 31076

SEQ ID NO: 402667 - RNA, 64 nt, hsa; identical to SEQ ID NO: 31077

SEQ ID NO: 402668 - RNA, 64 nt, hsa; identical to SEQ ID NO: 31078

SEQ ID NO: 402669 - RNA, 64 nt, hsa; identical to SEQ ID NO: 31079

SEQ ID NO: 402670 - RNA, 64 nt, hsa; identical to SEQ ID NO: 31080

SEQ ID NO: 402671 - RNA, 64 nt, hsa; identical to SEQ ID NO: 31081

SEQ ID NO: 402672 - RNA, 64 nt, hsa; identical to SEQ ID NO: 31082

SEQ ID NO: 402673 - RNA, 64 nt, hsa; identical to SEQ ID NO: 31083

SEQ ID NO: 402674 - RNA, 64 nt, hsa; identical to SEQ ID NO: 31084

SEQ ID NO: 402675 - RNA, 64 nt, hsa; identical to SEQ ID NO: 31085

SEQ ID NO: 402676 - RNA, 64 nt, hsa; identical to SEQ ID NO: 31086

SEQ ID NO: 402677 - RNA, 64 nt, hsa; identical to SEQ ID NO: 31087

SEQ ID NO: 402678 - RNA, 64 nt, hsa; identical to SEQ ID NO: 31088

SEQ ID NO: 402679 - RNA, 64 nt, hsa; identical to SEQ ID NO: 31089

SEQ ID NO: 402680 - RNA, 64 nt, hsa; identical to SEQ ID NO: 31090

SEQ ID NO: 402681 - RNA, 64 nt, hsa; identical to SEQ ID NO: 31091

SEQ ID NO: 402682 - RNA, 64 nt, hsa; identical to SEQ ID NO: 31092

SEQ ID NO: 402683 - RNA, 64 nt, hsa; identical to SEQ ID NO: 31093

SEQ ID NO: 402684 - RNA, 64 nt, hsa; identical to SEQ ID NO: 31094

SEQ ID NO: 402685 - RNA, 64 nt, hsa; identical to SEQ ID NO: 31095

SEQ ID NO: 402686 - RNA, 64 nt, hsa; identical to SEQ ID NO: 31096

SEQ ID NO: 402687 - RNA, 64 nt, hsa; identical to SEQ ID NO: 31097

SEQ ID NO: 402688 - RNA, 64 nt, hsa; identical to SEQ ID NO: 31098

SEQ ID NO: 402689 - RNA, 64 nt, hsa; identical to SEQ ID NO: 31099

SEQ ID NO: 402690 - RNA, 64 nt, hsa; identical to SEQ ID NO: 31100

SEQ ID NO: 402691 - RNA, 64 nt, hsa; identical to SEQ ID NO: 31101

SEQ ID NO: 402692 - RNA, 64 nt, hsa; identical to SEQ ID NO: 31102

SEQ ID NO: 402693 - RNA, 64 nt, hsa; identical to SEQ ID NO: 31103

SEQ ID NO: 402694 - RNA, 64 nt, hsa; identical to SEQ ID NO: 31104

SEQ ID NO: 402695 - RNA, 64 nt, hsa; identical to SEQ ID NO: 31105

SEQ ID NO: 402696 - RNA, 64 nt, hsa; identical to SEQ ID NO: 31106

SEQ ID NO: 402697 - RNA, 64 nt, hsa; identical to SEQ ID NO: 31107

SEQ ID NO: 402698 - RNA, 64 nt, hsa; identical to SEQ ID NO: 31108

SEQ ID NO: 402699 - RNA, 64 nt, hsa; identical to SEQ ID NO: 31109

SEQ ID NO: 402700 - RNA, 64 nt, hsa; identical to SEQ ID NO: 31110

SEQ ID NO: 402701 - RNA, 64 nt, hsa; identical to SEQ ID NO: 31111

SEQ ID NO: 402702 - RNA, 64 nt, hsa; identical to SEQ ID NO: 31112

SEQ ID NO: 402703 - RNA, 64 nt, hsa; identical to SEQ ID NO: 31113

SEQ ID NO: 402704 - RNA, 64 nt, hsa; identical to SEQ ID NO: 31114

SEQ ID NO: 402705 - RNA, 64 nt, hsa; identical to SEQ ID NO: 31115

SEQ ID NO: 402706 - RNA, 64 nt, hsa; identical to SEQ ID NO: 31116

SEQ ID NO: 402707 - RNA, 64 nt, hsa; identical to SEQ ID NO: 31117

SEQ ID NO: 402708 - RNA, 64 nt, hsa; identical to SEQ ID NO: 31118

SEQ ID NO: 402709 - RNA, 64 nt, hsa; identical to SEQ ID NO: 31119

SEQ ID NO: 402710 - RNA, 64 nt, hsa; identical to SEQ ID NO: 31120

SEQ ID NO: 402711 - RNA, 64 nt, hsa; identical to SEQ ID NO: 31121

SEQ ID NO: 402712 - RNA, 64 nt, hsa; identical to SEQ ID NO: 31122

SEQ ID NO: 402713 - RNA, 64 nt, hsa; identical to SEQ ID NO: 31123

SEQ ID NO: 402714 - RNA, 64 nt, hsa; identical to SEQ ID NO: 31124

SEQ ID NO: 402715 - RNA, 64 nt, hsa; identical to SEQ ID NO: 31125

SEQ ID NO: 402716 - RNA, 64 nt, hsa; identical to SEQ ID NO: 31126

SEQ ID NO: 402717 - RNA, 64 nt, hsa; identical to SEQ ID NO: 31127

SEQ ID NO: 402718 - RNA, 64 nt, hsa; identical to SEQ ID NO: 31128

SEQ ID NO: 402719 - RNA, 64 nt, hsa; identical to SEQ ID NO: 31129

SEQ ID NO: 402720 - RNA, 64 nt, hsa; identical to SEQ ID NO: 31130

SEQ ID NO: 402721 - RNA, 64 nt, hsa; identical to SEQ ID NO: 31131

SEQ ID NO: 402722 - RNA, 64 nt, hsa; identical to SEQ ID NO: 31132

SEQ ID NO: 402723 - RNA, 64 nt, hsa; identical to SEQ ID NO: 31133

SEQ ID NO: 402724 - RNA, 64 nt, hsa; identical to SEQ ID NO: 31134

SEQ ID NO: 402725 - RNA, 64 nt, hsa; identical to SEQ ID NO: 31135

SEQ ID NO: 402726 - RNA, 64 nt, hsa; identical to SEQ ID NO: 31136

SEQ ID NO: 402727 - RNA, 64 nt, hsa; identical to SEQ ID NO: 31137

SEQ ID NO: 402728 - RNA, 64 nt, hsa; identical to SEQ ID NO: 31138

SEQ ID NO: 402729 - RNA, 64 nt, hsa; identical to SEQ ID NO: 31139

SEQ ID NO: 402730 - RNA, 64 nt, hsa; identical to SEQ ID NO: 31140

SEQ ID NO: 402731 - RNA, 64 nt, hsa; identical to SEQ ID NO: 31141

SEQ ID NO: 402732 - RNA, 64 nt, hsa; identical to SEQ ID NO: 31142

SEQ ID NO: 402733 - RNA, 64 nt, hsa; identical to SEQ ID NO: 31143

SEQ ID NO: 402734 - RNA, 64 nt, hsa; identical to SEQ ID NO: 31144

SEQ ID NO: 402735 - RNA, 64 nt, hsa; identical to SEQ ID NO: 31145

SEQ ID NO: 402736 - RNA, 64 nt, hsa; identical to SEQ ID NO: 31146

SEQ ID NO: 402737 - RNA, 64 nt, hsa; identical to SEQ ID NO: 31147

SEQ ID NO: 402738 - RNA, 64 nt, hsa; identical to SEQ ID NO: 31148

SEQ ID NO: 402739 - RNA, 64 nt, hsa; identical to SEQ ID NO: 31149

SEQ ID NO: 402740 - RNA, 64 nt, hsa; identical to SEQ ID NO: 31150

SEQ ID NO: 402741 - RNA, 64 nt, hsa; identical to SEQ ID NO: 31151

SEQ ID NO: 402742 - RNA, 64 nt, hsa; identical to SEQ ID NO: 31152

SEQ ID NO: 402743 - RNA, 64 nt, hsa; identical to SEQ ID NO: 31153

SEQ ID NO: 402744 - RNA, 64 nt, hsa; identical to SEQ ID NO: 31154

SEQ ID NO: 402745 - RNA, 64 nt, hsa; identical to SEQ ID NO: 31155

SEQ ID NO: 402746 - RNA, 64 nt, hsa; identical to SEQ ID NO: 31156

SEQ ID NO: 402747 - RNA, 64 nt, hsa; identical to SEQ ID NO: 31157

SEQ ID NO: 402748 - RNA, 64 nt, hsa; identical to SEQ ID NO: 31158

SEQ ID NO: 402749 - RNA, 64 nt, hsa; identical to SEQ ID NO: 31159

SEQ ID NO: 402750 - RNA, 64 nt, hsa; identical to SEQ ID NO: 31160

SEQ ID NO: 402751 - RNA, 64 nt, hsa; identical to SEQ ID NO: 31161

SEQ ID NO: 402752 - RNA, 64 nt, hsa; identical to SEQ ID NO: 31162

SEQ ID NO: 402753 - RNA, 64 nt, hsa; identical to SEQ ID NO: 31163

SEQ ID NO: 402754 - RNA, 64 nt, hsa; identical to SEQ ID NO: 31164

SEQ ID NO: 402755 - RNA, 64 nt, hsa; identical to SEQ ID NO: 31165

SEQ ID NO: 402756 - RNA, 64 nt, hsa; identical to SEQ ID NO: 31166

SEQ ID NO: 402757 - RNA, 64 nt, hsa; identical to SEQ ID NO: 31167

SEQ ID NO: 402758 - RNA, 64 nt, hsa; identical to SEQ ID NO: 31168

SEQ ID NO: 402759 - RNA, 64 nt, hsa; identical to SEQ ID NO: 31169

SEQ ID NO: 402760 - RNA, 64 nt, hsa; identical to SEQ ID NO: 31170

SEQ ID NO: 402761 - RNA, 64 nt, hsa; identical to SEQ ID NO: 31171

SEQ ID NO: 402762 - RNA, 64 nt, hsa; identical to SEQ ID NO: 31172

SEQ ID NO: 402763 - RNA, 64 nt, hsa; identical to SEQ ID NO: 31173

SEQ ID NO: 402764 - RNA, 64 nt, hsa; identical to SEQ ID NO: 31174

SEQ ID NO: 402765 - RNA, 64 nt, hsa; identical to SEQ ID NO: 31175

SEQ ID NO: 402766 - RNA, 64 nt, hsa; identical to SEQ ID NO: 31176

SEQ ID NO: 402767 - RNA, 64 nt, hsa; identical to SEQ ID NO: 31177

SEQ ID NO: 402768 - RNA, 64 nt, hsa; identical to SEQ ID NO: 31178

SEQ ID NO: 402769 - RNA, 64 nt, hsa; identical to SEQ ID NO: 31179

SEQ ID NO: 402770 - RNA, 64 nt, hsa; identical to SEQ ID NO: 31180

SEQ ID NO: 402771 - RNA, 64 nt, hsa; identical to SEQ ID NO: 31181

SEQ ID NO: 402772 - RNA, 64 nt, hsa; identical to SEQ ID NO: 31182

SEQ ID NO: 402773 - RNA, 64 nt, hsa; identical to SEQ ID NO: 31183

SEQ ID NO: 402774 - RNA, 64 nt, hsa; identical to SEQ ID NO: 31184

SEQ ID NO: 402775 - RNA, 64 nt, hsa; identical to SEQ ID NO: 31185

SEQ ID NO: 402776 - RNA, 64 nt, hsa; identical to SEQ ID NO: 31186

SEQ ID NO: 402777 - RNA, 64 nt, hsa; identical to SEQ ID NO: 31187

SEQ ID NO: 402778 - RNA, 64 nt, hsa; identical to SEQ ID NO: 31188

SEQ ID NO: 402779 - RNA, 64 nt, hsa; identical to SEQ ID NO: 31189

SEQ ID NO: 402780 - RNA, 64 nt, hsa; identical to SEQ ID NO: 31190

SEQ ID NO: 402781 - RNA, 64 nt, hsa; identical to SEQ ID NO: 31191

SEQ ID NO: 402782 - RNA, 64 nt, hsa; identical to SEQ ID NO: 31192

SEQ ID NO: 402783 - RNA, 64 nt, hsa; identical to SEQ ID NO: 31193

SEQ ID NO: 402784 - RNA, 64 nt, hsa; identical to SEQ ID NO: 31194

SEQ ID NO: 402785 - RNA, 64 nt, hsa; identical to SEQ ID NO: 31195

SEQ ID NO: 402786 - RNA, 64 nt, hsa; identical to SEQ ID NO: 31196

SEQ ID NO: 402787 - RNA, 64 nt, hsa; identical to SEQ ID NO: 31197

SEQ ID NO: 402788 - RNA, 64 nt, hsa; identical to SEQ ID NO: 31198

SEQ ID NO: 402789 - RNA, 64 nt, hsa; identical to SEQ ID NO: 31199

SEQ ID NO: 402790 - RNA, 64 nt, hsa; identical to SEQ ID NO: 31200

SEQ ID NO: 402791 - RNA, 64 nt, hsa; identical to SEQ ID NO: 31201

SEQ ID NO: 402792 - RNA, 64 nt, hsa; identical to SEQ ID NO: 31202

SEQ ID NO: 402793 - RNA, 64 nt, hsa; identical to SEQ ID NO: 31203

SEQ ID NO: 402794 - RNA, 64 nt, hsa; identical to SEQ ID NO: 31204

SEQ ID NO: 402795 - RNA, 64 nt, hsa; identical to SEQ ID NO: 31205

SEQ ID NO: 402796 - RNA, 64 nt, hsa; identical to SEQ ID NO: 31206

SEQ ID NO: 402797 - RNA, 64 nt, hsa; identical to SEQ ID NO: 31207

SEQ ID NO: 402798 - RNA, 64 nt, hsa; identical to SEQ ID NO: 31208

SEQ ID NO: 402799 - RNA, 64 nt, hsa; identical to SEQ ID NO: 31209

SEQ ID NO: 402800 - RNA, 64 nt, hsa; identical to SEQ ID NO: 31210

SEQ ID NO: 402801 - RNA, 64 nt, hsa; identical to SEQ ID NO: 31211

SEQ ID NO: 402802 - RNA, 64 nt, hsa; identical to SEQ ID NO: 31212

SEQ ID NO: 402803 - RNA, 64 nt, hsa; identical to SEQ ID NO: 31213

SEQ ID NO: 402804 - RNA, 64 nt, hsa; identical to SEQ ID NO: 31214

SEQ ID NO: 402805 - RNA, 64 nt, hsa; identical to SEQ ID NO: 31215

SEQ ID NO: 402806 - RNA, 64 nt, hsa; identical to SEQ ID NO: 31216

SEQ ID NO: 402807 - RNA, 64 nt, hsa; identical to SEQ ID NO: 31217

SEQ ID NO: 402808 - RNA, 64 nt, hsa; identical to SEQ ID NO: 31218

SEQ ID NO: 402809 - RNA, 64 nt, hsa; identical to SEQ ID NO: 31219

SEQ ID NO: 402810 - RNA, 64 nt, hsa; identical to SEQ ID NO: 31220

SEQ ID NO: 402811 - RNA, 64 nt, hsa; identical to SEQ ID NO: 31221

SEQ ID NO: 402812 - RNA, 64 nt, hsa; identical to SEQ ID NO: 31222

SEQ ID NO: 402813 - RNA, 64 nt, hsa; identical to SEQ ID NO: 31223

SEQ ID NO: 402814 - RNA, 64 nt, hsa; identical to SEQ ID NO: 31224

SEQ ID NO: 402815 - RNA, 64 nt, hsa; identical to SEQ ID NO: 31225

SEQ ID NO: 402816 - RNA, 64 nt, hsa; identical to SEQ ID NO: 31226

SEQ ID NO: 402817 - RNA, 64 nt, hsa; identical to SEQ ID NO: 31227

SEQ ID NO: 402818 - RNA, 64 nt, hsa; identical to SEQ ID NO: 31228

SEQ ID NO: 402819 - RNA, 64 nt, hsa; identical to SEQ ID NO: 31229

SEQ ID NO: 402820 - RNA, 64 nt, hsa; identical to SEQ ID NO: 31230

SEQ ID NO: 402821 - RNA, 64 nt, hsa; identical to SEQ ID NO: 31231

SEQ ID NO: 402822 - RNA, 64 nt, hsa; identical to SEQ ID NO: 31232

SEQ ID NO: 402823 - RNA, 64 nt, hsa; identical to SEQ ID NO: 31233

SEQ ID NO: 402824 - RNA, 64 nt, hsa; identical to SEQ ID NO: 31234

SEQ ID NO: 402825 - RNA, 64 nt, hsa; identical to SEQ ID NO: 31235

SEQ ID NO: 402826 - RNA, 64 nt, hsa; identical to SEQ ID NO: 31236

SEQ ID NO: 402827 - RNA, 64 nt, hsa; identical to SEQ ID NO: 31237

SEQ ID NO: 402828 - RNA, 64 nt, hsa; identical to SEQ ID NO: 31238

SEQ ID NO: 402829 - RNA, 64 nt, hsa; identical to SEQ ID NO: 31239

SEQ ID NO: 402830 - RNA, 64 nt, hsa; identical to SEQ ID NO: 31240

SEQ ID NO: 402831 - RNA, 62 nt, hsa; identical to SEQ ID NO: 31241

SEQ ID NO: 402832 - RNA, 63 nt, hsa; identical to SEQ ID NO: 31242

SEQ ID NO: 402833 - RNA, 64 nt, hsa; identical to SEQ ID NO: 31243

SEQ ID NO: 402834 - RNA, 64 nt, hsa; identical to SEQ ID NO: 31244

SEQ ID NO: 402835 - RNA, 64 nt, hsa; identical to SEQ ID NO: 31245

SEQ ID NO: 402836 - RNA, 64 nt, hsa; identical to SEQ ID NO: 31246

SEQ ID NO: 402837 - RNA, 64 nt, hsa; identical to SEQ ID NO: 31247

SEQ ID NO: 402838 - RNA, 64 nt, hsa; identical to SEQ ID NO: 31248

SEQ ID NO: 402839 - RNA, 64 nt, hsa; identical to SEQ ID NO: 31249

SEQ ID NO: 402840 - RNA, 64 nt, hsa; identical to SEQ ID NO: 31250

SEQ ID NO: 402841 - RNA, 64 nt, hsa; identical to SEQ ID NO: 31251

SEQ ID NO: 402842 - RNA, 64 nt, hsa; identical to SEQ ID NO: 31252

SEQ ID NO: 402843 - RNA, 64 nt, hsa; identical to SEQ ID NO: 31253

SEQ ID NO: 402844 - RNA, 64 nt, hsa; identical to SEQ ID NO: 31254

SEQ ID NO: 402845 - RNA, 64 nt, hsa; identical to SEQ ID NO: 31255

SEQ ID NO: 402846 - RNA, 64 nt, hsa; identical to SEQ ID NO: 31256

SEQ ID NO: 402847 - RNA, 64 nt, hsa; identical to SEQ ID NO: 31257

SEQ ID NO: 402848 - RNA, 64 nt, hsa; identical to SEQ ID NO: 31258

SEQ ID NO: 402849 - RNA, 64 nt, hsa; identical to SEQ ID NO: 31259

SEQ ID NO: 402850 - RNA, 64 nt, hsa; identical to SEQ ID NO: 31260

SEQ ID NO: 402851 - RNA, 64 nt, hsa; identical to SEQ ID NO: 31261

SEQ ID NO: 402852 - RNA, 64 nt, hsa; identical to SEQ ID NO: 31262

SEQ ID NO: 402853 - RNA, 64 nt, hsa; identical to SEQ ID NO: 31263

SEQ ID NO: 402854 - RNA, 64 nt, hsa; identical to SEQ ID NO: 31264

SEQ ID NO: 402855 - RNA, 64 nt, hsa; identical to SEQ ID NO: 31265

SEQ ID NO: 402856 - RNA, 64 nt, hsa; identical to SEQ ID NO: 31266

SEQ ID NO: 402857 - RNA, 64 nt, hsa; identical to SEQ ID NO: 31267

SEQ ID NO: 402858 - RNA, 64 nt, hsa; identical to SEQ ID NO: 31268

SEQ ID NO: 402859 - RNA, 64 nt, hsa; identical to SEQ ID NO: 31269

SEQ ID NO: 402860 - RNA, 64 nt, hsa; identical to SEQ ID NO: 31270

SEQ ID NO: 402861 - RNA, 64 nt, hsa; identical to SEQ ID NO: 31271

SEQ ID NO: 402862 - RNA, 64 nt, hsa; identical to SEQ ID NO: 31272

SEQ ID NO: 402863 - RNA, 64 nt, hsa; identical to SEQ ID NO: 31273

SEQ ID NO: 402864 - RNA, 64 nt, hsa; identical to SEQ ID NO: 31274

SEQ ID NO: 402865 - RNA, 64 nt, hsa; identical to SEQ ID NO: 31275

SEQ ID NO: 402866 - RNA, 64 nt, hsa; identical to SEQ ID NO: 31276

SEQ ID NO: 402867 - RNA, 64 nt, hsa; identical to SEQ ID NO: 31277

SEQ ID NO: 402868 - RNA, 64 nt, hsa; identical to SEQ ID NO: 31278

SEQ ID NO: 402869 - RNA, 64 nt, hsa; identical to SEQ ID NO: 31279

SEQ ID NO: 402870 - RNA, 64 nt, hsa; identical to SEQ ID NO: 31280

SEQ ID NO: 402871 - RNA, 64 nt, hsa; identical to SEQ ID NO: 31281

SEQ ID NO: 402872 - RNA, 64 nt, hsa; identical to SEQ ID NO: 31282

SEQ ID NO: 402873 - RNA, 64 nt, hsa; identical to SEQ ID NO: 31283

SEQ ID NO: 402874 - RNA, 64 nt, hsa; identical to SEQ ID NO: 31284

SEQ ID NO: 402875 - RNA, 64 nt, hsa; identical to SEQ ID NO: 31285

SEQ ID NO: 402876 - RNA, 64 nt, hsa; identical to SEQ ID NO: 31286

SEQ ID NO: 402877 - RNA, 64 nt, hsa; identical to SEQ ID NO: 31287

SEQ ID NO: 402878 - RNA, 64 nt, hsa; identical to SEQ ID NO: 31288

SEQ ID NO: 402879 - RNA, 64 nt, hsa; identical to SEQ ID NO: 31289

SEQ ID NO: 402880 - RNA, 64 nt, hsa; identical to SEQ ID NO: 31290

SEQ ID NO: 402881 - RNA, 64 nt, hsa; identical to SEQ ID NO: 31291

SEQ ID NO: 402882 - RNA, 64 nt, hsa; identical to SEQ ID NO: 31292

SEQ ID NO: 402883 - RNA, 64 nt, hsa; identical to SEQ ID NO: 31293

SEQ ID NO: 402884 - RNA, 64 nt, hsa; identical to SEQ ID NO: 31294

SEQ ID NO: 402885 - RNA, 64 nt, hsa; identical to SEQ ID NO: 31295

SEQ ID NO: 402886 - RNA, 64 nt, hsa; identical to SEQ ID NO: 31296

SEQ ID NO: 402887 - RNA, 64 nt, hsa; identical to SEQ ID NO: 31297

SEQ ID NO: 402888 - RNA, 64 nt, hsa; identical to SEQ ID NO: 31298

SEQ ID NO: 402889 - RNA, 64 nt, hsa; identical to SEQ ID NO: 31299

SEQ ID NO: 402890 - RNA, 64 nt, hsa; identical to SEQ ID NO: 31300

SEQ ID NO: 402891 - RNA, 64 nt, hsa; identical to SEQ ID NO: 31301

SEQ ID NO: 402892 - RNA, 64 nt, hsa; identical to SEQ ID NO: 31302

SEQ ID NO: 402893 - RNA, 64 nt, hsa; identical to SEQ ID NO: 31303

SEQ ID NO: 402894 - RNA, 64 nt, hsa; identical to SEQ ID NO: 31304

SEQ ID NO: 402895 - RNA, 64 nt, hsa; identical to SEQ ID NO: 31305

SEQ ID NO: 402896 - RNA, 64 nt, hsa; identical to SEQ ID NO: 31306

SEQ ID NO: 402897 - RNA, 64 nt, hsa; identical to SEQ ID NO: 31307

SEQ ID NO: 402898 - RNA, 64 nt, hsa; identical to SEQ ID NO: 31308

SEQ ID NO: 402899 - RNA, 64 nt, hsa; identical to SEQ ID NO: 31309

SEQ ID NO: 402900 - RNA, 64 nt, hsa; identical to SEQ ID NO: 31310

SEQ ID NO: 402901 - RNA, 64 nt, hsa; identical to SEQ ID NO: 31311

SEQ ID NO: 402902 - RNA, 64 nt, hsa; identical to SEQ ID NO: 31312

SEQ ID NO: 402903 - RNA, 64 nt, hsa; identical to SEQ ID NO: 31313

SEQ ID NO: 402904 - RNA, 64 nt, hsa; identical to SEQ ID NO: 31314

SEQ ID NO: 402905 - RNA, 64 nt, hsa; identical to SEQ ID NO: 31315

SEQ ID NO: 402906 - RNA, 64 nt, hsa; identical to SEQ ID NO: 31316

SEQ ID NO: 402907 - RNA, 64 nt, hsa; identical to SEQ ID NO: 31317

SEQ ID NO: 402908 - RNA, 64 nt, hsa; identical to SEQ ID NO: 31318

SEQ ID NO: 402909 - RNA, 64 nt, hsa; identical to SEQ ID NO: 31319

SEQ ID NO: 402910 - RNA, 64 nt, hsa; identical to SEQ ID NO: 31320

SEQ ID NO: 402911 - RNA, 64 nt, hsa; identical to SEQ ID NO: 31321

SEQ ID NO: 402912 - RNA, 64 nt, hsa; identical to SEQ ID NO: 31322

SEQ ID NO: 402913 - RNA, 64 nt, hsa; identical to SEQ ID NO: 31323

SEQ ID NO: 402914 - RNA, 64 nt, hsa; identical to SEQ ID NO: 31324

SEQ ID NO: 402915 - RNA, 64 nt, hsa; identical to SEQ ID NO: 31325

SEQ ID NO: 402916 - RNA, 64 nt, hsa; identical to SEQ ID NO: 31326

SEQ ID NO: 402917 - RNA, 64 nt, hsa; identical to SEQ ID NO: 31327

SEQ ID NO: 402918 - RNA, 64 nt, hsa; identical to SEQ ID NO: 31328

SEQ ID NO: 402919 - RNA, 64 nt, hsa; identical to SEQ ID NO: 31329

SEQ ID NO: 402920 - RNA, 64 nt, hsa; identical to SEQ ID NO: 31330

SEQ ID NO: 402921 - RNA, 64 nt, hsa; identical to SEQ ID NO: 31331

SEQ ID NO: 402922 - RNA, 64 nt, hsa; identical to SEQ ID NO: 31332

SEQ ID NO: 402923 - RNA, 64 nt, hsa; identical to SEQ ID NO: 31333

SEQ ID NO: 402924 - RNA, 64 nt, hsa; identical to SEQ ID NO: 31334

SEQ ID NO: 402925 - RNA, 64 nt, hsa; identical to SEQ ID NO: 31335

SEQ ID NO: 402926 - RNA, 64 nt, hsa; identical to SEQ ID NO: 31336

SEQ ID NO: 402927 - RNA, 64 nt, hsa; identical to SEQ ID NO: 31337

SEQ ID NO: 402928 - RNA, 64 nt, hsa; identical to SEQ ID NO: 31338

SEQ ID NO: 402929 - RNA, 64 nt, hsa; identical to SEQ ID NO: 31339

SEQ ID NO: 402930 - RNA, 64 nt, hsa; identical to SEQ ID NO: 31340

SEQ ID NO: 402931 - RNA, 64 nt, hsa; identical to SEQ ID NO: 31341

SEQ ID NO: 402932 - RNA, 64 nt, hsa; identical to SEQ ID NO: 31342

SEQ ID NO: 402933 - RNA, 64 nt, hsa; identical to SEQ ID NO: 31343

SEQ ID NO: 402934 - RNA, 64 nt, hsa; identical to SEQ ID NO: 31344

SEQ ID NO: 402935 - RNA, 64 nt, hsa; identical to SEQ ID NO: 31345

SEQ ID NO: 402936 - RNA, 64 nt, hsa; identical to SEQ ID NO: 31346

SEQ ID NO: 402937 - RNA, 64 nt, hsa; identical to SEQ ID NO: 31347

SEQ ID NO: 402938 - RNA, 64 nt, hsa; identical to SEQ ID NO: 31348

SEQ ID NO: 402939 - RNA, 64 nt, hsa; identical to SEQ ID NO: 31349

SEQ ID NO: 402940 - RNA, 64 nt, hsa; identical to SEQ ID NO: 31350

SEQ ID NO: 402941 - RNA, 64 nt, hsa; identical to SEQ ID NO: 31351

SEQ ID NO: 402942 - RNA, 64 nt, hsa; identical to SEQ ID NO: 31352

SEQ ID NO: 402943 - RNA, 64 nt, hsa; identical to SEQ ID NO: 31353

SEQ ID NO: 402944 - RNA, 64 nt, hsa; identical to SEQ ID NO: 31354

SEQ ID NO: 402945 - RNA, 64 nt, hsa; identical to SEQ ID NO: 31355

SEQ ID NO: 402946 - RNA, 64 nt, hsa; identical to SEQ ID NO: 31356

SEQ ID NO: 402947 - RNA, 64 nt, hsa; identical to SEQ ID NO: 31357

SEQ ID NO: 402948 - RNA, 64 nt, hsa; identical to SEQ ID NO: 31358

SEQ ID NO: 402949 - RNA, 64 nt, hsa; identical to SEQ ID NO: 31359

SEQ ID NO: 402950 - RNA, 64 nt, hsa; identical to SEQ ID NO: 31360

SEQ ID NO: 402951 - RNA, 64 nt, hsa; identical to SEQ ID NO: 31361

SEQ ID NO: 402952 - RNA, 64 nt, hsa; identical to SEQ ID NO: 31362

SEQ ID NO: 402953 - RNA, 64 nt, hsa; identical to SEQ ID NO: 31363

SEQ ID NO: 402954 - RNA, 64 nt, hsa; identical to SEQ ID NO: 31364

SEQ ID NO: 402955 - RNA, 64 nt, hsa; identical to SEQ ID NO: 31365

SEQ ID NO: 402956 - RNA, 64 nt, hsa; identical to SEQ ID NO: 31366

SEQ ID NO: 402957 - RNA, 64 nt, hsa; identical to SEQ ID NO: 31367

SEQ ID NO: 402958 - RNA, 64 nt, hsa; identical to SEQ ID NO: 31368

SEQ ID NO: 402959 - RNA, 64 nt, hsa; identical to SEQ ID NO: 31369

SEQ ID NO: 402960 - RNA, 64 nt, hsa; identical to SEQ ID NO: 31370

SEQ ID NO: 402961 - RNA, 64 nt, hsa; identical to SEQ ID NO: 31371

SEQ ID NO: 402962 - RNA, 64 nt, hsa; identical to SEQ ID NO: 31372

SEQ ID NO: 402963 - RNA, 64 nt, hsa; identical to SEQ ID NO: 31373

SEQ ID NO: 402964 - RNA, 64 nt, hsa; identical to SEQ ID NO: 31374

SEQ ID NO: 402965 - RNA, 64 nt, hsa; identical to SEQ ID NO: 31375

SEQ ID NO: 402966 - RNA, 64 nt, hsa; identical to SEQ ID NO: 31376

SEQ ID NO: 402967 - RNA, 64 nt, hsa; identical to SEQ ID NO: 31377

SEQ ID NO: 402968 - RNA, 64 nt, hsa; identical to SEQ ID NO: 31378

SEQ ID NO: 402969 - RNA, 64 nt, hsa; identical to SEQ ID NO: 31379

SEQ ID NO: 402970 - RNA, 64 nt, hsa; identical to SEQ ID NO: 31380

SEQ ID NO: 402971 - RNA, 64 nt, hsa; identical to SEQ ID NO: 31381

SEQ ID NO: 402972 - RNA, 64 nt, hsa; identical to SEQ ID NO: 31382

SEQ ID NO: 402973 - RNA, 64 nt, hsa; identical to SEQ ID NO: 31383

SEQ ID NO: 402974 - RNA, 64 nt, hsa; identical to SEQ ID NO: 31384

SEQ ID NO: 402975 - RNA, 64 nt, hsa; identical to SEQ ID NO: 31385

SEQ ID NO: 402976 - RNA, 64 nt, hsa; identical to SEQ ID NO: 31386

SEQ ID NO: 402977 - RNA, 64 nt, hsa; identical to SEQ ID NO: 31387

SEQ ID NO: 402978 - RNA, 64 nt, hsa; identical to SEQ ID NO: 31388

SEQ ID NO: 402979 - RNA, 64 nt, hsa; identical to SEQ ID NO: 31389

SEQ ID NO: 402980 - RNA, 64 nt, hsa; identical to SEQ ID NO: 31390

SEQ ID NO: 402981 - RNA, 64 nt, hsa; identical to SEQ ID NO: 31391

SEQ ID NO: 402982 - RNA, 64 nt, hsa; identical to SEQ ID NO: 31392

SEQ ID NO: 402983 - RNA, 64 nt, hsa; identical to SEQ ID NO: 31393

SEQ ID NO: 402984 - RNA, 64 nt, hsa; identical to SEQ ID NO: 31394

SEQ ID NO: 402985 - RNA, 64 nt, hsa; identical to SEQ ID NO: 31395

SEQ ID NO: 402986 - RNA, 64 nt, hsa; identical to SEQ ID NO: 31396

SEQ ID NO: 402987 - RNA, 64 nt, hsa; identical to SEQ ID NO: 31397

SEQ ID NO: 402988 - RNA, 64 nt, hsa; identical to SEQ ID NO: 31398

SEQ ID NO: 402989 - RNA, 64 nt, hsa; identical to SEQ ID NO: 31399

SEQ ID NO: 402990 - RNA, 64 nt, hsa; identical to SEQ ID NO: 31400

SEQ ID NO: 402991 - RNA, 64 nt, hsa; identical to SEQ ID NO: 31401

SEQ ID NO: 402992 - RNA, 64 nt, hsa; identical to SEQ ID NO: 31402

SEQ ID NO: 402993 - RNA, 64 nt, hsa; identical to SEQ ID NO: 31403

SEQ ID NO: 402994 - RNA, 64 nt, hsa; identical to SEQ ID NO: 31404

SEQ ID NO: 402995 - RNA, 64 nt, hsa; identical to SEQ ID NO: 31405

SEQ ID NO: 402996 - RNA, 64 nt, hsa; identical to SEQ ID NO: 31406

SEQ ID NO: 402997 - RNA, 64 nt, hsa; identical to SEQ ID NO: 31407

SEQ ID NO: 402998 - RNA, 64 nt, hsa; identical to SEQ ID NO: 31408

SEQ ID NO: 402999 - RNA, 64 nt, hsa; identical to SEQ ID NO: 31409

SEQ ID NO: 403000 - RNA, 64 nt, hsa; identical to SEQ ID NO: 31410

SEQ ID NO: 403001 - RNA, 64 nt, hsa; identical to SEQ ID NO: 31411

SEQ ID NO: 403002 - RNA, 64 nt, hsa; identical to SEQ ID NO: 31412

SEQ ID NO: 403003 - RNA, 64 nt, hsa; identical to SEQ ID NO: 31413

SEQ ID NO: 403004 - RNA, 64 nt, hsa; identical to SEQ ID NO: 31414

SEQ ID NO: 403005 - RNA, 64 nt, hsa; identical to SEQ ID NO: 31415

SEQ ID NO: 403006 - RNA, 64 nt, hsa; identical to SEQ ID NO: 31416

SEQ ID NO: 403007 - RNA, 64 nt, hsa; identical to SEQ ID NO: 31417

SEQ ID NO: 403008 - RNA, 64 nt, hsa; identical to SEQ ID NO: 31418

SEQ ID NO: 403009 - RNA, 64 nt, hsa; identical to SEQ ID NO: 31419

SEQ ID NO: 403010 - RNA, 64 nt, hsa; identical to SEQ ID NO: 31420

SEQ ID NO: 403011 - RNA, 64 nt, hsa; identical to SEQ ID NO: 31421

SEQ ID NO: 403012 - RNA, 64 nt, hsa; identical to SEQ ID NO: 31422

SEQ ID NO: 403013 - RNA, 64 nt, hsa; identical to SEQ ID NO: 31423

SEQ ID NO: 403014 - RNA, 64 nt, hsa; identical to SEQ ID NO: 31424

SEQ ID NO: 403015 - RNA, 64 nt, hsa; identical to SEQ ID NO: 31425

SEQ ID NO: 403016 - RNA, 64 nt, hsa; identical to SEQ ID NO: 31426

SEQ ID NO: 403017 - RNA, 64 nt, hsa; identical to SEQ ID NO: 31427

SEQ ID NO: 403018 - RNA, 64 nt, hsa; identical to SEQ ID NO: 31428

SEQ ID NO: 403019 - RNA, 64 nt, hsa; identical to SEQ ID NO: 31429

SEQ ID NO: 403020 - RNA, 64 nt, hsa; identical to SEQ ID NO: 31430

SEQ ID NO: 403021 - RNA, 64 nt, hsa; identical to SEQ ID NO: 31431

SEQ ID NO: 403022 - RNA, 64 nt, hsa; identical to SEQ ID NO: 31432

SEQ ID NO: 403023 - RNA, 64 nt, hsa; identical to SEQ ID NO: 31433

SEQ ID NO: 403024 - RNA, 64 nt, hsa; identical to SEQ ID NO: 31434

SEQ ID NO: 403025 - RNA, 64 nt, hsa; identical to SEQ ID NO: 31435

SEQ ID NO: 403026 - RNA, 64 nt, hsa; identical to SEQ ID NO: 31436

SEQ ID NO: 403027 - RNA, 64 nt, hsa; identical to SEQ ID NO: 31437

SEQ ID NO: 403028 - RNA, 64 nt, hsa; identical to SEQ ID NO: 31438

SEQ ID NO: 403029 - RNA, 64 nt, hsa; identical to SEQ ID NO: 31439

SEQ ID NO: 403030 - RNA, 64 nt, hsa; identical to SEQ ID NO: 31440

SEQ ID NO: 403031 - RNA, 64 nt, hsa; identical to SEQ ID NO: 31441

SEQ ID NO: 403032 - RNA, 64 nt, hsa; identical to SEQ ID NO: 31442

SEQ ID NO: 403033 - RNA, 64 nt, hsa; identical to SEQ ID NO: 31443

SEQ ID NO: 403034 - RNA, 64 nt, hsa; identical to SEQ ID NO: 31444

SEQ ID NO: 403035 - RNA, 64 nt, hsa; identical to SEQ ID NO: 31445

SEQ ID NO: 403036 - RNA, 64 nt, hsa; identical to SEQ ID NO: 31446

SEQ ID NO: 403037 - RNA, 64 nt, hsa; identical to SEQ ID NO: 31447

SEQ ID NO: 403038 - RNA, 64 nt, hsa; identical to SEQ ID NO: 31448

SEQ ID NO: 403039 - RNA, 64 nt, hsa; identical to SEQ ID NO: 31449

SEQ ID NO: 403040 - RNA, 64 nt, hsa; identical to SEQ ID NO: 31450

SEQ ID NO: 403041 - RNA, 64 nt, hsa; identical to SEQ ID NO: 31451

SEQ ID NO: 403042 - RNA, 64 nt, hsa; identical to SEQ ID NO: 31452

SEQ ID NO: 403043 - RNA, 64 nt, hsa; identical to SEQ ID NO: 31453

SEQ ID NO: 403044 - RNA, 64 nt, hsa; identical to SEQ ID NO: 31454

SEQ ID NO: 403045 - RNA, 64 nt, hsa; identical to SEQ ID NO: 31455

SEQ ID NO: 403046 - RNA, 64 nt, hsa; identical to SEQ ID NO: 31456

SEQ ID NO: 403047 - RNA, 64 nt, hsa; identical to SEQ ID NO: 31457

SEQ ID NO: 403048 - RNA, 64 nt, hsa; identical to SEQ ID NO: 31458

SEQ ID NO: 403049 - RNA, 64 nt, hsa; identical to SEQ ID NO: 31459

SEQ ID NO: 403050 - RNA, 64 nt, hsa; identical to SEQ ID NO: 31460

SEQ ID NO: 403051 - RNA, 64 nt, hsa; identical to SEQ ID NO: 31461

SEQ ID NO: 403052 - RNA, 64 nt, hsa; identical to SEQ ID NO: 31462

SEQ ID NO: 403053 - RNA, 64 nt, hsa; identical to SEQ ID NO: 31463

SEQ ID NO: 403054 - RNA, 64 nt, hsa; identical to SEQ ID NO: 31464

SEQ ID NO: 403055 - RNA, 64 nt, hsa; identical to SEQ ID NO: 31465

SEQ ID NO: 403056 - RNA, 64 nt, hsa; identical to SEQ ID NO: 31466

SEQ ID NO: 403057 - RNA, 64 nt, hsa; identical to SEQ ID NO: 31467

SEQ ID NO: 403058 - RNA, 64 nt, hsa; identical to SEQ ID NO: 31468

SEQ ID NO: 403059 - RNA, 64 nt, hsa; identical to SEQ ID NO: 31469

SEQ ID NO: 403060 - RNA, 64 nt, hsa; identical to SEQ ID NO: 31470

SEQ ID NO: 403061 - RNA, 64 nt, hsa; identical to SEQ ID NO: 31471

SEQ ID NO: 403062 - RNA, 64 nt, hsa; identical to SEQ ID NO: 31472

SEQ ID NO: 403063 - RNA, 64 nt, hsa; identical to SEQ ID NO: 31473

SEQ ID NO: 403064 - RNA, 64 nt, hsa; identical to SEQ ID NO: 31474

SEQ ID NO: 403065 - RNA, 64 nt, hsa; identical to SEQ ID NO: 31475

SEQ ID NO: 403066 - RNA, 64 nt, hsa; identical to SEQ ID NO: 31476

SEQ ID NO: 403067 - RNA, 64 nt, hsa; identical to SEQ ID NO: 31477

SEQ ID NO: 403068 - RNA, 64 nt, hsa; identical to SEQ ID NO: 31478

SEQ ID NO: 403069 - RNA, 64 nt, hsa; identical to SEQ ID NO: 31479

SEQ ID NO: 403070 - RNA, 64 nt, hsa; identical to SEQ ID NO: 31480

SEQ ID NO: 403071 - RNA, 64 nt, hsa; identical to SEQ ID NO: 31481

SEQ ID NO: 403072 - RNA, 64 nt, hsa; identical to SEQ ID NO: 31482

SEQ ID NO: 403073 - RNA, 64 nt, hsa; identical to SEQ ID NO: 31483

SEQ ID NO: 403074 - RNA, 64 nt, hsa; identical to SEQ ID NO: 31484

SEQ ID NO: 403075 - RNA, 64 nt, hsa; identical to SEQ ID NO: 31485

SEQ ID NO: 403076 - RNA, 64 nt, hsa; identical to SEQ ID NO: 31486

SEQ ID NO: 403077 - RNA, 64 nt, hsa; identical to SEQ ID NO: 31487

SEQ ID NO: 403078 - RNA, 64 nt, hsa; identical to SEQ ID NO: 31488

SEQ ID NO: 403079 - RNA, 64 nt, hsa; identical to SEQ ID NO: 31489

SEQ ID NO: 403080 - RNA, 64 nt, hsa; identical to SEQ ID NO: 31490

SEQ ID NO: 403081 - RNA, 64 nt, hsa; identical to SEQ ID NO: 31491

SEQ ID NO: 403082 - RNA, 64 nt, hsa; identical to SEQ ID NO: 31492

SEQ ID NO: 403083 - RNA, 64 nt, hsa; identical to SEQ ID NO: 31493

SEQ ID NO: 403084 - RNA, 64 nt, hsa; identical to SEQ ID NO: 31494

SEQ ID NO: 403085 - RNA, 64 nt, hsa; identical to SEQ ID NO: 31495

SEQ ID NO: 403086 - RNA, 64 nt, hsa; identical to SEQ ID NO: 31496

SEQ ID NO: 403087 - RNA, 64 nt, hsa; identical to SEQ ID NO: 31497

SEQ ID NO: 403088 - RNA, 64 nt, hsa; identical to SEQ ID NO: 31498

SEQ ID NO: 403089 - RNA, 64 nt, hsa; identical to SEQ ID NO: 31499

SEQ ID NO: 403090 - RNA, 64 nt, hsa; identical to SEQ ID NO: 31500

SEQ ID NO: 403091 - RNA, 64 nt, hsa; identical to SEQ ID NO: 31501

SEQ ID NO: 403092 - RNA, 64 nt, hsa; identical to SEQ ID NO: 31502

SEQ ID NO: 403093 - RNA, 64 nt, hsa; identical to SEQ ID NO: 31503

SEQ ID NO: 403094 - RNA, 64 nt, hsa; identical to SEQ ID NO: 31504

SEQ ID NO: 403095 - RNA, 64 nt, hsa; identical to SEQ ID NO: 31505

SEQ ID NO: 403096 - RNA, 64 nt, hsa; identical to SEQ ID NO: 31506

SEQ ID NO: 403097 - RNA, 64 nt, hsa; identical to SEQ ID NO: 31507

SEQ ID NO: 403098 - RNA, 64 nt, hsa; identical to SEQ ID NO: 31508

SEQ ID NO: 403099 - RNA, 64 nt, hsa; identical to SEQ ID NO: 31509

SEQ ID NO: 403100 - RNA, 64 nt, hsa; identical to SEQ ID NO: 31510

SEQ ID NO: 403101 - RNA, 64 nt, hsa; identical to SEQ ID NO: 31511

SEQ ID NO: 403102 - RNA, 64 nt, hsa; identical to SEQ ID NO: 31512

SEQ ID NO: 403103 - RNA, 64 nt, hsa; identical to SEQ ID NO: 31513

SEQ ID NO: 403104 - RNA, 64 nt, hsa; identical to SEQ ID NO: 31514

SEQ ID NO: 403105 - RNA, 64 nt, hsa; identical to SEQ ID NO: 31515

SEQ ID NO: 403106 - RNA, 64 nt, hsa; identical to SEQ ID NO: 31516

SEQ ID NO: 403107 - RNA, 64 nt, hsa; identical to SEQ ID NO: 31517

SEQ ID NO: 403108 - RNA, 64 nt, hsa; identical to SEQ ID NO: 31518

SEQ ID NO: 403109 - RNA, 64 nt, hsa; identical to SEQ ID NO: 31519

SEQ ID NO: 403110 - RNA, 64 nt, hsa; identical to SEQ ID NO: 31520

SEQ ID NO: 403111 - RNA, 64 nt, hsa; identical to SEQ ID NO: 31521

SEQ ID NO: 403112 - RNA, 64 nt, hsa; identical to SEQ ID NO: 31522

SEQ ID NO: 403113 - RNA, 64 nt, hsa; identical to SEQ ID NO: 31523

SEQ ID NO: 403114 - RNA, 64 nt, hsa; identical to SEQ ID NO: 31524

SEQ ID NO: 403115 - RNA, 64 nt, hsa; identical to SEQ ID NO: 31525

SEQ ID NO: 403116 - RNA, 64 nt, hsa; identical to SEQ ID NO: 31526

SEQ ID NO: 403117 - RNA, 64 nt, hsa; identical to SEQ ID NO: 31527

SEQ ID NO: 403118 - RNA, 64 nt, hsa; identical to SEQ ID NO: 31528

SEQ ID NO: 403119 - RNA, 64 nt, hsa; identical to SEQ ID NO: 31529

SEQ ID NO: 403120 - RNA, 64 nt, hsa; identical to SEQ ID NO: 31530

SEQ ID NO: 403121 - RNA, 64 nt, hsa; identical to SEQ ID NO: 31531

SEQ ID NO: 403122 - RNA, 64 nt, hsa; identical to SEQ ID NO: 31532

SEQ ID NO: 403123 - RNA, 64 nt, hsa; identical to SEQ ID NO: 31533

SEQ ID NO: 403124 - RNA, 64 nt, hsa; identical to SEQ ID NO: 31534

SEQ ID NO: 403125 - RNA, 64 nt, hsa; identical to SEQ ID NO: 31535

SEQ ID NO: 403126 - RNA, 64 nt, hsa; identical to SEQ ID NO: 31536

SEQ ID NO: 403127 - RNA, 64 nt, hsa; identical to SEQ ID NO: 31537

SEQ ID NO: 403128 - RNA, 64 nt, hsa; identical to SEQ ID NO: 31538

SEQ ID NO: 403129 - RNA, 64 nt, hsa; identical to SEQ ID NO: 31539

SEQ ID NO: 403130 - RNA, 64 nt, hsa; identical to SEQ ID NO: 31540

SEQ ID NO: 403131 - RNA, 64 nt, hsa; identical to SEQ ID NO: 31541

SEQ ID NO: 403132 - RNA, 64 nt, hsa; identical to SEQ ID NO: 31542

SEQ ID NO: 403133 - RNA, 64 nt, hsa; identical to SEQ ID NO: 31543

SEQ ID NO: 403134 - RNA, 64 nt, hsa; identical to SEQ ID NO: 31544

SEQ ID NO: 403135 - RNA, 64 nt, hsa; identical to SEQ ID NO: 31545

SEQ ID NO: 403136 - RNA, 64 nt, hsa; identical to SEQ ID NO: 31546

SEQ ID NO: 403137 - RNA, 64 nt, hsa; identical to SEQ ID NO: 31547

SEQ ID NO: 403138 - RNA, 64 nt, hsa; identical to SEQ ID NO: 31548

SEQ ID NO: 403139 - RNA, 64 nt, hsa; identical to SEQ ID NO: 31549

SEQ ID NO: 403140 - RNA, 64 nt, hsa; identical to SEQ ID NO: 31550

SEQ ID NO: 403141 - RNA, 64 nt, hsa; identical to SEQ ID NO: 31551

SEQ ID NO: 403142 - RNA, 64 nt, hsa; identical to SEQ ID NO: 31552

SEQ ID NO: 403143 - RNA, 64 nt, hsa; identical to SEQ ID NO: 31553

SEQ ID NO: 403144 - RNA, 64 nt, hsa; identical to SEQ ID NO: 31554

SEQ ID NO: 403145 - RNA, 64 nt, hsa; identical to SEQ ID NO: 31555

SEQ ID NO: 403146 - RNA, 64 nt, hsa; identical to SEQ ID NO: 31556

SEQ ID NO: 403147 - RNA, 50 nt, hsa; identical to SEQ ID NO: 31557

SEQ ID NO: 403148 - RNA, 51 nt, hsa; identical to SEQ ID NO: 31558

SEQ ID NO: 403149 - RNA, 64 nt, hsa; identical to SEQ ID NO: 31559

SEQ ID NO: 403150 - RNA, 64 nt, hsa; identical to SEQ ID NO: 31560

SEQ ID NO: 403151 - RNA, 64 nt, hsa; identical to SEQ ID NO: 31561

SEQ ID NO: 403152 - RNA, 64 nt, hsa; identical to SEQ ID NO: 31562

SEQ ID NO: 403153 - RNA, 64 nt, hsa; identical to SEQ ID NO: 31563

SEQ ID NO: 403154 - RNA, 64 nt, hsa; identical to SEQ ID NO: 31564

SEQ ID NO: 403155 - RNA, 64 nt, hsa; identical to SEQ ID NO: 31565

SEQ ID NO: 403156 - RNA, 64 nt, hsa; identical to SEQ ID NO: 31566

SEQ ID NO: 403157 - RNA, 64 nt, hsa; identical to SEQ ID NO: 31567

SEQ ID NO: 403158 - RNA, 64 nt, hsa; identical to SEQ ID NO: 31568

SEQ ID NO: 403159 - RNA, 64 nt, hsa; identical to SEQ ID NO: 31569

SEQ ID NO: 403160 - RNA, 64 nt, hsa; identical to SEQ ID NO: 31570

SEQ ID NO: 403161 - RNA, 64 nt, hsa; identical to SEQ ID NO: 31571

SEQ ID NO: 403162 - RNA, 64 nt, hsa; identical to SEQ ID NO: 31572

SEQ ID NO: 403163 - RNA, 64 nt, hsa; identical to SEQ ID NO: 31573

SEQ ID NO: 403164 - RNA, 64 nt, hsa; identical to SEQ ID NO: 31574

SEQ ID NO: 403165 - RNA, 64 nt, hsa; identical to SEQ ID NO: 31575

SEQ ID NO: 403166 - RNA, 64 nt, hsa; identical to SEQ ID NO: 31576

SEQ ID NO: 403167 - RNA, 64 nt, hsa; identical to SEQ ID NO: 31577

SEQ ID NO: 403168 - RNA, 64 nt, hsa; identical to SEQ ID NO: 31578

SEQ ID NO: 403169 - RNA, 64 nt, hsa; identical to SEQ ID NO: 31579

SEQ ID NO: 403170 - RNA, 64 nt, hsa; identical to SEQ ID NO: 31580

SEQ ID NO: 403171 - RNA, 64 nt, hsa; identical to SEQ ID NO: 31581

SEQ ID NO: 403172 - RNA, 64 nt, hsa; identical to SEQ ID NO: 31582

SEQ ID NO: 403173 - RNA, 64 nt, hsa; identical to SEQ ID NO: 31583

SEQ ID NO: 403174 - RNA, 64 nt, hsa; identical to SEQ ID NO: 31584

SEQ ID NO: 403175 - RNA, 64 nt, hsa; identical to SEQ ID NO: 31585

SEQ ID NO: 403176 - RNA, 64 nt, hsa; identical to SEQ ID NO: 31586

SEQ ID NO: 403177 - RNA, 64 nt, hsa; identical to SEQ ID NO: 31587

SEQ ID NO: 403178 - RNA, 64 nt, hsa; identical to SEQ ID NO: 31588

SEQ ID NO: 403179 - RNA, 64 nt, hsa; identical to SEQ ID NO: 31589

SEQ ID NO: 403180 - RNA, 64 nt, hsa; identical to SEQ ID NO: 31590

SEQ ID NO: 403181 - RNA, 64 nt, hsa; identical to SEQ ID NO: 31591

SEQ ID NO: 403182 - RNA, 64 nt, hsa; identical to SEQ ID NO: 31592

SEQ ID NO: 403183 - RNA, 64 nt, hsa; identical to SEQ ID NO: 31593

SEQ ID NO: 403184 - RNA, 64 nt, hsa; identical to SEQ ID NO: 31594

SEQ ID NO: 403185 - RNA, 64 nt, hsa; identical to SEQ ID NO: 31595

SEQ ID NO: 403186 - RNA, 64 nt, hsa; identical to SEQ ID NO: 31596

SEQ ID NO: 403187 - RNA, 64 nt, hsa; identical to SEQ ID NO: 31597

SEQ ID NO: 403188 - RNA, 64 nt, hsa; identical to SEQ ID NO: 31598

SEQ ID NO: 403189 - RNA, 64 nt, hsa; identical to SEQ ID NO: 31599

SEQ ID NO: 403190 - RNA, 64 nt, hsa; identical to SEQ ID NO: 31600

SEQ ID NO: 403191 - RNA, 64 nt, hsa; identical to SEQ ID NO: 31601

SEQ ID NO: 403192 - RNA, 64 nt, hsa; identical to SEQ ID NO: 31602

SEQ ID NO: 403193 - RNA, 64 nt, hsa; identical to SEQ ID NO: 31603

SEQ ID NO: 403194 - RNA, 64 nt, hsa; identical to SEQ ID NO: 31604

SEQ ID NO: 403195 - RNA, 64 nt, hsa; identical to SEQ ID NO: 31605

SEQ ID NO: 403196 - RNA, 64 nt, hsa; identical to SEQ ID NO: 31606

SEQ ID NO: 403197 - RNA, 64 nt, hsa; identical to SEQ ID NO: 31607

SEQ ID NO: 403198 - RNA, 64 nt, hsa; identical to SEQ ID NO: 31608

SEQ ID NO: 403199 - RNA, 64 nt, hsa; identical to SEQ ID NO: 31609

SEQ ID NO: 403200 - RNA, 64 nt, hsa; identical to SEQ ID NO: 31610

SEQ ID NO: 403201 - RNA, 64 nt, hsa; identical to SEQ ID NO: 31611

SEQ ID NO: 403202 - RNA, 64 nt, hsa; identical to SEQ ID NO: 31612

SEQ ID NO: 403203 - RNA, 64 nt, hsa; identical to SEQ ID NO: 31613

SEQ ID NO: 403204 - RNA, 64 nt, hsa; identical to SEQ ID NO: 31614

SEQ ID NO: 403205 - RNA, 64 nt, hsa; identical to SEQ ID NO: 31615

SEQ ID NO: 403206 - RNA, 64 nt, hsa; identical to SEQ ID NO: 31616

SEQ ID NO: 403207 - RNA, 64 nt, hsa; identical to SEQ ID NO: 31617

SEQ ID NO: 403208 - RNA, 64 nt, hsa; identical to SEQ ID NO: 31618

SEQ ID NO: 403209 - RNA, 64 nt, hsa; identical to SEQ ID NO: 31619

SEQ ID NO: 403210 - RNA, 64 nt, hsa; identical to SEQ ID NO: 31620

SEQ ID NO: 403211 - RNA, 64 nt, hsa; identical to SEQ ID NO: 31621

SEQ ID NO: 403212 - RNA, 55 nt, hsa; identical to SEQ ID NO: 31622

SEQ ID NO: 403213 - RNA, 54 nt, hsa; identical to SEQ ID NO: 31623

SEQ ID NO: 403214 - RNA, 64 nt, hsa; identical to SEQ ID NO: 31624

SEQ ID NO: 403215 - RNA, 64 nt, hsa; identical to SEQ ID NO: 31625

SEQ ID NO: 403216 - RNA, 64 nt, hsa; identical to SEQ ID NO: 31626

SEQ ID NO: 403217 - RNA, 64 nt, hsa; identical to SEQ ID NO: 31627

SEQ ID NO: 403218 - RNA, 64 nt, hsa; identical to SEQ ID NO: 31628

SEQ ID NO: 403219 - RNA, 64 nt, hsa; identical to SEQ ID NO: 31629

SEQ ID NO: 403220 - RNA, 64 nt, hsa; identical to SEQ ID NO: 31630

SEQ ID NO: 403221 - RNA, 64 nt, hsa; identical to SEQ ID NO: 31631

SEQ ID NO: 403222 - RNA, 64 nt, hsa; identical to SEQ ID NO: 31632

SEQ ID NO: 403223 - RNA, 64 nt, hsa; identical to SEQ ID NO: 31633

SEQ ID NO: 403224 - RNA, 64 nt, hsa; identical to SEQ ID NO: 31634

SEQ ID NO: 403225 - RNA, 64 nt, hsa; identical to SEQ ID NO: 31635

SEQ ID NO: 403226 - RNA, 64 nt, hsa; identical to SEQ ID NO: 31636

SEQ ID NO: 403227 - RNA, 64 nt, hsa; identical to SEQ ID NO: 31637

SEQ ID NO: 403228 - RNA, 64 nt, hsa; identical to SEQ ID NO: 31638

SEQ ID NO: 403229 - RNA, 64 nt, hsa; identical to SEQ ID NO: 31639

SEQ ID NO: 403230 - RNA, 64 nt, hsa; identical to SEQ ID NO: 31640

SEQ ID NO: 403231 - RNA, 64 nt, hsa; identical to SEQ ID NO: 31641

SEQ ID NO: 403232 - RNA, 64 nt, hsa; identical to SEQ ID NO: 31642

SEQ ID NO: 403233 - RNA, 64 nt, hsa; identical to SEQ ID NO: 31643

SEQ ID NO: 403234 - RNA, 64 nt, hsa; identical to SEQ ID NO: 31644

SEQ ID NO: 403235 - RNA, 64 nt, hsa; identical to SEQ ID NO: 31645

SEQ ID NO: 403236 - RNA, 64 nt, hsa; identical to SEQ ID NO: 31646

SEQ ID NO: 403237 - RNA, 64 nt, hsa; identical to SEQ ID NO: 31647

SEQ ID NO: 403238 - RNA, 64 nt, hsa; identical to SEQ ID NO: 31648

SEQ ID NO: 403239 - RNA, 64 nt, hsa; identical to SEQ ID NO: 31649

SEQ ID NO: 403240 - RNA, 64 nt, hsa; identical to SEQ ID NO: 31650

SEQ ID NO: 403241 - RNA, 64 nt, hsa; identical to SEQ ID NO: 31651

SEQ ID NO: 403242 - RNA, 64 nt, hsa; identical to SEQ ID NO: 31652

SEQ ID NO: 403243 - RNA, 64 nt, hsa; identical to SEQ ID NO: 31653

SEQ ID NO: 403244 - RNA, 64 nt, hsa; identical to SEQ ID NO: 31654

SEQ ID NO: 403245 - RNA, 64 nt, hsa; identical to SEQ ID NO: 31655

SEQ ID NO: 403246 - RNA, 64 nt, hsa; identical to SEQ ID NO: 31656

SEQ ID NO: 403247 - RNA, 64 nt, hsa; identical to SEQ ID NO: 31657

SEQ ID NO: 403248 - RNA, 64 nt, hsa; identical to SEQ ID NO: 31658

SEQ ID NO: 403249 - RNA, 64 nt, hsa; identical to SEQ ID NO: 31659

SEQ ID NO: 403250 - RNA, 64 nt, hsa; identical to SEQ ID NO: 31660

SEQ ID NO: 403251 - RNA, 64 nt, hsa; identical to SEQ ID NO: 31661

SEQ ID NO: 403252 - RNA, 64 nt, hsa; identical to SEQ ID NO: 31662

SEQ ID NO: 403253 - RNA, 64 nt, hsa; identical to SEQ ID NO: 31663

SEQ ID NO: 403254 - RNA, 64 nt, hsa; identical to SEQ ID NO: 31664

SEQ ID NO: 403255 - RNA, 64 nt, hsa; identical to SEQ ID NO: 31665

SEQ ID NO: 403256 - RNA, 64 nt, hsa; identical to SEQ ID NO: 31666

SEQ ID NO: 403257 - RNA, 64 nt, hsa; identical to SEQ ID NO: 31667

SEQ ID NO: 403258 - RNA, 64 nt, hsa; identical to SEQ ID NO: 31668

SEQ ID NO: 403259 - RNA, 64 nt, hsa; identical to SEQ ID NO: 31669

SEQ ID NO: 403260 - RNA, 64 nt, hsa; identical to SEQ ID NO: 31670

SEQ ID NO: 403261 - RNA, 64 nt, hsa; identical to SEQ ID NO: 31671

SEQ ID NO: 403262 - RNA, 64 nt, hsa; identical to SEQ ID NO: 31672

SEQ ID NO: 403263 - RNA, 64 nt, hsa; identical to SEQ ID NO: 31673

SEQ ID NO: 403264 - RNA, 60 nt, hsa; identical to SEQ ID NO: 31674

SEQ ID NO: 403265 - RNA, 64 nt, hsa; identical to SEQ ID NO: 31675

SEQ ID NO: 403266 - RNA, 64 nt, hsa; identical to SEQ ID NO: 31676

SEQ ID NO: 403267 - RNA, 64 nt, hsa; identical to SEQ ID NO: 31677

SEQ ID NO: 403268 - RNA, 64 nt, hsa; identical to SEQ ID NO: 31678

SEQ ID NO: 403269 - RNA, 64 nt, hsa; identical to SEQ ID NO: 31679

SEQ ID NO: 403270 - RNA, 64 nt, hsa; identical to SEQ ID NO: 31680

SEQ ID NO: 403271 - RNA, 64 nt, hsa; identical to SEQ ID NO: 31681

SEQ ID NO: 403272 - RNA, 64 nt, hsa; identical to SEQ ID NO: 31682

SEQ ID NO: 403273 - RNA, 64 nt, hsa; identical to SEQ ID NO: 31683

SEQ ID NO: 403274 - RNA, 64 nt, hsa; identical to SEQ ID NO: 31684

SEQ ID NO: 403275 - RNA, 64 nt, hsa; identical to SEQ ID NO: 31685

SEQ ID NO: 403276 - RNA, 64 nt, hsa; identical to SEQ ID NO: 31686

SEQ ID NO: 403277 - RNA, 64 nt, hsa; identical to SEQ ID NO: 31687

SEQ ID NO: 403278 - RNA, 64 nt, hsa; identical to SEQ ID NO: 31688

SEQ ID NO: 403279 - RNA, 64 nt, hsa; identical to SEQ ID NO: 31689

SEQ ID NO: 403280 - RNA, 64 nt, hsa; identical to SEQ ID NO: 31690

SEQ ID NO: 403281 - RNA, 64 nt, hsa; identical to SEQ ID NO: 31691

SEQ ID NO: 403282 - RNA, 64 nt, hsa; identical to SEQ ID NO: 31692

SEQ ID NO: 403283 - RNA, 64 nt, hsa; identical to SEQ ID NO: 31693

SEQ ID NO: 403284 - RNA, 64 nt, hsa; identical to SEQ ID NO: 31694

SEQ ID NO: 403285 - RNA, 64 nt, hsa; identical to SEQ ID NO: 31695

SEQ ID NO: 403286 - RNA, 64 nt, hsa; identical to SEQ ID NO: 31696

SEQ ID NO: 403287 - RNA, 64 nt, hsa; identical to SEQ ID NO: 31697

SEQ ID NO: 403288 - RNA, 64 nt, hsa; identical to SEQ ID NO: 31698

SEQ ID NO: 403289 - RNA, 64 nt, hsa; identical to SEQ ID NO: 31699

SEQ ID NO: 403290 - RNA, 64 nt, hsa; identical to SEQ ID NO: 31700

SEQ ID NO: 403291 - RNA, 64 nt, hsa; identical to SEQ ID NO: 31701

SEQ ID NO: 403292 - RNA, 64 nt, hsa; identical to SEQ ID NO: 31702

SEQ ID NO: 403293 - RNA, 64 nt, hsa; identical to SEQ ID NO: 31703

SEQ ID NO: 403294 - RNA, 64 nt, hsa; identical to SEQ ID NO: 31704

SEQ ID NO: 403295 - RNA, 64 nt, hsa; identical to SEQ ID NO: 31705

SEQ ID NO: 403296 - RNA, 64 nt, hsa; identical to SEQ ID NO: 31706

SEQ ID NO: 403297 - RNA, 64 nt, hsa; identical to SEQ ID NO: 31707

SEQ ID NO: 403298 - RNA, 64 nt, hsa; identical to SEQ ID NO: 31708

SEQ ID NO: 403299 - RNA, 64 nt, hsa; identical to SEQ ID NO: 31709

SEQ ID NO: 403300 - RNA, 64 nt, hsa; identical to SEQ ID NO: 31710

SEQ ID NO: 403301 - RNA, 64 nt, hsa; identical to SEQ ID NO: 31711

SEQ ID NO: 403302 - RNA, 64 nt, hsa; identical to SEQ ID NO: 31712

SEQ ID NO: 403303 - RNA, 64 nt, hsa; identical to SEQ ID NO: 31713

SEQ ID NO: 403304 - RNA, 64 nt, hsa; identical to SEQ ID NO: 31714

SEQ ID NO: 403305 - RNA, 64 nt, hsa; identical to SEQ ID NO: 31715

SEQ ID NO: 403306 - RNA, 64 nt, hsa; identical to SEQ ID NO: 31716

SEQ ID NO: 403307 - RNA, 64 nt, hsa; identical to SEQ ID NO: 31717

SEQ ID NO: 403308 - RNA, 64 nt, hsa; identical to SEQ ID NO: 31718

SEQ ID NO: 403309 - RNA, 64 nt, hsa; identical to SEQ ID NO: 31719

SEQ ID NO: 403310 - RNA, 64 nt, hsa; identical to SEQ ID NO: 31720

SEQ ID NO: 403311 - RNA, 64 nt, hsa; identical to SEQ ID NO: 31721

SEQ ID NO: 403312 - RNA, 64 nt, hsa; identical to SEQ ID NO: 31722

SEQ ID NO: 403313 - RNA, 64 nt, hsa; identical to SEQ ID NO: 31723

SEQ ID NO: 403314 - RNA, 64 nt, hsa; identical to SEQ ID NO: 31724

SEQ ID NO: 403315 - RNA, 64 nt, hsa; identical to SEQ ID NO: 31725

SEQ ID NO: 403316 - RNA, 64 nt, hsa; identical to SEQ ID NO: 31726

SEQ ID NO: 403317 - RNA, 64 nt, hsa; identical to SEQ ID NO: 31727

SEQ ID NO: 403318 - RNA, 64 nt, hsa; identical to SEQ ID NO: 31728

SEQ ID NO: 403319 - RNA, 64 nt, hsa; identical to SEQ ID NO: 31729

SEQ ID NO: 403320 - RNA, 64 nt, hsa; identical to SEQ ID NO: 31730

SEQ ID NO: 403321 - RNA, 64 nt, hsa; identical to SEQ ID NO: 31731

SEQ ID NO: 403322 - RNA, 64 nt, hsa; identical to SEQ ID NO: 31732

SEQ ID NO: 403323 - RNA, 64 nt, hsa; identical to SEQ ID NO: 31733

SEQ ID NO: 403324 - RNA, 64 nt, hsa; identical to SEQ ID NO: 31734

SEQ ID NO: 403325 - RNA, 64 nt, hsa; identical to SEQ ID NO: 31735

SEQ ID NO: 403326 - RNA, 64 nt, hsa; identical to SEQ ID NO: 31736

SEQ ID NO: 403327 - RNA, 64 nt, hsa; identical to SEQ ID NO: 31737

SEQ ID NO: 403328 - RNA, 64 nt, hsa; identical to SEQ ID NO: 31738

SEQ ID NO: 403329 - RNA, 64 nt, hsa; identical to SEQ ID NO: 31739

SEQ ID NO: 403330 - RNA, 64 nt, hsa; identical to SEQ ID NO: 31740

SEQ ID NO: 403331 - RNA, 64 nt, hsa; identical to SEQ ID NO: 31741

SEQ ID NO: 403332 - RNA, 64 nt, hsa; identical to SEQ ID NO: 31742

SEQ ID NO: 403333 - RNA, 64 nt, hsa; identical to SEQ ID NO: 31743

SEQ ID NO: 403334 - RNA, 64 nt, hsa; identical to SEQ ID NO: 31744

SEQ ID NO: 403335 - RNA, 64 nt, hsa; identical to SEQ ID NO: 31745

SEQ ID NO: 403336 - RNA, 64 nt, hsa; identical to SEQ ID NO: 31746

SEQ ID NO: 403337 - RNA, 64 nt, hsa; identical to SEQ ID NO: 31747

SEQ ID NO: 403338 - RNA, 64 nt, hsa; identical to SEQ ID NO: 31748

SEQ ID NO: 403339 - RNA, 64 nt, hsa; identical to SEQ ID NO: 31749

SEQ ID NO: 403340 - RNA, 64 nt, hsa; identical to SEQ ID NO: 31750

SEQ ID NO: 403341 - RNA, 64 nt, hsa; identical to SEQ ID NO: 31751

SEQ ID NO: 403342 - RNA, 64 nt, hsa; identical to SEQ ID NO: 31752

SEQ ID NO: 403343 - RNA, 64 nt, hsa; identical to SEQ ID NO: 31753

SEQ ID NO: 403344 - RNA, 64 nt, hsa; identical to SEQ ID NO: 31754

SEQ ID NO: 403345 - RNA, 64 nt, hsa; identical to SEQ ID NO: 31755

SEQ ID NO: 403346 - RNA, 64 nt, hsa; identical to SEQ ID NO: 31756

SEQ ID NO: 403347 - RNA, 64 nt, hsa; identical to SEQ ID NO: 31757

SEQ ID NO: 403348 - RNA, 64 nt, hsa; identical to SEQ ID NO: 31758

SEQ ID NO: 403349 - RNA, 64 nt, hsa; identical to SEQ ID NO: 31759

SEQ ID NO: 403350 - RNA, 64 nt, hsa; identical to SEQ ID NO: 31760

SEQ ID NO: 403351 - RNA, 64 nt, hsa; identical to SEQ ID NO: 31761

SEQ ID NO: 403352 - RNA, 64 nt, hsa; identical to SEQ ID NO: 31762

SEQ ID NO: 403353 - RNA, 64 nt, hsa; identical to SEQ ID NO: 31763

SEQ ID NO: 403354 - RNA, 64 nt, hsa; identical to SEQ ID NO: 31764

SEQ ID NO: 403355 - RNA, 64 nt, hsa; identical to SEQ ID NO: 31765

SEQ ID NO: 403356 - RNA, 64 nt, hsa; identical to SEQ ID NO: 31766

SEQ ID NO: 403357 - RNA, 64 nt, hsa; identical to SEQ ID NO: 31767

SEQ ID NO: 403358 - RNA, 64 nt, hsa; identical to SEQ ID NO: 31768

SEQ ID NO: 403359 - RNA, 64 nt, hsa; identical to SEQ ID NO: 31769

SEQ ID NO: 403360 - RNA, 64 nt, hsa; identical to SEQ ID NO: 31770

SEQ ID NO: 403361 - RNA, 64 nt, hsa; identical to SEQ ID NO: 31771

SEQ ID NO: 403362 - RNA, 64 nt, hsa; identical to SEQ ID NO: 31772

SEQ ID NO: 403363 - RNA, 64 nt, hsa; identical to SEQ ID NO: 31773

SEQ ID NO: 403364 - RNA, 64 nt, hsa; identical to SEQ ID NO: 31774

SEQ ID NO: 403365 - RNA, 64 nt, hsa; identical to SEQ ID NO: 31775

SEQ ID NO: 403366 - RNA, 64 nt, hsa; identical to SEQ ID NO: 31776

SEQ ID NO: 403367 - RNA, 64 nt, hsa; identical to SEQ ID NO: 31777

SEQ ID NO: 403368 - RNA, 64 nt, hsa; identical to SEQ ID NO: 31778

SEQ ID NO: 403369 - RNA, 64 nt, hsa; identical to SEQ ID NO: 31779

SEQ ID NO: 403370 - RNA, 64 nt, hsa; identical to SEQ ID NO: 31780

SEQ ID NO: 403371 - RNA, 64 nt, hsa; identical to SEQ ID NO: 31781

SEQ ID NO: 403372 - RNA, 64 nt, hsa; identical to SEQ ID NO: 31782

SEQ ID NO: 403373 - RNA, 64 nt, hsa; identical to SEQ ID NO: 31783

SEQ ID NO: 403374 - RNA, 64 nt, hsa; identical to SEQ ID NO: 31784

SEQ ID NO: 403375 - RNA, 64 nt, hsa; identical to SEQ ID NO: 31785

SEQ ID NO: 403376 - RNA, 64 nt, hsa; identical to SEQ ID NO: 31786

SEQ ID NO: 403377 - RNA, 64 nt, hsa; identical to SEQ ID NO: 31787

SEQ ID NO: 403378 - RNA, 64 nt, hsa; identical to SEQ ID NO: 31788

SEQ ID NO: 403379 - RNA, 64 nt, hsa; identical to SEQ ID NO: 31789

SEQ ID NO: 403380 - RNA, 64 nt, hsa; identical to SEQ ID NO: 31790

SEQ ID NO: 403381 - RNA, 64 nt, hsa; identical to SEQ ID NO: 31791

SEQ ID NO: 403382 - RNA, 64 nt, hsa; identical to SEQ ID NO: 31792

SEQ ID NO: 403383 - RNA, 64 nt, hsa; identical to SEQ ID NO: 31793

SEQ ID NO: 403384 - RNA, 64 nt, hsa; identical to SEQ ID NO: 31794

SEQ ID NO: 403385 - RNA, 64 nt, hsa; identical to SEQ ID NO: 31795

SEQ ID NO: 403386 - RNA, 64 nt, hsa; identical to SEQ ID NO: 31796

SEQ ID NO: 403387 - RNA, 64 nt, hsa; identical to SEQ ID NO: 31797

SEQ ID NO: 403388 - RNA, 64 nt, hsa; identical to SEQ ID NO: 31798

SEQ ID NO: 403389 - RNA, 64 nt, hsa; identical to SEQ ID NO: 31799

SEQ ID NO: 403390 - RNA, 64 nt, hsa; identical to SEQ ID NO: 31800

SEQ ID NO: 403391 - RNA, 64 nt, hsa; identical to SEQ ID NO: 31801

SEQ ID NO: 403392 - RNA, 64 nt, hsa; identical to SEQ ID NO: 31802

SEQ ID NO: 403393 - RNA, 64 nt, hsa; identical to SEQ ID NO: 31803

SEQ ID NO: 403394 - RNA, 64 nt, hsa; identical to SEQ ID NO: 31804

SEQ ID NO: 403395 - RNA, 64 nt, hsa; identical to SEQ ID NO: 31805

SEQ ID NO: 403396 - RNA, 64 nt, hsa; identical to SEQ ID NO: 31806

SEQ ID NO: 403397 - RNA, 64 nt, hsa; identical to SEQ ID NO: 31807

SEQ ID NO: 403398 - RNA, 64 nt, hsa; identical to SEQ ID NO: 31808

SEQ ID NO: 403399 - RNA, 64 nt, hsa; identical to SEQ ID NO: 31809

SEQ ID NO: 403400 - RNA, 64 nt, hsa; identical to SEQ ID NO: 31810

SEQ ID NO: 403401 - RNA, 64 nt, hsa; identical to SEQ ID NO: 31811

SEQ ID NO: 403402 - RNA, 64 nt, hsa; identical to SEQ ID NO: 31812

SEQ ID NO: 403403 - RNA, 64 nt, hsa; identical to SEQ ID NO: 31813

SEQ ID NO: 403404 - RNA, 64 nt, hsa; identical to SEQ ID NO: 31814

SEQ ID NO: 403405 - RNA, 64 nt, hsa; identical to SEQ ID NO: 31815

SEQ ID NO: 403406 - RNA, 64 nt, hsa; identical to SEQ ID NO: 31816

SEQ ID NO: 403407 - RNA, 64 nt, hsa; identical to SEQ ID NO: 31817

SEQ ID NO: 403408 - RNA, 64 nt, hsa; identical to SEQ ID NO: 31818

SEQ ID NO: 403409 - RNA, 64 nt, hsa; identical to SEQ ID NO: 31819

SEQ ID NO: 403410 - RNA, 64 nt, hsa; identical to SEQ ID NO: 31820

SEQ ID NO: 403411 - RNA, 64 nt, hsa; identical to SEQ ID NO: 31821

SEQ ID NO: 403412 - RNA, 64 nt, hsa; identical to SEQ ID NO: 31822

SEQ ID NO: 403413 - RNA, 64 nt, hsa; identical to SEQ ID NO: 31823

SEQ ID NO: 403414 - RNA, 64 nt, hsa; identical to SEQ ID NO: 31824

SEQ ID NO: 403415 - RNA, 64 nt, hsa; identical to SEQ ID NO: 31825

SEQ ID NO: 403416 - RNA, 64 nt, hsa; identical to SEQ ID NO: 31826

SEQ ID NO: 403417 - RNA, 64 nt, hsa; identical to SEQ ID NO: 31827

SEQ ID NO: 403418 - RNA, 64 nt, hsa; identical to SEQ ID NO: 31828

SEQ ID NO: 403419 - RNA, 64 nt, hsa; identical to SEQ ID NO: 31829

SEQ ID NO: 403420 - RNA, 64 nt, hsa; identical to SEQ ID NO: 31830

SEQ ID NO: 403421 - RNA, 64 nt, hsa; identical to SEQ ID NO: 31831

SEQ ID NO: 403422 - RNA, 64 nt, hsa; identical to SEQ ID NO: 31832

SEQ ID NO: 403423 - RNA, 64 nt, hsa; identical to SEQ ID NO: 31833

SEQ ID NO: 403424 - RNA, 64 nt, hsa; identical to SEQ ID NO: 31834

SEQ ID NO: 403425 - RNA, 64 nt, hsa; identical to SEQ ID NO: 31835

SEQ ID NO: 403426 - RNA, 64 nt, hsa; identical to SEQ ID NO: 31836

SEQ ID NO: 403427 - RNA, 64 nt, hsa; identical to SEQ ID NO: 31837

SEQ ID NO: 403428 - RNA, 64 nt, hsa; identical to SEQ ID NO: 31838

SEQ ID NO: 403429 - RNA, 64 nt, hsa; identical to SEQ ID NO: 31839

SEQ ID NO: 403430 - RNA, 64 nt, hsa; identical to SEQ ID NO: 31840

SEQ ID NO: 403431 - RNA, 64 nt, hsa; identical to SEQ ID NO: 31841

SEQ ID NO: 403432 - RNA, 64 nt, hsa; identical to SEQ ID NO: 31842

SEQ ID NO: 403433 - RNA, 64 nt, hsa; identical to SEQ ID NO: 31843

SEQ ID NO: 403434 - RNA, 64 nt, hsa; identical to SEQ ID NO: 31844

SEQ ID NO: 403435 - RNA, 64 nt, hsa; identical to SEQ ID NO: 31845

SEQ ID NO: 403436 - RNA, 64 nt, hsa; identical to SEQ ID NO: 31846

SEQ ID NO: 403437 - RNA, 64 nt, hsa; identical to SEQ ID NO: 31847

SEQ ID NO: 403438 - RNA, 64 nt, hsa; identical to SEQ ID NO: 31848

SEQ ID NO: 403439 - RNA, 64 nt, hsa; identical to SEQ ID NO: 31849

SEQ ID NO: 403440 - RNA, 64 nt, hsa; identical to SEQ ID NO: 31850

SEQ ID NO: 403441 - RNA, 64 nt, hsa; identical to SEQ ID NO: 31851

SEQ ID NO: 403442 - RNA, 64 nt, hsa; identical to SEQ ID NO: 31852

SEQ ID NO: 403443 - RNA, 64 nt, hsa; identical to SEQ ID NO: 31853

SEQ ID NO: 403444 - RNA, 64 nt, hsa; identical to SEQ ID NO: 31854

SEQ ID NO: 403445 - RNA, 64 nt, hsa; identical to SEQ ID NO: 31855

SEQ ID NO: 403446 - RNA, 64 nt, hsa; identical to SEQ ID NO: 31856

SEQ ID NO: 403447 - RNA, 64 nt, hsa; identical to SEQ ID NO: 31857

SEQ ID NO: 403448 - RNA, 64 nt, hsa; identical to SEQ ID NO: 31858

SEQ ID NO: 403449 - RNA, 64 nt, hsa; identical to SEQ ID NO: 31859

SEQ ID NO: 403450 - RNA, 64 nt, hsa; identical to SEQ ID NO: 31860

SEQ ID NO: 403451 - RNA, 64 nt, hsa; identical to SEQ ID NO: 31861

SEQ ID NO: 403452 - RNA, 64 nt, hsa; identical to SEQ ID NO: 31862

SEQ ID NO: 403453 - RNA, 64 nt, hsa; identical to SEQ ID NO: 31863

SEQ ID NO: 403454 - RNA, 64 nt, hsa; identical to SEQ ID NO: 31864

SEQ ID NO: 403455 - RNA, 64 nt, hsa; identical to SEQ ID NO: 31865

SEQ ID NO: 403456 - RNA, 64 nt, hsa; identical to SEQ ID NO: 31866

SEQ ID NO: 403457 - RNA, 64 nt, hsa; identical to SEQ ID NO: 31867

SEQ ID NO: 403458 - RNA, 64 nt, hsa; identical to SEQ ID NO: 31868

SEQ ID NO: 403459 - RNA, 64 nt, hsa; identical to SEQ ID NO: 31869

SEQ ID NO: 403460 - RNA, 64 nt, hsa; identical to SEQ ID NO: 31870

SEQ ID NO: 403461 - RNA, 64 nt, hsa; identical to SEQ ID NO: 31871

SEQ ID NO: 403462 - RNA, 64 nt, hsa; identical to SEQ ID NO: 31872

SEQ ID NO: 403463 - RNA, 64 nt, hsa; identical to SEQ ID NO: 31873

SEQ ID NO: 403464 - RNA, 64 nt, hsa; identical to SEQ ID NO: 31874

SEQ ID NO: 403465 - RNA, 64 nt, hsa; identical to SEQ ID NO: 31875

SEQ ID NO: 403466 - RNA, 64 nt, hsa; identical to SEQ ID NO: 31876

SEQ ID NO: 403467 - RNA, 64 nt, hsa; identical to SEQ ID NO: 31877

SEQ ID NO: 403468 - RNA, 64 nt, hsa; identical to SEQ ID NO: 31878

SEQ ID NO: 403469 - RNA, 64 nt, hsa; identical to SEQ ID NO: 31879

SEQ ID NO: 403470 - RNA, 64 nt, hsa; identical to SEQ ID NO: 31880

SEQ ID NO: 403471 - RNA, 64 nt, hsa; identical to SEQ ID NO: 31881

SEQ ID NO: 403472 - RNA, 64 nt, hsa; identical to SEQ ID NO: 31882

SEQ ID NO: 403473 - RNA, 64 nt, hsa; identical to SEQ ID NO: 31883

SEQ ID NO: 403474 - RNA, 64 nt, hsa; identical to SEQ ID NO: 31884

SEQ ID NO: 403475 - RNA, 64 nt, hsa; identical to SEQ ID NO: 31885

SEQ ID NO: 403476 - RNA, 64 nt, hsa; identical to SEQ ID NO: 31886

SEQ ID NO: 403477 - RNA, 64 nt, hsa; identical to SEQ ID NO: 31887

SEQ ID NO: 403478 - RNA, 64 nt, hsa; identical to SEQ ID NO: 31888

SEQ ID NO: 403479 - RNA, 64 nt, hsa; identical to SEQ ID NO: 31889

SEQ ID NO: 403480 - RNA, 64 nt, hsa; identical to SEQ ID NO: 31890

SEQ ID NO: 403481 - RNA, 64 nt, hsa; identical to SEQ ID NO: 31891

SEQ ID NO: 403482 - RNA, 64 nt, hsa; identical to SEQ ID NO: 31892

SEQ ID NO: 403483 - RNA, 64 nt, hsa; identical to SEQ ID NO: 31893

SEQ ID NO: 403484 - RNA, 64 nt, hsa; identical to SEQ ID NO: 31894

SEQ ID NO: 403485 - RNA, 64 nt, hsa; identical to SEQ ID NO: 31895

SEQ ID NO: 403486 - RNA, 64 nt, hsa; identical to SEQ ID NO: 31896

SEQ ID NO: 403487 - RNA, 64 nt, hsa; identical to SEQ ID NO: 31897

SEQ ID NO: 403488 - RNA, 64 nt, hsa; identical to SEQ ID NO: 31898

SEQ ID NO: 403489 - RNA, 64 nt, hsa; identical to SEQ ID NO: 31899

SEQ ID NO: 403490 - RNA, 64 nt, hsa; identical to SEQ ID NO: 31900

SEQ ID NO: 403491 - RNA, 64 nt, hsa; identical to SEQ ID NO: 31901

SEQ ID NO: 403492 - RNA, 64 nt, hsa; identical to SEQ ID NO: 31902

SEQ ID NO: 403493 - RNA, 64 nt, hsa; identical to SEQ ID NO: 31903

SEQ ID NO: 403494 - RNA, 64 nt, hsa; identical to SEQ ID NO: 31904

SEQ ID NO: 403495 - RNA, 64 nt, hsa; identical to SEQ ID NO: 31905

SEQ ID NO: 403496 - RNA, 64 nt, hsa; identical to SEQ ID NO: 31906

SEQ ID NO: 403497 - RNA, 64 nt, hsa; identical to SEQ ID NO: 31907

SEQ ID NO: 403498 - RNA, 64 nt, hsa; identical to SEQ ID NO: 31908

SEQ ID NO: 403499 - RNA, 64 nt, hsa; identical to SEQ ID NO: 31909

SEQ ID NO: 403500 - RNA, 64 nt, hsa; identical to SEQ ID NO: 31910

SEQ ID NO: 403501 - RNA, 64 nt, hsa; identical to SEQ ID NO: 31911

SEQ ID NO: 403502 - RNA, 64 nt, hsa; identical to SEQ ID NO: 31912

SEQ ID NO: 403503 - RNA, 64 nt, hsa; identical to SEQ ID NO: 31913

SEQ ID NO: 403504 - RNA, 64 nt, hsa; identical to SEQ ID NO: 31914

SEQ ID NO: 403505 - RNA, 64 nt, hsa; identical to SEQ ID NO: 31915

SEQ ID NO: 403506 - RNA, 64 nt, hsa; identical to SEQ ID NO: 31916

SEQ ID NO: 403507 - RNA, 64 nt, hsa; identical to SEQ ID NO: 31917

SEQ ID NO: 403508 - RNA, 64 nt, hsa; identical to SEQ ID NO: 31918

SEQ ID NO: 403509 - RNA, 64 nt, hsa; identical to SEQ ID NO: 31919

SEQ ID NO: 403510 - RNA, 64 nt, hsa; identical to SEQ ID NO: 31920

SEQ ID NO: 403511 - RNA, 64 nt, hsa; identical to SEQ ID NO: 31921

SEQ ID NO: 403512 - RNA, 64 nt, hsa; identical to SEQ ID NO: 31922

SEQ ID NO: 403513 - RNA, 64 nt, hsa; identical to SEQ ID NO: 31923

SEQ ID NO: 403514 - RNA, 64 nt, hsa; identical to SEQ ID NO: 31924

SEQ ID NO: 403515 - RNA, 64 nt, hsa; identical to SEQ ID NO: 31925

SEQ ID NO: 403516 - RNA, 64 nt, hsa; identical to SEQ ID NO: 31926

SEQ ID NO: 403517 - RNA, 64 nt, hsa; identical to SEQ ID NO: 31927

SEQ ID NO: 403518 - RNA, 64 nt, hsa; identical to SEQ ID NO: 31928

SEQ ID NO: 403519 - RNA, 64 nt, hsa; identical to SEQ ID NO: 31929

SEQ ID NO: 403520 - RNA, 64 nt, hsa; identical to SEQ ID NO: 31930

SEQ ID NO: 403521 - RNA, 64 nt, hsa; identical to SEQ ID NO: 31931

SEQ ID NO: 403522 - RNA, 64 nt, hsa; identical to SEQ ID NO: 31932

SEQ ID NO: 403523 - RNA, 64 nt, hsa; identical to SEQ ID NO: 31933

SEQ ID NO: 403524 - RNA, 64 nt, hsa; identical to SEQ ID NO: 31934

SEQ ID NO: 403525 - RNA, 64 nt, hsa; identical to SEQ ID NO: 31935

SEQ ID NO: 403526 - RNA, 64 nt, hsa; identical to SEQ ID NO: 31936

SEQ ID NO: 403527 - RNA, 64 nt, hsa; identical to SEQ ID NO: 31937

SEQ ID NO: 403528 - RNA, 64 nt, hsa; identical to SEQ ID NO: 31938

SEQ ID NO: 403529 - RNA, 64 nt, hsa; identical to SEQ ID NO: 31939

SEQ ID NO: 403530 - RNA, 64 nt, hsa; identical to SEQ ID NO: 31940

SEQ ID NO: 403531 - RNA, 64 nt, hsa; identical to SEQ ID NO: 31941

SEQ ID NO: 403532 - RNA, 64 nt, hsa; identical to SEQ ID NO: 31942

SEQ ID NO: 403533 - RNA, 64 nt, hsa; identical to SEQ ID NO: 31943

SEQ ID NO: 403534 - RNA, 64 nt, hsa; identical to SEQ ID NO: 31944

SEQ ID NO: 403535 - RNA, 64 nt, hsa; identical to SEQ ID NO: 31945

SEQ ID NO: 403536 - RNA, 64 nt, hsa; identical to SEQ ID NO: 31946

SEQ ID NO: 403537 - RNA, 64 nt, hsa; identical to SEQ ID NO: 31947

SEQ ID NO: 403538 - RNA, 64 nt, hsa; identical to SEQ ID NO: 31948

SEQ ID NO: 403539 - RNA, 64 nt, hsa; identical to SEQ ID NO: 31949

SEQ ID NO: 403540 - RNA, 64 nt, hsa; identical to SEQ ID NO: 31950

SEQ ID NO: 403541 - RNA, 64 nt, hsa; identical to SEQ ID NO: 31951

SEQ ID NO: 403542 - RNA, 64 nt, hsa; identical to SEQ ID NO: 31952

SEQ ID NO: 403543 - RNA, 64 nt, hsa; identical to SEQ ID NO: 31953

SEQ ID NO: 403544 - RNA, 64 nt, hsa; identical to SEQ ID NO: 31954

SEQ ID NO: 403545 - RNA, 64 nt, hsa; identical to SEQ ID NO: 31955

SEQ ID NO: 403546 - RNA, 64 nt, hsa; identical to SEQ ID NO: 31956

SEQ ID NO: 403547 - RNA, 64 nt, hsa; identical to SEQ ID NO: 31957

SEQ ID NO: 403548 - RNA, 64 nt, hsa; identical to SEQ ID NO: 31958

SEQ ID NO: 403549 - RNA, 64 nt, hsa; identical to SEQ ID NO: 31959

SEQ ID NO: 403550 - RNA, 64 nt, hsa; identical to SEQ ID NO: 31960

SEQ ID NO: 403551 - RNA, 64 nt, hsa; identical to SEQ ID NO: 31961

SEQ ID NO: 403552 - RNA, 64 nt, hsa; identical to SEQ ID NO: 31962

SEQ ID NO: 403553 - RNA, 64 nt, hsa; identical to SEQ ID NO: 31963

SEQ ID NO: 403554 - RNA, 64 nt, hsa; identical to SEQ ID NO: 31964

SEQ ID NO: 403555 - RNA, 64 nt, hsa; identical to SEQ ID NO: 31965

SEQ ID NO: 403556 - RNA, 64 nt, hsa; identical to SEQ ID NO: 31966

SEQ ID NO: 403557 - RNA, 64 nt, hsa; identical to SEQ ID NO: 31967

SEQ ID NO: 403558 - RNA, 64 nt, hsa; identical to SEQ ID NO: 31968

SEQ ID NO: 403559 - RNA, 64 nt, hsa; identical to SEQ ID NO: 31969

SEQ ID NO: 403560 - RNA, 64 nt, hsa; identical to SEQ ID NO: 31970

SEQ ID NO: 403561 - RNA, 64 nt, hsa; identical to SEQ ID NO: 31971

SEQ ID NO: 403562 - RNA, 64 nt, hsa; identical to SEQ ID NO: 31972

SEQ ID NO: 403563 - RNA, 64 nt, hsa; identical to SEQ ID NO: 31973

SEQ ID NO: 403564 - RNA, 64 nt, hsa; identical to SEQ ID NO: 31974

SEQ ID NO: 403565 - RNA, 64 nt, hsa; identical to SEQ ID NO: 31975

SEQ ID NO: 403566 - RNA, 64 nt, hsa; identical to SEQ ID NO: 31976

SEQ ID NO: 403567 - RNA, 64 nt, hsa; identical to SEQ ID NO: 31977

SEQ ID NO: 403568 - RNA, 64 nt, hsa; identical to SEQ ID NO: 31978

SEQ ID NO: 403569 - RNA, 64 nt, hsa; identical to SEQ ID NO: 31979

SEQ ID NO: 403570 - RNA, 64 nt, hsa; identical to SEQ ID NO: 31980

SEQ ID NO: 403571 - RNA, 64 nt, hsa; identical to SEQ ID NO: 31981

SEQ ID NO: 403572 - RNA, 64 nt, hsa; identical to SEQ ID NO: 31982

SEQ ID NO: 403573 - RNA, 64 nt, hsa; identical to SEQ ID NO: 31983

SEQ ID NO: 403574 - RNA, 64 nt, hsa; identical to SEQ ID NO: 31984

SEQ ID NO: 403575 - RNA, 64 nt, hsa; identical to SEQ ID NO: 31985

SEQ ID NO: 403576 - RNA, 64 nt, hsa; identical to SEQ ID NO: 31986

SEQ ID NO: 403577 - RNA, 64 nt, hsa; identical to SEQ ID NO: 31987

SEQ ID NO: 403578 - RNA, 64 nt, hsa; identical to SEQ ID NO: 31988

SEQ ID NO: 403579 - RNA, 64 nt, hsa; identical to SEQ ID NO: 31989

SEQ ID NO: 403580 - RNA, 64 nt, hsa; identical to SEQ ID NO: 31990

SEQ ID NO: 403581 - RNA, 64 nt, hsa; identical to SEQ ID NO: 31991

SEQ ID NO: 403582 - RNA, 64 nt, hsa; identical to SEQ ID NO: 31992

SEQ ID NO: 403583 - RNA, 64 nt, hsa; identical to SEQ ID NO: 31993

SEQ ID NO: 403584 - RNA, 64 nt, hsa; identical to SEQ ID NO: 31994

SEQ ID NO: 403585 - RNA, 64 nt, hsa; identical to SEQ ID NO: 31995

SEQ ID NO: 403586 - RNA, 64 nt, hsa; identical to SEQ ID NO: 31996

SEQ ID NO: 403587 - RNA, 64 nt, hsa; identical to SEQ ID NO: 31997

SEQ ID NO: 403588 - RNA, 64 nt, hsa; identical to SEQ ID NO: 31998

SEQ ID NO: 403589 - RNA, 64 nt, hsa; identical to SEQ ID NO: 31999

SEQ ID NO: 403590 - RNA, 64 nt, hsa; identical to SEQ ID NO: 32000

SEQ ID NO: 403591 - RNA, 64 nt, hsa; identical to SEQ ID NO: 32001

SEQ ID NO: 403592 - RNA, 64 nt, hsa; identical to SEQ ID NO: 32002

SEQ ID NO: 403593 - RNA, 64 nt, hsa; identical to SEQ ID NO: 32003

SEQ ID NO: 403594 - RNA, 64 nt, hsa; identical to SEQ ID NO: 32004

SEQ ID NO: 403595 - RNA, 64 nt, hsa; identical to SEQ ID NO: 32005

SEQ ID NO: 403596 - RNA, 64 nt, hsa; identical to SEQ ID NO: 32006

SEQ ID NO: 403597 - RNA, 64 nt, hsa; identical to SEQ ID NO: 32007

SEQ ID NO: 403598 - RNA, 64 nt, hsa; identical to SEQ ID NO: 32008

SEQ ID NO: 403599 - RNA, 64 nt, hsa; identical to SEQ ID NO: 32009

SEQ ID NO: 403600 - RNA, 64 nt, hsa; identical to SEQ ID NO: 32010

SEQ ID NO: 403601 - RNA, 64 nt, hsa; identical to SEQ ID NO: 32011

SEQ ID NO: 403602 - RNA, 64 nt, hsa; identical to SEQ ID NO: 32012

SEQ ID NO: 403603 - RNA, 64 nt, hsa; identical to SEQ ID NO: 32013

SEQ ID NO: 403604 - RNA, 64 nt, hsa; identical to SEQ ID NO: 32014

SEQ ID NO: 403605 - RNA, 64 nt, hsa; identical to SEQ ID NO: 32015

SEQ ID NO: 403606 - RNA, 64 nt, hsa; identical to SEQ ID NO: 32016

SEQ ID NO: 403607 - RNA, 64 nt, hsa; identical to SEQ ID NO: 32017

SEQ ID NO: 403608 - RNA, 64 nt, hsa; identical to SEQ ID NO: 32018

SEQ ID NO: 403609 - RNA, 64 nt, hsa; identical to SEQ ID NO: 32019

SEQ ID NO: 403610 - RNA, 64 nt, hsa; identical to SEQ ID NO: 32020

SEQ ID NO: 403611 - RNA, 64 nt, hsa; identical to SEQ ID NO: 32021

SEQ ID NO: 403612 - RNA, 64 nt, hsa; identical to SEQ ID NO: 32022

SEQ ID NO: 403613 - RNA, 64 nt, hsa; identical to SEQ ID NO: 32023

SEQ ID NO: 403614 - RNA, 64 nt, hsa; identical to SEQ ID NO: 32024

SEQ ID NO: 403615 - RNA, 64 nt, hsa; identical to SEQ ID NO: 32025

SEQ ID NO: 403616 - RNA, 64 nt, hsa; identical to SEQ ID NO: 32026

SEQ ID NO: 403617 - RNA, 64 nt, hsa; identical to SEQ ID NO: 32027

SEQ ID NO: 403618 - RNA, 64 nt, hsa; identical to SEQ ID NO: 32028

SEQ ID NO: 403619 - RNA, 64 nt, hsa; identical to SEQ ID NO: 32029

SEQ ID NO: 403620 - RNA, 64 nt, hsa; identical to SEQ ID NO: 32030

SEQ ID NO: 403621 - RNA, 64 nt, hsa; identical to SEQ ID NO: 32031

SEQ ID NO: 403622 - RNA, 64 nt, hsa; identical to SEQ ID NO: 32032

SEQ ID NO: 403623 - RNA, 64 nt, hsa; identical to SEQ ID NO: 32033

SEQ ID NO: 403624 - RNA, 64 nt, hsa; identical to SEQ ID NO: 32034

SEQ ID NO: 403625 - RNA, 64 nt, hsa; identical to SEQ ID NO: 32035

SEQ ID NO: 403626 - RNA, 64 nt, hsa; identical to SEQ ID NO: 32036

SEQ ID NO: 403627 - RNA, 64 nt, hsa; identical to SEQ ID NO: 32037

SEQ ID NO: 403628 - RNA, 64 nt, hsa; identical to SEQ ID NO: 32038

SEQ ID NO: 403629 - RNA, 64 nt, hsa; identical to SEQ ID NO: 32039

SEQ ID NO: 403630 - RNA, 64 nt, hsa; identical to SEQ ID NO: 32040

SEQ ID NO: 403631 - RNA, 64 nt, hsa; identical to SEQ ID NO: 32041

SEQ ID NO: 403632 - RNA, 64 nt, hsa; identical to SEQ ID NO: 32042

SEQ ID NO: 403633 - RNA, 64 nt, hsa; identical to SEQ ID NO: 32043

SEQ ID NO: 403634 - RNA, 63 nt, hsa; identical to SEQ ID NO: 32044

SEQ ID NO: 403635 - RNA, 64 nt, hsa; identical to SEQ ID NO: 32045

SEQ ID NO: 403636 - RNA, 64 nt, hsa; identical to SEQ ID NO: 32046

SEQ ID NO: 403637 - RNA, 64 nt, hsa; identical to SEQ ID NO: 32047

SEQ ID NO: 403638 - RNA, 64 nt, hsa; identical to SEQ ID NO: 32048

SEQ ID NO: 403639 - RNA, 64 nt, hsa; identical to SEQ ID NO: 32049

SEQ ID NO: 403640 - RNA, 64 nt, hsa; identical to SEQ ID NO: 32050

SEQ ID NO: 403641 - RNA, 64 nt, hsa; identical to SEQ ID NO: 32051

SEQ ID NO: 403642 - RNA, 64 nt, hsa; identical to SEQ ID NO: 32052

SEQ ID NO: 403643 - RNA, 64 nt, hsa; identical to SEQ ID NO: 32053

SEQ ID NO: 403644 - RNA, 64 nt, hsa; identical to SEQ ID NO: 32054

SEQ ID NO: 403645 - RNA, 64 nt, hsa; identical to SEQ ID NO: 32055

SEQ ID NO: 403646 - RNA, 64 nt, hsa; identical to SEQ ID NO: 32056

SEQ ID NO: 403647 - RNA, 64 nt, hsa; identical to SEQ ID NO: 32057

SEQ ID NO: 403648 - RNA, 64 nt, hsa; identical to SEQ ID NO: 32058

SEQ ID NO: 403649 - RNA, 64 nt, hsa; identical to SEQ ID NO: 32059

SEQ ID NO: 403650 - RNA, 64 nt, hsa; identical to SEQ ID NO: 32060

SEQ ID NO: 403651 - RNA, 64 nt, hsa; identical to SEQ ID NO: 32061

SEQ ID NO: 403652 - RNA, 64 nt, hsa; identical to SEQ ID NO: 32062

SEQ ID NO: 403653 - RNA, 64 nt, hsa; identical to SEQ ID NO: 32063

SEQ ID NO: 403654 - RNA, 64 nt, hsa; identical to SEQ ID NO: 32064

SEQ ID NO: 403655 - RNA, 64 nt, hsa; identical to SEQ ID NO: 32065

SEQ ID NO: 403656 - RNA, 64 nt, hsa; identical to SEQ ID NO: 32066

SEQ ID NO: 403657 - RNA, 64 nt, hsa; identical to SEQ ID NO: 32067

SEQ ID NO: 403658 - RNA, 64 nt, hsa; identical to SEQ ID NO: 32068

SEQ ID NO: 403659 - RNA, 64 nt, hsa; identical to SEQ ID NO: 32069

SEQ ID NO: 403660 - RNA, 64 nt, hsa; identical to SEQ ID NO: 32070

SEQ ID NO: 403661 - RNA, 64 nt, hsa; identical to SEQ ID NO: 32071

SEQ ID NO: 403662 - RNA, 64 nt, hsa; identical to SEQ ID NO: 32072

SEQ ID NO: 403663 - RNA, 64 nt, hsa; identical to SEQ ID NO: 32073

SEQ ID NO: 403664 - RNA, 64 nt, hsa; identical to SEQ ID NO: 32074

SEQ ID NO: 403665 - RNA, 64 nt, hsa; identical to SEQ ID NO: 32075

SEQ ID NO: 403666 - RNA, 64 nt, hsa; identical to SEQ ID NO: 32076

SEQ ID NO: 403667 - RNA, 64 nt, hsa; identical to SEQ ID NO: 32077

SEQ ID NO: 403668 - RNA, 64 nt, hsa; identical to SEQ ID NO: 32078

SEQ ID NO: 403669 - RNA, 64 nt, hsa; identical to SEQ ID NO: 32079

SEQ ID NO: 403670 - RNA, 64 nt, hsa; identical to SEQ ID NO: 32080

SEQ ID NO: 403671 - RNA, 64 nt, hsa; identical to SEQ ID NO: 32081

SEQ ID NO: 403672 - RNA, 64 nt, hsa; identical to SEQ ID NO: 32082

SEQ ID NO: 403673 - RNA, 64 nt, hsa; identical to SEQ ID NO: 32083

SEQ ID NO: 403674 - RNA, 64 nt, hsa; identical to SEQ ID NO: 32084

SEQ ID NO: 403675 - RNA, 64 nt, hsa; identical to SEQ ID NO: 32085

SEQ ID NO: 403676 - RNA, 64 nt, hsa; identical to SEQ ID NO: 32086

SEQ ID NO: 403677 - RNA, 64 nt, hsa; identical to SEQ ID NO: 32087

SEQ ID NO: 403678 - RNA, 64 nt, hsa; identical to SEQ ID NO: 32088

SEQ ID NO: 403679 - RNA, 64 nt, hsa; identical to SEQ ID NO: 32089

SEQ ID NO: 403680 - RNA, 64 nt, hsa; identical to SEQ ID NO: 32090

SEQ ID NO: 403681 - RNA, 64 nt, hsa; identical to SEQ ID NO: 32091

SEQ ID NO: 403682 - RNA, 64 nt, hsa; identical to SEQ ID NO: 32092

SEQ ID NO: 403683 - RNA, 64 nt, hsa; identical to SEQ ID NO: 32093

SEQ ID NO: 403684 - RNA, 64 nt, hsa; identical to SEQ ID NO: 32094

SEQ ID NO: 403685 - RNA, 64 nt, hsa; identical to SEQ ID NO: 32095

SEQ ID NO: 403686 - RNA, 64 nt, hsa; identical to SEQ ID NO: 32096

SEQ ID NO: 403687 - RNA, 64 nt, hsa; identical to SEQ ID NO: 32097

SEQ ID NO: 403688 - RNA, 64 nt, hsa; identical to SEQ ID NO: 32098

SEQ ID NO: 403689 - RNA, 64 nt, hsa; identical to SEQ ID NO: 32099

SEQ ID NO: 403690 - RNA, 64 nt, hsa; identical to SEQ ID NO: 32100

SEQ ID NO: 403691 - RNA, 64 nt, hsa; identical to SEQ ID NO: 32101

SEQ ID NO: 403692 - RNA, 64 nt, hsa; identical to SEQ ID NO: 32102

SEQ ID NO: 403693 - RNA, 64 nt, hsa; identical to SEQ ID NO: 32103

SEQ ID NO: 403694 - RNA, 64 nt, hsa; identical to SEQ ID NO: 32104

SEQ ID NO: 403695 - RNA, 64 nt, hsa; identical to SEQ ID NO: 32105

SEQ ID NO: 403696 - RNA, 64 nt, hsa; identical to SEQ ID NO: 32106

SEQ ID NO: 403697 - RNA, 64 nt, hsa; identical to SEQ ID NO: 32107

SEQ ID NO: 403698 - RNA, 64 nt, hsa; identical to SEQ ID NO: 32108

SEQ ID NO: 403699 - RNA, 64 nt, hsa; identical to SEQ ID NO: 32109

SEQ ID NO: 403700 - RNA, 64 nt, hsa; identical to SEQ ID NO: 32110

SEQ ID NO: 403701 - RNA, 64 nt, hsa; identical to SEQ ID NO: 32111

SEQ ID NO: 403702 - RNA, 64 nt, hsa; identical to SEQ ID NO: 32112

SEQ ID NO: 403703 - RNA, 64 nt, hsa; identical to SEQ ID NO: 32113

SEQ ID NO: 403704 - RNA, 64 nt, hsa; identical to SEQ ID NO: 32114

SEQ ID NO: 403705 - RNA, 64 nt, hsa; identical to SEQ ID NO: 32115

SEQ ID NO: 403706 - RNA, 64 nt, hsa; identical to SEQ ID NO: 32116

SEQ ID NO: 403707 - RNA, 64 nt, hsa; identical to SEQ ID NO: 32117

SEQ ID NO: 403708 - RNA, 64 nt, hsa; identical to SEQ ID NO: 32118

SEQ ID NO: 403709 - RNA, 64 nt, hsa; identical to SEQ ID NO: 32119

SEQ ID NO: 403710 - RNA, 64 nt, hsa; identical to SEQ ID NO: 32120

SEQ ID NO: 403711 - RNA, 64 nt, hsa; identical to SEQ ID NO: 32121

SEQ ID NO: 403712 - RNA, 64 nt, hsa; identical to SEQ ID NO: 32122

SEQ ID NO: 403713 - RNA, 64 nt, hsa; identical to SEQ ID NO: 32123

SEQ ID NO: 403714 - RNA, 64 nt, hsa; identical to SEQ ID NO: 32124

SEQ ID NO: 403715 - RNA, 64 nt, hsa; identical to SEQ ID NO: 32125

SEQ ID NO: 403716 - RNA, 64 nt, hsa; identical to SEQ ID NO: 32126

SEQ ID NO: 403717 - RNA, 64 nt, hsa; identical to SEQ ID NO: 32127

SEQ ID NO: 403718 - RNA, 64 nt, hsa; identical to SEQ ID NO: 32128

SEQ ID NO: 403719 - RNA, 64 nt, hsa; identical to SEQ ID NO: 32129

SEQ ID NO: 403720 - RNA, 64 nt, hsa; identical to SEQ ID NO: 32130

SEQ ID NO: 403721 - RNA, 64 nt, hsa; identical to SEQ ID NO: 32131

SEQ ID NO: 403722 - RNA, 64 nt, hsa; identical to SEQ ID NO: 32132

SEQ ID NO: 403723 - RNA, 64 nt, hsa; identical to SEQ ID NO: 32133

SEQ ID NO: 403724 - RNA, 64 nt, hsa; identical to SEQ ID NO: 32134

SEQ ID NO: 403725 - RNA, 64 nt, hsa; identical to SEQ ID NO: 32135

SEQ ID NO: 403726 - RNA, 64 nt, hsa; identical to SEQ ID NO: 32136

SEQ ID NO: 403727 - RNA, 64 nt, hsa; identical to SEQ ID NO: 32137

SEQ ID NO: 403728 - RNA, 64 nt, hsa; identical to SEQ ID NO: 32138

SEQ ID NO: 403729 - RNA, 64 nt, hsa; identical to SEQ ID NO: 32139

SEQ ID NO: 403730 - RNA, 64 nt, hsa; identical to SEQ ID NO: 32140

SEQ ID NO: 403731 - RNA, 64 nt, hsa; identical to SEQ ID NO: 32141

SEQ ID NO: 403732 - RNA, 64 nt, hsa; identical to SEQ ID NO: 32142

SEQ ID NO: 403733 - RNA, 64 nt, hsa; identical to SEQ ID NO: 32143

SEQ ID NO: 403734 - RNA, 64 nt, hsa; identical to SEQ ID NO: 32144

SEQ ID NO: 403735 - RNA, 64 nt, hsa; identical to SEQ ID NO: 32145

SEQ ID NO: 403736 - RNA, 64 nt, hsa; identical to SEQ ID NO: 32146

SEQ ID NO: 403737 - RNA, 64 nt, hsa; identical to SEQ ID NO: 32147

SEQ ID NO: 403738 - RNA, 64 nt, hsa; identical to SEQ ID NO: 32148

SEQ ID NO: 403739 - RNA, 64 nt, hsa; identical to SEQ ID NO: 32149

SEQ ID NO: 403740 - RNA, 64 nt, hsa; identical to SEQ ID NO: 32150

SEQ ID NO: 403741 - RNA, 64 nt, hsa; identical to SEQ ID NO: 32151

SEQ ID NO: 403742 - RNA, 64 nt, hsa; identical to SEQ ID NO: 32152

SEQ ID NO: 403743 - RNA, 64 nt, hsa; identical to SEQ ID NO: 32153

SEQ ID NO: 403744 - RNA, 64 nt, hsa; identical to SEQ ID NO: 32154

SEQ ID NO: 403745 - RNA, 64 nt, hsa; identical to SEQ ID NO: 32155

SEQ ID NO: 403746 - RNA, 64 nt, hsa; identical to SEQ ID NO: 32156

SEQ ID NO: 403747 - RNA, 64 nt, hsa; identical to SEQ ID NO: 32157

SEQ ID NO: 403748 - RNA, 64 nt, hsa; identical to SEQ ID NO: 32158

SEQ ID NO: 403749 - RNA, 64 nt, hsa; identical to SEQ ID NO: 32159

SEQ ID NO: 403750 - RNA, 64 nt, hsa; identical to SEQ ID NO: 32160

SEQ ID NO: 403751 - RNA, 64 nt, hsa; identical to SEQ ID NO: 32161

SEQ ID NO: 403752 - RNA, 64 nt, hsa; identical to SEQ ID NO: 32162

SEQ ID NO: 403753 - RNA, 64 nt, hsa; identical to SEQ ID NO: 32163

SEQ ID NO: 403754 - RNA, 64 nt, hsa; identical to SEQ ID NO: 32164

SEQ ID NO: 403755 - RNA, 64 nt, hsa; identical to SEQ ID NO: 32165

SEQ ID NO: 403756 - RNA, 64 nt, hsa; identical to SEQ ID NO: 32166

SEQ ID NO: 403757 - RNA, 64 nt, hsa; identical to SEQ ID NO: 32167

SEQ ID NO: 403758 - RNA, 64 nt, hsa; identical to SEQ ID NO: 32168

SEQ ID NO: 403759 - RNA, 64 nt, hsa; identical to SEQ ID NO: 32169

SEQ ID NO: 403760 - RNA, 64 nt, hsa; identical to SEQ ID NO: 32170

SEQ ID NO: 403761 - RNA, 64 nt, hsa; identical to SEQ ID NO: 32171

SEQ ID NO: 403762 - RNA, 64 nt, hsa; identical to SEQ ID NO: 32172

SEQ ID NO: 403763 - RNA, 64 nt, hsa; identical to SEQ ID NO: 32173

SEQ ID NO: 403764 - RNA, 64 nt, hsa; identical to SEQ ID NO: 32174

SEQ ID NO: 403765 - RNA, 64 nt, hsa; identical to SEQ ID NO: 32175

SEQ ID NO: 403766 - RNA, 64 nt, hsa; identical to SEQ ID NO: 32176

SEQ ID NO: 403767 - RNA, 64 nt, hsa; identical to SEQ ID NO: 32177

SEQ ID NO: 403768 - RNA, 64 nt, hsa; identical to SEQ ID NO: 32178

SEQ ID NO: 403769 - RNA, 64 nt, hsa; identical to SEQ ID NO: 32179

SEQ ID NO: 403770 - RNA, 64 nt, hsa; identical to SEQ ID NO: 32180

SEQ ID NO: 403771 - RNA, 64 nt, hsa; identical to SEQ ID NO: 32181

SEQ ID NO: 403772 - RNA, 64 nt, hsa; identical to SEQ ID NO: 32182

SEQ ID NO: 403773 - RNA, 64 nt, hsa; identical to SEQ ID NO: 32183

SEQ ID NO: 403774 - RNA, 64 nt, hsa; identical to SEQ ID NO: 32184

SEQ ID NO: 403775 - RNA, 64 nt, hsa; identical to SEQ ID NO: 32185

SEQ ID NO: 403776 - RNA, 64 nt, hsa; identical to SEQ ID NO: 32186

SEQ ID NO: 403777 - RNA, 64 nt, hsa; identical to SEQ ID NO: 32187

SEQ ID NO: 403778 - RNA, 64 nt, hsa; identical to SEQ ID NO: 32188

SEQ ID NO: 403779 - RNA, 64 nt, hsa; identical to SEQ ID NO: 32189

SEQ ID NO: 403780 - RNA, 64 nt, hsa; identical to SEQ ID NO: 32190

SEQ ID NO: 403781 - RNA, 64 nt, hsa; identical to SEQ ID NO: 32191

SEQ ID NO: 403782 - RNA, 64 nt, hsa; identical to SEQ ID NO: 32192

SEQ ID NO: 403783 - RNA, 64 nt, hsa; identical to SEQ ID NO: 32193

SEQ ID NO: 403784 - RNA, 64 nt, hsa; identical to SEQ ID NO: 32194

SEQ ID NO: 403785 - RNA, 64 nt, hsa; identical to SEQ ID NO: 32195

SEQ ID NO: 403786 - RNA, 64 nt, hsa; identical to SEQ ID NO: 32196

SEQ ID NO: 403787 - RNA, 64 nt, hsa; identical to SEQ ID NO: 32197

SEQ ID NO: 403788 - RNA, 64 nt, hsa; identical to SEQ ID NO: 32198

SEQ ID NO: 403789 - RNA, 64 nt, hsa; identical to SEQ ID NO: 32199

SEQ ID NO: 403790 - RNA, 64 nt, hsa; identical to SEQ ID NO: 32200

SEQ ID NO: 403791 - RNA, 64 nt, hsa; identical to SEQ ID NO: 32201

SEQ ID NO: 403792 - RNA, 64 nt, hsa; identical to SEQ ID NO: 32202

SEQ ID NO: 403793 - RNA, 64 nt, hsa; identical to SEQ ID NO: 32203

SEQ ID NO: 403794 - RNA, 64 nt, hsa; identical to SEQ ID NO: 32204

SEQ ID NO: 403795 - RNA, 64 nt, hsa; identical to SEQ ID NO: 32205

SEQ ID NO: 403796 - RNA, 64 nt, hsa; identical to SEQ ID NO: 32206

SEQ ID NO: 403797 - RNA, 64 nt, hsa; identical to SEQ ID NO: 32207

SEQ ID NO: 403798 - RNA, 64 nt, hsa; identical to SEQ ID NO: 32208

SEQ ID NO: 403799 - RNA, 64 nt, hsa; identical to SEQ ID NO: 32209

SEQ ID NO: 403800 - RNA, 64 nt, hsa; identical to SEQ ID NO: 32210

SEQ ID NO: 403801 - RNA, 64 nt, hsa; identical to SEQ ID NO: 32211

SEQ ID NO: 403802 - RNA, 64 nt, hsa; identical to SEQ ID NO: 32212

SEQ ID NO: 403803 - RNA, 64 nt, hsa; identical to SEQ ID NO: 32213

SEQ ID NO: 403804 - RNA, 64 nt, hsa; identical to SEQ ID NO: 32214

SEQ ID NO: 403805 - RNA, 64 nt, hsa; identical to SEQ ID NO: 32215

SEQ ID NO: 403806 - RNA, 64 nt, hsa; identical to SEQ ID NO: 32216

SEQ ID NO: 403807 - RNA, 64 nt, hsa; identical to SEQ ID NO: 32217

SEQ ID NO: 403808 - RNA, 64 nt, hsa; identical to SEQ ID NO: 32218

SEQ ID NO: 403809 - RNA, 64 nt, hsa; identical to SEQ ID NO: 32219

SEQ ID NO: 403810 - RNA, 64 nt, hsa; identical to SEQ ID NO: 32220

SEQ ID NO: 403811 - RNA, 64 nt, hsa; identical to SEQ ID NO: 32221

SEQ ID NO: 403812 - RNA, 64 nt, hsa; identical to SEQ ID NO: 32222

SEQ ID NO: 403813 - RNA, 64 nt, hsa; identical to SEQ ID NO: 32223

SEQ ID NO: 403814 - RNA, 64 nt, hsa; identical to SEQ ID NO: 32224

SEQ ID NO: 403815 - RNA, 64 nt, hsa; identical to SEQ ID NO: 32225

SEQ ID NO: 403816 - RNA, 64 nt, hsa; identical to SEQ ID NO: 32226

SEQ ID NO: 403817 - RNA, 64 nt, hsa; identical to SEQ ID NO: 32227

SEQ ID NO: 403818 - RNA, 64 nt, hsa; identical to SEQ ID NO: 32228

SEQ ID NO: 403819 - RNA, 64 nt, hsa; identical to SEQ ID NO: 32229

SEQ ID NO: 403820 - RNA, 64 nt, hsa; identical to SEQ ID NO: 32230

SEQ ID NO: 403821 - RNA, 64 nt, hsa; identical to SEQ ID NO: 32231

SEQ ID NO: 403822 - RNA, 64 nt, hsa; identical to SEQ ID NO: 32232

SEQ ID NO: 403823 - RNA, 64 nt, hsa; identical to SEQ ID NO: 32233

SEQ ID NO: 403824 - RNA, 64 nt, hsa; identical to SEQ ID NO: 32234

SEQ ID NO: 403825 - RNA, 64 nt, hsa; identical to SEQ ID NO: 32235

SEQ ID NO: 403826 - RNA, 64 nt, hsa; identical to SEQ ID NO: 32236

SEQ ID NO: 403827 - RNA, 64 nt, hsa; identical to SEQ ID NO: 32237

SEQ ID NO: 403828 - RNA, 64 nt, hsa; identical to SEQ ID NO: 32238

SEQ ID NO: 403829 - RNA, 64 nt, hsa; identical to SEQ ID NO: 32239

SEQ ID NO: 403830 - RNA, 64 nt, hsa; identical to SEQ ID NO: 32240

SEQ ID NO: 403831 - RNA, 64 nt, hsa; identical to SEQ ID NO: 32241

SEQ ID NO: 403832 - RNA, 64 nt, hsa; identical to SEQ ID NO: 32242

SEQ ID NO: 403833 - RNA, 64 nt, hsa; identical to SEQ ID NO: 32243

SEQ ID NO: 403834 - RNA, 64 nt, hsa; identical to SEQ ID NO: 32244

SEQ ID NO: 403835 - RNA, 64 nt, hsa; identical to SEQ ID NO: 32245

SEQ ID NO: 403836 - RNA, 64 nt, hsa; identical to SEQ ID NO: 32246

SEQ ID NO: 403837 - RNA, 64 nt, hsa; identical to SEQ ID NO: 32247

SEQ ID NO: 403838 - RNA, 64 nt, hsa; identical to SEQ ID NO: 32248

SEQ ID NO: 403839 - RNA, 64 nt, hsa; identical to SEQ ID NO: 32249

SEQ ID NO: 403840 - RNA, 64 nt, hsa; identical to SEQ ID NO: 32250

SEQ ID NO: 403841 - RNA, 64 nt, hsa; identical to SEQ ID NO: 32251

SEQ ID NO: 403842 - RNA, 64 nt, hsa; identical to SEQ ID NO: 32252

SEQ ID NO: 403843 - RNA, 64 nt, hsa; identical to SEQ ID NO: 32253

SEQ ID NO: 403844 - RNA, 64 nt, hsa; identical to SEQ ID NO: 32254

SEQ ID NO: 403845 - RNA, 64 nt, hsa; identical to SEQ ID NO: 32255

SEQ ID NO: 403846 - RNA, 64 nt, hsa; identical to SEQ ID NO: 32256

SEQ ID NO: 403847 - RNA, 64 nt, hsa; identical to SEQ ID NO: 32257

SEQ ID NO: 403848 - RNA, 64 nt, hsa; identical to SEQ ID NO: 32258

SEQ ID NO: 403849 - RNA, 64 nt, hsa; identical to SEQ ID NO: 32259

SEQ ID NO: 403850 - RNA, 64 nt, hsa; identical to SEQ ID NO: 32260

SEQ ID NO: 403851 - RNA, 64 nt, hsa; identical to SEQ ID NO: 32261

SEQ ID NO: 403852 - RNA, 64 nt, hsa; identical to SEQ ID NO: 32262

SEQ ID NO: 403853 - RNA, 64 nt, hsa; identical to SEQ ID NO: 32263

SEQ ID NO: 403854 - RNA, 64 nt, hsa; identical to SEQ ID NO: 32264

SEQ ID NO: 403855 - RNA, 64 nt, hsa; identical to SEQ ID NO: 32265

SEQ ID NO: 403856 - RNA, 64 nt, hsa; identical to SEQ ID NO: 32266

SEQ ID NO: 403857 - RNA, 64 nt, hsa; identical to SEQ ID NO: 32267

SEQ ID NO: 403858 - RNA, 64 nt, hsa; identical to SEQ ID NO: 32268

SEQ ID NO: 403859 - RNA, 64 nt, hsa; identical to SEQ ID NO: 32269

SEQ ID NO: 403860 - RNA, 64 nt, hsa; identical to SEQ ID NO: 32270

SEQ ID NO: 403861 - RNA, 64 nt, hsa; identical to SEQ ID NO: 32271

SEQ ID NO: 403862 - RNA, 64 nt, hsa; identical to SEQ ID NO: 32272

SEQ ID NO: 403863 - RNA, 64 nt, hsa; identical to SEQ ID NO: 32273

SEQ ID NO: 403864 - RNA, 64 nt, hsa; identical to SEQ ID NO: 32274

SEQ ID NO: 403865 - RNA, 64 nt, hsa; identical to SEQ ID NO: 32275

SEQ ID NO: 403866 - RNA, 64 nt, hsa; identical to SEQ ID NO: 32276

SEQ ID NO: 403867 - RNA, 64 nt, hsa; identical to SEQ ID NO: 32277

SEQ ID NO: 403868 - RNA, 64 nt, hsa; identical to SEQ ID NO: 32278

SEQ ID NO: 403869 - RNA, 64 nt, hsa; identical to SEQ ID NO: 32279

SEQ ID NO: 403870 - RNA, 64 nt, hsa; identical to SEQ ID NO: 32280

SEQ ID NO: 403871 - RNA, 64 nt, hsa; identical to SEQ ID NO: 32281

SEQ ID NO: 403872 - RNA, 64 nt, hsa; identical to SEQ ID NO: 32282

SEQ ID NO: 403873 - RNA, 64 nt, hsa; identical to SEQ ID NO: 32283

SEQ ID NO: 403874 - RNA, 64 nt, hsa; identical to SEQ ID NO: 32284

SEQ ID NO: 403875 - RNA, 64 nt, hsa; identical to SEQ ID NO: 32285

SEQ ID NO: 403876 - RNA, 64 nt, hsa; identical to SEQ ID NO: 32286

SEQ ID NO: 403877 - RNA, 64 nt, hsa; identical to SEQ ID NO: 32287

SEQ ID NO: 403878 - RNA, 64 nt, hsa; identical to SEQ ID NO: 32288

SEQ ID NO: 403879 - RNA, 64 nt, hsa; identical to SEQ ID NO: 32289

SEQ ID NO: 403880 - RNA, 64 nt, hsa; identical to SEQ ID NO: 32290

SEQ ID NO: 403881 - RNA, 64 nt, hsa; identical to SEQ ID NO: 32291

SEQ ID NO: 403882 - RNA, 64 nt, hsa; identical to SEQ ID NO: 32292

SEQ ID NO: 403883 - RNA, 64 nt, hsa; identical to SEQ ID NO: 32293

SEQ ID NO: 403884 - RNA, 64 nt, hsa; identical to SEQ ID NO: 32294

SEQ ID NO: 403885 - RNA, 64 nt, hsa; identical to SEQ ID NO: 32295

SEQ ID NO: 403886 - RNA, 64 nt, hsa; identical to SEQ ID NO: 32296

SEQ ID NO: 403887 - RNA, 64 nt, hsa; identical to SEQ ID NO: 32297

SEQ ID NO: 403888 - RNA, 64 nt, hsa; identical to SEQ ID NO: 32298

SEQ ID NO: 403889 - RNA, 64 nt, hsa; identical to SEQ ID NO: 32299

SEQ ID NO: 403890 - RNA, 64 nt, hsa; identical to SEQ ID NO: 32300

SEQ ID NO: 403891 - RNA, 64 nt, hsa; identical to SEQ ID NO: 32301

SEQ ID NO: 403892 - RNA, 64 nt, hsa; identical to SEQ ID NO: 32302

SEQ ID NO: 403893 - RNA, 64 nt, hsa; identical to SEQ ID NO: 32303

SEQ ID NO: 403894 - RNA, 64 nt, hsa; identical to SEQ ID NO: 32304

SEQ ID NO: 403895 - RNA, 64 nt, hsa; identical to SEQ ID NO: 32305

SEQ ID NO: 403896 - RNA, 64 nt, hsa; identical to SEQ ID NO: 32306

SEQ ID NO: 403897 - RNA, 64 nt, hsa; identical to SEQ ID NO: 32307

SEQ ID NO: 403898 - RNA, 64 nt, hsa; identical to SEQ ID NO: 32308

SEQ ID NO: 403899 - RNA, 64 nt, hsa; identical to SEQ ID NO: 32309

SEQ ID NO: 403900 - RNA, 64 nt, hsa; identical to SEQ ID NO: 32310

SEQ ID NO: 403901 - RNA, 64 nt, hsa; identical to SEQ ID NO: 32311

SEQ ID NO: 403902 - RNA, 64 nt, hsa; identical to SEQ ID NO: 32312

SEQ ID NO: 403903 - RNA, 64 nt, hsa; identical to SEQ ID NO: 32313

SEQ ID NO: 403904 - RNA, 64 nt, hsa; identical to SEQ ID NO: 32314

SEQ ID NO: 403905 - RNA, 64 nt, hsa; identical to SEQ ID NO: 32315

SEQ ID NO: 403906 - RNA, 64 nt, hsa; identical to SEQ ID NO: 32316

SEQ ID NO: 403907 - RNA, 64 nt, hsa; identical to SEQ ID NO: 32317

SEQ ID NO: 403908 - RNA, 64 nt, hsa; identical to SEQ ID NO: 32318

SEQ ID NO: 403909 - RNA, 64 nt, hsa; identical to SEQ ID NO: 32319

SEQ ID NO: 403910 - RNA, 64 nt, hsa; identical to SEQ ID NO: 32320

SEQ ID NO: 403911 - RNA, 64 nt, hsa; identical to SEQ ID NO: 32321

SEQ ID NO: 403912 - RNA, 64 nt, hsa; identical to SEQ ID NO: 32322

SEQ ID NO: 403913 - RNA, 64 nt, hsa; identical to SEQ ID NO: 32323

SEQ ID NO: 403914 - RNA, 64 nt, hsa; identical to SEQ ID NO: 32324

SEQ ID NO: 403915 - RNA, 64 nt, hsa; identical to SEQ ID NO: 32325

SEQ ID NO: 403916 - RNA, 64 nt, hsa; identical to SEQ ID NO: 32326

SEQ ID NO: 403917 - RNA, 64 nt, hsa; identical to SEQ ID NO: 32327

SEQ ID NO: 403918 - RNA, 64 nt, hsa; identical to SEQ ID NO: 32328

SEQ ID NO: 403919 - RNA, 64 nt, hsa; identical to SEQ ID NO: 32329

SEQ ID NO: 403920 - RNA, 64 nt, hsa; identical to SEQ ID NO: 32330

SEQ ID NO: 403921 - RNA, 64 nt, hsa; identical to SEQ ID NO: 32331

SEQ ID NO: 403922 - RNA, 64 nt, hsa; identical to SEQ ID NO: 32332

SEQ ID NO: 403923 - RNA, 64 nt, hsa; identical to SEQ ID NO: 32333

SEQ ID NO: 403924 - RNA, 64 nt, hsa; identical to SEQ ID NO: 32334

SEQ ID NO: 403925 - RNA, 64 nt, hsa; identical to SEQ ID NO: 32335

SEQ ID NO: 403926 - RNA, 64 nt, hsa; identical to SEQ ID NO: 32336

SEQ ID NO: 403927 - RNA, 64 nt, hsa; identical to SEQ ID NO: 32337

SEQ ID NO: 403928 - RNA, 64 nt, hsa; identical to SEQ ID NO: 32338

SEQ ID NO: 403929 - RNA, 64 nt, hsa; identical to SEQ ID NO: 32339

SEQ ID NO: 403930 - RNA, 64 nt, hsa; identical to SEQ ID NO: 32340

SEQ ID NO: 403931 - RNA, 64 nt, hsa; identical to SEQ ID NO: 32341

SEQ ID NO: 403932 - RNA, 64 nt, hsa; identical to SEQ ID NO: 32342

SEQ ID NO: 403933 - RNA, 64 nt, hsa; identical to SEQ ID NO: 32343

SEQ ID NO: 403934 - RNA, 64 nt, hsa; identical to SEQ ID NO: 32344

SEQ ID NO: 403935 - RNA, 64 nt, hsa; identical to SEQ ID NO: 32345

SEQ ID NO: 403936 - RNA, 64 nt, hsa; identical to SEQ ID NO: 32346

SEQ ID NO: 403937 - RNA, 64 nt, hsa; identical to SEQ ID NO: 32347

SEQ ID NO: 403938 - RNA, 64 nt, hsa; identical to SEQ ID NO: 32348

SEQ ID NO: 403939 - RNA, 64 nt, hsa; identical to SEQ ID NO: 32349

SEQ ID NO: 403940 - RNA, 64 nt, hsa; identical to SEQ ID NO: 32350

SEQ ID NO: 403941 - RNA, 64 nt, hsa; identical to SEQ ID NO: 32351

SEQ ID NO: 403942 - RNA, 64 nt, hsa; identical to SEQ ID NO: 32352

SEQ ID NO: 403943 - RNA, 64 nt, hsa; identical to SEQ ID NO: 32353

SEQ ID NO: 403944 - RNA, 64 nt, hsa; identical to SEQ ID NO: 32354

SEQ ID NO: 403945 - RNA, 64 nt, hsa; identical to SEQ ID NO: 32355

SEQ ID NO: 403946 - RNA, 64 nt, hsa; identical to SEQ ID NO: 32356

SEQ ID NO: 403947 - RNA, 64 nt, hsa; identical to SEQ ID NO: 32357

SEQ ID NO: 403948 - RNA, 64 nt, hsa; identical to SEQ ID NO: 32358

SEQ ID NO: 403949 - RNA, 64 nt, hsa; identical to SEQ ID NO: 32359

SEQ ID NO: 403950 - RNA, 64 nt, hsa; identical to SEQ ID NO: 32360

SEQ ID NO: 403951 - RNA, 64 nt, hsa; identical to SEQ ID NO: 32361

SEQ ID NO: 403952 - RNA, 64 nt, hsa; identical to SEQ ID NO: 32362

SEQ ID NO: 403953 - RNA, 64 nt, hsa; identical to SEQ ID NO: 32363

SEQ ID NO: 403954 - RNA, 64 nt, hsa; identical to SEQ ID NO: 32364

SEQ ID NO: 403955 - RNA, 64 nt, hsa; identical to SEQ ID NO: 32365

SEQ ID NO: 403956 - RNA, 64 nt, hsa; identical to SEQ ID NO: 32366

SEQ ID NO: 403957 - RNA, 64 nt, hsa; identical to SEQ ID NO: 32367

SEQ ID NO: 403958 - RNA, 64 nt, hsa; identical to SEQ ID NO: 32368

SEQ ID NO: 403959 - RNA, 64 nt, hsa; identical to SEQ ID NO: 32369

SEQ ID NO: 403960 - RNA, 64 nt, hsa; identical to SEQ ID NO: 32370

SEQ ID NO: 403961 - RNA, 64 nt, hsa; identical to SEQ ID NO: 32371

SEQ ID NO: 403962 - RNA, 64 nt, hsa; identical to SEQ ID NO: 32372

SEQ ID NO: 403963 - RNA, 64 nt, hsa; identical to SEQ ID NO: 32373

SEQ ID NO: 403964 - RNA, 64 nt, hsa; identical to SEQ ID NO: 32374

SEQ ID NO: 403965 - RNA, 64 nt, hsa; identical to SEQ ID NO: 32375

SEQ ID NO: 403966 - RNA, 64 nt, hsa; identical to SEQ ID NO: 32376

SEQ ID NO: 403967 - RNA, 64 nt, hsa; identical to SEQ ID NO: 32377

SEQ ID NO: 403968 - RNA, 64 nt, hsa; identical to SEQ ID NO: 32378

SEQ ID NO: 403969 - RNA, 64 nt, hsa; identical to SEQ ID NO: 32379

SEQ ID NO: 403970 - RNA, 64 nt, hsa; identical to SEQ ID NO: 32380

SEQ ID NO: 403971 - RNA, 64 nt, hsa; identical to SEQ ID NO: 32381

SEQ ID NO: 403972 - RNA, 64 nt, hsa; identical to SEQ ID NO: 32382

SEQ ID NO: 403973 - RNA, 64 nt, hsa; identical to SEQ ID NO: 32383

SEQ ID NO: 403974 - RNA, 64 nt, hsa; identical to SEQ ID NO: 32384

SEQ ID NO: 403975 - RNA, 64 nt, hsa; identical to SEQ ID NO: 32385

SEQ ID NO: 403976 - RNA, 64 nt, hsa; identical to SEQ ID NO: 32386

SEQ ID NO: 403977 - RNA, 64 nt, hsa; identical to SEQ ID NO: 32387

SEQ ID NO: 403978 - RNA, 64 nt, hsa; identical to SEQ ID NO: 32388

SEQ ID NO: 403979 - RNA, 64 nt, hsa; identical to SEQ ID NO: 32389

SEQ ID NO: 403980 - RNA, 64 nt, hsa; identical to SEQ ID NO: 32390

SEQ ID NO: 403981 - RNA, 64 nt, hsa; identical to SEQ ID NO: 32391

SEQ ID NO: 403982 - RNA, 64 nt, hsa; identical to SEQ ID NO: 32392

SEQ ID NO: 403983 - RNA, 64 nt, hsa; identical to SEQ ID NO: 32393

SEQ ID NO: 403984 - RNA, 64 nt, hsa; identical to SEQ ID NO: 32394

SEQ ID NO: 403985 - RNA, 64 nt, hsa; identical to SEQ ID NO: 32395

SEQ ID NO: 403986 - RNA, 64 nt, hsa; identical to SEQ ID NO: 32396

SEQ ID NO: 403987 - RNA, 64 nt, hsa; identical to SEQ ID NO: 32397

SEQ ID NO: 403988 - RNA, 64 nt, hsa; identical to SEQ ID NO: 32398

SEQ ID NO: 403989 - RNA, 64 nt, hsa; identical to SEQ ID NO: 32399

SEQ ID NO: 403990 - RNA, 64 nt, hsa; identical to SEQ ID NO: 32400

SEQ ID NO: 403991 - RNA, 64 nt, hsa; identical to SEQ ID NO: 32401

SEQ ID NO: 403992 - RNA, 64 nt, hsa; identical to SEQ ID NO: 32402

SEQ ID NO: 403993 - RNA, 64 nt, hsa; identical to SEQ ID NO: 32403

SEQ ID NO: 403994 - RNA, 64 nt, hsa; identical to SEQ ID NO: 32404

SEQ ID NO: 403995 - RNA, 64 nt, hsa; identical to SEQ ID NO: 32405

SEQ ID NO: 403996 - RNA, 64 nt, hsa; identical to SEQ ID NO: 32406

SEQ ID NO: 403997 - RNA, 64 nt, hsa; identical to SEQ ID NO: 32407

SEQ ID NO: 403998 - RNA, 64 nt, hsa; identical to SEQ ID NO: 32408

SEQ ID NO: 403999 - RNA, 64 nt, hsa; identical to SEQ ID NO: 32409

SEQ ID NO: 404000 - RNA, 64 nt, hsa; identical to SEQ ID NO: 32410

SEQ ID NO: 404001 - RNA, 64 nt, hsa; identical to SEQ ID NO: 32411

SEQ ID NO: 404002 - RNA, 64 nt, hsa; identical to SEQ ID NO: 32412

SEQ ID NO: 404003 - RNA, 64 nt, hsa; identical to SEQ ID NO: 32413

SEQ ID NO: 404004 - RNA, 64 nt, hsa; identical to SEQ ID NO: 32414

SEQ ID NO: 404005 - RNA, 64 nt, hsa; identical to SEQ ID NO: 32415

SEQ ID NO: 404006 - RNA, 64 nt, hsa; identical to SEQ ID NO: 32416

SEQ ID NO: 404007 - RNA, 64 nt, hsa; identical to SEQ ID NO: 32417

SEQ ID NO: 404008 - RNA, 64 nt, hsa; identical to SEQ ID NO: 32418

SEQ ID NO: 404009 - RNA, 64 nt, hsa; identical to SEQ ID NO: 32419

SEQ ID NO: 404010 - RNA, 64 nt, hsa; identical to SEQ ID NO: 32420

SEQ ID NO: 404011 - RNA, 64 nt, hsa; identical to SEQ ID NO: 32421

SEQ ID NO: 404012 - RNA, 64 nt, hsa; identical to SEQ ID NO: 32422

SEQ ID NO: 404013 - RNA, 64 nt, hsa; identical to SEQ ID NO: 32423

SEQ ID NO: 404014 - RNA, 64 nt, hsa; identical to SEQ ID NO: 32424

SEQ ID NO: 404015 - RNA, 64 nt, hsa; identical to SEQ ID NO: 32425

SEQ ID NO: 404016 - RNA, 64 nt, hsa; identical to SEQ ID NO: 32426

SEQ ID NO: 404017 - RNA, 64 nt, hsa; identical to SEQ ID NO: 32427

SEQ ID NO: 404018 - RNA, 64 nt, hsa; identical to SEQ ID NO: 32428

SEQ ID NO: 404019 - RNA, 64 nt, hsa; identical to SEQ ID NO: 32429

SEQ ID NO: 404020 - RNA, 64 nt, hsa; identical to SEQ ID NO: 32430

SEQ ID NO: 404021 - RNA, 64 nt, hsa; identical to SEQ ID NO: 32431

SEQ ID NO: 404022 - RNA, 64 nt, hsa; identical to SEQ ID NO: 32432

SEQ ID NO: 404023 - RNA, 64 nt, hsa; identical to SEQ ID NO: 32433

SEQ ID NO: 404024 - RNA, 64 nt, hsa; identical to SEQ ID NO: 32434

SEQ ID NO: 404025 - RNA, 64 nt, hsa; identical to SEQ ID NO: 32435

SEQ ID NO: 404026 - RNA, 64 nt, hsa; identical to SEQ ID NO: 32436

SEQ ID NO: 404027 - RNA, 64 nt, hsa; identical to SEQ ID NO: 32437

SEQ ID NO: 404028 - RNA, 64 nt, hsa; identical to SEQ ID NO: 32438

SEQ ID NO: 404029 - RNA, 64 nt, hsa; identical to SEQ ID NO: 32439

SEQ ID NO: 404030 - RNA, 64 nt, hsa; identical to SEQ ID NO: 32440

SEQ ID NO: 404031 - RNA, 64 nt, hsa; identical to SEQ ID NO: 32441

SEQ ID NO: 404032 - RNA, 64 nt, hsa; identical to SEQ ID NO: 32442

SEQ ID NO: 404033 - RNA, 64 nt, hsa; identical to SEQ ID NO: 32443

SEQ ID NO: 404034 - RNA, 64 nt, hsa; identical to SEQ ID NO: 32444

SEQ ID NO: 404035 - RNA, 64 nt, hsa; identical to SEQ ID NO: 32445

SEQ ID NO: 404036 - RNA, 64 nt, hsa; identical to SEQ ID NO: 32446

SEQ ID NO: 404037 - RNA, 64 nt, hsa; identical to SEQ ID NO: 32447

SEQ ID NO: 404038 - RNA, 64 nt, hsa; identical to SEQ ID NO: 32448

SEQ ID NO: 404039 - RNA, 64 nt, hsa; identical to SEQ ID NO: 32449

SEQ ID NO: 404040 - RNA, 64 nt, hsa; identical to SEQ ID NO: 32450

SEQ ID NO: 404041 - RNA, 64 nt, hsa; identical to SEQ ID NO: 32451

SEQ ID NO: 404042 - RNA, 64 nt, hsa; identical to SEQ ID NO: 32452

SEQ ID NO: 404043 - RNA, 64 nt, hsa; identical to SEQ ID NO: 32453

SEQ ID NO: 404044 - RNA, 64 nt, hsa; identical to SEQ ID NO: 32454

SEQ ID NO: 404045 - RNA, 64 nt, hsa; identical to SEQ ID NO: 32455

SEQ ID NO: 404046 - RNA, 64 nt, hsa; identical to SEQ ID NO: 32456

SEQ ID NO: 404047 - RNA, 64 nt, hsa; identical to SEQ ID NO: 32457

SEQ ID NO: 404048 - RNA, 64 nt, hsa; identical to SEQ ID NO: 32458

SEQ ID NO: 404049 - RNA, 64 nt, hsa; identical to SEQ ID NO: 32459

SEQ ID NO: 404050 - RNA, 64 nt, hsa; identical to SEQ ID NO: 32460

SEQ ID NO: 404051 - RNA, 64 nt, hsa; identical to SEQ ID NO: 32461

SEQ ID NO: 404052 - RNA, 64 nt, hsa; identical to SEQ ID NO: 32462

SEQ ID NO: 404053 - RNA, 64 nt, hsa; identical to SEQ ID NO: 32463

SEQ ID NO: 404054 - RNA, 64 nt, hsa; identical to SEQ ID NO: 32464

SEQ ID NO: 404055 - RNA, 64 nt, hsa; identical to SEQ ID NO: 32465

SEQ ID NO: 404056 - RNA, 64 nt, hsa; identical to SEQ ID NO: 32466

SEQ ID NO: 404057 - RNA, 64 nt, hsa; identical to SEQ ID NO: 32467

SEQ ID NO: 404058 - RNA, 64 nt, hsa; identical to SEQ ID NO: 32468

SEQ ID NO: 404059 - RNA, 64 nt, hsa; identical to SEQ ID NO: 32469

SEQ ID NO: 404060 - RNA, 64 nt, hsa; identical to SEQ ID NO: 32470

SEQ ID NO: 404061 - RNA, 64 nt, hsa; identical to SEQ ID NO: 32471

SEQ ID NO: 404062 - RNA, 64 nt, hsa; identical to SEQ ID NO: 32472

SEQ ID NO: 404063 - RNA, 64 nt, hsa; identical to SEQ ID NO: 32473

SEQ ID NO: 404064 - RNA, 64 nt, hsa; identical to SEQ ID NO: 32474

SEQ ID NO: 404065 - RNA, 64 nt, hsa; identical to SEQ ID NO: 32475

SEQ ID NO: 404066 - RNA, 64 nt, hsa; identical to SEQ ID NO: 32476

SEQ ID NO: 404067 - RNA, 64 nt, hsa; identical to SEQ ID NO: 32477

SEQ ID NO: 404068 - RNA, 64 nt, hsa; identical to SEQ ID NO: 32478

SEQ ID NO: 404069 - RNA, 64 nt, hsa; identical to SEQ ID NO: 32479

SEQ ID NO: 404070 - RNA, 64 nt, hsa; identical to SEQ ID NO: 32480

SEQ ID NO: 404071 - RNA, 64 nt, hsa; identical to SEQ ID NO: 32481

SEQ ID NO: 404072 - RNA, 64 nt, hsa; identical to SEQ ID NO: 32482

SEQ ID NO: 404073 - RNA, 64 nt, hsa; identical to SEQ ID NO: 32483

SEQ ID NO: 404074 - RNA, 64 nt, hsa; identical to SEQ ID NO: 32484

SEQ ID NO: 404075 - RNA, 64 nt, hsa; identical to SEQ ID NO: 32485

SEQ ID NO: 404076 - RNA, 64 nt, hsa; identical to SEQ ID NO: 32486

SEQ ID NO: 404077 - RNA, 64 nt, hsa; identical to SEQ ID NO: 32487

SEQ ID NO: 404078 - RNA, 64 nt, hsa; identical to SEQ ID NO: 32488

SEQ ID NO: 404079 - RNA, 64 nt, hsa; identical to SEQ ID NO: 32489

SEQ ID NO: 404080 - RNA, 64 nt, hsa; identical to SEQ ID NO: 32490

SEQ ID NO: 404081 - RNA, 64 nt, hsa; identical to SEQ ID NO: 32491

SEQ ID NO: 404082 - RNA, 64 nt, hsa; identical to SEQ ID NO: 32492

SEQ ID NO: 404083 - RNA, 64 nt, hsa; identical to SEQ ID NO: 32493

SEQ ID NO: 404084 - RNA, 64 nt, hsa; identical to SEQ ID NO: 32494

SEQ ID NO: 404085 - RNA, 64 nt, hsa; identical to SEQ ID NO: 32495

SEQ ID NO: 404086 - RNA, 64 nt, hsa; identical to SEQ ID NO: 32496

SEQ ID NO: 404087 - RNA, 64 nt, hsa; identical to SEQ ID NO: 32497

SEQ ID NO: 404088 - RNA, 64 nt, hsa; identical to SEQ ID NO: 32498

SEQ ID NO: 404089 - RNA, 64 nt, hsa; identical to SEQ ID NO: 32499

SEQ ID NO: 404090 - RNA, 64 nt, hsa; identical to SEQ ID NO: 32500

SEQ ID NO: 404091 - RNA, 64 nt, hsa; identical to SEQ ID NO: 32501

SEQ ID NO: 404092 - RNA, 64 nt, hsa; identical to SEQ ID NO: 32502

SEQ ID NO: 404093 - RNA, 64 nt, hsa; identical to SEQ ID NO: 32503

SEQ ID NO: 404094 - RNA, 64 nt, hsa; identical to SEQ ID NO: 32504

SEQ ID NO: 404095 - RNA, 64 nt, hsa; identical to SEQ ID NO: 32505

SEQ ID NO: 404096 - RNA, 64 nt, hsa; identical to SEQ ID NO: 32506

SEQ ID NO: 404097 - RNA, 64 nt, hsa; identical to SEQ ID NO: 32507

SEQ ID NO: 404098 - RNA, 64 nt, hsa; identical to SEQ ID NO: 32508

SEQ ID NO: 404099 - RNA, 64 nt, hsa; identical to SEQ ID NO: 32509

SEQ ID NO: 404100 - RNA, 64 nt, hsa; identical to SEQ ID NO: 32510

SEQ ID NO: 404101 - RNA, 64 nt, hsa; identical to SEQ ID NO: 32511

SEQ ID NO: 404102 - RNA, 64 nt, hsa; identical to SEQ ID NO: 32512

SEQ ID NO: 404103 - RNA, 64 nt, hsa; identical to SEQ ID NO: 32513

SEQ ID NO: 404104 - RNA, 64 nt, hsa; identical to SEQ ID NO: 32514

SEQ ID NO: 404105 - RNA, 64 nt, hsa; identical to SEQ ID NO: 32515

SEQ ID NO: 404106 - RNA, 64 nt, hsa; identical to SEQ ID NO: 32516

SEQ ID NO: 404107 - RNA, 64 nt, hsa; identical to SEQ ID NO: 32517

SEQ ID NO: 404108 - RNA, 64 nt, hsa; identical to SEQ ID NO: 32518

SEQ ID NO: 404109 - RNA, 64 nt, hsa; identical to SEQ ID NO: 32519

SEQ ID NO: 404110 - RNA, 64 nt, hsa; identical to SEQ ID NO: 32520

SEQ ID NO: 404111 - RNA, 64 nt, hsa; identical to SEQ ID NO: 32521

SEQ ID NO: 404112 - RNA, 64 nt, hsa; identical to SEQ ID NO: 32522

SEQ ID NO: 404113 - RNA, 64 nt, hsa; identical to SEQ ID NO: 32523

SEQ ID NO: 404114 - RNA, 64 nt, hsa; identical to SEQ ID NO: 32524

SEQ ID NO: 404115 - RNA, 64 nt, hsa; identical to SEQ ID NO: 32525

SEQ ID NO: 404116 - RNA, 64 nt, hsa; identical to SEQ ID NO: 32526

SEQ ID NO: 404117 - RNA, 64 nt, hsa; identical to SEQ ID NO: 32527

SEQ ID NO: 404118 - RNA, 64 nt, hsa; identical to SEQ ID NO: 32528

SEQ ID NO: 404119 - RNA, 64 nt, hsa; identical to SEQ ID NO: 32529

SEQ ID NO: 404120 - RNA, 64 nt, hsa; identical to SEQ ID NO: 32530

SEQ ID NO: 404121 - RNA, 64 nt, hsa; identical to SEQ ID NO: 32531

SEQ ID NO: 404122 - RNA, 64 nt, hsa; identical to SEQ ID NO: 32532

SEQ ID NO: 404123 - RNA, 64 nt, hsa; identical to SEQ ID NO: 32533

SEQ ID NO: 404124 - RNA, 64 nt, hsa; identical to SEQ ID NO: 32534

SEQ ID NO: 404125 - RNA, 64 nt, hsa; identical to SEQ ID NO: 32535

SEQ ID NO: 404126 - RNA, 64 nt, hsa; identical to SEQ ID NO: 32536

SEQ ID NO: 404127 - RNA, 64 nt, hsa; identical to SEQ ID NO: 32537

SEQ ID NO: 404128 - RNA, 64 nt, hsa; identical to SEQ ID NO: 32538

SEQ ID NO: 404129 - RNA, 64 nt, hsa; identical to SEQ ID NO: 32539

SEQ ID NO: 404130 - RNA, 64 nt, hsa; identical to SEQ ID NO: 32540

SEQ ID NO: 404131 - RNA, 64 nt, hsa; identical to SEQ ID NO: 32541

SEQ ID NO: 404132 - RNA, 64 nt, hsa; identical to SEQ ID NO: 32542

SEQ ID NO: 404133 - RNA, 64 nt, hsa; identical to SEQ ID NO: 32543

SEQ ID NO: 404134 - RNA, 64 nt, hsa; identical to SEQ ID NO: 32544

SEQ ID NO: 404135 - RNA, 64 nt, hsa; identical to SEQ ID NO: 32545

SEQ ID NO: 404136 - RNA, 64 nt, hsa; identical to SEQ ID NO: 32546

SEQ ID NO: 404137 - RNA, 64 nt, hsa; identical to SEQ ID NO: 32547

SEQ ID NO: 404138 - RNA, 64 nt, hsa; identical to SEQ ID NO: 32548

SEQ ID NO: 404139 - RNA, 64 nt, hsa; identical to SEQ ID NO: 32549

SEQ ID NO: 404140 - RNA, 64 nt, hsa; identical to SEQ ID NO: 32550

SEQ ID NO: 404141 - RNA, 64 nt, hsa; identical to SEQ ID NO: 32551

SEQ ID NO: 404142 - RNA, 64 nt, hsa; identical to SEQ ID NO: 32552

SEQ ID NO: 404143 - RNA, 64 nt, hsa; identical to SEQ ID NO: 32553

SEQ ID NO: 404144 - RNA, 64 nt, hsa; identical to SEQ ID NO: 32554

SEQ ID NO: 404145 - RNA, 64 nt, hsa; identical to SEQ ID NO: 32555

SEQ ID NO: 404146 - RNA, 64 nt, hsa; identical to SEQ ID NO: 32556

SEQ ID NO: 404147 - RNA, 64 nt, hsa; identical to SEQ ID NO: 32557

SEQ ID NO: 404148 - RNA, 64 nt, hsa; identical to SEQ ID NO: 32558

SEQ ID NO: 404149 - RNA, 64 nt, hsa; identical to SEQ ID NO: 32559

SEQ ID NO: 404150 - RNA, 63 nt, hsa; identical to SEQ ID NO: 32560

SEQ ID NO: 404151 - RNA, 64 nt, hsa; identical to SEQ ID NO: 32561

SEQ ID NO: 404152 - RNA, 64 nt, hsa; identical to SEQ ID NO: 32562

SEQ ID NO: 404153 - RNA, 64 nt, hsa; identical to SEQ ID NO: 32563

SEQ ID NO: 404154 - RNA, 64 nt, hsa; identical to SEQ ID NO: 32564

SEQ ID NO: 404155 - RNA, 64 nt, hsa; identical to SEQ ID NO: 32565

SEQ ID NO: 404156 - RNA, 64 nt, hsa; identical to SEQ ID NO: 32566

SEQ ID NO: 404157 - RNA, 64 nt, hsa; identical to SEQ ID NO: 32567

SEQ ID NO: 404158 - RNA, 64 nt, hsa; identical to SEQ ID NO: 32568

SEQ ID NO: 404159 - RNA, 64 nt, hsa; identical to SEQ ID NO: 32569

SEQ ID NO: 404160 - RNA, 64 nt, hsa; identical to SEQ ID NO: 32570

SEQ ID NO: 404161 - RNA, 64 nt, hsa; identical to SEQ ID NO: 32571

SEQ ID NO: 404162 - RNA, 64 nt, hsa; identical to SEQ ID NO: 32572

SEQ ID NO: 404163 - RNA, 64 nt, hsa; identical to SEQ ID NO: 32573

SEQ ID NO: 404164 - RNA, 64 nt, hsa; identical to SEQ ID NO: 32574

SEQ ID NO: 404165 - RNA, 64 nt, hsa; identical to SEQ ID NO: 32575

SEQ ID NO: 404166 - RNA, 64 nt, hsa; identical to SEQ ID NO: 32576

SEQ ID NO: 404167 - RNA, 64 nt, hsa; identical to SEQ ID NO: 32577

SEQ ID NO: 404168 - RNA, 64 nt, hsa; identical to SEQ ID NO: 32578

SEQ ID NO: 404169 - RNA, 64 nt, hsa; identical to SEQ ID NO: 32579

SEQ ID NO: 404170 - RNA, 64 nt, hsa; identical to SEQ ID NO: 32580

SEQ ID NO: 404171 - RNA, 64 nt, hsa; identical to SEQ ID NO: 32581

SEQ ID NO: 404172 - RNA, 64 nt, hsa; identical to SEQ ID NO: 32582

SEQ ID NO: 404173 - RNA, 64 nt, hsa; identical to SEQ ID NO: 32583

SEQ ID NO: 404174 - RNA, 64 nt, hsa; identical to SEQ ID NO: 32584

SEQ ID NO: 404175 - RNA, 64 nt, hsa; identical to SEQ ID NO: 32585

SEQ ID NO: 404176 - RNA, 64 nt, hsa; identical to SEQ ID NO: 32586

SEQ ID NO: 404177 - RNA, 64 nt, hsa; identical to SEQ ID NO: 32587

SEQ ID NO: 404178 - RNA, 64 nt, hsa; identical to SEQ ID NO: 32588

SEQ ID NO: 404179 - RNA, 64 nt, hsa; identical to SEQ ID NO: 32589

SEQ ID NO: 404180 - RNA, 64 nt, hsa; identical to SEQ ID NO: 32590

SEQ ID NO: 404181 - RNA, 64 nt, hsa; identical to SEQ ID NO: 32591

SEQ ID NO: 404182 - RNA, 64 nt, hsa; identical to SEQ ID NO: 32592

SEQ ID NO: 404183 - RNA, 64 nt, hsa; identical to SEQ ID NO: 32593

SEQ ID NO: 404184 - RNA, 64 nt, hsa; identical to SEQ ID NO: 32594

SEQ ID NO: 404185 - RNA, 64 nt, hsa; identical to SEQ ID NO: 32595

SEQ ID NO: 404186 - RNA, 64 nt, hsa; identical to SEQ ID NO: 32596

SEQ ID NO: 404187 - RNA, 64 nt, hsa; identical to SEQ ID NO: 32597

SEQ ID NO: 404188 - RNA, 64 nt, hsa; identical to SEQ ID NO: 32598

SEQ ID NO: 404189 - RNA, 64 nt, hsa; identical to SEQ ID NO: 32599

SEQ ID NO: 404190 - RNA, 64 nt, hsa; identical to SEQ ID NO: 32600

SEQ ID NO: 404191 - RNA, 64 nt, hsa; identical to SEQ ID NO: 32601

SEQ ID NO: 404192 - RNA, 64 nt, hsa; identical to SEQ ID NO: 32602

SEQ ID NO: 404193 - RNA, 64 nt, hsa; identical to SEQ ID NO: 32603

SEQ ID NO: 404194 - RNA, 64 nt, hsa; identical to SEQ ID NO: 32604

SEQ ID NO: 404195 - RNA, 64 nt, hsa; identical to SEQ ID NO: 32605

SEQ ID NO: 404196 - RNA, 64 nt, hsa; identical to SEQ ID NO: 32606

SEQ ID NO: 404197 - RNA, 64 nt, hsa; identical to SEQ ID NO: 32607

SEQ ID NO: 404198 - RNA, 64 nt, hsa; identical to SEQ ID NO: 32608

SEQ ID NO: 404199 - RNA, 64 nt, hsa; identical to SEQ ID NO: 32609

SEQ ID NO: 404200 - RNA, 64 nt, hsa; identical to SEQ ID NO: 32610

SEQ ID NO: 404201 - RNA, 64 nt, hsa; identical to SEQ ID NO: 32611

SEQ ID NO: 404202 - RNA, 64 nt, hsa; identical to SEQ ID NO: 32612

SEQ ID NO: 404203 - RNA, 64 nt, hsa; identical to SEQ ID NO: 32613

SEQ ID NO: 404204 - RNA, 64 nt, hsa; identical to SEQ ID NO: 32614

SEQ ID NO: 404205 - RNA, 64 nt, hsa; identical to SEQ ID NO: 32615

SEQ ID NO: 404206 - RNA, 64 nt, hsa; identical to SEQ ID NO: 32616

SEQ ID NO: 404207 - RNA, 64 nt, hsa; identical to SEQ ID NO: 32617

SEQ ID NO: 404208 - RNA, 64 nt, hsa; identical to SEQ ID NO: 32618

SEQ ID NO: 404209 - RNA, 64 nt, hsa; identical to SEQ ID NO: 32619

SEQ ID NO: 404210 - RNA, 64 nt, hsa; identical to SEQ ID NO: 32620

SEQ ID NO: 404211 - RNA, 64 nt, hsa; identical to SEQ ID NO: 32621

SEQ ID NO: 404212 - RNA, 64 nt, hsa; identical to SEQ ID NO: 32622

SEQ ID NO: 404213 - RNA, 64 nt, hsa; identical to SEQ ID NO: 32623

SEQ ID NO: 404214 - RNA, 64 nt, hsa; identical to SEQ ID NO: 32624

SEQ ID NO: 404215 - RNA, 64 nt, hsa; identical to SEQ ID NO: 32625

SEQ ID NO: 404216 - RNA, 64 nt, hsa; identical to SEQ ID NO: 32626

SEQ ID NO: 404217 - RNA, 64 nt, hsa; identical to SEQ ID NO: 32627

SEQ ID NO: 404218 - RNA, 64 nt, hsa; identical to SEQ ID NO: 32628

SEQ ID NO: 404219 - RNA, 64 nt, hsa; identical to SEQ ID NO: 32629

SEQ ID NO: 404220 - RNA, 64 nt, hsa; identical to SEQ ID NO: 32630

SEQ ID NO: 404221 - RNA, 64 nt, hsa; identical to SEQ ID NO: 32631

SEQ ID NO: 404222 - RNA, 64 nt, hsa; identical to SEQ ID NO: 32632

SEQ ID NO: 404223 - RNA, 64 nt, hsa; identical to SEQ ID NO: 32633

SEQ ID NO: 404224 - RNA, 64 nt, hsa; identical to SEQ ID NO: 32634

SEQ ID NO: 404225 - RNA, 64 nt, hsa; identical to SEQ ID NO: 32635

SEQ ID NO: 404226 - RNA, 64 nt, hsa; identical to SEQ ID NO: 32636

SEQ ID NO: 404227 - RNA, 64 nt, hsa; identical to SEQ ID NO: 32637

SEQ ID NO: 404228 - RNA, 64 nt, hsa; identical to SEQ ID NO: 32638

SEQ ID NO: 404229 - RNA, 64 nt, hsa; identical to SEQ ID NO: 32639

SEQ ID NO: 404230 - RNA, 64 nt, hsa; identical to SEQ ID NO: 32640

SEQ ID NO: 404231 - RNA, 64 nt, hsa; identical to SEQ ID NO: 32641

SEQ ID NO: 404232 - RNA, 64 nt, hsa; identical to SEQ ID NO: 32642

SEQ ID NO: 404233 - RNA, 64 nt, hsa; identical to SEQ ID NO: 32643

SEQ ID NO: 404234 - RNA, 64 nt, hsa; identical to SEQ ID NO: 32644

SEQ ID NO: 404235 - RNA, 64 nt, hsa; identical to SEQ ID NO: 32645

SEQ ID NO: 404236 - RNA, 64 nt, hsa; identical to SEQ ID NO: 32646

SEQ ID NO: 404237 - RNA, 64 nt, hsa; identical to SEQ ID NO: 32647

SEQ ID NO: 404238 - RNA, 64 nt, hsa; identical to SEQ ID NO: 32648

SEQ ID NO: 404239 - RNA, 64 nt, hsa; identical to SEQ ID NO: 32649

SEQ ID NO: 404240 - RNA, 64 nt, hsa; identical to SEQ ID NO: 32650

SEQ ID NO: 404241 - RNA, 64 nt, hsa; identical to SEQ ID NO: 32651

SEQ ID NO: 404242 - RNA, 64 nt, hsa; identical to SEQ ID NO: 32652

SEQ ID NO: 404243 - RNA, 64 nt, hsa; identical to SEQ ID NO: 32653

SEQ ID NO: 404244 - RNA, 64 nt, hsa; identical to SEQ ID NO: 32654

SEQ ID NO: 404245 - RNA, 64 nt, hsa; identical to SEQ ID NO: 32655

SEQ ID NO: 404246 - RNA, 64 nt, hsa; identical to SEQ ID NO: 32656

SEQ ID NO: 404247 - RNA, 64 nt, hsa; identical to SEQ ID NO: 32657

SEQ ID NO: 404248 - RNA, 64 nt, hsa; identical to SEQ ID NO: 32658

SEQ ID NO: 404249 - RNA, 64 nt, hsa; identical to SEQ ID NO: 32659

SEQ ID NO: 404250 - RNA, 64 nt, hsa; identical to SEQ ID NO: 32660

SEQ ID NO: 404251 - RNA, 64 nt, hsa; identical to SEQ ID NO: 32661

SEQ ID NO: 404252 - RNA, 64 nt, hsa; identical to SEQ ID NO: 32662

SEQ ID NO: 404253 - RNA, 64 nt, hsa; identical to SEQ ID NO: 32663

SEQ ID NO: 404254 - RNA, 64 nt, hsa; identical to SEQ ID NO: 32664

SEQ ID NO: 404255 - RNA, 64 nt, hsa; identical to SEQ ID NO: 32665

SEQ ID NO: 404256 - RNA, 64 nt, hsa; identical to SEQ ID NO: 32666

SEQ ID NO: 404257 - RNA, 64 nt, hsa; identical to SEQ ID NO: 32667

SEQ ID NO: 404258 - RNA, 64 nt, hsa; identical to SEQ ID NO: 32668

SEQ ID NO: 404259 - RNA, 64 nt, hsa; identical to SEQ ID NO: 32669

SEQ ID NO: 404260 - RNA, 64 nt, hsa; identical to SEQ ID NO: 32670

SEQ ID NO: 404261 - RNA, 64 nt, hsa; identical to SEQ ID NO: 32671

SEQ ID NO: 404262 - RNA, 64 nt, hsa; identical to SEQ ID NO: 32672

SEQ ID NO: 404263 - RNA, 64 nt, hsa; identical to SEQ ID NO: 32673

SEQ ID NO: 404264 - RNA, 64 nt, hsa; identical to SEQ ID NO: 32674

SEQ ID NO: 404265 - RNA, 64 nt, hsa; identical to SEQ ID NO: 32675

SEQ ID NO: 404266 - RNA, 64 nt, hsa; identical to SEQ ID NO: 32676

SEQ ID NO: 404267 - RNA, 64 nt, hsa; identical to SEQ ID NO: 32677

SEQ ID NO: 404268 - RNA, 64 nt, hsa; identical to SEQ ID NO: 32678

SEQ ID NO: 404269 - RNA, 64 nt, hsa; identical to SEQ ID NO: 32679

SEQ ID NO: 404270 - RNA, 64 nt, hsa; identical to SEQ ID NO: 32680

SEQ ID NO: 404271 - RNA, 64 nt, hsa; identical to SEQ ID NO: 32681

SEQ ID NO: 404272 - RNA, 64 nt, hsa; identical to SEQ ID NO: 32682

SEQ ID NO: 404273 - RNA, 64 nt, hsa; identical to SEQ ID NO: 32683

SEQ ID NO: 404274 - RNA, 64 nt, hsa; identical to SEQ ID NO: 32684

SEQ ID NO: 404275 - RNA, 64 nt, hsa; identical to SEQ ID NO: 32685

SEQ ID NO: 404276 - RNA, 64 nt, hsa; identical to SEQ ID NO: 32686

SEQ ID NO: 404277 - RNA, 64 nt, hsa; identical to SEQ ID NO: 32687

SEQ ID NO: 404278 - RNA, 64 nt, hsa; identical to SEQ ID NO: 32688

SEQ ID NO: 404279 - RNA, 64 nt, hsa; identical to SEQ ID NO: 32689

SEQ ID NO: 404280 - RNA, 64 nt, hsa; identical to SEQ ID NO: 32690

SEQ ID NO: 404281 - RNA, 64 nt, hsa; identical to SEQ ID NO: 32691

SEQ ID NO: 404282 - RNA, 64 nt, hsa; identical to SEQ ID NO: 32692

SEQ ID NO: 404283 - RNA, 64 nt, hsa; identical to SEQ ID NO: 32693

SEQ ID NO: 404284 - RNA, 64 nt, hsa; identical to SEQ ID NO: 32694

SEQ ID NO: 404285 - RNA, 64 nt, hsa; identical to SEQ ID NO: 32695

SEQ ID NO: 404286 - RNA, 64 nt, hsa; identical to SEQ ID NO: 32696

SEQ ID NO: 404287 - RNA, 64 nt, hsa; identical to SEQ ID NO: 32697

SEQ ID NO: 404288 - RNA, 64 nt, hsa; identical to SEQ ID NO: 32698

SEQ ID NO: 404289 - RNA, 64 nt, hsa; identical to SEQ ID NO: 32699

SEQ ID NO: 404290 - RNA, 64 nt, hsa; identical to SEQ ID NO: 32700

SEQ ID NO: 404291 - RNA, 64 nt, hsa; identical to SEQ ID NO: 32701

SEQ ID NO: 404292 - RNA, 64 nt, hsa; identical to SEQ ID NO: 32702

SEQ ID NO: 404293 - RNA, 64 nt, hsa; identical to SEQ ID NO: 32703

SEQ ID NO: 404294 - RNA, 64 nt, hsa; identical to SEQ ID NO: 32704

SEQ ID NO: 404295 - RNA, 64 nt, hsa; identical to SEQ ID NO: 32705

SEQ ID NO: 404296 - RNA, 64 nt, hsa; identical to SEQ ID NO: 32706

SEQ ID NO: 404297 - RNA, 64 nt, hsa; identical to SEQ ID NO: 32707

SEQ ID NO: 404298 - RNA, 64 nt, hsa; identical to SEQ ID NO: 32708

SEQ ID NO: 404299 - RNA, 64 nt, hsa; identical to SEQ ID NO: 32709

SEQ ID NO: 404300 - RNA, 64 nt, hsa; identical to SEQ ID NO: 32710

SEQ ID NO: 404301 - RNA, 64 nt, hsa; identical to SEQ ID NO: 32711

SEQ ID NO: 404302 - RNA, 64 nt, hsa; identical to SEQ ID NO: 32712

SEQ ID NO: 404303 - RNA, 64 nt, hsa; identical to SEQ ID NO: 32713

SEQ ID NO: 404304 - RNA, 64 nt, hsa; identical to SEQ ID NO: 32714

SEQ ID NO: 404305 - RNA, 64 nt, hsa; identical to SEQ ID NO: 32715

SEQ ID NO: 404306 - RNA, 64 nt, hsa; identical to SEQ ID NO: 32716

SEQ ID NO: 404307 - RNA, 64 nt, hsa; identical to SEQ ID NO: 32717

SEQ ID NO: 404308 - RNA, 64 nt, hsa; identical to SEQ ID NO: 32718

SEQ ID NO: 404309 - RNA, 64 nt, hsa; identical to SEQ ID NO: 32719

SEQ ID NO: 404310 - RNA, 64 nt, hsa; identical to SEQ ID NO: 32720

SEQ ID NO: 404311 - RNA, 64 nt, hsa; identical to SEQ ID NO: 32721

SEQ ID NO: 404312 - RNA, 64 nt, hsa; identical to SEQ ID NO: 32722

SEQ ID NO: 404313 - RNA, 64 nt, hsa; identical to SEQ ID NO: 32723

SEQ ID NO: 404314 - RNA, 64 nt, hsa; identical to SEQ ID NO: 32724

SEQ ID NO: 404315 - RNA, 64 nt, hsa; identical to SEQ ID NO: 32725

SEQ ID NO: 404316 - RNA, 64 nt, hsa; identical to SEQ ID NO: 32726

SEQ ID NO: 404317 - RNA, 64 nt, hsa; identical to SEQ ID NO: 32727

SEQ ID NO: 404318 - RNA, 64 nt, hsa; identical to SEQ ID NO: 32728

SEQ ID NO: 404319 - RNA, 64 nt, hsa; identical to SEQ ID NO: 32729

SEQ ID NO: 404320 - RNA, 64 nt, hsa; identical to SEQ ID NO: 32730

SEQ ID NO: 404321 - RNA, 64 nt, hsa; identical to SEQ ID NO: 32731

SEQ ID NO: 404322 - RNA, 64 nt, hsa; identical to SEQ ID NO: 32732

SEQ ID NO: 404323 - RNA, 64 nt, hsa; identical to SEQ ID NO: 32733

SEQ ID NO: 404324 - RNA, 64 nt, hsa; identical to SEQ ID NO: 32734

SEQ ID NO: 404325 - RNA, 64 nt, hsa; identical to SEQ ID NO: 32735

SEQ ID NO: 404326 - RNA, 64 nt, hsa; identical to SEQ ID NO: 32736

SEQ ID NO: 404327 - RNA, 64 nt, hsa; identical to SEQ ID NO: 32737

SEQ ID NO: 404328 - RNA, 64 nt, hsa; identical to SEQ ID NO: 32738

SEQ ID NO: 404329 - RNA, 64 nt, hsa; identical to SEQ ID NO: 32739

SEQ ID NO: 404330 - RNA, 64 nt, hsa; identical to SEQ ID NO: 32740

SEQ ID NO: 404331 - RNA, 64 nt, hsa; identical to SEQ ID NO: 32741

SEQ ID NO: 404332 - RNA, 64 nt, hsa; identical to SEQ ID NO: 32742

SEQ ID NO: 404333 - RNA, 64 nt, hsa; identical to SEQ ID NO: 32743

SEQ ID NO: 404334 - RNA, 64 nt, hsa; identical to SEQ ID NO: 32744

SEQ ID NO: 404335 - RNA, 64 nt, hsa; identical to SEQ ID NO: 32745

SEQ ID NO: 404336 - RNA, 64 nt, hsa; identical to SEQ ID NO: 32746

SEQ ID NO: 404337 - RNA, 64 nt, hsa; identical to SEQ ID NO: 32747

SEQ ID NO: 404338 - RNA, 64 nt, hsa; identical to SEQ ID NO: 32748

SEQ ID NO: 404339 - RNA, 64 nt, hsa; identical to SEQ ID NO: 32749

SEQ ID NO: 404340 - RNA, 64 nt, hsa; identical to SEQ ID NO: 32750

SEQ ID NO: 404341 - RNA, 64 nt, hsa; identical to SEQ ID NO: 32751

SEQ ID NO: 404342 - RNA, 64 nt, hsa; identical to SEQ ID NO: 32752

SEQ ID NO: 404343 - RNA, 64 nt, hsa; identical to SEQ ID NO: 32753

SEQ ID NO: 404344 - RNA, 64 nt, hsa; identical to SEQ ID NO: 32754

SEQ ID NO: 404345 - RNA, 64 nt, hsa; identical to SEQ ID NO: 32755

SEQ ID NO: 404346 - RNA, 64 nt, hsa; identical to SEQ ID NO: 32756

SEQ ID NO: 404347 - RNA, 64 nt, hsa; identical to SEQ ID NO: 32757

SEQ ID NO: 404348 - RNA, 64 nt, hsa; identical to SEQ ID NO: 32758

SEQ ID NO: 404349 - RNA, 64 nt, hsa; identical to SEQ ID NO: 32759

SEQ ID NO: 404350 - RNA, 64 nt, hsa; identical to SEQ ID NO: 32760

SEQ ID NO: 404351 - RNA, 64 nt, hsa; identical to SEQ ID NO: 32761

SEQ ID NO: 404352 - RNA, 64 nt, hsa; identical to SEQ ID NO: 32762

SEQ ID NO: 404353 - RNA, 64 nt, hsa; identical to SEQ ID NO: 32763

SEQ ID NO: 404354 - RNA, 64 nt, hsa; identical to SEQ ID NO: 32764

SEQ ID NO: 404355 - RNA, 64 nt, hsa; identical to SEQ ID NO: 32765

SEQ ID NO: 404356 - RNA, 64 nt, hsa; identical to SEQ ID NO: 32766

SEQ ID NO: 404357 - RNA, 64 nt, hsa; identical to SEQ ID NO: 32767

SEQ ID NO: 404358 - RNA, 64 nt, hsa; identical to SEQ ID NO: 32768

SEQ ID NO: 404359 - RNA, 64 nt, hsa; identical to SEQ ID NO: 32769

SEQ ID NO: 404360 - RNA, 64 nt, hsa; identical to SEQ ID NO: 32770

SEQ ID NO: 404361 - RNA, 64 nt, hsa; identical to SEQ ID NO: 32771

SEQ ID NO: 404362 - RNA, 64 nt, hsa; identical to SEQ ID NO: 32772

SEQ ID NO: 404363 - RNA, 64 nt, hsa; identical to SEQ ID NO: 32773

SEQ ID NO: 404364 - RNA, 64 nt, hsa; identical to SEQ ID NO: 32774

SEQ ID NO: 404365 - RNA, 64 nt, hsa; identical to SEQ ID NO: 32775

SEQ ID NO: 404366 - RNA, 64 nt, hsa; identical to SEQ ID NO: 32776

SEQ ID NO: 404367 - RNA, 64 nt, hsa; identical to SEQ ID NO: 32777

SEQ ID NO: 404368 - RNA, 64 nt, hsa; identical to SEQ ID NO: 32778

SEQ ID NO: 404369 - RNA, 64 nt, hsa; identical to SEQ ID NO: 32779

SEQ ID NO: 404370 - RNA, 64 nt, hsa; identical to SEQ ID NO: 32780

SEQ ID NO: 404371 - RNA, 64 nt, hsa; identical to SEQ ID NO: 32781

SEQ ID NO: 404372 - RNA, 64 nt, hsa; identical to SEQ ID NO: 32782

SEQ ID NO: 404373 - RNA, 64 nt, hsa; identical to SEQ ID NO: 32783

SEQ ID NO: 404374 - RNA, 64 nt, hsa; identical to SEQ ID NO: 32784

SEQ ID NO: 404375 - RNA, 64 nt, hsa; identical to SEQ ID NO: 32785

SEQ ID NO: 404376 - RNA, 64 nt, hsa; identical to SEQ ID NO: 32786

SEQ ID NO: 404377 - RNA, 64 nt, hsa; identical to SEQ ID NO: 32787

SEQ ID NO: 404378 - RNA, 64 nt, hsa; identical to SEQ ID NO: 32788

SEQ ID NO: 404379 - RNA, 64 nt, hsa; identical to SEQ ID NO: 32789

SEQ ID NO: 404380 - RNA, 64 nt, hsa; identical to SEQ ID NO: 32790

SEQ ID NO: 404381 - RNA, 64 nt, hsa; identical to SEQ ID NO: 32791

SEQ ID NO: 404382 - RNA, 64 nt, hsa; identical to SEQ ID NO: 32792

SEQ ID NO: 404383 - RNA, 64 nt, hsa; identical to SEQ ID NO: 32793

SEQ ID NO: 404384 - RNA, 64 nt, hsa; identical to SEQ ID NO: 32794

SEQ ID NO: 404385 - RNA, 64 nt, hsa; identical to SEQ ID NO: 32795

SEQ ID NO: 404386 - RNA, 64 nt, hsa; identical to SEQ ID NO: 32796

SEQ ID NO: 404387 - RNA, 64 nt, hsa; identical to SEQ ID NO: 32797

SEQ ID NO: 404388 - RNA, 64 nt, hsa; identical to SEQ ID NO: 32798

SEQ ID NO: 404389 - RNA, 64 nt, hsa; identical to SEQ ID NO: 32799

SEQ ID NO: 404390 - RNA, 64 nt, hsa; identical to SEQ ID NO: 32800

SEQ ID NO: 404391 - RNA, 64 nt, hsa; identical to SEQ ID NO: 32801

SEQ ID NO: 404392 - RNA, 64 nt, hsa; identical to SEQ ID NO: 32802

SEQ ID NO: 404393 - RNA, 64 nt, hsa; identical to SEQ ID NO: 32803

SEQ ID NO: 404394 - RNA, 64 nt, hsa; identical to SEQ ID NO: 32804

SEQ ID NO: 404395 - RNA, 64 nt, hsa; identical to SEQ ID NO: 32805

SEQ ID NO: 404396 - RNA, 64 nt, hsa; identical to SEQ ID NO: 32806

SEQ ID NO: 404397 - RNA, 64 nt, hsa; identical to SEQ ID NO: 32807

SEQ ID NO: 404398 - RNA, 64 nt, hsa; identical to SEQ ID NO: 32808

SEQ ID NO: 404399 - RNA, 64 nt, hsa; identical to SEQ ID NO: 32809

SEQ ID NO: 404400 - RNA, 64 nt, hsa; identical to SEQ ID NO: 32810

SEQ ID NO: 404401 - RNA, 64 nt, hsa; identical to SEQ ID NO: 32811

SEQ ID NO: 404402 - RNA, 64 nt, hsa; identical to SEQ ID NO: 32812

SEQ ID NO: 404403 - RNA, 64 nt, hsa; identical to SEQ ID NO: 32813

SEQ ID NO: 404404 - RNA, 64 nt, hsa; identical to SEQ ID NO: 32814

SEQ ID NO: 404405 - RNA, 64 nt, hsa; identical to SEQ ID NO: 32815

SEQ ID NO: 404406 - RNA, 64 nt, hsa; identical to SEQ ID NO: 32816

SEQ ID NO: 404407 - RNA, 64 nt, hsa; identical to SEQ ID NO: 32817

SEQ ID NO: 404408 - RNA, 64 nt, hsa; identical to SEQ ID NO: 32818

SEQ ID NO: 404409 - RNA, 64 nt, hsa; identical to SEQ ID NO: 32819

SEQ ID NO: 404410 - RNA, 64 nt, hsa; identical to SEQ ID NO: 32820

SEQ ID NO: 404411 - RNA, 64 nt, hsa; identical to SEQ ID NO: 32821

SEQ ID NO: 404412 - RNA, 64 nt, hsa; identical to SEQ ID NO: 32822

SEQ ID NO: 404413 - RNA, 64 nt, hsa; identical to SEQ ID NO: 32823

SEQ ID NO: 404414 - RNA, 64 nt, hsa; identical to SEQ ID NO: 32824

SEQ ID NO: 404415 - RNA, 64 nt, hsa; identical to SEQ ID NO: 32825

SEQ ID NO: 404416 - RNA, 64 nt, hsa; identical to SEQ ID NO: 32826

SEQ ID NO: 404417 - RNA, 64 nt, hsa; identical to SEQ ID NO: 32827

SEQ ID NO: 404418 - RNA, 64 nt, hsa; identical to SEQ ID NO: 32828

SEQ ID NO: 404419 - RNA, 64 nt, hsa; identical to SEQ ID NO: 32829

SEQ ID NO: 404420 - RNA, 64 nt, hsa; identical to SEQ ID NO: 32830

SEQ ID NO: 404421 - RNA, 64 nt, hsa; identical to SEQ ID NO: 32831

SEQ ID NO: 404422 - RNA, 64 nt, hsa; identical to SEQ ID NO: 32832

SEQ ID NO: 404423 - RNA, 64 nt, hsa; identical to SEQ ID NO: 32833

SEQ ID NO: 404424 - RNA, 64 nt, hsa; identical to SEQ ID NO: 32834

SEQ ID NO: 404425 - RNA, 64 nt, hsa; identical to SEQ ID NO: 32835

SEQ ID NO: 404426 - RNA, 64 nt, hsa; identical to SEQ ID NO: 32836

SEQ ID NO: 404427 - RNA, 64 nt, hsa; identical to SEQ ID NO: 32837

SEQ ID NO: 404428 - RNA, 64 nt, hsa; identical to SEQ ID NO: 32838

SEQ ID NO: 404429 - RNA, 64 nt, hsa; identical to SEQ ID NO: 32839

SEQ ID NO: 404430 - RNA, 64 nt, hsa; identical to SEQ ID NO: 32840

SEQ ID NO: 404431 - RNA, 64 nt, hsa; identical to SEQ ID NO: 32841

SEQ ID NO: 404432 - RNA, 64 nt, hsa; identical to SEQ ID NO: 32842

SEQ ID NO: 404433 - RNA, 64 nt, hsa; identical to SEQ ID NO: 32843

SEQ ID NO: 404434 - RNA, 64 nt, hsa; identical to SEQ ID NO: 32844

SEQ ID NO: 404435 - RNA, 64 nt, hsa; identical to SEQ ID NO: 32845

SEQ ID NO: 404436 - RNA, 64 nt, hsa; identical to SEQ ID NO: 32846

SEQ ID NO: 404437 - RNA, 64 nt, hsa; identical to SEQ ID NO: 32847

SEQ ID NO: 404438 - RNA, 64 nt, hsa; identical to SEQ ID NO: 32848

SEQ ID NO: 404439 - RNA, 64 nt, hsa; identical to SEQ ID NO: 32849

SEQ ID NO: 404440 - RNA, 64 nt, hsa; identical to SEQ ID NO: 32850

SEQ ID NO: 404441 - RNA, 64 nt, hsa; identical to SEQ ID NO: 32851

SEQ ID NO: 404442 - RNA, 53 nt, hsa; identical to SEQ ID NO: 32852

SEQ ID NO: 404443 - RNA, 52 nt, hsa; identical to SEQ ID NO: 32853

SEQ ID NO: 404444 - RNA, 51 nt, hsa; identical to SEQ ID NO: 32854

SEQ ID NO: 404445 - RNA, 50 nt, hsa; identical to SEQ ID NO: 32855

SEQ ID NO: 404446 - RNA, 64 nt, hsa; identical to SEQ ID NO: 32856

SEQ ID NO: 404447 - RNA, 64 nt, hsa; identical to SEQ ID NO: 32857

SEQ ID NO: 404448 - RNA, 64 nt, hsa; identical to SEQ ID NO: 32858

SEQ ID NO: 404449 - RNA, 64 nt, hsa; identical to SEQ ID NO: 32859

SEQ ID NO: 404450 - RNA, 64 nt, hsa; identical to SEQ ID NO: 32860

SEQ ID NO: 404451 - RNA, 64 nt, hsa; identical to SEQ ID NO: 32861

SEQ ID NO: 404452 - RNA, 64 nt, hsa; identical to SEQ ID NO: 32862

SEQ ID NO: 404453 - RNA, 64 nt, hsa; identical to SEQ ID NO: 32863

SEQ ID NO: 404454 - RNA, 64 nt, hsa; identical to SEQ ID NO: 32864

SEQ ID NO: 404455 - RNA, 64 nt, hsa; identical to SEQ ID NO: 32865

SEQ ID NO: 404456 - RNA, 64 nt, hsa; identical to SEQ ID NO: 32866

SEQ ID NO: 404457 - RNA, 64 nt, hsa; identical to SEQ ID NO: 32867

SEQ ID NO: 404458 - RNA, 64 nt, hsa; identical to SEQ ID NO: 32868

SEQ ID NO: 404459 - RNA, 64 nt, hsa; identical to SEQ ID NO: 32869

SEQ ID NO: 404460 - RNA, 64 nt, hsa; identical to SEQ ID NO: 32870

SEQ ID NO: 404461 - RNA, 64 nt, hsa; identical to SEQ ID NO: 32871

SEQ ID NO: 404462 - RNA, 64 nt, hsa; identical to SEQ ID NO: 32872

SEQ ID NO: 404463 - RNA, 64 nt, hsa; identical to SEQ ID NO: 32873

SEQ ID NO: 404464 - RNA, 64 nt, hsa; identical to SEQ ID NO: 32874

SEQ ID NO: 404465 - RNA, 64 nt, hsa; identical to SEQ ID NO: 32875

SEQ ID NO: 404466 - RNA, 64 nt, hsa; identical to SEQ ID NO: 32876

SEQ ID NO: 404467 - RNA, 64 nt, hsa; identical to SEQ ID NO: 32877

SEQ ID NO: 404468 - RNA, 64 nt, hsa; identical to SEQ ID NO: 32878

SEQ ID NO: 404469 - RNA, 64 nt, hsa; identical to SEQ ID NO: 32879

SEQ ID NO: 404470 - RNA, 64 nt, hsa; identical to SEQ ID NO: 32880

SEQ ID NO: 404471 - RNA, 64 nt, hsa; identical to SEQ ID NO: 32881

SEQ ID NO: 404472 - RNA, 64 nt, hsa; identical to SEQ ID NO: 32882

SEQ ID NO: 404473 - RNA, 64 nt, hsa; identical to SEQ ID NO: 32883

SEQ ID NO: 404474 - RNA, 64 nt, hsa; identical to SEQ ID NO: 32884

SEQ ID NO: 404475 - RNA, 64 nt, hsa; identical to SEQ ID NO: 32885

SEQ ID NO: 404476 - RNA, 64 nt, hsa; identical to SEQ ID NO: 32886

SEQ ID NO: 404477 - RNA, 64 nt, hsa; identical to SEQ ID NO: 32887

SEQ ID NO: 404478 - RNA, 64 nt, hsa; identical to SEQ ID NO: 32888

SEQ ID NO: 404479 - RNA, 64 nt, hsa; identical to SEQ ID NO: 32889

SEQ ID NO: 404480 - RNA, 64 nt, hsa; identical to SEQ ID NO: 32890

SEQ ID NO: 404481 - RNA, 64 nt, hsa; identical to SEQ ID NO: 32891

SEQ ID NO: 404482 - RNA, 64 nt, hsa; identical to SEQ ID NO: 32892

SEQ ID NO: 404483 - RNA, 64 nt, hsa; identical to SEQ ID NO: 32893

SEQ ID NO: 404484 - RNA, 64 nt, hsa; identical to SEQ ID NO: 32894

SEQ ID NO: 404485 - RNA, 64 nt, hsa; identical to SEQ ID NO: 32895

SEQ ID NO: 404486 - RNA, 64 nt, hsa; identical to SEQ ID NO: 32896

SEQ ID NO: 404487 - RNA, 64 nt, hsa; identical to SEQ ID NO: 32897

SEQ ID NO: 404488 - RNA, 64 nt, hsa; identical to SEQ ID NO: 32898

SEQ ID NO: 404489 - RNA, 64 nt, hsa; identical to SEQ ID NO: 32899

SEQ ID NO: 404490 - RNA, 64 nt, hsa; identical to SEQ ID NO: 32900

SEQ ID NO: 404491 - RNA, 64 nt, hsa; identical to SEQ ID NO: 32901

SEQ ID NO: 404492 - RNA, 64 nt, hsa; identical to SEQ ID NO: 32902

SEQ ID NO: 404493 - RNA, 64 nt, hsa; identical to SEQ ID NO: 32903

SEQ ID NO: 404494 - RNA, 64 nt, hsa; identical to SEQ ID NO: 32904

SEQ ID NO: 404495 - RNA, 64 nt, hsa; identical to SEQ ID NO: 32905

SEQ ID NO: 404496 - RNA, 64 nt, hsa; identical to SEQ ID NO: 32906

SEQ ID NO: 404497 - RNA, 64 nt, hsa; identical to SEQ ID NO: 32907

SEQ ID NO: 404498 - RNA, 64 nt, hsa; identical to SEQ ID NO: 32908

SEQ ID NO: 404499 - RNA, 64 nt, hsa; identical to SEQ ID NO: 32909

SEQ ID NO: 404500 - RNA, 64 nt, hsa; identical to SEQ ID NO: 32910

SEQ ID NO: 404501 - RNA, 64 nt, hsa; identical to SEQ ID NO: 32911

SEQ ID NO: 404502 - RNA, 64 nt, hsa; identical to SEQ ID NO: 32912

SEQ ID NO: 404503 - RNA, 64 nt, hsa; identical to SEQ ID NO: 32913

SEQ ID NO: 404504 - RNA, 64 nt, hsa; identical to SEQ ID NO: 32914

SEQ ID NO: 404505 - RNA, 64 nt, hsa; identical to SEQ ID NO: 32915

SEQ ID NO: 404506 - RNA, 64 nt, hsa; identical to SEQ ID NO: 32916

SEQ ID NO: 404507 - RNA, 64 nt, hsa; identical to SEQ ID NO: 32917

SEQ ID NO: 404508 - RNA, 64 nt, hsa; identical to SEQ ID NO: 32918

SEQ ID NO: 404509 - RNA, 64 nt, hsa; identical to SEQ ID NO: 32919

SEQ ID NO: 404510 - RNA, 64 nt, hsa; identical to SEQ ID NO: 32920

SEQ ID NO: 404511 - RNA, 64 nt, hsa; identical to SEQ ID NO: 32921

SEQ ID NO: 404512 - RNA, 64 nt, hsa; identical to SEQ ID NO: 32922

SEQ ID NO: 404513 - RNA, 64 nt, hsa; identical to SEQ ID NO: 32923

SEQ ID NO: 404514 - RNA, 64 nt, hsa; identical to SEQ ID NO: 32924

SEQ ID NO: 404515 - RNA, 64 nt, hsa; identical to SEQ ID NO: 32925

SEQ ID NO: 404516 - RNA, 64 nt, hsa; identical to SEQ ID NO: 32926

SEQ ID NO: 404517 - RNA, 64 nt, hsa; identical to SEQ ID NO: 32927

SEQ ID NO: 404518 - RNA, 64 nt, hsa; identical to SEQ ID NO: 32928

SEQ ID NO: 404519 - RNA, 64 nt, hsa; identical to SEQ ID NO: 32929

SEQ ID NO: 404520 - RNA, 64 nt, hsa; identical to SEQ ID NO: 32930

SEQ ID NO: 404521 - RNA, 64 nt, hsa; identical to SEQ ID NO: 32931

SEQ ID NO: 404522 - RNA, 64 nt, hsa; identical to SEQ ID NO: 32932

SEQ ID NO: 404523 - RNA, 64 nt, hsa; identical to SEQ ID NO: 32933

SEQ ID NO: 404524 - RNA, 64 nt, hsa; identical to SEQ ID NO: 32934

SEQ ID NO: 404525 - RNA, 64 nt, hsa; identical to SEQ ID NO: 32935

SEQ ID NO: 404526 - RNA, 64 nt, hsa; identical to SEQ ID NO: 32936

SEQ ID NO: 404527 - RNA, 64 nt, hsa; identical to SEQ ID NO: 32937

SEQ ID NO: 404528 - RNA, 64 nt, hsa; identical to SEQ ID NO: 32938

SEQ ID NO: 404529 - RNA, 64 nt, hsa; identical to SEQ ID NO: 32939

SEQ ID NO: 404530 - RNA, 64 nt, hsa; identical to SEQ ID NO: 32940

SEQ ID NO: 404531 - RNA, 64 nt, hsa; identical to SEQ ID NO: 32941

SEQ ID NO: 404532 - RNA, 64 nt, hsa; identical to SEQ ID NO: 32942

SEQ ID NO: 404533 - RNA, 64 nt, hsa; identical to SEQ ID NO: 32943

SEQ ID NO: 404534 - RNA, 64 nt, hsa; identical to SEQ ID NO: 32944

SEQ ID NO: 404535 - RNA, 64 nt, hsa; identical to SEQ ID NO: 32945

SEQ ID NO: 404536 - RNA, 64 nt, hsa; identical to SEQ ID NO: 32946

SEQ ID NO: 404537 - RNA, 64 nt, hsa; identical to SEQ ID NO: 32947

SEQ ID NO: 404538 - RNA, 64 nt, hsa; identical to SEQ ID NO: 32948

SEQ ID NO: 404539 - RNA, 64 nt, hsa; identical to SEQ ID NO: 32949

SEQ ID NO: 404540 - RNA, 64 nt, hsa; identical to SEQ ID NO: 32950

SEQ ID NO: 404541 - RNA, 64 nt, hsa; identical to SEQ ID NO: 32951

SEQ ID NO: 404542 - RNA, 64 nt, hsa; identical to SEQ ID NO: 32952

SEQ ID NO: 404543 - RNA, 64 nt, hsa; identical to SEQ ID NO: 32953

SEQ ID NO: 404544 - RNA, 64 nt, hsa; identical to SEQ ID NO: 32954

SEQ ID NO: 404545 - RNA, 64 nt, hsa; identical to SEQ ID NO: 32955

SEQ ID NO: 404546 - RNA, 64 nt, hsa; identical to SEQ ID NO: 32956

SEQ ID NO: 404547 - RNA, 64 nt, hsa; identical to SEQ ID NO: 32957

SEQ ID NO: 404548 - RNA, 64 nt, hsa; identical to SEQ ID NO: 32958

SEQ ID NO: 404549 - RNA, 64 nt, hsa; identical to SEQ ID NO: 32959

SEQ ID NO: 404550 - RNA, 64 nt, hsa; identical to SEQ ID NO: 32960

SEQ ID NO: 404551 - RNA, 64 nt, hsa; identical to SEQ ID NO: 32961

SEQ ID NO: 404552 - RNA, 64 nt, hsa; identical to SEQ ID NO: 32962

SEQ ID NO: 404553 - RNA, 64 nt, hsa; identical to SEQ ID NO: 32963

SEQ ID NO: 404554 - RNA, 64 nt, hsa; identical to SEQ ID NO: 32964

SEQ ID NO: 404555 - RNA, 64 nt, hsa; identical to SEQ ID NO: 32965

SEQ ID NO: 404556 - RNA, 64 nt, hsa; identical to SEQ ID NO: 32966

SEQ ID NO: 404557 - RNA, 64 nt, hsa; identical to SEQ ID NO: 32967

SEQ ID NO: 404558 - RNA, 64 nt, hsa; identical to SEQ ID NO: 32968

SEQ ID NO: 404559 - RNA, 64 nt, hsa; identical to SEQ ID NO: 32969

SEQ ID NO: 404560 - RNA, 64 nt, hsa; identical to SEQ ID NO: 32970

SEQ ID NO: 404561 - RNA, 64 nt, hsa; identical to SEQ ID NO: 32971

SEQ ID NO: 404562 - RNA, 64 nt, hsa; identical to SEQ ID NO: 32972

SEQ ID NO: 404563 - RNA, 64 nt, hsa; identical to SEQ ID NO: 32973

SEQ ID NO: 404564 - RNA, 64 nt, hsa; identical to SEQ ID NO: 32974

SEQ ID NO: 404565 - RNA, 64 nt, hsa; identical to SEQ ID NO: 32975

SEQ ID NO: 404566 - RNA, 64 nt, hsa; identical to SEQ ID NO: 32976

SEQ ID NO: 404567 - RNA, 64 nt, hsa; identical to SEQ ID NO: 32977

SEQ ID NO: 404568 - RNA, 64 nt, hsa; identical to SEQ ID NO: 32978

SEQ ID NO: 404569 - RNA, 64 nt, hsa; identical to SEQ ID NO: 32979

SEQ ID NO: 404570 - RNA, 64 nt, hsa; identical to SEQ ID NO: 32980

SEQ ID NO: 404571 - RNA, 64 nt, hsa; identical to SEQ ID NO: 32981

SEQ ID NO: 404572 - RNA, 64 nt, hsa; identical to SEQ ID NO: 32982

SEQ ID NO: 404573 - RNA, 64 nt, hsa; identical to SEQ ID NO: 32983

SEQ ID NO: 404574 - RNA, 64 nt, hsa; identical to SEQ ID NO: 32984

SEQ ID NO: 404575 - RNA, 64 nt, hsa; identical to SEQ ID NO: 32985

SEQ ID NO: 404576 - RNA, 64 nt, hsa; identical to SEQ ID NO: 32986

SEQ ID NO: 404577 - RNA, 64 nt, hsa; identical to SEQ ID NO: 32987

SEQ ID NO: 404578 - RNA, 64 nt, hsa; identical to SEQ ID NO: 32988

SEQ ID NO: 404579 - RNA, 64 nt, hsa; identical to SEQ ID NO: 32989

SEQ ID NO: 404580 - RNA, 64 nt, hsa; identical to SEQ ID NO: 32990

SEQ ID NO: 404581 - RNA, 64 nt, hsa; identical to SEQ ID NO: 32991

SEQ ID NO: 404582 - RNA, 64 nt, hsa; identical to SEQ ID NO: 32992

SEQ ID NO: 404583 - RNA, 64 nt, hsa; identical to SEQ ID NO: 32993

SEQ ID NO: 404584 - RNA, 64 nt, hsa; identical to SEQ ID NO: 32994

SEQ ID NO: 404585 - RNA, 64 nt, hsa; identical to SEQ ID NO: 32995

SEQ ID NO: 404586 - RNA, 64 nt, hsa; identical to SEQ ID NO: 32996

SEQ ID NO: 404587 - RNA, 64 nt, hsa; identical to SEQ ID NO: 32997

SEQ ID NO: 404588 - RNA, 64 nt, hsa; identical to SEQ ID NO: 32998

SEQ ID NO: 404589 - RNA, 64 nt, hsa; identical to SEQ ID NO: 32999

SEQ ID NO: 404590 - RNA, 64 nt, hsa; identical to SEQ ID NO: 33000

SEQ ID NO: 404591 - RNA, 64 nt, hsa; identical to SEQ ID NO: 33001

SEQ ID NO: 404592 - RNA, 64 nt, hsa; identical to SEQ ID NO: 33002

SEQ ID NO: 404593 - RNA, 64 nt, hsa; identical to SEQ ID NO: 33003

SEQ ID NO: 404594 - RNA, 64 nt, hsa; identical to SEQ ID NO: 33004

SEQ ID NO: 404595 - RNA, 64 nt, hsa; identical to SEQ ID NO: 33005

SEQ ID NO: 404596 - RNA, 64 nt, hsa; identical to SEQ ID NO: 33006

SEQ ID NO: 404597 - RNA, 64 nt, hsa; identical to SEQ ID NO: 33007

SEQ ID NO: 404598 - RNA, 64 nt, hsa; identical to SEQ ID NO: 33008

SEQ ID NO: 404599 - RNA, 64 nt, hsa; identical to SEQ ID NO: 33009

SEQ ID NO: 404600 - RNA, 64 nt, hsa; identical to SEQ ID NO: 33010

SEQ ID NO: 404601 - RNA, 64 nt, hsa; identical to SEQ ID NO: 33011

SEQ ID NO: 404602 - RNA, 64 nt, hsa; identical to SEQ ID NO: 33012

SEQ ID NO: 404603 - RNA, 64 nt, hsa; identical to SEQ ID NO: 33013

SEQ ID NO: 404604 - RNA, 64 nt, hsa; identical to SEQ ID NO: 33014

SEQ ID NO: 404605 - RNA, 64 nt, hsa; identical to SEQ ID NO: 33015

SEQ ID NO: 404606 - RNA, 64 nt, hsa; identical to SEQ ID NO: 33016

SEQ ID NO: 404607 - RNA, 64 nt, hsa; identical to SEQ ID NO: 33017

SEQ ID NO: 404608 - RNA, 64 nt, hsa; identical to SEQ ID NO: 33018

SEQ ID NO: 404609 - RNA, 64 nt, hsa; identical to SEQ ID NO: 33019

SEQ ID NO: 404610 - RNA, 64 nt, hsa; identical to SEQ ID NO: 33020

SEQ ID NO: 404611 - RNA, 64 nt, hsa; identical to SEQ ID NO: 33021

SEQ ID NO: 404612 - RNA, 64 nt, hsa; identical to SEQ ID NO: 33022

SEQ ID NO: 404613 - RNA, 64 nt, hsa; identical to SEQ ID NO: 33023

SEQ ID NO: 404614 - RNA, 64 nt, hsa; identical to SEQ ID NO: 33024

SEQ ID NO: 404615 - RNA, 64 nt, hsa; identical to SEQ ID NO: 33025

SEQ ID NO: 404616 - RNA, 64 nt, hsa; identical to SEQ ID NO: 33026

SEQ ID NO: 404617 - RNA, 64 nt, hsa; identical to SEQ ID NO: 33027

SEQ ID NO: 404618 - RNA, 64 nt, hsa; identical to SEQ ID NO: 33028

SEQ ID NO: 404619 - RNA, 64 nt, hsa; identical to SEQ ID NO: 33029

SEQ ID NO: 404620 - RNA, 64 nt, hsa; identical to SEQ ID NO: 33030

SEQ ID NO: 404621 - RNA, 64 nt, hsa; identical to SEQ ID NO: 33031

SEQ ID NO: 404622 - RNA, 64 nt, hsa; identical to SEQ ID NO: 33032

SEQ ID NO: 404623 - RNA, 64 nt, hsa; identical to SEQ ID NO: 33033

SEQ ID NO: 404624 - RNA, 64 nt, hsa; identical to SEQ ID NO: 33034

SEQ ID NO: 404625 - RNA, 64 nt, hsa; identical to SEQ ID NO: 33035

SEQ ID NO: 404626 - RNA, 64 nt, hsa; identical to SEQ ID NO: 33036

SEQ ID NO: 404627 - RNA, 64 nt, hsa; identical to SEQ ID NO: 33037

SEQ ID NO: 404628 - RNA, 64 nt, hsa; identical to SEQ ID NO: 33038

SEQ ID NO: 404629 - RNA, 64 nt, hsa; identical to SEQ ID NO: 33039

SEQ ID NO: 404630 - RNA, 64 nt, hsa; identical to SEQ ID NO: 33040

SEQ ID NO: 404631 - RNA, 64 nt, hsa; identical to SEQ ID NO: 33041

SEQ ID NO: 404632 - RNA, 64 nt, hsa; identical to SEQ ID NO: 33042

SEQ ID NO: 404633 - RNA, 64 nt, hsa; identical to SEQ ID NO: 33043

SEQ ID NO: 404634 - RNA, 64 nt, hsa; identical to SEQ ID NO: 33044

SEQ ID NO: 404635 - RNA, 64 nt, hsa; identical to SEQ ID NO: 33045

SEQ ID NO: 404636 - RNA, 64 nt, hsa; identical to SEQ ID NO: 33046

SEQ ID NO: 404637 - RNA, 64 nt, hsa; identical to SEQ ID NO: 33047

SEQ ID NO: 404638 - RNA, 64 nt, hsa; identical to SEQ ID NO: 33048

SEQ ID NO: 404639 - RNA, 64 nt, hsa; identical to SEQ ID NO: 33049

SEQ ID NO: 404640 - RNA, 64 nt, hsa; identical to SEQ ID NO: 33050

SEQ ID NO: 404641 - RNA, 64 nt, hsa; identical to SEQ ID NO: 33051

SEQ ID NO: 404642 - RNA, 64 nt, hsa; identical to SEQ ID NO: 33052

SEQ ID NO: 404643 - RNA, 64 nt, hsa; identical to SEQ ID NO: 33053

SEQ ID NO: 404644 - RNA, 64 nt, hsa; identical to SEQ ID NO: 33054

SEQ ID NO: 404645 - RNA, 64 nt, hsa; identical to SEQ ID NO: 33055

SEQ ID NO: 404646 - RNA, 64 nt, hsa; identical to SEQ ID NO: 33056

SEQ ID NO: 404647 - RNA, 64 nt, hsa; identical to SEQ ID NO: 33057

SEQ ID NO: 404648 - RNA, 64 nt, hsa; identical to SEQ ID NO: 33058

SEQ ID NO: 404649 - RNA, 64 nt, hsa; identical to SEQ ID NO: 33059

SEQ ID NO: 404650 - RNA, 64 nt, hsa; identical to SEQ ID NO: 33060

SEQ ID NO: 404651 - RNA, 64 nt, hsa; identical to SEQ ID NO: 33061

SEQ ID NO: 404652 - RNA, 64 nt, hsa; identical to SEQ ID NO: 33062

SEQ ID NO: 404653 - RNA, 64 nt, hsa; identical to SEQ ID NO: 33063

SEQ ID NO: 404654 - RNA, 64 nt, hsa; identical to SEQ ID NO: 33064

SEQ ID NO: 404655 - RNA, 64 nt, hsa; identical to SEQ ID NO: 33065

SEQ ID NO: 404656 - RNA, 64 nt, hsa; identical to SEQ ID NO: 33066

SEQ ID NO: 404657 - RNA, 58 nt, hsa; identical to SEQ ID NO: 33067

SEQ ID NO: 404658 - RNA, 59 nt, hsa; identical to SEQ ID NO: 33068

SEQ ID NO: 404659 - RNA, 60 nt, hsa; identical to SEQ ID NO: 33069

SEQ ID NO: 404660 - RNA, 61 nt, hsa; identical to SEQ ID NO: 33070

SEQ ID NO: 404661 - RNA, 64 nt, hsa; identical to SEQ ID NO: 33071

SEQ ID NO: 404662 - RNA, 64 nt, hsa; identical to SEQ ID NO: 33072

SEQ ID NO: 404663 - RNA, 64 nt, hsa; identical to SEQ ID NO: 33073

SEQ ID NO: 404664 - RNA, 64 nt, hsa; identical to SEQ ID NO: 33074

SEQ ID NO: 404665 - RNA, 64 nt, hsa; identical to SEQ ID NO: 33075

SEQ ID NO: 404666 - RNA, 64 nt, hsa; identical to SEQ ID NO: 33076

SEQ ID NO: 404667 - RNA, 64 nt, hsa; identical to SEQ ID NO: 33077

SEQ ID NO: 404668 - RNA, 64 nt, hsa; identical to SEQ ID NO: 33078

SEQ ID NO: 404669 - RNA, 64 nt, hsa; identical to SEQ ID NO: 33079

SEQ ID NO: 404670 - RNA, 64 nt, hsa; identical to SEQ ID NO: 33080

SEQ ID NO: 404671 - RNA, 64 nt, hsa; identical to SEQ ID NO: 33081

SEQ ID NO: 404672 - RNA, 64 nt, hsa; identical to SEQ ID NO: 33082

SEQ ID NO: 404673 - RNA, 64 nt, hsa; identical to SEQ ID NO: 33083

SEQ ID NO: 404674 - RNA, 64 nt, hsa; identical to SEQ ID NO: 33084

SEQ ID NO: 404675 - RNA, 64 nt, hsa; identical to SEQ ID NO: 33085

SEQ ID NO: 404676 - RNA, 64 nt, hsa; identical to SEQ ID NO: 33086

SEQ ID NO: 404677 - RNA, 64 nt, hsa; identical to SEQ ID NO: 33087

SEQ ID NO: 404678 - RNA, 64 nt, hsa; identical to SEQ ID NO: 33088

SEQ ID NO: 404679 - RNA, 64 nt, hsa; identical to SEQ ID NO: 33089

SEQ ID NO: 404680 - RNA, 64 nt, hsa; identical to SEQ ID NO: 33090

SEQ ID NO: 404681 - RNA, 64 nt, hsa; identical to SEQ ID NO: 33091

SEQ ID NO: 404682 - RNA, 64 nt, hsa; identical to SEQ ID NO: 33092

SEQ ID NO: 404683 - RNA, 64 nt, hsa; identical to SEQ ID NO: 33093

SEQ ID NO: 404684 - RNA, 64 nt, hsa; identical to SEQ ID NO: 33094

SEQ ID NO: 404685 - RNA, 64 nt, hsa; identical to SEQ ID NO: 33095

SEQ ID NO: 404686 - RNA, 64 nt, hsa; identical to SEQ ID NO: 33096

SEQ ID NO: 404687 - RNA, 64 nt, hsa; identical to SEQ ID NO: 33097

SEQ ID NO: 404688 - RNA, 64 nt, hsa; identical to SEQ ID NO: 33098

SEQ ID NO: 404689 - RNA, 64 nt, hsa; identical to SEQ ID NO: 33099

SEQ ID NO: 404690 - RNA, 64 nt, hsa; identical to SEQ ID NO: 33100

SEQ ID NO: 404691 - RNA, 64 nt, hsa; identical to SEQ ID NO: 33101

SEQ ID NO: 404692 - RNA, 64 nt, hsa; identical to SEQ ID NO: 33102

SEQ ID NO: 404693 - RNA, 64 nt, hsa; identical to SEQ ID NO: 33103

SEQ ID NO: 404694 - RNA, 64 nt, hsa; identical to SEQ ID NO: 33104

SEQ ID NO: 404695 - RNA, 64 nt, hsa; identical to SEQ ID NO: 33105

SEQ ID NO: 404696 - RNA, 64 nt, hsa; identical to SEQ ID NO: 33106

SEQ ID NO: 404697 - RNA, 64 nt, hsa; identical to SEQ ID NO: 33107

SEQ ID NO: 404698 - RNA, 64 nt, hsa; identical to SEQ ID NO: 33108

SEQ ID NO: 404699 - RNA, 64 nt, hsa; identical to SEQ ID NO: 33109

SEQ ID NO: 404700 - RNA, 64 nt, hsa; identical to SEQ ID NO: 33110

SEQ ID NO: 404701 - RNA, 64 nt, hsa; identical to SEQ ID NO: 33111

SEQ ID NO: 404702 - RNA, 64 nt, hsa; identical to SEQ ID NO: 33112

SEQ ID NO: 404703 - RNA, 64 nt, hsa; identical to SEQ ID NO: 33113

SEQ ID NO: 404704 - RNA, 64 nt, hsa; identical to SEQ ID NO: 33114

SEQ ID NO: 404705 - RNA, 64 nt, hsa; identical to SEQ ID NO: 33115

SEQ ID NO: 404706 - RNA, 64 nt, hsa; identical to SEQ ID NO: 33116

SEQ ID NO: 404707 - RNA, 64 nt, hsa; identical to SEQ ID NO: 33117

SEQ ID NO: 404708 - RNA, 64 nt, hsa; identical to SEQ ID NO: 33118

SEQ ID NO: 404709 - RNA, 64 nt, hsa; identical to SEQ ID NO: 33119

SEQ ID NO: 404710 - RNA, 64 nt, hsa; identical to SEQ ID NO: 33120

SEQ ID NO: 404711 - RNA, 64 nt, hsa; identical to SEQ ID NO: 33121

SEQ ID NO: 404712 - RNA, 64 nt, hsa; identical to SEQ ID NO: 33122

SEQ ID NO: 404713 - RNA, 64 nt, hsa; identical to SEQ ID NO: 33123

SEQ ID NO: 404714 - RNA, 64 nt, hsa; identical to SEQ ID NO: 33124

SEQ ID NO: 404715 - RNA, 64 nt, hsa; identical to SEQ ID NO: 33125

SEQ ID NO: 404716 - RNA, 64 nt, hsa; identical to SEQ ID NO: 33126

SEQ ID NO: 404717 - RNA, 64 nt, hsa; identical to SEQ ID NO: 33127

SEQ ID NO: 404718 - RNA, 64 nt, hsa; identical to SEQ ID NO: 33128

SEQ ID NO: 404719 - RNA, 64 nt, hsa; identical to SEQ ID NO: 33129

SEQ ID NO: 404720 - RNA, 64 nt, hsa; identical to SEQ ID NO: 33130

SEQ ID NO: 404721 - RNA, 64 nt, hsa; identical to SEQ ID NO: 33131

SEQ ID NO: 404722 - RNA, 64 nt, hsa; identical to SEQ ID NO: 33132

SEQ ID NO: 404723 - RNA, 64 nt, hsa; identical to SEQ ID NO: 33133

SEQ ID NO: 404724 - RNA, 64 nt, hsa; identical to SEQ ID NO: 33134

SEQ ID NO: 404725 - RNA, 64 nt, hsa; identical to SEQ ID NO: 33135

SEQ ID NO: 404726 - RNA, 64 nt, hsa; identical to SEQ ID NO: 33136

SEQ ID NO: 404727 - RNA, 64 nt, hsa; identical to SEQ ID NO: 33137

SEQ ID NO: 404728 - RNA, 64 nt, hsa; identical to SEQ ID NO: 33138

SEQ ID NO: 404729 - RNA, 64 nt, hsa; identical to SEQ ID NO: 33139

SEQ ID NO: 404730 - RNA, 64 nt, hsa; identical to SEQ ID NO: 33140

SEQ ID NO: 404731 - RNA, 64 nt, hsa; identical to SEQ ID NO: 33141

SEQ ID NO: 404732 - RNA, 64 nt, hsa; identical to SEQ ID NO: 33142

SEQ ID NO: 404733 - RNA, 64 nt, hsa; identical to SEQ ID NO: 33143

SEQ ID NO: 404734 - RNA, 64 nt, hsa; identical to SEQ ID NO: 33144

SEQ ID NO: 404735 - RNA, 64 nt, hsa; identical to SEQ ID NO: 33145

SEQ ID NO: 404736 - RNA, 64 nt, hsa; identical to SEQ ID NO: 33146

SEQ ID NO: 404737 - RNA, 64 nt, hsa; identical to SEQ ID NO: 33147

SEQ ID NO: 404738 - RNA, 64 nt, hsa; identical to SEQ ID NO: 33148

SEQ ID NO: 404739 - RNA, 64 nt, hsa; identical to SEQ ID NO: 33149

SEQ ID NO: 404740 - RNA, 64 nt, hsa; identical to SEQ ID NO: 33150

SEQ ID NO: 404741 - RNA, 64 nt, hsa; identical to SEQ ID NO: 33151

SEQ ID NO: 404742 - RNA, 64 nt, hsa; identical to SEQ ID NO: 33152

SEQ ID NO: 404743 - RNA, 64 nt, hsa; identical to SEQ ID NO: 33153

SEQ ID NO: 404744 - RNA, 64 nt, hsa; identical to SEQ ID NO: 33154

SEQ ID NO: 404745 - RNA, 64 nt, hsa; identical to SEQ ID NO: 33155

SEQ ID NO: 404746 - RNA, 64 nt, hsa; identical to SEQ ID NO: 33156

SEQ ID NO: 404747 - RNA, 64 nt, hsa; identical to SEQ ID NO: 33157

SEQ ID NO: 404748 - RNA, 64 nt, hsa; identical to SEQ ID NO: 33158

SEQ ID NO: 404749 - RNA, 64 nt, hsa; identical to SEQ ID NO: 33159

SEQ ID NO: 404750 - RNA, 64 nt, hsa; identical to SEQ ID NO: 33160

SEQ ID NO: 404751 - RNA, 64 nt, hsa; identical to SEQ ID NO: 33161

SEQ ID NO: 404752 - RNA, 64 nt, hsa; identical to SEQ ID NO: 33162

SEQ ID NO: 404753 - RNA, 64 nt, hsa; identical to SEQ ID NO: 33163

SEQ ID NO: 404754 - RNA, 64 nt, hsa; identical to SEQ ID NO: 33164

SEQ ID NO: 404755 - RNA, 64 nt, hsa; identical to SEQ ID NO: 33165

SEQ ID NO: 404756 - RNA, 64 nt, hsa; identical to SEQ ID NO: 33166

SEQ ID NO: 404757 - RNA, 64 nt, hsa; identical to SEQ ID NO: 33167

SEQ ID NO: 404758 - RNA, 64 nt, hsa; identical to SEQ ID NO: 33168

SEQ ID NO: 404759 - RNA, 64 nt, hsa; identical to SEQ ID NO: 33169

SEQ ID NO: 404760 - RNA, 64 nt, hsa; identical to SEQ ID NO: 33170

SEQ ID NO: 404761 - RNA, 64 nt, hsa; identical to SEQ ID NO: 33171

SEQ ID NO: 404762 - RNA, 64 nt, hsa; identical to SEQ ID NO: 33172

SEQ ID NO: 404763 - RNA, 64 nt, hsa; identical to SEQ ID NO: 33173

SEQ ID NO: 404764 - RNA, 64 nt, hsa; identical to SEQ ID NO: 33174

SEQ ID NO: 404765 - RNA, 64 nt, hsa; identical to SEQ ID NO: 33175

SEQ ID NO: 404766 - RNA, 64 nt, hsa; identical to SEQ ID NO: 33176

SEQ ID NO: 404767 - RNA, 64 nt, hsa; identical to SEQ ID NO: 33177

SEQ ID NO: 404768 - RNA, 64 nt, hsa; identical to SEQ ID NO: 33178

SEQ ID NO: 404769 - RNA, 64 nt, hsa; identical to SEQ ID NO: 33179

SEQ ID NO: 404770 - RNA, 64 nt, hsa; identical to SEQ ID NO: 33180

SEQ ID NO: 404771 - RNA, 64 nt, hsa; identical to SEQ ID NO: 33181

SEQ ID NO: 404772 - RNA, 64 nt, hsa; identical to SEQ ID NO: 33182

SEQ ID NO: 404773 - RNA, 64 nt, hsa; identical to SEQ ID NO: 33183

SEQ ID NO: 404774 - RNA, 64 nt, hsa; identical to SEQ ID NO: 33184

SEQ ID NO: 404775 - RNA, 64 nt, hsa; identical to SEQ ID NO: 33185

SEQ ID NO: 404776 - RNA, 64 nt, hsa; identical to SEQ ID NO: 33186

SEQ ID NO: 404777 - RNA, 64 nt, hsa; identical to SEQ ID NO: 33187

SEQ ID NO: 404778 - RNA, 64 nt, hsa; identical to SEQ ID NO: 33188

SEQ ID NO: 404779 - RNA, 64 nt, hsa; identical to SEQ ID NO: 33189

SEQ ID NO: 404780 - RNA, 64 nt, hsa; identical to SEQ ID NO: 33190

SEQ ID NO: 404781 - RNA, 64 nt, hsa; identical to SEQ ID NO: 33191

SEQ ID NO: 404782 - RNA, 64 nt, hsa; identical to SEQ ID NO: 33192

SEQ ID NO: 404783 - RNA, 64 nt, hsa; identical to SEQ ID NO: 33193

SEQ ID NO: 404784 - RNA, 64 nt, hsa; identical to SEQ ID NO: 33194

SEQ ID NO: 404785 - RNA, 64 nt, hsa; identical to SEQ ID NO: 33195

SEQ ID NO: 404786 - RNA, 64 nt, hsa; identical to SEQ ID NO: 33196

SEQ ID NO: 404787 - RNA, 64 nt, hsa; identical to SEQ ID NO: 33197

SEQ ID NO: 404788 - RNA, 64 nt, hsa; identical to SEQ ID NO: 33198

SEQ ID NO: 404789 - RNA, 64 nt, hsa; identical to SEQ ID NO: 33199

SEQ ID NO: 404790 - RNA, 64 nt, hsa; identical to SEQ ID NO: 33200

SEQ ID NO: 404791 - RNA, 64 nt, hsa; identical to SEQ ID NO: 33201

SEQ ID NO: 404792 - RNA, 64 nt, hsa; identical to SEQ ID NO: 33202

SEQ ID NO: 404793 - RNA, 64 nt, hsa; identical to SEQ ID NO: 33203

SEQ ID NO: 404794 - RNA, 64 nt, hsa; identical to SEQ ID NO: 33204

SEQ ID NO: 404795 - RNA, 64 nt, hsa; identical to SEQ ID NO: 33205

SEQ ID NO: 404796 - RNA, 64 nt, hsa; identical to SEQ ID NO: 33206

SEQ ID NO: 404797 - RNA, 64 nt, hsa; identical to SEQ ID NO: 33207

SEQ ID NO: 404798 - RNA, 64 nt, hsa; identical to SEQ ID NO: 33208

SEQ ID NO: 404799 - RNA, 64 nt, hsa; identical to SEQ ID NO: 33209

SEQ ID NO: 404800 - RNA, 64 nt, hsa; identical to SEQ ID NO: 33210

SEQ ID NO: 404801 - RNA, 64 nt, hsa; identical to SEQ ID NO: 33211

SEQ ID NO: 404802 - RNA, 64 nt, hsa; identical to SEQ ID NO: 33212

SEQ ID NO: 404803 - RNA, 64 nt, hsa; identical to SEQ ID NO: 33213

SEQ ID NO: 404804 - RNA, 64 nt, hsa; identical to SEQ ID NO: 33214

SEQ ID NO: 404805 - RNA, 64 nt, hsa; identical to SEQ ID NO: 33215

SEQ ID NO: 404806 - RNA, 64 nt, hsa; identical to SEQ ID NO: 33216

SEQ ID NO: 404807 - RNA, 64 nt, hsa; identical to SEQ ID NO: 33217

SEQ ID NO: 404808 - RNA, 64 nt, hsa; identical to SEQ ID NO: 33218

SEQ ID NO: 404809 - RNA, 64 nt, hsa; identical to SEQ ID NO: 33219

SEQ ID NO: 404810 - RNA, 64 nt, hsa; identical to SEQ ID NO: 33220

SEQ ID NO: 404811 - RNA, 64 nt, hsa; identical to SEQ ID NO: 33221

SEQ ID NO: 404812 - RNA, 64 nt, hsa; identical to SEQ ID NO: 33222

SEQ ID NO: 404813 - RNA, 64 nt, hsa; identical to SEQ ID NO: 33223

SEQ ID NO: 404814 - RNA, 64 nt, hsa; identical to SEQ ID NO: 33224

SEQ ID NO: 404815 - RNA, 64 nt, hsa; identical to SEQ ID NO: 33225

SEQ ID NO: 404816 - RNA, 64 nt, hsa; identical to SEQ ID NO: 33226

SEQ ID NO: 404817 - RNA, 64 nt, hsa; identical to SEQ ID NO: 33227

SEQ ID NO: 404818 - RNA, 64 nt, hsa; identical to SEQ ID NO: 33228

SEQ ID NO: 404819 - RNA, 64 nt, hsa; identical to SEQ ID NO: 33229

SEQ ID NO: 404820 - RNA, 62 nt, hsa; identical to SEQ ID NO: 33230

SEQ ID NO: 404821 - RNA, 64 nt, hsa; identical to SEQ ID NO: 33231

SEQ ID NO: 404822 - RNA, 64 nt, hsa; identical to SEQ ID NO: 33232

SEQ ID NO: 404823 - RNA, 64 nt, hsa; identical to SEQ ID NO: 33233

SEQ ID NO: 404824 - RNA, 64 nt, hsa; identical to SEQ ID NO: 33234

SEQ ID NO: 404825 - RNA, 64 nt, hsa; identical to SEQ ID NO: 33235

SEQ ID NO: 404826 - RNA, 64 nt, hsa; identical to SEQ ID NO: 33236

SEQ ID NO: 404827 - RNA, 64 nt, hsa; identical to SEQ ID NO: 33237

SEQ ID NO: 404828 - RNA, 64 nt, hsa; identical to SEQ ID NO: 33238

SEQ ID NO: 404829 - RNA, 64 nt, hsa; identical to SEQ ID NO: 33239

SEQ ID NO: 404830 - RNA, 64 nt, hsa; identical to SEQ ID NO: 33240

SEQ ID NO: 404831 - RNA, 64 nt, hsa; identical to SEQ ID NO: 33241

SEQ ID NO: 404832 - RNA, 64 nt, hsa; identical to SEQ ID NO: 33242

SEQ ID NO: 404833 - RNA, 64 nt, hsa; identical to SEQ ID NO: 33243

SEQ ID NO: 404834 - RNA, 64 nt, hsa; identical to SEQ ID NO: 33244

SEQ ID NO: 404835 - RNA, 64 nt, hsa; identical to SEQ ID NO: 33245

SEQ ID NO: 404836 - RNA, 64 nt, hsa; identical to SEQ ID NO: 33246

SEQ ID NO: 404837 - RNA, 64 nt, hsa; identical to SEQ ID NO: 33247

SEQ ID NO: 404838 - RNA, 64 nt, hsa; identical to SEQ ID NO: 33248

SEQ ID NO: 404839 - RNA, 64 nt, hsa; identical to SEQ ID NO: 33249

SEQ ID NO: 404840 - RNA, 64 nt, hsa; identical to SEQ ID NO: 33250

SEQ ID NO: 404841 - RNA, 64 nt, hsa; identical to SEQ ID NO: 33251

SEQ ID NO: 404842 - RNA, 64 nt, hsa; identical to SEQ ID NO: 33252

SEQ ID NO: 404843 - RNA, 64 nt, hsa; identical to SEQ ID NO: 33253

SEQ ID NO: 404844 - RNA, 64 nt, hsa; identical to SEQ ID NO: 33254

SEQ ID NO: 404845 - RNA, 64 nt, hsa; identical to SEQ ID NO: 33255

SEQ ID NO: 404846 - RNA, 64 nt, hsa; identical to SEQ ID NO: 33256

SEQ ID NO: 404847 - RNA, 64 nt, hsa; identical to SEQ ID NO: 33257

SEQ ID NO: 404848 - RNA, 64 nt, hsa; identical to SEQ ID NO: 33258

SEQ ID NO: 404849 - RNA, 64 nt, hsa; identical to SEQ ID NO: 33259

SEQ ID NO: 404850 - RNA, 64 nt, hsa; identical to SEQ ID NO: 33260

SEQ ID NO: 404851 - RNA, 64 nt, hsa; identical to SEQ ID NO: 33261

SEQ ID NO: 404852 - RNA, 64 nt, hsa; identical to SEQ ID NO: 33262

SEQ ID NO: 404853 - RNA, 64 nt, hsa; identical to SEQ ID NO: 33263

SEQ ID NO: 404854 - RNA, 64 nt, hsa; identical to SEQ ID NO: 33264

SEQ ID NO: 404855 - RNA, 64 nt, hsa; identical to SEQ ID NO: 33265

SEQ ID NO: 404856 - RNA, 64 nt, hsa; identical to SEQ ID NO: 33266

SEQ ID NO: 404857 - RNA, 64 nt, hsa; identical to SEQ ID NO: 33267

SEQ ID NO: 404858 - RNA, 64 nt, hsa; identical to SEQ ID NO: 33268

SEQ ID NO: 404859 - RNA, 64 nt, hsa; identical to SEQ ID NO: 33269

SEQ ID NO: 404860 - RNA, 64 nt, hsa; identical to SEQ ID NO: 33270

SEQ ID NO: 404861 - RNA, 64 nt, hsa; identical to SEQ ID NO: 33271

SEQ ID NO: 404862 - RNA, 64 nt, hsa; identical to SEQ ID NO: 33272

SEQ ID NO: 404863 - RNA, 64 nt, hsa; identical to SEQ ID NO: 33273

SEQ ID NO: 404864 - RNA, 64 nt, hsa; identical to SEQ ID NO: 33274

SEQ ID NO: 404865 - RNA, 64 nt, hsa; identical to SEQ ID NO: 33275

SEQ ID NO: 404866 - RNA, 64 nt, hsa; identical to SEQ ID NO: 33276

SEQ ID NO: 404867 - RNA, 64 nt, hsa; identical to SEQ ID NO: 33277

SEQ ID NO: 404868 - RNA, 64 nt, hsa; identical to SEQ ID NO: 33278

SEQ ID NO: 404869 - RNA, 64 nt, hsa; identical to SEQ ID NO: 33279

SEQ ID NO: 404870 - RNA, 64 nt, hsa; identical to SEQ ID NO: 33280

SEQ ID NO: 404871 - RNA, 64 nt, hsa; identical to SEQ ID NO: 33281

SEQ ID NO: 404872 - RNA, 64 nt, hsa; identical to SEQ ID NO: 33282

SEQ ID NO: 404873 - RNA, 64 nt, hsa; identical to SEQ ID NO: 33283

SEQ ID NO: 404874 - RNA, 64 nt, hsa; identical to SEQ ID NO: 33284

SEQ ID NO: 404875 - RNA, 64 nt, hsa; identical to SEQ ID NO: 33285

SEQ ID NO: 404876 - RNA, 64 nt, hsa; identical to SEQ ID NO: 33286

SEQ ID NO: 404877 - RNA, 64 nt, hsa; identical to SEQ ID NO: 33287

SEQ ID NO: 404878 - RNA, 64 nt, hsa; identical to SEQ ID NO: 33288

SEQ ID NO: 404879 - RNA, 64 nt, hsa; identical to SEQ ID NO: 33289

SEQ ID NO: 404880 - RNA, 64 nt, hsa; identical to SEQ ID NO: 33290

SEQ ID NO: 404881 - RNA, 64 nt, hsa; identical to SEQ ID NO: 33291

SEQ ID NO: 404882 - RNA, 64 nt, hsa; identical to SEQ ID NO: 33292

SEQ ID NO: 404883 - RNA, 64 nt, hsa; identical to SEQ ID NO: 33293

SEQ ID NO: 404884 - RNA, 64 nt, hsa; identical to SEQ ID NO: 33294

SEQ ID NO: 404885 - RNA, 64 nt, hsa; identical to SEQ ID NO: 33295

SEQ ID NO: 404886 - RNA, 64 nt, hsa; identical to SEQ ID NO: 33296

SEQ ID NO: 404887 - RNA, 64 nt, hsa; identical to SEQ ID NO: 33297

SEQ ID NO: 404888 - RNA, 64 nt, hsa; identical to SEQ ID NO: 33298

SEQ ID NO: 404889 - RNA, 64 nt, hsa; identical to SEQ ID NO: 33299

SEQ ID NO: 404890 - RNA, 64 nt, hsa; identical to SEQ ID NO: 33300

SEQ ID NO: 404891 - RNA, 64 nt, hsa; identical to SEQ ID NO: 33301

SEQ ID NO: 404892 - RNA, 64 nt, hsa; identical to SEQ ID NO: 33302

SEQ ID NO: 404893 - RNA, 64 nt, hsa; identical to SEQ ID NO: 33303

SEQ ID NO: 404894 - RNA, 64 nt, hsa; identical to SEQ ID NO: 33304

SEQ ID NO: 404895 - RNA, 64 nt, hsa; identical to SEQ ID NO: 33305

SEQ ID NO: 404896 - RNA, 64 nt, hsa; identical to SEQ ID NO: 33306

SEQ ID NO: 404897 - RNA, 64 nt, hsa; identical to SEQ ID NO: 33307

SEQ ID NO: 404898 - RNA, 64 nt, hsa; identical to SEQ ID NO: 33308

SEQ ID NO: 404899 - RNA, 64 nt, hsa; identical to SEQ ID NO: 33309

SEQ ID NO: 404900 - RNA, 64 nt, hsa; identical to SEQ ID NO: 33310

SEQ ID NO: 404901 - RNA, 64 nt, hsa; identical to SEQ ID NO: 33311

SEQ ID NO: 404902 - RNA, 64 nt, hsa; identical to SEQ ID NO: 33312

SEQ ID NO: 404903 - RNA, 64 nt, hsa; identical to SEQ ID NO: 33313

SEQ ID NO: 404904 - RNA, 64 nt, hsa; identical to SEQ ID NO: 33314

SEQ ID NO: 404905 - RNA, 64 nt, hsa; identical to SEQ ID NO: 33315

SEQ ID NO: 404906 - RNA, 64 nt, hsa; identical to SEQ ID NO: 33316

SEQ ID NO: 404907 - RNA, 64 nt, hsa; identical to SEQ ID NO: 33317

SEQ ID NO: 404908 - RNA, 64 nt, hsa; identical to SEQ ID NO: 33318

SEQ ID NO: 404909 - RNA, 64 nt, hsa; identical to SEQ ID NO: 33319

SEQ ID NO: 404910 - RNA, 64 nt, hsa; identical to SEQ ID NO: 33320

SEQ ID NO: 404911 - RNA, 64 nt, hsa; identical to SEQ ID NO: 33321

SEQ ID NO: 404912 - RNA, 64 nt, hsa; identical to SEQ ID NO: 33322

SEQ ID NO: 404913 - RNA, 64 nt, hsa; identical to SEQ ID NO: 33323

SEQ ID NO: 404914 - RNA, 64 nt, hsa; identical to SEQ ID NO: 33324

SEQ ID NO: 404915 - RNA, 64 nt, hsa; identical to SEQ ID NO: 33325

SEQ ID NO: 404916 - RNA, 64 nt, hsa; identical to SEQ ID NO: 33326

SEQ ID NO: 404917 - RNA, 64 nt, hsa; identical to SEQ ID NO: 33327

SEQ ID NO: 404918 - RNA, 64 nt, hsa; identical to SEQ ID NO: 33328

SEQ ID NO: 404919 - RNA, 64 nt, hsa; identical to SEQ ID NO: 33329

SEQ ID NO: 404920 - RNA, 64 nt, hsa; identical to SEQ ID NO: 33330

SEQ ID NO: 404921 - RNA, 64 nt, hsa; identical to SEQ ID NO: 33331

SEQ ID NO: 404922 - RNA, 64 nt, hsa; identical to SEQ ID NO: 33332

SEQ ID NO: 404923 - RNA, 64 nt, hsa; identical to SEQ ID NO: 33333

SEQ ID NO: 404924 - RNA, 64 nt, hsa; identical to SEQ ID NO: 33334

SEQ ID NO: 404925 - RNA, 64 nt, hsa; identical to SEQ ID NO: 33335

SEQ ID NO: 404926 - RNA, 64 nt, hsa; identical to SEQ ID NO: 33336

SEQ ID NO: 404927 - RNA, 64 nt, hsa; identical to SEQ ID NO: 33337

SEQ ID NO: 404928 - RNA, 64 nt, hsa; identical to SEQ ID NO: 33338

SEQ ID NO: 404929 - RNA, 64 nt, hsa; identical to SEQ ID NO: 33339

SEQ ID NO: 404930 - RNA, 64 nt, hsa; identical to SEQ ID NO: 33340

SEQ ID NO: 404931 - RNA, 64 nt, hsa; identical to SEQ ID NO: 33341

SEQ ID NO: 404932 - RNA, 64 nt, hsa; identical to SEQ ID NO: 33342

SEQ ID NO: 404933 - RNA, 64 nt, hsa; identical to SEQ ID NO: 33343

SEQ ID NO: 404934 - RNA, 64 nt, hsa; identical to SEQ ID NO: 33344

SEQ ID NO: 404935 - RNA, 64 nt, hsa; identical to SEQ ID NO: 33345

SEQ ID NO: 404936 - RNA, 64 nt, hsa; identical to SEQ ID NO: 33346

SEQ ID NO: 404937 - RNA, 64 nt, hsa; identical to SEQ ID NO: 33347

SEQ ID NO: 404938 - RNA, 64 nt, hsa; identical to SEQ ID NO: 33348

SEQ ID NO: 404939 - RNA, 64 nt, hsa; identical to SEQ ID NO: 33349

SEQ ID NO: 404940 - RNA, 64 nt, hsa; identical to SEQ ID NO: 33350

SEQ ID NO: 404941 - RNA, 64 nt, hsa; identical to SEQ ID NO: 33351

SEQ ID NO: 404942 - RNA, 64 nt, hsa; identical to SEQ ID NO: 33352

SEQ ID NO: 404943 - RNA, 64 nt, hsa; identical to SEQ ID NO: 33353

SEQ ID NO: 404944 - RNA, 64 nt, hsa; identical to SEQ ID NO: 33354

SEQ ID NO: 404945 - RNA, 64 nt, hsa; identical to SEQ ID NO: 33355

SEQ ID NO: 404946 - RNA, 64 nt, hsa; identical to SEQ ID NO: 33356

SEQ ID NO: 404947 - RNA, 64 nt, hsa; identical to SEQ ID NO: 33357

SEQ ID NO: 404948 - RNA, 64 nt, hsa; identical to SEQ ID NO: 33358

SEQ ID NO: 404949 - RNA, 64 nt, hsa; identical to SEQ ID NO: 33359

SEQ ID NO: 404950 - RNA, 64 nt, hsa; identical to SEQ ID NO: 33360

SEQ ID NO: 404951 - RNA, 64 nt, hsa; identical to SEQ ID NO: 33361

SEQ ID NO: 404952 - RNA, 64 nt, hsa; identical to SEQ ID NO: 33362

SEQ ID NO: 404953 - RNA, 64 nt, hsa; identical to SEQ ID NO: 33363

SEQ ID NO: 404954 - RNA, 64 nt, hsa; identical to SEQ ID NO: 33364

SEQ ID NO: 404955 - RNA, 64 nt, hsa; identical to SEQ ID NO: 33365

SEQ ID NO: 404956 - RNA, 64 nt, hsa; identical to SEQ ID NO: 33366

SEQ ID NO: 404957 - RNA, 64 nt, hsa; identical to SEQ ID NO: 33367

SEQ ID NO: 404958 - RNA, 64 nt, hsa; identical to SEQ ID NO: 33368

SEQ ID NO: 404959 - RNA, 64 nt, hsa; identical to SEQ ID NO: 33369

SEQ ID NO: 404960 - RNA, 64 nt, hsa; identical to SEQ ID NO: 33370

SEQ ID NO: 404961 - RNA, 64 nt, hsa; identical to SEQ ID NO: 33371

SEQ ID NO: 404962 - RNA, 64 nt, hsa; identical to SEQ ID NO: 33372

SEQ ID NO: 404963 - RNA, 64 nt, hsa; identical to SEQ ID NO: 33373

SEQ ID NO: 404964 - RNA, 64 nt, hsa; identical to SEQ ID NO: 33374

SEQ ID NO: 404965 - RNA, 64 nt, hsa; identical to SEQ ID NO: 33375

SEQ ID NO: 404966 - RNA, 64 nt, hsa; identical to SEQ ID NO: 33376

SEQ ID NO: 404967 - RNA, 64 nt, hsa; identical to SEQ ID NO: 33377

SEQ ID NO: 404968 - RNA, 64 nt, hsa; identical to SEQ ID NO: 33378

SEQ ID NO: 404969 - RNA, 64 nt, hsa; identical to SEQ ID NO: 33379

SEQ ID NO: 404970 - RNA, 64 nt, hsa; identical to SEQ ID NO: 33380

SEQ ID NO: 404971 - RNA, 64 nt, hsa; identical to SEQ ID NO: 33381

SEQ ID NO: 404972 - RNA, 64 nt, hsa; identical to SEQ ID NO: 33382

SEQ ID NO: 404973 - RNA, 64 nt, hsa; identical to SEQ ID NO: 33383

SEQ ID NO: 404974 - RNA, 64 nt, hsa; identical to SEQ ID NO: 33384

SEQ ID NO: 404975 - RNA, 64 nt, hsa; identical to SEQ ID NO: 33385

SEQ ID NO: 404976 - RNA, 64 nt, hsa; identical to SEQ ID NO: 33386

SEQ ID NO: 404977 - RNA, 64 nt, hsa; identical to SEQ ID NO: 33387

SEQ ID NO: 404978 - RNA, 64 nt, hsa; identical to SEQ ID NO: 33388

SEQ ID NO: 404979 - RNA, 64 nt, hsa; identical to SEQ ID NO: 33389

SEQ ID NO: 404980 - RNA, 64 nt, hsa; identical to SEQ ID NO: 33390

SEQ ID NO: 404981 - RNA, 64 nt, hsa; identical to SEQ ID NO: 33391

SEQ ID NO: 404982 - RNA, 64 nt, hsa; identical to SEQ ID NO: 33392

SEQ ID NO: 404983 - RNA, 64 nt, hsa; identical to SEQ ID NO: 33393

SEQ ID NO: 404984 - RNA, 64 nt, hsa; identical to SEQ ID NO: 33394

SEQ ID NO: 404985 - RNA, 64 nt, hsa; identical to SEQ ID NO: 33395

SEQ ID NO: 404986 - RNA, 64 nt, hsa; identical to SEQ ID NO: 33396

SEQ ID NO: 404987 - RNA, 64 nt, hsa; identical to SEQ ID NO: 33397

SEQ ID NO: 404988 - RNA, 64 nt, hsa; identical to SEQ ID NO: 33398

SEQ ID NO: 404989 - RNA, 64 nt, hsa; identical to SEQ ID NO: 33399

SEQ ID NO: 404990 - RNA, 64 nt, hsa; identical to SEQ ID NO: 33400

SEQ ID NO: 404991 - RNA, 64 nt, hsa; identical to SEQ ID NO: 33401

SEQ ID NO: 404992 - RNA, 64 nt, hsa; identical to SEQ ID NO: 33402

SEQ ID NO: 404993 - RNA, 64 nt, hsa; identical to SEQ ID NO: 33403

SEQ ID NO: 404994 - RNA, 64 nt, hsa; identical to SEQ ID NO: 33404

SEQ ID NO: 404995 - RNA, 64 nt, hsa; identical to SEQ ID NO: 33405

SEQ ID NO: 404996 - RNA, 64 nt, hsa; identical to SEQ ID NO: 33406

SEQ ID NO: 404997 - RNA, 64 nt, hsa; identical to SEQ ID NO: 33407

SEQ ID NO: 404998 - RNA, 64 nt, hsa; identical to SEQ ID NO: 33408

SEQ ID NO: 404999 - RNA, 64 nt, hsa; identical to SEQ ID NO: 33409

SEQ ID NO: 405000 - RNA, 64 nt, hsa; identical to SEQ ID NO: 33410

SEQ ID NO: 405001 - RNA, 64 nt, hsa; identical to SEQ ID NO: 33411

SEQ ID NO: 405002 - RNA, 64 nt, hsa; identical to SEQ ID NO: 33412

SEQ ID NO: 405003 - RNA, 64 nt, hsa; identical to SEQ ID NO: 33413

SEQ ID NO: 405004 - RNA, 64 nt, hsa; identical to SEQ ID NO: 33414

SEQ ID NO: 405005 - RNA, 64 nt, hsa; identical to SEQ ID NO: 33415

SEQ ID NO: 405006 - RNA, 64 nt, hsa; identical to SEQ ID NO: 33416

SEQ ID NO: 405007 - RNA, 64 nt, hsa; identical to SEQ ID NO: 33417

SEQ ID NO: 405008 - RNA, 64 nt, hsa; identical to SEQ ID NO: 33418

SEQ ID NO: 405009 - RNA, 64 nt, hsa; identical to SEQ ID NO: 33419

SEQ ID NO: 405010 - RNA, 64 nt, hsa; identical to SEQ ID NO: 33420

SEQ ID NO: 405011 - RNA, 64 nt, hsa; identical to SEQ ID NO: 33421

SEQ ID NO: 405012 - RNA, 64 nt, hsa; identical to SEQ ID NO: 33422

SEQ ID NO: 405013 - RNA, 64 nt, hsa; identical to SEQ ID NO: 33423

SEQ ID NO: 405014 - RNA, 64 nt, hsa; identical to SEQ ID NO: 33424

SEQ ID NO: 405015 - RNA, 64 nt, hsa; identical to SEQ ID NO: 33425

SEQ ID NO: 405016 - RNA, 64 nt, hsa; identical to SEQ ID NO: 33426

SEQ ID NO: 405017 - RNA, 64 nt, hsa; identical to SEQ ID NO: 33427

SEQ ID NO: 405018 - RNA, 64 nt, hsa; identical to SEQ ID NO: 33428

SEQ ID NO: 405019 - RNA, 64 nt, hsa; identical to SEQ ID NO: 33429

SEQ ID NO: 405020 - RNA, 64 nt, hsa; identical to SEQ ID NO: 33430

SEQ ID NO: 405021 - RNA, 64 nt, hsa; identical to SEQ ID NO: 33431

SEQ ID NO: 405022 - RNA, 64 nt, hsa; identical to SEQ ID NO: 33432

SEQ ID NO: 405023 - RNA, 63 nt, hsa; identical to SEQ ID NO: 33433

SEQ ID NO: 405024 - RNA, 62 nt, hsa; identical to SEQ ID NO: 33434

SEQ ID NO: 405025 - RNA, 64 nt, hsa; identical to SEQ ID NO: 33435

SEQ ID NO: 405026 - RNA, 64 nt, hsa; identical to SEQ ID NO: 33436

SEQ ID NO: 405027 - RNA, 64 nt, hsa; identical to SEQ ID NO: 33437

SEQ ID NO: 405028 - RNA, 64 nt, hsa; identical to SEQ ID NO: 33438

SEQ ID NO: 405029 - RNA, 64 nt, hsa; identical to SEQ ID NO: 33439

SEQ ID NO: 405030 - RNA, 64 nt, hsa; identical to SEQ ID NO: 33440

SEQ ID NO: 405031 - RNA, 64 nt, hsa; identical to SEQ ID NO: 33441

SEQ ID NO: 405032 - RNA, 64 nt, hsa; identical to SEQ ID NO: 33442

SEQ ID NO: 405033 - RNA, 64 nt, hsa; identical to SEQ ID NO: 33443

SEQ ID NO: 405034 - RNA, 64 nt, hsa; identical to SEQ ID NO: 33444

SEQ ID NO: 405035 - RNA, 64 nt, hsa; identical to SEQ ID NO: 33445

SEQ ID NO: 405036 - RNA, 64 nt, hsa; identical to SEQ ID NO: 33446

SEQ ID NO: 405037 - RNA, 64 nt, hsa; identical to SEQ ID NO: 33447

SEQ ID NO: 405038 - RNA, 64 nt, hsa; identical to SEQ ID NO: 33448

SEQ ID NO: 405039 - RNA, 64 nt, hsa; identical to SEQ ID NO: 33449

SEQ ID NO: 405040 - RNA, 64 nt, hsa; identical to SEQ ID NO: 33450

SEQ ID NO: 405041 - RNA, 64 nt, hsa; identical to SEQ ID NO: 33451

SEQ ID NO: 405042 - RNA, 64 nt, hsa; identical to SEQ ID NO: 33452

SEQ ID NO: 405043 - RNA, 64 nt, hsa; identical to SEQ ID NO: 33453

SEQ ID NO: 405044 - RNA, 64 nt, hsa; identical to SEQ ID NO: 33454

SEQ ID NO: 405045 - RNA, 64 nt, hsa; identical to SEQ ID NO: 33455

SEQ ID NO: 405046 - RNA, 64 nt, hsa; identical to SEQ ID NO: 33456

SEQ ID NO: 405047 - RNA, 64 nt, hsa; identical to SEQ ID NO: 33457

SEQ ID NO: 405048 - RNA, 64 nt, hsa; identical to SEQ ID NO: 33458

SEQ ID NO: 405049 - RNA, 64 nt, hsa; identical to SEQ ID NO: 33459

SEQ ID NO: 405050 - RNA, 64 nt, hsa; identical to SEQ ID NO: 33460

SEQ ID NO: 405051 - RNA, 64 nt, hsa; identical to SEQ ID NO: 33461

SEQ ID NO: 405052 - RNA, 64 nt, hsa; identical to SEQ ID NO: 33462

SEQ ID NO: 405053 - RNA, 64 nt, hsa; identical to SEQ ID NO: 33463

SEQ ID NO: 405054 - RNA, 64 nt, hsa; identical to SEQ ID NO: 33464

SEQ ID NO: 405055 - RNA, 64 nt, hsa; identical to SEQ ID NO: 33465

SEQ ID NO: 405056 - RNA, 64 nt, hsa; identical to SEQ ID NO: 33466

SEQ ID NO: 405057 - RNA, 64 nt, hsa; identical to SEQ ID NO: 33467

SEQ ID NO: 405058 - RNA, 64 nt, hsa; identical to SEQ ID NO: 33468

SEQ ID NO: 405059 - RNA, 64 nt, hsa; identical to SEQ ID NO: 33469

SEQ ID NO: 405060 - RNA, 64 nt, hsa; identical to SEQ ID NO: 33470

SEQ ID NO: 405061 - RNA, 64 nt, hsa; identical to SEQ ID NO: 33471

SEQ ID NO: 405062 - RNA, 64 nt, hsa; identical to SEQ ID NO: 33472

SEQ ID NO: 405063 - RNA, 64 nt, hsa; identical to SEQ ID NO: 33473

SEQ ID NO: 405064 - RNA, 64 nt, hsa; identical to SEQ ID NO: 33474

SEQ ID NO: 405065 - RNA, 64 nt, hsa; identical to SEQ ID NO: 33475

SEQ ID NO: 405066 - RNA, 64 nt, hsa; identical to SEQ ID NO: 33476

SEQ ID NO: 405067 - RNA, 64 nt, hsa; identical to SEQ ID NO: 33477

SEQ ID NO: 405068 - RNA, 64 nt, hsa; identical to SEQ ID NO: 33478

SEQ ID NO: 405069 - RNA, 64 nt, hsa; identical to SEQ ID NO: 33479

SEQ ID NO: 405070 - RNA, 64 nt, hsa; identical to SEQ ID NO: 33480

SEQ ID NO: 405071 - RNA, 64 nt, hsa; identical to SEQ ID NO: 33481

SEQ ID NO: 405072 - RNA, 64 nt, hsa; identical to SEQ ID NO: 33482

SEQ ID NO: 405073 - RNA, 64 nt, hsa; identical to SEQ ID NO: 33483

SEQ ID NO: 405074 - RNA, 64 nt, hsa; identical to SEQ ID NO: 33484

SEQ ID NO: 405075 - RNA, 64 nt, hsa; identical to SEQ ID NO: 33485

SEQ ID NO: 405076 - RNA, 64 nt, hsa; identical to SEQ ID NO: 33486

SEQ ID NO: 405077 - RNA, 64 nt, hsa; identical to SEQ ID NO: 33487

SEQ ID NO: 405078 - RNA, 64 nt, hsa; identical to SEQ ID NO: 33488

SEQ ID NO: 405079 - RNA, 64 nt, hsa; identical to SEQ ID NO: 33489

SEQ ID NO: 405080 - RNA, 64 nt, hsa; identical to SEQ ID NO: 33490

SEQ ID NO: 405081 - RNA, 64 nt, hsa; identical to SEQ ID NO: 33491

SEQ ID NO: 405082 - RNA, 64 nt, hsa; identical to SEQ ID NO: 33492

SEQ ID NO: 405083 - RNA, 64 nt, hsa; identical to SEQ ID NO: 33493

SEQ ID NO: 405084 - RNA, 64 nt, hsa; identical to SEQ ID NO: 33494

SEQ ID NO: 405085 - RNA, 64 nt, hsa; identical to SEQ ID NO: 33495

SEQ ID NO: 405086 - RNA, 64 nt, hsa; identical to SEQ ID NO: 33496

SEQ ID NO: 405087 - RNA, 64 nt, hsa; identical to SEQ ID NO: 33497

SEQ ID NO: 405088 - RNA, 64 nt, hsa; identical to SEQ ID NO: 33498

SEQ ID NO: 405089 - RNA, 64 nt, hsa; identical to SEQ ID NO: 33499

SEQ ID NO: 405090 - RNA, 64 nt, hsa; identical to SEQ ID NO: 33500

SEQ ID NO: 405091 - RNA, 64 nt, hsa; identical to SEQ ID NO: 33501

SEQ ID NO: 405092 - RNA, 64 nt, hsa; identical to SEQ ID NO: 33502

SEQ ID NO: 405093 - RNA, 64 nt, hsa; identical to SEQ ID NO: 33503

SEQ ID NO: 405094 - RNA, 64 nt, hsa; identical to SEQ ID NO: 33504

SEQ ID NO: 405095 - RNA, 64 nt, hsa; identical to SEQ ID NO: 33505

SEQ ID NO: 405096 - RNA, 64 nt, hsa; identical to SEQ ID NO: 33506

SEQ ID NO: 405097 - RNA, 64 nt, hsa; identical to SEQ ID NO: 33507

SEQ ID NO: 405098 - RNA, 64 nt, hsa; identical to SEQ ID NO: 33508

SEQ ID NO: 405099 - RNA, 64 nt, hsa; identical to SEQ ID NO: 33509

SEQ ID NO: 405100 - RNA, 64 nt, hsa; identical to SEQ ID NO: 33510

SEQ ID NO: 405101 - RNA, 64 nt, hsa; identical to SEQ ID NO: 33511

SEQ ID NO: 405102 - RNA, 64 nt, hsa; identical to SEQ ID NO: 33512

SEQ ID NO: 405103 - RNA, 64 nt, hsa; identical to SEQ ID NO: 33513

SEQ ID NO: 405104 - RNA, 64 nt, hsa; identical to SEQ ID NO: 33514

SEQ ID NO: 405105 - RNA, 64 nt, hsa; identical to SEQ ID NO: 33515

SEQ ID NO: 405106 - RNA, 64 nt, hsa; identical to SEQ ID NO: 33516

SEQ ID NO: 405107 - RNA, 64 nt, hsa; identical to SEQ ID NO: 33517

SEQ ID NO: 405108 - RNA, 64 nt, hsa; identical to SEQ ID NO: 33518

SEQ ID NO: 405109 - RNA, 64 nt, hsa; identical to SEQ ID NO: 33519

SEQ ID NO: 405110 - RNA, 64 nt, hsa; identical to SEQ ID NO: 33520

SEQ ID NO: 405111 - RNA, 64 nt, hsa; identical to SEQ ID NO: 33521

SEQ ID NO: 405112 - RNA, 64 nt, hsa; identical to SEQ ID NO: 33522

SEQ ID NO: 405113 - RNA, 64 nt, hsa; identical to SEQ ID NO: 33523

SEQ ID NO: 405114 - RNA, 64 nt, hsa; identical to SEQ ID NO: 33524

SEQ ID NO: 405115 - RNA, 64 nt, hsa; identical to SEQ ID NO: 33525

SEQ ID NO: 405116 - RNA, 64 nt, hsa; identical to SEQ ID NO: 33526

SEQ ID NO: 405117 - RNA, 64 nt, hsa; identical to SEQ ID NO: 33527

SEQ ID NO: 405118 - RNA, 64 nt, hsa; identical to SEQ ID NO: 33528

SEQ ID NO: 405119 - RNA, 64 nt, hsa; identical to SEQ ID NO: 33529

SEQ ID NO: 405120 - RNA, 64 nt, hsa; identical to SEQ ID NO: 33530

SEQ ID NO: 405121 - RNA, 64 nt, hsa; identical to SEQ ID NO: 33531

SEQ ID NO: 405122 - RNA, 64 nt, hsa; identical to SEQ ID NO: 33532

SEQ ID NO: 405123 - RNA, 64 nt, hsa; identical to SEQ ID NO: 33533

SEQ ID NO: 405124 - RNA, 64 nt, hsa; identical to SEQ ID NO: 33534

SEQ ID NO: 405125 - RNA, 64 nt, hsa; identical to SEQ ID NO: 33535

SEQ ID NO: 405126 - RNA, 64 nt, hsa; identical to SEQ ID NO: 33536

SEQ ID NO: 405127 - RNA, 64 nt, hsa; identical to SEQ ID NO: 33537

SEQ ID NO: 405128 - RNA, 64 nt, hsa; identical to SEQ ID NO: 33538

SEQ ID NO: 405129 - RNA, 64 nt, hsa; identical to SEQ ID NO: 33539

SEQ ID NO: 405130 - RNA, 64 nt, hsa; identical to SEQ ID NO: 33540

SEQ ID NO: 405131 - RNA, 64 nt, hsa; identical to SEQ ID NO: 33541

SEQ ID NO: 405132 - RNA, 64 nt, hsa; identical to SEQ ID NO: 33542

SEQ ID NO: 405133 - RNA, 64 nt, hsa; identical to SEQ ID NO: 33543

SEQ ID NO: 405134 - RNA, 64 nt, hsa; identical to SEQ ID NO: 33544

SEQ ID NO: 405135 - RNA, 64 nt, hsa; identical to SEQ ID NO: 33545

SEQ ID NO: 405136 - RNA, 64 nt, hsa; identical to SEQ ID NO: 33546

SEQ ID NO: 405137 - RNA, 64 nt, hsa; identical to SEQ ID NO: 33547

SEQ ID NO: 405138 - RNA, 64 nt, hsa; identical to SEQ ID NO: 33548

SEQ ID NO: 405139 - RNA, 64 nt, hsa; identical to SEQ ID NO: 33549

SEQ ID NO: 405140 - RNA, 64 nt, hsa; identical to SEQ ID NO: 33550

SEQ ID NO: 405141 - RNA, 64 nt, hsa; identical to SEQ ID NO: 33551

SEQ ID NO: 405142 - RNA, 64 nt, hsa; identical to SEQ ID NO: 33552

SEQ ID NO: 405143 - RNA, 64 nt, hsa; identical to SEQ ID NO: 33553

SEQ ID NO: 405144 - RNA, 64 nt, hsa; identical to SEQ ID NO: 33554

SEQ ID NO: 405145 - RNA, 64 nt, hsa; identical to SEQ ID NO: 33555

SEQ ID NO: 405146 - RNA, 64 nt, hsa; identical to SEQ ID NO: 33556

SEQ ID NO: 405147 - RNA, 64 nt, hsa; identical to SEQ ID NO: 33557

SEQ ID NO: 405148 - RNA, 64 nt, hsa; identical to SEQ ID NO: 33558

SEQ ID NO: 405149 - RNA, 64 nt, hsa; identical to SEQ ID NO: 33559

SEQ ID NO: 405150 - RNA, 64 nt, hsa; identical to SEQ ID NO: 33560

SEQ ID NO: 405151 - RNA, 64 nt, hsa; identical to SEQ ID NO: 33561

SEQ ID NO: 405152 - RNA, 64 nt, hsa; identical to SEQ ID NO: 33562

SEQ ID NO: 405153 - RNA, 64 nt, hsa; identical to SEQ ID NO: 33563

SEQ ID NO: 405154 - RNA, 64 nt, hsa; identical to SEQ ID NO: 33564

SEQ ID NO: 405155 - RNA, 64 nt, hsa; identical to SEQ ID NO: 33565

SEQ ID NO: 405156 - RNA, 64 nt, hsa; identical to SEQ ID NO: 33566

SEQ ID NO: 405157 - RNA, 64 nt, hsa; identical to SEQ ID NO: 33567

SEQ ID NO: 405158 - RNA, 64 nt, hsa; identical to SEQ ID NO: 33568

SEQ ID NO: 405159 - RNA, 64 nt, hsa; identical to SEQ ID NO: 33569

SEQ ID NO: 405160 - RNA, 64 nt, hsa; identical to SEQ ID NO: 33570

SEQ ID NO: 405161 - RNA, 64 nt, hsa; identical to SEQ ID NO: 33571

SEQ ID NO: 405162 - RNA, 64 nt, hsa; identical to SEQ ID NO: 33572

SEQ ID NO: 405163 - RNA, 64 nt, hsa; identical to SEQ ID NO: 33573

SEQ ID NO: 405164 - RNA, 64 nt, hsa; identical to SEQ ID NO: 33574

SEQ ID NO: 405165 - RNA, 64 nt, hsa; identical to SEQ ID NO: 33575

SEQ ID NO: 405166 - RNA, 64 nt, hsa; identical to SEQ ID NO: 33576

SEQ ID NO: 405167 - RNA, 64 nt, hsa; identical to SEQ ID NO: 33577

SEQ ID NO: 405168 - RNA, 64 nt, hsa; identical to SEQ ID NO: 33578

SEQ ID NO: 405169 - RNA, 64 nt, hsa; identical to SEQ ID NO: 33579

SEQ ID NO: 405170 - RNA, 64 nt, hsa; identical to SEQ ID NO: 33580

SEQ ID NO: 405171 - RNA, 64 nt, hsa; identical to SEQ ID NO: 33581

SEQ ID NO: 405172 - RNA, 64 nt, hsa; identical to SEQ ID NO: 33582

SEQ ID NO: 405173 - RNA, 64 nt, hsa; identical to SEQ ID NO: 33583

SEQ ID NO: 405174 - RNA, 64 nt, hsa; identical to SEQ ID NO: 33584

SEQ ID NO: 405175 - RNA, 64 nt, hsa; identical to SEQ ID NO: 33585

SEQ ID NO: 405176 - RNA, 64 nt, hsa; identical to SEQ ID NO: 33586

SEQ ID NO: 405177 - RNA, 64 nt, hsa; identical to SEQ ID NO: 33587

SEQ ID NO: 405178 - RNA, 64 nt, hsa; identical to SEQ ID NO: 33588

SEQ ID NO: 405179 - RNA, 64 nt, hsa; identical to SEQ ID NO: 33589

SEQ ID NO: 405180 - RNA, 64 nt, hsa; identical to SEQ ID NO: 33590

SEQ ID NO: 405181 - RNA, 64 nt, hsa; identical to SEQ ID NO: 33591

SEQ ID NO: 405182 - RNA, 64 nt, hsa; identical to SEQ ID NO: 33592

SEQ ID NO: 405183 - RNA, 64 nt, hsa; identical to SEQ ID NO: 33593

SEQ ID NO: 405184 - RNA, 64 nt, hsa; identical to SEQ ID NO: 33594

SEQ ID NO: 405185 - RNA, 64 nt, hsa; identical to SEQ ID NO: 33595

SEQ ID NO: 405186 - RNA, 64 nt, hsa; identical to SEQ ID NO: 33596

SEQ ID NO: 405187 - RNA, 64 nt, hsa; identical to SEQ ID NO: 33597

SEQ ID NO: 405188 - RNA, 64 nt, hsa; identical to SEQ ID NO: 33598

SEQ ID NO: 405189 - RNA, 64 nt, hsa; identical to SEQ ID NO: 33599

SEQ ID NO: 405190 - RNA, 64 nt, hsa; identical to SEQ ID NO: 33600

SEQ ID NO: 405191 - RNA, 64 nt, hsa; identical to SEQ ID NO: 33601

SEQ ID NO: 405192 - RNA, 64 nt, hsa; identical to SEQ ID NO: 33602

SEQ ID NO: 405193 - RNA, 64 nt, hsa; identical to SEQ ID NO: 33603

SEQ ID NO: 405194 - RNA, 64 nt, hsa; identical to SEQ ID NO: 33604

SEQ ID NO: 405195 - RNA, 64 nt, hsa; identical to SEQ ID NO: 33605

SEQ ID NO: 405196 - RNA, 64 nt, hsa; identical to SEQ ID NO: 33606

SEQ ID NO: 405197 - RNA, 64 nt, hsa; identical to SEQ ID NO: 33607

SEQ ID NO: 405198 - RNA, 64 nt, hsa; identical to SEQ ID NO: 33608

SEQ ID NO: 405199 - RNA, 64 nt, hsa; identical to SEQ ID NO: 33609

SEQ ID NO: 405200 - RNA, 64 nt, hsa; identical to SEQ ID NO: 33610

SEQ ID NO: 405201 - RNA, 64 nt, hsa; identical to SEQ ID NO: 33611

SEQ ID NO: 405202 - RNA, 64 nt, hsa; identical to SEQ ID NO: 33612

SEQ ID NO: 405203 - RNA, 64 nt, hsa; identical to SEQ ID NO: 33613

SEQ ID NO: 405204 - RNA, 64 nt, hsa; identical to SEQ ID NO: 33614

SEQ ID NO: 405205 - RNA, 64 nt, hsa; identical to SEQ ID NO: 33615

SEQ ID NO: 405206 - RNA, 64 nt, hsa; identical to SEQ ID NO: 33616

SEQ ID NO: 405207 - RNA, 64 nt, hsa; identical to SEQ ID NO: 33617

SEQ ID NO: 405208 - RNA, 64 nt, hsa; identical to SEQ ID NO: 33618

SEQ ID NO: 405209 - RNA, 64 nt, hsa; identical to SEQ ID NO: 33619

SEQ ID NO: 405210 - RNA, 64 nt, hsa; identical to SEQ ID NO: 33620

SEQ ID NO: 405211 - RNA, 64 nt, hsa; identical to SEQ ID NO: 33621

SEQ ID NO: 405212 - RNA, 64 nt, hsa; identical to SEQ ID NO: 33622

SEQ ID NO: 405213 - RNA, 64 nt, hsa; identical to SEQ ID NO: 33623

SEQ ID NO: 405214 - RNA, 64 nt, hsa; identical to SEQ ID NO: 33624

SEQ ID NO: 405215 - RNA, 64 nt, hsa; identical to SEQ ID NO: 33625

SEQ ID NO: 405216 - RNA, 64 nt, hsa; identical to SEQ ID NO: 33626

SEQ ID NO: 405217 - RNA, 64 nt, hsa; identical to SEQ ID NO: 33627

SEQ ID NO: 405218 - RNA, 64 nt, hsa; identical to SEQ ID NO: 33628

SEQ ID NO: 405219 - RNA, 64 nt, hsa; identical to SEQ ID NO: 33629

SEQ ID NO: 405220 - RNA, 64 nt, hsa; identical to SEQ ID NO: 33630

SEQ ID NO: 405221 - RNA, 64 nt, hsa; identical to SEQ ID NO: 33631

SEQ ID NO: 405222 - RNA, 64 nt, hsa; identical to SEQ ID NO: 33632

SEQ ID NO: 405223 - RNA, 64 nt, hsa; identical to SEQ ID NO: 33633

SEQ ID NO: 405224 - RNA, 64 nt, hsa; identical to SEQ ID NO: 33634

SEQ ID NO: 405225 - RNA, 64 nt, hsa; identical to SEQ ID NO: 33635

SEQ ID NO: 405226 - RNA, 64 nt, hsa; identical to SEQ ID NO: 33636

SEQ ID NO: 405227 - RNA, 64 nt, hsa; identical to SEQ ID NO: 33637

SEQ ID NO: 405228 - RNA, 64 nt, hsa; identical to SEQ ID NO: 33638

SEQ ID NO: 405229 - RNA, 64 nt, hsa; identical to SEQ ID NO: 33639

SEQ ID NO: 405230 - RNA, 64 nt, hsa; identical to SEQ ID NO: 33640

SEQ ID NO: 405231 - RNA, 64 nt, hsa; identical to SEQ ID NO: 33641

SEQ ID NO: 405232 - RNA, 64 nt, hsa; identical to SEQ ID NO: 33642

SEQ ID NO: 405233 - RNA, 64 nt, hsa; identical to SEQ ID NO: 33643

SEQ ID NO: 405234 - RNA, 64 nt, hsa; identical to SEQ ID NO: 33644

SEQ ID NO: 405235 - RNA, 64 nt, hsa; identical to SEQ ID NO: 33645

SEQ ID NO: 405236 - RNA, 64 nt, hsa; identical to SEQ ID NO: 33646

SEQ ID NO: 405237 - RNA, 64 nt, hsa; identical to SEQ ID NO: 33647

SEQ ID NO: 405238 - RNA, 64 nt, hsa; identical to SEQ ID NO: 33648

SEQ ID NO: 405239 - RNA, 64 nt, hsa; identical to SEQ ID NO: 33649

SEQ ID NO: 405240 - RNA, 64 nt, hsa; identical to SEQ ID NO: 33650

SEQ ID NO: 405241 - RNA, 64 nt, hsa; identical to SEQ ID NO: 33651

SEQ ID NO: 405242 - RNA, 64 nt, hsa; identical to SEQ ID NO: 33652

SEQ ID NO: 405243 - RNA, 64 nt, hsa; identical to SEQ ID NO: 33653

SEQ ID NO: 405244 - RNA, 64 nt, hsa; identical to SEQ ID NO: 33654

SEQ ID NO: 405245 - RNA, 64 nt, hsa; identical to SEQ ID NO: 33655

SEQ ID NO: 405246 - RNA, 64 nt, hsa; identical to SEQ ID NO: 33656

SEQ ID NO: 405247 - RNA, 64 nt, hsa; identical to SEQ ID NO: 33657

SEQ ID NO: 405248 - RNA, 64 nt, hsa; identical to SEQ ID NO: 33658

SEQ ID NO: 405249 - RNA, 64 nt, hsa; identical to SEQ ID NO: 33659

SEQ ID NO: 405250 - RNA, 64 nt, hsa; identical to SEQ ID NO: 33660

SEQ ID NO: 405251 - RNA, 64 nt, hsa; identical to SEQ ID NO: 33661

SEQ ID NO: 405252 - RNA, 64 nt, hsa; identical to SEQ ID NO: 33662

SEQ ID NO: 405253 - RNA, 64 nt, hsa; identical to SEQ ID NO: 33663

SEQ ID NO: 405254 - RNA, 64 nt, hsa; identical to SEQ ID NO: 33664

SEQ ID NO: 405255 - RNA, 64 nt, hsa; identical to SEQ ID NO: 33665

SEQ ID NO: 405256 - RNA, 64 nt, hsa; identical to SEQ ID NO: 33666

SEQ ID NO: 405257 - RNA, 64 nt, hsa; identical to SEQ ID NO: 33667

SEQ ID NO: 405258 - RNA, 64 nt, hsa; identical to SEQ ID NO: 33668

SEQ ID NO: 405259 - RNA, 64 nt, hsa; identical to SEQ ID NO: 33669

SEQ ID NO: 405260 - RNA, 64 nt, hsa; identical to SEQ ID NO: 33670

SEQ ID NO: 405261 - RNA, 64 nt, hsa; identical to SEQ ID NO: 33671

SEQ ID NO: 405262 - RNA, 64 nt, hsa; identical to SEQ ID NO: 33672

SEQ ID NO: 405263 - RNA, 64 nt, hsa; identical to SEQ ID NO: 33673

SEQ ID NO: 405264 - RNA, 64 nt, hsa; identical to SEQ ID NO: 33674

SEQ ID NO: 405265 - RNA, 64 nt, hsa; identical to SEQ ID NO: 33675

SEQ ID NO: 405266 - RNA, 64 nt, hsa; identical to SEQ ID NO: 33676

SEQ ID NO: 405267 - RNA, 64 nt, hsa; identical to SEQ ID NO: 33677

SEQ ID NO: 405268 - RNA, 64 nt, hsa; identical to SEQ ID NO: 33678

SEQ ID NO: 405269 - RNA, 64 nt, hsa; identical to SEQ ID NO: 33679

SEQ ID NO: 405270 - RNA, 64 nt, hsa; identical to SEQ ID NO: 33680

SEQ ID NO: 405271 - RNA, 64 nt, hsa; identical to SEQ ID NO: 33681

SEQ ID NO: 405272 - RNA, 64 nt, hsa; identical to SEQ ID NO: 33682

SEQ ID NO: 405273 - RNA, 64 nt, hsa; identical to SEQ ID NO: 33683

SEQ ID NO: 405274 - RNA, 64 nt, hsa; identical to SEQ ID NO: 33684

SEQ ID NO: 405275 - RNA, 64 nt, hsa; identical to SEQ ID NO: 33685

SEQ ID NO: 405276 - RNA, 64 nt, hsa; identical to SEQ ID NO: 33686

SEQ ID NO: 405277 - RNA, 64 nt, hsa; identical to SEQ ID NO: 33687

SEQ ID NO: 405278 - RNA, 64 nt, hsa; identical to SEQ ID NO: 33688

SEQ ID NO: 405279 - RNA, 64 nt, hsa; identical to SEQ ID NO: 33689

SEQ ID NO: 405280 - RNA, 64 nt, hsa; identical to SEQ ID NO: 33690

SEQ ID NO: 405281 - RNA, 64 nt, hsa; identical to SEQ ID NO: 33691

SEQ ID NO: 405282 - RNA, 64 nt, hsa; identical to SEQ ID NO: 33692

SEQ ID NO: 405283 - RNA, 64 nt, hsa; identical to SEQ ID NO: 33693

SEQ ID NO: 405284 - RNA, 64 nt, hsa; identical to SEQ ID NO: 33694

SEQ ID NO: 405285 - RNA, 64 nt, hsa; identical to SEQ ID NO: 33695

SEQ ID NO: 405286 - RNA, 64 nt, hsa; identical to SEQ ID NO: 33696

SEQ ID NO: 405287 - RNA, 64 nt, hsa; identical to SEQ ID NO: 33697

SEQ ID NO: 405288 - RNA, 64 nt, hsa; identical to SEQ ID NO: 33698

SEQ ID NO: 405289 - RNA, 64 nt, hsa; identical to SEQ ID NO: 33699

SEQ ID NO: 405290 - RNA, 64 nt, hsa; identical to SEQ ID NO: 33700

SEQ ID NO: 405291 - RNA, 64 nt, hsa; identical to SEQ ID NO: 33701

SEQ ID NO: 405292 - RNA, 64 nt, hsa; identical to SEQ ID NO: 33702

SEQ ID NO: 405293 - RNA, 64 nt, hsa; identical to SEQ ID NO: 33703

SEQ ID NO: 405294 - RNA, 64 nt, hsa; identical to SEQ ID NO: 33704

SEQ ID NO: 405295 - RNA, 64 nt, hsa; identical to SEQ ID NO: 33705

SEQ ID NO: 405296 - RNA, 64 nt, hsa; identical to SEQ ID NO: 33706

SEQ ID NO: 405297 - RNA, 64 nt, hsa; identical to SEQ ID NO: 33707

SEQ ID NO: 405298 - RNA, 64 nt, hsa; identical to SEQ ID NO: 33708

SEQ ID NO: 405299 - RNA, 64 nt, hsa; identical to SEQ ID NO: 33709

SEQ ID NO: 405300 - RNA, 64 nt, hsa; identical to SEQ ID NO: 33710

SEQ ID NO: 405301 - RNA, 64 nt, hsa; identical to SEQ ID NO: 33711

SEQ ID NO: 405302 - RNA, 64 nt, hsa; identical to SEQ ID NO: 33712

SEQ ID NO: 405303 - RNA, 64 nt, hsa; identical to SEQ ID NO: 33713

SEQ ID NO: 405304 - RNA, 64 nt, hsa; identical to SEQ ID NO: 33714

SEQ ID NO: 405305 - RNA, 64 nt, hsa; identical to SEQ ID NO: 33715

SEQ ID NO: 405306 - RNA, 64 nt, hsa; identical to SEQ ID NO: 33716

SEQ ID NO: 405307 - RNA, 64 nt, hsa; identical to SEQ ID NO: 33717

SEQ ID NO: 405308 - RNA, 64 nt, hsa; identical to SEQ ID NO: 33718

SEQ ID NO: 405309 - RNA, 64 nt, hsa; identical to SEQ ID NO: 33719

SEQ ID NO: 405310 - RNA, 64 nt, hsa; identical to SEQ ID NO: 33720

SEQ ID NO: 405311 - RNA, 64 nt, hsa; identical to SEQ ID NO: 33721

SEQ ID NO: 405312 - RNA, 64 nt, hsa; identical to SEQ ID NO: 33722

SEQ ID NO: 405313 - RNA, 64 nt, hsa; identical to SEQ ID NO: 33723

SEQ ID NO: 405314 - RNA, 64 nt, hsa; identical to SEQ ID NO: 33724

SEQ ID NO: 405315 - RNA, 64 nt, hsa; identical to SEQ ID NO: 33725

SEQ ID NO: 405316 - RNA, 64 nt, hsa; identical to SEQ ID NO: 33726

SEQ ID NO: 405317 - RNA, 64 nt, hsa; identical to SEQ ID NO: 33727

SEQ ID NO: 405318 - RNA, 64 nt, hsa; identical to SEQ ID NO: 33728

SEQ ID NO: 405319 - RNA, 64 nt, hsa; identical to SEQ ID NO: 33729

SEQ ID NO: 405320 - RNA, 64 nt, hsa; identical to SEQ ID NO: 33730

SEQ ID NO: 405321 - RNA, 64 nt, hsa; identical to SEQ ID NO: 33731

SEQ ID NO: 405322 - RNA, 64 nt, hsa; identical to SEQ ID NO: 33732

SEQ ID NO: 405323 - RNA, 64 nt, hsa; identical to SEQ ID NO: 33733

SEQ ID NO: 405324 - RNA, 64 nt, hsa; identical to SEQ ID NO: 33734

SEQ ID NO: 405325 - RNA, 64 nt, hsa; identical to SEQ ID NO: 33735

SEQ ID NO: 405326 - RNA, 64 nt, hsa; identical to SEQ ID NO: 33736

SEQ ID NO: 405327 - RNA, 64 nt, hsa; identical to SEQ ID NO: 33737

SEQ ID NO: 405328 - RNA, 64 nt, hsa; identical to SEQ ID NO: 33738

SEQ ID NO: 405329 - RNA, 64 nt, hsa; identical to SEQ ID NO: 33739

SEQ ID NO: 405330 - RNA, 64 nt, hsa; identical to SEQ ID NO: 33740

SEQ ID NO: 405331 - RNA, 64 nt, hsa; identical to SEQ ID NO: 33741

SEQ ID NO: 405332 - RNA, 64 nt, hsa; identical to SEQ ID NO: 33742

SEQ ID NO: 405333 - RNA, 64 nt, hsa; identical to SEQ ID NO: 33743

SEQ ID NO: 405334 - RNA, 64 nt, hsa; identical to SEQ ID NO: 33744

SEQ ID NO: 405335 - RNA, 64 nt, hsa; identical to SEQ ID NO: 33745

SEQ ID NO: 405336 - RNA, 64 nt, hsa; identical to SEQ ID NO: 33746

SEQ ID NO: 405337 - RNA, 64 nt, hsa; identical to SEQ ID NO: 33747

SEQ ID NO: 405338 - RNA, 64 nt, hsa; identical to SEQ ID NO: 33748

SEQ ID NO: 405339 - RNA, 64 nt, hsa; identical to SEQ ID NO: 33749

SEQ ID NO: 405340 - RNA, 64 nt, hsa; identical to SEQ ID NO: 33750

SEQ ID NO: 405341 - RNA, 64 nt, hsa; identical to SEQ ID NO: 33751

SEQ ID NO: 405342 - RNA, 64 nt, hsa; identical to SEQ ID NO: 33752

SEQ ID NO: 405343 - RNA, 64 nt, hsa; identical to SEQ ID NO: 33753

SEQ ID NO: 405344 - RNA, 64 nt, hsa; identical to SEQ ID NO: 33754

SEQ ID NO: 405345 - RNA, 64 nt, hsa; identical to SEQ ID NO: 33755

SEQ ID NO: 405346 - RNA, 64 nt, hsa; identical to SEQ ID NO: 33756

SEQ ID NO: 405347 - RNA, 64 nt, hsa; identical to SEQ ID NO: 33757

SEQ ID NO: 405348 - RNA, 64 nt, hsa; identical to SEQ ID NO: 33758

SEQ ID NO: 405349 - RNA, 64 nt, hsa; identical to SEQ ID NO: 33759

SEQ ID NO: 405350 - RNA, 64 nt, hsa; identical to SEQ ID NO: 33760

SEQ ID NO: 405351 - RNA, 64 nt, hsa; identical to SEQ ID NO: 33761

SEQ ID NO: 405352 - RNA, 64 nt, hsa; identical to SEQ ID NO: 33762

SEQ ID NO: 405353 - RNA, 64 nt, hsa; identical to SEQ ID NO: 33763

SEQ ID NO: 405354 - RNA, 64 nt, hsa; identical to SEQ ID NO: 33764

SEQ ID NO: 405355 - RNA, 64 nt, hsa; identical to SEQ ID NO: 33765

SEQ ID NO: 405356 - RNA, 64 nt, hsa; identical to SEQ ID NO: 33766

SEQ ID NO: 405357 - RNA, 64 nt, hsa; identical to SEQ ID NO: 33767

SEQ ID NO: 405358 - RNA, 64 nt, hsa; identical to SEQ ID NO: 33768

SEQ ID NO: 405359 - RNA, 64 nt, hsa; identical to SEQ ID NO: 33769

SEQ ID NO: 405360 - RNA, 64 nt, hsa; identical to SEQ ID NO: 33770

SEQ ID NO: 405361 - RNA, 64 nt, hsa; identical to SEQ ID NO: 33771

SEQ ID NO: 405362 - RNA, 64 nt, hsa; identical to SEQ ID NO: 33772

SEQ ID NO: 405363 - RNA, 64 nt, hsa; identical to SEQ ID NO: 33773

SEQ ID NO: 405364 - RNA, 64 nt, hsa; identical to SEQ ID NO: 33774

SEQ ID NO: 405365 - RNA, 64 nt, hsa; identical to SEQ ID NO: 33775

SEQ ID NO: 405366 - RNA, 64 nt, hsa; identical to SEQ ID NO: 33776

SEQ ID NO: 405367 - RNA, 64 nt, hsa; identical to SEQ ID NO: 33777

SEQ ID NO: 405368 - RNA, 64 nt, hsa; identical to SEQ ID NO: 33778

SEQ ID NO: 405369 - RNA, 64 nt, hsa; identical to SEQ ID NO: 33779

SEQ ID NO: 405370 - RNA, 64 nt, hsa; identical to SEQ ID NO: 33780

SEQ ID NO: 405371 - RNA, 64 nt, hsa; identical to SEQ ID NO: 33781

SEQ ID NO: 405372 - RNA, 64 nt, hsa; identical to SEQ ID NO: 33782

SEQ ID NO: 405373 - RNA, 64 nt, hsa; identical to SEQ ID NO: 33783

SEQ ID NO: 405374 - RNA, 64 nt, hsa; identical to SEQ ID NO: 33784

SEQ ID NO: 405375 - RNA, 64 nt, hsa; identical to SEQ ID NO: 33785

SEQ ID NO: 405376 - RNA, 64 nt, hsa; identical to SEQ ID NO: 33786

SEQ ID NO: 405377 - RNA, 64 nt, hsa; identical to SEQ ID NO: 33787

SEQ ID NO: 405378 - RNA, 64 nt, hsa; identical to SEQ ID NO: 33788

SEQ ID NO: 405379 - RNA, 64 nt, hsa; identical to SEQ ID NO: 33789

SEQ ID NO: 405380 - RNA, 64 nt, hsa; identical to SEQ ID NO: 33790

SEQ ID NO: 405381 - RNA, 64 nt, hsa; identical to SEQ ID NO: 33791

SEQ ID NO: 405382 - RNA, 64 nt, hsa; identical to SEQ ID NO: 33792

SEQ ID NO: 405383 - RNA, 64 nt, hsa; identical to SEQ ID NO: 33793

SEQ ID NO: 405384 - RNA, 64 nt, hsa; identical to SEQ ID NO: 33794

SEQ ID NO: 405385 - RNA, 64 nt, hsa; identical to SEQ ID NO: 33795

SEQ ID NO: 405386 - RNA, 64 nt, hsa; identical to SEQ ID NO: 33796

SEQ ID NO: 405387 - RNA, 64 nt, hsa; identical to SEQ ID NO: 33797

SEQ ID NO: 405388 - RNA, 64 nt, hsa; identical to SEQ ID NO: 33798

SEQ ID NO: 405389 - RNA, 64 nt, hsa; identical to SEQ ID NO: 33799

SEQ ID NO: 405390 - RNA, 64 nt, hsa; identical to SEQ ID NO: 33800

SEQ ID NO: 405391 - RNA, 64 nt, hsa; identical to SEQ ID NO: 33801

SEQ ID NO: 405392 - RNA, 64 nt, hsa; identical to SEQ ID NO: 33802

SEQ ID NO: 405393 - RNA, 64 nt, hsa; identical to SEQ ID NO: 33803

SEQ ID NO: 405394 - RNA, 64 nt, hsa; identical to SEQ ID NO: 33804

SEQ ID NO: 405395 - RNA, 64 nt, hsa; identical to SEQ ID NO: 33805

SEQ ID NO: 405396 - RNA, 64 nt, hsa; identical to SEQ ID NO: 33806

SEQ ID NO: 405397 - RNA, 64 nt, hsa; identical to SEQ ID NO: 33807

SEQ ID NO: 405398 - RNA, 64 nt, hsa; identical to SEQ ID NO: 33808

SEQ ID NO: 405399 - RNA, 64 nt, hsa; identical to SEQ ID NO: 33809

SEQ ID NO: 405400 - RNA, 64 nt, hsa; identical to SEQ ID NO: 33810

SEQ ID NO: 405401 - RNA, 64 nt, hsa; identical to SEQ ID NO: 33811

SEQ ID NO: 405402 - RNA, 64 nt, hsa; identical to SEQ ID NO: 33812

SEQ ID NO: 405403 - RNA, 64 nt, hsa; identical to SEQ ID NO: 33813

SEQ ID NO: 405404 - RNA, 64 nt, hsa; identical to SEQ ID NO: 33814

SEQ ID NO: 405405 - RNA, 64 nt, hsa; identical to SEQ ID NO: 33815

SEQ ID NO: 405406 - RNA, 64 nt, hsa; identical to SEQ ID NO: 33816

SEQ ID NO: 405407 - RNA, 64 nt, hsa; identical to SEQ ID NO: 33817

SEQ ID NO: 405408 - RNA, 64 nt, hsa; identical to SEQ ID NO: 33818

SEQ ID NO: 405409 - RNA, 64 nt, hsa; identical to SEQ ID NO: 33819

SEQ ID NO: 405410 - RNA, 64 nt, hsa; identical to SEQ ID NO: 33820

SEQ ID NO: 405411 - RNA, 64 nt, hsa; identical to SEQ ID NO: 33821

SEQ ID NO: 405412 - RNA, 64 nt, hsa; identical to SEQ ID NO: 33822

SEQ ID NO: 405413 - RNA, 64 nt, hsa; identical to SEQ ID NO: 33823

SEQ ID NO: 405414 - RNA, 64 nt, hsa; identical to SEQ ID NO: 33824

SEQ ID NO: 405415 - RNA, 64 nt, hsa; identical to SEQ ID NO: 33825

SEQ ID NO: 405416 - RNA, 64 nt, hsa; identical to SEQ ID NO: 33826

SEQ ID NO: 405417 - RNA, 64 nt, hsa; identical to SEQ ID NO: 33827

SEQ ID NO: 405418 - RNA, 64 nt, hsa; identical to SEQ ID NO: 33828

SEQ ID NO: 405419 - RNA, 64 nt, hsa; identical to SEQ ID NO: 33829

SEQ ID NO: 405420 - RNA, 64 nt, hsa; identical to SEQ ID NO: 33830

SEQ ID NO: 405421 - RNA, 64 nt, hsa; identical to SEQ ID NO: 33831

SEQ ID NO: 405422 - RNA, 64 nt, hsa; identical to SEQ ID NO: 33832

SEQ ID NO: 405423 - RNA, 64 nt, hsa; identical to SEQ ID NO: 33833

SEQ ID NO: 405424 - RNA, 64 nt, hsa; identical to SEQ ID NO: 33834

SEQ ID NO: 405425 - RNA, 64 nt, hsa; identical to SEQ ID NO: 33835

SEQ ID NO: 405426 - RNA, 64 nt, hsa; identical to SEQ ID NO: 33836

SEQ ID NO: 405427 - RNA, 64 nt, hsa; identical to SEQ ID NO: 33837

SEQ ID NO: 405428 - RNA, 64 nt, hsa; identical to SEQ ID NO: 33838

SEQ ID NO: 405429 - RNA, 64 nt, hsa; identical to SEQ ID NO: 33839

SEQ ID NO: 405430 - RNA, 64 nt, hsa; identical to SEQ ID NO: 33840

SEQ ID NO: 405431 - RNA, 64 nt, hsa; identical to SEQ ID NO: 33841

SEQ ID NO: 405432 - RNA, 64 nt, hsa; identical to SEQ ID NO: 33842

SEQ ID NO: 405433 - RNA, 64 nt, hsa; identical to SEQ ID NO: 33843

SEQ ID NO: 405434 - RNA, 64 nt, hsa; identical to SEQ ID NO: 33844

SEQ ID NO: 405435 - RNA, 64 nt, hsa; identical to SEQ ID NO: 33845

SEQ ID NO: 405436 - RNA, 64 nt, hsa; identical to SEQ ID NO: 33846

SEQ ID NO: 405437 - RNA, 64 nt, hsa; identical to SEQ ID NO: 33847

SEQ ID NO: 405438 - RNA, 64 nt, hsa; identical to SEQ ID NO: 33848

SEQ ID NO: 405439 - RNA, 64 nt, hsa; identical to SEQ ID NO: 33849

SEQ ID NO: 405440 - RNA, 64 nt, hsa; identical to SEQ ID NO: 33850

SEQ ID NO: 405441 - RNA, 64 nt, hsa; identical to SEQ ID NO: 33851

SEQ ID NO: 405442 - RNA, 64 nt, hsa; identical to SEQ ID NO: 33852

SEQ ID NO: 405443 - RNA, 64 nt, hsa; identical to SEQ ID NO: 33853

SEQ ID NO: 405444 - RNA, 64 nt, hsa; identical to SEQ ID NO: 33854

SEQ ID NO: 405445 - RNA, 64 nt, hsa; identical to SEQ ID NO: 33855

SEQ ID NO: 405446 - RNA, 64 nt, hsa; identical to SEQ ID NO: 33856

SEQ ID NO: 405447 - RNA, 64 nt, hsa; identical to SEQ ID NO: 33857

SEQ ID NO: 405448 - RNA, 64 nt, hsa; identical to SEQ ID NO: 33858

SEQ ID NO: 405449 - RNA, 64 nt, hsa; identical to SEQ ID NO: 33859

SEQ ID NO: 405450 - RNA, 64 nt, hsa; identical to SEQ ID NO: 33860

SEQ ID NO: 405451 - RNA, 64 nt, hsa; identical to SEQ ID NO: 33861

SEQ ID NO: 405452 - RNA, 64 nt, hsa; identical to SEQ ID NO: 33862

SEQ ID NO: 405453 - RNA, 64 nt, hsa; identical to SEQ ID NO: 33863

SEQ ID NO: 405454 - RNA, 64 nt, hsa; identical to SEQ ID NO: 33864

SEQ ID NO: 405455 - RNA, 64 nt, hsa; identical to SEQ ID NO: 33865

SEQ ID NO: 405456 - RNA, 64 nt, hsa; identical to SEQ ID NO: 33866

SEQ ID NO: 405457 - RNA, 64 nt, hsa; identical to SEQ ID NO: 33867

SEQ ID NO: 405458 - RNA, 64 nt, hsa; identical to SEQ ID NO: 33868

SEQ ID NO: 405459 - RNA, 64 nt, hsa; identical to SEQ ID NO: 33869

SEQ ID NO: 405460 - RNA, 64 nt, hsa; identical to SEQ ID NO: 33870

SEQ ID NO: 405461 - RNA, 64 nt, hsa; identical to SEQ ID NO: 33871

SEQ ID NO: 405462 - RNA, 64 nt, hsa; identical to SEQ ID NO: 33872

SEQ ID NO: 405463 - RNA, 64 nt, hsa; identical to SEQ ID NO: 33873

SEQ ID NO: 405464 - RNA, 64 nt, hsa; identical to SEQ ID NO: 33874

SEQ ID NO: 405465 - RNA, 64 nt, hsa; identical to SEQ ID NO: 33875

SEQ ID NO: 405466 - RNA, 64 nt, hsa; identical to SEQ ID NO: 33876

SEQ ID NO: 405467 - RNA, 64 nt, hsa; identical to SEQ ID NO: 33877

SEQ ID NO: 405468 - RNA, 64 nt, hsa; identical to SEQ ID NO: 33878

SEQ ID NO: 405469 - RNA, 64 nt, hsa; identical to SEQ ID NO: 33879

SEQ ID NO: 405470 - RNA, 64 nt, hsa; identical to SEQ ID NO: 33880

SEQ ID NO: 405471 - RNA, 64 nt, hsa; identical to SEQ ID NO: 33881

SEQ ID NO: 405472 - RNA, 64 nt, hsa; identical to SEQ ID NO: 33882

SEQ ID NO: 405473 - RNA, 64 nt, hsa; identical to SEQ ID NO: 33883

SEQ ID NO: 405474 - RNA, 64 nt, hsa; identical to SEQ ID NO: 33884

SEQ ID NO: 405475 - RNA, 64 nt, hsa; identical to SEQ ID NO: 33885

SEQ ID NO: 405476 - RNA, 64 nt, hsa; identical to SEQ ID NO: 33886

SEQ ID NO: 405477 - RNA, 64 nt, hsa; identical to SEQ ID NO: 33887

SEQ ID NO: 405478 - RNA, 64 nt, hsa; identical to SEQ ID NO: 33888

SEQ ID NO: 405479 - RNA, 64 nt, hsa; identical to SEQ ID NO: 33889

SEQ ID NO: 405480 - RNA, 64 nt, hsa; identical to SEQ ID NO: 33890

SEQ ID NO: 405481 - RNA, 64 nt, hsa; identical to SEQ ID NO: 33891

SEQ ID NO: 405482 - RNA, 64 nt, hsa; identical to SEQ ID NO: 33892

SEQ ID NO: 405483 - RNA, 64 nt, hsa; identical to SEQ ID NO: 33893

SEQ ID NO: 405484 - RNA, 64 nt, hsa; identical to SEQ ID NO: 33894

SEQ ID NO: 405485 - RNA, 64 nt, hsa; identical to SEQ ID NO: 33895

SEQ ID NO: 405486 - RNA, 64 nt, hsa; identical to SEQ ID NO: 33896

SEQ ID NO: 405487 - RNA, 64 nt, hsa; identical to SEQ ID NO: 33897

SEQ ID NO: 405488 - RNA, 64 nt, hsa; identical to SEQ ID NO: 33898

SEQ ID NO: 405489 - RNA, 64 nt, hsa; identical to SEQ ID NO: 33899

SEQ ID NO: 405490 - RNA, 64 nt, hsa; identical to SEQ ID NO: 33900

SEQ ID NO: 405491 - RNA, 64 nt, hsa; identical to SEQ ID NO: 33901

SEQ ID NO: 405492 - RNA, 64 nt, hsa; identical to SEQ ID NO: 33902

SEQ ID NO: 405493 - RNA, 64 nt, hsa; identical to SEQ ID NO: 33903

SEQ ID NO: 405494 - RNA, 64 nt, hsa; identical to SEQ ID NO: 33904

SEQ ID NO: 405495 - RNA, 64 nt, hsa; identical to SEQ ID NO: 33905

SEQ ID NO: 405496 - RNA, 64 nt, hsa; identical to SEQ ID NO: 33906

SEQ ID NO: 405497 - RNA, 64 nt, hsa; identical to SEQ ID NO: 33907

SEQ ID NO: 405498 - RNA, 64 nt, hsa; identical to SEQ ID NO: 33908

SEQ ID NO: 405499 - RNA, 64 nt, hsa; identical to SEQ ID NO: 33909

SEQ ID NO: 405500 - RNA, 64 nt, hsa; identical to SEQ ID NO: 33910

SEQ ID NO: 405501 - RNA, 64 nt, hsa; identical to SEQ ID NO: 33911

SEQ ID NO: 405502 - RNA, 64 nt, hsa; identical to SEQ ID NO: 33912

SEQ ID NO: 405503 - RNA, 64 nt, hsa; identical to SEQ ID NO: 33913

SEQ ID NO: 405504 - RNA, 64 nt, hsa; identical to SEQ ID NO: 33914

SEQ ID NO: 405505 - RNA, 64 nt, hsa; identical to SEQ ID NO: 33915

SEQ ID NO: 405506 - RNA, 64 nt, hsa; identical to SEQ ID NO: 33916

SEQ ID NO: 405507 - RNA, 64 nt, hsa; identical to SEQ ID NO: 33917

SEQ ID NO: 405508 - RNA, 64 nt, hsa; identical to SEQ ID NO: 33918

SEQ ID NO: 405509 - RNA, 64 nt, hsa; identical to SEQ ID NO: 33919

SEQ ID NO: 405510 - RNA, 64 nt, hsa; identical to SEQ ID NO: 33920

SEQ ID NO: 405511 - RNA, 64 nt, hsa; identical to SEQ ID NO: 33921

SEQ ID NO: 405512 - RNA, 64 nt, hsa; identical to SEQ ID NO: 33922

SEQ ID NO: 405513 - RNA, 64 nt, hsa; identical to SEQ ID NO: 33923

SEQ ID NO: 405514 - RNA, 64 nt, hsa; identical to SEQ ID NO: 33924

SEQ ID NO: 405515 - RNA, 64 nt, hsa; identical to SEQ ID NO: 33925

SEQ ID NO: 405516 - RNA, 64 nt, hsa; identical to SEQ ID NO: 33926

SEQ ID NO: 405517 - RNA, 64 nt, hsa; identical to SEQ ID NO: 33927

SEQ ID NO: 405518 - RNA, 64 nt, hsa; identical to SEQ ID NO: 33928

SEQ ID NO: 405519 - RNA, 64 nt, hsa; identical to SEQ ID NO: 33929

SEQ ID NO: 405520 - RNA, 64 nt, hsa; identical to SEQ ID NO: 33930

SEQ ID NO: 405521 - RNA, 64 nt, hsa; identical to SEQ ID NO: 33931

SEQ ID NO: 405522 - RNA, 64 nt, hsa; identical to SEQ ID NO: 33932

SEQ ID NO: 405523 - RNA, 64 nt, hsa; identical to SEQ ID NO: 33933

SEQ ID NO: 405524 - RNA, 64 nt, hsa; identical to SEQ ID NO: 33934

SEQ ID NO: 405525 - RNA, 64 nt, hsa; identical to SEQ ID NO: 33935

SEQ ID NO: 405526 - RNA, 64 nt, hsa; identical to SEQ ID NO: 33936

SEQ ID NO: 405527 - RNA, 64 nt, hsa; identical to SEQ ID NO: 33937

SEQ ID NO: 405528 - RNA, 64 nt, hsa; identical to SEQ ID NO: 33938

SEQ ID NO: 405529 - RNA, 64 nt, hsa; identical to SEQ ID NO: 33939

SEQ ID NO: 405530 - RNA, 64 nt, hsa; identical to SEQ ID NO: 33940

SEQ ID NO: 405531 - RNA, 64 nt, hsa; identical to SEQ ID NO: 33941

SEQ ID NO: 405532 - RNA, 64 nt, hsa; identical to SEQ ID NO: 33942

SEQ ID NO: 405533 - RNA, 64 nt, hsa; identical to SEQ ID NO: 33943

SEQ ID NO: 405534 - RNA, 64 nt, hsa; identical to SEQ ID NO: 33944

SEQ ID NO: 405535 - RNA, 64 nt, hsa; identical to SEQ ID NO: 33945

SEQ ID NO: 405536 - RNA, 64 nt, hsa; identical to SEQ ID NO: 33946

SEQ ID NO: 405537 - RNA, 64 nt, hsa; identical to SEQ ID NO: 33947

SEQ ID NO: 405538 - RNA, 64 nt, hsa; identical to SEQ ID NO: 33948

SEQ ID NO: 405539 - RNA, 64 nt, hsa; identical to SEQ ID NO: 33949

SEQ ID NO: 405540 - RNA, 64 nt, hsa; identical to SEQ ID NO: 33950

SEQ ID NO: 405541 - RNA, 64 nt, hsa; identical to SEQ ID NO: 33951

SEQ ID NO: 405542 - RNA, 64 nt, hsa; identical to SEQ ID NO: 33952

SEQ ID NO: 405543 - RNA, 63 nt, hsa; identical to SEQ ID NO: 33953

SEQ ID NO: 405544 - RNA, 62 nt, hsa; identical to SEQ ID NO: 33954

SEQ ID NO: 405545 - RNA, 64 nt, hsa; identical to SEQ ID NO: 33955

SEQ ID NO: 405546 - RNA, 64 nt, hsa; identical to SEQ ID NO: 33956

SEQ ID NO: 405547 - RNA, 64 nt, hsa; identical to SEQ ID NO: 33957

SEQ ID NO: 405548 - RNA, 64 nt, hsa; identical to SEQ ID NO: 33958

SEQ ID NO: 405549 - RNA, 64 nt, hsa; identical to SEQ ID NO: 33959

SEQ ID NO: 405550 - RNA, 64 nt, hsa; identical to SEQ ID NO: 33960

SEQ ID NO: 405551 - RNA, 64 nt, hsa; identical to SEQ ID NO: 33961

SEQ ID NO: 405552 - RNA, 64 nt, hsa; identical to SEQ ID NO: 33962

SEQ ID NO: 405553 - RNA, 64 nt, hsa; identical to SEQ ID NO: 33963

SEQ ID NO: 405554 - RNA, 64 nt, hsa; identical to SEQ ID NO: 33964

SEQ ID NO: 405555 - RNA, 64 nt, hsa; identical to SEQ ID NO: 33965

SEQ ID NO: 405556 - RNA, 64 nt, hsa; identical to SEQ ID NO: 33966

SEQ ID NO: 405557 - RNA, 64 nt, hsa; identical to SEQ ID NO: 33967

SEQ ID NO: 405558 - RNA, 64 nt, hsa; identical to SEQ ID NO: 33968

SEQ ID NO: 405559 - RNA, 64 nt, hsa; identical to SEQ ID NO: 33969

SEQ ID NO: 405560 - RNA, 64 nt, hsa; identical to SEQ ID NO: 33970

SEQ ID NO: 405561 - RNA, 64 nt, hsa; identical to SEQ ID NO: 33971

SEQ ID NO: 405562 - RNA, 64 nt, hsa; identical to SEQ ID NO: 33972

SEQ ID NO: 405563 - RNA, 64 nt, hsa; identical to SEQ ID NO: 33973

SEQ ID NO: 405564 - RNA, 64 nt, hsa; identical to SEQ ID NO: 33974

SEQ ID NO: 405565 - RNA, 64 nt, hsa; identical to SEQ ID NO: 33975

SEQ ID NO: 405566 - RNA, 64 nt, hsa; identical to SEQ ID NO: 33976

SEQ ID NO: 405567 - RNA, 64 nt, hsa; identical to SEQ ID NO: 33977

SEQ ID NO: 405568 - RNA, 64 nt, hsa; identical to SEQ ID NO: 33978

SEQ ID NO: 405569 - RNA, 64 nt, hsa; identical to SEQ ID NO: 33979

SEQ ID NO: 405570 - RNA, 64 nt, hsa; identical to SEQ ID NO: 33980

SEQ ID NO: 405571 - RNA, 64 nt, hsa; identical to SEQ ID NO: 33981

SEQ ID NO: 405572 - RNA, 64 nt, hsa; identical to SEQ ID NO: 33982

SEQ ID NO: 405573 - RNA, 64 nt, hsa; identical to SEQ ID NO: 33983

SEQ ID NO: 405574 - RNA, 64 nt, hsa; identical to SEQ ID NO: 33984

SEQ ID NO: 405575 - RNA, 64 nt, hsa; identical to SEQ ID NO: 33985

SEQ ID NO: 405576 - RNA, 64 nt, hsa; identical to SEQ ID NO: 33986

SEQ ID NO: 405577 - RNA, 64 nt, hsa; identical to SEQ ID NO: 33987

SEQ ID NO: 405578 - RNA, 64 nt, hsa; identical to SEQ ID NO: 33988

SEQ ID NO: 405579 - RNA, 64 nt, hsa; identical to SEQ ID NO: 33989

SEQ ID NO: 405580 - RNA, 64 nt, hsa; identical to SEQ ID NO: 33990

SEQ ID NO: 405581 - RNA, 64 nt, hsa; identical to SEQ ID NO: 33991

SEQ ID NO: 405582 - RNA, 64 nt, hsa; identical to SEQ ID NO: 33992

SEQ ID NO: 405583 - RNA, 64 nt, hsa; identical to SEQ ID NO: 33993

SEQ ID NO: 405584 - RNA, 64 nt, hsa; identical to SEQ ID NO: 33994

SEQ ID NO: 405585 - RNA, 64 nt, hsa; identical to SEQ ID NO: 33995

SEQ ID NO: 405586 - RNA, 64 nt, hsa; identical to SEQ ID NO: 33996

SEQ ID NO: 405587 - RNA, 64 nt, hsa; identical to SEQ ID NO: 33997

SEQ ID NO: 405588 - RNA, 64 nt, hsa; identical to SEQ ID NO: 33998

SEQ ID NO: 405589 - RNA, 64 nt, hsa; identical to SEQ ID NO: 33999

SEQ ID NO: 405590 - RNA, 64 nt, hsa; identical to SEQ ID NO: 34000

SEQ ID NO: 405591 - RNA, 64 nt, hsa; identical to SEQ ID NO: 34001

SEQ ID NO: 405592 - RNA, 64 nt, hsa; identical to SEQ ID NO: 34002

SEQ ID NO: 405593 - RNA, 64 nt, hsa; identical to SEQ ID NO: 34003

SEQ ID NO: 405594 - RNA, 64 nt, hsa; identical to SEQ ID NO: 34004

SEQ ID NO: 405595 - RNA, 64 nt, hsa; identical to SEQ ID NO: 34005

SEQ ID NO: 405596 - RNA, 64 nt, hsa; identical to SEQ ID NO: 34006

SEQ ID NO: 405597 - RNA, 64 nt, hsa; identical to SEQ ID NO: 34007

SEQ ID NO: 405598 - RNA, 64 nt, hsa; identical to SEQ ID NO: 34008

SEQ ID NO: 405599 - RNA, 64 nt, hsa; identical to SEQ ID NO: 34009

SEQ ID NO: 405600 - RNA, 64 nt, hsa; identical to SEQ ID NO: 34010

SEQ ID NO: 405601 - RNA, 64 nt, hsa; identical to SEQ ID NO: 34011

SEQ ID NO: 405602 - RNA, 64 nt, hsa; identical to SEQ ID NO: 34012

SEQ ID NO: 405603 - RNA, 64 nt, hsa; identical to SEQ ID NO: 34013

SEQ ID NO: 405604 - RNA, 64 nt, hsa; identical to SEQ ID NO: 34014

SEQ ID NO: 405605 - RNA, 64 nt, hsa; identical to SEQ ID NO: 34015

SEQ ID NO: 405606 - RNA, 64 nt, hsa; identical to SEQ ID NO: 34016

SEQ ID NO: 405607 - RNA, 64 nt, hsa; identical to SEQ ID NO: 34017

SEQ ID NO: 405608 - RNA, 64 nt, hsa; identical to SEQ ID NO: 34018

SEQ ID NO: 405609 - RNA, 64 nt, hsa; identical to SEQ ID NO: 34019

SEQ ID NO: 405610 - RNA, 64 nt, hsa; identical to SEQ ID NO: 34020

SEQ ID NO: 405611 - RNA, 64 nt, hsa; identical to SEQ ID NO: 34021

SEQ ID NO: 405612 - RNA, 64 nt, hsa; identical to SEQ ID NO: 34022

SEQ ID NO: 405613 - RNA, 64 nt, hsa; identical to SEQ ID NO: 34023

SEQ ID NO: 405614 - RNA, 64 nt, hsa; identical to SEQ ID NO: 34024

SEQ ID NO: 405615 - RNA, 64 nt, hsa; identical to SEQ ID NO: 34025

SEQ ID NO: 405616 - RNA, 64 nt, hsa; identical to SEQ ID NO: 34026

SEQ ID NO: 405617 - RNA, 64 nt, hsa; identical to SEQ ID NO: 34027

SEQ ID NO: 405618 - RNA, 64 nt, hsa; identical to SEQ ID NO: 34028

SEQ ID NO: 405619 - RNA, 64 nt, hsa; identical to SEQ ID NO: 34029

SEQ ID NO: 405620 - RNA, 64 nt, hsa; identical to SEQ ID NO: 34030

SEQ ID NO: 405621 - RNA, 64 nt, hsa; identical to SEQ ID NO: 34031

SEQ ID NO: 405622 - RNA, 64 nt, hsa; identical to SEQ ID NO: 34032

SEQ ID NO: 405623 - RNA, 64 nt, hsa; identical to SEQ ID NO: 34033

SEQ ID NO: 405624 - RNA, 64 nt, hsa; identical to SEQ ID NO: 34034

SEQ ID NO: 405625 - RNA, 64 nt, hsa; identical to SEQ ID NO: 34035

SEQ ID NO: 405626 - RNA, 64 nt, hsa; identical to SEQ ID NO: 34036

SEQ ID NO: 405627 - RNA, 64 nt, hsa; identical to SEQ ID NO: 34037

SEQ ID NO: 405628 - RNA, 64 nt, hsa; identical to SEQ ID NO: 34038

SEQ ID NO: 405629 - RNA, 64 nt, hsa; identical to SEQ ID NO: 34039

SEQ ID NO: 405630 - RNA, 64 nt, hsa; identical to SEQ ID NO: 34040

SEQ ID NO: 405631 - RNA, 64 nt, hsa; identical to SEQ ID NO: 34041

SEQ ID NO: 405632 - RNA, 64 nt, hsa; identical to SEQ ID NO: 34042

SEQ ID NO: 405633 - RNA, 64 nt, hsa; identical to SEQ ID NO: 34043

SEQ ID NO: 405634 - RNA, 64 nt, hsa; identical to SEQ ID NO: 34044

SEQ ID NO: 405635 - RNA, 64 nt, hsa; identical to SEQ ID NO: 34045

SEQ ID NO: 405636 - RNA, 64 nt, hsa; identical to SEQ ID NO: 34046

SEQ ID NO: 405637 - RNA, 64 nt, hsa; identical to SEQ ID NO: 34047

SEQ ID NO: 405638 - RNA, 64 nt, hsa; identical to SEQ ID NO: 34048

SEQ ID NO: 405639 - RNA, 64 nt, hsa; identical to SEQ ID NO: 34049

SEQ ID NO: 405640 - RNA, 64 nt, hsa; identical to SEQ ID NO: 34050

SEQ ID NO: 405641 - RNA, 64 nt, hsa; identical to SEQ ID NO: 34051

SEQ ID NO: 405642 - RNA, 64 nt, hsa; identical to SEQ ID NO: 34052

SEQ ID NO: 405643 - RNA, 64 nt, hsa; identical to SEQ ID NO: 34053

SEQ ID NO: 405644 - RNA, 64 nt, hsa; identical to SEQ ID NO: 34054

SEQ ID NO: 405645 - RNA, 64 nt, hsa; identical to SEQ ID NO: 34055

SEQ ID NO: 405646 - RNA, 64 nt, hsa; identical to SEQ ID NO: 34056

SEQ ID NO: 405647 - RNA, 64 nt, hsa; identical to SEQ ID NO: 34057

SEQ ID NO: 405648 - RNA, 64 nt, hsa; identical to SEQ ID NO: 34058

SEQ ID NO: 405649 - RNA, 64 nt, hsa; identical to SEQ ID NO: 34059

SEQ ID NO: 405650 - RNA, 64 nt, hsa; identical to SEQ ID NO: 34060

SEQ ID NO: 405651 - RNA, 64 nt, hsa; identical to SEQ ID NO: 34061

SEQ ID NO: 405652 - RNA, 64 nt, hsa; identical to SEQ ID NO: 34062

SEQ ID NO: 405653 - RNA, 64 nt, hsa; identical to SEQ ID NO: 34063

SEQ ID NO: 405654 - RNA, 64 nt, hsa; identical to SEQ ID NO: 34064

SEQ ID NO: 405655 - RNA, 64 nt, hsa; identical to SEQ ID NO: 34065

SEQ ID NO: 405656 - RNA, 64 nt, hsa; identical to SEQ ID NO: 34066

SEQ ID NO: 405657 - RNA, 64 nt, hsa; identical to SEQ ID NO: 34067

SEQ ID NO: 405658 - RNA, 64 nt, hsa; identical to SEQ ID NO: 34068

SEQ ID NO: 405659 - RNA, 64 nt, hsa; identical to SEQ ID NO: 34069

SEQ ID NO: 405660 - RNA, 64 nt, hsa; identical to SEQ ID NO: 34070

SEQ ID NO: 405661 - RNA, 64 nt, hsa; identical to SEQ ID NO: 34071

SEQ ID NO: 405662 - RNA, 64 nt, hsa; identical to SEQ ID NO: 34072

SEQ ID NO: 405663 - RNA, 64 nt, hsa; identical to SEQ ID NO: 34073

SEQ ID NO: 405664 - RNA, 64 nt, hsa; identical to SEQ ID NO: 34074

SEQ ID NO: 405665 - RNA, 64 nt, hsa; identical to SEQ ID NO: 34075

SEQ ID NO: 405666 - RNA, 64 nt, hsa; identical to SEQ ID NO: 34076

SEQ ID NO: 405667 - RNA, 64 nt, hsa; identical to SEQ ID NO: 34077

SEQ ID NO: 405668 - RNA, 64 nt, hsa; identical to SEQ ID NO: 34078

SEQ ID NO: 405669 - RNA, 64 nt, hsa; identical to SEQ ID NO: 34079

SEQ ID NO: 405670 - RNA, 64 nt, hsa; identical to SEQ ID NO: 34080

SEQ ID NO: 405671 - RNA, 64 nt, hsa; identical to SEQ ID NO: 34081

SEQ ID NO: 405672 - RNA, 64 nt, hsa; identical to SEQ ID NO: 34082

SEQ ID NO: 405673 - RNA, 64 nt, hsa; identical to SEQ ID NO: 34083

SEQ ID NO: 405674 - RNA, 64 nt, hsa; identical to SEQ ID NO: 34084

SEQ ID NO: 405675 - RNA, 64 nt, hsa; identical to SEQ ID NO: 34085

SEQ ID NO: 405676 - RNA, 64 nt, hsa; identical to SEQ ID NO: 34086

SEQ ID NO: 405677 - RNA, 64 nt, hsa; identical to SEQ ID NO: 34087

SEQ ID NO: 405678 - RNA, 64 nt, hsa; identical to SEQ ID NO: 34088

SEQ ID NO: 405679 - RNA, 64 nt, hsa; identical to SEQ ID NO: 34089

SEQ ID NO: 405680 - RNA, 64 nt, hsa; identical to SEQ ID NO: 34090

SEQ ID NO: 405681 - RNA, 64 nt, hsa; identical to SEQ ID NO: 34091

SEQ ID NO: 405682 - RNA, 64 nt, hsa; identical to SEQ ID NO: 34092

SEQ ID NO: 405683 - RNA, 64 nt, hsa; identical to SEQ ID NO: 34093

SEQ ID NO: 405684 - RNA, 64 nt, hsa; identical to SEQ ID NO: 34094

SEQ ID NO: 405685 - RNA, 64 nt, hsa; identical to SEQ ID NO: 34095

SEQ ID NO: 405686 - RNA, 64 nt, hsa; identical to SEQ ID NO: 34096

SEQ ID NO: 405687 - RNA, 64 nt, hsa; identical to SEQ ID NO: 34097

SEQ ID NO: 405688 - RNA, 64 nt, hsa; identical to SEQ ID NO: 34098

SEQ ID NO: 405689 - RNA, 64 nt, hsa; identical to SEQ ID NO: 34099

SEQ ID NO: 405690 - RNA, 64 nt, hsa; identical to SEQ ID NO: 34100

SEQ ID NO: 405691 - RNA, 64 nt, hsa; identical to SEQ ID NO: 34101

SEQ ID NO: 405692 - RNA, 64 nt, hsa; identical to SEQ ID NO: 34102

SEQ ID NO: 405693 - RNA, 64 nt, hsa; identical to SEQ ID NO: 34103

SEQ ID NO: 405694 - RNA, 64 nt, hsa; identical to SEQ ID NO: 34104

SEQ ID NO: 405695 - RNA, 64 nt, hsa; identical to SEQ ID NO: 34105

SEQ ID NO: 405696 - RNA, 64 nt, hsa; identical to SEQ ID NO: 34106

SEQ ID NO: 405697 - RNA, 64 nt, hsa; identical to SEQ ID NO: 34107

SEQ ID NO: 405698 - RNA, 64 nt, hsa; identical to SEQ ID NO: 34108

SEQ ID NO: 405699 - RNA, 64 nt, hsa; identical to SEQ ID NO: 34109

SEQ ID NO: 405700 - RNA, 64 nt, hsa; identical to SEQ ID NO: 34110

SEQ ID NO: 405701 - RNA, 64 nt, hsa; identical to SEQ ID NO: 34111

SEQ ID NO: 405702 - RNA, 64 nt, hsa; identical to SEQ ID NO: 34112

SEQ ID NO: 405703 - RNA, 64 nt, hsa; identical to SEQ ID NO: 34113

SEQ ID NO: 405704 - RNA, 64 nt, hsa; identical to SEQ ID NO: 34114

SEQ ID NO: 405705 - RNA, 64 nt, hsa; identical to SEQ ID NO: 34115

SEQ ID NO: 405706 - RNA, 64 nt, hsa; identical to SEQ ID NO: 34116

SEQ ID NO: 405707 - RNA, 64 nt, hsa; identical to SEQ ID NO: 34117

SEQ ID NO: 405708 - RNA, 64 nt, hsa; identical to SEQ ID NO: 34118

SEQ ID NO: 405709 - RNA, 64 nt, hsa; identical to SEQ ID NO: 34119

SEQ ID NO: 405710 - RNA, 64 nt, hsa; identical to SEQ ID NO: 34120

SEQ ID NO: 405711 - RNA, 64 nt, hsa; identical to SEQ ID NO: 34121

SEQ ID NO: 405712 - RNA, 64 nt, hsa; identical to SEQ ID NO: 34122

SEQ ID NO: 405713 - RNA, 64 nt, hsa; identical to SEQ ID NO: 34123

SEQ ID NO: 405714 - RNA, 64 nt, hsa; identical to SEQ ID NO: 34124

SEQ ID NO: 405715 - RNA, 64 nt, hsa; identical to SEQ ID NO: 34125

SEQ ID NO: 405716 - RNA, 64 nt, hsa; identical to SEQ ID NO: 34126

SEQ ID NO: 405717 - RNA, 64 nt, hsa; identical to SEQ ID NO: 34127

SEQ ID NO: 405718 - RNA, 64 nt, hsa; identical to SEQ ID NO: 34128

SEQ ID NO: 405719 - RNA, 64 nt, hsa; identical to SEQ ID NO: 34129

SEQ ID NO: 405720 - RNA, 64 nt, hsa; identical to SEQ ID NO: 34130

SEQ ID NO: 405721 - RNA, 64 nt, hsa; identical to SEQ ID NO: 34131

SEQ ID NO: 405722 - RNA, 64 nt, hsa; identical to SEQ ID NO: 34132

SEQ ID NO: 405723 - RNA, 64 nt, hsa; identical to SEQ ID NO: 34133

SEQ ID NO: 405724 - RNA, 64 nt, hsa; identical to SEQ ID NO: 34134

SEQ ID NO: 405725 - RNA, 64 nt, hsa; identical to SEQ ID NO: 34135

SEQ ID NO: 405726 - RNA, 64 nt, hsa; identical to SEQ ID NO: 34136

SEQ ID NO: 405727 - RNA, 64 nt, hsa; identical to SEQ ID NO: 34137

SEQ ID NO: 405728 - RNA, 64 nt, hsa; identical to SEQ ID NO: 34138

SEQ ID NO: 405729 - RNA, 64 nt, hsa; identical to SEQ ID NO: 34139

SEQ ID NO: 405730 - RNA, 64 nt, hsa; identical to SEQ ID NO: 34140

SEQ ID NO: 405731 - RNA, 64 nt, hsa; identical to SEQ ID NO: 34141

SEQ ID NO: 405732 - RNA, 64 nt, hsa; identical to SEQ ID NO: 34142

SEQ ID NO: 405733 - RNA, 64 nt, hsa; identical to SEQ ID NO: 34143

SEQ ID NO: 405734 - RNA, 64 nt, hsa; identical to SEQ ID NO: 34144

SEQ ID NO: 405735 - RNA, 64 nt, hsa; identical to SEQ ID NO: 34145

SEQ ID NO: 405736 - RNA, 64 nt, hsa; identical to SEQ ID NO: 34146

SEQ ID NO: 405737 - RNA, 64 nt, hsa; identical to SEQ ID NO: 34147

SEQ ID NO: 405738 - RNA, 64 nt, hsa; identical to SEQ ID NO: 34148

SEQ ID NO: 405739 - RNA, 64 nt, hsa; identical to SEQ ID NO: 34149

SEQ ID NO: 405740 - RNA, 64 nt, hsa; identical to SEQ ID NO: 34150

SEQ ID NO: 405741 - RNA, 64 nt, hsa; identical to SEQ ID NO: 34151

SEQ ID NO: 405742 - RNA, 64 nt, hsa; identical to SEQ ID NO: 34152

SEQ ID NO: 405743 - RNA, 64 nt, hsa; identical to SEQ ID NO: 34153

SEQ ID NO: 405744 - RNA, 64 nt, hsa; identical to SEQ ID NO: 34154

SEQ ID NO: 405745 - RNA, 64 nt, hsa; identical to SEQ ID NO: 34155

SEQ ID NO: 405746 - RNA, 64 nt, hsa; identical to SEQ ID NO: 34156

SEQ ID NO: 405747 - RNA, 64 nt, hsa; identical to SEQ ID NO: 34157

SEQ ID NO: 405748 - RNA, 64 nt, hsa; identical to SEQ ID NO: 34158

SEQ ID NO: 405749 - RNA, 64 nt, hsa; identical to SEQ ID NO: 34159

SEQ ID NO: 405750 - RNA, 64 nt, hsa; identical to SEQ ID NO: 34160

SEQ ID NO: 405751 - RNA, 64 nt, hsa; identical to SEQ ID NO: 34161

SEQ ID NO: 405752 - RNA, 64 nt, hsa; identical to SEQ ID NO: 34162

SEQ ID NO: 405753 - RNA, 64 nt, hsa; identical to SEQ ID NO: 34163

SEQ ID NO: 405754 - RNA, 64 nt, hsa; identical to SEQ ID NO: 34164

SEQ ID NO: 405755 - RNA, 64 nt, hsa; identical to SEQ ID NO: 34165

SEQ ID NO: 405756 - RNA, 64 nt, hsa; identical to SEQ ID NO: 34166

SEQ ID NO: 405757 - RNA, 64 nt, hsa; identical to SEQ ID NO: 34167

SEQ ID NO: 405758 - RNA, 64 nt, hsa; identical to SEQ ID NO: 34168

SEQ ID NO: 405759 - RNA, 64 nt, hsa; identical to SEQ ID NO: 34169

SEQ ID NO: 405760 - RNA, 64 nt, hsa; identical to SEQ ID NO: 34170

SEQ ID NO: 405761 - RNA, 64 nt, hsa; identical to SEQ ID NO: 34171

SEQ ID NO: 405762 - RNA, 64 nt, hsa; identical to SEQ ID NO: 34172

SEQ ID NO: 405763 - RNA, 64 nt, hsa; identical to SEQ ID NO: 34173

SEQ ID NO: 405764 - RNA, 64 nt, hsa; identical to SEQ ID NO: 34174

SEQ ID NO: 405765 - RNA, 64 nt, hsa; identical to SEQ ID NO: 34175

SEQ ID NO: 405766 - RNA, 64 nt, hsa; identical to SEQ ID NO: 34176

SEQ ID NO: 405767 - RNA, 64 nt, hsa; identical to SEQ ID NO: 34177

SEQ ID NO: 405768 - RNA, 64 nt, hsa; identical to SEQ ID NO: 34178

SEQ ID NO: 405769 - RNA, 64 nt, hsa; identical to SEQ ID NO: 34179

SEQ ID NO: 405770 - RNA, 64 nt, hsa; identical to SEQ ID NO: 34180

SEQ ID NO: 405771 - RNA, 64 nt, hsa; identical to SEQ ID NO: 34181

SEQ ID NO: 405772 - RNA, 64 nt, hsa; identical to SEQ ID NO: 34182

SEQ ID NO: 405773 - RNA, 64 nt, hsa; identical to SEQ ID NO: 34183

SEQ ID NO: 405774 - RNA, 64 nt, hsa; identical to SEQ ID NO: 34184

SEQ ID NO: 405775 - RNA, 64 nt, hsa; identical to SEQ ID NO: 34185

SEQ ID NO: 405776 - RNA, 64 nt, hsa; identical to SEQ ID NO: 34186

SEQ ID NO: 405777 - RNA, 64 nt, hsa; identical to SEQ ID NO: 34187

SEQ ID NO: 405778 - RNA, 64 nt, hsa; identical to SEQ ID NO: 34188

SEQ ID NO: 405779 - RNA, 63 nt, hsa; identical to SEQ ID NO: 34189

SEQ ID NO: 405780 - RNA, 64 nt, hsa; identical to SEQ ID NO: 34190

SEQ ID NO: 405781 - RNA, 64 nt, hsa; identical to SEQ ID NO: 34191

SEQ ID NO: 405782 - RNA, 64 nt, hsa; identical to SEQ ID NO: 34192

SEQ ID NO: 405783 - RNA, 64 nt, hsa; identical to SEQ ID NO: 34193

SEQ ID NO: 405784 - RNA, 64 nt, hsa; identical to SEQ ID NO: 34194

SEQ ID NO: 405785 - RNA, 64 nt, hsa; identical to SEQ ID NO: 34195

SEQ ID NO: 405786 - RNA, 64 nt, hsa; identical to SEQ ID NO: 34196

SEQ ID NO: 405787 - RNA, 64 nt, hsa; identical to SEQ ID NO: 34197

SEQ ID NO: 405788 - RNA, 64 nt, hsa; identical to SEQ ID NO: 34198

SEQ ID NO: 405789 - RNA, 64 nt, hsa; identical to SEQ ID NO: 34199

SEQ ID NO: 405790 - RNA, 64 nt, hsa; identical to SEQ ID NO: 34200

SEQ ID NO: 405791 - RNA, 64 nt, hsa; identical to SEQ ID NO: 34201

SEQ ID NO: 405792 - RNA, 64 nt, hsa; identical to SEQ ID NO: 34202

SEQ ID NO: 405793 - RNA, 64 nt, hsa; identical to SEQ ID NO: 34203

SEQ ID NO: 405794 - RNA, 64 nt, hsa; identical to SEQ ID NO: 34204

SEQ ID NO: 405795 - RNA, 64 nt, hsa; identical to SEQ ID NO: 34205

SEQ ID NO: 405796 - RNA, 64 nt, hsa; identical to SEQ ID NO: 34206

SEQ ID NO: 405797 - RNA, 64 nt, hsa; identical to SEQ ID NO: 34207

SEQ ID NO: 405798 - RNA, 64 nt, hsa; identical to SEQ ID NO: 34208

SEQ ID NO: 405799 - RNA, 64 nt, hsa; identical to SEQ ID NO: 34209

SEQ ID NO: 405800 - RNA, 64 nt, hsa; identical to SEQ ID NO: 34210

SEQ ID NO: 405801 - RNA, 64 nt, hsa; identical to SEQ ID NO: 34211

SEQ ID NO: 405802 - RNA, 64 nt, hsa; identical to SEQ ID NO: 34212

SEQ ID NO: 405803 - RNA, 64 nt, hsa; identical to SEQ ID NO: 34213

SEQ ID NO: 405804 - RNA, 64 nt, hsa; identical to SEQ ID NO: 34214

SEQ ID NO: 405805 - RNA, 64 nt, hsa; identical to SEQ ID NO: 34215

SEQ ID NO: 405806 - RNA, 64 nt, hsa; identical to SEQ ID NO: 34216

SEQ ID NO: 405807 - RNA, 64 nt, hsa; identical to SEQ ID NO: 34217

SEQ ID NO: 405808 - RNA, 64 nt, hsa; identical to SEQ ID NO: 34218

SEQ ID NO: 405809 - RNA, 64 nt, hsa; identical to SEQ ID NO: 34219

SEQ ID NO: 405810 - RNA, 64 nt, hsa; identical to SEQ ID NO: 34220

SEQ ID NO: 405811 - RNA, 64 nt, hsa; identical to SEQ ID NO: 34221

SEQ ID NO: 405812 - RNA, 64 nt, hsa; identical to SEQ ID NO: 34222

SEQ ID NO: 405813 - RNA, 64 nt, hsa; identical to SEQ ID NO: 34223

SEQ ID NO: 405814 - RNA, 64 nt, hsa; identical to SEQ ID NO: 34224

SEQ ID NO: 405815 - RNA, 64 nt, hsa; identical to SEQ ID NO: 34225

SEQ ID NO: 405816 - RNA, 64 nt, hsa; identical to SEQ ID NO: 34226

SEQ ID NO: 405817 - RNA, 64 nt, hsa; identical to SEQ ID NO: 34227

SEQ ID NO: 405818 - RNA, 64 nt, hsa; identical to SEQ ID NO: 34228

SEQ ID NO: 405819 - RNA, 64 nt, hsa; identical to SEQ ID NO: 34229

SEQ ID NO: 405820 - RNA, 64 nt, hsa; identical to SEQ ID NO: 34230

SEQ ID NO: 405821 - RNA, 64 nt, hsa; identical to SEQ ID NO: 34231

SEQ ID NO: 405822 - RNA, 64 nt, hsa; identical to SEQ ID NO: 34232

SEQ ID NO: 405823 - RNA, 64 nt, hsa; identical to SEQ ID NO: 34233

SEQ ID NO: 405824 - RNA, 64 nt, hsa; identical to SEQ ID NO: 34234

SEQ ID NO: 405825 - RNA, 64 nt, hsa; identical to SEQ ID NO: 34235

SEQ ID NO: 405826 - RNA, 64 nt, hsa; identical to SEQ ID NO: 34236

SEQ ID NO: 405827 - RNA, 64 nt, hsa; identical to SEQ ID NO: 34237

SEQ ID NO: 405828 - RNA, 64 nt, hsa; identical to SEQ ID NO: 34238

SEQ ID NO: 405829 - RNA, 64 nt, hsa; identical to SEQ ID NO: 34239

SEQ ID NO: 405830 - RNA, 64 nt, hsa; identical to SEQ ID NO: 34240

SEQ ID NO: 405831 - RNA, 64 nt, hsa; identical to SEQ ID NO: 34241

SEQ ID NO: 405832 - RNA, 64 nt, hsa; identical to SEQ ID NO: 34242

SEQ ID NO: 405833 - RNA, 64 nt, hsa; identical to SEQ ID NO: 34243

SEQ ID NO: 405834 - RNA, 64 nt, hsa; identical to SEQ ID NO: 34244

SEQ ID NO: 405835 - RNA, 64 nt, hsa; identical to SEQ ID NO: 34245

SEQ ID NO: 405836 - RNA, 64 nt, hsa; identical to SEQ ID NO: 34246

SEQ ID NO: 405837 - RNA, 64 nt, hsa; identical to SEQ ID NO: 34247

SEQ ID NO: 405838 - RNA, 64 nt, hsa; identical to SEQ ID NO: 34248

SEQ ID NO: 405839 - RNA, 64 nt, hsa; identical to SEQ ID NO: 34249

SEQ ID NO: 405840 - RNA, 64 nt, hsa; identical to SEQ ID NO: 34250

SEQ ID NO: 405841 - RNA, 64 nt, hsa; identical to SEQ ID NO: 34251

SEQ ID NO: 405842 - RNA, 64 nt, hsa; identical to SEQ ID NO: 34252

SEQ ID NO: 405843 - RNA, 64 nt, hsa; identical to SEQ ID NO: 34253

SEQ ID NO: 405844 - RNA, 64 nt, hsa; identical to SEQ ID NO: 34254

SEQ ID NO: 405845 - RNA, 64 nt, hsa; identical to SEQ ID NO: 34255

SEQ ID NO: 405846 - RNA, 64 nt, hsa; identical to SEQ ID NO: 34256

SEQ ID NO: 405847 - RNA, 64 nt, hsa; identical to SEQ ID NO: 34257

SEQ ID NO: 405848 - RNA, 63 nt, hsa; identical to SEQ ID NO: 34258

SEQ ID NO: 405849 - RNA, 64 nt, hsa; identical to SEQ ID NO: 34259

SEQ ID NO: 405850 - RNA, 64 nt, hsa; identical to SEQ ID NO: 34260

SEQ ID NO: 405851 - RNA, 64 nt, hsa; identical to SEQ ID NO: 34261

SEQ ID NO: 405852 - RNA, 64 nt, hsa; identical to SEQ ID NO: 34262

SEQ ID NO: 405853 - RNA, 64 nt, hsa; identical to SEQ ID NO: 34263

SEQ ID NO: 405854 - RNA, 64 nt, hsa; identical to SEQ ID NO: 34264

SEQ ID NO: 405855 - RNA, 64 nt, hsa; identical to SEQ ID NO: 34265

SEQ ID NO: 405856 - RNA, 64 nt, hsa; identical to SEQ ID NO: 34266

SEQ ID NO: 405857 - RNA, 64 nt, hsa; identical to SEQ ID NO: 34267

SEQ ID NO: 405858 - RNA, 64 nt, hsa; identical to SEQ ID NO: 34268

SEQ ID NO: 405859 - RNA, 64 nt, hsa; identical to SEQ ID NO: 34269

SEQ ID NO: 405860 - RNA, 64 nt, hsa; identical to SEQ ID NO: 34270

SEQ ID NO: 405861 - RNA, 64 nt, hsa; identical to SEQ ID NO: 34271

SEQ ID NO: 405862 - RNA, 64 nt, hsa; identical to SEQ ID NO: 34272

SEQ ID NO: 405863 - RNA, 64 nt, hsa; identical to SEQ ID NO: 34273

SEQ ID NO: 405864 - RNA, 64 nt, hsa; identical to SEQ ID NO: 34274

SEQ ID NO: 405865 - RNA, 64 nt, hsa; identical to SEQ ID NO: 34275

SEQ ID NO: 405866 - RNA, 64 nt, hsa; identical to SEQ ID NO: 34276

SEQ ID NO: 405867 - RNA, 64 nt, hsa; identical to SEQ ID NO: 34277

SEQ ID NO: 405868 - RNA, 64 nt, hsa; identical to SEQ ID NO: 34278

SEQ ID NO: 405869 - RNA, 64 nt, hsa; identical to SEQ ID NO: 34279

SEQ ID NO: 405870 - RNA, 64 nt, hsa; identical to SEQ ID NO: 34280

SEQ ID NO: 405871 - RNA, 64 nt, hsa; identical to SEQ ID NO: 34281

SEQ ID NO: 405872 - RNA, 64 nt, hsa; identical to SEQ ID NO: 34282

SEQ ID NO: 405873 - RNA, 64 nt, hsa; identical to SEQ ID NO: 34283

SEQ ID NO: 405874 - RNA, 64 nt, hsa; identical to SEQ ID NO: 34284

SEQ ID NO: 405875 - RNA, 64 nt, hsa; identical to SEQ ID NO: 34285

SEQ ID NO: 405876 - RNA, 64 nt, hsa; identical to SEQ ID NO: 34286

SEQ ID NO: 405877 - RNA, 64 nt, hsa; identical to SEQ ID NO: 34287

SEQ ID NO: 405878 - RNA, 64 nt, hsa; identical to SEQ ID NO: 34288

SEQ ID NO: 405879 - RNA, 64 nt, hsa; identical to SEQ ID NO: 34289

SEQ ID NO: 405880 - RNA, 64 nt, hsa; identical to SEQ ID NO: 34290

SEQ ID NO: 405881 - RNA, 64 nt, hsa; identical to SEQ ID NO: 34291

SEQ ID NO: 405882 - RNA, 64 nt, hsa; identical to SEQ ID NO: 34292

SEQ ID NO: 405883 - RNA, 64 nt, hsa; identical to SEQ ID NO: 34293

SEQ ID NO: 405884 - RNA, 64 nt, hsa; identical to SEQ ID NO: 34294

SEQ ID NO: 405885 - RNA, 64 nt, hsa; identical to SEQ ID NO: 34295

SEQ ID NO: 405886 - RNA, 64 nt, hsa; identical to SEQ ID NO: 34296

SEQ ID NO: 405887 - RNA, 64 nt, hsa; identical to SEQ ID NO: 34297

SEQ ID NO: 405888 - RNA, 64 nt, hsa; identical to SEQ ID NO: 34298

SEQ ID NO: 405889 - RNA, 64 nt, hsa; identical to SEQ ID NO: 34299

SEQ ID NO: 405890 - RNA, 64 nt, hsa; identical to SEQ ID NO: 34300

SEQ ID NO: 405891 - RNA, 64 nt, hsa; identical to SEQ ID NO: 34301

SEQ ID NO: 405892 - RNA, 64 nt, hsa; identical to SEQ ID NO: 34302

SEQ ID NO: 405893 - RNA, 64 nt, hsa; identical to SEQ ID NO: 34303

SEQ ID NO: 405894 - RNA, 64 nt, hsa; identical to SEQ ID NO: 34304

SEQ ID NO: 405895 - RNA, 64 nt, hsa; identical to SEQ ID NO: 34305

SEQ ID NO: 405896 - RNA, 64 nt, hsa; identical to SEQ ID NO: 34306

SEQ ID NO: 405897 - RNA, 64 nt, hsa; identical to SEQ ID NO: 34307

SEQ ID NO: 405898 - RNA, 64 nt, hsa; identical to SEQ ID NO: 34308

SEQ ID NO: 405899 - RNA, 64 nt, hsa; identical to SEQ ID NO: 34309

SEQ ID NO: 405900 - RNA, 64 nt, hsa; identical to SEQ ID NO: 34310

SEQ ID NO: 405901 - RNA, 64 nt, hsa; identical to SEQ ID NO: 34311

SEQ ID NO: 405902 - RNA, 64 nt, hsa; identical to SEQ ID NO: 34312

SEQ ID NO: 405903 - RNA, 64 nt, hsa; identical to SEQ ID NO: 34313

SEQ ID NO: 405904 - RNA, 64 nt, hsa; identical to SEQ ID NO: 34314

SEQ ID NO: 405905 - RNA, 64 nt, hsa; identical to SEQ ID NO: 34315

SEQ ID NO: 405906 - RNA, 64 nt, hsa; identical to SEQ ID NO: 34316

SEQ ID NO: 405907 - RNA, 64 nt, hsa; identical to SEQ ID NO: 34317

SEQ ID NO: 405908 - RNA, 64 nt, hsa; identical to SEQ ID NO: 34318

SEQ ID NO: 405909 - RNA, 64 nt, hsa; identical to SEQ ID NO: 34319

SEQ ID NO: 405910 - RNA, 64 nt, hsa; identical to SEQ ID NO: 34320

SEQ ID NO: 405911 - RNA, 64 nt, hsa; identical to SEQ ID NO: 34321

SEQ ID NO: 405912 - RNA, 64 nt, hsa; identical to SEQ ID NO: 34322

SEQ ID NO: 405913 - RNA, 64 nt, hsa; identical to SEQ ID NO: 34323

SEQ ID NO: 405914 - RNA, 64 nt, hsa; identical to SEQ ID NO: 34324

SEQ ID NO: 405915 - RNA, 64 nt, hsa; identical to SEQ ID NO: 34325

SEQ ID NO: 405916 - RNA, 64 nt, hsa; identical to SEQ ID NO: 34326

SEQ ID NO: 405917 - RNA, 64 nt, hsa; identical to SEQ ID NO: 34327

SEQ ID NO: 405918 - RNA, 64 nt, hsa; identical to SEQ ID NO: 34328

SEQ ID NO: 405919 - RNA, 64 nt, hsa; identical to SEQ ID NO: 34329

SEQ ID NO: 405920 - RNA, 64 nt, hsa; identical to SEQ ID NO: 34330

SEQ ID NO: 405921 - RNA, 64 nt, hsa; identical to SEQ ID NO: 34331

SEQ ID NO: 405922 - RNA, 64 nt, hsa; identical to SEQ ID NO: 34332

SEQ ID NO: 405923 - RNA, 64 nt, hsa; identical to SEQ ID NO: 34333

SEQ ID NO: 405924 - RNA, 64 nt, hsa; identical to SEQ ID NO: 34334

SEQ ID NO: 405925 - RNA, 64 nt, hsa; identical to SEQ ID NO: 34335

SEQ ID NO: 405926 - RNA, 64 nt, hsa; identical to SEQ ID NO: 34336

SEQ ID NO: 405927 - RNA, 64 nt, hsa; identical to SEQ ID NO: 34337

SEQ ID NO: 405928 - RNA, 64 nt, hsa; identical to SEQ ID NO: 34338

SEQ ID NO: 405929 - RNA, 64 nt, hsa; identical to SEQ ID NO: 34339

SEQ ID NO: 405930 - RNA, 64 nt, hsa; identical to SEQ ID NO: 34340

SEQ ID NO: 405931 - RNA, 64 nt, hsa; identical to SEQ ID NO: 34341

SEQ ID NO: 405932 - RNA, 64 nt, hsa; identical to SEQ ID NO: 34342

SEQ ID NO: 405933 - RNA, 64 nt, hsa; identical to SEQ ID NO: 34343

SEQ ID NO: 405934 - RNA, 64 nt, hsa; identical to SEQ ID NO: 34344

SEQ ID NO: 405935 - RNA, 64 nt, hsa; identical to SEQ ID NO: 34345

SEQ ID NO: 405936 - RNA, 64 nt, hsa; identical to SEQ ID NO: 34346

SEQ ID NO: 405937 - RNA, 64 nt, hsa; identical to SEQ ID NO: 34347

SEQ ID NO: 405938 - RNA, 64 nt, hsa; identical to SEQ ID NO: 34348

SEQ ID NO: 405939 - RNA, 64 nt, hsa; identical to SEQ ID NO: 34349

SEQ ID NO: 405940 - RNA, 64 nt, hsa; identical to SEQ ID NO: 34350

SEQ ID NO: 405941 - RNA, 64 nt, hsa; identical to SEQ ID NO: 34351

SEQ ID NO: 405942 - RNA, 64 nt, hsa; identical to SEQ ID NO: 34352

SEQ ID NO: 405943 - RNA, 64 nt, hsa; identical to SEQ ID NO: 34353

SEQ ID NO: 405944 - RNA, 64 nt, hsa; identical to SEQ ID NO: 34354

SEQ ID NO: 405945 - RNA, 64 nt, hsa; identical to SEQ ID NO: 34355

SEQ ID NO: 405946 - RNA, 64 nt, hsa; identical to SEQ ID NO: 34356

SEQ ID NO: 405947 - RNA, 64 nt, hsa; identical to SEQ ID NO: 34357

SEQ ID NO: 405948 - RNA, 64 nt, hsa; identical to SEQ ID NO: 34358

SEQ ID NO: 405949 - RNA, 64 nt, hsa; identical to SEQ ID NO: 34359

SEQ ID NO: 405950 - RNA, 64 nt, hsa; identical to SEQ ID NO: 34360

SEQ ID NO: 405951 - RNA, 64 nt, hsa; identical to SEQ ID NO: 34361

SEQ ID NO: 405952 - RNA, 64 nt, hsa; identical to SEQ ID NO: 34362

SEQ ID NO: 405953 - RNA, 64 nt, hsa; identical to SEQ ID NO: 34363

SEQ ID NO: 405954 - RNA, 64 nt, hsa; identical to SEQ ID NO: 34364

SEQ ID NO: 405955 - RNA, 64 nt, hsa; identical to SEQ ID NO: 34365

SEQ ID NO: 405956 - RNA, 64 nt, hsa; identical to SEQ ID NO: 34366

SEQ ID NO: 405957 - RNA, 64 nt, hsa; identical to SEQ ID NO: 34367

SEQ ID NO: 405958 - RNA, 64 nt, hsa; identical to SEQ ID NO: 34368

SEQ ID NO: 405959 - RNA, 64 nt, hsa; identical to SEQ ID NO: 34369

SEQ ID NO: 405960 - RNA, 64 nt, hsa; identical to SEQ ID NO: 34370

SEQ ID NO: 405961 - RNA, 64 nt, hsa; identical to SEQ ID NO: 34371

SEQ ID NO: 405962 - RNA, 64 nt, hsa; identical to SEQ ID NO: 34372

SEQ ID NO: 405963 - RNA, 64 nt, hsa; identical to SEQ ID NO: 34373

SEQ ID NO: 405964 - RNA, 64 nt, hsa; identical to SEQ ID NO: 34374

SEQ ID NO: 405965 - RNA, 64 nt, hsa; identical to SEQ ID NO: 34375

SEQ ID NO: 405966 - RNA, 64 nt, hsa; identical to SEQ ID NO: 34376

SEQ ID NO: 405967 - RNA, 64 nt, hsa; identical to SEQ ID NO: 34377

SEQ ID NO: 405968 - RNA, 64 nt, hsa; identical to SEQ ID NO: 34378

SEQ ID NO: 405969 - RNA, 64 nt, hsa; identical to SEQ ID NO: 34379

SEQ ID NO: 405970 - RNA, 64 nt, hsa; identical to SEQ ID NO: 34380

SEQ ID NO: 405971 - RNA, 64 nt, hsa; identical to SEQ ID NO: 34381

SEQ ID NO: 405972 - RNA, 64 nt, hsa; identical to SEQ ID NO: 34382

SEQ ID NO: 405973 - RNA, 64 nt, hsa; identical to SEQ ID NO: 34383

SEQ ID NO: 405974 - RNA, 64 nt, hsa; identical to SEQ ID NO: 34384

SEQ ID NO: 405975 - RNA, 64 nt, hsa; identical to SEQ ID NO: 34385

SEQ ID NO: 405976 - RNA, 64 nt, hsa; identical to SEQ ID NO: 34386

SEQ ID NO: 405977 - RNA, 64 nt, hsa; identical to SEQ ID NO: 34387

SEQ ID NO: 405978 - RNA, 64 nt, hsa; identical to SEQ ID NO: 34388

SEQ ID NO: 405979 - RNA, 64 nt, hsa; identical to SEQ ID NO: 34389

SEQ ID NO: 405980 - RNA, 64 nt, hsa; identical to SEQ ID NO: 34390

SEQ ID NO: 405981 - RNA, 64 nt, hsa; identical to SEQ ID NO: 34391

SEQ ID NO: 405982 - RNA, 64 nt, hsa; identical to SEQ ID NO: 34392

SEQ ID NO: 405983 - RNA, 64 nt, hsa; identical to SEQ ID NO: 34393

SEQ ID NO: 405984 - RNA, 64 nt, hsa; identical to SEQ ID NO: 34394

SEQ ID NO: 405985 - RNA, 64 nt, hsa; identical to SEQ ID NO: 34395

SEQ ID NO: 405986 - RNA, 64 nt, hsa; identical to SEQ ID NO: 34396

SEQ ID NO: 405987 - RNA, 64 nt, hsa; identical to SEQ ID NO: 34397

SEQ ID NO: 405988 - RNA, 64 nt, hsa; identical to SEQ ID NO: 34398

SEQ ID NO: 405989 - RNA, 64 nt, hsa; identical to SEQ ID NO: 34399

SEQ ID NO: 405990 - RNA, 64 nt, hsa; identical to SEQ ID NO: 34400

SEQ ID NO: 405991 - RNA, 64 nt, hsa; identical to SEQ ID NO: 34401

SEQ ID NO: 405992 - RNA, 64 nt, hsa; identical to SEQ ID NO: 34402

SEQ ID NO: 405993 - RNA, 64 nt, hsa; identical to SEQ ID NO: 34403

SEQ ID NO: 405994 - RNA, 64 nt, hsa; identical to SEQ ID NO: 34404

SEQ ID NO: 405995 - RNA, 64 nt, hsa; identical to SEQ ID NO: 34405

SEQ ID NO: 405996 - RNA, 64 nt, hsa; identical to SEQ ID NO: 34406

SEQ ID NO: 405997 - RNA, 64 nt, hsa; identical to SEQ ID NO: 34407

SEQ ID NO: 405998 - RNA, 64 nt, hsa; identical to SEQ ID NO: 34408

SEQ ID NO: 405999 - RNA, 64 nt, hsa; identical to SEQ ID NO: 34409

SEQ ID NO: 406000 - RNA, 64 nt, hsa; identical to SEQ ID NO: 34410

SEQ ID NO: 406001 - RNA, 64 nt, hsa; identical to SEQ ID NO: 34411

SEQ ID NO: 406002 - RNA, 64 nt, hsa; identical to SEQ ID NO: 34412

SEQ ID NO: 406003 - RNA, 64 nt, hsa; identical to SEQ ID NO: 34413

SEQ ID NO: 406004 - RNA, 64 nt, hsa; identical to SEQ ID NO: 34414

SEQ ID NO: 406005 - RNA, 64 nt, hsa; identical to SEQ ID NO: 34415

SEQ ID NO: 406006 - RNA, 64 nt, hsa; identical to SEQ ID NO: 34416

SEQ ID NO: 406007 - RNA, 64 nt, hsa; identical to SEQ ID NO: 34417

SEQ ID NO: 406008 - RNA, 64 nt, hsa; identical to SEQ ID NO: 34418

SEQ ID NO: 406009 - RNA, 64 nt, hsa; identical to SEQ ID NO: 34419

SEQ ID NO: 406010 - RNA, 64 nt, hsa; identical to SEQ ID NO: 34420

SEQ ID NO: 406011 - RNA, 64 nt, hsa; identical to SEQ ID NO: 34421

SEQ ID NO: 406012 - RNA, 64 nt, hsa; identical to SEQ ID NO: 34422

SEQ ID NO: 406013 - RNA, 64 nt, hsa; identical to SEQ ID NO: 34423

SEQ ID NO: 406014 - RNA, 64 nt, hsa; identical to SEQ ID NO: 34424

SEQ ID NO: 406015 - RNA, 64 nt, hsa; identical to SEQ ID NO: 34425

SEQ ID NO: 406016 - RNA, 64 nt, hsa; identical to SEQ ID NO: 34426

SEQ ID NO: 406017 - RNA, 64 nt, hsa; identical to SEQ ID NO: 34427

SEQ ID NO: 406018 - RNA, 64 nt, hsa; identical to SEQ ID NO: 34428

SEQ ID NO: 406019 - RNA, 64 nt, hsa; identical to SEQ ID NO: 34429

SEQ ID NO: 406020 - RNA, 64 nt, hsa; identical to SEQ ID NO: 34430

SEQ ID NO: 406021 - RNA, 64 nt, hsa; identical to SEQ ID NO: 34431

SEQ ID NO: 406022 - RNA, 64 nt, hsa; identical to SEQ ID NO: 34432

SEQ ID NO: 406023 - RNA, 64 nt, hsa; identical to SEQ ID NO: 34433

SEQ ID NO: 406024 - RNA, 64 nt, hsa; identical to SEQ ID NO: 34434

SEQ ID NO: 406025 - RNA, 64 nt, hsa; identical to SEQ ID NO: 34435

SEQ ID NO: 406026 - RNA, 64 nt, hsa; identical to SEQ ID NO: 34436

SEQ ID NO: 406027 - RNA, 64 nt, hsa; identical to SEQ ID NO: 34437

SEQ ID NO: 406028 - RNA, 64 nt, hsa; identical to SEQ ID NO: 34438

SEQ ID NO: 406029 - RNA, 64 nt, hsa; identical to SEQ ID NO: 34439

SEQ ID NO: 406030 - RNA, 64 nt, hsa; identical to SEQ ID NO: 34440

SEQ ID NO: 406031 - RNA, 64 nt, hsa; identical to SEQ ID NO: 34441

SEQ ID NO: 406032 - RNA, 64 nt, hsa; identical to SEQ ID NO: 34442

SEQ ID NO: 406033 - RNA, 64 nt, hsa; identical to SEQ ID NO: 34443

SEQ ID NO: 406034 - RNA, 64 nt, hsa; identical to SEQ ID NO: 34444

SEQ ID NO: 406035 - RNA, 64 nt, hsa; identical to SEQ ID NO: 34445

SEQ ID NO: 406036 - RNA, 64 nt, hsa; identical to SEQ ID NO: 34446

SEQ ID NO: 406037 - RNA, 64 nt, hsa; identical to SEQ ID NO: 34447

SEQ ID NO: 406038 - RNA, 64 nt, hsa; identical to SEQ ID NO: 34448

SEQ ID NO: 406039 - RNA, 64 nt, hsa; identical to SEQ ID NO: 34449

SEQ ID NO: 406040 - RNA, 64 nt, hsa; identical to SEQ ID NO: 34450

SEQ ID NO: 406041 - RNA, 64 nt, hsa; identical to SEQ ID NO: 34451

SEQ ID NO: 406042 - RNA, 64 nt, hsa; identical to SEQ ID NO: 34452

SEQ ID NO: 406043 - RNA, 64 nt, hsa; identical to SEQ ID NO: 34453

SEQ ID NO: 406044 - RNA, 64 nt, hsa; identical to SEQ ID NO: 34454

SEQ ID NO: 406045 - RNA, 64 nt, hsa; identical to SEQ ID NO: 34455

SEQ ID NO: 406046 - RNA, 64 nt, hsa; identical to SEQ ID NO: 34456

SEQ ID NO: 406047 - RNA, 64 nt, hsa; identical to SEQ ID NO: 34457

SEQ ID NO: 406048 - RNA, 64 nt, hsa; identical to SEQ ID NO: 34458

SEQ ID NO: 406049 - RNA, 64 nt, hsa; identical to SEQ ID NO: 34459

SEQ ID NO: 406050 - RNA, 64 nt, hsa; identical to SEQ ID NO: 34460

SEQ ID NO: 406051 - RNA, 56 nt, hsa; identical to SEQ ID NO: 34461

SEQ ID NO: 406052 - RNA, 64 nt, hsa; identical to SEQ ID NO: 34462

SEQ ID NO: 406053 - RNA, 64 nt, hsa; identical to SEQ ID NO: 34463

SEQ ID NO: 406054 - RNA, 64 nt, hsa; identical to SEQ ID NO: 34464

SEQ ID NO: 406055 - RNA, 64 nt, hsa; identical to SEQ ID NO: 34465

SEQ ID NO: 406056 - RNA, 64 nt, hsa; identical to SEQ ID NO: 34466

SEQ ID NO: 406057 - RNA, 64 nt, hsa; identical to SEQ ID NO: 34467

SEQ ID NO: 406058 - RNA, 64 nt, hsa; identical to SEQ ID NO: 34468

SEQ ID NO: 406059 - RNA, 64 nt, hsa; identical to SEQ ID NO: 34469

SEQ ID NO: 406060 - RNA, 64 nt, hsa; identical to SEQ ID NO: 34470

SEQ ID NO: 406061 - RNA, 64 nt, hsa; identical to SEQ ID NO: 34471

SEQ ID NO: 406062 - RNA, 64 nt, hsa; identical to SEQ ID NO: 34472

SEQ ID NO: 406063 - RNA, 64 nt, hsa; identical to SEQ ID NO: 34473

SEQ ID NO: 406064 - RNA, 64 nt, hsa; identical to SEQ ID NO: 34474

SEQ ID NO: 406065 - RNA, 64 nt, hsa; identical to SEQ ID NO: 34475

SEQ ID NO: 406066 - RNA, 64 nt, hsa; identical to SEQ ID NO: 34476

SEQ ID NO: 406067 - RNA, 64 nt, hsa; identical to SEQ ID NO: 34477

SEQ ID NO: 406068 - RNA, 64 nt, hsa; identical to SEQ ID NO: 34478

SEQ ID NO: 406069 - RNA, 64 nt, hsa; identical to SEQ ID NO: 34479

SEQ ID NO: 406070 - RNA, 64 nt, hsa; identical to SEQ ID NO: 34480

SEQ ID NO: 406071 - RNA, 64 nt, hsa; identical to SEQ ID NO: 34481

SEQ ID NO: 406072 - RNA, 64 nt, hsa; identical to SEQ ID NO: 34482

SEQ ID NO: 406073 - RNA, 64 nt, hsa; identical to SEQ ID NO: 34483

SEQ ID NO: 406074 - RNA, 64 nt, hsa; identical to SEQ ID NO: 34484

SEQ ID NO: 406075 - RNA, 64 nt, hsa; identical to SEQ ID NO: 34485

SEQ ID NO: 406076 - RNA, 64 nt, hsa; identical to SEQ ID NO: 34486

SEQ ID NO: 406077 - RNA, 64 nt, hsa; identical to SEQ ID NO: 34487

SEQ ID NO: 406078 - RNA, 64 nt, hsa; identical to SEQ ID NO: 34488

SEQ ID NO: 406079 - RNA, 64 nt, hsa; identical to SEQ ID NO: 34489

SEQ ID NO: 406080 - RNA, 64 nt, hsa; identical to SEQ ID NO: 34490

SEQ ID NO: 406081 - RNA, 64 nt, hsa; identical to SEQ ID NO: 34491

SEQ ID NO: 406082 - RNA, 64 nt, hsa; identical to SEQ ID NO: 34492

SEQ ID NO: 406083 - RNA, 64 nt, hsa; identical to SEQ ID NO: 34493

SEQ ID NO: 406084 - RNA, 64 nt, hsa; identical to SEQ ID NO: 34494

SEQ ID NO: 406085 - RNA, 64 nt, hsa; identical to SEQ ID NO: 34495

SEQ ID NO: 406086 - RNA, 64 nt, hsa; identical to SEQ ID NO: 34496

SEQ ID NO: 406087 - RNA, 64 nt, hsa; identical to SEQ ID NO: 34497

SEQ ID NO: 406088 - RNA, 64 nt, hsa; identical to SEQ ID NO: 34498

SEQ ID NO: 406089 - RNA, 64 nt, hsa; identical to SEQ ID NO: 34499

SEQ ID NO: 406090 - RNA, 64 nt, hsa; identical to SEQ ID NO: 34500

SEQ ID NO: 406091 - RNA, 64 nt, hsa; identical to SEQ ID NO: 34501

SEQ ID NO: 406092 - RNA, 64 nt, hsa; identical to SEQ ID NO: 34502

SEQ ID NO: 406093 - RNA, 64 nt, hsa; identical to SEQ ID NO: 34503

SEQ ID NO: 406094 - RNA, 64 nt, hsa; identical to SEQ ID NO: 34504

SEQ ID NO: 406095 - RNA, 64 nt, hsa; identical to SEQ ID NO: 34505

SEQ ID NO: 406096 - RNA, 64 nt, hsa; identical to SEQ ID NO: 34506

SEQ ID NO: 406097 - RNA, 64 nt, hsa; identical to SEQ ID NO: 34507

SEQ ID NO: 406098 - RNA, 64 nt, hsa; identical to SEQ ID NO: 34508

SEQ ID NO: 406099 - RNA, 64 nt, hsa; identical to SEQ ID NO: 34509

SEQ ID NO: 406100 - RNA, 64 nt, hsa; identical to SEQ ID NO: 34510

SEQ ID NO: 406101 - RNA, 64 nt, hsa; identical to SEQ ID NO: 34511

SEQ ID NO: 406102 - RNA, 64 nt, hsa; identical to SEQ ID NO: 34512

SEQ ID NO: 406103 - RNA, 64 nt, hsa; identical to SEQ ID NO: 34513

SEQ ID NO: 406104 - RNA, 64 nt, hsa; identical to SEQ ID NO: 34514

SEQ ID NO: 406105 - RNA, 64 nt, hsa; identical to SEQ ID NO: 34515

SEQ ID NO: 406106 - RNA, 64 nt, hsa; identical to SEQ ID NO: 34516

SEQ ID NO: 406107 - RNA, 64 nt, hsa; identical to SEQ ID NO: 34517

SEQ ID NO: 406108 - RNA, 64 nt, hsa; identical to SEQ ID NO: 34518

SEQ ID NO: 406109 - RNA, 64 nt, hsa; identical to SEQ ID NO: 34519

SEQ ID NO: 406110 - RNA, 64 nt, hsa; identical to SEQ ID NO: 34520

SEQ ID NO: 406111 - RNA, 64 nt, hsa; identical to SEQ ID NO: 34521

SEQ ID NO: 406112 - RNA, 64 nt, hsa; identical to SEQ ID NO: 34522

SEQ ID NO: 406113 - RNA, 64 nt, hsa; identical to SEQ ID NO: 34523

SEQ ID NO: 406114 - RNA, 64 nt, hsa; identical to SEQ ID NO: 34524

SEQ ID NO: 406115 - RNA, 64 nt, hsa; identical to SEQ ID NO: 34525

SEQ ID NO: 406116 - RNA, 64 nt, hsa; identical to SEQ ID NO: 34526

SEQ ID NO: 406117 - RNA, 64 nt, hsa; identical to SEQ ID NO: 34527

SEQ ID NO: 406118 - RNA, 64 nt, hsa; identical to SEQ ID NO: 34528

SEQ ID NO: 406119 - RNA, 64 nt, hsa; identical to SEQ ID NO: 34529

SEQ ID NO: 406120 - RNA, 64 nt, hsa; identical to SEQ ID NO: 34530

SEQ ID NO: 406121 - RNA, 64 nt, hsa; identical to SEQ ID NO: 34531

SEQ ID NO: 406122 - RNA, 64 nt, hsa; identical to SEQ ID NO: 34532

SEQ ID NO: 406123 - RNA, 64 nt, hsa; identical to SEQ ID NO: 34533

SEQ ID NO: 406124 - RNA, 64 nt, hsa; identical to SEQ ID NO: 34534

SEQ ID NO: 406125 - RNA, 64 nt, hsa; identical to SEQ ID NO: 34535

SEQ ID NO: 406126 - RNA, 64 nt, hsa; identical to SEQ ID NO: 34536

SEQ ID NO: 406127 - RNA, 64 nt, hsa; identical to SEQ ID NO: 34537

SEQ ID NO: 406128 - RNA, 64 nt, hsa; identical to SEQ ID NO: 34538

SEQ ID NO: 406129 - RNA, 64 nt, hsa; identical to SEQ ID NO: 34539

SEQ ID NO: 406130 - RNA, 64 nt, hsa; identical to SEQ ID NO: 34540

SEQ ID NO: 406131 - RNA, 64 nt, hsa; identical to SEQ ID NO: 34541

SEQ ID NO: 406132 - RNA, 64 nt, hsa; identical to SEQ ID NO: 34542

SEQ ID NO: 406133 - RNA, 64 nt, hsa; identical to SEQ ID NO: 34543

SEQ ID NO: 406134 - RNA, 64 nt, hsa; identical to SEQ ID NO: 34544

SEQ ID NO: 406135 - RNA, 64 nt, hsa; identical to SEQ ID NO: 34545

SEQ ID NO: 406136 - RNA, 64 nt, hsa; identical to SEQ ID NO: 34546

SEQ ID NO: 406137 - RNA, 64 nt, hsa; identical to SEQ ID NO: 34547

SEQ ID NO: 406138 - RNA, 64 nt, hsa; identical to SEQ ID NO: 34548

SEQ ID NO: 406139 - RNA, 64 nt, hsa; identical to SEQ ID NO: 34549

SEQ ID NO: 406140 - RNA, 64 nt, hsa; identical to SEQ ID NO: 34550

SEQ ID NO: 406141 - RNA, 64 nt, hsa; identical to SEQ ID NO: 34551

SEQ ID NO: 406142 - RNA, 64 nt, hsa; identical to SEQ ID NO: 34552

SEQ ID NO: 406143 - RNA, 64 nt, hsa; identical to SEQ ID NO: 34553

SEQ ID NO: 406144 - RNA, 64 nt, hsa; identical to SEQ ID NO: 34554

SEQ ID NO: 406145 - RNA, 64 nt, hsa; identical to SEQ ID NO: 34555

SEQ ID NO: 406146 - RNA, 64 nt, hsa; identical to SEQ ID NO: 34556

SEQ ID NO: 406147 - RNA, 64 nt, hsa; identical to SEQ ID NO: 34557

SEQ ID NO: 406148 - RNA, 64 nt, hsa; identical to SEQ ID NO: 34558

SEQ ID NO: 406149 - RNA, 64 nt, hsa; identical to SEQ ID NO: 34559

SEQ ID NO: 406150 - RNA, 64 nt, hsa; identical to SEQ ID NO: 34560

SEQ ID NO: 406151 - RNA, 64 nt, hsa; identical to SEQ ID NO: 34561

SEQ ID NO: 406152 - RNA, 64 nt, hsa; identical to SEQ ID NO: 34562

SEQ ID NO: 406153 - RNA, 64 nt, hsa; identical to SEQ ID NO: 34563

SEQ ID NO: 406154 - RNA, 64 nt, hsa; identical to SEQ ID NO: 34564

SEQ ID NO: 406155 - RNA, 64 nt, hsa; identical to SEQ ID NO: 34565

SEQ ID NO: 406156 - RNA, 64 nt, hsa; identical to SEQ ID NO: 34566

SEQ ID NO: 406157 - RNA, 64 nt, hsa; identical to SEQ ID NO: 34567

SEQ ID NO: 406158 - RNA, 64 nt, hsa; identical to SEQ ID NO: 34568

SEQ ID NO: 406159 - RNA, 64 nt, hsa; identical to SEQ ID NO: 34569

SEQ ID NO: 406160 - RNA, 64 nt, hsa; identical to SEQ ID NO: 34570

SEQ ID NO: 406161 - RNA, 64 nt, hsa; identical to SEQ ID NO: 34571

SEQ ID NO: 406162 - RNA, 64 nt, hsa; identical to SEQ ID NO: 34572

SEQ ID NO: 406163 - RNA, 64 nt, hsa; identical to SEQ ID NO: 34573

SEQ ID NO: 406164 - RNA, 64 nt, hsa; identical to SEQ ID NO: 34574

SEQ ID NO: 406165 - RNA, 64 nt, hsa; identical to SEQ ID NO: 34575

SEQ ID NO: 406166 - RNA, 64 nt, hsa; identical to SEQ ID NO: 34576

SEQ ID NO: 406167 - RNA, 64 nt, hsa; identical to SEQ ID NO: 34577

SEQ ID NO: 406168 - RNA, 64 nt, hsa; identical to SEQ ID NO: 34578

SEQ ID NO: 406169 - RNA, 64 nt, hsa; identical to SEQ ID NO: 34579

SEQ ID NO: 406170 - RNA, 64 nt, hsa; identical to SEQ ID NO: 34580

SEQ ID NO: 406171 - RNA, 64 nt, hsa; identical to SEQ ID NO: 34581

SEQ ID NO: 406172 - RNA, 64 nt, hsa; identical to SEQ ID NO: 34582

SEQ ID NO: 406173 - RNA, 64 nt, hsa; identical to SEQ ID NO: 34583

SEQ ID NO: 406174 - RNA, 64 nt, hsa; identical to SEQ ID NO: 34584

SEQ ID NO: 406175 - RNA, 64 nt, hsa; identical to SEQ ID NO: 34585

SEQ ID NO: 406176 - RNA, 64 nt, hsa; identical to SEQ ID NO: 34586

SEQ ID NO: 406177 - RNA, 64 nt, hsa; identical to SEQ ID NO: 34587

SEQ ID NO: 406178 - RNA, 64 nt, hsa; identical to SEQ ID NO: 34588

SEQ ID NO: 406179 - RNA, 64 nt, hsa; identical to SEQ ID NO: 34589

SEQ ID NO: 406180 - RNA, 64 nt, hsa; identical to SEQ ID NO: 34590

SEQ ID NO: 406181 - RNA, 64 nt, hsa; identical to SEQ ID NO: 34591

SEQ ID NO: 406182 - RNA, 64 nt, hsa; identical to SEQ ID NO: 34592

SEQ ID NO: 406183 - RNA, 64 nt, hsa; identical to SEQ ID NO: 34593

SEQ ID NO: 406184 - RNA, 64 nt, hsa; identical to SEQ ID NO: 34594

SEQ ID NO: 406185 - RNA, 64 nt, hsa; identical to SEQ ID NO: 34595

SEQ ID NO: 406186 - RNA, 64 nt, hsa; identical to SEQ ID NO: 34596

SEQ ID NO: 406187 - RNA, 64 nt, hsa; identical to SEQ ID NO: 34597

SEQ ID NO: 406188 - RNA, 64 nt, hsa; identical to SEQ ID NO: 34598

SEQ ID NO: 406189 - RNA, 64 nt, hsa; identical to SEQ ID NO: 34599

SEQ ID NO: 406190 - RNA, 64 nt, hsa; identical to SEQ ID NO: 34600

SEQ ID NO: 406191 - RNA, 64 nt, hsa; identical to SEQ ID NO: 34601

SEQ ID NO: 406192 - RNA, 64 nt, hsa; identical to SEQ ID NO: 34602

SEQ ID NO: 406193 - RNA, 64 nt, hsa; identical to SEQ ID NO: 34603

SEQ ID NO: 406194 - RNA, 64 nt, hsa; identical to SEQ ID NO: 34604

SEQ ID NO: 406195 - RNA, 64 nt, hsa; identical to SEQ ID NO: 34605

SEQ ID NO: 406196 - RNA, 64 nt, hsa; identical to SEQ ID NO: 34606

SEQ ID NO: 406197 - RNA, 64 nt, hsa; identical to SEQ ID NO: 34607

SEQ ID NO: 406198 - RNA, 64 nt, hsa; identical to SEQ ID NO: 34608

SEQ ID NO: 406199 - RNA, 64 nt, hsa; identical to SEQ ID NO: 34609

SEQ ID NO: 406200 - RNA, 64 nt, hsa; identical to SEQ ID NO: 34610

SEQ ID NO: 406201 - RNA, 64 nt, hsa; identical to SEQ ID NO: 34611

SEQ ID NO: 406202 - RNA, 64 nt, hsa; identical to SEQ ID NO: 34612

SEQ ID NO: 406203 - RNA, 64 nt, hsa; identical to SEQ ID NO: 34613

SEQ ID NO: 406204 - RNA, 64 nt, hsa; identical to SEQ ID NO: 34614

SEQ ID NO: 406205 - RNA, 64 nt, hsa; identical to SEQ ID NO: 34615

SEQ ID NO: 406206 - RNA, 64 nt, hsa; identical to SEQ ID NO: 34616

SEQ ID NO: 406207 - RNA, 64 nt, hsa; identical to SEQ ID NO: 34617

SEQ ID NO: 406208 - RNA, 64 nt, hsa; identical to SEQ ID NO: 34618

SEQ ID NO: 406209 - RNA, 64 nt, hsa; identical to SEQ ID NO: 34619

SEQ ID NO: 406210 - RNA, 64 nt, hsa; identical to SEQ ID NO: 34620

SEQ ID NO: 406211 - RNA, 64 nt, hsa; identical to SEQ ID NO: 34621

SEQ ID NO: 406212 - RNA, 64 nt, hsa; identical to SEQ ID NO: 34622

SEQ ID NO: 406213 - RNA, 64 nt, hsa; identical to SEQ ID NO: 34623

SEQ ID NO: 406214 - RNA, 64 nt, hsa; identical to SEQ ID NO: 34624

SEQ ID NO: 406215 - RNA, 64 nt, hsa; identical to SEQ ID NO: 34625

SEQ ID NO: 406216 - RNA, 64 nt, hsa; identical to SEQ ID NO: 34626

SEQ ID NO: 406217 - RNA, 64 nt, hsa; identical to SEQ ID NO: 34627

SEQ ID NO: 406218 - RNA, 64 nt, hsa; identical to SEQ ID NO: 34628

SEQ ID NO: 406219 - RNA, 64 nt, hsa; identical to SEQ ID NO: 34629

SEQ ID NO: 406220 - RNA, 64 nt, hsa; identical to SEQ ID NO: 34630

SEQ ID NO: 406221 - RNA, 64 nt, hsa; identical to SEQ ID NO: 34631

SEQ ID NO: 406222 - RNA, 64 nt, hsa; identical to SEQ ID NO: 34632

SEQ ID NO: 406223 - RNA, 64 nt, hsa; identical to SEQ ID NO: 34633

SEQ ID NO: 406224 - RNA, 64 nt, hsa; identical to SEQ ID NO: 34634

SEQ ID NO: 406225 - RNA, 64 nt, hsa; identical to SEQ ID NO: 34635

SEQ ID NO: 406226 - RNA, 64 nt, hsa; identical to SEQ ID NO: 34636

SEQ ID NO: 406227 - RNA, 64 nt, hsa; identical to SEQ ID NO: 34637

SEQ ID NO: 406228 - RNA, 64 nt, hsa; identical to SEQ ID NO: 34638

SEQ ID NO: 406229 - RNA, 64 nt, hsa; identical to SEQ ID NO: 34639

SEQ ID NO: 406230 - RNA, 64 nt, hsa; identical to SEQ ID NO: 34640

SEQ ID NO: 406231 - RNA, 64 nt, hsa; identical to SEQ ID NO: 34641

SEQ ID NO: 406232 - RNA, 64 nt, hsa; identical to SEQ ID NO: 34642

SEQ ID NO: 406233 - RNA, 64 nt, hsa; identical to SEQ ID NO: 34643

SEQ ID NO: 406234 - RNA, 64 nt, hsa; identical to SEQ ID NO: 34644

SEQ ID NO: 406235 - RNA, 64 nt, hsa; identical to SEQ ID NO: 34645

SEQ ID NO: 406236 - RNA, 64 nt, hsa; identical to SEQ ID NO: 34646

SEQ ID NO: 406237 - RNA, 64 nt, hsa; identical to SEQ ID NO: 34647

SEQ ID NO: 406238 - RNA, 64 nt, hsa; identical to SEQ ID NO: 34648

SEQ ID NO: 406239 - RNA, 64 nt, hsa; identical to SEQ ID NO: 34649

SEQ ID NO: 406240 - RNA, 64 nt, hsa; identical to SEQ ID NO: 34650

SEQ ID NO: 406241 - RNA, 64 nt, hsa; identical to SEQ ID NO: 34651

SEQ ID NO: 406242 - RNA, 64 nt, hsa; identical to SEQ ID NO: 34652

SEQ ID NO: 406243 - RNA, 64 nt, hsa; identical to SEQ ID NO: 34653

SEQ ID NO: 406244 - RNA, 64 nt, hsa; identical to SEQ ID NO: 34654

SEQ ID NO: 406245 - RNA, 64 nt, hsa; identical to SEQ ID NO: 34655

SEQ ID NO: 406246 - RNA, 64 nt, hsa; identical to SEQ ID NO: 34656

SEQ ID NO: 406247 - RNA, 64 nt, hsa; identical to SEQ ID NO: 34657

SEQ ID NO: 406248 - RNA, 64 nt, hsa; identical to SEQ ID NO: 34658

SEQ ID NO: 406249 - RNA, 64 nt, hsa; identical to SEQ ID NO: 34659

SEQ ID NO: 406250 - RNA, 64 nt, hsa; identical to SEQ ID NO: 34660

SEQ ID NO: 406251 - RNA, 64 nt, hsa; identical to SEQ ID NO: 34661

SEQ ID NO: 406252 - RNA, 64 nt, hsa; identical to SEQ ID NO: 34662

SEQ ID NO: 406253 - RNA, 64 nt, hsa; identical to SEQ ID NO: 34663

SEQ ID NO: 406254 - RNA, 64 nt, hsa; identical to SEQ ID NO: 34664

SEQ ID NO: 406255 - RNA, 64 nt, hsa; identical to SEQ ID NO: 34665

SEQ ID NO: 406256 - RNA, 64 nt, hsa; identical to SEQ ID NO: 34666

SEQ ID NO: 406257 - RNA, 64 nt, hsa; identical to SEQ ID NO: 34667

SEQ ID NO: 406258 - RNA, 64 nt, hsa; identical to SEQ ID NO: 34668

SEQ ID NO: 406259 - RNA, 64 nt, hsa; identical to SEQ ID NO: 34669

SEQ ID NO: 406260 - RNA, 64 nt, hsa; identical to SEQ ID NO: 34670

SEQ ID NO: 406261 - RNA, 64 nt, hsa; identical to SEQ ID NO: 34671

SEQ ID NO: 406262 - RNA, 64 nt, hsa; identical to SEQ ID NO: 34672

SEQ ID NO: 406263 - RNA, 64 nt, hsa; identical to SEQ ID NO: 34673

SEQ ID NO: 406264 - RNA, 64 nt, hsa; identical to SEQ ID NO: 34674

SEQ ID NO: 406265 - RNA, 64 nt, hsa; identical to SEQ ID NO: 34675

SEQ ID NO: 406266 - RNA, 64 nt, hsa; identical to SEQ ID NO: 34676

SEQ ID NO: 406267 - RNA, 64 nt, hsa; identical to SEQ ID NO: 34677

SEQ ID NO: 406268 - RNA, 64 nt, hsa; identical to SEQ ID NO: 34678

SEQ ID NO: 406269 - RNA, 64 nt, hsa; identical to SEQ ID NO: 34679

SEQ ID NO: 406270 - RNA, 64 nt, hsa; identical to SEQ ID NO: 34680

SEQ ID NO: 406271 - RNA, 64 nt, hsa; identical to SEQ ID NO: 34681

SEQ ID NO: 406272 - RNA, 64 nt, hsa; identical to SEQ ID NO: 34682

SEQ ID NO: 406273 - RNA, 64 nt, hsa; identical to SEQ ID NO: 34683

SEQ ID NO: 406274 - RNA, 64 nt, hsa; identical to SEQ ID NO: 34684

SEQ ID NO: 406275 - RNA, 64 nt, hsa; identical to SEQ ID NO: 34685

SEQ ID NO: 406276 - RNA, 64 nt, hsa; identical to SEQ ID NO: 34686

SEQ ID NO: 406277 - RNA, 64 nt, hsa; identical to SEQ ID NO: 34687

SEQ ID NO: 406278 - RNA, 64 nt, hsa; identical to SEQ ID NO: 34688

SEQ ID NO: 406279 - RNA, 64 nt, hsa; identical to SEQ ID NO: 34689

SEQ ID NO: 406280 - RNA, 64 nt, hsa; identical to SEQ ID NO: 34690

SEQ ID NO: 406281 - RNA, 64 nt, hsa; identical to SEQ ID NO: 34691

SEQ ID NO: 406282 - RNA, 64 nt, hsa; identical to SEQ ID NO: 34692

SEQ ID NO: 406283 - RNA, 64 nt, hsa; identical to SEQ ID NO: 34693

SEQ ID NO: 406284 - RNA, 64 nt, hsa; identical to SEQ ID NO: 34694

SEQ ID NO: 406285 - RNA, 64 nt, hsa; identical to SEQ ID NO: 34695

SEQ ID NO: 406286 - RNA, 64 nt, hsa; identical to SEQ ID NO: 34696

SEQ ID NO: 406287 - RNA, 64 nt, hsa; identical to SEQ ID NO: 34697

SEQ ID NO: 406288 - RNA, 64 nt, hsa; identical to SEQ ID NO: 34698

SEQ ID NO: 406289 - RNA, 64 nt, hsa; identical to SEQ ID NO: 34699

SEQ ID NO: 406290 - RNA, 64 nt, hsa; identical to SEQ ID NO: 34700

SEQ ID NO: 406291 - RNA, 64 nt, hsa; identical to SEQ ID NO: 34701

SEQ ID NO: 406292 - RNA, 64 nt, hsa; identical to SEQ ID NO: 34702

SEQ ID NO: 406293 - RNA, 64 nt, hsa; identical to SEQ ID NO: 34703

SEQ ID NO: 406294 - RNA, 64 nt, hsa; identical to SEQ ID NO: 34704

SEQ ID NO: 406295 - RNA, 64 nt, hsa; identical to SEQ ID NO: 34705

SEQ ID NO: 406296 - RNA, 64 nt, hsa; identical to SEQ ID NO: 34706

SEQ ID NO: 406297 - RNA, 64 nt, hsa; identical to SEQ ID NO: 34707

SEQ ID NO: 406298 - RNA, 64 nt, hsa; identical to SEQ ID NO: 34708

SEQ ID NO: 406299 - RNA, 64 nt, hsa; identical to SEQ ID NO: 34709

SEQ ID NO: 406300 - RNA, 64 nt, hsa; identical to SEQ ID NO: 34710

SEQ ID NO: 406301 - RNA, 64 nt, hsa; identical to SEQ ID NO: 34711

SEQ ID NO: 406302 - RNA, 64 nt, hsa; identical to SEQ ID NO: 34712

SEQ ID NO: 406303 - RNA, 64 nt, hsa; identical to SEQ ID NO: 34713

SEQ ID NO: 406304 - RNA, 64 nt, hsa; identical to SEQ ID NO: 34714

SEQ ID NO: 406305 - RNA, 64 nt, hsa; identical to SEQ ID NO: 34715

SEQ ID NO: 406306 - RNA, 64 nt, hsa; identical to SEQ ID NO: 34716

SEQ ID NO: 406307 - RNA, 64 nt, hsa; identical to SEQ ID NO: 34717

SEQ ID NO: 406308 - RNA, 64 nt, hsa; identical to SEQ ID NO: 34718

SEQ ID NO: 406309 - RNA, 64 nt, hsa; identical to SEQ ID NO: 34719

SEQ ID NO: 406310 - RNA, 64 nt, hsa; identical to SEQ ID NO: 34720

SEQ ID NO: 406311 - RNA, 64 nt, hsa; identical to SEQ ID NO: 34721

SEQ ID NO: 406312 - RNA, 64 nt, hsa; identical to SEQ ID NO: 34722

SEQ ID NO: 406313 - RNA, 64 nt, hsa; identical to SEQ ID NO: 34723

SEQ ID NO: 406314 - RNA, 64 nt, hsa; identical to SEQ ID NO: 34724

SEQ ID NO: 406315 - RNA, 64 nt, hsa; identical to SEQ ID NO: 34725

SEQ ID NO: 406316 - RNA, 64 nt, hsa; identical to SEQ ID NO: 34726

SEQ ID NO: 406317 - RNA, 64 nt, hsa; identical to SEQ ID NO: 34727

SEQ ID NO: 406318 - RNA, 64 nt, hsa; identical to SEQ ID NO: 34728

SEQ ID NO: 406319 - RNA, 64 nt, hsa; identical to SEQ ID NO: 34729

SEQ ID NO: 406320 - RNA, 64 nt, hsa; identical to SEQ ID NO: 34730

SEQ ID NO: 406321 - RNA, 64 nt, hsa; identical to SEQ ID NO: 34731

SEQ ID NO: 406322 - RNA, 64 nt, hsa; identical to SEQ ID NO: 34732

SEQ ID NO: 406323 - RNA, 64 nt, hsa; identical to SEQ ID NO: 34733

SEQ ID NO: 406324 - RNA, 64 nt, hsa; identical to SEQ ID NO: 34734

SEQ ID NO: 406325 - RNA, 64 nt, hsa; identical to SEQ ID NO: 34735

SEQ ID NO: 406326 - RNA, 64 nt, hsa; identical to SEQ ID NO: 34736

SEQ ID NO: 406327 - RNA, 64 nt, hsa; identical to SEQ ID NO: 34737

SEQ ID NO: 406328 - RNA, 64 nt, hsa; identical to SEQ ID NO: 34738

SEQ ID NO: 406329 - RNA, 64 nt, hsa; identical to SEQ ID NO: 34739

SEQ ID NO: 406330 - RNA, 64 nt, hsa; identical to SEQ ID NO: 34740

SEQ ID NO: 406331 - RNA, 64 nt, hsa; identical to SEQ ID NO: 34741

SEQ ID NO: 406332 - RNA, 63 nt, hsa; identical to SEQ ID NO: 34742

SEQ ID NO: 406333 - RNA, 62 nt, hsa; identical to SEQ ID NO: 34743

SEQ ID NO: 406334 - RNA, 64 nt, hsa; identical to SEQ ID NO: 34744

SEQ ID NO: 406335 - RNA, 64 nt, hsa; identical to SEQ ID NO: 34745

SEQ ID NO: 406336 - RNA, 64 nt, hsa; identical to SEQ ID NO: 34746

SEQ ID NO: 406337 - RNA, 64 nt, hsa; identical to SEQ ID NO: 34747

SEQ ID NO: 406338 - RNA, 64 nt, hsa; identical to SEQ ID NO: 34748

SEQ ID NO: 406339 - RNA, 64 nt, hsa; identical to SEQ ID NO: 34749

SEQ ID NO: 406340 - RNA, 64 nt, hsa; identical to SEQ ID NO: 34750

SEQ ID NO: 406341 - RNA, 64 nt, hsa; identical to SEQ ID NO: 34751

SEQ ID NO: 406342 - RNA, 64 nt, hsa; identical to SEQ ID NO: 34752

SEQ ID NO: 406343 - RNA, 64 nt, hsa; identical to SEQ ID NO: 34753

SEQ ID NO: 406344 - RNA, 64 nt, hsa; identical to SEQ ID NO: 34754

SEQ ID NO: 406345 - RNA, 64 nt, hsa; identical to SEQ ID NO: 34755

SEQ ID NO: 406346 - RNA, 64 nt, hsa; identical to SEQ ID NO: 34756

SEQ ID NO: 406347 - RNA, 64 nt, hsa; identical to SEQ ID NO: 34757

SEQ ID NO: 406348 - RNA, 64 nt, hsa; identical to SEQ ID NO: 34758

SEQ ID NO: 406349 - RNA, 64 nt, hsa; identical to SEQ ID NO: 34759

SEQ ID NO: 406350 - RNA, 64 nt, hsa; identical to SEQ ID NO: 34760

SEQ ID NO: 406351 - RNA, 64 nt, hsa; identical to SEQ ID NO: 34761

SEQ ID NO: 406352 - RNA, 64 nt, hsa; identical to SEQ ID NO: 34762

SEQ ID NO: 406353 - RNA, 64 nt, hsa; identical to SEQ ID NO: 34763

SEQ ID NO: 406354 - RNA, 64 nt, hsa; identical to SEQ ID NO: 34764

SEQ ID NO: 406355 - RNA, 64 nt, hsa; identical to SEQ ID NO: 34765

SEQ ID NO: 406356 - RNA, 64 nt, hsa; identical to SEQ ID NO: 34766

SEQ ID NO: 406357 - RNA, 64 nt, hsa; identical to SEQ ID NO: 34767

SEQ ID NO: 406358 - RNA, 64 nt, hsa; identical to SEQ ID NO: 34768

SEQ ID NO: 406359 - RNA, 64 nt, hsa; identical to SEQ ID NO: 34769

SEQ ID NO: 406360 - RNA, 64 nt, hsa; identical to SEQ ID NO: 34770

SEQ ID NO: 406361 - RNA, 64 nt, hsa; identical to SEQ ID NO: 34771

SEQ ID NO: 406362 - RNA, 64 nt, hsa; identical to SEQ ID NO: 34772

SEQ ID NO: 406363 - RNA, 64 nt, hsa; identical to SEQ ID NO: 34773

SEQ ID NO: 406364 - RNA, 64 nt, hsa; identical to SEQ ID NO: 34774

SEQ ID NO: 406365 - RNA, 64 nt, hsa; identical to SEQ ID NO: 34775

SEQ ID NO: 406366 - RNA, 64 nt, hsa; identical to SEQ ID NO: 34776

SEQ ID NO: 406367 - RNA, 64 nt, hsa; identical to SEQ ID NO: 34777

SEQ ID NO: 406368 - RNA, 64 nt, hsa; identical to SEQ ID NO: 34778

SEQ ID NO: 406369 - RNA, 64 nt, hsa; identical to SEQ ID NO: 34779

SEQ ID NO: 406370 - RNA, 64 nt, hsa; identical to SEQ ID NO: 34780

SEQ ID NO: 406371 - RNA, 64 nt, hsa; identical to SEQ ID NO: 34781

SEQ ID NO: 406372 - RNA, 64 nt, hsa; identical to SEQ ID NO: 34782

SEQ ID NO: 406373 - RNA, 64 nt, hsa; identical to SEQ ID NO: 34783

SEQ ID NO: 406374 - RNA, 64 nt, hsa; identical to SEQ ID NO: 34784

SEQ ID NO: 406375 - RNA, 64 nt, hsa; identical to SEQ ID NO: 34785

SEQ ID NO: 406376 - RNA, 64 nt, hsa; identical to SEQ ID NO: 34786

SEQ ID NO: 406377 - RNA, 64 nt, hsa; identical to SEQ ID NO: 34787

SEQ ID NO: 406378 - RNA, 64 nt, hsa; identical to SEQ ID NO: 34788

SEQ ID NO: 406379 - RNA, 64 nt, hsa; identical to SEQ ID NO: 34789

SEQ ID NO: 406380 - RNA, 64 nt, hsa; identical to SEQ ID NO: 34790

SEQ ID NO: 406381 - RNA, 64 nt, hsa; identical to SEQ ID NO: 34791

SEQ ID NO: 406382 - RNA, 64 nt, hsa; identical to SEQ ID NO: 34792

SEQ ID NO: 406383 - RNA, 64 nt, hsa; identical to SEQ ID NO: 34793

SEQ ID NO: 406384 - RNA, 64 nt, hsa; identical to SEQ ID NO: 34794

SEQ ID NO: 406385 - RNA, 64 nt, hsa; identical to SEQ ID NO: 34795

SEQ ID NO: 406386 - RNA, 64 nt, hsa; identical to SEQ ID NO: 34796

SEQ ID NO: 406387 - RNA, 64 nt, hsa; identical to SEQ ID NO: 34797

SEQ ID NO: 406388 - RNA, 64 nt, hsa; identical to SEQ ID NO: 34798

SEQ ID NO: 406389 - RNA, 64 nt, hsa; identical to SEQ ID NO: 34799

SEQ ID NO: 406390 - RNA, 64 nt, hsa; identical to SEQ ID NO: 34800

SEQ ID NO: 406391 - RNA, 64 nt, hsa; identical to SEQ ID NO: 34801

SEQ ID NO: 406392 - RNA, 64 nt, hsa; identical to SEQ ID NO: 34802

SEQ ID NO: 406393 - RNA, 64 nt, hsa; identical to SEQ ID NO: 34803

SEQ ID NO: 406394 - RNA, 64 nt, hsa; identical to SEQ ID NO: 34804

SEQ ID NO: 406395 - RNA, 64 nt, hsa; identical to SEQ ID NO: 34805

SEQ ID NO: 406396 - RNA, 64 nt, hsa; identical to SEQ ID NO: 34806

SEQ ID NO: 406397 - RNA, 64 nt, hsa; identical to SEQ ID NO: 34807

SEQ ID NO: 406398 - RNA, 64 nt, hsa; identical to SEQ ID NO: 34808

SEQ ID NO: 406399 - RNA, 64 nt, hsa; identical to SEQ ID NO: 34809

SEQ ID NO: 406400 - RNA, 64 nt, hsa; identical to SEQ ID NO: 34810

SEQ ID NO: 406401 - RNA, 64 nt, hsa; identical to SEQ ID NO: 34811

SEQ ID NO: 406402 - RNA, 64 nt, hsa; identical to SEQ ID NO: 34812

SEQ ID NO: 406403 - RNA, 64 nt, hsa; identical to SEQ ID NO: 34813

SEQ ID NO: 406404 - RNA, 64 nt, hsa; identical to SEQ ID NO: 34814

SEQ ID NO: 406405 - RNA, 64 nt, hsa; identical to SEQ ID NO: 34815

SEQ ID NO: 406406 - RNA, 64 nt, hsa; identical to SEQ ID NO: 34816

SEQ ID NO: 406407 - RNA, 64 nt, hsa; identical to SEQ ID NO: 34817

SEQ ID NO: 406408 - RNA, 64 nt, hsa; identical to SEQ ID NO: 34818

SEQ ID NO: 406409 - RNA, 64 nt, hsa; identical to SEQ ID NO: 34819

SEQ ID NO: 406410 - RNA, 64 nt, hsa; identical to SEQ ID NO: 34820

SEQ ID NO: 406411 - RNA, 64 nt, hsa; identical to SEQ ID NO: 34821

SEQ ID NO: 406412 - RNA, 64 nt, hsa; identical to SEQ ID NO: 34822

SEQ ID NO: 406413 - RNA, 64 nt, hsa; identical to SEQ ID NO: 34823

SEQ ID NO: 406414 - RNA, 64 nt, hsa; identical to SEQ ID NO: 34824

SEQ ID NO: 406415 - RNA, 64 nt, hsa; identical to SEQ ID NO: 34825

SEQ ID NO: 406416 - RNA, 64 nt, hsa; identical to SEQ ID NO: 34826

SEQ ID NO: 406417 - RNA, 64 nt, hsa; identical to SEQ ID NO: 34827

SEQ ID NO: 406418 - RNA, 64 nt, hsa; identical to SEQ ID NO: 34828

SEQ ID NO: 406419 - RNA, 64 nt, hsa; identical to SEQ ID NO: 34829

SEQ ID NO: 406420 - RNA, 64 nt, hsa; identical to SEQ ID NO: 34830

SEQ ID NO: 406421 - RNA, 64 nt, hsa; identical to SEQ ID NO: 34831

SEQ ID NO: 406422 - RNA, 64 nt, hsa; identical to SEQ ID NO: 34832

SEQ ID NO: 406423 - RNA, 64 nt, hsa; identical to SEQ ID NO: 34833

SEQ ID NO: 406424 - RNA, 64 nt, hsa; identical to SEQ ID NO: 34834

SEQ ID NO: 406425 - RNA, 64 nt, hsa; identical to SEQ ID NO: 34835

SEQ ID NO: 406426 - RNA, 64 nt, hsa; identical to SEQ ID NO: 34836

SEQ ID NO: 406427 - RNA, 64 nt, hsa; identical to SEQ ID NO: 34837

SEQ ID NO: 406428 - RNA, 64 nt, hsa; identical to SEQ ID NO: 34838

SEQ ID NO: 406429 - RNA, 64 nt, hsa; identical to SEQ ID NO: 34839

SEQ ID NO: 406430 - RNA, 64 nt, hsa; identical to SEQ ID NO: 34840

SEQ ID NO: 406431 - RNA, 64 nt, hsa; identical to SEQ ID NO: 34841

SEQ ID NO: 406432 - RNA, 64 nt, hsa; identical to SEQ ID NO: 34842

SEQ ID NO: 406433 - RNA, 64 nt, hsa; identical to SEQ ID NO: 34843

SEQ ID NO: 406434 - RNA, 64 nt, hsa; identical to SEQ ID NO: 34844

SEQ ID NO: 406435 - RNA, 64 nt, hsa; identical to SEQ ID NO: 34845

SEQ ID NO: 406436 - RNA, 64 nt, hsa; identical to SEQ ID NO: 34846

SEQ ID NO: 406437 - RNA, 64 nt, hsa; identical to SEQ ID NO: 34847

SEQ ID NO: 406438 - RNA, 64 nt, hsa; identical to SEQ ID NO: 34848

SEQ ID NO: 406439 - RNA, 64 nt, hsa; identical to SEQ ID NO: 34849

SEQ ID NO: 406440 - RNA, 64 nt, hsa; identical to SEQ ID NO: 34850

SEQ ID NO: 406441 - RNA, 64 nt, hsa; identical to SEQ ID NO: 34851

SEQ ID NO: 406442 - RNA, 64 nt, hsa; identical to SEQ ID NO: 34852

SEQ ID NO: 406443 - RNA, 64 nt, hsa; identical to SEQ ID NO: 34853

SEQ ID NO: 406444 - RNA, 64 nt, hsa; identical to SEQ ID NO: 34854

SEQ ID NO: 406445 - RNA, 64 nt, hsa; identical to SEQ ID NO: 34855

SEQ ID NO: 406446 - RNA, 64 nt, hsa; identical to SEQ ID NO: 34856

SEQ ID NO: 406447 - RNA, 64 nt, hsa; identical to SEQ ID NO: 34857

SEQ ID NO: 406448 - RNA, 63 nt, hsa; identical to SEQ ID NO: 34858

SEQ ID NO: 406449 - RNA, 64 nt, hsa; identical to SEQ ID NO: 34859

SEQ ID NO: 406450 - RNA, 64 nt, hsa; identical to SEQ ID NO: 34860

SEQ ID NO: 406451 - RNA, 64 nt, hsa; identical to SEQ ID NO: 34861

SEQ ID NO: 406452 - RNA, 64 nt, hsa; identical to SEQ ID NO: 34862

SEQ ID NO: 406453 - RNA, 64 nt, hsa; identical to SEQ ID NO: 34863

SEQ ID NO: 406454 - RNA, 64 nt, hsa; identical to SEQ ID NO: 34864

SEQ ID NO: 406455 - RNA, 64 nt, hsa; identical to SEQ ID NO: 34865

SEQ ID NO: 406456 - RNA, 64 nt, hsa; identical to SEQ ID NO: 34866

SEQ ID NO: 406457 - RNA, 64 nt, hsa; identical to SEQ ID NO: 34867

SEQ ID NO: 406458 - RNA, 64 nt, hsa; identical to SEQ ID NO: 34868

SEQ ID NO: 406459 - RNA, 64 nt, hsa; identical to SEQ ID NO: 34869

SEQ ID NO: 406460 - RNA, 64 nt, hsa; identical to SEQ ID NO: 34870

SEQ ID NO: 406461 - RNA, 64 nt, hsa; identical to SEQ ID NO: 34871

SEQ ID NO: 406462 - RNA, 64 nt, hsa; identical to SEQ ID NO: 34872

SEQ ID NO: 406463 - RNA, 64 nt, hsa; identical to SEQ ID NO: 34873

SEQ ID NO: 406464 - RNA, 64 nt, hsa; identical to SEQ ID NO: 34874

SEQ ID NO: 406465 - RNA, 64 nt, hsa; identical to SEQ ID NO: 34875

SEQ ID NO: 406466 - RNA, 64 nt, hsa; identical to SEQ ID NO: 34876

SEQ ID NO: 406467 - RNA, 64 nt, hsa; identical to SEQ ID NO: 34877

SEQ ID NO: 406468 - RNA, 64 nt, hsa; identical to SEQ ID NO: 34878

SEQ ID NO: 406469 - RNA, 64 nt, hsa; identical to SEQ ID NO: 34879

SEQ ID NO: 406470 - RNA, 64 nt, hsa; identical to SEQ ID NO: 34880

SEQ ID NO: 406471 - RNA, 64 nt, hsa; identical to SEQ ID NO: 34881

SEQ ID NO: 406472 - RNA, 64 nt, hsa; identical to SEQ ID NO: 34882

SEQ ID NO: 406473 - RNA, 64 nt, hsa; identical to SEQ ID NO: 34883

SEQ ID NO: 406474 - RNA, 64 nt, hsa; identical to SEQ ID NO: 34884

SEQ ID NO: 406475 - RNA, 64 nt, hsa; identical to SEQ ID NO: 34885

SEQ ID NO: 406476 - RNA, 64 nt, hsa; identical to SEQ ID NO: 34886

SEQ ID NO: 406477 - RNA, 64 nt, hsa; identical to SEQ ID NO: 34887

SEQ ID NO: 406478 - RNA, 64 nt, hsa; identical to SEQ ID NO: 34888

SEQ ID NO: 406479 - RNA, 64 nt, hsa; identical to SEQ ID NO: 34889

SEQ ID NO: 406480 - RNA, 64 nt, hsa; identical to SEQ ID NO: 34890

SEQ ID NO: 406481 - RNA, 64 nt, hsa; identical to SEQ ID NO: 34891

SEQ ID NO: 406482 - RNA, 64 nt, hsa; identical to SEQ ID NO: 34892

SEQ ID NO: 406483 - RNA, 64 nt, hsa; identical to SEQ ID NO: 34893

SEQ ID NO: 406484 - RNA, 64 nt, hsa; identical to SEQ ID NO: 34894

SEQ ID NO: 406485 - RNA, 64 nt, hsa; identical to SEQ ID NO: 34895

SEQ ID NO: 406486 - RNA, 64 nt, hsa; identical to SEQ ID NO: 34896

SEQ ID NO: 406487 - RNA, 64 nt, hsa; identical to SEQ ID NO: 34897

SEQ ID NO: 406488 - RNA, 64 nt, hsa; identical to SEQ ID NO: 34898

SEQ ID NO: 406489 - RNA, 64 nt, hsa; identical to SEQ ID NO: 34899

SEQ ID NO: 406490 - RNA, 64 nt, hsa; identical to SEQ ID NO: 34900

SEQ ID NO: 406491 - RNA, 64 nt, hsa; identical to SEQ ID NO: 34901

SEQ ID NO: 406492 - RNA, 64 nt, hsa; identical to SEQ ID NO: 34902

SEQ ID NO: 406493 - RNA, 64 nt, hsa; identical to SEQ ID NO: 34903

SEQ ID NO: 406494 - RNA, 64 nt, hsa; identical to SEQ ID NO: 34904

SEQ ID NO: 406495 - RNA, 64 nt, hsa; identical to SEQ ID NO: 34905

SEQ ID NO: 406496 - RNA, 64 nt, hsa; identical to SEQ ID NO: 34906

SEQ ID NO: 406497 - RNA, 64 nt, hsa; identical to SEQ ID NO: 34907

SEQ ID NO: 406498 - RNA, 64 nt, hsa; identical to SEQ ID NO: 34908

SEQ ID NO: 406499 - RNA, 64 nt, hsa; identical to SEQ ID NO: 34909

SEQ ID NO: 406500 - RNA, 64 nt, hsa; identical to SEQ ID NO: 34910

SEQ ID NO: 406501 - RNA, 64 nt, hsa; identical to SEQ ID NO: 34911

SEQ ID NO: 406502 - RNA, 64 nt, hsa; identical to SEQ ID NO: 34912

SEQ ID NO: 406503 - RNA, 64 nt, hsa; identical to SEQ ID NO: 34913

SEQ ID NO: 406504 - RNA, 64 nt, hsa; identical to SEQ ID NO: 34914

SEQ ID NO: 406505 - RNA, 64 nt, hsa; identical to SEQ ID NO: 34915

SEQ ID NO: 406506 - RNA, 64 nt, hsa; identical to SEQ ID NO: 34916

SEQ ID NO: 406507 - RNA, 64 nt, hsa; identical to SEQ ID NO: 34917

SEQ ID NO: 406508 - RNA, 64 nt, hsa; identical to SEQ ID NO: 34918

SEQ ID NO: 406509 - RNA, 64 nt, hsa; identical to SEQ ID NO: 34919

SEQ ID NO: 406510 - RNA, 64 nt, hsa; identical to SEQ ID NO: 34920

SEQ ID NO: 406511 - RNA, 64 nt, hsa; identical to SEQ ID NO: 34921

SEQ ID NO: 406512 - RNA, 64 nt, hsa; identical to SEQ ID NO: 34922

SEQ ID NO: 406513 - RNA, 64 nt, hsa; identical to SEQ ID NO: 34923

SEQ ID NO: 406514 - RNA, 64 nt, hsa; identical to SEQ ID NO: 34924

SEQ ID NO: 406515 - RNA, 64 nt, hsa; identical to SEQ ID NO: 34925

SEQ ID NO: 406516 - RNA, 64 nt, hsa; identical to SEQ ID NO: 34926

SEQ ID NO: 406517 - RNA, 64 nt, hsa; identical to SEQ ID NO: 34927

SEQ ID NO: 406518 - RNA, 64 nt, hsa; identical to SEQ ID NO: 34928

SEQ ID NO: 406519 - RNA, 63 nt, hsa; identical to SEQ ID NO: 34929

SEQ ID NO: 406520 - RNA, 64 nt, hsa; identical to SEQ ID NO: 34930

SEQ ID NO: 406521 - RNA, 64 nt, hsa; identical to SEQ ID NO: 34931

SEQ ID NO: 406522 - RNA, 64 nt, hsa; identical to SEQ ID NO: 34932

SEQ ID NO: 406523 - RNA, 64 nt, hsa; identical to SEQ ID NO: 34933

SEQ ID NO: 406524 - RNA, 64 nt, hsa; identical to SEQ ID NO: 34934

SEQ ID NO: 406525 - RNA, 64 nt, hsa; identical to SEQ ID NO: 34935

SEQ ID NO: 406526 - RNA, 64 nt, hsa; identical to SEQ ID NO: 34936

SEQ ID NO: 406527 - RNA, 64 nt, hsa; identical to SEQ ID NO: 34937

SEQ ID NO: 406528 - RNA, 64 nt, hsa; identical to SEQ ID NO: 34938

SEQ ID NO: 406529 - RNA, 64 nt, hsa; identical to SEQ ID NO: 34939

SEQ ID NO: 406530 - RNA, 64 nt, hsa; identical to SEQ ID NO: 34940

SEQ ID NO: 406531 - RNA, 64 nt, hsa; identical to SEQ ID NO: 34941

SEQ ID NO: 406532 - RNA, 64 nt, hsa; identical to SEQ ID NO: 34942

SEQ ID NO: 406533 - RNA, 64 nt, hsa; identical to SEQ ID NO: 34943

SEQ ID NO: 406534 - RNA, 64 nt, hsa; identical to SEQ ID NO: 34944

SEQ ID NO: 406535 - RNA, 64 nt, hsa; identical to SEQ ID NO: 34945

SEQ ID NO: 406536 - RNA, 64 nt, hsa; identical to SEQ ID NO: 34946

SEQ ID NO: 406537 - RNA, 64 nt, hsa; identical to SEQ ID NO: 34947

SEQ ID NO: 406538 - RNA, 64 nt, hsa; identical to SEQ ID NO: 34948

SEQ ID NO: 406539 - RNA, 64 nt, hsa; identical to SEQ ID NO: 34949

SEQ ID NO: 406540 - RNA, 64 nt, hsa; identical to SEQ ID NO: 34950

SEQ ID NO: 406541 - RNA, 64 nt, hsa; identical to SEQ ID NO: 34951

SEQ ID NO: 406542 - RNA, 64 nt, hsa; identical to SEQ ID NO: 34952

SEQ ID NO: 406543 - RNA, 64 nt, hsa; identical to SEQ ID NO: 34953

SEQ ID NO: 406544 - RNA, 64 nt, hsa; identical to SEQ ID NO: 34954

SEQ ID NO: 406545 - RNA, 64 nt, hsa; identical to SEQ ID NO: 34955

SEQ ID NO: 406546 - RNA, 64 nt, hsa; identical to SEQ ID NO: 34956

SEQ ID NO: 406547 - RNA, 64 nt, hsa; identical to SEQ ID NO: 34957

SEQ ID NO: 406548 - RNA, 64 nt, hsa; identical to SEQ ID NO: 34958

SEQ ID NO: 406549 - RNA, 64 nt, hsa; identical to SEQ ID NO: 34959

SEQ ID NO: 406550 - RNA, 64 nt, hsa; identical to SEQ ID NO: 34960

SEQ ID NO: 406551 - RNA, 64 nt, hsa; identical to SEQ ID NO: 34961

SEQ ID NO: 406552 - RNA, 64 nt, hsa; identical to SEQ ID NO: 34962

SEQ ID NO: 406553 - RNA, 64 nt, hsa; identical to SEQ ID NO: 34963

SEQ ID NO: 406554 - RNA, 64 nt, hsa; identical to SEQ ID NO: 34964

SEQ ID NO: 406555 - RNA, 64 nt, hsa; identical to SEQ ID NO: 34965

SEQ ID NO: 406556 - RNA, 64 nt, hsa; identical to SEQ ID NO: 34966

SEQ ID NO: 406557 - RNA, 64 nt, hsa; identical to SEQ ID NO: 34967

SEQ ID NO: 406558 - RNA, 64 nt, hsa; identical to SEQ ID NO: 34968

SEQ ID NO: 406559 - RNA, 64 nt, hsa; identical to SEQ ID NO: 34969

SEQ ID NO: 406560 - RNA, 64 nt, hsa; identical to SEQ ID NO: 34970

SEQ ID NO: 406561 - RNA, 64 nt, hsa; identical to SEQ ID NO: 34971

SEQ ID NO: 406562 - RNA, 64 nt, hsa; identical to SEQ ID NO: 34972

SEQ ID NO: 406563 - RNA, 64 nt, hsa; identical to SEQ ID NO: 34973

SEQ ID NO: 406564 - RNA, 64 nt, hsa; identical to SEQ ID NO: 34974

SEQ ID NO: 406565 - RNA, 64 nt, hsa; identical to SEQ ID NO: 34975

SEQ ID NO: 406566 - RNA, 64 nt, hsa; identical to SEQ ID NO: 34976

SEQ ID NO: 406567 - RNA, 64 nt, hsa; identical to SEQ ID NO: 34977

SEQ ID NO: 406568 - RNA, 64 nt, hsa; identical to SEQ ID NO: 34978

SEQ ID NO: 406569 - RNA, 64 nt, hsa; identical to SEQ ID NO: 34979

SEQ ID NO: 406570 - RNA, 64 nt, hsa; identical to SEQ ID NO: 34980

SEQ ID NO: 406571 - RNA, 64 nt, hsa; identical to SEQ ID NO: 34981

SEQ ID NO: 406572 - RNA, 64 nt, hsa; identical to SEQ ID NO: 34982

SEQ ID NO: 406573 - RNA, 64 nt, hsa; identical to SEQ ID NO: 34983

SEQ ID NO: 406574 - RNA, 64 nt, hsa; identical to SEQ ID NO: 34984

SEQ ID NO: 406575 - RNA, 64 nt, hsa; identical to SEQ ID NO: 34985

SEQ ID NO: 406576 - RNA, 64 nt, hsa; identical to SEQ ID NO: 34986

SEQ ID NO: 406577 - RNA, 64 nt, hsa; identical to SEQ ID NO: 34987

SEQ ID NO: 406578 - RNA, 64 nt, hsa; identical to SEQ ID NO: 34988

SEQ ID NO: 406579 - RNA, 64 nt, hsa; identical to SEQ ID NO: 34989

SEQ ID NO: 406580 - RNA, 64 nt, hsa; identical to SEQ ID NO: 34990

SEQ ID NO: 406581 - RNA, 64 nt, hsa; identical to SEQ ID NO: 34991

SEQ ID NO: 406582 - RNA, 64 nt, hsa; identical to SEQ ID NO: 34992

SEQ ID NO: 406583 - RNA, 64 nt, hsa; identical to SEQ ID NO: 34993

SEQ ID NO: 406584 - RNA, 64 nt, hsa; identical to SEQ ID NO: 34994

SEQ ID NO: 406585 - RNA, 64 nt, hsa; identical to SEQ ID NO: 34995

SEQ ID NO: 406586 - RNA, 64 nt, hsa; identical to SEQ ID NO: 34996

SEQ ID NO: 406587 - RNA, 64 nt, hsa; identical to SEQ ID NO: 34997

SEQ ID NO: 406588 - RNA, 64 nt, hsa; identical to SEQ ID NO: 34998

SEQ ID NO: 406589 - RNA, 64 nt, hsa; identical to SEQ ID NO: 34999

SEQ ID NO: 406590 - RNA, 64 nt, hsa; identical to SEQ ID NO: 35000

SEQ ID NO: 406591 - RNA, 64 nt, hsa; identical to SEQ ID NO: 35001

SEQ ID NO: 406592 - RNA, 64 nt, hsa; identical to SEQ ID NO: 35002

SEQ ID NO: 406593 - RNA, 64 nt, hsa; identical to SEQ ID NO: 35003

SEQ ID NO: 406594 - RNA, 64 nt, hsa; identical to SEQ ID NO: 35004

SEQ ID NO: 406595 - RNA, 64 nt, hsa; identical to SEQ ID NO: 35005

SEQ ID NO: 406596 - RNA, 64 nt, hsa; identical to SEQ ID NO: 35006

SEQ ID NO: 406597 - RNA, 64 nt, hsa; identical to SEQ ID NO: 35007

SEQ ID NO: 406598 - RNA, 64 nt, hsa; identical to SEQ ID NO: 35008

SEQ ID NO: 406599 - RNA, 64 nt, hsa; identical to SEQ ID NO: 35009

SEQ ID NO: 406600 - RNA, 64 nt, hsa; identical to SEQ ID NO: 35010

SEQ ID NO: 406601 - RNA, 64 nt, hsa; identical to SEQ ID NO: 35011

SEQ ID NO: 406602 - RNA, 64 nt, hsa; identical to SEQ ID NO: 35012

SEQ ID NO: 406603 - RNA, 64 nt, hsa; identical to SEQ ID NO: 35013

SEQ ID NO: 406604 - RNA, 64 nt, hsa; identical to SEQ ID NO: 35014

SEQ ID NO: 406605 - RNA, 64 nt, hsa; identical to SEQ ID NO: 35015

SEQ ID NO: 406606 - RNA, 64 nt, hsa; identical to SEQ ID NO: 35016

SEQ ID NO: 406607 - RNA, 64 nt, hsa; identical to SEQ ID NO: 35017

SEQ ID NO: 406608 - RNA, 64 nt, hsa; identical to SEQ ID NO: 35018

SEQ ID NO: 406609 - RNA, 64 nt, hsa; identical to SEQ ID NO: 35019

SEQ ID NO: 406610 - RNA, 64 nt, hsa; identical to SEQ ID NO: 35020

SEQ ID NO: 406611 - RNA, 64 nt, hsa; identical to SEQ ID NO: 35021

SEQ ID NO: 406612 - RNA, 64 nt, hsa; identical to SEQ ID NO: 35022

SEQ ID NO: 406613 - RNA, 64 nt, hsa; identical to SEQ ID NO: 35023

SEQ ID NO: 406614 - RNA, 64 nt, hsa; identical to SEQ ID NO: 35024

SEQ ID NO: 406615 - RNA, 64 nt, hsa; identical to SEQ ID NO: 35025

SEQ ID NO: 406616 - RNA, 64 nt, hsa; identical to SEQ ID NO: 35026

SEQ ID NO: 406617 - RNA, 64 nt, hsa; identical to SEQ ID NO: 35027

SEQ ID NO: 406618 - RNA, 64 nt, hsa; identical to SEQ ID NO: 35028

SEQ ID NO: 406619 - RNA, 64 nt, hsa; identical to SEQ ID NO: 35029

SEQ ID NO: 406620 - RNA, 64 nt, hsa; identical to SEQ ID NO: 35030

SEQ ID NO: 406621 - RNA, 64 nt, hsa; identical to SEQ ID NO: 35031

SEQ ID NO: 406622 - RNA, 64 nt, hsa; identical to SEQ ID NO: 35032

SEQ ID NO: 406623 - RNA, 64 nt, hsa; identical to SEQ ID NO: 35033

SEQ ID NO: 406624 - RNA, 64 nt, hsa; identical to SEQ ID NO: 35034

SEQ ID NO: 406625 - RNA, 64 nt, hsa; identical to SEQ ID NO: 35035

SEQ ID NO: 406626 - RNA, 64 nt, hsa; identical to SEQ ID NO: 35036

SEQ ID NO: 406627 - RNA, 64 nt, hsa; identical to SEQ ID NO: 35037

SEQ ID NO: 406628 - RNA, 64 nt, hsa; identical to SEQ ID NO: 35038

SEQ ID NO: 406629 - RNA, 64 nt, hsa; identical to SEQ ID NO: 35039

SEQ ID NO: 406630 - RNA, 64 nt, hsa; identical to SEQ ID NO: 35040

SEQ ID NO: 406631 - RNA, 64 nt, hsa; identical to SEQ ID NO: 35041

SEQ ID NO: 406632 - RNA, 64 nt, hsa; identical to SEQ ID NO: 35042

SEQ ID NO: 406633 - RNA, 64 nt, hsa; identical to SEQ ID NO: 35043

SEQ ID NO: 406634 - RNA, 64 nt, hsa; identical to SEQ ID NO: 35044

SEQ ID NO: 406635 - RNA, 64 nt, hsa; identical to SEQ ID NO: 35045

SEQ ID NO: 406636 - RNA, 64 nt, hsa; identical to SEQ ID NO: 35046

SEQ ID NO: 406637 - RNA, 64 nt, hsa; identical to SEQ ID NO: 35047

SEQ ID NO: 406638 - RNA, 64 nt, hsa; identical to SEQ ID NO: 35048

SEQ ID NO: 406639 - RNA, 64 nt, hsa; identical to SEQ ID NO: 35049

SEQ ID NO: 406640 - RNA, 64 nt, hsa; identical to SEQ ID NO: 35050

SEQ ID NO: 406641 - RNA, 64 nt, hsa; identical to SEQ ID NO: 35051

SEQ ID NO: 406642 - RNA, 64 nt, hsa; identical to SEQ ID NO: 35052

SEQ ID NO: 406643 - RNA, 64 nt, hsa; identical to SEQ ID NO: 35053

SEQ ID NO: 406644 - RNA, 64 nt, hsa; identical to SEQ ID NO: 35054

SEQ ID NO: 406645 - RNA, 64 nt, hsa; identical to SEQ ID NO: 35055

SEQ ID NO: 406646 - RNA, 64 nt, hsa; identical to SEQ ID NO: 35056

SEQ ID NO: 406647 - RNA, 64 nt, hsa; identical to SEQ ID NO: 35057

SEQ ID NO: 406648 - RNA, 64 nt, hsa; identical to SEQ ID NO: 35058

SEQ ID NO: 406649 - RNA, 64 nt, hsa; identical to SEQ ID NO: 35059

SEQ ID NO: 406650 - RNA, 64 nt, hsa; identical to SEQ ID NO: 35060

SEQ ID NO: 406651 - RNA, 64 nt, hsa; identical to SEQ ID NO: 35061

SEQ ID NO: 406652 - RNA, 64 nt, hsa; identical to SEQ ID NO: 35062

SEQ ID NO: 406653 - RNA, 64 nt, hsa; identical to SEQ ID NO: 35063

SEQ ID NO: 406654 - RNA, 64 nt, hsa; identical to SEQ ID NO: 35064

SEQ ID NO: 406655 - RNA, 64 nt, hsa; identical to SEQ ID NO: 35065

SEQ ID NO: 406656 - RNA, 64 nt, hsa; identical to SEQ ID NO: 35066

SEQ ID NO: 406657 - RNA, 64 nt, hsa; identical to SEQ ID NO: 35067

SEQ ID NO: 406658 - RNA, 64 nt, hsa; identical to SEQ ID NO: 35068

SEQ ID NO: 406659 - RNA, 64 nt, hsa; identical to SEQ ID NO: 35069

SEQ ID NO: 406660 - RNA, 64 nt, hsa; identical to SEQ ID NO: 35070

SEQ ID NO: 406661 - RNA, 64 nt, hsa; identical to SEQ ID NO: 35071

SEQ ID NO: 406662 - RNA, 64 nt, hsa; identical to SEQ ID NO: 35072

SEQ ID NO: 406663 - RNA, 64 nt, hsa; identical to SEQ ID NO: 35073

SEQ ID NO: 406664 - RNA, 64 nt, hsa; identical to SEQ ID NO: 35074

SEQ ID NO: 406665 - RNA, 64 nt, hsa; identical to SEQ ID NO: 35075

SEQ ID NO: 406666 - RNA, 64 nt, hsa; identical to SEQ ID NO: 35076

SEQ ID NO: 406667 - RNA, 64 nt, hsa; identical to SEQ ID NO: 35077

SEQ ID NO: 406668 - RNA, 64 nt, hsa; identical to SEQ ID NO: 35078

SEQ ID NO: 406669 - RNA, 64 nt, hsa; identical to SEQ ID NO: 35079

SEQ ID NO: 406670 - RNA, 64 nt, hsa; identical to SEQ ID NO: 35080

SEQ ID NO: 406671 - RNA, 64 nt, hsa; identical to SEQ ID NO: 35081

SEQ ID NO: 406672 - RNA, 64 nt, hsa; identical to SEQ ID NO: 35082

SEQ ID NO: 406673 - RNA, 64 nt, hsa; identical to SEQ ID NO: 35083

SEQ ID NO: 406674 - RNA, 64 nt, hsa; identical to SEQ ID NO: 35084

SEQ ID NO: 406675 - RNA, 64 nt, hsa; identical to SEQ ID NO: 35085

SEQ ID NO: 406676 - RNA, 64 nt, hsa; identical to SEQ ID NO: 35086

SEQ ID NO: 406677 - RNA, 64 nt, hsa; identical to SEQ ID NO: 35087

SEQ ID NO: 406678 - RNA, 64 nt, hsa; identical to SEQ ID NO: 35088

SEQ ID NO: 406679 - RNA, 64 nt, hsa; identical to SEQ ID NO: 35089

SEQ ID NO: 406680 - RNA, 64 nt, hsa; identical to SEQ ID NO: 35090

SEQ ID NO: 406681 - RNA, 64 nt, hsa; identical to SEQ ID NO: 35091

SEQ ID NO: 406682 - RNA, 64 nt, hsa; identical to SEQ ID NO: 35092

SEQ ID NO: 406683 - RNA, 64 nt, hsa; identical to SEQ ID NO: 35093

SEQ ID NO: 406684 - RNA, 64 nt, hsa; identical to SEQ ID NO: 35094

SEQ ID NO: 406685 - RNA, 64 nt, hsa; identical to SEQ ID NO: 35095

SEQ ID NO: 406686 - RNA, 64 nt, hsa; identical to SEQ ID NO: 35096

SEQ ID NO: 406687 - RNA, 64 nt, hsa; identical to SEQ ID NO: 35097

SEQ ID NO: 406688 - RNA, 64 nt, hsa; identical to SEQ ID NO: 35098

SEQ ID NO: 406689 - RNA, 64 nt, hsa; identical to SEQ ID NO: 35099

SEQ ID NO: 406690 - RNA, 64 nt, hsa; identical to SEQ ID NO: 35100

SEQ ID NO: 406691 - RNA, 64 nt, hsa; identical to SEQ ID NO: 35101

SEQ ID NO: 406692 - RNA, 64 nt, hsa; identical to SEQ ID NO: 35102

SEQ ID NO: 406693 - RNA, 64 nt, hsa; identical to SEQ ID NO: 35103

SEQ ID NO: 406694 - RNA, 64 nt, hsa; identical to SEQ ID NO: 35104

SEQ ID NO: 406695 - RNA, 64 nt, hsa; identical to SEQ ID NO: 35105

SEQ ID NO: 406696 - RNA, 64 nt, hsa; identical to SEQ ID NO: 35106

SEQ ID NO: 406697 - RNA, 64 nt, hsa; identical to SEQ ID NO: 35107

SEQ ID NO: 406698 - RNA, 64 nt, hsa; identical to SEQ ID NO: 35108

SEQ ID NO: 406699 - RNA, 64 nt, hsa; identical to SEQ ID NO: 35109

SEQ ID NO: 406700 - RNA, 64 nt, hsa; identical to SEQ ID NO: 35110

SEQ ID NO: 406701 - RNA, 64 nt, hsa; identical to SEQ ID NO: 35111

SEQ ID NO: 406702 - RNA, 64 nt, hsa; identical to SEQ ID NO: 35112

SEQ ID NO: 406703 - RNA, 64 nt, hsa; identical to SEQ ID NO: 35113

SEQ ID NO: 406704 - RNA, 64 nt, hsa; identical to SEQ ID NO: 35114

SEQ ID NO: 406705 - RNA, 64 nt, hsa; identical to SEQ ID NO: 35115

SEQ ID NO: 406706 - RNA, 64 nt, hsa; identical to SEQ ID NO: 35116

SEQ ID NO: 406707 - RNA, 64 nt, hsa; identical to SEQ ID NO: 35117

SEQ ID NO: 406708 - RNA, 64 nt, hsa; identical to SEQ ID NO: 35118

SEQ ID NO: 406709 - RNA, 64 nt, hsa; identical to SEQ ID NO: 35119

SEQ ID NO: 406710 - RNA, 64 nt, hsa; identical to SEQ ID NO: 35120

SEQ ID NO: 406711 - RNA, 64 nt, hsa; identical to SEQ ID NO: 35121

SEQ ID NO: 406712 - RNA, 64 nt, hsa; identical to SEQ ID NO: 35122

SEQ ID NO: 406713 - RNA, 64 nt, hsa; identical to SEQ ID NO: 35123

SEQ ID NO: 406714 - RNA, 64 nt, hsa; identical to SEQ ID NO: 35124

SEQ ID NO: 406715 - RNA, 64 nt, hsa; identical to SEQ ID NO: 35125

SEQ ID NO: 406716 - RNA, 64 nt, hsa; identical to SEQ ID NO: 35126

SEQ ID NO: 406717 - RNA, 64 nt, hsa; identical to SEQ ID NO: 35127

SEQ ID NO: 406718 - RNA, 64 nt, hsa; identical to SEQ ID NO: 35128

SEQ ID NO: 406719 - RNA, 64 nt, hsa; identical to SEQ ID NO: 35129

SEQ ID NO: 406720 - RNA, 64 nt, hsa; identical to SEQ ID NO: 35130

SEQ ID NO: 406721 - RNA, 64 nt, hsa; identical to SEQ ID NO: 35131

SEQ ID NO: 406722 - RNA, 64 nt, hsa; identical to SEQ ID NO: 35132

SEQ ID NO: 406723 - RNA, 64 nt, hsa; identical to SEQ ID NO: 35133

SEQ ID NO: 406724 - RNA, 64 nt, hsa; identical to SEQ ID NO: 35134

SEQ ID NO: 406725 - RNA, 64 nt, hsa; identical to SEQ ID NO: 35135

SEQ ID NO: 406726 - RNA, 64 nt, hsa; identical to SEQ ID NO: 35136

SEQ ID NO: 406727 - RNA, 64 nt, hsa; identical to SEQ ID NO: 35137

SEQ ID NO: 406728 - RNA, 64 nt, hsa; identical to SEQ ID NO: 35138

SEQ ID NO: 406729 - RNA, 64 nt, hsa; identical to SEQ ID NO: 35139

SEQ ID NO: 406730 - RNA, 64 nt, hsa; identical to SEQ ID NO: 35140

SEQ ID NO: 406731 - RNA, 64 nt, hsa; identical to SEQ ID NO: 35141

SEQ ID NO: 406732 - RNA, 64 nt, hsa; identical to SEQ ID NO: 35142

SEQ ID NO: 406733 - RNA, 64 nt, hsa; identical to SEQ ID NO: 35143

SEQ ID NO: 406734 - RNA, 64 nt, hsa; identical to SEQ ID NO: 35144

SEQ ID NO: 406735 - RNA, 64 nt, hsa; identical to SEQ ID NO: 35145

SEQ ID NO: 406736 - RNA, 64 nt, hsa; identical to SEQ ID NO: 35146

SEQ ID NO: 406737 - RNA, 64 nt, hsa; identical to SEQ ID NO: 35147

SEQ ID NO: 406738 - RNA, 64 nt, hsa; identical to SEQ ID NO: 35148

SEQ ID NO: 406739 - RNA, 64 nt, hsa; identical to SEQ ID NO: 35149

SEQ ID NO: 406740 - RNA, 64 nt, hsa; identical to SEQ ID NO: 35150

SEQ ID NO: 406741 - RNA, 64 nt, hsa; identical to SEQ ID NO: 35151

SEQ ID NO: 406742 - RNA, 64 nt, hsa; identical to SEQ ID NO: 35152

SEQ ID NO: 406743 - RNA, 64 nt, hsa; identical to SEQ ID NO: 35153

SEQ ID NO: 406744 - RNA, 64 nt, hsa; identical to SEQ ID NO: 35154

SEQ ID NO: 406745 - RNA, 64 nt, hsa; identical to SEQ ID NO: 35155

SEQ ID NO: 406746 - RNA, 64 nt, hsa; identical to SEQ ID NO: 35156

SEQ ID NO: 406747 - RNA, 64 nt, hsa; identical to SEQ ID NO: 35157

SEQ ID NO: 406748 - RNA, 64 nt, hsa; identical to SEQ ID NO: 35158

SEQ ID NO: 406749 - RNA, 64 nt, hsa; identical to SEQ ID NO: 35159

SEQ ID NO: 406750 - RNA, 64 nt, hsa; identical to SEQ ID NO: 35160

SEQ ID NO: 406751 - RNA, 64 nt, hsa; identical to SEQ ID NO: 35161

SEQ ID NO: 406752 - RNA, 64 nt, hsa; identical to SEQ ID NO: 35162

SEQ ID NO: 406753 - RNA, 64 nt, hsa; identical to SEQ ID NO: 35163

SEQ ID NO: 406754 - RNA, 64 nt, hsa; identical to SEQ ID NO: 35164

SEQ ID NO: 406755 - RNA, 64 nt, hsa; identical to SEQ ID NO: 35165

SEQ ID NO: 406756 - RNA, 64 nt, hsa; identical to SEQ ID NO: 35166

SEQ ID NO: 406757 - RNA, 64 nt, hsa; identical to SEQ ID NO: 35167

SEQ ID NO: 406758 - RNA, 64 nt, hsa; identical to SEQ ID NO: 35168

SEQ ID NO: 406759 - RNA, 64 nt, hsa; identical to SEQ ID NO: 35169

SEQ ID NO: 406760 - RNA, 64 nt, hsa; identical to SEQ ID NO: 35170

SEQ ID NO: 406761 - RNA, 64 nt, hsa; identical to SEQ ID NO: 35171

SEQ ID NO: 406762 - RNA, 64 nt, hsa; identical to SEQ ID NO: 35172

SEQ ID NO: 406763 - RNA, 64 nt, hsa; identical to SEQ ID NO: 35173

SEQ ID NO: 406764 - RNA, 64 nt, hsa; identical to SEQ ID NO: 35174

SEQ ID NO: 406765 - RNA, 64 nt, hsa; identical to SEQ ID NO: 35175

SEQ ID NO: 406766 - RNA, 64 nt, hsa; identical to SEQ ID NO: 35176

SEQ ID NO: 406767 - RNA, 64 nt, hsa; identical to SEQ ID NO: 35177

SEQ ID NO: 406768 - RNA, 64 nt, hsa; identical to SEQ ID NO: 35178

SEQ ID NO: 406769 - RNA, 64 nt, hsa; identical to SEQ ID NO: 35179

SEQ ID NO: 406770 - RNA, 64 nt, hsa; identical to SEQ ID NO: 35180

SEQ ID NO: 406771 - RNA, 64 nt, hsa; identical to SEQ ID NO: 35181

SEQ ID NO: 406772 - RNA, 64 nt, hsa; identical to SEQ ID NO: 35182

SEQ ID NO: 406773 - RNA, 64 nt, hsa; identical to SEQ ID NO: 35183

SEQ ID NO: 406774 - RNA, 64 nt, hsa; identical to SEQ ID NO: 35184

SEQ ID NO: 406775 - RNA, 64 nt, hsa; identical to SEQ ID NO: 35185

SEQ ID NO: 406776 - RNA, 64 nt, hsa; identical to SEQ ID NO: 35186

SEQ ID NO: 406777 - RNA, 64 nt, hsa; identical to SEQ ID NO: 35187

SEQ ID NO: 406778 - RNA, 64 nt, hsa; identical to SEQ ID NO: 35188

SEQ ID NO: 406779 - RNA, 64 nt, hsa; identical to SEQ ID NO: 35189

SEQ ID NO: 406780 - RNA, 64 nt, hsa; identical to SEQ ID NO: 35190

SEQ ID NO: 406781 - RNA, 64 nt, hsa; identical to SEQ ID NO: 35191

SEQ ID NO: 406782 - RNA, 64 nt, hsa; identical to SEQ ID NO: 35192

SEQ ID NO: 406783 - RNA, 64 nt, hsa; identical to SEQ ID NO: 35193

SEQ ID NO: 406784 - RNA, 64 nt, hsa; identical to SEQ ID NO: 35194

SEQ ID NO: 406785 - RNA, 64 nt, hsa; identical to SEQ ID NO: 35195

SEQ ID NO: 406786 - RNA, 64 nt, hsa; identical to SEQ ID NO: 35196

SEQ ID NO: 406787 - RNA, 64 nt, hsa; identical to SEQ ID NO: 35197

SEQ ID NO: 406788 - RNA, 64 nt, hsa; identical to SEQ ID NO: 35198

SEQ ID NO: 406789 - RNA, 64 nt, hsa; identical to SEQ ID NO: 35199

SEQ ID NO: 406790 - RNA, 64 nt, hsa; identical to SEQ ID NO: 35200

SEQ ID NO: 406791 - RNA, 64 nt, hsa; identical to SEQ ID NO: 35201

SEQ ID NO: 406792 - RNA, 64 nt, hsa; identical to SEQ ID NO: 35202

SEQ ID NO: 406793 - RNA, 64 nt, hsa; identical to SEQ ID NO: 35203

SEQ ID NO: 406794 - RNA, 64 nt, hsa; identical to SEQ ID NO: 35204

SEQ ID NO: 406795 - RNA, 64 nt, hsa; identical to SEQ ID NO: 35205

SEQ ID NO: 406796 - RNA, 64 nt, hsa; identical to SEQ ID NO: 35206

SEQ ID NO: 406797 - RNA, 64 nt, hsa; identical to SEQ ID NO: 35207

SEQ ID NO: 406798 - RNA, 64 nt, hsa; identical to SEQ ID NO: 35208

SEQ ID NO: 406799 - RNA, 64 nt, hsa; identical to SEQ ID NO: 35209

SEQ ID NO: 406800 - RNA, 64 nt, hsa; identical to SEQ ID NO: 35210

SEQ ID NO: 406801 - RNA, 64 nt, hsa; identical to SEQ ID NO: 35211

SEQ ID NO: 406802 - RNA, 64 nt, hsa; identical to SEQ ID NO: 35212

SEQ ID NO: 406803 - RNA, 64 nt, hsa; identical to SEQ ID NO: 35213

SEQ ID NO: 406804 - RNA, 64 nt, hsa; identical to SEQ ID NO: 35214

SEQ ID NO: 406805 - RNA, 64 nt, hsa; identical to SEQ ID NO: 35215

SEQ ID NO: 406806 - RNA, 64 nt, hsa; identical to SEQ ID NO: 35216

SEQ ID NO: 406807 - RNA, 64 nt, hsa; identical to SEQ ID NO: 35217

SEQ ID NO: 406808 - RNA, 64 nt, hsa; identical to SEQ ID NO: 35218

SEQ ID NO: 406809 - RNA, 64 nt, hsa; identical to SEQ ID NO: 35219

SEQ ID NO: 406810 - RNA, 64 nt, hsa; identical to SEQ ID NO: 35220

SEQ ID NO: 406811 - RNA, 64 nt, hsa; identical to SEQ ID NO: 35221

SEQ ID NO: 406812 - RNA, 64 nt, hsa; identical to SEQ ID NO: 35222

SEQ ID NO: 406813 - RNA, 64 nt, hsa; identical to SEQ ID NO: 35223

SEQ ID NO: 406814 - RNA, 64 nt, hsa; identical to SEQ ID NO: 35224

SEQ ID NO: 406815 - RNA, 64 nt, hsa; identical to SEQ ID NO: 35225

SEQ ID NO: 406816 - RNA, 64 nt, hsa; identical to SEQ ID NO: 35226

SEQ ID NO: 406817 - RNA, 64 nt, hsa; identical to SEQ ID NO: 35227

SEQ ID NO: 406818 - RNA, 64 nt, hsa; identical to SEQ ID NO: 35228

SEQ ID NO: 406819 - RNA, 64 nt, hsa; identical to SEQ ID NO: 35229

SEQ ID NO: 406820 - RNA, 64 nt, hsa; identical to SEQ ID NO: 35230

SEQ ID NO: 406821 - RNA, 64 nt, hsa; identical to SEQ ID NO: 35231

SEQ ID NO: 406822 - RNA, 64 nt, hsa; identical to SEQ ID NO: 35232

SEQ ID NO: 406823 - RNA, 64 nt, hsa; identical to SEQ ID NO: 35233

SEQ ID NO: 406824 - RNA, 64 nt, hsa; identical to SEQ ID NO: 35234

SEQ ID NO: 406825 - RNA, 64 nt, hsa; identical to SEQ ID NO: 35235

SEQ ID NO: 406826 - RNA, 64 nt, hsa; identical to SEQ ID NO: 35236

SEQ ID NO: 406827 - RNA, 64 nt, hsa; identical to SEQ ID NO: 35237

SEQ ID NO: 406828 - RNA, 64 nt, hsa; identical to SEQ ID NO: 35238

SEQ ID NO: 406829 - RNA, 64 nt, hsa; identical to SEQ ID NO: 35239

SEQ ID NO: 406830 - RNA, 64 nt, hsa; identical to SEQ ID NO: 35240

SEQ ID NO: 406831 - RNA, 64 nt, hsa; identical to SEQ ID NO: 35241

SEQ ID NO: 406832 - RNA, 64 nt, hsa; identical to SEQ ID NO: 35242

SEQ ID NO: 406833 - RNA, 64 nt, hsa; identical to SEQ ID NO: 35243

SEQ ID NO: 406834 - RNA, 64 nt, hsa; identical to SEQ ID NO: 35244

SEQ ID NO: 406835 - RNA, 64 nt, hsa; identical to SEQ ID NO: 35245

SEQ ID NO: 406836 - RNA, 64 nt, hsa; identical to SEQ ID NO: 35246

SEQ ID NO: 406837 - RNA, 64 nt, hsa; identical to SEQ ID NO: 35247

SEQ ID NO: 406838 - RNA, 64 nt, hsa; identical to SEQ ID NO: 35248

SEQ ID NO: 406839 - RNA, 64 nt, hsa; identical to SEQ ID NO: 35249

SEQ ID NO: 406840 - RNA, 64 nt, hsa; identical to SEQ ID NO: 35250

SEQ ID NO: 406841 - RNA, 64 nt, hsa; identical to SEQ ID NO: 35251

SEQ ID NO: 406842 - RNA, 64 nt, hsa; identical to SEQ ID NO: 35252

SEQ ID NO: 406843 - RNA, 64 nt, hsa; identical to SEQ ID NO: 35253

SEQ ID NO: 406844 - RNA, 64 nt, hsa; identical to SEQ ID NO: 35254

SEQ ID NO: 406845 - RNA, 64 nt, hsa; identical to SEQ ID NO: 35255

SEQ ID NO: 406846 - RNA, 64 nt, hsa; identical to SEQ ID NO: 35256

SEQ ID NO: 406847 - RNA, 64 nt, hsa; identical to SEQ ID NO: 35257

SEQ ID NO: 406848 - RNA, 64 nt, hsa; identical to SEQ ID NO: 35258

SEQ ID NO: 406849 - RNA, 64 nt, hsa; identical to SEQ ID NO: 35259

SEQ ID NO: 406850 - RNA, 64 nt, hsa; identical to SEQ ID NO: 35260

SEQ ID NO: 406851 - RNA, 64 nt, hsa; identical to SEQ ID NO: 35261

SEQ ID NO: 406852 - RNA, 64 nt, hsa; identical to SEQ ID NO: 35262

SEQ ID NO: 406853 - RNA, 64 nt, hsa; identical to SEQ ID NO: 35263

SEQ ID NO: 406854 - RNA, 64 nt, hsa; identical to SEQ ID NO: 35264

SEQ ID NO: 406855 - RNA, 64 nt, hsa; identical to SEQ ID NO: 35265

SEQ ID NO: 406856 - RNA, 64 nt, hsa; identical to SEQ ID NO: 35266

SEQ ID NO: 406857 - RNA, 64 nt, hsa; identical to SEQ ID NO: 35267

SEQ ID NO: 406858 - RNA, 64 nt, hsa; identical to SEQ ID NO: 35268

SEQ ID NO: 406859 - RNA, 64 nt, hsa; identical to SEQ ID NO: 35269

SEQ ID NO: 406860 - RNA, 64 nt, hsa; identical to SEQ ID NO: 35270

SEQ ID NO: 406861 - RNA, 64 nt, hsa; identical to SEQ ID NO: 35271

SEQ ID NO: 406862 - RNA, 64 nt, hsa; identical to SEQ ID NO: 35272

SEQ ID NO: 406863 - RNA, 64 nt, hsa; identical to SEQ ID NO: 35273

SEQ ID NO: 406864 - RNA, 64 nt, hsa; identical to SEQ ID NO: 35274

SEQ ID NO: 406865 - RNA, 64 nt, hsa; identical to SEQ ID NO: 35275

SEQ ID NO: 406866 - RNA, 64 nt, hsa; identical to SEQ ID NO: 35276

SEQ ID NO: 406867 - RNA, 64 nt, hsa; identical to SEQ ID NO: 35277

SEQ ID NO: 406868 - RNA, 64 nt, hsa; identical to SEQ ID NO: 35278

SEQ ID NO: 406869 - RNA, 64 nt, hsa; identical to SEQ ID NO: 35279

SEQ ID NO: 406870 - RNA, 64 nt, hsa; identical to SEQ ID NO: 35280

SEQ ID NO: 406871 - RNA, 64 nt, hsa; identical to SEQ ID NO: 35281

SEQ ID NO: 406872 - RNA, 64 nt, hsa; identical to SEQ ID NO: 35282

SEQ ID NO: 406873 - RNA, 64 nt, hsa; identical to SEQ ID NO: 35283

SEQ ID NO: 406874 - RNA, 64 nt, hsa; identical to SEQ ID NO: 35284

SEQ ID NO: 406875 - RNA, 64 nt, hsa; identical to SEQ ID NO: 35285

SEQ ID NO: 406876 - RNA, 64 nt, hsa; identical to SEQ ID NO: 35286

SEQ ID NO: 406877 - RNA, 64 nt, hsa; identical to SEQ ID NO: 35287

SEQ ID NO: 406878 - RNA, 64 nt, hsa; identical to SEQ ID NO: 35288

SEQ ID NO: 406879 - RNA, 64 nt, hsa; identical to SEQ ID NO: 35289

SEQ ID NO: 406880 - RNA, 64 nt, hsa; identical to SEQ ID NO: 35290

SEQ ID NO: 406881 - RNA, 64 nt, hsa; identical to SEQ ID NO: 35291

SEQ ID NO: 406882 - RNA, 64 nt, hsa; identical to SEQ ID NO: 35292

SEQ ID NO: 406883 - RNA, 64 nt, hsa; identical to SEQ ID NO: 35293

SEQ ID NO: 406884 - RNA, 64 nt, hsa; identical to SEQ ID NO: 35294

SEQ ID NO: 406885 - RNA, 64 nt, hsa; identical to SEQ ID NO: 35295

SEQ ID NO: 406886 - RNA, 64 nt, hsa; identical to SEQ ID NO: 35296

SEQ ID NO: 406887 - RNA, 64 nt, hsa; identical to SEQ ID NO: 35297

SEQ ID NO: 406888 - RNA, 64 nt, hsa; identical to SEQ ID NO: 35298

SEQ ID NO: 406889 - RNA, 64 nt, hsa; identical to SEQ ID NO: 35299

SEQ ID NO: 406890 - RNA, 64 nt, hsa; identical to SEQ ID NO: 35300

SEQ ID NO: 406891 - RNA, 64 nt, hsa; identical to SEQ ID NO: 35301

SEQ ID NO: 406892 - RNA, 64 nt, hsa; identical to SEQ ID NO: 35302

SEQ ID NO: 406893 - RNA, 64 nt, hsa; identical to SEQ ID NO: 35303

SEQ ID NO: 406894 - RNA, 64 nt, hsa; identical to SEQ ID NO: 35304

SEQ ID NO: 406895 - RNA, 64 nt, hsa; identical to SEQ ID NO: 35305

SEQ ID NO: 406896 - RNA, 64 nt, hsa; identical to SEQ ID NO: 35306

SEQ ID NO: 406897 - RNA, 64 nt, hsa; identical to SEQ ID NO: 35307

SEQ ID NO: 406898 - RNA, 64 nt, hsa; identical to SEQ ID NO: 35308

SEQ ID NO: 406899 - RNA, 64 nt, hsa; identical to SEQ ID NO: 35309

SEQ ID NO: 406900 - RNA, 64 nt, hsa; identical to SEQ ID NO: 35310

SEQ ID NO: 406901 - RNA, 64 nt, hsa; identical to SEQ ID NO: 35311

SEQ ID NO: 406902 - RNA, 64 nt, hsa; identical to SEQ ID NO: 35312

SEQ ID NO: 406903 - RNA, 64 nt, hsa; identical to SEQ ID NO: 35313

SEQ ID NO: 406904 - RNA, 64 nt, hsa; identical to SEQ ID NO: 35314

SEQ ID NO: 406905 - RNA, 64 nt, hsa; identical to SEQ ID NO: 35315

SEQ ID NO: 406906 - RNA, 64 nt, hsa; identical to SEQ ID NO: 35316

SEQ ID NO: 406907 - RNA, 64 nt, hsa; identical to SEQ ID NO: 35317

SEQ ID NO: 406908 - RNA, 64 nt, hsa; identical to SEQ ID NO: 35318

SEQ ID NO: 406909 - RNA, 64 nt, hsa; identical to SEQ ID NO: 35319

SEQ ID NO: 406910 - RNA, 64 nt, hsa; identical to SEQ ID NO: 35320

SEQ ID NO: 406911 - RNA, 64 nt, hsa; identical to SEQ ID NO: 35321

SEQ ID NO: 406912 - RNA, 64 nt, hsa; identical to SEQ ID NO: 35322

SEQ ID NO: 406913 - RNA, 64 nt, hsa; identical to SEQ ID NO: 35323

SEQ ID NO: 406914 - RNA, 64 nt, hsa; identical to SEQ ID NO: 35324

SEQ ID NO: 406915 - RNA, 64 nt, hsa; identical to SEQ ID NO: 35325

SEQ ID NO: 406916 - RNA, 64 nt, hsa; identical to SEQ ID NO: 35326

SEQ ID NO: 406917 - RNA, 64 nt, hsa; identical to SEQ ID NO: 35327

SEQ ID NO: 406918 - RNA, 64 nt, hsa; identical to SEQ ID NO: 35328

SEQ ID NO: 406919 - RNA, 64 nt, hsa; identical to SEQ ID NO: 35329

SEQ ID NO: 406920 - RNA, 64 nt, hsa; identical to SEQ ID NO: 35330

SEQ ID NO: 406921 - RNA, 64 nt, hsa; identical to SEQ ID NO: 35331

SEQ ID NO: 406922 - RNA, 64 nt, hsa; identical to SEQ ID NO: 35332

SEQ ID NO: 406923 - RNA, 64 nt, hsa; identical to SEQ ID NO: 35333

SEQ ID NO: 406924 - RNA, 64 nt, hsa; identical to SEQ ID NO: 35334

SEQ ID NO: 406925 - RNA, 64 nt, hsa; identical to SEQ ID NO: 35335

SEQ ID NO: 406926 - RNA, 64 nt, hsa; identical to SEQ ID NO: 35336

SEQ ID NO: 406927 - RNA, 64 nt, hsa; identical to SEQ ID NO: 35337

SEQ ID NO: 406928 - RNA, 64 nt, hsa; identical to SEQ ID NO: 35338

SEQ ID NO: 406929 - RNA, 64 nt, hsa; identical to SEQ ID NO: 35339

SEQ ID NO: 406930 - RNA, 64 nt, hsa; identical to SEQ ID NO: 35340

SEQ ID NO: 406931 - RNA, 64 nt, hsa; identical to SEQ ID NO: 35341

SEQ ID NO: 406932 - RNA, 64 nt, hsa; identical to SEQ ID NO: 35342

SEQ ID NO: 406933 - RNA, 64 nt, hsa; identical to SEQ ID NO: 35343

SEQ ID NO: 406934 - RNA, 64 nt, hsa; identical to SEQ ID NO: 35344

SEQ ID NO: 406935 - RNA, 64 nt, hsa; identical to SEQ ID NO: 35345

SEQ ID NO: 406936 - RNA, 64 nt, hsa; identical to SEQ ID NO: 35346

SEQ ID NO: 406937 - RNA, 64 nt, hsa; identical to SEQ ID NO: 35347

SEQ ID NO: 406938 - RNA, 64 nt, hsa; identical to SEQ ID NO: 35348

SEQ ID NO: 406939 - RNA, 64 nt, hsa; identical to SEQ ID NO: 35349

SEQ ID NO: 406940 - RNA, 64 nt, hsa; identical to SEQ ID NO: 35350

SEQ ID NO: 406941 - RNA, 64 nt, hsa; identical to SEQ ID NO: 35351

SEQ ID NO: 406942 - RNA, 64 nt, hsa; identical to SEQ ID NO: 35352

SEQ ID NO: 406943 - RNA, 64 nt, hsa; identical to SEQ ID NO: 35353

SEQ ID NO: 406944 - RNA, 64 nt, hsa; identical to SEQ ID NO: 35354

SEQ ID NO: 406945 - RNA, 64 nt, hsa; identical to SEQ ID NO: 35355

SEQ ID NO: 406946 - RNA, 64 nt, hsa; identical to SEQ ID NO: 35356

SEQ ID NO: 406947 - RNA, 64 nt, hsa; identical to SEQ ID NO: 35357

SEQ ID NO: 406948 - RNA, 64 nt, hsa; identical to SEQ ID NO: 35358

SEQ ID NO: 406949 - RNA, 64 nt, hsa; identical to SEQ ID NO: 35359

SEQ ID NO: 406950 - RNA, 64 nt, hsa; identical to SEQ ID NO: 35360

SEQ ID NO: 406951 - RNA, 64 nt, hsa; identical to SEQ ID NO: 35361

SEQ ID NO: 406952 - RNA, 64 nt, hsa; identical to SEQ ID NO: 35362

SEQ ID NO: 406953 - RNA, 64 nt, hsa; identical to SEQ ID NO: 35363

SEQ ID NO: 406954 - RNA, 64 nt, hsa; identical to SEQ ID NO: 35364

SEQ ID NO: 406955 - RNA, 64 nt, hsa; identical to SEQ ID NO: 35365

SEQ ID NO: 406956 - RNA, 64 nt, hsa; identical to SEQ ID NO: 35366

SEQ ID NO: 406957 - RNA, 64 nt, hsa; identical to SEQ ID NO: 35367

SEQ ID NO: 406958 - RNA, 64 nt, hsa; identical to SEQ ID NO: 35368

SEQ ID NO: 406959 - RNA, 64 nt, hsa; identical to SEQ ID NO: 35369

SEQ ID NO: 406960 - RNA, 64 nt, hsa; identical to SEQ ID NO: 35370

SEQ ID NO: 406961 - RNA, 64 nt, hsa; identical to SEQ ID NO: 35371

SEQ ID NO: 406962 - RNA, 64 nt, hsa; identical to SEQ ID NO: 35372

SEQ ID NO: 406963 - RNA, 64 nt, hsa; identical to SEQ ID NO: 35373

SEQ ID NO: 406964 - RNA, 64 nt, hsa; identical to SEQ ID NO: 35374

SEQ ID NO: 406965 - RNA, 64 nt, hsa; identical to SEQ ID NO: 35375

SEQ ID NO: 406966 - RNA, 64 nt, hsa; identical to SEQ ID NO: 35376

SEQ ID NO: 406967 - RNA, 64 nt, hsa; identical to SEQ ID NO: 35377

SEQ ID NO: 406968 - RNA, 64 nt, hsa; identical to SEQ ID NO: 35378

SEQ ID NO: 406969 - RNA, 64 nt, hsa; identical to SEQ ID NO: 35379

SEQ ID NO: 406970 - RNA, 64 nt, hsa; identical to SEQ ID NO: 35380

SEQ ID NO: 406971 - RNA, 64 nt, hsa; identical to SEQ ID NO: 35381

SEQ ID NO: 406972 - RNA, 64 nt, hsa; identical to SEQ ID NO: 35382

SEQ ID NO: 406973 - RNA, 64 nt, hsa; identical to SEQ ID NO: 35383

SEQ ID NO: 406974 - RNA, 64 nt, hsa; identical to SEQ ID NO: 35384

SEQ ID NO: 406975 - RNA, 64 nt, hsa; identical to SEQ ID NO: 35385

SEQ ID NO: 406976 - RNA, 64 nt, hsa; identical to SEQ ID NO: 35386

SEQ ID NO: 406977 - RNA, 64 nt, hsa; identical to SEQ ID NO: 35387

SEQ ID NO: 406978 - RNA, 64 nt, hsa; identical to SEQ ID NO: 35388

SEQ ID NO: 406979 - RNA, 64 nt, hsa; identical to SEQ ID NO: 35389

SEQ ID NO: 406980 - RNA, 64 nt, hsa; identical to SEQ ID NO: 35390

SEQ ID NO: 406981 - RNA, 64 nt, hsa; identical to SEQ ID NO: 35391

SEQ ID NO: 406982 - RNA, 64 nt, hsa; identical to SEQ ID NO: 35392

SEQ ID NO: 406983 - RNA, 64 nt, hsa; identical to SEQ ID NO: 35393

SEQ ID NO: 406984 - RNA, 64 nt, hsa; identical to SEQ ID NO: 35394

SEQ ID NO: 406985 - RNA, 64 nt, hsa; identical to SEQ ID NO: 35395

SEQ ID NO: 406986 - RNA, 64 nt, hsa; identical to SEQ ID NO: 35396

SEQ ID NO: 406987 - RNA, 64 nt, hsa; identical to SEQ ID NO: 35397

SEQ ID NO: 406988 - RNA, 64 nt, hsa; identical to SEQ ID NO: 35398

SEQ ID NO: 406989 - RNA, 64 nt, hsa; identical to SEQ ID NO: 35399

SEQ ID NO: 406990 - RNA, 64 nt, hsa; identical to SEQ ID NO: 35400

SEQ ID NO: 406991 - RNA, 64 nt, hsa; identical to SEQ ID NO: 35401

SEQ ID NO: 406992 - RNA, 64 nt, hsa; identical to SEQ ID NO: 35402

SEQ ID NO: 406993 - RNA, 64 nt, hsa; identical to SEQ ID NO: 35403

SEQ ID NO: 406994 - RNA, 64 nt, hsa; identical to SEQ ID NO: 35404

SEQ ID NO: 406995 - RNA, 64 nt, hsa; identical to SEQ ID NO: 35405

SEQ ID NO: 406996 - RNA, 64 nt, hsa; identical to SEQ ID NO: 35406

SEQ ID NO: 406997 - RNA, 64 nt, hsa; identical to SEQ ID NO: 35407

SEQ ID NO: 406998 - RNA, 64 nt, hsa; identical to SEQ ID NO: 35408

SEQ ID NO: 406999 - RNA, 64 nt, hsa; identical to SEQ ID NO: 35409

SEQ ID NO: 407000 - RNA, 64 nt, hsa; identical to SEQ ID NO: 35410

SEQ ID NO: 407001 - RNA, 64 nt, hsa; identical to SEQ ID NO: 35411

SEQ ID NO: 407002 - RNA, 64 nt, hsa; identical to SEQ ID NO: 35412

SEQ ID NO: 407003 - RNA, 64 nt, hsa; identical to SEQ ID NO: 35413

SEQ ID NO: 407004 - RNA, 64 nt, hsa; identical to SEQ ID NO: 35414

SEQ ID NO: 407005 - RNA, 64 nt, hsa; identical to SEQ ID NO: 35415

SEQ ID NO: 407006 - RNA, 64 nt, hsa; identical to SEQ ID NO: 35416

SEQ ID NO: 407007 - RNA, 64 nt, hsa; identical to SEQ ID NO: 35417

SEQ ID NO: 407008 - RNA, 64 nt, hsa; identical to SEQ ID NO: 35418

SEQ ID NO: 407009 - RNA, 64 nt, hsa; identical to SEQ ID NO: 35419

SEQ ID NO: 407010 - RNA, 64 nt, hsa; identical to SEQ ID NO: 35420

SEQ ID NO: 407011 - RNA, 64 nt, hsa; identical to SEQ ID NO: 35421

SEQ ID NO: 407012 - RNA, 64 nt, hsa; identical to SEQ ID NO: 35422

SEQ ID NO: 407013 - RNA, 64 nt, hsa; identical to SEQ ID NO: 35423

SEQ ID NO: 407014 - RNA, 64 nt, hsa; identical to SEQ ID NO: 35424

SEQ ID NO: 407015 - RNA, 64 nt, hsa; identical to SEQ ID NO: 35425

SEQ ID NO: 407016 - RNA, 64 nt, hsa; identical to SEQ ID NO: 35426

SEQ ID NO: 407017 - RNA, 64 nt, hsa; identical to SEQ ID NO: 35427

SEQ ID NO: 407018 - RNA, 64 nt, hsa; identical to SEQ ID NO: 35428

SEQ ID NO: 407019 - RNA, 64 nt, hsa; identical to SEQ ID NO: 35429

SEQ ID NO: 407020 - RNA, 64 nt, hsa; identical to SEQ ID NO: 35430

SEQ ID NO: 407021 - RNA, 64 nt, hsa; identical to SEQ ID NO: 35431

SEQ ID NO: 407022 - RNA, 64 nt, hsa; identical to SEQ ID NO: 35432

SEQ ID NO: 407023 - RNA, 64 nt, hsa; identical to SEQ ID NO: 35433

SEQ ID NO: 407024 - RNA, 64 nt, hsa; identical to SEQ ID NO: 35434

SEQ ID NO: 407025 - RNA, 64 nt, hsa; identical to SEQ ID NO: 35435

SEQ ID NO: 407026 - RNA, 64 nt, hsa; identical to SEQ ID NO: 35436

SEQ ID NO: 407027 - RNA, 64 nt, hsa; identical to SEQ ID NO: 35437

SEQ ID NO: 407028 - RNA, 64 nt, hsa; identical to SEQ ID NO: 35438

SEQ ID NO: 407029 - RNA, 64 nt, hsa; identical to SEQ ID NO: 35439

SEQ ID NO: 407030 - RNA, 64 nt, hsa; identical to SEQ ID NO: 35440

SEQ ID NO: 407031 - RNA, 64 nt, hsa; identical to SEQ ID NO: 35441

SEQ ID NO: 407032 - RNA, 64 nt, hsa; identical to SEQ ID NO: 35442

SEQ ID NO: 407033 - RNA, 64 nt, hsa; identical to SEQ ID NO: 35443

SEQ ID NO: 407034 - RNA, 64 nt, hsa; identical to SEQ ID NO: 35444

SEQ ID NO: 407035 - RNA, 64 nt, hsa; identical to SEQ ID NO: 35445

SEQ ID NO: 407036 - RNA, 64 nt, hsa; identical to SEQ ID NO: 35446

SEQ ID NO: 407037 - RNA, 64 nt, hsa; identical to SEQ ID NO: 35447

SEQ ID NO: 407038 - RNA, 64 nt, hsa; identical to SEQ ID NO: 35448

SEQ ID NO: 407039 - RNA, 64 nt, hsa; identical to SEQ ID NO: 35449

SEQ ID NO: 407040 - RNA, 64 nt, hsa; identical to SEQ ID NO: 35450

SEQ ID NO: 407041 - RNA, 64 nt, hsa; identical to SEQ ID NO: 35451

SEQ ID NO: 407042 - RNA, 64 nt, hsa; identical to SEQ ID NO: 35452

SEQ ID NO: 407043 - RNA, 64 nt, hsa; identical to SEQ ID NO: 35453

SEQ ID NO: 407044 - RNA, 64 nt, hsa; identical to SEQ ID NO: 35454

SEQ ID NO: 407045 - RNA, 64 nt, hsa; identical to SEQ ID NO: 35455

SEQ ID NO: 407046 - RNA, 64 nt, hsa; identical to SEQ ID NO: 35456

SEQ ID NO: 407047 - RNA, 64 nt, hsa; identical to SEQ ID NO: 35457

SEQ ID NO: 407048 - RNA, 64 nt, hsa; identical to SEQ ID NO: 35458

SEQ ID NO: 407049 - RNA, 64 nt, hsa; identical to SEQ ID NO: 35459

SEQ ID NO: 407050 - RNA, 64 nt, hsa; identical to SEQ ID NO: 35460

SEQ ID NO: 407051 - RNA, 64 nt, hsa; identical to SEQ ID NO: 35461

SEQ ID NO: 407052 - RNA, 64 nt, hsa; identical to SEQ ID NO: 35462

SEQ ID NO: 407053 - RNA, 64 nt, hsa; identical to SEQ ID NO: 35463

SEQ ID NO: 407054 - RNA, 64 nt, hsa; identical to SEQ ID NO: 35464

SEQ ID NO: 407055 - RNA, 64 nt, hsa; identical to SEQ ID NO: 35465

SEQ ID NO: 407056 - RNA, 64 nt, hsa; identical to SEQ ID NO: 35466

SEQ ID NO: 407057 - RNA, 64 nt, hsa; identical to SEQ ID NO: 35467

SEQ ID NO: 407058 - RNA, 64 nt, hsa; identical to SEQ ID NO: 35468

SEQ ID NO: 407059 - RNA, 64 nt, hsa; identical to SEQ ID NO: 35469

SEQ ID NO: 407060 - RNA, 64 nt, hsa; identical to SEQ ID NO: 35470

SEQ ID NO: 407061 - RNA, 64 nt, hsa; identical to SEQ ID NO: 35471

SEQ ID NO: 407062 - RNA, 64 nt, hsa; identical to SEQ ID NO: 35472

SEQ ID NO: 407063 - RNA, 64 nt, hsa; identical to SEQ ID NO: 35473

SEQ ID NO: 407064 - RNA, 64 nt, hsa; identical to SEQ ID NO: 35474

SEQ ID NO: 407065 - RNA, 64 nt, hsa; identical to SEQ ID NO: 35475

SEQ ID NO: 407066 - RNA, 64 nt, hsa; identical to SEQ ID NO: 35476

SEQ ID NO: 407067 - RNA, 64 nt, hsa; identical to SEQ ID NO: 35477

SEQ ID NO: 407068 - RNA, 64 nt, hsa; identical to SEQ ID NO: 35478

SEQ ID NO: 407069 - RNA, 64 nt, hsa; identical to SEQ ID NO: 35479

SEQ ID NO: 407070 - RNA, 61 nt, hsa; identical to SEQ ID NO: 35480

SEQ ID NO: 407071 - RNA, 60 nt, hsa; identical to SEQ ID NO: 35481

SEQ ID NO: 407072 - RNA, 59 nt, hsa; identical to SEQ ID NO: 35482

SEQ ID NO: 407073 - RNA, 58 nt, hsa; identical to SEQ ID NO: 35483

SEQ ID NO: 407074 - RNA, 57 nt, hsa; identical to SEQ ID NO: 35484

SEQ ID NO: 407075 - RNA, 64 nt, hsa; identical to SEQ ID NO: 35485

SEQ ID NO: 407076 - RNA, 64 nt, hsa; identical to SEQ ID NO: 35486

SEQ ID NO: 407077 - RNA, 64 nt, hsa; identical to SEQ ID NO: 35487

SEQ ID NO: 407078 - RNA, 64 nt, hsa; identical to SEQ ID NO: 35488

SEQ ID NO: 407079 - RNA, 64 nt, hsa; identical to SEQ ID NO: 35489

SEQ ID NO: 407080 - RNA, 64 nt, hsa; identical to SEQ ID NO: 35490

SEQ ID NO: 407081 - RNA, 64 nt, hsa; identical to SEQ ID NO: 35491

SEQ ID NO: 407082 - RNA, 64 nt, hsa; identical to SEQ ID NO: 35492

SEQ ID NO: 407083 - RNA, 64 nt, hsa; identical to SEQ ID NO: 35493

SEQ ID NO: 407084 - RNA, 64 nt, hsa; identical to SEQ ID NO: 35494

SEQ ID NO: 407085 - RNA, 64 nt, hsa; identical to SEQ ID NO: 35495

SEQ ID NO: 407086 - RNA, 64 nt, hsa; identical to SEQ ID NO: 35496

SEQ ID NO: 407087 - RNA, 64 nt, hsa; identical to SEQ ID NO: 35497

SEQ ID NO: 407088 - RNA, 64 nt, hsa; identical to SEQ ID NO: 35498

SEQ ID NO: 407089 - RNA, 64 nt, hsa; identical to SEQ ID NO: 35499

SEQ ID NO: 407090 - RNA, 64 nt, hsa; identical to SEQ ID NO: 35500

SEQ ID NO: 407091 - RNA, 64 nt, hsa; identical to SEQ ID NO: 35501

SEQ ID NO: 407092 - RNA, 64 nt, hsa; identical to SEQ ID NO: 35502

SEQ ID NO: 407093 - RNA, 64 nt, hsa; identical to SEQ ID NO: 35503

SEQ ID NO: 407094 - RNA, 64 nt, hsa; identical to SEQ ID NO: 35504

SEQ ID NO: 407095 - RNA, 64 nt, hsa; identical to SEQ ID NO: 35505

SEQ ID NO: 407096 - RNA, 64 nt, hsa; identical to SEQ ID NO: 35506

SEQ ID NO: 407097 - RNA, 64 nt, hsa; identical to SEQ ID NO: 35507

SEQ ID NO: 407098 - RNA, 64 nt, hsa; identical to SEQ ID NO: 35508

SEQ ID NO: 407099 - RNA, 64 nt, hsa; identical to SEQ ID NO: 35509

SEQ ID NO: 407100 - RNA, 64 nt, hsa; identical to SEQ ID NO: 35510

SEQ ID NO: 407101 - RNA, 64 nt, hsa; identical to SEQ ID NO: 35511

SEQ ID NO: 407102 - RNA, 64 nt, hsa; identical to SEQ ID NO: 35512

SEQ ID NO: 407103 - RNA, 64 nt, hsa; identical to SEQ ID NO: 35513

SEQ ID NO: 407104 - RNA, 64 nt, hsa; identical to SEQ ID NO: 35514

SEQ ID NO: 407105 - RNA, 64 nt, hsa; identical to SEQ ID NO: 35515

SEQ ID NO: 407106 - RNA, 64 nt, hsa; identical to SEQ ID NO: 35516

SEQ ID NO: 407107 - RNA, 64 nt, hsa; identical to SEQ ID NO: 35517

SEQ ID NO: 407108 - RNA, 64 nt, hsa; identical to SEQ ID NO: 35518

SEQ ID NO: 407109 - RNA, 64 nt, hsa; identical to SEQ ID NO: 35519

SEQ ID NO: 407110 - RNA, 64 nt, hsa; identical to SEQ ID NO: 35520

SEQ ID NO: 407111 - RNA, 64 nt, hsa; identical to SEQ ID NO: 35521

SEQ ID NO: 407112 - RNA, 64 nt, hsa; identical to SEQ ID NO: 35522

SEQ ID NO: 407113 - RNA, 64 nt, hsa; identical to SEQ ID NO: 35523

SEQ ID NO: 407114 - RNA, 64 nt, hsa; identical to SEQ ID NO: 35524

SEQ ID NO: 407115 - RNA, 64 nt, hsa; identical to SEQ ID NO: 35525

SEQ ID NO: 407116 - RNA, 64 nt, hsa; identical to SEQ ID NO: 35526

SEQ ID NO: 407117 - RNA, 64 nt, hsa; identical to SEQ ID NO: 35527

SEQ ID NO: 407118 - RNA, 64 nt, hsa; identical to SEQ ID NO: 35528

SEQ ID NO: 407119 - RNA, 64 nt, hsa; identical to SEQ ID NO: 35529

SEQ ID NO: 407120 - RNA, 64 nt, hsa; identical to SEQ ID NO: 35530

SEQ ID NO: 407121 - RNA, 64 nt, hsa; identical to SEQ ID NO: 35531

SEQ ID NO: 407122 - RNA, 64 nt, hsa; identical to SEQ ID NO: 35532

SEQ ID NO: 407123 - RNA, 64 nt, hsa; identical to SEQ ID NO: 35533

SEQ ID NO: 407124 - RNA, 64 nt, hsa; identical to SEQ ID NO: 35534

SEQ ID NO: 407125 - RNA, 64 nt, hsa; identical to SEQ ID NO: 35535

SEQ ID NO: 407126 - RNA, 64 nt, hsa; identical to SEQ ID NO: 35536

SEQ ID NO: 407127 - RNA, 64 nt, hsa; identical to SEQ ID NO: 35537

SEQ ID NO: 407128 - RNA, 64 nt, hsa; identical to SEQ ID NO: 35538

SEQ ID NO: 407129 - RNA, 64 nt, hsa; identical to SEQ ID NO: 35539

SEQ ID NO: 407130 - RNA, 64 nt, hsa; identical to SEQ ID NO: 35540

SEQ ID NO: 407131 - RNA, 64 nt, hsa; identical to SEQ ID NO: 35541

SEQ ID NO: 407132 - RNA, 64 nt, hsa; identical to SEQ ID NO: 35542

SEQ ID NO: 407133 - RNA, 64 nt, hsa; identical to SEQ ID NO: 35543

SEQ ID NO: 407134 - RNA, 64 nt, hsa; identical to SEQ ID NO: 35544

SEQ ID NO: 407135 - RNA, 64 nt, hsa; identical to SEQ ID NO: 35545

SEQ ID NO: 407136 - RNA, 64 nt, hsa; identical to SEQ ID NO: 35546

SEQ ID NO: 407137 - RNA, 64 nt, hsa; identical to SEQ ID NO: 35547

SEQ ID NO: 407138 - RNA, 64 nt, hsa; identical to SEQ ID NO: 35548

SEQ ID NO: 407139 - RNA, 64 nt, hsa; identical to SEQ ID NO: 35549

SEQ ID NO: 407140 - RNA, 64 nt, hsa; identical to SEQ ID NO: 35550

SEQ ID NO: 407141 - RNA, 64 nt, hsa; identical to SEQ ID NO: 35551

SEQ ID NO: 407142 - RNA, 64 nt, hsa; identical to SEQ ID NO: 35552

SEQ ID NO: 407143 - RNA, 64 nt, hsa; identical to SEQ ID NO: 35553

SEQ ID NO: 407144 - RNA, 64 nt, hsa; identical to SEQ ID NO: 35554

SEQ ID NO: 407145 - RNA, 64 nt, hsa; identical to SEQ ID NO: 35555

SEQ ID NO: 407146 - RNA, 64 nt, hsa; identical to SEQ ID NO: 35556

SEQ ID NO: 407147 - RNA, 64 nt, hsa; identical to SEQ ID NO: 35557

SEQ ID NO: 407148 - RNA, 64 nt, hsa; identical to SEQ ID NO: 35558

SEQ ID NO: 407149 - RNA, 64 nt, hsa; identical to SEQ ID NO: 35559

SEQ ID NO: 407150 - RNA, 64 nt, hsa; identical to SEQ ID NO: 35560

SEQ ID NO: 407151 - RNA, 64 nt, hsa; identical to SEQ ID NO: 35561

SEQ ID NO: 407152 - RNA, 64 nt, hsa; identical to SEQ ID NO: 35562

SEQ ID NO: 407153 - RNA, 64 nt, hsa; identical to SEQ ID NO: 35563

SEQ ID NO: 407154 - RNA, 64 nt, hsa; identical to SEQ ID NO: 35564

SEQ ID NO: 407155 - RNA, 64 nt, hsa; identical to SEQ ID NO: 35565

SEQ ID NO: 407156 - RNA, 64 nt, hsa; identical to SEQ ID NO: 35566

SEQ ID NO: 407157 - RNA, 64 nt, hsa; identical to SEQ ID NO: 35567

SEQ ID NO: 407158 - RNA, 64 nt, hsa; identical to SEQ ID NO: 35568

SEQ ID NO: 407159 - RNA, 64 nt, hsa; identical to SEQ ID NO: 35569

SEQ ID NO: 407160 - RNA, 64 nt, hsa; identical to SEQ ID NO: 35570

SEQ ID NO: 407161 - RNA, 64 nt, hsa; identical to SEQ ID NO: 35571

SEQ ID NO: 407162 - RNA, 64 nt, hsa; identical to SEQ ID NO: 35572

SEQ ID NO: 407163 - RNA, 64 nt, hsa; identical to SEQ ID NO: 35573

SEQ ID NO: 407164 - RNA, 64 nt, hsa; identical to SEQ ID NO: 35574

SEQ ID NO: 407165 - RNA, 64 nt, hsa; identical to SEQ ID NO: 35575

SEQ ID NO: 407166 - RNA, 64 nt, hsa; identical to SEQ ID NO: 35576

SEQ ID NO: 407167 - RNA, 64 nt, hsa; identical to SEQ ID NO: 35577

SEQ ID NO: 407168 - RNA, 64 nt, hsa; identical to SEQ ID NO: 35578

SEQ ID NO: 407169 - RNA, 64 nt, hsa; identical to SEQ ID NO: 35579

SEQ ID NO: 407170 - RNA, 64 nt, hsa; identical to SEQ ID NO: 35580

SEQ ID NO: 407171 - RNA, 64 nt, hsa; identical to SEQ ID NO: 35581

SEQ ID NO: 407172 - RNA, 64 nt, hsa; identical to SEQ ID NO: 35582

SEQ ID NO: 407173 - RNA, 64 nt, hsa; identical to SEQ ID NO: 35583

SEQ ID NO: 407174 - RNA, 64 nt, hsa; identical to SEQ ID NO: 35584

SEQ ID NO: 407175 - RNA, 64 nt, hsa; identical to SEQ ID NO: 35585

SEQ ID NO: 407176 - RNA, 64 nt, hsa; identical to SEQ ID NO: 35586

SEQ ID NO: 407177 - RNA, 64 nt, hsa; identical to SEQ ID NO: 35587

SEQ ID NO: 407178 - RNA, 64 nt, hsa; identical to SEQ ID NO: 35588

SEQ ID NO: 407179 - RNA, 64 nt, hsa; identical to SEQ ID NO: 35589

SEQ ID NO: 407180 - RNA, 64 nt, hsa; identical to SEQ ID NO: 35590

SEQ ID NO: 407181 - RNA, 64 nt, hsa; identical to SEQ ID NO: 35591

SEQ ID NO: 407182 - RNA, 64 nt, hsa; identical to SEQ ID NO: 35592

SEQ ID NO: 407183 - RNA, 64 nt, hsa; identical to SEQ ID NO: 35593

SEQ ID NO: 407184 - RNA, 64 nt, hsa; identical to SEQ ID NO: 35594

SEQ ID NO: 407185 - RNA, 64 nt, hsa; identical to SEQ ID NO: 35595

SEQ ID NO: 407186 - RNA, 64 nt, hsa; identical to SEQ ID NO: 35596

SEQ ID NO: 407187 - RNA, 64 nt, hsa; identical to SEQ ID NO: 35597

SEQ ID NO: 407188 - RNA, 64 nt, hsa; identical to SEQ ID NO: 35598

SEQ ID NO: 407189 - RNA, 64 nt, hsa; identical to SEQ ID NO: 35599

SEQ ID NO: 407190 - RNA, 64 nt, hsa; identical to SEQ ID NO: 35600

SEQ ID NO: 407191 - RNA, 64 nt, hsa; identical to SEQ ID NO: 35601

SEQ ID NO: 407192 - RNA, 64 nt, hsa; identical to SEQ ID NO: 35602

SEQ ID NO: 407193 - RNA, 64 nt, hsa; identical to SEQ ID NO: 35603

SEQ ID NO: 407194 - RNA, 64 nt, hsa; identical to SEQ ID NO: 35604

SEQ ID NO: 407195 - RNA, 64 nt, hsa; identical to SEQ ID NO: 35605

SEQ ID NO: 407196 - RNA, 64 nt, hsa; identical to SEQ ID NO: 35606

SEQ ID NO: 407197 - RNA, 64 nt, hsa; identical to SEQ ID NO: 35607

SEQ ID NO: 407198 - RNA, 64 nt, hsa; identical to SEQ ID NO: 35608

SEQ ID NO: 407199 - RNA, 64 nt, hsa; identical to SEQ ID NO: 35609

SEQ ID NO: 407200 - RNA, 64 nt, hsa; identical to SEQ ID NO: 35610

SEQ ID NO: 407201 - RNA, 64 nt, hsa; identical to SEQ ID NO: 35611

SEQ ID NO: 407202 - RNA, 64 nt, hsa; identical to SEQ ID NO: 35612

SEQ ID NO: 407203 - RNA, 64 nt, hsa; identical to SEQ ID NO: 35613

SEQ ID NO: 407204 - RNA, 64 nt, hsa; identical to SEQ ID NO: 35614

SEQ ID NO: 407205 - RNA, 64 nt, hsa; identical to SEQ ID NO: 35615

SEQ ID NO: 407206 - RNA, 64 nt, hsa; identical to SEQ ID NO: 35616

SEQ ID NO: 407207 - RNA, 64 nt, hsa; identical to SEQ ID NO: 35617

SEQ ID NO: 407208 - RNA, 64 nt, hsa; identical to SEQ ID NO: 35618

SEQ ID NO: 407209 - RNA, 64 nt, hsa; identical to SEQ ID NO: 35619

SEQ ID NO: 407210 - RNA, 64 nt, hsa; identical to SEQ ID NO: 35620

SEQ ID NO: 407211 - RNA, 64 nt, hsa; identical to SEQ ID NO: 35621

SEQ ID NO: 407212 - RNA, 64 nt, hsa; identical to SEQ ID NO: 35622

SEQ ID NO: 407213 - RNA, 64 nt, hsa; identical to SEQ ID NO: 35623

SEQ ID NO: 407214 - RNA, 64 nt, hsa; identical to SEQ ID NO: 35624

SEQ ID NO: 407215 - RNA, 64 nt, hsa; identical to SEQ ID NO: 35625

SEQ ID NO: 407216 - RNA, 64 nt, hsa; identical to SEQ ID NO: 35626

SEQ ID NO: 407217 - RNA, 64 nt, hsa; identical to SEQ ID NO: 35627

SEQ ID NO: 407218 - RNA, 64 nt, hsa; identical to SEQ ID NO: 35628

SEQ ID NO: 407219 - RNA, 64 nt, hsa; identical to SEQ ID NO: 35629

SEQ ID NO: 407220 - RNA, 64 nt, hsa; identical to SEQ ID NO: 35630

SEQ ID NO: 407221 - RNA, 64 nt, hsa; identical to SEQ ID NO: 35631

SEQ ID NO: 407222 - RNA, 64 nt, hsa; identical to SEQ ID NO: 35632

SEQ ID NO: 407223 - RNA, 64 nt, hsa; identical to SEQ ID NO: 35633

SEQ ID NO: 407224 - RNA, 64 nt, hsa; identical to SEQ ID NO: 35634

SEQ ID NO: 407225 - RNA, 64 nt, hsa; identical to SEQ ID NO: 35635

SEQ ID NO: 407226 - RNA, 64 nt, hsa; identical to SEQ ID NO: 35636

SEQ ID NO: 407227 - RNA, 64 nt, hsa; identical to SEQ ID NO: 35637

SEQ ID NO: 407228 - RNA, 64 nt, hsa; identical to SEQ ID NO: 35638

SEQ ID NO: 407229 - RNA, 64 nt, hsa; identical to SEQ ID NO: 35639

SEQ ID NO: 407230 - RNA, 64 nt, hsa; identical to SEQ ID NO: 35640

SEQ ID NO: 407231 - RNA, 64 nt, hsa; identical to SEQ ID NO: 35641

SEQ ID NO: 407232 - RNA, 64 nt, hsa; identical to SEQ ID NO: 35642

SEQ ID NO: 407233 - RNA, 64 nt, hsa; identical to SEQ ID NO: 35643

SEQ ID NO: 407234 - RNA, 64 nt, hsa; identical to SEQ ID NO: 35644

SEQ ID NO: 407235 - RNA, 64 nt, hsa; identical to SEQ ID NO: 35645

SEQ ID NO: 407236 - RNA, 64 nt, hsa; identical to SEQ ID NO: 35646

SEQ ID NO: 407237 - RNA, 64 nt, hsa; identical to SEQ ID NO: 35647

SEQ ID NO: 407238 - RNA, 64 nt, hsa; identical to SEQ ID NO: 35648

SEQ ID NO: 407239 - RNA, 64 nt, hsa; identical to SEQ ID NO: 35649

SEQ ID NO: 407240 - RNA, 64 nt, hsa; identical to SEQ ID NO: 35650

SEQ ID NO: 407241 - RNA, 64 nt, hsa; identical to SEQ ID NO: 35651

SEQ ID NO: 407242 - RNA, 64 nt, hsa; identical to SEQ ID NO: 35652

SEQ ID NO: 407243 - RNA, 64 nt, hsa; identical to SEQ ID NO: 35653

SEQ ID NO: 407244 - RNA, 64 nt, hsa; identical to SEQ ID NO: 35654

SEQ ID NO: 407245 - RNA, 64 nt, hsa; identical to SEQ ID NO: 35655

SEQ ID NO: 407246 - RNA, 64 nt, hsa; identical to SEQ ID NO: 35656

SEQ ID NO: 407247 - RNA, 64 nt, hsa; identical to SEQ ID NO: 35657

SEQ ID NO: 407248 - RNA, 64 nt, hsa; identical to SEQ ID NO: 35658

SEQ ID NO: 407249 - RNA, 64 nt, hsa; identical to SEQ ID NO: 35659

SEQ ID NO: 407250 - RNA, 64 nt, hsa; identical to SEQ ID NO: 35660

SEQ ID NO: 407251 - RNA, 64 nt, hsa; identical to SEQ ID NO: 35661

SEQ ID NO: 407252 - RNA, 64 nt, hsa; identical to SEQ ID NO: 35662

SEQ ID NO: 407253 - RNA, 64 nt, hsa; identical to SEQ ID NO: 35663

SEQ ID NO: 407254 - RNA, 64 nt, hsa; identical to SEQ ID NO: 35664

SEQ ID NO: 407255 - RNA, 64 nt, hsa; identical to SEQ ID NO: 35665

SEQ ID NO: 407256 - RNA, 64 nt, hsa; identical to SEQ ID NO: 35666

SEQ ID NO: 407257 - RNA, 64 nt, hsa; identical to SEQ ID NO: 35667

SEQ ID NO: 407258 - RNA, 64 nt, hsa; identical to SEQ ID NO: 35668

SEQ ID NO: 407259 - RNA, 64 nt, hsa; identical to SEQ ID NO: 35669

SEQ ID NO: 407260 - RNA, 64 nt, hsa; identical to SEQ ID NO: 35670

SEQ ID NO: 407261 - RNA, 64 nt, hsa; identical to SEQ ID NO: 35671

SEQ ID NO: 407262 - RNA, 64 nt, hsa; identical to SEQ ID NO: 35672

SEQ ID NO: 407263 - RNA, 64 nt, hsa; identical to SEQ ID NO: 35673

SEQ ID NO: 407264 - RNA, 64 nt, hsa; identical to SEQ ID NO: 35674

SEQ ID NO: 407265 - RNA, 64 nt, hsa; identical to SEQ ID NO: 35675

SEQ ID NO: 407266 - RNA, 64 nt, hsa; identical to SEQ ID NO: 35676

SEQ ID NO: 407267 - RNA, 64 nt, hsa; identical to SEQ ID NO: 35677

SEQ ID NO: 407268 - RNA, 64 nt, hsa; identical to SEQ ID NO: 35678

SEQ ID NO: 407269 - RNA, 64 nt, hsa; identical to SEQ ID NO: 35679

SEQ ID NO: 407270 - RNA, 64 nt, hsa; identical to SEQ ID NO: 35680

SEQ ID NO: 407271 - RNA, 64 nt, hsa; identical to SEQ ID NO: 35681

SEQ ID NO: 407272 - RNA, 64 nt, hsa; identical to SEQ ID NO: 35682

SEQ ID NO: 407273 - RNA, 64 nt, hsa; identical to SEQ ID NO: 35683

SEQ ID NO: 407274 - RNA, 64 nt, hsa; identical to SEQ ID NO: 35684

SEQ ID NO: 407275 - RNA, 64 nt, hsa; identical to SEQ ID NO: 35685

SEQ ID NO: 407276 - RNA, 64 nt, hsa; identical to SEQ ID NO: 35686

SEQ ID NO: 407277 - RNA, 64 nt, hsa; identical to SEQ ID NO: 35687

SEQ ID NO: 407278 - RNA, 64 nt, hsa; identical to SEQ ID NO: 35688

SEQ ID NO: 407279 - RNA, 64 nt, hsa; identical to SEQ ID NO: 35689

SEQ ID NO: 407280 - RNA, 64 nt, hsa; identical to SEQ ID NO: 35690

SEQ ID NO: 407281 - RNA, 64 nt, hsa; identical to SEQ ID NO: 35691

SEQ ID NO: 407282 - RNA, 64 nt, hsa; identical to SEQ ID NO: 35692

SEQ ID NO: 407283 - RNA, 64 nt, hsa; identical to SEQ ID NO: 35693

SEQ ID NO: 407284 - RNA, 64 nt, hsa; identical to SEQ ID NO: 35694

SEQ ID NO: 407285 - RNA, 64 nt, hsa; identical to SEQ ID NO: 35695

SEQ ID NO: 407286 - RNA, 64 nt, hsa; identical to SEQ ID NO: 35696

SEQ ID NO: 407287 - RNA, 64 nt, hsa; identical to SEQ ID NO: 35697

SEQ ID NO: 407288 - RNA, 64 nt, hsa; identical to SEQ ID NO: 35698

SEQ ID NO: 407289 - RNA, 64 nt, hsa; identical to SEQ ID NO: 35699

SEQ ID NO: 407290 - RNA, 64 nt, hsa; identical to SEQ ID NO: 35700

SEQ ID NO: 407291 - RNA, 64 nt, hsa; identical to SEQ ID NO: 35701

SEQ ID NO: 407292 - RNA, 64 nt, hsa; identical to SEQ ID NO: 35702

SEQ ID NO: 407293 - RNA, 64 nt, hsa; identical to SEQ ID NO: 35703

SEQ ID NO: 407294 - RNA, 64 nt, hsa; identical to SEQ ID NO: 35704

SEQ ID NO: 407295 - RNA, 64 nt, hsa; identical to SEQ ID NO: 35705

SEQ ID NO: 407296 - RNA, 64 nt, hsa; identical to SEQ ID NO: 35706

SEQ ID NO: 407297 - RNA, 64 nt, hsa; identical to SEQ ID NO: 35707

SEQ ID NO: 407298 - RNA, 64 nt, hsa; identical to SEQ ID NO: 35708

SEQ ID NO: 407299 - RNA, 64 nt, hsa; identical to SEQ ID NO: 35709

SEQ ID NO: 407300 - RNA, 64 nt, hsa; identical to SEQ ID NO: 35710

SEQ ID NO: 407301 - RNA, 64 nt, hsa; identical to SEQ ID NO: 35711

SEQ ID NO: 407302 - RNA, 64 nt, hsa; identical to SEQ ID NO: 35712

SEQ ID NO: 407303 - RNA, 64 nt, hsa; identical to SEQ ID NO: 35713

SEQ ID NO: 407304 - RNA, 64 nt, hsa; identical to SEQ ID NO: 35714

SEQ ID NO: 407305 - RNA, 64 nt, hsa; identical to SEQ ID NO: 35715

SEQ ID NO: 407306 - RNA, 64 nt, hsa; identical to SEQ ID NO: 35716

SEQ ID NO: 407307 - RNA, 64 nt, hsa; identical to SEQ ID NO: 35717

SEQ ID NO: 407308 - RNA, 64 nt, hsa; identical to SEQ ID NO: 35718

SEQ ID NO: 407309 - RNA, 64 nt, hsa; identical to SEQ ID NO: 35719

SEQ ID NO: 407310 - RNA, 64 nt, hsa; identical to SEQ ID NO: 35720

SEQ ID NO: 407311 - RNA, 64 nt, hsa; identical to SEQ ID NO: 35721

SEQ ID NO: 407312 - RNA, 64 nt, hsa; identical to SEQ ID NO: 35722

SEQ ID NO: 407313 - RNA, 64 nt, hsa; identical to SEQ ID NO: 35723

SEQ ID NO: 407314 - RNA, 64 nt, hsa; identical to SEQ ID NO: 35724

SEQ ID NO: 407315 - RNA, 64 nt, hsa; identical to SEQ ID NO: 35725

SEQ ID NO: 407316 - RNA, 64 nt, hsa; identical to SEQ ID NO: 35726

SEQ ID NO: 407317 - RNA, 64 nt, hsa; identical to SEQ ID NO: 35727

SEQ ID NO: 407318 - RNA, 64 nt, hsa; identical to SEQ ID NO: 35728

SEQ ID NO: 407319 - RNA, 64 nt, hsa; identical to SEQ ID NO: 35729

SEQ ID NO: 407320 - RNA, 64 nt, hsa; identical to SEQ ID NO: 35730

SEQ ID NO: 407321 - RNA, 64 nt, hsa; identical to SEQ ID NO: 35731

SEQ ID NO: 407322 - RNA, 64 nt, hsa; identical to SEQ ID NO: 35732

SEQ ID NO: 407323 - RNA, 64 nt, hsa; identical to SEQ ID NO: 35733

SEQ ID NO: 407324 - RNA, 64 nt, hsa; identical to SEQ ID NO: 35734

SEQ ID NO: 407325 - RNA, 64 nt, hsa; identical to SEQ ID NO: 35735

SEQ ID NO: 407326 - RNA, 64 nt, hsa; identical to SEQ ID NO: 35736

SEQ ID NO: 407327 - RNA, 64 nt, hsa; identical to SEQ ID NO: 35737

SEQ ID NO: 407328 - RNA, 64 nt, hsa; identical to SEQ ID NO: 35738

SEQ ID NO: 407329 - RNA, 64 nt, hsa; identical to SEQ ID NO: 35739

SEQ ID NO: 407330 - RNA, 64 nt, hsa; identical to SEQ ID NO: 35740

SEQ ID NO: 407331 - RNA, 64 nt, hsa; identical to SEQ ID NO: 35741

SEQ ID NO: 407332 - RNA, 64 nt, hsa; identical to SEQ ID NO: 35742

SEQ ID NO: 407333 - RNA, 64 nt, hsa; identical to SEQ ID NO: 35743

SEQ ID NO: 407334 - RNA, 64 nt, hsa; identical to SEQ ID NO: 35744

SEQ ID NO: 407335 - RNA, 64 nt, hsa; identical to SEQ ID NO: 35745

SEQ ID NO: 407336 - RNA, 64 nt, hsa; identical to SEQ ID NO: 35746

SEQ ID NO: 407337 - RNA, 64 nt, hsa; identical to SEQ ID NO: 35747

SEQ ID NO: 407338 - RNA, 64 nt, hsa; identical to SEQ ID NO: 35748

SEQ ID NO: 407339 - RNA, 64 nt, hsa; identical to SEQ ID NO: 35749

SEQ ID NO: 407340 - RNA, 64 nt, hsa; identical to SEQ ID NO: 35750

SEQ ID NO: 407341 - RNA, 64 nt, hsa; identical to SEQ ID NO: 35751

SEQ ID NO: 407342 - RNA, 64 nt, hsa; identical to SEQ ID NO: 35752

SEQ ID NO: 407343 - RNA, 64 nt, hsa; identical to SEQ ID NO: 35753

SEQ ID NO: 407344 - RNA, 64 nt, hsa; identical to SEQ ID NO: 35754

SEQ ID NO: 407345 - RNA, 64 nt, hsa; identical to SEQ ID NO: 35755

SEQ ID NO: 407346 - RNA, 64 nt, hsa; identical to SEQ ID NO: 35756

SEQ ID NO: 407347 - RNA, 64 nt, hsa; identical to SEQ ID NO: 35757

SEQ ID NO: 407348 - RNA, 64 nt, hsa; identical to SEQ ID NO: 35758

SEQ ID NO: 407349 - RNA, 64 nt, hsa; identical to SEQ ID NO: 35759

SEQ ID NO: 407350 - RNA, 64 nt, hsa; identical to SEQ ID NO: 35760

SEQ ID NO: 407351 - RNA, 64 nt, hsa; identical to SEQ ID NO: 35761

SEQ ID NO: 407352 - RNA, 64 nt, hsa; identical to SEQ ID NO: 35762

SEQ ID NO: 407353 - RNA, 64 nt, hsa; identical to SEQ ID NO: 35763

SEQ ID NO: 407354 - RNA, 64 nt, hsa; identical to SEQ ID NO: 35764

SEQ ID NO: 407355 - RNA, 64 nt, hsa; identical to SEQ ID NO: 35765

SEQ ID NO: 407356 - RNA, 64 nt, hsa; identical to SEQ ID NO: 35766

SEQ ID NO: 407357 - RNA, 64 nt, hsa; identical to SEQ ID NO: 35767

SEQ ID NO: 407358 - RNA, 64 nt, hsa; identical to SEQ ID NO: 35768

SEQ ID NO: 407359 - RNA, 64 nt, hsa; identical to SEQ ID NO: 35769

SEQ ID NO: 407360 - RNA, 64 nt, hsa; identical to SEQ ID NO: 35770

SEQ ID NO: 407361 - RNA, 64 nt, hsa; identical to SEQ ID NO: 35771

SEQ ID NO: 407362 - RNA, 64 nt, hsa; identical to SEQ ID NO: 35772

SEQ ID NO: 407363 - RNA, 64 nt, hsa; identical to SEQ ID NO: 35773

SEQ ID NO: 407364 - RNA, 64 nt, hsa; identical to SEQ ID NO: 35774

SEQ ID NO: 407365 - RNA, 64 nt, hsa; identical to SEQ ID NO: 35775

SEQ ID NO: 407366 - RNA, 64 nt, hsa; identical to SEQ ID NO: 35776

SEQ ID NO: 407367 - RNA, 64 nt, hsa; identical to SEQ ID NO: 35777

SEQ ID NO: 407368 - RNA, 64 nt, hsa; identical to SEQ ID NO: 35778

SEQ ID NO: 407369 - RNA, 64 nt, hsa; identical to SEQ ID NO: 35779

SEQ ID NO: 407370 - RNA, 64 nt, hsa; identical to SEQ ID NO: 35780

SEQ ID NO: 407371 - RNA, 64 nt, hsa; identical to SEQ ID NO: 35781

SEQ ID NO: 407372 - RNA, 64 nt, hsa; identical to SEQ ID NO: 35782

SEQ ID NO: 407373 - RNA, 64 nt, hsa; identical to SEQ ID NO: 35783

SEQ ID NO: 407374 - RNA, 64 nt, hsa; identical to SEQ ID NO: 35784

SEQ ID NO: 407375 - RNA, 64 nt, hsa; identical to SEQ ID NO: 35785

SEQ ID NO: 407376 - RNA, 64 nt, hsa; identical to SEQ ID NO: 35786

SEQ ID NO: 407377 - RNA, 64 nt, hsa; identical to SEQ ID NO: 35787

SEQ ID NO: 407378 - RNA, 64 nt, hsa; identical to SEQ ID NO: 35788

SEQ ID NO: 407379 - RNA, 64 nt, hsa; identical to SEQ ID NO: 35789

SEQ ID NO: 407380 - RNA, 64 nt, hsa; identical to SEQ ID NO: 35790

SEQ ID NO: 407381 - RNA, 64 nt, hsa; identical to SEQ ID NO: 35791

SEQ ID NO: 407382 - RNA, 64 nt, hsa; identical to SEQ ID NO: 35792

SEQ ID NO: 407383 - RNA, 64 nt, hsa; identical to SEQ ID NO: 35793

SEQ ID NO: 407384 - RNA, 64 nt, hsa; identical to SEQ ID NO: 35794

SEQ ID NO: 407385 - RNA, 64 nt, hsa; identical to SEQ ID NO: 35795

SEQ ID NO: 407386 - RNA, 64 nt, hsa; identical to SEQ ID NO: 35796

SEQ ID NO: 407387 - RNA, 64 nt, hsa; identical to SEQ ID NO: 35797

SEQ ID NO: 407388 - RNA, 64 nt, hsa; identical to SEQ ID NO: 35798

SEQ ID NO: 407389 - RNA, 64 nt, hsa; identical to SEQ ID NO: 35799

SEQ ID NO: 407390 - RNA, 64 nt, hsa; identical to SEQ ID NO: 35800

SEQ ID NO: 407391 - RNA, 64 nt, hsa; identical to SEQ ID NO: 35801

SEQ ID NO: 407392 - RNA, 64 nt, hsa; identical to SEQ ID NO: 35802

SEQ ID NO: 407393 - RNA, 64 nt, hsa; identical to SEQ ID NO: 35803

SEQ ID NO: 407394 - RNA, 64 nt, hsa; identical to SEQ ID NO: 35804

SEQ ID NO: 407395 - RNA, 64 nt, hsa; identical to SEQ ID NO: 35805

SEQ ID NO: 407396 - RNA, 64 nt, hsa; identical to SEQ ID NO: 35806

SEQ ID NO: 407397 - RNA, 64 nt, hsa; identical to SEQ ID NO: 35807

SEQ ID NO: 407398 - RNA, 64 nt, hsa; identical to SEQ ID NO: 35808

SEQ ID NO: 407399 - RNA, 64 nt, hsa; identical to SEQ ID NO: 35809

SEQ ID NO: 407400 - RNA, 64 nt, hsa; identical to SEQ ID NO: 35810

SEQ ID NO: 407401 - RNA, 64 nt, hsa; identical to SEQ ID NO: 35811

SEQ ID NO: 407402 - RNA, 64 nt, hsa; identical to SEQ ID NO: 35812

SEQ ID NO: 407403 - RNA, 64 nt, hsa; identical to SEQ ID NO: 35813

SEQ ID NO: 407404 - RNA, 64 nt, hsa; identical to SEQ ID NO: 35814

SEQ ID NO: 407405 - RNA, 64 nt, hsa; identical to SEQ ID NO: 35815

SEQ ID NO: 407406 - RNA, 64 nt, hsa; identical to SEQ ID NO: 35816

SEQ ID NO: 407407 - RNA, 64 nt, hsa; identical to SEQ ID NO: 35817

SEQ ID NO: 407408 - RNA, 64 nt, hsa; identical to SEQ ID NO: 35818

SEQ ID NO: 407409 - RNA, 64 nt, hsa; identical to SEQ ID NO: 35819

SEQ ID NO: 407410 - RNA, 64 nt, hsa; identical to SEQ ID NO: 35820

SEQ ID NO: 407411 - RNA, 64 nt, hsa; identical to SEQ ID NO: 35821

SEQ ID NO: 407412 - RNA, 64 nt, hsa; identical to SEQ ID NO: 35822

SEQ ID NO: 407413 - RNA, 64 nt, hsa; identical to SEQ ID NO: 35823

SEQ ID NO: 407414 - RNA, 64 nt, hsa; identical to SEQ ID NO: 35824

SEQ ID NO: 407415 - RNA, 64 nt, hsa; identical to SEQ ID NO: 35825

SEQ ID NO: 407416 - RNA, 64 nt, hsa; identical to SEQ ID NO: 35826

SEQ ID NO: 407417 - RNA, 64 nt, hsa; identical to SEQ ID NO: 35827

SEQ ID NO: 407418 - RNA, 64 nt, hsa; identical to SEQ ID NO: 35828

SEQ ID NO: 407419 - RNA, 64 nt, hsa; identical to SEQ ID NO: 35829

SEQ ID NO: 407420 - RNA, 64 nt, hsa; identical to SEQ ID NO: 35830

SEQ ID NO: 407421 - RNA, 64 nt, hsa; identical to SEQ ID NO: 35831

SEQ ID NO: 407422 - RNA, 64 nt, hsa; identical to SEQ ID NO: 35832

SEQ ID NO: 407423 - RNA, 64 nt, hsa; identical to SEQ ID NO: 35833

SEQ ID NO: 407424 - RNA, 64 nt, hsa; identical to SEQ ID NO: 35834

SEQ ID NO: 407425 - RNA, 64 nt, hsa; identical to SEQ ID NO: 35835

SEQ ID NO: 407426 - RNA, 64 nt, hsa; identical to SEQ ID NO: 35836

SEQ ID NO: 407427 - RNA, 64 nt, hsa; identical to SEQ ID NO: 35837

SEQ ID NO: 407428 - RNA, 64 nt, hsa; identical to SEQ ID NO: 35838

SEQ ID NO: 407429 - RNA, 64 nt, hsa; identical to SEQ ID NO: 35839

SEQ ID NO: 407430 - RNA, 64 nt, hsa; identical to SEQ ID NO: 35840

SEQ ID NO: 407431 - RNA, 64 nt, hsa; identical to SEQ ID NO: 35841

SEQ ID NO: 407432 - RNA, 64 nt, hsa; identical to SEQ ID NO: 35842

SEQ ID NO: 407433 - RNA, 64 nt, hsa; identical to SEQ ID NO: 35843

SEQ ID NO: 407434 - RNA, 64 nt, hsa; identical to SEQ ID NO: 35844

SEQ ID NO: 407435 - RNA, 64 nt, hsa; identical to SEQ ID NO: 35845

SEQ ID NO: 407436 - RNA, 64 nt, hsa; identical to SEQ ID NO: 35846

SEQ ID NO: 407437 - RNA, 64 nt, hsa; identical to SEQ ID NO: 35847

SEQ ID NO: 407438 - RNA, 64 nt, hsa; identical to SEQ ID NO: 35848

SEQ ID NO: 407439 - RNA, 64 nt, hsa; identical to SEQ ID NO: 35849

SEQ ID NO: 407440 - RNA, 64 nt, hsa; identical to SEQ ID NO: 35850

SEQ ID NO: 407441 - RNA, 64 nt, hsa; identical to SEQ ID NO: 35851

SEQ ID NO: 407442 - RNA, 64 nt, hsa; identical to SEQ ID NO: 35852

SEQ ID NO: 407443 - RNA, 64 nt, hsa; identical to SEQ ID NO: 35853

SEQ ID NO: 407444 - RNA, 64 nt, hsa; identical to SEQ ID NO: 35854

SEQ ID NO: 407445 - RNA, 64 nt, hsa; identical to SEQ ID NO: 35855

SEQ ID NO: 407446 - RNA, 64 nt, hsa; identical to SEQ ID NO: 35856

SEQ ID NO: 407447 - RNA, 64 nt, hsa; identical to SEQ ID NO: 35857

SEQ ID NO: 407448 - RNA, 64 nt, hsa; identical to SEQ ID NO: 35858

SEQ ID NO: 407449 - RNA, 64 nt, hsa; identical to SEQ ID NO: 35859

SEQ ID NO: 407450 - RNA, 64 nt, hsa; identical to SEQ ID NO: 35860

SEQ ID NO: 407451 - RNA, 64 nt, hsa; identical to SEQ ID NO: 35861

SEQ ID NO: 407452 - RNA, 64 nt, hsa; identical to SEQ ID NO: 35862

SEQ ID NO: 407453 - RNA, 64 nt, hsa; identical to SEQ ID NO: 35863

SEQ ID NO: 407454 - RNA, 64 nt, hsa; identical to SEQ ID NO: 35864

SEQ ID NO: 407455 - RNA, 64 nt, hsa; identical to SEQ ID NO: 35865

SEQ ID NO: 407456 - RNA, 64 nt, hsa; identical to SEQ ID NO: 35866

SEQ ID NO: 407457 - RNA, 64 nt, hsa; identical to SEQ ID NO: 35867

SEQ ID NO: 407458 - RNA, 64 nt, hsa; identical to SEQ ID NO: 35868

SEQ ID NO: 407459 - RNA, 64 nt, hsa; identical to SEQ ID NO: 35869

SEQ ID NO: 407460 - RNA, 64 nt, hsa; identical to SEQ ID NO: 35870

SEQ ID NO: 407461 - RNA, 64 nt, hsa; identical to SEQ ID NO: 35871

SEQ ID NO: 407462 - RNA, 64 nt, hsa; identical to SEQ ID NO: 35872

SEQ ID NO: 407463 - RNA, 64 nt, hsa; identical to SEQ ID NO: 35873

SEQ ID NO: 407464 - RNA, 64 nt, hsa; identical to SEQ ID NO: 35874

SEQ ID NO: 407465 - RNA, 64 nt, hsa; identical to SEQ ID NO: 35875

SEQ ID NO: 407466 - RNA, 64 nt, hsa; identical to SEQ ID NO: 35876

SEQ ID NO: 407467 - RNA, 64 nt, hsa; identical to SEQ ID NO: 35877

SEQ ID NO: 407468 - RNA, 64 nt, hsa; identical to SEQ ID NO: 35878

SEQ ID NO: 407469 - RNA, 64 nt, hsa; identical to SEQ ID NO: 35879

SEQ ID NO: 407470 - RNA, 64 nt, hsa; identical to SEQ ID NO: 35880

SEQ ID NO: 407471 - RNA, 64 nt, hsa; identical to SEQ ID NO: 35881

SEQ ID NO: 407472 - RNA, 64 nt, hsa; identical to SEQ ID NO: 35882

SEQ ID NO: 407473 - RNA, 64 nt, hsa; identical to SEQ ID NO: 35883

SEQ ID NO: 407474 - RNA, 64 nt, hsa; identical to SEQ ID NO: 35884

SEQ ID NO: 407475 - RNA, 64 nt, hsa; identical to SEQ ID NO: 35885

SEQ ID NO: 407476 - RNA, 64 nt, hsa; identical to SEQ ID NO: 35886

SEQ ID NO: 407477 - RNA, 64 nt, hsa; identical to SEQ ID NO: 35887

SEQ ID NO: 407478 - RNA, 64 nt, hsa; identical to SEQ ID NO: 35888

SEQ ID NO: 407479 - RNA, 64 nt, hsa; identical to SEQ ID NO: 35889

SEQ ID NO: 407480 - RNA, 64 nt, hsa; identical to SEQ ID NO: 35890

SEQ ID NO: 407481 - RNA, 64 nt, hsa; identical to SEQ ID NO: 35891

SEQ ID NO: 407482 - RNA, 64 nt, hsa; identical to SEQ ID NO: 35892

SEQ ID NO: 407483 - RNA, 64 nt, hsa; identical to SEQ ID NO: 35893

SEQ ID NO: 407484 - RNA, 64 nt, hsa; identical to SEQ ID NO: 35894

SEQ ID NO: 407485 - RNA, 64 nt, hsa; identical to SEQ ID NO: 35895

SEQ ID NO: 407486 - RNA, 64 nt, hsa; identical to SEQ ID NO: 35896

SEQ ID NO: 407487 - RNA, 64 nt, hsa; identical to SEQ ID NO: 35897

SEQ ID NO: 407488 - RNA, 64 nt, hsa; identical to SEQ ID NO: 35898

SEQ ID NO: 407489 - RNA, 64 nt, hsa; identical to SEQ ID NO: 35899

SEQ ID NO: 407490 - RNA, 64 nt, hsa; identical to SEQ ID NO: 35900

SEQ ID NO: 407491 - RNA, 64 nt, hsa; identical to SEQ ID NO: 35901

SEQ ID NO: 407492 - RNA, 64 nt, hsa; identical to SEQ ID NO: 35902

SEQ ID NO: 407493 - RNA, 64 nt, hsa; identical to SEQ ID NO: 35903

SEQ ID NO: 407494 - RNA, 64 nt, hsa; identical to SEQ ID NO: 35904

SEQ ID NO: 407495 - RNA, 64 nt, hsa; identical to SEQ ID NO: 35905

SEQ ID NO: 407496 - RNA, 64 nt, hsa; identical to SEQ ID NO: 35906

SEQ ID NO: 407497 - RNA, 64 nt, hsa; identical to SEQ ID NO: 35907

SEQ ID NO: 407498 - RNA, 64 nt, hsa; identical to SEQ ID NO: 35908

SEQ ID NO: 407499 - RNA, 64 nt, hsa; identical to SEQ ID NO: 35909

SEQ ID NO: 407500 - RNA, 64 nt, hsa; identical to SEQ ID NO: 35910

SEQ ID NO: 407501 - RNA, 64 nt, hsa; identical to SEQ ID NO: 35911

SEQ ID NO: 407502 - RNA, 64 nt, hsa; identical to SEQ ID NO: 35912

SEQ ID NO: 407503 - RNA, 64 nt, hsa; identical to SEQ ID NO: 35913

SEQ ID NO: 407504 - RNA, 64 nt, hsa; identical to SEQ ID NO: 35914

SEQ ID NO: 407505 - RNA, 64 nt, hsa; identical to SEQ ID NO: 35915

SEQ ID NO: 407506 - RNA, 64 nt, hsa; identical to SEQ ID NO: 35916

SEQ ID NO: 407507 - RNA, 64 nt, hsa; identical to SEQ ID NO: 35917

SEQ ID NO: 407508 - RNA, 64 nt, hsa; identical to SEQ ID NO: 35918

SEQ ID NO: 407509 - RNA, 64 nt, hsa; identical to SEQ ID NO: 35919

SEQ ID NO: 407510 - RNA, 64 nt, hsa; identical to SEQ ID NO: 35920

SEQ ID NO: 407511 - RNA, 64 nt, hsa; identical to SEQ ID NO: 35921

SEQ ID NO: 407512 - RNA, 64 nt, hsa; identical to SEQ ID NO: 35922

SEQ ID NO: 407513 - RNA, 64 nt, hsa; identical to SEQ ID NO: 35923

SEQ ID NO: 407514 - RNA, 64 nt, hsa; identical to SEQ ID NO: 35924

SEQ ID NO: 407515 - RNA, 64 nt, hsa; identical to SEQ ID NO: 35925

SEQ ID NO: 407516 - RNA, 64 nt, hsa; identical to SEQ ID NO: 35926

SEQ ID NO: 407517 - RNA, 64 nt, hsa; identical to SEQ ID NO: 35927

SEQ ID NO: 407518 - RNA, 64 nt, hsa; identical to SEQ ID NO: 35928

SEQ ID NO: 407519 - RNA, 64 nt, hsa; identical to SEQ ID NO: 35929

SEQ ID NO: 407520 - RNA, 64 nt, hsa; identical to SEQ ID NO: 35930

SEQ ID NO: 407521 - RNA, 64 nt, hsa; identical to SEQ ID NO: 35931

SEQ ID NO: 407522 - RNA, 64 nt, hsa; identical to SEQ ID NO: 35932

SEQ ID NO: 407523 - RNA, 64 nt, hsa; identical to SEQ ID NO: 35933

SEQ ID NO: 407524 - RNA, 64 nt, hsa; identical to SEQ ID NO: 35934

SEQ ID NO: 407525 - RNA, 64 nt, hsa; identical to SEQ ID NO: 35935

SEQ ID NO: 407526 - RNA, 64 nt, hsa; identical to SEQ ID NO: 35936

SEQ ID NO: 407527 - RNA, 64 nt, hsa; identical to SEQ ID NO: 35937

SEQ ID NO: 407528 - RNA, 64 nt, hsa; identical to SEQ ID NO: 35938

SEQ ID NO: 407529 - RNA, 64 nt, hsa; identical to SEQ ID NO: 35939

SEQ ID NO: 407530 - RNA, 64 nt, hsa; identical to SEQ ID NO: 35940

SEQ ID NO: 407531 - RNA, 64 nt, hsa; identical to SEQ ID NO: 35941

SEQ ID NO: 407532 - RNA, 64 nt, hsa; identical to SEQ ID NO: 35942

SEQ ID NO: 407533 - RNA, 64 nt, hsa; identical to SEQ ID NO: 35943

SEQ ID NO: 407534 - RNA, 64 nt, hsa; identical to SEQ ID NO: 35944

SEQ ID NO: 407535 - RNA, 64 nt, hsa; identical to SEQ ID NO: 35945

SEQ ID NO: 407536 - RNA, 64 nt, hsa; identical to SEQ ID NO: 35946

SEQ ID NO: 407537 - RNA, 64 nt, hsa; identical to SEQ ID NO: 35947

SEQ ID NO: 407538 - RNA, 64 nt, hsa; identical to SEQ ID NO: 35948

SEQ ID NO: 407539 - RNA, 64 nt, hsa; identical to SEQ ID NO: 35949

SEQ ID NO: 407540 - RNA, 64 nt, hsa; identical to SEQ ID NO: 35950

SEQ ID NO: 407541 - RNA, 64 nt, hsa; identical to SEQ ID NO: 35951

SEQ ID NO: 407542 - RNA, 64 nt, hsa; identical to SEQ ID NO: 35952

SEQ ID NO: 407543 - RNA, 64 nt, hsa; identical to SEQ ID NO: 35953

SEQ ID NO: 407544 - RNA, 64 nt, hsa; identical to SEQ ID NO: 35954

SEQ ID NO: 407545 - RNA, 64 nt, hsa; identical to SEQ ID NO: 35955

SEQ ID NO: 407546 - RNA, 64 nt, hsa; identical to SEQ ID NO: 35956

SEQ ID NO: 407547 - RNA, 64 nt, hsa; identical to SEQ ID NO: 35957

SEQ ID NO: 407548 - RNA, 64 nt, hsa; identical to SEQ ID NO: 35958

SEQ ID NO: 407549 - RNA, 64 nt, hsa; identical to SEQ ID NO: 35959

SEQ ID NO: 407550 - RNA, 64 nt, hsa; identical to SEQ ID NO: 35960

SEQ ID NO: 407551 - RNA, 64 nt, hsa; identical to SEQ ID NO: 35961

SEQ ID NO: 407552 - RNA, 64 nt, hsa; identical to SEQ ID NO: 35962

SEQ ID NO: 407553 - RNA, 64 nt, hsa; identical to SEQ ID NO: 35963

SEQ ID NO: 407554 - RNA, 64 nt, hsa; identical to SEQ ID NO: 35964

SEQ ID NO: 407555 - RNA, 64 nt, hsa; identical to SEQ ID NO: 35965

SEQ ID NO: 407556 - RNA, 64 nt, hsa; identical to SEQ ID NO: 35966

SEQ ID NO: 407557 - RNA, 64 nt, hsa; identical to SEQ ID NO: 35967

SEQ ID NO: 407558 - RNA, 64 nt, hsa; identical to SEQ ID NO: 35968

SEQ ID NO: 407559 - RNA, 64 nt, hsa; identical to SEQ ID NO: 35969

SEQ ID NO: 407560 - RNA, 64 nt, hsa; identical to SEQ ID NO: 35970

SEQ ID NO: 407561 - RNA, 64 nt, hsa; identical to SEQ ID NO: 35971

SEQ ID NO: 407562 - RNA, 64 nt, hsa; identical to SEQ ID NO: 35972

SEQ ID NO: 407563 - RNA, 64 nt, hsa; identical to SEQ ID NO: 35973

SEQ ID NO: 407564 - RNA, 64 nt, hsa; identical to SEQ ID NO: 35974

SEQ ID NO: 407565 - RNA, 64 nt, hsa; identical to SEQ ID NO: 35975

SEQ ID NO: 407566 - RNA, 64 nt, hsa; identical to SEQ ID NO: 35976

SEQ ID NO: 407567 - RNA, 64 nt, hsa; identical to SEQ ID NO: 35977

SEQ ID NO: 407568 - RNA, 64 nt, hsa; identical to SEQ ID NO: 35978

SEQ ID NO: 407569 - RNA, 64 nt, hsa; identical to SEQ ID NO: 35979

SEQ ID NO: 407570 - RNA, 64 nt, hsa; identical to SEQ ID NO: 35980

SEQ ID NO: 407571 - RNA, 64 nt, hsa; identical to SEQ ID NO: 35981

SEQ ID NO: 407572 - RNA, 64 nt, hsa; identical to SEQ ID NO: 35982

SEQ ID NO: 407573 - RNA, 64 nt, hsa; identical to SEQ ID NO: 35983

SEQ ID NO: 407574 - RNA, 64 nt, hsa; identical to SEQ ID NO: 35984

SEQ ID NO: 407575 - RNA, 64 nt, hsa; identical to SEQ ID NO: 35985

SEQ ID NO: 407576 - RNA, 64 nt, hsa; identical to SEQ ID NO: 35986

SEQ ID NO: 407577 - RNA, 64 nt, hsa; identical to SEQ ID NO: 35987

SEQ ID NO: 407578 - RNA, 64 nt, hsa; identical to SEQ ID NO: 35988

SEQ ID NO: 407579 - RNA, 64 nt, hsa; identical to SEQ ID NO: 35989

SEQ ID NO: 407580 - RNA, 64 nt, hsa; identical to SEQ ID NO: 35990

SEQ ID NO: 407581 - RNA, 64 nt, hsa; identical to SEQ ID NO: 35991

SEQ ID NO: 407582 - RNA, 64 nt, hsa; identical to SEQ ID NO: 35992

SEQ ID NO: 407583 - RNA, 64 nt, hsa; identical to SEQ ID NO: 35993

SEQ ID NO: 407584 - RNA, 64 nt, hsa; identical to SEQ ID NO: 35994

SEQ ID NO: 407585 - RNA, 64 nt, hsa; identical to SEQ ID NO: 35995

SEQ ID NO: 407586 - RNA, 64 nt, hsa; identical to SEQ ID NO: 35996

SEQ ID NO: 407587 - RNA, 64 nt, hsa; identical to SEQ ID NO: 35997

SEQ ID NO: 407588 - RNA, 64 nt, hsa; identical to SEQ ID NO: 35998

SEQ ID NO: 407589 - RNA, 64 nt, hsa; identical to SEQ ID NO: 35999

SEQ ID NO: 407590 - RNA, 64 nt, hsa; identical to SEQ ID NO: 36000

SEQ ID NO: 407591 - RNA, 64 nt, hsa; identical to SEQ ID NO: 36001

SEQ ID NO: 407592 - RNA, 64 nt, hsa; identical to SEQ ID NO: 36002

SEQ ID NO: 407593 - RNA, 64 nt, hsa; identical to SEQ ID NO: 36003

SEQ ID NO: 407594 - RNA, 64 nt, hsa; identical to SEQ ID NO: 36004

SEQ ID NO: 407595 - RNA, 64 nt, hsa; identical to SEQ ID NO: 36005

SEQ ID NO: 407596 - RNA, 64 nt, hsa; identical to SEQ ID NO: 36006

SEQ ID NO: 407597 - RNA, 64 nt, hsa; identical to SEQ ID NO: 36007

SEQ ID NO: 407598 - RNA, 64 nt, hsa; identical to SEQ ID NO: 36008

SEQ ID NO: 407599 - RNA, 64 nt, hsa; identical to SEQ ID NO: 36009

SEQ ID NO: 407600 - RNA, 64 nt, hsa; identical to SEQ ID NO: 36010

SEQ ID NO: 407601 - RNA, 64 nt, hsa; identical to SEQ ID NO: 36011

SEQ ID NO: 407602 - RNA, 64 nt, hsa; identical to SEQ ID NO: 36012

SEQ ID NO: 407603 - RNA, 64 nt, hsa; identical to SEQ ID NO: 36013

SEQ ID NO: 407604 - RNA, 64 nt, hsa; identical to SEQ ID NO: 36014

SEQ ID NO: 407605 - RNA, 64 nt, hsa; identical to SEQ ID NO: 36015

SEQ ID NO: 407606 - RNA, 64 nt, hsa; identical to SEQ ID NO: 36016

SEQ ID NO: 407607 - RNA, 64 nt, hsa; identical to SEQ ID NO: 36017

SEQ ID NO: 407608 - RNA, 64 nt, hsa; identical to SEQ ID NO: 36018

SEQ ID NO: 407609 - RNA, 64 nt, hsa; identical to SEQ ID NO: 36019

SEQ ID NO: 407610 - RNA, 64 nt, hsa; identical to SEQ ID NO: 36020

SEQ ID NO: 407611 - RNA, 64 nt, hsa; identical to SEQ ID NO: 36021

SEQ ID NO: 407612 - RNA, 64 nt, hsa; identical to SEQ ID NO: 36022

SEQ ID NO: 407613 - RNA, 64 nt, hsa; identical to SEQ ID NO: 36023

SEQ ID NO: 407614 - RNA, 64 nt, hsa; identical to SEQ ID NO: 36024

SEQ ID NO: 407615 - RNA, 64 nt, hsa; identical to SEQ ID NO: 36025

SEQ ID NO: 407616 - RNA, 64 nt, hsa; identical to SEQ ID NO: 36026

SEQ ID NO: 407617 - RNA, 64 nt, hsa; identical to SEQ ID NO: 36027

SEQ ID NO: 407618 - RNA, 64 nt, hsa; identical to SEQ ID NO: 36028

SEQ ID NO: 407619 - RNA, 64 nt, hsa; identical to SEQ ID NO: 36029

SEQ ID NO: 407620 - RNA, 64 nt, hsa; identical to SEQ ID NO: 36030

SEQ ID NO: 407621 - RNA, 64 nt, hsa; identical to SEQ ID NO: 36031

SEQ ID NO: 407622 - RNA, 64 nt, hsa; identical to SEQ ID NO: 36032

SEQ ID NO: 407623 - RNA, 64 nt, hsa; identical to SEQ ID NO: 36033

SEQ ID NO: 407624 - RNA, 64 nt, hsa; identical to SEQ ID NO: 36034

SEQ ID NO: 407625 - RNA, 64 nt, hsa; identical to SEQ ID NO: 36035

SEQ ID NO: 407626 - RNA, 64 nt, hsa; identical to SEQ ID NO: 36036

SEQ ID NO: 407627 - RNA, 64 nt, hsa; identical to SEQ ID NO: 36037

SEQ ID NO: 407628 - RNA, 64 nt, hsa; identical to SEQ ID NO: 36038

SEQ ID NO: 407629 - RNA, 64 nt, hsa; identical to SEQ ID NO: 36039

SEQ ID NO: 407630 - RNA, 64 nt, hsa; identical to SEQ ID NO: 36040

SEQ ID NO: 407631 - RNA, 64 nt, hsa; identical to SEQ ID NO: 36041

SEQ ID NO: 407632 - RNA, 64 nt, hsa; identical to SEQ ID NO: 36042

SEQ ID NO: 407633 - RNA, 64 nt, hsa; identical to SEQ ID NO: 36043

SEQ ID NO: 407634 - RNA, 64 nt, hsa; identical to SEQ ID NO: 36044

SEQ ID NO: 407635 - RNA, 64 nt, hsa; identical to SEQ ID NO: 36045

SEQ ID NO: 407636 - RNA, 64 nt, hsa; identical to SEQ ID NO: 36046

SEQ ID NO: 407637 - RNA, 64 nt, hsa; identical to SEQ ID NO: 36047

SEQ ID NO: 407638 - RNA, 64 nt, hsa; identical to SEQ ID NO: 36048

SEQ ID NO: 407639 - RNA, 64 nt, hsa; identical to SEQ ID NO: 36049

SEQ ID NO: 407640 - RNA, 64 nt, hsa; identical to SEQ ID NO: 36050

SEQ ID NO: 407641 - RNA, 64 nt, hsa; identical to SEQ ID NO: 36051

SEQ ID NO: 407642 - RNA, 64 nt, hsa; identical to SEQ ID NO: 36052

SEQ ID NO: 407643 - RNA, 64 nt, hsa; identical to SEQ ID NO: 36053

SEQ ID NO: 407644 - RNA, 64 nt, hsa; identical to SEQ ID NO: 36054

SEQ ID NO: 407645 - RNA, 64 nt, hsa; identical to SEQ ID NO: 36055

SEQ ID NO: 407646 - RNA, 64 nt, hsa; identical to SEQ ID NO: 36056

SEQ ID NO: 407647 - RNA, 64 nt, hsa; identical to SEQ ID NO: 36057

SEQ ID NO: 407648 - RNA, 64 nt, hsa; identical to SEQ ID NO: 36058

SEQ ID NO: 407649 - RNA, 64 nt, hsa; identical to SEQ ID NO: 36059

SEQ ID NO: 407650 - RNA, 64 nt, hsa; identical to SEQ ID NO: 36060

SEQ ID NO: 407651 - RNA, 64 nt, hsa; identical to SEQ ID NO: 36061

SEQ ID NO: 407652 - RNA, 64 nt, hsa; identical to SEQ ID NO: 36062

SEQ ID NO: 407653 - RNA, 64 nt, hsa; identical to SEQ ID NO: 36063

SEQ ID NO: 407654 - RNA, 64 nt, hsa; identical to SEQ ID NO: 36064

SEQ ID NO: 407655 - RNA, 64 nt, hsa; identical to SEQ ID NO: 36065

SEQ ID NO: 407656 - RNA, 64 nt, hsa; identical to SEQ ID NO: 36066

SEQ ID NO: 407657 - RNA, 64 nt, hsa; identical to SEQ ID NO: 36067

SEQ ID NO: 407658 - RNA, 64 nt, hsa; identical to SEQ ID NO: 36068

SEQ ID NO: 407659 - RNA, 64 nt, hsa; identical to SEQ ID NO: 36069

SEQ ID NO: 407660 - RNA, 64 nt, hsa; identical to SEQ ID NO: 36070

SEQ ID NO: 407661 - RNA, 64 nt, hsa; identical to SEQ ID NO: 36071

SEQ ID NO: 407662 - RNA, 64 nt, hsa; identical to SEQ ID NO: 36072

SEQ ID NO: 407663 - RNA, 64 nt, hsa; identical to SEQ ID NO: 36073

SEQ ID NO: 407664 - RNA, 64 nt, hsa; identical to SEQ ID NO: 36074

SEQ ID NO: 407665 - RNA, 64 nt, hsa; identical to SEQ ID NO: 36075

SEQ ID NO: 407666 - RNA, 64 nt, hsa; identical to SEQ ID NO: 36076

SEQ ID NO: 407667 - RNA, 64 nt, hsa; identical to SEQ ID NO: 36077

SEQ ID NO: 407668 - RNA, 64 nt, hsa; identical to SEQ ID NO: 36078

SEQ ID NO: 407669 - RNA, 64 nt, hsa; identical to SEQ ID NO: 36079

SEQ ID NO: 407670 - RNA, 64 nt, hsa; identical to SEQ ID NO: 36080

SEQ ID NO: 407671 - RNA, 64 nt, hsa; identical to SEQ ID NO: 36081

SEQ ID NO: 407672 - RNA, 64 nt, hsa; identical to SEQ ID NO: 36082

SEQ ID NO: 407673 - RNA, 64 nt, hsa; identical to SEQ ID NO: 36083

SEQ ID NO: 407674 - RNA, 64 nt, hsa; identical to SEQ ID NO: 36084

SEQ ID NO: 407675 - RNA, 64 nt, hsa; identical to SEQ ID NO: 36085

SEQ ID NO: 407676 - RNA, 64 nt, hsa; identical to SEQ ID NO: 36086

SEQ ID NO: 407677 - RNA, 64 nt, hsa; identical to SEQ ID NO: 36087

SEQ ID NO: 407678 - RNA, 64 nt, hsa; identical to SEQ ID NO: 36088

SEQ ID NO: 407679 - RNA, 64 nt, hsa; identical to SEQ ID NO: 36089

SEQ ID NO: 407680 - RNA, 64 nt, hsa; identical to SEQ ID NO: 36090

SEQ ID NO: 407681 - RNA, 64 nt, hsa; identical to SEQ ID NO: 36091

SEQ ID NO: 407682 - RNA, 64 nt, hsa; identical to SEQ ID NO: 36092

SEQ ID NO: 407683 - RNA, 64 nt, hsa; identical to SEQ ID NO: 36093

SEQ ID NO: 407684 - RNA, 64 nt, hsa; identical to SEQ ID NO: 36094

SEQ ID NO: 407685 - RNA, 64 nt, hsa; identical to SEQ ID NO: 36095

SEQ ID NO: 407686 - RNA, 64 nt, hsa; identical to SEQ ID NO: 36096

SEQ ID NO: 407687 - RNA, 64 nt, hsa; identical to SEQ ID NO: 36097

SEQ ID NO: 407688 - RNA, 64 nt, hsa; identical to SEQ ID NO: 36098

SEQ ID NO: 407689 - RNA, 64 nt, hsa; identical to SEQ ID NO: 36099

SEQ ID NO: 407690 - RNA, 64 nt, hsa; identical to SEQ ID NO: 36100

SEQ ID NO: 407691 - RNA, 64 nt, hsa; identical to SEQ ID NO: 36101

SEQ ID NO: 407692 - RNA, 64 nt, hsa; identical to SEQ ID NO: 36102

SEQ ID NO: 407693 - RNA, 64 nt, hsa; identical to SEQ ID NO: 36103

SEQ ID NO: 407694 - RNA, 64 nt, hsa; identical to SEQ ID NO: 36104

SEQ ID NO: 407695 - RNA, 64 nt, hsa; identical to SEQ ID NO: 36105

SEQ ID NO: 407696 - RNA, 64 nt, hsa; identical to SEQ ID NO: 36106

SEQ ID NO: 407697 - RNA, 64 nt, hsa; identical to SEQ ID NO: 36107

SEQ ID NO: 407698 - RNA, 64 nt, hsa; identical to SEQ ID NO: 36108

SEQ ID NO: 407699 - RNA, 64 nt, hsa; identical to SEQ ID NO: 36109

SEQ ID NO: 407700 - RNA, 64 nt, hsa; identical to SEQ ID NO: 36110

SEQ ID NO: 407701 - RNA, 64 nt, hsa; identical to SEQ ID NO: 36111

SEQ ID NO: 407702 - RNA, 64 nt, hsa; identical to SEQ ID NO: 36112

SEQ ID NO: 407703 - RNA, 64 nt, hsa; identical to SEQ ID NO: 36113

SEQ ID NO: 407704 - RNA, 64 nt, hsa; identical to SEQ ID NO: 36114

SEQ ID NO: 407705 - RNA, 64 nt, hsa; identical to SEQ ID NO: 36115

SEQ ID NO: 407706 - RNA, 64 nt, hsa; identical to SEQ ID NO: 36116

SEQ ID NO: 407707 - RNA, 64 nt, hsa; identical to SEQ ID NO: 36117

SEQ ID NO: 407708 - RNA, 64 nt, hsa; identical to SEQ ID NO: 36118

SEQ ID NO: 407709 - RNA, 64 nt, hsa; identical to SEQ ID NO: 36119

SEQ ID NO: 407710 - RNA, 64 nt, hsa; identical to SEQ ID NO: 36120

SEQ ID NO: 407711 - RNA, 62 nt, hsa; identical to SEQ ID NO: 36121

SEQ ID NO: 407712 - RNA, 63 nt, hsa; identical to SEQ ID NO: 36122

SEQ ID NO: 407713 - RNA, 64 nt, hsa; identical to SEQ ID NO: 36123

SEQ ID NO: 407714 - RNA, 64 nt, hsa; identical to SEQ ID NO: 36124

SEQ ID NO: 407715 - RNA, 64 nt, hsa; identical to SEQ ID NO: 36125

SEQ ID NO: 407716 - RNA, 64 nt, hsa; identical to SEQ ID NO: 36126

SEQ ID NO: 407717 - RNA, 64 nt, hsa; identical to SEQ ID NO: 36127

SEQ ID NO: 407718 - RNA, 64 nt, hsa; identical to SEQ ID NO: 36128

SEQ ID NO: 407719 - RNA, 64 nt, hsa; identical to SEQ ID NO: 36129

SEQ ID NO: 407720 - RNA, 64 nt, hsa; identical to SEQ ID NO: 36130

SEQ ID NO: 407721 - RNA, 64 nt, hsa; identical to SEQ ID NO: 36131

SEQ ID NO: 407722 - RNA, 64 nt, hsa; identical to SEQ ID NO: 36132

SEQ ID NO: 407723 - RNA, 64 nt, hsa; identical to SEQ ID NO: 36133

SEQ ID NO: 407724 - RNA, 64 nt, hsa; identical to SEQ ID NO: 36134

SEQ ID NO: 407725 - RNA, 64 nt, hsa; identical to SEQ ID NO: 36135

SEQ ID NO: 407726 - RNA, 64 nt, hsa; identical to SEQ ID NO: 36136

SEQ ID NO: 407727 - RNA, 64 nt, hsa; identical to SEQ ID NO: 36137

SEQ ID NO: 407728 - RNA, 64 nt, hsa; identical to SEQ ID NO: 36138

SEQ ID NO: 407729 - RNA, 64 nt, hsa; identical to SEQ ID NO: 36139

SEQ ID NO: 407730 - RNA, 64 nt, hsa; identical to SEQ ID NO: 36140

SEQ ID NO: 407731 - RNA, 64 nt, hsa; identical to SEQ ID NO: 36141

SEQ ID NO: 407732 - RNA, 64 nt, hsa; identical to SEQ ID NO: 36142

SEQ ID NO: 407733 - RNA, 64 nt, hsa; identical to SEQ ID NO: 36143

SEQ ID NO: 407734 - RNA, 64 nt, hsa; identical to SEQ ID NO: 36144

SEQ ID NO: 407735 - RNA, 64 nt, hsa; identical to SEQ ID NO: 36145

SEQ ID NO: 407736 - RNA, 64 nt, hsa; identical to SEQ ID NO: 36146

SEQ ID NO: 407737 - RNA, 64 nt, hsa; identical to SEQ ID NO: 36147

SEQ ID NO: 407738 - RNA, 64 nt, hsa; identical to SEQ ID NO: 36148

SEQ ID NO: 407739 - RNA, 64 nt, hsa; identical to SEQ ID NO: 36149

SEQ ID NO: 407740 - RNA, 64 nt, hsa; identical to SEQ ID NO: 36150

SEQ ID NO: 407741 - RNA, 64 nt, hsa; identical to SEQ ID NO: 36151

SEQ ID NO: 407742 - RNA, 64 nt, hsa; identical to SEQ ID NO: 36152

SEQ ID NO: 407743 - RNA, 64 nt, hsa; identical to SEQ ID NO: 36153

SEQ ID NO: 407744 - RNA, 64 nt, hsa; identical to SEQ ID NO: 36154

SEQ ID NO: 407745 - RNA, 64 nt, hsa; identical to SEQ ID NO: 36155

SEQ ID NO: 407746 - RNA, 64 nt, hsa; identical to SEQ ID NO: 36156

SEQ ID NO: 407747 - RNA, 64 nt, hsa; identical to SEQ ID NO: 36157

SEQ ID NO: 407748 - RNA, 64 nt, hsa; identical to SEQ ID NO: 36158

SEQ ID NO: 407749 - RNA, 64 nt, hsa; identical to SEQ ID NO: 36159

SEQ ID NO: 407750 - RNA, 64 nt, hsa; identical to SEQ ID NO: 36160

SEQ ID NO: 407751 - RNA, 64 nt, hsa; identical to SEQ ID NO: 36161

SEQ ID NO: 407752 - RNA, 64 nt, hsa; identical to SEQ ID NO: 36162

SEQ ID NO: 407753 - RNA, 64 nt, hsa; identical to SEQ ID NO: 36163

SEQ ID NO: 407754 - RNA, 64 nt, hsa; identical to SEQ ID NO: 36164

SEQ ID NO: 407755 - RNA, 64 nt, hsa; identical to SEQ ID NO: 36165

SEQ ID NO: 407756 - RNA, 64 nt, hsa; identical to SEQ ID NO: 36166

SEQ ID NO: 407757 - RNA, 64 nt, hsa; identical to SEQ ID NO: 36167

SEQ ID NO: 407758 - RNA, 64 nt, hsa; identical to SEQ ID NO: 36168

SEQ ID NO: 407759 - RNA, 64 nt, hsa; identical to SEQ ID NO: 36169

SEQ ID NO: 407760 - RNA, 64 nt, hsa; identical to SEQ ID NO: 36170

SEQ ID NO: 407761 - RNA, 64 nt, hsa; identical to SEQ ID NO: 36171

SEQ ID NO: 407762 - RNA, 64 nt, hsa; identical to SEQ ID NO: 36172

SEQ ID NO: 407763 - RNA, 64 nt, hsa; identical to SEQ ID NO: 36173

SEQ ID NO: 407764 - RNA, 64 nt, hsa; identical to SEQ ID NO: 36174

SEQ ID NO: 407765 - RNA, 64 nt, hsa; identical to SEQ ID NO: 36175

SEQ ID NO: 407766 - RNA, 64 nt, hsa; identical to SEQ ID NO: 36176

SEQ ID NO: 407767 - RNA, 64 nt, hsa; identical to SEQ ID NO: 36177

SEQ ID NO: 407768 - RNA, 64 nt, hsa; identical to SEQ ID NO: 36178

SEQ ID NO: 407769 - RNA, 64 nt, hsa; identical to SEQ ID NO: 36179

SEQ ID NO: 407770 - RNA, 64 nt, hsa; identical to SEQ ID NO: 36180

SEQ ID NO: 407771 - RNA, 64 nt, hsa; identical to SEQ ID NO: 36181

SEQ ID NO: 407772 - RNA, 64 nt, hsa; identical to SEQ ID NO: 36182

SEQ ID NO: 407773 - RNA, 64 nt, hsa; identical to SEQ ID NO: 36183

SEQ ID NO: 407774 - RNA, 64 nt, hsa; identical to SEQ ID NO: 36184

SEQ ID NO: 407775 - RNA, 64 nt, hsa; identical to SEQ ID NO: 36185

SEQ ID NO: 407776 - RNA, 64 nt, hsa; identical to SEQ ID NO: 36186

SEQ ID NO: 407777 - RNA, 64 nt, hsa; identical to SEQ ID NO: 36187

SEQ ID NO: 407778 - RNA, 64 nt, hsa; identical to SEQ ID NO: 36188

SEQ ID NO: 407779 - RNA, 64 nt, hsa; identical to SEQ ID NO: 36189

SEQ ID NO: 407780 - RNA, 64 nt, hsa; identical to SEQ ID NO: 36190

SEQ ID NO: 407781 - RNA, 64 nt, hsa; identical to SEQ ID NO: 36191

SEQ ID NO: 407782 - RNA, 64 nt, hsa; identical to SEQ ID NO: 36192

SEQ ID NO: 407783 - RNA, 64 nt, hsa; identical to SEQ ID NO: 36193

SEQ ID NO: 407784 - RNA, 64 nt, hsa; identical to SEQ ID NO: 36194

SEQ ID NO: 407785 - RNA, 64 nt, hsa; identical to SEQ ID NO: 36195

SEQ ID NO: 407786 - RNA, 64 nt, hsa; identical to SEQ ID NO: 36196

SEQ ID NO: 407787 - RNA, 64 nt, hsa; identical to SEQ ID NO: 36197

SEQ ID NO: 407788 - RNA, 64 nt, hsa; identical to SEQ ID NO: 36198

SEQ ID NO: 407789 - RNA, 64 nt, hsa; identical to SEQ ID NO: 36199

SEQ ID NO: 407790 - RNA, 64 nt, hsa; identical to SEQ ID NO: 36200

SEQ ID NO: 407791 - RNA, 64 nt, hsa; identical to SEQ ID NO: 36201

SEQ ID NO: 407792 - RNA, 64 nt, hsa; identical to SEQ ID NO: 36202

SEQ ID NO: 407793 - RNA, 64 nt, hsa; identical to SEQ ID NO: 36203

SEQ ID NO: 407794 - RNA, 64 nt, hsa; identical to SEQ ID NO: 36204

SEQ ID NO: 407795 - RNA, 64 nt, hsa; identical to SEQ ID NO: 36205

SEQ ID NO: 407796 - RNA, 64 nt, hsa; identical to SEQ ID NO: 36206

SEQ ID NO: 407797 - RNA, 64 nt, hsa; identical to SEQ ID NO: 36207

SEQ ID NO: 407798 - RNA, 64 nt, hsa; identical to SEQ ID NO: 36208

SEQ ID NO: 407799 - RNA, 64 nt, hsa; identical to SEQ ID NO: 36209

SEQ ID NO: 407800 - RNA, 64 nt, hsa; identical to SEQ ID NO: 36210

SEQ ID NO: 407801 - RNA, 64 nt, hsa; identical to SEQ ID NO: 36211

SEQ ID NO: 407802 - RNA, 64 nt, hsa; identical to SEQ ID NO: 36212

SEQ ID NO: 407803 - RNA, 64 nt, hsa; identical to SEQ ID NO: 36213

SEQ ID NO: 407804 - RNA, 64 nt, hsa; identical to SEQ ID NO: 36214

SEQ ID NO: 407805 - RNA, 64 nt, hsa; identical to SEQ ID NO: 36215

SEQ ID NO: 407806 - RNA, 64 nt, hsa; identical to SEQ ID NO: 36216

SEQ ID NO: 407807 - RNA, 64 nt, hsa; identical to SEQ ID NO: 36217

SEQ ID NO: 407808 - RNA, 64 nt, hsa; identical to SEQ ID NO: 36218

SEQ ID NO: 407809 - RNA, 64 nt, hsa; identical to SEQ ID NO: 36219

SEQ ID NO: 407810 - RNA, 64 nt, hsa; identical to SEQ ID NO: 36220

SEQ ID NO: 407811 - RNA, 64 nt, hsa; identical to SEQ ID NO: 36221

SEQ ID NO: 407812 - RNA, 64 nt, hsa; identical to SEQ ID NO: 36222

SEQ ID NO: 407813 - RNA, 64 nt, hsa; identical to SEQ ID NO: 36223

SEQ ID NO: 407814 - RNA, 64 nt, hsa; identical to SEQ ID NO: 36224

SEQ ID NO: 407815 - RNA, 64 nt, hsa; identical to SEQ ID NO: 36225

SEQ ID NO: 407816 - RNA, 64 nt, hsa; identical to SEQ ID NO: 36226

SEQ ID NO: 407817 - RNA, 64 nt, hsa; identical to SEQ ID NO: 36227

SEQ ID NO: 407818 - RNA, 64 nt, hsa; identical to SEQ ID NO: 36228

SEQ ID NO: 407819 - RNA, 64 nt, hsa; identical to SEQ ID NO: 36229

SEQ ID NO: 407820 - RNA, 64 nt, hsa; identical to SEQ ID NO: 36230

SEQ ID NO: 407821 - RNA, 64 nt, hsa; identical to SEQ ID NO: 36231

SEQ ID NO: 407822 - RNA, 64 nt, hsa; identical to SEQ ID NO: 36232

SEQ ID NO: 407823 - RNA, 64 nt, hsa; identical to SEQ ID NO: 36233

SEQ ID NO: 407824 - RNA, 64 nt, hsa; identical to SEQ ID NO: 36234

SEQ ID NO: 407825 - RNA, 64 nt, hsa; identical to SEQ ID NO: 36235

SEQ ID NO: 407826 - RNA, 64 nt, hsa; identical to SEQ ID NO: 36236

SEQ ID NO: 407827 - RNA, 64 nt, hsa; identical to SEQ ID NO: 36237

SEQ ID NO: 407828 - RNA, 64 nt, hsa; identical to SEQ ID NO: 36238

SEQ ID NO: 407829 - RNA, 64 nt, hsa; identical to SEQ ID NO: 36239

SEQ ID NO: 407830 - RNA, 64 nt, hsa; identical to SEQ ID NO: 36240

SEQ ID NO: 407831 - RNA, 64 nt, hsa; identical to SEQ ID NO: 36241

SEQ ID NO: 407832 - RNA, 64 nt, hsa; identical to SEQ ID NO: 36242

SEQ ID NO: 407833 - RNA, 64 nt, hsa; identical to SEQ ID NO: 36243

SEQ ID NO: 407834 - RNA, 64 nt, hsa; identical to SEQ ID NO: 36244

SEQ ID NO: 407835 - RNA, 64 nt, hsa; identical to SEQ ID NO: 36245

SEQ ID NO: 407836 - RNA, 64 nt, hsa; identical to SEQ ID NO: 36246

SEQ ID NO: 407837 - RNA, 64 nt, hsa; identical to SEQ ID NO: 36247

SEQ ID NO: 407838 - RNA, 64 nt, hsa; identical to SEQ ID NO: 36248

SEQ ID NO: 407839 - RNA, 64 nt, hsa; identical to SEQ ID NO: 36249

SEQ ID NO: 407840 - RNA, 64 nt, hsa; identical to SEQ ID NO: 36250

SEQ ID NO: 407841 - RNA, 64 nt, hsa; identical to SEQ ID NO: 36251

SEQ ID NO: 407842 - RNA, 64 nt, hsa; identical to SEQ ID NO: 36252

SEQ ID NO: 407843 - RNA, 64 nt, hsa; identical to SEQ ID NO: 36253

SEQ ID NO: 407844 - RNA, 64 nt, hsa; identical to SEQ ID NO: 36254

SEQ ID NO: 407845 - RNA, 64 nt, hsa; identical to SEQ ID NO: 36255

SEQ ID NO: 407846 - RNA, 64 nt, hsa; identical to SEQ ID NO: 36256

SEQ ID NO: 407847 - RNA, 64 nt, hsa; identical to SEQ ID NO: 36257

SEQ ID NO: 407848 - RNA, 64 nt, hsa; identical to SEQ ID NO: 36258

SEQ ID NO: 407849 - RNA, 64 nt, hsa; identical to SEQ ID NO: 36259

SEQ ID NO: 407850 - RNA, 64 nt, hsa; identical to SEQ ID NO: 36260

SEQ ID NO: 407851 - RNA, 64 nt, hsa; identical to SEQ ID NO: 36261

SEQ ID NO: 407852 - RNA, 64 nt, hsa; identical to SEQ ID NO: 36262

SEQ ID NO: 407853 - RNA, 64 nt, hsa; identical to SEQ ID NO: 36263

SEQ ID NO: 407854 - RNA, 64 nt, hsa; identical to SEQ ID NO: 36264

SEQ ID NO: 407855 - RNA, 64 nt, hsa; identical to SEQ ID NO: 36265

SEQ ID NO: 407856 - RNA, 64 nt, hsa; identical to SEQ ID NO: 36266

SEQ ID NO: 407857 - RNA, 64 nt, hsa; identical to SEQ ID NO: 36267

SEQ ID NO: 407858 - RNA, 64 nt, hsa; identical to SEQ ID NO: 36268

SEQ ID NO: 407859 - RNA, 64 nt, hsa; identical to SEQ ID NO: 36269

SEQ ID NO: 407860 - RNA, 64 nt, hsa; identical to SEQ ID NO: 36270

SEQ ID NO: 407861 - RNA, 64 nt, hsa; identical to SEQ ID NO: 36271

SEQ ID NO: 407862 - RNA, 64 nt, hsa; identical to SEQ ID NO: 36272

SEQ ID NO: 407863 - RNA, 64 nt, hsa; identical to SEQ ID NO: 36273

SEQ ID NO: 407864 - RNA, 64 nt, hsa; identical to SEQ ID NO: 36274

SEQ ID NO: 407865 - RNA, 64 nt, hsa; identical to SEQ ID NO: 36275

SEQ ID NO: 407866 - RNA, 64 nt, hsa; identical to SEQ ID NO: 36276

SEQ ID NO: 407867 - RNA, 64 nt, hsa; identical to SEQ ID NO: 36277

SEQ ID NO: 407868 - RNA, 64 nt, hsa; identical to SEQ ID NO: 36278

SEQ ID NO: 407869 - RNA, 64 nt, hsa; identical to SEQ ID NO: 36279

SEQ ID NO: 407870 - RNA, 64 nt, hsa; identical to SEQ ID NO: 36280

SEQ ID NO: 407871 - RNA, 64 nt, hsa; identical to SEQ ID NO: 36281

SEQ ID NO: 407872 - RNA, 64 nt, hsa; identical to SEQ ID NO: 36282

SEQ ID NO: 407873 - RNA, 64 nt, hsa; identical to SEQ ID NO: 36283

SEQ ID NO: 407874 - RNA, 64 nt, hsa; identical to SEQ ID NO: 36284

SEQ ID NO: 407875 - RNA, 64 nt, hsa; identical to SEQ ID NO: 36285

SEQ ID NO: 407876 - RNA, 64 nt, hsa; identical to SEQ ID NO: 36286

SEQ ID NO: 407877 - RNA, 64 nt, hsa; identical to SEQ ID NO: 36287

SEQ ID NO: 407878 - RNA, 64 nt, hsa; identical to SEQ ID NO: 36288

SEQ ID NO: 407879 - RNA, 64 nt, hsa; identical to SEQ ID NO: 36289

SEQ ID NO: 407880 - RNA, 64 nt, hsa; identical to SEQ ID NO: 36290

SEQ ID NO: 407881 - RNA, 64 nt, hsa; identical to SEQ ID NO: 36291

SEQ ID NO: 407882 - RNA, 64 nt, hsa; identical to SEQ ID NO: 36292

SEQ ID NO: 407883 - RNA, 64 nt, hsa; identical to SEQ ID NO: 36293

SEQ ID NO: 407884 - RNA, 64 nt, hsa; identical to SEQ ID NO: 36294

SEQ ID NO: 407885 - RNA, 64 nt, hsa; identical to SEQ ID NO: 36295

SEQ ID NO: 407886 - RNA, 64 nt, hsa; identical to SEQ ID NO: 36296

SEQ ID NO: 407887 - RNA, 64 nt, hsa; identical to SEQ ID NO: 36297

SEQ ID NO: 407888 - RNA, 64 nt, hsa; identical to SEQ ID NO: 36298

SEQ ID NO: 407889 - RNA, 64 nt, hsa; identical to SEQ ID NO: 36299

SEQ ID NO: 407890 - RNA, 64 nt, hsa; identical to SEQ ID NO: 36300

SEQ ID NO: 407891 - RNA, 64 nt, hsa; identical to SEQ ID NO: 36301

SEQ ID NO: 407892 - RNA, 64 nt, hsa; identical to SEQ ID NO: 36302

SEQ ID NO: 407893 - RNA, 64 nt, hsa; identical to SEQ ID NO: 36303

SEQ ID NO: 407894 - RNA, 64 nt, hsa; identical to SEQ ID NO: 36304

SEQ ID NO: 407895 - RNA, 64 nt, hsa; identical to SEQ ID NO: 36305

SEQ ID NO: 407896 - RNA, 64 nt, hsa; identical to SEQ ID NO: 36306

SEQ ID NO: 407897 - RNA, 64 nt, hsa; identical to SEQ ID NO: 36307

SEQ ID NO: 407898 - RNA, 64 nt, hsa; identical to SEQ ID NO: 36308

SEQ ID NO: 407899 - RNA, 64 nt, hsa; identical to SEQ ID NO: 36309

SEQ ID NO: 407900 - RNA, 64 nt, hsa; identical to SEQ ID NO: 36310

SEQ ID NO: 407901 - RNA, 64 nt, hsa; identical to SEQ ID NO: 36311

SEQ ID NO: 407902 - RNA, 64 nt, hsa; identical to SEQ ID NO: 36312

SEQ ID NO: 407903 - RNA, 64 nt, hsa; identical to SEQ ID NO: 36313

SEQ ID NO: 407904 - RNA, 64 nt, hsa; identical to SEQ ID NO: 36314

SEQ ID NO: 407905 - RNA, 64 nt, hsa; identical to SEQ ID NO: 36315

SEQ ID NO: 407906 - RNA, 64 nt, hsa; identical to SEQ ID NO: 36316

SEQ ID NO: 407907 - RNA, 64 nt, hsa; identical to SEQ ID NO: 36317

SEQ ID NO: 407908 - RNA, 64 nt, hsa; identical to SEQ ID NO: 36318

SEQ ID NO: 407909 - RNA, 64 nt, hsa; identical to SEQ ID NO: 36319

SEQ ID NO: 407910 - RNA, 64 nt, hsa; identical to SEQ ID NO: 36320

SEQ ID NO: 407911 - RNA, 64 nt, hsa; identical to SEQ ID NO: 36321

SEQ ID NO: 407912 - RNA, 64 nt, hsa; identical to SEQ ID NO: 36322

SEQ ID NO: 407913 - RNA, 64 nt, hsa; identical to SEQ ID NO: 36323

SEQ ID NO: 407914 - RNA, 64 nt, hsa; identical to SEQ ID NO: 36324

SEQ ID NO: 407915 - RNA, 64 nt, hsa; identical to SEQ ID NO: 36325

SEQ ID NO: 407916 - RNA, 64 nt, hsa; identical to SEQ ID NO: 36326

SEQ ID NO: 407917 - RNA, 64 nt, hsa; identical to SEQ ID NO: 36327

SEQ ID NO: 407918 - RNA, 64 nt, hsa; identical to SEQ ID NO: 36328

SEQ ID NO: 407919 - RNA, 64 nt, hsa; identical to SEQ ID NO: 36329

SEQ ID NO: 407920 - RNA, 64 nt, hsa; identical to SEQ ID NO: 36330

SEQ ID NO: 407921 - RNA, 64 nt, hsa; identical to SEQ ID NO: 36331

SEQ ID NO: 407922 - RNA, 64 nt, hsa; identical to SEQ ID NO: 36332

SEQ ID NO: 407923 - RNA, 64 nt, hsa; identical to SEQ ID NO: 36333

SEQ ID NO: 407924 - RNA, 64 nt, hsa; identical to SEQ ID NO: 36334

SEQ ID NO: 407925 - RNA, 64 nt, hsa; identical to SEQ ID NO: 36335

SEQ ID NO: 407926 - RNA, 64 nt, hsa; identical to SEQ ID NO: 36336

SEQ ID NO: 407927 - RNA, 64 nt, hsa; identical to SEQ ID NO: 36337

SEQ ID NO: 407928 - RNA, 64 nt, hsa; identical to SEQ ID NO: 36338

SEQ ID NO: 407929 - RNA, 64 nt, hsa; identical to SEQ ID NO: 36339

SEQ ID NO: 407930 - RNA, 64 nt, hsa; identical to SEQ ID NO: 36340

SEQ ID NO: 407931 - RNA, 64 nt, hsa; identical to SEQ ID NO: 36341

SEQ ID NO: 407932 - RNA, 64 nt, hsa; identical to SEQ ID NO: 36342

SEQ ID NO: 407933 - RNA, 64 nt, hsa; identical to SEQ ID NO: 36343

SEQ ID NO: 407934 - RNA, 64 nt, hsa; identical to SEQ ID NO: 36344

SEQ ID NO: 407935 - RNA, 64 nt, hsa; identical to SEQ ID NO: 36345

SEQ ID NO: 407936 - RNA, 64 nt, hsa; identical to SEQ ID NO: 36346

SEQ ID NO: 407937 - RNA, 64 nt, hsa; identical to SEQ ID NO: 36347

SEQ ID NO: 407938 - RNA, 64 nt, hsa; identical to SEQ ID NO: 36348

SEQ ID NO: 407939 - RNA, 64 nt, hsa; identical to SEQ ID NO: 36349

SEQ ID NO: 407940 - RNA, 64 nt, hsa; identical to SEQ ID NO: 36350

SEQ ID NO: 407941 - RNA, 64 nt, hsa; identical to SEQ ID NO: 36351

SEQ ID NO: 407942 - RNA, 64 nt, hsa; identical to SEQ ID NO: 36352

SEQ ID NO: 407943 - RNA, 64 nt, hsa; identical to SEQ ID NO: 36353

SEQ ID NO: 407944 - RNA, 64 nt, hsa; identical to SEQ ID NO: 36354

SEQ ID NO: 407945 - RNA, 64 nt, hsa; identical to SEQ ID NO: 36355

SEQ ID NO: 407946 - RNA, 64 nt, hsa; identical to SEQ ID NO: 36356

SEQ ID NO: 407947 - RNA, 64 nt, hsa; identical to SEQ ID NO: 36357

SEQ ID NO: 407948 - RNA, 64 nt, hsa; identical to SEQ ID NO: 36358

SEQ ID NO: 407949 - RNA, 64 nt, hsa; identical to SEQ ID NO: 36359

SEQ ID NO: 407950 - RNA, 64 nt, hsa; identical to SEQ ID NO: 36360

SEQ ID NO: 407951 - RNA, 64 nt, hsa; identical to SEQ ID NO: 36361

SEQ ID NO: 407952 - RNA, 64 nt, hsa; identical to SEQ ID NO: 36362

SEQ ID NO: 407953 - RNA, 64 nt, hsa; identical to SEQ ID NO: 36363

SEQ ID NO: 407954 - RNA, 64 nt, hsa; identical to SEQ ID NO: 36364

SEQ ID NO: 407955 - RNA, 64 nt, hsa; identical to SEQ ID NO: 36365

SEQ ID NO: 407956 - RNA, 64 nt, hsa; identical to SEQ ID NO: 36366

SEQ ID NO: 407957 - RNA, 64 nt, hsa; identical to SEQ ID NO: 36367

SEQ ID NO: 407958 - RNA, 64 nt, hsa; identical to SEQ ID NO: 36368

SEQ ID NO: 407959 - RNA, 64 nt, hsa; identical to SEQ ID NO: 36369

SEQ ID NO: 407960 - RNA, 64 nt, hsa; identical to SEQ ID NO: 36370

SEQ ID NO: 407961 - RNA, 64 nt, hsa; identical to SEQ ID NO: 36371

SEQ ID NO: 407962 - RNA, 64 nt, hsa; identical to SEQ ID NO: 36372

SEQ ID NO: 407963 - RNA, 64 nt, hsa; identical to SEQ ID NO: 36373

SEQ ID NO: 407964 - RNA, 64 nt, hsa; identical to SEQ ID NO: 36374

SEQ ID NO: 407965 - RNA, 64 nt, hsa; identical to SEQ ID NO: 36375

SEQ ID NO: 407966 - RNA, 64 nt, hsa; identical to SEQ ID NO: 36376

SEQ ID NO: 407967 - RNA, 64 nt, hsa; identical to SEQ ID NO: 36377

SEQ ID NO: 407968 - RNA, 64 nt, hsa; identical to SEQ ID NO: 36378

SEQ ID NO: 407969 - RNA, 64 nt, hsa; identical to SEQ ID NO: 36379

SEQ ID NO: 407970 - RNA, 64 nt, hsa; identical to SEQ ID NO: 36380

SEQ ID NO: 407971 - RNA, 64 nt, hsa; identical to SEQ ID NO: 36381

SEQ ID NO: 407972 - RNA, 64 nt, hsa; identical to SEQ ID NO: 36382

SEQ ID NO: 407973 - RNA, 64 nt, hsa; identical to SEQ ID NO: 36383

SEQ ID NO: 407974 - RNA, 64 nt, hsa; identical to SEQ ID NO: 36384

SEQ ID NO: 407975 - RNA, 64 nt, hsa; identical to SEQ ID NO: 36385

SEQ ID NO: 407976 - RNA, 64 nt, hsa; identical to SEQ ID NO: 36386

SEQ ID NO: 407977 - RNA, 64 nt, hsa; identical to SEQ ID NO: 36387

SEQ ID NO: 407978 - RNA, 64 nt, hsa; identical to SEQ ID NO: 36388

SEQ ID NO: 407979 - RNA, 64 nt, hsa; identical to SEQ ID NO: 36389

SEQ ID NO: 407980 - RNA, 64 nt, hsa; identical to SEQ ID NO: 36390

SEQ ID NO: 407981 - RNA, 64 nt, hsa; identical to SEQ ID NO: 36391

SEQ ID NO: 407982 - RNA, 64 nt, hsa; identical to SEQ ID NO: 36392

SEQ ID NO: 407983 - RNA, 64 nt, hsa; identical to SEQ ID NO: 36393

SEQ ID NO: 407984 - RNA, 64 nt, hsa; identical to SEQ ID NO: 36394

SEQ ID NO: 407985 - RNA, 64 nt, hsa; identical to SEQ ID NO: 36395

SEQ ID NO: 407986 - RNA, 64 nt, hsa; identical to SEQ ID NO: 36396

SEQ ID NO: 407987 - RNA, 64 nt, hsa; identical to SEQ ID NO: 36397

SEQ ID NO: 407988 - RNA, 64 nt, hsa; identical to SEQ ID NO: 36398

SEQ ID NO: 407989 - RNA, 64 nt, hsa; identical to SEQ ID NO: 36399

SEQ ID NO: 407990 - RNA, 64 nt, hsa; identical to SEQ ID NO: 36400

SEQ ID NO: 407991 - RNA, 64 nt, hsa; identical to SEQ ID NO: 36401

SEQ ID NO: 407992 - RNA, 64 nt, hsa; identical to SEQ ID NO: 36402

SEQ ID NO: 407993 - RNA, 64 nt, hsa; identical to SEQ ID NO: 36403

SEQ ID NO: 407994 - RNA, 64 nt, hsa; identical to SEQ ID NO: 36404

SEQ ID NO: 407995 - RNA, 64 nt, hsa; identical to SEQ ID NO: 36405

SEQ ID NO: 407996 - RNA, 64 nt, hsa; identical to SEQ ID NO: 36406

SEQ ID NO: 407997 - RNA, 64 nt, hsa; identical to SEQ ID NO: 36407

SEQ ID NO: 407998 - RNA, 64 nt, hsa; identical to SEQ ID NO: 36408

SEQ ID NO: 407999 - RNA, 64 nt, hsa; identical to SEQ ID NO: 36409

SEQ ID NO: 408000 - RNA, 64 nt, hsa; identical to SEQ ID NO: 36410

SEQ ID NO: 408001 - RNA, 64 nt, hsa; identical to SEQ ID NO: 36411

SEQ ID NO: 408002 - RNA, 64 nt, hsa; identical to SEQ ID NO: 36412

SEQ ID NO: 408003 - RNA, 64 nt, hsa; identical to SEQ ID NO: 36413

SEQ ID NO: 408004 - RNA, 64 nt, hsa; identical to SEQ ID NO: 36414

SEQ ID NO: 408005 - RNA, 64 nt, hsa; identical to SEQ ID NO: 36415

SEQ ID NO: 408006 - RNA, 64 nt, hsa; identical to SEQ ID NO: 36416

SEQ ID NO: 408007 - RNA, 64 nt, hsa; identical to SEQ ID NO: 36417

SEQ ID NO: 408008 - RNA, 64 nt, hsa; identical to SEQ ID NO: 36418

SEQ ID NO: 408009 - RNA, 64 nt, hsa; identical to SEQ ID NO: 36419

SEQ ID NO: 408010 - RNA, 64 nt, hsa; identical to SEQ ID NO: 36420

SEQ ID NO: 408011 - RNA, 64 nt, hsa; identical to SEQ ID NO: 36421

SEQ ID NO: 408012 - RNA, 64 nt, hsa; identical to SEQ ID NO: 36422

SEQ ID NO: 408013 - RNA, 64 nt, hsa; identical to SEQ ID NO: 36423

SEQ ID NO: 408014 - RNA, 64 nt, hsa; identical to SEQ ID NO: 36424

SEQ ID NO: 408015 - RNA, 64 nt, hsa; identical to SEQ ID NO: 36425

SEQ ID NO: 408016 - RNA, 64 nt, hsa; identical to SEQ ID NO: 36426

SEQ ID NO: 408017 - RNA, 64 nt, hsa; identical to SEQ ID NO: 36427

SEQ ID NO: 408018 - RNA, 64 nt, hsa; identical to SEQ ID NO: 36428

SEQ ID NO: 408019 - RNA, 64 nt, hsa; identical to SEQ ID NO: 36429

SEQ ID NO: 408020 - RNA, 64 nt, hsa; identical to SEQ ID NO: 36430

SEQ ID NO: 408021 - RNA, 64 nt, hsa; identical to SEQ ID NO: 36431

SEQ ID NO: 408022 - RNA, 64 nt, hsa; identical to SEQ ID NO: 36432

SEQ ID NO: 408023 - RNA, 64 nt, hsa; identical to SEQ ID NO: 36433

SEQ ID NO: 408024 - RNA, 64 nt, hsa; identical to SEQ ID NO: 36434

SEQ ID NO: 408025 - RNA, 64 nt, hsa; identical to SEQ ID NO: 36435

SEQ ID NO: 408026 - RNA, 64 nt, hsa; identical to SEQ ID NO: 36436

SEQ ID NO: 408027 - RNA, 64 nt, hsa; identical to SEQ ID NO: 36437

SEQ ID NO: 408028 - RNA, 64 nt, hsa; identical to SEQ ID NO: 36438

SEQ ID NO: 408029 - RNA, 64 nt, hsa; identical to SEQ ID NO: 36439

SEQ ID NO: 408030 - RNA, 64 nt, hsa; identical to SEQ ID NO: 36440

SEQ ID NO: 408031 - RNA, 64 nt, hsa; identical to SEQ ID NO: 36441

SEQ ID NO: 408032 - RNA, 64 nt, hsa; identical to SEQ ID NO: 36442

SEQ ID NO: 408033 - RNA, 64 nt, hsa; identical to SEQ ID NO: 36443

SEQ ID NO: 408034 - RNA, 64 nt, hsa; identical to SEQ ID NO: 36444

SEQ ID NO: 408035 - RNA, 64 nt, hsa; identical to SEQ ID NO: 36445

SEQ ID NO: 408036 - RNA, 64 nt, hsa; identical to SEQ ID NO: 36446

SEQ ID NO: 408037 - RNA, 64 nt, hsa; identical to SEQ ID NO: 36447

SEQ ID NO: 408038 - RNA, 64 nt, hsa; identical to SEQ ID NO: 36448

SEQ ID NO: 408039 - RNA, 64 nt, hsa; identical to SEQ ID NO: 36449

SEQ ID NO: 408040 - RNA, 64 nt, hsa; identical to SEQ ID NO: 36450

SEQ ID NO: 408041 - RNA, 64 nt, hsa; identical to SEQ ID NO: 36451

SEQ ID NO: 408042 - RNA, 64 nt, hsa; identical to SEQ ID NO: 36452

SEQ ID NO: 408043 - RNA, 64 nt, hsa; identical to SEQ ID NO: 36453

SEQ ID NO: 408044 - RNA, 64 nt, hsa; identical to SEQ ID NO: 36454

SEQ ID NO: 408045 - RNA, 64 nt, hsa; identical to SEQ ID NO: 36455

SEQ ID NO: 408046 - RNA, 64 nt, hsa; identical to SEQ ID NO: 36456

SEQ ID NO: 408047 - RNA, 64 nt, hsa; identical to SEQ ID NO: 36457

SEQ ID NO: 408048 - RNA, 64 nt, hsa; identical to SEQ ID NO: 36458

SEQ ID NO: 408049 - RNA, 64 nt, hsa; identical to SEQ ID NO: 36459

SEQ ID NO: 408050 - RNA, 64 nt, hsa; identical to SEQ ID NO: 36460

SEQ ID NO: 408051 - RNA, 64 nt, hsa; identical to SEQ ID NO: 36461

SEQ ID NO: 408052 - RNA, 64 nt, hsa; identical to SEQ ID NO: 36462

SEQ ID NO: 408053 - RNA, 64 nt, hsa; identical to SEQ ID NO: 36463

SEQ ID NO: 408054 - RNA, 64 nt, hsa; identical to SEQ ID NO: 36464

SEQ ID NO: 408055 - RNA, 64 nt, hsa; identical to SEQ ID NO: 36465

SEQ ID NO: 408056 - RNA, 64 nt, hsa; identical to SEQ ID NO: 36466

SEQ ID NO: 408057 - RNA, 64 nt, hsa; identical to SEQ ID NO: 36467

SEQ ID NO: 408058 - RNA, 64 nt, hsa; identical to SEQ ID NO: 36468

SEQ ID NO: 408059 - RNA, 64 nt, hsa; identical to SEQ ID NO: 36469

SEQ ID NO: 408060 - RNA, 64 nt, hsa; identical to SEQ ID NO: 36470

SEQ ID NO: 408061 - RNA, 64 nt, hsa; identical to SEQ ID NO: 36471

SEQ ID NO: 408062 - RNA, 64 nt, hsa; identical to SEQ ID NO: 36472

SEQ ID NO: 408063 - RNA, 64 nt, hsa; identical to SEQ ID NO: 36473

SEQ ID NO: 408064 - RNA, 64 nt, hsa; identical to SEQ ID NO: 36474

SEQ ID NO: 408065 - RNA, 64 nt, hsa; identical to SEQ ID NO: 36475

SEQ ID NO: 408066 - RNA, 64 nt, hsa; identical to SEQ ID NO: 36476

SEQ ID NO: 408067 - RNA, 64 nt, hsa; identical to SEQ ID NO: 36477

SEQ ID NO: 408068 - RNA, 64 nt, hsa; identical to SEQ ID NO: 36478

SEQ ID NO: 408069 - RNA, 64 nt, hsa; identical to SEQ ID NO: 36479

SEQ ID NO: 408070 - RNA, 64 nt, hsa; identical to SEQ ID NO: 36480

SEQ ID NO: 408071 - RNA, 64 nt, hsa; identical to SEQ ID NO: 36481

SEQ ID NO: 408072 - RNA, 64 nt, hsa; identical to SEQ ID NO: 36482

SEQ ID NO: 408073 - RNA, 64 nt, hsa; identical to SEQ ID NO: 36483

SEQ ID NO: 408074 - RNA, 64 nt, hsa; identical to SEQ ID NO: 36484

SEQ ID NO: 408075 - RNA, 64 nt, hsa; identical to SEQ ID NO: 36485

SEQ ID NO: 408076 - RNA, 64 nt, hsa; identical to SEQ ID NO: 36486

SEQ ID NO: 408077 - RNA, 64 nt, hsa; identical to SEQ ID NO: 36487

SEQ ID NO: 408078 - RNA, 64 nt, hsa; identical to SEQ ID NO: 36488

SEQ ID NO: 408079 - RNA, 64 nt, hsa; identical to SEQ ID NO: 36489

SEQ ID NO: 408080 - RNA, 64 nt, hsa; identical to SEQ ID NO: 36490

SEQ ID NO: 408081 - RNA, 64 nt, hsa; identical to SEQ ID NO: 36491

SEQ ID NO: 408082 - RNA, 64 nt, hsa; identical to SEQ ID NO: 36492

SEQ ID NO: 408083 - RNA, 64 nt, hsa; identical to SEQ ID NO: 36493

SEQ ID NO: 408084 - RNA, 64 nt, hsa; identical to SEQ ID NO: 36494

SEQ ID NO: 408085 - RNA, 64 nt, hsa; identical to SEQ ID NO: 36495

SEQ ID NO: 408086 - RNA, 64 nt, hsa; identical to SEQ ID NO: 36496

SEQ ID NO: 408087 - RNA, 64 nt, hsa; identical to SEQ ID NO: 36497

SEQ ID NO: 408088 - RNA, 64 nt, hsa; identical to SEQ ID NO: 36498

SEQ ID NO: 408089 - RNA, 64 nt, hsa; identical to SEQ ID NO: 36499

SEQ ID NO: 408090 - RNA, 64 nt, hsa; identical to SEQ ID NO: 36500

SEQ ID NO: 408091 - RNA, 64 nt, hsa; identical to SEQ ID NO: 36501

SEQ ID NO: 408092 - RNA, 64 nt, hsa; identical to SEQ ID NO: 36502

SEQ ID NO: 408093 - RNA, 64 nt, hsa; identical to SEQ ID NO: 36503

SEQ ID NO: 408094 - RNA, 64 nt, hsa; identical to SEQ ID NO: 36504

SEQ ID NO: 408095 - RNA, 64 nt, hsa; identical to SEQ ID NO: 36505

SEQ ID NO: 408096 - RNA, 64 nt, hsa; identical to SEQ ID NO: 36506

SEQ ID NO: 408097 - RNA, 64 nt, hsa; identical to SEQ ID NO: 36507

SEQ ID NO: 408098 - RNA, 64 nt, hsa; identical to SEQ ID NO: 36508

SEQ ID NO: 408099 - RNA, 64 nt, hsa; identical to SEQ ID NO: 36509

SEQ ID NO: 408100 - RNA, 64 nt, hsa; identical to SEQ ID NO: 36510

SEQ ID NO: 408101 - RNA, 64 nt, hsa; identical to SEQ ID NO: 36511

SEQ ID NO: 408102 - RNA, 64 nt, hsa; identical to SEQ ID NO: 36512

SEQ ID NO: 408103 - RNA, 64 nt, hsa; identical to SEQ ID NO: 36513

SEQ ID NO: 408104 - RNA, 64 nt, hsa; identical to SEQ ID NO: 36514

SEQ ID NO: 408105 - RNA, 64 nt, hsa; identical to SEQ ID NO: 36515

SEQ ID NO: 408106 - RNA, 64 nt, hsa; identical to SEQ ID NO: 36516

SEQ ID NO: 408107 - RNA, 64 nt, hsa; identical to SEQ ID NO: 36517

SEQ ID NO: 408108 - RNA, 64 nt, hsa; identical to SEQ ID NO: 36518

SEQ ID NO: 408109 - RNA, 64 nt, hsa; identical to SEQ ID NO: 36519

SEQ ID NO: 408110 - RNA, 64 nt, hsa; identical to SEQ ID NO: 36520

SEQ ID NO: 408111 - RNA, 64 nt, hsa; identical to SEQ ID NO: 36521

SEQ ID NO: 408112 - RNA, 64 nt, hsa; identical to SEQ ID NO: 36522

SEQ ID NO: 408113 - RNA, 64 nt, hsa; identical to SEQ ID NO: 36523

SEQ ID NO: 408114 - RNA, 64 nt, hsa; identical to SEQ ID NO: 36524

SEQ ID NO: 408115 - RNA, 64 nt, hsa; identical to SEQ ID NO: 36525

SEQ ID NO: 408116 - RNA, 64 nt, hsa; identical to SEQ ID NO: 36526

SEQ ID NO: 408117 - RNA, 64 nt, hsa; identical to SEQ ID NO: 36527

SEQ ID NO: 408118 - RNA, 64 nt, hsa; identical to SEQ ID NO: 36528

SEQ ID NO: 408119 - RNA, 64 nt, hsa; identical to SEQ ID NO: 36529

SEQ ID NO: 408120 - RNA, 64 nt, hsa; identical to SEQ ID NO: 36530

SEQ ID NO: 408121 - RNA, 64 nt, hsa; identical to SEQ ID NO: 36531

SEQ ID NO: 408122 - RNA, 64 nt, hsa; identical to SEQ ID NO: 36532

SEQ ID NO: 408123 - RNA, 64 nt, hsa; identical to SEQ ID NO: 36533

SEQ ID NO: 408124 - RNA, 64 nt, hsa; identical to SEQ ID NO: 36534

SEQ ID NO: 408125 - RNA, 64 nt, hsa; identical to SEQ ID NO: 36535

SEQ ID NO: 408126 - RNA, 64 nt, hsa; identical to SEQ ID NO: 36536

SEQ ID NO: 408127 - RNA, 64 nt, hsa; identical to SEQ ID NO: 36537

SEQ ID NO: 408128 - RNA, 64 nt, hsa; identical to SEQ ID NO: 36538

SEQ ID NO: 408129 - RNA, 64 nt, hsa; identical to SEQ ID NO: 36539

SEQ ID NO: 408130 - RNA, 64 nt, hsa; identical to SEQ ID NO: 36540

SEQ ID NO: 408131 - RNA, 64 nt, hsa; identical to SEQ ID NO: 36541

SEQ ID NO: 408132 - RNA, 64 nt, hsa; identical to SEQ ID NO: 36542

SEQ ID NO: 408133 - RNA, 64 nt, hsa; identical to SEQ ID NO: 36543

SEQ ID NO: 408134 - RNA, 64 nt, hsa; identical to SEQ ID NO: 36544

SEQ ID NO: 408135 - RNA, 64 nt, hsa; identical to SEQ ID NO: 36545

SEQ ID NO: 408136 - RNA, 64 nt, hsa; identical to SEQ ID NO: 36546

SEQ ID NO: 408137 - RNA, 64 nt, hsa; identical to SEQ ID NO: 36547

SEQ ID NO: 408138 - RNA, 64 nt, hsa; identical to SEQ ID NO: 36548

SEQ ID NO: 408139 - RNA, 64 nt, hsa; identical to SEQ ID NO: 36549

SEQ ID NO: 408140 - RNA, 64 nt, hsa; identical to SEQ ID NO: 36550

SEQ ID NO: 408141 - RNA, 64 nt, hsa; identical to SEQ ID NO: 36551

SEQ ID NO: 408142 - RNA, 64 nt, hsa; identical to SEQ ID NO: 36552

SEQ ID NO: 408143 - RNA, 64 nt, hsa; identical to SEQ ID NO: 36553

SEQ ID NO: 408144 - RNA, 64 nt, hsa; identical to SEQ ID NO: 36554

SEQ ID NO: 408145 - RNA, 64 nt, hsa; identical to SEQ ID NO: 36555

SEQ ID NO: 408146 - RNA, 64 nt, hsa; identical to SEQ ID NO: 36556

SEQ ID NO: 408147 - RNA, 64 nt, hsa; identical to SEQ ID NO: 36557

SEQ ID NO: 408148 - RNA, 64 nt, hsa; identical to SEQ ID NO: 36558

SEQ ID NO: 408149 - RNA, 64 nt, hsa; identical to SEQ ID NO: 36559

SEQ ID NO: 408150 - RNA, 64 nt, hsa; identical to SEQ ID NO: 36560

SEQ ID NO: 408151 - RNA, 64 nt, hsa; identical to SEQ ID NO: 36561

SEQ ID NO: 408152 - RNA, 64 nt, hsa; identical to SEQ ID NO: 36562

SEQ ID NO: 408153 - RNA, 64 nt, hsa; identical to SEQ ID NO: 36563

SEQ ID NO: 408154 - RNA, 64 nt, hsa; identical to SEQ ID NO: 36564

SEQ ID NO: 408155 - RNA, 64 nt, hsa; identical to SEQ ID NO: 36565

SEQ ID NO: 408156 - RNA, 64 nt, hsa; identical to SEQ ID NO: 36566

SEQ ID NO: 408157 - RNA, 64 nt, hsa; identical to SEQ ID NO: 36567

SEQ ID NO: 408158 - RNA, 64 nt, hsa; identical to SEQ ID NO: 36568

SEQ ID NO: 408159 - RNA, 64 nt, hsa; identical to SEQ ID NO: 36569

SEQ ID NO: 408160 - RNA, 64 nt, hsa; identical to SEQ ID NO: 36570

SEQ ID NO: 408161 - RNA, 64 nt, hsa; identical to SEQ ID NO: 36571

SEQ ID NO: 408162 - RNA, 64 nt, hsa; identical to SEQ ID NO: 36572

SEQ ID NO: 408163 - RNA, 64 nt, hsa; identical to SEQ ID NO: 36573

SEQ ID NO: 408164 - RNA, 64 nt, hsa; identical to SEQ ID NO: 36574

SEQ ID NO: 408165 - RNA, 64 nt, hsa; identical to SEQ ID NO: 36575

SEQ ID NO: 408166 - RNA, 64 nt, hsa; identical to SEQ ID NO: 36576

SEQ ID NO: 408167 - RNA, 64 nt, hsa; identical to SEQ ID NO: 36577

SEQ ID NO: 408168 - RNA, 64 nt, hsa; identical to SEQ ID NO: 36578

SEQ ID NO: 408169 - RNA, 64 nt, hsa; identical to SEQ ID NO: 36579

SEQ ID NO: 408170 - RNA, 64 nt, hsa; identical to SEQ ID NO: 36580

SEQ ID NO: 408171 - RNA, 64 nt, hsa; identical to SEQ ID NO: 36581

SEQ ID NO: 408172 - RNA, 64 nt, hsa; identical to SEQ ID NO: 36582

SEQ ID NO: 408173 - RNA, 64 nt, hsa; identical to SEQ ID NO: 36583

SEQ ID NO: 408174 - RNA, 64 nt, hsa; identical to SEQ ID NO: 36584

SEQ ID NO: 408175 - RNA, 64 nt, hsa; identical to SEQ ID NO: 36585

SEQ ID NO: 408176 - RNA, 64 nt, hsa; identical to SEQ ID NO: 36586

SEQ ID NO: 408177 - RNA, 64 nt, hsa; identical to SEQ ID NO: 36587

SEQ ID NO: 408178 - RNA, 64 nt, hsa; identical to SEQ ID NO: 36588

SEQ ID NO: 408179 - RNA, 64 nt, hsa; identical to SEQ ID NO: 36589

SEQ ID NO: 408180 - RNA, 64 nt, hsa; identical to SEQ ID NO: 36590

SEQ ID NO: 408181 - RNA, 64 nt, hsa; identical to SEQ ID NO: 36591

SEQ ID NO: 408182 - RNA, 64 nt, hsa; identical to SEQ ID NO: 36592

SEQ ID NO: 408183 - RNA, 64 nt, hsa; identical to SEQ ID NO: 36593

SEQ ID NO: 408184 - RNA, 64 nt, hsa; identical to SEQ ID NO: 36594

SEQ ID NO: 408185 - RNA, 64 nt, hsa; identical to SEQ ID NO: 36595

SEQ ID NO: 408186 - RNA, 64 nt, hsa; identical to SEQ ID NO: 36596

SEQ ID NO: 408187 - RNA, 64 nt, hsa; identical to SEQ ID NO: 36597

SEQ ID NO: 408188 - RNA, 64 nt, hsa; identical to SEQ ID NO: 36598

SEQ ID NO: 408189 - RNA, 64 nt, hsa; identical to SEQ ID NO: 36599

SEQ ID NO: 408190 - RNA, 64 nt, hsa; identical to SEQ ID NO: 36600

SEQ ID NO: 408191 - RNA, 64 nt, hsa; identical to SEQ ID NO: 36601

SEQ ID NO: 408192 - RNA, 64 nt, hsa; identical to SEQ ID NO: 36602

SEQ ID NO: 408193 - RNA, 64 nt, hsa; identical to SEQ ID NO: 36603

SEQ ID NO: 408194 - RNA, 64 nt, hsa; identical to SEQ ID NO: 36604

SEQ ID NO: 408195 - RNA, 64 nt, hsa; identical to SEQ ID NO: 36605

SEQ ID NO: 408196 - RNA, 64 nt, hsa; identical to SEQ ID NO: 36606

SEQ ID NO: 408197 - RNA, 64 nt, hsa; identical to SEQ ID NO: 36607

SEQ ID NO: 408198 - RNA, 64 nt, hsa; identical to SEQ ID NO: 36608

SEQ ID NO: 408199 - RNA, 64 nt, hsa; identical to SEQ ID NO: 36609

SEQ ID NO: 408200 - RNA, 64 nt, hsa; identical to SEQ ID NO: 36610

SEQ ID NO: 408201 - RNA, 64 nt, hsa; identical to SEQ ID NO: 36611

SEQ ID NO: 408202 - RNA, 64 nt, hsa; identical to SEQ ID NO: 36612

SEQ ID NO: 408203 - RNA, 64 nt, hsa; identical to SEQ ID NO: 36613

SEQ ID NO: 408204 - RNA, 64 nt, hsa; identical to SEQ ID NO: 36614

SEQ ID NO: 408205 - RNA, 64 nt, hsa; identical to SEQ ID NO: 36615

SEQ ID NO: 408206 - RNA, 64 nt, hsa; identical to SEQ ID NO: 36616

SEQ ID NO: 408207 - RNA, 64 nt, hsa; identical to SEQ ID NO: 36617

SEQ ID NO: 408208 - RNA, 64 nt, hsa; identical to SEQ ID NO: 36618

SEQ ID NO: 408209 - RNA, 64 nt, hsa; identical to SEQ ID NO: 36619

SEQ ID NO: 408210 - RNA, 64 nt, hsa; identical to SEQ ID NO: 36620

SEQ ID NO: 408211 - RNA, 64 nt, hsa; identical to SEQ ID NO: 36621

SEQ ID NO: 408212 - RNA, 64 nt, hsa; identical to SEQ ID NO: 36622

SEQ ID NO: 408213 - RNA, 64 nt, hsa; identical to SEQ ID NO: 36623

SEQ ID NO: 408214 - RNA, 64 nt, hsa; identical to SEQ ID NO: 36624

SEQ ID NO: 408215 - RNA, 64 nt, hsa; identical to SEQ ID NO: 36625

SEQ ID NO: 408216 - RNA, 64 nt, hsa; identical to SEQ ID NO: 36626

SEQ ID NO: 408217 - RNA, 64 nt, hsa; identical to SEQ ID NO: 36627

SEQ ID NO: 408218 - RNA, 64 nt, hsa; identical to SEQ ID NO: 36628

SEQ ID NO: 408219 - RNA, 64 nt, hsa; identical to SEQ ID NO: 36629

SEQ ID NO: 408220 - RNA, 64 nt, hsa; identical to SEQ ID NO: 36630

SEQ ID NO: 408221 - RNA, 64 nt, hsa; identical to SEQ ID NO: 36631

SEQ ID NO: 408222 - RNA, 64 nt, hsa; identical to SEQ ID NO: 36632

SEQ ID NO: 408223 - RNA, 64 nt, hsa; identical to SEQ ID NO: 36633

SEQ ID NO: 408224 - RNA, 64 nt, hsa; identical to SEQ ID NO: 36634

SEQ ID NO: 408225 - RNA, 64 nt, hsa; identical to SEQ ID NO: 36635

SEQ ID NO: 408226 - RNA, 64 nt, hsa; identical to SEQ ID NO: 36636

SEQ ID NO: 408227 - RNA, 64 nt, hsa; identical to SEQ ID NO: 36637

SEQ ID NO: 408228 - RNA, 64 nt, hsa; identical to SEQ ID NO: 36638

SEQ ID NO: 408229 - RNA, 64 nt, hsa; identical to SEQ ID NO: 36639

SEQ ID NO: 408230 - RNA, 64 nt, hsa; identical to SEQ ID NO: 36640

SEQ ID NO: 408231 - RNA, 64 nt, hsa; identical to SEQ ID NO: 36641

SEQ ID NO: 408232 - RNA, 64 nt, hsa; identical to SEQ ID NO: 36642

SEQ ID NO: 408233 - RNA, 64 nt, hsa; identical to SEQ ID NO: 36643

SEQ ID NO: 408234 - RNA, 64 nt, hsa; identical to SEQ ID NO: 36644

SEQ ID NO: 408235 - RNA, 64 nt, hsa; identical to SEQ ID NO: 36645

SEQ ID NO: 408236 - RNA, 64 nt, hsa; identical to SEQ ID NO: 36646

SEQ ID NO: 408237 - RNA, 64 nt, hsa; identical to SEQ ID NO: 36647

SEQ ID NO: 408238 - RNA, 64 nt, hsa; identical to SEQ ID NO: 36648

SEQ ID NO: 408239 - RNA, 64 nt, hsa; identical to SEQ ID NO: 36649

SEQ ID NO: 408240 - RNA, 64 nt, hsa; identical to SEQ ID NO: 36650

SEQ ID NO: 408241 - RNA, 64 nt, hsa; identical to SEQ ID NO: 36651

SEQ ID NO: 408242 - RNA, 64 nt, hsa; identical to SEQ ID NO: 36652

SEQ ID NO: 408243 - RNA, 64 nt, hsa; identical to SEQ ID NO: 36653

SEQ ID NO: 408244 - RNA, 64 nt, hsa; identical to SEQ ID NO: 36654

SEQ ID NO: 408245 - RNA, 64 nt, hsa; identical to SEQ ID NO: 36655

SEQ ID NO: 408246 - RNA, 64 nt, hsa; identical to SEQ ID NO: 36656

SEQ ID NO: 408247 - RNA, 64 nt, hsa; identical to SEQ ID NO: 36657

SEQ ID NO: 408248 - RNA, 64 nt, hsa; identical to SEQ ID NO: 36658

SEQ ID NO: 408249 - RNA, 64 nt, hsa; identical to SEQ ID NO: 36659

SEQ ID NO: 408250 - RNA, 64 nt, hsa; identical to SEQ ID NO: 36660

SEQ ID NO: 408251 - RNA, 64 nt, hsa; identical to SEQ ID NO: 36661

SEQ ID NO: 408252 - RNA, 64 nt, hsa; identical to SEQ ID NO: 36662

SEQ ID NO: 408253 - RNA, 64 nt, hsa; identical to SEQ ID NO: 36663

SEQ ID NO: 408254 - RNA, 64 nt, hsa; identical to SEQ ID NO: 36664

SEQ ID NO: 408255 - RNA, 64 nt, hsa; identical to SEQ ID NO: 36665

SEQ ID NO: 408256 - RNA, 64 nt, hsa; identical to SEQ ID NO: 36666

SEQ ID NO: 408257 - RNA, 64 nt, hsa; identical to SEQ ID NO: 36667

SEQ ID NO: 408258 - RNA, 64 nt, hsa; identical to SEQ ID NO: 36668

SEQ ID NO: 408259 - RNA, 64 nt, hsa; identical to SEQ ID NO: 36669

SEQ ID NO: 408260 - RNA, 64 nt, hsa; identical to SEQ ID NO: 36670

SEQ ID NO: 408261 - RNA, 64 nt, hsa; identical to SEQ ID NO: 36671

SEQ ID NO: 408262 - RNA, 64 nt, hsa; identical to SEQ ID NO: 36672

SEQ ID NO: 408263 - RNA, 64 nt, hsa; identical to SEQ ID NO: 36673

SEQ ID NO: 408264 - RNA, 64 nt, hsa; identical to SEQ ID NO: 36674

SEQ ID NO: 408265 - RNA, 64 nt, hsa; identical to SEQ ID NO: 36675

SEQ ID NO: 408266 - RNA, 64 nt, hsa; identical to SEQ ID NO: 36676

SEQ ID NO: 408267 - RNA, 64 nt, hsa; identical to SEQ ID NO: 36677

SEQ ID NO: 408268 - RNA, 64 nt, hsa; identical to SEQ ID NO: 36678

SEQ ID NO: 408269 - RNA, 64 nt, hsa; identical to SEQ ID NO: 36679

SEQ ID NO: 408270 - RNA, 64 nt, hsa; identical to SEQ ID NO: 36680

SEQ ID NO: 408271 - RNA, 64 nt, hsa; identical to SEQ ID NO: 36681

SEQ ID NO: 408272 - RNA, 64 nt, hsa; identical to SEQ ID NO: 36682

SEQ ID NO: 408273 - RNA, 64 nt, hsa; identical to SEQ ID NO: 36683

SEQ ID NO: 408274 - RNA, 64 nt, hsa; identical to SEQ ID NO: 36684

SEQ ID NO: 408275 - RNA, 64 nt, hsa; identical to SEQ ID NO: 36685

SEQ ID NO: 408276 - RNA, 64 nt, hsa; identical to SEQ ID NO: 36686

SEQ ID NO: 408277 - RNA, 64 nt, hsa; identical to SEQ ID NO: 36687

SEQ ID NO: 408278 - RNA, 64 nt, hsa; identical to SEQ ID NO: 36688

SEQ ID NO: 408279 - RNA, 64 nt, hsa; identical to SEQ ID NO: 36689

SEQ ID NO: 408280 - RNA, 64 nt, hsa; identical to SEQ ID NO: 36690

SEQ ID NO: 408281 - RNA, 64 nt, hsa; identical to SEQ ID NO: 36691

SEQ ID NO: 408282 - RNA, 64 nt, hsa; identical to SEQ ID NO: 36692

SEQ ID NO: 408283 - RNA, 64 nt, hsa; identical to SEQ ID NO: 36693

SEQ ID NO: 408284 - RNA, 64 nt, hsa; identical to SEQ ID NO: 36694

SEQ ID NO: 408285 - RNA, 64 nt, hsa; identical to SEQ ID NO: 36695

SEQ ID NO: 408286 - RNA, 64 nt, hsa; identical to SEQ ID NO: 36696

SEQ ID NO: 408287 - RNA, 64 nt, hsa; identical to SEQ ID NO: 36697

SEQ ID NO: 408288 - RNA, 64 nt, hsa; identical to SEQ ID NO: 36698

SEQ ID NO: 408289 - RNA, 64 nt, hsa; identical to SEQ ID NO: 36699

SEQ ID NO: 408290 - RNA, 64 nt, hsa; identical to SEQ ID NO: 36700

SEQ ID NO: 408291 - RNA, 64 nt, hsa; identical to SEQ ID NO: 36701

SEQ ID NO: 408292 - RNA, 64 nt, hsa; identical to SEQ ID NO: 36702

SEQ ID NO: 408293 - RNA, 64 nt, hsa; identical to SEQ ID NO: 36703

SEQ ID NO: 408294 - RNA, 64 nt, hsa; identical to SEQ ID NO: 36704

SEQ ID NO: 408295 - RNA, 64 nt, hsa; identical to SEQ ID NO: 36705

SEQ ID NO: 408296 - RNA, 64 nt, hsa; identical to SEQ ID NO: 36706

SEQ ID NO: 408297 - RNA, 64 nt, hsa; identical to SEQ ID NO: 36707

SEQ ID NO: 408298 - RNA, 64 nt, hsa; identical to SEQ ID NO: 36708

SEQ ID NO: 408299 - RNA, 64 nt, hsa; identical to SEQ ID NO: 36709

SEQ ID NO: 408300 - RNA, 64 nt, hsa; identical to SEQ ID NO: 36710

SEQ ID NO: 408301 - RNA, 64 nt, hsa; identical to SEQ ID NO: 36711

SEQ ID NO: 408302 - RNA, 64 nt, hsa; identical to SEQ ID NO: 36712

SEQ ID NO: 408303 - RNA, 64 nt, hsa; identical to SEQ ID NO: 36713

SEQ ID NO: 408304 - RNA, 64 nt, hsa; identical to SEQ ID NO: 36714

SEQ ID NO: 408305 - RNA, 64 nt, hsa; identical to SEQ ID NO: 36715

SEQ ID NO: 408306 - RNA, 64 nt, hsa; identical to SEQ ID NO: 36716

SEQ ID NO: 408307 - RNA, 64 nt, hsa; identical to SEQ ID NO: 36717

SEQ ID NO: 408308 - RNA, 64 nt, hsa; identical to SEQ ID NO: 36718

SEQ ID NO: 408309 - RNA, 64 nt, hsa; identical to SEQ ID NO: 36719

SEQ ID NO: 408310 - RNA, 64 nt, hsa; identical to SEQ ID NO: 36720

SEQ ID NO: 408311 - RNA, 64 nt, hsa; identical to SEQ ID NO: 36721

SEQ ID NO: 408312 - RNA, 64 nt, hsa; identical to SEQ ID NO: 36722

SEQ ID NO: 408313 - RNA, 64 nt, hsa; identical to SEQ ID NO: 36723

SEQ ID NO: 408314 - RNA, 64 nt, hsa; identical to SEQ ID NO: 36724

SEQ ID NO: 408315 - RNA, 64 nt, hsa; identical to SEQ ID NO: 36725

SEQ ID NO: 408316 - RNA, 64 nt, hsa; identical to SEQ ID NO: 36726

SEQ ID NO: 408317 - RNA, 64 nt, hsa; identical to SEQ ID NO: 36727

SEQ ID NO: 408318 - RNA, 64 nt, hsa; identical to SEQ ID NO: 36728

SEQ ID NO: 408319 - RNA, 64 nt, hsa; identical to SEQ ID NO: 36729

SEQ ID NO: 408320 - RNA, 64 nt, hsa; identical to SEQ ID NO: 36730

SEQ ID NO: 408321 - RNA, 64 nt, hsa; identical to SEQ ID NO: 36731

SEQ ID NO: 408322 - RNA, 64 nt, hsa; identical to SEQ ID NO: 36732

SEQ ID NO: 408323 - RNA, 64 nt, hsa; identical to SEQ ID NO: 36733

SEQ ID NO: 408324 - RNA, 64 nt, hsa; identical to SEQ ID NO: 36734

SEQ ID NO: 408325 - RNA, 64 nt, hsa; identical to SEQ ID NO: 36735

SEQ ID NO: 408326 - RNA, 64 nt, hsa; identical to SEQ ID NO: 36736

SEQ ID NO: 408327 - RNA, 64 nt, hsa; identical to SEQ ID NO: 36737

SEQ ID NO: 408328 - RNA, 64 nt, hsa; identical to SEQ ID NO: 36738

SEQ ID NO: 408329 - RNA, 64 nt, hsa; identical to SEQ ID NO: 36739

SEQ ID NO: 408330 - RNA, 64 nt, hsa; identical to SEQ ID NO: 36740

SEQ ID NO: 408331 - RNA, 64 nt, hsa; identical to SEQ ID NO: 36741

SEQ ID NO: 408332 - RNA, 64 nt, hsa; identical to SEQ ID NO: 36742

SEQ ID NO: 408333 - RNA, 64 nt, hsa; identical to SEQ ID NO: 36743

SEQ ID NO: 408334 - RNA, 64 nt, hsa; identical to SEQ ID NO: 36744

SEQ ID NO: 408335 - RNA, 64 nt, hsa; identical to SEQ ID NO: 36745

SEQ ID NO: 408336 - RNA, 64 nt, hsa; identical to SEQ ID NO: 36746

SEQ ID NO: 408337 - RNA, 64 nt, hsa; identical to SEQ ID NO: 36747

SEQ ID NO: 408338 - RNA, 64 nt, hsa; identical to SEQ ID NO: 36748

SEQ ID NO: 408339 - RNA, 64 nt, hsa; identical to SEQ ID NO: 36749

SEQ ID NO: 408340 - RNA, 64 nt, hsa; identical to SEQ ID NO: 36750

SEQ ID NO: 408341 - RNA, 64 nt, hsa; identical to SEQ ID NO: 36751

SEQ ID NO: 408342 - RNA, 64 nt, hsa; identical to SEQ ID NO: 36752

SEQ ID NO: 408343 - RNA, 64 nt, hsa; identical to SEQ ID NO: 36753

SEQ ID NO: 408344 - RNA, 64 nt, hsa; identical to SEQ ID NO: 36754

SEQ ID NO: 408345 - RNA, 64 nt, hsa; identical to SEQ ID NO: 36755

SEQ ID NO: 408346 - RNA, 64 nt, hsa; identical to SEQ ID NO: 36756

SEQ ID NO: 408347 - RNA, 64 nt, hsa; identical to SEQ ID NO: 36757

SEQ ID NO: 408348 - RNA, 64 nt, hsa; identical to SEQ ID NO: 36758

SEQ ID NO: 408349 - RNA, 64 nt, hsa; identical to SEQ ID NO: 36759

SEQ ID NO: 408350 - RNA, 64 nt, hsa; identical to SEQ ID NO: 36760

SEQ ID NO: 408351 - RNA, 64 nt, hsa; identical to SEQ ID NO: 36761

SEQ ID NO: 408352 - RNA, 64 nt, hsa; identical to SEQ ID NO: 36762

SEQ ID NO: 408353 - RNA, 64 nt, hsa; identical to SEQ ID NO: 36763

SEQ ID NO: 408354 - RNA, 64 nt, hsa; identical to SEQ ID NO: 36764

SEQ ID NO: 408355 - RNA, 64 nt, hsa; identical to SEQ ID NO: 36765

SEQ ID NO: 408356 - RNA, 64 nt, hsa; identical to SEQ ID NO: 36766

SEQ ID NO: 408357 - RNA, 64 nt, hsa; identical to SEQ ID NO: 36767

SEQ ID NO: 408358 - RNA, 64 nt, hsa; identical to SEQ ID NO: 36768

SEQ ID NO: 408359 - RNA, 64 nt, hsa; identical to SEQ ID NO: 36769

SEQ ID NO: 408360 - RNA, 64 nt, hsa; identical to SEQ ID NO: 36770

SEQ ID NO: 408361 - RNA, 64 nt, hsa; identical to SEQ ID NO: 36771

SEQ ID NO: 408362 - RNA, 64 nt, hsa; identical to SEQ ID NO: 36772

SEQ ID NO: 408363 - RNA, 64 nt, hsa; identical to SEQ ID NO: 36773

SEQ ID NO: 408364 - RNA, 64 nt, hsa; identical to SEQ ID NO: 36774

SEQ ID NO: 408365 - RNA, 64 nt, hsa; identical to SEQ ID NO: 36775

SEQ ID NO: 408366 - RNA, 61 nt, hsa; identical to SEQ ID NO: 36776

SEQ ID NO: 408367 - RNA, 62 nt, hsa; identical to SEQ ID NO: 36777

SEQ ID NO: 408368 - RNA, 64 nt, hsa; identical to SEQ ID NO: 36778

SEQ ID NO: 408369 - RNA, 64 nt, hsa; identical to SEQ ID NO: 36779

SEQ ID NO: 408370 - RNA, 64 nt, hsa; identical to SEQ ID NO: 36780

SEQ ID NO: 408371 - RNA, 64 nt, hsa; identical to SEQ ID NO: 36781

SEQ ID NO: 408372 - RNA, 64 nt, hsa; identical to SEQ ID NO: 36782

SEQ ID NO: 408373 - RNA, 64 nt, hsa; identical to SEQ ID NO: 36783

SEQ ID NO: 408374 - RNA, 64 nt, hsa; identical to SEQ ID NO: 36784

SEQ ID NO: 408375 - RNA, 64 nt, hsa; identical to SEQ ID NO: 36785

SEQ ID NO: 408376 - RNA, 64 nt, hsa; identical to SEQ ID NO: 36786

SEQ ID NO: 408377 - RNA, 64 nt, hsa; identical to SEQ ID NO: 36787

SEQ ID NO: 408378 - RNA, 64 nt, hsa; identical to SEQ ID NO: 36788

SEQ ID NO: 408379 - RNA, 64 nt, hsa; identical to SEQ ID NO: 36789

SEQ ID NO: 408380 - RNA, 64 nt, hsa; identical to SEQ ID NO: 36790

SEQ ID NO: 408381 - RNA, 64 nt, hsa; identical to SEQ ID NO: 36791

SEQ ID NO: 408382 - RNA, 64 nt, hsa; identical to SEQ ID NO: 36792

SEQ ID NO: 408383 - RNA, 64 nt, hsa; identical to SEQ ID NO: 36793

SEQ ID NO: 408384 - RNA, 64 nt, hsa; identical to SEQ ID NO: 36794

SEQ ID NO: 408385 - RNA, 64 nt, hsa; identical to SEQ ID NO: 36795

SEQ ID NO: 408386 - RNA, 64 nt, hsa; identical to SEQ ID NO: 36796

SEQ ID NO: 408387 - RNA, 64 nt, hsa; identical to SEQ ID NO: 36797

SEQ ID NO: 408388 - RNA, 64 nt, hsa; identical to SEQ ID NO: 36798

SEQ ID NO: 408389 - RNA, 64 nt, hsa; identical to SEQ ID NO: 36799

SEQ ID NO: 408390 - RNA, 64 nt, hsa; identical to SEQ ID NO: 36800

SEQ ID NO: 408391 - RNA, 64 nt, hsa; identical to SEQ ID NO: 36801

SEQ ID NO: 408392 - RNA, 64 nt, hsa; identical to SEQ ID NO: 36802

SEQ ID NO: 408393 - RNA, 64 nt, hsa; identical to SEQ ID NO: 36803

SEQ ID NO: 408394 - RNA, 64 nt, hsa; identical to SEQ ID NO: 36804

SEQ ID NO: 408395 - RNA, 64 nt, hsa; identical to SEQ ID NO: 36805

SEQ ID NO: 408396 - RNA, 64 nt, hsa; identical to SEQ ID NO: 36806

SEQ ID NO: 408397 - RNA, 64 nt, hsa; identical to SEQ ID NO: 36807

SEQ ID NO: 408398 - RNA, 64 nt, hsa; identical to SEQ ID NO: 36808

SEQ ID NO: 408399 - RNA, 64 nt, hsa; identical to SEQ ID NO: 36809

SEQ ID NO: 408400 - RNA, 64 nt, hsa; identical to SEQ ID NO: 36810

SEQ ID NO: 408401 - RNA, 64 nt, hsa; identical to SEQ ID NO: 36811

SEQ ID NO: 408402 - RNA, 64 nt, hsa; identical to SEQ ID NO: 36812

SEQ ID NO: 408403 - RNA, 64 nt, hsa; identical to SEQ ID NO: 36813

SEQ ID NO: 408404 - RNA, 64 nt, hsa; identical to SEQ ID NO: 36814

SEQ ID NO: 408405 - RNA, 64 nt, hsa; identical to SEQ ID NO: 36815

SEQ ID NO: 408406 - RNA, 64 nt, hsa; identical to SEQ ID NO: 36816

SEQ ID NO: 408407 - RNA, 64 nt, hsa; identical to SEQ ID NO: 36817

SEQ ID NO: 408408 - RNA, 64 nt, hsa; identical to SEQ ID NO: 36818

SEQ ID NO: 408409 - RNA, 64 nt, hsa; identical to SEQ ID NO: 36819

SEQ ID NO: 408410 - RNA, 64 nt, hsa; identical to SEQ ID NO: 36820

SEQ ID NO: 408411 - RNA, 64 nt, hsa; identical to SEQ ID NO: 36821

SEQ ID NO: 408412 - RNA, 64 nt, hsa; identical to SEQ ID NO: 36822

SEQ ID NO: 408413 - RNA, 64 nt, hsa; identical to SEQ ID NO: 36823

SEQ ID NO: 408414 - RNA, 64 nt, hsa; identical to SEQ ID NO: 36824

SEQ ID NO: 408415 - RNA, 64 nt, hsa; identical to SEQ ID NO: 36825

SEQ ID NO: 408416 - RNA, 64 nt, hsa; identical to SEQ ID NO: 36826

SEQ ID NO: 408417 - RNA, 64 nt, hsa; identical to SEQ ID NO: 36827

SEQ ID NO: 408418 - RNA, 64 nt, hsa; identical to SEQ ID NO: 36828

SEQ ID NO: 408419 - RNA, 64 nt, hsa; identical to SEQ ID NO: 36829

SEQ ID NO: 408420 - RNA, 64 nt, hsa; identical to SEQ ID NO: 36830

SEQ ID NO: 408421 - RNA, 64 nt, hsa; identical to SEQ ID NO: 36831

SEQ ID NO: 408422 - RNA, 64 nt, hsa; identical to SEQ ID NO: 36832

SEQ ID NO: 408423 - RNA, 64 nt, hsa; identical to SEQ ID NO: 36833

SEQ ID NO: 408424 - RNA, 64 nt, hsa; identical to SEQ ID NO: 36834

SEQ ID NO: 408425 - RNA, 64 nt, hsa; identical to SEQ ID NO: 36835

SEQ ID NO: 408426 - RNA, 64 nt, hsa; identical to SEQ ID NO: 36836

SEQ ID NO: 408427 - RNA, 64 nt, hsa; identical to SEQ ID NO: 36837

SEQ ID NO: 408428 - RNA, 64 nt, hsa; identical to SEQ ID NO: 36838

SEQ ID NO: 408429 - RNA, 64 nt, hsa; identical to SEQ ID NO: 36839

SEQ ID NO: 408430 - RNA, 64 nt, hsa; identical to SEQ ID NO: 36840

SEQ ID NO: 408431 - RNA, 64 nt, hsa; identical to SEQ ID NO: 36841

SEQ ID NO: 408432 - RNA, 64 nt, hsa; identical to SEQ ID NO: 36842

SEQ ID NO: 408433 - RNA, 64 nt, hsa; identical to SEQ ID NO: 36843

SEQ ID NO: 408434 - RNA, 64 nt, hsa; identical to SEQ ID NO: 36844

SEQ ID NO: 408435 - RNA, 64 nt, hsa; identical to SEQ ID NO: 36845

SEQ ID NO: 408436 - RNA, 64 nt, hsa; identical to SEQ ID NO: 36846

SEQ ID NO: 408437 - RNA, 64 nt, hsa; identical to SEQ ID NO: 36847

SEQ ID NO: 408438 - RNA, 64 nt, hsa; identical to SEQ ID NO: 36848

SEQ ID NO: 408439 - RNA, 64 nt, hsa; identical to SEQ ID NO: 36849

SEQ ID NO: 408440 - RNA, 64 nt, hsa; identical to SEQ ID NO: 36850

SEQ ID NO: 408441 - RNA, 64 nt, hsa; identical to SEQ ID NO: 36851

SEQ ID NO: 408442 - RNA, 64 nt, hsa; identical to SEQ ID NO: 36852

SEQ ID NO: 408443 - RNA, 64 nt, hsa; identical to SEQ ID NO: 36853

SEQ ID NO: 408444 - RNA, 64 nt, hsa; identical to SEQ ID NO: 36854

SEQ ID NO: 408445 - RNA, 64 nt, hsa; identical to SEQ ID NO: 36855

SEQ ID NO: 408446 - RNA, 64 nt, hsa; identical to SEQ ID NO: 36856

SEQ ID NO: 408447 - RNA, 64 nt, hsa; identical to SEQ ID NO: 36857

SEQ ID NO: 408448 - RNA, 64 nt, hsa; identical to SEQ ID NO: 36858

SEQ ID NO: 408449 - RNA, 64 nt, hsa; identical to SEQ ID NO: 36859

SEQ ID NO: 408450 - RNA, 64 nt, hsa; identical to SEQ ID NO: 36860

SEQ ID NO: 408451 - RNA, 64 nt, hsa; identical to SEQ ID NO: 36861

SEQ ID NO: 408452 - RNA, 64 nt, hsa; identical to SEQ ID NO: 36862

SEQ ID NO: 408453 - RNA, 64 nt, hsa; identical to SEQ ID NO: 36863

SEQ ID NO: 408454 - RNA, 64 nt, hsa; identical to SEQ ID NO: 36864

SEQ ID NO: 408455 - RNA, 64 nt, hsa; identical to SEQ ID NO: 36865

SEQ ID NO: 408456 - RNA, 64 nt, hsa; identical to SEQ ID NO: 36866

SEQ ID NO: 408457 - RNA, 64 nt, hsa; identical to SEQ ID NO: 36867

SEQ ID NO: 408458 - RNA, 64 nt, hsa; identical to SEQ ID NO: 36868

SEQ ID NO: 408459 - RNA, 64 nt, hsa; identical to SEQ ID NO: 36869

SEQ ID NO: 408460 - RNA, 64 nt, hsa; identical to SEQ ID NO: 36870

SEQ ID NO: 408461 - RNA, 64 nt, hsa; identical to SEQ ID NO: 36871

SEQ ID NO: 408462 - RNA, 64 nt, hsa; identical to SEQ ID NO: 36872

SEQ ID NO: 408463 - RNA, 64 nt, hsa; identical to SEQ ID NO: 36873

SEQ ID NO: 408464 - RNA, 64 nt, hsa; identical to SEQ ID NO: 36874

SEQ ID NO: 408465 - RNA, 64 nt, hsa; identical to SEQ ID NO: 36875

SEQ ID NO: 408466 - RNA, 64 nt, hsa; identical to SEQ ID NO: 36876

SEQ ID NO: 408467 - RNA, 64 nt, hsa; identical to SEQ ID NO: 36877

SEQ ID NO: 408468 - RNA, 64 nt, hsa; identical to SEQ ID NO: 36878

SEQ ID NO: 408469 - RNA, 64 nt, hsa; identical to SEQ ID NO: 36879

SEQ ID NO: 408470 - RNA, 64 nt, hsa; identical to SEQ ID NO: 36880

SEQ ID NO: 408471 - RNA, 64 nt, hsa; identical to SEQ ID NO: 36881

SEQ ID NO: 408472 - RNA, 64 nt, hsa; identical to SEQ ID NO: 36882

SEQ ID NO: 408473 - RNA, 64 nt, hsa; identical to SEQ ID NO: 36883

SEQ ID NO: 408474 - RNA, 64 nt, hsa; identical to SEQ ID NO: 36884

SEQ ID NO: 408475 - RNA, 64 nt, hsa; identical to SEQ ID NO: 36885

SEQ ID NO: 408476 - RNA, 64 nt, hsa; identical to SEQ ID NO: 36886

SEQ ID NO: 408477 - RNA, 64 nt, hsa; identical to SEQ ID NO: 36887

SEQ ID NO: 408478 - RNA, 64 nt, hsa; identical to SEQ ID NO: 36888

SEQ ID NO: 408479 - RNA, 64 nt, hsa; identical to SEQ ID NO: 36889

SEQ ID NO: 408480 - RNA, 64 nt, hsa; identical to SEQ ID NO: 36890

SEQ ID NO: 408481 - RNA, 64 nt, hsa; identical to SEQ ID NO: 36891

SEQ ID NO: 408482 - RNA, 64 nt, hsa; identical to SEQ ID NO: 36892

SEQ ID NO: 408483 - RNA, 64 nt, hsa; identical to SEQ ID NO: 36893

SEQ ID NO: 408484 - RNA, 64 nt, hsa; identical to SEQ ID NO: 36894

SEQ ID NO: 408485 - RNA, 64 nt, hsa; identical to SEQ ID NO: 36895

SEQ ID NO: 408486 - RNA, 64 nt, hsa; identical to SEQ ID NO: 36896

SEQ ID NO: 408487 - RNA, 64 nt, hsa; identical to SEQ ID NO: 36897

SEQ ID NO: 408488 - RNA, 64 nt, hsa; identical to SEQ ID NO: 36898

SEQ ID NO: 408489 - RNA, 64 nt, hsa; identical to SEQ ID NO: 36899

SEQ ID NO: 408490 - RNA, 64 nt, hsa; identical to SEQ ID NO: 36900

SEQ ID NO: 408491 - RNA, 64 nt, hsa; identical to SEQ ID NO: 36901

SEQ ID NO: 408492 - RNA, 64 nt, hsa; identical to SEQ ID NO: 36902

SEQ ID NO: 408493 - RNA, 64 nt, hsa; identical to SEQ ID NO: 36903

SEQ ID NO: 408494 - RNA, 64 nt, hsa; identical to SEQ ID NO: 36904

SEQ ID NO: 408495 - RNA, 64 nt, hsa; identical to SEQ ID NO: 36905

SEQ ID NO: 408496 - RNA, 64 nt, hsa; identical to SEQ ID NO: 36906

SEQ ID NO: 408497 - RNA, 64 nt, hsa; identical to SEQ ID NO: 36907

SEQ ID NO: 408498 - RNA, 64 nt, hsa; identical to SEQ ID NO: 36908

SEQ ID NO: 408499 - RNA, 64 nt, hsa; identical to SEQ ID NO: 36909

SEQ ID NO: 408500 - RNA, 64 nt, hsa; identical to SEQ ID NO: 36910

SEQ ID NO: 408501 - RNA, 64 nt, hsa; identical to SEQ ID NO: 36911

SEQ ID NO: 408502 - RNA, 64 nt, hsa; identical to SEQ ID NO: 36912

SEQ ID NO: 408503 - RNA, 64 nt, hsa; identical to SEQ ID NO: 36913

SEQ ID NO: 408504 - RNA, 64 nt, hsa; identical to SEQ ID NO: 36914

SEQ ID NO: 408505 - RNA, 64 nt, hsa; identical to SEQ ID NO: 36915

SEQ ID NO: 408506 - RNA, 64 nt, hsa; identical to SEQ ID NO: 36916

SEQ ID NO: 408507 - RNA, 64 nt, hsa; identical to SEQ ID NO: 36917

SEQ ID NO: 408508 - RNA, 64 nt, hsa; identical to SEQ ID NO: 36918

SEQ ID NO: 408509 - RNA, 64 nt, hsa; identical to SEQ ID NO: 36919

SEQ ID NO: 408510 - RNA, 64 nt, hsa; identical to SEQ ID NO: 36920

SEQ ID NO: 408511 - RNA, 64 nt, hsa; identical to SEQ ID NO: 36921

SEQ ID NO: 408512 - RNA, 64 nt, hsa; identical to SEQ ID NO: 36922

SEQ ID NO: 408513 - RNA, 64 nt, hsa; identical to SEQ ID NO: 36923

SEQ ID NO: 408514 - RNA, 64 nt, hsa; identical to SEQ ID NO: 36924

SEQ ID NO: 408515 - RNA, 64 nt, hsa; identical to SEQ ID NO: 36925

SEQ ID NO: 408516 - RNA, 64 nt, hsa; identical to SEQ ID NO: 36926

SEQ ID NO: 408517 - RNA, 64 nt, hsa; identical to SEQ ID NO: 36927

SEQ ID NO: 408518 - RNA, 64 nt, hsa; identical to SEQ ID NO: 36928

SEQ ID NO: 408519 - RNA, 64 nt, hsa; identical to SEQ ID NO: 36929

SEQ ID NO: 408520 - RNA, 64 nt, hsa; identical to SEQ ID NO: 36930

SEQ ID NO: 408521 - RNA, 64 nt, hsa; identical to SEQ ID NO: 36931

SEQ ID NO: 408522 - RNA, 64 nt, hsa; identical to SEQ ID NO: 36932

SEQ ID NO: 408523 - RNA, 64 nt, hsa; identical to SEQ ID NO: 36933

SEQ ID NO: 408524 - RNA, 64 nt, hsa; identical to SEQ ID NO: 36934

SEQ ID NO: 408525 - RNA, 64 nt, hsa; identical to SEQ ID NO: 36935

SEQ ID NO: 408526 - RNA, 64 nt, hsa; identical to SEQ ID NO: 36936

SEQ ID NO: 408527 - RNA, 64 nt, hsa; identical to SEQ ID NO: 36937

SEQ ID NO: 408528 - RNA, 64 nt, hsa; identical to SEQ ID NO: 36938

SEQ ID NO: 408529 - RNA, 64 nt, hsa; identical to SEQ ID NO: 36939

SEQ ID NO: 408530 - RNA, 64 nt, hsa; identical to SEQ ID NO: 36940

SEQ ID NO: 408531 - RNA, 64 nt, hsa; identical to SEQ ID NO: 36941

SEQ ID NO: 408532 - RNA, 64 nt, hsa; identical to SEQ ID NO: 36942

SEQ ID NO: 408533 - RNA, 64 nt, hsa; identical to SEQ ID NO: 36943

SEQ ID NO: 408534 - RNA, 64 nt, hsa; identical to SEQ ID NO: 36944

SEQ ID NO: 408535 - RNA, 64 nt, hsa; identical to SEQ ID NO: 36945

SEQ ID NO: 408536 - RNA, 64 nt, hsa; identical to SEQ ID NO: 36946

SEQ ID NO: 408537 - RNA, 64 nt, hsa; identical to SEQ ID NO: 36947

SEQ ID NO: 408538 - RNA, 64 nt, hsa; identical to SEQ ID NO: 36948

SEQ ID NO: 408539 - RNA, 64 nt, hsa; identical to SEQ ID NO: 36949

SEQ ID NO: 408540 - RNA, 64 nt, hsa; identical to SEQ ID NO: 36950

SEQ ID NO: 408541 - RNA, 64 nt, hsa; identical to SEQ ID NO: 36951

SEQ ID NO: 408542 - RNA, 64 nt, hsa; identical to SEQ ID NO: 36952

SEQ ID NO: 408543 - RNA, 64 nt, hsa; identical to SEQ ID NO: 36953

SEQ ID NO: 408544 - RNA, 64 nt, hsa; identical to SEQ ID NO: 36954

SEQ ID NO: 408545 - RNA, 64 nt, hsa; identical to SEQ ID NO: 36955

SEQ ID NO: 408546 - RNA, 64 nt, hsa; identical to SEQ ID NO: 36956

SEQ ID NO: 408547 - RNA, 64 nt, hsa; identical to SEQ ID NO: 36957

SEQ ID NO: 408548 - RNA, 64 nt, hsa; identical to SEQ ID NO: 36958

SEQ ID NO: 408549 - RNA, 64 nt, hsa; identical to SEQ ID NO: 36959

SEQ ID NO: 408550 - RNA, 64 nt, hsa; identical to SEQ ID NO: 36960

SEQ ID NO: 408551 - RNA, 64 nt, hsa; identical to SEQ ID NO: 36961

SEQ ID NO: 408552 - RNA, 64 nt, hsa; identical to SEQ ID NO: 36962

SEQ ID NO: 408553 - RNA, 64 nt, hsa; identical to SEQ ID NO: 36963

SEQ ID NO: 408554 - RNA, 64 nt, hsa; identical to SEQ ID NO: 36964

SEQ ID NO: 408555 - RNA, 64 nt, hsa; identical to SEQ ID NO: 36965

SEQ ID NO: 408556 - RNA, 64 nt, hsa; identical to SEQ ID NO: 36966

SEQ ID NO: 408557 - RNA, 64 nt, hsa; identical to SEQ ID NO: 36967

SEQ ID NO: 408558 - RNA, 64 nt, hsa; identical to SEQ ID NO: 36968

SEQ ID NO: 408559 - RNA, 64 nt, hsa; identical to SEQ ID NO: 36969

SEQ ID NO: 408560 - RNA, 64 nt, hsa; identical to SEQ ID NO: 36970

SEQ ID NO: 408561 - RNA, 64 nt, hsa; identical to SEQ ID NO: 36971

SEQ ID NO: 408562 - RNA, 64 nt, hsa; identical to SEQ ID NO: 36972

SEQ ID NO: 408563 - RNA, 64 nt, hsa; identical to SEQ ID NO: 36973

SEQ ID NO: 408564 - RNA, 64 nt, hsa; identical to SEQ ID NO: 36974

SEQ ID NO: 408565 - RNA, 64 nt, hsa; identical to SEQ ID NO: 36975

SEQ ID NO: 408566 - RNA, 64 nt, hsa; identical to SEQ ID NO: 36976

SEQ ID NO: 408567 - RNA, 64 nt, hsa; identical to SEQ ID NO: 36977

SEQ ID NO: 408568 - RNA, 64 nt, hsa; identical to SEQ ID NO: 36978

SEQ ID NO: 408569 - RNA, 64 nt, hsa; identical to SEQ ID NO: 36979

SEQ ID NO: 408570 - RNA, 64 nt, hsa; identical to SEQ ID NO: 36980

SEQ ID NO: 408571 - RNA, 64 nt, hsa; identical to SEQ ID NO: 36981

SEQ ID NO: 408572 - RNA, 64 nt, hsa; identical to SEQ ID NO: 36982

SEQ ID NO: 408573 - RNA, 64 nt, hsa; identical to SEQ ID NO: 36983

SEQ ID NO: 408574 - RNA, 64 nt, hsa; identical to SEQ ID NO: 36984

SEQ ID NO: 408575 - RNA, 64 nt, hsa; identical to SEQ ID NO: 36985

SEQ ID NO: 408576 - RNA, 64 nt, hsa; identical to SEQ ID NO: 36986

SEQ ID NO: 408577 - RNA, 64 nt, hsa; identical to SEQ ID NO: 36987

SEQ ID NO: 408578 - RNA, 64 nt, hsa; identical to SEQ ID NO: 36988

SEQ ID NO: 408579 - RNA, 64 nt, hsa; identical to SEQ ID NO: 36989

SEQ ID NO: 408580 - RNA, 64 nt, hsa; identical to SEQ ID NO: 36990

SEQ ID NO: 408581 - RNA, 64 nt, hsa; identical to SEQ ID NO: 36991

SEQ ID NO: 408582 - RNA, 64 nt, hsa; identical to SEQ ID NO: 36992

SEQ ID NO: 408583 - RNA, 64 nt, hsa; identical to SEQ ID NO: 36993

SEQ ID NO: 408584 - RNA, 64 nt, hsa; identical to SEQ ID NO: 36994

SEQ ID NO: 408585 - RNA, 64 nt, hsa; identical to SEQ ID NO: 36995

SEQ ID NO: 408586 - RNA, 64 nt, hsa; identical to SEQ ID NO: 36996

SEQ ID NO: 408587 - RNA, 64 nt, hsa; identical to SEQ ID NO: 36997

SEQ ID NO: 408588 - RNA, 64 nt, hsa; identical to SEQ ID NO: 36998

SEQ ID NO: 408589 - RNA, 64 nt, hsa; identical to SEQ ID NO: 36999

SEQ ID NO: 408590 - RNA, 64 nt, hsa; identical to SEQ ID NO: 37000

SEQ ID NO: 408591 - RNA, 64 nt, hsa; identical to SEQ ID NO: 37001

SEQ ID NO: 408592 - RNA, 64 nt, hsa; identical to SEQ ID NO: 37002

SEQ ID NO: 408593 - RNA, 64 nt, hsa; identical to SEQ ID NO: 37003

SEQ ID NO: 408594 - RNA, 64 nt, hsa; identical to SEQ ID NO: 37004

SEQ ID NO: 408595 - RNA, 64 nt, hsa; identical to SEQ ID NO: 37005

SEQ ID NO: 408596 - RNA, 64 nt, hsa; identical to SEQ ID NO: 37006

SEQ ID NO: 408597 - RNA, 64 nt, hsa; identical to SEQ ID NO: 37007

SEQ ID NO: 408598 - RNA, 64 nt, hsa; identical to SEQ ID NO: 37008

SEQ ID NO: 408599 - RNA, 64 nt, hsa; identical to SEQ ID NO: 37009

SEQ ID NO: 408600 - RNA, 64 nt, hsa; identical to SEQ ID NO: 37010

SEQ ID NO: 408601 - RNA, 64 nt, hsa; identical to SEQ ID NO: 37011

SEQ ID NO: 408602 - RNA, 64 nt, hsa; identical to SEQ ID NO: 37012

SEQ ID NO: 408603 - RNA, 64 nt, hsa; identical to SEQ ID NO: 37013

SEQ ID NO: 408604 - RNA, 64 nt, hsa; identical to SEQ ID NO: 37014

SEQ ID NO: 408605 - RNA, 64 nt, hsa; identical to SEQ ID NO: 37015

SEQ ID NO: 408606 - RNA, 64 nt, hsa; identical to SEQ ID NO: 37016

SEQ ID NO: 408607 - RNA, 64 nt, hsa; identical to SEQ ID NO: 37017

SEQ ID NO: 408608 - RNA, 64 nt, hsa; identical to SEQ ID NO: 37018

SEQ ID NO: 408609 - RNA, 64 nt, hsa; identical to SEQ ID NO: 37019

SEQ ID NO: 408610 - RNA, 64 nt, hsa; identical to SEQ ID NO: 37020

SEQ ID NO: 408611 - RNA, 64 nt, hsa; identical to SEQ ID NO: 37021

SEQ ID NO: 408612 - RNA, 64 nt, hsa; identical to SEQ ID NO: 37022

SEQ ID NO: 408613 - RNA, 64 nt, hsa; identical to SEQ ID NO: 37023

SEQ ID NO: 408614 - RNA, 64 nt, hsa; identical to SEQ ID NO: 37024

SEQ ID NO: 408615 - RNA, 64 nt, hsa; identical to SEQ ID NO: 37025

SEQ ID NO: 408616 - RNA, 64 nt, hsa; identical to SEQ ID NO: 37026

SEQ ID NO: 408617 - RNA, 64 nt, hsa; identical to SEQ ID NO: 37027

SEQ ID NO: 408618 - RNA, 64 nt, hsa; identical to SEQ ID NO: 37028

SEQ ID NO: 408619 - RNA, 64 nt, hsa; identical to SEQ ID NO: 37029

SEQ ID NO: 408620 - RNA, 64 nt, hsa; identical to SEQ ID NO: 37030

SEQ ID NO: 408621 - RNA, 64 nt, hsa; identical to SEQ ID NO: 37031

SEQ ID NO: 408622 - RNA, 64 nt, hsa; identical to SEQ ID NO: 37032

SEQ ID NO: 408623 - RNA, 64 nt, hsa; identical to SEQ ID NO: 37033

SEQ ID NO: 408624 - RNA, 64 nt, hsa; identical to SEQ ID NO: 37034

SEQ ID NO: 408625 - RNA, 64 nt, hsa; identical to SEQ ID NO: 37035

SEQ ID NO: 408626 - RNA, 64 nt, hsa; identical to SEQ ID NO: 37036

SEQ ID NO: 408627 - RNA, 64 nt, hsa; identical to SEQ ID NO: 37037

SEQ ID NO: 408628 - RNA, 64 nt, hsa; identical to SEQ ID NO: 37038

SEQ ID NO: 408629 - RNA, 64 nt, hsa; identical to SEQ ID NO: 37039

SEQ ID NO: 408630 - RNA, 64 nt, hsa; identical to SEQ ID NO: 37040

SEQ ID NO: 408631 - RNA, 64 nt, hsa; identical to SEQ ID NO: 37041

SEQ ID NO: 408632 - RNA, 64 nt, hsa; identical to SEQ ID NO: 37042

SEQ ID NO: 408633 - RNA, 64 nt, hsa; identical to SEQ ID NO: 37043

SEQ ID NO: 408634 - RNA, 64 nt, hsa; identical to SEQ ID NO: 37044

SEQ ID NO: 408635 - RNA, 64 nt, hsa; identical to SEQ ID NO: 37045

SEQ ID NO: 408636 - RNA, 64 nt, hsa; identical to SEQ ID NO: 37046

SEQ ID NO: 408637 - RNA, 64 nt, hsa; identical to SEQ ID NO: 37047

SEQ ID NO: 408638 - RNA, 64 nt, hsa; identical to SEQ ID NO: 37048

SEQ ID NO: 408639 - RNA, 64 nt, hsa; identical to SEQ ID NO: 37049

SEQ ID NO: 408640 - RNA, 64 nt, hsa; identical to SEQ ID NO: 37050

SEQ ID NO: 408641 - RNA, 64 nt, hsa; identical to SEQ ID NO: 37051

SEQ ID NO: 408642 - RNA, 64 nt, hsa; identical to SEQ ID NO: 37052

SEQ ID NO: 408643 - RNA, 64 nt, hsa; identical to SEQ ID NO: 37053

SEQ ID NO: 408644 - RNA, 64 nt, hsa; identical to SEQ ID NO: 37054

SEQ ID NO: 408645 - RNA, 64 nt, hsa; identical to SEQ ID NO: 37055

SEQ ID NO: 408646 - RNA, 64 nt, hsa; identical to SEQ ID NO: 37056

SEQ ID NO: 408647 - RNA, 64 nt, hsa; identical to SEQ ID NO: 37057

SEQ ID NO: 408648 - RNA, 64 nt, hsa; identical to SEQ ID NO: 37058

SEQ ID NO: 408649 - RNA, 64 nt, hsa; identical to SEQ ID NO: 37059

SEQ ID NO: 408650 - RNA, 64 nt, hsa; identical to SEQ ID NO: 37060

SEQ ID NO: 408651 - RNA, 64 nt, hsa; identical to SEQ ID NO: 37061

SEQ ID NO: 408652 - RNA, 64 nt, hsa; identical to SEQ ID NO: 37062

SEQ ID NO: 408653 - RNA, 64 nt, hsa; identical to SEQ ID NO: 37063

SEQ ID NO: 408654 - RNA, 64 nt, hsa; identical to SEQ ID NO: 37064

SEQ ID NO: 408655 - RNA, 64 nt, hsa; identical to SEQ ID NO: 37065

SEQ ID NO: 408656 - RNA, 64 nt, hsa; identical to SEQ ID NO: 37066

SEQ ID NO: 408657 - RNA, 64 nt, hsa; identical to SEQ ID NO: 37067

SEQ ID NO: 408658 - RNA, 64 nt, hsa; identical to SEQ ID NO: 37068

SEQ ID NO: 408659 - RNA, 64 nt, hsa; identical to SEQ ID NO: 37069

SEQ ID NO: 408660 - RNA, 64 nt, hsa; identical to SEQ ID NO: 37070

SEQ ID NO: 408661 - RNA, 64 nt, hsa; identical to SEQ ID NO: 37071

SEQ ID NO: 408662 - RNA, 64 nt, hsa; identical to SEQ ID NO: 37072

SEQ ID NO: 408663 - RNA, 64 nt, hsa; identical to SEQ ID NO: 37073

SEQ ID NO: 408664 - RNA, 64 nt, hsa; identical to SEQ ID NO: 37074

SEQ ID NO: 408665 - RNA, 64 nt, hsa; identical to SEQ ID NO: 37075

SEQ ID NO: 408666 - RNA, 64 nt, hsa; identical to SEQ ID NO: 37076

SEQ ID NO: 408667 - RNA, 64 nt, hsa; identical to SEQ ID NO: 37077

SEQ ID NO: 408668 - RNA, 64 nt, hsa; identical to SEQ ID NO: 37078

SEQ ID NO: 408669 - RNA, 64 nt, hsa; identical to SEQ ID NO: 37079

SEQ ID NO: 408670 - RNA, 64 nt, hsa; identical to SEQ ID NO: 37080

SEQ ID NO: 408671 - RNA, 64 nt, hsa; identical to SEQ ID NO: 37081

SEQ ID NO: 408672 - RNA, 64 nt, hsa; identical to SEQ ID NO: 37082

SEQ ID NO: 408673 - RNA, 64 nt, hsa; identical to SEQ ID NO: 37083

SEQ ID NO: 408674 - RNA, 64 nt, hsa; identical to SEQ ID NO: 37084

SEQ ID NO: 408675 - RNA, 64 nt, hsa; identical to SEQ ID NO: 37085

SEQ ID NO: 408676 - RNA, 64 nt, hsa; identical to SEQ ID NO: 37086

SEQ ID NO: 408677 - RNA, 64 nt, hsa; identical to SEQ ID NO: 37087

SEQ ID NO: 408678 - RNA, 64 nt, hsa; identical to SEQ ID NO: 37088

SEQ ID NO: 408679 - RNA, 64 nt, hsa; identical to SEQ ID NO: 37089

SEQ ID NO: 408680 - RNA, 64 nt, hsa; identical to SEQ ID NO: 37090

SEQ ID NO: 408681 - RNA, 64 nt, hsa; identical to SEQ ID NO: 37091

SEQ ID NO: 408682 - RNA, 64 nt, hsa; identical to SEQ ID NO: 37092

SEQ ID NO: 408683 - RNA, 64 nt, hsa; identical to SEQ ID NO: 37093

SEQ ID NO: 408684 - RNA, 64 nt, hsa; identical to SEQ ID NO: 37094

SEQ ID NO: 408685 - RNA, 64 nt, hsa; identical to SEQ ID NO: 37095

SEQ ID NO: 408686 - RNA, 64 nt, hsa; identical to SEQ ID NO: 37096

SEQ ID NO: 408687 - RNA, 64 nt, hsa; identical to SEQ ID NO: 37097

SEQ ID NO: 408688 - RNA, 64 nt, hsa; identical to SEQ ID NO: 37098

SEQ ID NO: 408689 - RNA, 64 nt, hsa; identical to SEQ ID NO: 37099

SEQ ID NO: 408690 - RNA, 64 nt, hsa; identical to SEQ ID NO: 37100

SEQ ID NO: 408691 - RNA, 64 nt, hsa; identical to SEQ ID NO: 37101

SEQ ID NO: 408692 - RNA, 64 nt, hsa; identical to SEQ ID NO: 37102

SEQ ID NO: 408693 - RNA, 64 nt, hsa; identical to SEQ ID NO: 37103

SEQ ID NO: 408694 - RNA, 64 nt, hsa; identical to SEQ ID NO: 37104

SEQ ID NO: 408695 - RNA, 64 nt, hsa; identical to SEQ ID NO: 37105

SEQ ID NO: 408696 - RNA, 64 nt, hsa; identical to SEQ ID NO: 37106

SEQ ID NO: 408697 - RNA, 64 nt, hsa; identical to SEQ ID NO: 37107

SEQ ID NO: 408698 - RNA, 64 nt, hsa; identical to SEQ ID NO: 37108

SEQ ID NO: 408699 - RNA, 64 nt, hsa; identical to SEQ ID NO: 37109

SEQ ID NO: 408700 - RNA, 64 nt, hsa; identical to SEQ ID NO: 37110

SEQ ID NO: 408701 - RNA, 64 nt, hsa; identical to SEQ ID NO: 37111

SEQ ID NO: 408702 - RNA, 64 nt, hsa; identical to SEQ ID NO: 37112

SEQ ID NO: 408703 - RNA, 64 nt, hsa; identical to SEQ ID NO: 37113

SEQ ID NO: 408704 - RNA, 64 nt, hsa; identical to SEQ ID NO: 37114

SEQ ID NO: 408705 - RNA, 64 nt, hsa; identical to SEQ ID NO: 37115

SEQ ID NO: 408706 - RNA, 64 nt, hsa; identical to SEQ ID NO: 37116

SEQ ID NO: 408707 - RNA, 64 nt, hsa; identical to SEQ ID NO: 37117

SEQ ID NO: 408708 - RNA, 64 nt, hsa; identical to SEQ ID NO: 37118

SEQ ID NO: 408709 - RNA, 64 nt, hsa; identical to SEQ ID NO: 37119

SEQ ID NO: 408710 - RNA, 64 nt, hsa; identical to SEQ ID NO: 37120

SEQ ID NO: 408711 - RNA, 64 nt, hsa; identical to SEQ ID NO: 37121

SEQ ID NO: 408712 - RNA, 64 nt, hsa; identical to SEQ ID NO: 37122

SEQ ID NO: 408713 - RNA, 64 nt, hsa; identical to SEQ ID NO: 37123

SEQ ID NO: 408714 - RNA, 64 nt, hsa; identical to SEQ ID NO: 37124

SEQ ID NO: 408715 - RNA, 64 nt, hsa; identical to SEQ ID NO: 37125

SEQ ID NO: 408716 - RNA, 64 nt, hsa; identical to SEQ ID NO: 37126

SEQ ID NO: 408717 - RNA, 64 nt, hsa; identical to SEQ ID NO: 37127

SEQ ID NO: 408718 - RNA, 64 nt, hsa; identical to SEQ ID NO: 37128

SEQ ID NO: 408719 - RNA, 64 nt, hsa; identical to SEQ ID NO: 37129

SEQ ID NO: 408720 - RNA, 64 nt, hsa; identical to SEQ ID NO: 37130

SEQ ID NO: 408721 - RNA, 64 nt, hsa; identical to SEQ ID NO: 37131

SEQ ID NO: 408722 - RNA, 64 nt, hsa; identical to SEQ ID NO: 37132

SEQ ID NO: 408723 - RNA, 64 nt, hsa; identical to SEQ ID NO: 37133

SEQ ID NO: 408724 - RNA, 64 nt, hsa; identical to SEQ ID NO: 37134

SEQ ID NO: 408725 - RNA, 64 nt, hsa; identical to SEQ ID NO: 37135

SEQ ID NO: 408726 - RNA, 64 nt, hsa; identical to SEQ ID NO: 37136

SEQ ID NO: 408727 - RNA, 64 nt, hsa; identical to SEQ ID NO: 37137

SEQ ID NO: 408728 - RNA, 64 nt, hsa; identical to SEQ ID NO: 37138

SEQ ID NO: 408729 - RNA, 64 nt, hsa; identical to SEQ ID NO: 37139

SEQ ID NO: 408730 - RNA, 64 nt, hsa; identical to SEQ ID NO: 37140

SEQ ID NO: 408731 - RNA, 64 nt, hsa; identical to SEQ ID NO: 37141

SEQ ID NO: 408732 - RNA, 64 nt, hsa; identical to SEQ ID NO: 37142

SEQ ID NO: 408733 - RNA, 64 nt, hsa; identical to SEQ ID NO: 37143

SEQ ID NO: 408734 - RNA, 64 nt, hsa; identical to SEQ ID NO: 37144

SEQ ID NO: 408735 - RNA, 64 nt, hsa; identical to SEQ ID NO: 37145

SEQ ID NO: 408736 - RNA, 64 nt, hsa; identical to SEQ ID NO: 37146

SEQ ID NO: 408737 - RNA, 64 nt, hsa; identical to SEQ ID NO: 37147

SEQ ID NO: 408738 - RNA, 64 nt, hsa; identical to SEQ ID NO: 37148

SEQ ID NO: 408739 - RNA, 64 nt, hsa; identical to SEQ ID NO: 37149

SEQ ID NO: 408740 - RNA, 64 nt, hsa; identical to SEQ ID NO: 37150

SEQ ID NO: 408741 - RNA, 64 nt, hsa; identical to SEQ ID NO: 37151

SEQ ID NO: 408742 - RNA, 63 nt, hsa; identical to SEQ ID NO: 37152

SEQ ID NO: 408743 - RNA, 62 nt, hsa; identical to SEQ ID NO: 37153

SEQ ID NO: 408744 - RNA, 64 nt, hsa; identical to SEQ ID NO: 37154

SEQ ID NO: 408745 - RNA, 64 nt, hsa; identical to SEQ ID NO: 37155

SEQ ID NO: 408746 - RNA, 64 nt, hsa; identical to SEQ ID NO: 37156

SEQ ID NO: 408747 - RNA, 64 nt, hsa; identical to SEQ ID NO: 37157

SEQ ID NO: 408748 - RNA, 64 nt, hsa; identical to SEQ ID NO: 37158

SEQ ID NO: 408749 - RNA, 64 nt, hsa; identical to SEQ ID NO: 37159

SEQ ID NO: 408750 - RNA, 64 nt, hsa; identical to SEQ ID NO: 37160

SEQ ID NO: 408751 - RNA, 64 nt, hsa; identical to SEQ ID NO: 37161

SEQ ID NO: 408752 - RNA, 64 nt, hsa; identical to SEQ ID NO: 37162

SEQ ID NO: 408753 - RNA, 64 nt, hsa; identical to SEQ ID NO: 37163

SEQ ID NO: 408754 - RNA, 64 nt, hsa; identical to SEQ ID NO: 37164

SEQ ID NO: 408755 - RNA, 64 nt, hsa; identical to SEQ ID NO: 37165

SEQ ID NO: 408756 - RNA, 64 nt, hsa; identical to SEQ ID NO: 37166

SEQ ID NO: 408757 - RNA, 64 nt, hsa; identical to SEQ ID NO: 37167

SEQ ID NO: 408758 - RNA, 64 nt, hsa; identical to SEQ ID NO: 37168

SEQ ID NO: 408759 - RNA, 64 nt, hsa; identical to SEQ ID NO: 37169

SEQ ID NO: 408760 - RNA, 64 nt, hsa; identical to SEQ ID NO: 37170

SEQ ID NO: 408761 - RNA, 64 nt, hsa; identical to SEQ ID NO: 37171

SEQ ID NO: 408762 - RNA, 64 nt, hsa; identical to SEQ ID NO: 37172

SEQ ID NO: 408763 - RNA, 64 nt, hsa; identical to SEQ ID NO: 37173

SEQ ID NO: 408764 - RNA, 64 nt, hsa; identical to SEQ ID NO: 37174

SEQ ID NO: 408765 - RNA, 64 nt, hsa; identical to SEQ ID NO: 37175

SEQ ID NO: 408766 - RNA, 64 nt, hsa; identical to SEQ ID NO: 37176

SEQ ID NO: 408767 - RNA, 64 nt, hsa; identical to SEQ ID NO: 37177

SEQ ID NO: 408768 - RNA, 64 nt, hsa; identical to SEQ ID NO: 37178

SEQ ID NO: 408769 - RNA, 64 nt, hsa; identical to SEQ ID NO: 37179

SEQ ID NO: 408770 - RNA, 64 nt, hsa; identical to SEQ ID NO: 37180

SEQ ID NO: 408771 - RNA, 64 nt, hsa; identical to SEQ ID NO: 37181

SEQ ID NO: 408772 - RNA, 64 nt, hsa; identical to SEQ ID NO: 37182

SEQ ID NO: 408773 - RNA, 64 nt, hsa; identical to SEQ ID NO: 37183

SEQ ID NO: 408774 - RNA, 64 nt, hsa; identical to SEQ ID NO: 37184

SEQ ID NO: 408775 - RNA, 64 nt, hsa; identical to SEQ ID NO: 37185

SEQ ID NO: 408776 - RNA, 64 nt, hsa; identical to SEQ ID NO: 37186

SEQ ID NO: 408777 - RNA, 64 nt, hsa; identical to SEQ ID NO: 37187

SEQ ID NO: 408778 - RNA, 64 nt, hsa; identical to SEQ ID NO: 37188

SEQ ID NO: 408779 - RNA, 64 nt, hsa; identical to SEQ ID NO: 37189

SEQ ID NO: 408780 - RNA, 64 nt, hsa; identical to SEQ ID NO: 37190

SEQ ID NO: 408781 - RNA, 64 nt, hsa; identical to SEQ ID NO: 37191

SEQ ID NO: 408782 - RNA, 64 nt, hsa; identical to SEQ ID NO: 37192

SEQ ID NO: 408783 - RNA, 64 nt, hsa; identical to SEQ ID NO: 37193

SEQ ID NO: 408784 - RNA, 64 nt, hsa; identical to SEQ ID NO: 37194

SEQ ID NO: 408785 - RNA, 64 nt, hsa; identical to SEQ ID NO: 37195

SEQ ID NO: 408786 - RNA, 64 nt, hsa; identical to SEQ ID NO: 37196

SEQ ID NO: 408787 - RNA, 64 nt, hsa; identical to SEQ ID NO: 37197

SEQ ID NO: 408788 - RNA, 64 nt, hsa; identical to SEQ ID NO: 37198

SEQ ID NO: 408789 - RNA, 64 nt, hsa; identical to SEQ ID NO: 37199

SEQ ID NO: 408790 - RNA, 64 nt, hsa; identical to SEQ ID NO: 37200

SEQ ID NO: 408791 - RNA, 64 nt, hsa; identical to SEQ ID NO: 37201

SEQ ID NO: 408792 - RNA, 64 nt, hsa; identical to SEQ ID NO: 37202

SEQ ID NO: 408793 - RNA, 64 nt, hsa; identical to SEQ ID NO: 37203

SEQ ID NO: 408794 - RNA, 64 nt, hsa; identical to SEQ ID NO: 37204

SEQ ID NO: 408795 - RNA, 64 nt, hsa; identical to SEQ ID NO: 37205

SEQ ID NO: 408796 - RNA, 64 nt, hsa; identical to SEQ ID NO: 37206

SEQ ID NO: 408797 - RNA, 64 nt, hsa; identical to SEQ ID NO: 37207

SEQ ID NO: 408798 - RNA, 64 nt, hsa; identical to SEQ ID NO: 37208

SEQ ID NO: 408799 - RNA, 64 nt, hsa; identical to SEQ ID NO: 37209

SEQ ID NO: 408800 - RNA, 64 nt, hsa; identical to SEQ ID NO: 37210

SEQ ID NO: 408801 - RNA, 64 nt, hsa; identical to SEQ ID NO: 37211

SEQ ID NO: 408802 - RNA, 64 nt, hsa; identical to SEQ ID NO: 37212

SEQ ID NO: 408803 - RNA, 64 nt, hsa; identical to SEQ ID NO: 37213

SEQ ID NO: 408804 - RNA, 64 nt, hsa; identical to SEQ ID NO: 37214

SEQ ID NO: 408805 - RNA, 64 nt, hsa; identical to SEQ ID NO: 37215

SEQ ID NO: 408806 - RNA, 64 nt, hsa; identical to SEQ ID NO: 37216

SEQ ID NO: 408807 - RNA, 64 nt, hsa; identical to SEQ ID NO: 37217

SEQ ID NO: 408808 - RNA, 64 nt, hsa; identical to SEQ ID NO: 37218

SEQ ID NO: 408809 - RNA, 64 nt, hsa; identical to SEQ ID NO: 37219

SEQ ID NO: 408810 - RNA, 64 nt, hsa; identical to SEQ ID NO: 37220

SEQ ID NO: 408811 - RNA, 64 nt, hsa; identical to SEQ ID NO: 37221

SEQ ID NO: 408812 - RNA, 64 nt, hsa; identical to SEQ ID NO: 37222

SEQ ID NO: 408813 - RNA, 64 nt, hsa; identical to SEQ ID NO: 37223

SEQ ID NO: 408814 - RNA, 64 nt, hsa; identical to SEQ ID NO: 37224

SEQ ID NO: 408815 - RNA, 64 nt, hsa; identical to SEQ ID NO: 37225

SEQ ID NO: 408816 - RNA, 64 nt, hsa; identical to SEQ ID NO: 37226

SEQ ID NO: 408817 - RNA, 64 nt, hsa; identical to SEQ ID NO: 37227

SEQ ID NO: 408818 - RNA, 64 nt, hsa; identical to SEQ ID NO: 37228

SEQ ID NO: 408819 - RNA, 64 nt, hsa; identical to SEQ ID NO: 37229

SEQ ID NO: 408820 - RNA, 64 nt, hsa; identical to SEQ ID NO: 37230

SEQ ID NO: 408821 - RNA, 64 nt, hsa; identical to SEQ ID NO: 37231

SEQ ID NO: 408822 - RNA, 64 nt, hsa; identical to SEQ ID NO: 37232

SEQ ID NO: 408823 - RNA, 64 nt, hsa; identical to SEQ ID NO: 37233

SEQ ID NO: 408824 - RNA, 64 nt, hsa; identical to SEQ ID NO: 37234

SEQ ID NO: 408825 - RNA, 64 nt, hsa; identical to SEQ ID NO: 37235

SEQ ID NO: 408826 - RNA, 64 nt, hsa; identical to SEQ ID NO: 37236

SEQ ID NO: 408827 - RNA, 64 nt, hsa; identical to SEQ ID NO: 37237

SEQ ID NO: 408828 - RNA, 64 nt, hsa; identical to SEQ ID NO: 37238

SEQ ID NO: 408829 - RNA, 64 nt, hsa; identical to SEQ ID NO: 37239

SEQ ID NO: 408830 - RNA, 64 nt, hsa; identical to SEQ ID NO: 37240

SEQ ID NO: 408831 - RNA, 64 nt, hsa; identical to SEQ ID NO: 37241

SEQ ID NO: 408832 - RNA, 64 nt, hsa; identical to SEQ ID NO: 37242

SEQ ID NO: 408833 - RNA, 64 nt, hsa; identical to SEQ ID NO: 37243

SEQ ID NO: 408834 - RNA, 64 nt, hsa; identical to SEQ ID NO: 37244

SEQ ID NO: 408835 - RNA, 64 nt, hsa; identical to SEQ ID NO: 37245

SEQ ID NO: 408836 - RNA, 64 nt, hsa; identical to SEQ ID NO: 37246

SEQ ID NO: 408837 - RNA, 64 nt, hsa; identical to SEQ ID NO: 37247

SEQ ID NO: 408838 - RNA, 64 nt, hsa; identical to SEQ ID NO: 37248

SEQ ID NO: 408839 - RNA, 64 nt, hsa; identical to SEQ ID NO: 37249

SEQ ID NO: 408840 - RNA, 64 nt, hsa; identical to SEQ ID NO: 37250

SEQ ID NO: 408841 - RNA, 64 nt, hsa; identical to SEQ ID NO: 37251

SEQ ID NO: 408842 - RNA, 64 nt, hsa; identical to SEQ ID NO: 37252

SEQ ID NO: 408843 - RNA, 64 nt, hsa; identical to SEQ ID NO: 37253

SEQ ID NO: 408844 - RNA, 64 nt, hsa; identical to SEQ ID NO: 37254

SEQ ID NO: 408845 - RNA, 64 nt, hsa; identical to SEQ ID NO: 37255

SEQ ID NO: 408846 - RNA, 64 nt, hsa; identical to SEQ ID NO: 37256

SEQ ID NO: 408847 - RNA, 64 nt, hsa; identical to SEQ ID NO: 37257

SEQ ID NO: 408848 - RNA, 64 nt, hsa; identical to SEQ ID NO: 37258

SEQ ID NO: 408849 - RNA, 64 nt, hsa; identical to SEQ ID NO: 37259

SEQ ID NO: 408850 - RNA, 64 nt, hsa; identical to SEQ ID NO: 37260

SEQ ID NO: 408851 - RNA, 64 nt, hsa; identical to SEQ ID NO: 37261

SEQ ID NO: 408852 - RNA, 64 nt, hsa; identical to SEQ ID NO: 37262

SEQ ID NO: 408853 - RNA, 64 nt, hsa; identical to SEQ ID NO: 37263

SEQ ID NO: 408854 - RNA, 64 nt, hsa; identical to SEQ ID NO: 37264

SEQ ID NO: 408855 - RNA, 64 nt, hsa; identical to SEQ ID NO: 37265

SEQ ID NO: 408856 - RNA, 64 nt, hsa; identical to SEQ ID NO: 37266

SEQ ID NO: 408857 - RNA, 64 nt, hsa; identical to SEQ ID NO: 37267

SEQ ID NO: 408858 - RNA, 64 nt, hsa; identical to SEQ ID NO: 37268

SEQ ID NO: 408859 - RNA, 64 nt, hsa; identical to SEQ ID NO: 37269

SEQ ID NO: 408860 - RNA, 64 nt, hsa; identical to SEQ ID NO: 37270

SEQ ID NO: 408861 - RNA, 64 nt, hsa; identical to SEQ ID NO: 37271

SEQ ID NO: 408862 - RNA, 64 nt, hsa; identical to SEQ ID NO: 37272

SEQ ID NO: 408863 - RNA, 64 nt, hsa; identical to SEQ ID NO: 37273

SEQ ID NO: 408864 - RNA, 64 nt, hsa; identical to SEQ ID NO: 37274

SEQ ID NO: 408865 - RNA, 64 nt, hsa; identical to SEQ ID NO: 37275

SEQ ID NO: 408866 - RNA, 64 nt, hsa; identical to SEQ ID NO: 37276

SEQ ID NO: 408867 - RNA, 64 nt, hsa; identical to SEQ ID NO: 37277

SEQ ID NO: 408868 - RNA, 64 nt, hsa; identical to SEQ ID NO: 37278

SEQ ID NO: 408869 - RNA, 64 nt, hsa; identical to SEQ ID NO: 37279

SEQ ID NO: 408870 - RNA, 64 nt, hsa; identical to SEQ ID NO: 37280

SEQ ID NO: 408871 - RNA, 64 nt, hsa; identical to SEQ ID NO: 37281

SEQ ID NO: 408872 - RNA, 64 nt, hsa; identical to SEQ ID NO: 37282

SEQ ID NO: 408873 - RNA, 64 nt, hsa; identical to SEQ ID NO: 37283

SEQ ID NO: 408874 - RNA, 64 nt, hsa; identical to SEQ ID NO: 37284

SEQ ID NO: 408875 - RNA, 64 nt, hsa; identical to SEQ ID NO: 37285

SEQ ID NO: 408876 - RNA, 64 nt, hsa; identical to SEQ ID NO: 37286

SEQ ID NO: 408877 - RNA, 64 nt, hsa; identical to SEQ ID NO: 37287

SEQ ID NO: 408878 - RNA, 64 nt, hsa; identical to SEQ ID NO: 37288

SEQ ID NO: 408879 - RNA, 64 nt, hsa; identical to SEQ ID NO: 37289

SEQ ID NO: 408880 - RNA, 64 nt, hsa; identical to SEQ ID NO: 37290

SEQ ID NO: 408881 - RNA, 64 nt, hsa; identical to SEQ ID NO: 37291

SEQ ID NO: 408882 - RNA, 64 nt, hsa; identical to SEQ ID NO: 37292

SEQ ID NO: 408883 - RNA, 64 nt, hsa; identical to SEQ ID NO: 37293

SEQ ID NO: 408884 - RNA, 64 nt, hsa; identical to SEQ ID NO: 37294

SEQ ID NO: 408885 - RNA, 64 nt, hsa; identical to SEQ ID NO: 37295

SEQ ID NO: 408886 - RNA, 64 nt, hsa; identical to SEQ ID NO: 37296

SEQ ID NO: 408887 - RNA, 64 nt, hsa; identical to SEQ ID NO: 37297

SEQ ID NO: 408888 - RNA, 64 nt, hsa; identical to SEQ ID NO: 37298

SEQ ID NO: 408889 - RNA, 64 nt, hsa; identical to SEQ ID NO: 37299

SEQ ID NO: 408890 - RNA, 64 nt, hsa; identical to SEQ ID NO: 37300

SEQ ID NO: 408891 - RNA, 64 nt, hsa; identical to SEQ ID NO: 37301

SEQ ID NO: 408892 - RNA, 64 nt, hsa; identical to SEQ ID NO: 37302

SEQ ID NO: 408893 - RNA, 64 nt, hsa; identical to SEQ ID NO: 37303

SEQ ID NO: 408894 - RNA, 64 nt, hsa; identical to SEQ ID NO: 37304

SEQ ID NO: 408895 - RNA, 64 nt, hsa; identical to SEQ ID NO: 37305

SEQ ID NO: 408896 - RNA, 64 nt, hsa; identical to SEQ ID NO: 37306

SEQ ID NO: 408897 - RNA, 64 nt, hsa; identical to SEQ ID NO: 37307

SEQ ID NO: 408898 - RNA, 64 nt, hsa; identical to SEQ ID NO: 37308

SEQ ID NO: 408899 - RNA, 64 nt, hsa; identical to SEQ ID NO: 37309

SEQ ID NO: 408900 - RNA, 64 nt, hsa; identical to SEQ ID NO: 37310

SEQ ID NO: 408901 - RNA, 64 nt, hsa; identical to SEQ ID NO: 37311

SEQ ID NO: 408902 - RNA, 64 nt, hsa; identical to SEQ ID NO: 37312

SEQ ID NO: 408903 - RNA, 64 nt, hsa; identical to SEQ ID NO: 37313

SEQ ID NO: 408904 - RNA, 64 nt, hsa; identical to SEQ ID NO: 37314

SEQ ID NO: 408905 - RNA, 64 nt, hsa; identical to SEQ ID NO: 37315

SEQ ID NO: 408906 - RNA, 64 nt, hsa; identical to SEQ ID NO: 37316

SEQ ID NO: 408907 - RNA, 64 nt, hsa; identical to SEQ ID NO: 37317

SEQ ID NO: 408908 - RNA, 64 nt, hsa; identical to SEQ ID NO: 37318

SEQ ID NO: 408909 - RNA, 64 nt, hsa; identical to SEQ ID NO: 37319

SEQ ID NO: 408910 - RNA, 64 nt, hsa; identical to SEQ ID NO: 37320

SEQ ID NO: 408911 - RNA, 64 nt, hsa; identical to SEQ ID NO: 37321

SEQ ID NO: 408912 - RNA, 64 nt, hsa; identical to SEQ ID NO: 37322

SEQ ID NO: 408913 - RNA, 64 nt, hsa; identical to SEQ ID NO: 37323

SEQ ID NO: 408914 - RNA, 64 nt, hsa; identical to SEQ ID NO: 37324

SEQ ID NO: 408915 - RNA, 64 nt, hsa; identical to SEQ ID NO: 37325

SEQ ID NO: 408916 - RNA, 64 nt, hsa; identical to SEQ ID NO: 37326

SEQ ID NO: 408917 - RNA, 64 nt, hsa; identical to SEQ ID NO: 37327

SEQ ID NO: 408918 - RNA, 64 nt, hsa; identical to SEQ ID NO: 37328

SEQ ID NO: 408919 - RNA, 64 nt, hsa; identical to SEQ ID NO: 37329

SEQ ID NO: 408920 - RNA, 64 nt, hsa; identical to SEQ ID NO: 37330

SEQ ID NO: 408921 - RNA, 64 nt, hsa; identical to SEQ ID NO: 37331

SEQ ID NO: 408922 - RNA, 64 nt, hsa; identical to SEQ ID NO: 37332

SEQ ID NO: 408923 - RNA, 64 nt, hsa; identical to SEQ ID NO: 37333

SEQ ID NO: 408924 - RNA, 64 nt, hsa; identical to SEQ ID NO: 37334

SEQ ID NO: 408925 - RNA, 64 nt, hsa; identical to SEQ ID NO: 37335

SEQ ID NO: 408926 - RNA, 64 nt, hsa; identical to SEQ ID NO: 37336

SEQ ID NO: 408927 - RNA, 64 nt, hsa; identical to SEQ ID NO: 37337

SEQ ID NO: 408928 - RNA, 64 nt, hsa; identical to SEQ ID NO: 37338

SEQ ID NO: 408929 - RNA, 64 nt, hsa; identical to SEQ ID NO: 37339

SEQ ID NO: 408930 - RNA, 64 nt, hsa; identical to SEQ ID NO: 37340

SEQ ID NO: 408931 - RNA, 64 nt, hsa; identical to SEQ ID NO: 37341

SEQ ID NO: 408932 - RNA, 64 nt, hsa; identical to SEQ ID NO: 37342

SEQ ID NO: 408933 - RNA, 64 nt, hsa; identical to SEQ ID NO: 37343

SEQ ID NO: 408934 - RNA, 64 nt, hsa; identical to SEQ ID NO: 37344

SEQ ID NO: 408935 - RNA, 64 nt, hsa; identical to SEQ ID NO: 37345

SEQ ID NO: 408936 - RNA, 64 nt, hsa; identical to SEQ ID NO: 37346

SEQ ID NO: 408937 - RNA, 64 nt, hsa; identical to SEQ ID NO: 37347

SEQ ID NO: 408938 - RNA, 64 nt, hsa; identical to SEQ ID NO: 37348

SEQ ID NO: 408939 - RNA, 64 nt, hsa; identical to SEQ ID NO: 37349

SEQ ID NO: 408940 - RNA, 64 nt, hsa; identical to SEQ ID NO: 37350

SEQ ID NO: 408941 - RNA, 64 nt, hsa; identical to SEQ ID NO: 37351

SEQ ID NO: 408942 - RNA, 64 nt, hsa; identical to SEQ ID NO: 37352

SEQ ID NO: 408943 - RNA, 64 nt, hsa; identical to SEQ ID NO: 37353

SEQ ID NO: 408944 - RNA, 64 nt, hsa; identical to SEQ ID NO: 37354

SEQ ID NO: 408945 - RNA, 64 nt, hsa; identical to SEQ ID NO: 37355

SEQ ID NO: 408946 - RNA, 64 nt, hsa; identical to SEQ ID NO: 37356

SEQ ID NO: 408947 - RNA, 64 nt, hsa; identical to SEQ ID NO: 37357

SEQ ID NO: 408948 - RNA, 64 nt, hsa; identical to SEQ ID NO: 37358

SEQ ID NO: 408949 - RNA, 64 nt, hsa; identical to SEQ ID NO: 37359

SEQ ID NO: 408950 - RNA, 64 nt, hsa; identical to SEQ ID NO: 37360

SEQ ID NO: 408951 - RNA, 64 nt, hsa; identical to SEQ ID NO: 37361

SEQ ID NO: 408952 - RNA, 64 nt, hsa; identical to SEQ ID NO: 37362

SEQ ID NO: 408953 - RNA, 64 nt, hsa; identical to SEQ ID NO: 37363

SEQ ID NO: 408954 - RNA, 64 nt, hsa; identical to SEQ ID NO: 37364

SEQ ID NO: 408955 - RNA, 64 nt, hsa; identical to SEQ ID NO: 37365

SEQ ID NO: 408956 - RNA, 64 nt, hsa; identical to SEQ ID NO: 37366

SEQ ID NO: 408957 - RNA, 64 nt, hsa; identical to SEQ ID NO: 37367

SEQ ID NO: 408958 - RNA, 64 nt, hsa; identical to SEQ ID NO: 37368

SEQ ID NO: 408959 - RNA, 64 nt, hsa; identical to SEQ ID NO: 37369

SEQ ID NO: 408960 - RNA, 64 nt, hsa; identical to SEQ ID NO: 37370

SEQ ID NO: 408961 - RNA, 64 nt, hsa; identical to SEQ ID NO: 37371

SEQ ID NO: 408962 - RNA, 64 nt, hsa; identical to SEQ ID NO: 37372

SEQ ID NO: 408963 - RNA, 64 nt, hsa; identical to SEQ ID NO: 37373

SEQ ID NO: 408964 - RNA, 64 nt, hsa; identical to SEQ ID NO: 37374

SEQ ID NO: 408965 - RNA, 64 nt, hsa; identical to SEQ ID NO: 37375

SEQ ID NO: 408966 - RNA, 64 nt, hsa; identical to SEQ ID NO: 37376

SEQ ID NO: 408967 - RNA, 64 nt, hsa; identical to SEQ ID NO: 37377

SEQ ID NO: 408968 - RNA, 64 nt, hsa; identical to SEQ ID NO: 37378

SEQ ID NO: 408969 - RNA, 64 nt, hsa; identical to SEQ ID NO: 37379

SEQ ID NO: 408970 - RNA, 64 nt, hsa; identical to SEQ ID NO: 37380

SEQ ID NO: 408971 - RNA, 64 nt, hsa; identical to SEQ ID NO: 37381

SEQ ID NO: 408972 - RNA, 64 nt, hsa; identical to SEQ ID NO: 37382

SEQ ID NO: 408973 - RNA, 64 nt, hsa; identical to SEQ ID NO: 37383

SEQ ID NO: 408974 - RNA, 64 nt, hsa; identical to SEQ ID NO: 37384

SEQ ID NO: 408975 - RNA, 64 nt, hsa; identical to SEQ ID NO: 37385

SEQ ID NO: 408976 - RNA, 64 nt, hsa; identical to SEQ ID NO: 37386

SEQ ID NO: 408977 - RNA, 64 nt, hsa; identical to SEQ ID NO: 37387

SEQ ID NO: 408978 - RNA, 64 nt, hsa; identical to SEQ ID NO: 37388

SEQ ID NO: 408979 - RNA, 64 nt, hsa; identical to SEQ ID NO: 37389

SEQ ID NO: 408980 - RNA, 64 nt, hsa; identical to SEQ ID NO: 37390

SEQ ID NO: 408981 - RNA, 64 nt, hsa; identical to SEQ ID NO: 37391

SEQ ID NO: 408982 - RNA, 64 nt, hsa; identical to SEQ ID NO: 37392

SEQ ID NO: 408983 - RNA, 64 nt, hsa; identical to SEQ ID NO: 37393

SEQ ID NO: 408984 - RNA, 64 nt, hsa; identical to SEQ ID NO: 37394

SEQ ID NO: 408985 - RNA, 64 nt, hsa; identical to SEQ ID NO: 37395

SEQ ID NO: 408986 - RNA, 64 nt, hsa; identical to SEQ ID NO: 37396

SEQ ID NO: 408987 - RNA, 64 nt, hsa; identical to SEQ ID NO: 37397

SEQ ID NO: 408988 - RNA, 64 nt, hsa; identical to SEQ ID NO: 37398

SEQ ID NO: 408989 - RNA, 64 nt, hsa; identical to SEQ ID NO: 37399

SEQ ID NO: 408990 - RNA, 64 nt, hsa; identical to SEQ ID NO: 37400

SEQ ID NO: 408991 - RNA, 64 nt, hsa; identical to SEQ ID NO: 37401

SEQ ID NO: 408992 - RNA, 64 nt, hsa; identical to SEQ ID NO: 37402

SEQ ID NO: 408993 - RNA, 64 nt, hsa; identical to SEQ ID NO: 37403

SEQ ID NO: 408994 - RNA, 64 nt, hsa; identical to SEQ ID NO: 37404

SEQ ID NO: 408995 - RNA, 64 nt, hsa; identical to SEQ ID NO: 37405

SEQ ID NO: 408996 - RNA, 64 nt, hsa; identical to SEQ ID NO: 37406

SEQ ID NO: 408997 - RNA, 64 nt, hsa; identical to SEQ ID NO: 37407

SEQ ID NO: 408998 - RNA, 64 nt, hsa; identical to SEQ ID NO: 37408

SEQ ID NO: 408999 - RNA, 64 nt, hsa; identical to SEQ ID NO: 37409

SEQ ID NO: 409000 - RNA, 64 nt, hsa; identical to SEQ ID NO: 37410

SEQ ID NO: 409001 - RNA, 64 nt, hsa; identical to SEQ ID NO: 37411

SEQ ID NO: 409002 - RNA, 64 nt, hsa; identical to SEQ ID NO: 37412

SEQ ID NO: 409003 - RNA, 64 nt, hsa; identical to SEQ ID NO: 37413

SEQ ID NO: 409004 - RNA, 64 nt, hsa; identical to SEQ ID NO: 37414

SEQ ID NO: 409005 - RNA, 64 nt, hsa; identical to SEQ ID NO: 37415

SEQ ID NO: 409006 - RNA, 64 nt, hsa; identical to SEQ ID NO: 37416

SEQ ID NO: 409007 - RNA, 64 nt, hsa; identical to SEQ ID NO: 37417

SEQ ID NO: 409008 - RNA, 64 nt, hsa; identical to SEQ ID NO: 37418

SEQ ID NO: 409009 - RNA, 64 nt, hsa; identical to SEQ ID NO: 37419

SEQ ID NO: 409010 - RNA, 64 nt, hsa; identical to SEQ ID NO: 37420

SEQ ID NO: 409011 - RNA, 64 nt, hsa; identical to SEQ ID NO: 37421

SEQ ID NO: 409012 - RNA, 64 nt, hsa; identical to SEQ ID NO: 37422

SEQ ID NO: 409013 - RNA, 64 nt, hsa; identical to SEQ ID NO: 37423

SEQ ID NO: 409014 - RNA, 64 nt, hsa; identical to SEQ ID NO: 37424

SEQ ID NO: 409015 - RNA, 64 nt, hsa; identical to SEQ ID NO: 37425

SEQ ID NO: 409016 - RNA, 64 nt, hsa; identical to SEQ ID NO: 37426

SEQ ID NO: 409017 - RNA, 64 nt, hsa; identical to SEQ ID NO: 37427

SEQ ID NO: 409018 - RNA, 64 nt, hsa; identical to SEQ ID NO: 37428

SEQ ID NO: 409019 - RNA, 64 nt, hsa; identical to SEQ ID NO: 37429

SEQ ID NO: 409020 - RNA, 64 nt, hsa; identical to SEQ ID NO: 37430

SEQ ID NO: 409021 - RNA, 64 nt, hsa; identical to SEQ ID NO: 37431

SEQ ID NO: 409022 - RNA, 64 nt, hsa; identical to SEQ ID NO: 37432

SEQ ID NO: 409023 - RNA, 64 nt, hsa; identical to SEQ ID NO: 37433

SEQ ID NO: 409024 - RNA, 64 nt, hsa; identical to SEQ ID NO: 37434

SEQ ID NO: 409025 - RNA, 64 nt, hsa; identical to SEQ ID NO: 37435

SEQ ID NO: 409026 - RNA, 64 nt, hsa; identical to SEQ ID NO: 37436

SEQ ID NO: 409027 - RNA, 64 nt, hsa; identical to SEQ ID NO: 37437

SEQ ID NO: 409028 - RNA, 64 nt, hsa; identical to SEQ ID NO: 37438

SEQ ID NO: 409029 - RNA, 64 nt, hsa; identical to SEQ ID NO: 37439

SEQ ID NO: 409030 - RNA, 64 nt, hsa; identical to SEQ ID NO: 37440

SEQ ID NO: 409031 - RNA, 64 nt, hsa; identical to SEQ ID NO: 37441

SEQ ID NO: 409032 - RNA, 64 nt, hsa; identical to SEQ ID NO: 37442

SEQ ID NO: 409033 - RNA, 64 nt, hsa; identical to SEQ ID NO: 37443

SEQ ID NO: 409034 - RNA, 64 nt, hsa; identical to SEQ ID NO: 37444

SEQ ID NO: 409035 - RNA, 64 nt, hsa; identical to SEQ ID NO: 37445

SEQ ID NO: 409036 - RNA, 64 nt, hsa; identical to SEQ ID NO: 37446

SEQ ID NO: 409037 - RNA, 64 nt, hsa; identical to SEQ ID NO: 37447

SEQ ID NO: 409038 - RNA, 64 nt, hsa; identical to SEQ ID NO: 37448

SEQ ID NO: 409039 - RNA, 64 nt, hsa; identical to SEQ ID NO: 37449

SEQ ID NO: 409040 - RNA, 64 nt, hsa; identical to SEQ ID NO: 37450

SEQ ID NO: 409041 - RNA, 64 nt, hsa; identical to SEQ ID NO: 37451

SEQ ID NO: 409042 - RNA, 64 nt, hsa; identical to SEQ ID NO: 37452

SEQ ID NO: 409043 - RNA, 64 nt, hsa; identical to SEQ ID NO: 37453

SEQ ID NO: 409044 - RNA, 64 nt, hsa; identical to SEQ ID NO: 37454

SEQ ID NO: 409045 - RNA, 64 nt, hsa; identical to SEQ ID NO: 37455

SEQ ID NO: 409046 - RNA, 64 nt, hsa; identical to SEQ ID NO: 37456

SEQ ID NO: 409047 - RNA, 64 nt, hsa; identical to SEQ ID NO: 37457

SEQ ID NO: 409048 - RNA, 64 nt, hsa; identical to SEQ ID NO: 37458

SEQ ID NO: 409049 - RNA, 64 nt, hsa; identical to SEQ ID NO: 37459

SEQ ID NO: 409050 - RNA, 64 nt, hsa; identical to SEQ ID NO: 37460

SEQ ID NO: 409051 - RNA, 64 nt, hsa; identical to SEQ ID NO: 37461

SEQ ID NO: 409052 - RNA, 64 nt, hsa; identical to SEQ ID NO: 37462

SEQ ID NO: 409053 - RNA, 64 nt, hsa; identical to SEQ ID NO: 37463

SEQ ID NO: 409054 - RNA, 64 nt, hsa; identical to SEQ ID NO: 37464

SEQ ID NO: 409055 - RNA, 64 nt, hsa; identical to SEQ ID NO: 37465

SEQ ID NO: 409056 - RNA, 64 nt, hsa; identical to SEQ ID NO: 37466

SEQ ID NO: 409057 - RNA, 64 nt, hsa; identical to SEQ ID NO: 37467

SEQ ID NO: 409058 - RNA, 64 nt, hsa; identical to SEQ ID NO: 37468

SEQ ID NO: 409059 - RNA, 64 nt, hsa; identical to SEQ ID NO: 37469

SEQ ID NO: 409060 - RNA, 64 nt, hsa; identical to SEQ ID NO: 37470

SEQ ID NO: 409061 - RNA, 64 nt, hsa; identical to SEQ ID NO: 37471

SEQ ID NO: 409062 - RNA, 64 nt, hsa; identical to SEQ ID NO: 37472

SEQ ID NO: 409063 - RNA, 64 nt, hsa; identical to SEQ ID NO: 37473

SEQ ID NO: 409064 - RNA, 64 nt, hsa; identical to SEQ ID NO: 37474

SEQ ID NO: 409065 - RNA, 64 nt, hsa; identical to SEQ ID NO: 37475

SEQ ID NO: 409066 - RNA, 64 nt, hsa; identical to SEQ ID NO: 37476

SEQ ID NO: 409067 - RNA, 64 nt, hsa; identical to SEQ ID NO: 37477

SEQ ID NO: 409068 - RNA, 64 nt, hsa; identical to SEQ ID NO: 37478

SEQ ID NO: 409069 - RNA, 64 nt, hsa; identical to SEQ ID NO: 37479

SEQ ID NO: 409070 - RNA, 64 nt, hsa; identical to SEQ ID NO: 37480

SEQ ID NO: 409071 - RNA, 64 nt, hsa; identical to SEQ ID NO: 37481

SEQ ID NO: 409072 - RNA, 64 nt, hsa; identical to SEQ ID NO: 37482

SEQ ID NO: 409073 - RNA, 64 nt, hsa; identical to SEQ ID NO: 37483

SEQ ID NO: 409074 - RNA, 64 nt, hsa; identical to SEQ ID NO: 37484

SEQ ID NO: 409075 - RNA, 64 nt, hsa; identical to SEQ ID NO: 37485

SEQ ID NO: 409076 - RNA, 64 nt, hsa; identical to SEQ ID NO: 37486

SEQ ID NO: 409077 - RNA, 64 nt, hsa; identical to SEQ ID NO: 37487

SEQ ID NO: 409078 - RNA, 64 nt, hsa; identical to SEQ ID NO: 37488

SEQ ID NO: 409079 - RNA, 64 nt, hsa; identical to SEQ ID NO: 37489

SEQ ID NO: 409080 - RNA, 64 nt, hsa; identical to SEQ ID NO: 37490

SEQ ID NO: 409081 - RNA, 64 nt, hsa; identical to SEQ ID NO: 37491

SEQ ID NO: 409082 - RNA, 64 nt, hsa; identical to SEQ ID NO: 37492

SEQ ID NO: 409083 - RNA, 64 nt, hsa; identical to SEQ ID NO: 37493

SEQ ID NO: 409084 - RNA, 64 nt, hsa; identical to SEQ ID NO: 37494

SEQ ID NO: 409085 - RNA, 64 nt, hsa; identical to SEQ ID NO: 37495

SEQ ID NO: 409086 - RNA, 64 nt, hsa; identical to SEQ ID NO: 37496

SEQ ID NO: 409087 - RNA, 64 nt, hsa; identical to SEQ ID NO: 37497

SEQ ID NO: 409088 - RNA, 64 nt, hsa; identical to SEQ ID NO: 37498

SEQ ID NO: 409089 - RNA, 64 nt, hsa; identical to SEQ ID NO: 37499

SEQ ID NO: 409090 - RNA, 64 nt, hsa; identical to SEQ ID NO: 37500

SEQ ID NO: 409091 - RNA, 64 nt, hsa; identical to SEQ ID NO: 37501

SEQ ID NO: 409092 - RNA, 64 nt, hsa; identical to SEQ ID NO: 37502

SEQ ID NO: 409093 - RNA, 64 nt, hsa; identical to SEQ ID NO: 37503

SEQ ID NO: 409094 - RNA, 64 nt, hsa; identical to SEQ ID NO: 37504

SEQ ID NO: 409095 - RNA, 64 nt, hsa; identical to SEQ ID NO: 37505

SEQ ID NO: 409096 - RNA, 64 nt, hsa; identical to SEQ ID NO: 37506

SEQ ID NO: 409097 - RNA, 64 nt, hsa; identical to SEQ ID NO: 37507

SEQ ID NO: 409098 - RNA, 64 nt, hsa; identical to SEQ ID NO: 37508

SEQ ID NO: 409099 - RNA, 64 nt, hsa; identical to SEQ ID NO: 37509

SEQ ID NO: 409100 - RNA, 64 nt, hsa; identical to SEQ ID NO: 37510

SEQ ID NO: 409101 - RNA, 64 nt, hsa; identical to SEQ ID NO: 37511

SEQ ID NO: 409102 - RNA, 64 nt, hsa; identical to SEQ ID NO: 37512

SEQ ID NO: 409103 - RNA, 64 nt, hsa; identical to SEQ ID NO: 37513

SEQ ID NO: 409104 - RNA, 64 nt, hsa; identical to SEQ ID NO: 37514

SEQ ID NO: 409105 - RNA, 64 nt, hsa; identical to SEQ ID NO: 37515

SEQ ID NO: 409106 - RNA, 64 nt, hsa; identical to SEQ ID NO: 37516

SEQ ID NO: 409107 - RNA, 64 nt, hsa; identical to SEQ ID NO: 37517

SEQ ID NO: 409108 - RNA, 64 nt, hsa; identical to SEQ ID NO: 37518

SEQ ID NO: 409109 - RNA, 64 nt, hsa; identical to SEQ ID NO: 37272

SEQ ID NO: 409110 - RNA, 64 nt, hsa; identical to SEQ ID NO: 37520

SEQ ID NO: 409111 - RNA, 64 nt, hsa; identical to SEQ ID NO: 37521

SEQ ID NO: 409112 - RNA, 64 nt, hsa; identical to SEQ ID NO: 37522

SEQ ID NO: 409113 - RNA, 64 nt, hsa; identical to SEQ ID NO: 37523

SEQ ID NO: 409114 - RNA, 64 nt, hsa; identical to SEQ ID NO: 37524

SEQ ID NO: 409115 - RNA, 64 nt, hsa; identical to SEQ ID NO: 37525

SEQ ID NO: 409116 - RNA, 64 nt, hsa; identical to SEQ ID NO: 37526

SEQ ID NO: 409117 - RNA, 65 nt, hsa; identical to SEQ ID NO: 393598

SEQ ID NO: 409118 - RNA, 65 nt, hsa; identical to SEQ ID NO: 393599

SEQ ID NO: 409119 - RNA, 65 nt, hsa; identical to SEQ ID NO: 393600

SEQ ID NO: 409120 - RNA, 65 nt, hsa; identical to SEQ ID NO: 393601

SEQ ID NO: 409121 - RNA, 65 nt, hsa; identical to SEQ ID NO: 393602

SEQ ID NO: 409122 - RNA, 65 nt, hsa; identical to SEQ ID NO: 393603

SEQ ID NO: 409123 - RNA, 65 nt, hsa; identical to SEQ ID NO: 393604

SEQ ID NO: 409124 - RNA, 65 nt, hsa; identical to SEQ ID NO: 393605

SEQ ID NO: 409125 - RNA, 65 nt, hsa; identical to SEQ ID NO: 393606

SEQ ID NO: 409126 - RNA, 65 nt, hsa; identical to SEQ ID NO: 393607

SEQ ID NO: 409127 - RNA, 65 nt, hsa; identical to SEQ ID NO: 393608

SEQ ID NO: 409128 - RNA, 65 nt, hsa; identical to SEQ ID NO: 393609

SEQ ID NO: 409129 - RNA, 65 nt, hsa; identical to SEQ ID NO: 393610

SEQ ID NO: 409130 - RNA, 65 nt, hsa; identical to SEQ ID NO: 393611

SEQ ID NO: 409131 - RNA, 65 nt, hsa; identical to SEQ ID NO: 393612

SEQ ID NO: 409132 - RNA, 65 nt, hsa; identical to SEQ ID NO: 393613

SEQ ID NO: 409133 - RNA, 65 nt, hsa; identical to SEQ ID NO: 393614

SEQ ID NO: 409134 - RNA, 65 nt, hsa; identical to SEQ ID NO: 393615

SEQ ID NO: 409135 - RNA, 65 nt, hsa; identical to SEQ ID NO: 393616

SEQ ID NO: 409136 - RNA, 65 nt, hsa; identical to SEQ ID NO: 393617

SEQ ID NO: 409137 - RNA, 65 nt, hsa; identical to SEQ ID NO: 393618

SEQ ID NO: 409138 - RNA, 65 nt, hsa; identical to SEQ ID NO: 393619

SEQ ID NO: 409139 - RNA, 65 nt, hsa; identical to SEQ ID NO: 393620

SEQ ID NO: 409140 - RNA, 65 nt, hsa; identical to SEQ ID NO: 393621

SEQ ID NO: 409141 - RNA, 65 nt, hsa; identical to SEQ ID NO: 393622

SEQ ID NO: 409142 - RNA, 65 nt, hsa; identical to SEQ ID NO: 393623

SEQ ID NO: 409143 - RNA, 65 nt, hsa; identical to SEQ ID NO: 393624

SEQ ID NO: 409144 - RNA, 65 nt, hsa; identical to SEQ ID NO: 393625

SEQ ID NO: 409145 - RNA, 65 nt, hsa; identical to SEQ ID NO: 393626

SEQ ID NO: 409146 - RNA, 65 nt, hsa; identical to SEQ ID NO: 393627

SEQ ID NO: 409147 - RNA, 65 nt, hsa; identical to SEQ ID NO: 393628

SEQ ID NO: 409148 - RNA, 65 nt, hsa; identical to SEQ ID NO: 393629

SEQ ID NO: 409149 - RNA, 65 nt, hsa; identical to SEQ ID NO: 393630

SEQ ID NO: 409150 - RNA, 65 nt, hsa; identical to SEQ ID NO: 393631

SEQ ID NO: 409151 - RNA, 65 nt, hsa; identical to SEQ ID NO: 393632

SEQ ID NO: 409152 - RNA, 65 nt, hsa; identical to SEQ ID NO: 393633

SEQ ID NO: 409153 - RNA, 65 nt, hsa; identical to SEQ ID NO: 393634

SEQ ID NO: 409154 - RNA, 65 nt, hsa; identical to SEQ ID NO: 393635

SEQ ID NO: 409155 - RNA, 65 nt, hsa; identical to SEQ ID NO: 393636

SEQ ID NO: 409156 - RNA, 65 nt, hsa; identical to SEQ ID NO: 393637

SEQ ID NO: 409157 - RNA, 65 nt, hsa; identical to SEQ ID NO: 393638

SEQ ID NO: 409158 - RNA, 65 nt, hsa; identical to SEQ ID NO: 393639

SEQ ID NO: 409159 - RNA, 65 nt, hsa; identical to SEQ ID NO: 393640

SEQ ID NO: 409160 - RNA, 65 nt, hsa; identical to SEQ ID NO: 393641

SEQ ID NO: 409161 - RNA, 65 nt, hsa; identical to SEQ ID NO: 393642

SEQ ID NO: 409162 - RNA, 65 nt, hsa; identical to SEQ ID NO: 393643

SEQ ID NO: 409163 - RNA, 65 nt, hsa; identical to SEQ ID NO: 393644

SEQ ID NO: 409164 - RNA, 65 nt, hsa; identical to SEQ ID NO: 393645

SEQ ID NO: 409165 - RNA, 65 nt, hsa; identical to SEQ ID NO: 393646

SEQ ID NO: 409166 - RNA, 65 nt, hsa; identical to SEQ ID NO: 393647

SEQ ID NO: 409167 - RNA, 65 nt, hsa; identical to SEQ ID NO: 393648

SEQ ID NO: 409168 - RNA, 65 nt, hsa; identical to SEQ ID NO: 393649

SEQ ID NO: 409169 - RNA, 65 nt, hsa; identical to SEQ ID NO: 393650

SEQ ID NO: 409170 - RNA, 65 nt, hsa; identical to SEQ ID NO: 393651

SEQ ID NO: 409171 - RNA, 65 nt, hsa; identical to SEQ ID NO: 393652

SEQ ID NO: 409172 - RNA, 65 nt, hsa; identical to SEQ ID NO: 393653

SEQ ID NO: 409173 - RNA, 65 nt, hsa; identical to SEQ ID NO: 393654

SEQ ID NO: 409174 - RNA, 65 nt, hsa; identical to SEQ ID NO: 393655

SEQ ID NO: 409175 - RNA, 65 nt, hsa; identical to SEQ ID NO: 393656

SEQ ID NO: 409176 - RNA, 65 nt, hsa; identical to SEQ ID NO: 393657

SEQ ID NO: 409177 - RNA, 65 nt, hsa; identical to SEQ ID NO: 393658

SEQ ID NO: 409178 - RNA, 65 nt, hsa; identical to SEQ ID NO: 393659

SEQ ID NO: 409179 - RNA, 65 nt, hsa; identical to SEQ ID NO: 393660

SEQ ID NO: 409180 - RNA, 64 nt, hsa
aauauguaauucaccgaaaccacaccaaguccugcuacuguagaguggaaaugacuucugaaua

SEQ ID NO: 409181 - RNA, 64 nt, hsa
uaauaauuggcuauauuugguaccugucucucuccuacuguauugucauuuucaaaauguguuu

SEQ ID NO: 409182 - RNA, 64 nt, hsa
aguagaauauggacuuggaaaauucucuuaaucacuacuguauguaauauuuacauaaagacug

SEQ ID NO: 409183 - RNA, 64 nt, hsa
cgagguuaaagaagcugcauguuaagugccauuacuacuguacacggaccaucgccucugucuc

SEQ ID NO: 409184 - RNA, 64 nt, hsa
ugauaauuauuuagaugugaauguuaggucaguucuacuguaauaacuaaucguaaaaguugua

SEQ ID NO: 409185 - RNA, 64 nt, hsa
aauuauuucauaacuuuagcaguguguuuuggaacuacuguacuuaaagguuuguuuguuuguu

SEQ ID NO: 409186 - RNA, 64 nt, hsa
aucccauuuuaucauccuuucaguuuuuauuaaucuacuguaucaauaaaauucuguaauuuga

SEQ ID NO: 409187 - RNA, 64 nt, hsa
ggcagcguagaagugguauauccaaguauaucagcuacuguaguugucacagucuugugaacuu

SEQ ID NO: 409188 - RNA, 64 nt, hsa
gguacaaauuacugguauguuuuauaagccgcagcuacuguacacagccuaucugauauaaucu

SEQ ID NO: 409189 - RNA, 64 nt, hsa
aauuggaaugcaaaaauuagcagacaauccauuccuacuguauuucuguaugaauguguuugug

SEQ ID NO: 409190 - RNA, 64 nt, hsa
uggcuugauugcuuaaacuauugacuugguaagucuacuguauauaacaucuaauauauauaua

SEQ ID NO: 409191 - RNA, 64 nt, hsa
uggcuugauugcuuaaacuauugacuugguaagucuacuguauauaacaucuaauauauauauu

SEQ ID NO: 409192 - RNA, 64 nt, hsa
uggaaagcagagguugcagugagcugagaucacacuacuguacuacuguacuccagccuggggg

SEQ ID NO: 409193 - RNA, 64 nt, hsa
agagguugcagugagcugagaucacacuacuguacuacuguacuccagccugggggaaagagug

SEQ ID NO: 409194 - RNA, 64 nt, hsa
gaaugucuagcugagccuguuuuugauggagcuacuacuguaaugcgugaacuaacaaaccugu

SEQ ID NO: 409195 - RNA, 64 nt, hsa
cuaauuuuuuggacaaaucuucaaacggacugugcuacuguauuugucucaaagcuaccaaguu

SEQ ID NO: 409196 - RNA, 64 nt, hsa
uucacguucuaguguuuuuccugaaaugugcaaucuacuguauaguauugccacauaauuguac

SEQ ID NO: 409197 - RNA, 64 nt, hsa
aauucacaaauaacccuccauuuuucaauaucugcuacuguaaacaugaauauugaauacugac

SEQ ID NO: 409198 - RNA, 64 nt, hsa
uugauauaauguguuaugcuuauggcgcuguggacaaucugauuuuucaugucaacuuuccaga

SEQ ID NO: 409199 - RNA, 64 nt, hsa
guuucaagaaaugaggugauccuauuaucaaauucaaucugaugucaaauagcacuaagaaguu

SEQ ID NO: 409200 - RNA, 64 nt, hsa
gagccacugcgcccggccaaaaagaacauuuugucaaucugaacagagcacagaacauuuuuuc

SEQ ID NO: 409201 - RNA, 64 nt, hsa
cagucaucuucaaaggcagauuauuagauuccagcaaucugaaaucuauuauuccagcagucug

SEQ ID NO: 409202 - RNA, 64 nt, hsa
cucugucucaaaacaaacaaacaaacaaaagacccaaucugagucuuaucguuguacugauaga

SEQ ID NO: 409203 - RNA, 64 nt, hsa
ggcaugaauaagaggggaggucaaaauaaagacccaaucugaggccgggcacgguggcucacgc

SEQ ID NO: 409204 - RNA, 64 nt, hsa
uacuguccuuuuauaugaaauuuccagaacaggccaaucugaagagauguauaguggauuggug

SEQ ID NO: 409205 - RNA, 64 nt, hsa
ggguuugaauugggauuucugugaaucuauagaucaaucugaggagacuuaauaaugauauuga

SEQ ID NO: 409206 - RNA, 64 nt, hsa
augcacaggcucaaguuguuuuaaaaaucucauuuauuauaauauugaugcucaauuagguaag

SEQ ID NO: 409207 - RNA, 64 nt, hsa
caguuuuguaaaauuaguauugaguucuauugaguauuauaagauagcuuacauuuucaaaaug

SEQ ID NO: 409208 - RNA, 64 nt, hsa
uuaaggauugugauauuuuuacuugcauugaauauauuauaaucuuccauacuucuucauucaa

SEQ ID NO: 409209 - RNA, 64 nt, hsa
uauccagaguuuagaggaaaaaaaugacuaaaaauauuauaacuuaaaaaaaugacagauguug

SEQ ID NO: 409210 - RNA, 64 nt, hsa
ucuccuuuauuauuauuguuauaauuauuauaauuauuauaauuauuuuauccccucccccacc

SEQ ID NO: 409211 - RNA, 64 nt, hsa
uuuuauuaaucuccuuuauuauuauuguuauaauuauuauaauuauuauaauuauuuuaucccc

SEQ ID NO: 409212 - RNA, 64 nt, hsa
gacagagcaagaccccauucucuuacaaagucucuauuauaaaaguacauccaucaauaccauu

SEQ ID NO: 409213 - RNA, 64 nt, hsa
uauaaucauuacugccaaacuggaauuuucaaguuauuauaauaucccaggccccuugauaaaa

SEQ ID NO: 409214 - RNA, 64 nt, hsa
uaaaacauuauauguauacaucaguauaguguuuuauuauaaagccaauuaucugauuaagcau

SEQ ID NO: 409215 - RNA, 64 nt, hsa
auacugacagaaguuauuuccaaguuuguguauauauuauaaaaauuacauauauaaaacuaag

SEQ ID NO: 409216 - RNA, 64 nt, hsa
uggacccugucaguuuugcaacuacauuauacauuauuauaauauucuuuuuuuuuucuagaaa

SEQ ID NO: 409217 - RNA, 64 nt, hsa
uuuuacuuaaauuuucuuuaauuuacuuauauguuauuauaauuuugaauuuuuaaguucuaug

SEQ ID NO: 409218 - RNA, 64 nt, hsa
uuauccucucauuuuuucacugcuaugauauauuuauuauaaaauagggaaugaaugaaugaau

SEQ ID NO: 409219 - RNA, 64 nt, hsa
gggaaaaucauuauuuuagguguggagccauuuuuauuauaaaacuuucucaaaauaaaaaaac

SEQ ID NO: 409220 - RNA, 64 nt, hsa
uguaaguaaugcuguaauaauacauaucauaguauauuauaaucaguaugucauaguguuaaag

SEQ ID NO: 409221 - RNA, 64 nt, hsa
cuaaaccuuauauuuuauuuuugccaaaauauuuuauuauaaaauaugaccaaaauauuuaaaa

SEQ ID NO: 409222 - RNA, 64 nt, hsa
caaaauuaaugaauaccauauuaguauuauaaaauauuauaaaguaauaauuauaucaucuaua

SEQ ID NO: 409223 - RNA, 64 nt, hsa
uaacuuccaacaaaauuaaugaauaccauauuaguauuauaaaauauuauaaaguaauaauuau

SEQ ID NO: 409224 - RNA, 64 nt, hsa
uauuccuagauauggaggaaacauaagucuguaguauuauaaaacugauuguaauaauucuuuc

SEQ ID NO: 409225 - RNA, 64 nt, hsa
uuauuucaucugcaaaugauaauaaauccuuuguuauuauaacuguccagaagugugggcuaug

SEQ ID NO: 409226 - RNA, 64 nt, hsa
aaaaguaaaaugucuuuccaaauuauuucuuaauuauuauaaaaauauuaagacaauagcacuu

SEQ ID NO: 409227 - RNA, 64 nt, hsa
uagauuaauacucuauuuuuacauuuaaaccuuuuauuauaagucuuacauaaaccauuuuugu

SEQ ID NO: 409228 - RNA, 64 nt, hsa
guuuacugaagggaacaucaaaauauuaaugguauauuauaaaauaaagacuuucuuaaaggaa

SEQ ID NO: 409229 - RNA, 64 nt, hsa
ugacuguugucauucuggagguccuauuagagaauauuauaaaagggugaccuuguaggaagga

SEQ ID NO: 409230 - RNA, 64 nt, hsa
aggagaagaaucaguaaguguaagguguacuugguauuauaaugcauaauugauguuuucguua

SEQ ID NO: 409231 - RNA, 64 nt, hsa
aaauauauugcugcaaauggaagcuuuucuguucuauuauaaaacugucgauguauucugacca

SEQ ID NO: 409232 - RNA, 64 nt, hsa
uaauuucuaaaccauguauauguacguuuauauguauuauaauugcauacacaugccuccaugc

SEQ ID NO: 409233 - RNA, 64 nt, hsa
agcaucagaaaugaggcaagcuaggagaaugggcuauuauaauguaaagaauuguagucucagu

SEQ ID NO: 409234 - RNA, 64 nt, hsa
acauauuaaagccuuuauuccaucucucaagauauauuauaaaauuuauuuuuuuaauuuaaga

SEQ ID NO: 409235 - RNA, 64 nt, hsa
aagagguugggcuuuuuugaaagagacaaaaauuuauuauaacacuaaacacuccuuuuuugac

SEQ ID NO: 409236 - RNA, 64 nt, hsa
gauaagaaauaaaaagguguuuauaacuauuuuguauuauaaagugggccuuagagauaggaag

SEQ ID NO: 409237 - RNA, 64 nt, hsa
cugucuaucuucuugcuccacucacugaagauccuauuauaaucccaugaaaauguaaauuaca

SEQ ID NO: 409238 - RNA, 64 nt, hsa
aaaguaacuacaaauaaguguugugaauagauuuuauuauaaaucagagaacuguuuucucccu

SEQ ID NO: 409239 - RNA, 64 nt, hsa
gcuugaagcacuuuaauauaacuugaauauuaucuauuauaaaaguaacuacaaauaaguguug

SEQ ID NO: 409240 - RNA, 64 nt, hsa
aguugaggccuaaauaaagucuuuuuauaauuauuauuauaacaaugugacauugcacaucuaa

SEQ ID NO: 409241 - RNA, 64 nt, hsa
acuaguuuuaauuagcucugcccucaugaaguauuauuauaauucaccauaaacagcuaucugu

SEQ ID NO: 409242 - RNA, 64 nt, hsa
uuuauuucucaauaccugcuucacuugauaaucauauuauaauuuuuuaucaugauuauugacu

SEQ ID NO: 409243 - RNA, 64 nt, hsa
uaacuuuauggaguagguaccauuugugucucuuuauuauaagugagagaaaugaaguuuauau

SEQ ID NO: 409244 - RNA, 64 nt, hsa
gaacaucucaugugugcucacaauguucuggcacuauuauaagugcuucacagguuuuaugugu

SEQ ID NO: 409245 - RNA, 64 nt, hsa
ucuuucuguauucugagaguguacaguacaggauuauuauaaugaaaguuuauaucaacagggu

SEQ ID NO: 409246 - RNA, 64 nt, hsa
uuuauaucaacaggguuucguuggcucugccauauauuauaagcaaaagagauugguaaagugc

SEQ ID NO: 409247 - RNA, 64 nt, hsa
uucaacagucuguuuauuguacuuccaaugguuuuauuauaauacaguauacgggacauauauu

SEQ ID NO: 409248 - RNA, 64 nt, hsa
uuuuauuucuuuguagcuacuuguguuuuauugguauuauaaaccugauaauuauuuacauguu

SEQ ID NO: 409249 - RNA, 64 nt, hsa
uucccacauauuaagucaggguggauaaauuaguuauuauaacuaaacauaguauaguccaaca

SEQ ID NO: 409250 - RNA, 64 nt, hsa
gugggacaugcugugaauuuagauuacaaaugaauauuauaaaggggaugauuuuuaaccaaag

SEQ ID NO: 409251 - RNA, 64 nt, hsa
guauggucauacuuuuuaaauuugauuuuuuaaauauuauaaguggucaugaaauuuuaauguu

SEQ ID NO: 409252 - RNA, 64 nt, hsa
uuaacuaaaggaccauauuuauucauuauuuuaauauuauaagggaaguaaaaaaaagugaggu

SEQ ID NO: 409253 - RNA, 64 nt, hsa
cuauucagguaucuuuuuauuucugauaguuuuauauuauaauagaaagccagccacugcuuag

SEQ ID NO: 409254 - RNA, 64 nt, hsa
auaucauugccaggguauggcuuacagugacuacuauuauaauacuaaaacucagagaaucaaa

SEQ ID NO: 409255 - RNA, 64 nt, hsa
uauugcaacaaaguuaggaaguuuguuguuuguuuauuauaaacaaaaagcaugugaaagugca

SEQ ID NO: 409256 - RNA, 64 nt, hsa
uuucagcuacauauaugaacaaauccuuuauuauuauuauaauuauuuuuuugcgugaaagugu

SEQ ID NO: 409257 - RNA, 64 nt, hsa
ccccaaacauaggccuaauugagauaauugcuuuuauuauaauaauaggauugaaauuuuaaaa

SEQ ID NO: 409258 - RNA, 64 nt, hsa
ucagaggcaucuguuuccuuuaccaucugcaucuuauuauaaauguagucgucauaaagugugg

SEQ ID NO: 409259 - RNA, 64 nt, hsa
uuuucgauaauuuauucuuguauuacaaucuuuuuauuauaauagucuccacucuccccaaaau

SEQ ID NO: 409260 - RNA, 64 nt, hsa
uuccucaccauucuccuaugugagggacuucuuguauuauaaucuuuuaauauaauauuauauu

SEQ ID NO: 409261 - RNA, 64 nt, hsa
aacucagagaaacauuuauuucggcuugcugguuuauuauaaaagcaagguuuauuauaaaaga

SEQ ID NO: 409262 - RNA, 64 nt, hsa
uuucggcuugcugguuuauuauaaaagcaagguuuauuauaaaagauacuacaaaggauacaga

SEQ ID NO: 409263 - RNA, 64 nt, hsa
aaguguuuacaauaagcaauaaagugaaagaaccuauuauaacacagauuauauuuucauuguc

SEQ ID NO: 409264 - RNA, 64 nt, hsa
ccuguacuugcagauaagaagcuuacuauaucauuauuauaaguagcauauauuacuuucaaau

SEQ ID NO: 409265 - RNA, 64 nt, hsa
ccuuucaggggggacuaugagaucaaaauauuuuuauuauaaugugaagacauugucuuuucac

SEQ ID NO: 409266 - RNA, 64 nt, hsa
cuuuaacuugguucuguguaaauaguauguauuuuauuauaauauuucucauuuuaagaugcuu

SEQ ID NO: 409267 - RNA, 64 nt, hsa
aaagguuuagucaagaaacaaaaaucuuaaagauuauuauaacccagacuaagguugaacaacc

SEQ ID NO: 409268 - RNA, 64 nt, hsa
augucaaauuuuuuuucuuagaaguagucuucauuauuauaaauuuguacaccaaaaggccaug

SEQ ID NO: 409269 - RNA, 64 nt, hsa; identical to SEQ ID NO: 175085

SEQ ID NO: 409270 - RNA, 64 nt, hsa; identical to SEQ ID NO: 175086

SEQ ID NO: 409271 - RNA, 64 nt, hsa
acgccuguaaucccagcacuuugggaggccgaggcgggcagauuauugccugagcucaggaguu

SEQ ID NO: 409272 - RNA, 64 nt, hsa
acgccuguaaucccagcacucugggaggccaaagcgggcagaucaccugaggucaggaguucaa

SEQ ID NO: 409273 - RNA, 64 nt, hsa
cugccuauaaucccaguacuuugggaggccgaggcgggcagaucacuugaggucaggaguucaa

SEQ ID NO: 409274 - RNA, 64 nt, hsa
augccuguaacccuagcacuuugggaggcugaggcgggcagaucacuugagguuaggaguuuga

SEQ ID NO: 409275 - RNA, 64 nt, hsa; identical to SEQ ID NO: 247878

SEQ ID NO: 409276 - RNA, 64 nt, hsa; identical to SEQ ID NO: 247879

SEQ ID NO: 409277 - RNA, 64 nt, hsa; identical to SEQ ID NO: 247880

SEQ ID NO: 409278 - RNA, 64 nt, hsa; identical to SEQ ID NO: 247881

SEQ ID NO: 409279 - RNA, 64 nt, hsa
acuaaauugggcagggcuuuuuaguaucaaaucacuacuagaccauuuaauuuguuaaauuauc

SEQ ID NO: 409280 - RNA, 64 nt, hsa
gaaggagggggucugggcaucuguggauuuuuggcuacuagaagugucccagaagucacuguau

SEQ ID NO: 409281 - RNA, 65 nt, hsa
cuauuuugcccauagugccauuuagagaugaaaaccagcuuuaacuuugcaaagugaacauguac

SEQ ID NO: 409282 - RNA, 65 nt, hsa
ggcacccaaauccuugucgccaaucuccugaaguacagcuuuaccauauuaguggucauuauuua

SEQ ID NO: 409283 - RNA, 65 nt, hsa
augucagaauaacuuacagaaaaauagaaaaugcacagcuuuaaaaugggcagaguuaaaaucua

SEQ ID NO: 409284 - RNA, 65 nt, hsa
acagcuuuaaaaugggcagaguuaaaaucuauucccagcuuuaucacuuauuuagccaugcuagc

SEQ ID NO: 409285 - RNA, 65 nt, hsa
cagaaauggucuggguauaagcuauuucauaaaagcagcuuuaaauugucaguauuaagguuuuc

SEQ ID NO: 409286 - RNA, 65 nt, hsa
aaaguuuaugaaaacauucauuugaaaguuccaugcagcuuuagcacagaguugaccaaacacug

SEQ ID NO: 409287 - RNA, 65 nt, hsa
cacaccaaggucugcugucuuauagccaagaauuacagcuuuauuuauagagagugaauuauggg

SEQ ID NO: 409288 - RNA, 65 nt, hsa
uagugagcagcgcaccagauguagcgugcuacagucagcuuuagcucucaagagucguauguaac

SEQ ID NO: 409289 - RNA, 65 nt, hsa
aggaaaaggaaagcguuuuuguagcccaccaucuacagcuuuacuguaaaaccuugucuuauucg

SEQ ID NO: 409290 - RNA, 65 nt, hsa
caaaagaguauuuauacaucccaccaaucaaaacacagcuuuauuaccucaugcgaacucauaca

SEQ ID NO: 409291 - RNA, 65 nt, hsa
gggaacuucuaaacacuucauucuuuauauauggacagcuuuauuuuaaaugugguuuuugaugc

SEQ ID NO: 409292 - RNA, 65 nt, hsa
agccauuuacuuugcaagugagauagcuuccccaccagcuuuauuuuuuaacaugaaagcugaug

SEQ ID NO: 409293 - RNA, 65 nt, hsa
gcccugugggcaccuggugccugcccccugccgggcagcuuuaaggacagacccccaggggcagu

SEQ ID NO: 409294 - RNA, 65 nt, hsa
auggggccuuugaggcagggucgcagggacaagcucagcuuuaggcaccaucuguucccaucgcg

SEQ ID NO: 409295 - RNA, 65 nt, hsa
ccacagaugaccacaucuaauccugcuucuacucucagcuuuaggacaaaagcucugucagaggc

SEQ ID NO: 409296 - RNA, 65 nt, hsa
gccuuacgaauaaaaaacuggauucugguuuacagcagcuuuacagugauaguuaaauuaacugg

SEQ ID NO: 409297 - RNA, 65 nt, hsa
acagcaguggcuucuaggaaacugggaguuuagaucagcuuuacagauacaucgaucagaggcua

SEQ ID NO: 409298 - RNA, 65 nt, hsa
agcagugggaacugugauuggauuuggcaacaugucagcuuuauaguugccgauuagugauaugg

SEQ ID NO: 409299 - RNA, 65 nt, hsa
gcugguaacaguucauguuugcuucauaaaugaagcagcuuuaaacaaauucauauucugucugg

SEQ ID NO: 409300 - RNA, 65 nt, hsa
ugucccuuaacagugccgcaucucagccuggaagucagcuuuaagucauucaagagaaccucagg

SEQ ID NO: 409301 - RNA, 65 nt, hsa
gaacccuacagauuagcccaguucucucuuauuuucagcuuuacagacaagaacaauuuaaaucu

SEQ ID NO: 409302 - RNA, 65 nt, hsa
aauuagauguaauugagcuuuguguaauauuaugucagcuuuaacauauaauauuuugaauauuu

SEQ ID NO: 409303 - RNA, 65 nt, hsa
uauguaaucagucauuacacuagggagaaauuuaucagcuuuaguucuaaauaugcucaugaggu

SEQ ID NO: 409304 - RNA, 65 nt, hsa
ccuuguuucucuuccuuucuuuuuuuaaaaaauagcagcuuuagccaagugcagggccuguaauc

SEQ ID NO: 409305 - RNA, 65 nt, hsa
caaaaaaaaaaccauauauauacauauauauauagcagcuuuauggagauauaauucuuaugcca

SEQ ID NO: 409306 - RNA, 65 nt, hsa
aacaccugcggaaggagcuggagaaucugacaggacagcuuuaagcccaugugcaagaaaaugag

SEQ ID NO: 409307 - RNA, 65 nt, hsa
aacaccugcggaaggagcuggagaaucuggcaggacagcuuuaagcccaaguggaagaaaaugag

SEQ ID NO: 409308 - RNA, 64 nt, hsa; identical to SEQ ID NO: 234449

SEQ ID NO: 409309 - RNA, 64 nt, hsa; identical to SEQ ID NO: 234450

SEQ ID NO: 409310 - RNA, 64 nt, hsa; identical to SEQ ID NO: 234451

SEQ ID NO: 409311 - RNA, 64 nt, hsa; identical to SEQ ID NO: 234452

SEQ ID NO: 409312 - RNA, 64 nt, hsa; identical to SEQ ID NO: 234453

SEQ ID NO: 409313 - RNA, 64 nt, hsa; identical to SEQ ID NO: 234454

SEQ ID NO: 409314 - RNA, 64 nt, hsa; identical to SEQ ID NO: 234455

SEQ ID NO: 409315 - RNA, 64 nt, hsa; identical to SEQ ID NO: 234456

SEQ ID NO: 409316 - RNA, 64 nt, hsa; identical to SEQ ID NO: 234457

SEQ ID NO: 409317 - RNA, 64 nt, hsa; identical to SEQ ID NO: 234458

SEQ ID NO: 409318 - RNA, 64 nt, hsa; identical to SEQ ID NO: 234459

SEQ ID NO: 409319 - RNA, 64 nt, hsa; identical to SEQ ID NO: 234460

SEQ ID NO: 409320 - RNA, 64 nt, hsa; identical to SEQ ID NO: 234461

SEQ ID NO: 409321 - RNA, 64 nt, hsa; identical to SEQ ID NO: 234462

SEQ ID NO: 409322 - RNA, 64 nt, hsa; identical to SEQ ID NO: 234463

SEQ ID NO: 409323 - RNA, 64 nt, hsa; identical to SEQ ID NO: 234464

SEQ ID NO: 409324 - RNA, 54 nt, hsa; identical to SEQ ID NO: 234465

SEQ ID NO: 409325 - RNA, 64 nt, hsa; identical to SEQ ID NO: 234466

SEQ ID NO: 409326 - RNA, 64 nt, hsa; identical to SEQ ID NO: 234467

SEQ ID NO: 409327 - RNA, 64 nt, hsa; identical to SEQ ID NO: 234468

SEQ ID NO: 409328 - RNA, 64 nt, hsa; identical to SEQ ID NO: 234469

SEQ ID NO: 409329 - RNA, 64 nt, hsa; identical to SEQ ID NO: 234470

SEQ ID NO: 409330 - RNA, 64 nt, hsa; identical to SEQ ID NO: 234471

SEQ ID NO: 409331 - RNA, 64 nt, hsa; identical to SEQ ID NO: 234472

SEQ ID NO: 409332 - RNA, 64 nt, hsa; identical to SEQ ID NO: 234473

SEQ ID NO: 409333 - RNA, 64 nt, hsa; identical to SEQ ID NO: 234474

SEQ ID NO: 409334 - RNA, 64 nt, hsa; identical to SEQ ID NO: 234475

SEQ ID NO: 409335 - RNA, 64 nt, hsa; identical to SEQ ID NO: 234476

SEQ ID NO: 409336 - RNA, 64 nt, hsa; identical to SEQ ID NO: 234477

SEQ ID NO: 409337 - RNA, 64 nt, hsa; identical to SEQ ID NO: 234478

SEQ ID NO: 409338 - RNA, 64 nt, hsa; identical to SEQ ID NO: 234479

SEQ ID NO: 409339 - RNA, 64 nt, hsa; identical to SEQ ID NO: 234480

SEQ ID NO: 409340 - RNA, 64 nt, hsa; identical to SEQ ID NO: 234481

SEQ ID NO: 409341 - RNA, 64 nt, hsa; identical to SEQ ID NO: 234482

SEQ ID NO: 409342 - RNA, 64 nt, hsa; identical to SEQ ID NO: 234483

SEQ ID NO: 409343 - RNA, 64 nt, hsa; identical to SEQ ID NO: 234484

SEQ ID NO: 409344 - RNA, 64 nt, hsa; identical to SEQ ID NO: 234485

SEQ ID NO: 409345 - RNA, 64 nt, hsa; identical to SEQ ID NO: 234486

SEQ ID NO: 409346 - RNA, 64 nt, hsa; identical to SEQ ID NO: 234487

SEQ ID NO: 409347 - RNA, 64 nt, hsa; identical to SEQ ID NO: 234488

SEQ ID NO: 409348 - RNA, 64 nt, hsa; identical to SEQ ID NO: 234489

SEQ ID NO: 409349 - RNA, 64 nt, hsa; identical to SEQ ID NO: 234490

SEQ ID NO: 409350 - RNA, 64 nt, hsa; identical to SEQ ID NO: 234491

SEQ ID NO: 409351 - RNA, 64 nt, hsa; identical to SEQ ID NO: 234492

SEQ ID NO: 409352 - RNA, 64 nt, hsa; identical to SEQ ID NO: 234493

SEQ ID NO: 409353 - RNA, 64 nt, hsa; identical to SEQ ID NO: 234494

SEQ ID NO: 409354 - RNA, 64 nt, hsa; identical to SEQ ID NO: 234495

SEQ ID NO: 409355 - RNA, 64 nt, hsa; identical to SEQ ID NO: 234496

SEQ ID NO: 409356 - RNA, 64 nt, hsa; identical to SEQ ID NO: 234497

SEQ ID NO: 409357 - RNA, 64 nt, hsa; identical to SEQ ID NO: 234498

SEQ ID NO: 409358 - RNA, 64 nt, hsa; identical to SEQ ID NO: 234499

SEQ ID NO: 409359 - RNA, 64 nt, hsa; identical to SEQ ID NO: 234500

SEQ ID NO: 409360 - RNA, 64 nt, hsa; identical to SEQ ID NO: 234501

SEQ ID NO: 409361 - RNA, 64 nt, hsa; identical to SEQ ID NO: 234502

SEQ ID NO: 409362 - RNA, 64 nt, hsa; identical to SEQ ID NO: 234503

SEQ ID NO: 409363 - RNA, 64 nt, hsa; identical to SEQ ID NO: 234504

SEQ ID NO: 409364 - RNA, 64 nt, hsa; identical to SEQ ID NO: 234505

SEQ ID NO: 409365 - RNA, 64 nt, hsa; identical to SEQ ID NO: 234506

SEQ ID NO: 409366 - RNA, 64 nt, hsa; identical to SEQ ID NO: 234507

SEQ ID NO: 409367 - RNA, 64 nt, hsa; identical to SEQ ID NO: 234508

SEQ ID NO: 409368 - RNA, 64 nt, hsa; identical to SEQ ID NO: 244542

SEQ ID NO: 409369 - RNA, 64 nt, hsa; identical to SEQ ID NO: 244543

SEQ ID NO: 409370 - RNA, 64 nt, hsa; identical to SEQ ID NO: 244544

SEQ ID NO: 409371 - RNA, 64 nt, hsa; identical to SEQ ID NO: 244545

SEQ ID NO: 409372 - RNA, 64 nt, hsa; identical to SEQ ID NO: 244546

SEQ ID NO: 409373 - RNA, 64 nt, hsa; identical to SEQ ID NO: 244547

SEQ ID NO: 409374 - RNA, 64 nt, hsa; identical to SEQ ID NO: 244548

SEQ ID NO: 409375 - RNA, 64 nt, hsa; identical to SEQ ID NO: 244549

SEQ ID NO: 409376 - RNA, 64 nt, hsa; identical to SEQ ID NO: 244550

SEQ ID NO: 409377 - RNA, 64 nt, hsa; identical to SEQ ID NO: 244551

SEQ ID NO: 409378 - RNA, 64 nt, hsa; identical to SEQ ID NO: 244552

SEQ ID NO: 409379 - RNA, 64 nt, hsa; identical to SEQ ID NO: 244553

SEQ ID NO: 409380 - RNA, 64 nt, hsa; identical to SEQ ID NO: 244554

SEQ ID NO: 409381 - RNA, 64 nt, hsa; identical to SEQ ID NO: 244555

SEQ ID NO: 409382 - RNA, 64 nt, hsa; identical to SEQ ID NO: 244556

SEQ ID NO: 409383 - RNA, 64 nt, hsa; identical to SEQ ID NO: 244557

SEQ ID NO: 409384 - RNA, 64 nt, hsa; identical to SEQ ID NO: 244558

SEQ ID NO: 409385 - RNA, 64 nt, hsa; identical to SEQ ID NO: 244559

SEQ ID NO: 409386 - RNA, 64 nt, hsa; identical to SEQ ID NO: 244560

SEQ ID NO: 409387 - RNA, 64 nt, hsa; identical to SEQ ID NO: 244561

SEQ ID NO: 409388 - RNA, 64 nt, hsa; identical to SEQ ID NO: 244562

SEQ ID NO: 409389 - RNA, 64 nt, hsa; identical to SEQ ID NO: 244563

SEQ ID NO: 409390 - RNA, 64 nt, hsa; identical to SEQ ID NO: 244564

SEQ ID NO: 409391 - RNA, 64 nt, hsa; identical to SEQ ID NO: 244565

SEQ ID NO: 409392 - RNA, 64 nt, hsa; identical to SEQ ID NO: 244566

SEQ ID NO: 409393 - RNA, 64 nt, hsa; identical to SEQ ID NO: 244567

SEQ ID NO: 409394 - RNA, 64 nt, hsa; identical to SEQ ID NO: 244568

SEQ ID NO: 409395 - RNA, 64 nt, hsa; identical to SEQ ID NO: 244569

SEQ ID NO: 409396 - RNA, 64 nt, hsa; identical to SEQ ID NO: 244570

SEQ ID NO: 409397 - RNA, 64 nt, hsa; identical to SEQ ID NO: 309743

SEQ ID NO: 409398 - RNA, 64 nt, hsa; identical to SEQ ID NO: 309744

SEQ ID NO: 409399 - RNA, 64 nt, hsa; identical to SEQ ID NO: 309745

SEQ ID NO: 409400 - RNA, 64 nt, hsa; identical to SEQ ID NO: 309746

SEQ ID NO: 409401 - RNA, 64 nt, hsa; identical to SEQ ID NO: 309747

SEQ ID NO: 409402 - RNA, 64 nt, hsa; identical to SEQ ID NO: 309748

SEQ ID NO: 409403 - RNA, 64 nt, hsa; identical to SEQ ID NO: 309749

SEQ ID NO: 409404 - RNA, 56 nt, hsa; identical to SEQ ID NO: 83586

SEQ ID NO: 409405 - RNA, 64 nt, hsa; identical to SEQ ID NO: 309751

SEQ ID NO: 409406 - RNA, 64 nt, hsa; identical to SEQ ID NO: 309752

SEQ ID NO: 409407 - RNA, 64 nt, hsa; identical to SEQ ID NO: 309753

SEQ ID NO: 409408 - RNA, 64 nt, hsa; identical to SEQ ID NO: 309754

SEQ ID NO: 409409 - RNA, 64 nt, hsa; identical to SEQ ID NO: 309755

SEQ ID NO: 409410 - RNA, 64 nt, hsa; identical to SEQ ID NO: 309756

SEQ ID NO: 409411 - RNA, 64 nt, hsa; identical to SEQ ID NO: 309757

SEQ ID NO: 409412 - RNA, 64 nt, hsa; identical to SEQ ID NO: 309758

SEQ ID NO: 409413 - RNA, 64 nt, hsa; identical to SEQ ID NO: 309759

SEQ ID NO: 409414 - RNA, 64 nt, hsa; identical to SEQ ID NO: 309760

SEQ ID NO: 409415 - RNA, 64 nt, hsa; identical to SEQ ID NO: 309761

SEQ ID NO: 409416 - RNA, 64 nt, hsa; identical to SEQ ID NO: 309762

SEQ ID NO: 409417 - RNA, 64 nt, hsa; identical to SEQ ID NO: 309763

SEQ ID NO: 409418 - RNA, 64 nt, hsa; identical to SEQ ID NO: 309764

SEQ ID NO: 409419 - RNA, 64 nt, hsa; identical to SEQ ID NO: 309765

SEQ ID NO: 409420 - RNA, 64 nt, hsa; identical to SEQ ID NO: 309766

SEQ ID NO: 409421 - RNA, 64 nt, hsa; identical to SEQ ID NO: 309767

SEQ ID NO: 409422 - RNA, 64 nt, hsa; identical to SEQ ID NO: 309768

SEQ ID NO: 409423 - RNA, 64 nt, hsa; identical to SEQ ID NO: 309769

SEQ ID NO: 409424 - RNA, 64 nt, hsa; identical to SEQ ID NO: 309770

SEQ ID NO: 409425 - RNA, 64 nt, hsa; identical to SEQ ID NO: 309771

SEQ ID NO: 409426 - RNA, 64 nt, hsa; identical to SEQ ID NO: 309772

SEQ ID NO: 409427 - RNA, 64 nt, hsa; identical to SEQ ID NO: 309773

SEQ ID NO: 409428 - RNA, 64 nt, hsa; identical to SEQ ID NO: 309774

SEQ ID NO: 409429 - RNA, 64 nt, hsa; identical to SEQ ID NO: 309775

SEQ ID NO: 409430 - RNA, 64 nt, hsa; identical to SEQ ID NO: 315044

SEQ ID NO: 409431 - RNA, 64 nt, hsa; identical to SEQ ID NO: 315045

SEQ ID NO: 409432 - RNA, 64 nt, hsa; identical to SEQ ID NO: 315046

SEQ ID NO: 409433 - RNA, 64 nt, hsa; identical to SEQ ID NO: 315047

SEQ ID NO: 409434 - RNA, 64 nt, hsa; identical to SEQ ID NO: 315048

SEQ ID NO: 409435 - RNA, 64 nt, hsa; identical to SEQ ID NO: 315049

SEQ ID NO: 409436 - RNA, 64 nt, hsa; identical to SEQ ID NO: 315050

SEQ ID NO: 409437 - RNA, 64 nt, hsa; identical to SEQ ID NO: 315051

SEQ ID NO: 409438 - RNA, 64 nt, hsa; identical to SEQ ID NO: 315052

SEQ ID NO: 409439 - RNA, 64 nt, hsa; identical to SEQ ID NO: 315053

SEQ ID NO: 409440 - RNA, 64 nt, hsa; identical to SEQ ID NO: 315054

SEQ ID NO: 409441 - RNA, 64 nt, hsa; identical to SEQ ID NO: 315055

SEQ ID NO: 409442 - RNA, 64 nt, hsa; identical to SEQ ID NO: 315056

SEQ ID NO: 409443 - RNA, 64 nt, hsa; identical to SEQ ID NO: 315057

SEQ ID NO: 409444 - RNA, 64 nt, hsa; identical to SEQ ID NO: 315058

SEQ ID NO: 409445 - RNA, 64 nt, hsa; identical to SEQ ID NO: 315059

SEQ ID NO: 409446 - RNA, 64 nt, hsa; identical to SEQ ID NO: 315060

SEQ ID NO: 409447 - RNA, 64 nt, hsa; identical to SEQ ID NO: 315061

SEQ ID NO: 409448 - RNA, 64 nt, hsa; identical to SEQ ID NO: 315062

SEQ ID NO: 409449 - RNA, 64 nt, hsa; identical to SEQ ID NO: 315063

SEQ ID NO: 409450 - RNA, 64 nt, hsa; identical to SEQ ID NO: 315064

SEQ ID NO: 409451 - RNA, 64 nt, hsa; identical to SEQ ID NO: 315065

SEQ ID NO: 409452 - RNA, 64 nt, hsa; identical to SEQ ID NO: 315066

SEQ ID NO: 409453 - RNA, 64 nt, hsa; identical to SEQ ID NO: 315067

SEQ ID NO: 409454 - RNA, 57 nt, hsa; identical to SEQ ID NO: 315068

SEQ ID NO: 409455 - RNA, 64 nt, hsa; identical to SEQ ID NO: 315069

SEQ ID NO: 409456 - RNA, 64 nt, hsa; identical to SEQ ID NO: 315070

SEQ ID NO: 409457 - RNA, 64 nt, hsa; identical to SEQ ID NO: 315071

SEQ ID NO: 409458 - RNA, 64 nt, hsa; identical to SEQ ID NO: 315072

SEQ ID NO: 409459 - RNA, 64 nt, hsa; identical to SEQ ID NO: 315073

SEQ ID NO: 409460 - RNA, 64 nt, hsa; identical to SEQ ID NO: 315074

SEQ ID NO: 409461 - RNA, 64 nt, hsa; identical to SEQ ID NO: 315075

SEQ ID NO: 409462 - RNA, 64 nt, hsa
ugggccaugagaggguagguccagaagguggggggaacuguacagaucagcagagcaggacagu

SEQ ID NO: 409463 - RNA, 64 nt, hsa
ucuaccucccuaguuaguggaaauuuggauaagggaacuguagggcccagauucuggagguuuu

SEQ ID NO: 409464 - RNA, 64 nt, hsa
auguacuacugaacuguaccaguugcacaugcuugaacuguaguaauguuagcuuguucuaaag

SEQ ID NO: 409465 - RNA, 64 nt, hsa
gucguacauuuguuugagucguuuauguacuacugaacuguaccaguugcacaugcuugaacug

SEQ ID NO: 409466 - RNA, 64 nt, hsa
agcagaauagcuuugugcuauuccaguauaagaugaacuguaauaauuuuugacuucccuauuu

SEQ ID NO: 409467 - RNA, 64 nt, hsa
ggauaauugacaaauaaacgccauaggcuaggcugaacuguauguuacuguuuucaugcuuaua

SEQ ID NO: 409468 - RNA, 64 nt, hsa
ggucauuuaaauaacaaaauauuguauuguaaaagaacuguacaauuuuaaaacaauaaagauu

SEQ ID NO: 409469 - RNA, 64 nt, hsa
uuuaaaugcccuuugauguuucaaaaaaaaaaaggaacuguaauuugauugacugauuuuaaga

SEQ ID NO: 409470 - RNA, 64 nt, hsa
uagggggcugugucugaucuugguguucaaaacagaacuguauuuuugccuuuaaaauuaaaua

SEQ ID NO: 409471 - RNA, 64 nt, hsa
uucuugauguguucgcagugucaccccagagucagaacuguacacaucccaaaauuugguggcc

SEQ ID NO: 409472 - RNA, 64 nt, hsa
caucauugcaguccaccgaaaaaugaugaggacagaacuguauuuccugucaccucaggagaau

SEQ ID NO: 409473 - RNA, 64 nt, hsa
guguaaauaaaauaguguugauguacugaaauaugaacuguaucaaaaguauugguaauuguau

SEQ ID NO: 409474 - RNA, 64 nt, hsa
cccaggcgccgagacccaaggcgccacugagggcaccgcgcaccagagcgugaccucggcaggc

SEQ ID NO: 409475 - RNA, 64 nt, hsa
gcuguagagccgcgaaccuccccacaccucccucaccgcgcaggacccugagugaggaggagga

SEQ ID NO: 409476 - RNA, 64 nt, hsa
gaggcgagcagagcccgcagcccacgccuucucgaccgcgcacuucgauauucggagccgggca

SEQ ID NO: 409477 - RNA, 64 nt, hsa
ugccgggaaggggcauuauuugugcacugagaacaccgcgcagcgugacugugaguugcucaua

SEQ ID NO: 409478 - RNA, 64 nt, hsa
ccugacuggggcugcuccucccuccuguccugggaccgcgcagagcccacgcucucacugcugc

SEQ ID NO: 409479 - RNA, 64 nt, hsa
gcagccucccgccagccacacuguguugcagcucaccgcgcaugugcaugccgugcgggcagac

SEQ ID NO: 409480 - RNA, 64 nt, hsa
gggggagugugaguuuugccuuucuaagggagggaccgcgcaggcuccuuuguucuguauucug

SEQ ID NO: 409481 - RNA, 64 nt, hsa
cgccagagggcagcauccccuaacuaauaccguaaccgcgcagucccguuugacgguggugccg

SEQ ID NO: 409482 - RNA, 64 nt, hsa
gcaauuccaagcauaaccaccagauggcagagugaccgcgcauaccugcuuccaagaauaaaac

SEQ ID NO: 409483 - RNA, 64 nt, hsa
cugccuuccgcugggguuuccgagccgcccccgaaccgcgcacccgacuugcaggcguccgccu

SEQ ID NO: 409484 - RNA, 64 nt, hsa
agagcgccuucugguccuagccacgcccuguaugaccgcgcaaauauccccaaagcuuuugggu

SEQ ID NO: 409485 - RNA, 64 nt, hsa
ugaagauacugacaccaccuuugcccuccccgucaccgcgcacccacccugaccccucccucag

SEQ ID NO: 409486 - RNA, 64 nt, hsa
guaaauuauuguaucuccauccagaugguggaguaccgcgcagacauuaaaagucauguaaaag

SEQ ID NO: 409487 - RNA, 52 nt, hsa
ggcaccacgaugagcugugagcaccgcgcaccugccacagccucagaggccc

SEQ ID NO: 409488 - RNA, 64 nt, hsa
cuccgccccggcccaccaccucgcuacugcuggaaccgcgcagccugcuggugcuccgcggccc

SEQ ID NO: 409489 - RNA, 64 nt, hsa
uacauaguaacucuuauggagaccuaggggagacaccgcgcaucucuuccugauuccccacuca

SEQ ID NO: 409490 - RNA, 64 nt, hsa
acuugccugagaugguggacgcaguaaugagggcaccgcgcagcucaguuagagacggagaaag

SEQ ID NO: 409491 - RNA, 62 nt, hsa
gcacagcauccucaguucugugcccagccaagggugagcaucucugcugagacaguccuuuu

SEQ ID NO: 409492 - RNA, 62 nt, hsa
aagaugucuugagcucugcaaagaucagagcaggugagcauccacuuugacaugaaggacaa

SEQ ID NO: 409493 - RNA, 64 nt, hsa
auuacaaacagcagugugcccagacuuguggaaaugaagucaugucacuccucugcucagaaac

SEQ ID NO: 409494 - RNA, 64 nt, hsa
agaaaccuucaaugguucaccauuaccaguggaaugaagucaauucuccucacuauaacugggu

SEQ ID NO: 409495 - RNA, 64 nt, hsa
ccaggcaccaugcuagguauuggggaagagagacugaagucacaaccccugacugcuccucaaa

SEQ ID NO: 409496 - RNA, 64 nt, hsa
ucagaaacugacuuggggaaggaauuuaauacuuugaagucaugagaugcaccaucgaggcuac

SEQ ID NO: 409497 - RNA, 64 nt, hsa
uuuggccagggcuacuuacaggggcuguugggguugaagucaagucaccgcauuuuggcuccuu

SEQ ID NO: 409498 - RNA, 64 nt, hsa
gcauccucaggcuuugaggagaauacacaggauuugaagucagaagaccuagguuugaguucug

SEQ ID NO: 409499 - RNA, 64 nt, hsa
uucugaaagauaaagaaagugcuuuguauuuuguugaagucaguauuuuguauaaacauuuaug

SEQ ID NO: 409500 - RNA, 64 nt, hsa
auauggaccugcuagaauuuggaucacuuucaauugaagucaggguauugugcauaauagaaag

SEQ ID NO: 409501 - RNA, 64 nt, hsa
ucucugguagaaaaaucaaauaccuuagagauuaugaagucauuaauuuauacugaaauuggau

SEQ ID NO: 409502 - RNA, 64 nt, hsa
ugcauuaagccugagccauauucucacaugcaagugaagucauuaaagaacuuuacauauguga

SEQ ID NO: 409503 - RNA, 64 nt, hsa
cucccugccucuauucucucuccuuugcuuuccuugaagucagcuuuggaccacaauaauuuca

SEQ ID NO: 409504 - RNA, 64 nt, hsa
agcaauagagagcuucaugacugaguaagaguuuugaagucagcagugaaucaagugcccacag

SEQ ID NO: 409505 - RNA, 64 nt, hsa
gaauacccuugaaagggucuccccuuccccauggugaagucaggccuaauggagagaguggcua

SEQ ID NO: 409506 - RNA, 64 nt, hsa
ugaguuaacacaguuggagguaauaugcauauucugaagucauagauaauuuacacagaucucu

SEQ ID NO: 409507 - RNA, 64 nt, hsa
gggccacucaccggaggagggcggggccugcacuugaagucaggccgcaccugucuguuuuugg

SEQ ID NO: 409508 - RNA, 64 nt, hsa
uacuugaaaaggucaaucuucagggcuuccuguuugaagucaagucagagguaaaccggucagu

SEQ ID NO: 409509 - RNA, 64 nt, hsa
aauguugggaaaacagaugagcaacccacuacccugaagucauccaccguguaguggggaagac

SEQ ID NO: 409510 - RNA, 64 nt, hsa
gacuucuagauccuuugcauuuucguauaaaauuugaagucaacuucuaucaacuucaggccag

SEQ ID NO: 409511 - RNA, 64 nt, hsa
uguuaauauaaugauaaugagaacaccuuugcccugaagucaguucucacaguauagaagagaa

SEQ ID NO: 409512 - RNA, 64 nt, hsa
uauggguguaaugaauguggaaaaucauucugugugaagucaagaggccagagaaaaugcacaa

SEQ ID NO: 409513 - RNA, 64 nt, hsa
gguggguauggaaacacaugagagaaugugauagugaagucauauuuacaaaacugagaacaug

SEQ ID NO: 409514 - RNA, 64 nt, hsa
ucuuccuauuccuuugaugaccaaagagauaaagugaagucauccuuauuauuaaaaugcagcc

SEQ ID NO: 409515 - RNA, 64 nt, hsa
uucuucacauguuuaacuuuaaggauuugaaccaugaagucauagguuacagaccucaguuuua

SEQ ID NO: 409516 - RNA, 64 nt, hsa
agaggaggggaaaguccagggcuauagggugugaugaagucaccccuuucugucccacuacauc

SEQ ID NO: 409517 - RNA, 64 nt, hsa
gcucccagccacacccagaguggcccaaagcuguugaagucagcauccuuugucccaucaggac

SEQ ID NO: 409518 - RNA, 64 nt, hsa
ggagggugugagcacggaguauuucugucccucgugaagucacgucacacaggggagaggcgag

SEQ ID NO: 409519 - RNA, 64 nt, hsa
guagagacuuucaguauuuguuuucucuugauuuugaagucauuucuucuucucacgucuguga

SEQ ID NO: 409520 - RNA, 64 nt, hsa
uauugguuagggaaacaaacuucaggucaccaacugaagucauuacaaacuccuuguacauuca

SEQ ID NO: 409521 - RNA, 64 nt, hsa
auuaugggcgggugugagccauugcgcccagccuugaagucauguucuaaauuguauuugaauu

SEQ ID NO: 409522 - RNA, 64 nt, hsa
cccaggugcacugcucacacccccaccugcauuuugaagucauauuauuuuuuguuuuguuuuu

SEQ ID NO: 409523 - RNA, 64 nt, hsa
uuucuacauaguaaggugacugccaaauaauauuugaagucaucugucucuuuguaaauuauuu

SEQ ID NO: 409524 - RNA, 53 nt, hsa
aggaucgcuacgguucuuaauacugaagucaugauguguauuuccuggagaaa

SEQ ID NO: 409525 - RNA, 64 nt, hsa; identical to SEQ ID NO: 394451

SEQ ID NO: 409526 - RNA, 64 nt, hsa; identical to SEQ ID NO: 394452

SEQ ID NO: 409527 - RNA, 64 nt, hsa; identical to SEQ ID NO: 394453

SEQ ID NO: 409528 - RNA, 64 nt, hsa; identical to SEQ ID NO: 394454

SEQ ID NO: 409529 - RNA, 64 nt, hsa; identical to SEQ ID NO: 394455

SEQ ID NO: 409530 - RNA, 64 nt, hsa; identical to SEQ ID NO: 394456

SEQ ID NO: 409531 - RNA, 64 nt, hsa; identical to SEQ ID NO: 394457

SEQ ID NO: 409532 - RNA, 64 nt, hsa; identical to SEQ ID NO: 394458

SEQ ID NO: 409533 - RNA, 64 nt, hsa; identical to SEQ ID NO: 394459

SEQ ID NO: 409534 - RNA, 64 nt, hsa; identical to SEQ ID NO: 394460

SEQ ID NO: 409535 - RNA, 64 nt, hsa; identical to SEQ ID NO: 394461

SEQ ID NO: 409536 - RNA, 64 nt, hsa; identical to SEQ ID NO: 394462

SEQ ID NO: 409537 - RNA, 64 nt, hsa; identical to SEQ ID NO: 394463

SEQ ID NO: 409538 - RNA, 64 nt, hsa; identical to SEQ ID NO: 394464

SEQ ID NO: 409539 - RNA, 64 nt, hsa; identical to SEQ ID NO: 394465

SEQ ID NO: 409540 - RNA, 64 nt, hsa; identical to SEQ ID NO: 394466

SEQ ID NO: 409541 - RNA, 64 nt, hsa; identical to SEQ ID NO: 394467

SEQ ID NO: 409542 - RNA, 64 nt, hsa; identical to SEQ ID NO: 394468

SEQ ID NO: 409543 - RNA, 64 nt, hsa; identical to SEQ ID NO: 394469

SEQ ID NO: 409544 - RNA, 64 nt, hsa; identical to SEQ ID NO: 394470

SEQ ID NO: 409545 - RNA, 64 nt, hsa; identical to SEQ ID NO: 394471

SEQ ID NO: 409546 - RNA, 64 nt, hsa; identical to SEQ ID NO: 394472

SEQ ID NO: 409547 - RNA, 64 nt, hsa; identical to SEQ ID NO: 394473

SEQ ID NO: 409548 - RNA, 64 nt, hsa; identical to SEQ ID NO: 394474

SEQ ID NO: 409549 - RNA, 64 nt, hsa; identical to SEQ ID NO: 394475

SEQ ID NO: 409550 - RNA, 64 nt, hsa; identical to SEQ ID NO: 394476

SEQ ID NO: 409551 - RNA, 64 nt, hsa; identical to SEQ ID NO: 394477

SEQ ID NO: 409552 - RNA, 64 nt, hsa; identical to SEQ ID NO: 394478

SEQ ID NO: 409553 - RNA, 64 nt, hsa; identical to SEQ ID NO: 394479

SEQ ID NO: 409554 - RNA, 64 nt, hsa; identical to SEQ ID NO: 394480

SEQ ID NO: 409555 - RNA, 64 nt, hsa; identical to SEQ ID NO: 394481

SEQ ID NO: 409556 - RNA, 64 nt, hsa; identical to SEQ ID NO: 394482

SEQ ID NO: 409557 - RNA, 64 nt, hsa; identical to SEQ ID NO: 394483

SEQ ID NO: 409558 - RNA, 64 nt, hsa; identical to SEQ ID NO: 394484

SEQ ID NO: 409559 - RNA, 64 nt, hsa; identical to SEQ ID NO: 394485

SEQ ID NO: 409560 - RNA, 64 nt, hsa; identical to SEQ ID NO: 394486

SEQ ID NO: 409561 - RNA, 64 nt, hsa; identical to SEQ ID NO: 394487

SEQ ID NO: 409562 - RNA, 64 nt, hsa; identical to SEQ ID NO: 394488

SEQ ID NO: 409563 - RNA, 64 nt, hsa; identical to SEQ ID NO: 394489

SEQ ID NO: 409564 - RNA, 64 nt, hsa; identical to SEQ ID NO: 394490

SEQ ID NO: 409565 - RNA, 64 nt, hsa
ugggggcccauggcuuguggcaguucagcuucacccucaggaguggcccgaacccugcuggacc

SEQ ID NO: 409566 - RNA, 64 nt, hsa
ugauagcacuuucaggcaggagcuaugguuccuuccucaggaggccuccaaucugauggggaag

SEQ ID NO: 409567 - RNA, 64 nt, hsa
ucgaggcagggaaaagccaucuauucuucugcagccucaggagcgagacuucaaggacucaguu

SEQ ID NO: 409568 - RNA, 64 nt, hsa
cagggugaacauagcacacgcccuccuggcugggccucaggaggaacagccaaggagaagaaug

SEQ ID NO: 409569 - RNA, 64 nt, hsa
ggaccucaggucuaccucaggacugaacgccacaccucaggauuccuccuccuugaaucugaga

SEQ ID NO: 409570 - RNA, 64 nt, hsa
gcaucaacacaauuuccaggggaccucaggucuaccucaggacugaacgccacaccucaggauu

SEQ ID NO: 409571 - RNA, 64 nt, hsa
cugcccacuaccuaugcuucuagaaagccccucaccucaggaccccagagggaccagcuggggg

SEQ ID NO: 409572 - RNA, 64 nt, hsa
cccagcuggugucacucugccucuaaggccaaggccucaggagagcaucaccaccacaccccug

SEQ ID NO: 409573 - RNA, 64 nt, hsa
agagagaaucagaccuggguggaacucuccugcuccucaggaacuaugggagccucagacucau

SEQ ID NO: 409574 - RNA, 64 nt, hsa
agaccucccugugagagaguugcuccucagggucccucaggaccaaagaacacucgaaaagagc

SEQ ID NO: 409575 - RNA, 64 nt, hsa
uccuguugguguucugaugccuguucagcuuuguccucaggaagguuuggucaucuugguucug

SEQ ID NO: 409576 - RNA, 64 nt, hsa
uugcaggcagaggagauugggucuugacugguguccucaggaaggaagccccugggauggagug

SEQ ID NO: 409577 - RNA, 64 nt, hsa
aaguccaccccuuucccucaggaccugagucuacccucaggaccugggguugguuggacucugc

SEQ ID NO: 409578 - RNA, 64 nt, hsa
acagcaagaaagcccacugaaguccaccccuuucccucaggaccugagucuacccucaggaccu

SEQ ID NO: 409579 - RNA, 64 nt, hsa
aagauugcugcugcccuuagggucucagcucccuccucaggaaucccucuuaggaaggacccuc

SEQ ID NO: 409580 - RNA, 64 nt, hsa
agcucccuccucaggaaucccucuuaggaaggacccucaggacacccucucugcacccuguggu

SEQ ID NO: 409581 - RNA, 64 nt, hsa
ccaaucuuaccuguucuccagggacuggucacugccucaggacccccaagccuaugcccugagc

SEQ ID NO: 409582 - RNA, 64 nt, hsa
ugucaaagugugggcaggaguggagagcuggugcccucaggaggagaccacagcauguccauca

SEQ ID NO: 409583 - RNA, 64 nt, hsa
cccugucuccaguuccucuccccucaggaggccaccucaggaaggauuuugacaggugaccaua

SEQ ID NO: 409584 - RNA, 64 nt, hsa
gccucuucccugucccugucuccaguuccucuccccucaggaggccaccucaggaaggauuuug

SEQ ID NO: 409585 - RNA, 64 nt, hsa
ucugcacaugaggcugguuuaccaacaucuacucccucaggaugagcgugagccagaagcagcu

SEQ ID NO: 409586 - RNA, 64 nt, hsa
ggugagaaguuggcccuggucccgucugccugcuccucaggaccacucaguccaccuguuccuc

SEQ ID NO: 409587 - RNA, 64 nt, hsa
guuuaauggacucaguuccgcauugcuggugaggccucaggacacuuacacaaucauggcagaa

SEQ ID NO: 409588 - RNA, 64 nt, hsa
uagccaggugugguggcaagugccuuuaaucccaccucaggaggcugaggcaggagaaucgcuu

SEQ ID NO: 409589 - RNA, 64 nt, hsa
gaacuuggccuaaaaauacuccccuauuucuaacccucaggacggaucugauauuaaaugccuu

SEQ ID NO: 409590 - RNA, 64 nt, hsa
cccagccagggcucccuguccagaauucgguucuccucaggacgccaacucccagagcuaagga

SEQ ID NO: 409591 - RNA, 64 nt, hsa
cagggugccauucauugucuuucucuccuagcccccucaggaaagaaggacuauauuuguacug

SEQ ID NO: 409592 - RNA, 64 nt, hsa
ccuguguggggcaccccacacgacaccccucuucccucaggaggcccgugggcagacaggggag

SEQ ID NO: 409593 - RNA, 64 nt, hsa
uggaaggagagccacacuguggcgggucggcggcccucaggagagaccaggaggacugacagcg

SEQ ID NO: 409594 - RNA, 64 nt, hsa
ucaaacacccaaggucggauucuggggccccugcccucaggaggcugucagacuguucccccua

SEQ ID NO: 409595 - RNA, 64 nt, hsa
gugcucagcugcauuuccugcugggguccugguuccucaggagagagagaccacagggugagag

SEQ ID NO: 409596 - RNA, 64 nt, hsa
gcuucucucuggccuuucccgaggccugugagugccucaggaagcagcugggcccucugggaag

SEQ ID NO: 409597 - RNA, 64 nt, hsa
uauuuugccaagguuaaggaugcaccugugacagccucaggagguccugacaacaggugccuga

SEQ ID NO: 409598 - RNA, 64 nt, hsa
ucaggacccuccuccucgcccacggcgccucagaccucaggacccugccgucucacgccuuugu

SEQ ID NO: 409599 - RNA, 64 nt, hsa
cauacagaugaggacagaacuguauuuccugucaccucaggagaaucgccccagccucuuugga

SEQ ID NO: 409600 - RNA, 64 nt, hsa
gauucaaguauccugguuagcaagaccacucccaccucaggaagcuaguauucaugcccaggau

SEQ ID NO: 409601 - RNA, 64 nt, hsa
uaugcgggggggcagccaaccagagcuggucacuccucaggaccaugagguagcuuuggccaau

SEQ ID NO: 409602 - RNA, 64 nt, hsa
acuggggcucagagccggggugggguggcugcagccucaggacugggagcccccagccugucag

SEQ ID NO: 409603 - RNA, 64 nt, hsa
ugugccaaaaacuguggacaugcuggcucagcauccucaggaccaaguuguugcuuaauuuauu

SEQ ID NO: 409604 - RNA, 64 nt, hsa
auggcauuuuccagggcaggagaaaguaugagagccucaggaaaccccaucaaggaccgaguau

SEQ ID NO: 409605 - RNA, 64 nt, hsa
agagccacaagaccacacacacagcccuuacccuccucaggacuaccgaaccuucuggcacacc

SEQ ID NO: 409606 - RNA, 64 nt, hsa
gcgagcagcaccaccuccaagccgucaucaucauccucaggacccaggacccucccauggccgg

SEQ ID NO: 409607 - RNA, 64 nt, hsa
auuaggugggaaagacgggcuccuauuuacaguuccucaggauccucuuccgcaugcucaucag

SEQ ID NO: 409608 - RNA, 64 nt, hsa
cggccauuugcugcccuccccaccccugccccagccucaggacugcaggagccauccgcccccc

SEQ ID NO: 409609 - RNA, 64 nt, hsa
gggccaccccacggcaucuccccagaaguacaggccucaggaggagguggaacugauguagggg

SEQ ID NO: 409610 - RNA, 64 nt, hsa
gagaggaccuccuuucucccacagaaucccagauccucaggaaaagccaaaaccgaggcccauu

SEQ ID NO: 409611 - RNA, 64 nt, hsa
cugugaaauaggcagggccagaucacccaaaacuccucaggacugggaucuggcguuuauaaau

SEQ ID NO: 409612 - RNA, 64 nt, hsa
ggaagggauggccaaggccgcuaggguccuuaccccucaggaucacuccccagcccuuuccuca

SEQ ID NO: 409613 - RNA, 64 nt, hsa
guccuuaccccucaggaucacuccccagcccuuuccucaggagguaccgcucuccaaggugugc

SEQ ID NO: 409614 - RNA, 64 nt, hsa
ucagucccucucccagcauugcugugcauggcucccucaggaagaagcucuggaguggggccga

SEQ ID NO: 409615 - RNA, 64 nt, hsa
agugggagcugccacagugccccuugcuggccgcccucaggagggggccucuggaccgucagug

SEQ ID NO: 409616 - RNA, 64 nt, hsa
ggcaccugcagcacggagcuccggcuucccaaacccucaggauggcgccuucagccucuccggc

SEQ ID NO: 409617 - RNA, 64 nt, hsa
ugccagaaagaccuuuugcaggauguggaggcguccucaggagaguuauuucgauuuauucuga

SEQ ID NO: 409618 - RNA, 64 nt, hsa
gcuguggcucuaugagggcgcccgucugcucaagccucaggaucuggagaugcaguuccagagg

SEQ ID NO: 409619 - RNA, 64 nt, hsa
uggagauguacagccugaaggaugagaugggcaaccucaggaaguuacuagagucuaccccauc

SEQ ID NO: 409620 - RNA, 64 nt, hsa
cuuucaaacaguaacaucuggagccuggagauauccucaggaagcacaucuguagugcacuccc

SEQ ID NO: 409621 - RNA, 64 nt, hsa
ccaugagcauguacaaccucuggagcuagaagcuccucaggaaagccaguucuccaaguucuua

SEQ ID NO: 409622 - RNA, 64 nt, hsa
gucuaccuuccuggcaagaggcagaccccggggcccucaggaaggagggaguuggcagcggggg

SEQ ID NO: 409623 - RNA, 64 nt, hsa
aggaguaggagcagaugaggcgucuugccaggaaccucaggaggagggggcccgggaccugugu

SEQ ID NO: 409624 - RNA, 64 nt, hsa; identical to SEQ ID NO: 79919

SEQ ID NO: 409625 - RNA, 64 nt, hsa; identical to SEQ ID NO: 79920

SEQ ID NO: 409626 - RNA, 64 nt, hsa; identical to SEQ ID NO: 79921

SEQ ID NO: 409627 - RNA, 64 nt, hsa; identical to SEQ ID NO: 79922

SEQ ID NO: 409628 - RNA, 64 nt, hsa; identical to SEQ ID NO: 79923

SEQ ID NO: 409629 - RNA, 64 nt, hsa; identical to SEQ ID NO: 79924

SEQ ID NO: 409630 - RNA, 64 nt, hsa; identical to SEQ ID NO: 79925

SEQ ID NO: 409631 - RNA, 64 nt, hsa; identical to SEQ ID NO: 79926

SEQ ID NO: 409632 - RNA, 64 nt, hsa; identical to SEQ ID NO: 79927

SEQ ID NO: 409633 - RNA, 64 nt, hsa; identical to SEQ ID NO: 79928

SEQ ID NO: 409634 - RNA, 64 nt, hsa; identical to SEQ ID NO: 79929

SEQ ID NO: 409635 - RNA, 64 nt, hsa; identical to SEQ ID NO: 79930

SEQ ID NO: 409636 - RNA, 64 nt, hsa; identical to SEQ ID NO: 79931

SEQ ID NO: 409637 - RNA, 64 nt, hsa; identical to SEQ ID NO: 79932

SEQ ID NO: 409638 - RNA, 64 nt, hsa; identical to SEQ ID NO: 79933

SEQ ID NO: 409639 - RNA, 64 nt, hsa; identical to SEQ ID NO: 79934

SEQ ID NO: 409640 - RNA, 64 nt, hsa; identical to SEQ ID NO: 79935

SEQ ID NO: 409641 - RNA, 64 nt, hsa; identical to SEQ ID NO: 79936

SEQ ID NO: 409642 - RNA, 64 nt, hsa; identical to SEQ ID NO: 79937

SEQ ID NO: 409643 - RNA, 64 nt, hsa; identical to SEQ ID NO: 79938

SEQ ID NO: 409644 - RNA, 64 nt, hsa; identical to SEQ ID NO: 79939

SEQ ID NO: 409645 - RNA, 64 nt, hsa
guguggacuuuagucccaaaaggaaacuuuaguucacuugcaguaugcuuauccuugacugcac

SEQ ID NO: 409646 - RNA, 64 nt, hsa
aaaauuuaaggagguauucacacucagggucaugcacuugcacaauguugagaaugaguaccac

SEQ ID NO: 409647 - RNA, 64 nt, hsa
ugggccuacucucagcugccuaucuucugccuuucacuugcauccaacuccuggggcugggacc

SEQ ID NO: 409648 - RNA, 64 nt, hsa
gaggcuaauggacauaaucuacaguguccuuuuucacuugcaccuuuuuuauaagaauauauug

SEQ ID NO: 409649 - RNA, 64 nt, hsa
cugggauuacaggcgugagccaccacgcccggcccacuugcacauuuucaaaguaguccgcaaa

SEQ ID NO: 409650 - RNA, 64 nt, hsa
agaauaucuuguguuugcuuuuugucacuuauuucacuugcacauuuuuuguuuguuuguuugu

SEQ ID NO: 409651 - RNA, 64 nt, hsa; identical to SEQ ID NO: 131995

SEQ ID NO: 409652 - RNA, 64 nt, hsa; identical to SEQ ID NO: 131996

SEQ ID NO: 409653 - RNA, 64 nt, hsa; identical to SEQ ID NO: 131997

SEQ ID NO: 409654 - RNA, 64 nt, hsa; identical to SEQ ID NO: 131998

SEQ ID NO: 409655 - RNA, 64 nt, hsa; identical to SEQ ID NO: 131999

SEQ ID NO: 409656 - RNA, 64 nt, hsa; identical to SEQ ID NO: 132000

SEQ ID NO: 409657 - RNA, 64 nt, hsa; identical to SEQ ID NO: 132001

SEQ ID NO: 409658 - RNA, 64 nt, hsa; identical to SEQ ID NO: 132002

SEQ ID NO: 409659 - RNA, 64 nt, hsa; identical to SEQ ID NO: 132003

SEQ ID NO: 409660 - RNA, 64 nt, hsa; identical to SEQ ID NO: 132004

SEQ ID NO: 409661 - RNA, 64 nt, hsa; identical to SEQ ID NO: 132005

SEQ ID NO: 409662 - RNA, 64 nt, hsa; identical to SEQ ID NO: 132006

SEQ ID NO: 409663 - RNA, 64 nt, hsa; identical to SEQ ID NO: 132007

SEQ ID NO: 409664 - RNA, 64 nt, hsa; identical to SEQ ID NO: 132008

SEQ ID NO: 409665 - RNA, 64 nt, hsa; identical to SEQ ID NO: 132009

SEQ ID NO: 409666 - RNA, 64 nt, hsa; identical to SEQ ID NO: 132010

SEQ ID NO: 409667 - RNA, 64 nt, hsa; identical to SEQ ID NO: 132011

SEQ ID NO: 409668 - RNA, 64 nt, hsa; identical to SEQ ID NO: 132012

SEQ ID NO: 409669 - RNA, 64 nt, hsa; identical to SEQ ID NO: 132013

SEQ ID NO: 409670 - RNA, 64 nt, hsa; identical to SEQ ID NO: 132014

SEQ ID NO: 409671 - RNA, 64 nt, hsa; identical to SEQ ID NO: 132015

SEQ ID NO: 409672 - RNA, 64 nt, hsa; identical to SEQ ID NO: 132016

SEQ ID NO: 409673 - RNA, 64 nt, hsa; identical to SEQ ID NO: 132017

SEQ ID NO: 409674 - RNA, 64 nt, hsa; identical to SEQ ID NO: 132018

SEQ ID NO: 409675 - RNA, 64 nt, hsa; identical to SEQ ID NO: 132019

SEQ ID NO: 409676 - RNA, 64 nt, hsa; identical to SEQ ID NO: 132020

SEQ ID NO: 409677 - RNA, 64 nt, hsa; identical to SEQ ID NO: 132021

SEQ ID NO: 409678 - RNA, 64 nt, hsa; identical to SEQ ID NO: 132022

SEQ ID NO: 409679 - RNA, 64 nt, hsa; identical to SEQ ID NO: 132023

SEQ ID NO: 409680 - RNA, 64 nt, hsa; identical to SEQ ID NO: 132024

SEQ ID NO: 409681 - RNA, 64 nt, hsa; identical to SEQ ID NO: 132025

SEQ ID NO: 409682 - RNA, 64 nt, hsa; identical to SEQ ID NO: 132026

SEQ ID NO: 409683 - RNA, 64 nt, hsa; identical to SEQ ID NO: 132027

SEQ ID NO: 409684 - RNA, 64 nt, hsa; identical to SEQ ID NO: 132028

SEQ ID NO: 409685 - RNA, 64 nt, hsa; identical to SEQ ID NO: 132029

SEQ ID NO: 409686 - RNA, 64 nt, hsa; identical to SEQ ID NO: 132030

SEQ ID NO: 409687 - RNA, 64 nt, hsa; identical to SEQ ID NO: 132031

SEQ ID NO: 409688 - RNA, 64 nt, hsa; identical to SEQ ID NO: 132032

SEQ ID NO: 409689 - RNA, 64 nt, hsa; identical to SEQ ID NO: 132033

SEQ ID NO: 409690 - RNA, 64 nt, hsa; identical to SEQ ID NO: 132034

SEQ ID NO: 409691 - RNA, 64 nt, hsa; identical to SEQ ID NO: 132035

SEQ ID NO: 409692 - RNA, 64 nt, hsa; identical to SEQ ID NO: 132036

SEQ ID NO: 409693 - RNA, 64 nt, hsa; identical to SEQ ID NO: 132037

SEQ ID NO: 409694 - RNA, 64 nt, hsa; identical to SEQ ID NO: 132038

SEQ ID NO: 409695 - RNA, 64 nt, hsa; identical to SEQ ID NO: 132039

SEQ ID NO: 409696 - RNA, 64 nt, hsa; identical to SEQ ID NO: 132040

SEQ ID NO: 409697 - RNA, 64 nt, hsa; identical to SEQ ID NO: 132041

SEQ ID NO: 409698 - RNA, 55 nt, hsa; identical to SEQ ID NO: 116681

SEQ ID NO: 409699 - RNA, 64 nt, hsa; identical to SEQ ID NO: 132043

SEQ ID NO: 409700 - RNA, 64 nt, hsa; identical to SEQ ID NO: 132044

SEQ ID NO: 409701 - RNA, 64 nt, hsa; identical to SEQ ID NO: 132045

SEQ ID NO: 409702 - RNA, 64 nt, hsa; identical to SEQ ID NO: 132046

SEQ ID NO: 409703 - RNA, 64 nt, hsa; identical to SEQ ID NO: 132047

SEQ ID NO: 409704 - RNA, 64 nt, hsa; identical to SEQ ID NO: 132048

SEQ ID NO: 409705 - RNA, 64 nt, hsa; identical to SEQ ID NO: 132049

SEQ ID NO: 409706 - RNA, 64 nt, hsa; identical to SEQ ID NO: 132050

SEQ ID NO: 409707 - RNA, 64 nt, hsa; identical to SEQ ID NO: 132051

SEQ ID NO: 409708 - RNA, 64 nt, hsa; identical to SEQ ID NO: 132052

SEQ ID NO: 409709 - RNA, 64 nt, hsa; identical to SEQ ID NO: 132053

SEQ ID NO: 409710 - RNA, 64 nt, hsa; identical to SEQ ID NO: 132054

SEQ ID NO: 409711 - RNA, 64 nt, hsa; identical to SEQ ID NO: 132055

SEQ ID NO: 409712 - RNA, 64 nt, hsa; identical to SEQ ID NO: 132056

SEQ ID NO: 409713 - RNA, 64 nt, hsa; identical to SEQ ID NO: 132057

SEQ ID NO: 409714 - RNA, 64 nt, hsa; identical to SEQ ID NO: 132058

SEQ ID NO: 409715 - RNA, 64 nt, hsa; identical to SEQ ID NO: 132059

SEQ ID NO: 409716 - RNA, 64 nt, hsa; identical to SEQ ID NO: 132060

SEQ ID NO: 409717 - RNA, 64 nt, hsa; identical to SEQ ID NO: 132061

SEQ ID NO: 409718 - RNA, 64 nt, hsa; identical to SEQ ID NO: 132062

SEQ ID NO: 409719 - RNA, 64 nt, hsa; identical to SEQ ID NO: 132063

SEQ ID NO: 409720 - RNA, 64 nt, hsa; identical to SEQ ID NO: 132064

SEQ ID NO: 409721 - RNA, 64 nt, hsa; identical to SEQ ID NO: 132065

SEQ ID NO: 409722 - RNA, 64 nt, hsa; identical to SEQ ID NO: 132066

SEQ ID NO: 409723 - RNA, 64 nt, hsa; identical to SEQ ID NO: 132067

SEQ ID NO: 409724 - RNA, 64 nt, hsa; identical to SEQ ID NO: 132068

SEQ ID NO: 409725 - RNA, 64 nt, hsa; identical to SEQ ID NO: 132069

SEQ ID NO: 409726 - RNA, 64 nt, hsa; identical to SEQ ID NO: 132070

SEQ ID NO: 409727 - RNA, 64 nt, hsa; identical to SEQ ID NO: 132071

SEQ ID NO: 409728 - RNA, 64 nt, hsa; identical to SEQ ID NO: 132072

SEQ ID NO: 409729 - RNA, 64 nt, hsa; identical to SEQ ID NO: 132073

SEQ ID NO: 409730 - RNA, 64 nt, hsa; identical to SEQ ID NO: 132074

SEQ ID NO: 409731 - RNA, 64 nt, hsa; identical to SEQ ID NO: 132075

SEQ ID NO: 409732 - RNA, 64 nt, hsa; identical to SEQ ID NO: 132076

SEQ ID NO: 409733 - RNA, 64 nt, hsa; identical to SEQ ID NO: 132077

SEQ ID NO: 409734 - RNA, 64 nt, hsa; identical to SEQ ID NO: 132078

SEQ ID NO: 409735 - RNA, 64 nt, hsa; identical to SEQ ID NO: 132079

SEQ ID NO: 409736 - RNA, 64 nt, hsa; identical to SEQ ID NO: 132080

SEQ ID NO: 409737 - RNA, 60 nt, hsa; identical to SEQ ID NO: 116720

SEQ ID NO: 409738 - RNA, 64 nt, hsa; identical to SEQ ID NO: 132082

SEQ ID NO: 409739 - RNA, 64 nt, hsa; identical to SEQ ID NO: 132083

SEQ ID NO: 409740 - RNA, 64 nt, hsa; identical to SEQ ID NO: 132084

SEQ ID NO: 409741 - RNA, 64 nt, hsa; identical to SEQ ID NO: 132085

SEQ ID NO: 409742 - RNA, 64 nt, hsa; identical to SEQ ID NO: 132086

SEQ ID NO: 409743 - RNA, 64 nt, hsa; identical to SEQ ID NO: 132087

SEQ ID NO: 409744 - RNA, 64 nt, hsa; identical to SEQ ID NO: 132088

SEQ ID NO: 409745 - RNA, 64 nt, hsa; identical to SEQ ID NO: 132089

SEQ ID NO: 409746 - RNA, 64 nt, hsa; identical to SEQ ID NO: 132090

SEQ ID NO: 409747 - RNA, 64 nt, hsa; identical to SEQ ID NO: 132091

SEQ ID NO: 409748 - RNA, 64 nt, hsa; identical to SEQ ID NO: 132092

SEQ ID NO: 409749 - RNA, 64 nt, hsa; identical to SEQ ID NO: 132093

SEQ ID NO: 409750 - RNA, 64 nt, hsa; identical to SEQ ID NO: 132094

SEQ ID NO: 409751 - RNA, 64 nt, hsa; identical to SEQ ID NO: 132095

SEQ ID NO: 409752 - RNA, 64 nt, hsa; identical to SEQ ID NO: 132063

SEQ ID NO: 409753 - RNA, 64 nt, hsa; identical to SEQ ID NO: 132097

SEQ ID NO: 409754 - RNA, 61 nt, hsa; identical to SEQ ID NO: 116737

SEQ ID NO: 409755 - RNA, 64 nt, hsa; identical to SEQ ID NO: 132099

SEQ ID NO: 409756 - RNA, 64 nt, hsa; identical to SEQ ID NO: 132100

SEQ ID NO: 409757 - RNA, 64 nt, hsa; identical to SEQ ID NO: 132101

SEQ ID NO: 409758 - RNA, 64 nt, hsa; identical to SEQ ID NO: 132102

SEQ ID NO: 409759 - RNA, 64 nt, hsa; identical to SEQ ID NO: 132103

SEQ ID NO: 409760 - RNA, 64 nt, hsa; identical to SEQ ID NO: 132104

SEQ ID NO: 409761 - RNA, 64 nt, hsa; identical to SEQ ID NO: 132105

SEQ ID NO: 409762 - RNA, 64 nt, hsa; identical to SEQ ID NO: 132106

SEQ ID NO: 409763 - RNA, 64 nt, hsa; identical to SEQ ID NO: 132107

SEQ ID NO: 409764 - RNA, 64 nt, hsa; identical to SEQ ID NO: 132108

SEQ ID NO: 409765 - RNA, 64 nt, hsa; identical to SEQ ID NO: 132109

SEQ ID NO: 409766 - RNA, 64 nt, hsa; identical to SEQ ID NO: 132110

SEQ ID NO: 409767 - RNA, 64 nt, hsa; identical to SEQ ID NO: 132111

SEQ ID NO: 409768 - RNA, 63 nt, hsa; identical to SEQ ID NO: 132112

SEQ ID NO: 409769 - RNA, 64 nt, hsa; identical to SEQ ID NO: 132113

SEQ ID NO: 409770 - RNA, 64 nt, hsa; identical to SEQ ID NO: 132114

SEQ ID NO: 409771 - RNA, 64 nt, hsa; identical to SEQ ID NO: 132115

SEQ ID NO: 409772 - RNA, 64 nt, hsa; identical to SEQ ID NO: 132116

SEQ ID NO: 409773 - RNA, 64 nt, hsa; identical to SEQ ID NO: 132117

SEQ ID NO: 409774 - RNA, 64 nt, hsa; identical to SEQ ID NO: 132118

SEQ ID NO: 409775 - RNA, 64 nt, hsa; identical to SEQ ID NO: 132119

SEQ ID NO: 409776 - RNA, 64 nt, hsa; identical to SEQ ID NO: 132120

SEQ ID NO: 409777 - RNA, 64 nt, hsa; identical to SEQ ID NO: 132121

SEQ ID NO: 409778 - RNA, 64 nt, hsa; identical to SEQ ID NO: 132122

SEQ ID NO: 409779 - RNA, 64 nt, hsa; identical to SEQ ID NO: 132123

SEQ ID NO: 409780 - RNA, 60 nt, hsa; identical to SEQ ID NO: 116763

SEQ ID NO: 409781 - RNA, 64 nt, hsa; identical to SEQ ID NO: 132125

SEQ ID NO: 409782 - RNA, 64 nt, hsa; identical to SEQ ID NO: 132126

SEQ ID NO: 409783 - RNA, 64 nt, hsa; identical to SEQ ID NO: 132127

SEQ ID NO: 409784 - RNA, 64 nt, hsa; identical to SEQ ID NO: 132128

SEQ ID NO: 409785 - RNA, 64 nt, hsa; identical to SEQ ID NO: 132129

SEQ ID NO: 409786 - RNA, 64 nt, hsa; identical to SEQ ID NO: 132130

SEQ ID NO: 409787 - RNA, 64 nt, hsa; identical to SEQ ID NO: 132131

SEQ ID NO: 409788 - RNA, 64 nt, hsa; identical to SEQ ID NO: 132132

SEQ ID NO: 409789 - RNA, 64 nt, hsa; identical to SEQ ID NO: 132133

SEQ ID NO: 409790 - RNA, 64 nt, hsa; identical to SEQ ID NO: 132134

SEQ ID NO: 409791 - RNA, 64 nt, hsa; identical to SEQ ID NO: 132135

SEQ ID NO: 409792 - RNA, 64 nt, hsa; identical to SEQ ID NO: 132136

SEQ ID NO: 409793 - RNA, 64 nt, hsa; identical to SEQ ID NO: 132137

SEQ ID NO: 409794 - RNA, 64 nt, hsa; identical to SEQ ID NO: 132138

SEQ ID NO: 409795 - RNA, 64 nt, hsa; identical to SEQ ID NO: 132139

SEQ ID NO: 409796 - RNA, 64 nt, hsa; identical to SEQ ID NO: 132140

SEQ ID NO: 409797 - RNA, 64 nt, hsa; identical to SEQ ID NO: 132141

SEQ ID NO: 409798 - RNA, 64 nt, hsa; identical to SEQ ID NO: 132142

SEQ ID NO: 409799 - RNA, 64 nt, hsa; identical to SEQ ID NO: 132143

SEQ ID NO: 409800 - RNA, 64 nt, hsa; identical to SEQ ID NO: 132144

SEQ ID NO: 409801 - RNA, 64 nt, hsa; identical to SEQ ID NO: 132145

SEQ ID NO: 409802 - RNA, 64 nt, hsa; identical to SEQ ID NO: 132146

SEQ ID NO: 409803 - RNA, 64 nt, hsa; identical to SEQ ID NO: 132147

SEQ ID NO: 409804 - RNA, 64 nt, hsa; identical to SEQ ID NO: 132148

SEQ ID NO: 409805 - RNA, 64 nt, hsa; identical to SEQ ID NO: 132149

SEQ ID NO: 409806 - RNA, 64 nt, hsa; identical to SEQ ID NO: 132150

SEQ ID NO: 409807 - RNA, 64 nt, hsa; identical to SEQ ID NO: 132151

SEQ ID NO: 409808 - RNA, 64 nt, hsa; identical to SEQ ID NO: 132152

SEQ ID NO: 409809 - RNA, 64 nt, hsa; identical to SEQ ID NO: 132153

SEQ ID NO: 409810 - RNA, 64 nt, hsa; identical to SEQ ID NO: 132154

SEQ ID NO: 409811 - RNA, 64 nt, hsa; identical to SEQ ID NO: 132155

SEQ ID NO: 409812 - RNA, 64 nt, hsa; identical to SEQ ID NO: 132156

SEQ ID NO: 409813 - RNA, 64 nt, hsa; identical to SEQ ID NO: 132157

SEQ ID NO: 409814 - RNA, 64 nt, hsa; identical to SEQ ID NO: 132158

SEQ ID NO: 409815 - RNA, 64 nt, hsa; identical to SEQ ID NO: 132159

SEQ ID NO: 409816 - RNA, 64 nt, hsa; identical to SEQ ID NO: 132160

SEQ ID NO: 409817 - RNA, 64 nt, hsa; identical to SEQ ID NO: 132161

SEQ ID NO: 409818 - RNA, 64 nt, hsa; identical to SEQ ID NO: 132162

SEQ ID NO: 409819 - RNA, 64 nt, hsa; identical to SEQ ID NO: 132163

SEQ ID NO: 409820 - RNA, 64 nt, hsa; identical to SEQ ID NO: 132164

SEQ ID NO: 409821 - RNA, 64 nt, hsa; identical to SEQ ID NO: 132165

SEQ ID NO: 409822 - RNA, 64 nt, hsa; identical to SEQ ID NO: 132166

SEQ ID NO: 409823 - RNA, 64 nt, hsa; identical to SEQ ID NO: 132167

SEQ ID NO: 409824 - RNA, 64 nt, hsa; identical to SEQ ID NO: 132168

SEQ ID NO: 409825 - RNA, 64 nt, hsa; identical to SEQ ID NO: 132169

SEQ ID NO: 409826 - RNA, 64 nt, hsa; identical to SEQ ID NO: 132170

SEQ ID NO: 409827 - RNA, 64 nt, hsa; identical to SEQ ID NO: 132171

SEQ ID NO: 409828 - RNA, 64 nt, hsa; identical to SEQ ID NO: 132172

SEQ ID NO: 409829 - RNA, 64 nt, hsa; identical to SEQ ID NO: 132173

SEQ ID NO: 409830 - RNA, 64 nt, hsa; identical to SEQ ID NO: 132174

SEQ ID NO: 409831 - RNA, 64 nt, hsa; identical to SEQ ID NO: 132175

SEQ ID NO: 409832 - RNA, 64 nt, hsa; identical to SEQ ID NO: 132176

SEQ ID NO: 409833 - RNA, 64 nt, hsa; identical to SEQ ID NO: 132177

SEQ ID NO: 409834 - RNA, 64 nt, hsa; identical to SEQ ID NO: 132178

SEQ ID NO: 409835 - RNA, 64 nt, hsa; identical to SEQ ID NO: 132179

SEQ ID NO: 409836 - RNA, 64 nt, hsa; identical to SEQ ID NO: 132180

SEQ ID NO: 409837 - RNA, 64 nt, hsa; identical to SEQ ID NO: 132181

SEQ ID NO: 409838 - RNA, 64 nt, hsa; identical to SEQ ID NO: 132182

SEQ ID NO: 409839 - RNA, 64 nt, hsa; identical to SEQ ID NO: 132183

SEQ ID NO: 409840 - RNA, 64 nt, hsa; identical to SEQ ID NO: 132184

SEQ ID NO: 409841 - RNA, 64 nt, hsa; identical to SEQ ID NO: 132185

SEQ ID NO: 409842 - RNA, 64 nt, hsa; identical to SEQ ID NO: 132186

SEQ ID NO: 409843 - RNA, 64 nt, hsa; identical to SEQ ID NO: 132187

SEQ ID NO: 409844 - RNA, 64 nt, hsa; identical to SEQ ID NO: 132188

SEQ ID NO: 409845 - RNA, 64 nt, hsa; identical to SEQ ID NO: 132189

SEQ ID NO: 409846 - RNA, 64 nt, hsa; identical to SEQ ID NO: 132190

SEQ ID NO: 409847 - RNA, 64 nt, hsa; identical to SEQ ID NO: 132191

SEQ ID NO: 409848 - RNA, 64 nt, hsa; identical to SEQ ID NO: 132192

SEQ ID NO: 409849 - RNA, 64 nt, hsa; identical to SEQ ID NO: 132193

SEQ ID NO: 409850 - RNA, 64 nt, hsa; identical to SEQ ID NO: 132194

SEQ ID NO: 409851 - RNA, 64 nt, hsa; identical to SEQ ID NO: 264302

SEQ ID NO: 409852 - RNA, 64 nt, hsa; identical to SEQ ID NO: 264303

SEQ ID NO: 409853 - RNA, 64 nt, hsa; identical to SEQ ID NO: 264304

SEQ ID NO: 409854 - RNA, 64 nt, hsa; identical to SEQ ID NO: 264305

SEQ ID NO: 409855 - RNA, 64 nt, hsa; identical to SEQ ID NO: 264306

SEQ ID NO: 409856 - RNA, 64 nt, hsa; identical to SEQ ID NO: 264307

SEQ ID NO: 409857 - RNA, 64 nt, hsa; identical to SEQ ID NO: 264308

SEQ ID NO: 409858 - RNA, 64 nt, hsa; identical to SEQ ID NO: 264309

SEQ ID NO: 409859 - RNA, 64 nt, hsa; identical to SEQ ID NO: 264310

SEQ ID NO: 409860 - RNA, 64 nt, hsa; identical to SEQ ID NO: 264311

SEQ ID NO: 409861 - RNA, 64 nt, hsa; identical to SEQ ID NO: 264312

SEQ ID NO: 409862 - RNA, 64 nt, hsa; identical to SEQ ID NO: 264313

SEQ ID NO: 409863 - RNA, 64 nt, hsa; identical to SEQ ID NO: 264314

SEQ ID NO: 409864 - RNA, 64 nt, hsa; identical to SEQ ID NO: 96836

SEQ ID NO: 409865 - RNA, 64 nt, hsa; identical to SEQ ID NO: 96837

SEQ ID NO: 409866 - RNA, 64 nt, hsa; identical to SEQ ID NO: 96838

SEQ ID NO: 409867 - RNA, 64 nt, hsa; identical to SEQ ID NO: 96839

SEQ ID NO: 409868 - RNA, 64 nt, hsa; identical to SEQ ID NO: 96840

SEQ ID NO: 409869 - RNA, 64 nt, hsa; identical to SEQ ID NO: 96841

SEQ ID NO: 409870 - RNA, 64 nt, hsa; identical to SEQ ID NO: 96842

SEQ ID NO: 409871 - RNA, 64 nt, hsa; identical to SEQ ID NO: 96843

SEQ ID NO: 409872 - RNA, 64 nt, hsa; identical to SEQ ID NO: 96844

SEQ ID NO: 409873 - RNA, 64 nt, hsa; identical to SEQ ID NO: 96845

SEQ ID NO: 409874 - RNA, 64 nt, hsa; identical to SEQ ID NO: 96846

SEQ ID NO: 409875 - RNA, 64 nt, hsa; identical to SEQ ID NO: 96847

SEQ ID NO: 409876 - RNA, 64 nt, hsa; identical to SEQ ID NO: 96848

SEQ ID NO: 409877 - RNA, 64 nt, hsa; identical to SEQ ID NO: 96849

SEQ ID NO: 409878 - RNA, 64 nt, hsa; identical to SEQ ID NO: 96850

SEQ ID NO: 409879 - RNA, 64 nt, hsa; identical to SEQ ID NO: 96851

SEQ ID NO: 409880 - RNA, 64 nt, hsa; identical to SEQ ID NO: 96852

SEQ ID NO: 409881 - RNA, 64 nt, hsa; identical to SEQ ID NO: 96853

SEQ ID NO: 409882 - RNA, 64 nt, hsa; identical to SEQ ID NO: 96854

SEQ ID NO: 409883 - RNA, 64 nt, hsa; identical to SEQ ID NO: 96855

SEQ ID NO: 409884 - RNA, 64 nt, hsa; identical to SEQ ID NO: 96856

SEQ ID NO: 409885 - RNA, 64 nt, hsa; identical to SEQ ID NO: 96857

SEQ ID NO: 409886 - RNA, 64 nt, hsa; identical to SEQ ID NO: 96858

SEQ ID NO: 409887 - RNA, 64 nt, hsa; identical to SEQ ID NO: 96859

SEQ ID NO: 409888 - RNA, 64 nt, hsa; identical to SEQ ID NO: 96860

SEQ ID NO: 409889 - RNA, 64 nt, hsa; identical to SEQ ID NO: 96861

SEQ ID NO: 409890 - RNA, 64 nt, hsa; identical to SEQ ID NO: 96862

SEQ ID NO: 409891 - RNA, 64 nt, hsa; identical to SEQ ID NO: 96863

SEQ ID NO: 409892 - RNA, 64 nt, hsa; identical to SEQ ID NO: 96864

SEQ ID NO: 409893 - RNA, 64 nt, hsa; identical to SEQ ID NO: 96865

SEQ ID NO: 409894 - RNA, 64 nt, hsa; identical to SEQ ID NO: 96866

SEQ ID NO: 409895 - RNA, 64 nt, hsa; identical to SEQ ID NO: 96867

SEQ ID NO: 409896 - RNA, 64 nt, hsa; identical to SEQ ID NO: 96868

SEQ ID NO: 409897 - RNA, 64 nt, hsa; identical to SEQ ID NO: 96869

SEQ ID NO: 409898 - RNA, 64 nt, hsa; identical to SEQ ID NO: 96870

SEQ ID NO: 409899 - RNA, 64 nt, hsa; identical to SEQ ID NO: 96871

SEQ ID NO: 409900 - RNA, 64 nt, hsa; identical to SEQ ID NO: 96872

SEQ ID NO: 409901 - RNA, 64 nt, hsa; identical to SEQ ID NO: 96873

SEQ ID NO: 409902 - RNA, 64 nt, hsa; identical to SEQ ID NO: 96874

SEQ ID NO: 409903 - RNA, 64 nt, hsa; identical to SEQ ID NO: 96875

SEQ ID NO: 409904 - RNA, 64 nt, hsa; identical to SEQ ID NO: 155809

SEQ ID NO: 409905 - RNA, 64 nt, hsa; identical to SEQ ID NO: 155810

SEQ ID NO: 409906 - RNA, 64 nt, hsa; identical to SEQ ID NO: 155811

SEQ ID NO: 409907 - RNA, 64 nt, hsa; identical to SEQ ID NO: 155812

SEQ ID NO: 409908 - RNA, 64 nt, hsa; identical to SEQ ID NO: 155813

SEQ ID NO: 409909 - RNA, 64 nt, hsa; identical to SEQ ID NO: 155814

SEQ ID NO: 409910 - RNA, 64 nt, hsa; identical to SEQ ID NO: 155815

SEQ ID NO: 409911 - RNA, 64 nt, hsa; identical to SEQ ID NO: 155816

SEQ ID NO: 409912 - RNA, 64 nt, hsa; identical to SEQ ID NO: 155817

SEQ ID NO: 409913 - RNA, 64 nt, hsa; identical to SEQ ID NO: 155817

SEQ ID NO: 409914 - RNA, 64 nt, hsa; identical to SEQ ID NO: 155819

SEQ ID NO: 409915 - RNA, 64 nt, hsa; identical to SEQ ID NO: 155820

SEQ ID NO: 409916 - RNA, 64 nt, hsa; identical to SEQ ID NO: 155821

SEQ ID NO: 409917 - RNA, 64 nt, hsa
gccuuccauguucauaggcccagcccaagagagugacacacagugcuggcccugagacauuucc

SEQ ID NO: 409918 - RNA, 64 nt, hsa
cauagcugaccagggcugugcuugagguacagaggacacacauuguagacaggccugugucaug

SEQ ID NO: 409919 - RNA, 64 nt, hsa
ccccaggcagucugugugugaggcauagccccuggacacacacacacagacacacacacugccu

SEQ ID NO: 409920 - RNA, 64 nt, hsa
ugugugaggcauagccccuggacacacacacacagacacacacacugccuggaugcauguaugc

SEQ ID NO: 409921 - RNA, 64 nt, hsa
acacacgcacacccaugcgcagaugugcugccuggacacacacacacacacggauaugcugucu

SEQ ID NO: 409922 - RNA, 64 nt, hsa
gucuggacgcacacacgugcagauaugguauccggacacacacgugcacagauaugcugccugg

SEQ ID NO: 409923 - RNA, 64 nt, hsa
auccggacacacacgugcacagauaugcugccuggacacacagauaaugcugccuugacacaca

SEQ ID NO: 409924 - RNA, 64 nt, hsa
auaugcugccuggacacacagauaaugcugccuugacacacacaugcacggauauugccuggac

SEQ ID NO: 409925 - RNA, 64 nt, hsa
cugccuugacacacacaugcacggauauugccuggacacacacacacacacgugugcacagaua

SEQ ID NO: 409926 - RNA, 64 nt, hsa
cuggacacgcacacacaugcagauaugcugccuggacacacacuuccagacacacgugcacagg

SEQ ID NO: 409927 - RNA, 64 nt, hsa
gucuagucacacacacacgcagacaugcuguccggacacacacacgcaugcacagauaugcugu

SEQ ID NO: 409928 - RNA, 64 nt, hsa
ggacacacacacgcaugcacagauaugcuguccggacacacacacgcacgcagauaugcugccu

SEQ ID NO: 409929 - RNA, 64 nt, hsa
ccggacacacacacgcacgcagauaugcugccuggacacacacacagauaaugcugccucaaca

SEQ ID NO: 409930 - RNA, 64 nt, hsa
gccucaacacucacacacgugcagauauugccuggacacacacaugugcacagauaugcugucu

SEQ ID NO: 409931 - RNA, 64 nt, hsa
acaugcagauaugcugccugggcacacacuuccggacacacaugcacacacaggugcagauaug

SEQ ID NO: 409932 - RNA, 64 nt, hsa
agucccgagccucagcauggcuggcagcgcggcugacacacacguucaagcccaggacugcccg

SEQ ID NO: 409933 - RNA, 64 nt, hsa
ucaggugcaguggcccuacccagccuggccagcagacacacacagggaugcucacgggugcacc

SEQ ID NO: 409934 - RNA, 64 nt, hsa
uauaacuaacaaccaaagacuacauauugucacugacacacacguuauaaucauuuaucauaua

SEQ ID NO: 409935 - RNA, 64 nt, hsa
aguucaaguccugccucuuaaauaaaccuuuuuggacacacaaauuaucuuaaaacuccuguuu

SEQ ID NO: 409936 - RNA, 64 nt, hsa
cacacacgcagacacacacacacacacaaaugcagacacacaacaucaagaaaacagcaaggga

SEQ ID NO: 409937 - RNA, 64 nt, hsa
caggagaugaugugauggaacacacacacacgcagacacacacacacacacaaaugcagacaca

SEQ ID NO: 409938 - RNA, 64 nt, hsa
gggagagacacucccagggacaagggaaggaagggacacacacacacacacacacacacacaca

SEQ ID NO: 409939 - RNA, 64 nt, hsa
ccccagccauggugaggaagccccaagccauggugacacacagcagcacugcagauagccagac

SEQ ID NO: 409940 - RNA, 64 nt, hsa
cuccccgccacagagacacaccauuacauacacagacacacacagaaagacacacacagacaca

SEQ ID NO: 409941 - RNA, 64 nt, hsa
ccauuacacacacauacacagaaagacacacacagacacacaaucacacgcagccccuccccgc

SEQ ID NO: 409942 - RNA, 64 nt, hsa
cagaaacacaccauuacacacacauacacagaaagacacacacagacacacaaucacacgcagc

SEQ ID NO: 409943 - RNA, 64 nt, hsa
cccuccccgccacagagacaccauuacauacacagacacacacagaaagacacagacacaaaau

SEQ ID NO: 409944 - RNA, 64 nt, hsa
gagacaccauuacauacacagacacacacagaaagacacacacagacacaaaaucacacacaca

SEQ ID NO: 409945 - RNA, 64 nt, hsa
cccuccccaccacagagacaccauuacauacacagacacacacagaaagacacacacagacaca

SEQ ID NO: 409946 - RNA, 64 nt, hsa
cucaaaggcccagagaggacagugaccauccacagacacacagcacaggcgugacaguucugaa

SEQ ID NO: 409947 - RNA, 64 nt, hsa
cuuuuuggaagaggcaaauggcuggucugaggaugacacacaaaaacaaaaacaaaaaacaaaa

SEQ ID NO: 409948 - RNA, 64 nt, hsa
gcaaccagccugaguucagccccacggacaaagggacacacagcccccaauggagaccauugua

SEQ ID NO: 409949 - RNA, 64 nt, hsa
cacacacacauacacaccccugaacacacacacagacacacauacacccaugaugugagcaaac

SEQ ID NO: 409950 - RNA, 64 nt, hsa
cccucuccacaugcacacccugaaaacacacacagacacacaacacacacacauacacaccccu

SEQ ID NO: 409951 - RNA, 64 nt, hsa
caaacuuggauaaagaaaaagacaaacagaaauagacacacacaccagcagagacagaaacagc

SEQ ID NO: 409952 - RNA, 64 nt, hsa
cuuucuggaucucggcuucuccagcuguaaaauggacacacaauccuccuccagggacugcugu

SEQ ID NO: 409953 - RNA, 64 nt, hsa
uugcagaagacaguguguugccuuauaggcgugagacacacacacacacacacacacacacaca

SEQ ID NO: 409954 - RNA, 64 nt, hsa
ccagaaugagugcuaggauuacaggcgugagacagacacacauacacacacauacacacacaca

SEQ ID NO: 409955 - RNA, 64 nt, hsa
ccacgacucugguggggaaaaccguuuuuuaaaggacacacacacacacagcgaugcaucucuc

SEQ ID NO: 409956 - RNA, 64 nt, hsa
uuuuuaaaaacaaauaaaugaauaaagcugcugugacacacacacaaaaggaauuuaauaguau

SEQ ID NO: 409957 - RNA, 64 nt, hsa
uuuuuauaccuguacacacacagacacacaagcagacacacacauauauacauacgcaauugua

SEQ ID NO: 409958 - RNA, 64 nt, hsa
cugccugucaaguuuuuauaccuguacacacacagacacacaagcagacacacacauauauaca

SEQ ID NO: 409959 - RNA, 64 nt, hsa
uuagccggaagucaguccuccucauucaccagaggacacacaggggagacgccccagucugcag

SEQ ID NO: 409960 - RNA, 64 nt, hsa
uuagccggaagucagaccuccucagucaccagaggacacacacaggggagaagccuuaugucug

SEQ ID NO: 409961 - RNA, 64 nt, hsa
ucagugauaagucagauguuauuacacaccaaaggacacacacaggggggaagcccuacgucug

SEQ ID NO: 409962 - RNA, 64 nt, hsa
gcugccucccgcacaaggagaccuggacacaacagacacacaucacaaggcgaacacaaaugga

SEQ ID NO: 409963 - RNA, 64 nt, hsa
acaacagacacacaucacaaggcgaacacaaauggacacacauaccuggccacgaacccacacc

SEQ ID NO: 409964 - RNA, 64 nt, hsa
gguaggggccccacccucugggcuucccaucagcgacacacacacacuuauggcaccagccugg

SEQ ID NO: 409965 - RNA, 64 nt, hsa
gggcaggugcccggggcugggugaguggaauuaggacacacacaggcuugggcuucaaguucau

SEQ ID NO: 409966 - RNA, 64 nt, hsa
gccuggcccucccucccuagcccuuccagccugggacacacacacacacacacacacacacaca

SEQ ID NO: 409967 - RNA, 64 nt, hsa
ggcuuugugucagacacgcucggcuccccaccuggacacacacucaccaguggccuuucagugu

SEQ ID NO: 409968 - RNA, 52 nt, hsa
auggaaauuaccagcaguaagggacacacauucuggcuggagcccuuguggu

SEQ ID NO: 409969 - RNA, 64 nt, hsa
gucaacuuuucuuuaacuggcuacgccacagcuggacacacaugcagccccuggagggcagccu

SEQ ID NO: 409970 - RNA, 64 nt, hsa
auuuacacaccagacacacaaacacacacacacagacacacacacacacagacacaccaaguac

SEQ ID NO: 409971 - RNA, 64 nt, hsa
aauuuccgauuuuccccucugcauuuacacaccagacacacaaacacacacacacagacacaca

SEQ ID NO: 409972 - RNA, 64 nt, hsa
uaaaaguggaauguauuuaaaacuuguugaauuagacacacacacacagacacacacaaagaau

SEQ ID NO: 409973 - RNA, 64 nt, hsa
auuuaaaacuuguugaauuagacacacacacacagacacacacaaagaaucagcagagaaaaca

SEQ ID NO: 409974 - RNA, 64 nt, hsa
uucccaauuuacucucaguuccagucaagcugguugcucugaaaguaacccagcuuguugcucu

SEQ ID NO: 409975 - RNA, 64 nt, hsa
uaggaaggcagaacaagacagaugagcuccugccugcucugagacaagaaggguggggucucau

SEQ ID NO: 409976 - RNA, 64 nt, hsa
uacugcaaaagugagaaggagauaauagauacuuugcucugaauuuggcauccagaguuaacau

SEQ ID NO: 409977 - RNA, 64 nt, hsa
uuuguccauguugcauguaaugaaaauaaaucccugcucugagaaaagcucuuugaagcaaaaa

SEQ ID NO: 409978 - RNA, 64 nt, hsa
cucaaauuaauuaaucuuuaagcuucaagaaacuugcucugaccccucuaagcaaacuacuaag

SEQ ID NO: 409979 - RNA, 64 nt, hsa
gccggcgggcaccaggcuggggucuccuugucugugcucugauaugcuccuugacugaaacuuu

SEQ ID NO: 409980 - RNA, 64 nt, hsa
uggucuggaggauucucucuagccgugacuccgcugcucugaaggucaacugagaagucuugug

SEQ ID NO: 409981 - RNA, 64 nt, hsa
gaucaggagaauccuggaauuguuaucugucucuugcucugagauacagacuuguucauaggug

SEQ ID NO: 409982 - RNA, 64 nt, hsa
guguggcccuccugucuggagugacaucuucaucugcucugaauacuggugcccagccagcccg

SEQ ID NO: 409983 - RNA, 64 nt, hsa
gagaggggacucguggggcaagcaagcugcccugugcucugagugagggggaagguagccccuu

SEQ ID NO: 409984 - RNA, 64 nt, hsa
cccugacaugauucuuggugauggaauagguuugugcucugauucuaguuuaagagaacguugc

SEQ ID NO: 409985 - RNA, 64 nt, hsa
gaggccugcguucuguucccuauaaauggaagcgugcucugagccugucugccucccucggcug

SEQ ID NO: 409986 - RNA, 64 nt, hsa
ccuucuggccaaauagcacaacauuuccucguucugcucugaccucuuagcuuagaaggaagau

SEQ ID NO: 409987 - RNA, 64 nt, hsa
gaagugaggggcuaagaagguuguccuugccuaaugcucugaucuguaagugaauagggcagaa

SEQ ID NO: 409988 - RNA, 64 nt, hsa
auuuucuuguuucugguccauccgaugagacggaugcucugaugcucugaggcuucugggaggc

SEQ ID NO: 409989 - RNA, 64 nt, hsa
guuucugguccauccgaugagacggaugcucugaugcucugaggcuucugggaggcugggcccu

SEQ ID NO: 409990 - RNA, 64 nt, hsa
cagggcucuaguuaugguuacuuucccuagucaaugcucugaaaaugugucacauuauaaacaa

SEQ ID NO: 409991 - RNA, 64 nt, hsa
cuuacaaggcucuaauuaugauuucccuagucagugcucugaagaugugucacauuauauuaua

SEQ ID NO: 409992 - RNA, 64 nt, hsa
ugcugccuuggguuucugugcagauaaacagaaaugcucugauuagaaaggaaaugaaugguuc

SEQ ID NO: 409993 - RNA, 64 nt, hsa
uaacugaagauauuccaacucaaaaccagccucaugcucugauuagauaaucuuuuacauugaa

SEQ ID NO: 409994 - RNA, 64 nt, hsa
caaugccuuuuuucuucacauaaaguaguugauuacgagggagucaaauuuucuuuuuaaaaag

SEQ ID NO: 409995 - RNA, 64 nt, hsa
gucagacgccagugacagaagcugugaguggaagacgagggauugccaucgccuaugaggauga

SEQ ID NO: 409996 - RNA, 64 nt, hsa
ugggaaaacagaggaaucuaccuguggugacugaacgagggauaauucaaacugacaaccugug

SEQ ID NO: 409997 - RNA, 64 nt, hsa
auuuccuggagaaaagacaauuuauucaacaccaacgagggacucaucauaugggcacaacucu

SEQ ID NO: 409998 - RNA, 64 nt, hsa
ucgggagcauucugccugccugggaacgggguggacgagggagugucuguaaggacucaguguu

SEQ ID NO: 409999 - RNA, 64 nt, hsa
cuggugcccccgccccuggucccaaccugaucccacgagggaguugggacaggaggauugaugg

SEQ ID NO: 410000 - RNA, 64 nt, hsa
uccugagcugacugacugaugucugaaguuugagacgagggauuauuucaggguggggcccaau

SEQ ID NO: 410001 - RNA, 64 nt, hsa
cccaccagccugcaccacaggcuccccugggaggacgagggaaacgcugaugagacgcugggca

SEQ ID NO: 410002 - RNA, 64 nt, hsa
agcucgcuaccuguucucucuggucagcagggcgacgagggaagguuuccgacgcaggcaggug

SEQ ID NO: 410003 - RNA, 64 nt, hsa
guccuggagaagagacuggugcuucuccgcacacacgagggagggcgcccuugaggcaugcccu

SEQ ID NO: 410004 - RNA, 64 nt, hsa
cugggccggggguagagcuagcauccgggcauguacgagggaagagggaggcaggccucuauuc

SEQ ID NO: 410005 - RNA, 64 nt, hsa
gaggugccugcccugggcucuggaccccgggcacacgagggacggugcccugagcccguuaggu

SEQ ID NO: 410006 - RNA, 64 nt, hsa
cuguuccggcuucuucacggcugacauucggcuaacgagggauuacuuuggccaaaaccuuuca

SEQ ID NO: 410007 - RNA, 64 nt, hsa
uguuaaacugcauaacaggcaccagauggucaagacgagggaaauaugagaaggcaaaugaugu

SEQ ID NO: 410008 - RNA, 64 nt, hsa
guauccaaauuuaugccacuuaaauuucuuuaccacgagggauagagcaugcauacugguuuuu

SEQ ID NO: 410009 - RNA, 64 nt, hsa
gaaaggaggcuccguuuugcaaaguggaggagggacgagggacagggguuucaccagccagcaa

SEQ ID NO: 410010 - RNA, 64 nt, hsa
acauugcuauuuacuuuuguguuugggggaaaauacgagggauugauuuuaaauaaaaaacauu

SEQ ID NO: 410011 - RNA, 64 nt, hsa
gcgaacuggaggggggagaaauuuucaaagaaaaacgagggaaaugggaggggugcaaaagagg

SEQ ID NO: 410012 - RNA, 64 nt, hsa
gguuuucaucuaugaggguguuuccucuaaaccuacgagggaggaacaccugaucuuacagaaa

SEQ ID NO: 410013 - RNA, 64 nt, hsa
ggcagccucaugcaaccaugagggauaguaugugacgagggagaacuguccacucaugccauuu

SEQ ID NO: 410014 - RNA, 64 nt, hsa
ccuggcccugcgcaacgcaagcaucggacuucacacgagggaagucaguaaaaacuacgagcag

SEQ ID NO: 410015 - RNA, 64 nt, hsa
ggaacacugagaagggugaccaaugcguuggagaacgagggagggcuucauagcagaagacauu

SEQ ID NO: 410016 - RNA, 64 nt, hsa
cgaguagcagcauaucuucucuuuuagugucauuacgagggagugauggcgggaaucucagucg

SEQ ID NO: 410017 - RNA, 64 nt, hsa
agaggcucgccaggcccugauccggucuguggggacgagggacacugaggagaggugcugggca

SEQ ID NO: 410018 - RNA, 64 nt, hsa
auuggugcugacauguaaugacuucacaaguuuuacgagggaaaacugaaaaaggaaguaauau

SEQ ID NO: 410019 - RNA, 64 nt, hsa
ccccuuagggagcccagcuauuuacaaaguacacacgagggagcaggcuggucauugacuucgg

SEQ ID NO: 410020 - RNA, 64 nt, hsa
ugauucccaaaguuuggaaaaaaaugacaaaacaacgagggaagaaggaaccagaccuuagugc

SEQ ID NO: 410021 - RNA, 64 nt, hsa
cuggagugggguucuuugagugggggaggcagggacgagggaaggaaaguaacuccugacucuc

SEQ ID NO: 410022 - RNA, 64 nt, hsa
gcccuccaggggccuggcacagcuggccuuggggacgagggagaggacugauucagggcccccu

SEQ ID NO: 410023 - RNA, 61 nt, hsa
ucacaggcacagaaaacugaaucuguagauaacgagggagaaugaauugucaugaaaaauu

SEQ ID NO: 410024 - RNA, 64 nt, hsa
ugggcuugcugcuucauuacucaccuggauggggacgagggaugagaaggguguggguuuggcc

SEQ ID NO: 410025 - RNA, 64 nt, hsa
gacaaaugagcgacuucugugcuuccagaggaagacgagggagcaggagcuuggcugacugcuc

SEQ ID NO: 410026 - RNA, 64 nt, hsa
acagccauccuccugggagcccaggaaggcauccacgagggagcuccuggccagcagccgucau

SEQ ID NO: 410027 - RNA, 64 nt, hsa
ucugacccaggcccggcuccacccugcaccucacacgagggagcugccccugggugggcggcuc

SEQ ID NO: 410028 - RNA, 64 nt, hsa
uuuuuuuaauugacuuuugagcuuuugagauugcacgagggagaacaaggccuuugcuguugug

SEQ ID NO: 410029 - RNA, 64 nt, hsa
cuucaguuccacucccaggaacuuugccugucccacgagggaguaugggagagagggacugcca

SEQ ID NO: 410030 - RNA, 64 nt, hsa
caugagaggugggcacccggugccgaggacauggacgagggacugguggcugggagggagagga

SEQ ID NO: 410031 - RNA, 64 nt, hsa
uaaacauuaagucuguaguagcagcagcugacuaacgagggagauagggagauucugacaaacu

SEQ ID NO: 410032 - RNA, 64 nt, hsa
uaaggcuuauuuucacagaauaaaauaaagcaaaacgagggaggauuuuauugggggaagugca

SEQ ID NO: 410033 - RNA, 64 nt, hsa
uagcauuccagggcgcccaggggcgggcggggguacgagggaggaaggggagcaagacuugggc

SEQ ID NO: 410034 - RNA, 64 nt, hsa
gagaucugcaucuaaagcaaugguccuuugucaaacgagggauuuugauccacuucaccauuuu

SEQ ID NO: 410035 - RNA, 64 nt, hsa
uggcgcgcccucaucagccgucgcgcaagcacacacgagggacgugugccagagcccccucccu

SEQ ID NO: 410036 - RNA, 64 nt, hsa
uggguuagucucugucucacccuguuagaaugucacgagggacuguacuguccccucugucacc

SEQ ID NO: 410037 - RNA, 64 nt, hsa
aaaaagaaaaaauuuaaaaaauuuuaaaaauauaacgagggauaaauuuuugguggugauagug

SEQ ID NO: 410038 - RNA, 64 nt, hsa
cuggagccaguguccugguuugacagcauguucaacgagggaaccccaagacggacccacacag

SEQ ID NO: 410039 - RNA, 64 nt, hsa
ucagacucauacagaagguggggguuggcuggguacgagggauguggagcacaaaagccucuca

SEQ ID NO: 410040 - RNA, 64 nt, hsa
cauuuaucaaacuauucaugcuagcauuuuuccaacgagggaacuuauuccgcacgggccuacu

SEQ ID NO: 410041 - RNA, 64 nt, hsa
gaaugagggacuucuccuccaguggaccugaaggacgagggaugggauuucauguaaccaagag

SEQ ID NO: 410042 - RNA, 64 nt, hsa
ccaccacguucagguuucugaaugcagacccaccacgagggauggauuccacccgcccgcccug

SEQ ID NO: 410043 - RNA, 64 nt, hsa
ucucucugcaggccaggagggccuccuuccugccacgagggaggggagucgggccccaggucgc

SEQ ID NO: 410044 - RNA, 64 nt, hsa
gcaccacugugugagcaacaggaagggagagcgcacgagggagaggagccgaggccgagcgccc

SEQ ID NO: 410045 - RNA, 64 nt, hsa
cugguccucucccaucgcccacaaaagggggggcacgagggacgagcuuagcugagcugggagg

SEQ ID NO: 410046 - RNA, 64 nt, hsa
ccacacaacagagacauuuaaugagagggguuucacgagggauuuuguuagaacuuuaacauca

SEQ ID NO: 410047 - RNA, 64 nt, hsa
ccuccugcagcuggagccuucaggccguauucucacgagggaacguuugccaaggcucugaccu

SEQ ID NO: 410048 - RNA, 64 nt, hsa
gugaccucccuucuacggagaugcaggcagugccacgagggaggaggggaccugcaaagcuaga

SEQ ID NO: 410049 - RNA, 64 nt, hsa
agcauccugaagccccauucuccgacuuacaacgacgagggacuuugaugggcugggcccuccg

SEQ ID NO: 410050 - RNA, 64 nt, hsa
ucgagagaagcagaugagggaggaggcugaacgcacgagggaugaguuggagaggaggcugcug

SEQ ID NO: 410051 - RNA, 64 nt, hsa
gaagcaaaacaacaggaaaugugggaaaauauaaacgagggaagaaaacaaacuuuaaaaaaaa

SEQ ID NO: 410052 - RNA, 64 nt, hsa
cacacacacauauggggaccugcacaccugcaaaacgagggaacaacuaagguggcugaagacc

SEQ ID NO: 410053 - RNA, 64 nt, hsa
gagccugggagcaguaguacuaaggcgucuuuuguaggcuuaagaauuuauccuaauggccuuu

SEQ ID NO: 410054 - RNA, 64 nt, hsa
auaaagggugguauggcuagaaggguaugagcaguaggcuuauguacaccucuuauagagguug

SEQ ID NO: 410055 - RNA, 64 nt, hsa
gcaacaguggaauccauguaaaacucucugugcaucuaaauacuucuggagggcgacagauuca

SEQ ID NO: 410056 - RNA, 64 nt, hsa
cuuaacuguagauuuuauuggccuguuuuuuuuuucuaaauaauucuuuaaaacuugacuggaa

SEQ ID NO: 410057 - RNA, 64 nt, hsa
ucauuaugagaguauugacuaaauauuuucacaaucuaaauauugucacaaucuaaauuucugu

SEQ ID NO: 410058 - RNA, 64 nt, hsa
uccugaccucaggugauccacccaccuuggccucucuaaauacugggauuacaggcgugagcca

SEQ ID NO: 410059 - RNA, 64 nt, hsa
cuguuauaaacucuuugcuucugcuaagaagcagucuaaauauaaucaacguacagugagcucu

SEQ ID NO: 410060 - RNA, 64 nt, hsa
uggcaugauuacuuauuuauuuguuccaggugacucuaaauaguugauuuuucugccugaagga

SEQ ID NO: 410061 - RNA, 64 nt, hsa
cuagaagacuaguacacuggcaucaucuuagguuucuaaauauuauuuaauuccuuaauuugga

SEQ ID NO: 410062 - RNA, 64 nt, hsa
guuaacuuuggagcacagguuugauauuuaugcuucuaaauacauuaaaacauuucugaauugc

SEQ ID NO: 410063 - RNA, 64 nt, hsa
gucugauuuuacaaaucagauuuuauucaagcuuucuaaauaucugugaaguagacccuagaaa

SEQ ID NO: 410064 - RNA, 64 nt, hsa
aauuugaggauuuaacuugauauagcucucaggaucuaaauaaaguuuaaauuaucauuaagac

SEQ ID NO: 410065 - RNA, 64 nt, hsa
caucuccagaagaggggagcagaguccgagcuuaucuaaauaugaauguggccacaaagcugug

SEQ ID NO: 410066 - RNA, 64 nt, hsa
gaauucugacuuauacuuuauuaaaugcuguaaaucuaaauagauccuguuggaugugaugggu

SEQ ID NO: 410067 - RNA, 64 nt, hsa
gguaaaauuggaacucuccagaugaacaaagacaucuaaauaucuguagauagaaacauuuauc

SEQ ID NO: 410068 - RNA, 64 nt, hsa
caucuaaauaucuguagauagaaacauuuaucuaucuaaauauauugauagaccugucauugua

SEQ ID NO: 410069 - RNA, 64 nt, hsa
auauaugcagcacuuucuguguacaaaguacuguucuaaauacaaaagggaauauaaagaugac

SEQ ID NO: 410070 - RNA, 64 nt, hsa
auuuguaaaaauguuuguuuauauagaccuauccucuaaauaugugacaaggaucuagaaauuc

SEQ ID NO: 410071 - RNA, 64 nt, hsa
agacuauuauaaagcuuuaaguugucaacuuuguucuaaauaucaacuagcgcaagugaauacu

SEQ ID NO: 410072 - RNA, 64 nt, hsa
aggggaaauagguaauguauggagcauuuucacuucuaaauaguuagauacagaaauuaagugc

SEQ ID NO: 410073 - RNA, 64 nt, hsa
ugcaaugccuuuauuuaaaaaaauugucuacuuaucuaaauauucauaccacaauuucaaaccu

SEQ ID NO: 410074 - RNA, 64 nt, hsa
uggaacauuuaagugaauauaugaauauugaauuucuaaauauuuguugugccugucuuuacca

SEQ ID NO: 410075 - RNA, 64 nt, hsa
uucacauuacuuugucaccauauccuuuguguucucuaaauacauugcccacuuccaaaaaugu

SEQ ID NO: 410076 - RNA, 64 nt, hsa
aauauauuauuuugcuauuaaugugaaaguugucucuaaauauuuuuuaauuuucaaacucaua

SEQ ID NO: 410077 - RNA, 64 nt, hsa
cacuacacuggugaauuguaguagggaaaaacaaucuaaauauugaagaggaauggccuaauua

SEQ ID NO: 410078 - RNA, 64 nt, hsa
ugagacuuuggcaugaaauguuaagcauccgacaucuaaauagcaauauuuugaauacuggaaa

SEQ ID NO: 410079 - RNA, 64 nt, hsa
auauauagucauauugcugccauuguacuuaauuucuaaauauauaaaauccacauuuaaaaau

SEQ ID NO: 410080 - RNA, 64 nt, hsa
cacuccagccuaggugacagagugagacccugucucuaaauaaauaaauaaauaaaauauaaaa

SEQ ID NO: 410081 - RNA, 64 nt, hsa
uaucucguaagaggggagguccaccuagacacacucuaaauauguggccuagaagauuuugguc

SEQ ID NO: 410082 - RNA, 64 nt, hsa
aauauuucccagcagugacaaucuacacccuuuaucuaaauaaauauugagaugugcuuuuuuc

SEQ ID NO: 410083 - RNA, 64 nt, hsa
gagagaaaggaaacacacucuuucauugcugaauucuaaauaaugaugcccugaauuaguucua

SEQ ID NO: 410084 - RNA, 64 nt, hsa
cacuccagccugggcaacagagcgagacuccaucucuaaauaaauaaauaaauaaauaaauaaa

SEQ ID NO: 410085 - RNA, 64 nt, hsa
aggaaaucuuuauacuauuuuacaguaaccacaaucuaaauauuuacauauacccaaaauuaac

SEQ ID NO: 410086 - RNA, 64 nt, hsa
uaauuuggagcauaguaccauagaaauuugggguucuaaauauacaacuuguaagaagaauggu

SEQ ID NO: 410087 - RNA, 64 nt, hsa
gaguuuacuuuuuuuguauuaauacauugcuauuucuaaauaccacuuuccucaucuacuagua

SEQ ID NO: 410088 - RNA, 64 nt, hsa
uuuuguuaaggcauauucuuucgaaaauauagauucuaaauaaauaggggcuuauacaaaaaag

SEQ ID NO: 410089 - RNA, 64 nt, hsa
uuaguugaguuuuuaauguuuacauguuuacaucucuaaauaaaauuugcuuauuugaaauguu

SEQ ID NO: 410090 - RNA, 64 nt, hsa
aaagcuaccuuucuuuugauuauguacacagauaucuaaauaaggaaguaugaguuucacaugu

SEQ ID NO: 410091 - RNA, 64 nt, hsa
auauuauuaagauggguuggaggauuggcgaguuucuaaauauuaagacacugaucacuaaaug

SEQ ID NO: 410092 - RNA, 64 nt, hsa
auucuugucaguccuugcuauguagaaugacuauucuaaauauuaauguauuaaaaagaaaaua

SEQ ID NO: 410093 - RNA, 64 nt, hsa
ucauuacacuagggagaaauuuaucagcuuuaguucuaaauaugcucaugagguauaaaagcua

SEQ ID NO: 410094 - RNA, 64 nt, hsa
uuuccccccucuuucacuucuaaauauuuugcuuucuaaauacuagccuucugguucacaguga

SEQ ID NO: 410095 - RNA, 64 nt, hsa
uuguagaucauucuuuuuuccccccucuuucacuucuaaauauuuugcuuucuaaauacuagcc

SEQ ID NO: 410096 - RNA, 64 nt, hsa
uucuuuccuuaaaaauauuuuuuuuucaccuaggucuaaauagcuaacuaacugguagaccaga

SEQ ID NO: 410097 - RNA, 64 nt, hsa
gaaugauuuucaaguuugaauuucuguacaaauaucuaaauaagagaugugcagagagcaccaa

SEQ ID NO: 410098 - RNA, 64 nt, hsa
agagcaauuggaagagaauaugaaaaaacuggaaucuaaauagucagugaggaaggcuuugaua

SEQ ID NO: 410099 - RNA, 64 nt, hsa
uuaugaaaugugagagaggcucgccacuaaguauucuaaauacuuuucaauggcuuuucuaaca

SEQ ID NO: 410100 - RNA, 64 nt, hsa
uacaacuuauucuaaauauuuucauuuucuguguucuaaauagaaauauuaaguugcaguaaaa

SEQ ID NO: 410101 - RNA, 64 nt, hsa
uagugauuuauuugucaucaaauguacaacuuauucuaaauauuuucauuuucuguguucuaaa

SEQ ID NO: 410102 - RNA, 64 nt, hsa
gcacuccagcuuggugacagagugagauccugucucuaaauaaauaaauaaaaugcgggccagg

SEQ ID NO: 410103 - RNA, 64 nt, hsa
acugaguuaacucugucagauugcugcaaacauuucuaaauacuugcucuugguaucuauaacu

SEQ ID NO: 410104 - RNA, 64 nt, hsa
uuugcauuaauuugccaauacucuuauucuuuguucuaaauaaagugacuagaauuuuugugua

SEQ ID NO: 410105 - RNA, 64 nt, hsa
accaacugcauuuaacaaaacuccucuaaguacuucuaaauauucugugcaaauaucuugagaa

SEQ ID NO: 410106 - RNA, 64 nt, hsa; identical to SEQ ID NO: 265087

SEQ ID NO: 410107 - RNA, 64 nt, hsa; identical to SEQ ID NO: 265088

SEQ ID NO: 410108 - RNA, 64 nt, hsa; identical to SEQ ID NO: 265089

SEQ ID NO: 410109 - RNA, 64 nt, hsa; identical to SEQ ID NO: 265090

SEQ ID NO: 410110 - RNA, 64 nt, hsa; identical to SEQ ID NO: 265091

SEQ ID NO: 410111 - RNA, 64 nt, hsa; identical to SEQ ID NO: 265092

SEQ ID NO: 410112 - RNA, 64 nt, hsa; identical to SEQ ID NO: 265093

SEQ ID NO: 410113 - RNA, 61 nt, hsa; identical to SEQ ID NO: 265094

SEQ ID NO: 410114 - RNA, 64 nt, hsa; identical to SEQ ID NO: 265095

SEQ ID NO: 410115 - RNA, 64 nt, hsa; identical to SEQ ID NO: 265096

SEQ ID NO: 410116 - RNA, 64 nt, hsa; identical to SEQ ID NO: 265097

SEQ ID NO: 410117 - RNA, 64 nt, hsa; identical to SEQ ID NO: 265098

SEQ ID NO: 410118 - RNA, 64 nt, hsa; identical to SEQ ID NO: 265099

SEQ ID NO: 410119 - RNA, 64 nt, hsa; identical to SEQ ID NO: 265100

SEQ ID NO: 410120 - RNA, 64 nt, hsa; identical to SEQ ID NO: 265101

SEQ ID NO: 410121 - RNA, 64 nt, hsa; identical to SEQ ID NO: 265102

SEQ ID NO: 410122 - RNA, 64 nt, hsa; identical to SEQ ID NO: 265103

SEQ ID NO: 410123 - RNA, 64 nt, hsa; identical to SEQ ID NO: 265104

SEQ ID NO: 410124 - RNA, 64 nt, hsa; identical to SEQ ID NO: 265105

SEQ ID NO: 410125 - RNA, 64 nt, hsa; identical to SEQ ID NO: 265106

SEQ ID NO: 410126 - RNA, 64 nt, hsa; identical to SEQ ID NO: 265107

SEQ ID NO: 410127 - RNA, 64 nt, hsa; identical to SEQ ID NO: 265108

SEQ ID NO: 410128 - RNA, 64 nt, hsa; identical to SEQ ID NO: 265109

SEQ ID NO: 410129 - RNA, 64 nt, hsa; identical to SEQ ID NO: 265110

SEQ ID NO: 410130 - RNA, 64 nt, hsa; identical to SEQ ID NO: 84166

SEQ ID NO: 410131 - RNA, 64 nt, hsa; identical to SEQ ID NO: 84167

SEQ ID NO: 410132 - RNA, 64 nt, hsa; identical to SEQ ID NO: 84168

SEQ ID NO: 410133 - RNA, 64 nt, hsa; identical to SEQ ID NO: 84169

SEQ ID NO: 410134 - RNA, 64 nt, hsa; identical to SEQ ID NO: 84170

SEQ ID NO: 410135 - RNA, 64 nt, hsa; identical to SEQ ID NO: 84171

SEQ ID NO: 410136 - RNA, 64 nt, hsa; identical to SEQ ID NO: 84172

SEQ ID NO: 410137 - RNA, 64 nt, hsa; identical to SEQ ID NO: 84173

SEQ ID NO: 410138 - RNA, 64 nt, hsa; identical to SEQ ID NO: 84174

SEQ ID NO: 410139 - RNA, 64 nt, hsa; identical to SEQ ID NO: 84175

SEQ ID NO: 410140 - RNA, 64 nt, hsa; identical to SEQ ID NO: 84176

SEQ ID NO: 410141 - RNA, 64 nt, hsa; identical to SEQ ID NO: 84177

SEQ ID NO: 410142 - RNA, 64 nt, hsa; identical to SEQ ID NO: 84178

SEQ ID NO: 410143 - RNA, 64 nt, hsa; identical to SEQ ID NO: 84179

SEQ ID NO: 410144 - RNA, 64 nt, hsa; identical to SEQ ID NO: 84180

SEQ ID NO: 410145 - RNA, 64 nt, hsa; identical to SEQ ID NO: 84181

SEQ ID NO: 410146 - RNA, 64 nt, hsa; identical to SEQ ID NO: 84182

SEQ ID NO: 410147 - RNA, 64 nt, hsa; identical to SEQ ID NO: 84183

SEQ ID NO: 410148 - RNA, 64 nt, hsa; identical to SEQ ID NO: 84184

SEQ ID NO: 410149 - RNA, 64 nt, hsa; identical to SEQ ID NO: 84185

SEQ ID NO: 410150 - RNA, 64 nt, hsa; identical to SEQ ID NO: 84186

SEQ ID NO: 410151 - RNA, 64 nt, hsa; identical to SEQ ID NO: 84187

SEQ ID NO: 410152 - RNA, 64 nt, hsa; identical to SEQ ID NO: 84188

SEQ ID NO: 410153 - RNA, 64 nt, hsa; identical to SEQ ID NO: 84189

SEQ ID NO: 410154 - RNA, 64 nt, hsa; identical to SEQ ID NO: 84190

SEQ ID NO: 410155 - RNA, 64 nt, hsa; identical to SEQ ID NO: 84191

SEQ ID NO: 410156 - RNA, 64 nt, hsa; identical to SEQ ID NO: 84192

SEQ ID NO: 410157 - RNA, 64 nt, hsa; identical to SEQ ID NO: 84193

SEQ ID NO: 410158 - RNA, 64 nt, hsa; identical to SEQ ID NO: 84194

SEQ ID NO: 410159 - RNA, 64 nt, hsa; identical to SEQ ID NO: 84195

SEQ ID NO: 410160 - RNA, 64 nt, hsa; identical to SEQ ID NO: 84196

SEQ ID NO: 410161 - RNA, 64 nt, hsa; identical to SEQ ID NO: 84197

SEQ ID NO: 410162 - RNA, 64 nt, hsa; identical to SEQ ID NO: 84198

SEQ ID NO: 410163 - RNA, 64 nt, hsa; identical to SEQ ID NO: 84199

SEQ ID NO: 410164 - RNA, 64 nt, hsa; identical to SEQ ID NO: 84200

SEQ ID NO: 410165 - RNA, 64 nt, hsa; identical to SEQ ID NO: 84201

SEQ ID NO: 410166 - RNA, 64 nt, hsa; identical to SEQ ID NO: 84202

SEQ ID NO: 410167 - RNA, 64 nt, hsa; identical to SEQ ID NO: 84203

SEQ ID NO: 410168 - RNA, 64 nt, hsa; identical to SEQ ID NO: 84204

SEQ ID NO: 410169 - RNA, 64 nt, hsa; identical to SEQ ID NO: 84205

SEQ ID NO: 410170 - RNA, 64 nt, hsa; identical to SEQ ID NO: 84206

SEQ ID NO: 410171 - RNA, 64 nt, hsa; identical to SEQ ID NO: 84207

SEQ ID NO: 410172 - RNA, 64 nt, hsa; identical to SEQ ID NO: 84208

SEQ ID NO: 410173 - RNA, 64 nt, hsa; identical to SEQ ID NO: 84209

SEQ ID NO: 410174 - RNA, 64 nt, hsa; identical to SEQ ID NO: 84210

SEQ ID NO: 410175 - RNA, 64 nt, hsa; identical to SEQ ID NO: 84211

SEQ ID NO: 410176 - RNA, 64 nt, hsa; identical to SEQ ID NO: 84212

SEQ ID NO: 410177 - RNA, 64 nt, hsa; identical to SEQ ID NO: 84213

SEQ ID NO: 410178 - RNA, 64 nt, hsa; identical to SEQ ID NO: 84214

SEQ ID NO: 410179 - RNA, 64 nt, hsa; identical to SEQ ID NO: 84215

SEQ ID NO: 410180 - RNA, 64 nt, hsa; identical to SEQ ID NO: 84216

SEQ ID NO: 410181 - RNA, 64 nt, hsa; identical to SEQ ID NO: 84217

SEQ ID NO: 410182 - RNA, 64 nt, hsa; identical to SEQ ID NO: 84218

SEQ ID NO: 410183 - RNA, 64 nt, hsa; identical to SEQ ID NO: 84219

SEQ ID NO: 410184 - RNA, 64 nt, hsa; identical to SEQ ID NO: 84220

SEQ ID NO: 410185 - RNA, 64 nt, hsa; identical to SEQ ID NO: 84221

SEQ ID NO: 410186 - RNA, 64 nt, hsa; identical to SEQ ID NO: 84222

SEQ ID NO: 410187 - RNA, 64 nt, hsa; identical to SEQ ID NO: 84223

SEQ ID NO: 410188 - RNA, 64 nt, hsa; identical to SEQ ID NO: 84224

SEQ ID NO: 410189 - RNA, 64 nt, hsa; identical to SEQ ID NO: 84225

SEQ ID NO: 410190 - RNA, 64 nt, hsa; identical to SEQ ID NO: 84226

SEQ ID NO: 410191 - RNA, 64 nt, hsa; identical to SEQ ID NO: 84227

SEQ ID NO: 410192 - RNA, 64 nt, hsa; identical to SEQ ID NO: 84228

SEQ ID NO: 410193 - RNA, 64 nt, hsa; identical to SEQ ID NO: 84229

SEQ ID NO: 410194 - RNA, 64 nt, hsa; identical to SEQ ID NO: 84230

SEQ ID NO: 410195 - RNA, 64 nt, hsa; identical to SEQ ID NO: 84231

SEQ ID NO: 410196 - RNA, 64 nt, hsa; identical to SEQ ID NO: 84232

SEQ ID NO: 410197 - RNA, 64 nt, hsa; identical to SEQ ID NO: 84233

SEQ ID NO: 410198 - RNA, 64 nt, hsa
ccugguugggugggugguggauucuuggacgugugugucauacaagcauagacuggauuaaaga

SEQ ID NO: 410199 - RNA, 64 nt, hsa
gcccucgaggccacaguuaugcaacuuucagugugugucauaacgacgucacugcuuuuuaaac

SEQ ID NO: 410200 - RNA, 64 nt, hsa
cuacuguaaauuucccauaauuauguguguauaugugucauauguauguacauguauaugucua

SEQ ID NO: 410201 - RNA, 64 nt, hsa
gauagccaagcaguuuguauaauuucugucacuagugucauacaguuuucuggucaacaugugu

SEQ ID NO: 410202 - RNA, 64 nt, hsa
cauuuuagagcaaggccuaagggcacagguauuagugucauauugaucagaauucaaccuuugu

SEQ ID NO: 410203 - RNA, 64 nt, hsa
guguagacuuacuuuaaguuugcacccuugaaaugugucauaucaauuucuggauucauaauag

SEQ ID NO: 410204 - RNA, 64 nt, hsa
caauuaauggauauuuccuuguuaauaaaauuuugugucauaauuuacaaauuaguucuuuaaa

SEQ ID NO: 410205 - RNA, 64 nt, hsa
agcaguucugagauguggugacucaugugaaguggugucauaggaaugaaggacugugggcgcu

SEQ ID NO: 410206 - RNA, 64 nt, hsa
aacauccuuugcggucccaguccaagguaggcuggugucauagucuucucacuccuaauccaug

SEQ ID NO: 410207 - RNA, 64 nt, hsa
uucaucaaguuucacaucuaaguugaaacagggugugucauaaagucaguuaucucuaauaacu

SEQ ID NO: 410208 - RNA, 64 nt, hsa
uuuuguauuucucuauuuucauaaucaguaaauagugucauauaaacucauuuaucuccucuuc

SEQ ID NO: 410209 - RNA, 64 nt, hsa
cuguuuuguuuuguuuuaaucuuagcuuuuaauagugucauaaagauuauaauaugugccuuaa

SEQ ID NO: 410210 - RNA, 64 nt, hsa
gcuuucaaaauaaggaugacuuuagaauaauauugugucauagaauuaauuuucagccaugugg

SEQ ID NO: 410211 - RNA, 64 nt, hsa
aauauucaaugaacuuccauuuguauucaaauuugugucauaccagaaagcucuacauuugcag

SEQ ID NO: 410212 - RNA, 64 nt, hsa
guauaguaugcuccagugacagauggauuagggugugucauacuagggugugagagagguaggu

SEQ ID NO: 410213 - RNA, 64 nt, hsa
cacauaggcaggaccagauccacaucgugcagucgugucauaaaaaaacaaaacaaaacaaaaa

SEQ ID NO: 410214 - RNA, 64 nt, hsa
cauucaucaagcuguacauuuggugcacuuuucugugucauaccacaauaaaaaaaaaccuagc

SEQ ID NO: 410215 - RNA, 64 nt, hsa
cacagaaugcugcugcuccucuuaaaaauuaaaugugucauauuauauucuuuaaacuuacugu

SEQ ID NO: 410216 - RNA, 64 nt, hsa
aacaaggacucugguuacccuugccuccacccaugugucauaagaguaggcuacagaggugacc

SEQ ID NO: 410217 - RNA, 64 nt, hsa
cagaguuaacauuucuccccucacucccuugcuggugucauaguuauuagaaucagcagccucu

SEQ ID NO: 410218 - RNA, 64 nt, hsa
uuagcuguuacauaauaaauguggguacccucuagugucauauaugaauucuucaagaagaccu

SEQ ID NO: 410219 - RNA, 64 nt, hsa
aauuugguucugggaaacugaaacucacaguaaugugucauaucaucccugcaaaaauuaauac

SEQ ID NO: 410220 - RNA, 64 nt, hsa
uuaaauacuuuguacuaacuuuaucacacuuacugugucauagaauaucauacaguuuauacgc

SEQ ID NO: 410221 - RNA, 64 nt, hsa
uguuaaaucuaccaguuuaugucuuguaaacagagugucauauguauuuaaguuguguauuuuu

SEQ ID NO: 410222 - RNA, 64 nt, hsa
aagaaccagaaauuauaucuguuuuggagcaagagugucauaauguuucaggguagucaaaaua

SEQ ID NO: 410223 - RNA, 64 nt, hsa
uugcguucgggugcaccccuguuaaaccugaucugugucauaagugacuccggaugcaucagug

SEQ ID NO: 410224 - RNA, 64 nt, hsa
cuuuuccauuauacgguuugaaggcuguaauacagugucauauuauuuuucuguuuaaauugau

SEQ ID NO: 410225 - RNA, 64 nt, hsa
uccuguccaugaccuugggcacagggaaguucuggugucauagauaucccguuuugugagguag

SEQ ID NO: 410226 - RNA, 64 nt, hsa
auauguuuaugugguaucugacaauguguauuaggugucauauacaaugguaauaugccugucu

SEQ ID NO: 410227 - RNA, 64 nt, hsa
auaaaugaagaugcauuuuaaaugucuauaaauggugucauaacuagagcacgggcguuaugua

SEQ ID NO: 410228 - RNA, 64 nt, hsa
gauaagaaagccauccuaguuuuuaucucaagaugugucauaccgucuguaaugaagcaggcau

SEQ ID NO: 410229 - RNA, 64 nt, hsa
cuccucagccgaugguggcucuggguuuccuugagugucauauguccuagaaaguugcuggcug

SEQ ID NO: 410230 - RNA, 64 nt, hsa
uuauaguccaaauuugcaaacccuacaacucugggugucauaggucuauuuuaagggaagagag

SEQ ID NO: 410231 - RNA, 64 nt, hsa
ugguugagggauuuuuuuauaaacaguuuuacuugugucauauuuuaaaauuacuaacugccau

SEQ ID NO: 410232 - RNA, 64 nt, hsa
aaaucaguagaguuggaaaagcuuuauaaccggugugucauaugcuugcuauuuaaagcugugu

SEQ ID NO: 410233 - RNA, 64 nt, hsa
gagagaaccucaugggcagaauauuauaaaaagagugucauauuccagcauuugaauuggaaag

SEQ ID NO: 410234 - RNA, 52 nt, hsa
uucuuagaaucuggaauuaacagugucauacauauuuguucuccauugauau

SEQ ID NO: 410235 - RNA, 64 nt, hsa
gugauuucuauugaguucaaauuaacuugcuuaagugucauacuuuacuggcuuugcccugcac

SEQ ID NO: 410236 - RNA, 64 nt, hsa
agagcggagaaacugggauuuauuuuucaaauuggugucauaauauuguguaaaaagggaagga

SEQ ID NO: 410237 - RNA, 64 nt, hsa
gcuauuuaaguuguacuguauuagaacacugggugugucauaccguuaucugugcagaauauau

SEQ ID NO: 410238 - RNA, 64 nt, hsa
gguccgacuucaaaauguguuguauuguccuacagugucauaaagaaccugaaaaugaacuuuu

SEQ ID NO: 410239 - RNA, 64 nt, hsa
gcuauuagucuacauguauuucuguaauaguauugugucauaucaauuuuuaagaugucuaaau

SEQ ID NO: 410240 - RNA, 64 nt, hsa
auacuuauuaaauaauuaauaagaaugugaauaagugucauacuuuugugauuugagccaucau

SEQ ID NO: 410241 - RNA, 64 nt, hsa
uuaauucuuuuauuguucaaucuguuagugagaugugucauagguauuaugucauuaguucaaa

SEQ ID NO: 410242 - RNA, 64 nt, hsa
gcaucagcuuucaucuguguaaguugacaccaaugugucauaauauucuuuauuuugggaaauu

SEQ ID NO: 410243 - RNA, 64 nt, hsa
uggaaguuuuguauauuuauuguauuaacacagagugucauaaaauaaaaugcuguuuacugga

SEQ ID NO: 410244 - RNA, 64 nt, hsa
ugggggcuuccagaccccggccccaccagggcuugugucauagggagcccuuugcacuccucgu

SEQ ID NO: 410245 - RNA, 64 nt, hsa
ugcuugauugaggugguguauuuggguugaaauugugucauaugugugugcuauccaucucgug

SEQ ID NO: 410246 - RNA, 64 nt, hsa
uuuuaagccuucauuugcaauucauguaacaguugugucauaaauuacacaauaaagcaguccu

SEQ ID NO: 410247 - RNA, 64 nt, hsa
ccggcgacacagugggggcuccucacuugcugcagugucauagcaauaaaaugugauucuuggg

SEQ ID NO: 410248 - RNA, 64 nt, hsa
gguaaaauuuaaaauuaauuuuaauuuaauacuagugucauagauacuuuuuguacaucaaaca

SEQ ID NO: 410249 - RNA, 64 nt, hsa
uggagaaaucauaugaaaagcauaguuggucuuggugucauauggaucagaggcacaagugcag

SEQ ID NO: 410250 - RNA, 64 nt, hsa
gcauggcagcacuuaugcucugugacaguauugugugucauaguugagcaguagcugguagaau

SEQ ID NO: 410251 - RNA, 64 nt, hsa
uugugaagagguguuuuuucuaauuggcaugaaggugucauacagauuugcaaaguuuaauggu

SEQ ID NO: 410252 - RNA, 64 nt, hsa
ccagaguuuuuaaucuuuagcauuuagggaggcagugucauaaaguaaaaagugugugggccuu

SEQ ID NO: 410253 - RNA, 64 nt, hsa
uuucucuauuacagcuuaaaguaugcuacaaucugugucauauaguuaauugauaagcauuuuu

SEQ ID NO: 410254 - RNA, 64 nt, hsa
ugggaagaagacaacuauaaauacauauucuugggugucauaaucaagaaagaggugacuucug

SEQ ID NO: 410255 - RNA, 64 nt, hsa
agagaugagcuuucuuuuuaaagcuuuugauguggugucauagaauagcauguuguagauacaa

SEQ ID NO: 410256 - RNA, 64 nt, hsa
ucuucacccaucaccuucugucguccucccaggggugucauauuuacagaggcaaacucuuaca

SEQ ID NO: 410257 - RNA, 64 nt, hsa
cucagugcuggggacaggaguuuugcccaacgcagugucauaaacuggguucaugggcuuaccc

SEQ ID NO: 410258 - RNA, 64 nt, hsa
auuucacauucacaguguauuuacaaaauacgcugugucauaaauauguuugaauuccaacagc

SEQ ID NO: 410259 - RNA, 64 nt, hsa
guaguaauguuagcuuguucuaaagcuauccauugugucauauuuacucuaaaaauuaaagaga

SEQ ID NO: 410260 - RNA, 64 nt, hsa
gcauacugcagauuggagggcaggaccacugagggugucauagacauuagcucuauggaauucu

SEQ ID NO: 410261 - RNA, 64 nt, hsa
cuuuuaaggucugacugacaaauucuguauuaaggugucauagcuaugacauuuguuaaaaaua

SEQ ID NO: 410262 - RNA, 64 nt, hsa
cuggggguaccugugcccugaaguccuggccccugugucauagccccaaguacgacucacugag

SEQ ID NO: 410263 - RNA, 64 nt, hsa
agaaagaaggagagaaugagugagugcuugaaaugugucauacuguuuuaggaucaagacuagg

SEQ ID NO: 410264 - RNA, 64 nt, hsa
gaccagguuauuuuaaaaagauuuguuuugucaagugucauauguaggugucugcacccagggg

SEQ ID NO: 410265 - RNA, 64 nt, hsa
accuccggugugagauauacaaauauauuuaauugugucauauuaaacuucugauuucacauuc

SEQ ID NO: 410266 - RNA, 64 nt, hsa
ccaccuguauguagcacgccaugcugggccagcagugucauaggaguggagggggauaaguggg

SEQ ID NO: 410267 - RNA, 64 nt, hsa
aucuacaguaaugaaauguuuacuaaguggacuggugucauaaacuuucuccauuuaagacaca

SEQ ID NO: 410268 - RNA, 64 nt, hsa
cucggcuagcaucagcaccacuauagcacuguccgugucauaugagucacuaauauuaacucca

SEQ ID NO: 410269 - RNA, 64 nt, hsa
aauggaccagaaaagaaaagaaaccauaaauaucgugucauauuuuccccaagauuaaccaaaa

SEQ ID NO: 410270 - RNA, 64 nt, hsa
gcacaaagcauugcuuggguuggucaaaugucuugugucauaaauauauucugauguuucccag

SEQ ID NO: 410271 - RNA, 64 nt, hsa
guuuuucucaucagacucugaguaacugguugcugugucauaacuucauagaugcaggaggcuc

SEQ ID NO: 410272 - RNA, 64 nt, hsa
ugagagguggcugugaauuauaaaccucauaaaagugucauaauuccauuaagguuuaauuaua

SEQ ID NO: 410273 - RNA, 64 nt, hsa
auaaguuuuuugguguguuuucugggucgucuaugugucauaugguuuuacuuuucucuccuuu

SEQ ID NO: 410274 - RNA, 64 nt, hsa
agagcaguauugcuguaguaggaauguuuuaacagugucauaugaaaaagaacaaaauaaauau

SEQ ID NO: 410275 - RNA, 64 nt, hsa
uguacuggcaaauggugguauucagugugggauagugucauaacuaauuugacaauuuauuaau

SEQ ID NO: 410276 - RNA, 64 nt, hsa
gccagggaauaaaaccagagggagaggacccucagugucauaucaggaagcccagugccagagg

SEQ ID NO: 410277 - RNA, 64 nt, hsa
acaggugacaggcugcuuucgugacuugauauuggugucauagcauuuggccuacauuaaaagc

SEQ ID NO: 410278 - RNA, 64 nt, hsa
ggcucuaccucaaagaccuuugcacaguuuauuggugucauauuauacaauauuucaauuguga

SEQ ID NO: 410279 - RNA, 64 nt, hsa
accccugacucggggacuugggauguuccucuuggugucauauuccaacucagauugagcccua

SEQ ID NO: 410280 - RNA, 64 nt, hsa
uagagcuuuagugucuacaugaguaucuugugaagugucauaacaggcauaacauauuuuuaug

SEQ ID NO: 410281 - RNA, 64 nt, hsa
uucaguaagccaaucauuuguaaccauucuagcagugucauauuagguuaauaaggcugcugug

SEQ ID NO: 410282 - RNA, 64 nt, hsa
gagaccacaaccauauucaauaucauaccauaaugugucauagcuauaggcacaagaaaaacaa

SEQ ID NO: 410283 - RNA, 64 nt, hsa
uugcaugaaacauugggguuucuucaaaaugugugugucauacuucuuuugggagggggguugu

SEQ ID NO: 410284 - RNA, 64 nt, hsa
cacacagugucuuucuccuguuugaaaagaaauugugucauauuggugugcuguucuugcauag

SEQ ID NO: 410285 - RNA, 64 nt, hsa
gugcucuucaucaacuaauagagcaccuaccacagugucauaccugguagaggugagcaauuca

SEQ ID NO: 410286 - RNA, 64 nt, hsa
aagcugcugggcaguggugcagcauuccuaccuagugucauaaaagcaaaauacuuacauagcu

SEQ ID NO: 410287 - RNA, 64 nt, hsa
uauauuguaacuuccccucaccccaguugcaauugugucauagucaucuguauaucaaacuauu

SEQ ID NO: 410288 - RNA, 64 nt, hsa
gcccugugcccugcacuuucuucacuguguucaagugucauagcuaucaggccacuaucaugga

SEQ ID NO: 410289 - RNA, 64 nt, hsa
uggaaggcuggagugcccagggagagguauagaggugucauaggcauuaguguaguaauuggag

SEQ ID NO: 410290 - RNA, 64 nt, hsa
cacuuuguucagauuuuguuuccaggcauuaagugugucauacaguuguugccacugcuguuuu

SEQ ID NO: 410291 - RNA, 64 nt, hsa
uauaauuuugugcaguaccaaugacaaaaauauggugucauaauaaaaccagguuuguugaucu

SEQ ID NO: 410292 - RNA, 64 nt, hsa
ucuacuucuggagucuauaaaauguuuuuaaacagugucauauacaauugucauguaugugaaa

SEQ ID NO: 410293 - RNA, 64 nt, hsa
cugcuuuaauauuuuaaauaagauaauaugugaggugucauaaaaaccuucaucaaaucccuau

SEQ ID NO: 410294 - RNA, 64 nt, hsa
acaaaguuguacauccugaaccccaaagccgugagugucauagaacucuacggcauccuggacc

SEQ ID NO: 410295 - RNA, 64 nt, hsa
uuucucggugguuauucugauaucccauuuuggugugucauaauacuucaaacuggaaagucac

SEQ ID NO: 410296 - RNA, 64 nt, hsa
augacuuuggcgaaugcagaaagguugcuaucaagugucauacuuucugacacuuuugaggaug

SEQ ID NO: 410297 - RNA, 64 nt, hsa
uaaccuuauaacugcucucuagucugccuuauuugugucauagaguaagauauuccuugaaagc

SEQ ID NO: 410298 - RNA, 64 nt, hsa
augugguuggcaacaaaccagcaacuauuuagaagugucauaagaguucauucuuugaguauug

SEQ ID NO: 410299 - RNA, 64 nt, hsa
cccacgcaagaugugacaauguuugagaaaaggugugucauacucagugacuucaauuugcaaa

SEQ ID NO: 410300 - RNA, 64 nt, hsa
cuguggaauacagaccguguaacuggacagcugagugucauaaacucuaaaauaguccaggcua

SEQ ID NO: 410301 - RNA, 64 nt, hsa
uaaagauugaguggaauucuagauguggucauuugugucauaauuuuuuuguuuuauuuuguuu

SEQ ID NO: 410302 - RNA, 64 nt, hsa
ggaauuugaaaaagauaauuauaaugccugcaaugugucauauacucgcacaacuuaaauaggu

SEQ ID NO: 410303 - RNA, 64 nt, hsa
caaaauuguuuuucuaugggauguucuggcagcugugucauaaaaugcugcuggguucauucau

SEQ ID NO: 410304 - RNA, 64 nt, hsa
cugacuuccuaccucccccuccaucucuagauaagugucauauauuuguugagggcaaaagacu

SEQ ID NO: 410305 - RNA, 64 nt, hsa
ucuaugaugugaaacacuuugccuccuguguacugugucauaaacagaugaauaaacugaauuu

SEQ ID NO: 410306 - RNA, 64 nt, hsa
uucugagguccugugcccuuuacuugcuggugaggugucauagguagaaaagggcuggcccuuc

SEQ ID NO: 410307 - RNA, 64 nt, hsa
gggaaugcaagacuagugcauaaaaaugcaauaggugucauauguacagcauucuucuuagagu

SEQ ID NO: 410308 - RNA, 64 nt, hsa
uguuuuauauauuaucuaaauauauguauaugcugugucauacucauaaucuggaaaugaauaa

SEQ ID NO: 410309 - RNA, 64 nt, hsa
cugcuaggugggccagccccucccaccacagcaggugucauauauggggggccaacaccaggga

SEQ ID NO: 410310 - RNA, 64 nt, hsa
ggguacauuuuauaaaaaggcagauucuaguucagugucauaaggaacuuucuaguaauuagag

SEQ ID NO: 410311 - RNA, 64 nt, hsa
uccucgucaauccaucagcaaugcuucucucauagugucauagacuugggaaacccaaccagua

SEQ ID NO: 410312 - RNA, 64 nt, hsa
cugauaacaaugaaagugguaaaucaguguaaaagugucauauucucagacuugugaggcgguu

SEQ ID NO: 410313 - RNA, 64 nt, hsa
uaggacuucaaaaggugauuaaauauuuaaugaugugucauaugaguccucaagcuucucagac

SEQ ID NO: 410314 - RNA, 64 nt, hsa
ccucaggacccccuggcucaguucuugaaaaacggugucauauuuagucagaggccccaccccc

SEQ ID NO: 410315 - RNA, 64 nt, hsa
acuuugucccauuucuaaaggccucuuccuugcugugucauaccaggccgccccagccucugag

SEQ ID NO: 410316 - RNA, 64 nt, hsa
uggacuguuucaagguccauggaguacggcuggugugucauacugugcaggccugucccuggga

SEQ ID NO: 410317 - RNA, 64 nt, hsa
uacagauuucugucgucugaauacacaaaaaguugugucauaacuuacccagauauguuuuucu

SEQ ID NO: 410318 - RNA, 64 nt, hsa
cagguccuccuagugaagcuuaguuugacaaagggugucauaugcuuuccuaaccugauuugua

SEQ ID NO: 410319 - RNA, 64 nt, hsa
acauaguauuauuuuacuaagagaauaucucuuggugucauaucuaggggaagagaauuaacua

SEQ ID NO: 410320 - RNA, 64 nt, hsa
ucaaauccuaaagagugaauguguuagaauugcagugucauaccaaauaacauucaaaagaaau

SEQ ID NO: 410321 - RNA, 64 nt, hsa
uuucuaacuauauuacuguaggacuggauauuaggugucauauaggaaacacaaaaguuuauug

SEQ ID NO: 410322 - RNA, 64 nt, hsa
acucaccauuaugauauuuaucuugaaagaaauggugucauaccugccuagaaacugaaauuuu

SEQ ID NO: 410323 - RNA, 64 nt, hsa
auaaucuaggauuuauuugguauuaauaauuuaggugucauauuagcugaauacuauccucuau

SEQ ID NO: 410324 - RNA, 64 nt, hsa
ucuccaggauucugaugaacaagaccaucaggaggugucauacgcauaauuggaucacuguguu

SEQ ID NO: 410325 - RNA, 64 nt, hsa
ccucauucggguaaaccagcaaccuccagcaugggugucauagccaucacgagcaugucacagu

SEQ ID NO: 410326 - RNA, 64 nt, hsa
aagacauuuaccgucaucccuaucccaucacuuugugucauacuggacaagacgcuuaacugcu

SEQ ID NO: 410327 - RNA, 64 nt, hsa
ggggagggcguggaaauagggauucugugucuuugugucauaacuuugaugggggcagugaggg

SEQ ID NO: 410328 - RNA, 64 nt, hsa
aaaccuuugugagacagagaacagggaauuaaaugugucauacauauccacuugagggcgauuu

SEQ ID NO: 410329 - RNA, 64 nt, hsa
agugaagggcgugcccugugugccgggguccauggugucauaugcagugacacacacugucaag

SEQ ID NO: 410330 - RNA, 64 nt, hsa
uagagucugagggcuuguaguucuuuaaacugucgugucauacucgagucugaggccguugcug

SEQ ID NO: 410331 - RNA, 64 nt, hsa
cuccaagcagagagaauggcaugugugaaggugugugucauacacagggccuaguacauagugg

SEQ ID NO: 410332 - RNA, 64 nt, hsa
acuaauuguaagguauugcaaggucacuuugcgugugucauaaaguugacuuccuuauugguug

SEQ ID NO: 410333 - RNA, 64 nt, hsa
caacagacuggguuauuuauuuaagauguguauugugucauaugaaguuuaagagacauaaaug

SEQ ID NO: 410334 - RNA, 64 nt, hsa
caaauuuacauucacaaauucaguauccuguuaagugucauauucuuguaaucugcauucucca

SEQ ID NO: 410335 - RNA, 64 nt, hsa
uacaauagaugaguauuuuuacuauuuguauuaagugucauaauagcaucaaugugcacauuac

SEQ ID NO: 410336 - RNA, 64 nt, hsa
ggcaguccccagauuucaaccugaauugugaaaugugucauaagaaacaaaauauuuuuuaaac

SEQ ID NO: 410337 - RNA, 64 nt, hsa
ucucuuuguuuuaucagugccaagaugaccuguugugucauauaauuuaagcagagcuuagcau

SEQ ID NO: 410338 - RNA, 64 nt, hsa
uuuuuuuuuuaccauuuaugauuuauucuccuaugugucauaugaaaggccaaggggcuuuauc

SEQ ID NO: 410339 - RNA, 64 nt, hsa
ucccuugucuuugccaaguucuccacuagcuauggugucauaggcucuuuugggauuuuugaag

SEQ ID NO: 410340 - RNA, 64 nt, hsa
uacccauucuuuaauucagcaucucccuauguaugugucauagaauacuuaguucugcuagaua

SEQ ID NO: 410341 - RNA, 64 nt, hsa
agaaggcaugaagacuuuuuucccugcauggagagugucauaaguuauuguuuugcauaucuac

SEQ ID NO: 410342 - RNA, 64 nt, hsa
gaaugagaaaggugugcuggucauggaauggcaggugucauaugacugauuacucagagcagau

SEQ ID NO: 410343 - RNA, 64 nt, hsa
uacaguguguuauaguguuaauccuugugcauaugugucauaauacaacuauuucuguaaagaa

SEQ ID NO: 410344 - RNA, 64 nt, hsa
guggggguggaccgaauuuggcaagaaugaaauggugucauaaagaugggaggggaggguguuu

SEQ ID NO: 410345 - RNA, 64 nt, hsa
uacaacuaagaugcuguaguucuaucuuugcaaugugucauaaauucucuucuuuuucccccuu

SEQ ID NO: 410346 - RNA, 64 nt, hsa
uauauugcauagaauguuggccuugcagcauuuggugucauaugcaguagccaguggauaaacu

SEQ ID NO: 410347 - RNA, 64 nt, hsa
agacuugcauaagagacggacgcgugguugcaaggugucauacugauaugcagcauuaacuuua

SEQ ID NO: 410348 - RNA, 63 nt, hsa
aggcguuuuugagaguggaaaagaaauuuaaacuucccgaaagaagguccaccaucaggagau

SEQ ID NO: 410349 - RNA, 63 nt, hsa
guuuggugccaaggcucaggcuguauuggcaaauucccgaaaguuuucccacuuugccuggcc

SEQ ID NO: 410350 - RNA, 63 nt, hsa
gucuucucacgcccucuccucuggggccucgucuucccgaagguccccuucuccagugcuucc

SEQ ID NO: 410351 - RNA, 63 nt, hsa
uugaacuuucuauacuuuuauaaauguuacaaauucccgaaagaagggaauuucuuuuucugg

SEQ ID NO: 410352 - RNA, 63 nt, hsa
cgucauuuuauauuuagaucuccuguauucuuguucccgaaguaaaauacgaucgguuucaua

SEQ ID NO: 410353 - RNA, 63 nt, hsa
cucuauuuuaaacugagccuucuuuuuaauauauucccgaagagauauguaaauaagcucuca

SEQ ID NO: 410354 - RNA, 63 nt, hsa
cgcaggcaucucuuguuaccuacaucuaagcuguucccgaaagaguguuacagaacacaacag

SEQ ID NO: 410355 - RNA, 63 nt, hsa
uuugagugacucaggugaaauuuagagucauauuucccgaagcagaaguuaaagaaaauuuuu

SEQ ID NO: 410356 - RNA, 63 nt, hsa
gauggguggaccaaacccuuagcagcccagcauuucccgaaggccgacaccacuccugccagc

SEQ ID NO: 410357 - RNA, 63 nt, hsa
uuuuuguuuuguuuuuguuuuuugccuugucgauucccgaauaaauuuuguguuccuucuuuu

SEQ ID NO: 410358 - RNA, 63 nt, hsa
uaaaaccugcagcugguggauugugaucacacauucccgaaguaauaagugaggacgaaugca

SEQ ID NO: 410359 - RNA, 63 nt, hsa
accaaccuuuucccaaccauacaaaaauuccuuuucccgaaggaaaagggcuuucucaauaag

SEQ ID NO: 410360 - RNA, 63 nt, hsa
cucgagguggugugcccagacccacagcccguguucccgaaguugcuaagugcccgagcgcag

SEQ ID NO: 410361 - RNA, 63 nt, hsa
gacaagcuaucaccgggaacccucccuguccccuucccgaaucacacacauacccuacccuca

SEQ ID NO: 410362 - RNA, 63 nt, hsa
gcuaaucaguaucaaaccaaagauuucuaucucuucccgaaagagaggguaugugcaccaguc

SEQ ID NO: 410363 - RNA, 63 nt, hsa
caucugcagccaggugugugccacacggcagccuucccgaaacauaguauggauuuuaaaaau

SEQ ID NO: 410364 - RNA, 63 nt, hsa
uguuagagcaacaugacaugcccagcaucccacuucccgaaaaugucuacuccuucuacucug

SEQ ID NO: 410365 - RNA, 63 nt, hsa
cauguagggugcagucuuuacucccuaacccguuucccgaaaaaggugcuaccuccuuuccag

SEQ ID NO: 410366 - RNA, 63 nt, hsa
uuaaucuuugagucuaacacaccacuuucugcuuucccgaaguucagauaacuggguuggcuc

SEQ ID NO: 410367 - RNA, 63 nt, hsa
agccccuggucuucuuaaauuuaaacacgggacuucccgaacuaauuuuuuuaaggauacuga

SEQ ID NO: 410368 - RNA, 63 nt, hsa
ccggguuggcucucccuggagaccucuccaucauucccgaaaaguggauggagagagugaugg

SEQ ID NO: 410369 - RNA, 63 nt, hsa
gacaccgguucugagcauuaguuugagaacucguucccgaaugugcuuuccucccucuccccu

SEQ ID NO: 410370 - RNA, 63 nt, hsa
aagaaacccgacagagggaagaaaagagcuuucuucccgaaccccaaggagggagauggauca

SEQ ID NO: 410371 - RNA, 63 nt, hsa
ggucgccaugaauccacuuugguuuuaaaaccauucccgaauguccuaguggauuguguugug

SEQ ID NO: 410372 - RNA, 63 nt, hsa
ccaccagauggauguugacuuggugucugggaguucccgaacccuagagccaggauguucugu

SEQ ID NO: 410373 - RNA, 63 nt, hsa
gguaaagacacgaaaacacuuccuccagggaccuucccgaaaacguucuggcucucaucuggu

SEQ ID NO: 410374 - RNA, 63 nt, hsa
gagaggaaaagcacagaaacgcuugagcagcccuucccgaaggagcagcugcggacggaggug

SEQ ID NO: 410375 - RNA, 63 nt, hsa
ucccuagaugguucccuuuguugcugucuggcuuucccgaaucuuuuuaggccaccuccaagg

SEQ ID NO: 410376 - RNA, 63 nt, hsa
gugaagcaguauggcuggcuggaucagcaccgauucccgaaagcuuuccaccucagccucaga

SEQ ID NO: 410377 - RNA, 63 nt, hsa
aggcugcacagucucugauaaugaagggcugccuucccgaagucagccgcugcccaucggccu

SEQ ID NO: 410378 - RNA, 63 nt, hsa
uacaagcagaucauucugccuuagaggugcuaauucccgaaauuagaagacccuuucuuuucc

SEQ ID NO: 410379 - RNA, 63 nt, hsa
cccgcuucauccccaccgucccacuccacagccuucccgaaacauucccuggcaaacaaagga

SEQ ID NO: 410380 - RNA, 63 nt, hsa
agaaugggaggagacaaggagcugaaggaguaguucccgaaggaccuugugggugauauagag

SEQ ID NO: 410381 - RNA, 63 nt, hsa
auggaaccuguguugagggcagaugccacaagauucccgaaccuccccaaaccccgcccuacu

SEQ ID NO: 410382 - RNA, 63 nt, hsa
ccaaaccuugcucucaucaccagcuagagcuucuucccgaagggccuuuaggauaggagaaag

SEQ ID NO: 410383 - RNA, 64 nt, hsa
ccaaagacuuuuuugaaaauaugcagaaauuugugguaauuauguauuugugucuugugacaau

SEQ ID NO: 410384 - RNA, 64 nt, hsa
gauuauuguccaaaggcuuuuauuuagagaaacggguaauuaaaacagcagcuuuagaauagcu

SEQ ID NO: 410385 - RNA, 64 nt, hsa
uugagacugaauuucuaaaaauugaaugccaaaguacaaguagaggaguuuuuuauuuuauaua

SEQ ID NO: 410386 - RNA, 64 nt, hsa
auuuucaucccaagaacacuuuaaggaaacauuuuacaaguaugcuugaaagaaugucacuaac

SEQ ID NO: 410387 - RNA, 64 nt, hsa
aauauuuaauaucaaaagaaaauugauauuuuuauacaaguaauuuccugagcuaaaugcuuca

SEQ ID NO: 410388 - RNA, 64 nt, hsa
gugagccaccgcacguagcauuuacauuagguauuacaaguaauguaaagaugauuuaaguaua

SEQ ID NO: 410389 - RNA, 64 nt, hsa
augaaauguuuuguagcuagaauaaaaucauuuuuacaaguacagcauucuuggaaagaauuua

SEQ ID NO: 410390 - RNA, 64 nt, hsa
aaaaaaagcccuauuucgcacuaacauuuuauuuuacaaguauuuuaaucuuauauuuugguau

SEQ ID NO: 410391 - RNA, 64 nt, hsa
acaguuauaacguacaaguacauuacauguauauuacaaguauauuacauguaaaacaggacaa

SEQ ID NO: 410392 - RNA, 64 nt, hsa
caaaaaguauuugaaauauauuacaguuauaacguacaaguacauuacauguauauuacaagua

SEQ ID NO: 410393 - RNA, 64 nt, hsa
cucuuuuuuccaacauaaaauucuuguuuuaagauacaaguaaaauuaaucuuuaaauauaaau

SEQ ID NO: 410394 - RNA, 64 nt, hsa
cagaacuucuguuucacaacaauuucucucucgcuacaaguauucuuucacucagcacugggga

SEQ ID NO: 410395 - RNA, 64 nt, hsa
aucagaauacggugguugagaaggaaccaguguuuacaaguaauaucagaaaguugaaggaacc

SEQ ID NO: 410396 - RNA, 64 nt, hsa
caaguaauaucagaaaguugaaggaaccaguguuuacaaguaauaccagaaaguugccaaaccc

SEQ ID NO: 410397 - RNA, 64 nt, hsa
uaccccaccaaacaaagucuugaagguauuauuuuacaaguauauuuuuaaaguuguuuuauaa

SEQ ID NO: 410398 - RNA, 64 nt, hsa
auauuuuaugucucaaaaguauaaaaaacuuuaauacaaguacauacauauuauauauacacau

SEQ ID NO: 410399 - RNA, 64 nt, hsa
gcacuguaauauguacacaacuuagaaaccaaauuacaaguauucaguuccaauacuucauuaa

SEQ ID NO: 410400 - RNA, 64 nt, hsa
uuuuuugcaaauuuguaaacuuugcuucuccaaauacaaguacuagguuguccauuuaugguac

SEQ ID NO: 410401 - RNA, 64 nt, hsa
uuaaaagacggaauuuugacucgugucuguaucauacaaguacaaauacuaauuuugcccuaug

SEQ ID NO: 410402 - RNA, 64 nt, hsa
aaaguggauauuccaggaauguuuugcagcuuuguacaaguaacauaaauuggacaccucagaa

SEQ ID NO: 410403 - RNA, 64 nt, hsa; identical to SEQ ID NO: 245345

SEQ ID NO: 410404 - RNA, 64 nt, hsa; identical to SEQ ID NO: 245346

SEQ ID NO: 410405 - RNA, 64 nt, hsa; identical to SEQ ID NO: 245347

SEQ ID NO: 410406 - RNA, 64 nt, hsa; identical to SEQ ID NO: 245348

SEQ ID NO: 410407 - RNA, 64 nt, hsa; identical to SEQ ID NO: 245349

SEQ ID NO: 410408 - RNA, 64 nt, hsa; identical to SEQ ID NO: 245350

SEQ ID NO: 410409 - RNA, 64 nt, hsa; identical to SEQ ID NO: 245351

SEQ ID NO: 410410 - RNA, 64 nt, hsa; identical to SEQ ID NO: 245352

SEQ ID NO: 410411 - RNA, 64 nt, hsa; identical to SEQ ID NO: 245353

SEQ ID NO: 410412 - RNA, 64 nt, hsa; identical to SEQ ID NO: 245354

SEQ ID NO: 410413 - RNA, 64 nt, hsa; identical to SEQ ID NO: 245355

SEQ ID NO: 410414 - RNA, 64 nt, hsa; identical to SEQ ID NO: 245356

SEQ ID NO: 410415 - RNA, 64 nt, hsa; identical to SEQ ID NO: 245357

SEQ ID NO: 410416 - RNA, 64 nt, hsa; identical to SEQ ID NO: 245358

SEQ ID NO: 410417 - RNA, 64 nt, hsa; identical to SEQ ID NO: 245359

SEQ ID NO: 410418 - RNA, 64 nt, hsa; identical to SEQ ID NO: 245360

SEQ ID NO: 410419 - RNA, 64 nt, hsa; identical to SEQ ID NO: 245361

SEQ ID NO: 410420 - RNA, 64 nt, hsa; identical to SEQ ID NO: 245362

SEQ ID NO: 410421 - RNA, 64 nt, hsa; identical to SEQ ID NO: 245363

SEQ ID NO: 410422 - RNA, 64 nt, hsa; identical to SEQ ID NO: 245364

SEQ ID NO: 410423 - RNA, 64 nt, hsa; identical to SEQ ID NO: 245365

SEQ ID NO: 410424 - RNA, 64 nt, hsa; identical to SEQ ID NO: 245366

SEQ ID NO: 410425 - RNA, 64 nt, hsa; identical to SEQ ID NO: 245367

SEQ ID NO: 410426 - RNA, 64 nt, hsa; identical to SEQ ID NO: 245368

SEQ ID NO: 410427 - RNA, 64 nt, hsa; identical to SEQ ID NO: 245369

SEQ ID NO: 410428 - RNA, 64 nt, hsa; identical to SEQ ID NO: 245370

SEQ ID NO: 410429 - RNA, 64 nt, hsa; identical to SEQ ID NO: 245371

SEQ ID NO: 410430 - RNA, 64 nt, hsa; identical to SEQ ID NO: 245372

SEQ ID NO: 410431 - RNA, 64 nt, hsa; identical to SEQ ID NO: 245373

SEQ ID NO: 410432 - RNA, 64 nt, hsa; identical to SEQ ID NO: 245374

SEQ ID NO: 410433 - RNA, 64 nt, hsa; identical to SEQ ID NO: 245375

SEQ ID NO: 410434 - RNA, 64 nt, hsa; identical to SEQ ID NO: 245376

SEQ ID NO: 410435 - RNA, 64 nt, hsa; identical to SEQ ID NO: 245377

SEQ ID NO: 410436 - RNA, 64 nt, hsa; identical to SEQ ID NO: 245378

SEQ ID NO: 410437 - RNA, 64 nt, hsa; identical to SEQ ID NO: 245379

SEQ ID NO: 410438 - RNA, 64 nt, hsa; identical to SEQ ID NO: 245380

SEQ ID NO: 410439 - RNA, 64 nt, hsa; identical to SEQ ID NO: 245381

SEQ ID NO: 410440 - RNA, 64 nt, hsa; identical to SEQ ID NO: 245382

SEQ ID NO: 410441 - RNA, 64 nt, hsa; identical to SEQ ID NO: 245383

SEQ ID NO: 410442 - RNA, 64 nt, hsa; identical to SEQ ID NO: 245384

SEQ ID NO: 410443 - RNA, 64 nt, hsa; identical to SEQ ID NO: 245385

SEQ ID NO: 410444 - RNA, 51 nt, hsa; identical to SEQ ID NO: 245386

SEQ ID NO: 410445 - RNA, 64 nt, hsa; identical to SEQ ID NO: 245387

SEQ ID NO: 410446 - RNA, 64 nt, hsa; identical to SEQ ID NO: 245388

SEQ ID NO: 410447 - RNA, 64 nt, hsa; identical to SEQ ID NO: 245389

SEQ ID NO: 410448 - RNA, 64 nt, hsa; identical to SEQ ID NO: 245390

SEQ ID NO: 410449 - RNA, 64 nt, hsa; identical to SEQ ID NO: 245391

SEQ ID NO: 410450 - RNA, 64 nt, hsa; identical to SEQ ID NO: 245392

SEQ ID NO: 410451 - RNA, 57 nt, hsa; identical to SEQ ID NO: 245393

SEQ ID NO: 410452 - RNA, 64 nt, hsa; identical to SEQ ID NO: 245394

SEQ ID NO: 410453 - RNA, 64 nt, hsa; identical to SEQ ID NO: 245395

SEQ ID NO: 410454 - RNA, 64 nt, hsa; identical to SEQ ID NO: 245396

SEQ ID NO: 410455 - RNA, 64 nt, hsa; identical to SEQ ID NO: 245397

SEQ ID NO: 410456 - RNA, 64 nt, hsa; identical to SEQ ID NO: 245398

SEQ ID NO: 410457 - RNA, 64 nt, hsa; identical to SEQ ID NO: 245399

SEQ ID NO: 410458 - RNA, 64 nt, hsa; identical to SEQ ID NO: 245400

SEQ ID NO: 410459 - RNA, 64 nt, hsa; identical to SEQ ID NO: 245401

SEQ ID NO: 410460 - RNA, 64 nt, hsa; identical to SEQ ID NO: 245402

SEQ ID NO: 410461 - RNA, 64 nt, hsa; identical to SEQ ID NO: 245403

SEQ ID NO: 410462 - RNA, 64 nt, hsa; identical to SEQ ID NO: 245404

SEQ ID NO: 410463 - RNA, 64 nt, hsa; identical to SEQ ID NO: 245405

SEQ ID NO: 410464 - RNA, 64 nt, hsa; identical to SEQ ID NO: 61376

SEQ ID NO: 410465 - RNA, 64 nt, hsa; identical to SEQ ID NO: 61377

SEQ ID NO: 410466 - RNA, 64 nt, hsa; identical to SEQ ID NO: 61378

SEQ ID NO: 410467 - RNA, 64 nt, hsa; identical to SEQ ID NO: 61379

SEQ ID NO: 410468 - RNA, 64 nt, hsa; identical to SEQ ID NO: 61380

SEQ ID NO: 410469 - RNA, 64 nt, hsa; identical to SEQ ID NO: 61381

SEQ ID NO: 410470 - RNA, 64 nt, hsa; identical to SEQ ID NO: 61382

SEQ ID NO: 410471 - RNA, 64 nt, hsa; identical to SEQ ID NO: 61383

SEQ ID NO: 410472 - RNA, 64 nt, hsa; identical to SEQ ID NO: 61384

SEQ ID NO: 410473 - RNA, 64 nt, hsa; identical to SEQ ID NO: 61384

SEQ ID NO: 410474 - RNA, 64 nt, hsa; identical to SEQ ID NO: 61386

SEQ ID NO: 410475 - RNA, 64 nt, hsa; identical to SEQ ID NO: 61387

SEQ ID NO: 410476 - RNA, 64 nt, hsa; identical to SEQ ID NO: 61388

SEQ ID NO: 410477 - RNA, 64 nt, hsa; identical to SEQ ID NO: 61389

SEQ ID NO: 410478 - RNA, 64 nt, hsa; identical to SEQ ID NO: 129112

SEQ ID NO: 410479 - RNA, 64 nt, hsa; identical to SEQ ID NO: 129113

SEQ ID NO: 410480 - RNA, 64 nt, hsa; identical to SEQ ID NO: 129114

SEQ ID NO: 410481 - RNA, 64 nt, hsa; identical to SEQ ID NO: 129115

SEQ ID NO: 410482 - RNA, 64 nt, hsa; identical to SEQ ID NO: 129116

SEQ ID NO: 410483 - RNA, 64 nt, hsa; identical to SEQ ID NO: 129117

SEQ ID NO: 410484 - RNA, 64 nt, hsa; identical to SEQ ID NO: 129118

SEQ ID NO: 410485 - RNA, 64 nt, hsa; identical to SEQ ID NO: 129119

SEQ ID NO: 410486 - RNA, 64 nt, hsa; identical to SEQ ID NO: 129120

SEQ ID NO: 410487 - RNA, 64 nt, hsa; identical to SEQ ID NO: 129121

SEQ ID NO: 410488 - RNA, 64 nt, hsa; identical to SEQ ID NO: 129122

SEQ ID NO: 410489 - RNA, 64 nt, hsa; identical to SEQ ID NO: 129123

SEQ ID NO: 410490 - RNA, 64 nt, hsa; identical to SEQ ID NO: 129124

SEQ ID NO: 410491 - RNA, 64 nt, hsa; identical to SEQ ID NO: 129125

SEQ ID NO: 410492 - RNA, 64 nt, hsa; identical to SEQ ID NO: 129126

SEQ ID NO: 410493 - RNA, 64 nt, hsa; identical to SEQ ID NO: 129127

SEQ ID NO: 410494 - RNA, 64 nt, hsa; identical to SEQ ID NO: 129128

SEQ ID NO: 410495 - RNA, 64 nt, hsa; identical to SEQ ID NO: 129129

SEQ ID NO: 410496 - RNA, 62 nt, hsa
aagcaacaaagauccuguuuuuauacaaauauccuuaguacaaaaacaaaagaaggaaaacu

SEQ ID NO: 410497 - RNA, 62 nt, hsa
ccuaagaaaggaggagggcuguauucacugauccuuaguaacauguuaacauuuaugaagca

SEQ ID NO: 410498 - RNA, 54 nt, hsa
ucuaccagcgaacgaaauaaggggccuuaguacccuucuaccaggcccucacuc

SEQ ID NO: 410499 - RNA, 62 nt, hsa
auugugugugacuugauaccuguuaacuugccccuuaguaucagcuguuacuugacacaaau

SEQ ID NO: 410500 - RNA, 62 nt, hsa
cauugguucuccuaaaacaugaaaauuaucucccuuaguaaucccccuugccaaauuccaug

SEQ ID NO: 410501 - RNA, 62 nt, hsa
uuauuuacaaaauaauauguuucuguuaugguccuuaguaauaauugaagaggcuuagaaau

SEQ ID NO: 410502 - RNA, 62 nt, hsa
ucuacuuaauuaacuuagucauaaggacaaagccuuaguauauuuuugccacauacauguua

SEQ ID NO: 410503 - RNA, 62 nt, hsa
aaggaacuucagucaacauauuuucauugacuccuuaguacaagggaaccuuaaugaccaac

SEQ ID NO: 410504 - RNA, 62 nt, hsa
cucuaaaacugcuuucuugaaacauguuacuuccuuaguauaaucaauguauacucccuuac

SEQ ID NO: 410505 - RNA, 62 nt, hsa
gcuggcacccagccucccuucuccuuccacucccuuaguacacuggagugccgagcccugcc

SEQ ID NO: 410506 - RNA, 62 nt, hsa
cagguuuucaagcaauucuccugccucagccuccuuaguagcugggaccacagacaucuguc

SEQ ID NO: 410507 - RNA, 62 nt, hsa
uuuuuuauauacaugguaauucauuaaaauugccuuaguaauauauuagaauauacaaauau

SEQ ID NO: 410508 - RNA, 62 nt, hsa
uuaaaucugaagugucagaggcgcuuaguaagccuuaguaaaguugugauugaagaaacuua

SEQ ID NO: 410509 - RNA, 62 nt, hsa
agaucaugguccuauaauggauauuauucagaccuuaguacagcaagacacucuggccacca

SEQ ID NO: 410510 - RNA, 62 nt, hsa
auccugaagcuuacuaugcagccuacaaacagccuuaguaauuaaaacauuuuauaccaaua

SEQ ID NO: 410511 - RNA, 62 nt, hsa
ucauauacauuucuagaaauauugcuauucuaccuuaguauuucacauuuguaguucaaaca

SEQ ID NO: 410512 - RNA, 62 nt, hsa
aagagagcaaaccaguugauuuuuuaauucauccuuaguacacagagaauauacuuuuccuc

SEQ ID NO: 410513 - RNA, 62 nt, hsa
cuuuguacaggucaccugccuacucuaauuguccuuaguacuuggacaggcuuuaucauuaa

SEQ ID NO: 410514 - RNA, 62 nt, hsa
cugaucccugccaaaaaguggcuggaagagucccuuaguacucuucuagcauuuagaucuac

SEQ ID NO: 410515 - RNA, 53 nt, hsa
auuaucuauaugacaauugauauccuuaguaaucauggggcaugauuauagag

SEQ ID NO: 410516 - RNA, 62 nt, hsa
aaacaugauacuuucaaugugccaaaacuaaaccuuaguauacaacuaaaaaucuccugccu

SEQ ID NO: 410517 - RNA, 62 nt, hsa
gucauuguccgguuuccguagcaguuuugaaaccuuaguaccuuuuuaacagcaugugggug

SEQ ID NO: 410518 - RNA, 62 nt, hsa
cugguuggaagcugacugcagacuuuguuuccccuuaguaugugcuguguuguaaauuuuuc

SEQ ID NO: 410519 - RNA, 62 nt, hsa
uuaccaacaucuauugucaacauguacaucuaccuuaguauggucugcauucuuuuucugag

SEQ ID NO: 410520 - RNA, 62 nt, hsa
acagguguauacuuaugcaugcauacauaaauccuuaguauagaaaaauugcauaaagaaua

SEQ ID NO: 410521 - RNA, 62 nt, hsa
ccuguauacauagugcuuaaugcaugguaggcccuuaguaauguuuuugaauuaaugaggca

SEQ ID NO: 410522 - RNA, 62 nt, hsa
gaaaggggcuuccaaguucuuuugaacaugacccuuaguaacaaacacaauuuauauaauga

SEQ ID NO: 410523 - RNA, 62 nt, hsa
ggagcguccauggauacaagauaagauguguaccuuaguagaauacagagcuuugguaauua

SEQ ID NO: 410524 - RNA, 62 nt, hsa
ucauaugcaaauucucagaagggcugugaacaccuuaguaauaaauuuaucuuuugagguca

SEQ ID NO: 410525 - RNA, 62 nt, hsa
cugcagaccauccagaggaauaaaaagguuggccuuaguagucaaaaacaaagcugauagcc

SEQ ID NO: 410526 - RNA, 62 nt, hsa
caagaagggcugugggauaauuuaccaugaauccuuaguagcaaugacagcagaguuaaaaa

SEQ ID NO: 410527 - RNA, 62 nt, hsa
gugacugcaagucacucuuaggggcuguacuuccuuaguacugguagcauuauuauccaaug

SEQ ID NO: 410528 - RNA, 62 nt, hsa
aaugacagauaaauccuuaacauuucucuccaccuuaguacuuuagacuaauuguguuuguc

SEQ ID NO: 410529 - RNA, 62 nt, hsa
aauuuuucuucuuuaauacuaagagauggguaccuuaguacccuucaccuaacaucucucgg

SEQ ID NO: 410530 - RNA, 62 nt, hsa
gguaaaaucauaaugaacuggccacagaaaagccuuaguauuagcucaagccuuaauaauua

SEQ ID NO: 410531 - RNA, 62 nt, hsa
agacguuuggucuguuuucuucgcugucauuuccuuaguaguuagacuagugcugagauuuu

SEQ ID NO: 410532 - RNA, 62 nt, hsa
accagcuccaaguaaacuugucccugcaacugccuuaguaaacccaaaggcucuuuucagag

SEQ ID NO: 410533 - RNA, 62 nt, hsa
uguaacuucuuccuucccuauuaaaauuagaaccuuaguauaaauuuacuuucucaaauucu

SEQ ID NO: 410534 - RNA, 62 nt, hsa
uccaauaucauccuauccaccaaaaucuuauuccuuaguauuaauuuaucucauugggaaga

SEQ ID NO: 410535 - RNA, 62 nt, hsa
cucuguuuaaaucugccacuuucuggacuggaccuuaguacuguaaauucuuuuuaaagaau

SEQ ID NO: 410536 - RNA, 62 nt, hsa
ucauuaaaaaaaaaaccaugaauuacgaagcaccuuaguaagcaccuucuaaugcugcauuu

SEQ ID NO: 410537 - RNA, 62 nt, hsa
cuguccuuauccauuaccucaaagcagucauuccuuaguaaaguuuccaacaaauagaaauu

SEQ ID NO: 410538 - RNA, 62 nt, hsa
caggguucgugcuacccacugauucccuuuacccuuaguaauaauuuuggaucauuuucuuu

SEQ ID NO: 410539 - RNA, 62 nt, hsa
cucaacauaugugauguuuauggcccucagauccuuaguauugugugauuuucccccguuaa

SEQ ID NO: 410540 - RNA, 62 nt, hsa
gaagcuuaagauuuguuuugguuggaugaaguccuuaguacaguugaaaaacagagcauuaa

SEQ ID NO: 410541 - RNA, 62 nt, hsa
cuuaauaucauguguuaacauguuuaaaaagaccuuaguaguuugcaggcuggaccuuaauu

SEQ ID NO: 410542 - RNA, 62 nt, hsa
gaauguggaaaagcuuuucaccgauacucaauccuuaguacacauaagaaaauucauacugg

SEQ ID NO: 410543 - RNA, 62 nt, hsa
ggggccacgucuguuaguuuccuaucauuuugccuuaguauuuuuugaaaaagggacaugug

SEQ ID NO: 410544 - RNA, 62 nt, hsa
uguuaucauacuuuuuugaugaaaacauaaugccuuaguaaaauagcucuauuuaauaaaga

SEQ ID NO: 410545 - RNA, 62 nt, hsa
uaagucuaggaguuagaaaugaauuuuuuagaccuuaguaaaaccauuuaaccauaaaaugg

SEQ ID NO: 410546 - RNA, 62 nt, hsa
aucagggaagaacccuauacuugguuugcuacccuuaguauuuauuacuaaccucccuuaag

SEQ ID NO: 410547 - RNA, 62 nt, hsa
auuuuaagucagcugucaaggggagaccacagccuuaguaugacauccugcacaauuuguga

SEQ ID NO: 410548 - RNA, 62 nt, hsa
uucucaucccugcauagaugcaguauucuuagccuuaguagaaaaaccugguuuagugguuu

SEQ ID NO: 410549 - RNA, 62 nt, hsa
gacagguaacaacauuaaaucuaguugcuuucccuuaguauuagauuuguugaggguuuuuu

SEQ ID NO: 410550 - RNA, 62 nt, hsa
aauuauguaacuggcuaauaugguuuaauuaaccuuaguaacaucucaugaccacugacugc

SEQ ID NO: 410551 - RNA, 62 nt, hsa
gaagucaucaaauuagugaacugagacauuggccuuaguaggcuguauucacugcuaauuua

SEQ ID NO: 410552 - RNA, 62 nt, hsa
uuucaaaccagagcuguucacaugaaaauauuccuuaguagaauguauauuuaagaaauaaa

SEQ ID NO: 410553 - RNA, 62 nt, hsa
aaaauaaauucaccuagucuaaggaugcuaaaccuuaguacugaguuacauugucauuuaua

SEQ ID NO: 410554 - RNA, 62 nt, hsa
gaaaaauaaauaaauaaaagaacagccuuuucccuuaguauuaacagaaauguuucuguguc

SEQ ID NO: 410555 - RNA, 62 nt, hsa
gaugaucuaggugaaaaaugacuuaucugcugccuuaguauauugcgguuaugugucauugu

SEQ ID NO: 410556 - RNA, 62 nt, hsa
ucucauucacgcaagaauaaguucuuugaauuccuuaguauguagugaagaaaauuuaguug

SEQ ID NO: 410557 - RNA, 62 nt, hsa
ugguucuuauggguccaugaacacacuugugaccuuaguacuuggucauccagcaucauaca

SEQ ID NO: 410558 - RNA, 62 nt, hsa
cggaugccuauggcgccucaucuuuaaacuguccuuaguagcccaggggagccacacccuca

SEQ ID NO: 410559 - RNA, 62 nt, hsa
gauuuucaugggucacaaaauucuuggaggucccuuaguagauuugguaguuccuuaagaga

SEQ ID NO: 410560 - RNA, 62 nt, hsa
aaacaguauuaggguuuauuuggaguuaacucccuuaguaauugcuacagcuuccauaauua

SEQ ID NO: 410561 - RNA, 62 nt, hsa
aauaguaaugguucaguaagcacuccuuaacuccuuaguauuucauagaaaaaugacugcaa

SEQ ID NO: 410562 - RNA, 62 nt, hsa
caggaaagggaagaaaacacucaguugauaaaccuuaguacucagauaauaaauaagagacc

SEQ ID NO: 410563 - RNA, 62 nt, hsa
aaucuuucuaaaauguauuacgcacuucccugccuuaguaaacagaguauacuggagaguau

SEQ ID NO: 410564 - RNA, 62 nt, hsa
acuuaagaaaacuagcaaauauaugaaaagacccuuaguaccaaauacacucaauugccuuu

SEQ ID NO: 410565 - RNA, 62 nt, hsa
gggagauuuaggcccugcagaggcagaccauuccuuaguaucucacaaagcagaguaauacu

SEQ ID NO: 410566 - RNA, 62 nt, hsa
cuuuuuuacauaaugauuuugcauuggggucaccuuaguauauucacgucaauccacgcucu

SEQ ID NO: 410567 - RNA, 62 nt, hsa
cccuccgcgagggcuacucagcaguaagcaggccuuaguacggcugcugcacacuucucggu

SEQ ID NO: 410568 - RNA, 62 nt, hsa
ccuuaguucuaucugaauccaagacagccacaccuuaguauacugcccaaacuaaugaguuu

SEQ ID NO: 410569 - RNA, 62 nt, hsa
uuucaguuucucuaguucagccagugucuuguccuuaguaauuauuugcuuucccugcaguu

SEQ ID NO: 410570 - RNA, 62 nt, hsa
uuguuaaccuaguauucuaaccaguuaaccagccuuaguaugcauuaaaauuguauuguuca

SEQ ID NO: 410571 - RNA, 62 nt, hsa
ccugagucaugggaaagagucacacuccugacccuuaguacucugcccccaccucucuuuac

SEQ ID NO: 410572 - RNA, 62 nt, hsa
uuagacuugaaaggguuugauaaucucccaguccuuaguaaagauugagagaggcuggagca

SEQ ID NO: 410573 - RNA, 62 nt, hsa
uuaaagcaaucuagugguauacccgccccuugccuuaguaagaggagcagugaaauguauau

SEQ ID NO: 410574 - RNA, 62 nt, hsa
gauuucugaugacauugaaagacuuuaaacagccuuaguaaauuaucuuucuaaugcucugu

SEQ ID NO: 410575 - RNA, 62 nt, hsa
uguugccuacuucugaccaagaagaaaaaggaccuuaguauuuagcauaaaauuccagcgcu

SEQ ID NO: 410576 - RNA, 62 nt, hsa
ugaggagcugggaaguggggugacauagcugaccuuaguaucaaccccccucuucuccaacu

SEQ ID NO: 410577 - RNA, 62 nt, hsa
agaaacuucugagccaggagugaauggcccuuccuuaguagccugggggauguccagagacu

SEQ ID NO: 410578 - RNA, 62 nt, hsa
uguggaggucaggauggcugcgggcaaugaagccuuaguaaaacggugaaaaguacucccag

SEQ ID NO: 410579 - RNA, 62 nt, hsa
uauuaaaaaacuguagccagugaggcuucuacccuuaguacccagaacuccuuuuagguaua

SEQ ID NO: 410580 - RNA, 62 nt, hsa
uugguuuuccuuguccuucuuuuuacuuuuugccuuaguauugaaaaaugcucuuggagcua

SEQ ID NO: 410581 - RNA, 62 nt, hsa
cugagggcucccccaacuugccaugcccugucccuuaguagaugaguugcuccugauugguc

SEQ ID NO: 410582 - RNA, 62 nt, hsa
gugcaugcaaggguugaacuagauagacccugccuuaguagagggugggacuauaaccuuag

SEQ ID NO: 410583 - RNA, 62 nt, hsa
ggaaauuuaguuuaaaggcagcucuugguguaccuuaguauauuuuaauccacaauuauacc

SEQ ID NO: 410584 - RNA, 62 nt, hsa
ucucagcagcccuccuuggguugaacuauucuccuuaguaacuagguaagugggaaagccuu

SEQ ID NO: 410585 - RNA, 62 nt, hsa
ccugggcucaagugauccuccugccucagccuccuuaguagcugggacuaccagugcauacc

SEQ ID NO: 410586 - RNA, 62 nt, hsa
uggcagcacccacucagccauucucuacccauccuuaguacaugcucuguccagcuuucccc

SEQ ID NO: 410587 - RNA, 62 nt, hsa
gggcuauagccagaacauuuacuucaacucuaccuuaguagauacaaguagagaauauggag

SEQ ID NO: 410588 - RNA, 62 nt, hsa
guacacagagaccaagaggccucaguuuagcaccuuaguaccuccgcugcuucacuugcuuu

SEQ ID NO: 410589 - RNA, 62 nt, hsa
cuaauuaguguccaacuccaagugggucaauuccuuaguauaauauuaaggcuuacuaguau

SEQ ID NO: 410590 - RNA, 62 nt, hsa
agccaaacccugucugacaaccucuuggugaaccuuaguaccuaaaaggaaaucucacccca

SEQ ID NO: 410591 - RNA, 62 nt, hsa
aacauuucuguacccuacugguuugaccagagccuuaguaaguacgugccugaaacugaaac

SEQ ID NO: 410592 - RNA, 62 nt, hsa
aagaaggggcucagagcagagacuugugaauuccuuaguaacugugaguauaugaauguguu

SEQ ID NO: 410593 - RNA, 62 nt, hsa
ggagggaagcgcugucuaggcacacggcaaggccuuaguaacagcaugcuacacugcucgag

SEQ ID NO: 410594 - RNA, 62 nt, hsa
gauugugggaaagccuucaaugaucgcucaacccuuaguaaacacgagaggacacacacugg

SEQ ID NO: 410595 - RNA, 62 nt, hsa
gucaaggugcuuaaguaaucuuuuccaaguuuccuuaguaagggacagagccaggauuuuuu

SEQ ID NO: 410596 - RNA, 62 nt, hsa
cauacccucuacugugagauguuacuaaagaaccuuaguaacuugacucucaacuccacuac

SEQ ID NO: 410597 - RNA, 62 nt, hsa
uucaacgaauuugcuagugaucugguuuacugccuuaguaauaucuaguuccuaauaugccu

SEQ ID NO: 410598 - RNA, 62 nt, hsa
uccuucugauuugguccauguguuggguuuggccuuaguagaaaucucugaaggcagcagcc

SEQ ID NO: 410599 - RNA, 62 nt, hsa
acuuaucccuaccuucauguuccaguggaagaccuuaguaaaaucaaagaucagugaguuca

SEQ ID NO: 410600 - RNA, 62 nt, hsa
cccucagcucaguuuuuggcucuguuauggagccuuaguacccaccccgucuguguccccca

SEQ ID NO: 410601 - RNA, 62 nt, hsa
caucuccuccaaugaggaaacccacgcaccuuccuuaguaaugaaauccuggguuccaaagg

SEQ ID NO: 410602 - RNA, 62 nt, hsa
cuuuucuaucaaaauuuucaacauaugcauaaccuuaguauuuucccaaccaauagaaacua

SEQ ID NO: 410603 - RNA, 62 nt, hsa
ucccuggggguugggggcugugucucuccaucccuuaguaaaaauacagcaacucccaacuc

SEQ ID NO: 410604 - RNA, 62 nt, hsa
aacgacguuugugcgacauaguauuguauccaccuuaguauuguaucgagccuuuucugugu

SEQ ID NO: 410605 - RNA, 62 nt, hsa
acccccggcccguccucguccuggguaccccaccuuaguaaauggcgccaccaucugcccgg

SEQ ID NO: 410606 - RNA, 62 nt, hsa
caauauuggggaauugauuucacaguucguuaccuuaguagguaacgguaagguuauucucu

SEQ ID NO: 410607 - RNA, 62 nt, hsa
aguaccacuccuaccauucauuuuucuaaauuccuuaguacauauacuuggaucauguuaaa

SEQ ID NO: 410608 - RNA, 62 nt, hsa
aagcaaacugaaauuaguguuuucauucugguccuuaguaaauuccuaauucuaugauuaaa

SEQ ID NO: 410609 - RNA, 62 nt, hsa
uuguugcccuccuacccaauugucaugauuguccuuaguacccuaggccuagauucugagau

SEQ ID NO: 410610 - RNA, 62 nt, hsa
guccuuuugaagaacaguuugguugaugcaugccuuaguagccaaaaugcuacacucuagac

SEQ ID NO: 410611 - RNA, 62 nt, hsa
cauggcagaugauuugggcagagcgauggaguccuuaguaucagucaugacagaugaagaag

SEQ ID NO: 410612 - RNA, 62 nt, hsa
agauaaaagaauguguauuuuuucacuuguugccuuaguacuaucaagacuugugaauauau

SEQ ID NO: 410613 - RNA, 62 nt, hsa
ggaaauggucuaacucuaaaccauguaacugaccuuaguaaaguccuugacuaacugaacua

SEQ ID NO: 410614 - RNA, 64 nt, hsa
gacagagaugugcauguggguauuguuaggaaaugucaucaaacuccacccaccuggcuucaua

SEQ ID NO: 410615 - RNA, 64 nt, hsa
uuucacacaaugcccaacuuacugucuucuucaugucaucaaaaucugcacagucacuggccca

SEQ ID NO: 410616 - RNA, 64 nt, hsa
gacagagaugugcauguggguauuguuaggagaugucaucaagcuccacccuccuggccucaua

SEQ ID NO: 410617 - RNA, 64 nt, hsa
uuucauacaauggccaacuuauuguauuccucaugucaucaaaaccugcgcagucauuggccca

SEQ ID NO: 410618 - RNA, 64 nt, hsa
cuccaaagucaucuugccagucccgguguucaaugucaucaauggcaguucucaugcugucacc

SEQ ID NO: 410619 - RNA, 64 nt, hsa
cauuggagcggagguuuaccacagccugaagaaugucaucaaggagaaauaugggaaagaugcc

SEQ ID NO: 410620 - RNA, 64 nt, hsa
uuaacagaagcauuucacauaaauguugguuucagucaucaacuacccaugaauuccugcccaa

SEQ ID NO: 410621 - RNA, 64 nt, hsa
cugaguauaagagagaauaaaugauuucucuaaggucaucaaacuauuuaguuuuuccacuuua

SEQ ID NO: 410622 - RNA, 64 nt, hsa; identical to SEQ ID NO: 172369

SEQ ID NO: 410623 - RNA, 64 nt, hsa; identical to SEQ ID NO: 172370

SEQ ID NO: 410624 - RNA, 64 nt, hsa; identical to SEQ ID NO: 172371

SEQ ID NO: 410625 - RNA, 64 nt, hsa; identical to SEQ ID NO: 172372

SEQ ID NO: 410626 - RNA, 64 nt, hsa; identical to SEQ ID NO: 172373

SEQ ID NO: 410627 - RNA, 64 nt, hsa; identical to SEQ ID NO: 172374

SEQ ID NO: 410628 - RNA, 64 nt, hsa; identical to SEQ ID NO: 172375

SEQ ID NO: 410629 - RNA, 64 nt, hsa; identical to SEQ ID NO: 172376

SEQ ID NO: 410630 - RNA, 64 nt, hsa; identical to SEQ ID NO: 172377

SEQ ID NO: 410631 - RNA, 64 nt, hsa; identical to SEQ ID NO: 172378

SEQ ID NO: 410632 - RNA, 64 nt, hsa; identical to SEQ ID NO: 172379

SEQ ID NO: 410633 - RNA, 64 nt, hsa; identical to SEQ ID NO: 172380

SEQ ID NO: 410634 - RNA, 64 nt, hsa
agaagggugagggagaauaaggguaagggaguauucuaggcaaggaacuaaggaaggaaucccc

SEQ ID NO: 410635 - RNA, 64 nt, hsa
gggaaacuuaagaauagucaucaggguuuuagcuucuaggcaccagccaaggaugagaacuucu

SEQ ID NO: 410636 - RNA, 64 nt, hsa
ucagaagcaucccggauaauagauggguaaaaagucuaggcacccugaagaacaggugagacag

SEQ ID NO: 410637 - RNA, 64 nt, hsa
uguuucagacuuuaugcagccauauaaacuguucucuaggcaugcugugacauuuuaauaaaaa

SEQ ID NO: 410638 - RNA, 64 nt, hsa
ccagcacauuaguccuaaacgucccauguauuuuucuaggcauaaaaauaaaaguuggcuaaaa

SEQ ID NO: 410639 - RNA, 64 nt, hsa
caauaucaaacuuccugcauaucuccauuuuugcucuaggcaaauuaauuauccuuaaaaaagu

SEQ ID NO: 410640 - RNA, 64 nt, hsa
caguagguucaaggcaaagcagcucugaccgaauucuaggcaggggugggggcaccugccuggg

SEQ ID NO: 410641 - RNA, 64 nt, hsa
gugacucugcaagcagacaccucgaggcagguguucuaggcaaagggaugggcaugagcgaagg

SEQ ID NO: 410642 - RNA, 64 nt, hsa
cugcugggcugccagccccuuucagaaagcauggcagugggaaccagcaacuugggcuaccuua

SEQ ID NO: 410643 - RNA, 64 nt, hsa
cgaccacauccggucaaguucugacuuuucagggcagugggauggugacuucugagcuaagccu

SEQ ID NO: 410644 - RNA, 64 nt, hsa
gcaagcgcagccuggaggaagagggugcugcccacagugggaagagacugcgggccgugucucc

SEQ ID NO: 410645 - RNA, 64 nt, hsa
uggcugggcagccuggcacaagugaagaagaaggcagugggaaaacuggguuuaucucaaggca

SEQ ID NO: 410646 - RNA, 64 nt, hsa
guggcaucucagcaguguccuggccccuccagagcagugggacaucuggggacuguuuuugugu

SEQ ID NO: 410647 - RNA, 64 nt, hsa
aauuuuaaagacgauuugaacaagaaaaugaaggcagugggaaagcaaugccaaaugguugugg

SEQ ID NO: 410648 - RNA, 64 nt, hsa
ucauuguaaccauuucucacuagugucaggcccccagugggaccacaugccacugccugcaccu

SEQ ID NO: 410649 - RNA, 64 nt, hsa
guccccagacccuucuugccugcugggcuccccccagugggaugggacagggaggccacacgca

SEQ ID NO: 410650 - RNA, 64 nt, hsa
aacacuaacauucuguaagagguuauauaguuuucagugggagggguugggauggguaaucuca

SEQ ID NO: 410651 - RNA, 64 nt, hsa
gacuuacuggaaauaaauuaccuaucccauguuucagugggaaaugaacuacauauugagaugc

SEQ ID NO: 410652 - RNA, 64 nt, hsa
aaggcccacagaacugucuccaggcccuuguagacagugggaucucugggcugauuucugguug

SEQ ID NO: 410653 - RNA, 64 nt, hsa
caguucucugcugggaugaagaaaguuggacacucagugggaccagcugcaggugguuucacug

SEQ ID NO: 410654 - RNA, 64 nt, hsa
cuacuuaccaagguucuccacugcuuaccuuuuccagugggacaguacagugugagcccccggg

SEQ ID NO: 410655 - RNA, 64 nt, hsa
ugcacaacuugaagggccaucauucacaucuauucagugggaguggggucccugggauugggca

SEQ ID NO: 410656 - RNA, 64 nt, hsa
ggggugcuccucgcgggguggacuugggagugugcagugggacagggggcugcagggguccugc

SEQ ID NO: 410657 - RNA, 64 nt, hsa
guucugagacaugagccuugggauguggcagcaucagugggacaagauggacacugggccaccc

SEQ ID NO: 410658 - RNA, 64 nt, hsa
aaaugaggauuuugcuuaaaacagcacuugccgccagugggaggagggagguuuuauuuauucc

SEQ ID NO: 410659 - RNA, 64 nt, hsa
aacgaaaguagaauguaaaacucgcagcagauaucagugggaagggcugggggagggggcaccc

SEQ ID NO: 410660 - RNA, 64 nt, hsa
guauagccauugcccucuagcaggccaggccucccagugggaaggccuggguccagggcaucuu

SEQ ID NO: 410661 - RNA, 64 nt, hsa
accagaugggguccuuagauccuauuccugcucccagugggaauuugcuuuucuuugucauuuu

SEQ ID NO: 410662 - RNA, 64 nt, hsa
ggaaggcagaagaaacauuggaaagcaucuaguccagugggaagccagggguuggagaaggugc

SEQ ID NO: 410663 - RNA, 64 nt, hsa
ucuagcuuuuuuggcgugagacuuuugcaaugugcagugggauaaaaugcauuuccuuuucugg

SEQ ID NO: 410664 - RNA, 64 nt, hsa
uuagcugcagaacguauugguccagcuugcucuucagugggagaaaacacuuguaaguugcuaa

SEQ ID NO: 410665 - RNA, 64 nt, hsa
gccgcauucccugagucaccaggaauguuaaagucagugggaacgugacugccccaacuccugg

SEQ ID NO: 410666 - RNA, 64 nt, hsa
auucccaugcauccugauccuuaagauuaugcuccagugggagacccugguaggcacaaagcuu

SEQ ID NO: 410667 - RNA, 64 nt, hsa
cugggccaggcccuuuuccugcaugugccaccuccagugggaaacaaaacuaaagagaccacuc

SEQ ID NO: 410668 - RNA, 64 nt, hsa
cugcuuccuguccuucagaacacuucucugugcucagugggagccaggaagccucaggcuucac

SEQ ID NO: 410669 - RNA, 64 nt, hsa
ccgagccgaagggagaugaugggccuucgccccucagugggauggcagcugagggggcccugca

SEQ ID NO: 410670 - RNA, 64 nt, hsa
guucccguaauccccacgugacaugggagggacccagugggagguaauuuaauccucggggcgg

SEQ ID NO: 410671 - RNA, 64 nt, hsa
gaauauuuauuuuuauaaaaaaguauaaaguauacagugggauguuuugauauacauuaugaaa

SEQ ID NO: 410672 - RNA, 64 nt, hsa
ggagcugccccagcuguggcuggggguguggaggcagugggaugaacugggggacaggucugcg

SEQ ID NO: 410673 - RNA, 64 nt, hsa
gcagugggaugaacugggggacaggucugcgcugcagugggaucuggcugcucugccuccuuuc

SEQ ID NO: 410674 - RNA, 64 nt, hsa
aagaucuagauuguuauugcuguuugagcugucucagugggauaaguuugaaauucaaguguuu

SEQ ID NO: 410675 - RNA, 64 nt, hsa
ucucacuuuccccuugugggguaggaaccgaugccagugggagggaugugccccugaccauuaa

SEQ ID NO: 410676 - RNA, 64 nt, hsa
cuccucccucuuuccaccagcugccagucaagggcagugggaucucgauggagccucccccccc

SEQ ID NO: 410677 - RNA, 64 nt, hsa
ccccaccugaguggggaggagcgucucaagugaacagugggagccugcccaccuggcacugcac

SEQ ID NO: 410678 - RNA, 55 nt, hsa; identical to SEQ ID NO: 113265

SEQ ID NO: 410679 - RNA, 64 nt, hsa; identical to SEQ ID NO: 113266

SEQ ID NO: 410680 - RNA, 64 nt, hsa; identical to SEQ ID NO: 113267

SEQ ID NO: 410681 - RNA, 64 nt, hsa; identical to SEQ ID NO: 113268

SEQ ID NO: 410682 - RNA, 64 nt, hsa; identical to SEQ ID NO: 113269

SEQ ID NO: 410683 - RNA, 64 nt, hsa; identical to SEQ ID NO: 113270

SEQ ID NO: 410684 - RNA, 64 nt, hsa; identical to SEQ ID NO: 113271

SEQ ID NO: 410685 - RNA, 64 nt, hsa; identical to SEQ ID NO: 113272

SEQ ID NO: 410686 - RNA, 64 nt, hsa; identical to SEQ ID NO: 113273

SEQ ID NO: 410687 - RNA, 64 nt, hsa; identical to SEQ ID NO: 113274

SEQ ID NO: 410688 - RNA, 64 nt, hsa; identical to SEQ ID NO: 113275

SEQ ID NO: 410689 - RNA, 64 nt, hsa; identical to SEQ ID NO: 113276

SEQ ID NO: 410690 - RNA, 64 nt, hsa; identical to SEQ ID NO: 113277

SEQ ID NO: 410691 - RNA, 64 nt, hsa; identical to SEQ ID NO: 113278

SEQ ID NO: 410692 - RNA, 64 nt, hsa; identical to SEQ ID NO: 48846

SEQ ID NO: 410693 - RNA, 64 nt, hsa; identical to SEQ ID NO: 48847

SEQ ID NO: 410694 - RNA, 64 nt, hsa; identical to SEQ ID NO: 48848

SEQ ID NO: 410695 - RNA, 64 nt, hsa; identical to SEQ ID NO: 48849

SEQ ID NO: 410696 - RNA, 64 nt, hsa; identical to SEQ ID NO: 48850

SEQ ID NO: 410697 - RNA, 64 nt, hsa; identical to SEQ ID NO: 48851

SEQ ID NO: 410698 - RNA, 64 nt, hsa; identical to SEQ ID NO: 48852

SEQ ID NO: 410699 - RNA, 64 nt, hsa; identical to SEQ ID NO: 48853

SEQ ID NO: 410700 - RNA, 64 nt, hsa; identical to SEQ ID NO: 48854

SEQ ID NO: 410701 - RNA, 64 nt, hsa; identical to SEQ ID NO: 48855

SEQ ID NO: 410702 - RNA, 64 nt, hsa; identical to SEQ ID NO: 48856

SEQ ID NO: 410703 - RNA, 64 nt, hsa; identical to SEQ ID NO: 48857

SEQ ID NO: 410704 - RNA, 64 nt, hsa; identical to SEQ ID NO: 48858

SEQ ID NO: 410705 - RNA, 64 nt, hsa; identical to SEQ ID NO: 48859

SEQ ID NO: 410706 - RNA, 64 nt, hsa; identical to SEQ ID NO: 48860

SEQ ID NO: 410707 - RNA, 64 nt, hsa; identical to SEQ ID NO: 48861

SEQ ID NO: 410708 - RNA, 64 nt, hsa; identical to SEQ ID NO: 48862

SEQ ID NO: 410709 - RNA, 64 nt, hsa; identical to SEQ ID NO: 48863

SEQ ID NO: 410710 - RNA, 64 nt, hsa; identical to SEQ ID NO: 48864

SEQ ID NO: 410711 - RNA, 64 nt, hsa; identical to SEQ ID NO: 48865

SEQ ID NO: 410712 - RNA, 64 nt, hsa; identical to SEQ ID NO: 48866

SEQ ID NO: 410713 - RNA, 64 nt, hsa; identical to SEQ ID NO: 48867

SEQ ID NO: 410714 - RNA, 64 nt, hsa; identical to SEQ ID NO: 48868

SEQ ID NO: 410715 - RNA, 64 nt, hsa; identical to SEQ ID NO: 48869

SEQ ID NO: 410716 - RNA, 64 nt, hsa; identical to SEQ ID NO: 48870

SEQ ID NO: 410717 - RNA, 64 nt, hsa; identical to SEQ ID NO: 48871

SEQ ID NO: 410718 - RNA, 64 nt, hsa; identical to SEQ ID NO: 48872

SEQ ID NO: 410719 - RNA, 64 nt, hsa; identical to SEQ ID NO: 48873

SEQ ID NO: 410720 - RNA, 64 nt, hsa; identical to SEQ ID NO: 48874

SEQ ID NO: 410721 - RNA, 64 nt, hsa; identical to SEQ ID NO: 48875

SEQ ID NO: 410722 - RNA, 64 nt, hsa; identical to SEQ ID NO: 48876

SEQ ID NO: 410723 - RNA, 64 nt, hsa; identical to SEQ ID NO: 48877

SEQ ID NO: 410724 - RNA, 64 nt, hsa; identical to SEQ ID NO: 48878

SEQ ID NO: 410725 - RNA, 64 nt, hsa; identical to SEQ ID NO: 48879

SEQ ID NO: 410726 - RNA, 64 nt, hsa; identical to SEQ ID NO: 48880

SEQ ID NO: 410727 - RNA, 64 nt, hsa; identical to SEQ ID NO: 48881

SEQ ID NO: 410728 - RNA, 64 nt, hsa; identical to SEQ ID NO: 48882

SEQ ID NO: 410729 - RNA, 64 nt, hsa; identical to SEQ ID NO: 48883

SEQ ID NO: 410730 - RNA, 64 nt, hsa; identical to SEQ ID NO: 48884

SEQ ID NO: 410731 - RNA, 64 nt, hsa; identical to SEQ ID NO: 48885

SEQ ID NO: 410732 - RNA, 64 nt, hsa; identical to SEQ ID NO: 48886

SEQ ID NO: 410733 - RNA, 64 nt, hsa; identical to SEQ ID NO: 48887

SEQ ID NO: 410734 - RNA, 64 nt, hsa; identical to SEQ ID NO: 48888

SEQ ID NO: 410735 - RNA, 64 nt, hsa; identical to SEQ ID NO: 48889

SEQ ID NO: 410736 - RNA, 64 nt, hsa; identical to SEQ ID NO: 48890

SEQ ID NO: 410737 - RNA, 64 nt, hsa; identical to SEQ ID NO: 48891

SEQ ID NO: 410738 - RNA, 64 nt, hsa; identical to SEQ ID NO: 48892

SEQ ID NO: 410739 - RNA, 64 nt, hsa; identical to SEQ ID NO: 48893

SEQ ID NO: 410740 - RNA, 64 nt, hsa; identical to SEQ ID NO: 48894

SEQ ID NO: 410741 - RNA, 64 nt, hsa; identical to SEQ ID NO: 48895

SEQ ID NO: 410742 - RNA, 64 nt, hsa; identical to SEQ ID NO: 48896

SEQ ID NO: 410743 - RNA, 64 nt, hsa; identical to SEQ ID NO: 48897

SEQ ID NO: 410744 - RNA, 64 nt, hsa; identical to SEQ ID NO: 48898

SEQ ID NO: 410745 - RNA, 64 nt, hsa; identical to SEQ ID NO: 48899

SEQ ID NO: 410746 - RNA, 64 nt, hsa; identical to SEQ ID NO: 48900

SEQ ID NO: 410747 - RNA, 64 nt, hsa; identical to SEQ ID NO: 48901

SEQ ID NO: 410748 - RNA, 64 nt, hsa; identical to SEQ ID NO: 48902

SEQ ID NO: 410749 - RNA, 64 nt, hsa; identical to SEQ ID NO: 48903

SEQ ID NO: 410750 - RNA, 64 nt, hsa; identical to SEQ ID NO: 48904

SEQ ID NO: 410751 - RNA, 64 nt, hsa; identical to SEQ ID NO: 48905

SEQ ID NO: 410752 - RNA, 64 nt, hsa; identical to SEQ ID NO: 48906

SEQ ID NO: 410753 - RNA, 64 nt, hsa; identical to SEQ ID NO: 48907

SEQ ID NO: 410754 - RNA, 64 nt, hsa; identical to SEQ ID NO: 48908

SEQ ID NO: 410755 - RNA, 64 nt, hsa; identical to SEQ ID NO: 48909

SEQ ID NO: 410756 - RNA, 64 nt, hsa; identical to SEQ ID NO: 48910

SEQ ID NO: 410757 - RNA, 64 nt, hsa; identical to SEQ ID NO: 48911

SEQ ID NO: 410758 - RNA, 64 nt, hsa; identical to SEQ ID NO: 48912

SEQ ID NO: 410759 - RNA, 64 nt, hsa; identical to SEQ ID NO: 48913

SEQ ID NO: 410760 - RNA, 64 nt, hsa; identical to SEQ ID NO: 48914

SEQ ID NO: 410761 - RNA, 64 nt, hsa; identical to SEQ ID NO: 48915

SEQ ID NO: 410762 - RNA, 64 nt, hsa; identical to SEQ ID NO: 48916

SEQ ID NO: 410763 - RNA, 64 nt, hsa; identical to SEQ ID NO: 48917

SEQ ID NO: 410764 - RNA, 64 nt, hsa; identical to SEQ ID NO: 48918

SEQ ID NO: 410765 - RNA, 64 nt, hsa; identical to SEQ ID NO: 48919

SEQ ID NO: 410766 - RNA, 64 nt, hsa; identical to SEQ ID NO: 48920

SEQ ID NO: 410767 - RNA, 64 nt, hsa; identical to SEQ ID NO: 48921

SEQ ID NO: 410768 - RNA, 64 nt, hsa; identical to SEQ ID NO: 48922

SEQ ID NO: 410769 - RNA, 64 nt, hsa; identical to SEQ ID NO: 48923

SEQ ID NO: 410770 - RNA, 64 nt, hsa; identical to SEQ ID NO: 48924

SEQ ID NO: 410771 - RNA, 64 nt, hsa; identical to SEQ ID NO: 48925

SEQ ID NO: 410772 - RNA, 64 nt, hsa; identical to SEQ ID NO: 48926

SEQ ID NO: 410773 - RNA, 64 nt, hsa; identical to SEQ ID NO: 48927

SEQ ID NO: 410774 - RNA, 64 nt, hsa; identical to SEQ ID NO: 48928

SEQ ID NO: 410775 - RNA, 64 nt, hsa; identical to SEQ ID NO: 48929

SEQ ID NO: 410776 - RNA, 64 nt, hsa; identical to SEQ ID NO: 48930

SEQ ID NO: 410777 - RNA, 64 nt, hsa; identical to SEQ ID NO: 48931

SEQ ID NO: 410778 - RNA, 64 nt, hsa; identical to SEQ ID NO: 48932

SEQ ID NO: 410779 - RNA, 64 nt, hsa; identical to SEQ ID NO: 48933

SEQ ID NO: 410780 - RNA, 64 nt, hsa; identical to SEQ ID NO: 48934

SEQ ID NO: 410781 - RNA, 64 nt, hsa; identical to SEQ ID NO: 48935

SEQ ID NO: 410782 - RNA, 64 nt, hsa; identical to SEQ ID NO: 48936

SEQ ID NO: 410783 - RNA, 64 nt, hsa; identical to SEQ ID NO: 48937

SEQ ID NO: 410784 - RNA, 64 nt, hsa; identical to SEQ ID NO: 48938

SEQ ID NO: 410785 - RNA, 64 nt, hsa; identical to SEQ ID NO: 48939

SEQ ID NO: 410786 - RNA, 64 nt, hsa; identical to SEQ ID NO: 48940

SEQ ID NO: 410787 - RNA, 64 nt, hsa; identical to SEQ ID NO: 48941

SEQ ID NO: 410788 - RNA, 64 nt, hsa; identical to SEQ ID NO: 48942

SEQ ID NO: 410789 - RNA, 64 nt, hsa; identical to SEQ ID NO: 48943

SEQ ID NO: 410790 - RNA, 64 nt, hsa; identical to SEQ ID NO: 48944

SEQ ID NO: 410791 - RNA, 64 nt, hsa; identical to SEQ ID NO: 48945

SEQ ID NO: 410792 - RNA, 64 nt, hsa; identical to SEQ ID NO: 48946

SEQ ID NO: 410793 - RNA, 64 nt, hsa; identical to SEQ ID NO: 48947

SEQ ID NO: 410794 - RNA, 64 nt, hsa; identical to SEQ ID NO: 48948

SEQ ID NO: 410795 - RNA, 64 nt, hsa; identical to SEQ ID NO: 48949

SEQ ID NO: 410796 - RNA, 64 nt, hsa; identical to SEQ ID NO: 48950

SEQ ID NO: 410797 - RNA, 64 nt, hsa; identical to SEQ ID NO: 48951

SEQ ID NO: 410798 - RNA, 64 nt, hsa; identical to SEQ ID NO: 48952

SEQ ID NO: 410799 - RNA, 64 nt, hsa; identical to SEQ ID NO: 48953

SEQ ID NO: 410800 - RNA, 64 nt, hsa; identical to SEQ ID NO: 48954

SEQ ID NO: 410801 - RNA, 64 nt, hsa; identical to SEQ ID NO: 48955

SEQ ID NO: 410802 - RNA, 64 nt, hsa; identical to SEQ ID NO: 48956

SEQ ID NO: 410803 - RNA, 64 nt, hsa; identical to SEQ ID NO: 48957

SEQ ID NO: 410804 - RNA, 64 nt, hsa; identical to SEQ ID NO: 48958

SEQ ID NO: 410805 - RNA, 58 nt, hsa; identical to SEQ ID NO: 48959

SEQ ID NO: 410806 - RNA, 64 nt, hsa; identical to SEQ ID NO: 48960

SEQ ID NO: 410807 - RNA, 64 nt, hsa; identical to SEQ ID NO: 48961

SEQ ID NO: 410808 - RNA, 64 nt, hsa; identical to SEQ ID NO: 48962

SEQ ID NO: 410809 - RNA, 64 nt, hsa; identical to SEQ ID NO: 48963

SEQ ID NO: 410810 - RNA, 64 nt, hsa; identical to SEQ ID NO: 48964

SEQ ID NO: 410811 - RNA, 64 nt, hsa; identical to SEQ ID NO: 48965

SEQ ID NO: 410812 - RNA, 64 nt, hsa; identical to SEQ ID NO: 48966

SEQ ID NO: 410813 - RNA, 64 nt, hsa; identical to SEQ ID NO: 48967

SEQ ID NO: 410814 - RNA, 64 nt, hsa; identical to SEQ ID NO: 48968

SEQ ID NO: 410815 - RNA, 64 nt, hsa; identical to SEQ ID NO: 48969

SEQ ID NO: 410816 - RNA, 64 nt, hsa; identical to SEQ ID NO: 48970

SEQ ID NO: 410817 - RNA, 64 nt, hsa; identical to SEQ ID NO: 48971

SEQ ID NO: 410818 - RNA, 64 nt, hsa; identical to SEQ ID NO: 48972

SEQ ID NO: 410819 - RNA, 64 nt, hsa; identical to SEQ ID NO: 48973

SEQ ID NO: 410820 - RNA, 64 nt, hsa; identical to SEQ ID NO: 48974

SEQ ID NO: 410821 - RNA, 64 nt, hsa; identical to SEQ ID NO: 48975

SEQ ID NO: 410822 - RNA, 64 nt, hsa; identical to SEQ ID NO: 48976

SEQ ID NO: 410823 - RNA, 64 nt, hsa; identical to SEQ ID NO: 48977

SEQ ID NO: 410824 - RNA, 64 nt, hsa; identical to SEQ ID NO: 48978

SEQ ID NO: 410825 - RNA, 64 nt, hsa; identical to SEQ ID NO: 48979

SEQ ID NO: 410826 - RNA, 64 nt, hsa; identical to SEQ ID NO: 48980

SEQ ID NO: 410827 - RNA, 64 nt, hsa; identical to SEQ ID NO: 48981

SEQ ID NO: 410828 - RNA, 64 nt, hsa; identical to SEQ ID NO: 48982

SEQ ID NO: 410829 - RNA, 64 nt, hsa; identical to SEQ ID NO: 48983

SEQ ID NO: 410830 - RNA, 64 nt, hsa; identical to SEQ ID NO: 48984

SEQ ID NO: 410831 - RNA, 64 nt, hsa; identical to SEQ ID NO: 48985

SEQ ID NO: 410832 - RNA, 64 nt, hsa; identical to SEQ ID NO: 48986

SEQ ID NO: 410833 - RNA, 64 nt, hsa; identical to SEQ ID NO: 48987

SEQ ID NO: 410834 - RNA, 64 nt, hsa; identical to SEQ ID NO: 48988

SEQ ID NO: 410835 - RNA, 64 nt, hsa; identical to SEQ ID NO: 48989

SEQ ID NO: 410836 - RNA, 64 nt, hsa; identical to SEQ ID NO: 48990

SEQ ID NO: 410837 - RNA, 64 nt, hsa; identical to SEQ ID NO: 48991

SEQ ID NO: 410838 - RNA, 64 nt, hsa; identical to SEQ ID NO: 48992

SEQ ID NO: 410839 - RNA, 64 nt, hsa; identical to SEQ ID NO: 48993

SEQ ID NO: 410840 - RNA, 64 nt, hsa; identical to SEQ ID NO: 48994

SEQ ID NO: 410841 - RNA, 64 nt, hsa; identical to SEQ ID NO: 48995

SEQ ID NO: 410842 - RNA, 64 nt, hsa; identical to SEQ ID NO: 48996

SEQ ID NO: 410843 - RNA, 64 nt, hsa; identical to SEQ ID NO: 48997

SEQ ID NO: 410844 - RNA, 64 nt, hsa; identical to SEQ ID NO: 48998

SEQ ID NO: 410845 - RNA, 64 nt, hsa; identical to SEQ ID NO: 48999

SEQ ID NO: 410846 - RNA, 64 nt, hsa; identical to SEQ ID NO: 49000

SEQ ID NO: 410847 - RNA, 64 nt, hsa; identical to SEQ ID NO: 49001

SEQ ID NO: 410848 - RNA, 64 nt, hsa; identical to SEQ ID NO: 49002

SEQ ID NO: 410849 - RNA, 64 nt, hsa; identical to SEQ ID NO: 49003

SEQ ID NO: 410850 - RNA, 64 nt, hsa; identical to SEQ ID NO: 49004

SEQ ID NO: 410851 - RNA, 64 nt, hsa; identical to SEQ ID NO: 49005

SEQ ID NO: 410852 - RNA, 64 nt, hsa; identical to SEQ ID NO: 49006

SEQ ID NO: 410853 - RNA, 64 nt, hsa; identical to SEQ ID NO: 49007

SEQ ID NO: 410854 - RNA, 64 nt, hsa; identical to SEQ ID NO: 49008

SEQ ID NO: 410855 - RNA, 64 nt, hsa; identical to SEQ ID NO: 49009

SEQ ID NO: 410856 - RNA, 64 nt, hsa; identical to SEQ ID NO: 49010

SEQ ID NO: 410857 - RNA, 64 nt, hsa; identical to SEQ ID NO: 49011

SEQ ID NO: 410858 - RNA, 63 nt, hsa; identical to SEQ ID NO: 49012

SEQ ID NO: 410859 - RNA, 64 nt, hsa; identical to SEQ ID NO: 49013

SEQ ID NO: 410860 - RNA, 64 nt, hsa; identical to SEQ ID NO: 49014

SEQ ID NO: 410861 - RNA, 64 nt, hsa; identical to SEQ ID NO: 49015

SEQ ID NO: 410862 - RNA, 64 nt, hsa; identical to SEQ ID NO: 49016

SEQ ID NO: 410863 - RNA, 64 nt, hsa; identical to SEQ ID NO: 49017

SEQ ID NO: 410864 - RNA, 64 nt, hsa; identical to SEQ ID NO: 49018

SEQ ID NO: 410865 - RNA, 64 nt, hsa; identical to SEQ ID NO: 49019

SEQ ID NO: 410866 - RNA, 64 nt, hsa; identical to SEQ ID NO: 49020

SEQ ID NO: 410867 - RNA, 64 nt, hsa; identical to SEQ ID NO: 49021

SEQ ID NO: 410868 - RNA, 64 nt, hsa; identical to SEQ ID NO: 49022

SEQ ID NO: 410869 - RNA, 64 nt, hsa; identical to SEQ ID NO: 49023

SEQ ID NO: 410870 - RNA, 64 nt, hsa; identical to SEQ ID NO: 49024

SEQ ID NO: 410871 - RNA, 64 nt, hsa; identical to SEQ ID NO: 49025

SEQ ID NO: 410872 - RNA, 64 nt, hsa; identical to SEQ ID NO: 49026

SEQ ID NO: 410873 - RNA, 64 nt, hsa; identical to SEQ ID NO: 49027

SEQ ID NO: 410874 - RNA, 64 nt, hsa; identical to SEQ ID NO: 49028

SEQ ID NO: 410875 - RNA, 64 nt, hsa; identical to SEQ ID NO: 49029

SEQ ID NO: 410876 - RNA, 64 nt, hsa; identical to SEQ ID NO: 49030

SEQ ID NO: 410877 - RNA, 64 nt, hsa; identical to SEQ ID NO: 49031

SEQ ID NO: 410878 - RNA, 64 nt, hsa; identical to SEQ ID NO: 49032

SEQ ID NO: 410879 - RNA, 64 nt, hsa; identical to SEQ ID NO: 49033

SEQ ID NO: 410880 - RNA, 64 nt, hsa; identical to SEQ ID NO: 49034

SEQ ID NO: 410881 - RNA, 64 nt, hsa; identical to SEQ ID NO: 49035

SEQ ID NO: 410882 - RNA, 64 nt, hsa; identical to SEQ ID NO: 49036

SEQ ID NO: 410883 - RNA, 64 nt, hsa; identical to SEQ ID NO: 49037

SEQ ID NO: 410884 - RNA, 64 nt, hsa; identical to SEQ ID NO: 49038

SEQ ID NO: 410885 - RNA, 64 nt, hsa; identical to SEQ ID NO: 49039

SEQ ID NO: 410886 - RNA, 64 nt, hsa; identical to SEQ ID NO: 49040

SEQ ID NO: 410887 - RNA, 64 nt, hsa; identical to SEQ ID NO: 49041

SEQ ID NO: 410888 - RNA, 64 nt, hsa; identical to SEQ ID NO: 49042

SEQ ID NO: 410889 - RNA, 64 nt, hsa; identical to SEQ ID NO: 49043

SEQ ID NO: 410890 - RNA, 64 nt, hsa; identical to SEQ ID NO: 49044

SEQ ID NO: 410891 - RNA, 64 nt, hsa; identical to SEQ ID NO: 49045

SEQ ID NO: 410892 - RNA, 64 nt, hsa; identical to SEQ ID NO: 49046

SEQ ID NO: 410893 - RNA, 64 nt, hsa; identical to SEQ ID NO: 49047

SEQ ID NO: 410894 - RNA, 64 nt, hsa; identical to SEQ ID NO: 49048

SEQ ID NO: 410895 - RNA, 64 nt, hsa; identical to SEQ ID NO: 49049

SEQ ID NO: 410896 - RNA, 64 nt, hsa; identical to SEQ ID NO: 49050

SEQ ID NO: 410897 - RNA, 64 nt, hsa; identical to SEQ ID NO: 49051

SEQ ID NO: 410898 - RNA, 64 nt, hsa; identical to SEQ ID NO: 49052

SEQ ID NO: 410899 - RNA, 64 nt, hsa; identical to SEQ ID NO: 49053

SEQ ID NO: 410900 - RNA, 64 nt, hsa; identical to SEQ ID NO: 49054

SEQ ID NO: 410901 - RNA, 64 nt, hsa; identical to SEQ ID NO: 49043

SEQ ID NO: 410902 - RNA, 64 nt, hsa; identical to SEQ ID NO: 193171

SEQ ID NO: 410903 - RNA, 64 nt, hsa; identical to SEQ ID NO: 193172

SEQ ID NO: 410904 - RNA, 64 nt, hsa; identical to SEQ ID NO: 193173

SEQ ID NO: 410905 - RNA, 64 nt, hsa; identical to SEQ ID NO: 193174

SEQ ID NO: 410906 - RNA, 64 nt, hsa; identical to SEQ ID NO: 193175

SEQ ID NO: 410907 - RNA, 64 nt, hsa; identical to SEQ ID NO: 193176

SEQ ID NO: 410908 - RNA, 64 nt, hsa; identical to SEQ ID NO: 193177

SEQ ID NO: 410909 - RNA, 64 nt, hsa; identical to SEQ ID NO: 193178

SEQ ID NO: 410910 - RNA, 64 nt, hsa; identical to SEQ ID NO: 193179

SEQ ID NO: 410911 - RNA, 64 nt, hsa; identical to SEQ ID NO: 193180

SEQ ID NO: 410912 - RNA, 64 nt, hsa; identical to SEQ ID NO: 193181

SEQ ID NO: 410913 - RNA, 64 nt, hsa; identical to SEQ ID NO: 193182

SEQ ID NO: 410914 - RNA, 64 nt, hsa; identical to SEQ ID NO: 193183

SEQ ID NO: 410915 - RNA, 64 nt, hsa; identical to SEQ ID NO: 193184

SEQ ID NO: 410916 - RNA, 64 nt, hsa; identical to SEQ ID NO: 193185

SEQ ID NO: 410917 - RNA, 64 nt, hsa; identical to SEQ ID NO: 193186

SEQ ID NO: 410918 - RNA, 64 nt, hsa; identical to SEQ ID NO: 193187

SEQ ID NO: 410919 - RNA, 64 nt, hsa; identical to SEQ ID NO: 193188

SEQ ID NO: 410920 - RNA, 64 nt, hsa; identical to SEQ ID NO: 193188

SEQ ID NO: 410921 - RNA, 64 nt, hsa; identical to SEQ ID NO: 193190

SEQ ID NO: 410922 - RNA, 64 nt, hsa; identical to SEQ ID NO: 193191

SEQ ID NO: 410923 - RNA, 64 nt, hsa; identical to SEQ ID NO: 193192

SEQ ID NO: 410924 - RNA, 64 nt, hsa; identical to SEQ ID NO: 193193

SEQ ID NO: 410925 - RNA, 64 nt, hsa; identical to SEQ ID NO: 193194

SEQ ID NO: 410926 - RNA, 64 nt, hsa; identical to SEQ ID NO: 193195

SEQ ID NO: 410927 - RNA, 64 nt, hsa; identical to SEQ ID NO: 193196

SEQ ID NO: 410928 - RNA, 64 nt, hsa; identical to SEQ ID NO: 193197

SEQ ID NO: 410929 - RNA, 64 nt, hsa; identical to SEQ ID NO: 193198

SEQ ID NO: 410930 - RNA, 64 nt, hsa; identical to SEQ ID NO: 193199

SEQ ID NO: 410931 - RNA, 64 nt, hsa; identical to SEQ ID NO: 193200

SEQ ID NO: 410932 - RNA, 64 nt, hsa
ugcugugaauuucuuuacugauuucucuauucuccggugagaaacaauuaaaugugauuuaacg

SEQ ID NO: 410933 - RNA, 64 nt, hsa
gcccuugacauggacaauagguuuuuuacuuugacggugagaagucuccaccuggucuuccaga

SEQ ID NO: 410934 - RNA, 64 nt, hsa
uguacgaguccacgauggugguggaaggugugcucggugagaaguccugcacccugcggcuccg

SEQ ID NO: 410935 - RNA, 64 nt, hsa
ccaaggaagauggaguuggugaugugcaacauuucggugagaacuuuauugucagagguuuuca

SEQ ID NO: 410936 - RNA, 64 nt, hsa
guccucuuuguggcaacagaucucagauauccuacggugagaagcuuaccauaagcuuggcacc

SEQ ID NO: 410937 - RNA, 64 nt, hsa
uucggucuuugcgugauguuccuuagcccaaagacggugagacagggcugaaaucagguggcuu

SEQ ID NO: 410938 - RNA, 64 nt, hsa
gagggagcgaacgagcgaacaacugagcccaagccggugagaaugugaaacaguuucucaaagg

SEQ ID NO: 410939 - RNA, 64 nt, hsa
cgaggucaggagauggagaccauccuggcuaacacggugagaccccgucuccgcuaaaaauaca

SEQ ID NO: 410940 - RNA, 64 nt, hsa
cccugggugggagcggggaguccuggugagaccccggugagauggaccauccugcccccguggg

SEQ ID NO: 410941 - RNA, 64 nt, hsa
ccaugguggagcacucacuccgugccugucugcccggugagaccucaaguuccuugcagacaaa

SEQ ID NO: 410942 - RNA, 64 nt, hsa
uugcucuggggcuugcuauuaagaaacuaagguacggugagacucugaggugucaggagagccc

SEQ ID NO: 410943 - RNA, 64 nt, hsa
ccuucaagggcuggcagucuuacagaggcuggagcggugagaaugagaggccagagggaccaua

SEQ ID NO: 410944 - RNA, 64 nt, hsa
accugccccaaaguuggcuccauccuggacaacucggugagaggcagugggcaagugaucuugg

SEQ ID NO: 410945 - RNA, 64 nt, hsa
ucaaagcguuuaucugagaguucguguuccugaacggugagaagcauuuaggcauuagagucau

SEQ ID NO: 410946 - RNA, 64 nt, hsa
cugccucuccccauucgugugugguuuucuugaucggugagaucugucucugaagucacugcca

SEQ ID NO: 410947 - RNA, 56 nt, hsa
gcaccgacacgcugcugugagggucccggugagauggagugggucacaccuggcaa

SEQ ID NO: 410948 - RNA, 64 nt, hsa
aggugcuuuuuucuuaugcaaaaauacuccuuuccggugagaccagauuaacuaucuccauguu

SEQ ID NO: 410949 - RNA, 64 nt, hsa
cugagauuacgccacugcacucuagccugggcaacggugagacccugccucaaaaaaaauaaaa

SEQ ID NO: 410950 - RNA, 64 nt, hsa
gaggcgagccagggggcuccccggaccgcauggccggugagaguagagucggaggcggagagcc

SEQ ID NO: 410951 - RNA, 64 nt, hsa
uguuuuagaguuaacaaugauauauggauaaugccggugagaauaagagagucauaaaccuuaa

SEQ ID NO: 410952 - RNA, 64 nt, hsa
gccugcucugcggcccccugcggcugucagagagcggugagaccuggagcgaggugugggccgc

SEQ ID NO: 410953 - RNA, 64 nt, hsa
gaacccaguggggucacguaaaggaauugcaggucggugagaggacaagagggacucccauguu

SEQ ID NO: 410954 - RNA, 64 nt, hsa
gggucccggggcggggccggcguccgaggccgggcggugagaagggugcggcccgaggugcucc

SEQ ID NO: 410955 - RNA, 64 nt, hsa
ccuucagcggccgugacggggccagcuggacacacggugagauuuucucguauguaaauaaaag

SEQ ID NO: 410956 - RNA, 63 nt, hsa
ccucugggcccuggcuguagccgaggccgcagccggugagaggcggagccucgagcgggcccc

SEQ ID NO: 410957 - RNA, 64 nt, hsa
cugugggguucugcuuucgacgagaacgacccuucggugagagagcaccccaggggcacgcagg

SEQ ID NO: 410958 - RNA, 64 nt, hsa
gaaccccacaguaucuuagaggagacaaucaugucggugagaugguguggugaugaagccugcu

SEQ ID NO: 410959 - RNA, 64 nt, hsa
aucuaccuugcuguguuaaaucaugacagugagacggugagauggauucguuuugcacacaaca

SEQ ID NO: 410960 - RNA, 64 nt, hsa
ccgcgcuccugcugaagaguuuagaaugaggcagcggugagaagaagggugggagggcgugggg

SEQ ID NO: 410961 - RNA, 64 nt, hsa
cucagugugccucucuggccgcccacuggaugagcggugagacgaacaaaagggaaaggaaaaa

SEQ ID NO: 410962 - RNA, 64 nt, hsa
ccaggggugguggucccagccaguuuggugcugacggugagaggaaauuagaaucuguuugcaa

SEQ ID NO: 410963 - RNA, 64 nt, hsa
cccacaggcugguguaaggagcggggcuugggaucggugagacugauacagacuugaccuuuca

SEQ ID NO: 410964 - RNA, 64 nt, hsa
aaguucugguuaaggaggaaauuagugccacccacggugagaagcagagaaggcacuugcaucc

SEQ ID NO: 410965 - RNA, 64 nt, hsa
ugucuauuccuauggagaagccaguaguuagaaacggugagaauuccaacacuguucauguaac

SEQ ID NO: 410966 - RNA, 64 nt, hsa
uccaagagcccauugaagaagcccagugaugagacggugagaugguuugaguccucggugccug

SEQ ID NO: 410967 - RNA, 64 nt, hsa
caguuauuucuauccacgccuaugaaucuuuggacggugagaucucacagaugucagaacugcu

SEQ ID NO: 410968 - RNA, 64 nt, hsa
caucccccaucccuuguucacacgcccugauucacggugagacauuuugccaccuucuugugua

SEQ ID NO: 410969 - RNA, 64 nt, hsa
acucggguuucucuguggcuccaggccaaagugccggugagacccauggcuguguugguguggc

SEQ ID NO: 410970 - RNA, 64 nt, hsa
uagcagggaaacagcuaaugggacacuaauggggcggugagaggggaacagacuggaagcacag

SEQ ID NO: 410971 - RNA, 64 nt, hsa
aggaggcugagcagaaggagucaucauggaggagcggugagaacauggaaccggacuccaagau

SEQ ID NO: 410972 - RNA, 64 nt, hsa
cuuucuauuuccaguacacgucacauuauuuuaccggugagaugagaaugucacaaacauuaaa

SEQ ID NO: 410973 - RNA, 64 nt, hsa
ucccggccugaggccccugcagccacgcaccucccggugagaagcagagcgcgagagggagccc

SEQ ID NO: 410974 - RNA, 64 nt, hsa
agguggccggcuccucggacucugcuuuauguugcggugagaacucugcccaggugugcagggu

SEQ ID NO: 410975 - RNA, 64 nt, hsa
ugagaggugaaggagccagguggcuucauucuggcggugagaggcccacgaccacgggagugag

SEQ ID NO: 410976 - RNA, 64 nt, hsa
aggguuugccggcccuaacgcugcagcgcgugcgcggugagaggcccuuuuugagccuguuuac

SEQ ID NO: 410977 - RNA, 64 nt, hsa
gagggaaguagaggcugggagcaaaugccccaugcggugagaggaugaggggagccuacgccuc

SEQ ID NO: 410978 - RNA, 64 nt, hsa
gcaugaucgcgacacugcacuccagccugggugacggugagacuuugucucaaaaaaaaaaaaa

SEQ ID NO: 410979 - RNA, 64 nt, hsa
ggcggggaucugggagggucgggggagcaaaaggcggugagagaggauuuauuuaaaaaaauaa

SEQ ID NO: 410980 - RNA, 64 nt, hsa
cagagggagcauggcccagggguguugaggccagcggugagagccguguuagccaagacaugga

SEQ ID NO: 410981 - RNA, 64 nt, hsa
caaacgcugccugaccuucacucugugguuggggcggugagaaccacugagguccaaugaugag

SEQ ID NO: 410982 - RNA, 64 nt, hsa
gguggggaggcuuuggcuggcugggcguguaggacggugagagcacuucugucuuaaagguuuu

SEQ ID NO: 410983 - RNA, 64 nt, hsa
gccuucuccguggcuuccgcagcuaccgucugcacggugagagggcacgggcacacgguucggg

SEQ ID NO: 410984 - RNA, 64 nt, hsa
ucucugcccucccucuuacccugccucuguguuucggugagagucucuguauauguacugcuuu

SEQ ID NO: 410985 - RNA, 64 nt, hsa
guuauguggccucugaggcuacaggcacuugcaaauccgagaggaaagugccgucuuucauagc

SEQ ID NO: 410986 - RNA, 64 nt, hsa
cuguauaaagaguauguagcaacaacuguuuaacauccgagaugaaguggaccugaugcuguau

SEQ ID NO: 410987 - RNA, 64 nt, hsa; identical to SEQ ID NO: 125667

SEQ ID NO: 410988 - RNA, 64 nt, hsa; identical to SEQ ID NO: 125668

SEQ ID NO: 410989 - RNA, 64 nt, hsa; identical to SEQ ID NO: 125669

SEQ ID NO: 410990 - RNA, 64 nt, hsa; identical to SEQ ID NO: 125670

SEQ ID NO: 410991 - RNA, 64 nt, hsa; identical to SEQ ID NO: 125671

SEQ ID NO: 410992 - RNA, 64 nt, hsa; identical to SEQ ID NO: 125672

SEQ ID NO: 410993 - RNA, 64 nt, hsa; identical to SEQ ID NO: 125673

SEQ ID NO: 410994 - RNA, 64 nt, hsa; identical to SEQ ID NO: 125674

SEQ ID NO: 410995 - RNA, 64 nt, hsa; identical to SEQ ID NO: 125675

SEQ ID NO: 410996 - RNA, 64 nt, hsa; identical to SEQ ID NO: 125676

SEQ ID NO: 410997 - RNA, 64 nt, hsa; identical to SEQ ID NO: 125677

SEQ ID NO: 410998 - RNA, 64 nt, hsa; identical to SEQ ID NO: 125678

SEQ ID NO: 410999 - RNA, 64 nt, hsa; identical to SEQ ID NO: 125679

SEQ ID NO: 411000 - RNA, 64 nt, hsa; identical to SEQ ID NO: 125680

SEQ ID NO: 411001 - RNA, 64 nt, hsa; identical to SEQ ID NO: 125681

SEQ ID NO: 411002 - RNA, 64 nt, hsa; identical to SEQ ID NO: 125682

SEQ ID NO: 411003 - RNA, 64 nt, hsa; identical to SEQ ID NO: 125683

SEQ ID NO: 411004 - RNA, 64 nt, hsa; identical to SEQ ID NO: 125684

SEQ ID NO: 411005 - RNA, 64 nt, hsa; identical to SEQ ID NO: 125685

SEQ ID NO: 411006 - RNA, 64 nt, hsa; identical to SEQ ID NO: 125686

SEQ ID NO: 411007 - RNA, 64 nt, hsa; identical to SEQ ID NO: 125687

SEQ ID NO: 411008 - RNA, 64 nt, hsa; identical to SEQ ID NO: 125688

SEQ ID NO: 411009 - RNA, 64 nt, hsa; identical to SEQ ID NO: 125689

SEQ ID NO: 411010 - RNA, 64 nt, hsa; identical to SEQ ID NO: 125690

SEQ ID NO: 411011 - RNA, 64 nt, hsa; identical to SEQ ID NO: 125691

SEQ ID NO: 411012 - RNA, 64 nt, hsa; identical to SEQ ID NO: 125692

SEQ ID NO: 411013 - RNA, 64 nt, hsa; identical to SEQ ID NO: 125693

SEQ ID NO: 411014 - RNA, 64 nt, hsa; identical to SEQ ID NO: 125694

SEQ ID NO: 411015 - RNA, 64 nt, hsa; identical to SEQ ID NO: 125695

SEQ ID NO: 411016 - RNA, 64 nt, hsa; identical to SEQ ID NO: 125696

SEQ ID NO: 411017 - RNA, 64 nt, hsa; identical to SEQ ID NO: 125697

SEQ ID NO: 411018 - RNA, 64 nt, hsa; identical to SEQ ID NO: 125698

SEQ ID NO: 411019 - RNA, 64 nt, hsa; identical to SEQ ID NO: 125699

SEQ ID NO: 411020 - RNA, 64 nt, hsa; identical to SEQ ID NO: 125700

SEQ ID NO: 411021 - RNA, 64 nt, hsa
uugauccccaaagaagcugcgccccaccuuuccagauacccacaaagcccccagacagaaucua

SEQ ID NO: 411022 - RNA, 64 nt, hsa
ggggggaggggacugggacuggcggugagguuuugauacccacacccagccaucuggagucaug

SEQ ID NO: 411023 - RNA, 64 nt, hsa
ggggaacauucagagcaugauugguagacagaagggugcagaggcgcccaggggaguacauugc

SEQ ID NO: 411024 - RNA, 64 nt, hsa
cuguccugcuagccuuccuccaggaagcacacugggugcagauaaucaggacauuccagagauc

SEQ ID NO: 411025 - RNA, 64 nt, hsa
agggcugaggucugaugggaaggacuugacuccaggugcagagaugcacaggcucaagagagua

SEQ ID NO: 411026 - RNA, 64 nt, hsa
ccaaaacacacacacacauuuacaauggacugcuggugcagaagaauaaacaacuuuaaaaaua

SEQ ID NO: 411027 - RNA, 64 nt, hsa
ugacaaguaccuucugccuccuccauucuuccugggugcagaacuguagaagacccugaggacu

SEQ ID NO: 411028 - RNA, 64 nt, hsa
acuccugggcuagugugagcagcuauucugcaugggugcagauggcuggaugugaaagagacau

SEQ ID NO: 411029 - RNA, 64 nt, hsa
agauggcaagggcagugcguggaaaggccggggaggugcagaaaccagagcccagggcaauggu

SEQ ID NO: 411030 - RNA, 64 nt, hsa
gagugcucugggagccaggccagggugugagggaggugcagaggcauccggggcgggagcaagc

SEQ ID NO: 411031 - RNA, 64 nt, hsa
aacagggucaagggugcagaggccaggcagagugggugcagagugggggaugggcaaccagccu

SEQ ID NO: 411032 - RNA, 64 nt, hsa
cagcagggaagaggggcaauacaacagggucaagggugcagaggccaggcagagugggugcaga

SEQ ID NO: 411033 - RNA, 64 nt, hsa
aagaaacucugaguuugagguacaggggcuucggggugcagacgucccuccagggcccaugguc

SEQ ID NO: 411034 - RNA, 64 nt, hsa
auuccuggcugaggggucaguuuuauggcugggaggugcagaauuacacagaagucccagucug

SEQ ID NO: 411035 - RNA, 64 nt, hsa
ugcugcagcagcuggacugagggcagagccuguaggugcagaggcccuggcucccgagguccag

SEQ ID NO: 411036 - RNA, 64 nt, hsa
aacugcagcagcuggacugagggcagagucugugggugcagagacccugcauguaggucacagg

SEQ ID NO: 411037 - RNA, 64 nt, hsa
cagcuggacaauaugaaucuuuuccacugaaguuagggaugacugugauuuucagaacacgucc

SEQ ID NO: 411038 - RNA, 64 nt, hsa
uauuuuuugagaaagauagauaugagguuuagagagggaugaagaggugagaguaagccuugug

SEQ ID NO: 411039 - RNA, 64 nt, hsa
ucuucccugcuucccucgaacccagagauuuuugagggaugaacggguagacaaggacugagau

SEQ ID NO: 411040 - RNA, 64 nt, hsa
cucucucucccaaggccugacaaugguaccuauuagggaugagauacagacaaggauagcuauc

SEQ ID NO: 411041 - RNA, 64 nt, hsa
agguggccuuagaaagcaaagcuuguaacuggcaagggaugaugucagauucagcccaagguuc

SEQ ID NO: 411042 - RNA, 64 nt, hsa
uccuaccuccuuggagaugagauagggaaggagcagggaugagacuggcaauggucacagggaa

SEQ ID NO: 411043 - RNA, 64 nt, hsa
ugucggguuuccaguuucaccguguguuagggugagggaugauuguaaaauuugcuccucaaag

SEQ ID NO: 411044 - RNA, 64 nt, hsa
cucuccugucacccuaagagccacugaguuguguagggaugaagacuauugaagacuccauugc

SEQ ID NO: 411045 - RNA, 64 nt, hsa
ccuccaaaaucuacauuuacacaguagguaaauuagggaugacugcauuaucaaaauacucuca

SEQ ID NO: 411046 - RNA, 64 nt, hsa
gcccaaagacagcuugcaccacagcgcuggggagagggaugaaggcucggcggcccagggcagc

SEQ ID NO: 411047 - RNA, 64 nt, hsa
gugggcccugagcccucagguccccagcuccuugagggaugaaccugggagcccaagagccagu

SEQ ID NO: 411048 - RNA, 64 nt, hsa
ccccacgccuguaucuggcacugcuggugugugcagggaugaaacccagcaucagagagguuuu

SEQ ID NO: 411049 - RNA, 64 nt, hsa
ucagggaauuguuuuaagucuuaucaagcagccaagggaugaaagagaagguggguuuucauca

SEQ ID NO: 411050 - RNA, 64 nt, hsa
agguggguuuucaucaagacuggaagguggggacagggaugagcauggagcuggccgugggccu

SEQ ID NO: 411051 - RNA, 64 nt, hsa
ccucagcagggcuuacuaagcacuaccccuuaacagggaugacuccgcacugccccucaacagg

SEQ ID NO: 411052 - RNA, 64 nt, hsa
ccuuaacagggaugacuccgcacugccccucaacagggaugacucagcagagaugacucagcac

SEQ ID NO: 411053 - RNA, 64 nt, hsa
acucagcagagaugacucagcacugucccuuagcagggaugacacagcaaggaugacucagcac

SEQ ID NO: 411054 - RNA, 64 nt, hsa
augacucagggauggcuuaguacugccccucagcagggaugacucagcaccgccucucaacagg

SEQ ID NO: 411055 - RNA, 64 nt, hsa
ccucagcagggaugacucagcaccgccucucaacagggaugacucagcagggaugacucagcac

SEQ ID NO: 411056 - RNA, 64 nt, hsa
acucagcaccgccucucaacagggaugacucagcagggaugacucagcaccgccccucaacagg

SEQ ID NO: 411057 - RNA, 64 nt, hsa
acucugcagagaugacucagcacugucccuuagcagggaugacacagcaaggaugacucagcac

SEQ ID NO: 411058 - RNA, 64 nt, hsa
ccucagcaaggaugacucagcacugccgcucaacagggaugacucagggauggcuuaguacugc

SEQ ID NO: 411059 - RNA, 64 nt, hsa
augacucagggauggcuuaguacugccccucaacagggaugacucagcagggaugacucagcac

SEQ ID NO: 411060 - RNA, 64 nt, hsa
gcuuaguacugccccucaacagggaugacucagcagggaugacucagcaccgccccucaacagg

SEQ ID NO: 411061 - RNA, 64 nt, hsa
acucugcagagaugacuuaguacugccccucagcagggaugacucaguacugccccucagcagg

SEQ ID NO: 411062 - RNA, 64 nt, hsa
ccucagcagggaugacucaguacugccccucagcagggaugacucagcacugccccucaacagg

SEQ ID NO: 411063 - RNA, 64 nt, hsa
ccucagcagggaugacucagcacugccccucaacagggaugacucagcagggaugacucagcac

SEQ ID NO: 411064 - RNA, 64 nt, hsa
acucagcacugccccucaacagggaugacucagcagggaugacucagcacugucccuuagcagu

SEQ ID NO: 411065 - RNA, 64 nt, hsa
augacucagggauggcuuaguacugccccucagcagggaugacucagcaccgccccucaacagg

SEQ ID NO: 411066 - RNA, 64 nt, hsa
ccucagcagggaugacucagcaccgccccucaacagggaugacucagcacugccccucaacagg

SEQ ID NO: 411067 - RNA, 64 nt, hsa
ccucaacagggaugacucagcacugccccucaacagggaugacucagcagggaugacucagcag

SEQ ID NO: 411068 - RNA, 64 nt, hsa
acucagcacugccccucaacagggaugacucagcagggaugacucagcagugucccuuagcagc

SEQ ID NO: 411069 - RNA, 64 nt, hsa
augacucagggauggcuuaguacugccccucagcagggaugacucagcagggaugacucagcac

SEQ ID NO: 411070 - RNA, 64 nt, hsa
gcuuaguacugccccucagcagggaugacucagcagggaugacucagcaccaccccucaacagg

SEQ ID NO: 411071 - RNA, 64 nt, hsa
acucagcagggaugacucagcaccaccccucaacagggaugacucagcagggaugacucagcac

SEQ ID NO: 411072 - RNA, 64 nt, hsa
acucagcaccaccccucaacagggaugacucagcagggaugacucagcacugccccucaacagg

SEQ ID NO: 411073 - RNA, 64 nt, hsa
acucagcagggaugacucagcacugccccucaacagggaugacugcagggaugacucagcacug

SEQ ID NO: 411074 - RNA, 64 nt, hsa
ugacucagcacugccccucaacagggaugacugcagggaugacucagcacugccccucagcagg

SEQ ID NO: 411075 - RNA, 64 nt, hsa
ugacugcagggaugacucagcacugccccucagcagggaugacucagcacugccccucagcagg

SEQ ID NO: 411076 - RNA, 64 nt, hsa
ccucagcagggaugacucagcacugccccucagcagggaugacucagcagggaugacucagcac

SEQ ID NO: 411077 - RNA, 64 nt, hsa
acucagcacugccccucagcagggaugacucagcagggaugacucagcaccgccccucaacagg

SEQ ID NO: 411078 - RNA, 64 nt, hsa
acucagcacugccccucagcagggauggcucagcagggaugacucagcauugccccucaacagg

SEQ ID NO: 411079 - RNA, 64 nt, hsa
gcucagcagggaugacucagcauugccccucaacagggaugacucagcagacucagcagggaug

SEQ ID NO: 411080 - RNA, 64 nt, hsa
ugccccucaacagggaugacucagcagacucagcagggaugacucagcacugccccucaacaga

SEQ ID NO: 411081 - RNA, 64 nt, hsa
acucagcacugccccucaacagacaugacucagcagggaugacucagcaccgccccucagcaag

SEQ ID NO: 411082 - RNA, 64 nt, hsa
acucagcaccgccccucagcaaggaugacucagcagggaugauucagcagagauaacucgggga

SEQ ID NO: 411083 - RNA, 64 nt, hsa
gauaacucggggaugacucugauuguccuucagcagggaugagucuguuuugcuccgauggaag

SEQ ID NO: 411084 - RNA, 64 nt, hsa
uugcauaggaaauacuugauuuaauuacagguccagggaugagcugaugguugcuggaggaggc

SEQ ID NO: 411085 - RNA, 64 nt, hsa
auuuucucacccaaggaacauuugaucuagcagcagggaugagaggaaagcagaaaugaaugaa

SEQ ID NO: 411086 - RNA, 64 nt, hsa
ccuuucuggcagccucuuggugcucuggguagugagggaugaccagucuuguccugagaaaugu

SEQ ID NO: 411087 - RNA, 64 nt, hsa
uacugcuugguacgcagagcaccgaggccgagccagggaugaagcugaaauggaauaucugaag

SEQ ID NO: 411088 - RNA, 64 nt, hsa
agagaagcagaugagggaggaggcugaacgcacgagggaugaguuggagaggaggcugcugcag

SEQ ID NO: 411089 - RNA, 64 nt, hsa; identical to SEQ ID NO: 125072

SEQ ID NO: 411090 - RNA, 64 nt, hsa; identical to SEQ ID NO: 125073

SEQ ID NO: 411091 - RNA, 64 nt, hsa; identical to SEQ ID NO: 125074

SEQ ID NO: 411092 - RNA, 64 nt, hsa; identical to SEQ ID NO: 125075

SEQ ID NO: 411093 - RNA, 64 nt, hsa; identical to SEQ ID NO: 125076

SEQ ID NO: 411094 - RNA, 64 nt, hsa; identical to SEQ ID NO: 125077

SEQ ID NO: 411095 - RNA, 64 nt, hsa; identical to SEQ ID NO: 125078

SEQ ID NO: 411096 - RNA, 64 nt, hsa; identical to SEQ ID NO: 125079

SEQ ID NO: 411097 - RNA, 64 nt, hsa; identical to SEQ ID NO: 125080

SEQ ID NO: 411098 - RNA, 64 nt, hsa; identical to SEQ ID NO: 125081

SEQ ID NO: 411099 - RNA, 64 nt, hsa; identical to SEQ ID NO: 125082

SEQ ID NO: 411100 - RNA, 64 nt, hsa; identical to SEQ ID NO: 125083

SEQ ID NO: 411101 - RNA, 64 nt, hsa; identical to SEQ ID NO: 125084

SEQ ID NO: 411102 - RNA, 64 nt, hsa; identical to SEQ ID NO: 125085

SEQ ID NO: 411103 - RNA, 64 nt, hsa; identical to SEQ ID NO: 125086

SEQ ID NO: 411104 - RNA, 64 nt, hsa; identical to SEQ ID NO: 125087

SEQ ID NO: 411105 - RNA, 64 nt, hsa; identical to SEQ ID NO: 125088

SEQ ID NO: 411106 - RNA, 64 nt, hsa; identical to SEQ ID NO: 125089

SEQ ID NO: 411107 - RNA, 64 nt, hsa; identical to SEQ ID NO: 125090

SEQ ID NO: 411108 - RNA, 64 nt, hsa; identical to SEQ ID NO: 362427

SEQ ID NO: 411109 - RNA, 64 nt, hsa; identical to SEQ ID NO: 362428

SEQ ID NO: 411110 - RNA, 64 nt, hsa; identical to SEQ ID NO: 362429

SEQ ID NO: 411111 - RNA, 64 nt, hsa; identical to SEQ ID NO: 362430

SEQ ID NO: 411112 - RNA, 64 nt, hsa; identical to SEQ ID NO: 362431

SEQ ID NO: 411113 - RNA, 64 nt, hsa; identical to SEQ ID NO: 362432

SEQ ID NO: 411114 - RNA, 64 nt, hsa; identical to SEQ ID NO: 362433

SEQ ID NO: 411115 - RNA, 64 nt, hsa; identical to SEQ ID NO: 362434

SEQ ID NO: 411116 - RNA, 64 nt, hsa; identical to SEQ ID NO: 362435

SEQ ID NO: 411117 - RNA, 64 nt, hsa; identical to SEQ ID NO: 362436

SEQ ID NO: 411118 - RNA, 64 nt, hsa; identical to SEQ ID NO: 362437

SEQ ID NO: 411119 - RNA, 64 nt, hsa; identical to SEQ ID NO: 362438

SEQ ID NO: 411120 - RNA, 64 nt, hsa; identical to SEQ ID NO: 362439

SEQ ID NO: 411121 - RNA, 64 nt, hsa; identical to SEQ ID NO: 362440

SEQ ID NO: 411122 - RNA, 64 nt, hsa; identical to SEQ ID NO: 365461

SEQ ID NO: 411123 - RNA, 64 nt, hsa; identical to SEQ ID NO: 365462

SEQ ID NO: 411124 - RNA, 64 nt, hsa; identical to SEQ ID NO: 365463

SEQ ID NO: 411125 - RNA, 64 nt, hsa; identical to SEQ ID NO: 365464

SEQ ID NO: 411126 - RNA, 64 nt, hsa; identical to SEQ ID NO: 365465

SEQ ID NO: 411127 - RNA, 64 nt, hsa; identical to SEQ ID NO: 365466

SEQ ID NO: 411128 - RNA, 64 nt, hsa; identical to SEQ ID NO: 365467

SEQ ID NO: 411129 - RNA, 64 nt, hsa; identical to SEQ ID NO: 365468

SEQ ID NO: 411130 - RNA, 64 nt, hsa; identical to SEQ ID NO: 365469

SEQ ID NO: 411131 - RNA, 64 nt, hsa; identical to SEQ ID NO: 365470

SEQ ID NO: 411132 - RNA, 64 nt, hsa; identical to SEQ ID NO: 365471

SEQ ID NO: 411133 - RNA, 64 nt, hsa; identical to SEQ ID NO: 365472

SEQ ID NO: 411134 - RNA, 64 nt, hsa; identical to SEQ ID NO: 365473

SEQ ID NO: 411135 - RNA, 64 nt, hsa; identical to SEQ ID NO: 365474

SEQ ID NO: 411136 - RNA, 64 nt, hsa; identical to SEQ ID NO: 365475

SEQ ID NO: 411137 - RNA, 64 nt, hsa; identical to SEQ ID NO: 365476

SEQ ID NO: 411138 - RNA, 64 nt, hsa; identical to SEQ ID NO: 365477

SEQ ID NO: 411139 - RNA, 64 nt, hsa; identical to SEQ ID NO: 365478

SEQ ID NO: 411140 - RNA, 64 nt, hsa; identical to SEQ ID NO: 365479

SEQ ID NO: 411141 - RNA, 62 nt, hsa; identical to SEQ ID NO: 365480

SEQ ID NO: 411142 - RNA, 64 nt, hsa; identical to SEQ ID NO: 365481

SEQ ID NO: 411143 - RNA, 64 nt, hsa; identical to SEQ ID NO: 365482

SEQ ID NO: 411144 - RNA, 64 nt, hsa; identical to SEQ ID NO: 365483

SEQ ID NO: 411145 - RNA, 64 nt, hsa; identical to SEQ ID NO: 365484

SEQ ID NO: 411146 - RNA, 64 nt, hsa; identical to SEQ ID NO: 365485

SEQ ID NO: 411147 - RNA, 64 nt, hsa; identical to SEQ ID NO: 365486

SEQ ID NO: 411148 - RNA, 64 nt, hsa; identical to SEQ ID NO: 365487

SEQ ID NO: 411149 - RNA, 64 nt, hsa; identical to SEQ ID NO: 365488

SEQ ID NO: 411150 - RNA, 64 nt, hsa; identical to SEQ ID NO: 365489

SEQ ID NO: 411151 - RNA, 64 nt, hsa; identical to SEQ ID NO: 365490

SEQ ID NO: 411152 - RNA, 64 nt, hsa; identical to SEQ ID NO: 365491

SEQ ID NO: 411153 - RNA, 64 nt, hsa; identical to SEQ ID NO: 365492

SEQ ID NO: 411154 - RNA, 64 nt, hsa; identical to SEQ ID NO: 365493

SEQ ID NO: 411155 - RNA, 64 nt, hsa; identical to SEQ ID NO: 365494

SEQ ID NO: 411156 - RNA, 64 nt, hsa; identical to SEQ ID NO: 365495

SEQ ID NO: 411157 - RNA, 64 nt, hsa; identical to SEQ ID NO: 365496

SEQ ID NO: 411158 - RNA, 64 nt, hsa; identical to SEQ ID NO: 365497

SEQ ID NO: 411159 - RNA, 64 nt, hsa; identical to SEQ ID NO: 365498

SEQ ID NO: 411160 - RNA, 64 nt, hsa; identical to SEQ ID NO: 365499

SEQ ID NO: 411161 - RNA, 64 nt, hsa; identical to SEQ ID NO: 365500

SEQ ID NO: 411162 - RNA, 64 nt, hsa; identical to SEQ ID NO: 365501

SEQ ID NO: 411163 - RNA, 64 nt, hsa; identical to SEQ ID NO: 365502

SEQ ID NO: 411164 - RNA, 64 nt, hsa; identical to SEQ ID NO: 365503

SEQ ID NO: 411165 - RNA, 64 nt, hsa; identical to SEQ ID NO: 365504

SEQ ID NO: 411166 - RNA, 56 nt, hsa; identical to SEQ ID NO: 365505

SEQ ID NO: 411167 - RNA, 64 nt, hsa; identical to SEQ ID NO: 365506

SEQ ID NO: 411168 - RNA, 64 nt, hsa; identical to SEQ ID NO: 365507

SEQ ID NO: 411169 - RNA, 64 nt, hsa; identical to SEQ ID NO: 365508

SEQ ID NO: 411170 - RNA, 64 nt, hsa; identical to SEQ ID NO: 365509

SEQ ID NO: 411171 - RNA, 64 nt, hsa; identical to SEQ ID NO: 365510

SEQ ID NO: 411172 - RNA, 64 nt, hsa; identical to SEQ ID NO: 365511

SEQ ID NO: 411173 - RNA, 64 nt, hsa; identical to SEQ ID NO: 365512

SEQ ID NO: 411174 - RNA, 64 nt, hsa; identical to SEQ ID NO: 365513

SEQ ID NO: 411175 - RNA, 64 nt, hsa; identical to SEQ ID NO: 365514

SEQ ID NO: 411176 - RNA, 64 nt, hsa; identical to SEQ ID NO: 365515

SEQ ID NO: 411177 - RNA, 64 nt, hsa; identical to SEQ ID NO: 365516

SEQ ID NO: 411178 - RNA, 64 nt, hsa; identical to SEQ ID NO: 365517

SEQ ID NO: 411179 - RNA, 64 nt, hsa; identical to SEQ ID NO: 365518

SEQ ID NO: 411180 - RNA, 64 nt, hsa; identical to SEQ ID NO: 365519

SEQ ID NO: 411181 - RNA, 64 nt, hsa; identical to SEQ ID NO: 365520

SEQ ID NO: 411182 - RNA, 64 nt, hsa; identical to SEQ ID NO: 365521

SEQ ID NO: 411183 - RNA, 64 nt, hsa; identical to SEQ ID NO: 365522

SEQ ID NO: 411184 - RNA, 64 nt, hsa; identical to SEQ ID NO: 365523

SEQ ID NO: 411185 - RNA, 64 nt, hsa; identical to SEQ ID NO: 365524

SEQ ID NO: 411186 - RNA, 64 nt, hsa; identical to SEQ ID NO: 365525

SEQ ID NO: 411187 - RNA, 64 nt, hsa; identical to SEQ ID NO: 147267

SEQ ID NO: 411188 - RNA, 64 nt, hsa; identical to SEQ ID NO: 147268

SEQ ID NO: 411189 - RNA, 64 nt, hsa; identical to SEQ ID NO: 147269

SEQ ID NO: 411190 - RNA, 64 nt, hsa; identical to SEQ ID NO: 147270

SEQ ID NO: 411191 - RNA, 64 nt, hsa; identical to SEQ ID NO: 147271

SEQ ID NO: 411192 - RNA, 64 nt, hsa; identical to SEQ ID NO: 147272

SEQ ID NO: 411193 - RNA, 64 nt, hsa; identical to SEQ ID NO: 147273

SEQ ID NO: 411194 - RNA, 64 nt, hsa; identical to SEQ ID NO: 147274

SEQ ID NO: 411195 - RNA, 64 nt, hsa; identical to SEQ ID NO: 147275

SEQ ID NO: 411196 - RNA, 64 nt, hsa; identical to SEQ ID NO: 147276

SEQ ID NO: 411197 - RNA, 64 nt, hsa; identical to SEQ ID NO: 147277

SEQ ID NO: 411198 - RNA, 64 nt, hsa; identical to SEQ ID NO: 147278

SEQ ID NO: 411199 - RNA, 64 nt, hsa; identical to SEQ ID NO: 147279

SEQ ID NO: 411200 - RNA, 64 nt, hsa; identical to SEQ ID NO: 147280

SEQ ID NO: 411201 - RNA, 64 nt, hsa; identical to SEQ ID NO: 147281

SEQ ID NO: 411202 - RNA, 64 nt, hsa; identical to SEQ ID NO: 147282

SEQ ID NO: 411203 - RNA, 64 nt, hsa; identical to SEQ ID NO: 147283

SEQ ID NO: 411204 - RNA, 64 nt, hsa; identical to SEQ ID NO: 147284

SEQ ID NO: 411205 - RNA, 64 nt, hsa; identical to SEQ ID NO: 147285

SEQ ID NO: 411206 - RNA, 64 nt, hsa; identical to SEQ ID NO: 147286

SEQ ID NO: 411207 - RNA, 64 nt, hsa; identical to SEQ ID NO: 147287

SEQ ID NO: 411208 - RNA, 64 nt, hsa; identical to SEQ ID NO: 147288

SEQ ID NO: 411209 - RNA, 64 nt, hsa; identical to SEQ ID NO: 147289

SEQ ID NO: 411210 - RNA, 64 nt, hsa; identical to SEQ ID NO: 147290

SEQ ID NO: 411211 - RNA, 64 nt, hsa; identical to SEQ ID NO: 147291

SEQ ID NO: 411212 - RNA, 64 nt, hsa; identical to SEQ ID NO: 147292

SEQ ID NO: 411213 - RNA, 64 nt, hsa; identical to SEQ ID NO: 147293

SEQ ID NO: 411214 - RNA, 64 nt, hsa; identical to SEQ ID NO: 147294

SEQ ID NO: 411215 - RNA, 64 nt, hsa; identical to SEQ ID NO: 147295

SEQ ID NO: 411216 - RNA, 64 nt, hsa; identical to SEQ ID NO: 147296

SEQ ID NO: 411217 - RNA, 64 nt, hsa; identical to SEQ ID NO: 147297

SEQ ID NO: 411218 - RNA, 64 nt, hsa; identical to SEQ ID NO: 147298

SEQ ID NO: 411219 - RNA, 64 nt, hsa; identical to SEQ ID NO: 147299

SEQ ID NO: 411220 - RNA, 64 nt, hsa; identical to SEQ ID NO: 147300

SEQ ID NO: 411221 - RNA, 64 nt, hsa; identical to SEQ ID NO: 147301

SEQ ID NO: 411222 - RNA, 64 nt, hsa; identical to SEQ ID NO: 147302

SEQ ID NO: 411223 - RNA, 64 nt, hsa; identical to SEQ ID NO: 147303

SEQ ID NO: 411224 - RNA, 64 nt, hsa; identical to SEQ ID NO: 147304

SEQ ID NO: 411225 - RNA, 64 nt, hsa; identical to SEQ ID NO: 147305

SEQ ID NO: 411226 - RNA, 64 nt, hsa; identical to SEQ ID NO: 147306

SEQ ID NO: 411227 - RNA, 64 nt, hsa; identical to SEQ ID NO: 147307

SEQ ID NO: 411228 - RNA, 64 nt, hsa; identical to SEQ ID NO: 147308

SEQ ID NO: 411229 - RNA, 64 nt, hsa; identical to SEQ ID NO: 147309

SEQ ID NO: 411230 - RNA, 64 nt, hsa; identical to SEQ ID NO: 147310

SEQ ID NO: 411231 - RNA, 64 nt, hsa; identical to SEQ ID NO: 147311

SEQ ID NO: 411232 - RNA, 64 nt, hsa; identical to SEQ ID NO: 147312

SEQ ID NO: 411233 - RNA, 64 nt, hsa; identical to SEQ ID NO: 147313

SEQ ID NO: 411234 - RNA, 64 nt, hsa; identical to SEQ ID NO: 147314

SEQ ID NO: 411235 - RNA, 64 nt, hsa; identical to SEQ ID NO: 147315

SEQ ID NO: 411236 - RNA, 64 nt, hsa; identical to SEQ ID NO: 147316

SEQ ID NO: 411237 - RNA, 64 nt, hsa; identical to SEQ ID NO: 147317

SEQ ID NO: 411238 - RNA, 64 nt, hsa; identical to SEQ ID NO: 147318

SEQ ID NO: 411239 - RNA, 64 nt, hsa; identical to SEQ ID NO: 147319

SEQ ID NO: 411240 - RNA, 61 nt, hsa
aaccacaugaugccugcuaguuaugauggacaggauccagaauuucugaugauuuggguuc

SEQ ID NO: 411241 - RNA, 61 nt, hsa
ugugagucuccgagcaagagcaggaauagcuaggauccaugcucccagggacuugcaggua

SEQ ID NO: 411242 - RNA, 61 nt, hsa
aguugaaaaagcuggcgccuccuuggucucuaggauccaggcuccacagagcacaugacua

SEQ ID NO: 411243 - RNA, 61 nt, hsa
ccgcccucucagcuggaugagacuguccuggaggauccaccccggaacagacagaauggug

SEQ ID NO: 411244 - RNA, 64 nt, hsa
gaguugaaaccggcaguuacacuaaguaaguggagggaaugaaaguguuucgaggugaaugugg

SEQ ID NO: 411245 - RNA, 64 nt, hsa
cuaucuuauaguaauucaggcucuaauuagcugagggaaugaaacacacaaaaaucacugaauu

SEQ ID NO: 411246 - RNA, 64 nt, hsa
uucuguuccaccguaguugauucucaguagaguugggaaugaggaugcuguuacuuggccauuu

SEQ ID NO: 411247 - RNA, 64 nt, hsa
cagaaaaggaagcaggcaugguccuggaaaauuggggaaugacgggccaaucuguguuuccuaa

SEQ ID NO: 411248 - RNA, 64 nt, hsa
uuuguuuaagcucuaacucaccccuggaauacaggggaaugaugacaaccagcccagccaggcc

SEQ ID NO: 411249 - RNA, 64 nt, hsa
ggcagugcuaaagguggagcugggggauuuuccugggaaugauuugagggcucuugaaagccca

SEQ ID NO: 411250 - RNA, 64 nt, hsa
cuuauccucuccaugcugagcuugacaacacucugggaaugaggaacaagacuuuuucuaaaaa

SEQ ID NO: 411251 - RNA, 64 nt, hsa
uuuuuuuugcuuuuauuuucuaaaucauuuuuaagggaaugaaacaggaaugucaucagagauu

SEQ ID NO: 411252 - RNA, 64 nt, hsa
caggagccauccuccuggugguacccaaugucaugggaaugaugugccugucacccccauugga

SEQ ID NO: 411253 - RNA, 64 nt, hsa
cuuccagguguugcaguaucucaacaaaauggcugggaaugaauacauggguuucagcaaugcc

SEQ ID NO: 411254 - RNA, 64 nt, hsa
uuauugauuuuaaaaguuuuacauguaggagugugggaaugaaggaauucuggagcuuuuugac

SEQ ID NO: 411255 - RNA, 64 nt, hsa
auuuagaauaaaaucucacauccauuauuuuaaagggaaugauuggggggaaaaacuggugaaa

SEQ ID NO: 411256 - RNA, 64 nt, hsa
gccuacaaucauugauuuuuuuuuguuaugucacaaucaguauaucuucuuugggguuaccucu

SEQ ID NO: 411257 - RNA, 64 nt, hsa
ccaaaaagaagcugucuuggauuuaaaucuguaaaaucaguagaaauuuuacuacaauugcuug

SEQ ID NO: 411258 - RNA, 64 nt, hsa
gauccaagccauauauugaaauacaagcgugauuaaucaguaauucacauugccgauaugcaua

SEQ ID NO: 411259 - RNA, 64 nt, hsa
cagagauaaaauuuguuaugaauuugcuuuauuuaaucaguagcaaugauagaugugaugcaua

SEQ ID NO: 411260 - RNA, 64 nt, hsa
auucccacaguuuugguaagaaaccagccccaguaaucaguaagucaggcugaacugcagugac

SEQ ID NO: 411261 - RNA, 64 nt, hsa
acuaacucugcuuagagguucaaauaucaccagcaaucaguaaaaaauucagcaauaaucuuaa

SEQ ID NO: 411262 - RNA, 64 nt, hsa
auuuagcacuggagcaaauagccaagggaaaucaaaucaguaacuggucauggucaugcaucua

SEQ ID NO: 411263 - RNA, 64 nt, hsa
augcagccuauuaagaguuggguuaaaaaucaguaaucaguacuuuauuacaucacugaacuaa

SEQ ID NO: 411264 - RNA, 64 nt, hsa
ugucuuaaugcagccuauuaagaguuggguuaaaaaucaguaaucaguacuuuauuacaucacu

SEQ ID NO: 411265 - RNA, 64 nt, hsa
uacaaaaauguuucuguuuugaaacuugaucuacaaucaguaaaaguuugauaaucaguauauc

SEQ ID NO: 411266 - RNA, 64 nt, hsa
uugaaacuugaucuacaaucaguaaaaguuugauaaucaguauaucccuucccaacccccauug

SEQ ID NO: 411267 - RNA, 64 nt, hsa
auacauuggaauuuuugucaugacacauuugccaaaucaguaggauauauuuguuuuggcagcc

SEQ ID NO: 411268 - RNA, 64 nt, hsa
agaguucacugaagauauugacacaauuuuaaaaaaucaguaaaggaauguauauaauauugcu

SEQ ID NO: 411269 - RNA, 64 nt, hsa
uacccuauagagagggggcucuccaaaggggcugcuggggcaugugugccuguggcagaaaaga

SEQ ID NO: 411270 - RNA, 64 nt, hsa
gauguccucuuuacucccuuccuggccucacuggcuggggcagaggggcagccgcuaggagaga

SEQ ID NO: 411271 - RNA, 64 nt, hsa
aggauuucuaagggucaggaggccuucaccgcugcuggggcacacacacacacaugcauacaca

SEQ ID NO: 411272 - RNA, 64 nt, hsa
agcucccagaagauaaccucuccuccugggccaccuggggcaccuuaccaccggagccgaaucu

SEQ ID NO: 411273 - RNA, 64 nt, hsa
cagcuuccagcccuacauugaaccaccuucuuuccuggggcaagagcaccaggcuccagggcac

SEQ ID NO: 411274 - RNA, 64 nt, hsa
gcuccuggccagcguuugaagccuggccucccaccuggggcauuuacugacacccugucgccag

SEQ ID NO: 411275 - RNA, 64 nt, hsa
gaaacccccgggacuuuaccccagcaggcugccacuggggcaccgaacuaagccagcucagccu

SEQ ID NO: 411276 - RNA, 64 nt, hsa
uccgaaucuggggcaauggaaucacugcuuccagcuggggcaggugagaucuuuacgccuuuua

SEQ ID NO: 411277 - RNA, 64 nt, hsa
gaagagaggccuaguuuaaaucacaauuccgaaucuggggcaauggaaucacugcuuccagcug

SEQ ID NO: 411278 - RNA, 64 nt, hsa
caucagggaggagucagaggaauuugcccaauggcuggggcaucucccuugacuuacccauaau

SEQ ID NO: 411279 - RNA, 64 nt, hsa
cgguggguuuguguuuaguucagaagcggagagccuggggcacuccuccuacucuguggaugau

SEQ ID NO: 411280 - RNA, 64 nt, hsa
caacgucucagcccuucaguuuggucugcuccgccuggggcagaaagccacaaacuccauccag

SEQ ID NO: 411281 - RNA, 64 nt, hsa
uuaucaauggcacgcuccugccuacccaguuccacuggggcaaggugagugagcccacagcauc

SEQ ID NO: 411282 - RNA, 64 nt, hsa
auuucuaaagcugaaugucaaacagugccaaaugcuggggcagggggugaagaacccucugucc

SEQ ID NO: 411283 - RNA, 64 nt, hsa
gccucccagcuuaaauccuagcaggagagaggcucuggggcagcccccaugggcuccugccccu

SEQ ID NO: 411284 - RNA, 64 nt, hsa
acccuugccgcccagcuguugugcugggcacagucuggggcacaggccuccaugaugaagacgc

SEQ ID NO: 411285 - RNA, 64 nt, hsa
gccgguggcuuucuauaaucaaaucaauauuguucuggggcaucacaaagaggaaggggguccc

SEQ ID NO: 411286 - RNA, 64 nt, hsa
agacccucuggcuggggcagcgcagacccucuagcuggggcagaacaaggcuggugcuuccuuc

SEQ ID NO: 411287 - RNA, 64 nt, hsa
guaggccucagcagggacagcacagacccucuggcuggggcagcgcagacccucuagcuggggc

SEQ ID NO: 411288 - RNA, 64 nt, hsa
ccccaacaaaacguuuucaaaccccuuacaguuccuggggcaggcggaaacaggcucacagauu

SEQ ID NO: 411289 - RNA, 64 nt, hsa
cucaggcuggagggcgucccagccuaaucccgagcuggggcacacguauccugaggggcuuggg

SEQ ID NO: 411290 - RNA, 64 nt, hsa
gcggggagcuggaagaaaagucucuuggggaccucuggggcaaggagcugagaaguccugcagc

SEQ ID NO: 411291 - RNA, 64 nt, hsa
cacagaggguccugacacucuggcagggccugagcuggggcaggccucccucagggccaggggc

SEQ ID NO: 411292 - RNA, 64 nt, hsa
gaaaggagcaggggcccugguguugcauuuagcccuggggcauggagcugaacaguacuugugc

SEQ ID NO: 411293 - RNA, 64 nt, hsa
uagacagcuguguuccuacaauuggcccagcacccuggggcacgggagaaggguggggaccguu

SEQ ID NO: 411294 - RNA, 64 nt, hsa
gccuuccccauagagaccgugcuccaacucgggccuggggcacugcucgcugcucccaggaagg

SEQ ID NO: 411295 - RNA, 64 nt, hsa
accuuugugugucaccucacacaccacaagggggcuggggcaucuggucccuggggccugggcc

SEQ ID NO: 411296 - RNA, 64 nt, hsa
ucucuccagggagccggggcugugagaggaucaucuggggcaggcccuccacuuccaagcaagc

SEQ ID NO: 411297 - RNA, 64 nt, hsa
gcuuagcaggcagcugggcauggaggugcuggggcuggggcagaugccuaauuucgcacaaugc

SEQ ID NO: 411298 - RNA, 64 nt, hsa
guuuaucaguggccagcuaccugccaggcccgggcuggggcacggucugcggccaugaggccag

SEQ ID NO: 411299 - RNA, 64 nt, hsa
gagcaaaccugucccccaccugugaccagucacucuggggcaagcaucacugggaagggcauag

SEQ ID NO: 411300 - RNA, 64 nt, hsa
ggaccaccucaccgggcaaauggggucggggggacuggggcaccagaccaggcaccaccuggac

SEQ ID NO: 411301 - RNA, 64 nt, hsa
ccaucccccacccagcucccggccguccuccuaccuggggcagcuggggcugccaucccauuuc

SEQ ID NO: 411302 - RNA, 64 nt, hsa
cagagcccaagcacuggcuucgccccucagugcccuggggcauguucagggcaggguugagggg

SEQ ID NO: 411303 - RNA, 64 nt, hsa
agugccaccugcaucgugccauaacccugaccgccuggggcaggaaguauucagguuggcugug

SEQ ID NO: 411304 - RNA, 64 nt, hsa
ggcuucccaguugagcucccaagaccaggacccacuggggcauauaaaaaagucaaaaaucaaa

SEQ ID NO: 411305 - RNA, 64 nt, hsa
ggcuucccaguugagcucccaagaccaggacccacuggggcauauaaaaucucugcuguauccu

SEQ ID NO: 411306 - RNA, 64 nt, hsa
uggcgccuccagggggcgggaggagcacuaggggcuggggcaggaggcuccuggagcgcuggau

SEQ ID NO: 411307 - RNA, 64 nt, hsa
ccagcugggggacagugggcuguuguggcugggucuggggcaggugcauuugagccagggcugg

SEQ ID NO: 411308 - RNA, 64 nt, hsa
guuuuuggaaaagggugugggggugggggcgccgcuggggcagggccagguuuuguguuuuagu

SEQ ID NO: 411309 - RNA, 64 nt, hsa
uagcgggcggcagcgccagcgccccucugucaggcuggggcaaucuugguuuuguguccaaagg

SEQ ID NO: 411310 - RNA, 64 nt, hsa
gccugcuccucugccuggaccaggaggagggccccuggggcagaaguuaggcacgaggcagucu

SEQ ID NO: 411311 - RNA, 64 nt, hsa
ccccagccaggcccugcagggcuggucagggugucuggggcaggaggaggccaacucacugaac

SEQ ID NO: 411312 - RNA, 64 nt, hsa
auggucacauggggaaccuccccucaucgggccucuggggcaggaagcuugucacuggaagauc

SEQ ID NO: 411313 - RNA, 64 nt, hsa
ucucccucucuccaacaaauggaguagcaucccccuggggcacuugcugaggccaagccacuca

SEQ ID NO: 411314 - RNA, 64 nt, hsa
gucggggugaagggugguaucuuggcaguugaagcuggggcaagaacucugggcuuggguaaug

SEQ ID NO: 411315 - RNA, 64 nt, hsa
acuggguaccucagggugagcagagggcacugggcuggggcacagccccugcuucccugcaccc

SEQ ID NO: 411316 - RNA, 64 nt, hsa
acgaugcaauuucugggccugaaugucaugcucccuggggcaggaccuugagccugcagcacac

SEQ ID NO: 411317 - RNA, 64 nt, hsa
uggagggccugguggaugcccuccucccucagagcuggggcagcugccucccaggggugggacu

SEQ ID NO: 411318 - RNA, 64 nt, hsa
cccagacuuugacaaacccaccucaacaucaagccuggggcagguggaagguggucugacugca

SEQ ID NO: 411319 - RNA, 64 nt, hsa
uucagugagagagaaaaugauuuagaucuuggugcuggggcaaggccaucagcuucagagaccu

SEQ ID NO: 411320 - RNA, 64 nt, hsa
gaggaccucugaggccaggccugaaccuucuuggcuggggcaaaccacucuucaagugguggca

SEQ ID NO: 411321 - RNA, 64 nt, hsa
cucuuuugaaaugucacaaggccgccucccaccucuggggcauuguacaaguucuucccucucc

SEQ ID NO: 411322 - RNA, 64 nt, hsa
gggccacgcagccagccagaugccuggcccugugcuggggcagacaacgcugcagagcccaggg

SEQ ID NO: 411323 - RNA, 64 nt, hsa
gcagagagcagccuggcccucaccagugcgcaagcuggggcagcaaggcugacaguugcugcau

SEQ ID NO: 411324 - RNA, 64 nt, hsa
gcccucggcaaccguggggaggccauuugcugcccuggggcaucaugggcaacucgugacagcc

SEQ ID NO: 411325 - RNA, 64 nt, hsa
ugagcaagagccaggggugucccagucccagccucuggggcagagcuuguagcccuggauggcc

SEQ ID NO: 411326 - RNA, 64 nt, hsa
ccucuggggcagagcuuguagcccuggauggccucuggggcaggaccacuagcuaagcaagcca

SEQ ID NO: 411327 - RNA, 64 nt, hsa
ugcucuucaccaccacaaaggaugugugugcauccuggggcaugccugccucaugugggggugu

SEQ ID NO: 411328 - RNA, 64 nt, hsa
acucuggcaucucugccgaggcugcuggaaucgacuggggcaucuucccggaaucagauucaaa

SEQ ID NO: 411329 - RNA, 64 nt, hsa
ucgggaggccggacucaggggucagaagcagggacuggggcaggcgagcccggacagggaagag

SEQ ID NO: 411330 - RNA, 64 nt, hsa
gauagucuccaagggaccuggccuugccaagggccuggggcaaggugucggcgggacggugagg

SEQ ID NO: 411331 - RNA, 64 nt, hsa
ccagagggcggcgaguucggggucgacucuaccccuggggcaucguggaagguaaagcacugag

SEQ ID NO: 411332 - RNA, 52 nt, hsa; identical to SEQ ID NO: 264778

SEQ ID NO: 411333 - RNA, 64 nt, hsa
aggcuuugcggggcacgggggccacucagcagcgcuggggcaggugccucugcugucagcucca

SEQ ID NO: 411334 - RNA, 64 nt, hsa
cucuugcgcggugccugagaagagggugaaggagcuggggcaggccccauccugggcauuggag

SEQ ID NO: 411335 - RNA, 64 nt, hsa
ggugagaggcaaagggcacagccaugcaaaggcccuggggcaggacggcaccugguaugcggga

SEQ ID NO: 411336 - RNA, 64 nt, hsa
ucugcauuuucgaucaugggcuacaugccgagugcuggggcacagagaugaacaagaucgguuc

SEQ ID NO: 411337 - RNA, 64 nt, hsa
auguguuugggggcuuuuaggggacccagcugcacuggggcacugcccguggccuggguaggac

SEQ ID NO: 411338 - RNA, 64 nt, hsa
cuagucucguagcugagggguggggucccucugucuggggcacuggcacccacagcaggacucc

SEQ ID NO: 411339 - RNA, 64 nt, hsa
gcagagagccacuucaccugagaccacgcccuuccuggggcagccuguaucuggugucugagug

SEQ ID NO: 411340 - RNA, 64 nt, hsa
agaugggugagccugaagauggucccuuugguuucuggggcaaauagagcaccagcuuugugca

SEQ ID NO: 411341 - RNA, 64 nt, hsa
cuccuccuugucuuuguaaaaagggaccaccucccuggggcagggcuugggcugaccuguagga

SEQ ID NO: 411342 - RNA, 64 nt, hsa
gaagaccaggcugaggccccuccaggccaggguccuggggcaggcaucucagggagcagccagc

SEQ ID NO: 411343 - RNA, 64 nt, hsa
gagauccaugaggugugucccuagggcuucaguccuggggcagaggcauaaacagaaccaguca

SEQ ID NO: 411344 - RNA, 64 nt, hsa
ggacguucuuggcuccguuagacaggugaggaaacuggggcacagagaggugaugucaucugcc

SEQ ID NO: 411345 - RNA, 64 nt, hsa
uggcagagccacauuaccuacccugugcaugguccuggggcagcaaggaagaagcucagagggu

SEQ ID NO: 411346 - RNA, 64 nt, hsa
uccuaggaggucccccuggggugggcgggcgggccuggggcacuccgucgccuuugcagaacca

SEQ ID NO: 411347 - RNA, 64 nt, hsa
ggggguaccuaggagccaggugggguacgacaggcuggggcacacagucuccccccggccaccu

SEQ ID NO: 411348 - RNA, 64 nt, hsa
ucuuuugaagcaauuuuuugagaaauaguaaaaucuggggcagagugucuugcaguuaauugca

SEQ ID NO: 411349 - RNA, 64 nt, hsa
uagacuggggaaaaauugaggaucucuguuuuuccuggggcaaacagaaagaaaucugcaugag

SEQ ID NO: 411350 - RNA, 64 nt, hsa
acagggccagcaagacagaccaccagccagaaaucucugauaucaaccucaugucccccacccc

SEQ ID NO: 411351 - RNA, 64 nt, hsa
cuuuuauucagcauccuuuaucugugacuucaugcucugauaacugccuuuccuuccuucugug

SEQ ID NO: 411352 - RNA, 64 nt, hsa
cacacuucugagguacgguaucucucuccagccacucugauaccaaguaauucaagcuggcauu

SEQ ID NO: 411353 - RNA, 64 nt, hsa
uauaauauagaaaguauauagcaaaguaauuuuacucugauaauaaaaauuguuugacauguau

SEQ ID NO: 411354 - RNA, 64 nt, hsa
cuaaucuuuuguguaauuuucucuuaacugauugcucugauauuguaaacacaauagauguagc

SEQ ID NO: 411355 - RNA, 64 nt, hsa
aguauccuucagcuuuuuacauuaacccaguguccucugauauaggugagucuugugguagcca

SEQ ID NO: 411356 - RNA, 64 nt, hsa
gcgaaaacugauggcuaaaacaguaucuacuauucucugauaacuuuuuuuuugagacagaguu

SEQ ID NO: 411357 - RNA, 64 nt, hsa
uaaagccaacugaaagaguuccuucaagaaguuccucugauaggaagcuagaaguguagaauga

SEQ ID NO: 411358 - RNA, 64 nt, hsa
caguuucuuuuuauucaaagaaacaaaauucaaucucugauaauauuugagguaaaguuccuuu

SEQ ID NO: 411359 - RNA, 64 nt, hsa
auuguuuccaggauugagcagguucucagcugggcucugauaucccgugcggaguuggacaagu

SEQ ID NO: 411360 - RNA, 64 nt, hsa
ugaucucuuccacgugcugcugcuuuuuuugccacucugauacuaaaccagagaaagcugcagg

SEQ ID NO: 411361 - RNA, 64 nt, hsa
uggaaauuaucuacaauggaaucuucccucuguucucugauaaccuacuugcuuacucaaugcc

SEQ ID NO: 411362 - RNA, 64 nt, hsa
aacugccugacguugcacgauuucagcuucauuccucugauagaacaaagcgaaaugcaggucc

SEQ ID NO: 411363 - RNA, 64 nt, hsa
uaaauugcuuaaguacucacucagacauuccagucucugauagcuuuuccucaaguguuucuga

SEQ ID NO: 411364 - RNA, 64 nt, hsa
ucgggcuucugucucuaugagagauagcuuauuacucugauacucuuuaaucuuuuacaaaggc

SEQ ID NO: 411365 - RNA, 64 nt, hsa
ggcuuuagaauguauucuguaugccucucuuuugcucugauacuguugcuccugcuauucugau

SEQ ID NO: 411366 - RNA, 64 nt, hsa
accguguucaccucacacuaaggccuagaguuugcucugauaugcauuuggaugauuaauguua

SEQ ID NO: 411367 - RNA, 64 nt, hsa
uucaguuuucuuuaacagugagguggaucuuuaccucugauagaggucagaaugagguccuggg

SEQ ID NO: 411368 - RNA, 64 nt, hsa
gcugaagggugaauuucuuauuauacauaaaacacucugauauuauuguauaaaggaagcuaag

SEQ ID NO: 411369 - RNA, 64 nt, hsa
guagucuugaugugcuccugugguauuacuuccccucugauaggacauuguagccagccucagc

SEQ ID NO: 411370 - RNA, 64 nt, hsa
ccuuauuguaccucucuuauagaauauuuauuaccucugauaccucaacccccauuucuauuua

SEQ ID NO: 411371 - RNA, 64 nt, hsa
ggcugugaaggcucaugugaccuggaucugaggucucugauagaaaucuggacgccaccggguc

SEQ ID NO: 411372 - RNA, 64 nt, hsa
gggcacuuuucugcuuccuuccagaggccugggccucugauaacacuuuggcuuuuucuccauu

SEQ ID NO: 411373 - RNA, 64 nt, hsa
auacaauacuuggauuuuuuuuuuucagcuuagacucugauaauuucagugguaguggggaaac

SEQ ID NO: 411374 - RNA, 64 nt, hsa
agguaaaugcucucugugcucucagggacaccuccucugauaugcugaggccaguguuggggac

SEQ ID NO: 411375 - RNA, 64 nt, hsa
aaaggaaacuaguaguguuuccuccucuuugaugcucugauacuguucuguuuuucuucacgaa

SEQ ID NO: 411376 - RNA, 64 nt, hsa
cggcgggcaccaggcuggggucuccuugucugugcucugauaugcuccuugacugaaacuuuaa

SEQ ID NO: 411377 - RNA, 64 nt, hsa
aaguuacauaaauauuaccagagagccugaugcucucugauagcugugccauaagugcuuguga

SEQ ID NO: 411378 - RNA, 64 nt, hsa
gcuucacuacugcucacugcucacuuucugaucacucugauacuuuuuuuuuuuuuuuuuuuuu

SEQ ID NO: 411379 - RNA, 64 nt, hsa
gauuuauucacaaguuuuggagggcuuuuuguuccucugauagacaugacugacuuuuagcugu

SEQ ID NO: 411380 - RNA, 64 nt, hsa
aguagagcgugagcauguauuuuuagugggagagcucugauaguuguugggaauauauaauuua

SEQ ID NO: 411381 - RNA, 64 nt, hsa
cuuuugucaauuauagaauuauagggacauuuuucucugauagcuggaaguugaaccucaacca

SEQ ID NO: 411382 - RNA, 64 nt, hsa
cauccaagaaaauugcugucaaagccauugaagacucugauauguuacaggaggucaguacggu

SEQ ID NO: 411383 - RNA, 64 nt, hsa
aauacuauuuuuucacacuacgucaacuugguugcucugauaccccagagccugauugggggcc

SEQ ID NO: 411384 - RNA, 64 nt, hsa
ugcguuuucacaucagcugugcugcuuggugccucucugauacgaauacacugacacgucaaag

SEQ ID NO: 411385 - RNA, 64 nt, hsa
ggacuuucaaaauuaaaucugucccugagagugucucugauaaaagggcaaaucugcaccuaug

SEQ ID NO: 411386 - RNA, 64 nt, hsa
uauggggagggcauauaggaacacaguuuauucucucugauagagcuauuaaugacuuaguuuc

SEQ ID NO: 411387 - RNA, 64 nt, hsa
agcagaggcaguaagagaugugaaccuuggugagcucugauacagugagaagagauuauacuca

SEQ ID NO: 411388 - RNA, 64 nt, hsa
guuauauucuaagaucugcuuuggaaauuauugccucugauacauaccuaaguaaacauaacau

SEQ ID NO: 411389 - RNA, 64 nt, hsa
cucuggccccaagggcaaaauucccagggaagugcucugauaggccaaguuuguaucaggugcc

SEQ ID NO: 411390 - RNA, 64 nt, hsa
gcucuggauugccaugagcaggugaaaaugaaggcucugauauugugugguggugucacaggau

SEQ ID NO: 411391 - RNA, 64 nt, hsa
agugucuagcacauacuacaucuaagaggcuaaacucugauaggaaaagcacuuuaaacauaau

SEQ ID NO: 411392 - RNA, 64 nt, hsa
auguccacauaggaaauuaacacauauauaccuucucugauaagcacuccucuauguguccuga

SEQ ID NO: 411393 - RNA, 64 nt, hsa
gcccuagaagagcgagcccagcagcacagagaagcucugauagcacagaucagcaccaacguug

SEQ ID NO: 411394 - RNA, 64 nt, hsa
cuguugcaucaucauaagaaguuuaagcuuugugcucugauaaauuguguucuguuaaagaggu

SEQ ID NO: 411395 - RNA, 64 nt, hsa
cuaauugcugcccuucugaugucuuuauguauagcucugauagaauuuucaccagucuauguau

SEQ ID NO: 411396 - RNA, 64 nt, hsa
auucaggcaagauaccucuaagcuguuuugaacccucugauauuuuguauuuauguguuugucu

SEQ ID NO: 411397 - RNA, 64 nt, hsa
agucgucgccacaccaggcgacaggcaccacccccucugauaaauccaagcccgcccaggccca

SEQ ID NO: 411398 - RNA, 64 nt, hsa
guugaacaugcaauaaaugauauuuuccaaacugcucugauaucuuagaagaaauaaacugcaa

SEQ ID NO: 411399 - RNA, 64 nt, hsa
agccauuguguccucuacaauuaacaaaacuuaucucugauauacaaagggauauaaauauaua

SEQ ID NO: 411400 - RNA, 64 nt, hsa
gaucacuaauauaguaugcucuugguaccaggagcucugauauauaucugguacauguuugaua

SEQ ID NO: 411401 - RNA, 64 nt, hsa
gauuggauuaucuaaucuuuuagauccuuaacaacucugauauucugagauucucucauuugua

SEQ ID NO: 411402 - RNA, 64 nt, hsa
ugguguuucccucugacucuagugcacugaugaucucugauaaggcucagcugcuuuauaguuc

SEQ ID NO: 411403 - RNA, 64 nt, hsa
aaaguuaaaaaaaaaaaaccugacccaaaguauacucugauagacuauauuauauucaauuuug

SEQ ID NO: 411404 - RNA, 64 nt, hsa
uuuacuucugcgcuucuauguuugggaaacauugcucugauaaaaaauagcugucauuaugcag

SEQ ID NO: 411405 - RNA, 64 nt, hsa
cugcaagauguuuucuguuggcuuccacuggccacucugauagaugagaaaguucuaauucuuc

SEQ ID NO: 411406 - RNA, 64 nt, hsa
ugcaguuauucuaugagucgcacaauucuugagucucugauaccuaccuauugggguuaggaga

SEQ ID NO: 411407 - RNA, 64 nt, hsa
uuugacaaacugaaacagauggguuuucuggguucucugauaaccuaugggaauguuuggaugc

SEQ ID NO: 411408 - RNA, 64 nt, hsa
uaugcuaacaaacugaaaaaucuagacauagauccucugauauacaauuagagauauuuuuaua

SEQ ID NO: 411409 - RNA, 64 nt, hsa
ccugguuuccuagauugagaacuaugauauuuuucucugauaauuuaauaucuacucuccuaca

SEQ ID NO: 411410 - RNA, 64 nt, hsa
gccaaagucuucauuagaaggcagcauuuuuccucucugauacuuuucagucauuuuccuuaga

SEQ ID NO: 411411 - RNA, 64 nt, hsa
uugucauucuuuuucuuuuaaauuuguugcuaaucucugauaaugaagauucuuacucugauuc

SEQ ID NO: 411412 - RNA, 64 nt, hsa
ugaaaugccacugugcauuuucagaaaaaaaaaucucugauaaacagacuuugaauggauguuu

SEQ ID NO: 411413 - RNA, 64 nt, hsa
cugauauuaaugauaaucauuuuauuuuucaucucucugauauacccaauguguggcaaucagc

SEQ ID NO: 411414 - RNA, 64 nt, hsa
ugcauagaaaacuaucucuuacaaacuuuaagugcucugauaugacuucccccccaaauuuuau

SEQ ID NO: 411415 - RNA, 64 nt, hsa
aauuuagauacacaugcucagagcugagauauuucucugauaaaucagguaacaaaauguauuu

SEQ ID NO: 411416 - RNA, 64 nt, hsa
aguuggacuaacugauuauuaaggacucugucaacucugauauucugaaagugaauaaaagaaa

SEQ ID NO: 411417 - RNA, 64 nt, hsa
acagcuguauaucucaaaaguuaacccaagacaacucugauauuuagguuauuuguugagacuc

SEQ ID NO: 411418 - RNA, 64 nt, hsa
gcccuggauaggaagccacugagucugcccugggcucugauaaaaccuucaccauuaacuugcu

SEQ ID NO: 411419 - RNA, 64 nt, hsa
guagagacccaggccuggagaguagacauuuugccucugauaagcacuuuuuaaauggcucuaa

SEQ ID NO: 411420 - RNA, 64 nt, hsa
caugggcugugugaucucuucagggugggguggucucugauagguagcauuuuccagcacuuug

SEQ ID NO: 411421 - RNA, 64 nt, hsa
guauuugcaaggcugauuuauggucagaauuucccucugauaugucuagggugugauuuagguc

SEQ ID NO: 411422 - RNA, 64 nt, hsa
ggagcaaauuucagaauauauauguggauccaagcucugauaguucaggugcuggagggaagag

SEQ ID NO: 411423 - RNA, 64 nt, hsa
acacaacaccuuucccuguuucucuucaguuguccucugauauuuucacagccuguuaguggcg

SEQ ID NO: 411424 - RNA, 64 nt, hsa
ggauuccaugaugauuuuaaugucuuucucaaaacucugauauuugucacaccuagaaaguaug

SEQ ID NO: 411425 - RNA, 64 nt, hsa
caugaaccauaaugcugcuucuugugcaugucugcucugauauacgucgaacaauguagcagcc

SEQ ID NO: 411426 - RNA, 64 nt, hsa
ugcuuaugaaugccuucauauacuaauacagauacucugauaauauuacacucuaauaaggaua

SEQ ID NO: 411427 - RNA, 64 nt, hsa
caauacucaucugaaaaucauuaaugccaacuugcucugauaugugaaguaauggacaagagug

SEQ ID NO: 411428 - RNA, 64 nt, hsa
ggcagguagucaagaaaaugcaaguugccaagagcucugauauuuuuuaaaaagaauuuuuuug

SEQ ID NO: 411429 - RNA, 64 nt, hsa
gcaccccuucccugcauguguuccauugugacuucucugauaaagcgucugaucuaaucccagc

SEQ ID NO: 411430 - RNA, 64 nt, hsa
uuuuucagguggauuuuuaccuuuguuccuuuugcucugauagacaaaaucaguuuaggacuau

SEQ ID NO: 411431 - RNA, 64 nt, hsa
ccugggugcccagccuccccuccuccaauacauucucugauaaucugaccuugucaugaccauu

SEQ ID NO: 411432 - RNA, 64 nt, hsa
caugcucaguugaagaggacgagaggacgaccuucucugauagaggaggaccacgcuucaguca

SEQ ID NO: 411433 - RNA, 64 nt, hsa
agauucaaugccccugaauuuaaauagcuuuuuucucugauacagaaaaguugaauuuuacaug

SEQ ID NO: 411434 - RNA, 64 nt, hsa
uguuguugcaggaaaaugauuauaacuaaaagcucucugauagugcagagacuuaccagaagac

SEQ ID NO: 411435 - RNA, 64 nt, hsa
aacagguggcaggaccaggacuauagcccagguccucugauacccagagcauuacgugagccag

SEQ ID NO: 411436 - RNA, 64 nt, hsa
aauaaaaaaaaagcauugcaaaugcuuuagaaaucucugauaauggagagagagacagaggacc

SEQ ID NO: 411437 - RNA, 64 nt, hsa
caucaacuuauguaaaaacucagaaggaaggcuccucugauaaaaacacagcuccuuuauuaug

SEQ ID NO: 411438 - RNA, 64 nt, hsa
ccacccccaguuagcaccauuaacuccuccugagcucugauaacauaauuaacauuucucaaua

SEQ ID NO: 411439 - RNA, 64 nt, hsa
ccacccccaguuagcaccauuaacuccuccugagcucugauaagagaaucaacauuucucaaua

SEQ ID NO: 411440 - RNA, 64 nt, hsa
cugugugcuacugaacugucgaaggaaauagccgcucugauagguagaugugaguaaaaagaac

SEQ ID NO: 411441 - RNA, 64 nt, hsa
caucuucugccaccuuuacuggguucuaaaugcucucugauaauucagagagcauugggucugg

SEQ ID NO: 411442 - RNA, 64 nt, hsa
gguuaggggauauuuuucaaccucuugcuuuauacucugauaugggguguguuuaugaacuugu

SEQ ID NO: 411443 - RNA, 64 nt, hsa
cauugcauugccuuucaugaguuacuugucuauacucugauagaaccaaaguuucuugagggca

SEQ ID NO: 411444 - RNA, 64 nt, hsa
cgggcauaguagcaugugccugcggucccagcugcucugauaagaggaggcucacuugagccca

SEQ ID NO: 411445 - RNA, 64 nt, hsa
ugacaguuuauguauauauauaauucaguauucccucugauaacauaguugccaguguuuaaua

SEQ ID NO: 411446 - RNA, 64 nt, hsa
gaucuuuauaaccugaugccauaaauacaagauucucugauaccuucauuuaauauaucaauau

SEQ ID NO: 411447 - RNA, 64 nt, hsa
gccacugcacccagccuugaauuuuuaauuuuaucucugauauacuucauuaagugucuggaga

SEQ ID NO: 411448 - RNA, 64 nt, hsa
gacugaggaguagaguucauuggagucuuaaacucucugauaucacuuaaagcuggaguuuauu

SEQ ID NO: 411449 - RNA, 64 nt, hsa
gaguaaacugaggcccaaagcacuugcuuacauccucugauagcuguuucaaaugugcauuuug

SEQ ID NO: 411450 - RNA, 64 nt, hsa
gucuuaaagcucaggcuuuucguucauuaacauucucugauagaauucuggucaucagauguac

SEQ ID NO: 411451 - RNA, 64 nt, hsa
cccagcccugccuguacauacacaugcacacccucucugauauuuuuguccuuuagauguucaa

SEQ ID NO: 411452 - RNA, 64 nt, hsa
uuuaagcagacgaugcuguaaaaacuaacggcuucucugauauuuauuguaaguuuuaguacug

SEQ ID NO: 411453 - RNA, 64 nt, hsa
ucucucucucucaucggggucauuugcuauuccccucugauauucaacccuauagaaggagccu

SEQ ID NO: 411454 - RNA, 64 nt, hsa
guauacaaccauccuguuaaacauuuaaauuuagcucugauaguguguuaagaccugaauaucu

SEQ ID NO: 411455 - RNA, 64 nt, hsa
uuucucccuggaaaugugaaaacugaaccuauaacucugauaaggacuugagauguguagaaac

SEQ ID NO: 411456 - RNA, 64 nt, hsa
auuuaaacuacuuuuaauuauuuauauugauacucucugauaaaugcagguaguuaagaauaga

SEQ ID NO: 411457 - RNA, 64 nt, hsa
agacacaggacugcuuucaggcuccugguuuauucucugauagacugagcuccuuccaccagaa

SEQ ID NO: 411458 - RNA, 64 nt, hsa
uuucaaauaauuaggcucuguucccauuuuaaaacucugauauuggccuucaccugugacugga

SEQ ID NO: 411459 - RNA, 64 nt, hsa
agccaacguggguucccugcggcuccuuagucaccucugauagcagauugagggaggaaaacag

SEQ ID NO: 411460 - RNA, 64 nt, hsa
ugaagcauaaguggacuuugcuuuuggggcuuaucucugauacaugcuggagcccugccucucc

SEQ ID NO: 411461 - RNA, 64 nt, hsa
uuaggaaaacuuuccaaauaaaauaaauguuauucucugauaaagagcuaauacagaaauguuc

SEQ ID NO: 411462 - RNA, 64 nt, hsa
gugccaugcguggcuaacauccugcuuugauucccucugauaagcuguucugguggcaguaaca

SEQ ID NO: 411463 - RNA, 64 nt, hsa
augugucuucaaugucaacagauccgacuuuggccucugauacagacagcagucuagaagcagc

SEQ ID NO: 411464 - RNA, 64 nt, hsa
aacugccccuuauuugaucaccauguacuaggagcucugauagccagcucagcuccuaauccuu

SEQ ID NO: 411465 - RNA, 64 nt, hsa
ggggagcagagacacuaacgacuucagggcagggcucugauauuccaugaauguaucaggaaau

SEQ ID NO: 411466 - RNA, 64 nt, hsa
acugaacaggcaggccacuuugccucuaaauuaccucugauaauucuagagauuuuaccauauu

SEQ ID NO: 411467 - RNA, 64 nt, hsa
agaaccuugacauggccauaacagaaggaggugccucugauagaacaugcuagaaauggucuuu

SEQ ID NO: 411468 - RNA, 64 nt, hsa
ccagagauaaacuaaugguccacacccaauuccacucugauagaauuauuucacaaauaauagg

SEQ ID NO: 411469 - RNA, 64 nt, hsa
gaagcccucuuggcauccccaggagcagcuucuccucugauagggugcagcucacaccagugac

SEQ ID NO: 411470 - RNA, 64 nt, hsa
ugccucagauauacucaugcaaauaugaauauaccucugauaugguuuggcucuguguccccac

SEQ ID NO: 411471 - RNA, 64 nt, hsa
ucccaaggccucuccuagcaggcagaagccacuccucugauaacggccucuguaaauguucuga

SEQ ID NO: 411472 - RNA, 64 nt, hsa
aagaauggagcaguacaugggaaaggaggcaugccucugauaugggacugagccuggcccauag

SEQ ID NO: 411473 - RNA, 50 nt, hsa
aagaucugacucaagacugacucugauaguguagcauuuucccuggggga

SEQ ID NO: 411474 - RNA, 64 nt, hsa
uaacugugugucaggccccacacuaagugcucugcucugauauacucaaggccauuaaucuuca

SEQ ID NO: 411475 - RNA, 64 nt, hsa
aaaaauuguaauacauugauuuauaaaaugccuucucugauacuuuugaaacagaugugaaaaa

SEQ ID NO: 411476 - RNA, 64 nt, hsa
acuccuggacguaaauauuucaaagacuacuuuucucugauauuuauguaccaugaggggaaca

SEQ ID NO: 411477 - RNA, 64 nt, hsa
cacuggggcacagagugcccacguuagccccgggcucugauagagagguaggaggcacguucuu

SEQ ID NO: 411478 - RNA, 64 nt, hsa
ucuccacgugggcagggcaggccccaucgcuuuccucugauaaccacauggacacauccugaag

SEQ ID NO: 411479 - RNA, 64 nt, hsa
ccuggcugucggucacaccucugcagggccggcucucugauagaaaguggaaggcgguuuuaga

SEQ ID NO: 411480 - RNA, 64 nt, hsa
cugaauuuauuaaaaacaacacagaaaucuccugcucugauauaguuauguaacugaucucuua

SEQ ID NO: 411481 - RNA, 64 nt, hsa
uuaucuuuuagaaaguacacuuuaaggagccauacucugauaugacagaugagaaagggagaga

SEQ ID NO: 411482 - RNA, 63 nt, hsa
gaggcuugucaaggacauaaaugucacguccagcucugauaugcuucgcacugagcacaucac

SEQ ID NO: 411483 - RNA, 64 nt, hsa
aaugagcccagaggcuuguuuggggacuguuuuacucugauacuaccuggauaucuagcuuccu

SEQ ID NO: 411484 - RNA, 53 nt, hsa
gucucagugaccucuacugacuucucugauaccagcuggagguugagcucuuc

SEQ ID NO: 411485 - RNA, 64 nt, hsa
ucaugaaacaagauauaccuacauaugucaggcacucugauauuuucuauucuaguccaccuuu

SEQ ID NO: 411486 - RNA, 64 nt, hsa
cuucuuucacaagcacggacugggcugaggucaacucugauagauucagaugacuagaaauugg

SEQ ID NO: 411487 - RNA, 64 nt, hsa
ugugauugguugccauuuguguucuuuugcagaacucugauaagaaaaguguucaauuuguauu

SEQ ID NO: 411488 - RNA, 64 nt, hsa
gaggccucuucucagcaugcugcaaaccuguggucucugauacuaacucccuccccaaccccug

SEQ ID NO: 411489 - RNA, 64 nt, hsa
uagucuuagccaauauuaaaacauacuaugaagccucugauacuuaaacagcauggcgcuggua

SEQ ID NO: 411490 - RNA, 64 nt, hsa
aaguacuacaaggaaaacaauguugagaaacggacucugauaaaagucuucgggauccguuuug

SEQ ID NO: 411491 - RNA, 64 nt, hsa
gugugggugcccagaugugcgcuauuagauguuucucugauaauguccccaaucauaccaggga

SEQ ID NO: 411492 - RNA, 64 nt, hsa
gcugaacuucaaaggacuucauaaguauuuguuacucugauauaaauaaaaauaaguaguuuua

SEQ ID NO: 411493 - RNA, 64 nt, hsa
gccuuauaagcauuccuuccuguguccauuaagacucugauaauugucuccccuccauaggaau

SEQ ID NO: 411494 - RNA, 64 nt, hsa
auugcauaaaucugaaaaugaauuauguuauuugcucugauacaaaaauucuaaaucaauuauu

SEQ ID NO: 411495 - RNA, 64 nt, hsa
cuucugcagaucaacacagucaaagcggcucuagcucugauaacacagagagaggaauguccag

SEQ ID NO: 411496 - RNA, 64 nt, hsa
cuagaucaauuuauaccuuccguaugacguuuuacucugauaucauugugcacuuuagccagau

SEQ ID NO: 411497 - RNA, 64 nt, hsa
cuuucauuguugugccagcugguugaaauuaaaacucugauauuacuuuuuuugaggauuuuua

SEQ ID NO: 411498 - RNA, 64 nt, hsa
gccuguggccuguuuugagggaaaaguaacauaacucugauaauuaauuaugauaauaacuaug

SEQ ID NO: 411499 - RNA, 55 nt, hsa
gcaaugggacucguuugugaagcugcucugauacuagauauccuuaaaugauguu

SEQ ID NO: 411500 - RNA, 64 nt, hsa
ugcuaaauugucugccauuacaccagaaggaugccucugauaggaggacaaccaugcaaauugu

SEQ ID NO: 411501 - RNA, 64 nt, hsa
cuucaagugauauguggaaaaaagugaaugagaccucugauaggggguuuucagaaccuuguuc

SEQ ID NO: 411502 - RNA, 64 nt, hsa
agauauugguaagcuauugaauuuagauaugcaccucugauaagcaaggauuguuucccguagg

SEQ ID NO: 411503 - RNA, 64 nt, hsa
uucuaaaaagagauuuauuuuuaaaucaaugggacucugauauaaaggaagaauaagucacugu

SEQ ID NO: 411504 - RNA, 64 nt, hsa
cuccucccgugggggcuuccccagugccuaucuucucugauagucauggagagguuacacuaau

SEQ ID NO: 411505 - RNA, 64 nt, hsa
cuugugcauuaugcacuugcugcugccuccugggcucugauagaagggcagggcuguugagccu

SEQ ID NO: 411506 - RNA, 64 nt, hsa
cuuauuucuguucucuaggcuguuauguuaauuccucugauauguuaaaguaaugggugagacc

SEQ ID NO: 411507 - RNA, 64 nt, hsa
gcgcugagucuaaacuggcaacauguauuuuuuucucugauauuaagcaggaaggcauuuuaau

SEQ ID NO: 411508 - RNA, 64 nt, hsa
ccuggacauuucgaugguuuuugguaaggccaaacucugauaagcaaaacagagaauacugacg

SEQ ID NO: 411509 - RNA, 64 nt, hsa
gcccugcccagguggccuccuggcccgcccucaccucugauagacuuugugaaucugaacugcu

SEQ ID NO: 411510 - RNA, 64 nt, hsa
uuucuuacacaguuuaacacggccugauucaagacucugauaggauucaaacagauaccgguua

SEQ ID NO: 411511 - RNA, 64 nt, hsa
cugaaguucuguuuaaauauaguuacaugaauuucucugauacuaauguacucaacagccaggu

SEQ ID NO: 411512 - RNA, 64 nt, hsa
agggaugacuuaccuguucaguacucuacaauuccucugauaauauauuuucaaggauguuuuu

SEQ ID NO: 411513 - RNA, 64 nt, hsa
uguacucucuuccccucucaucgucauggucaggcucugauaccugcuuuuaaaauggagcuag

SEQ ID NO: 411514 - RNA, 64 nt, hsa
uagacaaucacagggaggauugaaaaaaagggcacucugauagggcaaaaacggaacaugggag

SEQ ID NO: 411515 - RNA, 64 nt, hsa
gcaggugacugcagccuuuggcucaagcucacaacucugauaacugucagugccugagguugug

SEQ ID NO: 411516 - RNA, 64 nt, hsa
augauccuggaaagugaacugggugaccuaggaccucugauaugaaugugaucugagacuaaag

SEQ ID NO: 411517 - RNA, 64 nt, hsa
gaacacucgggggacaugggccucuaacugcccacucugauaugccugggugagccuaggaggg

SEQ ID NO: 411518 - RNA, 64 nt, hsa
uugggcggccccuggacgaaggucugaaucccgacucugauaccuucuggcugugcuaccugag

SEQ ID NO: 411519 - RNA, 64 nt, hsa
agccuuuggcguguugguaucuuggaagcauuagcucugauaggucuauaaguguauuaaggga

SEQ ID NO: 411520 - RNA, 64 nt, hsa
uugucuugcagauguagaaauuguugcuuuguuucucugauaaaacugguuuuagacaaaaaau

SEQ ID NO: 411521 - RNA, 64 nt, hsa
gaagucuucugacgauccagaauuccuaagguggcucugauauuauaucauacuuuaauagaga

SEQ ID NO: 411522 - RNA, 64 nt, hsa
cuuuucuggguaccucugguuagcacuuucuacucucugauauuuccuauguacauagcuuuua

SEQ ID NO: 411523 - RNA, 64 nt, hsa
caaauucagucucugaauacacaguauucagagucucugauacacaguaauugugacaauaggg

SEQ ID NO: 411524 - RNA, 64 nt, hsa
cccuggagcucagagguguccccacuguaccagccucugauaagcugccuccaguuguccuuua

SEQ ID NO: 411525 - RNA, 64 nt, hsa
uuagguucuacucaagaguggaaggaccaaucaccucugauauucuguggaagguuuugggguc

SEQ ID NO: 411526 - RNA, 64 nt, hsa
cuucccccagugaaggcuccacaggcugcacagucucugauaaugaagggcugccuucccgaag

SEQ ID NO: 411527 - RNA, 64 nt, hsa
acccugagcaggaccguggaucaccugcaacaagcucugauacuccaggggauacuuaagcccu

SEQ ID NO: 411528 - RNA, 64 nt, hsa
caggcagcauucccuaugggaaaggugauaccagcucugauaugcaaagcauaugauaauuuau

SEQ ID NO: 411529 - RNA, 64 nt, hsa
gacuuuuuuuuuuuugguacaacaaugcaagaugcucugauagcauuugcuaacaggaccagga

SEQ ID NO: 411530 - RNA, 64 nt, hsa
gguccacagaagcaggccuuguguuuccagcggccucugauaagaggcagggaaggaccugaag

SEQ ID NO: 411531 - RNA, 64 nt, hsa
cauuuuauaaauagaguagauauuugauauaccacucugauaacucauauaaaaauaucaucau

SEQ ID NO: 411532 - RNA, 64 nt, hsa
caggaauguauuugugcauauguucuuugaucuucucugauagcaucucauuugaucuggccuc

SEQ ID NO: 411533 - RNA, 64 nt, hsa
caaaguuagacugacuucuauaugugcucuuuuacucugauaauauuaaauuaggacuaacuua

SEQ ID NO: 411534 - RNA, 64 nt, hsa
uuuggacaacuagcccugaugcauuaggcugcaacucugauauacagagacuagcaccuugaau

SEQ ID NO: 411535 - RNA, 64 nt, hsa
ucaaggccacccccaccccagaacagaaccgugucucugauaaagguuuugaagugaauaaagu

SEQ ID NO: 411536 - RNA, 64 nt, hsa
ucugaacaucccacagcagucucaguccugguuccucugauaagaucgacaaaagaaacaacaa

SEQ ID NO: 411537 - RNA, 64 nt, hsa
aaacaaaaaaagaggcagggguugcaauccuagucucugauaaaacagaauuuaaaccaacaaa

SEQ ID NO: 411538 - RNA, 64 nt, hsa
caagggcccccuagccagccccgcacacacucaacucugauacuccagcccuguggcaccccag

SEQ ID NO: 411539 - RNA, 64 nt, hsa
cguagcaggcagaaaagccccuuccauccugcuccucugauacugugcccccuuggagauauuu

SEQ ID NO: 411540 - RNA, 64 nt, hsa
aggauuuacacaagaaguaacucugucucugguucucugauacuaaucuaugauauugcaugau

SEQ ID NO: 411541 - RNA, 64 nt, hsa
uuguauuugaacauugaaaaguuacaguagucagcucugauaaaaaaaugaugcaguaggguga

SEQ ID NO: 411542 - RNA, 64 nt, hsa
gggggggaaagugcuuaugaauggugcagguugacucugauauucauucccaaaugacaguaug

SEQ ID NO: 411543 - RNA, 64 nt, hsa
cauuaguucauagacauugggguuguuuccaacucucugauauuauaaaugcuacugcugugaa

SEQ ID NO: 411544 - RNA, 64 nt, hsa
ucaguacuaaccugggcaacaaagaggccccugucucugauaaaaagaaaaaaaaugaaaaaau

SEQ ID NO: 411545 - RNA, 64 nt, hsa
caaaugcaucacuaugggugugaccucggcgugacucugauagugccuguggauguguugcgau

SEQ ID NO: 411546 - RNA, 64 nt, hsa
aauuuaagcaacuccuuuuauuaagcuuucugcucucugauauccaacaguuuuuucucuuugu

SEQ ID NO: 411547 - RNA, 64 nt, hsa
ccuggcccuggggucauagcuugggcuguuccuucucugauacgggaagagaccccaaucagau

SEQ ID NO: 411548 - RNA, 64 nt, hsa
auuuuccaaauuucguucugcaaauuuccacuuccucugauagacguuuuuuaguucuuuuaga

SEQ ID NO: 411549 - RNA, 64 nt, hsa
agaguagaacucagucucuaguuuccucauaacccucugauauuauauacuucagcauaaucag

SEQ ID NO: 411550 - RNA, 64 nt, hsa
aaaguagagcuguguauuaaauuagacugugucucucugauaccuuuacacuacugagaauagc

SEQ ID NO: 411551 - RNA, 64 nt, hsa
acagacacacaugccguuguguuaugcccagccacucugauauacuggcuucugacuuaugggc

SEQ ID NO: 411552 - RNA, 64 nt, hsa
uucccuggcguuggugacaugcugcagccuggaacucugauauccagugugacugcaaagcugu

SEQ ID NO: 411553 - RNA, 64 nt, hsa
guaauugcuuguuagcaaaauggauaugacacaucucugauacuuuuuucauuauugguugggc

SEQ ID NO: 411554 - RNA, 64 nt, hsa
uuuagcaagguaaaaaaaccaaaauggguguuaucucugauaucuugaaaccagcguucugaau

SEQ ID NO: 411555 - RNA, 64 nt, hsa
aagauggcagaacugucucccccuugucaccuaccucugauagaaugucuuuaaugguaucaua

SEQ ID NO: 411556 - RNA, 64 nt, hsa
gcuaucagagucuagugguugugcuuuuaagaugcucugauaccauuggguuaaggggcagauu

SEQ ID NO: 411557 - RNA, 64 nt, hsa
cccuugccagucuguuuaucccuccagauacagucucugauaguaaacuuuucuuucucuuaca

SEQ ID NO: 411558 - RNA, 64 nt, hsa
ugugcccuccacacuauccuuacuucugucuccacucugauaccagagugcagccaugcagaug

SEQ ID NO: 411559 - RNA, 64 nt, hsa
ucuuuugagggccccagccacaaaggccacaugccucugauaggagcugccuacaucaggcuuu

SEQ ID NO: 411560 - RNA, 64 nt, hsa
uccaguguaauucagaaucauuggccuagaaagucucugauauuuggaggggaacaaaaaucac

SEQ ID NO: 411561 - RNA, 64 nt, hsa
guggagggugggagaggaaaugucagggcaugugcucugauaaaauaaaggcagggaaacaagc

SEQ ID NO: 411562 - RNA, 64 nt, hsa
cucauuuuaaugauuguuuaaagguuucuauuuucucugauacuuuuuugaaaucaguaaacac

SEQ ID NO: 411563 - RNA, 63 nt, hsa
uugggagcgaagaagacuaaggcuuuuacuguucucugauauucuagaagcagacgaucucgg

SEQ ID NO: 411564 - RNA, 64 nt, hsa
gagcccugacuucacuuccuuugguccaguuuuacucugauacaggguggauuccaaaacuggc

SEQ ID NO: 411565 - RNA, 64 nt, hsa
uuuagaaaaagauuauaguuauuaauauugauaccucugauaauauuuuauucuuaaaucuuca

SEQ ID NO: 411566 - RNA, 64 nt, hsa
agagauuuuacaagucaugccauuagaagauuuucucugauauuauaugugcaguucaguuaca

SEQ ID NO: 411567 - RNA, 64 nt, hsa
ugaacucaaggcaguggcagaagaugucagucaccucugauaacuggaaaaaugggucucuugg

SEQ ID NO: 411568 - RNA, 64 nt, hsa
agauauugguaagcuauagaauuuagauaugcaccucugauaagcaaggauuguuucccguaug

SEQ ID NO: 411569 - RNA, 64 nt, hsa
uccuuguguccuuaccaaaugauagcucauaaaacucugauaauguaacaaaucacuuucaaag

SEQ ID NO: 411570 - RNA, 64 nt, hsa
gugcugagacuuggugccgaaauucaagagccagcucugauagaaagccagcaccagccucggg

SEQ ID NO: 411571 - RNA, 64 nt, hsa; identical to SEQ ID NO: 311484

SEQ ID NO: 411572 - RNA, 64 nt, hsa; identical to SEQ ID NO: 311485

SEQ ID NO: 411573 - RNA, 64 nt, hsa; identical to SEQ ID NO: 311486

SEQ ID NO: 411574 - RNA, 64 nt, hsa; identical to SEQ ID NO: 311487

SEQ ID NO: 411575 - RNA, 61 nt, hsa
agcaguggagagggaaagcaacuucuugcuggaagaauaucucugccuucuuaccuuaaau

SEQ ID NO: 411576 - RNA, 61 nt, hsa
caaaagauauuuugcucuauuuuaaaguguagaagaauacacugcuaauaaauaauaaaag

SEQ ID NO: 411577 - RNA, 61 nt, hsa
aauggcaauaucaacaaugaggaaaauuacugaagaauaaguuuccauaagucuccuacau

SEQ ID NO: 411578 - RNA, 61 nt, hsa
ucagguuuagaucauaugacacucgagcacagaagaauaauuucaaggaggucaucuugua

SEQ ID NO: 411579 - RNA, 61 nt, hsa
auuaaaaugggguuugcaggcuuuuuauggugaagaauaauauaucucugucuauagcuuu

SEQ ID NO: 411580 - RNA, 61 nt, hsa
gccauuucauugagggaaaacauaauaucuugaagaauauuguuaaaaccuuacuuaaagc

SEQ ID NO: 411581 - RNA, 61 nt, hsa
aaauucacacugugcguuuuagaguaugcaagaagaauauaaauaaauaaaaauauucucc

SEQ ID NO: 411582 - RNA, 61 nt, hsa
uuccgcaggucugcuccccaccccugccucggaagaauaaagagaauguaguucccuacuc

SEQ ID NO: 411583 - RNA, 61 nt, hsa
gaaaaaaugaauguauuccuguuuuugaagagaagaauaauuuuuuuuuucucuagggaga

SEQ ID NO: 411584 - RNA, 61 nt, hsa
uugcuguauacaccucaugcuuaugcaaugggaagaauaugggggccagggggugugguac

SEQ ID NO: 411585 - RNA, 61 nt, hsa
aagcaguaucuucacucaaaagucuugcuuggaagaauaagcagaaauaauuuuauauauu

SEQ ID NO: 411586 - RNA, 61 nt, hsa
ugaagguaaugacuaugggucccucucuguggaagaauacugaauagaagagagaaaucac

SEQ ID NO: 411587 - RNA, 61 nt, hsa
guuucagccgugguccuaguggcuacuuauggaagaauaggaauaguuccacaacauccug

SEQ ID NO: 411588 - RNA, 61 nt, hsa
uaaggucauuacucucaaccaccuaggcaaugaagaauauaccauuucaaauauuuacagu

SEQ ID NO: 411589 - RNA, 61 nt, hsa
gcccuccaagaaaaaaaauagaaaagcacuugaagaauauucccaauauucccggucagca

SEQ ID NO: 411590 - RNA, 61 nt, hsa
ggacugucauaccagugaagaauaaaagggugaagaauaaaagggauaugaugacaagguu

SEQ ID NO: 411591 - RNA, 61 nt, hsa
gcuaagaugguauagggacugucauaccagugaagaauaaaagggugaagaauaaaaggga

SEQ ID NO: 411592 - RNA, 61 nt, hsa
aaaaauuaaggggggauccauugaaagacuugaagaauacauauacuuauauucggggaua

SEQ ID NO: 411593 - RNA, 61 nt, hsa
auucaaugaaugaucucuagaaagauuuaaagaagaauauucagauaaggauguugaagau

SEQ ID NO: 411594 - RNA, 61 nt, hsa
acuugguauuuagaacuccuagcaccacggggaagaauagagguaucaucaaacguggcaa

SEQ ID NO: 411595 - RNA, 61 nt, hsa
uauauacauuucccuauuacucucaucagcugaagaauauguacuauuguguuacucaaau

SEQ ID NO: 411596 - RNA, 61 nt, hsa
gaacacugaucaaguaguuguggagagaugagaagaauauaugcagcaaaggugcugugag

SEQ ID NO: 411597 - RNA, 61 nt, hsa
gaugcuuuuucuugaugcuaagaucacugcagaagaauaaccugaccuuuucuuugcauuu

SEQ ID NO: 411598 - RNA, 61 nt, hsa
ggugcuucuuacauuuaauauggaaaggugggaagaauauuacugcauuagauguaauucu

SEQ ID NO: 411599 - RNA, 61 nt, hsa
ucgcuuaaaggaaaaaaaaaucuaaaacugcgaagaauacuaaauguaguugagaaauaau

SEQ ID NO: 411600 - RNA, 61 nt, hsa
ccaggaagugcuuauucucucaucacagugggaagaauagccuauugucuuucauuuugcc

SEQ ID NO: 411601 - RNA, 61 nt, hsa
ugauuuccucccaaaguaggugagcuauagugaagaauaggugcaaacaaacaagcuuacu

SEQ ID NO: 411602 - RNA, 60 nt, hsa
augcugugaaguaggcaauacaguuguuaaagaagaauaauguuggacucugaauguuau

SEQ ID NO: 411603 - RNA, 61 nt, hsa
guucaaucugucucugggaaagacuagauuggaagaauaaaauucaagaaugugauguuuu

SEQ ID NO: 411604 - RNA, 64 nt, hsa; identical to SEQ ID NO: 215308

SEQ ID NO: 411605 - RNA, 64 nt, hsa; identical to SEQ ID NO: 215309

SEQ ID NO: 411606 - RNA, 64 nt, hsa; identical to SEQ ID NO: 215310

SEQ ID NO: 411607 - RNA, 64 nt, hsa; identical to SEQ ID NO: 215311

SEQ ID NO: 411608 - RNA, 64 nt, hsa; identical to SEQ ID NO: 215312

SEQ ID NO: 411609 - RNA, 64 nt, hsa; identical to SEQ ID NO: 215313

SEQ ID NO: 411610 - RNA, 64 nt, hsa; identical to SEQ ID NO: 215314

SEQ ID NO: 411611 - RNA, 64 nt, hsa; identical to SEQ ID NO: 215315

SEQ ID NO: 411612 - RNA, 64 nt, hsa; identical to SEQ ID NO: 215316

SEQ ID NO: 411613 - RNA, 64 nt, hsa; identical to SEQ ID NO: 215317

SEQ ID NO: 411614 - RNA, 64 nt, hsa; identical to SEQ ID NO: 215318

SEQ ID NO: 411615 - RNA, 64 nt, hsa; identical to SEQ ID NO: 215319

SEQ ID NO: 411616 - RNA, 64 nt, hsa; identical to SEQ ID NO: 215320

SEQ ID NO: 411617 - RNA, 64 nt, hsa; identical to SEQ ID NO: 215321

SEQ ID NO: 411618 - RNA, 64 nt, hsa; identical to SEQ ID NO: 215322

SEQ ID NO: 411619 - RNA, 64 nt, hsa; identical to SEQ ID NO: 215323

SEQ ID NO: 411620 - RNA, 64 nt, hsa; identical to SEQ ID NO: 215324

SEQ ID NO: 411621 - RNA, 58 nt, hsa; identical to SEQ ID NO: 215325

SEQ ID NO: 411622 - RNA, 64 nt, hsa; identical to SEQ ID NO: 215326

SEQ ID NO: 411623 - RNA, 64 nt, hsa; identical to SEQ ID NO: 215327

SEQ ID NO: 411624 - RNA, 64 nt, hsa
cauaauuugguaaccuaugaaagaugcuagagcaccaauguauaauuuuuuugagacagggugu

SEQ ID NO: 411625 - RNA, 64 nt, hsa
gaaggauccacauccagacuaacauaguuguuacccaauguauuuccgugaggccuguugcauu

SEQ ID NO: 411626 - RNA, 64 nt, hsa; identical to SEQ ID NO: 296855

SEQ ID NO: 411627 - RNA, 64 nt, hsa; identical to SEQ ID NO: 296856

SEQ ID NO: 411628 - RNA, 64 nt, hsa; identical to SEQ ID NO: 296857

SEQ ID NO: 411629 - RNA, 64 nt, hsa; identical to SEQ ID NO: 296858

SEQ ID NO: 411630 - RNA, 64 nt, hsa; identical to SEQ ID NO: 296859

SEQ ID NO: 411631 - RNA, 64 nt, hsa; identical to SEQ ID NO: 296860

SEQ ID NO: 411632 - RNA, 64 nt, hsa; identical to SEQ ID NO: 296861

SEQ ID NO: 411633 - RNA, 64 nt, hsa; identical to SEQ ID NO: 296862

SEQ ID NO: 411634 - RNA, 64 nt, hsa; identical to SEQ ID NO: 296863

SEQ ID NO: 411635 - RNA, 64 nt, hsa; identical to SEQ ID NO: 296864

SEQ ID NO: 411636 - RNA, 64 nt, hsa; identical to SEQ ID NO: 296865

SEQ ID NO: 411637 - RNA, 64 nt, hsa; identical to SEQ ID NO: 296866

SEQ ID NO: 411638 - RNA, 64 nt, hsa; identical to SEQ ID NO: 296867

SEQ ID NO: 411639 - RNA, 64 nt, hsa; identical to SEQ ID NO: 296868

SEQ ID NO: 411640 - RNA, 64 nt, hsa; identical to SEQ ID NO: 296869

SEQ ID NO: 411641 - RNA, 64 nt, hsa; identical to SEQ ID NO: 296870

SEQ ID NO: 411642 - RNA, 64 nt, hsa; identical to SEQ ID NO: 296871

SEQ ID NO: 411643 - RNA, 64 nt, hsa; identical to SEQ ID NO: 296872

SEQ ID NO: 411644 - RNA, 64 nt, hsa; identical to SEQ ID NO: 296873

SEQ ID NO: 411645 - RNA, 64 nt, hsa; identical to SEQ ID NO: 296874

SEQ ID NO: 411646 - RNA, 64 nt, hsa; identical to SEQ ID NO: 296875

SEQ ID NO: 411647 - RNA, 64 nt, hsa; identical to SEQ ID NO: 296876

SEQ ID NO: 411648 - RNA, 64 nt, hsa; identical to SEQ ID NO: 296877

SEQ ID NO: 411649 - RNA, 64 nt, hsa; identical to SEQ ID NO: 296878

SEQ ID NO: 411650 - RNA, 64 nt, hsa; identical to SEQ ID NO: 296879

SEQ ID NO: 411651 - RNA, 64 nt, hsa; identical to SEQ ID NO: 296880

SEQ ID NO: 411652 - RNA, 64 nt, hsa; identical to SEQ ID NO: 296881

SEQ ID NO: 411653 - RNA, 64 nt, hsa; identical to SEQ ID NO: 296882

SEQ ID NO: 411654 - RNA, 64 nt, hsa; identical to SEQ ID NO: 296883

SEQ ID NO: 411655 - RNA, 64 nt, hsa; identical to SEQ ID NO: 296884

SEQ ID NO: 411656 - RNA, 64 nt, hsa; identical to SEQ ID NO: 296885

SEQ ID NO: 411657 - RNA, 64 nt, hsa; identical to SEQ ID NO: 296886

SEQ ID NO: 411658 - RNA, 64 nt, hsa; identical to SEQ ID NO: 296887

SEQ ID NO: 411659 - RNA, 64 nt, hsa; identical to SEQ ID NO: 296888

SEQ ID NO: 411660 - RNA, 64 nt, hsa; identical to SEQ ID NO: 296889

SEQ ID NO: 411661 - RNA, 64 nt, hsa; identical to SEQ ID NO: 296890

SEQ ID NO: 411662 - RNA, 64 nt, hsa; identical to SEQ ID NO: 296891

SEQ ID NO: 411663 - RNA, 64 nt, hsa; identical to SEQ ID NO: 296892

SEQ ID NO: 411664 - RNA, 64 nt, hsa; identical to SEQ ID NO: 296893

SEQ ID NO: 411665 - RNA, 64 nt, hsa; identical to SEQ ID NO: 296894

SEQ ID NO: 411666 - RNA, 64 nt, hsa; identical to SEQ ID NO: 296895

SEQ ID NO: 411667 - RNA, 64 nt, hsa; identical to SEQ ID NO: 296896

SEQ ID NO: 411668 - RNA, 64 nt, hsa; identical to SEQ ID NO: 296897

SEQ ID NO: 411669 - RNA, 64 nt, hsa; identical to SEQ ID NO: 296898

SEQ ID NO: 411670 - RNA, 64 nt, hsa; identical to SEQ ID NO: 296899

SEQ ID NO: 411671 - RNA, 64 nt, hsa; identical to SEQ ID NO: 296900

SEQ ID NO: 411672 - RNA, 64 nt, hsa; identical to SEQ ID NO: 296901

SEQ ID NO: 411673 - RNA, 59 nt, hsa; identical to SEQ ID NO: 296902

SEQ ID NO: 411674 - RNA, 64 nt, hsa; identical to SEQ ID NO: 296903

SEQ ID NO: 411675 - RNA, 64 nt, hsa; identical to SEQ ID NO: 296904

SEQ ID NO: 411676 - RNA, 64 nt, hsa; identical to SEQ ID NO: 296905

SEQ ID NO: 411677 - RNA, 64 nt, hsa; identical to SEQ ID NO: 296906

SEQ ID NO: 411678 - RNA, 64 nt, hsa; identical to SEQ ID NO: 296907

SEQ ID NO: 411679 - RNA, 64 nt, hsa; identical to SEQ ID NO: 296908

SEQ ID NO: 411680 - RNA, 64 nt, hsa; identical to SEQ ID NO: 296909

SEQ ID NO: 411681 - RNA, 64 nt, hsa; identical to SEQ ID NO: 296910

SEQ ID NO: 411682 - RNA, 64 nt, hsa; identical to SEQ ID NO: 296911

SEQ ID NO: 411683 - RNA, 64 nt, hsa; identical to SEQ ID NO: 296912

SEQ ID NO: 411684 - RNA, 64 nt, hsa; identical to SEQ ID NO: 296913

SEQ ID NO: 411685 - RNA, 64 nt, hsa; identical to SEQ ID NO: 296914

SEQ ID NO: 411686 - RNA, 64 nt, hsa; identical to SEQ ID NO: 296915

SEQ ID NO: 411687 - RNA, 64 nt, hsa; identical to SEQ ID NO: 296916

SEQ ID NO: 411688 - RNA, 64 nt, hsa; identical to SEQ ID NO: 296917

SEQ ID NO: 411689 - RNA, 64 nt, hsa; identical to SEQ ID NO: 296918

SEQ ID NO: 411690 - RNA, 64 nt, hsa; identical to SEQ ID NO: 296919

SEQ ID NO: 411691 - RNA, 64 nt, hsa; identical to SEQ ID NO: 296920

SEQ ID NO: 411692 - RNA, 64 nt, hsa; identical to SEQ ID NO: 296921

SEQ ID NO: 411693 - RNA, 64 nt, hsa; identical to SEQ ID NO: 296922

SEQ ID NO: 411694 - RNA, 64 nt, hsa; identical to SEQ ID NO: 296923

SEQ ID NO: 411695 - RNA, 64 nt, hsa; identical to SEQ ID NO: 385392

SEQ ID NO: 411696 - RNA, 64 nt, hsa; identical to SEQ ID NO: 385393

SEQ ID NO: 411697 - RNA, 64 nt, hsa; identical to SEQ ID NO: 385394

SEQ ID NO: 411698 - RNA, 64 nt, hsa; identical to SEQ ID NO: 385395

SEQ ID NO: 411699 - RNA, 64 nt, hsa; identical to SEQ ID NO: 385396

SEQ ID NO: 411700 - RNA, 64 nt, hsa; identical to SEQ ID NO: 385397

SEQ ID NO: 411701 - RNA, 64 nt, hsa; identical to SEQ ID NO: 385398

SEQ ID NO: 411702 - RNA, 64 nt, hsa; identical to SEQ ID NO: 385399

SEQ ID NO: 411703 - RNA, 64 nt, hsa; identical to SEQ ID NO: 385400

SEQ ID NO: 411704 - RNA, 64 nt, hsa; identical to SEQ ID NO: 385401

SEQ ID NO: 411705 - RNA, 64 nt, hsa; identical to SEQ ID NO: 385402

SEQ ID NO: 411706 - RNA, 64 nt, hsa; identical to SEQ ID NO: 385403

SEQ ID NO: 411707 - RNA, 64 nt, hsa; identical to SEQ ID NO: 385404

SEQ ID NO: 411708 - RNA, 64 nt, hsa; identical to SEQ ID NO: 385405

SEQ ID NO: 411709 - RNA, 64 nt, hsa; identical to SEQ ID NO: 385406

SEQ ID NO: 411710 - RNA, 64 nt, hsa; identical to SEQ ID NO: 385407

SEQ ID NO: 411711 - RNA, 64 nt, hsa; identical to SEQ ID NO: 385408

SEQ ID NO: 411712 - RNA, 64 nt, hsa; identical to SEQ ID NO: 385409

SEQ ID NO: 411713 - RNA, 64 nt, hsa; identical to SEQ ID NO: 385410

SEQ ID NO: 411714 - RNA, 64 nt, hsa; identical to SEQ ID NO: 385411

SEQ ID NO: 411715 - RNA, 64 nt, hsa; identical to SEQ ID NO: 385412

SEQ ID NO: 411716 - RNA, 64 nt, hsa; identical to SEQ ID NO: 385413

SEQ ID NO: 411717 - RNA, 62 nt, hsa; identical to SEQ ID NO: 385414

SEQ ID NO: 411718 - RNA, 64 nt, hsa; identical to SEQ ID NO: 385415

SEQ ID NO: 411719 - RNA, 64 nt, hsa; identical to SEQ ID NO: 385416

SEQ ID NO: 411720 - RNA, 64 nt, hsa; identical to SEQ ID NO: 385417

SEQ ID NO: 411721 - RNA, 64 nt, hsa; identical to SEQ ID NO: 385418

SEQ ID NO: 411722 - RNA, 64 nt, hsa; identical to SEQ ID NO: 385419

SEQ ID NO: 411723 - RNA, 64 nt, hsa; identical to SEQ ID NO: 385420

SEQ ID NO: 411724 - RNA, 64 nt, hsa; identical to SEQ ID NO: 385421

SEQ ID NO: 411725 - RNA, 64 nt, hsa; identical to SEQ ID NO: 385422

SEQ ID NO: 411726 - RNA, 64 nt, hsa; identical to SEQ ID NO: 385423

SEQ ID NO: 411727 - RNA, 64 nt, hsa; identical to SEQ ID NO: 385424

SEQ ID NO: 411728 - RNA, 64 nt, hsa; identical to SEQ ID NO: 385425

SEQ ID NO: 411729 - RNA, 64 nt, hsa; identical to SEQ ID NO: 165778

SEQ ID NO: 411730 - RNA, 64 nt, hsa; identical to SEQ ID NO: 165779

SEQ ID NO: 411731 - RNA, 64 nt, hsa; identical to SEQ ID NO: 165780

SEQ ID NO: 411732 - RNA, 64 nt, hsa; identical to SEQ ID NO: 165781

SEQ ID NO: 411733 - RNA, 64 nt, hsa; identical to SEQ ID NO: 165782

SEQ ID NO: 411734 - RNA, 64 nt, hsa; identical to SEQ ID NO: 165783

SEQ ID NO: 411735 - RNA, 64 nt, hsa; identical to SEQ ID NO: 165784

SEQ ID NO: 411736 - RNA, 64 nt, hsa; identical to SEQ ID NO: 165785

SEQ ID NO: 411737 - RNA, 64 nt, hsa; identical to SEQ ID NO: 165786

SEQ ID NO: 411738 - RNA, 64 nt, hsa; identical to SEQ ID NO: 165787

SEQ ID NO: 411739 - RNA, 64 nt, hsa; identical to SEQ ID NO: 165788

SEQ ID NO: 411740 - RNA, 64 nt, hsa; identical to SEQ ID NO: 165789

SEQ ID NO: 411741 - RNA, 64 nt, hsa; identical to SEQ ID NO: 165790

SEQ ID NO: 411742 - RNA, 64 nt, hsa; identical to SEQ ID NO: 165791

SEQ ID NO: 411743 - RNA, 64 nt, hsa; identical to SEQ ID NO: 165792

SEQ ID NO: 411744 - RNA, 64 nt, hsa; identical to SEQ ID NO: 165793

SEQ ID NO: 411745 - RNA, 64 nt, hsa; identical to SEQ ID NO: 165794

SEQ ID NO: 411746 - RNA, 64 nt, hsa; identical to SEQ ID NO: 165795

SEQ ID NO: 411747 - RNA, 64 nt, hsa; identical to SEQ ID NO: 165796

SEQ ID NO: 411748 - RNA, 64 nt, hsa; identical to SEQ ID NO: 165797

SEQ ID NO: 411749 - RNA, 64 nt, hsa; identical to SEQ ID NO: 165798

SEQ ID NO: 411750 - RNA, 64 nt, hsa; identical to SEQ ID NO: 165799

SEQ ID NO: 411751 - RNA, 64 nt, hsa
accacccuuuuccaaaaucucuccuugugauggcucccuuuacuaaccuuucuuuuagcuauuc

SEQ ID NO: 411752 - RNA, 64 nt, hsa
gauggcucccuuuacuaaccuuucuuuuagcuauucccuuuaugauaguuucuuaauuuuuucu

SEQ ID NO: 411753 - RNA, 64 nt, hsa
uagggcaucaucaauugcaaauauuuccuuuugcucccuuuaugaagauguucuuauacccuug

SEQ ID NO: 411754 - RNA, 64 nt, hsa
ggcuucuuauucuuuguaauguacucuuuuuaaaucccuuuaguuuacccuuuuuggauuccuu

SEQ ID NO: 411755 - RNA, 64 nt, hsa
gacauuucuuucaucagucuaaaaguuagaaauaucccuuuauuuuaacuuuuaugucguuucc

SEQ ID NO: 411756 - RNA, 64 nt, hsa
gauaaacacuaggugcuuuugaauuuuuuucacuucccuuuauaguuuugggaaaggaguggga

SEQ ID NO: 411757 - RNA, 64 nt, hsa
uaaaauggaaaaaccugugggcucuucauauaccucccuuuaguuaaguaauagaccaggcagc

SEQ ID NO: 411758 - RNA, 64 nt, hsa
auuuccuuguaaaaacuagggaccaucuauauauucccuuuaagaucuaguucuuuuuguaggu

SEQ ID NO: 411759 - RNA, 64 nt, hsa
gacaccaggcucuucuuggccacuuguaggaagaucccuuuacaauuuugacuaaggagauuuu

SEQ ID NO: 411760 - RNA, 64 nt, hsa
acaggacuuugauuuuaagccaaauccaucuccaucccuuuacugucaaucuucugucccagua

SEQ ID NO: 411761 - RNA, 64 nt, hsa
ccugaauuguguagauaguuuucuagcucucgggucccuuuauugcuuuuuaaaauaggguuug

SEQ ID NO: 411762 - RNA, 64 nt, hsa
gacaaaacagcuauccccacaagugaugagauagucccuuuacuguccucaaauggacuuggcc

SEQ ID NO: 411763 - RNA, 64 nt, hsa
ccgcacaugaaacauuauuuuaauugguuuaaagucccuuuauaaagagugcuacaugguuuag

SEQ ID NO: 411764 - RNA, 64 nt, hsa
aaaaucacauucugcauacuaaccuauuuuuuucucccuuuaaggugcuaaacuugcaccucau

SEQ ID NO: 411765 - RNA, 64 nt, hsa
gaaucucuccgggugggagccccauuauucauucucccuuuauugauucaucgaggagaacuug

SEQ ID NO: 411766 - RNA, 64 nt, hsa
gugcagugcccugagccacggccgucucugauucucccuuuaugaagcugcaggcugacgagag

SEQ ID NO: 411767 - RNA, 64 nt, hsa
uaacuagccagacccaucccuuuauuucagcccaucccuuuauuuccuguaagaaauguuuuua

SEQ ID NO: 411768 - RNA, 64 nt, hsa
acauguuccugcugcagauaacuagccagacccaucccuuuauuucagcccaucccuuuauuuc

SEQ ID NO: 411769 - RNA, 64 nt, hsa
ccuucuucccccccuccccccaaucuuuuuuuuuucccuuuacaaauuuuccccuuucccuuua

SEQ ID NO: 411770 - RNA, 64 nt, hsa
aucuuuuuuuuuucccuuuacaaauuuuccccuuucccuuuaccuccuuucccucccaucuucu

SEQ ID NO: 411771 - RNA, 64 nt, hsa
uaaaggggaugauauuccacaaacuaauuaugcacacagaaaaucuguggagccuaucagaccc

SEQ ID NO: 411772 - RNA, 64 nt, hsa
uuuaaccacuuuuagguuuuccccuuacagaaaccacagaaauauucccuuagaauaaaauagu

SEQ ID NO: 411773 - RNA, 64 nt, hsa
auauaugaacauuuuucuuuuauuguuuuaucuucacagaaaauaaaagguguuaauuugcuuu

SEQ ID NO: 411774 - RNA, 64 nt, hsa
cuguguuuucaaaacuuugcaaauucaucuguuacacagaaaauuuugacuuaaaacaucugcu

SEQ ID NO: 411775 - RNA, 64 nt, hsa
agaaguuuuguggugccgcuggugacaaggaacucacagaaagguuucuuagcuggugaagaau

SEQ ID NO: 411776 - RNA, 64 nt, hsa
aagcagauaccacuuaagauaggagucuaaacuccacagaaaaggauaauaccaagagcuugua

SEQ ID NO: 411777 - RNA, 64 nt, hsa
aggaggucucuaagaauauaagugggggaguggccacagaaaauucuucuccacuuucuagcca

SEQ ID NO: 411778 - RNA, 64 nt, hsa
gagucagaaguuucugccgcagcccugcagagggcacagaaaauggaagacagcucuuauauug

SEQ ID NO: 411779 - RNA, 64 nt, hsa
gggguuaggcuucaugccuucaugcccaggcagccacagaaacccacucuuccccgccucacag

SEQ ID NO: 411780 - RNA, 64 nt, hsa
gcagaugugugcaaaaagcacaaccccaaucacacacagaaacccguaggcacggacacaccca

SEQ ID NO: 411781 - RNA, 64 nt, hsa
caagugacgacaaagauucuguuucaaauauagccacagaaauaaaggagggaccaauaucugg

SEQ ID NO: 411782 - RNA, 64 nt, hsa
caagugacgagaaagauucuguuucaaauauagccacagaaauaaagaagggacaacaaucugg

SEQ ID NO: 411783 - RNA, 64 nt, hsa
caacugacgaggaagacucuguuucgaauauagccacagaaauaaaggauggagaaaaaucugg

SEQ ID NO: 411784 - RNA, 64 nt, hsa
caacugaugagaaagauucuguuucgaacauagccacagaaauaaaggauggagaaaaaucugg

SEQ ID NO: 411785 - RNA, 64 nt, hsa
ugagcuacaucuuguugagcaaggggagugaaaccacagaaacuguuaaauugaacguaaauaa

SEQ ID NO: 411786 - RNA, 64 nt, hsa
uugaccaguuggguuuuuugcguccuuuuggaaucacagaaauaaacaaguagguuucaguugu

SEQ ID NO: 411787 - RNA, 64 nt, hsa
uaaguagauaaugcuaauacaaauauacacauugcacagaaaauacacauuuacuguccaauuu

SEQ ID NO: 411788 - RNA, 64 nt, hsa
ucugaauaaagcagaaauauauuacaguucauuccacagaaagcauccaaaccacccaaaugac

SEQ ID NO: 411789 - RNA, 64 nt, hsa
aaaaaaaaaaaaaucagaaaacccccaccuaauccacagaaaguaaugucuuuccccuccccuu

SEQ ID NO: 411790 - RNA, 64 nt, hsa
uucaggucacgcagcccuguacuguauccagcaccacagaaaccucaguguuuuuccucugcug

SEQ ID NO: 411791 - RNA, 64 nt, hsa
agccuaggaaaccuuaaccauaucucuaacaccacacagaaagaggcuggaggagccacuggac

SEQ ID NO: 411792 - RNA, 64 nt, hsa
ucaggaagauaguaucucagaaugaccagagcagcacagaaacaagcuacucugacauuauggg

SEQ ID NO: 411793 - RNA, 64 nt, hsa
aauucaguguauccguuauuuuaaugcacuacaccacagaaauguuaaguuggucaagggcuua

SEQ ID NO: 411794 - RNA, 64 nt, hsa
aaacccuucccuccaggaggcccccgcugacucccacagaaacccaccuaccauaagaugucuu

SEQ ID NO: 411795 - RNA, 64 nt, hsa
caguucucuccucacuuguaaacuuguguaguuucacagaaaaaaaacaaaaugcaguuuuaaa

SEQ ID NO: 411796 - RNA, 64 nt, hsa
uuuccaucuuuuuccucucucgcuuucuuucuuacacagaaacauacacauaccgagaaaccua

SEQ ID NO: 411797 - RNA, 64 nt, hsa
gaccucaucacacuguaacugaagagucacuggacacagaaauggaaaacaggagucgauuuuc

SEQ ID NO: 411798 - RNA, 64 nt, hsa
auaguagauauuacaauagcaucugacuuugagucacagaaaccuuaaacugaggagacaauag

SEQ ID NO: 411799 - RNA, 64 nt, hsa
gggaaccaaagaaaaaaugugacaaguuugaagacacagaaagagucaucugauguaauucucu

SEQ ID NO: 411800 - RNA, 64 nt, hsa
uuaaacccucuuauuuuauaacuaaauaaauaaucacagaaaagaaugaucugaacaagaacag

SEQ ID NO: 411801 - RNA, 64 nt, hsa
gccacagagacacaccauuacauacacagacacacacagaaagacacacacagacacaaaauca

SEQ ID NO: 411802 - RNA, 64 nt, hsa
uccggccacagaaacacaccauuacacacacauacacagaaagacacacacagacacacaauca

SEQ ID NO: 411803 - RNA, 64 nt, hsa
cacagacacgcaaucgcagauacgcccuuccggccacagaaacacaccauuacacacacauaca

SEQ ID NO: 411804 - RNA, 64 nt, hsa
ccgccacagagacaccauuacauacacagacacacacagaaagacacagacacaaaaucacaca

SEQ ID NO: 411805 - RNA, 64 nt, hsa
ccaccacagagacaccauuacauacacagacacacacagaaagacacacacagacacaaaauca

SEQ ID NO: 411806 - RNA, 64 nt, hsa
uggcagugagaccagcccacccaccaccacccaccacagaaaagcacaaaccucugggaaagac

SEQ ID NO: 411807 - RNA, 64 nt, hsa
aaacacacccaccagugcagccugaaguaacucccacagaaaccaucaucgucuuuguacaucg

SEQ ID NO: 411808 - RNA, 64 nt, hsa
uugauuuuuaugcuuguuaguguauugcaagaaacacagaaaauguaguuuuguuuuaauaaac

SEQ ID NO: 411809 - RNA, 64 nt, hsa
auagauguguauuuccuccccugcagaaaauaagcacagaaaauuauaauguaggugaucggag

SEQ ID NO: 411810 - RNA, 64 nt, hsa
aguacaacuuuuaaggacuaauuacugugauggacacagaaauguagcuguguucuggaacuga

SEQ ID NO: 411811 - RNA, 64 nt, hsa
uaaucggguacuaccagucuugaaauuuugccaccacagaaagaaagauguuuuuaaaagcuug

SEQ ID NO: 411812 - RNA, 64 nt, hsa
uagucuccauuucauagaugaaaauagugaagcccacagaaaauaaguagcuccuccacagguu

SEQ ID NO: 411813 - RNA, 64 nt, hsa
uggauuggauagaauucccauucagcuguuuuaacacagaaauucaaaauagugacuuaacaug

SEQ ID NO: 411814 - RNA, 64 nt, hsa
aacgggcaaaauaauugugcuggauucucacacacacagaaauaucgaccaucacccucccccg

SEQ ID NO: 411815 - RNA, 64 nt, hsa
ccaccuuauuuccuuguuuuguugauuagaacaacacagaaaaaagcaaauauaaauuuuuaau

SEQ ID NO: 411816 - RNA, 64 nt, hsa
gaaacagaagagugagaagaaaggagaggaaaagcacagaaacgcuugagcagcccuucccgaa

SEQ ID NO: 411817 - RNA, 64 nt, hsa
aaccggccuuacugaccugcuuucacugaccagccacagaaagaaacagaagagugagaagaaa

SEQ ID NO: 411818 - RNA, 64 nt, hsa
cgauuucaauuuguaaaugaucaguggauaaaaucacagaaaauugucagauuucuucgggaaa

SEQ ID NO: 411819 - RNA, 64 nt, hsa
gccucuaugugcuguuuuuccucauacaaguaaacacagaaagucaaauucuucagccucccuc

SEQ ID NO: 411820 - RNA, 64 nt, hsa
guuuauuuaauaagugggcagguugcaagcguugcacagaaauucugagauuuuacugccuuuu

SEQ ID NO: 411821 - RNA, 64 nt, hsa
gaaauggugucccugucccucccaaagcacagagcacagaaaugaggccguuuacauggcgagu

SEQ ID NO: 411822 - RNA, 64 nt, hsa
uguacugcucaaaaacaugagaggaaucacacugcacagaaacacuaugaauguaaacugugug

SEQ ID NO: 411823 - RNA, 64 nt, hsa
uucacccaggaggaauggacuuugcuggauccuucacagaaaaaacucuacagagacgugaugu

SEQ ID NO: 411824 - RNA, 64 nt, hsa
agcaaaaguggucgguggcugcuguauuggacagcacagaaaaagauuuccaucaccacagaaa

SEQ ID NO: 411825 - RNA, 64 nt, hsa
uguauuggacagcacagaaaaagauuuccaucaccacagaaaggucggcuggcagcacuggcca

SEQ ID NO: 411826 - RNA, 64 nt, hsa
guggacacagaaaugcacaggggacacuuacggacacagaaaugcacaggggaggccgagcaua

SEQ ID NO: 411827 - RNA, 64 nt, hsa
gaggugucuacaggguuuauaguagucuuguggacacagaaaugcacaggggacacuuacggac

SEQ ID NO: 411828 - RNA, 64 nt, hsa
auucugcaguaaaucuuuuacaacugccucgaaacacagaaaccuuuuuaaaaauagacacucc

SEQ ID NO: 411829 - RNA, 64 nt, hsa
ucaucgaaucuacuaauuccacaccuuuuauugacacagaaaauguugagaaucccaaauuuga

SEQ ID NO: 411830 - RNA, 64 nt, hsa
aauggggccugggcugggggccuggccucuggagagcccugauucuacuccagucuucucucac

SEQ ID NO: 411831 - RNA, 64 nt, hsa
acacacucaccacccaggaugcucagcucaccagagcccugaccuccgagaaaugaccccgucc

SEQ ID NO: 411832 - RNA, 64 nt, hsa
caguuuccuggucauuucugcagcucugacugugagcccugagaagaaagggaagacuuggggc

SEQ ID NO: 411833 - RNA, 64 nt, hsa
gacaggagaggaaccucaacucaguccauuucauagcccugauaggggaagugggaguugacag

SEQ ID NO: 411834 - RNA, 64 nt, hsa
aaucacagauauccuauggagauuuaaggaugaaagcccugaguuguucuuggguucuuggauc

SEQ ID NO: 411835 - RNA, 64 nt, hsa
uaccaucuacaucuccuucaccccuauggugcucagcccugagauccugcacaagguggagugu

SEQ ID NO: 411836 - RNA, 64 nt, hsa
ggcuccuaugaugagagauacauguugccucaccagcccugaggcuccgccccagcccucagcc

SEQ ID NO: 411837 - RNA, 64 nt, hsa
agcccaucuccggggaagacgugcgcgaugugacagcccugaacgugagcacgcugaaggcuua

SEQ ID NO: 411838 - RNA, 64 nt, hsa
caggaugcccaauggcuccaccauucccccagggagcccugaggagaugcuuuuccacuuugga

SEQ ID NO: 411839 - RNA, 64 nt, hsa
uuuuguaccacuuacauuuuaggcuggggcaagcagcccugaccuaagggagaaugaguuggac

SEQ ID NO: 411840 - RNA, 64 nt, hsa
cuguuacaucauaacaacuucugaaacacacaccagcccugaguucugggcucauuugaagccu

SEQ ID NO: 411841 - RNA, 64 nt, hsa
aaggcuggggccacagcuccuaccccugcccagcagcccugagcucagcugcaggaaggacauc

SEQ ID NO: 411842 - RNA, 64 nt, hsa
agucggcugcagcagagggcaggagccccagcuuagcccugagcgccagcgcgaggaccagggc

SEQ ID NO: 411843 - RNA, 64 nt, hsa
gugggcacaugaaacgaccuggaacuugcuucacagcccugaggaagguggacuuacauaagca

SEQ ID NO: 411844 - RNA, 64 nt, hsa
aaacuaggccagugguuuucaaacugcuuggcagagcccugaaguuuccuagggguugccucag

SEQ ID NO: 411845 - RNA, 64 nt, hsa
cccugccagcagcugccugggaaggccguguuucagcccugaugggccaagggaaggcuaucag

SEQ ID NO: 411846 - RNA, 64 nt, hsa
gguugugcugacagcaaagauccacuuuggcaggagcccugacccagcuaggagguagucugga

SEQ ID NO: 411847 - RNA, 64 nt, hsa
uugccaccugccaucuccaagcauuuggacaacuagcccugaugcauuaggcugcaacucugau

SEQ ID NO: 411848 - RNA, 64 nt, hsa
agauuacaugagaagauuuccaugaaagaauugcagcccugagguccauggguugacuuaugcu

SEQ ID NO: 411849 - RNA, 64 nt, hsa
ugauucuucaaaagcauucugagaaggugagauaagcccugagucucagcuaccuaagaaaaac

SEQ ID NO: 411850 - RNA, 64 nt, hsa
uuuagcaauuuauacaauaucauccaguaccuuaagcccugauuguguauauucauauauuuug

SEQ ID NO: 411851 - RNA, 64 nt, hsa
cgaccguggagcgcuggcaagggcguccuggcccagcccugagcgcgcggcccuuccccugucg

SEQ ID NO: 411852 - RNA, 64 nt, hsa
uuaccucacccggccccaucuguugccccgguccagcccugauggcgcgcgccuggucugucug

SEQ ID NO: 411853 - RNA, 64 nt, hsa
ugcugccugcuuugugcaggguccuccggggcucagcccugaguuggcaucaccugcgcagggc

SEQ ID NO: 411854 - RNA, 64 nt, hsa
guuggcaucaccugcgcagggcccucuggggcucagcccugagcuagugucaccugcacagggc

SEQ ID NO: 411855 - RNA, 64 nt, hsa
gcuagugucaccugcacagggcccucugaggcucagcccugagcuggcgucaccugugcagggc

SEQ ID NO: 411856 - RNA, 64 nt, hsa
gcuggcgucaccugugcagggcccucuggggcucagcccugagcuggccucaccuggguucccc

SEQ ID NO: 411857 - RNA, 64 nt, hsa
uagcacucuuguuugcuuugaaaauauuuguccaauugaguagcugcaugcuguucccccaggu

SEQ ID NO: 411858 - RNA, 64 nt, hsa
agggaagauuuuuccauuuguauuacugcuucccauugaguaaucauacucaacugggggaagg

SEQ ID NO: 411859 - RNA, 64 nt, hsa
uaacaaaauuuuaaaauauauauugucauaauauauugaguaaaagaguauauauguauauacc

SEQ ID NO: 411860 - RNA, 64 nt, hsa
aauucagaagcuaucguuaauaauuuguuuuauaauugaguaguacaagcgaggaaaaaauacg

SEQ ID NO: 411861 - RNA, 64 nt, hsa
gggacuaaauaugacuuuaaagagacuucaaaauauugaguauuuuaaaaauuuaaaaguaggu

SEQ ID NO: 411862 - RNA, 64 nt, hsa
auauguuuuuucaaugccaucugaagauuuuguaauugaguagcaguaaauauacagauuuaca

SEQ ID NO: 411863 - RNA, 64 nt, hsa
uaggguggcugguuuguaaaguucaugcaucuauauugaguauucuuuuuuuuuuuuuuugaga

SEQ ID NO: 411864 - RNA, 64 nt, hsa
cugagauuacaggcaugagccaccacgcccagccauugaguauucuuuuuuaaaauaugaagcu

SEQ ID NO: 411865 - RNA, 64 nt, hsa
gugccacaagugguuuuuucauuauguaaagcacccguugaauuaaaagaauuuguuuuuguuc

SEQ ID NO: 411866 - RNA, 64 nt, hsa
aucccggcuauucagaaggccgaggugggagaauccguugaaccugggaggcggagguugugau

SEQ ID NO: 411867 - RNA, 64 nt, hsa
gguguuaaaagaaucaugguaaggaaaccuuaauccguugaaacucuuguaauuuggacaacaa

SEQ ID NO: 411868 - RNA, 64 nt, hsa
aucccucugacaucuccacugcccccaaagaccuccguugaacauucuguauggaaaagagccc

SEQ ID NO: 411869 - RNA, 64 nt, hsa
uuugcaccuccauggaaacgaagcaccaucauucccguugaacgucacaucuuuaacccacuaa

SEQ ID NO: 411870 - RNA, 64 nt, hsa
aguauaguuuucuuuuuaucuuauuuuuacucguccguugaaaagauaaucaaggccuacauuu

SEQ ID NO: 411871 - RNA, 64 nt, hsa
cacauggggccggugaugguaugcugaaguucagccguugaacacauaggaaugucuguggggu

SEQ ID NO: 411872 - RNA, 64 nt, hsa
uagugcaaauaugacccuggucagggcuuugccaccguugaagcccugcagaaggugcaaugua

SEQ ID NO: 411873 - RNA, 64 nt, hsa
gcgcauuucugaaucuagcaaauccuccuuuuacccguugaauguuuugaaugcccugacucua

SEQ ID NO: 411874 - RNA, 64 nt, hsa
ggccagcguggcuguggcacuuggccaggacgcuccguugaaugaagcucauugauuggccaug

SEQ ID NO: 411875 - RNA, 64 nt, hsa
uuccacggugccuguacacagccgagcagcauuuccguugaaggacuugcauccccauugcggg

SEQ ID NO: 411876 - RNA, 64 nt, hsa
ucuugggguacgugccugacaguguuuaagguguccguugaacuggaguugcagacuuuuaaau

SEQ ID NO: 411877 - RNA, 64 nt, hsa
ccugcaccccuuagcccucccugcuuugccuggcccguugaaguuccagggagcuugcccgggu

SEQ ID NO: 411878 - RNA, 64 nt, hsa
uuuacuuauaaaaguacaaguagacguauauuguccguugaauaacugaauauaccaucaaagg

SEQ ID NO: 411879 - RNA, 64 nt, hsa
ugcuggcuuugcaaauagaaguggucuccagcaaccguugaaaggcauagaauugacucuguuc

SEQ ID NO: 411880 - RNA, 64 nt, hsa
cgcaaaauguggaaagaaagaagacauuguuauuccguugaauaaagaaacagaaaaaauagaa

SEQ ID NO: 411881 - RNA, 64 nt, hsa
ccgagcccauccagccucugggccauagacccuuccguugaaggcccagccugccccugagacg

SEQ ID NO: 411882 - RNA, 64 nt, hsa
uguauauaauguuuuuuaaacagaacuucauuccccguugaacuuucgcauucucugacagagg

SEQ ID NO: 411883 - RNA, 64 nt, hsa
agcgagcgcuacccacuucuaaauagcaauuucgccguugaagaggaagggcaaaaccacuaga

SEQ ID NO: 411884 - RNA, 64 nt, hsa
gacacugaagauacuucucgggaaaggaucaucgccguugaaaugaaaagagagacagagagaa

SEQ ID NO: 411885 - RNA, 64 nt, hsa
guucauggggaucugggggguggggaggaggaagccguugaaucugggagggaaguggagguug

SEQ ID NO: 411886 - RNA, 64 nt, hsa
gaaucauuaaagaaaaagaaaaaagauuuuaagaccguugaaaucaauuaucaagaacguccua

SEQ ID NO: 411887 - RNA, 64 nt, hsa
guguaacuuaugugacucuagugcuuaacagcugccguugaagcuaauauucaguucuguagag

SEQ ID NO: 411888 - RNA, 64 nt, hsa
ucgugcaaaucuacaacaugucccagcccauucuccguugaaacagaucacagcaacgacaaac

SEQ ID NO: 411889 - RNA, 64 nt, hsa
gcaucuuucaugaaugguucacuuacuuuuuuugccguugaaaaauacagugcccaaaauaauc

SEQ ID NO: 411890 - RNA, 64 nt, hsa
cuuaugguuaaaaaagaguacaggagucuggaguccguugaaggguaaaggccucccgcaagcu

SEQ ID NO: 411891 - RNA, 64 nt, hsa
ccucggccuaggucacguuggcccucaaagcgagccguugaauuggaaacugcuucuagaaacu

SEQ ID NO: 411892 - RNA, 64 nt, hsa
uccuucucccccaacucccagcccugccuguggcccguugaaauguugguggcacuuaauaaau

SEQ ID NO: 411893 - RNA, 64 nt, hsa
gucucagcuacuugggacgcugaggcaggaaaauccguugaacccaggaggcagagguuguagu

SEQ ID NO: 411894 - RNA, 64 nt, hsa
acuacagagaugucccaguauguuucuuucugccccguugaagaggugcagccucaggcugaga

SEQ ID NO: 411895 - RNA, 64 nt, hsa
ccagccugucggccacaccccagacuccaggcccccguugaagccgcucccgguucccucccca

SEQ ID NO: 411896 - RNA, 64 nt, hsa
ugcagcagcaaguacaaaaggagaagaggaacauccguugaaugaguguguuuuguacauaacu

SEQ ID NO: 411897 - RNA, 64 nt, hsa
aguguucagagcagacagaagcagggugguggcaccguugaaaggcagaaagagccaggagaaa

SEQ ID NO: 411898 - RNA, 64 nt, hsa
uccucaucuuuuuguuguugucauggaugguggugacauggacuuguuuauagaggacagguca

SEQ ID NO: 411899 - RNA, 64 nt, hsa
cucauuugaggaacagcacaucagcuuugcccuugacauggacaauagguuuuuuacuuugacg

SEQ ID NO: 411900 - RNA, 64 nt, hsa
cguauuggagcaacagcguauuggcuuggcuguugacauggauggugaguaccuuucuaugaag

SEQ ID NO: 411901 - RNA, 64 nt, hsa
ugauaccauggaauauuucaucucaccaagaugugacauggauuauuuuucccuuggacacaaa

SEQ ID NO: 411902 - RNA, 64 nt, hsa
uuuucuaggccaaguacuucacuuccauuugucugacauggagauugagggagaaauguauuug

SEQ ID NO: 411903 - RNA, 64 nt, hsa
caguggaaggauuuuuauuaaaaagaagcuaauugacauggaaaugucagugaaauuucuuacc

SEQ ID NO: 411904 - RNA, 64 nt, hsa
uguuguauaaucauguguuuacuaacaaguugaugacauggauguauucauaagaccauguaau

SEQ ID NO: 411905 - RNA, 64 nt, hsa
aaaagacauggaagguuagguuugucaacacaaagacauggaagauuagagguuugucaacaca

SEQ ID NO: 411906 - RNA, 64 nt, hsa
aagacauggaagguuagagguuugucaacaaaaagacauggaagguuagguuugucaacacaaa

SEQ ID NO: 411907 - RNA, 64 nt, hsa
augcaccacccauggagagguuugucaacacaaagacauggaagguuagagguuugucaacaaa

SEQ ID NO: 411908 - RNA, 64 nt, hsa
agcuaucuuugaaccgggaagcaggcccuuaccagacauggacuaugccagugccuugauauug

SEQ ID NO: 411909 - RNA, 64 nt, hsa
cuuugggaugagaugaauauauuuuacaugugaugacauggauuuugggggccagagguguaau

SEQ ID NO: 411910 - RNA, 64 nt, hsa
uuggagcuucuuggaagacauggauuguccggaagacauggauugucuggaagauguggauuuu

SEQ ID NO: 411911 - RNA, 64 nt, hsa
cuugauuuacuggaagacuuggagcuucuuggaagacauggauuguccggaagacauggauugu

SEQ ID NO: 411912 - RNA, 64 nt, hsa
cuguauuugauggaagaccuugaaauuauuggaagacauggauuuccuggaagacguggauuuu

SEQ ID NO: 411913 - RNA, 64 nt, hsa
uuggauuugguggaagacacagauuuuucuggaagacauggauuagcuggaagaucuguauuug

SEQ ID NO: 411914 - RNA, 64 nt, hsa
aauuaugauuauucugugccauuuacaguuucuaauacuauacuguaugaaauauguauaaaua

SEQ ID NO: 411915 - RNA, 64 nt, hsa
uaauucucuucuucugaaauuauggucacacuauauacuauagcauuucgguuuuauccuuuga

SEQ ID NO: 411916 - RNA, 64 nt, hsa
aaagauuuucacuucucaauuguugccuuuguacauacuauagaguguugcuuguaagaaaggc

SEQ ID NO: 411917 - RNA, 64 nt, hsa
gauuaaaaauugcaccaaagcaucggcaaaaacaauacuauauucuuuaaaagugcucagguag

SEQ ID NO: 411918 - RNA, 51 nt, hsa
aaaagaguauuccuacguaauauacuauagagacuuuuugaaauaaaguca

SEQ ID NO: 411919 - RNA, 64 nt, hsa
agaauaaguauuuuaguauaaauauuuuaguaaaauacuauaaaaauaaaaggacauauaauuu

SEQ ID NO: 411920 - RNA, 64 nt, hsa
cauaguaauuauaaacauuuguaaaauuuguaaaauacuauaagucauuuugaguguugguguu

SEQ ID NO: 411921 - RNA, 64 nt, hsa
ucucucccaacacacacacacacacaccccucacauacuauaaaauaaaucuucacugcccuau

SEQ ID NO: 411922 - RNA, 64 nt, hsa
aaguuucuaaauaaucuucgcugaaaucuaaaauauacuauaacaaccguguuuuauuugugaa

SEQ ID NO: 411923 - RNA, 64 nt, hsa
uuacacaagugugacuauacaaauuguaaaacagauacuauaauauuuccuuuuauuuuagugu

SEQ ID NO: 411924 - RNA, 64 nt, hsa
uuccuuucaagaucuuuuuugccaaaacauuuugauacuauagcauuguacauuugaaaguagu

SEQ ID NO: 411925 - RNA, 64 nt, hsa
aucuauguuuucaguauuaugacaguaucugcagauacuauaauaauaugcuuuggccaaauuu

SEQ ID NO: 411926 - RNA, 64 nt, hsa
ucuucugcuuauuuuucagccuuuaaagucugaaauacuauaaaacacugagaguaucuauguc

SEQ ID NO: 411927 - RNA, 64 nt, hsa
uuauuugucuauacuaguagaagugaucagugacauacuauaaauaauccuaaaugguuauauu

SEQ ID NO: 411928 - RNA, 64 nt, hsa
aaaacuuuugguucagaagcuugacucauaaacuauacuauauauucccaaaaaugucaguauu

SEQ ID NO: 411929 - RNA, 64 nt, hsa
auuuuucccccuuuaaauaaaaauauuagaucaaauacuauaugcaagaaaucauagcaaaguu

SEQ ID NO: 411930 - RNA, 64 nt, hsa
guuguugauuuugcugugacaguacacuaaaucaauacuauaucuuauacaguuugaaaauaug

SEQ ID NO: 411931 - RNA, 64 nt, hsa
uguauauagugugugauguauaugugugugauguauacuauauaugcccacacaugcacuacau

SEQ ID NO: 411932 - RNA, 64 nt, hsa
aguguaugugugauguauacuauacauaucacauauacuauauguguguauauagugugugaug

SEQ ID NO: 411933 - RNA, 64 nt, hsa
uacacauauaguguauauaguguaugugugauguauacuauacauaucacauauacuauaugug

SEQ ID NO: 411934 - RNA, 64 nt, hsa; identical to SEQ ID NO: 76382

SEQ ID NO: 411935 - RNA, 64 nt, hsa; identical to SEQ ID NO: 76383

SEQ ID NO: 411936 - RNA, 64 nt, hsa; identical to SEQ ID NO: 76384

SEQ ID NO: 411937 - RNA, 64 nt, hsa; identical to SEQ ID NO: 76385

SEQ ID NO: 411938 - RNA, 64 nt, hsa; identical to SEQ ID NO: 76386

SEQ ID NO: 411939 - RNA, 64 nt, hsa; identical to SEQ ID NO: 76387

SEQ ID NO: 411940 - RNA, 64 nt, hsa; identical to SEQ ID NO: 76388

SEQ ID NO: 411941 - RNA, 64 nt, hsa; identical to SEQ ID NO: 76389

SEQ ID NO: 411942 - RNA, 64 nt, hsa; identical to SEQ ID NO: 76390

SEQ ID NO: 411943 - RNA, 64 nt, hsa; identical to SEQ ID NO: 76391

SEQ ID NO: 411944 - RNA, 64 nt, hsa; identical to SEQ ID NO: 76392

SEQ ID NO: 411945 - RNA, 64 nt, hsa; identical to SEQ ID NO: 76393

SEQ ID NO: 411946 - RNA, 64 nt, hsa; identical to SEQ ID NO: 76394

SEQ ID NO: 411947 - RNA, 64 nt, hsa; identical to SEQ ID NO: 76395

SEQ ID NO: 411948 - RNA, 64 nt, hsa; identical to SEQ ID NO: 76396

SEQ ID NO: 411949 - RNA, 64 nt, hsa; identical to SEQ ID NO: 76397

SEQ ID NO: 411950 - RNA, 64 nt, hsa; identical to SEQ ID NO: 76398

SEQ ID NO: 411951 - RNA, 64 nt, hsa; identical to SEQ ID NO: 76399

SEQ ID NO: 411952 - RNA, 64 nt, hsa; identical to SEQ ID NO: 76400

SEQ ID NO: 411953 - RNA, 64 nt, hsa; identical to SEQ ID NO: 76401

SEQ ID NO: 411954 - RNA, 64 nt, hsa; identical to SEQ ID NO: 76402

SEQ ID NO: 411955 - RNA, 64 nt, hsa; identical to SEQ ID NO: 76403

SEQ ID NO: 411956 - RNA, 64 nt, hsa; identical to SEQ ID NO: 76404

SEQ ID NO: 411957 - RNA, 64 nt, hsa; identical to SEQ ID NO: 76405

SEQ ID NO: 411958 - RNA, 64 nt, hsa; identical to SEQ ID NO: 76406

SEQ ID NO: 411959 - RNA, 64 nt, hsa; identical to SEQ ID NO: 76407

SEQ ID NO: 411960 - RNA, 64 nt, hsa; identical to SEQ ID NO: 76408

SEQ ID NO: 411961 - RNA, 64 nt, hsa; identical to SEQ ID NO: 76409

SEQ ID NO: 411962 - RNA, 64 nt, hsa; identical to SEQ ID NO: 76410

SEQ ID NO: 411963 - RNA, 64 nt, hsa; identical to SEQ ID NO: 76411

SEQ ID NO: 411964 - RNA, 64 nt, hsa; identical to SEQ ID NO: 76412

SEQ ID NO: 411965 - RNA, 64 nt, hsa; identical to SEQ ID NO: 76413

SEQ ID NO: 411966 - RNA, 64 nt, hsa; identical to SEQ ID NO: 76414

SEQ ID NO: 411967 - RNA, 64 nt, hsa; identical to SEQ ID NO: 76415

SEQ ID NO: 411968 - RNA, 64 nt, hsa; identical to SEQ ID NO: 76416

SEQ ID NO: 411969 - RNA, 64 nt, hsa; identical to SEQ ID NO: 76417

SEQ ID NO: 411970 - RNA, 64 nt, hsa; identical to SEQ ID NO: 76418

SEQ ID NO: 411971 - RNA, 64 nt, hsa; identical to SEQ ID NO: 76419

SEQ ID NO: 411972 - RNA, 64 nt, hsa; identical to SEQ ID NO: 76420

SEQ ID NO: 411973 - RNA, 64 nt, hsa; identical to SEQ ID NO: 76421

SEQ ID NO: 411974 - RNA, 64 nt, hsa; identical to SEQ ID NO: 76422

SEQ ID NO: 411975 - RNA, 64 nt, hsa; identical to SEQ ID NO: 76423

SEQ ID NO: 411976 - RNA, 62 nt, hsa; identical to SEQ ID NO: 76424

SEQ ID NO: 411977 - RNA, 64 nt, hsa; identical to SEQ ID NO: 76425

SEQ ID NO: 411978 - RNA, 61 nt, hsa
ccuuccugcugccaagguggccugacacugugccagagaguggcugguuuuaaauaccuac

SEQ ID NO: 411979 - RNA, 61 nt, hsa
ccuaggcuuccuccuggaugugauggggauugccagagaggcucuuagcauaaaaggcauu

SEQ ID NO: 411980 - RNA, 61 nt, hsa
gccagcugcaguccguaccguucuuagguuagccagagacagguuuucauuaucaggucac

SEQ ID NO: 411981 - RNA, 61 nt, hsa
cuguuuccauuacaaacuuuguucugucugggccagagaaccuagccuuugaaaucucucc

SEQ ID NO: 411982 - RNA, 61 nt, hsa
uguguccagcagcugcgggucugaaggaauagccagagaggagcaccugaaccccaugggc

SEQ ID NO: 411983 - RNA, 61 nt, hsa
cuuuuccaggauccugcaggaacgagcacuggccagagagggcccagcuguagccauggcu

SEQ ID NO: 411984 - RNA, 61 nt, hsa
uacagucacaacugcaguaggcagugaggaagccagagaaaugcgauagcggcauuucucu

SEQ ID NO: 411985 - RNA, 61 nt, hsa
ugcuuucaguugguuuucaauuugcucacuggccagagacauugauggcaguucuuaucug

SEQ ID NO: 411986 - RNA, 61 nt, hsa
aagugacgaggaagguucuguuuugaguauagccagagaaaacaaggauggagaaaaaucu

SEQ ID NO: 411987 - RNA, 61 nt, hsa
aagugacgaggaagauucuguuuuggguauagccagagaaaacaaggauggagaaaaaucu

SEQ ID NO: 411988 - RNA, 61 nt, hsa
uacaguccacagguggacaaagggauccccagccagagagagagagaccagccaacagcuu

SEQ ID NO: 411989 - RNA, 61 nt, hsa
agaccagccaacagcuugauagaccagugcagccagagagaccaccaaacagagcccccaa

SEQ ID NO: 411990 - RNA, 61 nt, hsa
aaaagcaagucccccagccccaccccagggagccagagaggcuugcacucaggagagaacc

SEQ ID NO: 411991 - RNA, 61 nt, hsa
ccgcccucugggguuugaguggagguauggagccagagaggcuauccuagcuaccuuccuc

SEQ ID NO: 411992 - RNA, 61 nt, hsa
gagaauaagucagucugaggggaaaugggaggccagagaugagaacccuuugaaaagauug

SEQ ID NO: 411993 - RNA, 61 nt, hsa
aucccucuuggccgcuaaggcuaagguaggagccagagagcuguagagacaggaccaccag

SEQ ID NO: 411994 - RNA, 61 nt, hsa
uacccuugccugcuggggggccuagccaugggccagagauggaggagccccaguggcugac

SEQ ID NO: 411995 - RNA, 61 nt, hsa
auggucauucucaaaaacccugggguccugggccagagacaggcagggcccaguccagggg

SEQ ID NO: 411996 - RNA, 61 nt, hsa
agggcccaggaucccaugccugggaggagcugccagagagaagcaaaaaggcggcugugga

SEQ ID NO: 411997 - RNA, 61 nt, hsa
aggccuuacuuagcuccuugcgauacugugagccagagagaaaguaaaagcacuucacaaa

SEQ ID NO: 411998 - RNA, 61 nt, hsa
gcauauuuggcucauggguucauaaauugaggccagagacucauuguauauccuugaucaa

SEQ ID NO: 411999 - RNA, 61 nt, hsa
cccugcuggcugccggcaccgcccuccugcugccagagacgaggcaggcacagcugccaga

SEQ ID NO: 412000 - RNA, 61 nt, hsa
uccugcugccagagacgaggcaggcacagcugccagagaccauccaggacguggagagaaa

SEQ ID NO: 412001 - RNA, 61 nt, hsa
cccccaggggaaaccuccagaggaacaagcugccagagacauuuaugcccccagcaccaau

SEQ ID NO: 412002 - RNA, 61 nt, hsa
ugaaaagaugcuguggcaguuccugaagcccgccagagacagcucaggugcaaggagauga

SEQ ID NO: 412003 - RNA, 61 nt, hsa
guggaagaaacaacccaccugaaggccaaaugccagagauuugggguuggggaaagggccc

SEQ ID NO: 412004 - RNA, 61 nt, hsa
ccugcccuugguuucccagaccccugcuauagccagagaacaauaaagaagggagaccagg

SEQ ID NO: 412005 - RNA, 61 nt, hsa
ccucugcagagcgcucucugugugccagagagccagagacccaagacagggcccgggcucu

SEQ ID NO: 412006 - RNA, 61 nt, hsa
agggcugcccucugcagagcgcucucugugugccagagagccagagacccaagacagggcc

SEQ ID NO: 412007 - RNA, 61 nt, hsa
ugcggcuuccagaggugcagcugccgaaagugccagagaugaaagucccugagaugaagcu

SEQ ID NO: 412008 - RNA, 61 nt, hsa
ugaaagugucggagaugaaacucccaaaggugccagagauggcugugccggaggugcggcu

SEQ ID NO: 412009 - RNA, 61 nt, hsa
ccaaagugucagagaugaaacucccaaaggugccagagauggcugugccggaggugcggcu

SEQ ID NO: 412010 - RNA, 61 nt, hsa
ccaaggugucagagaugaaacucccaaaggugccagagauggcugugccggaggugcggcu

SEQ ID NO: 412011 - RNA, 61 nt, hsa
guugcacuaaaaugaggauccagggcagcaggccagagaaagcaaaggugcacuccagacu

SEQ ID NO: 412012 - RNA, 61 nt, hsa
ugggaagggagcauugcagccuaagaagaaggccagagagggaaaaggcaggugcuuuugg

SEQ ID NO: 412013 - RNA, 61 nt, hsa
guggaauguguuguauuuucgacagguugcugccagagagccugcuuccugcugccugccg

SEQ ID NO: 412014 - RNA, 61 nt, hsa
gugccuguaaucccagcuucuggaggcugaggccagagaaucgcuugaaccugggaggugg

SEQ ID NO: 412015 - RNA, 64 nt, hsa; identical to SEQ ID NO: 209092

SEQ ID NO: 412016 - RNA, 64 nt, hsa; identical to SEQ ID NO: 209093

SEQ ID NO: 412017 - RNA, 64 nt, hsa; identical to SEQ ID NO: 209094

SEQ ID NO: 412018 - RNA, 64 nt, hsa; identical to SEQ ID NO: 209095

SEQ ID NO: 412019 - RNA, 64 nt, hsa; identical to SEQ ID NO: 209096

SEQ ID NO: 412020 - RNA, 64 nt, hsa; identical to SEQ ID NO: 209097

SEQ ID NO: 412021 - RNA, 64 nt, hsa; identical to SEQ ID NO: 209098

SEQ ID NO: 412022 - RNA, 64 nt, hsa; identical to SEQ ID NO: 209099

SEQ ID NO: 412023 - RNA, 64 nt, hsa; identical to SEQ ID NO: 209100

SEQ ID NO: 412024 - RNA, 64 nt, hsa; identical to SEQ ID NO: 209101

SEQ ID NO: 412025 - RNA, 64 nt, hsa; identical to SEQ ID NO: 209102

SEQ ID NO: 412026 - RNA, 64 nt, hsa; identical to SEQ ID NO: 209103

SEQ ID NO: 412027 - RNA, 64 nt, hsa; identical to SEQ ID NO: 209104

SEQ ID NO: 412028 - RNA, 64 nt, hsa; identical to SEQ ID NO: 209105

SEQ ID NO: 412029 - RNA, 64 nt, hsa; identical to SEQ ID NO: 209106

SEQ ID NO: 412030 - RNA, 64 nt, hsa; identical to SEQ ID NO: 209107

SEQ ID NO: 412031 - RNA, 64 nt, hsa; identical to SEQ ID NO: 209108

SEQ ID NO: 412032 - RNA, 64 nt, hsa; identical to SEQ ID NO: 209109

SEQ ID NO: 412033 - RNA, 64 nt, hsa; identical to SEQ ID NO: 209110

SEQ ID NO: 412034 - RNA, 64 nt, hsa; identical to SEQ ID NO: 209111

SEQ ID NO: 412035 - RNA, 64 nt, hsa; identical to SEQ ID NO: 209112

SEQ ID NO: 412036 - RNA, 64 nt, hsa; identical to SEQ ID NO: 209113

SEQ ID NO: 412037 - RNA, 59 nt, hsa; identical to SEQ ID NO: 209114

SEQ ID NO: 412038 - RNA, 64 nt, hsa; identical to SEQ ID NO: 209115

SEQ ID NO: 412039 - RNA, 64 nt, hsa; identical to SEQ ID NO: 209116

SEQ ID NO: 412040 - RNA, 64 nt, hsa; identical to SEQ ID NO: 209117

SEQ ID NO: 412041 - RNA, 64 nt, hsa; identical to SEQ ID NO: 209118

SEQ ID NO: 412042 - RNA, 64 nt, hsa; identical to SEQ ID NO: 209119

SEQ ID NO: 412043 - RNA, 64 nt, hsa; identical to SEQ ID NO: 209120

SEQ ID NO: 412044 - RNA, 64 nt, hsa; identical to SEQ ID NO: 209121

SEQ ID NO: 412045 - RNA, 64 nt, hsa; identical to SEQ ID NO: 209122

SEQ ID NO: 412046 - RNA, 64 nt, hsa; identical to SEQ ID NO: 209123

SEQ ID NO: 412047 - RNA, 64 nt, hsa; identical to SEQ ID NO: 209124

SEQ ID NO: 412048 - RNA, 64 nt, hsa; identical to SEQ ID NO: 209125

SEQ ID NO: 412049 - RNA, 64 nt, hsa; identical to SEQ ID NO: 209126

SEQ ID NO: 412050 - RNA, 64 nt, hsa; identical to SEQ ID NO: 209127

SEQ ID NO: 412051 - RNA, 64 nt, hsa; identical to SEQ ID NO: 209128

SEQ ID NO: 412052 - RNA, 64 nt, hsa; identical to SEQ ID NO: 209129

SEQ ID NO: 412053 - RNA, 64 nt, hsa; identical to SEQ ID NO: 209130

SEQ ID NO: 412054 - RNA, 64 nt, hsa; identical to SEQ ID NO: 209131

SEQ ID NO: 412055 - RNA, 64 nt, hsa; identical to SEQ ID NO: 209132

SEQ ID NO: 412056 - RNA, 64 nt, hsa; identical to SEQ ID NO: 209133

SEQ ID NO: 412057 - RNA, 64 nt, hsa; identical to SEQ ID NO: 209134

SEQ ID NO: 412058 - RNA, 64 nt, hsa; identical to SEQ ID NO: 209135

SEQ ID NO: 412059 - RNA, 64 nt, hsa; identical to SEQ ID NO: 209136

SEQ ID NO: 412060 - RNA, 64 nt, hsa; identical to SEQ ID NO: 209137

SEQ ID NO: 412061 - RNA, 64 nt, hsa; identical to SEQ ID NO: 209138

SEQ ID NO: 412062 - RNA, 64 nt, hsa; identical to SEQ ID NO: 209139

SEQ ID NO: 412063 - RNA, 64 nt, hsa; identical to SEQ ID NO: 209140

SEQ ID NO: 412064 - RNA, 64 nt, hsa; identical to SEQ ID NO: 209141

SEQ ID NO: 412065 - RNA, 64 nt, hsa; identical to SEQ ID NO: 209142

SEQ ID NO: 412066 - RNA, 64 nt, hsa; identical to SEQ ID NO: 209143

SEQ ID NO: 412067 - RNA, 64 nt, hsa; identical to SEQ ID NO: 209144

SEQ ID NO: 412068 - RNA, 64 nt, hsa; identical to SEQ ID NO: 209145

SEQ ID NO: 412069 - RNA, 64 nt, hsa
ggccucccaccgcagcgucccccgccgcgccaguccccgcuagugguaguaucucguaauagcu

SEQ ID NO: 412070 - RNA, 64 nt, hsa
cgccgccgcgcgccccugcccgagagagcucuggccccgcuagcggggccaggagccgggccuc

SEQ ID NO: 412071 - RNA, 64 nt, hsa; identical to SEQ ID NO: 123549

SEQ ID NO: 412072 - RNA, 64 nt, hsa; identical to SEQ ID NO: 123550

SEQ ID NO: 412073 - RNA, 64 nt, hsa; identical to SEQ ID NO: 123551

SEQ ID NO: 412074 - RNA, 64 nt, hsa; identical to SEQ ID NO: 123552

SEQ ID NO: 412075 - RNA, 64 nt, hsa; identical to SEQ ID NO: 123553

SEQ ID NO: 412076 - RNA, 64 nt, hsa; identical to SEQ ID NO: 123554

SEQ ID NO: 412077 - RNA, 64 nt, hsa; identical to SEQ ID NO: 123555

SEQ ID NO: 412078 - RNA, 64 nt, hsa; identical to SEQ ID NO: 123556

SEQ ID NO: 412079 - RNA, 64 nt, hsa; identical to SEQ ID NO: 123557

SEQ ID NO: 412080 - RNA, 64 nt, hsa; identical to SEQ ID NO: 123558

SEQ ID NO: 412081 - RNA, 64 nt, hsa; identical to SEQ ID NO: 123559

SEQ ID NO: 412082 - RNA, 64 nt, hsa; identical to SEQ ID NO: 123560

SEQ ID NO: 412083 - RNA, 64 nt, hsa; identical to SEQ ID NO: 123561

SEQ ID NO: 412084 - RNA, 64 nt, hsa; identical to SEQ ID NO: 123562

SEQ ID NO: 412085 - RNA, 64 nt, hsa; identical to SEQ ID NO: 123563

SEQ ID NO: 412086 - RNA, 64 nt, hsa; identical to SEQ ID NO: 123564

SEQ ID NO: 412087 - RNA, 64 nt, hsa; identical to SEQ ID NO: 123565

SEQ ID NO: 412088 - RNA, 64 nt, hsa; identical to SEQ ID NO: 123566

SEQ ID NO: 412089 - RNA, 64 nt, hsa; identical to SEQ ID NO: 123567

SEQ ID NO: 412090 - RNA, 64 nt, hsa; identical to SEQ ID NO: 123568

SEQ ID NO: 412091 - RNA, 64 nt, hsa; identical to SEQ ID NO: 123569

SEQ ID NO: 412092 - RNA, 64 nt, hsa; identical to SEQ ID NO: 123570

SEQ ID NO: 412093 - RNA, 64 nt, hsa; identical to SEQ ID NO: 123571

SEQ ID NO: 412094 - RNA, 64 nt, hsa; identical to SEQ ID NO: 123572

SEQ ID NO: 412095 - RNA, 64 nt, hsa; identical to SEQ ID NO: 123573

SEQ ID NO: 412096 - RNA, 64 nt, hsa; identical to SEQ ID NO: 123574

SEQ ID NO: 412097 - RNA, 64 nt, hsa; identical to SEQ ID NO: 123575

SEQ ID NO: 412098 - RNA, 64 nt, hsa; identical to SEQ ID NO: 123576

SEQ ID NO: 412099 - RNA, 64 nt, hsa; identical to SEQ ID NO: 123577

SEQ ID NO: 412100 - RNA, 64 nt, hsa; identical to SEQ ID NO: 123578

SEQ ID NO: 412101 - RNA, 64 nt, hsa; identical to SEQ ID NO: 123579

SEQ ID NO: 412102 - RNA, 64 nt, hsa; identical to SEQ ID NO: 123580

SEQ ID NO: 412103 - RNA, 64 nt, hsa; identical to SEQ ID NO: 123581

SEQ ID NO: 412104 - RNA, 64 nt, hsa; identical to SEQ ID NO: 123582

SEQ ID NO: 412105 - RNA, 64 nt, hsa; identical to SEQ ID NO: 123583

SEQ ID NO: 412106 - RNA, 64 nt, hsa; identical to SEQ ID NO: 123584

SEQ ID NO: 412107 - RNA, 64 nt, hsa; identical to SEQ ID NO: 123585

SEQ ID NO: 412108 - RNA, 64 nt, hsa; identical to SEQ ID NO: 123586

SEQ ID NO: 412109 - RNA, 64 nt, hsa; identical to SEQ ID NO: 123587

SEQ ID NO: 412110 - RNA, 64 nt, hsa; identical to SEQ ID NO: 123588

SEQ ID NO: 412111 - RNA, 64 nt, hsa; identical to SEQ ID NO: 123589

SEQ ID NO: 412112 - RNA, 64 nt, hsa; identical to SEQ ID NO: 123590

SEQ ID NO: 412113 - RNA, 64 nt, hsa; identical to SEQ ID NO: 123591

SEQ ID NO: 412114 - RNA, 64 nt, hsa; identical to SEQ ID NO: 123592

SEQ ID NO: 412115 - RNA, 64 nt, hsa; identical to SEQ ID NO: 123593

SEQ ID NO: 412116 - RNA, 64 nt, hsa; identical to SEQ ID NO: 123594

SEQ ID NO: 412117 - RNA, 64 nt, hsa; identical to SEQ ID NO: 123595

SEQ ID NO: 412118 - RNA, 64 nt, hsa; identical to SEQ ID NO: 123596

SEQ ID NO: 412119 - RNA, 64 nt, hsa; identical to SEQ ID NO: 123597

SEQ ID NO: 412120 - RNA, 64 nt, hsa; identical to SEQ ID NO: 123598

SEQ ID NO: 412121 - RNA, 64 nt, hsa; identical to SEQ ID NO: 123599

SEQ ID NO: 412122 - RNA, 64 nt, hsa; identical to SEQ ID NO: 123600

SEQ ID NO: 412123 - RNA, 64 nt, hsa; identical to SEQ ID NO: 123601

SEQ ID NO: 412124 - RNA, 64 nt, hsa
guugacagccauaauuagggaggcaugaauuaugcggcuauaaugcagagcccuacaauuaagg

SEQ ID NO: 412125 - RNA, 64 nt, hsa
ccuugucuggggccuggacacacugaggacaaugcggcuauagcagauggccauggcagucagu

SEQ ID NO: 412126 - RNA, 64 nt, hsa
accaggugacugcugcugggugacuccccugaggcggcuauacccuuaagccagccccacuacu

SEQ ID NO: 412127 - RNA, 64 nt, hsa
augcuuauauccuuuaauaaccaauugccaaccacggcuauaagauuauuucagagguggggcu

SEQ ID NO: 412128 - RNA, 64 nt, hsa
cguuagauugaagaaaacaucuagaugcagcgaucggcuauagauacuucuagaucgucuagau

SEQ ID NO: 412129 - RNA, 64 nt, hsa
gcuggcagaaagggaacagaaagguuuuugaguacggcuauagccuggacuuuccuguugucua

SEQ ID NO: 412130 - RNA, 64 nt, hsa
agcagucaguccccugggggaaucuggcauaauucggcuauaaauguagcaaugcuuggaaagg

SEQ ID NO: 412131 - RNA, 64 nt, hsa
aauuucagaaauugagaacaauuucauaauaaaacggcuauauuugaagagagaauacauuuua

SEQ ID NO: 412132 - RNA, 64 nt, hsa
ugcaugucucaauuucuaccuuuuucugugguaucggcuauacuagggaaccauuuuguagaag

SEQ ID NO: 412133 - RNA, 64 nt, hsa
ugucagcaaaccaaagaauuggaucuuaccaaugcggcuauaggaaaacagccuguugcauggu

SEQ ID NO: 412134 - RNA, 64 nt, hsa
aagugcugggauuacaggcuugagccaccgcgcccggcuauauuuuaucuuuuaucuuuuucuu

SEQ ID NO: 412135 - RNA, 64 nt, hsa
acauaauguguuuucccacauuuaggaccaaagacggcuauagaaaaacucaaauggauugcuu

SEQ ID NO: 412136 - RNA, 64 nt, hsa
uguagcguuuggguccuuuuaccccuaugucccccggcuauacuuuuaaaacagcuuuagcugu

SEQ ID NO: 412137 - RNA, 64 nt, hsa
agguccagagcucuggcccaugggggugggugagcggcuauaguguucaucccugcucuugaaa

SEQ ID NO: 412138 - RNA, 64 nt, hsa
uagggaagagauucucaaaugagaaaaagggcuccggcuauaugggcaacaaagagggaagaua

SEQ ID NO: 412139 - RNA, 64 nt, hsa
auauaaucaccacaaugcagcuaggauaguguugcggcuauaauuuuguguuuuuuuuuuuuaa

SEQ ID NO: 412140 - RNA, 64 nt, hsa
aucuguaagagcuugcuccagauucugaugcauacggcuauauugguuuauguagucaguugca

SEQ ID NO: 412141 - RNA, 64 nt, hsa
ucccuugggaguuguagcugcugucacugacucccggcuauacauggccugucgaccacguuau

SEQ ID NO: 412142 - RNA, 64 nt, hsa
acacgcuguuggggagagaaggauggagauaggauggagauaggauggagauguggcucuucuc

SEQ ID NO: 412143 - RNA, 64 nt, hsa
aacagacaaccacacgcuguuggggagagaaggauggagauaggauggagauaggauggagaug

SEQ ID NO: 412144 - RNA, 64 nt, hsa
agagcuauucucugauggauuugagcaacagcaguggagauaaauguccuagagucaccagguc

SEQ ID NO: 412145 - RNA, 64 nt, hsa
uuaagagucacgacccaucaagggaaugcauagauggagauauauagugugugauguguaaauc

SEQ ID NO: 412146 - RNA, 64 nt, hsa
acaaagcccauucauccauuggauucacugucaguggagauacuaccucucguggcaaccauag

SEQ ID NO: 412147 - RNA, 64 nt, hsa
aaucuaggucauggcaguugaaaaagggccucauuggagauaaagucguaggauaaaauuggga

SEQ ID NO: 412148 - RNA, 64 nt, hsa
cccgacuggaucgccaucugcuacaacaacugccuggagauacucagaguguaguguugguggc

SEQ ID NO: 412149 - RNA, 64 nt, hsa
ccugcauuugccacuggauuugcacugcaucguuuggagauacaaagcgagcaguucuugguca

SEQ ID NO: 412150 - RNA, 64 nt, hsa
cuuuagguuuucaagcacaugaaaguacucacacuggagauaaacccuuugaguguaaaaaaug

SEQ ID NO: 412151 - RNA, 64 nt, hsa
aacguucuuuccaaauacauggaaggacucacacuggagauaaacccuuuaaguguaaagaaug

SEQ ID NO: 412152 - RNA, 64 nt, hsa; identical to SEQ ID NO: 386331

SEQ ID NO: 412153 - RNA, 64 nt, hsa; identical to SEQ ID NO: 386332

SEQ ID NO: 412154 - RNA, 64 nt, hsa; identical to SEQ ID NO: 386353

SEQ ID NO: 412155 - RNA, 64 nt, hsa; identical to SEQ ID NO: 386354

SEQ ID NO: 412156 - RNA, 64 nt, hsa; identical to SEQ ID NO: 386357

SEQ ID NO: 412157 - RNA, 64 nt, hsa; identical to SEQ ID NO: 386358

SEQ ID NO: 412158 - RNA, 64 nt, hsa; identical to SEQ ID NO: 386377

SEQ ID NO: 412159 - RNA, 64 nt, hsa; identical to SEQ ID NO: 386378

SEQ ID NO: 412160 - RNA, 64 nt, hsa; identical to SEQ ID NO: 386418

SEQ ID NO: 412161 - RNA, 64 nt, hsa; identical to SEQ ID NO: 386419

SEQ ID NO: 412162 - RNA, 64 nt, hsa; identical to SEQ ID NO: 386420

SEQ ID NO: 412163 - RNA, 64 nt, hsa; identical to SEQ ID NO: 386421

SEQ ID NO: 412164 - RNA, 64 nt, hsa
uggagacgcagaaccugcuggugcaagcugggcagguccugaccaaccugcaucaggggaugcc

SEQ ID NO: 412165 - RNA, 64 nt, hsa
auccuuuccaguaacuuuaaaaaaacaucccucagguccugauauauuuccuuggauucauuuc

SEQ ID NO: 412166 - RNA, 64 nt, hsa
ucuaguauuuugauuauuugaaucuuacagcaacaaauaggaacuccuggccaaugagagcucu

SEQ ID NO: 412167 - RNA, 64 nt, hsa
aaauaccugugaaagugccuaggcagugccagccaaauaggaggcauucaaugaacauuuuuug

SEQ ID NO: 412168 - RNA, 64 nt, hsa
uucuggcaucaguuugcuacagugagcucagaucaaauaggaaaauacuugaaaugcaugucuc

SEQ ID NO: 412169 - RNA, 64 nt, hsa
guaacuuuuuaaaaguuuggauguauagagggauaaauaggaaauauaagaauugguuauuugg

SEQ ID NO: 412170 - RNA, 64 nt, hsa
aaauuugagcgaggccuugucaauuuuaagguggaaauaggaaggaccacaacaugacccguaa

SEQ ID NO: 412171 - RNA, 64 nt, hsa
ccucugcauuuuccucacugguuagagauuaaguaaauaggauagaauaugcugcgucuccccu

SEQ ID NO: 412172 - RNA, 64 nt, hsa
uguuucaguuuguaaauguguaacauuuauaguuaaauaggacaaagcaggcccuaugacuauu

SEQ ID NO: 412173 - RNA, 64 nt, hsa
agaauaauuuaagacacuacaaugggggcaaaugaaauaggaaaauuuuuagugaguuacacgu

SEQ ID NO: 412174 - RNA, 64 nt, hsa
gauuaacuuauuucauuaaagaaguugggagaacaaauaggaaaaaaaaaacuuauuuuucuag

SEQ ID NO: 412175 - RNA, 64 nt, hsa
cauuaaauguauacagauuuaguuaaguagcauuaaauaggauucuuagaaguauguccucaua

SEQ ID NO: 412176 - RNA, 64 nt, hsa
uucuaauuagauuuacuauaucaagauaugguucaaauaggacuacuagaguucauugaacacu

SEQ ID NO: 412177 - RNA, 64 nt, hsa
aggugcaagaguuauguagaaggaaagggagcugaaauaggaacagaaaaaucaaccccuauaa

SEQ ID NO: 412178 - RNA, 64 nt, hsa
uagaauagugguugccaaugucucagggagguugaaauaggagaugaccacuaauugauagaac

SEQ ID NO: 412179 - RNA, 64 nt, hsa
uugcucugauacaaaaauucuaaaucaauuauugaaauaggaugcacacaauuacuaaaguaca

SEQ ID NO: 412180 - RNA, 64 nt, hsa
uacugcacuguaaagaccguggucucuuuucacuaaauaggagauucgaguuucccaguuuaca

SEQ ID NO: 412181 - RNA, 64 nt, hsa
ccauuuuuauauacugaauguggccuuuugagugaaauaggaagcuucaugguguuggagccac

SEQ ID NO: 412182 - RNA, 64 nt, hsa
gguuuaaauauuaccaugauguaguugaaauauaaaauaggauuuggaaccuuauugugauaaa

SEQ ID NO: 412183 - RNA, 64 nt, hsa
aaacgcagcggaaaugucauuaugaacagauguuaaauaggaaauuauuacuuguuaacuucuu

SEQ ID NO: 412184 - RNA, 64 nt, hsa
cgcauaacauccaauucugagaugaaacagucuaaaauaggaguaaagcaugcacuacuuguug

SEQ ID NO: 412185 - RNA, 64 nt, hsa
uauuuauuuaugaucuucuuaaaaccauuccaugaaauaggaacuguaauuauccccaauucua

SEQ ID NO: 412186 - RNA, 64 nt, hsa
cuauuuccuggcauuuuugucccuuuggaagaagaaauaggacucagaauacaguggcaugagu

SEQ ID NO: 412187 - RNA, 64 nt, hsa
aaaaauguaucugcagcaacucugcagguuugugaaauaggaugaaacucaaucuuuuucuauu

SEQ ID NO: 412188 - RNA, 64 nt, hsa
ggaauaagcuuuuucgaacugaaaauucaugguaaaauaggauuucuaucuaauguuaauccau

SEQ ID NO: 412189 - RNA, 64 nt, hsa
uucuaguuaaaucuuaaccauguucuuaaguccaaaauaggaagaaguggaguaguuugcagua

SEQ ID NO: 412190 - RNA, 64 nt, hsa
ucagcacagcugcuuccaaauaggagaaaccauaaaauaggaugaaaaucaaguaaaaugcaaa

SEQ ID NO: 412191 - RNA, 64 nt, hsa
ggugcccaaauaagugaucagcacagcugcuuccaaauaggagaaaccauaaaauaggaugaaa

SEQ ID NO: 412192 - RNA, 64 nt, hsa; identical to SEQ ID NO: 180822

SEQ ID NO: 412193 - RNA, 64 nt, hsa; identical to SEQ ID NO: 180823

SEQ ID NO: 412194 - RNA, 64 nt, hsa; identical to SEQ ID NO: 180824

SEQ ID NO: 412195 - RNA, 64 nt, hsa; identical to SEQ ID NO: 180825

SEQ ID NO: 412196 - RNA, 64 nt, hsa; identical to SEQ ID NO: 180826

SEQ ID NO: 412197 - RNA, 64 nt, hsa; identical to SEQ ID NO: 180827

SEQ ID NO: 412198 - RNA, 64 nt, hsa; identical to SEQ ID NO: 180828

SEQ ID NO: 412199 - RNA, 60 nt, hsa; identical to SEQ ID NO: 180829

SEQ ID NO: 412200 - RNA, 64 nt, hsa; identical to SEQ ID NO: 180830

SEQ ID NO: 412201 - RNA, 64 nt, hsa; identical to SEQ ID NO: 180831

SEQ ID NO: 412202 - RNA, 64 nt, hsa; identical to SEQ ID NO: 180832

SEQ ID NO: 412203 - RNA, 64 nt, hsa; identical to SEQ ID NO: 180833

SEQ ID NO: 412204 - RNA, 64 nt, hsa; identical to SEQ ID NO: 180834

SEQ ID NO: 412205 - RNA, 64 nt, hsa; identical to SEQ ID NO: 180835

SEQ ID NO: 412206 - RNA, 64 nt, hsa; identical to SEQ ID NO: 180836

SEQ ID NO: 412207 - RNA, 64 nt, hsa
augauuucauaaggaaaaccacuguuugaauaagccgcacaaaaaauaaaguuaagucugagac

SEQ ID NO: 412208 - RNA, 64 nt, hsa
agacugccccugcugccuucugcccagugggaccccgcacaacaucccucaccacucuccccca

SEQ ID NO: 412209 - RNA, 64 nt, hsa
gcauauugaguuauuuugcagaaucauaauggacccgcacaaaaucucagaaccauaucuguug

SEQ ID NO: 412210 - RNA, 64 nt, hsa
ggacgcuguguggagaguccaggaugacgggaucccgcacaagcucccuucaguccuucagggc

SEQ ID NO: 412211 - RNA, 64 nt, hsa
ggucucacgguguagagaggagcuuugaggccacccgcacaaaauucacccagagggaaaucuc

SEQ ID NO: 412212 - RNA, 64 nt, hsa
ccgcggaaggggguagggcccgagcuccgcgcggccgcacaauccgagcccccgccccgcgccc

SEQ ID NO: 412213 - RNA, 64 nt, hsa
ccaugcagauaagcccuggccaucucagcagccaccgcacaaccccccuaaugaaagacacgcc

SEQ ID NO: 412214 - RNA, 64 nt, hsa
ccauguagacaagcccuggucaucucagcagccaccgcacaacaccccugguggaagacacgcc

SEQ ID NO: 412215 - RNA, 64 nt, hsa
aucuaaaaauguuuacucguugccaugcugcaguccgcacaagcugugaggcagaaaacuugac

SEQ ID NO: 412216 - RNA, 64 nt, hsa
cugcuuuagaaugaaggucuuccagaagccacauccgcacaauuuuccacuuaaccaggaaaua

SEQ ID NO: 412217 - RNA, 64 nt, hsa
ccuucucucacccccacccuagccuccaccauccccgcacaaagcggcucuaaaccucaggcca

SEQ ID NO: 412218 - RNA, 64 nt, hsa
cuccccgucccacacugccccccauuugaguacaccgcacaagucaaacgcuaggaaguuugaa

SEQ ID NO: 412219 - RNA, 64 nt, hsa
uauucucugccuuuuuuuuccuauuuauuucuucccgcacaaauuccacauagaggccuuccca

SEQ ID NO: 412220 - RNA, 64 nt, hsa
ucugaguucauuucaaaagugaccaagggaaucuccgcacaaaagugcagauugaggaauugug

SEQ ID NO: 412221 - RNA, 64 nt, hsa
ggaccugaaagucagcucuggacccccucccucaccgcacaacucucuuucaccacgcgccucc

SEQ ID NO: 412222 - RNA, 64 nt, hsa
ucacuuuuccagucuuuuggaaaaaaauuucaguccgcacaagaugauauaauuggaguauuuu

SEQ ID NO: 412223 - RNA, 64 nt, hsa
cugcuguagcuuuaaugcauacaaacaugucccuccgcacaacuaaccugcccugccucuccau

SEQ ID NO: 412224 - RNA, 64 nt, hsa
ucccugcagccaaucaggcugaaaaugcagauuaccgcacaaaucucuuuguaccuacaguuga

SEQ ID NO: 412225 - RNA, 64 nt, hsa
aaugugagaaaguucuggugggccggcaggauugccgcacaaguuuauaugauggucguauaua

SEQ ID NO: 412226 - RNA, 64 nt, hsa
uggcgaggggcgccccaacccccugcccgccucuccgcacaauacuugaacauucaucuguacu

SEQ ID NO: 412227 - RNA, 64 nt, hsa
caaggugaacuuuuaauguuuauuauuuucuucuccgcacaaaguaaagagccuaauuuugugu

SEQ ID NO: 412228 - RNA, 64 nt, hsa
acgguggguggggggcucacccuggugcugccucccgcacaaggagaccuggacacaacagaca

SEQ ID NO: 412229 - RNA, 64 nt, hsa
aaaaggcccacaugauacaauuagagaauucccaccgcacaaaaaaaguuccuaaguauguuaa

SEQ ID NO: 412230 - RNA, 64 nt, hsa
cuguagugcaucuugaagagcucaaagcacaugaccgcacaaaugcuuacaggguuuccucccg

SEQ ID NO: 412231 - RNA, 64 nt, hsa
ggcuggcccccuucccucugucuggggucgcauuccgcacaagccuuucaucaacaucuuaaaa

SEQ ID NO: 412232 - RNA, 64 nt, hsa
cagccugcaguccucccaugauagccagggagagccgcacaacauacaauuauauuuuugguag

SEQ ID NO: 412233 - RNA, 64 nt, hsa
gcgccccuccuggacuuccgggccucgauuucuuccgcacaagccugaccguggauuucaggga

SEQ ID NO: 412234 - RNA, 64 nt, hsa
gugagcaccgcgcaccugccacagccucagaggcccgcacaaugaccggaggaggggccgcugu

SEQ ID NO: 412235 - RNA, 64 nt, hsa
ggguaugacugggggagaguggaacaugccuuuuccgcacaauauuaauuccuuuuuguaucag

SEQ ID NO: 412236 - RNA, 64 nt, hsa
ugaaaauauuuuuuaggagggaggauguaaauagccgcacaaagggguccaacagcucuuugag

SEQ ID NO: 412237 - RNA, 57 nt, hsa
cauacaaccauuauuccugacacugagccgcacaaccagucacugggccucucugca

SEQ ID NO: 412238 - RNA, 64 nt, hsa
gucugucuucaaagacaacaugcuuuggaaacauauguccuagaaaacauaaaauuaaaaaaaa

SEQ ID NO: 412239 - RNA, 64 nt, hsa
uaaguagauaacauguauuaguauuuuugucuguauguccuagcacuguucaacaacaaauuuu

SEQ ID NO: 412240 - RNA, 64 nt, hsa
gaaacuaguucguguuuauauacuauuuccuuugauguccuauaagucggaaaagaaaggggca

SEQ ID NO: 412241 - RNA, 64 nt, hsa
ugaaaacaagaauuuagagagccauuccuagaaaauguccuacugcccugcauuugacaaacaa

SEQ ID NO: 412242 - RNA, 64 nt, hsa
agaugcucugggauccuguacccucuuuggucucauguccuacaaucugcauucuggccauaau

SEQ ID NO: 412243 - RNA, 64 nt, hsa
gcugccugcuguugccacacuccucauggaugucauguccuacuucaauggguagggcugccuu

SEQ ID NO: 412244 - RNA, 64 nt, hsa
agacuauauuuauauuugacuuggcaacauuaacauguccuaagacuuagugcagagaagcuug

SEQ ID NO: 412245 - RNA, 64 nt, hsa
uucuugucuguuuuagguguacuuguuaauucuuauguccuaauuuuauuuaauucugaguucc

SEQ ID NO: 412246 - RNA, 64 nt, hsa
uuggggagagggggguaucaggcagggagggggcagaggcaaaucaccgggcagagggagggga

SEQ ID NO: 412247 - RNA, 64 nt, hsa
ggaggccuuuuggcaaacagugucuauuuuacagagaggcaaaccaagccuccuuagugcccug

SEQ ID NO: 412248 - RNA, 64 nt, hsa
caauuaaaaaagcgugggagcagugugaaggagaagaggcaagaacgaccccuggaccgaccaa

SEQ ID NO: 412249 - RNA, 64 nt, hsa
ugaucacagggaacacuuacuuagaacccugauuagaggcaauguuauucucaccaaaaaaggc

SEQ ID NO: 412250 - RNA, 64 nt, hsa
augccaucucuuuuuagauauacucaaaagacugagaggcaaaacuuggcuuuuagcugcagca

SEQ ID NO: 412251 - RNA, 64 nt, hsa
aauacaauguuuuagaaacagccaaguuaauuuuagaggcaagaacaugauuugaugcuauaaa

SEQ ID NO: 412252 - RNA, 64 nt, hsa
ucccaccuucucuuccccuguugccaaggucuaacucauggauuuuucucuuuccucauggaug

SEQ ID NO: 412253 - RNA, 64 nt, hsa
uugccaaggucuaacucauggauuuuucucuuuccucauggaugaucuucagcaagaguggacu

SEQ ID NO: 412254 - RNA, 64 nt, hsa
agagagcagcauaaauguugacaugggacauuugcucauggaauuggagcucgugggacaguca

SEQ ID NO: 412255 - RNA, 64 nt, hsa
uugcucauggaauuggagcucgugggacagucaccucauggaauuggagcucguggaacaguua

SEQ ID NO: 412256 - RNA, 64 nt, hsa
cagguugggugcucacagaacccuuuuccugacucucauggaagaugguggaaggaaaauagac

SEQ ID NO: 412257 - RNA, 64 nt, hsa
cuuccuucauggaaagguguuggcgcugauguagcucauggaaggaucagacugggaaccacag

SEQ ID NO: 412258 - RNA, 64 nt, hsa
uucaccccuccccuuucaccaccauccucuuuuccucauggaaaugucugcuuuaugaaacuau

SEQ ID NO: 412259 - RNA, 64 nt, hsa
uuucugguuucccuuccugugcauugcccauuuucucauggaguuucuuaucuuuuuugguuua

SEQ ID NO: 412260 - RNA, 64 nt, hsa; identical to SEQ ID NO: 86125

SEQ ID NO: 412261 - RNA, 64 nt, hsa; identical to SEQ ID NO: 86126

SEQ ID NO: 412262 - RNA, 64 nt, hsa; identical to SEQ ID NO: 86127

SEQ ID NO: 412263 - RNA, 64 nt, hsa; identical to SEQ ID NO: 86128

SEQ ID NO: 412264 - RNA, 58 nt, hsa; identical to SEQ ID NO: 86129

SEQ ID NO: 412265 - RNA, 64 nt, hsa; identical to SEQ ID NO: 86130

SEQ ID NO: 412266 - RNA, 64 nt, hsa; identical to SEQ ID NO: 86131

SEQ ID NO: 412267 - RNA, 64 nt, hsa; identical to SEQ ID NO: 86132

SEQ ID NO: 412268 - RNA, 64 nt, hsa; identical to SEQ ID NO: 86133

SEQ ID NO: 412269 - RNA, 64 nt, hsa; identical to SEQ ID NO: 86134

SEQ ID NO: 412270 - RNA, 64 nt, hsa; identical to SEQ ID NO: 86135

SEQ ID NO: 412271 - RNA, 64 nt, hsa; identical to SEQ ID NO: 86136

SEQ ID NO: 412272 - RNA, 64 nt, hsa; identical to SEQ ID NO: 86137

SEQ ID NO: 412273 - RNA, 64 nt, hsa; identical to SEQ ID NO: 86138

SEQ ID NO: 412274 - RNA, 64 nt, hsa; identical to SEQ ID NO: 86139

SEQ ID NO: 412275 - RNA, 64 nt, hsa; identical to SEQ ID NO: 86140

SEQ ID NO: 412276 - RNA, 64 nt, hsa; identical to SEQ ID NO: 86141

SEQ ID NO: 412277 - RNA, 64 nt, hsa; identical to SEQ ID NO: 86142

SEQ ID NO: 412278 - RNA, 64 nt, hsa; identical to SEQ ID NO: 86143

SEQ ID NO: 412279 - RNA, 64 nt, hsa; identical to SEQ ID NO: 86144

SEQ ID NO: 412280 - RNA, 64 nt, hsa; identical to SEQ ID NO: 86145

SEQ ID NO: 412281 - RNA, 64 nt, hsa; identical to SEQ ID NO: 86146

SEQ ID NO: 412282 - RNA, 64 nt, hsa; identical to SEQ ID NO: 86147

SEQ ID NO: 412283 - RNA, 64 nt, hsa; identical to SEQ ID NO: 86148

SEQ ID NO: 412284 - RNA, 64 nt, hsa; identical to SEQ ID NO: 86149

SEQ ID NO: 412285 - RNA, 64 nt, hsa; identical to SEQ ID NO: 86150

SEQ ID NO: 412286 - RNA, 64 nt, hsa; identical to SEQ ID NO: 86151

SEQ ID NO: 412287 - RNA, 64 nt, hsa; identical to SEQ ID NO: 86152

SEQ ID NO: 412288 - RNA, 64 nt, hsa; identical to SEQ ID NO: 86153

SEQ ID NO: 412289 - RNA, 64 nt, hsa; identical to SEQ ID NO: 86154

SEQ ID NO: 412290 - RNA, 64 nt, hsa; identical to SEQ ID NO: 86155

SEQ ID NO: 412291 - RNA, 64 nt, hsa; identical to SEQ ID NO: 86156

SEQ ID NO: 412292 - RNA, 64 nt, hsa; identical to SEQ ID NO: 86157

SEQ ID NO: 412293 - RNA, 64 nt, hsa; identical to SEQ ID NO: 86158

SEQ ID NO: 412294 - RNA, 64 nt, hsa; identical to SEQ ID NO: 86159

SEQ ID NO: 412295 - RNA, 64 nt, hsa; identical to SEQ ID NO: 86160

SEQ ID NO: 412296 - RNA, 64 nt, hsa; identical to SEQ ID NO: 86161

SEQ ID NO: 412297 - RNA, 64 nt, hsa; identical to SEQ ID NO: 86162

SEQ ID NO: 412298 - RNA, 64 nt, hsa; identical to SEQ ID NO: 86163

SEQ ID NO: 412299 - RNA, 60 nt, hsa; identical to SEQ ID NO: 86164

SEQ ID NO: 412300 - RNA, 64 nt, hsa; identical to SEQ ID NO: 86165

SEQ ID NO: 412301 - RNA, 64 nt, hsa; identical to SEQ ID NO: 86166

SEQ ID NO: 412302 - RNA, 64 nt, hsa; identical to SEQ ID NO: 86167

SEQ ID NO: 412303 - RNA, 64 nt, hsa; identical to SEQ ID NO: 86168

SEQ ID NO: 412304 - RNA, 64 nt, hsa; identical to SEQ ID NO: 86169

SEQ ID NO: 412305 - RNA, 64 nt, hsa; identical to SEQ ID NO: 86170

SEQ ID NO: 412306 - RNA, 64 nt, hsa; identical to SEQ ID NO: 86171

SEQ ID NO: 412307 - RNA, 64 nt, hsa; identical to SEQ ID NO: 86172

SEQ ID NO: 412308 - RNA, 64 nt, hsa; identical to SEQ ID NO: 86173

SEQ ID NO: 412309 - RNA, 64 nt, hsa; identical to SEQ ID NO: 86174

SEQ ID NO: 412310 - RNA, 64 nt, hsa; identical to SEQ ID NO: 86175

SEQ ID NO: 412311 - RNA, 64 nt, hsa; identical to SEQ ID NO: 86176

SEQ ID NO: 412312 - RNA, 64 nt, hsa; identical to SEQ ID NO: 86177

SEQ ID NO: 412313 - RNA, 64 nt, hsa; identical to SEQ ID NO: 86178

SEQ ID NO: 412314 - RNA, 64 nt, hsa; identical to SEQ ID NO: 86179

SEQ ID NO: 412315 - RNA, 64 nt, hsa; identical to SEQ ID NO: 86180

SEQ ID NO: 412316 - RNA, 64 nt, hsa; identical to SEQ ID NO: 86181

SEQ ID NO: 412317 - RNA, 64 nt, hsa; identical to SEQ ID NO: 86182

SEQ ID NO: 412318 - RNA, 64 nt, hsa; identical to SEQ ID NO: 86183

SEQ ID NO: 412319 - RNA, 64 nt, hsa; identical to SEQ ID NO: 86184

SEQ ID NO: 412320 - RNA, 64 nt, hsa; identical to SEQ ID NO: 86185

SEQ ID NO: 412321 - RNA, 64 nt, hsa; identical to SEQ ID NO: 86186

SEQ ID NO: 412322 - RNA, 64 nt, hsa; identical to SEQ ID NO: 237354

SEQ ID NO: 412323 - RNA, 64 nt, hsa; identical to SEQ ID NO: 237355

SEQ ID NO: 412324 - RNA, 64 nt, hsa; identical to SEQ ID NO: 237356

SEQ ID NO: 412325 - RNA, 64 nt, hsa; identical to SEQ ID NO: 237357

SEQ ID NO: 412326 - RNA, 64 nt, hsa; identical to SEQ ID NO: 237358

SEQ ID NO: 412327 - RNA, 64 nt, hsa; identical to SEQ ID NO: 237359

SEQ ID NO: 412328 - RNA, 64 nt, hsa; identical to SEQ ID NO: 237360

SEQ ID NO: 412329 - RNA, 64 nt, hsa; identical to SEQ ID NO: 237361

SEQ ID NO: 412330 - RNA, 64 nt, hsa; identical to SEQ ID NO: 237362

SEQ ID NO: 412331 - RNA, 64 nt, hsa; identical to SEQ ID NO: 237363

SEQ ID NO: 412332 - RNA, 64 nt, hsa; identical to SEQ ID NO: 237364

SEQ ID NO: 412333 - RNA, 64 nt, hsa; identical to SEQ ID NO: 237365

SEQ ID NO: 412334 - RNA, 64 nt, hsa; identical to SEQ ID NO: 237366

SEQ ID NO: 412335 - RNA, 64 nt, hsa; identical to SEQ ID NO: 237367

SEQ ID NO: 412336 - RNA, 64 nt, hsa; identical to SEQ ID NO: 237368

SEQ ID NO: 412337 - RNA, 64 nt, hsa; identical to SEQ ID NO: 237369

SEQ ID NO: 412338 - RNA, 64 nt, hsa; identical to SEQ ID NO: 237370

SEQ ID NO: 412339 - RNA, 64 nt, hsa; identical to SEQ ID NO: 237371

SEQ ID NO: 412340 - RNA, 64 nt, hsa; identical to SEQ ID NO: 237372

SEQ ID NO: 412341 - RNA, 64 nt, hsa; identical to SEQ ID NO: 237373

SEQ ID NO: 412342 - RNA, 64 nt, hsa; identical to SEQ ID NO: 237374

SEQ ID NO: 412343 - RNA, 64 nt, hsa; identical to SEQ ID NO: 237375

SEQ ID NO: 412344 - RNA, 64 nt, hsa; identical to SEQ ID NO: 237376

SEQ ID NO: 412345 - RNA, 64 nt, hsa; identical to SEQ ID NO: 237377

SEQ ID NO: 412346 - RNA, 64 nt, hsa; identical to SEQ ID NO: 237378

SEQ ID NO: 412347 - RNA, 64 nt, hsa; identical to SEQ ID NO: 237379

SEQ ID NO: 412348 - RNA, 64 nt, hsa; identical to SEQ ID NO: 237380

SEQ ID NO: 412349 - RNA, 64 nt, hsa; identical to SEQ ID NO: 237381

SEQ ID NO: 412350 - RNA, 64 nt, hsa; identical to SEQ ID NO: 237382

SEQ ID NO: 412351 - RNA, 64 nt, hsa; identical to SEQ ID NO: 237383

SEQ ID NO: 412352 - RNA, 64 nt, hsa; identical to SEQ ID NO: 237384

SEQ ID NO: 412353 - RNA, 64 nt, hsa; identical to SEQ ID NO: 237385

SEQ ID NO: 412354 - RNA, 64 nt, hsa; identical to SEQ ID NO: 237386

SEQ ID NO: 412355 - RNA, 64 nt, hsa; identical to SEQ ID NO: 237387

SEQ ID NO: 412356 - RNA, 64 nt, hsa; identical to SEQ ID NO: 237388

SEQ ID NO: 412357 - RNA, 64 nt, hsa; identical to SEQ ID NO: 237389

SEQ ID NO: 412358 - RNA, 64 nt, hsa; identical to SEQ ID NO: 237390

SEQ ID NO: 412359 - RNA, 64 nt, hsa; identical to SEQ ID NO: 237391

SEQ ID NO: 412360 - RNA, 64 nt, hsa; identical to SEQ ID NO: 237392

SEQ ID NO: 412361 - RNA, 64 nt, hsa; identical to SEQ ID NO: 237393

SEQ ID NO: 412362 - RNA, 64 nt, hsa; identical to SEQ ID NO: 237394

SEQ ID NO: 412363 - RNA, 64 nt, hsa; identical to SEQ ID NO: 237395

SEQ ID NO: 412364 - RNA, 64 nt, hsa; identical to SEQ ID NO: 237396

SEQ ID NO: 412365 - RNA, 64 nt, hsa; identical to SEQ ID NO: 237397

SEQ ID NO: 412366 - RNA, 64 nt, hsa; identical to SEQ ID NO: 237398

SEQ ID NO: 412367 - RNA, 64 nt, hsa; identical to SEQ ID NO: 237399

SEQ ID NO: 412368 - RNA, 64 nt, hsa; identical to SEQ ID NO: 237400

SEQ ID NO: 412369 - RNA, 64 nt, hsa; identical to SEQ ID NO: 237401

SEQ ID NO: 412370 - RNA, 64 nt, hsa; identical to SEQ ID NO: 237402

SEQ ID NO: 412371 - RNA, 64 nt, hsa; identical to SEQ ID NO: 237403

SEQ ID NO: 412372 - RNA, 64 nt, hsa; identical to SEQ ID NO: 237404

SEQ ID NO: 412373 - RNA, 64 nt, hsa; identical to SEQ ID NO: 237405

SEQ ID NO: 412374 - RNA, 64 nt, hsa; identical to SEQ ID NO: 237406

SEQ ID NO: 412375 - RNA, 64 nt, hsa; identical to SEQ ID NO: 237407

SEQ ID NO: 412376 - RNA, 64 nt, hsa; identical to SEQ ID NO: 237408

SEQ ID NO: 412377 - RNA, 64 nt, hsa; identical to SEQ ID NO: 237409

SEQ ID NO: 412378 - RNA, 64 nt, hsa
ggucagcccuacccaccugcccuguuugaacuuccuguuugacaauguuugcuguugauuuuuu

SEQ ID NO: 412379 - RNA, 64 nt, hsa
gcaaggagaggauggucagcccuacccaccugcccuguuugaacuuccuguuugacaauguuug

SEQ ID NO: 412380 - RNA, 64 nt, hsa
acaccaugaccgaggagccaacugggacuucuggcuguuugacauccucauguucccguugguc

SEQ ID NO: 412381 - RNA, 64 nt, hsa
gccuuugccauugugugcucucagauuucuuccacuguuugacacccuccuuagagggcugcuc

SEQ ID NO: 412382 - RNA, 64 nt, hsa
acacagagaauauacuuuuccucaaguaauauaccuguuugaagcuuuaagagagauguuuuug

SEQ ID NO: 412383 - RNA, 64 nt, hsa
acaguuacugcucgccuguuaaauuucaaauguccuguuugauacuacuguagaacacuauuuu

SEQ ID NO: 412384 - RNA, 64 nt, hsa
uuugucuaccuugugagcaggcuuuuggaagaaccuguuugaugcaaaaaagaaaaugaaaaac

SEQ ID NO: 412385 - RNA, 64 nt, hsa
aaaccuuauuaugggagcccgucggucuuagaagcuguuugacauguauaauaaauggcauuga

SEQ ID NO: 412386 - RNA, 64 nt, hsa
ucccucaaaccuuguuacagcaucaucacauuaccuguuugauguaaaaaauaaaaaauagaaa

SEQ ID NO: 412387 - RNA, 64 nt, hsa
augaacuaucuuauuauaaaaggcuguacuucuacuguuugaaaaaauuauuucuaggguuuaa

SEQ ID NO: 412388 - RNA, 64 nt, hsa
ccuucuagaacauguagacacuugagaaauguuucuguuugaagaaaauagagggagaaacaga

SEQ ID NO: 412389 - RNA, 64 nt, hsa
acaugaaggugugguaucaaacuucagguugaaacuguuugaagcauuauaaacauucauuuca

SEQ ID NO: 412390 - RNA, 64 nt, hsa
uuucccaaguacuggauuuuaaaucuguauguaucuguuugauuuuuuuuucuaauauuucagu

SEQ ID NO: 412391 - RNA, 64 nt, hsa
aguuaucuuaguaccuauggauuuucuuuauuugcuguuugaauggauugaccuugguuaugug

SEQ ID NO: 412392 - RNA, 64 nt, hsa
gaugcacacccuucuugguuggaacugaaagcuucuguuugaagagacaugaguucuggaagga

SEQ ID NO: 412393 - RNA, 64 nt, hsa
cauaagccauaugaugacacacagugucuuucuccuguuugaaaagaaauugugucauauuggu

SEQ ID NO: 412394 - RNA, 64 nt, hsa
uuggucucagacuaaguaaugcaucagaauucaucuguuugaagccugaaauaauuuaggacuc

SEQ ID NO: 412395 - RNA, 64 nt, hsa
cauuuaugauuugaaaguuggaaguuuguaccaucuguuugaguauaugcacauuuaaaaaaua

SEQ ID NO: 412396 - RNA, 64 nt, hsa
aaacauaauguaucuuaugaaagcauuacccaaccuguuugaguugagaaugcauuuguccacc

SEQ ID NO: 412397 - RNA, 64 nt, hsa
uaauugggaugauaagaaacaaaaauaaucccaacuguuugaaaguucgaaagaggggcauucu

SEQ ID NO: 412398 - RNA, 64 nt, hsa
auuuuugugagggcaaaggggaggaaaugggguucuguuugaaaaaaaugaggggaucuuagau

SEQ ID NO: 412399 - RNA, 64 nt, hsa
ccccucaugugcuucuucugaauacugaaugugacuguuugaaagcugguagaauucaucccuc

SEQ ID NO: 412400 - RNA, 64 nt, hsa
gucaccccuccuccugcgaagugaucugcaguggcuguuugaccagaccacaaaguucacaucu

SEQ ID NO: 412401 - RNA, 64 nt, hsa
uaaaagagccuugucugaccuuaaugcaagcagucuguuugaaccccuguaggcugcauucagg

SEQ ID NO: 412402 - RNA, 64 nt, hsa
uuaggaaaaaucuguguguauuguauagcucuagcuguuugacuaucuguaaugaaaaugcugc

SEQ ID NO: 412403 - RNA, 64 nt, hsa
gacgacaucuacauuucagugcuuuuucccuaagcuguuugaaaguuacgcuuuucuguuguuc

SEQ ID NO: 412404 - RNA, 64 nt, hsa
gaucaggguagacacguggagugcuggugcugagcuguuugagaagcucuguguggguguuucu

SEQ ID NO: 412405 - RNA, 64 nt, hsa
uauacuccaaugaguguguuugugaguuuuuauccuguuugaauuuugaugucguccaggcguc

SEQ ID NO: 412406 - RNA, 64 nt, hsa
cgucugcauuuucccccuuuaaagcugcggucuccuguuugauaaaagaauauuggccaguauu

SEQ ID NO: 412407 - RNA, 64 nt, hsa
uaugaagcuuagauaauaauggcuguuucguaaacuguuugagaccuauuaaugaaaaugacua

SEQ ID NO: 412408 - RNA, 64 nt, hsa; identical to SEQ ID NO: 134458

SEQ ID NO: 412409 - RNA, 64 nt, hsa; identical to SEQ ID NO: 134459

SEQ ID NO: 412410 - RNA, 64 nt, hsa; identical to SEQ ID NO: 134460

SEQ ID NO: 412411 - RNA, 64 nt, hsa; identical to SEQ ID NO: 134461

SEQ ID NO: 412412 - RNA, 64 nt, hsa; identical to SEQ ID NO: 134462

SEQ ID NO: 412413 - RNA, 64 nt, hsa; identical to SEQ ID NO: 134463

SEQ ID NO: 412414 - RNA, 64 nt, hsa; identical to SEQ ID NO: 134464

SEQ ID NO: 412415 - RNA, 64 nt, hsa; identical to SEQ ID NO: 134465

SEQ ID NO: 412416 - RNA, 64 nt, hsa; identical to SEQ ID NO: 134466

SEQ ID NO: 412417 - RNA, 64 nt, hsa; identical to SEQ ID NO: 134467

SEQ ID NO: 412418 - RNA, 64 nt, hsa; identical to SEQ ID NO: 134468

SEQ ID NO: 412419 - RNA, 64 nt, hsa; identical to SEQ ID NO: 134469

SEQ ID NO: 412420 - RNA, 64 nt, hsa; identical to SEQ ID NO: 134470

SEQ ID NO: 412421 - RNA, 64 nt, hsa; identical to SEQ ID NO: 134471

SEQ ID NO: 412422 - RNA, 64 nt, hsa; identical to SEQ ID NO: 134472

SEQ ID NO: 412423 - RNA, 64 nt, hsa; identical to SEQ ID NO: 134473

SEQ ID NO: 412424 - RNA, 64 nt, hsa; identical to SEQ ID NO: 134474

SEQ ID NO: 412425 - RNA, 64 nt, hsa; identical to SEQ ID NO: 134475

SEQ ID NO: 412426 - RNA, 64 nt, hsa; identical to SEQ ID NO: 134476

SEQ ID NO: 412427 - RNA, 64 nt, hsa; identical to SEQ ID NO: 134477

SEQ ID NO: 412428 - RNA, 64 nt, hsa; identical to SEQ ID NO: 134478

SEQ ID NO: 412429 - RNA, 64 nt, hsa; identical to SEQ ID NO: 134479

SEQ ID NO: 412430 - RNA, 64 nt, hsa; identical to SEQ ID NO: 134480

SEQ ID NO: 412431 - RNA, 64 nt, hsa; identical to SEQ ID NO: 134481

SEQ ID NO: 412432 - RNA, 64 nt, hsa; identical to SEQ ID NO: 134482

SEQ ID NO: 412433 - RNA, 64 nt, hsa; identical to SEQ ID NO: 134483

SEQ ID NO: 412434 - RNA, 64 nt, hsa; identical to SEQ ID NO: 134484

SEQ ID NO: 412435 - RNA, 64 nt, hsa; identical to SEQ ID NO: 134485

SEQ ID NO: 412436 - RNA, 64 nt, hsa; identical to SEQ ID NO: 134486

SEQ ID NO: 412437 - RNA, 64 nt, hsa; identical to SEQ ID NO: 134487

SEQ ID NO: 412438 - RNA, 64 nt, hsa; identical to SEQ ID NO: 134488

SEQ ID NO: 412439 - RNA, 64 nt, hsa; identical to SEQ ID NO: 134489

SEQ ID NO: 412440 - RNA, 64 nt, hsa; identical to SEQ ID NO: 134490

SEQ ID NO: 412441 - RNA, 64 nt, hsa; identical to SEQ ID NO: 134491

SEQ ID NO: 412442 - RNA, 64 nt, hsa; identical to SEQ ID NO: 134492

SEQ ID NO: 412443 - RNA, 64 nt, hsa; identical to SEQ ID NO: 134493

SEQ ID NO: 412444 - RNA, 64 nt, hsa; identical to SEQ ID NO: 134494

SEQ ID NO: 412445 - RNA, 64 nt, hsa; identical to SEQ ID NO: 134495

SEQ ID NO: 412446 - RNA, 64 nt, hsa; identical to SEQ ID NO: 134496

SEQ ID NO: 412447 - RNA, 64 nt, hsa; identical to SEQ ID NO: 134497

SEQ ID NO: 412448 - RNA, 64 nt, hsa; identical to SEQ ID NO: 134498

SEQ ID NO: 412449 - RNA, 64 nt, hsa; identical to SEQ ID NO: 134499

SEQ ID NO: 412450 - RNA, 64 nt, hsa; identical to SEQ ID NO: 134500

SEQ ID NO: 412451 - RNA, 64 nt, hsa; identical to SEQ ID NO: 134501

SEQ ID NO: 412452 - RNA, 64 nt, hsa; identical to SEQ ID NO: 134502

SEQ ID NO: 412453 - RNA, 64 nt, hsa; identical to SEQ ID NO: 134503

SEQ ID NO: 412454 - RNA, 64 nt, hsa; identical to SEQ ID NO: 134504

SEQ ID NO: 412455 - RNA, 64 nt, hsa; identical to SEQ ID NO: 134505

SEQ ID NO: 412456 - RNA, 64 nt, hsa; identical to SEQ ID NO: 134506

SEQ ID NO: 412457 - RNA, 64 nt, hsa; identical to SEQ ID NO: 134507

SEQ ID NO: 412458 - RNA, 64 nt, hsa; identical to SEQ ID NO: 134508

SEQ ID NO: 412459 - RNA, 64 nt, hsa; identical to SEQ ID NO: 134509

SEQ ID NO: 412460 - RNA, 64 nt, hsa; identical to SEQ ID NO: 134510

SEQ ID NO: 412461 - RNA, 64 nt, hsa; identical to SEQ ID NO: 134511

SEQ ID NO: 412462 - RNA, 64 nt, hsa; identical to SEQ ID NO: 134512

SEQ ID NO: 412463 - RNA, 64 nt, hsa; identical to SEQ ID NO: 134513

SEQ ID NO: 412464 - RNA, 64 nt, hsa; identical to SEQ ID NO: 134514

SEQ ID NO: 412465 - RNA, 64 nt, hsa; identical to SEQ ID NO: 134515

SEQ ID NO: 412466 - RNA, 64 nt, hsa; identical to SEQ ID NO: 134516

SEQ ID NO: 412467 - RNA, 64 nt, hsa; identical to SEQ ID NO: 134517

SEQ ID NO: 412468 - RNA, 64 nt, hsa; identical to SEQ ID NO: 134518

SEQ ID NO: 412469 - RNA, 64 nt, hsa; identical to SEQ ID NO: 134519

SEQ ID NO: 412470 - RNA, 64 nt, hsa; identical to SEQ ID NO: 134520

SEQ ID NO: 412471 - RNA, 64 nt, hsa; identical to SEQ ID NO: 134521

SEQ ID NO: 412472 - RNA, 64 nt, hsa; identical to SEQ ID NO: 134522

SEQ ID NO: 412473 - RNA, 64 nt, hsa; identical to SEQ ID NO: 134523

SEQ ID NO: 412474 - RNA, 64 nt, hsa; identical to SEQ ID NO: 134524

SEQ ID NO: 412475 - RNA, 64 nt, hsa; identical to SEQ ID NO: 134525

SEQ ID NO: 412476 - RNA, 64 nt, hsa; identical to SEQ ID NO: 134526

SEQ ID NO: 412477 - RNA, 64 nt, hsa; identical to SEQ ID NO: 134527

SEQ ID NO: 412478 - RNA, 64 nt, hsa; identical to SEQ ID NO: 134525

SEQ ID NO: 412479 - RNA, 64 nt, hsa; identical to SEQ ID NO: 134524

SEQ ID NO: 412480 - RNA, 64 nt, hsa; identical to SEQ ID NO: 134530

SEQ ID NO: 412481 - RNA, 64 nt, hsa; identical to SEQ ID NO: 134531

SEQ ID NO: 412482 - RNA, 64 nt, hsa; identical to SEQ ID NO: 134532

SEQ ID NO: 412483 - RNA, 64 nt, hsa; identical to SEQ ID NO: 134533

SEQ ID NO: 412484 - RNA, 64 nt, hsa; identical to SEQ ID NO: 134534

SEQ ID NO: 412485 - RNA, 64 nt, hsa; identical to SEQ ID NO: 134535

SEQ ID NO: 412486 - RNA, 64 nt, hsa; identical to SEQ ID NO: 134536

SEQ ID NO: 412487 - RNA, 64 nt, hsa; identical to SEQ ID NO: 134537

SEQ ID NO: 412488 - RNA, 64 nt, hsa; identical to SEQ ID NO: 134538

SEQ ID NO: 412489 - RNA, 64 nt, hsa; identical to SEQ ID NO: 134539

SEQ ID NO: 412490 - RNA, 64 nt, hsa; identical to SEQ ID NO: 134540

SEQ ID NO: 412491 - RNA, 64 nt, hsa; identical to SEQ ID NO: 134541

SEQ ID NO: 412492 - RNA, 64 nt, hsa; identical to SEQ ID NO: 134542

SEQ ID NO: 412493 - RNA, 64 nt, hsa; identical to SEQ ID NO: 134543

SEQ ID NO: 412494 - RNA, 64 nt, hsa; identical to SEQ ID NO: 134544

SEQ ID NO: 412495 - RNA, 64 nt, hsa; identical to SEQ ID NO: 134545

SEQ ID NO: 412496 - RNA, 64 nt, hsa; identical to SEQ ID NO: 134546

SEQ ID NO: 412497 - RNA, 64 nt, hsa; identical to SEQ ID NO: 134547

SEQ ID NO: 412498 - RNA, 64 nt, hsa; identical to SEQ ID NO: 134548

SEQ ID NO: 412499 - RNA, 64 nt, hsa; identical to SEQ ID NO: 134549

SEQ ID NO: 412500 - RNA, 64 nt, hsa; identical to SEQ ID NO: 134550

SEQ ID NO: 412501 - RNA, 64 nt, hsa; identical to SEQ ID NO: 134551

SEQ ID NO: 412502 - RNA, 64 nt, hsa; identical to SEQ ID NO: 134552

SEQ ID NO: 412503 - RNA, 64 nt, hsa; identical to SEQ ID NO: 134553

SEQ ID NO: 412504 - RNA, 64 nt, hsa; identical to SEQ ID NO: 134554

SEQ ID NO: 412505 - RNA, 64 nt, hsa; identical to SEQ ID NO: 134555

SEQ ID NO: 412506 - RNA, 64 nt, hsa; identical to SEQ ID NO: 134556

SEQ ID NO: 412507 - RNA, 64 nt, hsa; identical to SEQ ID NO: 134557

SEQ ID NO: 412508 - RNA, 64 nt, hsa; identical to SEQ ID NO: 134558

SEQ ID NO: 412509 - RNA, 64 nt, hsa; identical to SEQ ID NO: 134559

SEQ ID NO: 412510 - RNA, 64 nt, hsa; identical to SEQ ID NO: 134560

SEQ ID NO: 412511 - RNA, 64 nt, hsa; identical to SEQ ID NO: 134561

SEQ ID NO: 412512 - RNA, 64 nt, hsa; identical to SEQ ID NO: 134562

SEQ ID NO: 412513 - RNA, 64 nt, hsa; identical to SEQ ID NO: 134563

SEQ ID NO: 412514 - RNA, 64 nt, hsa; identical to SEQ ID NO: 134564

SEQ ID NO: 412515 - RNA, 64 nt, hsa; identical to SEQ ID NO: 134565

SEQ ID NO: 412516 - RNA, 64 nt, hsa; identical to SEQ ID NO: 134566

SEQ ID NO: 412517 - RNA, 64 nt, hsa; identical to SEQ ID NO: 134567

SEQ ID NO: 412518 - RNA, 64 nt, hsa; identical to SEQ ID NO: 134568

SEQ ID NO: 412519 - RNA, 64 nt, hsa; identical to SEQ ID NO: 134569

SEQ ID NO: 412520 - RNA, 64 nt, hsa; identical to SEQ ID NO: 134570

SEQ ID NO: 412521 - RNA, 64 nt, hsa; identical to SEQ ID NO: 134571

SEQ ID NO: 412522 - RNA, 64 nt, hsa; identical to SEQ ID NO: 134572

SEQ ID NO: 412523 - RNA, 64 nt, hsa; identical to SEQ ID NO: 134573

SEQ ID NO: 412524 - RNA, 64 nt, hsa; identical to SEQ ID NO: 134574

SEQ ID NO: 412525 - RNA, 64 nt, hsa; identical to SEQ ID NO: 134575

SEQ ID NO: 412526 - RNA, 64 nt, hsa; identical to SEQ ID NO: 134576

SEQ ID NO: 412527 - RNA, 64 nt, hsa; identical to SEQ ID NO: 134577

SEQ ID NO: 412528 - RNA, 64 nt, hsa; identical to SEQ ID NO: 134578

SEQ ID NO: 412529 - RNA, 64 nt, hsa; identical to SEQ ID NO: 134579

SEQ ID NO: 412530 - RNA, 64 nt, hsa; identical to SEQ ID NO: 134580

SEQ ID NO: 412531 - RNA, 64 nt, hsa; identical to SEQ ID NO: 134581

SEQ ID NO: 412532 - RNA, 64 nt, hsa; identical to SEQ ID NO: 134582

SEQ ID NO: 412533 - RNA, 64 nt, hsa; identical to SEQ ID NO: 134583

SEQ ID NO: 412534 - RNA, 64 nt, hsa; identical to SEQ ID NO: 134584

SEQ ID NO: 412535 - RNA, 64 nt, hsa; identical to SEQ ID NO: 134585

SEQ ID NO: 412536 - RNA, 64 nt, hsa; identical to SEQ ID NO: 134586

SEQ ID NO: 412537 - RNA, 64 nt, hsa; identical to SEQ ID NO: 134587

SEQ ID NO: 412538 - RNA, 64 nt, hsa; identical to SEQ ID NO: 134588

SEQ ID NO: 412539 - RNA, 64 nt, hsa; identical to SEQ ID NO: 134589

SEQ ID NO: 412540 - RNA, 64 nt, hsa; identical to SEQ ID NO: 134590

SEQ ID NO: 412541 - RNA, 64 nt, hsa; identical to SEQ ID NO: 134591

SEQ ID NO: 412542 - RNA, 64 nt, hsa; identical to SEQ ID NO: 134592

SEQ ID NO: 412543 - RNA, 64 nt, hsa; identical to SEQ ID NO: 134593

SEQ ID NO: 412544 - RNA, 64 nt, hsa; identical to SEQ ID NO: 134594

SEQ ID NO: 412545 - RNA, 64 nt, hsa; identical to SEQ ID NO: 134595

SEQ ID NO: 412546 - RNA, 64 nt, hsa; identical to SEQ ID NO: 134596

SEQ ID NO: 412547 - RNA, 64 nt, hsa; identical to SEQ ID NO: 134597

SEQ ID NO: 412548 - RNA, 64 nt, hsa; identical to SEQ ID NO: 134598

SEQ ID NO: 412549 - RNA, 64 nt, hsa; identical to SEQ ID NO: 134599

SEQ ID NO: 412550 - RNA, 64 nt, hsa; identical to SEQ ID NO: 134600

SEQ ID NO: 412551 - RNA, 64 nt, hsa; identical to SEQ ID NO: 134601

SEQ ID NO: 412552 - RNA, 64 nt, hsa; identical to SEQ ID NO: 134602

SEQ ID NO: 412553 - RNA, 64 nt, hsa; identical to SEQ ID NO: 134603

SEQ ID NO: 412554 - RNA, 64 nt, hsa; identical to SEQ ID NO: 134604

SEQ ID NO: 412555 - RNA, 64 nt, hsa; identical to SEQ ID NO: 134605

SEQ ID NO: 412556 - RNA, 64 nt, hsa; identical to SEQ ID NO: 134606

SEQ ID NO: 412557 - RNA, 64 nt, hsa; identical to SEQ ID NO: 134607

SEQ ID NO: 412558 - RNA, 64 nt, hsa; identical to SEQ ID NO: 134608

SEQ ID NO: 412559 - RNA, 64 nt, hsa; identical to SEQ ID NO: 134609

SEQ ID NO: 412560 - RNA, 64 nt, hsa; identical to SEQ ID NO: 134610

SEQ ID NO: 412561 - RNA, 64 nt, hsa; identical to SEQ ID NO: 134611

SEQ ID NO: 412562 - RNA, 64 nt, hsa; identical to SEQ ID NO: 134612

SEQ ID NO: 412563 - RNA, 64 nt, hsa; identical to SEQ ID NO: 134613

SEQ ID NO: 412564 - RNA, 64 nt, hsa; identical to SEQ ID NO: 134614

SEQ ID NO: 412565 - RNA, 64 nt, hsa; identical to SEQ ID NO: 134615

SEQ ID NO: 412566 - RNA, 64 nt, hsa; identical to SEQ ID NO: 134616

SEQ ID NO: 412567 - RNA, 64 nt, hsa; identical to SEQ ID NO: 134617

SEQ ID NO: 412568 - RNA, 64 nt, hsa; identical to SEQ ID NO: 134618

SEQ ID NO: 412569 - RNA, 64 nt, hsa; identical to SEQ ID NO: 134619

SEQ ID NO: 412570 - RNA, 64 nt, hsa; identical to SEQ ID NO: 134620

SEQ ID NO: 412571 - RNA, 64 nt, hsa; identical to SEQ ID NO: 134621

SEQ ID NO: 412572 - RNA, 64 nt, hsa; identical to SEQ ID NO: 134622

SEQ ID NO: 412573 - RNA, 64 nt, hsa; identical to SEQ ID NO: 134623

SEQ ID NO: 412574 - RNA, 64 nt, hsa; identical to SEQ ID NO: 134624

SEQ ID NO: 412575 - RNA, 64 nt, hsa; identical to SEQ ID NO: 134625

SEQ ID NO: 412576 - RNA, 64 nt, hsa; identical to SEQ ID NO: 134626

SEQ ID NO: 412577 - RNA, 64 nt, hsa; identical to SEQ ID NO: 134627

SEQ ID NO: 412578 - RNA, 64 nt, hsa; identical to SEQ ID NO: 134628

SEQ ID NO: 412579 - RNA, 64 nt, hsa; identical to SEQ ID NO: 134629

SEQ ID NO: 412580 - RNA, 64 nt, hsa; identical to SEQ ID NO: 134630

SEQ ID NO: 412581 - RNA, 64 nt, hsa; identical to SEQ ID NO: 134631

SEQ ID NO: 412582 - RNA, 64 nt, hsa; identical to SEQ ID NO: 134632

SEQ ID NO: 412583 - RNA, 64 nt, hsa; identical to SEQ ID NO: 134633

SEQ ID NO: 412584 - RNA, 64 nt, hsa; identical to SEQ ID NO: 134634

SEQ ID NO: 412585 - RNA, 64 nt, hsa; identical to SEQ ID NO: 134635

SEQ ID NO: 412586 - RNA, 64 nt, hsa; identical to SEQ ID NO: 134636

SEQ ID NO: 412587 - RNA, 64 nt, hsa; identical to SEQ ID NO: 134637

SEQ ID NO: 412588 - RNA, 64 nt, hsa; identical to SEQ ID NO: 134638

SEQ ID NO: 412589 - RNA, 64 nt, hsa; identical to SEQ ID NO: 134639

SEQ ID NO: 412590 - RNA, 64 nt, hsa; identical to SEQ ID NO: 134640

SEQ ID NO: 412591 - RNA, 64 nt, hsa; identical to SEQ ID NO: 134641

SEQ ID NO: 412592 - RNA, 64 nt, hsa; identical to SEQ ID NO: 134642

SEQ ID NO: 412593 - RNA, 64 nt, hsa; identical to SEQ ID NO: 134643

SEQ ID NO: 412594 - RNA, 64 nt, hsa; identical to SEQ ID NO: 134644

SEQ ID NO: 412595 - RNA, 64 nt, hsa; identical to SEQ ID NO: 134645

SEQ ID NO: 412596 - RNA, 64 nt, hsa
cacucuauguucuaagaagugaaaaucuacacuccagugagacagcucugcauacucauuagga

SEQ ID NO: 412597 - RNA, 64 nt, hsa
ccgagauugugccccugcacuccagccugagcgacagugagacucugucucaguccaugaagau

SEQ ID NO: 412598 - RNA, 64 nt, hsa
guggacagacccaggguggucuucaagccuggcccagugagagugaggcccccgcacgcaagcc

SEQ ID NO: 412599 - RNA, 64 nt, hsa
aggagcagugggcccuggcucugucacuaaauggcagugagaugucagacaaauucauucccuu

SEQ ID NO: 412600 - RNA, 64 nt, hsa
guuaggaggaguccucaucagcuguucucauugccagugagauauauucaguauuguagauacu

SEQ ID NO: 412601 - RNA, 64 nt, hsa
aaggugggcaggggcaagugaacucagcacucugcagugagagggacagucccauguguggcag

SEQ ID NO: 412602 - RNA, 64 nt, hsa
aguuuagcccugaacauuucaugguguucaucaacagugagagacuccauaguuugggcuugua

SEQ ID NO: 412603 - RNA, 64 nt, hsa
gauuggccagaaaccuuccugcugagccucacagcagugagacuggggccacuacauuugcucc

SEQ ID NO: 412604 - RNA, 64 nt, hsa
ccucauucauucagcaaaucucuauugaguucuucagugagaaggagcaggcacugggccugga

SEQ ID NO: 412605 - RNA, 64 nt, hsa
cucgcacagaaggugauaaguuacuaucaaaugccagugagaaucuucuuauagaauaaccugg

SEQ ID NO: 412606 - RNA, 64 nt, hsa
uuaggcaaauaacaaucagcaaggaaaccuucaccagugagaagaacaaugaaugucaugaacc

SEQ ID NO: 412607 - RNA, 64 nt, hsa
guuaaacucuuaaucgacuccugcaaaucuauaccagugagaaaucuuacaaauguauugaaug

SEQ ID NO: 412608 - RNA, 64 nt, hsa
aagauuguaccacuguacuccagccugggcuggacagugagacuuuugacagugagacugucaa

SEQ ID NO: 412609 - RNA, 64 nt, hsa
uacuccagccugggcuggacagugagacuuuugacagugagacugucaaaaaaaaaaaaaaaau

SEQ ID NO: 412610 - RNA, 64 nt, hsa
agacgcauggcucauggcgggcacaugcggcugccagugagacagcgucuccucugggagcugg

SEQ ID NO: 412611 - RNA, 64 nt, hsa
cucaccugccccucuuucuccugcacuuggcuugcagugagaugcucccagaugcauuugucca

SEQ ID NO: 412612 - RNA, 64 nt, hsa
uuucuguguuucccuuuaaaccagauccuggagacagugagauacucagggcguuguuaacagg

SEQ ID NO: 412613 - RNA, 64 nt, hsa
uuuuuguuuucuuguuuuuaaaaaaaggauuucacagugagaaaguuuugguuagugcauaccg

SEQ ID NO: 412614 - RNA, 64 nt, hsa
caucccuggauccacaggggcuaucgaggagacccagugagaauguagcauuuuguucaucccc

SEQ ID NO: 412615 - RNA, 64 nt, hsa
auucaccccuuuuggcagacucuccaccugaguucagugagagagaaaaugauuuagaucuugg

SEQ ID NO: 412616 - RNA, 64 nt, hsa
ugaucucacacaccagggcauucccccuaagaggcagugagauguagccuggcccuggaacuag

SEQ ID NO: 412617 - RNA, 64 nt, hsa
augacucuuaacauuagagagggcuaaacaagggcagugagaagacuggcaggcagcagaaauc

SEQ ID NO: 412618 - RNA, 64 nt, hsa
cccaggcucaggcugcccagcggcucuuccuggacagugagagcagggcugggcgccucugucc

SEQ ID NO: 412619 - RNA, 64 nt, hsa
uuuaaaauaggccaauguuggcuagucugugccucagugagaucagucagcuccgaguggcucc

SEQ ID NO: 412620 - RNA, 62 nt, hsa
ugacagagcaccuaggauaaagugcagugaugcaaucacagcucaccucagugcggccuuga

SEQ ID NO: 412621 - RNA, 64 nt, hsa
uuuuuuuuuguagagguggggaagugcagugaugcaaucacagcucaccucagugcggccuuga

SEQ ID NO: 412622 - RNA, 64 nt, hsa; identical to SEQ ID NO: 373662

SEQ ID NO: 412623 - RNA, 64 nt, hsa; identical to SEQ ID NO: 373663

SEQ ID NO: 412624 - RNA, 64 nt, hsa; identical to SEQ ID NO: 373664

SEQ ID NO: 412625 - RNA, 64 nt, hsa; identical to SEQ ID NO: 373665

SEQ ID NO: 412626 - RNA, 64 nt, hsa; identical to SEQ ID NO: 308983

SEQ ID NO: 412627 - RNA, 64 nt, hsa; identical to SEQ ID NO: 308984

SEQ ID NO: 412628 - RNA, 64 nt, hsa; identical to SEQ ID NO: 308985

SEQ ID NO: 412629 - RNA, 64 nt, hsa; identical to SEQ ID NO: 308986

SEQ ID NO: 412630 - RNA, 64 nt, hsa; identical to SEQ ID NO: 308987

SEQ ID NO: 412631 - RNA, 64 nt, hsa; identical to SEQ ID NO: 308988

SEQ ID NO: 412632 - RNA, 64 nt, hsa; identical to SEQ ID NO: 308989

SEQ ID NO: 412633 - RNA, 64 nt, hsa; identical to SEQ ID NO: 308990

SEQ ID NO: 412634 - RNA, 64 nt, hsa; identical to SEQ ID NO: 308991

SEQ ID NO: 412635 - RNA, 64 nt, hsa; identical to SEQ ID NO: 308992

SEQ ID NO: 412636 - RNA, 64 nt, hsa; identical to SEQ ID NO: 308993

SEQ ID NO: 412637 - RNA, 64 nt, hsa; identical to SEQ ID NO: 308994

SEQ ID NO: 412638 - RNA, 64 nt, hsa; identical to SEQ ID NO: 308995

SEQ ID NO: 412639 - RNA, 64 nt, hsa; identical to SEQ ID NO: 308996

SEQ ID NO: 412640 - RNA, 64 nt, hsa; identical to SEQ ID NO: 308997

SEQ ID NO: 412641 - RNA, 64 nt, hsa; identical to SEQ ID NO: 308998

SEQ ID NO: 412642 - RNA, 64 nt, hsa; identical to SEQ ID NO: 308999

SEQ ID NO: 412643 - RNA, 64 nt, hsa; identical to SEQ ID NO: 309000

SEQ ID NO: 412644 - RNA, 64 nt, hsa; identical to SEQ ID NO: 309001

SEQ ID NO: 412645 - RNA, 64 nt, hsa; identical to SEQ ID NO: 309002

SEQ ID NO: 412646 - RNA, 64 nt, hsa; identical to SEQ ID NO: 309003

SEQ ID NO: 412647 - RNA, 64 nt, hsa; identical to SEQ ID NO: 309004

SEQ ID NO: 412648 - RNA, 64 nt, hsa; identical to SEQ ID NO: 309005

SEQ ID NO: 412649 - RNA, 64 nt, hsa; identical to SEQ ID NO: 309006

SEQ ID NO: 412650 - RNA, 64 nt, hsa; identical to SEQ ID NO: 309007

SEQ ID NO: 412651 - RNA, 64 nt, hsa; identical to SEQ ID NO: 309008

SEQ ID NO: 412652 - RNA, 64 nt, hsa; identical to SEQ ID NO: 309009

SEQ ID NO: 412653 - RNA, 64 nt, hsa; identical to SEQ ID NO: 309010

SEQ ID NO: 412654 - RNA, 64 nt, hsa; identical to SEQ ID NO: 309011

SEQ ID NO: 412655 - RNA, 64 nt, hsa; identical to SEQ ID NO: 309012

SEQ ID NO: 412656 - RNA, 64 nt, hsa; identical to SEQ ID NO: 309013

SEQ ID NO: 412657 - RNA, 64 nt, hsa; identical to SEQ ID NO: 309014

SEQ ID NO: 412658 - RNA, 64 nt, hsa; identical to SEQ ID NO: 309015

SEQ ID NO: 412659 - RNA, 64 nt, hsa; identical to SEQ ID NO: 309016

SEQ ID NO: 412660 - RNA, 64 nt, hsa; identical to SEQ ID NO: 309017

SEQ ID NO: 412661 - RNA, 64 nt, hsa; identical to SEQ ID NO: 309018

SEQ ID NO: 412662 - RNA, 64 nt, hsa; identical to SEQ ID NO: 309019

SEQ ID NO: 412663 - RNA, 64 nt, hsa; identical to SEQ ID NO: 309020

SEQ ID NO: 412664 - RNA, 64 nt, hsa; identical to SEQ ID NO: 309021

SEQ ID NO: 412665 - RNA, 64 nt, hsa; identical to SEQ ID NO: 309022

SEQ ID NO: 412666 - RNA, 64 nt, hsa; identical to SEQ ID NO: 309023

SEQ ID NO: 412667 - RNA, 64 nt, hsa; identical to SEQ ID NO: 309024

SEQ ID NO: 412668 - RNA, 64 nt, hsa; identical to SEQ ID NO: 309025

SEQ ID NO: 412669 - RNA, 64 nt, hsa; identical to SEQ ID NO: 309026

SEQ ID NO: 412670 - RNA, 64 nt, hsa; identical to SEQ ID NO: 309027

SEQ ID NO: 412671 - RNA, 64 nt, hsa; identical to SEQ ID NO: 309028

SEQ ID NO: 412672 - RNA, 64 nt, hsa; identical to SEQ ID NO: 309029

SEQ ID NO: 412673 - RNA, 64 nt, hsa; identical to SEQ ID NO: 309030

SEQ ID NO: 412674 - RNA, 64 nt, hsa; identical to SEQ ID NO: 309031

SEQ ID NO: 412675 - RNA, 64 nt, hsa; identical to SEQ ID NO: 309032

SEQ ID NO: 412676 - RNA, 64 nt, hsa; identical to SEQ ID NO: 309033

SEQ ID NO: 412677 - RNA, 64 nt, hsa; identical to SEQ ID NO: 309034

SEQ ID NO: 412678 - RNA, 64 nt, hsa; identical to SEQ ID NO: 309035

SEQ ID NO: 412679 - RNA, 64 nt, hsa; identical to SEQ ID NO: 309036

SEQ ID NO: 412680 - RNA, 64 nt, hsa; identical to SEQ ID NO: 309037

SEQ ID NO: 412681 - RNA, 64 nt, hsa; identical to SEQ ID NO: 309038

SEQ ID NO: 412682 - RNA, 64 nt, hsa; identical to SEQ ID NO: 309039

SEQ ID NO: 412683 - RNA, 64 nt, hsa; identical to SEQ ID NO: 309040

SEQ ID NO: 412684 - RNA, 64 nt, hsa; identical to SEQ ID NO: 309041

SEQ ID NO: 412685 - RNA, 64 nt, hsa; identical to SEQ ID NO: 309042

SEQ ID NO: 412686 - RNA, 64 nt, hsa; identical to SEQ ID NO: 309043

SEQ ID NO: 412687 - RNA, 64 nt, hsa; identical to SEQ ID NO: 309044

SEQ ID NO: 412688 - RNA, 64 nt, hsa; identical to SEQ ID NO: 309045

SEQ ID NO: 412689 - RNA, 64 nt, hsa; identical to SEQ ID NO: 309046

SEQ ID NO: 412690 - RNA, 64 nt, hsa; identical to SEQ ID NO: 309047

SEQ ID NO: 412691 - RNA, 64 nt, hsa; identical to SEQ ID NO: 309048

SEQ ID NO: 412692 - RNA, 64 nt, hsa; identical to SEQ ID NO: 309049

SEQ ID NO: 412693 - RNA, 64 nt, hsa; identical to SEQ ID NO: 309050

SEQ ID NO: 412694 - RNA, 64 nt, hsa; identical to SEQ ID NO: 309051

SEQ ID NO: 412695 - RNA, 64 nt, hsa; identical to SEQ ID NO: 309052

SEQ ID NO: 412696 - RNA, 64 nt, hsa; identical to SEQ ID NO: 309053

SEQ ID NO: 412697 - RNA, 64 nt, hsa; identical to SEQ ID NO: 309054

SEQ ID NO: 412698 - RNA, 64 nt, hsa; identical to SEQ ID NO: 309055

SEQ ID NO: 412699 - RNA, 64 nt, hsa; identical to SEQ ID NO: 309056

SEQ ID NO: 412700 - RNA, 64 nt, hsa; identical to SEQ ID NO: 309057

SEQ ID NO: 412701 - RNA, 64 nt, hsa; identical to SEQ ID NO: 309058

SEQ ID NO: 412702 - RNA, 64 nt, hsa; identical to SEQ ID NO: 309059

SEQ ID NO: 412703 - RNA, 64 nt, hsa; identical to SEQ ID NO: 309060

SEQ ID NO: 412704 - RNA, 64 nt, hsa; identical to SEQ ID NO: 309061

SEQ ID NO: 412705 - RNA, 64 nt, hsa; identical to SEQ ID NO: 309062

SEQ ID NO: 412706 - RNA, 64 nt, hsa; identical to SEQ ID NO: 309063

SEQ ID NO: 412707 - RNA, 64 nt, hsa; identical to SEQ ID NO: 309064

SEQ ID NO: 412708 - RNA, 64 nt, hsa; identical to SEQ ID NO: 309065

SEQ ID NO: 412709 - RNA, 64 nt, hsa; identical to SEQ ID NO: 309066

SEQ ID NO: 412710 - RNA, 64 nt, hsa; identical to SEQ ID NO: 309067

SEQ ID NO: 412711 - RNA, 64 nt, hsa; identical to SEQ ID NO: 309068

SEQ ID NO: 412712 - RNA, 64 nt, hsa; identical to SEQ ID NO: 309069

SEQ ID NO: 412713 - RNA, 64 nt, hsa; identical to SEQ ID NO: 309070

SEQ ID NO: 412714 - RNA, 64 nt, hsa; identical to SEQ ID NO: 309071

SEQ ID NO: 412715 - RNA, 64 nt, hsa; identical to SEQ ID NO: 309072

SEQ ID NO: 412716 - RNA, 64 nt, hsa; identical to SEQ ID NO: 309073

SEQ ID NO: 412717 - RNA, 64 nt, hsa; identical to SEQ ID NO: 309074

SEQ ID NO: 412718 - RNA, 64 nt, hsa; identical to SEQ ID NO: 309075

SEQ ID NO: 412719 - RNA, 64 nt, hsa; identical to SEQ ID NO: 309076

SEQ ID NO: 412720 - RNA, 64 nt, hsa; identical to SEQ ID NO: 309077

SEQ ID NO: 412721 - RNA, 64 nt, hsa; identical to SEQ ID NO: 309078

SEQ ID NO: 412722 - RNA, 64 nt, hsa; identical to SEQ ID NO: 309079

SEQ ID NO: 412723 - RNA, 64 nt, hsa; identical to SEQ ID NO: 309080

SEQ ID NO: 412724 - RNA, 64 nt, hsa; identical to SEQ ID NO: 309081

SEQ ID NO: 412725 - RNA, 64 nt, hsa; identical to SEQ ID NO: 309082

SEQ ID NO: 412726 - RNA, 64 nt, hsa; identical to SEQ ID NO: 309083

SEQ ID NO: 412727 - RNA, 64 nt, hsa; identical to SEQ ID NO: 309084

SEQ ID NO: 412728 - RNA, 64 nt, hsa; identical to SEQ ID NO: 309085

SEQ ID NO: 412729 - RNA, 64 nt, hsa; identical to SEQ ID NO: 309086

SEQ ID NO: 412730 - RNA, 64 nt, hsa; identical to SEQ ID NO: 309087

SEQ ID NO: 412731 - RNA, 64 nt, hsa; identical to SEQ ID NO: 309088

SEQ ID NO: 412732 - RNA, 64 nt, hsa; identical to SEQ ID NO: 309089

SEQ ID NO: 412733 - RNA, 64 nt, hsa; identical to SEQ ID NO: 309090

SEQ ID NO: 412734 - RNA, 64 nt, hsa; identical to SEQ ID NO: 309091

SEQ ID NO: 412735 - RNA, 64 nt, hsa; identical to SEQ ID NO: 309092

SEQ ID NO: 412736 - RNA, 64 nt, hsa; identical to SEQ ID NO: 309093

SEQ ID NO: 412737 - RNA, 64 nt, hsa; identical to SEQ ID NO: 309094

SEQ ID NO: 412738 - RNA, 64 nt, hsa; identical to SEQ ID NO: 309095

SEQ ID NO: 412739 - RNA, 64 nt, hsa; identical to SEQ ID NO: 309096

SEQ ID NO: 412740 - RNA, 64 nt, hsa; identical to SEQ ID NO: 309097

SEQ ID NO: 412741 - RNA, 64 nt, hsa; identical to SEQ ID NO: 309098

SEQ ID NO: 412742 - RNA, 64 nt, hsa; identical to SEQ ID NO: 309099

SEQ ID NO: 412743 - RNA, 64 nt, hsa; identical to SEQ ID NO: 309100

SEQ ID NO: 412744 - RNA, 64 nt, hsa; identical to SEQ ID NO: 309101

SEQ ID NO: 412745 - RNA, 64 nt, hsa; identical to SEQ ID NO: 309102

SEQ ID NO: 412746 - RNA, 64 nt, hsa; identical to SEQ ID NO: 309103

SEQ ID NO: 412747 - RNA, 64 nt, hsa; identical to SEQ ID NO: 309104

SEQ ID NO: 412748 - RNA, 64 nt, hsa; identical to SEQ ID NO: 309105

SEQ ID NO: 412749 - RNA, 64 nt, hsa; identical to SEQ ID NO: 309106

SEQ ID NO: 412750 - RNA, 64 nt, hsa; identical to SEQ ID NO: 309107

SEQ ID NO: 412751 - RNA, 64 nt, hsa; identical to SEQ ID NO: 309108

SEQ ID NO: 412752 - RNA, 64 nt, hsa; identical to SEQ ID NO: 309109

SEQ ID NO: 412753 - RNA, 64 nt, hsa; identical to SEQ ID NO: 309110

SEQ ID NO: 412754 - RNA, 64 nt, hsa; identical to SEQ ID NO: 309111

SEQ ID NO: 412755 - RNA, 64 nt, hsa; identical to SEQ ID NO: 309112

SEQ ID NO: 412756 - RNA, 64 nt, hsa; identical to SEQ ID NO: 309113

SEQ ID NO: 412757 - RNA, 64 nt, hsa; identical to SEQ ID NO: 309114

SEQ ID NO: 412758 - RNA, 64 nt, hsa; identical to SEQ ID NO: 309115

SEQ ID NO: 412759 - RNA, 64 nt, hsa; identical to SEQ ID NO: 309116

SEQ ID NO: 412760 - RNA, 64 nt, hsa; identical to SEQ ID NO: 309117

SEQ ID NO: 412761 - RNA, 64 nt, hsa; identical to SEQ ID NO: 309118

SEQ ID NO: 412762 - RNA, 64 nt, hsa; identical to SEQ ID NO: 309119

SEQ ID NO: 412763 - RNA, 64 nt, hsa; identical to SEQ ID NO: 309120

SEQ ID NO: 412764 - RNA, 64 nt, hsa; identical to SEQ ID NO: 309121

SEQ ID NO: 412765 - RNA, 64 nt, hsa; identical to SEQ ID NO: 309122

SEQ ID NO: 412766 - RNA, 64 nt, hsa; identical to SEQ ID NO: 309123

SEQ ID NO: 412767 - RNA, 64 nt, hsa; identical to SEQ ID NO: 309124

SEQ ID NO: 412768 - RNA, 53 nt, hsa; identical to SEQ ID NO: 309125

SEQ ID NO: 412769 - RNA, 64 nt, hsa; identical to SEQ ID NO: 309126

SEQ ID NO: 412770 - RNA, 64 nt, hsa; identical to SEQ ID NO: 309127

SEQ ID NO: 412771 - RNA, 64 nt, hsa; identical to SEQ ID NO: 309128

SEQ ID NO: 412772 - RNA, 64 nt, hsa; identical to SEQ ID NO: 309129

SEQ ID NO: 412773 - RNA, 64 nt, hsa; identical to SEQ ID NO: 309130

SEQ ID NO: 412774 - RNA, 64 nt, hsa; identical to SEQ ID NO: 309131

SEQ ID NO: 412775 - RNA, 64 nt, hsa; identical to SEQ ID NO: 309132

SEQ ID NO: 412776 - RNA, 64 nt, hsa; identical to SEQ ID NO: 309133

SEQ ID NO: 412777 - RNA, 64 nt, hsa; identical to SEQ ID NO: 309134

SEQ ID NO: 412778 - RNA, 64 nt, hsa; identical to SEQ ID NO: 309135

SEQ ID NO: 412779 - RNA, 64 nt, hsa; identical to SEQ ID NO: 309136

SEQ ID NO: 412780 - RNA, 64 nt, hsa; identical to SEQ ID NO: 309137

SEQ ID NO: 412781 - RNA, 64 nt, hsa; identical to SEQ ID NO: 309138

SEQ ID NO: 412782 - RNA, 64 nt, hsa; identical to SEQ ID NO: 309139

SEQ ID NO: 412783 - RNA, 64 nt, hsa; identical to SEQ ID NO: 309140

SEQ ID NO: 412784 - RNA, 64 nt, hsa; identical to SEQ ID NO: 309141

SEQ ID NO: 412785 - RNA, 64 nt, hsa; identical to SEQ ID NO: 309142

SEQ ID NO: 412786 - RNA, 64 nt, hsa; identical to SEQ ID NO: 309143

SEQ ID NO: 412787 - RNA, 64 nt, hsa; identical to SEQ ID NO: 309144

SEQ ID NO: 412788 - RNA, 64 nt, hsa; identical to SEQ ID NO: 309145

SEQ ID NO: 412789 - RNA, 64 nt, hsa; identical to SEQ ID NO: 309146

SEQ ID NO: 412790 - RNA, 64 nt, hsa; identical to SEQ ID NO: 309147

SEQ ID NO: 412791 - RNA, 64 nt, hsa; identical to SEQ ID NO: 309148

SEQ ID NO: 412792 - RNA, 64 nt, hsa; identical to SEQ ID NO: 309149

SEQ ID NO: 412793 - RNA, 64 nt, hsa; identical to SEQ ID NO: 309150

SEQ ID NO: 412794 - RNA, 64 nt, hsa; identical to SEQ ID NO: 309151

SEQ ID NO: 412795 - RNA, 64 nt, hsa; identical to SEQ ID NO: 309152

SEQ ID NO: 412796 - RNA, 64 nt, hsa; identical to SEQ ID NO: 236580

SEQ ID NO: 412797 - RNA, 64 nt, hsa; identical to SEQ ID NO: 236581

SEQ ID NO: 412798 - RNA, 64 nt, hsa; identical to SEQ ID NO: 236582

SEQ ID NO: 412799 - RNA, 64 nt, hsa; identical to SEQ ID NO: 236583

SEQ ID NO: 412800 - RNA, 64 nt, hsa; identical to SEQ ID NO: 236584

SEQ ID NO: 412801 - RNA, 64 nt, hsa; identical to SEQ ID NO: 236585

SEQ ID NO: 412802 - RNA, 64 nt, hsa; identical to SEQ ID NO: 236586

SEQ ID NO: 412803 - RNA, 64 nt, hsa; identical to SEQ ID NO: 236587

SEQ ID NO: 412804 - RNA, 64 nt, hsa; identical to SEQ ID NO: 236588

SEQ ID NO: 412805 - RNA, 64 nt, hsa; identical to SEQ ID NO: 236589

SEQ ID NO: 412806 - RNA, 64 nt, hsa; identical to SEQ ID NO: 236590

SEQ ID NO: 412807 - RNA, 64 nt, hsa; identical to SEQ ID NO: 236591

SEQ ID NO: 412808 - RNA, 64 nt, hsa; identical to SEQ ID NO: 236592

SEQ ID NO: 412809 - RNA, 64 nt, hsa; identical to SEQ ID NO: 236593

SEQ ID NO: 412810 - RNA, 64 nt, hsa; identical to SEQ ID NO: 236594

SEQ ID NO: 412811 - RNA, 64 nt, hsa; identical to SEQ ID NO: 236595

SEQ ID NO: 412812 - RNA, 64 nt, hsa; identical to SEQ ID NO: 236596

SEQ ID NO: 412813 - RNA, 64 nt, hsa; identical to SEQ ID NO: 236597

SEQ ID NO: 412814 - RNA, 64 nt, hsa; identical to SEQ ID NO: 236598

SEQ ID NO: 412815 - RNA, 64 nt, hsa; identical to SEQ ID NO: 236599

SEQ ID NO: 412816 - RNA, 64 nt, hsa; identical to SEQ ID NO: 236600

SEQ ID NO: 412817 - RNA, 64 nt, hsa; identical to SEQ ID NO: 236601

SEQ ID NO: 412818 - RNA, 64 nt, hsa; identical to SEQ ID NO: 236602

SEQ ID NO: 412819 - RNA, 64 nt, hsa; identical to SEQ ID NO: 236603

SEQ ID NO: 412820 - RNA, 64 nt, hsa; identical to SEQ ID NO: 236604

SEQ ID NO: 412821 - RNA, 64 nt, hsa; identical to SEQ ID NO: 236605

SEQ ID NO: 412822 - RNA, 64 nt, hsa; identical to SEQ ID NO: 236606

SEQ ID NO: 412823 - RNA, 64 nt, hsa; identical to SEQ ID NO: 236607

SEQ ID NO: 412824 - RNA, 64 nt, hsa; identical to SEQ ID NO: 236608

SEQ ID NO: 412825 - RNA, 64 nt, hsa; identical to SEQ ID NO: 236609

SEQ ID NO: 412826 - RNA, 64 nt, hsa; identical to SEQ ID NO: 236610

SEQ ID NO: 412827 - RNA, 64 nt, hsa; identical to SEQ ID NO: 236611

SEQ ID NO: 412828 - RNA, 64 nt, hsa; identical to SEQ ID NO: 236612

SEQ ID NO: 412829 - RNA, 64 nt, hsa; identical to SEQ ID NO: 236613

SEQ ID NO: 412830 - RNA, 64 nt, hsa; identical to SEQ ID NO: 236614

SEQ ID NO: 412831 - RNA, 64 nt, hsa; identical to SEQ ID NO: 236615

SEQ ID NO: 412832 - RNA, 64 nt, hsa; identical to SEQ ID NO: 236616

SEQ ID NO: 412833 - RNA, 64 nt, hsa; identical to SEQ ID NO: 236617

SEQ ID NO: 412834 - RNA, 64 nt, hsa; identical to SEQ ID NO: 236618

SEQ ID NO: 412835 - RNA, 64 nt, hsa; identical to SEQ ID NO: 236619

SEQ ID NO: 412836 - RNA, 64 nt, hsa; identical to SEQ ID NO: 303529

SEQ ID NO: 412837 - RNA, 64 nt, hsa; identical to SEQ ID NO: 303530

SEQ ID NO: 412838 - RNA, 64 nt, hsa; identical to SEQ ID NO: 303531

SEQ ID NO: 412839 - RNA, 64 nt, hsa; identical to SEQ ID NO: 303532

SEQ ID NO: 412840 - RNA, 64 nt, hsa; identical to SEQ ID NO: 303533

SEQ ID NO: 412841 - RNA, 64 nt, hsa; identical to SEQ ID NO: 303534

SEQ ID NO: 412842 - RNA, 64 nt, hsa; identical to SEQ ID NO: 303535

SEQ ID NO: 412843 - RNA, 64 nt, hsa; identical to SEQ ID NO: 303536

SEQ ID NO: 412844 - RNA, 64 nt, hsa; identical to SEQ ID NO: 303537

SEQ ID NO: 412845 - RNA, 64 nt, hsa; identical to SEQ ID NO: 303538

SEQ ID NO: 412846 - RNA, 64 nt, hsa
aucaauuccucccauuucaauucaguuaagacuucugugauagauguuuauagcagagaagaaa

SEQ ID NO: 412847 - RNA, 64 nt, hsa
guguuuaccuguuuuaaaaugauaauguuggcaucugugauaaacuaucaaugaggcucccauc

SEQ ID NO: 412848 - RNA, 64 nt, hsa
gugauauaauccauuuauaucacaacucaaaggacugugauauaauccauuuauaucacagcuc

SEQ ID NO: 412849 - RNA, 64 nt, hsa
accauuaaauacauuuacaucacagcucaaaggacugugauauaauccauuuauaucacaacuc

SEQ ID NO: 412850 - RNA, 64 nt, hsa
uucauauuuuucucuuauaaaaauguauuugauacugugauauguucacgaaaaguauucuuua

SEQ ID NO: 412851 - RNA, 64 nt, hsa
aaggucuaaauaaagagcaguuucccauauuuggcugugauaccuuuauccucauuaucuacaa

SEQ ID NO: 412852 - RNA, 64 nt, hsa
auuuccuuuuugcacacauuacaggugguguguucugugauaaugaaaagcaucagaaaagcuu

SEQ ID NO: 412853 - RNA, 64 nt, hsa
caagcaguuccucauucacaucaacagagcgaggcugugauaacuuaggaggcagcaauccuaa

SEQ ID NO: 412854 - RNA, 64 nt, hsa
ggacacuucaucuuacuuaagucauaguuaagaucugugauacgaaccauagauauugccugac

SEQ ID NO: 412855 - RNA, 64 nt, hsa
gacagcuuuucuacuuuuccugaaaauuuuaagacugugauaucugucauuuuacuguauagcu

SEQ ID NO: 412856 - RNA, 64 nt, hsa; identical to SEQ ID NO: 87480

SEQ ID NO: 412857 - RNA, 64 nt, hsa; identical to SEQ ID NO: 87481

SEQ ID NO: 412858 - RNA, 64 nt, hsa; identical to SEQ ID NO: 87482

SEQ ID NO: 412859 - RNA, 64 nt, hsa; identical to SEQ ID NO: 87483

SEQ ID NO: 412860 - RNA, 64 nt, hsa; identical to SEQ ID NO: 87484

SEQ ID NO: 412861 - RNA, 64 nt, hsa; identical to SEQ ID NO: 87485

SEQ ID NO: 412862 - RNA, 64 nt, hsa; identical to SEQ ID NO: 87486

SEQ ID NO: 412863 - RNA, 64 nt, hsa; identical to SEQ ID NO: 87487

SEQ ID NO: 412864 - RNA, 64 nt, hsa; identical to SEQ ID NO: 87488

SEQ ID NO: 412865 - RNA, 64 nt, hsa; identical to SEQ ID NO: 87489

SEQ ID NO: 412866 - RNA, 64 nt, hsa; identical to SEQ ID NO: 87490

SEQ ID NO: 412867 - RNA, 64 nt, hsa; identical to SEQ ID NO: 87491

SEQ ID NO: 412868 - RNA, 64 nt, hsa; identical to SEQ ID NO: 87492

SEQ ID NO: 412869 - RNA, 64 nt, hsa; identical to SEQ ID NO: 87493

SEQ ID NO: 412870 - RNA, 64 nt, hsa; identical to SEQ ID NO: 87494

SEQ ID NO: 412871 - RNA, 64 nt, hsa; identical to SEQ ID NO: 87495

SEQ ID NO: 412872 - RNA, 64 nt, hsa; identical to SEQ ID NO: 87496

SEQ ID NO: 412873 - RNA, 64 nt, hsa; identical to SEQ ID NO: 87497

SEQ ID NO: 412874 - RNA, 64 nt, hsa; identical to SEQ ID NO: 87498

SEQ ID NO: 412875 - RNA, 64 nt, hsa; identical to SEQ ID NO: 87499

SEQ ID NO: 412876 - RNA, 64 nt, hsa; identical to SEQ ID NO: 87500

SEQ ID NO: 412877 - RNA, 64 nt, hsa; identical to SEQ ID NO: 87501

SEQ ID NO: 412878 - RNA, 64 nt, hsa; identical to SEQ ID NO: 87502

SEQ ID NO: 412879 - RNA, 64 nt, hsa; identical to SEQ ID NO: 87503

SEQ ID NO: 412880 - RNA, 64 nt, hsa; identical to SEQ ID NO: 87504

SEQ ID NO: 412881 - RNA, 64 nt, hsa; identical to SEQ ID NO: 87505

SEQ ID NO: 412882 - RNA, 64 nt, hsa; identical to SEQ ID NO: 87506

SEQ ID NO: 412883 - RNA, 64 nt, hsa; identical to SEQ ID NO: 87507

SEQ ID NO: 412884 - RNA, 64 nt, hsa; identical to SEQ ID NO: 87508

SEQ ID NO: 412885 - RNA, 64 nt, hsa; identical to SEQ ID NO: 87509

SEQ ID NO: 412886 - RNA, 64 nt, hsa; identical to SEQ ID NO: 87510

SEQ ID NO: 412887 - RNA, 64 nt, hsa; identical to SEQ ID NO: 87511

SEQ ID NO: 412888 - RNA, 64 nt, hsa; identical to SEQ ID NO: 87512

SEQ ID NO: 412889 - RNA, 64 nt, hsa; identical to SEQ ID NO: 87513

SEQ ID NO: 412890 - RNA, 64 nt, hsa; identical to SEQ ID NO: 87514

SEQ ID NO: 412891 - RNA, 64 nt, hsa; identical to SEQ ID NO: 87515

SEQ ID NO: 412892 - RNA, 64 nt, hsa; identical to SEQ ID NO: 87516

SEQ ID NO: 412893 - RNA, 64 nt, hsa; identical to SEQ ID NO: 87517

SEQ ID NO: 412894 - RNA, 64 nt, hsa; identical to SEQ ID NO: 87518

SEQ ID NO: 412895 - RNA, 64 nt, hsa; identical to SEQ ID NO: 87519

SEQ ID NO: 412896 - RNA, 64 nt, hsa; identical to SEQ ID NO: 87520

SEQ ID NO: 412897 - RNA, 64 nt, hsa; identical to SEQ ID NO: 87521

SEQ ID NO: 412898 - RNA, 64 nt, hsa; identical to SEQ ID NO: 87522

SEQ ID NO: 412899 - RNA, 64 nt, hsa; identical to SEQ ID NO: 87523

SEQ ID NO: 412900 - RNA, 64 nt, hsa; identical to SEQ ID NO: 87524

SEQ ID NO: 412901 - RNA, 64 nt, hsa; identical to SEQ ID NO: 87525

SEQ ID NO: 412902 - RNA, 64 nt, hsa; identical to SEQ ID NO: 87526

SEQ ID NO: 412903 - RNA, 64 nt, hsa; identical to SEQ ID NO: 87527

SEQ ID NO: 412904 - RNA, 64 nt, hsa; identical to SEQ ID NO: 87528

SEQ ID NO: 412905 - RNA, 64 nt, hsa; identical to SEQ ID NO: 87529

SEQ ID NO: 412906 - RNA, 64 nt, hsa; identical to SEQ ID NO: 87530

SEQ ID NO: 412907 - RNA, 64 nt, hsa; identical to SEQ ID NO: 87531

SEQ ID NO: 412908 - RNA, 64 nt, hsa; identical to SEQ ID NO: 87532

SEQ ID NO: 412909 - RNA, 64 nt, hsa; identical to SEQ ID NO: 87533

SEQ ID NO: 412910 - RNA, 64 nt, hsa; identical to SEQ ID NO: 87534

SEQ ID NO: 412911 - RNA, 64 nt, hsa; identical to SEQ ID NO: 87535

SEQ ID NO: 412912 - RNA, 64 nt, hsa; identical to SEQ ID NO: 87536

SEQ ID NO: 412913 - RNA, 64 nt, hsa; identical to SEQ ID NO: 133550

SEQ ID NO: 412914 - RNA, 64 nt, hsa; identical to SEQ ID NO: 133551

SEQ ID NO: 412915 - RNA, 64 nt, hsa; identical to SEQ ID NO: 133552

SEQ ID NO: 412916 - RNA, 64 nt, hsa; identical to SEQ ID NO: 133553

SEQ ID NO: 412917 - RNA, 64 nt, hsa; identical to SEQ ID NO: 133554

SEQ ID NO: 412918 - RNA, 64 nt, hsa; identical to SEQ ID NO: 133555

SEQ ID NO: 412919 - RNA, 64 nt, hsa; identical to SEQ ID NO: 133556

SEQ ID NO: 412920 - RNA, 64 nt, hsa; identical to SEQ ID NO: 133557

SEQ ID NO: 412921 - RNA, 64 nt, hsa; identical to SEQ ID NO: 133558

SEQ ID NO: 412922 - RNA, 64 nt, hsa; identical to SEQ ID NO: 133559

SEQ ID NO: 412923 - RNA, 64 nt, hsa; identical to SEQ ID NO: 133560

SEQ ID NO: 412924 - RNA, 64 nt, hsa; identical to SEQ ID NO: 133561

SEQ ID NO: 412925 - RNA, 64 nt, hsa; identical to SEQ ID NO: 133562

SEQ ID NO: 412926 - RNA, 64 nt, hsa; identical to SEQ ID NO: 133563

SEQ ID NO: 412927 - RNA, 64 nt, hsa; identical to SEQ ID NO: 133564

SEQ ID NO: 412928 - RNA, 64 nt, hsa; identical to SEQ ID NO: 133565

SEQ ID NO: 412929 - RNA, 64 nt, hsa; identical to SEQ ID NO: 133566

SEQ ID NO: 412930 - RNA, 64 nt, hsa; identical to SEQ ID NO: 133567

SEQ ID NO: 412931 - RNA, 64 nt, hsa; identical to SEQ ID NO: 133568

SEQ ID NO: 412932 - RNA, 64 nt, hsa; identical to SEQ ID NO: 133569

SEQ ID NO: 412933 - RNA, 64 nt, hsa; identical to SEQ ID NO: 133570

SEQ ID NO: 412934 - RNA, 64 nt, hsa; identical to SEQ ID NO: 133571

SEQ ID NO: 412935 - RNA, 64 nt, hsa; identical to SEQ ID NO: 133572

SEQ ID NO: 412936 - RNA, 64 nt, hsa; identical to SEQ ID NO: 133573

SEQ ID NO: 412937 - RNA, 64 nt, hsa; identical to SEQ ID NO: 133574

SEQ ID NO: 412938 - RNA, 64 nt, hsa; identical to SEQ ID NO: 133575

SEQ ID NO: 412939 - RNA, 64 nt, hsa; identical to SEQ ID NO: 133576

SEQ ID NO: 412940 - RNA, 64 nt, hsa; identical to SEQ ID NO: 133577

SEQ ID NO: 412941 - RNA, 64 nt, hsa; identical to SEQ ID NO: 133578

SEQ ID NO: 412942 - RNA, 64 nt, hsa; identical to SEQ ID NO: 133579

SEQ ID NO: 412943 - RNA, 64 nt, hsa; identical to SEQ ID NO: 133580

SEQ ID NO: 412944 - RNA, 64 nt, hsa; identical to SEQ ID NO: 133581

SEQ ID NO: 412945 - RNA, 64 nt, hsa; identical to SEQ ID NO: 133582

SEQ ID NO: 412946 - RNA, 64 nt, hsa; identical to SEQ ID NO: 133583

SEQ ID NO: 412947 - RNA, 64 nt, hsa; identical to SEQ ID NO: 133584

SEQ ID NO: 412948 - RNA, 64 nt, hsa; identical to SEQ ID NO: 133585

SEQ ID NO: 412949 - RNA, 64 nt, hsa; identical to SEQ ID NO: 133586

SEQ ID NO: 412950 - RNA, 64 nt, hsa; identical to SEQ ID NO: 133587

SEQ ID NO: 412951 - RNA, 64 nt, hsa; identical to SEQ ID NO: 133588

SEQ ID NO: 412952 - RNA, 64 nt, hsa; identical to SEQ ID NO: 133589

SEQ ID NO: 412953 - RNA, 64 nt, hsa; identical to SEQ ID NO: 133590

SEQ ID NO: 412954 - RNA, 64 nt, hsa; identical to SEQ ID NO: 133591

SEQ ID NO: 412955 - RNA, 64 nt, hsa; identical to SEQ ID NO: 133592

SEQ ID NO: 412956 - RNA, 64 nt, hsa; identical to SEQ ID NO: 133593

SEQ ID NO: 412957 - RNA, 64 nt, hsa; identical to SEQ ID NO: 133594

SEQ ID NO: 412958 - RNA, 64 nt, hsa; identical to SEQ ID NO: 133595

SEQ ID NO: 412959 - RNA, 64 nt, hsa; identical to SEQ ID NO: 133596

SEQ ID NO: 412960 - RNA, 64 nt, hsa; identical to SEQ ID NO: 133597

SEQ ID NO: 412961 - RNA, 64 nt, hsa; identical to SEQ ID NO: 133598

SEQ ID NO: 412962 - RNA, 64 nt, hsa; identical to SEQ ID NO: 133599

SEQ ID NO: 412963 - RNA, 64 nt, hsa; identical to SEQ ID NO: 133600

SEQ ID NO: 412964 - RNA, 64 nt, hsa; identical to SEQ ID NO: 133601

SEQ ID NO: 412965 - RNA, 64 nt, hsa; identical to SEQ ID NO: 133602

SEQ ID NO: 412966 - RNA, 64 nt, hsa; identical to SEQ ID NO: 133603

SEQ ID NO: 412967 - RNA, 64 nt, hsa; identical to SEQ ID NO: 133604

SEQ ID NO: 412968 - RNA, 64 nt, hsa; identical to SEQ ID NO: 133605

SEQ ID NO: 412969 - RNA, 64 nt, hsa; identical to SEQ ID NO: 133606

SEQ ID NO: 412970 - RNA, 64 nt, hsa; identical to SEQ ID NO: 133607

SEQ ID NO: 412971 - RNA, 64 nt, hsa; identical to SEQ ID NO: 133608

SEQ ID NO: 412972 - RNA, 64 nt, hsa; identical to SEQ ID NO: 133609

SEQ ID NO: 412973 - RNA, 64 nt, hsa; identical to SEQ ID NO: 133610

SEQ ID NO: 412974 - RNA, 52 nt, hsa; identical to SEQ ID NO: 133611

SEQ ID NO: 412975 - RNA, 55 nt, hsa; identical to SEQ ID NO: 133612

SEQ ID NO: 412976 - RNA, 64 nt, hsa; identical to SEQ ID NO: 133613

SEQ ID NO: 412977 - RNA, 64 nt, hsa; identical to SEQ ID NO: 133614

SEQ ID NO: 412978 - RNA, 64 nt, hsa; identical to SEQ ID NO: 133615

SEQ ID NO: 412979 - RNA, 64 nt, hsa; identical to SEQ ID NO: 133616

SEQ ID NO: 412980 - RNA, 64 nt, hsa; identical to SEQ ID NO: 133617

SEQ ID NO: 412981 - RNA, 64 nt, hsa; identical to SEQ ID NO: 133618

SEQ ID NO: 412982 - RNA, 64 nt, hsa; identical to SEQ ID NO: 133619

SEQ ID NO: 412983 - RNA, 64 nt, hsa; identical to SEQ ID NO: 133620

SEQ ID NO: 412984 - RNA, 64 nt, hsa; identical to SEQ ID NO: 133621

SEQ ID NO: 412985 - RNA, 64 nt, hsa; identical to SEQ ID NO: 133622

SEQ ID NO: 412986 - RNA, 64 nt, hsa; identical to SEQ ID NO: 133623

SEQ ID NO: 412987 - RNA, 64 nt, hsa; identical to SEQ ID NO: 133624

SEQ ID NO: 412988 - RNA, 64 nt, hsa; identical to SEQ ID NO: 133625

SEQ ID NO: 412989 - RNA, 64 nt, hsa; identical to SEQ ID NO: 133626

SEQ ID NO: 412990 - RNA, 64 nt, hsa; identical to SEQ ID NO: 133627

SEQ ID NO: 412991 - RNA, 64 nt, hsa; identical to SEQ ID NO: 133628

SEQ ID NO: 412992 - RNA, 64 nt, hsa; identical to SEQ ID NO: 133629

SEQ ID NO: 412993 - RNA, 64 nt, hsa; identical to SEQ ID NO: 133630

SEQ ID NO: 412994 - RNA, 64 nt, hsa; identical to SEQ ID NO: 133631

SEQ ID NO: 412995 - RNA, 64 nt, hsa; identical to SEQ ID NO: 133632

SEQ ID NO: 412996 - RNA, 64 nt, hsa; identical to SEQ ID NO: 133633

SEQ ID NO: 412997 - RNA, 64 nt, hsa; identical to SEQ ID NO: 133634

SEQ ID NO: 412998 - RNA, 64 nt, hsa; identical to SEQ ID NO: 133635

SEQ ID NO: 412999 - RNA, 64 nt, hsa; identical to SEQ ID NO: 133636

SEQ ID NO: 413000 - RNA, 64 nt, hsa; identical to SEQ ID NO: 133637

SEQ ID NO: 413001 - RNA, 64 nt, hsa; identical to SEQ ID NO: 133638

SEQ ID NO: 413002 - RNA, 63 nt, hsa; identical to SEQ ID NO: 133639

SEQ ID NO: 413003 - RNA, 51 nt, hsa; identical to SEQ ID NO: 133640

SEQ ID NO: 413004 - RNA, 64 nt, hsa; identical to SEQ ID NO: 133641

SEQ ID NO: 413005 - RNA, 64 nt, hsa; identical to SEQ ID NO: 133642

SEQ ID NO: 413006 - RNA, 64 nt, hsa; identical to SEQ ID NO: 133643

SEQ ID NO: 413007 - RNA, 64 nt, hsa; identical to SEQ ID NO: 133644

SEQ ID NO: 413008 - RNA, 64 nt, hsa; identical to SEQ ID NO: 133645

SEQ ID NO: 413009 - RNA, 64 nt, hsa; identical to SEQ ID NO: 133646

SEQ ID NO: 413010 - RNA, 64 nt, hsa; identical to SEQ ID NO: 133647

SEQ ID NO: 413011 - RNA, 64 nt, hsa; identical to SEQ ID NO: 133648

SEQ ID NO: 413012 - RNA, 64 nt, hsa; identical to SEQ ID NO: 133649

SEQ ID NO: 413013 - RNA, 64 nt, hsa; identical to SEQ ID NO: 133650

SEQ ID NO: 413014 - RNA, 64 nt, hsa; identical to SEQ ID NO: 133651

SEQ ID NO: 413015 - RNA, 64 nt, hsa; identical to SEQ ID NO: 133652

SEQ ID NO: 413016 - RNA, 64 nt, hsa; identical to SEQ ID NO: 133653

SEQ ID NO: 413017 - RNA, 64 nt, hsa; identical to SEQ ID NO: 133654

SEQ ID NO: 413018 - RNA, 64 nt, hsa; identical to SEQ ID NO: 133655

SEQ ID NO: 413019 - RNA, 64 nt, hsa; identical to SEQ ID NO: 133656

SEQ ID NO: 413020 - RNA, 64 nt, hsa; identical to SEQ ID NO: 133657

SEQ ID NO: 413021 - RNA, 64 nt, hsa; identical to SEQ ID NO: 133658

SEQ ID NO: 413022 - RNA, 64 nt, hsa; identical to SEQ ID NO: 133659

SEQ ID NO: 413023 - RNA, 64 nt, hsa; identical to SEQ ID NO: 133660

SEQ ID NO: 413024 - RNA, 64 nt, hsa; identical to SEQ ID NO: 133661

SEQ ID NO: 413025 - RNA, 64 nt, hsa; identical to SEQ ID NO: 133662

SEQ ID NO: 413026 - RNA, 64 nt, hsa; identical to SEQ ID NO: 133663

SEQ ID NO: 413027 - RNA, 64 nt, hsa; identical to SEQ ID NO: 133664

SEQ ID NO: 413028 - RNA, 64 nt, hsa; identical to SEQ ID NO: 133665

SEQ ID NO: 413029 - RNA, 64 nt, hsa; identical to SEQ ID NO: 133666

SEQ ID NO: 413030 - RNA, 64 nt, hsa; identical to SEQ ID NO: 133667

SEQ ID NO: 413031 - RNA, 64 nt, hsa; identical to SEQ ID NO: 133668

SEQ ID NO: 413032 - RNA, 64 nt, hsa; identical to SEQ ID NO: 133669

SEQ ID NO: 413033 - RNA, 64 nt, hsa; identical to SEQ ID NO: 133670

SEQ ID NO: 413034 - RNA, 64 nt, hsa; identical to SEQ ID NO: 133671

SEQ ID NO: 413035 - RNA, 64 nt, hsa; identical to SEQ ID NO: 133672

SEQ ID NO: 413036 - RNA, 64 nt, hsa; identical to SEQ ID NO: 133673

SEQ ID NO: 413037 - RNA, 64 nt, hsa; identical to SEQ ID NO: 133674

SEQ ID NO: 413038 - RNA, 64 nt, hsa; identical to SEQ ID NO: 133675

SEQ ID NO: 413039 - RNA, 64 nt, hsa; identical to SEQ ID NO: 133676

SEQ ID NO: 413040 - RNA, 50 nt, hsa; identical to SEQ ID NO: 133677

SEQ ID NO: 413041 - RNA, 64 nt, hsa; identical to SEQ ID NO: 133678

SEQ ID NO: 413042 - RNA, 64 nt, hsa; identical to SEQ ID NO: 133679

SEQ ID NO: 413043 - RNA, 64 nt, hsa; identical to SEQ ID NO: 133680

SEQ ID NO: 413044 - RNA, 64 nt, hsa; identical to SEQ ID NO: 133681

SEQ ID NO: 413045 - RNA, 64 nt, hsa; identical to SEQ ID NO: 133682

SEQ ID NO: 413046 - RNA, 64 nt, hsa; identical to SEQ ID NO: 133683

SEQ ID NO: 413047 - RNA, 64 nt, hsa; identical to SEQ ID NO: 133684

SEQ ID NO: 413048 - RNA, 64 nt, hsa; identical to SEQ ID NO: 133685

SEQ ID NO: 413049 - RNA, 64 nt, hsa; identical to SEQ ID NO: 133686

SEQ ID NO: 413050 - RNA, 64 nt, hsa; identical to SEQ ID NO: 133687

SEQ ID NO: 413051 - RNA, 64 nt, hsa; identical to SEQ ID NO: 133688

SEQ ID NO: 413052 - RNA, 64 nt, hsa; identical to SEQ ID NO: 133689

SEQ ID NO: 413053 - RNA, 64 nt, hsa; identical to SEQ ID NO: 133690

SEQ ID NO: 413054 - RNA, 64 nt, hsa; identical to SEQ ID NO: 133691

SEQ ID NO: 413055 - RNA, 64 nt, hsa; identical to SEQ ID NO: 133692

SEQ ID NO: 413056 - RNA, 64 nt, hsa; identical to SEQ ID NO: 133693

SEQ ID NO: 413057 - RNA, 64 nt, hsa; identical to SEQ ID NO: 133694

SEQ ID NO: 413058 - RNA, 64 nt, hsa; identical to SEQ ID NO: 133695

SEQ ID NO: 413059 - RNA, 64 nt, hsa; identical to SEQ ID NO: 133696

SEQ ID NO: 413060 - RNA, 64 nt, hsa; identical to SEQ ID NO: 133697

SEQ ID NO: 413061 - RNA, 64 nt, hsa; identical to SEQ ID NO: 133698

SEQ ID NO: 413062 - RNA, 64 nt, hsa; identical to SEQ ID NO: 133699

SEQ ID NO: 413063 - RNA, 64 nt, hsa; identical to SEQ ID NO: 133700

SEQ ID NO: 413064 - RNA, 64 nt, hsa; identical to SEQ ID NO: 133701

SEQ ID NO: 413065 - RNA, 64 nt, hsa; identical to SEQ ID NO: 133702

SEQ ID NO: 413066 - RNA, 64 nt, hsa; identical to SEQ ID NO: 133703

SEQ ID NO: 413067 - RNA, 64 nt, hsa; identical to SEQ ID NO: 133704

SEQ ID NO: 413068 - RNA, 64 nt, hsa; identical to SEQ ID NO: 133705

SEQ ID NO: 413069 - RNA, 64 nt, hsa; identical to SEQ ID NO: 133706

SEQ ID NO: 413070 - RNA, 64 nt, hsa; identical to SEQ ID NO: 133707

SEQ ID NO: 413071 - RNA, 64 nt, hsa; identical to SEQ ID NO: 133708

SEQ ID NO: 413072 - RNA, 64 nt, hsa; identical to SEQ ID NO: 133709

SEQ ID NO: 413073 - RNA, 64 nt, hsa; identical to SEQ ID NO: 133710

SEQ ID NO: 413074 - RNA, 64 nt, hsa; identical to SEQ ID NO: 133711

SEQ ID NO: 413075 - RNA, 64 nt, hsa; identical to SEQ ID NO: 133712

SEQ ID NO: 413076 - RNA, 64 nt, hsa; identical to SEQ ID NO: 133713

SEQ ID NO: 413077 - RNA, 64 nt, hsa; identical to SEQ ID NO: 133714

SEQ ID NO: 413078 - RNA, 64 nt, hsa; identical to SEQ ID NO: 133715

SEQ ID NO: 413079 - RNA, 64 nt, hsa; identical to SEQ ID NO: 133716

SEQ ID NO: 413080 - RNA, 64 nt, hsa; identical to SEQ ID NO: 133717

SEQ ID NO: 413081 - RNA, 64 nt, hsa; identical to SEQ ID NO: 133718

SEQ ID NO: 413082 - RNA, 64 nt, hsa; identical to SEQ ID NO: 133719

SEQ ID NO: 413083 - RNA, 64 nt, hsa; identical to SEQ ID NO: 133720

SEQ ID NO: 413084 - RNA, 64 nt, hsa; identical to SEQ ID NO: 133721

SEQ ID NO: 413085 - RNA, 64 nt, hsa; identical to SEQ ID NO: 133722

SEQ ID NO: 413086 - RNA, 64 nt, hsa; identical to SEQ ID NO: 133723

SEQ ID NO: 413087 - RNA, 64 nt, hsa; identical to SEQ ID NO: 133724

SEQ ID NO: 413088 - RNA, 64 nt, hsa; identical to SEQ ID NO: 133725

SEQ ID NO: 413089 - RNA, 64 nt, hsa; identical to SEQ ID NO: 133726

SEQ ID NO: 413090 - RNA, 64 nt, hsa; identical to SEQ ID NO: 133727

SEQ ID NO: 413091 - RNA, 64 nt, hsa; identical to SEQ ID NO: 133728

SEQ ID NO: 413092 - RNA, 64 nt, hsa; identical to SEQ ID NO: 133729

SEQ ID NO: 413093 - RNA, 64 nt, hsa; identical to SEQ ID NO: 133730

SEQ ID NO: 413094 - RNA, 64 nt, hsa; identical to SEQ ID NO: 133731

SEQ ID NO: 413095 - RNA, 64 nt, hsa; identical to SEQ ID NO: 133732

SEQ ID NO: 413096 - RNA, 64 nt, hsa; identical to SEQ ID NO: 133733

SEQ ID NO: 413097 - RNA, 64 nt, hsa; identical to SEQ ID NO: 133734

SEQ ID NO: 413098 - RNA, 64 nt, hsa; identical to SEQ ID NO: 133735

SEQ ID NO: 413099 - RNA, 64 nt, hsa; identical to SEQ ID NO: 133736

SEQ ID NO: 413100 - RNA, 64 nt, hsa; identical to SEQ ID NO: 133737

SEQ ID NO: 413101 - RNA, 64 nt, hsa; identical to SEQ ID NO: 133738

SEQ ID NO: 413102 - RNA, 64 nt, hsa; identical to SEQ ID NO: 133739

SEQ ID NO: 413103 - RNA, 64 nt, hsa; identical to SEQ ID NO: 133740

SEQ ID NO: 413104 - RNA, 64 nt, hsa; identical to SEQ ID NO: 133741

SEQ ID NO: 413105 - RNA, 64 nt, hsa; identical to SEQ ID NO: 133742

SEQ ID NO: 413106 - RNA, 64 nt, hsa; identical to SEQ ID NO: 133743

SEQ ID NO: 413107 - RNA, 64 nt, hsa; identical to SEQ ID NO: 133744

SEQ ID NO: 413108 - RNA, 64 nt, hsa; identical to SEQ ID NO: 133745

SEQ ID NO: 413109 - RNA, 64 nt, hsa; identical to SEQ ID NO: 133746

SEQ ID NO: 413110 - RNA, 64 nt, hsa; identical to SEQ ID NO: 133747

SEQ ID NO: 413111 - RNA, 64 nt, hsa; identical to SEQ ID NO: 133748

SEQ ID NO: 413112 - RNA, 64 nt, hsa; identical to SEQ ID NO: 133749

SEQ ID NO: 413113 - RNA, 64 nt, hsa; identical to SEQ ID NO: 133750

SEQ ID NO: 413114 - RNA, 64 nt, hsa; identical to SEQ ID NO: 133751

SEQ ID NO: 413115 - RNA, 64 nt, hsa; identical to SEQ ID NO: 133752

SEQ ID NO: 413116 - RNA, 64 nt, hsa; identical to SEQ ID NO: 133753

SEQ ID NO: 413117 - RNA, 64 nt, hsa; identical to SEQ ID NO: 133754

SEQ ID NO: 413118 - RNA, 64 nt, hsa; identical to SEQ ID NO: 133755

SEQ ID NO: 413119 - RNA, 64 nt, hsa; identical to SEQ ID NO: 133756

SEQ ID NO: 413120 - RNA, 64 nt, hsa; identical to SEQ ID NO: 133757

SEQ ID NO: 413121 - RNA, 64 nt, hsa; identical to SEQ ID NO: 133758

SEQ ID NO: 413122 - RNA, 64 nt, hsa; identical to SEQ ID NO: 133759

SEQ ID NO: 413123 - RNA, 64 nt, hsa; identical to SEQ ID NO: 133760

SEQ ID NO: 413124 - RNA, 64 nt, hsa; identical to SEQ ID NO: 133761

SEQ ID NO: 413125 - RNA, 64 nt, hsa; identical to SEQ ID NO: 133762

SEQ ID NO: 413126 - RNA, 64 nt, hsa; identical to SEQ ID NO: 133763

SEQ ID NO: 413127 - RNA, 64 nt, hsa; identical to SEQ ID NO: 133764

SEQ ID NO: 413128 - RNA, 64 nt, hsa; identical to SEQ ID NO: 133765

SEQ ID NO: 413129 - RNA, 60 nt, hsa; identical to SEQ ID NO: 133766

SEQ ID NO: 413130 - RNA, 57 nt, hsa; identical to SEQ ID NO: 133767

SEQ ID NO: 413131 - RNA, 64 nt, hsa; identical to SEQ ID NO: 133768

SEQ ID NO: 413132 - RNA, 64 nt, hsa; identical to SEQ ID NO: 133769

SEQ ID NO: 413133 - RNA, 64 nt, hsa; identical to SEQ ID NO: 133770

SEQ ID NO: 413134 - RNA, 64 nt, hsa; identical to SEQ ID NO: 133771

SEQ ID NO: 413135 - RNA, 64 nt, hsa; identical to SEQ ID NO: 133772

SEQ ID NO: 413136 - RNA, 64 nt, hsa; identical to SEQ ID NO: 133773

SEQ ID NO: 413137 - RNA, 64 nt, hsa; identical to SEQ ID NO: 133774

SEQ ID NO: 413138 - RNA, 64 nt, hsa; identical to SEQ ID NO: 133775

SEQ ID NO: 413139 - RNA, 64 nt, hsa; identical to SEQ ID NO: 133776

SEQ ID NO: 413140 - RNA, 64 nt, hsa; identical to SEQ ID NO: 133777

SEQ ID NO: 413141 - RNA, 64 nt, hsa; identical to SEQ ID NO: 133778

SEQ ID NO: 413142 - RNA, 64 nt, hsa; identical to SEQ ID NO: 133779

SEQ ID NO: 413143 - RNA, 64 nt, hsa; identical to SEQ ID NO: 133780

SEQ ID NO: 413144 - RNA, 64 nt, hsa; identical to SEQ ID NO: 133781

SEQ ID NO: 413145 - RNA, 64 nt, hsa; identical to SEQ ID NO: 133782

SEQ ID NO: 413146 - RNA, 64 nt, hsa; identical to SEQ ID NO: 133783

SEQ ID NO: 413147 - RNA, 64 nt, hsa; identical to SEQ ID NO: 133784

SEQ ID NO: 413148 - RNA, 64 nt, hsa; identical to SEQ ID NO: 133785

SEQ ID NO: 413149 - RNA, 64 nt, hsa; identical to SEQ ID NO: 133786

SEQ ID NO: 413150 - RNA, 64 nt, hsa; identical to SEQ ID NO: 133787

SEQ ID NO: 413151 - RNA, 64 nt, hsa; identical to SEQ ID NO: 133788

SEQ ID NO: 413152 - RNA, 64 nt, hsa; identical to SEQ ID NO: 133789

SEQ ID NO: 413153 - RNA, 64 nt, hsa; identical to SEQ ID NO: 133790

SEQ ID NO: 413154 - RNA, 64 nt, hsa; identical to SEQ ID NO: 133791

SEQ ID NO: 413155 - RNA, 64 nt, hsa; identical to SEQ ID NO: 133792

SEQ ID NO: 413156 - RNA, 64 nt, hsa; identical to SEQ ID NO: 133793

SEQ ID NO: 413157 - RNA, 64 nt, hsa; identical to SEQ ID NO: 133794

SEQ ID NO: 413158 - RNA, 64 nt, hsa; identical to SEQ ID NO: 133795

SEQ ID NO: 413159 - RNA, 64 nt, hsa; identical to SEQ ID NO: 133796

SEQ ID NO: 413160 - RNA, 64 nt, hsa; identical to SEQ ID NO: 133797

SEQ ID NO: 413161 - RNA, 64 nt, hsa; identical to SEQ ID NO: 133798

SEQ ID NO: 413162 - RNA, 64 nt, hsa; identical to SEQ ID NO: 133799

SEQ ID NO: 413163 - RNA, 64 nt, hsa; identical to SEQ ID NO: 133800

SEQ ID NO: 413164 - RNA, 64 nt, hsa; identical to SEQ ID NO: 133801

SEQ ID NO: 413165 - RNA, 64 nt, hsa; identical to SEQ ID NO: 133802

SEQ ID NO: 413166 - RNA, 64 nt, hsa; identical to SEQ ID NO: 133803

SEQ ID NO: 413167 - RNA, 64 nt, hsa; identical to SEQ ID NO: 133804

SEQ ID NO: 413168 - RNA, 64 nt, hsa; identical to SEQ ID NO: 133805

SEQ ID NO: 413169 - RNA, 64 nt, hsa; identical to SEQ ID NO: 133806

SEQ ID NO: 413170 - RNA, 64 nt, hsa; identical to SEQ ID NO: 133807

SEQ ID NO: 413171 - RNA, 64 nt, hsa; identical to SEQ ID NO: 133808

SEQ ID NO: 413172 - RNA, 64 nt, hsa; identical to SEQ ID NO: 133809

SEQ ID NO: 413173 - RNA, 64 nt, hsa; identical to SEQ ID NO: 133810

SEQ ID NO: 413174 - RNA, 64 nt, hsa; identical to SEQ ID NO: 133811

SEQ ID NO: 413175 - RNA, 64 nt, hsa; identical to SEQ ID NO: 133812

SEQ ID NO: 413176 - RNA, 64 nt, hsa; identical to SEQ ID NO: 133813

SEQ ID NO: 413177 - RNA, 64 nt, hsa; identical to SEQ ID NO: 133814

SEQ ID NO: 413178 - RNA, 64 nt, hsa; identical to SEQ ID NO: 133815

SEQ ID NO: 413179 - RNA, 64 nt, hsa; identical to SEQ ID NO: 133816

SEQ ID NO: 413180 - RNA, 64 nt, hsa; identical to SEQ ID NO: 133817

SEQ ID NO: 413181 - RNA, 64 nt, hsa; identical to SEQ ID NO: 133818

SEQ ID NO: 413182 - RNA, 64 nt, hsa; identical to SEQ ID NO: 133819

SEQ ID NO: 413183 - RNA, 64 nt, hsa; identical to SEQ ID NO: 133820

SEQ ID NO: 413184 - RNA, 64 nt, hsa; identical to SEQ ID NO: 133821

SEQ ID NO: 413185 - RNA, 64 nt, hsa; identical to SEQ ID NO: 133822

SEQ ID NO: 413186 - RNA, 64 nt, hsa; identical to SEQ ID NO: 133823

SEQ ID NO: 413187 - RNA, 64 nt, hsa; identical to SEQ ID NO: 133824

SEQ ID NO: 413188 - RNA, 64 nt, hsa; identical to SEQ ID NO: 133825

SEQ ID NO: 413189 - RNA, 64 nt, hsa; identical to SEQ ID NO: 133826

SEQ ID NO: 413190 - RNA, 64 nt, hsa; identical to SEQ ID NO: 133827

SEQ ID NO: 413191 - RNA, 64 nt, hsa; identical to SEQ ID NO: 133828

SEQ ID NO: 413192 - RNA, 64 nt, hsa; identical to SEQ ID NO: 133829

SEQ ID NO: 413193 - RNA, 64 nt, hsa
acucuugcuggaucuguagugauggaguuccuucuggugucagccccacaggaggcucccaggc

SEQ ID NO: 413194 - RNA, 64 nt, hsa
gaagagagcauuuggcagagucugaagaaguuuuuggugucacagcuuuguggggagcaugcua

SEQ ID NO: 413195 - RNA, 64 nt, hsa
ugcagaugggagcuuuuuagaaggggcuaagugcuggugucagggaaauuccauaaugaaguag

SEQ ID NO: 413196 - RNA, 64 nt, hsa
auuuucuuucagguuuacuugauaguggauacauuggugucagaggaccuugacuggguucauu

SEQ ID NO: 413197 - RNA, 64 nt, hsa
cagacaugaaagaggggugagcuggaggaagucauggugucacugggguacaggagggugaaug

SEQ ID NO: 413198 - RNA, 64 nt, hsa
cugagcuccagggcccagcccuaccugccagugcuggugucagggcacucaacaccgagugugg

SEQ ID NO: 413199 - RNA, 64 nt, hsa
cacuaagucaaguuaaaggcuuuguucgaaagaauggugucaaugaagccaaaauagaugagau

SEQ ID NO: 413200 - RNA, 64 nt, hsa
aaggcucuaccucaaagaccuuugcacaguuuauuggugucauauuauacaauauuucaauugu

SEQ ID NO: 413201 - RNA, 64 nt, hsa
cacacacauggaaacccauaggcccacacacagguggugucacugucccuccuggugucacccc

SEQ ID NO: 413202 - RNA, 64 nt, hsa
uaggcccacacacagguggugucacugucccuccuggugucaccccagagccacacaugggcau

SEQ ID NO: 413203 - RNA, 64 nt, hsa
auuuccacucaccuccguguucuuggggagugcguggugucagaucccauccugcuccucucca

SEQ ID NO: 413204 - RNA, 64 nt, hsa
auuuccucucaccuccguguucucggggagugcguggugucagaucccauccugcucaucucca

SEQ ID NO: 413205 - RNA, 64 nt, hsa
auuuccucucaccucuguguucucggggagugcguggugucagaucccauccugcuccucucca

SEQ ID NO: 413206 - RNA, 64 nt, hsa
auuuccucucaccuccguguucucggggagugcguggugucagaucccauccugcuccucucca

SEQ ID NO: 413207 - RNA, 64 nt, hsa
aggcugggggauugagguggggaaucauuuuagcuggugucagccccucuucccuuccuccauu

SEQ ID NO: 413208 - RNA, 64 nt, hsa
ccucacccccgacgguguggcugaugaugucuucuggugucauggugaccacccccuguucccu

SEQ ID NO: 413209 - RNA, 64 nt, hsa
aggacaguuggguguggccugggcucaugccugguggugucacaucccaaggcagcaagagcau

SEQ ID NO: 413210 - RNA, 64 nt, hsa
gugauacgcauuugcuugccacauuaagggaaaauggugucauuuguugcagaaaaacaaugga

SEQ ID NO: 413211 - RNA, 64 nt, hsa
ugguuugguacagagacugagaaguuuuucauucuggugucaaaguuuuguuacauuaugggug

SEQ ID NO: 413212 - RNA, 64 nt, hsa
cuuccaaggaaguuaaaaggcuugguauggauguuggugucagauaggucugacuaaccucucc

SEQ ID NO: 413213 - RNA, 64 nt, hsa
cugguggcuguauuagcuaggaaagguuuguaaauggugucagugagguggggaaaggaagucu

SEQ ID NO: 413214 - RNA, 64 nt, hsa
gagaagaugcucuggggacugagcccacuguuguuggugucagggaggcuuacuggagccacac

SEQ ID NO: 413215 - RNA, 64 nt, hsa
ugccccugggucgugagcucgccugaguaugggguggugucauggagccgcauaccccuggguu

SEQ ID NO: 413216 - RNA, 64 nt, hsa
ugccccugggucgugagcuugccugcguaugggguggugucauggagccucaugccccuggguc

SEQ ID NO: 413217 - RNA, 64 nt, hsa; identical to SEQ ID NO: 87769

SEQ ID NO: 413218 - RNA, 64 nt, hsa; identical to SEQ ID NO: 87770

SEQ ID NO: 413219 - RNA, 64 nt, hsa; identical to SEQ ID NO: 87771

SEQ ID NO: 413220 - RNA, 64 nt, hsa; identical to SEQ ID NO: 87772

SEQ ID NO: 413221 - RNA, 64 nt, hsa; identical to SEQ ID NO: 87773

SEQ ID NO: 413222 - RNA, 64 nt, hsa; identical to SEQ ID NO: 87774

SEQ ID NO: 413223 - RNA, 64 nt, hsa; identical to SEQ ID NO: 87775

SEQ ID NO: 413224 - RNA, 64 nt, hsa; identical to SEQ ID NO: 87776

SEQ ID NO: 413225 - RNA, 64 nt, hsa; identical to SEQ ID NO: 87777

SEQ ID NO: 413226 - RNA, 64 nt, hsa; identical to SEQ ID NO: 87778

SEQ ID NO: 413227 - RNA, 64 nt, hsa; identical to SEQ ID NO: 87779

SEQ ID NO: 413228 - RNA, 64 nt, hsa; identical to SEQ ID NO: 87780

SEQ ID NO: 413229 - RNA, 64 nt, hsa; identical to SEQ ID NO: 87781

SEQ ID NO: 413230 - RNA, 50 nt, hsa; identical to SEQ ID NO: 87782

SEQ ID NO: 413231 - RNA, 64 nt, hsa; identical to SEQ ID NO: 87783

SEQ ID NO: 413232 - RNA, 64 nt, hsa; identical to SEQ ID NO: 87784

SEQ ID NO: 413233 - RNA, 64 nt, hsa; identical to SEQ ID NO: 87785

SEQ ID NO: 413234 - RNA, 64 nt, hsa; identical to SEQ ID NO: 87786

SEQ ID NO: 413235 - RNA, 64 nt, hsa; identical to SEQ ID NO: 87787

SEQ ID NO: 413236 - RNA, 64 nt, hsa; identical to SEQ ID NO: 87788

SEQ ID NO: 413237 - RNA, 64 nt, hsa; identical to SEQ ID NO: 87789

SEQ ID NO: 413238 - RNA, 64 nt, hsa; identical to SEQ ID NO: 87790

SEQ ID NO: 413239 - RNA, 64 nt, hsa; identical to SEQ ID NO: 87791

SEQ ID NO: 413240 - RNA, 64 nt, hsa; identical to SEQ ID NO: 87792

SEQ ID NO: 413241 - RNA, 64 nt, hsa; identical to SEQ ID NO: 87793

SEQ ID NO: 413242 - RNA, 64 nt, hsa; identical to SEQ ID NO: 87794

SEQ ID NO: 413243 - RNA, 64 nt, hsa; identical to SEQ ID NO: 87795

SEQ ID NO: 413244 - RNA, 64 nt, hsa; identical to SEQ ID NO: 87796

SEQ ID NO: 413245 - RNA, 64 nt, hsa; identical to SEQ ID NO: 87797

SEQ ID NO: 413246 - RNA, 64 nt, hsa; identical to SEQ ID NO: 87798

SEQ ID NO: 413247 - RNA, 64 nt, hsa; identical to SEQ ID NO: 87799

SEQ ID NO: 413248 - RNA, 64 nt, hsa; identical to SEQ ID NO: 87800

SEQ ID NO: 413249 - RNA, 64 nt, hsa; identical to SEQ ID NO: 87801

SEQ ID NO: 413250 - RNA, 64 nt, hsa; identical to SEQ ID NO: 87802

SEQ ID NO: 413251 - RNA, 64 nt, hsa; identical to SEQ ID NO: 87803

SEQ ID NO: 413252 - RNA, 64 nt, hsa; identical to SEQ ID NO: 87804

SEQ ID NO: 413253 - RNA, 64 nt, hsa; identical to SEQ ID NO: 87805

SEQ ID NO: 413254 - RNA, 64 nt, hsa; identical to SEQ ID NO: 87806

SEQ ID NO: 413255 - RNA, 64 nt, hsa; identical to SEQ ID NO: 87807

SEQ ID NO: 413256 - RNA, 64 nt, hsa; identical to SEQ ID NO: 87808

SEQ ID NO: 413257 - RNA, 64 nt, hsa; identical to SEQ ID NO: 87809

SEQ ID NO: 413258 - RNA, 64 nt, hsa; identical to SEQ ID NO: 87810

SEQ ID NO: 413259 - RNA, 64 nt, hsa; identical to SEQ ID NO: 87811

SEQ ID NO: 413260 - RNA, 64 nt, hsa; identical to SEQ ID NO: 87812

SEQ ID NO: 413261 - RNA, 64 nt, hsa; identical to SEQ ID NO: 87813

SEQ ID NO: 413262 - RNA, 64 nt, hsa; identical to SEQ ID NO: 87814

SEQ ID NO: 413263 - RNA, 64 nt, hsa; identical to SEQ ID NO: 87815

SEQ ID NO: 413264 - RNA, 64 nt, hsa; identical to SEQ ID NO: 87816

SEQ ID NO: 413265 - RNA, 64 nt, hsa; identical to SEQ ID NO: 87817

SEQ ID NO: 413266 - RNA, 64 nt, hsa
uaaaaauacaaaauuagucggguaugguggcacaugccuguaauuccagcugcuugggagccug

SEQ ID NO: 413267 - RNA, 64 nt, hsa
aaaaauacaaaaaguagccaggcgugguggcgugugccuguagucccagcuacuugggaggcug

SEQ ID NO: 413268 - RNA, 64 nt, hsa
auagggaaggaggaaggacacauuuucaauccucugccuguagcucaauccaaauuuguggaua

SEQ ID NO: 413269 - RNA, 64 nt, hsa
aaaaauauaaaaauuagccaggcgugguggugcaugccuguagucccaguuacucgggaggcug

SEQ ID NO: 413270 - RNA, 64 nt, hsa
uaaucugggaaggcaguagaauggccagcauuccugccuguaagucuucccaagacagaggccc

SEQ ID NO: 413271 - RNA, 64 nt, hsa
aauaauacaaaaauuagcugggcgugguggcacaugccuguaaucccagcuacuugggaggcug

SEQ ID NO: 413272 - RNA, 64 nt, hsa
aaaaauacaaaaauuagccaggcaucguggugggugccuguaaucccagcuauucaggaggcug

SEQ ID NO: 413273 - RNA, 64 nt, hsa
uaaagauaaagucuaggccaggcaugguggcucaugccuguaaucccaacacuuaggguggcug

SEQ ID NO: 413274 - RNA, 64 nt, hsa
cuuuuuucaauuucgguuuuaguaaucuaggcuuugccuguaaagaauacaacgauggauuuua

SEQ ID NO: 413275 - RNA, 64 nt, hsa
aaaaauacaaaaauuauccgggcaugguggcacaugccuguaaucucagcuacucaggaggcug

SEQ ID NO: 413276 - RNA, 64 nt, hsa
aaaaauacaaaaauuagccaggcaugguggugcaugccuguagucccagcuguuugggaggcug

SEQ ID NO: 413277 - RNA, 64 nt, hsa
uaaugagcuuuauuuggccgugcauggugccucaugccuguaaugaggcagauggcuugagucc

SEQ ID NO: 413278 - RNA, 64 nt, hsa
uaaaauuaugugaaaucugcccgggcacaccucaugccuguaaucccagcacucugggaggcca

SEQ ID NO: 413279 - RNA, 64 nt, hsa
gagagaaaauugagauguguaaaaaucuaguuacugccuguaaauggugucauugaggcagaua

SEQ ID NO: 413280 - RNA, 64 nt, hsa
gaagaggauucaaaacgccacguguaguggcucaugccuguaaucccaacacuuugggaggcug

SEQ ID NO: 413281 - RNA, 64 nt, hsa
aaaauacaaaaaauuagccgagcacgguggugcaugccuguaaucccagcuacuugggaggcug

SEQ ID NO: 413282 - RNA, 64 nt, hsa
uuaaauagcuaauacgaccggguacagugguucaugccuguaaucccagaacuucgggaggccg

SEQ ID NO: 413283 - RNA, 64 nt, hsa
aauauaaauaauuguggccgggugcaauggcucaugccuguaaucccagcacuuugggaggcug

SEQ ID NO: 413284 - RNA, 64 nt, hsa
aaaaaguaaacaugcggcugggcgugguggcucaugccuguaaucccagcacuuugggaggcug

SEQ ID NO: 413285 - RNA, 64 nt, hsa
uaaaaauacaaaacuagccggguauggugguacaugccuguaaucccagcuacucaggaggcug

SEQ ID NO: 413286 - RNA, 64 nt, hsa
uggaagagcaaauggggcugagugcaguggcucaugccuguaaucccagcacuuagggugccaa

SEQ ID NO: 413287 - RNA, 64 nt, hsa
aagauuuuaauaauuaguugggcguaguggugcaugccuguaaucccagcuacucuggagacag

SEQ ID NO: 413288 - RNA, 64 nt, hsa
uauuaaauguugaccuagccagcgcaguggcucaugccuguaaucccagcacuuugggaggcug

SEQ ID NO: 413289 - RNA, 64 nt, hsa
uaaaaauacaaaauuagcugggcaugguggugcaugccuguaauuccagcuacucgggaggcug

SEQ ID NO: 413290 - RNA, 64 nt, hsa
aaaaauguuaacgugggcugggcaugguggcucaugccuguaaucccagcacucugggaggcug

SEQ ID NO: 413291 - RNA, 64 nt, hsa
uaaagauggaugaaaggccaggcaugguggcucaugccuguaaucccagcacuuugggaggccg

SEQ ID NO: 413292 - RNA, 64 nt, hsa
aaaaauacaaaaauuagccgagcgugguggugcgugccuguagucccagcuacuuaggaggcug

SEQ ID NO: 413293 - RNA, 64 nt, hsa
aaaagaaaaaagaauacccaggugugguagugcaugccuguagucccagcuacuuuggagacug

SEQ ID NO: 413294 - RNA, 64 nt, hsa
aaaauacaaaaaauuaguugggugugguggcgggugccuguaaucccagcuacucaggaggcug

SEQ ID NO: 413295 - RNA, 64 nt, hsa
aaaaauacaaaaauuagccagguguggagguacaugccuguaaucccagcuacucaggaggcug

SEQ ID NO: 413296 - RNA, 64 nt, hsa
aaaauacaaaaaauuagccaggcgugguggcacgugccuguagucccagcuacuccggaggcug

SEQ ID NO: 413297 - RNA, 64 nt, hsa
acaaacaaaaaaauuagccgggcaugguggcaggugccuguaaucccagcuacucagggggcug

SEQ ID NO: 413298 - RNA, 64 nt, hsa
aaaaauacaaaaauuagccgggagugguggugcgugccuguagucccagcuacuugggaggcug

SEQ ID NO: 413299 - RNA, 64 nt, hsa
aaaaacacaaaaauuaucugggcaugguggggcaugccuguagucccacuuacuugggaggccg

SEQ ID NO: 413300 - RNA, 64 nt, hsa
uggugcuaaaccacaauauguauagcauauggagugccuguacaagcugauguuuuguauuuug

SEQ ID NO: 413301 - RNA, 64 nt, hsa
cagaaaugaaagcggggccaggcgcgguggcucgugccuguaaucccagcacuuugggaggcug

SEQ ID NO: 413302 - RNA, 64 nt, hsa
aaaaacacaaaaauuagccaggcaugguggcgcaugccuguaaucccagcuacuagagaggcug

SEQ ID NO: 413303 - RNA, 64 nt, hsa
cacaguaacccagagcuguauuuggcuagcaaucugccuguaucucucacuauuaucuaaaaga

SEQ ID NO: 413304 - RNA, 64 nt, hsa
uuaauuaaaagugugggcugggcgugggggcucaugccuguaaucccagcacuuugggaggccg

SEQ ID NO: 413305 - RNA, 64 nt, hsa
aaaaauacaaaaauuagccaggcgugauggcaggugccuguaauccuagcuacuuggcaggcua

SEQ ID NO: 413306 - RNA, 64 nt, hsa
gcaggggggcggcagcagcggcgguggcagugggugccuguagugugaugugucugaacuaaua

SEQ ID NO: 413307 - RNA, 64 nt, hsa
gcuguugccugggcagggggaagggggggcacggugccuguaauuauuaaacaugaauucaauu

SEQ ID NO: 413308 - RNA, 64 nt, hsa
aguaguugaaauucuaggccggugcgguggcucaugccuguaaucccagcacuguaggcggccg

SEQ ID NO: 413309 - RNA, 64 nt, hsa
gaaaaucaagcuuugggccaggugcgguggcucaugccuguaaucccagcacuaugggaggcca

SEQ ID NO: 413310 - RNA, 64 nt, hsa
auacaaaaaaaaauuagcuggaccugguggcgcaugccuguaauccuagcuacucaggaggcug

SEQ ID NO: 413311 - RNA, 64 nt, hsa
aauuccaugaaucuuggccaggcaugguggcucaugccuguaaucccaccacuuugggagggug

SEQ ID NO: 413312 - RNA, 64 nt, hsa
gaaauuacuaauccaggccaggugugguggcucaugccuguaaucccagcacuuugagaggccg

SEQ ID NO: 413313 - RNA, 64 nt, hsa
aaaaauacaaaaauuagccaggcgugguggcacgugccuguagucccagcuacuugggaggcua

SEQ ID NO: 413314 - RNA, 64 nt, hsa
aggcuuaaauuccauuuuauuaaaaaaaaaaaauugccuguaaucccagcacuucaggaggccg

SEQ ID NO: 413315 - RNA, 64 nt, hsa
agacaaugauuuuuaaagcauuggaaaaauauuuugccuguaaaaguuaguaacuaggugguuc

SEQ ID NO: 413316 - RNA, 64 nt, hsa
auucauuaaaaguuuuauguacuuugauuuacagugccuguaucuuuuauuuuccugucuucuu

SEQ ID NO: 413317 - RNA, 64 nt, hsa
aaaaauaagaaaauuagcuuggcaugguggcacgugccuguagucccagcuacaugggaggcug

SEQ ID NO: 413318 - RNA, 64 nt, hsa
aaaaauacaaaaauuagcugggugugguggugcaugccuguagucccagcuacucgggaggcug

SEQ ID NO: 413319 - RNA, 64 nt, hsa
uaaaccaucacauuuuuuucuuucuacgcccccuugccuguaaaacaccugggaaguuccacug

SEQ ID NO: 413320 - RNA, 64 nt, hsa
aaauacaaaaauauuagccgggcgugguggugcaugccuguaaucccagcuacuagggaggcug

SEQ ID NO: 413321 - RNA, 64 nt, hsa
aaaaauacaaaaauuagcugggugugguggcaugugccuguagucuuagcuacuugagaggcug

SEQ ID NO: 413322 - RNA, 64 nt, hsa
aaauacaaaaaaauuagcugggcgugguggcgcaugccuguaauccuagcuacuugggagucug

SEQ ID NO: 413323 - RNA, 64 nt, hsa
uaagauaaaaaucagggcagggugugguggcuuaugccuguaaucccaguacuuugggaggccg

SEQ ID NO: 413324 - RNA, 64 nt, hsa
gugaguuaauguccgggcuggucacagugguucaugccuguaaucccagcacuuugggagucca

SEQ ID NO: 413325 - RNA, 64 nt, hsa
aaaaauacaaaaaugagcccgguauguuggcauaugccuguaaucccagcuacucgagaggcug

SEQ ID NO: 413326 - RNA, 64 nt, hsa
aaauacaaaaaaauuagccaggcgugguggcacgugccuguaaucccagcuacuugggaggcug

SEQ ID NO: 413327 - RNA, 64 nt, hsa
acugugggcuucagaagccaugacuccccaacucugccuguaucaccgguugaauggacaacua

SEQ ID NO: 413328 - RNA, 64 nt, hsa
ucgauuagacuggacagcuuguggcaagugaauuugccuguaacaagccagauuuuuuaaaauu

SEQ ID NO: 413329 - RNA, 64 nt, hsa
auugagaaggaaaauuuuagcgugcucacugaccugccuguagccccagugacagcuaggaugu

SEQ ID NO: 413330 - RNA, 64 nt, hsa
aauuaaaagggauagggccaggcacaguggcuuaugccuguaauugcagcacuuuuagaggccg

SEQ ID NO: 413331 - RNA, 64 nt, hsa
aaaaacuuucaucuaggccacgugcgguggcucaugccuguaaucccggcacuuugggaggccu

SEQ ID NO: 413332 - RNA, 64 nt, hsa
aaauauacaaaaauuaguuggguguuauggugcaugccuguaaucccagcuacucgggaggcug

SEQ ID NO: 413333 - RNA, 64 nt, hsa
ucuuugaaaagaccgugcugggcgcgguggcucuugccuguaaucccagcacuuugggaggcug

SEQ ID NO: 413334 - RNA, 64 nt, hsa
uaagaacacaaaauuagcugggcaugguggugcaugccuguaaucccagcuacuugggaggccg

SEQ ID NO: 413335 - RNA, 64 nt, hsa
ucaaaaacugaaguuagcugggugugguggcucaugccuguaaucccagcacuuugggggccaa

SEQ ID NO: 413336 - RNA, 64 nt, hsa
uaaaaauacaaaaguagccgggcguggugaugcgugccuguaaucccagcuacccaggaaggcu

SEQ ID NO: 413337 - RNA, 64 nt, hsa
agaaacaagguuaauagccaggcaugguggcucaugccuguaaucccagcacuuugggaggcug

SEQ ID NO: 413338 - RNA, 64 nt, hsa
uucaaaaacaaaauuagccgggcaugauggugcaugccuguagucucagcuaguuggggagcua

SEQ ID NO: 413339 - RNA, 64 nt, hsa
uaagauucucugcccagccgggcacaguggcgcaugccuguaaucccagaacuuugggaggcca

SEQ ID NO: 413340 - RNA, 64 nt, hsa
aaaaauacaaaaauuaaccaggcuuggugguguaugccuguaaucccagcuacuugggaggcug

SEQ ID NO: 413341 - RNA, 64 nt, hsa
gaaguuccacaaccaggccgggcaugguggcucaugccuguaaucccagcacuuugggagguga

SEQ ID NO: 413342 - RNA, 64 nt, hsa
aaaaauacaaaaauuagcugggcaugguggggcaugccuguagucccagcuacucagaagggug

SEQ ID NO: 413343 - RNA, 64 nt, hsa
aaaaauagaaaaaucagcuggguguggugccgcgugccuguaaucccagcuacuugggaggcug

SEQ ID NO: 413344 - RNA, 64 nt, hsa
cauuacuugucuuauauuuuuacugccacuaaacugccuguauuucuguauguccuucuaucca

SEQ ID NO: 413345 - RNA, 64 nt, hsa
ucuguuuauguaguuuguuuuuaaaaugugccaaugccuguacauuaacaagauuuuuaaaaau

SEQ ID NO: 413346 - RNA, 64 nt, hsa
aaaagagaccucuggggccgagugugguggcuuaugccuguaaucccugcacuuugggaagcca

SEQ ID NO: 413347 - RNA, 64 nt, hsa
augaaagaauuuuggggccgggcgcgguggcuuaugccuguaaucccagcacuuugggaggccg

SEQ ID NO: 413348 - RNA, 64 nt, hsa
agcuguggaccccgauuggugagggcucugcauaugccuguaugaaggagauacaggugugugu

SEQ ID NO: 413349 - RNA, 64 nt, hsa
aaaaauacaaaaauuagcuuggcaugguggugcgugccuguaaucccagcuacucgggaggcug

SEQ ID NO: 413350 - RNA, 64 nt, hsa
gaagaagccccuucaggccagucgugguggcucaugccuguaaucccagcacuuugcaaggccg

SEQ ID NO: 413351 - RNA, 64 nt, hsa
gaaaauaagguccagggccggacacaguggcccaugccuguaaucccagcacuuuggggggcca

SEQ ID NO: 413352 - RNA, 64 nt, hsa
cuaaucaguaaggccagcuagacccaauggcucaugccuguaaucccaacacuuugggaggcca

SEQ ID NO: 413353 - RNA, 64 nt, hsa
aaaaauacaaaaauuagcugggcgugguggugcaugccuguaaucccagcuacucgggaggcug

SEQ ID NO: 413354 - RNA, 64 nt, hsa
aaaaauacaaaaauuagccgggcaugguggcaugugccuguauucccagcuacucaugaggcug

SEQ ID NO: 413355 - RNA, 64 nt, hsa
aaauugaaugggggaggcccaaugagguggcucaugccuguaaucccagcacuuugggaagcug

SEQ ID NO: 413356 - RNA, 64 nt, hsa
aaauacagaaaaguuagccaggcgugguggcacaugccuguaaucccagcugcucaggaggcug

SEQ ID NO: 413357 - RNA, 64 nt, hsa
gaaaaauggcuuccuggccgggcgugguggcuccugccuguaaucccagcacuuugggaggccg

SEQ ID NO: 413358 - RNA, 64 nt, hsa
aaaagaaagaaaacaggccgggcacaguggcucaugccuguaaucccagcacuuugggaggucg

SEQ ID NO: 413359 - RNA, 64 nt, hsa
aaaauuacaaaaauuagccgagcaugguggcgcaugccuguagucgcagcuacucgcgagguug

SEQ ID NO: 413360 - RNA, 64 nt, hsa
aaaaauacaaaaauuagcugggcgugguggugcgugccuguaguuccagcuacuugggaggcug

SEQ ID NO: 413361 - RNA, 64 nt, hsa
cuauuuauuugccuuccgucuucccaaccucagcugccuguauucaugccagaggugcaaaggc

SEQ ID NO: 413362 - RNA, 64 nt, hsa
uuguguuauuugauaggccgggcaugguggcucaugccuguaaucccagcacuuugggaggcca

SEQ ID NO: 413363 - RNA, 64 nt, hsa
aaaaauucaaaaauuaccuaggcgucauggggcaugccuguagucccaccuacuugggaggcug

SEQ ID NO: 413364 - RNA, 64 nt, hsa
aaaugccaugaaucaagccagggccguuggcuuaugccuguaaucccagcacuuugcaggccga

SEQ ID NO: 413365 - RNA, 64 nt, hsa
aaauauaaaaauguuggcugugcacgguagcuuaugccuguaaucucagcacuuugggaggcca

SEQ ID NO: 413366 - RNA, 64 nt, hsa
gaaaaucaguaauuggaccaggcgcgguggcucuugccuguaaucccagcacuuugggaggccg

SEQ ID NO: 413367 - RNA, 64 nt, hsa
aaaaauacaaaaauuagccggggguggugacaugugccuguaaucccagcuacucaggaggcua

SEQ ID NO: 413368 - RNA, 64 nt, hsa
guuuaaaaaaaaaaagguugggcguuguggcucaugccuguaaucccagcacuuugggaggcug

SEQ ID NO: 413369 - RNA, 64 nt, hsa
aaaaauacaaaaauuagcugagcaugguggcgugugccuguaaucucagcuacucaggaggcug

SEQ ID NO: 413370 - RNA, 64 nt, hsa
uuuuacacaaagggaagucgggcaugguggcucaugccuguaaucucagcacuuugggaggcug

SEQ ID NO: 413371 - RNA, 64 nt, hsa
aaaaaaaaacuuuagaacugggugcaguggcucaugccuguaaucccagccagcacuuugggag

SEQ ID NO: 413372 - RNA, 64 nt, hsa
aaaaauacaaaaauuagcugggcgugguggcacgugccuguaaucccagcuacucgggaggcug

SEQ ID NO: 413373 - RNA, 64 nt, hsa
aauuuaucuuaguacugcugggcgcaguggcucaugccuguaaucugagcacuuugggaagcug

SEQ ID NO: 413374 - RNA, 64 nt, hsa
uauuuagaaagcagcagucaggcacgguggcucaugccuguaaucccagcacuuugggaggcug

SEQ ID NO: 413375 - RNA, 64 nt, hsa
aaaaaaaaaaaaauuagucgggcgugguggugcaugccuguaaucccagcuacuggggaggcug

SEQ ID NO: 413376 - RNA, 64 nt, hsa
cuaaagguugguguuggccaggcaugguggcucaugccuguaaucccagcauuuugggaggcca

SEQ ID NO: 413377 - RNA, 64 nt, hsa
cucaaaaaaaaaaauugccgggcgcgguggcaaaugccuguaaucccagcacuuugggaggccg

SEQ ID NO: 413378 - RNA, 64 nt, hsa
uaaaaauacaaaauuagccaggcgugguggugcaugccuguaauccagcuacuugggaggcuga

SEQ ID NO: 413379 - RNA, 64 nt, hsa
aaaaaucaagcucuuggccaggcaugguggcucaugccuguaauuccagcacuuugggaggcca

SEQ ID NO: 413380 - RNA, 64 nt, hsa
gaaacugcuaugcaaggcugggugcuguggcucaugccuguaaucccagcacuuugggaggcca

SEQ ID NO: 413381 - RNA, 64 nt, hsa
aauaauacaaaaauuagcugggcaugguggcgcaugccuguaaucccagcuacugggaaggcug

SEQ ID NO: 413382 - RNA, 64 nt, hsa
caaacaagaaaugcuggcuuggcccgguggcucaugccuguaaucccagcacugugggagacca

SEQ ID NO: 413383 - RNA, 64 nt, hsa
aauaaucaaaaaauuggccgggcaugguggcaugugccuguagucccagcuacuugggaggcug

SEQ ID NO: 413384 - RNA, 64 nt, hsa
aaaauacaaaaacuuagcuggguguaacggcggaugccuguaaucccagcuacuugggaggcug

SEQ ID NO: 413385 - RNA, 64 nt, hsa
uuaaaaaaguuugccggcuaggugcgguggcucaugccuguaauccuagcauuuugggaggacg

SEQ ID NO: 413386 - RNA, 64 nt, hsa
uuaaaagaauaaacaagcuaggugugguggcucaugccuguaauccuagcacuuugggaagcca

SEQ ID NO: 413387 - RNA, 64 nt, hsa
aaauacaaaaaaacuagccggauaugguggcgggugccuguaaucucagcuacuugagaggcug

SEQ ID NO: 413388 - RNA, 64 nt, hsa
cucaaaaaaaaaauuagccagauguggugacgcaugccuguaguccuagcuacucaggaggcug

SEQ ID NO: 413389 - RNA, 64 nt, hsa
auaaaagaggaagucagccaggcgcgguggcucaugccuguaaucccagcacuuugggaggcca

SEQ ID NO: 413390 - RNA, 64 nt, hsa
aaauacaaaauuagccgggcauugugguggugcaugccuguaaucccagcuacucgggaagcug

SEQ ID NO: 413391 - RNA, 64 nt, hsa
aauaaaaaaauuauuagcugggcaugguggugugugccuguaaucccagcuacucaggaggaug

SEQ ID NO: 413392 - RNA, 64 nt, hsa
uaaaugccuaacacaggccgggucugguggcucaugccuguaaucccagcacuuugagaggccu

SEQ ID NO: 413393 - RNA, 64 nt, hsa
aaaaauacaaaaauuagcccugcaugguggcaggugccuguagucccagguacucgggaggcug

SEQ ID NO: 413394 - RNA, 64 nt, hsa
auaaauuaaaaaaguugccgggggugguggcucaugccuguaaucccagcacuuugggaggcug

SEQ ID NO: 413395 - RNA, 64 nt, hsa
cuuugucaaccaaagacagcuucccccuuuugauugccuguagacuuuggagccaagaaacacu

SEQ ID NO: 413396 - RNA, 64 nt, hsa
ugggagguguccuguaugucuguacguuggggacugccuguauuuggaagauuuaaaaaccuag

SEQ ID NO: 413397 - RNA, 64 nt, hsa
aaacuucucuaaauuagccggaugugguggugcaugccuguagucccagcuacucgggaggcug

SEQ ID NO: 413398 - RNA, 64 nt, hsa
aauagaagaagaaaaggccgggcaugguggcucaugccuguaaucccaacacuuugggaggcua

SEQ ID NO: 413399 - RNA, 64 nt, hsa
aaaaauacaaaaauuagccgggcaugguggaaugugccuguaaucccaccuacucgagaggcug

SEQ ID NO: 413400 - RNA, 64 nt, hsa
uuaaaaaaaaaauuguagcacugggcguggugcaugccuguaaucccagccacucaggaggcug

SEQ ID NO: 413401 - RNA, 64 nt, hsa
aaagauaaaaaaauuagcugaguguguuggugggugccuguaauccagcuacuugggagacuga

SEQ ID NO: 413402 - RNA, 64 nt, hsa
gaauuaaaagaauuuggccgggugcggcagcucaugccuguaaucccaacacuuugggaggcug

SEQ ID NO: 413403 - RNA, 64 nt, hsa
aauaaacgcuuauuuggccaagccugauggcucgugccuguacucccagcacuuugggaggcug

SEQ ID NO: 413404 - RNA, 64 nt, hsa
gccggguuuacucacugcccuguucugaugucagugccuguacauaccuccaaaggcaggacuu

SEQ ID NO: 413405 - RNA, 64 nt, hsa
aaaauacaaaaaauuagcuggguguggugacgcuugccuguaucccagcuacucaggaagcuga

SEQ ID NO: 413406 - RNA, 64 nt, hsa
aaaguacgaaacuuagccaggcaugaugggggucugccuguaaugccagcuacuccagaggcug

SEQ ID NO: 413407 - RNA, 64 nt, hsa
gaaaacccaagagcuggccaggugugguggcucaugccuguaaucccagcacuuugggaggcug

SEQ ID NO: 413408 - RNA, 64 nt, hsa
aaaauuacaaaaauuagcugggcaugguugcgcaugccuguaaucccagcuacuuuggaggcug

SEQ ID NO: 413409 - RNA, 64 nt, hsa
aaauagaagaaggucggccgggcuugguggcuuaugccuguaaccccagcacuuugggaggccg

SEQ ID NO: 413410 - RNA, 64 nt, hsa
aaaauacaaacaaguagcugguuguggcgccgcaugccuguagucccagcuacucgggaggcug

SEQ ID NO: 413411 - RNA, 64 nt, hsa
ugggauuauaggcacaagacaccacaauaauuauugccuguaugucaauuauuauuuuaaaaua

SEQ ID NO: 413412 - RNA, 64 nt, hsa
aaaguuuaagaaaugagccagacauggugguguaugccuguagucccagccacucagaaggcug

SEQ ID NO: 413413 - RNA, 64 nt, hsa
aauuuuuuaaaaaugagccaagugugguggugcaugccuguaguuccagcuacucaggacacug

SEQ ID NO: 413414 - RNA, 64 nt, hsa
aaaaauacaaaaauuagccaggcgugguggcaggugccuguaaucccagcuacuugggaggcug

SEQ ID NO: 413415 - RNA, 64 nt, hsa
aaaaaauaaaaaauaaucagggcacaguggcucaugccuguaaucccagcacucugggaggcug

SEQ ID NO: 413416 - RNA, 64 nt, hsa
aaaaauacaaaaauuagccgggcaugguggugcaugccuguaaucccagcuacucgggaggcug

SEQ ID NO: 413417 - RNA, 64 nt, hsa
uaaaagcacacugcaagccgggcucaguggcucaugccuguagucccagcacucuguggggccg

SEQ ID NO: 413418 - RNA, 64 nt, hsa
aaaaauucaaaaauuacccggacgugguggcgcaugccuguaaucccagcuacuugggagccug

SEQ ID NO: 413419 - RNA, 64 nt, hsa
acuaaaacaaaaauuagccaggcaugguggcaccugccuguaaucccagcuacuugggaggcug

SEQ ID NO: 413420 - RNA, 64 nt, hsa
caagagucaguuuggggccaggcgugguggcucaugccuguaaucucagcacuuugggaggcug

SEQ ID NO: 413421 - RNA, 64 nt, hsa
aaaaauacagaaauuagccgggcauggugucgcgugccuguagucccagcuccucaggcugcug

SEQ ID NO: 413422 - RNA, 64 nt, hsa
aaaaauacaaaaauuggcugggcaugguggcgggugccuguaaucccagcuacuggggaggcug

SEQ ID NO: 413423 - RNA, 64 nt, hsa
agaaaagaagggcugggcaaggcauaguggcuuaugccuguaaucccgguacuuugggaggcug

SEQ ID NO: 413424 - RNA, 64 nt, hsa
uaaagauacaaaauuagccaggcaugguggugcaugccuguaaucccagcuacuugggaggcua

SEQ ID NO: 413425 - RNA, 64 nt, hsa
aaagaacagccaaguggccaggugcgguggcucaugccuguaaucccagcacuuugggaggcca

SEQ ID NO: 413426 - RNA, 64 nt, hsa
aaaaaauaaaaaauuagcugggcacgguggugugugccuguagucccagcuacuggugaggcug

SEQ ID NO: 413427 - RNA, 64 nt, hsa
cagaagggaaacaaacgccaggcacgguggcucaugccuguaaucccaacacuuugggaggcug

SEQ ID NO: 413428 - RNA, 64 nt, hsa
gaaaaaggcagaaaaggccgggcgcgguggcucaugccuguaaccccagcacuuugggaggccg

SEQ ID NO: 413429 - RNA, 64 nt, hsa
agagcaggggauagaagccgggcgaaguggcccaugccuguaaucucagcacucugggagaccg

SEQ ID NO: 413430 - RNA, 64 nt, hsa
caaaauauagaaauuagccuggugugguggcgagugccuguaaucccagcuauucaggagggug

SEQ ID NO: 413431 - RNA, 64 nt, hsa
aaaaaaaaaaaaauagaccaggugcucuggcucaugccuguaaucccagcacuuugggaggcca

SEQ ID NO: 413432 - RNA, 64 nt, hsa
uaaaaauacaaacuuagcugggcuuaguggugcaugccuguagucucagcuacuugggaggcug

SEQ ID NO: 413433 - RNA, 64 nt, hsa
uaaaaauacaaaauuagccgggcgugguggcaggugccuguaaucccagcuacuugggaggcug

SEQ ID NO: 413434 - RNA, 64 nt, hsa
aaauuacaaaaaauuagccgggcaugguagcaggugccuguagucccagcuacucgggaggcug

SEQ ID NO: 413435 - RNA, 64 nt, hsa
aaaaaaagaaguuauggccgggcgcgguggcucaugccuguaauaccagcacuuugggaggcgg

SEQ ID NO: 413436 - RNA, 64 nt, hsa
auugaaagccaauaugaggccaggugguggcucaugccuguaaucccagcacuuugggaggcca

SEQ ID NO: 413437 - RNA, 64 nt, hsa
aaauacaaaaaaauuagcugggcaugguggugcaugccuguagucccagcuacucaggaggcug

SEQ ID NO: 413438 - RNA, 64 nt, hsa
uauuaugagaauuuaggccaagugugguggcucaugccuguaaucccagcacuuugcgaggccg

SEQ ID NO: 413439 - RNA, 64 nt, hsa
aaaaauaauaauaauagccaggcgugguggcacaugccuguauucccagcugcuugggaggcug

SEQ ID NO: 413440 - RNA, 64 nt, hsa
aaacauaaaaaaauuagucagguguggcggugcgugccuguaaucccagcuauucaggaggcug

SEQ ID NO: 413441 - RNA, 64 nt, hsa
guaucagugaugaaaauuugccuuugccccggcuugccuguaaucccagcacuuugggaggccg

SEQ ID NO: 413442 - RNA, 64 nt, hsa
uggugggcucucucuggcccagcguggugguucaugccuguaauaccagcguuuugggaggcug

SEQ ID NO: 413443 - RNA, 64 nt, hsa
uggcacguugguuuccugugcgucugugucuuugugccuguaucucgcugggggacuucacagg

SEQ ID NO: 413444 - RNA, 64 nt, hsa
auaagcagcccacacaacugggcauagugguucaugccuguaaucccagcacuuugggaggcug

SEQ ID NO: 413445 - RNA, 64 nt, hsa
gagaucaacccaauaucauaagaaguuugugugaugccuguauuuuuagcuaauuaccaagguc

SEQ ID NO: 413446 - RNA, 64 nt, hsa
aaaaauacaaaaaugagcugggugugaugauacaugccuguaauccuggcuacuugggaggcug

SEQ ID NO: 413447 - RNA, 64 nt, hsa
aauacaaaaaaaauuagcugggcgugguggcggaugccuguagucccagcuacucaggaggcug

SEQ ID NO: 413448 - RNA, 64 nt, hsa
gagcauggcaaauuuaaaaaauaacacaauuucuugccuguaacccuagcacuuugggaggccg

SEQ ID NO: 413449 - RNA, 64 nt, hsa
aaaaauacaaaaauuagcugggcgugguagugcaugccuguaaucccagcuacuugggaggcug

SEQ ID NO: 413450 - RNA, 64 nt, hsa
agauaauuucaacuaauuaaauaaccuguuuuacugccuguacauuccacauuaauaaagcgau

SEQ ID NO: 413451 - RNA, 64 nt, hsa
aaaaauacaaaaauuagcugggcguaguggcgcgugccuguaauuccaucuacucgggaggcug

SEQ ID NO: 413452 - RNA, 64 nt, hsa
uaaaauacaaaaauuagccgggcgugguggugcgugccuguagucccagcuacucgaaagguug

SEQ ID NO: 413453 - RNA, 64 nt, hsa
aaauucuuaguucagggcugggcgcgguggcucaugccuguaacccuagcacuuugggaggcug

SEQ ID NO: 413454 - RNA, 64 nt, hsa
auuauaaaaguauuaauuuggggaacuaauaaauguccaugaaaccuucacaauccauguuuuu

SEQ ID NO: 413455 - RNA, 64 nt, hsa
aaucacaaggguauugacuggggaagugauaaguguccaugaaaucuuuacaauuuauguuuag

SEQ ID NO: 413456 - RNA, 64 nt, hsa
cucucuucucacuucuguuaagauggcugauauaguccaugaaucccacucaugaucucuuuau

SEQ ID NO: 413457 - RNA, 64 nt, hsa; identical to SEQ ID NO: 206165

SEQ ID NO: 413458 - RNA, 64 nt, hsa; identical to SEQ ID NO: 206166

SEQ ID NO: 413459 - RNA, 64 nt, hsa; identical to SEQ ID NO: 206167

SEQ ID NO: 413460 - RNA, 64 nt, hsa; identical to SEQ ID NO: 206168

SEQ ID NO: 413461 - RNA, 64 nt, hsa; identical to SEQ ID NO: 206169

SEQ ID NO: 413462 - RNA, 64 nt, hsa; identical to SEQ ID NO: 206170

SEQ ID NO: 413463 - RNA, 64 nt, hsa; identical to SEQ ID NO: 206171

SEQ ID NO: 413464 - RNA, 64 nt, hsa; identical to SEQ ID NO: 206172

SEQ ID NO: 413465 - RNA, 64 nt, hsa; identical to SEQ ID NO: 206173

SEQ ID NO: 413466 - RNA, 64 nt, hsa; identical to SEQ ID NO: 206174

SEQ ID NO: 413467 - RNA, 64 nt, hsa; identical to SEQ ID NO: 206175

SEQ ID NO: 413468 - RNA, 64 nt, hsa; identical to SEQ ID NO: 206176

SEQ ID NO: 413469 - RNA, 64 nt, hsa; identical to SEQ ID NO: 206177

SEQ ID NO: 413470 - RNA, 64 nt, hsa; identical to SEQ ID NO: 206178

SEQ ID NO: 413471 - RNA, 64 nt, hsa; identical to SEQ ID NO: 206179

SEQ ID NO: 413472 - RNA, 64 nt, hsa; identical to SEQ ID NO: 206180

SEQ ID NO: 413473 - RNA, 64 nt, hsa; identical to SEQ ID NO: 206181

SEQ ID NO: 413474 - RNA, 64 nt, hsa; identical to SEQ ID NO: 206182

SEQ ID NO: 413475 - RNA, 64 nt, hsa; identical to SEQ ID NO: 206183

SEQ ID NO: 413476 - RNA, 64 nt, hsa; identical to SEQ ID NO: 206184

SEQ ID NO: 413477 - RNA, 64 nt, hsa; identical to SEQ ID NO: 206185

SEQ ID NO: 413478 - RNA, 64 nt, hsa; identical to SEQ ID NO: 206186

SEQ ID NO: 413479 - RNA, 64 nt, hsa; identical to SEQ ID NO: 206187

SEQ ID NO: 413480 - RNA, 64 nt, hsa; identical to SEQ ID NO: 206188

SEQ ID NO: 413481 - RNA, 64 nt, hsa; identical to SEQ ID NO: 206189

SEQ ID NO: 413482 - RNA, 64 nt, hsa; identical to SEQ ID NO: 206190

SEQ ID NO: 413483 - RNA, 64 nt, hsa; identical to SEQ ID NO: 206191

SEQ ID NO: 413484 - RNA, 64 nt, hsa; identical to SEQ ID NO: 206192

SEQ ID NO: 413485 - RNA, 64 nt, hsa; identical to SEQ ID NO: 206193

SEQ ID NO: 413486 - RNA, 64 nt, hsa; identical to SEQ ID NO: 206194

SEQ ID NO: 413487 - RNA, 64 nt, hsa; identical to SEQ ID NO: 206193

SEQ ID NO: 413488 - RNA, 64 nt, hsa; identical to SEQ ID NO: 206196

SEQ ID NO: 413489 - RNA, 64 nt, hsa; identical to SEQ ID NO: 206197

SEQ ID NO: 413490 - RNA, 64 nt, hsa; identical to SEQ ID NO: 206198

SEQ ID NO: 413491 - RNA, 64 nt, hsa; identical to SEQ ID NO: 206199

SEQ ID NO: 413492 - RNA, 64 nt, hsa; identical to SEQ ID NO: 206200

SEQ ID NO: 413493 - RNA, 64 nt, hsa; identical to SEQ ID NO: 206201

SEQ ID NO: 413494 - RNA, 64 nt, hsa; identical to SEQ ID NO: 206202

SEQ ID NO: 413495 - RNA, 64 nt, hsa; identical to SEQ ID NO: 206203

SEQ ID NO: 413496 - RNA, 64 nt, hsa; identical to SEQ ID NO: 206204

SEQ ID NO: 413497 - RNA, 64 nt, hsa; identical to SEQ ID NO: 206205

SEQ ID NO: 413498 - RNA, 64 nt, hsa; identical to SEQ ID NO: 206206

SEQ ID NO: 413499 - RNA, 64 nt, hsa; identical to SEQ ID NO: 206207

SEQ ID NO: 413500 - RNA, 64 nt, hsa; identical to SEQ ID NO: 206208

SEQ ID NO: 413501 - RNA, 64 nt, hsa; identical to SEQ ID NO: 206209

SEQ ID NO: 413502 - RNA, 64 nt, hsa; identical to SEQ ID NO: 206210

SEQ ID NO: 413503 - RNA, 64 nt, hsa; identical to SEQ ID NO: 206211

SEQ ID NO: 413504 - RNA, 64 nt, hsa; identical to SEQ ID NO: 206212

SEQ ID NO: 413505 - RNA, 53 nt, hsa; identical to SEQ ID NO: 206213

SEQ ID NO: 413506 - RNA, 64 nt, hsa; identical to SEQ ID NO: 206214

SEQ ID NO: 413507 - RNA, 64 nt, hsa; identical to SEQ ID NO: 206215

SEQ ID NO: 413508 - RNA, 53 nt, hsa; identical to SEQ ID NO: 206216

SEQ ID NO: 413509 - RNA, 64 nt, hsa; identical to SEQ ID NO: 206217

SEQ ID NO: 413510 - RNA, 64 nt, hsa; identical to SEQ ID NO: 206218

SEQ ID NO: 413511 - RNA, 64 nt, hsa; identical to SEQ ID NO: 206219

SEQ ID NO: 413512 - RNA, 64 nt, hsa; identical to SEQ ID NO: 206220

SEQ ID NO: 413513 - RNA, 64 nt, hsa; identical to SEQ ID NO: 206221

SEQ ID NO: 413514 - RNA, 64 nt, hsa; identical to SEQ ID NO: 243644

SEQ ID NO: 413515 - RNA, 64 nt, hsa; identical to SEQ ID NO: 243645

SEQ ID NO: 413516 - RNA, 64 nt, hsa; identical to SEQ ID NO: 243646

SEQ ID NO: 413517 - RNA, 64 nt, hsa; identical to SEQ ID NO: 243647

SEQ ID NO: 413518 - RNA, 64 nt, hsa; identical to SEQ ID NO: 243648

SEQ ID NO: 413519 - RNA, 64 nt, hsa; identical to SEQ ID NO: 243649

SEQ ID NO: 413520 - RNA, 64 nt, hsa; identical to SEQ ID NO: 243650

SEQ ID NO: 413521 - RNA, 64 nt, hsa; identical to SEQ ID NO: 243651

SEQ ID NO: 413522 - RNA, 64 nt, hsa; identical to SEQ ID NO: 243652

SEQ ID NO: 413523 - RNA, 64 nt, hsa; identical to SEQ ID NO: 243653

SEQ ID NO: 413524 - RNA, 64 nt, hsa; identical to SEQ ID NO: 243654

SEQ ID NO: 413525 - RNA, 64 nt, hsa; identical to SEQ ID NO: 243655

SEQ ID NO: 413526 - RNA, 64 nt, hsa; identical to SEQ ID NO: 243656

SEQ ID NO: 413527 - RNA, 64 nt, hsa; identical to SEQ ID NO: 243657

SEQ ID NO: 413528 - RNA, 64 nt, hsa
gcuuccaggcagccuguuuuuaaagaaaugggacuaaugggagaagcuguuugucacucuaaga

SEQ ID NO: 413529 - RNA, 64 nt, hsa
cuugcccuucccaagggacuguucuuguggcccuuaaugggaagggggcaggggugaggagcug

SEQ ID NO: 413530 - RNA, 64 nt, hsa
uauuacccuaagaaugcuuugccauaaccacauuuaaugggaaaaacggcaguaucacagaugu

SEQ ID NO: 413531 - RNA, 64 nt, hsa
cguggagaucgcuuuucucagacucaccaacuuuuaaugggauuucaugggguuugguugugcu

SEQ ID NO: 413532 - RNA, 64 nt, hsa
guugacaccuguuacccauuaggggugauaacauuaaugggaagaaaugauggcaacuuugaau

SEQ ID NO: 413533 - RNA, 64 nt, hsa
gcuuggagaacucugccuuccaucaacugcaguguaaugggaaagaggguggugagguuuugaa

SEQ ID NO: 413534 - RNA, 64 nt, hsa
ucaucuucugggauuauuguucaagaccagccucuaaugggaggugaaacgguacgauggucuc

SEQ ID NO: 413535 - RNA, 64 nt, hsa
ucgaaacugaagugagucccgguuuguuucauuuuaaugggaggguaauaaagaugaaagacca

SEQ ID NO: 413536 - RNA, 64 nt, hsa
augauacacauuccaccuucaggaacacucuuuuuaaugggagguuaugcuuuggcaaucagcg

SEQ ID NO: 413537 - RNA, 64 nt, hsa
ugagcccuugaaaaaugaacugcccuucagcaucuaaugggaguugugaauguaacugguuaau

SEQ ID NO: 413538 - RNA, 64 nt, hsa
aacagcugugagacagacauauugagaugccugcccuuguuaguauucauuuuaugcugcccaa

SEQ ID NO: 413539 - RNA, 64 nt, hsa
uaacaaguauuuccuugugauuauauuacucuguccuuguuaauaaagugcugcuguguuugac

SEQ ID NO: 413540 - RNA, 64 nt, hsa
auguuuuuagccaggguuauuuguucagguucuuccuuguuaggauuccagacuggaaaguugg

SEQ ID NO: 413541 - RNA, 64 nt, hsa
cuuuguacugcugcuaaugauaugcacccagaaaccuuguuagacaaaaggcaguuucaagcca

SEQ ID NO: 413542 - RNA, 64 nt, hsa
caguuauuaaaucaggaaucucuuuuauguguguccuuguuacauugagguuaagagacaaaau

SEQ ID NO: 413543 - RNA, 64 nt, hsa
uucccucaugaauagacucaccagcauuuuacccccuuguuauaaaacugugcagagcaagaag

SEQ ID NO: 413544 - RNA, 64 nt, hsa; identical to SEQ ID NO: 300473

SEQ ID NO: 413545 - RNA, 64 nt, hsa; identical to SEQ ID NO: 300474

SEQ ID NO: 413546 - RNA, 64 nt, hsa; identical to SEQ ID NO: 300475

SEQ ID NO: 413547 - RNA, 64 nt, hsa; identical to SEQ ID NO: 300476

SEQ ID NO: 413548 - RNA, 64 nt, hsa; identical to SEQ ID NO: 300477

SEQ ID NO: 413549 - RNA, 64 nt, hsa; identical to SEQ ID NO: 300478

SEQ ID NO: 413550 - RNA, 64 nt, hsa; identical to SEQ ID NO: 300479

SEQ ID NO: 413551 - RNA, 64 nt, hsa; identical to SEQ ID NO: 300480

SEQ ID NO: 413552 - RNA, 64 nt, hsa; identical to SEQ ID NO: 300481

SEQ ID NO: 413553 - RNA, 64 nt, hsa; identical to SEQ ID NO: 300482

SEQ ID NO: 413554 - RNA, 64 nt, hsa; identical to SEQ ID NO: 300483

SEQ ID NO: 413555 - RNA, 64 nt, hsa
aaaagacaugaaggggguuggggucugugugaguaguggggaggugcauguguauccacaugug

SEQ ID NO: 413556 - RNA, 64 nt, hsa
agccugaguaaaaggcuuggaaguuggaauuaacaguggggagcagaagcacucauagcucuuu

SEQ ID NO: 413557 - RNA, 64 nt, hsa
ccuuccaagcugcuuagccuuugucaaccaucaaaguggggaaagggucucuggccuugcaagg

SEQ ID NO: 413558 - RNA, 64 nt, hsa
cacaccgugguccugggccagggccugagaugacaguggggagcaccauccucauuaaugucca

SEQ ID NO: 413559 - RNA, 64 nt, hsa
cugggugacagagcaggacaugagacauagauacaguggggaggagaaguggggaaagguggag

SEQ ID NO: 413560 - RNA, 64 nt, hsa
caggacaugagacauagauacaguggggaggagaaguggggaaagguggagcagagaguucuua

SEQ ID NO: 413561 - RNA, 64 nt, hsa
ucacggugccugaagagggccugacacuucacagaguggggacccaccagagccuauagaauca

SEQ ID NO: 413562 - RNA, 64 nt, hsa
guaauggaccagaucuaccucaguauucaaguucaguggggacaccaguggcuucaaacuuccu

SEQ ID NO: 413563 - RNA, 64 nt, hsa
guacggccugauggcucugugcaguaccugguugaguggggaggagggggcaucuucugaacag

SEQ ID NO: 413564 - RNA, 64 nt, hsa
guaguucucccuacugcccaggcuggaauccaagaguggggaguggggaagaggcccucuucuc

SEQ ID NO: 413565 - RNA, 64 nt, hsa
ucccuacugcccaggcuggaauccaagaguggggaguggggaagaggcccucuucucuacccuc

SEQ ID NO: 413566 - RNA, 64 nt, hsa
cugaacgguuugauguggggaugggguggugggcaguggggaauagaugguugacuuuguuucu

SEQ ID NO: 413567 - RNA, 64 nt, hsa
aguucagaguugaugcuggauguucagauuccuaaguggggagagaguuuggacaucucacuca

SEQ ID NO: 413568 - RNA, 64 nt, hsa
ucuggagggcauugacaccuggcucagcuggaacaguggggacaggaggaggcaggucucaaga

SEQ ID NO: 413569 - RNA, 64 nt, hsa
gagcaacccacuacccugaagucauccaccguguaguggggaagacggagaucacaguagggug

SEQ ID NO: 413570 - RNA, 64 nt, hsa
aggauggggaucaagggacaggccaggagccaggaguggggaagggagggaugaaaggggacac

SEQ ID NO: 413571 - RNA, 64 nt, hsa
gaaggugauuuuccaguucaaaaaaaugggcaggaguggggaacaaaacaauuaacguaagagc

SEQ ID NO: 413572 - RNA, 64 nt, hsa
uuuguuuguuuuuuuugauaaauuggcaugacagaguggggaaaaaaagcaauucacaaaacca

SEQ ID NO: 413573 - RNA, 64 nt, hsa
ccuuuuauaaaaauaaaugcuugggguaggguggaguggggagggauuaaaacccauccaaaaa

SEQ ID NO: 413574 - RNA, 64 nt, hsa
gaauucugagagauaccauuuaaguugagauuucaguggggacacagccaaaccauaucauucu

SEQ ID NO: 413575 - RNA, 64 nt, hsa
ggaauuccagaagauaaauucaaguugcaauuucaguggggacauagccaaaccauaucacugg

SEQ ID NO: 413576 - RNA, 64 nt, hsa
gcaguucagguauguguguauauaguaugaaugcaguggggacacccuuugugguuacaguuug

SEQ ID NO: 413577 - RNA, 64 nt, hsa
ccuuaaugcagagcuagaggacuucuggcagggaaguggggaaguguuccagauagcagggcau

SEQ ID NO: 413578 - RNA, 64 nt, hsa
gugggaaagaacagacaagccaugggaaguuggcaguggggagauuuccacuguggaaaccgcc

SEQ ID NO: 413579 - RNA, 64 nt, hsa
auuccaucugugggcuggccggcaagauggcaccaguggggacccacacccuggcugggcagag

SEQ ID NO: 413580 - RNA, 64 nt, hsa
gagcaaacacaucaccacccugagcagauacaggaguggggagggggcuguaacucagugagug

SEQ ID NO: 413581 - RNA, 64 nt, hsa
ucugggaggacagggguggggacccagaguuagcaguggggauggagcaguagaaggaaucacu

SEQ ID NO: 413582 - RNA, 64 nt, hsa
cuguccccaagggcucuuucuuauuauggcagggaguggggauugguccuacuuucuuucucug

SEQ ID NO: 413583 - RNA, 64 nt, hsa
caggaauuuaguauaugguaagagggauguuuuaaguggggaaaaagguggauuauuuaauaaa

SEQ ID NO: 413584 - RNA, 64 nt, hsa
ugaaagaaaggagccuugaaugguggagggaggcaguggggagaaaggucucaccggacagguu

SEQ ID NO: 413585 - RNA, 64 nt, hsa
aggucagcggugcuggggaacagauggagggggcaguggggacagggcuugggcagacaccagc

SEQ ID NO: 413586 - RNA, 64 nt, hsa
gaagagggugggugcccuccagaccuggggacugaguggggaaaggaguuacacccgugagugg

SEQ ID NO: 413587 - RNA, 64 nt, hsa
uggggacugaguggggaaaggaguuacacccgugaguggggaaugaggcugguccugcagccuc

SEQ ID NO: 413588 - RNA, 64 nt, hsa
gaugaaggcacuuauggacccuuugauggcuuggaguggggaaggcuguuucuuugaaaguugc

SEQ ID NO: 413589 - RNA, 64 nt, hsa
agugacccacacucucugcugcccaguacugccaaguggggaggguccugccuuuuucucugcc

SEQ ID NO: 413590 - RNA, 64 nt, hsa
ugcaaaggcucauauuuauaaaucccacccccagaguggggagggucaggugccagaccuggac

SEQ ID NO: 413591 - RNA, 64 nt, hsa
gguaaacacugggaacuccagaaguuguggggagaguggggaaucagacagccgccucuagggg

SEQ ID NO: 413592 - RNA, 64 nt, hsa
agagguuuuucccuuggagggcaaacaaaguggcaguggggaccaggguguccccugcugagaa

SEQ ID NO: 413593 - RNA, 64 nt, hsa
cauggggcugaaucucagacuucugaggugggggaguggggaugccacucaaugcagcugguau

SEQ ID NO: 413594 - RNA, 64 nt, hsa
cuccgcgugaucaaagccacacucugggcuccagaguggggaugacaugcacucagcucuuggc

SEQ ID NO: 413595 - RNA, 64 nt, hsa
ccgaaaaccaggccuuaucuccaagaccagagauaguggggagacuucuuggcuuggugaggaa

SEQ ID NO: 413596 - RNA, 64 nt, hsa
aaugucuccagggcuaaaggcuggagaucucaccaguggggaaaguacaucugagucaggauuu

SEQ ID NO: 413597 - RNA, 64 nt, hsa
acuggccugaaaggcuggcaagugggagggagucaguggggaggccaggauagaacuagagcug

SEQ ID NO: 413598 - RNA, 64 nt, hsa
guuuuucuauaagaaaucuuucagaaucagcaaaaguggggaugacccaggcaucuugauuugc

SEQ ID NO: 413599 - RNA, 64 nt, hsa
uagguguaggaaauggaagaaaaagauucagccaaguggggaggugacagaugcacaauuauga

SEQ ID NO: 413600 - RNA, 64 nt, hsa
uucucauuugugcuuuuuucucucguaauagaaaaguggggagccgcuggggagccaccccauu

SEQ ID NO: 413601 - RNA, 64 nt, hsa
cgcuagauuuuaacguccagccuucccucagcugaguggggagggcaucccugcaaaagggaac

SEQ ID NO: 413602 - RNA, 64 nt, hsa
ggcagagacgcagaagagaggaacagaaauccagaguggggagacagagaccaagagcagggga

SEQ ID NO: 413603 - RNA, 64 nt, hsa
uuuagugguagcaccaggacccaaaggaaauagcaguggggaagcaucauguaucugggagcau

SEQ ID NO: 413604 - RNA, 64 nt, hsa
uuggguuuaggaagagcuagguuaagucguaacgaguggggaaacacugagucuuguugggucu

SEQ ID NO: 413605 - RNA, 64 nt, hsa
accaccacuaccaccaccacccaacuggggcuagaguggggaagauuuccccuuuagaucaaac

SEQ ID NO: 413606 - RNA, 64 nt, hsa
ucgagacccaaugccucagucugcucauccguaaaguggggauagugaagaugacaccccuccc

SEQ ID NO: 413607 - RNA, 64 nt, hsa
aggccacggcucagugaugggcucaccacccagaaguggggagagacuuugggccucccaccca

SEQ ID NO: 413608 - RNA, 64 nt, hsa
uguaaggggcuccucuucccaccuggaacuugugaguggggacccaugauguaugggucucacc

SEQ ID NO: 413609 - RNA, 64 nt, hsa
cacuacagacaauaaauauuaggagacacagggaaguggggagagguggggaguaauaguaaac

SEQ ID NO: 413610 - RNA, 64 nt, hsa
uggccuacccagauuguaucaugugcuagauuggaguggggaagugugucaaaucaauaaauga

SEQ ID NO: 413611 - RNA, 64 nt, hsa
ccuuggauaaagagcuauaugcuuuucccuggagaguggggagaugagaccaguguuccucaca

SEQ ID NO: 413612 - RNA, 64 nt, hsa
agaccaaacuagagucagaacgaauacuagcaucaguggggaagaaaccuccccaggaaauugg

SEQ ID NO: 413613 - RNA, 64 nt, hsa
acagccuugggcccuagguaccccagcugaucagugccaggagagaccagagccucuggaggcu

SEQ ID NO: 413614 - RNA, 64 nt, hsa
acccccuccucugagcucugaauaugggacccagugccaggagcuggaagacaagguguuucug

SEQ ID NO: 413615 - RNA, 64 nt, hsa
aaggccaaggaggagcggcgcauggaccagaugaugccaggaaagaccaaagcagaugcugcug

SEQ ID NO: 413616 - RNA, 64 nt, hsa
ccuggcccaggugagcaagguggaggccuugcagugccaggaggagggcugccgccauggggca

SEQ ID NO: 413617 - RNA, 64 nt, hsa
ucuccuugcuccuggccuugcugaccucagcgguugccaggaaggggugagcacagagugccuc

SEQ ID NO: 413618 - RNA, 64 nt, hsa
cacgccccaauuuucagguaguacuaagaguaugugccaggaaacucuugcuauugaauugaga

SEQ ID NO: 413619 - RNA, 64 nt, hsa
caugauggucacuuaaaaugugcaguaauagcacugccaggaucaagcaugaaaggcuuuuaaa

SEQ ID NO: 413620 - RNA, 64 nt, hsa
cuuugccuguagagccagccuugguuggaccuauugccaggaauguuucagcugcaguugaaga

SEQ ID NO: 413621 - RNA, 64 nt, hsa
aaguauuugagagagagaaccuuuccacucccacugccaggauuuuguauugccaucgggugcc

SEQ ID NO: 413622 - RNA, 64 nt, hsa
cagguccccggccagcugggccccucccaggcacugccaggaagccccagcugccccuggcggg

SEQ ID NO: 413623 - RNA, 64 nt, hsa
ccuaggcugcgucgggcaugcuuggaagcuggccugccaggaccuuccacccuggggccugugu

SEQ ID NO: 413624 - RNA, 64 nt, hsa
ugagcaccuaaacguuucagggcugaaaugggguugccaggacaacaagcauggcaggggcgaa

SEQ ID NO: 413625 - RNA, 64 nt, hsa
agcacacaggacaggcuggugcaccuccaggcugugccaggaaacccgcugccuuugcgucacc

SEQ ID NO: 413626 - RNA, 64 nt, hsa
cugugcugucgaggcgccugcucgcuuacucgccugccaggaggccgggcucucaguuuggggu

SEQ ID NO: 413627 - RNA, 64 nt, hsa
cgcauguccuacaaucugcucuuagacacggccuugccaggagagccugcccucagacugcagg

SEQ ID NO: 413628 - RNA, 64 nt, hsa
ugccaggagccagauucgggaaccguaacugaugugccaggaauggugcauugauucccaguuc

SEQ ID NO: 413629 - RNA, 64 nt, hsa
agcuguaaacagacaucugcauuuccuagugagcugccaggagccagauucgggaaccguaacu

SEQ ID NO: 413630 - RNA, 64 nt, hsa
acugggagaaggguggccugcugggccgucuggcugccaggaagaaggugaguggccugucggc

SEQ ID NO: 413631 - RNA, 64 nt, hsa
gaaacccaggaggagaguguggaguccagagugcugccaggacccaggcacaggcguuagcucc

SEQ ID NO: 413632 - RNA, 64 nt, hsa
gcugaggccgggcuugagaggagagcgcuggccaugccaggagagaacccacgcacaugcacac

SEQ ID NO: 413633 - RNA, 64 nt, hsa
gaugacgcccagcacagcagcaggacacaccaugugccaggaaaugaccucagcaagaaaccuc

SEQ ID NO: 413634 - RNA, 64 nt, hsa
aaagggacugcugugggccaaagccaagcccaucugccaggacgagguaaugucagagcuccau

SEQ ID NO: 413635 - RNA, 64 nt, hsa
cagacccaagcuuguggcaccaggcaucugauggugccaggaaagccacuggaauugucacacg

SEQ ID NO: 413636 - RNA, 64 nt, hsa
agggguuuccuuuuccauuugccaaguuccauugugccaggacugccgugcuccacugagcucc

SEQ ID NO: 413637 - RNA, 64 nt, hsa
aaugguuuuagcuagagucagaccagaaugaaaaugccaggagcugguacacuacagauguagu

SEQ ID NO: 413638 - RNA, 64 nt, hsa
cccgcagccuuguugagagccacacuucugcccaugccaggagccagcugugugaccauccagg

SEQ ID NO: 413639 - RNA, 64 nt, hsa
agagguucucagcaucaggccaccuccaccccaaugccaggauagauguauucuagaguagggg

SEQ ID NO: 413640 - RNA, 64 nt, hsa
agggacugaccucaggaccuuccagguuccucugugccaggaaugagaggccaggcccgauccu

SEQ ID NO: 413641 - RNA, 64 nt, hsa
ucucccagauguaaguuguuuugcaaacucaguuugccaggauuucuuucuuuccuaaucuuaa

SEQ ID NO: 413642 - RNA, 64 nt, hsa
ggaggugggguuuauugggaugcuggagaagagcugccaggaaguguuuuuucugggucaguaa

SEQ ID NO: 413643 - RNA, 64 nt, hsa
auuauuuucucagucauccuggcagccaaaaaugugccaggaaaagaaagaauguggagcacgc

SEQ ID NO: 413644 - RNA, 64 nt, hsa; identical to SEQ ID NO: 333348

SEQ ID NO: 413645 - RNA, 64 nt, hsa; identical to SEQ ID NO: 333349

SEQ ID NO: 413646 - RNA, 64 nt, hsa; identical to SEQ ID NO: 333350

SEQ ID NO: 413647 - RNA, 64 nt, hsa; identical to SEQ ID NO: 333351

SEQ ID NO: 413648 - RNA, 64 nt, hsa; identical to SEQ ID NO: 333352

SEQ ID NO: 413649 - RNA, 64 nt, hsa; identical to SEQ ID NO: 333353

SEQ ID NO: 413650 - RNA, 64 nt, hsa; identical to SEQ ID NO: 333354

SEQ ID NO: 413651 - RNA, 64 nt, hsa; identical to SEQ ID NO: 333355

SEQ ID NO: 413652 - RNA, 64 nt, hsa; identical to SEQ ID NO: 333356

SEQ ID NO: 413653 - RNA, 64 nt, hsa; identical to SEQ ID NO: 333357

SEQ ID NO: 413654 - RNA, 64 nt, hsa; identical to SEQ ID NO: 333358

SEQ ID NO: 413655 - RNA, 64 nt, hsa; identical to SEQ ID NO: 333359

SEQ ID NO: 413656 - RNA, 64 nt, hsa; identical to SEQ ID NO: 333360

SEQ ID NO: 413657 - RNA, 64 nt, hsa; identical to SEQ ID NO: 333361

SEQ ID NO: 413658 - RNA, 64 nt, hsa; identical to SEQ ID NO: 333362

SEQ ID NO: 413659 - RNA, 64 nt, hsa; identical to SEQ ID NO: 333363

SEQ ID NO: 413660 - RNA, 64 nt, hsa; identical to SEQ ID NO: 333364

SEQ ID NO: 413661 - RNA, 64 nt, hsa; identical to SEQ ID NO: 333365

SEQ ID NO: 413662 - RNA, 64 nt, hsa; identical to SEQ ID NO: 333366

SEQ ID NO: 413663 - RNA, 64 nt, hsa; identical to SEQ ID NO: 333367

SEQ ID NO: 413664 - RNA, 64 nt, hsa; identical to SEQ ID NO: 333368

SEQ ID NO: 413665 - RNA, 64 nt, hsa; identical to SEQ ID NO: 333369

SEQ ID NO: 413666 - RNA, 64 nt, hsa; identical to SEQ ID NO: 333370

SEQ ID NO: 413667 - RNA, 64 nt, hsa; identical to SEQ ID NO: 333371

SEQ ID NO: 413668 - RNA, 64 nt, hsa; identical to SEQ ID NO: 333372

SEQ ID NO: 413669 - RNA, 64 nt, hsa; identical to SEQ ID NO: 333373

SEQ ID NO: 413670 - RNA, 64 nt, hsa; identical to SEQ ID NO: 333374

SEQ ID NO: 413671 - RNA, 64 nt, hsa; identical to SEQ ID NO: 333375

SEQ ID NO: 413672 - RNA, 64 nt, hsa; identical to SEQ ID NO: 333376

SEQ ID NO: 413673 - RNA, 64 nt, hsa; identical to SEQ ID NO: 333377

SEQ ID NO: 413674 - RNA, 64 nt, hsa; identical to SEQ ID NO: 333378

SEQ ID NO: 413675 - RNA, 64 nt, hsa; identical to SEQ ID NO: 333379

SEQ ID NO: 413676 - RNA, 64 nt, hsa; identical to SEQ ID NO: 333380

SEQ ID NO: 413677 - RNA, 64 nt, hsa; identical to SEQ ID NO: 333381

SEQ ID NO: 413678 - RNA, 64 nt, hsa; identical to SEQ ID NO: 333382

SEQ ID NO: 413679 - RNA, 64 nt, hsa; identical to SEQ ID NO: 333383

SEQ ID NO: 413680 - RNA, 64 nt, hsa; identical to SEQ ID NO: 333384

SEQ ID NO: 413681 - RNA, 64 nt, hsa; identical to SEQ ID NO: 333385

SEQ ID NO: 413682 - RNA, 64 nt, hsa; identical to SEQ ID NO: 333386

SEQ ID NO: 413683 - RNA, 64 nt, hsa; identical to SEQ ID NO: 333387

SEQ ID NO: 413684 - RNA, 64 nt, hsa; identical to SEQ ID NO: 333388

SEQ ID NO: 413685 - RNA, 64 nt, hsa; identical to SEQ ID NO: 333389

SEQ ID NO: 413686 - RNA, 64 nt, hsa; identical to SEQ ID NO: 333390

SEQ ID NO: 413687 - RNA, 64 nt, hsa; identical to SEQ ID NO: 333391

SEQ ID NO: 413688 - RNA, 64 nt, hsa; identical to SEQ ID NO: 333392

SEQ ID NO: 413689 - RNA, 64 nt, hsa; identical to SEQ ID NO: 333393

SEQ ID NO: 413690 - RNA, 64 nt, hsa; identical to SEQ ID NO: 333394

SEQ ID NO: 413691 - RNA, 64 nt, hsa; identical to SEQ ID NO: 333395

SEQ ID NO: 413692 - RNA, 64 nt, hsa; identical to SEQ ID NO: 333396

SEQ ID NO: 413693 - RNA, 64 nt, hsa; identical to SEQ ID NO: 333397

SEQ ID NO: 413694 - RNA, 64 nt, hsa; identical to SEQ ID NO: 333398

SEQ ID NO: 413695 - RNA, 64 nt, hsa; identical to SEQ ID NO: 333399

SEQ ID NO: 413696 - RNA, 64 nt, hsa; identical to SEQ ID NO: 333400

SEQ ID NO: 413697 - RNA, 64 nt, hsa; identical to SEQ ID NO: 333401

SEQ ID NO: 413698 - RNA, 64 nt, hsa; identical to SEQ ID NO: 333402

SEQ ID NO: 413699 - RNA, 64 nt, hsa; identical to SEQ ID NO: 333403

SEQ ID NO: 413700 - RNA, 64 nt, hsa; identical to SEQ ID NO: 333404

SEQ ID NO: 413701 - RNA, 64 nt, hsa; identical to SEQ ID NO: 333405

SEQ ID NO: 413702 - RNA, 64 nt, hsa; identical to SEQ ID NO: 333406

SEQ ID NO: 413703 - RNA, 64 nt, hsa; identical to SEQ ID NO: 333407

SEQ ID NO: 413704 - RNA, 64 nt, hsa; identical to SEQ ID NO: 333408

SEQ ID NO: 413705 - RNA, 64 nt, hsa; identical to SEQ ID NO: 333409

SEQ ID NO: 413706 - RNA, 64 nt, hsa; identical to SEQ ID NO: 333410

SEQ ID NO: 413707 - RNA, 64 nt, hsa; identical to SEQ ID NO: 333411

SEQ ID NO: 413708 - RNA, 64 nt, hsa; identical to SEQ ID NO: 333412

SEQ ID NO: 413709 - RNA, 64 nt, hsa; identical to SEQ ID NO: 333413

SEQ ID NO: 413710 - RNA, 64 nt, hsa; identical to SEQ ID NO: 333414

SEQ ID NO: 413711 - RNA, 64 nt, hsa; identical to SEQ ID NO: 333415

SEQ ID NO: 413712 - RNA, 64 nt, hsa; identical to SEQ ID NO: 333416

SEQ ID NO: 413713 - RNA, 64 nt, hsa; identical to SEQ ID NO: 333417

SEQ ID NO: 413714 - RNA, 64 nt, hsa; identical to SEQ ID NO: 333418

SEQ ID NO: 413715 - RNA, 64 nt, hsa; identical to SEQ ID NO: 333419

SEQ ID NO: 413716 - RNA, 64 nt, hsa; identical to SEQ ID NO: 333420

SEQ ID NO: 413717 - RNA, 64 nt, hsa; identical to SEQ ID NO: 333421

SEQ ID NO: 413718 - RNA, 64 nt, hsa; identical to SEQ ID NO: 333422

SEQ ID NO: 413719 - RNA, 64 nt, hsa; identical to SEQ ID NO: 333423

SEQ ID NO: 413720 - RNA, 64 nt, hsa; identical to SEQ ID NO: 333424

SEQ ID NO: 413721 - RNA, 64 nt, hsa; identical to SEQ ID NO: 333425

SEQ ID NO: 413722 - RNA, 64 nt, hsa; identical to SEQ ID NO: 333426

SEQ ID NO: 413723 - RNA, 64 nt, hsa; identical to SEQ ID NO: 333427

SEQ ID NO: 413724 - RNA, 64 nt, hsa; identical to SEQ ID NO: 333428

SEQ ID NO: 413725 - RNA, 64 nt, hsa; identical to SEQ ID NO: 333429

SEQ ID NO: 413726 - RNA, 64 nt, hsa; identical to SEQ ID NO: 333430

SEQ ID NO: 413727 - RNA, 64 nt, hsa; identical to SEQ ID NO: 333431

SEQ ID NO: 413728 - RNA, 64 nt, hsa; identical to SEQ ID NO: 333432

SEQ ID NO: 413729 - RNA, 64 nt, hsa; identical to SEQ ID NO: 333433

SEQ ID NO: 413730 - RNA, 64 nt, hsa; identical to SEQ ID NO: 333434

SEQ ID NO: 413731 - RNA, 64 nt, hsa; identical to SEQ ID NO: 333435

SEQ ID NO: 413732 - RNA, 64 nt, hsa; identical to SEQ ID NO: 333436

SEQ ID NO: 413733 - RNA, 64 nt, hsa; identical to SEQ ID NO: 333437

SEQ ID NO: 413734 - RNA, 64 nt, hsa; identical to SEQ ID NO: 333438

SEQ ID NO: 413735 - RNA, 64 nt, hsa; identical to SEQ ID NO: 333439

SEQ ID NO: 413736 - RNA, 64 nt, hsa; identical to SEQ ID NO: 333440

SEQ ID NO: 413737 - RNA, 64 nt, hsa; identical to SEQ ID NO: 333441

SEQ ID NO: 413738 - RNA, 64 nt, hsa; identical to SEQ ID NO: 333442

SEQ ID NO: 413739 - RNA, 64 nt, hsa; identical to SEQ ID NO: 333443

SEQ ID NO: 413740 - RNA, 64 nt, hsa; identical to SEQ ID NO: 333444

SEQ ID NO: 413741 - RNA, 64 nt, hsa; identical to SEQ ID NO: 333445

SEQ ID NO: 413742 - RNA, 64 nt, hsa; identical to SEQ ID NO: 333446

SEQ ID NO: 413743 - RNA, 64 nt, hsa; identical to SEQ ID NO: 333447

SEQ ID NO: 413744 - RNA, 64 nt, hsa; identical to SEQ ID NO: 333448

SEQ ID NO: 413745 - RNA, 64 nt, hsa; identical to SEQ ID NO: 333449

SEQ ID NO: 413746 - RNA, 64 nt, hsa; identical to SEQ ID NO: 333450

SEQ ID NO: 413747 - RNA, 64 nt, hsa; identical to SEQ ID NO: 333451

SEQ ID NO: 413748 - RNA, 64 nt, hsa; identical to SEQ ID NO: 333452

SEQ ID NO: 413749 - RNA, 64 nt, hsa; identical to SEQ ID NO: 333453

SEQ ID NO: 413750 - RNA, 64 nt, hsa; identical to SEQ ID NO: 333454

SEQ ID NO: 413751 - RNA, 55 nt, hsa; identical to SEQ ID NO: 333455

SEQ ID NO: 413752 - RNA, 64 nt, hsa; identical to SEQ ID NO: 333456

SEQ ID NO: 413753 - RNA, 64 nt, hsa; identical to SEQ ID NO: 333457

SEQ ID NO: 413754 - RNA, 64 nt, hsa; identical to SEQ ID NO: 333458

SEQ ID NO: 413755 - RNA, 64 nt, hsa; identical to SEQ ID NO: 207712

SEQ ID NO: 413756 - RNA, 64 nt, hsa; identical to SEQ ID NO: 207713

SEQ ID NO: 413757 - RNA, 64 nt, hsa; identical to SEQ ID NO: 207714

SEQ ID NO: 413758 - RNA, 64 nt, hsa; identical to SEQ ID NO: 207715

SEQ ID NO: 413759 - RNA, 64 nt, hsa; identical to SEQ ID NO: 207716

SEQ ID NO: 413760 - RNA, 64 nt, hsa; identical to SEQ ID NO: 207717

SEQ ID NO: 413761 - RNA, 64 nt, hsa; identical to SEQ ID NO: 207718

SEQ ID NO: 413762 - RNA, 64 nt, hsa; identical to SEQ ID NO: 207719

SEQ ID NO: 413763 - RNA, 64 nt, hsa; identical to SEQ ID NO: 207720

SEQ ID NO: 413764 - RNA, 64 nt, hsa; identical to SEQ ID NO: 207721

SEQ ID NO: 413765 - RNA, 64 nt, hsa; identical to SEQ ID NO: 207722

SEQ ID NO: 413766 - RNA, 64 nt, hsa; identical to SEQ ID NO: 207723

SEQ ID NO: 413767 - RNA, 64 nt, hsa; identical to SEQ ID NO: 207724

SEQ ID NO: 413768 - RNA, 64 nt, hsa; identical to SEQ ID NO: 207725

SEQ ID NO: 413769 - RNA, 64 nt, hsa; identical to SEQ ID NO: 207726

SEQ ID NO: 413770 - RNA, 64 nt, hsa; identical to SEQ ID NO: 207727

SEQ ID NO: 413771 - RNA, 64 nt, hsa; identical to SEQ ID NO: 207728

SEQ ID NO: 413772 - RNA, 64 nt, hsa; identical to SEQ ID NO: 207729

SEQ ID NO: 413773 - RNA, 64 nt, hsa; identical to SEQ ID NO: 207730

SEQ ID NO: 413774 - RNA, 64 nt, hsa; identical to SEQ ID NO: 207731

SEQ ID NO: 413775 - RNA, 64 nt, hsa; identical to SEQ ID NO: 207732

SEQ ID NO: 413776 - RNA, 64 nt, hsa; identical to SEQ ID NO: 207733

SEQ ID NO: 413777 - RNA, 64 nt, hsa; identical to SEQ ID NO: 207734

SEQ ID NO: 413778 - RNA, 64 nt, hsa
agauggagucccuuuggcaaaacuuaggcaugcacagcuguaguaccccaagaagaaaauguua

SEQ ID NO: 413779 - RNA, 64 nt, hsa
aagauccccaaaacaggccaggugugguugcucacagcuguaauaacaacaccuucagaggcug

SEQ ID NO: 413780 - RNA, 64 nt, hsa
agcauccauauggaaagcaaaggcagaauuaucccagcuguauuauuuugaucuuuuggaugca

SEQ ID NO: 413781 - RNA, 64 nt, hsa
uuuuuaccuucaggggugggagcuaagucaguugcagcuguaaucaauugugcgcaguugggaa

SEQ ID NO: 413782 - RNA, 64 nt, hsa
ugaagccuuucagccaguugcuucugagccagaccagcuguaagcugaaaccucaaugaauaac

SEQ ID NO: 413783 - RNA, 64 nt, hsa
agaaaaugcacaauuuguagggguuuggaugaagcagcuguaacugcccuaguguaguuugacc

SEQ ID NO: 413784 - RNA, 64 nt, hsa
agaacuuuaaacaauauaguauuuauggcgaggacagcuguagucuguugugauauuucacauu

SEQ ID NO: 413785 - RNA, 64 nt, hsa
aguucaggcuagcuucuuucacauaaugcugucucagcuguauuuccaguaacacagcaucauc

SEQ ID NO: 413786 - RNA, 64 nt, hsa; identical to SEQ ID NO: 195961

SEQ ID NO: 413787 - RNA, 64 nt, hsa; identical to SEQ ID NO: 195962

SEQ ID NO: 413788 - RNA, 64 nt, hsa; identical to SEQ ID NO: 195963

SEQ ID NO: 413789 - RNA, 64 nt, hsa; identical to SEQ ID NO: 195964

SEQ ID NO: 413790 - RNA, 64 nt, hsa; identical to SEQ ID NO: 195965

SEQ ID NO: 413791 - RNA, 64 nt, hsa; identical to SEQ ID NO: 195966

SEQ ID NO: 413792 - RNA, 64 nt, hsa; identical to SEQ ID NO: 195967

SEQ ID NO: 413793 - RNA, 64 nt, hsa; identical to SEQ ID NO: 195968

SEQ ID NO: 413794 - RNA, 64 nt, hsa; identical to SEQ ID NO: 195969

SEQ ID NO: 413795 - RNA, 64 nt, hsa; identical to SEQ ID NO: 195970

SEQ ID NO: 413796 - RNA, 64 nt, hsa; identical to SEQ ID NO: 195971

SEQ ID NO: 413797 - RNA, 64 nt, hsa; identical to SEQ ID NO: 195972

SEQ ID NO: 413798 - RNA, 64 nt, hsa; identical to SEQ ID NO: 195973

SEQ ID NO: 413799 - RNA, 64 nt, hsa; identical to SEQ ID NO: 195974

SEQ ID NO: 413800 - RNA, 64 nt, hsa; identical to SEQ ID NO: 195975

SEQ ID NO: 413801 - RNA, 64 nt, hsa; identical to SEQ ID NO: 195976

SEQ ID NO: 413802 - RNA, 64 nt, hsa; identical to SEQ ID NO: 195977

SEQ ID NO: 413803 - RNA, 64 nt, hsa; identical to SEQ ID NO: 195978

SEQ ID NO: 413804 - RNA, 64 nt, hsa; identical to SEQ ID NO: 195979

SEQ ID NO: 413805 - RNA, 64 nt, hsa; identical to SEQ ID NO: 195980

SEQ ID NO: 413806 - RNA, 64 nt, hsa; identical to SEQ ID NO: 195981

SEQ ID NO: 413807 - RNA, 64 nt, hsa; identical to SEQ ID NO: 195982

SEQ ID NO: 413808 - RNA, 64 nt, hsa; identical to SEQ ID NO: 195983

SEQ ID NO: 413809 - RNA, 64 nt, hsa; identical to SEQ ID NO: 195984

SEQ ID NO: 413810 - RNA, 64 nt, hsa; identical to SEQ ID NO: 195985

SEQ ID NO: 413811 - RNA, 64 nt, hsa; identical to SEQ ID NO: 195986

SEQ ID NO: 413812 - RNA, 64 nt, hsa; identical to SEQ ID NO: 195987

SEQ ID NO: 413813 - RNA, 64 nt, hsa
uagcucagaucuccuuucaaaguaguggcuuucuggaugguaauuccaucuuaaggugucagaa

SEQ ID NO: 413814 - RNA, 64 nt, hsa
auuuuuauuuauauauggggccuaggccaauccaggaugguagcuggaauaccuuccuucuuaa

SEQ ID NO: 413815 - RNA, 64 nt, hsa
uacgugauauuuuagaaacuuagugggaaaaguaggaugguauuuuuauguaaagccuugaccc

SEQ ID NO: 413816 - RNA, 64 nt, hsa
aaaucagugcucuuucacuucuucagagaagcagggaugguaccuacccggcagguagguuaga

SEQ ID NO: 413817 - RNA, 64 nt, hsa
uggguauguuaaccuaggcagugggaggcaaaugggaugguaugugagcuaggagaagggcuga

SEQ ID NO: 413818 - RNA, 64 nt, hsa
ggauggagauaaacagcucccaucccuggguaauggaugguaagaugauggagauuccuaagau

SEQ ID NO: 413819 - RNA, 64 nt, hsa
aaagugaaggaaaauacugaacucugucugagugggaugguaugaguuagaggaagaauucucu

SEQ ID NO: 413820 - RNA, 64 nt, hsa
aacccauuuugugccacaugcaaguuuugaauaaggaugguauagaaaacaacgcugcauauac

SEQ ID NO: 413821 - RNA, 64 nt, hsa
gggagcagccucacacaagcagaaacacuccuguggaugguauuguagcauguauuguuuauuu

SEQ ID NO: 413822 - RNA, 64 nt, hsa
uuacagugcaauuuggagauuuuuuuuuuuuccuggaugguaagauuugaaauauuuacauuaa

SEQ ID NO: 413823 - RNA, 64 nt, hsa
cuuuggccauuucuauggaaaugcgaugucagauggaugguaauggugcccuccaguggcugug

SEQ ID NO: 413824 - RNA, 64 nt, hsa
uggagccuuagucucccagacugaaaaaggaagaggaugguauuacaucagcuccauuguuuga

SEQ ID NO: 413825 - RNA, 64 nt, hsa
cguucccucacagcaaagcaacaauacaggcuagggaugguaauccuuuaaacauacaaaaauu

SEQ ID NO: 413826 - RNA, 64 nt, hsa
aaauuauaucugucccaggugcucuccacacauaggaugguaaugccagucccaggggagggug

SEQ ID NO: 413827 - RNA, 64 nt, hsa
uuacagauaacacuuacuugugccuggcugugcuggaugguauauucugugucauuuuucuuca

SEQ ID NO: 413828 - RNA, 64 nt, hsa
uuauagaguucucagccauuggaccucuucuaaaggaugguauaaaaugacucucaaccacuuu

SEQ ID NO: 413829 - RNA, 64 nt, hsa
cuuuugugcacacugcauacguuucagaacuccuggaugguaaccaucucuggagugcagcgcu

SEQ ID NO: 413830 - RNA, 64 nt, hsa
ccuuucuuauccccgaguggauggauggauggauggaugguagggauguuaauaauuuuagugg

SEQ ID NO: 413831 - RNA, 64 nt, hsa
guacaggauaaugguauaaaucaaaagagagaugggaugguaucuaaaaacucaaguauuuucg

SEQ ID NO: 413832 - RNA, 64 nt, hsa
ggcaaguaauuuaaaaauaggcaaaagaauugcuggaugguaugguaguucuauuuuuaguuuu

SEQ ID NO: 413833 - RNA, 64 nt, hsa
ucauucaacuaaaaauauuaaaauuuauuucacuggaugguaauguaaccuuaaaagcaucaua

SEQ ID NO: 413834 - RNA, 64 nt, hsa
ugcauuauagagauggguauuuguagggccggagggaugguagugauggggagaaggugaggaa

SEQ ID NO: 413835 - RNA, 64 nt, hsa
uuguuagugcacagcacaaauuaguuguauaugaggaugguaguuuuuucaccuucaguugucu

SEQ ID NO: 413836 - RNA, 64 nt, hsa
uugauaguuguguguaugugugugugggguggggggaugguaagagaaaagagagaaacacuga

SEQ ID NO: 413837 - RNA, 64 nt, hsa
uuuugguguuggagagacucuacgcuuccccgauggaugguacuucuucugcucucagcauggg

SEQ ID NO: 413838 - RNA, 64 nt, hsa
ugcuuccuauaaacagcuccgcucuuucagggaaggaugguaacaaacuagaaggacaaauaug

SEQ ID NO: 413839 - RNA, 64 nt, hsa
auuaguucugaggcccuuuguggggagguuagggggaugguaauagaaaaagacuauuuuauuu

SEQ ID NO: 413840 - RNA, 64 nt, hsa
uuggagucuaaucuuucaaggaggugggcucccaggaugguaccauugcucuuuccuagcuaac

SEQ ID NO: 413841 - RNA, 64 nt, hsa
uagaucaagaagcuacucuagaagucggagcagaggaugguacagcagaggccgaaccagaagc

SEQ ID NO: 413842 - RNA, 64 nt, hsa
augggaaugugggucugcaccuuguccccucauaggaugguaccaagcauuuagugcacagugg

SEQ ID NO: 413843 - RNA, 64 nt, hsa
ugucuaucuguuuaccucaguguagaugauaugaggaugguauaacuauguaaauuguuuuuga

SEQ ID NO: 413844 - RNA, 64 nt, hsa
caguggguagggcuucugucuucccugggagcagggaugguaucuuagucaauuuuuuucccuu

SEQ ID NO: 413845 - RNA, 64 nt, hsa
guuuggccaaggaguguccuggccagagaucagaggaugguagggugccuauucucggcucuuc

SEQ ID NO: 413846 - RNA, 64 nt, hsa
accauuguuaacaggaauuaaauaagcacauagaggaugguaugggaagaaauuuggcugaucg

SEQ ID NO: 413847 - RNA, 64 nt, hsa
cauguugcagauauuuucccgaguuccccagaauggaugguauugaaucucagccacaugcaac

SEQ ID NO: 413848 - RNA, 64 nt, hsa
guaaauagggcaugaggaacucaucuguguauugggaugguauuagagagagaaucaggaaaga

SEQ ID NO: 413849 - RNA, 64 nt, hsa
gugaaaaggcuucuuggcagccagguggcauugaggaugguauucagggcgcuuuccuucuguc

SEQ ID NO: 413850 - RNA, 64 nt, hsa
ugcuuugccucuggugguacaagguuuuuaacauggaugguaaacaauugucuagaaauucugg

SEQ ID NO: 413851 - RNA, 64 nt, hsa
uucccagacuaaauucauagccgagagcucggggggaugguagaguuaaaauuuaaaauaauuu

SEQ ID NO: 413852 - RNA, 64 nt, hsa
auggacagggccuuccacccuggcuccuucacagggaugguagcugaccggugauggguucauu

SEQ ID NO: 413853 - RNA, 64 nt, hsa
agcugcuggacaaggaggucuacuuauuuuguguggaugguaauuauggcaugcacgcugaaug

SEQ ID NO: 413854 - RNA, 64 nt, hsa
uucuacagaaccugugauuauucucgcaugauaaggaugguacuugcauauggugaauuacuac

SEQ ID NO: 413855 - RNA, 64 nt, hsa
ccuagagaugaauuucguuuucaaauaucuggugggaugguaauggggauuagagaacugacau

SEQ ID NO: 413856 - RNA, 64 nt, hsa
aauaaauggaugaaaaucuuuuaacggagacaaaggaugguauuuaaaaauguagaacacaaug

SEQ ID NO: 413857 - RNA, 64 nt, hsa
ccaauuagauacauauauacaagauaaaggaauaggaugguaauauauuuguuugaaauuaaau

SEQ ID NO: 413858 - RNA, 64 nt, hsa
guauauauuucaagagcuugugaugaaaucuauaggaugguaaugauggacuugucaccuguau

SEQ ID NO: 413859 - RNA, 64 nt, hsa
gaagaccuacccuccguuuuucuacuagauaggaggaugguagaaguuuggcugcugucauaac

SEQ ID NO: 413860 - RNA, 64 nt, hsa
gagauugggacugugauguugggaccugaggacuggaugguagaauacuggggucccccagcuc

SEQ ID NO: 413861 - RNA, 64 nt, hsa
uuaauguauggauucagauuagacugagaaaaauggaugguauuuucuuaaaauugugccaccu

SEQ ID NO: 413862 - RNA, 64 nt, hsa
aaggguuggaaacuauugauugccaacuuuuuaaggaugguagggauuuuuucuuuguugaaua

SEQ ID NO: 413863 - RNA, 64 nt, hsa
cgugacuuggguggcacccuaucuucuccaucagggaugguagcuauuuuucugccaugagacu

SEQ ID NO: 413864 - RNA, 64 nt, hsa
gcuaaagaaagugugaagaucuuaugaaauagguggaugguaaguugaaauuauugaugugggu

SEQ ID NO: 413865 - RNA, 64 nt, hsa
uugggaggcuguauuucuccuccacccucuuaauggaugguauggcuuugcucacucacuaggc

SEQ ID NO: 413866 - RNA, 64 nt, hsa
accuccccaaauucaaucugagcccagcaggagaggaugguaggguugccagggcucagaagug

SEQ ID NO: 413867 - RNA, 64 nt, hsa
uuuuuuuguuguuguuuuuuuuuugcgggggaggggaugguacagacuaaacguggggaaaaga

SEQ ID NO: 413868 - RNA, 64 nt, hsa
aaauguuaaggcuuauugaaaccuuucaaguaggggaugguacauuuauuucaucugcaaauga

SEQ ID NO: 413869 - RNA, 64 nt, hsa
uaaguggaauuaaaggucuagagugauuuguauuggaugguaacuaaggucuauacaucuacuc

SEQ ID NO: 413870 - RNA, 64 nt, hsa
aucucuguuuuggcaaaauucagguucaggggcuggaugguauguguuucugcugccuuauuca

SEQ ID NO: 413871 - RNA, 64 nt, hsa
auuuucuguguugcaggauggcuucugucuccaaggaugguacauggaaacugugggacacaga

SEQ ID NO: 413872 - RNA, 64 nt, hsa
guauuuuuaacuugaaguuccauuucuuuaucaaggaugguauuuagauuuuuuuccucuuaac

SEQ ID NO: 413873 - RNA, 64 nt, hsa
auuguuuuucccauauugauaugcuggcaauauaggaugguauguaauggacagaacugaugca

SEQ ID NO: 413874 - RNA, 64 nt, hsa
auucugcuuuguccaauuaaauuauuccaauggcggaugguaauauucaccaucucuaauucau

SEQ ID NO: 413875 - RNA, 64 nt, hsa
ggcccccugcggcccuagccugacccggaggaaaggaugguagauucuguuaacucuugaagac

SEQ ID NO: 413876 - RNA, 64 nt, hsa
gcagacaauuuuaggaugugguuuacaguaagguggaugguaccuuauggcaaaaaucucucag

SEQ ID NO: 413877 - RNA, 64 nt, hsa
gagucagaaugaggggacuacacaagcugacagcggaugguaugacucauugggggccauugau

SEQ ID NO: 413878 - RNA, 64 nt, hsa
cacuggcaaucuuccuguuaaccacucuccuuagggaugguaucugaaacaacaauggucaccc

SEQ ID NO: 413879 - RNA, 64 nt, hsa
cauugcuaccaaguuucauaccaaauauuugaaaggaugguauugaaucuaaaaccaaauauua

SEQ ID NO: 413880 - RNA, 64 nt, hsa
uaaugggauuuggccaauuuugguaaugaaguuaggaugguaaugucugcaucugcuaaaggua

SEQ ID NO: 413881 - RNA, 64 nt, hsa
acucugggccaagaccucccacuccgcccucugaggaugguaccaagaaugggccuuugggacu

SEQ ID NO: 413882 - RNA, 64 nt, hsa
uuuuaaauauaaucaauaguaaagacuguucuguggaugguaguguuuaauacauuuucuauuu

SEQ ID NO: 413883 - RNA, 64 nt, hsa
ggcaggcugcuggagccgcccucugaguugcccgggaugguagugccucugaugccagcccugg

SEQ ID NO: 413884 - RNA, 64 nt, hsa
accuagguguaggauauucuucaagcaaauuuguggaugguagaugaaguacuuugcggugcuc

SEQ ID NO: 413885 - RNA, 64 nt, hsa
ugguuuguaaaauccacagcuauauccugaugcuggaugguauuaaucuuguguagucuucaac

SEQ ID NO: 413886 - RNA, 64 nt, hsa
ccuagaauaauacuggcauuaaagaauccuuguuggaugguagaaaucagaucccuaaccagug

SEQ ID NO: 413887 - RNA, 64 nt, hsa
ggggguuugagggugggguaagggauuucuuaggggaugguagaccuuuauuggguaucaagac

SEQ ID NO: 413888 - RNA, 64 nt, hsa
uugcuaacuguggucuuuguggcuacuuguuuguggaugguauuguguuuguuagugaacugug

SEQ ID NO: 413889 - RNA, 64 nt, hsa
acuuugucauuuuugucuuuagaaaagaucugaaggaugguaaagccccgugcugaaacccagu

SEQ ID NO: 413890 - RNA, 64 nt, hsa
agccaccaugcccggcccaaauauuuuuuauucaggaugguauaaccuaacugauaauagguaa

SEQ ID NO: 413891 - RNA, 64 nt, hsa
uuuucucacucccuaucagggauauuuuggggggggaugguaaagggugggcuaaggaacagac

SEQ ID NO: 413892 - RNA, 64 nt, hsa
cccccgaagccaugucacugaaaaggccugggggggaugguauauggcccuuuccccaccaggc

SEQ ID NO: 413893 - RNA, 64 nt, hsa
aaggagguuccuggcuccuguucucagagaaggaggaugguaagguauccaggauuuuuagggg

SEQ ID NO: 413894 - RNA, 53 nt, hsa
cugauccuguugugaaaugauacggaugguauucacugcacauaugaugaaau

SEQ ID NO: 413895 - RNA, 64 nt, hsa
gcuccuuccuagcuagggagaccuuaugagaaguggaugguaggaggagucacuaauguuucaa

SEQ ID NO: 413896 - RNA, 64 nt, hsa
ucuuacugucaucuggacagcuguuuuccuguuuggaugguaaaggaaguugagagucuuuaga

SEQ ID NO: 413897 - RNA, 64 nt, hsa
aggccaaggaacaccggccuguuuaugaggggaaggaugguaccaucgaggacaucaucacagg

SEQ ID NO: 413898 - RNA, 64 nt, hsa
aaugcuuaggagacagaucacuccuggaggcuggggaugguaggauugcuggggauuuuuuuuu

SEQ ID NO: 413899 - RNA, 64 nt, hsa
agaaaaugcagccuuaaacaguguccaggagaugggaugguaccuccuaggaguacaagugccu

SEQ ID NO: 413900 - RNA, 64 nt, hsa
gccuucuaacaauugcuguuuguaaaauaaaucaggaugguagaaagugauuauauggaaaauu

SEQ ID NO: 413901 - RNA, 64 nt, hsa
gguaaagugaauucaaaauccuaguaugcuaaagggaugguacaagucuaacacaaauuguacg

SEQ ID NO: 413902 - RNA, 64 nt, hsa
auuacauaaacgaagcucucaaagcccacauacuggaugguaucaaucuuugcggauacuuugc

SEQ ID NO: 413903 - RNA, 64 nt, hsa
uuauuucccuuguuucucauuuugcccugucaguggaugguagaugcuuuguauaucuuaaauc

SEQ ID NO: 413904 - RNA, 64 nt, hsa
uuguuggugcacagcacaaauuaguuauauauggggaugguaguuuuuucaucuucaguugucu

SEQ ID NO: 413905 - RNA, 64 nt, hsa
aacuaugaacguugaaacaaggacaauuuguguuggaugguauucaaaaggaauuuuuuaaaac

SEQ ID NO: 413906 - RNA, 64 nt, hsa
ugcuucuaaaguaauuuuuguaaguaaugagaugggaugguaaucuaguaauuugacuuuauag

SEQ ID NO: 413907 - RNA, 64 nt, hsa
guaugcugucucuuuuugcaugcacuacuauccaggaugguaaaccugggcuuacauguuacac

SEQ ID NO: 413908 - RNA, 64 nt, hsa
ugacgcagacagaggggauggggauagaggaaagggaugguaaguugagauguuguguggcaau

SEQ ID NO: 413909 - RNA, 64 nt, hsa
ccuucuggucugaacaugggggaguugauugcacggaugguaaggaauauggauaacucacugc

SEQ ID NO: 413910 - RNA, 64 nt, hsa
uuguaagcuuugguguuuguuuaauuagcaauagggaugguaggauucaaaugugugucauuua

SEQ ID NO: 413911 - RNA, 64 nt, hsa
gaauuaaagagagaagccuccuuaaggagccacaggaugguaccuggccccaaaaggaauccug

SEQ ID NO: 413912 - RNA, 64 nt, hsa
uuuggacuugacaaaaauguaugcaaaugaugggggaugguagaaaaaaauuauuuacacaacc

SEQ ID NO: 413913 - RNA, 64 nt, hsa
aacaguuuuaggcuuccaaaggugguaaacuaugggaugguaaauauccgagaggaagcugaug

SEQ ID NO: 413914 - RNA, 64 nt, hsa
augcccgcucuuggggagugaggauucugcacguggaugguacccuuucugugcugggcuccug

SEQ ID NO: 413915 - RNA, 64 nt, hsa
acagcaggugucauauauggggggccaacaccagggaugguacuagggggaagugacaaggccc

SEQ ID NO: 413916 - RNA, 64 nt, hsa
aucucuucuguauuuagguucgacuagugauaguggaugguauugcuuuuccauuucgucauga

SEQ ID NO: 413917 - RNA, 64 nt, hsa
ugacauuaaauaccccuuccacugcucacuuuguggaugguagcaugagcugucuaccaagaag

SEQ ID NO: 413918 - RNA, 64 nt, hsa
caacuaauguacucugcuuuagaaauuggaacaaggaugguacuaccacaaucacccccugcaa

SEQ ID NO: 413919 - RNA, 64 nt, hsa
uccuagggugggaaggggcuagggaggaccaaagggaugguauugagaagagagaaagaagaua

SEQ ID NO: 413920 - RNA, 64 nt, hsa
aacugucucugaagggugaaggcaggccguccugggaugguacccugugcucucccguggagga

SEQ ID NO: 413921 - RNA, 64 nt, hsa
auuuggauauuaagaugcagagggggaggggaagggaugguagagauagacagcucuccccuac

SEQ ID NO: 413922 - RNA, 64 nt, hsa
uuagggccagcccugcgugaacugcaggggcaauggaugguaaagcccuuuggcucuuggcagg

SEQ ID NO: 413923 - RNA, 64 nt, hsa
acagccugccaaucgaagcccgucccugcauccaggaugguaccagcucccgccccucgccccc

SEQ ID NO: 413924 - RNA, 64 nt, hsa
uuugaccuugcugaaaaggaacauauaauuguauggaugguaggauuaaguuguugaguaguuu

SEQ ID NO: 413925 - RNA, 64 nt, hsa
uugggaagauugccuuguagagguagcaugcacaggaugguaaauuggauugguggauccacca

SEQ ID NO: 413926 - RNA, 64 nt, hsa
agguuagucaguuuaaaaauuguucauguuguuuggaugguaucgaaaaccagaaaccacuuuu

SEQ ID NO: 413927 - RNA, 64 nt, hsa
aauuuaggaccgugggucaugcagcgaaggggcuggaugguaggaagggaugugcccgccucuc

SEQ ID NO: 413928 - RNA, 64 nt, hsa
gggacaggccucacuagucuugaggcccagccuaggaugguagucaggggaaggagcgagauuc

SEQ ID NO: 413929 - RNA, 64 nt, hsa; identical to SEQ ID NO: 413928

SEQ ID NO: 413930 - RNA, 64 nt, hsa
cgggggcucacugcuugcacugugcuuaggguagggaugguaaauauccucccugcauggcuuu

SEQ ID NO: 413931 - RNA, 64 nt, hsa
agggagaacacagggacgugccacucgagggggaggaugguauggauuucugcuuuugucacac

SEQ ID NO: 413932 - RNA, 64 nt, hsa
uccuuucauuucuuucucuugugcauuuaauaaaggaugguaucuauaaacaaugcaaaagaug

SEQ ID NO: 413933 - RNA, 64 nt, hsa
gggaggggagagaagagaaggagggaaggauuuaggaugguaaaguuagguacagagaccuccc

SEQ ID NO: 413934 - RNA, 64 nt, hsa
uuuuuccuaacauaccuaagcaaacccagugucaggaugguaauucuuauucuuucguucaguu

SEQ ID NO: 413935 - RNA, 64 nt, hsa
uguaucgacuacauauguauuugacccugugggaggaugguacuuuucuuuuuaacuuuuauuu

SEQ ID NO: 413936 - RNA, 64 nt, hsa
aaaugucuccagauauugccagcuaccccuugagggaugguaccucugguugagaaccauugcu

SEQ ID NO: 413937 - RNA, 64 nt, hsa
cccgccucaugcacugaccacagcccccaggggaggaugguacuggaucuggccccaucuucug

SEQ ID NO: 413938 - RNA, 64 nt, hsa; identical to SEQ ID NO: 226314

SEQ ID NO: 413939 - RNA, 64 nt, hsa; identical to SEQ ID NO: 226315

SEQ ID NO: 413940 - RNA, 64 nt, hsa; identical to SEQ ID NO: 226316

SEQ ID NO: 413941 - RNA, 64 nt, hsa; identical to SEQ ID NO: 226317

SEQ ID NO: 413942 - RNA, 64 nt, hsa; identical to SEQ ID NO: 226318

SEQ ID NO: 413943 - RNA, 64 nt, hsa; identical to SEQ ID NO: 226319

SEQ ID NO: 413944 - RNA, 64 nt, hsa; identical to SEQ ID NO: 226320

SEQ ID NO: 413945 - RNA, 64 nt, hsa; identical to SEQ ID NO: 226321

SEQ ID NO: 413946 - RNA, 64 nt, hsa; identical to SEQ ID NO: 226322

SEQ ID NO: 413947 - RNA, 64 nt, hsa; identical to SEQ ID NO: 226323

SEQ ID NO: 413948 - RNA, 64 nt, hsa; identical to SEQ ID NO: 226324

SEQ ID NO: 413949 - RNA, 64 nt, hsa; identical to SEQ ID NO: 226325

SEQ ID NO: 413950 - RNA, 64 nt, hsa; identical to SEQ ID NO: 226326

SEQ ID NO: 413951 - RNA, 64 nt, hsa; identical to SEQ ID NO: 226327

SEQ ID NO: 413952 - RNA, 64 nt, hsa; identical to SEQ ID NO: 226328

SEQ ID NO: 413953 - RNA, 64 nt, hsa; identical to SEQ ID NO: 226329

SEQ ID NO: 413954 - RNA, 64 nt, hsa; identical to SEQ ID NO: 226330

SEQ ID NO: 413955 - RNA, 64 nt, hsa; identical to SEQ ID NO: 226331

SEQ ID NO: 413956 - RNA, 64 nt, hsa; identical to SEQ ID NO: 226332

SEQ ID NO: 413957 - RNA, 64 nt, hsa; identical to SEQ ID NO: 226333

SEQ ID NO: 413958 - RNA, 64 nt, hsa; identical to SEQ ID NO: 226334

SEQ ID NO: 413959 - RNA, 64 nt, hsa; identical to SEQ ID NO: 226335

SEQ ID NO: 413960 - RNA, 64 nt, hsa; identical to SEQ ID NO: 226336

SEQ ID NO: 413961 - RNA, 64 nt, hsa; identical to SEQ ID NO: 226337

SEQ ID NO: 413962 - RNA, 64 nt, hsa; identical to SEQ ID NO: 226338

SEQ ID NO: 413963 - RNA, 64 nt, hsa; identical to SEQ ID NO: 226339

SEQ ID NO: 413964 - RNA, 64 nt, hsa; identical to SEQ ID NO: 226340

SEQ ID NO: 413965 - RNA, 64 nt, hsa; identical to SEQ ID NO: 226341

SEQ ID NO: 413966 - RNA, 64 nt, hsa
cacauacugaaggcuuuauaugucucaugcauacuuaguguaucaugaauauuugguaucuuug

SEQ ID NO: 413967 - RNA, 64 nt, hsa
ggaacaaggagaaagcaaugauagauuaacacuguuaguguaacgugccaguggaguggaaaga

SEQ ID NO: 413968 - RNA, 64 nt, hsa
ccucuccguuuauuauaaacuguaugcucacaacuuaguguaauauaccagcuuguaugcaaug

SEQ ID NO: 413969 - RNA, 64 nt, hsa
aaucaaaacucacaagugcucaucuguuguagauuuaguguaauaagacuuagauugugcuccu

SEQ ID NO: 413970 - RNA, 64 nt, hsa
uuccuugggugacaaacuuguuugauuacucuauuuaguguaucccaaaguuauuaccacauaa

SEQ ID NO: 413971 - RNA, 64 nt, hsa
aaucuuuaaccgaguauaaguacuugcuguguauuuaguguaaaaguacaugcagaaagaugaa

SEQ ID NO: 413972 - RNA, 64 nt, hsa
gugugccaccacacccggcuaauuuuucguauuuuuaguguagacgggguuucacuauguugcc

SEQ ID NO: 413973 - RNA, 64 nt, hsa
ucucaggcuuacuugauuuuuggcuauuuuauauuuaguguacacagggcuuugaaauauuaau

SEQ ID NO: 413974 - RNA, 64 nt, hsa
aacaguagguaacuuuuccuagguuucacucuuuuuaguguacuagauccagaaacuuagugua

SEQ ID NO: 413975 - RNA, 64 nt, hsa
guuucacucuuuuuaguguacuagauccagaaacuuaguguaaugcccugcuuuauauuucuuu

SEQ ID NO: 413976 - RNA, 64 nt, hsa
uuuucugaguggaugugauuaaauauucagacguuuaguguaugauuaagagugagauagagau

SEQ ID NO: 413977 - RNA, 64 nt, hsa
aaguuuuccuuucagauuuacuguuauguuggcuuuaguguaagacaaggucacugugcugauu

SEQ ID NO: 413978 - RNA, 64 nt, hsa
acaugaacuuguuuuuuuaaucacugaaaggaauuuaguguauaauauguguuuguaacuguga

SEQ ID NO: 413979 - RNA, 64 nt, hsa
uuggcaaauuuuagaagcauuuauugcuuugucuuuaguguaacaagaucacuggauuaaauau

SEQ ID NO: 413980 - RNA, 64 nt, hsa
aguggugcuucuuacccaagcuucaaggaagugcuugggggacccccagccucauccucuuagu

SEQ ID NO: 413981 - RNA, 64 nt, hsa
ucaaacuagccaaaaggcaguuuuggaaacuacauugggggacguuauuuuuauuuauauaugg

SEQ ID NO: 413982 - RNA, 64 nt, hsa
cuaguucuccccgauggggcaucggucuaaagcuuugggggagugggcgcaguggcucacaccu

SEQ ID NO: 413983 - RNA, 64 nt, hsa
gggccggaaggaaugucagggccaggugcagaccuugggggaagacuuuaaaccaccuaguucu

SEQ ID NO: 413984 - RNA, 64 nt, hsa
ucuguagcucuucgagaaagaaaguucaagucauuugggggaaacuuaagaauagucaucaggg

SEQ ID NO: 413985 - RNA, 64 nt, hsa
gaggccauacaucaggggauccccuugacucacuuugggggaaccuuggaagucacaguuuggg

SEQ ID NO: 413986 - RNA, 64 nt, hsa
uauucuauuguauuauuuggaguuagguccucacuugggggaaaaaaaaaaaagaaaagccaag

SEQ ID NO: 413987 - RNA, 64 nt, hsa
accucuagccuuaaggggggcagggagugaugauuugggggaggcuuugggagcaaaauaagga

SEQ ID NO: 413988 - RNA, 64 nt, hsa
augccggcgguuggguggggaggggaaucauugguugggggaagggaggaaaccccaccuccag

SEQ ID NO: 413989 - RNA, 64 nt, hsa
uacaucugacugccugacauggacuccugcccacuugggggaaaccuuauacccagaggaaaau

SEQ ID NO: 413990 - RNA, 64 nt, hsa
uccggggugacgaauuuggccgauggcagauguuuugggggaacgccgggacugagagacucca

SEQ ID NO: 413991 - RNA, 64 nt, hsa
uuugucuuaaaauucaaggccacaaaaacaauguuugggggaaaaaaaagaaaaaaucaugcca

SEQ ID NO: 413992 - RNA, 64 nt, hsa
uauuggggggcaauaaucaacugaauugcaaaauuugggggaaaauggcacuauccguguacga

SEQ ID NO: 413993 - RNA, 64 nt, hsa
guugaucuagaugucuguuuguuguauggaaauuuugggggaaaaaauccaaaacacaaacugu

SEQ ID NO: 413994 - RNA, 64 nt, hsa
guaucuaauuucauccucaccccacccuccaggguugggggagcaggaagcccagauauuugga

SEQ ID NO: 413995 - RNA, 64 nt, hsa
cuguggguuuucuuuccuuuuuguuuuuggugguuugggggaugggaggguuggauugaacagc

SEQ ID NO: 413996 - RNA, 64 nt, hsa
guggugucaggcaaacggacucuguuaguaagaguugggggaggugcccagguggguggaccag

SEQ ID NO: 413997 - RNA, 64 nt, hsa
uucaaaauuagaagaaucaaaaagugauagaauauugggggaaggagggcagacuccaucguuu

SEQ ID NO: 413998 - RNA, 64 nt, hsa
gugugcuggggucuccgaagagggucccuccuuuuugggggaaggucagcccagccccuccaaa

SEQ ID NO: 413999 - RNA, 64 nt, hsa
cucccccgaccuaauugucuuuguucugugauuauugggggacacccggcucccuccagacaau

SEQ ID NO: 414000 - RNA, 64 nt, hsa
ccaaguaaggucugaaccuccgaaugccuuuuauuugggggaacacaaaaccaaacagcagaug

SEQ ID NO: 414001 - RNA, 64 nt, hsa
aaagaaaucacgugccugaaacugugcuuaaguuuugggggaaagauggaguuccuauccagag

SEQ ID NO: 414002 - RNA, 64 nt, hsa
aaccauaacuaggacuuuaucagaaacucaaagcuugggggauaaaaaggagcaagagaauacu

SEQ ID NO: 414003 - RNA, 64 nt, hsa
uucgugcuucauaagccaauucuuauuauuauuuuugggggacucuucuucaaagagcuugcca

SEQ ID NO: 414004 - RNA, 64 nt, hsa
uuccaacuagauagccaugugacguccuggugacuugggggaaaaauuagugaugaaacagcca

SEQ ID NO: 414005 - RNA, 64 nt, hsa
gcuccugccauuucucauuggaagggacuccucuuugggggaggguggauauccaaaccaaaaa

SEQ ID NO: 414006 - RNA, 57 nt, hsa
ucucuugcaggucuccauaaauugucuuugggggauuccaccacacccaaugcucug

SEQ ID NO: 414007 - RNA, 64 nt, hsa
ggggguuuggggugggagggaaugcagaugggaguugggggaggggaggauacaguucaggaua

SEQ ID NO: 414008 - RNA, 64 nt, hsa
auguacuuguccugugaagaguugagugcugugcuugggggagacaccccaccucccuccucca

SEQ ID NO: 414009 - RNA, 64 nt, hsa
agaggggaaacaguccagaguccaacagcagaacuugggggaagcggucgggguggccaggaac

SEQ ID NO: 414010 - RNA, 62 nt, hsa
uuuccaaguuuggagacuagacugaaacuuuuuugggggagggggcaaaggggacuuuuuac

SEQ ID NO: 414011 - RNA, 64 nt, hsa
uaagaaauacuggauuuauaaagcaaauggcuguuugggggauuccaaggauuuaccuaauugu

SEQ ID NO: 414012 - RNA, 64 nt, hsa
gugucacuccccucaccaaucacuccagaugguuuugggggaaccauucuacucuucugguggg

SEQ ID NO: 414013 - RNA, 64 nt, hsa
ggagauggccucucccaagccaggucaaggagguuugggggaggguugccccucugccccucug

SEQ ID NO: 414014 - RNA, 64 nt, hsa
gcuuuuuagaacugcaguucauuguuuuaagggauugggggagggagccuggggacacaaaccu

SEQ ID NO: 414015 - RNA, 64 nt, hsa
gaggcccccuacuagaaggacgugaaagcagcuuuugggggaaacugaggcaguggggaagaca

SEQ ID NO: 414016 - RNA, 64 nt, hsa
ucaccaguggggaaaguacaucugagucaggauuuugggggaaagcuaguuacugauagccaca

SEQ ID NO: 414017 - RNA, 64 nt, hsa
ccugcagcucccacuucuuuagccgggcagcuguuugggggacaagagagggccagggucugug

SEQ ID NO: 414018 - RNA, 64 nt, hsa
ucuacacauaauuaugaauucagaauuuuaaaaauugggggaaaagccauuuauuuagcaaguu

SEQ ID NO: 414019 - RNA, 64 nt, hsa
acuaauuuuucugccuuuuaccaaaaauaaacucuugggggaagaaaaguggauuaacuuuuga

SEQ ID NO: 414020 - RNA, 64 nt, hsa
cuauaaaucaccaaccaacuaucuaaauggacauuugggggaauucccucccaaauuugauuuu

SEQ ID NO: 414021 - RNA, 64 nt, hsa
ggucucuccuucuccuccuccuccuccucuucccuugggggaaaaaaaaaaaugugcuaauaaa

SEQ ID NO: 414022 - RNA, 64 nt, hsa
ggaccucgcagccaggcaaggcugucagguuguuuugggggaagagggggucauggauggcuga

SEQ ID NO: 414023 - RNA, 64 nt, hsa
caugugggccguggggaacucccagagcuaccucuugggggagcgugguggcagcgaugauggg

SEQ ID NO: 414024 - RNA, 64 nt, hsa
guggucucugcauggaccccagggcuguggggacuugggggacaguaaucaaguaauccccuuu

SEQ ID NO: 414025 - RNA, 64 nt, hsa
augauggugggggauggagugucuuccgagguucuugggggaaaaaaaauuguagcauauuuaa

SEQ ID NO: 414026 - RNA, 64 nt, hsa
ggcggggaccugaugggguagcuggggugugggguugggggaugaggucagggggucuugggug

SEQ ID NO: 414027 - RNA, 64 nt, hsa
acuuuuuacaacucaucugcagcuccgggugcgguugggggagauagcgaagggucuggccucg

SEQ ID NO: 414028 - RNA, 64 nt, hsa
gagccagaaaauuaacugaaaagcaguuuagacauugggggaggcuggaucucucgagcugucu

SEQ ID NO: 414029 - RNA, 64 nt, hsa
gaaagaagcaguuuacucuagacuaaagaguauauugggggaggaagagagggaggcacguagg

SEQ ID NO: 414030 - RNA, 64 nt, hsa; identical to SEQ ID NO: 364943

SEQ ID NO: 414031 - RNA, 64 nt, hsa; identical to SEQ ID NO: 364944

SEQ ID NO: 414032 - RNA, 64 nt, hsa; identical to SEQ ID NO: 364945

SEQ ID NO: 414033 - RNA, 64 nt, hsa; identical to SEQ ID NO: 364946

SEQ ID NO: 414034 - RNA, 64 nt, hsa; identical to SEQ ID NO: 364947

SEQ ID NO: 414035 - RNA, 64 nt, hsa; identical to SEQ ID NO: 364948

SEQ ID NO: 414036 - RNA, 64 nt, hsa; identical to SEQ ID NO: 364949

SEQ ID NO: 414037 - RNA, 64 nt, hsa; identical to SEQ ID NO: 364950

SEQ ID NO: 414038 - RNA, 64 nt, hsa; identical to SEQ ID NO: 364951

SEQ ID NO: 414039 - RNA, 64 nt, hsa; identical to SEQ ID NO: 364952

SEQ ID NO: 414040 - RNA, 64 nt, hsa; identical to SEQ ID NO: 364953

SEQ ID NO: 414041 - RNA, 64 nt, hsa; identical to SEQ ID NO: 364954

SEQ ID NO: 414042 - RNA, 64 nt, hsa; identical to SEQ ID NO: 364955

SEQ ID NO: 414043 - RNA, 64 nt, hsa; identical to SEQ ID NO: 364956

SEQ ID NO: 414044 - RNA, 64 nt, hsa; identical to SEQ ID NO: 364957

SEQ ID NO: 414045 - RNA, 64 nt, hsa; identical to SEQ ID NO: 364958

SEQ ID NO: 414046 - RNA, 64 nt, hsa; identical to SEQ ID NO: 364959

SEQ ID NO: 414047 - RNA, 64 nt, hsa; identical to SEQ ID NO: 364960

SEQ ID NO: 414048 - RNA, 64 nt, hsa; identical to SEQ ID NO: 364961

SEQ ID NO: 414049 - RNA, 64 nt, hsa; identical to SEQ ID NO: 364962

SEQ ID NO: 414050 - RNA, 64 nt, hsa; identical to SEQ ID NO: 364963

SEQ ID NO: 414051 - RNA, 64 nt, hsa; identical to SEQ ID NO: 364964

SEQ ID NO: 414052 - RNA, 64 nt, hsa
acuuuuccuccucuauuaaacaugggaaacugaagcccuugaagguuuggggagagggggguau

SEQ ID NO: 414053 - RNA, 64 nt, hsa
uggauuuuaggcucauuugcccucucagccaacugcccuugagcaguguacagccugcucaaca

SEQ ID NO: 414054 - RNA, 64 nt, hsa
gaaguugugaucccucacucacccugcuagcuuugcccuugacucgucuucucugaaccucagc

SEQ ID NO: 414055 - RNA, 64 nt, hsa
acagccccaucaguccaggaacuucccaccaccagcccuugacugucccauuaacugacauggu

SEQ ID NO: 414056 - RNA, 64 nt, hsa
uggauacucugaggccugguuugucaggcaauaugcccuugagcaggucacccccugggaaugg

SEQ ID NO: 414057 - RNA, 64 nt, hsa
cccugcugcccagcucagacucuaagcucaacaagcccuugagcccccagaaggagaccgcuaa

SEQ ID NO: 414058 - RNA, 64 nt, hsa
gcucuuaucggcucauaugagagagcagguuccugcccuugaaaaugccgguaagcuauagcau

SEQ ID NO: 414059 - RNA, 64 nt, hsa
cuucugucccuuucuucccccccccacgagucuugcccuugacuucugcucuggauucacucuu

SEQ ID NO: 414060 - RNA, 64 nt, hsa; identical to SEQ ID NO: 56599

SEQ ID NO: 414061 - RNA, 64 nt, hsa; identical to SEQ ID NO: 56600

SEQ ID NO: 414062 - RNA, 64 nt, hsa; identical to SEQ ID NO: 56601

SEQ ID NO: 414063 - RNA, 64 nt, hsa; identical to SEQ ID NO: 56602

SEQ ID NO: 414064 - RNA, 64 nt, hsa; identical to SEQ ID NO: 56603

SEQ ID NO: 414065 - RNA, 64 nt, hsa; identical to SEQ ID NO: 56604

SEQ ID NO: 414066 - RNA, 64 nt, hsa; identical to SEQ ID NO: 56605

SEQ ID NO: 414067 - RNA, 64 nt, hsa; identical to SEQ ID NO: 56606

SEQ ID NO: 414068 - RNA, 64 nt, hsa; identical to SEQ ID NO: 56607

SEQ ID NO: 414069 - RNA, 64 nt, hsa; identical to SEQ ID NO: 56608

SEQ ID NO: 414070 - RNA, 64 nt, hsa; identical to SEQ ID NO: 56609

SEQ ID NO: 414071 - RNA, 64 nt, hsa; identical to SEQ ID NO: 56610

SEQ ID NO: 414072 - RNA, 64 nt, hsa; identical to SEQ ID NO: 56611

SEQ ID NO: 414073 - RNA, 64 nt, hsa; identical to SEQ ID NO: 56612

SEQ ID NO: 414074 - RNA, 64 nt, hsa; identical to SEQ ID NO: 56613

SEQ ID NO: 414075 - RNA, 64 nt, hsa; identical to SEQ ID NO: 56614

SEQ ID NO: 414076 - RNA, 64 nt, hsa; identical to SEQ ID NO: 56615

SEQ ID NO: 414077 - RNA, 64 nt, hsa; identical to SEQ ID NO: 56616

SEQ ID NO: 414078 - RNA, 64 nt, hsa; identical to SEQ ID NO: 56617

SEQ ID NO: 414079 - RNA, 64 nt, hsa; identical to SEQ ID NO: 56618

SEQ ID NO: 414080 - RNA, 64 nt, hsa; identical to SEQ ID NO: 56619

SEQ ID NO: 414081 - RNA, 64 nt, hsa; identical to SEQ ID NO: 56620

SEQ ID NO: 414082 - RNA, 64 nt, hsa; identical to SEQ ID NO: 56621

SEQ ID NO: 414083 - RNA, 64 nt, hsa; identical to SEQ ID NO: 56622

SEQ ID NO: 414084 - RNA, 64 nt, hsa; identical to SEQ ID NO: 56623

SEQ ID NO: 414085 - RNA, 64 nt, hsa; identical to SEQ ID NO: 56624

SEQ ID NO: 414086 - RNA, 64 nt, hsa; identical to SEQ ID NO: 56625

SEQ ID NO: 414087 - RNA, 64 nt, hsa; identical to SEQ ID NO: 56626

SEQ ID NO: 414088 - RNA, 64 nt, hsa; identical to SEQ ID NO: 56627

SEQ ID NO: 414089 - RNA, 64 nt, hsa; identical to SEQ ID NO: 56628

SEQ ID NO: 414090 - RNA, 64 nt, hsa; identical to SEQ ID NO: 56629

SEQ ID NO: 414091 - RNA, 64 nt, hsa; identical to SEQ ID NO: 56630

SEQ ID NO: 414092 - RNA, 64 nt, hsa; identical to SEQ ID NO: 56631

SEQ ID NO: 414093 - RNA, 64 nt, hsa; identical to SEQ ID NO: 56632

SEQ ID NO: 414094 - RNA, 64 nt, hsa; identical to SEQ ID NO: 56633

SEQ ID NO: 414095 - RNA, 64 nt, hsa; identical to SEQ ID NO: 56634

SEQ ID NO: 414096 - RNA, 64 nt, hsa; identical to SEQ ID NO: 56635

SEQ ID NO: 414097 - RNA, 64 nt, hsa; identical to SEQ ID NO: 56636

SEQ ID NO: 414098 - RNA, 64 nt, hsa; identical to SEQ ID NO: 56637

SEQ ID NO: 414099 - RNA, 64 nt, hsa; identical to SEQ ID NO: 56638

SEQ ID NO: 414100 - RNA, 64 nt, hsa; identical to SEQ ID NO: 56639

SEQ ID NO: 414101 - RNA, 64 nt, hsa; identical to SEQ ID NO: 56640

SEQ ID NO: 414102 - RNA, 64 nt, hsa; identical to SEQ ID NO: 56641

SEQ ID NO: 414103 - RNA, 64 nt, hsa; identical to SEQ ID NO: 56642

SEQ ID NO: 414104 - RNA, 64 nt, hsa; identical to SEQ ID NO: 56643

SEQ ID NO: 414105 - RNA, 64 nt, hsa; identical to SEQ ID NO: 56644

SEQ ID NO: 414106 - RNA, 64 nt, hsa; identical to SEQ ID NO: 56645

SEQ ID NO: 414107 - RNA, 64 nt, hsa; identical to SEQ ID NO: 56646

SEQ ID NO: 414108 - RNA, 64 nt, hsa; identical to SEQ ID NO: 56647

SEQ ID NO: 414109 - RNA, 64 nt, hsa; identical to SEQ ID NO: 56648

SEQ ID NO: 414110 - RNA, 64 nt, hsa; identical to SEQ ID NO: 56649

SEQ ID NO: 414111 - RNA, 64 nt, hsa; identical to SEQ ID NO: 56650

SEQ ID NO: 414112 - RNA, 64 nt, hsa; identical to SEQ ID NO: 56651

SEQ ID NO: 414113 - RNA, 64 nt, hsa; identical to SEQ ID NO: 56652

SEQ ID NO: 414114 - RNA, 64 nt, hsa; identical to SEQ ID NO: 56653

SEQ ID NO: 414115 - RNA, 64 nt, hsa; identical to SEQ ID NO: 56654

SEQ ID NO: 414116 - RNA, 64 nt, hsa; identical to SEQ ID NO: 56655

SEQ ID NO: 414117 - RNA, 64 nt, hsa; identical to SEQ ID NO: 56656

SEQ ID NO: 414118 - RNA, 64 nt, hsa; identical to SEQ ID NO: 56657

SEQ ID NO: 414119 - RNA, 64 nt, hsa; identical to SEQ ID NO: 56658

SEQ ID NO: 414120 - RNA, 64 nt, hsa; identical to SEQ ID NO: 56659

SEQ ID NO: 414121 - RNA, 64 nt, hsa; identical to SEQ ID NO: 56660

SEQ ID NO: 414122 - RNA, 64 nt, hsa; identical to SEQ ID NO: 56661

SEQ ID NO: 414123 - RNA, 64 nt, hsa; identical to SEQ ID NO: 56662

SEQ ID NO: 414124 - RNA, 64 nt, hsa; identical to SEQ ID NO: 56663

SEQ ID NO: 414125 - RNA, 64 nt, hsa; identical to SEQ ID NO: 56664

SEQ ID NO: 414126 - RNA, 64 nt, hsa; identical to SEQ ID NO: 56665

SEQ ID NO: 414127 - RNA, 64 nt, hsa; identical to SEQ ID NO: 56666

SEQ ID NO: 414128 - RNA, 64 nt, hsa; identical to SEQ ID NO: 56667

SEQ ID NO: 414129 - RNA, 64 nt, hsa; identical to SEQ ID NO: 56668

SEQ ID NO: 414130 - RNA, 64 nt, hsa; identical to SEQ ID NO: 56669

SEQ ID NO: 414131 - RNA, 64 nt, hsa; identical to SEQ ID NO: 56670

SEQ ID NO: 414132 - RNA, 64 nt, hsa; identical to SEQ ID NO: 56671

SEQ ID NO: 414133 - RNA, 64 nt, hsa; identical to SEQ ID NO: 56672

SEQ ID NO: 414134 - RNA, 64 nt, hsa; identical to SEQ ID NO: 56673

SEQ ID NO: 414135 - RNA, 64 nt, hsa; identical to SEQ ID NO: 56674

SEQ ID NO: 414136 - RNA, 64 nt, hsa; identical to SEQ ID NO: 56675

SEQ ID NO: 414137 - RNA, 64 nt, hsa; identical to SEQ ID NO: 56676

SEQ ID NO: 414138 - RNA, 64 nt, hsa; identical to SEQ ID NO: 56677

SEQ ID NO: 414139 - RNA, 64 nt, hsa; identical to SEQ ID NO: 56678

SEQ ID NO: 414140 - RNA, 64 nt, hsa; identical to SEQ ID NO: 56679

SEQ ID NO: 414141 - RNA, 64 nt, hsa; identical to SEQ ID NO: 56680

SEQ ID NO: 414142 - RNA, 64 nt, hsa; identical to SEQ ID NO: 56681

SEQ ID NO: 414143 - RNA, 64 nt, hsa; identical to SEQ ID NO: 56682

SEQ ID NO: 414144 - RNA, 64 nt, hsa; identical to SEQ ID NO: 56683

SEQ ID NO: 414145 - RNA, 64 nt, hsa; identical to SEQ ID NO: 56684

SEQ ID NO: 414146 - RNA, 64 nt, hsa; identical to SEQ ID NO: 56685

SEQ ID NO: 414147 - RNA, 64 nt, hsa; identical to SEQ ID NO: 56686

SEQ ID NO: 414148 - RNA, 64 nt, hsa; identical to SEQ ID NO: 56687

SEQ ID NO: 414149 - RNA, 64 nt, hsa; identical to SEQ ID NO: 56688

SEQ ID NO: 414150 - RNA, 64 nt, hsa; identical to SEQ ID NO: 56689

SEQ ID NO: 414151 - RNA, 64 nt, hsa; identical to SEQ ID NO: 56690

SEQ ID NO: 414152 - RNA, 64 nt, hsa; identical to SEQ ID NO: 56691

SEQ ID NO: 414153 - RNA, 64 nt, hsa; identical to SEQ ID NO: 56692

SEQ ID NO: 414154 - RNA, 64 nt, hsa; identical to SEQ ID NO: 56693

SEQ ID NO: 414155 - RNA, 64 nt, hsa; identical to SEQ ID NO: 56694

SEQ ID NO: 414156 - RNA, 64 nt, hsa; identical to SEQ ID NO: 56695

SEQ ID NO: 414157 - RNA, 64 nt, hsa; identical to SEQ ID NO: 56696

SEQ ID NO: 414158 - RNA, 64 nt, hsa; identical to SEQ ID NO: 56697

SEQ ID NO: 414159 - RNA, 64 nt, hsa; identical to SEQ ID NO: 56698

SEQ ID NO: 414160 - RNA, 64 nt, hsa; identical to SEQ ID NO: 56699

SEQ ID NO: 414161 - RNA, 64 nt, hsa; identical to SEQ ID NO: 56700

SEQ ID NO: 414162 - RNA, 64 nt, hsa; identical to SEQ ID NO: 56701

SEQ ID NO: 414163 - RNA, 64 nt, hsa; identical to SEQ ID NO: 56702

SEQ ID NO: 414164 - RNA, 64 nt, hsa; identical to SEQ ID NO: 56703

SEQ ID NO: 414165 - RNA, 64 nt, hsa; identical to SEQ ID NO: 56704

SEQ ID NO: 414166 - RNA, 64 nt, hsa; identical to SEQ ID NO: 56705

SEQ ID NO: 414167 - RNA, 64 nt, hsa; identical to SEQ ID NO: 56706

SEQ ID NO: 414168 - RNA, 64 nt, hsa; identical to SEQ ID NO: 56707

SEQ ID NO: 414169 - RNA, 64 nt, hsa; identical to SEQ ID NO: 56708

SEQ ID NO: 414170 - RNA, 64 nt, hsa; identical to SEQ ID NO: 56709

SEQ ID NO: 414171 - RNA, 64 nt, hsa; identical to SEQ ID NO: 56710

SEQ ID NO: 414172 - RNA, 64 nt, hsa; identical to SEQ ID NO: 56711

SEQ ID NO: 414173 - RNA, 64 nt, hsa; identical to SEQ ID NO: 56712

SEQ ID NO: 414174 - RNA, 64 nt, hsa; identical to SEQ ID NO: 56713

SEQ ID NO: 414175 - RNA, 64 nt, hsa; identical to SEQ ID NO: 56714

SEQ ID NO: 414176 - RNA, 64 nt, hsa; identical to SEQ ID NO: 56715

SEQ ID NO: 414177 - RNA, 64 nt, hsa; identical to SEQ ID NO: 56716

SEQ ID NO: 414178 - RNA, 64 nt, hsa; identical to SEQ ID NO: 56717

SEQ ID NO: 414179 - RNA, 64 nt, hsa; identical to SEQ ID NO: 56718

SEQ ID NO: 414180 - RNA, 64 nt, hsa; identical to SEQ ID NO: 56719

SEQ ID NO: 414181 - RNA, 64 nt, hsa; identical to SEQ ID NO: 56720

SEQ ID NO: 414182 - RNA, 64 nt, hsa; identical to SEQ ID NO: 56721

SEQ ID NO: 414183 - RNA, 64 nt, hsa; identical to SEQ ID NO: 56722

SEQ ID NO: 414184 - RNA, 64 nt, hsa; identical to SEQ ID NO: 56723

SEQ ID NO: 414185 - RNA, 64 nt, hsa; identical to SEQ ID NO: 56724

SEQ ID NO: 414186 - RNA, 64 nt, hsa; identical to SEQ ID NO: 56725

SEQ ID NO: 414187 - RNA, 64 nt, hsa; identical to SEQ ID NO: 56726

SEQ ID NO: 414188 - RNA, 64 nt, hsa; identical to SEQ ID NO: 56727

SEQ ID NO: 414189 - RNA, 64 nt, hsa; identical to SEQ ID NO: 56728

SEQ ID NO: 414190 - RNA, 64 nt, hsa; identical to SEQ ID NO: 56729

SEQ ID NO: 414191 - RNA, 64 nt, hsa; identical to SEQ ID NO: 56730

SEQ ID NO: 414192 - RNA, 64 nt, hsa; identical to SEQ ID NO: 56731

SEQ ID NO: 414193 - RNA, 64 nt, hsa; identical to SEQ ID NO: 56732

SEQ ID NO: 414194 - RNA, 64 nt, hsa; identical to SEQ ID NO: 56733

SEQ ID NO: 414195 - RNA, 64 nt, hsa; identical to SEQ ID NO: 56734

SEQ ID NO: 414196 - RNA, 64 nt, hsa; identical to SEQ ID NO: 56735

SEQ ID NO: 414197 - RNA, 64 nt, hsa; identical to SEQ ID NO: 56736

SEQ ID NO: 414198 - RNA, 64 nt, hsa; identical to SEQ ID NO: 56737

SEQ ID NO: 414199 - RNA, 64 nt, hsa; identical to SEQ ID NO: 56738

SEQ ID NO: 414200 - RNA, 64 nt, hsa; identical to SEQ ID NO: 56739

SEQ ID NO: 414201 - RNA, 64 nt, hsa; identical to SEQ ID NO: 56740

SEQ ID NO: 414202 - RNA, 64 nt, hsa; identical to SEQ ID NO: 56741

SEQ ID NO: 414203 - RNA, 64 nt, hsa; identical to SEQ ID NO: 56742

SEQ ID NO: 414204 - RNA, 64 nt, hsa; identical to SEQ ID NO: 56743

SEQ ID NO: 414205 - RNA, 64 nt, hsa; identical to SEQ ID NO: 56744

SEQ ID NO: 414206 - RNA, 64 nt, hsa; identical to SEQ ID NO: 56745

SEQ ID NO: 414207 - RNA, 64 nt, hsa; identical to SEQ ID NO: 56746

SEQ ID NO: 414208 - RNA, 64 nt, hsa; identical to SEQ ID NO: 56747

SEQ ID NO: 414209 - RNA, 64 nt, hsa; identical to SEQ ID NO: 56748

SEQ ID NO: 414210 - RNA, 64 nt, hsa; identical to SEQ ID NO: 56749

SEQ ID NO: 414211 - RNA, 64 nt, hsa; identical to SEQ ID NO: 56750

SEQ ID NO: 414212 - RNA, 64 nt, hsa; identical to SEQ ID NO: 56751

SEQ ID NO: 414213 - RNA, 64 nt, hsa; identical to SEQ ID NO: 56752

SEQ ID NO: 414214 - RNA, 64 nt, hsa; identical to SEQ ID NO: 56753

SEQ ID NO: 414215 - RNA, 64 nt, hsa; identical to SEQ ID NO: 56754

SEQ ID NO: 414216 - RNA, 64 nt, hsa; identical to SEQ ID NO: 56755

SEQ ID NO: 414217 - RNA, 64 nt, hsa; identical to SEQ ID NO: 56618

SEQ ID NO: 414218 - RNA, 64 nt, hsa; identical to SEQ ID NO: 56757

SEQ ID NO: 414219 - RNA, 64 nt, hsa; identical to SEQ ID NO: 56758

SEQ ID NO: 414220 - RNA, 64 nt, hsa; identical to SEQ ID NO: 56759

SEQ ID NO: 414221 - RNA, 64 nt, hsa; identical to SEQ ID NO: 56760

SEQ ID NO: 414222 - RNA, 64 nt, hsa; identical to SEQ ID NO: 56761

SEQ ID NO: 414223 - RNA, 64 nt, hsa; identical to SEQ ID NO: 100727

SEQ ID NO: 414224 - RNA, 64 nt, hsa; identical to SEQ ID NO: 100728

SEQ ID NO: 414225 - RNA, 64 nt, hsa; identical to SEQ ID NO: 100729

SEQ ID NO: 414226 - RNA, 64 nt, hsa; identical to SEQ ID NO: 100730

SEQ ID NO: 414227 - RNA, 64 nt, hsa; identical to SEQ ID NO: 100731

SEQ ID NO: 414228 - RNA, 64 nt, hsa; identical to SEQ ID NO: 100732

SEQ ID NO: 414229 - RNA, 64 nt, hsa; identical to SEQ ID NO: 210768

SEQ ID NO: 414230 - RNA, 64 nt, hsa; identical to SEQ ID NO: 210769

SEQ ID NO: 414231 - RNA, 64 nt, hsa; identical to SEQ ID NO: 210770

SEQ ID NO: 414232 - RNA, 64 nt, hsa; identical to SEQ ID NO: 210771

SEQ ID NO: 414233 - RNA, 64 nt, hsa; identical to SEQ ID NO: 210772

SEQ ID NO: 414234 - RNA, 64 nt, hsa; identical to SEQ ID NO: 210773

SEQ ID NO: 414235 - RNA, 64 nt, hsa; identical to SEQ ID NO: 210774

SEQ ID NO: 414236 - RNA, 64 nt, hsa; identical to SEQ ID NO: 210775

SEQ ID NO: 414237 - RNA, 64 nt, hsa; identical to SEQ ID NO: 210776

SEQ ID NO: 414238 - RNA, 64 nt, hsa; identical to SEQ ID NO: 210777

SEQ ID NO: 414239 - RNA, 64 nt, hsa; identical to SEQ ID NO: 210778

SEQ ID NO: 414240 - RNA, 64 nt, hsa; identical to SEQ ID NO: 210779

SEQ ID NO: 414241 - RNA, 64 nt, hsa; identical to SEQ ID NO: 210780

SEQ ID NO: 414242 - RNA, 64 nt, hsa; identical to SEQ ID NO: 210781

SEQ ID NO: 414243 - RNA, 64 nt, hsa; identical to SEQ ID NO: 210782

SEQ ID NO: 414244 - RNA, 64 nt, hsa; identical to SEQ ID NO: 210783

SEQ ID NO: 414245 - RNA, 64 nt, hsa; identical to SEQ ID NO: 210784

SEQ ID NO: 414246 - RNA, 64 nt, hsa; identical to SEQ ID NO: 210785

SEQ ID NO: 414247 - RNA, 64 nt, hsa; identical to SEQ ID NO: 210786

SEQ ID NO: 414248 - RNA, 64 nt, hsa; identical to SEQ ID NO: 210787

SEQ ID NO: 414249 - RNA, 64 nt, hsa; identical to SEQ ID NO: 210788

SEQ ID NO: 414250 - RNA, 64 nt, hsa; identical to SEQ ID NO: 210789

SEQ ID NO: 414251 - RNA, 64 nt, hsa; identical to SEQ ID NO: 210790

SEQ ID NO: 414252 - RNA, 64 nt, hsa; identical to SEQ ID NO: 210791

SEQ ID NO: 414253 - RNA, 64 nt, hsa; identical to SEQ ID NO: 210792

SEQ ID NO: 414254 - RNA, 64 nt, hsa; identical to SEQ ID NO: 210793

SEQ ID NO: 414255 - RNA, 64 nt, hsa; identical to SEQ ID NO: 210794

SEQ ID NO: 414256 - RNA, 64 nt, hsa; identical to SEQ ID NO: 210795

SEQ ID NO: 414257 - RNA, 64 nt, hsa; identical to SEQ ID NO: 210796

SEQ ID NO: 414258 - RNA, 64 nt, hsa; identical to SEQ ID NO: 210797

SEQ ID NO: 414259 - RNA, 64 nt, hsa; identical to SEQ ID NO: 210798

SEQ ID NO: 414260 - RNA, 64 nt, hsa; identical to SEQ ID NO: 210799

SEQ ID NO: 414261 - RNA, 64 nt, hsa; identical to SEQ ID NO: 210800

SEQ ID NO: 414262 - RNA, 64 nt, hsa; identical to SEQ ID NO: 210801

SEQ ID NO: 414263 - RNA, 64 nt, hsa; identical to SEQ ID NO: 210802

SEQ ID NO: 414264 - RNA, 64 nt, hsa; identical to SEQ ID NO: 210803

SEQ ID NO: 414265 - RNA, 64 nt, hsa; identical to SEQ ID NO: 210804

SEQ ID NO: 414266 - RNA, 64 nt, hsa; identical to SEQ ID NO: 210805

SEQ ID NO: 414267 - RNA, 64 nt, hsa; identical to SEQ ID NO: 210806

SEQ ID NO: 414268 - RNA, 64 nt, hsa; identical to SEQ ID NO: 210807

SEQ ID NO: 414269 - RNA, 64 nt, hsa; identical to SEQ ID NO: 210808

SEQ ID NO: 414270 - RNA, 64 nt, hsa; identical to SEQ ID NO: 210809

SEQ ID NO: 414271 - RNA, 64 nt, hsa
gaaaaaaucuguccuuuaacaagcuauucuguuuugugucaauugguucguggcaggaagcuau

SEQ ID NO: 414272 - RNA, 64 nt, hsa
guuuuuuuuuuuuuuaacauucugaagauggugcugugucaagaaggaccuuuuuuuuccccuc

SEQ ID NO: 414273 - RNA, 64 nt, hsa
uuugugcauuuuacuauugauauauauguuaaauugugucaaauauauaugucaaauucccucc

SEQ ID NO: 414274 - RNA, 64 nt, hsa
uguacauaugacauguguauaugccuaugguauaugugucaauuuauguguccccuuacauaua

SEQ ID NO: 414275 - RNA, 64 nt, hsa
uguaggcaucacugccucagcuguuaaggagaccugugucaaaacuuacauccacauuccuaca

SEQ ID NO: 414276 - RNA, 64 nt, hsa
ugcugcgaagcauggaccccaguguuguugugggugugucaaauccccuuucauccucaagagc

SEQ ID NO: 414277 - RNA, 64 nt, hsa
ccuccacggggcugugucaaaugcccucccacauugugucaagucugcccauggcccacccucc

SEQ ID NO: 414278 - RNA, 64 nt, hsa
aaggccuccccgagcauuagguccuccacggggcugugucaaaugcccucccacauugugucaa

SEQ ID NO: 414279 - RNA, 64 nt, hsa
gcacaaagcagaggcugugggcugucacagaugcugugucaaccagggcccuagggcuaagggc

SEQ ID NO: 414280 - RNA, 64 nt, hsa
uccccaggaauucacuuaaaaagggacugagcauugugucaaccuguugcaguguuuuucauau

SEQ ID NO: 414281 - RNA, 64 nt, hsa
uuauuuuuuaucauuugaacugauaagcacuuuuugugucaauauaaaauauacuaaaacugau

SEQ ID NO: 414282 - RNA, 64 nt, hsa
aauguaguacuggggauaacuuaauauccuauguugugucaagacucuuugaagacuuucuuga

SEQ ID NO: 414283 - RNA, 64 nt, hsa
gcuaauacuguaaugguggaaugugggacacauaugugucaauucaguuuccuuagaccagugc

SEQ ID NO: 414284 - RNA, 64 nt, hsa
guuaaccuaagcacauacacagcaauugcucgacugugucaauuaaaugaguaaaggaagccca

SEQ ID NO: 414285 - RNA, 63 nt, hsa
ggaggggcgauguggcuggggagcuagggagagacucuggagguggugggucucucgggagac

SEQ ID NO: 414286 - RNA, 63 nt, hsa
cuggaaugcaaguccuucuucccuuuggaauguacucuggaucccuuccccugcuuugacccc

SEQ ID NO: 414287 - RNA, 63 nt, hsa
ucuccgcuggcuuugaaucuuccucugggcucuacucuggagaacauaagggcugcugugguu

SEQ ID NO: 414288 - RNA, 63 nt, hsa
ggcccagggaagccccugguucugucccuggagacucuggaaauccuuuugcauuaaaaggac

SEQ ID NO: 414289 - RNA, 63 nt, hsa
cggaugugguggcaggugccuguagucccagcuacucuggaggcugaggcaggagaauggcgu

SEQ ID NO: 414290 - RNA, 63 nt, hsa
aagaauacaaaugcuccaacauuauuuuuuauaacucuggauuaccgaugcugagaugugugc

SEQ ID NO: 414291 - RNA, 63 nt, hsa
auuaucuccacuuucaaucucccuccaagcucuacucuggaggagucugucccacucugucaa

SEQ ID NO: 414292 - RNA, 63 nt, hsa
uuucuuacucccaaaaaagaaugaacaccccugacucuggagugguguauacugccacaucag

SEQ ID NO: 414293 - RNA, 63 nt, hsa
cuuuccacucuggauucagccuucuuuuucuggacucuggacuuucucuaauaauaaauaguu

SEQ ID NO: 414294 - RNA, 63 nt, hsa
ugcacccuccuagggcauuguaucugucuuuccacucuggauucagccuucuuuuucuggacu

SEQ ID NO: 414295 - RNA, 63 nt, hsa
cuugcccucuccucaccuccuuuucucucagugacucuggaaccugaaugcagcuuacaagac

SEQ ID NO: 414296 - RNA, 63 nt, hsa
caggagcuagcagaaaauaacucaaaguugaagacucuggaagauuuugcuuuaaccuaacuc

SEQ ID NO: 414297 - RNA, 63 nt, hsa
uguccuguuaaauuuacaacacuaacgauguagacucuggaaaugccuaauaagucaaagaag

SEQ ID NO: 414298 - RNA, 63 nt, hsa
ugagguucucuuuuucuuggugcuuuauuagcaacucuggauauuuuuauaaaacuaguuaca

SEQ ID NO: 414299 - RNA, 63 nt, hsa
augggccugugacaccccaaagagaagaaggggacucuggauaggguccccacauccagggcg

SEQ ID NO: 414300 - RNA, 63 nt, hsa
cagucuguggccguggucuuagcccccaguuccacucuggaugggccugugacaccccaaaga

SEQ ID NO: 414301 - RNA, 63 nt, hsa
caggcaugguggugcgcaccuguagucccagcuacucuggaggcugaggcaggggaauggcuc

SEQ ID NO: 414302 - RNA, 63 nt, hsa
ggcccaguuuauuucguaugcaugaaagaacucacucuggagagaaacuauaugaauguaagc

SEQ ID NO: 414303 - RNA, 63 nt, hsa
acucuggaaccucugugacgccaguucucccugacucuggaaccucugugauccuuugcaggu

SEQ ID NO: 414304 - RNA, 63 nt, hsa
auuucacucagcugcuccucucaguucucccugacucuggaaccucugugacgccaguucucc

SEQ ID NO: 414305 - RNA, 64 nt, hsa
ugcuuuaagcucaugugucaggcagacuuuaccagagugucagacauuaccuaaaacacauacg

SEQ ID NO: 414306 - RNA, 64 nt, hsa
gaucuucagaucuuucucucuggaaaugugcagagagugucaguuucccaaguucugagguaac

SEQ ID NO: 414307 - RNA, 62 nt, hsa
cagcugcuuuugaggagaaaauauauagcuuuggacacgaggaagaucuagaaaauuaucau

SEQ ID NO: 414308 - RNA, 62 nt, hsa
aggaacguggaggguuauuacugcgggagaagggacacgaggauggcuuugcuuccccuugc

SEQ ID NO: 414309 - RNA, 62 nt, hsa
cagcugagcaaaaacauugagucgcucucaaaggacacgaggcccuuggcagggaauauuua

SEQ ID NO: 414310 - RNA, 62 nt, hsa
augccaagagcucuggagguucuugaaagaggggacacgaaggaggagugacugggaagccu

SEQ ID NO: 414311 - RNA, 62 nt, hsa
ucaggagugagauuuucggguucugaaaccugggacacgagucugugaauagucgguuuucu

SEQ ID NO: 414312 - RNA, 62 nt, hsa
gagcgagggcagcggaaaggaguucuuccgggggacacgaauugccuggcugaguagcaaga

SEQ ID NO: 414313 - RNA, 62 nt, hsa
ucgugauguggaggaagagccaccugcaagauggacacgagccacaagcugcacugugaacc

SEQ ID NO: 414314 - RNA, 62 nt, hsa
uaguuaugaaaauauauugaaggacaggaaguggacacgaagugauuuuuguaaccugagca

SEQ ID NO: 414315 - RNA, 62 nt, hsa
caggccuggacccagagacgucccccaucgugggacacgacacacccagaccgcgugcccca

SEQ ID NO: 414316 - RNA, 62 nt, hsa
acccugucccucgguggccuccccaggccccuggacacgacaguucuccucaggcagguggg

SEQ ID NO: 414317 - RNA, 62 nt, hsa
acauuucuuuacaaaggaggccuguagaaauuggacacgaucaugcuugagcaugugaguua

SEQ ID NO: 414318 - RNA, 62 nt, hsa
gacguggugcaauuuugaugagaugucucuggggacacgaggaugcccuaaugaugcugacu

SEQ ID NO: 414319 - RNA, 62 nt, hsa
aagauacugucggguuuuuccauucagcaauaggacacgaaaggcauagaaggagaagacaa

SEQ ID NO: 414320 - RNA, 62 nt, hsa
gguggccuccaggcucaaugcagaaaccccaaggacacgaguggggccaggugaguuccuga

SEQ ID NO: 414321 - RNA, 62 nt, hsa
cagcagcgggagcuaggggcgggggcggaggaggacacgaacuggaaggggguucacgguca

SEQ ID NO: 414322 - RNA, 62 nt, hsa
agaaaggccagaggcugcaaaagacagucaaaggacacgagagaaaggaaggggaagaacag

SEQ ID NO: 414323 - RNA, 62 nt, hsa
ucccuuuauguauauauuuuaacaauccgcuuggacacgaacaaagccacacuucuaacugc

SEQ ID NO: 414324 - RNA, 62 nt, hsa
ccucuacugugaaggagcagggagcugccgagggacacgagccucagugcgggguggaaggc

SEQ ID NO: 414325 - RNA, 62 nt, hsa
cuccugcaaaagcuuccgucccugaggcaaaaggacacgagggcccgacugccagagggagg

SEQ ID NO: 414326 - RNA, 62 nt, hsa
uaugucauucggaucugaggcuccccaaacgaggacacgacggccaagguggcaguuugucc

SEQ ID NO: 414327 - RNA, 62 nt, hsa
gacagguugucuuucucuccccaguuggcgagggacacgaaggcugcggccgggcuggcaga

SEQ ID NO: 414328 - RNA, 62 nt, hsa
cagcuggagcccguucccgugcguguuaguuuggacacgaauuuagucuaaaaagcugucug

SEQ ID NO: 414329 - RNA, 62 nt, hsa
cccuuuaagaccaaggagauaaggguggaggaggacacgaaagugaacuccaccgucauccc

SEQ ID NO: 414330 - RNA, 62 nt, hsa
cuaucuggaguuuuccaugcuggccaagaucuggacacgagcagucccugaggggcgggguc

SEQ ID NO: 414331 - RNA, 62 nt, hsa
augcaaugugagaggauggcaugccagaauuaggacacgacaugaaaccagaguggugccuc

SEQ ID NO: 414332 - RNA, 62 nt, hsa
auucacaaacccacgcucaccugacagccgagggacacgagcaucacucugcuggacggacc

SEQ ID NO: 414333 - RNA, 62 nt, hsa
ugacugcagggacacgggcagccuggcucccaggacacgacuuguaaugaaaguuuggggac

SEQ ID NO: 414334 - RNA, 62 nt, hsa
gugaugggacuuuuaaagguuugaauuuauuaggacacgaacuaaaaauaaaagugcacuag

SEQ ID NO: 414335 - RNA, 62 nt, hsa
ugcgagucauguagugugguagaauuaaaggaggacacgagccugcuucuguuaccuccaag

SEQ ID NO: 414336 - RNA, 62 nt, hsa
ugauucuauagaaaaccauuuaccaacugaaaggacacgaagucuagcuccggacaaaagcu

SEQ ID NO: 414337 - RNA, 62 nt, hsa
caagccacccaggcaccgaggcaagagacagaggacacgagcuguuccaguauaauaaaaua

SEQ ID NO: 414338 - RNA, 62 nt, hsa
agaagaaaacccgagggacagcagauuccacaggacacgaaggcugccccuguaagguuuca

SEQ ID NO: 414339 - RNA, 62 nt, hsa
gcccuagggacaccccaggcaguccuggguguggacacgaugaagcaccggcuccauaagac

SEQ ID NO: 414340 - RNA, 62 nt, hsa
uugcacuuuaacgguaguuccggugucaacauggacacgaacaaaaccuuacccagguguuu

SEQ ID NO: 414341 - RNA, 62 nt, hsa
auuuaucuguaaauauguuuguccugauugagggacacgaucuguguuccacucuauagcaa

SEQ ID NO: 414342 - RNA, 62 nt, hsa
agcagacucgggaacugccugaaugugguuugggacacgagaccucaucauauugaugagcg

SEQ ID NO: 414343 - RNA, 62 nt, hsa
cccuccacaguggcggaccugcuguacuggaaggacacgaggacgucaggaguggucuucac

SEQ ID NO: 414344 - RNA, 62 nt, hsa
guauagcuuaccgcaaggaucagacuguugcuggacacgacgucuguguggagccaggagga

SEQ ID NO: 414345 - RNA, 62 nt, hsa
cuucuccugcaccuuuugucugcugggcugagggacacgagggcaacccugugacaauggca

SEQ ID NO: 414346 - RNA, 62 nt, hsa
ggcaaaccaucaagguggucccucuccagucuggacacgaugccagcaaggaugacguccug

SEQ ID NO: 414347 - RNA, 62 nt, hsa
auuucacagaggauaccaccgagacucggaggggacacgaugagcaccaggccccaccuuug

SEQ ID NO: 414348 - RNA, 64 nt, hsa
augaguauuuucagacaaugaaacuuauuagucugugucagauucugagcaaucauagagucau

SEQ ID NO: 414349 - RNA, 64 nt, hsa
aauuacccaauuggugauaugaucuuaagcuuuugugucagauuauuuaauaugaugacuucau

SEQ ID NO: 414350 - RNA, 64 nt, hsa
uuccacucaccuccguguucuuggggagugcguggugucagaucccauccugcuccucuccaga

SEQ ID NO: 414351 - RNA, 64 nt, hsa
uuccucucaccuccguguucucggggagugcguggugucagaucccauccugcucaucuccagc

SEQ ID NO: 414352 - RNA, 64 nt, hsa
uuccucucaccucuguguucucggggagugcguggugucagaucccauccugcuccucuccagc

SEQ ID NO: 414353 - RNA, 64 nt, hsa
uuccucucaccuccguguucucggggagugcguggugucagaucccauccugcuccucuccaga

SEQ ID NO: 414354 - RNA, 64 nt, hsa
uacuuuaauucaugaagcuuacuuuuuuuuuuuggugucagagucucgcucuugucacccaggc

SEQ ID NO: 414355 - RNA, 64 nt, hsa
aaaaauucucauaggaauuaaauguagucucccugugucagacugcucuuucauaguauaacuu

SEQ ID NO: 414356 - RNA, 64 nt, hsa
cgaugugcaccuccccgaggugcagcugccgaaagugucagagauucggcugccggaaaugcaa

SEQ ID NO: 414357 - RNA, 64 nt, hsa
gcugccgaaagugucagagaugaaacucccagaggugucagagguggcugugccagaggugcgg

SEQ ID NO: 414358 - RNA, 64 nt, hsa
ggaggugcggcuuccagagguacagcugccgaaagugucagagaugaaacucccagagguguca

SEQ ID NO: 414359 - RNA, 64 nt, hsa
ggaggugcggcuuccagagguagagcugcccaaagugucagagaugaaacucccaaaggugcca

SEQ ID NO: 414360 - RNA, 64 nt, hsa
agagguucgacucccagagguggagcuccccaaggugucagagaugaaacucccaaaggugcca

SEQ ID NO: 414361 - RNA, 64 nt, hsa
cccaauuggugugggagaauuagagaauuuauuugugucagaaaauacuccagaacaaccaccc

SEQ ID NO: 414362 - RNA, 64 nt, hsa
aacuuguggagucugcacuaacuuggagaaguuagugucagaauugaauuauagaacacccagu

SEQ ID NO: 414363 - RNA, 60 nt, hsa
gguuagaaaucucuaccugggugugcccacgaagacaaccaucacacuuaucaauggcac

SEQ ID NO: 414364 - RNA, 60 nt, hsa
auccgccuggauugggagaccuauguuccagaagacaaggaagaccggcugguggagcug

SEQ ID NO: 414365 - RNA, 60 nt, hsa
aagucuguguucugaguugucagaucucuugaagacaauauuuuucaucacuuauuguuu

SEQ ID NO: 414366 - RNA, 60 nt, hsa
aucuuucauuuaauaucaauaucaaaagaagaagacaaacaucuaucuuucucaucuaua

SEQ ID NO: 414367 - RNA, 60 nt, hsa
ugaaauuugcaaaaucacuuagcagcaacugaagacaauuaucaaccacguggagaaaau

SEQ ID NO: 414368 - RNA, 60 nt, hsa
cucacaguguggggcagccguccuucuaaugaagacaaugauauugacacugucccucuu

SEQ ID NO: 414369 - RNA, 60 nt, hsa
uauugguuuggacaucuguagaauauauaugaagacaauuucuguaaugguuuuaagaga

SEQ ID NO: 414370 - RNA, 60 nt, hsa
cacaguaaggagugacaaguuuauaauaaggaagacaaaguuuaacaccuucacucaagc

SEQ ID NO: 414371 - RNA, 60 nt, hsa
uggaugugauaguggaaggaauuguggauggaagacaagcagaaaagcugaagacaauag

SEQ ID NO: 414372 - RNA, 60 nt, hsa
aauuguggauggaagacaagcagaaaagcugaagacaauaguuccucagacagaccucaa

SEQ ID NO: 414373 - RNA, 60 nt, hsa
uaucagccccuguaccccacacugcccucugaagacaacacaggcuccugcuuccaccuc

SEQ ID NO: 414374 - RNA, 60 nt, hsa
ucacugggaauguguuuugaaaaugaauuugaagacaagccaacaaacccugcacuccaa

SEQ ID NO: 414375 - RNA, 60 nt, hsa
gaaauuuuugaggaugcaaagcuuuucugugaagacaagucuucacaucuuguuuucaua

SEQ ID NO: 414376 - RNA, 60 nt, hsa
cacuuguuuauuuauaggagccagcccucagaagacaaacacaaugcaaaacauuuccuu

SEQ ID NO: 414377 - RNA, 64 nt, hsa; identical to SEQ ID NO: 414348

SEQ ID NO: 414378 - RNA, 64 nt, hsa; identical to SEQ ID NO: 414349

SEQ ID NO: 414379 - RNA, 64 nt, hsa; identical to SEQ ID NO: 414350

SEQ ID NO: 414380 - RNA, 64 nt, hsa; identical to SEQ ID NO: 414351

SEQ ID NO: 414381 - RNA, 64 nt, hsa; identical to SEQ ID NO: 414352

SEQ ID NO: 414382 - RNA, 64 nt, hsa; identical to SEQ ID NO: 414353

SEQ ID NO: 414383 - RNA, 64 nt, hsa; identical to SEQ ID NO: 414354

SEQ ID NO: 414384 - RNA, 64 nt, hsa; identical to SEQ ID NO: 414355

SEQ ID NO: 414385 - RNA, 64 nt, hsa; identical to SEQ ID NO: 414356

SEQ ID NO: 414386 - RNA, 64 nt, hsa; identical to SEQ ID NO: 414357

SEQ ID NO: 414387 - RNA, 64 nt, hsa; identical to SEQ ID NO: 414358

SEQ ID NO: 414388 - RNA, 64 nt, hsa; identical to SEQ ID NO: 414359

SEQ ID NO: 414389 - RNA, 64 nt, hsa; identical to SEQ ID NO: 414360

SEQ ID NO: 414390 - RNA, 64 nt, hsa; identical to SEQ ID NO: 414361

SEQ ID NO: 414391 - RNA, 64 nt, hsa; identical to SEQ ID NO: 414362

SEQ ID NO: 414392 - RNA, 60 nt, hsa; identical to SEQ ID NO: 414363

SEQ ID NO: 414393 - RNA, 60 nt, hsa; identical to SEQ ID NO: 414364

SEQ ID NO: 414394 - RNA, 60 nt, hsa; identical to SEQ ID NO: 414365

SEQ ID NO: 414395 - RNA, 60 nt, hsa; identical to SEQ ID NO: 414366

SEQ ID NO: 414396 - RNA, 60 nt, hsa; identical to SEQ ID NO: 414367

SEQ ID NO: 414397 - RNA, 60 nt, hsa; identical to SEQ ID NO: 414368

SEQ ID NO: 414398 - RNA, 60 nt, hsa; identical to SEQ ID NO: 414369

SEQ ID NO: 414399 - RNA, 60 nt, hsa; identical to SEQ ID NO: 414370

SEQ ID NO: 414400 - RNA, 60 nt, hsa; identical to SEQ ID NO: 414371

SEQ ID NO: 414401 - RNA, 60 nt, hsa; identical to SEQ ID NO: 414372

SEQ ID NO: 414402 - RNA, 60 nt, hsa; identical to SEQ ID NO: 414373

SEQ ID NO: 414403 - RNA, 60 nt, hsa; identical to SEQ ID NO: 414374

SEQ ID NO: 414404 - RNA, 60 nt, hsa; identical to SEQ ID NO: 414375

SEQ ID NO: 414405 - RNA, 60 nt, hsa; identical to SEQ ID NO: 414376

SEQ ID NO: 414406 - RNA, 64 nt, hsa; identical to SEQ ID NO: 414348

SEQ ID NO: 414407 - RNA, 64 nt, hsa; identical to SEQ ID NO: 414349

SEQ ID NO: 414408 - RNA, 64 nt, hsa; identical to SEQ ID NO: 414350

SEQ ID NO: 414409 - RNA, 64 nt, hsa; identical to SEQ ID NO: 414351

SEQ ID NO: 414410 - RNA, 64 nt, hsa; identical to SEQ ID NO: 414352

SEQ ID NO: 414411 - RNA, 64 nt, hsa; identical to SEQ ID NO: 414353

SEQ ID NO: 414412 - RNA, 64 nt, hsa; identical to SEQ ID NO: 414354

SEQ ID NO: 414413 - RNA, 64 nt, hsa; identical to SEQ ID NO: 414355

SEQ ID NO: 414414 - RNA, 64 nt, hsa; identical to SEQ ID NO: 414356

SEQ ID NO: 414415 - RNA, 64 nt, hsa; identical to SEQ ID NO: 414357

SEQ ID NO: 414416 - RNA, 64 nt, hsa; identical to SEQ ID NO: 414358

SEQ ID NO: 414417 - RNA, 64 nt, hsa; identical to SEQ ID NO: 414359

SEQ ID NO: 414418 - RNA, 64 nt, hsa; identical to SEQ ID NO: 414360

SEQ ID NO: 414419 - RNA, 64 nt, hsa; identical to SEQ ID NO: 414361

SEQ ID NO: 414420 - RNA, 64 nt, hsa; identical to SEQ ID NO: 414362

SEQ ID NO: 414421 - RNA, 60 nt, hsa; identical to SEQ ID NO: 414363

SEQ ID NO: 414422 - RNA, 60 nt, hsa; identical to SEQ ID NO: 414364

SEQ ID NO: 414423 - RNA, 60 nt, hsa; identical to SEQ ID NO: 414365

SEQ ID NO: 414424 - RNA, 60 nt, hsa; identical to SEQ ID NO: 414366

SEQ ID NO: 414425 - RNA, 60 nt, hsa; identical to SEQ ID NO: 414367

SEQ ID NO: 414426 - RNA, 60 nt, hsa; identical to SEQ ID NO: 414368

SEQ ID NO: 414427 - RNA, 60 nt, hsa; identical to SEQ ID NO: 414369

SEQ ID NO: 414428 - RNA, 60 nt, hsa; identical to SEQ ID NO: 414370

SEQ ID NO: 414429 - RNA, 60 nt, hsa; identical to SEQ ID NO: 414371

SEQ ID NO: 414430 - RNA, 60 nt, hsa; identical to SEQ ID NO: 414372

SEQ ID NO: 414431 - RNA, 60 nt, hsa; identical to SEQ ID NO: 414373

SEQ ID NO: 414432 - RNA, 60 nt, hsa; identical to SEQ ID NO: 414374

SEQ ID NO: 414433 - RNA, 60 nt, hsa; identical to SEQ ID NO: 414375

SEQ ID NO: 414434 - RNA, 60 nt, hsa; identical to SEQ ID NO: 414376

SEQ ID NO: 414435 - RNA, 64 nt, hsa; identical to SEQ ID NO: 188946

SEQ ID NO: 414436 - RNA, 64 nt, hsa; identical to SEQ ID NO: 188947

SEQ ID NO: 414437 - RNA, 64 nt, hsa; identical to SEQ ID NO: 188948

SEQ ID NO: 414438 - RNA, 64 nt, hsa; identical to SEQ ID NO: 188949

SEQ ID NO: 414439 - RNA, 64 nt, hsa; identical to SEQ ID NO: 188950

SEQ ID NO: 414440 - RNA, 64 nt, hsa; identical to SEQ ID NO: 188951

SEQ ID NO: 414441 - RNA, 64 nt, hsa; identical to SEQ ID NO: 188952

SEQ ID NO: 414442 - RNA, 64 nt, hsa; identical to SEQ ID NO: 188953

SEQ ID NO: 414443 - RNA, 64 nt, hsa; identical to SEQ ID NO: 188954

SEQ ID NO: 414444 - RNA, 64 nt, hsa
ccuguucccccuggaguuuuccauuagugaguuuuugugcaaggaucuuauuugugaugccuuc

SEQ ID NO: 414445 - RNA, 64 nt, hsa
uuauuugugaugccuucccuccccuagaaagauuuugugcaauauauuaaauggggacagaauu

SEQ ID NO: 414446 - RNA, 64 nt, hsa
uuuguucuuuuuagccaugaacaaaguggcaaaguugugcaauuaccuaacaugauauaaauuu

SEQ ID NO: 414447 - RNA, 64 nt, hsa
agaaacccaauggcuaccuagacuauagggauaguugugcaaagugaacauuguaacuacacca

SEQ ID NO: 414448 - RNA, 64 nt, hsa
agucauaaguucaggauauuucuuuucuauuugguugugcaaaauguuuuucccaguuauuuaa

SEQ ID NO: 414449 - RNA, 64 nt, hsa
uucaccuuuuaggggugcaaguauagcuuuaaguuugugcaagugaaaauguugaaaagugagu

SEQ ID NO: 414450 - RNA, 64 nt, hsa
uauuaauuauuuuuagcaaaauguugccuuugucuugugcaaacauguagaauaugcucuuuaa

SEQ ID NO: 414451 - RNA, 64 nt, hsa
gguuuguaaagcucaguuccacuaguucaugguuuugugcaacuucugagccucaguuuucucc

SEQ ID NO: 414452 - RNA, 64 nt, hsa
uugccagacugcauuaguauuuuggcauugaaacuugugcaauaucuguguaauguagaaugug

SEQ ID NO: 414453 - RNA, 64 nt, hsa
uaagauguuuugggaggaaaacaauugaauuacauugugcaaugcauuaagaaacccauccagc

SEQ ID NO: 414454 - RNA, 64 nt, hsa
gccuguacccgcgacuaacuagacuuuucugcuguugugcaaaguucaguuucuucucagcaac

SEQ ID NO: 414455 - RNA, 64 nt, hsa
uaccaggucaguggauugcuucaaaagcagaguuuugugcaagcacucacugugcucucugaaa

SEQ ID NO: 414456 - RNA, 64 nt, hsa
uucccaauggaaaucucugagaaugacaguggaguugugcaagcauuuuacauugccacauaau

SEQ ID NO: 414457 - RNA, 64 nt, hsa
aaaccagacccuguaguccaguggugcugcccuguugugcaaacugcuccuuuuucucguguuu

SEQ ID NO: 414458 - RNA, 64 nt, hsa
uggaauuuugcucgucacccaggcuggagugcaauugugcaaucucagcucacugcaaccuccg

SEQ ID NO: 414459 - RNA, 64 nt, hsa
uccaccacuuaccaggaacugccuguuaacuggcuugugcaaugauaaaggccuuuuguuuaag

SEQ ID NO: 414460 - RNA, 64 nt, hsa
uuucaccaagagcuuuucagguugccccuaagcuuugugcaauuuuuucugguuccccaaagug

SEQ ID NO: 414461 - RNA, 64 nt, hsa
gccauaaaauacuaugcuuuauuggucccauguuuugugcaauuuuaaagagauggcuuucuau

SEQ ID NO: 414462 - RNA, 64 nt, hsa; identical to SEQ ID NO: 299218

SEQ ID NO: 414463 - RNA, 64 nt, hsa; identical to SEQ ID NO: 299219

SEQ ID NO: 414464 - RNA, 64 nt, hsa; identical to SEQ ID NO: 299220

SEQ ID NO: 414465 - RNA, 64 nt, hsa; identical to SEQ ID NO: 299221

SEQ ID NO: 414466 - RNA, 64 nt, hsa; identical to SEQ ID NO: 299222

SEQ ID NO: 414467 - RNA, 64 nt, hsa; identical to SEQ ID NO: 299223

SEQ ID NO: 414468 - RNA, 64 nt, hsa; identical to SEQ ID NO: 299224

SEQ ID NO: 414469 - RNA, 64 nt, hsa; identical to SEQ ID NO: 299225

SEQ ID NO: 414470 - RNA, 64 nt, hsa; identical to SEQ ID NO: 299226

SEQ ID NO: 414471 - RNA, 64 nt, hsa; identical to SEQ ID NO: 299227

SEQ ID NO: 414472 - RNA, 64 nt, hsa; identical to SEQ ID NO: 299228

SEQ ID NO: 414473 - RNA, 64 nt, hsa; identical to SEQ ID NO: 299229

SEQ ID NO: 414474 - RNA, 64 nt, hsa; identical to SEQ ID NO: 299230

SEQ ID NO: 414475 - RNA, 64 nt, hsa; identical to SEQ ID NO: 299231

SEQ ID NO: 414476 - RNA, 64 nt, hsa; identical to SEQ ID NO: 299232

SEQ ID NO: 414477 - RNA, 64 nt, hsa; identical to SEQ ID NO: 299233

SEQ ID NO: 414478 - RNA, 64 nt, hsa; identical to SEQ ID NO: 299234

SEQ ID NO: 414479 - RNA, 64 nt, hsa; identical to SEQ ID NO: 299235

SEQ ID NO: 414480 - RNA, 64 nt, hsa; identical to SEQ ID NO: 299236

SEQ ID NO: 414481 - RNA, 64 nt, hsa; identical to SEQ ID NO: 299237

SEQ ID NO: 414482 - RNA, 64 nt, hsa; identical to SEQ ID NO: 299238

SEQ ID NO: 414483 - RNA, 64 nt, hsa; identical to SEQ ID NO: 299239

SEQ ID NO: 414484 - RNA, 64 nt, hsa; identical to SEQ ID NO: 299240

SEQ ID NO: 414485 - RNA, 64 nt, hsa; identical to SEQ ID NO: 299241

SEQ ID NO: 414486 - RNA, 64 nt, hsa; identical to SEQ ID NO: 299242

SEQ ID NO: 414487 - RNA, 55 nt, hsa; identical to SEQ ID NO: 143234

SEQ ID NO: 414488 - RNA, 64 nt, hsa; identical to SEQ ID NO: 299244

SEQ ID NO: 414489 - RNA, 64 nt, hsa; identical to SEQ ID NO: 299245

SEQ ID NO: 414490 - RNA, 64 nt, hsa; identical to SEQ ID NO: 299246

SEQ ID NO: 414491 - RNA, 64 nt, hsa; identical to SEQ ID NO: 299247

SEQ ID NO: 414492 - RNA, 64 nt, hsa; identical to SEQ ID NO: 299248

SEQ ID NO: 414493 - RNA, 64 nt, hsa; identical to SEQ ID NO: 299249

SEQ ID NO: 414494 - RNA, 64 nt, hsa; identical to SEQ ID NO: 299250

SEQ ID NO: 414495 - RNA, 64 nt, hsa; identical to SEQ ID NO: 299251

SEQ ID NO: 414496 - RNA, 64 nt, hsa; identical to SEQ ID NO: 299252

SEQ ID NO: 414497 - RNA, 64 nt, hsa; identical to SEQ ID NO: 299253

SEQ ID NO: 414498 - RNA, 64 nt, hsa; identical to SEQ ID NO: 299254

SEQ ID NO: 414499 - RNA, 64 nt, hsa; identical to SEQ ID NO: 299255

SEQ ID NO: 414500 - RNA, 64 nt, hsa; identical to SEQ ID NO: 299256

SEQ ID NO: 414501 - RNA, 64 nt, hsa; identical to SEQ ID NO: 299257

SEQ ID NO: 414502 - RNA, 64 nt, hsa; identical to SEQ ID NO: 299258

SEQ ID NO: 414503 - RNA, 64 nt, hsa; identical to SEQ ID NO: 299259

SEQ ID NO: 414504 - RNA, 64 nt, hsa; identical to SEQ ID NO: 299260

SEQ ID NO: 414505 - RNA, 64 nt, hsa; identical to SEQ ID NO: 299261

SEQ ID NO: 414506 - RNA, 64 nt, hsa; identical to SEQ ID NO: 299262

SEQ ID NO: 414507 - RNA, 64 nt, hsa; identical to SEQ ID NO: 299263

SEQ ID NO: 414508 - RNA, 64 nt, hsa; identical to SEQ ID NO: 299264

SEQ ID NO: 414509 - RNA, 64 nt, hsa; identical to SEQ ID NO: 299265

SEQ ID NO: 414510 - RNA, 64 nt, hsa; identical to SEQ ID NO: 299266

SEQ ID NO: 414511 - RNA, 64 nt, hsa; identical to SEQ ID NO: 299267

SEQ ID NO: 414512 - RNA, 64 nt, hsa; identical to SEQ ID NO: 299268

SEQ ID NO: 414513 - RNA, 64 nt, hsa; identical to SEQ ID NO: 299269

SEQ ID NO: 414514 - RNA, 64 nt, hsa; identical to SEQ ID NO: 299270

SEQ ID NO: 414515 - RNA, 64 nt, hsa; identical to SEQ ID NO: 299271

SEQ ID NO: 414516 - RNA, 64 nt, hsa; identical to SEQ ID NO: 299272

SEQ ID NO: 414517 - RNA, 64 nt, hsa; identical to SEQ ID NO: 299273

SEQ ID NO: 414518 - RNA, 64 nt, hsa; identical to SEQ ID NO: 299274

SEQ ID NO: 414519 - RNA, 64 nt, hsa; identical to SEQ ID NO: 299275

SEQ ID NO: 414520 - RNA, 64 nt, hsa; identical to SEQ ID NO: 299276

SEQ ID NO: 414521 - RNA, 64 nt, hsa; identical to SEQ ID NO: 299277

SEQ ID NO: 414522 - RNA, 64 nt, hsa; identical to SEQ ID NO: 299278

SEQ ID NO: 414523 - RNA, 64 nt, hsa; identical to SEQ ID NO: 299279

SEQ ID NO: 414524 - RNA, 64 nt, hsa; identical to SEQ ID NO: 299280

SEQ ID NO: 414525 - RNA, 64 nt, hsa; identical to SEQ ID NO: 299281

SEQ ID NO: 414526 - RNA, 64 nt, hsa; identical to SEQ ID NO: 299282

SEQ ID NO: 414527 - RNA, 64 nt, hsa; identical to SEQ ID NO: 299283

SEQ ID NO: 414528 - RNA, 64 nt, hsa; identical to SEQ ID NO: 299284

SEQ ID NO: 414529 - RNA, 64 nt, hsa; identical to SEQ ID NO: 299285

SEQ ID NO: 414530 - RNA, 64 nt, hsa; identical to SEQ ID NO: 299286

SEQ ID NO: 414531 - RNA, 64 nt, hsa; identical to SEQ ID NO: 299287

SEQ ID NO: 414532 - RNA, 64 nt, hsa; identical to SEQ ID NO: 299288

SEQ ID NO: 414533 - RNA, 64 nt, hsa; identical to SEQ ID NO: 299289

SEQ ID NO: 414534 - RNA, 64 nt, hsa; identical to SEQ ID NO: 299290

SEQ ID NO: 414535 - RNA, 64 nt, hsa; identical to SEQ ID NO: 299291

SEQ ID NO: 414536 - RNA, 64 nt, hsa; identical to SEQ ID NO: 299292

SEQ ID NO: 414537 - RNA, 64 nt, hsa; identical to SEQ ID NO: 299293

SEQ ID NO: 414538 - RNA, 64 nt, hsa; identical to SEQ ID NO: 299294

SEQ ID NO: 414539 - RNA, 64 nt, hsa; identical to SEQ ID NO: 299295

SEQ ID NO: 414540 - RNA, 64 nt, hsa; identical to SEQ ID NO: 299296

SEQ ID NO: 414541 - RNA, 64 nt, hsa; identical to SEQ ID NO: 299297

SEQ ID NO: 414542 - RNA, 64 nt, hsa; identical to SEQ ID NO: 299298

SEQ ID NO: 414543 - RNA, 64 nt, hsa; identical to SEQ ID NO: 299299

SEQ ID NO: 414544 - RNA, 64 nt, hsa; identical to SEQ ID NO: 299300

SEQ ID NO: 414545 - RNA, 64 nt, hsa; identical to SEQ ID NO: 299301

SEQ ID NO: 414546 - RNA, 64 nt, hsa; identical to SEQ ID NO: 299302

SEQ ID NO: 414547 - RNA, 64 nt, hsa; identical to SEQ ID NO: 299303

SEQ ID NO: 414548 - RNA, 64 nt, hsa; identical to SEQ ID NO: 299304

SEQ ID NO: 414549 - RNA, 64 nt, hsa; identical to SEQ ID NO: 299305

SEQ ID NO: 414550 - RNA, 64 nt, hsa; identical to SEQ ID NO: 299306

SEQ ID NO: 414551 - RNA, 64 nt, hsa; identical to SEQ ID NO: 299307

SEQ ID NO: 414552 - RNA, 64 nt, hsa; identical to SEQ ID NO: 299308

SEQ ID NO: 414553 - RNA, 64 nt, hsa; identical to SEQ ID NO: 299309

SEQ ID NO: 414554 - RNA, 64 nt, hsa; identical to SEQ ID NO: 299310

SEQ ID NO: 414555 - RNA, 64 nt, hsa; identical to SEQ ID NO: 299311

SEQ ID NO: 414556 - RNA, 64 nt, hsa; identical to SEQ ID NO: 299312

SEQ ID NO: 414557 - RNA, 64 nt, hsa; identical to SEQ ID NO: 299313

SEQ ID NO: 414558 - RNA, 64 nt, hsa; identical to SEQ ID NO: 299314

SEQ ID NO: 414559 - RNA, 64 nt, hsa; identical to SEQ ID NO: 299315

SEQ ID NO: 414560 - RNA, 50 nt, hsa; identical to SEQ ID NO: 143307

SEQ ID NO: 414561 - RNA, 64 nt, hsa; identical to SEQ ID NO: 299317

SEQ ID NO: 414562 - RNA, 64 nt, hsa; identical to SEQ ID NO: 299318

SEQ ID NO: 414563 - RNA, 64 nt, hsa; identical to SEQ ID NO: 299319

SEQ ID NO: 414564 - RNA, 64 nt, hsa; identical to SEQ ID NO: 299320

SEQ ID NO: 414565 - RNA, 64 nt, hsa; identical to SEQ ID NO: 299321

SEQ ID NO: 414566 - RNA, 64 nt, hsa; identical to SEQ ID NO: 299322

SEQ ID NO: 414567 - RNA, 64 nt, hsa; identical to SEQ ID NO: 299323

SEQ ID NO: 414568 - RNA, 64 nt, hsa; identical to SEQ ID NO: 299324

SEQ ID NO: 414569 - RNA, 64 nt, hsa; identical to SEQ ID NO: 299325

SEQ ID NO: 414570 - RNA, 64 nt, hsa; identical to SEQ ID NO: 299326

SEQ ID NO: 414571 - RNA, 64 nt, hsa; identical to SEQ ID NO: 299327

SEQ ID NO: 414572 - RNA, 64 nt, hsa; identical to SEQ ID NO: 299328

SEQ ID NO: 414573 - RNA, 64 nt, hsa; identical to SEQ ID NO: 299329

SEQ ID NO: 414574 - RNA, 64 nt, hsa; identical to SEQ ID NO: 299330

SEQ ID NO: 414575 - RNA, 64 nt, hsa; identical to SEQ ID NO: 299331

SEQ ID NO: 414576 - RNA, 64 nt, hsa; identical to SEQ ID NO: 299332

SEQ ID NO: 414577 - RNA, 64 nt, hsa; identical to SEQ ID NO: 299333

SEQ ID NO: 414578 - RNA, 64 nt, hsa; identical to SEQ ID NO: 299334

SEQ ID NO: 414579 - RNA, 64 nt, hsa; identical to SEQ ID NO: 299335

SEQ ID NO: 414580 - RNA, 64 nt, hsa; identical to SEQ ID NO: 299336

SEQ ID NO: 414581 - RNA, 64 nt, hsa; identical to SEQ ID NO: 299337

SEQ ID NO: 414582 - RNA, 64 nt, hsa; identical to SEQ ID NO: 299338

SEQ ID NO: 414583 - RNA, 64 nt, hsa; identical to SEQ ID NO: 299339

SEQ ID NO: 414584 - RNA, 64 nt, hsa; identical to SEQ ID NO: 299340

SEQ ID NO: 414585 - RNA, 64 nt, hsa; identical to SEQ ID NO: 299341

SEQ ID NO: 414586 - RNA, 64 nt, hsa; identical to SEQ ID NO: 299342

SEQ ID NO: 414587 - RNA, 64 nt, hsa; identical to SEQ ID NO: 299343

SEQ ID NO: 414588 - RNA, 64 nt, hsa; identical to SEQ ID NO: 299344

SEQ ID NO: 414589 - RNA, 64 nt, hsa; identical to SEQ ID NO: 299345

SEQ ID NO: 414590 - RNA, 64 nt, hsa; identical to SEQ ID NO: 299346

SEQ ID NO: 414591 - RNA, 64 nt, hsa; identical to SEQ ID NO: 299347

SEQ ID NO: 414592 - RNA, 64 nt, hsa; identical to SEQ ID NO: 299348

SEQ ID NO: 414593 - RNA, 64 nt, hsa; identical to SEQ ID NO: 299349

SEQ ID NO: 414594 - RNA, 64 nt, hsa; identical to SEQ ID NO: 299350

SEQ ID NO: 414595 - RNA, 64 nt, hsa; identical to SEQ ID NO: 299351

SEQ ID NO: 414596 - RNA, 64 nt, hsa; identical to SEQ ID NO: 299352

SEQ ID NO: 414597 - RNA, 64 nt, hsa; identical to SEQ ID NO: 299353

SEQ ID NO: 414598 - RNA, 64 nt, hsa; identical to SEQ ID NO: 299354

SEQ ID NO: 414599 - RNA, 64 nt, hsa; identical to SEQ ID NO: 299355

SEQ ID NO: 414600 - RNA, 64 nt, hsa; identical to SEQ ID NO: 299356

SEQ ID NO: 414601 - RNA, 64 nt, hsa
uuuguuaaaaugacuucauuuaacauucacugauguagauuaauaauguaaguucugauuuaaa

SEQ ID NO: 414602 - RNA, 64 nt, hsa
uauagcucuaggugugcuccugaaucaguucaugguagauuaugcugaacaacagugagauguu

SEQ ID NO: 414603 - RNA, 64 nt, hsa
uucucauuaagauauauauauagaaccacuuuuuguagauuaguauaagaaaaauauuuacccu

SEQ ID NO: 414604 - RNA, 64 nt, hsa
uauuuguuuuuuugugcugugagaauugauguuuguagauuaauaaucauuuuguuuagaauua

SEQ ID NO: 414605 - RNA, 64 nt, hsa
ccuuauuucuuaacagggaggccucgugggucugguagauuauccugaugaugaugaagaugau

SEQ ID NO: 414606 - RNA, 64 nt, hsa
uguaauugaaaauuacuggaaagcacuggaagauguagauuauguacagacauuuaaaggauua

SEQ ID NO: 414607 - RNA, 64 nt, hsa
uagucugucuuccccccgggccucucaaagucugguagauuacgacagcucugacgauucugac

SEQ ID NO: 414608 - RNA, 64 nt, hsa
auuaauccuucauacaauuaguguuuccacuaauguagauuauugaaaauuagauauugaauua

SEQ ID NO: 414609 - RNA, 64 nt, hsa; identical to SEQ ID NO: 296130

SEQ ID NO: 414610 - RNA, 64 nt, hsa; identical to SEQ ID NO: 296131

SEQ ID NO: 414611 - RNA, 64 nt, hsa; identical to SEQ ID NO: 296132

SEQ ID NO: 414612 - RNA, 64 nt, hsa; identical to SEQ ID NO: 296133

SEQ ID NO: 414613 - RNA, 64 nt, hsa; identical to SEQ ID NO: 296134

SEQ ID NO: 414614 - RNA, 64 nt, hsa; identical to SEQ ID NO: 296135

SEQ ID NO: 414615 - RNA, 64 nt, hsa; identical to SEQ ID NO: 296136

SEQ ID NO: 414616 - RNA, 64 nt, hsa; identical to SEQ ID NO: 296137

SEQ ID NO: 414617 - RNA, 64 nt, hsa; identical to SEQ ID NO: 296138

SEQ ID NO: 414618 - RNA, 64 nt, hsa; identical to SEQ ID NO: 296139

SEQ ID NO: 414619 - RNA, 64 nt, hsa; identical to SEQ ID NO: 296140

SEQ ID NO: 414620 - RNA, 64 nt, hsa; identical to SEQ ID NO: 296141

SEQ ID NO: 414621 - RNA, 64 nt, hsa; identical to SEQ ID NO: 296142

SEQ ID NO: 414622 - RNA, 64 nt, hsa; identical to SEQ ID NO: 296143

SEQ ID NO: 414623 - RNA, 64 nt, hsa; identical to SEQ ID NO: 296144

SEQ ID NO: 414624 - RNA, 64 nt, hsa; identical to SEQ ID NO: 296145

SEQ ID NO: 414625 - RNA, 64 nt, hsa; identical to SEQ ID NO: 296146

SEQ ID NO: 414626 - RNA, 64 nt, hsa; identical to SEQ ID NO: 296147

SEQ ID NO: 414627 - RNA, 64 nt, hsa; identical to SEQ ID NO: 296148

SEQ ID NO: 414628 - RNA, 64 nt, hsa; identical to SEQ ID NO: 296149

SEQ ID NO: 414629 - RNA, 64 nt, hsa; identical to SEQ ID NO: 296150

SEQ ID NO: 414630 - RNA, 64 nt, hsa; identical to SEQ ID NO: 296151

SEQ ID NO: 414631 - RNA, 64 nt, hsa; identical to SEQ ID NO: 296152

SEQ ID NO: 414632 - RNA, 64 nt, hsa; identical to SEQ ID NO: 296153

SEQ ID NO: 414633 - RNA, 64 nt, hsa; identical to SEQ ID NO: 296154

SEQ ID NO: 414634 - RNA, 64 nt, hsa; identical to SEQ ID NO: 296155

SEQ ID NO: 414635 - RNA, 64 nt, hsa; identical to SEQ ID NO: 296156

SEQ ID NO: 414636 - RNA, 64 nt, hsa; identical to SEQ ID NO: 296157

SEQ ID NO: 414637 - RNA, 64 nt, hsa; identical to SEQ ID NO: 296158

SEQ ID NO: 414638 - RNA, 64 nt, hsa; identical to SEQ ID NO: 296159

SEQ ID NO: 414639 - RNA, 64 nt, hsa; identical to SEQ ID NO: 296160

SEQ ID NO: 414640 - RNA, 64 nt, hsa; identical to SEQ ID NO: 296161

SEQ ID NO: 414641 - RNA, 64 nt, hsa; identical to SEQ ID NO: 296162

SEQ ID NO: 414642 - RNA, 64 nt, hsa; identical to SEQ ID NO: 296163

SEQ ID NO: 414643 - RNA, 64 nt, hsa; identical to SEQ ID NO: 296164

SEQ ID NO: 414644 - RNA, 64 nt, hsa; identical to SEQ ID NO: 296165

SEQ ID NO: 414645 - RNA, 64 nt, hsa; identical to SEQ ID NO: 296166

SEQ ID NO: 414646 - RNA, 64 nt, hsa; identical to SEQ ID NO: 296167

SEQ ID NO: 414647 - RNA, 64 nt, hsa; identical to SEQ ID NO: 296168

SEQ ID NO: 414648 - RNA, 64 nt, hsa; identical to SEQ ID NO: 296169

SEQ ID NO: 414649 - RNA, 64 nt, hsa; identical to SEQ ID NO: 296170

SEQ ID NO: 414650 - RNA, 64 nt, hsa; identical to SEQ ID NO: 296171

SEQ ID NO: 414651 - RNA, 64 nt, hsa; identical to SEQ ID NO: 296172

SEQ ID NO: 414652 - RNA, 64 nt, hsa; identical to SEQ ID NO: 296173

SEQ ID NO: 414653 - RNA, 64 nt, hsa; identical to SEQ ID NO: 296174

SEQ ID NO: 414654 - RNA, 64 nt, hsa; identical to SEQ ID NO: 296175

SEQ ID NO: 414655 - RNA, 64 nt, hsa; identical to SEQ ID NO: 133993

SEQ ID NO: 414656 - RNA, 64 nt, hsa; identical to SEQ ID NO: 133994

SEQ ID NO: 414657 - RNA, 64 nt, hsa; identical to SEQ ID NO: 133995

SEQ ID NO: 414658 - RNA, 64 nt, hsa; identical to SEQ ID NO: 133996

SEQ ID NO: 414659 - RNA, 64 nt, hsa; identical to SEQ ID NO: 133997

SEQ ID NO: 414660 - RNA, 64 nt, hsa; identical to SEQ ID NO: 133998

SEQ ID NO: 414661 - RNA, 64 nt, hsa; identical to SEQ ID NO: 133999

SEQ ID NO: 414662 - RNA, 64 nt, hsa; identical to SEQ ID NO: 134000

SEQ ID NO: 414663 - RNA, 64 nt, hsa; identical to SEQ ID NO: 134001

SEQ ID NO: 414664 - RNA, 64 nt, hsa; identical to SEQ ID NO: 134002

SEQ ID NO: 414665 - RNA, 64 nt, hsa; identical to SEQ ID NO: 134003

SEQ ID NO: 414666 - RNA, 64 nt, hsa; identical to SEQ ID NO: 134004

SEQ ID NO: 414667 - RNA, 64 nt, hsa; identical to SEQ ID NO: 134005

SEQ ID NO: 414668 - RNA, 64 nt, hsa; identical to SEQ ID NO: 134006

SEQ ID NO: 414669 - RNA, 64 nt, hsa; identical to SEQ ID NO: 134007

SEQ ID NO: 414670 - RNA, 64 nt, hsa; identical to SEQ ID NO: 134008

SEQ ID NO: 414671 - RNA, 64 nt, hsa; identical to SEQ ID NO: 206029

SEQ ID NO: 414672 - RNA, 64 nt, hsa; identical to SEQ ID NO: 206030

SEQ ID NO: 414673 - RNA, 64 nt, hsa; identical to SEQ ID NO: 206031

SEQ ID NO: 414674 - RNA, 64 nt, hsa; identical to SEQ ID NO: 206032

SEQ ID NO: 414675 - RNA, 64 nt, hsa; identical to SEQ ID NO: 206033

SEQ ID NO: 414676 - RNA, 64 nt, hsa; identical to SEQ ID NO: 206034

SEQ ID NO: 414677 - RNA, 64 nt, hsa; identical to SEQ ID NO: 206035

SEQ ID NO: 414678 - RNA, 64 nt, hsa; identical to SEQ ID NO: 206036

SEQ ID NO: 414679 - RNA, 64 nt, hsa; identical to SEQ ID NO: 206037

SEQ ID NO: 414680 - RNA, 64 nt, hsa; identical to SEQ ID NO: 206038

SEQ ID NO: 414681 - RNA, 64 nt, hsa; identical to SEQ ID NO: 206039

SEQ ID NO: 414682 - RNA, 64 nt, hsa; identical to SEQ ID NO: 206040

SEQ ID NO: 414683 - RNA, 64 nt, hsa; identical to SEQ ID NO: 206041

SEQ ID NO: 414684 - RNA, 64 nt, hsa; identical to SEQ ID NO: 206042

SEQ ID NO: 414685 - RNA, 64 nt, hsa; identical to SEQ ID NO: 206043

SEQ ID NO: 414686 - RNA, 64 nt, hsa; identical to SEQ ID NO: 206044

SEQ ID NO: 414687 - RNA, 64 nt, hsa; identical to SEQ ID NO: 206045

SEQ ID NO: 414688 - RNA, 64 nt, hsa; identical to SEQ ID NO: 206046

SEQ ID NO: 414689 - RNA, 64 nt, hsa; identical to SEQ ID NO: 206047

SEQ ID NO: 414690 - RNA, 64 nt, hsa; identical to SEQ ID NO: 206048

SEQ ID NO: 414691 - RNA, 64 nt, hsa; identical to SEQ ID NO: 206049

SEQ ID NO: 414692 - RNA, 64 nt, hsa; identical to SEQ ID NO: 206050

SEQ ID NO: 414693 - RNA, 64 nt, hsa; identical to SEQ ID NO: 206051

SEQ ID NO: 414694 - RNA, 64 nt, hsa; identical to SEQ ID NO: 206052

SEQ ID NO: 414695 - RNA, 64 nt, hsa; identical to SEQ ID NO: 206053

SEQ ID NO: 414696 - RNA, 64 nt, hsa; identical to SEQ ID NO: 206054

SEQ ID NO: 414697 - RNA, 64 nt, hsa; identical to SEQ ID NO: 206055

SEQ ID NO: 414698 - RNA, 64 nt, hsa; identical to SEQ ID NO: 206056

SEQ ID NO: 414699 - RNA, 64 nt, hsa; identical to SEQ ID NO: 206057

SEQ ID NO: 414700 - RNA, 64 nt, hsa; identical to SEQ ID NO: 206058

SEQ ID NO: 414701 - RNA, 64 nt, hsa; identical to SEQ ID NO: 206059

SEQ ID NO: 414702 - RNA, 64 nt, hsa; identical to SEQ ID NO: 206060

SEQ ID NO: 414703 - RNA, 64 nt, hsa; identical to SEQ ID NO: 206061

SEQ ID NO: 414704 - RNA, 64 nt, hsa; identical to SEQ ID NO: 206062

SEQ ID NO: 414705 - RNA, 64 nt, hsa; identical to SEQ ID NO: 206063

SEQ ID NO: 414706 - RNA, 64 nt, hsa; identical to SEQ ID NO: 206064

SEQ ID NO: 414707 - RNA, 64 nt, hsa; identical to SEQ ID NO: 206065

SEQ ID NO: 414708 - RNA, 64 nt, hsa; identical to SEQ ID NO: 206066

SEQ ID NO: 414709 - RNA, 64 nt, hsa; identical to SEQ ID NO: 206067

SEQ ID NO: 414710 - RNA, 64 nt, hsa; identical to SEQ ID NO: 206068

SEQ ID NO: 414711 - RNA, 64 nt, hsa; identical to SEQ ID NO: 206069

SEQ ID NO: 414712 - RNA, 64 nt, hsa; identical to SEQ ID NO: 206070

SEQ ID NO: 414713 - RNA, 64 nt, hsa; identical to SEQ ID NO: 206071

SEQ ID NO: 414714 - RNA, 64 nt, hsa; identical to SEQ ID NO: 206072

SEQ ID NO: 414715 - RNA, 64 nt, hsa; identical to SEQ ID NO: 206073

SEQ ID NO: 414716 - RNA, 64 nt, hsa; identical to SEQ ID NO: 206074

SEQ ID NO: 414717 - RNA, 64 nt, hsa; identical to SEQ ID NO: 206075

SEQ ID NO: 414718 - RNA, 64 nt, hsa; identical to SEQ ID NO: 206076

SEQ ID NO: 414719 - RNA, 64 nt, hsa; identical to SEQ ID NO: 206077

SEQ ID NO: 414720 - RNA, 64 nt, hsa; identical to SEQ ID NO: 206078

SEQ ID NO: 414721 - RNA, 64 nt, hsa; identical to SEQ ID NO: 301214

SEQ ID NO: 414722 - RNA, 64 nt, hsa; identical to SEQ ID NO: 301215

SEQ ID NO: 414723 - RNA, 64 nt, hsa; identical to SEQ ID NO: 301216

SEQ ID NO: 414724 - RNA, 64 nt, hsa; identical to SEQ ID NO: 301217

SEQ ID NO: 414725 - RNA, 64 nt, hsa; identical to SEQ ID NO: 301218

SEQ ID NO: 414726 - RNA, 64 nt, hsa; identical to SEQ ID NO: 301219

SEQ ID NO: 414727 - RNA, 64 nt, hsa; identical to SEQ ID NO: 301220

SEQ ID NO: 414728 - RNA, 64 nt, hsa; identical to SEQ ID NO: 301221

SEQ ID NO: 414729 - RNA, 64 nt, hsa; identical to SEQ ID NO: 301222

SEQ ID NO: 414730 - RNA, 64 nt, hsa; identical to SEQ ID NO: 301223

SEQ ID NO: 414731 - RNA, 64 nt, hsa; identical to SEQ ID NO: 301224

SEQ ID NO: 414732 - RNA, 64 nt, hsa; identical to SEQ ID NO: 301225

SEQ ID NO: 414733 - RNA, 64 nt, hsa; identical to SEQ ID NO: 301226

SEQ ID NO: 414734 - RNA, 64 nt, hsa; identical to SEQ ID NO: 301227

SEQ ID NO: 414735 - RNA, 64 nt, hsa; identical to SEQ ID NO: 301228

SEQ ID NO: 414736 - RNA, 64 nt, hsa; identical to SEQ ID NO: 301229

SEQ ID NO: 414737 - RNA, 64 nt, hsa; identical to SEQ ID NO: 301230

SEQ ID NO: 414738 - RNA, 64 nt, hsa; identical to SEQ ID NO: 301231

SEQ ID NO: 414739 - RNA, 64 nt, hsa
cgcagcaucaacuuucaagcauaaguaaaaacacaacuugcauacuuugauggagcuuaauugu

SEQ ID NO: 414740 - RNA, 64 nt, hsa
ucaaguuaauugguaaauuuuuauugaaauuuaaaacuugcauuuuuauauauguguaugugua

SEQ ID NO: 414741 - RNA, 64 nt, hsa
uagagcacagauggcacaaccccgaggcagccccaacuugcauuucccucccuccaggggcuau

SEQ ID NO: 414742 - RNA, 64 nt, hsa
ugauugcacaaaaauuuuaaaaacacgugauguaaacuugcaagcauaucaaccaggcaagucu

SEQ ID NO: 414743 - RNA, 64 nt, hsa
aauguauuuuuuauuacaacuuuguacugguuguaacuugcauuagaaaaaaaagagauauaua

SEQ ID NO: 414744 - RNA, 64 nt, hsa
uacauguuugaaguauucaaucauaggagcaaagaacuugcaaaauaugaagugacuuggaauu

SEQ ID NO: 414745 - RNA, 64 nt, hsa
guuccccuugcacacuuaccuauuuaaaaaacuaaacuugcacugcaacugagaaauuauuugu

SEQ ID NO: 414746 - RNA, 64 nt, hsa
auuuuaaggacugcgggacuugggucucauuuagaacuugcagcugauguuggaagagaaagca

SEQ ID NO: 414747 - RNA, 64 nt, hsa
gaaacuggcacugaauuaaucaucuauaaagaagaacuugcauggagcaggacucuauuuuaag

SEQ ID NO: 414748 - RNA, 64 nt, hsa
aaaacaaaacaaaacaaaacaaacaaacaaacaaaacuugcaucuaaccaaaaagucuugguuu

SEQ ID NO: 414749 - RNA, 64 nt, hsa
ccuagauaacgaagugcacuuacacuuauaaaauaacuugcaucuaggcugggcguggcggcuc

SEQ ID NO: 414750 - RNA, 64 nt, hsa
gagaccaguaacuuuacuguaaauuuacuuuguuucauugaaaaaacaaauugauaaacauauu

SEQ ID NO: 414751 - RNA, 64 nt, hsa
gaauguaaaaguaaguccaaucuauuuucuuaugucauugaauuuguaguguuaacuugcauau

SEQ ID NO: 414752 - RNA, 64 nt, hsa
uugcuaaaauaccccucacagcuagucauccauaucauugaagcgcucaugauuugauagauua

SEQ ID NO: 414753 - RNA, 64 nt, hsa
uauucugccaaaccaaucauguuauuguuuuuaaucauugaaucauuggaucuuuaaauaggag

SEQ ID NO: 414754 - RNA, 64 nt, hsa
acuagcacacaggcuguagaaacagucuuagaaaucauugaaagauuugauuaugaaagaauag

SEQ ID NO: 414755 - RNA, 64 nt, hsa
uucagugaagauucuaauauuuuaucuauuuuguucauugaauuccaugguuaaaucucauaaa

SEQ ID NO: 414756 - RNA, 64 nt, hsa
gacuacaaacauuaaaucgcacuuuuaaagugagucauugaaauaaauaguacugaaaugauuc

SEQ ID NO: 414757 - RNA, 64 nt, hsa
uaacucucaauuuagcauuuuccuugauacuuuaucauugaaaauuuaugcauuuauuuacuga

SEQ ID NO: 414758 - RNA, 64 nt, hsa
cuuauuuuuuucaagguuacaucauaugaagaaaucauugaaugugcugaccaaaggcuugcaa

SEQ ID NO: 414759 - RNA, 64 nt, hsa
cuccuagagucaaaagaaaaccacugcaacagacucauugaagaaaaugacaaguaucaaagac

SEQ ID NO: 414760 - RNA, 64 nt, hsa
gcagauggacaaaaugcacagugucuagaacugcucauugaaaaugguuuugaugucaacacuc

SEQ ID NO: 414761 - RNA, 64 nt, hsa
gccagaaauccgccaaauacuagagaauccuuguucauugaagcauuugugucgguuaaaaauu

SEQ ID NO: 414762 - RNA, 64 nt, hsa
agccagggaauuuacaauaacauuuccguuuccaucauugaauaagucuuauucagucaucggu

SEQ ID NO: 414763 - RNA, 64 nt, hsa
aauuuucuaccuuaguuaucauuaauguaguuccucauugaacaugugauaaucuaauaccugu

SEQ ID NO: 414764 - RNA, 64 nt, hsa
acacuuaaguguugccguaguaucaauauuucugucauugaauuuuuucucaccccuuauuauu

SEQ ID NO: 414765 - RNA, 64 nt, hsa
aauuuguuuuuguauggugcaauaugacagccugucauugaaucuaaacaacuuaauuugcuug

SEQ ID NO: 414766 - RNA, 64 nt, hsa
uuuguagcuuucagagugucucauugagucuagaucauugaaccaacacuuaaccaaauguccc

SEQ ID NO: 414767 - RNA, 64 nt, hsa
ucucaucuuuucauauaccucuaacccccgguacucauugaaucauugaugagguaucucaauu

SEQ ID NO: 414768 - RNA, 64 nt, hsa
uauuuagcuuuauaauucagguuuagugcuauugucauugaacacugguauuuucuguaucaua

SEQ ID NO: 414769 - RNA, 64 nt, hsa
guccaggucaucuucacccagaggagaagccucaucauugaauggagaaucucauuaaaguuua

SEQ ID NO: 414770 - RNA, 64 nt, hsa
accacaaugccucauuguaaugggauauugaaguucauugaagaauuacuagguugccaugugg

SEQ ID NO: 414771 - RNA, 64 nt, hsa
uuaaaauggaaccuuacgguuguguuuuaaguauucauugaaaccagcuucagaaaacaagaug

SEQ ID NO: 414772 - RNA, 64 nt, hsa
agugguguguugcaugcucaaaacagcagcgucgucauugaagucugcuugauuaaaccauaau

SEQ ID NO: 414773 - RNA, 64 nt, hsa
acgacuucagcaucuuuuuaaaauaaucuaagcaucauugaagcaguaacacaaaaaaaagguu

SEQ ID NO: 414774 - RNA, 64 nt, hsa
guuauauagccaauauaacuaucucuacugaaugucauugaaaaacuaaaaaauuaaacuuauu

SEQ ID NO: 414775 - RNA, 64 nt, hsa
uaacaguuaccugagagauuuaacauuaucuaguucauugaaucauuguauguggucauggaua

SEQ ID NO: 414776 - RNA, 64 nt, hsa
cuauuguuccauauaaccaaaaagcaugguuuauucauugaaacacgguugaccugaacucgug

SEQ ID NO: 414777 - RNA, 64 nt, hsa
guaggagucacgugcagccuuucucaggggacugucauugaaaaggaaacguuugaugucugug

SEQ ID NO: 414778 - RNA, 64 nt, hsa
cuucugcucagccugcuuggcguuaaaauacaaaucauugaacugagggggaaaaauguaacua

SEQ ID NO: 414779 - RNA, 64 nt, hsa
uucccgcucuuaagacauggcuggagcucagucuucauugaaugaaguuugcugugguauugca

SEQ ID NO: 414780 - RNA, 64 nt, hsa; identical to SEQ ID NO: 392458

SEQ ID NO: 414781 - RNA, 64 nt, hsa; identical to SEQ ID NO: 392459

SEQ ID NO: 414782 - RNA, 64 nt, hsa; identical to SEQ ID NO: 392460

SEQ ID NO: 414783 - RNA, 64 nt, hsa; identical to SEQ ID NO: 392461

SEQ ID NO: 414784 - RNA, 58 nt, hsa
ucacuccaaaauaggugcugauccuuccuauuccuauucuuugccaccuuuugggugu

SEQ ID NO: 414785 - RNA, 58 nt, hsa
caaauaggcuuuagaagagauuauccuauauuccuaucaguauaauacuaaaauguaa

SEQ ID NO: 414786 - RNA, 58 nt, hsa
aaacgugccuucuguauaaguuuauguuuauuccuacauuuuauucauuuuuaaugua

SEQ ID NO: 414787 - RNA, 58 nt, hsa
uuuguguggagguucuuuugaccaauuuuauuccuaagaauaaacaaaccccuacagu

SEQ ID NO: 414788 - RNA, 58 nt, hsa
cugcgucagacaaaccugccuuccauuuuauuccuaaacaagauaguuacaaagauuu

SEQ ID NO: 414789 - RNA, 58 nt, hsa
agguagaaacuucucaacuuuuuucauuuauuccuaaguauuucuuacuuuaaguucu

SEQ ID NO: 414790 - RNA, 58 nt, hsa
cccuaauucucaucugucagauccaguguauuccuaagcugggacaaagccucuguuu

SEQ ID NO: 414791 - RNA, 58 nt, hsa
ucuucuuccucuucuuuucacaggugcuuauuccuaauaaacaucuugcaacccaaac

SEQ ID NO: 414792 - RNA, 64 nt, hsa; identical to SEQ ID NO: 43747

SEQ ID NO: 414793 - RNA, 64 nt, hsa; identical to SEQ ID NO: 43748

SEQ ID NO: 414794 - RNA, 64 nt, hsa; identical to SEQ ID NO: 43749

SEQ ID NO: 414795 - RNA, 64 nt, hsa; identical to SEQ ID NO: 43750

SEQ ID NO: 414796 - RNA, 64 nt, hsa; identical to SEQ ID NO: 43751

SEQ ID NO: 414797 - RNA, 64 nt, hsa; identical to SEQ ID NO: 43752

SEQ ID NO: 414798 - RNA, 64 nt, hsa; identical to SEQ ID NO: 43753

SEQ ID NO: 414799 - RNA, 64 nt, hsa; identical to SEQ ID NO: 43754

SEQ ID NO: 414800 - RNA, 64 nt, hsa; identical to SEQ ID NO: 43755

SEQ ID NO: 414801 - RNA, 64 nt, hsa; identical to SEQ ID NO: 43756

SEQ ID NO: 414802 - RNA, 64 nt, hsa; identical to SEQ ID NO: 43757

SEQ ID NO: 414803 - RNA, 64 nt, hsa; identical to SEQ ID NO: 43758

SEQ ID NO: 414804 - RNA, 64 nt, hsa; identical to SEQ ID NO: 43759

SEQ ID NO: 414805 - RNA, 64 nt, hsa; identical to SEQ ID NO: 43760

SEQ ID NO: 414806 - RNA, 64 nt, hsa; identical to SEQ ID NO: 43761

SEQ ID NO: 414807 - RNA, 64 nt, hsa; identical to SEQ ID NO: 173010

SEQ ID NO: 414808 - RNA, 64 nt, hsa; identical to SEQ ID NO: 173011

SEQ ID NO: 414809 - RNA, 64 nt, hsa; identical to SEQ ID NO: 173012

SEQ ID NO: 414810 - RNA, 64 nt, hsa; identical to SEQ ID NO: 173013

SEQ ID NO: 414811 - RNA, 64 nt, hsa; identical to SEQ ID NO: 173014

SEQ ID NO: 414812 - RNA, 64 nt, hsa; identical to SEQ ID NO: 173015

SEQ ID NO: 414813 - RNA, 64 nt, hsa; identical to SEQ ID NO: 173016

SEQ ID NO: 414814 - RNA, 64 nt, hsa; identical to SEQ ID NO: 173017

SEQ ID NO: 414815 - RNA, 64 nt, hsa; identical to SEQ ID NO: 173018

SEQ ID NO: 414816 - RNA, 64 nt, hsa; identical to SEQ ID NO: 173019

SEQ ID NO: 414817 - RNA, 64 nt, hsa; identical to SEQ ID NO: 173020

SEQ ID NO: 414818 - RNA, 64 nt, hsa; identical to SEQ ID NO: 173021

SEQ ID NO: 414819 - RNA, 64 nt, hsa; identical to SEQ ID NO: 173022

SEQ ID NO: 414820 - RNA, 64 nt, hsa; identical to SEQ ID NO: 173023

SEQ ID NO: 414821 - RNA, 64 nt, hsa; identical to SEQ ID NO: 173024

SEQ ID NO: 414822 - RNA, 64 nt, hsa; identical to SEQ ID NO: 173025

SEQ ID NO: 414823 - RNA, 64 nt, hsa; identical to SEQ ID NO: 173026

SEQ ID NO: 414824 - RNA, 64 nt, hsa; identical to SEQ ID NO: 173027

SEQ ID NO: 414825 - RNA, 64 nt, hsa; identical to SEQ ID NO: 173028

SEQ ID NO: 414826 - RNA, 64 nt, hsa; identical to SEQ ID NO: 173029

SEQ ID NO: 414827 - RNA, 64 nt, hsa; identical to SEQ ID NO: 173030

SEQ ID NO: 414828 - RNA, 64 nt, hsa; identical to SEQ ID NO: 173031

SEQ ID NO: 414829 - RNA, 64 nt, hsa; identical to SEQ ID NO: 173032

SEQ ID NO: 414830 - RNA, 64 nt, hsa; identical to SEQ ID NO: 173033

SEQ ID NO: 414831 - RNA, 64 nt, hsa; identical to SEQ ID NO: 173034

SEQ ID NO: 414832 - RNA, 64 nt, hsa; identical to SEQ ID NO: 173035

SEQ ID NO: 414833 - RNA, 64 nt, hsa; identical to SEQ ID NO: 173036

SEQ ID NO: 414834 - RNA, 64 nt, hsa; identical to SEQ ID NO: 173037

SEQ ID NO: 414835 - RNA, 64 nt, hsa; identical to SEQ ID NO: 173038

SEQ ID NO: 414836 - RNA, 64 nt, hsa; identical to SEQ ID NO: 173039

SEQ ID NO: 414837 - RNA, 64 nt, hsa; identical to SEQ ID NO: 173040

SEQ ID NO: 414838 - RNA, 64 nt, hsa; identical to SEQ ID NO: 173041

SEQ ID NO: 414839 - RNA, 64 nt, hsa; identical to SEQ ID NO: 173042

SEQ ID NO: 414840 - RNA, 64 nt, hsa; identical to SEQ ID NO: 173043

SEQ ID NO: 414841 - RNA, 64 nt, hsa; identical to SEQ ID NO: 173044

SEQ ID NO: 414842 - RNA, 64 nt, hsa
cucagcugugugucugagcccacucagcagcaggcaugaucagggcagggcccagcgcuaaggg

SEQ ID NO: 414843 - RNA, 64 nt, hsa
ggaaaacugaggcacagagagguuagggacuuuucaugaucacacagcuaauaagugguggucc

SEQ ID NO: 414844 - RNA, 64 nt, hsa
ucuguucauuuuugucuaugauaaauaaugcuaccaugaucauuuguguacaaauuuaugugug

SEQ ID NO: 414845 - RNA, 64 nt, hsa
gucugacucuguugcccaagcuggagugcaguggcaugaucauagcucauuguaaccucaaacu

SEQ ID NO: 414846 - RNA, 64 nt, hsa
ccccucacucuugccccaagaaaagaggccaaagcaagagcagauucccuaggcaagagcagca

SEQ ID NO: 414847 - RNA, 64 nt, hsa
gaaaagaggccaaagcaagagcagauucccuaggcaagagcagcagcacaacuaggaaacccca

SEQ ID NO: 414848 - RNA, 64 nt, hsa
cuucguugguuuuuuggagucuugguugugacuccaagagcagagugaggaagacccccaagca

SEQ ID NO: 414849 - RNA, 64 nt, hsa
acuuuguuggcuuuuagaguguuggucaugacuccaagagcagagcagggaagagcccaagcau

SEQ ID NO: 414850 - RNA, 64 nt, hsa
guugacuuagaagcaauagggggcagcaggccaccaagagcacaaccccagggcgaggucuggg

SEQ ID NO: 414851 - RNA, 64 nt, hsa
agcugggcggcauccacagccagagaggcagaggcaagagcagagccaggcugugcccgaggga

SEQ ID NO: 414852 - RNA, 64 nt, hsa
gaccucaacacacuggauuccagguggacuggaccaagagcaggcaaagacacgggaacugaaa

SEQ ID NO: 414853 - RNA, 64 nt, hsa
agcauugcccuaagaaucagaaguaaagauaauccaagagcaaaacccacuguacuuggggccu

SEQ ID NO: 414854 - RNA, 64 nt, hsa
aucaaacagcaagcacugacaagcagcacauucucaagagcacacagguaagaggaccugcuuu

SEQ ID NO: 414855 - RNA, 64 nt, hsa
gaggcaugaccuuuguauuucacuaaguuuaaagcaagagcaacugaugauuaaauguugcuuu

SEQ ID NO: 414856 - RNA, 64 nt, hsa
ccugcuuuugccuugcucuguuccucuuuggucccaagagcagcagccgcagccuccucgugau

SEQ ID NO: 414857 - RNA, 64 nt, hsa
ggucacuucccauggcugcaguccacuggugggacaagagcaaagcccacugccaguaagaagg

SEQ ID NO: 414858 - RNA, 64 nt, hsa
uccacuaucaaugaacccagacucuugucuucuucaagagcaagggccuccggagauccaaacu

SEQ ID NO: 414859 - RNA, 64 nt, hsa
ucuccuuucuccuggcagcagaaaaggaagaacacaagagcaaacacacaacaaugaugguggc

SEQ ID NO: 414860 - RNA, 64 nt, hsa
gcugcacugucgguguuaagagaaauuacucucacaagagcagaggccugaagauucuuucuuc

SEQ ID NO: 414861 - RNA, 64 nt, hsa
uagcucagguuaaaaacacccauuuaaacaaaaacaagagcauuuguaauaggaaguguuuaua

SEQ ID NO: 414862 - RNA, 64 nt, hsa
ugugcaagaaaaugagggcuugagucgccugaaccaagagcaggaagagguugcuggagcaaga

SEQ ID NO: 414863 - RNA, 61 nt, hsa
ggaagaaaaugagggcuugagucaccugaaccaagagcaggaagagguugcucagguuguu

SEQ ID NO: 414864 - RNA, 64 nt, hsa
ggaagaugcuaacgcaguaaggucugugcugggccaagagcagcuuugaagcuccagagaacca

SEQ ID NO: 414865 - RNA, 64 nt, hsa
cuuuucuuuuucuuuuuuuuuuuuuuuuaaacaccaagagcacguauagcaugggggaaagaac

SEQ ID NO: 414866 - RNA, 64 nt, hsa
cuucuugccuguggguucccucacccccaugccuguccuccaggcuggggcagguucuuaguuu

SEQ ID NO: 414867 - RNA, 64 nt, hsa
acuugccacacugugucgucguuuguuugccuauguccuccagggcacgguggcaggaacaacu

SEQ ID NO: 414868 - RNA, 64 nt, hsa
cuugacuggcuggagccuucaaagccacugggauguccuccaggcaccugggucccaugaccag

SEQ ID NO: 414869 - RNA, 64 nt, hsa
uuggcuucugcacuccuuggcgucagccucucagguccuccauucacacgagguccuccucgcu

SEQ ID NO: 414870 - RNA, 64 nt, hsa
cauugagcagccuuagcauugucccccuacucccguccuccagguguccccaucccuccccugu

SEQ ID NO: 414871 - RNA, 64 nt, hsa
ucgugaggccucuccccuggcaccugcuucaguuguccuccacagcacugauuugcagcccaca

SEQ ID NO: 414872 - RNA, 64 nt, hsa
ccaggaagggaaggggggucagaagagagggugaguccuccagaacucuuccuccaaggacaga

SEQ ID NO: 414873 - RNA, 64 nt, hsa
cagggugagguggcaugguccauucucaagggacguccuccaacggguggcgcuagaggccaug

SEQ ID NO: 414874 - RNA, 64 nt, hsa; identical to SEQ ID NO: 24182

SEQ ID NO: 414875 - RNA, 64 nt, hsa; identical to SEQ ID NO: 24183

SEQ ID NO: 414876 - RNA, 64 nt, hsa; identical to SEQ ID NO: 24184

SEQ ID NO: 414877 - RNA, 64 nt, hsa; identical to SEQ ID NO: 24185

SEQ ID NO: 414878 - RNA, 64 nt, hsa; identical to SEQ ID NO: 24186

SEQ ID NO: 414879 - RNA, 64 nt, hsa; identical to SEQ ID NO: 24187

SEQ ID NO: 414880 - RNA, 64 nt, hsa; identical to SEQ ID NO: 24188

SEQ ID NO: 414881 - RNA, 64 nt, hsa; identical to SEQ ID NO: 24189

SEQ ID NO: 414882 - RNA, 64 nt, hsa; identical to SEQ ID NO: 24190

SEQ ID NO: 414883 - RNA, 64 nt, hsa; identical to SEQ ID NO: 24191

SEQ ID NO: 414884 - RNA, 64 nt, hsa; identical to SEQ ID NO: 24192

SEQ ID NO: 414885 - RNA, 64 nt, hsa; identical to SEQ ID NO: 24193

SEQ ID NO: 414886 - RNA, 64 nt, hsa; identical to SEQ ID NO: 24194

SEQ ID NO: 414887 - RNA, 64 nt, hsa; identical to SEQ ID NO: 24195

SEQ ID NO: 414888 - RNA, 64 nt, hsa; identical to SEQ ID NO: 24196

SEQ ID NO: 414889 - RNA, 64 nt, hsa; identical to SEQ ID NO: 24197

SEQ ID NO: 414890 - RNA, 64 nt, hsa; identical to SEQ ID NO: 24198

SEQ ID NO: 414891 - RNA, 64 nt, hsa; identical to SEQ ID NO: 24199

SEQ ID NO: 414892 - RNA, 64 nt, hsa; identical to SEQ ID NO: 24200

SEQ ID NO: 414893 - RNA, 64 nt, hsa; identical to SEQ ID NO: 24201

SEQ ID NO: 414894 - RNA, 64 nt, hsa; identical to SEQ ID NO: 24202

SEQ ID NO: 414895 - RNA, 64 nt, hsa; identical to SEQ ID NO: 24203

SEQ ID NO: 414896 - RNA, 64 nt, hsa; identical to SEQ ID NO: 24204

SEQ ID NO: 414897 - RNA, 64 nt, hsa; identical to SEQ ID NO: 24205

SEQ ID NO: 414898 - RNA, 64 nt, hsa; identical to SEQ ID NO: 24206

SEQ ID NO: 414899 - RNA, 64 nt, hsa; identical to SEQ ID NO: 24207

SEQ ID NO: 414900 - RNA, 64 nt, hsa; identical to SEQ ID NO: 24208

SEQ ID NO: 414901 - RNA, 64 nt, hsa; identical to SEQ ID NO: 24209

SEQ ID NO: 414902 - RNA, 64 nt, hsa; identical to SEQ ID NO: 24210

SEQ ID NO: 414903 - RNA, 64 nt, hsa; identical to SEQ ID NO: 24211

SEQ ID NO: 414904 - RNA, 64 nt, hsa; identical to SEQ ID NO: 24212

SEQ ID NO: 414905 - RNA, 64 nt, hsa; identical to SEQ ID NO: 24213

SEQ ID NO: 414906 - RNA, 64 nt, hsa; identical to SEQ ID NO: 24214

SEQ ID NO: 414907 - RNA, 64 nt, hsa; identical to SEQ ID NO: 24215

SEQ ID NO: 414908 - RNA, 64 nt, hsa; identical to SEQ ID NO: 24216

SEQ ID NO: 414909 - RNA, 64 nt, hsa; identical to SEQ ID NO: 24217

SEQ ID NO: 414910 - RNA, 64 nt, hsa; identical to SEQ ID NO: 24218

SEQ ID NO: 414911 - RNA, 64 nt, hsa; identical to SEQ ID NO: 24219

SEQ ID NO: 414912 - RNA, 64 nt, hsa; identical to SEQ ID NO: 24220

SEQ ID NO: 414913 - RNA, 64 nt, hsa; identical to SEQ ID NO: 24221

SEQ ID NO: 414914 - RNA, 64 nt, hsa; identical to SEQ ID NO: 24222

SEQ ID NO: 414915 - RNA, 64 nt, hsa; identical to SEQ ID NO: 24223

SEQ ID NO: 414916 - RNA, 64 nt, hsa; identical to SEQ ID NO: 24224

SEQ ID NO: 414917 - RNA, 64 nt, hsa; identical to SEQ ID NO: 24225

SEQ ID NO: 414918 - RNA, 64 nt, hsa; identical to SEQ ID NO: 24226

SEQ ID NO: 414919 - RNA, 64 nt, hsa; identical to SEQ ID NO: 24227

SEQ ID NO: 414920 - RNA, 64 nt, hsa; identical to SEQ ID NO: 24228

SEQ ID NO: 414921 - RNA, 64 nt, hsa; identical to SEQ ID NO: 24229

SEQ ID NO: 414922 - RNA, 64 nt, hsa; identical to SEQ ID NO: 24230

SEQ ID NO: 414923 - RNA, 64 nt, hsa; identical to SEQ ID NO: 24231

SEQ ID NO: 414924 - RNA, 64 nt, hsa; identical to SEQ ID NO: 24232

SEQ ID NO: 414925 - RNA, 64 nt, hsa; identical to SEQ ID NO: 24233

SEQ ID NO: 414926 - RNA, 64 nt, hsa; identical to SEQ ID NO: 24234

SEQ ID NO: 414927 - RNA, 64 nt, hsa; identical to SEQ ID NO: 24235

SEQ ID NO: 414928 - RNA, 64 nt, hsa; identical to SEQ ID NO: 24236

SEQ ID NO: 414929 - RNA, 64 nt, hsa; identical to SEQ ID NO: 24237

SEQ ID NO: 414930 - RNA, 64 nt, hsa; identical to SEQ ID NO: 24238

SEQ ID NO: 414931 - RNA, 64 nt, hsa; identical to SEQ ID NO: 24239

SEQ ID NO: 414932 - RNA, 64 nt, hsa; identical to SEQ ID NO: 24240

SEQ ID NO: 414933 - RNA, 64 nt, hsa; identical to SEQ ID NO: 24241

SEQ ID NO: 414934 - RNA, 64 nt, hsa; identical to SEQ ID NO: 24242

SEQ ID NO: 414935 - RNA, 64 nt, hsa; identical to SEQ ID NO: 24243

SEQ ID NO: 414936 - RNA, 64 nt, hsa; identical to SEQ ID NO: 24244

SEQ ID NO: 414937 - RNA, 64 nt, hsa; identical to SEQ ID NO: 24245

SEQ ID NO: 414938 - RNA, 64 nt, hsa; identical to SEQ ID NO: 24246

SEQ ID NO: 414939 - RNA, 64 nt, hsa; identical to SEQ ID NO: 24247

SEQ ID NO: 414940 - RNA, 64 nt, hsa; identical to SEQ ID NO: 24248

SEQ ID NO: 414941 - RNA, 64 nt, hsa; identical to SEQ ID NO: 24249

SEQ ID NO: 414942 - RNA, 64 nt, hsa; identical to SEQ ID NO: 24250

SEQ ID NO: 414943 - RNA, 64 nt, hsa; identical to SEQ ID NO: 24247

SEQ ID NO: 414944 - RNA, 64 nt, hsa; identical to SEQ ID NO: 24252

SEQ ID NO: 414945 - RNA, 64 nt, hsa; identical to SEQ ID NO: 24253

SEQ ID NO: 414946 - RNA, 64 nt, hsa; identical to SEQ ID NO: 24254

SEQ ID NO: 414947 - RNA, 64 nt, hsa; identical to SEQ ID NO: 24255

SEQ ID NO: 414948 - RNA, 64 nt, hsa; identical to SEQ ID NO: 24256

SEQ ID NO: 414949 - RNA, 64 nt, hsa; identical to SEQ ID NO: 24257

SEQ ID NO: 414950 - RNA, 64 nt, hsa; identical to SEQ ID NO: 24258

SEQ ID NO: 414951 - RNA, 64 nt, hsa; identical to SEQ ID NO: 24259

SEQ ID NO: 414952 - RNA, 64 nt, hsa; identical to SEQ ID NO: 24260

SEQ ID NO: 414953 - RNA, 64 nt, hsa; identical to SEQ ID NO: 24261

SEQ ID NO: 414954 - RNA, 64 nt, hsa; identical to SEQ ID NO: 24262

SEQ ID NO: 414955 - RNA, 64 nt, hsa; identical to SEQ ID NO: 24263

SEQ ID NO: 414956 - RNA, 64 nt, hsa; identical to SEQ ID NO: 24264

SEQ ID NO: 414957 - RNA, 64 nt, hsa; identical to SEQ ID NO: 24265

SEQ ID NO: 414958 - RNA, 64 nt, hsa; identical to SEQ ID NO: 24266

SEQ ID NO: 414959 - RNA, 64 nt, hsa; identical to SEQ ID NO: 24267

SEQ ID NO: 414960 - RNA, 64 nt, hsa; identical to SEQ ID NO: 24268

SEQ ID NO: 414961 - RNA, 64 nt, hsa; identical to SEQ ID NO: 24269

SEQ ID NO: 414962 - RNA, 64 nt, hsa; identical to SEQ ID NO: 24270

SEQ ID NO: 414963 - RNA, 64 nt, hsa; identical to SEQ ID NO: 24271

SEQ ID NO: 414964 - RNA, 64 nt, hsa; identical to SEQ ID NO: 24272

SEQ ID NO: 414965 - RNA, 64 nt, hsa; identical to SEQ ID NO: 24273

SEQ ID NO: 414966 - RNA, 64 nt, hsa; identical to SEQ ID NO: 24274

SEQ ID NO: 414967 - RNA, 64 nt, hsa; identical to SEQ ID NO: 24275

SEQ ID NO: 414968 - RNA, 64 nt, hsa; identical to SEQ ID NO: 24276

SEQ ID NO: 414969 - RNA, 64 nt, hsa; identical to SEQ ID NO: 24277

SEQ ID NO: 414970 - RNA, 64 nt, hsa; identical to SEQ ID NO: 24278

SEQ ID NO: 414971 - RNA, 64 nt, hsa; identical to SEQ ID NO: 24279

SEQ ID NO: 414972 - RNA, 64 nt, hsa; identical to SEQ ID NO: 24280

SEQ ID NO: 414973 - RNA, 64 nt, hsa; identical to SEQ ID NO: 24281

SEQ ID NO: 414974 - RNA, 64 nt, hsa; identical to SEQ ID NO: 24282

SEQ ID NO: 414975 - RNA, 64 nt, hsa; identical to SEQ ID NO: 24283

SEQ ID NO: 414976 - RNA, 64 nt, hsa; identical to SEQ ID NO: 24284

SEQ ID NO: 414977 - RNA, 64 nt, hsa; identical to SEQ ID NO: 24285

SEQ ID NO: 414978 - RNA, 64 nt, hsa; identical to SEQ ID NO: 24286

SEQ ID NO: 414979 - RNA, 64 nt, hsa; identical to SEQ ID NO: 24287

SEQ ID NO: 414980 - RNA, 64 nt, hsa; identical to SEQ ID NO: 24288

SEQ ID NO: 414981 - RNA, 64 nt, hsa; identical to SEQ ID NO: 24289

SEQ ID NO: 414982 - RNA, 64 nt, hsa; identical to SEQ ID NO: 24290

SEQ ID NO: 414983 - RNA, 64 nt, hsa; identical to SEQ ID NO: 24291

SEQ ID NO: 414984 - RNA, 64 nt, hsa; identical to SEQ ID NO: 24292

SEQ ID NO: 414985 - RNA, 64 nt, hsa; identical to SEQ ID NO: 24293

SEQ ID NO: 414986 - RNA, 64 nt, hsa; identical to SEQ ID NO: 24294

SEQ ID NO: 414987 - RNA, 64 nt, hsa; identical to SEQ ID NO: 24295

SEQ ID NO: 414988 - RNA, 64 nt, hsa; identical to SEQ ID NO: 24296

SEQ ID NO: 414989 - RNA, 64 nt, hsa; identical to SEQ ID NO: 24297

SEQ ID NO: 414990 - RNA, 64 nt, hsa; identical to SEQ ID NO: 24298

SEQ ID NO: 414991 - RNA, 64 nt, hsa; identical to SEQ ID NO: 24299

SEQ ID NO: 414992 - RNA, 64 nt, hsa; identical to SEQ ID NO: 24300

SEQ ID NO: 414993 - RNA, 64 nt, hsa; identical to SEQ ID NO: 24301

SEQ ID NO: 414994 - RNA, 64 nt, hsa; identical to SEQ ID NO: 24302

SEQ ID NO: 414995 - RNA, 64 nt, hsa; identical to SEQ ID NO: 24303

SEQ ID NO: 414996 - RNA, 64 nt, hsa; identical to SEQ ID NO: 24304

SEQ ID NO: 414997 - RNA, 64 nt, hsa; identical to SEQ ID NO: 24305

SEQ ID NO: 414998 - RNA, 64 nt, hsa; identical to SEQ ID NO: 24306

SEQ ID NO: 414999 - RNA, 64 nt, hsa; identical to SEQ ID NO: 24307

SEQ ID NO: 415000 - RNA, 64 nt, hsa; identical to SEQ ID NO: 24308

SEQ ID NO: 415001 - RNA, 64 nt, hsa; identical to SEQ ID NO: 24309

SEQ ID NO: 415002 - RNA, 64 nt, hsa; identical to SEQ ID NO: 24310

SEQ ID NO: 415003 - RNA, 64 nt, hsa; identical to SEQ ID NO: 24311

SEQ ID NO: 415004 - RNA, 64 nt, hsa; identical to SEQ ID NO: 24312

SEQ ID NO: 415005 - RNA, 64 nt, hsa; identical to SEQ ID NO: 24313

SEQ ID NO: 415006 - RNA, 64 nt, hsa; identical to SEQ ID NO: 24314

SEQ ID NO: 415007 - RNA, 64 nt, hsa; identical to SEQ ID NO: 24315

SEQ ID NO: 415008 - RNA, 64 nt, hsa; identical to SEQ ID NO: 24316

SEQ ID NO: 415009 - RNA, 64 nt, hsa; identical to SEQ ID NO: 24317

SEQ ID NO: 415010 - RNA, 64 nt, hsa; identical to SEQ ID NO: 24318

SEQ ID NO: 415011 - RNA, 64 nt, hsa; identical to SEQ ID NO: 24319

SEQ ID NO: 415012 - RNA, 64 nt, hsa; identical to SEQ ID NO: 24320

SEQ ID NO: 415013 - RNA, 64 nt, hsa; identical to SEQ ID NO: 24321

SEQ ID NO: 415014 - RNA, 64 nt, hsa; identical to SEQ ID NO: 24322

SEQ ID NO: 415015 - RNA, 64 nt, hsa; identical to SEQ ID NO: 24323

SEQ ID NO: 415016 - RNA, 64 nt, hsa; identical to SEQ ID NO: 24324

SEQ ID NO: 415017 - RNA, 64 nt, hsa; identical to SEQ ID NO: 24325

SEQ ID NO: 415018 - RNA, 64 nt, hsa; identical to SEQ ID NO: 24326

SEQ ID NO: 415019 - RNA, 64 nt, hsa; identical to SEQ ID NO: 24327

SEQ ID NO: 415020 - RNA, 64 nt, hsa; identical to SEQ ID NO: 225462

SEQ ID NO: 415021 - RNA, 64 nt, hsa; identical to SEQ ID NO: 225463

SEQ ID NO: 415022 - RNA, 64 nt, hsa; identical to SEQ ID NO: 225464

SEQ ID NO: 415023 - RNA, 64 nt, hsa; identical to SEQ ID NO: 225465

SEQ ID NO: 415024 - RNA, 64 nt, hsa; identical to SEQ ID NO: 225466

SEQ ID NO: 415025 - RNA, 64 nt, hsa; identical to SEQ ID NO: 225467

SEQ ID NO: 415026 - RNA, 64 nt, hsa; identical to SEQ ID NO: 225468

SEQ ID NO: 415027 - RNA, 64 nt, hsa; identical to SEQ ID NO: 225469

SEQ ID NO: 415028 - RNA, 56 nt, hsa; identical to SEQ ID NO: 225470

SEQ ID NO: 415029 - RNA, 64 nt, hsa; identical to SEQ ID NO: 225471

SEQ ID NO: 415030 - RNA, 64 nt, hsa; identical to SEQ ID NO: 225472

SEQ ID NO: 415031 - RNA, 64 nt, hsa; identical to SEQ ID NO: 225473

SEQ ID NO: 415032 - RNA, 64 nt, hsa; identical to SEQ ID NO: 225474

SEQ ID NO: 415033 - RNA, 64 nt, hsa; identical to SEQ ID NO: 225475

SEQ ID NO: 415034 - RNA, 64 nt, hsa; identical to SEQ ID NO: 225476

SEQ ID NO: 415035 - RNA, 64 nt, hsa; identical to SEQ ID NO: 225477

SEQ ID NO: 415036 - RNA, 64 nt, hsa; identical to SEQ ID NO: 225478

SEQ ID NO: 415037 - RNA, 64 nt, hsa; identical to SEQ ID NO: 225479

SEQ ID NO: 415038 - RNA, 64 nt, hsa; identical to SEQ ID NO: 225480

SEQ ID NO: 415039 - RNA, 64 nt, hsa; identical to SEQ ID NO: 225481

SEQ ID NO: 415040 - RNA, 64 nt, hsa; identical to SEQ ID NO: 225482

SEQ ID NO: 415041 - RNA, 64 nt, hsa; identical to SEQ ID NO: 225483

SEQ ID NO: 415042 - RNA, 64 nt, hsa; identical to SEQ ID NO: 225484

SEQ ID NO: 415043 - RNA, 64 nt, hsa; identical to SEQ ID NO: 225485

SEQ ID NO: 415044 - RNA, 64 nt, hsa; identical to SEQ ID NO: 225486

SEQ ID NO: 415045 - RNA, 64 nt, hsa; identical to SEQ ID NO: 225487

SEQ ID NO: 415046 - RNA, 64 nt, hsa
ugcaaguuuuugacuugaaggaaagaaagaggaaggcugguagaagcaguuagagcaauguguu

SEQ ID NO: 415047 - RNA, 64 nt, hsa
ucuuccuauuccacugagucucugaagggaauagggcugguagugggugggaaaaggggaaaaa

SEQ ID NO: 415048 - RNA, 64 nt, hsa; identical to SEQ ID NO: 125963

SEQ ID NO: 415049 - RNA, 64 nt, hsa; identical to SEQ ID NO: 125964

SEQ ID NO: 415050 - RNA, 64 nt, hsa; identical to SEQ ID NO: 125965

SEQ ID NO: 415051 - RNA, 64 nt, hsa; identical to SEQ ID NO: 125966

SEQ ID NO: 415052 - RNA, 64 nt, hsa; identical to SEQ ID NO: 125967

SEQ ID NO: 415053 - RNA, 64 nt, hsa; identical to SEQ ID NO: 125968

SEQ ID NO: 415054 - RNA, 64 nt, hsa; identical to SEQ ID NO: 125969

SEQ ID NO: 415055 - RNA, 64 nt, hsa; identical to SEQ ID NO: 125970

SEQ ID NO: 415056 - RNA, 64 nt, hsa; identical to SEQ ID NO: 125971

SEQ ID NO: 415057 - RNA, 64 nt, hsa; identical to SEQ ID NO: 125972

SEQ ID NO: 415058 - RNA, 64 nt, hsa; identical to SEQ ID NO: 125973

SEQ ID NO: 415059 - RNA, 64 nt, hsa; identical to SEQ ID NO: 125974

SEQ ID NO: 415060 - RNA, 64 nt, hsa; identical to SEQ ID NO: 125975

SEQ ID NO: 415061 - RNA, 64 nt, hsa; identical to SEQ ID NO: 125976

SEQ ID NO: 415062 - RNA, 64 nt, hsa; identical to SEQ ID NO: 125977

SEQ ID NO: 415063 - RNA, 64 nt, hsa; identical to SEQ ID NO: 125978

SEQ ID NO: 415064 - RNA, 64 nt, hsa; identical to SEQ ID NO: 125979

SEQ ID NO: 415065 - RNA, 64 nt, hsa; identical to SEQ ID NO: 125980

SEQ ID NO: 415066 - RNA, 64 nt, hsa; identical to SEQ ID NO: 125981

SEQ ID NO: 415067 - RNA, 64 nt, hsa; identical to SEQ ID NO: 125982

SEQ ID NO: 415068 - RNA, 64 nt, hsa; identical to SEQ ID NO: 125983

SEQ ID NO: 415069 - RNA, 64 nt, hsa; identical to SEQ ID NO: 125984

SEQ ID NO: 415070 - RNA, 64 nt, hsa; identical to SEQ ID NO: 125985

SEQ ID NO: 415071 - RNA, 64 nt, hsa; identical to SEQ ID NO: 125986

SEQ ID NO: 415072 - RNA, 64 nt, hsa; identical to SEQ ID NO: 125987

SEQ ID NO: 415073 - RNA, 64 nt, hsa; identical to SEQ ID NO: 125988

SEQ ID NO: 415074 - RNA, 64 nt, hsa; identical to SEQ ID NO: 125989

SEQ ID NO: 415075 - RNA, 64 nt, hsa; identical to SEQ ID NO: 125990

SEQ ID NO: 415076 - RNA, 64 nt, hsa; identical to SEQ ID NO: 125991

SEQ ID NO: 415077 - RNA, 64 nt, hsa; identical to SEQ ID NO: 125992

SEQ ID NO: 415078 - RNA, 64 nt, hsa; identical to SEQ ID NO: 125993

SEQ ID NO: 415079 - RNA, 64 nt, hsa; identical to SEQ ID NO: 125994

SEQ ID NO: 415080 - RNA, 64 nt, hsa; identical to SEQ ID NO: 125995

SEQ ID NO: 415081 - RNA, 64 nt, hsa; identical to SEQ ID NO: 125996

SEQ ID NO: 415082 - RNA, 64 nt, hsa; identical to SEQ ID NO: 125997

SEQ ID NO: 415083 - RNA, 64 nt, hsa; identical to SEQ ID NO: 125998

SEQ ID NO: 415084 - RNA, 64 nt, hsa; identical to SEQ ID NO: 327419

SEQ ID NO: 415085 - RNA, 64 nt, hsa; identical to SEQ ID NO: 327420

SEQ ID NO: 415086 - RNA, 64 nt, hsa; identical to SEQ ID NO: 327421

SEQ ID NO: 415087 - RNA, 64 nt, hsa; identical to SEQ ID NO: 327422

SEQ ID NO: 415088 - RNA, 64 nt, hsa; identical to SEQ ID NO: 327423

SEQ ID NO: 415089 - RNA, 64 nt, hsa; identical to SEQ ID NO: 327424

SEQ ID NO: 415090 - RNA, 64 nt, hsa; identical to SEQ ID NO: 141798

SEQ ID NO: 415091 - RNA, 64 nt, hsa; identical to SEQ ID NO: 141799

SEQ ID NO: 415092 - RNA, 64 nt, hsa; identical to SEQ ID NO: 141800

SEQ ID NO: 415093 - RNA, 64 nt, hsa; identical to SEQ ID NO: 141801

SEQ ID NO: 415094 - RNA, 64 nt, hsa; identical to SEQ ID NO: 141802

SEQ ID NO: 415095 - RNA, 64 nt, hsa; identical to SEQ ID NO: 141803

SEQ ID NO: 415096 - RNA, 64 nt, hsa; identical to SEQ ID NO: 141804

SEQ ID NO: 415097 - RNA, 64 nt, hsa; identical to SEQ ID NO: 141805

SEQ ID NO: 415098 - RNA, 64 nt, hsa
uauucagaccuuaguacagcaagacacucuggccaccauaaaaaacgcagaaaagaaaaaaagg

SEQ ID NO: 415099 - RNA, 64 nt, hsa
gcaaauauuaaagagacugguagcucaucauccuaccauaaaagagaaaaaaauucggaaagug

SEQ ID NO: 415100 - RNA, 64 nt, hsa
aucaaaagagaaaaaaguuucugaaaacaaugaaaccauaaaagauaauauucuaaaaacugag

SEQ ID NO: 415101 - RNA, 64 nt, hsa
aauuuuauucgccaugacuuucuagugaauuauuaccauaaauaacaauuucagaaacuuaguu

SEQ ID NO: 415102 - RNA, 64 nt, hsa
cccucuguuagucauuuguaaauucuaaauggucaccauaaaauguauuagguaggagaagaua

SEQ ID NO: 415103 - RNA, 64 nt, hsa
ugguuugcauuucauaaaaggcaaaguuuacagaaccauaaacauucucaauuuucuuuaugcu

SEQ ID NO: 415104 - RNA, 64 nt, hsa
ugcucagguauaaagccaauuaagguacaauuguaccauaaagggaacaaucuguuucugauug

SEQ ID NO: 415105 - RNA, 64 nt, hsa
aacccacaaguagcuacgacugcaagcaccugccaccauaaagggcugcauuuugccaccauaa

SEQ ID NO: 415106 - RNA, 64 nt, hsa
aagcaccugccaccauaaagggcugcauuuugccaccauaaagggcugcauuuuuuuaaaaagc

SEQ ID NO: 415107 - RNA, 64 nt, hsa
aguagaccaagucagaaagaucucucucgagcguaccauaaaccugcagagagaagucucgaaa

SEQ ID NO: 415108 - RNA, 64 nt, hsa
gcagauggcguggaagcauucaucaggggagauaaccauaaaggauuuggccuaauuaccauac

SEQ ID NO: 415109 - RNA, 64 nt, hsa; identical to SEQ ID NO: 84086

SEQ ID NO: 415110 - RNA, 64 nt, hsa; identical to SEQ ID NO: 84087

SEQ ID NO: 415111 - RNA, 64 nt, hsa; identical to SEQ ID NO: 84088

SEQ ID NO: 415112 - RNA, 64 nt, hsa; identical to SEQ ID NO: 84089

SEQ ID NO: 415113 - RNA, 64 nt, hsa; identical to SEQ ID NO: 84090

SEQ ID NO: 415114 - RNA, 64 nt, hsa; identical to SEQ ID NO: 84091

SEQ ID NO: 415115 - RNA, 64 nt, hsa; identical to SEQ ID NO: 84092

SEQ ID NO: 415116 - RNA, 64 nt, hsa; identical to SEQ ID NO: 84093

SEQ ID NO: 415117 - RNA, 64 nt, hsa; identical to SEQ ID NO: 84094

SEQ ID NO: 415118 - RNA, 64 nt, hsa; identical to SEQ ID NO: 84095

SEQ ID NO: 415119 - RNA, 64 nt, hsa; identical to SEQ ID NO: 84096

SEQ ID NO: 415120 - RNA, 64 nt, hsa; identical to SEQ ID NO: 84097

SEQ ID NO: 415121 - RNA, 64 nt, hsa; identical to SEQ ID NO: 84098

SEQ ID NO: 415122 - RNA, 64 nt, hsa; identical to SEQ ID NO: 84099

SEQ ID NO: 415123 - RNA, 64 nt, hsa; identical to SEQ ID NO: 84100

SEQ ID NO: 415124 - RNA, 64 nt, hsa; identical to SEQ ID NO: 84101

SEQ ID NO: 415125 - RNA, 64 nt, hsa; identical to SEQ ID NO: 84102

SEQ ID NO: 415126 - RNA, 64 nt, hsa; identical to SEQ ID NO: 84103

SEQ ID NO: 415127 - RNA, 64 nt, hsa; identical to SEQ ID NO: 84104

SEQ ID NO: 415128 - RNA, 64 nt, hsa; identical to SEQ ID NO: 84105

SEQ ID NO: 415129 - RNA, 64 nt, hsa; identical to SEQ ID NO: 84106

SEQ ID NO: 415130 - RNA, 64 nt, hsa; identical to SEQ ID NO: 84107

SEQ ID NO: 415131 - RNA, 64 nt, hsa; identical to SEQ ID NO: 84108

SEQ ID NO: 415132 - RNA, 64 nt, hsa; identical to SEQ ID NO: 84109

SEQ ID NO: 415133 - RNA, 64 nt, hsa; identical to SEQ ID NO: 84110

SEQ ID NO: 415134 - RNA, 64 nt, hsa; identical to SEQ ID NO: 84111

SEQ ID NO: 415135 - RNA, 64 nt, hsa; identical to SEQ ID NO: 84112

SEQ ID NO: 415136 - RNA, 64 nt, hsa; identical to SEQ ID NO: 84113

SEQ ID NO: 415137 - RNA, 64 nt, hsa; identical to SEQ ID NO: 84114

SEQ ID NO: 415138 - RNA, 64 nt, hsa; identical to SEQ ID NO: 84115

SEQ ID NO: 415139 - RNA, 64 nt, hsa; identical to SEQ ID NO: 84116

SEQ ID NO: 415140 - RNA, 64 nt, hsa; identical to SEQ ID NO: 84117

SEQ ID NO: 415141 - RNA, 64 nt, hsa; identical to SEQ ID NO: 84118

SEQ ID NO: 415142 - RNA, 64 nt, hsa; identical to SEQ ID NO: 84119

SEQ ID NO: 415143 - RNA, 64 nt, hsa; identical to SEQ ID NO: 84120

SEQ ID NO: 415144 - RNA, 64 nt, hsa; identical to SEQ ID NO: 84121

SEQ ID NO: 415145 - RNA, 64 nt, hsa; identical to SEQ ID NO: 84122

SEQ ID NO: 415146 - RNA, 64 nt, hsa; identical to SEQ ID NO: 84123

SEQ ID NO: 415147 - RNA, 64 nt, hsa; identical to SEQ ID NO: 84124

SEQ ID NO: 415148 - RNA, 64 nt, hsa; identical to SEQ ID NO: 84125

SEQ ID NO: 415149 - RNA, 64 nt, hsa; identical to SEQ ID NO: 84126

SEQ ID NO: 415150 - RNA, 64 nt, hsa; identical to SEQ ID NO: 84127

SEQ ID NO: 415151 - RNA, 64 nt, hsa; identical to SEQ ID NO: 84128

SEQ ID NO: 415152 - RNA, 64 nt, hsa; identical to SEQ ID NO: 84129

SEQ ID NO: 415153 - RNA, 64 nt, hsa; identical to SEQ ID NO: 84130

SEQ ID NO: 415154 - RNA, 64 nt, hsa; identical to SEQ ID NO: 84131

SEQ ID NO: 415155 - RNA, 64 nt, hsa; identical to SEQ ID NO: 199298

SEQ ID NO: 415156 - RNA, 64 nt, hsa; identical to SEQ ID NO: 199299

SEQ ID NO: 415157 - RNA, 64 nt, hsa; identical to SEQ ID NO: 199300

SEQ ID NO: 415158 - RNA, 64 nt, hsa; identical to SEQ ID NO: 199301

SEQ ID NO: 415159 - RNA, 64 nt, hsa; identical to SEQ ID NO: 72787

SEQ ID NO: 415160 - RNA, 64 nt, hsa; identical to SEQ ID NO: 72788

SEQ ID NO: 415161 - RNA, 64 nt, hsa; identical to SEQ ID NO: 72789

SEQ ID NO: 415162 - RNA, 64 nt, hsa; identical to SEQ ID NO: 72790

SEQ ID NO: 415163 - RNA, 64 nt, hsa; identical to SEQ ID NO: 72791

SEQ ID NO: 415164 - RNA, 64 nt, hsa; identical to SEQ ID NO: 72792

SEQ ID NO: 415165 - RNA, 64 nt, hsa; identical to SEQ ID NO: 72793

SEQ ID NO: 415166 - RNA, 64 nt, hsa; identical to SEQ ID NO: 72794

SEQ ID NO: 415167 - RNA, 64 nt, hsa; identical to SEQ ID NO: 72795

SEQ ID NO: 415168 - RNA, 64 nt, hsa; identical to SEQ ID NO: 72796

SEQ ID NO: 415169 - RNA, 64 nt, hsa; identical to SEQ ID NO: 72797

SEQ ID NO: 415170 - RNA, 64 nt, hsa; identical to SEQ ID NO: 72798

SEQ ID NO: 415171 - RNA, 64 nt, hsa; identical to SEQ ID NO: 72799

SEQ ID NO: 415172 - RNA, 64 nt, hsa; identical to SEQ ID NO: 72800

SEQ ID NO: 415173 - RNA, 64 nt, hsa; identical to SEQ ID NO: 72801

SEQ ID NO: 415174 - RNA, 64 nt, hsa; identical to SEQ ID NO: 72802

SEQ ID NO: 415175 - RNA, 64 nt, hsa; identical to SEQ ID NO: 72803

SEQ ID NO: 415176 - RNA, 64 nt, hsa; identical to SEQ ID NO: 72804

SEQ ID NO: 415177 - RNA, 64 nt, hsa; identical to SEQ ID NO: 72805

SEQ ID NO: 415178 - RNA, 64 nt, hsa; identical to SEQ ID NO: 72806

SEQ ID NO: 415179 - RNA, 64 nt, hsa; identical to SEQ ID NO: 72807

SEQ ID NO: 415180 - RNA, 64 nt, hsa; identical to SEQ ID NO: 72808

SEQ ID NO: 415181 - RNA, 64 nt, hsa; identical to SEQ ID NO: 72809

SEQ ID NO: 415182 - RNA, 64 nt, hsa; identical to SEQ ID NO: 72810

SEQ ID NO: 415183 - RNA, 64 nt, hsa; identical to SEQ ID NO: 72811

SEQ ID NO: 415184 - RNA, 64 nt, hsa; identical to SEQ ID NO: 72812

SEQ ID NO: 415185 - RNA, 64 nt, hsa; identical to SEQ ID NO: 72813

SEQ ID NO: 415186 - RNA, 64 nt, hsa; identical to SEQ ID NO: 72814

SEQ ID NO: 415187 - RNA, 64 nt, hsa; identical to SEQ ID NO: 72815

SEQ ID NO: 415188 - RNA, 64 nt, hsa; identical to SEQ ID NO: 72816

SEQ ID NO: 415189 - RNA, 64 nt, hsa; identical to SEQ ID NO: 72817

SEQ ID NO: 415190 - RNA, 64 nt, hsa; identical to SEQ ID NO: 72818

SEQ ID NO: 415191 - RNA, 64 nt, hsa; identical to SEQ ID NO: 72819

SEQ ID NO: 415192 - RNA, 64 nt, hsa; identical to SEQ ID NO: 72820

SEQ ID NO: 415193 - RNA, 64 nt, hsa; identical to SEQ ID NO: 72821

SEQ ID NO: 415194 - RNA, 64 nt, hsa; identical to SEQ ID NO: 72822

SEQ ID NO: 415195 - RNA, 64 nt, hsa; identical to SEQ ID NO: 72823

SEQ ID NO: 415196 - RNA, 64 nt, hsa; identical to SEQ ID NO: 72824

SEQ ID NO: 415197 - RNA, 64 nt, hsa; identical to SEQ ID NO: 72825

SEQ ID NO: 415198 - RNA, 64 nt, hsa; identical to SEQ ID NO: 72826

SEQ ID NO: 415199 - RNA, 64 nt, hsa; identical to SEQ ID NO: 72827

SEQ ID NO: 415200 - RNA, 64 nt, hsa; identical to SEQ ID NO: 72828

SEQ ID NO: 415201 - RNA, 64 nt, hsa; identical to SEQ ID NO: 72829

SEQ ID NO: 415202 - RNA, 64 nt, hsa; identical to SEQ ID NO: 72830

SEQ ID NO: 415203 - RNA, 64 nt, hsa; identical to SEQ ID NO: 72831

SEQ ID NO: 415204 - RNA, 64 nt, hsa; identical to SEQ ID NO: 72832

SEQ ID NO: 415205 - RNA, 64 nt, hsa; identical to SEQ ID NO: 72833

SEQ ID NO: 415206 - RNA, 64 nt, hsa; identical to SEQ ID NO: 72834

SEQ ID NO: 415207 - RNA, 64 nt, hsa; identical to SEQ ID NO: 72835

SEQ ID NO: 415208 - RNA, 64 nt, hsa; identical to SEQ ID NO: 72836

SEQ ID NO: 415209 - RNA, 64 nt, hsa; identical to SEQ ID NO: 72837

SEQ ID NO: 415210 - RNA, 64 nt, hsa; identical to SEQ ID NO: 72838

SEQ ID NO: 415211 - RNA, 64 nt, hsa; identical to SEQ ID NO: 72839

SEQ ID NO: 415212 - RNA, 64 nt, hsa; identical to SEQ ID NO: 72840

SEQ ID NO: 415213 - RNA, 64 nt, hsa; identical to SEQ ID NO: 72841

SEQ ID NO: 415214 - RNA, 64 nt, hsa
ucccuccacuugugagcgcccccagcuuugcggcgccccccaccccagcgcugucugugggucc

SEQ ID NO: 415215 - RNA, 64 nt, hsa
acuugcuagcgucccuucauuuucccacaaguuugccccccaccuccacuuaccugucugcccu

SEQ ID NO: 415216 - RNA, 64 nt, hsa
aaucaccuuggaguggucaccagggggacagggagccccccaccaauguaucaaugggugauuu

SEQ ID NO: 415217 - RNA, 64 nt, hsa
ugcgaagucugauuuaccggccuacucucgaccugccccccacccccagcucaggggaccuuuu

SEQ ID NO: 415218 - RNA, 64 nt, hsa
ggguuccacagggcccagcccuggcaggggucuggccccccagguaggcggagagcagucccuc

SEQ ID NO: 415219 - RNA, 64 nt, hsa
gggcaggcaggggcaggcugaggaguugcccuuugccccccagagacugacucucagagccaga

SEQ ID NO: 415220 - RNA, 64 nt, hsa
ccaaaaccaggagccaggcugugccaugucccccgccccccaucccagccggcccgguccgaac

SEQ ID NO: 415221 - RNA, 64 nt, hsa
accagcagcacaauucugucccugucccugccccgccccccagagccagggcuguccuuagacu

SEQ ID NO: 415222 - RNA, 55 nt, hsa
agaucauggugacaguguaggcagggccccccaagggaguggcagggagauggcg

SEQ ID NO: 415223 - RNA, 64 nt, hsa
ugcugcagcaucacgaucagggcaaaucagcacagccccccagccaucaguggugucuagaaaa

SEQ ID NO: 415224 - RNA, 64 nt, hsa
gagagacagcaaggggccggcaggugcucgaugggccccccagggcuucuccagggcagcacag

SEQ ID NO: 415225 - RNA, 64 nt, hsa
ucagcugcccacaaguuuccugcacccuggaaaagccccccacccuuccucugggaaacugaca

SEQ ID NO: 415226 - RNA, 64 nt, hsa
cagggggagccuaggcccagcuccuccgcgguuggccccccagaccauaccucugacccaccca

SEQ ID NO: 415227 - RNA, 64 nt, hsa
cucagaugaugggcucccugaaacugcugccgccgccccccaucaugucugccagggugcuccc

SEQ ID NO: 415228 - RNA, 64 nt, hsa
ccgggggcagcguguuccccuguaccuguccaaggccccccagcaggugagagcucuuuccccu

SEQ ID NO: 415229 - RNA, 50 nt, hsa
cucaacucgugaacuacuaggccccccagggguccagcaggguggcuggu

SEQ ID NO: 415230 - RNA, 64 nt, hsa
ccucaggccuggcccucgggccuccgugaugggagccccccaggaggggucagaugcuggaagg

SEQ ID NO: 415231 - RNA, 64 nt, hsa
acaccccgcuucucccggacucucccagcggacagccccccagccccacagccugagccuccca

SEQ ID NO: 415232 - RNA, 64 nt, hsa
ugagccagccaggccuggccgcugggccugaccggccccccagccccuacaccccgcuucuccc

SEQ ID NO: 415233 - RNA, 64 nt, hsa
aagcacugagccagcaggugccagggagccacccgccccccaucgcuucugcacaccucagacu

SEQ ID NO: 415234 - RNA, 64 nt, hsa
uaaagggaaggaaaggaagcugggcguccucugggccccccaacacacgucccauuuagcccug

SEQ ID NO: 415235 - RNA, 64 nt, hsa
ggaaggggcccccacucuccuuucaugucccugugccccccaguucuccuccucagccuuuucc

SEQ ID NO: 415236 - RNA, 64 nt, hsa
acacuuggcccgaguuccuccauuucccuggccugccccccacccccaaccugucccacccccg

SEQ ID NO: 415237 - RNA, 64 nt, hsa
caugcagaggugcucuccuccuuucucagccauggccccccaucccugaccucagcuugggaag

SEQ ID NO: 415238 - RNA, 64 nt, hsa
ccuccaaccucccccuuuuucguugugcagccuggccccccagggaccccagagggccagggcg

SEQ ID NO: 415239 - RNA, 64 nt, hsa
guggcugagaggagccggcuguggagccccgcccgccccccacccucuagguggcccccguccg

SEQ ID NO: 415240 - RNA, 64 nt, hsa
acugacgagccgaggcagcagugcccccaccguggccccccacgccccauuaacccccacaccc

SEQ ID NO: 415241 - RNA, 64 nt, hsa
gugugcgugugccacgugagugccaaaguccccugccccccaagccagccagacccagacauua

SEQ ID NO: 415242 - RNA, 64 nt, hsa
cuuuuucuuggaaccugccccuguucuucacacugccccccaugccucagccucauacagaugu

SEQ ID NO: 415243 - RNA, 64 nt, hsa
uguccuucuguccuggauguuucaugggcccggggccccccagggaagcuuaccccuccugugc

SEQ ID NO: 415244 - RNA, 64 nt, hsa
gaucguguggcuuccaaagccuuuuacagcccccgccccccaucccguggucugucugcaggaa

SEQ ID NO: 415245 - RNA, 64 nt, hsa
uucaccccugacuucugcuucaccuuugaccucugccccccaugaaucccauuuuaccucuaga

SEQ ID NO: 415246 - RNA, 64 nt, hsa
guccccucgaggcuucugaccuuugauccgcuaggccccccaucucugaacccuagagccccgc

SEQ ID NO: 415247 - RNA, 64 nt, hsa
gggggcccagacuccacagugacuugccacauuugccccccauuuggagaaugcuuuuauauca

SEQ ID NO: 415248 - RNA, 64 nt, hsa
ggccucugccugggccucugugccagccccgggggccccccaguuacucagucuuuccuggaga

SEQ ID NO: 415249 - RNA, 64 nt, hsa
cugggauaugaugagagauuccagcccaagccuggccccccaccgccaggccauagggcauaau

SEQ ID NO: 415250 - RNA, 64 nt, hsa
ugccucagcccagcucugcaaauccccucccccugccccccaccuccccaggcucaccuugcca

SEQ ID NO: 415251 - RNA, 64 nt, hsa
cugggacugcucaggcuccccaagacuugacgcagccccccacgcuucuggagguggggagggc

SEQ ID NO: 415252 - RNA, 64 nt, hsa
cgaaguccgaggccuggcucuggagcccgccugcgccccccaguggacucgcgagagggugccg

SEQ ID NO: 415253 - RNA, 64 nt, hsa
accuccuccucccuucuuucuuugaagccuaauggccccccaaaagaugggcaggacaagcugu

SEQ ID NO: 415254 - RNA, 64 nt, hsa
gcaaggauccggagccagcucccaggggcccagagccccccacuugaagaggagcuugagcuuc

SEQ ID NO: 415255 - RNA, 64 nt, hsa
uccccuccuggcccaggugugcugggggcaccgugccccccaccccccugcccuccucagggug

SEQ ID NO: 415256 - RNA, 64 nt, hsa
cggugcuaaccuggcagcuguggggcccuuaggagccccccaccgaggguggacacagucccuu

SEQ ID NO: 415257 - RNA, 64 nt, hsa; identical to SEQ ID NO: 132800

SEQ ID NO: 415258 - RNA, 64 nt, hsa; identical to SEQ ID NO: 132801

SEQ ID NO: 415259 - RNA, 64 nt, hsa; identical to SEQ ID NO: 132802

SEQ ID NO: 415260 - RNA, 64 nt, hsa; identical to SEQ ID NO: 132803

SEQ ID NO: 415261 - RNA, 64 nt, hsa; identical to SEQ ID NO: 132804

SEQ ID NO: 415262 - RNA, 64 nt, hsa; identical to SEQ ID NO: 132805

SEQ ID NO: 415263 - RNA, 64 nt, hsa; identical to SEQ ID NO: 132806

SEQ ID NO: 415264 - RNA, 64 nt, hsa; identical to SEQ ID NO: 132807

SEQ ID NO: 415265 - RNA, 64 nt, hsa; identical to SEQ ID NO: 132808

SEQ ID NO: 415266 - RNA, 64 nt, hsa; identical to SEQ ID NO: 132809

SEQ ID NO: 415267 - RNA, 64 nt, hsa; identical to SEQ ID NO: 132810

SEQ ID NO: 415268 - RNA, 64 nt, hsa; identical to SEQ ID NO: 132811

SEQ ID NO: 415269 - RNA, 64 nt, hsa; identical to SEQ ID NO: 132812

SEQ ID NO: 415270 - RNA, 64 nt, hsa; identical to SEQ ID NO: 132813

SEQ ID NO: 415271 - RNA, 64 nt, hsa; identical to SEQ ID NO: 132814

SEQ ID NO: 415272 - RNA, 64 nt, hsa; identical to SEQ ID NO: 132815

SEQ ID NO: 415273 - RNA, 64 nt, hsa; identical to SEQ ID NO: 132816

SEQ ID NO: 415274 - RNA, 64 nt, hsa; identical to SEQ ID NO: 132817

SEQ ID NO: 415275 - RNA, 64 nt, hsa; identical to SEQ ID NO: 132818

SEQ ID NO: 415276 - RNA, 64 nt, hsa; identical to SEQ ID NO: 132819

SEQ ID NO: 415277 - RNA, 64 nt, hsa; identical to SEQ ID NO: 132820

SEQ ID NO: 415278 - RNA, 64 nt, hsa; identical to SEQ ID NO: 132821

SEQ ID NO: 415279 - RNA, 64 nt, hsa; identical to SEQ ID NO: 132822

SEQ ID NO: 415280 - RNA, 64 nt, hsa; identical to SEQ ID NO: 132823

SEQ ID NO: 415281 - RNA, 64 nt, hsa; identical to SEQ ID NO: 132824

SEQ ID NO: 415282 - RNA, 64 nt, hsa; identical to SEQ ID NO: 132825

SEQ ID NO: 415283 - RNA, 64 nt, hsa; identical to SEQ ID NO: 132826

SEQ ID NO: 415284 - RNA, 64 nt, hsa; identical to SEQ ID NO: 132827

SEQ ID NO: 415285 - RNA, 64 nt, hsa; identical to SEQ ID NO: 132828

SEQ ID NO: 415286 - RNA, 64 nt, hsa; identical to SEQ ID NO: 132829

SEQ ID NO: 415287 - RNA, 64 nt, hsa; identical to SEQ ID NO: 132830

SEQ ID NO: 415288 - RNA, 64 nt, hsa; identical to SEQ ID NO: 132831

SEQ ID NO: 415289 - RNA, 64 nt, hsa; identical to SEQ ID NO: 132832

SEQ ID NO: 415290 - RNA, 64 nt, hsa; identical to SEQ ID NO: 132833

SEQ ID NO: 415291 - RNA, 64 nt, hsa; identical to SEQ ID NO: 132834

SEQ ID NO: 415292 - RNA, 64 nt, hsa; identical to SEQ ID NO: 132835

SEQ ID NO: 415293 - RNA, 64 nt, hsa; identical to SEQ ID NO: 132836

SEQ ID NO: 415294 - RNA, 64 nt, hsa; identical to SEQ ID NO: 132837

SEQ ID NO: 415295 - RNA, 64 nt, hsa; identical to SEQ ID NO: 132838

SEQ ID NO: 415296 - RNA, 64 nt, hsa; identical to SEQ ID NO: 132839

SEQ ID NO: 415297 - RNA, 64 nt, hsa; identical to SEQ ID NO: 132840

SEQ ID NO: 415298 - RNA, 64 nt, hsa; identical to SEQ ID NO: 132841

SEQ ID NO: 415299 - RNA, 64 nt, hsa; identical to SEQ ID NO: 132842

SEQ ID NO: 415300 - RNA, 64 nt, hsa; identical to SEQ ID NO: 132843

SEQ ID NO: 415301 - RNA, 64 nt, hsa; identical to SEQ ID NO: 132844

SEQ ID NO: 415302 - RNA, 58 nt, hsa; identical to SEQ ID NO: 132845

SEQ ID NO: 415303 - RNA, 64 nt, hsa; identical to SEQ ID NO: 132846

SEQ ID NO: 415304 - RNA, 64 nt, hsa; identical to SEQ ID NO: 132847

SEQ ID NO: 415305 - RNA, 64 nt, hsa; identical to SEQ ID NO: 132848

SEQ ID NO: 415306 - RNA, 64 nt, hsa; identical to SEQ ID NO: 132849

SEQ ID NO: 415307 - RNA, 64 nt, hsa; identical to SEQ ID NO: 132850

SEQ ID NO: 415308 - RNA, 64 nt, hsa; identical to SEQ ID NO: 132851

SEQ ID NO: 415309 - RNA, 64 nt, hsa; identical to SEQ ID NO: 132852

SEQ ID NO: 415310 - RNA, 64 nt, hsa; identical to SEQ ID NO: 132853

SEQ ID NO: 415311 - RNA, 64 nt, hsa; identical to SEQ ID NO: 132854

SEQ ID NO: 415312 - RNA, 64 nt, hsa; identical to SEQ ID NO: 132855

SEQ ID NO: 415313 - RNA, 64 nt, hsa; identical to SEQ ID NO: 132856

SEQ ID NO: 415314 - RNA, 64 nt, hsa; identical to SEQ ID NO: 132857

SEQ ID NO: 415315 - RNA, 64 nt, hsa; identical to SEQ ID NO: 132858

SEQ ID NO: 415316 - RNA, 64 nt, hsa; identical to SEQ ID NO: 132859

SEQ ID NO: 415317 - RNA, 64 nt, hsa; identical to SEQ ID NO: 132860

SEQ ID NO: 415318 - RNA, 64 nt, hsa; identical to SEQ ID NO: 132861

SEQ ID NO: 415319 - RNA, 64 nt, hsa; identical to SEQ ID NO: 132862

SEQ ID NO: 415320 - RNA, 64 nt, hsa; identical to SEQ ID NO: 132863

SEQ ID NO: 415321 - RNA, 64 nt, hsa; identical to SEQ ID NO: 132864

SEQ ID NO: 415322 - RNA, 64 nt, hsa; identical to SEQ ID NO: 132865

SEQ ID NO: 415323 - RNA, 64 nt, hsa; identical to SEQ ID NO: 132866

SEQ ID NO: 415324 - RNA, 64 nt, hsa; identical to SEQ ID NO: 132867

SEQ ID NO: 415325 - RNA, 64 nt, hsa; identical to SEQ ID NO: 132868

SEQ ID NO: 415326 - RNA, 64 nt, hsa; identical to SEQ ID NO: 132869

SEQ ID NO: 415327 - RNA, 64 nt, hsa; identical to SEQ ID NO: 132870

SEQ ID NO: 415328 - RNA, 64 nt, hsa; identical to SEQ ID NO: 132871

SEQ ID NO: 415329 - RNA, 64 nt, hsa; identical to SEQ ID NO: 132872

SEQ ID NO: 415330 - RNA, 64 nt, hsa; identical to SEQ ID NO: 132873

SEQ ID NO: 415331 - RNA, 64 nt, hsa; identical to SEQ ID NO: 132874

SEQ ID NO: 415332 - RNA, 64 nt, hsa; identical to SEQ ID NO: 132875

SEQ ID NO: 415333 - RNA, 64 nt, hsa; identical to SEQ ID NO: 132876

SEQ ID NO: 415334 - RNA, 64 nt, hsa; identical to SEQ ID NO: 132877

SEQ ID NO: 415335 - RNA, 64 nt, hsa; identical to SEQ ID NO: 132878

SEQ ID NO: 415336 - RNA, 64 nt, hsa; identical to SEQ ID NO: 132879

SEQ ID NO: 415337 - RNA, 64 nt, hsa; identical to SEQ ID NO: 132880

SEQ ID NO: 415338 - RNA, 64 nt, hsa; identical to SEQ ID NO: 132881

SEQ ID NO: 415339 - RNA, 64 nt, hsa; identical to SEQ ID NO: 132882

SEQ ID NO: 415340 - RNA, 64 nt, hsa; identical to SEQ ID NO: 132883

SEQ ID NO: 415341 - RNA, 64 nt, hsa; identical to SEQ ID NO: 132884

SEQ ID NO: 415342 - RNA, 64 nt, hsa; identical to SEQ ID NO: 132885

SEQ ID NO: 415343 - RNA, 64 nt, hsa; identical to SEQ ID NO: 132886

SEQ ID NO: 415344 - RNA, 64 nt, hsa; identical to SEQ ID NO: 132887

SEQ ID NO: 415345 - RNA, 64 nt, hsa; identical to SEQ ID NO: 132888

SEQ ID NO: 415346 - RNA, 64 nt, hsa; identical to SEQ ID NO: 132889

SEQ ID NO: 415347 - RNA, 64 nt, hsa; identical to SEQ ID NO: 115828

SEQ ID NO: 415348 - RNA, 64 nt, hsa; identical to SEQ ID NO: 115829

SEQ ID NO: 415349 - RNA, 64 nt, hsa; identical to SEQ ID NO: 115830

SEQ ID NO: 415350 - RNA, 64 nt, hsa; identical to SEQ ID NO: 115831

SEQ ID NO: 415351 - RNA, 64 nt, hsa; identical to SEQ ID NO: 115832

SEQ ID NO: 415352 - RNA, 64 nt, hsa; identical to SEQ ID NO: 115833

SEQ ID NO: 415353 - RNA, 64 nt, hsa; identical to SEQ ID NO: 115834

SEQ ID NO: 415354 - RNA, 64 nt, hsa; identical to SEQ ID NO: 115835

SEQ ID NO: 415355 - RNA, 64 nt, hsa; identical to SEQ ID NO: 115836

SEQ ID NO: 415356 - RNA, 64 nt, hsa; identical to SEQ ID NO: 115837

SEQ ID NO: 415357 - RNA, 64 nt, hsa; identical to SEQ ID NO: 115838

SEQ ID NO: 415358 - RNA, 64 nt, hsa; identical to SEQ ID NO: 115839

SEQ ID NO: 415359 - RNA, 64 nt, hsa; identical to SEQ ID NO: 115840

SEQ ID NO: 415360 - RNA, 64 nt, hsa; identical to SEQ ID NO: 115841

SEQ ID NO: 415361 - RNA, 64 nt, hsa; identical to SEQ ID NO: 115842

SEQ ID NO: 415362 - RNA, 64 nt, hsa; identical to SEQ ID NO: 115843

SEQ ID NO: 415363 - RNA, 64 nt, hsa; identical to SEQ ID NO: 115844

SEQ ID NO: 415364 - RNA, 64 nt, hsa; identical to SEQ ID NO: 115845

SEQ ID NO: 415365 - RNA, 64 nt, hsa; identical to SEQ ID NO: 115846

SEQ ID NO: 415366 - RNA, 64 nt, hsa; identical to SEQ ID NO: 115847

SEQ ID NO: 415367 - RNA, 64 nt, hsa; identical to SEQ ID NO: 115848

SEQ ID NO: 415368 - RNA, 64 nt, hsa; identical to SEQ ID NO: 115849

SEQ ID NO: 415369 - RNA, 64 nt, hsa; identical to SEQ ID NO: 115850

SEQ ID NO: 415370 - RNA, 64 nt, hsa; identical to SEQ ID NO: 115851

SEQ ID NO: 415371 - RNA, 64 nt, hsa; identical to SEQ ID NO: 115852

SEQ ID NO: 415372 - RNA, 64 nt, hsa; identical to SEQ ID NO: 323108

SEQ ID NO: 415373 - RNA, 64 nt, hsa; identical to SEQ ID NO: 323109

SEQ ID NO: 415374 - RNA, 64 nt, hsa; identical to SEQ ID NO: 323110

SEQ ID NO: 415375 - RNA, 64 nt, hsa; identical to SEQ ID NO: 323111

SEQ ID NO: 415376 - RNA, 64 nt, hsa; identical to SEQ ID NO: 323112

SEQ ID NO: 415377 - RNA, 64 nt, hsa; identical to SEQ ID NO: 323113

SEQ ID NO: 415378 - RNA, 64 nt, hsa; identical to SEQ ID NO: 323114

SEQ ID NO: 415379 - RNA, 64 nt, hsa; identical to SEQ ID NO: 323115

SEQ ID NO: 415380 - RNA, 64 nt, hsa; identical to SEQ ID NO: 323116

SEQ ID NO: 415381 - RNA, 64 nt, hsa; identical to SEQ ID NO: 323117

SEQ ID NO: 415382 - RNA, 64 nt, hsa; identical to SEQ ID NO: 323118

SEQ ID NO: 415383 - RNA, 64 nt, hsa; identical to SEQ ID NO: 323119

SEQ ID NO: 415384 - RNA, 64 nt, hsa; identical to SEQ ID NO: 323120

SEQ ID NO: 415385 - RNA, 64 nt, hsa; identical to SEQ ID NO: 323121

SEQ ID NO: 415386 - RNA, 64 nt, hsa; identical to SEQ ID NO: 323122

SEQ ID NO: 415387 - RNA, 64 nt, hsa; identical to SEQ ID NO: 323123

SEQ ID NO: 415388 - RNA, 64 nt, hsa; identical to SEQ ID NO: 323124

SEQ ID NO: 415389 - RNA, 64 nt, hsa; identical to SEQ ID NO: 323125

SEQ ID NO: 415390 - RNA, 64 nt, hsa; identical to SEQ ID NO: 323126

SEQ ID NO: 415391 - RNA, 64 nt, hsa; identical to SEQ ID NO: 323127

SEQ ID NO: 415392 - RNA, 64 nt, hsa; identical to SEQ ID NO: 190819

SEQ ID NO: 415393 - RNA, 64 nt, hsa; identical to SEQ ID NO: 190820

SEQ ID NO: 415394 - RNA, 64 nt, hsa; identical to SEQ ID NO: 190821

SEQ ID NO: 415395 - RNA, 64 nt, hsa; identical to SEQ ID NO: 190822

SEQ ID NO: 415396 - RNA, 64 nt, hsa; identical to SEQ ID NO: 190823

SEQ ID NO: 415397 - RNA, 64 nt, hsa; identical to SEQ ID NO: 190824

SEQ ID NO: 415398 - RNA, 64 nt, hsa; identical to SEQ ID NO: 190825

SEQ ID NO: 415399 - RNA, 64 nt, hsa; identical to SEQ ID NO: 190826

SEQ ID NO: 415400 - RNA, 64 nt, hsa; identical to SEQ ID NO: 190827

SEQ ID NO: 415401 - RNA, 64 nt, hsa; identical to SEQ ID NO: 190828

SEQ ID NO: 415402 - RNA, 64 nt, hsa; identical to SEQ ID NO: 190829

SEQ ID NO: 415403 - RNA, 64 nt, hsa; identical to SEQ ID NO: 190830

SEQ ID NO: 415404 - RNA, 64 nt, hsa; identical to SEQ ID NO: 190831

SEQ ID NO: 415405 - RNA, 64 nt, hsa; identical to SEQ ID NO: 190832

SEQ ID NO: 415406 - RNA, 64 nt, hsa; identical to SEQ ID NO: 411037

SEQ ID NO: 415407 - RNA, 64 nt, hsa; identical to SEQ ID NO: 411038

SEQ ID NO: 415408 - RNA, 64 nt, hsa; identical to SEQ ID NO: 411039

SEQ ID NO: 415409 - RNA, 64 nt, hsa; identical to SEQ ID NO: 411040

SEQ ID NO: 415410 - RNA, 64 nt, hsa; identical to SEQ ID NO: 411041

SEQ ID NO: 415411 - RNA, 64 nt, hsa; identical to SEQ ID NO: 411042

SEQ ID NO: 415412 - RNA, 64 nt, hsa; identical to SEQ ID NO: 411043

SEQ ID NO: 415413 - RNA, 64 nt, hsa; identical to SEQ ID NO: 411044

SEQ ID NO: 415414 - RNA, 64 nt, hsa; identical to SEQ ID NO: 411045

SEQ ID NO: 415415 - RNA, 64 nt, hsa; identical to SEQ ID NO: 411046

SEQ ID NO: 415416 - RNA, 64 nt, hsa; identical to SEQ ID NO: 411047

SEQ ID NO: 415417 - RNA, 64 nt, hsa; identical to SEQ ID NO: 411048

SEQ ID NO: 415418 - RNA, 64 nt, hsa; identical to SEQ ID NO: 411049

SEQ ID NO: 415419 - RNA, 64 nt, hsa; identical to SEQ ID NO: 411050

SEQ ID NO: 415420 - RNA, 64 nt, hsa; identical to SEQ ID NO: 411051

SEQ ID NO: 415421 - RNA, 64 nt, hsa; identical to SEQ ID NO: 411052

SEQ ID NO: 415422 - RNA, 64 nt, hsa; identical to SEQ ID NO: 411053

SEQ ID NO: 415423 - RNA, 64 nt, hsa; identical to SEQ ID NO: 411054

SEQ ID NO: 415424 - RNA, 64 nt, hsa; identical to SEQ ID NO: 411055

SEQ ID NO: 415425 - RNA, 64 nt, hsa; identical to SEQ ID NO: 411056

SEQ ID NO: 415426 - RNA, 64 nt, hsa; identical to SEQ ID NO: 411057

SEQ ID NO: 415427 - RNA, 64 nt, hsa; identical to SEQ ID NO: 411058

SEQ ID NO: 415428 - RNA, 64 nt, hsa; identical to SEQ ID NO: 411059

SEQ ID NO: 415429 - RNA, 64 nt, hsa; identical to SEQ ID NO: 411060

SEQ ID NO: 415430 - RNA, 64 nt, hsa; identical to SEQ ID NO: 411061

SEQ ID NO: 415431 - RNA, 64 nt, hsa; identical to SEQ ID NO: 411062

SEQ ID NO: 415432 - RNA, 64 nt, hsa; identical to SEQ ID NO: 411063

SEQ ID NO: 415433 - RNA, 64 nt, hsa; identical to SEQ ID NO: 411064

SEQ ID NO: 415434 - RNA, 64 nt, hsa; identical to SEQ ID NO: 411065

SEQ ID NO: 415435 - RNA, 64 nt, hsa; identical to SEQ ID NO: 411066

SEQ ID NO: 415436 - RNA, 64 nt, hsa; identical to SEQ ID NO: 411067

SEQ ID NO: 415437 - RNA, 64 nt, hsa; identical to SEQ ID NO: 411068

SEQ ID NO: 415438 - RNA, 64 nt, hsa; identical to SEQ ID NO: 411069

SEQ ID NO: 415439 - RNA, 64 nt, hsa; identical to SEQ ID NO: 411070

SEQ ID NO: 415440 - RNA, 64 nt, hsa; identical to SEQ ID NO: 411071

SEQ ID NO: 415441 - RNA, 64 nt, hsa; identical to SEQ ID NO: 411072

SEQ ID NO: 415442 - RNA, 64 nt, hsa; identical to SEQ ID NO: 411073

SEQ ID NO: 415443 - RNA, 64 nt, hsa; identical to SEQ ID NO: 411074

SEQ ID NO: 415444 - RNA, 64 nt, hsa; identical to SEQ ID NO: 411075

SEQ ID NO: 415445 - RNA, 64 nt, hsa; identical to SEQ ID NO: 411076

SEQ ID NO: 415446 - RNA, 64 nt, hsa; identical to SEQ ID NO: 411077

SEQ ID NO: 415447 - RNA, 64 nt, hsa; identical to SEQ ID NO: 411078

SEQ ID NO: 415448 - RNA, 64 nt, hsa; identical to SEQ ID NO: 411079

SEQ ID NO: 415449 - RNA, 64 nt, hsa; identical to SEQ ID NO: 411080

SEQ ID NO: 415450 - RNA, 64 nt, hsa; identical to SEQ ID NO: 411081

SEQ ID NO: 415451 - RNA, 64 nt, hsa; identical to SEQ ID NO: 411082

SEQ ID NO: 415452 - RNA, 64 nt, hsa; identical to SEQ ID NO: 411083

SEQ ID NO: 415453 - RNA, 64 nt, hsa; identical to SEQ ID NO: 411084

SEQ ID NO: 415454 - RNA, 64 nt, hsa; identical to SEQ ID NO: 411085

SEQ ID NO: 415455 - RNA, 64 nt, hsa; identical to SEQ ID NO: 411086

SEQ ID NO: 415456 - RNA, 64 nt, hsa; identical to SEQ ID NO: 411087

SEQ ID NO: 415457 - RNA, 64 nt, hsa; identical to SEQ ID NO: 411088

SEQ ID NO: 415458 - RNA, 64 nt, hsa
caaagcuuaaacaccuuugcccuggcucugcauugucaccuagagagcaagaggucuauagaaa

SEQ ID NO: 415459 - RNA, 64 nt, hsa
cuuugugugguaagagguuugaguaguccuauaugucaccuagggaacagacauuauagcuuac

SEQ ID NO: 415460 - RNA, 64 nt, hsa
caauguagucaacuccucacuuagggucugguuggucaccuaaagaaauagagcccuaccaggg

SEQ ID NO: 415461 - RNA, 64 nt, hsa
guggaggcuccacucaaagcuggcauccuccuaugucaccuagagugugggucaaagcaauaca

SEQ ID NO: 415462 - RNA, 64 nt, hsa
cuuucuugacuuaaagguugcagcaguacaucucgucaccuaggaauagauuaucaggccuugc

SEQ ID NO: 415463 - RNA, 64 nt, hsa
gacuacuugacaaauacuuuaugcuaaaaauuuugucaccuaaguguuugggaggcuuuuucuu

SEQ ID NO: 415464 - RNA, 64 nt, hsa
aaaacuacugccccacuucaaauugcaguguucugucaccuaggcaucaucucuuccugccccu

SEQ ID NO: 415465 - RNA, 64 nt, hsa
agcugucagacauuuuguuauugauaccuuaaaggucaccuaccacaaauugauggcuagagca

SEQ ID NO: 415466 - RNA, 64 nt, hsa
auuccagccuccugcuacauuauauccagaaguaauugcggaggcuccuucagcugccucagca

SEQ ID NO: 415467 - RNA, 64 nt, hsa
augccagaaauagcacugaaucaagaaaauagccauugcggagcugcccucuugagucuuucug

SEQ ID NO: 415468 - RNA, 64 nt, hsa
acaaagccaguuccaugagcugccuaugauaugcauugcggaaguaacauuuuacccagggugu

SEQ ID NO: 415469 - RNA, 64 nt, hsa
gacauagccugugaugaugggucuggugacuauuauugcggaccgugguacccaguuuuaggaa

SEQ ID NO: 415470 - RNA, 64 nt, hsa
ucaaagauacaacaaaagcagaaguuacaagaauauugcggagagguuggaaagcaggauuuaa

SEQ ID NO: 415471 - RNA, 64 nt, hsa
ggcagaggauaaagcccccuccucacaucccucuauugcggauccacaguggccuuacucuuaa

SEQ ID NO: 415472 - RNA, 64 nt, hsa
aguguggcauacuuucugaaaccuggagcugggaauugcggagaagggaaggucuagacuaguu

SEQ ID NO: 415473 - RNA, 64 nt, hsa
cagcgcuccagccaaagcggcggccccaggguuaauugcggagaacaggacagugcccgguccc

SEQ ID NO: 415474 - RNA, 64 nt, hsa
gaaaaggggacaggggaaugaguaaacuucuuuuauugcggacaaaugugcacauagccgcuag

SEQ ID NO: 415475 - RNA, 64 nt, hsa
uuugugcaggacugagaaacacagugcauuauuuauugcggaaucauugcugcuaaauaacuac

SEQ ID NO: 415476 - RNA, 64 nt, hsa
caccuggaaccuccugcuggacuuuggaaacaugauugcggaugauaugucuaacuacgaugaa

SEQ ID NO: 415477 - RNA, 64 nt, hsa
gcguauaaagggaaaacuugcuuuaaucugugggauugcggaccgaugcgacuugcagaaggua

SEQ ID NO: 415478 - RNA, 64 nt, hsa
ccacccaggagccccgaggccuucucugaaggacauugcggacagccacggccaggccagaggg

SEQ ID NO: 415479 - RNA, 64 nt, hsa
cagggaccugcugaggaccagccgcgugcacuggauugcggaggagccucccgcagcacugguc

SEQ ID NO: 415480 - RNA, 64 nt, hsa
uucuggagucugccaaaacaagggauuaucacauauugcggaguccagcacccaggugauguga

SEQ ID NO: 415481 - RNA, 64 nt, hsa
ccugauuccuucuuaaacuuggaaugauagaugaaauucacaccccugcagaucagaaaaaaca

SEQ ID NO: 415482 - RNA, 64 nt, hsa
gaaaucauuuugcaauugagugacacuucauuguaauucacaguguaaauuuaauccaaacuga

SEQ ID NO: 415483 - RNA, 64 nt, hsa
guaccucucaaugaaaaauguaaaaguaccuagaaauucacaaaaaaauuaauaccucugugga

SEQ ID NO: 415484 - RNA, 64 nt, hsa
auggaacgaaauuagaaaucaauaaaauuugggaaauucacaaauauguggauauuaaacaaca

SEQ ID NO: 415485 - RNA, 64 nt, hsa
cacagagugaaaugucagaaguuacauguaaaugaauucacagucaauaaaguccacgucuacc

SEQ ID NO: 415486 - RNA, 64 nt, hsa
cgaauacacagacuuacuggauuauagaagagaaaauucacaucugccuuguuaaucuaauaaa

SEQ ID NO: 415487 - RNA, 64 nt, hsa
auggaaucuccaucauuguuauuuuaacgauaguaauucacaguccucagaagccuauuuuuaa

SEQ ID NO: 415488 - RNA, 64 nt, hsa
augcuguuuuuggucaaacuguguaaacuggaaaaauucacaucauuucugaguuuaaucacuu

SEQ ID NO: 415489 - RNA, 64 nt, hsa
guaguccaagcucaggcauaauucagcauaagaaaauucacaccagagccaaaucuuacaaaug

SEQ ID NO: 415490 - RNA, 64 nt, hsa
ucagucguaguguccaccuuacucaacaucagaaaauucacaaagagaugcccuguaaguguac

SEQ ID NO: 415491 - RNA, 64 nt, hsa
uacguguagugaauguggaaaagacuucagauugaauucacaucuuauucagcaucaaagaauu

SEQ ID NO: 415492 - RNA, 64 nt, hsa
ucagauugaauucacaucuuauucagcaucaaagaauucacacaggagagaaagcacaugaaug

SEQ ID NO: 415493 - RNA, 64 nt, hsa
ucagucauagcucagccauugcucagcaucagauaauucacaccagagagaaacccucugaaug

SEQ ID NO: 415494 - RNA, 64 nt, hsa
uauuaguauuuucauaccuuagucacauuuggagaauucacaugggaauaaaauuccauugcug

SEQ ID NO: 415495 - RNA, 64 nt, hsa
aauggcuaacuuucaaauaggaugguugcuuaugaauucacaccuugaguauaaaacuugcaga

SEQ ID NO: 415496 - RNA, 64 nt, hsa
uuccccaaaggauacugacuguaauacaauuaccaauucacaaugauaaaaauauuuugaaagg

SEQ ID NO: 415497 - RNA, 64 nt, hsa
cuaccacugcaauucacauuauauuggaaugaacaauucacaugucuaccacaagucuguaaac

SEQ ID NO: 415498 - RNA, 64 nt, hsa
cccauagcacuguguauaccgcuacuaccacugcaauucacauuauauuggaaugaacaauuca

SEQ ID NO: 415499 - RNA, 64 nt, hsa
gauuuugcuuucuguggaauugaaaauucacaaaaauucacagcuuaaauuucccaucagugac

SEQ ID NO: 415500 - RNA, 64 nt, hsa
augugauacagauuuugcuuucuguggaauugaaaauucacaaaaauucacagcuuaaauuucc

SEQ ID NO: 415501 - RNA, 64 nt, hsa
acaucuaaguaaugggggaaaaccugugcaaauuaauucacauacaugguucagaaaauucaca

SEQ ID NO: 415502 - RNA, 64 nt, hsa
ccugugcaaauuaauucacauacaugguucagaaaauucacagcaggagggccgggcgcagugg

SEQ ID NO: 415503 - RNA, 58 nt, hsa
caucucuuaaacuuguuuaacaccagaaaauucacacaagagaaaggccuuaugaaug

SEQ ID NO: 415504 - RNA, 64 nt, hsa
auaauccucaauuuuuccuuaucuuguuuuccacaauucacaagcaacagcaagcauuuucuau

SEQ ID NO: 415505 - RNA, 64 nt, hsa
uuagaugucgcuccacacuugauacacaucagagaauucacacuggugaaaggccuuaugagug

SEQ ID NO: 415506 - RNA, 64 nt, hsa
uuagauacaacuccagccucauuaaacaucggagaauucacacuggagagagaccuuaucagug

SEQ ID NO: 415507 - RNA, 64 nt, hsa
gaaaauccagugacuguaaauuuuuuuaccucauaauucacaauuuauuaagcaucagaauuua

SEQ ID NO: 415508 - RNA, 64 nt, hsa
cuuuuuauuuaacaauccuuaucuaacaucaccaaauucacauugcagagaaacuucagaaaua

SEQ ID NO: 415509 - RNA, 64 nt, hsa
uccuuuauugauuguucaacucuuaacaccagagaauucacacuggugagaaacccuuugaaug

SEQ ID NO: 415510 - RNA, 64 nt, hsa
cuuugcuuguuuccuaccuuaauagaaaucagagaauucacacuagugagaaaccguaucagug

SEQ ID NO: 415511 - RNA, 64 nt, hsa
uuacuuggcuuucaaacuugaauaaacaucagacaauucacacuggugacaaacccuaugaaug

SEQ ID NO: 415512 - RNA, 64 nt, hsa
ucauuuguuuuuuugauuuuaauagacaucagagaauucacaaaggagagaaacccuaucagug

SEQ ID NO: 415513 - RNA, 63 nt, hsa
caagcauaaugcacaucuaaugagacaucagagaauucacaguggggagaaacccuaugaaug

SEQ ID NO: 415514 - RNA, 64 nt, hsa
ucgggaaugauucacacguggcaccccauacuagaauucacacuggagagaaaccuuacaagug

SEQ ID NO: 415515 - RNA, 64 nt, hsa
uucauucacaaauccagcuucaaauacauaggagaauucacacuggagaaaagccauagaaaug

SEQ ID NO: 415516 - RNA, 64 nt, hsa
ggucaaaauucacaccuuguaauuaaaaggucaaaauucacaccuuguaauucauaguggagag

SEQ ID NO: 415517 - RNA, 64 nt, hsa
uaaguguaaugaguguggcaagaccguuggucaaaauucacaccuuguaauuaaaaggucaaaa

SEQ ID NO: 415518 - RNA, 64 nt, hsa
uugcauauaaugcauaucuggcaaaacauacuagaauucacacuggagagaaacucauuauaag

SEQ ID NO: 415519 - RNA, 64 nt, hsa
ucaguuguaaaucaaaccuuaaaacacauaagaaaauucacauugaagagaaaccauacagagg

SEQ ID NO: 415520 - RNA, 64 nt, hsa
uauaggaauuguuucugcagauuccggauauuauaauucacaccauaaagauugugaagugguu

SEQ ID NO: 415521 - RNA, 64 nt, hsa
aaaugugaccauguauaaaguauuuauacucuuuaauucacacuguuagagagcaaaaucaucu

SEQ ID NO: 415522 - RNA, 57 nt, hsa
ccagccuugaaguucuuugaccuccucaauucacaaccuguagcugacuuuagccac

SEQ ID NO: 415523 - RNA, 64 nt, hsa
gcagccacccacugcugccccaagcucacucaggaauucacacccgccugguuucuugaagugu

SEQ ID NO: 415524 - RNA, 64 nt, hsa
uagcuuuuggugcacuuuuguuucaccaucugaaaauucacaaaacuucuugcuucaaaugaaa

SEQ ID NO: 415525 - RNA, 64 nt, hsa
aacuccgccccaaaaaggagaguaacaaauacacaauucacacauaacacuaagcguaaaucua

SEQ ID NO: 415526 - RNA, 64 nt, hsa; identical to SEQ ID NO: 175479

SEQ ID NO: 415527 - RNA, 64 nt, hsa; identical to SEQ ID NO: 175480

SEQ ID NO: 415528 - RNA, 64 nt, hsa; identical to SEQ ID NO: 175481

SEQ ID NO: 415529 - RNA, 64 nt, hsa; identical to SEQ ID NO: 175482

SEQ ID NO: 415530 - RNA, 64 nt, hsa; identical to SEQ ID NO: 175483

SEQ ID NO: 415531 - RNA, 64 nt, hsa; identical to SEQ ID NO: 175484

SEQ ID NO: 415532 - RNA, 64 nt, hsa; identical to SEQ ID NO: 175485

SEQ ID NO: 415533 - RNA, 64 nt, hsa; identical to SEQ ID NO: 175486

SEQ ID NO: 415534 - RNA, 64 nt, hsa; identical to SEQ ID NO: 175487

SEQ ID NO: 415535 - RNA, 64 nt, hsa; identical to SEQ ID NO: 175488

SEQ ID NO: 415536 - RNA, 64 nt, hsa; identical to SEQ ID NO: 175489

SEQ ID NO: 415537 - RNA, 64 nt, hsa; identical to SEQ ID NO: 175490

SEQ ID NO: 415538 - RNA, 64 nt, hsa; identical to SEQ ID NO: 175491

SEQ ID NO: 415539 - RNA, 64 nt, hsa; identical to SEQ ID NO: 175492

SEQ ID NO: 415540 - RNA, 64 nt, hsa; identical to SEQ ID NO: 175493

SEQ ID NO: 415541 - RNA, 64 nt, hsa; identical to SEQ ID NO: 175494

SEQ ID NO: 415542 - RNA, 64 nt, hsa; identical to SEQ ID NO: 175495

SEQ ID NO: 415543 - RNA, 64 nt, hsa; identical to SEQ ID NO: 175496

SEQ ID NO: 415544 - RNA, 64 nt, hsa; identical to SEQ ID NO: 175497

SEQ ID NO: 415545 - RNA, 64 nt, hsa; identical to SEQ ID NO: 175498

SEQ ID NO: 415546 - RNA, 64 nt, hsa; identical to SEQ ID NO: 175499

SEQ ID NO: 415547 - RNA, 64 nt, hsa; identical to SEQ ID NO: 175500

SEQ ID NO: 415548 - RNA, 64 nt, hsa; identical to SEQ ID NO: 175501

SEQ ID NO: 415549 - RNA, 64 nt, hsa; identical to SEQ ID NO: 175502

SEQ ID NO: 415550 - RNA, 64 nt, hsa; identical to SEQ ID NO: 175503

SEQ ID NO: 415551 - RNA, 64 nt, hsa; identical to SEQ ID NO: 175504

SEQ ID NO: 415552 - RNA, 64 nt, hsa; identical to SEQ ID NO: 175505

SEQ ID NO: 415553 - RNA, 64 nt, hsa; identical to SEQ ID NO: 175506

SEQ ID NO: 415554 - RNA, 64 nt, hsa; identical to SEQ ID NO: 175507

SEQ ID NO: 415555 - RNA, 64 nt, hsa; identical to SEQ ID NO: 175508

SEQ ID NO: 415556 - RNA, 64 nt, hsa; identical to SEQ ID NO: 175509

SEQ ID NO: 415557 - RNA, 64 nt, hsa; identical to SEQ ID NO: 175510

SEQ ID NO: 415558 - RNA, 64 nt, hsa; identical to SEQ ID NO: 175511

SEQ ID NO: 415559 - RNA, 64 nt, hsa; identical to SEQ ID NO: 175512

SEQ ID NO: 415560 - RNA, 64 nt, hsa; identical to SEQ ID NO: 175513

SEQ ID NO: 415561 - RNA, 64 nt, hsa; identical to SEQ ID NO: 175514

SEQ ID NO: 415562 - RNA, 64 nt, hsa; identical to SEQ ID NO: 175515

SEQ ID NO: 415563 - RNA, 64 nt, hsa; identical to SEQ ID NO: 175516

SEQ ID NO: 415564 - RNA, 64 nt, hsa; identical to SEQ ID NO: 175517

SEQ ID NO: 415565 - RNA, 64 nt, hsa; identical to SEQ ID NO: 175518

SEQ ID NO: 415566 - RNA, 64 nt, hsa; identical to SEQ ID NO: 175519

SEQ ID NO: 415567 - RNA, 64 nt, hsa; identical to SEQ ID NO: 175520

SEQ ID NO: 415568 - RNA, 64 nt, hsa; identical to SEQ ID NO: 175521

SEQ ID NO: 415569 - RNA, 64 nt, hsa; identical to SEQ ID NO: 175522

SEQ ID NO: 415570 - RNA, 64 nt, hsa; identical to SEQ ID NO: 175523

SEQ ID NO: 415571 - RNA, 64 nt, hsa; identical to SEQ ID NO: 175524

SEQ ID NO: 415572 - RNA, 64 nt, hsa; identical to SEQ ID NO: 175525

SEQ ID NO: 415573 - RNA, 64 nt, hsa; identical to SEQ ID NO: 175526

SEQ ID NO: 415574 - RNA, 64 nt, hsa; identical to SEQ ID NO: 175527

SEQ ID NO: 415575 - RNA, 64 nt, hsa; identical to SEQ ID NO: 175528

SEQ ID NO: 415576 - RNA, 64 nt, hsa; identical to SEQ ID NO: 175529

SEQ ID NO: 415577 - RNA, 64 nt, hsa; identical to SEQ ID NO: 175530

SEQ ID NO: 415578 - RNA, 64 nt, hsa; identical to SEQ ID NO: 175531

SEQ ID NO: 415579 - RNA, 64 nt, hsa; identical to SEQ ID NO: 175532

SEQ ID NO: 415580 - RNA, 64 nt, hsa; identical to SEQ ID NO: 175533

SEQ ID NO: 415581 - RNA, 64 nt, hsa; identical to SEQ ID NO: 175534

SEQ ID NO: 415582 - RNA, 64 nt, hsa; identical to SEQ ID NO: 175535

SEQ ID NO: 415583 - RNA, 64 nt, hsa; identical to SEQ ID NO: 175536

SEQ ID NO: 415584 - RNA, 64 nt, hsa; identical to SEQ ID NO: 175537

SEQ ID NO: 415585 - RNA, 64 nt, hsa; identical to SEQ ID NO: 175538

SEQ ID NO: 415586 - RNA, 53 nt, hsa; identical to SEQ ID NO: 175539

SEQ ID NO: 415587 - RNA, 64 nt, hsa; identical to SEQ ID NO: 175540

SEQ ID NO: 415588 - RNA, 64 nt, hsa; identical to SEQ ID NO: 175541

SEQ ID NO: 415589 - RNA, 64 nt, hsa; identical to SEQ ID NO: 175542

SEQ ID NO: 415590 - RNA, 64 nt, hsa; identical to SEQ ID NO: 175543

SEQ ID NO: 415591 - RNA, 64 nt, hsa; identical to SEQ ID NO: 175544

SEQ ID NO: 415592 - RNA, 64 nt, hsa; identical to SEQ ID NO: 175545

SEQ ID NO: 415593 - RNA, 64 nt, hsa; identical to SEQ ID NO: 175546

SEQ ID NO: 415594 - RNA, 64 nt, hsa; identical to SEQ ID NO: 175547

SEQ ID NO: 415595 - RNA, 64 nt, hsa; identical to SEQ ID NO: 175548

SEQ ID NO: 415596 - RNA, 64 nt, hsa; identical to SEQ ID NO: 175549

SEQ ID NO: 415597 - RNA, 64 nt, hsa; identical to SEQ ID NO: 175550

SEQ ID NO: 415598 - RNA, 64 nt, hsa; identical to SEQ ID NO: 175551

SEQ ID NO: 415599 - RNA, 64 nt, hsa; identical to SEQ ID NO: 175552

SEQ ID NO: 415600 - RNA, 64 nt, hsa; identical to SEQ ID NO: 175553

SEQ ID NO: 415601 - RNA, 64 nt, hsa; identical to SEQ ID NO: 175554

SEQ ID NO: 415602 - RNA, 64 nt, hsa; identical to SEQ ID NO: 175555

SEQ ID NO: 415603 - RNA, 64 nt, hsa; identical to SEQ ID NO: 175556

SEQ ID NO: 415604 - RNA, 64 nt, hsa; identical to SEQ ID NO: 175557

SEQ ID NO: 415605 - RNA, 64 nt, hsa; identical to SEQ ID NO: 175558

SEQ ID NO: 415606 - RNA, 64 nt, hsa; identical to SEQ ID NO: 175559

SEQ ID NO: 415607 - RNA, 64 nt, hsa; identical to SEQ ID NO: 175560

SEQ ID NO: 415608 - RNA, 64 nt, hsa; identical to SEQ ID NO: 175561

SEQ ID NO: 415609 - RNA, 64 nt, hsa; identical to SEQ ID NO: 175562

SEQ ID NO: 415610 - RNA, 64 nt, hsa; identical to SEQ ID NO: 175563

SEQ ID NO: 415611 - RNA, 64 nt, hsa; identical to SEQ ID NO: 175564

SEQ ID NO: 415612 - RNA, 64 nt, hsa; identical to SEQ ID NO: 175565

SEQ ID NO: 415613 - RNA, 64 nt, hsa; identical to SEQ ID NO: 175566

SEQ ID NO: 415614 - RNA, 64 nt, hsa; identical to SEQ ID NO: 301804

SEQ ID NO: 415615 - RNA, 64 nt, hsa; identical to SEQ ID NO: 301805

SEQ ID NO: 415616 - RNA, 55 nt, hsa; identical to SEQ ID NO: 301806

SEQ ID NO: 415617 - RNA, 64 nt, hsa; identical to SEQ ID NO: 301807

SEQ ID NO: 415618 - RNA, 64 nt, hsa; identical to SEQ ID NO: 301808

SEQ ID NO: 415619 - RNA, 64 nt, hsa; identical to SEQ ID NO: 301809

SEQ ID NO: 415620 - RNA, 64 nt, hsa; identical to SEQ ID NO: 301810

SEQ ID NO: 415621 - RNA, 64 nt, hsa; identical to SEQ ID NO: 301811

SEQ ID NO: 415622 - RNA, 64 nt, hsa; identical to SEQ ID NO: 301812

SEQ ID NO: 415623 - RNA, 64 nt, hsa; identical to SEQ ID NO: 301813

SEQ ID NO: 415624 - RNA, 64 nt, hsa; identical to SEQ ID NO: 301814

SEQ ID NO: 415625 - RNA, 64 nt, hsa; identical to SEQ ID NO: 301815

SEQ ID NO: 415626 - RNA, 64 nt, hsa; identical to SEQ ID NO: 301816

SEQ ID NO: 415627 - RNA, 64 nt, hsa; identical to SEQ ID NO: 301817

SEQ ID NO: 415628 - RNA, 64 nt, hsa; identical to SEQ ID NO: 301818

SEQ ID NO: 415629 - RNA, 64 nt, hsa; identical to SEQ ID NO: 301819

SEQ ID NO: 415630 - RNA, 64 nt, hsa; identical to SEQ ID NO: 301820

SEQ ID NO: 415631 - RNA, 64 nt, hsa; identical to SEQ ID NO: 301821

SEQ ID NO: 415632 - RNA, 64 nt, hsa; identical to SEQ ID NO: 301822

SEQ ID NO: 415633 - RNA, 64 nt, hsa; identical to SEQ ID NO: 301823

SEQ ID NO: 415634 - RNA, 64 nt, hsa; identical to SEQ ID NO: 301824

SEQ ID NO: 415635 - RNA, 64 nt, hsa; identical to SEQ ID NO: 301825

SEQ ID NO: 415636 - RNA, 64 nt, hsa; identical to SEQ ID NO: 301826

SEQ ID NO: 415637 - RNA, 51 nt, hsa; identical to SEQ ID NO: 301827

SEQ ID NO: 415638 - RNA, 64 nt, hsa; identical to SEQ ID NO: 301828

SEQ ID NO: 415639 - RNA, 64 nt, hsa; identical to SEQ ID NO: 301829

SEQ ID NO: 415640 - RNA, 64 nt, hsa; identical to SEQ ID NO: 301830

SEQ ID NO: 415641 - RNA, 64 nt, hsa; identical to SEQ ID NO: 301831

SEQ ID NO: 415642 - RNA, 64 nt, hsa; identical to SEQ ID NO: 301832

SEQ ID NO: 415643 - RNA, 64 nt, hsa; identical to SEQ ID NO: 301833

SEQ ID NO: 415644 - RNA, 64 nt, hsa; identical to SEQ ID NO: 301834

SEQ ID NO: 415645 - RNA, 64 nt, hsa; identical to SEQ ID NO: 301835

SEQ ID NO: 415646 - RNA, 64 nt, hsa; identical to SEQ ID NO: 301836

SEQ ID NO: 415647 - RNA, 64 nt, hsa; identical to SEQ ID NO: 301837

SEQ ID NO: 415648 - RNA, 64 nt, hsa; identical to SEQ ID NO: 301838

SEQ ID NO: 415649 - RNA, 64 nt, hsa; identical to SEQ ID NO: 301839

SEQ ID NO: 415650 - RNA, 64 nt, hsa; identical to SEQ ID NO: 301840

SEQ ID NO: 415651 - RNA, 64 nt, hsa; identical to SEQ ID NO: 301841

SEQ ID NO: 415652 - RNA, 64 nt, hsa; identical to SEQ ID NO: 301842

SEQ ID NO: 415653 - RNA, 64 nt, hsa; identical to SEQ ID NO: 301843

SEQ ID NO: 415654 - RNA, 64 nt, hsa; identical to SEQ ID NO: 301844

SEQ ID NO: 415655 - RNA, 64 nt, hsa; identical to SEQ ID NO: 301845

SEQ ID NO: 415656 - RNA, 64 nt, hsa; identical to SEQ ID NO: 301846

SEQ ID NO: 415657 - RNA, 64 nt, hsa; identical to SEQ ID NO: 301847

SEQ ID NO: 415658 - RNA, 64 nt, hsa; identical to SEQ ID NO: 301848

SEQ ID NO: 415659 - RNA, 64 nt, hsa; identical to SEQ ID NO: 301849

SEQ ID NO: 415660 - RNA, 64 nt, hsa; identical to SEQ ID NO: 301850

SEQ ID NO: 415661 - RNA, 64 nt, hsa; identical to SEQ ID NO: 301851

SEQ ID NO: 415662 - RNA, 64 nt, hsa; identical to SEQ ID NO: 301852

SEQ ID NO: 415663 - RNA, 64 nt, hsa; identical to SEQ ID NO: 301853

SEQ ID NO: 415664 - RNA, 64 nt, hsa; identical to SEQ ID NO: 301854

SEQ ID NO: 415665 - RNA, 64 nt, hsa; identical to SEQ ID NO: 301855

SEQ ID NO: 415666 - RNA, 64 nt, hsa; identical to SEQ ID NO: 301856

SEQ ID NO: 415667 - RNA, 64 nt, hsa; identical to SEQ ID NO: 301857

SEQ ID NO: 415668 - RNA, 64 nt, hsa; identical to SEQ ID NO: 301858

SEQ ID NO: 415669 - RNA, 64 nt, hsa; identical to SEQ ID NO: 301859

SEQ ID NO: 415670 - RNA, 64 nt, hsa; identical to SEQ ID NO: 301860

SEQ ID NO: 415671 - RNA, 64 nt, hsa; identical to SEQ ID NO: 301861

SEQ ID NO: 415672 - RNA, 64 nt, hsa; identical to SEQ ID NO: 169330

SEQ ID NO: 415673 - RNA, 64 nt, hsa; identical to SEQ ID NO: 169331

SEQ ID NO: 415674 - RNA, 64 nt, hsa; identical to SEQ ID NO: 169332

SEQ ID NO: 415675 - RNA, 64 nt, hsa; identical to SEQ ID NO: 169333

SEQ ID NO: 415676 - RNA, 64 nt, hsa; identical to SEQ ID NO: 169334

SEQ ID NO: 415677 - RNA, 64 nt, hsa; identical to SEQ ID NO: 169335

SEQ ID NO: 415678 - RNA, 64 nt, hsa; identical to SEQ ID NO: 169336

SEQ ID NO: 415679 - RNA, 64 nt, hsa; identical to SEQ ID NO: 169337

SEQ ID NO: 415680 - RNA, 64 nt, hsa; identical to SEQ ID NO: 169338

SEQ ID NO: 415681 - RNA, 64 nt, hsa; identical to SEQ ID NO: 169339

SEQ ID NO: 415682 - RNA, 64 nt, hsa; identical to SEQ ID NO: 169340

SEQ ID NO: 415683 - RNA, 64 nt, hsa; identical to SEQ ID NO: 169341

SEQ ID NO: 415684 - RNA, 64 nt, hsa; identical to SEQ ID NO: 169342

SEQ ID NO: 415685 - RNA, 64 nt, hsa; identical to SEQ ID NO: 169343

SEQ ID NO: 415686 - RNA, 64 nt, hsa; identical to SEQ ID NO: 169344

SEQ ID NO: 415687 - RNA, 64 nt, hsa; identical to SEQ ID NO: 169345

SEQ ID NO: 415688 - RNA, 64 nt, hsa; identical to SEQ ID NO: 169346

SEQ ID NO: 415689 - RNA, 64 nt, hsa; identical to SEQ ID NO: 169347

SEQ ID NO: 415690 - RNA, 64 nt, hsa; identical to SEQ ID NO: 169348

SEQ ID NO: 415691 - RNA, 64 nt, hsa; identical to SEQ ID NO: 169349

SEQ ID NO: 415692 - RNA, 64 nt, hsa; identical to SEQ ID NO: 169350

SEQ ID NO: 415693 - RNA, 64 nt, hsa; identical to SEQ ID NO: 169351

SEQ ID NO: 415694 - RNA, 64 nt, hsa; identical to SEQ ID NO: 169352

SEQ ID NO: 415695 - RNA, 64 nt, hsa; identical to SEQ ID NO: 169353

SEQ ID NO: 415696 - RNA, 64 nt, hsa; identical to SEQ ID NO: 169354

SEQ ID NO: 415697 - RNA, 64 nt, hsa; identical to SEQ ID NO: 169355

SEQ ID NO: 415698 - RNA, 64 nt, hsa; identical to SEQ ID NO: 169356

SEQ ID NO: 415699 - RNA, 64 nt, hsa; identical to SEQ ID NO: 169357

SEQ ID NO: 415700 - RNA, 64 nt, hsa; identical to SEQ ID NO: 169358

SEQ ID NO: 415701 - RNA, 64 nt, hsa; identical to SEQ ID NO: 169359

SEQ ID NO: 415702 - RNA, 64 nt, hsa; identical to SEQ ID NO: 169360

SEQ ID NO: 415703 - RNA, 64 nt, hsa; identical to SEQ ID NO: 169361

SEQ ID NO: 415704 - RNA, 64 nt, hsa; identical to SEQ ID NO: 169362

SEQ ID NO: 415705 - RNA, 64 nt, hsa; identical to SEQ ID NO: 169363

SEQ ID NO: 415706 - RNA, 64 nt, hsa; identical to SEQ ID NO: 169364

SEQ ID NO: 415707 - RNA, 64 nt, hsa; identical to SEQ ID NO: 169365

SEQ ID NO: 415708 - RNA, 64 nt, hsa; identical to SEQ ID NO: 169366

SEQ ID NO: 415709 - RNA, 64 nt, hsa; identical to SEQ ID NO: 169367

SEQ ID NO: 415710 - RNA, 64 nt, hsa; identical to SEQ ID NO: 169368

SEQ ID NO: 415711 - RNA, 64 nt, hsa; identical to SEQ ID NO: 169369

SEQ ID NO: 415712 - RNA, 64 nt, hsa; identical to SEQ ID NO: 169370

SEQ ID NO: 415713 - RNA, 64 nt, hsa; identical to SEQ ID NO: 169371

SEQ ID NO: 415714 - RNA, 64 nt, hsa; identical to SEQ ID NO: 169372

SEQ ID NO: 415715 - RNA, 64 nt, hsa; identical to SEQ ID NO: 169373

SEQ ID NO: 415716 - RNA, 64 nt, hsa; identical to SEQ ID NO: 169374

SEQ ID NO: 415717 - RNA, 64 nt, hsa; identical to SEQ ID NO: 169375

SEQ ID NO: 415718 - RNA, 64 nt, hsa; identical to SEQ ID NO: 169376

SEQ ID NO: 415719 - RNA, 64 nt, hsa
augaaacgcagaggaugggugcccagaagcaccugcggcagaggcgcacgggaagcccggggcc

SEQ ID NO: 415720 - RNA, 64 nt, hsa
caggcagccaccaagcccaccccaggucaugccagcggcagaggacgugaggggcuggcagcag

SEQ ID NO: 415721 - RNA, 64 nt, hsa
uguugcgugacacucuccuugcaguucuugaguugcggcagaacaucgcgaugggaaccgaugg

SEQ ID NO: 415722 - RNA, 64 nt, hsa
uucagcaggaucaugccuucugugucuggaagaggcggcagaggcaacaguguuuaggauuugg

SEQ ID NO: 415723 - RNA, 64 nt, hsa
gccugggcuuccuggccugaguggguagacgcaggcggcagaggugcuggaccacaucuccgcc

SEQ ID NO: 415724 - RNA, 64 nt, hsa
ggggcagccaggcugcucagggaaggggcugaaagcggcagaggagugcccuggcuuggucacc

SEQ ID NO: 415725 - RNA, 64 nt, hsa
guucgguguccucgagguugagcuucacuccacugcggcagaggcagcgugcacacucggauuu

SEQ ID NO: 415726 - RNA, 64 nt, hsa
aaggaguggcugcucuccaaacuaugccaaggcggcggcagagcuggucuucuggucuccuugg

SEQ ID NO: 415727 - RNA, 64 nt, hsa
aggaggaagaggggucuggaaagaaacccagaaugcggcagaacuaggaguaaguccaucucaa

SEQ ID NO: 415728 - RNA, 64 nt, hsa
aucacugaacaaacauuuccugauggcaacuccugcggcagagcccaggcuggggaagugaacu

SEQ ID NO: 415729 - RNA, 64 nt, hsa
ugcagguauuuuccaucugcugugccaaggcugagcggcagaaacuugucucauaaauuggcac

SEQ ID NO: 415730 - RNA, 64 nt, hsa
gcacacggugccucaaccaacuggacaagggauggcggcagaccaggggccaggccaaagcacu

SEQ ID NO: 415731 - RNA, 64 nt, hsa
ucaggugacuugcccaaggucacacagcuaguuagcggcagagccugcacucgaauucaggucu

SEQ ID NO: 415732 - RNA, 64 nt, hsa
aggaggcugaggcagaagaauugcuugaacccaggcggcagagguugcagugagucgagauugc

SEQ ID NO: 415733 - RNA, 64 nt, hsa
ccucaacgguucggcuccucaacagacagucccugcggcagaaguggguguggccgugagccuc

SEQ ID NO: 415734 - RNA, 64 nt, hsa
ugucagcauucccagcuuuccaagcugcccccaggcggcagagucugagggucccggggcccgg

SEQ ID NO: 415735 - RNA, 64 nt, hsa
aacuuugcccccuuugcaucuucauaaaccugcugcggcagacuccucagccgaugguggcucu

SEQ ID NO: 415736 - RNA, 64 nt, hsa
uugagcugacggagcgugagugcaucaaguacaugcggcagaucucggagggaguggaguacau

SEQ ID NO: 415737 - RNA, 64 nt, hsa
cccagcuacgcagaaagcagccggagccucggcggcggcagaaaggggacaaccagggccuccu

SEQ ID NO: 415738 - RNA, 64 nt, hsa
caggucugggccagaugcugggcaggaaaccccagcggcagaugggccugugugcacccaacgu

SEQ ID NO: 415739 - RNA, 64 nt, hsa
ggcaaaaauuuauggugaaugaauauggcuuuaggcggcagaugauauacauaucugacuuccc

SEQ ID NO: 415740 - RNA, 64 nt, hsa
gucauggcaacaggaggcugugcugaccuccugagcggcagacaccuuccaggagcccugaggg

SEQ ID NO: 415741 - RNA, 64 nt, hsa
cauguaaauagacaaaaggaaacauuugccaaaagcggcagaucuuuacugaaagagagagcag

SEQ ID NO: 415742 - RNA, 64 nt, hsa
acugccucgaguacccaccagaccaagaaggccugcggcagagccgaggacgcuggguccuccu

SEQ ID NO: 415743 - RNA, 64 nt, hsa
cacagaagacaccgaaugugcaucuggagguguugcggcagagguuugagugaacccucuuuca

SEQ ID NO: 415744 - RNA, 64 nt, hsa
gccgcucugagcaccgggggaugugacugccucagcggcagagcuggaagggcccucgaaugcc

SEQ ID NO: 415745 - RNA, 64 nt, hsa
aacaaaaccucagagcccgggucaucuucugcaggcggcagaacuacaucggggccaccaaauc

SEQ ID NO: 415746 - RNA, 64 nt, hsa
auugcuuguguccauaggaguccaucaaggcagagcggcagagcggcaagcagagcggcaaggc

SEQ ID NO: 415747 - RNA, 64 nt, hsa
auggaccucacaaaaaccuguuccgacucuuucugcggcagaacacucagggcgcccaggccga

SEQ ID NO: 415748 - RNA, 64 nt, hsa
agcgccacuccaggguucagacagggcugcacaggcggcagagauacagggucugagggcugag

SEQ ID NO: 415749 - RNA, 64 nt, hsa
uuagucuguguaguuaauuuaauuugcaguuugugcggcagauugcucugccaagauacuugaa

SEQ ID NO: 415750 - RNA, 64 nt, hsa
gugccuguaaucccagcuacccaggaaggcugaggcggcagaaucacuugaacccggaggcgga

SEQ ID NO: 415751 - RNA, 64 nt, hsa
ugaauuguuggagaauguaaaccgccuccacguggcggcagacuuccuaaggccccagcucgcu

SEQ ID NO: 415752 - RNA, 64 nt, hsa
aguggucagugucgguggggggugggaggagagagcggcagagaagcucugagagccccuuccc

SEQ ID NO: 415753 - RNA, 64 nt, hsa
gggagguugaggcaggagaaucgcuuaaacccaggcggcagagguugcagugagccaagaucgc

SEQ ID NO: 415754 - RNA, 64 nt, hsa
gacaaagugccucaugcaaccgggcccucucucugcggcagaguccuuaguggagggguuuacc

SEQ ID NO: 415755 - RNA, 64 nt, hsa
guuaaaaaguguucaaacacuaucccuaaugccugcggcagaauuuauauacgauccauucauu

SEQ ID NO: 415756 - RNA, 64 nt, hsa
cagaguugaagaggcugacuuggcccacugcuaagcggcagaggcagggccagccauccugucg

SEQ ID NO: 415757 - RNA, 64 nt, hsa
gaggaguuauggugaacccacaacuuaggcccuagcggcagaaaggaaaaccugaagacugagg

SEQ ID NO: 415758 - RNA, 64 nt, hsa
augugauagaagucugggggggaguugggggauggcggcagauguuagccaggucugcccuccc

SEQ ID NO: 415759 - RNA, 64 nt, hsa
cuuccccgggggggacugcaaaccgcucaggguugcggcagagccauggacuuccggucccugc

SEQ ID NO: 415760 - RNA, 64 nt, hsa
ggugagagugggagggagguaacgggugccugcugcggcagacgggaggggaaaggcugccgag

SEQ ID NO: 415761 - RNA, 64 nt, hsa
cucuccuaacccaaggcggagaaugaaggugguggcggcagaggaggagggcagcagcugagag

SEQ ID NO: 415762 - RNA, 64 nt, hsa
ggcaccugcgccuguguggaaauuuggagaaguugcggcagagaagccaugcguuccagcauuc

SEQ ID NO: 415763 - RNA, 64 nt, hsa
cagugauaagcaacuccaccuaaggcaugaauaugcggcagagaaaacagcaauagugaaugaa

SEQ ID NO: 415764 - RNA, 64 nt, hsa
gauuguaaaguguaaggcauuagguucugagacagcggcagagagagccaugcaaauguuuagg

SEQ ID NO: 415765 - RNA, 64 nt, hsa
ucagagggagcagccuaucucccccaagcuggaggcggcagaggacugggccaagccccaaccu

SEQ ID NO: 415766 - RNA, 64 nt, hsa
gaauuucaguacagaacacugacaaacaaggaaagcggcagagaaagaagaaagaccuagaagg

SEQ ID NO: 415767 - RNA, 64 nt, hsa
caaauuccuaagggggaagaggagaggguauggggcggcagacccuaucaucaacuguccagug

SEQ ID NO: 415768 - RNA, 64 nt, hsa
acucuguccugaagagugggacaaaugcagccgggcggcagaucuagcgggagcucaaagggau

SEQ ID NO: 415769 - RNA, 64 nt, hsa
ugcaggcuuccccccgaccauucccugcagccaugcggcagagcuggcauuucuccucagagaa

SEQ ID NO: 415770 - RNA, 64 nt, hsa
cacacgcagcuggagagggcuucugucccugucagcggcagagggcguuggggcuggccggggc

SEQ ID NO: 415771 - RNA, 64 nt, hsa
aggguuggcaugacugucugugcaccgagaagaggcggcagauccugcccuggccaaucaggcg

SEQ ID NO: 415772 - RNA, 64 nt, hsa
uggcccagggcggccucuacgccaagcuggugcagcggcagaugcuggggcuucagcccgccgc

SEQ ID NO: 415773 - RNA, 64 nt, hsa
acccaggaccuacaaccacacugaaggcuccagugcggcagagccucgugcaagcaggagagaa

SEQ ID NO: 415774 - RNA, 64 nt, hsa
gagaauguuugagguccagccuugguguagagaagcggcagaaacagaaaucccaaaagguguc

SEQ ID NO: 415775 - RNA, 64 nt, hsa
cccaccgucacccagugacccaccggguucugcagcggcagagcaauuccaggcugagccauga

SEQ ID NO: 415776 - RNA, 64 nt, hsa
cgcgcucagaaaaggaccuugugagacggaggaagcggcagaaggcggacgcgugccggcggga

SEQ ID NO: 415777 - RNA, 64 nt, hsa
gcccugugucgucagaggcuugugauuaacuguggcggcagacacagcuuguccacagcuuggg

SEQ ID NO: 415778 - RNA, 64 nt, hsa
guacaguaaauggcuuauccagcuggugagugaugcggcagauugaguuuucuucugugauucg

SEQ ID NO: 415779 - RNA, 64 nt, hsa
cucuaaauuaaugguugaccggaagggauuggaggcggcagaaccauuaacccuacacaagaac

SEQ ID NO: 415780 - RNA, 64 nt, hsa
ggggcaggcagauugccucacuuaacuuaaaucugcggcagacaacugccagugcccaucaaac

SEQ ID NO: 415781 - RNA, 64 nt, hsa
gacagacuggaguugaaagccgacgaaccgacacgcggcagagucaauaauucaauaaaaaagu

SEQ ID NO: 415782 - RNA, 64 nt, hsa
gucagagugcgaauaugucucugagaagcuagaggcggcagagagagacaaucaaaaccuggaa

SEQ ID NO: 415783 - RNA, 64 nt, hsa
ggggccagggcugagccggcggguccuccugagcgcggcagagggugagccucacagccccucu

SEQ ID NO: 415784 - RNA, 64 nt, hsa
caguuuguauucuuaggaaucauucuuaggcagugcggcagaagcaggccucugugaagugucu

SEQ ID NO: 415785 - RNA, 64 nt, hsa
agcacaaugagaaacggcagcgccgacaggagcggcggcagaugaagcgguuauagccauugac

SEQ ID NO: 415786 - RNA, 64 nt, hsa
ucuccgccagagucacagcagugccgagguguccgcggcagaccacacagaccgucugaaaugc

SEQ ID NO: 415787 - RNA, 64 nt, hsa
gcugggucuggggccgccacaggccccucacggggcggcagaggcaacuucagugucccuguua

SEQ ID NO: 415788 - RNA, 64 nt, hsa
aggccucaguggucauuaagauguuaagucuuuugcggcagauuccuggugauuugaucaauaa

SEQ ID NO: 415789 - RNA, 64 nt, hsa
ccccuucaccgacggcuggcaccccuucgugguagcggcagagcucaucuacuuccucuuccuc

SEQ ID NO: 415790 - RNA, 64 nt, hsa
acucggaguuaggggcaugggcaauagcaagcuggcggcagaguccagcccagcauaugacuug

SEQ ID NO: 415791 - RNA, 64 nt, hsa
uccucagccagcacccugggguguggaaucagcagcggcagaguccaccguguuuggagacucu

SEQ ID NO: 415792 - RNA, 64 nt, hsa
gugaacuuuauagaauccucucuguacuggaugugcggcagagggguggcuccgagccucggcu

SEQ ID NO: 415793 - RNA, 64 nt, hsa
cacucacacucccuaacaucaacacaucuucaaggcggcagagcugugcgcccacccagcuauu

SEQ ID NO: 415794 - RNA, 64 nt, hsa
gagugugcggcugugugugcacgcgugugcaggagcggcagauggggagacaacgugcucuuug

SEQ ID NO: 415795 - RNA, 64 nt, hsa
gaggcacacagcugcagagacagagaggacgugggcggcagagaggacuguugacauccaagcu

SEQ ID NO: 415796 - RNA, 64 nt, hsa
ggacacagagacacacagagaagaaagccauguggcggcagaggcagagaugggagugaugcgg

SEQ ID NO: 415797 - RNA, 64 nt, hsa
cucucuccucggcagcagcgggaggcagaggaaggcggcagaagaugaagagcuuucccaucca

SEQ ID NO: 415798 - RNA, 64 nt, hsa
aagcggcgccgcacguagacccucagcccugguggcggcagagaagcgggcgaggcacuguggu

SEQ ID NO: 415799 - RNA, 64 nt, hsa
gucuugggaccaggcuucugcuccuccucagccagcggcagaagcagggcugaugcucagggac

SEQ ID NO: 415800 - RNA, 64 nt, hsa
auaguucauuuuaugugggaggauguucagcagcgcggcagagucauggggguaagugagugcu

SEQ ID NO: 415801 - RNA, 64 nt, hsa
uucucugucucuguggaaaagccaucucagguuggcggcagacacauugucaucagaggggagc

SEQ ID NO: 415802 - RNA, 64 nt, hsa
ccccagaaccccaaagcagacagcgagacccccagcggcagaggccucccucggcacuccaggc

SEQ ID NO: 415803 - RNA, 64 nt, hsa
agagucaccccauggugguauggcugaacaaggagcggcagacaacucagggagaaacucagga

SEQ ID NO: 415804 - RNA, 64 nt, hsa
cugacagcucuguggccugggaauccauuuuccugcggcagagcagggccugguguggaaccag

SEQ ID NO: 415805 - RNA, 64 nt, hsa
ggcuccuuccugccaccuccucccaucaccuccugcggcagaacagcacccgugacccacccag

SEQ ID NO: 415806 - RNA, 64 nt, hsa
gauaggcucugauuuccggggcagccuuucagaugcggcagacauacaacaccuguacuuuaga

SEQ ID NO: 415807 - RNA, 64 nt, hsa; identical to SEQ ID NO: 169330

SEQ ID NO: 415808 - RNA, 64 nt, hsa; identical to SEQ ID NO: 169331

SEQ ID NO: 415809 - RNA, 64 nt, hsa; identical to SEQ ID NO: 169332

SEQ ID NO: 415810 - RNA, 64 nt, hsa; identical to SEQ ID NO: 169333

SEQ ID NO: 415811 - RNA, 64 nt, hsa; identical to SEQ ID NO: 169334

SEQ ID NO: 415812 - RNA, 64 nt, hsa; identical to SEQ ID NO: 169335

SEQ ID NO: 415813 - RNA, 64 nt, hsa; identical to SEQ ID NO: 169336

SEQ ID NO: 415814 - RNA, 64 nt, hsa; identical to SEQ ID NO: 169337

SEQ ID NO: 415815 - RNA, 64 nt, hsa; identical to SEQ ID NO: 169338

SEQ ID NO: 415816 - RNA, 64 nt, hsa; identical to SEQ ID NO: 169339

SEQ ID NO: 415817 - RNA, 64 nt, hsa; identical to SEQ ID NO: 169340

SEQ ID NO: 415818 - RNA, 64 nt, hsa; identical to SEQ ID NO: 169341

SEQ ID NO: 415819 - RNA, 64 nt, hsa; identical to SEQ ID NO: 169342

SEQ ID NO: 415820 - RNA, 64 nt, hsa; identical to SEQ ID NO: 169343

SEQ ID NO: 415821 - RNA, 64 nt, hsa; identical to SEQ ID NO: 169344

SEQ ID NO: 415822 - RNA, 64 nt, hsa; identical to SEQ ID NO: 169345

SEQ ID NO: 415823 - RNA, 64 nt, hsa; identical to SEQ ID NO: 169346

SEQ ID NO: 415824 - RNA, 64 nt, hsa; identical to SEQ ID NO: 169347

SEQ ID NO: 415825 - RNA, 64 nt, hsa; identical to SEQ ID NO: 169348

SEQ ID NO: 415826 - RNA, 64 nt, hsa; identical to SEQ ID NO: 169349

SEQ ID NO: 415827 - RNA, 64 nt, hsa; identical to SEQ ID NO: 169350

SEQ ID NO: 415828 - RNA, 64 nt, hsa; identical to SEQ ID NO: 169351

SEQ ID NO: 415829 - RNA, 64 nt, hsa; identical to SEQ ID NO: 169352

SEQ ID NO: 415830 - RNA, 64 nt, hsa; identical to SEQ ID NO: 169353

SEQ ID NO: 415831 - RNA, 64 nt, hsa; identical to SEQ ID NO: 169354

SEQ ID NO: 415832 - RNA, 64 nt, hsa; identical to SEQ ID NO: 169355

SEQ ID NO: 415833 - RNA, 64 nt, hsa; identical to SEQ ID NO: 169356

SEQ ID NO: 415834 - RNA, 64 nt, hsa; identical to SEQ ID NO: 169357

SEQ ID NO: 415835 - RNA, 64 nt, hsa; identical to SEQ ID NO: 169358

SEQ ID NO: 415836 - RNA, 64 nt, hsa; identical to SEQ ID NO: 169359

SEQ ID NO: 415837 - RNA, 64 nt, hsa; identical to SEQ ID NO: 169360

SEQ ID NO: 415838 - RNA, 64 nt, hsa; identical to SEQ ID NO: 169361

SEQ ID NO: 415839 - RNA, 64 nt, hsa; identical to SEQ ID NO: 169362

SEQ ID NO: 415840 - RNA, 64 nt, hsa; identical to SEQ ID NO: 169363

SEQ ID NO: 415841 - RNA, 64 nt, hsa; identical to SEQ ID NO: 169364

SEQ ID NO: 415842 - RNA, 64 nt, hsa; identical to SEQ ID NO: 169365

SEQ ID NO: 415843 - RNA, 64 nt, hsa; identical to SEQ ID NO: 169366

SEQ ID NO: 415844 - RNA, 64 nt, hsa; identical to SEQ ID NO: 169367

SEQ ID NO: 415845 - RNA, 64 nt, hsa; identical to SEQ ID NO: 169368

SEQ ID NO: 415846 - RNA, 64 nt, hsa; identical to SEQ ID NO: 169369

SEQ ID NO: 415847 - RNA, 64 nt, hsa; identical to SEQ ID NO: 169370

SEQ ID NO: 415848 - RNA, 64 nt, hsa; identical to SEQ ID NO: 169371

SEQ ID NO: 415849 - RNA, 64 nt, hsa; identical to SEQ ID NO: 169372

SEQ ID NO: 415850 - RNA, 64 nt, hsa; identical to SEQ ID NO: 169373

SEQ ID NO: 415851 - RNA, 64 nt, hsa; identical to SEQ ID NO: 169374

SEQ ID NO: 415852 - RNA, 64 nt, hsa; identical to SEQ ID NO: 169375

SEQ ID NO: 415853 - RNA, 64 nt, hsa; identical to SEQ ID NO: 169376

SEQ ID NO: 415854 - RNA, 64 nt, hsa; identical to SEQ ID NO: 415719

SEQ ID NO: 415855 - RNA, 64 nt, hsa; identical to SEQ ID NO: 415720

SEQ ID NO: 415856 - RNA, 64 nt, hsa; identical to SEQ ID NO: 415721

SEQ ID NO: 415857 - RNA, 64 nt, hsa; identical to SEQ ID NO: 415722

SEQ ID NO: 415858 - RNA, 64 nt, hsa; identical to SEQ ID NO: 415723

SEQ ID NO: 415859 - RNA, 64 nt, hsa; identical to SEQ ID NO: 415724

SEQ ID NO: 415860 - RNA, 64 nt, hsa; identical to SEQ ID NO: 415725

SEQ ID NO: 415861 - RNA, 64 nt, hsa; identical to SEQ ID NO: 415726

SEQ ID NO: 415862 - RNA, 64 nt, hsa; identical to SEQ ID NO: 415727

SEQ ID NO: 415863 - RNA, 64 nt, hsa; identical to SEQ ID NO: 415728

SEQ ID NO: 415864 - RNA, 64 nt, hsa; identical to SEQ ID NO: 415729

SEQ ID NO: 415865 - RNA, 64 nt, hsa; identical to SEQ ID NO: 415730

SEQ ID NO: 415866 - RNA, 64 nt, hsa; identical to SEQ ID NO: 415731

SEQ ID NO: 415867 - RNA, 64 nt, hsa; identical to SEQ ID NO: 415732

SEQ ID NO: 415868 - RNA, 64 nt, hsa; identical to SEQ ID NO: 415733

SEQ ID NO: 415869 - RNA, 64 nt, hsa; identical to SEQ ID NO: 415734

SEQ ID NO: 415870 - RNA, 64 nt, hsa; identical to SEQ ID NO: 415735

SEQ ID NO: 415871 - RNA, 64 nt, hsa; identical to SEQ ID NO: 415736

SEQ ID NO: 415872 - RNA, 64 nt, hsa; identical to SEQ ID NO: 415737

SEQ ID NO: 415873 - RNA, 64 nt, hsa; identical to SEQ ID NO: 415738

SEQ ID NO: 415874 - RNA, 64 nt, hsa; identical to SEQ ID NO: 415739

SEQ ID NO: 415875 - RNA, 64 nt, hsa; identical to SEQ ID NO: 415740

SEQ ID NO: 415876 - RNA, 64 nt, hsa; identical to SEQ ID NO: 415741

SEQ ID NO: 415877 - RNA, 64 nt, hsa; identical to SEQ ID NO: 415742

SEQ ID NO: 415878 - RNA, 64 nt, hsa; identical to SEQ ID NO: 415743

SEQ ID NO: 415879 - RNA, 64 nt, hsa; identical to SEQ ID NO: 415744

SEQ ID NO: 415880 - RNA, 64 nt, hsa; identical to SEQ ID NO: 415745

SEQ ID NO: 415881 - RNA, 64 nt, hsa; identical to SEQ ID NO: 415746

SEQ ID NO: 415882 - RNA, 64 nt, hsa; identical to SEQ ID NO: 415747

SEQ ID NO: 415883 - RNA, 64 nt, hsa; identical to SEQ ID NO: 415748

SEQ ID NO: 415884 - RNA, 64 nt, hsa; identical to SEQ ID NO: 415749

SEQ ID NO: 415885 - RNA, 64 nt, hsa; identical to SEQ ID NO: 415750

SEQ ID NO: 415886 - RNA, 64 nt, hsa; identical to SEQ ID NO: 415751

SEQ ID NO: 415887 - RNA, 64 nt, hsa; identical to SEQ ID NO: 415752

SEQ ID NO: 415888 - RNA, 64 nt, hsa; identical to SEQ ID NO: 415753

SEQ ID NO: 415889 - RNA, 64 nt, hsa; identical to SEQ ID NO: 415754

SEQ ID NO: 415890 - RNA, 64 nt, hsa; identical to SEQ ID NO: 415755

SEQ ID NO: 415891 - RNA, 64 nt, hsa; identical to SEQ ID NO: 415756

SEQ ID NO: 415892 - RNA, 64 nt, hsa; identical to SEQ ID NO: 415757

SEQ ID NO: 415893 - RNA, 64 nt, hsa; identical to SEQ ID NO: 415758

SEQ ID NO: 415894 - RNA, 64 nt, hsa; identical to SEQ ID NO: 415759

SEQ ID NO: 415895 - RNA, 64 nt, hsa; identical to SEQ ID NO: 415760

SEQ ID NO: 415896 - RNA, 64 nt, hsa; identical to SEQ ID NO: 415761

SEQ ID NO: 415897 - RNA, 64 nt, hsa; identical to SEQ ID NO: 415762

SEQ ID NO: 415898 - RNA, 64 nt, hsa; identical to SEQ ID NO: 415763

SEQ ID NO: 415899 - RNA, 64 nt, hsa; identical to SEQ ID NO: 415764

SEQ ID NO: 415900 - RNA, 64 nt, hsa; identical to SEQ ID NO: 415765

SEQ ID NO: 415901 - RNA, 64 nt, hsa; identical to SEQ ID NO: 415766

SEQ ID NO: 415902 - RNA, 64 nt, hsa; identical to SEQ ID NO: 415767

SEQ ID NO: 415903 - RNA, 64 nt, hsa; identical to SEQ ID NO: 415768

SEQ ID NO: 415904 - RNA, 64 nt, hsa; identical to SEQ ID NO: 415769

SEQ ID NO: 415905 - RNA, 64 nt, hsa; identical to SEQ ID NO: 415770

SEQ ID NO: 415906 - RNA, 64 nt, hsa; identical to SEQ ID NO: 415771

SEQ ID NO: 415907 - RNA, 64 nt, hsa; identical to SEQ ID NO: 415772

SEQ ID NO: 415908 - RNA, 64 nt, hsa; identical to SEQ ID NO: 415773

SEQ ID NO: 415909 - RNA, 64 nt, hsa; identical to SEQ ID NO: 415774

SEQ ID NO: 415910 - RNA, 64 nt, hsa; identical to SEQ ID NO: 415775

SEQ ID NO: 415911 - RNA, 64 nt, hsa; identical to SEQ ID NO: 415776

SEQ ID NO: 415912 - RNA, 64 nt, hsa; identical to SEQ ID NO: 415777

SEQ ID NO: 415913 - RNA, 64 nt, hsa; identical to SEQ ID NO: 415778

SEQ ID NO: 415914 - RNA, 64 nt, hsa; identical to SEQ ID NO: 415779

SEQ ID NO: 415915 - RNA, 64 nt, hsa; identical to SEQ ID NO: 415780

SEQ ID NO: 415916 - RNA, 64 nt, hsa; identical to SEQ ID NO: 415781

SEQ ID NO: 415917 - RNA, 64 nt, hsa; identical to SEQ ID NO: 415782

SEQ ID NO: 415918 - RNA, 64 nt, hsa; identical to SEQ ID NO: 415783

SEQ ID NO: 415919 - RNA, 64 nt, hsa; identical to SEQ ID NO: 415784

SEQ ID NO: 415920 - RNA, 64 nt, hsa; identical to SEQ ID NO: 415785

SEQ ID NO: 415921 - RNA, 64 nt, hsa; identical to SEQ ID NO: 415786

SEQ ID NO: 415922 - RNA, 64 nt, hsa; identical to SEQ ID NO: 415787

SEQ ID NO: 415923 - RNA, 64 nt, hsa; identical to SEQ ID NO: 415788

SEQ ID NO: 415924 - RNA, 64 nt, hsa; identical to SEQ ID NO: 415789

SEQ ID NO: 415925 - RNA, 64 nt, hsa; identical to SEQ ID NO: 415790

SEQ ID NO: 415926 - RNA, 64 nt, hsa; identical to SEQ ID NO: 415791

SEQ ID NO: 415927 - RNA, 64 nt, hsa; identical to SEQ ID NO: 415792

SEQ ID NO: 415928 - RNA, 64 nt, hsa; identical to SEQ ID NO: 415793

SEQ ID NO: 415929 - RNA, 64 nt, hsa; identical to SEQ ID NO: 415794

SEQ ID NO: 415930 - RNA, 64 nt, hsa; identical to SEQ ID NO: 415795

SEQ ID NO: 415931 - RNA, 64 nt, hsa; identical to SEQ ID NO: 415796

SEQ ID NO: 415932 - RNA, 64 nt, hsa; identical to SEQ ID NO: 415797

SEQ ID NO: 415933 - RNA, 64 nt, hsa; identical to SEQ ID NO: 415798

SEQ ID NO: 415934 - RNA, 64 nt, hsa; identical to SEQ ID NO: 415799

SEQ ID NO: 415935 - RNA, 64 nt, hsa; identical to SEQ ID NO: 415800

SEQ ID NO: 415936 - RNA, 64 nt, hsa; identical to SEQ ID NO: 415801

SEQ ID NO: 415937 - RNA, 64 nt, hsa; identical to SEQ ID NO: 415802

SEQ ID NO: 415938 - RNA, 64 nt, hsa; identical to SEQ ID NO: 415803

SEQ ID NO: 415939 - RNA, 64 nt, hsa; identical to SEQ ID NO: 415804

SEQ ID NO: 415940 - RNA, 64 nt, hsa; identical to SEQ ID NO: 415805

SEQ ID NO: 415941 - RNA, 64 nt, hsa; identical to SEQ ID NO: 415806

SEQ ID NO: 415942 - RNA, 64 nt, hsa; identical to SEQ ID NO: 362406

SEQ ID NO: 415943 - RNA, 64 nt, hsa; identical to SEQ ID NO: 362407

SEQ ID NO: 415944 - RNA, 64 nt, hsa; identical to SEQ ID NO: 362408

SEQ ID NO: 415945 - RNA, 64 nt, hsa; identical to SEQ ID NO: 362409

SEQ ID NO: 415946 - RNA, 64 nt, hsa; identical to SEQ ID NO: 362410

SEQ ID NO: 415947 - RNA, 64 nt, hsa; identical to SEQ ID NO: 362411

SEQ ID NO: 415948 - RNA, 64 nt, hsa; identical to SEQ ID NO: 362412

SEQ ID NO: 415949 - RNA, 64 nt, hsa; identical to SEQ ID NO: 362413

SEQ ID NO: 415950 - RNA, 64 nt, hsa; identical to SEQ ID NO: 362414

SEQ ID NO: 415951 - RNA, 64 nt, hsa; identical to SEQ ID NO: 362415

SEQ ID NO: 415952 - RNA, 64 nt, hsa; identical to SEQ ID NO: 362416

SEQ ID NO: 415953 - RNA, 64 nt, hsa; identical to SEQ ID NO: 362417

SEQ ID NO: 415954 - RNA, 64 nt, hsa; identical to SEQ ID NO: 362418

SEQ ID NO: 415955 - RNA, 64 nt, hsa; identical to SEQ ID NO: 362419

SEQ ID NO: 415956 - RNA, 64 nt, hsa; identical to SEQ ID NO: 362420

SEQ ID NO: 415957 - RNA, 64 nt, hsa; identical to SEQ ID NO: 362421

SEQ ID NO: 415958 - RNA, 64 nt, hsa; identical to SEQ ID NO: 362422

SEQ ID NO: 415959 - RNA, 64 nt, hsa; identical to SEQ ID NO: 362423

SEQ ID NO: 415960 - RNA, 64 nt, hsa; identical to SEQ ID NO: 362424

SEQ ID NO: 415961 - RNA, 64 nt, hsa; identical to SEQ ID NO: 362425

SEQ ID NO: 415962 - RNA, 64 nt, hsa; identical to SEQ ID NO: 362426

SEQ ID NO: 415963 - RNA, 63 nt, hsa
gacagaugguagagacuuccauagaauuaagaggguucucauggaggggauaggaaguagguu

SEQ ID NO: 415964 - RNA, 63 nt, hsa
agaagguuucaggggcauuugacauccccuccugguucucaccaggaaaacauccaaagcuuu

SEQ ID NO: 415965 - RNA, 63 nt, hsa
uacagucaccagugugugaagacucuugagucugguucucauaucagagucaucauuuuucuu

SEQ ID NO: 415966 - RNA, 63 nt, hsa
uggaaguguccaugccucaccugcaacccaugugguucucagacuugaaucuucucggccccc

SEQ ID NO: 415967 - RNA, 63 nt, hsa
aaccagaaauacagaauaauucauagaaaucaugguucucaaguauuuguucaauuagcuuug

SEQ ID NO: 415968 - RNA, 63 nt, hsa
aagauuuauauucaaauguuuuuauuaaaguaagguucucauuuagcagacaucgcaacaagu

SEQ ID NO: 415969 - RNA, 63 nt, hsa
cagacuggcuggauucagaucaguguguuggcugguucucauuuuaagggguaagcaguuugc

SEQ ID NO: 415970 - RNA, 63 nt, hsa
uaaaguuccuuuuuaauguucuaaaguguuuacgguucucaaauaucaguuaaaaacuaauuu

SEQ ID NO: 415971 - RNA, 63 nt, hsa
uugaaggcuauuuuaccauuccuguucacaaaagguucucauggugccugacagguuacccuu

SEQ ID NO: 415972 - RNA, 63 nt, hsa
gaaucucuuuuaaacuauuauaugauucauaaugguucucaggaauuaauaaaugauuacugu

SEQ ID NO: 415973 - RNA, 63 nt, hsa
ccuuaagccugcgaggcccaggccuguggggcugguucucaccuuugacagcugaauguuccu

SEQ ID NO: 415974 - RNA, 63 nt, hsa
uucccaugcuuuuuguuagagcuuauuaguacagguucucaagagaugaccacauaaaagugc

SEQ ID NO: 415975 - RNA, 63 nt, hsa
uuaacaucuuuuaauuguuuccaggauugagcagguucucagcugggcucugauaucccgugc

SEQ ID NO: 415976 - RNA, 63 nt, hsa
ucaugguucagcagagguuacauaggagcaaaugguucucaauuuuccaguuugauugaagug

SEQ ID NO: 415977 - RNA, 63 nt, hsa
uaacgcgucuuccugaguggugccaaacaaaaagguucucagguguugccaaauauguccugg

SEQ ID NO: 415978 - RNA, 63 nt, hsa
ugccuuuuuuuuuuuuuuuuuuuuuuugagauggguucucacuauauuguccaggcuagagug

SEQ ID NO: 415979 - RNA, 63 nt, hsa
ugggggagauccuucauguugaggguuuugcuggguucucaggcuagugggggcauuaggaac

SEQ ID NO: 415980 - RNA, 63 nt, hsa
guuagcuucacagcaacagggagcuaggccauugguucucaaacuuaaggaaggaucagcauc

SEQ ID NO: 415981 - RNA, 63 nt, hsa
aucacuccacacacccaaagccucuggacuucugguucucaggagucugccuaccugucgccc

SEQ ID NO: 415982 - RNA, 63 nt, hsa
ucuucaaucuuaaacauuucuauuuagcugauugguucucacauauacuucuaaaagaaacuu

SEQ ID NO: 415983 - RNA, 63 nt, hsa
ccagcuccugcaucgagucuguaaaccagagcugguucucauggccuucgucacgauaccagg

SEQ ID NO: 415984 - RNA, 63 nt, hsa
ucccuuggagucucacaagguuuacuuugguaugguucucagcacaaaccuuucaaguauguu

SEQ ID NO: 415985 - RNA, 63 nt, hsa
uacucauugugcugcuuagccuucccaggagucgguucucaauuaggcuguugggaauccgcc

SEQ ID NO: 415986 - RNA, 63 nt, hsa
gggcagaagucuuggggaggaaugggcaaaggagguucucagucaauaaaaccaaaguucuuu

SEQ ID NO: 415987 - RNA, 63 nt, hsa
ggacgagcacugguuuaggagucaagauaucuggguucucacucuacucagucccagcagagc

SEQ ID NO: 415988 - RNA, 63 nt, hsa
cuuggcacccacauccagggcagagaggucugugguucucagcaucagaaggcagcgcagccc

SEQ ID NO: 415989 - RNA, 63 nt, hsa
accaaauuguggucaauggaaauaggagaauaugguucucacucuugagaaaaaaaccuaaga

SEQ ID NO: 415990 - RNA, 63 nt, hsa
uauuugugauuuugucacagccugacauggccagguucucacacuggcccagagaaaagagcc

SEQ ID NO: 415991 - RNA, 63 nt, hsa
ggcugcagaagaugguaaacguagagaagaauugguucucaggugucuguauagauggccuaa

SEQ ID NO: 415992 - RNA, 63 nt, hsa
uuaggaaaacuguuuguaugugguggcuuugaugguucucaugccaucaguuguguggaaaug

SEQ ID NO: 415993 - RNA, 63 nt, hsa
aaaaauaagagcuaguggcuuauaauggugacagguucucauguggcaccccuaggaccugug

SEQ ID NO: 415994 - RNA, 63 nt, hsa
aaaguuucauuuacuuagcuaggagaaagacuugguucucaaaauaauacauuuuaagauuaa

SEQ ID NO: 415995 - RNA, 63 nt, hsa
uuugggaaaagaaggggcugauggcguuaaccagguucucaauauagaacuggauuucuggag

SEQ ID NO: 415996 - RNA, 63 nt, hsa
gcgaucucggcucacugcaagcuccgccucccggguucucaccauucuccugccucagccucc

SEQ ID NO: 415997 - RNA, 63 nt, hsa
uuucuguagcuugaauguaacugcuuuaagaaagguucucaaauguuuugaaaaaaauaaaau

SEQ ID NO: 415998 - RNA, 63 nt, hsa
ggaucuauuuuuggagguuuauuacguaugucugguucucaauuccaacaguuuaaugaagau

SEQ ID NO: 415999 - RNA, 63 nt, hsa
uggaagccuggagagaagguggugacacccauggguucucaacuguaaggaaaaaagacacca

SEQ ID NO: 416000 - RNA, 63 nt, hsa
acaguaggaagaugcaagagccuuuaguaccaagguucucaacacugacuacaugcuggaaug

SEQ ID NO: 416001 - RNA, 63 nt, hsa
uuuauggaauuuuaggggauauuuugagcuuuggguucucaguagugaauugagacuuggagg

SEQ ID NO: 416002 - RNA, 63 nt, hsa
gggucugucuuccuuaucaucgggguggcagcugguucucaaugugccagcagggacucagua

SEQ ID NO: 416003 - RNA, 63 nt, hsa
gauggggcugugcauugaggaccccugcuuccugguucucagucccaccccaaaaccuggcac

SEQ ID NO: 416004 - RNA, 63 nt, hsa
ggguccuuuuuacuguaggugguggaucugccugguucucaauuugacacccuaagcgaucau

SEQ ID NO: 416005 - RNA, 63 nt, hsa
aaaacauaauauaagaaucauagugccauagaugguucucaauuguauaguuauauuugcuga

SEQ ID NO: 416006 - RNA, 63 nt, hsa
gcuggggggugaccugagaggcagagggugacggguucucaggcaguccugauuuuaccugcc

SEQ ID NO: 416007 - RNA, 63 nt, hsa
gaaaucccuaaaacuuccagccucacauagcacgguucucaccugucacuguuuucccaccuc

SEQ ID NO: 416008 - RNA, 63 nt, hsa
caaaaucugacaaguaaaucagcauuguuguuugguucucauaauguauuguuucuuaagaac

SEQ ID NO: 416009 - RNA, 63 nt, hsa
ccccugaagucuaucugcaggauggucuucacagguucucaaagcuggcccagaugcugauac

SEQ ID NO: 416010 - RNA, 63 nt, hsa
aaaaagucacagcuuaucccaggcacccuggcagguucucagagccugccuccucccuguuua

SEQ ID NO: 416011 - RNA, 63 nt, hsa
ccuguagcagcuucaucugugcuuugugcacuugguucucagucaucucugcaagggacccug

SEQ ID NO: 416012 - RNA, 63 nt, hsa
ucaccuaaaaaaagagaauuagauuauauuggugguucucagcaagagaaggaguaugugucc

SEQ ID NO: 416013 - RNA, 63 nt, hsa
caccaugcuccauguucauucggagccaggagggguucucaguggagccuggcuuagggaaca

SEQ ID NO: 416014 - RNA, 63 nt, hsa
uaaagaacuuauaaacuaacgguuuaaagcagugguucucaaaguguggucccuggacuauca

SEQ ID NO: 416015 - RNA, 63 nt, hsa
uuuuauauuuuauacaaauagauugcuuagaaugguucucaagaauuauaagagaaaugaacu

SEQ ID NO: 416016 - RNA, 63 nt, hsa
gauggguuuuaauugcaugaauguggcuaaugugguucucagaaauuggucaguauggcccaa

SEQ ID NO: 416017 - RNA, 63 nt, hsa
uuagccugggaccugacagugacaguggggguggguucucaguccccugcuagagaacccuua

SEQ ID NO: 416018 - RNA, 63 nt, hsa
aaaccuguuguauaacuguagacacucucuaaugguucucaaaggaggaaauguagccuucag

SEQ ID NO: 416019 - RNA, 63 nt, hsa
gucaaaguauuccucauuaaagagagaaucucagguucucacuggaggcacugugcauauuuu

SEQ ID NO: 416020 - RNA, 63 nt, hsa
gaucaaccgugguggggaguggguccaaguaaggguucucauuguugccuuuuaagaggccua

SEQ ID NO: 416021 - RNA, 63 nt, hsa
aaacuccccagugauguaaacguugcuauugaagguucucauguggugaagcccuucauuuaa

SEQ ID NO: 416022 - RNA, 63 nt, hsa
aauaguaaaaauaauacaugaaucccauucacagguucucagcccaagcaacaagguaauugc

SEQ ID NO: 416023 - RNA, 63 nt, hsa
cccagugaacaguuuggauguccucaaagaagugguucucacugccuccuacaaccaggucuu

SEQ ID NO: 416024 - RNA, 63 nt, hsa
aacaaauacuucuacuguuugggugugugauaggguucucaaugcagaucucccuuuucuagu

SEQ ID NO: 416025 - RNA, 50 nt, hsa
aucugucucaggaaggguaagguucucagacacugccgacaucagcauug

SEQ ID NO: 416026 - RNA, 63 nt, hsa
gggggcagucagaacagcuguuccccacuccgugguucucaaaaucauaaaccauggcuacuc

SEQ ID NO: 416027 - RNA, 63 nt, hsa
acacauguaaagaauguggcaaagccuucaauagguucucaacccuuacugugcacaagauaa

SEQ ID NO: 416028 - RNA, 63 nt, hsa
ucuggagagugacgucucccugcugggagugcugguucucacgugcgguuucccuuguguauc

SEQ ID NO: 416029 - RNA, 63 nt, hsa
uagucucuauggcgugucuuuaugguguaauaagguucucacggguucaaucuuuuguguuua

SEQ ID NO: 416030 - RNA, 63 nt, hsa
caugcaggugaauauuuuaauagguuacuauaagguucucaauuaaauucuuuaaucugucca

SEQ ID NO: 416031 - RNA, 63 nt, hsa
aaauggcacgauuucacguuaucagugcaguucgguucucagggggaaagguaagcccauagc

SEQ ID NO: 416032 - RNA, 63 nt, hsa
aacugggaaaacagugaaucuuaugguggaagagguucucagcaaguguacaguauuuaccuu

SEQ ID NO: 416033 - RNA, 63 nt, hsa
ucagguuauauuaucuugggucagagaaugaaugguucucaggcuuuucaaaagagcugguca

SEQ ID NO: 416034 - RNA, 63 nt, hsa
uaggagaggaggguuccucuuaggucagauggagguucucagagccaaguccucccucucuac

SEQ ID NO: 416035 - RNA, 63 nt, hsa
augauuucccuucuguaacucccuagagccacagguucucauuccuuuucccauuauacuucu

SEQ ID NO: 416036 - RNA, 63 nt, hsa
uaaauuaaaauuucaaagcucuuucgagauucagguucucaauaauaauauucaaguuuuaga

SEQ ID NO: 416037 - RNA, 63 nt, hsa
cccacccccacuacagcauugugcuugggucuggguucucaguaauguagccauuugagaaac

SEQ ID NO: 416038 - RNA, 63 nt, hsa
aagguaagaaaagcaauuuaaagucagcgagcagguucucauugauaacaagcuccauacugc

SEQ ID NO: 416039 - RNA, 63 nt, hsa
caggcaaggcgaggugcccgcucagcucagcaagguucucaacugccucgaguacccaccaga

SEQ ID NO: 416040 - RNA, 63 nt, hsa
gaggagcuggaguuacagaaaugauugucucuugguucucaguuuuuagcccuugagaggaca

SEQ ID NO: 416041 - RNA, 63 nt, hsa
augaagggaguaugucuuaaauguaaaguuucugguucucacacuguacucugagguccaaau

SEQ ID NO: 416042 - RNA, 63 nt, hsa
ggauccccagaguugguccaaggagggagaguggguucucaauacgguaccaaagauauaauc

SEQ ID NO: 416043 - RNA, 63 nt, hsa
ucucuggugucagcugcugcuguggccccagcagguucucaaagcucccaaguccucccuacg

SEQ ID NO: 416044 - RNA, 63 nt, hsa
ugauuucuucccccaaauuuaauaaagacagaggguucucaugauucacauugguugugcuau

SEQ ID NO: 416045 - RNA, 63 nt, hsa
uuugaacuucaggacuuguaccaggaggcccuggguucucaggccuuuggcuuuggacugaga

SEQ ID NO: 416046 - RNA, 63 nt, hsa
ugugcacuagccugugauuaacuugcuuaguaugguucucagaucuugacaguauauuugaaa

SEQ ID NO: 416047 - RNA, 63 nt, hsa
aaaaacugaggcguacaacggagcaacaauaucgguucucagugucuauuucaagauacauuu

SEQ ID NO: 416048 - RNA, 63 nt, hsa
ccacgaaggacccacaaaacuaaccuaguucaggguucucaggcaggcaguucugcuucagcu

SEQ ID NO: 416049 - RNA, 63 nt, hsa
cacagucacucuuacacauaugccuaguccagugguucucaaagugugauccauagacuaaua

SEQ ID NO: 416050 - RNA, 63 nt, hsa
aagcauuggaguuaucgauugccauugccccaugguucucacucuuugcaggcacucuucaaa

SEQ ID NO: 416051 - RNA, 63 nt, hsa
acauagauuggauuuggaguugguaguagguaugguucucauaccagaauucucuuaaaaaaa

SEQ ID NO: 416052 - RNA, 63 nt, hsa
uuccagauuugggguauaggucucaucucuucagguucucaugauaccaccuuuacugugcuu

SEQ ID NO: 416053 - RNA, 63 nt, hsa
uggggcagaucacuucaagcaagcccccaugaugguucucaguccugcuucucuguggguacg

SEQ ID NO: 416054 - RNA, 63 nt, hsa
auggcauucaccuucuuggagcucuaggacagugguucucaaaauuuuuuucucucaggaccu

SEQ ID NO: 416055 - RNA, 63 nt, hsa
ccacccccgacuucccguggaaauucccaacucgguucucauggaggaguggguggagacaag

SEQ ID NO: 416056 - RNA, 63 nt, hsa
agucaaggccucugucugaaaugagucgcuccagguucucagcauacacuuccaucgcgucug

SEQ ID NO: 416057 - RNA, 63 nt, hsa
ccaggguagacauggacucuacucuccuucucugguucucagcuguggcuuuuguucuggggc

SEQ ID NO: 416058 - RNA, 63 nt, hsa
gcuuacugggaugucaggaaaugauacaggguugguucucauuucgugccgaaaugagacaga

SEQ ID NO: 416059 - RNA, 63 nt, hsa
agaaauuuccacaaguccuuucauggaucuugagguucucaaaaacagccaaacucaaccuuu

SEQ ID NO: 416060 - RNA, 63 nt, hsa
gauuagcuuuaaaucccuuuucaguucacuguugguucucaucuuugaaagagggcagcauaa

SEQ ID NO: 416061 - RNA, 63 nt, hsa
cugacugcugagucuuccuagaaguaccugcuggguucucaguuccaguucccauccuuugau

SEQ ID NO: 416062 - RNA, 63 nt, hsa
cauuuugucauuaacacagcuauaacuugccgugguucucagauuuauuuuggacuauuuuga

SEQ ID NO: 416063 - RNA, 63 nt, hsa
aauaagcagcaaauaaacaacuauggcuguugagguucucauuuugguuuguuuuaauuuuuu

SEQ ID NO: 416064 - RNA, 63 nt, hsa
ccaaagaccaaguuaucaucucaccacaccacagguucucacuagaugacuguaaguagacac

SEQ ID NO: 416065 - RNA, 63 nt, hsa
gguggugucccugacucugacugcuguuauccugguucucaccaggaggugucgcacugccuc

SEQ ID NO: 416066 - RNA, 63 nt, hsa
aaaaggcaacuuauucaggcagucuggaaaggggguucucagaaaacucaguuucuuuauucc

SEQ ID NO: 416067 - RNA, 63 nt, hsa
uccccacauccgcaccugcuguucccacucugggguucucaaguccaugaacagauauuguug

SEQ ID NO: 416068 - RNA, 59 nt, hsa
guuacauuccaauuuuauaacccaaguaagguucucaaauguagaaaauuauaaauguu

SEQ ID NO: 416069 - RNA, 63 nt, hsa
cuagucuaucagcaucugacaggugaauuggaugguucucagaaccauuucacccagacagcc

SEQ ID NO: 416070 - RNA, 63 nt, hsa
gacagguccucugucuuaaaaagguuacuucuugguucucagcugguucuagucaauucugaa

SEQ ID NO: 416071 - RNA, 63 nt, hsa
uacuuaaaauacuacacagauuuugaguuuuaugguucucaaagcaagguuuccaucuuaaga

SEQ ID NO: 416072 - RNA, 63 nt, hsa
gcaccuucuguucacucccacaaaguggugucugguucucacugagacguuuuaagauuuuuc

SEQ ID NO: 416073 - RNA, 63 nt, hsa
ugcccucuuagguugcauucucuuuaggccacugguucucaaacauuagggugcacuguaacc

SEQ ID NO: 416074 - RNA, 63 nt, hsa
cugucugcuaauggugcuuaaauucucccaagagguucucacuuuuauuugaaggagguguua

SEQ ID NO: 416075 - RNA, 63 nt, hsa
aacuccuuguuagcccuucagauuguuaggagugguucucauuuggucugccagaauacuggg

SEQ ID NO: 416076 - RNA, 63 nt, hsa
caucugcgacuagagagcacccggcccacguuggguucucagugcuuucuacugcacagagug

SEQ ID NO: 416077 - RNA, 63 nt, hsa
cccuguucuugaggucucuuuucucuacuccaugguucucaauuuauuuggggggaaauaccu

SEQ ID NO: 416078 - RNA, 63 nt, hsa
cagggacuugcugcaggcuggggggcacugggugguucucaccagcaggcugcggggcacugu

SEQ ID NO: 416079 - RNA, 63 nt, hsa
cuggccauuugccaauuuuccuacucucacacugguucucaaugaaaaauagugucuuuguga

SEQ ID NO: 416080 - RNA, 63 nt, hsa
uauagauguauauacaggguggggggagugggcgguucucauuaaacgucaccauuucaugag

SEQ ID NO: 416081 - RNA, 63 nt, hsa
uucuaucuguuccucuuagcccccaaacucccagguucucacuuccuucuucuggaguuuaac

SEQ ID NO: 416082 - RNA, 63 nt, hsa
agcagagacaacggaggaggcucccaccaggacgguucucauuauuuauauguuaauauguuu

SEQ ID NO: 416083 - RNA, 63 nt, hsa
augugaagcuauuugauaugcaccaggucucaagguucucauuucucaggugacgugauucua

SEQ ID NO: 416084 - RNA, 63 nt, hsa
agguuaucgcaagaugucuuagaguaggguuaagguucucagugacacaagaauucaguauua

SEQ ID NO: 416085 - RNA, 63 nt, hsa
aagaagcuggaauuucuugcacacuuuauccuggguucucaaccucuuuggaaucuucuucau

SEQ ID NO: 416086 - RNA, 63 nt, hsa
gguggaauuagaguggaauaaggauguuaacuugguucucagacucuuucuucacuacguguu

SEQ ID NO: 416087 - RNA, 63 nt, hsa
aaaacaugcagaaagcacagaaaggaaaaccaagguucucaugaaucuccaacuuuaaauccu

SEQ ID NO: 416088 - RNA, 63 nt, hsa
acaaucuagucagaauagcaguucuagagcacagguucucagucuaagcuauggaaaagcucc

SEQ ID NO: 416089 - RNA, 63 nt, hsa
uauguuuuuuccagagcauuaaagcuuucauaagguucucaaaggucucagaccuacaaagag

SEQ ID NO: 416090 - RNA, 63 nt, hsa
cgggcagaguccuugggacaccagccucucugggguucucaggccaucccguuggggcugucg

SEQ ID NO: 416091 - RNA, 63 nt, hsa
gcuuggaaaggaccaguaugcuuggacugaagggguucucacagugggagccagggcugucuu

SEQ ID NO: 416092 - RNA, 63 nt, hsa
gggcucugauucugcccaaugaguauccccauagguucucaaaaacaugaacaagucuguaaa

SEQ ID NO: 416093 - RNA, 63 nt, hsa
uucaugcuuggcuggcgucugcccuagggcugggguucucaagccccuggcccuggcccagag

SEQ ID NO: 416094 - RNA, 63 nt, hsa
uacugacuuguacuauauuggcugccaugauaggguucucacagcgucauccaugaucguaag

SEQ ID NO: 416095 - RNA, 63 nt, hsa
cagacagccuaguugauuaucuagcauacuuaggguucucauuuuguaguuucuucccucuuu

SEQ ID NO: 416096 - RNA, 63 nt, hsa
uuaugugaaacucuuccauucagauuccagagagguucucaugcuccccccccuccuuauuug

SEQ ID NO: 416097 - RNA, 63 nt, hsa
agaugaucuacucagaaauuuuuauuuuucuaagguucucauaggaaaaguacauuuaauaca

SEQ ID NO: 416098 - RNA, 63 nt, hsa
acuugaaagaaaaaucaucugugaguuccuucagguucucacucauagucaugauccuucaga

SEQ ID NO: 416099 - RNA, 63 nt, hsa
agcagggcccagaggagacccaucaacucaucugguucucaccaaagccccuagcuagaggca

SEQ ID NO: 416100 - RNA, 63 nt, hsa
agauuugauuaauauuguauuaaucucauggaugguucucaaagguaaaaaaagagagagaaa

SEQ ID NO: 416101 - RNA, 63 nt, hsa
uagaaaaguaucccuuuuuuuuuuuuugagacggguucucacuauguugcccagggcuggucu

SEQ ID NO: 416102 - RNA, 63 nt, hsa
cagccccaggcuccagggccacggcggagucaugguucucaggacugagcgcuuguuuagguc

SEQ ID NO: 416103 - RNA, 63 nt, hsa
uccuugagcccuugccccugcgucccgcgucuggguucucagcuauuuccagagccagcucaa

SEQ ID NO: 416104 - RNA, 63 nt, hsa
uaagagcaagugucccaugaaugugauuuccuggguucucacugucuuugcaccacgucuagg

SEQ ID NO: 416105 - RNA, 63 nt, hsa
cuuuuagcugggaaaguauagcaugaaaccagagguucucagaaugacuguaagauagcuuac

SEQ ID NO: 416106 - RNA, 63 nt, hsa
ccuuaccuugugggcuugggaaacacgacucgugguucucaaauuuagcaccuuacagacagu

SEQ ID NO: 416107 - RNA, 63 nt, hsa
ucuauuggucugaagguuucugaaccucuuucugguucucagcagaaguaacugaaguagauc

SEQ ID NO: 416108 - RNA, 63 nt, hsa
agagcuuccaucaucaugaagaaaaaaaaauuugguucucaagugaacaaacauauaaaaugu

SEQ ID NO: 416109 - RNA, 63 nt, hsa
gugaaaaccaugcugcuuauucccuaauacaaugguucucaaacuuuaguguguaucagaauc

SEQ ID NO: 416110 - RNA, 63 nt, hsa
ggcuuaucaugugcuugguaaaaggugaucgcagguucucagacgaguuuacuuuacaugaga

SEQ ID NO: 416111 - RNA, 63 nt, hsa
uuuuauuuuuugucucuuuuaagaugguaaaaugguucucagggauuccugccaauacuuuga

SEQ ID NO: 416112 - RNA, 63 nt, hsa
ugggauugguauugcugugugcuuccagccacagguucucacacucaauuccaaagccuuccu

SEQ ID NO: 416113 - RNA, 63 nt, hsa
gaguaaggauaaaauucuuucuacuaaagcacugguucucaaacuuuuuggucucagacccca

SEQ ID NO: 416114 - RNA, 63 nt, hsa
ggacuucaaaaacugucaaagaaucaauccagcgguucucaaacgguacacagacuauugaca

SEQ ID NO: 416115 - RNA, 63 nt, hsa
cagaaucagaaguuaauuuuuaaguguuuguaagguucucaaguacugugacauguauuuuuu

SEQ ID NO: 416116 - RNA, 63 nt, hsa
ucagagggauauaagagccagcauccaucccuggguucucaguaggaaugcuggugcugucua

SEQ ID NO: 416117 - RNA, 63 nt, hsa
agcauggacaucauggccucucaggucccuuuugguucucaguuucauugguuccucuuucug

SEQ ID NO: 416118 - RNA, 63 nt, hsa
cuuucucaauauuaacuggaaugcugccucuuggguucucaccugcauggaugcuuugaguug

SEQ ID NO: 416119 - RNA, 63 nt, hsa
agaaucugagacucuuuggagccaggcuuucucgguucucagaggaaaaguaugaaugagugu

SEQ ID NO: 416120 - RNA, 63 nt, hsa
cagauuaaaaacuuuauagggacuugcauuaucgguucucaauaaauuacugagcagcuuugu

SEQ ID NO: 416121 - RNA, 63 nt, hsa
agcuccuuucucaagcuacaaaguggugaacaugguucucaacuccuuaauuuauacucucuc

SEQ ID NO: 416122 - RNA, 63 nt, hsa
aauagauauuaaucuugacucaucuagcucagugguucucaucaagggucaauuugauuguca

SEQ ID NO: 416123 - RNA, 61 nt, hsa
agcgauucugauuuuguuuuauauggguucucugguucucaaaaaaaaaaaaaaucuauug

SEQ ID NO: 416124 - RNA, 63 nt, hsa
caugcuuuggagccagucugguggcuccuguaagguucucaaggcugguggcagcucagucug

SEQ ID NO: 416125 - RNA, 63 nt, hsa
acuaacugaauugaaaccuauuacaauuaauaggguucucaaaggccuauuccuauuagaaga

SEQ ID NO: 416126 - RNA, 63 nt, hsa
gaagggaaaaaaaauguagcgacagcauuuuaagguucucagaccuccagugaguaccugcaa

SEQ ID NO: 416127 - RNA, 63 nt, hsa
uuucucuagacauucaucugaaaaucauuuuaugguucucaauccccauguagcuuugcauag

SEQ ID NO: 416128 - RNA, 63 nt, hsa
agaaggcacaucccuuuggaauggaagcuuagggguucucaggugauagggagagguggcugu

SEQ ID NO: 416129 - RNA, 63 nt, hsa
cagcugcccccuccccgcccccguguugagacagguucucaaggcucaggggaagaugcauac

SEQ ID NO: 416130 - RNA, 63 nt, hsa
uguauuacaacaaucuggagauacuaaaucugggguucucagguucacucauugacaugauau

SEQ ID NO: 416131 - RNA, 63 nt, hsa
ugcacuuuacugaaauagaugaacauuucaguagguucucaacuuaaaauuaagccuaaccua

SEQ ID NO: 416132 - RNA, 63 nt, hsa
cagcccccucuccgaguccuucacaauuccuuagguucucaggguuagaaacagucuugcgag

SEQ ID NO: 416133 - RNA, 63 nt, hsa
ugcucuguagcagaaacugagcuccggguggcugguucucagugguugucucaugucucuuuu

SEQ ID NO: 416134 - RNA, 63 nt, hsa
uccgaucucacagccugucaugcugcucagugugguucucaccccugcaagcucaaauucagu

SEQ ID NO: 416135 - RNA, 63 nt, hsa
gaaucuauagcagcauugucaguacagaccagugguucucaaacuuuaaaaugccucagcauc

SEQ ID NO: 416136 - RNA, 63 nt, hsa
gaacauuucauucuugaacgcagcaucugacaugguucucagcaaguuggaauaguaaggauu

SEQ ID NO: 416137 - RNA, 63 nt, hsa
ccggccuuuuccuucagguucgucaggcucaccgguucucacugugucugggaaguaggacug

SEQ ID NO: 416138 - RNA, 63 nt, hsa
uuuacugguugaugauagauuuuauaaccuaacgguucucaugcggugcguaauuguagaugc

SEQ ID NO: 416139 - RNA, 63 nt, hsa
ccuuucugcccagccugcucagcagguugaauggguucucaguggucaccuuccucagcucag

SEQ ID NO: 416140 - RNA, 63 nt, hsa
gauucccuugcugccuacccuuuucucuccucugguucucaaccucaacgaguucaaaucagu

SEQ ID NO: 416141 - RNA, 63 nt, hsa
cugcagcaguacuacugucaacauaguguaaaugguucucaaaagcuuaccaguguggacuug

SEQ ID NO: 416142 - RNA, 63 nt, hsa
gagcuccccuuugcugacagaacugcuggauuugguucucauugguccagacgaggaagguau

SEQ ID NO: 416143 - RNA, 63 nt, hsa
gcacuuugaauaggcuuuccauuuuguuuuggagguucucacuuugaaccuucuuguuuacag

SEQ ID NO: 416144 - RNA, 63 nt, hsa
guuuuucuauuccugucccaaaucaaagagcaugguucucaggaaaaccaguuccccaguuua

SEQ ID NO: 416145 - RNA, 63 nt, hsa
uaugugagcgacaaaaaaggucugcuuuauagggguucucacucuagcuuggggagccagggu

SEQ ID NO: 416146 - RNA, 63 nt, hsa
ccugggaggacucucuuaguucuuaccuuuugugguucucaauaaaacagaacuuaaaaaauu

SEQ ID NO: 416147 - RNA, 63 nt, hsa
augcagaucaaccuguggcuguuuucccgucuagguucucacagguaucuccugacagaggua

SEQ ID NO: 416148 - RNA, 63 nt, hsa
aucauaaaagcaaagucagccagcugauauuuugguucucaaaaacugcauuauuaauaauau

SEQ ID NO: 416149 - RNA, 63 nt, hsa
auccuuacugucccuggaaagauauagcauagugguucucagcacagucuccagaacagaagc

SEQ ID NO: 416150 - RNA, 63 nt, hsa
agcuuucuaccauccagguacaugcccaggccugguucucaccccuguuggagucagcuuuca

SEQ ID NO: 416151 - RNA, 63 nt, hsa
ggccccaggaguggagccuggccacuccuguuugguucucacugggaggcccacuggccuugg

SEQ ID NO: 416152 - RNA, 63 nt, hsa
gcgugccaagugaccuggugccugugggaaguggguucucaggacuggcauucuuggaauaaa

SEQ ID NO: 416153 - RNA, 63 nt, hsa
auaaaauuaugauaguuuguuuuaauagccagggguucucaauggaaaaacgaaugcucuuac

SEQ ID NO: 416154 - RNA, 63 nt, hsa
cugucccgggguugccugaggcagagcaagacggguucucaccccugacuucuggaggcuucc

SEQ ID NO: 416155 - RNA, 63 nt, hsa
uguugagauggaugcuugaggaauauugcugcugguucucauaauuucuagaguaaaugaggg

SEQ ID NO: 416156 - RNA, 63 nt, hsa
uggaccuuagagccauuguccacaaucacggaugguucucaagaguugauuguaagaaauuuc

SEQ ID NO: 416157 - RNA, 63 nt, hsa
cccaaauuaucaaaccauuaagaacucauuacugguucucagccuccuccaguacuagccuca

SEQ ID NO: 416158 - RNA, 63 nt, hsa
uucuguagcuacugugaacccaaucuuaaaggagguucucaugcccaggguccacagugacca

SEQ ID NO: 416159 - RNA, 63 nt, hsa
guaucuugugcuucuucacuuacccauuagccagguucucauuagguuuugcuugggccuccc

SEQ ID NO: 416160 - RNA, 63 nt, hsa
gacaggaaacccaagccuaagaaacaauuaagugguucucaucucuaauuaacugugaaacca

SEQ ID NO: 416161 - RNA, 63 nt, hsa
cuccccuucucauccuccccacccccccgccaagguucucacacuggccugggcuugggugcc

SEQ ID NO: 416162 - RNA, 63 nt, hsa
agccuuggcucuacccugaguucauaaauuuaugguucucaggccugacucucagcagcuaug

SEQ ID NO: 416163 - RNA, 63 nt, hsa
agagcuaauccucuaaguucucuguacucaguugguucucaguuagcuggucaaguggagugu

SEQ ID NO: 416164 - RNA, 63 nt, hsa
ggauaguguuuaacaagccagcuggcuuaugcugguucucagcuguuuaaaaaaaaaaaaaaa

SEQ ID NO: 416165 - RNA, 63 nt, hsa
gcaggccugaaggaugaugguuuuguccucuuugguucucaccugcuugagaaguaaaacagu

SEQ ID NO: 416166 - RNA, 63 nt, hsa
uguaguugcaaaaacaacucuguaauuuguugagguucucaaacugacagccagcgagacugg

SEQ ID NO: 416167 - RNA, 63 nt, hsa
gccacagaaaccacgauggcaaaaaaucucauugguucucaaggacuaaccugugggggaaag

SEQ ID NO: 416168 - RNA, 63 nt, hsa
cagcuucggugugcagaucauccgucugugugggguucucagugccggaggccuugggguggg

SEQ ID NO: 416169 - RNA, 63 nt, hsa
cucucgcauguaugaauaucuaguccuuucugugguucucagccaagacauaaaaacuaggac

SEQ ID NO: 416170 - RNA, 63 nt, hsa
ggcugaaaucuagaacuucaucccgggcaaugagguucucacagaaggugcaguuuuauaacu

SEQ ID NO: 416171 - RNA, 63 nt, hsa
cuucauuucuucaccgcgguuccucgucauagggguucucacucugaacuuucccucucuacu

SEQ ID NO: 416172 - RNA, 63 nt, hsa
caaggugcagcgggcuucacagcccuacaauuggguucucagcuaagccccagaguucuggua

SEQ ID NO: 416173 - RNA, 63 nt, hsa
ggggcaggaaagcggcugggcucuuggacaccugguucucagagaacccugugaugaucaccc

SEQ ID NO: 416174 - RNA, 63 nt, hsa
ccccgccgccaaagucugcagaaugugagaugagguucucaaggucacaggccccagucccag

SEQ ID NO: 416175 - RNA, 63 nt, hsa
uucuguuuggacuggguucucaagacacgaccagguucucaagacacgaguccccuuguuccu

SEQ ID NO: 416176 - RNA, 63 nt, hsa
ucccaguccagaggccugauucuguuuggacuggguucucaagacacgaccagguucucaaga

SEQ ID NO: 416177 - RNA, 63 nt, hsa
gccccuuacccacucucucccuguggcuggucugguucucauguaaacccacuccuugcuuug

SEQ ID NO: 416178 - RNA, 63 nt, hsa
aaguguguggggaaggagaggacugguuuccuggguucucaggggccaggaggaguaacagaa

SEQ ID NO: 416179 - RNA, 63 nt, hsa
agccaaggaccaaagaagguguguaagugaagugguucucaguccccagacaugugccccuuu

SEQ ID NO: 416180 - RNA, 63 nt, hsa
ccgcccagcacccccaggcccugggggaccugggguucucagacugccaaagaagccuugcca

SEQ ID NO: 416181 - RNA, 63 nt, hsa
uggagccuguccagcuggcccgggcccuggccugguucucaaguguuuccuagacagagaggc

SEQ ID NO: 416182 - RNA, 63 nt, hsa
agcugcacaggccagggcgcaggcacaucuguugguucucaggccucagauaaaaccaucucc

SEQ ID NO: 416183 - RNA, 63 nt, hsa
ggccugguaucuugcucgggcccuagcuguugggguucucauggguugcacugaccauacugc

SEQ ID NO: 416184 - RNA, 63 nt, hsa
uuuauuaaacuuucuauuugggucuuaacccaugguucucagcuggggugacacugcuccucu

SEQ ID NO: 416185 - RNA, 63 nt, hsa
uuggagcaucaggccuccgaccuuucuugccucgguucucauuacacuuucacccauagcaga

SEQ ID NO: 416186 - RNA, 63 nt, hsa
uuuuguugauccgugagcccaguuuuggugcuggguucucacauccaaguguuccuggguucc

SEQ ID NO: 416187 - RNA, 63 nt, hsa
aaauauugggcuguuucccucuuccugugaagugguucucaaauuccuauguacuguaaagcu

SEQ ID NO: 416188 - RNA, 63 nt, hsa
uuggaccugucaguuaaacucuaagguggacaggguucucaguacuaagcaaggagacagaau

SEQ ID NO: 416189 - RNA, 63 nt, hsa
gaaaacuuagggucuaaguuguucuaaacccaggguucucaaauguguuguacaaaaaguuuc

SEQ ID NO: 416190 - RNA, 63 nt, hsa
uguuugcuguguuauauguuagcuccgaacaaugguucucauuuggcuaagcaucaaaaucac

SEQ ID NO: 416191 - RNA, 63 nt, hsa
gaaaaacuuggccgacccuuggucuacagcacggguucucagucgggcgacgauuuggcuguc

SEQ ID NO: 416192 - RNA, 63 nt, hsa
gccaucuggaggcucaguggaguggggaguugggguucucauaccagcagauuucccuagagc

SEQ ID NO: 416193 - RNA, 63 nt, hsa
ccauuggccauugccuggcuaaugagaaccccugguucucagaauuuuaaccaaaaggaguug

SEQ ID NO: 416194 - RNA, 63 nt, hsa
uuuaucuuugauucuccuucagcccucaccccugguucucaucuuucuugaucaacaucuuuu

SEQ ID NO: 416195 - RNA, 63 nt, hsa
ugcagccccuugggacuugaggggggccccagggguucucaggaccccucccaccaccuccca

SEQ ID NO: 416196 - RNA, 63 nt, hsa
guacagaggccugcccugccuggccgggcaggagguucucacuguugugaagguuguagacgu

SEQ ID NO: 416197 - RNA, 59 nt, hsa
ucaccagcaugucccucugacaugcccaggguucucauccacagcagcugggucaccug

SEQ ID NO: 416198 - RNA, 63 nt, hsa
gcccccuccuccuucucucaggauuucucuugggguucucaauacuugguuaccucauuaucc

SEQ ID NO: 416199 - RNA, 63 nt, hsa
gggguuggucccauggguuaagagcucaccccagguucucaccucagggguuaagagcucaga

SEQ ID NO: 416200 - RNA, 63 nt, hsa
ggccgaccuacuauuuuuauuauuuuugagcuagguucucagucuguuggcagacuggagugc

SEQ ID NO: 416201 - RNA, 63 nt, hsa
cuguguugaaggcaucuuucaagcccucgcucugguucucagggcagcauuuuccaggcgggu

SEQ ID NO: 416202 - RNA, 63 nt, hsa
gauacccagggacaguagggcucccagguggcugguucucagcacaccuuccaugaaucugcu

SEQ ID NO: 416203 - RNA, 63 nt, hsa
gaucaguguuuauaucagaguaccaggugucccgguucucaagauguaacacagcagaaaagu

SEQ ID NO: 416204 - RNA, 63 nt, hsa
uuucccuugcucuggucuccacguguaugaugggguucucaggcccaggcuucgaccagagga

SEQ ID NO: 416205 - RNA, 63 nt, hsa
ugauugguugccacauguuauguuuguugaagugguucucaugcaaaaauauuacacauuugu

SEQ ID NO: 416206 - RNA, 63 nt, hsa
caggcgcuuggacccggcccaagauuugacuccgguucucaccccgcccucuccugggguggu

SEQ ID NO: 416207 - RNA, 63 nt, hsa
cucagaggagcucacgcagggcaggaauagccagguucucauaucccagggguucagacuuug

SEQ ID NO: 416208 - RNA, 63 nt, hsa
acuucugcuuugcacuauguucacuuugggguugguucucagccauccaagggucuccaguga

SEQ ID NO: 416209 - RNA, 63 nt, hsa
gacugcacccuugguggcugcuggaaggggagagguucucagcaucaggccaccuccacccca

SEQ ID NO: 416210 - RNA, 63 nt, hsa
ucugggaaagagcccugcaucuuucauuaauucgguucucagagaaccaaggcuggaaggcau

SEQ ID NO: 416211 - RNA, 63 nt, hsa
ucaaugcaguaaauauuuacuugcaggcaacuggguucucaucucuugauuugcuuuuguaau

SEQ ID NO: 416212 - RNA, 63 nt, hsa
cagccagagccccaggucagaagugcagaccaggguucucagcacagugcccgucgugcuucc

SEQ ID NO: 416213 - RNA, 63 nt, hsa
agcucaaagucuccaguggaagcucauggacaagguucucagggaaguuuuggaguuugcaac

SEQ ID NO: 416214 - RNA, 63 nt, hsa
uugagacugaccguaaaccacagacgcucuccagguucucaagaguuauccugccuuccagau

SEQ ID NO: 416215 - RNA, 63 nt, hsa
gggugggaaaggcuuuaucagguaucaucaacagguucucaauuaaagauuugauuuauucaa

SEQ ID NO: 416216 - RNA, 63 nt, hsa
ugcccaccaccaagcaagcagcaagcaagaugggguucucaucaguucuuccucccacaaugu

SEQ ID NO: 416217 - RNA, 63 nt, hsa
gaggcccucuuuuccaguaggaaguuagauggggguucucagaaguggcugauuggaagggga

SEQ ID NO: 416218 - RNA, 63 nt, hsa
cguuugcacaccuuucuuucccauuagaaaccggguucucaauuuggucuucuuuuguuguua

SEQ ID NO: 416219 - RNA, 63 nt, hsa
ccaucaucugccucggggacuuccucucuccgugguucucaccccauacucugucacugccac

SEQ ID NO: 416220 - RNA, 63 nt, hsa
cugcuucagggccaggcagagagugaggcuggggguucucacaccuuacuccaccgggcacau

SEQ ID NO: 416221 - RNA, 63 nt, hsa
gcucccucuggccugguggaucaccaagagggcgguucucauuuuguuauuaguggaagagcc

SEQ ID NO: 416222 - RNA, 58 nt, hsa
aacugaccucgaccuccugaucugaccugguucucaacagacccagugagcccuucac

SEQ ID NO: 416223 - RNA, 63 nt, hsa
cugcuucaggaccaggcagagagugaggcuggggguucucacaccuuacuccaccgggcacau

SEQ ID NO: 416224 - RNA, 63 nt, hsa
cagagcuuuugagcucacaggugacaggcucaggguucucauccuggccccaccagggccuug

SEQ ID NO: 416225 - RNA, 63 nt, hsa
augugugcuugugaugauacacacacaugcacagguucucaaccacguguguauauauguaug

SEQ ID NO: 416226 - RNA, 63 nt, hsa
uugcugggagggggcuguguugugagcccucccgguucucaccucgccuggcacuuaaccaca

SEQ ID NO: 416227 - RNA, 63 nt, hsa
agggugguuauugcuauauguguuacagaccucgguucucauuaaaguauuuauuggcagaau

SEQ ID NO: 416228 - RNA, 63 nt, hsa
acucuuugaaacuauucuuugagucaauuuuaugguucucagaagccaaaauacacaacuuuu

SEQ ID NO: 416229 - RNA, 63 nt, hsa
ucaguuuuaccauuguuagcaaaaaaguuaucugguucucaaagcaauaaagguguccauuug

SEQ ID NO: 416230 - RNA, 63 nt, hsa
ucgagacuuacauaugaaacacuggcuuuacaggguucucagagaugugggguauacacuguc

SEQ ID NO: 416231 - RNA, 63 nt, hsa
cccaguauuuccccuccuuguacuuuugccuuagguucucaagggacaauagucuucauguug

SEQ ID NO: 416232 - RNA, 63 nt, hsa
cucuagaucccuggggccucacccuguauuugagguucucaccacccucagcagggagaaggg

SEQ ID NO: 416233 - RNA, 63 nt, hsa
cauugccauucuuauggccacaagcaaaguaaugguucucauagugguauaaaguucacacag

SEQ ID NO: 416234 - RNA, 64 nt, hsa
ugacagaugguagagacuuccauagaauuaagaggguucucauggaggggauaggaaguagguu

SEQ ID NO: 416235 - RNA, 64 nt, hsa
cagaagguuucaggggcauuugacauccccuccugguucucaccaggaaaacauccaaagcuuu

SEQ ID NO: 416236 - RNA, 64 nt, hsa
uuacagucaccagugugugaagacucuugagucugguucucauaucagagucaucauuuuucuu

SEQ ID NO: 416237 - RNA, 64 nt, hsa
cuggaaguguccaugccucaccugcaacccaugugguucucagacuugaaucuucucggccccc

SEQ ID NO: 416238 - RNA, 64 nt, hsa
aaaccagaaauacagaauaauucauagaaaucaugguucucaaguauuuguucaauuagcuuug

SEQ ID NO: 416239 - RNA, 64 nt, hsa
aaagauuuauauucaaauguuuuuauuaaaguaagguucucauuuagcagacaucgcaacaagu

SEQ ID NO: 416240 - RNA, 64 nt, hsa
ucagacuggcuggauucagaucaguguguuggcugguucucauuuuaagggguaagcaguuugc

SEQ ID NO: 416241 - RNA, 64 nt, hsa
guaaaguuccuuuuuaauguucuaaaguguuuacgguucucaaauaucaguuaaaaacuaauuu

SEQ ID NO: 416242 - RNA, 64 nt, hsa
uuugaaggcuauuuuaccauuccuguucacaaaagguucucauggugccugacagguuacccuu

SEQ ID NO: 416243 - RNA, 64 nt, hsa
ugaaucucuuuuaaacuauuauaugauucauaaugguucucaggaauuaauaaaugauuacugu

SEQ ID NO: 416244 - RNA, 64 nt, hsa
uccuuaagccugcgaggcccaggccuguggggcugguucucaccuuugacagcugaauguuccu

SEQ ID NO: 416245 - RNA, 64 nt, hsa
guucccaugcuuuuuguuagagcuuauuaguacagguucucaagagaugaccacauaaaagugc

SEQ ID NO: 416246 - RNA, 64 nt, hsa
guuaacaucuuuuaauuguuuccaggauugagcagguucucagcugggcucugauaucccgugc

SEQ ID NO: 416247 - RNA, 64 nt, hsa
gucaugguucagcagagguuacauaggagcaaaugguucucaauuuuccaguuugauugaagug

SEQ ID NO: 416248 - RNA, 64 nt, hsa
guaacgcgucuuccugaguggugccaaacaaaaagguucucagguguugccaaauauguccugg

SEQ ID NO: 416249 - RNA, 64 nt, hsa
uugccuuuuuuuuuuuuuuuuuuuuuuugagauggguucucacuauauuguccaggcuagagug

SEQ ID NO: 416250 - RNA, 64 nt, hsa
cugggggagauccuucauguugaggguuuugcuggguucucaggcuagugggggcauuaggaac

SEQ ID NO: 416251 - RNA, 64 nt, hsa
gguuagcuucacagcaacagggagcuaggccauugguucucaaacuuaaggaaggaucagcauc

SEQ ID NO: 416252 - RNA, 64 nt, hsa
aaucacuccacacacccaaagccucuggacuucugguucucaggagucugccuaccugucgccc

SEQ ID NO: 416253 - RNA, 64 nt, hsa
aucuucaaucuuaaacauuucuauuuagcugauugguucucacauauacuucuaaaagaaacuu

SEQ ID NO: 416254 - RNA, 64 nt, hsa
uccagcuccugcaucgagucuguaaaccagagcugguucucauggccuucgucacgauaccagg

SEQ ID NO: 416255 - RNA, 64 nt, hsa
aucccuuggagucucacaagguuuacuuugguaugguucucagcacaaaccuuucaaguauguu

SEQ ID NO: 416256 - RNA, 64 nt, hsa
uuacucauugugcugcuuagccuucccaggagucgguucucaauuaggcuguugggaauccgcc

SEQ ID NO: 416257 - RNA, 64 nt, hsa
ugggcagaagucuuggggaggaaugggcaaaggagguucucagucaauaaaaccaaaguucuuu

SEQ ID NO: 416258 - RNA, 64 nt, hsa
gggacgagcacugguuuaggagucaagauaucuggguucucacucuacucagucccagcagagc

SEQ ID NO: 416259 - RNA, 64 nt, hsa
ucuuggcacccacauccagggcagagaggucugugguucucagcaucagaaggcagcgcagccc

SEQ ID NO: 416260 - RNA, 64 nt, hsa
aaccaaauuguggucaauggaaauaggagaauaugguucucacucuugagaaaaaaaccuaaga

SEQ ID NO: 416261 - RNA, 64 nt, hsa
guauuugugauuuugucacagccugacauggccagguucucacacuggcccagagaaaagagcc

SEQ ID NO: 416262 - RNA, 64 nt, hsa
uggcugcagaagaugguaaacguagagaagaauugguucucaggugucuguauagauggccuaa

SEQ ID NO: 416263 - RNA, 64 nt, hsa
uuuaggaaaacuguuuguaugugguggcuuugaugguucucaugccaucaguuguguggaaaug

SEQ ID NO: 416264 - RNA, 64 nt, hsa
gaaaaauaagagcuaguggcuuauaauggugacagguucucauguggcaccccuaggaccugug

SEQ ID NO: 416265 - RNA, 64 nt, hsa
uaaaguuucauuuacuuagcuaggagaaagacuugguucucaaaauaauacauuuuaagauuaa

SEQ ID NO: 416266 - RNA, 64 nt, hsa
auuugggaaaagaaggggcugauggcguuaaccagguucucaauauagaacuggauuucuggag

SEQ ID NO: 416267 - RNA, 64 nt, hsa
ugcgaucucggcucacugcaagcuccgccucccggguucucaccauucuccugccucagccucc

SEQ ID NO: 416268 - RNA, 64 nt, hsa
auuucuguagcuugaauguaacugcuuuaagaaagguucucaaauguuuugaaaaaaauaaaau

SEQ ID NO: 416269 - RNA, 64 nt, hsa
aggaucuauuuuuggagguuuauuacguaugucugguucucaauuccaacaguuuaaugaagau

SEQ ID NO: 416270 - RNA, 64 nt, hsa
cuggaagccuggagagaagguggugacacccauggguucucaacuguaaggaaaaaagacacca

SEQ ID NO: 416271 - RNA, 64 nt, hsa
gacaguaggaagaugcaagagccuuuaguaccaagguucucaacacugacuacaugcuggaaug

SEQ ID NO: 416272 - RNA, 64 nt, hsa
uuuuauggaauuuuaggggauauuuugagcuuuggguucucaguagugaauugagacuuggagg

SEQ ID NO: 416273 - RNA, 64 nt, hsa
cgggucugucuuccuuaucaucgggguggcagcugguucucaaugugccagcagggacucagua

SEQ ID NO: 416274 - RNA, 64 nt, hsa
ugauggggcugugcauugaggaccccugcuuccugguucucagucccaccccaaaaccuggcac

SEQ ID NO: 416275 - RNA, 64 nt, hsa
aggguccuuuuuacuguaggugguggaucugccugguucucaauuugacacccuaagcgaucau

SEQ ID NO: 416276 - RNA, 64 nt, hsa
gaaaacauaauauaagaaucauagugccauagaugguucucaauuguauaguuauauuugcuga

SEQ ID NO: 416277 - RNA, 64 nt, hsa
agcuggggggugaccugagaggcagagggugacggguucucaggcaguccugauuuuaccugcc

SEQ ID NO: 416278 - RNA, 64 nt, hsa
ggaaaucccuaaaacuuccagccucacauagcacgguucucaccugucacuguuuucccaccuc

SEQ ID NO: 416279 - RNA, 64 nt, hsa
ucaaaaucugacaaguaaaucagcauuguuguuugguucucauaauguauuguuucuuaagaac

SEQ ID NO: 416280 - RNA, 64 nt, hsa
gccccugaagucuaucugcaggauggucuucacagguucucaaagcuggcccagaugcugauac

SEQ ID NO: 416281 - RNA, 64 nt, hsa
caaaaagucacagcuuaucccaggcacccuggcagguucucagagccugccuccucccuguuua

SEQ ID NO: 416282 - RNA, 64 nt, hsa
gccuguagcagcuucaucugugcuuugugcacuugguucucagucaucucugcaagggacccug

SEQ ID NO: 416283 - RNA, 64 nt, hsa
cucaccuaaaaaaagagaauuagauuauauuggugguucucagcaagagaaggaguaugugucc

SEQ ID NO: 416284 - RNA, 64 nt, hsa
acaccaugcuccauguucauucggagccaggagggguucucaguggagccuggcuuagggaaca

SEQ ID NO: 416285 - RNA, 64 nt, hsa
uuaaagaacuuauaaacuaacgguuuaaagcagugguucucaaaguguggucccuggacuauca

SEQ ID NO: 416286 - RNA, 64 nt, hsa
auuuuauauuuuauacaaauagauugcuuagaaugguucucaagaauuauaagagaaaugaacu

SEQ ID NO: 416287 - RNA, 64 nt, hsa
agauggguuuuaauugcaugaauguggcuaaugugguucucagaaauuggucaguauggcccaa

SEQ ID NO: 416288 - RNA, 64 nt, hsa
auuagccugggaccugacagugacaguggggguggguucucaguccccugcuagagaacccuua

SEQ ID NO: 416289 - RNA, 64 nt, hsa
gaaaccuguuguauaacuguagacacucucuaaugguucucaaaggaggaaauguagccuucag

SEQ ID NO: 416290 - RNA, 64 nt, hsa
agucaaaguauuccucauuaaagagagaaucucagguucucacuggaggcacugugcauauuuu

SEQ ID NO: 416291 - RNA, 64 nt, hsa
agaucaaccgugguggggaguggguccaaguaaggguucucauuguugccuuuuaagaggccua

SEQ ID NO: 416292 - RNA, 64 nt, hsa
uaaacuccccagugauguaaacguugcuauugaagguucucauguggugaagcccuucauuuaa

SEQ ID NO: 416293 - RNA, 64 nt, hsa
uaauaguaaaaauaauacaugaaucccauucacagguucucagcccaagcaacaagguaauugc

SEQ ID NO: 416294 - RNA, 64 nt, hsa
ucccagugaacaguuuggauguccucaaagaagugguucucacugccuccuacaaccaggucuu

SEQ ID NO: 416295 - RNA, 64 nt, hsa
aaacaaauacuucuacuguuugggugugugauaggguucucaaugcagaucucccuuuucuagu

SEQ ID NO: 416296 - RNA, 50 nt, hsa; identical to SEQ ID NO: 416025

SEQ ID NO: 416297 - RNA, 64 nt, hsa
ggggggcagucagaacagcuguuccccacuccgugguucucaaaaucauaaaccauggcuacuc

SEQ ID NO: 416298 - RNA, 64 nt, hsa
uacacauguaaagaauguggcaaagccuucaauagguucucaacccuuacugugcacaagauaa

SEQ ID NO: 416299 - RNA, 64 nt, hsa
cucuggagagugacgucucccugcugggagugcugguucucacgugcgguuucccuuguguauc

SEQ ID NO: 416300 - RNA, 64 nt, hsa
guagucucuauggcgugucuuuaugguguaauaagguucucacggguucaaucuuuuguguuua

SEQ ID NO: 416301 - RNA, 64 nt, hsa
acaugcaggugaauauuuuaauagguuacuauaagguucucaauuaaauucuuuaaucugucca

SEQ ID NO: 416302 - RNA, 64 nt, hsa
gaaauggcacgauuucacguuaucagugcaguucgguucucagggggaaagguaagcccauagc

SEQ ID NO: 416303 - RNA, 64 nt, hsa
gaacugggaaaacagugaaucuuaugguggaagagguucucagcaaguguacaguauuuaccuu

SEQ ID NO: 416304 - RNA, 64 nt, hsa
uucagguuauauuaucuugggucagagaaugaaugguucucaggcuuuucaaaagagcugguca

SEQ ID NO: 416305 - RNA, 64 nt, hsa
auaggagaggaggguuccucuuaggucagauggagguucucagagccaaguccucccucucuac

SEQ ID NO: 416306 - RNA, 64 nt, hsa
gaugauuucccuucuguaacucccuagagccacagguucucauuccuuuucccauuauacuucu

SEQ ID NO: 416307 - RNA, 64 nt, hsa
uuaaauuaaaauuucaaagcucuuucgagauucagguucucaauaauaauauucaaguuuuaga

SEQ ID NO: 416308 - RNA, 64 nt, hsa
acccacccccacuacagcauugugcuugggucuggguucucaguaauguagccauuugagaaac

SEQ ID NO: 416309 - RNA, 64 nt, hsa
gaagguaagaaaagcaauuuaaagucagcgagcagguucucauugauaacaagcuccauacugc

SEQ ID NO: 416310 - RNA, 64 nt, hsa
gcaggcaaggcgaggugcccgcucagcucagcaagguucucaacugccucgaguacccaccaga

SEQ ID NO: 416311 - RNA, 64 nt, hsa
agaggagcuggaguuacagaaaugauugucucuugguucucaguuuuuagcccuugagaggaca

SEQ ID NO: 416312 - RNA, 64 nt, hsa
aaugaagggaguaugucuuaaauguaaaguuucugguucucacacuguacucugagguccaaau

SEQ ID NO: 416313 - RNA, 64 nt, hsa
gggauccccagaguugguccaaggagggagaguggguucucaauacgguaccaaagauauaauc

SEQ ID NO: 416314 - RNA, 64 nt, hsa
aucucuggugucagcugcugcuguggccccagcagguucucaaagcucccaaguccucccuacg

SEQ ID NO: 416315 - RNA, 64 nt, hsa
uugauuucuucccccaaauuuaauaaagacagaggguucucaugauucacauugguugugcuau

SEQ ID NO: 416316 - RNA, 64 nt, hsa
cuuugaacuucaggacuuguaccaggaggcccuggguucucaggccuuuggcuuuggacugaga

SEQ ID NO: 416317 - RNA, 64 nt, hsa
cugugcacuagccugugauuaacuugcuuaguaugguucucagaucuugacaguauauuugaaa

SEQ ID NO: 416318 - RNA, 64 nt, hsa
aaaaaacugaggcguacaacggagcaacaauaucgguucucagugucuauuucaagauacauuu

SEQ ID NO: 416319 - RNA, 64 nt, hsa
cccacgaaggacccacaaaacuaaccuaguucaggguucucaggcaggcaguucugcuucagcu

SEQ ID NO: 416320 - RNA, 64 nt, hsa
gcacagucacucuuacacauaugccuaguccagugguucucaaagugugauccauagacuaaua

SEQ ID NO: 416321 - RNA, 64 nt, hsa
gaagcauuggaguuaucgauugccauugccccaugguucucacucuuugcaggcacucuucaaa

SEQ ID NO: 416322 - RNA, 64 nt, hsa
aacauagauuggauuuggaguugguaguagguaugguucucauaccagaauucucuuaaaaaaa

SEQ ID NO: 416323 - RNA, 64 nt, hsa
uuuccagauuugggguauaggucucaucucuucagguucucaugauaccaccuuuacugugcuu

SEQ ID NO: 416324 - RNA, 64 nt, hsa
cuggggcagaucacuucaagcaagcccccaugaugguucucaguccugcuucucuguggguacg

SEQ ID NO: 416325 - RNA, 64 nt, hsa
uauggcauucaccuucuuggagcucuaggacagugguucucaaaauuuuuuucucucaggaccu

SEQ ID NO: 416326 - RNA, 64 nt, hsa
gccacccccgacuucccguggaaauucccaacucgguucucauggaggaguggguggagacaag

SEQ ID NO: 416327 - RNA, 64 nt, hsa
cagucaaggccucugucugaaaugagucgcuccagguucucagcauacacuuccaucgcgucug

SEQ ID NO: 416328 - RNA, 64 nt, hsa
cccaggguagacauggacucuacucuccuucucugguucucagcuguggcuuuuguucuggggc

SEQ ID NO: 416329 - RNA, 64 nt, hsa
agcuuacugggaugucaggaaaugauacaggguugguucucauuucgugccgaaaugagacaga

SEQ ID NO: 416330 - RNA, 64 nt, hsa
cagaaauuuccacaaguccuuucauggaucuugagguucucaaaaacagccaaacucaaccuuu

SEQ ID NO: 416331 - RNA, 64 nt, hsa
agauuagcuuuaaaucccuuuucaguucacuguugguucucaucuuugaaagagggcagcauaa

SEQ ID NO: 416332 - RNA, 64 nt, hsa
acugacugcugagucuuccuagaaguaccugcuggguucucaguuccaguucccauccuuugau

SEQ ID NO: 416333 - RNA, 64 nt, hsa
acauuuugucauuaacacagcuauaacuugccgugguucucagauuuauuuuggacuauuuuga

SEQ ID NO: 416334 - RNA, 64 nt, hsa
gaauaagcagcaaauaaacaacuauggcuguugagguucucauuuugguuuguuuuaauuuuuu

SEQ ID NO: 416335 - RNA, 64 nt, hsa
accaaagaccaaguuaucaucucaccacaccacagguucucacuagaugacuguaaguagacac

SEQ ID NO: 416336 - RNA, 64 nt, hsa
ugguggugucccugacucugacugcuguuauccugguucucaccaggaggugucgcacugccuc

SEQ ID NO: 416337 - RNA, 64 nt, hsa
gaaaaggcaacuuauucaggcagucuggaaaggggguucucagaaaacucaguuucuuuauucc

SEQ ID NO: 416338 - RNA, 64 nt, hsa
cuccccacauccgcaccugcuguucccacucugggguucucaaguccaugaacagauauuguug

SEQ ID NO: 416339 - RNA, 59 nt, hsa; identical to SEQ ID NO: 416068

SEQ ID NO: 416340 - RNA, 64 nt, hsa
gcuagucuaucagcaucugacaggugaauuggaugguucucagaaccauuucacccagacagcc

SEQ ID NO: 416341 - RNA, 64 nt, hsa
agacagguccucugucuuaaaaagguuacuucuugguucucagcugguucuagucaauucugaa

SEQ ID NO: 416342 - RNA, 64 nt, hsa
auacuuaaaauacuacacagauuuugaguuuuaugguucucaaagcaagguuuccaucuuaaga

SEQ ID NO: 416343 - RNA, 64 nt, hsa
ggcaccuucuguucacucccacaaaguggugucugguucucacugagacguuuuaagauuuuuc

SEQ ID NO: 416344 - RNA, 64 nt, hsa
uugcccucuuagguugcauucucuuuaggccacugguucucaaacauuagggugcacuguaacc

SEQ ID NO: 416345 - RNA, 64 nt, hsa
ucugucugcuaauggugcuuaaauucucccaagagguucucacuuuuauuugaaggagguguua

SEQ ID NO: 416346 - RNA, 64 nt, hsa
gaacuccuuguuagcccuucagauuguuaggagugguucucauuuggucugccagaauacuggg

SEQ ID NO: 416347 - RNA, 64 nt, hsa
gcaucugcgacuagagagcacccggcccacguuggguucucagugcuuucuacugcacagagug

SEQ ID NO: 416348 - RNA, 64 nt, hsa
gcccuguucuugaggucucuuuucucuacuccaugguucucaauuuauuuggggggaaauaccu

SEQ ID NO: 416349 - RNA, 64 nt, hsa
ccagggacuugcugcaggcuggggggcacugggugguucucaccagcaggcugcggggcacugu

SEQ ID NO: 416350 - RNA, 64 nt, hsa
acuggccauuugccaauuuuccuacucucacacugguucucaaugaaaaauagugucuuuguga

SEQ ID NO: 416351 - RNA, 64 nt, hsa
uuauagauguauauacaggguggggggagugggcgguucucauuaaacgucaccauuucaugag

SEQ ID NO: 416352 - RNA, 64 nt, hsa
uuucuaucuguuccucuuagcccccaaacucccagguucucacuuccuucuucuggaguuuaac

SEQ ID NO: 416353 - RNA, 64 nt, hsa
cagcagagacaacggaggaggcucccaccaggacgguucucauuauuuauauguuaauauguuu

SEQ ID NO: 416354 - RNA, 64 nt, hsa
caugugaagcuauuugauaugcaccaggucucaagguucucauuucucaggugacgugauucua

SEQ ID NO: 416355 - RNA, 64 nt, hsa
cagguuaucgcaagaugucuuagaguaggguuaagguucucagugacacaagaauucaguauua

SEQ ID NO: 416356 - RNA, 64 nt, hsa
caagaagcuggaauuucuugcacacuuuauccuggguucucaaccucuuuggaaucuucuucau

SEQ ID NO: 416357 - RNA, 64 nt, hsa
ggguggaauuagaguggaauaaggauguuaacuugguucucagacucuuucuucacuacguguu

SEQ ID NO: 416358 - RNA, 64 nt, hsa
gaaaacaugcagaaagcacagaaaggaaaaccaagguucucaugaaucuccaacuuuaaauccu

SEQ ID NO: 416359 - RNA, 64 nt, hsa
uacaaucuagucagaauagcaguucuagagcacagguucucagucuaagcuauggaaaagcucc

SEQ ID NO: 416360 - RNA, 64 nt, hsa
guauguuuuuuccagagcauuaaagcuuucauaagguucucaaaggucucagaccuacaaagag

SEQ ID NO: 416361 - RNA, 64 nt, hsa
ucgggcagaguccuugggacaccagccucucugggguucucaggccaucccguuggggcugucg

SEQ ID NO: 416362 - RNA, 64 nt, hsa
agcuuggaaaggaccaguaugcuuggacugaagggguucucacagugggagccagggcugucuu

SEQ ID NO: 416363 - RNA, 64 nt, hsa
ugggcucugauucugcccaaugaguauccccauagguucucaaaaacaugaacaagucuguaaa

SEQ ID NO: 416364 - RNA, 64 nt, hsa
cuucaugcuuggcuggcgucugcccuagggcugggguucucaagccccuggcccuggcccagag

SEQ ID NO: 416365 - RNA, 64 nt, hsa
guacugacuuguacuauauuggcugccaugauaggguucucacagcgucauccaugaucguaag

SEQ ID NO: 416366 - RNA, 64 nt, hsa
gcagacagccuaguugauuaucuagcauacuuaggguucucauuuuguaguuucuucccucuuu

SEQ ID NO: 416367 - RNA, 64 nt, hsa
guuaugugaaacucuuccauucagauuccagagagguucucaugcuccccccccuccuuauuug

SEQ ID NO: 416368 - RNA, 64 nt, hsa
aagaugaucuacucagaaauuuuuauuuuucuaagguucucauaggaaaaguacauuuaauaca

SEQ ID NO: 416369 - RNA, 64 nt, hsa
aacuugaaagaaaaaucaucugugaguuccuucagguucucacucauagucaugauccuucaga

SEQ ID NO: 416370 - RNA, 64 nt, hsa
aagcagggcccagaggagacccaucaacucaucugguucucaccaaagccccuagcuagaggca

SEQ ID NO: 416371 - RNA, 64 nt, hsa
cagauuugauuaauauuguauuaaucucauggaugguucucaaagguaaaaaaagagagagaaa

SEQ ID NO: 416372 - RNA, 64 nt, hsa
auagaaaaguaucccuuuuuuuuuuuuugagacggguucucacuauguugcccagggcuggucu

SEQ ID NO: 416373 - RNA, 64 nt, hsa
ccagccccaggcuccagggccacggcggagucaugguucucaggacugagcgcuuguuuagguc

SEQ ID NO: 416374 - RNA, 64 nt, hsa
cuccuugagcccuugccccugcgucccgcgucuggguucucagcuauuuccagagccagcucaa

SEQ ID NO: 416375 - RNA, 64 nt, hsa
guaagagcaagugucccaugaaugugauuuccuggguucucacugucuuugcaccacgucuagg

SEQ ID NO: 416376 - RNA, 64 nt, hsa
acuuuuagcugggaaaguauagcaugaaaccagagguucucagaaugacuguaagauagcuuac

SEQ ID NO: 416377 - RNA, 64 nt, hsa
cccuuaccuugugggcuugggaaacacgacucgugguucucaaauuuagcaccuuacagacagu

SEQ ID NO: 416378 - RNA, 64 nt, hsa
aucuauuggucugaagguuucugaaccucuuucugguucucagcagaaguaacugaaguagauc

SEQ ID NO: 416379 - RNA, 64 nt, hsa
cagagcuuccaucaucaugaagaaaaaaaaauuugguucucaagugaacaaacauauaaaaugu

SEQ ID NO: 416380 - RNA, 64 nt, hsa
agugaaaaccaugcugcuuauucccuaauacaaugguucucaaacuuuaguguguaucagaauc

SEQ ID NO: 416381 - RNA, 64 nt, hsa
cggcuuaucaugugcuugguaaaaggugaucgcagguucucagacgaguuuacuuuacaugaga

SEQ ID NO: 416382 - RNA, 64 nt, hsa
cuuuuauuuuuugucucuuuuaagaugguaaaaugguucucagggauuccugccaauacuuuga

SEQ ID NO: 416383 - RNA, 64 nt, hsa
augggauugguauugcugugugcuuccagccacagguucucacacucaauuccaaagccuuccu

SEQ ID NO: 416384 - RNA, 64 nt, hsa
agaguaaggauaaaauucuuucuacuaaagcacugguucucaaacuuuuuggucucagacccca

SEQ ID NO: 416385 - RNA, 64 nt, hsa
cggacuucaaaaacugucaaagaaucaauccagcgguucucaaacgguacacagacuauugaca

SEQ ID NO: 416386 - RNA, 64 nt, hsa
acagaaucagaaguuaauuuuuaaguguuuguaagguucucaaguacugugacauguauuuuuu

SEQ ID NO: 416387 - RNA, 64 nt, hsa
gucagagggauauaagagccagcauccaucccuggguucucaguaggaaugcuggugcugucua

SEQ ID NO: 416388 - RNA, 64 nt, hsa
cagcauggacaucauggccucucaggucccuuuugguucucaguuucauugguuccucuuucug

SEQ ID NO: 416389 - RNA, 64 nt, hsa
ucuuucucaauauuaacuggaaugcugccucuuggguucucaccugcauggaugcuuugaguug

SEQ ID NO: 416390 - RNA, 64 nt, hsa
gagaaucugagacucuuuggagccaggcuuucucgguucucagaggaaaaguaugaaugagugu

SEQ ID NO: 416391 - RNA, 64 nt, hsa
gcagauuaaaaacuuuauagggacuugcauuaucgguucucaauaaauuacugagcagcuuugu

SEQ ID NO: 416392 - RNA, 64 nt, hsa
uagcuccuuucucaagcuacaaaguggugaacaugguucucaacuccuuaauuuauacucucuc

SEQ ID NO: 416393 - RNA, 64 nt, hsa
uaauagauauuaaucuugacucaucuagcucagugguucucaucaagggucaauuugauuguca

SEQ ID NO: 416394 - RNA, 62 nt, hsa
aagcgauucugauuuuguuuuauauggguucucugguucucaaaaaaaaaaaaaaucuauug

SEQ ID NO: 416395 - RNA, 64 nt, hsa
ccaugcuuuggagccagucugguggcuccuguaagguucucaaggcugguggcagcucagucug

SEQ ID NO: 416396 - RNA, 64 nt, hsa
gacuaacugaauugaaaccuauuacaauuaauaggguucucaaaggccuauuccuauuagaaga

SEQ ID NO: 416397 - RNA, 64 nt, hsa
ggaagggaaaaaaaauguagcgacagcauuuuaagguucucagaccuccagugaguaccugcaa

SEQ ID NO: 416398 - RNA, 64 nt, hsa
uuuucucuagacauucaucugaaaaucauuuuaugguucucaauccccauguagcuuugcauag

SEQ ID NO: 416399 - RNA, 64 nt, hsa
cagaaggcacaucccuuuggaauggaagcuuagggguucucaggugauagggagagguggcugu

SEQ ID NO: 416400 - RNA, 64 nt, hsa
acagcugcccccuccccgcccccguguugagacagguucucaaggcucaggggaagaugcauac

SEQ ID NO: 416401 - RNA, 64 nt, hsa
guguauuacaacaaucuggagauacuaaaucugggguucucagguucacucauugacaugauau

SEQ ID NO: 416402 - RNA, 64 nt, hsa
gugcacuuuacugaaauagaugaacauuucaguagguucucaacuuaaaauuaagccuaaccua

SEQ ID NO: 416403 - RNA, 64 nt, hsa
ccagcccccucuccgaguccuucacaauuccuuagguucucaggguuagaaacagucuugcgag

SEQ ID NO: 416404 - RNA, 64 nt, hsa
gugcucuguagcagaaacugagcuccggguggcugguucucagugguugucucaugucucuuuu

SEQ ID NO: 416405 - RNA, 64 nt, hsa
cuccgaucucacagccugucaugcugcucagugugguucucaccccugcaagcucaaauucagu

SEQ ID NO: 416406 - RNA, 64 nt, hsa
ugaaucuauagcagcauugucaguacagaccagugguucucaaacuuuaaaaugccucagcauc

SEQ ID NO: 416407 - RNA, 64 nt, hsa
ggaacauuucauucuugaacgcagcaucugacaugguucucagcaaguuggaauaguaaggauu

SEQ ID NO: 416408 - RNA, 64 nt, hsa
gccggccuuuuccuucagguucgucaggcucaccgguucucacugugucugggaaguaggacug

SEQ ID NO: 416409 - RNA, 64 nt, hsa
auuuacugguugaugauagauuuuauaaccuaacgguucucaugcggugcguaauuguagaugc

SEQ ID NO: 416410 - RNA, 64 nt, hsa
uccuuucugcccagccugcucagcagguugaauggguucucaguggucaccuuccucagcucag

SEQ ID NO: 416411 - RNA, 64 nt, hsa
cgauucccuugcugccuacccuuuucucuccucugguucucaaccucaacgaguucaaaucagu

SEQ ID NO: 416412 - RNA, 64 nt, hsa
ccugcagcaguacuacugucaacauaguguaaaugguucucaaaagcuuaccaguguggacuug

SEQ ID NO: 416413 - RNA, 64 nt, hsa
agagcuccccuuugcugacagaacugcuggauuugguucucauugguccagacgaggaagguau

SEQ ID NO: 416414 - RNA, 64 nt, hsa
ugcacuuugaauaggcuuuccauuuuguuuuggagguucucacuuugaaccuucuuguuuacag

SEQ ID NO: 416415 - RNA, 64 nt, hsa
uguuuuucuauuccugucccaaaucaaagagcaugguucucaggaaaaccaguuccccaguuua

SEQ ID NO: 416416 - RNA, 64 nt, hsa
auaugugagcgacaaaaaaggucugcuuuauagggguucucacucuagcuuggggagccagggu

SEQ ID NO: 416417 - RNA, 64 nt, hsa
accugggaggacucucuuaguucuuaccuuuugugguucucaauaaaacagaacuuaaaaaauu

SEQ ID NO: 416418 - RNA, 64 nt, hsa
gaugcagaucaaccuguggcuguuuucccgucuagguucucacagguaucuccugacagaggua

SEQ ID NO: 416419 - RNA, 64 nt, hsa
caucauaaaagcaaagucagccagcugauauuuugguucucaaaaacugcauuauuaauaauau

SEQ ID NO: 416420 - RNA, 64 nt, hsa
gauccuuacugucccuggaaagauauagcauagugguucucagcacagucuccagaacagaagc

SEQ ID NO: 416421 - RNA, 64 nt, hsa
cagcuuucuaccauccagguacaugcccaggccugguucucaccccuguuggagucagcuuuca

SEQ ID NO: 416422 - RNA, 64 nt, hsa
uggccccaggaguggagccuggccacuccuguuugguucucacugggaggcccacuggccuugg

SEQ ID NO: 416423 - RNA, 64 nt, hsa
agcgugccaagugaccuggugccugugggaaguggguucucaggacuggcauucuuggaauaaa

SEQ ID NO: 416424 - RNA, 64 nt, hsa
cauaaaauuaugauaguuuguuuuaauagccagggguucucaauggaaaaacgaaugcucuuac

SEQ ID NO: 416425 - RNA, 64 nt, hsa
ccugucccgggguugccugaggcagagcaagacggguucucaccccugacuucuggaggcuucc

SEQ ID NO: 416426 - RNA, 64 nt, hsa
auguugagauggaugcuugaggaauauugcugcugguucucauaauuucuagaguaaaugaggg

SEQ ID NO: 416427 - RNA, 64 nt, hsa
uuggaccuuagagccauuguccacaaucacggaugguucucaagaguugauuguaagaaauuuc

SEQ ID NO: 416428 - RNA, 64 nt, hsa
acccaaauuaucaaaccauuaagaacucauuacugguucucagccuccuccaguacuagccuca

SEQ ID NO: 416429 - RNA, 64 nt, hsa
uuucuguagcuacugugaacccaaucuuaaaggagguucucaugcccaggguccacagugacca

SEQ ID NO: 416430 - RNA, 64 nt, hsa
aguaucuugugcuucuucacuuacccauuagccagguucucauuagguuuugcuugggccuccc

SEQ ID NO: 416431 - RNA, 64 nt, hsa
ugacaggaaacccaagccuaagaaacaauuaagugguucucaucucuaauuaacugugaaacca

SEQ ID NO: 416432 - RNA, 64 nt, hsa
ccuccccuucucauccuccccacccccccgccaagguucucacacuggccugggcuugggugcc

SEQ ID NO: 416433 - RNA, 64 nt, hsa
aagccuuggcucuacccugaguucauaaauuuaugguucucaggccugacucucagcagcuaug

SEQ ID NO: 416434 - RNA, 64 nt, hsa
cagagcuaauccucuaaguucucuguacucaguugguucucaguuagcuggucaaguggagugu

SEQ ID NO: 416435 - RNA, 64 nt, hsa
aggauaguguuuaacaagccagcuggcuuaugcugguucucagcuguuuaaaaaaaaaaaaaaa

SEQ ID NO: 416436 - RNA, 64 nt, hsa
agcaggccugaaggaugaugguuuuguccucuuugguucucaccugcuugagaaguaaaacagu

SEQ ID NO: 416437 - RNA, 64 nt, hsa
uuguaguugcaaaaacaacucuguaauuuguugagguucucaaacugacagccagcgagacugg

SEQ ID NO: 416438 - RNA, 64 nt, hsa
agccacagaaaccacgauggcaaaaaaucucauugguucucaaggacuaaccugugggggaaag

SEQ ID NO: 416439 - RNA, 64 nt, hsa
gcagcuucggugugcagaucauccgucugugugggguucucagugccggaggccuugggguggg

SEQ ID NO: 416440 - RNA, 64 nt, hsa
gcucucgcauguaugaauaucuaguccuuucugugguucucagccaagacauaaaaacuaggac

SEQ ID NO: 416441 - RNA, 64 nt, hsa
aggcugaaaucuagaacuucaucccgggcaaugagguucucacagaaggugcaguuuuauaacu

SEQ ID NO: 416442 - RNA, 64 nt, hsa
ccuucauuucuucaccgcgguuccucgucauagggguucucacucugaacuuucccucucuacu

SEQ ID NO: 416443 - RNA, 64 nt, hsa
ccaaggugcagcgggcuucacagcccuacaauuggguucucagcuaagccccagaguucuggua

SEQ ID NO: 416444 - RNA, 64 nt, hsa
aggggcaggaaagcggcugggcucuuggacaccugguucucagagaacccugugaugaucaccc

SEQ ID NO: 416445 - RNA, 64 nt, hsa
gccccgccgccaaagucugcagaaugugagaugagguucucaaggucacaggccccagucccag

SEQ ID NO: 416446 - RNA, 64 nt, hsa
auucuguuuggacuggguucucaagacacgaccagguucucaagacacgaguccccuuguuccu

SEQ ID NO: 416447 - RNA, 64 nt, hsa
cucccaguccagaggccugauucuguuuggacuggguucucaagacacgaccagguucucaaga

SEQ ID NO: 416448 - RNA, 64 nt, hsa
ggccccuuacccacucucucccuguggcuggucugguucucauguaaacccacuccuugcuuug

SEQ ID NO: 416449 - RNA, 64 nt, hsa
aaaguguguggggaaggagaggacugguuuccuggguucucaggggccaggaggaguaacagaa

SEQ ID NO: 416450 - RNA, 64 nt, hsa
cagccaaggaccaaagaagguguguaagugaagugguucucaguccccagacaugugccccuuu

SEQ ID NO: 416451 - RNA, 64 nt, hsa
cccgcccagcacccccaggcccugggggaccugggguucucagacugccaaagaagccuugcca

SEQ ID NO: 416452 - RNA, 64 nt, hsa
cuggagccuguccagcuggcccgggcccuggccugguucucaaguguuuccuagacagagaggc

SEQ ID NO: 416453 - RNA, 64 nt, hsa
cagcugcacaggccagggcgcaggcacaucuguugguucucaggccucagauaaaaccaucucc

SEQ ID NO: 416454 - RNA, 64 nt, hsa
aggccugguaucuugcucgggcccuagcuguugggguucucauggguugcacugaccauacugc

SEQ ID NO: 416455 - RNA, 64 nt, hsa
uuuuauuaaacuuucuauuugggucuuaacccaugguucucagcuggggugacacugcuccucu

SEQ ID NO: 416456 - RNA, 64 nt, hsa
guuggagcaucaggccuccgaccuuucuugccucgguucucauuacacuuucacccauagcaga

SEQ ID NO: 416457 - RNA, 64 nt, hsa
uuuuuguugauccgugagcccaguuuuggugcuggguucucacauccaaguguuccuggguucc

SEQ ID NO: 416458 - RNA, 64 nt, hsa
uaaauauugggcuguuucccucuuccugugaagugguucucaaauuccuauguacuguaaagcu

SEQ ID NO: 416459 - RNA, 64 nt, hsa
cuuggaccugucaguuaaacucuaagguggacaggguucucaguacuaagcaaggagacagaau

SEQ ID NO: 416460 - RNA, 64 nt, hsa
cgaaaacuuagggucuaaguuguucuaaacccaggguucucaaauguguuguacaaaaaguuuc

SEQ ID NO: 416461 - RNA, 64 nt, hsa
uuguuugcuguguuauauguuagcuccgaacaaugguucucauuuggcuaagcaucaaaaucac

SEQ ID NO: 416462 - RNA, 64 nt, hsa
agaaaaacuuggccgacccuuggucuacagcacggguucucagucgggcgacgauuuggcuguc

SEQ ID NO: 416463 - RNA, 64 nt, hsa
cgccaucuggaggcucaguggaguggggaguugggguucucauaccagcagauuucccuagagc

SEQ ID NO: 416464 - RNA, 64 nt, hsa
cccauuggccauugccuggcuaaugagaaccccugguucucagaauuuuaaccaaaaggaguug

SEQ ID NO: 416465 - RNA, 64 nt, hsa
uuuuaucuuugauucuccuucagcccucaccccugguucucaucuuucuugaucaacaucuuuu

SEQ ID NO: 416466 - RNA, 64 nt, hsa
cugcagccccuugggacuugaggggggccccagggguucucaggaccccucccaccaccuccca

SEQ ID NO: 416467 - RNA, 64 nt, hsa
gguacagaggccugcccugccuggccgggcaggagguucucacuguugugaagguuguagacgu

SEQ ID NO: 416468 - RNA, 59 nt, hsa; identical to SEQ ID NO: 416197

SEQ ID NO: 416469 - RNA, 64 nt, hsa
ggcccccuccuccuucucucaggauuucucuugggguucucaauacuugguuaccucauuaucc

SEQ ID NO: 416470 - RNA, 64 nt, hsa
agggguuggucccauggguuaagagcucaccccagguucucaccucagggguuaagagcucaga

SEQ ID NO: 416471 - RNA, 64 nt, hsa
uggccgaccuacuauuuuuauuauuuuugagcuagguucucagucuguuggcagacuggagugc

SEQ ID NO: 416472 - RNA, 64 nt, hsa
ucuguguugaaggcaucuuucaagcccucgcucugguucucagggcagcauuuuccaggcgggu

SEQ ID NO: 416473 - RNA, 64 nt, hsa
ggauacccagggacaguagggcucccagguggcugguucucagcacaccuuccaugaaucugcu

SEQ ID NO: 416474 - RNA, 64 nt, hsa
ugaucaguguuuauaucagaguaccaggugucccgguucucaagauguaacacagcagaaaagu

SEQ ID NO: 416475 - RNA, 64 nt, hsa
guuucccuugcucuggucuccacguguaugaugggguucucaggcccaggcuucgaccagagga

SEQ ID NO: 416476 - RNA, 64 nt, hsa
uugauugguugccacauguuauguuuguugaagugguucucaugcaaaaauauuacacauuugu

SEQ ID NO: 416477 - RNA, 64 nt, hsa
ucaggcgcuuggacccggcccaagauuugacuccgguucucaccccgcccucuccugggguggu

SEQ ID NO: 416478 - RNA, 64 nt, hsa
ccucagaggagcucacgcagggcaggaauagccagguucucauaucccagggguucagacuuug

SEQ ID NO: 416479 - RNA, 64 nt, hsa
aacuucugcuuugcacuauguucacuuugggguugguucucagccauccaagggucuccaguga

SEQ ID NO: 416480 - RNA, 64 nt, hsa
ugacugcacccuugguggcugcuggaaggggagagguucucagcaucaggccaccuccacccca

SEQ ID NO: 416481 - RNA, 64 nt, hsa
cucugggaaagagcccugcaucuuucauuaauucgguucucagagaaccaaggcuggaaggcau

SEQ ID NO: 416482 - RNA, 64 nt, hsa
cucaaugcaguaaauauuuacuugcaggcaacuggguucucaucucuugauuugcuuuuguaau

SEQ ID NO: 416483 - RNA, 64 nt, hsa
acagccagagccccaggucagaagugcagaccaggguucucagcacagugcccgucgugcuucc

SEQ ID NO: 416484 - RNA, 64 nt, hsa
cagcucaaagucuccaguggaagcucauggacaagguucucagggaaguuuuggaguuugcaac

SEQ ID NO: 416485 - RNA, 64 nt, hsa
cuugagacugaccguaaaccacagacgcucuccagguucucaagaguuauccugccuuccagau

SEQ ID NO: 416486 - RNA, 64 nt, hsa
ggggugggaaaggcuuuaucagguaucaucaacagguucucaauuaaagauuugauuuauucaa

SEQ ID NO: 416487 - RNA, 64 nt, hsa
cugcccaccaccaagcaagcagcaagcaagaugggguucucaucaguucuuccucccacaaugu

SEQ ID NO: 416488 - RNA, 64 nt, hsa
ggaggcccucuuuuccaguaggaaguuagauggggguucucagaaguggcugauuggaagggga

SEQ ID NO: 416489 - RNA, 64 nt, hsa
acguuugcacaccuuucuuucccauuagaaaccggguucucaauuuggucuucuuuuguuguua

SEQ ID NO: 416490 - RNA, 64 nt, hsa
cccaucaucugccucggggacuuccucucuccgugguucucaccccauacucugucacugccac

SEQ ID NO: 416491 - RNA, 64 nt, hsa
ucugcuucagggccaggcagagagugaggcuggggguucucacaccuuacuccaccgggcacau

SEQ ID NO: 416492 - RNA, 64 nt, hsa
cgcucccucuggccugguggaucaccaagagggcgguucucauuuuguuauuaguggaagagcc

SEQ ID NO: 416493 - RNA, 58 nt, hsa; identical to SEQ ID NO: 416222

SEQ ID NO: 416494 - RNA, 64 nt, hsa
ucugcuucaggaccaggcagagagugaggcuggggguucucacaccuuacuccaccgggcacau

SEQ ID NO: 416495 - RNA, 64 nt, hsa
gcagagcuuuugagcucacaggugacaggcucaggguucucauccuggccccaccagggccuug

SEQ ID NO: 416496 - RNA, 64 nt, hsa
gaugugugcuugugaugauacacacacaugcacagguucucaaccacguguguauauauguaug

SEQ ID NO: 416497 - RNA, 64 nt, hsa
uuugcugggagggggcuguguugugagcccucccgguucucaccucgccuggcacuuaaccaca

SEQ ID NO: 416498 - RNA, 64 nt, hsa
cagggugguuauugcuauauguguuacagaccucgguucucauuaaaguauuuauuggcagaau

SEQ ID NO: 416499 - RNA, 64 nt, hsa
uacucuuugaaacuauucuuugagucaauuuuaugguucucagaagccaaaauacacaacuuuu

SEQ ID NO: 416500 - RNA, 64 nt, hsa
uucaguuuuaccauuguuagcaaaaaaguuaucugguucucaaagcaauaaagguguccauuug

SEQ ID NO: 416501 - RNA, 64 nt, hsa
uucgagacuuacauaugaaacacuggcuuuacaggguucucagagaugugggguauacacuguc

SEQ ID NO: 416502 - RNA, 64 nt, hsa
acccaguauuuccccuccuuguacuuuugccuuagguucucaagggacaauagucuucauguug

SEQ ID NO: 416503 - RNA, 64 nt, hsa
ccucuagaucccuggggccucacccuguauuugagguucucaccacccucagcagggagaaggg

SEQ ID NO: 416504 - RNA, 64 nt, hsa
ucauugccauucuuauggccacaagcaaaguaaugguucucauagugguauaaaguucacacag

SEQ ID NO: 416505 - RNA, 64 nt, hsa
ugccagccaugccuacauccccaugggcacagaacaagccaaagccuucguuguauguugacga

SEQ ID NO: 416506 - RNA, 64 nt, hsa
cacugggaauguguuuugaaaaugaauuugaagacaagccaacaaacccugcacuccaaaaaag

SEQ ID NO: 416507 - RNA, 64 nt, hsa
cuuuuaucuaaaggacuuuggcuuuuguaaaucacaagccaauaauagacuuuuuucucccccu

SEQ ID NO: 416508 - RNA, 64 nt, hsa
aacaagcacgcgugcucggcucacaccaacaaggcaagccaaaggcgccccuccccagagggau

SEQ ID NO: 416509 - RNA, 64 nt, hsa; identical to SEQ ID NO: 221388

SEQ ID NO: 416510 - RNA, 64 nt, hsa; identical to SEQ ID NO: 221389

SEQ ID NO: 416511 - RNA, 64 nt, hsa; identical to SEQ ID NO: 221390

SEQ ID NO: 416512 - RNA, 64 nt, hsa; identical to SEQ ID NO: 221391

SEQ ID NO: 416513 - RNA, 64 nt, hsa; identical to SEQ ID NO: 221392

SEQ ID NO: 416514 - RNA, 64 nt, hsa; identical to SEQ ID NO: 221393

SEQ ID NO: 416515 - RNA, 64 nt, hsa; identical to SEQ ID NO: 221394

SEQ ID NO: 416516 - RNA, 64 nt, hsa; identical to SEQ ID NO: 221395

SEQ ID NO: 416517 - RNA, 64 nt, hsa; identical to SEQ ID NO: 221396

SEQ ID NO: 416518 - RNA, 64 nt, hsa; identical to SEQ ID NO: 221397

SEQ ID NO: 416519 - RNA, 64 nt, hsa; identical to SEQ ID NO: 221398

SEQ ID NO: 416520 - RNA, 64 nt, hsa; identical to SEQ ID NO: 221399

SEQ ID NO: 416521 - RNA, 64 nt, hsa; identical to SEQ ID NO: 221400

SEQ ID NO: 416522 - RNA, 64 nt, hsa; identical to SEQ ID NO: 221401

SEQ ID NO: 416523 - RNA, 64 nt, hsa; identical to SEQ ID NO: 221402

SEQ ID NO: 416524 - RNA, 64 nt, hsa; identical to SEQ ID NO: 221403

SEQ ID NO: 416525 - RNA, 64 nt, hsa; identical to SEQ ID NO: 221404

SEQ ID NO: 416526 - RNA, 64 nt, hsa; identical to SEQ ID NO: 221405

SEQ ID NO: 416527 - RNA, 64 nt, hsa; identical to SEQ ID NO: 221406

SEQ ID NO: 416528 - RNA, 64 nt, hsa; identical to SEQ ID NO: 221407

SEQ ID NO: 416529 - RNA, 64 nt, hsa; identical to SEQ ID NO: 221408

SEQ ID NO: 416530 - RNA, 64 nt, hsa; identical to SEQ ID NO: 221409

SEQ ID NO: 416531 - RNA, 64 nt, hsa; identical to SEQ ID NO: 221410

SEQ ID NO: 416532 - RNA, 64 nt, hsa; identical to SEQ ID NO: 221411

SEQ ID NO: 416533 - RNA, 64 nt, hsa; identical to SEQ ID NO: 221412

SEQ ID NO: 416534 - RNA, 64 nt, hsa; identical to SEQ ID NO: 221413

SEQ ID NO: 416535 - RNA, 64 nt, hsa; identical to SEQ ID NO: 221414

SEQ ID NO: 416536 - RNA, 64 nt, hsa; identical to SEQ ID NO: 221415

SEQ ID NO: 416537 - RNA, 64 nt, hsa; identical to SEQ ID NO: 221416

SEQ ID NO: 416538 - RNA, 64 nt, hsa; identical to SEQ ID NO: 221417

SEQ ID NO: 416539 - RNA, 64 nt, hsa; identical to SEQ ID NO: 221418

SEQ ID NO: 416540 - RNA, 64 nt, hsa; identical to SEQ ID NO: 221419

SEQ ID NO: 416541 - RNA, 64 nt, hsa; identical to SEQ ID NO: 221420

SEQ ID NO: 416542 - RNA, 64 nt, hsa; identical to SEQ ID NO: 221421

SEQ ID NO: 416543 - RNA, 64 nt, hsa; identical to SEQ ID NO: 221422

SEQ ID NO: 416544 - RNA, 64 nt, hsa; identical to SEQ ID NO: 221423

SEQ ID NO: 416545 - RNA, 64 nt, hsa; identical to SEQ ID NO: 221424

SEQ ID NO: 416546 - RNA, 64 nt, hsa; identical to SEQ ID NO: 221425

SEQ ID NO: 416547 - RNA, 64 nt, hsa; identical to SEQ ID NO: 221426

SEQ ID NO: 416548 - RNA, 64 nt, hsa; identical to SEQ ID NO: 221427

SEQ ID NO: 416549 - RNA, 64 nt, hsa; identical to SEQ ID NO: 221428

SEQ ID NO: 416550 - RNA, 64 nt, hsa; identical to SEQ ID NO: 221429

SEQ ID NO: 416551 - RNA, 64 nt, hsa; identical to SEQ ID NO: 221430

SEQ ID NO: 416552 - RNA, 64 nt, hsa; identical to SEQ ID NO: 221431

SEQ ID NO: 416553 - RNA, 64 nt, hsa; identical to SEQ ID NO: 221432

SEQ ID NO: 416554 - RNA, 64 nt, hsa; identical to SEQ ID NO: 221433

SEQ ID NO: 416555 - RNA, 64 nt, hsa; identical to SEQ ID NO: 221434

SEQ ID NO: 416556 - RNA, 64 nt, hsa; identical to SEQ ID NO: 221435

SEQ ID NO: 416557 - RNA, 64 nt, hsa; identical to SEQ ID NO: 221436

SEQ ID NO: 416558 - RNA, 64 nt, hsa; identical to SEQ ID NO: 221437

SEQ ID NO: 416559 - RNA, 64 nt, hsa; identical to SEQ ID NO: 221438

SEQ ID NO: 416560 - RNA, 64 nt, hsa; identical to SEQ ID NO: 221439

SEQ ID NO: 416561 - RNA, 64 nt, hsa; identical to SEQ ID NO: 221440

SEQ ID NO: 416562 - RNA, 64 nt, hsa; identical to SEQ ID NO: 221441

SEQ ID NO: 416563 - RNA, 64 nt, hsa; identical to SEQ ID NO: 221442

SEQ ID NO: 416564 - RNA, 64 nt, hsa; identical to SEQ ID NO: 221443

SEQ ID NO: 416565 - RNA, 64 nt, hsa; identical to SEQ ID NO: 221444

SEQ ID NO: 416566 - RNA, 64 nt, hsa; identical to SEQ ID NO: 221445

SEQ ID NO: 416567 - RNA, 64 nt, hsa; identical to SEQ ID NO: 221446

SEQ ID NO: 416568 - RNA, 64 nt, hsa; identical to SEQ ID NO: 221447

SEQ ID NO: 416569 - RNA, 64 nt, hsa; identical to SEQ ID NO: 221448

SEQ ID NO: 416570 - RNA, 64 nt, hsa; identical to SEQ ID NO: 221449

SEQ ID NO: 416571 - RNA, 64 nt, hsa; identical to SEQ ID NO: 221450

SEQ ID NO: 416572 - RNA, 64 nt, hsa; identical to SEQ ID NO: 221451

SEQ ID NO: 416573 - RNA, 64 nt, hsa; identical to SEQ ID NO: 221452

SEQ ID NO: 416574 - RNA, 64 nt, hsa; identical to SEQ ID NO: 221453

SEQ ID NO: 416575 - RNA, 64 nt, hsa; identical to SEQ ID NO: 221454

SEQ ID NO: 416576 - RNA, 64 nt, hsa; identical to SEQ ID NO: 221455

SEQ ID NO: 416577 - RNA, 64 nt, hsa; identical to SEQ ID NO: 221456

SEQ ID NO: 416578 - RNA, 64 nt, hsa; identical to SEQ ID NO: 221457

SEQ ID NO: 416579 - RNA, 64 nt, hsa; identical to SEQ ID NO: 221458

SEQ ID NO: 416580 - RNA, 64 nt, hsa; identical to SEQ ID NO: 221459

SEQ ID NO: 416581 - RNA, 64 nt, hsa; identical to SEQ ID NO: 221460

SEQ ID NO: 416582 - RNA, 64 nt, hsa; identical to SEQ ID NO: 221461

SEQ ID NO: 416583 - RNA, 64 nt, hsa; identical to SEQ ID NO: 221462

SEQ ID NO: 416584 - RNA, 64 nt, hsa; identical to SEQ ID NO: 221463

SEQ ID NO: 416585 - RNA, 64 nt, hsa; identical to SEQ ID NO: 221464

SEQ ID NO: 416586 - RNA, 64 nt, hsa; identical to SEQ ID NO: 221465

SEQ ID NO: 416587 - RNA, 64 nt, hsa; identical to SEQ ID NO: 221466

SEQ ID NO: 416588 - RNA, 64 nt, hsa; identical to SEQ ID NO: 221467

SEQ ID NO: 416589 - RNA, 64 nt, hsa; identical to SEQ ID NO: 221468

SEQ ID NO: 416590 - RNA, 64 nt, hsa; identical to SEQ ID NO: 221469

SEQ ID NO: 416591 - RNA, 64 nt, hsa; identical to SEQ ID NO: 221470

SEQ ID NO: 416592 - RNA, 64 nt, hsa; identical to SEQ ID NO: 221471

SEQ ID NO: 416593 - RNA, 64 nt, hsa; identical to SEQ ID NO: 221472

SEQ ID NO: 416594 - RNA, 64 nt, hsa; identical to SEQ ID NO: 221473

SEQ ID NO: 416595 - RNA, 64 nt, hsa; identical to SEQ ID NO: 221474

SEQ ID NO: 416596 - RNA, 64 nt, hsa; identical to SEQ ID NO: 221475

SEQ ID NO: 416597 - RNA, 64 nt, hsa; identical to SEQ ID NO: 221476

SEQ ID NO: 416598 - RNA, 64 nt, hsa; identical to SEQ ID NO: 221477

SEQ ID NO: 416599 - RNA, 64 nt, hsa; identical to SEQ ID NO: 221478

SEQ ID NO: 416600 - RNA, 64 nt, hsa; identical to SEQ ID NO: 221479

SEQ ID NO: 416601 - RNA, 64 nt, hsa; identical to SEQ ID NO: 221480

SEQ ID NO: 416602 - RNA, 64 nt, hsa; identical to SEQ ID NO: 221481

SEQ ID NO: 416603 - RNA, 64 nt, hsa; identical to SEQ ID NO: 221482

SEQ ID NO: 416604 - RNA, 64 nt, hsa; identical to SEQ ID NO: 221483

SEQ ID NO: 416605 - RNA, 64 nt, hsa; identical to SEQ ID NO: 221484

SEQ ID NO: 416606 - RNA, 64 nt, hsa; identical to SEQ ID NO: 221485

SEQ ID NO: 416607 - RNA, 64 nt, hsa; identical to SEQ ID NO: 221486

SEQ ID NO: 416608 - RNA, 64 nt, hsa; identical to SEQ ID NO: 221487

SEQ ID NO: 416609 - RNA, 64 nt, hsa; identical to SEQ ID NO: 221488

SEQ ID NO: 416610 - RNA, 64 nt, hsa; identical to SEQ ID NO: 221489

SEQ ID NO: 416611 - RNA, 64 nt, hsa; identical to SEQ ID NO: 221490

SEQ ID NO: 416612 - RNA, 64 nt, hsa; identical to SEQ ID NO: 221491

SEQ ID NO: 416613 - RNA, 64 nt, hsa; identical to SEQ ID NO: 221492

SEQ ID NO: 416614 - RNA, 64 nt, hsa; identical to SEQ ID NO: 221493

SEQ ID NO: 416615 - RNA, 64 nt, hsa; identical to SEQ ID NO: 221494

SEQ ID NO: 416616 - RNA, 64 nt, hsa; identical to SEQ ID NO: 221495

SEQ ID NO: 416617 - RNA, 64 nt, hsa; identical to SEQ ID NO: 221496

SEQ ID NO: 416618 - RNA, 64 nt, hsa; identical to SEQ ID NO: 221497

SEQ ID NO: 416619 - RNA, 64 nt, hsa; identical to SEQ ID NO: 221498

SEQ ID NO: 416620 - RNA, 64 nt, hsa; identical to SEQ ID NO: 221499

SEQ ID NO: 416621 - RNA, 64 nt, hsa; identical to SEQ ID NO: 221500

SEQ ID NO: 416622 - RNA, 64 nt, hsa; identical to SEQ ID NO: 221501

SEQ ID NO: 416623 - RNA, 64 nt, hsa; identical to SEQ ID NO: 221502

SEQ ID NO: 416624 - RNA, 64 nt, hsa; identical to SEQ ID NO: 221503

SEQ ID NO: 416625 - RNA, 64 nt, hsa; identical to SEQ ID NO: 221504

SEQ ID NO: 416626 - RNA, 64 nt, hsa; identical to SEQ ID NO: 221505

SEQ ID NO: 416627 - RNA, 64 nt, hsa; identical to SEQ ID NO: 221506

SEQ ID NO: 416628 - RNA, 64 nt, hsa; identical to SEQ ID NO: 221507

SEQ ID NO: 416629 - RNA, 64 nt, hsa; identical to SEQ ID NO: 221508

SEQ ID NO: 416630 - RNA, 64 nt, hsa; identical to SEQ ID NO: 221509

SEQ ID NO: 416631 - RNA, 64 nt, hsa; identical to SEQ ID NO: 221510

SEQ ID NO: 416632 - RNA, 64 nt, hsa; identical to SEQ ID NO: 221511

SEQ ID NO: 416633 - RNA, 64 nt, hsa; identical to SEQ ID NO: 221512

SEQ ID NO: 416634 - RNA, 64 nt, hsa; identical to SEQ ID NO: 221513

SEQ ID NO: 416635 - RNA, 64 nt, hsa; identical to SEQ ID NO: 221514

SEQ ID NO: 416636 - RNA, 64 nt, hsa; identical to SEQ ID NO: 221515

SEQ ID NO: 416637 - RNA, 64 nt, hsa; identical to SEQ ID NO: 221516

SEQ ID NO: 416638 - RNA, 64 nt, hsa; identical to SEQ ID NO: 221517

SEQ ID NO: 416639 - RNA, 64 nt, hsa; identical to SEQ ID NO: 221518

SEQ ID NO: 416640 - RNA, 64 nt, hsa; identical to SEQ ID NO: 221519

SEQ ID NO: 416641 - RNA, 64 nt, hsa; identical to SEQ ID NO: 221520

SEQ ID NO: 416642 - RNA, 64 nt, hsa; identical to SEQ ID NO: 221521

SEQ ID NO: 416643 - RNA, 64 nt, hsa; identical to SEQ ID NO: 221522

SEQ ID NO: 416644 - RNA, 64 nt, hsa; identical to SEQ ID NO: 221523

SEQ ID NO: 416645 - RNA, 64 nt, hsa; identical to SEQ ID NO: 221524

SEQ ID NO: 416646 - RNA, 64 nt, hsa; identical to SEQ ID NO: 221525

SEQ ID NO: 416647 - RNA, 64 nt, hsa; identical to SEQ ID NO: 221526

SEQ ID NO: 416648 - RNA, 64 nt, hsa; identical to SEQ ID NO: 221527

SEQ ID NO: 416649 - RNA, 64 nt, hsa; identical to SEQ ID NO: 221528

SEQ ID NO: 416650 - RNA, 64 nt, hsa; identical to SEQ ID NO: 221529

SEQ ID NO: 416651 - RNA, 64 nt, hsa; identical to SEQ ID NO: 221530

SEQ ID NO: 416652 - RNA, 64 nt, hsa; identical to SEQ ID NO: 221531

SEQ ID NO: 416653 - RNA, 64 nt, hsa; identical to SEQ ID NO: 221532

SEQ ID NO: 416654 - RNA, 64 nt, hsa; identical to SEQ ID NO: 221533

SEQ ID NO: 416655 - RNA, 64 nt, hsa; identical to SEQ ID NO: 221534

SEQ ID NO: 416656 - RNA, 64 nt, hsa; identical to SEQ ID NO: 221535

SEQ ID NO: 416657 - RNA, 64 nt, hsa; identical to SEQ ID NO: 221536

SEQ ID NO: 416658 - RNA, 64 nt, hsa; identical to SEQ ID NO: 221537

SEQ ID NO: 416659 - RNA, 64 nt, hsa; identical to SEQ ID NO: 221538

SEQ ID NO: 416660 - RNA, 64 nt, hsa; identical to SEQ ID NO: 221539

SEQ ID NO: 416661 - RNA, 64 nt, hsa; identical to SEQ ID NO: 221540

SEQ ID NO: 416662 - RNA, 64 nt, hsa; identical to SEQ ID NO: 221541

SEQ ID NO: 416663 - RNA, 64 nt, hsa; identical to SEQ ID NO: 221542

SEQ ID NO: 416664 - RNA, 64 nt, hsa; identical to SEQ ID NO: 221543

SEQ ID NO: 416665 - RNA, 64 nt, hsa; identical to SEQ ID NO: 221544

SEQ ID NO: 416666 - RNA, 64 nt, hsa; identical to SEQ ID NO: 221545

SEQ ID NO: 416667 - RNA, 64 nt, hsa; identical to SEQ ID NO: 221546

SEQ ID NO: 416668 - RNA, 64 nt, hsa; identical to SEQ ID NO: 221547

SEQ ID NO: 416669 - RNA, 64 nt, hsa; identical to SEQ ID NO: 221548

SEQ ID NO: 416670 - RNA, 64 nt, hsa; identical to SEQ ID NO: 221549

SEQ ID NO: 416671 - RNA, 64 nt, hsa; identical to SEQ ID NO: 221550

SEQ ID NO: 416672 - RNA, 64 nt, hsa; identical to SEQ ID NO: 221551

SEQ ID NO: 416673 - RNA, 64 nt, hsa; identical to SEQ ID NO: 221552

SEQ ID NO: 416674 - RNA, 64 nt, hsa; identical to SEQ ID NO: 221553

SEQ ID NO: 416675 - RNA, 64 nt, hsa; identical to SEQ ID NO: 221554

SEQ ID NO: 416676 - RNA, 64 nt, hsa; identical to SEQ ID NO: 221555

SEQ ID NO: 416677 - RNA, 64 nt, hsa; identical to SEQ ID NO: 221556

SEQ ID NO: 416678 - RNA, 64 nt, hsa; identical to SEQ ID NO: 221557

SEQ ID NO: 416679 - RNA, 64 nt, hsa; identical to SEQ ID NO: 221558

SEQ ID NO: 416680 - RNA, 64 nt, hsa; identical to SEQ ID NO: 221559

SEQ ID NO: 416681 - RNA, 64 nt, hsa; identical to SEQ ID NO: 221560

SEQ ID NO: 416682 - RNA, 64 nt, hsa; identical to SEQ ID NO: 221561

SEQ ID NO: 416683 - RNA, 64 nt, hsa; identical to SEQ ID NO: 221562

SEQ ID NO: 416684 - RNA, 64 nt, hsa; identical to SEQ ID NO: 221563

SEQ ID NO: 416685 - RNA, 64 nt, hsa; identical to SEQ ID NO: 221564

SEQ ID NO: 416686 - RNA, 64 nt, hsa; identical to SEQ ID NO: 221565

SEQ ID NO: 416687 - RNA, 64 nt, hsa; identical to SEQ ID NO: 221566

SEQ ID NO: 416688 - RNA, 64 nt, hsa; identical to SEQ ID NO: 221567

SEQ ID NO: 416689 - RNA, 64 nt, hsa; identical to SEQ ID NO: 221568

SEQ ID NO: 416690 - RNA, 64 nt, hsa; identical to SEQ ID NO: 221569

SEQ ID NO: 416691 - RNA, 64 nt, hsa; identical to SEQ ID NO: 221570

SEQ ID NO: 416692 - RNA, 64 nt, hsa; identical to SEQ ID NO: 221571

SEQ ID NO: 416693 - RNA, 64 nt, hsa; identical to SEQ ID NO: 221572

SEQ ID NO: 416694 - RNA, 64 nt, hsa; identical to SEQ ID NO: 221573

SEQ ID NO: 416695 - RNA, 64 nt, hsa; identical to SEQ ID NO: 221574

SEQ ID NO: 416696 - RNA, 64 nt, hsa; identical to SEQ ID NO: 221575

SEQ ID NO: 416697 - RNA, 64 nt, hsa; identical to SEQ ID NO: 221576

SEQ ID NO: 416698 - RNA, 64 nt, hsa; identical to SEQ ID NO: 221577

SEQ ID NO: 416699 - RNA, 64 nt, hsa; identical to SEQ ID NO: 221578

SEQ ID NO: 416700 - RNA, 64 nt, hsa; identical to SEQ ID NO: 221579

SEQ ID NO: 416701 - RNA, 64 nt, hsa; identical to SEQ ID NO: 221580

SEQ ID NO: 416702 - RNA, 64 nt, hsa; identical to SEQ ID NO: 221581

SEQ ID NO: 416703 - RNA, 64 nt, hsa; identical to SEQ ID NO: 221582

SEQ ID NO: 416704 - RNA, 64 nt, hsa; identical to SEQ ID NO: 221583

SEQ ID NO: 416705 - RNA, 64 nt, hsa; identical to SEQ ID NO: 221584

SEQ ID NO: 416706 - RNA, 64 nt, hsa; identical to SEQ ID NO: 221585

SEQ ID NO: 416707 - RNA, 64 nt, hsa; identical to SEQ ID NO: 221586

SEQ ID NO: 416708 - RNA, 64 nt, hsa; identical to SEQ ID NO: 221587

SEQ ID NO: 416709 - RNA, 64 nt, hsa; identical to SEQ ID NO: 221588

SEQ ID NO: 416710 - RNA, 64 nt, hsa; identical to SEQ ID NO: 221589

SEQ ID NO: 416711 - RNA, 64 nt, hsa; identical to SEQ ID NO: 221590

SEQ ID NO: 416712 - RNA, 64 nt, hsa; identical to SEQ ID NO: 221591

SEQ ID NO: 416713 - RNA, 64 nt, hsa; identical to SEQ ID NO: 221592

SEQ ID NO: 416714 - RNA, 64 nt, hsa; identical to SEQ ID NO: 221593

SEQ ID NO: 416715 - RNA, 64 nt, hsa; identical to SEQ ID NO: 221594

SEQ ID NO: 416716 - RNA, 64 nt, hsa; identical to SEQ ID NO: 221595

SEQ ID NO: 416717 - RNA, 64 nt, hsa; identical to SEQ ID NO: 221596

SEQ ID NO: 416718 - RNA, 64 nt, hsa; identical to SEQ ID NO: 221597

SEQ ID NO: 416719 - RNA, 64 nt, hsa; identical to SEQ ID NO: 221598

SEQ ID NO: 416720 - RNA, 64 nt, hsa; identical to SEQ ID NO: 221599

SEQ ID NO: 416721 - RNA, 64 nt, hsa; identical to SEQ ID NO: 221600

SEQ ID NO: 416722 - RNA, 64 nt, hsa; identical to SEQ ID NO: 221601

SEQ ID NO: 416723 - RNA, 64 nt, hsa; identical to SEQ ID NO: 221602

SEQ ID NO: 416724 - RNA, 64 nt, hsa; identical to SEQ ID NO: 221603

SEQ ID NO: 416725 - RNA, 64 nt, hsa; identical to SEQ ID NO: 221604

SEQ ID NO: 416726 - RNA, 64 nt, hsa; identical to SEQ ID NO: 221605

SEQ ID NO: 416727 - RNA, 64 nt, hsa; identical to SEQ ID NO: 221606

SEQ ID NO: 416728 - RNA, 64 nt, hsa; identical to SEQ ID NO: 221607

SEQ ID NO: 416729 - RNA, 64 nt, hsa; identical to SEQ ID NO: 221608

SEQ ID NO: 416730 - RNA, 64 nt, hsa; identical to SEQ ID NO: 221609

SEQ ID NO: 416731 - RNA, 64 nt, hsa; identical to SEQ ID NO: 221610

SEQ ID NO: 416732 - RNA, 64 nt, hsa; identical to SEQ ID NO: 221611

SEQ ID NO: 416733 - RNA, 64 nt, hsa; identical to SEQ ID NO: 221612

SEQ ID NO: 416734 - RNA, 64 nt, hsa; identical to SEQ ID NO: 221613

SEQ ID NO: 416735 - RNA, 64 nt, hsa; identical to SEQ ID NO: 221614

SEQ ID NO: 416736 - RNA, 64 nt, hsa; identical to SEQ ID NO: 221615

SEQ ID NO: 416737 - RNA, 64 nt, hsa; identical to SEQ ID NO: 221616

SEQ ID NO: 416738 - RNA, 64 nt, hsa; identical to SEQ ID NO: 221617

SEQ ID NO: 416739 - RNA, 64 nt, hsa; identical to SEQ ID NO: 221618

SEQ ID NO: 416740 - RNA, 64 nt, hsa; identical to SEQ ID NO: 221619

SEQ ID NO: 416741 - RNA, 64 nt, hsa; identical to SEQ ID NO: 221620

SEQ ID NO: 416742 - RNA, 64 nt, hsa; identical to SEQ ID NO: 221621

SEQ ID NO: 416743 - RNA, 64 nt, hsa; identical to SEQ ID NO: 221622

SEQ ID NO: 416744 - RNA, 64 nt, hsa; identical to SEQ ID NO: 221623

SEQ ID NO: 416745 - RNA, 64 nt, hsa; identical to SEQ ID NO: 221624

SEQ ID NO: 416746 - RNA, 64 nt, hsa; identical to SEQ ID NO: 221625

SEQ ID NO: 416747 - RNA, 64 nt, hsa; identical to SEQ ID NO: 221626

SEQ ID NO: 416748 - RNA, 64 nt, hsa; identical to SEQ ID NO: 221627

SEQ ID NO: 416749 - RNA, 64 nt, hsa; identical to SEQ ID NO: 221628

SEQ ID NO: 416750 - RNA, 64 nt, hsa; identical to SEQ ID NO: 221629

SEQ ID NO: 416751 - RNA, 64 nt, hsa; identical to SEQ ID NO: 221630

SEQ ID NO: 416752 - RNA, 64 nt, hsa; identical to SEQ ID NO: 221631

SEQ ID NO: 416753 - RNA, 64 nt, hsa; identical to SEQ ID NO: 221632

SEQ ID NO: 416754 - RNA, 64 nt, hsa; identical to SEQ ID NO: 221633

SEQ ID NO: 416755 - RNA, 64 nt, hsa; identical to SEQ ID NO: 221634

SEQ ID NO: 416756 - RNA, 64 nt, hsa; identical to SEQ ID NO: 221635

SEQ ID NO: 416757 - RNA, 64 nt, hsa; identical to SEQ ID NO: 221636

SEQ ID NO: 416758 - RNA, 64 nt, hsa; identical to SEQ ID NO: 221637

SEQ ID NO: 416759 - RNA, 64 nt, hsa; identical to SEQ ID NO: 221638

SEQ ID NO: 416760 - RNA, 64 nt, hsa; identical to SEQ ID NO: 221639

SEQ ID NO: 416761 - RNA, 64 nt, hsa; identical to SEQ ID NO: 221640

SEQ ID NO: 416762 - RNA, 64 nt, hsa; identical to SEQ ID NO: 221641

SEQ ID NO: 416763 - RNA, 64 nt, hsa; identical to SEQ ID NO: 221642

SEQ ID NO: 416764 - RNA, 64 nt, hsa; identical to SEQ ID NO: 221643

SEQ ID NO: 416765 - RNA, 64 nt, hsa; identical to SEQ ID NO: 221644

SEQ ID NO: 416766 - RNA, 64 nt, hsa; identical to SEQ ID NO: 221645

SEQ ID NO: 416767 - RNA, 64 nt, hsa; identical to SEQ ID NO: 221646

SEQ ID NO: 416768 - RNA, 64 nt, hsa; identical to SEQ ID NO: 221647

SEQ ID NO: 416769 - RNA, 64 nt, hsa; identical to SEQ ID NO: 221648

SEQ ID NO: 416770 - RNA, 64 nt, hsa; identical to SEQ ID NO: 221649

SEQ ID NO: 416771 - RNA, 64 nt, hsa; identical to SEQ ID NO: 221650

SEQ ID NO: 416772 - RNA, 64 nt, hsa; identical to SEQ ID NO: 221651

SEQ ID NO: 416773 - RNA, 64 nt, hsa; identical to SEQ ID NO: 221652

SEQ ID NO: 416774 - RNA, 64 nt, hsa; identical to SEQ ID NO: 221653

SEQ ID NO: 416775 - RNA, 64 nt, hsa; identical to SEQ ID NO: 221654

SEQ ID NO: 416776 - RNA, 64 nt, hsa; identical to SEQ ID NO: 221655

SEQ ID NO: 416777 - RNA, 64 nt, hsa; identical to SEQ ID NO: 221656

SEQ ID NO: 416778 - RNA, 64 nt, hsa; identical to SEQ ID NO: 221657

SEQ ID NO: 416779 - RNA, 64 nt, hsa; identical to SEQ ID NO: 221658

SEQ ID NO: 416780 - RNA, 64 nt, hsa; identical to SEQ ID NO: 221659

SEQ ID NO: 416781 - RNA, 64 nt, hsa; identical to SEQ ID NO: 221660

SEQ ID NO: 416782 - RNA, 64 nt, hsa; identical to SEQ ID NO: 221661

SEQ ID NO: 416783 - RNA, 64 nt, hsa; identical to SEQ ID NO: 221662

SEQ ID NO: 416784 - RNA, 64 nt, hsa; identical to SEQ ID NO: 221663

SEQ ID NO: 416785 - RNA, 64 nt, hsa; identical to SEQ ID NO: 221664

SEQ ID NO: 416786 - RNA, 64 nt, hsa; identical to SEQ ID NO: 221665

SEQ ID NO: 416787 - RNA, 64 nt, hsa; identical to SEQ ID NO: 221666

SEQ ID NO: 416788 - RNA, 64 nt, hsa; identical to SEQ ID NO: 221667

SEQ ID NO: 416789 - RNA, 64 nt, hsa; identical to SEQ ID NO: 221668

SEQ ID NO: 416790 - RNA, 64 nt, hsa; identical to SEQ ID NO: 221669

SEQ ID NO: 416791 - RNA, 64 nt, hsa; identical to SEQ ID NO: 221670

SEQ ID NO: 416792 - RNA, 64 nt, hsa; identical to SEQ ID NO: 221671

SEQ ID NO: 416793 - RNA, 64 nt, hsa; identical to SEQ ID NO: 221672

SEQ ID NO: 416794 - RNA, 64 nt, hsa; identical to SEQ ID NO: 221673

SEQ ID NO: 416795 - RNA, 64 nt, hsa; identical to SEQ ID NO: 221674

SEQ ID NO: 416796 - RNA, 64 nt, hsa; identical to SEQ ID NO: 77430

SEQ ID NO: 416797 - RNA, 64 nt, hsa; identical to SEQ ID NO: 77431

SEQ ID NO: 416798 - RNA, 64 nt, hsa; identical to SEQ ID NO: 77432

SEQ ID NO: 416799 - RNA, 64 nt, hsa; identical to SEQ ID NO: 77433

SEQ ID NO: 416800 - RNA, 64 nt, hsa; identical to SEQ ID NO: 77434

SEQ ID NO: 416801 - RNA, 64 nt, hsa; identical to SEQ ID NO: 77435

SEQ ID NO: 416802 - RNA, 64 nt, hsa; identical to SEQ ID NO: 77436

SEQ ID NO: 416803 - RNA, 64 nt, hsa; identical to SEQ ID NO: 77437

SEQ ID NO: 416804 - RNA, 64 nt, hsa; identical to SEQ ID NO: 77438

SEQ ID NO: 416805 - RNA, 64 nt, hsa; identical to SEQ ID NO: 77439

SEQ ID NO: 416806 - RNA, 64 nt, hsa; identical to SEQ ID NO: 77440

SEQ ID NO: 416807 - RNA, 64 nt, hsa; identical to SEQ ID NO: 77441

SEQ ID NO: 416808 - RNA, 64 nt, hsa; identical to SEQ ID NO: 77442

SEQ ID NO: 416809 - RNA, 64 nt, hsa; identical to SEQ ID NO: 77443

SEQ ID NO: 416810 - RNA, 64 nt, hsa; identical to SEQ ID NO: 77444

SEQ ID NO: 416811 - RNA, 64 nt, hsa; identical to SEQ ID NO: 77445

SEQ ID NO: 416812 - RNA, 64 nt, hsa; identical to SEQ ID NO: 77446

SEQ ID NO: 416813 - RNA, 64 nt, hsa; identical to SEQ ID NO: 77447

SEQ ID NO: 416814 - RNA, 64 nt, hsa; identical to SEQ ID NO: 77448

SEQ ID NO: 416815 - RNA, 64 nt, hsa; identical to SEQ ID NO: 77449

SEQ ID NO: 416816 - RNA, 64 nt, hsa; identical to SEQ ID NO: 77450

SEQ ID NO: 416817 - RNA, 64 nt, hsa; identical to SEQ ID NO: 77451

SEQ ID NO: 416818 - RNA, 64 nt, hsa; identical to SEQ ID NO: 77452

SEQ ID NO: 416819 - RNA, 64 nt, hsa; identical to SEQ ID NO: 77453

SEQ ID NO: 416820 - RNA, 64 nt, hsa; identical to SEQ ID NO: 77454

SEQ ID NO: 416821 - RNA, 64 nt, hsa; identical to SEQ ID NO: 77455

SEQ ID NO: 416822 - RNA, 64 nt, hsa; identical to SEQ ID NO: 77456

SEQ ID NO: 416823 - RNA, 64 nt, hsa; identical to SEQ ID NO: 77457

SEQ ID NO: 416824 - RNA, 64 nt, hsa; identical to SEQ ID NO: 77458

SEQ ID NO: 416825 - RNA, 64 nt, hsa; identical to SEQ ID NO: 77459

SEQ ID NO: 416826 - RNA, 64 nt, hsa; identical to SEQ ID NO: 77460

SEQ ID NO: 416827 - RNA, 64 nt, hsa; identical to SEQ ID NO: 77461

SEQ ID NO: 416828 - RNA, 64 nt, hsa; identical to SEQ ID NO: 77462

SEQ ID NO: 416829 - RNA, 64 nt, hsa; identical to SEQ ID NO: 77463

SEQ ID NO: 416830 - RNA, 64 nt, hsa; identical to SEQ ID NO: 77464

SEQ ID NO: 416831 - RNA, 64 nt, hsa; identical to SEQ ID NO: 77465

SEQ ID NO: 416832 - RNA, 64 nt, hsa; identical to SEQ ID NO: 77466

SEQ ID NO: 416833 - RNA, 64 nt, hsa; identical to SEQ ID NO: 77467

SEQ ID NO: 416834 - RNA, 64 nt, hsa; identical to SEQ ID NO: 77468

SEQ ID NO: 416835 - RNA, 64 nt, hsa; identical to SEQ ID NO: 77469

SEQ ID NO: 416836 - RNA, 64 nt, hsa; identical to SEQ ID NO: 77470

SEQ ID NO: 416837 - RNA, 64 nt, hsa; identical to SEQ ID NO: 77471

SEQ ID NO: 416838 - RNA, 64 nt, hsa; identical to SEQ ID NO: 77472

SEQ ID NO: 416839 - RNA, 64 nt, hsa; identical to SEQ ID NO: 77473

SEQ ID NO: 416840 - RNA, 64 nt, hsa; identical to SEQ ID NO: 77474

SEQ ID NO: 416841 - RNA, 64 nt, hsa; identical to SEQ ID NO: 77475

SEQ ID NO: 416842 - RNA, 64 nt, hsa; identical to SEQ ID NO: 77476

SEQ ID NO: 416843 - RNA, 64 nt, hsa; identical to SEQ ID NO: 77477

SEQ ID NO: 416844 - RNA, 64 nt, hsa; identical to SEQ ID NO: 77478

SEQ ID NO: 416845 - RNA, 64 nt, hsa; identical to SEQ ID NO: 77479

SEQ ID NO: 416846 - RNA, 64 nt, hsa; identical to SEQ ID NO: 77480

SEQ ID NO: 416847 - RNA, 64 nt, hsa; identical to SEQ ID NO: 77481

SEQ ID NO: 416848 - RNA, 64 nt, hsa; identical to SEQ ID NO: 77482

SEQ ID NO: 416849 - RNA, 64 nt, hsa; identical to SEQ ID NO: 77483

SEQ ID NO: 416850 - RNA, 64 nt, hsa; identical to SEQ ID NO: 77484

SEQ ID NO: 416851 - RNA, 64 nt, hsa; identical to SEQ ID NO: 77485

SEQ ID NO: 416852 - RNA, 64 nt, hsa; identical to SEQ ID NO: 77486

SEQ ID NO: 416853 - RNA, 64 nt, hsa; identical to SEQ ID NO: 217189

SEQ ID NO: 416854 - RNA, 64 nt, hsa; identical to SEQ ID NO: 217190

SEQ ID NO: 416855 - RNA, 64 nt, hsa; identical to SEQ ID NO: 217191

SEQ ID NO: 416856 - RNA, 64 nt, hsa; identical to SEQ ID NO: 217192

SEQ ID NO: 416857 - RNA, 64 nt, hsa; identical to SEQ ID NO: 217193

SEQ ID NO: 416858 - RNA, 64 nt, hsa; identical to SEQ ID NO: 217194

SEQ ID NO: 416859 - RNA, 64 nt, hsa; identical to SEQ ID NO: 217195

SEQ ID NO: 416860 - RNA, 64 nt, hsa; identical to SEQ ID NO: 217196

SEQ ID NO: 416861 - RNA, 64 nt, hsa; identical to SEQ ID NO: 217197

SEQ ID NO: 416862 - RNA, 64 nt, hsa; identical to SEQ ID NO: 315044

SEQ ID NO: 416863 - RNA, 64 nt, hsa; identical to SEQ ID NO: 315045

SEQ ID NO: 416864 - RNA, 64 nt, hsa; identical to SEQ ID NO: 315046

SEQ ID NO: 416865 - RNA, 64 nt, hsa; identical to SEQ ID NO: 315047

SEQ ID NO: 416866 - RNA, 64 nt, hsa; identical to SEQ ID NO: 315048

SEQ ID NO: 416867 - RNA, 64 nt, hsa; identical to SEQ ID NO: 315049

SEQ ID NO: 416868 - RNA, 64 nt, hsa; identical to SEQ ID NO: 315050

SEQ ID NO: 416869 - RNA, 64 nt, hsa; identical to SEQ ID NO: 315051

SEQ ID NO: 416870 - RNA, 64 nt, hsa; identical to SEQ ID NO: 315052

SEQ ID NO: 416871 - RNA, 64 nt, hsa; identical to SEQ ID NO: 315053

SEQ ID NO: 416872 - RNA, 64 nt, hsa; identical to SEQ ID NO: 315054

SEQ ID NO: 416873 - RNA, 64 nt, hsa; identical to SEQ ID NO: 315055

SEQ ID NO: 416874 - RNA, 64 nt, hsa; identical to SEQ ID NO: 315056

SEQ ID NO: 416875 - RNA, 64 nt, hsa; identical to SEQ ID NO: 315057

SEQ ID NO: 416876 - RNA, 64 nt, hsa; identical to SEQ ID NO: 315058

SEQ ID NO: 416877 - RNA, 64 nt, hsa; identical to SEQ ID NO: 315059

SEQ ID NO: 416878 - RNA, 64 nt, hsa; identical to SEQ ID NO: 315060

SEQ ID NO: 416879 - RNA, 64 nt, hsa; identical to SEQ ID NO: 315061

SEQ ID NO: 416880 - RNA, 64 nt, hsa; identical to SEQ ID NO: 315062

SEQ ID NO: 416881 - RNA, 64 nt, hsa; identical to SEQ ID NO: 315063

SEQ ID NO: 416882 - RNA, 64 nt, hsa; identical to SEQ ID NO: 315064

SEQ ID NO: 416883 - RNA, 64 nt, hsa; identical to SEQ ID NO: 315065

SEQ ID NO: 416884 - RNA, 64 nt, hsa; identical to SEQ ID NO: 315066

SEQ ID NO: 416885 - RNA, 64 nt, hsa; identical to SEQ ID NO: 315067

SEQ ID NO: 416886 - RNA, 57 nt, hsa; identical to SEQ ID NO: 315068

SEQ ID NO: 416887 - RNA, 64 nt, hsa; identical to SEQ ID NO: 315069

SEQ ID NO: 416888 - RNA, 64 nt, hsa; identical to SEQ ID NO: 315070

SEQ ID NO: 416889 - RNA, 64 nt, hsa; identical to SEQ ID NO: 315071

SEQ ID NO: 416890 - RNA, 64 nt, hsa; identical to SEQ ID NO: 315072

SEQ ID NO: 416891 - RNA, 64 nt, hsa; identical to SEQ ID NO: 315073

SEQ ID NO: 416892 - RNA, 64 nt, hsa; identical to SEQ ID NO: 315074

SEQ ID NO: 416893 - RNA, 64 nt, hsa; identical to SEQ ID NO: 315075

SEQ ID NO: 416894 - RNA, 64 nt, hsa; identical to SEQ ID NO: 124927

SEQ ID NO: 416895 - RNA, 64 nt, hsa; identical to SEQ ID NO: 124928

SEQ ID NO: 416896 - RNA, 64 nt, hsa; identical to SEQ ID NO: 124929

SEQ ID NO: 416897 - RNA, 64 nt, hsa; identical to SEQ ID NO: 124930

SEQ ID NO: 416898 - RNA, 64 nt, hsa; identical to SEQ ID NO: 124931

SEQ ID NO: 416899 - RNA, 64 nt, hsa; identical to SEQ ID NO: 124932

SEQ ID NO: 416900 - RNA, 64 nt, hsa; identical to SEQ ID NO: 124933

SEQ ID NO: 416901 - RNA, 64 nt, hsa; identical to SEQ ID NO: 124934

SEQ ID NO: 416902 - RNA, 64 nt, hsa; identical to SEQ ID NO: 124935

SEQ ID NO: 416903 - RNA, 64 nt, hsa; identical to SEQ ID NO: 124936

SEQ ID NO: 416904 - RNA, 64 nt, hsa; identical to SEQ ID NO: 124937

SEQ ID NO: 416905 - RNA, 64 nt, hsa; identical to SEQ ID NO: 124938

SEQ ID NO: 416906 - RNA, 64 nt, hsa; identical to SEQ ID NO: 124939

SEQ ID NO: 416907 - RNA, 64 nt, hsa; identical to SEQ ID NO: 124940

SEQ ID NO: 416908 - RNA, 64 nt, hsa; identical to SEQ ID NO: 124941

SEQ ID NO: 416909 - RNA, 64 nt, hsa; identical to SEQ ID NO: 124942

SEQ ID NO: 416910 - RNA, 64 nt, hsa; identical to SEQ ID NO: 124943

SEQ ID NO: 416911 - RNA, 64 nt, hsa; identical to SEQ ID NO: 124944

SEQ ID NO: 416912 - RNA, 64 nt, hsa; identical to SEQ ID NO: 124945

SEQ ID NO: 416913 - RNA, 64 nt, hsa; identical to SEQ ID NO: 124946

SEQ ID NO: 416914 - RNA, 64 nt, hsa; identical to SEQ ID NO: 124947

SEQ ID NO: 416915 - RNA, 64 nt, hsa; identical to SEQ ID NO: 124948

SEQ ID NO: 416916 - RNA, 64 nt, hsa; identical to SEQ ID NO: 124949

SEQ ID NO: 416917 - RNA, 64 nt, hsa; identical to SEQ ID NO: 124950

SEQ ID NO: 416918 - RNA, 64 nt, hsa; identical to SEQ ID NO: 124951

SEQ ID NO: 416919 - RNA, 64 nt, hsa; identical to SEQ ID NO: 124952

SEQ ID NO: 416920 - RNA, 64 nt, hsa; identical to SEQ ID NO: 124953

SEQ ID NO: 416921 - RNA, 64 nt, hsa; identical to SEQ ID NO: 124954

SEQ ID NO: 416922 - RNA, 64 nt, hsa; identical to SEQ ID NO: 124955

SEQ ID NO: 416923 - RNA, 64 nt, hsa; identical to SEQ ID NO: 124956

SEQ ID NO: 416924 - RNA, 64 nt, hsa; identical to SEQ ID NO: 124957

SEQ ID NO: 416925 - RNA, 64 nt, hsa; identical to SEQ ID NO: 124958

SEQ ID NO: 416926 - RNA, 64 nt, hsa; identical to SEQ ID NO: 124959

SEQ ID NO: 416927 - RNA, 64 nt, hsa; identical to SEQ ID NO: 124960

SEQ ID NO: 416928 - RNA, 64 nt, hsa; identical to SEQ ID NO: 124961

SEQ ID NO: 416929 - RNA, 64 nt, hsa; identical to SEQ ID NO: 124962

SEQ ID NO: 416930 - RNA, 64 nt, hsa; identical to SEQ ID NO: 124963

SEQ ID NO: 416931 - RNA, 64 nt, hsa; identical to SEQ ID NO: 124964

SEQ ID NO: 416932 - RNA, 64 nt, hsa; identical to SEQ ID NO: 124965

SEQ ID NO: 416933 - RNA, 64 nt, hsa; identical to SEQ ID NO: 124966

SEQ ID NO: 416934 - RNA, 64 nt, hsa; identical to SEQ ID NO: 124967

SEQ ID NO: 416935 - RNA, 63 nt, hsa; identical to SEQ ID NO: 124968

SEQ ID NO: 416936 - RNA, 64 nt, hsa; identical to SEQ ID NO: 124969

SEQ ID NO: 416937 - RNA, 64 nt, hsa; identical to SEQ ID NO: 124970

SEQ ID NO: 416938 - RNA, 64 nt, hsa; identical to SEQ ID NO: 124971

SEQ ID NO: 416939 - RNA, 64 nt, hsa; identical to SEQ ID NO: 124972

SEQ ID NO: 416940 - RNA, 64 nt, hsa; identical to SEQ ID NO: 124973

SEQ ID NO: 416941 - RNA, 64 nt, hsa; identical to SEQ ID NO: 124974

SEQ ID NO: 416942 - RNA, 64 nt, hsa; identical to SEQ ID NO: 124975

SEQ ID NO: 416943 - RNA, 64 nt, hsa; identical to SEQ ID NO: 124976

SEQ ID NO: 416944 - RNA, 64 nt, hsa; identical to SEQ ID NO: 124977

SEQ ID NO: 416945 - RNA, 64 nt, hsa; identical to SEQ ID NO: 124977

SEQ ID NO: 416946 - RNA, 64 nt, hsa; identical to SEQ ID NO: 124979

SEQ ID NO: 416947 - RNA, 64 nt, hsa; identical to SEQ ID NO: 124980

SEQ ID NO: 416948 - RNA, 64 nt, hsa; identical to SEQ ID NO: 124981

SEQ ID NO: 416949 - RNA, 64 nt, hsa; identical to SEQ ID NO: 124982

SEQ ID NO: 416950 - RNA, 64 nt, hsa; identical to SEQ ID NO: 124983

SEQ ID NO: 416951 - RNA, 64 nt, hsa; identical to SEQ ID NO: 124984

SEQ ID NO: 416952 - RNA, 64 nt, hsa; identical to SEQ ID NO: 124985

SEQ ID NO: 416953 - RNA, 64 nt, hsa; identical to SEQ ID NO: 124986

SEQ ID NO: 416954 - RNA, 64 nt, hsa; identical to SEQ ID NO: 124987

SEQ ID NO: 416955 - RNA, 64 nt, hsa; identical to SEQ ID NO: 124988

SEQ ID NO: 416956 - RNA, 64 nt, hsa; identical to SEQ ID NO: 124989

SEQ ID NO: 416957 - RNA, 64 nt, hsa; identical to SEQ ID NO: 124990

SEQ ID NO: 416958 - RNA, 64 nt, hsa; identical to SEQ ID NO: 124991

SEQ ID NO: 416959 - RNA, 64 nt, hsa; identical to SEQ ID NO: 124992

SEQ ID NO: 416960 - RNA, 64 nt, hsa; identical to SEQ ID NO: 124993

SEQ ID NO: 416961 - RNA, 64 nt, hsa; identical to SEQ ID NO: 124994

SEQ ID NO: 416962 - RNA, 64 nt, hsa; identical to SEQ ID NO: 124995

SEQ ID NO: 416963 - RNA, 64 nt, hsa; identical to SEQ ID NO: 124996

SEQ ID NO: 416964 - RNA, 64 nt, hsa; identical to SEQ ID NO: 124997

SEQ ID NO: 416965 - RNA, 64 nt, hsa; identical to SEQ ID NO: 124998

SEQ ID NO: 416966 - RNA, 64 nt, hsa; identical to SEQ ID NO: 124999

SEQ ID NO: 416967 - RNA, 64 nt, hsa; identical to SEQ ID NO: 125000

SEQ ID NO: 416968 - RNA, 64 nt, hsa; identical to SEQ ID NO: 125001

SEQ ID NO: 416969 - RNA, 64 nt, hsa; identical to SEQ ID NO: 125002

SEQ ID NO: 416970 - RNA, 64 nt, hsa
ggaccagucagcacagcaugccugguuguauuaaagcagggauaugcuguauuuuauaaaauug

SEQ ID NO: 416971 - RNA, 64 nt, hsa
aagcaguuucuuucaaagaagccagcaggcgaaaagcagggacugccacugcauuucauaucac

SEQ ID NO: 416972 - RNA, 64 nt, hsa
ggaagaagaccaaggcccaccgugccccaggcucagcagggagcugcuggagguaguagagccu

SEQ ID NO: 416973 - RNA, 64 nt, hsa
ggaagaagaccaagacccaucaugccccaggcucagcagggagcugcuggcugagaaagagccu

SEQ ID NO: 416974 - RNA, 64 nt, hsa
ccacaggagggagagaacuuaaaaaagcaacaguagcagggaauugauccacuucuuaaugcuu

SEQ ID NO: 416975 - RNA, 64 nt, hsa
auuugacacacagacuacagccagaagcccauggagcagggaugucacgucuugaaaagccuau

SEQ ID NO: 416976 - RNA, 64 nt, hsa
uuacuuuuucucuuguuucuguuggaaacacugaagcagggacucuaaaaugaaagcaucucac

SEQ ID NO: 416977 - RNA, 64 nt, hsa
ucuacccuaaauaauuuuuauaugcucaaggcaaagcagggaauagaggcaauuagcuagauaa

SEQ ID NO: 416978 - RNA, 64 nt, hsa
ugagggggucugcgguggcuccugucuucccugcagcagggaaggagggccguguggugcuuug

SEQ ID NO: 416979 - RNA, 64 nt, hsa
aggcagccagcagcagcugcacuggaacagucagagcagggagccucuuccucaacccagcuuu

SEQ ID NO: 416980 - RNA, 64 nt, hsa
uagcuacucaagggagggggaugugggcacuugaagcagggacacccacagaauggucccucuu

SEQ ID NO: 416981 - RNA, 64 nt, hsa
cugugcuguugguucccaaaacuagaaagaaggaagcagggagcggugccccaagcauggcucc

SEQ ID NO: 416982 - RNA, 64 nt, hsa
gucccucugccccauccuccagcagggaaaaugcagcagggaugcccuggagguggcugagccc

SEQ ID NO: 416983 - RNA, 64 nt, hsa
ccuccucucccauugucccucugccccauccuccagcagggaaaaugcagcagggaugcccugg

SEQ ID NO: 416984 - RNA, 51 nt, hsa
aauucggccuccugaaaugacagcagggagacuugggucggccuccugaaa

SEQ ID NO: 416985 - RNA, 64 nt, hsa
agcagggagacuugggucggccuccugaaaugacagcagggagacuugggugaccccccuucca

SEQ ID NO: 416986 - RNA, 64 nt, hsa
gcuacacuagccugggcugggcccugcaguggccagcagggagcccagcugcuccccagugacu

SEQ ID NO: 416987 - RNA, 64 nt, hsa
gcucccaucugccucugcugcacacacaggcaccagcagggaugccacaggagugcccacaggg

SEQ ID NO: 416988 - RNA, 64 nt, hsa
gggucuugggacugggguuucggauugaguugcaagcagggagaaaaccugaaggucggugccc

SEQ ID NO: 416989 - RNA, 60 nt, hsa
ccagcugguucgggcugugacgggguggccagcagggacgcgccccaggugggcagcugu

SEQ ID NO: 416990 - RNA, 64 nt, hsa
auccccagcugguucgggccgugacggggcggccagcagggacgcgccccaggugggcagcugu

SEQ ID NO: 416991 - RNA, 64 nt, hsa
ggucugcugaacuuuacuguuccucugggaaaggagcagggaccucuggaauucccaucuguuu

SEQ ID NO: 416992 - RNA, 64 nt, hsa
ugcagggugggauuugagcugugaguugguaacuagcagggagaaauauuaacuuuuuuaaccc

SEQ ID NO: 416993 - RNA, 64 nt, hsa
gauucuagaaucugugcccugggaagggagaaacagcagggaagaggggcaauacaacaggguc

SEQ ID NO: 416994 - RNA, 64 nt, hsa
ccccucuggccaggacugaggaggaguggagggaagcagggagggagggagcaagugugaaggg

SEQ ID NO: 416995 - RNA, 64 nt, hsa
uauguugguaacuacccaccaagagcacauggguagcagggaagaaguaaaaaaagagaaggag

SEQ ID NO: 416996 - RNA, 64 nt, hsa
gaaagaaacuacuaccuaggagaaucuaagcuauagcagggaugauuuaugcaaauuugaacua

SEQ ID NO: 416997 - RNA, 64 nt, hsa
aucuugcagccguguggagccugggacuuugagcagcagggagugcauuugcuggggugucggg

SEQ ID NO: 416998 - RNA, 64 nt, hsa
ggaugcccccgcgagccccagcgcccuggcagucagcagggauggccgccugcuggccuuugug

SEQ ID NO: 416999 - RNA, 64 nt, hsa
aguacaguggggucaccuguuguuucuauacaacagcagggaaggggccauggagcuuuucccu

SEQ ID NO: 417000 - RNA, 64 nt, hsa
gcagggguccugaccuaccucagguggaacggugagcagggaacaugucggaguccuucagaga

SEQ ID NO: 417001 - RNA, 64 nt, hsa
augacucagcagagaugacucagcacugucccuuagcagggaugacacagcaaggaugacucag

SEQ ID NO: 417002 - RNA, 64 nt, hsa
gacaugacucagggauggcuuaguacugccccucagcagggaugacucagcaccgccucucaac

SEQ ID NO: 417003 - RNA, 64 nt, hsa
augacucagcaccgccucucaacagggaugacucagcagggaugacucagcaccgccccucaac

SEQ ID NO: 417004 - RNA, 64 nt, hsa
augacucugcagagaugacucagcacugucccuuagcagggaugacacagcaaggaugacucag

SEQ ID NO: 417005 - RNA, 64 nt, hsa
auggcuuaguacugccccucaacagggaugacucagcagggaugacucagcaccgccccucaac

SEQ ID NO: 417006 - RNA, 64 nt, hsa
augacucugcagagaugacuuaguacugccccucagcagggaugacucaguacugccccucagc

SEQ ID NO: 417007 - RNA, 64 nt, hsa
gccccucagcagggaugacucaguacugccccucagcagggaugacucagcacugccccucaac

SEQ ID NO: 417008 - RNA, 64 nt, hsa
augacucagcacugccccucaacagggaugacucagcagggaugacucagcacugucccuuagc

SEQ ID NO: 417009 - RNA, 64 nt, hsa
gacaugacucagggauggcuuaguacugccccucagcagggaugacucagcaccgccccucaac

SEQ ID NO: 417010 - RNA, 64 nt, hsa
augacucagcacugccccucaacagggaugacucagcagggaugacucagcagugucccuuagc

SEQ ID NO: 417011 - RNA, 64 nt, hsa
gacaugacucagggauggcuuaguacugccccucagcagggaugacucagcagggaugacucag

SEQ ID NO: 417012 - RNA, 64 nt, hsa
auggcuuaguacugccccucagcagggaugacucagcagggaugacucagcaccaccccucaac

SEQ ID NO: 417013 - RNA, 64 nt, hsa
augacucagcaccaccccucaacagggaugacucagcagggaugacucagcacugccccucaac

SEQ ID NO: 417014 - RNA, 64 nt, hsa
ggaugacugcagggaugacucagcacugccccucagcagggaugacucagcacugccccucagc

SEQ ID NO: 417015 - RNA, 64 nt, hsa
gccccucagcagggaugacucagcacugccccucagcagggaugacucagcagggaugacucag

SEQ ID NO: 417016 - RNA, 64 nt, hsa
augacucagcacugccccucagcagggaugacucagcagggaugacucagcaccgccccucaac

SEQ ID NO: 417017 - RNA, 64 nt, hsa
augacucugcagagaugacucagcacugccccucagcagggauggcucagcagggaugacucag

SEQ ID NO: 417018 - RNA, 64 nt, hsa
augacucagcacugccccucagcagggauggcucagcagggaugacucagcauugccccucaac

SEQ ID NO: 417019 - RNA, 64 nt, hsa
cauugccccucaacagggaugacucagcagacucagcagggaugacucagcacugccccucaac

SEQ ID NO: 417020 - RNA, 64 nt, hsa
augacucagcacugccccucaacagacaugacucagcagggaugacucagcaccgccccucagc

SEQ ID NO: 417021 - RNA, 64 nt, hsa
augacucagcaccgccccucagcaaggaugacucagcagggaugauucagcagagauaacucgg

SEQ ID NO: 417022 - RNA, 64 nt, hsa
agagauaacucggggaugacucugauuguccuucagcagggaugagucuguuuugcuccgaugg

SEQ ID NO: 417023 - RNA, 64 nt, hsa
gggcauuaagucuaagagagaggagccuggaagcagcagggagcagccugggucucugucccag

SEQ ID NO: 417024 - RNA, 64 nt, hsa
ccccuaugccuuguuccgagcacgaagaaacagcagcagggaugucuaccagccaccucucacc

SEQ ID NO: 417025 - RNA, 64 nt, hsa
gcugccucugagugugguguugaacuucgggaggagcagggagcccugcaccuuguguccuggc

SEQ ID NO: 417026 - RNA, 64 nt, hsa
aguauuuaaaggaugauagagaccaucagauagaagcagggaagguagauaacuuuuaggaccu

SEQ ID NO: 417027 - RNA, 64 nt, hsa
uaggugguggccugugccgucauccccauuucaaagcagggagcugagguccugggaggggaaa

SEQ ID NO: 417028 - RNA, 64 nt, hsa
gccccucuucugguggcucuaggaauugggguucagcagggaccaaaggaaaggaggaggugcc

SEQ ID NO: 417029 - RNA, 64 nt, hsa
gcagggucugucauggaacaucccaagucugugcagcagggagccccaugccccugggacauga

SEQ ID NO: 417030 - RNA, 64 nt, hsa
cggggguugcucauggagcauccugaggccgugcagcagggagccccaugccccugggucguga

SEQ ID NO: 417031 - RNA, 64 nt, hsa
ccuuuccuguugucacauggguucagagcagcugagcagggaacacguccuaggcaggucugac

SEQ ID NO: 417032 - RNA, 64 nt, hsa
ggaugggcaugagcgaaggcuccaggguccacagagcagggaguguggagaagguggaagagcu

SEQ ID NO: 417033 - RNA, 64 nt, hsa; identical to SEQ ID NO: 99488

SEQ ID NO: 417034 - RNA, 64 nt, hsa; identical to SEQ ID NO: 99489

SEQ ID NO: 417035 - RNA, 64 nt, hsa; identical to SEQ ID NO: 99490

SEQ ID NO: 417036 - RNA, 64 nt, hsa; identical to SEQ ID NO: 99491

SEQ ID NO: 417037 - RNA, 64 nt, hsa; identical to SEQ ID NO: 99492

SEQ ID NO: 417038 - RNA, 64 nt, hsa; identical to SEQ ID NO: 99493

SEQ ID NO: 417039 - RNA, 64 nt, hsa; identical to SEQ ID NO: 99494

SEQ ID NO: 417040 - RNA, 64 nt, hsa; identical to SEQ ID NO: 99495

SEQ ID NO: 417041 - RNA, 55 nt, hsa; identical to SEQ ID NO: 194635

SEQ ID NO: 417042 - RNA, 64 nt, hsa
agcccagcugcccagcccugcccccccuccccauagccagcacagcuaucccgcggggacacca

SEQ ID NO: 417043 - RNA, 64 nt, hsa
ccagcacugcacagacagcugcgaccaggacgucagccagcacugcacagacagcugcgaccag

SEQ ID NO: 417044 - RNA, 64 nt, hsa
guuucccugugaggccgugguuagcguggacaucagccagcacugcacagacagcugcgaccag

SEQ ID NO: 417045 - RNA, 64 nt, hsa
aaguggaggagggacgagggacagggguuucaccagccagcaaccugggccuuguacugucugu

SEQ ID NO: 417046 - RNA, 64 nt, hsa
cuccaggaccucucccggaucugucuccuccucuagccagcaguauggacagcuggaccccuga

SEQ ID NO: 417047 - RNA, 64 nt, hsa
agugacuccacucugagucccagagccaaucaguagccagcaucugccuccccuucacucccac

SEQ ID NO: 417048 - RNA, 64 nt, hsa
caaaauaagcaggcgugaccugccaggcacacugagccagcagccuggcucucccagccagguu

SEQ ID NO: 417049 - RNA, 64 nt, hsa
gacugagacaagcagggcuugaugcuggugguggagccagcaucucaccugccaggcuuccuuu

SEQ ID NO: 417050 - RNA, 64 nt, hsa
ggggaagcaggauacccuggcgggccacccugccagccagcagcuggcccuccaccaucuucac

SEQ ID NO: 417051 - RNA, 64 nt, hsa
ugagucccagauacacucaugggcugcccugggcagccagcauucauuguaaguucccucuuug

SEQ ID NO: 417052 - RNA, 64 nt, hsa
cuguuacuuugggauagguugcaguaccagccacagccagcagauagaggaaaagacacacaua

SEQ ID NO: 417053 - RNA, 64 nt, hsa
cucuugcccucccugccucuuuggugcucuuaaaagccagcagcugagaacauagcacaggccc

SEQ ID NO: 417054 - RNA, 64 nt, hsa
gauaagugugcaguuucuagugcugggaagucuuagccagcaccagagcgccaggccucucccu

SEQ ID NO: 417055 - RNA, 64 nt, hsa
aauaauccaggcuucagcaacacuccucuuucccagccagcaaaggcugugaauuugaauucuu

SEQ ID NO: 417056 - RNA, 64 nt, hsa
acacuaacagcugggagaggggagccagcuguccagccagcauguuccuguuguacagcccggu

SEQ ID NO: 417057 - RNA, 64 nt, hsa
guccugggccccauccuugagggccuucccagccagccagcaggagaggcaagaacugggggaa

SEQ ID NO: 417058 - RNA, 64 nt, hsa
uggcuuucccucccuccuugccccauccugggccagccagcagggcuccuccucuggcucuuca

SEQ ID NO: 417059 - RNA, 64 nt, hsa
uccucugugggagcagacccgugggccucagggcagccagcaggcaggucuuguugccaauuua

SEQ ID NO: 417060 - RNA, 64 nt, hsa
cugccuccggcccugccccacacaggccuggcccagccagcagguucucuccugugagcucccc

SEQ ID NO: 417061 - RNA, 64 nt, hsa
ggacuccuuguuugccuuuaggcaggaagucaggagccagcagggcgggccaggagaaagaagg

SEQ ID NO: 417062 - RNA, 64 nt, hsa
cggcaggaggggugggaccaggcugggaggacagagccagcagcugccaugcccuccugcuccc

SEQ ID NO: 417063 - RNA, 64 nt, hsa
caaauacuggccaaggucaggaggagcaaaaaugagccagcaccagcgccuuggcuuuguguua

SEQ ID NO: 417064 - RNA, 64 nt, hsa
cugguccaccucucauugcaagccccaagcacugagccagcaggugccagggagccacccgccc

SEQ ID NO: 417065 - RNA, 64 nt, hsa
ccauuuagcccugcacagcggucuccuuccccuaagccagcacugcugcucccuggagcccggg

SEQ ID NO: 417066 - RNA, 64 nt, hsa
ggagggcucugcuccacccacuuggcuaugggagagccagcagggguucuggagaaagaaacug

SEQ ID NO: 417067 - RNA, 64 nt, hsa
cccggcucuccucccagcaucacaccagccaugcagccagcagguccuccggaucacugugguu

SEQ ID NO: 417068 - RNA, 64 nt, hsa
cuggccgaggggcggaggcacagcugcuuccagcagccagcauucaguggccuugucaccaagc

SEQ ID NO: 417069 - RNA, 64 nt, hsa
ggcuucuguggcaggacuggcccagggaggaggaagccagcagcacaccuggggaauggggucc

SEQ ID NO: 417070 - RNA, 64 nt, hsa
guguaagcccugcuuagcucaucuuagagcaaagagccagcacccugaugucccugggguggcu

SEQ ID NO: 417071 - RNA, 64 nt, hsa
ugggaaugcugcccgcucugcagacugcugcuagagccagcaacuccacuaagguggauuuuca

SEQ ID NO: 417072 - RNA, 64 nt, hsa
gugagaaaggaaaaggcaugaaguucuauaccucagccagcagcugccuucguuuggaacugaa

SEQ ID NO: 417073 - RNA, 64 nt, hsa
agccagcagcugccuucguuuggaacugaaguccagccagcagacucucuagcuccaucucccc

SEQ ID NO: 417074 - RNA, 64 nt, hsa
ucuuggccccaagguugccccgggccagcagcccagccagcagcacagucucuauggugcugag

SEQ ID NO: 417075 - RNA, 64 nt, hsa
gggaggaggacaugguggagaccagggacaggagagccagcaggguggaugcaaggggccucua

SEQ ID NO: 417076 - RNA, 64 nt, hsa
cuuggccucccagaaugcuggguuuauagaugugagccagcacaccgggccaagugaagaaucu

SEQ ID NO: 417077 - RNA, 64 nt, hsa
agggagacuuucugaaguagccugaucuuucuagagccagcaguacguggcuucagaggccugg

SEQ ID NO: 417078 - RNA, 64 nt, hsa
agugcugggauuacaggcaugagccaccaugccuagccagcaagcaucauuucuauuauaccuu

SEQ ID NO: 417079 - RNA, 64 nt, hsa
cacaccucucaccuccaccaccccucccugucccagccagcaucaucucuuuggggaccacucc

SEQ ID NO: 417080 - RNA, 64 nt, hsa
cccccaucucaugccccuggcugggacguggcucagccagcacuuguccagcugagcgccagga

SEQ ID NO: 417081 - RNA, 64 nt, hsa
ucaaagaggcugaggcuggcacaggacaugcgguagccagcacacagggcagugagggagggcu

SEQ ID NO: 417082 - RNA, 64 nt, hsa; identical to SEQ ID NO: 193284

SEQ ID NO: 417083 - RNA, 64 nt, hsa; identical to SEQ ID NO: 193285

SEQ ID NO: 417084 - RNA, 64 nt, hsa; identical to SEQ ID NO: 193286

SEQ ID NO: 417085 - RNA, 64 nt, hsa; identical to SEQ ID NO: 193287

SEQ ID NO: 417086 - RNA, 64 nt, hsa; identical to SEQ ID NO: 193288

SEQ ID NO: 417087 - RNA, 64 nt, hsa; identical to SEQ ID NO: 193289

SEQ ID NO: 417088 - RNA, 64 nt, hsa; identical to SEQ ID NO: 193290

SEQ ID NO: 417089 - RNA, 64 nt, hsa; identical to SEQ ID NO: 193291

SEQ ID NO: 417090 - RNA, 64 nt, hsa; identical to SEQ ID NO: 193292

SEQ ID NO: 417091 - RNA, 64 nt, hsa; identical to SEQ ID NO: 193293

SEQ ID NO: 417092 - RNA, 64 nt, hsa; identical to SEQ ID NO: 193294

SEQ ID NO: 417093 - RNA, 64 nt, hsa; identical to SEQ ID NO: 193295

SEQ ID NO: 417094 - RNA, 64 nt, hsa; identical to SEQ ID NO: 193296

SEQ ID NO: 417095 - RNA, 64 nt, hsa; identical to SEQ ID NO: 193297

SEQ ID NO: 417096 - RNA, 64 nt, hsa; identical to SEQ ID NO: 193298

SEQ ID NO: 417097 - RNA, 64 nt, hsa; identical to SEQ ID NO: 193299

SEQ ID NO: 417098 - RNA, 64 nt, hsa; identical to SEQ ID NO: 193300

SEQ ID NO: 417099 - RNA, 64 nt, hsa; identical to SEQ ID NO: 193301

SEQ ID NO: 417100 - RNA, 64 nt, hsa; identical to SEQ ID NO: 193302

SEQ ID NO: 417101 - RNA, 64 nt, hsa; identical to SEQ ID NO: 193303

SEQ ID NO: 417102 - RNA, 64 nt, hsa; identical to SEQ ID NO: 193304

SEQ ID NO: 417103 - RNA, 64 nt, hsa; identical to SEQ ID NO: 193305

SEQ ID NO: 417104 - RNA, 64 nt, hsa; identical to SEQ ID NO: 193306

SEQ ID NO: 417105 - RNA, 64 nt, hsa; identical to SEQ ID NO: 193307

SEQ ID NO: 417106 - RNA, 64 nt, hsa; identical to SEQ ID NO: 193308

SEQ ID NO: 417107 - RNA, 64 nt, hsa; identical to SEQ ID NO: 193309

SEQ ID NO: 417108 - RNA, 64 nt, hsa; identical to SEQ ID NO: 193310

SEQ ID NO: 417109 - RNA, 64 nt, hsa; identical to SEQ ID NO: 193311

SEQ ID NO: 417110 - RNA, 64 nt, hsa; identical to SEQ ID NO: 193312

SEQ ID NO: 417111 - RNA, 64 nt, hsa; identical to SEQ ID NO: 193313

SEQ ID NO: 417112 - RNA, 64 nt, hsa; identical to SEQ ID NO: 103765

SEQ ID NO: 417113 - RNA, 64 nt, hsa; identical to SEQ ID NO: 103766

SEQ ID NO: 417114 - RNA, 53 nt, hsa; identical to SEQ ID NO: 103767

SEQ ID NO: 417115 - RNA, 64 nt, hsa; identical to SEQ ID NO: 103768

SEQ ID NO: 417116 - RNA, 64 nt, hsa; identical to SEQ ID NO: 103769

SEQ ID NO: 417117 - RNA, 64 nt, hsa; identical to SEQ ID NO: 103770

SEQ ID NO: 417118 - RNA, 53 nt, hsa; identical to SEQ ID NO: 103771

SEQ ID NO: 417119 - RNA, 64 nt, hsa; identical to SEQ ID NO: 103772

SEQ ID NO: 417120 - RNA, 64 nt, hsa; identical to SEQ ID NO: 103773

SEQ ID NO: 417121 - RNA, 64 nt, hsa; identical to SEQ ID NO: 103774

SEQ ID NO: 417122 - RNA, 64 nt, hsa; identical to SEQ ID NO: 103775

SEQ ID NO: 417123 - RNA, 64 nt, hsa; identical to SEQ ID NO: 103776

SEQ ID NO: 417124 - RNA, 64 nt, hsa; identical to SEQ ID NO: 113335

SEQ ID NO: 417125 - RNA, 64 nt, hsa; identical to SEQ ID NO: 113336

SEQ ID NO: 417126 - RNA, 64 nt, hsa; identical to SEQ ID NO: 113337

SEQ ID NO: 417127 - RNA, 64 nt, hsa; identical to SEQ ID NO: 113338

SEQ ID NO: 417128 - RNA, 64 nt, hsa; identical to SEQ ID NO: 113339

SEQ ID NO: 417129 - RNA, 64 nt, hsa; identical to SEQ ID NO: 113340

SEQ ID NO: 417130 - RNA, 64 nt, hsa; identical to SEQ ID NO: 113341

SEQ ID NO: 417131 - RNA, 64 nt, hsa; identical to SEQ ID NO: 113342

SEQ ID NO: 417132 - RNA, 64 nt, hsa; identical to SEQ ID NO: 113343

SEQ ID NO: 417133 - RNA, 64 nt, hsa; identical to SEQ ID NO: 113344

SEQ ID NO: 417134 - RNA, 64 nt, hsa; identical to SEQ ID NO: 113345

SEQ ID NO: 417135 - RNA, 64 nt, hsa; identical to SEQ ID NO: 113346

SEQ ID NO: 417136 - RNA, 64 nt, hsa; identical to SEQ ID NO: 113347

SEQ ID NO: 417137 - RNA, 64 nt, hsa; identical to SEQ ID NO: 113348

SEQ ID NO: 417138 - RNA, 64 nt, hsa; identical to SEQ ID NO: 113349

SEQ ID NO: 417139 - RNA, 64 nt, hsa; identical to SEQ ID NO: 113350

SEQ ID NO: 417140 - RNA, 64 nt, hsa; identical to SEQ ID NO: 113351

SEQ ID NO: 417141 - RNA, 64 nt, hsa; identical to SEQ ID NO: 113352

SEQ ID NO: 417142 - RNA, 64 nt, hsa; identical to SEQ ID NO: 113353

SEQ ID NO: 417143 - RNA, 64 nt, hsa; identical to SEQ ID NO: 113354

SEQ ID NO: 417144 - RNA, 64 nt, hsa
gcaggucugugauuugggggauagaaaacaaaguaccuaugaaacgggauaucuggauuuuacu

SEQ ID NO: 417145 - RNA, 64 nt, hsa
caggagaagaagaucuaucagcuggcuuuuaaagaccuaugacaacaugaaagugguguucagc

SEQ ID NO: 417146 - RNA, 64 nt, hsa; identical to SEQ ID NO: 155068

SEQ ID NO: 417147 - RNA, 64 nt, hsa; identical to SEQ ID NO: 155069

SEQ ID NO: 417148 - RNA, 64 nt, hsa; identical to SEQ ID NO: 155070

SEQ ID NO: 417149 - RNA, 64 nt, hsa; identical to SEQ ID NO: 155071

SEQ ID NO: 417150 - RNA, 64 nt, hsa; identical to SEQ ID NO: 155072

SEQ ID NO: 417151 - RNA, 64 nt, hsa; identical to SEQ ID NO: 155073

SEQ ID NO: 417152 - RNA, 64 nt, hsa; identical to SEQ ID NO: 155074

SEQ ID NO: 417153 - RNA, 64 nt, hsa; identical to SEQ ID NO: 155075

SEQ ID NO: 417154 - RNA, 64 nt, hsa; identical to SEQ ID NO: 155076

SEQ ID NO: 417155 - RNA, 64 nt, hsa; identical to SEQ ID NO: 155077

SEQ ID NO: 417156 - RNA, 64 nt, hsa; identical to SEQ ID NO: 155078

SEQ ID NO: 417157 - RNA, 64 nt, hsa; identical to SEQ ID NO: 155079

SEQ ID NO: 417158 - RNA, 64 nt, hsa; identical to SEQ ID NO: 155080

SEQ ID NO: 417159 - RNA, 64 nt, hsa; identical to SEQ ID NO: 155081

SEQ ID NO: 417160 - RNA, 64 nt, hsa; identical to SEQ ID NO: 155082

SEQ ID NO: 417161 - RNA, 64 nt, hsa; identical to SEQ ID NO: 155083

SEQ ID NO: 417162 - RNA, 64 nt, hsa; identical to SEQ ID NO: 155084

SEQ ID NO: 417163 - RNA, 64 nt, hsa; identical to SEQ ID NO: 155085

SEQ ID NO: 417164 - RNA, 64 nt, hsa; identical to SEQ ID NO: 155086

SEQ ID NO: 417165 - RNA, 64 nt, hsa; identical to SEQ ID NO: 155087

SEQ ID NO: 417166 - RNA, 64 nt, hsa; identical to SEQ ID NO: 155088

SEQ ID NO: 417167 - RNA, 64 nt, hsa; identical to SEQ ID NO: 155089

SEQ ID NO: 417168 - RNA, 64 nt, hsa; identical to SEQ ID NO: 155090

SEQ ID NO: 417169 - RNA, 64 nt, hsa; identical to SEQ ID NO: 155091

SEQ ID NO: 417170 - RNA, 64 nt, hsa; identical to SEQ ID NO: 155092

SEQ ID NO: 417171 - RNA, 64 nt, hsa; identical to SEQ ID NO: 155093

SEQ ID NO: 417172 - RNA, 64 nt, hsa; identical to SEQ ID NO: 155094

SEQ ID NO: 417173 - RNA, 64 nt, hsa; identical to SEQ ID NO: 155095

SEQ ID NO: 417174 - RNA, 64 nt, hsa; identical to SEQ ID NO: 155096

SEQ ID NO: 417175 - RNA, 64 nt, hsa; identical to SEQ ID NO: 155097

SEQ ID NO: 417176 - RNA, 64 nt, hsa; identical to SEQ ID NO: 155098

SEQ ID NO: 417177 - RNA, 64 nt, hsa; identical to SEQ ID NO: 155099

SEQ ID NO: 417178 - RNA, 64 nt, hsa; identical to SEQ ID NO: 155100

SEQ ID NO: 417179 - RNA, 64 nt, hsa; identical to SEQ ID NO: 155101

SEQ ID NO: 417180 - RNA, 64 nt, hsa; identical to SEQ ID NO: 155102

SEQ ID NO: 417181 - RNA, 64 nt, hsa; identical to SEQ ID NO: 285036

SEQ ID NO: 417182 - RNA, 64 nt, hsa; identical to SEQ ID NO: 285037

SEQ ID NO: 417183 - RNA, 64 nt, hsa; identical to SEQ ID NO: 285038

SEQ ID NO: 417184 - RNA, 64 nt, hsa; identical to SEQ ID NO: 285039

SEQ ID NO: 417185 - RNA, 64 nt, hsa; identical to SEQ ID NO: 285040

SEQ ID NO: 417186 - RNA, 64 nt, hsa; identical to SEQ ID NO: 285041

SEQ ID NO: 417187 - RNA, 64 nt, hsa; identical to SEQ ID NO: 285042

SEQ ID NO: 417188 - RNA, 64 nt, hsa; identical to SEQ ID NO: 285043

SEQ ID NO: 417189 - RNA, 64 nt, hsa; identical to SEQ ID NO: 285044

SEQ ID NO: 417190 - RNA, 64 nt, hsa; identical to SEQ ID NO: 285045

SEQ ID NO: 417191 - RNA, 64 nt, hsa; identical to SEQ ID NO: 285046

SEQ ID NO: 417192 - RNA, 64 nt, hsa; identical to SEQ ID NO: 285047

SEQ ID NO: 417193 - RNA, 64 nt, hsa; identical to SEQ ID NO: 285048

SEQ ID NO: 417194 - RNA, 64 nt, hsa; identical to SEQ ID NO: 285049

SEQ ID NO: 417195 - RNA, 64 nt, hsa; identical to SEQ ID NO: 285050

SEQ ID NO: 417196 - RNA, 64 nt, hsa; identical to SEQ ID NO: 285051

SEQ ID NO: 417197 - RNA, 64 nt, hsa; identical to SEQ ID NO: 285052

SEQ ID NO: 417198 - RNA, 64 nt, hsa; identical to SEQ ID NO: 285053

SEQ ID NO: 417199 - RNA, 64 nt, hsa; identical to SEQ ID NO: 285054

SEQ ID NO: 417200 - RNA, 64 nt, hsa; identical to SEQ ID NO: 285055

SEQ ID NO: 417201 - RNA, 64 nt, hsa; identical to SEQ ID NO: 285056

SEQ ID NO: 417202 - RNA, 64 nt, hsa; identical to SEQ ID NO: 285057

SEQ ID NO: 417203 - RNA, 64 nt, hsa; identical to SEQ ID NO: 105601

SEQ ID NO: 417204 - RNA, 64 nt, hsa; identical to SEQ ID NO: 105602

SEQ ID NO: 417205 - RNA, 64 nt, hsa; identical to SEQ ID NO: 105603

SEQ ID NO: 417206 - RNA, 64 nt, hsa; identical to SEQ ID NO: 105604

SEQ ID NO: 417207 - RNA, 64 nt, hsa; identical to SEQ ID NO: 105605

SEQ ID NO: 417208 - RNA, 64 nt, hsa; identical to SEQ ID NO: 105606

SEQ ID NO: 417209 - RNA, 64 nt, hsa; identical to SEQ ID NO: 105607

SEQ ID NO: 417210 - RNA, 64 nt, hsa; identical to SEQ ID NO: 105608

SEQ ID NO: 417211 - RNA, 64 nt, hsa; identical to SEQ ID NO: 105609

SEQ ID NO: 417212 - RNA, 64 nt, hsa; identical to SEQ ID NO: 105610

SEQ ID NO: 417213 - RNA, 64 nt, hsa; identical to SEQ ID NO: 105611

SEQ ID NO: 417214 - RNA, 64 nt, hsa; identical to SEQ ID NO: 105612

SEQ ID NO: 417215 - RNA, 64 nt, hsa; identical to SEQ ID NO: 105613

SEQ ID NO: 417216 - RNA, 64 nt, hsa; identical to SEQ ID NO: 105614

SEQ ID NO: 417217 - RNA, 64 nt, hsa; identical to SEQ ID NO: 53685

SEQ ID NO: 417218 - RNA, 64 nt, hsa; identical to SEQ ID NO: 53686

SEQ ID NO: 417219 - RNA, 64 nt, hsa; identical to SEQ ID NO: 53687

SEQ ID NO: 417220 - RNA, 64 nt, hsa; identical to SEQ ID NO: 53688

SEQ ID NO: 417221 - RNA, 64 nt, hsa; identical to SEQ ID NO: 53689

SEQ ID NO: 417222 - RNA, 64 nt, hsa; identical to SEQ ID NO: 53690

SEQ ID NO: 417223 - RNA, 64 nt, hsa; identical to SEQ ID NO: 53691

SEQ ID NO: 417224 - RNA, 64 nt, hsa; identical to SEQ ID NO: 53692

SEQ ID NO: 417225 - RNA, 64 nt, hsa; identical to SEQ ID NO: 53693

SEQ ID NO: 417226 - RNA, 64 nt, hsa; identical to SEQ ID NO: 53694

SEQ ID NO: 417227 - RNA, 64 nt, hsa; identical to SEQ ID NO: 53695

SEQ ID NO: 417228 - RNA, 64 nt, hsa; identical to SEQ ID NO: 53696

SEQ ID NO: 417229 - RNA, 64 nt, hsa
uucuaccuguguucuguuccagcgaauugggaagucucaccaagcuagauugucuaccaucagc

SEQ ID NO: 417230 - RNA, 64 nt, hsa
aggggagugggaauaaaauguugccuuccccacuucucaccaccaccgccaucaugacgcucau

SEQ ID NO: 417231 - RNA, 64 nt, hsa
uaucucuagcaucaggugcuagacaugguuagaaucucaccaugguuuagugacugguagauag

SEQ ID NO: 417232 - RNA, 64 nt, hsa
ucuaggguuaaggauuaaggccugggaauuggagucucaccauggcuccccuuccuugucuggg

SEQ ID NO: 417233 - RNA, 64 nt, hsa
gcuguggcaccccaucgccccacagcucguaccuucucaccagauuccccugaauccaaacucg

SEQ ID NO: 417234 - RNA, 64 nt, hsa
ggucccucuauuuauuucucaacccuggcuggccucucaccaggaguuuaggcugaaugccuuc

SEQ ID NO: 417235 - RNA, 64 nt, hsa
ucuuuuucugucaugcccugggggcuucugcucuucucaccagaaagaacauuugaaucuggau

SEQ ID NO: 417236 - RNA, 64 nt, hsa
ccuguuauccuguuaucuacugagaccccaaauuucucaccaauguuuugggagauccuggaaa

SEQ ID NO: 417237 - RNA, 64 nt, hsa
ugcugagagcauccagaaacuuccagaccagcccucucaccacacccagaagaggccuuuccca

SEQ ID NO: 417238 - RNA, 64 nt, hsa
uucucaccuggagagaaauuuccagaccauccccucucaccacagccaggagaggccuuuccca

SEQ ID NO: 417239 - RNA, 64 nt, hsa
uucccaccuggacagaaacuuccagaccagccccucucaccacagccaggagaggccuuuacca

SEQ ID NO: 417240 - RNA, 64 nt, hsa
uucccaccuggagagaaacuuccagaccagccccucucaccacagccaggagaggccguuccca

SEQ ID NO: 417241 - RNA, 64 nt, hsa
cugcucugauguccucgcucccuccauuccugccucucaccaugcacgcauccauuguccacac

SEQ ID NO: 417242 - RNA, 64 nt, hsa
agccgcaucacccuguugcuuccuucacagcaugucucaccaucugcaaccaucuuucuguuug

SEQ ID NO: 417243 - RNA, 64 nt, hsa
cacaccacaccgcacugcaccauaccucaccacaucucaccacaccacagcacaccucaccaca

SEQ ID NO: 417244 - RNA, 64 nt, hsa
ugcaccgcaccgcaccgcaccguaccucgccacaucucaccacaccacaccacaccacaccuca

SEQ ID NO: 417245 - RNA, 64 nt, hsa
acccacaaaugcccaugacugugcccaaugugcuucucaccagagcccugcaaggggaagucuc

SEQ ID NO: 417246 - RNA, 64 nt, hsa
uaaauuaaaaaaaugguuuuuuguagagaugaggucucaccauguugcccaggcuggucuugaa

SEQ ID NO: 417247 - RNA, 64 nt, hsa
ucuuguuccugacucugacaagaaagcauaagucucucaccauuuagugugauuuuagcugugg

SEQ ID NO: 417248 - RNA, 64 nt, hsa
caccuucgcuucucucaccaggaacauucgcuucucucaccaggaacauuuaugguaguaugag

SEQ ID NO: 417249 - RNA, 64 nt, hsa
gguggcugagccaggagaugcacaccuucgcuucucucaccaggaacauucgcuucucucacca

SEQ ID NO: 417250 - RNA, 64 nt, hsa
acugacugacuaggcauuauuuucuauacaucccucucaccagugaaaagauuccucuugcugc

SEQ ID NO: 417251 - RNA, 64 nt, hsa
agaacuaugguaacagauguuaauaguugcagggucucaccacuucauuagauaaguguugucu

SEQ ID NO: 417252 - RNA, 64 nt, hsa
ccagcugugguuguugaacucggaggugagcuccucucaccacucucuugaauaaagcuuuucu

SEQ ID NO: 417253 - RNA, 64 nt, hsa
gagcuccucucaccacucucuugaauaaagcuuuucucaccauuuuaacaaguccucagaauca

SEQ ID NO: 417254 - RNA, 64 nt, hsa
ucuuucuauugaaaugucaauucaaucccagcuuucucaccaccguuccccuuugauucuuucu

SEQ ID NO: 417255 - RNA, 64 nt, hsa
cuagaucccuggggccucacccuguauuugagguucucaccacccucagcagggagaagggcug

SEQ ID NO: 417256 - RNA, 64 nt, hsa
uuuguuuucaaaggcuuugcacuggagaagauauguguagaauuuuuguuuuauuuuuaaaaug

SEQ ID NO: 417257 - RNA, 64 nt, hsa
uucugauugcaugacuauuauuuaucuucuuuuaguguagaaaauaauuuuuuacaaaaaguca

SEQ ID NO: 417258 - RNA, 64 nt, hsa
ccccacucccguuccguaguguagaagcccacagguguagaacucagucuuaaacuucaguaug

SEQ ID NO: 417259 - RNA, 64 nt, hsa
auaagcuuuucagcccccccacucccguuccguaguguagaagcccacagguguagaacucagu

SEQ ID NO: 417260 - RNA, 64 nt, hsa
caucaguuaccagcacauuuugaaccccugcucuguguagaauguugaacuagaugcuucccgc

SEQ ID NO: 417261 - RNA, 64 nt, hsa
guugaggaaagauaaaaauguaugcaauuccugaguguagaaacuucuugcacuuauuuaaaau

SEQ ID NO: 417262 - RNA, 64 nt, hsa
uuguuuucucuccuaaaaauuugcacacuacuucauugucuaccaacuuuuuacauauuggaaa

SEQ ID NO: 417263 - RNA, 64 nt, hsa
ucucacuguuauguugaauaauaauuagcauauaauugucuacagaagcaagagcaaucuggaa

SEQ ID NO: 417264 - RNA, 64 nt, hsa
auuaagugugaguaaaguuaguaucauuaaacaaauugucuauuaaaugcaagacgugguaaua

SEQ ID NO: 417265 - RNA, 64 nt, hsa
uuuauauauuuugucucaaaaguggaaaaauuauauugucuaauuaugaugaauuauuuucuug

SEQ ID NO: 417266 - RNA, 64 nt, hsa
gauuuccccagugaaaagggagaagagccaaaguauugucuaggugcugaguucccuuuucuga

SEQ ID NO: 417267 - RNA, 64 nt, hsa
agccacaguugugaaaauaaauggaaguugguugauugucuagaaagugcaagaagauggcccu

SEQ ID NO: 417268 - RNA, 64 nt, hsa
ggcccuuucugaaucaaagugcggcaaaguaaauauugucuaagcuuuaauccacuguguuagg

SEQ ID NO: 417269 - RNA, 64 nt, hsa
aucucccaaaaauaucacauccucuugaaaaugaauugucuacaaaauuucaaaugcaaaguau

SEQ ID NO: 417270 - RNA, 64 nt, hsa
guaucucuuuuucagagucugguuaagcuaugucauugucuacugcauaguuuccugagucugu

SEQ ID NO: 417271 - RNA, 64 nt, hsa
uucacugacaguaaugacaaauuuaauguauguaauugucuaugcauuuuaaguuaaacugccu

SEQ ID NO: 417272 - RNA, 64 nt, hsa
agcaucaacgcugaguugugccuuguagaauugcauugucuauacaugcaaaagacuauuaagu

SEQ ID NO: 417273 - RNA, 64 nt, hsa
uaaauuagacauugucuuuaccuuaaagaagaaaauugucuauuucagugucuuuuuuagcaag

SEQ ID NO: 417274 - RNA, 64 nt, hsa
acuggcauugggcuccccagccggaacugguuaccaaggacaaggacacucugacauucggcuu

SEQ ID NO: 417275 - RNA, 64 nt, hsa
auugggcuccccagccggaacugguuaccaaggacaaggacacucugacauucggcuugaucca

SEQ ID NO: 417276 - RNA, 64 nt, hsa
cauuccacacaggcacugccccaggacaacacaacaaggacagucacaacaaggacaacaagga

SEQ ID NO: 417277 - RNA, 64 nt, hsa
cugccccaggacaacacaacaaggacagucacaacaaggacaacaaggacacaacacaacacac

SEQ ID NO: 417278 - RNA, 64 nt, hsa
gacaacacaacaaggacagucacaacaaggacaacaaggacacaacacaacacacaacaaggac

SEQ ID NO: 417279 - RNA, 64 nt, hsa
aacaaggacaacaaggacacaacacaacacacaacaaggacagucacaacaagccuagagccag

SEQ ID NO: 417280 - RNA, 64 nt, hsa
ggccccgucuccaccaaccuuugugugacaaaaacaaggacaaauuccugcuacuaagacaugc

SEQ ID NO: 417281 - RNA, 64 nt, hsa
uugccuuccgcagagaccagagaucucuguacuucaaggacagccuuggcuggcuccccaucca

SEQ ID NO: 417282 - RNA, 64 nt, hsa
ugacagaaggcguccauccauucaucucauuggccaaggacaaacucuccucugggacgucugg

SEQ ID NO: 417283 - RNA, 64 nt, hsa
acuugacagggaccuucaaaccucgacagugaugcaaggacacagagaguaccagauagguagc

SEQ ID NO: 417284 - RNA, 64 nt, hsa
accccaacgugcucaaguucaucggggugcucuacaaggacaagaggcucaacuucaucacuga

SEQ ID NO: 417285 - RNA, 64 nt, hsa
gccaguacccauggagccagagagugagcuuugccaaggacaucgcaucagggauggugaguga

SEQ ID NO: 417286 - RNA, 64 nt, hsa
guuauacaaguggauucagacugaacccccaguacaaggacauuguuuugaacuagguggacau

SEQ ID NO: 417287 - RNA, 64 nt, hsa
gcacacaguugcuguguugaguucucuuuaaaaacaaggacaaaaccaaccagcguucaaagga

SEQ ID NO: 417288 - RNA, 64 nt, hsa
ccugaacuuaagauagccacaaucagaaaaaggacaaggacaugagacaguggugauggccauc

SEQ ID NO: 417289 - RNA, 64 nt, hsa
ggagcagggcuuggagcucgggugguggagaugacaaggacacuguggggucuggguccccaga

SEQ ID NO: 417290 - RNA, 64 nt, hsa
acaggcaagaggaauuuucccucggccuuacugacaaggacaccaaccuagggugcaaacagau

SEQ ID NO: 417291 - RNA, 64 nt, hsa
accaaccuagggugcaaacagauggacuaugguucaaggacacuggaauugaggagcugaucaa

SEQ ID NO: 417292 - RNA, 64 nt, hsa
agcaugaaaaaggaagagaaaaaguuugauaugccaaggacagauuuugaaacagacuugguaa

SEQ ID NO: 417293 - RNA, 64 nt, hsa
auuuugcuaauaauauuugaaggagauugccuaccaaggacaaaacaauaaauuuaaaaaucaa

SEQ ID NO: 417294 - RNA, 64 nt, hsa
aguccugcagcuucuucuucgagucggagagcuacaaggacagcguccaggguagggugagagg

SEQ ID NO: 417295 - RNA, 64 nt, hsa
agcgcagagaaguugagaggacccaugaaggaagcaaggacacggggcaggcaccuggauguug

SEQ ID NO: 417296 - RNA, 64 nt, hsa
cacuguuguacuuccgugggcccuccuuccagaacaaggacaacaaggacaagguugaaggguc

SEQ ID NO: 417297 - RNA, 64 nt, hsa
acuuccgugggcccuccuuccagaacaaggacaacaaggacaagguugaagggucuucucaucu

SEQ ID NO: 417298 - RNA, 64 nt, hsa
uagaagccggggcggccccagcggggaggaggagcaaggacauguaccaugccagcaagagugc

SEQ ID NO: 417299 - RNA, 64 nt, hsa
ugcccaccugccagugucuugggcauuuccuuggcaaggacauuaaagugauuucaucacagug

SEQ ID NO: 417300 - RNA, 64 nt, hsa
ucuggccuggcugccuggccguggcuucucuuuggcucccaaagagaaggacaguguugggagu

SEQ ID NO: 417301 - RNA, 64 nt, hsa
caguguugggaguaucugccguggcuucucuuuggcucccaaagagaaggacaguguugggagu

SEQ ID NO: 417302 - RNA, 64 nt, hsa
gcacggcccuccuucuuuuccuaacaugcaccuugcucccaauggugcuuggagggggaagaga

SEQ ID NO: 417303 - RNA, 64 nt, hsa
ggagggggcaagcuuugcuccuucaguucugcuugcucccaagccccugacccgcucggacuua

SEQ ID NO: 417304 - RNA, 64 nt, hsa
gacagcagaauguuauaacgcaaguucauguguugcucccaacuccauucucuuuucucucgug

SEQ ID NO: 417305 - RNA, 64 nt, hsa
auuuuaaaauguauguuuccccucacuguuugcagcucccaauguugucauuuuuaaauguuau

SEQ ID NO: 417306 - RNA, 64 nt, hsa
aaucucugcuguauccuuucggcuucccaguugagcucccaagaccaggacccacuggggcaua

SEQ ID NO: 417307 - RNA, 64 nt, hsa
cuucucugcuguguccuuucggcuucccaguugagcucccaagaccaggacccacuggggcaua

SEQ ID NO: 417308 - RNA, 64 nt, hsa; identical to SEQ ID NO: 159813

SEQ ID NO: 417309 - RNA, 64 nt, hsa; identical to SEQ ID NO: 159814

SEQ ID NO: 417310 - RNA, 64 nt, hsa; identical to SEQ ID NO: 159815

SEQ ID NO: 417311 - RNA, 64 nt, hsa; identical to SEQ ID NO: 159816

SEQ ID NO: 417312 - RNA, 64 nt, hsa
ccugccauccgucuuggguucagugagcuucaaggcucacaauggaagcacugucauuucccca

SEQ ID NO: 417313 - RNA, 64 nt, hsa
gggagcccagaacccacauaaaagccccagcuuggcucacaaggcccaggagaccuccagcuaa

SEQ ID NO: 417314 - RNA, 64 nt, hsa
augcuaggccccaauguucagagcugggacuugagcucacaaaacuggggagcugagacauuug

SEQ ID NO: 417315 - RNA, 64 nt, hsa
cgcuggccugcuccuccugcagggccugugagcugcucacaacugggucaacgcuuuaggcuga

SEQ ID NO: 417316 - RNA, 64 nt, hsa
uuucuggugagggucaaauauuuuuguuaauuaagcucacaaauuugauaaauuaagaauuauc

SEQ ID NO: 417317 - RNA, 64 nt, hsa
uuuuaaaauuaaaaauaauuccgaagauacaccagcucacaaaugaaaacgucagccucugccc

SEQ ID NO: 417318 - RNA, 64 nt, hsa
aacauuucugaagaugggaaagacaaauuauguagcucacaaacugguuuauuauauauaugga

SEQ ID NO: 417319 - RNA, 64 nt, hsa
cauauagacgaggcacuuuggaaccacaagcuuggcucacaaaaagagcuuucuggguuguagg

SEQ ID NO: 417320 - RNA, 64 nt, hsa
cugugacaagucuguacuauccacuauguaaauggcucacaagucaauugcaaacaaacugaau

SEQ ID NO: 417321 - RNA, 64 nt, hsa
gugcacccuggggaggagagcucugggaacagccgcucacaauauggccaucagguaccugggg

SEQ ID NO: 417322 - RNA, 64 nt, hsa
gucuuacagaacuaagaucuuuuucagagaaauugcucacaaaaguuagugacaguuguauuua

SEQ ID NO: 417323 - RNA, 64 nt, hsa
auaucuaaaaacuuagaaacggaaauggaauccugcucacaaaaucacuuuaagaucuuuucga

SEQ ID NO: 417324 - RNA, 64 nt, hsa
ugugacucgaaauaauuaacuuugucaaaauccugcucacaauuugaagaugaaacuugucauu

SEQ ID NO: 417325 - RNA, 64 nt, hsa
cuaauacuuuuaaaagcauguguuuuguguauaugcucacaaaaugucugugaagagauuucuu

SEQ ID NO: 417326 - RNA, 64 nt, hsa
cuguuaaccaugaauuugauugugucacuucccugcucacaaucuuccaaugacuucucccucc

SEQ ID NO: 417327 - RNA, 64 nt, hsa
aagaccuucugaagaucucagauaaagugaccaggcucacaacuguuuuugaagaagggaaauu

SEQ ID NO: 417328 - RNA, 64 nt, hsa
cauguagagagagaaaaguaacuguuuugguuuugcucacaaaagucuacuuuaccuaagggcu

SEQ ID NO: 417329 - RNA, 64 nt, hsa
uucuuaucccccauacuugugaguucuugggguugcucacaaauacuagggguuuuuguuguau

SEQ ID NO: 417330 - RNA, 64 nt, hsa
cugucacuccauccccggcagggagggaccgucagcucacaaggcccucuuuguuuccugcucc

SEQ ID NO: 417331 - RNA, 64 nt, hsa
uuuucuauuuaaauccucucuacuugacucaggggcucacaagguaccauuauaugcaaaagua

SEQ ID NO: 417332 - RNA, 64 nt, hsa
ugacuuggcuaccugaaaaaucuuaggaggaauagcucacaauacaauaaaucuguagauucug

SEQ ID NO: 417333 - RNA, 64 nt, hsa
cguacauugugcccuguagcuccuuagcuaguuagcucacaagccguguuuuaugacuaauccu

SEQ ID NO: 417334 - RNA, 64 nt, hsa
cugcuagagauccaagaaggcuggcaggagugaggcucacaacucagccucgcaagagguggca

SEQ ID NO: 417335 - RNA, 64 nt, hsa
uuaacuaauuaauguuuuuuauauucuuaaauuugcucacaaauugugguuuguuacaauuaaa

SEQ ID NO: 417336 - RNA, 64 nt, hsa
augggcaggugucacaaagaagagggcccuaagggcucacaaccaaagugauccgccaagcagg

SEQ ID NO: 417337 - RNA, 64 nt, hsa
ucauuguugccucuccguuuauuauaaacuguaugcucacaacuuaguguaauauaccagcuug

SEQ ID NO: 417338 - RNA, 64 nt, hsa
gucacccaggcuggaauacagugguacagucacggcucacaaaagccuugaccuccugggcuca

SEQ ID NO: 417339 - RNA, 64 nt, hsa
gacuggguaauugauaaagaaaaagguuuguuuggcucacaauuuugcuggcuagaagguuggg

SEQ ID NO: 417340 - RNA, 64 nt, hsa
uuccaaaaugagugguuaacugggcaaaccuuaagcucacaagaguauaaaagaucucuggcuu

SEQ ID NO: 417341 - RNA, 64 nt, hsa
guagcuaucagacauggacagaaacugacuuagugcucacaagccccuacaccuucugggcuga

SEQ ID NO: 417342 - RNA, 64 nt, hsa
aucaucagaaacuaaauggcagccaggcaugggggcucacaacuguaauccucgcacuuuggga

SEQ ID NO: 417343 - RNA, 64 nt, hsa
agaaugguaaaugagaacacuacaacuguagucagcucacaauuuuuaaauaaaggauaccaca

SEQ ID NO: 417344 - RNA, 64 nt, hsa
cggauggccucagcccuggguggccagacucugugcucacaauccagagcaauggauccuccaa

SEQ ID NO: 417345 - RNA, 64 nt, hsa
auucugaccagagcuaugaaucugguugauggcggcucacaagugaaaacugauuucccauuuu

SEQ ID NO: 417346 - RNA, 64 nt, hsa
gaaacccuuguauaauucccuacauuucucucgagcucacaaauacuuuuuuuucuuuuuccuu

SEQ ID NO: 417347 - RNA, 64 nt, hsa
gcacaacaaaacgaaaugauggaaaugcucuugagcucacaacauuuguuuuucuuuuaaagua

SEQ ID NO: 417348 - RNA, 64 nt, hsa
auaucaucauaguaaaagaaaugagggcauaucggcucacaaagagauaaacuacauaggggug

SEQ ID NO: 417349 - RNA, 64 nt, hsa
guccaaguggacaggacucugacauucucccggggcucacaacaguaucucaaaaaauauguug

SEQ ID NO: 417350 - RNA, 64 nt, hsa
aggaacacaccaggucaccugacaucccaagaaugcucacaaaccugcaggcauaucauuggcg

SEQ ID NO: 417351 - RNA, 64 nt, hsa
caucacuugcaguuaaauaaaacucacaauuugugcucacaagcuuaaacuucuguuaucucuu

SEQ ID NO: 417352 - RNA, 64 nt, hsa
cagucuucagccacaguugugaugguuguuaaaugcucacaauugugcauucuuaggguuuuuc

SEQ ID NO: 417353 - RNA, 64 nt, hsa
uucucugggacuuaagcugcuauauccccucagagcucacaaaugccuuuacauucuuucccug

SEQ ID NO: 417354 - RNA, 64 nt, hsa
uucucugggacuuaaggugcuauauucccucagagcucacaaaugccuuucaauucuuucccug

SEQ ID NO: 417355 - RNA, 64 nt, hsa
guaaauugcuucauagaaugcagaauguguaauagcucacaauaaguagguauuauguuuacau

SEQ ID NO: 417356 - RNA, 64 nt, hsa
gucacugagcuggaccuuaaacacaucugcaggagcucacaaaaugggagcaaaagaggcauuc

SEQ ID NO: 417357 - RNA, 50 nt, hsa
acaaauccagugauaucuaagcucacaagauacccacuuuucaggauggg

SEQ ID NO: 417358 - RNA, 64 nt, hsa
uguauaaaaugcaacuguugauuuccucaacauggcucacaaauuucuaucccaaaucuuuucu

SEQ ID NO: 417359 - RNA, 56 nt, hsa
ucuuagaguauuuuauuuagaauagagcucacaacuacuccuuuagacauguaauu

SEQ ID NO: 417360 - RNA, 64 nt, hsa
cuugguuagagcagcacacgucggagaacaggaggcucacaaaagaacgauuuucagugccccc

SEQ ID NO: 417361 - RNA, 64 nt, hsa
ccaccuaaucaggcugaggugucuuaagccuuuugcucacaaaaccuggcacaauggcuaauuc

SEQ ID NO: 417362 - RNA, 64 nt, hsa
ugcuucauauauccaugaccaagauugacauguugcucacaacaugucacaauuuagugaggag

SEQ ID NO: 417363 - RNA, 64 nt, hsa
ggccagcauguggagagucgcugcggcugcuccugcucacaauaaagccggggccgagcagcug

SEQ ID NO: 417364 - RNA, 64 nt, hsa
augugcaauuucucuuagauacacuacugcugcagcucacaaacaccucugcauauuacaugua

SEQ ID NO: 417365 - RNA, 64 nt, hsa
uccaaucuuuuucuagagaaaaagauaaucugaagcucacaaagaugaagugacuuccucaaaa

SEQ ID NO: 417366 - RNA, 64 nt, hsa
agagauaauuagacaugguucccgcccucaagaagcucacaaaaguauucaggaaauaaugcag

SEQ ID NO: 417367 - RNA, 64 nt, hsa
aggucgcgugcugugggaugacagcgggacgggagcucacaagugcuuucacugaagauuuguu

SEQ ID NO: 417368 - RNA, 64 nt, hsa
aacuguacacagaauuguuccaguacuauggagugcucacaaaggauacuuuuacagguuaaga

SEQ ID NO: 417369 - RNA, 64 nt, hsa
guggcuaauuccuaaggaaaccugauuaacacaugcucacaaccauccuggucauucucgagca

SEQ ID NO: 417370 - RNA, 64 nt, hsa
ugugaagaugucaugcuaucacaauaugcuaagagcucacaaaaauaagauagaauuuccagga

SEQ ID NO: 417371 - RNA, 64 nt, hsa
gagagugaaauauagaaguguuugaaauguucaagcucacaauaagcuuaaauuuauagaaaau

SEQ ID NO: 417372 - RNA, 64 nt, hsa
uaugcauguguaauccccuguaauacacucaggugcucacaaauagagcagauugucauauugu

SEQ ID NO: 417373 - RNA, 63 nt, hsa
auaguacuugugugaauugaguaggggcuucaugcucacaacucgaacugacugacaaugugg

SEQ ID NO: 417374 - RNA, 64 nt, hsa
guagcaggcccagcugcagaaggaccucaccugugcucacaagauccuucugguaagccgccau

SEQ ID NO: 417375 - RNA, 64 nt, hsa
cuuuacuauguggauggugguaucagggaagagggcucacaagacacauuugucccccgggccc

SEQ ID NO: 417376 - RNA, 64 nt, hsa
gcaaccaccaugcauuugcagauaggcaagucaggcucacaaaaauguaugcagagcuucaggg

SEQ ID NO: 417377 - RNA, 64 nt, hsa
uggcugaccuccagggaggagcacucacuggagugcucacaaggugcacacugcuguguguacc

SEQ ID NO: 417378 - RNA, 64 nt, hsa
ugcccacacuccaagaccugugccuuuuagagaagcucacaaugauuuaaggacuguuugaaac

SEQ ID NO: 417379 - RNA, 64 nt, hsa
cucuucagagcaagcacuggacuacaagggcauggcucacaaaagguuaauggauggggguuac

SEQ ID NO: 417380 - RNA, 64 nt, hsa
ccucucuggccucucaggaaucaggguggacauggcucacaacagcagggccuucuucuuuuug

SEQ ID NO: 417381 - RNA, 64 nt, hsa
agacuuaaaugaaugcuucuagaaacuuccagcggcucacaaagaauaagccugccuuagggcu

SEQ ID NO: 417382 - RNA, 64 nt, hsa
uucugucagggcagccagcuguagacauccaaaagcucacaaaugagaagcuccuugaguaucu

SEQ ID NO: 417383 - RNA, 64 nt, hsa
ccaccgggaacagucagcuuucuuuauuaaaugugcucacaaagcauggugccuuguuaccugg

SEQ ID NO: 417384 - RNA, 64 nt, hsa
ucgggugaaguuacaguauccauuacuuguguuugcucacaacagagcuaccuuccuguugugu

SEQ ID NO: 417385 - RNA, 64 nt, hsa
aaacucucaucuucccccacagauacacauccaagcucacaaauaggaguagcaauucuaggug

SEQ ID NO: 417386 - RNA, 64 nt, hsa
uaaaagucuaccuguguuuuuuucuaaaaaggcugcucacaaguucuauuucuugaagaauaaa

SEQ ID NO: 417387 - RNA, 64 nt, hsa
auauuucaugucaauuguauuuauuuuaauaauagcucacaaugccuuuaguaaguaauaaagu

SEQ ID NO: 417388 - RNA, 64 nt, hsa
cagccauggagagcuggggaaaccacauuaaggugcucacaaaaauacagugugacguguacug

SEQ ID NO: 417389 - RNA, 64 nt, hsa
augccucuuugccucugcuuugucaugccauuaagcucacaauaaggaagaaauaacagauaag

SEQ ID NO: 417390 - RNA, 64 nt, hsa
ggaaaaaaauguguucucucuggacucuugccuagcucacaaggcuuuggagaauugucuuccu

SEQ ID NO: 417391 - RNA, 64 nt, hsa
gcuccuguaacagaccucuuuuugguuauggauggcucacaaaauagggcccccaaugcuauuu

SEQ ID NO: 417392 - RNA, 64 nt, hsa
gucgucacacucagaaggacaggcuugucugccagcucacaaggggaggcugcaguggguuugg

SEQ ID NO: 417393 - RNA, 64 nt, hsa
ccuuaauaauaaugccaaugaacaucucaugugugcucacaauguucuggcacuauuauaagug

SEQ ID NO: 417394 - RNA, 64 nt, hsa
gaauucaggcuuuccccuccagcccccaaucauagcucacaaaccuuccuugcuauuuguucuu

SEQ ID NO: 417395 - RNA, 64 nt, hsa
guuuuucugcacuuccugaccacucuuauaaaaagcucacaaaccuuugaagaaacuggaguag

SEQ ID NO: 417396 - RNA, 64 nt, hsa
gugacggucaguccuacugcuguaugucagguuugcucacaaugagguauucccacauagaaau

SEQ ID NO: 417397 - RNA, 64 nt, hsa
guaaacuucauuggucagauuuagaagcauucaugcucacaaguuuugggaaagugaaaaauaa

SEQ ID NO: 417398 - RNA, 64 nt, hsa
gugucugugcucagcccauccaccagaagagucugcucacaagccagaggucuugucuugguuu

SEQ ID NO: 417399 - RNA, 64 nt, hsa
cauuuggguuucacuccauaucuagaagaauuuagcucacaaaacaauuuuuguguguuuugag

SEQ ID NO: 417400 - RNA, 64 nt, hsa
ucaaaaugaacguuacaucacucuaaccugaacagcucacaauguagcuguaaauauaaaaaau

SEQ ID NO: 417401 - RNA, 64 nt, hsa
uucuuggaauggcugcagugaggccgugucauuggcucacaaaagugacucauagguaauuucu

SEQ ID NO: 417402 - RNA, 64 nt, hsa
agacccugcccuuguuuggggcaggaguagcugagcucacaaggcagcaaggcccgagcagcug

SEQ ID NO: 417403 - RNA, 64 nt, hsa
uuaaauggaauucguaaagaaauauaaaacuucagcucacaauuaaaacugucuuuuuaguuuu

SEQ ID NO: 417404 - RNA, 64 nt, hsa
aacuggagacuguggccucaucccacugugcugugcucacaacacuugugucugccacauggca

SEQ ID NO: 417405 - RNA, 64 nt, hsa
aaguaaucagcugaacacuaaugcuguucugucugcucacaagagauaaagauacccucucaug

SEQ ID NO: 417406 - RNA, 64 nt, hsa
aaguaaauguugcuuguuauuugguagagauuaggcucacaaaauauuucuccauuuccaguga

SEQ ID NO: 417407 - RNA, 64 nt, hsa
aguaucagucuuguccugggagccggguccugcugcucacaagcccagagcugccagggagcuc

SEQ ID NO: 417408 - RNA, 64 nt, hsa
guuuugccauccacaaucccuccuacagggccuggcucacaaaaagagugcaacaaaugcuucu

SEQ ID NO: 417409 - RNA, 64 nt, hsa
cuccuuccuaacccuuugucuagagcaccacaccgcucacaaacucuuuccaaaugcucaguug

SEQ ID NO: 417410 - RNA, 64 nt, hsa
ggggaggcgguggggggugguggggggagcgggugcucacaagcacagagcugccuguugugaa

SEQ ID NO: 417411 - RNA, 64 nt, hsa
auuccaaguuuugugacccaaaagagaaauaaaugcucacaagugcuguagaauuaaacuucag

SEQ ID NO: 417412 - RNA, 64 nt, hsa
ccaugacuacaacacgucuuucucaaacuccaaugcucacaaagcugaaaagaagcuucaaaac

SEQ ID NO: 417413 - RNA, 64 nt, hsa
cuaaugaagcaggugacugcagccuuuggcucaagcucacaacucugauaacugucagugccug

SEQ ID NO: 417414 - RNA, 63 nt, hsa
ccuguccuguaucugucugaaucagucacucuugcucacaaugggcauggaucagaagaccau

SEQ ID NO: 417415 - RNA, 51 nt, hsa
gcagggcaaagcacaacuagagcucacaaccaaaacugcacuucagccucu

SEQ ID NO: 417416 - RNA, 64 nt, hsa
ccacuuugccaacuucccgagaacaaacaggccugcucacaacugccccucaaguucaaccccg

SEQ ID NO: 417417 - RNA, 64 nt, hsa
auagguggaaauaucauucaaaauagucacuugagcucacaaaaaaagcaaggaagaauucuca

SEQ ID NO: 417418 - RNA, 64 nt, hsa
aaauauaaaguucaguuugucacaagauuaaauugcucacaagguaaaauuguauuguuuggca

SEQ ID NO: 417419 - RNA, 64 nt, hsa
gaggagacaagugaaaaauuuuugcuucaaaggagcucacaagcuaaguaaauaaaugaaauua

SEQ ID NO: 417420 - RNA, 64 nt, hsa
uacuugcccccuacuuccucuucucucuggaacggcucacaaugagugugacauuagaaaacuc

SEQ ID NO: 417421 - RNA, 64 nt, hsa
auucuggaauugggguuugguggugcaauguguugcucacaaguggccagaacuccuauuccua

SEQ ID NO: 417422 - RNA, 64 nt, hsa
ucuacccuagagaaggcucgcucccugccuacuggcucacaaaugaggaccagugagccauguc

SEQ ID NO: 417423 - RNA, 64 nt, hsa
ccucaaaucaaaaacaggcagguacagguagugggcucacaacguuugaccucgacugguuuuu

SEQ ID NO: 417424 - RNA, 64 nt, hsa
gcucagagcccuugaaccagaaccaacugcucaggcucacaaaaguuggcaaaaugcgggcugg

SEQ ID NO: 417425 - RNA, 64 nt, hsa
ucaaccucccugccaaaagaacaaaccauuugaagcucacaauugugaagcauucacggcgucg

SEQ ID NO: 417426 - RNA, 64 nt, hsa
gaaaauuuuuuuagauuauuugguguacgguuuugcucacaacaauagguggaaguugcuagug

SEQ ID NO: 417427 - RNA, 64 nt, hsa
aguuuacuccauucuuugugacacgagucaaguggcucacaaccuccucagggcaccagaggac

SEQ ID NO: 417428 - RNA, 64 nt, hsa
cagagaauugucagagcugaaaguuccuuugguugcucacaacucagguaugcacccauguggc

SEQ ID NO: 417429 - RNA, 64 nt, hsa
gcuucuccaguggugaccacccccccccauccccgcucacaacuuggguucuucucagcggggc

SEQ ID NO: 417430 - RNA, 64 nt, hsa
ugggaugggggucaauguaugcuacacaucuugggcucacaagugaggcuguggaggccaggag

SEQ ID NO: 417431 - RNA, 64 nt, hsa
gcuucuaauuggauagaacuugcuuuaccuuacagcucacaaccucagcuggguuuuagguacc

SEQ ID NO: 417432 - RNA, 64 nt, hsa
guuuaaaaaauaacacuuggaauaagauuuguaagcucacaaagccuucuuccaaaguugcuug

SEQ ID NO: 417433 - RNA, 64 nt, hsa
acauauacaaaagcaagacuuccagguagggccagcucacaagcccaggcuggagauccuaacu

SEQ ID NO: 417434 - RNA, 64 nt, hsa
aaauauugguuaguauuuaacuacaucugccucggcucacaaauuccgauuagaccuuuaucca

SEQ ID NO: 417435 - RNA, 64 nt, hsa
auuucccaucccacccaccuccccccaaaaaauagcucacaaggggagagccaguaugggggag

SEQ ID NO: 417436 - RNA, 64 nt, hsa
ugcuuccuuguuuccaugccaacaugcugagcaugcucacaaagaaggcucguccauuccuccu

SEQ ID NO: 417437 - RNA, 64 nt, hsa
gcauugcuugugauggagacuacuaaguauaugagcucacaauucuaucugauuccauucuaca

SEQ ID NO: 417438 - RNA, 64 nt, hsa
gcucagcagacauccacacacaguaauggggugagcucacaaccaccauucagucaagugaggu

SEQ ID NO: 417439 - RNA, 64 nt, hsa
gaugggaccugccuucuccacuaguagcugggcagcucacaauucacaccuguguaccugccac

SEQ ID NO: 417440 - RNA, 64 nt, hsa
cucucucuuaacaauucaagcaguagacaaaguugcucacaaauacagaaaacaucuuuuuguc

SEQ ID NO: 417441 - RNA, 64 nt, hsa
uuacgguauugcuggggagguaaccgugacuacugcucacaaacgucgcaaagcagaaacugaa

SEQ ID NO: 417442 - RNA, 64 nt, hsa
gugcaggcgcugggagagacaauagcuuugaggagcucacaaucuagcugaggagacaagacac

SEQ ID NO: 417443 - RNA, 64 nt, hsa
auuuuaaaacaguaaaacaaaaugaaacuuaauagcucacaaaauuccaguccauguuucauga

SEQ ID NO: 417444 - RNA, 64 nt, hsa
gaauugcagcccugagguccauggguugacuuaugcucacaaauauguuucguuugcucaacau

SEQ ID NO: 417445 - RNA, 64 nt, hsa
uuugaacaaagugaugauuuguguguauuaauaagcucacaaauagugauuauuuucaaaagau

SEQ ID NO: 417446 - RNA, 64 nt, hsa
agcggccaggcagggucuggccccgggcugcugggcucacaaagucacacuagaccacagugac

SEQ ID NO: 417447 - RNA, 64 nt, hsa
cccaccucagccuccugaguagcugggaccauaggcucacaacaccacaccuggcaaauuugau

SEQ ID NO: 417448 - RNA, 64 nt, hsa
acacugguguggauuaaccugccagggagacagagcucacaauaaaaauggcucagaugccacu

SEQ ID NO: 417449 - RNA, 64 nt, hsa
guuacggaacaugugggaaucccuuuuacuucaugcucacaauuuaucagaaauuauuucguau

SEQ ID NO: 417450 - RNA, 64 nt, hsa
ucugugagucaggggucugggcacugcuucaggagcucacaaggcagcagucacagugucuccu

SEQ ID NO: 417451 - RNA, 64 nt, hsa
agguuuuugaacgugggaaucccuuuugcuucaugcucacaacuaagcauaggaaguuuuauuu

SEQ ID NO: 417452 - RNA, 64 nt, hsa
cccugagccaacuuucaaauugacgcauacaagggcucacaauuuggcuuuuuugggucccucc

SEQ ID NO: 417453 - RNA, 64 nt, hsa
ucccuaucccuggaccccugcccuccuuuuuucugcucacaaggacuuuugauuuuaguuauaa

SEQ ID NO: 417454 - RNA, 64 nt, hsa
auagaauguuucagugagaccaugagaauuccaggcucacaaagggagaggagagaacagggca

SEQ ID NO: 417455 - RNA, 64 nt, hsa
cccucagugcccucauuuuaugucauuaaauggggcucacaaaccaugcaaaugcuaugagaug

SEQ ID NO: 417456 - RNA, 64 nt, hsa
guaucaaaaagucaccacuaacccucccccagaagcucacaaaggaaaacggagagagcgagcg

SEQ ID NO: 417457 - RNA, 64 nt, hsa
gacaccucagacacgcuucugcagcugugccucggcucacaacacagauugacugcucugacuu

SEQ ID NO: 417458 - RNA, 63 nt, hsa
cagcagcacuccccuauugaaagaccugcuggagcucacaaggcgggaguuccagagagagga

SEQ ID NO: 417459 - RNA, 64 nt, hsa
cuggaggcugccaacccagcccucauccucccuugcucacaaaguuacaggguaggcaccuguc

SEQ ID NO: 417460 - RNA, 64 nt, hsa
gagcuccacguccccuagugcacccugagagggggcucacaagugaccgauccugggugccuca

SEQ ID NO: 417461 - RNA, 64 nt, hsa
uuuuauuuauaauaacagaaacaacaaccugcaugcucacaauacccagacagucuacuagcca

SEQ ID NO: 417462 - RNA, 64 nt, hsa
agccagacucacacagcugagaagccggcguccugcucacaaacugggaaagugugaaaacuau

SEQ ID NO: 417463 - RNA, 64 nt, hsa
gaagcuuaacacuauuuaaguaaauacaguagaagcucacaaauagauuucuuugcacaaugau

SEQ ID NO: 417464 - RNA, 64 nt, hsa
acugugcugcacaacuccaggaacuccaugguaugcucacaauuuucugcaaguugccuccacu

SEQ ID NO: 417465 - RNA, 64 nt, hsa
cuaggucaacuggccucaaacugauuugccaugagcucacaaaaugaaucccuaugcuuaauga

SEQ ID NO: 417466 - RNA, 64 nt, hsa
acuagcaauaguguguaucccgaugugugugugugcucacaaccacucucaccuguucgugagc

SEQ ID NO: 417467 - RNA, 64 nt, hsa; identical to SEQ ID NO: 159813

SEQ ID NO: 417468 - RNA, 64 nt, hsa; identical to SEQ ID NO: 159814

SEQ ID NO: 417469 - RNA, 64 nt, hsa; identical to SEQ ID NO: 159815

SEQ ID NO: 417470 - RNA, 64 nt, hsa; identical to SEQ ID NO: 159816

SEQ ID NO: 417471 - RNA, 64 nt, hsa; identical to SEQ ID NO: 417312

SEQ ID NO: 417472 - RNA, 64 nt, hsa; identical to SEQ ID NO: 417313

SEQ ID NO: 417473 - RNA, 64 nt, hsa; identical to SEQ ID NO: 417314

SEQ ID NO: 417474 - RNA, 64 nt, hsa; identical to SEQ ID NO: 417315

SEQ ID NO: 417475 - RNA, 64 nt, hsa; identical to SEQ ID NO: 417316

SEQ ID NO: 417476 - RNA, 64 nt, hsa; identical to SEQ ID NO: 417317

SEQ ID NO: 417477 - RNA, 64 nt, hsa; identical to SEQ ID NO: 417318

SEQ ID NO: 417478 - RNA, 64 nt, hsa; identical to SEQ ID NO: 417319

SEQ ID NO: 417479 - RNA, 64 nt, hsa; identical to SEQ ID NO: 417320

SEQ ID NO: 417480 - RNA, 64 nt, hsa; identical to SEQ ID NO: 417321

SEQ ID NO: 417481 - RNA, 64 nt, hsa; identical to SEQ ID NO: 417322

SEQ ID NO: 417482 - RNA, 64 nt, hsa; identical to SEQ ID NO: 417323

SEQ ID NO: 417483 - RNA, 64 nt, hsa; identical to SEQ ID NO: 417324

SEQ ID NO: 417484 - RNA, 64 nt, hsa; identical to SEQ ID NO: 417325

SEQ ID NO: 417485 - RNA, 64 nt, hsa; identical to SEQ ID NO: 417326

SEQ ID NO: 417486 - RNA, 64 nt, hsa; identical to SEQ ID NO: 417327

SEQ ID NO: 417487 - RNA, 64 nt, hsa; identical to SEQ ID NO: 417328

SEQ ID NO: 417488 - RNA, 64 nt, hsa; identical to SEQ ID NO: 417329

SEQ ID NO: 417489 - RNA, 64 nt, hsa; identical to SEQ ID NO: 417330

SEQ ID NO: 417490 - RNA, 64 nt, hsa; identical to SEQ ID NO: 417331

SEQ ID NO: 417491 - RNA, 64 nt, hsa; identical to SEQ ID NO: 417332

SEQ ID NO: 417492 - RNA, 64 nt, hsa; identical to SEQ ID NO: 417333

SEQ ID NO: 417493 - RNA, 64 nt, hsa; identical to SEQ ID NO: 417334

SEQ ID NO: 417494 - RNA, 64 nt, hsa; identical to SEQ ID NO: 417335

SEQ ID NO: 417495 - RNA, 64 nt, hsa; identical to SEQ ID NO: 417336

SEQ ID NO: 417496 - RNA, 64 nt, hsa; identical to SEQ ID NO: 417337

SEQ ID NO: 417497 - RNA, 64 nt, hsa; identical to SEQ ID NO: 417338

SEQ ID NO: 417498 - RNA, 64 nt, hsa; identical to SEQ ID NO: 417339

SEQ ID NO: 417499 - RNA, 64 nt, hsa; identical to SEQ ID NO: 417340

SEQ ID NO: 417500 - RNA, 64 nt, hsa; identical to SEQ ID NO: 417341

SEQ ID NO: 417501 - RNA, 64 nt, hsa; identical to SEQ ID NO: 417342

SEQ ID NO: 417502 - RNA, 64 nt, hsa; identical to SEQ ID NO: 417343

SEQ ID NO: 417503 - RNA, 64 nt, hsa; identical to SEQ ID NO: 417344

SEQ ID NO: 417504 - RNA, 64 nt, hsa; identical to SEQ ID NO: 417345

SEQ ID NO: 417505 - RNA, 64 nt, hsa; identical to SEQ ID NO: 417346

SEQ ID NO: 417506 - RNA, 64 nt, hsa; identical to SEQ ID NO: 417347

SEQ ID NO: 417507 - RNA, 64 nt, hsa; identical to SEQ ID NO: 417348

SEQ ID NO: 417508 - RNA, 64 nt, hsa; identical to SEQ ID NO: 417349

SEQ ID NO: 417509 - RNA, 64 nt, hsa; identical to SEQ ID NO: 417350

SEQ ID NO: 417510 - RNA, 64 nt, hsa; identical to SEQ ID NO: 417351

SEQ ID NO: 417511 - RNA, 64 nt, hsa; identical to SEQ ID NO: 417352

SEQ ID NO: 417512 - RNA, 64 nt, hsa; identical to SEQ ID NO: 417353

SEQ ID NO: 417513 - RNA, 64 nt, hsa; identical to SEQ ID NO: 417354

SEQ ID NO: 417514 - RNA, 64 nt, hsa; identical to SEQ ID NO: 417355

SEQ ID NO: 417515 - RNA, 64 nt, hsa; identical to SEQ ID NO: 417356

SEQ ID NO: 417516 - RNA, 50 nt, hsa; identical to SEQ ID NO: 417357

SEQ ID NO: 417517 - RNA, 64 nt, hsa; identical to SEQ ID NO: 417358

SEQ ID NO: 417518 - RNA, 56 nt, hsa; identical to SEQ ID NO: 417359

SEQ ID NO: 417519 - RNA, 64 nt, hsa; identical to SEQ ID NO: 417360

SEQ ID NO: 417520 - RNA, 64 nt, hsa; identical to SEQ ID NO: 417361

SEQ ID NO: 417521 - RNA, 64 nt, hsa; identical to SEQ ID NO: 417362

SEQ ID NO: 417522 - RNA, 64 nt, hsa; identical to SEQ ID NO: 417363

SEQ ID NO: 417523 - RNA, 64 nt, hsa; identical to SEQ ID NO: 417364

SEQ ID NO: 417524 - RNA, 64 nt, hsa; identical to SEQ ID NO: 417365

SEQ ID NO: 417525 - RNA, 64 nt, hsa; identical to SEQ ID NO: 417366

SEQ ID NO: 417526 - RNA, 64 nt, hsa; identical to SEQ ID NO: 417367

SEQ ID NO: 417527 - RNA, 64 nt, hsa; identical to SEQ ID NO: 417368

SEQ ID NO: 417528 - RNA, 64 nt, hsa; identical to SEQ ID NO: 417369

SEQ ID NO: 417529 - RNA, 64 nt, hsa; identical to SEQ ID NO: 417370

SEQ ID NO: 417530 - RNA, 64 nt, hsa; identical to SEQ ID NO: 417371

SEQ ID NO: 417531 - RNA, 64 nt, hsa; identical to SEQ ID NO: 417372

SEQ ID NO: 417532 - RNA, 63 nt, hsa; identical to SEQ ID NO: 417373

SEQ ID NO: 417533 - RNA, 64 nt, hsa; identical to SEQ ID NO: 417374

SEQ ID NO: 417534 - RNA, 64 nt, hsa; identical to SEQ ID NO: 417375

SEQ ID NO: 417535 - RNA, 64 nt, hsa; identical to SEQ ID NO: 417376

SEQ ID NO: 417536 - RNA, 64 nt, hsa; identical to SEQ ID NO: 417377

SEQ ID NO: 417537 - RNA, 64 nt, hsa; identical to SEQ ID NO: 417378

SEQ ID NO: 417538 - RNA, 64 nt, hsa; identical to SEQ ID NO: 417379

SEQ ID NO: 417539 - RNA, 64 nt, hsa; identical to SEQ ID NO: 417380

SEQ ID NO: 417540 - RNA, 64 nt, hsa; identical to SEQ ID NO: 417381

SEQ ID NO: 417541 - RNA, 64 nt, hsa; identical to SEQ ID NO: 417382

SEQ ID NO: 417542 - RNA, 64 nt, hsa; identical to SEQ ID NO: 417383

SEQ ID NO: 417543 - RNA, 64 nt, hsa; identical to SEQ ID NO: 417384

SEQ ID NO: 417544 - RNA, 64 nt, hsa; identical to SEQ ID NO: 417385

SEQ ID NO: 417545 - RNA, 64 nt, hsa; identical to SEQ ID NO: 417386

SEQ ID NO: 417546 - RNA, 64 nt, hsa; identical to SEQ ID NO: 417387

SEQ ID NO: 417547 - RNA, 64 nt, hsa; identical to SEQ ID NO: 417388

SEQ ID NO: 417548 - RNA, 64 nt, hsa; identical to SEQ ID NO: 417389

SEQ ID NO: 417549 - RNA, 64 nt, hsa; identical to SEQ ID NO: 417390

SEQ ID NO: 417550 - RNA, 64 nt, hsa; identical to SEQ ID NO: 417391

SEQ ID NO: 417551 - RNA, 64 nt, hsa; identical to SEQ ID NO: 417392

SEQ ID NO: 417552 - RNA, 64 nt, hsa; identical to SEQ ID NO: 417393

SEQ ID NO: 417553 - RNA, 64 nt, hsa; identical to SEQ ID NO: 417394

SEQ ID NO: 417554 - RNA, 64 nt, hsa; identical to SEQ ID NO: 417395

SEQ ID NO: 417555 - RNA, 64 nt, hsa; identical to SEQ ID NO: 417396

SEQ ID NO: 417556 - RNA, 64 nt, hsa; identical to SEQ ID NO: 417397

SEQ ID NO: 417557 - RNA, 64 nt, hsa; identical to SEQ ID NO: 417398

SEQ ID NO: 417558 - RNA, 64 nt, hsa; identical to SEQ ID NO: 417399

SEQ ID NO: 417559 - RNA, 64 nt, hsa; identical to SEQ ID NO: 417400

SEQ ID NO: 417560 - RNA, 64 nt, hsa; identical to SEQ ID NO: 417401

SEQ ID NO: 417561 - RNA, 64 nt, hsa; identical to SEQ ID NO: 417402

SEQ ID NO: 417562 - RNA, 64 nt, hsa; identical to SEQ ID NO: 417403

SEQ ID NO: 417563 - RNA, 64 nt, hsa; identical to SEQ ID NO: 417404

SEQ ID NO: 417564 - RNA, 64 nt, hsa; identical to SEQ ID NO: 417405

SEQ ID NO: 417565 - RNA, 64 nt, hsa; identical to SEQ ID NO: 417406

SEQ ID NO: 417566 - RNA, 64 nt, hsa; identical to SEQ ID NO: 417407

SEQ ID NO: 417567 - RNA, 64 nt, hsa; identical to SEQ ID NO: 417408

SEQ ID NO: 417568 - RNA, 64 nt, hsa; identical to SEQ ID NO: 417409

SEQ ID NO: 417569 - RNA, 64 nt, hsa; identical to SEQ ID NO: 417410

SEQ ID NO: 417570 - RNA, 64 nt, hsa; identical to SEQ ID NO: 417411

SEQ ID NO: 417571 - RNA, 64 nt, hsa; identical to SEQ ID NO: 417412

SEQ ID NO: 417572 - RNA, 64 nt, hsa; identical to SEQ ID NO: 417413

SEQ ID NO: 417573 - RNA, 63 nt, hsa; identical to SEQ ID NO: 417414

SEQ ID NO: 417574 - RNA, 51 nt, hsa; identical to SEQ ID NO: 417415

SEQ ID NO: 417575 - RNA, 64 nt, hsa; identical to SEQ ID NO: 417416

SEQ ID NO: 417576 - RNA, 64 nt, hsa; identical to SEQ ID NO: 417417

SEQ ID NO: 417577 - RNA, 64 nt, hsa; identical to SEQ ID NO: 417418

SEQ ID NO: 417578 - RNA, 64 nt, hsa; identical to SEQ ID NO: 417419

SEQ ID NO: 417579 - RNA, 64 nt, hsa; identical to SEQ ID NO: 417420

SEQ ID NO: 417580 - RNA, 64 nt, hsa; identical to SEQ ID NO: 417421

SEQ ID NO: 417581 - RNA, 64 nt, hsa; identical to SEQ ID NO: 417422

SEQ ID NO: 417582 - RNA, 64 nt, hsa; identical to SEQ ID NO: 417423

SEQ ID NO: 417583 - RNA, 64 nt, hsa; identical to SEQ ID NO: 417424

SEQ ID NO: 417584 - RNA, 64 nt, hsa; identical to SEQ ID NO: 417425

SEQ ID NO: 417585 - RNA, 64 nt, hsa; identical to SEQ ID NO: 417426

SEQ ID NO: 417586 - RNA, 64 nt, hsa; identical to SEQ ID NO: 417427

SEQ ID NO: 417587 - RNA, 64 nt, hsa; identical to SEQ ID NO: 417428

SEQ ID NO: 417588 - RNA, 64 nt, hsa; identical to SEQ ID NO: 417429

SEQ ID NO: 417589 - RNA, 64 nt, hsa; identical to SEQ ID NO: 417430

SEQ ID NO: 417590 - RNA, 64 nt, hsa; identical to SEQ ID NO: 417431

SEQ ID NO: 417591 - RNA, 64 nt, hsa; identical to SEQ ID NO: 417432

SEQ ID NO: 417592 - RNA, 64 nt, hsa; identical to SEQ ID NO: 417433

SEQ ID NO: 417593 - RNA, 64 nt, hsa; identical to SEQ ID NO: 417434

SEQ ID NO: 417594 - RNA, 64 nt, hsa; identical to SEQ ID NO: 417435

SEQ ID NO: 417595 - RNA, 64 nt, hsa; identical to SEQ ID NO: 417436

SEQ ID NO: 417596 - RNA, 64 nt, hsa; identical to SEQ ID NO: 417437

SEQ ID NO: 417597 - RNA, 64 nt, hsa; identical to SEQ ID NO: 417438

SEQ ID NO: 417598 - RNA, 64 nt, hsa; identical to SEQ ID NO: 417439

SEQ ID NO: 417599 - RNA, 64 nt, hsa; identical to SEQ ID NO: 417440

SEQ ID NO: 417600 - RNA, 64 nt, hsa; identical to SEQ ID NO: 417441

SEQ ID NO: 417601 - RNA, 64 nt, hsa; identical to SEQ ID NO: 417442

SEQ ID NO: 417602 - RNA, 64 nt, hsa; identical to SEQ ID NO: 417443

SEQ ID NO: 417603 - RNA, 64 nt, hsa; identical to SEQ ID NO: 417444

SEQ ID NO: 417604 - RNA, 64 nt, hsa; identical to SEQ ID NO: 417445

SEQ ID NO: 417605 - RNA, 64 nt, hsa; identical to SEQ ID NO: 417446

SEQ ID NO: 417606 - RNA, 64 nt, hsa; identical to SEQ ID NO: 417447

SEQ ID NO: 417607 - RNA, 64 nt, hsa; identical to SEQ ID NO: 417448

SEQ ID NO: 417608 - RNA, 64 nt, hsa; identical to SEQ ID NO: 417449

SEQ ID NO: 417609 - RNA, 64 nt, hsa; identical to SEQ ID NO: 417450

SEQ ID NO: 417610 - RNA, 64 nt, hsa; identical to SEQ ID NO: 417451

SEQ ID NO: 417611 - RNA, 64 nt, hsa; identical to SEQ ID NO: 417452

SEQ ID NO: 417612 - RNA, 64 nt, hsa; identical to SEQ ID NO: 417453

SEQ ID NO: 417613 - RNA, 64 nt, hsa; identical to SEQ ID NO: 417454

SEQ ID NO: 417614 - RNA, 64 nt, hsa; identical to SEQ ID NO: 417455

SEQ ID NO: 417615 - RNA, 64 nt, hsa; identical to SEQ ID NO: 417456

SEQ ID NO: 417616 - RNA, 64 nt, hsa; identical to SEQ ID NO: 417457

SEQ ID NO: 417617 - RNA, 63 nt, hsa; identical to SEQ ID NO: 417458

SEQ ID NO: 417618 - RNA, 64 nt, hsa; identical to SEQ ID NO: 417459

SEQ ID NO: 417619 - RNA, 64 nt, hsa; identical to SEQ ID NO: 417460

SEQ ID NO: 417620 - RNA, 64 nt, hsa; identical to SEQ ID NO: 417461

SEQ ID NO: 417621 - RNA, 64 nt, hsa; identical to SEQ ID NO: 417462

SEQ ID NO: 417622 - RNA, 64 nt, hsa; identical to SEQ ID NO: 417463

SEQ ID NO: 417623 - RNA, 64 nt, hsa; identical to SEQ ID NO: 417464

SEQ ID NO: 417624 - RNA, 64 nt, hsa; identical to SEQ ID NO: 417465

SEQ ID NO: 417625 - RNA, 64 nt, hsa; identical to SEQ ID NO: 417466

SEQ ID NO: 417626 - RNA, 64 nt, hsa; identical to SEQ ID NO: 409974

SEQ ID NO: 417627 - RNA, 64 nt, hsa; identical to SEQ ID NO: 409975

SEQ ID NO: 417628 - RNA, 64 nt, hsa; identical to SEQ ID NO: 409976

SEQ ID NO: 417629 - RNA, 64 nt, hsa; identical to SEQ ID NO: 409977

SEQ ID NO: 417630 - RNA, 64 nt, hsa; identical to SEQ ID NO: 409978

SEQ ID NO: 417631 - RNA, 64 nt, hsa; identical to SEQ ID NO: 409979

SEQ ID NO: 417632 - RNA, 64 nt, hsa; identical to SEQ ID NO: 409980

SEQ ID NO: 417633 - RNA, 64 nt, hsa; identical to SEQ ID NO: 409981

SEQ ID NO: 417634 - RNA, 64 nt, hsa; identical to SEQ ID NO: 409982

SEQ ID NO: 417635 - RNA, 64 nt, hsa; identical to SEQ ID NO: 409983

SEQ ID NO: 417636 - RNA, 64 nt, hsa; identical to SEQ ID NO: 409984

SEQ ID NO: 417637 - RNA, 64 nt, hsa; identical to SEQ ID NO: 409985

SEQ ID NO: 417638 - RNA, 64 nt, hsa; identical to SEQ ID NO: 409986

SEQ ID NO: 417639 - RNA, 64 nt, hsa; identical to SEQ ID NO: 409987

SEQ ID NO: 417640 - RNA, 64 nt, hsa; identical to SEQ ID NO: 409988

SEQ ID NO: 417641 - RNA, 64 nt, hsa; identical to SEQ ID NO: 409989

SEQ ID NO: 417642 - RNA, 64 nt, hsa; identical to SEQ ID NO: 409990

SEQ ID NO: 417643 - RNA, 64 nt, hsa; identical to SEQ ID NO: 409991

SEQ ID NO: 417644 - RNA, 64 nt, hsa; identical to SEQ ID NO: 409992

SEQ ID NO: 417645 - RNA, 64 nt, hsa; identical to SEQ ID NO: 409993

SEQ ID NO: 417646 - RNA, 64 nt, hsa; identical to SEQ ID NO: 70884

SEQ ID NO: 417647 - RNA, 64 nt, hsa; identical to SEQ ID NO: 70885

SEQ ID NO: 417648 - RNA, 64 nt, hsa; identical to SEQ ID NO: 70886

SEQ ID NO: 417649 - RNA, 64 nt, hsa; identical to SEQ ID NO: 70887

SEQ ID NO: 417650 - RNA, 64 nt, hsa; identical to SEQ ID NO: 70888

SEQ ID NO: 417651 - RNA, 64 nt, hsa; identical to SEQ ID NO: 70889

SEQ ID NO: 417652 - RNA, 64 nt, hsa
agggcuguaguauucaguaaugugucugcuccuuguugggcagacaccagcggugugcagggag

SEQ ID NO: 417653 - RNA, 64 nt, hsa
gaaaguuuuacugaauaauaccaagcuaauugcuguugggcacaccuggauggcuuugcaccug

SEQ ID NO: 417654 - RNA, 64 nt, hsa
cugcguccacuggcuagagagcaggcggugcgcgguugggcagacaccugggaggagucuccaa

SEQ ID NO: 417655 - RNA, 64 nt, hsa
guuacagcuuucuguugcagcagauaaaugccauguugggcaacuaugucauagauuucugcuc

SEQ ID NO: 417656 - RNA, 64 nt, hsa
aauauuaauagcaccacuuuacucaaguacccagguugggcaauagucugcuuccacggugauc

SEQ ID NO: 417657 - RNA, 64 nt, hsa
ccuucugggcccagcuaggagaaugaagugugguguugggcagccccugggcguaucucuucuu

SEQ ID NO: 417658 - RNA, 64 nt, hsa
acucuguuccucuccagaggggcucucugucccaguugggcagcucaccuuugggacauaagcc

SEQ ID NO: 417659 - RNA, 64 nt, hsa
guagcagagccgggacuaucccuuaucccuguggguugggcaacacuauuuaguccugaaaccg

SEQ ID NO: 417660 - RNA, 64 nt, hsa
cccugucugauagauaacuaacaaaauaguuuuaguugggcaaaauuaaagaguugggcaacca

SEQ ID NO: 417661 - RNA, 64 nt, hsa
uaacaaaauaguuuuaguugggcaaaauuaaagaguugggcaaccaucacugaaaucaguuuca

SEQ ID NO: 417662 - RNA, 64 nt, hsa; identical to SEQ ID NO: 246041

SEQ ID NO: 417663 - RNA, 64 nt, hsa; identical to SEQ ID NO: 246042

SEQ ID NO: 417664 - RNA, 64 nt, hsa; identical to SEQ ID NO: 246043

SEQ ID NO: 417665 - RNA, 64 nt, hsa; identical to SEQ ID NO: 246044

SEQ ID NO: 417666 - RNA, 64 nt, hsa; identical to SEQ ID NO: 246045

SEQ ID NO: 417667 - RNA, 64 nt, hsa; identical to SEQ ID NO: 246046

SEQ ID NO: 417668 - RNA, 64 nt, hsa; identical to SEQ ID NO: 246047

SEQ ID NO: 417669 - RNA, 64 nt, hsa; identical to SEQ ID NO: 246048

SEQ ID NO: 417670 - RNA, 64 nt, hsa; identical to SEQ ID NO: 246049

SEQ ID NO: 417671 - RNA, 64 nt, hsa; identical to SEQ ID NO: 246050

SEQ ID NO: 417672 - RNA, 64 nt, hsa; identical to SEQ ID NO: 246051

SEQ ID NO: 417673 - RNA, 64 nt, hsa; identical to SEQ ID NO: 246052

SEQ ID NO: 417674 - RNA, 64 nt, hsa; identical to SEQ ID NO: 246053

SEQ ID NO: 417675 - RNA, 64 nt, hsa; identical to SEQ ID NO: 246054

SEQ ID NO: 417676 - RNA, 64 nt, hsa; identical to SEQ ID NO: 246055

SEQ ID NO: 417677 - RNA, 64 nt, hsa; identical to SEQ ID NO: 246056

SEQ ID NO: 417678 - RNA, 64 nt, hsa
cuauuucagaguggggaagugauaaacuauuugccuucuggagcucuuugugaaaaauuaaaaa

SEQ ID NO: 417679 - RNA, 64 nt, hsa
cugucuggauuucucuugggaucuaacgugggaucuucuggacagacaaccgugacaucagcag

SEQ ID NO: 417680 - RNA, 64 nt, hsa
cuuauuauacacccccagaaagagagaaagcugccuucuggaggacugauuccacaugcuauau

SEQ ID NO: 417681 - RNA, 64 nt, hsa
ucauaccuugccagaucccucucucaguuccagccuucuggacaaggccugggcuaagaggagc

SEQ ID NO: 417682 - RNA, 64 nt, hsa
uuacccagcugggacuccaaaacucaaccaucaccuucuggaauaucacccuggaggaugaagg

SEQ ID NO: 417683 - RNA, 64 nt, hsa
cuugcucugccacugcccgcccagcccccauggucuucuggaaggucccucggucagggauuga

SEQ ID NO: 417684 - RNA, 64 nt, hsa
auauugccaaugcuacaguaauaaaugaaugucacuucuggauauagcuaggugacauauacau

SEQ ID NO: 417685 - RNA, 64 nt, hsa
uacccaucuuaaaaacaacgaaagaaggcauggacuucuggaugcccauccacuggguguaaac

SEQ ID NO: 417686 - RNA, 64 nt, hsa
cucuggaguuuuagugaaaggauuuauugagcagcuucuggaauauaaugugcauguccaaaau

SEQ ID NO: 417687 - RNA, 64 nt, hsa
ccuggcagaugaauaauuuucacucauuuauugucuucuggaaaccauuuaacuuuuacuguuu

SEQ ID NO: 417688 - RNA, 64 nt, hsa
ugucuacuuguucuccagcuucuggguagcugggcuucuggaaggguggcagugggcuacuccc

SEQ ID NO: 417689 - RNA, 64 nt, hsa
gugagccgcuguacccgaacuuuuuuuguuuuugcuucuggaacuuugaaacacaaaacacaag

SEQ ID NO: 417690 - RNA, 64 nt, hsa
aaguacaaacgcugcuuggauaaggagagcaaagcuucuggaacuuuauuuacucuuucuuuuu

SEQ ID NO: 417691 - RNA, 64 nt, hsa
cugggccaaccacguuuguuaucauggcugcugccuucuggacagcugccagcucugccuugag

SEQ ID NO: 417692 - RNA, 64 nt, hsa
aagcgugguuuuuugcuaagagccagaggcaggucuucuggaguucucaggggggcccugugac

SEQ ID NO: 417693 - RNA, 64 nt, hsa
agcccguguuucucagacuuuaaagccaccagggcuucuggaacaccugucauagaagcaauaa

SEQ ID NO: 417694 - RNA, 64 nt, hsa
aagucuaaaaucaaagugucagcagaguugguuccuucuggaggcucuaaggaagaauccauaa

SEQ ID NO: 417695 - RNA, 64 nt, hsa
cuuguggcugugugcaauucuuggaguucuuuggcuucuggacaaaucuuguccaaguauugca

SEQ ID NO: 417696 - RNA, 64 nt, hsa
ugagccugcaggguccugggccauguggguggugcuucuggaugugagucucuuauuuaucugc

SEQ ID NO: 417697 - RNA, 64 nt, hsa
cacugggaaaccgggccagcguggggcucccugccuucuggacuccugaaggucguggauggau

SEQ ID NO: 417698 - RNA, 64 nt, hsa
aaagacugaucauaaaccaaugcugguauugcaccuucuggaacuaugggcuugagaaaacccc

SEQ ID NO: 417699 - RNA, 64 nt, hsa
uuaaauagaagcaggaaagggagacaaagacuggcuucuggacuuccucccugauccccacccu

SEQ ID NO: 417700 - RNA, 64 nt, hsa
acuccaucucgacccuggggcugaggccugaguccuucuggacucuugguacccacauugccuc

SEQ ID NO: 417701 - RNA, 64 nt, hsa
gugaagcuggggcaucgaugacccaagacuuuaucuucuggaaaauauuuuucagacuccucaa

SEQ ID NO: 417702 - RNA, 64 nt, hsa
ggcauagagguugggcuggaggccuguccacuggcuucuggagcugaaggucugcgucacggug

SEQ ID NO: 417703 - RNA, 64 nt, hsa
ggucagaggcucugacacugucugguuuccaaugcuucuggagacuuccugccuaggccucauc

SEQ ID NO: 417704 - RNA, 64 nt, hsa
ccugauggcugccccuuccccagacagggcuggacuucuggagcugcuaagccacccuccguuu

SEQ ID NO: 417705 - RNA, 64 nt, hsa
uuggaguucccuggagccuggccagcccucaccucuucuggauagaggauucccccaacucccc

SEQ ID NO: 417706 - RNA, 64 nt, hsa
cguggggugagggaucacugccaaaaugguacagcuucuggagcagaacuuuccagggauccag

SEQ ID NO: 417707 - RNA, 64 nt, hsa
gagccagcaguacguggcuucagaggccuggcaucuucuggagaagcuugugguguuccugaag

SEQ ID NO: 417708 - RNA, 64 nt, hsa
uaaaauaaacuguauuugcaaauccaacauugagcuucuggacuacgcugacuccacugcugaa

SEQ ID NO: 417709 - RNA, 64 nt, hsa
ucuggcccacuccucacccccuugcuccccuggucuucuggaguuugugacauugauuugaaau

SEQ ID NO: 417710 - RNA, 64 nt, hsa
agacuguuagcucugcuaacagucaggacuauuccuucuggacucugugccuuugccugcacag

SEQ ID NO: 417711 - RNA, 64 nt, hsa
auggcuuguuuguuguuuucaccagagugagcuccuucuggacauacugccuggcagccugccu

SEQ ID NO: 417712 - RNA, 64 nt, hsa
uuuuauguauuauacuuagucaaauguaauguggcuucuggaaucauuguccagagcugcuucc

SEQ ID NO: 417713 - RNA, 64 nt, hsa
caaucaguagcuuaagaaaaaaccguguuugucucuucuggaaugguuagaagugagggaguuu

SEQ ID NO: 417714 - RNA, 64 nt, hsa; identical to SEQ ID NO: 95035

SEQ ID NO: 417715 - RNA, 64 nt, hsa; identical to SEQ ID NO: 95036

SEQ ID NO: 417716 - RNA, 64 nt, hsa; identical to SEQ ID NO: 95037

SEQ ID NO: 417717 - RNA, 64 nt, hsa; identical to SEQ ID NO: 95038

SEQ ID NO: 417718 - RNA, 64 nt, hsa; identical to SEQ ID NO: 95039

SEQ ID NO: 417719 - RNA, 64 nt, hsa; identical to SEQ ID NO: 95040

SEQ ID NO: 417720 - RNA, 64 nt, hsa; identical to SEQ ID NO: 95041

SEQ ID NO: 417721 - RNA, 64 nt, hsa; identical to SEQ ID NO: 95042

SEQ ID NO: 417722 - RNA, 64 nt, hsa; identical to SEQ ID NO: 95043

SEQ ID NO: 417723 - RNA, 64 nt, hsa; identical to SEQ ID NO: 95044

SEQ ID NO: 417724 - RNA, 64 nt, hsa; identical to SEQ ID NO: 95045

SEQ ID NO: 417725 - RNA, 64 nt, hsa; identical to SEQ ID NO: 95046

SEQ ID NO: 417726 - RNA, 64 nt, hsa; identical to SEQ ID NO: 95047

SEQ ID NO: 417727 - RNA, 64 nt, hsa; identical to SEQ ID NO: 95048

SEQ ID NO: 417728 - RNA, 64 nt, hsa; identical to SEQ ID NO: 95049

SEQ ID NO: 417729 - RNA, 64 nt, hsa; identical to SEQ ID NO: 95050

SEQ ID NO: 417730 - RNA, 64 nt, hsa; identical to SEQ ID NO: 95051

SEQ ID NO: 417731 - RNA, 64 nt, hsa; identical to SEQ ID NO: 95052

SEQ ID NO: 417732 - RNA, 64 nt, hsa; identical to SEQ ID NO: 102350

SEQ ID NO: 417733 - RNA, 64 nt, hsa; identical to SEQ ID NO: 102351

SEQ ID NO: 417734 - RNA, 64 nt, hsa; identical to SEQ ID NO: 102352

SEQ ID NO: 417735 - RNA, 64 nt, hsa; identical to SEQ ID NO: 102353

SEQ ID NO: 417736 - RNA, 64 nt, hsa; identical to SEQ ID NO: 102354

SEQ ID NO: 417737 - RNA, 64 nt, hsa; identical to SEQ ID NO: 102355

SEQ ID NO: 417738 - RNA, 64 nt, hsa; identical to SEQ ID NO: 102356

SEQ ID NO: 417739 - RNA, 64 nt, hsa; identical to SEQ ID NO: 102357

SEQ ID NO: 417740 - RNA, 64 nt, hsa; identical to SEQ ID NO: 102358

SEQ ID NO: 417741 - RNA, 64 nt, hsa; identical to SEQ ID NO: 102359

SEQ ID NO: 417742 - RNA, 64 nt, hsa; identical to SEQ ID NO: 102360

SEQ ID NO: 417743 - RNA, 64 nt, hsa; identical to SEQ ID NO: 102361

SEQ ID NO: 417744 - RNA, 64 nt, hsa; identical to SEQ ID NO: 102362

SEQ ID NO: 417745 - RNA, 64 nt, hsa; identical to SEQ ID NO: 102363

SEQ ID NO: 417746 - RNA, 64 nt, hsa; identical to SEQ ID NO: 102364

SEQ ID NO: 417747 - RNA, 64 nt, hsa; identical to SEQ ID NO: 102365

SEQ ID NO: 417748 - RNA, 64 nt, hsa; identical to SEQ ID NO: 102366

SEQ ID NO: 417749 - RNA, 64 nt, hsa; identical to SEQ ID NO: 102367

SEQ ID NO: 417750 - RNA, 64 nt, hsa; identical to SEQ ID NO: 102368

SEQ ID NO: 417751 - RNA, 64 nt, hsa; identical to SEQ ID NO: 102369

SEQ ID NO: 417752 - RNA, 64 nt, hsa; identical to SEQ ID NO: 102370

SEQ ID NO: 417753 - RNA, 64 nt, hsa; identical to SEQ ID NO: 102371

SEQ ID NO: 417754 - RNA, 64 nt, hsa; identical to SEQ ID NO: 102372

SEQ ID NO: 417755 - RNA, 64 nt, hsa; identical to SEQ ID NO: 102373

SEQ ID NO: 417756 - RNA, 64 nt, hsa; identical to SEQ ID NO: 102374

SEQ ID NO: 417757 - RNA, 64 nt, hsa; identical to SEQ ID NO: 102375

SEQ ID NO: 417758 - RNA, 64 nt, hsa; identical to SEQ ID NO: 102376

SEQ ID NO: 417759 - RNA, 64 nt, hsa; identical to SEQ ID NO: 102377

SEQ ID NO: 417760 - RNA, 64 nt, hsa; identical to SEQ ID NO: 102378

SEQ ID NO: 417761 - RNA, 64 nt, hsa; identical to SEQ ID NO: 102379

SEQ ID NO: 417762 - RNA, 64 nt, hsa; identical to SEQ ID NO: 102380

SEQ ID NO: 417763 - RNA, 64 nt, hsa; identical to SEQ ID NO: 102381

SEQ ID NO: 417764 - RNA, 64 nt, hsa; identical to SEQ ID NO: 102382

SEQ ID NO: 417765 - RNA, 64 nt, hsa; identical to SEQ ID NO: 102383

SEQ ID NO: 417766 - RNA, 64 nt, hsa; identical to SEQ ID NO: 102384

SEQ ID NO: 417767 - RNA, 64 nt, hsa; identical to SEQ ID NO: 102385

SEQ ID NO: 417768 - RNA, 64 nt, hsa; identical to SEQ ID NO: 102386

SEQ ID NO: 417769 - RNA, 64 nt, hsa; identical to SEQ ID NO: 102387

SEQ ID NO: 417770 - RNA, 64 nt, hsa; identical to SEQ ID NO: 102388

SEQ ID NO: 417771 - RNA, 64 nt, hsa; identical to SEQ ID NO: 102389

SEQ ID NO: 417772 - RNA, 64 nt, hsa; identical to SEQ ID NO: 102390

SEQ ID NO: 417773 - RNA, 64 nt, hsa; identical to SEQ ID NO: 102391

SEQ ID NO: 417774 - RNA, 64 nt, hsa; identical to SEQ ID NO: 102392

SEQ ID NO: 417775 - RNA, 64 nt, hsa; identical to SEQ ID NO: 102393

SEQ ID NO: 417776 - RNA, 64 nt, hsa; identical to SEQ ID NO: 102394

SEQ ID NO: 417777 - RNA, 64 nt, hsa; identical to SEQ ID NO: 102395

SEQ ID NO: 417778 - RNA, 64 nt, hsa; identical to SEQ ID NO: 102396

SEQ ID NO: 417779 - RNA, 64 nt, hsa; identical to SEQ ID NO: 102397

SEQ ID NO: 417780 - RNA, 64 nt, hsa; identical to SEQ ID NO: 102398

SEQ ID NO: 417781 - RNA, 64 nt, hsa; identical to SEQ ID NO: 102399

SEQ ID NO: 417782 - RNA, 64 nt, hsa; identical to SEQ ID NO: 102400

SEQ ID NO: 417783 - RNA, 64 nt, hsa; identical to SEQ ID NO: 102401

SEQ ID NO: 417784 - RNA, 64 nt, hsa; identical to SEQ ID NO: 102402

SEQ ID NO: 417785 - RNA, 64 nt, hsa; identical to SEQ ID NO: 102403

SEQ ID NO: 417786 - RNA, 64 nt, hsa; identical to SEQ ID NO: 102404

SEQ ID NO: 417787 - RNA, 64 nt, hsa; identical to SEQ ID NO: 102405

SEQ ID NO: 417788 - RNA, 64 nt, hsa; identical to SEQ ID NO: 102406

SEQ ID NO: 417789 - RNA, 64 nt, hsa; identical to SEQ ID NO: 102407

SEQ ID NO: 417790 - RNA, 64 nt, hsa; identical to SEQ ID NO: 102408

SEQ ID NO: 417791 - RNA, 64 nt, hsa; identical to SEQ ID NO: 102409

SEQ ID NO: 417792 - RNA, 64 nt, hsa; identical to SEQ ID NO: 102410

SEQ ID NO: 417793 - RNA, 64 nt, hsa; identical to SEQ ID NO: 102411

SEQ ID NO: 417794 - RNA, 64 nt, hsa; identical to SEQ ID NO: 102412

SEQ ID NO: 417795 - RNA, 64 nt, hsa; identical to SEQ ID NO: 102413

SEQ ID NO: 417796 - RNA, 64 nt, hsa; identical to SEQ ID NO: 102414

SEQ ID NO: 417797 - RNA, 64 nt, hsa; identical to SEQ ID NO: 102415

SEQ ID NO: 417798 - RNA, 64 nt, hsa; identical to SEQ ID NO: 102416

SEQ ID NO: 417799 - RNA, 64 nt, hsa; identical to SEQ ID NO: 102417

SEQ ID NO: 417800 - RNA, 64 nt, hsa; identical to SEQ ID NO: 102418

SEQ ID NO: 417801 - RNA, 64 nt, hsa; identical to SEQ ID NO: 102419

SEQ ID NO: 417802 - RNA, 64 nt, hsa; identical to SEQ ID NO: 102420

SEQ ID NO: 417803 - RNA, 64 nt, hsa; identical to SEQ ID NO: 102421

SEQ ID NO: 417804 - RNA, 64 nt, hsa; identical to SEQ ID NO: 102422

SEQ ID NO: 417805 - RNA, 64 nt, hsa; identical to SEQ ID NO: 102423

SEQ ID NO: 417806 - RNA, 64 nt, hsa; identical to SEQ ID NO: 102424

SEQ ID NO: 417807 - RNA, 64 nt, hsa; identical to SEQ ID NO: 102425

SEQ ID NO: 417808 - RNA, 64 nt, hsa; identical to SEQ ID NO: 102426

SEQ ID NO: 417809 - RNA, 64 nt, hsa; identical to SEQ ID NO: 102427

SEQ ID NO: 417810 - RNA, 64 nt, hsa; identical to SEQ ID NO: 102428

SEQ ID NO: 417811 - RNA, 64 nt, hsa; identical to SEQ ID NO: 102429

SEQ ID NO: 417812 - RNA, 64 nt, hsa; identical to SEQ ID NO: 102430

SEQ ID NO: 417813 - RNA, 64 nt, hsa; identical to SEQ ID NO: 102431

SEQ ID NO: 417814 - RNA, 64 nt, hsa; identical to SEQ ID NO: 102432

SEQ ID NO: 417815 - RNA, 64 nt, hsa; identical to SEQ ID NO: 102433

SEQ ID NO: 417816 - RNA, 64 nt, hsa; identical to SEQ ID NO: 102434

SEQ ID NO: 417817 - RNA, 64 nt, hsa; identical to SEQ ID NO: 102435

SEQ ID NO: 417818 - RNA, 64 nt, hsa; identical to SEQ ID NO: 102436

SEQ ID NO: 417819 - RNA, 64 nt, hsa; identical to SEQ ID NO: 102437

SEQ ID NO: 417820 - RNA, 64 nt, hsa; identical to SEQ ID NO: 102438

SEQ ID NO: 417821 - RNA, 64 nt, hsa; identical to SEQ ID NO: 102439

SEQ ID NO: 417822 - RNA, 64 nt, hsa; identical to SEQ ID NO: 102440

SEQ ID NO: 417823 - RNA, 64 nt, hsa; identical to SEQ ID NO: 102441

SEQ ID NO: 417824 - RNA, 64 nt, hsa; identical to SEQ ID NO: 102442

SEQ ID NO: 417825 - RNA, 64 nt, hsa; identical to SEQ ID NO: 102443

SEQ ID NO: 417826 - RNA, 64 nt, hsa; identical to SEQ ID NO: 102444

SEQ ID NO: 417827 - RNA, 64 nt, hsa; identical to SEQ ID NO: 102445

SEQ ID NO: 417828 - RNA, 64 nt, hsa; identical to SEQ ID NO: 102446

SEQ ID NO: 417829 - RNA, 64 nt, hsa; identical to SEQ ID NO: 102447

SEQ ID NO: 417830 - RNA, 64 nt, hsa; identical to SEQ ID NO: 51918

SEQ ID NO: 417831 - RNA, 64 nt, hsa; identical to SEQ ID NO: 51919

SEQ ID NO: 417832 - RNA, 64 nt, hsa; identical to SEQ ID NO: 51920

SEQ ID NO: 417833 - RNA, 64 nt, hsa; identical to SEQ ID NO: 51921

SEQ ID NO: 417834 - RNA, 64 nt, hsa; identical to SEQ ID NO: 51922

SEQ ID NO: 417835 - RNA, 64 nt, hsa; identical to SEQ ID NO: 51923

SEQ ID NO: 417836 - RNA, 64 nt, hsa; identical to SEQ ID NO: 51924

SEQ ID NO: 417837 - RNA, 64 nt, hsa; identical to SEQ ID NO: 51925

SEQ ID NO: 417838 - RNA, 64 nt, hsa; identical to SEQ ID NO: 51926

SEQ ID NO: 417839 - RNA, 64 nt, hsa; identical to SEQ ID NO: 51927

SEQ ID NO: 417840 - RNA, 64 nt, hsa; identical to SEQ ID NO: 51928

SEQ ID NO: 417841 - RNA, 64 nt, hsa; identical to SEQ ID NO: 51929

SEQ ID NO: 417842 - RNA, 64 nt, hsa; identical to SEQ ID NO: 51930

SEQ ID NO: 417843 - RNA, 64 nt, hsa; identical to SEQ ID NO: 51931

SEQ ID NO: 417844 - RNA, 64 nt, hsa; identical to SEQ ID NO: 51932

SEQ ID NO: 417845 - RNA, 64 nt, hsa; identical to SEQ ID NO: 51933

SEQ ID NO: 417846 - RNA, 64 nt, hsa; identical to SEQ ID NO: 51934

SEQ ID NO: 417847 - RNA, 64 nt, hsa; identical to SEQ ID NO: 51935

SEQ ID NO: 417848 - RNA, 64 nt, hsa; identical to SEQ ID NO: 51936

SEQ ID NO: 417849 - RNA, 64 nt, hsa; identical to SEQ ID NO: 51937

SEQ ID NO: 417850 - RNA, 64 nt, hsa; identical to SEQ ID NO: 51938

SEQ ID NO: 417851 - RNA, 64 nt, hsa; identical to SEQ ID NO: 51939

SEQ ID NO: 417852 - RNA, 64 nt, hsa; identical to SEQ ID NO: 51940

SEQ ID NO: 417853 - RNA, 64 nt, hsa; identical to SEQ ID NO: 51941

SEQ ID NO: 417854 - RNA, 64 nt, hsa; identical to SEQ ID NO: 51942

SEQ ID NO: 417855 - RNA, 64 nt, hsa; identical to SEQ ID NO: 51943

SEQ ID NO: 417856 - RNA, 64 nt, hsa; identical to SEQ ID NO: 51944

SEQ ID NO: 417857 - RNA, 64 nt, hsa
auaccuuugggcugccugggacaggcuccugaggaggauugagggugaaagucucccacgagua

SEQ ID NO: 417858 - RNA, 64 nt, hsa
ggguuuuccccccuuuuuuauggaguuggccaauaggauugaguuggggcuccaguagagaagg

SEQ ID NO: 417859 - RNA, 64 nt, hsa
uuacagguuaugcuuugagaucucuuuggggugaaggauugaaauuaaacccugagccaccgug

SEQ ID NO: 417860 - RNA, 64 nt, hsa
ucaauaaacaacaacaaaaagaacucucucugugaggauugauccacuuuuaaauuucucuucu

SEQ ID NO: 417861 - RNA, 64 nt, hsa
agggauaauaacagcaccccauagaguugugacgaggauugagauaaucuaaguaaagcacagu

SEQ ID NO: 417862 - RNA, 64 nt, hsa
uuuucaaaaaaacgaaucuguauguugaggcaaaaggauugaaccuggaagucugggacuuuau

SEQ ID NO: 417863 - RNA, 64 nt, hsa
gaaaugaaggcagagaaauauaguuuccuuuccuaggauugagacaauucuauuuuucauauac

SEQ ID NO: 417864 - RNA, 64 nt, hsa
ugaguuccaacagaauucacaaagggaauaaaacaggauugagauuuugaggugugcacaaggu

SEQ ID NO: 417865 - RNA, 64 nt, hsa
cagccauaaagccacauugaguagucuaucccauaggauugacuacugcagagucuagugcaga

SEQ ID NO: 417866 - RNA, 64 nt, hsa
ucccaaccugaucccacgagggaguugggacaggaggauugauggugcuccccuuccugccagc

SEQ ID NO: 417867 - RNA, 64 nt, hsa
cccaggagaauccuuuuugcaaagauaggcaaaaaggauugaauccauaccagaacacguagac

SEQ ID NO: 417868 - RNA, 64 nt, hsa
gagccuggccgguuaacaucuuuuaauuguuuccaggauugagcagguucucagcugggcucug

SEQ ID NO: 417869 - RNA, 64 nt, hsa
uggauuuuaaauacuguuuguggaauguguuuaaaggauugauucuagaaccuuuguauauuug

SEQ ID NO: 417870 - RNA, 64 nt, hsa
uuuugcuccuaguuuuggaguuugaauuucugccaggauugaauuauuuugaaaucuccugucu

SEQ ID NO: 417871 - RNA, 64 nt, hsa
uuuauacaugaggaucuucuuuguggugaauaccaggauugacugcaucccuuuaaagaaguuu

SEQ ID NO: 417872 - RNA, 64 nt, hsa
ggaaauaaccauuccuuugcacuuguacaaucugaggauugauugcugccuuuuaaaauuuuau

SEQ ID NO: 417873 - RNA, 64 nt, hsa
ccaggaguagagaccaugggaaaugggguggauuaggauugagcuggagaagacuuaaacucuc

SEQ ID NO: 417874 - RNA, 64 nt, hsa
gagguaugaagaugggcucaauuaugagccagggaggauugaaacuagguccugccuuucugua

SEQ ID NO: 417875 - RNA, 64 nt, hsa
cguguuccuagcaggaccaacuacagucuucccaaggauugaguuauggacuuugggagugaga

SEQ ID NO: 417876 - RNA, 64 nt, hsa
uuugacuuaaaccuuguccaccucuugauauuuuaggauugaggaauaagucauuaaucuaagg

SEQ ID NO: 417877 - RNA, 64 nt, hsa
gaagacaaccacuucucuccuuuuagaaagcagcaggauugacuuauugagaaauaaugcagug

SEQ ID NO: 417878 - RNA, 64 nt, hsa
acaaucaugaaguucucauugcaugcaauuguguaggauugacaaggaacucagauaaaaauuu

SEQ ID NO: 417879 - RNA, 64 nt, hsa
cuuaauacacauuuguugacuuaaauuuaauucaaggauugaaaaauuaacuggauaucuugaa

SEQ ID NO: 417880 - RNA, 64 nt, hsa
gggcgaauauaggcauagacauaucuggagcgcaaggauugagaggcccuguggacaaggggaa

SEQ ID NO: 417881 - RNA, 64 nt, hsa
cgccaaguuuuuauacuuucugaaaugaaaacauaggauugacuaguuuacugguuuuuauucc

SEQ ID NO: 417882 - RNA, 64 nt, hsa
gaaagcgaugaagaaugucucuagaagagaaugaaggauugaagaauucaccauuagaggacau

SEQ ID NO: 417883 - RNA, 64 nt, hsa
auuuaucucaaaaagugacuuccaaacaacucuuaggauugacguaccgugcaucugagauaaa

SEQ ID NO: 417884 - RNA, 64 nt, hsa
uagugugaugccuccagcuuuguucuuuuggcuuaggauugaauuggugaugcgggcucuuuuu

SEQ ID NO: 417885 - RNA, 64 nt, hsa
ucuuaaucucaugacuauguucuucucccaaacaaggauugauagguaaaugcauugaacaagu

SEQ ID NO: 417886 - RNA, 64 nt, hsa
uucuccaguuuuuaguuugcacguaaggauucguaggauugauuucagauugacagaugguugu

SEQ ID NO: 417887 - RNA, 64 nt, hsa
cacagagggggccuucacagugaccaucgcaaccaggauugacagguggggcucugggacuugg

SEQ ID NO: 417888 - RNA, 64 nt, hsa
uuuuccggcugauaaggcuaacccuacccaggaaaggauugauaacuaaauaaauuuccucugu

SEQ ID NO: 417889 - RNA, 64 nt, hsa
ucucucggcagucgcucacacuacaaugcacacaaggauugagaagaguuaaaggcuaaagaaa

SEQ ID NO: 417890 - RNA, 64 nt, hsa
gacuccugaaacccuccccaggucuuccaaguacaggauugaagcuuuagugaaauuaaccaag

SEQ ID NO: 417891 - RNA, 64 nt, hsa
uguuaccuuucuuugugaggcaauggaguggucuaggauugagcaaaaagcaauuuuuguuaca

SEQ ID NO: 417892 - RNA, 64 nt, hsa
cuguagucccagcuacuuaggaggcugagaugggaggauugaucgaucgcuugagccugggagg

SEQ ID NO: 417893 - RNA, 64 nt, hsa
gagcccagaaaaaaggacuguauaguuuaaagggaggauugaaagggagguaaaaaaucagauu

SEQ ID NO: 417894 - RNA, 64 nt, hsa
caccacuguaccuggcuagcuacuucuuuguuagaggauugagaaugaaauuucugcaaaaggg

SEQ ID NO: 417895 - RNA, 64 nt, hsa
uguugaagugcuguuuuauuacuguuucuaaacuaggauugacauucuacaguugugauaauag

SEQ ID NO: 417896 - RNA, 64 nt, hsa
ugaccauucccuagucuccauggccaagcacucaaggauugauggacaccacacaccagcuaua

SEQ ID NO: 417897 - RNA, 64 nt, hsa
gaacauacuucagcucacacaugagaucuaggugaggauugauuaccuaguagucauuucaugg

SEQ ID NO: 417898 - RNA, 64 nt, hsa
uauuaaaagauuuuuguucaauacauuuuagauuaggauugacaaguaaagauacugcuaugga

SEQ ID NO: 417899 - RNA, 64 nt, hsa
augcacauggugcaguuuugguguguaacuuagaaggauugaacuucuuugaauuuacuggaca

SEQ ID NO: 417900 - RNA, 64 nt, hsa
cagcuacuugggaggcugaggcaggagaaucacaaggauugaaacuaugcaguguguucuccaa

SEQ ID NO: 417901 - RNA, 64 nt, hsa
cauuucucucaugugcgcccucagggcuuccagcaggauugagucacccugacgaugaccgggg

SEQ ID NO: 417902 - RNA, 64 nt, hsa
gacauaacacugcuuaccucuugguguggcuaugaggauugauugggcugauguguagaaaaua

SEQ ID NO: 417903 - RNA, 64 nt, hsa
uuauuguagaggguaucaauuggccuaacuaagcaggauugaauuuaccagaggcuaaguucag

SEQ ID NO: 417904 - RNA, 64 nt, hsa
ccucagggucaccacccauguauugggcuuagucaggauugacagauacauucucagcuggccu

SEQ ID NO: 417905 - RNA, 64 nt, hsa
accaggaaggacuguaaaaggacauaccaauuuuaggauugaaauaguucaggccgggcgcagu

SEQ ID NO: 417906 - RNA, 64 nt, hsa
ucuggguuccaggcauggugugccuuuucuuggcaggauugaucuugagcaagucaaugaaccu

SEQ ID NO: 417907 - RNA, 64 nt, hsa
acaaugagagcgacaagcagaugaagaaauucaaaggauugaagagguuuucacucucugcuaa

SEQ ID NO: 417908 - RNA, 64 nt, hsa
ugucugagguaaaucuagaaauugucuuaguuuuaggauugaaacagucuauaaacuguauuuu

SEQ ID NO: 417909 - RNA, 64 nt, hsa
cagaccaguuucaguaucucuggcaacagaaacaaggauugaaauggugguaguuaagagugca

SEQ ID NO: 417910 - RNA, 64 nt, hsa
guguaaauuguauucuuaacauuuuguauuuuguaggauugaucuuauuuugagacaaggguug

SEQ ID NO: 417911 - RNA, 64 nt, hsa
guucuugugacagauuauacagaauugugucugcaggauugauuaugcagaauacuuuucucuu

SEQ ID NO: 417912 - RNA, 64 nt, hsa
gauggccauuauuuuguauuuuaaauacauaaauaggauugaaucaacuagaaaugaaucuaua

SEQ ID NO: 417913 - RNA, 64 nt, hsa
uugaucaaaucuaauguaagaaaauuugaaguaaaggauugaucacuuuguuaaaaauauuuuc

SEQ ID NO: 417914 - RNA, 64 nt, hsa
acagaaaaggaaguguuguucugagcagggggacaggauugaugaggcuugaaagagcccacug

SEQ ID NO: 417915 - RNA, 64 nt, hsa
auguauguguggcauuuuuguuagagaugagaaaaggauugagaaggauaaacuggaauccugg

SEQ ID NO: 417916 - RNA, 64 nt, hsa
cuacuuuaaaucacucugagagguaaauggauauaggauugaaguuauguggguauuuggcaug

SEQ ID NO: 417917 - RNA, 64 nt, hsa
aacccaaaauuauguuuucauggucucuucucugaggauugagguuuacaaaggguguuagcag

SEQ ID NO: 417918 - RNA, 64 nt, hsa
ggaaauaaccuaccaauuguuuuuucuaggagauaggauugauuugcaacugauauuccuuuug

SEQ ID NO: 417919 - RNA, 64 nt, hsa
aucuguauuuguagcacuaagagaauuauuauuaaggauugacuagaaccuuaaaagauauaug

SEQ ID NO: 417920 - RNA, 64 nt, hsa
uuuuucaaaagcaguaaucccucaauuuuaaaaaaggauugaaaauucuaaaugucuuucugug

SEQ ID NO: 417921 - RNA, 64 nt, hsa
aaugcauccaucaaagagagccacccagaggaagaggauugauguccuugcaaaugcauuaccc

SEQ ID NO: 417922 - RNA, 64 nt, hsa
cuaaacaugaaauauaaugaauauaguauuauuaaggauugagacaaaaacugugauuuuaaua

SEQ ID NO: 417923 - RNA, 64 nt, hsa
cccgcagagcucccuuccugacccuccgcugcagaggauugaggcuuaauucugagcuggcccu

SEQ ID NO: 417924 - RNA, 64 nt, hsa
ggauugauguguuguggccaugcagcccucccugaggauugacuucugcacuaauccagugaag

SEQ ID NO: 417925 - RNA, 64 nt, hsa
ucuccacaccugccuggcaccccuggggggguccaggauugaggauucaucuaccugccaggcc

SEQ ID NO: 417926 - RNA, 64 nt, hsa
ugguauuccaugauuuuuauuuucaaaccaaaucaggauugacaaaagcugugcaugaagaacu

SEQ ID NO: 417927 - RNA, 64 nt, hsa
auguauaagaauguacuaauaguuuuauuugauuaggauugaacaguucaguuguaucuaugcc

SEQ ID NO: 417928 - RNA, 64 nt, hsa
gcaaaggagaaacgggacuuacuucacaggacagaggauugacagaagucaguuuaagauaagu

SEQ ID NO: 417929 - RNA, 64 nt, hsa
gaauggugguuaucaagggcugguggggcaguggaggauugaggagauauuggucaaaauuuac

SEQ ID NO: 417930 - RNA, 64 nt, hsa
uacuugcuuaaauugugggcaaaagagaaaaagaaggauugaucagagcauugugcaauacagu

SEQ ID NO: 417931 - RNA, 64 nt, hsa
ucugacugcaacaucuuucaccccauugaucgccaggauugauuugguugaucuggcugagcag

SEQ ID NO: 417932 - RNA, 64 nt, hsa
aucaaccauuauuuuucauuuuguuuguucuaagaggauugaaaaucaguuuaguuuaaauguc

SEQ ID NO: 417933 - RNA, 64 nt, hsa
uuaagggaaggaacucuggcuuccagguaucuccaggauugaagagcauugcauggacaccccu

SEQ ID NO: 417934 - RNA, 64 nt, hsa
aucagcuggucucggauuuacaucggaacugcucaggauugauacauuucaagucuguaaauac

SEQ ID NO: 417935 - RNA, 64 nt, hsa
agggaacuuagaagaagcugaaauacaaaagcagaggauugaacaacugcagagagaaaggcgg

SEQ ID NO: 417936 - RNA, 64 nt, hsa
ccugaagaagugacucugggagggcccggcgcagaggauugaggaggagggaucuggccuccuc

SEQ ID NO: 417937 - RNA, 64 nt, hsa
ugacuuuggaaaauuuacaugaagcucaaguguuaggauugacuuaugaaaauaaauuuuauuu

SEQ ID NO: 417938 - RNA, 64 nt, hsa
acagauugguaaaugcuauaauuauguaaugaucaggauugagauuaauacuguaguauaaauu

SEQ ID NO: 417939 - RNA, 64 nt, hsa
accaacauuuuguugcuuuuuuuuuuaauucuguaggauugaacuucaauaccaggaaguuaug

SEQ ID NO: 417940 - RNA, 64 nt, hsa
cucuaggaagcuaaucugcuuagucuauuuuuagaggauugaucucuggcacaagcagcuuccu

SEQ ID NO: 417941 - RNA, 64 nt, hsa
guuuuucaagccuguuauauucagugugugccacaggauugaaauaaaugacaauguaauuaug

SEQ ID NO: 417942 - RNA, 64 nt, hsa
ccguccuccuggaggcaguauaggagagagagcaaggauugagucugagacuuaagcacucggu

SEQ ID NO: 417943 - RNA, 64 nt, hsa
gcaacuauuuuccuugagaaacauucucagcaucaggauugauaaacaaauguagaugauuaaa

SEQ ID NO: 417944 - RNA, 64 nt, hsa
gcucuguguguuaaaaugagggucucacugcuuuaggauugaaguggcuggaaagagugaugcc

SEQ ID NO: 417945 - RNA, 64 nt, hsa
ggguggucuuuauucagguuuuacuguaaugguaaggauugacucaagagacaguauuaguaaa

SEQ ID NO: 417946 - RNA, 64 nt, hsa
ugcuggaagcagggaaaagaagcgugaagaucguaggauugagaacuuagggaagcacauuagc

SEQ ID NO: 417947 - RNA, 64 nt, hsa
uuauuuauggaguuagaaauuuguaguguuauccaggauugauuuucauuugaucacaucucac

SEQ ID NO: 417948 - RNA, 64 nt, hsa
uagcuuguugcaggaguucacaggaaaguugacuaggauugaguguguugggcuuuggguauaa

SEQ ID NO: 417949 - RNA, 64 nt, hsa
guauuucacacucaguucucccuuuuuuuacauaaggauugaguuucuuuuuaugaugauuuua

SEQ ID NO: 417950 - RNA, 64 nt, hsa
ucucucagaccacauugcaaucacacuagaccucaggauugagaaagucacucaaaaccgcuca

SEQ ID NO: 417951 - RNA, 64 nt, hsa
ggaaagccaggacucaggggagaagcaaacccccaggauugaaggcuaggguucuagggccuuu

SEQ ID NO: 417952 - RNA, 64 nt, hsa
cuuauaggaaucaaaguuuauuaaaguuacauagaggauugaaaaauguauaucacucaauuuu

SEQ ID NO: 417953 - RNA, 64 nt, hsa
cugggucagugauggaaagggguuaacuucagccaggauugauggcagcugagggaaauucuug

SEQ ID NO: 417954 - RNA, 64 nt, hsa
gcccagggcugggacugggcaugagguggucaccaggauugagcuuccucagcacccagugggu

SEQ ID NO: 417955 - RNA, 64 nt, hsa
ucaggugcauucuggcaacugacauacuugauggaggauugauucgguagagagcaguagaaau

SEQ ID NO: 417956 - RNA, 64 nt, hsa
ccaaggccaagcggacagaggggccauggguuguaggauugaggaacggaaucugccgacucac

SEQ ID NO: 417957 - RNA, 64 nt, hsa
acaccuguccugccuaccucacaaggucacucugaggauugaaacuugaucuuguccaggaaag

SEQ ID NO: 417958 - RNA, 64 nt, hsa
uuuaaaaauuaacucauuaguaucauaaacgucaaggauugauuggaccaggcaagagccaugu

SEQ ID NO: 417959 - RNA, 64 nt, hsa
ugaucacuaaaugaauggaugaucuacucgggucaggauugaaagagaaauauuucaacaccuu

SEQ ID NO: 417960 - RNA, 64 nt, hsa
caugguugguaugauggaccauucuuuggggcggaggauugauuauguuacucucuuuaaaauc

SEQ ID NO: 417961 - RNA, 64 nt, hsa
aggcccugucuaccucacaugcaggucuagggugaggauugaagaaaauaguggugaugagggc

SEQ ID NO: 417962 - RNA, 64 nt, hsa
ucauaaugccauuuauacauagcugaauuugaugaggauugaaugucauauauaagaggaauga

SEQ ID NO: 417963 - RNA, 64 nt, hsa
uggcaaauauauuuugaaaaaauaaagaacuaucaggauugaaaacagcucuuuugaggaaugu

SEQ ID NO: 417964 - RNA, 64 nt, hsa
agagagauguauuuaugagggugauaacuagcccaggauugauuucuuuccuaaagucccuagu

SEQ ID NO: 417965 - RNA, 64 nt, hsa
ccgauagggacuuugccaaguccaauuaucuucuaggauugaaaggugcauuuuccccauaaaa

SEQ ID NO: 417966 - RNA, 64 nt, hsa
uuaucauucaugaacuguuaaaguguuaaagauuaggauugaagucacugaccauuccggcuau

SEQ ID NO: 417967 - RNA, 64 nt, hsa
aacuucacuuccauuaggugaagauugaaaggauaggauugacauacccaaaguagccagcugg

SEQ ID NO: 417968 - RNA, 64 nt, hsa
aaacuguuugccugugguagacaccugcacgcauaggauugaagacaguacaggcugcuguaca

SEQ ID NO: 417969 - RNA, 64 nt, hsa
aaauaaauuacuuuguuuuuguauaaguauguauaggauugagcucuaaaaccaaaccauuaua

SEQ ID NO: 417970 - RNA, 64 nt, hsa
agugcccaguggcagcuccagugguagaggaccaaggauugagguuugggaccugaagcuccag

SEQ ID NO: 417971 - RNA, 64 nt, hsa
aaaaccuccugggacuguugcaaggaugaaaugaaggauugagggauugagggauugcugagcu

SEQ ID NO: 417972 - RNA, 64 nt, hsa
ucccaaggaugaagguguggcugugggucuggcuaggauugaagccaucuggaccuuuucuaga

SEQ ID NO: 417973 - RNA, 64 nt, hsa
gaccuucuuaacaggcuuaugauagguaucaaucaggauugagcacugaauuccaagcuccacu

SEQ ID NO: 417974 - RNA, 64 nt, hsa
aagccaggagucgacaguuuuggaagccucucucaggauugagauucuaggaugagauuggcuu

SEQ ID NO: 417975 - RNA, 64 nt, hsa
guccccuggucaagucucucggcuccuuuaauguaggauugagagcugggcaaacaggucccac

SEQ ID NO: 417976 - RNA, 64 nt, hsa
ccuccagacacccagggaauacccucugccccacaggauugaagacugcuuggcaguccuccca

SEQ ID NO: 417977 - RNA, 64 nt, hsa
uuguuguuuuuuuuucccaaacaugcaaacacugaggauugagcuguguggggucagcugugcu

SEQ ID NO: 417978 - RNA, 64 nt, hsa
agcaaguuuuuaagaaguauuuaaaaaucuuacuaggauugacauuuuuucugaauucuguaua

SEQ ID NO: 417979 - RNA, 64 nt, hsa
ccugcacucacaauaucugcuaugcuguagugcuaggauugauuauguguucuccaaagaugcu

SEQ ID NO: 417980 - RNA, 64 nt, hsa
cgaucagaccccaaccaugcugcauguguaaagaaggauugaaaauaaaauugcacuuuuuagg

SEQ ID NO: 417981 - RNA, 64 nt, hsa
ugcccaccccgcccugcugcccuguggagggaagaggauugagcuuugugucaccugccugcgc

SEQ ID NO: 417982 - RNA, 64 nt, hsa
uuugucauauguaaaagucauaacaccuguuuuaaggauugagauuguucauuuacugugugcc

SEQ ID NO: 417983 - RNA, 64 nt, hsa
auccucacuuggagagugucaaauacauacuuugaggauugacuuuauauaaggugcccuguag

SEQ ID NO: 417984 - RNA, 64 nt, hsa
aagagcccgcaugcccuagacucacuccagaggaaggauugauuugcaaccagaaagggagcug

SEQ ID NO: 417985 - RNA, 64 nt, hsa
uagaggaaaaugaagagcccuucguugcccccuuaggauugagcgucccgucugacguggaguu

SEQ ID NO: 417986 - RNA, 64 nt, hsa
auggggauaauaccuauuucacaagguuguucugaggauugauacguuuugaguauguauuugu

SEQ ID NO: 417987 - RNA, 64 nt, hsa
aggcaaccugggggaugacuuagguuaaugugcuaggauugacacaccucauccagccuucuua

SEQ ID NO: 417988 - RNA, 64 nt, hsa
aaaaggaaacaaaaaauguugaguuuuaaaaaucaggauugacuuuuuucuccaaaaccauaca

SEQ ID NO: 417989 - RNA, 64 nt, hsa
cguuucucagaagcagacccacccuuaaguugacaggauugauggaacaugcucuccugcucaa

SEQ ID NO: 417990 - RNA, 64 nt, hsa
ggugggggcaaggaaauuagcugagauucaucucaggauugagauucuauccccccuuccccgc

SEQ ID NO: 417991 - RNA, 64 nt, hsa
guagcaccuguaacuguguucuuguucuguuaaaaggauugauuugcuuuuauaguccuugugc

SEQ ID NO: 417992 - RNA, 64 nt, hsa
gauagguuuagcaguaaagaagaaagcuuuuaaaaggauugauucagcuaagcaaaguugggca

SEQ ID NO: 417993 - RNA, 64 nt, hsa
uugagcaguaaauguauauugauguaacugugucaggauugaggaugaacucagguuuccggcu

SEQ ID NO: 417994 - RNA, 64 nt, hsa
auguuguucuaaagaugucuuaacauuuauagugaggauugacagaaauuaagcaguguuaaga

SEQ ID NO: 417995 - RNA, 64 nt, hsa
agaacugccaaaguauauguucagcagugugcccaggauugaagguguaaaugggacaaaauaa

SEQ ID NO: 417996 - RNA, 64 nt, hsa
gcaaacgccagcagggcugcugugaauuuguguaaggauugagggacaguugcuuuucagcaug

SEQ ID NO: 417997 - RNA, 64 nt, hsa
agccgaccuccaugcaucauucucuagaguugaaaggauugacauuucucaguaacuacccggc

SEQ ID NO: 417998 - RNA, 64 nt, hsa
cugauuaaacuuggccuacuggcaauggcuacuuaggauugaucuaagggccaaagugcagggu

SEQ ID NO: 417999 - RNA, 64 nt, hsa
aucagcaggauucuaaaaguagacaaucacagggaggauugaaaaaaagggcacucugauaggg

SEQ ID NO: 418000 - RNA, 64 nt, hsa
uaaaguaaaauaucuaacaggugaaaaaggugugaggauugaacucaauaaaccuucagauuca

SEQ ID NO: 418001 - RNA, 64 nt, hsa
uauaagauuguugggaguuaauggugucaauaaaaggauugauggucccucuaaugaaacccag

SEQ ID NO: 418002 - RNA, 64 nt, hsa
auacggugggacuaauguauugguagcagccuagaggauugaugggaaagguaugaagcuagaa

SEQ ID NO: 418003 - RNA, 64 nt, hsa
uucccacuucuuaccucauggagccuguugaggaaggauugagcugaugacuuaagggcaaucu

SEQ ID NO: 418004 - RNA, 64 nt, hsa
ucauuuaggguccagauucccacuauggcacaaaaggauugaagaaaguagugcaugagacacc

SEQ ID NO: 418005 - RNA, 64 nt, hsa
gauucauguuucugauuuaaaaaaacaacaacacaggauugaauuaaguagaguaauagcacua

SEQ ID NO: 418006 - RNA, 64 nt, hsa
uuuuccuaccaacugauacguuuaaauuugcccuaggauugagcuaacagcaaaaaaaaaaaaa

SEQ ID NO: 418007 - RNA, 64 nt, hsa
agugguacugggauaacuagcuagccauaugcagaggauugaaacugaaccacuuccuuacacc

SEQ ID NO: 418008 - RNA, 64 nt, hsa
cuagcuaauauguaugugucaguaguaggcuccaaggauugacaaauauauuuaugaucuauuc

SEQ ID NO: 418009 - RNA, 64 nt, hsa
uccccaguucuccuggcucuccuuucugaaauaaaggauugaaaacgguuccuguucagacuga

SEQ ID NO: 418010 - RNA, 64 nt, hsa
cuguguucccagcugcuuaggaggcugaagcaggaggauugauugagccugcgaggccaaggcu

SEQ ID NO: 418011 - RNA, 64 nt, hsa
ccauaaucccagcccuuugggaagcugaggcaggaggauugagaccaggaguucgagaagagcc

SEQ ID NO: 418012 - RNA, 64 nt, hsa
accccauccucucagaagguaggggaagggcgggaggauugagaagggacaagccaccuugacc

SEQ ID NO: 418013 - RNA, 64 nt, hsa
acacagcucuucauuccauugacuuagaggcaacaggauugaucauucuuuuauagagcauauu

SEQ ID NO: 418014 - RNA, 64 nt, hsa
gaggcauuagggaggcaugaaaggaagaggaaugaggauugagacaugugaagacauugugcau

SEQ ID NO: 418015 - RNA, 64 nt, hsa
cagacccaggcucugaagauucccagaagccacaaggauugaagggaaaaggugauccugguaa

SEQ ID NO: 418016 - RNA, 64 nt, hsa
cucuugaaagaaaaguaguuucuguaccaauuaaaggauugacguggucucagauauugaugca

SEQ ID NO: 418017 - RNA, 64 nt, hsa
aauuucugcggugggaggcagugcucugcuagucaggauugauaaacagcugggcacaccgaaa

SEQ ID NO: 418018 - RNA, 64 nt, hsa
ugcagauuugcuuucguugauguccacguuacugaggauugacugaguauagacuggagacagg

SEQ ID NO: 418019 - RNA, 64 nt, hsa
guuuacauauuuauuauccuaugggggccugagcaggauugagggagccaggggaggggcagga

SEQ ID NO: 418020 - RNA, 64 nt, hsa
agcacauuucaaucauuuuaggauugucaaaaggaggauugaggaggaucagaucaauaaugga

SEQ ID NO: 418021 - RNA, 64 nt, hsa
ugggccuuguacccccagcucuggcagcgcccccaggauugaacguggggagccccagggcaga

SEQ ID NO: 418022 - RNA, 64 nt, hsa
cuaccagacuuacccuggggccuggcuuaaaagcaggauugaagaaaagggacugggggaagga

SEQ ID NO: 418023 - RNA, 64 nt, hsa
aaguauagagagaaguucauacaaagcgugcacaaggauugaaaauucgcccgagcuguuuaug

SEQ ID NO: 418024 - RNA, 64 nt, hsa
cuuagguuagaugaaaaguaggugauugaaggagaggauugaggguggaaggugggcugugaag

SEQ ID NO: 418025 - RNA, 64 nt, hsa
cugagaccaaauuuacaaaaaaacgaaaaaaauaaggauugacugggcuaccucagcauacauu

SEQ ID NO: 418026 - RNA, 64 nt, hsa
aagagggagaaaugucaugagacguuggacaggcaggauugaugauagcaugaccauagcuuug

SEQ ID NO: 418027 - RNA, 64 nt, hsa
uacaucuccuaaaggaccugaugccaacacaaguaggauugacuuaaacucuuaagcgcagcau

SEQ ID NO: 418028 - RNA, 64 nt, hsa
guagugaacacacauguuauuuacuucaaaagacaggauugacaaauucagucaauacuauuuu

SEQ ID NO: 418029 - RNA, 64 nt, hsa
gccuaauugagauaauugcuuuuauuauaauaauaggauugaaauuuuaaaauuuugaaaggac

SEQ ID NO: 418030 - RNA, 64 nt, hsa
acagguggcccgagcuguucuuucagcugcuccaaggauugagacccaagucaucaugaaaaag

SEQ ID NO: 418031 - RNA, 64 nt, hsa
cugaaccgagcuggagccaacagaugugucagccaggauugaccuuugcacgaacaccaagugu

SEQ ID NO: 418032 - RNA, 64 nt, hsa
uuugaaccuccaacagggaaggcucuguccagaaaggauugaaugugaacgggggcacccccuu

SEQ ID NO: 418033 - RNA, 64 nt, hsa
cuguaaucccagcacuuugggaggcugagguaggaggauugauugaggccaagaguuaaagacc

SEQ ID NO: 418034 - RNA, 64 nt, hsa
gguccugagguaauauacauccuccucagcugacaggauugagagauuaaaguaaagacaggca

SEQ ID NO: 418035 - RNA, 64 nt, hsa
uagcuaaaauacauagcauugaagacuaauuuuaaggauugacaagaguuuauuuucuauugug

SEQ ID NO: 418036 - RNA, 62 nt, hsa
gcccgacagaggccuccugauccaggacuggcaggauugaucccaccuccaagucuccgggc

SEQ ID NO: 418037 - RNA, 64 nt, hsa
ccgacugcacccuccccuucugguagucauaggcaggauugagugacgguugggaagggggcuc

SEQ ID NO: 418038 - RNA, 64 nt, hsa
gccugauacgugucaaaggagagagggauagaggaggauugaauagaaggagacuaagacugca

SEQ ID NO: 418039 - RNA, 64 nt, hsa
ucauuuuuguuuucuguuucaccuaaaccagcauaggauugauaggggagacgguuggcgggca

SEQ ID NO: 418040 - RNA, 64 nt, hsa
cuucgucgucuuucagucaaucucuuccacucuaaggauugagugagcgcgagcuggggacucu

SEQ ID NO: 418041 - RNA, 64 nt, hsa
uguucacaauuagguuccuaggagcaaaaccucaaggauugauuuauuguuuucaacuccaagg

SEQ ID NO: 418042 - RNA, 64 nt, hsa
cuuugggaaucauguuagcccaucagaauguugaaggauugaagaguucuaagcauaaaauaag

SEQ ID NO: 418043 - RNA, 64 nt, hsa
ucuaagaggaaaaggugaguugcucaugcugauuaggauugaaaugauuuguuucucuuccuag

SEQ ID NO: 418044 - RNA, 64 nt, hsa
cccuggugagccaaggacaaccacacagaaagccaggauugaagcggugcucagccaggccccu

SEQ ID NO: 418045 - RNA, 64 nt, hsa
gauuugaaaaggcuuuuuaucacuacaaucuuagaggauugacaguacaggauuuuuguuuaag

SEQ ID NO: 418046 - RNA, 64 nt, hsa
agaaaugaaguuuuuaauugcuauuguuuuauauaggauugaaagaaaauuaacuccuuuauua

SEQ ID NO: 418047 - RNA, 64 nt, hsa
ugaagccaugagcauguuaaauagagcucaggaaaggauugaugccugggcucagcugaacucu

SEQ ID NO: 418048 - RNA, 64 nt, hsa
uccugaccagcugcuccgaggacccaggaaaggcaggauugaaaauguccaggaaaguggccaa

SEQ ID NO: 418049 - RNA, 64 nt, hsa
cccagcuggucucauacauagacagcacuugugaaggauugaaugcagguuccagguggaggga

SEQ ID NO: 418050 - RNA, 64 nt, hsa
aggaagaaagggaaauugcagccccucagcccccaggauugaccucuggggagugaugguagcg

SEQ ID NO: 418051 - RNA, 64 nt, hsa
aaauguuaauuccuagcucaaacugugaauaguaaggauugaaaaguaaaguauguaaugcuaa

SEQ ID NO: 418052 - RNA, 64 nt, hsa
agcucagaucucuagagcugucuugucgccgcccaggauugaccuguguguaagucccaauaaa

SEQ ID NO: 418053 - RNA, 64 nt, hsa
ccacuggguauccguuagagguaagggagaggagaggauugauagaguguugcaaaaguauaga

SEQ ID NO: 418054 - RNA, 64 nt, hsa
cucuucugaggucauuauuauuuuaagaaugauuaggauugauaagggucccaugaccagcauu

SEQ ID NO: 418055 - RNA, 64 nt, hsa
uuuuugcaguauuauugaauuuauuuucuaaaucaggauugaaacaggaacuuuuccagguggu

SEQ ID NO: 418056 - RNA, 64 nt, hsa
aucacggacacuuuuuuccccuccaccgaaugucaggauugaaagcugccuccgagugguuggg

SEQ ID NO: 418057 - RNA, 64 nt, hsa
agcacagaucucuagagcuguccugucgcugcccaggauugaccuguguguaagucccaauaaa

SEQ ID NO: 418058 - RNA, 64 nt, hsa
cugcuccucccuuccuccuucacacuccuaguuuaggauugauguguccaagcucauagggaag

SEQ ID NO: 418059 - RNA, 64 nt, hsa
ccugucucacaccaguucagaaaacacuagacccaggauugaaaaagcaaaccacagcagaacc

SEQ ID NO: 418060 - RNA, 64 nt, hsa
auguuccuuuuauuuaacauuguaaucuaaguuuaggauugauacuggucacauuuguuguuua

SEQ ID NO: 418061 - RNA, 62 nt, hsa
cgggccaaugcagaggccucccgaaccaagcagcaggauugaagcuucggccucccuggccc

SEQ ID NO: 418062 - RNA, 64 nt, hsa
cacuauuuuuugugucuggcagaugaguaugucaaggauugagaugaacacauaagucuuggaa

SEQ ID NO: 418063 - RNA, 64 nt, hsa
uugaaugugugaugugaacugacuuuaaguaaucaggauugaauuccauuagcauuugcuacca

SEQ ID NO: 418064 - RNA, 64 nt, hsa
auuguaaguagugcauauuuuaucuuaaaaacucaggauugauguaagcacuggaauauuuuau

SEQ ID NO: 418065 - RNA, 64 nt, hsa
guaaggacagugccugggaacugguguagcugcaaggauugagaauggcaugcauuagcucacu

SEQ ID NO: 418066 - RNA, 64 nt, hsa
augaaaacaguaccugucaugcagaauuguugggaggauugauaauuuagauguuuauacaugu

SEQ ID NO: 418067 - RNA, 62 nt, hsa
uccccaaagcugaacaguaguaggaagaaaaaaggauugaugugaagaaauaaagaggcaga

SEQ ID NO: 418068 - RNA, 64 nt, hsa
uacagauggggcauauccuaucccaucccaccagaggauugauucuccauuucacaaggacuga

SEQ ID NO: 418069 - RNA, 62 nt, hsa
uguccuuccaggccucuuccccuuuccuccaucucuggcaacaguucuugggguuuggcaau

SEQ ID NO: 418070 - RNA, 62 nt, hsa
gaaauaaagauuuccuccaagccacaugaggacucuggcacccacccacaaagcaagaccug

SEQ ID NO: 418071 - RNA, 62 nt, hsa
caggacccccaagagugagugagggggcaaggcucuggcacaaaaccuccuccucccaggca

SEQ ID NO: 418072 - RNA, 62 nt, hsa
ccaggaaaagcagcagcugccugcucuccagccucuggcaggaacucagggcccuggagcug

SEQ ID NO: 418073 - RNA, 62 nt, hsa
ccaagggugugucugcucuuucccuccccauccucuggcagaaaucagcuagacgcuauacc

SEQ ID NO: 418074 - RNA, 62 nt, hsa
ggcuccccucugggccagcacaguccccucaccucuggcagggcugcuaccuccucagaguu

SEQ ID NO: 418075 - RNA, 62 nt, hsa
ucacacucugccauguucaugccugugggccucucuggcaggaacucugaugcaccgcgagg

SEQ ID NO: 418076 - RNA, 62 nt, hsa
uggauggaggcacucaggccuggguaggauuccucuggcacggagggagagacccuggguga

SEQ ID NO: 418077 - RNA, 62 nt, hsa
gcauccuuaggucuuggacagaccucggucagcucuggcacagucaagaauccaccuugggc

SEQ ID NO: 418078 - RNA, 62 nt, hsa
cgccccgcaacugacgcuccugcaaggaaaagcucuggcacgccgaugacgucgccggccuc

SEQ ID NO: 418079 - RNA, 62 nt, hsa
cugaccuguucuguugacuggggcccugcagacucuggcagagcugagaagggcagggaccu

SEQ ID NO: 418080 - RNA, 62 nt, hsa
uccagcucagaacccaucccucugguggguaccucuggcacccaucugcaaauaucucccuc

SEQ ID NO: 418081 - RNA, 62 nt, hsa
agcucugggggaggcacaggcccucauccacccucuggcacaacucugaggccaccaaccuc

SEQ ID NO: 418082 - RNA, 62 nt, hsa
cugccccagguugaggcccacaacacggugaccucuggcaccgcaaccacagucauugagau

SEQ ID NO: 418083 - RNA, 62 nt, hsa
gagugggucucuguggcuuucacugauguucacucuggcauacuuucgcaauuuucuuuuuc

SEQ ID NO: 418084 - RNA, 62 nt, hsa
uuuuaaauuucacagaagaggaaaguugccugcucuggcagguaugugcaagauagagugug

SEQ ID NO: 418085 - RNA, 62 nt, hsa; identical to SEQ ID NO: 418084

SEQ ID NO: 418086 - RNA, 62 nt, hsa; identical to SEQ ID NO: 418083

SEQ ID NO: 418087 - RNA, 62 nt, hsa
uucuaaaucucacagaagaggaaaguggccugcucuggcagguaugugcaggauacagugug

SEQ ID NO: 418088 - RNA, 62 nt, hsa
gagugggucucuguggcucucacugauguucacucuggcauccuucagcauuuuucuuuuuu

SEQ ID NO: 418089 - RNA, 62 nt, hsa
uuguuacaaacaucccucuggcauuuccuggucucuggcacaucauaaccaauuggaaaccu

SEQ ID NO: 418090 - RNA, 62 nt, hsa
cuuagaguuuggcagcuuuguuacaaacaucccucuggcauuuccuggucucuggcacauca

SEQ ID NO: 418091 - RNA, 62 nt, hsa
cugacuucuugcccuuuggaaauggugcagcacucuggcauuuaucacccccaccugggucc

SEQ ID NO: 418092 - RNA, 62 nt, hsa
aaggaguguccuuuacccucccagccuccaggcucuggcagaaauaaacuccaacccgacug

SEQ ID NO: 418093 - RNA, 62 nt, hsa
cccugcccacucuuaccgagcaagguggguggcucuggcacgagucccccagggggagagca

SEQ ID NO: 418094 - RNA, 62 nt, hsa
caccaugaggacauuccauccuucacccccuccucuggcacaggccaccacugcggugcugu

SEQ ID NO: 418095 - RNA, 62 nt, hsa
gucucuuagaccuguucuggcugaagggcuaucucuggcaccucugagaucccuagguccug

SEQ ID NO: 418096 - RNA, 62 nt, hsa
acucugcagcccuugaacauggcacugcccuccucuggcacucaugcugggccugugcccac

SEQ ID NO: 418097 - RNA, 62 nt, hsa
acacccacaggacacugggggcugucacccugcucuggcaguccugcuaagagugucagggc

SEQ ID NO: 418098 - RNA, 62 nt, hsa
cuuccaggcaugaucuuccccaucaggcugggcucuggcagggaccugcccaggauggagau

SEQ ID NO: 418099 - RNA, 64 nt, hsa; identical to SEQ ID NO: 123011

SEQ ID NO: 418100 - RNA, 64 nt, hsa; identical to SEQ ID NO: 123012

SEQ ID NO: 418101 - RNA, 64 nt, hsa; identical to SEQ ID NO: 123013

SEQ ID NO: 418102 - RNA, 64 nt, hsa; identical to SEQ ID NO: 123014

SEQ ID NO: 418103 - RNA, 64 nt, hsa; identical to SEQ ID NO: 123015

SEQ ID NO: 418104 - RNA, 64 nt, hsa; identical to SEQ ID NO: 123016

SEQ ID NO: 418105 - RNA, 64 nt, hsa; identical to SEQ ID NO: 123017

SEQ ID NO: 418106 - RNA, 64 nt, hsa; identical to SEQ ID NO: 123018

SEQ ID NO: 418107 - RNA, 64 nt, hsa; identical to SEQ ID NO: 123019

SEQ ID NO: 418108 - RNA, 64 nt, hsa; identical to SEQ ID NO: 123020

SEQ ID NO: 418109 - RNA, 64 nt, hsa; identical to SEQ ID NO: 123021

SEQ ID NO: 418110 - RNA, 64 nt, hsa; identical to SEQ ID NO: 123022

SEQ ID NO: 418111 - RNA, 64 nt, hsa; identical to SEQ ID NO: 123023

SEQ ID NO: 418112 - RNA, 64 nt, hsa; identical to SEQ ID NO: 123024

SEQ ID NO: 418113 - RNA, 64 nt, hsa; identical to SEQ ID NO: 123025

SEQ ID NO: 418114 - RNA, 64 nt, hsa; identical to SEQ ID NO: 123026

SEQ ID NO: 418115 - RNA, 64 nt, hsa; identical to SEQ ID NO: 123027

SEQ ID NO: 418116 - RNA, 64 nt, hsa; identical to SEQ ID NO: 123028

SEQ ID NO: 418117 - RNA, 64 nt, hsa; identical to SEQ ID NO: 123029

SEQ ID NO: 418118 - RNA, 64 nt, hsa; identical to SEQ ID NO: 123030

SEQ ID NO: 418119 - RNA, 64 nt, hsa; identical to SEQ ID NO: 123031

SEQ ID NO: 418120 - RNA, 64 nt, hsa; identical to SEQ ID NO: 123032

SEQ ID NO: 418121 - RNA, 64 nt, hsa; identical to SEQ ID NO: 123033

SEQ ID NO: 418122 - RNA, 64 nt, hsa; identical to SEQ ID NO: 123034

SEQ ID NO: 418123 - RNA, 64 nt, hsa; identical to SEQ ID NO: 123035

SEQ ID NO: 418124 - RNA, 64 nt, hsa; identical to SEQ ID NO: 123036

SEQ ID NO: 418125 - RNA, 64 nt, hsa; identical to SEQ ID NO: 123037

SEQ ID NO: 418126 - RNA, 64 nt, hsa; identical to SEQ ID NO: 123038

SEQ ID NO: 418127 - RNA, 64 nt, hsa; identical to SEQ ID NO: 123039

SEQ ID NO: 418128 - RNA, 64 nt, hsa; identical to SEQ ID NO: 123040

SEQ ID NO: 418129 - RNA, 64 nt, hsa; identical to SEQ ID NO: 123041

SEQ ID NO: 418130 - RNA, 64 nt, hsa; identical to SEQ ID NO: 123042

SEQ ID NO: 418131 - RNA, 64 nt, hsa; identical to SEQ ID NO: 123043

SEQ ID NO: 418132 - RNA, 64 nt, hsa; identical to SEQ ID NO: 123044

SEQ ID NO: 418133 - RNA, 64 nt, hsa; identical to SEQ ID NO: 123045

SEQ ID NO: 418134 - RNA, 64 nt, hsa; identical to SEQ ID NO: 123046

SEQ ID NO: 418135 - RNA, 64 nt, hsa; identical to SEQ ID NO: 123047

SEQ ID NO: 418136 - RNA, 64 nt, hsa; identical to SEQ ID NO: 123048

SEQ ID NO: 418137 - RNA, 64 nt, hsa; identical to SEQ ID NO: 123049

SEQ ID NO: 418138 - RNA, 64 nt, hsa; identical to SEQ ID NO: 123050

SEQ ID NO: 418139 - RNA, 64 nt, hsa; identical to SEQ ID NO: 123051

SEQ ID NO: 418140 - RNA, 64 nt, hsa; identical to SEQ ID NO: 123052

SEQ ID NO: 418141 - RNA, 64 nt, hsa; identical to SEQ ID NO: 123053

SEQ ID NO: 418142 - RNA, 64 nt, hsa; identical to SEQ ID NO: 123054

SEQ ID NO: 418143 - RNA, 64 nt, hsa; identical to SEQ ID NO: 123055

SEQ ID NO: 418144 - RNA, 64 nt, hsa; identical to SEQ ID NO: 123056

SEQ ID NO: 418145 - RNA, 64 nt, hsa; identical to SEQ ID NO: 123057

SEQ ID NO: 418146 - RNA, 64 nt, hsa; identical to SEQ ID NO: 123058

SEQ ID NO: 418147 - RNA, 64 nt, hsa; identical to SEQ ID NO: 123059

SEQ ID NO: 418148 - RNA, 64 nt, hsa; identical to SEQ ID NO: 123060

SEQ ID NO: 418149 - RNA, 64 nt, hsa; identical to SEQ ID NO: 123061

SEQ ID NO: 418150 - RNA, 64 nt, hsa; identical to SEQ ID NO: 123062

SEQ ID NO: 418151 - RNA, 64 nt, hsa; identical to SEQ ID NO: 123063

SEQ ID NO: 418152 - RNA, 64 nt, hsa; identical to SEQ ID NO: 123064

SEQ ID NO: 418153 - RNA, 64 nt, hsa; identical to SEQ ID NO: 123065

SEQ ID NO: 418154 - RNA, 64 nt, hsa; identical to SEQ ID NO: 123066

SEQ ID NO: 418155 - RNA, 64 nt, hsa; identical to SEQ ID NO: 123067

SEQ ID NO: 418156 - RNA, 64 nt, hsa; identical to SEQ ID NO: 123068

SEQ ID NO: 418157 - RNA, 64 nt, hsa; identical to SEQ ID NO: 123069

SEQ ID NO: 418158 - RNA, 64 nt, hsa; identical to SEQ ID NO: 123070

SEQ ID NO: 418159 - RNA, 64 nt, hsa; identical to SEQ ID NO: 123071

SEQ ID NO: 418160 - RNA, 64 nt, hsa; identical to SEQ ID NO: 123072

SEQ ID NO: 418161 - RNA, 64 nt, hsa; identical to SEQ ID NO: 123073

SEQ ID NO: 418162 - RNA, 64 nt, hsa; identical to SEQ ID NO: 123074

SEQ ID NO: 418163 - RNA, 64 nt, hsa
ugcucauccacuucccuacacaucuauggguaucacacccaagacuacccaccaagcucauaca

SEQ ID NO: 418164 - RNA, 64 nt, hsa
cccaagacuacccaccaagcucauacagggaaccacacccaacacuuagacaugcgaacaagca

SEQ ID NO: 418165 - RNA, 62 nt, hsa
ccggggguagggguggggccacacaaaucuccaggagccaccacucaacacaauggcccugc

SEQ ID NO: 418166 - RNA, 62 nt, hsa
agggugggugcuggcugagcccccggggcagcaggagccaggcaggugaugucuuuguucuc

SEQ ID NO: 418167 - RNA, 62 nt, hsa
uccaugcaguacaauggcagcuacuucgacagaggagccaagggcggcagccgccucugcac

SEQ ID NO: 418168 - RNA, 62 nt, hsa
ugcaggcaccucuguucccgcuuugccccuggaggagccacuauuccagaaggcuccacccu

SEQ ID NO: 418169 - RNA, 62 nt, hsa
acggcaugguauauuacuauuuccacauaaugaggagccaaagaaaucugauguuuuuaaca

SEQ ID NO: 418170 - RNA, 62 nt, hsa
ucccauggcgagaugggggcucacuccggaggaggagccaggcagcagggccuuccugacca

SEQ ID NO: 418171 - RNA, 62 nt, hsa
ccaccugcccccuccacuucccucagaugaugaggagccagggcuaagggggcagccuucuc

SEQ ID NO: 418172 - RNA, 62 nt, hsa
gccugauguccccagcuggggucagucucaacaggagccagucuucuggagccucugggcag

SEQ ID NO: 418173 - RNA, 62 nt, hsa
ugugguuuauuguuguacauucacaaucuugcaggagccaagaaguucgcaguugugaacag

SEQ ID NO: 418174 - RNA, 62 nt, hsa
cuugggccccaaaagcugguggugaaaugaggaggagccaauuuaagaagacccuuauggag

SEQ ID NO: 418175 - RNA, 62 nt, hsa
gcucagggcagcugugcugggugagcucuuccaggagccaccuugccacccauucuucccgu

SEQ ID NO: 418176 - RNA, 51 nt, hsa
gcagcgccucccaguucugagaggagccagguuccccuuccucccucccuu

SEQ ID NO: 418177 - RNA, 62 nt, hsa
ggcuuauuguuugagugugaaguuccagagcaaggagccauguuccucuaagggaauucagg

SEQ ID NO: 418178 - RNA, 62 nt, hsa
ccuggacuauucccaggcacagcugugggcccaggagccagcucaggugcuccccuccacca

SEQ ID NO: 418179 - RNA, 62 nt, hsa
auagggcccagugaugccagaagaugggagggaggagccaaccuugcugccugcgacccugg

SEQ ID NO: 418180 - RNA, 62 nt, hsa
ccuguuuguuuuaguauccaaggaagagaccaaggagccagcuggcgggaaggggugggggu

SEQ ID NO: 418181 - RNA, 62 nt, hsa
gaccuuuguuguaagucucccaacguccuauuaggagccacagcaggugaggcauuuggugc

SEQ ID NO: 418182 - RNA, 62 nt, hsa
cguguggauaugaggcugguguagaggcggagaggagccaagaaacuaaaggugaaaaauac

SEQ ID NO: 418183 - RNA, 62 nt, hsa
ugcagcccuuuggaagacauuguccugcaagcaggagccagggcaauaucuauauuccuaca

SEQ ID NO: 418184 - RNA, 62 nt, hsa
ugugagccaagcagaccuucccucucaucccaaggagccagaguccucccaagauccccugg

SEQ ID NO: 418185 - RNA, 62 nt, hsa
aauacuugaaccuucucccagguaggggcaggaggagccacaugagagagggagaaggaccg

SEQ ID NO: 418186 - RNA, 62 nt, hsa
uaagaugaggaagucgggcaguacacaggaagaggagccaggcccuuguaccuaugggauug

SEQ ID NO: 418187 - RNA, 62 nt, hsa
aggccuucugagccgggugguccuggaauuaaaggagccacaggcccuccgggagcucaggg

SEQ ID NO: 418188 - RNA, 62 nt, hsa
guauaaauauucuauuuagucauccugauaugaggagccaguguugcaugaugaaaagaugg

SEQ ID NO: 418189 - RNA, 62 nt, hsa
uaguaucgccugguugggccugggcaaugggaaggagccagaaaugccaucuucacccagaa

SEQ ID NO: 418190 - RNA, 62 nt, hsa
ggugcuuucuaaaaugaaugcaauugaaagaaaggagccaaggaagagauuaagaaaaagaa

SEQ ID NO: 418191 - RNA, 62 nt, hsa
gcagaucccucuuuuccaguucuccuuccucuaggagccauguuauccucugucccccauag

SEQ ID NO: 418192 - RNA, 62 nt, hsa
guaaugggauugagcauuuauggcagcaacagaggagccacaaaauguucuuuguucuuugg

SEQ ID NO: 418193 - RNA, 62 nt, hsa
cgggaucaucuaagaaauguagcugaaacccaaggagccagcuagaaagaagcuuuugauua

SEQ ID NO: 418194 - RNA, 62 nt, hsa
cugggcagguccuggggaggcugagacugcagaggagccaccugggcugggagaaggugcuu

SEQ ID NO: 418195 - RNA, 62 nt, hsa
gaagaacaucucgaauacaauuuuggugggaaaggagccaauugauuucaacagaaucagau

SEQ ID NO: 418196 - RNA, 62 nt, hsa
aagcuguaccaguugcuaaccugucuuguuucaggagccaccauguuuuuuuuucaguguua

SEQ ID NO: 418197 - RNA, 62 nt, hsa
cacuggggccaaggugggguggagagaggccuaggagccagaaagggcccucugcugugguc

SEQ ID NO: 418198 - RNA, 62 nt, hsa
ccccucggugggacagcggcggccuuggaguuaggagccacccugggagguugugccggugc

SEQ ID NO: 418199 - RNA, 62 nt, hsa
cccacaugggagagaaaagcugccaccuuuuuaggagccagcgccaccuugggacaaaaagg

SEQ ID NO: 418200 - RNA, 62 nt, hsa
caccacucugcugccccaccacgcggccugugaggagccacuaaaccuuuccgugccuagac

SEQ ID NO: 418201 - RNA, 62 nt, hsa
ccguaggggcuccugagugucaugaagugcacaggagccaaaugaccgagcccuggagagcc

SEQ ID NO: 418202 - RNA, 62 nt, hsa
gcggacauagagacaggaugaagacaugcuugaggagccacggaguuugggggccacagcac

SEQ ID NO: 418203 - RNA, 62 nt, hsa
uuuugccauagcuuuuuaggacuugguguuaaaggagccaguggucucucuggguggguacu

SEQ ID NO: 418204 - RNA, 62 nt, hsa
uuuuccucagaguuucugccuugcgcugguccaggagccauuuugcaccaaggacuugguag

SEQ ID NO: 418205 - RNA, 62 nt, hsa
agggcagguagcacugaggcuccuguggaaacaggagccaccugcucaggagaccccuuucc

SEQ ID NO: 418206 - RNA, 62 nt, hsa
caggcuucaugccugcauccuccagagaccacaggagccaaagcgagccuccaggcccagca

SEQ ID NO: 418207 - RNA, 62 nt, hsa
aucggguuucuguuggagauggggcuucccuuaggagccauauucaacuacagccuucuaaa

SEQ ID NO: 418208 - RNA, 62 nt, hsa
cucuauuuucacacuccacuuuggaacuacccaggagccagcgcccucuccccucucccgag

SEQ ID NO: 418209 - RNA, 62 nt, hsa
guagugugacacauuguaguguuugccaggaaaggagccagucaugccggaaacacugacuu

SEQ ID NO: 418210 - RNA, 62 nt, hsa
caggcucuggacuaggugcuagguuuccagggaggagccaaacacgggccuugcucuugugg

SEQ ID NO: 418211 - RNA, 62 nt, hsa
cucacaccaggccuuggacagcucucccagacaggagccaggguugagcaauggagagccca

SEQ ID NO: 418212 - RNA, 62 nt, hsa
agaaggacgaaaugaaaagcauuuggaaguuuaggagccacgugagugaaaguuuuaagaaa

SEQ ID NO: 418213 - RNA, 62 nt, hsa
aagcuugggccugcucuccuuuccauccucuaaggagccaacuuggcuuuuaccugucaaau

SEQ ID NO: 418214 - RNA, 62 nt, hsa
ucgaaccaaccuuuuagcuguugcaaaucagaaggagccagagaagcaggcagucucaugca

SEQ ID NO: 418215 - RNA, 62 nt, hsa
gaugcuuaccagugggcaggggacccccaaagaggagccagcccucugcucuccaucucccc

SEQ ID NO: 418216 - RNA, 62 nt, hsa
gcggccuccguagcuaaccucccugcccucugaggagccaucuuccugaaucgcauucucua

SEQ ID NO: 418217 - RNA, 62 nt, hsa
cagugcccagcaaugaagugaauucauggcacaggagccagggaccgugacaacggugcccu

SEQ ID NO: 418218 - RNA, 62 nt, hsa
ugugauguuguguguguugggggagcuuccacaggagccacacuggggaaaagcuguaguau

SEQ ID NO: 418219 - RNA, 62 nt, hsa
aguagccccauaagcaucagcccuguagagugaggagccaucucuagcgggcccuucauucc

SEQ ID NO: 418220 - RNA, 62 nt, hsa
auuucuaaauuaaucuuuuucagaaauaucgaaggagccaaaaauauaaaacaguucuguau

SEQ ID NO: 418221 - RNA, 62 nt, hsa
gacugugaggacagaagccaaacuggaaguggaggagccaagggauugacaaacaacagagc

SEQ ID NO: 418222 - RNA, 62 nt, hsa
uuguguuccgggaauaacaugauacuauucagaggagccagaaguaaaguuuauuucaugga

SEQ ID NO: 418223 - RNA, 62 nt, hsa
uggguucccagaagggagaucugggaggggucaggagccacuaaguugcuucacuccuuuuu

SEQ ID NO: 418224 - RNA, 62 nt, hsa
gcacacugaagucacgggaggaggcugugaugaggagccaggugcugcaggccugaggggcc

SEQ ID NO: 418225 - RNA, 62 nt, hsa
aaaggacaccauuuuggcaagcucuaucaccaaggagccaaacauccuacaagacacaguga

SEQ ID NO: 418226 - RNA, 62 nt, hsa
ccagugcucuuguacauccacacagcacccuaaggagccauagucaccaucaaagacucaac

SEQ ID NO: 418227 - RNA, 62 nt, hsa
guauggaaaccugccggcuccaggccagacccaggagccaagagaaggcugaagccagcuug

SEQ ID NO: 418228 - RNA, 62 nt, hsa
uucugcuuucuuuuaaaggcaggaggaaaggcaggagccaguccgugcaggcacacucagcg

SEQ ID NO: 418229 - RNA, 62 nt, hsa
cuucucuccggaccagggaggcgucccucccuaggagccacacauuauacuccaagucccug

SEQ ID NO: 418230 - RNA, 62 nt, hsa
uggcgacaguuucccuuaggggucugccuggcaggagccacagcucaggagaguugugaggg

SEQ ID NO: 418231 - RNA, 62 nt, hsa
aaaauuucugugaaaucaaauccaguuuuaagaggagccacuuaucaaagagauuuuaacag

SEQ ID NO: 418232 - RNA, 62 nt, hsa
uggacgaggcuuaaagugcuuugugagugaauaggagccauucgcuaauucuagacccacag

SEQ ID NO: 418233 - RNA, 62 nt, hsa
gguggggggugucagggcaguggaggggcccgaggagccagguugcauuuauuggaugggga

SEQ ID NO: 418234 - RNA, 62 nt, hsa
gagggucccacgcugaccuuggcccugaccucaggagccacgcuguagacauucccucuccu

SEQ ID NO: 418235 - RNA, 62 nt, hsa
uuggggagccaggagacagcagggucugagagaggagccacagucccuaaugacacccacuc

SEQ ID NO: 418236 - RNA, 62 nt, hsa
gccugcgcuuuccucaggucccagaggguggaaggagccaggacgcacccccacugcugcug

SEQ ID NO: 418237 - RNA, 62 nt, hsa
agccugcgggcugcgggagcggcucucacccuaggagccagagcccaaugugucuuauuccc

SEQ ID NO: 418238 - RNA, 62 nt, hsa
gaggaaucaggccccaagacagaaguacuuggaggagccagcugcaguaguauccgccugua

SEQ ID NO: 418239 - RNA, 62 nt, hsa
uuauagcugcuucauucugcuacuuuguaacuaggagccauugcauuuauuaaaugucccuc

SEQ ID NO: 418240 - RNA, 62 nt, hsa
agcucccuagacucaucccaugucagcucccuaggagccacagcaccaggaagggaugcugc

SEQ ID NO: 418241 - RNA, 62 nt, hsa
ucuggguacuucccuugaccccgagaucacucaggagccagacaggaaacuuauucuauucc

SEQ ID NO: 418242 - RNA, 62 nt, hsa
uauuguacuaucccuguaacugccaagagcucaggagccaggcuagugaucacaccaggggu

SEQ ID NO: 418243 - RNA, 62 nt, hsa
gugauaugucaccguaugccuuaggauguucaaggagccagacgaaauaaggccugucuucc

SEQ ID NO: 418244 - RNA, 62 nt, hsa
augccugugggcuguccucccaggacaagccaaggagccaacgagggcucuggagcugugag

SEQ ID NO: 418245 - RNA, 62 nt, hsa
cagcucagccaccacucagugcuucucugugcaggagccaguccugauuaauaugugggaau

SEQ ID NO: 418246 - RNA, 62 nt, hsa
uguacagcaucauuaaacacuaagcucaguuaaggagccaucagcaacacugaagagaucag

SEQ ID NO: 418247 - RNA, 62 nt, hsa
ggcuggagagguuggggccgggguagggaggcaggagccaugucaguucugaaggaggguga

SEQ ID NO: 418248 - RNA, 62 nt, hsa
gcaaagcugggaauccugcagaaaagagugugaggagccagggaaaggcagaaccaccucca

SEQ ID NO: 418249 - RNA, 62 nt, hsa
ccgaagcuacuggacuaugcugaugggccagcaggagccagccaaggccgcuguggccuuca

SEQ ID NO: 418250 - RNA, 62 nt, hsa
cugagcagggagauuauaacagcuggguucgcaggagccagccuuggcccuguuguaggcuu

SEQ ID NO: 418251 - RNA, 62 nt, hsa
uuuucugaaucucugguuuugcuuuguuggcaaggagccagggaauccugaccugagccaga

SEQ ID NO: 418252 - RNA, 62 nt, hsa
ccgggaaccaagcaggagacgacaggcgagagaggagccagacagacccugaaaagaaggac

SEQ ID NO: 418253 - RNA, 62 nt, hsa
cuccucacugcccuuuaggcucccagggccagaggagccagggacuauuuucugcaccagcc

SEQ ID NO: 418254 - RNA, 62 nt, hsa
ucgauuugcuauugaaauauaguauuugauacaggagccauguguacgaauugcaaucauga

SEQ ID NO: 418255 - RNA, 62 nt, hsa
acuucuuuuuagagccaauguaauugccuguuaggagccagaaguuugcccagcugcuuucu

SEQ ID NO: 418256 - RNA, 62 nt, hsa
caucagagagcaaaaccacauguucugucuugaggagccauagcagaaagagcaaauuaguc

SEQ ID NO: 418257 - RNA, 62 nt, hsa
gaaaccugguuggccacgccacaccaugaccgaggagccaacugggacuucuggcuguuuga

SEQ ID NO: 418258 - RNA, 62 nt, hsa
acuucccaguuuccuuucaguaaucuuucugaaggagccaggacaauagggccuguuguuua

SEQ ID NO: 418259 - RNA, 62 nt, hsa
gcccaaucccucuuggccgcuaaggcuaagguaggagccagagagcuguagagacaggacca

SEQ ID NO: 418260 - RNA, 62 nt, hsa
ggugugugucuuggugcauuggaaaaggagucaggagccacugugaggugagaaugaaagug

SEQ ID NO: 418261 - RNA, 62 nt, hsa
ccucaccccaguuccaugacauuggcugguauaggagccacagucaggaaagcacuugaggc

SEQ ID NO: 418262 - RNA, 56 nt, hsa
acaaggucacagaucuauaggaacccaggagccacggccugcuguugcuucagccu

SEQ ID NO: 418263 - RNA, 62 nt, hsa
aguuuguaugaaugaauugcuauacauuuauaaggagccagggucuggaggguugcuaucac

SEQ ID NO: 418264 - RNA, 62 nt, hsa
uuucuccucacuguauccagguucccucccagaggagccaccaguucucauggguggcacuc

SEQ ID NO: 418265 - RNA, 62 nt, hsa
cgaaugagaggaccacauuuugcuuaauguaaaggagccacuugaaaaugucugcuccuucg

SEQ ID NO: 418266 - RNA, 62 nt, hsa
cacuuuuuucagaaaaccaauuguuccucagaaggagccaucaccuuugcuggaaaagaaga

SEQ ID NO: 418267 - RNA, 62 nt, hsa
acccaaagcauuuuaugcuccguuccaucuuaaggagccauccuuaagucugcucccacccu

SEQ ID NO: 418268 - RNA, 62 nt, hsa
ggucuagugacacgguagcaccaguugcaggaaggagccagacuuguucucagagcacugug

SEQ ID NO: 418269 - RNA, 62 nt, hsa
uacauccgcccaccaugucccccugcugggucaggagccaacacaggacccugcgugugagc

SEQ ID NO: 418270 - RNA, 62 nt, hsa
acccugcugaagaucacucugugcccugggggaggagccaagcccucaccccacaaggggca

SEQ ID NO: 418271 - RNA, 62 nt, hsa
ggaacagagccaaugauguguggguuacacugaggagccaaggacagggccucaggucuccc

SEQ ID NO: 418272 - RNA, 62 nt, hsa
uucuuuaacaggacaaacuuacugcagcuugaaggagccaaccauggauuugaggcguguga

SEQ ID NO: 418273 - RNA, 62 nt, hsa
ccggcgcagugggaagcucgcagcagcuggggaggagccaaagccucggcgcucaccuaagc

SEQ ID NO: 418274 - RNA, 62 nt, hsa
auggggcaggccgugguccuccagcaugaagaaggagccaugaggaguucccaugaccuccc

SEQ ID NO: 418275 - RNA, 62 nt, hsa
ucccuggaccagccuccuguuugcaggcccagaggagccaagucauuaaaauggaaguggau

SEQ ID NO: 418276 - RNA, 62 nt, hsa
uggcuguucucccaccgggucugggcucuggaaggagccagaugcccccagaaaggugggug

SEQ ID NO: 418277 - RNA, 62 nt, hsa
ggcagaggugcuccucacuucccagagggugcaggagccagcucugacuaguaaauuucuaa

SEQ ID NO: 418278 - RNA, 62 nt, hsa
cauucacacauggccaggcuauccaaaaagaaaggagccauguucucaugugguuuaccaua

SEQ ID NO: 418279 - RNA, 62 nt, hsa
aguuaauaggaguauuuuugggcuauugcauaaggagccacugcugccaccacuuuuggauu

SEQ ID NO: 418280 - RNA, 62 nt, hsa
gcugaaagucagcccacgucggagcggugaggaggagccacagcacauggggugccaccucg

SEQ ID NO: 418281 - RNA, 62 nt, hsa
uguagauggcuaacaagcaguauuaaaauuucaggagccaagucacaaucuuucuccuguuu

SEQ ID NO: 418282 - RNA, 62 nt, hsa
cagacacacacagggaugcucacgggugcaccaggagccaggugcggcgcagccaacccuga

SEQ ID NO: 418283 - RNA, 62 nt, hsa
gcccaggccugcccggugcccacccugcugguaggagccagcggcucuggccaagugcacga

SEQ ID NO: 418284 - RNA, 62 nt, hsa
ucugcaagccacugcugagacccuucccagggaggagccacccaagagcugcacucuugugc

SEQ ID NO: 418285 - RNA, 62 nt, hsa
agaccaaugcacuucacaggcaagacugcagcaggagccagaaggaaaacagauacaacugc

SEQ ID NO: 418286 - RNA, 62 nt, hsa
uaaagagcagaugccaucuucuggcuuccucaaggagccaguuaaaaaaccagagcauuccu

SEQ ID NO: 418287 - RNA, 62 nt, hsa
gcaacacuaauauaaauuauuccaagucuuuaaggagccaaagaaaaaaaagauuucucaca

SEQ ID NO: 418288 - RNA, 62 nt, hsa
accaggcccuugucugugcccuguccacacccaggagccauccucagugucuguggccacaa

SEQ ID NO: 418289 - RNA, 62 nt, hsa
ugaugucuuuucuuuuggucggaagugagugaaggagccaggucgcccugaagguuuuccaa

SEQ ID NO: 418290 - RNA, 62 nt, hsa
ugaaagggaaagucagcuuucagagccagugaaggagccacgugaauggcccuagaacugug

SEQ ID NO: 418291 - RNA, 62 nt, hsa
gccuggagugugaacuguauuuauuuuagcagaggagccauguccugcugcuucugcaaaaa

SEQ ID NO: 418292 - RNA, 62 nt, hsa
agccucuacacaauaauagggagacaaggauuaggagccauaccucccagagcaagguaucu

SEQ ID NO: 418293 - RNA, 62 nt, hsa
gguguucugcagaagggagaaggcugugcuagaggagccagugagggccagcaugggguggg

SEQ ID NO: 418294 - RNA, 62 nt, hsa
uccaauauggauuucuagaaugcugugauuaaaggagccagccagguguaauacagucaagg

SEQ ID NO: 418295 - RNA, 62 nt, hsa
ccagcccuggcugggagagcgggagcuggcagaggagccacugccaaacucaaggcuccucu

SEQ ID NO: 418296 - RNA, 62 nt, hsa
guggggccgugggcuggguagggugccuuggcaggagccaggacaaggcccuccuggcagag

SEQ ID NO: 418297 - RNA, 62 nt, hsa
ugacuuugcuucugugcacagccccgucuuccaggagccacaacucagaagaaaagggugcu

SEQ ID NO: 418298 - RNA, 62 nt, hsa
agaggcugcacuugugcccccagauguuucugaggagccagacuagggcuggcauugcugua

SEQ ID NO: 418299 - RNA, 62 nt, hsa
guuuugcuguucuccccacuccauauuaaugcaggagccagguuggucuguuaggaugaaca

SEQ ID NO: 418300 - RNA, 62 nt, hsa
gggggaugcauccagagaaaauugcuucuuuaaggagccacggaagaaaugauaaucucuaa

SEQ ID NO: 418301 - RNA, 62 nt, hsa
cauaucucuaacaccacacagaaagaggcuggaggagccacuggacaaagcuucugucucug

SEQ ID NO: 418302 - RNA, 62 nt, hsa
uggaacauaauaugcaagauugguaaacaggcaggagccagguugugcagugcuguguaugg

SEQ ID NO: 418303 - RNA, 62 nt, hsa
cuggugugggcaggcagaggccaguacagaggaggagccauuguggcagugcccugugcgcc

SEQ ID NO: 418304 - RNA, 62 nt, hsa
cuucugccuccccggagccacaggauggauuuaggagccacugcucagugcacuucucccuu

SEQ ID NO: 418305 - RNA, 62 nt, hsa
aagaugaccagugugaaaacucucagauagaaaggagccaugcauauuaaaugaggggcaac

SEQ ID NO: 418306 - RNA, 62 nt, hsa
uaccaugccuuauuauuacccuuugcuguuugaggagccagaaauagaggugcaguuagagg

SEQ ID NO: 418307 - RNA, 62 nt, hsa
aucaagucccucacagccauuucuguucccagaggagccaggccugcagcuggcugcucagg

SEQ ID NO: 418308 - RNA, 62 nt, hsa
ccucgagaaccuuuuuuuuuuuaaccaaaaccaggagccaggcugugccaugucccccgccc

SEQ ID NO: 418309 - RNA, 62 nt, hsa
uggcgccuccggcggggccugucccugggcccaggagccaaugugaacuuuuuuuuuuaccg

SEQ ID NO: 418310 - RNA, 62 nt, hsa
gacagccccaucuucaucugcccugcacucacaggagccaauggggucacggugccugaaga

SEQ ID NO: 418311 - RNA, 62 nt, hsa
uuuccgugucauccuuuuugguguguaggacaaggagccagggaauuggcacguuuggcuuu

SEQ ID NO: 418312 - RNA, 62 nt, hsa
gcuucggcugugccuagggcaacagccaaccuaggagccagcgggcuuucggggaaaaaaaa

SEQ ID NO: 418313 - RNA, 62 nt, hsa
gcuuccuggguccugccugguccucccucccaaggagccauucugugugugacucugggugg

SEQ ID NO: 418314 - RNA, 62 nt, hsa
cauuguguggccacacagugucguugauuuaaaggagccagugcuuccccucuccccaggua

SEQ ID NO: 418315 - RNA, 62 nt, hsa
guaaaaauacaaacagaucgugugaucauucaaggagccagacaugagguccugcacgaggg

SEQ ID NO: 418316 - RNA, 62 nt, hsa
uauagaaugugucacacuguggccugaucagcaggagccaauaucccuuacuuuaacccuuu

SEQ ID NO: 418317 - RNA, 62 nt, hsa
gucagaaauagcaagcaaaaagcaggacucccaggagccacaagaaaagagcacaggcugca

SEQ ID NO: 418318 - RNA, 62 nt, hsa
uccccauucuggccagagcagggcuggagggaaggagccaggagggagagagccucccaccu

SEQ ID NO: 418319 - RNA, 62 nt, hsa
cuccaccaaauaagggcuuuuuccccuauuuaaggagccagauggauugaaagauguggaaa

SEQ ID NO: 418320 - RNA, 62 nt, hsa
caguucuuuugcaggagucaagaugugcucauaggagccaagggcaaacucgaaaacagccc

SEQ ID NO: 418321 - RNA, 62 nt, hsa
acauggacuaaaggcaaugccaggagcccugaaggagccagcagaaccuucccacaugcuga

SEQ ID NO: 418322 - RNA, 62 nt, hsa
uaguugcuuuucaccccccgaguucaguuucuaggagccaaugaaacuuccccucaccuccu

SEQ ID NO: 418323 - RNA, 62 nt, hsa
auuaguaugccaacugccacuacuccuucaaaaggagccaggaccagcgacaagacucauga

SEQ ID NO: 418324 - RNA, 62 nt, hsa
gccaauaaaagaagggccucacaagacaaaacaggagccagaaguaaggacugaaggagaag

SEQ ID NO: 418325 - RNA, 62 nt, hsa
gccaaagcuguccguuuugcagauggacaggaaggagccaggacacagcucagcuugcucac

SEQ ID NO: 418326 - RNA, 62 nt, hsa
acuggggccuggggcucuagcccaaggcucagaggagccaauaaaccuguaaaugaauagac

SEQ ID NO: 418327 - RNA, 62 nt, hsa
agccccuggaaaagaagagacagccauagacgaggagccagagugggggcagacuggccauu

SEQ ID NO: 418328 - RNA, 62 nt, hsa
ugucucaaagguaggcagaggcaggaaaagcaaggagccagaauuaagagguugggucaguc

SEQ ID NO: 418329 - RNA, 62 nt, hsa
cugggaggagaagggaggggcuggggguucccaggagccaugcguggccugcagaguccauu

SEQ ID NO: 418330 - RNA, 62 nt, hsa
ucccagccggauuuaaagcagucacuucagacaggagccacagggagccugugagggaguag

SEQ ID NO: 418331 - RNA, 62 nt, hsa
ugccgucauugcuggcuuaaagacaaggggccaggagccaacaccagaggccacuccacaac

SEQ ID NO: 418332 - RNA, 62 nt, hsa
uucagaaaauauaagccuuuaaagugaagaagaggagccaguugugcuggcucacaucugua

SEQ ID NO: 418333 - RNA, 62 nt, hsa
agccacagaagccuagggcagaccaagaagaaaggagccaaggcaaagagggaccacugugc

SEQ ID NO: 418334 - RNA, 62 nt, hsa
gucauacuguuuuaggaucaagacuaggaauuaggagccagguugacaaggacuuuuucuga

SEQ ID NO: 418335 - RNA, 62 nt, hsa
uaauuuuuauuauauuuucaguuuuuccauaaaggagccaauuccaacucuguaccuggucu

SEQ ID NO: 418336 - RNA, 62 nt, hsa
guuccuguggugguuucuguuugcauuuuugcaggagccauaggaaacuacugaaaugauug

SEQ ID NO: 418337 - RNA, 62 nt, hsa
auagcauccgccccuuagagcccucuggcuagaggagccaccaguggaaaggaagacccucc

SEQ ID NO: 418338 - RNA, 62 nt, hsa
gugggccgcuguguuuggagacggccaagugaaggagccagugcccacuauggcccugggag

SEQ ID NO: 418339 - RNA, 62 nt, hsa
acaugaucguuggaugaccaaguucaggcuccaggagccaugccugagacucccuaugucug

SEQ ID NO: 418340 - RNA, 62 nt, hsa
gcccugcccucucaccucugacacccagccccaggagccagaccacuccugccuccaccucu

SEQ ID NO: 418341 - RNA, 62 nt, hsa
uggguuucagggaaugggcaugccaggugccaaggagccaaacagauggcuuuccaggcagc

SEQ ID NO: 418342 - RNA, 62 nt, hsa
ggugcagcugcagccaggaggggagcgggcccaggagccaggcucagguccagcugguuccu

SEQ ID NO: 418343 - RNA, 62 nt, hsa
ggggacuggacagaaaaccacugcaagccccaaggagccagcugaagccucccaauccccag

SEQ ID NO: 418344 - RNA, 62 nt, hsa
acaugaacaugauggacacccuugggucugcaaggagccagcaucuuacuuggucccacguc

SEQ ID NO: 418345 - RNA, 62 nt, hsa
gccccuuuugagcccugccagugacagcccugaggagccaggagcccgguggccccuucccc

SEQ ID NO: 418346 - RNA, 62 nt, hsa
ccucagggaggauggggaucaagggacaggccaggagccaggaguggggaagggagggauga

SEQ ID NO: 418347 - RNA, 62 nt, hsa
uugugccucaguuccagaaauuauugccaaacaggagccacagcaauuuuuggcuacuuuuc

SEQ ID NO: 418348 - RNA, 62 nt, hsa
cucaagcugcauccacagauacaaaaaaauauaggagccaugaaaugaaguuaaacaccuug

SEQ ID NO: 418349 - RNA, 62 nt, hsa
cccaaagaugacauuacuaaugaugugauuucaggagccacagaagaaccuuaccagcuucc

SEQ ID NO: 418350 - RNA, 62 nt, hsa
aagagagugguccaugaccacacuuagugagaaggagccacaaguuguggcugagaguuccc

SEQ ID NO: 418351 - RNA, 62 nt, hsa
ccaaccgacgugcucauagugaucagcugugcaggagccaugaggcaccaaccucuccccgc

SEQ ID NO: 418352 - RNA, 62 nt, hsa
gugccugcccugccucuccacgcacaguguuaaggagccaagaggagccacuucgcccagac

SEQ ID NO: 418353 - RNA, 62 nt, hsa
ugccucuccacgcacaguguuaaggagccaagaggagccacuucgcccagacuuuguuuccc

SEQ ID NO: 418354 - RNA, 62 nt, hsa
gggaacggggguggggagguucuuaguugcgaaggagccaagcuccugauggacuugcguug

SEQ ID NO: 418355 - RNA, 62 nt, hsa
cggccugcagccaaguucacugucacgggggaaggagccaccagccaguccucagauuucag

SEQ ID NO: 418356 - RNA, 62 nt, hsa
gaaaaugagaggcccugccuggacccagggagaggagccagugacacaggcagagcggugca

SEQ ID NO: 418357 - RNA, 62 nt, hsa
aagcgaugcuugggggucagaccacccccuagaggagccacgugccgcccagccaccuucaa

SEQ ID NO: 418358 - RNA, 62 nt, hsa
gacgugaagccucccgaacacgcacagaaggaaggagccagcucccagcccacucaucgcag

SEQ ID NO: 418359 - RNA, 62 nt, hsa
uguuccagcugaggcagggggauuugguaggaaggagccagugaacuuggcuuuccuguuuc

SEQ ID NO: 418360 - RNA, 62 nt, hsa
gucacugccuguuccccacugccuguguucgcaggagccacgggacagaagacgguggccuc

SEQ ID NO: 418361 - RNA, 62 nt, hsa
ccuggggugaggugcucagcaccuuccucucgaggagccacauuuuccuccuuuguguuagg

SEQ ID NO: 418362 - RNA, 62 nt, hsa
uucgacaccagacguggggauuucaacaggggaggagccaaggaauucuguggcugugcugc

SEQ ID NO: 418363 - RNA, 62 nt, hsa
caucacagcgccagggcagcugugccugggacaggagccacacagucagagggggauguaag

SEQ ID NO: 418364 - RNA, 62 nt, hsa
gagugcugggcaugugccuggaacuaccgaguaggagccauuucuuuguaccccugccuaau

SEQ ID NO: 418365 - RNA, 62 nt, hsa
uuagggauguuuaggucauacuaggagcaauuaggagccauaugccugggcugagaagagcu

SEQ ID NO: 418366 - RNA, 62 nt, hsa
ggcuacuugagauaaugggagugcuagaagcaaggagccagcaagucuggacacauuacaaa

SEQ ID NO: 418367 - RNA, 62 nt, hsa
uuagaacuuagcacuuguguuauugauuagugaggagccaguaagaaacaucuggguauuug

SEQ ID NO: 418368 - RNA, 62 nt, hsa
uacacagaucgugcauuugcauaguucagacuaggagccaaaugaagacucaaaaccaagcu

SEQ ID NO: 418369 - RNA, 62 nt, hsa
aauguucgagagaacacuugccccuugacuguaggagccagaaggggacccaggugugcaua

SEQ ID NO: 418370 - RNA, 62 nt, hsa
ccccacugaggaugcugcuggcagccuggggaaggagccaguuuuuuuugguuuuuuuuuua

SEQ ID NO: 418371 - RNA, 62 nt, hsa
aauaccugacuuuagagagaguaaaaugugccaggagccauaggaauaucuguauguuggau

SEQ ID NO: 418372 - RNA, 62 nt, hsa
uuccuauuggaaaggcauugacagccagggacaggagccaggguggggguaguuuuguggga

SEQ ID NO: 418373 - RNA, 62 nt, hsa
aggagguggagguugcagugagccaagaucacaggagccacugcacuccagccugggugaca

SEQ ID NO: 418374 - RNA, 62 nt, hsa
gagggggcacccagcugccuuuccucccucacaggagccaccaccagccaccucucaggaga

SEQ ID NO: 418375 - RNA, 62 nt, hsa
guuuucuucuguuuauuuucugagacuccuacaggagccaaauuuguaauuuagagacacuu

SEQ ID NO: 418376 - RNA, 62 nt, hsa
caaauucuagucccaaagaucaaguugucugaaggagccaaagugugaaugugggugucggc

SEQ ID NO: 418377 - RNA, 62 nt, hsa
aggugcccaagaagauggaggaucccugugccaggagccaaccuggucuucccgagggucag

SEQ ID NO: 418378 - RNA, 62 nt, hsa
aaaaacccuccccaggaaggaggaggguguucaggagccagacuuuuggagagaaggcagcu

SEQ ID NO: 418379 - RNA, 62 nt, hsa
ccuccguggccuccuccugugugagucccaccaggagccacgugcccggccuugcccucaag

SEQ ID NO: 418380 - RNA, 62 nt, hsa
gcuggggagagaccccagcaccuugagcacacaggagccaggaggagcccaacagagcagca

SEQ ID NO: 418381 - RNA, 62 nt, hsa
gagaauggcacuggcugucccauaugguauccaggagccaccaaugucuguugaguacuuca

SEQ ID NO: 418382 - RNA, 62 nt, hsa
ucuccucuacagguuugucaauccuaggggacaggagccaggcuacugucuguacccccacu

SEQ ID NO: 418383 - RNA, 62 nt, hsa
ggccuggcccuaccuccuggucuuguaauuacaggagccauuucuguagguaacuggaccaa

SEQ ID NO: 418384 - RNA, 62 nt, hsa
gacaaggugaacaguugggugggaaaggagagaggagccagccagggaggggcagcugcagu

SEQ ID NO: 418385 - RNA, 62 nt, hsa
agcugugagugaggggacaaggggcaggucccaggagccacacacucccuuccucacuuugg

SEQ ID NO: 418386 - RNA, 62 nt, hsa
aucauagacccaucuggaggcucccaugggcuaggagccagugugaggcuguaacuuauacu

SEQ ID NO: 418387 - RNA, 62 nt, hsa
uucagcuccugcuuggccaguguggagaggaaaggagccacaggagcgggugcuacacccgg

SEQ ID NO: 418388 - RNA, 62 nt, hsa
cugugauuaccaucaguccauuuuaccgaggaaggagccaagguccaggcccacugaaggac

SEQ ID NO: 418389 - RNA, 62 nt, hsa
uuaaagcuuuauaugccucaaauaucagggaaaggagccaaguccuugguauuuaguuuggu

SEQ ID NO: 418390 - RNA, 62 nt, hsa
agccuguaagcacuccagguggggaaguggacaggagccauuggucauaaccagacagaauu

SEQ ID NO: 418391 - RNA, 62 nt, hsa
uuauuauuuuaucuuuuagaaaguacacuuuaaggagccauacucugauaugacagaugaga

SEQ ID NO: 418392 - RNA, 62 nt, hsa
ggggaauaguugagugugcuguuugggggcucaggagccaucaaggcuguggggaggaacca

SEQ ID NO: 418393 - RNA, 62 nt, hsa
accacuaaggucccagcccucacuaggaugucaggagccaggucuaggcccagcuuucacac

SEQ ID NO: 418394 - RNA, 62 nt, hsa
uauuuauaauucuuaaaauaaggguagcucaaaggagccaaguacaguaguuuagcuugcua

SEQ ID NO: 418395 - RNA, 62 nt, hsa
acucugccuggagauacuuccugccucagaugaggagccagaagaaacagagcccgacuuga

SEQ ID NO: 418396 - RNA, 62 nt, hsa
cacauaucaagucccgaggcagcaacaggaccaggagccagguguccugacuguccuacaau

SEQ ID NO: 418397 - RNA, 62 nt, hsa
uggacuccuuguuugccuuuaggcaggaagucaggagccagcagggcgggccaggagaaaga

SEQ ID NO: 418398 - RNA, 62 nt, hsa
gauuguguugugcugccuaagcugccggcugcaggagccagagaagugacccccgcgggagc

SEQ ID NO: 418399 - RNA, 62 nt, hsa
cugguggaguccuguggcuuuccagagaagccaggagccaaaagcugggguaggagaggaga

SEQ ID NO: 418400 - RNA, 62 nt, hsa
cucauccgcccucuguugcucccuagcauuccaggagccaucuuggacucuccuccccaggu

SEQ ID NO: 418401 - RNA, 62 nt, hsa
ggcccacaggaggcaagcaagcucucuugccgaggagccaggcaacuucaguccugggagac

SEQ ID NO: 418402 - RNA, 62 nt, hsa
cgcucccaaaggaaagagcagucuaucauugcaggagccauaugacaagccuuugugcucua

SEQ ID NO: 418403 - RNA, 54 nt, hsa
gcccgcccucccgaauguagcgccaggagccacgucccuucucccuuccccgug

SEQ ID NO: 418404 - RNA, 62 nt, hsa
ucuucccccaccauuuggaucacaggaaguggaggagccagaggugccuuuguggaggacag

SEQ ID NO: 418405 - RNA, 62 nt, hsa
gacacaggccaggccugggccaggagucugccaggagccaggagcgccuacaccucccugga

SEQ ID NO: 418406 - RNA, 62 nt, hsa
aaacagacaucugcauuuccuagugagcugccaggagccagauucgggaaccguaacugaug

SEQ ID NO: 418407 - RNA, 62 nt, hsa
ugcuuuauggggaagccugagguagucaacccaggagccaagaaaagagaacuacgaggaac

SEQ ID NO: 418408 - RNA, 62 nt, hsa
gacuguagagugucugacuauacugggggaagaggagccaaugacaggguagggagaugaca

SEQ ID NO: 418409 - RNA, 62 nt, hsa
agaaaacaaaaaaaacuugcacaaaaauacugaggagccaauuaauuuccuacuucaaugua

SEQ ID NO: 418410 - RNA, 62 nt, hsa
cccgcgaaacccggugcaucuggcacguggccaggagccaugacaggggcgcuugggagggg

SEQ ID NO: 418411 - RNA, 62 nt, hsa
ugccugccuugaagcugagaaggcacagggcaaggagccaaggaccacagagccucagccag

SEQ ID NO: 418412 - RNA, 62 nt, hsa
gaaugggguggggucacuaaggagagagggucaggagccagaguugaugagcagaucugugg

SEQ ID NO: 418413 - RNA, 62 nt, hsa
cccucccuuucugauacagugacuggggcaaaaggagccauugugaccaggggcugcgggag

SEQ ID NO: 418414 - RNA, 58 nt, hsa
augucuaugucuccccaugagcauggaaaggagccaccuccaccccuuuccccaccca

SEQ ID NO: 418415 - RNA, 62 nt, hsa
gaaaucuauaacucagaaauggucagauggucaggagccagcuaugcagcaguauaccaucu

SEQ ID NO: 418416 - RNA, 62 nt, hsa
acucgaaccuuacccaaacaagugggagagccaggagccaaacuaucaggcuccaaagcuuu

SEQ ID NO: 418417 - RNA, 62 nt, hsa
gccuugaauggcccuugucuuaaaaagaaauuaggagccaggugcgguggcacgugccugua

SEQ ID NO: 418418 - RNA, 62 nt, hsa
cacugucccuucaguccagggggccggggcucaggagccaugaccuggugucuccugcccac

SEQ ID NO: 418419 - RNA, 62 nt, hsa
cagaggaaguggaucugcuucuccaguuuuugaggagccagccagggguccagcacagcccu

SEQ ID NO: 418420 - RNA, 56 nt, hsa
ucuucaggaaggucagauagccggagaggagccaagaucccuccagacagcaccag

SEQ ID NO: 418421 - RNA, 62 nt, hsa
caaggaaauugugcuuuauccaacaaaauguaaggagccaauaagggaucccuauuugucuc

SEQ ID NO: 418422 - RNA, 62 nt, hsa
gggcuuggaaggagacaggaauggggcgaggaaggagccaggcccggcaugaggaccugacg

SEQ ID NO: 418423 - RNA, 62 nt, hsa
aagaagucugaggcagacggugaggguggcccaggagccauggccucacacagacccgaggc

SEQ ID NO: 418424 - RNA, 62 nt, hsa
guuuuguuccaucuuggauauuugaagagaaaaggagccaagaacuggcggguggugugugu

SEQ ID NO: 418425 - RNA, 62 nt, hsa
cuggaacacagcagaauuguugcaaagguucuaggagccagauucauuccuucuucauucuu

SEQ ID NO: 418426 - RNA, 62 nt, hsa
caggugggccugccagccaagucagcuguaucaggagccauccuccuggugguacccaaugu

SEQ ID NO: 418427 - RNA, 62 nt, hsa
caagagcuggaaaaaaacgcguaucuacuaggaggagccagggacuggggcggggggcgggg

SEQ ID NO: 418428 - RNA, 62 nt, hsa
uucaaugaagacuaauucaauuuugcauauagaggagccaaagagagauuucagcucuguau

SEQ ID NO: 418429 - RNA, 62 nt, hsa
guuauuggauauagucuuuauccuaaguucugaggagccauaaaaauaguuuuccagaaugg

SEQ ID NO: 418430 - RNA, 62 nt, hsa
gcccugugcugggcacugggggcacucccugcaggagccaucaucugugaaaaggagcacug

SEQ ID NO: 418431 - RNA, 62 nt, hsa
gccauaaugaggucccacguggcuucuucgauaggagccacaacuuggggugggaagaacuu

SEQ ID NO: 418432 - RNA, 62 nt, hsa
aaccccccagagcucuuuaccaaggaugaaagaggagccaggccuugggcuccugaugagga

SEQ ID NO: 418433 - RNA, 62 nt, hsa
cugccccugggacaugguggugaugugggugcaggagccagugucuguugucgggacucgca

SEQ ID NO: 418434 - RNA, 62 nt, hsa
gcugagauagagauauuggucaugguugacugaggagccaauuaaaaccuguuuaugccuag

SEQ ID NO: 418435 - RNA, 62 nt, hsa
ggauuucauguuuucacucuguucuuagucccaggagccacagguaaucgagaauguuugug

SEQ ID NO: 418436 - RNA, 62 nt, hsa
auaguacacaacucugccguugauaguguguaaggagccauauacaauauguaaacaaauca

SEQ ID NO: 418437 - RNA, 62 nt, hsa
aauacucuuacgaaaacuauucuaaaggaggcaggagccaaggccaaaagugaacguacagg

SEQ ID NO: 418438 - RNA, 62 nt, hsa
guugaacuggugucguagaagaaauugucuacaggagccaaggugaaagucucugaugacgg

SEQ ID NO: 418439 - RNA, 62 nt, hsa
agcgucugucucugugggcuugggauguuaacaggagccaaaaggagggaaagugugaagaa

SEQ ID NO: 418440 - RNA, 62 nt, hsa
uuugcagaauaccugucuccacauuccuagagaggagccaaguucuaguaguuucaguucua

SEQ ID NO: 418441 - RNA, 62 nt, hsa
acaggacacgccccagagcuguggcagauugcaggagccaucguguggggagaauuuaauaa

SEQ ID NO: 418442 - RNA, 62 nt, hsa
gggagaaggcacccagccauccugacccagcgaggagccaacuaucccaaauauaccugggg

SEQ ID NO: 418443 - RNA, 62 nt, hsa
uugagcacuguaggcaagagggaagaaagagaaggagccaucuccaucuugaaggaacucaa

SEQ ID NO: 418444 - RNA, 62 nt, hsa
ccagccaucagccaggguuggccuaggguggcaggagccagggaggagugggccucuuugau

SEQ ID NO: 418445 - RNA, 62 nt, hsa
gaagcggcagaaggcggacgcgugccggcgggaggagccacgcgugagcacaccugacacgu

SEQ ID NO: 418446 - RNA, 62 nt, hsa
gccuuugaucaagauucgggugcaaguggagcaggagccauauaccuggagggaaugugcuu

SEQ ID NO: 418447 - RNA, 62 nt, hsa
ugggcuggcagagaagguuugugucccuguugaggagccacucugccagucuuugcuggucc

SEQ ID NO: 418448 - RNA, 62 nt, hsa
ccaggccgggccgcaagcuguuuccagagugcaggagccaagugcucggggacccuuugaaa

SEQ ID NO: 418449 - RNA, 62 nt, hsa
uuuuauucuuugugugucagaguucagagcucaggagccaaaauauuuuuauacauauauag

SEQ ID NO: 418450 - RNA, 62 nt, hsa
gaaugcgcguaugacaggucaacguauuaggaaggagccagaaaguauucauacugcuacuc

SEQ ID NO: 418451 - RNA, 62 nt, hsa
ucgagcucagguucgccacauagaucccgugcaggagccacauggguccugugcaggacccc

SEQ ID NO: 418452 - RNA, 62 nt, hsa
cgaacgcuucccugggcucccacugccuucuaaggagccaaggagaauucccugcccacuuu

SEQ ID NO: 418453 - RNA, 62 nt, hsa
cucaguaggaacuuggaagggaagagcucugaaggagccagaggggcagccaccuugcauga

SEQ ID NO: 418454 - RNA, 62 nt, hsa
uuuuggagcaccgcauggucuugccagcuaccaggagccacuuaagagauuauugugcuguu

SEQ ID NO: 418455 - RNA, 62 nt, hsa
ugauccagugcucucccaucuaacaacuaaacaggagccauuucaaggcgggagauauuuua

SEQ ID NO: 418456 - RNA, 62 nt, hsa
uuaugaauaucuaaaaggccagcuaccugccuaggagccacuauauauauagauagauguag

SEQ ID NO: 418457 - RNA, 62 nt, hsa
auucacauuuucucaaagucucauagcuuuggaggagccaucugcuuuuuuggcugcucuuu

SEQ ID NO: 418458 - RNA, 62 nt, hsa
ugcaguuuaaaauguugggaugccugaggaccaggagccaccacccacugggguguugugag

SEQ ID NO: 418459 - RNA, 62 nt, hsa
gggacacagauccuugucuucagcaccuuccaaggagccaacuuuuauucccuuuccucucu

SEQ ID NO: 418460 - RNA, 62 nt, hsa
ccccugccggcagccccuuucccugccaccccaggagccaggcuuccccucagcugggugaa

SEQ ID NO: 418461 - RNA, 62 nt, hsa
auuuaucugugaccuauaucaaguacacauuuaggagccagguagguuaccugcuuacacac

SEQ ID NO: 418462 - RNA, 62 nt, hsa
acccaccacagaauacaguguguguuauuacgaggagccagcaguugagccuaagguccuuc

SEQ ID NO: 418463 - RNA, 62 nt, hsa
uccccuguuuuuaagucccauguggggcugccaggagccaagagcaugccuucaugcccuuc

SEQ ID NO: 418464 - RNA, 62 nt, hsa
ccaggggacucccagaagccaguagagagaccaggagccaccucaaucagcaggacagccuc

SEQ ID NO: 418465 - RNA, 62 nt, hsa
gcgccugucuuacccgguggccuuggcccagaaggagccagaggcagcagccucagccccag

SEQ ID NO: 418466 - RNA, 62 nt, hsa
gauauuucccuaaccucacucagucacauuguaggagccaguguagcuauggaauuaucuua

SEQ ID NO: 418467 - RNA, 62 nt, hsa
caagcauaacugcaaggagaggaggaauuccuaggagccaaagaguuuuguggggugagggu

SEQ ID NO: 418468 - RNA, 62 nt, hsa
agaaagaaacugguggguuagggccuugguccaggagccaguugagccagggcagccacauc

SEQ ID NO: 418469 - RNA, 62 nt, hsa
cucauggagaauuaaagagagaagccuccuuaaggagccacaggaugguaccuggccccaaa

SEQ ID NO: 418470 - RNA, 62 nt, hsa
cccccgugucacccccgccaucacugcuggacaggagccacccccuuggguaccagagggag

SEQ ID NO: 418471 - RNA, 62 nt, hsa
ccaacacccuggagugguuccgucagaccaugaggagccaagaccagcaggucccacagccg

SEQ ID NO: 418472 - RNA, 62 nt, hsa
gcagcucgcuaccuaaguguuucuguaggggaaggagccaauuaagaaaaaguguugguaca

SEQ ID NO: 418473 - RNA, 62 nt, hsa
augcuuuugcaccuuugacugaugccaagacuaggagccaugcugaugaugugggucucguu

SEQ ID NO: 418474 - RNA, 62 nt, hsa
aaguuucucuuuucaaaacauuuuacuuuaaaaggagccaauuuaaagaaaacuguuaauag

SEQ ID NO: 418475 - RNA, 62 nt, hsa
ccucagucucccaaagcgcugggauuacaggcaggagccacugagcccagccaagacuucag

SEQ ID NO: 418476 - RNA, 62 nt, hsa
aaaccgcaagauggggccugggcaugcgcaggaggagccaucggguacuacgcagcaacacu

SEQ ID NO: 418477 - RNA, 62 nt, hsa
aagccacuguccgucuuuaaacagaaagucaaaggagccacgaagcaagcggccguccgggc

SEQ ID NO: 418478 - RNA, 62 nt, hsa
ccagccccaggaagcuccagggcugaguggucaggagccaguuucuccagccccuccucccc

SEQ ID NO: 418479 - RNA, 62 nt, hsa
uuuuaaucacuugaauaaauugauauaauaaaaggagccaccaggugguguguggauucuga

SEQ ID NO: 418480 - RNA, 62 nt, hsa
acauuccuuagucucaagggcuagcaucccugaggagccaggccgggccgaauccccucccu

SEQ ID NO: 418481 - RNA, 62 nt, hsa
gaccugcuggggcagaguugauugccuuccccaggagccagaccacugggggugcaucauug

SEQ ID NO: 418482 - RNA, 62 nt, hsa
gagcagaauucuggccccagaacucugugcccaggagccaugccuugagcaguauuagccgu

SEQ ID NO: 418483 - RNA, 62 nt, hsa
gaaccuucuccuaggaaauggugaagucuauuaggagccacuugugacuccaugaccuguua

SEQ ID NO: 418484 - RNA, 62 nt, hsa
cccgcucaggccccuacucgggcgcucccagaaggagccaccucucagugccucaccucccc

SEQ ID NO: 418485 - RNA, 62 nt, hsa
cucucaucuuaggaccuaaugggacccccgaaaggagccaaguggggcccucggccucuucc

SEQ ID NO: 418486 - RNA, 62 nt, hsa
aacgcacucggugguggaggccccauguucccaggagccaagauucguagcauccuugaggc

SEQ ID NO: 418487 - RNA, 62 nt, hsa
gccaggagugagaaggaauucagggagagcaaaggagccagugcugagaugcugcuguguug

SEQ ID NO: 418488 - RNA, 62 nt, hsa
gggcacuguauucugagcaaaggccugggcccaggagccagccagggaugagugccaucaug

SEQ ID NO: 418489 - RNA, 62 nt, hsa
gaccucuggccagaagccucccuucugugcacaggagccaguuucacagauggagaagaugu

SEQ ID NO: 418490 - RNA, 62 nt, hsa
agaacuagucaguucucugcagcaaagggaacaggagccauuugaacccucugggaccccuc

SEQ ID NO: 418491 - RNA, 62 nt, hsa
acagucacccucccucugcugggaugagguccaggagccaacuaaaacaauggcagaggaga

SEQ ID NO: 418492 - RNA, 62 nt, hsa
caacuuaggauggauggcugagagggcuuccuaggagccagucagcagggugggguggggcc

SEQ ID NO: 418493 - RNA, 62 nt, hsa
ucuucgggaaaccagaauauguuuggggugguaggagccacacagacucuucugagcccccu

SEQ ID NO: 418494 - RNA, 62 nt, hsa
guggugaacccuccaauucaggaagugggaaaaggagccaggaaaugugcuucuacuuugcc

SEQ ID NO: 418495 - RNA, 62 nt, hsa
ccuuggcugcgggagaaggcccagagcccuggaggagccaccaccccgccggccccucgacc

SEQ ID NO: 418496 - RNA, 62 nt, hsa
aagggagagggaggcgggggcuguagucaggaaggagccagagaagaacaggguuugggugc

SEQ ID NO: 418497 - RNA, 62 nt, hsa
aagaaucugguugucugaacuauuuuaaauuaaggagccagauguuuuuagucaggcuaucc

SEQ ID NO: 418498 - RNA, 62 nt, hsa
gcccauaucuggaagggcacuauauuuuugggaggagccauagauuccugguuauccuauuu

SEQ ID NO: 418499 - RNA, 62 nt, hsa
uccccacccacuccucaguguuuguggagucgaggagccaaccccagccuccugccaggauc

SEQ ID NO: 418500 - RNA, 62 nt, hsa
guucgucgggaaucaggauuauugagaggugaaggagccagguggcuucauucuggcgguga

SEQ ID NO: 418501 - RNA, 62 nt, hsa
gaaaccuccagucacugcgcccggcaggagucaggagccagggacugugcagccuggaaccu

SEQ ID NO: 418502 - RNA, 62 nt, hsa
gagccgccaggccugcagcugggccagugcccaggagccauccuggcguggggccaggagcu

SEQ ID NO: 418503 - RNA, 62 nt, hsa
ccggggccuggggucucuguggugccugcagcaggagccaggaacgcccggcaggcaggcgc

SEQ ID NO: 418504 - RNA, 62 nt, hsa
gggggcuggcaccgagaguucaaggagagcccaggagccagucucuggcuguggcuccccag

SEQ ID NO: 418505 - RNA, 62 nt, hsa
accugaaucccccaccagagaggaugugugugaggagccagaaacgcugaauccaauuaaga

SEQ ID NO: 418506 - RNA, 62 nt, hsa
cucuguacaguuguuacugacucugauuucuaaggagccaauaaacaccgucucagagccuc

SEQ ID NO: 418507 - RNA, 55 nt, hsa
ugguggggacugcucccuagacuccaggagccauaucccagaccuuugccagcua

SEQ ID NO: 418508 - RNA, 62 nt, hsa
uugccuccaaccugucccaacagcugacagccaggagccacucucccagcugcaggccuuug

SEQ ID NO: 418509 - RNA, 62 nt, hsa
ucugugcuaaguucacuugggaggauggcaguaggagccagggcuggccauggguccccuac

SEQ ID NO: 418510 - RNA, 62 nt, hsa
gcagagucacccacagggccagccccucagccaggagccaguggcaggagcggaacagccca

SEQ ID NO: 418511 - RNA, 62 nt, hsa
auuaggugaggucaaacacagagcuagcuuucaggagccaaggcccuuuccaaguccaggug

SEQ ID NO: 418512 - RNA, 51 nt, hsa
acgcccugacugagaucugagaggagccaagggaacccagaugacacccuu

SEQ ID NO: 418513 - RNA, 62 nt, hsa
uuaaaaacagacacccagcugccgaggcaaaaaggagccaggcgcucccucuuucuugaaga

SEQ ID NO: 418514 - RNA, 62 nt, hsa
ucuguaauaaaagcaaacagccuggcuuagcaaggagccaacauaacagaugggcuggaagu

SEQ ID NO: 418515 - RNA, 62 nt, hsa
aauccagacauucucacccccagcggaugcacaggagccacucaggccuggcuuagagguag

SEQ ID NO: 418516 - RNA, 62 nt, hsa
agcucuggggggcaaccuggaggucugaaaagaggagccagagaaggugguacccaggcuuc

SEQ ID NO: 418517 - RNA, 62 nt, hsa
ucagcuguuuguaccugacuugccgccugcauaggagccaguucuguuccuucugacuagcc

SEQ ID NO: 418518 - RNA, 62 nt, hsa
uuaauauuuguggcuuuagaggaaagaacuaaaggagccaucucucuccccucuccuccguu

SEQ ID NO: 418519 - RNA, 62 nt, hsa
cuaauaaacagaguccagugggauuccuauuuaggagccaaggaguacuuuggaacaguaca

SEQ ID NO: 418520 - RNA, 62 nt, hsa
gcuagaacucaaacucuucaauuacucaaagaaggagccauuucaguuaacucaagugaaug

SEQ ID NO: 418521 - RNA, 59 nt, hsa
ucccgcgcucccuucgcugacacgggccaaggagccaguggggaagugcguguguuggg

SEQ ID NO: 418522 - RNA, 62 nt, hsa
gggaguaccaccugagucuccagcuucuccggaggagccagcuguccuggugggacgauagc

SEQ ID NO: 418523 - RNA, 62 nt, hsa
ggcgcaaccagagucucgugugugccgaccacaggagccaagccuuuuccacuguguggacu

SEQ ID NO: 418524 - RNA, 62 nt, hsa
uccucuguuacaaccucagcacuuugcaccguaggagccauuguuaaaguugucacuugugu

SEQ ID NO: 418525 - RNA, 62 nt, hsa
acuuuccaaggagucuuggguguguagccaagaggagccaugagcuauggacuccucaagca

SEQ ID NO: 418526 - RNA, 62 nt, hsa
uguuauaacuauauuuuauguuguauguuaucaggagccaucagagaaugaccuuuuugugu

SEQ ID NO: 418527 - RNA, 62 nt, hsa
uugcugcauuccccuugguucgauuccacgcaaggagccacaagugagaacuccacuguccu

SEQ ID NO: 418528 - RNA, 62 nt, hsa
ucaggggaucuuauggagcaucucagggcuucaggagccagcccucuuccauccgcccggcu

SEQ ID NO: 418529 - RNA, 62 nt, hsa
acugcaccuggcucuugcacuuguuuauuuauaggagccagcccucagaagacaaacacaau

SEQ ID NO: 418530 - RNA, 62 nt, hsa
uguuucuaaaacacagaacuuacaagagccacaggagccaauuauagcaccugacagaauac

SEQ ID NO: 418531 - RNA, 62 nt, hsa
gaacuacagagcaugauguuuaaucuaauuuaaggagccacugauuguaaaacaugccauua

SEQ ID NO: 418532 - RNA, 62 nt, hsa
uaacaccugacauuaaagaagcaagccaagugaggagccaggggagauaagcauuccuggca

SEQ ID NO: 418533 - RNA, 62 nt, hsa
gucccccagcuuccggacuggccgcaccccggaggagccacgggggcgcugcugggaacgug

SEQ ID NO: 418534 - RNA, 62 nt, hsa
aagauacggguggggagggaagauauccagaaaggagccacagcugacgccaaaaagaaaag

SEQ ID NO: 418535 - RNA, 62 nt, hsa
accuccaagccgcgggugcccccuagggcgacaggagccagcgggacgccgcacgcggcccc

SEQ ID NO: 418536 - RNA, 62 nt, hsa
cugggcagagccuguccccuccccccuucuccaggagccagggggugacuggagagacagac

SEQ ID NO: 418537 - RNA, 62 nt, hsa
ggagagccaaagacaggguugugccuuaccccaggagccaccccuguaccccccuugcccug

SEQ ID NO: 418538 - RNA, 62 nt, hsa
cuuuuggcacuacccaccccgugugacagaauaggagccagcgacucaggacugcucacggg

SEQ ID NO: 418539 - RNA, 62 nt, hsa
cauccugggagcaacagggcucugaggacgugaggagccaucgcugugggaggcagcaggcc

SEQ ID NO: 418540 - RNA, 62 nt, hsa
uagugggcaugugaagauauuuagucacccagaggagccaguaaauguuauaauguuaaaaa

SEQ ID NO: 418541 - RNA, 62 nt, hsa
caacuugccauaauggauuguucugauuucugaggagccaggacaaguuggcgaccuuacuc

SEQ ID NO: 418542 - RNA, 62 nt, hsa
ugccucagccagggagggcuuccuggaggagaaggagccagcuagacauggauaggagugcg

SEQ ID NO: 418543 - RNA, 62 nt, hsa
gaaaacccccaaggaugaaucugccaaucaggaggagccagaggccagagucccggcccaga

SEQ ID NO: 418544 - RNA, 62 nt, hsa
cugcaaguaaacaccuggaggugaaggcagagaggagccaggacuguggaguccgacaaagc

SEQ ID NO: 418545 - RNA, 62 nt, hsa
ccuccccaccccugccccagccucaggacugcaggagccauccgccccccucagccccuucc

SEQ ID NO: 418546 - RNA, 62 nt, hsa
ggugaggggaaucuguugcccagguccugcaaaggagccaggugccauggcauauaagucag

SEQ ID NO: 418547 - RNA, 62 nt, hsa
caccagccacacggaacuacuguggucccugaaggagccauacauuuucccacuuaugugcc

SEQ ID NO: 418548 - RNA, 62 nt, hsa
uuugggguggugcugacgcucccaggggugccaggagccacugggacagggugaggcuccca

SEQ ID NO: 418549 - RNA, 62 nt, hsa
ugcucugaacucuggcugagaggaugcugcucaggagccagcacaggacaccccccacccca

SEQ ID NO: 418550 - RNA, 62 nt, hsa
ugcaaugcauuugcgauucccauuucucugcuaggagccagccuggguggcgcugcucccag

SEQ ID NO: 418551 - RNA, 62 nt, hsa
aaggaauggggggccccagccccaggccgggaaggagccagcggccgacaaagcagaaacac

SEQ ID NO: 418552 - RNA, 62 nt, hsa
gcuccgccuccccugcccuccucucuccaggaaggagccagaacccucaccccucucccacc

SEQ ID NO: 418553 - RNA, 62 nt, hsa
cucuagaacuggagagagguccagauugcgacaggagccacaccagagugugcaggcuucau

SEQ ID NO: 418554 - RNA, 62 nt, hsa
ggauauauaaggcacuguggugguuauucccgaggagccagagaaaccuggagaagagauca

SEQ ID NO: 418555 - RNA, 62 nt, hsa
uucgagauuccuucacugucagaaugggcucaaggagccaucuuuugugauagguauugggg

SEQ ID NO: 418556 - RNA, 62 nt, hsa
uuaagugacuugccugaggccaucccacuaacaggagccaggguuaggauucaaaccccauc

SEQ ID NO: 418557 - RNA, 62 nt, hsa
gcugucaggaccaugaagccaggacagaggccaggagccagcccugcagcccuccccacccg

SEQ ID NO: 418558 - RNA, 62 nt, hsa
acuguaaagcagaugcuguuuagcaccugccaaggagccauaugcccugaaguucagcauua

SEQ ID NO: 418559 - RNA, 62 nt, hsa
acccugugaucucugcccugucuucgggcgacaggagccagaaaaucagggacauggcugau

SEQ ID NO: 418560 - RNA, 62 nt, hsa
aagucacagaaucccaugaaagggaauggggcaggagccagggguguuuuuucccagugcag

SEQ ID NO: 418561 - RNA, 62 nt, hsa
ugaggauuugcccagaguucaguccuggcuggaggagccacagccugucugggggaaaggac

SEQ ID NO: 418562 - RNA, 62 nt, hsa
ccccgguuugcagaauggaggagggaaguugaaggagccaccuccucugucuacccacccgu

SEQ ID NO: 418563 - RNA, 62 nt, hsa
ccugucacgacagagccugggcacuucagaggaggagccaggaucgaauggaaggggggaau

SEQ ID NO: 418564 - RNA, 62 nt, hsa
cuaagcugggacaaagccucuguuuucccaguaggagccagggcugaguguggaaauuacag

SEQ ID NO: 418565 - RNA, 62 nt, hsa
guuggaguaugcauggauguagugcuuuuuagaggagccacugggcaaggccaccaagaaca

SEQ ID NO: 418566 - RNA, 62 nt, hsa
aacccuccuguccuggacgugacuucauccugaggagccacagcacaggccgugcuggcacu

SEQ ID NO: 418567 - RNA, 62 nt, hsa
guugggcuccucacacaugaucguguuucguaaggagccagaggcagcauagugaaaaguua

SEQ ID NO: 418568 - RNA, 62 nt, hsa
caggguagcucaugcuuuuacugguuggaauaaggagccaaaaccaacaaaauaauauuuau

SEQ ID NO: 418569 - RNA, 62 nt, hsa
cugaagaaggugggaggggagggcggaaccugaggagccaccugagccagcuuuauauuuca

SEQ ID NO: 418570 - RNA, 62 nt, hsa
gccuuguugagagccacacuucugcccaugccaggagccagcugugugaccauccaggggug

SEQ ID NO: 418571 - RNA, 62 nt, hsa
accgggaggcuguuagggggucacugaaucccaggagccaaccucccccuuugcagggcugc

SEQ ID NO: 418572 - RNA, 62 nt, hsa
ccugccucucacacacaauuuuacaugccccgaggagccaaguuugggacauuuacccucca

SEQ ID NO: 418573 - RNA, 62 nt, hsa
aggucagggccuacagcuguguuguccaguacaggagccacgagccaaauguggcauuugaa

SEQ ID NO: 418574 - RNA, 62 nt, hsa
auguaaauccccacugggaccaacccuggggaaggagccaguuugccggauacaaacuggua

SEQ ID NO: 418575 - RNA, 62 nt, hsa
ccagccacuggcuggacagggaagaagaccccaggagccaagcccaccccuucuuuguguag

SEQ ID NO: 418576 - RNA, 62 nt, hsa
ggagaugagccuggacccuggagaaggaggccaggagccagccacuggcuggacagggaaga

SEQ ID NO: 418577 - RNA, 62 nt, hsa
gcacaugugcugcucgugagcaggaaaaucagaggagccacugaucugagugguauuuaggu

SEQ ID NO: 418578 - RNA, 62 nt, hsa
ccaugagaaccugaggggcaucugcccaggacaggagccauggcauaugacaaagaccaaug

SEQ ID NO: 418579 - RNA, 62 nt, hsa
cucuucauuuaagaauuauuugaaugccugccaggagccagauuuguucuggguauuaggaa

SEQ ID NO: 418580 - RNA, 62 nt, hsa
ccuucugaacccucugggccugcgcuaauuguaggagccacagcgcuccuagggugagaggc

SEQ ID NO: 418581 - RNA, 62 nt, hsa
caaaguggccugaaugaggccaggcccugagaaggagccaccagcuggaggaaaggggcucc

SEQ ID NO: 418582 - RNA, 62 nt, hsa
ugggccaagaucacaugcaggauaccaugggaaggagccaucuccacucuccuucuccagaa

SEQ ID NO: 418583 - RNA, 62 nt, hsa
aaggaagacacagcccagacaagauggcuggaaggagccagccaggacuccuuagacugauc

SEQ ID NO: 418584 - RNA, 62 nt, hsa
agauccucuaccacagacauuaauagcugagcaggagccacauggauugauuguauccacuc

SEQ ID NO: 418585 - RNA, 62 nt, hsa
cauagaaccaaggagcacucaaauagggagccaggagccagggagcuggugacacuugugug

SEQ ID NO: 418586 - RNA, 62 nt, hsa
uauuaauacuguuuacacauugggccuugaucaggagccaggugggcgggggcuagggggag

SEQ ID NO: 418587 - RNA, 62 nt, hsa
cguguauguuugguuccaugucacagcccccuaggagccagugaugcucggccuugcgcccg

SEQ ID NO: 418588 - RNA, 62 nt, hsa
ggcucuugcguggugagaguagggguccccccaggagccaugcuggacccaugagccucgcu

SEQ ID NO: 418589 - RNA, 62 nt, hsa
gguguuccagagcccaggguugagcauccugaaggagccacugcagccgucacuguccccag

SEQ ID NO: 418590 - RNA, 62 nt, hsa
cccgaagaggcaggccguccuguagguccuagaggagccacagcccaggggcagaugaaggg

SEQ ID NO: 418591 - RNA, 62 nt, hsa
gggcuaccgcgcgcccccccaucccacagaucaggagccaaggagggagaacagggcagccu

SEQ ID NO: 418592 - RNA, 56 nt, hsa
gcugccgaagaaccugcuaaguguguaggagccagugagcgaaucaagacuccacg

SEQ ID NO: 418593 - RNA, 62 nt, hsa
cugugaggagagaggcggacugugaggcagccaggagccagcugcguccguguguggucugu

SEQ ID NO: 418594 - RNA, 62 nt, hsa
cgccccuugcccuggagucugggaacaaagagaggagccagccuccccgcacugcuucagau

SEQ ID NO: 418595 - RNA, 62 nt, hsa
acaagagcacagcgggccugucagaugaagucaggagccauacgugaccgcucguagaacac

SEQ ID NO: 418596 - RNA, 62 nt, hsa
cauccagaaagaguuuaagaaaaucucagcucaggagccagaacagaaaagaucaauagcuu

SEQ ID NO: 418597 - RNA, 62 nt, hsa
cuuagagaaggcccuccaugugacuuccucccaggagccagaugcgauccucaggcugcucu

SEQ ID NO: 418598 - RNA, 62 nt, hsa
uuccuucgcuuagcaccuaggaagucgugugcaggagccagcagggcgccaaguggcccagu

SEQ ID NO: 418599 - RNA, 62 nt, hsa
ggccacccuagaccaggguccgagaggcaggcaggagccacucaugucuuccccauugcccg

SEQ ID NO: 418600 - RNA, 62 nt, hsa
auuaacuuccaaagaauucugguuuucaaaacaggagccagaguuggagauauuacagucaa

SEQ ID NO: 418601 - RNA, 62 nt, hsa
ccagcaagggucuuugagaccugggggaucucaggagccaccugggauggcccuggccugaa

SEQ ID NO: 418602 - RNA, 62 nt, hsa
gucacucacccucucuggaccucaucuguaagaggagccagcuggauaagaugauuucugaa

SEQ ID NO: 418603 - RNA, 62 nt, hsa
cauucauguccuacgcagcuaaaacagagcccaggagccagggaggaaaagcagucaggcca

SEQ ID NO: 418604 - RNA, 62 nt, hsa
ggauggccacagaaggggcaggccagguggaaaggagccagggggaaguggucuaagagacc

SEQ ID NO: 418605 - RNA, 62 nt, hsa
caccgcccgccccgucucaccuucuuuaccucaggagccaggagcagacagcaauacuucgu

SEQ ID NO: 418606 - RNA, 62 nt, hsa
auggcucagaggugauucgggcagccagggacaggagccacccuccccaggcccaacucugc

SEQ ID NO: 418607 - RNA, 62 nt, hsa
gugugcagggcauucaccucagccccccaggcaggagccaagcacagcaggagcuuccgccu

SEQ ID NO: 418608 - RNA, 62 nt, hsa
uuuguuguuguuuuguuuuuaaagaauacagaaggagccaagcuuuuuugcacuuuguaucc

SEQ ID NO: 418609 - RNA, 62 nt, hsa
guaggaggccagggaggggaacucagcaguucaggagccaccccaaaccauucugggacagg

SEQ ID NO: 418610 - RNA, 62 nt, hsa
ugguugugcacgugggacccuggggcggacccaggagccaaacucuugaagcacccccuggg

SEQ ID NO: 418611 - RNA, 62 nt, hsa
auauauugacaccccagugucaucagucaggcaggagccaaacaaugaaugccccucuuagg

SEQ ID NO: 418612 - RNA, 62 nt, hsa
cccuggugguggauccuggaauuuucucacgcaggagccauugcucuccuagagggggucuc

SEQ ID NO: 418613 - RNA, 62 nt, hsa
ggccucugugcccagccugauucucugcucccaggagccagugacaugaggugcagaggccc

SEQ ID NO: 418614 - RNA, 62 nt, hsa
ugccagaugcuccccugacaacaccaggcuacaggagccagacgccagggccugcccggccu

SEQ ID NO: 418615 - RNA, 62 nt, hsa
cuccaacucuaggaggccaggcaagcauggacaggagccaagggagcagggucauuaacuuu

SEQ ID NO: 418616 - RNA, 62 nt, hsa
agaaagugccugaugcccgcgucagagaccagaggagccaacugagaugauggggugggggu

SEQ ID NO: 418617 - RNA, 62 nt, hsa
cugagggacucagcacaacaggauaagcguccaggagccacgggcucccaccccgagcauau

SEQ ID NO: 418618 - RNA, 62 nt, hsa
cccugugcccuccaaauucacaggggguaccuaggagccaggugggguacgacaggcugggg

SEQ ID NO: 418619 - RNA, 62 nt, hsa
gggguggaccuggcauuuaucuggccaaaaacaggagccagagaaauaugaauauaccaaag

SEQ ID NO: 418620 - RNA, 62 nt, hsa
aggggcccugccaggaacugaccagcucagcgaggagccauaaugugcauaugugcacaagc

SEQ ID NO: 418621 - RNA, 62 nt, hsa
guccuccuuucauuacccuacagacagcuuacaggagccagccugcuucccacaacuacuag

SEQ ID NO: 418622 - RNA, 51 nt, hsa
aagagcugacaauuacauaacaggagccacauuccccauugaucaaccccc

SEQ ID NO: 418623 - RNA, 62 nt, hsa
acugugccaauuaggggguaaggcccccucucaggagccaucaucggcuuuccccauuccua

SEQ ID NO: 418624 - RNA, 62 nt, hsa
cccugggaacucuccuggccuucuaggaauggaggagccaggccccaccccuucccuauagg

SEQ ID NO: 418625 - RNA, 62 nt, hsa
cuaucgagggaagaaaaagcucuuccaaagagaggagccacuggaaggaacagagcaauacu

SEQ ID NO: 418626 - RNA, 62 nt, hsa
aaaaagaauuaguguaugcuuccugaauaaaaaggagccaaaguugaucagaaugguggcgu

SEQ ID NO: 418627 - RNA, 62 nt, hsa
aguccucccugguccaccccacccucauccucaggagccacagccauuucuuagaggguuuc

SEQ ID NO: 418628 - RNA, 62 nt, hsa
uuucuuaaacuuggccaauuuggaaagggggaaggagccaccccaaaacggugguucagcuu

SEQ ID NO: 418629 - RNA, 62 nt, hsa
cgccacccccuccccgcagcccucaccccgccaggagccacugcucucccccuugcccuccg

SEQ ID NO: 418630 - RNA, 62 nt, hsa
ccaguacugagaccuagaguccagaugcuuguaggagccaagucguguucuaaguauuuauu

SEQ ID NO: 418631 - RNA, 64 nt, hsa
uguccugcaagcaggagccagggcaauaucuauauuccuacagugacuauuuuucucuguagag

SEQ ID NO: 418632 - RNA, 64 nt, hsa
ugcgcccggcccaugguguuuuucuuuagggcucuuccuacaaccuugagaaguagauaggcau

SEQ ID NO: 418633 - RNA, 64 nt, hsa
uaaauauguuuccugagagauaagagaaauaauguuccuacaauaguuguauguaucuaagaua

SEQ ID NO: 418634 - RNA, 64 nt, hsa
ugucucuuucgaaagcauuaauucacuuuccuuuuuccuacaaugaaaccuguuuuccauuugu

SEQ ID NO: 418635 - RNA, 64 nt, hsa
ccccaaaguuguugguaauggagccggucugcccuuccuacaaacucaagaggcucauuguuca

SEQ ID NO: 418636 - RNA, 64 nt, hsa
gccagagcagcugcuugucugcagcaggacacaguuccuacauacguuucaguucuuucauggu

SEQ ID NO: 418637 - RNA, 64 nt, hsa
cagccccucaaaagaaaaacuguuuacauagaaauuccuacacauacguuugcguauauguuau

SEQ ID NO: 418638 - RNA, 64 nt, hsa
ucagaaacuaaaacaaauacugaaauauuagcucuuccuacacuucguguuccccuuuagcugc

SEQ ID NO: 418639 - RNA, 64 nt, hsa
ugagugagcaaaauuuguuuacuguugugaauuuuuccuacagcacuguuuuuaaucuugaugu

SEQ ID NO: 418640 - RNA, 64 nt, hsa
aaaucacaggugauagcaguugucauucaguaauuuccuacaagcagcaccccaaaggaaauau

SEQ ID NO: 418641 - RNA, 64 nt, hsa
uggcuuccauuuccuacauuuucauacugcugccuuccuacagcugcuagaccaagaccuguug

SEQ ID NO: 418642 - RNA, 64 nt, hsa
gguggacuaacuuuggacacaaauuggcuuccauuuccuacauuuucauacugcugccuuccua

SEQ ID NO: 418643 - RNA, 64 nt, hsa
ucuuuccagaaaccaaacuaggagaugaaacugguuccuacauccuaagguucuugcuuucucu

SEQ ID NO: 418644 - RNA, 64 nt, hsa
agacaagagggcaagccucuaguguaccaagugcuuccuacaaagacgcaaggugugcucugag

SEQ ID NO: 418645 - RNA, 64 nt, hsa
uuaggaacuuucuguuuagcaggaaggcaacacauuccuacacuuuuaauguauauguuuguua

SEQ ID NO: 418646 - RNA, 64 nt, hsa
ucaagcaucaaaauaccuugcaucugagacagacuuccuacaucagggacagguaucugugugu

SEQ ID NO: 418647 - RNA, 64 nt, hsa
uagggaaaaaacaacacuguguuugacguauuuguuccuacagcauucucaguauuucuggccc

SEQ ID NO: 418648 - RNA, 64 nt, hsa
aagaaaacgugccuucuguauaaguuuauguuuauuccuacauuuuauucauuuuuaauguaug

SEQ ID NO: 418649 - RNA, 64 nt, hsa
cagauuucuggggccaccugcaagccccauuccauuccuacagaucucucagccaccuguaagu

SEQ ID NO: 418650 - RNA, 64 nt, hsa
uuuagcuccugucuuuucaaaauggcagagggaguuccuacacacacuuuuucccuggaggcca

SEQ ID NO: 418651 - RNA, 64 nt, hsa; identical to SEQ ID NO: 89025

SEQ ID NO: 418652 - RNA, 64 nt, hsa; identical to SEQ ID NO: 89026

SEQ ID NO: 418653 - RNA, 64 nt, hsa; identical to SEQ ID NO: 89027

SEQ ID NO: 418654 - RNA, 64 nt, hsa; identical to SEQ ID NO: 89028

SEQ ID NO: 418655 - RNA, 64 nt, hsa; identical to SEQ ID NO: 89029

SEQ ID NO: 418656 - RNA, 64 nt, hsa; identical to SEQ ID NO: 89030

SEQ ID NO: 418657 - RNA, 64 nt, hsa; identical to SEQ ID NO: 89031

SEQ ID NO: 418658 - RNA, 64 nt, hsa; identical to SEQ ID NO: 89032

SEQ ID NO: 418659 - RNA, 64 nt, hsa; identical to SEQ ID NO: 89033

SEQ ID NO: 418660 - RNA, 64 nt, hsa; identical to SEQ ID NO: 89034

SEQ ID NO: 418661 - RNA, 64 nt, hsa; identical to SEQ ID NO: 89035

SEQ ID NO: 418662 - RNA, 64 nt, hsa; identical to SEQ ID NO: 89036

SEQ ID NO: 418663 - RNA, 64 nt, hsa; identical to SEQ ID NO: 89037

SEQ ID NO: 418664 - RNA, 64 nt, hsa; identical to SEQ ID NO: 89038

SEQ ID NO: 418665 - RNA, 64 nt, hsa; identical to SEQ ID NO: 89039

SEQ ID NO: 418666 - RNA, 64 nt, hsa; identical to SEQ ID NO: 89040

SEQ ID NO: 418667 - RNA, 64 nt, hsa
guaucuugacuauuaaacuacguauaguguugcugaaauagaaagaaaacagcauuggaauugg

SEQ ID NO: 418668 - RNA, 64 nt, hsa
gugaaaacagaaacaagaaugagguaguggcaaugaaauagaauuauuaguauauuaugaacau

SEQ ID NO: 418669 - RNA, 64 nt, hsa
uuuaacacauuguuaugugagaaauguuacuggggaaauagaucagccacuuuuaaggugcugu

SEQ ID NO: 418670 - RNA, 64 nt, hsa
gacauaguuuaaagacauuuuuuccccauuuuuugaaauagagaauauuuuauuauuuuuguga

SEQ ID NO: 418671 - RNA, 64 nt, hsa
gcagaaagaaggaaagccuagaacagaaauaaaugaaauagagaauagaaaagcaauacagaaa

SEQ ID NO: 418672 - RNA, 64 nt, hsa
aggaagacacagaauaccaaaucugacuccacaagaaauagauguugugaauagagcuugcuau

SEQ ID NO: 418673 - RNA, 64 nt, hsa
auuuaagaaauagacuuacuuaagacuauuuuaagaaauagagaugucauagccugaagauuua

SEQ ID NO: 418674 - RNA, 64 nt, hsa
cuggcuuuaacaauaauuuuuguuguuaauuuaagaaauagacuuacuuaagacuauuuuaaga

SEQ ID NO: 418675 - RNA, 64 nt, hsa
cucuuuuuccuccuggacacauuggaaugccuuggaaauagaaagaagccauauaugaccagaa

SEQ ID NO: 418676 - RNA, 64 nt, hsa
ugguuaagggcucccuaaacuuuggccuuuguucgaaauagauauccucucccccuccuccagg

SEQ ID NO: 418677 - RNA, 64 nt, hsa
cucuggucaccuuggauuauauauaaaaauacaggaaauagauaaacaugaaugugauuaauaa

SEQ ID NO: 418678 - RNA, 64 nt, hsa
uugagcaagauuguggcaguuuuugcacaacuuugaaauagaaauaccugguacucuaucuugu

SEQ ID NO: 418679 - RNA, 64 nt, hsa
uaugauucaguggcugggaauugagaauuuauuugaaauagaauagguaacaccucagcguacu

SEQ ID NO: 418680 - RNA, 64 nt, hsa
ugugaccauguuacucccuuccauuucacacaaagaaauagacacaacugcaguucacaaguag

SEQ ID NO: 418681 - RNA, 64 nt, hsa
uucaaauaaaauuuccugaccaaauuguuuuguggaaauagauguguuugcaauuugaagauau

SEQ ID NO: 418682 - RNA, 64 nt, hsa
ggcuaaucuucccaaaaacuagcucauuaaagaugaaauagaccagcucucuucagugaagagg

SEQ ID NO: 418683 - RNA, 64 nt, hsa
ugagcuaaucaaaauaauucagccaagucuauuugaaauagaaaacugucuauuuaauauagua

SEQ ID NO: 418684 - RNA, 64 nt, hsa
gaauuaggaaaaaaaucuggagaacaauaugguugaaauagaaacaagagaaugcaccuagguu

SEQ ID NO: 418685 - RNA, 64 nt, hsa
uuuuuguuagguacagucuggaucauggcauguagaaauagaaauuuagaauuuuacugcagcu

SEQ ID NO: 418686 - RNA, 64 nt, hsa
acaauguucuugguuuuaauguuccaguugcugugaaauagaacuccuacaaucaaaagacagu

SEQ ID NO: 418687 - RNA, 64 nt, hsa
agccagaaguugggaaacaaaugcugucucuugugaaauagaugaauaaaaugugauaguaaca

SEQ ID NO: 418688 - RNA, 64 nt, hsa
uaauguguuccuggaaggccuacagaugcauuaagaaauagauaugagauguaugaggauuuga

SEQ ID NO: 418689 - RNA, 64 nt, hsa
cuggccagugugggguuagcagaucgaauaacuugaaauagaccaugcaguauuccuagcacuc

SEQ ID NO: 418690 - RNA, 64 nt, hsa
auuuugcuaauacuacuuuuuuugccuggcagaagaaauagacuauuuggaucacauuucucau

SEQ ID NO: 418691 - RNA, 64 nt, hsa
cuggaggcuggagccaggggccacuucugaacugcaccagcaccaggcccacccucgucucugc

SEQ ID NO: 418692 - RNA, 64 nt, hsa
ccuccccauagccagcacagcuaucccgcggggacaccagcacugagcccccucucccuccugc

SEQ ID NO: 418693 - RNA, 64 nt, hsa
aggccucagccccucuuucccaggcccuggaucucaccagcagccaagguugagccagaaccag

SEQ ID NO: 418694 - RNA, 64 nt, hsa
aguuggcauggguugcccuacaggcccacagggccaccagcacacccccgcacgcugggcacca

SEQ ID NO: 418695 - RNA, 64 nt, hsa
acacagaaucaggaccagcaugugcagagcuggccaccagcacaggcuuagggcaguucagaac

SEQ ID NO: 418696 - RNA, 64 nt, hsa
acaggugaguacucauaauuggccagcaucucaccaccagcaaguaguagggccaggucaaucc

SEQ ID NO: 418697 - RNA, 64 nt, hsa
cuguccaugcggccucacugggggccaucagccucaccagcaaagcagagaugagagcguggga

SEQ ID NO: 418698 - RNA, 64 nt, hsa
gucaugaggggccuaugccuuuacuccuuuuaaacaccagcacccgucuuuuccccaaccuaaa

SEQ ID NO: 418699 - RNA, 64 nt, hsa
ccagcacccgucuuuuccccaaccuaaaaccaaccaccagcauuucacuacaggaccaaaugga

SEQ ID NO: 418700 - RNA, 64 nt, hsa
uaggcacucucuggcuaaaaacaaacucugaggccaccagcagaucaucuuuaagcuaaguuac

SEQ ID NO: 418701 - RNA, 64 nt, hsa
cauuggcuggguucugauugcuagaugucacacccaccagcaucaccaaagugacucugagaua

SEQ ID NO: 418702 - RNA, 64 nt, hsa
cccggcaguucucaaacuuuagcaugugaagagucaccagcagauuccugggcucgccuggaga

SEQ ID NO: 418703 - RNA, 64 nt, hsa
gcaccauggccagcagagcggugagcagcacucccaccagcagcccggucagacugaaguguuc

SEQ ID NO: 418704 - RNA, 64 nt, hsa
gaaaguucagccaaugcccagagugaccaagcagcaccagcaggccugcccaggaugcugaaag

SEQ ID NO: 418705 - RNA, 64 nt, hsa
gugaggaaaaccugccauuguggcccuggagagucaccagcagcucuugggaaggacuugcugg

SEQ ID NO: 418706 - RNA, 64 nt, hsa
cugugcuguuugucuccucgacagggagccuguccaccagcaggcugcggucccagcgggugcg

SEQ ID NO: 418707 - RNA, 64 nt, hsa
agacaccccucugcccagcucaccacaucuucaucaccagcaaacgccaggacuuggcuccccc

SEQ ID NO: 418708 - RNA, 64 nt, hsa
aggggcccgagcugcccccacccccggccucagccaccagcacccccauagggcccccagacac

SEQ ID NO: 418709 - RNA, 64 nt, hsa
gagagcccuuggaaggggucucgguggagcugugcaccagcagccaagcagaaagaaacacgcg

SEQ ID NO: 418710 - RNA, 64 nt, hsa
cgcccuucuuugagccagacgccaacuugacccucaccagcauuaucaggagcgcgcucagcaa

SEQ ID NO: 418711 - RNA, 64 nt, hsa
cggccccucccgggagauccgugcgcccgaccagcaccagcaucgcggaccgcaaaggccgccc

SEQ ID NO: 418712 - RNA, 64 nt, hsa
acugaagacaacuaacccuuuccccaacagagcccaccagcagugguggagaugucgguccaug

SEQ ID NO: 418713 - RNA, 64 nt, hsa
ccuguuuuuuuaaaaaaagaaguggagguguuuacaccagcaaaauacucauuuuuuaagugua

SEQ ID NO: 418714 - RNA, 64 nt, hsa
uggguccccccaaaacuugggcuggcccagggcccaccagcagcugauguugccuccucuccug

SEQ ID NO: 418715 - RNA, 64 nt, hsa
acacccccguggggggacagccgaugggagccagcaccagcaggauccgagggcgccccggaca

SEQ ID NO: 418716 - RNA, 64 nt, hsa
uucacucuccucugauuagaugaaacuguuaccuuacccuaaacacaguauuucuuuuuaacuu

SEQ ID NO: 418717 - RNA, 64 nt, hsa
ccuauucagcuccccaagaugauguguuuuugcuuacccuaagagagguuuucuucuuauuuuu

SEQ ID NO: 418718 - RNA, 64 nt, hsa
uuucuccaagacagauuuucggaacacauuucccuacccuaaagcgacaucccaguaguguuug

SEQ ID NO: 418719 - RNA, 64 nt, hsa
auugucuuuguuauaaaugaggucacuauggacuuacccuaaagaucuucuguacuucucucuu

SEQ ID NO: 418720 - RNA, 64 nt, hsa
uaaaaggacucauuuaagcucacauggucaguagguggcagagcuacuaguagggaaagaagaa

SEQ ID NO: 418721 - RNA, 64 nt, hsa
uauacauguauguauaugguauauuauacauuugguggcagaaaaagaagauacugcauuuuca

SEQ ID NO: 418722 - RNA, 64 nt, hsa
uuugcauuugguggaaaaccucaagucagacucaguggcagaacaugcagcagaaaagcuguga

SEQ ID NO: 418723 - RNA, 64 nt, hsa
cugcaacaccaugagaccugagcaagaaugugcuguggcagagggggucuugguuucauaaaug

SEQ ID NO: 418724 - RNA, 64 nt, hsa
cauaguuuuggguuuuuuuuuuuuuuuuacguaaguggcagacacuuuauugcacaugaaauuu

SEQ ID NO: 418725 - RNA, 64 nt, hsa
uauuuuuaaagauauugauuuuuugcccaugcuuguggcagaaguuuuccuuauuugccauuuu

SEQ ID NO: 418726 - RNA, 64 nt, hsa
augugaagguuuguaaauaguccaugaugaugucguggcagagucugauuucuauauagaggug

SEQ ID NO: 418727 - RNA, 59 nt, hsa
ugauccucuaugaggugugacccugggagguggcagacagaagcacccccugccccggc

SEQ ID NO: 418728 - RNA, 64 nt, hsa
aagaaaaaucaugcuggagggaagcccuacacauguggcagaauguggcaaagcauuuaauugg

SEQ ID NO: 418729 - RNA, 64 nt, hsa
uucuggggaaaaaaaugcuacaaaugugaaaaacguggcagagccuucagaccauccacaaacc

SEQ ID NO: 418730 - RNA, 64 nt, hsa
cucgcagauaaaaaagggaaaacuauagcuuugaguggcagacagcacacaucacaugcaucaa

SEQ ID NO: 418731 - RNA, 64 nt, hsa
gcugaauaggacauugcaugggaagaguacagagguggcagaaugaagcuagagugggaaggac

SEQ ID NO: 418732 - RNA, 64 nt, hsa
uuaaugaauuaagaacacauucuaacaagggucuguggcagacauugccgagugacuuucuuag

SEQ ID NO: 418733 - RNA, 64 nt, hsa
uuaaugaauuaagaacacauucuaacaagggucuguggcagacauugccgagugacuuucuaac

SEQ ID NO: 418734 - RNA, 64 nt, hsa
guggccagcagggacgcgccccaggugggcagcuguggcagagcagcgacccgcggcggggcgg

SEQ ID NO: 418735 - RNA, 64 nt, hsa
gcggccagcagggacgcgccccaggugggcagcuguggcagagcagucccgacaccuaaauaaa

SEQ ID NO: 418736 - RNA, 64 nt, hsa
acuauguuucacccgcuucaugacuaaaucacagguggcagaauuuuucaguucuuuuuuuuuu

SEQ ID NO: 418737 - RNA, 64 nt, hsa
uuaaacaaagaaaccacauuuuuaaaauuaccuuguggcagagaacuaaaaagcuuuguguucu

SEQ ID NO: 418738 - RNA, 64 nt, hsa
gucagccucugguucuccucgaguccuuggggacguggcagaugccagcgaccaucagacaacg

SEQ ID NO: 418739 - RNA, 64 nt, hsa
cgcggggagggugggugcuguggccccugcagguguggcagagauggggcaugggcauuggggu

SEQ ID NO: 418740 - RNA, 64 nt, hsa
gcaggcagccugucuggguuccugaggccuggggguggcagacgagcccacggcgccguggucc

SEQ ID NO: 418741 - RNA, 64 nt, hsa
gcgggccauguguguuugcaugaggaacucuuuaguggcagacaccuaagagacggcugcgguc

SEQ ID NO: 418742 - RNA, 64 nt, hsa
aauauuuauggccauguaaacguucugacaacugguggcagauuucgcuuuucguuguaaauau

SEQ ID NO: 418743 - RNA, 64 nt, hsa
ggaggcgccgggagguugccugcgucuccuuggaguggcagauuccacccacccagcucugccc

SEQ ID NO: 418744 - RNA, 64 nt, hsa
ucagacaaaaccuuuucuccuguguaucuuugaaguggcagacaaggcgaagcaucagacuggu

SEQ ID NO: 418745 - RNA, 64 nt, hsa
caaaauuaacccuuuucuccuguguaucuuugaaguggcagauaaggugaagcaucagacuggu

SEQ ID NO: 418746 - RNA, 64 nt, hsa
gcccugaaaaauuaguccgauuuuguggugguaaugggagaaggacaucccaggagcagggucu

SEQ ID NO: 418747 - RNA, 64 nt, hsa
gugccuguaaucccggcuauucagaaggccgaggugggagaauccguugaaccugggaggcgga

SEQ ID NO: 418748 - RNA, 64 nt, hsa
agcagguucugcuugcaaagaggccucaguccagugggagaaacagaccugggcgcaaacaacu

SEQ ID NO: 418749 - RNA, 64 nt, hsa
accuguaucucuuguugggagaaaagcugaguguugggagaagcugaggccgagcuugcauguc

SEQ ID NO: 418750 - RNA, 64 nt, hsa
gucuaccugucuccuacccaccuguaucucuuguugggagaaaagcugaguguugggagaagcu

SEQ ID NO: 418751 - RNA, 64 nt, hsa
cugagggacagaccucuaucaaauagaagagggcugggagaaggggugauuagaagcagaguga

SEQ ID NO: 418752 - RNA, 64 nt, hsa
uuuaagccaggauaguuaaccguuagggggccagugggagaaugcuugccuugcauuugcacau

SEQ ID NO: 418753 - RNA, 64 nt, hsa
cggaggccaaaggccaacuguacucccaaaggcaugggagaagguuggcgagaagaccccugac

SEQ ID NO: 418754 - RNA, 64 nt, hsa
ccgaguuauuuggugggauuugcagggacuuuucugggagaacuuaaaggcccauaguaacugc

SEQ ID NO: 418755 - RNA, 64 nt, hsa
uaucauauauuaaaacaauaaugcaauuagaauuugggagaagcaaauauagguccuguguuaa

SEQ ID NO: 418756 - RNA, 64 nt, hsa
uuugcucuaaucucucugccgaaagucaaagugaugggagaauugguauacugguaugacuacg

SEQ ID NO: 418757 - RNA, 64 nt, hsa
auauauucugaccguuaaaaaauucuuguucauaugggagaagggggaguaaugacuuguacaa

SEQ ID NO: 418758 - RNA, 64 nt, hsa
cuuucugccacaucucgcccuucuggaccugcacugggagaaauucaggacaggagugaacuca

SEQ ID NO: 418759 - RNA, 64 nt, hsa
gagcauuaaaguuccuaagacccagugacaguacugggagaaaccaaggcugaagagucagguu

SEQ ID NO: 418760 - RNA, 64 nt, hsa
uuaaaacuuuguagaaagcaaacaaaauuguucuugggagaaaaucaacuuuuagauuaaaaaa

SEQ ID NO: 418761 - RNA, 64 nt, hsa
ugcuaaugacgacaccuagcucuaagagcaauucugggagaaugaaaggaaguauaaaguaacc

SEQ ID NO: 418762 - RNA, 64 nt, hsa
uauuauuaaacuagucaaaaaugcuaaaauaauuugggagaaaauauuuuuuaaguaguguuau

SEQ ID NO: 418763 - RNA, 64 nt, hsa
acuucuacacaucugccuaacuugggaaugaaugugggagaaaaucgcugcugcugagauggac

SEQ ID NO: 418764 - RNA, 64 nt, hsa
cuuaaacaucuugcgaggcagccugccugguuuaugggagaacucugaagcccaugauguuuuc

SEQ ID NO: 418765 - RNA, 64 nt, hsa
aacaagccccguuggaacuuccuagugggaaugaugggagaaguuuggggcaggguauccaaga

SEQ ID NO: 418766 - RNA, 64 nt, hsa
uuuucuuucccaagcuccuagccaacacuauccuugggagaaagaaauuugcagaaacugcuaa

SEQ ID NO: 418767 - RNA, 64 nt, hsa
agaaccuugcuguugcucugaggagauauaauucugggagaaagaaucuuuuauaagaacagua

SEQ ID NO: 418768 - RNA, 64 nt, hsa
aguggaucgguggugaaccuguugccuucaccaaugggagaagagggcccucucaacgcuccaa

SEQ ID NO: 418769 - RNA, 64 nt, hsa
ccaggcagcacaugcgguggcucugggacauuggugggagaaaguccuuuuggauaggcaagua

SEQ ID NO: 418770 - RNA, 64 nt, hsa
uucauauuccuccaaccaaagcaagcacagcacaugggagaagggcauuuggcaucugcugccc

SEQ ID NO: 418771 - RNA, 64 nt, hsa
cagggacuacauaacaggcaccuuugagagagcaugggagaagguggauaagaggaugcugcuc

SEQ ID NO: 418772 - RNA, 64 nt, hsa
agccauaggcuccccagcuuucuccaggcuggggugggagaaggaagcaggacagagcugcaag

SEQ ID NO: 418773 - RNA, 64 nt, hsa
aguucccuggacuaccuucaggaggcacgagagcugggagaagaggcaaagcuacagguuuacu

SEQ ID NO: 418774 - RNA, 64 nt, hsa
caagugccccugugggaugggaggagugaggcagugggagaagaggugguggucguuucuaugc

SEQ ID NO: 418775 - RNA, 64 nt, hsa
auaaaucauaccucaaaggauggagugcaucaauugggagaaaaggagacauagcccaaacccu

SEQ ID NO: 418776 - RNA, 64 nt, hsa
auaaggggugggagugugauuuuaaaugcucuuuugggagaacaaagaaauuaauguaaauaag

SEQ ID NO: 418777 - RNA, 64 nt, hsa
aacgaucaccaaaaugaaaagguggacuguagauugggagaaaauauuugcaaaccguuaucug

SEQ ID NO: 418778 - RNA, 64 nt, hsa
acgccuguaaucucagcacuuugggaggccgaggugggagaaucacaaggucaggagacugaga

SEQ ID NO: 418779 - RNA, 64 nt, hsa
gacauccuuuccagcucaaacguggguagggaugugggagaauaagaaugugggagaaccaaga

SEQ ID NO: 418780 - RNA, 64 nt, hsa
caaacguggguagggaugugggagaauaagaaugugggagaaccaagagaaaaaguggggcugg

SEQ ID NO: 418781 - RNA, 64 nt, hsa
ugguaauauuuggagcuuuauagccuguauuccuugggagaaaaaaaugggaauuggaguaaaa

SEQ ID NO: 418782 - RNA, 64 nt, hsa
auuucagaugacaguguggucagaagauguuuuuugggagaaccuaguguuugcugggcacuau

SEQ ID NO: 418783 - RNA, 64 nt, hsa
ucuccuguagcguuagcucugcagagcuaagcuuugggagaaugaaucuaucacugagaaguuu

SEQ ID NO: 418784 - RNA, 64 nt, hsa
agccagccgugguggggugcagaguuggcaggagugggagaaggaggagagaaaagcugguccu

SEQ ID NO: 418785 - RNA, 64 nt, hsa
uuuacuuccgccccuggcagggacuucuggguuaugggagaaaccagagaugggaaugaggaaa

SEQ ID NO: 418786 - RNA, 64 nt, hsa
guggggugggauucagagugcuuagucugcucacugggagaagaagaguuccugcgcaugcaag

SEQ ID NO: 418787 - RNA, 64 nt, hsa
agaccaaaucuuuguccgggaagcaagaagugggugggagaauguauccuguuuuugucaguuu

SEQ ID NO: 418788 - RNA, 64 nt, hsa
cugcaacuugacagagccugaguuugccucuuagugggagaaugagagagagcuguagugucac

SEQ ID NO: 418789 - RNA, 64 nt, hsa
agaggguccaggcuggaaaccugaacuuucugggugggagaaccagguggugccugccgagguc

SEQ ID NO: 418790 - RNA, 64 nt, hsa
gagacuagcuucagcuuuugcuauuuuuuuuaagugggagaagggugggcaguuaucacugggg

SEQ ID NO: 418791 - RNA, 64 nt, hsa
cuuggucguuccugagugugggccaagcuaacuuugggagaaauuuacuuuauagguuaaauua

SEQ ID NO: 418792 - RNA, 64 nt, hsa
agugacauaaguucaucuccugauccauuguuugugggagaauuauacuugacugaauuauggg

SEQ ID NO: 418793 - RNA, 64 nt, hsa
cuuaguuggccccaguaauucuccuuggaggacuugggagaagaauuuccacaaagcaaacuac

SEQ ID NO: 418794 - RNA, 64 nt, hsa
cagccaccuaugugaucuuuaaauccaaccccaaugggagaaaagggcaagaacagucugugcc

SEQ ID NO: 418795 - RNA, 64 nt, hsa
aagggaaugaugugauucaagcuggaaagaggguugggagaaacagcuuguccagguggagcua

SEQ ID NO: 418796 - RNA, 64 nt, hsa
caccuccuaguuuccgacagucaucuccuucugcugggagaauuagcagcaguucagggggcuu

SEQ ID NO: 418797 - RNA, 64 nt, hsa
agggaaggggagugggguccaagugacagcuggaugggagaagccauaguuucucccagucagc

SEQ ID NO: 418798 - RNA, 64 nt, hsa
ucuagggcuaguacuuaguuucacacccgggagcugggagaaaaaaccuguacaguugucuuuc

SEQ ID NO: 418799 - RNA, 64 nt, hsa
guuuuguaucgguauuugauuuuuagugggcagaugggagaaggaaagguuauuuauucuauag

SEQ ID NO: 418800 - RNA, 64 nt, hsa
aauagcaccuauagccauuuuaauuuagucauguugggagaaaaauagauggguuacaaauaca

SEQ ID NO: 418801 - RNA, 64 nt, hsa; identical to SEQ ID NO: 273006

SEQ ID NO: 418802 - RNA, 64 nt, hsa; identical to SEQ ID NO: 273007

SEQ ID NO: 418803 - RNA, 64 nt, hsa; identical to SEQ ID NO: 273008

SEQ ID NO: 418804 - RNA, 64 nt, hsa; identical to SEQ ID NO: 273009

SEQ ID NO: 418805 - RNA, 64 nt, hsa; identical to SEQ ID NO: 273010

SEQ ID NO: 418806 - RNA, 64 nt, hsa; identical to SEQ ID NO: 273011

SEQ ID NO: 418807 - RNA, 64 nt, hsa; identical to SEQ ID NO: 273012

SEQ ID NO: 418808 - RNA, 64 nt, hsa; identical to SEQ ID NO: 273013

SEQ ID NO: 418809 - RNA, 64 nt, hsa; identical to SEQ ID NO: 273014

SEQ ID NO: 418810 - RNA, 64 nt, hsa; identical to SEQ ID NO: 273015

SEQ ID NO: 418811 - RNA, 64 nt, hsa; identical to SEQ ID NO: 273016

SEQ ID NO: 418812 - RNA, 64 nt, hsa; identical to SEQ ID NO: 273017

SEQ ID NO: 418813 - RNA, 64 nt, hsa; identical to SEQ ID NO: 273018

SEQ ID NO: 418814 - RNA, 64 nt, hsa; identical to SEQ ID NO: 273019

SEQ ID NO: 418815 - RNA, 64 nt, hsa; identical to SEQ ID NO: 273020

SEQ ID NO: 418816 - RNA, 64 nt, hsa; identical to SEQ ID NO: 273021

SEQ ID NO: 418817 - RNA, 64 nt, hsa; identical to SEQ ID NO: 273022

SEQ ID NO: 418818 - RNA, 64 nt, hsa; identical to SEQ ID NO: 273023

SEQ ID NO: 418819 - RNA, 64 nt, hsa; identical to SEQ ID NO: 273024

SEQ ID NO: 418820 - RNA, 64 nt, hsa; identical to SEQ ID NO: 273025

SEQ ID NO: 418821 - RNA, 64 nt, hsa; identical to SEQ ID NO: 273026

SEQ ID NO: 418822 - RNA, 64 nt, hsa; identical to SEQ ID NO: 273027

SEQ ID NO: 418823 - RNA, 64 nt, hsa; identical to SEQ ID NO: 273028

SEQ ID NO: 418824 - RNA, 64 nt, hsa; identical to SEQ ID NO: 273029

SEQ ID NO: 418825 - RNA, 64 nt, hsa; identical to SEQ ID NO: 273030

SEQ ID NO: 418826 - RNA, 64 nt, hsa; identical to SEQ ID NO: 273031

SEQ ID NO: 418827 - RNA, 64 nt, hsa; identical to SEQ ID NO: 273032

SEQ ID NO: 418828 - RNA, 64 nt, hsa; identical to SEQ ID NO: 273033

SEQ ID NO: 418829 - RNA, 64 nt, hsa; identical to SEQ ID NO: 273034

SEQ ID NO: 418830 - RNA, 64 nt, hsa; identical to SEQ ID NO: 273035

SEQ ID NO: 418831 - RNA, 64 nt, hsa; identical to SEQ ID NO: 273036

SEQ ID NO: 418832 - RNA, 64 nt, hsa; identical to SEQ ID NO: 273037

SEQ ID NO: 418833 - RNA, 64 nt, hsa; identical to SEQ ID NO: 85985

SEQ ID NO: 418834 - RNA, 64 nt, hsa; identical to SEQ ID NO: 85986

SEQ ID NO: 418835 - RNA, 64 nt, hsa; identical to SEQ ID NO: 85987

SEQ ID NO: 418836 - RNA, 64 nt, hsa; identical to SEQ ID NO: 85988

SEQ ID NO: 418837 - RNA, 64 nt, hsa; identical to SEQ ID NO: 85989

SEQ ID NO: 418838 - RNA, 64 nt, hsa; identical to SEQ ID NO: 85990

SEQ ID NO: 418839 - RNA, 64 nt, hsa; identical to SEQ ID NO: 365526

SEQ ID NO: 418840 - RNA, 64 nt, hsa; identical to SEQ ID NO: 365527

SEQ ID NO: 418841 - RNA, 64 nt, hsa; identical to SEQ ID NO: 365528

SEQ ID NO: 418842 - RNA, 64 nt, hsa; identical to SEQ ID NO: 365529

SEQ ID NO: 418843 - RNA, 64 nt, hsa; identical to SEQ ID NO: 365530

SEQ ID NO: 418844 - RNA, 64 nt, hsa; identical to SEQ ID NO: 365531

SEQ ID NO: 418845 - RNA, 64 nt, hsa; identical to SEQ ID NO: 365532

SEQ ID NO: 418846 - RNA, 64 nt, hsa; identical to SEQ ID NO: 365533

SEQ ID NO: 418847 - RNA, 64 nt, hsa
acuuuccacaacuuguuuuuguacuuuaagguuucucaauuagaauauuucuaguugagcugua

SEQ ID NO: 418848 - RNA, 64 nt, hsa
uuaaccaugcugguguuaugauucaguauuaacucucaauuagcaugccccuguucuuccuaac

SEQ ID NO: 418849 - RNA, 64 nt, hsa
uauuggugauuaaucuuuuuguaaucauaaauuacucaauuaggauaaaaauaaauuauguuuu

SEQ ID NO: 418850 - RNA, 64 nt, hsa
gguaaccuucaguuauuuugaauuaauuuaacuucucaauuaugccaaaguugcacuugcauga

SEQ ID NO: 418851 - RNA, 64 nt, hsa
augguuacauugugcugcuagaaauaaugucauucucaauuaaaaggguuacaccuguagccac

SEQ ID NO: 418852 - RNA, 64 nt, hsa
acacacuacaggguaauuauguaauucucuagcacucaauuaagaagcuuguagguuagcaaaa

SEQ ID NO: 418853 - RNA, 64 nt, hsa
acugcauuccaaccugggugaugaagugagacucuccaaaaaaaaaaaagaaauuauuaauccc

SEQ ID NO: 418854 - RNA, 64 nt, hsa
aacuuaggcucuuuauuaauugguuaagguuuucuccaaaaagggcauuucaacaaugggaauu

SEQ ID NO: 418855 - RNA, 64 nt, hsa
uuuaacaguuacagcaauaaagaauaguuaguacuccaaaaauauuauauuuaagaugcucaac

SEQ ID NO: 418856 - RNA, 64 nt, hsa
cuuuccucugcucacuuuaagaacuuuuaccgacuccaaaaaucucaggaauuaaacuuuuaac

SEQ ID NO: 418857 - RNA, 64 nt, hsa
uacuugaacuugguaguguuuccuuagaaccuccuccaaaaauaugcauuuaccaggcuuguua

SEQ ID NO: 418858 - RNA, 64 nt, hsa
cauuuuuaauuuauaucagauuuauaucagacccuccaaaaaguauuugaaauauauuacaguu

SEQ ID NO: 418859 - RNA, 64 nt, hsa
aaaaaaaaaaaaaaaaaaaaaaaaaaaguuaauguccaaaaaugacagauuuacaaguguaagc

SEQ ID NO: 418860 - RNA, 64 nt, hsa
uaggaaaacuaccaauaaauguagaauggaugauuccaaaaaaaaaaaaaaaaagaagaaagag

SEQ ID NO: 418861 - RNA, 64 nt, hsa
guguagaauucuugaaaaguuaacguagaaaauauccaaaaagcaguauuucuagaaagugucc

SEQ ID NO: 418862 - RNA, 64 nt, hsa
gaaaauauccaaaaagcaguauuucuagaaaguguccaaaaagcaguauuucuuucccuugguu

SEQ ID NO: 418863 - RNA, 64 nt, hsa
uaacaaaaugagcaguaaaagucacaugaaccacuccaaaaaucagugcauuuugcauauuuuu

SEQ ID NO: 418864 - RNA, 64 nt, hsa
acuuuaauaaagaaguauuucgaggagauaucuguccaaaaagguuugacuggccuccagauuc

SEQ ID NO: 418865 - RNA, 64 nt, hsa
auuauaccaaguuagguuuuuugcuaucuauugauccaaaaaauauauucgugcaauuaaaguu

SEQ ID NO: 418866 - RNA, 64 nt, hsa
gguugaguuuugguuuuuucuuuuucuuuuuuuuuccaaaaauaaagacagcccauuuuuguca

SEQ ID NO: 418867 - RNA, 64 nt, hsa
uuucuuauuggcucugccuccugugcuuauaucauccaaaaacuuuuuaaaaagguccagaauu

SEQ ID NO: 418868 - RNA, 64 nt, hsa
uccgccuguuuuuuaaacuuuuccaccaccugcguccaaaaagaauguuauagcgagugcucuu

SEQ ID NO: 418869 - RNA, 64 nt, hsa
augauguuggagaagggaaguugaacgagcauaguccaaaaagcuccuggggcguccaggccgc

SEQ ID NO: 418870 - RNA, 64 nt, hsa
aaugccauuuauuuauugauuccuuuuuucaaaauccaaaaagaaaugauguuggagaagggaa

SEQ ID NO: 418871 - RNA, 64 nt, hsa
agggacacagaauguugguuucuaacagacuacuuccaaaaacaguuugagaaaaaaacugucu

SEQ ID NO: 418872 - RNA, 64 nt, hsa
gaggacaugagggggaaaguccuuuuugcccuucuccaaaaaauaaccuuccacagagacaaac

SEQ ID NO: 418873 - RNA, 64 nt, hsa
cacuccagccugggcaacagagcaagacuccgucuccaaaaaaaaaaaaaaaaaaaaagaauuc

SEQ ID NO: 418874 - RNA, 64 nt, hsa
cacuggcccccaaggucagcucccugggucugucuccaaaaaugguugcugaugacaucaccaa

SEQ ID NO: 418875 - RNA, 64 nt, hsa
gaugaaauagaagcauuaaauauuuuuaucuauauccaaaaaggagcacauuuuuauauuuaca

SEQ ID NO: 418876 - RNA, 64 nt, hsa
cauuuauaacugccuauugccuguucuauuagcauccaaaaauguggaaggccucccaaccacc

SEQ ID NO: 418877 - RNA, 64 nt, hsa
caucauauggggaauuuucuauucaccguacuuauccaaaaaucucuuuuaaaaaguaaauuug

SEQ ID NO: 418878 - RNA, 64 nt, hsa
aauugagauagcaaugguuuuauggcaugaauuauccaaaaaaauaucagaauuacuuauuauu

SEQ ID NO: 418879 - RNA, 64 nt, hsa
ucaaauuuguuaaaagaauuuugaguucuauaaauccaaaaaucugaaaccugaauuuauuuaa

SEQ ID NO: 418880 - RNA, 64 nt, hsa
ugggagcaacugaguagcaauaguaaauuuacuuuccaaaaaagccuuauuaaaauauaaauau

SEQ ID NO: 418881 - RNA, 64 nt, hsa
auucacugguacaguccagccaguaaaaaacacuuccaaaaagauacacagaagaggaacuaaa

SEQ ID NO: 418882 - RNA, 64 nt, hsa
aaggauaccggacacaccucugcuccaaaggaaauccaaaaaagcaaacacaagaaaucaaaau

SEQ ID NO: 418883 - RNA, 64 nt, hsa
cuguaauguuaaacucuuuggcuuuaaguaaaaauccaaaaaguuuuuuuaaaaaagcaaagga

SEQ ID NO: 418884 - RNA, 64 nt, hsa
uuuauauuuuuaaagcaaguuguugcuuaucuuuuccaaaaagugaaaaauguuaaaacagaca

SEQ ID NO: 418885 - RNA, 64 nt, hsa
uacaauuaggucuuugucagacauucuggagguuuccaaaaauaauauuguaaaguucaauuuc

SEQ ID NO: 418886 - RNA, 64 nt, hsa
gcuguagaguuuccacauuucacaugcaguguacuccaaaaagcggguuugggucaaccauuuc

SEQ ID NO: 418887 - RNA, 64 nt, hsa
uauggaugcauuuauucacaagcaaccccaaaaguccaaaaauguaauaauuuugacaaggccc

SEQ ID NO: 418888 - RNA, 64 nt, hsa
ucaaguuuacuaauuuggauugugagaaaguaccaaguaccagccguccaaacugaucacaauu

SEQ ID NO: 418889 - RNA, 64 nt, hsa
ugaguuuucaaguuuacuaauuuggauugugagaaaguaccaaguaccagccguccaaacugau

SEQ ID NO: 418890 - RNA, 64 nt, hsa
cucaccaaagaagaaauuaaccugcacuuucaaaaaguaccauguauaggaaugaaacauugag

SEQ ID NO: 418891 - RNA, 64 nt, hsa
cuuuacuugugaaagguaugcuauauaauucagcaaguaccaacuuguguagcugcagaauaac

SEQ ID NO: 418892 - RNA, 64 nt, hsa; identical to SEQ ID NO: 245291

SEQ ID NO: 418893 - RNA, 64 nt, hsa; identical to SEQ ID NO: 245292

SEQ ID NO: 418894 - RNA, 64 nt, hsa; identical to SEQ ID NO: 245293

SEQ ID NO: 418895 - RNA, 64 nt, hsa; identical to SEQ ID NO: 245294

SEQ ID NO: 418896 - RNA, 62 nt, hsa; identical to SEQ ID NO: 315869

SEQ ID NO: 418897 - RNA, 62 nt, hsa; identical to SEQ ID NO: 315870

SEQ ID NO: 418898 - RNA, 62 nt, hsa; identical to SEQ ID NO: 315871

SEQ ID NO: 418899 - RNA, 62 nt, hsa; identical to SEQ ID NO: 315872

SEQ ID NO: 418900 - RNA, 62 nt, hsa; identical to SEQ ID NO: 315873

SEQ ID NO: 418901 - RNA, 62 nt, hsa; identical to SEQ ID NO: 315874

SEQ ID NO: 418902 - RNA, 62 nt, hsa; identical to SEQ ID NO: 315875

SEQ ID NO: 418903 - RNA, 62 nt, hsa; identical to SEQ ID NO: 315876

SEQ ID NO: 418904 - RNA, 62 nt, hsa; identical to SEQ ID NO: 315877

SEQ ID NO: 418905 - RNA, 62 nt, hsa; identical to SEQ ID NO: 315878

SEQ ID NO: 418906 - RNA, 62 nt, hsa; identical to SEQ ID NO: 315879

SEQ ID NO: 418907 - RNA, 62 nt, hsa; identical to SEQ ID NO: 315880

SEQ ID NO: 418908 - RNA, 62 nt, hsa; identical to SEQ ID NO: 315881

SEQ ID NO: 418909 - RNA, 62 nt, hsa; identical to SEQ ID NO: 315882

SEQ ID NO: 418910 - RNA, 62 nt, hsa; identical to SEQ ID NO: 315883

SEQ ID NO: 418911 - RNA, 62 nt, hsa; identical to SEQ ID NO: 315884

SEQ ID NO: 418912 - RNA, 62 nt, hsa; identical to SEQ ID NO: 315885

SEQ ID NO: 418913 - RNA, 62 nt, hsa; identical to SEQ ID NO: 315886

SEQ ID NO: 418914 - RNA, 62 nt, hsa; identical to SEQ ID NO: 315887

SEQ ID NO: 418915 - RNA, 62 nt, hsa; identical to SEQ ID NO: 315888

SEQ ID NO: 418916 - RNA, 62 nt, hsa; identical to SEQ ID NO: 315889

SEQ ID NO: 418917 - RNA, 62 nt, hsa; identical to SEQ ID NO: 315890

SEQ ID NO: 418918 - RNA, 62 nt, hsa; identical to SEQ ID NO: 315891

SEQ ID NO: 418919 - RNA, 62 nt, hsa; identical to SEQ ID NO: 315892

SEQ ID NO: 418920 - RNA, 62 nt, hsa; identical to SEQ ID NO: 315893

SEQ ID NO: 418921 - RNA, 62 nt, hsa; identical to SEQ ID NO: 315894

SEQ ID NO: 418922 - RNA, 62 nt, hsa; identical to SEQ ID NO: 315895

SEQ ID NO: 418923 - RNA, 62 nt, hsa; identical to SEQ ID NO: 315896

SEQ ID NO: 418924 - RNA, 62 nt, hsa; identical to SEQ ID NO: 315897

SEQ ID NO: 418925 - RNA, 62 nt, hsa; identical to SEQ ID NO: 315898

SEQ ID NO: 418926 - RNA, 62 nt, hsa; identical to SEQ ID NO: 315899

SEQ ID NO: 418927 - RNA, 62 nt, hsa; identical to SEQ ID NO: 315900

SEQ ID NO: 418928 - RNA, 62 nt, hsa; identical to SEQ ID NO: 315901

SEQ ID NO: 418929 - RNA, 62 nt, hsa; identical to SEQ ID NO: 315902

SEQ ID NO: 418930 - RNA, 62 nt, hsa; identical to SEQ ID NO: 315903

SEQ ID NO: 418931 - RNA, 62 nt, hsa; identical to SEQ ID NO: 315904

SEQ ID NO: 418932 - RNA, 62 nt, hsa; identical to SEQ ID NO: 315905

SEQ ID NO: 418933 - RNA, 62 nt, hsa; identical to SEQ ID NO: 315906

SEQ ID NO: 418934 - RNA, 62 nt, hsa; identical to SEQ ID NO: 315907

SEQ ID NO: 418935 - RNA, 62 nt, hsa; identical to SEQ ID NO: 315908

SEQ ID NO: 418936 - RNA, 62 nt, hsa; identical to SEQ ID NO: 315909

SEQ ID NO: 418937 - RNA, 62 nt, hsa; identical to SEQ ID NO: 315910

SEQ ID NO: 418938 - RNA, 62 nt, hsa; identical to SEQ ID NO: 315911

SEQ ID NO: 418939 - RNA, 62 nt, hsa; identical to SEQ ID NO: 315912

SEQ ID NO: 418940 - RNA, 62 nt, hsa; identical to SEQ ID NO: 315913

SEQ ID NO: 418941 - RNA, 62 nt, hsa; identical to SEQ ID NO: 315914

SEQ ID NO: 418942 - RNA, 62 nt, hsa; identical to SEQ ID NO: 315915

SEQ ID NO: 418943 - RNA, 62 nt, hsa; identical to SEQ ID NO: 315916

SEQ ID NO: 418944 - RNA, 62 nt, hsa; identical to SEQ ID NO: 315917

SEQ ID NO: 418945 - RNA, 62 nt, hsa; identical to SEQ ID NO: 315918

SEQ ID NO: 418946 - RNA, 62 nt, hsa; identical to SEQ ID NO: 315919

SEQ ID NO: 418947 - RNA, 62 nt, hsa; identical to SEQ ID NO: 315920

SEQ ID NO: 418948 - RNA, 62 nt, hsa; identical to SEQ ID NO: 315921

SEQ ID NO: 418949 - RNA, 62 nt, hsa; identical to SEQ ID NO: 315922

SEQ ID NO: 418950 - RNA, 62 nt, hsa; identical to SEQ ID NO: 315923

SEQ ID NO: 418951 - RNA, 62 nt, hsa; identical to SEQ ID NO: 315924

SEQ ID NO: 418952 - RNA, 62 nt, hsa; identical to SEQ ID NO: 315925

SEQ ID NO: 418953 - RNA, 62 nt, hsa; identical to SEQ ID NO: 315926

SEQ ID NO: 418954 - RNA, 62 nt, hsa; identical to SEQ ID NO: 315927

SEQ ID NO: 418955 - RNA, 62 nt, hsa; identical to SEQ ID NO: 315928

SEQ ID NO: 418956 - RNA, 62 nt, hsa; identical to SEQ ID NO: 315929

SEQ ID NO: 418957 - RNA, 62 nt, hsa; identical to SEQ ID NO: 315930

SEQ ID NO: 418958 - RNA, 62 nt, hsa; identical to SEQ ID NO: 315931

SEQ ID NO: 418959 - RNA, 62 nt, hsa; identical to SEQ ID NO: 315932

SEQ ID NO: 418960 - RNA, 62 nt, hsa; identical to SEQ ID NO: 315933

SEQ ID NO: 418961 - RNA, 62 nt, hsa; identical to SEQ ID NO: 315934

SEQ ID NO: 418962 - RNA, 62 nt, hsa; identical to SEQ ID NO: 315935

SEQ ID NO: 418963 - RNA, 62 nt, hsa; identical to SEQ ID NO: 315936

SEQ ID NO: 418964 - RNA, 62 nt, hsa; identical to SEQ ID NO: 315937

SEQ ID NO: 418965 - RNA, 62 nt, hsa; identical to SEQ ID NO: 315938

SEQ ID NO: 418966 - RNA, 62 nt, hsa; identical to SEQ ID NO: 315939

SEQ ID NO: 418967 - RNA, 62 nt, hsa; identical to SEQ ID NO: 315940

SEQ ID NO: 418968 - RNA, 62 nt, hsa; identical to SEQ ID NO: 315941

SEQ ID NO: 418969 - RNA, 62 nt, hsa; identical to SEQ ID NO: 315942

SEQ ID NO: 418970 - RNA, 62 nt, hsa; identical to SEQ ID NO: 315943

SEQ ID NO: 418971 - RNA, 62 nt, hsa; identical to SEQ ID NO: 315944

SEQ ID NO: 418972 - RNA, 62 nt, hsa; identical to SEQ ID NO: 315945

SEQ ID NO: 418973 - RNA, 62 nt, hsa; identical to SEQ ID NO: 315946

SEQ ID NO: 418974 - RNA, 62 nt, hsa; identical to SEQ ID NO: 315947

SEQ ID NO: 418975 - RNA, 62 nt, hsa; identical to SEQ ID NO: 315948

SEQ ID NO: 418976 - RNA, 62 nt, hsa; identical to SEQ ID NO: 315949

SEQ ID NO: 418977 - RNA, 62 nt, hsa; identical to SEQ ID NO: 315950

SEQ ID NO: 418978 - RNA, 62 nt, hsa; identical to SEQ ID NO: 315951

SEQ ID NO: 418979 - RNA, 62 nt, hsa; identical to SEQ ID NO: 315952

SEQ ID NO: 418980 - RNA, 62 nt, hsa; identical to SEQ ID NO: 315953

SEQ ID NO: 418981 - RNA, 62 nt, hsa; identical to SEQ ID NO: 315953

SEQ ID NO: 418982 - RNA, 62 nt, hsa; identical to SEQ ID NO: 315955

SEQ ID NO: 418983 - RNA, 62 nt, hsa; identical to SEQ ID NO: 315956

SEQ ID NO: 418984 - RNA, 62 nt, hsa; identical to SEQ ID NO: 315957

SEQ ID NO: 418985 - RNA, 62 nt, hsa; identical to SEQ ID NO: 315958

SEQ ID NO: 418986 - RNA, 62 nt, hsa; identical to SEQ ID NO: 315959

SEQ ID NO: 418987 - RNA, 62 nt, hsa; identical to SEQ ID NO: 315960

SEQ ID NO: 418988 - RNA, 62 nt, hsa; identical to SEQ ID NO: 315961

SEQ ID NO: 418989 - RNA, 62 nt, hsa; identical to SEQ ID NO: 315962

SEQ ID NO: 418990 - RNA, 62 nt, hsa; identical to SEQ ID NO: 315963

SEQ ID NO: 418991 - RNA, 62 nt, hsa; identical to SEQ ID NO: 315964

SEQ ID NO: 418992 - RNA, 62 nt, hsa; identical to SEQ ID NO: 315965

SEQ ID NO: 418993 - RNA, 62 nt, hsa; identical to SEQ ID NO: 315966

SEQ ID NO: 418994 - RNA, 62 nt, hsa; identical to SEQ ID NO: 315967

SEQ ID NO: 418995 - RNA, 62 nt, hsa; identical to SEQ ID NO: 315968

SEQ ID NO: 418996 - RNA, 62 nt, hsa; identical to SEQ ID NO: 315969

SEQ ID NO: 418997 - RNA, 62 nt, hsa; identical to SEQ ID NO: 315970

SEQ ID NO: 418998 - RNA, 62 nt, hsa; identical to SEQ ID NO: 315971

SEQ ID NO: 418999 - RNA, 62 nt, hsa; identical to SEQ ID NO: 315972

SEQ ID NO: 419000 - RNA, 62 nt, hsa; identical to SEQ ID NO: 315973

SEQ ID NO: 419001 - RNA, 62 nt, hsa; identical to SEQ ID NO: 315974

SEQ ID NO: 419002 - RNA, 62 nt, hsa; identical to SEQ ID NO: 315975

SEQ ID NO: 419003 - RNA, 62 nt, hsa; identical to SEQ ID NO: 315976

SEQ ID NO: 419004 - RNA, 62 nt, hsa; identical to SEQ ID NO: 315977

SEQ ID NO: 419005 - RNA, 62 nt, hsa; identical to SEQ ID NO: 315978

SEQ ID NO: 419006 - RNA, 62 nt, hsa; identical to SEQ ID NO: 315979

SEQ ID NO: 419007 - RNA, 62 nt, hsa; identical to SEQ ID NO: 315980

SEQ ID NO: 419008 - RNA, 62 nt, hsa; identical to SEQ ID NO: 315981

SEQ ID NO: 419009 - RNA, 62 nt, hsa; identical to SEQ ID NO: 315982

SEQ ID NO: 419010 - RNA, 62 nt, hsa; identical to SEQ ID NO: 315983

SEQ ID NO: 419011 - RNA, 62 nt, hsa; identical to SEQ ID NO: 315984

SEQ ID NO: 419012 - RNA, 62 nt, hsa; identical to SEQ ID NO: 315985

SEQ ID NO: 419013 - RNA, 62 nt, hsa; identical to SEQ ID NO: 315986

SEQ ID NO: 419014 - RNA, 62 nt, hsa; identical to SEQ ID NO: 315987

SEQ ID NO: 419015 - RNA, 62 nt, hsa; identical to SEQ ID NO: 315988

SEQ ID NO: 419016 - RNA, 62 nt, hsa; identical to SEQ ID NO: 315989

SEQ ID NO: 419017 - RNA, 62 nt, hsa; identical to SEQ ID NO: 315990

SEQ ID NO: 419018 - RNA, 62 nt, hsa; identical to SEQ ID NO: 315991

SEQ ID NO: 419019 - RNA, 62 nt, hsa; identical to SEQ ID NO: 315992

SEQ ID NO: 419020 - RNA, 62 nt, hsa; identical to SEQ ID NO: 315993

SEQ ID NO: 419021 - RNA, 62 nt, hsa; identical to SEQ ID NO: 315994

SEQ ID NO: 419022 - RNA, 62 nt, hsa; identical to SEQ ID NO: 315995

SEQ ID NO: 419023 - RNA, 62 nt, hsa; identical to SEQ ID NO: 315996

SEQ ID NO: 419024 - RNA, 62 nt, hsa; identical to SEQ ID NO: 315997

SEQ ID NO: 419025 - RNA, 62 nt, hsa; identical to SEQ ID NO: 315998

SEQ ID NO: 419026 - RNA, 62 nt, hsa; identical to SEQ ID NO: 315999

SEQ ID NO: 419027 - RNA, 62 nt, hsa; identical to SEQ ID NO: 316000

SEQ ID NO: 419028 - RNA, 62 nt, hsa; identical to SEQ ID NO: 316001

SEQ ID NO: 419029 - RNA, 62 nt, hsa; identical to SEQ ID NO: 316002

SEQ ID NO: 419030 - RNA, 62 nt, hsa; identical to SEQ ID NO: 316003

SEQ ID NO: 419031 - RNA, 62 nt, hsa; identical to SEQ ID NO: 316004

SEQ ID NO: 419032 - RNA, 62 nt, hsa; identical to SEQ ID NO: 316005

SEQ ID NO: 419033 - RNA, 62 nt, hsa; identical to SEQ ID NO: 316006

SEQ ID NO: 419034 - RNA, 62 nt, hsa; identical to SEQ ID NO: 316007

SEQ ID NO: 419035 - RNA, 62 nt, hsa; identical to SEQ ID NO: 316008

SEQ ID NO: 419036 - RNA, 62 nt, hsa; identical to SEQ ID NO: 316009

SEQ ID NO: 419037 - RNA, 62 nt, hsa; identical to SEQ ID NO: 316010

SEQ ID NO: 419038 - RNA, 62 nt, hsa; identical to SEQ ID NO: 316011

SEQ ID NO: 419039 - RNA, 62 nt, hsa; identical to SEQ ID NO: 316012

SEQ ID NO: 419040 - RNA, 62 nt, hsa; identical to SEQ ID NO: 316013

SEQ ID NO: 419041 - RNA, 62 nt, hsa; identical to SEQ ID NO: 316014

SEQ ID NO: 419042 - RNA, 62 nt, hsa; identical to SEQ ID NO: 316015

SEQ ID NO: 419043 - RNA, 62 nt, hsa; identical to SEQ ID NO: 316016

SEQ ID NO: 419044 - RNA, 62 nt, hsa; identical to SEQ ID NO: 316017

SEQ ID NO: 419045 - RNA, 62 nt, hsa; identical to SEQ ID NO: 316018

SEQ ID NO: 419046 - RNA, 62 nt, hsa; identical to SEQ ID NO: 316019

SEQ ID NO: 419047 - RNA, 62 nt, hsa; identical to SEQ ID NO: 316020

SEQ ID NO: 419048 - RNA, 62 nt, hsa; identical to SEQ ID NO: 316021

SEQ ID NO: 419049 - RNA, 62 nt, hsa; identical to SEQ ID NO: 316022

SEQ ID NO: 419050 - RNA, 62 nt, hsa; identical to SEQ ID NO: 316023

SEQ ID NO: 419051 - RNA, 62 nt, hsa; identical to SEQ ID NO: 316024

SEQ ID NO: 419052 - RNA, 62 nt, hsa; identical to SEQ ID NO: 316025

SEQ ID NO: 419053 - RNA, 62 nt, hsa; identical to SEQ ID NO: 316026

SEQ ID NO: 419054 - RNA, 62 nt, hsa; identical to SEQ ID NO: 316027

SEQ ID NO: 419055 - RNA, 62 nt, hsa; identical to SEQ ID NO: 316027

SEQ ID NO: 419056 - RNA, 62 nt, hsa; identical to SEQ ID NO: 316029

SEQ ID NO: 419057 - RNA, 62 nt, hsa; identical to SEQ ID NO: 316030

SEQ ID NO: 419058 - RNA, 62 nt, hsa; identical to SEQ ID NO: 316031

SEQ ID NO: 419059 - RNA, 62 nt, hsa; identical to SEQ ID NO: 316032

SEQ ID NO: 419060 - RNA, 62 nt, hsa; identical to SEQ ID NO: 316033

SEQ ID NO: 419061 - RNA, 62 nt, hsa; identical to SEQ ID NO: 316034

SEQ ID NO: 419062 - RNA, 62 nt, hsa; identical to SEQ ID NO: 316035

SEQ ID NO: 419063 - RNA, 62 nt, hsa; identical to SEQ ID NO: 316036

SEQ ID NO: 419064 - RNA, 62 nt, hsa; identical to SEQ ID NO: 316037

SEQ ID NO: 419065 - RNA, 62 nt, hsa; identical to SEQ ID NO: 316038

SEQ ID NO: 419066 - RNA, 62 nt, hsa; identical to SEQ ID NO: 316039

SEQ ID NO: 419067 - RNA, 62 nt, hsa; identical to SEQ ID NO: 316040

SEQ ID NO: 419068 - RNA, 62 nt, hsa; identical to SEQ ID NO: 316041

SEQ ID NO: 419069 - RNA, 62 nt, hsa; identical to SEQ ID NO: 316042

SEQ ID NO: 419070 - RNA, 62 nt, hsa; identical to SEQ ID NO: 316043

SEQ ID NO: 419071 - RNA, 62 nt, hsa; identical to SEQ ID NO: 316044

SEQ ID NO: 419072 - RNA, 62 nt, hsa; identical to SEQ ID NO: 316045

SEQ ID NO: 419073 - RNA, 62 nt, hsa; identical to SEQ ID NO: 316046

SEQ ID NO: 419074 - RNA, 62 nt, hsa; identical to SEQ ID NO: 316047

SEQ ID NO: 419075 - RNA, 62 nt, hsa; identical to SEQ ID NO: 316048

SEQ ID NO: 419076 - RNA, 62 nt, hsa; identical to SEQ ID NO: 316049

SEQ ID NO: 419077 - RNA, 62 nt, hsa; identical to SEQ ID NO: 316050

SEQ ID NO: 419078 - RNA, 62 nt, hsa; identical to SEQ ID NO: 316051

SEQ ID NO: 419079 - RNA, 62 nt, hsa; identical to SEQ ID NO: 316052

SEQ ID NO: 419080 - RNA, 62 nt, hsa; identical to SEQ ID NO: 316053

SEQ ID NO: 419081 - RNA, 62 nt, hsa; identical to SEQ ID NO: 316054

SEQ ID NO: 419082 - RNA, 62 nt, hsa; identical to SEQ ID NO: 316055

SEQ ID NO: 419083 - RNA, 62 nt, hsa; identical to SEQ ID NO: 316056

SEQ ID NO: 419084 - RNA, 62 nt, hsa; identical to SEQ ID NO: 316057

SEQ ID NO: 419085 - RNA, 62 nt, hsa; identical to SEQ ID NO: 316058

SEQ ID NO: 419086 - RNA, 62 nt, hsa; identical to SEQ ID NO: 316059

SEQ ID NO: 419087 - RNA, 62 nt, hsa; identical to SEQ ID NO: 316060

SEQ ID NO: 419088 - RNA, 62 nt, hsa; identical to SEQ ID NO: 316061

SEQ ID NO: 419089 - RNA, 60 nt, hsa; identical to SEQ ID NO: 316062

SEQ ID NO: 419090 - RNA, 62 nt, hsa; identical to SEQ ID NO: 316063

SEQ ID NO: 419091 - RNA, 62 nt, hsa; identical to SEQ ID NO: 316055

SEQ ID NO: 419092 - RNA, 62 nt, hsa; identical to SEQ ID NO: 316065

SEQ ID NO: 419093 - RNA, 63 nt, hsa; identical to SEQ ID NO: 316066

SEQ ID NO: 419094 - RNA, 63 nt, hsa; identical to SEQ ID NO: 316067

SEQ ID NO: 419095 - RNA, 63 nt, hsa; identical to SEQ ID NO: 316068

SEQ ID NO: 419096 - RNA, 63 nt, hsa; identical to SEQ ID NO: 316069

SEQ ID NO: 419097 - RNA, 63 nt, hsa; identical to SEQ ID NO: 316070

SEQ ID NO: 419098 - RNA, 63 nt, hsa; identical to SEQ ID NO: 316071

SEQ ID NO: 419099 - RNA, 63 nt, hsa; identical to SEQ ID NO: 316072

SEQ ID NO: 419100 - RNA, 63 nt, hsa; identical to SEQ ID NO: 316073

SEQ ID NO: 419101 - RNA, 63 nt, hsa; identical to SEQ ID NO: 316074

SEQ ID NO: 419102 - RNA, 63 nt, hsa; identical to SEQ ID NO: 316075

SEQ ID NO: 419103 - RNA, 63 nt, hsa; identical to SEQ ID NO: 316076

SEQ ID NO: 419104 - RNA, 63 nt, hsa; identical to SEQ ID NO: 316077

SEQ ID NO: 419105 - RNA, 63 nt, hsa; identical to SEQ ID NO: 316078

SEQ ID NO: 419106 - RNA, 63 nt, hsa; identical to SEQ ID NO: 316079

SEQ ID NO: 419107 - RNA, 63 nt, hsa; identical to SEQ ID NO: 316080

SEQ ID NO: 419108 - RNA, 63 nt, hsa; identical to SEQ ID NO: 316081

SEQ ID NO: 419109 - RNA, 63 nt, hsa; identical to SEQ ID NO: 316082

SEQ ID NO: 419110 - RNA, 63 nt, hsa; identical to SEQ ID NO: 316083

SEQ ID NO: 419111 - RNA, 63 nt, hsa; identical to SEQ ID NO: 316084

SEQ ID NO: 419112 - RNA, 63 nt, hsa; identical to SEQ ID NO: 316085

SEQ ID NO: 419113 - RNA, 63 nt, hsa; identical to SEQ ID NO: 316086

SEQ ID NO: 419114 - RNA, 63 nt, hsa; identical to SEQ ID NO: 316087

SEQ ID NO: 419115 - RNA, 63 nt, hsa; identical to SEQ ID NO: 316088

SEQ ID NO: 419116 - RNA, 63 nt, hsa; identical to SEQ ID NO: 316089

SEQ ID NO: 419117 - RNA, 63 nt, hsa; identical to SEQ ID NO: 316090

SEQ ID NO: 419118 - RNA, 63 nt, hsa; identical to SEQ ID NO: 316091

SEQ ID NO: 419119 - RNA, 63 nt, hsa; identical to SEQ ID NO: 316092

SEQ ID NO: 419120 - RNA, 63 nt, hsa; identical to SEQ ID NO: 316093

SEQ ID NO: 419121 - RNA, 63 nt, hsa; identical to SEQ ID NO: 316094

SEQ ID NO: 419122 - RNA, 63 nt, hsa; identical to SEQ ID NO: 316095

SEQ ID NO: 419123 - RNA, 63 nt, hsa; identical to SEQ ID NO: 316096

SEQ ID NO: 419124 - RNA, 63 nt, hsa; identical to SEQ ID NO: 316097

SEQ ID NO: 419125 - RNA, 63 nt, hsa; identical to SEQ ID NO: 316098

SEQ ID NO: 419126 - RNA, 63 nt, hsa; identical to SEQ ID NO: 316099

SEQ ID NO: 419127 - RNA, 63 nt, hsa; identical to SEQ ID NO: 316100

SEQ ID NO: 419128 - RNA, 63 nt, hsa; identical to SEQ ID NO: 316101

SEQ ID NO: 419129 - RNA, 63 nt, hsa; identical to SEQ ID NO: 316102

SEQ ID NO: 419130 - RNA, 63 nt, hsa; identical to SEQ ID NO: 316103

SEQ ID NO: 419131 - RNA, 63 nt, hsa; identical to SEQ ID NO: 316104

SEQ ID NO: 419132 - RNA, 63 nt, hsa; identical to SEQ ID NO: 316105

SEQ ID NO: 419133 - RNA, 63 nt, hsa; identical to SEQ ID NO: 316106

SEQ ID NO: 419134 - RNA, 63 nt, hsa; identical to SEQ ID NO: 316107

SEQ ID NO: 419135 - RNA, 63 nt, hsa; identical to SEQ ID NO: 316108

SEQ ID NO: 419136 - RNA, 63 nt, hsa; identical to SEQ ID NO: 316109

SEQ ID NO: 419137 - RNA, 63 nt, hsa; identical to SEQ ID NO: 316110

SEQ ID NO: 419138 - RNA, 63 nt, hsa; identical to SEQ ID NO: 316111

SEQ ID NO: 419139 - RNA, 63 nt, hsa; identical to SEQ ID NO: 316112

SEQ ID NO: 419140 - RNA, 63 nt, hsa; identical to SEQ ID NO: 316113

SEQ ID NO: 419141 - RNA, 63 nt, hsa; identical to SEQ ID NO: 316114

SEQ ID NO: 419142 - RNA, 63 nt, hsa; identical to SEQ ID NO: 316115

SEQ ID NO: 419143 - RNA, 63 nt, hsa; identical to SEQ ID NO: 316116

SEQ ID NO: 419144 - RNA, 63 nt, hsa; identical to SEQ ID NO: 316117

SEQ ID NO: 419145 - RNA, 63 nt, hsa; identical to SEQ ID NO: 316118

SEQ ID NO: 419146 - RNA, 63 nt, hsa; identical to SEQ ID NO: 316119

SEQ ID NO: 419147 - RNA, 63 nt, hsa; identical to SEQ ID NO: 316120

SEQ ID NO: 419148 - RNA, 63 nt, hsa; identical to SEQ ID NO: 316121

SEQ ID NO: 419149 - RNA, 63 nt, hsa; identical to SEQ ID NO: 316122

SEQ ID NO: 419150 - RNA, 63 nt, hsa; identical to SEQ ID NO: 316123

SEQ ID NO: 419151 - RNA, 63 nt, hsa; identical to SEQ ID NO: 316124

SEQ ID NO: 419152 - RNA, 63 nt, hsa; identical to SEQ ID NO: 316125

SEQ ID NO: 419153 - RNA, 63 nt, hsa; identical to SEQ ID NO: 316126

SEQ ID NO: 419154 - RNA, 63 nt, hsa; identical to SEQ ID NO: 316127

SEQ ID NO: 419155 - RNA, 63 nt, hsa; identical to SEQ ID NO: 316128

SEQ ID NO: 419156 - RNA, 63 nt, hsa; identical to SEQ ID NO: 316129

SEQ ID NO: 419157 - RNA, 63 nt, hsa; identical to SEQ ID NO: 316130

SEQ ID NO: 419158 - RNA, 63 nt, hsa; identical to SEQ ID NO: 316131

SEQ ID NO: 419159 - RNA, 63 nt, hsa; identical to SEQ ID NO: 316132

SEQ ID NO: 419160 - RNA, 63 nt, hsa; identical to SEQ ID NO: 316133

SEQ ID NO: 419161 - RNA, 63 nt, hsa; identical to SEQ ID NO: 316134

SEQ ID NO: 419162 - RNA, 63 nt, hsa; identical to SEQ ID NO: 316135

SEQ ID NO: 419163 - RNA, 63 nt, hsa; identical to SEQ ID NO: 316136

SEQ ID NO: 419164 - RNA, 63 nt, hsa; identical to SEQ ID NO: 316137

SEQ ID NO: 419165 - RNA, 63 nt, hsa; identical to SEQ ID NO: 316138

SEQ ID NO: 419166 - RNA, 63 nt, hsa; identical to SEQ ID NO: 316139

SEQ ID NO: 419167 - RNA, 63 nt, hsa; identical to SEQ ID NO: 316140

SEQ ID NO: 419168 - RNA, 63 nt, hsa; identical to SEQ ID NO: 316141

SEQ ID NO: 419169 - RNA, 63 nt, hsa; identical to SEQ ID NO: 316142

SEQ ID NO: 419170 - RNA, 63 nt, hsa; identical to SEQ ID NO: 316143

SEQ ID NO: 419171 - RNA, 63 nt, hsa; identical to SEQ ID NO: 316144

SEQ ID NO: 419172 - RNA, 63 nt, hsa; identical to SEQ ID NO: 316145

SEQ ID NO: 419173 - RNA, 63 nt, hsa; identical to SEQ ID NO: 316146

SEQ ID NO: 419174 - RNA, 63 nt, hsa; identical to SEQ ID NO: 316147

SEQ ID NO: 419175 - RNA, 63 nt, hsa; identical to SEQ ID NO: 316148

SEQ ID NO: 419176 - RNA, 63 nt, hsa; identical to SEQ ID NO: 316149

SEQ ID NO: 419177 - RNA, 63 nt, hsa; identical to SEQ ID NO: 316150

SEQ ID NO: 419178 - RNA, 63 nt, hsa; identical to SEQ ID NO: 316150

SEQ ID NO: 419179 - RNA, 63 nt, hsa; identical to SEQ ID NO: 316152

SEQ ID NO: 419180 - RNA, 63 nt, hsa; identical to SEQ ID NO: 316153

SEQ ID NO: 419181 - RNA, 63 nt, hsa; identical to SEQ ID NO: 316154

SEQ ID NO: 419182 - RNA, 63 nt, hsa; identical to SEQ ID NO: 316155

SEQ ID NO: 419183 - RNA, 63 nt, hsa; identical to SEQ ID NO: 316156

SEQ ID NO: 419184 - RNA, 63 nt, hsa; identical to SEQ ID NO: 316157

SEQ ID NO: 419185 - RNA, 63 nt, hsa; identical to SEQ ID NO: 316158

SEQ ID NO: 419186 - RNA, 63 nt, hsa; identical to SEQ ID NO: 316159

SEQ ID NO: 419187 - RNA, 63 nt, hsa; identical to SEQ ID NO: 316160

SEQ ID NO: 419188 - RNA, 63 nt, hsa; identical to SEQ ID NO: 316161

SEQ ID NO: 419189 - RNA, 63 nt, hsa; identical to SEQ ID NO: 316162

SEQ ID NO: 419190 - RNA, 63 nt, hsa; identical to SEQ ID NO: 316163

SEQ ID NO: 419191 - RNA, 63 nt, hsa; identical to SEQ ID NO: 316164

SEQ ID NO: 419192 - RNA, 63 nt, hsa; identical to SEQ ID NO: 316165

SEQ ID NO: 419193 - RNA, 63 nt, hsa; identical to SEQ ID NO: 316166

SEQ ID NO: 419194 - RNA, 63 nt, hsa; identical to SEQ ID NO: 316167

SEQ ID NO: 419195 - RNA, 63 nt, hsa; identical to SEQ ID NO: 316168

SEQ ID NO: 419196 - RNA, 63 nt, hsa; identical to SEQ ID NO: 316169

SEQ ID NO: 419197 - RNA, 63 nt, hsa; identical to SEQ ID NO: 316170

SEQ ID NO: 419198 - RNA, 63 nt, hsa; identical to SEQ ID NO: 316171

SEQ ID NO: 419199 - RNA, 63 nt, hsa; identical to SEQ ID NO: 316172

SEQ ID NO: 419200 - RNA, 63 nt, hsa; identical to SEQ ID NO: 316173

SEQ ID NO: 419201 - RNA, 63 nt, hsa; identical to SEQ ID NO: 316174

SEQ ID NO: 419202 - RNA, 63 nt, hsa; identical to SEQ ID NO: 316175

SEQ ID NO: 419203 - RNA, 63 nt, hsa; identical to SEQ ID NO: 316176

SEQ ID NO: 419204 - RNA, 63 nt, hsa; identical to SEQ ID NO: 316177

SEQ ID NO: 419205 - RNA, 63 nt, hsa; identical to SEQ ID NO: 316178

SEQ ID NO: 419206 - RNA, 63 nt, hsa; identical to SEQ ID NO: 316179

SEQ ID NO: 419207 - RNA, 63 nt, hsa; identical to SEQ ID NO: 316180

SEQ ID NO: 419208 - RNA, 63 nt, hsa; identical to SEQ ID NO: 316181

SEQ ID NO: 419209 - RNA, 63 nt, hsa; identical to SEQ ID NO: 316182

SEQ ID NO: 419210 - RNA, 63 nt, hsa; identical to SEQ ID NO: 316183

SEQ ID NO: 419211 - RNA, 63 nt, hsa; identical to SEQ ID NO: 316184

SEQ ID NO: 419212 - RNA, 63 nt, hsa; identical to SEQ ID NO: 316185

SEQ ID NO: 419213 - RNA, 63 nt, hsa; identical to SEQ ID NO: 316186

SEQ ID NO: 419214 - RNA, 63 nt, hsa; identical to SEQ ID NO: 316187

SEQ ID NO: 419215 - RNA, 63 nt, hsa; identical to SEQ ID NO: 316188

SEQ ID NO: 419216 - RNA, 63 nt, hsa; identical to SEQ ID NO: 316189

SEQ ID NO: 419217 - RNA, 63 nt, hsa; identical to SEQ ID NO: 316190

SEQ ID NO: 419218 - RNA, 63 nt, hsa; identical to SEQ ID NO: 316191

SEQ ID NO: 419219 - RNA, 63 nt, hsa; identical to SEQ ID NO: 316192

SEQ ID NO: 419220 - RNA, 63 nt, hsa; identical to SEQ ID NO: 316193

SEQ ID NO: 419221 - RNA, 63 nt, hsa; identical to SEQ ID NO: 316194

SEQ ID NO: 419222 - RNA, 63 nt, hsa; identical to SEQ ID NO: 316195

SEQ ID NO: 419223 - RNA, 63 nt, hsa; identical to SEQ ID NO: 316196

SEQ ID NO: 419224 - RNA, 63 nt, hsa; identical to SEQ ID NO: 316197

SEQ ID NO: 419225 - RNA, 63 nt, hsa; identical to SEQ ID NO: 316198

SEQ ID NO: 419226 - RNA, 63 nt, hsa; identical to SEQ ID NO: 316199

SEQ ID NO: 419227 - RNA, 63 nt, hsa; identical to SEQ ID NO: 316200

SEQ ID NO: 419228 - RNA, 63 nt, hsa; identical to SEQ ID NO: 316201

SEQ ID NO: 419229 - RNA, 63 nt, hsa; identical to SEQ ID NO: 316202

SEQ ID NO: 419230 - RNA, 63 nt, hsa; identical to SEQ ID NO: 316203

SEQ ID NO: 419231 - RNA, 63 nt, hsa; identical to SEQ ID NO: 316204

SEQ ID NO: 419232 - RNA, 63 nt, hsa; identical to SEQ ID NO: 316205

SEQ ID NO: 419233 - RNA, 63 nt, hsa; identical to SEQ ID NO: 316206

SEQ ID NO: 419234 - RNA, 63 nt, hsa; identical to SEQ ID NO: 316207

SEQ ID NO: 419235 - RNA, 63 nt, hsa; identical to SEQ ID NO: 316208

SEQ ID NO: 419236 - RNA, 63 nt, hsa; identical to SEQ ID NO: 316209

SEQ ID NO: 419237 - RNA, 63 nt, hsa; identical to SEQ ID NO: 316210

SEQ ID NO: 419238 - RNA, 63 nt, hsa; identical to SEQ ID NO: 316211

SEQ ID NO: 419239 - RNA, 63 nt, hsa; identical to SEQ ID NO: 316212

SEQ ID NO: 419240 - RNA, 63 nt, hsa; identical to SEQ ID NO: 316213

SEQ ID NO: 419241 - RNA, 63 nt, hsa; identical to SEQ ID NO: 316214

SEQ ID NO: 419242 - RNA, 63 nt, hsa; identical to SEQ ID NO: 316215

SEQ ID NO: 419243 - RNA, 63 nt, hsa; identical to SEQ ID NO: 316216

SEQ ID NO: 419244 - RNA, 63 nt, hsa; identical to SEQ ID NO: 316217

SEQ ID NO: 419245 - RNA, 63 nt, hsa; identical to SEQ ID NO: 316218

SEQ ID NO: 419246 - RNA, 63 nt, hsa; identical to SEQ ID NO: 316219

SEQ ID NO: 419247 - RNA, 63 nt, hsa; identical to SEQ ID NO: 316220

SEQ ID NO: 419248 - RNA, 63 nt, hsa; identical to SEQ ID NO: 316221

SEQ ID NO: 419249 - RNA, 63 nt, hsa; identical to SEQ ID NO: 316222

SEQ ID NO: 419250 - RNA, 63 nt, hsa; identical to SEQ ID NO: 316223

SEQ ID NO: 419251 - RNA, 63 nt, hsa; identical to SEQ ID NO: 316224

SEQ ID NO: 419252 - RNA, 63 nt, hsa; identical to SEQ ID NO: 316224

SEQ ID NO: 419253 - RNA, 63 nt, hsa; identical to SEQ ID NO: 316226

SEQ ID NO: 419254 - RNA, 63 nt, hsa; identical to SEQ ID NO: 316227

SEQ ID NO: 419255 - RNA, 63 nt, hsa; identical to SEQ ID NO: 316228

SEQ ID NO: 419256 - RNA, 63 nt, hsa; identical to SEQ ID NO: 316229

SEQ ID NO: 419257 - RNA, 63 nt, hsa; identical to SEQ ID NO: 316230

SEQ ID NO: 419258 - RNA, 63 nt, hsa; identical to SEQ ID NO: 316231

SEQ ID NO: 419259 - RNA, 63 nt, hsa; identical to SEQ ID NO: 316232

SEQ ID NO: 419260 - RNA, 63 nt, hsa; identical to SEQ ID NO: 316233

SEQ ID NO: 419261 - RNA, 63 nt, hsa; identical to SEQ ID NO: 316234

SEQ ID NO: 419262 - RNA, 63 nt, hsa; identical to SEQ ID NO: 316235

SEQ ID NO: 419263 - RNA, 63 nt, hsa; identical to SEQ ID NO: 316236

SEQ ID NO: 419264 - RNA, 63 nt, hsa; identical to SEQ ID NO: 316237

SEQ ID NO: 419265 - RNA, 63 nt, hsa; identical to SEQ ID NO: 316238

SEQ ID NO: 419266 - RNA, 63 nt, hsa; identical to SEQ ID NO: 316239

SEQ ID NO: 419267 - RNA, 63 nt, hsa; identical to SEQ ID NO: 316240

SEQ ID NO: 419268 - RNA, 63 nt, hsa; identical to SEQ ID NO: 316241

SEQ ID NO: 419269 - RNA, 63 nt, hsa; identical to SEQ ID NO: 316242

SEQ ID NO: 419270 - RNA, 63 nt, hsa; identical to SEQ ID NO: 316243

SEQ ID NO: 419271 - RNA, 63 nt, hsa; identical to SEQ ID NO: 316244

SEQ ID NO: 419272 - RNA, 63 nt, hsa; identical to SEQ ID NO: 316245

SEQ ID NO: 419273 - RNA, 63 nt, hsa; identical to SEQ ID NO: 316246

SEQ ID NO: 419274 - RNA, 63 nt, hsa; identical to SEQ ID NO: 316247

SEQ ID NO: 419275 - RNA, 63 nt, hsa; identical to SEQ ID NO: 316248

SEQ ID NO: 419276 - RNA, 63 nt, hsa; identical to SEQ ID NO: 316249

SEQ ID NO: 419277 - RNA, 63 nt, hsa; identical to SEQ ID NO: 316250

SEQ ID NO: 419278 - RNA, 63 nt, hsa; identical to SEQ ID NO: 316251

SEQ ID NO: 419279 - RNA, 63 nt, hsa; identical to SEQ ID NO: 316252

SEQ ID NO: 419280 - RNA, 63 nt, hsa; identical to SEQ ID NO: 316253

SEQ ID NO: 419281 - RNA, 63 nt, hsa; identical to SEQ ID NO: 316254

SEQ ID NO: 419282 - RNA, 63 nt, hsa; identical to SEQ ID NO: 316255

SEQ ID NO: 419283 - RNA, 63 nt, hsa; identical to SEQ ID NO: 316256

SEQ ID NO: 419284 - RNA, 63 nt, hsa; identical to SEQ ID NO: 316257

SEQ ID NO: 419285 - RNA, 63 nt, hsa; identical to SEQ ID NO: 316258

SEQ ID NO: 419286 - RNA, 61 nt, hsa; identical to SEQ ID NO: 316259

SEQ ID NO: 419287 - RNA, 63 nt, hsa; identical to SEQ ID NO: 316260

SEQ ID NO: 419288 - RNA, 63 nt, hsa; identical to SEQ ID NO: 316252

SEQ ID NO: 419289 - RNA, 63 nt, hsa; identical to SEQ ID NO: 316262

SEQ ID NO: 419290 - RNA, 64 nt, hsa; identical to SEQ ID NO: 316263

SEQ ID NO: 419291 - RNA, 64 nt, hsa; identical to SEQ ID NO: 316264

SEQ ID NO: 419292 - RNA, 64 nt, hsa; identical to SEQ ID NO: 316265

SEQ ID NO: 419293 - RNA, 64 nt, hsa; identical to SEQ ID NO: 316266

SEQ ID NO: 419294 - RNA, 64 nt, hsa; identical to SEQ ID NO: 316267

SEQ ID NO: 419295 - RNA, 64 nt, hsa; identical to SEQ ID NO: 316268

SEQ ID NO: 419296 - RNA, 64 nt, hsa; identical to SEQ ID NO: 316269

SEQ ID NO: 419297 - RNA, 64 nt, hsa; identical to SEQ ID NO: 316270

SEQ ID NO: 419298 - RNA, 64 nt, hsa; identical to SEQ ID NO: 316271

SEQ ID NO: 419299 - RNA, 64 nt, hsa; identical to SEQ ID NO: 316272

SEQ ID NO: 419300 - RNA, 64 nt, hsa; identical to SEQ ID NO: 316273

SEQ ID NO: 419301 - RNA, 64 nt, hsa; identical to SEQ ID NO: 316274

SEQ ID NO: 419302 - RNA, 64 nt, hsa; identical to SEQ ID NO: 316275

SEQ ID NO: 419303 - RNA, 64 nt, hsa; identical to SEQ ID NO: 316276

SEQ ID NO: 419304 - RNA, 64 nt, hsa; identical to SEQ ID NO: 316277

SEQ ID NO: 419305 - RNA, 64 nt, hsa; identical to SEQ ID NO: 316278

SEQ ID NO: 419306 - RNA, 64 nt, hsa; identical to SEQ ID NO: 316279

SEQ ID NO: 419307 - RNA, 64 nt, hsa; identical to SEQ ID NO: 316280

SEQ ID NO: 419308 - RNA, 64 nt, hsa; identical to SEQ ID NO: 316281

SEQ ID NO: 419309 - RNA, 64 nt, hsa; identical to SEQ ID NO: 316282

SEQ ID NO: 419310 - RNA, 64 nt, hsa; identical to SEQ ID NO: 316283

SEQ ID NO: 419311 - RNA, 64 nt, hsa; identical to SEQ ID NO: 316284

SEQ ID NO: 419312 - RNA, 64 nt, hsa; identical to SEQ ID NO: 316285

SEQ ID NO: 419313 - RNA, 64 nt, hsa; identical to SEQ ID NO: 316286

SEQ ID NO: 419314 - RNA, 64 nt, hsa; identical to SEQ ID NO: 316287

SEQ ID NO: 419315 - RNA, 64 nt, hsa; identical to SEQ ID NO: 316288

SEQ ID NO: 419316 - RNA, 64 nt, hsa; identical to SEQ ID NO: 316289

SEQ ID NO: 419317 - RNA, 64 nt, hsa; identical to SEQ ID NO: 316290

SEQ ID NO: 419318 - RNA, 64 nt, hsa; identical to SEQ ID NO: 316291

SEQ ID NO: 419319 - RNA, 64 nt, hsa; identical to SEQ ID NO: 316292

SEQ ID NO: 419320 - RNA, 64 nt, hsa; identical to SEQ ID NO: 316293

SEQ ID NO: 419321 - RNA, 64 nt, hsa; identical to SEQ ID NO: 316294

SEQ ID NO: 419322 - RNA, 64 nt, hsa; identical to SEQ ID NO: 316295

SEQ ID NO: 419323 - RNA, 64 nt, hsa; identical to SEQ ID NO: 316296

SEQ ID NO: 419324 - RNA, 64 nt, hsa; identical to SEQ ID NO: 316297

SEQ ID NO: 419325 - RNA, 64 nt, hsa; identical to SEQ ID NO: 316298

SEQ ID NO: 419326 - RNA, 64 nt, hsa; identical to SEQ ID NO: 316299

SEQ ID NO: 419327 - RNA, 64 nt, hsa; identical to SEQ ID NO: 316300

SEQ ID NO: 419328 - RNA, 64 nt, hsa; identical to SEQ ID NO: 316301

SEQ ID NO: 419329 - RNA, 64 nt, hsa; identical to SEQ ID NO: 316302

SEQ ID NO: 419330 - RNA, 64 nt, hsa; identical to SEQ ID NO: 316303

SEQ ID NO: 419331 - RNA, 64 nt, hsa; identical to SEQ ID NO: 316304

SEQ ID NO: 419332 - RNA, 64 nt, hsa; identical to SEQ ID NO: 316305

SEQ ID NO: 419333 - RNA, 64 nt, hsa; identical to SEQ ID NO: 316306

SEQ ID NO: 419334 - RNA, 64 nt, hsa; identical to SEQ ID NO: 316307

SEQ ID NO: 419335 - RNA, 64 nt, hsa; identical to SEQ ID NO: 316308

SEQ ID NO: 419336 - RNA, 64 nt, hsa; identical to SEQ ID NO: 316309

SEQ ID NO: 419337 - RNA, 64 nt, hsa; identical to SEQ ID NO: 316310

SEQ ID NO: 419338 - RNA, 64 nt, hsa; identical to SEQ ID NO: 316311

SEQ ID NO: 419339 - RNA, 64 nt, hsa; identical to SEQ ID NO: 316312

SEQ ID NO: 419340 - RNA, 64 nt, hsa; identical to SEQ ID NO: 316313

SEQ ID NO: 419341 - RNA, 64 nt, hsa; identical to SEQ ID NO: 316314

SEQ ID NO: 419342 - RNA, 64 nt, hsa; identical to SEQ ID NO: 316315

SEQ ID NO: 419343 - RNA, 64 nt, hsa; identical to SEQ ID NO: 316316

SEQ ID NO: 419344 - RNA, 64 nt, hsa; identical to SEQ ID NO: 316317

SEQ ID NO: 419345 - RNA, 64 nt, hsa; identical to SEQ ID NO: 316318

SEQ ID NO: 419346 - RNA, 64 nt, hsa; identical to SEQ ID NO: 316319

SEQ ID NO: 419347 - RNA, 64 nt, hsa; identical to SEQ ID NO: 316320

SEQ ID NO: 419348 - RNA, 64 nt, hsa; identical to SEQ ID NO: 316321

SEQ ID NO: 419349 - RNA, 64 nt, hsa; identical to SEQ ID NO: 316322

SEQ ID NO: 419350 - RNA, 64 nt, hsa; identical to SEQ ID NO: 316323

SEQ ID NO: 419351 - RNA, 64 nt, hsa; identical to SEQ ID NO: 316324

SEQ ID NO: 419352 - RNA, 64 nt, hsa; identical to SEQ ID NO: 316325

SEQ ID NO: 419353 - RNA, 64 nt, hsa; identical to SEQ ID NO: 316326

SEQ ID NO: 419354 - RNA, 64 nt, hsa; identical to SEQ ID NO: 316327

SEQ ID NO: 419355 - RNA, 64 nt, hsa; identical to SEQ ID NO: 316328

SEQ ID NO: 419356 - RNA, 64 nt, hsa; identical to SEQ ID NO: 316329

SEQ ID NO: 419357 - RNA, 64 nt, hsa; identical to SEQ ID NO: 316330

SEQ ID NO: 419358 - RNA, 64 nt, hsa; identical to SEQ ID NO: 316331

SEQ ID NO: 419359 - RNA, 64 nt, hsa; identical to SEQ ID NO: 316332

SEQ ID NO: 419360 - RNA, 64 nt, hsa; identical to SEQ ID NO: 316333

SEQ ID NO: 419361 - RNA, 64 nt, hsa; identical to SEQ ID NO: 316334

SEQ ID NO: 419362 - RNA, 64 nt, hsa; identical to SEQ ID NO: 316335

SEQ ID NO: 419363 - RNA, 64 nt, hsa; identical to SEQ ID NO: 316336

SEQ ID NO: 419364 - RNA, 64 nt, hsa; identical to SEQ ID NO: 316337

SEQ ID NO: 419365 - RNA, 64 nt, hsa; identical to SEQ ID NO: 316338

SEQ ID NO: 419366 - RNA, 64 nt, hsa; identical to SEQ ID NO: 316339

SEQ ID NO: 419367 - RNA, 64 nt, hsa; identical to SEQ ID NO: 316340

SEQ ID NO: 419368 - RNA, 64 nt, hsa; identical to SEQ ID NO: 316341

SEQ ID NO: 419369 - RNA, 64 nt, hsa; identical to SEQ ID NO: 316342

SEQ ID NO: 419370 - RNA, 64 nt, hsa; identical to SEQ ID NO: 316343

SEQ ID NO: 419371 - RNA, 64 nt, hsa; identical to SEQ ID NO: 316344

SEQ ID NO: 419372 - RNA, 64 nt, hsa; identical to SEQ ID NO: 316345

SEQ ID NO: 419373 - RNA, 64 nt, hsa; identical to SEQ ID NO: 316346

SEQ ID NO: 419374 - RNA, 64 nt, hsa; identical to SEQ ID NO: 316347

SEQ ID NO: 419375 - RNA, 64 nt, hsa; identical to SEQ ID NO: 316347

SEQ ID NO: 419376 - RNA, 64 nt, hsa; identical to SEQ ID NO: 316349

SEQ ID NO: 419377 - RNA, 64 nt, hsa; identical to SEQ ID NO: 316350

SEQ ID NO: 419378 - RNA, 64 nt, hsa; identical to SEQ ID NO: 316351

SEQ ID NO: 419379 - RNA, 64 nt, hsa; identical to SEQ ID NO: 316352

SEQ ID NO: 419380 - RNA, 64 nt, hsa; identical to SEQ ID NO: 316353

SEQ ID NO: 419381 - RNA, 64 nt, hsa; identical to SEQ ID NO: 316354

SEQ ID NO: 419382 - RNA, 64 nt, hsa; identical to SEQ ID NO: 316355

SEQ ID NO: 419383 - RNA, 64 nt, hsa; identical to SEQ ID NO: 316356

SEQ ID NO: 419384 - RNA, 64 nt, hsa; identical to SEQ ID NO: 316357

SEQ ID NO: 419385 - RNA, 64 nt, hsa; identical to SEQ ID NO: 316358

SEQ ID NO: 419386 - RNA, 64 nt, hsa; identical to SEQ ID NO: 316359

SEQ ID NO: 419387 - RNA, 64 nt, hsa; identical to SEQ ID NO: 316360

SEQ ID NO: 419388 - RNA, 64 nt, hsa; identical to SEQ ID NO: 316361

SEQ ID NO: 419389 - RNA, 64 nt, hsa; identical to SEQ ID NO: 316362

SEQ ID NO: 419390 - RNA, 64 nt, hsa; identical to SEQ ID NO: 316363

SEQ ID NO: 419391 - RNA, 64 nt, hsa; identical to SEQ ID NO: 316364

SEQ ID NO: 419392 - RNA, 64 nt, hsa; identical to SEQ ID NO: 316365

SEQ ID NO: 419393 - RNA, 64 nt, hsa; identical to SEQ ID NO: 316366

SEQ ID NO: 419394 - RNA, 64 nt, hsa; identical to SEQ ID NO: 316367

SEQ ID NO: 419395 - RNA, 64 nt, hsa; identical to SEQ ID NO: 316368

SEQ ID NO: 419396 - RNA, 64 nt, hsa; identical to SEQ ID NO: 316369

SEQ ID NO: 419397 - RNA, 64 nt, hsa; identical to SEQ ID NO: 316370

SEQ ID NO: 419398 - RNA, 64 nt, hsa; identical to SEQ ID NO: 316371

SEQ ID NO: 419399 - RNA, 64 nt, hsa; identical to SEQ ID NO: 316372

SEQ ID NO: 419400 - RNA, 64 nt, hsa; identical to SEQ ID NO: 316373

SEQ ID NO: 419401 - RNA, 64 nt, hsa; identical to SEQ ID NO: 316374

SEQ ID NO: 419402 - RNA, 64 nt, hsa; identical to SEQ ID NO: 316375

SEQ ID NO: 419403 - RNA, 64 nt, hsa; identical to SEQ ID NO: 316376

SEQ ID NO: 419404 - RNA, 64 nt, hsa; identical to SEQ ID NO: 316377

SEQ ID NO: 419405 - RNA, 64 nt, hsa; identical to SEQ ID NO: 316378

SEQ ID NO: 419406 - RNA, 64 nt, hsa; identical to SEQ ID NO: 316379

SEQ ID NO: 419407 - RNA, 64 nt, hsa; identical to SEQ ID NO: 316380

SEQ ID NO: 419408 - RNA, 64 nt, hsa; identical to SEQ ID NO: 316381

SEQ ID NO: 419409 - RNA, 64 nt, hsa; identical to SEQ ID NO: 316382

SEQ ID NO: 419410 - RNA, 64 nt, hsa; identical to SEQ ID NO: 316383

SEQ ID NO: 419411 - RNA, 64 nt, hsa; identical to SEQ ID NO: 316384

SEQ ID NO: 419412 - RNA, 64 nt, hsa; identical to SEQ ID NO: 316385

SEQ ID NO: 419413 - RNA, 64 nt, hsa; identical to SEQ ID NO: 316386

SEQ ID NO: 419414 - RNA, 64 nt, hsa; identical to SEQ ID NO: 316387

SEQ ID NO: 419415 - RNA, 64 nt, hsa; identical to SEQ ID NO: 316388

SEQ ID NO: 419416 - RNA, 64 nt, hsa; identical to SEQ ID NO: 316389

SEQ ID NO: 419417 - RNA, 64 nt, hsa; identical to SEQ ID NO: 316390

SEQ ID NO: 419418 - RNA, 64 nt, hsa; identical to SEQ ID NO: 316391

SEQ ID NO: 419419 - RNA, 64 nt, hsa; identical to SEQ ID NO: 316392

SEQ ID NO: 419420 - RNA, 64 nt, hsa; identical to SEQ ID NO: 316393

SEQ ID NO: 419421 - RNA, 64 nt, hsa; identical to SEQ ID NO: 316394

SEQ ID NO: 419422 - RNA, 64 nt, hsa; identical to SEQ ID NO: 316395

SEQ ID NO: 419423 - RNA, 64 nt, hsa; identical to SEQ ID NO: 316396

SEQ ID NO: 419424 - RNA, 64 nt, hsa; identical to SEQ ID NO: 316397

SEQ ID NO: 419425 - RNA, 64 nt, hsa; identical to SEQ ID NO: 316398

SEQ ID NO: 419426 - RNA, 64 nt, hsa; identical to SEQ ID NO: 316399

SEQ ID NO: 419427 - RNA, 64 nt, hsa; identical to SEQ ID NO: 316400

SEQ ID NO: 419428 - RNA, 64 nt, hsa; identical to SEQ ID NO: 316401

SEQ ID NO: 419429 - RNA, 64 nt, hsa; identical to SEQ ID NO: 316402

SEQ ID NO: 419430 - RNA, 64 nt, hsa; identical to SEQ ID NO: 316403

SEQ ID NO: 419431 - RNA, 64 nt, hsa; identical to SEQ ID NO: 316404

SEQ ID NO: 419432 - RNA, 64 nt, hsa; identical to SEQ ID NO: 316405

SEQ ID NO: 419433 - RNA, 64 nt, hsa; identical to SEQ ID NO: 316406

SEQ ID NO: 419434 - RNA, 64 nt, hsa; identical to SEQ ID NO: 316407

SEQ ID NO: 419435 - RNA, 64 nt, hsa; identical to SEQ ID NO: 316408

SEQ ID NO: 419436 - RNA, 64 nt, hsa; identical to SEQ ID NO: 316409

SEQ ID NO: 419437 - RNA, 64 nt, hsa; identical to SEQ ID NO: 316410

SEQ ID NO: 419438 - RNA, 64 nt, hsa; identical to SEQ ID NO: 316411

SEQ ID NO: 419439 - RNA, 64 nt, hsa; identical to SEQ ID NO: 316412

SEQ ID NO: 419440 - RNA, 64 nt, hsa; identical to SEQ ID NO: 316413

SEQ ID NO: 419441 - RNA, 64 nt, hsa; identical to SEQ ID NO: 316414

SEQ ID NO: 419442 - RNA, 64 nt, hsa; identical to SEQ ID NO: 316415

SEQ ID NO: 419443 - RNA, 64 nt, hsa; identical to SEQ ID NO: 316416

SEQ ID NO: 419444 - RNA, 64 nt, hsa; identical to SEQ ID NO: 316417

SEQ ID NO: 419445 - RNA, 64 nt, hsa; identical to SEQ ID NO: 316418

SEQ ID NO: 419446 - RNA, 64 nt, hsa; identical to SEQ ID NO: 316419

SEQ ID NO: 419447 - RNA, 64 nt, hsa; identical to SEQ ID NO: 316420

SEQ ID NO: 419448 - RNA, 64 nt, hsa; identical to SEQ ID NO: 316421

SEQ ID NO: 419449 - RNA, 64 nt, hsa; identical to SEQ ID NO: 316421

SEQ ID NO: 419450 - RNA, 64 nt, hsa; identical to SEQ ID NO: 316423

SEQ ID NO: 419451 - RNA, 64 nt, hsa; identical to SEQ ID NO: 316424

SEQ ID NO: 419452 - RNA, 64 nt, hsa; identical to SEQ ID NO: 316425

SEQ ID NO: 419453 - RNA, 64 nt, hsa; identical to SEQ ID NO: 316426

SEQ ID NO: 419454 - RNA, 64 nt, hsa; identical to SEQ ID NO: 316427

SEQ ID NO: 419455 - RNA, 64 nt, hsa; identical to SEQ ID NO: 316428

SEQ ID NO: 419456 - RNA, 64 nt, hsa; identical to SEQ ID NO: 316429

SEQ ID NO: 419457 - RNA, 64 nt, hsa; identical to SEQ ID NO: 316430

SEQ ID NO: 419458 - RNA, 64 nt, hsa; identical to SEQ ID NO: 316431

SEQ ID NO: 419459 - RNA, 64 nt, hsa; identical to SEQ ID NO: 316432

SEQ ID NO: 419460 - RNA, 64 nt, hsa; identical to SEQ ID NO: 316433

SEQ ID NO: 419461 - RNA, 64 nt, hsa; identical to SEQ ID NO: 316434

SEQ ID NO: 419462 - RNA, 64 nt, hsa; identical to SEQ ID NO: 316435

SEQ ID NO: 419463 - RNA, 64 nt, hsa; identical to SEQ ID NO: 316436

SEQ ID NO: 419464 - RNA, 64 nt, hsa; identical to SEQ ID NO: 316437

SEQ ID NO: 419465 - RNA, 64 nt, hsa; identical to SEQ ID NO: 316438

SEQ ID NO: 419466 - RNA, 64 nt, hsa; identical to SEQ ID NO: 316439

SEQ ID NO: 419467 - RNA, 64 nt, hsa; identical to SEQ ID NO: 316440

SEQ ID NO: 419468 - RNA, 64 nt, hsa; identical to SEQ ID NO: 316441

SEQ ID NO: 419469 - RNA, 64 nt, hsa; identical to SEQ ID NO: 316442

SEQ ID NO: 419470 - RNA, 64 nt, hsa; identical to SEQ ID NO: 316443

SEQ ID NO: 419471 - RNA, 64 nt, hsa; identical to SEQ ID NO: 316444

SEQ ID NO: 419472 - RNA, 64 nt, hsa; identical to SEQ ID NO: 316445

SEQ ID NO: 419473 - RNA, 64 nt, hsa; identical to SEQ ID NO: 316446

SEQ ID NO: 419474 - RNA, 64 nt, hsa; identical to SEQ ID NO: 316447

SEQ ID NO: 419475 - RNA, 64 nt, hsa; identical to SEQ ID NO: 316448

SEQ ID NO: 419476 - RNA, 64 nt, hsa; identical to SEQ ID NO: 316449

SEQ ID NO: 419477 - RNA, 64 nt, hsa; identical to SEQ ID NO: 316450

SEQ ID NO: 419478 - RNA, 64 nt, hsa; identical to SEQ ID NO: 316451

SEQ ID NO: 419479 - RNA, 64 nt, hsa; identical to SEQ ID NO: 316452

SEQ ID NO: 419480 - RNA, 64 nt, hsa; identical to SEQ ID NO: 316453

SEQ ID NO: 419481 - RNA, 64 nt, hsa; identical to SEQ ID NO: 316454

SEQ ID NO: 419482 - RNA, 64 nt, hsa; identical to SEQ ID NO: 316455

SEQ ID NO: 419483 - RNA, 62 nt, hsa; identical to SEQ ID NO: 316456

SEQ ID NO: 419484 - RNA, 64 nt, hsa; identical to SEQ ID NO: 316457

SEQ ID NO: 419485 - RNA, 64 nt, hsa; identical to SEQ ID NO: 316449

SEQ ID NO: 419486 - RNA, 64 nt, hsa; identical to SEQ ID NO: 316459

SEQ ID NO: 419487 - RNA, 61 nt, hsa; identical to SEQ ID NO: 316460

SEQ ID NO: 419488 - RNA, 61 nt, hsa; identical to SEQ ID NO: 316461

SEQ ID NO: 419489 - RNA, 61 nt, hsa; identical to SEQ ID NO: 316462

SEQ ID NO: 419490 - RNA, 61 nt, hsa; identical to SEQ ID NO: 316463

SEQ ID NO: 419491 - RNA, 61 nt, hsa; identical to SEQ ID NO: 316464

SEQ ID NO: 419492 - RNA, 61 nt, hsa; identical to SEQ ID NO: 316465

SEQ ID NO: 419493 - RNA, 61 nt, hsa; identical to SEQ ID NO: 316466

SEQ ID NO: 419494 - RNA, 61 nt, hsa; identical to SEQ ID NO: 316467

SEQ ID NO: 419495 - RNA, 61 nt, hsa; identical to SEQ ID NO: 316468

SEQ ID NO: 419496 - RNA, 61 nt, hsa; identical to SEQ ID NO: 316469

SEQ ID NO: 419497 - RNA, 61 nt, hsa; identical to SEQ ID NO: 316470

SEQ ID NO: 419498 - RNA, 61 nt, hsa; identical to SEQ ID NO: 316471

SEQ ID NO: 419499 - RNA, 61 nt, hsa; identical to SEQ ID NO: 316472

SEQ ID NO: 419500 - RNA, 61 nt, hsa; identical to SEQ ID NO: 316473

SEQ ID NO: 419501 - RNA, 61 nt, hsa; identical to SEQ ID NO: 316474

SEQ ID NO: 419502 - RNA, 55 nt, hsa; identical to SEQ ID NO: 316475

SEQ ID NO: 419503 - RNA, 61 nt, hsa; identical to SEQ ID NO: 316476

SEQ ID NO: 419504 - RNA, 61 nt, hsa; identical to SEQ ID NO: 316477

SEQ ID NO: 419505 - RNA, 61 nt, hsa; identical to SEQ ID NO: 316478

SEQ ID NO: 419506 - RNA, 61 nt, hsa; identical to SEQ ID NO: 316479

SEQ ID NO: 419507 - RNA, 61 nt, hsa; identical to SEQ ID NO: 316480

SEQ ID NO: 419508 - RNA, 61 nt, hsa; identical to SEQ ID NO: 316481

SEQ ID NO: 419509 - RNA, 61 nt, hsa; identical to SEQ ID NO: 316482

SEQ ID NO: 419510 - RNA, 61 nt, hsa; identical to SEQ ID NO: 316483

SEQ ID NO: 419511 - RNA, 61 nt, hsa; identical to SEQ ID NO: 316484

SEQ ID NO: 419512 - RNA, 61 nt, hsa; identical to SEQ ID NO: 316485

SEQ ID NO: 419513 - RNA, 61 nt, hsa; identical to SEQ ID NO: 316486

SEQ ID NO: 419514 - RNA, 61 nt, hsa; identical to SEQ ID NO: 316487

SEQ ID NO: 419515 - RNA, 61 nt, hsa; identical to SEQ ID NO: 316488

SEQ ID NO: 419516 - RNA, 61 nt, hsa; identical to SEQ ID NO: 316489

SEQ ID NO: 419517 - RNA, 61 nt, hsa; identical to SEQ ID NO: 316490

SEQ ID NO: 419518 - RNA, 61 nt, hsa; identical to SEQ ID NO: 316491

SEQ ID NO: 419519 - RNA, 61 nt, hsa; identical to SEQ ID NO: 316492

SEQ ID NO: 419520 - RNA, 61 nt, hsa; identical to SEQ ID NO: 316493

SEQ ID NO: 419521 - RNA, 61 nt, hsa; identical to SEQ ID NO: 316494

SEQ ID NO: 419522 - RNA, 61 nt, hsa; identical to SEQ ID NO: 316495

SEQ ID NO: 419523 - RNA, 61 nt, hsa; identical to SEQ ID NO: 316496

SEQ ID NO: 419524 - RNA, 61 nt, hsa; identical to SEQ ID NO: 316497

SEQ ID NO: 419525 - RNA, 61 nt, hsa; identical to SEQ ID NO: 316498

SEQ ID NO: 419526 - RNA, 61 nt, hsa; identical to SEQ ID NO: 316499

SEQ ID NO: 419527 - RNA, 61 nt, hsa; identical to SEQ ID NO: 316500

SEQ ID NO: 419528 - RNA, 61 nt, hsa; identical to SEQ ID NO: 316501

SEQ ID NO: 419529 - RNA, 61 nt, hsa; identical to SEQ ID NO: 316502

SEQ ID NO: 419530 - RNA, 61 nt, hsa; identical to SEQ ID NO: 316503

SEQ ID NO: 419531 - RNA, 61 nt, hsa; identical to SEQ ID NO: 316504

SEQ ID NO: 419532 - RNA, 61 nt, hsa; identical to SEQ ID NO: 316505

SEQ ID NO: 419533 - RNA, 61 nt, hsa; identical to SEQ ID NO: 316506

SEQ ID NO: 419534 - RNA, 61 nt, hsa; identical to SEQ ID NO: 316507

SEQ ID NO: 419535 - RNA, 61 nt, hsa; identical to SEQ ID NO: 316508

SEQ ID NO: 419536 - RNA, 61 nt, hsa; identical to SEQ ID NO: 316509

SEQ ID NO: 419537 - RNA, 61 nt, hsa; identical to SEQ ID NO: 316510

SEQ ID NO: 419538 - RNA, 61 nt, hsa; identical to SEQ ID NO: 316511

SEQ ID NO: 419539 - RNA, 61 nt, hsa; identical to SEQ ID NO: 316512

SEQ ID NO: 419540 - RNA, 61 nt, hsa; identical to SEQ ID NO: 316513

SEQ ID NO: 419541 - RNA, 61 nt, hsa; identical to SEQ ID NO: 316514

SEQ ID NO: 419542 - RNA, 61 nt, hsa; identical to SEQ ID NO: 316515

SEQ ID NO: 419543 - RNA, 61 nt, hsa; identical to SEQ ID NO: 316516

SEQ ID NO: 419544 - RNA, 61 nt, hsa; identical to SEQ ID NO: 316517

SEQ ID NO: 419545 - RNA, 61 nt, hsa; identical to SEQ ID NO: 316518

SEQ ID NO: 419546 - RNA, 61 nt, hsa; identical to SEQ ID NO: 316519

SEQ ID NO: 419547 - RNA, 61 nt, hsa; identical to SEQ ID NO: 316520

SEQ ID NO: 419548 - RNA, 61 nt, hsa; identical to SEQ ID NO: 316521

SEQ ID NO: 419549 - RNA, 61 nt, hsa; identical to SEQ ID NO: 316522

SEQ ID NO: 419550 - RNA, 61 nt, hsa; identical to SEQ ID NO: 316523

SEQ ID NO: 419551 - RNA, 61 nt, hsa; identical to SEQ ID NO: 316524

SEQ ID NO: 419552 - RNA, 61 nt, hsa; identical to SEQ ID NO: 316525

SEQ ID NO: 419553 - RNA, 61 nt, hsa; identical to SEQ ID NO: 316526

SEQ ID NO: 419554 - RNA, 61 nt, hsa; identical to SEQ ID NO: 316527

SEQ ID NO: 419555 - RNA, 61 nt, hsa; identical to SEQ ID NO: 316528

SEQ ID NO: 419556 - RNA, 61 nt, hsa; identical to SEQ ID NO: 316529

SEQ ID NO: 419557 - RNA, 61 nt, hsa; identical to SEQ ID NO: 316530

SEQ ID NO: 419558 - RNA, 61 nt, hsa; identical to SEQ ID NO: 316531

SEQ ID NO: 419559 - RNA, 61 nt, hsa; identical to SEQ ID NO: 316532

SEQ ID NO: 419560 - RNA, 61 nt, hsa; identical to SEQ ID NO: 316533

SEQ ID NO: 419561 - RNA, 61 nt, hsa; identical to SEQ ID NO: 316534

SEQ ID NO: 419562 - RNA, 61 nt, hsa; identical to SEQ ID NO: 316535

SEQ ID NO: 419563 - RNA, 61 nt, hsa; identical to SEQ ID NO: 316536

SEQ ID NO: 419564 - RNA, 61 nt, hsa; identical to SEQ ID NO: 316537

SEQ ID NO: 419565 - RNA, 61 nt, hsa; identical to SEQ ID NO: 316538

SEQ ID NO: 419566 - RNA, 61 nt, hsa; identical to SEQ ID NO: 316539

SEQ ID NO: 419567 - RNA, 61 nt, hsa; identical to SEQ ID NO: 316540

SEQ ID NO: 419568 - RNA, 61 nt, hsa; identical to SEQ ID NO: 316541

SEQ ID NO: 419569 - RNA, 61 nt, hsa; identical to SEQ ID NO: 316542

SEQ ID NO: 419570 - RNA, 61 nt, hsa; identical to SEQ ID NO: 316543

SEQ ID NO: 419571 - RNA, 61 nt, hsa; identical to SEQ ID NO: 316544

SEQ ID NO: 419572 - RNA, 61 nt, hsa; identical to SEQ ID NO: 316545

SEQ ID NO: 419573 - RNA, 61 nt, hsa; identical to SEQ ID NO: 316546

SEQ ID NO: 419574 - RNA, 61 nt, hsa; identical to SEQ ID NO: 316547

SEQ ID NO: 419575 - RNA, 61 nt, hsa; identical to SEQ ID NO: 316548

SEQ ID NO: 419576 - RNA, 61 nt, hsa; identical to SEQ ID NO: 316549

SEQ ID NO: 419577 - RNA, 61 nt, hsa; identical to SEQ ID NO: 316550

SEQ ID NO: 419578 - RNA, 61 nt, hsa; identical to SEQ ID NO: 316551

SEQ ID NO: 419579 - RNA, 61 nt, hsa; identical to SEQ ID NO: 316552

SEQ ID NO: 419580 - RNA, 61 nt, hsa; identical to SEQ ID NO: 316553

SEQ ID NO: 419581 - RNA, 61 nt, hsa; identical to SEQ ID NO: 316554

SEQ ID NO: 419582 - RNA, 61 nt, hsa; identical to SEQ ID NO: 316555

SEQ ID NO: 419583 - RNA, 61 nt, hsa; identical to SEQ ID NO: 316556

SEQ ID NO: 419584 - RNA, 61 nt, hsa; identical to SEQ ID NO: 316557

SEQ ID NO: 419585 - RNA, 61 nt, hsa; identical to SEQ ID NO: 316558

SEQ ID NO: 419586 - RNA, 61 nt, hsa; identical to SEQ ID NO: 316559

SEQ ID NO: 419587 - RNA, 61 nt, hsa; identical to SEQ ID NO: 316560

SEQ ID NO: 419588 - RNA, 61 nt, hsa; identical to SEQ ID NO: 316561

SEQ ID NO: 419589 - RNA, 61 nt, hsa; identical to SEQ ID NO: 316562

SEQ ID NO: 419590 - RNA, 61 nt, hsa; identical to SEQ ID NO: 316563

SEQ ID NO: 419591 - RNA, 61 nt, hsa; identical to SEQ ID NO: 316564

SEQ ID NO: 419592 - RNA, 61 nt, hsa; identical to SEQ ID NO: 316565

SEQ ID NO: 419593 - RNA, 61 nt, hsa; identical to SEQ ID NO: 316566

SEQ ID NO: 419594 - RNA, 61 nt, hsa; identical to SEQ ID NO: 316567

SEQ ID NO: 419595 - RNA, 61 nt, hsa; identical to SEQ ID NO: 316568

SEQ ID NO: 419596 - RNA, 61 nt, hsa; identical to SEQ ID NO: 316569

SEQ ID NO: 419597 - RNA, 61 nt, hsa; identical to SEQ ID NO: 316570

SEQ ID NO: 419598 - RNA, 61 nt, hsa; identical to SEQ ID NO: 316571

SEQ ID NO: 419599 - RNA, 61 nt, hsa; identical to SEQ ID NO: 316572

SEQ ID NO: 419600 - RNA, 61 nt, hsa; identical to SEQ ID NO: 316573

SEQ ID NO: 419601 - RNA, 61 nt, hsa; identical to SEQ ID NO: 316574

SEQ ID NO: 419602 - RNA, 61 nt, hsa; identical to SEQ ID NO: 316575

SEQ ID NO: 419603 - RNA, 61 nt, hsa; identical to SEQ ID NO: 316576

SEQ ID NO: 419604 - RNA, 61 nt, hsa; identical to SEQ ID NO: 316577

SEQ ID NO: 419605 - RNA, 61 nt, hsa; identical to SEQ ID NO: 316578

SEQ ID NO: 419606 - RNA, 61 nt, hsa; identical to SEQ ID NO: 316579

SEQ ID NO: 419607 - RNA, 61 nt, hsa; identical to SEQ ID NO: 316580

SEQ ID NO: 419608 - RNA, 61 nt, hsa; identical to SEQ ID NO: 316581

SEQ ID NO: 419609 - RNA, 61 nt, hsa; identical to SEQ ID NO: 316582

SEQ ID NO: 419610 - RNA, 61 nt, hsa; identical to SEQ ID NO: 316583

SEQ ID NO: 419611 - RNA, 61 nt, hsa; identical to SEQ ID NO: 316584

SEQ ID NO: 419612 - RNA, 61 nt, hsa; identical to SEQ ID NO: 316585

SEQ ID NO: 419613 - RNA, 61 nt, hsa; identical to SEQ ID NO: 316586

SEQ ID NO: 419614 - RNA, 61 nt, hsa; identical to SEQ ID NO: 316587

SEQ ID NO: 419615 - RNA, 61 nt, hsa; identical to SEQ ID NO: 316588

SEQ ID NO: 419616 - RNA, 61 nt, hsa; identical to SEQ ID NO: 316589

SEQ ID NO: 419617 - RNA, 61 nt, hsa; identical to SEQ ID NO: 316590

SEQ ID NO: 419618 - RNA, 61 nt, hsa; identical to SEQ ID NO: 316591

SEQ ID NO: 419619 - RNA, 61 nt, hsa; identical to SEQ ID NO: 316592

SEQ ID NO: 419620 - RNA, 61 nt, hsa; identical to SEQ ID NO: 316593

SEQ ID NO: 419621 - RNA, 61 nt, hsa; identical to SEQ ID NO: 316594

SEQ ID NO: 419622 - RNA, 61 nt, hsa; identical to SEQ ID NO: 316595

SEQ ID NO: 419623 - RNA, 61 nt, hsa; identical to SEQ ID NO: 316596

SEQ ID NO: 419624 - RNA, 61 nt, hsa; identical to SEQ ID NO: 316597

SEQ ID NO: 419625 - RNA, 61 nt, hsa; identical to SEQ ID NO: 316598

SEQ ID NO: 419626 - RNA, 61 nt, hsa; identical to SEQ ID NO: 316599

SEQ ID NO: 419627 - RNA, 61 nt, hsa; identical to SEQ ID NO: 316600

SEQ ID NO: 419628 - RNA, 61 nt, hsa; identical to SEQ ID NO: 316601

SEQ ID NO: 419629 - RNA, 61 nt, hsa; identical to SEQ ID NO: 316602

SEQ ID NO: 419630 - RNA, 61 nt, hsa; identical to SEQ ID NO: 316603

SEQ ID NO: 419631 - RNA, 61 nt, hsa; identical to SEQ ID NO: 316604

SEQ ID NO: 419632 - RNA, 61 nt, hsa; identical to SEQ ID NO: 316605

SEQ ID NO: 419633 - RNA, 61 nt, hsa; identical to SEQ ID NO: 316606

SEQ ID NO: 419634 - RNA, 61 nt, hsa; identical to SEQ ID NO: 316607

SEQ ID NO: 419635 - RNA, 61 nt, hsa; identical to SEQ ID NO: 316608

SEQ ID NO: 419636 - RNA, 61 nt, hsa; identical to SEQ ID NO: 316609

SEQ ID NO: 419637 - RNA, 61 nt, hsa; identical to SEQ ID NO: 316610

SEQ ID NO: 419638 - RNA, 61 nt, hsa; identical to SEQ ID NO: 316611

SEQ ID NO: 419639 - RNA, 61 nt, hsa; identical to SEQ ID NO: 316612

SEQ ID NO: 419640 - RNA, 61 nt, hsa; identical to SEQ ID NO: 316613

SEQ ID NO: 419641 - RNA, 61 nt, hsa; identical to SEQ ID NO: 316614

SEQ ID NO: 419642 - RNA, 61 nt, hsa; identical to SEQ ID NO: 316615

SEQ ID NO: 419643 - RNA, 61 nt, hsa; identical to SEQ ID NO: 316616

SEQ ID NO: 419644 - RNA, 61 nt, hsa; identical to SEQ ID NO: 316617

SEQ ID NO: 419645 - RNA, 61 nt, hsa; identical to SEQ ID NO: 316618

SEQ ID NO: 419646 - RNA, 61 nt, hsa; identical to SEQ ID NO: 316619

SEQ ID NO: 419647 - RNA, 61 nt, hsa; identical to SEQ ID NO: 316620

SEQ ID NO: 419648 - RNA, 61 nt, hsa; identical to SEQ ID NO: 316621

SEQ ID NO: 419649 - RNA, 61 nt, hsa; identical to SEQ ID NO: 316622

SEQ ID NO: 419650 - RNA, 61 nt, hsa; identical to SEQ ID NO: 316623

SEQ ID NO: 419651 - RNA, 61 nt, hsa; identical to SEQ ID NO: 316624

SEQ ID NO: 419652 - RNA, 61 nt, hsa; identical to SEQ ID NO: 316625

SEQ ID NO: 419653 - RNA, 61 nt, hsa; identical to SEQ ID NO: 316626

SEQ ID NO: 419654 - RNA, 61 nt, hsa; identical to SEQ ID NO: 316627

SEQ ID NO: 419655 - RNA, 61 nt, hsa; identical to SEQ ID NO: 316628

SEQ ID NO: 419656 - RNA, 61 nt, hsa; identical to SEQ ID NO: 316629

SEQ ID NO: 419657 - RNA, 61 nt, hsa; identical to SEQ ID NO: 316630

SEQ ID NO: 419658 - RNA, 61 nt, hsa; identical to SEQ ID NO: 316631

SEQ ID NO: 419659 - RNA, 58 nt, hsa; identical to SEQ ID NO: 316632

SEQ ID NO: 419660 - RNA, 61 nt, hsa; identical to SEQ ID NO: 316633

SEQ ID NO: 419661 - RNA, 61 nt, hsa; identical to SEQ ID NO: 316634

SEQ ID NO: 419662 - RNA, 61 nt, hsa; identical to SEQ ID NO: 316635

SEQ ID NO: 419663 - RNA, 61 nt, hsa; identical to SEQ ID NO: 316636

SEQ ID NO: 419664 - RNA, 61 nt, hsa; identical to SEQ ID NO: 316637

SEQ ID NO: 419665 - RNA, 61 nt, hsa; identical to SEQ ID NO: 316638

SEQ ID NO: 419666 - RNA, 61 nt, hsa; identical to SEQ ID NO: 316639

SEQ ID NO: 419667 - RNA, 61 nt, hsa; identical to SEQ ID NO: 316640

SEQ ID NO: 419668 - RNA, 61 nt, hsa; identical to SEQ ID NO: 316641

SEQ ID NO: 419669 - RNA, 61 nt, hsa; identical to SEQ ID NO: 316642

SEQ ID NO: 419670 - RNA, 61 nt, hsa; identical to SEQ ID NO: 316643

SEQ ID NO: 419671 - RNA, 61 nt, hsa; identical to SEQ ID NO: 316644

SEQ ID NO: 419672 - RNA, 61 nt, hsa; identical to SEQ ID NO: 316645

SEQ ID NO: 419673 - RNA, 61 nt, hsa; identical to SEQ ID NO: 316646

SEQ ID NO: 419674 - RNA, 61 nt, hsa; identical to SEQ ID NO: 316647

SEQ ID NO: 419675 - RNA, 61 nt, hsa; identical to SEQ ID NO: 316648

SEQ ID NO: 419676 - RNA, 61 nt, hsa; identical to SEQ ID NO: 316649

SEQ ID NO: 419677 - RNA, 61 nt, hsa; identical to SEQ ID NO: 316650

SEQ ID NO: 419678 - RNA, 61 nt, hsa; identical to SEQ ID NO: 316651

SEQ ID NO: 419679 - RNA, 61 nt, hsa; identical to SEQ ID NO: 316652

SEQ ID NO: 419680 - RNA, 61 nt, hsa; identical to SEQ ID NO: 316653

SEQ ID NO: 419681 - RNA, 61 nt, hsa; identical to SEQ ID NO: 316654

SEQ ID NO: 419682 - RNA, 61 nt, hsa; identical to SEQ ID NO: 316655

SEQ ID NO: 419683 - RNA, 61 nt, hsa; identical to SEQ ID NO: 316656

SEQ ID NO: 419684 - RNA, 61 nt, hsa; identical to SEQ ID NO: 316657

SEQ ID NO: 419685 - RNA, 61 nt, hsa; identical to SEQ ID NO: 316658

SEQ ID NO: 419686 - RNA, 61 nt, hsa; identical to SEQ ID NO: 316659

SEQ ID NO: 419687 - RNA, 61 nt, hsa; identical to SEQ ID NO: 316660

SEQ ID NO: 419688 - RNA, 61 nt, hsa; identical to SEQ ID NO: 316661

SEQ ID NO: 419689 - RNA, 61 nt, hsa; identical to SEQ ID NO: 316662

SEQ ID NO: 419690 - RNA, 61 nt, hsa; identical to SEQ ID NO: 316663

SEQ ID NO: 419691 - RNA, 61 nt, hsa; identical to SEQ ID NO: 316664

SEQ ID NO: 419692 - RNA, 61 nt, hsa; identical to SEQ ID NO: 316665

SEQ ID NO: 419693 - RNA, 61 nt, hsa; identical to SEQ ID NO: 316666

SEQ ID NO: 419694 - RNA, 61 nt, hsa; identical to SEQ ID NO: 316667

SEQ ID NO: 419695 - RNA, 61 nt, hsa; identical to SEQ ID NO: 316668

SEQ ID NO: 419696 - RNA, 61 nt, hsa; identical to SEQ ID NO: 316669

SEQ ID NO: 419697 - RNA, 61 nt, hsa; identical to SEQ ID NO: 316670

SEQ ID NO: 419698 - RNA, 61 nt, hsa; identical to SEQ ID NO: 316671

SEQ ID NO: 419699 - RNA, 61 nt, hsa; identical to SEQ ID NO: 316672

SEQ ID NO: 419700 - RNA, 61 nt, hsa; identical to SEQ ID NO: 316673

SEQ ID NO: 419701 - RNA, 59 nt, hsa; identical to SEQ ID NO: 316674

SEQ ID NO: 419702 - RNA, 61 nt, hsa; identical to SEQ ID NO: 316675

SEQ ID NO: 419703 - RNA, 61 nt, hsa; identical to SEQ ID NO: 316676

SEQ ID NO: 419704 - RNA, 61 nt, hsa; identical to SEQ ID NO: 316677

SEQ ID NO: 419705 - RNA, 61 nt, hsa; identical to SEQ ID NO: 316678

SEQ ID NO: 419706 - RNA, 61 nt, hsa; identical to SEQ ID NO: 316679

SEQ ID NO: 419707 - RNA, 61 nt, hsa; identical to SEQ ID NO: 316680

SEQ ID NO: 419708 - RNA, 61 nt, hsa; identical to SEQ ID NO: 316681

SEQ ID NO: 419709 - RNA, 61 nt, hsa; identical to SEQ ID NO: 316682

SEQ ID NO: 419710 - RNA, 61 nt, hsa; identical to SEQ ID NO: 316683

SEQ ID NO: 419711 - RNA, 61 nt, hsa; identical to SEQ ID NO: 316684

SEQ ID NO: 419712 - RNA, 61 nt, hsa; identical to SEQ ID NO: 316685

SEQ ID NO: 419713 - RNA, 61 nt, hsa; identical to SEQ ID NO: 316686

SEQ ID NO: 419714 - RNA, 61 nt, hsa; identical to SEQ ID NO: 316687

SEQ ID NO: 419715 - RNA, 61 nt, hsa; identical to SEQ ID NO: 316688

SEQ ID NO: 419716 - RNA, 61 nt, hsa; identical to SEQ ID NO: 316689

SEQ ID NO: 419717 - RNA, 61 nt, hsa; identical to SEQ ID NO: 316690

SEQ ID NO: 419718 - RNA, 61 nt, hsa; identical to SEQ ID NO: 316691

SEQ ID NO: 419719 - RNA, 61 nt, hsa; identical to SEQ ID NO: 316692

SEQ ID NO: 419720 - RNA, 61 nt, hsa; identical to SEQ ID NO: 316693

SEQ ID NO: 419721 - RNA, 61 nt, hsa; identical to SEQ ID NO: 316694

SEQ ID NO: 419722 - RNA, 61 nt, hsa; identical to SEQ ID NO: 316695

SEQ ID NO: 419723 - RNA, 61 nt, hsa; identical to SEQ ID NO: 316696

SEQ ID NO: 419724 - RNA, 61 nt, hsa; identical to SEQ ID NO: 316697

SEQ ID NO: 419725 - RNA, 61 nt, hsa; identical to SEQ ID NO: 316698

SEQ ID NO: 419726 - RNA, 61 nt, hsa; identical to SEQ ID NO: 316699

SEQ ID NO: 419727 - RNA, 61 nt, hsa; identical to SEQ ID NO: 316700

SEQ ID NO: 419728 - RNA, 61 nt, hsa; identical to SEQ ID NO: 316701

SEQ ID NO: 419729 - RNA, 61 nt, hsa; identical to SEQ ID NO: 316702

SEQ ID NO: 419730 - RNA, 61 nt, hsa; identical to SEQ ID NO: 316703

SEQ ID NO: 419731 - RNA, 61 nt, hsa; identical to SEQ ID NO: 316704

SEQ ID NO: 419732 - RNA, 61 nt, hsa; identical to SEQ ID NO: 316705

SEQ ID NO: 419733 - RNA, 61 nt, hsa; identical to SEQ ID NO: 316706

SEQ ID NO: 419734 - RNA, 61 nt, hsa; identical to SEQ ID NO: 316707

SEQ ID NO: 419735 - RNA, 61 nt, hsa; identical to SEQ ID NO: 316708

SEQ ID NO: 419736 - RNA, 61 nt, hsa; identical to SEQ ID NO: 316709

SEQ ID NO: 419737 - RNA, 61 nt, hsa; identical to SEQ ID NO: 316710

SEQ ID NO: 419738 - RNA, 61 nt, hsa; identical to SEQ ID NO: 316711

SEQ ID NO: 419739 - RNA, 61 nt, hsa; identical to SEQ ID NO: 316712

SEQ ID NO: 419740 - RNA, 61 nt, hsa; identical to SEQ ID NO: 316713

SEQ ID NO: 419741 - RNA, 61 nt, hsa; identical to SEQ ID NO: 316714

SEQ ID NO: 419742 - RNA, 61 nt, hsa; identical to SEQ ID NO: 316715

SEQ ID NO: 419743 - RNA, 61 nt, hsa; identical to SEQ ID NO: 316716

SEQ ID NO: 419744 - RNA, 61 nt, hsa; identical to SEQ ID NO: 316717

SEQ ID NO: 419745 - RNA, 61 nt, hsa; identical to SEQ ID NO: 316718

SEQ ID NO: 419746 - RNA, 61 nt, hsa; identical to SEQ ID NO: 316719

SEQ ID NO: 419747 - RNA, 61 nt, hsa; identical to SEQ ID NO: 316720

SEQ ID NO: 419748 - RNA, 61 nt, hsa; identical to SEQ ID NO: 316721

SEQ ID NO: 419749 - RNA, 61 nt, hsa; identical to SEQ ID NO: 316722

SEQ ID NO: 419750 - RNA, 61 nt, hsa; identical to SEQ ID NO: 316723

SEQ ID NO: 419751 - RNA, 61 nt, hsa; identical to SEQ ID NO: 316724

SEQ ID NO: 419752 - RNA, 61 nt, hsa; identical to SEQ ID NO: 316725

SEQ ID NO: 419753 - RNA, 61 nt, hsa; identical to SEQ ID NO: 316726

SEQ ID NO: 419754 - RNA, 61 nt, hsa; identical to SEQ ID NO: 316727

SEQ ID NO: 419755 - RNA, 61 nt, hsa; identical to SEQ ID NO: 316728

SEQ ID NO: 419756 - RNA, 61 nt, hsa; identical to SEQ ID NO: 316729

SEQ ID NO: 419757 - RNA, 61 nt, hsa; identical to SEQ ID NO: 316730

SEQ ID NO: 419758 - RNA, 61 nt, hsa; identical to SEQ ID NO: 316731

SEQ ID NO: 419759 - RNA, 61 nt, hsa; identical to SEQ ID NO: 316732

SEQ ID NO: 419760 - RNA, 61 nt, hsa; identical to SEQ ID NO: 316733

SEQ ID NO: 419761 - RNA, 61 nt, hsa; identical to SEQ ID NO: 316734

SEQ ID NO: 419762 - RNA, 61 nt, hsa; identical to SEQ ID NO: 316735

SEQ ID NO: 419763 - RNA, 61 nt, hsa; identical to SEQ ID NO: 316736

SEQ ID NO: 419764 - RNA, 61 nt, hsa; identical to SEQ ID NO: 316737

SEQ ID NO: 419765 - RNA, 61 nt, hsa; identical to SEQ ID NO: 316738

SEQ ID NO: 419766 - RNA, 61 nt, hsa; identical to SEQ ID NO: 316739

SEQ ID NO: 419767 - RNA, 61 nt, hsa; identical to SEQ ID NO: 316740

SEQ ID NO: 419768 - RNA, 61 nt, hsa; identical to SEQ ID NO: 316741

SEQ ID NO: 419769 - RNA, 61 nt, hsa; identical to SEQ ID NO: 316742

SEQ ID NO: 419770 - RNA, 61 nt, hsa; identical to SEQ ID NO: 316743

SEQ ID NO: 419771 - RNA, 61 nt, hsa; identical to SEQ ID NO: 316744

SEQ ID NO: 419772 - RNA, 61 nt, hsa; identical to SEQ ID NO: 316745

SEQ ID NO: 419773 - RNA, 61 nt, hsa; identical to SEQ ID NO: 316746

SEQ ID NO: 419774 - RNA, 61 nt, hsa; identical to SEQ ID NO: 316747

SEQ ID NO: 419775 - RNA, 61 nt, hsa; identical to SEQ ID NO: 316748

SEQ ID NO: 419776 - RNA, 61 nt, hsa; identical to SEQ ID NO: 316749

SEQ ID NO: 419777 - RNA, 61 nt, hsa; identical to SEQ ID NO: 316750

SEQ ID NO: 419778 - RNA, 61 nt, hsa; identical to SEQ ID NO: 316751

SEQ ID NO: 419779 - RNA, 61 nt, hsa; identical to SEQ ID NO: 316752

SEQ ID NO: 419780 - RNA, 61 nt, hsa; identical to SEQ ID NO: 316753

SEQ ID NO: 419781 - RNA, 61 nt, hsa; identical to SEQ ID NO: 316754

SEQ ID NO: 419782 - RNA, 61 nt, hsa; identical to SEQ ID NO: 316755

SEQ ID NO: 419783 - RNA, 61 nt, hsa; identical to SEQ ID NO: 316756

SEQ ID NO: 419784 - RNA, 61 nt, hsa; identical to SEQ ID NO: 316757

SEQ ID NO: 419785 - RNA, 61 nt, hsa; identical to SEQ ID NO: 316758

SEQ ID NO: 419786 - RNA, 61 nt, hsa; identical to SEQ ID NO: 316759

SEQ ID NO: 419787 - RNA, 61 nt, hsa; identical to SEQ ID NO: 316760

SEQ ID NO: 419788 - RNA, 61 nt, hsa; identical to SEQ ID NO: 316761

SEQ ID NO: 419789 - RNA, 61 nt, hsa; identical to SEQ ID NO: 316762

SEQ ID NO: 419790 - RNA, 61 nt, hsa; identical to SEQ ID NO: 316763

SEQ ID NO: 419791 - RNA, 61 nt, hsa; identical to SEQ ID NO: 316764

SEQ ID NO: 419792 - RNA, 61 nt, hsa; identical to SEQ ID NO: 316765

SEQ ID NO: 419793 - RNA, 61 nt, hsa; identical to SEQ ID NO: 316766

SEQ ID NO: 419794 - RNA, 61 nt, hsa; identical to SEQ ID NO: 316767

SEQ ID NO: 419795 - RNA, 61 nt, hsa; identical to SEQ ID NO: 316768

SEQ ID NO: 419796 - RNA, 61 nt, hsa; identical to SEQ ID NO: 316769

SEQ ID NO: 419797 - RNA, 61 nt, hsa; identical to SEQ ID NO: 316770

SEQ ID NO: 419798 - RNA, 50 nt, hsa; identical to SEQ ID NO: 316771

SEQ ID NO: 419799 - RNA, 61 nt, hsa; identical to SEQ ID NO: 316772

SEQ ID NO: 419800 - RNA, 61 nt, hsa; identical to SEQ ID NO: 316773

SEQ ID NO: 419801 - RNA, 61 nt, hsa; identical to SEQ ID NO: 316774

SEQ ID NO: 419802 - RNA, 61 nt, hsa; identical to SEQ ID NO: 316775

SEQ ID NO: 419803 - RNA, 61 nt, hsa; identical to SEQ ID NO: 316776

SEQ ID NO: 419804 - RNA, 61 nt, hsa; identical to SEQ ID NO: 316777

SEQ ID NO: 419805 - RNA, 61 nt, hsa; identical to SEQ ID NO: 316778

SEQ ID NO: 419806 - RNA, 61 nt, hsa; identical to SEQ ID NO: 316779

SEQ ID NO: 419807 - RNA, 61 nt, hsa; identical to SEQ ID NO: 316780

SEQ ID NO: 419808 - RNA, 61 nt, hsa; identical to SEQ ID NO: 316781

SEQ ID NO: 419809 - RNA, 61 nt, hsa; identical to SEQ ID NO: 316782

SEQ ID NO: 419810 - RNA, 61 nt, hsa; identical to SEQ ID NO: 316783

SEQ ID NO: 419811 - RNA, 61 nt, hsa; identical to SEQ ID NO: 316784

SEQ ID NO: 419812 - RNA, 61 nt, hsa; identical to SEQ ID NO: 316785

SEQ ID NO: 419813 - RNA, 61 nt, hsa; identical to SEQ ID NO: 316786

SEQ ID NO: 419814 - RNA, 61 nt, hsa; identical to SEQ ID NO: 316787

SEQ ID NO: 419815 - RNA, 61 nt, hsa; identical to SEQ ID NO: 316788

SEQ ID NO: 419816 - RNA, 61 nt, hsa; identical to SEQ ID NO: 316789

SEQ ID NO: 419817 - RNA, 61 nt, hsa; identical to SEQ ID NO: 316790

SEQ ID NO: 419818 - RNA, 61 nt, hsa; identical to SEQ ID NO: 316791

SEQ ID NO: 419819 - RNA, 61 nt, hsa; identical to SEQ ID NO: 316792

SEQ ID NO: 419820 - RNA, 61 nt, hsa; identical to SEQ ID NO: 316793

SEQ ID NO: 419821 - RNA, 61 nt, hsa; identical to SEQ ID NO: 316794

SEQ ID NO: 419822 - RNA, 61 nt, hsa; identical to SEQ ID NO: 316795

SEQ ID NO: 419823 - RNA, 61 nt, hsa; identical to SEQ ID NO: 316796

SEQ ID NO: 419824 - RNA, 61 nt, hsa; identical to SEQ ID NO: 316797

SEQ ID NO: 419825 - RNA, 61 nt, hsa; identical to SEQ ID NO: 316798

SEQ ID NO: 419826 - RNA, 61 nt, hsa; identical to SEQ ID NO: 316799

SEQ ID NO: 419827 - RNA, 61 nt, hsa; identical to SEQ ID NO: 316800

SEQ ID NO: 419828 - RNA, 61 nt, hsa; identical to SEQ ID NO: 316801

SEQ ID NO: 419829 - RNA, 61 nt, hsa; identical to SEQ ID NO: 316802

SEQ ID NO: 419830 - RNA, 61 nt, hsa; identical to SEQ ID NO: 316803

SEQ ID NO: 419831 - RNA, 61 nt, hsa; identical to SEQ ID NO: 316804

SEQ ID NO: 419832 - RNA, 61 nt, hsa; identical to SEQ ID NO: 316805

SEQ ID NO: 419833 - RNA, 61 nt, hsa; identical to SEQ ID NO: 316806

SEQ ID NO: 419834 - RNA, 61 nt, hsa; identical to SEQ ID NO: 316807

SEQ ID NO: 419835 - RNA, 61 nt, hsa; identical to SEQ ID NO: 316808

SEQ ID NO: 419836 - RNA, 61 nt, hsa; identical to SEQ ID NO: 316809

SEQ ID NO: 419837 - RNA, 61 nt, hsa; identical to SEQ ID NO: 316810

SEQ ID NO: 419838 - RNA, 61 nt, hsa; identical to SEQ ID NO: 316811

SEQ ID NO: 419839 - RNA, 61 nt, hsa; identical to SEQ ID NO: 316812

SEQ ID NO: 419840 - RNA, 61 nt, hsa; identical to SEQ ID NO: 316813

SEQ ID NO: 419841 - RNA, 61 nt, hsa; identical to SEQ ID NO: 316814

SEQ ID NO: 419842 - RNA, 61 nt, hsa; identical to SEQ ID NO: 316815

SEQ ID NO: 419843 - RNA, 61 nt, hsa; identical to SEQ ID NO: 316816

SEQ ID NO: 419844 - RNA, 61 nt, hsa; identical to SEQ ID NO: 316817

SEQ ID NO: 419845 - RNA, 61 nt, hsa; identical to SEQ ID NO: 316818

SEQ ID NO: 419846 - RNA, 61 nt, hsa; identical to SEQ ID NO: 316819

SEQ ID NO: 419847 - RNA, 61 nt, hsa; identical to SEQ ID NO: 316820

SEQ ID NO: 419848 - RNA, 61 nt, hsa; identical to SEQ ID NO: 316821

SEQ ID NO: 419849 - RNA, 61 nt, hsa; identical to SEQ ID NO: 316822

SEQ ID NO: 419850 - RNA, 61 nt, hsa; identical to SEQ ID NO: 316823

SEQ ID NO: 419851 - RNA, 61 nt, hsa; identical to SEQ ID NO: 316824

SEQ ID NO: 419852 - RNA, 61 nt, hsa; identical to SEQ ID NO: 316825

SEQ ID NO: 419853 - RNA, 61 nt, hsa; identical to SEQ ID NO: 316826

SEQ ID NO: 419854 - RNA, 61 nt, hsa; identical to SEQ ID NO: 316827

SEQ ID NO: 419855 - RNA, 61 nt, hsa; identical to SEQ ID NO: 316828

SEQ ID NO: 419856 - RNA, 61 nt, hsa; identical to SEQ ID NO: 316829

SEQ ID NO: 419857 - RNA, 61 nt, hsa; identical to SEQ ID NO: 316830

SEQ ID NO: 419858 - RNA, 61 nt, hsa; identical to SEQ ID NO: 316831

SEQ ID NO: 419859 - RNA, 61 nt, hsa; identical to SEQ ID NO: 316832

SEQ ID NO: 419860 - RNA, 61 nt, hsa; identical to SEQ ID NO: 316833

SEQ ID NO: 419861 - RNA, 61 nt, hsa; identical to SEQ ID NO: 316834

SEQ ID NO: 419862 - RNA, 61 nt, hsa; identical to SEQ ID NO: 316835

SEQ ID NO: 419863 - RNA, 61 nt, hsa; identical to SEQ ID NO: 316836

SEQ ID NO: 419864 - RNA, 61 nt, hsa; identical to SEQ ID NO: 316837

SEQ ID NO: 419865 - RNA, 61 nt, hsa; identical to SEQ ID NO: 316838

SEQ ID NO: 419866 - RNA, 61 nt, hsa; identical to SEQ ID NO: 316839

SEQ ID NO: 419867 - RNA, 61 nt, hsa; identical to SEQ ID NO: 316840

SEQ ID NO: 419868 - RNA, 61 nt, hsa; identical to SEQ ID NO: 316841

SEQ ID NO: 419869 - RNA, 61 nt, hsa; identical to SEQ ID NO: 316842

SEQ ID NO: 419870 - RNA, 61 nt, hsa; identical to SEQ ID NO: 316843

SEQ ID NO: 419871 - RNA, 61 nt, hsa; identical to SEQ ID NO: 316844

SEQ ID NO: 419872 - RNA, 61 nt, hsa; identical to SEQ ID NO: 316845

SEQ ID NO: 419873 - RNA, 61 nt, hsa; identical to SEQ ID NO: 316846

SEQ ID NO: 419874 - RNA, 61 nt, hsa; identical to SEQ ID NO: 316847

SEQ ID NO: 419875 - RNA, 61 nt, hsa; identical to SEQ ID NO: 316848

SEQ ID NO: 419876 - RNA, 61 nt, hsa; identical to SEQ ID NO: 316849

SEQ ID NO: 419877 - RNA, 61 nt, hsa; identical to SEQ ID NO: 316850

SEQ ID NO: 419878 - RNA, 61 nt, hsa; identical to SEQ ID NO: 316851

SEQ ID NO: 419879 - RNA, 61 nt, hsa; identical to SEQ ID NO: 316852

SEQ ID NO: 419880 - RNA, 61 nt, hsa; identical to SEQ ID NO: 316853

SEQ ID NO: 419881 - RNA, 61 nt, hsa; identical to SEQ ID NO: 316854

SEQ ID NO: 419882 - RNA, 61 nt, hsa; identical to SEQ ID NO: 316855

SEQ ID NO: 419883 - RNA, 61 nt, hsa; identical to SEQ ID NO: 316856

SEQ ID NO: 419884 - RNA, 61 nt, hsa; identical to SEQ ID NO: 316857

SEQ ID NO: 419885 - RNA, 61 nt, hsa; identical to SEQ ID NO: 316858

SEQ ID NO: 419886 - RNA, 61 nt, hsa; identical to SEQ ID NO: 316859

SEQ ID NO: 419887 - RNA, 61 nt, hsa; identical to SEQ ID NO: 316860

SEQ ID NO: 419888 - RNA, 61 nt, hsa; identical to SEQ ID NO: 316861

SEQ ID NO: 419889 - RNA, 61 nt, hsa; identical to SEQ ID NO: 316862

SEQ ID NO: 419890 - RNA, 61 nt, hsa; identical to SEQ ID NO: 316863

SEQ ID NO: 419891 - RNA, 61 nt, hsa; identical to SEQ ID NO: 316864

SEQ ID NO: 419892 - RNA, 61 nt, hsa; identical to SEQ ID NO: 316865

SEQ ID NO: 419893 - RNA, 61 nt, hsa; identical to SEQ ID NO: 316866

SEQ ID NO: 419894 - RNA, 61 nt, hsa; identical to SEQ ID NO: 316867

SEQ ID NO: 419895 - RNA, 61 nt, hsa; identical to SEQ ID NO: 316868

SEQ ID NO: 419896 - RNA, 61 nt, hsa; identical to SEQ ID NO: 316869

SEQ ID NO: 419897 - RNA, 61 nt, hsa; identical to SEQ ID NO: 316870

SEQ ID NO: 419898 - RNA, 61 nt, hsa; identical to SEQ ID NO: 316871

SEQ ID NO: 419899 - RNA, 61 nt, hsa; identical to SEQ ID NO: 316872

SEQ ID NO: 419900 - RNA, 61 nt, hsa; identical to SEQ ID NO: 316873

SEQ ID NO: 419901 - RNA, 61 nt, hsa; identical to SEQ ID NO: 316874

SEQ ID NO: 419902 - RNA, 61 nt, hsa; identical to SEQ ID NO: 316875

SEQ ID NO: 419903 - RNA, 61 nt, hsa; identical to SEQ ID NO: 316876

SEQ ID NO: 419904 - RNA, 61 nt, hsa; identical to SEQ ID NO: 316877

SEQ ID NO: 419905 - RNA, 61 nt, hsa; identical to SEQ ID NO: 316878

SEQ ID NO: 419906 - RNA, 64 nt, hsa
cucguugagcagcaacgcaaucaccaucaucccacugcccaaucuagaauaugucugcucuccu

SEQ ID NO: 419907 - RNA, 64 nt, hsa
gcagacacagaaagacacaaaacggucgucuuuccugcccaaguaaagcuuacagacuaacugg

SEQ ID NO: 419908 - RNA, 64 nt, hsa
cuaugcaaguucauuuaagccucagggcuggucccugcccaaagggcuggacccuccuaauccu

SEQ ID NO: 419909 - RNA, 64 nt, hsa
ucucuauggacaguuccguauagacucaacucaucugcccaaccaaguauguuccuccugaauu

SEQ ID NO: 419910 - RNA, 64 nt, hsa
gggggccagaguccuuuccaaggcuucuccaauucugcccaaaaauaugguugauaguuuaccu

SEQ ID NO: 419911 - RNA, 64 nt, hsa
aaaacaaaacaaaacaaaaaacuccccuuccucacugcccaauauaaaaggcaaauguguacau

SEQ ID NO: 419912 - RNA, 64 nt, hsa
cuggccagacccuggcgcugccacaguccuggcacugcccaaggccauaccugccuagcccuuu

SEQ ID NO: 419913 - RNA, 64 nt, hsa
gucagcagggggccuggugggaggagcgacugcccugcccaaaugaacugccacagcagggaca

SEQ ID NO: 419914 - RNA, 64 nt, hsa
ugggaguuugcucuuggaugagcauuacgggcaucugcccaaguuucugcauuucuucaucuac

SEQ ID NO: 419915 - RNA, 64 nt, hsa
ccgugugcacauccugcaggugcuacugagacugcugcccaacaugagcagugaucuccaaggc

SEQ ID NO: 419916 - RNA, 63 nt, hsa
gccacagugcucacaacuagccgggaggcaagacugcccaacugucagguaaauucagauguc

SEQ ID NO: 419917 - RNA, 64 nt, hsa
cugggguggaaguuuuguagccacacacaggauacugcccaagauccagcggguguuuucuucu

SEQ ID NO: 419918 - RNA, 64 nt, hsa
gagaagcccacaagaucugagugaaaaaagucaccugcccaauaaagcuugacaagacacucgc

SEQ ID NO: 419919 - RNA, 64 nt, hsa
ucaagcccccagcuggaaguuaagagaaagucaccugcccaagaaacaccgagugaggccauag

SEQ ID NO: 419920 - RNA, 64 nt, hsa
caggacugggccgggcccagggccucuggcuucccugcccaauccucccuggagaagggacaug

SEQ ID NO: 419921 - RNA, 64 nt, hsa
aggaccacuagcuaagcaagccaggagaagaccccugcccaaguggcucuugggacaacgugcu

SEQ ID NO: 419922 - RNA, 64 nt, hsa
uaaagugggggagauggcagacgcuuucugggaccugcccaagauauguauucucugacacucu

SEQ ID NO: 419923 - RNA, 64 nt, hsa
ccagugaucccaugccuuugggaaucccaggaugcugcccaacgggaaauuuguacauugggug

SEQ ID NO: 419924 - RNA, 64 nt, hsa
agauauaauucuguauuuagaaaaccuguugucucugcccaaaggcuccuagaucugauaaaca

SEQ ID NO: 419925 - RNA, 64 nt, hsa
cucauggauaggaagaaucaguauuguuaaaauacugcccaaagcaauuuacagagccaaugcu

SEQ ID NO: 419926 - RNA, 64 nt, hsa
ggccgugcccgaugugcaccucccagaggugcagcugcccaaagucugugaaaugaaagucccu

SEQ ID NO: 419927 - RNA, 64 nt, hsa
ggcugugccggaggugcggcuuccagagguagagcugcccaaagugucagagaugaaacuccca

SEQ ID NO: 419928 - RNA, 64 nt, hsa
ucucuuucccucuucuccccagccuccuccagggcugcccaaggcaggguuuccagccaggccu

SEQ ID NO: 419929 - RNA, 64 nt, hsa
gguaccgcucuccaaggugugcuagcagugggcccugcccaacuucaggcagaacagggaggcc

SEQ ID NO: 419930 - RNA, 64 nt, hsa; identical to SEQ ID NO: 108616

SEQ ID NO: 419931 - RNA, 64 nt, hsa; identical to SEQ ID NO: 108617

SEQ ID NO: 419932 - RNA, 64 nt, hsa; identical to SEQ ID NO: 108618

SEQ ID NO: 419933 - RNA, 64 nt, hsa; identical to SEQ ID NO: 108619

SEQ ID NO: 419934 - RNA, 64 nt, hsa; identical to SEQ ID NO: 108620

SEQ ID NO: 419935 - RNA, 64 nt, hsa; identical to SEQ ID NO: 108621

SEQ ID NO: 419936 - RNA, 64 nt, hsa; identical to SEQ ID NO: 108622

SEQ ID NO: 419937 - RNA, 64 nt, hsa; identical to SEQ ID NO: 108623

SEQ ID NO: 419938 - RNA, 61 nt, hsa; identical to SEQ ID NO: 108624

SEQ ID NO: 419939 - RNA, 64 nt, hsa; identical to SEQ ID NO: 108625

SEQ ID NO: 419940 - RNA, 64 nt, hsa; identical to SEQ ID NO: 108626

SEQ ID NO: 419941 - RNA, 64 nt, hsa; identical to SEQ ID NO: 108627

SEQ ID NO: 419942 - RNA, 64 nt, hsa; identical to SEQ ID NO: 108628

SEQ ID NO: 419943 - RNA, 64 nt, hsa; identical to SEQ ID NO: 108629

SEQ ID NO: 419944 - RNA, 64 nt, hsa; identical to SEQ ID NO: 108630

SEQ ID NO: 419945 - RNA, 64 nt, hsa; identical to SEQ ID NO: 108631

SEQ ID NO: 419946 - RNA, 64 nt, hsa; identical to SEQ ID NO: 108632

SEQ ID NO: 419947 - RNA, 64 nt, hsa; identical to SEQ ID NO: 108633

SEQ ID NO: 419948 - RNA, 64 nt, hsa; identical to SEQ ID NO: 108634

SEQ ID NO: 419949 - RNA, 64 nt, hsa; identical to SEQ ID NO: 108635

SEQ ID NO: 419950 - RNA, 64 nt, hsa; identical to SEQ ID NO: 108636

SEQ ID NO: 419951 - RNA, 64 nt, hsa; identical to SEQ ID NO: 108637

SEQ ID NO: 419952 - RNA, 64 nt, hsa; identical to SEQ ID NO: 108638

SEQ ID NO: 419953 - RNA, 64 nt, hsa; identical to SEQ ID NO: 108639

SEQ ID NO: 419954 - RNA, 64 nt, hsa; identical to SEQ ID NO: 108640

SEQ ID NO: 419955 - RNA, 64 nt, hsa; identical to SEQ ID NO: 108641

SEQ ID NO: 419956 - RNA, 64 nt, hsa; identical to SEQ ID NO: 108642

SEQ ID NO: 419957 - RNA, 64 nt, hsa; identical to SEQ ID NO: 108643

SEQ ID NO: 419958 - RNA, 64 nt, hsa; identical to SEQ ID NO: 108644

SEQ ID NO: 419959 - RNA, 64 nt, hsa; identical to SEQ ID NO: 108645

SEQ ID NO: 419960 - RNA, 64 nt, hsa; identical to SEQ ID NO: 108646

SEQ ID NO: 419961 - RNA, 64 nt, hsa; identical to SEQ ID NO: 108647

SEQ ID NO: 419962 - RNA, 64 nt, hsa; identical to SEQ ID NO: 108648

SEQ ID NO: 419963 - RNA, 64 nt, hsa; identical to SEQ ID NO: 108649

SEQ ID NO: 419964 - RNA, 64 nt, hsa; identical to SEQ ID NO: 108650

SEQ ID NO: 419965 - RNA, 64 nt, hsa; identical to SEQ ID NO: 108651

SEQ ID NO: 419966 - RNA, 64 nt, hsa; identical to SEQ ID NO: 108652

SEQ ID NO: 419967 - RNA, 64 nt, hsa; identical to SEQ ID NO: 108653

SEQ ID NO: 419968 - RNA, 64 nt, hsa; identical to SEQ ID NO: 108654

SEQ ID NO: 419969 - RNA, 64 nt, hsa; identical to SEQ ID NO: 108655

SEQ ID NO: 419970 - RNA, 64 nt, hsa; identical to SEQ ID NO: 108656

SEQ ID NO: 419971 - RNA, 64 nt, hsa; identical to SEQ ID NO: 108657

SEQ ID NO: 419972 - RNA, 64 nt, hsa; identical to SEQ ID NO: 108658

SEQ ID NO: 419973 - RNA, 64 nt, hsa; identical to SEQ ID NO: 108659

SEQ ID NO: 419974 - RNA, 64 nt, hsa; identical to SEQ ID NO: 108660

SEQ ID NO: 419975 - RNA, 64 nt, hsa; identical to SEQ ID NO: 108661

SEQ ID NO: 419976 - RNA, 64 nt, hsa; identical to SEQ ID NO: 108662

SEQ ID NO: 419977 - RNA, 64 nt, hsa; identical to SEQ ID NO: 108663

SEQ ID NO: 419978 - RNA, 64 nt, hsa; identical to SEQ ID NO: 108664

SEQ ID NO: 419979 - RNA, 64 nt, hsa; identical to SEQ ID NO: 108665

SEQ ID NO: 419980 - RNA, 64 nt, hsa; identical to SEQ ID NO: 108666

SEQ ID NO: 419981 - RNA, 64 nt, hsa; identical to SEQ ID NO: 108667

SEQ ID NO: 419982 - RNA, 64 nt, hsa; identical to SEQ ID NO: 108668

SEQ ID NO: 419983 - RNA, 64 nt, hsa; identical to SEQ ID NO: 108669

SEQ ID NO: 419984 - RNA, 64 nt, hsa; identical to SEQ ID NO: 108670

SEQ ID NO: 419985 - RNA, 64 nt, hsa; identical to SEQ ID NO: 108671

SEQ ID NO: 419986 - RNA, 64 nt, hsa; identical to SEQ ID NO: 108672

SEQ ID NO: 419987 - RNA, 64 nt, hsa; identical to SEQ ID NO: 108673

SEQ ID NO: 419988 - RNA, 64 nt, hsa; identical to SEQ ID NO: 108674

SEQ ID NO: 419989 - RNA, 64 nt, hsa; identical to SEQ ID NO: 108675

SEQ ID NO: 419990 - RNA, 64 nt, hsa; identical to SEQ ID NO: 108676

SEQ ID NO: 419991 - RNA, 64 nt, hsa; identical to SEQ ID NO: 108677

SEQ ID NO: 419992 - RNA, 64 nt, hsa; identical to SEQ ID NO: 108678

SEQ ID NO: 419993 - RNA, 64 nt, hsa; identical to SEQ ID NO: 108679

SEQ ID NO: 419994 - RNA, 64 nt, hsa; identical to SEQ ID NO: 108680

SEQ ID NO: 419995 - RNA, 64 nt, hsa; identical to SEQ ID NO: 108681

SEQ ID NO: 419996 - RNA, 64 nt, hsa; identical to SEQ ID NO: 108682

SEQ ID NO: 419997 - RNA, 64 nt, hsa; identical to SEQ ID NO: 108683

SEQ ID NO: 419998 - RNA, 64 nt, hsa; identical to SEQ ID NO: 108684

SEQ ID NO: 419999 - RNA, 64 nt, hsa; identical to SEQ ID NO: 108685

SEQ ID NO: 420000 - RNA, 64 nt, hsa; identical to SEQ ID NO: 108686

SEQ ID NO: 420001 - RNA, 64 nt, hsa; identical to SEQ ID NO: 108687

SEQ ID NO: 420002 - RNA, 64 nt, hsa; identical to SEQ ID NO: 108688

SEQ ID NO: 420003 - RNA, 64 nt, hsa; identical to SEQ ID NO: 108689

SEQ ID NO: 420004 - RNA, 64 nt, hsa; identical to SEQ ID NO: 108690

SEQ ID NO: 420005 - RNA, 64 nt, hsa; identical to SEQ ID NO: 108691

SEQ ID NO: 420006 - RNA, 64 nt, hsa; identical to SEQ ID NO: 108692

SEQ ID NO: 420007 - RNA, 64 nt, hsa; identical to SEQ ID NO: 108693

SEQ ID NO: 420008 - RNA, 64 nt, hsa; identical to SEQ ID NO: 108694

SEQ ID NO: 420009 - RNA, 64 nt, hsa; identical to SEQ ID NO: 108695

SEQ ID NO: 420010 - RNA, 64 nt, hsa; identical to SEQ ID NO: 108696

SEQ ID NO: 420011 - RNA, 64 nt, hsa; identical to SEQ ID NO: 108697

SEQ ID NO: 420012 - RNA, 64 nt, hsa; identical to SEQ ID NO: 108698

SEQ ID NO: 420013 - RNA, 64 nt, hsa; identical to SEQ ID NO: 108699

SEQ ID NO: 420014 - RNA, 64 nt, hsa; identical to SEQ ID NO: 108700

SEQ ID NO: 420015 - RNA, 64 nt, hsa; identical to SEQ ID NO: 108701

SEQ ID NO: 420016 - RNA, 64 nt, hsa; identical to SEQ ID NO: 108702

SEQ ID NO: 420017 - RNA, 64 nt, hsa; identical to SEQ ID NO: 108703

SEQ ID NO: 420018 - RNA, 64 nt, hsa; identical to SEQ ID NO: 108704

SEQ ID NO: 420019 - RNA, 64 nt, hsa; identical to SEQ ID NO: 108705

SEQ ID NO: 420020 - RNA, 64 nt, hsa; identical to SEQ ID NO: 108706

SEQ ID NO: 420021 - RNA, 64 nt, hsa; identical to SEQ ID NO: 108707

SEQ ID NO: 420022 - RNA, 64 nt, hsa; identical to SEQ ID NO: 108708

SEQ ID NO: 420023 - RNA, 64 nt, hsa; identical to SEQ ID NO: 108709

SEQ ID NO: 420024 - RNA, 64 nt, hsa; identical to SEQ ID NO: 108710

SEQ ID NO: 420025 - RNA, 64 nt, hsa; identical to SEQ ID NO: 108711

SEQ ID NO: 420026 - RNA, 64 nt, hsa; identical to SEQ ID NO: 108712

SEQ ID NO: 420027 - RNA, 64 nt, hsa; identical to SEQ ID NO: 108713

SEQ ID NO: 420028 - RNA, 64 nt, hsa; identical to SEQ ID NO: 108714

SEQ ID NO: 420029 - RNA, 64 nt, hsa; identical to SEQ ID NO: 108715

SEQ ID NO: 420030 - RNA, 64 nt, hsa; identical to SEQ ID NO: 108716

SEQ ID NO: 420031 - RNA, 64 nt, hsa; identical to SEQ ID NO: 108717

SEQ ID NO: 420032 - RNA, 64 nt, hsa; identical to SEQ ID NO: 108718

SEQ ID NO: 420033 - RNA, 64 nt, hsa; identical to SEQ ID NO: 108719

SEQ ID NO: 420034 - RNA, 64 nt, hsa; identical to SEQ ID NO: 108720

SEQ ID NO: 420035 - RNA, 64 nt, hsa; identical to SEQ ID NO: 108721

SEQ ID NO: 420036 - RNA, 64 nt, hsa; identical to SEQ ID NO: 108722

SEQ ID NO: 420037 - RNA, 64 nt, hsa; identical to SEQ ID NO: 108723

SEQ ID NO: 420038 - RNA, 64 nt, hsa; identical to SEQ ID NO: 108724

SEQ ID NO: 420039 - RNA, 64 nt, hsa; identical to SEQ ID NO: 108725

SEQ ID NO: 420040 - RNA, 64 nt, hsa; identical to SEQ ID NO: 108726

SEQ ID NO: 420041 - RNA, 64 nt, hsa; identical to SEQ ID NO: 108727

SEQ ID NO: 420042 - RNA, 64 nt, hsa; identical to SEQ ID NO: 108728

SEQ ID NO: 420043 - RNA, 64 nt, hsa; identical to SEQ ID NO: 108729

SEQ ID NO: 420044 - RNA, 64 nt, hsa; identical to SEQ ID NO: 108730

SEQ ID NO: 420045 - RNA, 64 nt, hsa; identical to SEQ ID NO: 108731

SEQ ID NO: 420046 - RNA, 64 nt, hsa; identical to SEQ ID NO: 108732

SEQ ID NO: 420047 - RNA, 64 nt, hsa; identical to SEQ ID NO: 108733

SEQ ID NO: 420048 - RNA, 64 nt, hsa; identical to SEQ ID NO: 108734

SEQ ID NO: 420049 - RNA, 64 nt, hsa; identical to SEQ ID NO: 108735

SEQ ID NO: 420050 - RNA, 64 nt, hsa; identical to SEQ ID NO: 108736

SEQ ID NO: 420051 - RNA, 64 nt, hsa; identical to SEQ ID NO: 108737

SEQ ID NO: 420052 - RNA, 64 nt, hsa; identical to SEQ ID NO: 108738

SEQ ID NO: 420053 - RNA, 64 nt, hsa; identical to SEQ ID NO: 108739

SEQ ID NO: 420054 - RNA, 64 nt, hsa; identical to SEQ ID NO: 108740

SEQ ID NO: 420055 - RNA, 64 nt, hsa; identical to SEQ ID NO: 108741

SEQ ID NO: 420056 - RNA, 64 nt, hsa; identical to SEQ ID NO: 108742

SEQ ID NO: 420057 - RNA, 64 nt, hsa; identical to SEQ ID NO: 108743

SEQ ID NO: 420058 - RNA, 64 nt, hsa; identical to SEQ ID NO: 108744

SEQ ID NO: 420059 - RNA, 64 nt, hsa; identical to SEQ ID NO: 108745

SEQ ID NO: 420060 - RNA, 64 nt, hsa; identical to SEQ ID NO: 108746

SEQ ID NO: 420061 - RNA, 64 nt, hsa; identical to SEQ ID NO: 108747

SEQ ID NO: 420062 - RNA, 64 nt, hsa; identical to SEQ ID NO: 108748

SEQ ID NO: 420063 - RNA, 64 nt, hsa; identical to SEQ ID NO: 108749

SEQ ID NO: 420064 - RNA, 64 nt, hsa; identical to SEQ ID NO: 108750

SEQ ID NO: 420065 - RNA, 64 nt, hsa; identical to SEQ ID NO: 108751

SEQ ID NO: 420066 - RNA, 64 nt, hsa; identical to SEQ ID NO: 108752

SEQ ID NO: 420067 - RNA, 64 nt, hsa; identical to SEQ ID NO: 108753

SEQ ID NO: 420068 - RNA, 64 nt, hsa; identical to SEQ ID NO: 108754

SEQ ID NO: 420069 - RNA, 64 nt, hsa; identical to SEQ ID NO: 108755

SEQ ID NO: 420070 - RNA, 64 nt, hsa; identical to SEQ ID NO: 108756

SEQ ID NO: 420071 - RNA, 64 nt, hsa; identical to SEQ ID NO: 108757

SEQ ID NO: 420072 - RNA, 64 nt, hsa; identical to SEQ ID NO: 108758

SEQ ID NO: 420073 - RNA, 64 nt, hsa; identical to SEQ ID NO: 108759

SEQ ID NO: 420074 - RNA, 64 nt, hsa; identical to SEQ ID NO: 108760

SEQ ID NO: 420075 - RNA, 64 nt, hsa; identical to SEQ ID NO: 108761

SEQ ID NO: 420076 - RNA, 64 nt, hsa; identical to SEQ ID NO: 108762

SEQ ID NO: 420077 - RNA, 64 nt, hsa; identical to SEQ ID NO: 108763

SEQ ID NO: 420078 - RNA, 64 nt, hsa; identical to SEQ ID NO: 108764

SEQ ID NO: 420079 - RNA, 64 nt, hsa; identical to SEQ ID NO: 108765

SEQ ID NO: 420080 - RNA, 50 nt, hsa
gauggagacgccaaacaugaaaguuagaagaacggaucaugugccaacug

SEQ ID NO: 420081 - RNA, 64 nt, hsa
uguggguauucuccagcauacuugaaaaugaauaaaguuagauugcucacauugaagcuaaugg

SEQ ID NO: 420082 - RNA, 64 nt, hsa
uuauuuuuuguuaagauauaaugggugauuauauaaguuagauuuauuuaugauaucaacuugg

SEQ ID NO: 420083 - RNA, 64 nt, hsa
agcuuaugaacauuggguucacaaggcauuggguaaguuagauaaaauagcauauacuuucucu

SEQ ID NO: 420084 - RNA, 64 nt, hsa
cguugaaaaaagaaugcacgugugaguuacuaaaaaguuagaauaaugugcaugggaacagugc

SEQ ID NO: 420085 - RNA, 64 nt, hsa
guuuaaauggggugggguuaaaguucagguaaguaaguuagagagaaaacauuguaugaucagc

SEQ ID NO: 420086 - RNA, 64 nt, hsa
ggcuacugcuuuacuaaggagaugugcaaugcugaaguuagaaacaagguuaauagccaggcau

SEQ ID NO: 420087 - RNA, 64 nt, hsa
gcacccuauauuucugcuucccucuauuuucuccaaguuagaggucaacauuugaaaagccuuu

SEQ ID NO: 420088 - RNA, 64 nt, hsa
uguguuuuguuccgggacugguuuggcugggacaaaguuagaacugccugaaguucgcacauuc

SEQ ID NO: 420089 - RNA, 64 nt, hsa
gacuuguccacagcagaugaggacagugagaauuaaguuagauccgagacugcgaagagcuucu

SEQ ID NO: 420090 - RNA, 64 nt, hsa
agguugcauguucacugccccuaauuccuaaagcaaguuagaaauuuuuagcauuuucuuugaa

SEQ ID NO: 420091 - RNA, 64 nt, hsa
ggguugcguguucacugcccccaauuccuaaagcaaguuagaaguuuuuagcauuuaaggugug

SEQ ID NO: 420092 - RNA, 59 nt, hsa
ccuaucauuuccguuuugccugugacuguaaagaguagccauucuuuucccauguauug

SEQ ID NO: 420093 - RNA, 59 nt, hsa
acugugcaguuuuguuugguuuacuuucaaaagaguagaaagcuugaaaagauucugaa

SEQ ID NO: 420094 - RNA, 59 nt, hsa
ucuagaauuuaaaguucuaagauuaguauaaagaguauauagauuguuaauccccacca

SEQ ID NO: 420095 - RNA, 59 nt, hsa
aaugaggcagguuuuuuucuguuuucuaaaaagaguaaccaagauaccuccaggguguc

SEQ ID NO: 420096 - RNA, 59 nt, hsa
gauaggcaaggaugaaagacaaagaaggaaaagaguaucaaaggcagaaaggagaucau

SEQ ID NO: 420097 - RNA, 59 nt, hsa
guguugcuuucugacugauccugaacaagaaagaguaacacugaggcgcucgcucccau

SEQ ID NO: 420098 - RNA, 57 nt, hsa
auuauugauucaaaauaaaaagaagccacaaagaguaauugaguuguuacugguuug

SEQ ID NO: 420099 - RNA, 59 nt, hsa
gcaauuaaggccaauugaauuaaguuuccaaagaguaaucuaggaaguggucaugggcu

SEQ ID NO: 420100 - RNA, 59 nt, hsa
uuagcagccacaaauuuccacugguaaccaaagaguaccuaaguaguuuuucauuauuu

SEQ ID NO: 420101 - RNA, 59 nt, hsa
uugagaagggaauuguuuaagggaaaagaaaagaguaauaauuuuuuuuaaaacauuaa

SEQ ID NO: 420102 - RNA, 59 nt, hsa
agucguuuuguuuaacgcugugugaauauaaagaguaguuugcagcugugugguagugg

SEQ ID NO: 420103 - RNA, 59 nt, hsa
aagaaagaaaugaagaaagaaaaugaugaaaagaguaguucaagaaguucuggagauaa

SEQ ID NO: 420104 - RNA, 59 nt, hsa
gugccgucuuucauagcuggucucuguauaaagaguauguagcaacaacuguuuaacau

SEQ ID NO: 420105 - RNA, 59 nt, hsa
gaaauauuuuuguuguuguuuuguuucuuaaagaguacagaggccauugaagccuuuug

SEQ ID NO: 420106 - RNA, 64 nt, hsa; identical to SEQ ID NO: 292892

SEQ ID NO: 420107 - RNA, 63 nt, hsa; identical to SEQ ID NO: 292893

SEQ ID NO: 420108 - RNA, 64 nt, hsa; identical to SEQ ID NO: 292894

SEQ ID NO: 420109 - RNA, 64 nt, hsa; identical to SEQ ID NO: 292895

SEQ ID NO: 420110 - RNA, 64 nt, hsa; identical to SEQ ID NO: 292896

SEQ ID NO: 420111 - RNA, 64 nt, hsa; identical to SEQ ID NO: 292897

SEQ ID NO: 420112 - RNA, 64 nt, hsa; identical to SEQ ID NO: 292898

SEQ ID NO: 420113 - RNA, 64 nt, hsa; identical to SEQ ID NO: 292899

SEQ ID NO: 420114 - RNA, 64 nt, hsa; identical to SEQ ID NO: 292900

SEQ ID NO: 420115 - RNA, 64 nt, hsa; identical to SEQ ID NO: 292901

SEQ ID NO: 420116 - RNA, 64 nt, hsa
uguaaggauuaagcagauagggagaagggaaaaggggccucacuuuagaaugaaugagucaccu

SEQ ID NO: 420117 - RNA, 64 nt, hsa
ggcuccagggccacuuuguuuguaaguaugaucugggccucaaaauaccauaguagcugcuuga

SEQ ID NO: 420118 - RNA, 64 nt, hsa
aggagcugggucuuggggcagcuuuauuccuguugggccucaguuucucuuccccacacaguuu

SEQ ID NO: 420119 - RNA, 64 nt, hsa
ccugagccuuucucccaaguuccagagccucuccgggccucagugcugccaucuguacaauggu

SEQ ID NO: 420120 - RNA, 64 nt, hsa
cgcccacaggaagccugcaguccuggaagcgcgagggccucaaaggcccgcucuacaucuucug

SEQ ID NO: 420121 - RNA, 64 nt, hsa
uucauuugagaaguaaacagauggcacuuugaaggggccucaccgagugggggcaucaucaaaa

SEQ ID NO: 420122 - RNA, 64 nt, hsa
guguguguagaaagccagcuggauguuugugguggggccucauggugccuaggaggagauaaag

SEQ ID NO: 420123 - RNA, 64 nt, hsa
cacgccacaggccucaggauggcuuuuugucugagggccucauuaggcccagacugcugcugcu

SEQ ID NO: 420124 - RNA, 64 nt, hsa
cgcacccccgggggccucagaacuaccccuuccagggccucagaacuaccccuacaguuucucc

SEQ ID NO: 420125 - RNA, 64 nt, hsa
acuccucccuggaccugcagcuccgcacccccgggggccucagaacuaccccuuccagggccuc

SEQ ID NO: 420126 - RNA, 64 nt, hsa
cucccgcccagcauccucccugaguccccacacagggccucacucugcaccccaccaggguccc

SEQ ID NO: 420127 - RNA, 64 nt, hsa
cugucccccaaggagucauggaacucaggguacugggccucaacgggaaccugagacagcucca

SEQ ID NO: 420128 - RNA, 64 nt, hsa
cguggggaacggaggaggacauggggagguuguggggccucaggcuccgggcaccaggggccaa

SEQ ID NO: 420129 - RNA, 64 nt, hsa
ugagggccgguucuaaggcucagacugggcacuggggccucagccugcuuuccugcagcagucg

SEQ ID NO: 420130 - RNA, 64 nt, hsa
cacgugccacgcuguagccacagaccccuugcucgggccucacccaaggccaaacuccaaacac

SEQ ID NO: 420131 - RNA, 64 nt, hsa
cgggaaccuggaagcugcgcugcucugcgccucugggccucacuguggacagaggagucaggcc

SEQ ID NO: 420132 - RNA, 64 nt, hsa
uggggauucaccuaccuggguccucacuuuccuggggccucaccugcuggagucuucgguggcc

SEQ ID NO: 420133 - RNA, 64 nt, hsa
ggaaccucauuuuccuggggccucaccugagugggggccucaucuaccuaaggacucguuugcc

SEQ ID NO: 420134 - RNA, 64 nt, hsa
uggggccugggcugccaggaaccucauuuuccuggggccucaccugagugggggccucaucuac

SEQ ID NO: 420135 - RNA, 64 nt, hsa
uggggccucggcugccuggggucucaccugccuggggccucaccugcuggagucuuugguggcc

SEQ ID NO: 420136 - RNA, 64 nt, hsa
auggggccugggcugccgggaccucacuuucccagggccucaccuaccuagggucucacuaguc

SEQ ID NO: 420137 - RNA, 64 nt, hsa
aguucuccuuucccaaguucucccgccugcgucggggccucaaagccgaggcugucaagggucc

SEQ ID NO: 420138 - RNA, 64 nt, hsa
cugaguggcccuggacaaaguuguuucucucccugggccucaguuuccccaucucuagaaugag

SEQ ID NO: 420139 - RNA, 64 nt, hsa
ccaccccaaaagcagcuccaacagaauggccagagggccucagggagcugcaaaacucauccag

SEQ ID NO: 420140 - RNA, 64 nt, hsa
cccucuggggaaagagcacaggaacugaguugcugggccucaaaacaaaaggcugcaggcacau

SEQ ID NO: 420141 - RNA, 64 nt, hsa
cacuuaaauuuuuucuuuauaaagcuuuuugaaggucauaaacaaagaccauaauugaugauag

SEQ ID NO: 420142 - RNA, 64 nt, hsa
gaaaguaaccaaaccaaauauuuaucugggcaaagucauaaauucuccacuugaaugcgcucau

SEQ ID NO: 420143 - RNA, 64 nt, hsa
gacagaucugaacacuuugcuucaugacuauuucgucauaaagguauauguuuaaaaucugaau

SEQ ID NO: 420144 - RNA, 64 nt, hsa
cauaauuccuuaccgaaaacaacugaaauugagagucauaaauacuguggguuagaauaaaaac

SEQ ID NO: 420145 - RNA, 64 nt, hsa
uauuuaguacuaaaaucacagucaugaaaucauagucauaaaauggucuucacacagcagucau

SEQ ID NO: 420146 - RNA, 64 nt, hsa
gaaguuuuguauauuuauuguauuaacacagagugucauaaaauaaaaugcuguuuacuggaug

SEQ ID NO: 420147 - RNA, 64 nt, hsa
uuuuagaauauuuuauguugcuugcacuauaggagucauaaaaggaacuuaguuaaaauauguu

SEQ ID NO: 420148 - RNA, 64 nt, hsa
auuuagguacaaacuuuauaaagaauguuaguaugucauaaaauauaacauuacagcuuauuua

SEQ ID NO: 420149 - RNA, 64 nt, hsa
acagagcuagacagauaagaugcauaguugaccagucauaaaaggcgguguuuaggugaucagg

SEQ ID NO: 420150 - RNA, 64 nt, hsa
uuugccaagaugcacaucgcuauuaacagccagagucauaaaugaaaugaaauugaagaauuca

SEQ ID NO: 420151 - RNA, 64 nt, hsa
gauucuuguuauuuuuaagucauaaauguagccagucauaaauacauaaauguuaaccuucggg

SEQ ID NO: 420152 - RNA, 64 nt, hsa
uccauaucuaauuccugauucuuguuauuuuuaagucauaaauguagccagucauaaauacaua

SEQ ID NO: 420153 - RNA, 64 nt, hsa
acauuagcaaaucuaugucuuguccugauucacugucauaaagcaugagcagaggcuagaagua

SEQ ID NO: 420154 - RNA, 64 nt, hsa
ugauuuaaaggauuagagaaaucuacaaauguaugucauaaauaagcaaauuuguaaacuuuuc

SEQ ID NO: 420155 - RNA, 64 nt, hsa
aggugagaugauaugaaaaacaaauuuucucacugucauaaaaggcucuaauuaugguuacuuu

SEQ ID NO: 420156 - RNA, 64 nt, hsa; identical to SEQ ID NO: 415481

SEQ ID NO: 420157 - RNA, 64 nt, hsa; identical to SEQ ID NO: 415482

SEQ ID NO: 420158 - RNA, 64 nt, hsa; identical to SEQ ID NO: 415483

SEQ ID NO: 420159 - RNA, 64 nt, hsa; identical to SEQ ID NO: 415484

SEQ ID NO: 420160 - RNA, 64 nt, hsa; identical to SEQ ID NO: 415485

SEQ ID NO: 420161 - RNA, 64 nt, hsa; identical to SEQ ID NO: 415486

SEQ ID NO: 420162 - RNA, 64 nt, hsa; identical to SEQ ID NO: 415487

SEQ ID NO: 420163 - RNA, 64 nt, hsa; identical to SEQ ID NO: 415488

SEQ ID NO: 420164 - RNA, 64 nt, hsa; identical to SEQ ID NO: 415489

SEQ ID NO: 420165 - RNA, 64 nt, hsa; identical to SEQ ID NO: 415490

SEQ ID NO: 420166 - RNA, 64 nt, hsa; identical to SEQ ID NO: 415491

SEQ ID NO: 420167 - RNA, 64 nt, hsa; identical to SEQ ID NO: 415492

SEQ ID NO: 420168 - RNA, 64 nt, hsa; identical to SEQ ID NO: 415493

SEQ ID NO: 420169 - RNA, 64 nt, hsa; identical to SEQ ID NO: 415494

SEQ ID NO: 420170 - RNA, 64 nt, hsa; identical to SEQ ID NO: 415495

SEQ ID NO: 420171 - RNA, 64 nt, hsa; identical to SEQ ID NO: 415496

SEQ ID NO: 420172 - RNA, 64 nt, hsa; identical to SEQ ID NO: 415497

SEQ ID NO: 420173 - RNA, 64 nt, hsa; identical to SEQ ID NO: 415498

SEQ ID NO: 420174 - RNA, 64 nt, hsa; identical to SEQ ID NO: 415499

SEQ ID NO: 420175 - RNA, 64 nt, hsa; identical to SEQ ID NO: 415500

SEQ ID NO: 420176 - RNA, 64 nt, hsa; identical to SEQ ID NO: 415501

SEQ ID NO: 420177 - RNA, 64 nt, hsa; identical to SEQ ID NO: 415502

SEQ ID NO: 420178 - RNA, 58 nt, hsa; identical to SEQ ID NO: 415503

SEQ ID NO: 420179 - RNA, 64 nt, hsa; identical to SEQ ID NO: 415504

SEQ ID NO: 420180 - RNA, 64 nt, hsa; identical to SEQ ID NO: 415505

SEQ ID NO: 420181 - RNA, 64 nt, hsa; identical to SEQ ID NO: 415506

SEQ ID NO: 420182 - RNA, 64 nt, hsa; identical to SEQ ID NO: 415507

SEQ ID NO: 420183 - RNA, 64 nt, hsa; identical to SEQ ID NO: 415508

SEQ ID NO: 420184 - RNA, 64 nt, hsa; identical to SEQ ID NO: 415509

SEQ ID NO: 420185 - RNA, 64 nt, hsa; identical to SEQ ID NO: 415510

SEQ ID NO: 420186 - RNA, 64 nt, hsa; identical to SEQ ID NO: 415511

SEQ ID NO: 420187 - RNA, 64 nt, hsa; identical to SEQ ID NO: 415512

SEQ ID NO: 420188 - RNA, 63 nt, hsa; identical to SEQ ID NO: 415513

SEQ ID NO: 420189 - RNA, 64 nt, hsa; identical to SEQ ID NO: 415514

SEQ ID NO: 420190 - RNA, 64 nt, hsa; identical to SEQ ID NO: 415515

SEQ ID NO: 420191 - RNA, 64 nt, hsa; identical to SEQ ID NO: 415516

SEQ ID NO: 420192 - RNA, 64 nt, hsa; identical to SEQ ID NO: 415517

SEQ ID NO: 420193 - RNA, 64 nt, hsa; identical to SEQ ID NO: 415518

SEQ ID NO: 420194 - RNA, 64 nt, hsa; identical to SEQ ID NO: 415519

SEQ ID NO: 420195 - RNA, 64 nt, hsa; identical to SEQ ID NO: 415520

SEQ ID NO: 420196 - RNA, 64 nt, hsa; identical to SEQ ID NO: 415521

SEQ ID NO: 420197 - RNA, 57 nt, hsa; identical to SEQ ID NO: 415522

SEQ ID NO: 420198 - RNA, 64 nt, hsa; identical to SEQ ID NO: 415523

SEQ ID NO: 420199 - RNA, 64 nt, hsa; identical to SEQ ID NO: 415524

SEQ ID NO: 420200 - RNA, 64 nt, hsa; identical to SEQ ID NO: 415525

SEQ ID NO: 420201 - RNA, 64 nt, hsa
auaauaaacucagucauauauagugaacaguucaaaugggaaaguguucuaaaacauauuauuu

SEQ ID NO: 420202 - RNA, 64 nt, hsa
ugcaaaauugugugaaaucaccuuaucaaauuaaaaugggaagaaaguaauuuuaauaauuuuu

SEQ ID NO: 420203 - RNA, 64 nt, hsa
aaaaaaaaaagcaaaugggauuaaggacucauggaaugggaaggggaaggggagucuuacuaua

SEQ ID NO: 420204 - RNA, 64 nt, hsa
uuccucaagcucccugccaaccucuggauacaucaaugggaaggaaaccagggaagcauagacc

SEQ ID NO: 420205 - RNA, 64 nt, hsa
augcuggauggaugcaggaaggaauggaggaaugaaugggaagggagaacauaucuauccucuc

SEQ ID NO: 420206 - RNA, 64 nt, hsa
cccuggggcuagagguggaggaggcaguccugggaaugggaaaaaccccaacuuuggggucaua

SEQ ID NO: 420207 - RNA, 64 nt, hsa
uucuugcauugcuguauacaccucaugcuuaugcaaugggaagaauaugggggccagggggugu

SEQ ID NO: 420208 - RNA, 64 nt, hsa
cugcuguauguauagaggagcugaggugcugucuaaugggaaaugugauuugauugauuuauuu

SEQ ID NO: 420209 - RNA, 64 nt, hsa
gaaauagcaccuuccuuagguuucauggacaaauaaugggaacuucuaauuuugaucaauccca

SEQ ID NO: 420210 - RNA, 64 nt, hsa
cucacuaaucucccguuagccaaaauaugccagaaaugggaaagagaggagaaaaagucauuaa

SEQ ID NO: 420211 - RNA, 64 nt, hsa
ggcaaucauaagaaacaucugaauaacaacgaugaaugggaaacuaguguugaaauaggauuca

SEQ ID NO: 420212 - RNA, 64 nt, hsa
uuuuuccuuuuuaauaugaguaaugcuuuauaaaaaugggaaaaaaaguauacuuaaggaucug

SEQ ID NO: 420213 - RNA, 64 nt, hsa
aauauuaaaaucauuccuguccauuccacuuguaaaugggaauucaugaaauuaaauauuacuu

SEQ ID NO: 420214 - RNA, 64 nt, hsa
uuuaaagacauuugaggggaggaggauuauuaugaaugggaaaaaaagauuuugguugagacua

SEQ ID NO: 420215 - RNA, 64 nt, hsa
aaagcagcuuuuaguucagacuuaguuuuuauaaaaugggaauucugacuuacuuaaccagguu

SEQ ID NO: 420216 - RNA, 64 nt, hsa
cauacaaaaaaaaucuuuaaugguuaauaggaugaaugggaaaguauuuuugaaagaauucuau

SEQ ID NO: 420217 - RNA, 64 nt, hsa
auaaaauauuucggauaagguuucauaauuuacaaaugggaauuucauuuauaauaauaaauau

SEQ ID NO: 420218 - RNA, 64 nt, hsa
ccacuaaugguguaaaagagaccaguagauuuucaaugggaaauguaccuagcaagcugguucu

SEQ ID NO: 420219 - RNA, 64 nt, hsa
gagaauccacagugcuacagacaauaagugauaaaaugggaaaaaauagugaagaucuucuuuu

SEQ ID NO: 420220 - RNA, 64 nt, hsa
aucuuuagggacuucuaaugaaaaggguauaugaaaugggaacaauaaauucuguacauguaua

SEQ ID NO: 420221 - RNA, 64 nt, hsa
uugacaccuguuacccauuaggggugauaacauuaaugggaagaaaugauggcaacuuugaaug

SEQ ID NO: 420222 - RNA, 64 nt, hsa
cuuggagaacucugccuuccaucaacugcaguguaaugggaaagaggguggugagguuuugaaa

SEQ ID NO: 420223 - RNA, 64 nt, hsa
cuaauuaaaacagaaaugggaauuauugcacagaaaugggaaauaacuaauuuuaaaucaguca

SEQ ID NO: 420224 - RNA, 64 nt, hsa
agggccauagaaguaugaaucuaauuaaaacagaaaugggaauuauugcacagaaaugggaaau

SEQ ID NO: 420225 - RNA, 64 nt, hsa
ggaaaacauuagcuuaugcuucuuuagauggaauaaugggaaaggagggaaaugggaaauggau

SEQ ID NO: 420226 - RNA, 64 nt, hsa
ugcuucuuuagauggaauaaugggaaaggagggaaaugggaaauggauggaaaugggaaaggag

SEQ ID NO: 420227 - RNA, 64 nt, hsa
uaaugggaaaggagggaaaugggaaauggauggaaaugggaaaggagggaaaauaauagcccag

SEQ ID NO: 420228 - RNA, 64 nt, hsa
acggccuugagacaauaagguggagcaacagaacaaugggaaagaggacugggagaggaaucua

SEQ ID NO: 420229 - RNA, 64 nt, hsa
uuaaccucucuguauagaauuuucacaucuuuaaaaugggaauaauaguaccuaccucauaggg

SEQ ID NO: 420230 - RNA, 64 nt, hsa
acaauuuagacucuaaaaagucuuuucaaaaagaaaugggaaauaggcagacuguuuauguuaa

SEQ ID NO: 420231 - RNA, 64 nt, hsa
aagaagcugauuuugcuaaacuccuguucccuacaaugggaaaugucacaagaaugugcaaaaa

SEQ ID NO: 420232 - RNA, 64 nt, hsa
ucggccacaggcucaacgggacaugcaacauaaaaaugggaagguuauuuaaacaacaaaaaac

SEQ ID NO: 420233 - RNA, 64 nt, hsa
agacucaagaccaugaccuucuuugauccuugaaaaugggaacuuugacagccaugaccaugaa

SEQ ID NO: 420234 - RNA, 64 nt, hsa
cuguuaggugccugcccucaguauagacguauccaaugggaaaacagcggaccugcccagagca

SEQ ID NO: 420235 - RNA, 64 nt, hsa
gccucgucucgucccagaggcauuggaucaggagaaugggaauuuuuuuccucccaccuggaca

SEQ ID NO: 420236 - RNA, 64 nt, hsa
cgcaaccugggaucucaaggagcuuuaaagucuuaaugggaacuuggcauuuuccugaugaucu

SEQ ID NO: 420237 - RNA, 64 nt, hsa
uuauugucaaggggaguuuuuacauggaaaugacaaugggaaaauucagauauuuucuuaguag

SEQ ID NO: 420238 - RNA, 64 nt, hsa
aaggcaggaacauuggagccugcaauaagggaaaaaugggaacuggagaguguggggaauggga

SEQ ID NO: 420239 - RNA, 64 nt, hsa
aauaagggaaaaaugggaacuggagaguguggggaaugggaagaagcaguuuacuuuagacuaa

SEQ ID NO: 420240 - RNA, 64 nt, hsa; identical to SEQ ID NO: 81180

SEQ ID NO: 420241 - RNA, 64 nt, hsa; identical to SEQ ID NO: 81181

SEQ ID NO: 420242 - RNA, 64 nt, hsa; identical to SEQ ID NO: 81204

SEQ ID NO: 420243 - RNA, 64 nt, hsa; identical to SEQ ID NO: 81205

SEQ ID NO: 420244 - RNA, 64 nt, hsa; identical to SEQ ID NO: 81232

SEQ ID NO: 420245 - RNA, 64 nt, hsa; identical to SEQ ID NO: 81233

SEQ ID NO: 420246 - RNA, 64 nt, hsa; identical to SEQ ID NO: 81241

SEQ ID NO: 420247 - RNA, 64 nt, hsa; identical to SEQ ID NO: 81242

SEQ ID NO: 420248 - RNA, 64 nt, hsa; identical to SEQ ID NO: 81294

SEQ ID NO: 420249 - RNA, 64 nt, hsa; identical to SEQ ID NO: 81295

SEQ ID NO: 420250 - RNA, 64 nt, hsa; identical to SEQ ID NO: 81311

SEQ ID NO: 420251 - RNA, 64 nt, hsa; identical to SEQ ID NO: 81312

SEQ ID NO: 420252 - RNA, 64 nt, hsa; identical to SEQ ID NO: 81313

SEQ ID NO: 420253 - RNA, 64 nt, hsa; identical to SEQ ID NO: 81314

SEQ ID NO: 420254 - RNA, 64 nt, hsa; identical to SEQ ID NO: 81315

SEQ ID NO: 420255 - RNA, 64 nt, hsa; identical to SEQ ID NO: 81413

SEQ ID NO: 420256 - RNA, 64 nt, hsa; identical to SEQ ID NO: 81414

SEQ ID NO: 420257 - RNA, 64 nt, hsa; identical to SEQ ID NO: 81424

SEQ ID NO: 420258 - RNA, 64 nt, hsa; identical to SEQ ID NO: 81425

SEQ ID NO: 420259 - RNA, 64 nt, hsa; identical to SEQ ID NO: 81444

SEQ ID NO: 420260 - RNA, 64 nt, hsa; identical to SEQ ID NO: 81445

SEQ ID NO: 420261 - RNA, 64 nt, hsa; identical to SEQ ID NO: 81449

SEQ ID NO: 420262 - RNA, 64 nt, hsa; identical to SEQ ID NO: 81450

SEQ ID NO: 420263 - RNA, 64 nt, hsa; identical to SEQ ID NO: 81554

SEQ ID NO: 420264 - RNA, 64 nt, hsa; identical to SEQ ID NO: 81555

SEQ ID NO: 420265 - RNA, 64 nt, hsa; identical to SEQ ID NO: 81577

SEQ ID NO: 420266 - RNA, 64 nt, hsa; identical to SEQ ID NO: 81578

SEQ ID NO: 420267 - RNA, 64 nt, hsa
aaauguauggcaucuuuuccuugcaaauucuuccaguuuccaagugagaaggggagcagguguu

SEQ ID NO: 420268 - RNA, 64 nt, hsa
gcuaucucuaucuuagaaagcaaaaacaaacaggaguuuccagggagaaugggaaagccagggg

SEQ ID NO: 420269 - RNA, 64 nt, hsa
caaaagauacaaccacauaauguauauaauuccuaguuuccauauuuauccgcauguaaagggc

SEQ ID NO: 420270 - RNA, 64 nt, hsa
uauuuauggcuagaagaacucguauguacacuuuaguuuccagaacuguuugguaaccuuucgu

SEQ ID NO: 420271 - RNA, 64 nt, hsa
uaguuuaauuguuucagguggaaaguauucuuugaguuuccauauugaauguguuuggacuaaa

SEQ ID NO: 420272 - RNA, 64 nt, hsa
cuauugcauauauuuuggggacacagauuuucauaguuuccauuuuuggggggcuuaaggauuu

SEQ ID NO: 420273 - RNA, 64 nt, hsa
cuaauuuuuggucauagaaaaucugcaucaaaucaguuuccaugcaucaguaauauugaagguc

SEQ ID NO: 420274 - RNA, 63 nt, hsa
aaggagaagccaacacuugauagcacuacuuggaguuuccaugaauaagauggagaaagcuca

SEQ ID NO: 420275 - RNA, 64 nt, hsa
uuuuagauuugugcacccauuggcaaaacaggaaaguuuccagauagguauuguaucauugaga

SEQ ID NO: 420276 - RNA, 64 nt, hsa
aaguuugaaaugguuaacaguaaauuauuauguuaguuuccaggcacuugaacugugcuacaag

SEQ ID NO: 420277 - RNA, 64 nt, hsa
ggaagucauuccacccucaauuuguugauccacaaguuuccaguuguccucuucuuuuuguuau

SEQ ID NO: 420278 - RNA, 64 nt, hsa
caggcuuauaccuuccauuuccaucguauucuccaguuuccaggauagacguugcucaucgucu

SEQ ID NO: 420279 - RNA, 60 nt, hsa
cacaucacuugcccaucugagcacuaaagaaguuuccauaaggaauaaaaccuugucuuc

SEQ ID NO: 420280 - RNA, 64 nt, hsa
aguaagaugcauaaaaucaauccacuacugaaauaguuuccagucagacauuucugaguucaga

SEQ ID NO: 420281 - RNA, 64 nt, hsa
uuacauuuaaauagauuagugggaaaacuuuaagaguuuccacauauuaguuuucauuuuuuga

SEQ ID NO: 420282 - RNA, 64 nt, hsa
acuauuuguguuuaccagaguugggagauaagauaguuuccaugaagguguguauguuuuauac

SEQ ID NO: 420283 - RNA, 64 nt, hsa
cacaggucagucugcgugaaagcccuuuguggggaguuuccaagccagugucguuuuugcacug

SEQ ID NO: 420284 - RNA, 64 nt, hsa
caccucacugucagauauuguucuuuugauaugcaguuuccagcccuccaaugaguccccagca

SEQ ID NO: 420285 - RNA, 64 nt, hsa
aggagcuuuucagaauagcgucugcagcagaaccaguuuccauucagagcgcguccuuggugga

SEQ ID NO: 420286 - RNA, 64 nt, hsa
uguggugacauaaacuagacauggggugcccucaaguuuccaaggggaccaaugugccacuguu

SEQ ID NO: 420287 - RNA, 64 nt, hsa
aaaacauuuuuaaaauagcaaauguuaauauuccaguuuccauugguaggaaauuuuuuaggua

SEQ ID NO: 420288 - RNA, 64 nt, hsa
gguugauagcuaccaaugggacaguguagaaacaaguuuccaccuuucuaaaaccaguuuggua

SEQ ID NO: 420289 - RNA, 64 nt, hsa
gggaggccucauuggccacuuagagcgcagccugaguuuccaggccccuuccugggagaggcug

SEQ ID NO: 420290 - RNA, 64 nt, hsa
uuugaaugcagaagggagcagcuccuccuaguuaaguuuccacuaaaucaucgccaaagaggac

SEQ ID NO: 420291 - RNA, 64 nt, hsa
ugucuggagagaagcugugguguguaugcuguagaguuuccacauuucacaugcaguguacucc

SEQ ID NO: 420292 - RNA, 64 nt, hsa
gauugcaguauucauuaucugcaucuaauuugguaguuuccacaaucguauuugaugaaagaaa

SEQ ID NO: 420293 - RNA, 64 nt, hsa
auucuugguauauucuuguguuaacugcccauuggccugaaaauacucauuguaagccugaaaa

SEQ ID NO: 420294 - RNA, 64 nt, hsa
uaacugcccauuggccugaaaauacucauuguaagccugaaaaaaaaaaucuuucccacuguuu

SEQ ID NO: 420295 - RNA, 64 nt, hsa
aaaaaaauaaaaagaaaugagggcagguuccagggccugaaauguagguaugcugcaaggcuuu

SEQ ID NO: 420296 - RNA, 64 nt, hsa
aaaagaaaacuacauggggaaccagaagaccuaagccugaaaucccagcccugccccuaacuaa

SEQ ID NO: 420297 - RNA, 64 nt, hsa
agccaugguuucauucuuaucaguccaacccuuugccugaaacauugaaucuuguuaaaccaca

SEQ ID NO: 420298 - RNA, 64 nt, hsa
cccagccgucaccagacaacagaauaaucaaucugccugaaaaucccuccuccuuguccuacac

SEQ ID NO: 420299 - RNA, 64 nt, hsa
guaaagaagguggaauaauugacggggagauagcgccugaaauaaacaaaauaugggcaugcau

SEQ ID NO: 420300 - RNA, 64 nt, hsa
uucaaaguuuuguacaaaauuauauggauuuugugccugaaaauaauagagcuugagcugucug

SEQ ID NO: 420301 - RNA, 64 nt, hsa
cuauugggcuuuauuuggacaaaccaaacuuuuagccugaaaccaacuuuaugccacuaaguca

SEQ ID NO: 420302 - RNA, 64 nt, hsa
cucaguugucccaguuauuuguccuccugaaaaugccugaaacaucagacagacauugcuugcu

SEQ ID NO: 420303 - RNA, 64 nt, hsa
auuaaaaauauacaauuucuugaacucaggacuagccugaaaauccaaaaugcauguagaguug

SEQ ID NO: 420304 - RNA, 64 nt, hsa
uggaguggucacaggauucucuucucagaacucugccugaaaccuuuccgguguguuuugucuu

SEQ ID NO: 420305 - RNA, 64 nt, hsa
agugcaguggggugcaagggcuuuguuucugccugccugaaagagagggcucuggggauggaga

SEQ ID NO: 420306 - RNA, 64 nt, hsa
gucauggcauuuaguucagaguggaggggcuuuggccugaaauaaaaugcaaguauuuaagauu

SEQ ID NO: 420307 - RNA, 64 nt, hsa
ccaggagcagaagcaaagagcagacacacauacagccugaaacagaccuggacagacagacaca

SEQ ID NO: 420308 - RNA, 64 nt, hsa
uacagccugaaacagaccuggacagacagacacagccugaaacagacccggacagacagacaca

SEQ ID NO: 420309 - RNA, 64 nt, hsa
cacagccugaaacagacccggacagacagacacagccugaaacagacccagacaaacagacaga

SEQ ID NO: 420310 - RNA, 64 nt, hsa
gaaacagacccagacaaacagacagacagacacagccugaaacagacccagacagacagacaga

SEQ ID NO: 420311 - RNA, 64 nt, hsa
cagccugaaacagacccagacagacagacagacagccugaaacagacccagacacagccugaaa

SEQ ID NO: 420312 - RNA, 64 nt, hsa
gacagacagacagccugaaacagacccagacacagccugaaacagauccggacagacagacaga

SEQ ID NO: 420313 - RNA, 64 nt, hsa
gccugaaacagauccggacagacagacagaaacagccugaaacagacccagacagacagacaga

SEQ ID NO: 420314 - RNA, 64 nt, hsa
gccugaaacagacccagacagacagacagacacagccugaaacagacccggacagacagacaga

SEQ ID NO: 420315 - RNA, 64 nt, hsa
gccugaaacagacccggacagacagacagacacagccugaaacagacccggacagacagacaga

SEQ ID NO: 420316 - RNA, 64 nt, hsa; identical to SEQ ID NO: 420315

SEQ ID NO: 420317 - RNA, 64 nt, hsa
gccugaaacagacccggacagacagacagacacagccugaaacagaccuagacagacagacaca

SEQ ID NO: 420318 - RNA, 64 nt, hsa
gauugaaacagacccagacaaacagacagacacagccugaaacagacccagacacagccugaaa

SEQ ID NO: 420319 - RNA, 64 nt, hsa
cagacagacacagccugaaacagacccagacacagccugaaacagacccggacagacagacaga

SEQ ID NO: 420320 - RNA, 64 nt, hsa
gccugaaacagacccggacagacagacagacacagccugaaacagacccagacagacagacaga

SEQ ID NO: 420321 - RNA, 64 nt, hsa
gccugaaacagacccagacagacagacagacacagccugaaacagacccagacagacagaccga

SEQ ID NO: 420322 - RNA, 64 nt, hsa
gccugaaacagacccagacagacagaccgacgcagccugaaagagacccagacagagagacagg

SEQ ID NO: 420323 - RNA, 64 nt, hsa
cuacuaauuuaaacuaagacaguuuaaaaaggaagccugaaaaagacucauacuacaaauaauu

SEQ ID NO: 420324 - RNA, 64 nt, hsa
ugguccuuggccgccuccugcuccugcucugcaagccugaaacuggcuugucuggagccaggag

SEQ ID NO: 420325 - RNA, 64 nt, hsa
auggacaaauauuuuucuccccuugcucuuccuggccugaaacacgggaaaccagagucaaaag

SEQ ID NO: 420326 - RNA, 64 nt, hsa
ugaugccuugagauuuuuuucugcguuguuuaaugccugaaauccaagucuuccuccaugggaa

SEQ ID NO: 420327 - RNA, 64 nt, hsa; identical to SEQ ID NO: 316995

SEQ ID NO: 420328 - RNA, 64 nt, hsa; identical to SEQ ID NO: 316996

SEQ ID NO: 420329 - RNA, 64 nt, hsa; identical to SEQ ID NO: 316997

SEQ ID NO: 420330 - RNA, 64 nt, hsa; identical to SEQ ID NO: 316998

SEQ ID NO: 420331 - RNA, 64 nt, hsa; identical to SEQ ID NO: 316999

SEQ ID NO: 420332 - RNA, 64 nt, hsa; identical to SEQ ID NO: 317000

SEQ ID NO: 420333 - RNA, 64 nt, hsa; identical to SEQ ID NO: 317001

SEQ ID NO: 420334 - RNA, 64 nt, hsa; identical to SEQ ID NO: 317002

SEQ ID NO: 420335 - RNA, 64 nt, hsa; identical to SEQ ID NO: 317003

SEQ ID NO: 420336 - RNA, 60 nt, hsa; identical to SEQ ID NO: 317004

SEQ ID NO: 420337 - RNA, 64 nt, hsa; identical to SEQ ID NO: 317005

SEQ ID NO: 420338 - RNA, 64 nt, hsa; identical to SEQ ID NO: 317006

SEQ ID NO: 420339 - RNA, 64 nt, hsa; identical to SEQ ID NO: 317007

SEQ ID NO: 420340 - RNA, 64 nt, hsa; identical to SEQ ID NO: 317008

SEQ ID NO: 420341 - RNA, 64 nt, hsa; identical to SEQ ID NO: 317009

SEQ ID NO: 420342 - RNA, 64 nt, hsa; identical to SEQ ID NO: 317010

SEQ ID NO: 420343 - RNA, 64 nt, hsa; identical to SEQ ID NO: 317011

SEQ ID NO: 420344 - RNA, 64 nt, hsa; identical to SEQ ID NO: 317012

SEQ ID NO: 420345 - RNA, 64 nt, hsa; identical to SEQ ID NO: 317013

SEQ ID NO: 420346 - RNA, 64 nt, hsa; identical to SEQ ID NO: 317014

SEQ ID NO: 420347 - RNA, 64 nt, hsa; identical to SEQ ID NO: 317015

SEQ ID NO: 420348 - RNA, 64 nt, hsa; identical to SEQ ID NO: 317016

SEQ ID NO: 420349 - RNA, 64 nt, hsa; identical to SEQ ID NO: 317017

SEQ ID NO: 420350 - RNA, 64 nt, hsa; identical to SEQ ID NO: 317018

SEQ ID NO: 420351 - RNA, 64 nt, hsa; identical to SEQ ID NO: 317019

SEQ ID NO: 420352 - RNA, 64 nt, hsa; identical to SEQ ID NO: 317020

SEQ ID NO: 420353 - RNA, 64 nt, hsa; identical to SEQ ID NO: 317021

SEQ ID NO: 420354 - RNA, 62 nt, hsa; identical to SEQ ID NO: 317022

SEQ ID NO: 420355 - RNA, 64 nt, hsa; identical to SEQ ID NO: 317023

SEQ ID NO: 420356 - RNA, 64 nt, hsa; identical to SEQ ID NO: 317024

SEQ ID NO: 420357 - RNA, 64 nt, hsa; identical to SEQ ID NO: 317025

SEQ ID NO: 420358 - RNA, 64 nt, hsa; identical to SEQ ID NO: 317026

SEQ ID NO: 420359 - RNA, 64 nt, hsa; identical to SEQ ID NO: 317027

SEQ ID NO: 420360 - RNA, 64 nt, hsa; identical to SEQ ID NO: 317028

SEQ ID NO: 420361 - RNA, 64 nt, hsa; identical to SEQ ID NO: 317029

SEQ ID NO: 420362 - RNA, 53 nt, hsa; identical to SEQ ID NO: 317030

SEQ ID NO: 420363 - RNA, 54 nt, hsa; identical to SEQ ID NO: 317031

SEQ ID NO: 420364 - RNA, 64 nt, hsa; identical to SEQ ID NO: 317032

SEQ ID NO: 420365 - RNA, 64 nt, hsa; identical to SEQ ID NO: 317033

SEQ ID NO: 420366 - RNA, 64 nt, hsa; identical to SEQ ID NO: 317034

SEQ ID NO: 420367 - RNA, 64 nt, hsa; identical to SEQ ID NO: 317035

SEQ ID NO: 420368 - RNA, 64 nt, hsa; identical to SEQ ID NO: 317036

SEQ ID NO: 420369 - RNA, 64 nt, hsa; identical to SEQ ID NO: 317037

SEQ ID NO: 420370 - RNA, 64 nt, hsa; identical to SEQ ID NO: 317038

SEQ ID NO: 420371 - RNA, 64 nt, hsa; identical to SEQ ID NO: 317039

SEQ ID NO: 420372 - RNA, 64 nt, hsa; identical to SEQ ID NO: 317040

SEQ ID NO: 420373 - RNA, 64 nt, hsa; identical to SEQ ID NO: 317041

SEQ ID NO: 420374 - RNA, 64 nt, hsa; identical to SEQ ID NO: 317042

SEQ ID NO: 420375 - RNA, 64 nt, hsa; identical to SEQ ID NO: 317043

SEQ ID NO: 420376 - RNA, 64 nt, hsa; identical to SEQ ID NO: 317044

SEQ ID NO: 420377 - RNA, 64 nt, hsa; identical to SEQ ID NO: 317045

SEQ ID NO: 420378 - RNA, 64 nt, hsa; identical to SEQ ID NO: 317046

SEQ ID NO: 420379 - RNA, 64 nt, hsa; identical to SEQ ID NO: 317047

SEQ ID NO: 420380 - RNA, 64 nt, hsa; identical to SEQ ID NO: 317048

SEQ ID NO: 420381 - RNA, 64 nt, hsa; identical to SEQ ID NO: 317049

SEQ ID NO: 420382 - RNA, 64 nt, hsa; identical to SEQ ID NO: 317050

SEQ ID NO: 420383 - RNA, 64 nt, hsa; identical to SEQ ID NO: 317051

SEQ ID NO: 420384 - RNA, 64 nt, hsa; identical to SEQ ID NO: 317052

SEQ ID NO: 420385 - RNA, 64 nt, hsa; identical to SEQ ID NO: 317053

SEQ ID NO: 420386 - RNA, 64 nt, hsa; identical to SEQ ID NO: 317054

SEQ ID NO: 420387 - RNA, 64 nt, hsa; identical to SEQ ID NO: 317055

SEQ ID NO: 420388 - RNA, 64 nt, hsa; identical to SEQ ID NO: 317056

SEQ ID NO: 420389 - RNA, 64 nt, hsa; identical to SEQ ID NO: 317057

SEQ ID NO: 420390 - RNA, 64 nt, hsa; identical to SEQ ID NO: 317058

SEQ ID NO: 420391 - RNA, 64 nt, hsa; identical to SEQ ID NO: 317059

SEQ ID NO: 420392 - RNA, 64 nt, hsa; identical to SEQ ID NO: 317060

SEQ ID NO: 420393 - RNA, 64 nt, hsa; identical to SEQ ID NO: 317061

SEQ ID NO: 420394 - RNA, 64 nt, hsa; identical to SEQ ID NO: 317062

SEQ ID NO: 420395 - RNA, 64 nt, hsa; identical to SEQ ID NO: 317063

SEQ ID NO: 420396 - RNA, 64 nt, hsa; identical to SEQ ID NO: 317064

SEQ ID NO: 420397 - RNA, 55 nt, hsa; identical to SEQ ID NO: 317065

SEQ ID NO: 420398 - RNA, 64 nt, hsa; identical to SEQ ID NO: 317066

SEQ ID NO: 420399 - RNA, 63 nt, hsa; identical to SEQ ID NO: 317067

SEQ ID NO: 420400 - RNA, 64 nt, hsa; identical to SEQ ID NO: 317068

SEQ ID NO: 420401 - RNA, 64 nt, hsa; identical to SEQ ID NO: 317069

SEQ ID NO: 420402 - RNA, 64 nt, hsa; identical to SEQ ID NO: 317070

SEQ ID NO: 420403 - RNA, 64 nt, hsa; identical to SEQ ID NO: 317071

SEQ ID NO: 420404 - RNA, 64 nt, hsa; identical to SEQ ID NO: 317072

SEQ ID NO: 420405 - RNA, 64 nt, hsa; identical to SEQ ID NO: 317073

SEQ ID NO: 420406 - RNA, 64 nt, hsa; identical to SEQ ID NO: 317074

SEQ ID NO: 420407 - RNA, 64 nt, hsa; identical to SEQ ID NO: 317075

SEQ ID NO: 420408 - RNA, 64 nt, hsa; identical to SEQ ID NO: 317076

SEQ ID NO: 420409 - RNA, 64 nt, hsa; identical to SEQ ID NO: 317077

SEQ ID NO: 420410 - RNA, 64 nt, hsa; identical to SEQ ID NO: 317078

SEQ ID NO: 420411 - RNA, 64 nt, hsa; identical to SEQ ID NO: 317079

SEQ ID NO: 420412 - RNA, 64 nt, hsa; identical to SEQ ID NO: 317080

SEQ ID NO: 420413 - RNA, 64 nt, hsa; identical to SEQ ID NO: 317081

SEQ ID NO: 420414 - RNA, 64 nt, hsa; identical to SEQ ID NO: 317082

SEQ ID NO: 420415 - RNA, 64 nt, hsa; identical to SEQ ID NO: 317083

SEQ ID NO: 420416 - RNA, 64 nt, hsa; identical to SEQ ID NO: 317084

SEQ ID NO: 420417 - RNA, 64 nt, hsa; identical to SEQ ID NO: 317085

SEQ ID NO: 420418 - RNA, 64 nt, hsa; identical to SEQ ID NO: 317086

SEQ ID NO: 420419 - RNA, 64 nt, hsa; identical to SEQ ID NO: 317087

SEQ ID NO: 420420 - RNA, 64 nt, hsa; identical to SEQ ID NO: 317088

SEQ ID NO: 420421 - RNA, 64 nt, hsa; identical to SEQ ID NO: 317089

SEQ ID NO: 420422 - RNA, 64 nt, hsa; identical to SEQ ID NO: 317090

SEQ ID NO: 420423 - RNA, 64 nt, hsa; identical to SEQ ID NO: 316995

SEQ ID NO: 420424 - RNA, 64 nt, hsa; identical to SEQ ID NO: 316996

SEQ ID NO: 420425 - RNA, 64 nt, hsa; identical to SEQ ID NO: 316997

SEQ ID NO: 420426 - RNA, 64 nt, hsa; identical to SEQ ID NO: 316998

SEQ ID NO: 420427 - RNA, 64 nt, hsa; identical to SEQ ID NO: 316999

SEQ ID NO: 420428 - RNA, 64 nt, hsa; identical to SEQ ID NO: 317000

SEQ ID NO: 420429 - RNA, 64 nt, hsa; identical to SEQ ID NO: 317001

SEQ ID NO: 420430 - RNA, 64 nt, hsa; identical to SEQ ID NO: 317002

SEQ ID NO: 420431 - RNA, 64 nt, hsa; identical to SEQ ID NO: 317003

SEQ ID NO: 420432 - RNA, 60 nt, hsa; identical to SEQ ID NO: 317004

SEQ ID NO: 420433 - RNA, 64 nt, hsa; identical to SEQ ID NO: 317005

SEQ ID NO: 420434 - RNA, 64 nt, hsa; identical to SEQ ID NO: 317006

SEQ ID NO: 420435 - RNA, 64 nt, hsa; identical to SEQ ID NO: 317007

SEQ ID NO: 420436 - RNA, 64 nt, hsa; identical to SEQ ID NO: 317008

SEQ ID NO: 420437 - RNA, 64 nt, hsa; identical to SEQ ID NO: 317009

SEQ ID NO: 420438 - RNA, 64 nt, hsa; identical to SEQ ID NO: 317010

SEQ ID NO: 420439 - RNA, 64 nt, hsa; identical to SEQ ID NO: 317011

SEQ ID NO: 420440 - RNA, 64 nt, hsa; identical to SEQ ID NO: 317012

SEQ ID NO: 420441 - RNA, 64 nt, hsa; identical to SEQ ID NO: 317013

SEQ ID NO: 420442 - RNA, 64 nt, hsa; identical to SEQ ID NO: 317014

SEQ ID NO: 420443 - RNA, 64 nt, hsa; identical to SEQ ID NO: 317015

SEQ ID NO: 420444 - RNA, 64 nt, hsa; identical to SEQ ID NO: 317016

SEQ ID NO: 420445 - RNA, 64 nt, hsa; identical to SEQ ID NO: 317017

SEQ ID NO: 420446 - RNA, 64 nt, hsa; identical to SEQ ID NO: 317018

SEQ ID NO: 420447 - RNA, 64 nt, hsa; identical to SEQ ID NO: 317019

SEQ ID NO: 420448 - RNA, 64 nt, hsa; identical to SEQ ID NO: 317020

SEQ ID NO: 420449 - RNA, 64 nt, hsa; identical to SEQ ID NO: 317021

SEQ ID NO: 420450 - RNA, 62 nt, hsa; identical to SEQ ID NO: 317022

SEQ ID NO: 420451 - RNA, 64 nt, hsa; identical to SEQ ID NO: 317023

SEQ ID NO: 420452 - RNA, 64 nt, hsa; identical to SEQ ID NO: 317024

SEQ ID NO: 420453 - RNA, 64 nt, hsa; identical to SEQ ID NO: 317025

SEQ ID NO: 420454 - RNA, 64 nt, hsa; identical to SEQ ID NO: 317026

SEQ ID NO: 420455 - RNA, 64 nt, hsa; identical to SEQ ID NO: 317027

SEQ ID NO: 420456 - RNA, 64 nt, hsa; identical to SEQ ID NO: 317028

SEQ ID NO: 420457 - RNA, 64 nt, hsa; identical to SEQ ID NO: 317029

SEQ ID NO: 420458 - RNA, 53 nt, hsa; identical to SEQ ID NO: 317030

SEQ ID NO: 420459 - RNA, 54 nt, hsa; identical to SEQ ID NO: 317031

SEQ ID NO: 420460 - RNA, 64 nt, hsa; identical to SEQ ID NO: 317032

SEQ ID NO: 420461 - RNA, 64 nt, hsa; identical to SEQ ID NO: 317033

SEQ ID NO: 420462 - RNA, 64 nt, hsa; identical to SEQ ID NO: 317034

SEQ ID NO: 420463 - RNA, 64 nt, hsa; identical to SEQ ID NO: 317035

SEQ ID NO: 420464 - RNA, 64 nt, hsa; identical to SEQ ID NO: 317036

SEQ ID NO: 420465 - RNA, 64 nt, hsa; identical to SEQ ID NO: 317037

SEQ ID NO: 420466 - RNA, 64 nt, hsa; identical to SEQ ID NO: 317038

SEQ ID NO: 420467 - RNA, 64 nt, hsa; identical to SEQ ID NO: 317039

SEQ ID NO: 420468 - RNA, 64 nt, hsa; identical to SEQ ID NO: 317040

SEQ ID NO: 420469 - RNA, 64 nt, hsa; identical to SEQ ID NO: 317041

SEQ ID NO: 420470 - RNA, 64 nt, hsa; identical to SEQ ID NO: 317042

SEQ ID NO: 420471 - RNA, 64 nt, hsa; identical to SEQ ID NO: 317043

SEQ ID NO: 420472 - RNA, 64 nt, hsa; identical to SEQ ID NO: 317044

SEQ ID NO: 420473 - RNA, 64 nt, hsa; identical to SEQ ID NO: 317045

SEQ ID NO: 420474 - RNA, 64 nt, hsa; identical to SEQ ID NO: 317046

SEQ ID NO: 420475 - RNA, 64 nt, hsa; identical to SEQ ID NO: 317047

SEQ ID NO: 420476 - RNA, 64 nt, hsa; identical to SEQ ID NO: 317048

SEQ ID NO: 420477 - RNA, 64 nt, hsa; identical to SEQ ID NO: 317049

SEQ ID NO: 420478 - RNA, 64 nt, hsa; identical to SEQ ID NO: 317050

SEQ ID NO: 420479 - RNA, 64 nt, hsa; identical to SEQ ID NO: 317051

SEQ ID NO: 420480 - RNA, 64 nt, hsa; identical to SEQ ID NO: 317052

SEQ ID NO: 420481 - RNA, 64 nt, hsa; identical to SEQ ID NO: 317053

SEQ ID NO: 420482 - RNA, 64 nt, hsa; identical to SEQ ID NO: 317054

SEQ ID NO: 420483 - RNA, 64 nt, hsa; identical to SEQ ID NO: 317055

SEQ ID NO: 420484 - RNA, 64 nt, hsa; identical to SEQ ID NO: 317056

SEQ ID NO: 420485 - RNA, 64 nt, hsa; identical to SEQ ID NO: 317057

SEQ ID NO: 420486 - RNA, 64 nt, hsa; identical to SEQ ID NO: 317058

SEQ ID NO: 420487 - RNA, 64 nt, hsa; identical to SEQ ID NO: 317059

SEQ ID NO: 420488 - RNA, 64 nt, hsa; identical to SEQ ID NO: 317060

SEQ ID NO: 420489 - RNA, 64 nt, hsa; identical to SEQ ID NO: 317061

SEQ ID NO: 420490 - RNA, 64 nt, hsa; identical to SEQ ID NO: 317062

SEQ ID NO: 420491 - RNA, 64 nt, hsa; identical to SEQ ID NO: 317063

SEQ ID NO: 420492 - RNA, 64 nt, hsa; identical to SEQ ID NO: 317064

SEQ ID NO: 420493 - RNA, 55 nt, hsa; identical to SEQ ID NO: 317065

SEQ ID NO: 420494 - RNA, 64 nt, hsa; identical to SEQ ID NO: 317066

SEQ ID NO: 420495 - RNA, 63 nt, hsa; identical to SEQ ID NO: 317067

SEQ ID NO: 420496 - RNA, 64 nt, hsa; identical to SEQ ID NO: 317068

SEQ ID NO: 420497 - RNA, 64 nt, hsa; identical to SEQ ID NO: 317069

SEQ ID NO: 420498 - RNA, 64 nt, hsa; identical to SEQ ID NO: 317070

SEQ ID NO: 420499 - RNA, 64 nt, hsa; identical to SEQ ID NO: 317071

SEQ ID NO: 420500 - RNA, 64 nt, hsa; identical to SEQ ID NO: 317072

SEQ ID NO: 420501 - RNA, 64 nt, hsa; identical to SEQ ID NO: 317073

SEQ ID NO: 420502 - RNA, 64 nt, hsa; identical to SEQ ID NO: 317074

SEQ ID NO: 420503 - RNA, 64 nt, hsa; identical to SEQ ID NO: 317075

SEQ ID NO: 420504 - RNA, 64 nt, hsa; identical to SEQ ID NO: 317076

SEQ ID NO: 420505 - RNA, 64 nt, hsa; identical to SEQ ID NO: 317077

SEQ ID NO: 420506 - RNA, 64 nt, hsa; identical to SEQ ID NO: 317078

SEQ ID NO: 420507 - RNA, 64 nt, hsa; identical to SEQ ID NO: 317079

SEQ ID NO: 420508 - RNA, 64 nt, hsa; identical to SEQ ID NO: 317080

SEQ ID NO: 420509 - RNA, 64 nt, hsa; identical to SEQ ID NO: 317081

SEQ ID NO: 420510 - RNA, 64 nt, hsa; identical to SEQ ID NO: 317082

SEQ ID NO: 420511 - RNA, 64 nt, hsa; identical to SEQ ID NO: 317083

SEQ ID NO: 420512 - RNA, 64 nt, hsa; identical to SEQ ID NO: 317084

SEQ ID NO: 420513 - RNA, 64 nt, hsa; identical to SEQ ID NO: 317085

SEQ ID NO: 420514 - RNA, 64 nt, hsa; identical to SEQ ID NO: 317086

SEQ ID NO: 420515 - RNA, 64 nt, hsa; identical to SEQ ID NO: 317087

SEQ ID NO: 420516 - RNA, 64 nt, hsa; identical to SEQ ID NO: 317088

SEQ ID NO: 420517 - RNA, 64 nt, hsa; identical to SEQ ID NO: 317089

SEQ ID NO: 420518 - RNA, 64 nt, hsa; identical to SEQ ID NO: 317090

SEQ ID NO: 420519 - RNA, 64 nt, hsa; identical to SEQ ID NO: 284290

SEQ ID NO: 420520 - RNA, 64 nt, hsa; identical to SEQ ID NO: 284291

SEQ ID NO: 420521 - RNA, 64 nt, hsa; identical to SEQ ID NO: 284292

SEQ ID NO: 420522 - RNA, 64 nt, hsa; identical to SEQ ID NO: 284293

SEQ ID NO: 420523 - RNA, 64 nt, hsa; identical to SEQ ID NO: 284294

SEQ ID NO: 420524 - RNA, 64 nt, hsa; identical to SEQ ID NO: 284295

SEQ ID NO: 420525 - RNA, 64 nt, hsa; identical to SEQ ID NO: 284296

SEQ ID NO: 420526 - RNA, 64 nt, hsa; identical to SEQ ID NO: 284297

SEQ ID NO: 420527 - RNA, 64 nt, hsa; identical to SEQ ID NO: 284298

SEQ ID NO: 420528 - RNA, 64 nt, hsa; identical to SEQ ID NO: 284299

SEQ ID NO: 420529 - RNA, 64 nt, hsa; identical to SEQ ID NO: 284300

SEQ ID NO: 420530 - RNA, 64 nt, hsa; identical to SEQ ID NO: 284301

SEQ ID NO: 420531 - RNA, 64 nt, hsa; identical to SEQ ID NO: 284302

SEQ ID NO: 420532 - RNA, 64 nt, hsa; identical to SEQ ID NO: 284303

SEQ ID NO: 420533 - RNA, 64 nt, hsa; identical to SEQ ID NO: 284304

SEQ ID NO: 420534 - RNA, 64 nt, hsa; identical to SEQ ID NO: 284305

SEQ ID NO: 420535 - RNA, 64 nt, hsa; identical to SEQ ID NO: 284306

SEQ ID NO: 420536 - RNA, 64 nt, hsa; identical to SEQ ID NO: 284307

SEQ ID NO: 420537 - RNA, 64 nt, hsa; identical to SEQ ID NO: 284308

SEQ ID NO: 420538 - RNA, 64 nt, hsa; identical to SEQ ID NO: 284309

SEQ ID NO: 420539 - RNA, 64 nt, hsa; identical to SEQ ID NO: 284310

SEQ ID NO: 420540 - RNA, 64 nt, hsa; identical to SEQ ID NO: 284311

SEQ ID NO: 420541 - RNA, 64 nt, hsa; identical to SEQ ID NO: 284312

SEQ ID NO: 420542 - RNA, 64 nt, hsa; identical to SEQ ID NO: 284313

SEQ ID NO: 420543 - RNA, 64 nt, hsa; identical to SEQ ID NO: 284314

SEQ ID NO: 420544 - RNA, 64 nt, hsa; identical to SEQ ID NO: 284315

SEQ ID NO: 420545 - RNA, 64 nt, hsa; identical to SEQ ID NO: 284316

SEQ ID NO: 420546 - RNA, 64 nt, hsa; identical to SEQ ID NO: 284317

SEQ ID NO: 420547 - RNA, 64 nt, hsa; identical to SEQ ID NO: 284318

SEQ ID NO: 420548 - RNA, 64 nt, hsa; identical to SEQ ID NO: 284319

SEQ ID NO: 420549 - RNA, 64 nt, hsa; identical to SEQ ID NO: 284320

SEQ ID NO: 420550 - RNA, 64 nt, hsa; identical to SEQ ID NO: 284321

SEQ ID NO: 420551 - RNA, 64 nt, hsa; identical to SEQ ID NO: 284322

SEQ ID NO: 420552 - RNA, 64 nt, hsa; identical to SEQ ID NO: 284323

SEQ ID NO: 420553 - RNA, 64 nt, hsa; identical to SEQ ID NO: 284324

SEQ ID NO: 420554 - RNA, 64 nt, hsa; identical to SEQ ID NO: 284325

SEQ ID NO: 420555 - RNA, 64 nt, hsa; identical to SEQ ID NO: 284326

SEQ ID NO: 420556 - RNA, 64 nt, hsa; identical to SEQ ID NO: 284327

SEQ ID NO: 420557 - RNA, 64 nt, hsa; identical to SEQ ID NO: 284328

SEQ ID NO: 420558 - RNA, 64 nt, hsa; identical to SEQ ID NO: 284329

SEQ ID NO: 420559 - RNA, 64 nt, hsa; identical to SEQ ID NO: 284330

SEQ ID NO: 420560 - RNA, 64 nt, hsa; identical to SEQ ID NO: 284331

SEQ ID NO: 420561 - RNA, 64 nt, hsa; identical to SEQ ID NO: 284332

SEQ ID NO: 420562 - RNA, 64 nt, hsa; identical to SEQ ID NO: 284333

SEQ ID NO: 420563 - RNA, 50 nt, hsa; identical to SEQ ID NO: 284334

SEQ ID NO: 420564 - RNA, 64 nt, hsa; identical to SEQ ID NO: 284335

SEQ ID NO: 420565 - RNA, 64 nt, hsa; identical to SEQ ID NO: 284336

SEQ ID NO: 420566 - RNA, 64 nt, hsa; identical to SEQ ID NO: 284337

SEQ ID NO: 420567 - RNA, 64 nt, hsa; identical to SEQ ID NO: 284338

SEQ ID NO: 420568 - RNA, 64 nt, hsa; identical to SEQ ID NO: 284339

SEQ ID NO: 420569 - RNA, 64 nt, hsa; identical to SEQ ID NO: 284340

SEQ ID NO: 420570 - RNA, 64 nt, hsa; identical to SEQ ID NO: 284341

SEQ ID NO: 420571 - RNA, 64 nt, hsa; identical to SEQ ID NO: 284342

SEQ ID NO: 420572 - RNA, 64 nt, hsa; identical to SEQ ID NO: 284343

SEQ ID NO: 420573 - RNA, 64 nt, hsa; identical to SEQ ID NO: 284344

SEQ ID NO: 420574 - RNA, 64 nt, hsa; identical to SEQ ID NO: 284345

SEQ ID NO: 420575 - RNA, 64 nt, hsa; identical to SEQ ID NO: 284346

SEQ ID NO: 420576 - RNA, 64 nt, hsa; identical to SEQ ID NO: 284347

SEQ ID NO: 420577 - RNA, 64 nt, hsa; identical to SEQ ID NO: 284348

SEQ ID NO: 420578 - RNA, 64 nt, hsa; identical to SEQ ID NO: 284349

SEQ ID NO: 420579 - RNA, 64 nt, hsa; identical to SEQ ID NO: 284350

SEQ ID NO: 420580 - RNA, 64 nt, hsa; identical to SEQ ID NO: 284351

SEQ ID NO: 420581 - RNA, 64 nt, hsa; identical to SEQ ID NO: 284352

SEQ ID NO: 420582 - RNA, 64 nt, hsa; identical to SEQ ID NO: 284353

SEQ ID NO: 420583 - RNA, 64 nt, hsa
ccuuuuuccugacccccuccuucuggaggcaguugggagcuauccuuguuuaugccucacuauu

SEQ ID NO: 420584 - RNA, 64 nt, hsa
cuggcugucugaggaggaaggccuccuggaaacugggagcuaagggcgaggcccuucccuucag

SEQ ID NO: 420585 - RNA, 64 nt, hsa
gauggaggacucacugcacagccgcuuccuagcagggagcuauacuccaacuccuacuugaguu

SEQ ID NO: 420586 - RNA, 64 nt, hsa
aaaaaggcgccuggauccccaaaaaaccgaggcugggagcuaguggcccuuuugcuuucuagga

SEQ ID NO: 420587 - RNA, 64 nt, hsa
cuaagccccacaaacuugacaccugaucaggucugggagcuacaaaauuucauuuuucuccuca

SEQ ID NO: 420588 - RNA, 64 nt, hsa
guagcaaggguccagagaugagguguuuuuuucggggagcuaauaacaaaaacauuuuaaaacu

SEQ ID NO: 420589 - RNA, 64 nt, hsa; identical to SEQ ID NO: 50174

SEQ ID NO: 420590 - RNA, 64 nt, hsa; identical to SEQ ID NO: 50175

SEQ ID NO: 420591 - RNA, 64 nt, hsa; identical to SEQ ID NO: 50176

SEQ ID NO: 420592 - RNA, 64 nt, hsa; identical to SEQ ID NO: 50177

SEQ ID NO: 420593 - RNA, 64 nt, hsa; identical to SEQ ID NO: 50178

SEQ ID NO: 420594 - RNA, 64 nt, hsa; identical to SEQ ID NO: 50179

SEQ ID NO: 420595 - RNA, 64 nt, hsa; identical to SEQ ID NO: 50180

SEQ ID NO: 420596 - RNA, 64 nt, hsa; identical to SEQ ID NO: 50181

SEQ ID NO: 420597 - RNA, 64 nt, hsa; identical to SEQ ID NO: 50182

SEQ ID NO: 420598 - RNA, 64 nt, hsa; identical to SEQ ID NO: 50183

SEQ ID NO: 420599 - RNA, 64 nt, hsa; identical to SEQ ID NO: 50184

SEQ ID NO: 420600 - RNA, 64 nt, hsa; identical to SEQ ID NO: 50185

SEQ ID NO: 420601 - RNA, 64 nt, hsa; identical to SEQ ID NO: 50186

SEQ ID NO: 420602 - RNA, 64 nt, hsa; identical to SEQ ID NO: 50187

SEQ ID NO: 420603 - RNA, 64 nt, hsa; identical to SEQ ID NO: 50188

SEQ ID NO: 420604 - RNA, 64 nt, hsa; identical to SEQ ID NO: 50189

SEQ ID NO: 420605 - RNA, 64 nt, hsa; identical to SEQ ID NO: 50190

SEQ ID NO: 420606 - RNA, 64 nt, hsa; identical to SEQ ID NO: 50191

SEQ ID NO: 420607 - RNA, 64 nt, hsa; identical to SEQ ID NO: 50192

SEQ ID NO: 420608 - RNA, 64 nt, hsa; identical to SEQ ID NO: 50193

SEQ ID NO: 420609 - RNA, 64 nt, hsa; identical to SEQ ID NO: 50194

SEQ ID NO: 420610 - RNA, 64 nt, hsa; identical to SEQ ID NO: 50195

SEQ ID NO: 420611 - RNA, 64 nt, hsa; identical to SEQ ID NO: 50196

SEQ ID NO: 420612 - RNA, 64 nt, hsa; identical to SEQ ID NO: 50197

SEQ ID NO: 420613 - RNA, 64 nt, hsa; identical to SEQ ID NO: 50198

SEQ ID NO: 420614 - RNA, 64 nt, hsa; identical to SEQ ID NO: 50199

SEQ ID NO: 420615 - RNA, 64 nt, hsa; identical to SEQ ID NO: 50200

SEQ ID NO: 420616 - RNA, 64 nt, hsa; identical to SEQ ID NO: 50201

SEQ ID NO: 420617 - RNA, 64 nt, hsa; identical to SEQ ID NO: 50202

SEQ ID NO: 420618 - RNA, 64 nt, hsa; identical to SEQ ID NO: 50203

SEQ ID NO: 420619 - RNA, 64 nt, hsa; identical to SEQ ID NO: 50204

SEQ ID NO: 420620 - RNA, 64 nt, hsa; identical to SEQ ID NO: 50205

SEQ ID NO: 420621 - RNA, 64 nt, hsa; identical to SEQ ID NO: 50206

SEQ ID NO: 420622 - RNA, 64 nt, hsa; identical to SEQ ID NO: 50207

SEQ ID NO: 420623 - RNA, 64 nt, hsa; identical to SEQ ID NO: 50208

SEQ ID NO: 420624 - RNA, 64 nt, hsa; identical to SEQ ID NO: 50209

SEQ ID NO: 420625 - RNA, 64 nt, hsa; identical to SEQ ID NO: 50210

SEQ ID NO: 420626 - RNA, 64 nt, hsa; identical to SEQ ID NO: 50211

SEQ ID NO: 420627 - RNA, 64 nt, hsa; identical to SEQ ID NO: 50212

SEQ ID NO: 420628 - RNA, 64 nt, hsa; identical to SEQ ID NO: 50213

SEQ ID NO: 420629 - RNA, 64 nt, hsa; identical to SEQ ID NO: 50214

SEQ ID NO: 420630 - RNA, 64 nt, hsa; identical to SEQ ID NO: 50215

SEQ ID NO: 420631 - RNA, 64 nt, hsa; identical to SEQ ID NO: 50216

SEQ ID NO: 420632 - RNA, 64 nt, hsa; identical to SEQ ID NO: 50217

SEQ ID NO: 420633 - RNA, 64 nt, hsa; identical to SEQ ID NO: 50218

SEQ ID NO: 420634 - RNA, 64 nt, hsa; identical to SEQ ID NO: 50219

SEQ ID NO: 420635 - RNA, 64 nt, hsa; identical to SEQ ID NO: 50220

SEQ ID NO: 420636 - RNA, 64 nt, hsa; identical to SEQ ID NO: 50221

SEQ ID NO: 420637 - RNA, 64 nt, hsa; identical to SEQ ID NO: 50222

SEQ ID NO: 420638 - RNA, 64 nt, hsa; identical to SEQ ID NO: 50223

SEQ ID NO: 420639 - RNA, 64 nt, hsa; identical to SEQ ID NO: 50224

SEQ ID NO: 420640 - RNA, 64 nt, hsa; identical to SEQ ID NO: 50225

SEQ ID NO: 420641 - RNA, 64 nt, hsa; identical to SEQ ID NO: 50226

SEQ ID NO: 420642 - RNA, 64 nt, hsa; identical to SEQ ID NO: 50227

SEQ ID NO: 420643 - RNA, 64 nt, hsa; identical to SEQ ID NO: 50228

SEQ ID NO: 420644 - RNA, 64 nt, hsa; identical to SEQ ID NO: 50229

SEQ ID NO: 420645 - RNA, 64 nt, hsa; identical to SEQ ID NO: 50230

SEQ ID NO: 420646 - RNA, 64 nt, hsa; identical to SEQ ID NO: 50231

SEQ ID NO: 420647 - RNA, 64 nt, hsa; identical to SEQ ID NO: 50232

SEQ ID NO: 420648 - RNA, 64 nt, hsa; identical to SEQ ID NO: 50233

SEQ ID NO: 420649 - RNA, 64 nt, hsa; identical to SEQ ID NO: 50234

SEQ ID NO: 420650 - RNA, 64 nt, hsa; identical to SEQ ID NO: 50235

SEQ ID NO: 420651 - RNA, 64 nt, hsa; identical to SEQ ID NO: 50236

SEQ ID NO: 420652 - RNA, 64 nt, hsa; identical to SEQ ID NO: 50237

SEQ ID NO: 420653 - RNA, 64 nt, hsa; identical to SEQ ID NO: 50238

SEQ ID NO: 420654 - RNA, 64 nt, hsa; identical to SEQ ID NO: 50239

SEQ ID NO: 420655 - RNA, 64 nt, hsa; identical to SEQ ID NO: 50240

SEQ ID NO: 420656 - RNA, 64 nt, hsa; identical to SEQ ID NO: 50241

SEQ ID NO: 420657 - RNA, 64 nt, hsa; identical to SEQ ID NO: 50242

SEQ ID NO: 420658 - RNA, 64 nt, hsa; identical to SEQ ID NO: 50243

SEQ ID NO: 420659 - RNA, 65 nt, hsa
uuuucauuccuuauugaacuuauuuugcacaauaguguuuacaaaucuuauacaucuuacuuuga

SEQ ID NO: 420660 - RNA, 65 nt, hsa
caugggggucuugacaaagcagaguaaaaauaugcuguuuacauuguuuacuuacaaguaaggag

SEQ ID NO: 420661 - RNA, 65 nt, hsa
cacuuuuauuaauucuucauuuuuuguaaaacuuauguuuacaagaagaaaacaaaucaaaacau

SEQ ID NO: 420662 - RNA, 65 nt, hsa
uuugccuaaaagaaaggacugacaagugugcaaaauguuuacaaucuuuugugaaauuguaguuu

SEQ ID NO: 420663 - RNA, 65 nt, hsa
cugaucuuagcucacuuuccaauaacagaaggaguuguuuacagaugaauaguaucacaucauua

SEQ ID NO: 420664 - RNA, 65 nt, hsa
caugucuuuuguaaaacaaaaauuacaaaaaaauuuguuuacauuccacugguaccuuaauuuaa

SEQ ID NO: 420665 - RNA, 65 nt, hsa
ccuuuccccaacuacaaaaauguuuggcaacuuuguguuuacauuuaaagaucauuugcaccuuu

SEQ ID NO: 420666 - RNA, 65 nt, hsa
ccuuuuucaaggaaaaaaaguauugaguaaacaauuguuuacauauaucauuuaugcuuuuuucu

SEQ ID NO: 420667 - RNA, 65 nt, hsa
uauuucuucuguuuuauacaagcucuguuaaguuauguuuacaguaucuuguaucgcuguuuaca

SEQ ID NO: 420668 - RNA, 65 nt, hsa
cucuguuaaguuauguuuacaguaucuuguaucgcuguuuacaaaucuugcauggacuccugcca

SEQ ID NO: 420669 - RNA, 65 nt, hsa
gauccaaguugauuuuugugucuacagcuaaauuuuguuuacaauuaggcuauuuuuuaauauag

SEQ ID NO: 420670 - RNA, 65 nt, hsa
uucaagacuagccugggcaauguggcaaaaccgcguguuuacaaaaaauacaaaaauuagccagg

SEQ ID NO: 420671 - RNA, 65 nt, hsa
caguucuuucaugguaagcucaauggacuuugaauuguuuacagugcuguauguccaauuguuaa

SEQ ID NO: 420672 - RNA, 65 nt, hsa
aagacuccaacggagggagccuguugguguuaaauuguuuacauuucuuuauacaaauaaugugc

SEQ ID NO: 420673 - RNA, 65 nt, hsa
uaaaggcucaauaacaaauacaacaaauguaaauauguuuacauuuuaagacauaugcagugguu

SEQ ID NO: 420674 - RNA, 65 nt, hsa
ugucugcaaauuucaugaauuugugaugucuuugcuguuuacaugcagucccaagaaauggauug

SEQ ID NO: 420675 - RNA, 65 nt, hsa
aauguacaucuaccccagccccucaaaagaaaaacuguuuacauagaaauuccuacacauacguu

SEQ ID NO: 420676 - RNA, 65 nt, hsa
auuuaaaacauaauugccaauugaaacccuaaauauguuuacauaccauuaagauaugauucaug

SEQ ID NO: 420677 - RNA, 65 nt, hsa
cccaacaccagccccugccccagcccaaguccaaauguuuacagggagccuccugcccagucccc

SEQ ID NO: 420678 - RNA, 65 nt, hsa
cuuccaagugacuccgugccuugagugugucugcguguuuacacccgucccucugcuggccgccc

SEQ ID NO: 420679 - RNA, 65 nt, hsa
augauacuuacaauuuuuagcagguagcuuuuuaauguuuacagaaauuuuaauuuuuuucuauu

SEQ ID NO: 420680 - RNA, 65 nt, hsa
aauuuuaauuuuuuucuauuuugaaauuugaggcuuguuuacauugcuuagauaauuuagaauuu

SEQ ID NO: 420681 - RNA, 65 nt, hsa
gaaaacauaagugucucuggccaucaaagugaucuuguuuacagcagugcuuuugugaaacaauu

SEQ ID NO: 420682 - RNA, 65 nt, hsa
uuuguuuacaacucaaaacuuugaguuuuacacuuuguuuacaguagauaauuuuuuuuccuuug

SEQ ID NO: 420683 - RNA, 65 nt, hsa
guuuacaaguccagauucaaaaaauguuuuuacuuuguuuacaacucaaaacuuugaguuuuaca

SEQ ID NO: 420684 - RNA, 65 nt, hsa
gcuguccagaacugaagacuuuaaaauuuuguuacuguuuacaaguccagauucaaaaaauguuu

SEQ ID NO: 420685 - RNA, 65 nt, hsa
uucaagacccagaauguaggugccacugccuccuauguuuacaggauccuccguggcccuaggca

SEQ ID NO: 420686 - RNA, 65 nt, hsa
gaugcuguggggugcugguggagcagcugaugucguguuuacagagcaaggcuucccugucuccc

SEQ ID NO: 420687 - RNA, 65 nt, hsa
auuuaugagaaaguucucauuuaaaaugagaucguuguuuacaguguauguacuaagcaguaagc

SEQ ID NO: 420688 - RNA, 65 nt, hsa
auuuccuaaugucagaguagaagauuuuaugcugcuguuuacaaaagcccaauguaaugcauagg

SEQ ID NO: 420689 - RNA, 65 nt, hsa
aaagcaagaugccauuuuccccaugacuuugguuuuguuuacauuuuucccuuucaguuaguaua

SEQ ID NO: 420690 - RNA, 65 nt, hsa
ccuacuauuuuuaaaauuccuguugaguuucuuuguguuuacaaggaaaggacugaacuuuuucu

SEQ ID NO: 420691 - RNA, 65 nt, hsa
ugugauuuuacaauaacauuaucaucugcaguuacuguuuacaagacugcuuuuaccuuaaacuu

SEQ ID NO: 420692 - RNA, 65 nt, hsa
guuuacaagacugcuuuuaccuuaaacuuuguagauguuuacaucuuuuuguuguguuuuaagau

SEQ ID NO: 420693 - RNA, 65 nt, hsa
cagcagcuggucugacacuacgcgcagugcucgguuguuuacaaucaguggggaaaagggcagaa

SEQ ID NO: 420694 - RNA, 65 nt, hsa
uauuuuuuggaagugcaaaaaucucaauuugugucuguuuacagcucucucuccucacugcucac

SEQ ID NO: 420695 - RNA, 65 nt, hsa
guauccgcgagccugcuugcugauauugcaguuuuuguuuacaagaauaauuagcaauacugagu

SEQ ID NO: 420696 - RNA, 65 nt, hsa
acaaacaacaaagcagaagacuccucucuucugacuguuuacaccuuuccgugccgggagcgcac

SEQ ID NO: 420697 - RNA, 65 nt, hsa
ucuucauauccauuucuaauccaucaaacagcuuauguuuacauaaaauuuuaucauucacaagg

SEQ ID NO: 420698 - RNA, 65 nt, hsa
uagagguuuugauaggaaguauguuuguuucuuaguguuuacaaauauuaaguacucuugauaca

SEQ ID NO: 420699 - RNA, 65 nt, hsa
uugucuuaaacuuuaauaaauucgcauuuuaaagguguuuacagauuauuuuuuauaucuguagc

SEQ ID NO: 420700 - RNA, 65 nt, hsa
cauuaaacauucugcauuggguauaaucuaagaauuguuuacaaaaagauuauuuuguauuuacc

SEQ ID NO: 420701 - RNA, 65 nt, hsa
aagauaaccuguauguguuccgagcuuuaauuuuuuguuuacaaauugaacaguguuacaugggc

SEQ ID NO: 420702 - RNA, 65 nt, hsa
aauaacaaaccuguuuuaugaaaauucacuggugcuguuuacauuggaauaaaaagcucuauaag

SEQ ID NO: 420703 - RNA, 65 nt, hsa
uuuaagaauauuauccugguuuaacaacagugcccuguuuacaacagauugugcccuaucucauc

SEQ ID NO: 420704 - RNA, 65 nt, hsa
cagguguuaacaucuguuucaggaacauggcaguauguuuacaugucagaaguuuuguuuaauuc

SEQ ID NO: 420705 - RNA, 65 nt, hsa
accuuacaaguauaugaguauuauuuauagguaguuguuuacauaugagucgggaccaaagagaa

SEQ ID NO: 420706 - RNA, 65 nt, hsa
uuuuaugaacaugaagaaacuuuaguaaauguacuuguuuacauaguuaugugaauagauuagau

SEQ ID NO: 420707 - RNA, 65 nt, hsa
auaaauaaauauuuauuuauuuauuuauaaguagauguuuacauaugcccaggauuuugaagagc

SEQ ID NO: 420708 - RNA, 65 nt, hsa
acauggaaaaacuuuaggaaaugcacuuauuaggcuguuuacauggguugccuggauacaaauca

SEQ ID NO: 420709 - RNA, 65 nt, hsa
aaagauaaaauuuaguugaguuuuuaauguuuacauguuuacaucucuaaauaaaauuugcuuau

SEQ ID NO: 420710 - RNA, 65 nt, hsa
aucauaauaaagauaaaauuuaguugaguuuuuaauguuuacauguuuacaucucuaaauaaaau

SEQ ID NO: 420711 - RNA, 65 nt, hsa
agugcaauuugguucuugaaaauuaaauuuaaacuuguuuacaaagguuuaguuuuguaauaagg

SEQ ID NO: 420712 - RNA, 65 nt, hsa
uuuccuauguuagcuguuaaagaaacagcaggacuuguuuacaaagaugucuucauucccaaggu

SEQ ID NO: 420713 - RNA, 65 nt, hsa
agaggaagaaugggacauggccccaugcuuauuuuuguuuacaacguaacauggcaugagagagg

SEQ ID NO: 420714 - RNA, 65 nt, hsa
gcuauaccaggcacaagauaaaacuccaaaauuucuguuuacauugaccuuuacauuuaaagcug

SEQ ID NO: 420715 - RNA, 65 nt, hsa
cgcaccuggcuccuaccuggaggacucaguuguucuguuuacauccugguggcaccucucacccu

SEQ ID NO: 420716 - RNA, 65 nt, hsa
cacuuuccccuugcucguuucucccuuguuguaaguguuuacaacuggcaugugcuuuuaaacau

SEQ ID NO: 420717 - RNA, 65 nt, hsa
caucugauuugggguuaaacuaggcggcuggaggauguuuacagcuuugaggcuucaaauaaguu

SEQ ID NO: 420718 - RNA, 65 nt, hsa
aucaauuaccucccauguguggacauccugggacuuguuuacauuuuaucuguaauaagauaacu

SEQ ID NO: 420719 - RNA, 65 nt, hsa
uuucaaaggcaucacuauuuuuaaauguuuacauauguuuacauguuugugugcaacugcuucau

SEQ ID NO: 420720 - RNA, 65 nt, hsa
uccccuuacauuucaaaggcaucacuauuuuuaaauguuuacauauguuuacauguuugugugca

SEQ ID NO: 420721 - RNA, 65 nt, hsa
aaaagaguauuuauguuggaauaauuuuuaaauaauguuuacauaacuguaaguccuguuugguu

SEQ ID NO: 420722 - RNA, 65 nt, hsa
acuuggcacuuguucuagagaaguguagaggaugauguuuacauaauuuuagcaccucaagguau

SEQ ID NO: 420723 - RNA, 65 nt, hsa
acccaaucagaauacggugguugagaaggaaccaguguuuacaaguaauaucagaaaguugaagg

SEQ ID NO: 420724 - RNA, 65 nt, hsa
guuuacaaguaauaucagaaaguugaaggaaccaguguuuacaaguaauaccagaaaguugccaa

SEQ ID NO: 420725 - RNA, 65 nt, hsa
uucagcauucaaucaggcugagcugaauguagugauguuuacauuguuuacauucuuuguacugu

SEQ ID NO: 420726 - RNA, 65 nt, hsa
caaucaggcugagcugaauguagugauguuuacauuguuuacauucuuuguacugucuuccugcu

SEQ ID NO: 420727 - RNA, 65 nt, hsa
uuucuuucuuucuuucugccaacuuuguuuuccaguguuuacaaggugacaaauguuugacuuug

SEQ ID NO: 420728 - RNA, 65 nt, hsa
uugcuuuagcacaggacaacuuuacaaaacaugauuguuuacagcugcucuuccccucuuuucug

SEQ ID NO: 420729 - RNA, 65 nt, hsa
uaacccaggacuaaaaauggacaggcugaccucaguguuuacaaauucagaauuuugauaggggu

SEQ ID NO: 420730 - RNA, 65 nt, hsa
uccagugcugggugcagcuccaucacccucuuguguguuuacaugucucuuucuaugauaagagg

SEQ ID NO: 420731 - RNA, 65 nt, hsa
auauaugccugucuagacaucaaauuguugguuauuguuuacaaucuagaaaugaugaagcucuu

SEQ ID NO: 420732 - RNA, 65 nt, hsa
gaucuagggugauugugucuggagacccuuaauuauguuuacaaagacccauguuccaaguaagu

SEQ ID NO: 420733 - RNA, 65 nt, hsa
ugccucacugcuguucugggccauccccauagccauguuuacaugauuugaugugcaauagggug

SEQ ID NO: 420734 - RNA, 65 nt, hsa
gcugggugacugggucuagccccugaucccaaaucuguuuacacaucaaucugccucacugcugu

SEQ ID NO: 420735 - RNA, 65 nt, hsa
ucucuuggggggucagggugcuguccccuccccucuguuuacaucuccccucuaccccgcuguau

SEQ ID NO: 420736 - RNA, 65 nt, hsa
gacccagaggaagccucuauuuauuuauuagcuuuuguuuacaccguggaauugaccccuuccuc

SEQ ID NO: 420737 - RNA, 65 nt, hsa
caaaacaauugagaugcuaacagggaggauuacaguguuuacagaacaaccuucagcgccgaccu

SEQ ID NO: 420738 - RNA, 65 nt, hsa
acuagguagaauaaccgaguaugacaauucuuaauuguuuacauuuuauaacuuccuguccuuca

SEQ ID NO: 420739 - RNA, 65 nt, hsa
ggacccuugcagggcuuugcagcugcucaucuguuuguuuacaguuuguucuuucccuccuuccc

SEQ ID NO: 420740 - RNA, 65 nt, hsa
auuuuguguuuuacuugaccaaaaccaaguguauauguuuacauguuuuuauccuguuuagcuug

SEQ ID NO: 420741 - RNA, 65 nt, hsa
agccuccuuccuugcaguguuuacaacauagccaguguuuacagcauagcagaugcugcugcuga

SEQ ID NO: 420742 - RNA, 65 nt, hsa
acucuggcccuuguuucuagccuccuuccuugcaguguuuacaacauagccaguguuuacagcau

SEQ ID NO: 420743 - RNA, 65 nt, hsa
auuauguaguaaauguauguuuacaggguuuaucauguuuacagauuaagcuaauuucuguaguc

SEQ ID NO: 420744 - RNA, 65 nt, hsa
auucuuuacacuuguacaauuauguaguaaauguauguuuacaggguuuaucauguuuacagauu

SEQ ID NO: 420745 - RNA, 65 nt, hsa
cuggggcuugcgcugggccguggugggaggcacaguguuuacaggcucugguggcagagcaguug

SEQ ID NO: 420746 - RNA, 65 nt, hsa
guuauauauauuuuuugcaacuuggauuuccaguuuguuuacagaguagucuuagguaguagcaa

SEQ ID NO: 420747 - RNA, 65 nt, hsa
caucuuugaaaggcauugugggucugucuuuaaaguguuuacaaaaaaaaauuauauaaaaaaaa

SEQ ID NO: 420748 - RNA, 65 nt, hsa
aaaagucuagugucgacugguguuuucccucgugauguuuacagcuugcuguuugcugcccagcc

SEQ ID NO: 420749 - RNA, 65 nt, hsa
cgcugcucccacggaggggagcaggaaugcugcacuguuuacacccugacugugcuuaaaaacac

SEQ ID NO: 420750 - RNA, 65 nt, hsa
aaaacauauccacgguaaccggucccuggcaauucuguuuacaugaaauggggagaaagucaccg

SEQ ID NO: 420751 - RNA, 65 nt, hsa
auugacaauaaaauggcuuuuaauuauuuguuauuuguuuacacccuauuccucaguuauuauua

SEQ ID NO: 420752 - RNA, 65 nt, hsa
guucaaaacuauuuguucaaagaacccguuaguguuguuuacaggguuacaguuucucucacaug

SEQ ID NO: 420753 - RNA, 65 nt, hsa
cugaaccauuugguaccugguguuaacuggaguccuguuuacaagguggagucggggcuugcuga

SEQ ID NO: 420754 - RNA, 65 nt, hsa
caagcuguuagccuuagagugauugcagugaacacuguuuacacaccgugaauccauucccauca

SEQ ID NO: 420755 - RNA, 65 nt, hsa
uuuaguucacaagcauaauuuggagguguguucuguguuuacacaguaguuuggauguacaauua

SEQ ID NO: 420756 - RNA, 65 nt, hsa
uagcuugguuuccauaacauagagcauugguugacuguuuacagaagacucacucaccaggauaa

SEQ ID NO: 420757 - RNA, 65 nt, hsa
uuuaaggaaaauuaauaaaucauuaauaguuaaaauguuuacauugagcacuagaacauguuugg

SEQ ID NO: 420758 - RNA, 65 nt, hsa
cuguucuauaguaguuacaacaauuucacaaccuauguuuacagauucuucauaaauacaugcau

SEQ ID NO: 420759 - RNA, 65 nt, hsa
ucuuuauaggucuuuaaaaauuacuuuuauuauauuguuuacaaauauauuucaugcaagaaaca

SEQ ID NO: 420760 - RNA, 65 nt, hsa
augaagaugcuguacccacuugaacaguccucagguguuuacauaaauacuauguuuuacaguuu

SEQ ID NO: 420761 - RNA, 64 nt, hsa
gaaaagcaaccacagccagccuuagggaaaacuuggaaguaagugaaauuugucuucagaauaa

SEQ ID NO: 420762 - RNA, 64 nt, hsa
agcagguguugcagacaggagggccacagcguguggaaguaaagacuuuggagcuagagaagcc

SEQ ID NO: 420763 - RNA, 64 nt, hsa
auuuagcuuuggaaguuuucuuugccuuaguuuuggaaguaaauucuaguuuguaguucucauu

SEQ ID NO: 420764 - RNA, 64 nt, hsa
uuuuggcccuucaauuuggaggagggcaaaaguuggaaguaagaaguuuuauuuuaaguacuuu

SEQ ID NO: 420765 - RNA, 64 nt, hsa
cugggauuacaggcgcgagccaccacacccggcuggaaguaaacauuuuuaaagcuacuuuuac

SEQ ID NO: 420766 - RNA, 64 nt, hsa
gucacuuuuuucccccuucaaaguauguuacugaggaaguaaacuuuuuuuuuuuuuuuugguu

SEQ ID NO: 420767 - RNA, 64 nt, hsa
uuugcaaccugaggucuauaaacaaagucuuccuggaaguaauuguaagcauccugaaauaaaa

SEQ ID NO: 420768 - RNA, 64 nt, hsa
uggcuuagcaaggagccaacauaacagaugggcuggaaguaaggaaacauguaaugauaggcgg

SEQ ID NO: 420769 - RNA, 64 nt, hsa; identical to SEQ ID NO: 170678

SEQ ID NO: 420770 - RNA, 60 nt, hsa; identical to SEQ ID NO: 170679

SEQ ID NO: 420771 - RNA, 64 nt, hsa; identical to SEQ ID NO: 170680

SEQ ID NO: 420772 - RNA, 64 nt, hsa; identical to SEQ ID NO: 170681

SEQ ID NO: 420773 - RNA, 64 nt, hsa; identical to SEQ ID NO: 170682

SEQ ID NO: 420774 - RNA, 64 nt, hsa; identical to SEQ ID NO: 170683

SEQ ID NO: 420775 - RNA, 64 nt, hsa; identical to SEQ ID NO: 170684

SEQ ID NO: 420776 - RNA, 64 nt, hsa; identical to SEQ ID NO: 170685

SEQ ID NO: 420777 - RNA, 64 nt, hsa; identical to SEQ ID NO: 170686

SEQ ID NO: 420778 - RNA, 64 nt, hsa; identical to SEQ ID NO: 170687

SEQ ID NO: 420779 - RNA, 64 nt, hsa; identical to SEQ ID NO: 170688

SEQ ID NO: 420780 - RNA, 64 nt, hsa; identical to SEQ ID NO: 170689

SEQ ID NO: 420781 - RNA, 64 nt, hsa; identical to SEQ ID NO: 170690

SEQ ID NO: 420782 - RNA, 64 nt, hsa; identical to SEQ ID NO: 170691

SEQ ID NO: 420783 - RNA, 64 nt, hsa; identical to SEQ ID NO: 170692

SEQ ID NO: 420784 - RNA, 64 nt, hsa; identical to SEQ ID NO: 170693

SEQ ID NO: 420785 - RNA, 64 nt, hsa; identical to SEQ ID NO: 170694

SEQ ID NO: 420786 - RNA, 64 nt, hsa; identical to SEQ ID NO: 170695

SEQ ID NO: 420787 - RNA, 64 nt, hsa; identical to SEQ ID NO: 170696

SEQ ID NO: 420788 - RNA, 64 nt, hsa; identical to SEQ ID NO: 170697

SEQ ID NO: 420789 - RNA, 64 nt, hsa; identical to SEQ ID NO: 170698

SEQ ID NO: 420790 - RNA, 64 nt, hsa; identical to SEQ ID NO: 170699

SEQ ID NO: 420791 - RNA, 64 nt, hsa; identical to SEQ ID NO: 170700

SEQ ID NO: 420792 - RNA, 64 nt, hsa; identical to SEQ ID NO: 170701

SEQ ID NO: 420793 - RNA, 64 nt, hsa; identical to SEQ ID NO: 170702

SEQ ID NO: 420794 - RNA, 64 nt, hsa; identical to SEQ ID NO: 170703

SEQ ID NO: 420795 - RNA, 64 nt, hsa; identical to SEQ ID NO: 170704

SEQ ID NO: 420796 - RNA, 64 nt, hsa; identical to SEQ ID NO: 170705

SEQ ID NO: 420797 - RNA, 64 nt, hsa; identical to SEQ ID NO: 170706

SEQ ID NO: 420798 - RNA, 64 nt, hsa; identical to SEQ ID NO: 170707

SEQ ID NO: 420799 - RNA, 64 nt, hsa; identical to SEQ ID NO: 170708

SEQ ID NO: 420800 - RNA, 64 nt, hsa; identical to SEQ ID NO: 170709

SEQ ID NO: 420801 - RNA, 64 nt, hsa; identical to SEQ ID NO: 170710

SEQ ID NO: 420802 - RNA, 64 nt, hsa; identical to SEQ ID NO: 170711

SEQ ID NO: 420803 - RNA, 64 nt, hsa; identical to SEQ ID NO: 170712

SEQ ID NO: 420804 - RNA, 64 nt, hsa; identical to SEQ ID NO: 170713

SEQ ID NO: 420805 - RNA, 64 nt, hsa; identical to SEQ ID NO: 170714

SEQ ID NO: 420806 - RNA, 64 nt, hsa; identical to SEQ ID NO: 170715

SEQ ID NO: 420807 - RNA, 50 nt, hsa; identical to SEQ ID NO: 170716

SEQ ID NO: 420808 - RNA, 64 nt, hsa; identical to SEQ ID NO: 170717

SEQ ID NO: 420809 - RNA, 64 nt, hsa; identical to SEQ ID NO: 170718

SEQ ID NO: 420810 - RNA, 64 nt, hsa; identical to SEQ ID NO: 170719

SEQ ID NO: 420811 - RNA, 64 nt, hsa; identical to SEQ ID NO: 170720

SEQ ID NO: 420812 - RNA, 64 nt, hsa; identical to SEQ ID NO: 170721

SEQ ID NO: 420813 - RNA, 61 nt, hsa
aguugucugguuuccauguauucuaggccagguaggcaacacagagccaaggcgggugcug

SEQ ID NO: 420814 - RNA, 61 nt, hsa
gcacacggugauuucauguuauauaugcaaaguaggcaacuguuuucuuaguuacagaagu

SEQ ID NO: 420815 - RNA, 61 nt, hsa
ucuuagguggguugggaagacagauaaugaaguaggcaaagagaaaaggacccaagauaga

SEQ ID NO: 420816 - RNA, 61 nt, hsa
ccaccaucuauagggucccaacuugguuauuguaggcaaccuucccucucuccuuggugaa

SEQ ID NO: 420817 - RNA, 61 nt, hsa
aaaucaugaguagucgcauguguggacaucaguaggcaaguaaccaguuuuacuaaugcau

SEQ ID NO: 420818 - RNA, 61 nt, hsa
gguaaucugaaaaggaccacaagcauagcugguaggcaaauuguuaggcagaauaauggua

SEQ ID NO: 420819 - RNA, 61 nt, hsa
uggggccaaggaugccaccccacccucagcuguaggcaagcuugcacauaaauaacccccg

SEQ ID NO: 420820 - RNA, 61 nt, hsa
gacacauccaggccaaccucccauggaauagguaggcaagccaggacuccgggaaggaggu

SEQ ID NO: 420821 - RNA, 61 nt, hsa
aauauuguguuauuaaaaugauggcuuuuggguaggcaaaacuucuuuucuaaaagguaua

SEQ ID NO: 420822 - RNA, 61 nt, hsa
aucuguacaacauguuacuguauugaauacaguaggcaauuguaacacaaugguaaguauc

SEQ ID NO: 420823 - RNA, 61 nt, hsa
uauugcaagucauuugcucuaauucucaauuguaggcaaacugauuuguaaauuugcuucu

SEQ ID NO: 420824 - RNA, 61 nt, hsa
aacugcacguguuuuauauuuuuaagagaucguaggcaauuagagaucgaagccuccuauc

SEQ ID NO: 420825 - RNA, 61 nt, hsa
guggagcccugagcagggcuggauaugggaaguaggcaaaugaaaugcgccaaggguucag

SEQ ID NO: 420826 - RNA, 61 nt, hsa
cuguggcccagagacacaaugggguccuucuguaggcaaagguggaaguccuccagggauc

SEQ ID NO: 420827 - RNA, 61 nt, hsa
cccuagacuaaguugaaauguauuucuaauaguaggcaauuuuaauuuucauguaguuguu

SEQ ID NO: 420828 - RNA, 61 nt, hsa
gugucuguauguuucugcguugugugucuuuguaggcaagcaaacguugucuacacaaacg

SEQ ID NO: 420829 - RNA, 61 nt, hsa
ugguggcucagcuucuaaucccagcacuuugguaggcaaaggugggaggaucauuugagcu

SEQ ID NO: 420830 - RNA, 61 nt, hsa
ccugggugaaaggccacaguauuuuggguugguaggcaaauugcaacauucuggacauggc

SEQ ID NO: 420831 - RNA, 61 nt, hsa
caucugauugcuggcuccuccuccguuugcaguaggcaagcucugcugcgaugccucugcc

SEQ ID NO: 420832 - RNA, 61 nt, hsa
auaucgauacaugaauuuaacuuacuuuaauguaggcaaacuaucaauuuuuuguccauuu

SEQ ID NO: 420833 - RNA, 61 nt, hsa
aaucacuggaaagaggagaggaaagaaccagguaggcaaauggucugugaaacccuugggu

SEQ ID NO: 420834 - RNA, 61 nt, hsa
gcagugaaaugaaccuuggguuagaguuaugguaggcaaaaagaaaaggagaauuuaggaa

SEQ ID NO: 420835 - RNA, 61 nt, hsa
uaagcaguugggaagaacaaauuguaugcauguaggcaaagauuuugaagauacauuugca

SEQ ID NO: 420836 - RNA, 61 nt, hsa
uagaaucagggaggacgggacuuaugcugugguaggcaacagaaaaaaacuucuauugauu

SEQ ID NO: 420837 - RNA, 61 nt, hsa
uauuauaguuaccuauuuuaagguaaggucuguaggcaagauauguaaguaaagacaagcc

SEQ ID NO: 420838 - RNA, 61 nt, hsa
acugcuuugaauacauacuauggauauaaauguaggcaaaaugaaagauuaugacuaauau

SEQ ID NO: 420839 - RNA, 61 nt, hsa
auuuaaauuuuauuugaaaaaaugaaauaaaguaggcaaaaaaauaaagauguuuauuuuu

SEQ ID NO: 420840 - RNA, 61 nt, hsa
cacauaaugugcuauuucugugaguuuuaaaguaggcaagggauaauaaccaaagaagaaa

SEQ ID NO: 420841 - RNA, 61 nt, hsa
auuggcacaauguauacuucagugcucacccguaggcaaaucucuuuuuaaaaaacucuuu

SEQ ID NO: 420842 - RNA, 61 nt, hsa
uuuuuuuucaugaaaaagugcucaaauuaugguaggcaacuaacgguguuuuuaagggggu

SEQ ID NO: 420843 - RNA, 61 nt, hsa
uaaaaaggaaguauuucucccaaaauugggaguaggcaaacuacuaaucaguuuagcuuug

SEQ ID NO: 420844 - RNA, 61 nt, hsa
uuuuaagagaguacagacauacacuuuuugaguaggcaauauguucacauaguuugaaauu

SEQ ID NO: 420845 - RNA, 61 nt, hsa
gguguuggugcaacucaccagcaggugugcaguaggcaagcuugaagguggcccaugcuuc

SEQ ID NO: 420846 - RNA, 61 nt, hsa
aggggcuaucaauguguagauaaagcccugaguaggcaagagcagugagauccacugcuau

SEQ ID NO: 420847 - RNA, 61 nt, hsa
uacagacauauacagcauguuacugaauacuguaggcaauaguaacagugguauuuguaua

SEQ ID NO: 420848 - RNA, 61 nt, hsa
guccugccuccccauuucucaagggaagccaguaggcaacacagccagcacggugcucucc

SEQ ID NO: 420849 - RNA, 61 nt, hsa
uauaauuaaaaggaaaacagaaaaaggaaaaguaggcaaaugugaaaauaguuucaauaua

SEQ ID NO: 420850 - RNA, 61 nt, hsa
uuuauaauaaagcauggaagaaauuaucuuaguaggcaauuguaacacuuuuugaaaguaa

SEQ ID NO: 420851 - RNA, 61 nt, hsa
acauaauguaaaguucuacaaaauaaagcuaguaggcaagaccccucaguguauaccuuua

SEQ ID NO: 420852 - RNA, 61 nt, hsa
auuaauuguagacuccaggauacaaaccauaguaggcaauacaauuuuagaauguaauaua

SEQ ID NO: 420853 - RNA, 61 nt, hsa
cagguuguuagaugauaacucaaaauuuucaguaggcaaauagguaauguggaaaucugaa

SEQ ID NO: 420854 - RNA, 61 nt, hsa
uauguaucuaccaucuaaucuaugcauguauguaggcaauacauguaucuaaacaauguau

SEQ ID NO: 420855 - RNA, 61 nt, hsa
aaguagcuuuucaauuugcuagaagcuuaauguaggcaagccacuucauuuuucagaacuu

SEQ ID NO: 420856 - RNA, 61 nt, hsa
uauuucugccuuuguguagacugaugauuaaguaggcaaacuacuucuacuuucaaagagc

SEQ ID NO: 420857 - RNA, 61 nt, hsa
cauuccacucuauaauaaaacaaaagauuuuguaggcaacucggaauauagcucuuuugaa

SEQ ID NO: 420858 - RNA, 61 nt, hsa
gcuacugauuuuccuuaauuugugggaaggaguaggcaaagaauaugcuuacaugauuaca

SEQ ID NO: 420859 - RNA, 61 nt, hsa
gaaggaggucauugaaaaagagaacagugacguaggcaaauguuucaagcacuuuagaaac

SEQ ID NO: 420860 - RNA, 61 nt, hsa
gcacuaggagcugauguuugccucauuuaaaguaggcaagccgagccaacugcagccauca

SEQ ID NO: 420861 - RNA, 61 nt, hsa
ucugcaaugagugauuacaugcuuguaauagguaggcaauuccuugauuacaggaagcuuu

SEQ ID NO: 420862 - RNA, 61 nt, hsa
cuuguggcaucagggaaauauuuguuacauaguaggcaauuuuuauccaguacuuuauaga

SEQ ID NO: 420863 - RNA, 61 nt, hsa
uagugccuuucuugucuugauuguauggucaguaggcaaucuuaaauguuuuuauuuaaaa

SEQ ID NO: 420864 - RNA, 61 nt, hsa
ugguacauugccauuccaaggaauucugagaguaggcaaacaaauuuugccuucaugguac

SEQ ID NO: 420865 - RNA, 61 nt, hsa
caaagguccuuagguguaaauugaugccaucguaggcaaggugcaggcaggauuugaaggc

SEQ ID NO: 420866 - RNA, 61 nt, hsa
cauauguccacuaaguacuccaauuaccagcguaggcaaaaugagcuuccaccucugucca

SEQ ID NO: 420867 - RNA, 61 nt, hsa
accauugucccaaagucuagagucuuuacagguaggcaaaauuuguuuucaaugccugugc

SEQ ID NO: 420868 - RNA, 61 nt, hsa
cacuacuuaacacuccuaaagacuacuuugaguaggcaacauaacuaaauuuuucuaguuu

SEQ ID NO: 420869 - RNA, 61 nt, hsa
ggaccgcagccugccgcuccgaacugagcccguaggcaaggugcaccugggugcccgggcc

SEQ ID NO: 420870 - RNA, 61 nt, hsa
acagaauguauguagagaguuggggugucugguaggcaaacugcaaggcaguugagauagu

SEQ ID NO: 420871 - RNA, 61 nt, hsa
gccuucuccuugaaaccuugguuaugacugcguaggcaagaaguugaaaaacaguugauuu

SEQ ID NO: 420872 - RNA, 61 nt, hsa
cugagguuggccagccccugccaaguguuguguaggcaaagcacuuguuaguggcuuccua

SEQ ID NO: 420873 - RNA, 61 nt, hsa
ccaucuacauuccauggaauguuuuuaauaaguaggcaagaaaaaugccacuaaucaaagc

SEQ ID NO: 420874 - RNA, 61 nt, hsa
uuuuuuuuuuuaagagcugugucauccuuauguaggcaagagauguuugcuuuuguuaaaa

SEQ ID NO: 420875 - RNA, 61 nt, hsa
ugagucauuuuaugaagcuaggucuuaaugcguaggcaaccucccagcucacuaugaacgc

SEQ ID NO: 420876 - RNA, 61 nt, hsa
uccccauccacugaguguagcauccucagagguaggcaaguuugcuucuagggaguuagca

SEQ ID NO: 420877 - RNA, 61 nt, hsa
agaaccuauuuuuuaucaucuuauuuucaaaguaggcaaaagcaaaaucacuuaauuagua

SEQ ID NO: 420878 - RNA, 61 nt, hsa
aaaucaaggcugucugcuuauuuauacuagcguaggcaacacuuggauuucccuucuuagu

SEQ ID NO: 420879 - RNA, 61 nt, hsa
agcacuugcuguauaugcaguauugagcacuguaggcaagagggaagaaagagaaggagcc

SEQ ID NO: 420880 - RNA, 61 nt, hsa
uuacacucaaagcuuucuuggaccccguuccguaggcaauaacgugcguccgccucagcgc

SEQ ID NO: 420881 - RNA, 61 nt, hsa
uuguuuuauaauugcuacugauuuuuuuaauguaggcaaagcuuuguuacuuugaaauuua

SEQ ID NO: 420882 - RNA, 61 nt, hsa
aggcccagccacucucccuggggccugguggguaggcaaguagcucuggggccaccucaag

SEQ ID NO: 420883 - RNA, 61 nt, hsa
acuagaccaccagaggaggaugugugggauuguaggcaaacccaccuguggcaucacugaa

SEQ ID NO: 420884 - RNA, 61 nt, hsa
aguuccucaguaagaaaaaaaauguguuuuuguaggcaaaaagaacauuucuaaagucuca

SEQ ID NO: 420885 - RNA, 61 nt, hsa
acaauguuuuuaauuacaaauccagaauucuguaggcaaaaugcuacaguucauaucuucc

SEQ ID NO: 420886 - RNA, 61 nt, hsa
uaauuuagauaaguuugagggaaaauaaucaguaggcaagaggaacauuuuuccuguagua

SEQ ID NO: 420887 - RNA, 61 nt, hsa
ccauguuuccaugugccauuucuuaccccuuguaggcaauggcaaagaauguggucaggcu

SEQ ID NO: 420888 - RNA, 61 nt, hsa
uugggauuauggcuuagaagaagggggcuggguaggcaagcacuccuuggcuguguccucu

SEQ ID NO: 420889 - RNA, 61 nt, hsa
guugaacaacuccauguagauaagagcaaguguaggcaaagguuuagaaaauggacauaaa

SEQ ID NO: 420890 - RNA, 61 nt, hsa
uauuuacaaguaugacuauuuuuuuuucaaaguaggcaauucuuuguauauuuuaaggcaa

SEQ ID NO: 420891 - RNA, 61 nt, hsa
aguuugugguacgaccccucccccuccccaaguaggcaaggacugcacguuucuuucucuc

SEQ ID NO: 420892 - RNA, 61 nt, hsa
aucaaccgggaguuugggguccuccccugaaguaggcaaggacugcacguuucuuucucuc

SEQ ID NO: 420893 - RNA, 61 nt, hsa
uccccccucgugcgcaucucagaacccaucgguaggcaaaggaaaauacgcucaggugguu

SEQ ID NO: 420894 - RNA, 61 nt, hsa
cccugccgccugugcccuugcuggguccaggguaggcaaggcugccggcugcacccuguau

SEQ ID NO: 420895 - RNA, 61 nt, hsa
uuugugggccuuugccccuuagaaaguagcuguaggcaaagauuugugauuuuccaauuac

SEQ ID NO: 420896 - RNA, 61 nt, hsa
aaaauuuguugcagcaagaacuuuccuaccuguaggcaauagauugcuauguuuuuaacaa

SEQ ID NO: 420897 - RNA, 61 nt, hsa
acccucacuccagccaucucggagcccuuguguaggcaacgcccggugcgggcuguguggg

SEQ ID NO: 420898 - RNA, 61 nt, hsa
aucagucauuguuacauggaaaagacaggugguaggcaaguagguggaggaucucgguuug

SEQ ID NO: 420899 - RNA, 61 nt, hsa
uuuccugaagauguuuaaacgugagagucugguaggcaaagcagucugagaaagaaauagg

SEQ ID NO: 420900 - RNA, 61 nt, hsa
ccucuuauuuuuacaaguuucauuuuuaaaaguaggcaacuacuuuggguuacaguauuuu

SEQ ID NO: 420901 - RNA, 61 nt, hsa
uaaaguuuuuuaagaauguuuaucucagccaguaggcaaauacuugguguaaaacaaguug

SEQ ID NO: 420902 - RNA, 61 nt, hsa
gugagcugagauaacgccacugcacuccaguguaggcaacagagugagacccugucucaaa

SEQ ID NO: 420903 - RNA, 61 nt, hsa
ggcgggcgcgcccgaagcgcccauccucgugguaggcaacaagcgggacaggcagcggcug

SEQ ID NO: 420904 - RNA, 61 nt, hsa
accucagucucccuuugggaccuguccaaggguaggcaaccaccuucaccuucacacagau

SEQ ID NO: 420905 - RNA, 61 nt, hsa
ccacccacuccauccuacccagggaccccaaguaggcaacuguuauggcaguggguccagc

SEQ ID NO: 420906 - RNA, 61 nt, hsa
gauaaaagagguuuaugaaguuuagggugaaguaggcaagggaaucuguuuacucccucuu

SEQ ID NO: 420907 - RNA, 61 nt, hsa
augaaaggccaaggggcuuuaucuuuuacuaguaggcaagccugggcauuucugcauuugu

SEQ ID NO: 420908 - RNA, 61 nt, hsa
gcaaaauauguauuuuuaaaguucaugauuuguaggcaaagauguuaagagcauuguuucc

SEQ ID NO: 420909 - RNA, 61 nt, hsa
uuagaaaacuuuguuaggccaaagacaaauaguaggcaagauggcacagggcaugaaauga

SEQ ID NO: 420910 - RNA, 61 nt, hsa
uguuguuucaagaguuuuaguuaaauaggaaguaggcaaauguaacuacugaguaucucuu

SEQ ID NO: 420911 - RNA, 61 nt, hsa
accaauauguucauauuaagcaguacagaguguaggcaagagaaagaauauguuauuguuc

SEQ ID NO: 420912 - RNA, 61 nt, hsa
aaaaaggugacucaccccucauuuccagaguguaggcaauuauguccugcuuugauaaaac

SEQ ID NO: 420913 - RNA, 61 nt, hsa
guuacucccuguaacuauguuaugcugugaaguaggcaauacaguuguuaaagaagaauaa

SEQ ID NO: 420914 - RNA, 63 nt, hsa
ccaguugucugguuuccauguauucuaggccagguaggcaacacagagccaaggcgggugcug

SEQ ID NO: 420915 - RNA, 63 nt, hsa
augcacacggugauuucauguuauauaugcaaaguaggcaacuguuuucuuaguuacagaagu

SEQ ID NO: 420916 - RNA, 63 nt, hsa
agucuuagguggguugggaagacagauaaugaaguaggcaaagagaaaaggacccaagauaga

SEQ ID NO: 420917 - RNA, 63 nt, hsa
caccaccaucuauagggucccaacuugguuauuguaggcaaccuucccucucuccuuggugaa

SEQ ID NO: 420918 - RNA, 63 nt, hsa
guaaaucaugaguagucgcauguguggacaucaguaggcaaguaaccaguuuuacuaaugcau

SEQ ID NO: 420919 - RNA, 63 nt, hsa
uugguaaucugaaaaggaccacaagcauagcugguaggcaaauuguuaggcagaauaauggua

SEQ ID NO: 420920 - RNA, 63 nt, hsa
aguggggccaaggaugccaccccacccucagcuguaggcaagcuugcacauaaauaacccccg

SEQ ID NO: 420921 - RNA, 63 nt, hsa
uugacacauccaggccaaccucccauggaauagguaggcaagccaggacuccgggaaggaggu

SEQ ID NO: 420922 - RNA, 63 nt, hsa
cuaauauuguguuauuaaaaugauggcuuuuggguaggcaaaacuucuuuucuaaaagguaua

SEQ ID NO: 420923 - RNA, 63 nt, hsa
aaaucuguacaacauguuacuguauugaauacaguaggcaauuguaacacaaugguaaguauc

SEQ ID NO: 420924 - RNA, 63 nt, hsa
gguauugcaagucauuugcucuaauucucaauuguaggcaaacugauuuguaaauuugcuucu

SEQ ID NO: 420925 - RNA, 63 nt, hsa
ucaacugcacguguuuuauauuuuuaagagaucguaggcaauuagagaucgaagccuccuauc

SEQ ID NO: 420926 - RNA, 63 nt, hsa
caguggagcccugagcagggcuggauaugggaaguaggcaaaugaaaugcgccaaggguucag

SEQ ID NO: 420927 - RNA, 63 nt, hsa
gccuguggcccagagacacaaugggguccuucuguaggcaaagguggaaguccuccagggauc

SEQ ID NO: 420928 - RNA, 63 nt, hsa
aucccuagacuaaguugaaauguauuucuaauaguaggcaauuuuaauuuucauguaguuguu

SEQ ID NO: 420929 - RNA, 63 nt, hsa
gugugucuguauguuucugcguugugugucuuuguaggcaagcaaacguugucuacacaaacg

SEQ ID NO: 420930 - RNA, 63 nt, hsa
caugguggcucagcuucuaaucccagcacuuugguaggcaaaggugggaggaucauuugagcu

SEQ ID NO: 420931 - RNA, 63 nt, hsa
ucccugggugaaaggccacaguauuuuggguugguaggcaaauugcaacauucuggacauggc

SEQ ID NO: 420932 - RNA, 63 nt, hsa
aacaucugauugcuggcuccuccuccguuugcaguaggcaagcucugcugcgaugccucugcc

SEQ ID NO: 420933 - RNA, 63 nt, hsa
uuauaucgauacaugaauuuaacuuacuuuaauguaggcaaacuaucaauuuuuuguccauuu

SEQ ID NO: 420934 - RNA, 63 nt, hsa
gaaaucacuggaaagaggagaggaaagaaccagguaggcaaauggucugugaaacccuugggu

SEQ ID NO: 420935 - RNA, 63 nt, hsa
aagcagugaaaugaaccuuggguuagaguuaugguaggcaaaaagaaaaggagaauuuaggaa

SEQ ID NO: 420936 - RNA, 63 nt, hsa
ccuaagcaguugggaagaacaaauuguaugcauguaggcaaagauuuugaagauacauuugca

SEQ ID NO: 420937 - RNA, 63 nt, hsa
aguagaaucagggaggacgggacuuaugcugugguaggcaacagaaaaaaacuucuauugauu

SEQ ID NO: 420938 - RNA, 63 nt, hsa
ucuauuauaguuaccuauuuuaagguaaggucuguaggcaagauauguaaguaaagacaagcc

SEQ ID NO: 420939 - RNA, 63 nt, hsa
ucacugcuuugaauacauacuauggauauaaauguaggcaaaaugaaagauuaugacuaauau

SEQ ID NO: 420940 - RNA, 63 nt, hsa
agauuuaaauuuuauuugaaaaaaugaaauaaaguaggcaaaaaaauaaagauguuuauuuuu

SEQ ID NO: 420941 - RNA, 63 nt, hsa
ugcacauaaugugcuauuucugugaguuuuaaaguaggcaagggauaauaaccaaagaagaaa

SEQ ID NO: 420942 - RNA, 63 nt, hsa
acauuggcacaauguauacuucagugcucacccguaggcaaaucucuuuuuaaaaaacucuuu

SEQ ID NO: 420943 - RNA, 63 nt, hsa
uuuuuuuuuucaugaaaaagugcucaaauuaugguaggcaacuaacgguguuuuuaagggggu

SEQ ID NO: 420944 - RNA, 63 nt, hsa
uguaaaaaggaaguauuucucccaaaauugggaguaggcaaacuacuaaucaguuuagcuuug

SEQ ID NO: 420945 - RNA, 63 nt, hsa
auuuuuaagagaguacagacauacacuuuuugaguaggcaauauguucacauaguuugaaauu

SEQ ID NO: 420946 - RNA, 63 nt, hsa
cggguguuggugcaacucaccagcaggugugcaguaggcaagcuugaagguggcccaugcuuc

SEQ ID NO: 420947 - RNA, 63 nt, hsa
ugaggggcuaucaauguguagauaaagcccugaguaggcaagagcagugagauccacugcuau

SEQ ID NO: 420948 - RNA, 63 nt, hsa
gcuacagacauauacagcauguuacugaauacuguaggcaauaguaacagugguauuuguaua

SEQ ID NO: 420949 - RNA, 63 nt, hsa
agguccugccuccccauuucucaagggaagccaguaggcaacacagccagcacggugcucucc

SEQ ID NO: 420950 - RNA, 63 nt, hsa
uguauaauuaaaaggaaaacagaaaaaggaaaaguaggcaaaugugaaaauaguuucaauaua

SEQ ID NO: 420951 - RNA, 63 nt, hsa
acuuuauaauaaagcauggaagaaauuaucuuaguaggcaauuguaacacuuuuugaaaguaa

SEQ ID NO: 420952 - RNA, 63 nt, hsa
ucacauaauguaaaguucuacaaaauaaagcuaguaggcaagaccccucaguguauaccuuua

SEQ ID NO: 420953 - RNA, 63 nt, hsa
aaauuaauuguagacuccaggauacaaaccauaguaggcaauacaauuuuagaauguaauaua

SEQ ID NO: 420954 - RNA, 63 nt, hsa
aucagguuguuagaugauaacucaaaauuuucaguaggcaaauagguaauguggaaaucugaa

SEQ ID NO: 420955 - RNA, 63 nt, hsa
ucuauguaucuaccaucuaaucuaugcauguauguaggcaauacauguaucuaaacaauguau

SEQ ID NO: 420956 - RNA, 63 nt, hsa
agaaguagcuuuucaauuugcuagaagcuuaauguaggcaagccacuucauuuuucagaacuu

SEQ ID NO: 420957 - RNA, 63 nt, hsa
uuuauuucugccuuuguguagacugaugauuaaguaggcaaacuacuucuacuuucaaagagc

SEQ ID NO: 420958 - RNA, 63 nt, hsa
uccauuccacucuauaauaaaacaaaagauuuuguaggcaacucggaauauagcucuuuugaa

SEQ ID NO: 420959 - RNA, 63 nt, hsa
uugcuacugauuuuccuuaauuugugggaaggaguaggcaaagaauaugcuuacaugauuaca

SEQ ID NO: 420960 - RNA, 63 nt, hsa
augaaggaggucauugaaaaagagaacagugacguaggcaaauguuucaagcacuuuagaaac

SEQ ID NO: 420961 - RNA, 63 nt, hsa
uggcacuaggagcugauguuugccucauuuaaaguaggcaagccgagccaacugcagccauca

SEQ ID NO: 420962 - RNA, 63 nt, hsa
aaucugcaaugagugauuacaugcuuguaauagguaggcaauuccuugauuacaggaagcuuu

SEQ ID NO: 420963 - RNA, 63 nt, hsa
aucuuguggcaucagggaaauauuuguuacauaguaggcaauuuuuauccaguacuuuauaga

SEQ ID NO: 420964 - RNA, 63 nt, hsa
ucuagugccuuucuugucuugauuguauggucaguaggcaaucuuaaauguuuuuauuuaaaa

SEQ ID NO: 420965 - RNA, 63 nt, hsa
ccugguacauugccauuccaaggaauucugagaguaggcaaacaaauuuugccuucaugguac

SEQ ID NO: 420966 - RNA, 63 nt, hsa
uucaaagguccuuagguguaaauugaugccaucguaggcaaggugcaggcaggauuugaaggc

SEQ ID NO: 420967 - RNA, 63 nt, hsa
gacauauguccacuaaguacuccaauuaccagcguaggcaaaaugagcuuccaccucugucca

SEQ ID NO: 420968 - RNA, 63 nt, hsa
ggaccauugucccaaagucuagagucuuuacagguaggcaaaauuuguuuucaaugccugugc

SEQ ID NO: 420969 - RNA, 63 nt, hsa
cacacuacuuaacacuccuaaagacuacuuugaguaggcaacauaacuaaauuuuucuaguuu

SEQ ID NO: 420970 - RNA, 63 nt, hsa
ugggaccgcagccugccgcuccgaacugagcccguaggcaaggugcaccugggugcccgggcc

SEQ ID NO: 420971 - RNA, 63 nt, hsa
ugacagaauguauguagagaguuggggugucugguaggcaaacugcaaggcaguugagauagu

SEQ ID NO: 420972 - RNA, 63 nt, hsa
cugccuucuccuugaaaccuugguuaugacugcguaggcaagaaguugaaaaacaguugauuu

SEQ ID NO: 420973 - RNA, 63 nt, hsa
cacugagguuggccagccccugccaaguguuguguaggcaaagcacuuguuaguggcuuccua

SEQ ID NO: 420974 - RNA, 63 nt, hsa
aaccaucuacauuccauggaauguuuuuaauaaguaggcaagaaaaaugccacuaaucaaagc

SEQ ID NO: 420975 - RNA, 63 nt, hsa
uuuuuuuuuuuuuaagagcugugucauccuuauguaggcaagagauguuugcuuuuguuaaaa

SEQ ID NO: 420976 - RNA, 63 nt, hsa
uuugagucauuuuaugaagcuaggucuuaaugcguaggcaaccucccagcucacuaugaacgc

SEQ ID NO: 420977 - RNA, 63 nt, hsa
uuuccccauccacugaguguagcauccucagagguaggcaaguuugcuucuagggaguuagca

SEQ ID NO: 420978 - RNA, 63 nt, hsa
ucagaaccuauuuuuuaucaucuuauuuucaaaguaggcaaaagcaaaaucacuuaauuagua

SEQ ID NO: 420979 - RNA, 63 nt, hsa
uuaaaucaaggcugucugcuuauuuauacuagcguaggcaacacuuggauuucccuucuuagu

SEQ ID NO: 420980 - RNA, 63 nt, hsa
ugagcacuugcuguauaugcaguauugagcacuguaggcaagagggaagaaagagaaggagcc

SEQ ID NO: 420981 - RNA, 63 nt, hsa
aguuacacucaaagcuuucuuggaccccguuccguaggcaauaacgugcguccgccucagcgc

SEQ ID NO: 420982 - RNA, 63 nt, hsa
acuuguuuuauaauugcuacugauuuuuuuaauguaggcaaagcuuuguuacuuugaaauuua

SEQ ID NO: 420983 - RNA, 63 nt, hsa
ugaggcccagccacucucccuggggccugguggguaggcaaguagcucuggggccaccucaag

SEQ ID NO: 420984 - RNA, 63 nt, hsa
ugacuagaccaccagaggaggaugugugggauuguaggcaaacccaccuguggcaucacugaa

SEQ ID NO: 420985 - RNA, 63 nt, hsa
aaaguuccucaguaagaaaaaaaauguguuuuuguaggcaaaaagaacauuucuaaagucuca

SEQ ID NO: 420986 - RNA, 63 nt, hsa
agacaauguuuuuaauuacaaauccagaauucuguaggcaaaaugcuacaguucauaucuucc

SEQ ID NO: 420987 - RNA, 63 nt, hsa
uuuaauuuagauaaguuugagggaaaauaaucaguaggcaagaggaacauuuuuccuguagua

SEQ ID NO: 420988 - RNA, 63 nt, hsa
ugccauguuuccaugugccauuucuuaccccuuguaggcaauggcaaagaauguggucaggcu

SEQ ID NO: 420989 - RNA, 63 nt, hsa
ccuugggauuauggcuuagaagaagggggcuggguaggcaagcacuccuuggcuguguccucu

SEQ ID NO: 420990 - RNA, 63 nt, hsa
agguugaacaacuccauguagauaagagcaaguguaggcaaagguuuagaaaauggacauaaa

SEQ ID NO: 420991 - RNA, 63 nt, hsa
uuuauuuacaaguaugacuauuuuuuuuucaaaguaggcaauucuuuguauauuuuaaggcaa

SEQ ID NO: 420992 - RNA, 63 nt, hsa
ggaguuugugguacgaccccucccccuccccaaguaggcaaggacugcacguuucuuucucuc

SEQ ID NO: 420993 - RNA, 63 nt, hsa
cuaucaaccgggaguuugggguccuccccugaaguaggcaaggacugcacguuucuuucucuc

SEQ ID NO: 420994 - RNA, 63 nt, hsa
uuuccccccucgugcgcaucucagaacccaucgguaggcaaaggaaaauacgcucaggugguu

SEQ ID NO: 420995 - RNA, 63 nt, hsa
gccccugccgccugugcccuugcuggguccaggguaggcaaggcugccggcugcacccuguau

SEQ ID NO: 420996 - RNA, 63 nt, hsa
gcuuugugggccuuugccccuuagaaaguagcuguaggcaaagauuugugauuuuccaauuac

SEQ ID NO: 420997 - RNA, 63 nt, hsa
uuaaaauuuguugcagcaagaacuuuccuaccuguaggcaauagauugcuauguuuuuaacaa

SEQ ID NO: 420998 - RNA, 63 nt, hsa
ccacccucacuccagccaucucggagcccuuguguaggcaacgcccggugcgggcuguguggg

SEQ ID NO: 420999 - RNA, 63 nt, hsa
acaucagucauuguuacauggaaaagacaggugguaggcaaguagguggaggaucucgguuug

SEQ ID NO: 421000 - RNA, 63 nt, hsa
cauuuccugaagauguuuaaacgugagagucugguaggcaaagcagucugagaaagaaauagg

SEQ ID NO: 421001 - RNA, 63 nt, hsa
ucccucuuauuuuuacaaguuucauuuuuaaaaguaggcaacuacuuuggguuacaguauuuu

SEQ ID NO: 421002 - RNA, 63 nt, hsa
aguaaaguuuuuuaagaauguuuaucucagccaguaggcaaauacuugguguaaaacaaguug

SEQ ID NO: 421003 - RNA, 63 nt, hsa
cagugagcugagauaacgccacugcacuccaguguaggcaacagagugagacccugucucaaa

SEQ ID NO: 421004 - RNA, 63 nt, hsa
ccggcgggcgcgcccgaagcgcccauccucgugguaggcaacaagcgggacaggcagcggcug

SEQ ID NO: 421005 - RNA, 63 nt, hsa
caaccucagucucccuuugggaccuguccaaggguaggcaaccaccuucaccuucacacagau

SEQ ID NO: 421006 - RNA, 63 nt, hsa
ccccacccacuccauccuacccagggaccccaaguaggcaacuguuauggcaguggguccagc

SEQ ID NO: 421007 - RNA, 63 nt, hsa
cagauaaaagagguuuaugaaguuuagggugaaguaggcaagggaaucuguuuacucccucuu

SEQ ID NO: 421008 - RNA, 63 nt, hsa
auaugaaaggccaaggggcuuuaucuuuuacuaguaggcaagccugggcauuucugcauuugu

SEQ ID NO: 421009 - RNA, 63 nt, hsa
uugcaaaauauguauuuuuaaaguucaugauuuguaggcaaagauguuaagagcauuguuucc

SEQ ID NO: 421010 - RNA, 63 nt, hsa
uauuagaaaacuuuguuaggccaaagacaaauaguaggcaagauggcacagggcaugaaauga

SEQ ID NO: 421011 - RNA, 63 nt, hsa
uguguuguuucaagaguuuuaguuaaauaggaaguaggcaaauguaacuacugaguaucucuu

SEQ ID NO: 421012 - RNA, 63 nt, hsa
ugaccaauauguucauauuaagcaguacagaguguaggcaagagaaagaauauguuauuguuc

SEQ ID NO: 421013 - RNA, 63 nt, hsa
ugaaaaaggugacucaccccucauuuccagaguguaggcaauuauguccugcuuugauaaaac

SEQ ID NO: 421014 - RNA, 63 nt, hsa
caguuacucccuguaacuauguuaugcugugaaguaggcaauacaguuguuaaagaagaauaa

SEQ ID NO: 421015 - RNA, 66 nt, hsa
uggccaguugucugguuuccauguauucuaggccagguaggcaacacagagccaaggcgggugcug

SEQ ID NO: 421016 - RNA, 66 nt, hsa
cuuaugcacacggugauuucauguuauauaugcaaaguaggcaacuguuuucuuaguuacagaagu

SEQ ID NO: 421017 - RNA, 66 nt, hsa
cuaagucuuagguggguugggaagacagauaaugaaguaggcaaagagaaaaggacccaagauaga

SEQ ID NO: 421018 - RNA, 66 nt, hsa
ugacaccaccaucuauagggucccaacuugguuauuguaggcaaccuucccucucuccuuggugaa

SEQ ID NO: 421019 - RNA, 66 nt, hsa
gcaguaaaucaugaguagucgcauguguggacaucaguaggcaaguaaccaguuuuacuaaugcau

SEQ ID NO: 421020 - RNA, 66 nt, hsa
agauugguaaucugaaaaggaccacaagcauagcugguaggcaaauuguuaggcagaauaauggua

SEQ ID NO: 421021 - RNA, 66 nt, hsa
ugcaguggggccaaggaugccaccccacccucagcuguaggcaagcuugcacauaaauaacccccg

SEQ ID NO: 421022 - RNA, 66 nt, hsa
cccuugacacauccaggccaaccucccauggaauagguaggcaagccaggacuccgggaaggaggu

SEQ ID NO: 421023 - RNA, 66 nt, hsa
acacuaauauuguguuauuaaaaugauggcuuuuggguaggcaaaacuucuuuucuaaaagguaua

SEQ ID NO: 421024 - RNA, 66 nt, hsa
uacaaaucuguacaacauguuacuguauugaauacaguaggcaauuguaacacaaugguaaguauc

SEQ ID NO: 421025 - RNA, 66 nt, hsa
ccugguauugcaagucauuugcucuaauucucaauuguaggcaaacugauuuguaaauuugcuucu

SEQ ID NO: 421026 - RNA, 66 nt, hsa
aagucaacugcacguguuuuauauuuuuaagagaucguaggcaauuagagaucgaagccuccuauc

SEQ ID NO: 421027 - RNA, 66 nt, hsa
uugcaguggagcccugagcagggcuggauaugggaaguaggcaaaugaaaugcgccaaggguucag

SEQ ID NO: 421028 - RNA, 66 nt, hsa
ucagccuguggcccagagacacaaugggguccuucuguaggcaaagguggaaguccuccagggauc

SEQ ID NO: 421029 - RNA, 66 nt, hsa
uggaucccuagacuaaguugaaauguauuucuaauaguaggcaauuuuaauuuucauguaguuguu

SEQ ID NO: 421030 - RNA, 66 nt, hsa
ugugugugucuguauguuucugcguugugugucuuuguaggcaagcaaacguugucuacacaaacg

SEQ ID NO: 421031 - RNA, 66 nt, hsa
ggacaugguggcucagcuucuaaucccagcacuuugguaggcaaaggugggaggaucauuugagcu

SEQ ID NO: 421032 - RNA, 66 nt, hsa
ggcucccugggugaaaggccacaguauuuuggguugguaggcaaauugcaacauucuggacauggc

SEQ ID NO: 421033 - RNA, 66 nt, hsa
gaaaacaucugauugcuggcuccuccuccguuugcaguaggcaagcucugcugcgaugccucugcc

SEQ ID NO: 421034 - RNA, 66 nt, hsa
uaauuauaucgauacaugaauuuaacuuacuuuaauguaggcaaacuaucaauuuuuuguccauuu

SEQ ID NO: 421035 - RNA, 66 nt, hsa
cuagaaaucacuggaaagaggagaggaaagaaccagguaggcaaauggucugugaaacccuugggu

SEQ ID NO: 421036 - RNA, 66 nt, hsa
gccaagcagugaaaugaaccuuggguuagaguuaugguaggcaaaaagaaaaggagaauuuaggaa

SEQ ID NO: 421037 - RNA, 66 nt, hsa
uucccuaagcaguugggaagaacaaauuguaugcauguaggcaaagauuuugaagauacauuugca

SEQ ID NO: 421038 - RNA, 66 nt, hsa
auuaguagaaucagggaggacgggacuuaugcugugguaggcaacagaaaaaaacuucuauugauu

SEQ ID NO: 421039 - RNA, 66 nt, hsa
uaaucuauuauaguuaccuauuuuaagguaaggucuguaggcaagauauguaaguaaagacaagcc

SEQ ID NO: 421040 - RNA, 66 nt, hsa
acuucacugcuuugaauacauacuauggauauaaauguaggcaaaaugaaagauuaugacuaauau

SEQ ID NO: 421041 - RNA, 66 nt, hsa
uacagauuuaaauuuuauuugaaaaaaugaaauaaaguaggcaaaaaaauaaagauguuuauuuuu

SEQ ID NO: 421042 - RNA, 66 nt, hsa
gcuugcacauaaugugcuauuucugugaguuuuaaaguaggcaagggauaauaaccaaagaagaaa

SEQ ID NO: 421043 - RNA, 66 nt, hsa
auuacauuggcacaauguauacuucagugcucacccguaggcaaaucucuuuuuaaaaaacucuuu

SEQ ID NO: 421044 - RNA, 66 nt, hsa
uuuuuuuuuuuuucaugaaaaagugcucaaauuaugguaggcaacuaacgguguuuuuaagggggu

SEQ ID NO: 421045 - RNA, 66 nt, hsa
uuuuguaaaaaggaaguauuucucccaaaauugggaguaggcaaacuacuaaucaguuuagcuuug

SEQ ID NO: 421046 - RNA, 66 nt, hsa
uucauuuuuaagagaguacagacauacacuuuuugaguaggcaauauguucacauaguuugaaauu

SEQ ID NO: 421047 - RNA, 66 nt, hsa
acacggguguuggugcaacucaccagcaggugugcaguaggcaagcuugaagguggcccaugcuuc

SEQ ID NO: 421048 - RNA, 66 nt, hsa
cucugaggggcuaucaauguguagauaaagcccugaguaggcaagagcagugagauccacugcuau

SEQ ID NO: 421049 - RNA, 66 nt, hsa
uaggcuacagacauauacagcauguuacugaauacuguaggcaauaguaacagugguauuuguaua

SEQ ID NO: 421050 - RNA, 66 nt, hsa
uagagguccugccuccccauuucucaagggaagccaguaggcaacacagccagcacggugcucucc

SEQ ID NO: 421051 - RNA, 66 nt, hsa
auuuguauaauuaaaaggaaaacagaaaaaggaaaaguaggcaaaugugaaaauaguuucaauaua

SEQ ID NO: 421052 - RNA, 66 nt, hsa
ugcacuuuauaauaaagcauggaagaaauuaucuuaguaggcaauuguaacacuuuuugaaaguaa

SEQ ID NO: 421053 - RNA, 66 nt, hsa
auuucacauaauguaaaguucuacaaaauaaagcuaguaggcaagaccccucaguguauaccuuua

SEQ ID NO: 421054 - RNA, 66 nt, hsa
uuaaaauuaauuguagacuccaggauacaaaccauaguaggcaauacaauuuuagaauguaauaua

SEQ ID NO: 421055 - RNA, 66 nt, hsa
auuaucagguuguuagaugauaacucaaaauuuucaguaggcaaauagguaauguggaaaucugaa

SEQ ID NO: 421056 - RNA, 66 nt, hsa
acaucuauguaucuaccaucuaaucuaugcauguauguaggcaauacauguaucuaaacaauguau

SEQ ID NO: 421057 - RNA, 66 nt, hsa
ccaagaaguagcuuuucaauuugcuagaagcuuaauguaggcaagccacuucauuuuucagaacuu

SEQ ID NO: 421058 - RNA, 66 nt, hsa
cuuuuuauuucugccuuuguguagacugaugauuaaguaggcaaacuacuucuacuuucaaagagc

SEQ ID NO: 421059 - RNA, 66 nt, hsa
ugauccauuccacucuauaauaaaacaaaagauuuuguaggcaacucggaauauagcucuuuugaa

SEQ ID NO: 421060 - RNA, 66 nt, hsa
auuuugcuacugauuuuccuuaauuugugggaaggaguaggcaaagaauaugcuuacaugauuaca

SEQ ID NO: 421061 - RNA, 66 nt, hsa
uuuaugaaggaggucauugaaaaagagaacagugacguaggcaaauguuucaagcacuuuagaaac

SEQ ID NO: 421062 - RNA, 66 nt, hsa
gaauggcacuaggagcugauguuugccucauuuaaaguaggcaagccgagccaacugcagccauca

SEQ ID NO: 421063 - RNA, 66 nt, hsa
aggaaucugcaaugagugauuacaugcuuguaauagguaggcaauuccuugauuacaggaagcuuu

SEQ ID NO: 421064 - RNA, 66 nt, hsa
uuaaucuuguggcaucagggaaauauuuguuacauaguaggcaauuuuuauccaguacuuuauaga

SEQ ID NO: 421065 - RNA, 66 nt, hsa
guuucuagugccuuucuugucuugauuguauggucaguaggcaaucuuaaauguuuuuauuuaaaa

SEQ ID NO: 421066 - RNA, 66 nt, hsa
ccuccugguacauugccauuccaaggaauucugagaguaggcaaacaaauuuugccuucaugguac

SEQ ID NO: 421067 - RNA, 66 nt, hsa
cucuucaaagguccuuagguguaaauugaugccaucguaggcaaggugcaggcaggauuugaaggc

SEQ ID NO: 421068 - RNA, 66 nt, hsa
gaagacauauguccacuaaguacuccaauuaccagcguaggcaaaaugagcuuccaccucugucca

SEQ ID NO: 421069 - RNA, 66 nt, hsa
ccaggaccauugucccaaagucuagagucuuuacagguaggcaaaauuuguuuucaaugccugugc

SEQ ID NO: 421070 - RNA, 66 nt, hsa
agacacacuacuuaacacuccuaaagacuacuuugaguaggcaacauaacuaaauuuuucuaguuu

SEQ ID NO: 421071 - RNA, 66 nt, hsa
gucugggaccgcagccugccgcuccgaacugagcccguaggcaaggugcaccugggugcccgggcc

SEQ ID NO: 421072 - RNA, 66 nt, hsa
acaugacagaauguauguagagaguuggggugucugguaggcaaacugcaaggcaguugagauagu

SEQ ID NO: 421073 - RNA, 66 nt, hsa
cgccugccuucuccuugaaaccuugguuaugacugcguaggcaagaaguugaaaaacaguugauuu

SEQ ID NO: 421074 - RNA, 66 nt, hsa
caucacugagguuggccagccccugccaaguguuguguaggcaaagcacuuguuaguggcuuccua

SEQ ID NO: 421075 - RNA, 66 nt, hsa
agaaaccaucuacauuccauggaauguuuuuaauaaguaggcaagaaaaaugccacuaaucaaagc

SEQ ID NO: 421076 - RNA, 66 nt, hsa
aucuuuuuuuuuuuuuaagagcugugucauccuuauguaggcaagagauguuugcuuuuguuaaaa

SEQ ID NO: 421077 - RNA, 66 nt, hsa
ggcuuugagucauuuuaugaagcuaggucuuaaugcguaggcaaccucccagcucacuaugaacgc

SEQ ID NO: 421078 - RNA, 66 nt, hsa
ugguuuccccauccacugaguguagcauccucagagguaggcaaguuugcuucuagggaguuagca

SEQ ID NO: 421079 - RNA, 66 nt, hsa
aauucagaaccuauuuuuuaucaucuuauuuucaaaguaggcaaaagcaaaaucacuuaauuagua

SEQ ID NO: 421080 - RNA, 66 nt, hsa
cucuuaaaucaaggcugucugcuuauuuauacuagcguaggcaacacuuggauuucccuucuuagu

SEQ ID NO: 421081 - RNA, 66 nt, hsa
uauugagcacuugcuguauaugcaguauugagcacuguaggcaagagggaagaaagagaaggagcc

SEQ ID NO: 421082 - RNA, 66 nt, hsa
aucaguuacacucaaagcuuucuuggaccccguuccguaggcaauaacgugcguccgccucagcgc

SEQ ID NO: 421083 - RNA, 66 nt, hsa
uugacuuguuuuauaauugcuacugauuuuuuuaauguaggcaaagcuuuguuacuuugaaauuua

SEQ ID NO: 421084 - RNA, 66 nt, hsa
gguugaggcccagccacucucccuggggccugguggguaggcaaguagcucuggggccaccucaag

SEQ ID NO: 421085 - RNA, 66 nt, hsa
uauugacuagaccaccagaggaggaugugugggauuguaggcaaacccaccuguggcaucacugaa

SEQ ID NO: 421086 - RNA, 66 nt, hsa
auuaaaguuccucaguaagaaaaaaaauguguuuuuguaggcaaaaagaacauuucuaaagucuca

SEQ ID NO: 421087 - RNA, 66 nt, hsa
ugaagacaauguuuuuaauuacaaauccagaauucuguaggcaaaaugcuacaguucauaucuucc

SEQ ID NO: 421088 - RNA, 66 nt, hsa
guguuuaauuuagauaaguuugagggaaaauaaucaguaggcaagaggaacauuuuuccuguagua

SEQ ID NO: 421089 - RNA, 66 nt, hsa
gccugccauguuuccaugugccauuucuuaccccuuguaggcaauggcaaagaauguggucaggcu

SEQ ID NO: 421090 - RNA, 66 nt, hsa
accccuugggauuauggcuuagaagaagggggcuggguaggcaagcacuccuuggcuguguccucu

SEQ ID NO: 421091 - RNA, 66 nt, hsa
ggcagguugaacaacuccauguagauaagagcaaguguaggcaaagguuuagaaaauggacauaaa

SEQ ID NO: 421092 - RNA, 66 nt, hsa
cuauuuauuuacaaguaugacuauuuuuuuuucaaaguaggcaauucuuuguauauuuuaaggcaa

SEQ ID NO: 421093 - RNA, 66 nt, hsa
caaggaguuugugguacgaccccucccccuccccaaguaggcaaggacugcacguuucuuucucuc

SEQ ID NO: 421094 - RNA, 66 nt, hsa
cuacuaucaaccgggaguuugggguccuccccugaaguaggcaaggacugcacguuucuuucucuc

SEQ ID NO: 421095 - RNA, 66 nt, hsa
caauuuccccccucgugcgcaucucagaacccaucgguaggcaaaggaaaauacgcucaggugguu

SEQ ID NO: 421096 - RNA, 66 nt, hsa
ccugccccugccgccugugcccuugcuggguccaggguaggcaaggcugccggcugcacccuguau

SEQ ID NO: 421097 - RNA, 66 nt, hsa
caggcuuugugggccuuugccccuuagaaaguagcuguaggcaaagauuugugauuuuccaauuac

SEQ ID NO: 421098 - RNA, 66 nt, hsa
cauuuaaaauuuguugcagcaagaacuuuccuaccuguaggcaauagauugcuauguuuuuaacaa

SEQ ID NO: 421099 - RNA, 66 nt, hsa
gccccacccucacuccagccaucucggagcccuuguguaggcaacgcccggugcgggcuguguggg

SEQ ID NO: 421100 - RNA, 66 nt, hsa
ucuacaucagucauuguuacauggaaaagacaggugguaggcaaguagguggaggaucucgguuug

SEQ ID NO: 421101 - RNA, 66 nt, hsa
cugcauuuccugaagauguuuaaacgugagagucugguaggcaaagcagucugagaaagaaauagg

SEQ ID NO: 421102 - RNA, 66 nt, hsa
ggcucccucuuauuuuuacaaguuucauuuuuaaaaguaggcaacuacuuuggguuacaguauuuu

SEQ ID NO: 421103 - RNA, 66 nt, hsa
uucaguaaaguuuuuuaagaauguuuaucucagccaguaggcaaauacuugguguaaaacaaguug

SEQ ID NO: 421104 - RNA, 66 nt, hsa
uugcagugagcugagauaacgccacugcacuccaguguaggcaacagagugagacccugucucaaa

SEQ ID NO: 421105 - RNA, 66 nt, hsa
aggccggcgggcgcgcccgaagcgcccauccucgugguaggcaacaagcgggacaggcagcggcug

SEQ ID NO: 421106 - RNA, 66 nt, hsa
ugacaaccucagucucccuuugggaccuguccaaggguaggcaaccaccuucaccuucacacagau

SEQ ID NO: 421107 - RNA, 66 nt, hsa
gcaccccacccacuccauccuacccagggaccccaaguaggcaacuguuauggcaguggguccagc

SEQ ID NO: 421108 - RNA, 66 nt, hsa
gugcagauaaaagagguuuaugaaguuuagggugaaguaggcaagggaaucuguuuacucccucuu

SEQ ID NO: 421109 - RNA, 66 nt, hsa
gucauaugaaaggccaaggggcuuuaucuuuuacuaguaggcaagccugggcauuucugcauuugu

SEQ ID NO: 421110 - RNA, 66 nt, hsa
aaauugcaaaauauguauuuuuaaaguucaugauuuguaggcaaagauguuaagagcauuguuucc

SEQ ID NO: 421111 - RNA, 66 nt, hsa
ccauauuagaaaacuuuguuaggccaaagacaaauaguaggcaagauggcacagggcaugaaauga

SEQ ID NO: 421112 - RNA, 66 nt, hsa
acuuguguuguuucaagaguuuuaguuaaauaggaaguaggcaaauguaacuacugaguaucucuu

SEQ ID NO: 421113 - RNA, 66 nt, hsa
aagugaccaauauguucauauuaagcaguacagaguguaggcaagagaaagaauauguuauuguuc

SEQ ID NO: 421114 - RNA, 66 nt, hsa
uuuugaaaaaggugacucaccccucauuuccagaguguaggcaauuauguccugcuuugauaaaac

SEQ ID NO: 421115 - RNA, 66 nt, hsa
acucaguuacucccuguaacuauguuaugcugugaaguaggcaauacaguuguuaaagaagaauaa

SEQ ID NO: 421116 - RNA, 64 nt, hsa; identical to SEQ ID NO: 374207

SEQ ID NO: 421117 - RNA, 64 nt, hsa; identical to SEQ ID NO: 374208

SEQ ID NO: 421118 - RNA, 64 nt, hsa; identical to SEQ ID NO: 374209

SEQ ID NO: 421119 - RNA, 64 nt, hsa; identical to SEQ ID NO: 374210

SEQ ID NO: 421120 - RNA, 64 nt, hsa; identical to SEQ ID NO: 374211

SEQ ID NO: 421121 - RNA, 64 nt, hsa; identical to SEQ ID NO: 374212

SEQ ID NO: 421122 - RNA, 64 nt, hsa; identical to SEQ ID NO: 374213

SEQ ID NO: 421123 - RNA, 64 nt, hsa; identical to SEQ ID NO: 374214

SEQ ID NO: 421124 - RNA, 64 nt, hsa; identical to SEQ ID NO: 374215

SEQ ID NO: 421125 - RNA, 64 nt, hsa; identical to SEQ ID NO: 374216

SEQ ID NO: 421126 - RNA, 64 nt, hsa; identical to SEQ ID NO: 374217

SEQ ID NO: 421127 - RNA, 64 nt, hsa; identical to SEQ ID NO: 374218

SEQ ID NO: 421128 - RNA, 64 nt, hsa; identical to SEQ ID NO: 374219

SEQ ID NO: 421129 - RNA, 64 nt, hsa; identical to SEQ ID NO: 374220

SEQ ID NO: 421130 - RNA, 64 nt, hsa; identical to SEQ ID NO: 374221

SEQ ID NO: 421131 - RNA, 64 nt, hsa; identical to SEQ ID NO: 374222

SEQ ID NO: 421132 - RNA, 64 nt, hsa; identical to SEQ ID NO: 374223

SEQ ID NO: 421133 - RNA, 64 nt, hsa; identical to SEQ ID NO: 374224

SEQ ID NO: 421134 - RNA, 64 nt, hsa; identical to SEQ ID NO: 374225

SEQ ID NO: 421135 - RNA, 64 nt, hsa; identical to SEQ ID NO: 374226

SEQ ID NO: 421136 - RNA, 64 nt, hsa; identical to SEQ ID NO: 374227

SEQ ID NO: 421137 - RNA, 64 nt, hsa; identical to SEQ ID NO: 374228

SEQ ID NO: 421138 - RNA, 64 nt, hsa; identical to SEQ ID NO: 374229

SEQ ID NO: 421139 - RNA, 64 nt, hsa; identical to SEQ ID NO: 374230

SEQ ID NO: 421140 - RNA, 64 nt, hsa; identical to SEQ ID NO: 374231

SEQ ID NO: 421141 - RNA, 64 nt, hsa; identical to SEQ ID NO: 374232

SEQ ID NO: 421142 - RNA, 64 nt, hsa; identical to SEQ ID NO: 374233

SEQ ID NO: 421143 - RNA, 64 nt, hsa; identical to SEQ ID NO: 374234

SEQ ID NO: 421144 - RNA, 64 nt, hsa; identical to SEQ ID NO: 374235

SEQ ID NO: 421145 - RNA, 64 nt, hsa; identical to SEQ ID NO: 374236

SEQ ID NO: 421146 - RNA, 64 nt, hsa; identical to SEQ ID NO: 374237

SEQ ID NO: 421147 - RNA, 64 nt, hsa; identical to SEQ ID NO: 374238

SEQ ID NO: 421148 - RNA, 64 nt, hsa; identical to SEQ ID NO: 374239

SEQ ID NO: 421149 - RNA, 64 nt, hsa; identical to SEQ ID NO: 374240

SEQ ID NO: 421150 - RNA, 64 nt, hsa; identical to SEQ ID NO: 374241

SEQ ID NO: 421151 - RNA, 64 nt, hsa; identical to SEQ ID NO: 374242

SEQ ID NO: 421152 - RNA, 64 nt, hsa; identical to SEQ ID NO: 374243

SEQ ID NO: 421153 - RNA, 64 nt, hsa; identical to SEQ ID NO: 374244

SEQ ID NO: 421154 - RNA, 64 nt, hsa; identical to SEQ ID NO: 374245

SEQ ID NO: 421155 - RNA, 64 nt, hsa; identical to SEQ ID NO: 374246

SEQ ID NO: 421156 - RNA, 64 nt, hsa; identical to SEQ ID NO: 374247

SEQ ID NO: 421157 - RNA, 64 nt, hsa; identical to SEQ ID NO: 374248

SEQ ID NO: 421158 - RNA, 64 nt, hsa; identical to SEQ ID NO: 374249

SEQ ID NO: 421159 - RNA, 64 nt, hsa; identical to SEQ ID NO: 374250

SEQ ID NO: 421160 - RNA, 64 nt, hsa; identical to SEQ ID NO: 374251

SEQ ID NO: 421161 - RNA, 64 nt, hsa; identical to SEQ ID NO: 374252

SEQ ID NO: 421162 - RNA, 64 nt, hsa; identical to SEQ ID NO: 374253

SEQ ID NO: 421163 - RNA, 64 nt, hsa; identical to SEQ ID NO: 374254

SEQ ID NO: 421164 - RNA, 64 nt, hsa; identical to SEQ ID NO: 374255

SEQ ID NO: 421165 - RNA, 64 nt, hsa; identical to SEQ ID NO: 374256

SEQ ID NO: 421166 - RNA, 64 nt, hsa; identical to SEQ ID NO: 374257

SEQ ID NO: 421167 - RNA, 64 nt, hsa; identical to SEQ ID NO: 374258

SEQ ID NO: 421168 - RNA, 64 nt, hsa; identical to SEQ ID NO: 374259

SEQ ID NO: 421169 - RNA, 64 nt, hsa; identical to SEQ ID NO: 374260

SEQ ID NO: 421170 - RNA, 64 nt, hsa; identical to SEQ ID NO: 374261

SEQ ID NO: 421171 - RNA, 64 nt, hsa; identical to SEQ ID NO: 374262

SEQ ID NO: 421172 - RNA, 64 nt, hsa; identical to SEQ ID NO: 374263

SEQ ID NO: 421173 - RNA, 64 nt, hsa; identical to SEQ ID NO: 374264

SEQ ID NO: 421174 - RNA, 64 nt, hsa; identical to SEQ ID NO: 374265

SEQ ID NO: 421175 - RNA, 64 nt, hsa; identical to SEQ ID NO: 374266

SEQ ID NO: 421176 - RNA, 64 nt, hsa; identical to SEQ ID NO: 374267

SEQ ID NO: 421177 - RNA, 64 nt, hsa; identical to SEQ ID NO: 374268

SEQ ID NO: 421178 - RNA, 64 nt, hsa; identical to SEQ ID NO: 374269

SEQ ID NO: 421179 - RNA, 64 nt, hsa; identical to SEQ ID NO: 374270

SEQ ID NO: 421180 - RNA, 64 nt, hsa; identical to SEQ ID NO: 374271

SEQ ID NO: 421181 - RNA, 64 nt, hsa; identical to SEQ ID NO: 374272

SEQ ID NO: 421182 - RNA, 64 nt, hsa; identical to SEQ ID NO: 374273

SEQ ID NO: 421183 - RNA, 64 nt, hsa; identical to SEQ ID NO: 374274

SEQ ID NO: 421184 - RNA, 64 nt, hsa; identical to SEQ ID NO: 374275

SEQ ID NO: 421185 - RNA, 64 nt, hsa; identical to SEQ ID NO: 374276

SEQ ID NO: 421186 - RNA, 64 nt, hsa; identical to SEQ ID NO: 374277

SEQ ID NO: 421187 - RNA, 64 nt, hsa; identical to SEQ ID NO: 374278

SEQ ID NO: 421188 - RNA, 64 nt, hsa; identical to SEQ ID NO: 374279

SEQ ID NO: 421189 - RNA, 64 nt, hsa
uugaaaguggccuggauagggaaguuguuuuccuuuuaaagaaggauauauaauaauucccaug

SEQ ID NO: 421190 - RNA, 64 nt, hsa
guguguuuguaaaacuagaguugcuaaggauaaguuuaaagaccaauaccccuguacuuaaucc

SEQ ID NO: 421191 - RNA, 64 nt, hsa
uuguaaauaggaaacaugaauguucauuuuuuucuuuaaagaauucuuauuaaauggcucccug

SEQ ID NO: 421192 - RNA, 64 nt, hsa
gugggggaggggggcgguguugaggagagguauuuuuaaagaucuggcaacuuuucaggauuau

SEQ ID NO: 421193 - RNA, 64 nt, hsa
gaacugcuccaaguaacgcuaauuaaaaacuugcuuuaaagauauugaauuuaaaaaggcauaa

SEQ ID NO: 421194 - RNA, 64 nt, hsa
gcuacguugacucuuaaaaucuauguucucuuauuuuaaagauacagugcuccccacugaaaau

SEQ ID NO: 421195 - RNA, 64 nt, hsa
auuacccuaaacuguuuaaauaaagagcucuauuuuuaaagaaaaaagguacaauugaauggaa

SEQ ID NO: 421196 - RNA, 64 nt, hsa
ugagccaccgcgcccagccaaaccuuacuauuuuuuuaaagaauuuuuuccagaguuuaauuuc

SEQ ID NO: 421197 - RNA, 64 nt, hsa
gugcagccugauuuaaaaccaaacccugaacccuuuuaaagaacaauaaaacauauuuuacacg

SEQ ID NO: 421198 - RNA, 64 nt, hsa
auaaagcaacaugaaacauuagcccuccuuuuauuuuaaagacuaauguuaauuguucuuaaaa

SEQ ID NO: 421199 - RNA, 64 nt, hsa
agaauaagaaaauaguucuucaggagggccgaccuuuaaagaacuucaacauaguuucggaauu

SEQ ID NO: 421200 - RNA, 64 nt, hsa
uaacucauuugaugcaccuaaagggguuccucauuuuaaagauuuguuaggccaagaagcaaga

SEQ ID NO: 421201 - RNA, 64 nt, hsa
cuacaauaaugauaauuuauuagucuuucuguuauuuaaagaauaaaaacaugcuuauaaaaga

SEQ ID NO: 421202 - RNA, 64 nt, hsa
aaugaagcagaucaacuuaaaggauaauaaaauuuuuaaagaaaagauauucuaauguacucuc

SEQ ID NO: 421203 - RNA, 64 nt, hsa
acaauugaggaaaaagucaaaauuauaaaauaccuuuaaagacaugcacuuuccauauuuucaa

SEQ ID NO: 421204 - RNA, 64 nt, hsa
uggcauaauauuugaagugcacauuuuugugauuuuuaaagauuauuuagugcuaacuuuuaau

SEQ ID NO: 421205 - RNA, 64 nt, hsa
gauaaauuaagaaagaugccuaaauagaagcaaguuuaaagagcuauauuuuuaaacaugaaca

SEQ ID NO: 421206 - RNA, 64 nt, hsa
aaaaguguguuugguuauuaauauauaugagacuuuuaaagaaaguuauauaacuacauagaga

SEQ ID NO: 421207 - RNA, 64 nt, hsa
caauaugauaauaaaauacauuugucuauaaucguuuaaagauuagcuuugcaugauccuuuau

SEQ ID NO: 421208 - RNA, 64 nt, hsa
uguuaagguacauuaauaacuacacaaaauuuuauuuaaagagaacacuuagcagccuaugaua

SEQ ID NO: 421209 - RNA, 64 nt, hsa
ggucacaucugucucuagauggucauugaauuuguuuaaagauggaugaaaggccaggcauggu

SEQ ID NO: 421210 - RNA, 64 nt, hsa
aacuuaccuaguagagauuuagugaguuguuuccuuuaaagaauuuuacacuacauauuuuaau

SEQ ID NO: 421211 - RNA, 64 nt, hsa
agcaauuaccuaauuugccaguagcuuuauaauuuuuaaagauaauuguucauuauuuugucaa

SEQ ID NO: 421212 - RNA, 64 nt, hsa
aauaauccaggauucuaagcauaugcucagcuauuuuaaagaggaaauuaaauauuauaaaaga

SEQ ID NO: 421213 - RNA, 64 nt, hsa
accaaaauauuuuuggugggucuuuuuauggaaguuuaaagaaaggacaucaucauagauauga

SEQ ID NO: 421214 - RNA, 64 nt, hsa
agauugguuuaaaaagaaaaguguaaugcaagaauuuaaagaaauauuuuuaaagccacaauua

SEQ ID NO: 421215 - RNA, 64 nt, hsa
auugcuggucaagauuacuaauauuugggaaggcuuuaaagacgcauguuauggugcuaaugua

SEQ ID NO: 421216 - RNA, 64 nt, hsa
gaauaguaaauuaaacaguuguuaucaaaaugauuuuaaagacuauuucuuuuucuggguaacu

SEQ ID NO: 421217 - RNA, 64 nt, hsa
gaucuuuuuucaggauggcaaacuuuugacauaguuuaaagacauuuuuuccccauuuuuugaa

SEQ ID NO: 421218 - RNA, 64 nt, hsa
cuagagacccagaacgucugaaaacguccugauauuuaaagaacaaagcauccuucauuugaga

SEQ ID NO: 421219 - RNA, 64 nt, hsa
aacaaagcauccuucauuugagaauaaguuucacuuuaaagacccccucaauauccuccucaga

SEQ ID NO: 421220 - RNA, 64 nt, hsa
gaaugugaaauuuuuacagaaucagacagaugacuuuaaagaaauuuuuuucaugauggaaaaa

SEQ ID NO: 421221 - RNA, 64 nt, hsa
aucuuuuucuuauggacuuuaagaccuuuauauuuuuaaagauauugauuuuuugcccaugcuu

SEQ ID NO: 421222 - RNA, 64 nt, hsa
gaugauaaguguguuuuuagugguguguuguuuuuuuaaagaggugauucaaguaccguugcua

SEQ ID NO: 421223 - RNA, 64 nt, hsa
uaaacaguaugagauaggaggauuaaaauauuauuuuaaagaaaccacuguuucccccuaaaau

SEQ ID NO: 421224 - RNA, 64 nt, hsa
ucccagcaggagggauugcugggauuguuuuuucuuuaaagaagaauguuaauauuuuacuuuu

SEQ ID NO: 421225 - RNA, 64 nt, hsa
agacacacaugacgcaccaguuacagggguuguuuuuaaagaaaaaaacaaucccagcaggagg

SEQ ID NO: 421226 - RNA, 64 nt, hsa
gugauuuuuuaaagauuuggcuauacuuaagauauuuaaagaggaugagguugagucgugagua

SEQ ID NO: 421227 - RNA, 64 nt, hsa
aauguagcacuagaggcaagaaaaggggugauuuuuuaaagauuuggcuauacuuaagauauuu

SEQ ID NO: 421228 - RNA, 64 nt, hsa
gccagccuuugccucuacuguaucgcuuugggacuuuaaagaugcagaaguauuagaacacaca

SEQ ID NO: 421229 - RNA, 64 nt, hsa
ugaaauguucugguggguugaaaaacguucuuauuuuaaagaaagguugugcucgcuacacugc

SEQ ID NO: 421230 - RNA, 64 nt, hsa
caaucuggaauagagaacguucacacuucgcuccuuuaaagaagcgaccccagaucugcaaggu

SEQ ID NO: 421231 - RNA, 64 nt, hsa
guuggcuguuacaggagcaucccauuuugccaauuuuaaagacauucuuauauuucauaucagu

SEQ ID NO: 421232 - RNA, 64 nt, hsa
aaugguaaaaccaugacgcaaagagagauuuuuuuuuaaagaagaaaaaaaaaaauucacacug

SEQ ID NO: 421233 - RNA, 64 nt, hsa
gggggucugcacccgggugggggacagagggaccuuuaaagaaaacaaaacuggacagaaacag

SEQ ID NO: 421234 - RNA, 64 nt, hsa
uaaaccacucgacucaucuuguagcuuauuuuuuuuuaaagaggacguuuucuacggcuguggc

SEQ ID NO: 421235 - RNA, 64 nt, hsa
aagaaucuugcuacagccaaauggcaucucacuuuuuaaagacguuugcaauuauuaguugauu

SEQ ID NO: 421236 - RNA, 64 nt, hsa
uuacuuggaagagcaaagaaggaaaaauuauauuuuuaaagaaagagaauauucaggcuuuauu

SEQ ID NO: 421237 - RNA, 64 nt, hsa
uccuucucuuuacuuuuuuuuucuuuuuucuuuuuuuaaagaaaugguagcauaauauacacag

SEQ ID NO: 421238 - RNA, 64 nt, hsa
gaaaugguagcauaauauacacaguuguccauuuuuuaaagacuaaaccaucucacagauuguu

SEQ ID NO: 421239 - RNA, 64 nt, hsa
ucuucauuuuaagacuuuuaauacaaaugucauuuuuaaagaaacaaacccaaaacuauuguuu

SEQ ID NO: 421240 - RNA, 64 nt, hsa
ggugcaugauacucuucagagcuauuugugaaauuuuaaagacagaagugucucagugacaagu

SEQ ID NO: 421241 - RNA, 64 nt, hsa
uuuuaguauaugaaaauuauuacucuuuuugggguuuaaagaaauggucugcauaaccugaaug

SEQ ID NO: 421242 - RNA, 64 nt, hsa
gaaaugugcguguugauagcaauaauuuguuucuuuuaaagauucuaaaaggucugagaccugu

SEQ ID NO: 421243 - RNA, 64 nt, hsa
uauuuaaggacaucagaagcaugucaaagcuauuuuuaaagagagaaacuguauaagauguuua

SEQ ID NO: 421244 - RNA, 64 nt, hsa
cauguagguucuggauucuaagcuuacauugcucuuuaaagaacuuauaaacuaacgguuuaaa

SEQ ID NO: 421245 - RNA, 64 nt, hsa
auuuguuuuuaucccaaauucauguuuuaaggccuuuaaagaauagucagacugauaaagaagu

SEQ ID NO: 421246 - RNA, 64 nt, hsa
ggccaguguuguuggugaaauauauaaacauuuauuuaaagagaaaaguuaccaguaucuacac

SEQ ID NO: 421247 - RNA, 64 nt, hsa
uuucuuuuuaaagagaaagcaggcuuuucuagacuuuaaagaauaaagucuuugggaggucuca

SEQ ID NO: 421248 - RNA, 64 nt, hsa
ccaauuuuuaaucaauuauuaauuuuuuuuucuuuuuaaagagaaagcaggcuuuucuagacuu

SEQ ID NO: 421249 - RNA, 64 nt, hsa
gauccaaagagacucccacucagauucuaaagcauuuaaagacaauucuagcagaauuuaucaa

SEQ ID NO: 421250 - RNA, 64 nt, hsa
guaacuaauccgggaaaagugaacauaugggcccuuuaaagacuacaagauuugcuagauaaac

SEQ ID NO: 421251 - RNA, 64 nt, hsa
cugcauugcaggcuguaugauaaaacacacauaauuuaaagagagaaggcucuugauuccuuau

SEQ ID NO: 421252 - RNA, 64 nt, hsa
aauugauaaaccagaaguuucuuuugagauuugcuuuaaagaaaugcuuuaguaagaauaugaa

SEQ ID NO: 421253 - RNA, 64 nt, hsa
caaugcagagguugagaggaggacuugguugauguuuaaagagaaguucccagccaagggccuc

SEQ ID NO: 421254 - RNA, 64 nt, hsa
cucuugaaaccugaugucagcugcuguugaacuuuuuaaagaagugcaugaaaaaccauuuuug

SEQ ID NO: 421255 - RNA, 64 nt, hsa
acuugucuucauucauaauuuuguuuucaccugguuuaaagaauccagauauuuuacugcaaaa

SEQ ID NO: 421256 - RNA, 64 nt, hsa
auuuauauauauuauuguagagaauuuguauauuuuuaaagaugucuuaagauaucuuaauuuu

SEQ ID NO: 421257 - RNA, 64 nt, hsa
gcuguaguaacuaugauggguguaacaacauuuuuuuaaagaagggaaucuguuuaucgcuuuu

SEQ ID NO: 421258 - RNA, 64 nt, hsa
aaaaugauagcuaucuaacaacuaauuacuaauuuuuaaagaacaaaucacacauuuaaaaaau

SEQ ID NO: 421259 - RNA, 64 nt, hsa
auguagacuauacuguaaaaauucaguuuguugcuuuaaagaaacaaacugauaccugaauuuu

SEQ ID NO: 421260 - RNA, 64 nt, hsa
ccaaacuuaguaacucuguuaaauauuuggaggauuuaaagaacaucccaguuugaauucauuu

SEQ ID NO: 421261 - RNA, 64 nt, hsa
gauggcggcucacaagugaaaacugauuucccauuuuaaagaagaaguggaucuaaauggaagc

SEQ ID NO: 421262 - RNA, 64 nt, hsa
agcuauuuuugcacagguacauagcucucauguauuuaaagaacacugcaguguuauuuucuuu

SEQ ID NO: 421263 - RNA, 64 nt, hsa
cuggagaaccaccagguuuagcuuggaaauaaccuuuaaagauuguuucuguugccaagaccaa

SEQ ID NO: 421264 - RNA, 64 nt, hsa
auaauuuugaauuuuuaaguucuaugauucauguuuuaaagauggaauaauuuuaauacauauu

SEQ ID NO: 421265 - RNA, 64 nt, hsa
uaaaguauauucuuccccagggaagacuguauucuuuaaagacaguagaauauuggcuauuucu

SEQ ID NO: 421266 - RNA, 64 nt, hsa
auuuuggcugagaaugguaccuuuauauaacucuuuuaaagaugaaauucagaauaauuuuauu

SEQ ID NO: 421267 - RNA, 64 nt, hsa
uuuacuaaaauaaaaacucuguguaauuuuuccauuuaaagauauaagccaguuauugggagag

SEQ ID NO: 421268 - RNA, 64 nt, hsa
cauguuuaccccauacccaguggcagagguguucuuuaaagacuugaauauaugaaugugugug

SEQ ID NO: 421269 - RNA, 64 nt, hsa
guuaauaaaaggauuaucggcauuaauacuuuaauuuaaagaaaaguuguguucuguuuuccuu

SEQ ID NO: 421270 - RNA, 64 nt, hsa
uugguccccucuaguaugugucacugagaaauuuuuuaaagacaugguagaucguguuuagagg

SEQ ID NO: 421271 - RNA, 64 nt, hsa
aguacaaaaugacucuuuuuccugucaauugaaauuuaaagaaaaguuuuaauuauauaaauag

SEQ ID NO: 421272 - RNA, 64 nt, hsa
guaaaacuacaaaucuccuccucagggugauauuuuuaaagauuaaggaguaugacaucaauua

SEQ ID NO: 421273 - RNA, 64 nt, hsa
uaaagauuaaggaguaugacaucaauuaacagucuuuaaagauguuacauacgcucaaagcaau

SEQ ID NO: 421274 - RNA, 64 nt, hsa
acaacuuuauaagagaaacaguggucuucaaucuuuuaaagacaugaaauccuauauggcauuc

SEQ ID NO: 421275 - RNA, 64 nt, hsa
uuuuuggugagaagaaauaagacauuuucucccuuuuaaagaucaucucuucagagcugcaugg

SEQ ID NO: 421276 - RNA, 64 nt, hsa
auucacugauguagauuaauaauguaaguucugauuuaaagaaugguggcaaaauggugcaugu

SEQ ID NO: 421277 - RNA, 64 nt, hsa
gaguuuguuguugcaguccuucuuugcaccuuauuuuaaagaauaaaugaaacauuuuucuggu

SEQ ID NO: 421278 - RNA, 64 nt, hsa
auguauaaugguagguguuugugugugauucauuuuuaaagaaauauuuuucucaagcuccuau

SEQ ID NO: 421279 - RNA, 64 nt, hsa
aaauaaaaaugugugcucuuuacuguuuuucauuuuuaaagaauauuauuauggaagcacgauu

SEQ ID NO: 421280 - RNA, 64 nt, hsa
uacuuuucaauauuuucauauuucuuaaccagauuuuaaagaaauuuguuguuaguuacgugaa

SEQ ID NO: 421281 - RNA, 64 nt, hsa
acauguaaaacaggacaauuuaaaaauuuuaaauuuuaaagaauuaaaaauuuuaaaaauuuaa

SEQ ID NO: 421282 - RNA, 64 nt, hsa
cugccagucauccagcugauacacaccugaugauuuuaaagaaagccacacagagcugaauggg

SEQ ID NO: 421283 - RNA, 64 nt, hsa
gucugcagaagcauuugaaaagucaaggacuaauuuuaaagaggaaaaauaauaauaacucuug

SEQ ID NO: 421284 - RNA, 64 nt, hsa
aaaaucucucauaacucaaguauggaauacuuuuuuuaaagaaauucuuaucauggguguugua

SEQ ID NO: 421285 - RNA, 64 nt, hsa
guauauugcuauagauuuuucuuuaacaagcuauuuuaaagauaauggcauuauuauuuccaag

SEQ ID NO: 421286 - RNA, 64 nt, hsa
gcuuuuguuuuugaacaauaauauacugguuugcuuuaaagaagggacuaaauaugacuuuaaa

SEQ ID NO: 421287 - RNA, 64 nt, hsa
acugguuugcuuuaaagaagggacuaaauaugacuuuaaagagacuucaaaauauugaguauuu

SEQ ID NO: 421288 - RNA, 64 nt, hsa
gugaaaaaaagaaacgaaaaggacagacgaagaguuuaaagagaaaagggaaaaaagaaagaaa

SEQ ID NO: 421289 - RNA, 64 nt, hsa
gugggguuaauauagcauguuauccugucuaucuuuuaaagauuucuguauaagacuguugagc

SEQ ID NO: 421290 - RNA, 64 nt, hsa
guuuuggagaacuugucuacaaccagggauugauuuuaaagaugucuuuuuuuauuuuacuuuu

SEQ ID NO: 421291 - RNA, 64 nt, hsa
agaaaugguguaaaggcugucuuuuuuuuuuuuuuuuaaagaaaaguuauuaccauguauuuug

SEQ ID NO: 421292 - RNA, 64 nt, hsa
agagaauuuuucucuccuuaauagaagcauccuuuuuaaagagaaguugccuugguccacacac

SEQ ID NO: 421293 - RNA, 64 nt, hsa
ccacuaugauuauugauguccugccuugaacaguuuuaaagaaaacaauuuuuggaauagcuca

SEQ ID NO: 421294 - RNA, 64 nt, hsa
uuuuuguccaguguuuuucuuuuuaagaugaacuuuuaaagaaccuugcgauuugcacauauug

SEQ ID NO: 421295 - RNA, 64 nt, hsa
ccuauggggccugacugcacugauauauauuuuuuuuaaagagcaacugccacaugcgggauuu

SEQ ID NO: 421296 - RNA, 64 nt, hsa
aggugcugugugauccuuggaugaaaaacauauauuuaaagaaauggagaguguuuauuuuguu

SEQ ID NO: 421297 - RNA, 64 nt, hsa
acucugagcccugcauugcaagggcgucuuuugcuuuaaagaauucuuaguuuugccacaacag

SEQ ID NO: 421298 - RNA, 64 nt, hsa
aaugcagguuuuagaaacaaugcaggaaucuugcuuuaaagaugaaaaagggaaugggccagcu

SEQ ID NO: 421299 - RNA, 64 nt, hsa
uaagugcuaagcaaggaauuauuuacugauugguuuuaaagagagcagaaaacacccaagugua

SEQ ID NO: 421300 - RNA, 64 nt, hsa
ugguggggaauuuaaaaaugcauccuggaaauccuuuaaagauuucagacuuugaaaggccuug

SEQ ID NO: 421301 - RNA, 64 nt, hsa
uccaauucaguaaaugguaucacuguuuaccccuuuuaaagauaugauuagacuucguuaguaa

SEQ ID NO: 421302 - RNA, 64 nt, hsa
guuuuuuauuuuuauauauuuuuucugacuccuauuuaaagaaccccuuagguuucuaaguacc

SEQ ID NO: 421303 - RNA, 64 nt, hsa
uauagcacucaucuuucaagagagggcagucaucuuuaaagaacauuuuauuuuuauacaaugu

SEQ ID NO: 421304 - RNA, 64 nt, hsa
aaaacaacauagaguacacauauuuauauguauuuuuaaagauaaagaauaucuaaaauguguu

SEQ ID NO: 421305 - RNA, 62 nt, hsa
cuagagcuguagccacguaguuuucuacuuaauuuaaagaaaagaauuccuuaccuauaaaa

SEQ ID NO: 421306 - RNA, 64 nt, hsa
uauaaaaaugucaucauauauaauuaaacagcuuuuuaaagaaacauaaccacaaaccuuuuca

SEQ ID NO: 421307 - RNA, 64 nt, hsa
caaauaauaauaauaauaauaauaaaaaauguauuuuaaagauggccugugguuaucuuggaaa

SEQ ID NO: 421308 - RNA, 64 nt, hsa
uuauuuguaagaccuucaccaaguucugauaucuuuuaaagacauaguucaaaauugcuuuuga

SEQ ID NO: 421309 - RNA, 64 nt, hsa
auuauguuuucuuuaaguguuuaugguaaacucuuuuaaagaaaauuuaauauguuauagcuga

SEQ ID NO: 421310 - RNA, 64 nt, hsa
cauagcuuaagucucuauguagacagggauccauuuuaaagagcuacuuagagaaauaauuuuc

SEQ ID NO: 421311 - RNA, 64 nt, hsa
uuaggaauauguaacaugcuaaaacuuuuuuuuuuuuaaagaguacugagucacaacauguuuu

SEQ ID NO: 421312 - RNA, 64 nt, hsa
aauuauguauuauaucuguaauauauuuauuuuguuuaaagaaggcuuucuaacaaugacugac

SEQ ID NO: 421313 - RNA, 64 nt, hsa
uauuagguuuuuuuuguuuuuguuuucuacaucuuuuaaagacuuuuggaaauuuggcugaaca

SEQ ID NO: 421314 - RNA, 64 nt, hsa
acugaccaugugauguacauuuauuaugucuuuuuuuaaagaauggaaauauuuauuucagagg

SEQ ID NO: 421315 - RNA, 64 nt, hsa
ucuaccaguuaaacuacuuuaauacacauucauuuuuaaagaaaauguuuguuuuaacauaaau

SEQ ID NO: 421316 - RNA, 64 nt, hsa
guaguaauagauuaauauucauagauuguugguguuuaaagaucugaagugugaguagaaugua

SEQ ID NO: 421317 - RNA, 64 nt, hsa
uguaguuuagauauucaaaaguaugcauguagaauuuaaagaauauguuaaaaauuauuaauuu

SEQ ID NO: 421318 - RNA, 64 nt, hsa
aucuuaaugauguuuuugauuuuuauauacuuauuuuaaagaaaaucuuauauaguacauuuua

SEQ ID NO: 421319 - RNA, 64 nt, hsa
uuucuuuugaaugugacuguucggagaugaggccuuuaaagaggugacuuaaguucaaaggagg

SEQ ID NO: 421320 - RNA, 64 nt, hsa
aagugauuuuagaauaaaaugcaggaaaaacuuuuuuaaagauguuagucuuguagcgugaaua

SEQ ID NO: 421321 - RNA, 64 nt, hsa
ggcaggucauauacuuuuuuuuggcauauaccuuuuuaaagacuguaauuagugcaguaacagu

SEQ ID NO: 421322 - RNA, 64 nt, hsa
uguguguguucuacaagaacggaagugugauauguuuaaagaugaucagagaaaagacaguguc

SEQ ID NO: 421323 - RNA, 64 nt, hsa
aauauaagacaauauugaucagcucuagaauaacuuuaaagaaagacguguucugcauugauaa

SEQ ID NO: 421324 - RNA, 64 nt, hsa
ucccaaaugggcccauuccccuaauaguuuuauuuuuaaagaaagccauacauagaaugcuuca

SEQ ID NO: 421325 - RNA, 64 nt, hsa
aaauauacaguauauauuaauaauguacaugguguuuaaagaaugguaagcauuguuaauuucu

SEQ ID NO: 421326 - RNA, 64 nt, hsa
ugaaaugcauguagcaguuguugggcgaaugguguuuaaagaccgaaaaugaauuguaauuuuc

SEQ ID NO: 421327 - RNA, 64 nt, hsa
aaagaccgaaaaugaauuguaauuuucuuuuccuuuuaaagacagguucugugugcuuuuuauu

SEQ ID NO: 421328 - RNA, 64 nt, hsa
ucuucuaaguugauuuuuuuccucccaagucuuuuuuaaagaaaguauacuguauuuuaccaac

SEQ ID NO: 421329 - RNA, 64 nt, hsa
agacaaggcagaguuuaaagugaggaauuuuauauuuaaagaacuuuuugguuggauaaaaaca

SEQ ID NO: 421330 - RNA, 64 nt, hsa
caggauugugaaagaguucuucuguuuguauuuuuuuaaagagaacuuuuuuaguuuauuaaau

SEQ ID NO: 421331 - RNA, 64 nt, hsa
aguguucuggaaaucugugcauucguucucgauuuuuaaagaagaauugggucuuuuuauuauu

SEQ ID NO: 421332 - RNA, 64 nt, hsa
cacuagauuauagaguuuauuuuugcuuuuaugcuuuaaagaaugcaugcccaaaacacuacua

SEQ ID NO: 421333 - RNA, 64 nt, hsa
cucuuuccccaaaagugaugaucucaaguccuuuuuuaaagaaugacaaauuuuaggagacuuc

SEQ ID NO: 421334 - RNA, 64 nt, hsa
cauuaacuuuucugaugccuuaaaagugaacuucuuuaaagaaccuuugugcuauuuuaucaca

SEQ ID NO: 421335 - RNA, 64 nt, hsa
aucagcagcaauugaaaugcuacaaaagacuuuguuuaaagauuuuauuuaaacuauuaagaau

SEQ ID NO: 421336 - RNA, 64 nt, hsa
cacauugccaggaugauaaguuccuuuccuuuucuuuaaagaaguugaaguuuaggaauccuuu

SEQ ID NO: 421337 - RNA, 64 nt, hsa
ugccuuugauguuacagauuuaauacaguuuauuuuuaaagauagauccuuuuauaggugagaa

SEQ ID NO: 421338 - RNA, 64 nt, hsa
uguuauuguuuuguuaauuacaccauaaugcuaauuuaaagagacuccaaaucucaaugaagcc

SEQ ID NO: 421339 - RNA, 64 nt, hsa
uuucucaaauagaaaagccagauuuugaaaaaauuuuaaagauaaaauaggacauauuuugcag

SEQ ID NO: 421340 - RNA, 64 nt, hsa
acaaauauauuuaaguacuaaaggugauuuuuuuuuuaaagacuuuuucaaauugucaaaugau

SEQ ID NO: 421341 - RNA, 64 nt, hsa
uuuggaaacauuuucauaaagcuccauggagaguuuuaaagaaacauauguagcaugauuuugu

SEQ ID NO: 421342 - RNA, 64 nt, hsa
agguuuuuuuguaaauccuuguauuccuauuuuuuuuaaagaaaaaaaaaaaaccuuaagcugc

SEQ ID NO: 421343 - RNA, 64 nt, hsa
ucucgguauguacuuuuccccuaaaugcuggggauuuaaagaauugcacuaauucauagaacuc

SEQ ID NO: 421344 - RNA, 64 nt, hsa
acuuuaccuacucugaucacucuguucucuuuguuuuaaagagagaauuuuguaaaccauuuau

SEQ ID NO: 421345 - RNA, 64 nt, hsa
gaagcaauuuuggggaaggguuugaauuguuuucuuuaaagauguaaugucccuuucagagaca

SEQ ID NO: 421346 - RNA, 64 nt, hsa
acacagucaaaauaauucuaaaucccucgauauuuuuaaagaucuguaaguaacuucacauuaa

SEQ ID NO: 421347 - RNA, 64 nt, hsa
ucucuggcgacaaugcugagauugaucuggaagauuuaaagaagcacacagucuacuacggugg

SEQ ID NO: 421348 - RNA, 64 nt, hsa
gugugcucuacuuugauggaaacauggcaaggaauuuaaagacaggaauguauuaauauuauug

SEQ ID NO: 421349 - RNA, 64 nt, hsa
uugacuaccuuuugauaagcaaaauuugaaaccauuuaaagaccacuguauuuuaacucaacaa

SEQ ID NO: 421350 - RNA, 64 nt, hsa
acacggguaggacuuucuuggugugugugcauucuuuaaagagccaaguugcuucggggaaaca

SEQ ID NO: 421351 - RNA, 64 nt, hsa
auugauuguccuggggcuaagaaagaagauaauuuuuaaagaaugggagugggcaacagugaaa

SEQ ID NO: 421352 - RNA, 64 nt, hsa
auagacuuugcuaacuuacuaguaccagaguuauuuuaaagaaaaacacuaguguccaauuuca

SEQ ID NO: 421353 - RNA, 64 nt, hsa
aucagaauuuaguuaucuaucagacucaaaaucauuuaaagacuaacaaaacacaaucaugaua

SEQ ID NO: 421354 - RNA, 64 nt, hsa
acucauaauaaucugaauaucuugaucauuuguauuuaaagaagcaguaauuauauacuugaaa

SEQ ID NO: 421355 - RNA, 64 nt, hsa
gucuuugauuaucagauacugucucuaaaauuauuuuaaagauuaauauuuguucaaguagaga

SEQ ID NO: 421356 - RNA, 64 nt, hsa
uaauucugacuugagaaucuuuuucaugaaugauuuuaaagaaaaauuuggauuuuaaagguau

SEQ ID NO: 421357 - RNA, 64 nt, hsa
aaauuuuaagaagaaagauuuaaaguauuuuaauuuuaaagaguguguuauaaaauaauguacu

SEQ ID NO: 421358 - RNA, 64 nt, hsa
caauguauauugcaauugaugugauuauuuuucuuuuaaagauuuguuuguguuuaugaaacag

SEQ ID NO: 421359 - RNA, 64 nt, hsa
caugaguguaacagugauaaccugaucuguuuguuuuaaagauuauuaccaagugaaaaauuca

SEQ ID NO: 421360 - RNA, 64 nt, hsa
cucauauacuguacauuccaaaaacucuaaacuuuuuaaagauuauagauacacuaccaaacau

SEQ ID NO: 421361 - RNA, 64 nt, hsa
agcaccauuguacagucuagcauaaacagcaaauuuuaaagaggacauauuuaaguucauaauc

SEQ ID NO: 421362 - RNA, 64 nt, hsa
gauuggaugaauguucucaaauguuacaaagcuguuuaaagaaaaagguauauauaaguaauca

SEQ ID NO: 421363 - RNA, 64 nt, hsa
gaaaaccuccacggccuuuucaguauuuggugccuuuaaagaggccuaaggacuuaguuuauuu

SEQ ID NO: 421364 - RNA, 64 nt, hsa
caaauauaggcuagaauccggaauguuuucuugauuuaaagacaucuuuagaccgggcacagug

SEQ ID NO: 421365 - RNA, 64 nt, hsa
aaaguaacuuuaugcuuaaauaaauuauaguugauuuaaagauuuguuuggcauugauaauaau

SEQ ID NO: 421366 - RNA, 64 nt, hsa
uuaauacacuuuuaaaagucaaaauugauuauauuuuaaagauaaccaggauauuaucuaaugg

SEQ ID NO: 421367 - RNA, 64 nt, hsa
aaagaacccaucuguuaauguaguaaauguuggcuuuaaagaaauagcuccgauaaggacuuuu

SEQ ID NO: 421368 - RNA, 64 nt, hsa
uauaaaaucagugaguugaaaguaaaauuucuuauuuaaagaacccaucuguuaauguaguaaa

SEQ ID NO: 421369 - RNA, 64 nt, hsa
cccauauggcccaagaguagcucguaggaggcccuuuaaagacggaacaaguaauuuaccaguu

SEQ ID NO: 421370 - RNA, 64 nt, hsa
caugaacacaauuucucuccaccuggcucccaaauuuaaagauguggaccaaggccugugggua

SEQ ID NO: 421371 - RNA, 64 nt, hsa
ggaugauggaaaaaucacccaguugugcuauauuuuuaaagaaggaggucguuuaugugugcag

SEQ ID NO: 421372 - RNA, 64 nt, hsa
aaaauagacacuauaguuuuacccauaaguaauauuuaaagauuauagcucccaaaagaaugga

SEQ ID NO: 421373 - RNA, 64 nt, hsa
cugaacuugauguuuuugcauucuuugaguucaguuuaaagacaacuacgagcaucuguaacca

SEQ ID NO: 421374 - RNA, 64 nt, hsa
auuugaauuucuguaggaagaaucaaaucaccgauuuaaagagugcaauauauaauaaucauuu

SEQ ID NO: 421375 - RNA, 64 nt, hsa
gaaauaauugauaacuuuuaagccauacuauguuuuuaaagauaauuugcacaaacacguuugu

SEQ ID NO: 421376 - RNA, 64 nt, hsa
gugucuguucuguccaauauagauuuggcaauuauuuaaagagggauaaucuugaaaaaaauua

SEQ ID NO: 421377 - RNA, 64 nt, hsa
agaauaacuuacugagauuuauugauuugaagauuuuaaagaugaaugguaaaacacacucuua

SEQ ID NO: 421378 - RNA, 64 nt, hsa
uuuccacaaaggauuugugguugguauauaauucuuuaaagauaccuggaucaguguaaaaaaa

SEQ ID NO: 421379 - RNA, 64 nt, hsa
uagauguaugucuuaaaaugugggugauaggaauuuuaaagauuuauauaaugcaucaaaagcc

SEQ ID NO: 421380 - RNA, 64 nt, hsa
ccuuguuuuuuguuguauuuuggaagacagguuuuuuaaagaaacauuuuccucagauuaaaag

SEQ ID NO: 421381 - RNA, 64 nt, hsa
auuugaauuucuguaggaagaaucaaaucaccgauuuaaagauugcaauauauaauaaucauuu

SEQ ID NO: 421382 - RNA, 64 nt, hsa; identical to SEQ ID NO: 421373

SEQ ID NO: 421383 - RNA, 64 nt, hsa
cuuugguuucaugaaaaaauaaacgauaaauaucuuuaaagagaacuagaagaauuuuuuguuu

SEQ ID NO: 421384 - RNA, 64 nt, hsa
acagacauccagcaaaaacaggagaaucacaugcuuuaaagaacacuuucucuuagguuuccuu

SEQ ID NO: 421385 - RNA, 64 nt, hsa
aauugagacaguguauauuuaaucuaauuuaaauuuuaaagagauacugguauuuugaaaaugc

SEQ ID NO: 421386 - RNA, 64 nt, hsa
uuagaguaaggaugagaaacuugaguguuuuuaauuuaaagauaaaagccuguguuuuacacau

SEQ ID NO: 421387 - RNA, 64 nt, hsa
cauuuuacucaucaagucucuuucauuucggcaguuuaaagacacaacugugggcuuucugagg

SEQ ID NO: 421388 - RNA, 64 nt, hsa
uuuuggccauuuucucuuuacacuucguauguauuuuaaagaagaaaaaaaacaaaaaaaauuc

SEQ ID NO: 421389 - RNA, 64 nt, hsa
uaggguguucuggcuuuuuugugggguuuuuauuuuuaaagaaacacucaaucauccuaccgcu

SEQ ID NO: 421390 - RNA, 64 nt, hsa
ugugcuuuuuuguuuugugcuaacgucuuacuaauuuaaagaugcugucggcaccauguuuauu

SEQ ID NO: 421391 - RNA, 64 nt, hsa
aaaccucaagcuuuacugacuucaauuaucuguuuuuaaagacguagaagauuuauuuaauuug

SEQ ID NO: 421392 - RNA, 64 nt, hsa
agaaguauuucugaacauaucaaauauaaauuuuuuuaaagaucuaacugugaaaacauacaua

SEQ ID NO: 421393 - RNA, 64 nt, hsa
acauuucuuguaaaaccuggcuuguugcuuggcuuuuaaagaugguguauguuuguaaaaauau

SEQ ID NO: 421394 - RNA, 64 nt, hsa
ugauuguuguggguguagcccaggcaugggauuuuuuaaagagcugcucagguaauuccaauuu

SEQ ID NO: 421395 - RNA, 64 nt, hsa
uguagggcugcagugguggccagaauuagauaucuuuaaagaauuuuaaauacaauaaacacuu

SEQ ID NO: 421396 - RNA, 64 nt, hsa
agaacugaugcacuauauagaacgaauuuggguuuuuaaagaaauauuaaaaguuagguacugu

SEQ ID NO: 421397 - RNA, 64 nt, hsa
uauucacuugggcuuuuuuucuucccccucuuucuuuaaagaacugcucaauauucaaucuguu

SEQ ID NO: 421398 - RNA, 64 nt, hsa
cuguugugaagaaccugauuugcacucuguaguguuuaaagaaacaaagaaacucuaauauuga

SEQ ID NO: 421399 - RNA, 64 nt, hsa
uagauccaaauguaaaggcagguuugggaagguguuuaaagaguuggaggaauuggggauugag

SEQ ID NO: 421400 - RNA, 64 nt, hsa
auucccuguuggauuuacuucggauuuauucccuuuuaaagaauuuuugcccauaucuggaagg

SEQ ID NO: 421401 - RNA, 64 nt, hsa
uuccacaguuggcacugcaggugcaggccaacccuuuaaagaauaaacaaggaagucagcucuu

SEQ ID NO: 421402 - RNA, 64 nt, hsa
uuaauauacaucuuuaauccuuuuuagguuguccuuuaaagaguuuuugacuaguuucuuuuuc

SEQ ID NO: 421403 - RNA, 64 nt, hsa
ggugguuauguaagaggcuuaaaaugaucuuauguuuaaagagauucuguuauuagcaccauga

SEQ ID NO: 421404 - RNA, 64 nt, hsa
gaacccuuauugauuacuuaaguguuuacauuauuuuaaagacuccuguuuaagagcuuucaga

SEQ ID NO: 421405 - RNA, 64 nt, hsa
uggaauaccgcugauugugcucuuuuuauccuacuuuaaagaagcuuucaugauuagauuugag

SEQ ID NO: 421406 - RNA, 64 nt, hsa
agaaauacucucccauuaaagaggaagagaagauuuuaaagacuuaaugaugucuuauugggca

SEQ ID NO: 421407 - RNA, 64 nt, hsa
uauuauauauauuauauauauauauauauuucuauuuaaagaggauccugaguuugugaaugga

SEQ ID NO: 421408 - RNA, 64 nt, hsa
aaagaaaaucugaguuaugguaauacgugaggaauuuaaagacucauccccagccuccaccucc

SEQ ID NO: 421409 - RNA, 64 nt, hsa
cgugagccaccaugcccgacucucacuucauauguuuaaagaaugaguaaaagaaagcaauuac

SEQ ID NO: 421410 - RNA, 64 nt, hsa
acuuuuguguauuuaaaauuuuccaugauguucuuuuaaagaucaaauuauccaugaaauuaua

SEQ ID NO: 421411 - RNA, 64 nt, hsa
uccaccuuucuaaaaccaguuugguacauaucuuuuuaaagaucgcuuuauaaaaacaaaaaga

SEQ ID NO: 421412 - RNA, 64 nt, hsa
agucuuuaagagucuguugugcagcggaguaggcuuuaaagaaacagugcagcagugguuucag

SEQ ID NO: 421413 - RNA, 64 nt, hsa
auguguucuugguguuugugaaaauccuauaagauuuaaagaaauauauauauacuuuuuuucu

SEQ ID NO: 421414 - RNA, 64 nt, hsa
agaaauauauauauacuuuuuuucuuuuuucuuuuuuaaagacagggucucacucucauugccc

SEQ ID NO: 421415 - RNA, 64 nt, hsa
gagcaagaagcucucuuaagaaaagggaauucucuuuaaagaaaccaccaccaacaacaaaaca

SEQ ID NO: 421416 - RNA, 64 nt, hsa
uuccaagggagcgauacuaaggcagacucagcuuuuuaaagaugggaggucaggagguggaagu

SEQ ID NO: 421417 - RNA, 64 nt, hsa
uuaacuuuaaagacauauuugcacaaaaccuuuguuuaaagaucugcaauauuauauauauaaa

SEQ ID NO: 421418 - RNA, 64 nt, hsa
uuauuuucuuuuguuuaugauaauuucacuuaacuuuaaagacauauuugcacaaaaccuuugu

SEQ ID NO: 421419 - RNA, 64 nt, hsa
augugaaaauguaguaaaccuuuaaaacucauguuuuaaagaauaauaacucuaguaauaacuc

SEQ ID NO: 421420 - RNA, 64 nt, hsa
guauaaagacacacaaaucauuuuaacuuggacauuuaaagaucagucuuaguguuuguucagu

SEQ ID NO: 421421 - RNA, 64 nt, hsa
cuuuguuuuuauuuaagaaaauaaacacgacauauuuaaagaagguucuuucaccugggagcaa

SEQ ID NO: 421422 - RNA, 64 nt, hsa
gggagcaaaugaacaauagcuaagugucuugguauuuaaagaguaaauuauuuguggcuuugcu

SEQ ID NO: 421423 - RNA, 64 nt, hsa
aaaaauuggaagaagagcuuaaaaaagauaagauuuuaaagagucccaaguuauuuaaguugag

SEQ ID NO: 421424 - RNA, 64 nt, hsa
uaaaguuuuauuuaaauaaauguugaagcucaaguuuaaagaagcguugcagaggcccacgguc

SEQ ID NO: 421425 - RNA, 64 nt, hsa
caacaugcugcuuuuuaaucauaggauggagaauuuuaaagaacuguuugggccaggcacaguc

SEQ ID NO: 421426 - RNA, 64 nt, hsa
auuuggcagcucccguaucuuuuguuauguugcuuuuaaagauaugauguuuuauuguuuuaac

SEQ ID NO: 421427 - RNA, 64 nt, hsa
agcauucaaggaugcccaggagagcugucccuguuuuaaagagcuguguuuuguuuuguuucgc

SEQ ID NO: 421428 - RNA, 64 nt, hsa
auuguacagaaacuuuuauuaaaauuguuuaauguuuaaagaguuuucuauuguuugaguuuua

SEQ ID NO: 421429 - RNA, 64 nt, hsa
cuguaaaguauugcuuacaaaaaguaugauuauuuuuaaagaaauauauaugguauguauccuc

SEQ ID NO: 421430 - RNA, 64 nt, hsa
auggaguugacauaauacuuuguaaauugaauuuuuuaaagaaauaggcauuugauaaccagcu

SEQ ID NO: 421431 - RNA, 64 nt, hsa
caaguaacucuacuaacagauguugguauagcuauuuaaagacuacuucguaaguaguaugauu

SEQ ID NO: 421432 - RNA, 64 nt, hsa
aacugcaccaccgaccaacuccagacuugggagcuuuaaagagcaggauagcucuuccucccca

SEQ ID NO: 421433 - RNA, 64 nt, hsa
cgguguuuuuuguuguuguugguuuuuuuuuuuuuuuaaagaaaaguucuuaaaacacuaacgg

SEQ ID NO: 421434 - RNA, 64 nt, hsa
guuuuguaauauauauaaggacuggaauuguguuuuuaaagaaaagcauucaaguaugacaaua

SEQ ID NO: 421435 - RNA, 64 nt, hsa
guacuuugaguauaacaucaagcuuuaacaaauauuuaaagacaaaaaaaucacgucaguaaaa

SEQ ID NO: 421436 - RNA, 64 nt, hsa
uguucagauuauuggagacuaauucuaauguggaccuuagaauacaguuuugaguagaguugau

SEQ ID NO: 421437 - RNA, 64 nt, hsa
uuuucccaaaggcauuauaaaaagaaugaagccuccuuagaaaaaaaauuauaccucaaugucc

SEQ ID NO: 421438 - RNA, 64 nt, hsa
ucaaccaaaggcaugugauugauuaaugauucccccuuagaaagcaaguguuaccaaaguugug

SEQ ID NO: 421439 - RNA, 64 nt, hsa
gauagugacuuuggggucuucuucacugaaagcaccuuagaacuguacuauaagaaaacauuuc

SEQ ID NO: 421440 - RNA, 64 nt, hsa
ccugcugucaagacuguguguguggauuucucacccuuagaagcucuacuaagacaucaacgga

SEQ ID NO: 421441 - RNA, 64 nt, hsa
ucuagacagaaucucccagaguguggaaauguugccuuagaaauggugauuaaaaucacucauu

SEQ ID NO: 421442 - RNA, 64 nt, hsa
caauucaaggaaauaaggaaugaccuggaacaggccuuagaaacaauugauuuauuccaauagu

SEQ ID NO: 421443 - RNA, 64 nt, hsa
ucauauaguauuguuagccaaacuauuauuccuuccuuagaaguugauguaucagaaaauuuau

SEQ ID NO: 421444 - RNA, 64 nt, hsa
uuuugaacagggaggcaauguaaucagauuuaugccuuagaacuggacuauccaauagguugcc

SEQ ID NO: 421445 - RNA, 64 nt, hsa
ccaucgcugaggaaaguucugcuggaccgcacacccuuagaaggauggcucugguggccgggcg

SEQ ID NO: 421446 - RNA, 64 nt, hsa
auugcucuaauucuuuucaaaauuguugcaucccccuuagaauguuucuauuuccauaaggauu

SEQ ID NO: 421447 - RNA, 64 nt, hsa
uuggaauuuuaaguucuaucagugacuucugaauccuuagaauggccucuuuguagaacccugu

SEQ ID NO: 421448 - RNA, 64 nt, hsa
ugaacuuggggccuaucacuccccacaguggaugccuuagaagggagagggaaggagggaggca

SEQ ID NO: 421449 - RNA, 64 nt, hsa
uauaaguuuccaggcuuugcagaagaccuugucuccuuagaaaugccccagaaauuuuccacac

SEQ ID NO: 421450 - RNA, 64 nt, hsa
guucccauuaucgauacucuuucuuugcagaauaccuuagaaccguuauuucccucaguguaga

SEQ ID NO: 421451 - RNA, 64 nt, hsa
guucagcuguuagagacugaagauuguuagggcaccuuagaaugucucaucuuuucuagguugu

SEQ ID NO: 421452 - RNA, 64 nt, hsa
cgcaguuccgugguugaauauauuugagaugguaccuuagaaaaaguuucacgcagauccuugg

SEQ ID NO: 421453 - RNA, 64 nt, hsa
uucccaaucccaggccuugugauuugagaugguaccuuagaaaaaguuacacgcaguuccgugg

SEQ ID NO: 421454 - RNA, 64 nt, hsa
cuuuauaaaaaucuguuguucugaaaaucaacaaccuuagaaggauuuugucuuagaaaauuuc

SEQ ID NO: 421455 - RNA, 64 nt, hsa
aguucaaagccuuuaaaguuucaucugauucuggccuuagaauuguccuuaaaagcuuucuccu

SEQ ID NO: 421456 - RNA, 64 nt, hsa
uaugaaaaucauuaugucauuccauaaugacugaaucaaggaggaaaauaugguguuuggaaug

SEQ ID NO: 421457 - RNA, 64 nt, hsa
cuaugcccuuguuuuauacauuuccagaccauucaucaaggaaaggaccugaagaaguggaaag

SEQ ID NO: 421458 - RNA, 64 nt, hsa
acuguuuuuaagugcaugaauaguacaaguuauuaucaaggauguuuuacagggaaaucaaaag

SEQ ID NO: 421459 - RNA, 64 nt, hsa
ccauauuuauaauuaggcuuuauuaucuuccuaaaucaaggaaaggaaaucauccccagaccau

SEQ ID NO: 421460 - RNA, 64 nt, hsa
uaugucaguguguugcucaggauaccccagguacaucaaggaaucaaggagaggaaaauaugag

SEQ ID NO: 421461 - RNA, 64 nt, hsa
uguguugcucaggauaccccagguacaucaaggaaucaaggagaggaaaauaugagcaauaugu

SEQ ID NO: 421462 - RNA, 64 nt, hsa
ucuucucuauggcucaccuuauuuggagugagaaaucaaggagacagagcugacugcaugauga

SEQ ID NO: 421463 - RNA, 64 nt, hsa
cucacugcccuucuucugaguggcauuggccugaaucaaggaaagccaggccuugugggccccc

SEQ ID NO: 421464 - RNA, 64 nt, hsa
cagaauuggccauuuuuuuugugaguuuccuugcaucaaggacacugagaaacacagucauugu

SEQ ID NO: 421465 - RNA, 64 nt, hsa
ugggccacuucccuccuuccagucaugaguaaucaucaaggagcaaguuggaguguuucaggug

SEQ ID NO: 421466 - RNA, 64 nt, hsa; identical to SEQ ID NO: 139090

SEQ ID NO: 421467 - RNA, 64 nt, hsa; identical to SEQ ID NO: 139091

SEQ ID NO: 421468 - RNA, 64 nt, hsa; identical to SEQ ID NO: 139092

SEQ ID NO: 421469 - RNA, 64 nt, hsa; identical to SEQ ID NO: 139093

SEQ ID NO: 421470 - RNA, 64 nt, hsa; identical to SEQ ID NO: 139094

SEQ ID NO: 421471 - RNA, 64 nt, hsa; identical to SEQ ID NO: 139095

SEQ ID NO: 421472 - RNA, 64 nt, hsa; identical to SEQ ID NO: 139096

SEQ ID NO: 421473 - RNA, 64 nt, hsa; identical to SEQ ID NO: 139097

SEQ ID NO: 421474 - RNA, 64 nt, hsa; identical to SEQ ID NO: 139098

SEQ ID NO: 421475 - RNA, 64 nt, hsa; identical to SEQ ID NO: 139099

SEQ ID NO: 421476 - RNA, 64 nt, hsa; identical to SEQ ID NO: 139100

SEQ ID NO: 421477 - RNA, 64 nt, hsa; identical to SEQ ID NO: 139101

SEQ ID NO: 421478 - RNA, 64 nt, hsa; identical to SEQ ID NO: 139102

SEQ ID NO: 421479 - RNA, 64 nt, hsa; identical to SEQ ID NO: 139103

SEQ ID NO: 421480 - RNA, 64 nt, hsa; identical to SEQ ID NO: 139104

SEQ ID NO: 421481 - RNA, 64 nt, hsa; identical to SEQ ID NO: 139105

SEQ ID NO: 421482 - RNA, 64 nt, hsa; identical to SEQ ID NO: 139106

SEQ ID NO: 421483 - RNA, 64 nt, hsa; identical to SEQ ID NO: 139107

SEQ ID NO: 421484 - RNA, 64 nt, hsa; identical to SEQ ID NO: 139108

SEQ ID NO: 421485 - RNA, 64 nt, hsa; identical to SEQ ID NO: 139109

SEQ ID NO: 421486 - RNA, 64 nt, hsa; identical to SEQ ID NO: 139110

SEQ ID NO: 421487 - RNA, 64 nt, hsa; identical to SEQ ID NO: 139111

SEQ ID NO: 421488 - RNA, 64 nt, hsa; identical to SEQ ID NO: 139112

SEQ ID NO: 421489 - RNA, 64 nt, hsa; identical to SEQ ID NO: 139113

SEQ ID NO: 421490 - RNA, 64 nt, hsa; identical to SEQ ID NO: 139114

SEQ ID NO: 421491 - RNA, 64 nt, hsa; identical to SEQ ID NO: 139115

SEQ ID NO: 421492 - RNA, 52 nt, hsa; identical to SEQ ID NO: 112167

SEQ ID NO: 421493 - RNA, 64 nt, hsa; identical to SEQ ID NO: 139117

SEQ ID NO: 421494 - RNA, 64 nt, hsa; identical to SEQ ID NO: 139118

SEQ ID NO: 421495 - RNA, 64 nt, hsa; identical to SEQ ID NO: 139119

SEQ ID NO: 421496 - RNA, 64 nt, hsa; identical to SEQ ID NO: 139120

SEQ ID NO: 421497 - RNA, 64 nt, hsa; identical to SEQ ID NO: 139121

SEQ ID NO: 421498 - RNA, 64 nt, hsa; identical to SEQ ID NO: 139122

SEQ ID NO: 421499 - RNA, 64 nt, hsa; identical to SEQ ID NO: 139123

SEQ ID NO: 421500 - RNA, 64 nt, hsa; identical to SEQ ID NO: 139124

SEQ ID NO: 421501 - RNA, 64 nt, hsa; identical to SEQ ID NO: 139125

SEQ ID NO: 421502 - RNA, 64 nt, hsa; identical to SEQ ID NO: 139126

SEQ ID NO: 421503 - RNA, 64 nt, hsa; identical to SEQ ID NO: 139127

SEQ ID NO: 421504 - RNA, 64 nt, hsa; identical to SEQ ID NO: 139128

SEQ ID NO: 421505 - RNA, 64 nt, hsa; identical to SEQ ID NO: 139129

SEQ ID NO: 421506 - RNA, 64 nt, hsa; identical to SEQ ID NO: 139130

SEQ ID NO: 421507 - RNA, 64 nt, hsa; identical to SEQ ID NO: 139131

SEQ ID NO: 421508 - RNA, 64 nt, hsa; identical to SEQ ID NO: 220726

SEQ ID NO: 421509 - RNA, 64 nt, hsa; identical to SEQ ID NO: 220727

SEQ ID NO: 421510 - RNA, 64 nt, hsa; identical to SEQ ID NO: 220728

SEQ ID NO: 421511 - RNA, 64 nt, hsa; identical to SEQ ID NO: 220729

SEQ ID NO: 421512 - RNA, 64 nt, hsa; identical to SEQ ID NO: 220730

SEQ ID NO: 421513 - RNA, 64 nt, hsa; identical to SEQ ID NO: 220731

SEQ ID NO: 421514 - RNA, 64 nt, hsa; identical to SEQ ID NO: 220732

SEQ ID NO: 421515 - RNA, 64 nt, hsa; identical to SEQ ID NO: 220733

SEQ ID NO: 421516 - RNA, 64 nt, hsa; identical to SEQ ID NO: 220734

SEQ ID NO: 421517 - RNA, 64 nt, hsa; identical to SEQ ID NO: 220735

SEQ ID NO: 421518 - RNA, 64 nt, hsa; identical to SEQ ID NO: 220736

SEQ ID NO: 421519 - RNA, 64 nt, hsa; identical to SEQ ID NO: 220737

SEQ ID NO: 421520 - RNA, 64 nt, hsa; identical to SEQ ID NO: 220738

SEQ ID NO: 421521 - RNA, 64 nt, hsa; identical to SEQ ID NO: 220739

SEQ ID NO: 421522 - RNA, 64 nt, hsa
cacuuugggaggccgaggcggguggaucacgaggucaggagaucgagaccauccuggcuaacac

SEQ ID NO: 421523 - RNA, 64 nt, hsa
agcacugggaggccgaggggggcggaucgugaagucaggagaucgagaccauccuggcuaacau

SEQ ID NO: 421524 - RNA, 64 nt, hsa
cggauacugccucauugcacuccccaaaagagagucaggagagcagcaggagaggcgcacagaa

SEQ ID NO: 421525 - RNA, 64 nt, hsa
cacuuugggaggccaaggugggcggaucacaaggucaggagaucgagaccauccuggcgaacac

SEQ ID NO: 421526 - RNA, 64 nt, hsa
uggccgggauggacuaaugaggcucuaacacugcucaggagaccccugcccucuaguugguucu

SEQ ID NO: 421527 - RNA, 64 nt, hsa
ccuggcaguggggagcaucgcuguuuccaauggcucaggagacaaugaaaagcccccauuuaaa

SEQ ID NO: 421528 - RNA, 64 nt, hsa
guuugaggguuuccuuuaguucacccucauacucucaggagacucuucuggauacuuuugucuu

SEQ ID NO: 421529 - RNA, 64 nt, hsa
gccuguggguuuuuaagugguuauugaauugguaucaggagauccugaggcugguaggggaagg

SEQ ID NO: 421530 - RNA, 64 nt, hsa
uggagucuuuucucugaagucaccaggccaggggucaggagagagauggauucccaagggauga

SEQ ID NO: 421531 - RNA, 64 nt, hsa
gacuggacuugacaccccacaguggaagggagcaucaggagaggaacaaaaaaagggaucucag

SEQ ID NO: 421532 - RNA, 64 nt, hsa
cacuuugggaggccgagguggguggaucacgaggucaggagaucgagaccaucccggcuaacau

SEQ ID NO: 421533 - RNA, 64 nt, hsa
agaggugaaauuggaaguuggagguguggagaguucaggagaggguucuggaccacagauguug

SEQ ID NO: 421534 - RNA, 64 nt, hsa
uuagccgguagaaggaguaguucaguuugucaauucaggagaaacuguacuggucagucacauc

SEQ ID NO: 421535 - RNA, 64 nt, hsa
cagcucuuguucuccagaaacuggagaauugcccucaggagaugagagccaucucaccucaccc

SEQ ID NO: 421536 - RNA, 64 nt, hsa
cauuuugggaggcugagguaggcggaucacaaggucaggagaucgagaccauccuggccaacau

SEQ ID NO: 421537 - RNA, 64 nt, hsa
caacugugcccagcugcacugguacacacgcucaucaggagaaucccuacuggaagccugcaag

SEQ ID NO: 421538 - RNA, 64 nt, hsa
ugacucauuucaacacuaaguacuagggguguugucaggagacaaaucugaagucaggagagga

SEQ ID NO: 421539 - RNA, 64 nt, hsa
guacuagggguguugucaggagacaaaucugaagucaggagaggaaaaugcaaaggagcccugc

SEQ ID NO: 421540 - RNA, 64 nt, hsa
cacuuugggaggccaaggcggguggaucacgaggucaggagauggagaccauccuggcuaacau

SEQ ID NO: 421541 - RNA, 64 nt, hsa
caugcauguagucccagcuacuccugaggcucagucaggagaaucgcuugaacuugggaggcgg

SEQ ID NO: 421542 - RNA, 64 nt, hsa
ggcggccuccgugucacccaaagucaugaucaauucaggagacugcccaaggcuugcagaagag

SEQ ID NO: 421543 - RNA, 64 nt, hsa
ggaagggaagcauaugcccauuaaugauuuuguuucaggagaggugagaaugagcagauuuaau

SEQ ID NO: 421544 - RNA, 64 nt, hsa
uccucugccgccuccccucaugccucaccgugucucaggagagaggggugcacguuucauggac

SEQ ID NO: 421545 - RNA, 64 nt, hsa
aaaucauugacgucauagaauauucuucuuccucucaggagaagacggaagcuggaguuggaca

SEQ ID NO: 421546 - RNA, 64 nt, hsa
ucugugccucuucaguggggguuuggggaccauaucaggagaccuggguugugcugacagcaaa

SEQ ID NO: 421547 - RNA, 64 nt, hsa
agaggcaagcccugccucuggccguguccaccuuucaggagacuuugaguggcagguuuggacu

SEQ ID NO: 421548 - RNA, 64 nt, hsa
ccagccagggcuucugagaugcaaagguuuggccucaggagagucaccuuuucucacggcccug

SEQ ID NO: 421549 - RNA, 64 nt, hsa
ccccaauccuggcaaaagcccaaagaucccagggucaggagagaccccucuguauccccagguc

SEQ ID NO: 421550 - RNA, 64 nt, hsa
uuaaugaaaacucagaggaaauaggaaaaucugcucaggagaaagaagcuaaaucugcauagau

SEQ ID NO: 421551 - RNA, 64 nt, hsa
cacuucgggaggccgaggcggguggaucacgaggucaggagaucaagaccauccuggcuaacac

SEQ ID NO: 421552 - RNA, 64 nt, hsa
gggcuugguggcuggcgccuguaaucccagcuacucaggagacugaggcagaaggaucgcuuga

SEQ ID NO: 421553 - RNA, 64 nt, hsa
gggaggugcccacccagcuacuggggaggcugagucaggagaaucgcuugaaccugggaggcgg

SEQ ID NO: 421554 - RNA, 64 nt, hsa
ugggaggucgggggggugggggaggaucacggggucaggagaucgagaccauccuggccaacau

SEQ ID NO: 421555 - RNA, 64 nt, hsa
cacuaugggaggccgagacgggcggaucacgaggucaggagacugagaccauccuggcuaacac

SEQ ID NO: 421556 - RNA, 64 nt, hsa
ccagggugcacguggucaauauccccuccugcauucaggagagccaugguagggcuagaguugg

SEQ ID NO: 421557 - RNA, 64 nt, hsa
aagguagggaguucugagggaagccgcgugcuccucaggagagagcuguuuagguuuuccgauc

SEQ ID NO: 421558 - RNA, 64 nt, hsa
uagguucugcggauaaaggaggaauaagacagagucaggagaacuguuccuugugguuuccguc

SEQ ID NO: 421559 - RNA, 64 nt, hsa
cgcaggugcucaugcugcuccccuaaagccaggcucaggagaagccagugucuaggcacugagc

SEQ ID NO: 421560 - RNA, 64 nt, hsa
ucugcuccucuuguuccugaaauguguuuccuuuucaggagauggggaauaauuuccuucaggc

SEQ ID NO: 421561 - RNA, 64 nt, hsa
uuucaaaaugcuaaagacucacacugcagcaaucaucccagaugauuaaauucaaagaaauagg

SEQ ID NO: 421562 - RNA, 64 nt, hsa
agaguuccuucaucaucgaaauagugauuaagugaucccagaacaaggaauacuagaguaaaaa

SEQ ID NO: 421563 - RNA, 64 nt, hsa
ugugacaccugcugcacucaucugauguaaaaccaucccagagcuggcgagaggauggagcugg

SEQ ID NO: 421564 - RNA, 64 nt, hsa
uuuggguucccagugcccagcacuuuguagucucaucccagauuacuaacccuuccugauccug

SEQ ID NO: 421565 - RNA, 64 nt, hsa
acuaaacgcaaaucuguagauucucuccucucccaucccagaaaacaaaacaaaauaaugcuuu

SEQ ID NO: 421566 - RNA, 64 nt, hsa
ucuucucuucccuaaccaaugaagcuaagugguuaucccagaaacuugucuucuaaaagggagg

SEQ ID NO: 421567 - RNA, 64 nt, hsa
auuuugagaaucagcauaguaaauuacauuucuaaucccagaggacuuaauauuuucuuuuguc

SEQ ID NO: 421568 - RNA, 64 nt, hsa
uuuugaacuucuaauuggggccaguguaaggucgaucccagaggcugaucugcaaaucaagcua

SEQ ID NO: 421569 - RNA, 64 nt, hsa
uugucuuuuuuuuuuuuuuuuuuuaagccaugacaucccagaagaggacagugaauuacuccua

SEQ ID NO: 421570 - RNA, 64 nt, hsa
cuuguugaacuuuuuaaaaagugcuacuuuuaaaaucccagauacucugaauuuuagaaaacaa

SEQ ID NO: 421571 - RNA, 64 nt, hsa
cuuccacauugcaacagcaaguugauuucuugugaucccagaauuuucuaagaggaugaguuga

SEQ ID NO: 421572 - RNA, 64 nt, hsa
ccucagcaucacuugggagcuuauugaaaugcagaucccagagucaguaaaucugccugugaag

SEQ ID NO: 421573 - RNA, 64 nt, hsa
ugcugguuuguaaauggugaggggacuugggggcaucccagagugcucccuccaggccugcuuc

SEQ ID NO: 421574 - RNA, 64 nt, hsa
gccaauaaauagcauuaguagcuucuguggggggaucccagagccccuguauuuauuuucccug

SEQ ID NO: 421575 - RNA, 64 nt, hsa
uguguggaguuggcuguuacgacaucccugugugaucccagaggaggggcaguagcugggcaga

SEQ ID NO: 421576 - RNA, 64 nt, hsa
gaaaaccauuuccccuuccaguagcuugguguccaucccagagcauucaugaagucuucccgcc

SEQ ID NO: 421577 - RNA, 64 nt, hsa
uugguaucccucaucccagaagaggcaucuccauaucccagaaaagaagauccuaucaugaaua

SEQ ID NO: 421578 - RNA, 64 nt, hsa
ccacacauuuggcacuguuaucuugguaucccucaucccagaagaggcaucuccauaucccaga

SEQ ID NO: 421579 - RNA, 64 nt, hsa
auggagguccgugagcuggaacugggcacacgccaucccagagggcucaggaugccccaggaag

SEQ ID NO: 421580 - RNA, 64 nt, hsa
gccugauggcagccucagaggcuuacucuaacccaucccagaauaaauggagacuucauguguu

SEQ ID NO: 421581 - RNA, 64 nt, hsa
uucaagcacuacgccuuccacccccaggcacuggaucccagauucccaagccuucacccaccag

SEQ ID NO: 421582 - RNA, 64 nt, hsa
cacaaugccuggauccuggggcccccaucacuggaucccagauccccucacuccacccacugga

SEQ ID NO: 421583 - RNA, 64 nt, hsa
cugggucaugcgauccccacccuucagccacuagaucccagaucccccuguaaccauaacugug

SEQ ID NO: 421584 - RNA, 64 nt, hsa
ggcgcuggggguggaagugcccuggaagccccuccccucucacacugaccuccccccuuacggc

SEQ ID NO: 421585 - RNA, 64 nt, hsa
ugcaaaaguguggccccucacucuaguguguggucccucucaggguccuggggaucugccucuc

SEQ ID NO: 421586 - RNA, 64 nt, hsa
uucacacugggaggcccacuccuggcucaccucucccucucagggacccacgugggagccugga

SEQ ID NO: 421587 - RNA, 64 nt, hsa
uagggcagggcugacuuuggugacacugcccauucccucucaggccagcucaggucacccgggc

SEQ ID NO: 421588 - RNA, 64 nt, hsa
cggcccauacucaccccuucaccugaggcuucuccccucucaacuugcuguugauuucuuuuga

SEQ ID NO: 421589 - RNA, 64 nt, hsa
gucuuguccccuccuacccccagauuagcaccaccccucucacucuuggguuggaugcuauggg

SEQ ID NO: 421590 - RNA, 51 nt, hsa
ccucuccagguccccucugagcccucucaccuuguccuguggaagaagcac

SEQ ID NO: 421591 - RNA, 64 nt, hsa
cagucucccuccccugacucccucugcuguccuccccucucacgagaauaaagugucaagcaag

SEQ ID NO: 421592 - RNA, 64 nt, hsa
cucuccaucaggugguugaccucuaggaccagggcccucucagaggugcagcuuccaugucagu

SEQ ID NO: 421593 - RNA, 64 nt, hsa
guguucaugucucuagccccugcacacugcaggccccucucagcuucacauaccccucuccaug

SEQ ID NO: 421594 - RNA, 64 nt, hsa
agaugcugagagcauccagaaacuuccagaccagcccucucaccacacccagaagaggccuuuc

SEQ ID NO: 421595 - RNA, 64 nt, hsa
ccuuucucaccuggagagaaauuuccagaccauccccucucaccacagccaggagaggccuuuc

SEQ ID NO: 421596 - RNA, 64 nt, hsa
gccuuuccagccuggagagaaacuuccagaccagcccucucacuacagccaggagaggccuuuc

SEQ ID NO: 421597 - RNA, 64 nt, hsa
ccuuucccaccuggacagaaacuuccagaccagccccucucaccacagccaggagaggccuuua

SEQ ID NO: 421598 - RNA, 64 nt, hsa
gccuuucccaccgggagagaaacuuccagaccagcccucucacuacagccagaagaggccuuuc

SEQ ID NO: 421599 - RNA, 64 nt, hsa
ccuuucccaccuggagagaaacuuccagaccagccccucucaccacagccaggagaggccguuc

SEQ ID NO: 421600 - RNA, 64 nt, hsa
ccucucuggcagggaucucagaugaccguggccucccucucagagggggagaacgccagagccc

SEQ ID NO: 421601 - RNA, 64 nt, hsa
gaugugcuggcugggggugaaucccaaugagggucccucucagagcgggagaacgccagagccc

SEQ ID NO: 421602 - RNA, 64 nt, hsa
gaugcgcuggcugggggugaaucccaaugagggucccucucagaaagggagaacgccagagccc

SEQ ID NO: 421603 - RNA, 64 nt, hsa
ggacucuucaaccugguacuccauaccucuugugcccucucacuuuaggcagcuugcacuauuc

SEQ ID NO: 421604 - RNA, 64 nt, hsa
gcugccuucugcugcucccucccagcaggauucacccucucauucccgggcuccugggcccugu

SEQ ID NO: 421605 - RNA, 64 nt, hsa
agaagcccuucuaccuuccugcaacaccuuguuucccucucagauuguaccauugaggaauaaa

SEQ ID NO: 421606 - RNA, 64 nt, hsa
agccauuccuguucccaugagaugaugccaugggcccucucagcaggggaggguagagcggaga

SEQ ID NO: 421607 - RNA, 64 nt, hsa
gcauccccaguucagugaacugguacaauguggucccucucaauauuuaaaaauauaauuugua

SEQ ID NO: 421608 - RNA, 64 nt, hsa
gcucguuagcagcauuagcaccuucugaauuccacccucucagaagaauccacaguguuugaac

SEQ ID NO: 421609 - RNA, 64 nt, hsa
gccuggcagcagcgucccagcgccuccacauugccccucucaccucccagcucuccacgccacu

SEQ ID NO: 421610 - RNA, 64 nt, hsa
cauucuuguguuuuuuuccuccuucuuucccaaucccucucaaccauguauuuauuuauauaug

SEQ ID NO: 421611 - RNA, 64 nt, hsa
gucaccuacccccugcuugcucaaucgaucacgacccucucacguggacccccuuagaguugug

SEQ ID NO: 421612 - RNA, 64 nt, hsa
aggaaauugaauacucugagagaagagagacagacccucucauacuguuuuauauuguuuuaua

SEQ ID NO: 421613 - RNA, 64 nt, hsa
ggccuggcacugcauggagccagcacguugaccucccucucagcucccugcucagggacggugg

SEQ ID NO: 421614 - RNA, 64 nt, hsa
agacuaacgcauagcccaggggagugguuggcagcccucucaccccagggccuguggcugccug

SEQ ID NO: 421615 - RNA, 64 nt, hsa
gcaagcccagggcacagaugccaggauggcuucucccucucagugcgaggcuucaccccugcca

SEQ ID NO: 421616 - RNA, 64 nt, hsa
gcaagcccagggcauagaugcugagacagccucucccucucagugcagggacgucaccccugcc

SEQ ID NO: 421617 - RNA, 64 nt, hsa
gcaagcccagggcacagaggccgggacggccucucccucucagugugaggcuucacccaugcua

SEQ ID NO: 421618 - RNA, 64 nt, hsa
gcaagcccagggcacagaugccgggauggccccucccucucagugcgggaacgucaccccugcc

SEQ ID NO: 421619 - RNA, 64 nt, hsa
ucucucucucucucucccucccucuccuucccuacccucucaccaucuuucuuggccucucuga

SEQ ID NO: 421620 - RNA, 64 nt, hsa
cuugaacccuugcaaaggggcaggacaaggggaccccucucacuccugcugcugcccaugcucu

SEQ ID NO: 421621 - RNA, 64 nt, hsa
aguauuuucccugcuagggguuuuaggucucuuccccucucagagcuacuugggccauagcucc

SEQ ID NO: 421622 - RNA, 64 nt, hsa
agagaagccugugcccugauccaaguuuacucaacccucucaggugaccaaaauccccuucuca

SEQ ID NO: 421623 - RNA, 64 nt, hsa; identical to SEQ ID NO: 140386

SEQ ID NO: 421624 - RNA, 64 nt, hsa; identical to SEQ ID NO: 140387

SEQ ID NO: 421625 - RNA, 64 nt, hsa; identical to SEQ ID NO: 140388

SEQ ID NO: 421626 - RNA, 64 nt, hsa; identical to SEQ ID NO: 140389

SEQ ID NO: 421627 - RNA, 64 nt, hsa; identical to SEQ ID NO: 140390

SEQ ID NO: 421628 - RNA, 64 nt, hsa; identical to SEQ ID NO: 140391

SEQ ID NO: 421629 - RNA, 64 nt, hsa; identical to SEQ ID NO: 140392

SEQ ID NO: 421630 - RNA, 64 nt, hsa; identical to SEQ ID NO: 140393

SEQ ID NO: 421631 - RNA, 64 nt, hsa; identical to SEQ ID NO: 140394

SEQ ID NO: 421632 - RNA, 64 nt, hsa; identical to SEQ ID NO: 140395

SEQ ID NO: 421633 - RNA, 64 nt, hsa; identical to SEQ ID NO: 140396

SEQ ID NO: 421634 - RNA, 64 nt, hsa; identical to SEQ ID NO: 140397

SEQ ID NO: 421635 - RNA, 64 nt, hsa; identical to SEQ ID NO: 140398

SEQ ID NO: 421636 - RNA, 64 nt, hsa; identical to SEQ ID NO: 140399

SEQ ID NO: 421637 - RNA, 64 nt, hsa; identical to SEQ ID NO: 140400

SEQ ID NO: 421638 - RNA, 64 nt, hsa; identical to SEQ ID NO: 140401

SEQ ID NO: 421639 - RNA, 64 nt, hsa; identical to SEQ ID NO: 140402

SEQ ID NO: 421640 - RNA, 64 nt, hsa; identical to SEQ ID NO: 140403

SEQ ID NO: 421641 - RNA, 64 nt, hsa; identical to SEQ ID NO: 140404

SEQ ID NO: 421642 - RNA, 64 nt, hsa; identical to SEQ ID NO: 140405

SEQ ID NO: 421643 - RNA, 64 nt, hsa; identical to SEQ ID NO: 140406

SEQ ID NO: 421644 - RNA, 64 nt, hsa; identical to SEQ ID NO: 140407

SEQ ID NO: 421645 - RNA, 64 nt, hsa; identical to SEQ ID NO: 140408

SEQ ID NO: 421646 - RNA, 64 nt, hsa; identical to SEQ ID NO: 140409

SEQ ID NO: 421647 - RNA, 64 nt, hsa; identical to SEQ ID NO: 140410

SEQ ID NO: 421648 - RNA, 64 nt, hsa; identical to SEQ ID NO: 140411

SEQ ID NO: 421649 - RNA, 64 nt, hsa; identical to SEQ ID NO: 140412

SEQ ID NO: 421650 - RNA, 64 nt, hsa; identical to SEQ ID NO: 140413

SEQ ID NO: 421651 - RNA, 64 nt, hsa; identical to SEQ ID NO: 140414

SEQ ID NO: 421652 - RNA, 64 nt, hsa; identical to SEQ ID NO: 140415

SEQ ID NO: 421653 - RNA, 64 nt, hsa; identical to SEQ ID NO: 140416

SEQ ID NO: 421654 - RNA, 64 nt, hsa; identical to SEQ ID NO: 140417

SEQ ID NO: 421655 - RNA, 64 nt, hsa; identical to SEQ ID NO: 140418

SEQ ID NO: 421656 - RNA, 64 nt, hsa; identical to SEQ ID NO: 140419

SEQ ID NO: 421657 - RNA, 64 nt, hsa; identical to SEQ ID NO: 140420

SEQ ID NO: 421658 - RNA, 64 nt, hsa; identical to SEQ ID NO: 140421

SEQ ID NO: 421659 - RNA, 64 nt, hsa; identical to SEQ ID NO: 140422

SEQ ID NO: 421660 - RNA, 64 nt, hsa; identical to SEQ ID NO: 140423

SEQ ID NO: 421661 - RNA, 64 nt, hsa; identical to SEQ ID NO: 140424

SEQ ID NO: 421662 - RNA, 64 nt, hsa; identical to SEQ ID NO: 140425

SEQ ID NO: 421663 - RNA, 64 nt, hsa; identical to SEQ ID NO: 140426

SEQ ID NO: 421664 - RNA, 64 nt, hsa; identical to SEQ ID NO: 140427

SEQ ID NO: 421665 - RNA, 64 nt, hsa; identical to SEQ ID NO: 140428

SEQ ID NO: 421666 - RNA, 64 nt, hsa; identical to SEQ ID NO: 140429

SEQ ID NO: 421667 - RNA, 63 nt, hsa; identical to SEQ ID NO: 140430

SEQ ID NO: 421668 - RNA, 64 nt, hsa; identical to SEQ ID NO: 140431

SEQ ID NO: 421669 - RNA, 64 nt, hsa; identical to SEQ ID NO: 140432

SEQ ID NO: 421670 - RNA, 64 nt, hsa; identical to SEQ ID NO: 140433

SEQ ID NO: 421671 - RNA, 64 nt, hsa; identical to SEQ ID NO: 140434

SEQ ID NO: 421672 - RNA, 52 nt, hsa; identical to SEQ ID NO: 140435

SEQ ID NO: 421673 - RNA, 64 nt, hsa; identical to SEQ ID NO: 140436

SEQ ID NO: 421674 - RNA, 64 nt, hsa; identical to SEQ ID NO: 140437

SEQ ID NO: 421675 - RNA, 64 nt, hsa; identical to SEQ ID NO: 140438

SEQ ID NO: 421676 - RNA, 64 nt, hsa; identical to SEQ ID NO: 140439

SEQ ID NO: 421677 - RNA, 64 nt, hsa; identical to SEQ ID NO: 140440

SEQ ID NO: 421678 - RNA, 64 nt, hsa; identical to SEQ ID NO: 140441

SEQ ID NO: 421679 - RNA, 64 nt, hsa; identical to SEQ ID NO: 140442

SEQ ID NO: 421680 - RNA, 64 nt, hsa; identical to SEQ ID NO: 140443

SEQ ID NO: 421681 - RNA, 64 nt, hsa; identical to SEQ ID NO: 140444

SEQ ID NO: 421682 - RNA, 64 nt, hsa; identical to SEQ ID NO: 140445

SEQ ID NO: 421683 - RNA, 64 nt, hsa; identical to SEQ ID NO: 140446

SEQ ID NO: 421684 - RNA, 64 nt, hsa; identical to SEQ ID NO: 140447

SEQ ID NO: 421685 - RNA, 64 nt, hsa; identical to SEQ ID NO: 140448

SEQ ID NO: 421686 - RNA, 64 nt, hsa; identical to SEQ ID NO: 140449

SEQ ID NO: 421687 - RNA, 64 nt, hsa; identical to SEQ ID NO: 140450

SEQ ID NO: 421688 - RNA, 64 nt, hsa; identical to SEQ ID NO: 140451

SEQ ID NO: 421689 - RNA, 64 nt, hsa; identical to SEQ ID NO: 140452

SEQ ID NO: 421690 - RNA, 64 nt, hsa; identical to SEQ ID NO: 140453

SEQ ID NO: 421691 - RNA, 64 nt, hsa; identical to SEQ ID NO: 140454

SEQ ID NO: 421692 - RNA, 64 nt, hsa; identical to SEQ ID NO: 140455

SEQ ID NO: 421693 - RNA, 64 nt, hsa; identical to SEQ ID NO: 140456

SEQ ID NO: 421694 - RNA, 64 nt, hsa; identical to SEQ ID NO: 140457

SEQ ID NO: 421695 - RNA, 64 nt, hsa; identical to SEQ ID NO: 140458

SEQ ID NO: 421696 - RNA, 64 nt, hsa; identical to SEQ ID NO: 140459

SEQ ID NO: 421697 - RNA, 64 nt, hsa; identical to SEQ ID NO: 140460

SEQ ID NO: 421698 - RNA, 64 nt, hsa; identical to SEQ ID NO: 140461

SEQ ID NO: 421699 - RNA, 64 nt, hsa; identical to SEQ ID NO: 140462

SEQ ID NO: 421700 - RNA, 64 nt, hsa; identical to SEQ ID NO: 140463

SEQ ID NO: 421701 - RNA, 64 nt, hsa; identical to SEQ ID NO: 140464

SEQ ID NO: 421702 - RNA, 64 nt, hsa; identical to SEQ ID NO: 140465

SEQ ID NO: 421703 - RNA, 64 nt, hsa; identical to SEQ ID NO: 140466

SEQ ID NO: 421704 - RNA, 64 nt, hsa; identical to SEQ ID NO: 140467

SEQ ID NO: 421705 - RNA, 64 nt, hsa; identical to SEQ ID NO: 140468

SEQ ID NO: 421706 - RNA, 64 nt, hsa; identical to SEQ ID NO: 140469

SEQ ID NO: 421707 - RNA, 64 nt, hsa; identical to SEQ ID NO: 140470

SEQ ID NO: 421708 - RNA, 64 nt, hsa; identical to SEQ ID NO: 140471

SEQ ID NO: 421709 - RNA, 64 nt, hsa; identical to SEQ ID NO: 140472

SEQ ID NO: 421710 - RNA, 64 nt, hsa; identical to SEQ ID NO: 140473

SEQ ID NO: 421711 - RNA, 64 nt, hsa; identical to SEQ ID NO: 140474

SEQ ID NO: 421712 - RNA, 64 nt, hsa; identical to SEQ ID NO: 140475

SEQ ID NO: 421713 - RNA, 64 nt, hsa; identical to SEQ ID NO: 140476

SEQ ID NO: 421714 - RNA, 64 nt, hsa; identical to SEQ ID NO: 140477

SEQ ID NO: 421715 - RNA, 64 nt, hsa; identical to SEQ ID NO: 140478

SEQ ID NO: 421716 - RNA, 64 nt, hsa; identical to SEQ ID NO: 140479

SEQ ID NO: 421717 - RNA, 64 nt, hsa; identical to SEQ ID NO: 140480

SEQ ID NO: 421718 - RNA, 64 nt, hsa; identical to SEQ ID NO: 140481

SEQ ID NO: 421719 - RNA, 64 nt, hsa; identical to SEQ ID NO: 140482

SEQ ID NO: 421720 - RNA, 64 nt, hsa; identical to SEQ ID NO: 140483

SEQ ID NO: 421721 - RNA, 64 nt, hsa; identical to SEQ ID NO: 140484

SEQ ID NO: 421722 - RNA, 64 nt, hsa; identical to SEQ ID NO: 140485

SEQ ID NO: 421723 - RNA, 64 nt, hsa; identical to SEQ ID NO: 140486

SEQ ID NO: 421724 - RNA, 64 nt, hsa; identical to SEQ ID NO: 140487

SEQ ID NO: 421725 - RNA, 64 nt, hsa; identical to SEQ ID NO: 140488

SEQ ID NO: 421726 - RNA, 64 nt, hsa; identical to SEQ ID NO: 140489

SEQ ID NO: 421727 - RNA, 64 nt, hsa; identical to SEQ ID NO: 140490

SEQ ID NO: 421728 - RNA, 64 nt, hsa; identical to SEQ ID NO: 140491

SEQ ID NO: 421729 - RNA, 64 nt, hsa; identical to SEQ ID NO: 140492

SEQ ID NO: 421730 - RNA, 64 nt, hsa; identical to SEQ ID NO: 140493

SEQ ID NO: 421731 - RNA, 64 nt, hsa; identical to SEQ ID NO: 140494

SEQ ID NO: 421732 - RNA, 64 nt, hsa; identical to SEQ ID NO: 140495

SEQ ID NO: 421733 - RNA, 64 nt, hsa; identical to SEQ ID NO: 140496

SEQ ID NO: 421734 - RNA, 64 nt, hsa; identical to SEQ ID NO: 140497

SEQ ID NO: 421735 - RNA, 64 nt, hsa; identical to SEQ ID NO: 140498

SEQ ID NO: 421736 - RNA, 64 nt, hsa; identical to SEQ ID NO: 140499

SEQ ID NO: 421737 - RNA, 64 nt, hsa; identical to SEQ ID NO: 140500

SEQ ID NO: 421738 - RNA, 64 nt, hsa; identical to SEQ ID NO: 140501

SEQ ID NO: 421739 - RNA, 64 nt, hsa; identical to SEQ ID NO: 140502

SEQ ID NO: 421740 - RNA, 64 nt, hsa; identical to SEQ ID NO: 140503

SEQ ID NO: 421741 - RNA, 64 nt, hsa; identical to SEQ ID NO: 140504

SEQ ID NO: 421742 - RNA, 64 nt, hsa; identical to SEQ ID NO: 140505

SEQ ID NO: 421743 - RNA, 64 nt, hsa; identical to SEQ ID NO: 140506

SEQ ID NO: 421744 - RNA, 64 nt, hsa; identical to SEQ ID NO: 140507

SEQ ID NO: 421745 - RNA, 64 nt, hsa; identical to SEQ ID NO: 140508

SEQ ID NO: 421746 - RNA, 64 nt, hsa; identical to SEQ ID NO: 140509

SEQ ID NO: 421747 - RNA, 64 nt, hsa; identical to SEQ ID NO: 140510

SEQ ID NO: 421748 - RNA, 64 nt, hsa; identical to SEQ ID NO: 140511

SEQ ID NO: 421749 - RNA, 64 nt, hsa; identical to SEQ ID NO: 140512

SEQ ID NO: 421750 - RNA, 64 nt, hsa; identical to SEQ ID NO: 140513

SEQ ID NO: 421751 - RNA, 64 nt, hsa; identical to SEQ ID NO: 140514

SEQ ID NO: 421752 - RNA, 64 nt, hsa; identical to SEQ ID NO: 140515

SEQ ID NO: 421753 - RNA, 64 nt, hsa; identical to SEQ ID NO: 140516

SEQ ID NO: 421754 - RNA, 64 nt, hsa; identical to SEQ ID NO: 140517

SEQ ID NO: 421755 - RNA, 64 nt, hsa; identical to SEQ ID NO: 140518

SEQ ID NO: 421756 - RNA, 64 nt, hsa; identical to SEQ ID NO: 140519

SEQ ID NO: 421757 - RNA, 64 nt, hsa; identical to SEQ ID NO: 140520

SEQ ID NO: 421758 - RNA, 64 nt, hsa; identical to SEQ ID NO: 140521

SEQ ID NO: 421759 - RNA, 64 nt, hsa; identical to SEQ ID NO: 140522

SEQ ID NO: 421760 - RNA, 64 nt, hsa; identical to SEQ ID NO: 140523

SEQ ID NO: 421761 - RNA, 64 nt, hsa; identical to SEQ ID NO: 140524

SEQ ID NO: 421762 - RNA, 64 nt, hsa; identical to SEQ ID NO: 140525

SEQ ID NO: 421763 - RNA, 64 nt, hsa; identical to SEQ ID NO: 140526

SEQ ID NO: 421764 - RNA, 64 nt, hsa; identical to SEQ ID NO: 140527

SEQ ID NO: 421765 - RNA, 64 nt, hsa; identical to SEQ ID NO: 140528

SEQ ID NO: 421766 - RNA, 64 nt, hsa; identical to SEQ ID NO: 140529

SEQ ID NO: 421767 - RNA, 64 nt, hsa; identical to SEQ ID NO: 140530

SEQ ID NO: 421768 - RNA, 64 nt, hsa; identical to SEQ ID NO: 140531

SEQ ID NO: 421769 - RNA, 64 nt, hsa; identical to SEQ ID NO: 140532

SEQ ID NO: 421770 - RNA, 64 nt, hsa; identical to SEQ ID NO: 140533

SEQ ID NO: 421771 - RNA, 64 nt, hsa; identical to SEQ ID NO: 140534

SEQ ID NO: 421772 - RNA, 64 nt, hsa; identical to SEQ ID NO: 140535

SEQ ID NO: 421773 - RNA, 64 nt, hsa; identical to SEQ ID NO: 140536

SEQ ID NO: 421774 - RNA, 64 nt, hsa; identical to SEQ ID NO: 140537

SEQ ID NO: 421775 - RNA, 64 nt, hsa; identical to SEQ ID NO: 140538

SEQ ID NO: 421776 - RNA, 62 nt, hsa; identical to SEQ ID NO: 140539

SEQ ID NO: 421777 - RNA, 64 nt, hsa; identical to SEQ ID NO: 140540

SEQ ID NO: 421778 - RNA, 64 nt, hsa; identical to SEQ ID NO: 140541

SEQ ID NO: 421779 - RNA, 64 nt, hsa; identical to SEQ ID NO: 140542

SEQ ID NO: 421780 - RNA, 64 nt, hsa; identical to SEQ ID NO: 140543

SEQ ID NO: 421781 - RNA, 64 nt, hsa; identical to SEQ ID NO: 140544

SEQ ID NO: 421782 - RNA, 64 nt, hsa; identical to SEQ ID NO: 140545

SEQ ID NO: 421783 - RNA, 64 nt, hsa; identical to SEQ ID NO: 140546

SEQ ID NO: 421784 - RNA, 64 nt, hsa; identical to SEQ ID NO: 140547

SEQ ID NO: 421785 - RNA, 64 nt, hsa; identical to SEQ ID NO: 140548

SEQ ID NO: 421786 - RNA, 64 nt, hsa; identical to SEQ ID NO: 140549

SEQ ID NO: 421787 - RNA, 64 nt, hsa; identical to SEQ ID NO: 140550

SEQ ID NO: 421788 - RNA, 64 nt, hsa; identical to SEQ ID NO: 140551

SEQ ID NO: 421789 - RNA, 64 nt, hsa; identical to SEQ ID NO: 140552

SEQ ID NO: 421790 - RNA, 64 nt, hsa; identical to SEQ ID NO: 140553

SEQ ID NO: 421791 - RNA, 64 nt, hsa; identical to SEQ ID NO: 140554

SEQ ID NO: 421792 - RNA, 64 nt, hsa; identical to SEQ ID NO: 140555

SEQ ID NO: 421793 - RNA, 64 nt, hsa; identical to SEQ ID NO: 140556

SEQ ID NO: 421794 - RNA, 64 nt, hsa; identical to SEQ ID NO: 140557

SEQ ID NO: 421795 - RNA, 64 nt, hsa; identical to SEQ ID NO: 140558

SEQ ID NO: 421796 - RNA, 64 nt, hsa; identical to SEQ ID NO: 140559

SEQ ID NO: 421797 - RNA, 64 nt, hsa; identical to SEQ ID NO: 140560

SEQ ID NO: 421798 - RNA, 64 nt, hsa; identical to SEQ ID NO: 140561

SEQ ID NO: 421799 - RNA, 64 nt, hsa; identical to SEQ ID NO: 140562

SEQ ID NO: 421800 - RNA, 64 nt, hsa; identical to SEQ ID NO: 140563

SEQ ID NO: 421801 - RNA, 64 nt, hsa; identical to SEQ ID NO: 140564

SEQ ID NO: 421802 - RNA, 64 nt, hsa; identical to SEQ ID NO: 140565

SEQ ID NO: 421803 - RNA, 64 nt, hsa; identical to SEQ ID NO: 140566

SEQ ID NO: 421804 - RNA, 64 nt, hsa; identical to SEQ ID NO: 140567

SEQ ID NO: 421805 - RNA, 64 nt, hsa; identical to SEQ ID NO: 140568

SEQ ID NO: 421806 - RNA, 64 nt, hsa; identical to SEQ ID NO: 140569

SEQ ID NO: 421807 - RNA, 64 nt, hsa; identical to SEQ ID NO: 140570

SEQ ID NO: 421808 - RNA, 64 nt, hsa; identical to SEQ ID NO: 140571

SEQ ID NO: 421809 - RNA, 64 nt, hsa; identical to SEQ ID NO: 140572

SEQ ID NO: 421810 - RNA, 64 nt, hsa; identical to SEQ ID NO: 140573

SEQ ID NO: 421811 - RNA, 64 nt, hsa; identical to SEQ ID NO: 140574

SEQ ID NO: 421812 - RNA, 64 nt, hsa; identical to SEQ ID NO: 140575

SEQ ID NO: 421813 - RNA, 64 nt, hsa; identical to SEQ ID NO: 140576

SEQ ID NO: 421814 - RNA, 64 nt, hsa; identical to SEQ ID NO: 140577

SEQ ID NO: 421815 - RNA, 64 nt, hsa; identical to SEQ ID NO: 140578

SEQ ID NO: 421816 - RNA, 64 nt, hsa; identical to SEQ ID NO: 140579

SEQ ID NO: 421817 - RNA, 64 nt, hsa; identical to SEQ ID NO: 140580

SEQ ID NO: 421818 - RNA, 64 nt, hsa; identical to SEQ ID NO: 140581

SEQ ID NO: 421819 - RNA, 64 nt, hsa; identical to SEQ ID NO: 140582

SEQ ID NO: 421820 - RNA, 64 nt, hsa; identical to SEQ ID NO: 140583

SEQ ID NO: 421821 - RNA, 64 nt, hsa; identical to SEQ ID NO: 140584

SEQ ID NO: 421822 - RNA, 64 nt, hsa; identical to SEQ ID NO: 140585

SEQ ID NO: 421823 - RNA, 64 nt, hsa; identical to SEQ ID NO: 140586

SEQ ID NO: 421824 - RNA, 64 nt, hsa; identical to SEQ ID NO: 140587

SEQ ID NO: 421825 - RNA, 64 nt, hsa; identical to SEQ ID NO: 140588

SEQ ID NO: 421826 - RNA, 64 nt, hsa; identical to SEQ ID NO: 140589

SEQ ID NO: 421827 - RNA, 64 nt, hsa; identical to SEQ ID NO: 140590

SEQ ID NO: 421828 - RNA, 64 nt, hsa; identical to SEQ ID NO: 140591

SEQ ID NO: 421829 - RNA, 64 nt, hsa; identical to SEQ ID NO: 140592

SEQ ID NO: 421830 - RNA, 64 nt, hsa; identical to SEQ ID NO: 140593

SEQ ID NO: 421831 - RNA, 64 nt, hsa; identical to SEQ ID NO: 140594

SEQ ID NO: 421832 - RNA, 64 nt, hsa; identical to SEQ ID NO: 140595

SEQ ID NO: 421833 - RNA, 64 nt, hsa; identical to SEQ ID NO: 140596

SEQ ID NO: 421834 - RNA, 64 nt, hsa
ccgugccuaggaaaaggggacagagggcaaggagagaagugagagcuacaauuccagcauugga

SEQ ID NO: 421835 - RNA, 64 nt, hsa
ugcccagauagacuaacaacccuuuagugcuccaagaagugagaauuuccgaaaaagaucugcc

SEQ ID NO: 421836 - RNA, 64 nt, hsa
ugugagccaccgcacccggcuggccaaucuuaucagaagugagcuaccaaaacuuccacagaug

SEQ ID NO: 421837 - RNA, 64 nt, hsa
aaagcauuccucaagaucacuuuuaaaaaagguuagaagugaagcaaauacauucagcuuacug

SEQ ID NO: 421838 - RNA, 64 nt, hsa
ggugaggagcaacucugcccagccgccccgucugagaagugaggagacccuccgccuggcaacc

SEQ ID NO: 421839 - RNA, 64 nt, hsa
aaggagccccucugcccagcagccgccccgucugagaagugaggagccccucugcccagcagcc

SEQ ID NO: 421840 - RNA, 64 nt, hsa
gggccuguuucuguaacuuucucccccucuacugagaagugaccuggaagugagaaguucuuug

SEQ ID NO: 421841 - RNA, 64 nt, hsa
agacggguguuuuauuuggucuaauacccugaaaagaagugaugacuuguugcuuuucaaaaca

SEQ ID NO: 421842 - RNA, 64 nt, hsa
auaauaauaaaaauauaaaaaggugauguucaacagaagugaagacaaaacaauaugcaucagg

SEQ ID NO: 421843 - RNA, 64 nt, hsa
aauguucuuucacaucacuggaaucugcaauucaagaagugacaagggagaauucuugcuuuac

SEQ ID NO: 421844 - RNA, 64 nt, hsa
gacagagacgggagcucugaguguccacgggugaagaagugaguguccacgggugaagaaguga

SEQ ID NO: 421845 - RNA, 64 nt, hsa
guccacgggugaagaagugaguguccacgggugaagaagugaguauguuucaccuggacauuaa

SEQ ID NO: 421846 - RNA, 64 nt, hsa
gcauauaaggaaaaccaucuagagaguuuucuuuagaagugacucccauuagccugguguggug

SEQ ID NO: 421847 - RNA, 64 nt, hsa
gagcgagacccugugucuaaguaaagaaaaagccagaagugacucccacugcuucuguugaucg

SEQ ID NO: 421848 - RNA, 64 nt, hsa
uaaccuccaucggccuuaguuuuugcauccaaaaagaagugauugggcuggucuuggaagguuu

SEQ ID NO: 421849 - RNA, 64 nt, hsa
uggacagccuggacauuuugagcagcgcgagaguagaagugaauacccccaggaacuccaauug

SEQ ID NO: 421850 - RNA, 64 nt, hsa
uuaccuacuauuggcccuaaauagcagaaagaagagaagugaccgagagaaccucagauucuuc

SEQ ID NO: 421851 - RNA, 64 nt, hsa
cuauucugaugaaucucaaaguaaggcugguaagagaagugaguggugugacucuuacuccuua

SEQ ID NO: 421852 - RNA, 64 nt, hsa
acugcuaucauaaggggucagggacauuccggggagaagugaccacuaaggugaggauuagaga

SEQ ID NO: 421853 - RNA, 64 nt, hsa
aagugaccacuaaggugaggauuagagagugaguagaagugagccagacaaaaaaagcagaaaa

SEQ ID NO: 421854 - RNA, 64 nt, hsa
gccacugaguggccacuguccuuccuaaaugucaagaagugaaguaugucacccuuucagggaa

SEQ ID NO: 421855 - RNA, 64 nt, hsa
aacaugcugacagaaaacucccauggcucuaggaagaagugacacuaagccaacaccuuucuuu

SEQ ID NO: 421856 - RNA, 63 nt, hsa
auaaagaagaaaaacuguagguuguguagcuggagaagugacagucaggggcccugauuccac

SEQ ID NO: 421857 - RNA, 64 nt, hsa
auagauacaaagucugugucuaaauauuauuuaaagaagugauuuuucauucucuuggauucuu

SEQ ID NO: 421858 - RNA, 64 nt, hsa
ggugaggagcgucucugucuggccaccccgucugagaagugaggagaccuccgcccggcagccg

SEQ ID NO: 421859 - RNA, 64 nt, hsa
ugaggagaccuccgcccggcagccgcccugucugagaagugaggagccccuccgcccggcagcc

SEQ ID NO: 421860 - RNA, 64 nt, hsa
agcauuuuuagugaagcaagaaaggaguuugccaagaagugaucuguuuuaaaggucauauuug

SEQ ID NO: 421861 - RNA, 64 nt, hsa
gcacgguuuaacacagcagaguacagaagggugaagaagugagcagaggcuuaugaagauauuc

SEQ ID NO: 421862 - RNA, 64 nt, hsa
aaauuucuuguucauaagauuaugaaaccacaugagaagugauaaaauguuuguuaaagcuaga

SEQ ID NO: 421863 - RNA, 64 nt, hsa
uuaauucauccuagcaaauucuaccuuauuuuacagaagugaaagugagguaucagaaguguua

SEQ ID NO: 421864 - RNA, 64 nt, hsa
uaagcuaauaaagaaaagagguuuauacugcaaaagaagugaaacuauauguauucacaguuga

SEQ ID NO: 421865 - RNA, 64 nt, hsa
acccucguaacaacagucucccugggugggucccagaagugaucuuugugucgcucgggucgga

SEQ ID NO: 421866 - RNA, 64 nt, hsa
agugccugcccucagcucucacacaugacuggagagaagugagaagacucccagaaucugccuu

SEQ ID NO: 421867 - RNA, 64 nt, hsa
auccauaagccugaugaguugaaauugcaguuugagaagugaauuaaccuuacaucccuuuguu

SEQ ID NO: 421868 - RNA, 64 nt, hsa
cuguuguuauaguucauuguuuugccuacucagcagaagugaugacucuuaaaaauuggcuuug

SEQ ID NO: 421869 - RNA, 64 nt, hsa
aguggcuagauggaguauuaagguggagcagaaaagaagugagaacaucuugauuccccuuucu

SEQ ID NO: 421870 - RNA, 64 nt, hsa
aggccagggauugccuucuaaauuaugauaaaacagaagugaagaguuucagagcaucagauug

SEQ ID NO: 421871 - RNA, 64 nt, hsa
uguuucuguuuuucccaguaugcauguuuaaaauagaagugacaagaaucacauccgguugugu

SEQ ID NO: 421872 - RNA, 64 nt, hsa
guucaggagaccauaggaccccugacccaugagaagaagugauugguuucgauuauagacauca

SEQ ID NO: 421873 - RNA, 64 nt, hsa
gaugcucaagagggagguuuccuccugagugaagagaagugauucucccuugacucuggcuccu

SEQ ID NO: 421874 - RNA, 64 nt, hsa; identical to SEQ ID NO: 88616

SEQ ID NO: 421875 - RNA, 64 nt, hsa; identical to SEQ ID NO: 88617

SEQ ID NO: 421876 - RNA, 64 nt, hsa; identical to SEQ ID NO: 88618

SEQ ID NO: 421877 - RNA, 64 nt, hsa; identical to SEQ ID NO: 88619

SEQ ID NO: 421878 - RNA, 64 nt, hsa; identical to SEQ ID NO: 88620

SEQ ID NO: 421879 - RNA, 64 nt, hsa; identical to SEQ ID NO: 88621

SEQ ID NO: 421880 - RNA, 64 nt, hsa; identical to SEQ ID NO: 88622

SEQ ID NO: 421881 - RNA, 64 nt, hsa; identical to SEQ ID NO: 88623

SEQ ID NO: 421882 - RNA, 64 nt, hsa; identical to SEQ ID NO: 82031

SEQ ID NO: 421883 - RNA, 64 nt, hsa; identical to SEQ ID NO: 82032

SEQ ID NO: 421884 - RNA, 64 nt, hsa; identical to SEQ ID NO: 82033

SEQ ID NO: 421885 - RNA, 64 nt, hsa; identical to SEQ ID NO: 82034

SEQ ID NO: 421886 - RNA, 64 nt, hsa; identical to SEQ ID NO: 82035

SEQ ID NO: 421887 - RNA, 64 nt, hsa; identical to SEQ ID NO: 82036

SEQ ID NO: 421888 - RNA, 64 nt, hsa; identical to SEQ ID NO: 82037

SEQ ID NO: 421889 - RNA, 64 nt, hsa; identical to SEQ ID NO: 82038

SEQ ID NO: 421890 - RNA, 64 nt, hsa; identical to SEQ ID NO: 82039

SEQ ID NO: 421891 - RNA, 64 nt, hsa; identical to SEQ ID NO: 82040

SEQ ID NO: 421892 - RNA, 64 nt, hsa; identical to SEQ ID NO: 82041

SEQ ID NO: 421893 - RNA, 64 nt, hsa; identical to SEQ ID NO: 82042

SEQ ID NO: 421894 - RNA, 64 nt, hsa; identical to SEQ ID NO: 82043

SEQ ID NO: 421895 - RNA, 64 nt, hsa; identical to SEQ ID NO: 82044

SEQ ID NO: 421896 - RNA, 64 nt, hsa; identical to SEQ ID NO: 82045

SEQ ID NO: 421897 - RNA, 64 nt, hsa; identical to SEQ ID NO: 82046

SEQ ID NO: 421898 - RNA, 64 nt, hsa; identical to SEQ ID NO: 82047

SEQ ID NO: 421899 - RNA, 64 nt, hsa; identical to SEQ ID NO: 82048

SEQ ID NO: 421900 - RNA, 64 nt, hsa; identical to SEQ ID NO: 82049

SEQ ID NO: 421901 - RNA, 64 nt, hsa; identical to SEQ ID NO: 82050

SEQ ID NO: 421902 - RNA, 64 nt, hsa; identical to SEQ ID NO: 82051

SEQ ID NO: 421903 - RNA, 64 nt, hsa; identical to SEQ ID NO: 82052

SEQ ID NO: 421904 - RNA, 64 nt, hsa; identical to SEQ ID NO: 82053

SEQ ID NO: 421905 - RNA, 64 nt, hsa; identical to SEQ ID NO: 82054

SEQ ID NO: 421906 - RNA, 64 nt, hsa; identical to SEQ ID NO: 82055

SEQ ID NO: 421907 - RNA, 64 nt, hsa; identical to SEQ ID NO: 82056

SEQ ID NO: 421908 - RNA, 64 nt, hsa; identical to SEQ ID NO: 82057

SEQ ID NO: 421909 - RNA, 64 nt, hsa; identical to SEQ ID NO: 82058

SEQ ID NO: 421910 - RNA, 64 nt, hsa; identical to SEQ ID NO: 82059

SEQ ID NO: 421911 - RNA, 64 nt, hsa; identical to SEQ ID NO: 82060

SEQ ID NO: 421912 - RNA, 64 nt, hsa; identical to SEQ ID NO: 82061

SEQ ID NO: 421913 - RNA, 64 nt, hsa; identical to SEQ ID NO: 77572

SEQ ID NO: 421914 - RNA, 64 nt, hsa; identical to SEQ ID NO: 77573

SEQ ID NO: 421915 - RNA, 64 nt, hsa; identical to SEQ ID NO: 77574

SEQ ID NO: 421916 - RNA, 64 nt, hsa; identical to SEQ ID NO: 77575

SEQ ID NO: 421917 - RNA, 64 nt, hsa; identical to SEQ ID NO: 77576

SEQ ID NO: 421918 - RNA, 64 nt, hsa; identical to SEQ ID NO: 77577

SEQ ID NO: 421919 - RNA, 64 nt, hsa; identical to SEQ ID NO: 77578

SEQ ID NO: 421920 - RNA, 64 nt, hsa; identical to SEQ ID NO: 77579

SEQ ID NO: 421921 - RNA, 64 nt, hsa; identical to SEQ ID NO: 77580

SEQ ID NO: 421922 - RNA, 64 nt, hsa; identical to SEQ ID NO: 77581

SEQ ID NO: 421923 - RNA, 64 nt, hsa; identical to SEQ ID NO: 77582

SEQ ID NO: 421924 - RNA, 64 nt, hsa; identical to SEQ ID NO: 77583

SEQ ID NO: 421925 - RNA, 64 nt, hsa; identical to SEQ ID NO: 77584

SEQ ID NO: 421926 - RNA, 64 nt, hsa; identical to SEQ ID NO: 77585

SEQ ID NO: 421927 - RNA, 64 nt, hsa; identical to SEQ ID NO: 77586

SEQ ID NO: 421928 - RNA, 64 nt, hsa; identical to SEQ ID NO: 77587

SEQ ID NO: 421929 - RNA, 64 nt, hsa; identical to SEQ ID NO: 77588

SEQ ID NO: 421930 - RNA, 64 nt, hsa; identical to SEQ ID NO: 77589

SEQ ID NO: 421931 - RNA, 56 nt, hsa; identical to SEQ ID NO: 77590

SEQ ID NO: 421932 - RNA, 64 nt, hsa; identical to SEQ ID NO: 77591

SEQ ID NO: 421933 - RNA, 64 nt, hsa; identical to SEQ ID NO: 77592

SEQ ID NO: 421934 - RNA, 64 nt, hsa; identical to SEQ ID NO: 77593

SEQ ID NO: 421935 - RNA, 64 nt, hsa; identical to SEQ ID NO: 77594

SEQ ID NO: 421936 - RNA, 64 nt, hsa; identical to SEQ ID NO: 77595

SEQ ID NO: 421937 - RNA, 64 nt, hsa; identical to SEQ ID NO: 77596

SEQ ID NO: 421938 - RNA, 64 nt, hsa; identical to SEQ ID NO: 77597

SEQ ID NO: 421939 - RNA, 64 nt, hsa; identical to SEQ ID NO: 77598

SEQ ID NO: 421940 - RNA, 64 nt, hsa; identical to SEQ ID NO: 77599

SEQ ID NO: 421941 - RNA, 64 nt, hsa; identical to SEQ ID NO: 77600

SEQ ID NO: 421942 - RNA, 64 nt, hsa; identical to SEQ ID NO: 77601

SEQ ID NO: 421943 - RNA, 64 nt, hsa; identical to SEQ ID NO: 77602

SEQ ID NO: 421944 - RNA, 64 nt, hsa; identical to SEQ ID NO: 77603

SEQ ID NO: 421945 - RNA, 64 nt, hsa; identical to SEQ ID NO: 77604

SEQ ID NO: 421946 - RNA, 64 nt, hsa; identical to SEQ ID NO: 77605

SEQ ID NO: 421947 - RNA, 64 nt, hsa; identical to SEQ ID NO: 77606

SEQ ID NO: 421948 - RNA, 64 nt, hsa; identical to SEQ ID NO: 77607

SEQ ID NO: 421949 - RNA, 64 nt, hsa; identical to SEQ ID NO: 77608

SEQ ID NO: 421950 - RNA, 64 nt, hsa; identical to SEQ ID NO: 77609

SEQ ID NO: 421951 - RNA, 64 nt, hsa; identical to SEQ ID NO: 77610

SEQ ID NO: 421952 - RNA, 64 nt, hsa; identical to SEQ ID NO: 77611

SEQ ID NO: 421953 - RNA, 64 nt, hsa; identical to SEQ ID NO: 77612

SEQ ID NO: 421954 - RNA, 64 nt, hsa; identical to SEQ ID NO: 77613

SEQ ID NO: 421955 - RNA, 64 nt, hsa; identical to SEQ ID NO: 77614

SEQ ID NO: 421956 - RNA, 64 nt, hsa; identical to SEQ ID NO: 77615

SEQ ID NO: 421957 - RNA, 64 nt, hsa; identical to SEQ ID NO: 77616

SEQ ID NO: 421958 - RNA, 64 nt, hsa; identical to SEQ ID NO: 77617

SEQ ID NO: 421959 - RNA, 64 nt, hsa; identical to SEQ ID NO: 77618

SEQ ID NO: 421960 - RNA, 64 nt, hsa; identical to SEQ ID NO: 77619

SEQ ID NO: 421961 - RNA, 64 nt, hsa; identical to SEQ ID NO: 77620

SEQ ID NO: 421962 - RNA, 64 nt, hsa; identical to SEQ ID NO: 77621

SEQ ID NO: 421963 - RNA, 64 nt, hsa; identical to SEQ ID NO: 77622

SEQ ID NO: 421964 - RNA, 64 nt, hsa; identical to SEQ ID NO: 77623

SEQ ID NO: 421965 - RNA, 64 nt, hsa; identical to SEQ ID NO: 77624

SEQ ID NO: 421966 - RNA, 64 nt, hsa; identical to SEQ ID NO: 77625

SEQ ID NO: 421967 - RNA, 64 nt, hsa; identical to SEQ ID NO: 77626

SEQ ID NO: 421968 - RNA, 64 nt, hsa; identical to SEQ ID NO: 77627

SEQ ID NO: 421969 - RNA, 64 nt, hsa; identical to SEQ ID NO: 77628

SEQ ID NO: 421970 - RNA, 64 nt, hsa; identical to SEQ ID NO: 77629

SEQ ID NO: 421971 - RNA, 64 nt, hsa; identical to SEQ ID NO: 77630

SEQ ID NO: 421972 - RNA, 64 nt, hsa; identical to SEQ ID NO: 77631

SEQ ID NO: 421973 - RNA, 64 nt, hsa; identical to SEQ ID NO: 77632

SEQ ID NO: 421974 - RNA, 64 nt, hsa; identical to SEQ ID NO: 77633

SEQ ID NO: 421975 - RNA, 64 nt, hsa; identical to SEQ ID NO: 77634

SEQ ID NO: 421976 - RNA, 64 nt, hsa; identical to SEQ ID NO: 77635

SEQ ID NO: 421977 - RNA, 64 nt, hsa; identical to SEQ ID NO: 77636

SEQ ID NO: 421978 - RNA, 64 nt, hsa; identical to SEQ ID NO: 77637

SEQ ID NO: 421979 - RNA, 64 nt, hsa; identical to SEQ ID NO: 77638

SEQ ID NO: 421980 - RNA, 64 nt, hsa; identical to SEQ ID NO: 77639

SEQ ID NO: 421981 - RNA, 64 nt, hsa; identical to SEQ ID NO: 77640

SEQ ID NO: 421982 - RNA, 64 nt, hsa; identical to SEQ ID NO: 77641

SEQ ID NO: 421983 - RNA, 64 nt, hsa; identical to SEQ ID NO: 77642

SEQ ID NO: 421984 - RNA, 64 nt, hsa; identical to SEQ ID NO: 77643

SEQ ID NO: 421985 - RNA, 64 nt, hsa; identical to SEQ ID NO: 77644

SEQ ID NO: 421986 - RNA, 64 nt, hsa; identical to SEQ ID NO: 77645

SEQ ID NO: 421987 - RNA, 64 nt, hsa; identical to SEQ ID NO: 77646

SEQ ID NO: 421988 - RNA, 64 nt, hsa; identical to SEQ ID NO: 77647

SEQ ID NO: 421989 - RNA, 64 nt, hsa; identical to SEQ ID NO: 77648

SEQ ID NO: 421990 - RNA, 64 nt, hsa; identical to SEQ ID NO: 77649

SEQ ID NO: 421991 - RNA, 64 nt, hsa; identical to SEQ ID NO: 77650

SEQ ID NO: 421992 - RNA, 64 nt, hsa; identical to SEQ ID NO: 77651

SEQ ID NO: 421993 - RNA, 64 nt, hsa; identical to SEQ ID NO: 77652

SEQ ID NO: 421994 - RNA, 64 nt, hsa; identical to SEQ ID NO: 77653

SEQ ID NO: 421995 - RNA, 64 nt, hsa; identical to SEQ ID NO: 77654

SEQ ID NO: 421996 - RNA, 64 nt, hsa; identical to SEQ ID NO: 77655

SEQ ID NO: 421997 - RNA, 64 nt, hsa; identical to SEQ ID NO: 77656

SEQ ID NO: 421998 - RNA, 64 nt, hsa; identical to SEQ ID NO: 77657

SEQ ID NO: 421999 - RNA, 64 nt, hsa; identical to SEQ ID NO: 77658

SEQ ID NO: 422000 - RNA, 64 nt, hsa; identical to SEQ ID NO: 77659

SEQ ID NO: 422001 - RNA, 64 nt, hsa; identical to SEQ ID NO: 77660

SEQ ID NO: 422002 - RNA, 63 nt, hsa; identical to SEQ ID NO: 77661

SEQ ID NO: 422003 - RNA, 64 nt, hsa; identical to SEQ ID NO: 77662

SEQ ID NO: 422004 - RNA, 64 nt, hsa; identical to SEQ ID NO: 77663

SEQ ID NO: 422005 - RNA, 64 nt, hsa; identical to SEQ ID NO: 77664

SEQ ID NO: 422006 - RNA, 64 nt, hsa; identical to SEQ ID NO: 77665

SEQ ID NO: 422007 - RNA, 64 nt, hsa; identical to SEQ ID NO: 77666

SEQ ID NO: 422008 - RNA, 64 nt, hsa; identical to SEQ ID NO: 77667

SEQ ID NO: 422009 - RNA, 64 nt, hsa; identical to SEQ ID NO: 77668

SEQ ID NO: 422010 - RNA, 64 nt, hsa; identical to SEQ ID NO: 77669

SEQ ID NO: 422011 - RNA, 64 nt, hsa; identical to SEQ ID NO: 77670

SEQ ID NO: 422012 - RNA, 64 nt, hsa; identical to SEQ ID NO: 77671

SEQ ID NO: 422013 - RNA, 64 nt, hsa; identical to SEQ ID NO: 77672

SEQ ID NO: 422014 - RNA, 64 nt, hsa; identical to SEQ ID NO: 77673

SEQ ID NO: 422015 - RNA, 64 nt, hsa; identical to SEQ ID NO: 77674

SEQ ID NO: 422016 - RNA, 64 nt, hsa; identical to SEQ ID NO: 77675

SEQ ID NO: 422017 - RNA, 64 nt, hsa; identical to SEQ ID NO: 77676

SEQ ID NO: 422018 - RNA, 64 nt, hsa; identical to SEQ ID NO: 77677

SEQ ID NO: 422019 - RNA, 64 nt, hsa; identical to SEQ ID NO: 77678

SEQ ID NO: 422020 - RNA, 64 nt, hsa; identical to SEQ ID NO: 77679

SEQ ID NO: 422021 - RNA, 64 nt, hsa; identical to SEQ ID NO: 77680

SEQ ID NO: 422022 - RNA, 64 nt, hsa; identical to SEQ ID NO: 77681

SEQ ID NO: 422023 - RNA, 64 nt, hsa; identical to SEQ ID NO: 77682

SEQ ID NO: 422024 - RNA, 64 nt, hsa; identical to SEQ ID NO: 77683

SEQ ID NO: 422025 - RNA, 57 nt, hsa; identical to SEQ ID NO: 77684

SEQ ID NO: 422026 - RNA, 64 nt, hsa; identical to SEQ ID NO: 77685

SEQ ID NO: 422027 - RNA, 64 nt, hsa; identical to SEQ ID NO: 77686

SEQ ID NO: 422028 - RNA, 64 nt, hsa; identical to SEQ ID NO: 77687

SEQ ID NO: 422029 - RNA, 64 nt, hsa; identical to SEQ ID NO: 77688

SEQ ID NO: 422030 - RNA, 64 nt, hsa; identical to SEQ ID NO: 77689

SEQ ID NO: 422031 - RNA, 64 nt, hsa; identical to SEQ ID NO: 77690

SEQ ID NO: 422032 - RNA, 64 nt, hsa; identical to SEQ ID NO: 77691

SEQ ID NO: 422033 - RNA, 64 nt, hsa; identical to SEQ ID NO: 77692

SEQ ID NO: 422034 - RNA, 64 nt, hsa; identical to SEQ ID NO: 77693

SEQ ID NO: 422035 - RNA, 64 nt, hsa; identical to SEQ ID NO: 77694

SEQ ID NO: 422036 - RNA, 64 nt, hsa; identical to SEQ ID NO: 77695

SEQ ID NO: 422037 - RNA, 64 nt, hsa; identical to SEQ ID NO: 77696

SEQ ID NO: 422038 - RNA, 64 nt, hsa; identical to SEQ ID NO: 77697

SEQ ID NO: 422039 - RNA, 64 nt, hsa; identical to SEQ ID NO: 77698

SEQ ID NO: 422040 - RNA, 64 nt, hsa; identical to SEQ ID NO: 77699

SEQ ID NO: 422041 - RNA, 64 nt, hsa; identical to SEQ ID NO: 77700

SEQ ID NO: 422042 - RNA, 64 nt, hsa; identical to SEQ ID NO: 77701

SEQ ID NO: 422043 - RNA, 64 nt, hsa; identical to SEQ ID NO: 77702

SEQ ID NO: 422044 - RNA, 63 nt, hsa; identical to SEQ ID NO: 77703

SEQ ID NO: 422045 - RNA, 64 nt, hsa; identical to SEQ ID NO: 77704

SEQ ID NO: 422046 - RNA, 64 nt, hsa; identical to SEQ ID NO: 77705

SEQ ID NO: 422047 - RNA, 64 nt, hsa; identical to SEQ ID NO: 77706

SEQ ID NO: 422048 - RNA, 64 nt, hsa; identical to SEQ ID NO: 77707

SEQ ID NO: 422049 - RNA, 64 nt, hsa; identical to SEQ ID NO: 77708

SEQ ID NO: 422050 - RNA, 64 nt, hsa; identical to SEQ ID NO: 77709

SEQ ID NO: 422051 - RNA, 64 nt, hsa; identical to SEQ ID NO: 77710

SEQ ID NO: 422052 - RNA, 64 nt, hsa; identical to SEQ ID NO: 77711

SEQ ID NO: 422053 - RNA, 64 nt, hsa; identical to SEQ ID NO: 77712

SEQ ID NO: 422054 - RNA, 64 nt, hsa; identical to SEQ ID NO: 77713

SEQ ID NO: 422055 - RNA, 64 nt, hsa; identical to SEQ ID NO: 77714

SEQ ID NO: 422056 - RNA, 64 nt, hsa; identical to SEQ ID NO: 77715

SEQ ID NO: 422057 - RNA, 64 nt, hsa; identical to SEQ ID NO: 77716

SEQ ID NO: 422058 - RNA, 64 nt, hsa; identical to SEQ ID NO: 77717

SEQ ID NO: 422059 - RNA, 64 nt, hsa; identical to SEQ ID NO: 77718

SEQ ID NO: 422060 - RNA, 64 nt, hsa; identical to SEQ ID NO: 77719

SEQ ID NO: 422061 - RNA, 64 nt, hsa; identical to SEQ ID NO: 77720

SEQ ID NO: 422062 - RNA, 64 nt, hsa; identical to SEQ ID NO: 77721

SEQ ID NO: 422063 - RNA, 64 nt, hsa; identical to SEQ ID NO: 77722

SEQ ID NO: 422064 - RNA, 64 nt, hsa; identical to SEQ ID NO: 77723

SEQ ID NO: 422065 - RNA, 64 nt, hsa; identical to SEQ ID NO: 77724

SEQ ID NO: 422066 - RNA, 64 nt, hsa; identical to SEQ ID NO: 77725

SEQ ID NO: 422067 - RNA, 64 nt, hsa; identical to SEQ ID NO: 77726

SEQ ID NO: 422068 - RNA, 64 nt, hsa; identical to SEQ ID NO: 77727

SEQ ID NO: 422069 - RNA, 64 nt, hsa; identical to SEQ ID NO: 77728

SEQ ID NO: 422070 - RNA, 64 nt, hsa; identical to SEQ ID NO: 77729

SEQ ID NO: 422071 - RNA, 64 nt, hsa; identical to SEQ ID NO: 77730

SEQ ID NO: 422072 - RNA, 64 nt, hsa; identical to SEQ ID NO: 77731

SEQ ID NO: 422073 - RNA, 64 nt, hsa; identical to SEQ ID NO: 77732

SEQ ID NO: 422074 - RNA, 64 nt, hsa; identical to SEQ ID NO: 77733

SEQ ID NO: 422075 - RNA, 64 nt, hsa; identical to SEQ ID NO: 77734

SEQ ID NO: 422076 - RNA, 64 nt, hsa; identical to SEQ ID NO: 77735

SEQ ID NO: 422077 - RNA, 50 nt, hsa; identical to SEQ ID NO: 77736

SEQ ID NO: 422078 - RNA, 64 nt, hsa; identical to SEQ ID NO: 77737

SEQ ID NO: 422079 - RNA, 64 nt, hsa; identical to SEQ ID NO: 77738

SEQ ID NO: 422080 - RNA, 64 nt, hsa; identical to SEQ ID NO: 77739

SEQ ID NO: 422081 - RNA, 64 nt, hsa; identical to SEQ ID NO: 77740

SEQ ID NO: 422082 - RNA, 64 nt, hsa; identical to SEQ ID NO: 77741

SEQ ID NO: 422083 - RNA, 64 nt, hsa; identical to SEQ ID NO: 77742

SEQ ID NO: 422084 - RNA, 64 nt, hsa; identical to SEQ ID NO: 77743

SEQ ID NO: 422085 - RNA, 64 nt, hsa; identical to SEQ ID NO: 77744

SEQ ID NO: 422086 - RNA, 64 nt, hsa
augaguuugauuucuuuugcuauuucauugcucuagcuaggacagccaguauugauugaauaga

SEQ ID NO: 422087 - RNA, 64 nt, hsa
uguauuuuuaguagagacuggguuucaccguguuagcuaggauggucucgaucuucuguccuua

SEQ ID NO: 422088 - RNA, 64 nt, hsa
acuaucuucaucugagagaggcuaaaauguuuucagcuaggaacaaaucuuccuggucgaaagu

SEQ ID NO: 422089 - RNA, 64 nt, hsa
gcaauccuuacaaaugauugcuuuuaaaauuuuaagcuaggaaaagaaaucuauagaaaguguu

SEQ ID NO: 422090 - RNA, 64 nt, hsa
uucccuuaaucagugaaggacaacccuuauuuauuaccuagagcaguuguauaauucgcuguua

SEQ ID NO: 422091 - RNA, 64 nt, hsa
uauguuaugcuuuguaaauuuuuuuuuuugcuuuuaccuagauaaacuucuagcuaaucaaaua

SEQ ID NO: 422092 - RNA, 64 nt, hsa
ccuaugaguguagagcccauauccccauagagucuaccuagagcaggggucgccaaauguuuuc

SEQ ID NO: 422093 - RNA, 64 nt, hsa
gugaaugccggcagcugugccaauaggaaaaagcuaccuagacuaggcauguccaaaauggcgg

SEQ ID NO: 422094 - RNA, 64 nt, hsa; identical to SEQ ID NO: 284748

SEQ ID NO: 422095 - RNA, 64 nt, hsa; identical to SEQ ID NO: 284749

SEQ ID NO: 422096 - RNA, 64 nt, hsa; identical to SEQ ID NO: 284750

SEQ ID NO: 422097 - RNA, 64 nt, hsa; identical to SEQ ID NO: 284751

SEQ ID NO: 422098 - RNA, 64 nt, hsa; identical to SEQ ID NO: 284752

SEQ ID NO: 422099 - RNA, 64 nt, hsa; identical to SEQ ID NO: 284753

SEQ ID NO: 422100 - RNA, 64 nt, hsa; identical to SEQ ID NO: 284754

SEQ ID NO: 422101 - RNA, 64 nt, hsa; identical to SEQ ID NO: 284755

SEQ ID NO: 422102 - RNA, 64 nt, hsa; identical to SEQ ID NO: 284756

SEQ ID NO: 422103 - RNA, 64 nt, hsa; identical to SEQ ID NO: 284757

SEQ ID NO: 422104 - RNA, 64 nt, hsa; identical to SEQ ID NO: 284758

SEQ ID NO: 422105 - RNA, 64 nt, hsa; identical to SEQ ID NO: 284759

SEQ ID NO: 422106 - RNA, 64 nt, hsa; identical to SEQ ID NO: 284760

SEQ ID NO: 422107 - RNA, 64 nt, hsa; identical to SEQ ID NO: 284761

SEQ ID NO: 422108 - RNA, 64 nt, hsa; identical to SEQ ID NO: 284762

SEQ ID NO: 422109 - RNA, 64 nt, hsa; identical to SEQ ID NO: 284763

SEQ ID NO: 422110 - RNA, 64 nt, hsa; identical to SEQ ID NO: 284764

SEQ ID NO: 422111 - RNA, 64 nt, hsa; identical to SEQ ID NO: 284765

SEQ ID NO: 422112 - RNA, 64 nt, hsa; identical to SEQ ID NO: 284766

SEQ ID NO: 422113 - RNA, 64 nt, hsa; identical to SEQ ID NO: 284767

SEQ ID NO: 422114 - RNA, 64 nt, hsa; identical to SEQ ID NO: 284768

SEQ ID NO: 422115 - RNA, 64 nt, hsa; identical to SEQ ID NO: 284769

SEQ ID NO: 422116 - RNA, 64 nt, hsa; identical to SEQ ID NO: 284770

SEQ ID NO: 422117 - RNA, 64 nt, hsa; identical to SEQ ID NO: 284771

SEQ ID NO: 422118 - RNA, 64 nt, hsa; identical to SEQ ID NO: 284772

SEQ ID NO: 422119 - RNA, 64 nt, hsa; identical to SEQ ID NO: 284773

SEQ ID NO: 422120 - RNA, 64 nt, hsa; identical to SEQ ID NO: 284774

SEQ ID NO: 422121 - RNA, 64 nt, hsa; identical to SEQ ID NO: 284775

SEQ ID NO: 422122 - RNA, 64 nt, hsa; identical to SEQ ID NO: 284776

SEQ ID NO: 422123 - RNA, 64 nt, hsa; identical to SEQ ID NO: 284777

SEQ ID NO: 422124 - RNA, 64 nt, hsa; identical to SEQ ID NO: 284778

SEQ ID NO: 422125 - RNA, 64 nt, hsa; identical to SEQ ID NO: 284779

SEQ ID NO: 422126 - RNA, 64 nt, hsa; identical to SEQ ID NO: 284780

SEQ ID NO: 422127 - RNA, 64 nt, hsa; identical to SEQ ID NO: 284781

SEQ ID NO: 422128 - RNA, 64 nt, hsa; identical to SEQ ID NO: 284782

SEQ ID NO: 422129 - RNA, 64 nt, hsa; identical to SEQ ID NO: 284783

SEQ ID NO: 422130 - RNA, 64 nt, hsa; identical to SEQ ID NO: 284784

SEQ ID NO: 422131 - RNA, 64 nt, hsa; identical to SEQ ID NO: 284785

SEQ ID NO: 422132 - RNA, 64 nt, hsa; identical to SEQ ID NO: 284786

SEQ ID NO: 422133 - RNA, 64 nt, hsa; identical to SEQ ID NO: 284787

SEQ ID NO: 422134 - RNA, 64 nt, hsa; identical to SEQ ID NO: 284788

SEQ ID NO: 422135 - RNA, 64 nt, hsa; identical to SEQ ID NO: 284789

SEQ ID NO: 422136 - RNA, 64 nt, hsa; identical to SEQ ID NO: 284790

SEQ ID NO: 422137 - RNA, 64 nt, hsa; identical to SEQ ID NO: 284791

SEQ ID NO: 422138 - RNA, 64 nt, hsa; identical to SEQ ID NO: 284792

SEQ ID NO: 422139 - RNA, 64 nt, hsa; identical to SEQ ID NO: 284793

SEQ ID NO: 422140 - RNA, 64 nt, hsa; identical to SEQ ID NO: 284794

SEQ ID NO: 422141 - RNA, 64 nt, hsa; identical to SEQ ID NO: 284795

SEQ ID NO: 422142 - RNA, 64 nt, hsa; identical to SEQ ID NO: 284796

SEQ ID NO: 422143 - RNA, 64 nt, hsa; identical to SEQ ID NO: 284797

SEQ ID NO: 422144 - RNA, 64 nt, hsa; identical to SEQ ID NO: 284798

SEQ ID NO: 422145 - RNA, 64 nt, hsa; identical to SEQ ID NO: 284799

SEQ ID NO: 422146 - RNA, 64 nt, hsa; identical to SEQ ID NO: 284800

SEQ ID NO: 422147 - RNA, 64 nt, hsa; identical to SEQ ID NO: 284801

SEQ ID NO: 422148 - RNA, 64 nt, hsa; identical to SEQ ID NO: 284802

SEQ ID NO: 422149 - RNA, 64 nt, hsa; identical to SEQ ID NO: 284803

SEQ ID NO: 422150 - RNA, 64 nt, hsa; identical to SEQ ID NO: 284804

SEQ ID NO: 422151 - RNA, 64 nt, hsa; identical to SEQ ID NO: 284805

SEQ ID NO: 422152 - RNA, 64 nt, hsa; identical to SEQ ID NO: 284806

SEQ ID NO: 422153 - RNA, 64 nt, hsa; identical to SEQ ID NO: 284807

SEQ ID NO: 422154 - RNA, 64 nt, hsa; identical to SEQ ID NO: 284808

SEQ ID NO: 422155 - RNA, 64 nt, hsa; identical to SEQ ID NO: 284809

SEQ ID NO: 422156 - RNA, 64 nt, hsa; identical to SEQ ID NO: 284810

SEQ ID NO: 422157 - RNA, 64 nt, hsa; identical to SEQ ID NO: 284811

SEQ ID NO: 422158 - RNA, 64 nt, hsa; identical to SEQ ID NO: 284812

SEQ ID NO: 422159 - RNA, 64 nt, hsa; identical to SEQ ID NO: 284813

SEQ ID NO: 422160 - RNA, 64 nt, hsa; identical to SEQ ID NO: 284814

SEQ ID NO: 422161 - RNA, 64 nt, hsa; identical to SEQ ID NO: 284815

SEQ ID NO: 422162 - RNA, 64 nt, hsa; identical to SEQ ID NO: 284816

SEQ ID NO: 422163 - RNA, 64 nt, hsa; identical to SEQ ID NO: 284817

SEQ ID NO: 422164 - RNA, 64 nt, hsa; identical to SEQ ID NO: 284818

SEQ ID NO: 422165 - RNA, 64 nt, hsa; identical to SEQ ID NO: 284819

SEQ ID NO: 422166 - RNA, 64 nt, hsa; identical to SEQ ID NO: 284820

SEQ ID NO: 422167 - RNA, 64 nt, hsa; identical to SEQ ID NO: 284821

SEQ ID NO: 422168 - RNA, 64 nt, hsa; identical to SEQ ID NO: 284822

SEQ ID NO: 422169 - RNA, 64 nt, hsa; identical to SEQ ID NO: 284823

SEQ ID NO: 422170 - RNA, 64 nt, hsa; identical to SEQ ID NO: 284824

SEQ ID NO: 422171 - RNA, 57 nt, hsa; identical to SEQ ID NO: 284825

SEQ ID NO: 422172 - RNA, 52 nt, hsa; identical to SEQ ID NO: 284826

SEQ ID NO: 422173 - RNA, 64 nt, hsa; identical to SEQ ID NO: 284827

SEQ ID NO: 422174 - RNA, 64 nt, hsa; identical to SEQ ID NO: 284828

SEQ ID NO: 422175 - RNA, 64 nt, hsa; identical to SEQ ID NO: 284829

SEQ ID NO: 422176 - RNA, 64 nt, hsa; identical to SEQ ID NO: 284830

SEQ ID NO: 422177 - RNA, 64 nt, hsa; identical to SEQ ID NO: 284831

SEQ ID NO: 422178 - RNA, 64 nt, hsa; identical to SEQ ID NO: 284832

SEQ ID NO: 422179 - RNA, 64 nt, hsa; identical to SEQ ID NO: 284833

SEQ ID NO: 422180 - RNA, 64 nt, hsa; identical to SEQ ID NO: 284834

SEQ ID NO: 422181 - RNA, 64 nt, hsa; identical to SEQ ID NO: 284835

SEQ ID NO: 422182 - RNA, 64 nt, hsa; identical to SEQ ID NO: 284836

SEQ ID NO: 422183 - RNA, 64 nt, hsa; identical to SEQ ID NO: 284837

SEQ ID NO: 422184 - RNA, 64 nt, hsa; identical to SEQ ID NO: 284838

SEQ ID NO: 422185 - RNA, 64 nt, hsa; identical to SEQ ID NO: 284839

SEQ ID NO: 422186 - RNA, 64 nt, hsa; identical to SEQ ID NO: 284840

SEQ ID NO: 422187 - RNA, 64 nt, hsa; identical to SEQ ID NO: 361679

SEQ ID NO: 422188 - RNA, 64 nt, hsa; identical to SEQ ID NO: 361680

SEQ ID NO: 422189 - RNA, 64 nt, hsa; identical to SEQ ID NO: 361681

SEQ ID NO: 422190 - RNA, 64 nt, hsa; identical to SEQ ID NO: 361682

SEQ ID NO: 422191 - RNA, 64 nt, hsa; identical to SEQ ID NO: 361683

SEQ ID NO: 422192 - RNA, 64 nt, hsa; identical to SEQ ID NO: 361684

SEQ ID NO: 422193 - RNA, 64 nt, hsa; identical to SEQ ID NO: 361685

SEQ ID NO: 422194 - RNA, 64 nt, hsa; identical to SEQ ID NO: 361686

SEQ ID NO: 422195 - RNA, 64 nt, hsa
augaaaccacgcugcgcuuccgaugcccccgcuugccguguaaugguucagcuaaucccauggc

SEQ ID NO: 422196 - RNA, 64 nt, hsa
aggguauuccagaguggggauaugauuuaaaucagccguguaaccauggacccaauauuuacca

SEQ ID NO: 422197 - RNA, 64 nt, hsa
aaacaaaacuagcagaauguuuuuaaaacuuuuugccguguaugaggagugcuagaaaaugcaa

SEQ ID NO: 422198 - RNA, 64 nt, hsa
agucuacuuguuacuauccaucuccaggcucugggccguguagacacuaaaccucaugcccuaa

SEQ ID NO: 422199 - RNA, 64 nt, hsa
ccuuagaugcccaucuggacgugaugccgcgccugccguguaagaaggugcaauccuagauaac

SEQ ID NO: 422200 - RNA, 64 nt, hsa
gggggccaugggccuugugggaggauaucuuuuggccguguacccucagguccagugcuugguc

SEQ ID NO: 422201 - RNA, 64 nt, hsa
auagaggcaacucccaggccagugagcuuuacuugccguguaaaaggaggaaagggguggaaaa

SEQ ID NO: 422202 - RNA, 64 nt, hsa
ugauauuuucacagauggaagaaguuuuaacuaugccguguaguuucugguaucguucgcuugu

SEQ ID NO: 422203 - RNA, 64 nt, hsa
auccacucacguucauaaagagaauguugauggcgccguguagaagccgcucuguauccaucca

SEQ ID NO: 422204 - RNA, 64 nt, hsa
uaaacuuuuuuuugccauccauccugugcaauaugccguguagaauauuugucuuaaaauucaa

SEQ ID NO: 422205 - RNA, 64 nt, hsa
gcaugcuacaauccaggacugugguguucuaugugccguguauggucauauuaguagcuauuug

SEQ ID NO: 422206 - RNA, 64 nt, hsa
cccgggcacugucgcgcuugcugcaggcggcccagccguguauuuauuuuucaccuaucuccuu

SEQ ID NO: 422207 - RNA, 64 nt, hsa
cacauucuaacugugcaaaauuaucuuggccuuggccguguaaugugagguuuaccugauucuc

SEQ ID NO: 422208 - RNA, 64 nt, hsa
gccuaggcaaacuacuaacaugcauugugagaaugccguguauaccucacguacuguguacuuu

SEQ ID NO: 422209 - RNA, 64 nt, hsa
cacuggggggcugugacagcagcugggccaggaggccguguaaugaccacacacuccucucaag

SEQ ID NO: 422210 - RNA, 64 nt, hsa
cagcacugcugcugcccugaggggaaacgccugggccguguaguggggacgcucugggaauggu

SEQ ID NO: 422211 - RNA, 64 nt, hsa
gcccagaagagaggccgggcugcugcagaaccccgccguguaaagaggcagaaaaguugguuug

SEQ ID NO: 422212 - RNA, 64 nt, hsa
aauuuauuuccaggaagguguguggaagacaugagccguguauaauauuuuuuuuaacauuuuc

SEQ ID NO: 422213 - RNA, 64 nt, hsa
ugcuccucugggcucuugaguugcugcuugaauugccguguagacauuugcuuggagaguccac

SEQ ID NO: 422214 - RNA, 64 nt, hsa
aucuaucuaucuaucuauauaacuauaaccacacgccguguagacacccgcugccacacacuac

SEQ ID NO: 422215 - RNA, 64 nt, hsa
uuaagcuaacaaagaucauaauuuucaaugauuagccguguaacuccugcaaugaauguuuaug

SEQ ID NO: 422216 - RNA, 64 nt, hsa
gcagguauggaucacauaggaugcgauaccuguggccguguauguccacaugugugccuguaga

SEQ ID NO: 422217 - RNA, 64 nt, hsa
ccagcccaccacagccacuguagaccacaggcaggccguguacugcaccacugggaggacgugg

SEQ ID NO: 422218 - RNA, 64 nt, hsa
guacuacucaguaugcaccacagaauaagaguuugccguguaaagacaauauccccauucguca

SEQ ID NO: 422219 - RNA, 64 nt, hsa
caguauuaaugguguaacuuuguuggcaauauuugccguguagaauuuuuuuuagauauccauu

SEQ ID NO: 422220 - RNA, 64 nt, hsa
gggucccuccguggggggcugggugcggcccccugccguguauuuccuccccagggaguggggc

SEQ ID NO: 422221 - RNA, 64 nt, hsa
uuuauauuaaaaggggccuccuuuuuaaauauaugccguguaaaaaauguacuuauaggaacau

SEQ ID NO: 422222 - RNA, 64 nt, hsa
gggguggguguaagggugaggugggggugugugugccguguauguguguagggguguggugggg

SEQ ID NO: 422223 - RNA, 64 nt, hsa
ccuguggcuuuguuuucuuaguuacuuuuuccgugccguguauuuuuuaauugauuuuucuucu

SEQ ID NO: 422224 - RNA, 64 nt, hsa
caagccugaguguuaauuuaacucuauguuguccgccguguagacauccgaggucauuuguugc

SEQ ID NO: 422225 - RNA, 64 nt, hsa
ggagggggugccgaggcuacgcauguccucgagggccguguacacucuccaggcaccaugggcg

SEQ ID NO: 422226 - RNA, 64 nt, hsa
uucugcccaccccuuccguugucacgagugccgugccguguaauaaagucccagugcucaucca

SEQ ID NO: 422227 - RNA, 64 nt, hsa
gacaaaucaaaauacggaugacaaagaggauauagccguguauaccccagggagaggaggcgcc

SEQ ID NO: 422228 - RNA, 64 nt, hsa
cugccugcguugcaaacugggcuuuguagcgucugccguguaacacccuuccucugaucgcacc

SEQ ID NO: 422229 - RNA, 64 nt, hsa
ccugcugugggcuuggugcaccgucaacaccagagccguguaccugaggcccaggcagcgggaa

SEQ ID NO: 422230 - RNA, 64 nt, hsa
cagugauaaagcgugcaccgugcagcccgccauggccguguagacccuaacccggagggaaccc

SEQ ID NO: 422231 - RNA, 64 nt, hsa
cagguuuggguacaaguggcaaccugcuuccauggccguguagaagcauggugcccuggcuucu

SEQ ID NO: 422232 - RNA, 64 nt, hsa
gaacguuuuaccgaaguguugugacucaauaauugccguguaguucaucaaaaccuacauauua

SEQ ID NO: 422233 - RNA, 64 nt, hsa; identical to SEQ ID NO: 381884

SEQ ID NO: 422234 - RNA, 64 nt, hsa; identical to SEQ ID NO: 381885

SEQ ID NO: 422235 - RNA, 64 nt, hsa; identical to SEQ ID NO: 381886

SEQ ID NO: 422236 - RNA, 64 nt, hsa; identical to SEQ ID NO: 381887

SEQ ID NO: 422237 - RNA, 64 nt, hsa; identical to SEQ ID NO: 381888

SEQ ID NO: 422238 - RNA, 64 nt, hsa; identical to SEQ ID NO: 381889

SEQ ID NO: 422239 - RNA, 64 nt, hsa; identical to SEQ ID NO: 381890

SEQ ID NO: 422240 - RNA, 64 nt, hsa; identical to SEQ ID NO: 381891

SEQ ID NO: 422241 - RNA, 59 nt, hsa; identical to SEQ ID NO: 381892

SEQ ID NO: 422242 - RNA, 64 nt, hsa; identical to SEQ ID NO: 381893

SEQ ID NO: 422243 - RNA, 64 nt, hsa; identical to SEQ ID NO: 381894

SEQ ID NO: 422244 - RNA, 64 nt, hsa; identical to SEQ ID NO: 381895

SEQ ID NO: 422245 - RNA, 64 nt, hsa; identical to SEQ ID NO: 381896

SEQ ID NO: 422246 - RNA, 64 nt, hsa; identical to SEQ ID NO: 381897

SEQ ID NO: 422247 - RNA, 64 nt, hsa; identical to SEQ ID NO: 381898

SEQ ID NO: 422248 - RNA, 64 nt, hsa; identical to SEQ ID NO: 381899

SEQ ID NO: 422249 - RNA, 64 nt, hsa; identical to SEQ ID NO: 381900

SEQ ID NO: 422250 - RNA, 64 nt, hsa; identical to SEQ ID NO: 381901

SEQ ID NO: 422251 - RNA, 64 nt, hsa; identical to SEQ ID NO: 381902

SEQ ID NO: 422252 - RNA, 64 nt, hsa; identical to SEQ ID NO: 381903

SEQ ID NO: 422253 - RNA, 64 nt, hsa; identical to SEQ ID NO: 381904

SEQ ID NO: 422254 - RNA, 64 nt, hsa; identical to SEQ ID NO: 381905

SEQ ID NO: 422255 - RNA, 64 nt, hsa; identical to SEQ ID NO: 381906

SEQ ID NO: 422256 - RNA, 64 nt, hsa; identical to SEQ ID NO: 381907

SEQ ID NO: 422257 - RNA, 64 nt, hsa; identical to SEQ ID NO: 381908

SEQ ID NO: 422258 - RNA, 64 nt, hsa; identical to SEQ ID NO: 381909

SEQ ID NO: 422259 - RNA, 64 nt, hsa; identical to SEQ ID NO: 381910

SEQ ID NO: 422260 - RNA, 64 nt, hsa; identical to SEQ ID NO: 381911

SEQ ID NO: 422261 - RNA, 64 nt, hsa; identical to SEQ ID NO: 381912

SEQ ID NO: 422262 - RNA, 64 nt, hsa; identical to SEQ ID NO: 381913

SEQ ID NO: 422263 - RNA, 64 nt, hsa; identical to SEQ ID NO: 381914

SEQ ID NO: 422264 - RNA, 64 nt, hsa; identical to SEQ ID NO: 381915

SEQ ID NO: 422265 - RNA, 64 nt, hsa; identical to SEQ ID NO: 381916

SEQ ID NO: 422266 - RNA, 64 nt, hsa; identical to SEQ ID NO: 381917

SEQ ID NO: 422267 - RNA, 64 nt, hsa; identical to SEQ ID NO: 381918

SEQ ID NO: 422268 - RNA, 64 nt, hsa; identical to SEQ ID NO: 381919

SEQ ID NO: 422269 - RNA, 64 nt, hsa; identical to SEQ ID NO: 381920

SEQ ID NO: 422270 - RNA, 64 nt, hsa; identical to SEQ ID NO: 381921

SEQ ID NO: 422271 - RNA, 64 nt, hsa; identical to SEQ ID NO: 381922

SEQ ID NO: 422272 - RNA, 64 nt, hsa; identical to SEQ ID NO: 381923

SEQ ID NO: 422273 - RNA, 64 nt, hsa; identical to SEQ ID NO: 381924

SEQ ID NO: 422274 - RNA, 64 nt, hsa; identical to SEQ ID NO: 381925

SEQ ID NO: 422275 - RNA, 64 nt, hsa; identical to SEQ ID NO: 381926

SEQ ID NO: 422276 - RNA, 64 nt, hsa; identical to SEQ ID NO: 381927

SEQ ID NO: 422277 - RNA, 64 nt, hsa; identical to SEQ ID NO: 381928

SEQ ID NO: 422278 - RNA, 64 nt, hsa; identical to SEQ ID NO: 281120

SEQ ID NO: 422279 - RNA, 64 nt, hsa; identical to SEQ ID NO: 281120

SEQ ID NO: 422280 - RNA, 64 nt, hsa; identical to SEQ ID NO: 281122

SEQ ID NO: 422281 - RNA, 64 nt, hsa; identical to SEQ ID NO: 281123

SEQ ID NO: 422282 - RNA, 64 nt, hsa; identical to SEQ ID NO: 281124

SEQ ID NO: 422283 - RNA, 64 nt, hsa; identical to SEQ ID NO: 281125

SEQ ID NO: 422284 - RNA, 64 nt, hsa; identical to SEQ ID NO: 281126

SEQ ID NO: 422285 - RNA, 64 nt, hsa; identical to SEQ ID NO: 281127

SEQ ID NO: 422286 - RNA, 64 nt, hsa; identical to SEQ ID NO: 281128

SEQ ID NO: 422287 - RNA, 64 nt, hsa; identical to SEQ ID NO: 281129

SEQ ID NO: 422288 - RNA, 64 nt, hsa; identical to SEQ ID NO: 281130

SEQ ID NO: 422289 - RNA, 64 nt, hsa; identical to SEQ ID NO: 281131

SEQ ID NO: 422290 - RNA, 64 nt, hsa; identical to SEQ ID NO: 281132

SEQ ID NO: 422291 - RNA, 64 nt, hsa; identical to SEQ ID NO: 281133

SEQ ID NO: 422292 - RNA, 64 nt, hsa; identical to SEQ ID NO: 281134

SEQ ID NO: 422293 - RNA, 64 nt, hsa; identical to SEQ ID NO: 281135

SEQ ID NO: 422294 - RNA, 64 nt, hsa; identical to SEQ ID NO: 281136

SEQ ID NO: 422295 - RNA, 64 nt, hsa; identical to SEQ ID NO: 281137

SEQ ID NO: 422296 - RNA, 64 nt, hsa; identical to SEQ ID NO: 281138

SEQ ID NO: 422297 - RNA, 64 nt, hsa; identical to SEQ ID NO: 281139

SEQ ID NO: 422298 - RNA, 64 nt, hsa
uaaaagcugggaaaguuaugggaaagagaaugcauagaccuaucuagggucaucauagaagccu

SEQ ID NO: 422299 - RNA, 64 nt, hsa
aaaucaauucaagauggauuaaagacuuaaacguuagaccuaaaaccauaaaaacccuagaaga

SEQ ID NO: 422300 - RNA, 64 nt, hsa
aaauggaagaagaaacagaacuucauggccaaaguagaccuauagauuuugauuggguucuuug

SEQ ID NO: 422301 - RNA, 64 nt, hsa
ccuugcuacccugaggggauguguucaccuuaccuagaccuaguuaggaaguaucauuuuaagc

SEQ ID NO: 422302 - RNA, 58 nt, hsa
uaauaaaaaaaagaaguugaguaaaaaaaaaaaacacacaaaccuguuaguuucaaaa

SEQ ID NO: 422303 - RNA, 58 nt, hsa
caauuuuuaacguuaauugauauaaaaaaaaaaacaacaaaauuaggcuuguaaaacu

SEQ ID NO: 422304 - RNA, 58 nt, hsa
uaacauuuuccccuucuguaguuguaugaaaaaacaaauauuguuagcauaguagaua

SEQ ID NO: 422305 - RNA, 58 nt, hsa
uaaaauuacauuuuuuuuccaggggagaaaaaaacaucaaacaaaaacaucuaaauca

SEQ ID NO: 422306 - RNA, 58 nt, hsa
uaaaacaaaaacaaaaaaccacaaaaauaaaaaacaaaaaaaacaaaaaacccaagaa

SEQ ID NO: 422307 - RNA, 58 nt, hsa
aacaaaaaaccacaaaaauaaaaaacaaaaaaaacaaaaaacccaagaaaaaaaaaaa

SEQ ID NO: 422308 - RNA, 58 nt, hsa
aaguuuugaaaugcugcacuuacauuuaaaaaaacaacaacaacauuuuuucaacaau

SEQ ID NO: 422309 - RNA, 58 nt, hsa
ucaccccaggacucuaaauuauugggguaaaaaacagccuugcaagaaaaaggggagc

SEQ ID NO: 422310 - RNA, 58 nt, hsa
gaggcaggagcccuggggugagaaaagcaaaaaacaaacaaaaaacaaaacccuggag

SEQ ID NO: 422311 - RNA, 58 nt, hsa
ccuggggugagaaaagcaaaaaacaaacaaaaaacaaaacccuggaguguuaggagga

SEQ ID NO: 422312 - RNA, 58 nt, hsa
caccagaagacuugaaaaucuuaaaaaaaaaaaacaaaaaaacaagaaaaggcaacau

SEQ ID NO: 422313 - RNA, 58 nt, hsa
gacuugaaaaucuuaaaaaaaaaaaacaaaaaaacaagaaaaggcaacaucucauuuu

SEQ ID NO: 422314 - RNA, 58 nt, hsa
aaaaaaaaaaaaaaacaaaaaaacaaaaaaaaaacaaaacaguuuuuaaaacugauuu

SEQ ID NO: 422315 - RNA, 58 nt, hsa
aguccugagcaaaaaaaaaaaaaaaacaaaaaaacaaaaaaaaaacaaaacaguuuuu

SEQ ID NO: 422316 - RNA, 58 nt, hsa
aagcaaauaguccugagcaaaaaaaaaaaaaaaacaaaaaaacaaaaaaaaaacaaaa

SEQ ID NO: 422317 - RNA, 58 nt, hsa
aaaaaaaaaaaaacaaaaaacaacaccaaaaaaacagcagugauauauauauauauau

SEQ ID NO: 422318 - RNA, 58 nt, hsa
cacuuuuagauaaaaaaaaaaaaaaaacaaaaaacaacaccaaaaaaacagcagugau

SEQ ID NO: 422319 - RNA, 58 nt, hsa
accugggcacuuuuagauaaaaaaaaaaaaaaaacaaaaaacaacaccaaaaaaacag

SEQ ID NO: 422320 - RNA, 58 nt, hsa
aacaacaacaaaaaacuaagcgauugggaaaaaacaggaauuuuaucugguuauugca

SEQ ID NO: 422321 - RNA, 58 nt, hsa
guucugggucagaaugaucuacucaguuaaaaaacaacaacaacaaaaaacuaagcga

SEQ ID NO: 422322 - RNA, 58 nt, hsa
caguguguuguuaauagucacuacaggcaaaaaacaguaagagcuugcuuuuaaauug

SEQ ID NO: 422323 - RNA, 58 nt, hsa
uacaauaaugcuuagaugcagagagaggaaaaaacagcaacaaagucacauaaaucuu

SEQ ID NO: 422324 - RNA, 58 nt, hsa
cuauucuuuggaaaaaaacaaaaaacaaaaaaaacaacaaaaaaagcuaaguuauaag

SEQ ID NO: 422325 - RNA, 58 nt, hsa
uuuaaggaacuauucuuuggaaaaaaacaaaaaacaaaaaaaacaacaaaaaaagcua

SEQ ID NO: 422326 - RNA, 58 nt, hsa
cauccauuuuaaggaacuauucuuuggaaaaaaacaaaaaacaaaaaaaacaacaaaa

SEQ ID NO: 422327 - RNA, 58 nt, hsa
uuguuugauacucaguaccuguuuuaagaaaaaacaacaaggaaguaaaaccaaagac

SEQ ID NO: 422328 - RNA, 58 nt, hsa
ucaaagaauaucagggccugacauccacaaaaaacaaacuuaauuuugauugaacuaa

SEQ ID NO: 422329 - RNA, 58 nt, hsa
ccugggcaacauagugagaucccaucucaaaaaacauuauuuuuaaaauuagccuggu

SEQ ID NO: 422330 - RNA, 58 nt, hsa
gacagagcaagacgccaucucaaaaacaaaaaaacaaaauucauguuacuaaaagaca

SEQ ID NO: 422331 - RNA, 58 nt, hsa
acuggcugcucuucaucaaaccuacuauaaaaaacauucaaguucaacuguuucuuug

SEQ ID NO: 422332 - RNA, 58 nt, hsa
uggaugacagaguggagacucuguuucaaaaaaacagaaaagaaaauauaguuugauu

SEQ ID NO: 422333 - RNA, 58 nt, hsa
cacuugccuagucuugaagaaaaaaaacaaaaaacaaaaaaaaaccuuguuccuuuau

SEQ ID NO: 422334 - RNA, 58 nt, hsa
acugcuucacuugccuagucuugaagaaaaaaaacaaaaaacaaaaaaaaaccuuguu

SEQ ID NO: 422335 - RNA, 58 nt, hsa
ucgugucauaaaaaaacaaaacaaaacaaaaaaacacuaggaguccacucaacccugg

SEQ ID NO: 422336 - RNA, 58 nt, hsa
cagauccacaucgugcagucgugucauaaaaaaacaaaacaaaacaaaaaaacacuag

SEQ ID NO: 422337 - RNA, 58 nt, hsa
uaucucaaaaaaaaacaaaaaaaaaaacaaaaaacaaagaugagucgcacaucugcug

SEQ ID NO: 422338 - RNA, 58 nt, hsa
gagacucuaucucaaaaaaaaacaaaaaaaaaaacaaaaaacaaagaugagucgcaca

SEQ ID NO: 422339 - RNA, 58 nt, hsa
gggcaacagagcgagacucuaucucaaaaaaaaacaaaaaaaaaaacaaaaaacaaag

SEQ ID NO: 422340 - RNA, 58 nt, hsa
ucuuauuuccuaacauugaauucguuagaaaaaacagcgucaccucacucuucaccug

SEQ ID NO: 422341 - RNA, 58 nt, hsa
caaaaguuagaagucauuuuacaaauuaaaaaaacauuuuuuucuugguagucuuuaa

SEQ ID NO: 422342 - RNA, 58 nt, hsa
cucaaagaaaaaaaaaaugggagugcaaaaaaaacaaagccaaaaaauauaugaagga

SEQ ID NO: 422343 - RNA, 58 nt, hsa
aaacauaauuuuuuuuccuccaaaggugaaaaaacaaugcauucuugcuuuaaaaaaa

SEQ ID NO: 422344 - RNA, 58 nt, hsa
uuuuguauuuuguauuuaacuugcauucaaaaaacaggaucucaguucuccuuucuug

SEQ ID NO: 422345 - RNA, 58 nt, hsa
ucuuccugaaugcucauuaggacuucuuaaaaaacaugaaaguaauuuggaaguaagu

SEQ ID NO: 422346 - RNA, 58 nt, hsa
uuuguugacauguagacuguuuacaaaaaaaaaacacaugguuaaauguuaaauuuua

SEQ ID NO: 422347 - RNA, 58 nt, hsa
aggagucaccuuuuacaugacucaggugaaaaaacaguauaaacauuaauuuacuuug

SEQ ID NO: 422348 - RNA, 58 nt, hsa
gugaaaaaaugaaaauuugcuauuuauuaaaaaacauuaaauuucauuccaaaugaga

SEQ ID NO: 422349 - RNA, 58 nt, hsa
cuaagcaucaucugauuugauauucccuaaaaaacauuuggaauauaugcuaucuaua

SEQ ID NO: 422350 - RNA, 58 nt, hsa
cauuaaacaguuauguuguucuccuugcaaaaaacauguacugacuucccguugagua

SEQ ID NO: 422351 - RNA, 58 nt, hsa
ggggacaaagaaaagcaaaacugaccauaaaaaacaauuaccuggugagaaguugcau

SEQ ID NO: 422352 - RNA, 58 nt, hsa
acagucaaaaccccaccuggagcaaauaaaaaaacauacaaaacguacuggugcuuuc

SEQ ID NO: 422353 - RNA, 58 nt, hsa
guagcgacacaaaguuaaacaaacaaacaaaaaacacaaaacauaauaaaacaccaag

SEQ ID NO: 422354 - RNA, 58 nt, hsa
uguuucucaaaaaagaaaaacaaaaaacaaaaaacaggggccaauaaauucccuaaca

SEQ ID NO: 422355 - RNA, 58 nt, hsa
augcucuuguuucucaaaaaagaaaaacaaaaaacaaaaaacaggggccaauaaauuc

SEQ ID NO: 422356 - RNA, 58 nt, hsa
uacacaccgcucuucagguuguaaaaaaaaaaaacauacauuggggaaagguuuaaga

SEQ ID NO: 422357 - RNA, 58 nt, hsa
aauauaaauguuaagaaaaauuuuuuuuaaaaaacacuucauuauguuuaggggggaa

SEQ ID NO: 422358 - RNA, 58 nt, hsa
agguuuauuuuaguaaaaaaaaaaaaacaaaaaacaaaaacaaaagauuuuuaucaaa

SEQ ID NO: 422359 - RNA, 58 nt, hsa
cccgaacagguuuauuuuaguaaaaaaaaaaaaacaaaaaacaaaaacaaaagauuuu

SEQ ID NO: 422360 - RNA, 58 nt, hsa
ucauuaaaaaaaacgaaaacaaaaacaaaaaaaacacaaaccaucaucacagaagaug

SEQ ID NO: 422361 - RNA, 58 nt, hsa
gacaaaaccacaucagguuuucagaaggaaaaaacauuuaaaaacccaccaucacaug

SEQ ID NO: 422362 - RNA, 58 nt, hsa
aauuuccagaagaggaaaaaaaaacuacaaaaaacaaaacauugaagguugauauuuu

SEQ ID NO: 422363 - RNA, 58 nt, hsa
aggagcuuauggucaaaaagugcaaaaaaaaaaacaaaaaaaaagcaauagauagaga

SEQ ID NO: 422364 - RNA, 58 nt, hsa
auuucaaaggaaaccaaaccuuaaaaaaaaaaaacaaaaacugggcugggucuuccaa

SEQ ID NO: 422365 - RNA, 58 nt, hsa
guucagccucaagucuggcccgucuucgaaaaaacaaacacauuuguaagcuuugugg

SEQ ID NO: 422366 - RNA, 58 nt, hsa
ugggugucucccacaugucuacuauggcaaaaaacauuaccauccccacccauaccac

SEQ ID NO: 422367 - RNA, 58 nt, hsa
agcccucagccccaggccccagcuggagaaaaaacauugcccagggauuaggagcagc

SEQ ID NO: 422368 - RNA, 58 nt, hsa
ugaagucucuuuaugguuagagaagaccaaaaaacaaacaaacaaacuuagaaacaua

SEQ ID NO: 422369 - RNA, 58 nt, hsa
auggugaaaccccgucucuccugaaaaaaaaaaacacaaaaauuagccaggcauggug

SEQ ID NO: 422370 - RNA, 55 nt, hsa
auuuauuguaucccauguaaaaacaaaaaaacaaaaaacaaagaaaagaaagaga

SEQ ID NO: 422371 - RNA, 58 nt, hsa
auuguaucccauguaaaaacaaaaaaacaaaaaacaaagaaaagaaagagauuuuaua

SEQ ID NO: 422372 - RNA, 58 nt, hsa
auuaaccauuuuauauuugccaccuacaaaaaaacacccaauaucuucucuuguagac

SEQ ID NO: 422373 - RNA, 58 nt, hsa
ugaaguuaucuuuuuuguuuaaaaaaaaaaaaaacacugcauuaaaaaaguaucuguu

SEQ ID NO: 422374 - RNA, 58 nt, hsa
uagaaaaggcauuuugggguuauguuuaaaaaaacauuauugucccacaauauuaccu

SEQ ID NO: 422375 - RNA, 58 nt, hsa
gccagacaugguggcaugcgcuuguuuaaaaaaacaaauaaauaaauaaucgacucaa

SEQ ID NO: 422376 - RNA, 58 nt, hsa
auuguacugcaauaauuuuucaaaaaacaaaaaacaaaacaaacaaaagagaacuaug

SEQ ID NO: 422377 - RNA, 58 nt, hsa
aggaguaauuguacugcaauaauuuuucaaaaaacaaaaaacaaaacaaacaaaagag

SEQ ID NO: 422378 - RNA, 58 nt, hsa
aaggaugccaagaaugcauuauuccacaaaaaaacagcagaccaacauauagaguguu

SEQ ID NO: 422379 - RNA, 58 nt, hsa
uugcgugauuuguauauuucacugguuuaaaaaacaaacaucgaaaggcuuaugccaa

SEQ ID NO: 422380 - RNA, 58 nt, hsa
cugagauuucaguggugcaaugucuuuaaaaaaacaggcuuuguugggaggguauuuc

SEQ ID NO: 422381 - RNA, 58 nt, hsa
acauauucaauuuggcuuuuuguggcugaaaaaacauaacuguuagacccaaagcauu

SEQ ID NO: 422382 - RNA, 58 nt, hsa
accuuuagggaaugauuaaaauuuaaaaaaaaaacauuucacucaguugcacuuaguc

SEQ ID NO: 422383 - RNA, 58 nt, hsa
agaaugaagauuggaaaaaggaaaaaaaaaaaaacacgucaaaaguuagcagugaaau

SEQ ID NO: 422384 - RNA, 58 nt, hsa
auacugaaagugccuccuuuugugguguaaaaaacaaauuauggugcaaaaaguaauc

SEQ ID NO: 422385 - RNA, 58 nt, hsa
cauggcaaaauguuugcuaccuuaguuuaaaaaacaaucucaaacaaaagacuugcuu

SEQ ID NO: 422386 - RNA, 58 nt, hsa
ggauugugcugauuuuuguugauaacacaaaaaacacuauguuuucuggagagcugug

SEQ ID NO: 422387 - RNA, 58 nt, hsa
gguuguauaaggguagcuuuuguuguuaaaaaaacaguagagaguuaaguuccauaua

SEQ ID NO: 422388 - RNA, 58 nt, hsa
cugaauagguuccccaauccaucguauuaaaaaacaauuaacugcccucugaaauaau

SEQ ID NO: 422389 - RNA, 58 nt, hsa
cuguguaaccagcucaguguuuugguggaaaaaacauuuuaaguuuuacugauaauuu

SEQ ID NO: 422390 - RNA, 58 nt, hsa
cugggugacagagucagacuccgucccaaaaaaacaaacaaacaaaacaaaacaaaaa

SEQ ID NO: 422391 - RNA, 58 nt, hsa
aaaaaacaaacaaacaaaacaaaacaaaaaaaaacagaaguuacaaaugaauacucac

SEQ ID NO: 422392 - RNA, 58 nt, hsa
accaaccuggugaaaccccgucucuacaaaaaaacacaaaaaauagccaggcauggug

SEQ ID NO: 422393 - RNA, 58 nt, hsa
uauuuucuauaugacccucuugauauuuaaaaaacacuauggauaacaauucuucauu

SEQ ID NO: 422394 - RNA, 58 nt, hsa
acauaccuuugacuauaagaaauuaaaaaaaaaacaccaaaauaauauuuuucuuacu

SEQ ID NO: 422395 - RNA, 58 nt, hsa
uucuuugguuuucuucaaacauaggugaaaaaaacacugccauucacaagucaaggaa

SEQ ID NO: 422396 - RNA, 58 nt, hsa
agaauuuggaugccuaaggcauaaaggaaaaaaacagaguucauaguuugagcuggua

SEQ ID NO: 422397 - RNA, 58 nt, hsa
auguaagacuuugguucccaacuuuguuaaaaaacaaaaaaagugauggaaagguguu

SEQ ID NO: 422398 - RNA, 58 nt, hsa
acaaaaagccaacaacccagaaagguuuaaaaaacauaaggaaaaaaaagacaaauua

SEQ ID NO: 422399 - RNA, 58 nt, hsa
acaaaaaaguuggaaggcagaaaccauuaaaaaacaaaaagccaacaacccagaaagg

SEQ ID NO: 422400 - RNA, 58 nt, hsa
acuuauuugucuucuuuuugcauugugaaaaaaacaaaauaaauuuugugugauaauu

SEQ ID NO: 422401 - RNA, 58 nt, hsa
ugaauugugcacauaagaaaaccaauacaaaaaacaauuuguauucaauauugucaca

SEQ ID NO: 422402 - RNA, 58 nt, hsa
caaacucucuuaagguucaauauguaauaaaaaacauaacacaaauaauuauucuaua

SEQ ID NO: 422403 - RNA, 58 nt, hsa
agcccuauuuguauuauuuugugcauuuaaaaaacacaaucuuaaggggauagacuag

SEQ ID NO: 422404 - RNA, 58 nt, hsa
accuucagccuaaggcacaaggaugccaaaaaaacaaaggugagaaaccacaacacag

SEQ ID NO: 422405 - RNA, 58 nt, hsa
aacacaccacucauuggaaaauggaaaaaaaaaacaaaaaaaaaacaaaaaaauguac

SEQ ID NO: 422406 - RNA, 58 nt, hsa
cauuggaaaauggaaaaaaaaaacaaaaaaaaaacaaaaaaauguacaauggaugcau

SEQ ID NO: 422407 - RNA, 58 nt, hsa
cuacccuccuugguuuaccuccaucauuaaaaaacaacaaugacaacgacaacaaaaa

SEQ ID NO: 422408 - RNA, 58 nt, hsa
auuaaaaaacaacaaugacaacgacaacaaaaaacaaaacuaaaacgacuuauuauuu

SEQ ID NO: 422409 - RNA, 58 nt, hsa
gucagccuuugcucuccauuuugacguuaaaaaacaacaacagaucuagagauaccuc

SEQ ID NO: 422410 - RNA, 58 nt, hsa
cuguaauuuaguuguaacauagaaaaugaaaaaacaguuaaaaaaagugaaguaguug

SEQ ID NO: 422411 - RNA, 58 nt, hsa
guauuacugauaaaaaauuaucuaaggaaaaaaacagaaaauuauuugguguggccau

SEQ ID NO: 422412 - RNA, 58 nt, hsa
aaaaagugucuguaaaucuucaguguuaaaaaaacagaugcccauuuguuggcuguuu

SEQ ID NO: 422413 - RNA, 58 nt, hsa
aagacuauuucacaaguccugugaggcaaaaaaacaaaacaaaacaaaacaaccaaac

SEQ ID NO: 422414 - RNA, 58 nt, hsa
uuguccuauuugucaacuggguucuggaaaaaaacaaacaugaugaagcuuuugaaua

SEQ ID NO: 422415 - RNA, 58 nt, hsa
cagagcaagacccugucugucucaaaacaaaaaacaaaaccacuuauauugcuagcua

SEQ ID NO: 422416 - RNA, 58 nt, hsa
auacaaaagaaaauguguaaggcuugcuaaaaaacaaaacaaaacaaaacacaguccu

SEQ ID NO: 422417 - RNA, 58 nt, hsa
aauauaugcauucacuugaaaaacuaaaaaaaaacaauaauuuggaaaaacccaugaa

SEQ ID NO: 422418 - RNA, 58 nt, hsa
auaaugaaaugacuaaguuaugugaggaaaaaaacagaagacauugcuaaaagaguua

SEQ ID NO: 422419 - RNA, 58 nt, hsa
gauaaagcaaaaguaaaaaaaaaaaaaaaaaaaacaaggggaaaggguugguuaggca

SEQ ID NO: 422420 - RNA, 58 nt, hsa
gggcaacauggcaaagccccaucucuacaaaaaacacaaaaauuagcugggcauugug

SEQ ID NO: 422421 - RNA, 58 nt, hsa
auuguaagaguucuucuguuugugaagaaaaaaacaaguuaaaaacugaauguacuga

SEQ ID NO: 422422 - RNA, 58 nt, hsa
ucuugaacauuucagaaggagugguagaaaaaaacacacauucagccaaccacuuaua

SEQ ID NO: 422423 - RNA, 58 nt, hsa
cgagacucugucucaaaaaaacaaaacaaaaaaacaccaaaaaaacccccaaaccuga

SEQ ID NO: 422424 - RNA, 58 nt, hsa
cugggugacagagcgagacucugucucaaaaaaacaaaacaaaaaaacaccaaaaaaa

SEQ ID NO: 422425 - RNA, 58 nt, hsa
ugaauugaaaauaucccuuaggaaaaaaaaaaaacacacaaaaaaccacaagagcccc

SEQ ID NO: 422426 - RNA, 58 nt, hsa
aaaaagaaaauauguaauauaauguaaaaaaaaacaaaaaaaagcuuuuaugauggau

SEQ ID NO: 422427 - RNA, 58 nt, hsa
acgcaacucaaaucugugcuggacuuuaaaaaaacaauucaggaccaaauuuuuucuc

SEQ ID NO: 422428 - RNA, 58 nt, hsa
uauuuaaauguagacuuuugacacuuuuaaaaaacaaaaaaagacaagagagaugaaa

SEQ ID NO: 422429 - RNA, 58 nt, hsa
uuuacagcucaucauucaaauaacgcacaaaaaacaaaagccgcuaugaccggcguug

SEQ ID NO: 422430 - RNA, 58 nt, hsa
gccacguaacaagagucuauuugccuugaaaaaacaauuauccuugaacuuccuccag

SEQ ID NO: 422431 - RNA, 58 nt, hsa
ggaauccugugcugaacccgaaucuuccaaaaaacagccuacaaucugugaccaccac

SEQ ID NO: 422432 - RNA, 58 nt, hsa
uuguccugagaaauaacagugcuguuuuaaaaaacauuugaaauaaauaccgcacaca

SEQ ID NO: 422433 - RNA, 58 nt, hsa
uuaaaccuuuguucugggauuuacuguuaaaaaacaaacaaaaaacaacaaaaaagcg

SEQ ID NO: 422434 - RNA, 58 nt, hsa
uucugggauuuacuguuaaaaaacaaacaaaaaacaacaaaaaagcggugacaggaaa

SEQ ID NO: 422435 - RNA, 58 nt, hsa
cuugguuucuugauucauuuauuugagaaaaaaacaauacaaagaaaugcauucauau

SEQ ID NO: 422436 - RNA, 58 nt, hsa
ugcaaccauaugcuauuaauaaaauggaaaaaaacaaaauggucauuuugcauauacu

SEQ ID NO: 422437 - RNA, 58 nt, hsa
aaggguuuauuuuauguaaaaaaaaaaaaaaaaacaaaaaaaaacccugagaccauga

SEQ ID NO: 422438 - RNA, 58 nt, hsa
cuggacaacaagagcgaaauucugucuaaaaaaacaaaagucccaauuaagaaccucc

SEQ ID NO: 422439 - RNA, 58 nt, hsa
aaacaaacaacaaaaaaaaaauuaaaaaaaaaaacagaaauagagcucuaaguuaugu

SEQ ID NO: 422440 - RNA, 58 nt, hsa
aaguccugcuauguuaaaaacaaacaacaaaaaacaaacaacaaaaaaaaaauuaaaa

SEQ ID NO: 422441 - RNA, 58 nt, hsa
aacaaccuuagcauuaagaaauaaaaacaaaaaacaagaagcaaguuguacugcuaga

SEQ ID NO: 422442 - RNA, 58 nt, hsa
uuaauacucuguaaacaaacaaacaaacaaaaaacaaccuuagcauuaagaaauaaaa

SEQ ID NO: 422443 - RNA, 58 nt, hsa
uguuuuaauaucuuuacucaaaaaaacaaaaaaacaaaaacccauggaagcaacaaaa

SEQ ID NO: 422444 - RNA, 58 nt, hsa
aucugaauuguuuuaauaucuuuacucaaaaaaacaaaaaaacaaaaacccauggaag

SEQ ID NO: 422445 - RNA, 58 nt, hsa
cuuggaaccuuuguacgcuuugcucaaaaaaaaacaaaaaaaaaaaacaaaaaaaaaa

SEQ ID NO: 422446 - RNA, 58 nt, hsa
uacgcuuugcucaaaaaaaaacaaaaaaaaaaaacaaaaaaaaaaaacaacgguggag

SEQ ID NO: 422447 - RNA, 58 nt, hsa
aaaaaaaacaaaaaaaaaaaacaaaaaaaaaaaacaacgguggagccuucgcacucaa

SEQ ID NO: 422448 - RNA, 58 nt, hsa
ugacagggucugacauggucagucuacuaaaaaacaaaaaaaaaaaacaaaaaaaaaa

SEQ ID NO: 422449 - RNA, 58 nt, hsa
cauggucagucuacuaaaaaacaaaaaaaaaaaacaaaaaaaaaaaaacaaaagaaaa

SEQ ID NO: 422450 - RNA, 58 nt, hsa
uaaaaaacaaaaaaaaaaaacaaaaaaaaaaaaacaaaagaaaaaaauaaaaauacgg

SEQ ID NO: 422451 - RNA, 58 nt, hsa
uuaaguugucaucauucugggaagaaaaaaaaaacauuaaugaagaggccaauaauau

SEQ ID NO: 422452 - RNA, 58 nt, hsa
ugacuguuuuuugaauagguuggaauugaaaaaacaauuaucaaacguuaagaacaaa

SEQ ID NO: 422453 - RNA, 58 nt, hsa
aaagcaccuuuaaaaaaaauacauuuuaaaaaaacauuccaagccaauuggaagacau

SEQ ID NO: 422454 - RNA, 58 nt, hsa
cugggcgacagagcaggacucucucucaaaaaaacacaaaaaaacaaaaacaaaaaac

SEQ ID NO: 422455 - RNA, 58 nt, hsa
gagcaggacucucucucaaaaaaacacaaaaaaacaaaaacaaaaaaccauacacaca

SEQ ID NO: 422456 - RNA, 58 nt, hsa
auccacuguauuuauaaggaagagucggaaaaaacaaugaccuuaguuuuuuuuaagc

SEQ ID NO: 422457 - RNA, 58 nt, hsa
uuucagauaaaagucaggaguuacugcuaaaaaacagacauguaggagacauucaaca

SEQ ID NO: 422458 - RNA, 58 nt, hsa
uugugaaugguucagauauuuuuucauuaaaaaacaagguauggcagauggacuuuuc

SEQ ID NO: 422459 - RNA, 58 nt, hsa
ucuaaauaaagucaucuaacuauuaaaaaaaaaacacccuuccuaacccuucuuuucu

SEQ ID NO: 422460 - RNA, 58 nt, hsa
uuaaaaacaaaacaaaaaaaaaaacaaaaaaaaacaaaaguaaauuaaaaacaaaacc

SEQ ID NO: 422461 - RNA, 58 nt, hsa
aaaauagaaauuaaaaacaaaacaaaaaaaaaaacaaaaaaaaacaaaaguaaauuaa

SEQ ID NO: 422462 - RNA, 58 nt, hsa
uguuaaaaaaaaacaaaaaaaaaaaaaaaaaaaacaagaugacgacgacaaccacaaa

SEQ ID NO: 422463 - RNA, 58 nt, hsa
aaaacaagaccagaugugauuuguuaaaaaaaaacaaaaaaaaaaaaaaaaaaaacaa

SEQ ID NO: 422464 - RNA, 58 nt, hsa
ccaaaaaauaaaaaaaccacaaaaaacaaaaaaacaaaacuaaggcacuucacuuaga

SEQ ID NO: 422465 - RNA, 58 nt, hsa
ccacccccccaaaaaauaaaaaaaccacaaaaaacaaaaaaacaaaacuaaggcacuu

SEQ ID NO: 422466 - RNA, 58 nt, hsa
uucuaagcuugcagguuacaaaaaacaaaaaaaacagagaagcugccugcguaaaaag

SEQ ID NO: 422467 - RNA, 58 nt, hsa
accugagauuucuaagcuugcagguuacaaaaaacaaaaaaaacagagaagcugccug

SEQ ID NO: 422468 - RNA, 58 nt, hsa
gcauuuuuaccucucucuuaaauguuauaaaaaacaauuguauuuuuaagaauguuua

SEQ ID NO: 422469 - RNA, 58 nt, hsa
uucauuugcagaaacaaauaacugaaauaaaaaacauguuaauccuuguaucauacuu

SEQ ID NO: 422470 - RNA, 58 nt, hsa
ugcuuaaugguuucucauuauguuuaucaaaaaacaacuguagcuguuauuuucagua

SEQ ID NO: 422471 - RNA, 58 nt, hsa
gccaaaaccauuaaguggaaagcugauuaaaaaacaaaaauuucuaauggauuuauca

SEQ ID NO: 422472 - RNA, 58 nt, hsa
caacuccccuccaaacaaacaauuaaaaaaaaaacauacagacacucaaauuccacaa

SEQ ID NO: 422473 - RNA, 58 nt, hsa
uaggaaaucaaaagaaaagcauacauauaaaaaacaguuuuuucuaagcauuucucau

SEQ ID NO: 422474 - RNA, 58 nt, hsa
caaaucaagaccccgucuccaaaaaaaaaaaaaacaaaacuugauugggauccaaaau

SEQ ID NO: 422475 - RNA, 58 nt, hsa
uguaugucacuacauaugaaaaaacaucaaaaaacaauuagcauuggacaucuuaaua

SEQ ID NO: 422476 - RNA, 58 nt, hsa
cuaaaugcucuguaugucacuacauaugaaaaaacaucaaaaaacaauuagcauugga

SEQ ID NO: 422477 - RNA, 58 nt, hsa
gugauuggggaaucaaacauuuugguuuaaaaaacaugauuauuuaaaacuggaaacu

SEQ ID NO: 422478 - RNA, 58 nt, hsa
auggcaccucaaauuuuauacucuuaaaaaaaaacaauaauuugugaauuaccaccaa

SEQ ID NO: 422479 - RNA, 58 nt, hsa
guagcauagcaagacccugucucuacaaaaaaaacaaaaauuagcugggcaugguggc

SEQ ID NO: 422480 - RNA, 58 nt, hsa
cacuuagaggaaauuugaacaaguuggaaaaaaacaauuuuuguuucaauucuaagaa

SEQ ID NO: 422481 - RNA, 58 nt, hsa
aauuuuugguuguuuugguuguuuucuuaaaaaacaaguuaaaaccugacgauuucug

SEQ ID NO: 422482 - RNA, 58 nt, hsa
acugucuugauggcaaaauaauuaugguaaaaaacaagucucguguuuauuauuccuu

SEQ ID NO: 422483 - RNA, 58 nt, hsa
guaaauguagaacccuaauuuuucuauaaaaaaacaaacuaacuaacuaacuguguaa

SEQ ID NO: 422484 - RNA, 58 nt, hsa
gaagcauucguccagcagcaccaggcugaaaaaacagaacgagagaaucggcuuaaag

SEQ ID NO: 422485 - RNA, 58 nt, hsa
acaauaagcuagaaaagacaaaaaaaacaaaaaacaaaaaaacguguaauaaaguuag

SEQ ID NO: 422486 - RNA, 58 nt, hsa
ucuaccaacaauaagcuagaaaagacaaaaaaaacaaaaaacaaaaaaacguguaaua

SEQ ID NO: 422487 - RNA, 58 nt, hsa
aucccccccuuuuuuuuuuuuuuuaacaaaaaaacacuuuucuaaggacugaagauug

SEQ ID NO: 422488 - RNA, 58 nt, hsa
uccuagauuacuuauugauuuaaaaacaaaaaaacacaaaaaaauaguaaaauauaaa

SEQ ID NO: 422489 - RNA, 58 nt, hsa
aacaucgaaaaacuuaaauauuauggaaaaaaaacauugcaaaauauaaaauaaauaa

SEQ ID NO: 422490 - RNA, 58 nt, hsa
uaggccugauuagaguagagugacuauuaaaaaacauaacuuucuaggagcuauaaau

SEQ ID NO: 422491 - RNA, 58 nt, hsa
aacuaugguguaagucuuugacaagaaaaaaaaacaaacaaacacuucuuuccaucag

SEQ ID NO: 422492 - RNA, 58 nt, hsa
caaaaaaaaaaaaaaaacaaaaacaaaaaaaaaacacaaaagcugcaugucuaaaauu

SEQ ID NO: 422493 - RNA, 58 nt, hsa
aauaaacugguuuuuuucaaaaaaaaaaaaaaaacaaaaacaaaaaaaaaacacaaaa

SEQ ID NO: 422494 - RNA, 58 nt, hsa
auuucaaguacccuguauucuggaugcuaaaaaacaaaaacaaacaaaaaaacaaaaa

SEQ ID NO: 422495 - RNA, 58 nt, hsa
ucuggaugcuaaaaaacaaaaacaaacaaaaaaacaaaaacaaaaaaacaaaaccaga

SEQ ID NO: 422496 - RNA, 58 nt, hsa
aacaaaaacaaacaaaaaaacaaaaacaaaaaaacaaaaccagaaucagguaaaacag

SEQ ID NO: 422497 - RNA, 58 nt, hsa
aagaccuaacugcagccgcuuugggaaaaaaaaacaaaaaacaaaaaacagaaaacaa

SEQ ID NO: 422498 - RNA, 58 nt, hsa
aacugcagccgcuuugggaaaaaaaaacaaaaaacaaaaaacagaaaacaaaaaaaaa

SEQ ID NO: 422499 - RNA, 57 nt, hsa
gccgcuuugggaaaaaaaaacaaaaaacaaaaaacagaaaacaaaaaaaaaaaaacu

SEQ ID NO: 422500 - RNA, 58 nt, hsa
uguauauuuaugaccagagcaaaaauguaaaaaacaaaaaaaacaacaaaaaaaguuu

SEQ ID NO: 422501 - RNA, 58 nt, hsa
augaccagagcaaaaauguaaaaaacaaaaaaaacaacaaaaaaaguuuguuacuuug

SEQ ID NO: 422502 - RNA, 58 nt, hsa
accacauuuuucaaguauuucuaaguauaaaaaacaaaacaaaaaucucuuaggaaau

SEQ ID NO: 422503 - RNA, 58 nt, hsa
ugacaaaauuuaagcugagcuuaaaagcaaaaaacaaaaaguacacagaaauauuuau

SEQ ID NO: 422504 - RNA, 58 nt, hsa
uuguuggccaccagaaaaccgcuuuuuaaaaaaacacuuggugauucuuucaagugcc

SEQ ID NO: 422505 - RNA, 58 nt, hsa
agcauuaaugcacauuuuuaaaaaaagaaaaaaacauggucuuguuuuuacuaccugu

SEQ ID NO: 422506 - RNA, 58 nt, hsa
aaucgaaaugaaagaagaguugauguuaaaaaaacaaaagucaagugauuuauuauau

SEQ ID NO: 422507 - RNA, 58 nt, hsa
aacacuucuguaauugaucauuauaaagaaaaaacaagguaacagucauaguucaccu

SEQ ID NO: 422508 - RNA, 58 nt, hsa
agcaagacucuugucucaaaaaaaacaaaaaaaacauauauacugcuguaucaugcca

SEQ ID NO: 422509 - RNA, 58 nt, hsa
uggggacagagcaagacucuugucucaaaaaaaacaaaaaaaacauauauacugcugu

SEQ ID NO: 422510 - RNA, 58 nt, hsa
uggaagaaacacguggucaugaauagaaaaaaaacaaacccaaagguaggaaggucaa

SEQ ID NO: 422511 - RNA, 58 nt, hsa
gaaaggaaaagaggcccaagugcaaaagaaaaaacauuuuagaaacggacagcuuaua

SEQ ID NO: 422512 - RNA, 58 nt, hsa
uuuuguauaaaucccuaauauuuaaaaaaaaaaacaaaacaaaaaaagguuacaaagu

SEQ ID NO: 422513 - RNA, 58 nt, hsa
auggaaaggacuagccucuacugaugcaaaaaaacaaaaagcaacacaaacguuuccu

SEQ ID NO: 422514 - RNA, 58 nt, hsa
cacaguauagaagagaacuuaaagagggaaaaaacaauaugaagauagggaaugcagg

SEQ ID NO: 422515 - RNA, 58 nt, hsa
cuccagccugagugacagagagagauucaaaaaacaaaaaaaaagcaaaaauauacuu

SEQ ID NO: 422516 - RNA, 58 nt, hsa
aguacaaccuugauaacaaaaccuaaaaaaaaaacaacaaaaaaacccauaaagcuau

SEQ ID NO: 422517 - RNA, 58 nt, hsa
agauuuagaugcaaaauccuaaaauugaaaaaaacaucuagccauauccauaaacuau

SEQ ID NO: 422518 - RNA, 58 nt, hsa
aacuagcuucuugucuuaggccugaaccaaaaaacaacaaacaaacaaaaaacaagaa

SEQ ID NO: 422519 - RNA, 58 nt, hsa
ggccugaaccaaaaaacaacaaacaaacaaaaaacaagaaugaaaaacagaaauaaaa

SEQ ID NO: 422520 - RNA, 58 nt, hsa
ccucuuagcuuucuagacuucuuaacagaaaaaacaguuuggguucaauagcauuuua

SEQ ID NO: 422521 - RNA, 58 nt, hsa
uuauuuguuuugguuagaaagugaauuuaaaaaacaaaccaaacucuaaacuuucuca

SEQ ID NO: 422522 - RNA, 58 nt, hsa
acuucaggucuuaagugcaaaucaaagcaaaaaacaaacaaaacuuacauggaaaaac

SEQ ID NO: 422523 - RNA, 58 nt, hsa
aaagaguuaaaacaaacagacaaacaaaaaaaaacacuacuauuuuaaauaguggaac

SEQ ID NO: 422524 - RNA, 58 nt, hsa
guggccugaagaggaagagaaaaaaaacaaaaaacagaaaccaaucgguaaucugauc

SEQ ID NO: 422525 - RNA, 58 nt, hsa
uccagcaguggccugaagaggaagagaaaaaaaacaaaaaacagaaaccaaucgguaa

SEQ ID NO: 422526 - RNA, 58 nt, hsa
aggggaagacuguggucaaguuaaaaaaaaaaaacaauauuaaacaacaugaaacugc

SEQ ID NO: 422527 - RNA, 58 nt, hsa
cauucuucagugccucaugacugaaaacaaaaaacaaaaaaacgaaagcaucuucaca

SEQ ID NO: 422528 - RNA, 58 nt, hsa
uuauucuuuaacaaagagaaucuaaaaaaaaaaacaaaaaacuguugucuaauauauc

SEQ ID NO: 422529 - RNA, 58 nt, hsa
ggaauacugcucguuauaaacacuacuaaaaaaacaguuuauauuuuauauacacaua

SEQ ID NO: 422530 - RNA, 58 nt, hsa
ccccaucagggaccagacuguuccaaaaaaaaaacaaaaaacaaaaacaaacaaaaaa

SEQ ID NO: 422531 - RNA, 58 nt, hsa
agggaccagacuguuccaaaaaaaaaacaaaaaacaaaaacaaacaaaaaaacacuua

SEQ ID NO: 422532 - RNA, 58 nt, hsa
aaaaaaaaacaaaaaacaaaaacaaacaaaaaaacacuuaaaagcccaaggaguaagc

SEQ ID NO: 422533 - RNA, 58 nt, hsa
agugacuugaaucuucauaaguuaaaguaaaaaacagcaaaaaaccuagaucuuuguc

SEQ ID NO: 422534 - RNA, 58 nt, hsa
aaaccacaaaguggcucaggcuuuaaaaaaaaaacacuguggauaaugacaaaaagca

SEQ ID NO: 422535 - RNA, 58 nt, hsa
gguaaagauauuauucaccauguaaaacaaaaaacaauauuuauuguauuuuaguaua

SEQ ID NO: 422536 - RNA, 58 nt, hsa
auaaacuguccucuuucagaaaacagaaaaaaaacacacacacacacaacaaaaauuu

SEQ ID NO: 422537 - RNA, 58 nt, hsa
ucuacuguuucaaaaaagugucuuuacaaaaaaacaaaaaagaaaagaaauuuauuua

SEQ ID NO: 422538 - RNA, 58 nt, hsa
cucaaaucuaaaacauuuacagaguuacaaaaaacaaacaaucaaaaaaaaagacagu

SEQ ID NO: 422539 - RNA, 58 nt, hsa
uuuuuggaagagcugcuaauuuuauuuuaaaaaacaaaguugugaaaacaugccuccu

SEQ ID NO: 422540 - RNA, 58 nt, hsa
uugcaugaugaugacucuugaacagagcaaaaaacaaggaggauuaugugugacuggg

SEQ ID NO: 422541 - RNA, 58 nt, hsa
aggcaucuggaaagggggggaaaaaagcaaaaaacaaaauuaaaaaaaauugauuucc

SEQ ID NO: 422542 - RNA, 58 nt, hsa
guaaaaauuucuucugggcugaguagauaaaaaacaucaucgcucccaaaggaaagag

SEQ ID NO: 422543 - RNA, 58 nt, hsa
ucauccgcacuguaaauacauguauuuaaaaaaacaaucccaaguaaaaauuucuucu

SEQ ID NO: 422544 - RNA, 58 nt, hsa
auuuuucaguuccaugugccucccaaauaaaaaacagaaaauaaguaguuuuugugaa

SEQ ID NO: 422545 - RNA, 58 nt, hsa
aauggaaaaaaugaucauggcuuuaaaaaaaaaacaaaaacacacacacaugaacuca

SEQ ID NO: 422546 - RNA, 58 nt, hsa
guggcaaagugagacucuggcucaaaaaaaaaaacaaaaaacaaaaccaucugcccuc

SEQ ID NO: 422547 - RNA, 58 nt, hsa
agugagacucuggcucaaaaaaaaaaacaaaaaacaaaaccaucugcccuccuccccu

SEQ ID NO: 422548 - RNA, 58 nt, hsa
ccagagagcaguguggaaaaaaaaaaacaaaaaacaacugaccaguuguugauaacca

SEQ ID NO: 422549 - RNA, 58 nt, hsa
uucgaauccagagagcaguguggaaaaaaaaaaacaaaaaacaacugaccaguuguug

SEQ ID NO: 422550 - RNA, 58 nt, hsa
ucaaaacaaaacaaaaaacaacaacaacaaaaaacaaguccaaacugauauauccuau

SEQ ID NO: 422551 - RNA, 58 nt, hsa
aaaagugcacugaacuucaaaacaaaacaaaaaacaacaacaacaaaaaacaagucca

SEQ ID NO: 422552 - RNA, 58 nt, hsa
auguuauaaauauuguuauuuaaaaaacaaaaaacaaaacacacguacauuagguccu

SEQ ID NO: 422553 - RNA, 58 nt, hsa
acuggccauguuauaaauauuguuauuuaaaaaacaaaaaacaaaacacacguacauu

SEQ ID NO: 422554 - RNA, 58 nt, hsa
uaaaaucaaaaacaaaacaaaaaaacacaaaaaacacauucuaaauacuagagauaac

SEQ ID NO: 422555 - RNA, 58 nt, hsa
auuccuucuuaaaaucaaaaacaaaacaaaaaaacacaaaaaacacauucuaaauacu

SEQ ID NO: 422556 - RNA, 58 nt, hsa
agacuccuuuaaaaaaacaaacaaacaaaaaaaacauagacuucuuuauaucuuuuga

SEQ ID NO: 422557 - RNA, 58 nt, hsa
auaggcaauuuuaaaacagacuccuuuaaaaaaacaaacaaacaaaaaaaacauagac

SEQ ID NO: 422558 - RNA, 58 nt, hsa
aaaaaaaaaaacaaaaacaaacaaacaaaaaaaacaccucaccaugagugcuacaugu

SEQ ID NO: 422559 - RNA, 58 nt, hsa
aacagaguaagacucugucucaaaaaaaaaaaaacaaaaacaaacaaacaaaaaaaac

SEQ ID NO: 422560 - RNA, 58 nt, hsa
uuaguuugucuaaaauagucucacagguaaaaaacauaacaacaaugaccaccauugu

SEQ ID NO: 422561 - RNA, 58 nt, hsa
aaaaaaacgaaaaaaacaaaacaaaacaaaaaaacaugagcagugguguucuaaugaa

SEQ ID NO: 422562 - RNA, 58 nt, hsa
aacacuaaugcuuuguuuaaaaaaacgaaaaaaacaaaacaaaacaaaaaaacaugag

SEQ ID NO: 422563 - RNA, 58 nt, hsa
ucuuccugauuaaaaaaauuuuuuuugaaaaaaacaaggccagccccaaccuuccaaa

SEQ ID NO: 422564 - RNA, 58 nt, hsa
ugacuuucuuguuuugucucaaaacuuaaaaaaacaaacacaaaaagaugagucccac

SEQ ID NO: 422565 - RNA, 58 nt, hsa
ugugguggauauuauuauuugaagaaagaaaaaacagauuuuaggguggaaaaaacag

SEQ ID NO: 422566 - RNA, 58 nt, hsa
aagaaagaaaaaacagauuuuaggguggaaaaaacagucaacucacacaaagaaugga

SEQ ID NO: 422567 - RNA, 58 nt, hsa
uaccuacauaguuuuuaaauuauuguuuaaaaaacaaaacagcuguuauaaaugaaua

SEQ ID NO: 422568 - RNA, 58 nt, hsa
gaauaaaucuuaaaugcuuuguuuaauuaaaaaacaaaaaucaccaauauccaagaca

SEQ ID NO: 422569 - RNA, 58 nt, hsa
caucaauuuaaaaguaaaaaaaacaaaaaaaaaacaaaaaauuuaaaaaaaagguuug

SEQ ID NO: 422570 - RNA, 58 nt, hsa
ccacgguucaccaucaauuuaaaaguaaaaaaaacaaaaaaaaaacaaaaaauuuaaa

SEQ ID NO: 422571 - RNA, 58 nt, hsa
guguagacaauggugguuaaaaaaaaaaaaaaaacagguaccagguucuguguguuug

SEQ ID NO: 422572 - RNA, 58 nt, hsa
aaaauucauuuuacauuggguagacaguaaaaaacaaguaaaauaacuugacaugagc

SEQ ID NO: 422573 - RNA, 58 nt, hsa
cagagauacuuuccuaaaaaggaaaaauaaaaaacaaaauggugccacuuuggguuga

SEQ ID NO: 422574 - RNA, 58 nt, hsa
aauucauuuauaugucuuuugauucuuaaaaaaacaaaaaacauuccauuagaagcac

SEQ ID NO: 422575 - RNA, 58 nt, hsa
uuauaugucuuuugauucuuaaaaaaacaaaaaacauuccauuagaagcaccaguuuu

SEQ ID NO: 422576 - RNA, 58 nt, hsa
uaaccauguuuuuucuguuuaauuauguaaaaaacaaaacuacaacaacaaaaaaaga

SEQ ID NO: 422577 - RNA, 58 nt, hsa
aacaaaaaaagaaaaaaguuaaaaaagaaaaaaacaccaaaaaacaaaaacaaacaaa

SEQ ID NO: 422578 - RNA, 58 nt, hsa
gaaaaaaguuaaaaaagaaaaaaacaccaaaaaacaaaaacaaacaaaaaaaaaaacc

SEQ ID NO: 422579 - RNA, 58 nt, hsa
uaacuauuucaaaaauuacugccuuuaaaaaaaacaaccucaagcuauauuuguauuc

SEQ ID NO: 422580 - RNA, 58 nt, hsa
guauuucuccauugaaaacacaauaaaaaaaaaacagcacaaucucacaguugccuga

SEQ ID NO: 422581 - RNA, 58 nt, hsa
acaaaacaaaaaaaaaaaaaaaagaaaaaaaaaacaugcaccuguuucacugugaaua

SEQ ID NO: 422582 - RNA, 58 nt, hsa
uggcucagucagcaaccucagaacucugaaaaaacaaaacaaaaaaaaaaaaaaaaga

SEQ ID NO: 422583 - RNA, 58 nt, hsa
gaccaaauuguuuaagaaaaaaaaacaaaaaaaacaaaaucuagggcuguauuuuaua

SEQ ID NO: 422584 - RNA, 58 nt, hsa
gugcaucgugaccaaauuguuuaagaaaaaaaaacaaaaaaaacaaaaucuagggcug

SEQ ID NO: 422585 - RNA, 58 nt, hsa
uccagcaaaagaggauguagccucugggaaaaaacaaacauguuacaguguuuuuugu

SEQ ID NO: 422586 - RNA, 58 nt, hsa
acuguauauaccugucucuaaguaaaggaaaaaacaaaauaaggacuucaauccaaag

SEQ ID NO: 422587 - RNA, 58 nt, hsa
aguucagagucacccguggcuccuaaggaaaaaacagcaucaugaaaggcaaaaagua

SEQ ID NO: 422588 - RNA, 58 nt, hsa
gccuuuaauugucuugcucucuaugggaaaaaaacaaaagggcuucagucucauggau

SEQ ID NO: 422589 - RNA, 58 nt, hsa
uuuaauuuggcaggauaaaauauugcaaaaaaaacacauuuguauguuaaguccuauu

SEQ ID NO: 422590 - RNA, 58 nt, hsa
guuagugaauuuggaaauaaaaagaaaaaaaaaacaaaaacaaacaggcugccauaau

SEQ ID NO: 422591 - RNA, 58 nt, hsa
agagagagaacuugaugcaaaguccacgaaaaaacaauuuuuuucaccucagguguca

SEQ ID NO: 422592 - RNA, 58 nt, hsa
caccucaggugucaaaguaaauuuguuaaaaaaacaaaaaaaacacaaaaauuucaaa

SEQ ID NO: 422593 - RNA, 58 nt, hsa
ugucaaaguaaauuuguuaaaaaaacaaaaaaaacacaaaaauuucaaaaaacaccac

SEQ ID NO: 422594 - RNA, 58 nt, hsa
aaaaaaacaaaaaaaacacaaaaauuucaaaaaacaccacccaccaaauugcacaaua

SEQ ID NO: 422595 - RNA, 58 nt, hsa
aagacacaaaccugacaggagggagaagaaaaaacaaaacacuugaaccaagaaacuc

SEQ ID NO: 422596 - RNA, 58 nt, hsa
agaagcuuuccuucauaaaauagaaagaaaaaaacauuuggcuuauuuuucacuguag

SEQ ID NO: 422597 - RNA, 58 nt, hsa
cauuuuauuaaaagaauaauuauaauuaaaaaaacacgauacagaucagugcauauag

SEQ ID NO: 422598 - RNA, 58 nt, hsa
aacuguucuaaaauagaaagucugugaaaaaaaacaaaaguaaaguuauaaaaggaaa

SEQ ID NO: 422599 - RNA, 58 nt, hsa
ccugaccauguaaggcuuuuuuauuuuaaaaaaacagaguuaucccaauacauuaucc

SEQ ID NO: 422600 - RNA, 58 nt, hsa
gaauuugaauaucaucagaaugugucugaaaaaacauuguccucaaauaauguucuuu

SEQ ID NO: 422601 - RNA, 58 nt, hsa
auaugaucagacaaaaugcagaaggaaaaaaaaacauauugaaugaagcacuuggaaa

SEQ ID NO: 422602 - RNA, 58 nt, hsa
ugcuaaaaagacaaaaaacaaaaaacaaaaaaaacaaaaaaaaccucaugagugcaug

SEQ ID NO: 422603 - RNA, 58 nt, hsa
cccucuuccugcuaaaaagacaaaaaacaaaaaacaaaaaaaacaaaaaaaaccucau

SEQ ID NO: 422604 - RNA, 58 nt, hsa
auucucccccucuuccugcuaaaaagacaaaaaacaaaaaacaaaaaaaacaaaaaaa

SEQ ID NO: 422605 - RNA, 58 nt, hsa
cucuauucacugguacaguccagccaguaaaaaacacuuccaaaaagauacacagaag

SEQ ID NO: 422606 - RNA, 58 nt, hsa
auagucuaaugcugacaacuucuauuuuaaaaaacaagacuuuacuuucuucugcccc

SEQ ID NO: 422607 - RNA, 58 nt, hsa
uaauuugcuaaauagacuaacaggaggaaaaaaacaaacagccuagcuuuaaaaaaca

SEQ ID NO: 422608 - RNA, 58 nt, hsa
ggaggaaaaaaacaaacagccuagcuuuaaaaaacagugaaauagcagugauuucaug

SEQ ID NO: 422609 - RNA, 58 nt, hsa
guaccuggcaccuuacucaagcaaaaacaaaaaacagcuuuacuucaaaagcaugugc

SEQ ID NO: 422610 - RNA, 58 nt, hsa
caccugacccuguguguacaauccaggaaaaaaacaaaccccacucagaaacagagaa

SEQ ID NO: 422611 - RNA, 58 nt, hsa
uccucauccuaguucuuuaaaaaaaacaaaaaaacaaaaaaaacuuuuuuuaaucguu

SEQ ID NO: 422612 - RNA, 58 nt, hsa
cggcucucuccucauccuaguucuuuaaaaaaaacaaaaaaacaaaaaaaacuuuuuu

SEQ ID NO: 422613 - RNA, 58 nt, hsa
augguaauaaacgagauguuugccaaauaaaaaacagaaaccgcaggaguuugcgaag

SEQ ID NO: 422614 - RNA, 58 nt, hsa
uacuccccuuucuuccaaacuuuugcagaaaaaacaaaaaaacuacaaacaaaagcag

SEQ ID NO: 422615 - RNA, 58 nt, hsa
ggcgauagagcuagacucugucucaaaaaaaaaacaaaaaacaaguaacucuuuauuc

SEQ ID NO: 422616 - RNA, 58 nt, hsa
gagcuagacucugucucaaaaaaaaaacaaaaaacaaguaacucuuuauuccuugugu

SEQ ID NO: 422617 - RNA, 58 nt, hsa
cuucugugugaccgaccccuuggccaaaaaaaaacaaaaagcaaaaaacaaaaaccua

SEQ ID NO: 422618 - RNA, 58 nt, hsa
accccuuggccaaaaaaaaacaaaaagcaaaaaacaaaaaccuacccuguucugguuu

SEQ ID NO: 422619 - RNA, 58 nt, hsa
ggcuuaauacauuagugguaacugguuuaaaaaacaaagacuguaagccugugugugc

SEQ ID NO: 422620 - RNA, 58 nt, hsa
uuugugcuauuguuuuaaaaaaauaauuaaaaaacaguuggcguuaauaaaaauguca

SEQ ID NO: 422621 - RNA, 58 nt, hsa
cauuaucagcaugaugaaaggugugucuaaaaaacaauucagaauaccagcagcauug

SEQ ID NO: 422622 - RNA, 58 nt, hsa
uugaauauuuuauuuuuuuaaugaaaagaaaaaacaagaaaguuauguuucauaauuu

SEQ ID NO: 422623 - RNA, 58 nt, hsa
cuggucaacaagaguaaaacuucaucucaaaaaacaaaacaaaacaaaaacaacaaca

SEQ ID NO: 422624 - RNA, 58 nt, hsa
ucagacacacccaugguaaaaaaaaaaaaaaaaacaaucccaaggguacagaagagcu

SEQ ID NO: 422625 - RNA, 58 nt, hsa
uugaguauauauuugaaaaggaaaaaacaaaaaacaaacccagaccccaccugaauug

SEQ ID NO: 422626 - RNA, 58 nt, hsa
gguugaauugaguauauauuugaaaaggaaaaaacaaaaaacaaacccagaccccacc

SEQ ID NO: 422627 - RNA, 58 nt, hsa
ggaaguaaaaaaacaaaacaaaaaacaaaaaaaacaaaaaaaaaacccuauuuaaaug

SEQ ID NO: 422628 - RNA, 58 nt, hsa
aucgaauagggaaguaaaaaaacaaaacaaaaaacaaaaaaaacaaaaaaaaaacccu

SEQ ID NO: 422629 - RNA, 58 nt, hsa
caggaaacucaaaucgaauagggaaguaaaaaaacaaaacaaaaaacaaaaaaaacaa

SEQ ID NO: 422630 - RNA, 58 nt, hsa
accccuuuuucuaaaaaacaaacaaaaaaaaaaacacacaaaacaaaaacagaacaaa

SEQ ID NO: 422631 - RNA, 58 nt, hsa
uuauuucuucucccccaccccuuuuucuaaaaaacaaacaaaaaaaaaaacacacaaa

SEQ ID NO: 422632 - RNA, 58 nt, hsa
ucagcugauagaaaaacaaaaaugaaaaaaaaaacacaaaaaacaaaaaacauggcac

SEQ ID NO: 422633 - RNA, 58 nt, hsa
agaaaaacaaaaaugaaaaaaaaaacacaaaaaacaaaaaacauggcacguugcuagu

SEQ ID NO: 422634 - RNA, 58 nt, hsa
caaaaaugaaaaaaaaaacacaaaaaacaaaaaacauggcacguugcuaguuuacagg

SEQ ID NO: 422635 - RNA, 58 nt, hsa
uuuaugaaaaaaaaaacacuucucagugaaaaaacaagauuacaagggggaauaauau

SEQ ID NO: 422636 - RNA, 58 nt, hsa
uaucauuugaaauauuuuuuuaugaaaaaaaaaacacuucucagugaaaaaacaagau

SEQ ID NO: 422637 - RNA, 58 nt, hsa
ucaaguggacaagaaaaaauaacaaaacaaaaaacaagaaaaaaaaaacacaaaaccc

SEQ ID NO: 422638 - RNA, 58 nt, hsa
aaaaauaacaaaacaaaaaacaagaaaaaaaaaacacaaaaccccguaaaaucacaaa

SEQ ID NO: 422639 - RNA, 58 nt, hsa
uguggggacguguuaggagagaaaaaaaaaaaaacaaaaauauauaugggggaaauua

SEQ ID NO: 422640 - RNA, 58 nt, hsa
aaggaaacguucacauuuuagaguuuaaaaaaaacaccucgacauuuaaaaaaucaac

SEQ ID NO: 422641 - RNA, 58 nt, hsa
cggugagacuuugucucaaaaaaaaaaaaaaaaacaauggaaggcagacagcaagucc

SEQ ID NO: 422642 - RNA, 58 nt, hsa
cacaguguccuguagcuaagugucuaggaaaaaacaaaaacuccaaacccuucagugg

SEQ ID NO: 422643 - RNA, 58 nt, hsa
cuuuucagcuggugcuuuuacuuagggaaaaaaacaauuuguaaauacagaacauugu

SEQ ID NO: 422644 - RNA, 58 nt, hsa
uauggaagaaccgggacauuuuacagaaaaaaaacaaaaaacaacaaaaaauauacgu

SEQ ID NO: 422645 - RNA, 58 nt, hsa
gaaccgggacauuuuacagaaaaaaaacaaaaaacaacaaaaaauauacgugggaaaa

SEQ ID NO: 422646 - RNA, 58 nt, hsa
cacugagaacuaguauuauaugguuuuuaaaaaacaauggugaaguacaugccacaua

SEQ ID NO: 422647 - RNA, 58 nt, hsa
guaaaaugaaacucuauaaccaccauuaaaaaaacaacucauucccacauucuucagu

SEQ ID NO: 422648 - RNA, 58 nt, hsa
aaaaaagaaaaaaaucaaaaaagcgacaaaaaaacacaaacagaagaggaaaaaaaag

SEQ ID NO: 422649 - RNA, 58 nt, hsa
uuuacuggggauucuugaacuugaaaaaaaaaaacacaaaaaaagacaaaaaaaaaaa

SEQ ID NO: 422650 - RNA, 58 nt, hsa
cccuuuuucuuguuaaaaaacaaaaaacaaaaaacaaaaaaccacacacacauuuugu

SEQ ID NO: 422651 - RNA, 58 nt, hsa
uuuugcccccuuuuucuuguuaaaaaacaaaaaacaaaaaacaaaaaaccacacacac

SEQ ID NO: 422652 - RNA, 58 nt, hsa
uccuggcuuuugcccccuuuuucuuguuaaaaaacaaaaaacaaaaaacaaaaaacca

SEQ ID NO: 422653 - RNA, 58 nt, hsa
uugaaagacaggagaauucauacuggagaaaaaacauacaaauguaagguuuguaaca

SEQ ID NO: 422654 - RNA, 58 nt, hsa
uguaaugaauguggcaagguuuuuaaucaaaaaacaacccuugcacgucaucauagaa

SEQ ID NO: 422655 - RNA, 58 nt, hsa
augccuuaggacauguuugaacugcagcaaaaaacaaaaacaaaaaacagugcauuag

SEQ ID NO: 422656 - RNA, 58 nt, hsa
uguuugaacugcagcaaaaaacaaaaacaaaaaacagugcauuagcaauuucauagca

SEQ ID NO: 422657 - RNA, 58 nt, hsa
agagagagaggaagcgagagagagagagaaaaaacaaaaaacagaaaacacgaaugcc

SEQ ID NO: 422658 - RNA, 58 nt, hsa
gaggaagcgagagagagagagaaaaaacaaaaaacagaaaacacgaaugccuuuucua

SEQ ID NO: 422659 - RNA, 58 nt, hsa
gcgagaccucaucuccaaaaaagaaaacaaaaaacaaaaaaaggaaugauguucugua

SEQ ID NO: 422660 - RNA, 58 nt, hsa
cugauuuaaaacaaaccaaaaaaaaagaaaaaaacaaaaaaaaaaaucccuccuuucu

SEQ ID NO: 422661 - RNA, 58 nt, hsa
ggucugucuuuucuccauuuguuuaaaaaaaaaacaaaaacaaaaaacaacacuuugg

SEQ ID NO: 422662 - RNA, 58 nt, hsa
uccauuuguuuaaaaaaaaaacaaaaacaaaaaacaacacuuugguguggugguaugg

SEQ ID NO: 422663 - RNA, 58 nt, hsa
uuuuugcacugaaaucuaaagauguuuuaaaaaacacuuuucacaaaaauaguccuuu

SEQ ID NO: 422664 - RNA, 58 nt, hsa
uaauagugugaaauugucauguuaaaaaaaaaaacaggaaccaaaugugaccuugugc

SEQ ID NO: 422665 - RNA, 58 nt, hsa
gagaggacguuucccuguuuagggaaagaaaaaacaucuucagaucauagguccuaaa

SEQ ID NO: 422666 - RNA, 58 nt, hsa
agucugguuuaaguagucauuucugcugaaaaaacagaugauccugguggaagaaaag

SEQ ID NO: 422667 - RNA, 58 nt, hsa
ugagcaccagcagcagaaaacaacaacaaaaaaacaccucguuuuuaccuugucuucu

SEQ ID NO: 422668 - RNA, 58 nt, hsa
gucuuuauuuguguaauucauuuugaggaaaaaacaacuccauguauuuauucaagug

SEQ ID NO: 422669 - RNA, 58 nt, hsa
ucuuuuguuacaucuauuacaaguuuagaaaaaacaaagcaauugucaaaaaaaguua

SEQ ID NO: 422670 - RNA, 58 nt, hsa
aauuauuuuucucaaaaaacaaacaaacaaaaaacacaaaaaaaaccacucuucucca

SEQ ID NO: 422671 - RNA, 58 nt, hsa
ugaggcuucaauuagaauuauuuuucucaaaaaacaaacaaacaaaaaacacaaaaaa

SEQ ID NO: 422672 - RNA, 58 nt, hsa
uagugcagaccuuuaccccuagucuaugaaaaaacaaaccaaaauaugcucuugcgcc

SEQ ID NO: 422673 - RNA, 58 nt, hsa
gggaauuuuuuuuaaaaaacaacaaaaaaaaaaacauacaaagauggguuucugaaua

SEQ ID NO: 422674 - RNA, 58 nt, hsa
aaaccaguucauaaggggaauuuuuuuuaaaaaacaacaaaaaaaaaaacauacaaag

SEQ ID NO: 422675 - RNA, 58 nt, hsa
uggggaggccaaauaagcccccacugcaaaaaaacaaaaaacagguuaagaaaauuac

SEQ ID NO: 422676 - RNA, 58 nt, hsa
gccaaauaagcccccacugcaaaaaaacaaaaaacagguuaagaaaauuacuugggug

SEQ ID NO: 422677 - RNA, 58 nt, hsa
auguuaaaaaaaaaaaaacaaaaaaacaaaaaaacaacuguucuuugccuaauaaaga

SEQ ID NO: 422678 - RNA, 58 nt, hsa
uaaaggaaauguuaaaaaaaaaaaaacaaaaaaacaaaaaaacaacuguucuuugccu

SEQ ID NO: 422679 - RNA, 58 nt, hsa
accuuccuuaaaggaaauguuaaaaaaaaaaaaacaaaaaaacaaaaaaacaacuguu

SEQ ID NO: 422680 - RNA, 58 nt, hsa
gccaaauaagcccucacuccaaaaaaacaaaaaacaggguaagaaaauuacuugggug

SEQ ID NO: 422681 - RNA, 58 nt, hsa
uggggaggccaaauaagcccucacuccaaaaaaacaaaaaacaggguaagaaaauuac

SEQ ID NO: 422682 - RNA, 58 nt, hsa
aaaaaaacacacacacacaaaaaaagagaaaaaacauaacaaguaaauuuuaaaaaaa

SEQ ID NO: 422683 - RNA, 58 nt, hsa
aacaaaaaaaacaaaaaaacaaaaaacaaaaaaacacacacacacaaaaaaagagaaa

SEQ ID NO: 422684 - RNA, 58 nt, hsa
aaacaaaaaacaaaaaaaacaaaaaaacaaaaaacaaaaaaacacacacacacaaaaa

SEQ ID NO: 422685 - RNA, 58 nt, hsa
aaagcaaaaacaaaaaacaaaaaaaacaaaaaaacaaaaaacaaaaaaacacacacac

SEQ ID NO: 422686 - RNA, 58 nt, hsa
accuuccaaaagcaaaaacaaaaaacaaaaaaaacaaaaaaacaaaaaacaaaaaaac

SEQ ID NO: 422687 - RNA, 58 nt, hsa
cgcugggagaccuuccaaaagcaaaaacaaaaaacaaaaaaaacaaaaaaacaaaaaa

SEQ ID NO: 422688 - RNA, 58 nt, hsa
uuucacaaacaguuuuauuuaaaaaaacaaaaaacaaaaaaaaucaaaaaaucaaaaa

SEQ ID NO: 422689 - RNA, 58 nt, hsa
auagcuguuucacaaacaguuuuauuuaaaaaaacaaaaaacaaaaaaaaucaaaaaa

SEQ ID NO: 422690 - RNA, 58 nt, hsa
aagaagaauaguuguuuaaauauuuuuuaaaaaacacuugaauaagaaucaguagggu

SEQ ID NO: 422691 - RNA, 58 nt, hsa
gcuaacacggugaaaccccgucucuacuaaaaaacagaaaauuagccgggcguggugg

SEQ ID NO: 422692 - RNA, 58 nt, hsa
ggagagcuacuuucuauccaaauaauuuaaaaaacacuuuucaccuacuccuuucaug

SEQ ID NO: 422693 - RNA, 58 nt, hsa
uucauacuacccuuuagucauaaggagaaaaaaacacucaaauaguagaagcagcaag

SEQ ID NO: 422694 - RNA, 58 nt, hsa
ucucccugagguggggauaaaagaaaaaaaaaaacaacuucuuuuuuucuuccgcaua

SEQ ID NO: 422695 - RNA, 58 nt, hsa
uauugucggcaggcggugagggguagaaaaaaaacaaacaaacaaacagaaaaaaaaa

SEQ ID NO: 422696 - RNA, 58 nt, hsa
ucaaagucacaagaagaaaaaugaaaggaaaaaacagcagcccuauucagaaauuggu

SEQ ID NO: 422697 - RNA, 58 nt, hsa
uuaaagaaacuugaccaaaagacaguacaaaaaacacuggcacuugaauguugaaugu

SEQ ID NO: 422698 - RNA, 64 nt, hsa; identical to SEQ ID NO: 247175

SEQ ID NO: 422699 - RNA, 64 nt, hsa; identical to SEQ ID NO: 247176

SEQ ID NO: 422700 - RNA, 64 nt, hsa; identical to SEQ ID NO: 247177

SEQ ID NO: 422701 - RNA, 64 nt, hsa; identical to SEQ ID NO: 247178

SEQ ID NO: 422702 - RNA, 64 nt, hsa; identical to SEQ ID NO: 247179

SEQ ID NO: 422703 - RNA, 64 nt, hsa; identical to SEQ ID NO: 247180

SEQ ID NO: 422704 - RNA, 64 nt, hsa; identical to SEQ ID NO: 247181

SEQ ID NO: 422705 - RNA, 64 nt, hsa; identical to SEQ ID NO: 247182

SEQ ID NO: 422706 - RNA, 64 nt, hsa; identical to SEQ ID NO: 247183

SEQ ID NO: 422707 - RNA, 64 nt, hsa; identical to SEQ ID NO: 247184

SEQ ID NO: 422708 - RNA, 64 nt, hsa; identical to SEQ ID NO: 247185

SEQ ID NO: 422709 - RNA, 64 nt, hsa; identical to SEQ ID NO: 247186

SEQ ID NO: 422710 - RNA, 64 nt, hsa; identical to SEQ ID NO: 247187

SEQ ID NO: 422711 - RNA, 64 nt, hsa; identical to SEQ ID NO: 247188

SEQ ID NO: 422712 - RNA, 64 nt, hsa; identical to SEQ ID NO: 247189

SEQ ID NO: 422713 - RNA, 64 nt, hsa; identical to SEQ ID NO: 247190

SEQ ID NO: 422714 - RNA, 64 nt, hsa; identical to SEQ ID NO: 247191

SEQ ID NO: 422715 - RNA, 64 nt, hsa; identical to SEQ ID NO: 247192

SEQ ID NO: 422716 - RNA, 64 nt, hsa; identical to SEQ ID NO: 247193

SEQ ID NO: 422717 - RNA, 64 nt, hsa; identical to SEQ ID NO: 247194

SEQ ID NO: 422718 - RNA, 64 nt, hsa; identical to SEQ ID NO: 247195

SEQ ID NO: 422719 - RNA, 64 nt, hsa; identical to SEQ ID NO: 247196

SEQ ID NO: 422720 - RNA, 64 nt, hsa; identical to SEQ ID NO: 247197

SEQ ID NO: 422721 - RNA, 64 nt, hsa; identical to SEQ ID NO: 247198

SEQ ID NO: 422722 - RNA, 64 nt, hsa; identical to SEQ ID NO: 247199

SEQ ID NO: 422723 - RNA, 64 nt, hsa; identical to SEQ ID NO: 247200

SEQ ID NO: 422724 - RNA, 64 nt, hsa; identical to SEQ ID NO: 247201

SEQ ID NO: 422725 - RNA, 61 nt, hsa; identical to SEQ ID NO: 247202

SEQ ID NO: 422726 - RNA, 64 nt, hsa; identical to SEQ ID NO: 247203

SEQ ID NO: 422727 - RNA, 64 nt, hsa; identical to SEQ ID NO: 247204

SEQ ID NO: 422728 - RNA, 64 nt, hsa; identical to SEQ ID NO: 247205

SEQ ID NO: 422729 - RNA, 64 nt, hsa; identical to SEQ ID NO: 247206

SEQ ID NO: 422730 - RNA, 64 nt, hsa; identical to SEQ ID NO: 247207

SEQ ID NO: 422731 - RNA, 64 nt, hsa; identical to SEQ ID NO: 247208

SEQ ID NO: 422732 - RNA, 64 nt, hsa; identical to SEQ ID NO: 247209

SEQ ID NO: 422733 - RNA, 64 nt, hsa; identical to SEQ ID NO: 247210

SEQ ID NO: 422734 - RNA, 64 nt, hsa; identical to SEQ ID NO: 247211

SEQ ID NO: 422735 - RNA, 64 nt, hsa; identical to SEQ ID NO: 247212

SEQ ID NO: 422736 - RNA, 64 nt, hsa; identical to SEQ ID NO: 247213

SEQ ID NO: 422737 - RNA, 64 nt, hsa; identical to SEQ ID NO: 247214

SEQ ID NO: 422738 - RNA, 64 nt, hsa; identical to SEQ ID NO: 247215

SEQ ID NO: 422739 - RNA, 64 nt, hsa; identical to SEQ ID NO: 247216

SEQ ID NO: 422740 - RNA, 64 nt, hsa; identical to SEQ ID NO: 247217

SEQ ID NO: 422741 - RNA, 64 nt, hsa; identical to SEQ ID NO: 247218

SEQ ID NO: 422742 - RNA, 64 nt, hsa; identical to SEQ ID NO: 247219

SEQ ID NO: 422743 - RNA, 64 nt, hsa; identical to SEQ ID NO: 247220

SEQ ID NO: 422744 - RNA, 64 nt, hsa; identical to SEQ ID NO: 247221

SEQ ID NO: 422745 - RNA, 64 nt, hsa; identical to SEQ ID NO: 247222

SEQ ID NO: 422746 - RNA, 64 nt, hsa; identical to SEQ ID NO: 247223

SEQ ID NO: 422747 - RNA, 64 nt, hsa; identical to SEQ ID NO: 247224

SEQ ID NO: 422748 - RNA, 64 nt, hsa; identical to SEQ ID NO: 247225

SEQ ID NO: 422749 - RNA, 64 nt, hsa; identical to SEQ ID NO: 247226

SEQ ID NO: 422750 - RNA, 64 nt, hsa; identical to SEQ ID NO: 247227

SEQ ID NO: 422751 - RNA, 64 nt, hsa; identical to SEQ ID NO: 247228

SEQ ID NO: 422752 - RNA, 64 nt, hsa; identical to SEQ ID NO: 247229

SEQ ID NO: 422753 - RNA, 64 nt, hsa; identical to SEQ ID NO: 247230

SEQ ID NO: 422754 - RNA, 64 nt, hsa; identical to SEQ ID NO: 247231

SEQ ID NO: 422755 - RNA, 64 nt, hsa; identical to SEQ ID NO: 247232

SEQ ID NO: 422756 - RNA, 64 nt, hsa; identical to SEQ ID NO: 247233

SEQ ID NO: 422757 - RNA, 64 nt, hsa; identical to SEQ ID NO: 247234

SEQ ID NO: 422758 - RNA, 64 nt, hsa; identical to SEQ ID NO: 247235

SEQ ID NO: 422759 - RNA, 64 nt, hsa; identical to SEQ ID NO: 247236

SEQ ID NO: 422760 - RNA, 64 nt, hsa; identical to SEQ ID NO: 247237

SEQ ID NO: 422761 - RNA, 64 nt, hsa; identical to SEQ ID NO: 247238

SEQ ID NO: 422762 - RNA, 64 nt, hsa; identical to SEQ ID NO: 247239

SEQ ID NO: 422763 - RNA, 64 nt, hsa; identical to SEQ ID NO: 247240

SEQ ID NO: 422764 - RNA, 64 nt, hsa; identical to SEQ ID NO: 247241

SEQ ID NO: 422765 - RNA, 64 nt, hsa; identical to SEQ ID NO: 247242

SEQ ID NO: 422766 - RNA, 64 nt, hsa; identical to SEQ ID NO: 247243

SEQ ID NO: 422767 - RNA, 64 nt, hsa; identical to SEQ ID NO: 247244

SEQ ID NO: 422768 - RNA, 64 nt, hsa; identical to SEQ ID NO: 247245

SEQ ID NO: 422769 - RNA, 64 nt, hsa; identical to SEQ ID NO: 247246

SEQ ID NO: 422770 - RNA, 64 nt, hsa; identical to SEQ ID NO: 247247

SEQ ID NO: 422771 - RNA, 64 nt, hsa; identical to SEQ ID NO: 247248

SEQ ID NO: 422772 - RNA, 64 nt, hsa; identical to SEQ ID NO: 247249

SEQ ID NO: 422773 - RNA, 64 nt, hsa; identical to SEQ ID NO: 247250

SEQ ID NO: 422774 - RNA, 64 nt, hsa; identical to SEQ ID NO: 247251

SEQ ID NO: 422775 - RNA, 64 nt, hsa; identical to SEQ ID NO: 247252

SEQ ID NO: 422776 - RNA, 64 nt, hsa; identical to SEQ ID NO: 84166

SEQ ID NO: 422777 - RNA, 64 nt, hsa; identical to SEQ ID NO: 84167

SEQ ID NO: 422778 - RNA, 64 nt, hsa; identical to SEQ ID NO: 84168

SEQ ID NO: 422779 - RNA, 64 nt, hsa; identical to SEQ ID NO: 84169

SEQ ID NO: 422780 - RNA, 64 nt, hsa; identical to SEQ ID NO: 84170

SEQ ID NO: 422781 - RNA, 64 nt, hsa; identical to SEQ ID NO: 84171

SEQ ID NO: 422782 - RNA, 64 nt, hsa; identical to SEQ ID NO: 84172

SEQ ID NO: 422783 - RNA, 64 nt, hsa; identical to SEQ ID NO: 84173

SEQ ID NO: 422784 - RNA, 64 nt, hsa; identical to SEQ ID NO: 84174

SEQ ID NO: 422785 - RNA, 64 nt, hsa; identical to SEQ ID NO: 84175

SEQ ID NO: 422786 - RNA, 64 nt, hsa; identical to SEQ ID NO: 84176

SEQ ID NO: 422787 - RNA, 64 nt, hsa; identical to SEQ ID NO: 84177

SEQ ID NO: 422788 - RNA, 64 nt, hsa; identical to SEQ ID NO: 84178

SEQ ID NO: 422789 - RNA, 64 nt, hsa; identical to SEQ ID NO: 84179

SEQ ID NO: 422790 - RNA, 64 nt, hsa; identical to SEQ ID NO: 84180

SEQ ID NO: 422791 - RNA, 64 nt, hsa; identical to SEQ ID NO: 84181

SEQ ID NO: 422792 - RNA, 64 nt, hsa; identical to SEQ ID NO: 84182

SEQ ID NO: 422793 - RNA, 64 nt, hsa; identical to SEQ ID NO: 84183

SEQ ID NO: 422794 - RNA, 64 nt, hsa; identical to SEQ ID NO: 84184

SEQ ID NO: 422795 - RNA, 64 nt, hsa; identical to SEQ ID NO: 84185

SEQ ID NO: 422796 - RNA, 64 nt, hsa; identical to SEQ ID NO: 84186

SEQ ID NO: 422797 - RNA, 64 nt, hsa; identical to SEQ ID NO: 84187

SEQ ID NO: 422798 - RNA, 64 nt, hsa; identical to SEQ ID NO: 84188

SEQ ID NO: 422799 - RNA, 64 nt, hsa; identical to SEQ ID NO: 84189

SEQ ID NO: 422800 - RNA, 64 nt, hsa; identical to SEQ ID NO: 84190

SEQ ID NO: 422801 - RNA, 64 nt, hsa; identical to SEQ ID NO: 84191

SEQ ID NO: 422802 - RNA, 64 nt, hsa; identical to SEQ ID NO: 84192

SEQ ID NO: 422803 - RNA, 64 nt, hsa; identical to SEQ ID NO: 84193

SEQ ID NO: 422804 - RNA, 64 nt, hsa; identical to SEQ ID NO: 84194

SEQ ID NO: 422805 - RNA, 64 nt, hsa; identical to SEQ ID NO: 84195

SEQ ID NO: 422806 - RNA, 64 nt, hsa; identical to SEQ ID NO: 84196

SEQ ID NO: 422807 - RNA, 64 nt, hsa; identical to SEQ ID NO: 84197

SEQ ID NO: 422808 - RNA, 64 nt, hsa; identical to SEQ ID NO: 84198

SEQ ID NO: 422809 - RNA, 64 nt, hsa; identical to SEQ ID NO: 84199

SEQ ID NO: 422810 - RNA, 64 nt, hsa; identical to SEQ ID NO: 84200

SEQ ID NO: 422811 - RNA, 64 nt, hsa; identical to SEQ ID NO: 84201

SEQ ID NO: 422812 - RNA, 64 nt, hsa; identical to SEQ ID NO: 84202

SEQ ID NO: 422813 - RNA, 64 nt, hsa; identical to SEQ ID NO: 84203

SEQ ID NO: 422814 - RNA, 64 nt, hsa; identical to SEQ ID NO: 84204

SEQ ID NO: 422815 - RNA, 64 nt, hsa; identical to SEQ ID NO: 84205

SEQ ID NO: 422816 - RNA, 64 nt, hsa; identical to SEQ ID NO: 84206

SEQ ID NO: 422817 - RNA, 64 nt, hsa; identical to SEQ ID NO: 84207

SEQ ID NO: 422818 - RNA, 64 nt, hsa; identical to SEQ ID NO: 84208

SEQ ID NO: 422819 - RNA, 64 nt, hsa; identical to SEQ ID NO: 84209

SEQ ID NO: 422820 - RNA, 64 nt, hsa; identical to SEQ ID NO: 84210

SEQ ID NO: 422821 - RNA, 64 nt, hsa; identical to SEQ ID NO: 84211

SEQ ID NO: 422822 - RNA, 64 nt, hsa; identical to SEQ ID NO: 84212

SEQ ID NO: 422823 - RNA, 64 nt, hsa; identical to SEQ ID NO: 84213

SEQ ID NO: 422824 - RNA, 64 nt, hsa; identical to SEQ ID NO: 84214

SEQ ID NO: 422825 - RNA, 64 nt, hsa; identical to SEQ ID NO: 84215

SEQ ID NO: 422826 - RNA, 64 nt, hsa; identical to SEQ ID NO: 84216

SEQ ID NO: 422827 - RNA, 64 nt, hsa; identical to SEQ ID NO: 84217

SEQ ID NO: 422828 - RNA, 64 nt, hsa; identical to SEQ ID NO: 84218

SEQ ID NO: 422829 - RNA, 64 nt, hsa; identical to SEQ ID NO: 84219

SEQ ID NO: 422830 - RNA, 64 nt, hsa; identical to SEQ ID NO: 84220

SEQ ID NO: 422831 - RNA, 64 nt, hsa; identical to SEQ ID NO: 84221

SEQ ID NO: 422832 - RNA, 64 nt, hsa; identical to SEQ ID NO: 84222

SEQ ID NO: 422833 - RNA, 64 nt, hsa; identical to SEQ ID NO: 84223

SEQ ID NO: 422834 - RNA, 64 nt, hsa; identical to SEQ ID NO: 84224

SEQ ID NO: 422835 - RNA, 64 nt, hsa; identical to SEQ ID NO: 84225

SEQ ID NO: 422836 - RNA, 64 nt, hsa; identical to SEQ ID NO: 84226

SEQ ID NO: 422837 - RNA, 64 nt, hsa; identical to SEQ ID NO: 84227

SEQ ID NO: 422838 - RNA, 64 nt, hsa; identical to SEQ ID NO: 84228

SEQ ID NO: 422839 - RNA, 64 nt, hsa; identical to SEQ ID NO: 84229

SEQ ID NO: 422840 - RNA, 64 nt, hsa; identical to SEQ ID NO: 84230

SEQ ID NO: 422841 - RNA, 64 nt, hsa; identical to SEQ ID NO: 84231

SEQ ID NO: 422842 - RNA, 64 nt, hsa; identical to SEQ ID NO: 84232

SEQ ID NO: 422843 - RNA, 64 nt, hsa; identical to SEQ ID NO: 84233

SEQ ID NO: 422844 - RNA, 64 nt, hsa
uuuaaaaaguuauuuuuuacccuaauacuuuucuccacugaauauuauuauuuuuuucuuagcu

SEQ ID NO: 422845 - RNA, 64 nt, hsa
ucugcagugaucauaagugcuuugugcccagaggccacugaagaugguaggcaggauucuuucc

SEQ ID NO: 422846 - RNA, 64 nt, hsa
gguucagugccuuccucucucuaccagucuauuuccacugaacaaaaccuacgcacauaccuuc

SEQ ID NO: 422847 - RNA, 64 nt, hsa
gauucacugccuuccucucucuaccagucuauuuccacugaacaaaaccuacacacauaccuuc

SEQ ID NO: 422848 - RNA, 64 nt, hsa
gguccagcuccauacccuaaauucugaguuucagccacugaacuccaagguccacuucucacca

SEQ ID NO: 422849 - RNA, 64 nt, hsa
gcucacucugguuacaagcccuguucuuccucucccacugaauucuaaauccuuaacauccagg

SEQ ID NO: 422850 - RNA, 64 nt, hsa
uguuuuugagugccacuguuugccaucaucuaagccacugaaucaaguguauuucaggcuuauu

SEQ ID NO: 422851 - RNA, 64 nt, hsa
uugucccuauguaggaugcaccgcaggccccuggccacugaaagagugugcaguggacuguggg

SEQ ID NO: 422852 - RNA, 64 nt, hsa
uggcuagugcgauuucacagucuacugccuguuuccacugaaaacauuuuugucauauucuugu

SEQ ID NO: 422853 - RNA, 64 nt, hsa
aaguuauuaggagagauacucucuccuguuuucuccacugaacgagacucaucuugcucuucua

SEQ ID NO: 422854 - RNA, 64 nt, hsa
ucggcacuccugggcuuccgaugcucccucugaaccacugaaagcugugauguccaagggggcu

SEQ ID NO: 422855 - RNA, 64 nt, hsa
ggcaucuacuuaacacugaccagaggaugugaagccacugaaagcuugacucagggaaaagaaa

SEQ ID NO: 422856 - RNA, 64 nt, hsa
ugucccaguuaacuguuaaauaaggccucauccuccacugaagaguauggauugaaggauugug

SEQ ID NO: 422857 - RNA, 64 nt, hsa
cuacacguuggaguauaccuaugugugugcuuugccacugaaguaagauuuugccuguauggua

SEQ ID NO: 422858 - RNA, 64 nt, hsa
aggguaacugcuuaaggcugcagacuaggaaaugggauuccagguuuaagauagcuccuuucug

SEQ ID NO: 422859 - RNA, 64 nt, hsa
ccccaccaacaccguccagagaggccugagggagggauuccaugcugccuucuccggacucugc

SEQ ID NO: 422860 - RNA, 64 nt, hsa
gcucaggagugucugcacacugucucggaagccaggauuccauuuguguugcugcuguauuuuc

SEQ ID NO: 422861 - RNA, 64 nt, hsa
cucuuucuccugaccaucaugggaagugucugcuggauuccauuuucuaagaguuucugagggu

SEQ ID NO: 422862 - RNA, 64 nt, hsa
ucagguuucugaaugcagacccaccacgagggauggauuccacccgcccgcccugcugcagaua

SEQ ID NO: 422863 - RNA, 64 nt, hsa
aggccuggccuuugcagcauaguugggagcuucuggauuccaucugcaccugugagccccaugc

SEQ ID NO: 422864 - RNA, 64 nt, hsa
uuccuucuugccuguagcuccugcuggaggaagaggauuccagccuguuggccccugucuucga

SEQ ID NO: 422865 - RNA, 64 nt, hsa
aucuauaaacguguuugcaugaguuuacaucccaggauuccaugauucuguaaaugccuaugca

SEQ ID NO: 422866 - RNA, 64 nt, hsa; identical to SEQ ID NO: 60301

SEQ ID NO: 422867 - RNA, 64 nt, hsa; identical to SEQ ID NO: 60302

SEQ ID NO: 422868 - RNA, 64 nt, hsa; identical to SEQ ID NO: 60303

SEQ ID NO: 422869 - RNA, 64 nt, hsa; identical to SEQ ID NO: 60304

SEQ ID NO: 422870 - RNA, 64 nt, hsa; identical to SEQ ID NO: 60305

SEQ ID NO: 422871 - RNA, 64 nt, hsa; identical to SEQ ID NO: 60306

SEQ ID NO: 422872 - RNA, 64 nt, hsa; identical to SEQ ID NO: 60307

SEQ ID NO: 422873 - RNA, 64 nt, hsa; identical to SEQ ID NO: 60308

SEQ ID NO: 422874 - RNA, 64 nt, hsa; identical to SEQ ID NO: 60309

SEQ ID NO: 422875 - RNA, 64 nt, hsa; identical to SEQ ID NO: 60310

SEQ ID NO: 422876 - RNA, 64 nt, hsa
uuuagauugcccuguauuuuguuaacauguauauauguacaacaguguguuuguaaauauauag

SEQ ID NO: 422877 - RNA, 64 nt, hsa
gcuuuugucaguaauggaaucuuuuguuuuuaaaauguacaaaccuauaaguuuaaacagguuu

SEQ ID NO: 422878 - RNA, 64 nt, hsa
auuuuuuaagucauuuuuuuuucuugaaauggauauguacaaauaaaauaaauggaagacagga

SEQ ID NO: 422879 - RNA, 64 nt, hsa
cuuccaccuggaggcucccuugucucccagccccauguacaaagcucaccaagccccugcccau

SEQ ID NO: 422880 - RNA, 64 nt, hsa
ggggaaauuguaaagaauuagcagaauuaggcauauguacaaaaccaaaauuuugucaugaaau

SEQ ID NO: 422881 - RNA, 64 nt, hsa
uggccugugacauuauccuguucagagcuuggagauguacaagggacauaggagcaauuuacac

SEQ ID NO: 422882 - RNA, 64 nt, hsa
acucauauaaaaauuauauuuagaauuuuuaaacauguacaaagggcuacauuuuaauuuuaaa

SEQ ID NO: 422883 - RNA, 64 nt, hsa
ccaaggagccagcuagaaagaagcuuuugauuagauguacaauacauugggggcagaagaucug

SEQ ID NO: 422884 - RNA, 64 nt, hsa
uuggauagucagucaauuauuuguguaugaaacaauguacaaaucaauguuuugaaaauaauga

SEQ ID NO: 422885 - RNA, 64 nt, hsa
cugccauccguucucccagucccaaggguccacgauguacaaagucauuucggccaguaggugu

SEQ ID NO: 422886 - RNA, 64 nt, hsa
agcaguuuauauaaagauacauauguguaaauauauguacaaaaauuacugaaaggcuucaguu

SEQ ID NO: 422887 - RNA, 64 nt, hsa
uaacuagaguggggagcaugccagagagagcucaauguacaaaugaaugccucauggcucuuag

SEQ ID NO: 422888 - RNA, 64 nt, hsa
aauaguguuuccuuuuuuuuuuuuuuuuuugaaaauguacaaaauaucuaucacuacugauagg

SEQ ID NO: 422889 - RNA, 64 nt, hsa
gauuuuguuucccaucucuuucuagguguuugcaauguacaaauaauacagcugugcuaaucuc

SEQ ID NO: 422890 - RNA, 64 nt, hsa
caagaucuuuucagagugguguuucuaaaagagcauguacaaaaguggccuguggacauuuagg

SEQ ID NO: 422891 - RNA, 64 nt, hsa
cgaaagcacugaauuuugcuucaaagaacuguguauguacaagagaaauccugcauaaccccau

SEQ ID NO: 422892 - RNA, 64 nt, hsa
aaaucauuagcaaaacauaggacuuagaauguuaauguacaaguuaagacuaaaguuuaaggac

SEQ ID NO: 422893 - RNA, 64 nt, hsa
auuuugacauaauguauuaacauuuuaauauauaauguacaauuuaagaauuggugcuuuaccu

SEQ ID NO: 422894 - RNA, 64 nt, hsa
uaucagucagugcuggagaaaucuugaauagcuuauguacaaaacuuuuuaaauuuuauauuau

SEQ ID NO: 422895 - RNA, 64 nt, hsa
ccugcugucuuacaccaguggagcuacccuuuaaauguacaaauuauuuguaugcuaauguaau

SEQ ID NO: 422896 - RNA, 64 nt, hsa
cugagaggugggagaugauuggaggccauggccuauguacaaacauacuggaagaaaaccagcu

SEQ ID NO: 422897 - RNA, 64 nt, hsa
cuaugaagaugaaaauagggguuaaguuuuccauauguacaaggagguauugagaggaacccua

SEQ ID NO: 422898 - RNA, 64 nt, hsa
uuuagacacaggguagaauuagagacaauauuggauguacaauuccucaggagacuacaguagu

SEQ ID NO: 422899 - RNA, 64 nt, hsa
uaaauggcucacaagucaauugcaaacaaacugaauguacaaaucuuagugcuggugcugaaau

SEQ ID NO: 422900 - RNA, 64 nt, hsa
uucuggaguucuuguccugguucuagcugcucacauguacaaaucacuucuaggccucaguuuc

SEQ ID NO: 422901 - RNA, 64 nt, hsa
ugcugcagugugaagcuccuucugggguuaucguauguacaaaguuuaccuuauaauggcucaa

SEQ ID NO: 422902 - RNA, 64 nt, hsa
uuauuugaggacaucagucaccuuugggguugccauguacaaugagauuuauaaucaugauacu

SEQ ID NO: 422903 - RNA, 64 nt, hsa
guacuuuuuaaaauuauuucucacaaagaaaugaauguacaauccaaugaaaacauuuguuauu

SEQ ID NO: 422904 - RNA, 64 nt, hsa
guugguuuuucccaugacuguauugcuuuuauaaauguacaaauaguuacugaaaugacgagac

SEQ ID NO: 422905 - RNA, 64 nt, hsa
cuugagcacucagucuagugaagauguugucauuauguacaauacauaacuaguuuaauuaacu

SEQ ID NO: 422906 - RNA, 64 nt, hsa
gauaucagaaauguaaauauuguacaguauugucauguacaagcguaccuaaugcacacuuuau

SEQ ID NO: 422907 - RNA, 64 nt, hsa
cccaugcuacuaguuucucugucuauucacacauauguacaaauacaugaacacagccugucug

SEQ ID NO: 422908 - RNA, 64 nt, hsa
guaugccauuguucaugccuuaagaaaugcaaagauguacaauaaaucauuuuuaaaaugugug

SEQ ID NO: 422909 - RNA, 64 nt, hsa
acaaaucaauauuguaagcauucauuauuuaagaauguacaauguauuuguguaauuuauagaa

SEQ ID NO: 422910 - RNA, 64 nt, hsa
accauuucaaccuuucgggagagucagagcuaggauguacaagaacugauucuaaccagaaguc

SEQ ID NO: 422911 - RNA, 64 nt, hsa
gcccuguuucggaccugcacuucaccucuaaguuauguacaacucaaccugcaucccucuaaaa

SEQ ID NO: 422912 - RNA, 64 nt, hsa
uaguaucaguuuuggauucuuauuguuaucaccuauguacaauggaaagggauuuuaagcacaa

SEQ ID NO: 422913 - RNA, 64 nt, hsa
cagccaucaaaaauaaggauuaauuuagaagauaauguacaauauguguccaugagaaguaagu

SEQ ID NO: 422914 - RNA, 64 nt, hsa
aauaugguacucauuaaaaaaaaaaaaaaaagugauguacaaccacuucggaaaacaauuuggc

SEQ ID NO: 422915 - RNA, 64 nt, hsa
uuguaaaagaaguaauugcuagaaacauuugauaauguacaaaguagucuauaaugacuguuca

SEQ ID NO: 422916 - RNA, 64 nt, hsa
cuaagaauuuauguagauaauguacuuuuaugagauguacaaguaagugucuuaucuguacaga

SEQ ID NO: 422917 - RNA, 64 nt, hsa
caccuggaggcauggaguugugugcauccugcuuauguacaauuguuuucaguguuucuaagaa

SEQ ID NO: 422918 - RNA, 64 nt, hsa
uaggauuugcucacauaguuccugcaaacuucagauguacaaguugcacuuguacuuuuauaga

SEQ ID NO: 422919 - RNA, 64 nt, hsa
ggacucagcccguggccggcagaugccauccaggauguacaaggugcagccaaggcaggccaug

SEQ ID NO: 422920 - RNA, 64 nt, hsa
gcuguggccagggccccaccucccucucucagauauguacaauaauuuaacacgguugccugaa

SEQ ID NO: 422921 - RNA, 64 nt, hsa
uuccauaauggaugggacagagagcugggaucuaauguacaagugaagggcuuggucuucccug

SEQ ID NO: 422922 - RNA, 64 nt, hsa
uguaugaaaccuugucaaaauguacuccacaaguauguacaauuaaguauuuuaaaaauaaaug

SEQ ID NO: 422923 - RNA, 64 nt, hsa
uuuuuuaauuauuguuuauauuuucaauucaaaaauguacaaaauaaaguuacauugcuggucu

SEQ ID NO: 422924 - RNA, 64 nt, hsa
cauuuugaagcuaauuauuuuaauuagguuaacuauguacaauauuuuaagcauuacucuugua

SEQ ID NO: 422925 - RNA, 64 nt, hsa
agcaaguuauaucagugaaguaagauccuuuugaauguacaaagacccacacuauugagacagc

SEQ ID NO: 422926 - RNA, 64 nt, hsa
auuccaaaguaacauguaauuguuucuaaaagaaauguacaaacuagaauuuuaauauaaagaa

SEQ ID NO: 422927 - RNA, 64 nt, hsa
uauguccaaggacucuaaauugagacucuuccacauguacaaucucaucauccugaagccuaua

SEQ ID NO: 422928 - RNA, 64 nt, hsa
aucuguaaguuuugaauuuauauuguuucaucccauguacaaaaccauuuuuuccuacaaauag

SEQ ID NO: 422929 - RNA, 64 nt, hsa
auggaguagccuggacuguuucauaguuuucuaaauguacaaauucuuauaggcuagacuuaga

SEQ ID NO: 422930 - RNA, 64 nt, hsa
ugaucugaacagaaauaccaaaauuauuucagaaauguacaacuuuuuaccuaguacaaggcaa

SEQ ID NO: 422931 - RNA, 64 nt, hsa
caauuuuuuucccuugagaugaggucugugccugauguacaacggauacuccauaaauguuuga

SEQ ID NO: 422932 - RNA, 64 nt, hsa
aaauaaaagccaagaagaggaaacaagauaauaaauguacaaaacaugaaaauuaaaaugaaca

SEQ ID NO: 422933 - RNA, 64 nt, hsa
gaguggcccuuuaacucuauuuggcuaucugaggauguacaaaauucucauuuaauuuucuggu

SEQ ID NO: 422934 - RNA, 64 nt, hsa
cauccuguaacuucuguccaaaaagaacaggaugauguacaaauugcucuuccagguaauccac

SEQ ID NO: 422935 - RNA, 64 nt, hsa
guucaaggggaacuugggaccagaaaccacuguuauguacaaaaaaauggcaaauucaauaaac

SEQ ID NO: 422936 - RNA, 64 nt, hsa
agccagucauuguaaccucgugucuaguagaacaauguacaagguauguacaguucauaaauuu

SEQ ID NO: 422937 - RNA, 64 nt, hsa
ugagaggcaaugugaaagagggaguauuacuuuuauguacaaaguuauuuauuuauagaaauuu

SEQ ID NO: 422938 - RNA, 64 nt, hsa
auauggcguuucuauuuuuuuaagauaauuuaguauguacaaaaguauccaaauuuaaauauag

SEQ ID NO: 422939 - RNA, 64 nt, hsa
gggcagccacuucauauaaagguuacuccagaccauguacaaaacacagccacucuugaaauca

SEQ ID NO: 422940 - RNA, 64 nt, hsa
auaagaauguggaacccgccauggcccccaaccaauguacaagcuauuauuuagaguguuuaga

SEQ ID NO: 422941 - RNA, 64 nt, hsa
uauuuuggauuagugaacuaaguuauuguuaauuauguacaacauuuauauauugucuguaaaa

SEQ ID NO: 422942 - RNA, 64 nt, hsa
auauuuggcuuuaaguuguuguuuguguuuuuuaauguacaauguucugauaaauuugacuguu

SEQ ID NO: 422943 - RNA, 64 nt, hsa
auguguaggccuuuuauuguuuguuggaaucgauauguacaaaguguaaauaaauguuucuuuu

SEQ ID NO: 422944 - RNA, 64 nt, hsa
uaauuuguuguaauaaaguccaguauuuaauaaaauguacaauguuaaaucucagccaaccucu

SEQ ID NO: 422945 - RNA, 64 nt, hsa
ugcugaauaaagaccgaugaagagguuugaguagauguacaaaucaaguaaugguuugaacacc

SEQ ID NO: 422946 - RNA, 64 nt, hsa
uuucaccagucuauguaucucuggagugagaucuauguacaaagugacauacaauuggaaaucc

SEQ ID NO: 422947 - RNA, 64 nt, hsa
uucuaaccugaaggauacccagauuucuuucuuuauguacaagauggaaaauccccuaccccuc

SEQ ID NO: 422948 - RNA, 64 nt, hsa
caugcuuuggcuuaaacuguaauuaauuuauuuuauguacaauaaaucgcauuugaaaaagagc

SEQ ID NO: 422949 - RNA, 64 nt, hsa
cugccucccacuccauaccccgccaaggaaaggcauguacaaaaauuaugcaauucaguguucc

SEQ ID NO: 422950 - RNA, 64 nt, hsa
uuaguaauuucuugcugguugaaacuuguuuauuauguacaaauagauucuuauaauauuauuu

SEQ ID NO: 422951 - RNA, 64 nt, hsa
gaauagaaagcaauguuaucgucauauaauuuucauguacaaaugccacaaauaaauugaaugu

SEQ ID NO: 422952 - RNA, 64 nt, hsa
ugacacuauguaggaauccuuccaaggaauaucuauguacaauguauauagcugaaaugcucag

SEQ ID NO: 422953 - RNA, 64 nt, hsa
gcaauguguacaauggcugauuuaauuaaauaaaauguacaaguguuaaauguggcaacgguga

SEQ ID NO: 422954 - RNA, 64 nt, hsa
gaguuucaucuggggaugaaagcuauggaagaugauguacaaauguuauugauggagaaaaugg

SEQ ID NO: 422955 - RNA, 64 nt, hsa
cucgaaccgcugugucuccuacguaaaaaaagagauguacaaaucaauaauaauuacacuuuua

SEQ ID NO: 422956 - RNA, 64 nt, hsa
auuuguggaauaauguaaaauguugaauaaaaauauguacaaguguuguuuuuuaaguugcacu

SEQ ID NO: 422957 - RNA, 64 nt, hsa
cuacauagacuaaaauauuccaugguggugaaggauguacaagcuugugaauauguaaauuuua

SEQ ID NO: 422958 - RNA, 64 nt, hsa
aaacuugauccugaaguuuuagaauggcaaauaaauguacaauuguuuacauaacagaaaaggc

SEQ ID NO: 422959 - RNA, 64 nt, hsa
caccagguauuuaacauuaacuuuggaaacaaaaauguacaauuaaguaaagucaacauaugca

SEQ ID NO: 422960 - RNA, 64 nt, hsa
aaaauggaugacaucaaacauuuuuaacaaaaugauguacaaacuaaggacuauuuauugauaa

SEQ ID NO: 422961 - RNA, 64 nt, hsa
cucugguggaugcaaugauguuucugaaacugcuauguacaaccuacccuguguauaacauuuc

SEQ ID NO: 422962 - RNA, 64 nt, hsa
gauacuguaaauacaaguaccauuuuaauaaagcauguacaauaaaccaaaauaagcuugaguu

SEQ ID NO: 422963 - RNA, 64 nt, hsa
uguguugccccuccuccgcaugccaacgcaguucauguacaaggccccucugcaacuggagaga

SEQ ID NO: 422964 - RNA, 64 nt, hsa
aaauggaaaaaaaaaacaaaaaaaaaacaaaaaaauguacaauggaugcauugaaauuauaugu

SEQ ID NO: 422965 - RNA, 64 nt, hsa
ucuuucuaaguguccuuggauuuauagacaauguauguacaauccaaauagaggagcuuaaugg

SEQ ID NO: 422966 - RNA, 64 nt, hsa
aaaauaaaucacccuaagugacacaaauugaagcauguacaaauuauacauaauaaaguguuuu

SEQ ID NO: 422967 - RNA, 64 nt, hsa
uaugguagacaauuugccuuaggaagugacuugaauguacaaagauacuugaugcacuuauuuu

SEQ ID NO: 422968 - RNA, 64 nt, hsa
accguguuuguuuuuaaucaaauauuaccuaaaaauguacaaauuagugaaaugguuaaacuuc

SEQ ID NO: 422969 - RNA, 64 nt, hsa
ggucagcagaguuauugaaucuuaauuuuuuuuaauguacaaguuuuguauaaauaauaaagaa

SEQ ID NO: 422970 - RNA, 64 nt, hsa
uguuuuaaaaaguguuucagauauuucucuaauuauguacaaccuaaaauguugguguuuugua

SEQ ID NO: 422971 - RNA, 64 nt, hsa
ugugaaauuuaugcuauaacauuuuuacaauaagauguacaauuuauuaccuauauggaagugg

SEQ ID NO: 422972 - RNA, 64 nt, hsa
uuguuguguugguggcacauuggauauuucuaacauguacaaagcuauguauuuugauuuacuu

SEQ ID NO: 422973 - RNA, 64 nt, hsa
agaaaguguuuauuuauauaucuauacauguuguauguacaaauauccuacuacuuuuaaucug

SEQ ID NO: 422974 - RNA, 64 nt, hsa
uaaaauucuagcaccacuagaauaaucacauagcauguacaauauauuuaugcuggcugaaaag

SEQ ID NO: 422975 - RNA, 64 nt, hsa
gucaccuuaaauaagacauuuuaauuuuguuauaauguacaauuuagaaguuugauuaauuaua

SEQ ID NO: 422976 - RNA, 64 nt, hsa
aucucaagauaggaagaaaauuuccuccacauucauguacaaugauguaaauauuucaauaacu

SEQ ID NO: 422977 - RNA, 64 nt, hsa
gccacauaaggcuauuuaaauuaauucaaauuaaauguacaauucagucacucauucucaucaa

SEQ ID NO: 422978 - RNA, 64 nt, hsa
cuugguauuguugauucgucgccgagucaggcucauguacaaaggcauguuucguguugauugu

SEQ ID NO: 422979 - RNA, 64 nt, hsa
ucaauuauuuacaucaaauaaugaaauaacugaaauguacaaaugucaaauuuuggaaguauau

SEQ ID NO: 422980 - RNA, 64 nt, hsa
guugcuccccccuuuguaugaugcaaaugcugaaauguacaaaaucaaccaugacaacaaagaa

SEQ ID NO: 422981 - RNA, 64 nt, hsa
cucacuucuuuucagguguagcuacaauuguguaauguacaauauuagagaaaggacaggcuuu

SEQ ID NO: 422982 - RNA, 64 nt, hsa
aaacaaauuaauaaauuaucuuuuacauaaaaacauguacaauauuguuuauggauuuacuucu

SEQ ID NO: 422983 - RNA, 64 nt, hsa
aaaauaugauauuuuaaccucauaucuaauaaguauguacaaagguaaccaucacuccuuaaau

SEQ ID NO: 422984 - RNA, 64 nt, hsa
auuuaggauaaucuuuaugguucuacuuccuguaauguacaauuuuauauaauucugaaauguu

SEQ ID NO: 422985 - RNA, 64 nt, hsa
uuuuaaauccuuacucauacacuuguugggagggauguacaaugcauauucccaaacuguggaa

SEQ ID NO: 422986 - RNA, 64 nt, hsa
aaccauuguuacuaucuccuuugagcuuaggaaaauguacaagagaacaaauuaaaauugaaaa

SEQ ID NO: 422987 - RNA, 64 nt, hsa
cuacuuggaucccaugccugaaauuuggaagcauauguacaaaaaucauuuuuacguuuuauuu

SEQ ID NO: 422988 - RNA, 64 nt, hsa
gcaaguuguagaaaguuauauacaaauuauauauauguacaaaacaauacuaugcauucucuau

SEQ ID NO: 422989 - RNA, 64 nt, hsa
uguguaaauuguguuauuauguauauggguaaagauguacaaauauauguccucuuuguagcag

SEQ ID NO: 422990 - RNA, 64 nt, hsa
ugagcgccuacuauguacuaaugcuagauguuagauguacaaagaagacaguuuucauccucua

SEQ ID NO: 422991 - RNA, 64 nt, hsa
uaauaccuacaaguugaacuucuaagaugcguauauguacaauuuggugccauuauuucuccua

SEQ ID NO: 422992 - RNA, 64 nt, hsa
auacaaaaaacaaaaacaaaaaaaaaagaggguaauguacaaguuucuguauguauaaagucau

SEQ ID NO: 422993 - RNA, 64 nt, hsa
auagaacaauguuuaugcuauagccauuuaauauauguacaaauuguaaagaauauguauaaau

SEQ ID NO: 422994 - RNA, 64 nt, hsa
gucuugucagccucucuaguuccccuuggccugcauguacaaacuucuacccuagaagcucucu

SEQ ID NO: 422995 - RNA, 64 nt, hsa
ggauugaaagugaaaauuauguuccuagaacaaaauguacaaaaagaacaauauaauuuucaca

SEQ ID NO: 422996 - RNA, 59 nt, hsa
aagauugggaaggaaauuaaaaacugaaaauguacaauuaucauuuaggcuaucucaag

SEQ ID NO: 422997 - RNA, 64 nt, hsa
uuaagccugugaccuggcaaguguuuuguuugguauguacaaaauggucagagcuaguuggaga

SEQ ID NO: 422998 - RNA, 64 nt, hsa
auggcuuggauaucugauguuuucaaauacaaaaauguacaauuuauccuuugagagagaauca

SEQ ID NO: 422999 - RNA, 64 nt, hsa
uacuuguugaucucugaauagcucacuucuuacaauguacaaauuccucauucugucaccuuuu

SEQ ID NO: 423000 - RNA, 64 nt, hsa
cagaugcuuguguauccucagaccaaacugauucauguacaaauaauaaaauguuuacucuuuu

SEQ ID NO: 423001 - RNA, 64 nt, hsa
ucauuaguuuuccaauacaauauaaguugaaacaauguacaauauuguauauucuuuguugcaa

SEQ ID NO: 423002 - RNA, 64 nt, hsa
cagauugaauuaauuugaggaugggauuauucuaauguacaaccacggcugagaaccacugccg

SEQ ID NO: 423003 - RNA, 64 nt, hsa
agaagcugcuuuuucacacugaaaccauuuaaguauguacaaauaaguuaauaguguaaaugua

SEQ ID NO: 423004 - RNA, 64 nt, hsa
aaaaauaugggaaaacauuccaccccauguaaauauguacaagugcaucacugguacaauuuua

SEQ ID NO: 423005 - RNA, 64 nt, hsa
uacuuaggguggguauaccuaaauuauaaaccuuauguacaagucaguaagccuuagggaaggu

SEQ ID NO: 423006 - RNA, 64 nt, hsa
auguucguuuuuuauaauuuaaauuuugguaaauauguacaaaggcacuucgggucuaugugac

SEQ ID NO: 423007 - RNA, 64 nt, hsa
aaacuguauuauauugccuuauuuauuuuuaaucauguacaauauucauguacaaauguuagag

SEQ ID NO: 423008 - RNA, 64 nt, hsa
uugccuuauuuauuuuuaaucauguacaauauucauguacaaauguuagagccauucggguagg

SEQ ID NO: 423009 - RNA, 64 nt, hsa
uuacuagcauuuauccuuuguauuuuauuuuaaaauguacaacuaaauuguuauggacuacagg

SEQ ID NO: 423010 - RNA, 64 nt, hsa
accucacucagaaagacuaaaggaaauguaauuuauguacaaaauguauauucggauauguauc

SEQ ID NO: 423011 - RNA, 64 nt, hsa
augcagucuuuuuuaagagagcagagaguaucagauguacaauuauggaaauaagaacauuacu

SEQ ID NO: 423012 - RNA, 64 nt, hsa
gcuucaucaaauaagcauguugugauaaugauagauguacaauuccaacaagguuauuauuuuu

SEQ ID NO: 423013 - RNA, 64 nt, hsa
agcuucaccaaugcugcuccugaccaauggaaauauguacaacuucagcauuuuaaguaacugg

SEQ ID NO: 423014 - RNA, 64 nt, hsa
cuuuuguagcagugguuauauugcuuauaauuuaauguacaauacuauugaaacuggugaguuc

SEQ ID NO: 423015 - RNA, 64 nt, hsa
gacucaaauuuuguaccaaguaaauccaggcuuuauguacaaacauguuguuuguuuuauuugg

SEQ ID NO: 423016 - RNA, 64 nt, hsa
uuguuuuuuuuuuuagaaaaacaccacuuuuauuauguacaauaaaauauuucauuagcuugaa

SEQ ID NO: 423017 - RNA, 64 nt, hsa
cuuccugcaaaaugucuuuuucucacuuauuuuuauguacaauauugauagugagagguauguc

SEQ ID NO: 423018 - RNA, 64 nt, hsa
agcaaguucaaaagaacucugguaauuuuccuguauguacaauuuaaagagugaauaagauuau

SEQ ID NO: 423019 - RNA, 64 nt, hsa
uaguugauugcuguaacuuuuucauuuucaaaccauguacaauucuuguauagaccaacuuguu

SEQ ID NO: 423020 - RNA, 64 nt, hsa
uucucuuaacagcuguuguaaaguuuauuacuuuauguacaacugaaguuuuguuuuaguuuug

SEQ ID NO: 423021 - RNA, 64 nt, hsa
aauuaucaaguuggaaccaagaaauagcaaggaaauguacaauuuuaucuucuggcaaagggac

SEQ ID NO: 423022 - RNA, 64 nt, hsa
gagcaaaagcuugugccuuuguuucugguuucugauguacaagccccuggggcucuguugaacc

SEQ ID NO: 423023 - RNA, 64 nt, hsa
acagguagcaaaauaucacauacacccccaaaauauguacaaauauuauauaucaauaaauaaa

SEQ ID NO: 423024 - RNA, 64 nt, hsa
gagaccaugccacuagcuuuuaagggcuaccaagauguacaacagaacaugauagcccauugag

SEQ ID NO: 423025 - RNA, 64 nt, hsa
auaaagacuuucuacuuaaaauauguggguugaaauguacaauucugaaauaaccugggaauau

SEQ ID NO: 423026 - RNA, 64 nt, hsa
gguuccaaccacaguggugaagcagcgcuugcagauguacaacucgcagcaccggucagcaauc

SEQ ID NO: 423027 - RNA, 64 nt, hsa
cuuggaggaauaagaaaaauuguacauccauuaaauguacaauugauugcaacaucuugauugu

SEQ ID NO: 423028 - RNA, 64 nt, hsa
uaauuuaacuuacaaugugaaaauacaaugugaaauguacaauaaaucauauuuauggacagau

SEQ ID NO: 423029 - RNA, 64 nt, hsa
ugcuuuccacaucuaaaagaguuaucuuucauauauguacaaguuauugguagucuuauuuuug

SEQ ID NO: 423030 - RNA, 64 nt, hsa
augagcaggaaaaggcacauacucaguuuuuuaaauguacaaucaacaaguaaaaauaaccuca

SEQ ID NO: 423031 - RNA, 64 nt, hsa
agaugcacaaugauuauucaaacaagcuauauauauguacaaaggcaaacagacacauaacagu

SEQ ID NO: 423032 - RNA, 64 nt, hsa
auuaauguguaaaucacaaguaaaaugaauucuaauguacaaguuuguuuuaaaaaguguaugu

SEQ ID NO: 423033 - RNA, 64 nt, hsa
guagguuugugucuuaaacuagguguucuaaucaauguacaagacuuuaccauacacgcaacua

SEQ ID NO: 423034 - RNA, 64 nt, hsa
gguuaggcuaaccugcccuggcccaaagccagacauguacaagggcuuucugugagcaaugaua

SEQ ID NO: 423035 - RNA, 64 nt, hsa
auauugaaccucauucaguuucacuuccacauguauguacaaguuaggucaccaaacacggaag

SEQ ID NO: 423036 - RNA, 64 nt, hsa
aguaaauugucugccuccuauagcagaaaggugaauguacaaacuguugguggcccugaaucca

SEQ ID NO: 423037 - RNA, 64 nt, hsa
ccagaaaaaaauguauauuagcuauuuugauuuuauguacaaugauuuauacucuccuuuugaa

SEQ ID NO: 423038 - RNA, 64 nt, hsa
aaaaagccuacaacauagaugcauuuagcaaaccauguacaaaucaaucacuauaauaaacugc

SEQ ID NO: 423039 - RNA, 64 nt, hsa
caaagaggaaauggacagcaugcaauucauccuaauguacaaaacguuauaugcacucaaaugu

SEQ ID NO: 423040 - RNA, 64 nt, hsa
ucuacuaugcauuaaaucuugaacuuuauaaaacauguacaaaaauuguacaagauaaguucca

SEQ ID NO: 423041 - RNA, 64 nt, hsa
uuguaacuuaauauacuagauguuaagguuguuaauguacaaaaaaaaaacccuuauacucacc

SEQ ID NO: 423042 - RNA, 64 nt, hsa
aaaacaggcuagaaucucauguuuuauaugaaagauguacaauucaguguuuaaaaauaaaaau

SEQ ID NO: 423043 - RNA, 64 nt, hsa
uuuugaauuaauuuucaauuuauuuacaaaagcuauguacaauuaacuaaaaugauaaagcagu

SEQ ID NO: 423044 - RNA, 64 nt, hsa
guuagucgagccucaaugcuugcuacaaggauguauguacaaggacugacuuuaauaauuugca

SEQ ID NO: 423045 - RNA, 64 nt, hsa
uuuggguuugaggguguguuauuuugagucaugaauguacaagcucugugaaucagaccagcuu

SEQ ID NO: 423046 - RNA, 64 nt, hsa
uagucuagcuuagaagcaaaugcaaguuauuuuaauguacaaacuaaauggguaagagguaaaa

SEQ ID NO: 423047 - RNA, 64 nt, hsa
gaaaacauccuucucagugaaacaagccagagagauguacaaggcuacagacuguaugauucca

SEQ ID NO: 423048 - RNA, 64 nt, hsa
guauauaagguaguauucagugaauacuugagaaauguacaaaucuuucauccauaccugugca

SEQ ID NO: 423049 - RNA, 64 nt, hsa
ugcuugaaagaagaucaccacugcuggaggcauaauguacaaggcaggaaaagggauggaauug

SEQ ID NO: 423050 - RNA, 64 nt, hsa
gucccugaguguucuuuaagaacauuugggauuuauguacaauuuaauacuggaguuagaacuu

SEQ ID NO: 423051 - RNA, 64 nt, hsa
uacaaaacuguaauauauuauuauuugauuguauauguacaacuguaaauacauuuguaccucu

SEQ ID NO: 423052 - RNA, 64 nt, hsa
aaggcuacuuguauaauaacccuugucauuuuuaauguacaaaacgcuauuaaguggcuuagaa

SEQ ID NO: 423053 - RNA, 64 nt, hsa
cuuauuuucaagagaauuuauggacguuguagaaauguacaaaugcauuuccaaacugccuuaa

SEQ ID NO: 423054 - RNA, 64 nt, hsa
uguccucccuggcuucucuggggcacuuggggcuauguacaaccuggcacgauccagaaagggu

SEQ ID NO: 423055 - RNA, 64 nt, hsa
uucuaagacuuuugaauuuucauuuuuuaaaaagauguacaaaacaguuugaaauaaauuuuaa

SEQ ID NO: 423056 - RNA, 64 nt, hsa
gauuaaacacuaaaaagaaagagagauauauguaauguacaacugacacugccauuuuuccuuu

SEQ ID NO: 423057 - RNA, 64 nt, hsa
uaaaucuguuuucaguauugauguuuaauaaagaauguacaauggccagaguucuacucuuucc

SEQ ID NO: 423058 - RNA, 64 nt, hsa
uacaggcaauuuuacugugaguguuucacuggaaauguacaaucuuuguguguuagaguauuug

SEQ ID NO: 423059 - RNA, 64 nt, hsa
uuuuaccuagauguaaaauuccacauguauuaaaauguacaaaauguuuuguuaauaaaauuua

SEQ ID NO: 423060 - RNA, 64 nt, hsa
ucccacagaaaccaucaucgucuuuguacaucguauguacaaugcaaucauuucauacuuuaaa

SEQ ID NO: 423061 - RNA, 64 nt, hsa
aagaauauaacugcuuuuauaaaucuuuugaaucauguacaagacuuauaucuacauuuuuuga

SEQ ID NO: 423062 - RNA, 64 nt, hsa
auguuucagcuugaagaaccaaaacagaaggaauauguacaaagaauaaauuuucugcucacga

SEQ ID NO: 423063 - RNA, 64 nt, hsa
aacuaggacauccucaagggcagcuaggccccgaauguacaauguuaagacagggaauuuugug

SEQ ID NO: 423064 - RNA, 64 nt, hsa
uuaccguuugauagaaauuuucauccuaaaauacauguacaaaguuuggaaagaugaaaaaaag

SEQ ID NO: 423065 - RNA, 64 nt, hsa
gacuacaaaaauauucagugcccaagaagguaaaauguacaaugucuagcauccaguagagagg

SEQ ID NO: 423066 - RNA, 64 nt, hsa
uugccaugguuuuacucaugugcagguuuugaaaauguacaauauguauaauuuuuaaaauguu

SEQ ID NO: 423067 - RNA, 64 nt, hsa
ugugaauuaucccugaaguucauaggacuuacauauguacaagugguaugugauauaaaucgug

SEQ ID NO: 423068 - RNA, 64 nt, hsa
caacucauagccacaucaaacauuuuccuuuuguauguacaacacucaggguguaaauucuaaa

SEQ ID NO: 423069 - RNA, 64 nt, hsa
uucauugacauacugugaucucuauuagugauggauguacaaaaaauguuuucuuacccuugac

SEQ ID NO: 423070 - RNA, 64 nt, hsa
aaauacugugccuuaggagacuggaaguuuaaaaauguacaaguccuuucagugaugagggaau

SEQ ID NO: 423071 - RNA, 64 nt, hsa
ccguuaaggagaaagaaauuaagguuagcggaucauguacaagcugagugugaaaguagaaauc

SEQ ID NO: 423072 - RNA, 64 nt, hsa
auuaagacugauggguaacuuucaaaugagggucauguacaaauauugggaugcaugagauccc

SEQ ID NO: 423073 - RNA, 64 nt, hsa
guuuaucauugcuuuguuauuuguaaggacugaaauguacaaaacccuucaaugggaugugugu

SEQ ID NO: 423074 - RNA, 64 nt, hsa
uuguucaugauggauaugaacaugauuuuucuuuauguacaaaaacuaaaauaaagucaauaaa

SEQ ID NO: 423075 - RNA, 64 nt, hsa
caaaauaaguacuaaauucauuaucguuaagcaaauguacaauaugcucaggcaccgcagagag

SEQ ID NO: 423076 - RNA, 64 nt, hsa
uuuuuggucucuuuuucuuauauucaaguuacaaauguacaaguauccuuacuaagagugcucc

SEQ ID NO: 423077 - RNA, 64 nt, hsa
cagcauuagaacaucuauacauauggugaucuaaauguacaaaauguaaaauguauaagucauc

SEQ ID NO: 423078 - RNA, 64 nt, hsa
uauuuuucccuugcuuuuggggguucagaggaguauguacaauucuucugggaagccagccuuc

SEQ ID NO: 423079 - RNA, 64 nt, hsa
auacacaagaagguacuuaguccacaagaucaggauguacaagauaaccccagagggcgcucag

SEQ ID NO: 423080 - RNA, 64 nt, hsa
uggucuuuaaccuguugucauguuuuuucccuagauguacaacacugacucaucauaaaugugg

SEQ ID NO: 423081 - RNA, 64 nt, hsa
agagcccagcccaggggcgcuggacgugaccaucauguacaagggccgcacggugcugcagaag

SEQ ID NO: 423082 - RNA, 64 nt, hsa
aucgggcugaggaagcacagcagcaucuucaaacauguacaaaaucgauuggcuuuaaacaccc

SEQ ID NO: 423083 - RNA, 64 nt, hsa
cauauauaugacuuuccuuuucaaaaauacuuuaauguacaaguguaaauauaugugcccauaa

SEQ ID NO: 423084 - RNA, 64 nt, hsa
uucuggaaaauauuuugacuagcugcuuggcuggauguacaaagaaauaggcauuauuuuauug

SEQ ID NO: 423085 - RNA, 64 nt, hsa
uuagguugaggaaagugcuuuagaaauaauaaagauguacaaauacaaggcuuuggauuuuuua

SEQ ID NO: 423086 - RNA, 64 nt, hsa
uuuauguuuuugcagucaaugugaauucuuacgaauguacaacacaaacuguaugaagccauga

SEQ ID NO: 423087 - RNA, 64 nt, hsa
ccauuuacuugaucauucucaguauccacugucuauguacaauaaaggauguuuauaagcaaau

SEQ ID NO: 423088 - RNA, 64 nt, hsa
aagauccagcggguguuuucuucucgguuguuagauguacaauuggauuaauguccaucguuuu

SEQ ID NO: 423089 - RNA, 64 nt, hsa
uguuggccccuuaaaaagcuugggaauguuuuguauguacaaguuuauuaaaacuggguaugcu

SEQ ID NO: 423090 - RNA, 64 nt, hsa
aguaagaacugucccauauguuaguaaauuacauauguacaaauugaaacuguaaauugugaac

SEQ ID NO: 423091 - RNA, 64 nt, hsa
gaauuuaucucccuuagaagagagccaguaacuuauguacaaggaugaaagaaaggucgcagca

SEQ ID NO: 423092 - RNA, 64 nt, hsa
agucacuuuaauagauagggacaguaauaaauaaauguacaaucucuauauacaagcugagacc

SEQ ID NO: 423093 - RNA, 64 nt, hsa
ucuacaauucaguauuugauguggucguguaaauauguacaauauuguaaauacauaaaaaaua

SEQ ID NO: 423094 - RNA, 64 nt, hsa
gggcucccugcccgugaggcccggugcaggaccgauguacaaaacagcagcaagugccucucuu

SEQ ID NO: 423095 - RNA, 64 nt, hsa
gccccauauguauauaguauguuguacacugcacauguacaaagaaugucuucagaucaaagaa

SEQ ID NO: 423096 - RNA, 64 nt, hsa
ucccuuaagaugaaaaguuccuuuucuuguguuaauguacaaagcuuuucuuuuggcacugaca

SEQ ID NO: 423097 - RNA, 64 nt, hsa
uaacuuauucuugaauaaugcaaauuuugcuauaauguacaaauugcuauaugugaauuaaaaa

SEQ ID NO: 423098 - RNA, 64 nt, hsa
aaaaguaccauuuuugugguuguuuggagcagggauguacaaaauaauuuuaauguauuaacuc

SEQ ID NO: 423099 - RNA, 64 nt, hsa
cuuauuuauuccaucaguagauaugguuuguacaauguacaauuguuucauuucagaaaauaaa

SEQ ID NO: 423100 - RNA, 64 nt, hsa
ucaagucacggguuuccauagccaggcaguugguauguacaauucaguucagcguaugaacuug

SEQ ID NO: 423101 - RNA, 64 nt, hsa
gaugaugacuauauggcuuauauacaaacauucuauguacaauuucaagggagacuaaacuuua

SEQ ID NO: 423102 - RNA, 64 nt, hsa
gaaaguuaaugccaauagaaaaauucaagagauaauguacaaugucagaaaagggauucuuuau

SEQ ID NO: 423103 - RNA, 64 nt, hsa
uuuccuaauacaaggcaggauaugugggaagaauauguacaauuauuugauuaaaauuauuucc

SEQ ID NO: 423104 - RNA, 64 nt, hsa
auauuuguuuaauaaugggauguuuuauuuucugauguacaaagcuugauuaccauagaaaacc

SEQ ID NO: 423105 - RNA, 64 nt, hsa
aaaucccaaagugcccacaugggaaagagauaaaauguacaaauuagaaaaauguggauaaaca

SEQ ID NO: 423106 - RNA, 64 nt, hsa
aguauccaugaaagcacaagugacuaguccuaugauguacaaagccuguaucucugugaugauu

SEQ ID NO: 423107 - RNA, 64 nt, hsa
cugggucuggagauccgggugaaggucucagacuauguacaagaccggauucgggcccuacgcg

SEQ ID NO: 423108 - RNA, 64 nt, hsa
caauuccauagcuuacuucuuucuccuaaauuuaauguacaaaaauguacauggaugauauuau

SEQ ID NO: 423109 - RNA, 64 nt, hsa
cauuaagauggauagcacauaauggcacuugucuauguacaaaacacaaacuuuagagcaagaa

SEQ ID NO: 423110 - RNA, 64 nt, hsa
caaagggauugcuuuuuccucucauugucuuguuauguacaaacuaguuuuuauagcuaucaac

SEQ ID NO: 423111 - RNA, 64 nt, hsa
agagaaacuuguaguguucuccacauaauggaaaauguacaaaugccuaguuguguugcccauc

SEQ ID NO: 423112 - RNA, 64 nt, hsa
uuuacuugugaguuuuuuacugaauuaaucugaaauguacaagcccuggauuugcuacagagug

SEQ ID NO: 423113 - RNA, 64 nt, hsa
uguaaaaagucauaaaauguaucuuccaugcuacauguacaauaagaacuucuauaauuguaua

SEQ ID NO: 423114 - RNA, 64 nt, hsa
aauuuuuaucuguuuguauaucuuacuauagauuauguacaaguaacaucuaaauaaaauuaca

SEQ ID NO: 423115 - RNA, 64 nt, hsa
aaauauuacugaagauuucgacuuccacuguuaaauguacaagauacaugaaauauuaaagaaa

SEQ ID NO: 423116 - RNA, 64 nt, hsa
ugggucaacuuuuuuuuuuuuuuuuggcguuugcauguacaacuuucuauuuuuagccuauauu

SEQ ID NO: 423117 - RNA, 64 nt, hsa
uuuacaauaaggaggaggcaaggcaaaugcauagauguacaaauauauguacaacagauuuugc

SEQ ID NO: 423118 - RNA, 64 nt, hsa
aggaggcaaggcaaaugcauagauguacaaauauauguacaacagauuuugcuuuuuauuuauu

SEQ ID NO: 423119 - RNA, 64 nt, hsa
auguuuugguuguaauauucaguucacucacccaauguacaaccaaugaaauaaaagaagcauu

SEQ ID NO: 423120 - RNA, 64 nt, hsa
caauauuuauaaagaauguuucuuaacuauaaauauguacaauugugggcauaaacuguuucag

SEQ ID NO: 423121 - RNA, 64 nt, hsa
accaaagaagauucucuuaaagaaauuaugaaaaauguacaauuuaacauuuuaaauaaauagu

SEQ ID NO: 423122 - RNA, 64 nt, hsa
ugugauacacacaugcauguacagguaagcacacauguacaagcuccuacaggcuugcucucac

SEQ ID NO: 423123 - RNA, 64 nt, hsa
ggaaucuuaaaaaaggaguuuuuaauaagucaagauguacaauuuguaguaaauuagcagaggu

SEQ ID NO: 423124 - RNA, 64 nt, hsa
uuuuuuuuaaugugucaguauuuuacauugcuagauguacaaacuuuauacagaagcacaaccu

SEQ ID NO: 423125 - RNA, 64 nt, hsa
gcaucggguguuucuauuccacagaguauuguuaauguacaacacacacacacacacacacaca

SEQ ID NO: 423126 - RNA, 64 nt, hsa
agauuuuaaucccuacuuucuuuaugguacaaauauguacaaaagaaaaaggucuuauauucuu

SEQ ID NO: 423127 - RNA, 64 nt, hsa
uauuuuaauauagcccaauaaaccuagaguauacauguacaaaauacauauaauuguuaacgug

SEQ ID NO: 423128 - RNA, 64 nt, hsa
gugguucauaccagagaccugagaauguuuguaaauguacaaguaucaaaguucuuacaguuaa

SEQ ID NO: 423129 - RNA, 64 nt, hsa
uuaggauagcuugggaugagaugugugugaaaguauguacaagagaaaacggaagagagaggaa

SEQ ID NO: 423130 - RNA, 64 nt, hsa
acacuuaccuaaauauccuggggaccaaggaacuauguacaaaaacaaaccuaccaaccaccaa

SEQ ID NO: 423131 - RNA, 64 nt, hsa
auauuauaaacuggugacauucuacuauugaauuauguacaacauuuucauuuuuuaugcuucu

SEQ ID NO: 423132 - RNA, 64 nt, hsa
auguauguaugcaugguuauacuauuuuguuaacauguacaauuuccugauuuuucuucaaaaa

SEQ ID NO: 423133 - RNA, 64 nt, hsa
gggguugguacagaaacuugaagcuguuugugauauguacaacucagauguuucucauuaaaaa

SEQ ID NO: 423134 - RNA, 64 nt, hsa
ccgaagaaaaaagauggucauacuaacaggugaaauguacaaggugucuguguguuuuguguag

SEQ ID NO: 423135 - RNA, 64 nt, hsa
auuuccuauaaauuuguauuuauguguauauaaaauguacaaugaauguaaauaugacuuucug

SEQ ID NO: 423136 - RNA, 64 nt, hsa
aagugcuauuuauagggugcccagggagccgcugauguacaauaaccuugaggucccccauacu

SEQ ID NO: 423137 - RNA, 64 nt, hsa
uaugugaauucagaguuuauuuaucgagggaaauauguacaaagaagcuucaaauggaauauuu

SEQ ID NO: 423138 - RNA, 64 nt, hsa
cuaucuuucaggaaauuuuugcauguuuaauaauauguacaaauaauauugccuugauguuucu

SEQ ID NO: 423139 - RNA, 64 nt, hsa
gcacguuuuccauuaugaggaaacuuggacauuuauguacaaaaugaauugccuuugauaauuc

SEQ ID NO: 423140 - RNA, 64 nt, hsa
aagcugucuugugccagugagaaccagcaggagaauguacaacagugucacuuguuaacgagac

SEQ ID NO: 423141 - RNA, 64 nt, hsa
cuaaagcaguguaaguuguauauuacuguuucuuauguacaaggaacaacaauaaaucauaugg

SEQ ID NO: 423142 - RNA, 64 nt, hsa
agaguuuuuugagaucagggaugcuccuagugacauguacaagaucaugaagaaagccaucgag

SEQ ID NO: 423143 - RNA, 64 nt, hsa
aaaaguuucaaaucuagacacuaaaugugugugaauguacaaagaaaacaaaccauugcuuaug

SEQ ID NO: 423144 - RNA, 64 nt, hsa
acuaugagagcguugcuaccuguggggcaagagcauguacaaacaugcucagaacuugcuggga

SEQ ID NO: 423145 - RNA, 64 nt, hsa
gcaucaccuuuauggaguguagacauuggcauuuauguacaauuuuauuugugucuuauuuuau

SEQ ID NO: 423146 - RNA, 64 nt, hsa
uugguuggcuggccuuccacuuggcuacacagggauguacaaggcgaucccaucuugauaagac

SEQ ID NO: 423147 - RNA, 64 nt, hsa
acaaaccuuuaaaaguuccccggcccgugaacaaauguacaauucucuauucugacauuacaga

SEQ ID NO: 423148 - RNA, 64 nt, hsa
caaucccagguuuucucuucuucccuuauccugcauguacaauaacugcugccuggcaaacugc

SEQ ID NO: 423149 - RNA, 64 nt, hsa
aaaccaaaucaaaugggaugugucuuuugggaggauguacaagacacaaaucuuucacuaggca

SEQ ID NO: 423150 - RNA, 64 nt, hsa
ggaacgggagggacagggaauuuuuucccccucuauguacaaaaaaaaacaaagcucucuuucc

SEQ ID NO: 423151 - RNA, 64 nt, hsa
guacuguggcuucagauuuaguaccuaugaacagauguacaagacauuuauuacacuuuuuacc

SEQ ID NO: 423152 - RNA, 64 nt, hsa
ucccagggacagucagggccucgggggcccagcuauguacaacgaagcugucgaaggagaagac

SEQ ID NO: 423153 - RNA, 64 nt, hsa
ugccauugacuucuucccaagauucaaucccaggauguacaaggacagccccuccuccauagua

SEQ ID NO: 423154 - RNA, 64 nt, hsa
guuuugaaaaugcacuuugaauaaucucaaaaagauguacaaguuauaccuguaaaccacaaaa

SEQ ID NO: 423155 - RNA, 64 nt, hsa
uaaagaacgcgacuuccacaaaccuggauuuuuuauguacaacccugaccgugaccguuugcua

SEQ ID NO: 423156 - RNA, 64 nt, hsa
ggacaaccuuucucccagauguaaacagagagacauguacaaaccuggauuuuuuuuuuauacc

SEQ ID NO: 423157 - RNA, 64 nt, hsa
agaucaugguagagaaucucucccuccucaguaaauguacaacugcaccugucaucauggaggu

SEQ ID NO: 423158 - RNA, 64 nt, hsa
uccugagaaacuguagcauauccagcccccuaaaauguacaauguaacuuguucaguccaacaa

SEQ ID NO: 423159 - RNA, 64 nt, hsa
gagcucugccacccccaggagggacccuugauacauguacaaagcauacauagcaccccuugcc

SEQ ID NO: 423160 - RNA, 64 nt, hsa
ccagcuuaaacccauacaauguauguacaauacaauguacaauuaugucucuugagcaucaauc

SEQ ID NO: 423161 - RNA, 64 nt, hsa
uauaauauucagccagcuuaaacccauacaauguauguacaauacaauguacaauuaugucucu

SEQ ID NO: 423162 - RNA, 64 nt, hsa
cacugcacucccauaaaagguuuuaaaauacaaaauguacaagaacacacaauuccaagugcug

SEQ ID NO: 423163 - RNA, 64 nt, hsa
uauauaaauauuuuaaauaucuuucauguuccaaauguacaaggauguuuggucuuuaaugaaa

SEQ ID NO: 423164 - RNA, 64 nt, hsa
gcugaauuuguaguuguugguuuauuuuaaugguauguacaaguugaguaucccuuauccaaaa

SEQ ID NO: 423165 - RNA, 64 nt, hsa
cuuuuuccuucuccccaauuacuccccugaaucaauguacaaaucagcacccacauccccuuuc

SEQ ID NO: 423166 - RNA, 64 nt, hsa
gcccccaauucuguggcgcauccagauugugaaaauguacaauaaauguguaaugaguaaccag

SEQ ID NO: 423167 - RNA, 64 nt, hsa
gccugcuugccaaaagcuaggaugcuucaggcccauguacaauugaaagcagaggcauccuuga

SEQ ID NO: 423168 - RNA, 64 nt, hsa
uaaauuguuuuaauagugauuuauuugucaucaaauguacaacuuauucuaaauauuuucauuu

SEQ ID NO: 423169 - RNA, 64 nt, hsa
caaagccuuugcucucacgcagaggaaggcuuggauguacaaugaaacugccuggaacuaaaag

SEQ ID NO: 423170 - RNA, 64 nt, hsa
cuguucccaaagcuuguugggcuccuuaaauggcauguacaauuuaagugcaaagacagggagu

SEQ ID NO: 423171 - RNA, 64 nt, hsa
ggucaaacuguauaaagggauugguagucaaaacauguacaaagaaauaccuguaaaacuguuu

SEQ ID NO: 423172 - RNA, 64 nt, hsa
ugcccccuagcaauaagcccuuuccuuugaauacauguacaacuuuggucauaugagaagcagg

SEQ ID NO: 423173 - RNA, 64 nt, hsa
ugggagggaaguugucaaugauugaugggcaaaaauguacaacacaguuauguguuuguccaug

SEQ ID NO: 423174 - RNA, 64 nt, hsa
uuugacuugaauuaaaauacuagacaaagcagaaauguacaauuucuggucuguguuuuccagg

SEQ ID NO: 423175 - RNA, 64 nt, hsa
uauacagauacauaucuguguauuaucucaaggaauguacaaacuuuaguuuuugauuauaagg

SEQ ID NO: 423176 - RNA, 64 nt, hsa
augccuaauguaaagaaaauguauuacauucuguauguacaaagauuaaaaaucaaccucuuuu

SEQ ID NO: 423177 - RNA, 64 nt, hsa
uuuaaaggagcaaaaauuugcaagucaaauagaaauguacaaaucgagauaacauuuacauuuc

SEQ ID NO: 423178 - RNA, 64 nt, hsa
ccccuccccaccaaaggguucaccucacacuugaauguacaacccaccccacugucgggaaggc

SEQ ID NO: 423179 - RNA, 64 nt, hsa
uaggggguuauugccucugaaaugccucuucuuuauguacaaagauuauuugcacgaacuggac

SEQ ID NO: 423180 - RNA, 64 nt, hsa
guuugccuucuuauuguuggauuuugagaguucuauguacaaguccuuugucagucgugugauu

SEQ ID NO: 423181 - RNA, 64 nt, hsa
cuuaauggaagaccaaaugguuuuuuauauguguauguacaaaguuuucuauuaacgcugcccg

SEQ ID NO: 423182 - RNA, 64 nt, hsa
aauccaauucuacacuuuaaaaaaaaauuuuuaaauguacaauuaaauuuuuauuuaccacagu

SEQ ID NO: 423183 - RNA, 64 nt, hsa
uauugcacaggaaagcauuuauacuugagaagaaauguacaaauauuggcaaaguaaaaaaucc

SEQ ID NO: 423184 - RNA, 64 nt, hsa
uguauauggcuccuuuaauauuguaaagaugcugauguacaauugucgugcauuugugugaaca

SEQ ID NO: 423185 - RNA, 64 nt, hsa
uuuuuuauuagcauucugaaagaaggaaaguaaaauguacaaguuuaauaaaaaggggccuucc

SEQ ID NO: 423186 - RNA, 64 nt, hsa
caaaagcaacuguuguuuuggcaagacgguccugauguacaagcuugauugaaauucacugcuc

SEQ ID NO: 423187 - RNA, 64 nt, hsa
gcauauaauucucccugcaaggauguaugauaauauguacaaaguaauuccaacugaggaagcu

SEQ ID NO: 423188 - RNA, 64 nt, hsa
guucaaacagauacagcaugguccagagucccagauguacaaaaacagggauucaucacaaauc

SEQ ID NO: 423189 - RNA, 64 nt, hsa
agcuucucaggugugaccuacugugcuuggccuaauguacaacuuuuuaagcaaugccaaacua

SEQ ID NO: 423190 - RNA, 64 nt, hsa
gugagaaagccugaacaguugaaucuuucuagauauguacaaacucacacuguagagaaacccu

SEQ ID NO: 423191 - RNA, 64 nt, hsa
cacagcaguaucagaaacuucugacaaucagugaauguacaacccagccgaggggacggugcau

SEQ ID NO: 423192 - RNA, 64 nt, hsa
uccaucagaaucugccugggagggagcuuuuacaauguacaaguggugagaauguuuccaaggu

SEQ ID NO: 423193 - RNA, 64 nt, hsa
gaucaguuacuucauguuuugugucagagaaaacauguacaaaacauuugagaaaauauuuuag

SEQ ID NO: 423194 - RNA, 64 nt, hsa
cauguacugcaauauugcuguccaccccauaaauauguacaauucuguauacauuuuuaaaauc

SEQ ID NO: 423195 - RNA, 64 nt, hsa
ggagcaguaaaugaagacagaguggaggacacaaauguacaaaaugcacaagacugauuucuua

SEQ ID NO: 423196 - RNA, 64 nt, hsa
ugcugucuaaugacggggaaagcacgaugaaaagauguacaauccugcauccuugcuuauuuca

SEQ ID NO: 423197 - RNA, 64 nt, hsa
uggagguguguucuguguuuacacaguaguuuggauguacaauuauuauuaguggcuuuuuaaa

SEQ ID NO: 423198 - RNA, 64 nt, hsa
cacccacacgagcccugugcuuuugguguaaauaauguacaauuuguggaugucauugaaucua

SEQ ID NO: 423199 - RNA, 64 nt, hsa
uuuauuuaaauauugaagggaaaaauaccuaaaaauguacaaagguuuuauauugucauagugg

SEQ ID NO: 423200 - RNA, 64 nt, hsa
guauuuuuugaccucuuacugauucauuguugguauguacaaacuguugacuuguaaaaucaau

SEQ ID NO: 423201 - RNA, 64 nt, hsa
gcuuuccugaaugaugaaguuuggaauuugucaaauguacaacagggaaaauaucuuuauaucc

SEQ ID NO: 423202 - RNA, 64 nt, hsa
uauuuucuuuuuguaauuaguaauaaaacccagcauguacaaaaguaccauagaacagaacugc

SEQ ID NO: 423203 - RNA, 64 nt, hsa
uucugccugacccugggagacauaucaguaauggauguacaaaagcaggucuguuuuaugucuu

SEQ ID NO: 423204 - RNA, 64 nt, hsa
uauaucuauacauacauauauacauauauauauaauguacaauauauacauagacuguaacuac

SEQ ID NO: 423205 - RNA, 64 nt, hsa
aaaccauuuuauucuguaggcuuuuuacucaauuauguacaaaccacaaaucagguacuguauu

SEQ ID NO: 423206 - RNA, 64 nt, hsa
gauaugccucugcucccaacuucgccagccuccaauguacaacuuccgcguguagugggcguug

SEQ ID NO: 423207 - RNA, 64 nt, hsa
aauuaugggaauaauugcuuuuucacagucacugauguacaauuaaaaaccugauggaaccugg

SEQ ID NO: 423208 - RNA, 64 nt, hsa
gaaaggaaaggccaaaaaaaagaggaaaagaaaaauguacaaaaagauuuucgaucuucucacu

SEQ ID NO: 423209 - RNA, 64 nt, hsa
uaguccccagccugcucccuagccagaggcucuaauguacaauaaagcaaugugguaguuccaa

SEQ ID NO: 423210 - RNA, 64 nt, hsa; identical to SEQ ID NO: 423209

SEQ ID NO: 423211 - RNA, 64 nt, hsa
aaaucguguaucugacaaaagguuuguguccaggauguacaaagaacucucaaaccggauagua

SEQ ID NO: 423212 - RNA, 64 nt, hsa
gguuccacuggucucaaaagucaccugccuacaaauguacaaaaggcgaagguucugauggcug

SEQ ID NO: 423213 - RNA, 64 nt, hsa
aagaaguggucaauggguuguugcugccaugagcauguacaaccucuggagcuagaagcuccuc

SEQ ID NO: 423214 - RNA, 64 nt, hsa
gcacaaacauagacagauguggacaugcacccgcauguacaaaaacacaaauacggaaguaaac

SEQ ID NO: 423215 - RNA, 64 nt, hsa
cuucagugaauacaaaauguugauaucauaggugauguacaauuuaguuuugaaugaguuauua

SEQ ID NO: 423216 - RNA, 64 nt, hsa
cgagauuuuauaaccagagucuagcagugauaaaauguacaauuuacgcucugaauagaaacau

SEQ ID NO: 423217 - RNA, 64 nt, hsa
acauuaauugcaaggagcauaacguacaggcuguauguacaauccugggcauugacucugugac

SEQ ID NO: 423218 - RNA, 64 nt, hsa
caguacagauguguaucccaccaaacuaauguagauguacaaacacuucacugucugucucaag

SEQ ID NO: 423219 - RNA, 64 nt, hsa
gcaauuccacuucuaggaauguacauacucacacauguacaaaaugaugaacauacaguauuca

SEQ ID NO: 423220 - RNA, 64 nt, hsa
uccaguucugcaaaaaugaccuauaaauuuauucauguacaauuuugguuacuugaauuguuaa

SEQ ID NO: 423221 - RNA, 64 nt, hsa
gacauacaucacauuauacacaaaaguguaugauauguacaacugagugguacagauaugacau

SEQ ID NO: 423222 - RNA, 64 nt, hsa
cccaauaagccaaguugaagguggauuauaguaaauguacaacugugcucacuaggcuucaagu

SEQ ID NO: 423223 - RNA, 64 nt, hsa
ccuccccaaguuccaauggauuugccuucucaaaauguacaacuaagcaacuaaagaaaauuaa

SEQ ID NO: 423224 - RNA, 64 nt, hsa
ugauggaugccaauauuaaaucugcuggaguuucauguacaagaugaaggagaggcaacaucca

SEQ ID NO: 423225 - RNA, 64 nt, hsa; identical to SEQ ID NO: 86383

SEQ ID NO: 423226 - RNA, 64 nt, hsa; identical to SEQ ID NO: 86384

SEQ ID NO: 423227 - RNA, 64 nt, hsa; identical to SEQ ID NO: 86385

SEQ ID NO: 423228 - RNA, 64 nt, hsa; identical to SEQ ID NO: 86386

SEQ ID NO: 423229 - RNA, 64 nt, hsa; identical to SEQ ID NO: 86387

SEQ ID NO: 423230 - RNA, 64 nt, hsa; identical to SEQ ID NO: 86388

SEQ ID NO: 423231 - RNA, 64 nt, hsa; identical to SEQ ID NO: 86389

SEQ ID NO: 423232 - RNA, 64 nt, hsa; identical to SEQ ID NO: 86390

SEQ ID NO: 423233 - RNA, 64 nt, hsa; identical to SEQ ID NO: 86391

SEQ ID NO: 423234 - RNA, 64 nt, hsa; identical to SEQ ID NO: 86392

SEQ ID NO: 423235 - RNA, 64 nt, hsa; identical to SEQ ID NO: 86393

SEQ ID NO: 423236 - RNA, 64 nt, hsa; identical to SEQ ID NO: 86394

SEQ ID NO: 423237 - RNA, 61 nt, hsa; identical to SEQ ID NO: 86395

SEQ ID NO: 423238 - RNA, 64 nt, hsa; identical to SEQ ID NO: 86396

SEQ ID NO: 423239 - RNA, 64 nt, hsa; identical to SEQ ID NO: 86397

SEQ ID NO: 423240 - RNA, 64 nt, hsa; identical to SEQ ID NO: 86398

SEQ ID NO: 423241 - RNA, 64 nt, hsa; identical to SEQ ID NO: 86399

SEQ ID NO: 423242 - RNA, 64 nt, hsa; identical to SEQ ID NO: 86400

SEQ ID NO: 423243 - RNA, 64 nt, hsa; identical to SEQ ID NO: 86401

SEQ ID NO: 423244 - RNA, 64 nt, hsa; identical to SEQ ID NO: 86402

SEQ ID NO: 423245 - RNA, 64 nt, hsa; identical to SEQ ID NO: 86403

SEQ ID NO: 423246 - RNA, 64 nt, hsa; identical to SEQ ID NO: 86404

SEQ ID NO: 423247 - RNA, 64 nt, hsa; identical to SEQ ID NO: 86405

SEQ ID NO: 423248 - RNA, 64 nt, hsa; identical to SEQ ID NO: 86406

SEQ ID NO: 423249 - RNA, 64 nt, hsa; identical to SEQ ID NO: 86407

SEQ ID NO: 423250 - RNA, 64 nt, hsa; identical to SEQ ID NO: 86408

SEQ ID NO: 423251 - RNA, 64 nt, hsa; identical to SEQ ID NO: 86409

SEQ ID NO: 423252 - RNA, 64 nt, hsa; identical to SEQ ID NO: 86410

SEQ ID NO: 423253 - RNA, 64 nt, hsa; identical to SEQ ID NO: 86411

SEQ ID NO: 423254 - RNA, 64 nt, hsa; identical to SEQ ID NO: 86412

SEQ ID NO: 423255 - RNA, 64 nt, hsa; identical to SEQ ID NO: 86413

SEQ ID NO: 423256 - RNA, 64 nt, hsa; identical to SEQ ID NO: 86414

SEQ ID NO: 423257 - RNA, 64 nt, hsa; identical to SEQ ID NO: 86415

SEQ ID NO: 423258 - RNA, 64 nt, hsa; identical to SEQ ID NO: 86416

SEQ ID NO: 423259 - RNA, 64 nt, hsa; identical to SEQ ID NO: 86417

SEQ ID NO: 423260 - RNA, 64 nt, hsa; identical to SEQ ID NO: 86418

SEQ ID NO: 423261 - RNA, 64 nt, hsa; identical to SEQ ID NO: 86419

SEQ ID NO: 423262 - RNA, 64 nt, hsa; identical to SEQ ID NO: 86420

SEQ ID NO: 423263 - RNA, 64 nt, hsa; identical to SEQ ID NO: 86421

SEQ ID NO: 423264 - RNA, 64 nt, hsa; identical to SEQ ID NO: 86422

SEQ ID NO: 423265 - RNA, 64 nt, hsa; identical to SEQ ID NO: 86423

SEQ ID NO: 423266 - RNA, 64 nt, hsa; identical to SEQ ID NO: 86424

SEQ ID NO: 423267 - RNA, 64 nt, hsa; identical to SEQ ID NO: 86425

SEQ ID NO: 423268 - RNA, 64 nt, hsa; identical to SEQ ID NO: 86426

SEQ ID NO: 423269 - RNA, 64 nt, hsa; identical to SEQ ID NO: 86427

SEQ ID NO: 423270 - RNA, 64 nt, hsa; identical to SEQ ID NO: 86428

SEQ ID NO: 423271 - RNA, 64 nt, hsa; identical to SEQ ID NO: 86429

SEQ ID NO: 423272 - RNA, 64 nt, hsa; identical to SEQ ID NO: 86430

SEQ ID NO: 423273 - RNA, 64 nt, hsa; identical to SEQ ID NO: 86431

SEQ ID NO: 423274 - RNA, 64 nt, hsa; identical to SEQ ID NO: 86432

SEQ ID NO: 423275 - RNA, 64 nt, hsa; identical to SEQ ID NO: 86433

SEQ ID NO: 423276 - RNA, 64 nt, hsa; identical to SEQ ID NO: 86434

SEQ ID NO: 423277 - RNA, 64 nt, hsa; identical to SEQ ID NO: 86435

SEQ ID NO: 423278 - RNA, 64 nt, hsa; identical to SEQ ID NO: 86436

SEQ ID NO: 423279 - RNA, 64 nt, hsa; identical to SEQ ID NO: 86437

SEQ ID NO: 423280 - RNA, 64 nt, hsa; identical to SEQ ID NO: 86438

SEQ ID NO: 423281 - RNA, 64 nt, hsa; identical to SEQ ID NO: 86439

SEQ ID NO: 423282 - RNA, 64 nt, hsa; identical to SEQ ID NO: 86440

SEQ ID NO: 423283 - RNA, 64 nt, hsa; identical to SEQ ID NO: 86441

SEQ ID NO: 423284 - RNA, 64 nt, hsa; identical to SEQ ID NO: 86442

SEQ ID NO: 423285 - RNA, 64 nt, hsa; identical to SEQ ID NO: 86443

SEQ ID NO: 423286 - RNA, 64 nt, hsa; identical to SEQ ID NO: 86444

SEQ ID NO: 423287 - RNA, 64 nt, hsa; identical to SEQ ID NO: 86445

SEQ ID NO: 423288 - RNA, 60 nt, hsa; identical to SEQ ID NO: 86446

SEQ ID NO: 423289 - RNA, 64 nt, hsa; identical to SEQ ID NO: 86447

SEQ ID NO: 423290 - RNA, 64 nt, hsa; identical to SEQ ID NO: 86448

SEQ ID NO: 423291 - RNA, 64 nt, hsa; identical to SEQ ID NO: 86449

SEQ ID NO: 423292 - RNA, 64 nt, hsa; identical to SEQ ID NO: 86450

SEQ ID NO: 423293 - RNA, 64 nt, hsa; identical to SEQ ID NO: 86451

SEQ ID NO: 423294 - RNA, 64 nt, hsa; identical to SEQ ID NO: 86452

SEQ ID NO: 423295 - RNA, 64 nt, hsa; identical to SEQ ID NO: 86453

SEQ ID NO: 423296 - RNA, 64 nt, hsa; identical to SEQ ID NO: 86454

SEQ ID NO: 423297 - RNA, 64 nt, hsa; identical to SEQ ID NO: 86455

SEQ ID NO: 423298 - RNA, 64 nt, hsa; identical to SEQ ID NO: 86456

SEQ ID NO: 423299 - RNA, 64 nt, hsa; identical to SEQ ID NO: 86457

SEQ ID NO: 423300 - RNA, 64 nt, hsa; identical to SEQ ID NO: 86458

SEQ ID NO: 423301 - RNA, 64 nt, hsa; identical to SEQ ID NO: 86459

SEQ ID NO: 423302 - RNA, 64 nt, hsa; identical to SEQ ID NO: 86460

SEQ ID NO: 423303 - RNA, 64 nt, hsa; identical to SEQ ID NO: 86461

SEQ ID NO: 423304 - RNA, 55 nt, hsa; identical to SEQ ID NO: 86462

SEQ ID NO: 423305 - RNA, 64 nt, hsa; identical to SEQ ID NO: 86463

SEQ ID NO: 423306 - RNA, 64 nt, hsa; identical to SEQ ID NO: 86464

SEQ ID NO: 423307 - RNA, 64 nt, hsa; identical to SEQ ID NO: 86465

SEQ ID NO: 423308 - RNA, 64 nt, hsa; identical to SEQ ID NO: 86466

SEQ ID NO: 423309 - RNA, 64 nt, hsa; identical to SEQ ID NO: 86467

SEQ ID NO: 423310 - RNA, 64 nt, hsa; identical to SEQ ID NO: 86468

SEQ ID NO: 423311 - RNA, 64 nt, hsa; identical to SEQ ID NO: 86469

SEQ ID NO: 423312 - RNA, 64 nt, hsa; identical to SEQ ID NO: 86470

SEQ ID NO: 423313 - RNA, 64 nt, hsa; identical to SEQ ID NO: 86471

SEQ ID NO: 423314 - RNA, 64 nt, hsa; identical to SEQ ID NO: 86472

SEQ ID NO: 423315 - RNA, 64 nt, hsa; identical to SEQ ID NO: 86473

SEQ ID NO: 423316 - RNA, 64 nt, hsa; identical to SEQ ID NO: 86474

SEQ ID NO: 423317 - RNA, 64 nt, hsa; identical to SEQ ID NO: 86475

SEQ ID NO: 423318 - RNA, 64 nt, hsa; identical to SEQ ID NO: 86476

SEQ ID NO: 423319 - RNA, 64 nt, hsa; identical to SEQ ID NO: 86477

SEQ ID NO: 423320 - RNA, 64 nt, hsa; identical to SEQ ID NO: 86478

SEQ ID NO: 423321 - RNA, 64 nt, hsa; identical to SEQ ID NO: 86479

SEQ ID NO: 423322 - RNA, 64 nt, hsa; identical to SEQ ID NO: 86480

SEQ ID NO: 423323 - RNA, 64 nt, hsa; identical to SEQ ID NO: 86481

SEQ ID NO: 423324 - RNA, 64 nt, hsa; identical to SEQ ID NO: 86482

SEQ ID NO: 423325 - RNA, 64 nt, hsa; identical to SEQ ID NO: 86483

SEQ ID NO: 423326 - RNA, 64 nt, hsa; identical to SEQ ID NO: 86484

SEQ ID NO: 423327 - RNA, 64 nt, hsa; identical to SEQ ID NO: 86485

SEQ ID NO: 423328 - RNA, 64 nt, hsa; identical to SEQ ID NO: 86486

SEQ ID NO: 423329 - RNA, 64 nt, hsa; identical to SEQ ID NO: 86487

SEQ ID NO: 423330 - RNA, 64 nt, hsa; identical to SEQ ID NO: 86488

SEQ ID NO: 423331 - RNA, 64 nt, hsa; identical to SEQ ID NO: 86489

SEQ ID NO: 423332 - RNA, 64 nt, hsa; identical to SEQ ID NO: 86490

SEQ ID NO: 423333 - RNA, 64 nt, hsa; identical to SEQ ID NO: 86491

SEQ ID NO: 423334 - RNA, 64 nt, hsa; identical to SEQ ID NO: 86492

SEQ ID NO: 423335 - RNA, 64 nt, hsa; identical to SEQ ID NO: 86493

SEQ ID NO: 423336 - RNA, 51 nt, hsa; identical to SEQ ID NO: 86494

SEQ ID NO: 423337 - RNA, 64 nt, hsa; identical to SEQ ID NO: 86495

SEQ ID NO: 423338 - RNA, 64 nt, hsa; identical to SEQ ID NO: 86496

SEQ ID NO: 423339 - RNA, 64 nt, hsa; identical to SEQ ID NO: 86497

SEQ ID NO: 423340 - RNA, 64 nt, hsa; identical to SEQ ID NO: 86498

SEQ ID NO: 423341 - RNA, 64 nt, hsa; identical to SEQ ID NO: 86499

SEQ ID NO: 423342 - RNA, 64 nt, hsa; identical to SEQ ID NO: 86500

SEQ ID NO: 423343 - RNA, 64 nt, hsa; identical to SEQ ID NO: 86501

SEQ ID NO: 423344 - RNA, 64 nt, hsa; identical to SEQ ID NO: 86502

SEQ ID NO: 423345 - RNA, 64 nt, hsa; identical to SEQ ID NO: 86503

SEQ ID NO: 423346 - RNA, 64 nt, hsa; identical to SEQ ID NO: 86504

SEQ ID NO: 423347 - RNA, 64 nt, hsa; identical to SEQ ID NO: 86505

SEQ ID NO: 423348 - RNA, 64 nt, hsa; identical to SEQ ID NO: 86506

SEQ ID NO: 423349 - RNA, 64 nt, hsa; identical to SEQ ID NO: 86507

SEQ ID NO: 423350 - RNA, 64 nt, hsa; identical to SEQ ID NO: 86508

SEQ ID NO: 423351 - RNA, 64 nt, hsa; identical to SEQ ID NO: 86509

SEQ ID NO: 423352 - RNA, 64 nt, hsa; identical to SEQ ID NO: 86510

SEQ ID NO: 423353 - RNA, 64 nt, hsa; identical to SEQ ID NO: 86511

SEQ ID NO: 423354 - RNA, 64 nt, hsa; identical to SEQ ID NO: 86512

SEQ ID NO: 423355 - RNA, 64 nt, hsa; identical to SEQ ID NO: 86513

SEQ ID NO: 423356 - RNA, 64 nt, hsa; identical to SEQ ID NO: 86514

SEQ ID NO: 423357 - RNA, 64 nt, hsa; identical to SEQ ID NO: 86515

SEQ ID NO: 423358 - RNA, 64 nt, hsa; identical to SEQ ID NO: 86516

SEQ ID NO: 423359 - RNA, 64 nt, hsa; identical to SEQ ID NO: 86517

SEQ ID NO: 423360 - RNA, 64 nt, hsa; identical to SEQ ID NO: 86518

SEQ ID NO: 423361 - RNA, 64 nt, hsa; identical to SEQ ID NO: 86519

SEQ ID NO: 423362 - RNA, 64 nt, hsa; identical to SEQ ID NO: 86520

SEQ ID NO: 423363 - RNA, 64 nt, hsa; identical to SEQ ID NO: 86521

SEQ ID NO: 423364 - RNA, 64 nt, hsa; identical to SEQ ID NO: 86522

SEQ ID NO: 423365 - RNA, 64 nt, hsa; identical to SEQ ID NO: 86523

SEQ ID NO: 423366 - RNA, 64 nt, hsa; identical to SEQ ID NO: 86524

SEQ ID NO: 423367 - RNA, 64 nt, hsa; identical to SEQ ID NO: 86525

SEQ ID NO: 423368 - RNA, 64 nt, hsa; identical to SEQ ID NO: 262900

SEQ ID NO: 423369 - RNA, 64 nt, hsa; identical to SEQ ID NO: 262901

SEQ ID NO: 423370 - RNA, 64 nt, hsa; identical to SEQ ID NO: 262902

SEQ ID NO: 423371 - RNA, 64 nt, hsa; identical to SEQ ID NO: 262903

SEQ ID NO: 423372 - RNA, 64 nt, hsa; identical to SEQ ID NO: 262904

SEQ ID NO: 423373 - RNA, 64 nt, hsa; identical to SEQ ID NO: 262905

SEQ ID NO: 423374 - RNA, 64 nt, hsa; identical to SEQ ID NO: 262906

SEQ ID NO: 423375 - RNA, 64 nt, hsa; identical to SEQ ID NO: 262907

SEQ ID NO: 423376 - RNA, 64 nt, hsa; identical to SEQ ID NO: 262908

SEQ ID NO: 423377 - RNA, 64 nt, hsa; identical to SEQ ID NO: 262909

SEQ ID NO: 423378 - RNA, 64 nt, hsa; identical to SEQ ID NO: 262910

SEQ ID NO: 423379 - RNA, 64 nt, hsa; identical to SEQ ID NO: 262911

SEQ ID NO: 423380 - RNA, 64 nt, hsa; identical to SEQ ID NO: 262912

SEQ ID NO: 423381 - RNA, 64 nt, hsa
gaaauuaauguccucucaaaguaaaauauugaggagcacugaaaguauguuuuacuuuuuuuuu

SEQ ID NO: 423382 - RNA, 64 nt, hsa
gugccuuaaauauagcaguagucuuuuuuggacuagcacugacugaacuguaauguaggggaaa

SEQ ID NO: 423383 - RNA, 64 nt, hsa
aaaugugcuguguuccuaccucggcaagaucaccagcacugaggggcccagcuggagaaugauu

SEQ ID NO: 423384 - RNA, 64 nt, hsa
ccccaugcccaccguggagcugcaacuccucgacagcacugaguuugauagucucacuggaagc

SEQ ID NO: 423385 - RNA, 64 nt, hsa
caacuaaaagugauggaaaaauacuguauuuuguagcacugauuuugugaguuugacccauuau

SEQ ID NO: 423386 - RNA, 64 nt, hsa
uugugcaguggggucuaccaugcaauuuucuuucagcacugaccccuuuuuaaggaauacaaau

SEQ ID NO: 423387 - RNA, 64 nt, hsa
aguguauagaaccugucauacauucaugauaaguagcacugaaaaauuacucauucaaauuucc

SEQ ID NO: 423388 - RNA, 64 nt, hsa
auagcaguacacuagcaaguaucugugaauccuuagcacugacggguuaacagaaaugcuuugg

SEQ ID NO: 423389 - RNA, 64 nt, hsa
gagggcagucagugucacuucugggaugugccccagcacugagaacaaaaugcaggcauccccc

SEQ ID NO: 423390 - RNA, 64 nt, hsa
ugaagggcaaacagcccauggguaguauggcccgagcacugaauucccuugcgccuuuucaaag

SEQ ID NO: 423391 - RNA, 64 nt, hsa
auaugauaaugcaaaccuauuucaucacucuaaaagcacugaccucaaaaaaccuuauaagcac

SEQ ID NO: 423392 - RNA, 64 nt, hsa
uuaaccaagccccucuccacuucuuuuauuuaaaagcacugauucaauugcuaggaauauuuuu

SEQ ID NO: 423393 - RNA, 64 nt, hsa
agagaacaagacuauucaacaacuucuuugcugaagcacugaggagauuuguaauacuccuaaa

SEQ ID NO: 423394 - RNA, 64 nt, hsa
agaguaauucacauuuacucuagaaccuuuaacaagcacugaaaggaagaagccugagauuuga

SEQ ID NO: 423395 - RNA, 64 nt, hsa
acuuuaggaaccaccauauuauaucacucccaauagcacugaccuggugaucaaaaacacuuga

SEQ ID NO: 423396 - RNA, 64 nt, hsa
cauuccuucagucaucuucuguguaggugaccggagcacugagaggcagcucugaugcacuauu

SEQ ID NO: 423397 - RNA, 64 nt, hsa
uauauauuuuauaggcauuuaguugcuuauuaaaagcacugauuuucaaacuuuuugauuuaag

SEQ ID NO: 423398 - RNA, 64 nt, hsa
agccacauaauuaaagcaguugaacuauagggaaagcacugaacaaaccacuuuggaguaaaua

SEQ ID NO: 423399 - RNA, 64 nt, hsa
cuaguuccuggaacagacucacagauuggcaugaagcacugaucaggggcugcacucagacucc

SEQ ID NO: 423400 - RNA, 64 nt, hsa
accuauuccugcaccuaggcuaggauaacuuuagagcacugacauaaaacgcaaaaacaggaau

SEQ ID NO: 423401 - RNA, 64 nt, hsa
accagccaccuuuucucucucuuagcuccacgucagcacugagaccagacucgagcaccccugu

SEQ ID NO: 423402 - RNA, 64 nt, hsa
uauaugcaugagccaaacuguugcaucauaauuuagcacugaugucugcuuuuauuuugaucau

SEQ ID NO: 423403 - RNA, 64 nt, hsa
caggaauccuaaagcagcauuuuauugaguuugaauuauuaaagguacagaggaaaugugguga

SEQ ID NO: 423404 - RNA, 64 nt, hsa
aaugugggagaaaaaacccugcaggauggaaacaauuauuaagaauguagaucaauaaguacuu

SEQ ID NO: 423405 - RNA, 64 nt, hsa
ccuaccuauuauggaauaaucaguuuuuacagagauuauuaauaugguagaacccuguuaugua

SEQ ID NO: 423406 - RNA, 64 nt, hsa
uguuuguauauaccacauuuucauuauccagccuauuauuaaugcacauuuagguugauuccuu

SEQ ID NO: 423407 - RNA, 64 nt, hsa
uggggguuuggugugcagauaauuuuaucacacaauuauuaaucauaauacccaauagguuuuu

SEQ ID NO: 423408 - RNA, 64 nt, hsa
aaugagucuguaguuacuaaacccuaauggaauaauuauuaaugaaagauuuuugaaauauaaa

SEQ ID NO: 423409 - RNA, 64 nt, hsa
gagcuguacagagguaaaaaaauaaauguggaacauuauuaacuuacuuugugucuaggaacaa

SEQ ID NO: 423410 - RNA, 64 nt, hsa
uuuuccaagguuagauuccaauaaauaucuauuuauuauuaaauauuaaaauaucuauuuauua

SEQ ID NO: 423411 - RNA, 64 nt, hsa
aucuauuuauuauuaaauauuaaaauaucuauuuauuauuaaaaccauuuauaaggcuuuuuca

SEQ ID NO: 423412 - RNA, 64 nt, hsa
auaaggcuuuuucauaaauguauagcaaauaggaauuauuaacuugagcauaagauaugagaua

SEQ ID NO: 423413 - RNA, 64 nt, hsa
guuuuucaaaaaagaauaaaaaguuugaauagcuauuauuaaagaaaagccaugucuucaacau

SEQ ID NO: 423414 - RNA, 64 nt, hsa
ucuuaggucuugagacucaguuuccaacaccuucauuauuaauguuaagaauggccauauacca

SEQ ID NO: 423415 - RNA, 64 nt, hsa
aaugguugaaacuuaguaaaauguccuauuucugauuauuaagacuaguauaaaugagaaaauc

SEQ ID NO: 423416 - RNA, 64 nt, hsa
aggaaugaaacuugguuaagauuuugacuacuucauuauuaaaaauugauagaauuuuagcucc

SEQ ID NO: 423417 - RNA, 64 nt, hsa
aaugaaucugagcugauggugacuuuaaguuaauauuauuaauauaucacugcauauuuuuacc

SEQ ID NO: 423418 - RNA, 64 nt, hsa
gaaaagggagaauaaugugaauaucacggcuuauauuauuaaauguugauugauggcuuguaau

SEQ ID NO: 423419 - RNA, 64 nt, hsa
caguggcagaagaauuuuuuaaggguuucaaucaauuauuaaugcagagaguauugaauguaaa

SEQ ID NO: 423420 - RNA, 64 nt, hsa
guuuauuuguaaagcuaauaugcuccucaauguaauuauuaaaaauucucaagucacagcuaaa

SEQ ID NO: 423421 - RNA, 64 nt, hsa
aaucacccccuccucuguaugcugucacaccuauauuauuaaacuuaucacauugcauuguaau

SEQ ID NO: 423422 - RNA, 64 nt, hsa
auuacaauaauauaccauaggaggcacaagcaccauuauuaagccacuuugcuuacaccuuaag

SEQ ID NO: 423423 - RNA, 64 nt, hsa
uacuuaccuguauacaccauaugcaugcacuagaauuauuaacuaacgaggugagguauugcaa

SEQ ID NO: 423424 - RNA, 64 nt, hsa
acagaucauauuuauuuuacuauuuuuguagaaaauuauuaauuuugauuguauuuuuguauuu

SEQ ID NO: 423425 - RNA, 64 nt, hsa
uuauuuuuuuacccuuccucaaacaccaguaacuauuauuaacucguuuugcugaauguuguug

SEQ ID NO: 423426 - RNA, 64 nt, hsa
ugaugaagugagacucuccaaaaaaaaaaaagaaauuauuaaucccugccugugcucuacauag

SEQ ID NO: 423427 - RNA, 64 nt, hsa
ugcauauguacuguuacuaaaagcuuuauaugaaauuauuaaugugaaguuuuucauuuauaau

SEQ ID NO: 423428 - RNA, 64 nt, hsa
aauugaguuuagagagaauggugguguugagcugauuauuaacaguuacugaaaucaaauauuu

SEQ ID NO: 423429 - RNA, 64 nt, hsa
uuuacuggaaaguuggccagcagagggaguagaaauuauuaaaauucuaguguuuggauugggc

SEQ ID NO: 423430 - RNA, 64 nt, hsa
uuaacucagaagacuacauuagugagauguaagaauuauuaaauauuccauuuccgcuuuggcu

SEQ ID NO: 423431 - RNA, 64 nt, hsa
caauaucacauauguucuucaagaaacacaugaaauuauuaauaaaguaauuaaaaaauuuuua

SEQ ID NO: 423432 - RNA, 64 nt, hsa
auauuacuguuaaauuucuuagugcagaaauaacauuauuaauagaguauuguuuucaaaacag

SEQ ID NO: 423433 - RNA, 64 nt, hsa
acagcaaaccauuuuucuuucaugaaaauaauauauuauuaacaugaauauauuauuuugcuau

SEQ ID NO: 423434 - RNA, 64 nt, hsa
cacauggaggcccuuuuggauuuagagacuguaaauuauuaaaucggcaacagggcuucucuuu

SEQ ID NO: 423435 - RNA, 64 nt, hsa
uucaaaaugauauucaaucuuaacaaaagugaacauuauuaaaucagaaucuuuaaagaggagc

SEQ ID NO: 423436 - RNA, 64 nt, hsa
uuuucauuuucacuaagaguuuaaaagcuauuguauuauuaaaaagucuuuacaaugcuuguuu

SEQ ID NO: 423437 - RNA, 64 nt, hsa
cuuuaauuuguccuuuuuuucuuuggucuaaaacauuauuaaauuuuuguaaauauuuugauuu

SEQ ID NO: 423438 - RNA, 64 nt, hsa
aacagugucuagaaacccauuuugaaaguggaaaauuauuaagucaccuaucaccuuuaaacgc

SEQ ID NO: 423439 - RNA, 64 nt, hsa
caacuuuuaaauacacuuugaacuucuucucugaauuauuaaaguucuuuaugaccucauuuau

SEQ ID NO: 423440 - RNA, 64 nt, hsa
gauaauaaaaagcagagugauuuuggucaauuuuauuauuaauucuuaaauucccugcagagaa

SEQ ID NO: 423441 - RNA, 64 nt, hsa
caccuugcaucuugagcaugcauuucucacaauaauuauuaagcugugugauaauuucugcuuu

SEQ ID NO: 423442 - RNA, 64 nt, hsa
auuuccccugugcauaguuauuaauaguauugguauuauuaaaaacuaauuuggcauuuuaaga

SEQ ID NO: 423443 - RNA, 64 nt, hsa
uuuaucuggauuuagcaugugaagaucccuuucaauuauuaagguauaauaggcuguaaagcug

SEQ ID NO: 423444 - RNA, 64 nt, hsa
auauuugugcuauuuaauucuuucuauuuucacaauuauuaaauuguguacacuuucauuacuu

SEQ ID NO: 423445 - RNA, 64 nt, hsa
uucaaaaacuaaaaucauugucaaaauuaauaugauuauuaaucagaauaucagaauaugauuc

SEQ ID NO: 423446 - RNA, 64 nt, hsa
guuggcguggggccuuugucagaacuagaauuugauuauuaacauaggugaaaguuaauccacu

SEQ ID NO: 423447 - RNA, 64 nt, hsa
gagaaucaacauuucucaauaauuuccuccacaaauuauuaaugaaaauaagaauuauuuugau

SEQ ID NO: 423448 - RNA, 64 nt, hsa
uuaaauccaacagacgcugccggucggucagauuauuauuaauauuauuguuguuguuaauuau

SEQ ID NO: 423449 - RNA, 64 nt, hsa
ugcuuuuuguuuuauuuucuugagagaccucaaaauuauuaaauccaacagacgcugccggucg

SEQ ID NO: 423450 - RNA, 64 nt, hsa
auugaauaagcaagaagugcauccuaauccuuugauuauuaaugagguugaauauuugugugcu

SEQ ID NO: 423451 - RNA, 64 nt, hsa
auuugaguacauuugaaaaguagaaaaauuagaaauuauuaacuuuauugaauaagcaagaagu

SEQ ID NO: 423452 - RNA, 64 nt, hsa
ugccugauccaaucauuaucaaguuccauaauucauuauuaagcucugaaauucaggacacaua

SEQ ID NO: 423453 - RNA, 64 nt, hsa
uguguguguguggugugucuuucaugacacugacauuauuaaagaguucaggcaaguuugugga

SEQ ID NO: 423454 - RNA, 64 nt, hsa
aaaagcauaaacuauguuucuuauuacuauuagaauuauuaaauuucaaaaugaauccaaccuu

SEQ ID NO: 423455 - RNA, 64 nt, hsa
uuuccauuugggggcaaacucuauucuugugagcauuauuaaaucuuguuuguaaauauauugu

SEQ ID NO: 423456 - RNA, 64 nt, hsa
uuugaaaaugccagaaguaugaugcaucuuacagauuauuaaaaaagaaagaaaaaccugcaua

SEQ ID NO: 423457 - RNA, 64 nt, hsa
ugucuaagaguauuuuaaacccuuauggauuuucauuauuaaaggaaaugaaacauggcaauuc

SEQ ID NO: 423458 - RNA, 64 nt, hsa
cauucacaacucuugaguuugguguucaggcaucauuauuaaaaaguggaguccuauguaccag

SEQ ID NO: 423459 - RNA, 64 nt, hsa
gauuuacccugcccuugaacuugaaggacauuaaauuauuaaugaucauuugguaacauguuua

SEQ ID NO: 423460 - RNA, 64 nt, hsa
ccuuuuucuaacgggcauuucugauuauuaauuuauuauuaauaaucauguuugucaauggaag

SEQ ID NO: 423461 - RNA, 64 nt, hsa
acuuucaagucccuuuuucuaacgggcauuucugauuauuaauuuauuauuaauaaucauguuu

SEQ ID NO: 423462 - RNA, 64 nt, hsa
auccuucuggacuuaaacacuuaacauuaaccacauuauuaauuguugcugaguuuauuccccc

SEQ ID NO: 423463 - RNA, 64 nt, hsa
gugagauauaagacauacauacuuuagauuuuaaauuauuaaagucaaaaauccauagaaaagu

SEQ ID NO: 423464 - RNA, 64 nt, hsa
acaguuuuauauaaaacucugagaacuagaagaaauuauuaacuuuuuuucuuuuuuaauucua

SEQ ID NO: 423465 - RNA, 64 nt, hsa
gugcuccuccauaucaccagucauacacagccucauuauuaaggucuuauuuaauuucagagug

SEQ ID NO: 423466 - RNA, 64 nt, hsa
cuucugaaagccaagcaccacaaggaaaaaaaaaauuauuaauagcucagguuaaaaacaccca

SEQ ID NO: 423467 - RNA, 64 nt, hsa
uccauucaugaaacuguauuugauacauaauccuauuauuaauucguaugcuuagucaaccuag

SEQ ID NO: 423468 - RNA, 64 nt, hsa
ccaguuauccuuguauccauguaauuucagaugaauuauuaagcaaacauuuuaaagugaauuc

SEQ ID NO: 423469 - RNA, 64 nt, hsa
augaauuauuaagcaaacauuuuaaagugaauucauuauuaaaaacuauucauuuuuuuccuuu

SEQ ID NO: 423470 - RNA, 64 nt, hsa
ugaccaagucuuaaaugcuagaaucugagaaggaauuauuaaauaggugaguuguugagcgaga

SEQ ID NO: 423471 - RNA, 64 nt, hsa
acauauauuauguucucuguaguuacuggcugugauuauuaauaauauugccgcacccuaauau

SEQ ID NO: 423472 - RNA, 64 nt, hsa
guuucagcccuagacugcccaaggaguauuauuaauuauuaauaaaugaauucugugcuuuuaa

SEQ ID NO: 423473 - RNA, 64 nt, hsa
gaucaauguuucagcccuagacugcccaaggaguauuauuaauuauuaauaaaugaauucugug

SEQ ID NO: 423474 - RNA, 64 nt, hsa
aagcaagguauaagcaguuaaagcaaaguuauuaauuauuaauauaugagaauuuaaaauuuua

SEQ ID NO: 423475 - RNA, 64 nt, hsa
uaugagaauuuaaaauuuuauaaauaaguuagaaauuauuaauguauuuuaaauauggaguaaa

SEQ ID NO: 423476 - RNA, 64 nt, hsa
ccauacccucauuccuccuuacacaauuucuccuauuauuaagauggugcauuaguguggcaca

SEQ ID NO: 423477 - RNA, 64 nt, hsa
acauuuguuacaaaugaugaaccaauauuaauuuauuauuaauuauagcccauaguucacauua

SEQ ID NO: 423478 - RNA, 64 nt, hsa
caaugagaaacuuacuuuugcuccuuuauacagaauuauuaacuauauuuuacuaacuaaaaaa

SEQ ID NO: 423479 - RNA, 64 nt, hsa
aucccucugauuccacuauccagagauagccauuauuauuaauauuugguauguacauccuuau

SEQ ID NO: 423480 - RNA, 64 nt, hsa
uugaacgucaggcuaaaaaagcagccaugcauuuauuauuaaacauuuucuaccgacaaggcac

SEQ ID NO: 423481 - RNA, 64 nt, hsa
ucaucuuacuaaugaaaauaauguuuucccauauauuauuaaaaagcauacagucuaaauaaua

SEQ ID NO: 423482 - RNA, 64 nt, hsa
ucagaagcaguguuucauuuugaacacauuuuggauuauuaagcugacuaagcaaugaucuaau

SEQ ID NO: 423483 - RNA, 64 nt, hsa
uuuuaaaacucucaggacugaacagaagagaaaaauuauuaauuagcugcuacuguauguugau

SEQ ID NO: 423484 - RNA, 64 nt, hsa
aacauaugaaggcauaaagauauacagaagaaaaauuauuaaacaacucauuuuaagauucaaa

SEQ ID NO: 423485 - RNA, 64 nt, hsa
uaauuuuacuaauacauguucucaauucauucauauuauuaagcucuuccugcaguugauaucu

SEQ ID NO: 423486 - RNA, 64 nt, hsa
agguaagaaauaggcaugaugauaagcuaugcagauuauuaaaaagcuugauacauuugauuuu

SEQ ID NO: 423487 - RNA, 64 nt, hsa
acaggugugagcuaccgcgccuggccaugaugauauuauuaaacaccauuauucacauuucaaa

SEQ ID NO: 423488 - RNA, 64 nt, hsa
uuucauuucugaauagcuuuugaauuuaugaaaaauuauuaacaaugaaaaauugguaauuuua

SEQ ID NO: 423489 - RNA, 64 nt, hsa
acauuuaaaugauauaaaaagaagagguugaaagauuauuaaauaacuuaucaggcaucucaau

SEQ ID NO: 423490 - RNA, 64 nt, hsa
auucuauuuuguguccauauuccauuagauugugauuauuaauuuucuagcuaugguauuacua

SEQ ID NO: 423491 - RNA, 64 nt, hsa
acauuuaaaggauauaaaaagaagagguugaaagauuauuaaauaacuuaucaggcaucucaau

SEQ ID NO: 423492 - RNA, 64 nt, hsa; identical to SEQ ID NO: 423490

SEQ ID NO: 423493 - RNA, 64 nt, hsa; identical to SEQ ID NO: 323034

SEQ ID NO: 423494 - RNA, 64 nt, hsa; identical to SEQ ID NO: 323035

SEQ ID NO: 423495 - RNA, 64 nt, hsa; identical to SEQ ID NO: 323036

SEQ ID NO: 423496 - RNA, 64 nt, hsa; identical to SEQ ID NO: 323037

SEQ ID NO: 423497 - RNA, 64 nt, hsa; identical to SEQ ID NO: 323038

SEQ ID NO: 423498 - RNA, 64 nt, hsa; identical to SEQ ID NO: 323039

SEQ ID NO: 423499 - RNA, 64 nt, hsa; identical to SEQ ID NO: 323040

SEQ ID NO: 423500 - RNA, 64 nt, hsa; identical to SEQ ID NO: 323041

SEQ ID NO: 423501 - RNA, 64 nt, hsa; identical to SEQ ID NO: 323042

SEQ ID NO: 423502 - RNA, 64 nt, hsa; identical to SEQ ID NO: 323043

SEQ ID NO: 423503 - RNA, 64 nt, hsa; identical to SEQ ID NO: 323044

SEQ ID NO: 423504 - RNA, 64 nt, hsa; identical to SEQ ID NO: 323045

SEQ ID NO: 423505 - RNA, 64 nt, hsa; identical to SEQ ID NO: 323046

SEQ ID NO: 423506 - RNA, 64 nt, hsa; identical to SEQ ID NO: 323047

SEQ ID NO: 423507 - RNA, 64 nt, hsa; identical to SEQ ID NO: 323048

SEQ ID NO: 423508 - RNA, 64 nt, hsa; identical to SEQ ID NO: 323049

SEQ ID NO: 423509 - RNA, 64 nt, hsa; identical to SEQ ID NO: 323050

SEQ ID NO: 423510 - RNA, 64 nt, hsa; identical to SEQ ID NO: 323051

SEQ ID NO: 423511 - RNA, 64 nt, hsa; identical to SEQ ID NO: 323052

SEQ ID NO: 423512 - RNA, 64 nt, hsa; identical to SEQ ID NO: 323053

SEQ ID NO: 423513 - RNA, 64 nt, hsa; identical to SEQ ID NO: 323054

SEQ ID NO: 423514 - RNA, 64 nt, hsa; identical to SEQ ID NO: 323055

SEQ ID NO: 423515 - RNA, 64 nt, hsa; identical to SEQ ID NO: 323056

SEQ ID NO: 423516 - RNA, 64 nt, hsa; identical to SEQ ID NO: 323057

SEQ ID NO: 423517 - RNA, 64 nt, hsa; identical to SEQ ID NO: 323058

SEQ ID NO: 423518 - RNA, 64 nt, hsa; identical to SEQ ID NO: 323059

SEQ ID NO: 423519 - RNA, 64 nt, hsa; identical to SEQ ID NO: 323060

SEQ ID NO: 423520 - RNA, 64 nt, hsa; identical to SEQ ID NO: 60537

SEQ ID NO: 423521 - RNA, 64 nt, hsa; identical to SEQ ID NO: 60538

SEQ ID NO: 423522 - RNA, 64 nt, hsa; identical to SEQ ID NO: 60539

SEQ ID NO: 423523 - RNA, 64 nt, hsa; identical to SEQ ID NO: 60540

SEQ ID NO: 423524 - RNA, 64 nt, hsa; identical to SEQ ID NO: 60541

SEQ ID NO: 423525 - RNA, 64 nt, hsa
uucugcugaggguggagugucccauccuuuuaaucaaggugauugugauuuugacuaauaaaaa

SEQ ID NO: 423526 - RNA, 64 nt, hsa
uaaccuccuuaaccaccagcaucccuccucuccccaaggugaaguggagggugcuguggugagc

SEQ ID NO: 423527 - RNA, 64 nt, hsa
aaaaagguggagagggagaugugugagcauccugcaaggugaaacgacucaaaaugacaguuuc

SEQ ID NO: 423528 - RNA, 64 nt, hsa
gagagucaggauaaaaaauacauacuguggucggcaaggugagggagauagggauauccagggg

SEQ ID NO: 423529 - RNA, 64 nt, hsa
uuuuacauuuccuguuuguauuauuuugugagagcaaggugaucaugcugcuuaagguccaggu

SEQ ID NO: 423530 - RNA, 64 nt, hsa
ccauguugaggggcuccauucccaauuccugggucaaggugaauuaacccuauguuggagcacu

SEQ ID NO: 423531 - RNA, 64 nt, hsa; identical to SEQ ID NO: 367108

SEQ ID NO: 423532 - RNA, 64 nt, hsa; identical to SEQ ID NO: 367109

SEQ ID NO: 423533 - RNA, 64 nt, hsa; identical to SEQ ID NO: 367110

SEQ ID NO: 423534 - RNA, 64 nt, hsa; identical to SEQ ID NO: 367111

SEQ ID NO: 423535 - RNA, 64 nt, hsa; identical to SEQ ID NO: 367112

SEQ ID NO: 423536 - RNA, 52 nt, hsa; identical to SEQ ID NO: 367113

SEQ ID NO: 423537 - RNA, 64 nt, hsa; identical to SEQ ID NO: 367114

SEQ ID NO: 423538 - RNA, 64 nt, hsa; identical to SEQ ID NO: 367115

SEQ ID NO: 423539 - RNA, 64 nt, hsa; identical to SEQ ID NO: 367116

SEQ ID NO: 423540 - RNA, 64 nt, hsa; identical to SEQ ID NO: 367117

SEQ ID NO: 423541 - RNA, 64 nt, hsa; identical to SEQ ID NO: 367118

SEQ ID NO: 423542 - RNA, 64 nt, hsa; identical to SEQ ID NO: 367119

SEQ ID NO: 423543 - RNA, 64 nt, hsa; identical to SEQ ID NO: 367120

SEQ ID NO: 423544 - RNA, 64 nt, hsa; identical to SEQ ID NO: 367121

SEQ ID NO: 423545 - RNA, 64 nt, hsa; identical to SEQ ID NO: 367122

SEQ ID NO: 423546 - RNA, 64 nt, hsa; identical to SEQ ID NO: 367123

SEQ ID NO: 423547 - RNA, 64 nt, hsa; identical to SEQ ID NO: 367124

SEQ ID NO: 423548 - RNA, 64 nt, hsa; identical to SEQ ID NO: 367125

SEQ ID NO: 423549 - RNA, 64 nt, hsa; identical to SEQ ID NO: 367126

SEQ ID NO: 423550 - RNA, 64 nt, hsa; identical to SEQ ID NO: 367127

SEQ ID NO: 423551 - RNA, 64 nt, hsa; identical to SEQ ID NO: 367127

SEQ ID NO: 423552 - RNA, 64 nt, hsa; identical to SEQ ID NO: 367129

SEQ ID NO: 423553 - RNA, 64 nt, hsa; identical to SEQ ID NO: 367130

SEQ ID NO: 423554 - RNA, 64 nt, hsa; identical to SEQ ID NO: 367131

SEQ ID NO: 423555 - RNA, 64 nt, hsa; identical to SEQ ID NO: 367132

SEQ ID NO: 423556 - RNA, 64 nt, hsa; identical to SEQ ID NO: 367133

SEQ ID NO: 423557 - RNA, 64 nt, hsa; identical to SEQ ID NO: 367134

SEQ ID NO: 423558 - RNA, 64 nt, hsa; identical to SEQ ID NO: 367135

SEQ ID NO: 423559 - RNA, 64 nt, hsa; identical to SEQ ID NO: 367136

SEQ ID NO: 423560 - RNA, 64 nt, hsa; identical to SEQ ID NO: 367137

SEQ ID NO: 423561 - RNA, 64 nt, hsa; identical to SEQ ID NO: 367138

SEQ ID NO: 423562 - RNA, 64 nt, hsa; identical to SEQ ID NO: 166381

SEQ ID NO: 423563 - RNA, 64 nt, hsa; identical to SEQ ID NO: 166382

SEQ ID NO: 423564 - RNA, 64 nt, hsa; identical to SEQ ID NO: 166383

SEQ ID NO: 423565 - RNA, 64 nt, hsa; identical to SEQ ID NO: 166384

SEQ ID NO: 423566 - RNA, 64 nt, hsa; identical to SEQ ID NO: 166385

SEQ ID NO: 423567 - RNA, 64 nt, hsa; identical to SEQ ID NO: 166386

SEQ ID NO: 423568 - RNA, 64 nt, hsa; identical to SEQ ID NO: 166387

SEQ ID NO: 423569 - RNA, 64 nt, hsa; identical to SEQ ID NO: 166388

SEQ ID NO: 423570 - RNA, 64 nt, hsa; identical to SEQ ID NO: 166389

SEQ ID NO: 423571 - RNA, 64 nt, hsa; identical to SEQ ID NO: 166390

SEQ ID NO: 423572 - RNA, 64 nt, hsa; identical to SEQ ID NO: 166391

SEQ ID NO: 423573 - RNA, 64 nt, hsa; identical to SEQ ID NO: 166392

SEQ ID NO: 423574 - RNA, 64 nt, hsa; identical to SEQ ID NO: 166393

SEQ ID NO: 423575 - RNA, 64 nt, hsa; identical to SEQ ID NO: 166394

SEQ ID NO: 423576 - RNA, 64 nt, hsa; identical to SEQ ID NO: 166395

SEQ ID NO: 423577 - RNA, 64 nt, hsa; identical to SEQ ID NO: 166396

SEQ ID NO: 423578 - RNA, 64 nt, hsa; identical to SEQ ID NO: 166397

SEQ ID NO: 423579 - RNA, 64 nt, hsa
cugacauggcccaguagaacagggcauugauggaucacaugagaugguagaaggaacaucauca

SEQ ID NO: 423580 - RNA, 64 nt, hsa
guuuuucgaauauuuauauagaaaaaaagucuuuucacaugacaaaugacacucucacaccagu

SEQ ID NO: 423581 - RNA, 64 nt, hsa
gcauguccccagcgaggggguugggggauggaguucacaugaagauguaaggaauuuggguggg

SEQ ID NO: 423582 - RNA, 64 nt, hsa
gauucauuacaagacuuugggcucuuaugucacaucacaugauuuggagaaauuagacacaauc

SEQ ID NO: 423583 - RNA, 64 nt, hsa
agagcugauuuuaauggccacaucuaaucucauuucacaugaaagaagaaguauauuuuagaaa

SEQ ID NO: 423584 - RNA, 64 nt, hsa
aaguacagcugaaauucagaggacccauaagaguucacaugaaaaaaaucaauuuauuugaaaa

SEQ ID NO: 423585 - RNA, 64 nt, hsa
acgaguucaggcagaccuggaagcuguucagcucucacaugaauaucgacauuacagaugacug

SEQ ID NO: 423586 - RNA, 64 nt, hsa
gcuacaaaaauacaacaugcaauuccugauccguucacaugaaugcaaaccugaaggcuaugaa

SEQ ID NO: 423587 - RNA, 64 nt, hsa
auguaaauuuacauuuuugaauaugcuuguuguuucacaugauacauuuaggguaugcagcucc

SEQ ID NO: 423588 - RNA, 64 nt, hsa
caucuguuucaaaugugggacuuacaagcacuucucacaugagaaauuaggggcgggugggaag

SEQ ID NO: 423589 - RNA, 64 nt, hsa
ccauuuuagaauuuucuaagggaauuuaaugaauucacaugaaagggguagucugagugacaca

SEQ ID NO: 423590 - RNA, 64 nt, hsa
ccucaggcuguuuagggaccauugccugucuuggucacaugagucugucuccuuacuuuagucc

SEQ ID NO: 423591 - RNA, 64 nt, hsa
cccugccccucaugcagacugcccugcuggggccgggccggaggguggagcagaaaggggaccc

SEQ ID NO: 423592 - RNA, 64 nt, hsa
gggcgaggucggaagcugcaggccagcugggcccgggccggagcgugcccggcggggcugcccg

SEQ ID NO: 423593 - RNA, 64 nt, hsa
ugacgauuuagcuguggcucccuccuccuguccucccccgcacccccucccuucugggaaacaa

SEQ ID NO: 423594 - RNA, 64 nt, hsa
ccuggaagggccggcuucugccuggggugcauuucccccgcagugcauaccggacuugucacac

SEQ ID NO: 423595 - RNA, 64 nt, hsa
aagaggaucuuuaggccugaguugugaagcgcaacccccgcaaaacgcauuugccaucacaguu

SEQ ID NO: 423596 - RNA, 64 nt, hsa
uuguuaaaggaguuccugucaccugcuccccccacccccgcaugcgucuguccacuuggcuaac

SEQ ID NO: 423597 - RNA, 64 nt, hsa
ggguacgggggcgcggcagggguccccggccccucccccgcagaggucaaugccaacgaacaaa

SEQ ID NO: 423598 - RNA, 64 nt, hsa
cccccaccccacccacccucggggcgccccccuccccccgcaagccagccugggccagccccgc

SEQ ID NO: 423599 - RNA, 64 nt, hsa
uacauaucuuuaugauuuucaucauaaagacuggcaauauuauaacuaaaaaucuuacuauaau

SEQ ID NO: 423600 - RNA, 64 nt, hsa
acugauaauugcaacuguuucuuauccuaagauucaauauuacguuauacaaauuuuuaaaauu

SEQ ID NO: 423601 - RNA, 64 nt, hsa
guaauagcaacuuuuaaaauugucauuaguucugcaauauuagcugaaauguaguacagaaaag

SEQ ID NO: 423602 - RNA, 64 nt, hsa
uacuuaagucugcauuuguuacugugcuaauaaacaauauuaaaaaccaccuaauaaacacugc

SEQ ID NO: 423603 - RNA, 64 nt, hsa
auauaauauacuaugcauaaauuuuaacaacacacaauauuauauugcauauugcccaauaagc

SEQ ID NO: 423604 - RNA, 64 nt, hsa
aauaacaaauuaaaagcuauauauaaacgguuaacaauauuagguggacauauuuguuugaaga

SEQ ID NO: 423605 - RNA, 64 nt, hsa
auuuuauggggcuacugcagauaaaaauaggacacaauauuaaaggagcuacagaaggaaggga

SEQ ID NO: 423606 - RNA, 64 nt, hsa
caaauaugcaaauuugguacugcaguuuguuaugcaauauuauaucaccaacccaguaucacaa

SEQ ID NO: 423607 - RNA, 64 nt, hsa
aaccagaggcuugcaucgcuauucuuucaccugucaauauuaauaagaaaauagucucaucuca

SEQ ID NO: 423608 - RNA, 64 nt, hsa
agauuauaugcaguaaacccaacuggaagauuaacaauauuaaaauaugaaacauuuuuaagac

SEQ ID NO: 423609 - RNA, 64 nt, hsa
cccuucucuuuccuucccuuucccuaaaucaaaucaauauuaauugugccuuauuucacuuaac

SEQ ID NO: 423610 - RNA, 64 nt, hsa
gagacagggauuuuuuuaaagagcaagaaagucacaauauuacuucuuuccuuccuuuuuuccu

SEQ ID NO: 423611 - RNA, 64 nt, hsa
uuuuauucucuccaaacacuuuuggauuaggguacaauauuagagcucuaaaaaggaauaguag

SEQ ID NO: 423612 - RNA, 64 nt, hsa
cauucuaagauucccauaucuuuugguuaggggacaauauuagagcuuuuaaaaaggaagggua

SEQ ID NO: 423613 - RNA, 64 nt, hsa
cccaucauuuggaaaaauaaaggcaucugaaguacaauauuacuuauagaaauaguuuauauuc

SEQ ID NO: 423614 - RNA, 64 nt, hsa
gagaagggggcuguagaguuugaaaaagcauauucaauauuaaaauaguuuuauauuugggaag

SEQ ID NO: 423615 - RNA, 64 nt, hsa
aggggaagacuguggucaaguuaaaaaaaaaaaacaauauuaaacaacaugaaacugcagucug

SEQ ID NO: 423616 - RNA, 64 nt, hsa
uuagaaauguuuuuaagagcuaugugaaaacagacaauauuaguuuaggucgggaacugagaua

SEQ ID NO: 423617 - RNA, 64 nt, hsa
cuugugaaucuuuucuuaagaaaucccaaaaagccaauauuaguuaaaauucuguuguuuaauu

SEQ ID NO: 423618 - RNA, 64 nt, hsa
cacugucucuguuggugguacaucuuguugaauucaauauuagaaaguauuucuuuuuggggua

SEQ ID NO: 423619 - RNA, 64 nt, hsa
cagaaggcagaggccaccacuggacuauugguuucaauauuagaccacuguagccgaaucagag

SEQ ID NO: 423620 - RNA, 64 nt, hsa
gaaagaagaguucugagcagggccuagucuuagccaauauuaaaacauacuaugaagccucuga

SEQ ID NO: 423621 - RNA, 63 nt, hsa
auguuaucuuccauucuauuuuuaucugcuuuuugcugcuaguuucaaacugccaguauuuuu

SEQ ID NO: 423622 - RNA, 63 nt, hsa
gaccauucgcgauuuagaaguuguggagggaagugcugcuagauuugacugcaagauugaagg

SEQ ID NO: 423623 - RNA, 63 nt, hsa
uaugagaauguuuugcguaggggcaacacagucugcugcuauauagugggggaagcgugcacu

SEQ ID NO: 423624 - RNA, 63 nt, hsa
uuaaacauuuuuaaucacaagcuguauuagcuuugcugcuauauagguguuauguguaaaugc

SEQ ID NO: 423625 - RNA, 63 nt, hsa
uaauuuuguaaaugccaaaugaaaaacguuuuuugcugcuauggucuuagccuguagacaugc

SEQ ID NO: 423626 - RNA, 63 nt, hsa
guuuuuugcugcuauggucuuagccuguagacaugcugcuaguaucagaggggcaguagagcu

SEQ ID NO: 423627 - RNA, 63 nt, hsa
cuuugggauuucaggugucccaugaucuugaugugcugcuaggcuggagcacacacuggccau

SEQ ID NO: 423628 - RNA, 63 nt, hsa
acaguauuuaacuugaaauucaucaugggagucugcugcuauaccaggcacaagauaaaacuc

SEQ ID NO: 423629 - RNA, 63 nt, hsa
gugucucguaaaggucaucucacggaauccaauugcugcuaccucaccauguugcugugcccu

SEQ ID NO: 423630 - RNA, 63 nt, hsa
cccacucacuuugugugcucuuaaccuucugagugcugcuagcccagaccuguggacgaggca

SEQ ID NO: 423631 - RNA, 63 nt, hsa
ggacggucuacucagcacaacugacugcuucagugcugcuaucagaagaugucuucuaucuuu

SEQ ID NO: 423632 - RNA, 63 nt, hsa
aauagccauaauuuuaccagccuuucugucauaugcugcuauuacaaaguggaagcuguugaa

SEQ ID NO: 423633 - RNA, 63 nt, hsa
uuauuuccaaauuguuaaagagccagccauugaugcugcuacaugaguuccaugcucaagagc

SEQ ID NO: 423634 - RNA, 63 nt, hsa
ugucuugcagacagagacccuuggcuaccacugugcugcuaauaggauaaguacucuguugcc

SEQ ID NO: 423635 - RNA, 63 nt, hsa
aacuaacacucccccuccuccaccccagccugcugcugcuacugcugcccgcugcugcucugu

SEQ ID NO: 423636 - RNA, 63 nt, hsa
agaagagagggcugggcggggaggagcugcuacugcugcuaccgaggcugugggccucauccu

SEQ ID NO: 423637 - RNA, 63 nt, hsa
cuuguucuucuuaaaugugacaugaaauaauugugcugcuacauuauacuggaaauuaacagg

SEQ ID NO: 423638 - RNA, 63 nt, hsa
ggauuagggugggaucuuugaaaagcugacauuugcugcuaucauuccaacacuaaauucuua

SEQ ID NO: 423639 - RNA, 63 nt, hsa
augacgccccagaaaugcugcuuccauaucagcugcugcuagcgccagcgcagacucucaggg

SEQ ID NO: 423640 - RNA, 63 nt, hsa
agaugacacguggugauugugaagaugguaauuugcugcuaauagaguccucaaaggguuaag

SEQ ID NO: 423641 - RNA, 63 nt, hsa
uuaagucuuauuuuuacuguuuauauauuugaaugcugcuacaacagaugaucuucaucccug

SEQ ID NO: 423642 - RNA, 63 nt, hsa
gugcauuaauauuuucaauuuguuuaaccacuuugcugcuaagauuuugccgucccauuccca

SEQ ID NO: 423643 - RNA, 63 nt, hsa
cagccaccuccagacaccagugcgugcucccgaugcugcuauggaaggugcuacuugaccuaa

SEQ ID NO: 423644 - RNA, 63 nt, hsa
guguacaaugccuuugaugaacuguuuuguaagugcugcuauaucuauccauuuuuuaauaaa

SEQ ID NO: 423645 - RNA, 63 nt, hsa
uacaacaagcccuacaauuagagauugcugaacugcugcuaaagugauuuuuuuuuuauuuga

SEQ ID NO: 423646 - RNA, 63 nt, hsa
cuaacauuuuguucccauuaccagaagcaaagcugcugcuaacccaacaucuggcacauagga

SEQ ID NO: 423647 - RNA, 64 nt, hsa
ugauuugauugugauuagagaaccuuggacauuuugcugcuaaagaaucuuuuuuccccucucc

SEQ ID NO: 423648 - RNA, 64 nt, hsa
ccggcucagucggccagacuuccucuaggaguggugcugcuaccuuguauguuuacauaaugcu

SEQ ID NO: 423649 - RNA, 64 nt, hsa
uaacagaaaagauauuuauuggccaggaaguuggugcugcuaagaccgagaaauuuaaagaauc

SEQ ID NO: 423650 - RNA, 64 nt, hsa
uuucuauucgggacaauaaaauguauuuugaaagugcugcuaacuauugaugcugacaguguuu

SEQ ID NO: 423651 - RNA, 64 nt, hsa
aagucaguuauuagauuuaaaucaccuucugaaaugcugcuauagggcugguaucuguaaaaga

SEQ ID NO: 423652 - RNA, 64 nt, hsa
uuuuaaaucaauggagagaaaaaacugaaaaagaugcugcuaaguaguucucuguauuaaagga

SEQ ID NO: 423653 - RNA, 64 nt, hsa
caaauugcuaaauuccaaacagaaccagugacuuugcugcuacauauuuacuaaauugaccacu

SEQ ID NO: 423654 - RNA, 64 nt, hsa
uucauagcaacauaaugugucccugaguagaggaugcugcuaugcgugaguucauggacacaag

SEQ ID NO: 423655 - RNA, 64 nt, hsa
uuauucagaugacugcagaaccuggaaaagcuguugcugcuauugaugcauaacauacugcuau

SEQ ID NO: 423656 - RNA, 64 nt, hsa
aguuuccucugcucagcaucauuucaugccaaagugcugcuaugggcugcuuugugugcacaaa

SEQ ID NO: 423657 - RNA, 64 nt, hsa
caaacaaaaaaaacuguuaucgaacuuucuuuguugcugcuaguuaaaacuuguugcaacuuuu

SEQ ID NO: 423658 - RNA, 64 nt, hsa
caggguucuguaugauggagacuauuauugcuauugcugcuaauuccaugagcugugaagaucc

SEQ ID NO: 423659 - RNA, 64 nt, hsa
ggauggaggagacagaauaggaggaaagugaugcugcugcuaagaauauucgaggucaagagcu

SEQ ID NO: 423660 - RNA, 64 nt, hsa
aauucugcguuuuugguuuuaauguuauaucugaugcugcuauauccacuguccaacggaguua

SEQ ID NO: 423661 - RNA, 64 nt, hsa
aauuuuuguaagaaaccgaggcgaugccacgcuuugcugcuaccgcccugggcuggacuggagg

SEQ ID NO: 423662 - RNA, 64 nt, hsa
cuggaucuuuccacauuucagcagcaccaacaucugcugcuacucaaaauguccuguugaagag

SEQ ID NO: 423663 - RNA, 64 nt, hsa
ugaccccuggggaaugccccauggcccagaaugaugcugcuaguuuucuacugagugaagccau

SEQ ID NO: 423664 - RNA, 64 nt, hsa
uugggcauuugaacuuuguuuuucuuuaaagaaaugcugcuauuaaacauauuuguaaaugguu

SEQ ID NO: 423665 - RNA, 64 nt, hsa
gaugagcuacgccuugaugaaagaaccguguuggugcugcuaaguuuagccauuaugguuuuuc

SEQ ID NO: 423666 - RNA, 64 nt, hsa
caccugggcaauuccuguuuucuaagguggucucugcugcuauuuaacaacccagaguaggccu

SEQ ID NO: 423667 - RNA, 64 nt, hsa
guaucccucguuuaucauccccuuuguuugugauugcugcuaaagucaguaguaucguuuuuuu

SEQ ID NO: 423668 - RNA, 64 nt, hsa
guuacacacugcccacacucagagcaagaugaguugcugcuauucuuugccugccccugggguu

SEQ ID NO: 423669 - RNA, 64 nt, hsa
uuugcuggcuucagaagccuuuguacauaagagaugcugcuacccaagcaccaaagaccuguua

SEQ ID NO: 423670 - RNA, 64 nt, hsa
cuuaucccguuaguacaguauguaauagugggucugcugcuacuuucuguuuuaaggugugagg

SEQ ID NO: 423671 - RNA, 64 nt, hsa
auacugggacauauuuaaauacugaguauaguacugcugcuacugcuucuacaauguaaaaugu

SEQ ID NO: 423672 - RNA, 64 nt, hsa
acuguugcuuugguagagaugagaggccgcauuuugcugcuaaagcaagagaaacuuggagcug

SEQ ID NO: 423673 - RNA, 64 nt, hsa
aauaucuucuuuuaccuaucaauauucauugaacugcugcuacauccagacacugugcaaauaa

SEQ ID NO: 423674 - RNA, 64 nt, hsa
gacagauucugcccagucucugggcauccauaauugcugcuaaccuagacauuucauaguuaca

SEQ ID NO: 423675 - RNA, 64 nt, hsa
aagucccagcugaauucuugcccuuaagugcuuuugcugcuauuuuuuugcccccaguuccaca

SEQ ID NO: 423676 - RNA, 64 nt, hsa
agaucaacaaugaaguauuuuauaaauguauuuaugcugcuagacugugggucaaauguuucca

SEQ ID NO: 423677 - RNA, 64 nt, hsa
ccucaacugccccaaaucucuuaauagcuucuagugcugcuacaaucuaagucaggucaccaga

SEQ ID NO: 423678 - RNA, 64 nt, hsa
acaggccaaucagacagggcccagagcaucucuuugcugcuacuguuuugccauccuucuauuc

SEQ ID NO: 423679 - RNA, 64 nt, hsa
ucuguccuuaaggaaugguccucugggagggcugugcugcuaguggguaccucagucacacacc

SEQ ID NO: 423680 - RNA, 64 nt, hsa
ccgagaagcagggugagagauucuaacgacuggaugcugcuaguaacacauuguuuguauugcu

SEQ ID NO: 423681 - RNA, 64 nt, hsa
ugaaauuguaucucagucuaaggucucaugcuguugcugcuacugucuuacuauuauagcaacu

SEQ ID NO: 423682 - RNA, 64 nt, hsa
cuuaucauuaggauaggguaagugaaguuugcuaugcugcuagcauccuaagaugauaccuuug

SEQ ID NO: 423683 - RNA, 64 nt, hsa
guaccacuggugagugcuccauaguuuccuuaccugcugcuacagaauguuauuuuacaucccu

SEQ ID NO: 423684 - RNA, 64 nt, hsa
ugaaaacauuuguuauuggcuauuucagguguuuugcugcuagaaauuauuaaaguuacacacu

SEQ ID NO: 423685 - RNA, 64 nt, hsa
cuauaggcuuccuauuuucacuuuacugcucuaaugcugcuagucguagucuuuagcacacuag

SEQ ID NO: 423686 - RNA, 64 nt, hsa
ugagguucuuuucuacaugaugaccuucagcuccugcugcuagucuccaauugccaagggaauu

SEQ ID NO: 423687 - RNA, 64 nt, hsa
ccuuauggaaaugaaauaugaaauuuuauuaaaaugcugcuauauuacauaaguugcuucauua

SEQ ID NO: 423688 - RNA, 64 nt, hsa
uugguugaaaauuguacuugaauacauacaugcaugcugcuaaacuagaacuuuaauuuuuccc

SEQ ID NO: 423689 - RNA, 64 nt, hsa
auucuuacaaaucuuuuaagagggcuguaacaguugcugcuaguauuaggguuccacaucauuc

SEQ ID NO: 423690 - RNA, 64 nt, hsa
ccuguuaauaaaagaauuuacaguuugguaaaauugcugcuaaacaaucauuggaucacaaucc

SEQ ID NO: 423691 - RNA, 64 nt, hsa
uuuuaauggcugccuuuucauuuucaucuuuucuugcugcuacccaucuauguauguagucauu

SEQ ID NO: 423692 - RNA, 64 nt, hsa
cagauaugguaguuaugaagaaaacaaugucauuugcugcuauuauuguaagagucuuauaauu

SEQ ID NO: 423693 - RNA, 64 nt, hsa
cugaaggggagcaccgggcgagugcaugugcuacugcugcuacaggccugucuaucuguuuguc

SEQ ID NO: 423694 - RNA, 64 nt, hsa
ucacggugacaccaccuuccugaggcuucccuccugcugcuaccacugaugcgagggaaaggcc

SEQ ID NO: 423695 - RNA, 64 nt, hsa
caagaacaaugccauuugagagugagguggucccugcugcuacgaggccauuguacuguuuuuu

SEQ ID NO: 423696 - RNA, 64 nt, hsa
uuuuauguuuguacacaacaccuaaaaccaguuuugcugcuauaauucuauacuguugauucgu

SEQ ID NO: 423697 - RNA, 64 nt, hsa
gugcugaguuguaugucuuugcauagcuccacucugcugcuaaauaugcauguucugacugaca

SEQ ID NO: 423698 - RNA, 64 nt, hsa
gaaguucaugagaggacagaagaaagugacuucuugcugcuaguuuugaaggacauuguaucgc

SEQ ID NO: 423699 - RNA, 64 nt, hsa
cccucaccaguuuggacaauuugaaauuaccuauugcugcuacuuguucuguccucugaccuug

SEQ ID NO: 423700 - RNA, 64 nt, hsa
uuguguguuuuuacuuuuuggcuacucugaaugaugcugcuaugaacauauuucuacaagauuu

SEQ ID NO: 423701 - RNA, 64 nt, hsa
uauuuuuuuuaagucuucuugaaggcacucuaauugcugcuaaaugauguugcuucuuugcuaa

SEQ ID NO: 423702 - RNA, 64 nt, hsa
gguauuugcugauaaaaggcauaacgagacauagugcugcuaccacugaauaagugauacuuug

SEQ ID NO: 423703 - RNA, 64 nt, hsa
uauuaggagcuguacauccaauucaaguuuuauuugcugcuauucugggagaauaaacuuguau

SEQ ID NO: 423704 - RNA, 64 nt, hsa
aacuuuugguaggaaggaaaacagggaaggugauugcugcuauucuggaauguguccauugaaa

SEQ ID NO: 423705 - RNA, 64 nt, hsa
acauugagcucaguggccuguuucaucacguaugugcugcuaccuguacagcagacaugccgcu

SEQ ID NO: 423706 - RNA, 64 nt, hsa
gaagaaucaggagaaugcauuucaugucugauucugcugcuaauuaagucaaucauuuaauuuu

SEQ ID NO: 423707 - RNA, 64 nt, hsa
cuggauacacauggagcuguuugggaauuuuccuugcugcuaccgcgcugccaccaaauggaau

SEQ ID NO: 423708 - RNA, 64 nt, hsa
ccuaacucuguuguuuucaaccucuacguuauuuugcugcuaugugcauuuccagaucugauuu

SEQ ID NO: 423709 - RNA, 64 nt, hsa
gccugaugaugugacaaugcauggucuuugugcaugcugcuagacacuuuucuuucccagccga

SEQ ID NO: 423710 - RNA, 64 nt, hsa
ugccucuuccaaaaggggacacagaagcacuggcugcugcuacagaccgcaaaagcagaaaguu

SEQ ID NO: 423711 - RNA, 64 nt, hsa
uagauaucaugcaaauuucaugaccaguaaaggcugcugcuacaauguccuaacugaaagauga

SEQ ID NO: 423712 - RNA, 64 nt, hsa
uuguuugucucuccuuuucuuuuguuacuguucuugcugcuagaacuuuuuuaaauaaacuuuu

SEQ ID NO: 423713 - RNA, 64 nt, hsa
cagcugggaucagccugcagccaucccccgacccugcugcuaggccacggucugcgcccugggg

SEQ ID NO: 423714 - RNA, 64 nt, hsa
guugcuguugcuguugcuguugcuguuggcaucuugcugcuaauccugaggcugguagcagaau

SEQ ID NO: 423715 - RNA, 64 nt, hsa
ccauuaacagcgccucuuugauagguuacccugaugcugcuaaaguaaagccuuaaguguguuu

SEQ ID NO: 423716 - RNA, 64 nt, hsa
augaaaaccauaugauauuuugucuccuaccugcugcugcuauuauguaacauccagaagguuu

SEQ ID NO: 423717 - RNA, 64 nt, hsa
uacccacaugguucucccacugcccugucugcucugcugcuacagaggggcagggccuccccca

SEQ ID NO: 423718 - RNA, 64 nt, hsa
aaagggcaguggauucuggaggcucuacuucaggugcugcuauaaugccucaucuaaucaggac

SEQ ID NO: 423719 - RNA, 64 nt, hsa
auuuuuuucuaaauuuuuagcauuaguccauuucugcugcuaacaauugaauccagaaaucuac

SEQ ID NO: 423720 - RNA, 64 nt, hsa
acucuuccuuucuggccaaggaugaugucaguucugcugcuacuagccuggaguugcagaagcu

SEQ ID NO: 423721 - RNA, 64 nt, hsa
uuggggaagucucuuuuuugaaacacuucagaacugcugcuauaaagaaauucucuaauugguu

SEQ ID NO: 423722 - RNA, 64 nt, hsa
ucuccagaggcagaacacauguuuucagagaagcugcugcuaaggaccuucuagacugcucaca

SEQ ID NO: 423723 - RNA, 64 nt, hsa
ccccugugaaaacuuacuuugccccuagucuggcugcugcuaggacuucugaggagcaauggga

SEQ ID NO: 423724 - RNA, 64 nt, hsa
uagcagcauaauuauuuccaaagaccccaguauuugcugcuauuuuuaaaacuccccugaugua

SEQ ID NO: 423725 - RNA, 64 nt, hsa
cugucacccccaggaggcgcugugguacuggggcugcugcuauuuaagccaagaacugaggucc

SEQ ID NO: 423726 - RNA, 64 nt, hsa
cagucggcgacaagguugugcguggcuccugaccugcugcuaagagucacuugaccagacugca

SEQ ID NO: 423727 - RNA, 64 nt, hsa
aaguccaaaguauaaacaugcuccuuuccucucuugcugcuacucuugcuuuuggaaguuacca

SEQ ID NO: 423728 - RNA, 64 nt, hsa
ugugaaaaauugacagcucccucacucuuaagguugcugcuauauacagucuagguuuucuguu

SEQ ID NO: 423729 - RNA, 64 nt, hsa; identical to SEQ ID NO: 250961

SEQ ID NO: 423730 - RNA, 64 nt, hsa; identical to SEQ ID NO: 250962

SEQ ID NO: 423731 - RNA, 64 nt, hsa
guccuggguaaggcuucauuugaaugaaggguucugcugcuaaaaaaaaaaaaaaagucggaaa

SEQ ID NO: 423732 - RNA, 64 nt, hsa
uuuuucugaguuucucguaaugcucauuuuuacaugcugcuacuagcuuuuuuuuuuaaaaaaa

SEQ ID NO: 423733 - RNA, 64 nt, hsa
uuucuaaaugcaagucaagcuuuauuguuaggcuugcugcuacucauuaacccaaauauuugua

SEQ ID NO: 423734 - RNA, 64 nt, hsa
agccugccaagaauuuuauuucugcuguuuuuuuugcugcuaaagaaaggaacuaagucaggau

SEQ ID NO: 423735 - RNA, 64 nt, hsa
cauuaggagcucuuucucucacucuucugucauuugcugcuauguugaaauucuuauuuugacc

SEQ ID NO: 423736 - RNA, 64 nt, hsa
accauuggcuugccaagaguacagaaauucauuaugcugcuaauuuaacguggaauuccuucau

SEQ ID NO: 423737 - RNA, 64 nt, hsa; identical to SEQ ID NO: 250963

SEQ ID NO: 423738 - RNA, 64 nt, hsa; identical to SEQ ID NO: 250964

SEQ ID NO: 423739 - RNA, 64 nt, hsa
ucucacuuauagagcucuccaggacuggaaaaagugcugcuauuuuaacuugcucuugcuugua

SEQ ID NO: 423740 - RNA, 64 nt, hsa
gacugucuggaugguucauuacucaaguuacugcugcugcuauugucuuuccuuuguugucgau

SEQ ID NO: 423741 - RNA, 64 nt, hsa
gccccgcuuguguaacaguccuguuuuguugaguugcugcuauugcacugccagugcagcccac

SEQ ID NO: 423742 - RNA, 64 nt, hsa
cuacauguaguugcacacgguucaguaaaaauaaugcugcuaucgaguaugcaaauauugaagu

SEQ ID NO: 423743 - RNA, 64 nt, hsa
agcuuaaacuauugacucuauaccucuaaagaauugcugcuacuuugugcaagaacuuugaagg

SEQ ID NO: 423744 - RNA, 64 nt, hsa
uguguguguguuuuuuuuaauuugguugaacauuugcugcuaaugggacuugcccagcugagug

SEQ ID NO: 423745 - RNA, 64 nt, hsa
auaugauugugacuucuaguucuuuucuagaggaugcugcuagaaaaugguuuugcuuuguauu

SEQ ID NO: 423746 - RNA, 64 nt, hsa
ccuguacuguacucccaguggccaaacuuauuuaugcugcuaaaugaaagaaagaaaaaagcaa

SEQ ID NO: 423747 - RNA, 64 nt, hsa
uuguaauagauguuugauagauuuucugcuacuuugcugcuaugguuuucuccaagagcuacau

SEQ ID NO: 423748 - RNA, 59 nt, hsa
agagaccccgugcccuuuaaaccggcauuugcugcuaaaggauacccagaacccucacu

SEQ ID NO: 423749 - RNA, 64 nt, hsa
cuugucaccaugagauagcauuagcugcccaggaugcugcuauauauauauauauauauauaua

SEQ ID NO: 423750 - RNA, 64 nt, hsa
aacuuuuaagauggauaauagggcauggacugagugcugcuaucuugaaaugugcacagguaca

SEQ ID NO: 423751 - RNA, 64 nt, hsa
agagaauucagucuacagccauuuaaaugaucauugcugcuacagaagugcuuuaagagaauug

SEQ ID NO: 423752 - RNA, 64 nt, hsa
ucugagaagcagcuuuaugagguuuuacagaguaugcugcuaccucucuccuugaagggagcau

SEQ ID NO: 423753 - RNA, 64 nt, hsa
ugagcuuugguuuuuagaaauaaagugcaugaauugcugcuaugcuguauccuaguaucccagu

SEQ ID NO: 423754 - RNA, 64 nt, hsa
ggguugacucagagagucgcugucauucugucauugcugcuacucuaacacugagcaacacucu

SEQ ID NO: 423755 - RNA, 64 nt, hsa
accagugaaagacagaucauaggagagacccuuuugcugcuacuucauucguucugaccuaaua

SEQ ID NO: 423756 - RNA, 64 nt, hsa
uccccuggcaaacauugucaccaaggugggauguugcugcuaaugggagagucaucauaaaaaa

SEQ ID NO: 423757 - RNA, 64 nt, hsa
uugugcaguuuuuuaacuagggaaagcuuuguacugcugcuaaugauaugcacccagaaaccuu

SEQ ID NO: 423758 - RNA, 64 nt, hsa
ucuuccugguguacaagccuuuaaagacuucugcugcugcuaugccucuuggaugcacacuuug

SEQ ID NO: 423759 - RNA, 64 nt, hsa
uaaaacaauucuauuucauagcacaucacaauacugcugcuacucuguagccacccccauggcu

SEQ ID NO: 423760 - RNA, 64 nt, hsa
cauucuuuccuuacgcaaagcccaaggaaugagcugcugcuacuuuaaaguguggucauuauga

SEQ ID NO: 423761 - RNA, 64 nt, hsa
uuuaaguuuucuuucuguuucuaagacaacaguaugcugcuauagccgucugcuaccucgagaa

SEQ ID NO: 423762 - RNA, 64 nt, hsa
ccugccacauaagaucuaguuuuuauuucuagagugcugcuaugaauaauuacuauagcugcug

SEQ ID NO: 423763 - RNA, 64 nt, hsa
uuuucugagguaacuggguaauagaauaucaaauugcugcuaucucggaccuauuguuaaagga

SEQ ID NO: 423764 - RNA, 64 nt, hsa
uacuaaguaugcagguuuccugguaccauugaguugcugcuauuaaagcucacacacgaaaugg

SEQ ID NO: 423765 - RNA, 64 nt, hsa
uggcaauuaauuaauccugugaagguuacauugcugcugcuagagaggguggggauugcaccuu

SEQ ID NO: 423766 - RNA, 64 nt, hsa
ucaggcucaugauaaauguauuagucuguucucaugcugcuauuaaagacauaccugacacugg

SEQ ID NO: 423767 - RNA, 64 nt, hsa
gaggaggacgaacagagauccugaaauucugacuugcugcuauuccagaacccagccuccuggg

SEQ ID NO: 423768 - RNA, 64 nt, hsa
guucaauguuccauucuucgacauccgucauugcugcugcuaccagcgccaaauguucauccuc

SEQ ID NO: 423769 - RNA, 64 nt, hsa
aaaagacaguggagaauuuacggaaugacaugaaugcugcuaaaggacuggacucaaacaaaaa

SEQ ID NO: 423770 - RNA, 64 nt, hsa
uuccuguaguaggcuugcuggagcaaaggaaaugugcugcuaaaaaucaacuuaugccauuuua

SEQ ID NO: 423771 - RNA, 64 nt, hsa
cuuuuuuuaaucuuuuuaaaaacugcugugguuuugcugcuacacuaagaauugugauuugcau

SEQ ID NO: 423772 - RNA, 64 nt, hsa
uagaggguuccaugagauuauuguagacucaugaugcugcuaucucaaccagaugcccaggaca

SEQ ID NO: 423773 - RNA, 64 nt, hsa; identical to SEQ ID NO: 250965

SEQ ID NO: 423774 - RNA, 64 nt, hsa; identical to SEQ ID NO: 250966

SEQ ID NO: 423775 - RNA, 64 nt, hsa
auuuuuuuagugcugcauuuuuuuaaaguuggauugcugcuauuuaaaaaaaaaaaaaggacac

SEQ ID NO: 423776 - RNA, 64 nt, hsa
ucuugccaaaauggauccuuugauuuuugucauuugcugcuaaaauauauuaucugaagguaaa

SEQ ID NO: 423777 - RNA, 64 nt, hsa
caccgcgcagcgugacugugaguugcucauaccgugcugcuaucugggcagcgcugcccauuua

SEQ ID NO: 423778 - RNA, 64 nt, hsa
uggguuguuucugacuuuuggcuauugggaauagugcugcuaugaauguuuguguaccuguauu

SEQ ID NO: 423779 - RNA, 64 nt, hsa
ucucugggguaagaguaaaggcuuccagaagacaugcugcuauggucacugagggguuagcuuu

SEQ ID NO: 423780 - RNA, 64 nt, hsa
gggugacagcuccgggaucagcaacccuuccugcugcugcuacugcugcugcugcugccgccgc

SEQ ID NO: 423781 - RNA, 64 nt, hsa
ugugagcugugggacuuuaggcaaguuaucuaaaugcugcuaugcuauagucuccccaccugua

SEQ ID NO: 423782 - RNA, 64 nt, hsa
guugguucguuauuuuuuaagauuagccauucucugcugcuauuucccuacauaaugucaauuu

SEQ ID NO: 423783 - RNA, 64 nt, hsa
gaagucagccugcucuacuacuaacaaacaggccugcugcuagaugaucucuaaugaccaaugg

SEQ ID NO: 423784 - RNA, 64 nt, hsa
gagaacaguacuggccuucaguauaugcauagaaugcugcuagaagacaagugauguccugggu

SEQ ID NO: 423785 - RNA, 64 nt, hsa
gccugcaguuacauugaauuguagguguuucgugugcugcuaagguaugcuuauuugaguuuau

SEQ ID NO: 423786 - RNA, 64 nt, hsa
aauuucauuuuaaucauuggacaccuuugcguuuugcugcuaacaguguguguaugucacccuc

SEQ ID NO: 423787 - RNA, 64 nt, hsa
agcuuuauauguaaagaauuuuagaagaucuuggugcugcuauuccugcuggaggaaugaauag

SEQ ID NO: 423788 - RNA, 64 nt, hsa
uaccuggaaauaauuuaccaaaauaacugaguguugcugcuaaagaacaaaaguggggagguau

SEQ ID NO: 423789 - RNA, 64 nt, hsa
caaugacucguauucagaugcuuaaagaaagcauugcugcuacaaauauuucuauuuuuagaaa

SEQ ID NO: 423790 - RNA, 64 nt, hsa
agagaacacuggcuucacagaggacuuugugcauugcugcuaugaacuuugaccugagucgggg

SEQ ID NO: 423791 - RNA, 64 nt, hsa
ucacauuuuuuaaaagggcaaguacaggagcaacugcugcuacccagaaaaauguguguauuau

SEQ ID NO: 423792 - RNA, 64 nt, hsa
uaaauagccacaguccuuaagccacacacauuguugcugcuaugacuuuuuaccuccuuuaaac

SEQ ID NO: 423793 - RNA, 64 nt, hsa
ugaagccaaauuuauauguccuaguagaaugaagugcugcuaguuuuuaugagaaguauauuau

SEQ ID NO: 423794 - RNA, 64 nt, hsa
cuaguuuaaggugguugauggauuuagccauauaugcugcuaaagaaauugucuaccuuuucuu

SEQ ID NO: 423795 - RNA, 64 nt, hsa
gugaccuuuuccuaugucuaggcuccuccacaggugcugcuauuuugugagcuccggcuccugu

SEQ ID NO: 423796 - RNA, 64 nt, hsa
uaacaguagcuuguagagauccagugcacgccgaugcugcuaaacucagugccugagcccggcc

SEQ ID NO: 423797 - RNA, 64 nt, hsa
agggugcgcagggaggccgggcuugggggcagccugcugcuauguccuugcuggcgcccauacc

SEQ ID NO: 423798 - RNA, 64 nt, hsa
acaaaacaaaucuuauguugcauuuacuaucaacugcugcuaauacguuauuauaaaacuuacc

SEQ ID NO: 423799 - RNA, 64 nt, hsa
uguguucuuuucugaauuucauuucagcaauuuaugcugcuaaauagaaucccgcaugucugca

SEQ ID NO: 423800 - RNA, 64 nt, hsa
uuaauuuauuuuguaaugucuuguuuugaaguauugcugcuauccuuguuauccuucccacugu

SEQ ID NO: 423801 - RNA, 64 nt, hsa
ugagaggacaagaagacacaguuuuagaaucuacugcugcuaaagcacauuaaaaacaaauccu

SEQ ID NO: 423802 - RNA, 64 nt, hsa
uagacuuuuuguuucuugcaacaacagugcccucugcugcuagaaaccuuuuucuacuuacuau

SEQ ID NO: 423803 - RNA, 64 nt, hsa
ccaaagaagaugauuuaaugguagaacggauaccugcugcuagaccugauggaauguuaccugu

SEQ ID NO: 423804 - RNA, 64 nt, hsa
ugucuuguuucuucuuuauguuucuuuuacuuauugcugcuaggauccuacauaggauuucuau

SEQ ID NO: 423805 - RNA, 64 nt, hsa
cuggccccauccucacuuccucuuuuuauuucacugcugcuaaaauuguguuuuuaccuacuac

SEQ ID NO: 423806 - RNA, 64 nt, hsa
ugcuuuuuaacaagaacugaugcuccuugggugcugcugcuacucagacuagcucuaaguaaug

SEQ ID NO: 423807 - RNA, 64 nt, hsa
guccaagacaggggccuaaggagggucuccacacugcugcuaggggcuguugcauuuuuuuauu

SEQ ID NO: 423808 - RNA, 64 nt, hsa
uggaucguuucuacuucuugacuauuauacauaaugcugcuaggaacuuuuguguaugaguuuu

SEQ ID NO: 423809 - RNA, 64 nt, hsa
gcaguguucacaaggauguugguuuggagaugucugcugcuaggaccuggggugugugacucag

SEQ ID NO: 423810 - RNA, 64 nt, hsa
guacgacuaauguuggagccugaaacuauggaaaugcugcuaaaauuuuuauauugacaaacau

SEQ ID NO: 423811 - RNA, 64 nt, hsa
uccaaagaaacccuauauuauauauccacauuacugcugcuaggauucauaguugcacauacug

SEQ ID NO: 423812 - RNA, 64 nt, hsa
gaggaugugugaaaagcucacagagcccgaugccugcugcuauuucacggcaaugagccuuuuu

SEQ ID NO: 423813 - RNA, 64 nt, hsa
ugcagaccuauuagaucugcaguuuaaguugccaugcugcuaggaaauuguccuuuuucuuucu

SEQ ID NO: 423814 - RNA, 64 nt, hsa
aagagcuacuucauucuuuucugaaguuguguguugcugcuagaaauagucauuugugaauuau

SEQ ID NO: 423815 - RNA, 64 nt, hsa; identical to SEQ ID NO: 250967

SEQ ID NO: 423816 - RNA, 64 nt, hsa; identical to SEQ ID NO: 250968

SEQ ID NO: 423817 - RNA, 64 nt, hsa
gaguacugaaauguuuuguaaauuuuuuuuaaugugcugcuagguuuuuuguuuuguuuuguuc

SEQ ID NO: 423818 - RNA, 64 nt, hsa
ccuggaggaagaaugugccuucaggccacagucgugcugcuagaacagucucguagcugcaguu

SEQ ID NO: 423819 - RNA, 64 nt, hsa
aaguccacugaaagucucuaaggaaguauccucuugcugcuaaacuugguacaaguugacuacc

SEQ ID NO: 423820 - RNA, 64 nt, hsa
uguagaguuuuuaaacaucaaucuuuaaaccaauugcugcuacuuauauaauugccaaaaagug

SEQ ID NO: 423821 - RNA, 64 nt, hsa
ugcuuuucuaacaaauucccgcguauuuugccuuugcugcuacuuuuucuaguuagauuucaaa

SEQ ID NO: 423822 - RNA, 64 nt, hsa
uuaagucuguggaucugcugauguacagugccuuugcugcuauggaucaaaaucaaaagaaccg

SEQ ID NO: 423823 - RNA, 64 nt, hsa
auuuuuaucacacagcuaaagucuguaguuaaguugcugcuacuuuugagucaauaacaucaag

SEQ ID NO: 423824 - RNA, 64 nt, hsa
ccuguucccccagaucuugccuugggaccacauuugcugcuacuuuuccugcugcucuauccua

SEQ ID NO: 423825 - RNA, 64 nt, hsa; identical to SEQ ID NO: 250969

SEQ ID NO: 423826 - RNA, 64 nt, hsa; identical to SEQ ID NO: 250970

SEQ ID NO: 423827 - RNA, 64 nt, hsa
auuaugguuuucuuauucgugaaaauucggagagugcugcuaaaauuggauuggugugaucuuu

SEQ ID NO: 423828 - RNA, 64 nt, hsa
ugaaaauauuuguguuuguuuugucugacuaacuugcugcuaaaugcuaucuuuagguguguga

SEQ ID NO: 423829 - RNA, 64 nt, hsa
ugaguuauaucuaauuuuucacucuuauaaauagugcugcuaugaaugucuguaaaaaaaaaaa

SEQ ID NO: 423830 - RNA, 64 nt, hsa
uggaaucaccgacuacugaaucuccuacauguauugcugcuacuucaagcuccuccacuugaaa

SEQ ID NO: 423831 - RNA, 64 nt, hsa
caggaggguccuggcacuacccagauuuccacagugcugcuaauaucccagcuccagccagcac

SEQ ID NO: 423832 - RNA, 64 nt, hsa
aggccugugcugcccgccucaggagguggccgacugcugcuagcggccugccgccacgucagca

SEQ ID NO: 423833 - RNA, 64 nt, hsa
uuucuccccuuuauugaccaauuaacugagcacuugcugcuauuucuagacaugaaaugucacc

SEQ ID NO: 423834 - RNA, 64 nt, hsa
gaagcagcauuucuuguuaacuaguuaagcacuaugcugcuaguuacaguguaggcaccccggc

SEQ ID NO: 423835 - RNA, 64 nt, hsa
ccauggaucagcucuuccuguguuuguaauuuaaugcugcuacaagauguuucuguuucuuaga

SEQ ID NO: 423836 - RNA, 64 nt, hsa
cagccaauccauucacaagcuuggcauugacaugugcugcuaguuuauaaacuggcauugacga

SEQ ID NO: 423837 - RNA, 64 nt, hsa
cugugcuaccuggguccuuuucagaagugagcuuugcugcuacaggggaagguggccucugugg

SEQ ID NO: 423838 - RNA, 64 nt, hsa
cucucaaguaacuaucaaauauuguaaaugcaauugcugcuaguucaguuacauuucugcugau

SEQ ID NO: 423839 - RNA, 64 nt, hsa
ucuuuauaaacuaugccuuccagacaauugauaaugcugcuauaauuaguauuauguugauaau

SEQ ID NO: 423840 - RNA, 64 nt, hsa; identical to SEQ ID NO: 250971

SEQ ID NO: 423841 - RNA, 64 nt, hsa; identical to SEQ ID NO: 250972

SEQ ID NO: 423842 - RNA, 64 nt, hsa
ccaccacacccagcccggacagcuucuuugggagugcugcuaaccuugaaauuaucagacacuu

SEQ ID NO: 423843 - RNA, 64 nt, hsa
caccucccugguccuugcucuuguuaacccaagaugcugcuacacagaugccaaauggaaaucu

SEQ ID NO: 423844 - RNA, 64 nt, hsa
cauuugcuuuaagaaaacagucuugaauuucacaugcugcuauuuuuauauuuugccauuuuac

SEQ ID NO: 423845 - RNA, 64 nt, hsa
gggcccgcugggcaccuggcaccuggccugcagaugcugcuacgagugaccagugcugugugga

SEQ ID NO: 423846 - RNA, 64 nt, hsa
cuacaaacaaaaaucuuugugucuggacaccuggugcugcuaauuguguucaugguuuccuuug

SEQ ID NO: 423847 - RNA, 64 nt, hsa; identical to SEQ ID NO: 250973

SEQ ID NO: 423848 - RNA, 64 nt, hsa; identical to SEQ ID NO: 250974

SEQ ID NO: 423849 - RNA, 64 nt, hsa
ggaugccuuuucuaccccaucccucacagccucuugcugcuaaaauagauguuucauuuuucug

SEQ ID NO: 423850 - RNA, 64 nt, hsa
uuaguauuauguaaauuuaugcugcaauagcuuuugcugcuauuaaaaugguauuauuaauacc

SEQ ID NO: 423851 - RNA, 64 nt, hsa
ccauucaugaaaaacguuuuuaaguauugcuuuuugcugcuauguucugcauugagccuaguuu

SEQ ID NO: 423852 - RNA, 64 nt, hsa
augaugauucuguggagguauugccuugugaauuugcugcuauuuuaguuuugucuuugcugua

SEQ ID NO: 423853 - RNA, 64 nt, hsa
aaugccuguauuuaugaagacagggccauugcacugcugcuaugcugaaaugaacuuuuauaaa

SEQ ID NO: 423854 - RNA, 64 nt, hsa
agcuuuuuuuuaaaaggaaaagauaccaaaugccugcugcuaccacccuuuucaauugcuaucu

SEQ ID NO: 423855 - RNA, 64 nt, hsa
aacauuagccagggagguucuggcuaacguuaaaugcugcuauacaacugcuuugcaacaguug

SEQ ID NO: 423856 - RNA, 64 nt, hsa
ggggcagagcaucugugggguggggucuuccccuugcugcuauuguauggcuggggacuggucu

SEQ ID NO: 423857 - RNA, 64 nt, hsa; identical to SEQ ID NO: 250975

SEQ ID NO: 423858 - RNA, 64 nt, hsa; identical to SEQ ID NO: 250976

SEQ ID NO: 423859 - RNA, 64 nt, hsa
ggggcuuggcugagagaguggcauuggcagcaggugcugcuacccucccugcuguccccucuug

SEQ ID NO: 423860 - RNA, 64 nt, hsa
aaauccuauuaggcaagucaguugaaaaugcucgugcugcuaauggaauuagagugcguucauu

SEQ ID NO: 423861 - RNA, 64 nt, hsa
ucacaucgcuucuguguaucucuuucacauuguuugcugcuauuggaggaucaguuuuuuguuu

SEQ ID NO: 423862 - RNA, 64 nt, hsa
caguuaagacuuguucuuugagugauguauuaaaugcugcuagaaaagccucauuacauuaaau

SEQ ID NO: 423863 - RNA, 64 nt, hsa
cuagauguacaacacugacucaucauaaauguggugcugcuauucgacaaaccaguuuuagcag

SEQ ID NO: 423864 - RNA, 64 nt, hsa
gccuuaggcuauuccaccucucgaucacaagagcugcugcuauaacuuccaguuuuacaucuuu

SEQ ID NO: 423865 - RNA, 64 nt, hsa
agccuuuuaauuuauugaaauguuucaugacuacugcugcuagcucuucaagccagguucaugc

SEQ ID NO: 423866 - RNA, 64 nt, hsa
aagcuccuugaaaauccaggcggguauggaaaggugcugcuacccauaucuuuuugacuuucuu

SEQ ID NO: 423867 - RNA, 64 nt, hsa
cagagggucaggguuggaggccugugcuuguguuugcugcuaauguccagcuacagacccagag

SEQ ID NO: 423868 - RNA, 64 nt, hsa
gcuugguagccccucgaggcagaugcaccugacuugcugcuauuaaaaagccgugugccuucua

SEQ ID NO: 423869 - RNA, 64 nt, hsa
aggaggaacaaguaaaaaccaaaugguuacauugugcugcuagaaauaaugucauucucaauua

SEQ ID NO: 423870 - RNA, 64 nt, hsa
gaccaucggcucuggggaauccuggugaauauagugcugcuauguugacauuauucuuccuaga

SEQ ID NO: 423871 - RNA, 64 nt, hsa
uacaggcacucauugcuacugaaggggacaccaaugcugcuauccgcaagcucaagagauccca

SEQ ID NO: 423872 - RNA, 64 nt, hsa
aaauaggagauuuuguaacugcuugccauuaacuugcugcuaaauucccaauguauugauuaaa

SEQ ID NO: 423873 - RNA, 64 nt, hsa
aguucugcucuagacaguguagggcaacaauacaugcugcuaauucaaagcucuauuaagauuu

SEQ ID NO: 423874 - RNA, 64 nt, hsa
uguauugugaccgugcggcuccaccucuuccagcugcugcuacagcugaggccuggaucccggc

SEQ ID NO: 423875 - RNA, 64 nt, hsa
cgacagggaccgcccucuugucaggacaacugccugcugcuagggucuguugccaaggucaacc

SEQ ID NO: 423876 - RNA, 64 nt, hsa
agcuguaguuuaauggauaaguuguucuaugagcugcugcuaucaguacuuuuuuccacauuuu

SEQ ID NO: 423877 - RNA, 64 nt, hsa
uguaauaaauguguauuuuuguacuugcagaaacugcugcuaacuuuuaaaguuguuugguuuu

SEQ ID NO: 423878 - RNA, 64 nt, hsa
augucauucagaaaccugaaguguggcugcaucuugcugcuaaugugugauguugacgccuaac

SEQ ID NO: 423879 - RNA, 64 nt, hsa
ccuggcuuuccacuuuggaugcccgggcauccgcugcugcuacaucuuagccagaacuugaagu

SEQ ID NO: 423880 - RNA, 64 nt, hsa
cccgccucacuguggcaguguauugccuguuaauugcugcuaauucuaauucugaugaugacuc

SEQ ID NO: 423881 - RNA, 64 nt, hsa
uaaauaaaauuuuguuuuucuguaaugucauauuugcugcuacaguagcucaauauuuuacagg

SEQ ID NO: 423882 - RNA, 64 nt, hsa
uugacaguaccuagcuguaauguuucacagagugugcugcuauuuuauaaacauuuuuauaaua

SEQ ID NO: 423883 - RNA, 64 nt, hsa
ucguaaucucaagguuauuauucugacaccagcuugcugcuaugauuucagagcacauaaguaa

SEQ ID NO: 423884 - RNA, 64 nt, hsa
aucucuuuguacucuguaucuauauaucaaaagcugcugcuaugucucucuucugucuuauucu

SEQ ID NO: 423885 - RNA, 64 nt, hsa
guuacaacgaauuuacagucuaguacuuauuacaugcugcuauacacaagcaaugcaagaaaaa

SEQ ID NO: 423886 - RNA, 64 nt, hsa
ccagaaccuggaacagggacuuucacuugaaucuugcugcuaaauguaaaugccuucucaaaug

SEQ ID NO: 423887 - RNA, 64 nt, hsa
aauaucgacagggcuacacgugauguccccaaacugcugcuauugaagaacuucccaaaacuuc

SEQ ID NO: 423888 - RNA, 64 nt, hsa
acuuuaucaggaugaacccaggacugcuucugaaugcugcuacuugauuucuuucucaucccac

SEQ ID NO: 423889 - RNA, 64 nt, hsa
gaccucaucaggaugaacccaggacgcuucugaaugcugcuacuuaauuccuuucucaucccac

SEQ ID NO: 423890 - RNA, 64 nt, hsa
auuacuggguagauacccaaaggauuacaaaucaugcugcuauaaagacacaugcacacauaug

SEQ ID NO: 423891 - RNA, 64 nt, hsa
uauuucauccagaauagaucaguuauugaagcagugcugcuaacauccauucccuuucauacca

SEQ ID NO: 423892 - RNA, 64 nt, hsa
caguucauacuuaccuaaaauuaaauauaguuuaugcugcuauuguauaaaguagcacauguca

SEQ ID NO: 423893 - RNA, 64 nt, hsa
uaguauuuccuucccuuuuaucuaauuuuuuauaugcugcuaaauauauuuuaaauauacuaug

SEQ ID NO: 423894 - RNA, 64 nt, hsa; identical to SEQ ID NO: 250977

SEQ ID NO: 423895 - RNA, 64 nt, hsa; identical to SEQ ID NO: 250978

SEQ ID NO: 423896 - RNA, 64 nt, hsa
cuggagaaaucuacuccccuuggccaggacaugcugcugcuacugcuaacagccaauuuuauag

SEQ ID NO: 423897 - RNA, 64 nt, hsa
gaagugcuauuaccuuucucaguuaccagaaucuugcugcuaaaguugcaagugauugauaaug

SEQ ID NO: 423898 - RNA, 64 nt, hsa
gagaaacacagugcauuauuuauugcggaaucauugcugcuaaauaacuacugucuguuuauuu

SEQ ID NO: 423899 - RNA, 64 nt, hsa
ugggcuggaguagaggacucuggugggaagguuuugcugcuaauguauuuauggaaugaaugua

SEQ ID NO: 423900 - RNA, 64 nt, hsa
aucagcuagcaaaagaaguaacaagagugauucuugcugcuauuacugcuaaaaaaaaaaaaaa

SEQ ID NO: 423901 - RNA, 64 nt, hsa
guaaagucuagagaggacauugcaccuuugcugcugcugcuaucuuccaagagaacgggacucc

SEQ ID NO: 423902 - RNA, 64 nt, hsa
gaagcaaucgggauaaaacagcauuagauagucaugcugcuagaucuuuauuauggaaaacauu

SEQ ID NO: 423903 - RNA, 64 nt, hsa
guuucugugaucucugaggucuauuuuauguuuuugcugcuacuucuguggaaguagcuuugaa

SEQ ID NO: 423904 - RNA, 64 nt, hsa
auugucugaccacauucuuuuuguauccaaauagugcugcuagaaacugcacugaaguggcuga

SEQ ID NO: 423905 - RNA, 64 nt, hsa
acauaguuagaagaauauauuuauaaagauuccuugcugcuaagucagaucagauuugcuaaca

SEQ ID NO: 423906 - RNA, 64 nt, hsa
uucuucuggacagaccacaacucuaagaagcuagugcugcuaucucauauaugaguauuaaaua

SEQ ID NO: 423907 - RNA, 64 nt, hsa
caucucuccacuguccuguaagcugugcagaaccugcugcuaacaccaaggugugaacaugccc

SEQ ID NO: 423908 - RNA, 64 nt, hsa; identical to SEQ ID NO: 250979

SEQ ID NO: 423909 - RNA, 64 nt, hsa; identical to SEQ ID NO: 250980

SEQ ID NO: 423910 - RNA, 64 nt, hsa
aaaggcucuuaaagagcaaauguccucuucuccuugcugcuagagugggaggagaaagaugucu

SEQ ID NO: 423911 - RNA, 64 nt, hsa
ugauguggcuuaacaaucagacuucuucuauuuuugcugcuauggugguuguauuagagaacug

SEQ ID NO: 423912 - RNA, 64 nt, hsa
aucuaaauuaacuucuauuuucaaguggaaaccuugcugcuaugcuguucauugaugacauggg

SEQ ID NO: 423913 - RNA, 64 nt, hsa
agugcaaagccagcaugcgaguucagcuuccauuugcugcuauaaauuuuguucuuguugcugc

SEQ ID NO: 423914 - RNA, 64 nt, hsa
uuuuuuauuauugcauuuuauuuugacccuggacugcugcuaugaacaauagaauaugcauuug

SEQ ID NO: 423915 - RNA, 64 nt, hsa
ccuuguugaauucuuacaguuuuuagauggaauuugcugcuauaagaauguccagcuaccaugg

SEQ ID NO: 423916 - RNA, 64 nt, hsa
accaguggggacccacacccuggcugggcagaggugcugcuagcaaccucucuuccucuauaag

SEQ ID NO: 423917 - RNA, 64 nt, hsa
aaauacagugucugaguuuucaucggucuucacaugcugcuauauauuccacagaguuccuugc

SEQ ID NO: 423918 - RNA, 64 nt, hsa
agaugucccccaggcaucuugaucccagccugacugcugcuacaucuaauccccuaccaaugcc

SEQ ID NO: 423919 - RNA, 64 nt, hsa
ugguagaaaugaugucagcauucuuauuugcugaugcugcuaugauaccacgccuuaaaaauug

SEQ ID NO: 423920 - RNA, 64 nt, hsa
gucuggggagagcagcacacuggccgcccagcacugcugcuaugacgaggacagccggcugcug

SEQ ID NO: 423921 - RNA, 64 nt, hsa
aggagugguuugaguaguacagaccucgaagccuugcugcuaacacugagguagcucucuucau

SEQ ID NO: 423922 - RNA, 64 nt, hsa
uucuuaaaaguauauuuuuucuauaaacauccuuugcugcuacauuagaacuuuuauagccuaa

SEQ ID NO: 423923 - RNA, 64 nt, hsa; identical to SEQ ID NO: 250981

SEQ ID NO: 423924 - RNA, 64 nt, hsa; identical to SEQ ID NO: 250982

SEQ ID NO: 423925 - RNA, 64 nt, hsa
caaugccagaauguaagaguugcaagugauuuugugcugcuauucauuaaaacuuguauuccag

SEQ ID NO: 423926 - RNA, 64 nt, hsa
gauccuucacaggcagugcaugugaagcaugcuuugcugcuaugaaaaugagcaucagagagug

SEQ ID NO: 423927 - RNA, 64 nt, hsa
ccuggucugaauuucuuaagguuuuauaaacaaaugcugcuauuuauuagcugcaagaaugcac

SEQ ID NO: 423928 - RNA, 64 nt, hsa
uuugauccccuaacucacugucugcggugcucauugcugcuaacagcauugccugugcucuccu

SEQ ID NO: 423929 - RNA, 64 nt, hsa
uuucuuaagcagaaaauauuguugagguuaccuuugcugcuaaagauccaaucuucuaacgcca

SEQ ID NO: 423930 - RNA, 64 nt, hsa
cuagaagacagauggaguucuccccugaacuccuugcugcuaagaagugcugagaaguuacucg

SEQ ID NO: 423931 - RNA, 64 nt, hsa
auaguaauuguuuauauucauaauuauucagcucugcugcuaaacacguaguuccacuucguuu

SEQ ID NO: 423932 - RNA, 64 nt, hsa
acacacuugcaauugugucugguaugcuuguuccugcugcuaauaaaguaaggcccauuacugu

SEQ ID NO: 423933 - RNA, 64 nt, hsa
ugagacugacagcuuugcagguagcaguagugugugcugcuauuguggaauauacguguguaga

SEQ ID NO: 423934 - RNA, 64 nt, hsa
aaacuuaagcaagcaagcguguauuuuccuugucugcugcuauuugaaguaauuaguacagcug

SEQ ID NO: 423935 - RNA, 64 nt, hsa
auauuucucuuuucuguuuaugaaguacaacccaugcugcuaagaugcgagcaggaagaggcau

SEQ ID NO: 423936 - RNA, 64 nt, hsa
gagcgccucucacacagguaaugcccagcuuuucugcugcuaacacauuuggccaguuguugca

SEQ ID NO: 423937 - RNA, 64 nt, hsa
gagccuugucuguaucugggcagcagguguuccaugcugcuagguggcgggggucgggggucuu

SEQ ID NO: 423938 - RNA, 64 nt, hsa
cuucccaacugggggugguuaaagggagccccacugcugcuaccuggggaauggggcaccuggg

SEQ ID NO: 423939 - RNA, 64 nt, hsa
uuuguaaauuaaaaucuuacaaacuaaaucagugugcugcuagaggguucuuuuucacuugaca

SEQ ID NO: 423940 - RNA, 64 nt, hsa
acccugccagaaaugacccgcccucaaugcuggcugcugcuaacauuaaugagaagguggccuu

SEQ ID NO: 423941 - RNA, 64 nt, hsa
uuuucaaaaccagcuuuuuucuauauauaaauuaugcugcuauuacagauuuaacauuuucugu

SEQ ID NO: 423942 - RNA, 64 nt, hsa
ugguaccaggaaagaggauauucuaggcuuugcgugcugcuagcuggguucaggcuucacccac

SEQ ID NO: 423943 - RNA, 64 nt, hsa
uguauguauggaguggguuggggccccaaagcuuugcugcuauugauuuguccccgacagcagg

SEQ ID NO: 423944 - RNA, 64 nt, hsa
aagaauuggucuuuccuaaaaaugcaacagauaaugcugcuagauuguuauuuuguuugcacuu

SEQ ID NO: 423945 - RNA, 64 nt, hsa
gggggugcguacuagcacgugcccaguugcucagugcugcuaguagaaauugauuugcauaguc

SEQ ID NO: 423946 - RNA, 64 nt, hsa
ccgccugaccugggggagccgaccaauuagucacugcugcuacugccccucuccgaaagaagac

SEQ ID NO: 423947 - RNA, 64 nt, hsa
uacaaaaacuauggaaaauaucuuuguucuuguuugcugcuauuuucuguccuauuuugagaaa

SEQ ID NO: 423948 - RNA, 64 nt, hsa
uucuaucuugaauuucaugcuuuccuaaagucucugcugcuaaggcucuauuuccucccccagu

SEQ ID NO: 423949 - RNA, 64 nt, hsa
uacuugagugugcaagcaaagaacccauuugccaugcugcuaugaagacuacuuuuagaucaac

SEQ ID NO: 423950 - RNA, 64 nt, hsa
cugcuucagucaccucccaccucuugccaccugcugcugcuaucuguccuuacuugugggcuuc

SEQ ID NO: 423951 - RNA, 64 nt, hsa
ugccacccgugggaaugcugcccgcucugcagacugcugcuagagccagcaacuccacuaaggu

SEQ ID NO: 423952 - RNA, 64 nt, hsa
agccaggaaacaauaggaaccaaaagccucugccugcugcuauugcaauucccaggaucucucc

SEQ ID NO: 423953 - RNA, 64 nt, hsa
caggagggauugaaaggcaucccaguucuaaggcugcugcuaauuacagcccccaaccuccaac

SEQ ID NO: 423954 - RNA, 64 nt, hsa
uauguuuuuuacucucaggggaaaguuggggacaugcugcuacaauacggcuaaucuuucauug

SEQ ID NO: 423955 - RNA, 64 nt, hsa
gugaaguuuuccuugcuauuucaauaacagauggugcugcuaauucccaacauuucuuaaauua

SEQ ID NO: 423956 - RNA, 64 nt, hsa
uggagcaaauguccuaacagagaaauagaggugaugcugcuaaagggagaaaugccaggcggac

SEQ ID NO: 423957 - RNA, 64 nt, hsa
uucuugacagugagaggauauugagggcuucagcugcugcuauuaugauguuuugcaaaggaaa

SEQ ID NO: 423958 - RNA, 64 nt, hsa
uacuugucacaccugucuuaauaaacuggaguuuugcugcuaaagaacucuucucucugggggc

SEQ ID NO: 423959 - RNA, 64 nt, hsa
uucucccccgcccugccccgccuucgugugcugcugcugcuauugcugucuggugagguggccc

SEQ ID NO: 423960 - RNA, 64 nt, hsa
cuuaaauaaaagaaaugcacaaugucuugguacuugcugcuauuuuacugucuuaauuaaguaa

SEQ ID NO: 423961 - RNA, 64 nt, hsa
uaaagaaaggauauuuuaauaaguucuuucugcuugcugcuaagaguuugcuaaagugucauga

SEQ ID NO: 423962 - RNA, 64 nt, hsa
cucucugcaggcugucucucaagguggucucuucugcugcuagcaacucaaaaaucccaacagc

SEQ ID NO: 423963 - RNA, 64 nt, hsa
aaaguucuggcuuagcagcugcaggcaagcauuaugcugcuauugaagaagcauuagggguaug

SEQ ID NO: 423964 - RNA, 64 nt, hsa
cccuccacuccuuccugccaccugcugcugcugcugcugcuaaucuucagggcacugcugcugc

SEQ ID NO: 423965 - RNA, 64 nt, hsa
uuuuaauauuaaauauguucucacuuaauugcuuugcugcuagacuugcaacuaauuuuuuuaa

SEQ ID NO: 423966 - RNA, 53 nt, hsa
uuuucgacaccucugccugagccugcugcuagcccugccugguuccaccagac

SEQ ID NO: 423967 - RNA, 64 nt, hsa
guuuguuaaaaggcuacacgagcucucuagaaacugcugcuacuagaaaugucuaaacuauaag

SEQ ID NO: 423968 - RNA, 64 nt, hsa
aaguacaagugugugauguuagaaccucccuaguugcugcuauaucaaacacugcacacuugac

SEQ ID NO: 423969 - RNA, 64 nt, hsa
ucgcacggccuuggagcaggaggugggucuggcaugcugcuaugucucaaaagaggucauccgg

SEQ ID NO: 423970 - RNA, 64 nt, hsa
agaacauaaaagaaagagaaucucagaaguaguuugcugcuaauauauacauauauuguauaaa

SEQ ID NO: 423971 - RNA, 64 nt, hsa
aauuccauacagugaaggaaauuugagucuguauugcugcuacaaggguaaaaccaggaccaau

SEQ ID NO: 423972 - RNA, 64 nt, hsa
ugcaguccugggcuuagcuucugcccagcuuuauugcugcuauuggcaaagagcacaggacuca

SEQ ID NO: 423973 - RNA, 64 nt, hsa
uugauugauaaagggaauguugcauuugggacuaugcugcuaacgaaaugguuugaaguauuuu

SEQ ID NO: 423974 - RNA, 64 nt, hsa
aaauucuccucaaugccccccccgcccaguccuuugcugcuauccacugugauuuuuaugcauu

SEQ ID NO: 423975 - RNA, 64 nt, hsa
gcgugagcugagcaggccacacuucaaacuacuuugcugcuaauauuuuccuccugagugcuug

SEQ ID NO: 423976 - RNA, 64 nt, hsa
ugucaaagugaugaauauggaauauccaauccugugcugcuauccugccaaaaucauuuuaaug

SEQ ID NO: 423977 - RNA, 64 nt, hsa
ggaagaagacuguuuccaaauaauuugaacagcuugcugcuaaaugggacccaauuuuuggccu

SEQ ID NO: 423978 - RNA, 64 nt, hsa
cccccaccgcccaccaccuccuccccuucauuccugcugcuaccccuggucccgagggcuggga

SEQ ID NO: 423979 - RNA, 64 nt, hsa
ggguggccccguggggguagcucacucccccuccugcugcuaugccugugacccccgcggccca

SEQ ID NO: 423980 - RNA, 64 nt, hsa
auacuccugacuuguaauaagaagacaucagagaugcugcuaagucggcuccagcacacaggag

SEQ ID NO: 423981 - RNA, 64 nt, hsa; identical to SEQ ID NO: 250983

SEQ ID NO: 423982 - RNA, 64 nt, hsa; identical to SEQ ID NO: 250984

SEQ ID NO: 423983 - RNA, 64 nt, hsa
gucugucccacggcccacacgcucacuugacucaugcugcuaagaugcacaaccgcacacccau

SEQ ID NO: 423984 - RNA, 64 nt, hsa
uugggcuacuuccaccuuuugccuauugaaauaaugcugcuaugaagaugaguguacaaguguc

SEQ ID NO: 423985 - RNA, 64 nt, hsa
aaggggacagguagguggcuggagggacccuuuuugcugcuagaaagccccucccuucucccgg

SEQ ID NO: 423986 - RNA, 64 nt, hsa
aagaucaaguguaucugaacucucagguugugagugcugcuauuggacccaaaaggaacguguc

SEQ ID NO: 423987 - RNA, 64 nt, hsa
ccuugggucccacugucaccaaggcaaccaguccugcugcuaccugucaccuagagucacacac

SEQ ID NO: 423988 - RNA, 64 nt, hsa
ggcucccauccucaucucucuccuugacuggaauugcugcuacccagcuggggugggugaggcc

SEQ ID NO: 423989 - RNA, 64 nt, hsa
acucugcauacccucaucaaaaacacucucacuaugcugcuauggacgaccuccagcucucagu

SEQ ID NO: 423990 - RNA, 64 nt, hsa
ccacaccccugcgucuggccgguccccccacugcugcugcuaucaacgccagaauaaacacacu

SEQ ID NO: 423991 - RNA, 64 nt, hsa
gcucugcacggcauggagugggaaccccaccagcugcugcuacaggaccugggauugccuggga

SEQ ID NO: 423992 - RNA, 64 nt, hsa
agccaacccaccccccaguccacauggucaccacugcugcuaccagcugcucagugcaguggcc

SEQ ID NO: 423993 - RNA, 64 nt, hsa
gugacagggcuggggccacagucuacucugucucugcugcuagagaagccaccuguggaggacu

SEQ ID NO: 423994 - RNA, 64 nt, hsa
uugaaagcaaacuucacaauaauggacguagacuugcugcuaugaaaacauauuuuuuuuauuu

SEQ ID NO: 423995 - RNA, 64 nt, hsa
ccauuuauacuucuccagacccccugccauccucugcugcuacccacacaggcagaauaaaagg

SEQ ID NO: 423996 - RNA, 64 nt, hsa
ggcugugcugauagugcugagggagauaggaauuugcugcuaagauuuuucuuugggguggagu

SEQ ID NO: 423997 - RNA, 64 nt, hsa
caguggagccugccggcgcaucugaggggcagaaugcugcuagcacuugaaucugggaucucgc

SEQ ID NO: 423998 - RNA, 64 nt, hsa
aacacucgggaaaugaguaaagaaaauguaaaauugcugcuagucaaaucuuuuggaaagaauu

SEQ ID NO: 423999 - RNA, 64 nt, hsa
ggcugaacccucucaaagggcugucaccaucaccugcugcuaggacacuacaaaacaaucaaau

SEQ ID NO: 424000 - RNA, 64 nt, hsa
aaaaggcaguggcaaguaaguuauagaagagaaaugcugcuagaaggaauuaagcguuguagua

SEQ ID NO: 424001 - RNA, 64 nt, hsa
ccuccuggacgggcuggagcugggcuccugccuuugcugcuaacacuggaggcgguguuccuaa

SEQ ID NO: 424002 - RNA, 64 nt, hsa
uaacccuugccuuccugucacaggguuugcuuguugcugcuauaguuuuuaacuuuuuuuuauu

SEQ ID NO: 424003 - RNA, 64 nt, hsa
aaacugccauaaauuuucuaguuccaguuuaguuugcugcuauuagcagaaacucaauuguuuc

SEQ ID NO: 424004 - RNA, 64 nt, hsa
ucugcacagacaagacacucaguguccuuggcagugcugcuacuccucaggugcagcauacaua

SEQ ID NO: 424005 - RNA, 64 nt, hsa
uucacucucuggcugcugggucugccgucgguccugcugcuaaccuggcaccagagccucugcc

SEQ ID NO: 424006 - RNA, 64 nt, hsa
aggcgcucaugauuguuucugauuguuucacgcaugcugcuaacccagagccugggcccaaagc

SEQ ID NO: 424007 - RNA, 64 nt, hsa
gggcacagaacccugugccccaccaggauuggccugcugcuaggggccaggggcccugaccagg

SEQ ID NO: 424008 - RNA, 64 nt, hsa
ugggugcauauacguagagucugaacaggugcucugcugcuagaaacagcaaaccaucuagauu

SEQ ID NO: 424009 - RNA, 64 nt, hsa
uggauggagacaguggcagcucccacagugaugcugcugcuaagggcuuccaaacauugccugc

SEQ ID NO: 424010 - RNA, 64 nt, hsa
ccuccacauaucccuacaugaaauaugggaaaguugcugcuauugauucagggucugucuugga

SEQ ID NO: 424011 - RNA, 64 nt, hsa
ugucagcguccuuauuuauugguucuugaaguuuugcugcuauguuacugaaucauacuaaaga

SEQ ID NO: 424012 - RNA, 64 nt, hsa
acacucugaauucuuacuugauggagguuuuguuugcugcuacgguuuuaaucauccagggugc

SEQ ID NO: 424013 - RNA, 64 nt, hsa
acuauuugcacacgacagauuucuagauacuuuuugcugcuaguuuuauguaauauuuauugaa

SEQ ID NO: 424014 - RNA, 64 nt, hsa
uuacucucucagauggcucaucauaggggaaaccugcugcuacaucaugagauagcccugugga

SEQ ID NO: 424015 - RNA, 64 nt, hsa
uucuuuuggcccuccgcccccgcaggcuucugugugcugcuaacuguauuuauugugaugccuu

SEQ ID NO: 424016 - RNA, 64 nt, hsa
augagggaagcaauagguagcuggggagcccuauugcugcuaagucauuggcaaagugacaaag

SEQ ID NO: 424017 - RNA, 64 nt, hsa; identical to SEQ ID NO: 250985

SEQ ID NO: 424018 - RNA, 64 nt, hsa; identical to SEQ ID NO: 250986

SEQ ID NO: 424019 - RNA, 64 nt, hsa
aucuuuaauucuugucauccaggucaacauaugaugcugcuauaagucuggggcucaaauugau

SEQ ID NO: 424020 - RNA, 64 nt, hsa
uagaaggcaaagcugccaguaaaugucucagcauugcugcuaauuuugguccugcuaguuucug

SEQ ID NO: 424021 - RNA, 64 nt, hsa
auuuggguuuccacucuuuagcuauuaugaauaaugcugcuaugaacauuuguguauaaguuuu

SEQ ID NO: 424022 - RNA, 64 nt, hsa
uugauugauugauugauugauacauucagcuuccugcugcuagcaaugccacgauuuagauuua

SEQ ID NO: 424023 - RNA, 64 nt, hsa
uuuuuaccuugucauuuuggucuaagguugccauugcugcuaaagguuaccgauuucaaagucc

SEQ ID NO: 424024 - RNA, 64 nt, hsa
cccaucccccgccuuuuuuuuuuuuuuuuuuaacugcugcuaucugcagcuggauacucuucuu

SEQ ID NO: 424025 - RNA, 64 nt, hsa
uccaucacuaaaggccaaucagaauuuggaaccaugcugcuacccaagaaaucuaauggaauga

SEQ ID NO: 424026 - RNA, 64 nt, hsa
cuuuagaaacacauaauuaacacuuaagguugggugcugcuaauucuuugcaaaaauccaaaua

SEQ ID NO: 424027 - RNA, 64 nt, hsa
uuggggccccugacugcaaugugaaaccucucgcugcugcuagguuuacaaacaagcccauugu

SEQ ID NO: 424028 - RNA, 64 nt, hsa
ccuauccaccucccccaagccccuuuaccuaugcugcugcuaacgcugcugcugcugcugcugc

SEQ ID NO: 424029 - RNA, 64 nt, hsa; identical to SEQ ID NO: 424020

SEQ ID NO: 424030 - RNA, 64 nt, hsa
ccccgggcucuggccacccuggcccgccccucgcugcugcuacuacccgagcccagcuacauuc

SEQ ID NO: 424031 - RNA, 64 nt, hsa
ucuccagaggaguacgccgacuucagcagcuuccugcugcuagucgaugcagcaguacaaacgg

SEQ ID NO: 424032 - RNA, 64 nt, hsa
aacuauuugcacacaacagauuuuagauacuuuuugcugcuaguuguguaauauuuauugaaca

SEQ ID NO: 424033 - RNA, 64 nt, hsa
aaagcugcaguggugauggcaggcuccuaaagacugcugcuaaaagacacaagaauuauacagu

SEQ ID NO: 424034 - RNA, 64 nt, hsa; identical to SEQ ID NO: 46031

SEQ ID NO: 424035 - RNA, 64 nt, hsa; identical to SEQ ID NO: 46032

SEQ ID NO: 424036 - RNA, 64 nt, hsa; identical to SEQ ID NO: 46033

SEQ ID NO: 424037 - RNA, 64 nt, hsa; identical to SEQ ID NO: 46034

SEQ ID NO: 424038 - RNA, 64 nt, hsa; identical to SEQ ID NO: 102243

SEQ ID NO: 424039 - RNA, 64 nt, hsa; identical to SEQ ID NO: 102244

SEQ ID NO: 424040 - RNA, 64 nt, hsa; identical to SEQ ID NO: 102245

SEQ ID NO: 424041 - RNA, 64 nt, hsa; identical to SEQ ID NO: 102246

SEQ ID NO: 424042 - RNA, 64 nt, hsa; identical to SEQ ID NO: 102247

SEQ ID NO: 424043 - RNA, 64 nt, hsa; identical to SEQ ID NO: 102248

SEQ ID NO: 424044 - RNA, 64 nt, hsa; identical to SEQ ID NO: 102249

SEQ ID NO: 424045 - RNA, 64 nt, hsa; identical to SEQ ID NO: 102250

SEQ ID NO: 424046 - RNA, 64 nt, hsa; identical to SEQ ID NO: 102251

SEQ ID NO: 424047 - RNA, 64 nt, hsa; identical to SEQ ID NO: 102252

SEQ ID NO: 424048 - RNA, 64 nt, hsa; identical to SEQ ID NO: 102253

SEQ ID NO: 424049 - RNA, 64 nt, hsa; identical to SEQ ID NO: 102254

SEQ ID NO: 424050 - RNA, 64 nt, hsa; identical to SEQ ID NO: 102255

SEQ ID NO: 424051 - RNA, 64 nt, hsa; identical to SEQ ID NO: 102256

SEQ ID NO: 424052 - RNA, 64 nt, hsa; identical to SEQ ID NO: 102257

SEQ ID NO: 424053 - RNA, 64 nt, hsa; identical to SEQ ID NO: 102258

SEQ ID NO: 424054 - RNA, 64 nt, hsa; identical to SEQ ID NO: 283920

SEQ ID NO: 424055 - RNA, 64 nt, hsa; identical to SEQ ID NO: 283921

SEQ ID NO: 424056 - RNA, 64 nt, hsa; identical to SEQ ID NO: 283922

SEQ ID NO: 424057 - RNA, 64 nt, hsa; identical to SEQ ID NO: 283923

SEQ ID NO: 424058 - RNA, 64 nt, hsa; identical to SEQ ID NO: 283924

SEQ ID NO: 424059 - RNA, 64 nt, hsa; identical to SEQ ID NO: 283925

SEQ ID NO: 424060 - RNA, 64 nt, hsa; identical to SEQ ID NO: 283926

SEQ ID NO: 424061 - RNA, 64 nt, hsa; identical to SEQ ID NO: 283927

SEQ ID NO: 424062 - RNA, 64 nt, hsa; identical to SEQ ID NO: 283928

SEQ ID NO: 424063 - RNA, 64 nt, hsa; identical to SEQ ID NO: 283929

SEQ ID NO: 424064 - RNA, 64 nt, hsa; identical to SEQ ID NO: 283930

SEQ ID NO: 424065 - RNA, 64 nt, hsa; identical to SEQ ID NO: 283931

SEQ ID NO: 424066 - RNA, 64 nt, hsa; identical to SEQ ID NO: 283932

SEQ ID NO: 424067 - RNA, 64 nt, hsa; identical to SEQ ID NO: 283933

SEQ ID NO: 424068 - RNA, 64 nt, hsa; identical to SEQ ID NO: 283934

SEQ ID NO: 424069 - RNA, 64 nt, hsa; identical to SEQ ID NO: 283935

SEQ ID NO: 424070 - RNA, 64 nt, hsa; identical to SEQ ID NO: 283930

SEQ ID NO: 424071 - RNA, 64 nt, hsa; identical to SEQ ID NO: 283937

SEQ ID NO: 424072 - RNA, 64 nt, hsa; identical to SEQ ID NO: 283938

SEQ ID NO: 424073 - RNA, 64 nt, hsa; identical to SEQ ID NO: 283939

SEQ ID NO: 424074 - RNA, 64 nt, hsa; identical to SEQ ID NO: 283940

SEQ ID NO: 424075 - RNA, 64 nt, hsa; identical to SEQ ID NO: 283941

SEQ ID NO: 424076 - RNA, 64 nt, hsa; identical to SEQ ID NO: 283942

SEQ ID NO: 424077 - RNA, 64 nt, hsa; identical to SEQ ID NO: 283943

SEQ ID NO: 424078 - RNA, 64 nt, hsa; identical to SEQ ID NO: 283944

SEQ ID NO: 424079 - RNA, 60 nt, hsa; identical to SEQ ID NO: 283945

SEQ ID NO: 424080 - RNA, 64 nt, hsa; identical to SEQ ID NO: 283946

SEQ ID NO: 424081 - RNA, 64 nt, hsa; identical to SEQ ID NO: 283947

SEQ ID NO: 424082 - RNA, 64 nt, hsa; identical to SEQ ID NO: 283948

SEQ ID NO: 424083 - RNA, 64 nt, hsa; identical to SEQ ID NO: 283949

SEQ ID NO: 424084 - RNA, 64 nt, hsa; identical to SEQ ID NO: 283950

SEQ ID NO: 424085 - RNA, 64 nt, hsa; identical to SEQ ID NO: 283951

SEQ ID NO: 424086 - RNA, 64 nt, hsa; identical to SEQ ID NO: 283952

SEQ ID NO: 424087 - RNA, 64 nt, hsa; identical to SEQ ID NO: 283953

SEQ ID NO: 424088 - RNA, 64 nt, hsa; identical to SEQ ID NO: 283954

SEQ ID NO: 424089 - RNA, 64 nt, hsa; identical to SEQ ID NO: 283955

SEQ ID NO: 424090 - RNA, 64 nt, hsa; identical to SEQ ID NO: 283956

SEQ ID NO: 424091 - RNA, 64 nt, hsa; identical to SEQ ID NO: 283957

SEQ ID NO: 424092 - RNA, 64 nt, hsa; identical to SEQ ID NO: 283958

SEQ ID NO: 424093 - RNA, 64 nt, hsa; identical to SEQ ID NO: 283959

SEQ ID NO: 424094 - RNA, 64 nt, hsa; identical to SEQ ID NO: 283960

SEQ ID NO: 424095 - RNA, 64 nt, hsa; identical to SEQ ID NO: 283961

SEQ ID NO: 424096 - RNA, 64 nt, hsa; identical to SEQ ID NO: 283962

SEQ ID NO: 424097 - RNA, 64 nt, hsa; identical to SEQ ID NO: 283963

SEQ ID NO: 424098 - RNA, 64 nt, hsa; identical to SEQ ID NO: 283964

SEQ ID NO: 424099 - RNA, 64 nt, hsa; identical to SEQ ID NO: 283965

SEQ ID NO: 424100 - RNA, 64 nt, hsa; identical to SEQ ID NO: 283966

SEQ ID NO: 424101 - RNA, 64 nt, hsa; identical to SEQ ID NO: 283967

SEQ ID NO: 424102 - RNA, 64 nt, hsa; identical to SEQ ID NO: 283968

SEQ ID NO: 424103 - RNA, 64 nt, hsa; identical to SEQ ID NO: 283969

SEQ ID NO: 424104 - RNA, 64 nt, hsa; identical to SEQ ID NO: 283970

SEQ ID NO: 424105 - RNA, 64 nt, hsa; identical to SEQ ID NO: 283971

SEQ ID NO: 424106 - RNA, 64 nt, hsa; identical to SEQ ID NO: 283972

SEQ ID NO: 424107 - RNA, 64 nt, hsa; identical to SEQ ID NO: 283973

SEQ ID NO: 424108 - RNA, 64 nt, hsa; identical to SEQ ID NO: 283974

SEQ ID NO: 424109 - RNA, 64 nt, hsa; identical to SEQ ID NO: 283975

SEQ ID NO: 424110 - RNA, 64 nt, hsa; identical to SEQ ID NO: 283976

SEQ ID NO: 424111 - RNA, 64 nt, hsa; identical to SEQ ID NO: 283977

SEQ ID NO: 424112 - RNA, 64 nt, hsa; identical to SEQ ID NO: 283978

SEQ ID NO: 424113 - RNA, 64 nt, hsa; identical to SEQ ID NO: 283979

SEQ ID NO: 424114 - RNA, 64 nt, hsa; identical to SEQ ID NO: 283980

SEQ ID NO: 424115 - RNA, 64 nt, hsa; identical to SEQ ID NO: 283981

SEQ ID NO: 424116 - RNA, 64 nt, hsa; identical to SEQ ID NO: 283982

SEQ ID NO: 424117 - RNA, 64 nt, hsa; identical to SEQ ID NO: 283983

SEQ ID NO: 424118 - RNA, 64 nt, hsa; identical to SEQ ID NO: 283984

SEQ ID NO: 424119 - RNA, 64 nt, hsa; identical to SEQ ID NO: 363631

SEQ ID NO: 424120 - RNA, 64 nt, hsa; identical to SEQ ID NO: 363632

SEQ ID NO: 424121 - RNA, 64 nt, hsa; identical to SEQ ID NO: 363633

SEQ ID NO: 424122 - RNA, 64 nt, hsa; identical to SEQ ID NO: 363634

SEQ ID NO: 424123 - RNA, 64 nt, hsa; identical to SEQ ID NO: 363635

SEQ ID NO: 424124 - RNA, 64 nt, hsa; identical to SEQ ID NO: 363636

SEQ ID NO: 424125 - RNA, 64 nt, hsa; identical to SEQ ID NO: 363637

SEQ ID NO: 424126 - RNA, 64 nt, hsa; identical to SEQ ID NO: 363638

SEQ ID NO: 424127 - RNA, 64 nt, hsa; identical to SEQ ID NO: 363639

SEQ ID NO: 424128 - RNA, 64 nt, hsa; identical to SEQ ID NO: 363640

SEQ ID NO: 424129 - RNA, 64 nt, hsa; identical to SEQ ID NO: 363641

SEQ ID NO: 424130 - RNA, 64 nt, hsa; identical to SEQ ID NO: 363642

SEQ ID NO: 424131 - RNA, 63 nt, hsa; identical to SEQ ID NO: 363643

SEQ ID NO: 424132 - RNA, 64 nt, hsa; identical to SEQ ID NO: 363644

SEQ ID NO: 424133 - RNA, 64 nt, hsa; identical to SEQ ID NO: 363645

SEQ ID NO: 424134 - RNA, 64 nt, hsa; identical to SEQ ID NO: 363646

SEQ ID NO: 424135 - RNA, 64 nt, hsa; identical to SEQ ID NO: 363647

SEQ ID NO: 424136 - RNA, 64 nt, hsa; identical to SEQ ID NO: 363648

SEQ ID NO: 424137 - RNA, 64 nt, hsa; identical to SEQ ID NO: 363649

SEQ ID NO: 424138 - RNA, 64 nt, hsa; identical to SEQ ID NO: 363650

SEQ ID NO: 424139 - RNA, 64 nt, hsa; identical to SEQ ID NO: 363651

SEQ ID NO: 424140 - RNA, 64 nt, hsa; identical to SEQ ID NO: 363652

SEQ ID NO: 424141 - RNA, 64 nt, hsa; identical to SEQ ID NO: 363653

SEQ ID NO: 424142 - RNA, 64 nt, hsa; identical to SEQ ID NO: 363654

SEQ ID NO: 424143 - RNA, 64 nt, hsa; identical to SEQ ID NO: 363655

SEQ ID NO: 424144 - RNA, 64 nt, hsa; identical to SEQ ID NO: 363656

SEQ ID NO: 424145 - RNA, 64 nt, hsa; identical to SEQ ID NO: 363657

SEQ ID NO: 424146 - RNA, 64 nt, hsa; identical to SEQ ID NO: 363658

SEQ ID NO: 424147 - RNA, 64 nt, hsa; identical to SEQ ID NO: 363659

SEQ ID NO: 424148 - RNA, 64 nt, hsa; identical to SEQ ID NO: 363660

SEQ ID NO: 424149 - RNA, 64 nt, hsa; identical to SEQ ID NO: 363661

SEQ ID NO: 424150 - RNA, 64 nt, hsa; identical to SEQ ID NO: 363662

SEQ ID NO: 424151 - RNA, 64 nt, hsa; identical to SEQ ID NO: 363663

SEQ ID NO: 424152 - RNA, 64 nt, hsa; identical to SEQ ID NO: 363664

SEQ ID NO: 424153 - RNA, 64 nt, hsa; identical to SEQ ID NO: 363665

SEQ ID NO: 424154 - RNA, 57 nt, hsa; identical to SEQ ID NO: 262389

SEQ ID NO: 424155 - RNA, 64 nt, hsa; identical to SEQ ID NO: 363667

SEQ ID NO: 424156 - RNA, 64 nt, hsa; identical to SEQ ID NO: 363668

SEQ ID NO: 424157 - RNA, 64 nt, hsa; identical to SEQ ID NO: 363669

SEQ ID NO: 424158 - RNA, 64 nt, hsa; identical to SEQ ID NO: 363670

SEQ ID NO: 424159 - RNA, 64 nt, hsa; identical to SEQ ID NO: 363671

SEQ ID NO: 424160 - RNA, 64 nt, hsa; identical to SEQ ID NO: 363672

SEQ ID NO: 424161 - RNA, 64 nt, hsa; identical to SEQ ID NO: 363673

SEQ ID NO: 424162 - RNA, 64 nt, hsa; identical to SEQ ID NO: 363674

SEQ ID NO: 424163 - RNA, 64 nt, hsa; identical to SEQ ID NO: 363675

SEQ ID NO: 424164 - RNA, 64 nt, hsa; identical to SEQ ID NO: 363676

SEQ ID NO: 424165 - RNA, 64 nt, hsa; identical to SEQ ID NO: 363677

SEQ ID NO: 424166 - RNA, 64 nt, hsa; identical to SEQ ID NO: 363678

SEQ ID NO: 424167 - RNA, 64 nt, hsa; identical to SEQ ID NO: 363679

SEQ ID NO: 424168 - RNA, 64 nt, hsa; identical to SEQ ID NO: 363680

SEQ ID NO: 424169 - RNA, 64 nt, hsa; identical to SEQ ID NO: 117824

SEQ ID NO: 424170 - RNA, 64 nt, hsa; identical to SEQ ID NO: 117825

SEQ ID NO: 424171 - RNA, 64 nt, hsa; identical to SEQ ID NO: 117826

SEQ ID NO: 424172 - RNA, 64 nt, hsa; identical to SEQ ID NO: 117827

SEQ ID NO: 424173 - RNA, 64 nt, hsa; identical to SEQ ID NO: 117828

SEQ ID NO: 424174 - RNA, 64 nt, hsa; identical to SEQ ID NO: 117829

SEQ ID NO: 424175 - RNA, 64 nt, hsa; identical to SEQ ID NO: 117830

SEQ ID NO: 424176 - RNA, 64 nt, hsa; identical to SEQ ID NO: 117831

SEQ ID NO: 424177 - RNA, 64 nt, hsa; identical to SEQ ID NO: 117832

SEQ ID NO: 424178 - RNA, 64 nt, hsa; identical to SEQ ID NO: 117833

SEQ ID NO: 424179 - RNA, 64 nt, hsa; identical to SEQ ID NO: 117834

SEQ ID NO: 424180 - RNA, 64 nt, hsa; identical to SEQ ID NO: 117835

SEQ ID NO: 424181 - RNA, 64 nt, hsa; identical to SEQ ID NO: 117836

SEQ ID NO: 424182 - RNA, 64 nt, hsa; identical to SEQ ID NO: 117837

SEQ ID NO: 424183 - RNA, 64 nt, hsa; identical to SEQ ID NO: 117838

SEQ ID NO: 424184 - RNA, 64 nt, hsa; identical to SEQ ID NO: 117839

SEQ ID NO: 424185 - RNA, 64 nt, hsa; identical to SEQ ID NO: 117840

SEQ ID NO: 424186 - RNA, 64 nt, hsa; identical to SEQ ID NO: 117841

SEQ ID NO: 424187 - RNA, 64 nt, hsa; identical to SEQ ID NO: 117842

SEQ ID NO: 424188 - RNA, 64 nt, hsa; identical to SEQ ID NO: 117843

SEQ ID NO: 424189 - RNA, 64 nt, hsa; identical to SEQ ID NO: 117844

SEQ ID NO: 424190 - RNA, 64 nt, hsa; identical to SEQ ID NO: 117845

SEQ ID NO: 424191 - RNA, 64 nt, hsa; identical to SEQ ID NO: 117846

SEQ ID NO: 424192 - RNA, 64 nt, hsa; identical to SEQ ID NO: 117847

SEQ ID NO: 424193 - RNA, 64 nt, hsa; identical to SEQ ID NO: 117848

SEQ ID NO: 424194 - RNA, 64 nt, hsa; identical to SEQ ID NO: 117849

SEQ ID NO: 424195 - RNA, 64 nt, hsa; identical to SEQ ID NO: 117850

SEQ ID NO: 424196 - RNA, 64 nt, hsa; identical to SEQ ID NO: 117851

SEQ ID NO: 424197 - RNA, 64 nt, hsa; identical to SEQ ID NO: 117852

SEQ ID NO: 424198 - RNA, 64 nt, hsa; identical to SEQ ID NO: 117853

SEQ ID NO: 424199 - RNA, 64 nt, hsa; identical to SEQ ID NO: 117854

SEQ ID NO: 424200 - RNA, 64 nt, hsa; identical to SEQ ID NO: 117855

SEQ ID NO: 424201 - RNA, 64 nt, hsa
gcagagcaugcagugauggaagaagcaggaaaagcaagaagaaaagacagcagcaucaagagga

SEQ ID NO: 424202 - RNA, 64 nt, hsa
acccagaacaugcugagcagaacaucagaaaaagcaagaagaagaaaaggcgacaucaagaagg

SEQ ID NO: 424203 - RNA, 64 nt, hsa
gaaugcugaaucacaggaaugguguugaggcuaccaagaagaaauccaugcagccacuuugggu

SEQ ID NO: 424204 - RNA, 61 nt, hsa
accccuucggccagucuuaaacgggugucagcaagaagaaaaauuaacaaaagacagaagg

SEQ ID NO: 424205 - RNA, 64 nt, hsa
aagaucucuuucuaaagacaggagagauuauuuacaagaagaacucaccaggguuuaguuugca

SEQ ID NO: 424206 - RNA, 64 nt, hsa
auaaccguaaagguuuauuuuucuguuaccucaacaagaagaauuugaagacuucaaaauauug

SEQ ID NO: 424207 - RNA, 64 nt, hsa
ugucaacuuaaucucaguauguugcuuauauuaacaagaagacucacgcaauaacuccucgaua

SEQ ID NO: 424208 - RNA, 64 nt, hsa
uauaugaugaagagaagauuacagucuuuacagucaagaagacuuggguucauauccuaacccu

SEQ ID NO: 424209 - RNA, 64 nt, hsa
acuguucgaggcaaagacaaaacccaacuuugaccaagaagagcaaucuggauucuuguagccc

SEQ ID NO: 424210 - RNA, 64 nt, hsa
uaggugugauaaacagaguagaaaagauuguggccaagaagagugaaugugucccauccaaagg

SEQ ID NO: 424211 - RNA, 64 nt, hsa
ccuucaccaagaauaagguucuuucuggagccugcaagaagacaguugcccaacacuuugacac

SEQ ID NO: 424212 - RNA, 64 nt, hsa
auuucccccuuggugguuuuucagacaccugcagcaagaagaaauacugacugacuaggcauua

SEQ ID NO: 424213 - RNA, 64 nt, hsa
cuaacuuaaacggaugggauucacuuaacaaaagcaagaagaaaagcacacgaacaggugucuu

SEQ ID NO: 424214 - RNA, 64 nt, hsa
gaauacucuaagagaauaggacauggauauguuacaagaagaaguguauuggggcaagucuugu

SEQ ID NO: 424215 - RNA, 64 nt, hsa
ccuaagcagguacgggcggggcucaagucgcgaggcggggaagcgggaggcagacacggacgag

SEQ ID NO: 424216 - RNA, 64 nt, hsa
gauccgccccgcaggcagguacuucccggagcgagcggggaacgcgacguaccccagugcgccu

SEQ ID NO: 424217 - RNA, 64 nt, hsa; identical to SEQ ID NO: 194676

SEQ ID NO: 424218 - RNA, 64 nt, hsa; identical to SEQ ID NO: 194677

SEQ ID NO: 424219 - RNA, 64 nt, hsa; identical to SEQ ID NO: 194678

SEQ ID NO: 424220 - RNA, 64 nt, hsa; identical to SEQ ID NO: 194679

SEQ ID NO: 424221 - RNA, 64 nt, hsa; identical to SEQ ID NO: 194680

SEQ ID NO: 424222 - RNA, 64 nt, hsa; identical to SEQ ID NO: 194681

SEQ ID NO: 424223 - RNA, 64 nt, hsa; identical to SEQ ID NO: 194682

SEQ ID NO: 424224 - RNA, 64 nt, hsa; identical to SEQ ID NO: 194683

SEQ ID NO: 424225 - RNA, 64 nt, hsa; identical to SEQ ID NO: 194684

SEQ ID NO: 424226 - RNA, 64 nt, hsa; identical to SEQ ID NO: 194685

SEQ ID NO: 424227 - RNA, 64 nt, hsa; identical to SEQ ID NO: 194686

SEQ ID NO: 424228 - RNA, 64 nt, hsa; identical to SEQ ID NO: 194687

SEQ ID NO: 424229 - RNA, 64 nt, hsa; identical to SEQ ID NO: 194688

SEQ ID NO: 424230 - RNA, 64 nt, hsa; identical to SEQ ID NO: 194689

SEQ ID NO: 424231 - RNA, 64 nt, hsa; identical to SEQ ID NO: 194690

SEQ ID NO: 424232 - RNA, 64 nt, hsa; identical to SEQ ID NO: 194691

SEQ ID NO: 424233 - RNA, 64 nt, hsa; identical to SEQ ID NO: 194692

SEQ ID NO: 424234 - RNA, 64 nt, hsa; identical to SEQ ID NO: 194693

SEQ ID NO: 424235 - RNA, 64 nt, hsa; identical to SEQ ID NO: 194694

SEQ ID NO: 424236 - RNA, 64 nt, hsa; identical to SEQ ID NO: 194695

SEQ ID NO: 424237 - RNA, 64 nt, hsa; identical to SEQ ID NO: 194696

SEQ ID NO: 424238 - RNA, 64 nt, hsa; identical to SEQ ID NO: 194697

SEQ ID NO: 424239 - RNA, 64 nt, hsa; identical to SEQ ID NO: 194698

SEQ ID NO: 424240 - RNA, 64 nt, hsa; identical to SEQ ID NO: 194699

SEQ ID NO: 424241 - RNA, 64 nt, hsa; identical to SEQ ID NO: 194700

SEQ ID NO: 424242 - RNA, 64 nt, hsa; identical to SEQ ID NO: 194701

SEQ ID NO: 424243 - RNA, 64 nt, hsa; identical to SEQ ID NO: 194702

SEQ ID NO: 424244 - RNA, 64 nt, hsa; identical to SEQ ID NO: 194703

SEQ ID NO: 424245 - RNA, 64 nt, hsa; identical to SEQ ID NO: 194704

SEQ ID NO: 424246 - RNA, 64 nt, hsa; identical to SEQ ID NO: 194705

SEQ ID NO: 424247 - RNA, 60 nt, hsa; identical to SEQ ID NO: 194706

SEQ ID NO: 424248 - RNA, 64 nt, hsa; identical to SEQ ID NO: 194707

SEQ ID NO: 424249 - RNA, 64 nt, hsa; identical to SEQ ID NO: 194708

SEQ ID NO: 424250 - RNA, 64 nt, hsa; identical to SEQ ID NO: 194709

SEQ ID NO: 424251 - RNA, 64 nt, hsa; identical to SEQ ID NO: 194710

SEQ ID NO: 424252 - RNA, 64 nt, hsa; identical to SEQ ID NO: 194711

SEQ ID NO: 424253 - RNA, 64 nt, hsa; identical to SEQ ID NO: 194712

SEQ ID NO: 424254 - RNA, 64 nt, hsa; identical to SEQ ID NO: 194713

SEQ ID NO: 424255 - RNA, 64 nt, hsa; identical to SEQ ID NO: 194714

SEQ ID NO: 424256 - RNA, 64 nt, hsa
ucagggauucuggaacuaagucugauaaaagauuccagugaagcccuguucugagaacgagcag

SEQ ID NO: 424257 - RNA, 64 nt, hsa
ucaggugcuuugccaaacucuuaaaagaaaguguccagugaacuuggaagugggccccugagcu

SEQ ID NO: 424258 - RNA, 64 nt, hsa
uaauuuccuucuguucuccuuguucuguucugggccagugaagguccuuguucugauuuugaaa

SEQ ID NO: 424259 - RNA, 64 nt, hsa
cuuguucugauuuugaaacgaucugcaggucuugccagugaaccccuggacaacugaccacacc

SEQ ID NO: 424260 - RNA, 64 nt, hsa
aucugcuuccaucccagugaaauuuaccuguagcccagugaaggguguguuuggaacauucauu

SEQ ID NO: 424261 - RNA, 64 nt, hsa
uacuguuugauugggugguucaucugcuuccaucccagugaaauuuaccuguagcccagugaag

SEQ ID NO: 424262 - RNA, 64 nt, hsa
uucuauccaaacgaccaaaaaaccaacaguaacaccagugaaaccccacacugucgggcuuaua

SEQ ID NO: 424263 - RNA, 64 nt, hsa
aguuuagcucucaaagaaggggugaaucauaaagccagugaaaauuucacccucugagggaguu

SEQ ID NO: 424264 - RNA, 64 nt, hsa
ggcauuuccggaauucacuuuuuugcuacaaccuccagugaaagcaauuauuuauuuuaaaugu

SEQ ID NO: 424265 - RNA, 64 nt, hsa
uaaguauaaaaaaagacucucucuucaucauuccccagugaaauagcaaaauacaaaaaaagag

SEQ ID NO: 424266 - RNA, 64 nt, hsa
agcacuuuccagaagcauggagcuucagaaagugccagugaacucuugguccucaguagugaga

SEQ ID NO: 424267 - RNA, 64 nt, hsa
gugagauucagcucuaguuugcaccuugauuuccccagugaaaagggagaagagccaaaguauu

SEQ ID NO: 424268 - RNA, 64 nt, hsa
agcagaaagaugcuugcaagcagagucagggucaccagugaaugccacaaaaguucucuuuccc

SEQ ID NO: 424269 - RNA, 64 nt, hsa
uaguaaaacgcaacaagaagaaaaccaacccaaaccagugaaguuuuuuagaaccuuuagaagg

SEQ ID NO: 424270 - RNA, 64 nt, hsa
agccugaaauagugguucuuggaaaaauggauccccagugaaaacuagagcucuaagcccauuc

SEQ ID NO: 424271 - RNA, 64 nt, hsa
agaggccaggacagagcugacaaaauuuugcuccccagugaaggccacagcaaccuucugccca

SEQ ID NO: 424272 - RNA, 64 nt, hsa
uuacugcagggaagcuaccggaccugccugggagccagugaagggcgagucagggcacgcgucc

SEQ ID NO: 424273 - RNA, 64 nt, hsa
cgauugucagccuuggccugggguuuugaccuugccagugaaguuucgguuuugaagugauuaa

SEQ ID NO: 424274 - RNA, 64 nt, hsa
aaaaaucucauuguacuacaaaauuaugucugcaccagugaauccauucucaagaaaagucuua

SEQ ID NO: 424275 - RNA, 59 nt, hsa
uuacccccuuuuacugguaauaguacacuccagugaaauguacugaguggauuccgucu

SEQ ID NO: 424276 - RNA, 64 nt, hsa
gggcaguguucucacagcaccguuccgacagggaccagugaaagaaaagagacaaaguuagaac

SEQ ID NO: 424277 - RNA, 64 nt, hsa
gaagggaaaauacggacauuaacauuaaaagacaccagugaaauuguuaggucucuaggaaguu

SEQ ID NO: 424278 - RNA, 64 nt, hsa; identical to SEQ ID NO: 110816

SEQ ID NO: 424279 - RNA, 64 nt, hsa; identical to SEQ ID NO: 110817

SEQ ID NO: 424280 - RNA, 64 nt, hsa; identical to SEQ ID NO: 110818

SEQ ID NO: 424281 - RNA, 64 nt, hsa; identical to SEQ ID NO: 110819

SEQ ID NO: 424282 - RNA, 64 nt, hsa; identical to SEQ ID NO: 110820

SEQ ID NO: 424283 - RNA, 64 nt, hsa; identical to SEQ ID NO: 110821

SEQ ID NO: 424284 - RNA, 64 nt, hsa; identical to SEQ ID NO: 110822

SEQ ID NO: 424285 - RNA, 64 nt, hsa; identical to SEQ ID NO: 110823

SEQ ID NO: 424286 - RNA, 64 nt, hsa
cugccccaguugaugagcggcguguccccucugcagcgcgcaccccggcggggcuuuggcugug

SEQ ID NO: 424287 - RNA, 64 nt, hsa
gaauuccaccugaagacuuguguuaaaguucuacagcgcgcacuguuaacugaacgucuuuuuc

SEQ ID NO: 424288 - RNA, 64 nt, hsa
gguugccucagaagcccuaagacugaugagcuggagcgcgcauuugagagaagccucgcaccca

SEQ ID NO: 424289 - RNA, 64 nt, hsa
cguggccguagaccuguggagccgucgugaacugagcgcgcaggggcccguggcuugguuucac

SEQ ID NO: 424290 - RNA, 64 nt, hsa
ggcaagggggcgauccuaucaugacuuaacaucaagcgcgcaguucaaaacuacugucuucugu

SEQ ID NO: 424291 - RNA, 57 nt, hsa
cugucaccucccuggugugagcccaccagcgcgcaccgucgccacggaucgccgccc

SEQ ID NO: 424292 - RNA, 64 nt, hsa
caccaccaacaccaccaccaccaccgcgagcuggagcgcgcaccaggccauccagcgugcagcc

SEQ ID NO: 424293 - RNA, 64 nt, hsa
cguccugccgcgcagguucuuccccgcgcggaggagcgcgcagggugggcggcuuaccauagca

SEQ ID NO: 424294 - RNA, 64 nt, hsa
uggguauuuucuaauuucagacaaacacacacucagcgcgcacucacugauuccuacacauugc

SEQ ID NO: 424295 - RNA, 64 nt, hsa
cccgaacuggccaggacccccgcgcccgccgcacagcgcgcagccgggcgcucaaccuaagguc

SEQ ID NO: 424296 - RNA, 64 nt, hsa
gcucugagacacaccccaacaugccugcaccugcagcgcgcacacgcacgcacacacacauaca

SEQ ID NO: 424297 - RNA, 64 nt, hsa
gaggcagagaggccaggcggggcaggaguggccaagcgcgcaagggcgcgggcgagcaggccug

SEQ ID NO: 424298 - RNA, 64 nt, hsa
aguggcgcggauguuacaggaaaugcugucggagagcgcgcauucuauuuccuccgcagggaau

SEQ ID NO: 424299 - RNA, 64 nt, hsa
gacaccgccaucucuuuucuuuaaggcuucaggcagcgcgcacaggcucuggcagccgucucag

SEQ ID NO: 424300 - RNA, 64 nt, hsa
caaguggucugggacagggaggagcaacggccccagcgcgcaacgcucugcgcguuccuccgaa

SEQ ID NO: 424301 - RNA, 64 nt, hsa
ccucugugucccgcacugugugugaguggaccgcagcgcgcagccacaugcccuggcugccaug

SEQ ID NO: 424302 - RNA, 64 nt, hsa
acugaacggguaagagaagagguuugcaagacagagcgcgcagcccggcaaggggcaugugacc

SEQ ID NO: 424303 - RNA, 64 nt, hsa
ggcugugccgggcagccauccugcauucccacccagcgcgcagucuccaccucggccccagcaa

SEQ ID NO: 424304 - RNA, 64 nt, hsa; identical to SEQ ID NO: 415046

SEQ ID NO: 424305 - RNA, 64 nt, hsa; identical to SEQ ID NO: 415047

SEQ ID NO: 424306 - RNA, 64 nt, hsa; identical to SEQ ID NO: 53466

SEQ ID NO: 424307 - RNA, 64 nt, hsa; identical to SEQ ID NO: 53467

SEQ ID NO: 424308 - RNA, 64 nt, hsa; identical to SEQ ID NO: 53468

SEQ ID NO: 424309 - RNA, 64 nt, hsa; identical to SEQ ID NO: 53469

SEQ ID NO: 424310 - RNA, 64 nt, hsa; identical to SEQ ID NO: 53470

SEQ ID NO: 424311 - RNA, 64 nt, hsa; identical to SEQ ID NO: 53471

SEQ ID NO: 424312 - RNA, 64 nt, hsa; identical to SEQ ID NO: 53472

SEQ ID NO: 424313 - RNA, 64 nt, hsa; identical to SEQ ID NO: 53473

SEQ ID NO: 424314 - RNA, 64 nt, hsa; identical to SEQ ID NO: 53474

SEQ ID NO: 424315 - RNA, 64 nt, hsa; identical to SEQ ID NO: 53475

SEQ ID NO: 424316 - RNA, 64 nt, hsa; identical to SEQ ID NO: 53476

SEQ ID NO: 424317 - RNA, 64 nt, hsa; identical to SEQ ID NO: 53477

SEQ ID NO: 424318 - RNA, 64 nt, hsa; identical to SEQ ID NO: 53478

SEQ ID NO: 424319 - RNA, 64 nt, hsa; identical to SEQ ID NO: 53479

SEQ ID NO: 424320 - RNA, 64 nt, hsa; identical to SEQ ID NO: 194853

SEQ ID NO: 424321 - RNA, 64 nt, hsa; identical to SEQ ID NO: 194854

SEQ ID NO: 424322 - RNA, 64 nt, hsa; identical to SEQ ID NO: 194855

SEQ ID NO: 424323 - RNA, 64 nt, hsa; identical to SEQ ID NO: 194856

SEQ ID NO: 424324 - RNA, 64 nt, hsa; identical to SEQ ID NO: 194857

SEQ ID NO: 424325 - RNA, 64 nt, hsa; identical to SEQ ID NO: 194858

SEQ ID NO: 424326 - RNA, 64 nt, hsa; identical to SEQ ID NO: 194859

SEQ ID NO: 424327 - RNA, 64 nt, hsa; identical to SEQ ID NO: 194860

SEQ ID NO: 424328 - RNA, 64 nt, hsa; identical to SEQ ID NO: 194861

SEQ ID NO: 424329 - RNA, 64 nt, hsa; identical to SEQ ID NO: 194862

SEQ ID NO: 424330 - RNA, 64 nt, hsa; identical to SEQ ID NO: 194863

SEQ ID NO: 424331 - RNA, 64 nt, hsa; identical to SEQ ID NO: 194864

SEQ ID NO: 424332 - RNA, 64 nt, hsa; identical to SEQ ID NO: 194865

SEQ ID NO: 424333 - RNA, 64 nt, hsa; identical to SEQ ID NO: 194866

SEQ ID NO: 424334 - RNA, 64 nt, hsa; identical to SEQ ID NO: 194867

SEQ ID NO: 424335 - RNA, 64 nt, hsa; identical to SEQ ID NO: 194868

SEQ ID NO: 424336 - RNA, 64 nt, hsa; identical to SEQ ID NO: 194869

SEQ ID NO: 424337 - RNA, 64 nt, hsa; identical to SEQ ID NO: 194870

SEQ ID NO: 424338 - RNA, 64 nt, hsa; identical to SEQ ID NO: 194871

SEQ ID NO: 424339 - RNA, 64 nt, hsa; identical to SEQ ID NO: 194872

SEQ ID NO: 424340 - RNA, 64 nt, hsa; identical to SEQ ID NO: 194873

SEQ ID NO: 424341 - RNA, 64 nt, hsa; identical to SEQ ID NO: 194874

SEQ ID NO: 424342 - RNA, 64 nt, hsa; identical to SEQ ID NO: 194875

SEQ ID NO: 424343 - RNA, 64 nt, hsa; identical to SEQ ID NO: 194876

SEQ ID NO: 424344 - RNA, 64 nt, hsa; identical to SEQ ID NO: 194877

SEQ ID NO: 424345 - RNA, 64 nt, hsa; identical to SEQ ID NO: 194878

SEQ ID NO: 424346 - RNA, 64 nt, hsa; identical to SEQ ID NO: 194879

SEQ ID NO: 424347 - RNA, 64 nt, hsa; identical to SEQ ID NO: 194880

SEQ ID NO: 424348 - RNA, 64 nt, hsa; identical to SEQ ID NO: 194881

SEQ ID NO: 424349 - RNA, 64 nt, hsa; identical to SEQ ID NO: 194882

SEQ ID NO: 424350 - RNA, 64 nt, hsa; identical to SEQ ID NO: 194883

SEQ ID NO: 424351 - RNA, 64 nt, hsa; identical to SEQ ID NO: 194884

SEQ ID NO: 424352 - RNA, 64 nt, hsa; identical to SEQ ID NO: 194885

SEQ ID NO: 424353 - RNA, 64 nt, hsa; identical to SEQ ID NO: 194886

SEQ ID NO: 424354 - RNA, 64 nt, hsa; identical to SEQ ID NO: 194887

SEQ ID NO: 424355 - RNA, 64 nt, hsa; identical to SEQ ID NO: 194888

SEQ ID NO: 424356 - RNA, 64 nt, hsa; identical to SEQ ID NO: 194889

SEQ ID NO: 424357 - RNA, 64 nt, hsa; identical to SEQ ID NO: 194890

SEQ ID NO: 424358 - RNA, 64 nt, hsa; identical to SEQ ID NO: 194891

SEQ ID NO: 424359 - RNA, 64 nt, hsa; identical to SEQ ID NO: 194892

SEQ ID NO: 424360 - RNA, 64 nt, hsa; identical to SEQ ID NO: 194893

SEQ ID NO: 424361 - RNA, 64 nt, hsa; identical to SEQ ID NO: 194894

SEQ ID NO: 424362 - RNA, 64 nt, hsa; identical to SEQ ID NO: 194895

SEQ ID NO: 424363 - RNA, 64 nt, hsa; identical to SEQ ID NO: 194896

SEQ ID NO: 424364 - RNA, 64 nt, hsa; identical to SEQ ID NO: 194897

SEQ ID NO: 424365 - RNA, 64 nt, hsa; identical to SEQ ID NO: 194898

SEQ ID NO: 424366 - RNA, 64 nt, hsa; identical to SEQ ID NO: 194899

SEQ ID NO: 424367 - RNA, 64 nt, hsa; identical to SEQ ID NO: 194900

SEQ ID NO: 424368 - RNA, 64 nt, hsa; identical to SEQ ID NO: 194901

SEQ ID NO: 424369 - RNA, 64 nt, hsa; identical to SEQ ID NO: 194902

SEQ ID NO: 424370 - RNA, 64 nt, hsa; identical to SEQ ID NO: 194903

SEQ ID NO: 424371 - RNA, 64 nt, hsa; identical to SEQ ID NO: 194904

SEQ ID NO: 424372 - RNA, 64 nt, hsa; identical to SEQ ID NO: 194905

SEQ ID NO: 424373 - RNA, 64 nt, hsa; identical to SEQ ID NO: 194906

SEQ ID NO: 424374 - RNA, 64 nt, hsa; identical to SEQ ID NO: 194907

SEQ ID NO: 424375 - RNA, 64 nt, hsa; identical to SEQ ID NO: 194908

SEQ ID NO: 424376 - RNA, 64 nt, hsa; identical to SEQ ID NO: 194909

SEQ ID NO: 424377 - RNA, 64 nt, hsa; identical to SEQ ID NO: 194910

SEQ ID NO: 424378 - RNA, 64 nt, hsa; identical to SEQ ID NO: 194911

SEQ ID NO: 424379 - RNA, 64 nt, hsa; identical to SEQ ID NO: 194912

SEQ ID NO: 424380 - RNA, 64 nt, hsa; identical to SEQ ID NO: 194913

SEQ ID NO: 424381 - RNA, 64 nt, hsa; identical to SEQ ID NO: 194914

SEQ ID NO: 424382 - RNA, 64 nt, hsa; identical to SEQ ID NO: 194915

SEQ ID NO: 424383 - RNA, 64 nt, hsa; identical to SEQ ID NO: 194916

SEQ ID NO: 424384 - RNA, 64 nt, hsa; identical to SEQ ID NO: 194917

SEQ ID NO: 424385 - RNA, 64 nt, hsa; identical to SEQ ID NO: 194918

SEQ ID NO: 424386 - RNA, 64 nt, hsa; identical to SEQ ID NO: 194919

SEQ ID NO: 424387 - RNA, 64 nt, hsa; identical to SEQ ID NO: 194920

SEQ ID NO: 424388 - RNA, 64 nt, hsa; identical to SEQ ID NO: 194921

SEQ ID NO: 424389 - RNA, 64 nt, hsa; identical to SEQ ID NO: 194922

SEQ ID NO: 424390 - RNA, 64 nt, hsa; identical to SEQ ID NO: 194923

SEQ ID NO: 424391 - RNA, 64 nt, hsa; identical to SEQ ID NO: 194924

SEQ ID NO: 424392 - RNA, 64 nt, hsa; identical to SEQ ID NO: 194925

SEQ ID NO: 424393 - RNA, 64 nt, hsa; identical to SEQ ID NO: 194926

SEQ ID NO: 424394 - RNA, 64 nt, hsa; identical to SEQ ID NO: 194927

SEQ ID NO: 424395 - RNA, 64 nt, hsa; identical to SEQ ID NO: 194928

SEQ ID NO: 424396 - RNA, 64 nt, hsa; identical to SEQ ID NO: 194929

SEQ ID NO: 424397 - RNA, 64 nt, hsa; identical to SEQ ID NO: 194930

SEQ ID NO: 424398 - RNA, 64 nt, hsa; identical to SEQ ID NO: 194931

SEQ ID NO: 424399 - RNA, 64 nt, hsa; identical to SEQ ID NO: 194932

SEQ ID NO: 424400 - RNA, 64 nt, hsa; identical to SEQ ID NO: 194933

SEQ ID NO: 424401 - RNA, 64 nt, hsa; identical to SEQ ID NO: 194934

SEQ ID NO: 424402 - RNA, 64 nt, hsa; identical to SEQ ID NO: 194935

SEQ ID NO: 424403 - RNA, 64 nt, hsa; identical to SEQ ID NO: 194936

SEQ ID NO: 424404 - RNA, 64 nt, hsa; identical to SEQ ID NO: 194937

SEQ ID NO: 424405 - RNA, 64 nt, hsa; identical to SEQ ID NO: 194938

SEQ ID NO: 424406 - RNA, 64 nt, hsa; identical to SEQ ID NO: 194939

SEQ ID NO: 424407 - RNA, 64 nt, hsa; identical to SEQ ID NO: 194940

SEQ ID NO: 424408 - RNA, 64 nt, hsa; identical to SEQ ID NO: 194941

SEQ ID NO: 424409 - RNA, 64 nt, hsa; identical to SEQ ID NO: 194942

SEQ ID NO: 424410 - RNA, 64 nt, hsa; identical to SEQ ID NO: 194943

SEQ ID NO: 424411 - RNA, 64 nt, hsa; identical to SEQ ID NO: 194944

SEQ ID NO: 424412 - RNA, 64 nt, hsa; identical to SEQ ID NO: 194945

SEQ ID NO: 424413 - RNA, 51 nt, hsa; identical to SEQ ID NO: 194946

SEQ ID NO: 424414 - RNA, 64 nt, hsa; identical to SEQ ID NO: 194947

SEQ ID NO: 424415 - RNA, 64 nt, hsa; identical to SEQ ID NO: 194948

SEQ ID NO: 424416 - RNA, 64 nt, hsa; identical to SEQ ID NO: 194949

SEQ ID NO: 424417 - RNA, 64 nt, hsa; identical to SEQ ID NO: 194950

SEQ ID NO: 424418 - RNA, 64 nt, hsa; identical to SEQ ID NO: 118152

SEQ ID NO: 424419 - RNA, 64 nt, hsa; identical to SEQ ID NO: 118153

SEQ ID NO: 424420 - RNA, 64 nt, hsa; identical to SEQ ID NO: 118154

SEQ ID NO: 424421 - RNA, 64 nt, hsa; identical to SEQ ID NO: 118155

SEQ ID NO: 424422 - RNA, 64 nt, hsa; identical to SEQ ID NO: 118156

SEQ ID NO: 424423 - RNA, 64 nt, hsa; identical to SEQ ID NO: 118157

SEQ ID NO: 424424 - RNA, 64 nt, hsa; identical to SEQ ID NO: 118158

SEQ ID NO: 424425 - RNA, 64 nt, hsa; identical to SEQ ID NO: 118159

SEQ ID NO: 424426 - RNA, 64 nt, hsa
gugugcaaaagccuuggacuuggcugugaucuuugacugcuaggggagggaaccuggguauggu

SEQ ID NO: 424427 - RNA, 64 nt, hsa
uuuagcuccucuuuucuuccuuuuuauuucauaagacugcuaggaagugauuuuuuaaaauuag

SEQ ID NO: 424428 - RNA, 64 nt, hsa
ggccuggcuccaacucugugggccagaggugggggacugcuaggucgagucugcagcuucgcca

SEQ ID NO: 424429 - RNA, 64 nt, hsa
ugggcaaucauuuugaauacuguucugugacccugacugcuaguucugaggacacugguggcug

SEQ ID NO: 424430 - RNA, 64 nt, hsa
ggucuucuuggacauuaaucuuugaauacuugcugacugcuaagaaaugaccagaggggaagag

SEQ ID NO: 424431 - RNA, 64 nt, hsa
auaucaggggacauuaggauuggggaagacacuugacugcuagaaucagagguuggacacuaua

SEQ ID NO: 424432 - RNA, 64 nt, hsa
acuuuugcaaguuuucagguaaaccucagcucaggacugcuauuuagcuccucuuaagaagauu

SEQ ID NO: 424433 - RNA, 64 nt, hsa
ggaaagcuauauuuguaugcaacacuaaccuuuugacugcuaauguauguuucugcuugcugug

SEQ ID NO: 424434 - RNA, 64 nt, hsa
uacauauauaauuuauaacugaaucuaaguauuagacugcuacucauauuuugaacugcaggug

SEQ ID NO: 424435 - RNA, 64 nt, hsa
aaaggccauguagaaaauuuauuaaaacuacuaugacugcuacauucaggaauaugccaguggu

SEQ ID NO: 424436 - RNA, 64 nt, hsa
ccucccuucuaaacauguguaauaacuauacagagacugcuacaaaauuguauauaguuuuugg

SEQ ID NO: 424437 - RNA, 64 nt, hsa
gcacacucuugaaaacuggagcuuuguauucugugacugcuauggcuagcuuuguaaccaaagc

SEQ ID NO: 424438 - RNA, 64 nt, hsa
ggucaaaggagcaggcuaaugcaaagcuuuuggagacugcuaaguguuaaaaagugauuaaaca

SEQ ID NO: 424439 - RNA, 64 nt, hsa
ggguauguuugcauuuggucacugauauguaaaugacugcuagcccacggcuggaccacuucuc

SEQ ID NO: 424440 - RNA, 64 nt, hsa
ugugucagagaugauuuaaucuauuuaaguguuggacugcuaggagaacuuguacauuuaugau

SEQ ID NO: 424441 - RNA, 64 nt, hsa
gcuuuuuaugauuuuuuuuuuaacauuuuaagcagacugcuaaacuguucucuguauaaguuau

SEQ ID NO: 424442 - RNA, 64 nt, hsa
agcuggauguuuugcgugcaacaccuugagcacugacugcuauuguucaaaaaaagccuuugcu

SEQ ID NO: 424443 - RNA, 64 nt, hsa
uaaucccccaggagaacaucuuugacacucugcagacugcuaguguucugucuaaaaaccagac

SEQ ID NO: 424444 - RNA, 64 nt, hsa
aaucacggagagguguagauaaucuagaggcauagacugcuagagcccccagggaucuggggug

SEQ ID NO: 424445 - RNA, 64 nt, hsa
ucagauguuggugucuggaaguuuauucuuaagagacugcuacccagcuggucuguauuauugg

SEQ ID NO: 424446 - RNA, 64 nt, hsa
cuuugagguccgcaguagugcuuuugucagcacagacugcuaaucuacaucuugcugcguucug

SEQ ID NO: 424447 - RNA, 64 nt, hsa
uucuuucuaugaucagguaccugcuuucauuuuagacugcuacuuccaaacuaagcuagauucu

SEQ ID NO: 424448 - RNA, 64 nt, hsa
uucuuacgcaaugcuucuagaguuuuauagccuggacugcuaccuuucaaagcuuggagggaag

SEQ ID NO: 424449 - RNA, 64 nt, hsa
ugucagaguaaauguauuagaaauacaguauccagacugcuaguccuugccagagacauucuua

SEQ ID NO: 424450 - RNA, 64 nt, hsa
aaauauauaugaaugucguugaagucuauuuugagacugcuaaagcuauuaauugauacugugu

SEQ ID NO: 424451 - RNA, 64 nt, hsa
aaccaccuuugcgauaaugagagacagaccagaggacugcuacucuuuuuauaggagcugccua

SEQ ID NO: 424452 - RNA, 64 nt, hsa
ucaguagaagaaauacagacuguagaaaugagaggacugcuaauucuucagaacuguaggaaua

SEQ ID NO: 424453 - RNA, 64 nt, hsa
ugucauuauuagucuccuaauaaguuccucugaagacugcuaucagucucuuggacuggaggua

SEQ ID NO: 424454 - RNA, 64 nt, hsa
auagaugaagaagcuagaaaacaggcaaauuccugacugcuaguuuauauagaaauguauucuu

SEQ ID NO: 424455 - RNA, 64 nt, hsa
uuuuuaacuucuuuugccuguuuuacuucuguaagacugcuacagcuaggcucccccuccccuc

SEQ ID NO: 424456 - RNA, 64 nt, hsa
auuuuauuuuuauuauaaaaaugauauugugguggacugcuaaaaauaucacaaauggcaaugu

SEQ ID NO: 424457 - RNA, 64 nt, hsa
cugagagagacuugugcucaaggaaucggcuggggacugcuaccucugagaagacacaagguga

SEQ ID NO: 424458 - RNA, 64 nt, hsa
agagugucgaggauggaggggcccagccuggacugacugcuacuuccugucucuguuuccauua

SEQ ID NO: 424459 - RNA, 64 nt, hsa
acacugcugggcacggcccuggcguucggcacuagacugcuaguguccuccggugagcccaguc

SEQ ID NO: 424460 - RNA, 64 nt, hsa
uugauuuuuuuugaaaagaugaaccaaaggauuugacugcuaauauuuuauuccuuacacuuuu

SEQ ID NO: 424461 - RNA, 64 nt, hsa
cuuacgugacugggggaugucuguccuaaaagcugacugcuaggauaguaaggaucaucuugcc

SEQ ID NO: 424462 - RNA, 64 nt, hsa
ugguaauuuauaaaggaguguauaguaguauacugacugcuaaguguacuauacuguuugcuuu

SEQ ID NO: 424463 - RNA, 64 nt, hsa
ggagaguagcagagcauggguuacuggaagccgggacugcuagggcugguggccagggagcugc

SEQ ID NO: 424464 - RNA, 64 nt, hsa
aagauugaauaguauuguacauuacugcuaaagugacugcuauuucuguauacuguagaaaaac

SEQ ID NO: 424465 - RNA, 64 nt, hsa
guuaucugauagaacaagcugguggcugaugggugacugcuaggcgugacugagguaauagaug

SEQ ID NO: 424466 - RNA, 64 nt, hsa
cuuugcucuaagaauggguaauaguuguacuacagacugcuauaaauuucuugugauacucuuu

SEQ ID NO: 424467 - RNA, 64 nt, hsa
uuuagaagccaacuguuggccccuuaccaugcuggacugcuauaggcccagcuuccccuuguuc

SEQ ID NO: 424468 - RNA, 64 nt, hsa
cucccucucugguauguuucuguuuuguggauuagacugcuaaauaagcgaagaguuaauuuug

SEQ ID NO: 424469 - RNA, 64 nt, hsa
uuuguuggggcagugguaagcucuggcuuucuccgacugcuagggaguggucuuuccuaucaug

SEQ ID NO: 424470 - RNA, 64 nt, hsa
caggggaaaaucuaggagaaugcauuccucugcagacugcuagagagagauggcaagaaggaag

SEQ ID NO: 424471 - RNA, 64 nt, hsa
auucauaguuggcaguuaaacacauacuccaaaagacugcuacuaucuacuauuuuaagaaugu

SEQ ID NO: 424472 - RNA, 64 nt, hsa
gucuccgcacauuucccuaaaaguacaauguuuagacugcuaugguaauacauauuuuaaauuc

SEQ ID NO: 424473 - RNA, 64 nt, hsa
aaacacaacacaacagaauuccuggaaagaagacgacugcuaagacacggcaggggggccugga

SEQ ID NO: 424474 - RNA, 64 nt, hsa
caggcuauucuaauaacagaugauuccuucaacagacugcuauauauucaccauguaaacugca

SEQ ID NO: 424475 - RNA, 64 nt, hsa
aaucugccaucuuugaacucaucuuugguggcuagacugcuacggcagcuucucugaugggaaa

SEQ ID NO: 424476 - RNA, 64 nt, hsa
ucuaauauauuaaguaugugugauacuaagguuugacugcuauaauuauuuguacuguugauca

SEQ ID NO: 424477 - RNA, 64 nt, hsa
aaaauuaaucauagucaccugacuaagaaauucugacugcuaguugccauaaauaacucaaugg

SEQ ID NO: 424478 - RNA, 64 nt, hsa
ccagggguaaaggcugaagcuuucacagugcagagacugcuagccugggcacacacaccuccuu

SEQ ID NO: 424479 - RNA, 64 nt, hsa
guaauuaaacauaaaaugucauucaggguuuccugacugcuaaugcagaaaggaaaaucguaaa

SEQ ID NO: 424480 - RNA, 64 nt, hsa
uguuugcaaggggcuggggcuggaagcugguagugacugcuaaugggcaugaggaaucuuacag

SEQ ID NO: 424481 - RNA, 64 nt, hsa
auuugccucuaucuuccuuuccucagucuucccagacugcuaucaagcuguguaaaaauuuacu

SEQ ID NO: 424482 - RNA, 64 nt, hsa
aucuacuugguuuacccaagucauguuuuuaauagacugcuaauaucaaaggagaauuuuuaaa

SEQ ID NO: 424483 - RNA, 64 nt, hsa
gccagacugugaaggaaaauauaaaaaaaaagucgacugcuaugcucaaaaaguaaaaaaagcu

SEQ ID NO: 424484 - RNA, 64 nt, hsa
cauuacgagauacagguuacauuuuuuuucccaagacugcuacaugugugauguuguuuccuua

SEQ ID NO: 424485 - RNA, 64 nt, hsa
gaggcuuuacauaaaggguucucucucaucccaagacugcuaauuuagugauucugugagucac

SEQ ID NO: 424486 - RNA, 64 nt, hsa; identical to SEQ ID NO: 424480

SEQ ID NO: 424487 - RNA, 64 nt, hsa
aggaucaaaacucagaggcaaagagggaguuccugacugcuagaggugccaccaccacaaacac

SEQ ID NO: 424488 - RNA, 64 nt, hsa
uacuuuguuaauaucuaguuuaguucauugucaagacugcuauuuucuaagagacuucuaaaga

SEQ ID NO: 424489 - RNA, 64 nt, hsa
agcuguguuagaaguagcaaugacaaugaccaaggacugcuacaccucugauuacaauucugau

SEQ ID NO: 424490 - RNA, 64 nt, hsa
ucacacuugcaaaugaaugccuuucaaacauugagacugcuagaaccaagcacuaccaguaucu

SEQ ID NO: 424491 - RNA, 64 nt, hsa
cuagccugccaggggucaaggccuccugccaggugacugcuaucccguccacaccgcuucauug

SEQ ID NO: 424492 - RNA, 64 nt, hsa
uuaaauauuacaaauuuguucaguucauagcguagacugcuaaauacuguaauguuucaaaaca

SEQ ID NO: 424493 - RNA, 63 nt, hsa
gacacccuaaugccaauaaaaguugcucauuauggacugcuacaaagaccagaccagcuguga

SEQ ID NO: 424494 - RNA, 64 nt, hsa
aucaaagaacugaaagcacuagagcagccuuggggacugcuaggaugaagcccuaaagaaugca

SEQ ID NO: 424495 - RNA, 64 nt, hsa
cuuggccccugugugaguugagucuccucucugagacugcuaaguaggggcagugaugguugcc

SEQ ID NO: 424496 - RNA, 64 nt, hsa
ucaacuuucaaauguugguuuucuuuaagcaggagacugcuauuuuaguuguuguuaaaugaug

SEQ ID NO: 424497 - RNA, 64 nt, hsa
uauuauuugaguguuguuggaccaugugugaucagacugcuaucugaauaaaauaagauuuguc

SEQ ID NO: 424498 - RNA, 64 nt, hsa
cuauccucuguaaacuuuuugugcugaauguugggacugcuaaauaaaauuuguugcauaauuu

SEQ ID NO: 424499 - RNA, 64 nt, hsa
aggacaagaucaauucuuuucuagucaguucuaagacugcuagagagagauaccaggcccuuag

SEQ ID NO: 424500 - RNA, 64 nt, hsa
uaagagagaaacaccgaaauucagauagcucagggacugcuaacagagaacuacauuuuucuua

SEQ ID NO: 424501 - RNA, 64 nt, hsa
cccugcauggggagauacacuaacccccagaaaugacugcuaagccucuugccuugucuuuagu

SEQ ID NO: 424502 - RNA, 64 nt, hsa
ugguguucagaaaaaaauuaacaugcaggccugagacugcuaucccuagaaaggucugcuugca

SEQ ID NO: 424503 - RNA, 64 nt, hsa
ggguucuguauuucuucucugcccuccaauccccgacugcuaugauguuuacuacagugaaccc

SEQ ID NO: 424504 - RNA, 64 nt, hsa
cacaaacuguguuuuuaacucaaauauugucuucgacugcuauguguauaggaaagcagucucu

SEQ ID NO: 424505 - RNA, 64 nt, hsa
uacugaaugaaugaaugaacaaggggugccaggagacugcuacucccaguccuucccagaaacu

SEQ ID NO: 424506 - RNA, 64 nt, hsa
uacacaauccucaggcugacauaaaguuuacgaggacugcuacuauaacugagagugcugacca

SEQ ID NO: 424507 - RNA, 64 nt, hsa
cagcuuagcuaguucauaaccuguauauucuaaagacugcuaagguuuuguuuucauuuuaaau

SEQ ID NO: 424508 - RNA, 64 nt, hsa
ucacaauuaaggggaagcaaaaacaucuugaaaagacugcuaggaaggaaauuaauaucaguca

SEQ ID NO: 424509 - RNA, 64 nt, hsa
ucuuggggaguagccauccaucaacaaauauccugacugcuacuuuguuauauacaaaauacuu

SEQ ID NO: 424510 - RNA, 64 nt, hsa
uuuuuuuuuuuuuuuugucauugauuugugcugggacugcuauacuugacauuauacugcaaac

SEQ ID NO: 424511 - RNA, 64 nt, hsa
cauggucacagccaagaggagccugagaagacaugacugcuagauguaaugugguauccuacau

SEQ ID NO: 424512 - RNA, 64 nt, hsa
ggcuuuauuuucaccuuguguacaacauggcaaagacugcuaagauuaaaauccgucucccauu

SEQ ID NO: 424513 - RNA, 64 nt, hsa
aacauuacaguugccaaggaggaaaauacugaaugacugcuaagaauuaaccuuaagaccaguu

SEQ ID NO: 424514 - RNA, 64 nt, hsa
cacugugguaggauaacaguauaucugauuaacagacugcuacuaggugauuaaugggugggua

SEQ ID NO: 424515 - RNA, 64 nt, hsa
uuuacagugaaggugucauucacaaaaacucaaggacugcuauucuccuucuuccccuuaguuu

SEQ ID NO: 424516 - RNA, 64 nt, hsa
gaggacaucacagaaaggagaaucuccacucacugacugcuauggaccuuucucaggacagcua

SEQ ID NO: 424517 - RNA, 64 nt, hsa
gcccggcucccuggggcagcugcuugagaacagagacugcuaccccauccugcccaugcaggca

SEQ ID NO: 424518 - RNA, 64 nt, hsa
cucucacggaaccacuggcaucagauggugaagugacugcuacccgguugccaucuguugaaca

SEQ ID NO: 424519 - RNA, 64 nt, hsa
acagcuggagcucugagccuuccacagcccgugugacugcuagagggcaggggugcagggcuca

SEQ ID NO: 424520 - RNA, 64 nt, hsa
cagguaccacauucauuguuaaggaauggcugaugacugcuacacguguugggaaccugguugg

SEQ ID NO: 424521 - RNA, 64 nt, hsa
uuucagcagcuguggggaggugggacugaggagcgacugcuaaucaggaugggguuuccuccug

SEQ ID NO: 424522 - RNA, 64 nt, hsa
ggauacauuuugguggcccacuggguacugugaggacugcuacauugauggauguuauuggcua

SEQ ID NO: 424523 - RNA, 64 nt, hsa
ugauuccagccaccgccugaccauccgccauuccgacugcuaaaagcgaauguagucaggcccc

SEQ ID NO: 424524 - RNA, 64 nt, hsa
uuauuuguacauaaggauaaucacaucuaccugagacugcuaucauggaaauuaaauguuuggu

SEQ ID NO: 424525 - RNA, 64 nt, hsa
ggccaaaauggcuuuuaugaccuauccucaggaggacugcuaagcuuucacuuauuuccuauug

SEQ ID NO: 424526 - RNA, 64 nt, hsa
ugcaugggauucugcgugcccuuugcuugauauagacugcuaaggugagauggggaauaucaga

SEQ ID NO: 424527 - RNA, 64 nt, hsa
uuucagcagcuguggggaggugggacugaggagcgacugcuaaucaguaugggguuuccucccg

SEQ ID NO: 424528 - RNA, 64 nt, hsa
uuuggcugagaacagccccuggagaacauggggugacugcuaccauaggucuggaaguaugagg

SEQ ID NO: 424529 - RNA, 64 nt, hsa
auucuuuguuaauuuuaauuuuguccuguuccuagacugcuagaaucuggccccuggccaucuu

SEQ ID NO: 424530 - RNA, 64 nt, hsa
auauguagauccaaucacuuuaccuauacaaaaugacugcuauggugggaacacaauaaacacc

SEQ ID NO: 424531 - RNA, 64 nt, hsa
augggacugugaggccauacuugugaaacgucuggacugcuauucuagagcuuuuauuuggugu

SEQ ID NO: 424532 - RNA, 64 nt, hsa
ggugagcgcgggugucgaggucugugugucugcagacugcuaaccuaugacaauucagggaccu

SEQ ID NO: 424533 - RNA, 64 nt, hsa
ucuaugaaaugacuucuuaaauauuuaguugauagacugcuacagguaauagggacuuagcaag

SEQ ID NO: 424534 - RNA, 64 nt, hsa
agucagcugaaggaugguuagacagcacagcgaagacugcuaaaugcacugaccccccccauua

SEQ ID NO: 424535 - RNA, 64 nt, hsa
gaaaccaagaauauuguucuuaugcuggaaauuugacugcuaacauucucuuaauaaaguuuua

SEQ ID NO: 424536 - RNA, 64 nt, hsa
aaucaaauuaauuuguauucaauguguacuucaagacugcuaauuguuucaucugaaagccuac

SEQ ID NO: 424537 - RNA, 64 nt, hsa
ugaucucaguaggccuaaccuauaaccuagcacagacugcuacagcugcuccccucccgccaaa

SEQ ID NO: 424538 - RNA, 64 nt, hsa
ccucagaaagauuugaugggccacaacugucuuagacugcuagcuuucuccuuaccgucuugau

SEQ ID NO: 424539 - RNA, 64 nt, hsa
aaguauauuggagcgcagauaaauauaaauuguggacugcuaugaaaacagguuguacuucucc

SEQ ID NO: 424540 - RNA, 64 nt, hsa
auacuuuuuuggauauaaaugaccauauuuauuugacugcuaguuuuuuuguuuuuuuuuuguc

SEQ ID NO: 424541 - RNA, 64 nt, hsa
ggcuuaagugauaacuuccguuucaguuaaaaggaagcccgaaguuguguuugugcugcccaca

SEQ ID NO: 424542 - RNA, 64 nt, hsa
ggcauccccugccugaacgaagacuuccgccgcgaagcccgauagaucgggggaaaauggggcc

SEQ ID NO: 424543 - RNA, 64 nt, hsa
gggagacuuccgcccuccucacugaggcaacaugaagcccgaggcccagaugggggcugaacag

SEQ ID NO: 424544 - RNA, 64 nt, hsa
uuuuaaaaaguguuuaaugagaguuuacagacagaagcccgaaguggaaagaccuuaugguuuu

SEQ ID NO: 424545 - RNA, 64 nt, hsa
cuuggcacgcuacccucaucaucuuacucaucuuaagcccgagccauggaucaacuaggagccc

SEQ ID NO: 424546 - RNA, 64 nt, hsa
agacaugcucgucaugaaaaaagaaccauuucugaagcccgauuggggccaaacauuuacaccu

SEQ ID NO: 424547 - RNA, 64 nt, hsa
gcugggaggaggggcuggggaggaucugcagcugaagcccgaggcaggguuggugugaugccaa

SEQ ID NO: 424548 - RNA, 64 nt, hsa
gugggaccuucugugggguuuggggaucuccaggaagcccgaccaagcuguccccuuccccugu

SEQ ID NO: 424549 - RNA, 64 nt, hsa
cuuaggcaaagcauuauucauucccaucagucugaagcccgaaggacuguuuuguauaauaccu

SEQ ID NO: 424550 - RNA, 64 nt, hsa
guggggggggugacaugggcccuaggcagacugcaagcccgaccgagcacuuggacucgaacuc

SEQ ID NO: 424551 - RNA, 64 nt, hsa
gaacaauaucugggaagguacuagagaaauuacaaagcccgagcucuuucuuauaaugccaccu

SEQ ID NO: 424552 - RNA, 64 nt, hsa
ccugcagguuaacuggcgguaagugcuagacuguaagcccgacaagggcagggcuuuugguuuu

SEQ ID NO: 424553 - RNA, 64 nt, hsa
auugacugcuuaaccaaagaaauugaucuuuuucaagcccgaggaccacauuuuaaccccagcg

SEQ ID NO: 424554 - RNA, 64 nt, hsa
ccccgcccauccgugcuaugacauggaggcacugaagcccgaggaagguguguggagauucuaa

SEQ ID NO: 424555 - RNA, 64 nt, hsa
ugugaggccucccccaucaguggaccagagggagaagcccgaugccccaucccggcuuucccgu

SEQ ID NO: 424556 - RNA, 64 nt, hsa
cuccaagcugcauggcaaguucugugguucugagaagcccgaggucaucaccucccaguacaac

SEQ ID NO: 424557 - RNA, 64 nt, hsa
uuuucugguccuuacugcuccucccacaacagggaagcccgaucaguucugucaguauaagguu

SEQ ID NO: 424558 - RNA, 64 nt, hsa
gaucaucaucuuugaaaggggggaggaggaguaaaagcccgauuauaauggugaucaauucaag

SEQ ID NO: 424559 - RNA, 64 nt, hsa
uuuuuuuuuuuuuucaaauggggucaguaccugaaagcccgaaaccccauaccaagcuuauagu

SEQ ID NO: 424560 - RNA, 64 nt, hsa
guuggcaucaacacggggacccucugcuucaccaaagcccgagcccucagccccuggggagaac

SEQ ID NO: 424561 - RNA, 64 nt, hsa
uuaaagcauuuaaauggaaaccaggggaguuuuaaagcccgagaaaccacacauaaucuuuugu

SEQ ID NO: 424562 - RNA, 64 nt, hsa
ccacuguccugggcgcccuggaagccggcggcccaagcccgacuugcuguuuuguucugugguu

SEQ ID NO: 424563 - RNA, 64 nt, hsa
gcacuacucauauccuuuaaacuaaauuuugccaaagcccgagacaacauuaaggagaaauugu

SEQ ID NO: 424564 - RNA, 64 nt, hsa
cauacacauaugcagacacaugccagggccccccaagcccgagcaccggaccacguugcugccc

SEQ ID NO: 424565 - RNA, 64 nt, hsa
uuucaggaaaacgaaguagguaauaaacaggaaaaagcccgagucugaugcuaagaagaacaua

SEQ ID NO: 424566 - RNA, 64 nt, hsa
cacucuacaguaaaaucucuacacuaacaguuuaaagcccgaaagcugaagcauucagccucug

SEQ ID NO: 424567 - RNA, 64 nt, hsa
acugaaucaguggaaagagaaugcuucccauagaaagcccgacauggugcuaguuuccucucuu

SEQ ID NO: 424568 - RNA, 64 nt, hsa
gccggccaccaguccucgaugcuucugaacccugaagcccgaugacaucuuacgagguggacgu

SEQ ID NO: 424569 - RNA, 64 nt, hsa
gcagcaccgucgucucgacuucggaggcaacaccaagcccgaccgggccaggccugggugaucu

SEQ ID NO: 424570 - RNA, 64 nt, hsa
cuugagaugacugugguccccccuuagacucccuaagcccgagugagcucaggugucacccugu

SEQ ID NO: 424571 - RNA, 64 nt, hsa
gggggcggggaggggacguaaaucccuaaucuuuaagcccgacuugaggcugagagcagcugga

SEQ ID NO: 424572 - RNA, 64 nt, hsa
cucucuccuucugcaguucuaaaccacagucuauaagcccgagucaccaggacggccugucugg

SEQ ID NO: 424573 - RNA, 64 nt, hsa
agggauuggccauuuauacugggcucgagcucagaagcccgaggaacucuuugcuccccugcuu

SEQ ID NO: 424574 - RNA, 64 nt, hsa
gcaacccagcaccugguaggcuccauuucuucccaagcccgagcagagggucaugcgggcccca

SEQ ID NO: 424575 - RNA, 64 nt, hsa
auaacagaauuuguacaggugagaagccuaaugaaagcccgauauguguaaagaucuacucuca

SEQ ID NO: 424576 - RNA, 64 nt, hsa
gccuguuugagggcucacgaccccugcagcaaagaagcccgagacugauuccuuuagaauuaac

SEQ ID NO: 424577 - RNA, 64 nt, hsa
ugauggccagcaaaugaaauucugccuagaaauuaagcccgagcuguuguauauugagguguau

SEQ ID NO: 424578 - RNA, 64 nt, hsa
gaggagggauagagacgcagauuucagauguaagaagcccgauccacauugcauaaguggaccc

SEQ ID NO: 424579 - RNA, 64 nt, hsa
cuggaguucccacgugucccggggcuuuuccaggaagcccgagcccaggaccuguuggcagagu

SEQ ID NO: 424580 - RNA, 64 nt, hsa
agaugaagaagucuuugagcagaagcacguuaagaagcccgaagggcuuuucagaaaucgguuu

SEQ ID NO: 424581 - RNA, 64 nt, hsa; identical to SEQ ID NO: 159015

SEQ ID NO: 424582 - RNA, 64 nt, hsa; identical to SEQ ID NO: 159016

SEQ ID NO: 424583 - RNA, 64 nt, hsa; identical to SEQ ID NO: 159017

SEQ ID NO: 424584 - RNA, 64 nt, hsa; identical to SEQ ID NO: 159018

SEQ ID NO: 424585 - RNA, 64 nt, hsa; identical to SEQ ID NO: 159019

SEQ ID NO: 424586 - RNA, 64 nt, hsa; identical to SEQ ID NO: 159020

SEQ ID NO: 424587 - RNA, 64 nt, hsa; identical to SEQ ID NO: 421584

SEQ ID NO: 424588 - RNA, 64 nt, hsa; identical to SEQ ID NO: 421585

SEQ ID NO: 424589 - RNA, 64 nt, hsa; identical to SEQ ID NO: 421586

SEQ ID NO: 424590 - RNA, 64 nt, hsa; identical to SEQ ID NO: 421587

SEQ ID NO: 424591 - RNA, 64 nt, hsa; identical to SEQ ID NO: 421588

SEQ ID NO: 424592 - RNA, 64 nt, hsa; identical to SEQ ID NO: 421589

SEQ ID NO: 424593 - RNA, 51 nt, hsa; identical to SEQ ID NO: 421590

SEQ ID NO: 424594 - RNA, 64 nt, hsa; identical to SEQ ID NO: 421591

SEQ ID NO: 424595 - RNA, 64 nt, hsa; identical to SEQ ID NO: 421592

SEQ ID NO: 424596 - RNA, 64 nt, hsa; identical to SEQ ID NO: 421593

SEQ ID NO: 424597 - RNA, 64 nt, hsa; identical to SEQ ID NO: 421594

SEQ ID NO: 424598 - RNA, 64 nt, hsa; identical to SEQ ID NO: 421595

SEQ ID NO: 424599 - RNA, 64 nt, hsa; identical to SEQ ID NO: 421596

SEQ ID NO: 424600 - RNA, 64 nt, hsa; identical to SEQ ID NO: 421597

SEQ ID NO: 424601 - RNA, 64 nt, hsa; identical to SEQ ID NO: 421598

SEQ ID NO: 424602 - RNA, 64 nt, hsa; identical to SEQ ID NO: 421599

SEQ ID NO: 424603 - RNA, 64 nt, hsa; identical to SEQ ID NO: 421600

SEQ ID NO: 424604 - RNA, 64 nt, hsa; identical to SEQ ID NO: 421601

SEQ ID NO: 424605 - RNA, 64 nt, hsa; identical to SEQ ID NO: 421602

SEQ ID NO: 424606 - RNA, 64 nt, hsa; identical to SEQ ID NO: 421603

SEQ ID NO: 424607 - RNA, 64 nt, hsa; identical to SEQ ID NO: 421604

SEQ ID NO: 424608 - RNA, 64 nt, hsa; identical to SEQ ID NO: 421605

SEQ ID NO: 424609 - RNA, 64 nt, hsa; identical to SEQ ID NO: 421606

SEQ ID NO: 424610 - RNA, 64 nt, hsa; identical to SEQ ID NO: 421607

SEQ ID NO: 424611 - RNA, 64 nt, hsa; identical to SEQ ID NO: 421608

SEQ ID NO: 424612 - RNA, 64 nt, hsa; identical to SEQ ID NO: 421609

SEQ ID NO: 424613 - RNA, 64 nt, hsa; identical to SEQ ID NO: 421610

SEQ ID NO: 424614 - RNA, 64 nt, hsa; identical to SEQ ID NO: 421611

SEQ ID NO: 424615 - RNA, 64 nt, hsa; identical to SEQ ID NO: 421612

SEQ ID NO: 424616 - RNA, 64 nt, hsa; identical to SEQ ID NO: 421613

SEQ ID NO: 424617 - RNA, 64 nt, hsa; identical to SEQ ID NO: 421614

SEQ ID NO: 424618 - RNA, 64 nt, hsa; identical to SEQ ID NO: 421615

SEQ ID NO: 424619 - RNA, 64 nt, hsa; identical to SEQ ID NO: 421616

SEQ ID NO: 424620 - RNA, 64 nt, hsa; identical to SEQ ID NO: 421617

SEQ ID NO: 424621 - RNA, 64 nt, hsa; identical to SEQ ID NO: 421618

SEQ ID NO: 424622 - RNA, 64 nt, hsa; identical to SEQ ID NO: 421619

SEQ ID NO: 424623 - RNA, 64 nt, hsa; identical to SEQ ID NO: 421620

SEQ ID NO: 424624 - RNA, 64 nt, hsa; identical to SEQ ID NO: 421621

SEQ ID NO: 424625 - RNA, 64 nt, hsa; identical to SEQ ID NO: 421622

SEQ ID NO: 424626 - RNA, 64 nt, hsa
aaauaauauauuuaauucaaaacaauguuauaauuaauauuaauauuaacaauauugauguuaa

SEQ ID NO: 424627 - RNA, 64 nt, hsa
uauauuuaauucaaaacaauguuauaauuaauauuaauauuaacaauauugauguuaauuacau

SEQ ID NO: 424628 - RNA, 64 nt, hsa
cuguauuuccacagauuucucccaaggaaaaggcuaauauuagucacuacuguuaucacauccc

SEQ ID NO: 424629 - RNA, 64 nt, hsa
aguauuguaacguaugugaauagaugauaacaauuaauauuacuaaaagucccacaugagaguc

SEQ ID NO: 424630 - RNA, 64 nt, hsa
aaauacuuggaauaauuuuucauauucuugucauuaauauuauuuuguauuuuuauguggaaau

SEQ ID NO: 424631 - RNA, 64 nt, hsa
uuauguugaauuauuuuuggagcugaaaucuuuguaauauuaaagcaacuaguuucuaauuccc

SEQ ID NO: 424632 - RNA, 64 nt, hsa
gaagguaaaucaauggaaaaaugaaauuuauuuuuaauauuacuacuauaugaauuaucuuuuu

SEQ ID NO: 424633 - RNA, 64 nt, hsa
cuucauuauuuggaaggaaaauuaguauuuuuuuuaauauuauauggaccaucugauuauauuu

SEQ ID NO: 424634 - RNA, 64 nt, hsa
cauucauuuccuucauugcugaacaggcaagauauaauauuacaugaaugauuacuauauuuug

SEQ ID NO: 424635 - RNA, 64 nt, hsa
uccaaaacuuuaguugaauucaucuacguuuguuuaauauuaacuuaaccuauucuauuguauu

SEQ ID NO: 424636 - RNA, 64 nt, hsa
uaaguacaaauacaaugcagagcucauuuucaguuaauauuaguacuuuuuaaaucuuuacucu

SEQ ID NO: 424637 - RNA, 64 nt, hsa
acuacaaaaugauaaucagccauugugaaacugcuaauauuagcuugucauaauuauggccaua

SEQ ID NO: 424638 - RNA, 64 nt, hsa
cugaaacauuauuuuuuaauguuuaaaaaguuucuaauauuaaagucagaauauuaauacaauu

SEQ ID NO: 424639 - RNA, 64 nt, hsa
guuucuaauauuaaagucagaauauuaauacaauuaauauuaauauuaacuacagaaaagacaa

SEQ ID NO: 424640 - RNA, 64 nt, hsa
aauauuaaagucagaauauuaauacaauuaauauuaauauuaacuacagaaaagacaaacagua

SEQ ID NO: 424641 - RNA, 64 nt, hsa
uggaauaucuaugaaugaauauccucuauucuuauaauauuaaaacccauaaguaaauauagga

SEQ ID NO: 424642 - RNA, 64 nt, hsa
uuagguaaagcucuagguuacuguguuacuauuauaauauuaaacauucgaauaggcagucguu

SEQ ID NO: 424643 - RNA, 64 nt, hsa
guuuacaucuuagaaaaaacauagauagugcuaguaauauuacuuauaacuguaauauauagau

SEQ ID NO: 424644 - RNA, 64 nt, hsa
uuauuuuuagaugauguaacauagccaucaaaauuaauauuauguaaugccuaauacuuaguau

SEQ ID NO: 424645 - RNA, 64 nt, hsa
ccuaagagcuaaggcaguaaaauuaucucauaaauaauauuagcuuauuuuuuuucauacuauu

SEQ ID NO: 424646 - RNA, 64 nt, hsa
aaaaagagcaaacccauggaaaaugucucagaucuaauauuaaaaucaagacuaagcauuuaac

SEQ ID NO: 424647 - RNA, 64 nt, hsa
uuauuugccaaagacagauauaaauuaccugguuuaauauuagugaagaauaaauaagugcaca

SEQ ID NO: 424648 - RNA, 64 nt, hsa
aauaaaaguggucagauuuauaauguuaaugacuuaauauuauccuuuucuaauagucucaugu

SEQ ID NO: 424649 - RNA, 64 nt, hsa
gauuuuguauguuagacuuuuuacauuguuuaucuaauauuauuuaugacaguaauuuuaaaau

SEQ ID NO: 424650 - RNA, 64 nt, hsa
gugaguggaugaaaacauuuguaaggcugcaacauaauauuaaaaugugaauaaauaaauguuc

SEQ ID NO: 424651 - RNA, 64 nt, hsa
gaugcaugugggcagcaggaagcccaagugaaauuaauauuaugcagaugaugaaagggaccuc

SEQ ID NO: 424652 - RNA, 64 nt, hsa
gcugaaggccugggcaucucuugugacauuuuucuaauauuaguuuuagauuuucacguauuag

SEQ ID NO: 424653 - RNA, 64 nt, hsa
gaaagggaauuucucucucugccauuuuauuugauaauauuaaagaaauaaagacuggaaaggg

SEQ ID NO: 424654 - RNA, 64 nt, hsa
agauguuaccacuuaccccuucugcugcgcagaauaauauuaagaauugcuaugcuuaugauuc

SEQ ID NO: 424655 - RNA, 64 nt, hsa
uucugggagggacuuucauaucuggucaaugucauaauauuauuuuguauuuuuauuggaauaa

SEQ ID NO: 424656 - RNA, 64 nt, hsa
uuuugaaaaugaagaaguuagagcuuuauaacuauaauauuaaagaucauaucuaaccuacaga

SEQ ID NO: 424657 - RNA, 64 nt, hsa
agguuuaaaaaggaacuuuuaaauuccuuaauguuaauauuaauguucauguuaauguccuaag

SEQ ID NO: 424658 - RNA, 64 nt, hsa
cuaaaaaaggauucaguuaauuuauaauguuuaauaauauuauacuuuuagaauauuuuguuua

SEQ ID NO: 424659 - RNA, 64 nt, hsa
uauuaaagagagguauuggugcauauaaaaacaguaauauuauuguuaugcuuguauucuugca

SEQ ID NO: 424660 - RNA, 64 nt, hsa
auaaaguuguuauagauuuuuuaaaaugcuuuuuuaauauuaaaauguacuuuuacauucuuaa

SEQ ID NO: 424661 - RNA, 64 nt, hsa
ggacauugaaagugaaauaauuugugucuguguuuaauauuaccaacuacauuggaagccugag

SEQ ID NO: 424662 - RNA, 64 nt, hsa
auacaaauuuagugcucuuaacuuguuaccauuguaauauuaacuaaauaaacagauguauuau

SEQ ID NO: 424663 - RNA, 64 nt, hsa
ugcacacuaauauuuaguuuugcuuucucguggauaauauuaagcacuuacucugcaguuuccu

SEQ ID NO: 424664 - RNA, 64 nt, hsa
ccauuuuauuauuuuaguguauuaguuaugaagauaauauuaucuauuuguaaauugcuacuuu

SEQ ID NO: 424665 - RNA, 64 nt, hsa
uaaaugcugccuuuaugguauaaaacuguaaauguaauauuauguaauuaugugaacuuuugag

SEQ ID NO: 424666 - RNA, 64 nt, hsa
gaaacuauaagcaauuaugugggaaaucauuuaauaauauuaaaucuuagaaguuauaaggaaa

SEQ ID NO: 424667 - RNA, 64 nt, hsa
ugaaagagaaucccuguuguacuuuaucuuuuuguaauauuauuuuugaauuuuucauuauuau

SEQ ID NO: 424668 - RNA, 64 nt, hsa
auggaaauuaaauuuauggggaaaaguuuauuuuuaauauuacuuauagcugagucagaauuaa

SEQ ID NO: 424669 - RNA, 64 nt, hsa
ucauugaaacuacuacaaugauacuaucauuuaauaauauuaauauuacuugaaauagacuaag

SEQ ID NO: 424670 - RNA, 64 nt, hsa
aaacuacuacaaugauacuaucauuuaauaauauuaauauuacuugaaauagacuaagauaaag

SEQ ID NO: 424671 - RNA, 64 nt, hsa
auauauacacagguauuaaauauaucgcucuauauaauauuauauaugugugugguauccaagg

SEQ ID NO: 424672 - RNA, 64 nt, hsa
gucuguguauuaaaaauuuaagaauaccacacuuuaauauuaaauauucauaaggucuaguauc

SEQ ID NO: 424673 - RNA, 64 nt, hsa
ccuuauauacauuccacuaaugacauucuuauaauaauauuaaacacaugaucuugguacuaac

SEQ ID NO: 424674 - RNA, 64 nt, hsa
gaacccagccuauugcaaaaauaaaaucuuuuuauaauauuaucuaugggaugucagcacaaua

SEQ ID NO: 424675 - RNA, 64 nt, hsa
aaaacuuguauuucauaugaaaaauuugcuaauuuaauauuaacucauuugauaauaauacuug

SEQ ID NO: 424676 - RNA, 64 nt, hsa
cuuaacaugcugauccagcuguacuucagaaaaauaauauuaaucauauguuuuguguacguau

SEQ ID NO: 424677 - RNA, 64 nt, hsa
agcucaagcccgcugguggcagggcguuuucccaccgggauacgggaagccaccugugucaggg

SEQ ID NO: 424678 - RNA, 64 nt, hsa
uccuauaccccacccgccucuuccccuuucugucccgggauaccuggcggcaagagacuucuug

SEQ ID NO: 424679 - RNA, 64 nt, hsa
guacagaggcauagguuaccacccccaccccggcccgggauacugcccccggcccagauccugg

SEQ ID NO: 424680 - RNA, 64 nt, hsa
uacacacacucuuccuguucugccuucaccuaugccgggauaagcagagaucucaucaauuagc

SEQ ID NO: 424681 - RNA, 64 nt, hsa
cccccaaucggacugccaaauucuccgguuugccccgggauauuauagaaaauuauuuguauga

SEQ ID NO: 424682 - RNA, 64 nt, hsa
cagaugcuuugcccaggcuucucaccacgguguaccgggauauuaaaccucuuuccccagccug

SEQ ID NO: 424683 - RNA, 64 nt, hsa
gucuuccaauuuaaccaaagauaaaggacuagagccgggauacuuucagaugcucgccuguacc

SEQ ID NO: 424684 - RNA, 64 nt, hsa
ucugacuuuguucuucuuauauauuuuuucagugccgggauauucauauuccuaaagccacuau

SEQ ID NO: 424685 - RNA, 64 nt, hsa
ggucagcccagcaccugcucccagugggagcuucccgggauaaacugagccuguucauucugau

SEQ ID NO: 424686 - RNA, 64 nt, hsa
gaaaccaguuaagaggcacaguguacagaggaggccgggauagagccaugaggguuauaauauu

SEQ ID NO: 424687 - RNA, 64 nt, hsa
ucaaggcacuaguaucagauggcaagcucagugcccgggauacccacugcuggcaggagaaggc

SEQ ID NO: 424688 - RNA, 64 nt, hsa
ccugacuagggagcccucccauugccuuccuggcccgggauagaagaggggagguaagucuggg

SEQ ID NO: 424689 - RNA, 64 nt, hsa
gauaggggcugcccuuuuugucugauaccuggccccgggauagucaggacaggugaauguuggc

SEQ ID NO: 424690 - RNA, 64 nt, hsa
aguuucgcacccugggcagacccccaggccccauccgggauagggcagaggaggugcuggcggc

SEQ ID NO: 424691 - RNA, 64 nt, hsa
cccucgggcccacccguacagaggcugguggucgccgggauaauuaaugaccaccgccaauuca

SEQ ID NO: 424692 - RNA, 64 nt, hsa
cucuacucaguugggggagaaacucacagcuccuccgggauacauaugugcccucagcagcagc

SEQ ID NO: 424693 - RNA, 64 nt, hsa
gcccauggauggcugagcaccacuacgacuuaguccgggauaagggccuccccaguccucuccg

SEQ ID NO: 424694 - RNA, 64 nt, hsa
ucauucaagucuaugaugcuguugcccacguuucccgggauauauauucucuccccuccguugg

SEQ ID NO: 424695 - RNA, 64 nt, hsa
ugcugggauuacagacaugagccaccacgcuuggccgggauaguauauuuuuauagcacuuccc

SEQ ID NO: 424696 - RNA, 64 nt, hsa
gccuccauggaaacagccccuagaaucugaaaggccgggauaaaccuaaucacuguucccaaac

SEQ ID NO: 424697 - RNA, 64 nt, hsa
gguugugggccauuuuccugaacucaccacuuacccgggauaguaaacaugauacacaucaaua

SEQ ID NO: 424698 - RNA, 64 nt, hsa
uucuuuuuaaaaauauuuuauuuuauuuuacguuccgggauacaugugcaggaccugcagguuu

SEQ ID NO: 424699 - RNA, 64 nt, hsa
guucugccagucuacaauagcagugaagacugacaaaucagauauucccaaugacugacagcuu

SEQ ID NO: 424700 - RNA, 64 nt, hsa
aaaaucccuacgugauccuucugccaaaaugucgaaaucagacccugacaaacuggccaccguc

SEQ ID NO: 424701 - RNA, 64 nt, hsa
uucgcugaaggaagaugacgcagagcuuuaucugaaaucagaggggagcuauccaaaaugggag

SEQ ID NO: 424702 - RNA, 64 nt, hsa
uuuagugauaugaagaucacaacuaacaacugacaaaucagaguuugccaguucaaauucagca

SEQ ID NO: 424703 - RNA, 64 nt, hsa
auggaaaauuacaaaaaugaauuuuucuucccugaaaucagagcuuacauguguguuuuuuuau

SEQ ID NO: 424704 - RNA, 64 nt, hsa
ugguaggaggggaaaaaagucaggaaaauauaucaaaucagaaacauggaagaagaagggaacc

SEQ ID NO: 424705 - RNA, 64 nt, hsa
guuuugaucuguuuugaaaaagauaaagagccucaaaucagaccagcacugauuaauuaacccu

SEQ ID NO: 424706 - RNA, 64 nt, hsa
uuaaacaccauggcugucacacuucaguucaauuaaaucagaaugucugaggagugagacacag

SEQ ID NO: 424707 - RNA, 64 nt, hsa
uuuuauuaccagguccauuuugccugacaauugcaaaucagagcauacaaaauaaaacugugca

SEQ ID NO: 424708 - RNA, 64 nt, hsa
uaauuguugugguuuaaauacauaaauaguagaaaaaucagagucuauaacagaaaguuuguaa

SEQ ID NO: 424709 - RNA, 64 nt, hsa
ucugguuuaauguuguauuuauaauuuaaaguggaaaucagaaacuguuucaagaaccuguauu

SEQ ID NO: 424710 - RNA, 64 nt, hsa
ccuuuagacaaaggugacuuuugucugauuuuacaaaucagauuuuauucaagcuuucuaaaua

SEQ ID NO: 424711 - RNA, 64 nt, hsa
auccuuugcucuguuuuucucuucaggcucuggaaaaucagaucugugacuuaaucuuccucuc

SEQ ID NO: 424712 - RNA, 64 nt, hsa
aguagggguuggggggaguguggacaaaccccgcaaaucagaguggggaaggugagugguagag

SEQ ID NO: 424713 - RNA, 64 nt, hsa
aguccucagccagugcuuuagagcaacuucccgcaaaucagaaacucacugugauuccaaaaau

SEQ ID NO: 424714 - RNA, 64 nt, hsa
ugcccacuucaugcaacuccuaaacucaaagucuaaaucagauauuuuuauuaacaaugacaac

SEQ ID NO: 424715 - RNA, 64 nt, hsa
cguaacauggaggccucagcugcucugaggagagaaaucagacuuuguuuuuugaaaucgauug

SEQ ID NO: 424716 - RNA, 64 nt, hsa
gagggcauuauuuggaggaaaccgcuauaauguaaaaucagauuucagaaggaaaaugcagcaa

SEQ ID NO: 424717 - RNA, 64 nt, hsa
uuuaaagcucaugcauuucaagcagcugaagaaaaaaucagaacuaaccaguaccucuguauag

SEQ ID NO: 424718 - RNA, 64 nt, hsa
ugguuuccauuuacuaacagcaacagcaagaaauaaaucagagagcaaggcaucgggggugaau

SEQ ID NO: 424719 - RNA, 64 nt, hsa
cagccuucaucuuuauugggaaugaguuuguuauaaaucagaaauggguccaugaugaccacug

SEQ ID NO: 424720 - RNA, 64 nt, hsa
uccugggccccugcucuucccgagagcugcccccaaaucagacauaccucuguggcucuccucu

SEQ ID NO: 424721 - RNA, 64 nt, hsa
caggcacuacacagagaggaaguggauuuguuccaaaucagauauacaugucuagauguuacag

SEQ ID NO: 424722 - RNA, 64 nt, hsa
uacgagauacuccagccaaaaaugcacaaaagucaaaucagaauggaaaagacucaaaaccauc

SEQ ID NO: 424723 - RNA, 51 nt, hsa
aucggaagacucauaaaugagaaaucagaaugaugcaaugugagaaacuga

SEQ ID NO: 424724 - RNA, 64 nt, hsa
caagcaggaggcccuaaaauuacacucaugucaaaaaucagagaggagagagaccaaccauauu

SEQ ID NO: 424725 - RNA, 64 nt, hsa
gagcuguauagcuggguucuaagcuucaccaugcaaaucagaaauuuuaucucuaaguacaggc

SEQ ID NO: 424726 - RNA, 64 nt, hsa
uaagagaacucgacuggcuaucaggaagagauggaaaucagaaaaucccaucacuccagcagcu

SEQ ID NO: 424727 - RNA, 64 nt, hsa
aaacuauuucagaaucgcaauuuuaucgaagauuaaaucagacuuuuuugucugguaauuauau

SEQ ID NO: 424728 - RNA, 64 nt, hsa
gaucacgguuucuuuuguuuaucacgccauuugcaaaucagagcaagagcucuuucucaagggc

SEQ ID NO: 424729 - RNA, 64 nt, hsa
acaacuaaauauucacuaauggugccaguggaauaaaucagagaacauccccugcuacguaacu

SEQ ID NO: 424730 - RNA, 64 nt, hsa
auggucucuuuaauggcacccaauacaguauugaaaaucagaucaucaacaguauuucgaagca

SEQ ID NO: 424731 - RNA, 64 nt, hsa
uggaaguaagccuuuauuuauuacuuuuuggaggaaaucagagaagugucaauggaccgucacu

SEQ ID NO: 424732 - RNA, 64 nt, hsa
agcacuuuaaaauucuagaccccaaaaaacuacaaaaucagaaaaaguauuuuuauguuucuag

SEQ ID NO: 424733 - RNA, 64 nt, hsa
acauaagauaauuuauacuggagagaaacucuacaaaucagaaagaugugacuacuuuugacaa

SEQ ID NO: 424734 - RNA, 64 nt, hsa
gaaauauauaagguacugacacuucagauauacuaaaucagagugcuaaguauagaaaaucuga

SEQ ID NO: 424735 - RNA, 64 nt, hsa
auaaaagcauacauuguccacaggugagaagauuaaaucagaauaguuguucuuuguuaaaaaa

SEQ ID NO: 424736 - RNA, 64 nt, hsa
auauguaaggcacugaugcuucagguauuuuacuaaaucagagugcugaguauagaaaauaauc

SEQ ID NO: 424737 - RNA, 64 nt, hsa
auuuucagucauuucuucccuguugaauugaagcaaaucagauuuucuguggggacccucaaau

SEQ ID NO: 424738 - RNA, 64 nt, hsa
gaaaugagaugaggcuguucaguuugucuuaaaaaaaucagauuagguaaaagcuguccuacca

SEQ ID NO: 424739 - RNA, 64 nt, hsa; identical to SEQ ID NO: 261645

SEQ ID NO: 424740 - RNA, 64 nt, hsa; identical to SEQ ID NO: 261646

SEQ ID NO: 424741 - RNA, 64 nt, hsa; identical to SEQ ID NO: 261647

SEQ ID NO: 424742 - RNA, 64 nt, hsa; identical to SEQ ID NO: 261648

SEQ ID NO: 424743 - RNA, 64 nt, hsa; identical to SEQ ID NO: 73390

SEQ ID NO: 424744 - RNA, 64 nt, hsa; identical to SEQ ID NO: 73391

SEQ ID NO: 424745 - RNA, 64 nt, hsa; identical to SEQ ID NO: 73392

SEQ ID NO: 424746 - RNA, 64 nt, hsa; identical to SEQ ID NO: 73393

SEQ ID NO: 424747 - RNA, 64 nt, hsa; identical to SEQ ID NO: 73394

SEQ ID NO: 424748 - RNA, 64 nt, hsa; identical to SEQ ID NO: 73395

SEQ ID NO: 424749 - RNA, 64 nt, hsa; identical to SEQ ID NO: 73396

SEQ ID NO: 424750 - RNA, 64 nt, hsa; identical to SEQ ID NO: 73397

SEQ ID NO: 424751 - RNA, 64 nt, hsa; identical to SEQ ID NO: 73398

SEQ ID NO: 424752 - RNA, 64 nt, hsa; identical to SEQ ID NO: 73399

SEQ ID NO: 424753 - RNA, 64 nt, hsa; identical to SEQ ID NO: 73400

SEQ ID NO: 424754 - RNA, 64 nt, hsa; identical to SEQ ID NO: 73401

SEQ ID NO: 424755 - RNA, 64 nt, hsa; identical to SEQ ID NO: 73402

SEQ ID NO: 424756 - RNA, 64 nt, hsa; identical to SEQ ID NO: 73403

SEQ ID NO: 424757 - RNA, 64 nt, hsa; identical to SEQ ID NO: 73404

SEQ ID NO: 424758 - RNA, 64 nt, hsa; identical to SEQ ID NO: 73405

SEQ ID NO: 424759 - RNA, 64 nt, hsa; identical to SEQ ID NO: 73406

SEQ ID NO: 424760 - RNA, 64 nt, hsa; identical to SEQ ID NO: 73407

SEQ ID NO: 424761 - RNA, 64 nt, hsa; identical to SEQ ID NO: 73408

SEQ ID NO: 424762 - RNA, 64 nt, hsa; identical to SEQ ID NO: 73409

SEQ ID NO: 424763 - RNA, 64 nt, hsa; identical to SEQ ID NO: 360996

SEQ ID NO: 424764 - RNA, 64 nt, hsa; identical to SEQ ID NO: 360997

SEQ ID NO: 424765 - RNA, 64 nt, hsa; identical to SEQ ID NO: 360998

SEQ ID NO: 424766 - RNA, 64 nt, hsa; identical to SEQ ID NO: 360999

SEQ ID NO: 424767 - RNA, 64 nt, hsa; identical to SEQ ID NO: 361000

SEQ ID NO: 424768 - RNA, 64 nt, hsa; identical to SEQ ID NO: 361001

SEQ ID NO: 424769 - RNA, 64 nt, hsa; identical to SEQ ID NO: 361002

SEQ ID NO: 424770 - RNA, 64 nt, hsa; identical to SEQ ID NO: 361003

SEQ ID NO: 424771 - RNA, 64 nt, hsa; identical to SEQ ID NO: 361004

SEQ ID NO: 424772 - RNA, 64 nt, hsa; identical to SEQ ID NO: 361005

SEQ ID NO: 424773 - RNA, 64 nt, hsa; identical to SEQ ID NO: 361006

SEQ ID NO: 424774 - RNA, 64 nt, hsa; identical to SEQ ID NO: 361007

SEQ ID NO: 424775 - RNA, 64 nt, hsa; identical to SEQ ID NO: 361008

SEQ ID NO: 424776 - RNA, 64 nt, hsa; identical to SEQ ID NO: 361009

SEQ ID NO: 424777 - RNA, 64 nt, hsa; identical to SEQ ID NO: 361010

SEQ ID NO: 424778 - RNA, 64 nt, hsa; identical to SEQ ID NO: 361011

SEQ ID NO: 424779 - RNA, 64 nt, hsa; identical to SEQ ID NO: 361012

SEQ ID NO: 424780 - RNA, 64 nt, hsa; identical to SEQ ID NO: 361013

SEQ ID NO: 424781 - RNA, 61 nt, hsa
gacucugcucauguucaggugcagcugaaucuaucgccauggauucauucuuucaauuacu

SEQ ID NO: 424782 - RNA, 61 nt, hsa
ccucucgagugucuuuaccaauugagcuuuuuaucgccauagccccuuggagugccccagc

SEQ ID NO: 424783 - RNA, 61 nt, hsa
uggacacaugacauugaagaccaucccaagcuaucgccacccuuggagaugaugucuuauu

SEQ ID NO: 424784 - RNA, 61 nt, hsa
aaaacugccacaagcacaauugaucucuuuuuaucgccauuccaggggccucagguccuac

SEQ ID NO: 424785 - RNA, 61 nt, hsa
ccacugucuaccuugccagauccucagugcguaucgccaaugcaggaugcuccuuagaaaa

SEQ ID NO: 424786 - RNA, 61 nt, hsa
augcauuuuuugaugauagaacuacaguuuuuaucgccagcugggcaaagaguauauugcu

SEQ ID NO: 424787 - RNA, 61 nt, hsa
uucaccagaaaucuuaauugagcagcagucauaucgccacagcuuugugaguacacagcua

SEQ ID NO: 424788 - RNA, 61 nt, hsa
guccagccacgacauugagcagcacgcccccuaucgccaccugccagccagcaggguggug

SEQ ID NO: 424789 - RNA, 61 nt, hsa
aggagugcuuugagcggguccauggcgaguguaucgccaacuuguccuuugacaucacugg

SEQ ID NO: 424790 - RNA, 61 nt, hsa
cugguauuuuugucuguuuuaucuucuacuguaucgccagugccuggaacagugucuggug

SEQ ID NO: 424791 - RNA, 61 nt, hsa
agcaaacggugucaugguuuggaauguucauuaucgccaagaaccugguuagaggcauaaa

SEQ ID NO: 424792 - RNA, 61 nt, hsa
uaagaaacuuagaacccauggaacccuuguuuaucgccaugcaaauuacaaucuugaauga

SEQ ID NO: 424793 - RNA, 61 nt, hsa
aggagagaaaucaaaaacccauucauaggauuaucgccaccaucaccucuuucaauugcca

SEQ ID NO: 424794 - RNA, 61 nt, hsa
aaaaacuguaaaaaggaaguaguucagcaucuaucgccagccagguuguuucucagccauc

SEQ ID NO: 424795 - RNA, 61 nt, hsa
ugagaugaaaguuggcauacaaauaggauacuaucgccaguaguuauauuacaaacauuau

SEQ ID NO: 424796 - RNA, 61 nt, hsa
ccgagguaggaaaggccagccccagacauccuaucgccacaaugccaugucgcaauaggaa

SEQ ID NO: 424797 - RNA, 61 nt, hsa
uuuuuuuuuuugagacuccggagucucgcucuaucgccaggcuggaguguaguggcaugau

SEQ ID NO: 424798 - RNA, 61 nt, hsa
ucuucagcugaggaguuuugcuuuaguuucuuaucgccauggacugggaauuaacauguau

SEQ ID NO: 424799 - RNA, 61 nt, hsa
ucccccaaucaaaucuaaagguuuuuuaagcuaucgccagccgguguccagcgggcugccc

SEQ ID NO: 424800 - RNA, 61 nt, hsa
agcaggaaagagcgcugcgugagcugccauguaucgccagccguugcuuuguuacugaacg

SEQ ID NO: 424801 - RNA, 61 nt, hsa
ugagacagaauuaauggucauuugggaaaacuaucgccauggcuucccaucugugguuuuc

SEQ ID NO: 424802 - RNA, 61 nt, hsa
ccugggagguggagcuugcagugagccgagauaucgccacugcacuccagccugggugaca

SEQ ID NO: 424803 - RNA, 61 nt, hsa
aucaguguagaaguagaguuaccuaaaccuuuaucgccaaugcacagcuuggccuguuaag

SEQ ID NO: 424804 - RNA, 64 nt, hsa
caggaugugcagggcugccucagaagcuggcuggggacucuagccucuguguucauaaagacau

SEQ ID NO: 424805 - RNA, 64 nt, hsa
agucugaagaacaagcacagauugaugcugaaauggacucuacuccuguuggcuaucaguacgg

SEQ ID NO: 424806 - RNA, 64 nt, hsa
cuaucucaaaacaaucaaaacaaaaaagaccuguggacucuaguagauuuugaauccugccucu

SEQ ID NO: 424807 - RNA, 64 nt, hsa
auucuauuuuuguuuuucuaguccuuucaccccaggacucuaaauuauugggguaaaaaacagc

SEQ ID NO: 424808 - RNA, 64 nt, hsa
cuguggaaagaagggacucaggugagggucuucuggacucuaagacgguaaaggcacuaaaguc

SEQ ID NO: 424809 - RNA, 64 nt, hsa
cauuucccacuuccacccccguuagcuuccugcaggacucuaucccuggcuuccccuucagacc

SEQ ID NO: 424810 - RNA, 62 nt, hsa
auagaaaugauuucuuuucaauaaaaagaaagaaggacucuaccaugucuuuuguuauauac

SEQ ID NO: 424811 - RNA, 64 nt, hsa
accaggagaggggagaagugaaaaaccgugaggaggacucuauuuggauccuggauuuguuguu

SEQ ID NO: 424812 - RNA, 64 nt, hsa
cacuucugccaaggccagggccagcaggacggcaggacucuagggagggguguggccugcagcu

SEQ ID NO: 424813 - RNA, 64 nt, hsa
cccugacuccagugucuuugucaccaggcccuuuggacucuaccucagaaauauuucuuggacc

SEQ ID NO: 424814 - RNA, 64 nt, hsa
aucaugagggugacguagaauugagucuuccaggggacucuaucagaacuggaccaucuccaag

SEQ ID NO: 424815 - RNA, 64 nt, hsa
ugugaguccugauccuaacccugggcucccuggaggacucuagaagcucagguucccugccaca

SEQ ID NO: 424816 - RNA, 64 nt, hsa
aguccagacuauggauguguucucuaggccuucaggacucuagaauguccauauuuauuuuuau

SEQ ID NO: 424817 - RNA, 64 nt, hsa
uagcuagaacauacugaauuuuuuuuguacuguuggacucuauucagugucauguccuauaucu

SEQ ID NO: 424818 - RNA, 64 nt, hsa
uuuguuuuguuuuguuuuguuuuguuuuugagauggacucuagcucugucacccaggcuggagu

SEQ ID NO: 424819 - RNA, 64 nt, hsa
gugaaaugguccuguuuuuggguaggugacacguggacucuaguauguaaauguuacuugaauc

SEQ ID NO: 424820 - RNA, 64 nt, hsa
aauuuucuuccuaauauucuucacauuaaacuauggacucuaauuuucuggauaaaauauccug

SEQ ID NO: 424821 - RNA, 64 nt, hsa
aauaggagcacauuuaguugagguauacaagguaggacucuagacaaaaccuucuauuuuagcu

SEQ ID NO: 424822 - RNA, 64 nt, hsa
acagacagucaggcugaaauggacaguucuuuguggacucuacccuucccuucaaggaguaugu

SEQ ID NO: 424823 - RNA, 64 nt, hsa
ugaacacagaugacuacauuuuccaaaacuuaguggacucuaugugauguacuaaauguauaca

SEQ ID NO: 424824 - RNA, 64 nt, hsa
guuauguggcacggcaaagcaaguaccucuuaagggacucuaauauaugcuaacgcugguccuc

SEQ ID NO: 424825 - RNA, 64 nt, hsa
auugacauauagaacuuuacaaacauauguccaaggacucuaaauugagacucuuccacaugua

SEQ ID NO: 424826 - RNA, 64 nt, hsa
uggacaguugggaaaacaccugaccaccauuuaaggacucuaagccagaauggaaaauucacca

SEQ ID NO: 424827 - RNA, 64 nt, hsa
gaggaauuuggggccuaggaaccgagggcacacgggacucuagccucauccccaggacccccuu

SEQ ID NO: 424828 - RNA, 50 nt, hsa
gaccacaggcaaggccuugaggacucuacccacggcuaaggucuucauuu

SEQ ID NO: 424829 - RNA, 64 nt, hsa
uucuguccaguaaacgcaggauggaauuuuccugggacucuacacccaucuuaaggugguauac

SEQ ID NO: 424830 - RNA, 64 nt, hsa
guuaauagguuuccaugagacaccaaagaaaagaggacucuauacuggguggagcagggucuuc

SEQ ID NO: 424831 - RNA, 64 nt, hsa
aacaggaggggagaggaaacaaaugugaaguuguggacucuacccaggcagguggaugaaaaug

SEQ ID NO: 424832 - RNA, 64 nt, hsa
cacucucggccucucaauucuucaggcucagucuggacucuacuuacacucauuuuuaucuugg

SEQ ID NO: 424833 - RNA, 64 nt, hsa
auggacuguaggcagccugccagugaaggucacuggacucuagccuacaacaugcugagcuaca

SEQ ID NO: 424834 - RNA, 64 nt, hsa
uaaagauaaugaaagaaaacauaagagaacuauuggacucuaauugcuuugaacuaguuuugca

SEQ ID NO: 424835 - RNA, 64 nt, hsa
uuuucucuuguuucuguuggaaacacugaagcagggacucuaaaaugaaagcaucucacauugg

SEQ ID NO: 424836 - RNA, 64 nt, hsa
uucucuucuguauuguaacuuagaugauucccaaggacucuaauaaaaaaucacuucauuguau

SEQ ID NO: 424837 - RNA, 64 nt, hsa
cuccuaaacuccccaacccaccucucuucccuccggacucuaaacaggaacuugaauacuggga

SEQ ID NO: 424838 - RNA, 64 nt, hsa
accuuucuuauccuccuccuagaguuuugacuugggacucuaguguuaagaugaugagcccgug

SEQ ID NO: 424839 - RNA, 64 nt, hsa
gaucuggcgcacagggauguuuuguuuagcuugcggacucuaacacuuaaaaaaaaacccagau

SEQ ID NO: 424840 - RNA, 64 nt, hsa
guuuggcacaaaguguuguccuccagguccaaguggacucuacagagugcuugaccucaacaca

SEQ ID NO: 424841 - RNA, 64 nt, hsa
ucuugaauaguacauuuucacuucuguauucgagggacucuaaaaauaaauauugcuccagaaa

SEQ ID NO: 424842 - RNA, 56 nt, hsa
cagaccuccauacuuuauaaguuguuggacucuaguaccaagaaacaacaacaaac

SEQ ID NO: 424843 - RNA, 64 nt, hsa
ucccaagagaaugaaauugcugaaagaucuuucaggacucuaccucauaucaguuugcuagcag

SEQ ID NO: 424844 - RNA, 64 nt, hsa
uauauauuauguaaaauguuaacuaucaucauauggacucuauguaacacaaauucaaaagcaa

SEQ ID NO: 424845 - RNA, 64 nt, hsa
ggaacaauagagauuauaucauaacucugaagauggacucuaaacuuugguuuaccuccaugga

SEQ ID NO: 424846 - RNA, 64 nt, hsa
ugucuaaaggaugccuggauuccuuguuaucucaggacucuaaauacucuaacagcuguccagu

SEQ ID NO: 424847 - RNA, 64 nt, hsa
cuacuaacuuggcuuacguugacuggcuacuaagggacucuaggagucagaaacuaaaugcuga

SEQ ID NO: 424848 - RNA, 64 nt, hsa
uguuuacugaaagaaaaagaccuaugagcacauaggacucuagacggcauccagccggaggcca

SEQ ID NO: 424849 - RNA, 64 nt, hsa
agccaucaaacacauaaacaucaagauauuugaaggacucuaauugucuuuccuugacaaguug

SEQ ID NO: 424850 - RNA, 64 nt, hsa
uguaauaaccaaaugcaaugugaaauauuuuacuggacucuauuuugaaaaaccaucuguaaaa

SEQ ID NO: 424851 - RNA, 64 nt, hsa; identical to SEQ ID NO: 424850

SEQ ID NO: 424852 - RNA, 55 nt, hsa
cugagccuuccccaccguaaacuauggacucuaguucaguuuuauaugcaaugga

SEQ ID NO: 424853 - RNA, 64 nt, hsa
agaauuucucaggcuuucccuuuuuaaaaguauuggacucuacaaauagguucuauauuuggga

SEQ ID NO: 424854 - RNA, 64 nt, hsa
ccagagguagccucugcaaauggcauaccagaugggacucuaagaugcuugugugguggcuucu

SEQ ID NO: 424855 - RNA, 64 nt, hsa
aaggggguccauuuacaucaaacagcugaucagaggacucuaucuaaauugugaucguggcaga

SEQ ID NO: 424856 - RNA, 64 nt, hsa
cccacauacacauuuuuguguuacagucauugauggacucuauuuuuuuauuauuacuuggacc

SEQ ID NO: 424857 - RNA, 64 nt, hsa
ccacuacauugugagcuuucccuuggaaggcucuggacucuauccaagcuuaugauaauucaca

SEQ ID NO: 424858 - RNA, 64 nt, hsa
ccccccaccacucugccuggccuccugcugaugaggacucuaaguucccaggauacaaaagggg

SEQ ID NO: 424859 - RNA, 64 nt, hsa
auacguguuaggaggcugcaugcucuggaagccuggacucuaagcuggagcucuuggaagagcu

SEQ ID NO: 424860 - RNA, 64 nt, hsa
uuccucucugcccagaugguagguugauauuucuggacucuagccaagaaaaagcuaauucugg

SEQ ID NO: 424861 - RNA, 64 nt, hsa
aggagaauuuuuucuuaaagaagcugcauauucuggacucuaauuuaguuuaauucacuccagg

SEQ ID NO: 424862 - RNA, 64 nt, hsa
aggucccuggaccccagaaacccaggguagacauggacucuacucuccuucucugguucucagc

SEQ ID NO: 424863 - RNA, 64 nt, hsa
uuuuaccaaguauuuuguaaaugcuaauuuuuuaggacucuacuaguuggcauacgaaaauaua

SEQ ID NO: 424864 - RNA, 64 nt, hsa
aaauggagcccugaggcaucagcuauuauacuugggacucuaccucucacucacuauaugcuaa

SEQ ID NO: 424865 - RNA, 64 nt, hsa
aaagggaaagagaaagugagaagaaacugaagauggacucuauuaugugaaguaguaauguuca

SEQ ID NO: 424866 - RNA, 64 nt, hsa
uucccuguugccaguuagagaggugagaauguuuggacucuaacucaccgauugcuuugcagac

SEQ ID NO: 424867 - RNA, 64 nt, hsa
augaaugucaugaacccgaaaaaagcuucagucuggacucuacuauugaugcagaucagagagu

SEQ ID NO: 424868 - RNA, 64 nt, hsa
aggaccuuaggggcagauccguuuucucacuguuggacucuaccucacuggucuggaaguccuc

SEQ ID NO: 424869 - RNA, 64 nt, hsa
cucccaacuacuguuacugguuauagaggucuuuggacucuaaagaccaauguuuggccacuaa

SEQ ID NO: 424870 - RNA, 64 nt, hsa
uuccacccuuuggacgccucauccaggacgcagaggacucuagguuuaacauuuuguacaaaau

SEQ ID NO: 424871 - RNA, 59 nt, hsa
gcaaugacaugaugagcugacaccuccuuggacucuaccuguacagagcagcgucccuu

SEQ ID NO: 424872 - RNA, 64 nt, hsa
uugugcugggagugggucugacuuagugauaaaaggacucuauucacuaaguagccuguguuuu

SEQ ID NO: 424873 - RNA, 64 nt, hsa
acacuuaaaugaaagauuggcaagaaaagcagucggacucuaccuuaaggagggaugggaagga

SEQ ID NO: 424874 - RNA, 64 nt, hsa
uuugauuuuuggugguggauaaauaauacuaaaaggacucuaguggaaaggggggauaucgaag

SEQ ID NO: 424875 - RNA, 64 nt, hsa
gauuaagcuuugucagguuaauguagcauguuaaggacucuagaaaaaaauaaacuaaggagac

SEQ ID NO: 424876 - RNA, 64 nt, hsa
ucgggaagaugguaugaaguccucuuuggggcagggacucuaguagaucuucuugucagagaag

SEQ ID NO: 424877 - RNA, 64 nt, hsa
cagucucccccaucuguuacacuagagggcugcaggacucuauccaccgcccccggguuaucau

SEQ ID NO: 424878 - RNA, 64 nt, hsa
agagggcugcuuuaucauauuguacuuggguguaggacucuaguguucuuggguguauugcaug

SEQ ID NO: 424879 - RNA, 64 nt, hsa
guccacccugacaccacaggccgggggagaguagggacucuaccccccucuccccuuguaggug

SEQ ID NO: 424880 - RNA, 64 nt, hsa
cucaaggacaaaaugaggaagauguguucauuguggacucuaaaaacaaaacaaaacacaaaau

SEQ ID NO: 424881 - RNA, 64 nt, hsa
uccuugaccaagggggacagucaguuuugcaaaaggacucuaauaccuguuuaauauugucuuc

SEQ ID NO: 424882 - RNA, 64 nt, hsa
agucaagcucuaggcgguaugggaauggcuaccgggacucuaauggggugaaagagaggggagg

SEQ ID NO: 424883 - RNA, 64 nt, hsa
gggaggggcuucucuggggcaauugauaaaggaaggacucuagugacaucauagaacauggcag

SEQ ID NO: 424884 - RNA, 64 nt, hsa
uaaugucaauaguuuauuacaaguuguguaaaauggacucuaguuuaauaaugggggaaaaaag

SEQ ID NO: 424885 - RNA, 64 nt, hsa
caaagauacacaaucugaaacagcuucaugggguggacucuaacaguaguugcaauguuuuaga

SEQ ID NO: 424886 - RNA, 64 nt, hsa
uaugguauggcaaguuaccaaacacagugagccgggacucuaaaaaaaaauuguaauucaugau

SEQ ID NO: 424887 - RNA, 64 nt, hsa
cuggcgggggauggguggacuguaugauuuccaaggacucuaccagucagugguucugauguca

SEQ ID NO: 424888 - RNA, 64 nt, hsa
gaccugaaugaccugcagucagggcccagaguugggacucuauacuacccugggcucuggucug

SEQ ID NO: 424889 - RNA, 64 nt, hsa
aaagaaaccuauuccugcccuggggaccacccugggacucuaaccaagccuuccuggagggacc

SEQ ID NO: 424890 - RNA, 64 nt, hsa
aguccuccccaccucaacugucaccacugcuaagggacucuauccauugagcacauuuuccuaa

SEQ ID NO: 424891 - RNA, 64 nt, hsa
acauuuacaucccaaaacuuugguugaguuugcaggacucuaggcaugcaugaaagagcccccc

SEQ ID NO: 424892 - RNA, 64 nt, hsa
cauaaaagcaggcccagcgaggucaauuugucggggacucuaggaggguggccuggguggagac

SEQ ID NO: 424893 - RNA, 64 nt, hsa
ggcaaucaucuagaucucacagaucuucaacauaggacucuagguuaugagagcugaaccacau

SEQ ID NO: 424894 - RNA, 64 nt, hsa
ccaauguacuguggucucuugggacuugggacagggacucuagcagcaccucuguauccuuucu

SEQ ID NO: 424895 - RNA, 64 nt, hsa
ucuccuaaguuauuuauaaagagaaaucacuaauggacucuacugguuugagugcuucugagcu

SEQ ID NO: 424896 - RNA, 64 nt, hsa
augaaaccuccuguccgaguuguggaagguccuuggacucuagcagcccucuacccggcucuac

SEQ ID NO: 424897 - RNA, 64 nt, hsa
gagucuuucagcugaaaacuuuugccaugaagcaggacucuaaagaaggaaugagugcaauuuc

SEQ ID NO: 424898 - RNA, 64 nt, hsa
uuguucucaaaaccugggugagaagacuauuccuggacucuagcaacuucaaaacugaggcugg

SEQ ID NO: 424899 - RNA, 64 nt, hsa
uccaagccagccuugaacccaccucccugucccuggacucuacucccgaggcucuguacauugc

SEQ ID NO: 424900 - RNA, 64 nt, hsa
ucacuguagcugcuggcagcccugugccauaucuggacucuaguugucaguaucugaguuggac

SEQ ID NO: 424901 - RNA, 64 nt, hsa
acauuucucgggaaaucugaaaugaugcuggaugggacucuacacauccugagcuaagacauac

SEQ ID NO: 424902 - RNA, 64 nt, hsa
uuuuuuggccacugcccuggacuagugaaagaauggacucuaucuuuaucugcaagaggaacua

SEQ ID NO: 424903 - RNA, 64 nt, hsa
ccuuccgucucugacauuuugagaucuuuggaaaggacucuaucucauccuccccucgacaagc

SEQ ID NO: 424904 - RNA, 64 nt, hsa
ccaggagagagggcaaagggaugagccuggguuuggacucuaaaaucucagcacugccccaugg

SEQ ID NO: 424905 - RNA, 64 nt, hsa
aagaaaccaucaugagagagauacucugguggagggacucuagcuaccaugcacauguacauau

SEQ ID NO: 424906 - RNA, 64 nt, hsa
ggggaucacuuuccaagugccaaagagcccagagggacucuaagaaccuaagguggaaacacug

SEQ ID NO: 424907 - RNA, 64 nt, hsa
uuaaucaucuauaaagaagaacuugcauggagcaggacucuauuuuaaggacugcgggacuugg

SEQ ID NO: 424908 - RNA, 64 nt, hsa
uucccaaauguguaccuggaccccucgaaacagaggacucuacgaaaugacaagcugccccugc

SEQ ID NO: 424909 - RNA, 64 nt, hsa
aguuucugucguuaaaaacagauuuggaaagacuggacucuaaagucuguugauuaaagaugag

SEQ ID NO: 424910 - RNA, 64 nt, hsa
acuaauagaaaaguauguucuaaccuuuacaugaggacucuauucuuuaacucccauuaccaug

SEQ ID NO: 424911 - RNA, 64 nt, hsa
ggccucacgggaccgucagcaugggcuuugucuuggacucuaguccuuggcuggacuguagaag

SEQ ID NO: 424912 - RNA, 64 nt, hsa
gccucucccacuccuccuaccaccgaagugguuaggacucuauauaaauaaaaacaaggcuuuu

SEQ ID NO: 424913 - RNA, 64 nt, hsa
acucuggacacauaguccagcuuucuaaaauccaggacucuauccugggccuacuaaacuucug

SEQ ID NO: 424914 - RNA, 64 nt, hsa
cucuccuugccugacaggggagccccuguggccuggacucuaggggaugccgccaccagaaacc

SEQ ID NO: 424915 - RNA, 64 nt, hsa
cagauuggagagggcucugugcugacauggcucuggacucuaaagaccaaacuucacucugggc

SEQ ID NO: 424916 - RNA, 64 nt, hsa
cagguauaugaguagaccagugaugaguggcccaggacucuaugacccuacaaccaucaugaau

SEQ ID NO: 424917 - RNA, 64 nt, hsa
uccacaucugucugcacauaggaaggaaaagauaggacucuaaaccuagucaucuuggaauaaa

SEQ ID NO: 424918 - RNA, 64 nt, hsa
ccacacacaaauaaauaucugcggcuuagugauaggacucuaccuuuucuccuagaagcaguua

SEQ ID NO: 424919 - RNA, 64 nt, hsa
uuacuuuaauuugcauauauucuccaguuacaucggacucuaucuguggccuuguucuucauuu

SEQ ID NO: 424920 - RNA, 64 nt, hsa
auccugcaggcccugaggaccgcgcugaagcaccggacucuagaggcgaggccuccaagggcac

SEQ ID NO: 424921 - RNA, 64 nt, hsa
uugcuggucccccuucccuaguggguuuucccggggacucuauaggcagcugcuccugcccgca

SEQ ID NO: 424922 - RNA, 64 nt, hsa
uggggcuggggcagggggugucagcugcacagcgggacucuagggagaugggcgagcgagcguc

SEQ ID NO: 424923 - RNA, 64 nt, hsa
aagacuauugggaguauuugcuggccagagaaugggacucuaucagcuuuacacaugucccacc

SEQ ID NO: 424924 - RNA, 64 nt, hsa
agggauugucacgggaggaacaugacacccgaagggacucuaggugcccucggagugccacaca

SEQ ID NO: 424925 - RNA, 64 nt, hsa
cuggcuuucccgaaucuuuuuaggccaccuccaaggacucuaaaagggggcuauucccuggaga

SEQ ID NO: 424926 - RNA, 64 nt, hsa
ccugggggggccgcucucccccugcagccgugcaggacucuagcucaugaguggaaagucaccu

SEQ ID NO: 424927 - RNA, 64 nt, hsa
gacucagagggaggaaucgaggaaccagagccauggacucuacacugugaacuuggggaacaag

SEQ ID NO: 424928 - RNA, 64 nt, hsa
uguggcucugcaugacaaacacacauccagcccaggacucuaagccucucaccuggacuccagu

SEQ ID NO: 424929 - RNA, 64 nt, hsa
uaccugagccaagaauggaagcuugugaggagacggacucuauguugcccaggcuguuauggaa

SEQ ID NO: 424930 - RNA, 64 nt, hsa
cuccucagccacaucaagucuccuagaccacuguggacucuaaacugcacuugucucucucauu

SEQ ID NO: 424931 - RNA, 64 nt, hsa
cccguggcccaggucugugccuuccccaugccaaggacucuaggucaaaugucaauaaauauga

SEQ ID NO: 424932 - RNA, 64 nt, hsa
ugcuguggaaugacaagcuucaaggauuuacccaggacucuauuuauacaacccugacugacag

SEQ ID NO: 424933 - RNA, 64 nt, hsa
gcuugggcauccccaaugaacucugcccugccugggacucuauuuauucugauuaaagggguuu

SEQ ID NO: 424934 - RNA, 64 nt, hsa
guaugaaugaagagaacgcuggaaggcugcgagaggacucuaguaugagucuccaacauuugga

SEQ ID NO: 424935 - RNA, 64 nt, hsa
cuaaugugguccaaaugcggaucacuggucagauggacucuagaagcacugagcucccugucuc

SEQ ID NO: 424936 - RNA, 64 nt, hsa
gacaccauccugaaugagggguccagccugggggggacucuaccaaggucuucuugggcuggga

SEQ ID NO: 424937 - RNA, 64 nt, hsa
cacgccccugcugcgggaccuguacacccugaguggacucuaucccucccccuuccaccgggac

SEQ ID NO: 424938 - RNA, 64 nt, hsa
uguugagacuaaaaaauggcagucgcuaaaguagggacucuagagucuggcuuacgucaguguu

SEQ ID NO: 424939 - RNA, 64 nt, hsa
ggaaacuauaaauugaaauuaugugcugaaggaaggacucuaaacauaugacuuaagaaaauuc

SEQ ID NO: 424940 - RNA, 64 nt, hsa
cauccacucacacucccagccaccauguuacacuggacucuaagccacuucuuacuccaguagu

SEQ ID NO: 424941 - RNA, 64 nt, hsa
guguacaaaguguugcagggcugugacacaauagggacucuauggaaaacuggcagccauuggg

SEQ ID NO: 424942 - RNA, 64 nt, hsa
gccccucagccaugggcccuacaguccccucaggggacucuaaccugggggccugaggugccag

SEQ ID NO: 424943 - RNA, 64 nt, hsa
ccauccccugcucaggaagagauaccggaauuuuggacucuacuggcuggguuccuucgccaug

SEQ ID NO: 424944 - RNA, 64 nt, hsa
ugaguaugguaguccccuauuuucugcaagagauggacucuaagacccccaguggauaccuaaa

SEQ ID NO: 424945 - RNA, 64 nt, hsa
gaucuccaacacgcugggccccucccuggggcggggacucuaccuuccagauucagucccuagu

SEQ ID NO: 424946 - RNA, 64 nt, hsa
cccugacucccaccccaagcccccggccaagccuggacucuagccccugaccccagacucccga

SEQ ID NO: 424947 - RNA, 64 nt, hsa
ucagugauagcugccuucagccagcaucuuugggggacucuauaauagcagcuugagaucagug

SEQ ID NO: 424948 - RNA, 64 nt, hsa
acugagccacccucuccguaggguucuuucucgaggacucuacccuccucccccacguccuguc

SEQ ID NO: 424949 - RNA, 64 nt, hsa
uggccugcaaaggaaccaacagacccuaugcuggggacucuaacaugugagcucauuaaauucu

SEQ ID NO: 424950 - RNA, 64 nt, hsa
auuugugugugucuguuucaguauauuuggauugggacucuaagcagauaauaccuaugcuuaa

SEQ ID NO: 424951 - RNA, 64 nt, hsa
ccgccccuugugcucgccucauaggugucuauuuggacucuaagcucuacgggugacagaucuu

SEQ ID NO: 424952 - RNA, 64 nt, hsa
gccuaagacgggggcugcuucuccucuucaguauggacucuagaaagucuggcuacaugaauag

SEQ ID NO: 424953 - RNA, 64 nt, hsa
accgagugucugcagcuggggacacaacugcccgggacucuaacuuccaggaauuaaagacuca

SEQ ID NO: 424954 - RNA, 64 nt, hsa
caggagccaaggagggagaacagggcagccugugggacucuaggaugcuucagaagaagcgacg

SEQ ID NO: 424955 - RNA, 64 nt, hsa
acaaaaucauucuuugcaacucaaaauucagaagggacucuaccauaucuuagcucagagcaca

SEQ ID NO: 424956 - RNA, 64 nt, hsa
caacucgccagccuccugagcuccaugcccaucaggacucuagccucugaccuugcuguugacu

SEQ ID NO: 424957 - RNA, 64 nt, hsa
gaaugaauauuaaagucugagaaauuuacaaaagggacucuauggacucgauuuuaccauaugg

SEQ ID NO: 424958 - RNA, 64 nt, hsa
auucauguuauuaacgaugauugaccuuaaauagggacucuauugcuaaccauucugugcccuu

SEQ ID NO: 424959 - RNA, 64 nt, hsa
ucugugcucaguuucaguucacuccugccaaguuggacucuaaguuauucuucauguagucugc

SEQ ID NO: 424960 - RNA, 64 nt, hsa
acuuugagcacuaccagaagaaaaggaaaccucgggacucuauucauccacccagccuuuucau

SEQ ID NO: 424961 - RNA, 64 nt, hsa
gagaaguuguaauauuaauuggccucuuugggugggacucuaagcaguauuugcagaaauaugc

SEQ ID NO: 424962 - RNA, 64 nt, hsa
gggcgagucucagugccacuugguccccagccauggacucuauacagugagggccacucaccga

SEQ ID NO: 424963 - RNA, 64 nt, hsa; identical to SEQ ID NO: 48048

SEQ ID NO: 424964 - RNA, 64 nt, hsa; identical to SEQ ID NO: 48049

SEQ ID NO: 424965 - RNA, 64 nt, hsa; identical to SEQ ID NO: 48050

SEQ ID NO: 424966 - RNA, 64 nt, hsa; identical to SEQ ID NO: 48051

SEQ ID NO: 424967 - RNA, 64 nt, hsa; identical to SEQ ID NO: 48052

SEQ ID NO: 424968 - RNA, 64 nt, hsa; identical to SEQ ID NO: 48053

SEQ ID NO: 424969 - RNA, 64 nt, hsa; identical to SEQ ID NO: 48054

SEQ ID NO: 424970 - RNA, 64 nt, hsa; identical to SEQ ID NO: 48055

SEQ ID NO: 424971 - RNA, 64 nt, hsa; identical to SEQ ID NO: 48056

SEQ ID NO: 424972 - RNA, 64 nt, hsa; identical to SEQ ID NO: 48057

SEQ ID NO: 424973 - RNA, 64 nt, hsa; identical to SEQ ID NO: 48058

SEQ ID NO: 424974 - RNA, 64 nt, hsa; identical to SEQ ID NO: 48059

SEQ ID NO: 424975 - RNA, 64 nt, hsa; identical to SEQ ID NO: 48060

SEQ ID NO: 424976 - RNA, 64 nt, hsa; identical to SEQ ID NO: 48061

SEQ ID NO: 424977 - RNA, 64 nt, hsa; identical to SEQ ID NO: 48062

SEQ ID NO: 424978 - RNA, 64 nt, hsa; identical to SEQ ID NO: 48063

SEQ ID NO: 424979 - RNA, 64 nt, hsa; identical to SEQ ID NO: 48064

SEQ ID NO: 424980 - RNA, 64 nt, hsa; identical to SEQ ID NO: 48065

SEQ ID NO: 424981 - RNA, 64 nt, hsa; identical to SEQ ID NO: 48066

SEQ ID NO: 424982 - RNA, 64 nt, hsa; identical to SEQ ID NO: 48067

SEQ ID NO: 424983 - RNA, 64 nt, hsa; identical to SEQ ID NO: 48068

SEQ ID NO: 424984 - RNA, 64 nt, hsa; identical to SEQ ID NO: 48069

SEQ ID NO: 424985 - RNA, 64 nt, hsa; identical to SEQ ID NO: 48070

SEQ ID NO: 424986 - RNA, 64 nt, hsa; identical to SEQ ID NO: 48071

SEQ ID NO: 424987 - RNA, 64 nt, hsa; identical to SEQ ID NO: 48072

SEQ ID NO: 424988 - RNA, 64 nt, hsa; identical to SEQ ID NO: 48073

SEQ ID NO: 424989 - RNA, 64 nt, hsa; identical to SEQ ID NO: 48074

SEQ ID NO: 424990 - RNA, 64 nt, hsa; identical to SEQ ID NO: 48075

SEQ ID NO: 424991 - RNA, 64 nt, hsa; identical to SEQ ID NO: 48076

SEQ ID NO: 424992 - RNA, 64 nt, hsa; identical to SEQ ID NO: 48077

SEQ ID NO: 424993 - RNA, 64 nt, hsa; identical to SEQ ID NO: 48078

SEQ ID NO: 424994 - RNA, 64 nt, hsa; identical to SEQ ID NO: 48079

SEQ ID NO: 424995 - RNA, 64 nt, hsa; identical to SEQ ID NO: 48080

SEQ ID NO: 424996 - RNA, 64 nt, hsa; identical to SEQ ID NO: 48081

SEQ ID NO: 424997 - RNA, 64 nt, hsa; identical to SEQ ID NO: 48082

SEQ ID NO: 424998 - RNA, 64 nt, hsa; identical to SEQ ID NO: 48083

SEQ ID NO: 424999 - RNA, 64 nt, hsa; identical to SEQ ID NO: 48084

SEQ ID NO: 425000 - RNA, 64 nt, hsa; identical to SEQ ID NO: 48085

SEQ ID NO: 425001 - RNA, 64 nt, hsa; identical to SEQ ID NO: 48086

SEQ ID NO: 425002 - RNA, 64 nt, hsa; identical to SEQ ID NO: 48087

SEQ ID NO: 425003 - RNA, 64 nt, hsa; identical to SEQ ID NO: 48088

SEQ ID NO: 425004 - RNA, 64 nt, hsa; identical to SEQ ID NO: 48089

SEQ ID NO: 425005 - RNA, 64 nt, hsa; identical to SEQ ID NO: 48090

SEQ ID NO: 425006 - RNA, 64 nt, hsa; identical to SEQ ID NO: 48091

SEQ ID NO: 425007 - RNA, 64 nt, hsa; identical to SEQ ID NO: 48092

SEQ ID NO: 425008 - RNA, 64 nt, hsa; identical to SEQ ID NO: 48093

SEQ ID NO: 425009 - RNA, 64 nt, hsa; identical to SEQ ID NO: 48094

SEQ ID NO: 425010 - RNA, 64 nt, hsa; identical to SEQ ID NO: 48095

SEQ ID NO: 425011 - RNA, 64 nt, hsa; identical to SEQ ID NO: 48096

SEQ ID NO: 425012 - RNA, 64 nt, hsa; identical to SEQ ID NO: 48097

SEQ ID NO: 425013 - RNA, 64 nt, hsa; identical to SEQ ID NO: 48098

SEQ ID NO: 425014 - RNA, 64 nt, hsa; identical to SEQ ID NO: 48099

SEQ ID NO: 425015 - RNA, 64 nt, hsa; identical to SEQ ID NO: 48100

SEQ ID NO: 425016 - RNA, 64 nt, hsa; identical to SEQ ID NO: 48101

SEQ ID NO: 425017 - RNA, 64 nt, hsa; identical to SEQ ID NO: 48102

SEQ ID NO: 425018 - RNA, 64 nt, hsa; identical to SEQ ID NO: 48103

SEQ ID NO: 425019 - RNA, 64 nt, hsa; identical to SEQ ID NO: 48104

SEQ ID NO: 425020 - RNA, 64 nt, hsa; identical to SEQ ID NO: 48105

SEQ ID NO: 425021 - RNA, 64 nt, hsa; identical to SEQ ID NO: 48106

SEQ ID NO: 425022 - RNA, 64 nt, hsa; identical to SEQ ID NO: 48107

SEQ ID NO: 425023 - RNA, 64 nt, hsa; identical to SEQ ID NO: 48108

SEQ ID NO: 425024 - RNA, 64 nt, hsa; identical to SEQ ID NO: 48109

SEQ ID NO: 425025 - RNA, 64 nt, hsa; identical to SEQ ID NO: 48110

SEQ ID NO: 425026 - RNA, 64 nt, hsa; identical to SEQ ID NO: 48111

SEQ ID NO: 425027 - RNA, 64 nt, hsa; identical to SEQ ID NO: 48112

SEQ ID NO: 425028 - RNA, 64 nt, hsa; identical to SEQ ID NO: 48113

SEQ ID NO: 425029 - RNA, 64 nt, hsa; identical to SEQ ID NO: 48114

SEQ ID NO: 425030 - RNA, 64 nt, hsa; identical to SEQ ID NO: 48115

SEQ ID NO: 425031 - RNA, 64 nt, hsa; identical to SEQ ID NO: 48116

SEQ ID NO: 425032 - RNA, 64 nt, hsa; identical to SEQ ID NO: 48117

SEQ ID NO: 425033 - RNA, 64 nt, hsa; identical to SEQ ID NO: 48118

SEQ ID NO: 425034 - RNA, 64 nt, hsa; identical to SEQ ID NO: 48119

SEQ ID NO: 425035 - RNA, 64 nt, hsa; identical to SEQ ID NO: 48120

SEQ ID NO: 425036 - RNA, 64 nt, hsa; identical to SEQ ID NO: 48121

SEQ ID NO: 425037 - RNA, 64 nt, hsa; identical to SEQ ID NO: 48122

SEQ ID NO: 425038 - RNA, 64 nt, hsa; identical to SEQ ID NO: 48123

SEQ ID NO: 425039 - RNA, 64 nt, hsa; identical to SEQ ID NO: 48124

SEQ ID NO: 425040 - RNA, 64 nt, hsa; identical to SEQ ID NO: 48125

SEQ ID NO: 425041 - RNA, 64 nt, hsa; identical to SEQ ID NO: 48126

SEQ ID NO: 425042 - RNA, 64 nt, hsa; identical to SEQ ID NO: 48127

SEQ ID NO: 425043 - RNA, 64 nt, hsa; identical to SEQ ID NO: 48128

SEQ ID NO: 425044 - RNA, 64 nt, hsa; identical to SEQ ID NO: 48129

SEQ ID NO: 425045 - RNA, 64 nt, hsa; identical to SEQ ID NO: 48130

SEQ ID NO: 425046 - RNA, 64 nt, hsa; identical to SEQ ID NO: 48131

SEQ ID NO: 425047 - RNA, 59 nt, hsa; identical to SEQ ID NO: 48132

SEQ ID NO: 425048 - RNA, 64 nt, hsa; identical to SEQ ID NO: 48133

SEQ ID NO: 425049 - RNA, 64 nt, hsa; identical to SEQ ID NO: 48134

SEQ ID NO: 425050 - RNA, 64 nt, hsa; identical to SEQ ID NO: 48135

SEQ ID NO: 425051 - RNA, 64 nt, hsa; identical to SEQ ID NO: 48136

SEQ ID NO: 425052 - RNA, 64 nt, hsa; identical to SEQ ID NO: 48137

SEQ ID NO: 425053 - RNA, 64 nt, hsa; identical to SEQ ID NO: 48138

SEQ ID NO: 425054 - RNA, 64 nt, hsa; identical to SEQ ID NO: 48139

SEQ ID NO: 425055 - RNA, 64 nt, hsa; identical to SEQ ID NO: 48140

SEQ ID NO: 425056 - RNA, 64 nt, hsa; identical to SEQ ID NO: 48141

SEQ ID NO: 425057 - RNA, 64 nt, hsa; identical to SEQ ID NO: 48142

SEQ ID NO: 425058 - RNA, 64 nt, hsa; identical to SEQ ID NO: 48143

SEQ ID NO: 425059 - RNA, 64 nt, hsa; identical to SEQ ID NO: 48144

SEQ ID NO: 425060 - RNA, 64 nt, hsa; identical to SEQ ID NO: 48145

SEQ ID NO: 425061 - RNA, 64 nt, hsa; identical to SEQ ID NO: 48146

SEQ ID NO: 425062 - RNA, 64 nt, hsa; identical to SEQ ID NO: 48147

SEQ ID NO: 425063 - RNA, 64 nt, hsa; identical to SEQ ID NO: 48148

SEQ ID NO: 425064 - RNA, 64 nt, hsa; identical to SEQ ID NO: 48149

SEQ ID NO: 425065 - RNA, 64 nt, hsa; identical to SEQ ID NO: 48150

SEQ ID NO: 425066 - RNA, 64 nt, hsa; identical to SEQ ID NO: 48151

SEQ ID NO: 425067 - RNA, 64 nt, hsa; identical to SEQ ID NO: 48152

SEQ ID NO: 425068 - RNA, 64 nt, hsa; identical to SEQ ID NO: 48153

SEQ ID NO: 425069 - RNA, 64 nt, hsa; identical to SEQ ID NO: 48154

SEQ ID NO: 425070 - RNA, 64 nt, hsa; identical to SEQ ID NO: 48155

SEQ ID NO: 425071 - RNA, 64 nt, hsa; identical to SEQ ID NO: 48156

SEQ ID NO: 425072 - RNA, 64 nt, hsa; identical to SEQ ID NO: 48157

SEQ ID NO: 425073 - RNA, 64 nt, hsa; identical to SEQ ID NO: 48158

SEQ ID NO: 425074 - RNA, 64 nt, hsa; identical to SEQ ID NO: 48159

SEQ ID NO: 425075 - RNA, 64 nt, hsa; identical to SEQ ID NO: 48160

SEQ ID NO: 425076 - RNA, 64 nt, hsa; identical to SEQ ID NO: 48161

SEQ ID NO: 425077 - RNA, 64 nt, hsa; identical to SEQ ID NO: 48162

SEQ ID NO: 425078 - RNA, 64 nt, hsa; identical to SEQ ID NO: 48163

SEQ ID NO: 425079 - RNA, 64 nt, hsa; identical to SEQ ID NO: 48164

SEQ ID NO: 425080 - RNA, 64 nt, hsa; identical to SEQ ID NO: 48165

SEQ ID NO: 425081 - RNA, 64 nt, hsa; identical to SEQ ID NO: 48166

SEQ ID NO: 425082 - RNA, 64 nt, hsa; identical to SEQ ID NO: 48167

SEQ ID NO: 425083 - RNA, 64 nt, hsa; identical to SEQ ID NO: 48168

SEQ ID NO: 425084 - RNA, 64 nt, hsa; identical to SEQ ID NO: 48169

SEQ ID NO: 425085 - RNA, 64 nt, hsa; identical to SEQ ID NO: 48170

SEQ ID NO: 425086 - RNA, 64 nt, hsa; identical to SEQ ID NO: 48171

SEQ ID NO: 425087 - RNA, 64 nt, hsa; identical to SEQ ID NO: 48172

SEQ ID NO: 425088 - RNA, 64 nt, hsa; identical to SEQ ID NO: 48173

SEQ ID NO: 425089 - RNA, 64 nt, hsa; identical to SEQ ID NO: 48174

SEQ ID NO: 425090 - RNA, 64 nt, hsa; identical to SEQ ID NO: 48175

SEQ ID NO: 425091 - RNA, 64 nt, hsa; identical to SEQ ID NO: 48176

SEQ ID NO: 425092 - RNA, 64 nt, hsa; identical to SEQ ID NO: 48177

SEQ ID NO: 425093 - RNA, 64 nt, hsa; identical to SEQ ID NO: 48178

SEQ ID NO: 425094 - RNA, 64 nt, hsa; identical to SEQ ID NO: 48179

SEQ ID NO: 425095 - RNA, 64 nt, hsa; identical to SEQ ID NO: 48180

SEQ ID NO: 425096 - RNA, 64 nt, hsa; identical to SEQ ID NO: 48181

SEQ ID NO: 425097 - RNA, 64 nt, hsa; identical to SEQ ID NO: 48182

SEQ ID NO: 425098 - RNA, 64 nt, hsa; identical to SEQ ID NO: 48183

SEQ ID NO: 425099 - RNA, 64 nt, hsa; identical to SEQ ID NO: 48184

SEQ ID NO: 425100 - RNA, 64 nt, hsa; identical to SEQ ID NO: 48185

SEQ ID NO: 425101 - RNA, 64 nt, hsa; identical to SEQ ID NO: 48186

SEQ ID NO: 425102 - RNA, 64 nt, hsa; identical to SEQ ID NO: 48187

SEQ ID NO: 425103 - RNA, 64 nt, hsa; identical to SEQ ID NO: 48188

SEQ ID NO: 425104 - RNA, 64 nt, hsa; identical to SEQ ID NO: 48189

SEQ ID NO: 425105 - RNA, 64 nt, hsa; identical to SEQ ID NO: 48190

SEQ ID NO: 425106 - RNA, 64 nt, hsa; identical to SEQ ID NO: 48191

SEQ ID NO: 425107 - RNA, 64 nt, hsa; identical to SEQ ID NO: 48192

SEQ ID NO: 425108 - RNA, 64 nt, hsa; identical to SEQ ID NO: 48193

SEQ ID NO: 425109 - RNA, 64 nt, hsa; identical to SEQ ID NO: 48194

SEQ ID NO: 425110 - RNA, 64 nt, hsa; identical to SEQ ID NO: 48195

SEQ ID NO: 425111 - RNA, 64 nt, hsa; identical to SEQ ID NO: 48196

SEQ ID NO: 425112 - RNA, 64 nt, hsa; identical to SEQ ID NO: 48197

SEQ ID NO: 425113 - RNA, 64 nt, hsa; identical to SEQ ID NO: 48198

SEQ ID NO: 425114 - RNA, 64 nt, hsa; identical to SEQ ID NO: 48199

SEQ ID NO: 425115 - RNA, 64 nt, hsa; identical to SEQ ID NO: 48200

SEQ ID NO: 425116 - RNA, 64 nt, hsa; identical to SEQ ID NO: 48201

SEQ ID NO: 425117 - RNA, 64 nt, hsa; identical to SEQ ID NO: 48202

SEQ ID NO: 425118 - RNA, 64 nt, hsa; identical to SEQ ID NO: 48203

SEQ ID NO: 425119 - RNA, 64 nt, hsa; identical to SEQ ID NO: 48204

SEQ ID NO: 425120 - RNA, 64 nt, hsa; identical to SEQ ID NO: 48205

SEQ ID NO: 425121 - RNA, 64 nt, hsa; identical to SEQ ID NO: 48206

SEQ ID NO: 425122 - RNA, 64 nt, hsa; identical to SEQ ID NO: 48207

SEQ ID NO: 425123 - RNA, 64 nt, hsa; identical to SEQ ID NO: 48208

SEQ ID NO: 425124 - RNA, 64 nt, hsa; identical to SEQ ID NO: 48209

SEQ ID NO: 425125 - RNA, 64 nt, hsa; identical to SEQ ID NO: 48210

SEQ ID NO: 425126 - RNA, 64 nt, hsa; identical to SEQ ID NO: 48211

SEQ ID NO: 425127 - RNA, 64 nt, hsa; identical to SEQ ID NO: 48212

SEQ ID NO: 425128 - RNA, 64 nt, hsa; identical to SEQ ID NO: 48213

SEQ ID NO: 425129 - RNA, 64 nt, hsa; identical to SEQ ID NO: 48214

SEQ ID NO: 425130 - RNA, 64 nt, hsa; identical to SEQ ID NO: 48215

SEQ ID NO: 425131 - RNA, 64 nt, hsa; identical to SEQ ID NO: 48216

SEQ ID NO: 425132 - RNA, 64 nt, hsa; identical to SEQ ID NO: 48217

SEQ ID NO: 425133 - RNA, 64 nt, hsa; identical to SEQ ID NO: 48218

SEQ ID NO: 425134 - RNA, 64 nt, hsa; identical to SEQ ID NO: 48219

SEQ ID NO: 425135 - RNA, 64 nt, hsa; identical to SEQ ID NO: 48220

SEQ ID NO: 425136 - RNA, 64 nt, hsa; identical to SEQ ID NO: 48221

SEQ ID NO: 425137 - RNA, 64 nt, hsa; identical to SEQ ID NO: 48222

SEQ ID NO: 425138 - RNA, 64 nt, hsa; identical to SEQ ID NO: 48223

SEQ ID NO: 425139 - RNA, 64 nt, hsa; identical to SEQ ID NO: 48224

SEQ ID NO: 425140 - RNA, 64 nt, hsa; identical to SEQ ID NO: 48225

SEQ ID NO: 425141 - RNA, 64 nt, hsa; identical to SEQ ID NO: 48226

SEQ ID NO: 425142 - RNA, 64 nt, hsa; identical to SEQ ID NO: 48227

SEQ ID NO: 425143 - RNA, 64 nt, hsa; identical to SEQ ID NO: 48228

SEQ ID NO: 425144 - RNA, 64 nt, hsa; identical to SEQ ID NO: 48229

SEQ ID NO: 425145 - RNA, 64 nt, hsa; identical to SEQ ID NO: 48230

SEQ ID NO: 425146 - RNA, 64 nt, hsa; identical to SEQ ID NO: 48231

SEQ ID NO: 425147 - RNA, 64 nt, hsa; identical to SEQ ID NO: 48232

SEQ ID NO: 425148 - RNA, 64 nt, hsa; identical to SEQ ID NO: 48233

SEQ ID NO: 425149 - RNA, 64 nt, hsa; identical to SEQ ID NO: 48234

SEQ ID NO: 425150 - RNA, 64 nt, hsa; identical to SEQ ID NO: 48235

SEQ ID NO: 425151 - RNA, 64 nt, hsa; identical to SEQ ID NO: 48236

SEQ ID NO: 425152 - RNA, 64 nt, hsa; identical to SEQ ID NO: 48237

SEQ ID NO: 425153 - RNA, 64 nt, hsa; identical to SEQ ID NO: 48238

SEQ ID NO: 425154 - RNA, 64 nt, hsa; identical to SEQ ID NO: 48239

SEQ ID NO: 425155 - RNA, 64 nt, hsa; identical to SEQ ID NO: 48240

SEQ ID NO: 425156 - RNA, 64 nt, hsa; identical to SEQ ID NO: 48241

SEQ ID NO: 425157 - RNA, 64 nt, hsa; identical to SEQ ID NO: 48242

SEQ ID NO: 425158 - RNA, 64 nt, hsa; identical to SEQ ID NO: 48243

SEQ ID NO: 425159 - RNA, 64 nt, hsa; identical to SEQ ID NO: 48244

SEQ ID NO: 425160 - RNA, 64 nt, hsa; identical to SEQ ID NO: 48245

SEQ ID NO: 425161 - RNA, 64 nt, hsa; identical to SEQ ID NO: 48246

SEQ ID NO: 425162 - RNA, 64 nt, hsa; identical to SEQ ID NO: 48247

SEQ ID NO: 425163 - RNA, 64 nt, hsa; identical to SEQ ID NO: 48248

SEQ ID NO: 425164 - RNA, 64 nt, hsa; identical to SEQ ID NO: 48249

SEQ ID NO: 425165 - RNA, 64 nt, hsa; identical to SEQ ID NO: 48250

SEQ ID NO: 425166 - RNA, 64 nt, hsa; identical to SEQ ID NO: 48251

SEQ ID NO: 425167 - RNA, 64 nt, hsa; identical to SEQ ID NO: 48252

SEQ ID NO: 425168 - RNA, 64 nt, hsa; identical to SEQ ID NO: 48253

SEQ ID NO: 425169 - RNA, 64 nt, hsa; identical to SEQ ID NO: 48254

SEQ ID NO: 425170 - RNA, 64 nt, hsa; identical to SEQ ID NO: 48255

SEQ ID NO: 425171 - RNA, 64 nt, hsa; identical to SEQ ID NO: 48256

SEQ ID NO: 425172 - RNA, 64 nt, hsa; identical to SEQ ID NO: 48257

SEQ ID NO: 425173 - RNA, 64 nt, hsa; identical to SEQ ID NO: 48258

SEQ ID NO: 425174 - RNA, 64 nt, hsa; identical to SEQ ID NO: 48259

SEQ ID NO: 425175 - RNA, 64 nt, hsa; identical to SEQ ID NO: 48260

SEQ ID NO: 425176 - RNA, 64 nt, hsa; identical to SEQ ID NO: 48261

SEQ ID NO: 425177 - RNA, 64 nt, hsa; identical to SEQ ID NO: 48262

SEQ ID NO: 425178 - RNA, 64 nt, hsa; identical to SEQ ID NO: 48263

SEQ ID NO: 425179 - RNA, 64 nt, hsa; identical to SEQ ID NO: 48264

SEQ ID NO: 425180 - RNA, 64 nt, hsa; identical to SEQ ID NO: 48265

SEQ ID NO: 425181 - RNA, 64 nt, hsa; identical to SEQ ID NO: 48266

SEQ ID NO: 425182 - RNA, 64 nt, hsa; identical to SEQ ID NO: 48267

SEQ ID NO: 425183 - RNA, 64 nt, hsa; identical to SEQ ID NO: 48268

SEQ ID NO: 425184 - RNA, 64 nt, hsa; identical to SEQ ID NO: 48269

SEQ ID NO: 425185 - RNA, 64 nt, hsa; identical to SEQ ID NO: 48270

SEQ ID NO: 425186 - RNA, 64 nt, hsa; identical to SEQ ID NO: 48271

SEQ ID NO: 425187 - RNA, 64 nt, hsa; identical to SEQ ID NO: 48272

SEQ ID NO: 425188 - RNA, 64 nt, hsa; identical to SEQ ID NO: 48273

SEQ ID NO: 425189 - RNA, 64 nt, hsa; identical to SEQ ID NO: 48274

SEQ ID NO: 425190 - RNA, 64 nt, hsa; identical to SEQ ID NO: 48275

SEQ ID NO: 425191 - RNA, 64 nt, hsa; identical to SEQ ID NO: 48276

SEQ ID NO: 425192 - RNA, 64 nt, hsa; identical to SEQ ID NO: 48277

SEQ ID NO: 425193 - RNA, 64 nt, hsa; identical to SEQ ID NO: 48278

SEQ ID NO: 425194 - RNA, 64 nt, hsa; identical to SEQ ID NO: 48279

SEQ ID NO: 425195 - RNA, 64 nt, hsa; identical to SEQ ID NO: 48280

SEQ ID NO: 425196 - RNA, 64 nt, hsa; identical to SEQ ID NO: 48281

SEQ ID NO: 425197 - RNA, 64 nt, hsa; identical to SEQ ID NO: 48282

SEQ ID NO: 425198 - RNA, 64 nt, hsa; identical to SEQ ID NO: 48283

SEQ ID NO: 425199 - RNA, 64 nt, hsa; identical to SEQ ID NO: 48284

SEQ ID NO: 425200 - RNA, 64 nt, hsa; identical to SEQ ID NO: 48285

SEQ ID NO: 425201 - RNA, 64 nt, hsa; identical to SEQ ID NO: 48286

SEQ ID NO: 425202 - RNA, 64 nt, hsa; identical to SEQ ID NO: 48287

SEQ ID NO: 425203 - RNA, 64 nt, hsa; identical to SEQ ID NO: 48288

SEQ ID NO: 425204 - RNA, 64 nt, hsa; identical to SEQ ID NO: 48289

SEQ ID NO: 425205 - RNA, 64 nt, hsa; identical to SEQ ID NO: 48290

SEQ ID NO: 425206 - RNA, 64 nt, hsa; identical to SEQ ID NO: 48291

SEQ ID NO: 425207 - RNA, 64 nt, hsa; identical to SEQ ID NO: 48292

SEQ ID NO: 425208 - RNA, 64 nt, hsa; identical to SEQ ID NO: 48293

SEQ ID NO: 425209 - RNA, 64 nt, hsa; identical to SEQ ID NO: 48294

SEQ ID NO: 425210 - RNA, 64 nt, hsa; identical to SEQ ID NO: 48295

SEQ ID NO: 425211 - RNA, 64 nt, hsa; identical to SEQ ID NO: 48296

SEQ ID NO: 425212 - RNA, 64 nt, hsa; identical to SEQ ID NO: 48297

SEQ ID NO: 425213 - RNA, 64 nt, hsa; identical to SEQ ID NO: 48298

SEQ ID NO: 425214 - RNA, 64 nt, hsa; identical to SEQ ID NO: 48299

SEQ ID NO: 425215 - RNA, 64 nt, hsa; identical to SEQ ID NO: 48300

SEQ ID NO: 425216 - RNA, 64 nt, hsa; identical to SEQ ID NO: 48301

SEQ ID NO: 425217 - RNA, 64 nt, hsa; identical to SEQ ID NO: 48302

SEQ ID NO: 425218 - RNA, 64 nt, hsa
aagccuccuggugcaucuucaaaaugaguccuaaagaacauacugaguacuuauaaguagcaga

SEQ ID NO: 425219 - RNA, 64 nt, hsa
guccuaaagaacauacugaguacuuauaaguagcagaacauaaaauguauuucugacuaacaca

SEQ ID NO: 425220 - RNA, 64 nt, hsa
cuuuuuaggguuuuggaucacauuagagauauuuagaacauauuacccugugacuuacguagga

SEQ ID NO: 425221 - RNA, 64 nt, hsa
aaacagaagagagaaaaauauacauuauaaaagcagaacauacauguaccaguuuuuggauacu

SEQ ID NO: 425222 - RNA, 64 nt, hsa
guuuuuuuuuuaaaggaaaugcagccuagucuugagaacauaauuuuauauaaucaauuacuaa

SEQ ID NO: 425223 - RNA, 64 nt, hsa
ucuacuguuugccaggcauuuaagaauauggcaaagaacauaaaagauggugucaccagauuuu

SEQ ID NO: 425224 - RNA, 64 nt, hsa
uuacucugggugaagucagaacuuuguagaacacagaacauaaagggugagagaaaucuguuaa

SEQ ID NO: 425225 - RNA, 64 nt, hsa
acaucuauggugaccacuuuugacaaaggaaugaagaacauacacuggggaaaagauaaugucu

SEQ ID NO: 425226 - RNA, 64 nt, hsa
guccuaaagaacauacugaguacuuagaaguagaagaacauaagauguauuucugacuaaaaca

SEQ ID NO: 425227 - RNA, 64 nt, hsa
aaggcuccuggugcaucuucaaaaugaguccuaaagaacauacugaguacuuagaaguagaaga

SEQ ID NO: 425228 - RNA, 64 nt, hsa
uuaaccucugagaaaagaacauaagaacucaaggagaacauaagagaaaaggaaaccuguuaca

SEQ ID NO: 425229 - RNA, 64 nt, hsa
ggaaaaaaaaagcccaaacuuaaccucugagaaaagaacauaagaacucaaggagaacauaaga

SEQ ID NO: 425230 - RNA, 64 nt, hsa
acauuuaauuuguuuacaaaaauguuuauugucuucaguacaaaaaguuaaaaccaugauugga

SEQ ID NO: 425231 - RNA, 64 nt, hsa
uaauuucccaguccuugucuugaacaaucuuuucucaguacaacagccauagugauucuguuaa

SEQ ID NO: 425232 - RNA, 64 nt, hsa
uggcaaagcuuauccaauuuuaugcuuggagcagucaguacauaccaguuucugauguuucagg

SEQ ID NO: 425233 - RNA, 64 nt, hsa
gcuccauaucuaagauuuuucuaccugccccucuucaguacagggauggcuggcugcucaacac

SEQ ID NO: 425234 - RNA, 64 nt, hsa; identical to SEQ ID NO: 61460

SEQ ID NO: 425235 - RNA, 64 nt, hsa; identical to SEQ ID NO: 61461

SEQ ID NO: 425236 - RNA, 64 nt, hsa; identical to SEQ ID NO: 61462

SEQ ID NO: 425237 - RNA, 64 nt, hsa; identical to SEQ ID NO: 61463

SEQ ID NO: 425238 - RNA, 64 nt, hsa; identical to SEQ ID NO: 61464

SEQ ID NO: 425239 - RNA, 64 nt, hsa; identical to SEQ ID NO: 61465

SEQ ID NO: 425240 - RNA, 64 nt, hsa; identical to SEQ ID NO: 61466

SEQ ID NO: 425241 - RNA, 64 nt, hsa; identical to SEQ ID NO: 61467

SEQ ID NO: 425242 - RNA, 64 nt, hsa; identical to SEQ ID NO: 61468

SEQ ID NO: 425243 - RNA, 64 nt, hsa; identical to SEQ ID NO: 61469

SEQ ID NO: 425244 - RNA, 64 nt, hsa; identical to SEQ ID NO: 61470

SEQ ID NO: 425245 - RNA, 64 nt, hsa; identical to SEQ ID NO: 61471

SEQ ID NO: 425246 - RNA, 64 nt, hsa; identical to SEQ ID NO: 61472

SEQ ID NO: 425247 - RNA, 64 nt, hsa; identical to SEQ ID NO: 61473

SEQ ID NO: 425248 - RNA, 64 nt, hsa; identical to SEQ ID NO: 61474

SEQ ID NO: 425249 - RNA, 64 nt, hsa; identical to SEQ ID NO: 61475

SEQ ID NO: 425250 - RNA, 64 nt, hsa; identical to SEQ ID NO: 61476

SEQ ID NO: 425251 - RNA, 64 nt, hsa; identical to SEQ ID NO: 61477

SEQ ID NO: 425252 - RNA, 64 nt, hsa; identical to SEQ ID NO: 61478

SEQ ID NO: 425253 - RNA, 64 nt, hsa; identical to SEQ ID NO: 61479

SEQ ID NO: 425254 - RNA, 64 nt, hsa; identical to SEQ ID NO: 61480

SEQ ID NO: 425255 - RNA, 64 nt, hsa; identical to SEQ ID NO: 61481

SEQ ID NO: 425256 - RNA, 64 nt, hsa; identical to SEQ ID NO: 61482

SEQ ID NO: 425257 - RNA, 64 nt, hsa; identical to SEQ ID NO: 61483

SEQ ID NO: 425258 - RNA, 64 nt, hsa; identical to SEQ ID NO: 61484

SEQ ID NO: 425259 - RNA, 64 nt, hsa; identical to SEQ ID NO: 61485

SEQ ID NO: 425260 - RNA, 64 nt, hsa; identical to SEQ ID NO: 61486

SEQ ID NO: 425261 - RNA, 64 nt, hsa; identical to SEQ ID NO: 61487

SEQ ID NO: 425262 - RNA, 64 nt, hsa; identical to SEQ ID NO: 61488

SEQ ID NO: 425263 - RNA, 64 nt, hsa; identical to SEQ ID NO: 61489

SEQ ID NO: 425264 - RNA, 64 nt, hsa; identical to SEQ ID NO: 61490

SEQ ID NO: 425265 - RNA, 64 nt, hsa; identical to SEQ ID NO: 61491

SEQ ID NO: 425266 - RNA, 64 nt, hsa; identical to SEQ ID NO: 61492

SEQ ID NO: 425267 - RNA, 64 nt, hsa; identical to SEQ ID NO: 61493

SEQ ID NO: 425268 - RNA, 64 nt, hsa; identical to SEQ ID NO: 61494

SEQ ID NO: 425269 - RNA, 64 nt, hsa; identical to SEQ ID NO: 346526

SEQ ID NO: 425270 - RNA, 64 nt, hsa; identical to SEQ ID NO: 346527

SEQ ID NO: 425271 - RNA, 64 nt, hsa; identical to SEQ ID NO: 346528

SEQ ID NO: 425272 - RNA, 64 nt, hsa; identical to SEQ ID NO: 346529

SEQ ID NO: 425273 - RNA, 64 nt, hsa; identical to SEQ ID NO: 346530

SEQ ID NO: 425274 - RNA, 64 nt, hsa; identical to SEQ ID NO: 346531

SEQ ID NO: 425275 - RNA, 64 nt, hsa; identical to SEQ ID NO: 346532

SEQ ID NO: 425276 - RNA, 64 nt, hsa; identical to SEQ ID NO: 346533

SEQ ID NO: 425277 - RNA, 64 nt, hsa; identical to SEQ ID NO: 346534

SEQ ID NO: 425278 - RNA, 64 nt, hsa; identical to SEQ ID NO: 346535

SEQ ID NO: 425279 - RNA, 64 nt, hsa; identical to SEQ ID NO: 346536

SEQ ID NO: 425280 - RNA, 64 nt, hsa; identical to SEQ ID NO: 346537

SEQ ID NO: 425281 - RNA, 64 nt, hsa; identical to SEQ ID NO: 346538

SEQ ID NO: 425282 - RNA, 64 nt, hsa; identical to SEQ ID NO: 51918

SEQ ID NO: 425283 - RNA, 64 nt, hsa; identical to SEQ ID NO: 51919

SEQ ID NO: 425284 - RNA, 64 nt, hsa; identical to SEQ ID NO: 51920

SEQ ID NO: 425285 - RNA, 64 nt, hsa; identical to SEQ ID NO: 51921

SEQ ID NO: 425286 - RNA, 64 nt, hsa; identical to SEQ ID NO: 51922

SEQ ID NO: 425287 - RNA, 64 nt, hsa; identical to SEQ ID NO: 51923

SEQ ID NO: 425288 - RNA, 64 nt, hsa; identical to SEQ ID NO: 51924

SEQ ID NO: 425289 - RNA, 64 nt, hsa; identical to SEQ ID NO: 51925

SEQ ID NO: 425290 - RNA, 64 nt, hsa; identical to SEQ ID NO: 51926

SEQ ID NO: 425291 - RNA, 64 nt, hsa; identical to SEQ ID NO: 51927

SEQ ID NO: 425292 - RNA, 64 nt, hsa; identical to SEQ ID NO: 51928

SEQ ID NO: 425293 - RNA, 64 nt, hsa; identical to SEQ ID NO: 51929

SEQ ID NO: 425294 - RNA, 64 nt, hsa; identical to SEQ ID NO: 51930

SEQ ID NO: 425295 - RNA, 64 nt, hsa; identical to SEQ ID NO: 51931

SEQ ID NO: 425296 - RNA, 64 nt, hsa; identical to SEQ ID NO: 51932

SEQ ID NO: 425297 - RNA, 64 nt, hsa; identical to SEQ ID NO: 51933

SEQ ID NO: 425298 - RNA, 64 nt, hsa; identical to SEQ ID NO: 51934

SEQ ID NO: 425299 - RNA, 64 nt, hsa; identical to SEQ ID NO: 51935

SEQ ID NO: 425300 - RNA, 64 nt, hsa; identical to SEQ ID NO: 51936

SEQ ID NO: 425301 - RNA, 64 nt, hsa; identical to SEQ ID NO: 51937

SEQ ID NO: 425302 - RNA, 64 nt, hsa; identical to SEQ ID NO: 51938

SEQ ID NO: 425303 - RNA, 64 nt, hsa; identical to SEQ ID NO: 51939

SEQ ID NO: 425304 - RNA, 64 nt, hsa; identical to SEQ ID NO: 51940

SEQ ID NO: 425305 - RNA, 64 nt, hsa; identical to SEQ ID NO: 51941

SEQ ID NO: 425306 - RNA, 64 nt, hsa; identical to SEQ ID NO: 51942

SEQ ID NO: 425307 - RNA, 64 nt, hsa; identical to SEQ ID NO: 51943

SEQ ID NO: 425308 - RNA, 64 nt, hsa; identical to SEQ ID NO: 51944

SEQ ID NO: 425309 - RNA, 61 nt, hsa
gauugucugauaagucugccaauaaacuauccagaaauagcaaguguaauaguccccacua

SEQ ID NO: 425310 - RNA, 61 nt, hsa
ccacuuuuagguuuuccccuuacagaaaccacagaaauauucccuuagaauaaaauaguau

SEQ ID NO: 425311 - RNA, 61 nt, hsa
uuaguucccuaaacuuuagaagaaaugcuaucagaaauagauuuccuuccaguggaaagaa

SEQ ID NO: 425312 - RNA, 61 nt, hsa
gauggaaaaugcugugugcugccaugguaaucagaaauaauaaccuguuagggauguauuc

SEQ ID NO: 425313 - RNA, 61 nt, hsa
gccaaauucauccucuuaccagauccuuuuccagaaauaccugucuaggaaggugugaugu

SEQ ID NO: 425314 - RNA, 61 nt, hsa
uuuuucugacuucuagcugucugugaauauccagaaauaaaacaacucugauguggaaugc

SEQ ID NO: 425315 - RNA, 61 nt, hsa
uucaauuaccuggaugucaaaguccuagagccagaaauauauucucucaucccucuuagca

SEQ ID NO: 425316 - RNA, 61 nt, hsa
uuuaguuucacccagugugcuuuuggauaagcagaaauaucuaaaugggauuuugaguucu

SEQ ID NO: 425317 - RNA, 61 nt, hsa
acacuccccaaauuucuaaauuaaucuuuuucagaaauaucgaaggagccaaaaauauaaa

SEQ ID NO: 425318 - RNA, 61 nt, hsa
uauuguguaaugaucuuuaaacgcuauauuucagaaauauuaaauggaagaaaucaauauc

SEQ ID NO: 425319 - RNA, 61 nt, hsa
aaugggaaagggagggguagaaguuccuuuucagaaauaaagaggcauucaugaaggcuuu

SEQ ID NO: 425320 - RNA, 61 nt, hsa
ucucugauggucacuuuguggucugugcuuucagaaauacaggaaucugauaucaacauau

SEQ ID NO: 425321 - RNA, 61 nt, hsa
gacgacaaagauucuguuucaaauauagccacagaaauaaaggagggaccaauaucuggga

SEQ ID NO: 425322 - RNA, 61 nt, hsa
gacgagaaagauucuguuucaaauauagccacagaaauaaagaagggacaacaaucuggga

SEQ ID NO: 425323 - RNA, 61 nt, hsa
gacaagacagauucugcuuugaauauagcuacagaaauaaaggauggacuacaguguggga

SEQ ID NO: 425324 - RNA, 61 nt, hsa
gacgaggaagacucuguuucgaauauagccacagaaauaaaggauggagaaaaaucuggga

SEQ ID NO: 425325 - RNA, 61 nt, hsa
gaugagaaagauucuguuucgaacauagccacagaaauaaaggauggagaaaaaucuggga

SEQ ID NO: 425326 - RNA, 61 nt, hsa
guauauuuucaagccaagaaccaguagaaaacagaaauaauggugcucccaaauauucagu

SEQ ID NO: 425327 - RNA, 61 nt, hsa
caguuggguuuuuugcguccuuuuggaaucacagaaauaaacaaguagguuucaguugucu

SEQ ID NO: 425328 - RNA, 61 nt, hsa
uuaaauuugcuaguggauuuugucuaaugugcagaaauauauaugucuaaugugcagaaau

SEQ ID NO: 425329 - RNA, 61 nt, hsa
cuaaugugcagaaauauauaugucuaaugugcagaaauauauauguguguauguguguaua

SEQ ID NO: 425330 - RNA, 61 nt, hsa
uuggguaacaaauuuauacaggacagugguacagaaauacaucuuugcucugagaauacag

SEQ ID NO: 425331 - RNA, 61 nt, hsa
agcauuuuucuuuagucauuuaagaauuuaccagaaauauuugcucaauaugaucuugaua

SEQ ID NO: 425332 - RNA, 61 nt, hsa
auuauugauacaacaggauuuucaaguuauucagaaauaucccucauuucauuauuuuuca

SEQ ID NO: 425333 - RNA, 61 nt, hsa
cuuuaauaauuuguugauaaguuuacauaaacagaaauaaaagauacuaucuuuaccguag

SEQ ID NO: 425334 - RNA, 61 nt, hsa
ucccuguaaaacaauccccacagauuacuuucagaaauagauguauuucucuacguaaggg

SEQ ID NO: 425335 - RNA, 61 nt, hsa
uuagcauguuaagcguugaugcauauaaaaucagaaauagaugugagaaugguggaacuuu

SEQ ID NO: 425336 - RNA, 61 nt, hsa
auguugcaauaagcauucggguacuaucacccagaaauaugaauugccagaauagaacauu

SEQ ID NO: 425337 - RNA, 61 nt, hsa
uguacauauguaccuauuuuuuuuuaaaaagcagaaauagaaauacaagacugguaaacau

SEQ ID NO: 425338 - RNA, 61 nt, hsa
aauagcaacagugucucaugauuuaauggcucagaaauaguuauucauuaguuuuuaauuu

SEQ ID NO: 425339 - RNA, 61 nt, hsa
uauuuuauguugugccagugaauccaguugccagaaauaagucugaauguuuucaugcauc

SEQ ID NO: 425340 - RNA, 61 nt, hsa
uaaugugacccuagaaaacuguagcaagcuucagaaauaaaucuuuugaucuuucccuauc

SEQ ID NO: 425341 - RNA, 61 nt, hsa
uaauauuacuuauaacuguaauauauagauucagaaauacauuuucauuauccaaaaucag

SEQ ID NO: 425342 - RNA, 61 nt, hsa
aauuuagaaaaggaugucgacuugcuaauuucagaaauaauuauucauuuuuaaaaagccc

SEQ ID NO: 425343 - RNA, 61 nt, hsa
cuaccccaagcuguguaauauacuuguauaacagaaauaccuucuauacaaaccuuuuuuu

SEQ ID NO: 425344 - RNA, 61 nt, hsa
auucacaauggagaauuauaugacaugguagcagaaauaggcccuuuuauguguugcuucu

SEQ ID NO: 425345 - RNA, 61 nt, hsa
auauuagaguuuucccaaauccaaaaacggucagaaauaaguccauuaucaauauaauuug

SEQ ID NO: 425346 - RNA, 61 nt, hsa
uuuugauuuuauuaaaugggaagaaagcaagcagaaauaguaaaauucaguagguuuaaaa

SEQ ID NO: 425347 - RNA, 61 nt, hsa
ugugaaggguacagauuagguuugucccagucagaaauaaaauuugauaaacauuccuguu

SEQ ID NO: 425348 - RNA, 61 nt, hsa
ggaagauggagguuuaccgguuguuuagaaacagaaauagacuuaauaaagguuuaaagcu

SEQ ID NO: 425349 - RNA, 61 nt, hsa
acuuuauuacuuacaaacucagaaauacgaacagaaauacagcagacgaacauauuuauug

SEQ ID NO: 425350 - RNA, 61 nt, hsa
ucuaauuagaauacuuuauuacuuacaaacucagaaauacgaacagaaauacagcagacga

SEQ ID NO: 425351 - RNA, 61 nt, hsa
uguucaauucucuaaaaucccagaacacaaucagaaauagcucaggcagacacuaauaauu

SEQ ID NO: 425352 - RNA, 61 nt, hsa
guguuugagguuauauaugcacaaacacacacagaaauauauucaugucuauguguauaua

SEQ ID NO: 425353 - RNA, 61 nt, hsa
guaagagagaucaccggcguucuguugauuccagaaauacccucaaugaucuccugaagca

SEQ ID NO: 425354 - RNA, 61 nt, hsa
caucgcuauacuccccuccuucaacucuccccagaaauagcccaaccaagcgaguggaugu

SEQ ID NO: 425355 - RNA, 61 nt, hsa
agaccuuccagaaauacuacuguguaagggccagaaauaucuucacuugucauuguuauau

SEQ ID NO: 425356 - RNA, 61 nt, hsa
guacuagagcaagcaggaaucagagaccuuccagaaauacuacuguguaagggccagaaau

SEQ ID NO: 425357 - RNA, 61 nt, hsa
aaaaauguguuuccuguugcuuuuaguuauacagaaauaugugacuguagugucuuuaauu

SEQ ID NO: 425358 - RNA, 61 nt, hsa
gacuucaaucauuuuuaaaauuccuaauuuucagaaauaugaauaaauaguuuuuguuaaa

SEQ ID NO: 425359 - RNA, 61 nt, hsa
guacauauauugacuuuuugagcaagaaugccagaaauagccuucauuucuacccugcaaa

SEQ ID NO: 425360 - RNA, 61 nt, hsa
augaaaaauauuuucagcaaagcuuuaaaaccagaaauacuguguaacugugaucuaugug

SEQ ID NO: 425361 - RNA, 61 nt, hsa
aaugauaaagggaauaucaucacugaucccacagaaauacaaacuaccaucagagaauacu

SEQ ID NO: 425362 - RNA, 61 nt, hsa
gauauagaucaauagaacagaacagagcccucagaaauaaugccacauaucuacaacuauc

SEQ ID NO: 425363 - RNA, 61 nt, hsa
uuucauuagaaauuugcaccucaucaugccccagaaauaauccuucugaagcaaagcacca

SEQ ID NO: 425364 - RNA, 61 nt, hsa
uauacacaaaagugaauccagagauuaaaaacagaaauauggaaaagcuauguacuaaaau

SEQ ID NO: 425365 - RNA, 61 nt, hsa
cuugcuguuguacacaggguauuucuagaagcagaaauagacugggaagaugcacaaccaa

SEQ ID NO: 425366 - RNA, 61 nt, hsa
ucgcccaugcuccucaccuguauuuuguaaucagaaauaaauugcuuuuaaagaaaucugg

SEQ ID NO: 425367 - RNA, 61 nt, hsa
gucagauuugaugauuuccuagcaggacuuacagaaauaaagagcuaucaugcugugguuu

SEQ ID NO: 425368 - RNA, 61 nt, hsa
gucuauggggcuaucccuacaaagaagaauccagaaauaggggcacauugaggaaugauac

SEQ ID NO: 425369 - RNA, 61 nt, hsa
aaugacaaaggggacauuaccaccaaccccacagaaauacgaaaaacccucaaagauuacu

SEQ ID NO: 425370 - RNA, 61 nt, hsa
cacauagaucaauggaauagguaagagaacccagaaauaaaggcauauaccuacaaccaug

SEQ ID NO: 425371 - RNA, 61 nt, hsa
ugucccaaaaacaaaucgcagccagcuuuuccagaaauagaaaauucugccgucugagguu

SEQ ID NO: 425372 - RNA, 61 nt, hsa
uuuagguuugcaagccuccugaucaggaaaccagaaauaccacauuuauggaccaugaaag

SEQ ID NO: 425373 - RNA, 61 nt, hsa
uuuuaaaauccaagagcuucucuauacuuuucagaaauauccagaugcagugaacugccag

SEQ ID NO: 425374 - RNA, 61 nt, hsa
uuuuaaauuccaacuuaaaauuaugagguuucagaaauauauugaaaguuuaacaauguuu

SEQ ID NO: 425375 - RNA, 61 nt, hsa
uuguucgcuuagugauccacugaucucuaaucagaaauauuuuuaaaaaauacaauuuaga

SEQ ID NO: 425376 - RNA, 61 nt, hsa
uuggauaggcugcuaucuaauuugcaguugucagaaauacugugcugaaaguuuuaugaca

SEQ ID NO: 425377 - RNA, 64 nt, hsa; identical to SEQ ID NO: 290188

SEQ ID NO: 425378 - RNA, 64 nt, hsa; identical to SEQ ID NO: 290189

SEQ ID NO: 425379 - RNA, 64 nt, hsa; identical to SEQ ID NO: 290190

SEQ ID NO: 425380 - RNA, 64 nt, hsa; identical to SEQ ID NO: 290191

SEQ ID NO: 425381 - RNA, 64 nt, hsa; identical to SEQ ID NO: 290192

SEQ ID NO: 425382 - RNA, 64 nt, hsa; identical to SEQ ID NO: 290193

SEQ ID NO: 425383 - RNA, 63 nt, hsa
gcuuaaaaguuuaguaaaaaucgucugggcacaguggcucacgccuguaaucccagcacuuug

SEQ ID NO: 425384 - RNA, 63 nt, hsa
ucucaaagagaaaaaaaaaaaagaccgggugugguggcucacaccuguaaucccagcacuuug

SEQ ID NO: 425385 - RNA, 63 nt, hsa
augauuaagauaaugccgggcaggccgggcacaguggcucacgccuguaauccaagcacuugg

SEQ ID NO: 425386 - RNA, 63 nt, hsa
uaaccugccucuugaaagauucaaccgggugugguggcucacgccuguaaucccagcacauug

SEQ ID NO: 425387 - RNA, 63 nt, hsa
cucuccagcuacccuuuuaccucaucagaagcaguggcucagcuaagugcucccccuagcucc

SEQ ID NO: 425388 - RNA, 63 nt, hsa
ugggccuuucuuucaucccaaaugacaaggaauguggcucagagaaggguuuuucuuuuuuga

SEQ ID NO: 425389 - RNA, 63 nt, hsa
aagauguagaaaauagaaaauaggcuaggcacaguggcucacgccuguaaucucaacacuuug

SEQ ID NO: 425390 - RNA, 63 nt, hsa
ugcuguuuaaagucugaagcucggccaggugcgguggcucacgccuguaaucccaaaacuuug

SEQ ID NO: 425391 - RNA, 63 nt, hsa
gcuuguguaagaaacugaaauaagcugcgugugguggcucacaccuguaaucccaacacuuug

SEQ ID NO: 425392 - RNA, 63 nt, hsa
ucucaaaggaaaaaggaaacuaggccaggcgugguggcucacgccuguaaucccaacacuuug

SEQ ID NO: 425393 - RNA, 63 nt, hsa
uccauuuuaaagaguguaggcaggccaggugcaguggcucaugccuguaaucccagcauuuug

SEQ ID NO: 425394 - RNA, 63 nt, hsa
caaacacaagaacuauacacauggccaggcgcgguggcucacacccguaaucccagcacuuug

SEQ ID NO: 425395 - RNA, 63 nt, hsa
ucaaaaguaauuggcagugauuggccaggcgcaguggcucacgccuguaaucccagcacuggg

SEQ ID NO: 425396 - RNA, 63 nt, hsa
cgucuuaaaaaagcccauggcaggcugggcgcgguggcucacgccuguaaucccagcacuuug

SEQ ID NO: 425397 - RNA, 63 nt, hsa
ccagaaccugucgcuggaaaccagggcaaagcaguggcucagggcuccuugggugcaugugua

SEQ ID NO: 425398 - RNA, 63 nt, hsa
gccuuggcuggaaaacugugguagagccgggcuguggcucagguaauuuuugccauuuggcca

SEQ ID NO: 425399 - RNA, 63 nt, hsa
cuguggucccaguuacuugggaggcugacguggguggcucacuugagcacaggaguuugaggc

SEQ ID NO: 425400 - RNA, 63 nt, hsa
caggcauuuaaaaaauuaaaaugaccaggcacaguggcucacgccuguaaucucggcacuuug

SEQ ID NO: 425401 - RNA, 63 nt, hsa
aucucaaaaaacauuauuuuuaaaauuagccugguggcucacgccuguaaucccagcacuuug

SEQ ID NO: 425402 - RNA, 63 nt, hsa
acuggcaagauuaacaaaauuaggccgggcaugguggcucacgccuguaaucccagcacuuug

SEQ ID NO: 425403 - RNA, 63 nt, hsa
uuguacagaagaggauucaaaacgccacguguaguggcucaugccuguaaucccaacacuuug

SEQ ID NO: 425404 - RNA, 63 nt, hsa
cuaauuagaaaauauaguuugaggccgggcacgguggcucacgccuguaaucccaguacuugg

SEQ ID NO: 425405 - RNA, 63 nt, hsa
guuuuaagauuuuuggguccugagccagccgugguggcucacaccuguaaucccagcacuuug

SEQ ID NO: 425406 - RNA, 63 nt, hsa
aucaagaauagucaaguuuuuuggccgggcaugguggcucaugccuguaaucccagcacuugg

SEQ ID NO: 425407 - RNA, 63 nt, hsa
uuuuacuuauaauaccaauuuaggcugggcgcaguggcucacgccuguaaucccagcacuuug

SEQ ID NO: 425408 - RNA, 63 nt, hsa
aaaaaaaacaaaaaccaguuuaggcuggguaugguggcucaccagcacuuugggaggcugagg

SEQ ID NO: 425409 - RNA, 63 nt, hsa
agaauuuuggaagagcaaauggggcugagugcaguggcucaugccuguaaucccagcacuuag

SEQ ID NO: 425410 - RNA, 63 nt, hsa
gccuauuaaaaaaugcuguccaggccaggcacaguggcucacaccuguaaucccaggacuucg

SEQ ID NO: 425411 - RNA, 63 nt, hsa
gguuaacuauuaaauguugaccuagccagcgcaguggcucaugccuguaaucccagcacuuug

SEQ ID NO: 425412 - RNA, 63 nt, hsa
uaagaaacuaugacuuguaguaagccgggcgcgguggcucacgccuguaaucccaacacuuug

SEQ ID NO: 425413 - RNA, 63 nt, hsa
cuucauaaaaaauguuaacgugggcugggcaugguggcucaugccuguaaucccagcacucug

SEQ ID NO: 425414 - RNA, 63 nt, hsa
ucauuucaagauaggcuuagcaggaugggcgcaguggcucacgccacuaaucccaacauuuua

SEQ ID NO: 425415 - RNA, 63 nt, hsa
cucuauuuuauaaauuaaaaaaggcugggugugguggcucacacccauaaucccaacacuuug

SEQ ID NO: 425416 - RNA, 63 nt, hsa
uggacugggccuugucacuggaggucguaggcaguggcucaucacccugguagggcugauagg

SEQ ID NO: 425417 - RNA, 63 nt, hsa
acgaggccuccccagcccugcccggugcaggagguggcucaguuauugaaccuuuugggaagc

SEQ ID NO: 425418 - RNA, 63 nt, hsa
aguacucauuuaaaaacuagagggcuaggcuuaguggcucacgccuguaaucucagcacuuug

SEQ ID NO: 425419 - RNA, 63 nt, hsa
gucccuuauauaaaaugguguaggccgggcaugguggcucacgccuguaaucccaguacuuug

SEQ ID NO: 425420 - RNA, 63 nt, hsa
ccucaaaaaaugcuaaaacuuuggcugggcaugguggcucacgccuguaaucccagcacuuug

SEQ ID NO: 425421 - RNA, 63 nt, hsa
uccauaagaagacauuuugacuggcugggugcgguggcucacgcuuguaaucccagcacuuug

SEQ ID NO: 425422 - RNA, 63 nt, hsa
gcugagucaagauuuauauuaaggcuggaagcuguggcucacaccuguaaucccagcauuuug

SEQ ID NO: 425423 - RNA, 63 nt, hsa
gacagguguuaaugcaucuaugggccaggugcaguggcucacuccuguaauccgagcaauuug

SEQ ID NO: 425424 - RNA, 63 nt, hsa
aagcuaaauaaaaauguagacauggcuggcgcaguggcucaugcuuguaauccuagcacuuuu

SEQ ID NO: 425425 - RNA, 63 nt, hsa
ccacaaaaaaaaugaaaaauaaaccugggugcgguggcucacaccuguaaucccagcacuuug

SEQ ID NO: 425426 - RNA, 63 nt, hsa
agcauauagaagaaaguuaauaggccgggcuugguggcucaugccuguaaucccagcacuuug

SEQ ID NO: 425427 - RNA, 63 nt, hsa
gcaacaauaaaaaguagacaugggcugggugcaguggcucacuccuguagucccaggacuuug

SEQ ID NO: 425428 - RNA, 63 nt, hsa
accaguaauaaagaaacauaagggcugggggugguggcucaugccuguaaucccagcacuuug

SEQ ID NO: 425429 - RNA, 63 nt, hsa
gacauagaaaauguuuugaauaggccaggcgcaguggcucacaccuguaaucccagcacguug

SEQ ID NO: 425430 - RNA, 63 nt, hsa
agccauguaaaaaguaaauaaugucugggcacaguggcucacgccuguaauccuagcacuuug

SEQ ID NO: 425431 - RNA, 63 nt, hsa
gaaagucccuggucaggucucagguagugcgguguggcucagcuggguuuuuaauuagcgcau

SEQ ID NO: 425432 - RNA, 63 nt, hsa
acaauuaauuccuggucuaguuuccugggccuuguggcucagcugccacuaaagagcuuuuug

SEQ ID NO: 425433 - RNA, 63 nt, hsa
ccugcaggaugggccgcgccgccguggcccgcuguggcucaccacggcccaggguggccuugg

SEQ ID NO: 425434 - RNA, 63 nt, hsa
auaagcuuaaacaaauaacuuuggccgggcacgguggcucacaccuauaaucccagcacuaug

SEQ ID NO: 425435 - RNA, 63 nt, hsa
uucaggaaucaaaagauaaaggggccgggugugguggcucacaccuguaaucccagcacuuug

SEQ ID NO: 425436 - RNA, 63 nt, hsa
guaaauuaguaguugaaauucuaggccggugcgguggcucaugccuguaaucccagcacugua

SEQ ID NO: 425437 - RNA, 63 nt, hsa
gaaauuagaaaaucaagcuuugggccaggugcgguggcucaugccuguaaucccagcacuaug

SEQ ID NO: 425438 - RNA, 63 nt, hsa
aguuuuuaaaaaauugcuuguaggcugagcgcgguggcucacgccuguaaucccagcacuuug

SEQ ID NO: 425439 - RNA, 63 nt, hsa
ucuuuaaagagaauaaauagagggccaggugugguggcucacgccugugaucccagcacuuug

SEQ ID NO: 425440 - RNA, 63 nt, hsa
uaaaagaugaaagagggaaauaggccauggacgguggcucacgccuguaaucccagcacuuua

SEQ ID NO: 425441 - RNA, 63 nt, hsa
gugacgagacugcacaagacaaagcucaggcaaguggcucaguaguuggccagcccagcaggg

SEQ ID NO: 425442 - RNA, 63 nt, hsa
uuuaaggauaaaaacuaacauuggccaggcacgguggcucacgccuguaaucccaacacuuua

SEQ ID NO: 425443 - RNA, 63 nt, hsa
ucagguauuuaaaauguuacauaugccggcgcaguggcucauguguguaaucccagcacucug

SEQ ID NO: 425444 - RNA, 63 nt, hsa
aauacaaaaaauacaaaaaauuagccgggcgcgguggcucacaccuguaaucccagcacuuug

SEQ ID NO: 425445 - RNA, 63 nt, hsa
cccuuagaaggauggcucugguggccgggcgcgguggcucaaaccuguaaucccagcacuuug

SEQ ID NO: 425446 - RNA, 63 nt, hsa
cuguuuuaaaauuacggugauuggccaggugcaguggcucacaccuguaaucccagcacuuug

SEQ ID NO: 425447 - RNA, 63 nt, hsa
accaucaaaguuacuaaaacauggccaggcgcaguggcucaugccuguaaucccagcacuuug

SEQ ID NO: 425448 - RNA, 63 nt, hsa
gagggacucccuccucuucagagaagcccuccuguggcucaggggcagcugcagggccagaug

SEQ ID NO: 425449 - RNA, 63 nt, hsa
acaaauuaaaacuggguuuccaggccuggugugguggcucacgccuguagccccagcuauugc

SEQ ID NO: 425450 - RNA, 63 nt, hsa
ggcuuuuaaaaacuuucaucuaggccacgugcgguggcucaugccuguaaucccggcacuuug

SEQ ID NO: 425451 - RNA, 63 nt, hsa
uugcccucuagaaagcaacugaggccaggugcgguggcucacgccuguaaucccagcacuuug

SEQ ID NO: 425452 - RNA, 63 nt, hsa
uugcaagagggagcucaaucuuggccgggcgccguggcucacgccuguaaucgcagcacuuug

SEQ ID NO: 425453 - RNA, 63 nt, hsa
ugucucaucaaaaacugaaguuagcugggugugguggcucaugccuguaaucccagcacuuug

SEQ ID NO: 425454 - RNA, 63 nt, hsa
ugaaguuagaaacaagguuaauagccaggcaugguggcucaugccuguaaucccagcacuuug

SEQ ID NO: 425455 - RNA, 63 nt, hsa
agacaaaaaauuugaagugccuggcugggcgugguggcucacgccuguaaucccagcacuuug

SEQ ID NO: 425456 - RNA, 63 nt, hsa
ucucaaaaaaaaaagaguucuagcccaggagcgguggcucacacuuguaaucccagcacuuug

SEQ ID NO: 425457 - RNA, 63 nt, hsa
uucauucucuauaagaguucuaggcggggcgugguggcucacacuuguaaucccagcacuuug

SEQ ID NO: 425458 - RNA, 63 nt, hsa
cugucucaaaaaaaugcagacuggccaggcacaguggcucacaccuguaauccgacuguaagc

SEQ ID NO: 425459 - RNA, 63 nt, hsa
ugggcugcuuguuaaaaaugcaggccaggugcgguggcucacaccuguaaucccagcgcuuug

SEQ ID NO: 425460 - RNA, 63 nt, hsa
gcagaucauuuaagaaguaacaggccgggcgcgguggcucacgccuguaaucccagcacuuug

SEQ ID NO: 425461 - RNA, 63 nt, hsa
ggaauuaaaaaguaaaauaauaggccaggcaugguggcucaugccuauaagcacccugggagg

SEQ ID NO: 425462 - RNA, 63 nt, hsa
auaaaaguaaaggagaauaacuggccgggcacgguggcucaugccuauaaaauuccagcacuu

SEQ ID NO: 425463 - RNA, 63 nt, hsa
ucaagcuuaguuggcagcacucuccacacuucuguggcucagugauuacugcuauuacuauau

SEQ ID NO: 425464 - RNA, 63 nt, hsa
gaagucaacuucuaucaacuucaggccaggcccguggcucaugccuguauaaucccagcacuu

SEQ ID NO: 425465 - RNA, 63 nt, hsa
aacucugaaaauguacauguauggcuggacgcgguggcucacgccuguaaucccagcacuuug

SEQ ID NO: 425466 - RNA, 63 nt, hsa
ccaagaugaagaagccccuucaggccagucgugguggcucaugccuguaaucccagcacuuug

SEQ ID NO: 425467 - RNA, 63 nt, hsa
uaauaucacuguauuaaaagucugccgggcacaguggcucacgccuguaaucccaacacuuug

SEQ ID NO: 425468 - RNA, 63 nt, hsa
uccacuaaaaguacaaaaaauuagcugggcgugguggcucaugccuguaaucccagcuacuca

SEQ ID NO: 425469 - RNA, 63 nt, hsa
cgguaagauguaaagaacucuuggccaggugugguggcucaugccuauaaucccagcacuuug

SEQ ID NO: 425470 - RNA, 63 nt, hsa
aaguauaagcuaauacccaucaggcugggugugguggcucacgccuguaauccuagcacuuug

SEQ ID NO: 425471 - RNA, 63 nt, hsa
aggagugaagacugugaugugugguccccauauguggcucagcaaagacucgagagaucaucc

SEQ ID NO: 425472 - RNA, 63 nt, hsa
gaagaauaaaguuaaccaagcaggccaggcacgguggcucacgccuauaaucccagcacuuag

SEQ ID NO: 425473 - RNA, 63 nt, hsa
cgggucucacucugucacccaggcuggagugcaguggcucaaugcaaccucugccccccaagu

SEQ ID NO: 425474 - RNA, 63 nt, hsa
guuugcauuaauaauccuuccaggccgggcacaguggcucacgccuguaaucccagcacuuug

SEQ ID NO: 425475 - RNA, 63 nt, hsa
gucgggaguuugaaaccagucucaccaggcgcaguggcucacgccuguaauuccagcauguug

SEQ ID NO: 425476 - RNA, 63 nt, hsa
uccagagaauaggggaagacugggccagacgcaguggcucaugccuguaaucccagcacucug

SEQ ID NO: 425477 - RNA, 63 nt, hsa
gagcuuucaaaaagcacaaauaggcuggacaugguggcucaugccuguaaucccaguacuuug

SEQ ID NO: 425478 - RNA, 63 nt, hsa
ccugacaguaagaaaauacucuggcuggucucaguggcucaugucuguaauucuagcauguua

SEQ ID NO: 425479 - RNA, 63 nt, hsa
gacccuguuuaaaaaagaaaaaggccaggcacgguggcucaugccuguaaucccagcuacgca

SEQ ID NO: 425480 - RNA, 63 nt, hsa
cuuaaaaauguucaaauaaccugguugggugugguggcucacacuuguaaucccagcacuuug

SEQ ID NO: 425481 - RNA, 63 nt, hsa
ggaguauguaugagguccauccuggcaugagcaguggcucacccaccggccuugaagagguga

SEQ ID NO: 425482 - RNA, 63 nt, hsa
agagacccgggucuggcaccgucgggauggcaaguggcucaauguccacuaucacugcucagg

SEQ ID NO: 425483 - RNA, 63 nt, hsa
aauuuagauauuccaauuugcaucagucuuucuguggcucaaauaaugaugauuauggaauga

SEQ ID NO: 425484 - RNA, 63 nt, hsa
guguuccuuauaagagaagauagggcgggcaugguggcucacgccuguaaucccagcacugug

SEQ ID NO: 425485 - RNA, 63 nt, hsa
aagaaauuuguguuauuugauaggccgggcaugguggcucaugccuguaaucccagcacuuug

SEQ ID NO: 425486 - RNA, 63 nt, hsa
ccauuaagauuauccaaagucaggcugggcgcaguggcucacgccuguaaucccagcacuuug

SEQ ID NO: 425487 - RNA, 63 nt, hsa
ccguuaacaaaaaaguaagucuggccgggcaugguggcucaagccuguaaucccagcacuuug

SEQ ID NO: 425488 - RNA, 63 nt, hsa
ugauuugcgucaacauuauaaaagagcacuucuguggcucauuuaaaagaaaaaaaagguuaa

SEQ ID NO: 425489 - RNA, 63 nt, hsa
uuuaauagagaaaugcuguuuaggcugggcuugguggcucacaucuguaauaccagcgcuuug

SEQ ID NO: 425490 - RNA, 63 nt, hsa
uuuuuacaaaaagucacuuuugggcugggcgcaguggcucacgccuguaaucccagcacuuug

SEQ ID NO: 425491 - RNA, 63 nt, hsa
uaucucauuuuacacaaagggaagucgggcaugguggcucaugccuguaaucucagcacuuug

SEQ ID NO: 425492 - RNA, 63 nt, hsa
aaaaaaaaaaaaaaaacuuuagaacugggugcaguggcucaugccuguaaucccagccagcac

SEQ ID NO: 425493 - RNA, 63 nt, hsa
uggcuucaagaguccuuacugaagccaggcaccguggcucacgucuguaaucccagcgcuuug

SEQ ID NO: 425494 - RNA, 63 nt, hsa
cauuuaaaagucugccuauccuggccaggugugguggcucacaccuguaaucccagcacuuug

SEQ ID NO: 425495 - RNA, 63 nt, hsa
guccagugaaaugauauauucuggcugggcacaguggcucacaccuguaauccuagcacuuug

SEQ ID NO: 425496 - RNA, 63 nt, hsa
ugaguucaagaaaaguacuucaggcugggcacaguggcucaugccugaaauccuagcacuuug

SEQ ID NO: 425497 - RNA, 63 nt, hsa
gaaaugguauuuagaaagcagcagucaggcacgguggcucaugccuguaaucccagcacuuug

SEQ ID NO: 425498 - RNA, 63 nt, hsa
caaguaacuaaagguugguguuggccaggcaugguggcucaugccuguaaucccagcauuuug

SEQ ID NO: 425499 - RNA, 63 nt, hsa
uacauacaagacuucaccauaaggccaggagcaguggcucacaccuuguaaucccagcacuuu

SEQ ID NO: 425500 - RNA, 63 nt, hsa
gacauuuaagcgaaguaaaagaggccgggugcgguggcucacgccuguaaucccaacacuuua

SEQ ID NO: 425501 - RNA, 63 nt, hsa
cuuugucaaaguuguauggcugaggcccacacgguggcucacuucuguaaucccaucacuuug

SEQ ID NO: 425502 - RNA, 63 nt, hsa
agucuaucaaacaagaaaugcuggcuuggcccgguggcucaugccuguaaucccagcacugug

SEQ ID NO: 425503 - RNA, 63 nt, hsa
gagguuuuaaaaucaaauuugaggccaggugcaguggcucaugggcggaggagggcagauuac

SEQ ID NO: 425504 - RNA, 63 nt, hsa
uuuuguauuacaaguugacaguugcuggguguaguggcucaugccuguaauccuagcaacucg

SEQ ID NO: 425505 - RNA, 63 nt, hsa
cuucuaugaagaaaaaaaugcaggcugggcgcgguggcucacgccuguaauccuagcacuuug

SEQ ID NO: 425506 - RNA, 63 nt, hsa
ucuacuaaaaaauacaaaaauuagccaggugugguggcucacgcuuauguagucccaguuacu

SEQ ID NO: 425507 - RNA, 63 nt, hsa
ucaucaaagagaagaccauguuggccgggcgcgguggcucacgccugcagucccagcacuuug

SEQ ID NO: 425508 - RNA, 63 nt, hsa
cuguaauccuagcacuuugggaggcugaggcagguggcucacuugaggucaggaauucaagac

SEQ ID NO: 425509 - RNA, 63 nt, hsa
aguguaugaaagucauguuacaggccgagugcgguggcucacaccuguaauccuagcacuuug

SEQ ID NO: 425510 - RNA, 63 nt, hsa
aaugucaagaauuaaucuaggaggccgggccugguggcucacaccuguaaucccagcucuuug

SEQ ID NO: 425511 - RNA, 63 nt, hsa
ggauccucaaaacucagaacguggccgggcgugguggcucacgccuguaaucccagcacuuug

SEQ ID NO: 425512 - RNA, 63 nt, hsa
uccacaaaauuuaaaaauuagcggccgggcgcaguggcucacgccuguaaucccagcacuuug

SEQ ID NO: 425513 - RNA, 63 nt, hsa
ugcauaaagagggaguuuugggggcugggcgccguggcucacucuuguaaucccaaaacuuua

SEQ ID NO: 425514 - RNA, 63 nt, hsa
aaauaaaaauagaagaagaaaaggccgggcaugguggcucaugccuguaaucccaacacuuug

SEQ ID NO: 425515 - RNA, 63 nt, hsa
ugguccucauaaaaaucuugagggccgggcaugguggcucacgccuguaaucucagcacuuug

SEQ ID NO: 425516 - RNA, 63 nt, hsa
ucaaucaaucaaucacuguccuggccaguugcaguggcucacgccuauaaucccaacacuucg

SEQ ID NO: 425517 - RNA, 63 nt, hsa
uugccauaaaaaggcugaaggcagccgggcgcaguggcucacgccuguaaucccagcacuuug

SEQ ID NO: 425518 - RNA, 63 nt, hsa
gcccaguuagaaaauaagucugggccggcggcgguggcucacaccugcauaggcagugcuuug

SEQ ID NO: 425519 - RNA, 63 nt, hsa
ucuuguuaagaagguucugccaggccgggcgcgguggcucacaccuguaaucccagcacuuug

SEQ ID NO: 425520 - RNA, 63 nt, hsa
ugagccuguauuaaaggaaucaggccaggcacaguggcucacgccuguaaucucagcacauug

SEQ ID NO: 425521 - RNA, 63 nt, hsa
acuucuuuuacaaguaacucuaggcugggugugguggcucacgccuauaaucccagcacuuug

SEQ ID NO: 425522 - RNA, 63 nt, hsa
gaucuuaauauucaugaccacuggccaggcgagguggcucacaccuguaaucccagcacuuug

SEQ ID NO: 425523 - RNA, 63 nt, hsa
caucucaaaaaaaaaaauaagaggccgggugcgguggcucaagccuguaaucccagcacuuug

SEQ ID NO: 425524 - RNA, 63 nt, hsa
cacaaguuaaagagguuuugcuggccagguaugguggcucacgccuguaaucccagcacuuug

SEQ ID NO: 425525 - RNA, 63 nt, hsa
agcugagaucacaccaaaaugggguggggcgcaguggcucacgccuguaaucccagcacuuug

SEQ ID NO: 425526 - RNA, 63 nt, hsa
ugcaugucuaaaagaaaauaugggccuggugugguggcucacaccuguaaucccaacacuuug

SEQ ID NO: 425527 - RNA, 63 nt, hsa
cuuagaaaguccuucacuacauggccaggugcaguggcucacgccuguagucccagguacuug

SEQ ID NO: 425528 - RNA, 63 nt, hsa
cuagacucacaagcugguccuuggccaggugcaguggcucacgccuguaaucccagcacuuug

SEQ ID NO: 425529 - RNA, 63 nt, hsa
caucuuuaaaaaaaaacaagacgggccggcacgguggcucacgccuguaaucccagcacugag

SEQ ID NO: 425530 - RNA, 63 nt, hsa
uauuuauuaaaaacuuaagaugggccaggugcgguggcucacaccuguaaucccagcauuuug

SEQ ID NO: 425531 - RNA, 63 nt, hsa
uagggaaagaguauaaauagccagccaggggcgguggcucaugccuguaaucccagcacuuug

SEQ ID NO: 425532 - RNA, 63 nt, hsa
ccuggcccuccugcugcugcugguccaggggguguggcucaguggcuggugguggaccuggag

SEQ ID NO: 425533 - RNA, 63 nt, hsa
caacaauaaaagacuuggccuuggcugggcaugguggcucacgccuguaaucccagcacuuug

SEQ ID NO: 425534 - RNA, 63 nt, hsa
acaaaaaaagacuuggccuuagggccgagugcgguggcucacgccuauaaucccagcacuuug

SEQ ID NO: 425535 - RNA, 63 nt, hsa
uuugaacagauguuuuggcucuggcugggugugguggcucacaccuguaaucccagcacuuug

SEQ ID NO: 425536 - RNA, 63 nt, hsa
aauguagaagcuauauguauauuuuguuaauuaguggcucauauuuaaaauaguucucugacu

SEQ ID NO: 425537 - RNA, 63 nt, hsa
guguccucauaagauaaggagaggccaggccugguggcucacgccuguaaucccagcacuuua

SEQ ID NO: 425538 - RNA, 63 nt, hsa
uuuuaaaaagacgaaaagugacggccaggugcaguggcucacgccuauaaucucagcacucug

SEQ ID NO: 425539 - RNA, 63 nt, hsa
auuaaaaaaagaagacgagagauagugggugugguggcucacaccugcaaucccagcacuuug

SEQ ID NO: 425540 - RNA, 63 nt, hsa
ucucuaaaaugcaauaauaaugggccaggugaaguggcucacaccuguaaucccagcacugug

SEQ ID NO: 425541 - RNA, 63 nt, hsa
cuaaauaaauaaauaaaaugcgggccaggcacaguggcucacaccuguaaucccagcacuaug

SEQ ID NO: 425542 - RNA, 63 nt, hsa
uguauagauuuuuaaaacugguggcugggcgugguggcucacgccuguaaucccagcacuuug

SEQ ID NO: 425543 - RNA, 63 nt, hsa
aaaauaaaaauaaaaauaaacuggccaggugcgguggcucacgcuugcaaucccagugcuuug

SEQ ID NO: 425544 - RNA, 63 nt, hsa
caggguucccacuacccccucuuuggggguagaguggcucauggaacucagagaaacauuuau

SEQ ID NO: 425545 - RNA, 63 nt, hsa
uaaccuuggucacauugagucauuccaggaugaguggcucaaguauuuccucagggaaaauac

SEQ ID NO: 425546 - RNA, 63 nt, hsa
uugcuuagaauaugacaugcugaaccaggcaugguggcucaugcuuguaaaccugaugcuuug

SEQ ID NO: 425547 - RNA, 63 nt, hsa
agcuuuaagaaguaccugcaagggucaggcgcaguggcucacaccuguaaucccagcacuuug

SEQ ID NO: 425548 - RNA, 63 nt, hsa
cuacaaaaaaauuaaaaaauuuggccuggugugguggcucaugccugugauccuagcacuuug

SEQ ID NO: 425549 - RNA, 63 nt, hsa
ccgggacuuaaaaagauaaggaggccaggugugguggcucaugccugcaaucccagcacugua

SEQ ID NO: 425550 - RNA, 63 nt, hsa
aaaaaaagggggggcgggggacgggugggugcaguggcucacaucuguaaccccagcacuuug

SEQ ID NO: 425551 - RNA, 63 nt, hsa
gcuuauaagaucuaacccuuauggccaggugcaguggcucacguauguaaucccagcacuuug

SEQ ID NO: 425552 - RNA, 63 nt, hsa
cuuuggucaagagucaguuuggggccaggcgugguggcucaugccuguaaucucagcacuuug

SEQ ID NO: 425553 - RNA, 63 nt, hsa
acguuuaaaaacaaaguuccccggccaggcacaguggcucacaccuguaaucccagcacuuug

SEQ ID NO: 425554 - RNA, 63 nt, hsa
cgucucaaaaagaaaaaguuuggaucaggcaggguggcucacaccuguaaucccugcacuuug

SEQ ID NO: 425555 - RNA, 63 nt, hsa
uacguuaaaaaaaaaaaguuugggccaggcacaguggcucaugccuguaaucccagcacuuug

SEQ ID NO: 425556 - RNA, 63 nt, hsa
augauguugaaagugaugcacaggacaggugugguggcucacaccuguaaucccagcacuuug

SEQ ID NO: 425557 - RNA, 63 nt, hsa
agaaacaucaaauuugcgaugagaccagaugcuguggcucaggccuguaaucccauaauuuuc

SEQ ID NO: 425558 - RNA, 63 nt, hsa
agaaugcgagaaauauaaaucaggccaggcacgguggcucacaccuguaaucccaguacuuug

SEQ ID NO: 425559 - RNA, 63 nt, hsa
uuguuuugaaauugaagagagaggccaggcgcgguggcucacaccuguaaucccagcacuuug

SEQ ID NO: 425560 - RNA, 63 nt, hsa
guaugggaagaaauucucuacuggccgggcacaguggcucacgccuguaaugccagcacuuug

SEQ ID NO: 425561 - RNA, 63 nt, hsa
uggauagaaaccuuacaaaggacgccgggcgugguggcucacgccuguaaucccagcacuuug

SEQ ID NO: 425562 - RNA, 63 nt, hsa
ucuauuuaaaaaaagaaguuauggccgggcgcgguggcucaugccuguaauaccagcacuuug

SEQ ID NO: 425563 - RNA, 63 nt, hsa
cuugugaauauaaaguuacauuggcugggugugguggcucaugccuauaaucccaguacuuua

SEQ ID NO: 425564 - RNA, 63 nt, hsa
ugugcagggggaugggccagggccaggcuaaggguggcucaguuccaucaucuggaggucaga

SEQ ID NO: 425565 - RNA, 63 nt, hsa
auggggcaggcugggguguggguguggccugggguggcucagggcuggaacugcugccugauu

SEQ ID NO: 425566 - RNA, 63 nt, hsa
guucuuagaaaagccccagcauggccgggcaugguggcucaugccuauuaucccagcacuuug

SEQ ID NO: 425567 - RNA, 63 nt, hsa
ccgcauaccccccuguccagcagggcacuguggguggcucacccuagauuguggcccagaucu

SEQ ID NO: 425568 - RNA, 63 nt, hsa
guagcugcauuacaaaaaagaagccugggcacuguggcucacuccuguaaucucagaacuuug

SEQ ID NO: 425569 - RNA, 63 nt, hsa
ccuccaauuaaugcagcccugaggugucuggcuguggcucaagauuuggccccaugcagaccc

SEQ ID NO: 425570 - RNA, 63 nt, hsa
gagagaagagucuauuaugagcugguuacuacuguggcucaauccuauuggggaccuuuuaaa

SEQ ID NO: 425571 - RNA, 63 nt, hsa
uggauaaggaugcacuggaagaacugccagaauguggcucaugcucugaguacuguuccugua

SEQ ID NO: 425572 - RNA, 63 nt, hsa
cuauuuaaaaaugaaauuacaggcccgggcacgguggcucacaccuguaaucccagcacuuug

SEQ ID NO: 425573 - RNA, 63 nt, hsa
uacuuuuaaaaauauaaguuagggcuaggcacaguggcucaugccuauaaucucagcacuuuu

SEQ ID NO: 425574 - RNA, 63 nt, hsa
gagcaacaacaaaaaauguuuaagccgggcgcgguggcucacaucuguaaucccagcacuuug

SEQ ID NO: 425575 - RNA, 63 nt, hsa
cucuacaaaaaauacaaaaauuagccaugcaugguggcucaugccuguagucccagcuacuug

SEQ ID NO: 425576 - RNA, 63 nt, hsa
gugggccugaggugcccagcucagggcagccagguggcucaugggcuguagugagccagcucc

SEQ ID NO: 425577 - RNA, 63 nt, hsa
uuacucagcccuuuauggcccauggggaacuccguggcucagggagagcugaacuccaggggu

SEQ ID NO: 425578 - RNA, 63 nt, hsa
ccauuauaaauucuuaguucagggcugggcgcgguggcucaugccuguaacccuagcacuuug

SEQ ID NO: 425579 - RNA, 63 nt, hsa
uuuuuuaaaaccuuaaaugucuggccgggugugguggcucaucccuauaauccuacacuuugg

SEQ ID NO: 425580 - RNA, 63 nt, hsa
gcuaauucccccuucucuggugccauaaauuauguggcucauaguaggugcaccauccaagga

SEQ ID NO: 425581 - RNA, 63 nt, hsa
gugagacuccgucucaaaacaaaacaaaaguggguggcucacggguccggagguuaugucuuc

SEQ ID NO: 425582 - RNA, 63 nt, hsa
uugguccuuaaaacugggcgguggccgggcgugguggcucacgcugaggucaggaguucgaga

SEQ ID NO: 425583 - RNA, 64 nt, hsa; identical to SEQ ID NO: 56858

SEQ ID NO: 425584 - RNA, 64 nt, hsa; identical to SEQ ID NO: 56859

SEQ ID NO: 425585 - RNA, 64 nt, hsa; identical to SEQ ID NO: 56860

SEQ ID NO: 425586 - RNA, 64 nt, hsa; identical to SEQ ID NO: 56861

SEQ ID NO: 425587 - RNA, 64 nt, hsa; identical to SEQ ID NO: 56862

SEQ ID NO: 425588 - RNA, 64 nt, hsa; identical to SEQ ID NO: 56863

SEQ ID NO: 425589 - RNA, 64 nt, hsa; identical to SEQ ID NO: 56864

SEQ ID NO: 425590 - RNA, 64 nt, hsa; identical to SEQ ID NO: 56865

SEQ ID NO: 425591 - RNA, 64 nt, hsa; identical to SEQ ID NO: 56866

SEQ ID NO: 425592 - RNA, 64 nt, hsa; identical to SEQ ID NO: 56867

SEQ ID NO: 425593 - RNA, 64 nt, hsa; identical to SEQ ID NO: 56868

SEQ ID NO: 425594 - RNA, 64 nt, hsa; identical to SEQ ID NO: 56869

SEQ ID NO: 425595 - RNA, 64 nt, hsa; identical to SEQ ID NO: 56870

SEQ ID NO: 425596 - RNA, 64 nt, hsa; identical to SEQ ID NO: 56871

SEQ ID NO: 425597 - RNA, 64 nt, hsa; identical to SEQ ID NO: 56872

SEQ ID NO: 425598 - RNA, 64 nt, hsa; identical to SEQ ID NO: 56873

SEQ ID NO: 425599 - RNA, 64 nt, hsa; identical to SEQ ID NO: 56874

SEQ ID NO: 425600 - RNA, 64 nt, hsa; identical to SEQ ID NO: 56875

SEQ ID NO: 425601 - RNA, 64 nt, hsa; identical to SEQ ID NO: 56876

SEQ ID NO: 425602 - RNA, 64 nt, hsa; identical to SEQ ID NO: 56877

SEQ ID NO: 425603 - RNA, 64 nt, hsa; identical to SEQ ID NO: 56878

SEQ ID NO: 425604 - RNA, 64 nt, hsa; identical to SEQ ID NO: 56879

SEQ ID NO: 425605 - RNA, 64 nt, hsa; identical to SEQ ID NO: 56880

SEQ ID NO: 425606 - RNA, 64 nt, hsa; identical to SEQ ID NO: 56881

SEQ ID NO: 425607 - RNA, 64 nt, hsa; identical to SEQ ID NO: 370200

SEQ ID NO: 425608 - RNA, 64 nt, hsa; identical to SEQ ID NO: 370201

SEQ ID NO: 425609 - RNA, 64 nt, hsa; identical to SEQ ID NO: 370202

SEQ ID NO: 425610 - RNA, 64 nt, hsa; identical to SEQ ID NO: 370203

SEQ ID NO: 425611 - RNA, 64 nt, hsa; identical to SEQ ID NO: 370204

SEQ ID NO: 425612 - RNA, 64 nt, hsa; identical to SEQ ID NO: 370205

SEQ ID NO: 425613 - RNA, 64 nt, hsa; identical to SEQ ID NO: 370206

SEQ ID NO: 425614 - RNA, 64 nt, hsa; identical to SEQ ID NO: 370207

SEQ ID NO: 425615 - RNA, 64 nt, hsa; identical to SEQ ID NO: 370208

SEQ ID NO: 425616 - RNA, 64 nt, hsa; identical to SEQ ID NO: 370209

SEQ ID NO: 425617 - RNA, 64 nt, hsa; identical to SEQ ID NO: 370210

SEQ ID NO: 425618 - RNA, 64 nt, hsa; identical to SEQ ID NO: 370211

SEQ ID NO: 425619 - RNA, 64 nt, hsa; identical to SEQ ID NO: 90763

SEQ ID NO: 425620 - RNA, 64 nt, hsa; identical to SEQ ID NO: 90764

SEQ ID NO: 425621 - RNA, 64 nt, hsa; identical to SEQ ID NO: 90765

SEQ ID NO: 425622 - RNA, 64 nt, hsa; identical to SEQ ID NO: 90766

SEQ ID NO: 425623 - RNA, 64 nt, hsa; identical to SEQ ID NO: 90767

SEQ ID NO: 425624 - RNA, 64 nt, hsa; identical to SEQ ID NO: 90768

SEQ ID NO: 425625 - RNA, 64 nt, hsa; identical to SEQ ID NO: 90769

SEQ ID NO: 425626 - RNA, 64 nt, hsa; identical to SEQ ID NO: 90770

SEQ ID NO: 425627 - RNA, 64 nt, hsa; identical to SEQ ID NO: 90771

SEQ ID NO: 425628 - RNA, 64 nt, hsa; identical to SEQ ID NO: 90772

SEQ ID NO: 425629 - RNA, 64 nt, hsa; identical to SEQ ID NO: 90773

SEQ ID NO: 425630 - RNA, 64 nt, hsa; identical to SEQ ID NO: 90774

SEQ ID NO: 425631 - RNA, 64 nt, hsa; identical to SEQ ID NO: 90775

SEQ ID NO: 425632 - RNA, 64 nt, hsa; identical to SEQ ID NO: 90776

SEQ ID NO: 425633 - RNA, 64 nt, hsa; identical to SEQ ID NO: 90777

SEQ ID NO: 425634 - RNA, 64 nt, hsa; identical to SEQ ID NO: 90778

SEQ ID NO: 425635 - RNA, 64 nt, hsa; identical to SEQ ID NO: 90779

SEQ ID NO: 425636 - RNA, 64 nt, hsa; identical to SEQ ID NO: 90780

SEQ ID NO: 425637 - RNA, 64 nt, hsa; identical to SEQ ID NO: 90781

SEQ ID NO: 425638 - RNA, 64 nt, hsa; identical to SEQ ID NO: 90782

SEQ ID NO: 425639 - RNA, 64 nt, hsa; identical to SEQ ID NO: 90783

SEQ ID NO: 425640 - RNA, 64 nt, hsa; identical to SEQ ID NO: 90784

SEQ ID NO: 425641 - RNA, 64 nt, hsa; identical to SEQ ID NO: 90785

SEQ ID NO: 425642 - RNA, 64 nt, hsa; identical to SEQ ID NO: 90786

SEQ ID NO: 425643 - RNA, 64 nt, hsa; identical to SEQ ID NO: 90787

SEQ ID NO: 425644 - RNA, 64 nt, hsa; identical to SEQ ID NO: 90788

SEQ ID NO: 425645 - RNA, 64 nt, hsa; identical to SEQ ID NO: 90789

SEQ ID NO: 425646 - RNA, 64 nt, hsa; identical to SEQ ID NO: 90790

SEQ ID NO: 425647 - RNA, 64 nt, hsa; identical to SEQ ID NO: 90791

SEQ ID NO: 425648 - RNA, 64 nt, hsa; identical to SEQ ID NO: 90792

SEQ ID NO: 425649 - RNA, 64 nt, hsa; identical to SEQ ID NO: 90793

SEQ ID NO: 425650 - RNA, 64 nt, hsa; identical to SEQ ID NO: 90794

SEQ ID NO: 425651 - RNA, 64 nt, hsa; identical to SEQ ID NO: 90795

SEQ ID NO: 425652 - RNA, 64 nt, hsa; identical to SEQ ID NO: 90796

SEQ ID NO: 425653 - RNA, 64 nt, hsa; identical to SEQ ID NO: 90797

SEQ ID NO: 425654 - RNA, 64 nt, hsa; identical to SEQ ID NO: 90798

SEQ ID NO: 425655 - RNA, 64 nt, hsa; identical to SEQ ID NO: 90799

SEQ ID NO: 425656 - RNA, 64 nt, hsa; identical to SEQ ID NO: 90800

SEQ ID NO: 425657 - RNA, 64 nt, hsa; identical to SEQ ID NO: 90801

SEQ ID NO: 425658 - RNA, 64 nt, hsa; identical to SEQ ID NO: 90802

SEQ ID NO: 425659 - RNA, 64 nt, hsa; identical to SEQ ID NO: 90803

SEQ ID NO: 425660 - RNA, 64 nt, hsa; identical to SEQ ID NO: 90804

SEQ ID NO: 425661 - RNA, 64 nt, hsa; identical to SEQ ID NO: 90805

SEQ ID NO: 425662 - RNA, 64 nt, hsa; identical to SEQ ID NO: 90806

SEQ ID NO: 425663 - RNA, 64 nt, hsa; identical to SEQ ID NO: 90807

SEQ ID NO: 425664 - RNA, 64 nt, hsa; identical to SEQ ID NO: 90808

SEQ ID NO: 425665 - RNA, 64 nt, hsa; identical to SEQ ID NO: 90809

SEQ ID NO: 425666 - RNA, 64 nt, hsa; identical to SEQ ID NO: 90810

SEQ ID NO: 425667 - RNA, 64 nt, hsa; identical to SEQ ID NO: 90811

SEQ ID NO: 425668 - RNA, 64 nt, hsa; identical to SEQ ID NO: 90812

SEQ ID NO: 425669 - RNA, 64 nt, hsa; identical to SEQ ID NO: 90813

SEQ ID NO: 425670 - RNA, 64 nt, hsa; identical to SEQ ID NO: 90814

SEQ ID NO: 425671 - RNA, 64 nt, hsa; identical to SEQ ID NO: 90815

SEQ ID NO: 425672 - RNA, 64 nt, hsa; identical to SEQ ID NO: 90816

SEQ ID NO: 425673 - RNA, 64 nt, hsa; identical to SEQ ID NO: 90817

SEQ ID NO: 425674 - RNA, 64 nt, hsa; identical to SEQ ID NO: 90818

SEQ ID NO: 425675 - RNA, 64 nt, hsa; identical to SEQ ID NO: 90819

SEQ ID NO: 425676 - RNA, 64 nt, hsa; identical to SEQ ID NO: 90820

SEQ ID NO: 425677 - RNA, 64 nt, hsa; identical to SEQ ID NO: 90821

SEQ ID NO: 425678 - RNA, 64 nt, hsa; identical to SEQ ID NO: 90822

SEQ ID NO: 425679 - RNA, 64 nt, hsa; identical to SEQ ID NO: 90823

SEQ ID NO: 425680 - RNA, 64 nt, hsa; identical to SEQ ID NO: 90824

SEQ ID NO: 425681 - RNA, 64 nt, hsa; identical to SEQ ID NO: 90825

SEQ ID NO: 425682 - RNA, 64 nt, hsa; identical to SEQ ID NO: 90826

SEQ ID NO: 425683 - RNA, 64 nt, hsa; identical to SEQ ID NO: 90827

SEQ ID NO: 425684 - RNA, 64 nt, hsa; identical to SEQ ID NO: 90828

SEQ ID NO: 425685 - RNA, 64 nt, hsa; identical to SEQ ID NO: 90829

SEQ ID NO: 425686 - RNA, 64 nt, hsa; identical to SEQ ID NO: 90830

SEQ ID NO: 425687 - RNA, 64 nt, hsa; identical to SEQ ID NO: 90831

SEQ ID NO: 425688 - RNA, 64 nt, hsa; identical to SEQ ID NO: 90832

SEQ ID NO: 425689 - RNA, 64 nt, hsa; identical to SEQ ID NO: 90833

SEQ ID NO: 425690 - RNA, 64 nt, hsa; identical to SEQ ID NO: 90834

SEQ ID NO: 425691 - RNA, 64 nt, hsa; identical to SEQ ID NO: 90835

SEQ ID NO: 425692 - RNA, 64 nt, hsa; identical to SEQ ID NO: 90836

SEQ ID NO: 425693 - RNA, 64 nt, hsa; identical to SEQ ID NO: 90837

SEQ ID NO: 425694 - RNA, 64 nt, hsa; identical to SEQ ID NO: 90838

SEQ ID NO: 425695 - RNA, 64 nt, hsa; identical to SEQ ID NO: 90839

SEQ ID NO: 425696 - RNA, 64 nt, hsa; identical to SEQ ID NO: 90840

SEQ ID NO: 425697 - RNA, 64 nt, hsa; identical to SEQ ID NO: 90841

SEQ ID NO: 425698 - RNA, 64 nt, hsa; identical to SEQ ID NO: 90842

SEQ ID NO: 425699 - RNA, 64 nt, hsa; identical to SEQ ID NO: 90843

SEQ ID NO: 425700 - RNA, 64 nt, hsa; identical to SEQ ID NO: 90844

SEQ ID NO: 425701 - RNA, 64 nt, hsa; identical to SEQ ID NO: 90845

SEQ ID NO: 425702 - RNA, 64 nt, hsa; identical to SEQ ID NO: 90846

SEQ ID NO: 425703 - RNA, 64 nt, hsa; identical to SEQ ID NO: 90847

SEQ ID NO: 425704 - RNA, 64 nt, hsa; identical to SEQ ID NO: 90848

SEQ ID NO: 425705 - RNA, 64 nt, hsa; identical to SEQ ID NO: 90849

SEQ ID NO: 425706 - RNA, 64 nt, hsa; identical to SEQ ID NO: 90850

SEQ ID NO: 425707 - RNA, 64 nt, hsa; identical to SEQ ID NO: 90851

SEQ ID NO: 425708 - RNA, 64 nt, hsa; identical to SEQ ID NO: 90852

SEQ ID NO: 425709 - RNA, 64 nt, hsa; identical to SEQ ID NO: 90853

SEQ ID NO: 425710 - RNA, 64 nt, hsa; identical to SEQ ID NO: 90854

SEQ ID NO: 425711 - RNA, 64 nt, hsa; identical to SEQ ID NO: 90855

SEQ ID NO: 425712 - RNA, 64 nt, hsa; identical to SEQ ID NO: 90856

SEQ ID NO: 425713 - RNA, 64 nt, hsa; identical to SEQ ID NO: 90857

SEQ ID NO: 425714 - RNA, 64 nt, hsa; identical to SEQ ID NO: 90858

SEQ ID NO: 425715 - RNA, 64 nt, hsa; identical to SEQ ID NO: 90859

SEQ ID NO: 425716 - RNA, 64 nt, hsa; identical to SEQ ID NO: 90860

SEQ ID NO: 425717 - RNA, 64 nt, hsa; identical to SEQ ID NO: 90861

SEQ ID NO: 425718 - RNA, 64 nt, hsa; identical to SEQ ID NO: 90862

SEQ ID NO: 425719 - RNA, 64 nt, hsa; identical to SEQ ID NO: 90863

SEQ ID NO: 425720 - RNA, 64 nt, hsa; identical to SEQ ID NO: 90864

SEQ ID NO: 425721 - RNA, 64 nt, hsa; identical to SEQ ID NO: 90865

SEQ ID NO: 425722 - RNA, 64 nt, hsa; identical to SEQ ID NO: 90866

SEQ ID NO: 425723 - RNA, 64 nt, hsa; identical to SEQ ID NO: 90867

SEQ ID NO: 425724 - RNA, 64 nt, hsa; identical to SEQ ID NO: 90868

SEQ ID NO: 425725 - RNA, 64 nt, hsa; identical to SEQ ID NO: 90869

SEQ ID NO: 425726 - RNA, 64 nt, hsa; identical to SEQ ID NO: 90870

SEQ ID NO: 425727 - RNA, 64 nt, hsa; identical to SEQ ID NO: 90871

SEQ ID NO: 425728 - RNA, 64 nt, hsa; identical to SEQ ID NO: 90872

SEQ ID NO: 425729 - RNA, 64 nt, hsa; identical to SEQ ID NO: 90873

SEQ ID NO: 425730 - RNA, 64 nt, hsa; identical to SEQ ID NO: 90874

SEQ ID NO: 425731 - RNA, 64 nt, hsa; identical to SEQ ID NO: 90875

SEQ ID NO: 425732 - RNA, 64 nt, hsa; identical to SEQ ID NO: 90876

SEQ ID NO: 425733 - RNA, 64 nt, hsa; identical to SEQ ID NO: 90877

SEQ ID NO: 425734 - RNA, 64 nt, hsa; identical to SEQ ID NO: 90878

SEQ ID NO: 425735 - RNA, 64 nt, hsa; identical to SEQ ID NO: 90879

SEQ ID NO: 425736 - RNA, 64 nt, hsa; identical to SEQ ID NO: 90880

SEQ ID NO: 425737 - RNA, 64 nt, hsa; identical to SEQ ID NO: 90881

SEQ ID NO: 425738 - RNA, 64 nt, hsa; identical to SEQ ID NO: 90882

SEQ ID NO: 425739 - RNA, 64 nt, hsa; identical to SEQ ID NO: 90883

SEQ ID NO: 425740 - RNA, 64 nt, hsa; identical to SEQ ID NO: 90884

SEQ ID NO: 425741 - RNA, 64 nt, hsa; identical to SEQ ID NO: 90885

SEQ ID NO: 425742 - RNA, 64 nt, hsa; identical to SEQ ID NO: 90886

SEQ ID NO: 425743 - RNA, 64 nt, hsa; identical to SEQ ID NO: 90887

SEQ ID NO: 425744 - RNA, 64 nt, hsa; identical to SEQ ID NO: 90888

SEQ ID NO: 425745 - RNA, 64 nt, hsa; identical to SEQ ID NO: 90889

SEQ ID NO: 425746 - RNA, 64 nt, hsa; identical to SEQ ID NO: 90890

SEQ ID NO: 425747 - RNA, 64 nt, hsa; identical to SEQ ID NO: 90891

SEQ ID NO: 425748 - RNA, 64 nt, hsa; identical to SEQ ID NO: 90892

SEQ ID NO: 425749 - RNA, 64 nt, hsa; identical to SEQ ID NO: 90893

SEQ ID NO: 425750 - RNA, 64 nt, hsa; identical to SEQ ID NO: 90894

SEQ ID NO: 425751 - RNA, 64 nt, hsa; identical to SEQ ID NO: 90895

SEQ ID NO: 425752 - RNA, 64 nt, hsa; identical to SEQ ID NO: 90896

SEQ ID NO: 425753 - RNA, 64 nt, hsa; identical to SEQ ID NO: 90897

SEQ ID NO: 425754 - RNA, 64 nt, hsa; identical to SEQ ID NO: 90898

SEQ ID NO: 425755 - RNA, 64 nt, hsa; identical to SEQ ID NO: 90899

SEQ ID NO: 425756 - RNA, 54 nt, hsa; identical to SEQ ID NO: 90900

SEQ ID NO: 425757 - RNA, 64 nt, hsa; identical to SEQ ID NO: 90901

SEQ ID NO: 425758 - RNA, 64 nt, hsa; identical to SEQ ID NO: 90902

SEQ ID NO: 425759 - RNA, 64 nt, hsa; identical to SEQ ID NO: 90903

SEQ ID NO: 425760 - RNA, 64 nt, hsa; identical to SEQ ID NO: 90904

SEQ ID NO: 425761 - RNA, 64 nt, hsa; identical to SEQ ID NO: 90905

SEQ ID NO: 425762 - RNA, 64 nt, hsa; identical to SEQ ID NO: 90906

SEQ ID NO: 425763 - RNA, 64 nt, hsa; identical to SEQ ID NO: 90907

SEQ ID NO: 425764 - RNA, 64 nt, hsa; identical to SEQ ID NO: 90908

SEQ ID NO: 425765 - RNA, 64 nt, hsa; identical to SEQ ID NO: 90909

SEQ ID NO: 425766 - RNA, 64 nt, hsa; identical to SEQ ID NO: 90910

SEQ ID NO: 425767 - RNA, 64 nt, hsa; identical to SEQ ID NO: 90911

SEQ ID NO: 425768 - RNA, 64 nt, hsa; identical to SEQ ID NO: 90912

SEQ ID NO: 425769 - RNA, 64 nt, hsa; identical to SEQ ID NO: 90913

SEQ ID NO: 425770 - RNA, 64 nt, hsa; identical to SEQ ID NO: 90914

SEQ ID NO: 425771 - RNA, 64 nt, hsa; identical to SEQ ID NO: 90915

SEQ ID NO: 425772 - RNA, 64 nt, hsa; identical to SEQ ID NO: 90916

SEQ ID NO: 425773 - RNA, 64 nt, hsa; identical to SEQ ID NO: 90917

SEQ ID NO: 425774 - RNA, 64 nt, hsa; identical to SEQ ID NO: 90918

SEQ ID NO: 425775 - RNA, 64 nt, hsa; identical to SEQ ID NO: 90919

SEQ ID NO: 425776 - RNA, 64 nt, hsa; identical to SEQ ID NO: 90920

SEQ ID NO: 425777 - RNA, 64 nt, hsa; identical to SEQ ID NO: 90921

SEQ ID NO: 425778 - RNA, 64 nt, hsa; identical to SEQ ID NO: 90922

SEQ ID NO: 425779 - RNA, 64 nt, hsa; identical to SEQ ID NO: 90923

SEQ ID NO: 425780 - RNA, 64 nt, hsa; identical to SEQ ID NO: 90924

SEQ ID NO: 425781 - RNA, 64 nt, hsa; identical to SEQ ID NO: 90925

SEQ ID NO: 425782 - RNA, 64 nt, hsa; identical to SEQ ID NO: 90926

SEQ ID NO: 425783 - RNA, 64 nt, hsa; identical to SEQ ID NO: 90927

SEQ ID NO: 425784 - RNA, 64 nt, hsa; identical to SEQ ID NO: 90928

SEQ ID NO: 425785 - RNA, 64 nt, hsa; identical to SEQ ID NO: 90929

SEQ ID NO: 425786 - RNA, 64 nt, hsa; identical to SEQ ID NO: 90811

SEQ ID NO: 425787 - RNA, 64 nt, hsa; identical to SEQ ID NO: 90931

SEQ ID NO: 425788 - RNA, 64 nt, hsa; identical to SEQ ID NO: 90932

SEQ ID NO: 425789 - RNA, 64 nt, hsa; identical to SEQ ID NO: 90933

SEQ ID NO: 425790 - RNA, 64 nt, hsa; identical to SEQ ID NO: 90934

SEQ ID NO: 425791 - RNA, 64 nt, hsa; identical to SEQ ID NO: 90935

SEQ ID NO: 425792 - RNA, 64 nt, hsa; identical to SEQ ID NO: 90936

SEQ ID NO: 425793 - RNA, 64 nt, hsa; identical to SEQ ID NO: 90937

SEQ ID NO: 425794 - RNA, 64 nt, hsa; identical to SEQ ID NO: 90938

SEQ ID NO: 425795 - RNA, 64 nt, hsa; identical to SEQ ID NO: 90939

SEQ ID NO: 425796 - RNA, 64 nt, hsa; identical to SEQ ID NO: 90940

SEQ ID NO: 425797 - RNA, 64 nt, hsa; identical to SEQ ID NO: 90941

SEQ ID NO: 425798 - RNA, 64 nt, hsa; identical to SEQ ID NO: 90942

SEQ ID NO: 425799 - RNA, 64 nt, hsa; identical to SEQ ID NO: 90943

SEQ ID NO: 425800 - RNA, 64 nt, hsa; identical to SEQ ID NO: 90944

SEQ ID NO: 425801 - RNA, 64 nt, hsa; identical to SEQ ID NO: 90945

SEQ ID NO: 425802 - RNA, 64 nt, hsa; identical to SEQ ID NO: 90946

SEQ ID NO: 425803 - RNA, 64 nt, hsa; identical to SEQ ID NO: 90947

SEQ ID NO: 425804 - RNA, 64 nt, hsa; identical to SEQ ID NO: 90948

SEQ ID NO: 425805 - RNA, 64 nt, hsa; identical to SEQ ID NO: 90949

SEQ ID NO: 425806 - RNA, 64 nt, hsa; identical to SEQ ID NO: 90950

SEQ ID NO: 425807 - RNA, 64 nt, hsa; identical to SEQ ID NO: 90951

SEQ ID NO: 425808 - RNA, 64 nt, hsa; identical to SEQ ID NO: 90952

SEQ ID NO: 425809 - RNA, 64 nt, hsa; identical to SEQ ID NO: 90953

SEQ ID NO: 425810 - RNA, 64 nt, hsa; identical to SEQ ID NO: 90954

SEQ ID NO: 425811 - RNA, 64 nt, hsa; identical to SEQ ID NO: 90955

SEQ ID NO: 425812 - RNA, 64 nt, hsa; identical to SEQ ID NO: 90956

SEQ ID NO: 425813 - RNA, 64 nt, hsa; identical to SEQ ID NO: 90957

SEQ ID NO: 425814 - RNA, 64 nt, hsa; identical to SEQ ID NO: 90958

SEQ ID NO: 425815 - RNA, 64 nt, hsa; identical to SEQ ID NO: 90959

SEQ ID NO: 425816 - RNA, 64 nt, hsa; identical to SEQ ID NO: 90960

SEQ ID NO: 425817 - RNA, 64 nt, hsa; identical to SEQ ID NO: 90961

SEQ ID NO: 425818 - RNA, 64 nt, hsa; identical to SEQ ID NO: 90962

SEQ ID NO: 425819 - RNA, 64 nt, hsa; identical to SEQ ID NO: 90963

SEQ ID NO: 425820 - RNA, 64 nt, hsa; identical to SEQ ID NO: 90964

SEQ ID NO: 425821 - RNA, 64 nt, hsa; identical to SEQ ID NO: 90965

SEQ ID NO: 425822 - RNA, 64 nt, hsa; identical to SEQ ID NO: 90966

SEQ ID NO: 425823 - RNA, 64 nt, hsa; identical to SEQ ID NO: 90967

SEQ ID NO: 425824 - RNA, 64 nt, hsa; identical to SEQ ID NO: 90968

SEQ ID NO: 425825 - RNA, 64 nt, hsa; identical to SEQ ID NO: 90969

SEQ ID NO: 425826 - RNA, 64 nt, hsa; identical to SEQ ID NO: 90970

SEQ ID NO: 425827 - RNA, 64 nt, hsa; identical to SEQ ID NO: 90971

SEQ ID NO: 425828 - RNA, 64 nt, hsa; identical to SEQ ID NO: 90972

SEQ ID NO: 425829 - RNA, 64 nt, hsa; identical to SEQ ID NO: 90973

SEQ ID NO: 425830 - RNA, 64 nt, hsa; identical to SEQ ID NO: 90974

SEQ ID NO: 425831 - RNA, 64 nt, hsa; identical to SEQ ID NO: 90975

SEQ ID NO: 425832 - RNA, 64 nt, hsa; identical to SEQ ID NO: 90976

SEQ ID NO: 425833 - RNA, 64 nt, hsa; identical to SEQ ID NO: 90977

SEQ ID NO: 425834 - RNA, 64 nt, hsa; identical to SEQ ID NO: 90978

SEQ ID NO: 425835 - RNA, 64 nt, hsa; identical to SEQ ID NO: 90979

SEQ ID NO: 425836 - RNA, 64 nt, hsa; identical to SEQ ID NO: 90980

SEQ ID NO: 425837 - RNA, 64 nt, hsa; identical to SEQ ID NO: 90981

SEQ ID NO: 425838 - RNA, 64 nt, hsa; identical to SEQ ID NO: 90982

SEQ ID NO: 425839 - RNA, 64 nt, hsa; identical to SEQ ID NO: 90983

SEQ ID NO: 425840 - RNA, 64 nt, hsa; identical to SEQ ID NO: 90984

SEQ ID NO: 425841 - RNA, 64 nt, hsa; identical to SEQ ID NO: 90985

SEQ ID NO: 425842 - RNA, 64 nt, hsa; identical to SEQ ID NO: 90986

SEQ ID NO: 425843 - RNA, 64 nt, hsa; identical to SEQ ID NO: 90987

SEQ ID NO: 425844 - RNA, 64 nt, hsa; identical to SEQ ID NO: 90988

SEQ ID NO: 425845 - RNA, 64 nt, hsa; identical to SEQ ID NO: 90989

SEQ ID NO: 425846 - RNA, 64 nt, hsa; identical to SEQ ID NO: 90990

SEQ ID NO: 425847 - RNA, 64 nt, hsa; identical to SEQ ID NO: 90991

SEQ ID NO: 425848 - RNA, 64 nt, hsa; identical to SEQ ID NO: 90992

SEQ ID NO: 425849 - RNA, 64 nt, hsa; identical to SEQ ID NO: 90993

SEQ ID NO: 425850 - RNA, 64 nt, hsa; identical to SEQ ID NO: 90994

SEQ ID NO: 425851 - RNA, 64 nt, hsa; identical to SEQ ID NO: 90995

SEQ ID NO: 425852 - RNA, 64 nt, hsa; identical to SEQ ID NO: 90996

SEQ ID NO: 425853 - RNA, 64 nt, hsa; identical to SEQ ID NO: 90997

SEQ ID NO: 425854 - RNA, 64 nt, hsa; identical to SEQ ID NO: 90998

SEQ ID NO: 425855 - RNA, 64 nt, hsa; identical to SEQ ID NO: 90999

SEQ ID NO: 425856 - RNA, 64 nt, hsa; identical to SEQ ID NO: 91000

SEQ ID NO: 425857 - RNA, 64 nt, hsa; identical to SEQ ID NO: 91001

SEQ ID NO: 425858 - RNA, 64 nt, hsa; identical to SEQ ID NO: 91002

SEQ ID NO: 425859 - RNA, 64 nt, hsa; identical to SEQ ID NO: 91003

SEQ ID NO: 425860 - RNA, 64 nt, hsa; identical to SEQ ID NO: 91004

SEQ ID NO: 425861 - RNA, 64 nt, hsa; identical to SEQ ID NO: 91005

SEQ ID NO: 425862 - RNA, 64 nt, hsa; identical to SEQ ID NO: 91006

SEQ ID NO: 425863 - RNA, 64 nt, hsa; identical to SEQ ID NO: 91007

SEQ ID NO: 425864 - RNA, 64 nt, hsa; identical to SEQ ID NO: 91008

SEQ ID NO: 425865 - RNA, 64 nt, hsa; identical to SEQ ID NO: 91009

SEQ ID NO: 425866 - RNA, 64 nt, hsa; identical to SEQ ID NO: 91010

SEQ ID NO: 425867 - RNA, 64 nt, hsa; identical to SEQ ID NO: 91011

SEQ ID NO: 425868 - RNA, 64 nt, hsa; identical to SEQ ID NO: 91012

SEQ ID NO: 425869 - RNA, 64 nt, hsa; identical to SEQ ID NO: 91013

SEQ ID NO: 425870 - RNA, 64 nt, hsa; identical to SEQ ID NO: 91014

SEQ ID NO: 425871 - RNA, 64 nt, hsa; identical to SEQ ID NO: 91015

SEQ ID NO: 425872 - RNA, 64 nt, hsa; identical to SEQ ID NO: 91016

SEQ ID NO: 425873 - RNA, 64 nt, hsa; identical to SEQ ID NO: 91017

SEQ ID NO: 425874 - RNA, 64 nt, hsa; identical to SEQ ID NO: 91018

SEQ ID NO: 425875 - RNA, 64 nt, hsa; identical to SEQ ID NO: 91019

SEQ ID NO: 425876 - RNA, 64 nt, hsa; identical to SEQ ID NO: 91020

SEQ ID NO: 425877 - RNA, 64 nt, hsa; identical to SEQ ID NO: 91021

SEQ ID NO: 425878 - RNA, 64 nt, hsa; identical to SEQ ID NO: 91022

SEQ ID NO: 425879 - RNA, 64 nt, hsa; identical to SEQ ID NO: 91023

SEQ ID NO: 425880 - RNA, 64 nt, hsa; identical to SEQ ID NO: 91024

SEQ ID NO: 425881 - RNA, 64 nt, hsa; identical to SEQ ID NO: 91025

SEQ ID NO: 425882 - RNA, 64 nt, hsa; identical to SEQ ID NO: 91026

SEQ ID NO: 425883 - RNA, 64 nt, hsa; identical to SEQ ID NO: 91027

SEQ ID NO: 425884 - RNA, 64 nt, hsa; identical to SEQ ID NO: 91028

SEQ ID NO: 425885 - RNA, 64 nt, hsa; identical to SEQ ID NO: 91029

SEQ ID NO: 425886 - RNA, 64 nt, hsa
gaagccuguaccuacaggccauauugcucaggcucaggacaaggccucaggucgugggcccagc

SEQ ID NO: 425887 - RNA, 64 nt, hsa
gugcccaggccuguggguaguggggagggcugaacaggacaaccucucaucacccccacuuuug

SEQ ID NO: 425888 - RNA, 64 nt, hsa
gaacuggugcuguacuggguacacaguaggcgcccaggacaaguggguugcaagacaggaagaa

SEQ ID NO: 425889 - RNA, 64 nt, hsa
agcccacuggaccagaacugggagaggaagagagcaggacaaggcagacagaaggucaggucag

SEQ ID NO: 425890 - RNA, 64 nt, hsa
agcuugcaggucccuuucuacugugguguuggagcaggacaauaaaguccacuagaaaugcacc

SEQ ID NO: 425891 - RNA, 64 nt, hsa
gaggaccguuccuaggaugggacagugggucaggcaggacaaggagaaagcagggcagaaugau

SEQ ID NO: 425892 - RNA, 64 nt, hsa; identical to SEQ ID NO: 76961

SEQ ID NO: 425893 - RNA, 64 nt, hsa; identical to SEQ ID NO: 76962

SEQ ID NO: 425894 - RNA, 64 nt, hsa; identical to SEQ ID NO: 76963

SEQ ID NO: 425895 - RNA, 64 nt, hsa; identical to SEQ ID NO: 76964

SEQ ID NO: 425896 - RNA, 64 nt, hsa; identical to SEQ ID NO: 76965

SEQ ID NO: 425897 - RNA, 64 nt, hsa; identical to SEQ ID NO: 76966

SEQ ID NO: 425898 - RNA, 64 nt, hsa; identical to SEQ ID NO: 76967

SEQ ID NO: 425899 - RNA, 64 nt, hsa; identical to SEQ ID NO: 76968

SEQ ID NO: 425900 - RNA, 64 nt, hsa; identical to SEQ ID NO: 76969

SEQ ID NO: 425901 - RNA, 64 nt, hsa; identical to SEQ ID NO: 76970

SEQ ID NO: 425902 - RNA, 64 nt, hsa; identical to SEQ ID NO: 76971

SEQ ID NO: 425903 - RNA, 64 nt, hsa; identical to SEQ ID NO: 76972

SEQ ID NO: 425904 - RNA, 64 nt, hsa; identical to SEQ ID NO: 76973

SEQ ID NO: 425905 - RNA, 64 nt, hsa; identical to SEQ ID NO: 76974

SEQ ID NO: 425906 - RNA, 64 nt, hsa; identical to SEQ ID NO: 76975

SEQ ID NO: 425907 - RNA, 64 nt, hsa; identical to SEQ ID NO: 76976

SEQ ID NO: 425908 - RNA, 64 nt, hsa; identical to SEQ ID NO: 76977

SEQ ID NO: 425909 - RNA, 64 nt, hsa; identical to SEQ ID NO: 76978

SEQ ID NO: 425910 - RNA, 64 nt, hsa; identical to SEQ ID NO: 76979

SEQ ID NO: 425911 - RNA, 64 nt, hsa; identical to SEQ ID NO: 76980

SEQ ID NO: 425912 - RNA, 64 nt, hsa; identical to SEQ ID NO: 76981

SEQ ID NO: 425913 - RNA, 64 nt, hsa; identical to SEQ ID NO: 76982

SEQ ID NO: 425914 - RNA, 64 nt, hsa; identical to SEQ ID NO: 76983

SEQ ID NO: 425915 - RNA, 64 nt, hsa; identical to SEQ ID NO: 76984

SEQ ID NO: 425916 - RNA, 64 nt, hsa; identical to SEQ ID NO: 76985

SEQ ID NO: 425917 - RNA, 64 nt, hsa; identical to SEQ ID NO: 76986

SEQ ID NO: 425918 - RNA, 64 nt, hsa; identical to SEQ ID NO: 76987

SEQ ID NO: 425919 - RNA, 64 nt, hsa; identical to SEQ ID NO: 76988

SEQ ID NO: 425920 - RNA, 64 nt, hsa; identical to SEQ ID NO: 76989

SEQ ID NO: 425921 - RNA, 64 nt, hsa; identical to SEQ ID NO: 76990

SEQ ID NO: 425922 - RNA, 64 nt, hsa; identical to SEQ ID NO: 76991

SEQ ID NO: 425923 - RNA, 64 nt, hsa; identical to SEQ ID NO: 76992

SEQ ID NO: 425924 - RNA, 64 nt, hsa; identical to SEQ ID NO: 76993

SEQ ID NO: 425925 - RNA, 64 nt, hsa; identical to SEQ ID NO: 76994

SEQ ID NO: 425926 - RNA, 64 nt, hsa; identical to SEQ ID NO: 76995

SEQ ID NO: 425927 - RNA, 64 nt, hsa; identical to SEQ ID NO: 76996

SEQ ID NO: 425928 - RNA, 64 nt, hsa; identical to SEQ ID NO: 76997

SEQ ID NO: 425929 - RNA, 64 nt, hsa; identical to SEQ ID NO: 76998

SEQ ID NO: 425930 - RNA, 64 nt, hsa; identical to SEQ ID NO: 76999

SEQ ID NO: 425931 - RNA, 64 nt, hsa; identical to SEQ ID NO: 77000

SEQ ID NO: 425932 - RNA, 64 nt, hsa; identical to SEQ ID NO: 77001

SEQ ID NO: 425933 - RNA, 64 nt, hsa; identical to SEQ ID NO: 77002

SEQ ID NO: 425934 - RNA, 64 nt, hsa; identical to SEQ ID NO: 77003

SEQ ID NO: 425935 - RNA, 64 nt, hsa; identical to SEQ ID NO: 77004

SEQ ID NO: 425936 - RNA, 64 nt, hsa; identical to SEQ ID NO: 77005

SEQ ID NO: 425937 - RNA, 64 nt, hsa; identical to SEQ ID NO: 77006

SEQ ID NO: 425938 - RNA, 64 nt, hsa; identical to SEQ ID NO: 77007

SEQ ID NO: 425939 - RNA, 64 nt, hsa; identical to SEQ ID NO: 77008

SEQ ID NO: 425940 - RNA, 64 nt, hsa; identical to SEQ ID NO: 77009

SEQ ID NO: 425941 - RNA, 64 nt, hsa; identical to SEQ ID NO: 77010

SEQ ID NO: 425942 - RNA, 64 nt, hsa; identical to SEQ ID NO: 77011

SEQ ID NO: 425943 - RNA, 64 nt, hsa; identical to SEQ ID NO: 77012

SEQ ID NO: 425944 - RNA, 64 nt, hsa; identical to SEQ ID NO: 77013

SEQ ID NO: 425945 - RNA, 64 nt, hsa; identical to SEQ ID NO: 77014

SEQ ID NO: 425946 - RNA, 64 nt, hsa; identical to SEQ ID NO: 77015

SEQ ID NO: 425947 - RNA, 64 nt, hsa; identical to SEQ ID NO: 173420

SEQ ID NO: 425948 - RNA, 64 nt, hsa; identical to SEQ ID NO: 173421

SEQ ID NO: 425949 - RNA, 64 nt, hsa; identical to SEQ ID NO: 173422

SEQ ID NO: 425950 - RNA, 64 nt, hsa; identical to SEQ ID NO: 173423

SEQ ID NO: 425951 - RNA, 64 nt, hsa; identical to SEQ ID NO: 173424

SEQ ID NO: 425952 - RNA, 64 nt, hsa; identical to SEQ ID NO: 173425

SEQ ID NO: 425953 - RNA, 64 nt, hsa; identical to SEQ ID NO: 173426

SEQ ID NO: 425954 - RNA, 64 nt, hsa; identical to SEQ ID NO: 173427

SEQ ID NO: 425955 - RNA, 64 nt, hsa; identical to SEQ ID NO: 173428

SEQ ID NO: 425956 - RNA, 64 nt, hsa; identical to SEQ ID NO: 173429

SEQ ID NO: 425957 - RNA, 64 nt, hsa
ucugaccuuugaugguugagaaggguuuggacagaaaauugacaugaaaagaucuggcucaugg

SEQ ID NO: 425958 - RNA, 64 nt, hsa
caaagccuuuguguuuuucacugguggcaggaggaaaauugauaaaucagaggugcuacugagg

SEQ ID NO: 425959 - RNA, 64 nt, hsa
gaauauucaagauuauaaagguaucaggucuccuaaaauugaucuauggauuuaauaccauuuu

SEQ ID NO: 425960 - RNA, 64 nt, hsa
ugcuauuaaaaaaaaagaagguaacugauaaaccaaaauugagcauaguaauuacccacagaag

SEQ ID NO: 425961 - RNA, 64 nt, hsa
ccauuauggcagguuuagagaauccuuaaaaagaaaaauugacuugcuugccuaaaacuacagu

SEQ ID NO: 425962 - RNA, 64 nt, hsa
agaugugauuucuccuuuugggagagaaugucccaaaauugauuaggcugagccuugggaauag

SEQ ID NO: 425963 - RNA, 64 nt, hsa
ucuauauaguaaauuucacuagaaaaauucuuuuaaaauugacagaagauaauuuauaccuuuu

SEQ ID NO: 425964 - RNA, 64 nt, hsa
ugucauauuauauucuuuaaacuuacuguuuuacaaaauugagcucaucguaaaugucuagucu

SEQ ID NO: 425965 - RNA, 61 nt, hsa
cccaugaaaauucuauuuaguauuuucagagaaaauugaagguuuuuuuaaacaucacugg

SEQ ID NO: 425966 - RNA, 64 nt, hsa
cauauucuggugaaacauguaaaauacuuuaaguaaaauugaacauuuuuauuugaauuuuugc

SEQ ID NO: 425967 - RNA, 64 nt, hsa
ccaaguuuuuggaaaugguccuguuacuccagagaaaauugagcagcucagguaagaacacaau

SEQ ID NO: 425968 - RNA, 64 nt, hsa
uccaguuucugcccagcuucaagauauugaaggaaaaauugaccgauuuauuauuccuagagag

SEQ ID NO: 425969 - RNA, 64 nt, hsa
uauaauaggauuugaaauugcauuacaguucauaaaaauugaaaaugagaaauuaaaccugcaa

SEQ ID NO: 425970 - RNA, 64 nt, hsa
uguauauuuaauguuuuauuguuagcuucuccagaaaauugaugcaaauucugguaauaauucu

SEQ ID NO: 425971 - RNA, 64 nt, hsa
uaacuuuuuuucuuagucauauuugaaaaaguagaaaauugaguuacaauuugauuuuuuuucc

SEQ ID NO: 425972 - RNA, 64 nt, hsa
gugcuuuuauaugaauauuuguuuuuuauaguuuaaaauugauccuuugggaauccaguugaag

SEQ ID NO: 425973 - RNA, 64 nt, hsa
gaugcuaggaaguuagucuaauaauucacugcagaaaauugauuaaguggcuguccuuuuaauu

SEQ ID NO: 425974 - RNA, 64 nt, hsa
uucagugcacauaauacuaauguaacagcagaugaaaauugauaaaacccaaaagagagucauc

SEQ ID NO: 425975 - RNA, 64 nt, hsa
guuuuguuggcuacaauaauucaguauucaugucaaaauugagaagugcccuaauugaaugugu

SEQ ID NO: 425976 - RNA, 64 nt, hsa
uguauaaugugcagaaaauauuuaauaucaaaagaaaauugauauuuuuauacaaguaauuucc

SEQ ID NO: 425977 - RNA, 64 nt, hsa
accuuaaaauuaagauuuccuuaaccuuaaccuuaaaauugauauuauauuaaacauacauaau

SEQ ID NO: 425978 - RNA, 64 nt, hsa
auuaauuuuuauuuauuuuucuugggaauugaaaaaaauugaaauaaauaaaaaugcauugaac

SEQ ID NO: 425979 - RNA, 64 nt, hsa
auuuuggugcacaaauacaaaguggaaacuuaccaaaauugaacuagcuaccauauaagcagau

SEQ ID NO: 425980 - RNA, 64 nt, hsa
auaauguuuaaauagcauaaaaugaaaugcuacaaaaauugaacuaauuuauacuuuaaaguau

SEQ ID NO: 425981 - RNA, 64 nt, hsa
cuguuugugggauguuggaaaaaaaugaaacuucaaaauugaugaaaaacuaaauucgaggaau

SEQ ID NO: 425982 - RNA, 64 nt, hsa
aauaggauggcgaguuuguguuuuaauuuuucauaaaauugaaccuguugguugacaaaauugg

SEQ ID NO: 425983 - RNA, 64 nt, hsa
aaauagacaauguuuuugucucaagaacaagaauaaaauugaaaucugcauucaugccaauuca

SEQ ID NO: 425984 - RNA, 64 nt, hsa
uuaaguuaaagacagauuucuuuaauaaguuuuuaaaauugaucaacuuuaaauuaagcacagu

SEQ ID NO: 425985 - RNA, 64 nt, hsa
uggaauaugaaaaacuaauggauaaagcuagcauaaaauugauauuuuaguuuguauuauuaau

SEQ ID NO: 425986 - RNA, 64 nt, hsa
uaaugggaaggucauuuaauuuacagaugguuuuaaaauugagguaauaucugagguggcauaa

SEQ ID NO: 425987 - RNA, 64 nt, hsa
uaggaaaauguacaagagaacaaauuaaaauugaaaaauugauuucacuuagaaaaacuucuag

SEQ ID NO: 425988 - RNA, 64 nt, hsa
uuugagcuuaggaaaauguacaagagaacaaauuaaaauugaaaaauugauuucacuuagaaaa

SEQ ID NO: 425989 - RNA, 64 nt, hsa
augagaugcuucaaaugaaaagggaauuaugaguaaaauugaacuuugaugggggauucaguuc

SEQ ID NO: 425990 - RNA, 64 nt, hsa
aaauugcuaaauguuauaauuuagaguugacauaaaaauugauggccaggcaugguggcucacg

SEQ ID NO: 425991 - RNA, 64 nt, hsa
ccaagaauuguuacuuuacaauguucccuuaagcaaaauugaauuugcuuugaacuuuuaguua

SEQ ID NO: 425992 - RNA, 64 nt, hsa
uuuuuuuuaaauuuaaauacagaaacaacuggcaaaaauugaacuaagauuuacuuuuuuuucc

SEQ ID NO: 425993 - RNA, 64 nt, hsa
aaauaaagaacaucuauaaauauuuauagauuucaaaauugagaaagaaguauauauggagcca

SEQ ID NO: 425994 - RNA, 64 nt, hsa
uaucaaauuugcacuucaugaggauuuacacaugaaaauugauauucucaugggcuuugcugag

SEQ ID NO: 425995 - RNA, 64 nt, hsa
cuucauauaugucuaucagguaauaauaggcuugaaaauugauauccuguggugcuaaaguaca

SEQ ID NO: 425996 - RNA, 64 nt, hsa
ccaagugguguuucugguuaggaaucacagcuguaaaauugauuucaguucaucacacuucuuc

SEQ ID NO: 425997 - RNA, 64 nt, hsa
cccaaagaaaguuuauucaaugcuaauuugaaagaaaauugauaagaaaacuuugagggcccaa

SEQ ID NO: 425998 - RNA, 64 nt, hsa
ugcuucaaaagaucuaagaaaugcaaauauacugaaaauugacauccucugaaaauuccacuug

SEQ ID NO: 425999 - RNA, 64 nt, hsa
auaugaaauuuuguaagauguuuucaccuaaauaaaaauugaaagcaaguggauuacacaggag

SEQ ID NO: 426000 - RNA, 64 nt, hsa
ucuucauaucaucacaacauuauuugauuuaaauaaaauugaaaguaauauuugugcaacuuca

SEQ ID NO: 426001 - RNA, 64 nt, hsa
guuuuuauuaaaacaugagucacuaugggaugagaaaauugaaauaaagcuacugggccuccuc

SEQ ID NO: 426002 - RNA, 64 nt, hsa
gcuuuaaaaauacauagucauccaagguuuucuaaaaauugaaaucauauguugggaaugguaa

SEQ ID NO: 426003 - RNA, 64 nt, hsa
ucacuuucuuuucaaagaaauguuaauuauuacaaaaauugacauagauaucuuucccaaacuu

SEQ ID NO: 426004 - RNA, 64 nt, hsa
gaaaugaucuuagacacuuggauaaacucuauagaaaauugaguguuucuauuaauaacuaucu

SEQ ID NO: 426005 - RNA, 64 nt, hsa
uucaauggcugggccauuuuguucuuggagggacaaaauugaccucuccaugaaauugcaaaaa

SEQ ID NO: 426006 - RNA, 64 nt, hsa
aaguagacaucggaaaaugaaaauauuuauuuuaaaaauugaaauguuuggaaccuuuagcaca

SEQ ID NO: 426007 - RNA, 64 nt, hsa
aaagcauauagcuacuuucaguugauuguauuucaaaauugauuauuugcgguauuaacugaau

SEQ ID NO: 426008 - RNA, 64 nt, hsa
ccauccccuguucucccucuguugcuccccuuauaaaauugauguugucuuuaccagaaaggua

SEQ ID NO: 426009 - RNA, 64 nt, hsa
uuuuguguuuuucccacuuuccaauguacucaagaaaauugaacaaauguaauggaucaauuua

SEQ ID NO: 426010 - RNA, 64 nt, hsa
cccaaaaguaccuguacagaaaauugaauauugaaaaauugacaaauuguguacaaacacuaaa

SEQ ID NO: 426011 - RNA, 64 nt, hsa
aacuauaagaauugucccaaaaguaccuguacagaaaauugaauauugaaaaauugacaaauug

SEQ ID NO: 426012 - RNA, 64 nt, hsa
gauucuuugcucagcuaacacauuucuguuuuucaaaauugaugcuuaauuguagcuguuauuc

SEQ ID NO: 426013 - RNA, 64 nt, hsa
uuugcuguagcagagcuuuauugcaggcauuuuaaaaauugaauaaccaugugaaauaauuugg

SEQ ID NO: 426014 - RNA, 64 nt, hsa
guuaauuguugcgcucuaauacaacugaccauuuaaaauugaacaaguuuauuguuuuguaaca

SEQ ID NO: 426015 - RNA, 64 nt, hsa
uagagaugggguuuggccaugauggccaggcuggaaaauugaaacauaauuucacaauuauucc

SEQ ID NO: 426016 - RNA, 64 nt, hsa
uuuuuucugagaaaaaaaaguucuuaaauacaauaaaauugaaauguugaaauauaucucucaa

SEQ ID NO: 426017 - RNA, 64 nt, hsa
acuugggaacacuacugagagugacuucucuuuuaaaauugaguagcagaugaaaaauuaaaau

SEQ ID NO: 426018 - RNA, 64 nt, hsa
uucuacaaaauauuccuuauaaaaacaaagaacaaaaauugaauauuuaaugaauugacauuuu

SEQ ID NO: 426019 - RNA, 64 nt, hsa
auuuagacaugugauuucuaaaauuccagaaagcaaaauugauaagauguuagaaauuuggacc

SEQ ID NO: 426020 - RNA, 64 nt, hsa
gguugucccuauuaacaaaaaaguauuuuaauaaaaaauugaaaugagugagucauauuuuuug

SEQ ID NO: 426021 - RNA, 64 nt, hsa
uacauuuuuuucagcaccacaccacaccuauuccaaaauugaccacauaguuggaaguaaagca

SEQ ID NO: 426022 - RNA, 64 nt, hsa
uguauccaggagcugguuuuuugaaaggaucaacaaaauugauagaccgcuagcaagacuaaug

SEQ ID NO: 426023 - RNA, 64 nt, hsa
gucuaaaacaccaaaagcaauggcaacaaaagccaaaauugacaaaugggaucuaauuaaacua

SEQ ID NO: 426024 - RNA, 64 nt, hsa
uacaaagcagugcacaaagaaaucagaaacaauaaaaauugaaaaauaucucaugcucauggau

SEQ ID NO: 426025 - RNA, 64 nt, hsa
ugaugaacaccccaaagcaauugcaacaaaaacaaaaauugacaagugggaccuaauuaaacua

SEQ ID NO: 426026 - RNA, 64 nt, hsa
uucauacagaguacaagugcagccgccagaggagaaaauugagauucuugacccuuucauacuc

SEQ ID NO: 426027 - RNA, 64 nt, hsa
gguaaagcuuugucuaaaguccucauuuucuuuuaaaauugaauaaaauuucuguauacagauu

SEQ ID NO: 426028 - RNA, 64 nt, hsa
gccccauuacuacaaaaugcuaaaauauuuaaugaaaauugaugguggccacagugugcagguu

SEQ ID NO: 426029 - RNA, 64 nt, hsa
guuuucaaaaacaaaacaauuuuuaaaguaccuuaaaauugaggauguuacucaguguuaacac

SEQ ID NO: 426030 - RNA, 64 nt, hsa
ccaugcaaaccucauggagcauuuuggaaaguuaaaaauugauucuuauuuuugucauguuuac

SEQ ID NO: 426031 - RNA, 64 nt, hsa
uuauuuuugucauguuuacuuucaaacaugaaauaaaauugaguucuguuuucaugcaucaaac

SEQ ID NO: 426032 - RNA, 64 nt, hsa
cacuggaaagugucaauagaguugccuaagaauaaaaauugaaaugguguuaaucugaaaauua

SEQ ID NO: 426033 - RNA, 64 nt, hsa
gaaauuggugccucagcccuaucuagacuggggaaaaauugaggaucucuguuuuuccuggggc

SEQ ID NO: 426034 - RNA, 64 nt, hsa
uuguaauugacaucuaguagacuucugcacauguaaaauugaauucaaauaaaaucauacacac

SEQ ID NO: 426035 - RNA, 64 nt, hsa
ucaaugccuuuuaaaagaaaguuauaauggagaaaaaauugagccuuaaacaaaugguuacuuc

SEQ ID NO: 426036 - RNA, 64 nt, hsa
agacauaccucccaucaugacaugguccccaggcuggccugaggaugucacagcuugaggcugu

SEQ ID NO: 426037 - RNA, 64 nt, hsa
ggcucuugggugcauugcucagagucccagguccuggccugacccucaggcccuucacgugagg

SEQ ID NO: 426038 - RNA, 64 nt, hsa
uuugugacuaauggguagcaaucguauuauuugcuggccugaagagaaaaaaugguaaugugug

SEQ ID NO: 426039 - RNA, 64 nt, hsa
cugggcaaacaaucggaacgucaugcagaaggaauggccugacuccugcagugcagauuggagg

SEQ ID NO: 426040 - RNA, 64 nt, hsa
uuggccugauguuuguccucacaggcaugccacguggccugagaugauucagaacaaaucaugc

SEQ ID NO: 426041 - RNA, 64 nt, hsa
gaauagagguggccaggcccccagcgacucuucuuggccugauguuuguccucacaggcaugcc

SEQ ID NO: 426042 - RNA, 64 nt, hsa
ucauuagugugaaagaggugggagugagguuuucuggccugaagcagucugcacugaaagguac

SEQ ID NO: 426043 - RNA, 64 nt, hsa
ggccugaagcagucugcacugaaagguacccaaguggccugaaacaguguagggaaagaccugg

SEQ ID NO: 426044 - RNA, 64 nt, hsa
ggcaucagaggaccccagaaaacuacccaaaugauggccugacaaugaacuacugcaggaaucc

SEQ ID NO: 426045 - RNA, 64 nt, hsa
caagcuuggucaucuaugacgccacaucagcacauggccugaccaggaacuacugcaggaaucc

SEQ ID NO: 426046 - RNA, 64 nt, hsa
gaggcccggggcccuuccucgcacagggcaugccuggccugaggacccggcgcugaguggcggg

SEQ ID NO: 426047 - RNA, 64 nt, hsa
ccccgccccaccccguccugauucgagguccuccuggccugagcgcagcgccuccacccugccc

SEQ ID NO: 426048 - RNA, 64 nt, hsa
gcuauauuguccuuguccuaacugucacuugccauggccugaauguuggcuuaacugaauauug

SEQ ID NO: 426049 - RNA, 64 nt, hsa
ggugucuuuuuccagauuucaguauauucucugauggccugacaggccuauuaaguagauguga

SEQ ID NO: 426050 - RNA, 64 nt, hsa
aggaugaaaucagauuuuaacuaauaaugcuggauggccugaggaaagauucaacugccucucu

SEQ ID NO: 426051 - RNA, 64 nt, hsa
gaggcggcccugaccaaugugugaaguaugcacuuggccugacucaggaagccaggugagaaaa

SEQ ID NO: 426052 - RNA, 64 nt, hsa
aacccagcggucccugagaagagauugguuaguauggccugaacugguggcugggggaacugug

SEQ ID NO: 426053 - RNA, 64 nt, hsa
cagguccccgauguguauccaggggaagaauugguggccugagccgauggggccccccaggccc

SEQ ID NO: 426054 - RNA, 64 nt, hsa
guucacaguugucaccugcagaccugccucucccuggccugagguucaaaggccucaucggaug

SEQ ID NO: 426055 - RNA, 64 nt, hsa
cacacauggguggucccacagcaugggaccaggcuggccugagggaugcccaguuguaacaaug

SEQ ID NO: 426056 - RNA, 64 nt, hsa
ccaacugguucaggcucaaccuuccaacuuccuguggccugaagaagcacuucugcugcaucgc

SEQ ID NO: 426057 - RNA, 64 nt, hsa
acaggcuggguccugccagcuggaucgcugcacauggccugagcauccagaccugagcgggagu

SEQ ID NO: 426058 - RNA, 64 nt, hsa
cugggaccacacgucugcagagauccugcucugcuggccugagccccaggccuuggccuccugu

SEQ ID NO: 426059 - RNA, 64 nt, hsa
auccucaccagugcugaugaugccgucaugcugcuggccugagacaguaucccagcuacaacag

SEQ ID NO: 426060 - RNA, 64 nt, hsa
gggccagugcucucuccucaaauggaggcagccauggccugaagugcagaucacugacccaggg

SEQ ID NO: 426061 - RNA, 64 nt, hsa
gaguguagccagcagcggccgucuacuccuguucuggccugagaccaccggugugggucacgag

SEQ ID NO: 426062 - RNA, 64 nt, hsa
gugaugacauacaccuuagcugcuuagcuggugcuggccugaggcagggcaggaaaucagaaua

SEQ ID NO: 426063 - RNA, 64 nt, hsa
ucaguuuuugaauccugcaagcacauuccaagacuggccugaaacugcaugagcaacaucacuc

SEQ ID NO: 426064 - RNA, 64 nt, hsa
uuugguggcauggaaggggcuucuggaccuaggguggccugagagggcgguggguaugcgagac

SEQ ID NO: 426065 - RNA, 64 nt, hsa
gcugcuuccaggcugggcagcacaaggccuugccuggccugaugauggugggugggugggauga

SEQ ID NO: 426066 - RNA, 64 nt, hsa
uacugauguggagaaagcucaagagggaaucaucuggccugagccuaccaugaggcuguuugug

SEQ ID NO: 426067 - RNA, 64 nt, hsa
gcugaugugagagaaagaaaaucugaagggccccuggccugagaucuagacaaccuagcugcgc

SEQ ID NO: 426068 - RNA, 64 nt, hsa
agccacuguccacgauccaguacaacgugguggauggccugagggaccgccggagcuuccacgg

SEQ ID NO: 426069 - RNA, 64 nt, hsa
ucaccccgagcagcucauccaccauggaggucauuggccugaggcaaguuccccggagagucgg

SEQ ID NO: 426070 - RNA, 64 nt, hsa
agucccagcuacuugggaggcugaagugggaggauggccugagcucaaggagaugcaggcugca

SEQ ID NO: 426071 - RNA, 64 nt, hsa
auuguuacuaggcacacaggugaugcugacucgauggccugagacacaccccuugagaagaagc

SEQ ID NO: 426072 - RNA, 64 nt, hsa; identical to SEQ ID NO: 279526

SEQ ID NO: 426073 - RNA, 64 nt, hsa; identical to SEQ ID NO: 279527

SEQ ID NO: 426074 - RNA, 64 nt, hsa; identical to SEQ ID NO: 279528

SEQ ID NO: 426075 - RNA, 64 nt, hsa; identical to SEQ ID NO: 279529

SEQ ID NO: 426076 - RNA, 64 nt, hsa
cauuuggggcuuuaucggaaucccgcucacaucagaacaugacagaaucuucagacuaugagga

SEQ ID NO: 426077 - RNA, 64 nt, hsa
uacugacaguagugaugcagaaaaugaaauuaaugaacaugaugucgugguccaguugcagccu

SEQ ID NO: 426078 - RNA, 64 nt, hsa
auuucauaaguuugauauucaguggauacaaauagaacaugaauucuaaguuuuggguaauguu

SEQ ID NO: 426079 - RNA, 64 nt, hsa
gaaaauuuaugcauuuauuuacugauuguguugugaacaugaguuuuaugguauuuugugaggg

SEQ ID NO: 426080 - RNA, 64 nt, hsa
guuauuaguggggaacagaaguauaugugcuuaagaacaugacagguucaugcaaauaugcucu

SEQ ID NO: 426081 - RNA, 64 nt, hsa
uaacuaccauccauccuauuugaauuaucaagcagaacaugaccauaaaauuugguaacuuguu

SEQ ID NO: 426082 - RNA, 64 nt, hsa
gauggagcccucagcgugucuuuucagcaggagcagaaccgaugagagccgcccuuaccguugg

SEQ ID NO: 426083 - RNA, 64 nt, hsa
ggggcugaagagccugaacugcaccuaacgggaaagaaccgacauggcugccuuuuguuuacac

SEQ ID NO: 426084 - RNA, 64 nt, hsa
uguacgaaaaucguguaacacuaugcucaugcuaagaaccgacauaacagaauuacugaaauaa

SEQ ID NO: 426085 - RNA, 64 nt, hsa
accauuuacucuuuaucacucugcaacaaaucacagaaccgaucaucucaggcuuuuucuucug

SEQ ID NO: 426086 - RNA, 64 nt, hsa
uucccagcaaccccaaauucuggcugcgggucucagaaccgagugagguguacauugccguccu

SEQ ID NO: 426087 - RNA, 64 nt, hsa
gugguccgcccagaagagauuccuccagugccugagaaccgauuuuuacugagaagagauaugc

SEQ ID NO: 426088 - RNA, 64 nt, hsa
cgaaagaagaagcaagcgcuggccuggccuugaaagaaccgaagucuuucccauucacuucucu

SEQ ID NO: 426089 - RNA, 64 nt, hsa
uguuuguaucuuguuccuuugugaaguguguugcagaaccgacgcuuacugugcgagaaucgga

SEQ ID NO: 426090 - RNA, 64 nt, hsa
cggugucuaaauagcagagcuggaaugggaacugagaaccgauucuuuccacaaccgcccacug

SEQ ID NO: 426091 - RNA, 64 nt, hsa
aucagacaguggaugagacacacaacggcagugaagaaccgauacacuuggcauugacgucuag

SEQ ID NO: 426092 - RNA, 64 nt, hsa
uguguuugggguguggggguggugaaagggaaguagaaccgaaacaagauuaguccugaguuaa

SEQ ID NO: 426093 - RNA, 64 nt, hsa
guugguguugggggaggcgcgagugcgugugagaagaaccgacccaccccgcgcaaggggaagc

SEQ ID NO: 426094 - RNA, 64 nt, hsa
cagaguaauccugagaguaagcaaaggaaccaugagaaccgaagcuagaauugcuauugaauua

SEQ ID NO: 426095 - RNA, 64 nt, hsa
cggcuuucucccagcaauagggucgacgagaccuagaaccgaaccucaucuccgaguugggucu

SEQ ID NO: 426096 - RNA, 64 nt, hsa
uugaugccacuucccaggguggagacaguggaaaagaaccgaggacaggaaaggauuggguagg

SEQ ID NO: 426097 - RNA, 64 nt, hsa
accaaauaguagagcauaccacuugaagaaggaaagaaccgaagagcaaacaaaaguucugcgu

SEQ ID NO: 426098 - RNA, 64 nt, hsa
ugccuucacuuuacaaauucaagccuuagauaaaagaaccgagcaauuuucugcuaaaaagucc

SEQ ID NO: 426099 - RNA, 64 nt, hsa
aaauagauguaaguuucugcuacuugaaaccuacagaaccgacaaaaauuagggugcuaaaaaa

SEQ ID NO: 426100 - RNA, 59 nt, hsa
agaacgagagcaaagcaugaugggugaagagaaccgagcaaagaucaaaauaaaaagug

SEQ ID NO: 426101 - RNA, 64 nt, hsa
ccuaacuuggacugcuugaauuacauuggcuuuuagaaccgaaauuguaacuauguauuguauu

SEQ ID NO: 426102 - RNA, 64 nt, hsa
ugugagguugaggugggacauuugcugagcaaggagaaccgaugugaauggcaggcagauaaca

SEQ ID NO: 426103 - RNA, 64 nt, hsa
uccccucccacuacagggaucaagugaccugggaagaaccgaguuuaacaccaggauguguuuc

SEQ ID NO: 426104 - RNA, 64 nt, hsa
cguccaaaagugagccuaugcuauaaguuuaaugagaaccgaauucagccugcauucgagaaua

SEQ ID NO: 426105 - RNA, 64 nt, hsa
gcugguauaaaucuuacuuauaaaguaggaaaagagaaccgaggaagcacgugaaacuuacuaa

SEQ ID NO: 426106 - RNA, 64 nt, hsa
cuaaaguguugagaaccuuuuuaauuguaaaaugagaaccgauuuucaguuuaguguagcagca

SEQ ID NO: 426107 - RNA, 64 nt, hsa
cgccagcccaggcucggcugccacccaguggcacagaaccgaggagcugccauuaccccccaua

SEQ ID NO: 426108 - RNA, 64 nt, hsa
cacaucaugccuagaaucugaaauugaauuagcaagaaccgacuguuugcauuuuccauauauc

SEQ ID NO: 426109 - RNA, 64 nt, hsa
ucaauuccagggcagcuacacguggucugaaucgagaaccgagcuuggaguucuccaaguggag

SEQ ID NO: 426110 - RNA, 64 nt, hsa
ugccugacggagaggcagaucaagauaugguuccagaaccgacgcaugaaguggaaaaaggaga

SEQ ID NO: 426111 - RNA, 64 nt, hsa
aagggcccagcugcagccagacagauggugcuugagaaccgaggcccggugauccuccagccac

SEQ ID NO: 426112 - RNA, 64 nt, hsa
acaauacuguuaauuuucuaggaaugaugaccugagaaccgaauggccaugcuuucuaucacau

SEQ ID NO: 426113 - RNA, 64 nt, hsa
uccguugccuuacccgauggcuugugacgcggagagaaccgauuaaaaccguuugagaaacucc

SEQ ID NO: 426114 - RNA, 64 nt, hsa
ccccucaacagugaguuagacucaagggggugacagaaccgagaagggggugacaguccuccau

SEQ ID NO: 426115 - RNA, 64 nt, hsa
gccaagaccccgucucuauuuuuaaaaaagaaaaagaaccgacuucugaaucgcagcuccacuc

SEQ ID NO: 426116 - RNA, 64 nt, hsa
cuugcagagaccugcauuacagagcaaagcugggagaaccgaggacucaccccaggaaccucaa

SEQ ID NO: 426117 - RNA, 64 nt, hsa
gaacaaaagaaaagaggaacccaguggauguaacagaaccgacuccaguugaauguuuagauuu

SEQ ID NO: 426118 - RNA, 64 nt, hsa
gcuuuaguuuucaaccuuguuggugcugagagagagaaccgagaggucccaguacaagggcagg

SEQ ID NO: 426119 - RNA, 64 nt, hsa
aagucugcaggaacugcugccugagccaagccagagaaccgaagacccggccggcccuggccuc

SEQ ID NO: 426120 - RNA, 64 nt, hsa
uccugggagaucuaccugaaggagaacuaccuccagaaccgacaguuccagcaaaagcagcggc

SEQ ID NO: 426121 - RNA, 64 nt, hsa
acauagagagcuuugugugauucauguuuuaaaaagaaccgaagaagccacaggcagggccuga

SEQ ID NO: 426122 - RNA, 64 nt, hsa
agggggccaggcucuagaacgucuaacacaguggagaaccgaaaccccccccccccccccgcca

SEQ ID NO: 426123 - RNA, 64 nt, hsa
ugcaaaaaccucauugagugcagaaaugcaaaauagaaccgaagcauguauaucucgauggcga

SEQ ID NO: 426124 - RNA, 64 nt, hsa
ucaggcuugucccucccugauaccaaguaugucgagaaccgauggccccacccucuggcuggug

SEQ ID NO: 426125 - RNA, 64 nt, hsa; identical to SEQ ID NO: 129516

SEQ ID NO: 426126 - RNA, 64 nt, hsa; identical to SEQ ID NO: 129517

SEQ ID NO: 426127 - RNA, 64 nt, hsa; identical to SEQ ID NO: 129518

SEQ ID NO: 426128 - RNA, 64 nt, hsa; identical to SEQ ID NO: 129519

SEQ ID NO: 426129 - RNA, 64 nt, hsa; identical to SEQ ID NO: 129520

SEQ ID NO: 426130 - RNA, 64 nt, hsa; identical to SEQ ID NO: 129521

SEQ ID NO: 426131 - RNA, 64 nt, hsa; identical to SEQ ID NO: 129522

SEQ ID NO: 426132 - RNA, 64 nt, hsa; identical to SEQ ID NO: 129523

SEQ ID NO: 426133 - RNA, 64 nt, hsa; identical to SEQ ID NO: 129524

SEQ ID NO: 426134 - RNA, 64 nt, hsa; identical to SEQ ID NO: 129525

SEQ ID NO: 426135 - RNA, 59 nt, hsa; identical to SEQ ID NO: 129526

SEQ ID NO: 426136 - RNA, 64 nt, hsa; identical to SEQ ID NO: 129527

SEQ ID NO: 426137 - RNA, 64 nt, hsa; identical to SEQ ID NO: 129528

SEQ ID NO: 426138 - RNA, 64 nt, hsa; identical to SEQ ID NO: 129529

SEQ ID NO: 426139 - RNA, 64 nt, hsa; identical to SEQ ID NO: 129530

SEQ ID NO: 426140 - RNA, 64 nt, hsa; identical to SEQ ID NO: 129531

SEQ ID NO: 426141 - RNA, 64 nt, hsa; identical to SEQ ID NO: 129532

SEQ ID NO: 426142 - RNA, 53 nt, hsa; identical to SEQ ID NO: 129533

SEQ ID NO: 426143 - RNA, 64 nt, hsa; identical to SEQ ID NO: 129534

SEQ ID NO: 426144 - RNA, 64 nt, hsa; identical to SEQ ID NO: 129535

SEQ ID NO: 426145 - RNA, 64 nt, hsa; identical to SEQ ID NO: 129536

SEQ ID NO: 426146 - RNA, 64 nt, hsa; identical to SEQ ID NO: 129537

SEQ ID NO: 426147 - RNA, 64 nt, hsa; identical to SEQ ID NO: 129538

SEQ ID NO: 426148 - RNA, 64 nt, hsa; identical to SEQ ID NO: 129539

SEQ ID NO: 426149 - RNA, 64 nt, hsa; identical to SEQ ID NO: 129540

SEQ ID NO: 426150 - RNA, 64 nt, hsa; identical to SEQ ID NO: 129541

SEQ ID NO: 426151 - RNA, 64 nt, hsa; identical to SEQ ID NO: 129542

SEQ ID NO: 426152 - RNA, 64 nt, hsa; identical to SEQ ID NO: 129543

SEQ ID NO: 426153 - RNA, 64 nt, hsa; identical to SEQ ID NO: 129544

SEQ ID NO: 426154 - RNA, 64 nt, hsa; identical to SEQ ID NO: 129545

SEQ ID NO: 426155 - RNA, 64 nt, hsa; identical to SEQ ID NO: 129546

SEQ ID NO: 426156 - RNA, 64 nt, hsa; identical to SEQ ID NO: 129547

SEQ ID NO: 426157 - RNA, 64 nt, hsa; identical to SEQ ID NO: 129548

SEQ ID NO: 426158 - RNA, 64 nt, hsa; identical to SEQ ID NO: 129549

SEQ ID NO: 426159 - RNA, 64 nt, hsa; identical to SEQ ID NO: 129550

SEQ ID NO: 426160 - RNA, 64 nt, hsa; identical to SEQ ID NO: 129551

SEQ ID NO: 426161 - RNA, 64 nt, hsa; identical to SEQ ID NO: 129552

SEQ ID NO: 426162 - RNA, 64 nt, hsa; identical to SEQ ID NO: 129553

SEQ ID NO: 426163 - RNA, 64 nt, hsa; identical to SEQ ID NO: 129554

SEQ ID NO: 426164 - RNA, 64 nt, hsa; identical to SEQ ID NO: 129555

SEQ ID NO: 426165 - RNA, 64 nt, hsa; identical to SEQ ID NO: 129556

SEQ ID NO: 426166 - RNA, 64 nt, hsa; identical to SEQ ID NO: 129557

SEQ ID NO: 426167 - RNA, 64 nt, hsa; identical to SEQ ID NO: 223145

SEQ ID NO: 426168 - RNA, 64 nt, hsa; identical to SEQ ID NO: 223146

SEQ ID NO: 426169 - RNA, 64 nt, hsa; identical to SEQ ID NO: 223147

SEQ ID NO: 426170 - RNA, 64 nt, hsa; identical to SEQ ID NO: 223148

SEQ ID NO: 426171 - RNA, 64 nt, hsa; identical to SEQ ID NO: 223149

SEQ ID NO: 426172 - RNA, 64 nt, hsa; identical to SEQ ID NO: 223150

SEQ ID NO: 426173 - RNA, 64 nt, hsa; identical to SEQ ID NO: 223151

SEQ ID NO: 426174 - RNA, 64 nt, hsa; identical to SEQ ID NO: 223152

SEQ ID NO: 426175 - RNA, 64 nt, hsa; identical to SEQ ID NO: 223153

SEQ ID NO: 426176 - RNA, 64 nt, hsa; identical to SEQ ID NO: 223154

SEQ ID NO: 426177 - RNA, 64 nt, hsa; identical to SEQ ID NO: 223155

SEQ ID NO: 426178 - RNA, 64 nt, hsa; identical to SEQ ID NO: 223156

SEQ ID NO: 426179 - RNA, 64 nt, hsa; identical to SEQ ID NO: 223157

SEQ ID NO: 426180 - RNA, 64 nt, hsa; identical to SEQ ID NO: 223158

SEQ ID NO: 426181 - RNA, 64 nt, hsa; identical to SEQ ID NO: 223159

SEQ ID NO: 426182 - RNA, 64 nt, hsa; identical to SEQ ID NO: 223160

SEQ ID NO: 426183 - RNA, 64 nt, hsa; identical to SEQ ID NO: 223161

SEQ ID NO: 426184 - RNA, 64 nt, hsa; identical to SEQ ID NO: 223162

SEQ ID NO: 426185 - RNA, 64 nt, hsa; identical to SEQ ID NO: 223163

SEQ ID NO: 426186 - RNA, 64 nt, hsa; identical to SEQ ID NO: 223164

SEQ ID NO: 426187 - RNA, 64 nt, hsa; identical to SEQ ID NO: 223165

SEQ ID NO: 426188 - RNA, 64 nt, hsa; identical to SEQ ID NO: 223166

SEQ ID NO: 426189 - RNA, 64 nt, hsa; identical to SEQ ID NO: 223167

SEQ ID NO: 426190 - RNA, 64 nt, hsa; identical to SEQ ID NO: 223168

SEQ ID NO: 426191 - RNA, 64 nt, hsa; identical to SEQ ID NO: 223169

SEQ ID NO: 426192 - RNA, 64 nt, hsa; identical to SEQ ID NO: 223170

SEQ ID NO: 426193 - RNA, 64 nt, hsa; identical to SEQ ID NO: 223171

SEQ ID NO: 426194 - RNA, 64 nt, hsa; identical to SEQ ID NO: 223172

SEQ ID NO: 426195 - RNA, 64 nt, hsa; identical to SEQ ID NO: 223173

SEQ ID NO: 426196 - RNA, 64 nt, hsa; identical to SEQ ID NO: 223174

SEQ ID NO: 426197 - RNA, 64 nt, hsa; identical to SEQ ID NO: 223175

SEQ ID NO: 426198 - RNA, 64 nt, hsa; identical to SEQ ID NO: 223176

SEQ ID NO: 426199 - RNA, 64 nt, hsa; identical to SEQ ID NO: 223177

SEQ ID NO: 426200 - RNA, 64 nt, hsa; identical to SEQ ID NO: 223178

SEQ ID NO: 426201 - RNA, 64 nt, hsa; identical to SEQ ID NO: 223179

SEQ ID NO: 426202 - RNA, 64 nt, hsa; identical to SEQ ID NO: 223180

SEQ ID NO: 426203 - RNA, 64 nt, hsa; identical to SEQ ID NO: 223181

SEQ ID NO: 426204 - RNA, 64 nt, hsa; identical to SEQ ID NO: 223182

SEQ ID NO: 426205 - RNA, 64 nt, hsa; identical to SEQ ID NO: 223183

SEQ ID NO: 426206 - RNA, 64 nt, hsa; identical to SEQ ID NO: 223184

SEQ ID NO: 426207 - RNA, 64 nt, hsa; identical to SEQ ID NO: 223185

SEQ ID NO: 426208 - RNA, 64 nt, hsa; identical to SEQ ID NO: 223186

SEQ ID NO: 426209 - RNA, 64 nt, hsa; identical to SEQ ID NO: 223187

SEQ ID NO: 426210 - RNA, 64 nt, hsa; identical to SEQ ID NO: 223188

SEQ ID NO: 426211 - RNA, 64 nt, hsa; identical to SEQ ID NO: 223189

SEQ ID NO: 426212 - RNA, 64 nt, hsa; identical to SEQ ID NO: 223190

SEQ ID NO: 426213 - RNA, 64 nt, hsa; identical to SEQ ID NO: 223191

SEQ ID NO: 426214 - RNA, 64 nt, hsa; identical to SEQ ID NO: 223192

SEQ ID NO: 426215 - RNA, 64 nt, hsa; identical to SEQ ID NO: 223193

SEQ ID NO: 426216 - RNA, 64 nt, hsa; identical to SEQ ID NO: 223194

SEQ ID NO: 426217 - RNA, 64 nt, hsa; identical to SEQ ID NO: 223195

SEQ ID NO: 426218 - RNA, 57 nt, hsa; identical to SEQ ID NO: 223196

SEQ ID NO: 426219 - RNA, 64 nt, hsa; identical to SEQ ID NO: 223197

SEQ ID NO: 426220 - RNA, 54 nt, hsa; identical to SEQ ID NO: 223198

SEQ ID NO: 426221 - RNA, 64 nt, hsa; identical to SEQ ID NO: 418691

SEQ ID NO: 426222 - RNA, 64 nt, hsa; identical to SEQ ID NO: 418692

SEQ ID NO: 426223 - RNA, 64 nt, hsa; identical to SEQ ID NO: 418693

SEQ ID NO: 426224 - RNA, 64 nt, hsa; identical to SEQ ID NO: 418694

SEQ ID NO: 426225 - RNA, 64 nt, hsa; identical to SEQ ID NO: 418695

SEQ ID NO: 426226 - RNA, 64 nt, hsa; identical to SEQ ID NO: 418696

SEQ ID NO: 426227 - RNA, 64 nt, hsa; identical to SEQ ID NO: 418697

SEQ ID NO: 426228 - RNA, 64 nt, hsa; identical to SEQ ID NO: 418698

SEQ ID NO: 426229 - RNA, 64 nt, hsa; identical to SEQ ID NO: 418699

SEQ ID NO: 426230 - RNA, 64 nt, hsa; identical to SEQ ID NO: 418700

SEQ ID NO: 426231 - RNA, 64 nt, hsa; identical to SEQ ID NO: 418701

SEQ ID NO: 426232 - RNA, 64 nt, hsa; identical to SEQ ID NO: 418702

SEQ ID NO: 426233 - RNA, 64 nt, hsa; identical to SEQ ID NO: 418703

SEQ ID NO: 426234 - RNA, 64 nt, hsa; identical to SEQ ID NO: 418704

SEQ ID NO: 426235 - RNA, 64 nt, hsa; identical to SEQ ID NO: 418705

SEQ ID NO: 426236 - RNA, 64 nt, hsa; identical to SEQ ID NO: 418706

SEQ ID NO: 426237 - RNA, 64 nt, hsa; identical to SEQ ID NO: 418707

SEQ ID NO: 426238 - RNA, 64 nt, hsa; identical to SEQ ID NO: 418708

SEQ ID NO: 426239 - RNA, 64 nt, hsa; identical to SEQ ID NO: 418709

SEQ ID NO: 426240 - RNA, 64 nt, hsa; identical to SEQ ID NO: 418710

SEQ ID NO: 426241 - RNA, 64 nt, hsa; identical to SEQ ID NO: 418711

SEQ ID NO: 426242 - RNA, 64 nt, hsa; identical to SEQ ID NO: 418712

SEQ ID NO: 426243 - RNA, 64 nt, hsa; identical to SEQ ID NO: 418713

SEQ ID NO: 426244 - RNA, 64 nt, hsa; identical to SEQ ID NO: 418714

SEQ ID NO: 426245 - RNA, 64 nt, hsa; identical to SEQ ID NO: 418715

SEQ ID NO: 426246 - RNA, 64 nt, hsa; identical to SEQ ID NO: 284841

SEQ ID NO: 426247 - RNA, 64 nt, hsa; identical to SEQ ID NO: 284842

SEQ ID NO: 426248 - RNA, 64 nt, hsa; identical to SEQ ID NO: 284843

SEQ ID NO: 426249 - RNA, 64 nt, hsa; identical to SEQ ID NO: 284844

SEQ ID NO: 426250 - RNA, 64 nt, hsa; identical to SEQ ID NO: 284845

SEQ ID NO: 426251 - RNA, 64 nt, hsa; identical to SEQ ID NO: 284846

SEQ ID NO: 426252 - RNA, 64 nt, hsa
agguacucugaaacaugguggccugagagaagaagagcuggagaaaaugaaagaagagcgugaa

SEQ ID NO: 426253 - RNA, 64 nt, hsa
ucagcaaaugucuuuagaucuccaucucccccucgagcuggaccauuugguuacccucgggaug

SEQ ID NO: 426254 - RNA, 64 nt, hsa
ggcccugcacugccagcaucuggagaccguccuggagcuggagguggaaaauggugccuggagg

SEQ ID NO: 426255 - RNA, 64 nt, hsa
gcauagcuacgugaggccugcacagcuaaguguggagcuggacuacggcggcaguauggaauuc

SEQ ID NO: 426256 - RNA, 64 nt, hsa
cuauguauggagcuuuguaucuuuaugaaagacugagcuggaccacccaugccaaggagcgagc

SEQ ID NO: 426257 - RNA, 64 nt, hsa
uuuaauuagaaauaaagcuguucaacuugaaaaugagcuggagaauuuuacuaagcaguuucua

SEQ ID NO: 426258 - RNA, 64 nt, hsa
aaugcagcaaauccuucacccugcuuuauaaguggagcuggaauaguccuggggcucuggggcc

SEQ ID NO: 426259 - RNA, 64 nt, hsa
gagcaguuugccaacugagaaggacaaccaaagugagcuggaucuuugaagcacaaaugcagca

SEQ ID NO: 426260 - RNA, 64 nt, hsa
ugggcuggggagaggaacaggccuugggaaucaggagcuggagccaggaugcgaagcagcugua

SEQ ID NO: 426261 - RNA, 64 nt, hsa
uccaaggguggaaacuugccccuucccauuucuagagcuggaacccacuccuuuuuuucccauu

SEQ ID NO: 426262 - RNA, 64 nt, hsa
guuuccaggggucccccagacaugaaagaggggugagcuggaggaagucauggugucacugggg

SEQ ID NO: 426263 - RNA, 64 nt, hsa
agaccaggguuggacaaaaccccaugagggcggggagcuggaagaaaagucucuuggggaccuc

SEQ ID NO: 426264 - RNA, 64 nt, hsa
ugccuguaucaccgguugaauggacaacuaacccgagcuggaccaacacaauucucuccagaga

SEQ ID NO: 426265 - RNA, 64 nt, hsa
aaaucaucaggucuuauaaaauauaauguacuuagagcuggauucauggcuguuuauuaugaaa

SEQ ID NO: 426266 - RNA, 64 nt, hsa
agucaaggauaaaacaagcacgcgcacaaucaaggagcuggaacacacucuccaggccgucaaa

SEQ ID NO: 426267 - RNA, 64 nt, hsa
aaugauuugacaguguccaaacugagacauucuggagcuggaaagccugucacacuagagugug

SEQ ID NO: 426268 - RNA, 64 nt, hsa
agugugucgaugggaacugaagacuaguccauaggagcuggaagaacuuugucccuuuacuucu

SEQ ID NO: 426269 - RNA, 64 nt, hsa
ucccugcagugccaacaugcacugcccacagcaggagcuggauccagcgucagugugucgaugg

SEQ ID NO: 426270 - RNA, 64 nt, hsa
gguggcccagcugguuauugacucugacuugggugagcuggaguugggggugucucgggcccag

SEQ ID NO: 426271 - RNA, 64 nt, hsa
ugugcucuggugugugggugauugggcagggccugagcuggacaggggagcuccuaguagggga

SEQ ID NO: 426272 - RNA, 64 nt, hsa
ccugguccuggccaucccacgccgccugcguguggagcuggagugugaggagggcgagcugucu

SEQ ID NO: 426273 - RNA, 64 nt, hsa
cgcacgccugggagguggcccuuggggggcugcagagcuggagggugggcgugguacgugugcg

SEQ ID NO: 426274 - RNA, 64 nt, hsa
gccaggggcccuggccugauggggcccccauggggagcuggagccugcccugcagccuggagaa

SEQ ID NO: 426275 - RNA, 64 nt, hsa
gguaacaggcacggcuggcccaaugccuggucuggagcuggagcuugccuuuggcuuuccaggu

SEQ ID NO: 426276 - RNA, 60 nt, hsa; identical to SEQ ID NO: 90161

SEQ ID NO: 426277 - RNA, 64 nt, hsa
gccgcagcauggaaaacagggcgccuaaggcugggagcuggaagaaggggcauuggguacccag

SEQ ID NO: 426278 - RNA, 64 nt, hsa
agcccacucucuggacaccaauccugggaggugggagcuggaauggggagcaaugagaggaggg

SEQ ID NO: 426279 - RNA, 64 nt, hsa
ccuaugguaggacguguaccucuguguguucauggagcuggagaaaccaaaacugggucucucu

SEQ ID NO: 426280 - RNA, 64 nt, hsa
uguccacagcucugucugccuuguucuugggcuugagcuggauagagguggggucucuucaccu

SEQ ID NO: 426281 - RNA, 64 nt, hsa
augaggcuggccagcccucagcggggccgggcgggagcuggagccugccagccgcuuccugccu

SEQ ID NO: 426282 - RNA, 64 nt, hsa
gggcuccguaagaagcugaaaccuucgaccguuugagcuggaggggcccugagaaaucagaguc

SEQ ID NO: 426283 - RNA, 64 nt, hsa
gcuccaauucgugacccacucagccuuauccacggagcuggagccaaccuacgugccaggcccc

SEQ ID NO: 426284 - RNA, 64 nt, hsa
ggagaaggaguaucaggagaccauugaccagauagagcuggaguuggccacggccaagaacgac

SEQ ID NO: 426285 - RNA, 64 nt, hsa
ggucuucaaggggcucaugaguaacaaccugucggagcuggacaccaagauccaggagaaagcc

SEQ ID NO: 426286 - RNA, 64 nt, hsa
uuuccugguccaucucauugcggccuguugggcagagcuggacaaggugucuuugaaggaaagc

SEQ ID NO: 426287 - RNA, 64 nt, hsa
gacgguuuaugcugggcacugccagacugaaccagagcuggaacacaauaauguguccuucuac

SEQ ID NO: 426288 - RNA, 64 nt, hsa
cauugaugccugggggaccuuuugccucgaggcugagcuggaaaaucuugaaaauauuuuuuuu

SEQ ID NO: 426289 - RNA, 64 nt, hsa
auugugucuuaacaaaggugugguagacacucuugagcuggacuuagauuuuauucuuccuugc

SEQ ID NO: 426290 - RNA, 64 nt, hsa
ccggaugcgugccagcaaugaguuggcacuggcagagcuggaggaggaggagggcaaacccgag

SEQ ID NO: 426291 - RNA, 64 nt, hsa
ucugacagagcuggugcugcaggcccauaggaaggagcuggaaggccuccggaugcgugccagc

SEQ ID NO: 426292 - RNA, 64 nt, hsa
cauagcagaaagacuggccccuuccuaggguuaugagcuggaacuguuucuacuuucagucuuc

SEQ ID NO: 426293 - RNA, 64 nt, hsa
auucuccuggugccgcugcugcucccuguuucuggagcuggauguuccccagcuggcaguugag

SEQ ID NO: 426294 - RNA, 64 nt, hsa
ggaugagaggcuguggcagcaggagacucugcaggagcuggagaggcugcgggagcuggagagg

SEQ ID NO: 426295 - RNA, 64 nt, hsa
gcaggagacucugcaggagcuggagaggcugcgggagcuggagaggaugcuggagcuggggugg

SEQ ID NO: 426296 - RNA, 64 nt, hsa
gcagcuacaagcagaggcugaacaccugcggaaggagcuggagaaucugacaggacagcuuuaa

SEQ ID NO: 426297 - RNA, 64 nt, hsa
gcagcuacaagcagaggcugaacaccugcggaaggagcuggagaaucuggcaggacagcuuuaa

SEQ ID NO: 426298 - RNA, 64 nt, hsa
uuauacugaaggaauuugugcuguguauuggggggagcuggauccagagcuggagggggugggu

SEQ ID NO: 426299 - RNA, 64 nt, hsa
aauuugugcuguguauuggggggagcuggauccagagcuggaggggguggguccgggggaggga

SEQ ID NO: 426300 - RNA, 64 nt, hsa
aucccauggcuccucgccaaagacugaaauuguggagcuggagggcgcccccuccccggaguuu

SEQ ID NO: 426301 - RNA, 64 nt, hsa
accucaccaccucuuuuccuuugagcccaaggcagagcuggagcuggcgccacccagacagcgu

SEQ ID NO: 426302 - RNA, 64 nt, hsa
gacccugagcggcgcccacgaccucagcgagagugagcuggauguggccgggcugcagagccgg

SEQ ID NO: 426303 - RNA, 64 nt, hsa
cccaaauuggccucgguggcaggggagccccgcagagcuggacagcgacacgcagggggcucgg

SEQ ID NO: 426304 - RNA, 64 nt, hsa; identical to SEQ ID NO: 253886

SEQ ID NO: 426305 - RNA, 64 nt, hsa; identical to SEQ ID NO: 253887

SEQ ID NO: 426306 - RNA, 64 nt, hsa; identical to SEQ ID NO: 253888

SEQ ID NO: 426307 - RNA, 64 nt, hsa; identical to SEQ ID NO: 253889

SEQ ID NO: 426308 - RNA, 64 nt, hsa; identical to SEQ ID NO: 253890

SEQ ID NO: 426309 - RNA, 64 nt, hsa; identical to SEQ ID NO: 253891

SEQ ID NO: 426310 - RNA, 64 nt, hsa; identical to SEQ ID NO: 253892

SEQ ID NO: 426311 - RNA, 64 nt, hsa; identical to SEQ ID NO: 253893

SEQ ID NO: 426312 - RNA, 64 nt, hsa; identical to SEQ ID NO: 253894

SEQ ID NO: 426313 - RNA, 64 nt, hsa; identical to SEQ ID NO: 253895

SEQ ID NO: 426314 - RNA, 64 nt, hsa; identical to SEQ ID NO: 253896

SEQ ID NO: 426315 - RNA, 64 nt, hsa; identical to SEQ ID NO: 253897

SEQ ID NO: 426316 - RNA, 64 nt, hsa; identical to SEQ ID NO: 253898

SEQ ID NO: 426317 - RNA, 64 nt, hsa; identical to SEQ ID NO: 253899

SEQ ID NO: 426318 - RNA, 64 nt, hsa; identical to SEQ ID NO: 253900

SEQ ID NO: 426319 - RNA, 64 nt, hsa; identical to SEQ ID NO: 253901

SEQ ID NO: 426320 - RNA, 64 nt, hsa; identical to SEQ ID NO: 253902

SEQ ID NO: 426321 - RNA, 64 nt, hsa; identical to SEQ ID NO: 253903

SEQ ID NO: 426322 - RNA, 64 nt, hsa; identical to SEQ ID NO: 253904

SEQ ID NO: 426323 - RNA, 64 nt, hsa; identical to SEQ ID NO: 253905

SEQ ID NO: 426324 - RNA, 64 nt, hsa; identical to SEQ ID NO: 253906

SEQ ID NO: 426325 - RNA, 64 nt, hsa; identical to SEQ ID NO: 253907

SEQ ID NO: 426326 - RNA, 64 nt, hsa; identical to SEQ ID NO: 253908

SEQ ID NO: 426327 - RNA, 64 nt, hsa; identical to SEQ ID NO: 253909

SEQ ID NO: 426328 - RNA, 64 nt, hsa; identical to SEQ ID NO: 86595

SEQ ID NO: 426329 - RNA, 64 nt, hsa; identical to SEQ ID NO: 86596

SEQ ID NO: 426330 - RNA, 64 nt, hsa; identical to SEQ ID NO: 86597

SEQ ID NO: 426331 - RNA, 64 nt, hsa; identical to SEQ ID NO: 86598

SEQ ID NO: 426332 - RNA, 64 nt, hsa; identical to SEQ ID NO: 86599

SEQ ID NO: 426333 - RNA, 64 nt, hsa; identical to SEQ ID NO: 86600

SEQ ID NO: 426334 - RNA, 64 nt, hsa; identical to SEQ ID NO: 86601

SEQ ID NO: 426335 - RNA, 64 nt, hsa; identical to SEQ ID NO: 86602

SEQ ID NO: 426336 - RNA, 64 nt, hsa; identical to SEQ ID NO: 86603

SEQ ID NO: 426337 - RNA, 64 nt, hsa; identical to SEQ ID NO: 86604

SEQ ID NO: 426338 - RNA, 64 nt, hsa; identical to SEQ ID NO: 86605

SEQ ID NO: 426339 - RNA, 64 nt, hsa; identical to SEQ ID NO: 86606

SEQ ID NO: 426340 - RNA, 64 nt, hsa; identical to SEQ ID NO: 86607

SEQ ID NO: 426341 - RNA, 64 nt, hsa; identical to SEQ ID NO: 86608

SEQ ID NO: 426342 - RNA, 64 nt, hsa; identical to SEQ ID NO: 86609

SEQ ID NO: 426343 - RNA, 64 nt, hsa; identical to SEQ ID NO: 86610

SEQ ID NO: 426344 - RNA, 64 nt, hsa; identical to SEQ ID NO: 86611

SEQ ID NO: 426345 - RNA, 64 nt, hsa; identical to SEQ ID NO: 86612

SEQ ID NO: 426346 - RNA, 64 nt, hsa; identical to SEQ ID NO: 86613

SEQ ID NO: 426347 - RNA, 64 nt, hsa; identical to SEQ ID NO: 86614

SEQ ID NO: 426348 - RNA, 64 nt, hsa; identical to SEQ ID NO: 86615

SEQ ID NO: 426349 - RNA, 64 nt, hsa; identical to SEQ ID NO: 86616

SEQ ID NO: 426350 - RNA, 64 nt, hsa; identical to SEQ ID NO: 86617

SEQ ID NO: 426351 - RNA, 64 nt, hsa; identical to SEQ ID NO: 86618

SEQ ID NO: 426352 - RNA, 64 nt, hsa; identical to SEQ ID NO: 86619

SEQ ID NO: 426353 - RNA, 64 nt, hsa; identical to SEQ ID NO: 86619

SEQ ID NO: 426354 - RNA, 64 nt, hsa; identical to SEQ ID NO: 86621

SEQ ID NO: 426355 - RNA, 64 nt, hsa; identical to SEQ ID NO: 86622

SEQ ID NO: 426356 - RNA, 64 nt, hsa; identical to SEQ ID NO: 86623

SEQ ID NO: 426357 - RNA, 64 nt, hsa; identical to SEQ ID NO: 86624

SEQ ID NO: 426358 - RNA, 64 nt, hsa; identical to SEQ ID NO: 86625

SEQ ID NO: 426359 - RNA, 64 nt, hsa; identical to SEQ ID NO: 86626

SEQ ID NO: 426360 - RNA, 64 nt, hsa; identical to SEQ ID NO: 86627

SEQ ID NO: 426361 - RNA, 64 nt, hsa; identical to SEQ ID NO: 86628

SEQ ID NO: 426362 - RNA, 64 nt, hsa; identical to SEQ ID NO: 86629

SEQ ID NO: 426363 - RNA, 64 nt, hsa; identical to SEQ ID NO: 86630

SEQ ID NO: 426364 - RNA, 64 nt, hsa; identical to SEQ ID NO: 86631

SEQ ID NO: 426365 - RNA, 64 nt, hsa; identical to SEQ ID NO: 86632

SEQ ID NO: 426366 - RNA, 64 nt, hsa
ccaguccuggaggcagguugugcagcuuaggggaggaccccagaaucuggaccccagagucugg

SEQ ID NO: 426367 - RNA, 64 nt, hsa
agguugugcagcuuaggggaggaccccagaaucuggaccccagagucuggaagcaggccagaaa

SEQ ID NO: 426368 - RNA, 64 nt, hsa
augcagccaucccugaguucaugcgaugcugacgggaccccagcacacuucccugccuccuuug

SEQ ID NO: 426369 - RNA, 64 nt, hsa
ugggagccgagauccaccugauccgugacaugauggaccccaaccacacaggaggccuguauga

SEQ ID NO: 426370 - RNA, 64 nt, hsa
aacuuguguagcagcacagggcccacacuuagaaggaccccacacuugguucaaggcucugcua

SEQ ID NO: 426371 - RNA, 64 nt, hsa
aaauuugauuaaaugguuuuauaguauaauauugggaccccauaccguuagcccuuguauguau

SEQ ID NO: 426372 - RNA, 64 nt, hsa
guguuguguccauuuugcaaacccaacuaagccaggaccccaaugcgacaaguaguucaugagu

SEQ ID NO: 426373 - RNA, 64 nt, hsa
uaugagacaggaaaaaccaacagguuuaucugaaggaccccagguaagauguuaaucucccagc

SEQ ID NO: 426374 - RNA, 64 nt, hsa
ccuggggagcuggaccaggagguggaggcucaggggaccccauggggacaggcagagcuggucu

SEQ ID NO: 426375 - RNA, 64 nt, hsa
gccuccacggccccuugcccuugcucagguucuuggaccccaggcagcugguguggagccccuu

SEQ ID NO: 426376 - RNA, 64 nt, hsa
gaaaguucuuccuccgagucagucaguggugccgggaccccagggcagccuccucgacuccuga

SEQ ID NO: 426377 - RNA, 64 nt, hsa
ccuccgcucugcucccuggcuccaggggugugggggaccccagaaccaggcagagugggaacuu

SEQ ID NO: 426378 - RNA, 64 nt, hsa
ucugucacccucccguggggcgaucacuguguggggaccccauuccccaguuaaagugugucuc

SEQ ID NO: 426379 - RNA, 64 nt, hsa
caccuugggcuggucuuuggccuggugcucacugggaccccauaugucugcguaggagcagaac

SEQ ID NO: 426380 - RNA, 64 nt, hsa
ggcagcugucacaucugaaggguuucugcaaccuggaccccaucugggugugggucagacccug

SEQ ID NO: 426381 - RNA, 64 nt, hsa
ccaugcccgguuugcuguuggaaugaucugaacaggaccccaaaugccucuucccucuggucau

SEQ ID NO: 426382 - RNA, 64 nt, hsa
gugagggacaguacugaagacucugcagcccucgggaccccacucggagggugcccucugcuca

SEQ ID NO: 426383 - RNA, 64 nt, hsa
cucccuagcaccucccccuaaccaaauucucccuggaccccauucugagcuccccaucaccaug

SEQ ID NO: 426384 - RNA, 64 nt, hsa
gaacgggaaguggaccccagcccgggagccugcuggaccccagaucguccccuccucccagcug

SEQ ID NO: 426385 - RNA, 64 nt, hsa
uggucggucuccacucccagggagaacgggaaguggaccccagcccgggagccugcuggacccc

SEQ ID NO: 426386 - RNA, 64 nt, hsa
gguucccugagcuguccagaccccaccaucucccggaccccagggagguggccauugccagaag

SEQ ID NO: 426387 - RNA, 64 nt, hsa
gaagggacaaaagccuguuccagagacccugggaggaccccaggcagggagagcccgccugccu

SEQ ID NO: 426388 - RNA, 64 nt, hsa
gccugccggcaucaccugcggccacaccugagauggaccccacgcagcccugaucgcaggaggc

SEQ ID NO: 426389 - RNA, 64 nt, hsa
cauuccccucccccugugguccagugaagccuccggaccccaggcucugcucugcccugcccug

SEQ ID NO: 426390 - RNA, 64 nt, hsa
ccugggccccggcccuugagguacucccugagcaggaccccacacuugggugggggggcuuauc

SEQ ID NO: 426391 - RNA, 64 nt, hsa
gauuucaaucuacguucuagucacuggccucaaaggaccccacagcaccugggccagaccaaca

SEQ ID NO: 426392 - RNA, 64 nt, hsa
cucuauuuuuuaaguaacgacuucccccuuugggggaccccaaaauuuggaggccccauucuag

SEQ ID NO: 426393 - RNA, 64 nt, hsa
ccugccugacagccuuccccagcuccagcaggaaggaccccacauccuucucacugccauggaa

SEQ ID NO: 426394 - RNA, 64 nt, hsa
acagacucacugggaagcucccaccccacucaggggaccccacuccccucacacacaccccccc

SEQ ID NO: 426395 - RNA, 64 nt, hsa
gaccguuuggagaccaagcagcagaugcagguguggaccccaggaaccuacaggggugucagcc

SEQ ID NO: 426396 - RNA, 64 nt, hsa
auuuuuggcacauuuguucuggccuggcuuggugggaccccaccccuauucugcuucugugagu

SEQ ID NO: 426397 - RNA, 64 nt, hsa
cugucgcugaagcacuuaagaaauaaagguacuuuacagcaacauucgccauacuagcggaggu

SEQ ID NO: 426398 - RNA, 64 nt, hsa
aaaaguugaggacuuggugaaaggaaauagcaguuacagcaaaaccucagugauuacaauugag

SEQ ID NO: 426399 - RNA, 64 nt, hsa
ccucccccaccgcaucuggccagauggacuguccuacagcaaucguuuccaucugucacccucu

SEQ ID NO: 426400 - RNA, 64 nt, hsa
acagugguacagaaauacaucuuugcucugagaauacagcaaauauuaacuuaaauuauuauaa

SEQ ID NO: 426401 - RNA, 64 nt, hsa
gguuucuuuuaagaauuuguugccuuucuacuauuacagcaaagcagcauuuuguuacugacug

SEQ ID NO: 426402 - RNA, 64 nt, hsa
acaugaaacaaccagugaucaugcuuuagaagccuacagcaacauucugagacugcuccaacau

SEQ ID NO: 426403 - RNA, 64 nt, hsa
uuaaaugugaccauuuuucugguaugaauaaacuuacagcaacaaauaaucaaagauacaauua

SEQ ID NO: 426404 - RNA, 64 nt, hsa
uuuuuucauuuuuuauuuugaaaaauugcaaaucuacagcaaaaguaaaacaguagagugaaca

SEQ ID NO: 426405 - RNA, 64 nt, hsa
gcucaaaguaucuuuuagacuuuuaaggacaauuuacagcaaaugaaauuuaugaugcugugac

SEQ ID NO: 426406 - RNA, 64 nt, hsa
aaccaggaaggaauggaaaaaaaauucuuuucucuacagcaaauuaaugugaggaagcuccucc

SEQ ID NO: 426407 - RNA, 64 nt, hsa
aaccauuugaugugagaaacaauucuuuuuaauuuacagcaaaauauugaauaaccauugacaa

SEQ ID NO: 426408 - RNA, 64 nt, hsa
caccuaaaagugugguuguuuccaacauguauaauacagcaacaacuaucuggcccaaacugcu

SEQ ID NO: 426409 - RNA, 64 nt, hsa
aaagagccagcuagcucuuucaaccacaugagguuacagcaagaagucagcagucuacagugca

SEQ ID NO: 426410 - RNA, 64 nt, hsa
ucacacuacccaacuuuaaaccauacuacaaggcuacagcaacuaaaacagcaugguacuggua

SEQ ID NO: 426411 - RNA, 64 nt, hsa
augcagccauaaaaaagaacaagacuguguccuuuacagcaacauagauggagcugaggcucuu

SEQ ID NO: 426412 - RNA, 64 nt, hsa
cucacaauucuuuuuuuuucuuuuucacucaaacuacagcaaaauauuauauuucuauccuaua

SEQ ID NO: 426413 - RNA, 64 nt, hsa
uccauacaugagagaacccuauugcugcaaugaauacagcaaggccuuuacccacuguuauuuu

SEQ ID NO: 426414 - RNA, 64 nt, hsa; identical to SEQ ID NO: 153216

SEQ ID NO: 426415 - RNA, 64 nt, hsa; identical to SEQ ID NO: 153217

SEQ ID NO: 426416 - RNA, 64 nt, hsa; identical to SEQ ID NO: 153218

SEQ ID NO: 426417 - RNA, 64 nt, hsa; identical to SEQ ID NO: 153219

SEQ ID NO: 426418 - RNA, 64 nt, hsa; identical to SEQ ID NO: 153220

SEQ ID NO: 426419 - RNA, 64 nt, hsa; identical to SEQ ID NO: 153221

SEQ ID NO: 426420 - RNA, 64 nt, hsa; identical to SEQ ID NO: 153222

SEQ ID NO: 426421 - RNA, 64 nt, hsa; identical to SEQ ID NO: 153223

SEQ ID NO: 426422 - RNA, 64 nt, hsa; identical to SEQ ID NO: 153224

SEQ ID NO: 426423 - RNA, 64 nt, hsa; identical to SEQ ID NO: 153225

SEQ ID NO: 426424 - RNA, 64 nt, hsa; identical to SEQ ID NO: 153226

SEQ ID NO: 426425 - RNA, 64 nt, hsa; identical to SEQ ID NO: 153227

SEQ ID NO: 426426 - RNA, 64 nt, hsa; identical to SEQ ID NO: 153228

SEQ ID NO: 426427 - RNA, 64 nt, hsa; identical to SEQ ID NO: 153229

SEQ ID NO: 426428 - RNA, 64 nt, hsa; identical to SEQ ID NO: 153230

SEQ ID NO: 426429 - RNA, 64 nt, hsa; identical to SEQ ID NO: 153231

SEQ ID NO: 426430 - RNA, 64 nt, hsa; identical to SEQ ID NO: 153232

SEQ ID NO: 426431 - RNA, 64 nt, hsa; identical to SEQ ID NO: 153233

SEQ ID NO: 426432 - RNA, 64 nt, hsa; identical to SEQ ID NO: 153234

SEQ ID NO: 426433 - RNA, 64 nt, hsa; identical to SEQ ID NO: 153235

SEQ ID NO: 426434 - RNA, 64 nt, hsa; identical to SEQ ID NO: 153236

SEQ ID NO: 426435 - RNA, 64 nt, hsa; identical to SEQ ID NO: 343362

SEQ ID NO: 426436 - RNA, 64 nt, hsa; identical to SEQ ID NO: 343363

SEQ ID NO: 426437 - RNA, 64 nt, hsa; identical to SEQ ID NO: 343364

SEQ ID NO: 426438 - RNA, 64 nt, hsa; identical to SEQ ID NO: 343365

SEQ ID NO: 426439 - RNA, 64 nt, hsa; identical to SEQ ID NO: 343366

SEQ ID NO: 426440 - RNA, 64 nt, hsa; identical to SEQ ID NO: 343367

SEQ ID NO: 426441 - RNA, 64 nt, hsa; identical to SEQ ID NO: 343368

SEQ ID NO: 426442 - RNA, 64 nt, hsa; identical to SEQ ID NO: 343369

SEQ ID NO: 426443 - RNA, 64 nt, hsa; identical to SEQ ID NO: 343370

SEQ ID NO: 426444 - RNA, 64 nt, hsa; identical to SEQ ID NO: 343371

SEQ ID NO: 426445 - RNA, 64 nt, hsa; identical to SEQ ID NO: 343372

SEQ ID NO: 426446 - RNA, 64 nt, hsa; identical to SEQ ID NO: 343373

SEQ ID NO: 426447 - RNA, 64 nt, hsa; identical to SEQ ID NO: 343374

SEQ ID NO: 426448 - RNA, 64 nt, hsa; identical to SEQ ID NO: 343375

SEQ ID NO: 426449 - RNA, 64 nt, hsa; identical to SEQ ID NO: 343376

SEQ ID NO: 426450 - RNA, 64 nt, hsa; identical to SEQ ID NO: 343377

SEQ ID NO: 426451 - RNA, 64 nt, hsa; identical to SEQ ID NO: 343378

SEQ ID NO: 426452 - RNA, 64 nt, hsa; identical to SEQ ID NO: 343379

SEQ ID NO: 426453 - RNA, 64 nt, hsa; identical to SEQ ID NO: 343380

SEQ ID NO: 426454 - RNA, 64 nt, hsa; identical to SEQ ID NO: 343381

SEQ ID NO: 426455 - RNA, 64 nt, hsa; identical to SEQ ID NO: 343382

SEQ ID NO: 426456 - RNA, 64 nt, hsa; identical to SEQ ID NO: 343383

SEQ ID NO: 426457 - RNA, 64 nt, hsa; identical to SEQ ID NO: 343384

SEQ ID NO: 426458 - RNA, 64 nt, hsa; identical to SEQ ID NO: 343385

SEQ ID NO: 426459 - RNA, 64 nt, hsa; identical to SEQ ID NO: 343386

SEQ ID NO: 426460 - RNA, 64 nt, hsa; identical to SEQ ID NO: 343387

SEQ ID NO: 426461 - RNA, 64 nt, hsa; identical to SEQ ID NO: 343388

SEQ ID NO: 426462 - RNA, 64 nt, hsa; identical to SEQ ID NO: 343389

SEQ ID NO: 426463 - RNA, 64 nt, hsa; identical to SEQ ID NO: 343390

SEQ ID NO: 426464 - RNA, 64 nt, hsa; identical to SEQ ID NO: 228970

SEQ ID NO: 426465 - RNA, 64 nt, hsa; identical to SEQ ID NO: 228971

SEQ ID NO: 426466 - RNA, 64 nt, hsa; identical to SEQ ID NO: 228972

SEQ ID NO: 426467 - RNA, 64 nt, hsa; identical to SEQ ID NO: 228973

SEQ ID NO: 426468 - RNA, 64 nt, hsa; identical to SEQ ID NO: 228974

SEQ ID NO: 426469 - RNA, 64 nt, hsa; identical to SEQ ID NO: 228975

SEQ ID NO: 426470 - RNA, 64 nt, hsa; identical to SEQ ID NO: 228976

SEQ ID NO: 426471 - RNA, 64 nt, hsa; identical to SEQ ID NO: 228977

SEQ ID NO: 426472 - RNA, 64 nt, hsa; identical to SEQ ID NO: 228978

SEQ ID NO: 426473 - RNA, 64 nt, hsa; identical to SEQ ID NO: 228979

SEQ ID NO: 426474 - RNA, 64 nt, hsa; identical to SEQ ID NO: 70765

SEQ ID NO: 426475 - RNA, 64 nt, hsa; identical to SEQ ID NO: 70766

SEQ ID NO: 426476 - RNA, 64 nt, hsa; identical to SEQ ID NO: 70767

SEQ ID NO: 426477 - RNA, 64 nt, hsa; identical to SEQ ID NO: 70768

SEQ ID NO: 426478 - RNA, 64 nt, hsa; identical to SEQ ID NO: 70769

SEQ ID NO: 426479 - RNA, 64 nt, hsa; identical to SEQ ID NO: 70770

SEQ ID NO: 426480 - RNA, 64 nt, hsa; identical to SEQ ID NO: 70771

SEQ ID NO: 426481 - RNA, 64 nt, hsa; identical to SEQ ID NO: 70772

SEQ ID NO: 426482 - RNA, 64 nt, hsa; identical to SEQ ID NO: 70773

SEQ ID NO: 426483 - RNA, 64 nt, hsa; identical to SEQ ID NO: 70774

SEQ ID NO: 426484 - RNA, 64 nt, hsa; identical to SEQ ID NO: 70775

SEQ ID NO: 426485 - RNA, 64 nt, hsa; identical to SEQ ID NO: 70776

SEQ ID NO: 426486 - RNA, 64 nt, hsa; identical to SEQ ID NO: 70777

SEQ ID NO: 426487 - RNA, 64 nt, hsa; identical to SEQ ID NO: 70778

SEQ ID NO: 426488 - RNA, 64 nt, hsa; identical to SEQ ID NO: 70779

SEQ ID NO: 426489 - RNA, 64 nt, hsa; identical to SEQ ID NO: 70780

SEQ ID NO: 426490 - RNA, 64 nt, hsa; identical to SEQ ID NO: 70781

SEQ ID NO: 426491 - RNA, 64 nt, hsa; identical to SEQ ID NO: 70782

SEQ ID NO: 426492 - RNA, 64 nt, hsa; identical to SEQ ID NO: 70783

SEQ ID NO: 426493 - RNA, 64 nt, hsa; identical to SEQ ID NO: 70784

SEQ ID NO: 426494 - RNA, 64 nt, hsa; identical to SEQ ID NO: 70785

SEQ ID NO: 426495 - RNA, 64 nt, hsa; identical to SEQ ID NO: 70786

SEQ ID NO: 426496 - RNA, 64 nt, hsa; identical to SEQ ID NO: 70787

SEQ ID NO: 426497 - RNA, 64 nt, hsa; identical to SEQ ID NO: 70788

SEQ ID NO: 426498 - RNA, 64 nt, hsa; identical to SEQ ID NO: 70789

SEQ ID NO: 426499 - RNA, 64 nt, hsa; identical to SEQ ID NO: 70790

SEQ ID NO: 426500 - RNA, 64 nt, hsa; identical to SEQ ID NO: 70791

SEQ ID NO: 426501 - RNA, 64 nt, hsa; identical to SEQ ID NO: 70792

SEQ ID NO: 426502 - RNA, 64 nt, hsa; identical to SEQ ID NO: 70793

SEQ ID NO: 426503 - RNA, 64 nt, hsa; identical to SEQ ID NO: 70794

SEQ ID NO: 426504 - RNA, 64 nt, hsa; identical to SEQ ID NO: 70795

SEQ ID NO: 426505 - RNA, 64 nt, hsa; identical to SEQ ID NO: 70796

SEQ ID NO: 426506 - RNA, 64 nt, hsa; identical to SEQ ID NO: 70797

SEQ ID NO: 426507 - RNA, 64 nt, hsa; identical to SEQ ID NO: 70798

SEQ ID NO: 426508 - RNA, 64 nt, hsa; identical to SEQ ID NO: 70799

SEQ ID NO: 426509 - RNA, 64 nt, hsa; identical to SEQ ID NO: 70800

SEQ ID NO: 426510 - RNA, 64 nt, hsa; identical to SEQ ID NO: 70801

SEQ ID NO: 426511 - RNA, 64 nt, hsa; identical to SEQ ID NO: 70802

SEQ ID NO: 426512 - RNA, 64 nt, hsa; identical to SEQ ID NO: 70803

SEQ ID NO: 426513 - RNA, 64 nt, hsa; identical to SEQ ID NO: 70804

SEQ ID NO: 426514 - RNA, 64 nt, hsa; identical to SEQ ID NO: 70805

SEQ ID NO: 426515 - RNA, 64 nt, hsa; identical to SEQ ID NO: 70806

SEQ ID NO: 426516 - RNA, 64 nt, hsa; identical to SEQ ID NO: 70807

SEQ ID NO: 426517 - RNA, 64 nt, hsa; identical to SEQ ID NO: 70808

SEQ ID NO: 426518 - RNA, 64 nt, hsa; identical to SEQ ID NO: 70809

SEQ ID NO: 426519 - RNA, 64 nt, hsa; identical to SEQ ID NO: 70810

SEQ ID NO: 426520 - RNA, 64 nt, hsa; identical to SEQ ID NO: 70811

SEQ ID NO: 426521 - RNA, 64 nt, hsa; identical to SEQ ID NO: 70812

SEQ ID NO: 426522 - RNA, 64 nt, hsa; identical to SEQ ID NO: 70813

SEQ ID NO: 426523 - RNA, 64 nt, hsa; identical to SEQ ID NO: 70814

SEQ ID NO: 426524 - RNA, 64 nt, hsa; identical to SEQ ID NO: 70814

SEQ ID NO: 426525 - RNA, 64 nt, hsa; identical to SEQ ID NO: 70816

SEQ ID NO: 426526 - RNA, 64 nt, hsa; identical to SEQ ID NO: 70817

SEQ ID NO: 426527 - RNA, 64 nt, hsa; identical to SEQ ID NO: 70818

SEQ ID NO: 426528 - RNA, 64 nt, hsa; identical to SEQ ID NO: 70819

SEQ ID NO: 426529 - RNA, 64 nt, hsa; identical to SEQ ID NO: 70820

SEQ ID NO: 426530 - RNA, 64 nt, hsa; identical to SEQ ID NO: 70821

SEQ ID NO: 426531 - RNA, 64 nt, hsa; identical to SEQ ID NO: 70822

SEQ ID NO: 426532 - RNA, 64 nt, hsa; identical to SEQ ID NO: 70823

SEQ ID NO: 426533 - RNA, 64 nt, hsa; identical to SEQ ID NO: 70824

SEQ ID NO: 426534 - RNA, 64 nt, hsa; identical to SEQ ID NO: 70825

SEQ ID NO: 426535 - RNA, 64 nt, hsa; identical to SEQ ID NO: 70826

SEQ ID NO: 426536 - RNA, 64 nt, hsa; identical to SEQ ID NO: 70827

SEQ ID NO: 426537 - RNA, 64 nt, hsa; identical to SEQ ID NO: 70828

SEQ ID NO: 426538 - RNA, 64 nt, hsa; identical to SEQ ID NO: 70829

SEQ ID NO: 426539 - RNA, 64 nt, hsa; identical to SEQ ID NO: 154552

SEQ ID NO: 426540 - RNA, 64 nt, hsa; identical to SEQ ID NO: 154553

SEQ ID NO: 426541 - RNA, 64 nt, hsa; identical to SEQ ID NO: 154554

SEQ ID NO: 426542 - RNA, 64 nt, hsa; identical to SEQ ID NO: 154555

SEQ ID NO: 426543 - RNA, 64 nt, hsa
aggaguuauuuccaucaguugacauagauauuauucacuaaaauuuucagcagacucaaaauag

SEQ ID NO: 426544 - RNA, 64 nt, hsa
ccuaugggugagaagauguagaugacuauuguucucacuaaaguucuaaaauaauagcaagugu

SEQ ID NO: 426545 - RNA, 64 nt, hsa
uuaaauaaucacuaaaaucacuagauuuaaauaaucacuaaaaugauuugugagaaacuggcac

SEQ ID NO: 426546 - RNA, 64 nt, hsa
gcuuaaugcaagcuaggauagugauuuuaaauaaucacuaaaaucacuagauuuaaauaaucac

SEQ ID NO: 426547 - RNA, 64 nt, hsa
ggagguagaacucaguccucucccuugugagucuucacuaaaaucagugacucacuuccaaaga

SEQ ID NO: 426548 - RNA, 64 nt, hsa
aaauuuugaaaguuguauucucauaugacuaaguucacuaaaacccuggauugaaagugaaaau

SEQ ID NO: 426549 - RNA, 64 nt, hsa
gcuuaagauuuuuuuuuuucaaaugcauuuuuagucacuaaaaauuaacugucguaccaucuag

SEQ ID NO: 426550 - RNA, 64 nt, hsa
gcucaagaacuggguucuuuuucuaauaauuaacucacuaaaucugagccaguguccaaggaca

SEQ ID NO: 426551 - RNA, 64 nt, hsa
uuuauuugcaugaaaaaaacucacuaaauuuacaucacuaaacaaagguuaacccuugugugaa

SEQ ID NO: 426552 - RNA, 64 nt, hsa
uuuuauagacauuuuuuauuugcaugaaaaaaacucacuaaauuuacaucacuaaacaaagguu

SEQ ID NO: 426553 - RNA, 64 nt, hsa
gaaugcguuuuaguucuucaccuuuuaaauuaugucacuaaacuuuguaugaguucaaauaaau

SEQ ID NO: 426554 - RNA, 64 nt, hsa
aagaaauaaagaggcagaagauggauucaauagcucacuaaaauuuuauauauuuguaugauga

SEQ ID NO: 426555 - RNA, 64 nt, hsa; identical to SEQ ID NO: 234418

SEQ ID NO: 426556 - RNA, 64 nt, hsa; identical to SEQ ID NO: 234419

SEQ ID NO: 426557 - RNA, 64 nt, hsa; identical to SEQ ID NO: 234420

SEQ ID NO: 426558 - RNA, 64 nt, hsa; identical to SEQ ID NO: 234421

SEQ ID NO: 426559 - RNA, 64 nt, hsa; identical to SEQ ID NO: 234422

SEQ ID NO: 426560 - RNA, 64 nt, hsa; identical to SEQ ID NO: 234423

SEQ ID NO: 426561 - RNA, 64 nt, hsa; identical to SEQ ID NO: 234424

SEQ ID NO: 426562 - RNA, 64 nt, hsa; identical to SEQ ID NO: 234425

SEQ ID NO: 426563 - RNA, 64 nt, hsa; identical to SEQ ID NO: 234426

SEQ ID NO: 426564 - RNA, 64 nt, hsa; identical to SEQ ID NO: 234427

SEQ ID NO: 426565 - RNA, 64 nt, hsa; identical to SEQ ID NO: 234428

SEQ ID NO: 426566 - RNA, 64 nt, hsa; identical to SEQ ID NO: 234429

SEQ ID NO: 426567 - RNA, 64 nt, hsa; identical to SEQ ID NO: 234430

SEQ ID NO: 426568 - RNA, 64 nt, hsa; identical to SEQ ID NO: 234431

SEQ ID NO: 426569 - RNA, 64 nt, hsa; identical to SEQ ID NO: 234432

SEQ ID NO: 426570 - RNA, 64 nt, hsa; identical to SEQ ID NO: 234433

SEQ ID NO: 426571 - RNA, 64 nt, hsa; identical to SEQ ID NO: 234434

SEQ ID NO: 426572 - RNA, 64 nt, hsa; identical to SEQ ID NO: 234435

SEQ ID NO: 426573 - RNA, 64 nt, hsa; identical to SEQ ID NO: 234436

SEQ ID NO: 426574 - RNA, 64 nt, hsa; identical to SEQ ID NO: 234437

SEQ ID NO: 426575 - RNA, 64 nt, hsa; identical to SEQ ID NO: 234438

SEQ ID NO: 426576 - RNA, 64 nt, hsa; identical to SEQ ID NO: 234439

SEQ ID NO: 426577 - RNA, 64 nt, hsa; identical to SEQ ID NO: 234440

SEQ ID NO: 426578 - RNA, 64 nt, hsa; identical to SEQ ID NO: 234441

SEQ ID NO: 426579 - RNA, 64 nt, hsa; identical to SEQ ID NO: 234442

SEQ ID NO: 426580 - RNA, 64 nt, hsa; identical to SEQ ID NO: 234443

SEQ ID NO: 426581 - RNA, 64 nt, hsa; identical to SEQ ID NO: 234444

SEQ ID NO: 426582 - RNA, 64 nt, hsa; identical to SEQ ID NO: 234445

SEQ ID NO: 426583 - RNA, 64 nt, hsa; identical to SEQ ID NO: 234446

SEQ ID NO: 426584 - RNA, 64 nt, hsa; identical to SEQ ID NO: 234447

SEQ ID NO: 426585 - RNA, 64 nt, hsa; identical to SEQ ID NO: 234448

SEQ ID NO: 426586 - RNA, 64 nt, hsa; identical to SEQ ID NO: 315044

SEQ ID NO: 426587 - RNA, 64 nt, hsa; identical to SEQ ID NO: 315045

SEQ ID NO: 426588 - RNA, 64 nt, hsa; identical to SEQ ID NO: 315046

SEQ ID NO: 426589 - RNA, 64 nt, hsa; identical to SEQ ID NO: 315047

SEQ ID NO: 426590 - RNA, 64 nt, hsa; identical to SEQ ID NO: 315048

SEQ ID NO: 426591 - RNA, 64 nt, hsa; identical to SEQ ID NO: 315049

SEQ ID NO: 426592 - RNA, 64 nt, hsa; identical to SEQ ID NO: 315050

SEQ ID NO: 426593 - RNA, 64 nt, hsa; identical to SEQ ID NO: 315051

SEQ ID NO: 426594 - RNA, 64 nt, hsa; identical to SEQ ID NO: 315052

SEQ ID NO: 426595 - RNA, 64 nt, hsa; identical to SEQ ID NO: 315053

SEQ ID NO: 426596 - RNA, 64 nt, hsa; identical to SEQ ID NO: 315054

SEQ ID NO: 426597 - RNA, 64 nt, hsa; identical to SEQ ID NO: 315055

SEQ ID NO: 426598 - RNA, 64 nt, hsa; identical to SEQ ID NO: 315056

SEQ ID NO: 426599 - RNA, 64 nt, hsa; identical to SEQ ID NO: 315057

SEQ ID NO: 426600 - RNA, 64 nt, hsa; identical to SEQ ID NO: 315058

SEQ ID NO: 426601 - RNA, 64 nt, hsa; identical to SEQ ID NO: 315059

SEQ ID NO: 426602 - RNA, 64 nt, hsa; identical to SEQ ID NO: 315060

SEQ ID NO: 426603 - RNA, 64 nt, hsa; identical to SEQ ID NO: 315061

SEQ ID NO: 426604 - RNA, 64 nt, hsa; identical to SEQ ID NO: 315062

SEQ ID NO: 426605 - RNA, 64 nt, hsa; identical to SEQ ID NO: 315063

SEQ ID NO: 426606 - RNA, 64 nt, hsa; identical to SEQ ID NO: 315064

SEQ ID NO: 426607 - RNA, 64 nt, hsa; identical to SEQ ID NO: 315065

SEQ ID NO: 426608 - RNA, 64 nt, hsa; identical to SEQ ID NO: 315066

SEQ ID NO: 426609 - RNA, 64 nt, hsa; identical to SEQ ID NO: 315067

SEQ ID NO: 426610 - RNA, 57 nt, hsa; identical to SEQ ID NO: 315068

SEQ ID NO: 426611 - RNA, 64 nt, hsa; identical to SEQ ID NO: 315069

SEQ ID NO: 426612 - RNA, 64 nt, hsa; identical to SEQ ID NO: 315070

SEQ ID NO: 426613 - RNA, 64 nt, hsa; identical to SEQ ID NO: 315071

SEQ ID NO: 426614 - RNA, 64 nt, hsa; identical to SEQ ID NO: 315072

SEQ ID NO: 426615 - RNA, 64 nt, hsa; identical to SEQ ID NO: 315073

SEQ ID NO: 426616 - RNA, 64 nt, hsa; identical to SEQ ID NO: 315074

SEQ ID NO: 426617 - RNA, 64 nt, hsa; identical to SEQ ID NO: 315075

SEQ ID NO: 426618 - RNA, 64 nt, hsa; identical to SEQ ID NO: 379884

SEQ ID NO: 426619 - RNA, 64 nt, hsa; identical to SEQ ID NO: 379885

SEQ ID NO: 426620 - RNA, 64 nt, hsa; identical to SEQ ID NO: 379886

SEQ ID NO: 426621 - RNA, 64 nt, hsa; identical to SEQ ID NO: 379887

SEQ ID NO: 426622 - RNA, 64 nt, hsa; identical to SEQ ID NO: 379888

SEQ ID NO: 426623 - RNA, 64 nt, hsa; identical to SEQ ID NO: 379889

SEQ ID NO: 426624 - RNA, 64 nt, hsa; identical to SEQ ID NO: 379890

SEQ ID NO: 426625 - RNA, 64 nt, hsa; identical to SEQ ID NO: 379891

SEQ ID NO: 426626 - RNA, 64 nt, hsa; identical to SEQ ID NO: 379892

SEQ ID NO: 426627 - RNA, 64 nt, hsa; identical to SEQ ID NO: 379893

SEQ ID NO: 426628 - RNA, 64 nt, hsa; identical to SEQ ID NO: 379894

SEQ ID NO: 426629 - RNA, 64 nt, hsa; identical to SEQ ID NO: 379895

SEQ ID NO: 426630 - RNA, 64 nt, hsa; identical to SEQ ID NO: 264286

SEQ ID NO: 426631 - RNA, 64 nt, hsa; identical to SEQ ID NO: 264287

SEQ ID NO: 426632 - RNA, 64 nt, hsa; identical to SEQ ID NO: 264288

SEQ ID NO: 426633 - RNA, 64 nt, hsa; identical to SEQ ID NO: 264289

SEQ ID NO: 426634 - RNA, 64 nt, hsa; identical to SEQ ID NO: 264290

SEQ ID NO: 426635 - RNA, 64 nt, hsa; identical to SEQ ID NO: 264291

SEQ ID NO: 426636 - RNA, 64 nt, hsa; identical to SEQ ID NO: 264292

SEQ ID NO: 426637 - RNA, 64 nt, hsa; identical to SEQ ID NO: 264293

SEQ ID NO: 426638 - RNA, 64 nt, hsa; identical to SEQ ID NO: 264294

SEQ ID NO: 426639 - RNA, 64 nt, hsa; identical to SEQ ID NO: 264295

SEQ ID NO: 426640 - RNA, 64 nt, hsa; identical to SEQ ID NO: 264296

SEQ ID NO: 426641 - RNA, 64 nt, hsa; identical to SEQ ID NO: 264297

SEQ ID NO: 426642 - RNA, 64 nt, hsa; identical to SEQ ID NO: 264298

SEQ ID NO: 426643 - RNA, 64 nt, hsa; identical to SEQ ID NO: 264299

SEQ ID NO: 426644 - RNA, 64 nt, hsa; identical to SEQ ID NO: 264300

SEQ ID NO: 426645 - RNA, 64 nt, hsa; identical to SEQ ID NO: 264301

SEQ ID NO: 426646 - RNA, 64 nt, hsa; identical to SEQ ID NO: 246263

SEQ ID NO: 426647 - RNA, 64 nt, hsa; identical to SEQ ID NO: 246264

SEQ ID NO: 426648 - RNA, 64 nt, hsa; identical to SEQ ID NO: 246265

SEQ ID NO: 426649 - RNA, 64 nt, hsa; identical to SEQ ID NO: 246266

SEQ ID NO: 426650 - RNA, 64 nt, hsa; identical to SEQ ID NO: 246267

SEQ ID NO: 426651 - RNA, 64 nt, hsa; identical to SEQ ID NO: 246268

SEQ ID NO: 426652 - RNA, 64 nt, hsa; identical to SEQ ID NO: 105003

SEQ ID NO: 426653 - RNA, 64 nt, hsa; identical to SEQ ID NO: 105004

SEQ ID NO: 426654 - RNA, 64 nt, hsa; identical to SEQ ID NO: 105005

SEQ ID NO: 426655 - RNA, 64 nt, hsa; identical to SEQ ID NO: 105006

SEQ ID NO: 426656 - RNA, 64 nt, hsa; identical to SEQ ID NO: 105007

SEQ ID NO: 426657 - RNA, 54 nt, hsa; identical to SEQ ID NO: 100148

SEQ ID NO: 426658 - RNA, 64 nt, hsa; identical to SEQ ID NO: 105009

SEQ ID NO: 426659 - RNA, 64 nt, hsa; identical to SEQ ID NO: 105010

SEQ ID NO: 426660 - RNA, 64 nt, hsa; identical to SEQ ID NO: 105011

SEQ ID NO: 426661 - RNA, 64 nt, hsa; identical to SEQ ID NO: 105012

SEQ ID NO: 426662 - RNA, 64 nt, hsa; identical to SEQ ID NO: 105013

SEQ ID NO: 426663 - RNA, 64 nt, hsa; identical to SEQ ID NO: 105014

SEQ ID NO: 426664 - RNA, 64 nt, hsa; identical to SEQ ID NO: 105015

SEQ ID NO: 426665 - RNA, 64 nt, hsa
aucaguuucacaaaguuuguucccuaaggaaaucaaaucccauugucaccuaacucugaagauc

SEQ ID NO: 426666 - RNA, 64 nt, hsa
aucuaaauagcccuuggaucaguaugggaaccccaaaucccacagggccagauguggagucugu

SEQ ID NO: 426667 - RNA, 64 nt, hsa
uuagauauuuuguaugcaaagauggcucucccccaaaucccaguuuuucagcucaggauuauau

SEQ ID NO: 426668 - RNA, 64 nt, hsa
aagaaucauucucaaccugauaaucuguuaagaaaaaucccauaugaacaaucuggucauuaac

SEQ ID NO: 426669 - RNA, 64 nt, hsa
aggguuugcuguuugcgugaauggauuucuuuuuaaaucccauauuuuuuuuaucaugucguag

SEQ ID NO: 426670 - RNA, 64 nt, hsa
aaaauuuuguuuaaaacucagaauauaacauguaaaaucccaucugcuagaagcccauccugug

SEQ ID NO: 426671 - RNA, 64 nt, hsa
uguagacuaaagaacuuguugaaugcuaaggcugaaaucccaaccugagauuuguaguccagga

SEQ ID NO: 426672 - RNA, 64 nt, hsa
cauuaaguaagauccaggucaaauuccauuugacaaaucccagggacuauccaggaauuuuuuu

SEQ ID NO: 426673 - RNA, 64 nt, hsa
acaaaguuuuaagugacuagaaauauauacaguaaaaucccacuuucaugcaucucugggaaau

SEQ ID NO: 426674 - RNA, 64 nt, hsa
uauaggaaagccauuauuaguaguaaacuuuuacaaaucccauuuucaaauuacuuuuagaucu

SEQ ID NO: 426675 - RNA, 64 nt, hsa
ggugguucuucuccuccgaaauaauauacugcagaaaucccagacagagcuccuuacaaaccuu

SEQ ID NO: 426676 - RNA, 64 nt, hsa
cuguaacugucaaacuugccuuguauuagaaguuaaaucccaucguaaauacaucacgaggcca

SEQ ID NO: 426677 - RNA, 64 nt, hsa
gggaggggggagggggaagcaaaggggggaggucaaaucccaaaccauuacugaggggauucuc

SEQ ID NO: 426678 - RNA, 64 nt, hsa
agaacagagugccugcauucccaggaaaauacgaaaaucccaugagauaaauaaaaauauaggu

SEQ ID NO: 426679 - RNA, 64 nt, hsa
gaaacuugaguaauuuuuacauuucuaagacauuaaaucccauuuaaauucugugugaacauua

SEQ ID NO: 426680 - RNA, 64 nt, hsa
acagcacacuugcaaaaguauggucaaaggaaaaaaaucccacauuucaauuaacaaguagcau

SEQ ID NO: 426681 - RNA, 64 nt, hsa
aauuuaaaaaaaacaaaaauaaaaagcaaaacaaaaaucccaaaaugaauuccauucacaaaca

SEQ ID NO: 426682 - RNA, 64 nt, hsa
aaaugaauuccauucacaaacagaauuuuucaauaaaucccaguagagauacuugccuccuccc

SEQ ID NO: 426683 - RNA, 64 nt, hsa
agucuccaccucggccccagcaaagcgcuaagcagccggagagacagccagggcggcuuccuga

SEQ ID NO: 426684 - RNA, 64 nt, hsa
uagauuccagacccugcugccagagagaccugcugccggagagaaggggaggaggacuccagcu

SEQ ID NO: 426685 - RNA, 64 nt, hsa
ugguccaagacacagugaguaggagcucuguggaccaagacaaagcuggacuagagaguacagu

SEQ ID NO: 426686 - RNA, 64 nt, hsa
agucccuucauucuguagacguguauugguugguccaagacacagugaguaggagcucugugga

SEQ ID NO: 426687 - RNA, 64 nt, hsa
cugacaucuuauuuggugucucaaagcuguauuuccaagacagugguacaaggugacccuuaau

SEQ ID NO: 426688 - RNA, 64 nt, hsa
uuguuucauucuucucucuuccugucaccuucugccaagacauugauggcuucugacaucuuau

SEQ ID NO: 426689 - RNA, 64 nt, hsa
uugcuugaaccugggaggcagaggcugcagugagccaagacaaugccacuacacuccagccugg

SEQ ID NO: 426690 - RNA, 64 nt, hsa
ccuucuccccuggaaaaccugcucacuucugaccccaagacagcccccuccccuucccucuguc

SEQ ID NO: 426691 - RNA, 64 nt, hsa
aaggcugugauauggaaccagaaggcugucugaacuuuugaaaccuugugugggauugauggug

SEQ ID NO: 426692 - RNA, 64 nt, hsa
ucuugcauuggccaaagugaaaauuuuuuuuuuucuuuugaaaucuaguuuugaauaagucugg

SEQ ID NO: 426693 - RNA, 64 nt, hsa
cacuagaauccaugaccucccucgugcucucuuucuuuugaaacaaacuuuaaaaaggaaaaaa

SEQ ID NO: 426694 - RNA, 64 nt, hsa
uuggccuguuggcagaauuuauuuaggaacagcccuuuugaaagugucccaguaacaacgcacc

SEQ ID NO: 426695 - RNA, 64 nt, hsa
uuaacugguacuuuuauuauuuuuuagugaaagacuuuugaaaagugcccuuuccccuuaagag

SEQ ID NO: 426696 - RNA, 64 nt, hsa
uauuaugucugucaccaugaaaacuuagcugcaucuuuugaaauaucaaauaugaauuuucucu

SEQ ID NO: 426697 - RNA, 64 nt, hsa
ugugaaauacacuggugguguccuucuuacaaaacuuuugaaauaaaaaaaaaacucaaaucuu

SEQ ID NO: 426698 - RNA, 64 nt, hsa
aaccucuaacaagguuaaugugcaugcccaaggucuuuugaaauuucaguguguaaauuuccuu

SEQ ID NO: 426699 - RNA, 64 nt, hsa
auaauauaaacacuuuucugccccaucucccauacuuuugaaggucaguucuaugacagugaau

SEQ ID NO: 426700 - RNA, 64 nt, hsa
uaucacaaaguuuuauauguagaaaagugggguccuuuugaauaaaagaucauucaacuaaaaa

SEQ ID NO: 426701 - RNA, 64 nt, hsa
aucaagcuuacucugaaucaaagguuuuguaaaacuuuugaaaaugaacuuagcugcaaaauau

SEQ ID NO: 426702 - RNA, 64 nt, hsa
ccuccuucuguuccucuguuccccuucaugccuccuuuugaauugauaucucagcugucaauau

SEQ ID NO: 426703 - RNA, 64 nt, hsa
uaauaucuaguuuuuccaaaaaugauaguaauaucuuuugaagaacuaugcuuuuucaaaagca

SEQ ID NO: 426704 - RNA, 64 nt, hsa
uucagaugugguuuuaaauuuagauuauguauuccuuuugaaacauaagaaaaacauuuaaacc

SEQ ID NO: 426705 - RNA, 64 nt, hsa
accuuaccacuauguauauauguuuaauaucugucuuuugaaaugcagaaauaguuuaaauguu

SEQ ID NO: 426706 - RNA, 64 nt, hsa
uuuuuaaguggccugccucaauguauauuuauuucuuuugaaacaaaaagguucuggaaacugu

SEQ ID NO: 426707 - RNA, 54 nt, hsa
accauccagacacuguuuaguaaucuuuugaaacuuacuaaaagagguuuuuaa

SEQ ID NO: 426708 - RNA, 64 nt, hsa
uuucaaaugcaguccagugagaaauuacagguuccuuuugaagcucaacuguugccaggagaug

SEQ ID NO: 426709 - RNA, 64 nt, hsa
aagggauuugaucuuucuuuuuuuguuaucgaggcuuuugaaauguggaacuuguguguucugc

SEQ ID NO: 426710 - RNA, 64 nt, hsa
uacguucguuguuguuuguguacuuuuugcuuuucuuuugaaaguaugaaaaugauuuuuacaa

SEQ ID NO: 426711 - RNA, 64 nt, hsa
aguaguaugucauuguaacuagccaauaucacagcuuuugaaaaauuaaaaaaucacacuauau

SEQ ID NO: 426712 - RNA, 64 nt, hsa
aaggccuaugguaagguaacauugcuuuguuguacuuuugaacaagagcuccuccugaucacua

SEQ ID NO: 426713 - RNA, 64 nt, hsa
uuuaggguagaauuuuguucaguuuggauuuaaucuuuugaaaaguaaauuccuuguuuacugg

SEQ ID NO: 426714 - RNA, 64 nt, hsa
aauguucauuuuuaaauguuccuaacagauuuugcuuuugaaaaaugcuuguuacaugaauaau

SEQ ID NO: 426715 - RNA, 64 nt, hsa
cuucacagugccgaguuggcgggaaaagcaaauucuuuugaagucuuagucuuucccucaguag

SEQ ID NO: 426716 - RNA, 64 nt, hsa
cuuguuuguuuguuuuguacuaaaacaguauuaucuuuugaauaucguagggacauaaguauau

SEQ ID NO: 426717 - RNA, 64 nt, hsa
uucugauaucuuuuaaagacauaguucaaaauugcuuuugaaaaucuguauucuugaaaauauc

SEQ ID NO: 426718 - RNA, 64 nt, hsa
aggugacuuuuucaugguguuuguauguuuagcucuuuugaaaaggaauuuugaaaucuccauc

SEQ ID NO: 426719 - RNA, 64 nt, hsa
uucuauggcauauguauggaaggguguaaagauucuuuugaaagguuuauucacauuguagaac

SEQ ID NO: 426720 - RNA, 64 nt, hsa
uaaaguguuuguugaaaaggaguuucuucucuuccuuuugaaaaucaucacuuucuguauuuug

SEQ ID NO: 426721 - RNA, 64 nt, hsa
auuuaauagauguagggaaacuagauauugcugccuuuugaaugggguagggggguuuaccugg

SEQ ID NO: 426722 - RNA, 64 nt, hsa
ugugugacacagaaacggcacacucuuccacaugcuuuugaaguauuauaaaacacuuuauuac

SEQ ID NO: 426723 - RNA, 64 nt, hsa
ccuuaugauggaugugaaaaucuacggccaaauacuuuugaaaacaccuuucuauauugcacag

SEQ ID NO: 426724 - RNA, 64 nt, hsa
cuugauauucagguaaauuuucuuuuccaagaagcuuuugaauaagcauauuuccuccaaaggu

SEQ ID NO: 426725 - RNA, 64 nt, hsa
uuugugaagcaugguugaaauuagcuaguggucccuuuugaauuucaugagccucucaaaaaag

SEQ ID NO: 426726 - RNA, 64 nt, hsa
caagucaaucuacugaauuccuuuuuuaaauaaucuuuugaaacuaagaaaaugugucaaauug

SEQ ID NO: 426727 - RNA, 61 nt, hsa
ucaugcacuauacugauuaauuuuuuuuuuucuuuugaaguagauucuuauuacucaguca

SEQ ID NO: 426728 - RNA, 64 nt, hsa
ugaguguuucauuugggaguuauuuggccagggccuuuugaacaguaguguccccaugaagugc

SEQ ID NO: 426729 - RNA, 64 nt, hsa
gcagucacuuuuuaucauguuaacuaauuguucucuuuugaagaucuaugguugacuaauuaaa

SEQ ID NO: 426730 - RNA, 64 nt, hsa
ucugauccaucaaaagguucuuuuuuuauaaucccuuuugaaaaugauaaucaaaggaagagau

SEQ ID NO: 426731 - RNA, 64 nt, hsa
cagaugucacacgcuuucaucuucccuuugagcccuuuugaacccuccuggggcucugggguag

SEQ ID NO: 426732 - RNA, 64 nt, hsa
cuacuuaauucuuuuccauauauugugauacaaacuuuugaauauggaaucuuacuauuugaau

SEQ ID NO: 426733 - RNA, 64 nt, hsa
uaucaucuuguuuaaauguaaauguccccuuaugcuuuugaaauaaauuuccuuuuguaauuuu

SEQ ID NO: 426734 - RNA, 64 nt, hsa
aggugaaaauccaucucauucuggaaugguuuugcuuuugaauuuuugguuauuuuuguguuuc

SEQ ID NO: 426735 - RNA, 64 nt, hsa
gaaaagggaucugcucccaggcguucucacccuucuuuugaaggacuccuuaggcuuuguugaa

SEQ ID NO: 426736 - RNA, 64 nt, hsa
cccaaaacuuacuuuauguugcuuuguucaguaccuuuugaauucccccagaagaguuguuuuc

SEQ ID NO: 426737 - RNA, 64 nt, hsa
ccucggcuauugugcuggcuggacacuuuggucacuuuugaagcauguuaauaaaugucacuga

SEQ ID NO: 426738 - RNA, 64 nt, hsa
cuucugaguuuauauucugaaaggaaauacacuucuuuugaacauccccacuagguucuuuucc

SEQ ID NO: 426739 - RNA, 64 nt, hsa
agauauggcacuucuccaaccccggaaaacauugcuuuugaaaacugcugauaaaauaugagcc

SEQ ID NO: 426740 - RNA, 64 nt, hsa
guuuccaccuuggacugacuuugauccuguuccacuuuugaaauuuuauuuguuccuuuuccau

SEQ ID NO: 426741 - RNA, 64 nt, hsa
gaucuccggaccuuggcugcagaggccaucgcagcuuuugaaaagugaagggguuaauucccau

SEQ ID NO: 426742 - RNA, 64 nt, hsa
aacauaggcuuagcuacagugaaguuuugcauugcuuuugaagacaagaagauaagugcuagaa

SEQ ID NO: 426743 - RNA, 64 nt, hsa
aaaguauuuuuuuauuuuccuuuuuaagaugauacuuuugaaaugcaggauaugaugaguggga

SEQ ID NO: 426744 - RNA, 64 nt, hsa
uacuaggguagguucaagagcuacaugccucuggcuuuugaacccaucuauuaaaucuuuuuua

SEQ ID NO: 426745 - RNA, 64 nt, hsa
uguaagaaguuugacucauaauagaagacggugucuuuugaagcccagucucugucugucuuca

SEQ ID NO: 426746 - RNA, 64 nt, hsa
agguuuccugagaguucagcaguacagucuucaucuuuugaaagguagauauguugaaaauugu

SEQ ID NO: 426747 - RNA, 64 nt, hsa
agagauaaagacuacagaaggaaagagaucuugccuuuugaaaagaugaaggaacaaagguuga

SEQ ID NO: 426748 - RNA, 64 nt, hsa
uuugguuuucuuagcuuuugaauuugaagaaguacuuuugaagacucccauuuuaagaaccgug

SEQ ID NO: 426749 - RNA, 64 nt, hsa
gccuguguaacuguucccucuuugguuuucuuagcuuuugaauuugaagaaguacuuuugaaga

SEQ ID NO: 426750 - RNA, 64 nt, hsa
uuuucuuuccugcauuguuuuagucaaguaauggcuuuugaaaaaguaaaguucaauaauaacu

SEQ ID NO: 426751 - RNA, 64 nt, hsa
ggguuuguuaugucuuuauugaguauuuaaguaucuuuugaaacaaaugaccuguucaucugug

SEQ ID NO: 426752 - RNA, 64 nt, hsa
guaccaggauaaagccgaacugguaccaucuacucuuuugaaguguuuuagucuaguuauugga

SEQ ID NO: 426753 - RNA, 64 nt, hsa
augguaacuagguugacagauacuuuguauuuuucuuuugaauucagaccuggaauguaaguaa

SEQ ID NO: 426754 - RNA, 64 nt, hsa
ggguuuuuuucaucccugccaagaacucugggcacuuuugaacucacgagccuugcgcaaaacc

SEQ ID NO: 426755 - RNA, 64 nt, hsa
ugaagcuggggacagcuuuccugggugaguuuuucuuuugaauaauguagugcagucacccugu

SEQ ID NO: 426756 - RNA, 64 nt, hsa
caucuagguuucuuuuaucuggagaaaaagaacacuuuugaacuauguaaugcuucacccugaa

SEQ ID NO: 426757 - RNA, 64 nt, hsa
aauuucccauaaacuuaagugccuacacuuaggacuuuugaacuuucagucaucuuuuucgugg

SEQ ID NO: 426758 - RNA, 64 nt, hsa
aguacauauauuaaccgugagguguuaaacuuuucuuuugaagguuuggccaguuucuaaaaaa

SEQ ID NO: 426759 - RNA, 64 nt, hsa
aggagucuuacaccuguaucaugaaaacugaauccuuuugaaauaccacuauaugaagagagag

SEQ ID NO: 426760 - RNA, 64 nt, hsa
uugccugacaaagcagaaaucaccaaguuucccccuuuugaauuaccaccaagaaguguugaaa

SEQ ID NO: 426761 - RNA, 64 nt, hsa
aaaauguacuaaaaccuuccauuuuuuucaguaccuuuugaaaacaugaccaaacucauacuuc

SEQ ID NO: 426762 - RNA, 64 nt, hsa
aacaaugugguaaagcauuuaguagcuucaguuucuuuugaauacagucuucucuaguuucuga

SEQ ID NO: 426763 - RNA, 64 nt, hsa
ugaaauggcccugcugugucaguuucccuguggccuuuugaacuguacaucucacauguuggga

SEQ ID NO: 426764 - RNA, 64 nt, hsa
uuuccuaaaaucagaagaauuggaagauccuccccuuuugaaauggcccugcugugucaguuuc

SEQ ID NO: 426765 - RNA, 64 nt, hsa
aaagcuuauuugauagauaauguuuagagcauuucuuuugaaaaauuucaaaccuacacagaaa

SEQ ID NO: 426766 - RNA, 64 nt, hsa
ugagcacagcugcauuaaaacaaaggaaguucuccuuuugaacuugucacgaauuccaucuugu

SEQ ID NO: 426767 - RNA, 64 nt, hsa
aauuugaagauuugagagcaugaagauauucaugcuuuugaacucaaaauauugaagauacucu

SEQ ID NO: 426768 - RNA, 64 nt, hsa
auguggcaccuuaaacuuaaauauccaaagaugccuuuugaauuucaaagauuaaaacacagcu

SEQ ID NO: 426769 - RNA, 64 nt, hsa
uauucuaaaucuuguuaaugacgaagaguccaauguaucucauuauuuguagccaauuuuagac

SEQ ID NO: 426770 - RNA, 64 nt, hsa
cuccuucucucaaacuuguauuucuccuggaaauguaucucagaaaugaccuccucucccaacc

SEQ ID NO: 426771 - RNA, 64 nt, hsa
gugcuguugcucaguagucuccuugaauguucaaguaucucauccacucaguuuugugauuccu

SEQ ID NO: 426772 - RNA, 64 nt, hsa
cugugagacugaaaucccagaacauuguuugccaguaucucaaccacagccaggaaguauaugu

SEQ ID NO: 426773 - RNA, 64 nt, hsa
caggguuccugugguuucccuggucccucugagauggggacagacugaagacagaggucguuug

SEQ ID NO: 426774 - RNA, 64 nt, hsa
aauuaccaaaugcuucuaaauaugaaggagagguuggggacacgcacccuaugugauaccaagu

SEQ ID NO: 426775 - RNA, 64 nt, hsa
cuuugcaaaaugaccuggugacauggcaagucaguggggacaggaaggaccacucccuaaguaa

SEQ ID NO: 426776 - RNA, 64 nt, hsa
ucugcaucugcgaaugugcccuaggugcugcugcuggggacauggaugccaagcggaggccugc

SEQ ID NO: 426777 - RNA, 64 nt, hsa
gacugguggcggugggaggguuugcugggacugauggggacaccggccagcuugucuggugucc

SEQ ID NO: 426778 - RNA, 64 nt, hsa
cuuucuuugacagccaggccuagacagacaggccuggggacacuggccccaugaggggaggaag

SEQ ID NO: 426779 - RNA, 64 nt, hsa
gcuaucuccuaugccccuggacaggacaguuggcuggggacaggagaagugcucaaucuucaug

SEQ ID NO: 426780 - RNA, 64 nt, hsa
uggaggagagccugguugcccagggauuuguccuuggggacaucucauccaucaaguugcacac

SEQ ID NO: 426781 - RNA, 64 nt, hsa
ccaucaaguugcacacucacuggcaucuuugcuauggggacauuccaauuugcacuuucaggaa

SEQ ID NO: 426782 - RNA, 64 nt, hsa
uuucuauacaguaguuuugugauuagaauucaccuggggacacacacucacacgcacagucacu

SEQ ID NO: 426783 - RNA, 64 nt, hsa
uuauuuaaucaacuuuaagcauuacauucucaauuggggacaaaaauugguucuuggggugaaa

SEQ ID NO: 426784 - RNA, 64 nt, hsa
ggggaaccccucccauuaaagauccgggcaggacuggggacagguuggaagugugauggguggg

SEQ ID NO: 426785 - RNA, 64 nt, hsa
gacgccagcccugcccaaucagagaugccaaaaauggggacaugacuucuggacagaggacaug

SEQ ID NO: 426786 - RNA, 64 nt, hsa
gcggggacccggacagccaggugacuaccaguccuggggacacacucaccauaaacacaucccc

SEQ ID NO: 426787 - RNA, 64 nt, hsa
ucucgagagccagagcagcaguugaauguaaugcuggggacaggcaugcugccgccaguagggc

SEQ ID NO: 426788 - RNA, 64 nt, hsa
gcuggggggaugcuuagcucagagcaguggcugauggggacacugagauaagaucggaggggag

SEQ ID NO: 426789 - RNA, 64 nt, hsa
agugucauaggaguggagggggauaaguggggacuggggacaugugaaaugaugggcauuccag

SEQ ID NO: 426790 - RNA, 64 nt, hsa
agaacggaguuaugaguuggucagcagaggaggcuggggacaggcaguuuuuggucuuuuaccu

SEQ ID NO: 426791 - RNA, 64 nt, hsa
cacuuccucccaugagacagagugauggccagcuuggggacauuugcuuuaaaugggaaagagg

SEQ ID NO: 426792 - RNA, 64 nt, hsa
gagugcuauuagaacacagcuuauuacauggauauggggacaggagagauuaaagcagguucaa

SEQ ID NO: 426793 - RNA, 64 nt, hsa
agggugaugagugcugguccugacaggaggccgcuggggacacugugcuguuuuguuucguuuc

SEQ ID NO: 426794 - RNA, 64 nt, hsa
cagcacuugcauuaccgucccugcucuucccagguggggacaguggcccaagcaaggccucacu

SEQ ID NO: 426795 - RNA, 64 nt, hsa
auucugagagauaccauuuaaguugagauuucaguggggacacagccaaaccauaucauucuac

SEQ ID NO: 426796 - RNA, 64 nt, hsa
aauuccagaagauaaauucaaguugcaauuucaguggggacauagccaaaccauaucacuggug

SEQ ID NO: 426797 - RNA, 64 nt, hsa
uuuucacaauucaugggggccugcauggcaggaguggggacaggacaccugcuguuccuggagu

SEQ ID NO: 426798 - RNA, 64 nt, hsa
cuggggguaaaacagggaaggcagugccugagcauggggacaggugagguggggcugggcagac

SEQ ID NO: 426799 - RNA, 64 nt, hsa
gcucagcucauccucccucuggccccuucucccauggggacaucucggcccagcaccccuaucc

SEQ ID NO: 426800 - RNA, 64 nt, hsa
uuccucccaaacaaugacuuccugccauguuugauggggacagcuaccacuguccucugccccc

SEQ ID NO: 426801 - RNA, 64 nt, hsa
ggagacagguagacagaccuccaggucccuaagcuggggacagagaagguucugagcuguccca

SEQ ID NO: 426802 - RNA, 64 nt, hsa
uauacaaugccucccagcuagacuguaagcccuuuggggacaagggcugcuuccaguucuugga

SEQ ID NO: 426803 - RNA, 64 nt, hsa
cuaaggcguggagcugccugauauuucccuccccuggggacagcaagggcuaucccuuuccaaa

SEQ ID NO: 426804 - RNA, 64 nt, hsa
aaagagaagguggguuuucaucaagacuggaagguggggacagggaugagcauggagcuggccg

SEQ ID NO: 426805 - RNA, 64 nt, hsa
ugaccugccaaaaguucucuugccccaugccugcuggggacagaagguuuucaugaacucuuuu

SEQ ID NO: 426806 - RNA, 64 nt, hsa
uuguggcagggcucuaccaggagggagugagaucuggggacacaguggcuuccaaguuuucuaa

SEQ ID NO: 426807 - RNA, 64 nt, hsa
agauccaccuccccacugccuuuucucacucagauggggacaccgagguccagaggaaaagaca

SEQ ID NO: 426808 - RNA, 64 nt, hsa
ccugggauggcucaaaggagucaggacuuggaaguggggacaucaggguagcugaaggaaaucc

SEQ ID NO: 426809 - RNA, 64 nt, hsa
guaccccuccagauguggggacauuccaccccaguggggacagccauuccccuaccugcuccag

SEQ ID NO: 426810 - RNA, 64 nt, hsa
ccucugccuagacacugggguaccccuccagauguggggacauuccaccccaguggggacagcc

SEQ ID NO: 426811 - RNA, 64 nt, hsa
ccucgcccuaccaagagggcaccugaggagacuuuggggacagggcaggggcagggagggaaac

SEQ ID NO: 426812 - RNA, 64 nt, hsa
aggcuuggucaauuccugagagcauccucugugcuggggacacagugguaaucaagacagcccc

SEQ ID NO: 426813 - RNA, 64 nt, hsa
uguagccucuggguguggagcugggaucuucaacuggggacaguacaguaaagaacaucacagc

SEQ ID NO: 426814 - RNA, 64 nt, hsa
cugugccccggcgaggccggagagcuggugacuuuggggacagggggugggaaggggauggaca

SEQ ID NO: 426815 - RNA, 64 nt, hsa
caaugcuccagcugucgucugacucuggguucguuggggacaugagauuuuauuuuuugugagu

SEQ ID NO: 426816 - RNA, 64 nt, hsa
gguggcauuuggccuugaacaaaaccaaguccacuggggacagaggcaggggcaaguggcucuc

SEQ ID NO: 426817 - RNA, 64 nt, hsa
cccguuuucccaagaagaggguucgagcccuugguggggacagcuggggagauggcagugcagg

SEQ ID NO: 426818 - RNA, 64 nt, hsa; identical to SEQ ID NO: 82791

SEQ ID NO: 426819 - RNA, 64 nt, hsa; identical to SEQ ID NO: 82792

SEQ ID NO: 426820 - RNA, 64 nt, hsa; identical to SEQ ID NO: 82793

SEQ ID NO: 426821 - RNA, 64 nt, hsa; identical to SEQ ID NO: 82794

SEQ ID NO: 426822 - RNA, 64 nt, hsa; identical to SEQ ID NO: 82795

SEQ ID NO: 426823 - RNA, 64 nt, hsa; identical to SEQ ID NO: 82796

SEQ ID NO: 426824 - RNA, 64 nt, hsa; identical to SEQ ID NO: 82797

SEQ ID NO: 426825 - RNA, 64 nt, hsa; identical to SEQ ID NO: 82798

SEQ ID NO: 426826 - RNA, 64 nt, hsa; identical to SEQ ID NO: 82799

SEQ ID NO: 426827 - RNA, 64 nt, hsa; identical to SEQ ID NO: 82800

SEQ ID NO: 426828 - RNA, 64 nt, hsa; identical to SEQ ID NO: 82801

SEQ ID NO: 426829 - RNA, 64 nt, hsa; identical to SEQ ID NO: 82802

SEQ ID NO: 426830 - RNA, 64 nt, hsa; identical to SEQ ID NO: 82803

SEQ ID NO: 426831 - RNA, 64 nt, hsa; identical to SEQ ID NO: 82804

SEQ ID NO: 426832 - RNA, 64 nt, hsa; identical to SEQ ID NO: 82805

SEQ ID NO: 426833 - RNA, 64 nt, hsa; identical to SEQ ID NO: 82806

SEQ ID NO: 426834 - RNA, 64 nt, hsa; identical to SEQ ID NO: 82807

SEQ ID NO: 426835 - RNA, 64 nt, hsa; identical to SEQ ID NO: 82808

SEQ ID NO: 426836 - RNA, 64 nt, hsa; identical to SEQ ID NO: 82809

SEQ ID NO: 426837 - RNA, 64 nt, hsa; identical to SEQ ID NO: 82810

SEQ ID NO: 426838 - RNA, 61 nt, hsa; identical to SEQ ID NO: 82811

SEQ ID NO: 426839 - RNA, 64 nt, hsa; identical to SEQ ID NO: 82812

SEQ ID NO: 426840 - RNA, 64 nt, hsa; identical to SEQ ID NO: 82813

SEQ ID NO: 426841 - RNA, 64 nt, hsa; identical to SEQ ID NO: 82814

SEQ ID NO: 426842 - RNA, 64 nt, hsa; identical to SEQ ID NO: 82815

SEQ ID NO: 426843 - RNA, 64 nt, hsa; identical to SEQ ID NO: 82816

SEQ ID NO: 426844 - RNA, 64 nt, hsa; identical to SEQ ID NO: 82817

SEQ ID NO: 426845 - RNA, 64 nt, hsa; identical to SEQ ID NO: 82818

SEQ ID NO: 426846 - RNA, 64 nt, hsa; identical to SEQ ID NO: 82819

SEQ ID NO: 426847 - RNA, 64 nt, hsa; identical to SEQ ID NO: 82820

SEQ ID NO: 426848 - RNA, 64 nt, hsa; identical to SEQ ID NO: 82821

SEQ ID NO: 426849 - RNA, 64 nt, hsa; identical to SEQ ID NO: 82822

SEQ ID NO: 426850 - RNA, 64 nt, hsa; identical to SEQ ID NO: 82823

SEQ ID NO: 426851 - RNA, 64 nt, hsa; identical to SEQ ID NO: 82824

SEQ ID NO: 426852 - RNA, 64 nt, hsa; identical to SEQ ID NO: 82825

SEQ ID NO: 426853 - RNA, 64 nt, hsa; identical to SEQ ID NO: 82826

SEQ ID NO: 426854 - RNA, 64 nt, hsa; identical to SEQ ID NO: 82827

SEQ ID NO: 426855 - RNA, 64 nt, hsa; identical to SEQ ID NO: 82828

SEQ ID NO: 426856 - RNA, 64 nt, hsa; identical to SEQ ID NO: 82829

SEQ ID NO: 426857 - RNA, 64 nt, hsa; identical to SEQ ID NO: 82830

SEQ ID NO: 426858 - RNA, 64 nt, hsa; identical to SEQ ID NO: 82831

SEQ ID NO: 426859 - RNA, 64 nt, hsa; identical to SEQ ID NO: 82832

SEQ ID NO: 426860 - RNA, 64 nt, hsa; identical to SEQ ID NO: 82833

SEQ ID NO: 426861 - RNA, 64 nt, hsa; identical to SEQ ID NO: 82834

SEQ ID NO: 426862 - RNA, 64 nt, hsa; identical to SEQ ID NO: 82835

SEQ ID NO: 426863 - RNA, 64 nt, hsa; identical to SEQ ID NO: 82836

SEQ ID NO: 426864 - RNA, 64 nt, hsa; identical to SEQ ID NO: 82837

SEQ ID NO: 426865 - RNA, 64 nt, hsa; identical to SEQ ID NO: 82838

SEQ ID NO: 426866 - RNA, 64 nt, hsa; identical to SEQ ID NO: 82839

SEQ ID NO: 426867 - RNA, 64 nt, hsa; identical to SEQ ID NO: 82840

SEQ ID NO: 426868 - RNA, 64 nt, hsa; identical to SEQ ID NO: 68831

SEQ ID NO: 426869 - RNA, 64 nt, hsa; identical to SEQ ID NO: 68832

SEQ ID NO: 426870 - RNA, 64 nt, hsa; identical to SEQ ID NO: 68833

SEQ ID NO: 426871 - RNA, 64 nt, hsa; identical to SEQ ID NO: 68834

SEQ ID NO: 426872 - RNA, 64 nt, hsa; identical to SEQ ID NO: 68835

SEQ ID NO: 426873 - RNA, 64 nt, hsa; identical to SEQ ID NO: 68836

SEQ ID NO: 426874 - RNA, 64 nt, hsa; identical to SEQ ID NO: 68837

SEQ ID NO: 426875 - RNA, 64 nt, hsa; identical to SEQ ID NO: 68838

SEQ ID NO: 426876 - RNA, 64 nt, hsa; identical to SEQ ID NO: 68839

SEQ ID NO: 426877 - RNA, 64 nt, hsa; identical to SEQ ID NO: 68840

SEQ ID NO: 426878 - RNA, 64 nt, hsa; identical to SEQ ID NO: 68841

SEQ ID NO: 426879 - RNA, 64 nt, hsa; identical to SEQ ID NO: 68842

SEQ ID NO: 426880 - RNA, 64 nt, hsa; identical to SEQ ID NO: 68843

SEQ ID NO: 426881 - RNA, 64 nt, hsa; identical to SEQ ID NO: 68844

SEQ ID NO: 426882 - RNA, 64 nt, hsa; identical to SEQ ID NO: 68845

SEQ ID NO: 426883 - RNA, 64 nt, hsa; identical to SEQ ID NO: 68846

SEQ ID NO: 426884 - RNA, 64 nt, hsa; identical to SEQ ID NO: 68847

SEQ ID NO: 426885 - RNA, 64 nt, hsa; identical to SEQ ID NO: 68848

SEQ ID NO: 426886 - RNA, 64 nt, hsa; identical to SEQ ID NO: 68849

SEQ ID NO: 426887 - RNA, 64 nt, hsa; identical to SEQ ID NO: 68850

SEQ ID NO: 426888 - RNA, 64 nt, hsa; identical to SEQ ID NO: 68851

SEQ ID NO: 426889 - RNA, 64 nt, hsa; identical to SEQ ID NO: 68852

SEQ ID NO: 426890 - RNA, 64 nt, hsa; identical to SEQ ID NO: 68853

SEQ ID NO: 426891 - RNA, 64 nt, hsa; identical to SEQ ID NO: 68854

SEQ ID NO: 426892 - RNA, 64 nt, hsa; identical to SEQ ID NO: 68855

SEQ ID NO: 426893 - RNA, 64 nt, hsa; identical to SEQ ID NO: 68856

SEQ ID NO: 426894 - RNA, 64 nt, hsa; identical to SEQ ID NO: 68857

SEQ ID NO: 426895 - RNA, 64 nt, hsa; identical to SEQ ID NO: 68858

SEQ ID NO: 426896 - RNA, 64 nt, hsa; identical to SEQ ID NO: 68859

SEQ ID NO: 426897 - RNA, 64 nt, hsa; identical to SEQ ID NO: 68860

SEQ ID NO: 426898 - RNA, 64 nt, hsa; identical to SEQ ID NO: 68861

SEQ ID NO: 426899 - RNA, 64 nt, hsa; identical to SEQ ID NO: 68862

SEQ ID NO: 426900 - RNA, 64 nt, hsa; identical to SEQ ID NO: 68863

SEQ ID NO: 426901 - RNA, 64 nt, hsa; identical to SEQ ID NO: 68864

SEQ ID NO: 426902 - RNA, 64 nt, hsa; identical to SEQ ID NO: 68865

SEQ ID NO: 426903 - RNA, 64 nt, hsa; identical to SEQ ID NO: 68866

SEQ ID NO: 426904 - RNA, 64 nt, hsa; identical to SEQ ID NO: 68867

SEQ ID NO: 426905 - RNA, 64 nt, hsa; identical to SEQ ID NO: 68868

SEQ ID NO: 426906 - RNA, 64 nt, hsa; identical to SEQ ID NO: 68869

SEQ ID NO: 426907 - RNA, 64 nt, hsa; identical to SEQ ID NO: 68870

SEQ ID NO: 426908 - RNA, 64 nt, hsa; identical to SEQ ID NO: 68871

SEQ ID NO: 426909 - RNA, 64 nt, hsa; identical to SEQ ID NO: 68872

SEQ ID NO: 426910 - RNA, 64 nt, hsa; identical to SEQ ID NO: 68873

SEQ ID NO: 426911 - RNA, 64 nt, hsa; identical to SEQ ID NO: 68874

SEQ ID NO: 426912 - RNA, 64 nt, hsa; identical to SEQ ID NO: 68875

SEQ ID NO: 426913 - RNA, 64 nt, hsa; identical to SEQ ID NO: 68876

SEQ ID NO: 426914 - RNA, 64 nt, hsa; identical to SEQ ID NO: 68877

SEQ ID NO: 426915 - RNA, 64 nt, hsa; identical to SEQ ID NO: 68877

SEQ ID NO: 426916 - RNA, 64 nt, hsa; identical to SEQ ID NO: 68879

SEQ ID NO: 426917 - RNA, 64 nt, hsa; identical to SEQ ID NO: 68880

SEQ ID NO: 426918 - RNA, 64 nt, hsa; identical to SEQ ID NO: 68881

SEQ ID NO: 426919 - RNA, 64 nt, hsa; identical to SEQ ID NO: 68882

SEQ ID NO: 426920 - RNA, 64 nt, hsa; identical to SEQ ID NO: 68883

SEQ ID NO: 426921 - RNA, 64 nt, hsa; identical to SEQ ID NO: 68884

SEQ ID NO: 426922 - RNA, 64 nt, hsa; identical to SEQ ID NO: 68885

SEQ ID NO: 426923 - RNA, 64 nt, hsa; identical to SEQ ID NO: 68886

SEQ ID NO: 426924 - RNA, 64 nt, hsa; identical to SEQ ID NO: 68887

SEQ ID NO: 426925 - RNA, 64 nt, hsa; identical to SEQ ID NO: 68888

SEQ ID NO: 426926 - RNA, 64 nt, hsa; identical to SEQ ID NO: 68889

SEQ ID NO: 426927 - RNA, 64 nt, hsa; identical to SEQ ID NO: 68890

SEQ ID NO: 426928 - RNA, 64 nt, hsa; identical to SEQ ID NO: 68891

SEQ ID NO: 426929 - RNA, 64 nt, hsa; identical to SEQ ID NO: 68892

SEQ ID NO: 426930 - RNA, 64 nt, hsa; identical to SEQ ID NO: 68893

SEQ ID NO: 426931 - RNA, 64 nt, hsa; identical to SEQ ID NO: 68894

SEQ ID NO: 426932 - RNA, 64 nt, hsa; identical to SEQ ID NO: 68895

SEQ ID NO: 426933 - RNA, 64 nt, hsa; identical to SEQ ID NO: 68896

SEQ ID NO: 426934 - RNA, 64 nt, hsa; identical to SEQ ID NO: 68897

SEQ ID NO: 426935 - RNA, 64 nt, hsa; identical to SEQ ID NO: 68898

SEQ ID NO: 426936 - RNA, 64 nt, hsa; identical to SEQ ID NO: 68899

SEQ ID NO: 426937 - RNA, 64 nt, hsa; identical to SEQ ID NO: 68900

SEQ ID NO: 426938 - RNA, 64 nt, hsa; identical to SEQ ID NO: 68901

SEQ ID NO: 426939 - RNA, 64 nt, hsa; identical to SEQ ID NO: 68902

SEQ ID NO: 426940 - RNA, 64 nt, hsa; identical to SEQ ID NO: 68903

SEQ ID NO: 426941 - RNA, 64 nt, hsa; identical to SEQ ID NO: 68904

SEQ ID NO: 426942 - RNA, 64 nt, hsa; identical to SEQ ID NO: 68905

SEQ ID NO: 426943 - RNA, 64 nt, hsa; identical to SEQ ID NO: 68906

SEQ ID NO: 426944 - RNA, 64 nt, hsa; identical to SEQ ID NO: 68907

SEQ ID NO: 426945 - RNA, 64 nt, hsa; identical to SEQ ID NO: 68908

SEQ ID NO: 426946 - RNA, 64 nt, hsa; identical to SEQ ID NO: 68909

SEQ ID NO: 426947 - RNA, 64 nt, hsa; identical to SEQ ID NO: 68910

SEQ ID NO: 426948 - RNA, 64 nt, hsa; identical to SEQ ID NO: 68911

SEQ ID NO: 426949 - RNA, 64 nt, hsa; identical to SEQ ID NO: 68912

SEQ ID NO: 426950 - RNA, 64 nt, hsa; identical to SEQ ID NO: 68913

SEQ ID NO: 426951 - RNA, 64 nt, hsa; identical to SEQ ID NO: 68914

SEQ ID NO: 426952 - RNA, 64 nt, hsa; identical to SEQ ID NO: 68915

SEQ ID NO: 426953 - RNA, 64 nt, hsa; identical to SEQ ID NO: 68916

SEQ ID NO: 426954 - RNA, 64 nt, hsa; identical to SEQ ID NO: 68917

SEQ ID NO: 426955 - RNA, 64 nt, hsa; identical to SEQ ID NO: 68918

SEQ ID NO: 426956 - RNA, 64 nt, hsa; identical to SEQ ID NO: 68919

SEQ ID NO: 426957 - RNA, 64 nt, hsa; identical to SEQ ID NO: 68920

SEQ ID NO: 426958 - RNA, 64 nt, hsa; identical to SEQ ID NO: 68921

SEQ ID NO: 426959 - RNA, 64 nt, hsa; identical to SEQ ID NO: 68922

SEQ ID NO: 426960 - RNA, 64 nt, hsa; identical to SEQ ID NO: 68923

SEQ ID NO: 426961 - RNA, 64 nt, hsa; identical to SEQ ID NO: 68924

SEQ ID NO: 426962 - RNA, 64 nt, hsa; identical to SEQ ID NO: 68925

SEQ ID NO: 426963 - RNA, 64 nt, hsa; identical to SEQ ID NO: 68926

SEQ ID NO: 426964 - RNA, 64 nt, hsa; identical to SEQ ID NO: 68927

SEQ ID NO: 426965 - RNA, 64 nt, hsa; identical to SEQ ID NO: 68928

SEQ ID NO: 426966 - RNA, 64 nt, hsa; identical to SEQ ID NO: 68929

SEQ ID NO: 426967 - RNA, 64 nt, hsa; identical to SEQ ID NO: 68930

SEQ ID NO: 426968 - RNA, 64 nt, hsa; identical to SEQ ID NO: 68931

SEQ ID NO: 426969 - RNA, 64 nt, hsa; identical to SEQ ID NO: 68932

SEQ ID NO: 426970 - RNA, 64 nt, hsa; identical to SEQ ID NO: 68933

SEQ ID NO: 426971 - RNA, 64 nt, hsa; identical to SEQ ID NO: 68934

SEQ ID NO: 426972 - RNA, 64 nt, hsa; identical to SEQ ID NO: 68935

SEQ ID NO: 426973 - RNA, 64 nt, hsa; identical to SEQ ID NO: 355670

SEQ ID NO: 426974 - RNA, 64 nt, hsa; identical to SEQ ID NO: 355671

SEQ ID NO: 426975 - RNA, 64 nt, hsa; identical to SEQ ID NO: 355672

SEQ ID NO: 426976 - RNA, 64 nt, hsa; identical to SEQ ID NO: 355673

SEQ ID NO: 426977 - RNA, 64 nt, hsa; identical to SEQ ID NO: 355674

SEQ ID NO: 426978 - RNA, 64 nt, hsa; identical to SEQ ID NO: 355675

SEQ ID NO: 426979 - RNA, 64 nt, hsa; identical to SEQ ID NO: 355676

SEQ ID NO: 426980 - RNA, 64 nt, hsa; identical to SEQ ID NO: 355677

SEQ ID NO: 426981 - RNA, 64 nt, hsa; identical to SEQ ID NO: 355678

SEQ ID NO: 426982 - RNA, 64 nt, hsa; identical to SEQ ID NO: 355679

SEQ ID NO: 426983 - RNA, 64 nt, hsa; identical to SEQ ID NO: 355680

SEQ ID NO: 426984 - RNA, 64 nt, hsa; identical to SEQ ID NO: 355681

SEQ ID NO: 426985 - RNA, 64 nt, hsa
ccuuuaacuaauuauguaucugaaagucacccccacauaccaacucaacuuuuuuccugugaac

SEQ ID NO: 426986 - RNA, 64 nt, hsa
aacauaauugccaauugaaacccuaaauauguuuacauaccauuaagauaugauucauguaaca

SEQ ID NO: 426987 - RNA, 64 nt, hsa
auaugaagaacuauuauauugaggccuguccucuacauaccacacuuaaaagauggugaacugu

SEQ ID NO: 426988 - RNA, 64 nt, hsa
gugguucugugccucuuaucaaguguuacagaggacauaccacugccaugucagggguuugcuu

SEQ ID NO: 426989 - RNA, 64 nt, hsa
aaguagagcaaagagccauucagcuucagucuuuacauaccaugaauaaaacauuaaaacauca

SEQ ID NO: 426990 - RNA, 64 nt, hsa
aagcuuauccaauuuuaugcuuggagcagucaguacauaccaguuucugauguuucaggcagga

SEQ ID NO: 426991 - RNA, 64 nt, hsa
gcuucauugugacuuuaacaaacauuaucuucccacauaccaggaacuauuggacauuuauuuu

SEQ ID NO: 426992 - RNA, 64 nt, hsa
uucguuaaauugugaaggcgcuggaauuacaugaacauaccacccuaguaaaggcaaguucugu

SEQ ID NO: 426993 - RNA, 64 nt, hsa
gugugugugugugugugugugugugugugugugucggccucagagcgcgcugugugugugugug

SEQ ID NO: 426994 - RNA, 64 nt, hsa
gcacccuaagauggaggccagguagcaauggggccggccucagagagagcgcugugugugugug

SEQ ID NO: 426995 - RNA, 64 nt, hsa
aggccccgccuccaaggcaucaggccccgcccaacggccucauguccccgcccccacgacuucc

SEQ ID NO: 426996 - RNA, 64 nt, hsa
ugcggaaaggaaacccccuccccgacccgcccgacggccucaggccccgccuccaaggcaucag

SEQ ID NO: 426997 - RNA, 64 nt, hsa
aguagcguuuuagucguuuuauguuucuuugcaacggccucagaaguuuggccggagagggggc

SEQ ID NO: 426998 - RNA, 64 nt, hsa
uggccggagagggggcagccagagcggcagcccccggccucagaggcuaucacaggcucagggc

SEQ ID NO: 426999 - RNA, 64 nt, hsa
ccagcacugagucugggacacucagcgggaagggggcuggcaucgccagcgacccacacauucc

SEQ ID NO: 427000 - RNA, 64 nt, hsa
gcggaggcgccauugaaagcauggucuugccaguggcuggcaaggcgguuuuguucugcucagu

SEQ ID NO: 427001 - RNA, 64 nt, hsa
agggggccgaccccuuuccccaggcacagccccaggcuggcaaagggagggcccugggcugggu

SEQ ID NO: 427002 - RNA, 64 nt, hsa
ugugggcaggggacagggcgugggugggggccgaggcuggcacgccccucugcccucaccgucu

SEQ ID NO: 427003 - RNA, 64 nt, hsa
accucuuaugugcacuuuaaagauagacuuuaggggcuggcacaaaucugaucagagacacaua

SEQ ID NO: 427004 - RNA, 64 nt, hsa
ccggccuggcagugggacaaucgccagaggguggggcuggcagaacaccaucuccagccucagc

SEQ ID NO: 427005 - RNA, 64 nt, hsa
aucuggcuuguccuggcagugcuugaaugccacaggcuggcaggggccucugggggccccuccc

SEQ ID NO: 427006 - RNA, 64 nt, hsa
ggacuuggggcaaguucagaucagaagaggugcaggcuggcaccugcggcagguaccagccugg

SEQ ID NO: 427007 - RNA, 64 nt, hsa
agcugaacgcacuugcagcguccgagggccaccgggcuggcauuuugugacccuucccuguugc

SEQ ID NO: 427008 - RNA, 64 nt, hsa
gggcuccaggaaaguguuucugggaggucaggagggcuggcagcugaacgcacuugcagcgucc

SEQ ID NO: 427009 - RNA, 64 nt, hsa
uggauuuuuaaugaaacagacucagggagguaggggcuggcagggacccuagaauccuugugau

SEQ ID NO: 427010 - RNA, 64 nt, hsa
ucacccugcguugcccucugggucugugagggugggcuggcaggaggccuaggccuugcccuag

SEQ ID NO: 427011 - RNA, 64 nt, hsa
ccaauccugcugauguggcagucaauggcugcagggcuggcaaaccuccccuuagccagucagc

SEQ ID NO: 427012 - RNA, 64 nt, hsa
gggugaagagaagcuguccguggcggcugguguuggcuggcauuggcacugggcugugcugacc

SEQ ID NO: 427013 - RNA, 64 nt, hsa
guguucaggagucccaccuugcauuucagaccugggcuggcagucuguuggacuucucuucagg

SEQ ID NO: 427014 - RNA, 64 nt, hsa
cugcggaugcuucuuaacaaccgcccggggcuguggcuggcagcuuggugggccccagggccuu

SEQ ID NO: 427015 - RNA, 64 nt, hsa
aaaaaacaaaaaaaaacccugagaccaugaguggggcuggcaucuugccagccugggcuucagg

SEQ ID NO: 427016 - RNA, 64 nt, hsa
cugugcuggcuuuucuggaacgccaggcgcccauggcuggcaccuuucugcuugcucugucucu

SEQ ID NO: 427017 - RNA, 64 nt, hsa
ccuuccugggccagggccguuucuggcacugggaggcuggcaggggccccucccugccucggcu

SEQ ID NO: 427018 - RNA, 64 nt, hsa
gggugccauagugaggacccucguccuccagacuggcuggcaggagucaggccccagcagcccu

SEQ ID NO: 427019 - RNA, 64 nt, hsa
agguggugccaccaguuuugcagguggcaucagaggcuggcaugcuggcaggaacauccccucu

SEQ ID NO: 427020 - RNA, 64 nt, hsa
gcacccaagaccucagggcacaaagaugggugaaggcuggcaugauccaagcaagacugagggg

SEQ ID NO: 427021 - RNA, 64 nt, hsa
ccugugccccugccccggaccaagaagggcagcuggcuggcagacaaggugaagaggcugaugc

SEQ ID NO: 427022 - RNA, 64 nt, hsa
gccccccuggggggcugcgccugggggccgauggggcuggcagcaccgagagccuggggggccc

SEQ ID NO: 427023 - RNA, 64 nt, hsa
gcagcggucucugggggaucccccagcugaaggaggcuggcaggaguuggcaagagaacccccu

SEQ ID NO: 427024 - RNA, 64 nt, hsa
uuuggaucccaggggaguguucagggccagcccuggcuggcauggagggugaggcugggugucu

SEQ ID NO: 427025 - RNA, 64 nt, hsa
cucugucuauuugagacuuagaaaaauccuacaaggcuggcagugacagaacuaagaugaucau

SEQ ID NO: 427026 - RNA, 64 nt, hsa
aauguaagaaauguagaaaaaccuucagccaggaggcuggcaagauggccgaauaggaacagcu

SEQ ID NO: 427027 - RNA, 64 nt, hsa
agggguccacagacaccucauacaggagagcucuggcuggcaucuggugggugccccucuggga

SEQ ID NO: 427028 - RNA, 64 nt, hsa; identical to SEQ ID NO: 209179

SEQ ID NO: 427029 - RNA, 64 nt, hsa; identical to SEQ ID NO: 209180

SEQ ID NO: 427030 - RNA, 64 nt, hsa; identical to SEQ ID NO: 209181

SEQ ID NO: 427031 - RNA, 64 nt, hsa; identical to SEQ ID NO: 209182

SEQ ID NO: 427032 - RNA, 64 nt, hsa; identical to SEQ ID NO: 209183

SEQ ID NO: 427033 - RNA, 64 nt, hsa; identical to SEQ ID NO: 209184

SEQ ID NO: 427034 - RNA, 64 nt, hsa; identical to SEQ ID NO: 209185

SEQ ID NO: 427035 - RNA, 64 nt, hsa; identical to SEQ ID NO: 209186

SEQ ID NO: 427036 - RNA, 64 nt, hsa; identical to SEQ ID NO: 209187

SEQ ID NO: 427037 - RNA, 64 nt, hsa; identical to SEQ ID NO: 209188

SEQ ID NO: 427038 - RNA, 64 nt, hsa; identical to SEQ ID NO: 209189

SEQ ID NO: 427039 - RNA, 64 nt, hsa; identical to SEQ ID NO: 209190

SEQ ID NO: 427040 - RNA, 64 nt, hsa; identical to SEQ ID NO: 209191

SEQ ID NO: 427041 - RNA, 64 nt, hsa; identical to SEQ ID NO: 209192

SEQ ID NO: 427042 - RNA, 64 nt, hsa; identical to SEQ ID NO: 209193

SEQ ID NO: 427043 - RNA, 64 nt, hsa; identical to SEQ ID NO: 209194

SEQ ID NO: 427044 - RNA, 64 nt, hsa; identical to SEQ ID NO: 209195

SEQ ID NO: 427045 - RNA, 64 nt, hsa; identical to SEQ ID NO: 209196

SEQ ID NO: 427046 - RNA, 64 nt, hsa; identical to SEQ ID NO: 209197

SEQ ID NO: 427047 - RNA, 64 nt, hsa; identical to SEQ ID NO: 209198

SEQ ID NO: 427048 - RNA, 64 nt, hsa; identical to SEQ ID NO: 209199

SEQ ID NO: 427049 - RNA, 64 nt, hsa; identical to SEQ ID NO: 209200

SEQ ID NO: 427050 - RNA, 64 nt, hsa; identical to SEQ ID NO: 209201

SEQ ID NO: 427051 - RNA, 64 nt, hsa; identical to SEQ ID NO: 209202

SEQ ID NO: 427052 - RNA, 64 nt, hsa; identical to SEQ ID NO: 209203

SEQ ID NO: 427053 - RNA, 64 nt, hsa; identical to SEQ ID NO: 209204

SEQ ID NO: 427054 - RNA, 64 nt, hsa; identical to SEQ ID NO: 209205

SEQ ID NO: 427055 - RNA, 64 nt, hsa; identical to SEQ ID NO: 209206

SEQ ID NO: 427056 - RNA, 64 nt, hsa; identical to SEQ ID NO: 209207

SEQ ID NO: 427057 - RNA, 64 nt, hsa; identical to SEQ ID NO: 209208

SEQ ID NO: 427058 - RNA, 64 nt, hsa; identical to SEQ ID NO: 209209

SEQ ID NO: 427059 - RNA, 64 nt, hsa; identical to SEQ ID NO: 209210

SEQ ID NO: 427060 - RNA, 64 nt, hsa; identical to SEQ ID NO: 209211

SEQ ID NO: 427061 - RNA, 64 nt, hsa; identical to SEQ ID NO: 209212

SEQ ID NO: 427062 - RNA, 64 nt, hsa; identical to SEQ ID NO: 209213

SEQ ID NO: 427063 - RNA, 64 nt, hsa; identical to SEQ ID NO: 209214

SEQ ID NO: 427064 - RNA, 64 nt, hsa; identical to SEQ ID NO: 209215

SEQ ID NO: 427065 - RNA, 64 nt, hsa; identical to SEQ ID NO: 209216

SEQ ID NO: 427066 - RNA, 64 nt, hsa; identical to SEQ ID NO: 209217

SEQ ID NO: 427067 - RNA, 64 nt, hsa; identical to SEQ ID NO: 209218

SEQ ID NO: 427068 - RNA, 64 nt, hsa; identical to SEQ ID NO: 209219

SEQ ID NO: 427069 - RNA, 64 nt, hsa; identical to SEQ ID NO: 209220

SEQ ID NO: 427070 - RNA, 64 nt, hsa; identical to SEQ ID NO: 382199

SEQ ID NO: 427071 - RNA, 64 nt, hsa; identical to SEQ ID NO: 382200

SEQ ID NO: 427072 - RNA, 64 nt, hsa; identical to SEQ ID NO: 382201

SEQ ID NO: 427073 - RNA, 57 nt, hsa; identical to SEQ ID NO: 382202

SEQ ID NO: 427074 - RNA, 64 nt, hsa; identical to SEQ ID NO: 382203

SEQ ID NO: 427075 - RNA, 64 nt, hsa; identical to SEQ ID NO: 382204

SEQ ID NO: 427076 - RNA, 64 nt, hsa; identical to SEQ ID NO: 382205

SEQ ID NO: 427077 - RNA, 64 nt, hsa; identical to SEQ ID NO: 382206

SEQ ID NO: 427078 - RNA, 64 nt, hsa; identical to SEQ ID NO: 382207

SEQ ID NO: 427079 - RNA, 64 nt, hsa; identical to SEQ ID NO: 382208

SEQ ID NO: 427080 - RNA, 64 nt, hsa; identical to SEQ ID NO: 382209

SEQ ID NO: 427081 - RNA, 64 nt, hsa; identical to SEQ ID NO: 382210

SEQ ID NO: 427082 - RNA, 64 nt, hsa; identical to SEQ ID NO: 382211

SEQ ID NO: 427083 - RNA, 64 nt, hsa; identical to SEQ ID NO: 382212

SEQ ID NO: 427084 - RNA, 64 nt, hsa; identical to SEQ ID NO: 382213

SEQ ID NO: 427085 - RNA, 64 nt, hsa; identical to SEQ ID NO: 382214

SEQ ID NO: 427086 - RNA, 64 nt, hsa; identical to SEQ ID NO: 382215

SEQ ID NO: 427087 - RNA, 64 nt, hsa; identical to SEQ ID NO: 382216

SEQ ID NO: 427088 - RNA, 64 nt, hsa; identical to SEQ ID NO: 382217

SEQ ID NO: 427089 - RNA, 64 nt, hsa; identical to SEQ ID NO: 382218

SEQ ID NO: 427090 - RNA, 64 nt, hsa; identical to SEQ ID NO: 382219

SEQ ID NO: 427091 - RNA, 64 nt, hsa; identical to SEQ ID NO: 382220

SEQ ID NO: 427092 - RNA, 64 nt, hsa; identical to SEQ ID NO: 382221

SEQ ID NO: 427093 - RNA, 64 nt, hsa; identical to SEQ ID NO: 382222

SEQ ID NO: 427094 - RNA, 63 nt, hsa; identical to SEQ ID NO: 382223

SEQ ID NO: 427095 - RNA, 64 nt, hsa; identical to SEQ ID NO: 382224

SEQ ID NO: 427096 - RNA, 64 nt, hsa; identical to SEQ ID NO: 382225

SEQ ID NO: 427097 - RNA, 64 nt, hsa; identical to SEQ ID NO: 382226

SEQ ID NO: 427098 - RNA, 64 nt, hsa; identical to SEQ ID NO: 382227

SEQ ID NO: 427099 - RNA, 64 nt, hsa; identical to SEQ ID NO: 382228

SEQ ID NO: 427100 - RNA, 64 nt, hsa; identical to SEQ ID NO: 382229

SEQ ID NO: 427101 - RNA, 64 nt, hsa; identical to SEQ ID NO: 382230

SEQ ID NO: 427102 - RNA, 64 nt, hsa; identical to SEQ ID NO: 382231

SEQ ID NO: 427103 - RNA, 64 nt, hsa; identical to SEQ ID NO: 382232

SEQ ID NO: 427104 - RNA, 64 nt, hsa; identical to SEQ ID NO: 382233

SEQ ID NO: 427105 - RNA, 64 nt, hsa; identical to SEQ ID NO: 382234

SEQ ID NO: 427106 - RNA, 64 nt, hsa; identical to SEQ ID NO: 382235

SEQ ID NO: 427107 - RNA, 64 nt, hsa; identical to SEQ ID NO: 382236

SEQ ID NO: 427108 - RNA, 64 nt, hsa; identical to SEQ ID NO: 382237

SEQ ID NO: 427109 - RNA, 64 nt, hsa; identical to SEQ ID NO: 209384

SEQ ID NO: 427110 - RNA, 64 nt, hsa; identical to SEQ ID NO: 209385

SEQ ID NO: 427111 - RNA, 64 nt, hsa; identical to SEQ ID NO: 209386

SEQ ID NO: 427112 - RNA, 64 nt, hsa; identical to SEQ ID NO: 209387

SEQ ID NO: 427113 - RNA, 64 nt, hsa; identical to SEQ ID NO: 209388

SEQ ID NO: 427114 - RNA, 64 nt, hsa; identical to SEQ ID NO: 209389

SEQ ID NO: 427115 - RNA, 64 nt, hsa; identical to SEQ ID NO: 209390

SEQ ID NO: 427116 - RNA, 64 nt, hsa; identical to SEQ ID NO: 209391

SEQ ID NO: 427117 - RNA, 64 nt, hsa; identical to SEQ ID NO: 209392

SEQ ID NO: 427118 - RNA, 64 nt, hsa; identical to SEQ ID NO: 209393

SEQ ID NO: 427119 - RNA, 64 nt, hsa; identical to SEQ ID NO: 209394

SEQ ID NO: 427120 - RNA, 64 nt, hsa; identical to SEQ ID NO: 209395

SEQ ID NO: 427121 - RNA, 61 nt, hsa; identical to SEQ ID NO: 209396

SEQ ID NO: 427122 - RNA, 64 nt, hsa; identical to SEQ ID NO: 209397

SEQ ID NO: 427123 - RNA, 64 nt, hsa; identical to SEQ ID NO: 209398

SEQ ID NO: 427124 - RNA, 64 nt, hsa; identical to SEQ ID NO: 209399

SEQ ID NO: 427125 - RNA, 64 nt, hsa; identical to SEQ ID NO: 209400

SEQ ID NO: 427126 - RNA, 64 nt, hsa; identical to SEQ ID NO: 209401

SEQ ID NO: 427127 - RNA, 64 nt, hsa; identical to SEQ ID NO: 209402

SEQ ID NO: 427128 - RNA, 64 nt, hsa; identical to SEQ ID NO: 209403

SEQ ID NO: 427129 - RNA, 64 nt, hsa; identical to SEQ ID NO: 209404

SEQ ID NO: 427130 - RNA, 64 nt, hsa; identical to SEQ ID NO: 209405

SEQ ID NO: 427131 - RNA, 64 nt, hsa; identical to SEQ ID NO: 209406

SEQ ID NO: 427132 - RNA, 64 nt, hsa; identical to SEQ ID NO: 209407

SEQ ID NO: 427133 - RNA, 64 nt, hsa; identical to SEQ ID NO: 360996

SEQ ID NO: 427134 - RNA, 64 nt, hsa; identical to SEQ ID NO: 360997

SEQ ID NO: 427135 - RNA, 64 nt, hsa; identical to SEQ ID NO: 360998

SEQ ID NO: 427136 - RNA, 64 nt, hsa; identical to SEQ ID NO: 360999

SEQ ID NO: 427137 - RNA, 64 nt, hsa; identical to SEQ ID NO: 361000

SEQ ID NO: 427138 - RNA, 64 nt, hsa; identical to SEQ ID NO: 361001

SEQ ID NO: 427139 - RNA, 64 nt, hsa; identical to SEQ ID NO: 361002

SEQ ID NO: 427140 - RNA, 64 nt, hsa; identical to SEQ ID NO: 361003

SEQ ID NO: 427141 - RNA, 64 nt, hsa; identical to SEQ ID NO: 361004

SEQ ID NO: 427142 - RNA, 64 nt, hsa; identical to SEQ ID NO: 361005

SEQ ID NO: 427143 - RNA, 64 nt, hsa; identical to SEQ ID NO: 361006

SEQ ID NO: 427144 - RNA, 64 nt, hsa; identical to SEQ ID NO: 361007

SEQ ID NO: 427145 - RNA, 64 nt, hsa; identical to SEQ ID NO: 361008

SEQ ID NO: 427146 - RNA, 64 nt, hsa; identical to SEQ ID NO: 361009

SEQ ID NO: 427147 - RNA, 64 nt, hsa; identical to SEQ ID NO: 361010

SEQ ID NO: 427148 - RNA, 64 nt, hsa; identical to SEQ ID NO: 361011

SEQ ID NO: 427149 - RNA, 64 nt, hsa; identical to SEQ ID NO: 361012

SEQ ID NO: 427150 - RNA, 64 nt, hsa; identical to SEQ ID NO: 361013

SEQ ID NO: 427151 - RNA, 64 nt, hsa; identical to SEQ ID NO: 153305

SEQ ID NO: 427152 - RNA, 64 nt, hsa; identical to SEQ ID NO: 153306

SEQ ID NO: 427153 - RNA, 53 nt, hsa; identical to SEQ ID NO: 153307

SEQ ID NO: 427154 - RNA, 64 nt, hsa; identical to SEQ ID NO: 153308

SEQ ID NO: 427155 - RNA, 64 nt, hsa; identical to SEQ ID NO: 153309

SEQ ID NO: 427156 - RNA, 64 nt, hsa; identical to SEQ ID NO: 153310

SEQ ID NO: 427157 - RNA, 64 nt, hsa; identical to SEQ ID NO: 153311

SEQ ID NO: 427158 - RNA, 64 nt, hsa; identical to SEQ ID NO: 153312

SEQ ID NO: 427159 - RNA, 64 nt, hsa; identical to SEQ ID NO: 153313

SEQ ID NO: 427160 - RNA, 64 nt, hsa; identical to SEQ ID NO: 153314

SEQ ID NO: 427161 - RNA, 64 nt, hsa; identical to SEQ ID NO: 153315

SEQ ID NO: 427162 - RNA, 64 nt, hsa; identical to SEQ ID NO: 153312

SEQ ID NO: 427163 - RNA, 64 nt, hsa; identical to SEQ ID NO: 153317

SEQ ID NO: 427164 - RNA, 64 nt, hsa; identical to SEQ ID NO: 153318

SEQ ID NO: 427165 - RNA, 64 nt, hsa; identical to SEQ ID NO: 153315

SEQ ID NO: 427166 - RNA, 64 nt, hsa; identical to SEQ ID NO: 153320

SEQ ID NO: 427167 - RNA, 64 nt, hsa; identical to SEQ ID NO: 153321

SEQ ID NO: 427168 - RNA, 64 nt, hsa; identical to SEQ ID NO: 153322

SEQ ID NO: 427169 - RNA, 64 nt, hsa; identical to SEQ ID NO: 153323

SEQ ID NO: 427170 - RNA, 64 nt, hsa; identical to SEQ ID NO: 153324

SEQ ID NO: 427171 - RNA, 64 nt, hsa; identical to SEQ ID NO: 153325

SEQ ID NO: 427172 - RNA, 64 nt, hsa; identical to SEQ ID NO: 153326

SEQ ID NO: 427173 - RNA, 64 nt, hsa; identical to SEQ ID NO: 153327

SEQ ID NO: 427174 - RNA, 64 nt, hsa; identical to SEQ ID NO: 153328

SEQ ID NO: 427175 - RNA, 64 nt, hsa; identical to SEQ ID NO: 153329

SEQ ID NO: 427176 - RNA, 64 nt, hsa; identical to SEQ ID NO: 153330

SEQ ID NO: 427177 - RNA, 64 nt, hsa; identical to SEQ ID NO: 153331

SEQ ID NO: 427178 - RNA, 64 nt, hsa; identical to SEQ ID NO: 153332

SEQ ID NO: 427179 - RNA, 64 nt, hsa; identical to SEQ ID NO: 153333

SEQ ID NO: 427180 - RNA, 64 nt, hsa; identical to SEQ ID NO: 153334

SEQ ID NO: 427181 - RNA, 64 nt, hsa; identical to SEQ ID NO: 153335

SEQ ID NO: 427182 - RNA, 64 nt, hsa; identical to SEQ ID NO: 153336

SEQ ID NO: 427183 - RNA, 64 nt, hsa; identical to SEQ ID NO: 153337

SEQ ID NO: 427184 - RNA, 64 nt, hsa; identical to SEQ ID NO: 153338

SEQ ID NO: 427185 - RNA, 64 nt, hsa; identical to SEQ ID NO: 153339

SEQ ID NO: 427186 - RNA, 64 nt, hsa; identical to SEQ ID NO: 153340

SEQ ID NO: 427187 - RNA, 64 nt, hsa; identical to SEQ ID NO: 153341

SEQ ID NO: 427188 - RNA, 64 nt, hsa; identical to SEQ ID NO: 153342

SEQ ID NO: 427189 - RNA, 64 nt, hsa; identical to SEQ ID NO: 153343

SEQ ID NO: 427190 - RNA, 64 nt, hsa; identical to SEQ ID NO: 153344

SEQ ID NO: 427191 - RNA, 64 nt, hsa; identical to SEQ ID NO: 153345

SEQ ID NO: 427192 - RNA, 64 nt, hsa; identical to SEQ ID NO: 153346

SEQ ID NO: 427193 - RNA, 51 nt, hsa; identical to SEQ ID NO: 153347

SEQ ID NO: 427194 - RNA, 64 nt, hsa; identical to SEQ ID NO: 153348

SEQ ID NO: 427195 - RNA, 64 nt, hsa; identical to SEQ ID NO: 153349

SEQ ID NO: 427196 - RNA, 64 nt, hsa; identical to SEQ ID NO: 153350

SEQ ID NO: 427197 - RNA, 64 nt, hsa; identical to SEQ ID NO: 153351

SEQ ID NO: 427198 - RNA, 64 nt, hsa; identical to SEQ ID NO: 153352

SEQ ID NO: 427199 - RNA, 64 nt, hsa; identical to SEQ ID NO: 153353

SEQ ID NO: 427200 - RNA, 64 nt, hsa; identical to SEQ ID NO: 153354

SEQ ID NO: 427201 - RNA, 64 nt, hsa; identical to SEQ ID NO: 153355

SEQ ID NO: 427202 - RNA, 64 nt, hsa; identical to SEQ ID NO: 153356

SEQ ID NO: 427203 - RNA, 64 nt, hsa; identical to SEQ ID NO: 153357

SEQ ID NO: 427204 - RNA, 64 nt, hsa; identical to SEQ ID NO: 153358

SEQ ID NO: 427205 - RNA, 64 nt, hsa; identical to SEQ ID NO: 153359

SEQ ID NO: 427206 - RNA, 64 nt, hsa
cgaacaggagaugagcaaagcugcuugcacuucagucagguacacuguuacuugaaaggaagaa

SEQ ID NO: 427207 - RNA, 64 nt, hsa
caugaauaaauauugucagccagaaaagguuggugucagguaaugcauauuuuuuuaagcuuug

SEQ ID NO: 427208 - RNA, 64 nt, hsa
auaugugucuuugcacgugaggugggucuccugaauacagcacaccgauggguuuugacucuau

SEQ ID NO: 427209 - RNA, 64 nt, hsa
gaugugcaauaaauauuuguguuauuaacuacacauacagcacucuauaggagauauuccauuu

SEQ ID NO: 427210 - RNA, 64 nt, hsa
aaaaaugaaagaugauuugcaaugggauguaugaauacagcagcaagaaaaaaaaaugccauaa

SEQ ID NO: 427211 - RNA, 64 nt, hsa
aaaagaggaaaacccucaagggcaugagcauuggauacagcaguagacauuuuaacaagaagau

SEQ ID NO: 427212 - RNA, 64 nt, hsa
ugcauauggcagacccugcccagcgugcgcuuugauacagcaaauggagcagcugaccucaugg

SEQ ID NO: 427213 - RNA, 64 nt, hsa
cuaauugcagugggggcuaaggcauccauuaugaauacagcagaacauuugcuggcgagagucc

SEQ ID NO: 427214 - RNA, 64 nt, hsa
aaucaguauuugacuguaauaguauaguaguuaaauacagcacuuaaaaauaccacagacacag

SEQ ID NO: 427215 - RNA, 64 nt, hsa
gcauuucucaguguuugcuauucagacugucuaaauacagcaugugacaagcugaagaagccaa

SEQ ID NO: 427216 - RNA, 64 nt, hsa
agaaccuaccaagaaaaacagucucauuacucauauacagcaggcaaagagacagaaaauuaac

SEQ ID NO: 427217 - RNA, 64 nt, hsa
aaaaugcagaaagccgaagaguuagaacuuuuggauacagcagaagaaacagcggcuccacuac

SEQ ID NO: 427218 - RNA, 64 nt, hsa
cgcuguuguggggaggggggaagaaaaggaggaaccaauuaaauaggaccuuuuaaaaauuguu

SEQ ID NO: 427219 - RNA, 64 nt, hsa
aauuucuuuauagcugauuauuucaaacuaggauccaauuaaaguuuacauaugacacuugguu

SEQ ID NO: 427220 - RNA, 64 nt, hsa
gauauuuuugcacugcugagaagcagugccauuaccaauuaauucuugccaggagugagagaga

SEQ ID NO: 427221 - RNA, 64 nt, hsa
cuagaaugcagcuaaggaaagugaaauuucagugccaauuaauuaaaagauacacugucucucu

SEQ ID NO: 427222 - RNA, 64 nt, hsa
ugcucagagaaauuauucauaagagaaaagaauuccaauuaauuaaauaucacaauagcauccc

SEQ ID NO: 427223 - RNA, 64 nt, hsa
uuuaacacuaauuuuccaaagguuagggaagauuccaauuaaauuuaugccuuauaaaauuaug

SEQ ID NO: 427224 - RNA, 64 nt, hsa
uugcuuucaaauccccaaauaucaucuccaucucccaauuaauuuuauugucucuuuccucucu

SEQ ID NO: 427225 - RNA, 64 nt, hsa
cuucaugggcaugcuggugaaagaauaaauacauccaauuaaagcucaugcuggggucggggag

SEQ ID NO: 427226 - RNA, 64 nt, hsa
uguaguuguccuuuacguaacuacuccuuuacugccaauuaacuaucaccauaaaaguaauaaa

SEQ ID NO: 427227 - RNA, 64 nt, hsa
uuguacuuugccuuauuuuacaaauugaggauuaccaauuaaacuuuaacugaacuaaggcuac

SEQ ID NO: 427228 - RNA, 64 nt, hsa
ugcuuccuguucugcucauugaucaaagguagggccaauuaaggauucuaacccuaacccagca

SEQ ID NO: 427229 - RNA, 64 nt, hsa
auuaggugaaguagaacauaaaauugaauaguacccaauuaaaguuccucaguaagaaaaaaaa

SEQ ID NO: 427230 - RNA, 64 nt, hsa
gagcaaauugaccccuuuaacaugugauuauuguccaauuaaagacaguugauuuaaguagcau

SEQ ID NO: 427231 - RNA, 64 nt, hsa; identical to SEQ ID NO: 378451

SEQ ID NO: 427232 - RNA, 64 nt, hsa; identical to SEQ ID NO: 378452

SEQ ID NO: 427233 - RNA, 64 nt, hsa; identical to SEQ ID NO: 378453

SEQ ID NO: 427234 - RNA, 64 nt, hsa; identical to SEQ ID NO: 378454

SEQ ID NO: 427235 - RNA, 64 nt, hsa; identical to SEQ ID NO: 378455

SEQ ID NO: 427236 - RNA, 64 nt, hsa; identical to SEQ ID NO: 378456

SEQ ID NO: 427237 - RNA, 64 nt, hsa; identical to SEQ ID NO: 378457

SEQ ID NO: 427238 - RNA, 64 nt, hsa; identical to SEQ ID NO: 378458

SEQ ID NO: 427239 - RNA, 61 nt, hsa; identical to SEQ ID NO: 378459

SEQ ID NO: 427240 - RNA, 64 nt, hsa; identical to SEQ ID NO: 378460

SEQ ID NO: 427241 - RNA, 64 nt, hsa; identical to SEQ ID NO: 378461

SEQ ID NO: 427242 - RNA, 64 nt, hsa; identical to SEQ ID NO: 378462

SEQ ID NO: 427243 - RNA, 64 nt, hsa; identical to SEQ ID NO: 378463

SEQ ID NO: 427244 - RNA, 64 nt, hsa; identical to SEQ ID NO: 378464

SEQ ID NO: 427245 - RNA, 64 nt, hsa; identical to SEQ ID NO: 378465

SEQ ID NO: 427246 - RNA, 64 nt, hsa; identical to SEQ ID NO: 378466

SEQ ID NO: 427247 - RNA, 64 nt, hsa; identical to SEQ ID NO: 378467

SEQ ID NO: 427248 - RNA, 64 nt, hsa; identical to SEQ ID NO: 378468

SEQ ID NO: 427249 - RNA, 64 nt, hsa; identical to SEQ ID NO: 378469

SEQ ID NO: 427250 - RNA, 64 nt, hsa; identical to SEQ ID NO: 378470

SEQ ID NO: 427251 - RNA, 64 nt, hsa; identical to SEQ ID NO: 378471

SEQ ID NO: 427252 - RNA, 64 nt, hsa; identical to SEQ ID NO: 378472

SEQ ID NO: 427253 - RNA, 64 nt, hsa; identical to SEQ ID NO: 378473

SEQ ID NO: 427254 - RNA, 64 nt, hsa; identical to SEQ ID NO: 378474

SEQ ID NO: 427255 - RNA, 64 nt, hsa; identical to SEQ ID NO: 378475

SEQ ID NO: 427256 - RNA, 64 nt, hsa; identical to SEQ ID NO: 378476

SEQ ID NO: 427257 - RNA, 64 nt, hsa; identical to SEQ ID NO: 378477

SEQ ID NO: 427258 - RNA, 64 nt, hsa; identical to SEQ ID NO: 378478

SEQ ID NO: 427259 - RNA, 64 nt, hsa; identical to SEQ ID NO: 378479

SEQ ID NO: 427260 - RNA, 64 nt, hsa; identical to SEQ ID NO: 378480

SEQ ID NO: 427261 - RNA, 64 nt, hsa; identical to SEQ ID NO: 378481

SEQ ID NO: 427262 - RNA, 64 nt, hsa; identical to SEQ ID NO: 378482

SEQ ID NO: 427263 - RNA, 64 nt, hsa; identical to SEQ ID NO: 378483

SEQ ID NO: 427264 - RNA, 64 nt, hsa; identical to SEQ ID NO: 378484

SEQ ID NO: 427265 - RNA, 64 nt, hsa; identical to SEQ ID NO: 378485

SEQ ID NO: 427266 - RNA, 64 nt, hsa; identical to SEQ ID NO: 378486

SEQ ID NO: 427267 - RNA, 64 nt, hsa; identical to SEQ ID NO: 378487

SEQ ID NO: 427268 - RNA, 64 nt, hsa; identical to SEQ ID NO: 378488

SEQ ID NO: 427269 - RNA, 64 nt, hsa; identical to SEQ ID NO: 378489

SEQ ID NO: 427270 - RNA, 64 nt, hsa; identical to SEQ ID NO: 378490

SEQ ID NO: 427271 - RNA, 64 nt, hsa; identical to SEQ ID NO: 378491

SEQ ID NO: 427272 - RNA, 64 nt, hsa; identical to SEQ ID NO: 378492

SEQ ID NO: 427273 - RNA, 64 nt, hsa; identical to SEQ ID NO: 378493

SEQ ID NO: 427274 - RNA, 64 nt, hsa; identical to SEQ ID NO: 378494

SEQ ID NO: 427275 - RNA, 64 nt, hsa; identical to SEQ ID NO: 378495

SEQ ID NO: 427276 - RNA, 64 nt, hsa; identical to SEQ ID NO: 378496

SEQ ID NO: 427277 - RNA, 64 nt, hsa; identical to SEQ ID NO: 378497

SEQ ID NO: 427278 - RNA, 64 nt, hsa; identical to SEQ ID NO: 378498

SEQ ID NO: 427279 - RNA, 64 nt, hsa; identical to SEQ ID NO: 378499

SEQ ID NO: 427280 - RNA, 64 nt, hsa; identical to SEQ ID NO: 378500

SEQ ID NO: 427281 - RNA, 64 nt, hsa; identical to SEQ ID NO: 378501

SEQ ID NO: 427282 - RNA, 64 nt, hsa; identical to SEQ ID NO: 378502

SEQ ID NO: 427283 - RNA, 64 nt, hsa; identical to SEQ ID NO: 378503

SEQ ID NO: 427284 - RNA, 64 nt, hsa; identical to SEQ ID NO: 378504

SEQ ID NO: 427285 - RNA, 64 nt, hsa; identical to SEQ ID NO: 378505

SEQ ID NO: 427286 - RNA, 64 nt, hsa; identical to SEQ ID NO: 378506

SEQ ID NO: 427287 - RNA, 64 nt, hsa; identical to SEQ ID NO: 378507

SEQ ID NO: 427288 - RNA, 64 nt, hsa
aggcaaaggcuucugagcccugggcaggggugguggguaccagagaaugcugccuucccccaag

SEQ ID NO: 427289 - RNA, 64 nt, hsa
gucauggagagccucaguccccauaaugaggacaggguaccaugcccaccuuuccuucagaacc

SEQ ID NO: 427290 - RNA, 64 nt, hsa; identical to SEQ ID NO: 199324

SEQ ID NO: 427291 - RNA, 64 nt, hsa; identical to SEQ ID NO: 199325

SEQ ID NO: 427292 - RNA, 64 nt, hsa; identical to SEQ ID NO: 199326

SEQ ID NO: 427293 - RNA, 64 nt, hsa; identical to SEQ ID NO: 199327

SEQ ID NO: 427294 - RNA, 64 nt, hsa; identical to SEQ ID NO: 199328

SEQ ID NO: 427295 - RNA, 64 nt, hsa; identical to SEQ ID NO: 199329

SEQ ID NO: 427296 - RNA, 64 nt, hsa; identical to SEQ ID NO: 199330

SEQ ID NO: 427297 - RNA, 64 nt, hsa; identical to SEQ ID NO: 199331

SEQ ID NO: 427298 - RNA, 64 nt, hsa; identical to SEQ ID NO: 199332

SEQ ID NO: 427299 - RNA, 64 nt, hsa; identical to SEQ ID NO: 199333

SEQ ID NO: 427300 - RNA, 64 nt, hsa; identical to SEQ ID NO: 199334

SEQ ID NO: 427301 - RNA, 64 nt, hsa; identical to SEQ ID NO: 199335

SEQ ID NO: 427302 - RNA, 64 nt, hsa; identical to SEQ ID NO: 199336

SEQ ID NO: 427303 - RNA, 64 nt, hsa; identical to SEQ ID NO: 199337

SEQ ID NO: 427304 - RNA, 64 nt, hsa; identical to SEQ ID NO: 199338

SEQ ID NO: 427305 - RNA, 64 nt, hsa; identical to SEQ ID NO: 199339

SEQ ID NO: 427306 - RNA, 64 nt, hsa; identical to SEQ ID NO: 199340

SEQ ID NO: 427307 - RNA, 64 nt, hsa; identical to SEQ ID NO: 199341

SEQ ID NO: 427308 - RNA, 64 nt, hsa; identical to SEQ ID NO: 199342

SEQ ID NO: 427309 - RNA, 64 nt, hsa; identical to SEQ ID NO: 199343

SEQ ID NO: 427310 - RNA, 64 nt, hsa; identical to SEQ ID NO: 199344

SEQ ID NO: 427311 - RNA, 64 nt, hsa; identical to SEQ ID NO: 199345

SEQ ID NO: 427312 - RNA, 64 nt, hsa; identical to SEQ ID NO: 199346

SEQ ID NO: 427313 - RNA, 64 nt, hsa; identical to SEQ ID NO: 199347

SEQ ID NO: 427314 - RNA, 64 nt, hsa; identical to SEQ ID NO: 199348

SEQ ID NO: 427315 - RNA, 64 nt, hsa; identical to SEQ ID NO: 199349

SEQ ID NO: 427316 - RNA, 64 nt, hsa; identical to SEQ ID NO: 199350

SEQ ID NO: 427317 - RNA, 64 nt, hsa; identical to SEQ ID NO: 199351

SEQ ID NO: 427318 - RNA, 64 nt, hsa; identical to SEQ ID NO: 199352

SEQ ID NO: 427319 - RNA, 64 nt, hsa; identical to SEQ ID NO: 199353

SEQ ID NO: 427320 - RNA, 64 nt, hsa; identical to SEQ ID NO: 199354

SEQ ID NO: 427321 - RNA, 64 nt, hsa; identical to SEQ ID NO: 199355

SEQ ID NO: 427322 - RNA, 64 nt, hsa; identical to SEQ ID NO: 199356

SEQ ID NO: 427323 - RNA, 64 nt, hsa; identical to SEQ ID NO: 199357

SEQ ID NO: 427324 - RNA, 64 nt, hsa; identical to SEQ ID NO: 199358

SEQ ID NO: 427325 - RNA, 64 nt, hsa; identical to SEQ ID NO: 199359

SEQ ID NO: 427326 - RNA, 64 nt, hsa; identical to SEQ ID NO: 199360

SEQ ID NO: 427327 - RNA, 64 nt, hsa; identical to SEQ ID NO: 199361

SEQ ID NO: 427328 - RNA, 64 nt, hsa; identical to SEQ ID NO: 199362

SEQ ID NO: 427329 - RNA, 64 nt, hsa; identical to SEQ ID NO: 199363

SEQ ID NO: 427330 - RNA, 64 nt, hsa; identical to SEQ ID NO: 199364

SEQ ID NO: 427331 - RNA, 64 nt, hsa; identical to SEQ ID NO: 199365

SEQ ID NO: 427332 - RNA, 64 nt, hsa; identical to SEQ ID NO: 199366

SEQ ID NO: 427333 - RNA, 64 nt, hsa; identical to SEQ ID NO: 199367

SEQ ID NO: 427334 - RNA, 64 nt, hsa; identical to SEQ ID NO: 199368

SEQ ID NO: 427335 - RNA, 64 nt, hsa; identical to SEQ ID NO: 199369

SEQ ID NO: 427336 - RNA, 64 nt, hsa; identical to SEQ ID NO: 199370

SEQ ID NO: 427337 - RNA, 64 nt, hsa; identical to SEQ ID NO: 199371

SEQ ID NO: 427338 - RNA, 64 nt, hsa; identical to SEQ ID NO: 199372

SEQ ID NO: 427339 - RNA, 64 nt, hsa; identical to SEQ ID NO: 199373

SEQ ID NO: 427340 - RNA, 64 nt, hsa; identical to SEQ ID NO: 199374

SEQ ID NO: 427341 - RNA, 64 nt, hsa; identical to SEQ ID NO: 199375

SEQ ID NO: 427342 - RNA, 64 nt, hsa; identical to SEQ ID NO: 199376

SEQ ID NO: 427343 - RNA, 64 nt, hsa; identical to SEQ ID NO: 199377

SEQ ID NO: 427344 - RNA, 64 nt, hsa; identical to SEQ ID NO: 199378

SEQ ID NO: 427345 - RNA, 64 nt, hsa; identical to SEQ ID NO: 199379

SEQ ID NO: 427346 - RNA, 64 nt, hsa; identical to SEQ ID NO: 199380

SEQ ID NO: 427347 - RNA, 64 nt, hsa; identical to SEQ ID NO: 199381

SEQ ID NO: 427348 - RNA, 64 nt, hsa; identical to SEQ ID NO: 199382

SEQ ID NO: 427349 - RNA, 64 nt, hsa; identical to SEQ ID NO: 199383

SEQ ID NO: 427350 - RNA, 64 nt, hsa; identical to SEQ ID NO: 199384

SEQ ID NO: 427351 - RNA, 64 nt, hsa; identical to SEQ ID NO: 199385

SEQ ID NO: 427352 - RNA, 64 nt, hsa; identical to SEQ ID NO: 199386

SEQ ID NO: 427353 - RNA, 64 nt, hsa; identical to SEQ ID NO: 199387

SEQ ID NO: 427354 - RNA, 62 nt, hsa; identical to SEQ ID NO: 199388

SEQ ID NO: 427355 - RNA, 64 nt, hsa; identical to SEQ ID NO: 199389

SEQ ID NO: 427356 - RNA, 64 nt, hsa; identical to SEQ ID NO: 199390

SEQ ID NO: 427357 - RNA, 64 nt, hsa; identical to SEQ ID NO: 199391

SEQ ID NO: 427358 - RNA, 64 nt, hsa; identical to SEQ ID NO: 199392

SEQ ID NO: 427359 - RNA, 64 nt, hsa; identical to SEQ ID NO: 199393

SEQ ID NO: 427360 - RNA, 64 nt, hsa; identical to SEQ ID NO: 199394

SEQ ID NO: 427361 - RNA, 64 nt, hsa; identical to SEQ ID NO: 199395

SEQ ID NO: 427362 - RNA, 64 nt, hsa; identical to SEQ ID NO: 199396

SEQ ID NO: 427363 - RNA, 64 nt, hsa; identical to SEQ ID NO: 199397

SEQ ID NO: 427364 - RNA, 64 nt, hsa; identical to SEQ ID NO: 199398

SEQ ID NO: 427365 - RNA, 64 nt, hsa; identical to SEQ ID NO: 199399

SEQ ID NO: 427366 - RNA, 64 nt, hsa; identical to SEQ ID NO: 199400

SEQ ID NO: 427367 - RNA, 64 nt, hsa; identical to SEQ ID NO: 199401

SEQ ID NO: 427368 - RNA, 64 nt, hsa; identical to SEQ ID NO: 199402

SEQ ID NO: 427369 - RNA, 64 nt, hsa
uuauauuuuauacaaauagauugcuuagaaugguucucaagaauuauaagagaaaugaacucac

SEQ ID NO: 427370 - RNA, 64 nt, hsa
uaauacuguugguggcauaagagaaucaagccauucucaagagauaacuucauaaccagaauug

SEQ ID NO: 427371 - RNA, 64 nt, hsa
uuaguauaucaucauaaaauagacaauguuuuugucucaagaacaagaauaaaauugaaaucug

SEQ ID NO: 427372 - RNA, 64 nt, hsa
agaauaaaaagguaaaacuacauuuagacuucuuucucaagaaaucaaauacagcuuuuuuuca

SEQ ID NO: 427373 - RNA, 64 nt, hsa
ugaaagccuaguccagaaaucuauuacaccuuuaucucaagauaggaagaaaauuuccuccaca

SEQ ID NO: 427374 - RNA, 64 nt, hsa
uaggaugauagaucauaacagaacuuauucuccaucucaagaucugcuucuagugauugugagu

SEQ ID NO: 427375 - RNA, 64 nt, hsa
ugagcuggaacaguaggggcagggagaagacaggucucaagaaaagguuuuuaagaaguuucau

SEQ ID NO: 427376 - RNA, 64 nt, hsa
cucagcuggaacaguggggacaggaggaggcaggucucaagagaaggucuuuacuuacuugucu

SEQ ID NO: 427377 - RNA, 64 nt, hsa
cagauuuuccucugacaccagagaacaauaguagucucaagaauggaaaccugaaugucugagg

SEQ ID NO: 427378 - RNA, 64 nt, hsa
gaaaaacuucaguuacugaccagucaagagaauuucucaagaaaaaucccagcaacguucccuc

SEQ ID NO: 427379 - RNA, 64 nt, hsa
cuaacccccucugcucuguccuccccuauugcgcucucaagaccagagacccaacagcagugau

SEQ ID NO: 427380 - RNA, 64 nt, hsa
ccgagauccccagggcagccuggaucccugcccuucucaagacuuuagcuuuuccuuccauccg

SEQ ID NO: 427381 - RNA, 64 nt, hsa
ccuggcucucucucugcugccucuucauacguuuucucaagaacuucaguuuauaauuggaaga

SEQ ID NO: 427382 - RNA, 64 nt, hsa
gcuccucuauccgaggccauuggagaccccaguuucucaagaauucagcucugcucugagcguc

SEQ ID NO: 427383 - RNA, 64 nt, hsa
uaaaggaagugaaaauagccagccagaggaaaugucucaagaaccagaaauaaauaaggguggu

SEQ ID NO: 427384 - RNA, 64 nt, hsa
cagccuucuacuugagcaaaacauugauguaucuucucaagaucuaucuggacagacggccaga

SEQ ID NO: 427385 - RNA, 64 nt, hsa
cuguuuggacuggguucucaagacacgaccagguucucaagacacgaguccccuuguuccuccc

SEQ ID NO: 427386 - RNA, 64 nt, hsa
ccaguccagaggccugauucuguuuggacuggguucucaagacacgaccagguucucaagacac

SEQ ID NO: 427387 - RNA, 64 nt, hsa; identical to SEQ ID NO: 153305

SEQ ID NO: 427388 - RNA, 64 nt, hsa; identical to SEQ ID NO: 153306

SEQ ID NO: 427389 - RNA, 53 nt, hsa; identical to SEQ ID NO: 153307

SEQ ID NO: 427390 - RNA, 64 nt, hsa; identical to SEQ ID NO: 153308

SEQ ID NO: 427391 - RNA, 64 nt, hsa; identical to SEQ ID NO: 153309

SEQ ID NO: 427392 - RNA, 64 nt, hsa; identical to SEQ ID NO: 153310

SEQ ID NO: 427393 - RNA, 64 nt, hsa; identical to SEQ ID NO: 153311

SEQ ID NO: 427394 - RNA, 64 nt, hsa; identical to SEQ ID NO: 153312

SEQ ID NO: 427395 - RNA, 64 nt, hsa; identical to SEQ ID NO: 153313

SEQ ID NO: 427396 - RNA, 64 nt, hsa; identical to SEQ ID NO: 153314

SEQ ID NO: 427397 - RNA, 64 nt, hsa; identical to SEQ ID NO: 153315

SEQ ID NO: 427398 - RNA, 64 nt, hsa; identical to SEQ ID NO: 153312

SEQ ID NO: 427399 - RNA, 64 nt, hsa; identical to SEQ ID NO: 153317

SEQ ID NO: 427400 - RNA, 64 nt, hsa; identical to SEQ ID NO: 153318

SEQ ID NO: 427401 - RNA, 64 nt, hsa; identical to SEQ ID NO: 153315

SEQ ID NO: 427402 - RNA, 64 nt, hsa; identical to SEQ ID NO: 153320

SEQ ID NO: 427403 - RNA, 64 nt, hsa; identical to SEQ ID NO: 153321

SEQ ID NO: 427404 - RNA, 64 nt, hsa; identical to SEQ ID NO: 153322

SEQ ID NO: 427405 - RNA, 64 nt, hsa; identical to SEQ ID NO: 153323

SEQ ID NO: 427406 - RNA, 64 nt, hsa; identical to SEQ ID NO: 153324

SEQ ID NO: 427407 - RNA, 64 nt, hsa; identical to SEQ ID NO: 153325

SEQ ID NO: 427408 - RNA, 64 nt, hsa; identical to SEQ ID NO: 153326

SEQ ID NO: 427409 - RNA, 64 nt, hsa; identical to SEQ ID NO: 153327

SEQ ID NO: 427410 - RNA, 64 nt, hsa; identical to SEQ ID NO: 153328

SEQ ID NO: 427411 - RNA, 64 nt, hsa; identical to SEQ ID NO: 153329

SEQ ID NO: 427412 - RNA, 64 nt, hsa; identical to SEQ ID NO: 153330

SEQ ID NO: 427413 - RNA, 64 nt, hsa; identical to SEQ ID NO: 153331

SEQ ID NO: 427414 - RNA, 64 nt, hsa; identical to SEQ ID NO: 153332

SEQ ID NO: 427415 - RNA, 64 nt, hsa; identical to SEQ ID NO: 153333

SEQ ID NO: 427416 - RNA, 64 nt, hsa; identical to SEQ ID NO: 153334

SEQ ID NO: 427417 - RNA, 64 nt, hsa; identical to SEQ ID NO: 153335

SEQ ID NO: 427418 - RNA, 64 nt, hsa; identical to SEQ ID NO: 153336

SEQ ID NO: 427419 - RNA, 64 nt, hsa; identical to SEQ ID NO: 153337

SEQ ID NO: 427420 - RNA, 64 nt, hsa; identical to SEQ ID NO: 153338

SEQ ID NO: 427421 - RNA, 64 nt, hsa; identical to SEQ ID NO: 153339

SEQ ID NO: 427422 - RNA, 64 nt, hsa; identical to SEQ ID NO: 153340

SEQ ID NO: 427423 - RNA, 64 nt, hsa; identical to SEQ ID NO: 153341

SEQ ID NO: 427424 - RNA, 64 nt, hsa; identical to SEQ ID NO: 153342

SEQ ID NO: 427425 - RNA, 64 nt, hsa; identical to SEQ ID NO: 153343

SEQ ID NO: 427426 - RNA, 64 nt, hsa; identical to SEQ ID NO: 153344

SEQ ID NO: 427427 - RNA, 64 nt, hsa; identical to SEQ ID NO: 153345

SEQ ID NO: 427428 - RNA, 64 nt, hsa; identical to SEQ ID NO: 153346

SEQ ID NO: 427429 - RNA, 51 nt, hsa; identical to SEQ ID NO: 153347

SEQ ID NO: 427430 - RNA, 64 nt, hsa; identical to SEQ ID NO: 153348

SEQ ID NO: 427431 - RNA, 64 nt, hsa; identical to SEQ ID NO: 153349

SEQ ID NO: 427432 - RNA, 64 nt, hsa; identical to SEQ ID NO: 153350

SEQ ID NO: 427433 - RNA, 64 nt, hsa; identical to SEQ ID NO: 153351

SEQ ID NO: 427434 - RNA, 64 nt, hsa; identical to SEQ ID NO: 153352

SEQ ID NO: 427435 - RNA, 64 nt, hsa; identical to SEQ ID NO: 153353

SEQ ID NO: 427436 - RNA, 64 nt, hsa; identical to SEQ ID NO: 153354

SEQ ID NO: 427437 - RNA, 64 nt, hsa; identical to SEQ ID NO: 153355

SEQ ID NO: 427438 - RNA, 64 nt, hsa; identical to SEQ ID NO: 153356

SEQ ID NO: 427439 - RNA, 64 nt, hsa; identical to SEQ ID NO: 153357

SEQ ID NO: 427440 - RNA, 64 nt, hsa; identical to SEQ ID NO: 153358

SEQ ID NO: 427441 - RNA, 64 nt, hsa; identical to SEQ ID NO: 153359

SEQ ID NO: 427442 - RNA, 64 nt, hsa; identical to SEQ ID NO: 427206

SEQ ID NO: 427443 - RNA, 64 nt, hsa; identical to SEQ ID NO: 427207

SEQ ID NO: 427444 - RNA, 64 nt, hsa; identical to SEQ ID NO: 156691

SEQ ID NO: 427445 - RNA, 64 nt, hsa; identical to SEQ ID NO: 156692

SEQ ID NO: 427446 - RNA, 64 nt, hsa; identical to SEQ ID NO: 156693

SEQ ID NO: 427447 - RNA, 64 nt, hsa; identical to SEQ ID NO: 156694

SEQ ID NO: 427448 - RNA, 64 nt, hsa; identical to SEQ ID NO: 156695

SEQ ID NO: 427449 - RNA, 64 nt, hsa; identical to SEQ ID NO: 156696

SEQ ID NO: 427450 - RNA, 64 nt, hsa; identical to SEQ ID NO: 156697

SEQ ID NO: 427451 - RNA, 64 nt, hsa; identical to SEQ ID NO: 156698

SEQ ID NO: 427452 - RNA, 64 nt, hsa; identical to SEQ ID NO: 156699

SEQ ID NO: 427453 - RNA, 64 nt, hsa; identical to SEQ ID NO: 156700

SEQ ID NO: 427454 - RNA, 64 nt, hsa; identical to SEQ ID NO: 156701

SEQ ID NO: 427455 - RNA, 64 nt, hsa; identical to SEQ ID NO: 156702

SEQ ID NO: 427456 - RNA, 64 nt, hsa; identical to SEQ ID NO: 156703

SEQ ID NO: 427457 - RNA, 64 nt, hsa; identical to SEQ ID NO: 156704

SEQ ID NO: 427458 - RNA, 64 nt, hsa; identical to SEQ ID NO: 156705

SEQ ID NO: 427459 - RNA, 64 nt, hsa; identical to SEQ ID NO: 156706

SEQ ID NO: 427460 - RNA, 64 nt, hsa; identical to SEQ ID NO: 156707

SEQ ID NO: 427461 - RNA, 64 nt, hsa; identical to SEQ ID NO: 156708

SEQ ID NO: 427462 - RNA, 64 nt, hsa; identical to SEQ ID NO: 156709

SEQ ID NO: 427463 - RNA, 64 nt, hsa; identical to SEQ ID NO: 156710

SEQ ID NO: 427464 - RNA, 64 nt, hsa; identical to SEQ ID NO: 156711

SEQ ID NO: 427465 - RNA, 64 nt, hsa; identical to SEQ ID NO: 156712

SEQ ID NO: 427466 - RNA, 64 nt, hsa; identical to SEQ ID NO: 156713

SEQ ID NO: 427467 - RNA, 64 nt, hsa; identical to SEQ ID NO: 156714

SEQ ID NO: 427468 - RNA, 64 nt, hsa; identical to SEQ ID NO: 156715

SEQ ID NO: 427469 - RNA, 64 nt, hsa; identical to SEQ ID NO: 156716

SEQ ID NO: 427470 - RNA, 64 nt, hsa; identical to SEQ ID NO: 156717

SEQ ID NO: 427471 - RNA, 64 nt, hsa; identical to SEQ ID NO: 156718

SEQ ID NO: 427472 - RNA, 64 nt, hsa; identical to SEQ ID NO: 156719

SEQ ID NO: 427473 - RNA, 64 nt, hsa; identical to SEQ ID NO: 156720

SEQ ID NO: 427474 - RNA, 64 nt, hsa; identical to SEQ ID NO: 156721

SEQ ID NO: 427475 - RNA, 64 nt, hsa; identical to SEQ ID NO: 156722

SEQ ID NO: 427476 - RNA, 64 nt, hsa; identical to SEQ ID NO: 156723

SEQ ID NO: 427477 - RNA, 50 nt, hsa; identical to SEQ ID NO: 156724

SEQ ID NO: 427478 - RNA, 64 nt, hsa; identical to SEQ ID NO: 156725

SEQ ID NO: 427479 - RNA, 64 nt, hsa; identical to SEQ ID NO: 156726

SEQ ID NO: 427480 - RNA, 64 nt, hsa; identical to SEQ ID NO: 156727

SEQ ID NO: 427481 - RNA, 64 nt, hsa; identical to SEQ ID NO: 156728

SEQ ID NO: 427482 - RNA, 64 nt, hsa; identical to SEQ ID NO: 156729

SEQ ID NO: 427483 - RNA, 64 nt, hsa; identical to SEQ ID NO: 156730

SEQ ID NO: 427484 - RNA, 64 nt, hsa; identical to SEQ ID NO: 156731

SEQ ID NO: 427485 - RNA, 64 nt, hsa; identical to SEQ ID NO: 156732

SEQ ID NO: 427486 - RNA, 64 nt, hsa; identical to SEQ ID NO: 156733

SEQ ID NO: 427487 - RNA, 64 nt, hsa; identical to SEQ ID NO: 156734

SEQ ID NO: 427488 - RNA, 64 nt, hsa; identical to SEQ ID NO: 156735

SEQ ID NO: 427489 - RNA, 64 nt, hsa; identical to SEQ ID NO: 156736

SEQ ID NO: 427490 - RNA, 64 nt, hsa; identical to SEQ ID NO: 156737

SEQ ID NO: 427491 - RNA, 64 nt, hsa; identical to SEQ ID NO: 156738

SEQ ID NO: 427492 - RNA, 62 nt, hsa
ugcauugugaagaggaggaaaagugaaucacggagagagaaaggaaaggauagaaucacagg

SEQ ID NO: 427493 - RNA, 62 nt, hsa
ccaugucugugacacaggacggugggaagccugagagagagugaaauuaugugauacacuga

SEQ ID NO: 427494 - RNA, 62 nt, hsa
agcccacagugguggccucugccucuuuccuggagagagaaggacagugcacggagagguuu

SEQ ID NO: 427495 - RNA, 62 nt, hsa
ugcccuaccugucuuuccugaguguuugaggggagagagagacccacaucuccccaaagaga

SEQ ID NO: 427496 - RNA, 62 nt, hsa
cccuaccugucuuuccugaguguuugaggggagagagagacccacaucuccccaaagagaug

SEQ ID NO: 427497 - RNA, 62 nt, hsa
gcaggcucacugccaggccagccuccgagagggagagagagagagagaggacagcuugagcc

SEQ ID NO: 427498 - RNA, 62 nt, hsa
aggcucacugccaggccagccuccgagagggagagagagagagagaggacagcuugagccgg

SEQ ID NO: 427499 - RNA, 62 nt, hsa
gcucacugccaggccagccuccgagagggagagagagagagagaggacagcuugagccgggc

SEQ ID NO: 427500 - RNA, 62 nt, hsa
ucacugccaggccagccuccgagagggagagagagagagagaggacagcuugagccgggccc

SEQ ID NO: 427501 - RNA, 62 nt, hsa
acugccaggccagccuccgagagggagagagagagagagaggacagcuugagccgggccccu

SEQ ID NO: 427502 - RNA, 62 nt, hsa
gagaucuuacagguaucaggcacaggcaggaagagagagagagagguucuggggaggaaggg

SEQ ID NO: 427503 - RNA, 62 nt, hsa
gaucuuacagguaucaggcacaggcaggaagagagagagagagguucuggggaggaagggcc

SEQ ID NO: 427504 - RNA, 62 nt, hsa
ucuuacagguaucaggcacaggcaggaagagagagagagagguucuggggaggaagggccag

SEQ ID NO: 427505 - RNA, 62 nt, hsa
gagagagagagguucuggggaggaagggccaggagagagaucuagaaaguggguucacuaga

SEQ ID NO: 427506 - RNA, 62 nt, hsa
ucccuuucccugucuggcuucucccuuaagaagagagagauacuuguagaauuggguggggg

SEQ ID NO: 427507 - RNA, 62 nt, hsa
guccuuccauuugggauauguuacauuagagugagagagagaauaaggagccuuucuuaugg

SEQ ID NO: 427508 - RNA, 62 nt, hsa
ccuuccauuugggauauguuacauuagagugagagagagaauaaggagccuuucuuauggaa

SEQ ID NO: 427509 - RNA, 62 nt, hsa
gaugggaccucgaggcucgagcugaagcaggcgagagagaaacagcuacugcgugcgugcgc

SEQ ID NO: 427510 - RNA, 62 nt, hsa
ucucugucgaagaaagaagcucugucaaguuagagagagacaauguguaggaaauguucuuu

SEQ ID NO: 427511 - RNA, 62 nt, hsa
gaacucuccguccccccggggcccuccggagggagagagagaggaacugcuguuuaucucac

SEQ ID NO: 427512 - RNA, 62 nt, hsa
acucuccguccccccggggcccuccggagggagagagagaggaacugcuguuuaucucacuc

SEQ ID NO: 427513 - RNA, 62 nt, hsa
aaaagagcauguacaugggagugagagaaaaagagagagagagacagaguggcgggggcggg

SEQ ID NO: 427514 - RNA, 62 nt, hsa
aagagcauguacaugggagugagagaaaaagagagagagagacagaguggcgggggcgggga

SEQ ID NO: 427515 - RNA, 62 nt, hsa
gagcauguacaugggagugagagaaaaagagagagagagacagaguggcgggggcggggagg

SEQ ID NO: 427516 - RNA, 62 nt, hsa
gcaguuccuaaaugauucucacaagcaacccugagagagacagucuugugagggagaucugg

SEQ ID NO: 427517 - RNA, 62 nt, hsa
acaaacaaaaaacaauggaaaagaugaagcuggagagagaggaaccaguugccaagguagag

SEQ ID NO: 427518 - RNA, 62 nt, hsa
uagcagcagccucagcagcugucuugguaaaggagagagagagacauggggccaguaauucc

SEQ ID NO: 427519 - RNA, 62 nt, hsa
gcagcagccucagcagcugucuugguaaaggagagagagagacauggggccaguaauuccgg

SEQ ID NO: 427520 - RNA, 62 nt, hsa
agcagccucagcagcugucuugguaaaggagagagagagacauggggccaguaauuccgggg

SEQ ID NO: 427521 - RNA, 62 nt, hsa
gugaaacugaggagucugcaauuuggaauauggagagagagacugauuugcugaauuuccuu

SEQ ID NO: 427522 - RNA, 62 nt, hsa
gaaacugaggagucugcaauuuggaauauggagagagagacugauuugcugaauuuccuucu

SEQ ID NO: 427523 - RNA, 62 nt, hsa
gagaaccacaaugcacauuagcauauuagucugagagagaacuuauaguaaggaaacucacu

SEQ ID NO: 427524 - RNA, 62 nt, hsa
uuccuggaaacuuugacaagcuuuauuaaguugagagagagagaggggaaaaaaaaaagccu

SEQ ID NO: 427525 - RNA, 62 nt, hsa
ccuggaaacuuugacaagcuuuauuaaguugagagagagagaggggaaaaaaaaaagccuuu

SEQ ID NO: 427526 - RNA, 62 nt, hsa
uggaaacuuugacaagcuuuauuaaguugagagagagagaggggaaaaaaaaaagccuuucg

SEQ ID NO: 427527 - RNA, 62 nt, hsa
ucggcggccgcggcugggcccugcaggagggagagagagacacagucauggcccccuuccuc

SEQ ID NO: 427528 - RNA, 62 nt, hsa
guucggcggccgcggcugggcccugcaggagggagagagagacacagucauggcccccuucc

SEQ ID NO: 427529 - RNA, 62 nt, hsa
augaaauguccagaauaggcaaaucuguuugagagagagaaaguagaugaguacuugccuag

SEQ ID NO: 427530 - RNA, 62 nt, hsa
auaugaaauguccagaauaggcaaaucuguuugagagagagaaaguagaugaguacuugccu

SEQ ID NO: 427531 - RNA, 62 nt, hsa
ggguucuccccccuacacccucugcagguggagagagagaagcugggcccagccgggccgug

SEQ ID NO: 427532 - RNA, 62 nt, hsa
caggguucuccccccuacacccucugcagguggagagagagaagcugggcccagccgggccg

SEQ ID NO: 427533 - RNA, 62 nt, hsa
agucucuagagguagaaauuugccuugcugcagagagagaaggaauggcgugggauggggga

SEQ ID NO: 427534 - RNA, 62 nt, hsa
agagacacaggucucccgucccugcaccagcugagagagacuugccgcaaagcacaaggcug

SEQ ID NO: 427535 - RNA, 62 nt, hsa
ugaaauaaaaagaagagagggaggaagaaagggagagagaagaaaagaaaaaugaagaaaag

SEQ ID NO: 427536 - RNA, 62 nt, hsa
cccuagggucugcuuuagagaagggggauaaagagagagaaggacuguuaugaaaaacagaa

SEQ ID NO: 427537 - RNA, 62 nt, hsa
cugggacuccaggucuugaggagagagacagagagagagaauggauccucauaggucaggga

SEQ ID NO: 427538 - RNA, 62 nt, hsa
uucugggacuccaggucuugaggagagagacagagagagagaauggauccucauaggucagg

SEQ ID NO: 427539 - RNA, 62 nt, hsa
uggagcacuguucugggacuccaggucuugaggagagagacagagagagagaauggauccuc

SEQ ID NO: 427540 - RNA, 62 nt, hsa
ggagagccccacaaaacuuuggggacaagggagagagagacucaucugacacuucuuuugga

SEQ ID NO: 427541 - RNA, 62 nt, hsa
agggagagccccacaaaacuuuggggacaagggagagagagacucaucugacacuucuuuug

SEQ ID NO: 427542 - RNA, 62 nt, hsa
gagagacagaaagagagagagagagagagagagagagagauccucagaguggaaggaggggg

SEQ ID NO: 427543 - RNA, 62 nt, hsa
gagagagacagaaagagagagagagagagagagagagagagauccucagaguggaaggaggg

SEQ ID NO: 427544 - RNA, 62 nt, hsa
gagagagagacagaaagagagagagagagagagagagagagagauccucagaguggaaggag

SEQ ID NO: 427545 - RNA, 62 nt, hsa
gagagagagagacagaaagagagagagagagagagagagagagagauccucagaguggaagg

SEQ ID NO: 427546 - RNA, 62 nt, hsa
cagagagagagagacagaaagagagagagagagagagagagagagagauccucagaguggaa

SEQ ID NO: 427547 - RNA, 62 nt, hsa
agcagagagagagagacagaaagagagagagagagagagagagagagagauccucagagugg

SEQ ID NO: 427548 - RNA, 62 nt, hsa
guagcagagagagagagacagaaagagagagagagagagagagagagagagauccucagagu

SEQ ID NO: 427549 - RNA, 62 nt, hsa
ggguagcagagagagagagacagaaagagagagagagagagagagagagagagauccucaga

SEQ ID NO: 427550 - RNA, 62 nt, hsa
aaggguagcagagagagagagacagaaagagagagagagagagagagagagagagauccuca

SEQ ID NO: 427551 - RNA, 62 nt, hsa
ggaaggguagcagagagagagagacagaaagagagagagagagagagagagagagagauccu

SEQ ID NO: 427552 - RNA, 62 nt, hsa
ugggaaggguagcagagagagagagacagaaagagagagagagagagagagagagagagauc

SEQ ID NO: 427553 - RNA, 62 nt, hsa
gucugagggcagguugggaaggguagcagagagagagagacagaaagagagagagagagaga

SEQ ID NO: 427554 - RNA, 62 nt, hsa
gugucugagggcagguugggaaggguagcagagagagagagacagaaagagagagagagaga

SEQ ID NO: 427555 - RNA, 62 nt, hsa
cagugucugagggcagguugggaaggguagcagagagagagagacagaaagagagagagaga

SEQ ID NO: 427556 - RNA, 62 nt, hsa
aaaauguguguguguguucugugugugugugagagagagaguacuugauucauuaaaaaguc

SEQ ID NO: 427557 - RNA, 62 nt, hsa
uaaaaauguguguguguguucugugugugugugagagagagaguacuugauucauuaaaaag

SEQ ID NO: 427558 - RNA, 62 nt, hsa
uauuggagaaggacugggucagagaucuguuggagagagagaauaaagagauuauuuuucau

SEQ ID NO: 427559 - RNA, 62 nt, hsa
uuggagaaggacugggucagagaucuguuggagagagagaauaaagagauuauuuuucauua

SEQ ID NO: 427560 - RNA, 62 nt, hsa
agcacacauaaaagcacaaagacagagacgcagagagagagagagagccacggagaggaaaa

SEQ ID NO: 427561 - RNA, 62 nt, hsa
cacacauaaaagcacaaagacagagacgcagagagagagagagagccacggagaggaaaagc

SEQ ID NO: 427562 - RNA, 62 nt, hsa
cacauaaaagcacaaagacagagacgcagagagagagagagagccacggagaggaaaagcag

SEQ ID NO: 427563 - RNA, 62 nt, hsa
cauaaaagcacaaagacagagacgcagagagagagagagagccacggagaggaaaagcagau

SEQ ID NO: 427564 - RNA, 62 nt, hsa
ucgcccagcaccccugcugauaccaccagacagagagagagagcacuugauucuucccgaga

SEQ ID NO: 427565 - RNA, 62 nt, hsa
gcccagcaccccugcugauaccaccagacagagagagagagcacuugauucuucccgagaua

SEQ ID NO: 427566 - RNA, 62 nt, hsa
aguccacagguggacaaagggauccccagccagagagagagagaccagccaacagcuugaua

SEQ ID NO: 427567 - RNA, 62 nt, hsa
uccacagguggacaaagggauccccagccagagagagagagaccagccaacagcuugauaga

SEQ ID NO: 427568 - RNA, 62 nt, hsa
cacagguggacaaagggauccccagccagagagagagagaccagccaacagcuugauagacc

SEQ ID NO: 427569 - RNA, 62 nt, hsa
guguguguguguguguguguguguguguggcagagagagagaaagagagagagagagagaaa

SEQ ID NO: 427570 - RNA, 62 nt, hsa
guguguguguguguguguguguguguggcagagagagagaaagagagagagagagagaaauu

SEQ ID NO: 427571 - RNA, 62 nt, hsa
guguguguguguguguggcagagagagagaaagagagagagagagagaaauucuguuaaaau

SEQ ID NO: 427572 - RNA, 62 nt, hsa
guguguguguguguggcagagagagagaaagagagagagagagagaaauucuguuaaaaucu

SEQ ID NO: 427573 - RNA, 62 nt, hsa
guguguguguguggcagagagagagaaagagagagagagagagaaauucuguuaaaaucuau

SEQ ID NO: 427574 - RNA, 62 nt, hsa
guguguguguggcagagagagagaaagagagagagagagagaaauucuguuaaaaucuauuc

SEQ ID NO: 427575 - RNA, 62 nt, hsa
guguguguggcagagagagagaaagagagagagagagagaaauucuguuaaaaucuauucug

SEQ ID NO: 427576 - RNA, 62 nt, hsa
gggauagcagugaggucagaagucuuucccgggagagagauggccuggguuaucauugcuga

SEQ ID NO: 427577 - RNA, 62 nt, hsa
gacauaggacugagccaaggaagagucugccugagagagacgcuuggccugugcuuugcugc

SEQ ID NO: 427578 - RNA, 62 nt, hsa
uuuccaguuccguucugagagaaaaagagagagagagagaaaaagaccaugcugcauacauu

SEQ ID NO: 427579 - RNA, 62 nt, hsa
uguuuccaguuccguucugagagaaaaagagagagagagagaaaaagaccaugcugcauaca

SEQ ID NO: 427580 - RNA, 62 nt, hsa
gcuguuuccaguuccguucugagagaaaaagagagagagagagaaaaagaccaugcugcaua

SEQ ID NO: 427581 - RNA, 62 nt, hsa
uugcuguuuccaguuccguucugagagaaaaagagagagagagagaaaaagaccaugcugca

SEQ ID NO: 427582 - RNA, 62 nt, hsa
cuuucugaaagaucuagugguucacacagagagagagagaguacugaaaaagcaacuccucu

SEQ ID NO: 427583 - RNA, 62 nt, hsa
ggcuuucugaaagaucuagugguucacacagagagagagagaguacugaaaaagcaacuccu

SEQ ID NO: 427584 - RNA, 62 nt, hsa
caggcuuucugaaagaucuagugguucacacagagagagagagaguacugaaaaagcaacuc

SEQ ID NO: 427585 - RNA, 62 nt, hsa
guugggauguggauggaugugugcauaagagagagagagaauaugugugugugugugugcgu

SEQ ID NO: 427586 - RNA, 62 nt, hsa
uuguugggauguggauggaugugugcauaagagagagagagaauaugugugugugugugugc

SEQ ID NO: 427587 - RNA, 62 nt, hsa
aauuguugggauguggauggaugugugcauaagagagagagagaauaugugugugugugugu

SEQ ID NO: 427588 - RNA, 62 nt, hsa
ggggaaaagagagagagagagagagagagagagagagagaaagauggaggagaagaacuugg

SEQ ID NO: 427589 - RNA, 62 nt, hsa
agggggaaaagagagagagagagagagagagagagagagagaaagauggaggagaagaacuu

SEQ ID NO: 427590 - RNA, 62 nt, hsa
ggagggggaaaagagagagagagagagagagagagagagagagaaagauggaggagaagaac

SEQ ID NO: 427591 - RNA, 62 nt, hsa
ggggagggggaaaagagagagagagagagagagagagagagagagaaagauggaggagaaga

SEQ ID NO: 427592 - RNA, 62 nt, hsa
gaggggagggggaaaagagagagagagagagagagagagagagagagaaagauggaggagaa

SEQ ID NO: 427593 - RNA, 62 nt, hsa
cagaggggagggggaaaagagagagagagagagagagagagagagagagaaagauggaggag

SEQ ID NO: 427594 - RNA, 62 nt, hsa
ugcagaggggagggggaaaagagagagagagagagagagagagagagagagaaagauggagg

SEQ ID NO: 427595 - RNA, 62 nt, hsa
auugcagaggggagggggaaaagagagagagagagagagagagagagagagagaaagaugga

SEQ ID NO: 427596 - RNA, 62 nt, hsa
gaauugcagaggggagggggaaaagagagagagagagagagagagagagagagagaaagaug

SEQ ID NO: 427597 - RNA, 62 nt, hsa
gugaauugcagaggggagggggaaaagagagagagagagagagagagagagagagagaaaga

SEQ ID NO: 427598 - RNA, 62 nt, hsa
aagugaauugcagaggggagggggaaaagagagagagagagagagagagagagagagagaaa

SEQ ID NO: 427599 - RNA, 62 nt, hsa
ggaagugaauugcagaggggagggggaaaagagagagagagagagagagagagagagagaga

SEQ ID NO: 427600 - RNA, 62 nt, hsa
agggaagugaauugcagaggggagggggaaaagagagagagagagagagagagagagagaga

SEQ ID NO: 427601 - RNA, 62 nt, hsa
gaacucaucugaaucaucaguuccuugauggagagagagaaggagauggaaugugucuggua

SEQ ID NO: 427602 - RNA, 62 nt, hsa
uugaacucaucugaaucaucaguuccuugauggagagagagaaggagauggaaugugucugg

SEQ ID NO: 427603 - RNA, 62 nt, hsa
uguucgacugggagguucuggaaagaaagagagagagagaaaagagguaaaggagggagcca

SEQ ID NO: 427604 - RNA, 62 nt, hsa
ccuguucgacugggagguucuggaaagaaagagagagagagaaaagagguaaaggagggagc

SEQ ID NO: 427605 - RNA, 62 nt, hsa
uuccuguucgacugggagguucuggaaagaaagagagagagagaaaagagguaaaggaggga

SEQ ID NO: 427606 - RNA, 62 nt, hsa
aaggcuagaaaccuggcuggcugugagucagagagagagaggauggacgugggagaaagcaa

SEQ ID NO: 427607 - RNA, 62 nt, hsa
acaaggcuagaaaccuggcuggcugugagucagagagagagaggauggacgugggagaaagc

SEQ ID NO: 427608 - RNA, 62 nt, hsa
ugaucuagggguuucuuggccacauuucccuugagagagagugggauuugcccuauccacag

SEQ ID NO: 427609 - RNA, 62 nt, hsa
gguucaaaaagaaaaaaauaauaaaaauaaaagagagagagaaucagaccuggguggaacuc

SEQ ID NO: 427610 - RNA, 62 nt, hsa
uucaaaaagaaaaaaauaauaaaaauaaaagagagagagaaucagaccuggguggaacucuc

SEQ ID NO: 427611 - RNA, 62 nt, hsa
gccugggguggacauucagcagagugcgaguggagagagagagaugguguuuacucagaacc

SEQ ID NO: 427612 - RNA, 62 nt, hsa
cugggguggacauucagcagagugcgaguggagagagagagaugguguuuacucagaaccug

SEQ ID NO: 427613 - RNA, 62 nt, hsa
gggguggacauucagcagagugcgaguggagagagagagaugguguuuacucagaaccugcu

SEQ ID NO: 427614 - RNA, 62 nt, hsa
uucaaggaaucauuguuuggcauugaaaauaggagagagaucaugagaaauuaccaaaaugu

SEQ ID NO: 427615 - RNA, 62 nt, hsa
augaagucuuguucaggguauggggcuaggaugagagagaaugccacagaguaugaaggaag

SEQ ID NO: 427616 - RNA, 62 nt, hsa
ucaagucaacaaagaacuuaccuuggaggauagagagagagaagggaccaauuaugaggacu

SEQ ID NO: 427617 - RNA, 62 nt, hsa
aagucaacaaagaacuuaccuuggaggauagagagagagaagggaccaauuaugaggacuga

SEQ ID NO: 427618 - RNA, 62 nt, hsa
cccuuaguguuuggguauauucauuucaaagggagagagagagguuuuuuucuguucugucu

SEQ ID NO: 427619 - RNA, 62 nt, hsa
cuuaguguuuggguauauucauuucaaagggagagagagagguuuuuuucuguucugucuca

SEQ ID NO: 427620 - RNA, 62 nt, hsa
ugguuuugaugcuagagaggaaaaaggacuuggagagagagaaggaauggcugguccagagg

SEQ ID NO: 427621 - RNA, 62 nt, hsa
guuuugaugcuagagaggaaaaaggacuuggagagagagaaggaauggcugguccagaggcu

SEQ ID NO: 427622 - RNA, 50 nt, hsa; identical to SEQ ID NO: 157121

SEQ ID NO: 427623 - RNA, 52 nt, hsa; identical to SEQ ID NO: 157122

SEQ ID NO: 427624 - RNA, 54 nt, hsa; identical to SEQ ID NO: 157123

SEQ ID NO: 427625 - RNA, 56 nt, hsa; identical to SEQ ID NO: 157124

SEQ ID NO: 427626 - RNA, 58 nt, hsa; identical to SEQ ID NO: 157125

SEQ ID NO: 427627 - RNA, 60 nt, hsa; identical to SEQ ID NO: 157126

SEQ ID NO: 427628 - RNA, 62 nt, hsa; identical to SEQ ID NO: 157127

SEQ ID NO: 427629 - RNA, 62 nt, hsa
aaagggaauaagcaaagggggaagaauugaaagagagagagaagaaagaauacagagagcuu

SEQ ID NO: 427630 - RNA, 62 nt, hsa
agggaauaagcaaagggggaagaauugaaagagagagagaagaaagaauacagagagcuuac

SEQ ID NO: 427631 - RNA, 62 nt, hsa
uucuuuauguguguguaugugugucagagaaagagagagagagagagagaagggaggaugag

SEQ ID NO: 427632 - RNA, 62 nt, hsa
cuuuauguguguguaugugugucagagaaagagagagagagagagagaagggaggaugagaa

SEQ ID NO: 427633 - RNA, 62 nt, hsa
uuauguguguguaugugugucagagaaagagagagagagagagagaagggaggaugagaacg

SEQ ID NO: 427634 - RNA, 62 nt, hsa
auguguguguaugugugucagagaaagagagagagagagagagaagggaggaugagaacgaa

SEQ ID NO: 427635 - RNA, 62 nt, hsa
guguguguaugugugucagagaaagagagagagagagagagaagggaggaugagaacgaaug

SEQ ID NO: 427636 - RNA, 62 nt, hsa
guguguaugugugucagagaaagagagagagagagagagaagggaggaugagaacgaauggg

SEQ ID NO: 427637 - RNA, 62 nt, hsa
gaaagaaccaaaagagaucacaauacucaaaagagagagagagagaaaaaagagagaucuug

SEQ ID NO: 427638 - RNA, 62 nt, hsa
aagaaccaaaagagaucacaauacucaaaagagagagagagagaaaaaagagagaucuugau

SEQ ID NO: 427639 - RNA, 62 nt, hsa
gaaccaaaagagaucacaauacucaaaagagagagagagagaaaaaagagagaucuugaucc

SEQ ID NO: 427640 - RNA, 62 nt, hsa
accaaaagagaucacaauacucaaaagagagagagagagaaaaaagagagaucuugauccac

SEQ ID NO: 427641 - RNA, 62 nt, hsa
ugugugcagaaaucaaaugacagagaggaagugagagagagaggugucggggaggugccagg

SEQ ID NO: 427642 - RNA, 62 nt, hsa
ugugcagaaaucaaaugacagagaggaagugagagagagaggugucggggaggugccaggcu

SEQ ID NO: 427643 - RNA, 62 nt, hsa
uuggugcuacacagcuagaauagauauauuuagagagagagauauuuuuaagacaaagccca

SEQ ID NO: 427644 - RNA, 62 nt, hsa
ggugcuacacagcuagaauagauauauuuagagagagagauauuuuuaagacaaagcccaca

SEQ ID NO: 427645 - RNA, 62 nt, hsa
uggcauuggaagcuuauucuuuuuguucacuggagagagagagaacuguuuacaguuaaucu

SEQ ID NO: 427646 - RNA, 62 nt, hsa
gcauuggaagcuuauucuuuuuguucacuggagagagagagaacuguuuacaguuaaucugu

SEQ ID NO: 427647 - RNA, 62 nt, hsa
auuggaagcuuauucuuuuuguucacuggagagagagagaacuguuuacaguuaaucugugu

SEQ ID NO: 427648 - RNA, 62 nt, hsa
aacaggaccaucacagcuucugaacugagccggagagagagaauggaauugcugaccccugg

SEQ ID NO: 427649 - RNA, 62 nt, hsa
caggaccaucacagcuucugaacugagccggagagagagaauggaauugcugaccccuggaa

SEQ ID NO: 427650 - RNA, 62 nt, hsa
auaaaaacauagacuggaggagguaauccauggagagagaaaaagaagagggcucaggacaa

SEQ ID NO: 427651 - RNA, 62 nt, hsa
aauauugauggcaacagucaagauggugugaugagagagaugggaggggcacaaagaggagg

SEQ ID NO: 427652 - RNA, 62 nt, hsa
gaccuuguauuagcauccaagaaaugaugagagagagagaaauuauauacuaugaaaagugc

SEQ ID NO: 427653 - RNA, 62 nt, hsa
gagaccuuguauuagcauccaagaaaugaugagagagagagaaauuauauacuaugaaaagu

SEQ ID NO: 427654 - RNA, 62 nt, hsa
cugagaccuuguauuagcauccaagaaaugaugagagagagagaaauuauauacuaugaaaa

SEQ ID NO: 427655 - RNA, 62 nt, hsa
cagagugagacuccaucucaaaaaaaaaaagagagagagaugaaaagaguaggaaaaugaga

SEQ ID NO: 427656 - RNA, 62 nt, hsa
aacagagugagacuccaucucaaaaaaaaaaagagagagagaugaaaagaguaggaaaauga

SEQ ID NO: 427657 - RNA, 62 nt, hsa
caccugccccgaagacuccuaauaggucaagagagagagacccagacaagcaaacucaaaau

SEQ ID NO: 427658 - RNA, 62 nt, hsa
aacaccugccccgaagacuccuaauaggucaagagagagagacccagacaagcaaacucaaa

SEQ ID NO: 427659 - RNA, 62 nt, hsa
uuucauuaauaauaugagaaaugauaccuggagagagagauuaugagcaaauguauugcuuc

SEQ ID NO: 427660 - RNA, 62 nt, hsa
auuuucauuaauaauaugagaaaugauaccuggagagagagauuaugagcaaauguauugcu

SEQ ID NO: 427661 - RNA, 62 nt, hsa
aagagcaagaaaagagaaaauauuaaaacgaggagagagaaaaauaauauuaacacaaaaaa

SEQ ID NO: 427662 - RNA, 62 nt, hsa
ggguuuuguaggagcggguuugggggagucuggagagagacuggacaggggagugcuggaac

SEQ ID NO: 427663 - RNA, 62 nt, hsa
uaaaaaaaaaaaagaugacaaagaaaaacagagagagagaauauuggagauguccugaauuu

SEQ ID NO: 427664 - RNA, 62 nt, hsa
uuuaaaaaaaaaaaagaugacaaagaaaaacagagagagagaauauuggagauguccugaau

SEQ ID NO: 427665 - RNA, 62 nt, hsa
ggcucuuaaaaaaaaaaaaaaaaaaaaaaaaagagagagagagaauaaauagaaaagaaugu

SEQ ID NO: 427666 - RNA, 62 nt, hsa
cucuuaaaaaaaaaaaaaaaaaaaaaaaaagagagagagagaauaaauagaaaagaaugugg

SEQ ID NO: 427667 - RNA, 62 nt, hsa
cuuaaaaaaaaaaaaaaaaaaaaaaaaagagagagagagaauaaauagaaaagaauguggcu

SEQ ID NO: 427668 - RNA, 62 nt, hsa
ucaauaauguucaacugaaucucacagaugaggagagagaagaaacggaagaggaaguuuau

SEQ ID NO: 427669 - RNA, 62 nt, hsa
guggaauggaggaguuguuuggggagggaaaggagagagaaggaaaggagugagguauuucc

SEQ ID NO: 427670 - RNA, 62 nt, hsa
ucugacaaauucaaaagagagagagagaucuugagagagaaaugcuguucguucaaaagugg

SEQ ID NO: 427671 - RNA, 62 nt, hsa
ugcguaacuccaucugacaaauucaaaagagagagagagaucuugagagagaaaugcuguuc

SEQ ID NO: 427672 - RNA, 62 nt, hsa
ccugcguaacuccaucugacaaauucaaaagagagagagagaucuugagagagaaaugcugu

SEQ ID NO: 427673 - RNA, 62 nt, hsa
aaccugcguaacuccaucugacaaauucaaaagagagagagagaucuugagagagaaaugcu

SEQ ID NO: 427674 - RNA, 62 nt, hsa
ugacuguguugugauucauaguacauuaaaaagagagagagagagaaagaaucccacagggc

SEQ ID NO: 427675 - RNA, 62 nt, hsa
acuguguugugauucauaguacauuaaaaagagagagagagagaaagaaucccacagggcac

SEQ ID NO: 427676 - RNA, 62 nt, hsa
uguguugugauucauaguacauuaaaaagagagagagagagaaagaaucccacagggcacua

SEQ ID NO: 427677 - RNA, 62 nt, hsa
uguugugauucauaguacauuaaaaagagagagagagagaaagaaucccacagggcacuauu

SEQ ID NO: 427678 - RNA, 62 nt, hsa
cugacuucugcuagguagaggcauuugucuuagagagagagagagcgcgggagagagugaga

SEQ ID NO: 427679 - RNA, 62 nt, hsa
gacuucugcuagguagaggcauuugucuuagagagagagagagcgcgggagagagugagaga

SEQ ID NO: 427680 - RNA, 62 nt, hsa
cuucugcuagguagaggcauuugucuuagagagagagagagcgcgggagagagugagagaga

SEQ ID NO: 427681 - RNA, 62 nt, hsa
gucuuagagagagagagagcgcgggagagagugagagagagugagagcacaaagauaacgca

SEQ ID NO: 427682 - RNA, 62 nt, hsa
ugagagagagugagagcacaaagauaacgcaggagagagagagagaaagaaugagaaagaaa

SEQ ID NO: 427683 - RNA, 62 nt, hsa
agagagagugagagcacaaagauaacgcaggagagagagagagaaagaaugagaaagaaaag

SEQ ID NO: 427684 - RNA, 62 nt, hsa
agagagugagagcacaaagauaacgcaggagagagagagagaaagaaugagaaagaaaagga

SEQ ID NO: 427685 - RNA, 62 nt, hsa
agagugagagcacaaagauaacgcaggagagagagagagaaagaaugagaaagaaaaggaau

SEQ ID NO: 427686 - RNA, 62 nt, hsa
gaacaauagauuauuucuguuuuacuccaaaagagagagagagagugagugugagugugugu

SEQ ID NO: 427687 - RNA, 62 nt, hsa
acaauagauuauuucuguuuuacuccaaaagagagagagagagugagugugagugugugugu

SEQ ID NO: 427688 - RNA, 62 nt, hsa
aauagauuauuucuguuuuacuccaaaagagagagagagagugagugugagugugugugugu

SEQ ID NO: 427689 - RNA, 62 nt, hsa
ggauccaaacuuccugcaacauuuucuuagaggagagagagaaauauuaaaagagaaaugaa

SEQ ID NO: 427690 - RNA, 62 nt, hsa
auccaaacuuccugcaacauuuucuuagaggagagagagaaauauuaaaagagaaaugaaac

SEQ ID NO: 427691 - RNA, 62 nt, hsa
ggaagucgagacaccaucccagguguguguaagagagagagagagaacagggaggauacaga

SEQ ID NO: 427692 - RNA, 62 nt, hsa
aagucgagacaccaucccagguguguguaagagagagagagagaacagggaggauacagaag

SEQ ID NO: 427693 - RNA, 62 nt, hsa
gucgagacaccaucccagguguguguaagagagagagagagaacagggaggauacagaagua

SEQ ID NO: 427694 - RNA, 62 nt, hsa
cgagacaccaucccagguguguguaagagagagagagagaacagggaggauacagaaguauu

SEQ ID NO: 427695 - RNA, 62 nt, hsa
gcuaagaugcauuuaauaaaaaaaaagagagagagagagaggugugagggacaaaaugcaaa

SEQ ID NO: 427696 - RNA, 62 nt, hsa
uugcuaagaugcauuuaauaaaaaaaaagagagagagagagaggugugagggacaaaaugca

SEQ ID NO: 427697 - RNA, 62 nt, hsa
uuuugcuaagaugcauuuaauaaaaaaaaagagagagagagagaggugugagggacaaaaug

SEQ ID NO: 427698 - RNA, 62 nt, hsa
acuuuugcuaagaugcauuuaauaaaaaaaaagagagagagagagaggugugagggacaaaa

SEQ ID NO: 427699 - RNA, 62 nt, hsa
cuuccuccccuugcuuccagggaagaugaagagagagagauuuggaaggggcucuggcuccc

SEQ ID NO: 427700 - RNA, 62 nt, hsa
uucuuccuccccuugcuuccagggaagaugaagagagagagauuuggaaggggcucuggcuc

SEQ ID NO: 427701 - RNA, 62 nt, hsa
guuuccucagugcccuuuggcuguugaggagugagagagagagagagagagagagagagaga

SEQ ID NO: 427702 - RNA, 62 nt, hsa
uuccucagugcccuuuggcuguugaggagugagagagagagagagagagagagagagagaga

SEQ ID NO: 427703 - RNA, 62 nt, hsa
ccucagugcccuuuggcuguugaggagugagagagagagagagagagagagagagagagaga

SEQ ID NO: 427704 - RNA, 62 nt, hsa
ucagugcccuuuggcuguugaggagugagagagagagagagagagagagagagagagagaga

SEQ ID NO: 427705 - RNA, 62 nt, hsa
agugcccuuuggcuguugaggagugagagagagagagagagagagagagagagagagagaga

SEQ ID NO: 427706 - RNA, 62 nt, hsa
ugcccuuuggcuguugaggagugagagagagagagagagagagagagagagagagagagaga

SEQ ID NO: 427707 - RNA, 62 nt, hsa
cccuuuggcuguugaggagugagagagagagagagagagagagagagagagagagagagaga

SEQ ID NO: 427708 - RNA, 62 nt, hsa
cuuuggcuguugaggagugagagagagagagagagagagagagagagagagagagagagaca

SEQ ID NO: 427709 - RNA, 62 nt, hsa
uuggcuguugaggagugagagagagagagagagagagagagagagagagagagagagacaag

SEQ ID NO: 427710 - RNA, 62 nt, hsa
ggcuguugaggagugagagagagagagagagagagagagagagagagagagagagacaagca

SEQ ID NO: 427711 - RNA, 62 nt, hsa
cuguugaggagugagagagagagagagagagagagagagagagagagagagagacaagcagg

SEQ ID NO: 427712 - RNA, 62 nt, hsa
guugaggagugagagagagagagagagagagagagagagagagagagagagacaagcaggag

SEQ ID NO: 427713 - RNA, 62 nt, hsa
ugaggagugagagagagagagagagagagagagagagagagagagagagacaagcaggagcg

SEQ ID NO: 427714 - RNA, 62 nt, hsa
aggagugagagagagagagagagagagagagagagagagagagagagacaagcaggagcgug

SEQ ID NO: 427715 - RNA, 62 nt, hsa
gagugagagagagagagagagagagagagagagagagagagagagacaagcaggagcguggc

SEQ ID NO: 427716 - RNA, 62 nt, hsa
gugagagagagagagagagagagagagagagagagagagagagacaagcaggagcguggcug

SEQ ID NO: 427717 - RNA, 62 nt, hsa
gagagagagagagagagagagagagagagagagagagagagacaagcaggagcguggcugcu

SEQ ID NO: 427718 - RNA, 62 nt, hsa
gagagagagagagagagagagagagagagagagagagagacaagcaggagcguggcugcucg

SEQ ID NO: 427719 - RNA, 62 nt, hsa
cagucacauucgaauucggguggcauccuccggagagagagagaggaaggagauuccacaca

SEQ ID NO: 427720 - RNA, 62 nt, hsa
gucacauucgaauucggguggcauccuccggagagagagagaggaaggagauuccacacagg

SEQ ID NO: 427721 - RNA, 62 nt, hsa
cacauucgaauucggguggcauccuccggagagagagagaggaaggagauuccacacagggg

SEQ ID NO: 427722 - RNA, 62 nt, hsa
caaccuagaaacguuuucauucgucauuccaagagagagagaggaaagaaaaauacaacuuu

SEQ ID NO: 427723 - RNA, 62 nt, hsa
accuagaaacguuuucauucgucauuccaagagagagagaggaaagaaaaauacaacuuuca

SEQ ID NO: 427724 - RNA, 62 nt, hsa
ucagccuagugggagagagugggggagaggaagagagagagagagcauguauacccguaugu

SEQ ID NO: 427725 - RNA, 62 nt, hsa
agccuagugggagagagugggggagaggaagagagagagagagcauguauacccguauguua

SEQ ID NO: 427726 - RNA, 62 nt, hsa
ccuagugggagagagugggggagaggaagagagagagagagcauguauacccguauguuauc

SEQ ID NO: 427727 - RNA, 62 nt, hsa
agagagugaggagagugugugauagcuagaaagagagagagacagagagauggcaagcacug

SEQ ID NO: 427728 - RNA, 62 nt, hsa
agagugaggagagugugugauagcuagaaagagagagagacagagagauggcaagcacugag

SEQ ID NO: 427729 - RNA, 62 nt, hsa
cauaaaagagccuugauuuuaaaaaaaaaagagagagagauguaauuuaaaaaguuuauuau

SEQ ID NO: 427730 - RNA, 62 nt, hsa
gacauaaaagagccuugauuuuaaaaaaaaaagagagagagauguaauuuaaaaaguuuauu

SEQ ID NO: 427731 - RNA, 62 nt, hsa
uggccuuauuugacuucaaagaauccacaugagagagagacugcauaaauguaauaacugag

SEQ ID NO: 427732 - RNA, 62 nt, hsa
cauggccuuauuugacuucaaagaauccacaugagagagagacugcauaaauguaauaacug

SEQ ID NO: 427733 - RNA, 61 nt, hsa
cuggauaacagcaaaaaaacugaaaauaaagagagagagagaucuggguguuggugguugc

SEQ ID NO: 427734 - RNA, 62 nt, hsa
aucuggauaacagcaaaaaaacugaaaauaaagagagagagagaucuggguguuggugguug

SEQ ID NO: 427735 - RNA, 62 nt, hsa
cagcuccauaucugcauuccacuggggaaagagagagagaaaagagcagauuuuaaaaaaaa

SEQ ID NO: 427736 - RNA, 62 nt, hsa
aucagcuccauaucugcauuccacuggggaaagagagagagaaaagagcagauuuuaaaaaa

SEQ ID NO: 427737 - RNA, 62 nt, hsa
agacaauggagagagaaagagagagagagcgcgagagagaucaagacccaaguuuugaaucu

SEQ ID NO: 427738 - RNA, 62 nt, hsa
caguuuuucuagagacaauggagagagaaagagagagagagcgcgagagagaucaagaccca

SEQ ID NO: 427739 - RNA, 62 nt, hsa
cacaguuuuucuagagacaauggagagagaaagagagagagagcgcgagagagaucaagacc

SEQ ID NO: 427740 - RNA, 62 nt, hsa
cuguccuugccacaguuuuucuagagacaauggagagagaaagagagagagagcgcgagaga

SEQ ID NO: 427741 - RNA, 62 nt, hsa
cuugacauggugggcacacuggcgcccaguaagagagagagagagccaaagcuguccguuuu

SEQ ID NO: 427742 - RNA, 62 nt, hsa
ugacauggugggcacacuggcgcccaguaagagagagagagagccaaagcuguccguuuugc

SEQ ID NO: 427743 - RNA, 62 nt, hsa
acauggugggcacacuggcgcccaguaagagagagagagagccaaagcuguccguuuugcag

SEQ ID NO: 427744 - RNA, 62 nt, hsa
agccaggacacagcucagcuugcucacgcccagagagagaaaaaguuaagcugcugacccug

SEQ ID NO: 427745 - RNA, 62 nt, hsa
uugucccaaagugaguaaaauccccuagagcagagagagagagagagagagagagugucuuc

SEQ ID NO: 427746 - RNA, 62 nt, hsa
gucccaaagugaguaaaauccccuagagcagagagagagagagagagagagagugucuucau

SEQ ID NO: 427747 - RNA, 62 nt, hsa
cccaaagugaguaaaauccccuagagcagagagagagagagagagagagagugucuucaugc

SEQ ID NO: 427748 - RNA, 62 nt, hsa
caaagugaguaaaauccccuagagcagagagagagagagagagagagagugucuucaugcca

SEQ ID NO: 427749 - RNA, 62 nt, hsa
aagugaguaaaauccccuagagcagagagagagagagagagagagagugucuucaugccaac

SEQ ID NO: 427750 - RNA, 62 nt, hsa
gugaguaaaauccccuagagcagagagagagagagagagagagagugucuucaugccaacca

SEQ ID NO: 427751 - RNA, 62 nt, hsa
gaguaaaauccccuagagcagagagagagagagagagagagagugucuucaugccaaccaca

SEQ ID NO: 427752 - RNA, 62 nt, hsa
guaaaauccccuagagcagagagagagagagagagagagagugucuucaugccaaccacagc

SEQ ID NO: 427753 - RNA, 62 nt, hsa
ugccuuugggucgacauaguauggaaguauuugagagagagaaccuuuccacucccacugcc

SEQ ID NO: 427754 - RNA, 62 nt, hsa
ccuuugggucgacauaguauggaaguauuugagagagagaaccuuuccacucccacugccag

SEQ ID NO: 427755 - RNA, 62 nt, hsa
agcaaauguacuuaagucaucauucagagugagagagagaaagcacggcugaggcugaguca

SEQ ID NO: 427756 - RNA, 62 nt, hsa
aaagcaaauguacuuaagucaucauucagagugagagagagaaagcacggcugaggcugagu

SEQ ID NO: 427757 - RNA, 62 nt, hsa
uugcaaaugcuuuagaaaucucugauaauggagagagagacagaggacccuccucacuaccc

SEQ ID NO: 427758 - RNA, 62 nt, hsa
cauugcaaaugcuuuagaaaucucugauaauggagagagagacagaggacccuccucacuac

SEQ ID NO: 427759 - RNA, 62 nt, hsa
acugaggagaaugguagagaggagaggagagagagagagaaugugauuuuuggccuuguggc

SEQ ID NO: 427760 - RNA, 62 nt, hsa
gcacugaggagaaugguagagaggagaggagagagagagagaaugugauuuuuggccuugug

SEQ ID NO: 427761 - RNA, 62 nt, hsa
uggcacugaggagaaugguagagaggagaggagagagagagagaaugugauuuuuggccuug

SEQ ID NO: 427762 - RNA, 62 nt, hsa
ccuggcacugaggagaaugguagagaggagaggagagagagagagaaugugauuuuuggccu

SEQ ID NO: 427763 - RNA, 62 nt, hsa
ugagacuccaucucaaaaaaaaaaaagagagagagagagaaagaaauagaagagaagagcca

SEQ ID NO: 427764 - RNA, 62 nt, hsa
agugagacuccaucucaaaaaaaaaaaagagagagagagagaaagaaauagaagagaagagc

SEQ ID NO: 427765 - RNA, 62 nt, hsa
agagugagacuccaucucaaaaaaaaaaaagagagagagagagaaagaaauagaagagaaga

SEQ ID NO: 427766 - RNA, 62 nt, hsa
acagagugagacuccaucucaaaaaaaaaaaagagagagagagagaaagaaauagaagagaa

SEQ ID NO: 427767 - RNA, 62 nt, hsa
aaagaagagggagggagagagaaagacgaagggagagagaaagcaguuuccaaggauauguu

SEQ ID NO: 427768 - RNA, 62 nt, hsa
guacugaagagaaaugggaaagaagagggagggagagagaaagacgaagggagagagaaagc

SEQ ID NO: 427769 - RNA, 62 nt, hsa
ugugcacugaacucgggauguuggggauuggagagagagaauugccaaaguaacagcaaaaa

SEQ ID NO: 427770 - RNA, 62 nt, hsa
gaugugcacugaacucgggauguuggggauuggagagagagaauugccaaaguaacagcaaa

SEQ ID NO: 427771 - RNA, 62 nt, hsa
agcugugaucaugccacugcauuccagccugggagagagagaggaccugucuguugaaaaaa

SEQ ID NO: 427772 - RNA, 62 nt, hsa
cugugaucaugccacugcauuccagccugggagagagagaggaccugucuguugaaaaaaac

SEQ ID NO: 427773 - RNA, 62 nt, hsa
ugugggcucagagcucaggagucgccuuaccugagagagauguucuagcugagagggccugg

SEQ ID NO: 427774 - RNA, 62 nt, hsa
gugucccuguccccagagggaggagcaggcaggagagagaggggaaggagguaugaauccca

SEQ ID NO: 427775 - RNA, 62 nt, hsa
uguugacuuaagugagggggaaauaaaacccagagagagagagagagcgagagagagagaca

SEQ ID NO: 427776 - RNA, 62 nt, hsa
uugacuuaagugagggggaaauaaaacccagagagagagagagagcgagagagagagacaug

SEQ ID NO: 427777 - RNA, 62 nt, hsa
gacuuaagugagggggaaauaaaacccagagagagagagagagcgagagagagagacauguu

SEQ ID NO: 427778 - RNA, 62 nt, hsa
cuuaagugagggggaaauaaaacccagagagagagagagagcgagagagagagacauguuac

SEQ ID NO: 427779 - RNA, 62 nt, hsa
ggggaaauaaaacccagagagagagagagagcgagagagagagacauguuacuaugaaagac

SEQ ID NO: 427780 - RNA, 62 nt, hsa
ggaaauaaaacccagagagagagagagagcgagagagagagacauguuacuaugaaagacuu

SEQ ID NO: 427781 - RNA, 62 nt, hsa
aaauaaaacccagagagagagagagagcgagagagagagacauguuacuaugaaagacuugu

SEQ ID NO: 427782 - RNA, 62 nt, hsa
cccagcaguggagugccgggacccucagaguggagagagagacccgggaugugugugcugua

SEQ ID NO: 427783 - RNA, 62 nt, hsa
cagcaguggagugccgggacccucagaguggagagagagacccgggaugugugugcuguacc

SEQ ID NO: 427784 - RNA, 62 nt, hsa
cgcccucgcggcgggcgcccccagggccaggagagagagacagggcuggcuccucucgcccc

SEQ ID NO: 427785 - RNA, 62 nt, hsa
cccgcccucgcggcgggcgcccccagggccaggagagagagacagggcuggcuccucucgcc

SEQ ID NO: 427786 - RNA, 62 nt, hsa
ggaaccaggacacaaaagcagcaagaagcggggagagagagggauagaaaacaagcgcagga

SEQ ID NO: 427787 - RNA, 62 nt, hsa
uucacucauccugagacuuucuuuuugcaguggagagagagaauaaucuaguuggggcaaac

SEQ ID NO: 427788 - RNA, 62 nt, hsa
cacucauccugagacuuucuuuuugcaguggagagagagaauaaucuaguuggggcaaacac

SEQ ID NO: 427789 - RNA, 62 nt, hsa
uuugggagcugugugugucugugugugugugagagagagaucuugucugcgugugugugugu

SEQ ID NO: 427790 - RNA, 62 nt, hsa
aguuugggagcugugugugucugugugugugugagagagagaucuugucugcgugugugugu

SEQ ID NO: 427791 - RNA, 62 nt, hsa
gucccgacauuuuuuuucuguuucuauucugagagagagaugaucaaguuuuaauuugggua

SEQ ID NO: 427792 - RNA, 62 nt, hsa
uugucccgacauuuuuuuucuguuucuauucugagagagagaugaucaaguuuuaauuuggg

SEQ ID NO: 427793 - RNA, 62 nt, hsa
gcagugagccaagaucgcaccaccgcaugagagagagagauuacuauuucuugucccuuuuu

SEQ ID NO: 427794 - RNA, 62 nt, hsa
uugcagugagccaagaucgcaccaccgcaugagagagagagauuacuauuucuugucccuuu

SEQ ID NO: 427795 - RNA, 62 nt, hsa
gguugcagugagccaagaucgcaccaccgcaugagagagagagauuacuauuucuugucccu

SEQ ID NO: 427796 - RNA, 62 nt, hsa
guguguguguguguguguguguguaugagagagagagagacuuugacgguuguagauauuuu

SEQ ID NO: 427797 - RNA, 62 nt, hsa
guguguguguguguguguguguguguaugagagagagagagacuuugacgguuguagauauu

SEQ ID NO: 427798 - RNA, 62 nt, hsa
guguguguguguguguguguguguguguaugagagagagagagacuuugacgguuguagaua

SEQ ID NO: 427799 - RNA, 62 nt, hsa
guguguguguguguguguguguguguguguaugagagagagagagacuuugacgguuguaga

SEQ ID NO: 427800 - RNA, 62 nt, hsa
ggcagcgccuuugucugucuaucuggugacaagagagagacaaguaaaugggggccguuggg

SEQ ID NO: 427801 - RNA, 62 nt, hsa
agacuccaucucaaaaaauaaauaaauagaaagagagagagaggaaaaaaaaagaaaagaac

SEQ ID NO: 427802 - RNA, 62 nt, hsa
acuccaucucaaaaaauaaauaaauagaaagagagagagaggaaaaaaaaagaaaagaacac

SEQ ID NO: 427803 - RNA, 62 nt, hsa
cccuaucuccugcaaccucagugccucagccugagagagagaugagaugcucuuggacuccc

SEQ ID NO: 427804 - RNA, 62 nt, hsa
cuaucuccugcaaccucagugccucagccugagagagagaugagaugcucuuggacucccca

SEQ ID NO: 427805 - RNA, 62 nt, hsa
gagagacacagagagaaggagaaagagggagggagagagagaaagagagagaaagagagaga

SEQ ID NO: 427806 - RNA, 62 nt, hsa
gagacacagagagaaggagaaagagggagggagagagagaaagagagagaaagagagagaga

SEQ ID NO: 427807 - RNA, 62 nt, hsa
gagaaggagaaagagggagggagagagagaaagagagagaaagagagagagagagagagaga

SEQ ID NO: 427808 - RNA, 62 nt, hsa
aagagggagggagagagagaaagagagagaaagagagagagagagagagagagagaaagcug

SEQ ID NO: 427809 - RNA, 62 nt, hsa
gagggagggagagagagaaagagagagaaagagagagagagagagagagagagaaagcugaa

SEQ ID NO: 427810 - RNA, 62 nt, hsa
gggagggagagagagaaagagagagaaagagagagagagagagagagagagaaagcugaacg

SEQ ID NO: 427811 - RNA, 62 nt, hsa
gagggagagagagaaagagagagaaagagagagagagagagagagagagaaagcugaacgug

SEQ ID NO: 427812 - RNA, 62 nt, hsa
gggagagagagaaagagagagaaagagagagagagagagagagagagaaagcugaacgugca

SEQ ID NO: 427813 - RNA, 62 nt, hsa
gagagagagaaagagagagaaagagagagagagagagagagagagaaagcugaacgugcacu

SEQ ID NO: 427814 - RNA, 62 nt, hsa
gagagagaaagagagagaaagagagagagagagagagagagagaaagcugaacgugcacucu

SEQ ID NO: 427815 - RNA, 62 nt, hsa
gagagaaagagagagaaagagagagagagagagagagagagaaagcugaacgugcacucuga

SEQ ID NO: 427816 - RNA, 62 nt, hsa
gagaaagagagagaaagagagagagagagagagagagagaaagcugaacgugcacucugaca

SEQ ID NO: 427817 - RNA, 62 nt, hsa
gccaggggcugguagacaagaacugugaaagagagagagaaaaaaccucaacuguguauuuu

SEQ ID NO: 427818 - RNA, 62 nt, hsa
cugccaggggcugguagacaagaacugugaaagagagagagaaaaaaccucaacuguguauu

SEQ ID NO: 427819 - RNA, 62 nt, hsa
gagcagccaggcgcucuggagccagcuggagagagagagauccugauaccucuguggggacu

SEQ ID NO: 427820 - RNA, 62 nt, hsa
uggagcagccaggcgcucuggagccagcuggagagagagagauccugauaccucugugggga

SEQ ID NO: 427821 - RNA, 62 nt, hsa
ucuggagcagccaggcgcucuggagccagcuggagagagagagauccugauaccucuguggg

SEQ ID NO: 427822 - RNA, 62 nt, hsa
agaaaugcaacuuguauaaaacaaaaaugggagagagagagguauuaaacaaauaccccccu

SEQ ID NO: 427823 - RNA, 62 nt, hsa
cuagaaaugcaacuuguauaaaacaaaaaugggagagagagagguauuaaacaaauaccccc

SEQ ID NO: 427824 - RNA, 62 nt, hsa
gugugugugugugugagagagagagagagagagagagagaccagcaucuucaagagaaguau

SEQ ID NO: 427825 - RNA, 62 nt, hsa
gugugugugugugugugagagagagagagagagagagagagaccagcaucuucaagagaagu

SEQ ID NO: 427826 - RNA, 62 nt, hsa
gugugugugugugugugugagagagagagagagagagagagagaccagcaucuucaagagaa

SEQ ID NO: 427827 - RNA, 62 nt, hsa
uugugugugugugugugugugagagagagagagagagagagagagaccagcaucuucaagag

SEQ ID NO: 427828 - RNA, 62 nt, hsa
guuugugugugugugugugugugagagagagagagagagagagagagaccagcaucuucaag

SEQ ID NO: 427829 - RNA, 62 nt, hsa
guguuugugugugugugugugugugagagagagagagagagagagagagaccagcaucuuca

SEQ ID NO: 427830 - RNA, 62 nt, hsa
guguguuugugugugugugugugugugagagagagagagagagagagagagaccagcaucuu

SEQ ID NO: 427831 - RNA, 62 nt, hsa
guguguguuugugugugugugugugugugagagagagagagagagagagagagaccagcauc

SEQ ID NO: 427832 - RNA, 62 nt, hsa
guguguguguuugugugugugugugugugugagagagagagagagagagagagagaccagca

SEQ ID NO: 427833 - RNA, 62 nt, hsa
guguguguguguuugugugugugugugugugugagagagagagagagagagagagagaccag

SEQ ID NO: 427834 - RNA, 62 nt, hsa
gaguauuuucaggauuuguuucuaugagacgagagagagaagccuccgcuccuuaaugugaa

SEQ ID NO: 427835 - RNA, 62 nt, hsa
augaguauuuucaggauuuguuucuaugagacgagagagagaagccuccgcuccuuaaugug

SEQ ID NO: 427836 - RNA, 62 nt, hsa
ccuuuuucaacaaaggaguguguucagaaaaggagagagaggcugagaucauucaggaguuu

SEQ ID NO: 427837 - RNA, 62 nt, hsa
ugagagaacucagcaagccaaccugggaaucagagagagaaggagaaggaggggagccuguc

SEQ ID NO: 427838 - RNA, 62 nt, hsa
uuucauauuucuaaaaggggccaaugcaaaaggagagagaaggacuggauuuaagccaguuu

SEQ ID NO: 427839 - RNA, 62 nt, hsa
ccgaacuaauuuuuuuaaggauacugaaaaaugagagagaguggucgaaugccugaaauuuu

SEQ ID NO: 427840 - RNA, 62 nt, hsa
ggagucuuuguugcuauauuuuguggggcugggagagagagauuagauuauuuugacauggg

SEQ ID NO: 427841 - RNA, 62 nt, hsa
agucuuuguugcuauauuuuguggggcugggagagagagauuagauuauuuugacaugggau

SEQ ID NO: 427842 - RNA, 62 nt, hsa
agaaaaagauuacccaaaaacugucuuuaaaagagagagagagaaaaaaaaaauaguauuug

SEQ ID NO: 427843 - RNA, 62 nt, hsa
aaaaagauuacccaaaaacugucuuuaaaagagagagagagaaaaaaaaaauaguauuugca

SEQ ID NO: 427844 - RNA, 62 nt, hsa
aaagauuacccaaaaacugucuuuaaaagagagagagagaaaaaaaaaauaguauuugcaua

SEQ ID NO: 427845 - RNA, 62 nt, hsa
caucgccuuuuccuuccaucaguugaguggcugagagagaagugccucaucccugagccaca

SEQ ID NO: 427846 - RNA, 62 nt, hsa
ugggacaaaaccgguugaccagaaaaugggcagagagagaugaccucggaagcauuuccaca

SEQ ID NO: 427847 - RNA, 62 nt, hsa
aaucucauggaugguucucaaagguaaaaaaagagagagaaagagagagagcuagcuguggg

SEQ ID NO: 427848 - RNA, 62 nt, hsa
augguucucaaagguaaaaaaagagagagaaagagagagagcuagcugugggauucugugua

SEQ ID NO: 427849 - RNA, 62 nt, hsa
ucccuguuuccugggcuagucuuggaccccacgagagagaaucguuccucagccucauggug

SEQ ID NO: 427850 - RNA, 62 nt, hsa
gcaucuccguaaaugugcucugcuccucagcugagagagaaaaaaauaaacuguauuuggcu

SEQ ID NO: 427851 - RNA, 62 nt, hsa
uaacuggaaaagauguuaacaguaaagauggagagagagagugugugcguguguguguauau

SEQ ID NO: 427852 - RNA, 62 nt, hsa
auuaacuggaaaagauguuaacaguaaagauggagagagagagugugugcguguguguguau

SEQ ID NO: 427853 - RNA, 62 nt, hsa
gugcagaauucuuuugguucuuugguuccagagagagagaagaugcuugugccagguggcac

SEQ ID NO: 427854 - RNA, 62 nt, hsa
aagugcagaauucuuuugguucuuugguuccagagagagagaagaugcuugugccagguggc

SEQ ID NO: 427855 - RNA, 62 nt, hsa
ccuuaucucaaaaaaaaaaaaaaaaagagagagagagagaaaaagaaaugcuguguuuaauc

SEQ ID NO: 427856 - RNA, 62 nt, hsa
gaccuuaucucaaaaaaaaaaaaaaaaagagagagagagagaaaaagaaaugcuguguuuaa

SEQ ID NO: 427857 - RNA, 62 nt, hsa
gagaccuuaucucaaaaaaaaaaaaaaaaagagagagagagagaaaaagaaaugcuguguuu

SEQ ID NO: 427858 - RNA, 62 nt, hsa
gugagaccuuaucucaaaaaaaaaaaaaaaaagagagagagagagaaaaagaaaugcugugu

SEQ ID NO: 427859 - RNA, 62 nt, hsa
uguguguguguguguacucuguguguguaugagagagagaaaugcuaaccuuguagcaugug

SEQ ID NO: 427860 - RNA, 62 nt, hsa
uguguguguguguguguacucuguguguguaugagagagagaaaugcuaaccuuguagcaug

SEQ ID NO: 427861 - RNA, 62 nt, hsa
uuguauggcugagcaagagagagagagaaugagagagagacugugugugugugugugugugu

SEQ ID NO: 427862 - RNA, 62 nt, hsa
uguuguauggcugagcaagagagagagagaaugagagagagacugugugugugugugugugu

SEQ ID NO: 427863 - RNA, 62 nt, hsa
ccuggagggguguuguauggcugagcaagagagagagagaaugagagagagacugugugugu

SEQ ID NO: 427864 - RNA, 62 nt, hsa
auccuggagggguguuguauggcugagcaagagagagagagaaugagagagagacugugugu

SEQ ID NO: 427865 - RNA, 62 nt, hsa
ucauccuggagggguguuguauggcugagcaagagagagagagaaugagagagagacugugu

SEQ ID NO: 427866 - RNA, 62 nt, hsa
ccaagaaaaauuuccaaaacuauugagagagagagagagaaaguauugaaauuuuguucugc

SEQ ID NO: 427867 - RNA, 62 nt, hsa
uaccaagaaaaauuuccaaaacuauugagagagagagagagaaaguauugaaauuuuguucu

SEQ ID NO: 427868 - RNA, 62 nt, hsa
gguaccaagaaaaauuuccaaaacuauugagagagagagagagaaaguauugaaauuuuguu

SEQ ID NO: 427869 - RNA, 62 nt, hsa
uugguaccaagaaaaauuuccaaaacuauugagagagagagagagaaaguauugaaauuuug

SEQ ID NO: 427870 - RNA, 62 nt, hsa
uauugguaccaagaaaaauuuccaaaacuauugagagagagagagagaaaguauugaaauuu

SEQ ID NO: 427871 - RNA, 62 nt, hsa
auuuugaaucuaucuuaaaauacugagguguggagagagagacaggaucaggagcgauagag

SEQ ID NO: 427872 - RNA, 62 nt, hsa
uuugaaucuaucuuaaaauacugagguguggagagagagacaggaucaggagcgauagagag

SEQ ID NO: 427873 - RNA, 62 nt, hsa
uaguguguguguguguguguguguguguguaugagagagagagagagagacaacagagacag

SEQ ID NO: 427874 - RNA, 62 nt, hsa
guguguguguguguguguguguguguguaugagagagagagagagagacaacagagacagag

SEQ ID NO: 427875 - RNA, 62 nt, hsa
guguguguguguguguguguguguguaugagagagagagagagagacaacagagacagagag

SEQ ID NO: 427876 - RNA, 62 nt, hsa
guguguguguguguguguguguguaugagagagagagagagagacaacagagacagagagag

SEQ ID NO: 427877 - RNA, 62 nt, hsa
guguguguguguguguguguguaugagagagagagagagagacaacagagacagagagaggc

SEQ ID NO: 427878 - RNA, 62 nt, hsa
guguguguguguguguguguaugagagagagagagagagacaacagagacagagagaggcag

SEQ ID NO: 427879 - RNA, 62 nt, hsa
gacagagagaggcagagaggcauagagagacagagagagagacaagaaacagagauagacag

SEQ ID NO: 427880 - RNA, 62 nt, hsa
cagagagaggcagagaggcauagagagacagagagagagacaagaaacagagauagacagaa

SEQ ID NO: 427881 - RNA, 62 nt, hsa
ucugucucagaaaaaaaaaaaaaaaagagagagagagagaaagagaacaauauuugggagag

SEQ ID NO: 427882 - RNA, 62 nt, hsa
acucugucucagaaaaaaaaaaaaaaaagagagagagagagaaagagaacaauauuugggag

SEQ ID NO: 427883 - RNA, 62 nt, hsa
agacucugucucagaaaaaaaaaaaaaaaagagagagagagagaaagagaacaauauuuggg

SEQ ID NO: 427884 - RNA, 62 nt, hsa
caagacucugucucagaaaaaaaaaaaaaaaagagagagagagagaaagagaacaauauuug

SEQ ID NO: 427885 - RNA, 62 nt, hsa
aggugcuguucucaggugaaaagagagagagagagagagacauaagaaauuuagagaaaaau

SEQ ID NO: 427886 - RNA, 62 nt, hsa
guaggugcuguucucaggugaaaagagagagagagagagagacauaagaaauuuagagaaaa

SEQ ID NO: 427887 - RNA, 62 nt, hsa
cuguaggugcuguucucaggugaaaagagagagagagagagagacauaagaaauuuagagaa

SEQ ID NO: 427888 - RNA, 62 nt, hsa
aacuguaggugcuguucucaggugaaaagagagagagagagagagacauaagaaauuuagag

SEQ ID NO: 427889 - RNA, 62 nt, hsa
gaaacuguaggugcuguucucaggugaaaagagagagagagagagagacauaagaaauuuag

SEQ ID NO: 427890 - RNA, 62 nt, hsa
uggaaacuguaggugcuguucucaggugaaaagagagagagagagagagacauaagaaauuu

SEQ ID NO: 427891 - RNA, 62 nt, hsa
uguugaccaugauaaugcaaauaacagaaggagagagagaaugaacccuuucuggguguuuc

SEQ ID NO: 427892 - RNA, 62 nt, hsa
uuuguugaccaugauaaugcaaauaacagaaggagagagagaaugaacccuuucuggguguu

SEQ ID NO: 427893 - RNA, 62 nt, hsa
gagaggaggcugaauuucucaagccauuaggagagagagaaauugggagugguccccaaaga

SEQ ID NO: 427894 - RNA, 62 nt, hsa
ccgagaggaggcugaauuucucaagccauuaggagagagagaaauugggagugguccccaaa

SEQ ID NO: 427895 - RNA, 62 nt, hsa
aaagagagagagagaggagaaagagagagaaggagagagacaguagccaagagaaccccacg

SEQ ID NO: 427896 - RNA, 62 nt, hsa
uuuccuagagaaagagagagagagaggagaaagagagagaaggagagagacaguagccaaga

SEQ ID NO: 427897 - RNA, 62 nt, hsa
gcuucacaacagacauuuccuagagaaagagagagagagaggagaaagagagagaaggagag

SEQ ID NO: 427898 - RNA, 62 nt, hsa
cugcuucacaacagacauuuccuagagaaagagagagagagaggagaaagagagagaaggag

SEQ ID NO: 427899 - RNA, 62 nt, hsa
gccugcuucacaacagacauuuccuagagaaagagagagagagaggagaaagagagagaagg

SEQ ID NO: 427900 - RNA, 62 nt, hsa
ggccacuugcuugauuuaucaugagagaagaggagagagagagagacugagcgcuaggagug

SEQ ID NO: 427901 - RNA, 62 nt, hsa
ccacuugcuugauuuaucaugagagaagaggagagagagagagacugagcgcuaggagugug

SEQ ID NO: 427902 - RNA, 62 nt, hsa
acuugcuugauuuaucaugagagaagaggagagagagagagacugagcgcuaggagugugug

SEQ ID NO: 427903 - RNA, 62 nt, hsa
uugcuugauuuaucaugagagaagaggagagagagagagacugagcgcuaggagugugugua

SEQ ID NO: 427904 - RNA, 62 nt, hsa
gagagguggggagggagacagagacagaaacagagagagacagagacagagagagacugagg

SEQ ID NO: 427905 - RNA, 62 nt, hsa
gacagagacagaaacagagagagacagagacagagagagacugagggagagacucugaggac

SEQ ID NO: 427906 - RNA, 62 nt, hsa
agagagacugagggagagacucugaggacauggagagagacucaaagagacuccaagauuca

SEQ ID NO: 427907 - RNA, 62 nt, hsa
ccaagagagcgggagggagggaaggagggagggagagagauagagagagagagagagagaga

SEQ ID NO: 427908 - RNA, 62 nt, hsa
gggagggagggaaggagggagggagagagauagagagagagagagagagagaggaugugugg

SEQ ID NO: 427909 - RNA, 62 nt, hsa
gagggagggaaggagggagggagagagauagagagagagagagagagagaggaugugugggc

SEQ ID NO: 427910 - RNA, 62 nt, hsa
gggagggaaggagggagggagagagauagagagagagagagagagagaggaugugugggccc

SEQ ID NO: 427911 - RNA, 62 nt, hsa
gagggaaggagggagggagagagauagagagagagagagagagagaggaugugugggcccua

SEQ ID NO: 427912 - RNA, 62 nt, hsa
gggaaggagggagggagagagauagagagagagagagagagagaggaugugugggcccuaag

SEQ ID NO: 427913 - RNA, 62 nt, hsa
gaaggagggagggagagagauagagagagagagagagagagaggaugugugggcccuaaggc

SEQ ID NO: 427914 - RNA, 62 nt, hsa
gagggagagagauagagagagagagagagagagagagagaggaugugugggcccuaaggcug

SEQ ID NO: 427915 - RNA, 62 nt, hsa
caagaucgcaccacuugcacugcagccugagagagagagagccagaccuugucucaaaaaau

SEQ ID NO: 427916 - RNA, 62 nt, hsa
gucaagaucgcaccacuugcacugcagccugagagagagagagccagaccuugucucaaaaa

SEQ ID NO: 427917 - RNA, 62 nt, hsa
gggucaagaucgcaccacuugcacugcagccugagagagagagagccagaccuugucucaaa

SEQ ID NO: 427918 - RNA, 62 nt, hsa
gugugugugugugugugugugagagagagagagagagagaugggugguggugagaaguguug

SEQ ID NO: 427919 - RNA, 62 nt, hsa
gugugugugugugugugugugugagagagagagagagagagaugggugguggugagaagugu

SEQ ID NO: 427920 - RNA, 62 nt, hsa
gugugugugugugugugugugugugagagagagagagagagagaugggugguggugagaagu

SEQ ID NO: 427921 - RNA, 62 nt, hsa
gugugugugugugugugugugugugugagagagagagagagagagaugggugguggugagaa

SEQ ID NO: 427922 - RNA, 62 nt, hsa
gugugugugugugugugugugugugugugagagagagagagagagagaugggugguggugag

SEQ ID NO: 427923 - RNA, 62 nt, hsa
aagugugugugugugugugugugugugugugagagagagagagagagagaugggugguggug

SEQ ID NO: 427924 - RNA, 62 nt, hsa
ggaagugugugugugugugugugugugugugugagagagagagagagagagauggguggugg

SEQ ID NO: 427925 - RNA, 62 nt, hsa
acacacacacacacacacacacacgaaggagagagagagaaaacugauggggaaaacaagcu

SEQ ID NO: 427926 - RNA, 62 nt, hsa
acacacacacacacacacacacacacgaaggagagagagagaaaacugauggggaaaacaag

SEQ ID NO: 427927 - RNA, 62 nt, hsa
acacacacacacacacacacacacacacgaaggagagagagagaaaacugauggggaaaaca

SEQ ID NO: 427928 - RNA, 62 nt, hsa
ucccuggccuuuccuuuuguaauaagaaagaagagagagaacuugaugcaaaguccacgaaa

SEQ ID NO: 427929 - RNA, 62 nt, hsa
cucucugaccucccugcuugcauugggucugggagagagaguggaauauuugguagggaccu

SEQ ID NO: 427930 - RNA, 62 nt, hsa
cugucauuccccacacacguccuguucaccucgagagagagagagagagagcaccuuucuuc

SEQ ID NO: 427931 - RNA, 62 nt, hsa
gucauuccccacacacguccuguucaccucgagagagagagagagagagcaccuuucuuccg

SEQ ID NO: 427932 - RNA, 62 nt, hsa
cauuccccacacacguccuguucaccucgagagagagagagagagagcaccuuucuuccguc

SEQ ID NO: 427933 - RNA, 62 nt, hsa
uuccccacacacguccuguucaccucgagagagagagagagagagcaccuuucuuccgucug

SEQ ID NO: 427934 - RNA, 62 nt, hsa
ccccacacacguccuguucaccucgagagagagagagagagagcaccuuucuuccgucuguu

SEQ ID NO: 427935 - RNA, 62 nt, hsa
ccacacacguccuguucaccucgagagagagagagagagagcaccuuucuuccgucuguuca

SEQ ID NO: 427936 - RNA, 62 nt, hsa
agauuuuaaguguugaggagcagaggugagaagagagagagagagagaaagucaaauaaagu

SEQ ID NO: 427937 - RNA, 62 nt, hsa
auuuuaaguguugaggagcagaggugagaagagagagagagagagaaagucaaauaaaguca

SEQ ID NO: 427938 - RNA, 62 nt, hsa
uuuaaguguugaggagcagaggugagaagagagagagagagagaaagucaaauaaagucaaa

SEQ ID NO: 427939 - RNA, 62 nt, hsa
uaaguguugaggagcagaggugagaagagagagagagagagaaagucaaauaaagucaaaga

SEQ ID NO: 427940 - RNA, 62 nt, hsa
aguguugaggagcagaggugagaagagagagagagagagaaagucaaauaaagucaaagacc

SEQ ID NO: 427941 - RNA, 62 nt, hsa
cccacccaagacauuuuaauaguaaauagagagagagagaagaguuaaugaacaugagguag

SEQ ID NO: 427942 - RNA, 62 nt, hsa
cccccacccaagacauuuuaauaguaaauagagagagagagaagaguuaaugaacaugaggu

SEQ ID NO: 427943 - RNA, 62 nt, hsa
cacccccacccaagacauuuuaauaguaaauagagagagagagaagaguuaaugaacaugag

SEQ ID NO: 427944 - RNA, 62 nt, hsa
gcgccuagaaauugaaaggcaaaaacuagagagagagagaauggaacgcgaacgcuuggaaa

SEQ ID NO: 427945 - RNA, 62 nt, hsa
gagcgccuagaaauugaaaggcaaaaacuagagagagagagaauggaacgcgaacgcuugga

SEQ ID NO: 427946 - RNA, 62 nt, hsa
gagagcgccuagaaauugaaaggcaaaaacuagagagagagagaauggaacgcgaacgcuug

SEQ ID NO: 427947 - RNA, 62 nt, hsa
gugaacgggaagaacgggaacgcuuacagagagagagagagcgccuagaaauugaaaggcaa

SEQ ID NO: 427948 - RNA, 62 nt, hsa
ucgugaacgggaagaacgggaacgcuuacagagagagagagagcgccuagaaauugaaaggc

SEQ ID NO: 427949 - RNA, 62 nt, hsa
auucgugaacgggaagaacgggaacgcuuacagagagagagagagcgccuagaaauugaaag

SEQ ID NO: 427950 - RNA, 62 nt, hsa
uacugauuuuugguagacgaagagagauugcagagagagagcgucgagagcgagaacgcauu

SEQ ID NO: 427951 - RNA, 62 nt, hsa
aacagauggagauccuuucagggagagagagagagagagaggagaagacagagagauuaaag

SEQ ID NO: 427952 - RNA, 62 nt, hsa
gcaacagauggagauccuuucagggagagagagagagagagaggagaagacagagagauuaa

SEQ ID NO: 427953 - RNA, 62 nt, hsa
gugcaacagauggagauccuuucagggagagagagagagagagaggagaagacagagagauu

SEQ ID NO: 427954 - RNA, 62 nt, hsa
uggugcaacagauggagauccuuucagggagagagagagagagagaggagaagacagagaga

SEQ ID NO: 427955 - RNA, 62 nt, hsa
ccuggugcaacagauggagauccuuucagggagagagagagagagagaggagaagacagaga

SEQ ID NO: 427956 - RNA, 62 nt, hsa
guccuggugcaacagauggagauccuuucagggagagagagagagagagaggagaagacaga

SEQ ID NO: 427957 - RNA, 62 nt, hsa
cugcauuuccugcugggguccugguuccucaggagagagagaccacagggugagagugagcc

SEQ ID NO: 427958 - RNA, 62 nt, hsa
gcauuuccugcugggguccugguuccucaggagagagagaccacagggugagagugagccag

SEQ ID NO: 427959 - RNA, 62 nt, hsa
aacauggccuuggcaguuauuuuuccaucaccgagagagagagacagagagagaaaauaaac

SEQ ID NO: 427960 - RNA, 62 nt, hsa
cauggccuuggcaguuauuuuuccaucaccgagagagagagacagagagagaaaauaaacua

SEQ ID NO: 427961 - RNA, 62 nt, hsa
uggccuuggcaguuauuuuuccaucaccgagagagagagacagagagagaaaauaaacuacc

SEQ ID NO: 427962 - RNA, 62 nt, hsa
aguuauuuuuccaucaccgagagagagagacagagagagaaaauaaacuaccccuccuauuc

SEQ ID NO: 427963 - RNA, 62 nt, hsa
gagaaagagagugagagagagagagaaagagagagagagaugcuguugaaucagaaacagau

SEQ ID NO: 427964 - RNA, 62 nt, hsa
gagagaaagagagugagagagagagagaaagagagagagagaugcuguugaaucagaaacag

SEQ ID NO: 427965 - RNA, 62 nt, hsa
gagagagaaagagagugagagagagagagaaagagagagagagaugcuguugaaucagaaac

SEQ ID NO: 427966 - RNA, 62 nt, hsa
cagagagugagagagagaaagagagugagagagagagagaaagagagagagagaugcuguug

SEQ ID NO: 427967 - RNA, 62 nt, hsa
gccagagagugagagagagaaagagagugagagagagagagaaagagagagagagaugcugu

SEQ ID NO: 427968 - RNA, 62 nt, hsa
gagccagagagugagagagagaaagagagugagagagagagagaaagagagagagagaugcu

SEQ ID NO: 427969 - RNA, 62 nt, hsa
gagagccagagagugagagagagaaagagagugagagagagagagaaagagagagagagaug

SEQ ID NO: 427970 - RNA, 62 nt, hsa
gaguaaccaguuuccagagagccagagagugagagagagaaagagagugagagagagagaga

SEQ ID NO: 427971 - RNA, 62 nt, hsa
gagaguaaccaguuuccagagagccagagagugagagagagaaagagagugagagagagaga

SEQ ID NO: 427972 - RNA, 62 nt, hsa
ccugaggccgcugguagacuuuuguuaaaagagagagagacagagacagagaaauaagcauu

SEQ ID NO: 427973 - RNA, 62 nt, hsa
agccugaggccgcugguagacuuuuguuaaaagagagagagacagagacagagaaauaagca

SEQ ID NO: 427974 - RNA, 62 nt, hsa
cacuuuacaaaggaaauuugaauaaauggagagagagagaagccuuguuguuggauaggaaa

SEQ ID NO: 427975 - RNA, 62 nt, hsa
gccacuuuacaaaggaaauuugaauaaauggagagagagagaagccuuguuguuggauagga

SEQ ID NO: 427976 - RNA, 62 nt, hsa
gggccacuuuacaaaggaaauuugaauaaauggagagagagagaagccuuguuguuggauag

SEQ ID NO: 427977 - RNA, 62 nt, hsa
cagaagugcuggggcagggaggcccaggagaugagagagaagguccgaguaggugauagaag

SEQ ID NO: 427978 - RNA, 62 nt, hsa
gcacggaguugccaggagcaaaccaaagugaagagagagauaggaagcugccucggggccac

SEQ ID NO: 427979 - RNA, 62 nt, hsa
ugaaaggucuaaaugcccacuugaaugaagcugagagagagaucuagcaaaagcuaaaacuc

SEQ ID NO: 427980 - RNA, 62 nt, hsa
aaaggucuaaaugcccacuugaaugaagcugagagagagaucuagcaaaagcuaaaacucau

SEQ ID NO: 427981 - RNA, 62 nt, hsa
ucacuccggagugagaagcuuugcccuccuaagagagagagacagagagacagagagagaga

SEQ ID NO: 427982 - RNA, 62 nt, hsa
acuccggagugagaagcuuugcccuccuaagagagagagacagagagacagagagagagaaa

SEQ ID NO: 427983 - RNA, 62 nt, hsa
uugcccuccuaagagagagagacagagagacagagagagagaaagagagagugugugggucu

SEQ ID NO: 427984 - RNA, 62 nt, hsa
gcccuccuaagagagagagacagagagacagagagagagaaagagagagugugugggucuau

SEQ ID NO: 427985 - RNA, 62 nt, hsa
uaauuuaucucugugaccugccagggagaggggagagagagagagaugcuguugagcacaug

SEQ ID NO: 427986 - RNA, 62 nt, hsa
auuuaucucugugaccugccagggagaggggagagagagagagaugcuguugagcacaugac

SEQ ID NO: 427987 - RNA, 62 nt, hsa
uuaucucugugaccugccagggagaggggagagagagagagaugcuguugagcacaugacaa

SEQ ID NO: 427988 - RNA, 62 nt, hsa
aucucugugaccugccagggagaggggagagagagagagaugcuguugagcacaugacaaaa

SEQ ID NO: 427989 - RNA, 62 nt, hsa
ccugggagcuauuuacaaauguccaugugggagagagagagcaugagagcacaguagcccag

SEQ ID NO: 427990 - RNA, 62 nt, hsa
caccugggagcuauuuacaaauguccaugugggagagagagagcaugagagcacaguagccc

SEQ ID NO: 427991 - RNA, 62 nt, hsa
gaggcagagagacagagagggagagagggacagagagagauagagcaggaggucggggcacu

SEQ ID NO: 427992 - RNA, 62 nt, hsa
aggagacagagagggagagagagacagagggagagagagacagaggggaagagaggcagaga

SEQ ID NO: 427993 - RNA, 62 nt, hsa
agaggagacagagagggagagagagacagagggagagagagacagaggggaagagaggcaga

SEQ ID NO: 427994 - RNA, 62 nt, hsa
agagggagagaaacagaggagacagagagggagagagagacagagggagagagagacagagg

SEQ ID NO: 427995 - RNA, 62 nt, hsa
agagagggagagaaacagaggagacagagagggagagagagacagagggagagagagacaga

SEQ ID NO: 427996 - RNA, 62 nt, hsa
agagguggggagaggggagagagauaugaggagagagagacagaggaggcagagagggagag

SEQ ID NO: 427997 - RNA, 62 nt, hsa
agagagguggggagaggggagagagauaugaggagagagagacagaggaggcagagagggag

SEQ ID NO: 427998 - RNA, 62 nt, hsa
gaggggagagagaaagagagguggggagaggggagagagauaugaggagagagagacagagg

SEQ ID NO: 427999 - RNA, 62 nt, hsa
gaaaggaggagggagagagauggagaggaggggagagagaaagagagguggggagaggggag

SEQ ID NO: 428000 - RNA, 62 nt, hsa
auaaaugggggucagggagggaaaggaggagggagagagauggagaggaggggagagagaaa

SEQ ID NO: 428001 - RNA, 62 nt, hsa
gugccugauuggaaaaaaaaaaaaaagagagagagagagaagaagaagaagaagagacacaa

SEQ ID NO: 428002 - RNA, 62 nt, hsa
gagugccugauuggaaaaaaaaaaaaaagagagagagagagaagaagaagaagaagagacac

SEQ ID NO: 428003 - RNA, 62 nt, hsa
gagagugccugauuggaaaaaaaaaaaaaagagagagagagagaagaagaagaagaagagac

SEQ ID NO: 428004 - RNA, 62 nt, hsa
cagagagugccugauuggaaaaaaaaaaaaaagagagagagagagaagaagaagaagaagag

SEQ ID NO: 428005 - RNA, 62 nt, hsa
uaucagcaucuggcauccaaagcaacaucagagagagagaacacagaagaaaagcaauugcc

SEQ ID NO: 428006 - RNA, 62 nt, hsa
cuuaucagcaucuggcauccaaagcaacaucagagagagagaacacagaagaaaagcaauug

SEQ ID NO: 428007 - RNA, 62 nt, hsa
aaguuauuuggaaagaaagaaagaaagagagagagagagaaagaaagaaagaaaggcugccu

SEQ ID NO: 428008 - RNA, 62 nt, hsa
aaaaguuauuuggaaagaaagaaagaaagagagagagagagaaagaaagaaagaaaggcugc

SEQ ID NO: 428009 - RNA, 62 nt, hsa
gaaaaaguuauuuggaaagaaagaaagaaagagagagagagagaaagaaagaaagaaaggcu

SEQ ID NO: 428010 - RNA, 62 nt, hsa
aggaaaaaguuauuuggaaagaaagaaagaaagagagagagagagaaagaaagaaagaaagg

SEQ ID NO: 428011 - RNA, 62 nt, hsa
gaaugggcagaggugagagagagagagagaaagagagagaaugaaugcaguugcauugauuc

SEQ ID NO: 428012 - RNA, 62 nt, hsa
agugccuuuugaaugggcagaggugagagagagagagagaaagagagagaaugaaugcaguu

SEQ ID NO: 428013 - RNA, 62 nt, hsa
ccagugccuuuugaaugggcagaggugagagagagagagagaaagagagagaaugaaugcag

SEQ ID NO: 428014 - RNA, 62 nt, hsa
cuccagugccuuuugaaugggcagaggugagagagagagagagaaagagagagaaugaaugc

SEQ ID NO: 428015 - RNA, 62 nt, hsa
gacuccagugccuuuugaaugggcagaggugagagagagagagagaaagagagagaaugaau

SEQ ID NO: 428016 - RNA, 62 nt, hsa
aggacuccagugccuuuugaaugggcagaggugagagagagagagagaaagagagagaauga

SEQ ID NO: 428017 - RNA, 62 nt, hsa
gcuauggacacggaguggggcgggcaucuggagagagagagggagcggaggcuaaggacugg

SEQ ID NO: 428018 - RNA, 62 nt, hsa
cugcuauggacacggaguggggcgggcaucuggagagagagagggagcggaggcuaaggacu

SEQ ID NO: 428019 - RNA, 62 nt, hsa
aggaauuucagugggucucuguguguguaugagagagagaguguguguuuguguguuucaag

SEQ ID NO: 428020 - RNA, 62 nt, hsa
ggaggaauuucagugggucucuguguguguaugagagagagaguguguguuuguguguuuca

SEQ ID NO: 428021 - RNA, 62 nt, hsa
cuacaaaguguugauccccuucuuucccaugagagagagaacuggugauacuccaacaccgu

SEQ ID NO: 428022 - RNA, 62 nt, hsa
cucuacaaaguguugauccccuucuuucccaugagagagagaacuggugauacuccaacacc

SEQ ID NO: 428023 - RNA, 62 nt, hsa
guagcaucuguaacagcauuaacugucuuaaagagagagagagagaauuccgaauuggggaa

SEQ ID NO: 428024 - RNA, 62 nt, hsa
agcaucuguaacagcauuaacugucuuaaagagagagagagagaauuccgaauuggggaaca

SEQ ID NO: 428025 - RNA, 62 nt, hsa
caucuguaacagcauuaacugucuuaaagagagagagagagaauuccgaauuggggaacaca

SEQ ID NO: 428026 - RNA, 62 nt, hsa
ucuguaacagcauuaacugucuuaaagagagagagagagaauuccgaauuggggaacacacg

SEQ ID NO: 428027 - RNA, 62 nt, hsa
cugaacgggcccacccacacguuguauauucagagagagagagggagucaaggugugaccgu

SEQ ID NO: 428028 - RNA, 62 nt, hsa
gaacgggcccacccacacguuguauauucagagagagagagggagucaaggugugaccgucg

SEQ ID NO: 428029 - RNA, 62 nt, hsa
gucugaaagaaagagagaaagaaagaaagaaagagagagaaagaaagaaagaaagaaaggga

SEQ ID NO: 428030 - RNA, 62 nt, hsa
gauggaaggaaggaaggaaaaagaaagagaaagagagagagagagaaagaaaaagaaagaaa

SEQ ID NO: 428031 - RNA, 62 nt, hsa
uggaaggaaggaaggaaaaagaaagagaaagagagagagagagaaagaaaaagaaagaaaag

SEQ ID NO: 428032 - RNA, 62 nt, hsa
gaaggaaggaaggaaaaagaaagagaaagagagagagagagaaagaaaaagaaagaaaagua

SEQ ID NO: 428033 - RNA, 62 nt, hsa
aggaaggaaggaaaaagaaagagaaagagagagagagagaaagaaaaagaaagaaaaguaag

SEQ ID NO: 428034 - RNA, 62 nt, hsa
cacucgagcucaagaauucaagaccugggcaagagagagagacuuugucucuauuaaaaaua

SEQ ID NO: 428035 - RNA, 62 nt, hsa
cucgagcucaagaauucaagaccugggcaagagagagagacuuugucucuauuaaaaauaaa

SEQ ID NO: 428036 - RNA, 62 nt, hsa
uuuagacacacaaaacaaacaaacacaugggggagagagacuuggaagaggaggaggaggag

SEQ ID NO: 428037 - RNA, 62 nt, hsa
acuuggaagaggaggaggaggaggagaaggaggagagagaggggaagagacaaagugggugu

SEQ ID NO: 428038 - RNA, 62 nt, hsa
gacaccauuucccuccucuagaccucaucuuggagagagagauguuggauggggccaucuau

SEQ ID NO: 428039 - RNA, 62 nt, hsa
caccauuucccuccucuagaccucaucuuggagagagagauguuggauggggccaucuauuc

SEQ ID NO: 428040 - RNA, 62 nt, hsa
ccguggaaccccgaagccuggcgggagagagagagagagaagucuccucugcauuuuggguu

SEQ ID NO: 428041 - RNA, 62 nt, hsa
ccccguggaaccccgaagccuggcgggagagagagagagagaagucuccucugcauuuuggg

SEQ ID NO: 428042 - RNA, 62 nt, hsa
ggccccguggaaccccgaagccuggcgggagagagagagagagaagucuccucugcauuuug

SEQ ID NO: 428043 - RNA, 62 nt, hsa
ugggccccguggaaccccgaagccuggcgggagagagagagagagaagucuccucugcauuu

SEQ ID NO: 428044 - RNA, 62 nt, hsa
gaugggccccguggaaccccgaagccuggcgggagagagagagagagaagucuccucugcau

SEQ ID NO: 428045 - RNA, 62 nt, hsa
ugugcgcacgcccuuuugugcagugagagagagagagagauugcacacaugugucucuguag

SEQ ID NO: 428046 - RNA, 62 nt, hsa
ugugugcgcacgcccuuuugugcagugagagagagagagagauugcacacaugugucucugu

SEQ ID NO: 428047 - RNA, 62 nt, hsa
ugugugugcgcacgcccuuuugugcagugagagagagagagagauugcacacaugugucucu

SEQ ID NO: 428048 - RNA, 62 nt, hsa
ugugugugugcgcacgcccuuuugugcagugagagagagagagagauugcacacaugugucu

SEQ ID NO: 428049 - RNA, 62 nt, hsa
cgugugugugugcgcacgcccuuuugugcagugagagagagagagagauugcacacaugugu

SEQ ID NO: 428050 - RNA, 62 nt, hsa
aaaaaaaaaaaagcgagcgagagagagagcgagagagagagcgagagcagaagaaauuccua

SEQ ID NO: 428051 - RNA, 62 nt, hsa
aaaaaaaaaaaaaagcgagcgagagagagagcgagagagagagcgagagcagaagaaauucc

SEQ ID NO: 428052 - RNA, 62 nt, hsa
aaaagacaaaaaaaaaaaaaaaaagcgagcgagagagagagcgagagagagagcgagagcag

SEQ ID NO: 428053 - RNA, 62 nt, hsa
ugaaaagacaaaaaaaaaaaaaaaaagcgagcgagagagagagcgagagagagagcgagagc

SEQ ID NO: 428054 - RNA, 62 nt, hsa
cccagggucuggugauggcagggauggggggagagagagaaaauccacaaauuccaauguca

SEQ ID NO: 428055 - RNA, 62 nt, hsa
accccagggucuggugauggcagggauggggggagagagagaaaauccacaaauuccaaugu

SEQ ID NO: 428056 - RNA, 62 nt, hsa
gaaaacagaaacccgagaaagagagagacagagagagagaaaaaaaaucacccaccaccccc

SEQ ID NO: 428057 - RNA, 62 nt, hsa
gagaaaacagaaacccgagaaagagagagacagagagagagaaaaaaaaucacccaccaccc

SEQ ID NO: 428058 - RNA, 62 nt, hsa
aaaccaaaaagagaaaacagaaacccgagaaagagagagacagagagagagaaaaaaaauca

SEQ ID NO: 428059 - RNA, 62 nt, hsa
agcagagagagagagagagaaagagagagagagagagagaaggggcccaagagagacagcac

SEQ ID NO: 428060 - RNA, 62 nt, hsa
gcagcagagagagagagagagaaagagagagagagagagagaaggggcccaagagagacagc

SEQ ID NO: 428061 - RNA, 62 nt, hsa
gggcagcagagagagagagagagaaagagagagagagagagagaaggggcccaagagagaca

SEQ ID NO: 428062 - RNA, 62 nt, hsa
ccgggcagcagagagagagagagagaaagagagagagagagagagaaggggcccaagagaga

SEQ ID NO: 428063 - RNA, 62 nt, hsa
ccccgggcagcagagagagagagagagaaagagagagagagagagagaaggggcccaagaga

SEQ ID NO: 428064 - RNA, 62 nt, hsa
cuccccgggcagcagagagagagagagagaaagagagagagagagagagaaggggcccaaga

SEQ ID NO: 428065 - RNA, 62 nt, hsa
cucccacccccuccccgggcagcagagagagagagagagaaagagagagagagagagagaag

SEQ ID NO: 428066 - RNA, 62 nt, hsa
cccucccacccccuccccgggcagcagagagagagagagagaaagagagagagagagagaga

SEQ ID NO: 428067 - RNA, 62 nt, hsa
ugcccucccacccccuccccgggcagcagagagagagagagagaaagagagagagagagaga

SEQ ID NO: 428068 - RNA, 62 nt, hsa
ccugcccucccacccccuccccgggcagcagagagagagagagagaaagagagagagagaga

SEQ ID NO: 428069 - RNA, 62 nt, hsa
cgccugcccucccacccccuccccgggcagcagagagagagagagagaaagagagagagaga

SEQ ID NO: 428070 - RNA, 62 nt, hsa
uuuccauuaaguacaugugccaggaaacaagagagagagaaaguaaaggcaguaaugccuuc

SEQ ID NO: 428071 - RNA, 62 nt, hsa
cuuuuccauuaaguacaugugccaggaaacaagagagagagaaaguaaaggcaguaaugccu

SEQ ID NO: 428072 - RNA, 62 nt, hsa
auuauauauuauauagagagagggaggagagcgagagagagugaggacaccgaacugggcug

SEQ ID NO: 428073 - RNA, 62 nt, hsa
aaagauacagagagucaaauagagagaauggagagagagaaacauauauuauauauuauaua

SEQ ID NO: 428074 - RNA, 62 nt, hsa
auaaagauacagagagucaaauagagagaauggagagagagaaacauauauuauauauuaua

SEQ ID NO: 428075 - RNA, 62 nt, hsa
ugcugugacucaaggccacggcucuacuaaaagagagagaggaagcgagagagagagagaaa

SEQ ID NO: 428076 - RNA, 62 nt, hsa
gccacggcucuacuaaaagagagagaggaagcgagagagagagagaaaaaacaaaaaacaga

SEQ ID NO: 428077 - RNA, 62 nt, hsa
cacggcucuacuaaaagagagagaggaagcgagagagagagagaaaaaacaaaaaacagaaa

SEQ ID NO: 428078 - RNA, 62 nt, hsa
cggcucuacuaaaagagagagaggaagcgagagagagagagaaaaaacaaaaaacagaaaac

SEQ ID NO: 428079 - RNA, 62 nt, hsa
gcucuacuaaaagagagagaggaagcgagagagagagagaaaaaacaaaaaacagaaaacac

SEQ ID NO: 428080 - RNA, 62 nt, hsa
cucgcuuuaguuuucaaccuuguuggugcugagagagagaaccgagaggucccaguacaagg

SEQ ID NO: 428081 - RNA, 62 nt, hsa
cucucgcuuuaguuuucaaccuuguuggugcugagagagagaaccgagaggucccaguacaa

SEQ ID NO: 428082 - RNA, 62 nt, hsa
agcgccgccuccuagacucgagcagagccggagagagagacgagagggugggaggucccgga

SEQ ID NO: 428083 - RNA, 62 nt, hsa
ccagcgccgccuccuagacucgagcagagccggagagagagacgagagggugggaggucccg

SEQ ID NO: 428084 - RNA, 62 nt, hsa
uuccccuggugucugcacagccuuuauaaagagagagagagcuccgaagcaauaacaacacc

SEQ ID NO: 428085 - RNA, 62 nt, hsa
ccuuccccuggugucugcacagccuuuauaaagagagagagagcuccgaagcaauaacaaca

SEQ ID NO: 428086 - RNA, 62 nt, hsa
auuagcacuguucacuacauuaacaugcaagagagagagaagccuuguuacauuuccugcua

SEQ ID NO: 428087 - RNA, 62 nt, hsa
cuauuagcacuguucacuacauuaacaugcaagagagagagaagccuuguuacauuuccugc

SEQ ID NO: 428088 - RNA, 62 nt, hsa
auauucccagacugaggcagggcagguuugcagagagagacccagagugcacgugacccgca

SEQ ID NO: 428089 - RNA, 62 nt, hsa
ccuccuuaccacccaccaggccagauuuacaggagagagaaauccacuccacucuuccuuaa

SEQ ID NO: 428090 - RNA, 62 nt, hsa
aauuauaggauuuuuuuuucuucuuuuuuagagagagagauuagaaaacgacauuaggaauu

SEQ ID NO: 428091 - RNA, 62 nt, hsa
aaaauuauaggauuuuuuuuucuucuuuuuuagagagagagauuagaaaacgacauuaggaa

SEQ ID NO: 428092 - RNA, 62 nt, hsa
ggaagacagugguucugauggguucagcccuagagagagagagagaagcggggagaauaaga

SEQ ID NO: 428093 - RNA, 62 nt, hsa
aagacagugguucugauggguucagcccuagagagagagagagaagcggggagaauaagagu

SEQ ID NO: 428094 - RNA, 62 nt, hsa
gacagugguucugauggguucagcccuagagagagagagagaagcggggagaauaagagugc

SEQ ID NO: 428095 - RNA, 62 nt, hsa
cagugguucugauggguucagcccuagagagagagagagaagcggggagaauaagagugcac

SEQ ID NO: 428096 - RNA, 62 nt, hsa
ugagccagaaaguaacacagagcucaugcuuggagagagagagucuuggccauggcuuuccu

SEQ ID NO: 428097 - RNA, 62 nt, hsa
agccagaaaguaacacagagcucaugcuuggagagagagagucuuggccauggcuuuccugc

SEQ ID NO: 428098 - RNA, 62 nt, hsa
ccucuccggaucugucgauuuggagaccuuccgagagagaaccaagggugcagucagcuuaa

SEQ ID NO: 428099 - RNA, 62 nt, hsa
ucauauuuagaaguaaaacacaaaacaaaaaagagagagaaaagaaaagaaaucacaaugua

SEQ ID NO: 428100 - RNA, 62 nt, hsa
ccucugggccuccagcgcuggguuugucgagugagagagagagaggagcuuggguugcuucc

SEQ ID NO: 428101 - RNA, 62 nt, hsa
ucugggccuccagcgcuggguuugucgagugagagagagagaggagcuuggguugcuucccu

SEQ ID NO: 428102 - RNA, 62 nt, hsa
ugggccuccagcgcuggguuugucgagugagagagagagaggagcuuggguugcuucccugu

SEQ ID NO: 428103 - RNA, 62 nt, hsa
auagaagagggaaggaaagagagaaggaaagagagagagaaagaaagucuccagaccaggaa

SEQ ID NO: 428104 - RNA, 62 nt, hsa
acauagaagagggaaggaaagagagaaggaaagagagagagaaagaaagucuccagaccagg

SEQ ID NO: 428105 - RNA, 62 nt, hsa
ugucaaaauguuacaaccgcuguaaaaugacggagagagagagaaagaaucccagacauuaa

SEQ ID NO: 428106 - RNA, 62 nt, hsa
ucaaaauguuacaaccgcuguaaaaugacggagagagagagaaagaaucccagacauuaacg

SEQ ID NO: 428107 - RNA, 62 nt, hsa
aaaauguuacaaccgcuguaaaaugacggagagagagagaaagaaucccagacauuaacggu

SEQ ID NO: 428108 - RNA, 64 nt, hsa
auuauauauuuaaagugcucauuaauagaaugauggauguaaauuggauguaaauauucaguuu

SEQ ID NO: 428109 - RNA, 64 nt, hsa
aaagugcucauuaauagaaugauggauguaaauuggauguaaauauucaguuuauauaauuaua

SEQ ID NO: 428110 - RNA, 64 nt, hsa
uucuacuuuuaaaauuugugguaauacccagaauggauguaaaauaacauuuuucaauagauua

SEQ ID NO: 428111 - RNA, 64 nt, hsa
uacauauucuuaauauuugagcauugaggcaagaggauguaauugauagcauuacuuauuacau

SEQ ID NO: 428112 - RNA, 64 nt, hsa
gcaaaauauauguuuggcugaaauuaugucaaauggauguaauauaggguuuguuugcugcuuu

SEQ ID NO: 428113 - RNA, 64 nt, hsa
uuuuggagagagcaaucuugcugugaaacaguguggauguaaauuuuauaaggcugacucuuac

SEQ ID NO: 428114 - RNA, 64 nt, hsa; identical to SEQ ID NO: 244542

SEQ ID NO: 428115 - RNA, 64 nt, hsa; identical to SEQ ID NO: 244543

SEQ ID NO: 428116 - RNA, 64 nt, hsa; identical to SEQ ID NO: 244544

SEQ ID NO: 428117 - RNA, 64 nt, hsa; identical to SEQ ID NO: 244545

SEQ ID NO: 428118 - RNA, 64 nt, hsa; identical to SEQ ID NO: 244546

SEQ ID NO: 428119 - RNA, 64 nt, hsa; identical to SEQ ID NO: 244547

SEQ ID NO: 428120 - RNA, 64 nt, hsa; identical to SEQ ID NO: 244548

SEQ ID NO: 428121 - RNA, 64 nt, hsa; identical to SEQ ID NO: 244549

SEQ ID NO: 428122 - RNA, 64 nt, hsa; identical to SEQ ID NO: 244550

SEQ ID NO: 428123 - RNA, 64 nt, hsa; identical to SEQ ID NO: 244551

SEQ ID NO: 428124 - RNA, 64 nt, hsa; identical to SEQ ID NO: 244552

SEQ ID NO: 428125 - RNA, 64 nt, hsa; identical to SEQ ID NO: 244553

SEQ ID NO: 428126 - RNA, 64 nt, hsa; identical to SEQ ID NO: 244554

SEQ ID NO: 428127 - RNA, 64 nt, hsa; identical to SEQ ID NO: 244555

SEQ ID NO: 428128 - RNA, 64 nt, hsa; identical to SEQ ID NO: 244556

SEQ ID NO: 428129 - RNA, 64 nt, hsa; identical to SEQ ID NO: 244557

SEQ ID NO: 428130 - RNA, 64 nt, hsa; identical to SEQ ID NO: 244558

SEQ ID NO: 428131 - RNA, 64 nt, hsa; identical to SEQ ID NO: 244559

SEQ ID NO: 428132 - RNA, 64 nt, hsa; identical to SEQ ID NO: 244560

SEQ ID NO: 428133 - RNA, 64 nt, hsa; identical to SEQ ID NO: 244561

SEQ ID NO: 428134 - RNA, 64 nt, hsa; identical to SEQ ID NO: 244562

SEQ ID NO: 428135 - RNA, 64 nt, hsa; identical to SEQ ID NO: 244563

SEQ ID NO: 428136 - RNA, 64 nt, hsa; identical to SEQ ID NO: 244564

SEQ ID NO: 428137 - RNA, 64 nt, hsa; identical to SEQ ID NO: 244565

SEQ ID NO: 428138 - RNA, 64 nt, hsa; identical to SEQ ID NO: 244566

SEQ ID NO: 428139 - RNA, 64 nt, hsa; identical to SEQ ID NO: 244567

SEQ ID NO: 428140 - RNA, 64 nt, hsa; identical to SEQ ID NO: 244568

SEQ ID NO: 428141 - RNA, 64 nt, hsa; identical to SEQ ID NO: 244569

SEQ ID NO: 428142 - RNA, 64 nt, hsa; identical to SEQ ID NO: 244570

SEQ ID NO: 428143 - RNA, 64 nt, hsa; identical to SEQ ID NO: 187826

SEQ ID NO: 428144 - RNA, 64 nt, hsa; identical to SEQ ID NO: 187827

SEQ ID NO: 428145 - RNA, 64 nt, hsa; identical to SEQ ID NO: 187967

SEQ ID NO: 428146 - RNA, 64 nt, hsa; identical to SEQ ID NO: 187968

SEQ ID NO: 428147 - RNA, 61 nt, hsa
auauuaagguaaguagaaaguguuuuuauagggcuucaauacccagguggugacagagcag

SEQ ID NO: 428148 - RNA, 61 nt, hsa
aguuuuacuuuuuguauguuaccuguacuuaggcuucaaauugaagccuguuuuaugugua

SEQ ID NO: 428149 - RNA, 61 nt, hsa
agccacuguggagcccuugccuccgagcucuggcuucaaggggagcucuucuccagguuca

SEQ ID NO: 428150 - RNA, 61 nt, hsa
uuuuuuaaguuuuguuuuuaucuugccuguuggcuucaauacauuugagaauacgcugaag

SEQ ID NO: 428151 - RNA, 61 nt, hsa
uugcuuuacagacuuccaagaggcugauucuggcuucaagauggagccuuggaguugguuu

SEQ ID NO: 428152 - RNA, 61 nt, hsa
acuguauugaauacaguauaaugacuacuauggcuucaaucuuaaaccuggaaacaaauau

SEQ ID NO: 428153 - RNA, 61 nt, hsa
augcuguacuaacccagucuuucuucacucuggcuucaaaaagccacagcagagcauuguc

SEQ ID NO: 428154 - RNA, 61 nt, hsa
uggcauggcaggagucucugccaguuacuugggcuucaacagccaagcuggcacaaaagac

SEQ ID NO: 428155 - RNA, 64 nt, hsa; identical to SEQ ID NO: 72787

SEQ ID NO: 428156 - RNA, 64 nt, hsa; identical to SEQ ID NO: 72788

SEQ ID NO: 428157 - RNA, 64 nt, hsa; identical to SEQ ID NO: 72789

SEQ ID NO: 428158 - RNA, 64 nt, hsa; identical to SEQ ID NO: 72790

SEQ ID NO: 428159 - RNA, 64 nt, hsa; identical to SEQ ID NO: 72791

SEQ ID NO: 428160 - RNA, 64 nt, hsa; identical to SEQ ID NO: 72792

SEQ ID NO: 428161 - RNA, 64 nt, hsa; identical to SEQ ID NO: 72793

SEQ ID NO: 428162 - RNA, 64 nt, hsa; identical to SEQ ID NO: 72794

SEQ ID NO: 428163 - RNA, 64 nt, hsa; identical to SEQ ID NO: 72795

SEQ ID NO: 428164 - RNA, 64 nt, hsa; identical to SEQ ID NO: 72796

SEQ ID NO: 428165 - RNA, 64 nt, hsa; identical to SEQ ID NO: 72797

SEQ ID NO: 428166 - RNA, 64 nt, hsa; identical to SEQ ID NO: 72798

SEQ ID NO: 428167 - RNA, 64 nt, hsa; identical to SEQ ID NO: 72799

SEQ ID NO: 428168 - RNA, 64 nt, hsa; identical to SEQ ID NO: 72800

SEQ ID NO: 428169 - RNA, 64 nt, hsa; identical to SEQ ID NO: 72801

SEQ ID NO: 428170 - RNA, 64 nt, hsa; identical to SEQ ID NO: 72802

SEQ ID NO: 428171 - RNA, 64 nt, hsa; identical to SEQ ID NO: 72803

SEQ ID NO: 428172 - RNA, 64 nt, hsa; identical to SEQ ID NO: 72804

SEQ ID NO: 428173 - RNA, 64 nt, hsa; identical to SEQ ID NO: 72805

SEQ ID NO: 428174 - RNA, 64 nt, hsa; identical to SEQ ID NO: 72806

SEQ ID NO: 428175 - RNA, 64 nt, hsa; identical to SEQ ID NO: 72807

SEQ ID NO: 428176 - RNA, 64 nt, hsa; identical to SEQ ID NO: 72808

SEQ ID NO: 428177 - RNA, 64 nt, hsa; identical to SEQ ID NO: 72809

SEQ ID NO: 428178 - RNA, 64 nt, hsa; identical to SEQ ID NO: 72810

SEQ ID NO: 428179 - RNA, 64 nt, hsa; identical to SEQ ID NO: 72811

SEQ ID NO: 428180 - RNA, 64 nt, hsa; identical to SEQ ID NO: 72812

SEQ ID NO: 428181 - RNA, 64 nt, hsa; identical to SEQ ID NO: 72813

SEQ ID NO: 428182 - RNA, 64 nt, hsa; identical to SEQ ID NO: 72814

SEQ ID NO: 428183 - RNA, 64 nt, hsa; identical to SEQ ID NO: 72815

SEQ ID NO: 428184 - RNA, 64 nt, hsa; identical to SEQ ID NO: 72816

SEQ ID NO: 428185 - RNA, 64 nt, hsa; identical to SEQ ID NO: 72817

SEQ ID NO: 428186 - RNA, 64 nt, hsa; identical to SEQ ID NO: 72818

SEQ ID NO: 428187 - RNA, 64 nt, hsa; identical to SEQ ID NO: 72819

SEQ ID NO: 428188 - RNA, 64 nt, hsa; identical to SEQ ID NO: 72820

SEQ ID NO: 428189 - RNA, 64 nt, hsa; identical to SEQ ID NO: 72821

SEQ ID NO: 428190 - RNA, 64 nt, hsa; identical to SEQ ID NO: 72822

SEQ ID NO: 428191 - RNA, 64 nt, hsa; identical to SEQ ID NO: 72823

SEQ ID NO: 428192 - RNA, 64 nt, hsa; identical to SEQ ID NO: 72824

SEQ ID NO: 428193 - RNA, 64 nt, hsa; identical to SEQ ID NO: 72825

SEQ ID NO: 428194 - RNA, 64 nt, hsa; identical to SEQ ID NO: 72826

SEQ ID NO: 428195 - RNA, 64 nt, hsa; identical to SEQ ID NO: 72827

SEQ ID NO: 428196 - RNA, 64 nt, hsa; identical to SEQ ID NO: 72828

SEQ ID NO: 428197 - RNA, 64 nt, hsa; identical to SEQ ID NO: 72829

SEQ ID NO: 428198 - RNA, 64 nt, hsa; identical to SEQ ID NO: 72830

SEQ ID NO: 428199 - RNA, 64 nt, hsa; identical to SEQ ID NO: 72831

SEQ ID NO: 428200 - RNA, 64 nt, hsa; identical to SEQ ID NO: 72832

SEQ ID NO: 428201 - RNA, 64 nt, hsa; identical to SEQ ID NO: 72833

SEQ ID NO: 428202 - RNA, 64 nt, hsa; identical to SEQ ID NO: 72834

SEQ ID NO: 428203 - RNA, 64 nt, hsa; identical to SEQ ID NO: 72835

SEQ ID NO: 428204 - RNA, 64 nt, hsa; identical to SEQ ID NO: 72836

SEQ ID NO: 428205 - RNA, 64 nt, hsa; identical to SEQ ID NO: 72837

SEQ ID NO: 428206 - RNA, 64 nt, hsa; identical to SEQ ID NO: 72838

SEQ ID NO: 428207 - RNA, 64 nt, hsa; identical to SEQ ID NO: 72839

SEQ ID NO: 428208 - RNA, 64 nt, hsa; identical to SEQ ID NO: 72840

SEQ ID NO: 428209 - RNA, 64 nt, hsa; identical to SEQ ID NO: 72841

SEQ ID NO: 428210 - RNA, 61 nt, hsa
uuaaaaguuuaguaaaaaucgucugggcacaguggcucacgccuguaaucccagcacuuug

SEQ ID NO: 428211 - RNA, 61 nt, hsa
ucaaagagaaaaaaaaaaaagaccgggugugguggcucacaccuguaaucccagcacuuug

SEQ ID NO: 428212 - RNA, 61 nt, hsa
gauuaagauaaugccgggcaggccgggcacaguggcucacgccuguaauccaagcacuugg

SEQ ID NO: 428213 - RNA, 61 nt, hsa
accugccucuugaaagauucaaccgggugugguggcucacgccuguaaucccagcacauug

SEQ ID NO: 428214 - RNA, 61 nt, hsa
cuccagcuacccuuuuaccucaucagaagcaguggcucagcuaagugcucccccuagcucc

SEQ ID NO: 428215 - RNA, 61 nt, hsa
ggccuuucuuucaucccaaaugacaaggaauguggcucagagaaggguuuuucuuuuuuga

SEQ ID NO: 428216 - RNA, 61 nt, hsa
gauguagaaaauagaaaauaggcuaggcacaguggcucacgccuguaaucucaacacuuug

SEQ ID NO: 428217 - RNA, 61 nt, hsa
cuguuuaaagucugaagcucggccaggugcgguggcucacgccuguaaucccaaaacuuug

SEQ ID NO: 428218 - RNA, 61 nt, hsa
uuguguaagaaacugaaauaagcugcgugugguggcucacaccuguaaucccaacacuuug

SEQ ID NO: 428219 - RNA, 61 nt, hsa
ucaaaggaaaaaggaaacuaggccaggcgugguggcucacgccuguaaucccaacacuuug

SEQ ID NO: 428220 - RNA, 61 nt, hsa
cauuuuaaagaguguaggcaggccaggugcaguggcucaugccuguaaucccagcauuuug

SEQ ID NO: 428221 - RNA, 61 nt, hsa
aacacaagaacuauacacauggccaggcgcgguggcucacacccguaaucccagcacuuug

SEQ ID NO: 428222 - RNA, 61 nt, hsa
aaaaguaauuggcagugauuggccaggcgcaguggcucacgccuguaaucccagcacuggg

SEQ ID NO: 428223 - RNA, 61 nt, hsa
ucuuaaaaaagcccauggcaggcugggcgcgguggcucacgccuguaaucccagcacuuug

SEQ ID NO: 428224 - RNA, 61 nt, hsa
agaaccugucgcuggaaaccagggcaaagcaguggcucagggcuccuugggugcaugugua

SEQ ID NO: 428225 - RNA, 61 nt, hsa
cuuggcuggaaaacugugguagagccgggcuguggcucagguaauuuuugccauuuggcca

SEQ ID NO: 428226 - RNA, 61 nt, hsa
guggucccaguuacuugggaggcugacguggguggcucacuugagcacaggaguuugaggc

SEQ ID NO: 428227 - RNA, 61 nt, hsa
ggcauuuaaaaaauuaaaaugaccaggcacaguggcucacgccuguaaucucggcacuuug

SEQ ID NO: 428228 - RNA, 61 nt, hsa
cucaaaaaacauuauuuuuaaaauuagccugguggcucacgccuguaaucccagcacuuug

SEQ ID NO: 428229 - RNA, 61 nt, hsa
uggcaagauuaacaaaauuaggccgggcaugguggcucacgccuguaaucccagcacuuug

SEQ ID NO: 428230 - RNA, 61 nt, hsa
guacagaagaggauucaaaacgccacguguaguggcucaugccuguaaucccaacacuuug

SEQ ID NO: 428231 - RNA, 61 nt, hsa
aauuagaaaauauaguuugaggccgggcacgguggcucacgccuguaaucccaguacuugg

SEQ ID NO: 428232 - RNA, 61 nt, hsa
uuuaagauuuuuggguccugagccagccgugguggcucacaccuguaaucccagcacuuug

SEQ ID NO: 428233 - RNA, 61 nt, hsa
caagaauagucaaguuuuuuggccgggcaugguggcucaugccuguaaucccagcacuugg

SEQ ID NO: 428234 - RNA, 61 nt, hsa
uuacuuauaauaccaauuuaggcugggcgcaguggcucacgccuguaaucccagcacuuug

SEQ ID NO: 428235 - RNA, 61 nt, hsa
aaaaaacaaaaaccaguuuaggcuggguaugguggcucaccagcacuuugggaggcugagg

SEQ ID NO: 428236 - RNA, 61 nt, hsa
aauuuuggaagagcaaauggggcugagugcaguggcucaugccuguaaucccagcacuuag

SEQ ID NO: 428237 - RNA, 61 nt, hsa
cuauuaaaaaaugcuguccaggccaggcacaguggcucacaccuguaaucccaggacuucg

SEQ ID NO: 428238 - RNA, 61 nt, hsa
uuaacuauuaaauguugaccuagccagcgcaguggcucaugccuguaaucccagcacuuug

SEQ ID NO: 428239 - RNA, 61 nt, hsa
agaaacuaugacuuguaguaagccgggcgcgguggcucacgccuguaaucccaacacuuug

SEQ ID NO: 428240 - RNA, 61 nt, hsa
ucauaaaaaauguuaacgugggcugggcaugguggcucaugccuguaaucccagcacucug

SEQ ID NO: 428241 - RNA, 61 nt, hsa
auuucaagauaggcuuagcaggaugggcgcaguggcucacgccacuaaucccaacauuuua

SEQ ID NO: 428242 - RNA, 61 nt, hsa
cuauuuuauaaauuaaaaaaggcugggugugguggcucacacccauaaucccaacacuuug

SEQ ID NO: 428243 - RNA, 61 nt, hsa
gacugggccuugucacuggaggucguaggcaguggcucaucacccugguagggcugauagg

SEQ ID NO: 428244 - RNA, 61 nt, hsa
gaggccuccccagcccugcccggugcaggagguggcucaguuauugaaccuuuugggaagc

SEQ ID NO: 428245 - RNA, 61 nt, hsa
uacucauuuaaaaacuagagggcuaggcuuaguggcucacgccuguaaucucagcacuuug

SEQ ID NO: 428246 - RNA, 61 nt, hsa
cccuuauauaaaaugguguaggccgggcaugguggcucacgccuguaaucccaguacuuug

SEQ ID NO: 428247 - RNA, 61 nt, hsa
ucaaaaaaugcuaaaacuuuggcugggcaugguggcucacgccuguaaucccagcacuuug

SEQ ID NO: 428248 - RNA, 61 nt, hsa
cauaagaagacauuuugacuggcugggugcgguggcucacgcuuguaaucccagcacuuug

SEQ ID NO: 428249 - RNA, 61 nt, hsa
ugagucaagauuuauauuaaggcuggaagcuguggcucacaccuguaaucccagcauuuug

SEQ ID NO: 428250 - RNA, 61 nt, hsa
cagguguuaaugcaucuaugggccaggugcaguggcucacuccuguaauccgagcaauuug

SEQ ID NO: 428251 - RNA, 61 nt, hsa
gcuaaauaaaaauguagacauggcuggcgcaguggcucaugcuuguaauccuagcacuuuu

SEQ ID NO: 428252 - RNA, 61 nt, hsa
acaaaaaaaaugaaaaauaaaccugggugcgguggcucacaccuguaaucccagcacuuug

SEQ ID NO: 428253 - RNA, 61 nt, hsa
cauauagaagaaaguuaauaggccgggcuugguggcucaugccuguaaucccagcacuuug

SEQ ID NO: 428254 - RNA, 61 nt, hsa
aacaauaaaaaguagacaugggcugggugcaguggcucacuccuguagucccaggacuuug

SEQ ID NO: 428255 - RNA, 61 nt, hsa
caguaauaaagaaacauaagggcugggggugguggcucaugccuguaaucccagcacuuug

SEQ ID NO: 428256 - RNA, 61 nt, hsa
cauagaaaauguuuugaauaggccaggcgcaguggcucacaccuguaaucccagcacguug

SEQ ID NO: 428257 - RNA, 61 nt, hsa
ccauguaaaaaguaaauaaugucugggcacaguggcucacgccuguaauccuagcacuuug

SEQ ID NO: 428258 - RNA, 61 nt, hsa
aagucccuggucaggucucagguagugcgguguggcucagcuggguuuuuaauuagcgcau

SEQ ID NO: 428259 - RNA, 61 nt, hsa
aauuaauuccuggucuaguuuccugggccuuguggcucagcugccacuaaagagcuuuuug

SEQ ID NO: 428260 - RNA, 61 nt, hsa
ugcaggaugggccgcgccgccguggcccgcuguggcucaccacggcccaggguggccuugg

SEQ ID NO: 428261 - RNA, 61 nt, hsa
aagcuuaaacaaauaacuuuggccgggcacgguggcucacaccuauaaucccagcacuaug

SEQ ID NO: 428262 - RNA, 61 nt, hsa
caggaaucaaaagauaaaggggccgggugugguggcucacaccuguaaucccagcacuuug

SEQ ID NO: 428263 - RNA, 61 nt, hsa
aaauuaguaguugaaauucuaggccggugcgguggcucaugccuguaaucccagcacugua

SEQ ID NO: 428264 - RNA, 61 nt, hsa
aauuagaaaaucaagcuuugggccaggugcgguggcucaugccuguaaucccagcacuaug

SEQ ID NO: 428265 - RNA, 61 nt, hsa
uuuuuaaaaaauugcuuguaggcugagcgcgguggcucacgccuguaaucccagcacuuug

SEQ ID NO: 428266 - RNA, 61 nt, hsa
uuuaaagagaauaaauagagggccaggugugguggcucacgccugugaucccagcacuuug

SEQ ID NO: 428267 - RNA, 61 nt, hsa
aaagaugaaagagggaaauaggccauggacgguggcucacgccuguaaucccagcacuuua

SEQ ID NO: 428268 - RNA, 61 nt, hsa
gacgagacugcacaagacaaagcucaggcaaguggcucaguaguuggccagcccagcaggg

SEQ ID NO: 428269 - RNA, 61 nt, hsa
uaaggauaaaaacuaacauuggccaggcacgguggcucacgccuguaaucccaacacuuua

SEQ ID NO: 428270 - RNA, 61 nt, hsa
agguauuuaaaauguuacauaugccggcgcaguggcucauguguguaaucccagcacucug

SEQ ID NO: 428271 - RNA, 61 nt, hsa
uacaaaaaauacaaaaaauuagccgggcgcgguggcucacaccuguaaucccagcacuuug

SEQ ID NO: 428272 - RNA, 61 nt, hsa
cuuagaaggauggcucugguggccgggcgcgguggcucaaaccuguaaucccagcacuuug

SEQ ID NO: 428273 - RNA, 61 nt, hsa
guuuuaaaauuacggugauuggccaggugcaguggcucacaccuguaaucccagcacuuug

SEQ ID NO: 428274 - RNA, 61 nt, hsa
caucaaaguuacuaaaacauggccaggcgcaguggcucaugccuguaaucccagcacuuug

SEQ ID NO: 428275 - RNA, 61 nt, hsa
gggacucccuccucuucagagaagcccuccuguggcucaggggcagcugcagggccagaug

SEQ ID NO: 428276 - RNA, 61 nt, hsa
aaauuaaaacuggguuuccaggccuggugugguggcucacgccuguagccccagcuauugc

SEQ ID NO: 428277 - RNA, 61 nt, hsa
cuuuuaaaaacuuucaucuaggccacgugcgguggcucaugccuguaaucccggcacuuug

SEQ ID NO: 428278 - RNA, 61 nt, hsa
gcccucuagaaagcaacugaggccaggugcgguggcucacgccuguaaucccagcacuuug

SEQ ID NO: 428279 - RNA, 61 nt, hsa
gcaagagggagcucaaucuuggccgggcgccguggcucacgccuguaaucgcagcacuuug

SEQ ID NO: 428280 - RNA, 61 nt, hsa
ucucaucaaaaacugaaguuagcugggugugguggcucaugccuguaaucccagcacuuug

SEQ ID NO: 428281 - RNA, 61 nt, hsa
aaguuagaaacaagguuaauagccaggcaugguggcucaugccuguaaucccagcacuuug

SEQ ID NO: 428282 - RNA, 61 nt, hsa
acaaaaaauuugaagugccuggcugggcgugguggcucacgccuguaaucccagcacuuug

SEQ ID NO: 428283 - RNA, 61 nt, hsa
ucaaaaaaaaaagaguucuagcccaggagcgguggcucacacuuguaaucccagcacuuug

SEQ ID NO: 428284 - RNA, 61 nt, hsa
cauucucuauaagaguucuaggcggggcgugguggcucacacuuguaaucccagcacuuug

SEQ ID NO: 428285 - RNA, 61 nt, hsa
gucucaaaaaaaugcagacuggccaggcacaguggcucacaccuguaauccgacuguaagc

SEQ ID NO: 428286 - RNA, 61 nt, hsa
ggcugcuuguuaaaaaugcaggccaggugcgguggcucacaccuguaaucccagcgcuuug

SEQ ID NO: 428287 - RNA, 61 nt, hsa
agaucauuuaagaaguaacaggccgggcgcgguggcucacgccuguaaucccagcacuuug

SEQ ID NO: 428288 - RNA, 61 nt, hsa
aauuaaaaaguaaaauaauaggccaggcaugguggcucaugccuauaagcacccugggagg

SEQ ID NO: 428289 - RNA, 61 nt, hsa
aaaaguaaaggagaauaacuggccgggcacgguggcucaugccuauaaaauuccagcacuu

SEQ ID NO: 428290 - RNA, 61 nt, hsa
aagcuuaguuggcagcacucuccacacuucuguggcucagugauuacugcuauuacuauau

SEQ ID NO: 428291 - RNA, 61 nt, hsa
agucaacuucuaucaacuucaggccaggcccguggcucaugccuguauaaucccagcacuu

SEQ ID NO: 428292 - RNA, 61 nt, hsa
cucugaaaauguacauguauggcuggacgcgguggcucacgccuguaaucccagcacuuug

SEQ ID NO: 428293 - RNA, 61 nt, hsa
aagaugaagaagccccuucaggccagucgugguggcucaugccuguaaucccagcacuuug

SEQ ID NO: 428294 - RNA, 61 nt, hsa
auaucacuguauuaaaagucugccgggcacaguggcucacgccuguaaucccaacacuuug

SEQ ID NO: 428295 - RNA, 61 nt, hsa
cacuaaaaguacaaaaaauuagcugggcgugguggcucaugccuguaaucccagcuacuca

SEQ ID NO: 428296 - RNA, 61 nt, hsa
guaagauguaaagaacucuuggccaggugugguggcucaugccuauaaucccagcacuuug

SEQ ID NO: 428297 - RNA, 61 nt, hsa
guauaagcuaauacccaucaggcugggugugguggcucacgccuguaauccuagcacuuug

SEQ ID NO: 428298 - RNA, 61 nt, hsa
gagugaagacugugaugugugguccccauauguggcucagcaaagacucgagagaucaucc

SEQ ID NO: 428299 - RNA, 61 nt, hsa
agaauaaaguuaaccaagcaggccaggcacgguggcucacgccuauaaucccagcacuuag

SEQ ID NO: 428300 - RNA, 61 nt, hsa
ggucucacucugucacccaggcuggagugcaguggcucaaugcaaccucugccccccaagu

SEQ ID NO: 428301 - RNA, 61 nt, hsa
uugcauuaauaauccuuccaggccgggcacaguggcucacgccuguaaucccagcacuuug

SEQ ID NO: 428302 - RNA, 61 nt, hsa
cgggaguuugaaaccagucucaccaggcgcaguggcucacgccuguaauuccagcauguug

SEQ ID NO: 428303 - RNA, 61 nt, hsa
cagagaauaggggaagacugggccagacgcaguggcucaugccuguaaucccagcacucug

SEQ ID NO: 428304 - RNA, 61 nt, hsa
gcuuucaaaaagcacaaauaggcuggacaugguggcucaugccuguaaucccaguacuuug

SEQ ID NO: 428305 - RNA, 61 nt, hsa
ugacaguaagaaaauacucuggcuggucucaguggcucaugucuguaauucuagcauguua

SEQ ID NO: 428306 - RNA, 61 nt, hsa
cccuguuuaaaaaagaaaaaggccaggcacgguggcucaugccuguaaucccagcuacgca

SEQ ID NO: 428307 - RNA, 61 nt, hsa
uaaaaauguucaaauaaccugguugggugugguggcucacacuuguaaucccagcacuuug

SEQ ID NO: 428308 - RNA, 61 nt, hsa
aguauguaugagguccauccuggcaugagcaguggcucacccaccggccuugaagagguga

SEQ ID NO: 428309 - RNA, 61 nt, hsa
agacccgggucuggcaccgucgggauggcaaguggcucaauguccacuaucacugcucagg

SEQ ID NO: 428310 - RNA, 61 nt, hsa
uuuagauauuccaauuugcaucagucuuucuguggcucaaauaaugaugauuauggaauga

SEQ ID NO: 428311 - RNA, 61 nt, hsa
guuccuuauaagagaagauagggcgggcaugguggcucacgccuguaaucccagcacugug

SEQ ID NO: 428312 - RNA, 61 nt, hsa
gaaauuuguguuauuugauaggccgggcaugguggcucaugccuguaaucccagcacuuug

SEQ ID NO: 428313 - RNA, 61 nt, hsa
auuaagauuauccaaagucaggcugggcgcaguggcucacgccuguaaucccagcacuuug

SEQ ID NO: 428314 - RNA, 61 nt, hsa
guuaacaaaaaaguaagucuggccgggcaugguggcucaagccuguaaucccagcacuuug

SEQ ID NO: 428315 - RNA, 61 nt, hsa
auuugcgucaacauuauaaaagagcacuucuguggcucauuuaaaagaaaaaaaagguuaa

SEQ ID NO: 428316 - RNA, 61 nt, hsa
uaauagagaaaugcuguuuaggcugggcuugguggcucacaucuguaauaccagcgcuuug

SEQ ID NO: 428317 - RNA, 61 nt, hsa
uuuacaaaaagucacuuuugggcugggcgcaguggcucacgccuguaaucccagcacuuug

SEQ ID NO: 428318 - RNA, 61 nt, hsa
ucucauuuuacacaaagggaagucgggcaugguggcucaugccuguaaucucagcacuuug

SEQ ID NO: 428319 - RNA, 61 nt, hsa
aaaaaaaaaaaaaacuuuagaacugggugcaguggcucaugccuguaaucccagccagcac

SEQ ID NO: 428320 - RNA, 61 nt, hsa
gcuucaagaguccuuacugaagccaggcaccguggcucacgucuguaaucccagcgcuuug

SEQ ID NO: 428321 - RNA, 61 nt, hsa
uuuaaaagucugccuauccuggccaggugugguggcucacaccuguaaucccagcacuuug

SEQ ID NO: 428322 - RNA, 61 nt, hsa
ccagugaaaugauauauucuggcugggcacaguggcucacaccuguaauccuagcacuuug

SEQ ID NO: 428323 - RNA, 61 nt, hsa
aguucaagaaaaguacuucaggcugggcacaguggcucaugccugaaauccuagcacuuug

SEQ ID NO: 428324 - RNA, 61 nt, hsa
aaugguauuuagaaagcagcagucaggcacgguggcucaugccuguaaucccagcacuuug

SEQ ID NO: 428325 - RNA, 61 nt, hsa
aguaacuaaagguugguguuggccaggcaugguggcucaugccuguaaucccagcauuuug

SEQ ID NO: 428326 - RNA, 61 nt, hsa
cauacaagacuucaccauaaggccaggagcaguggcucacaccuuguaaucccagcacuuu

SEQ ID NO: 428327 - RNA, 61 nt, hsa
cauuuaagcgaaguaaaagaggccgggugcgguggcucacgccuguaaucccaacacuuua

SEQ ID NO: 428328 - RNA, 61 nt, hsa
uugucaaaguuguauggcugaggcccacacgguggcucacuucuguaaucccaucacuuug

SEQ ID NO: 428329 - RNA, 61 nt, hsa
ucuaucaaacaagaaaugcuggcuuggcccgguggcucaugccuguaaucccagcacugug

SEQ ID NO: 428330 - RNA, 61 nt, hsa
gguuuuaaaaucaaauuugaggccaggugcaguggcucaugggcggaggagggcagauuac

SEQ ID NO: 428331 - RNA, 61 nt, hsa
uuguauuacaaguugacaguugcuggguguaguggcucaugccuguaauccuagcaacucg

SEQ ID NO: 428332 - RNA, 61 nt, hsa
ucuaugaagaaaaaaaugcaggcugggcgcgguggcucacgccuguaauccuagcacuuug

SEQ ID NO: 428333 - RNA, 61 nt, hsa
uacuaaaaaauacaaaaauuagccaggugugguggcucacgcuuauguagucccaguuacu

SEQ ID NO: 428334 - RNA, 61 nt, hsa
aucaaagagaagaccauguuggccgggcgcgguggcucacgccugcagucccagcacuuug

SEQ ID NO: 428335 - RNA, 61 nt, hsa
guaauccuagcacuuugggaggcugaggcagguggcucacuugaggucaggaauucaagac

SEQ ID NO: 428336 - RNA, 61 nt, hsa
uguaugaaagucauguuacaggccgagugcgguggcucacaccuguaauccuagcacuuug

SEQ ID NO: 428337 - RNA, 61 nt, hsa
ugucaagaauuaaucuaggaggccgggccugguggcucacaccuguaaucccagcucuuug

SEQ ID NO: 428338 - RNA, 61 nt, hsa
auccucaaaacucagaacguggccgggcgugguggcucacgccuguaaucccagcacuuug

SEQ ID NO: 428339 - RNA, 61 nt, hsa
cacaaaauuuaaaaauuagcggccgggcgcaguggcucacgccuguaaucccagcacuuug

SEQ ID NO: 428340 - RNA, 61 nt, hsa
cauaaagagggaguuuugggggcugggcgccguggcucacucuuguaaucccaaaacuuua

SEQ ID NO: 428341 - RNA, 61 nt, hsa
auaaaaauagaagaagaaaaggccgggcaugguggcucaugccuguaaucccaacacuuug

SEQ ID NO: 428342 - RNA, 61 nt, hsa
guccucauaaaaaucuugagggccgggcaugguggcucacgccuguaaucucagcacuuug

SEQ ID NO: 428343 - RNA, 61 nt, hsa
aaucaaucaaucacuguccuggccaguugcaguggcucacgccuauaaucccaacacuucg

SEQ ID NO: 428344 - RNA, 61 nt, hsa
gccauaaaaaggcugaaggcagccgggcgcaguggcucacgccuguaaucccagcacuuug

SEQ ID NO: 428345 - RNA, 61 nt, hsa
ccaguuagaaaauaagucugggccggcggcgguggcucacaccugcauaggcagugcuuug

SEQ ID NO: 428346 - RNA, 61 nt, hsa
uuguuaagaagguucugccaggccgggcgcgguggcucacaccuguaaucccagcacuuug

SEQ ID NO: 428347 - RNA, 61 nt, hsa
agccuguauuaaaggaaucaggccaggcacaguggcucacgccuguaaucucagcacauug

SEQ ID NO: 428348 - RNA, 61 nt, hsa
uucuuuuacaaguaacucuaggcugggugugguggcucacgccuauaaucccagcacuuug

SEQ ID NO: 428349 - RNA, 61 nt, hsa
ucuuaauauucaugaccacuggccaggcgagguggcucacaccuguaaucccagcacuuug

SEQ ID NO: 428350 - RNA, 61 nt, hsa
ucucaaaaaaaaaaauaagaggccgggugcgguggcucaagccuguaaucccagcacuuug

SEQ ID NO: 428351 - RNA, 61 nt, hsa
caaguuaaagagguuuugcuggccagguaugguggcucacgccuguaaucccagcacuuug

SEQ ID NO: 428352 - RNA, 61 nt, hsa
cugagaucacaccaaaaugggguggggcgcaguggcucacgccuguaaucccagcacuuug

SEQ ID NO: 428353 - RNA, 61 nt, hsa
caugucuaaaagaaaauaugggccuggugugguggcucacaccuguaaucccaacacuuug

SEQ ID NO: 428354 - RNA, 61 nt, hsa
uagaaaguccuucacuacauggccaggugcaguggcucacgccuguagucccagguacuug

SEQ ID NO: 428355 - RNA, 61 nt, hsa
agacucacaagcugguccuuggccaggugcaguggcucacgccuguaaucccagcacuuug

SEQ ID NO: 428356 - RNA, 61 nt, hsa
ucuuuaaaaaaaaacaagacgggccggcacgguggcucacgccuguaaucccagcacugag

SEQ ID NO: 428357 - RNA, 61 nt, hsa
uuuauuaaaaacuuaagaugggccaggugcgguggcucacaccuguaaucccagcauuuug

SEQ ID NO: 428358 - RNA, 61 nt, hsa
gggaaagaguauaaauagccagccaggggcgguggcucaugccuguaaucccagcacuuug

SEQ ID NO: 428359 - RNA, 61 nt, hsa
uggcccuccugcugcugcugguccaggggguguggcucaguggcuggugguggaccuggag

SEQ ID NO: 428360 - RNA, 61 nt, hsa
acaauaaaagacuuggccuuggcugggcaugguggcucacgccuguaaucccagcacuuug

SEQ ID NO: 428361 - RNA, 61 nt, hsa
aaaaaaagacuuggccuuagggccgagugcgguggcucacgccuauaaucccagcacuuug

SEQ ID NO: 428362 - RNA, 61 nt, hsa
ugaacagauguuuuggcucuggcugggugugguggcucacaccuguaaucccagcacuuug

SEQ ID NO: 428363 - RNA, 61 nt, hsa
uguagaagcuauauguauauuuuguuaauuaguggcucauauuuaaaauaguucucugacu

SEQ ID NO: 428364 - RNA, 61 nt, hsa
guccucauaagauaaggagaggccaggccugguggcucacgccuguaaucccagcacuuua

SEQ ID NO: 428365 - RNA, 61 nt, hsa
uuaaaaagacgaaaagugacggccaggugcaguggcucacgccuauaaucucagcacucug

SEQ ID NO: 428366 - RNA, 61 nt, hsa
uaaaaaaagaagacgagagauagugggugugguggcucacaccugcaaucccagcacuuug

SEQ ID NO: 428367 - RNA, 61 nt, hsa
ucuaaaaugcaauaauaaugggccaggugaaguggcucacaccuguaaucccagcacugug

SEQ ID NO: 428368 - RNA, 61 nt, hsa
aaauaaauaaauaaaaugcgggccaggcacaguggcucacaccuguaaucccagcacuaug

SEQ ID NO: 428369 - RNA, 61 nt, hsa
uauagauuuuuaaaacugguggcugggcgugguggcucacgccuguaaucccagcacuuug

SEQ ID NO: 428370 - RNA, 61 nt, hsa
aauaaaaauaaaaauaaacuggccaggugcgguggcucacgcuugcaaucccagugcuuug

SEQ ID NO: 428371 - RNA, 61 nt, hsa
ggguucccacuacccccucuuuggggguagaguggcucauggaacucagagaaacauuuau

SEQ ID NO: 428372 - RNA, 61 nt, hsa
accuuggucacauugagucauuccaggaugaguggcucaaguauuuccucagggaaaauac

SEQ ID NO: 428373 - RNA, 61 nt, hsa
gcuuagaauaugacaugcugaaccaggcaugguggcucaugcuuguaaaccugaugcuuug

SEQ ID NO: 428374 - RNA, 61 nt, hsa
cuuuaagaaguaccugcaagggucaggcgcaguggcucacaccuguaaucccagcacuuug

SEQ ID NO: 428375 - RNA, 61 nt, hsa
acaaaaaaauuaaaaaauuuggccuggugugguggcucaugccugugauccuagcacuuug

SEQ ID NO: 428376 - RNA, 61 nt, hsa
gggacuuaaaaagauaaggaggccaggugugguggcucaugccugcaaucccagcacugua

SEQ ID NO: 428377 - RNA, 61 nt, hsa
aaaaagggggggcgggggacgggugggugcaguggcucacaucuguaaccccagcacuuug

SEQ ID NO: 428378 - RNA, 61 nt, hsa
uuauaagaucuaacccuuauggccaggugcaguggcucacguauguaaucccagcacuuug

SEQ ID NO: 428379 - RNA, 61 nt, hsa
uuggucaagagucaguuuggggccaggcgugguggcucaugccuguaaucucagcacuuug

SEQ ID NO: 428380 - RNA, 61 nt, hsa
guuuaaaaacaaaguuccccggccaggcacaguggcucacaccuguaaucccagcacuuug

SEQ ID NO: 428381 - RNA, 61 nt, hsa
ucucaaaaagaaaaaguuuggaucaggcaggguggcucacaccuguaaucccugcacuuug

SEQ ID NO: 428382 - RNA, 61 nt, hsa
cguuaaaaaaaaaaaguuugggccaggcacaguggcucaugccuguaaucccagcacuuug

SEQ ID NO: 428383 - RNA, 61 nt, hsa
gauguugaaagugaugcacaggacaggugugguggcucacaccuguaaucccagcacuuug

SEQ ID NO: 428384 - RNA, 61 nt, hsa
aaacaucaaauuugcgaugagaccagaugcuguggcucaggccuguaaucccauaauuuuc

SEQ ID NO: 428385 - RNA, 61 nt, hsa
aaugcgagaaauauaaaucaggccaggcacgguggcucacaccuguaaucccaguacuuug

SEQ ID NO: 428386 - RNA, 61 nt, hsa
guuuugaaauugaagagagaggccaggcgcgguggcucacaccuguaaucccagcacuuug

SEQ ID NO: 428387 - RNA, 61 nt, hsa
augggaagaaauucucuacuggccgggcacaguggcucacgccuguaaugccagcacuuug

SEQ ID NO: 428388 - RNA, 61 nt, hsa
gauagaaaccuuacaaaggacgccgggcgugguggcucacgccuguaaucccagcacuuug

SEQ ID NO: 428389 - RNA, 61 nt, hsa
uauuuaaaaaaagaaguuauggccgggcgcgguggcucaugccuguaauaccagcacuuug

SEQ ID NO: 428390 - RNA, 61 nt, hsa
ugugaauauaaaguuacauuggcugggugugguggcucaugccuauaaucccaguacuuua

SEQ ID NO: 428391 - RNA, 61 nt, hsa
ugcagggggaugggccagggccaggcuaaggguggcucaguuccaucaucuggaggucaga

SEQ ID NO: 428392 - RNA, 61 nt, hsa
ggggcaggcugggguguggguguggccugggguggcucagggcuggaacugcugccugauu

SEQ ID NO: 428393 - RNA, 61 nt, hsa
ucuuagaaaagccccagcauggccgggcaugguggcucaugccuauuaucccagcacuuug

SEQ ID NO: 428394 - RNA, 61 nt, hsa
gcauaccccccuguccagcagggcacuguggguggcucacccuagauuguggcccagaucu

SEQ ID NO: 428395 - RNA, 61 nt, hsa
agcugcauuacaaaaaagaagccugggcacuguggcucacuccuguaaucucagaacuuug

SEQ ID NO: 428396 - RNA, 61 nt, hsa
uccaauuaaugcagcccugaggugucuggcuguggcucaagauuuggccccaugcagaccc

SEQ ID NO: 428397 - RNA, 61 nt, hsa
gagaagagucuauuaugagcugguuacuacuguggcucaauccuauuggggaccuuuuaaa

SEQ ID NO: 428398 - RNA, 61 nt, hsa
gauaaggaugcacuggaagaacugccagaauguggcucaugcucugaguacuguuccugua

SEQ ID NO: 428399 - RNA, 61 nt, hsa
auuuaaaaaugaaauuacaggcccgggcacgguggcucacaccuguaaucccagcacuuug

SEQ ID NO: 428400 - RNA, 61 nt, hsa
cuuuuaaaaauauaaguuagggcuaggcacaguggcucaugccuauaaucucagcacuuuu

SEQ ID NO: 428401 - RNA, 61 nt, hsa
gcaacaacaaaaaauguuuaagccgggcgcgguggcucacaucuguaaucccagcacuuug

SEQ ID NO: 428402 - RNA, 61 nt, hsa
cuacaaaaaauacaaaaauuagccaugcaugguggcucaugccuguagucccagcuacuug

SEQ ID NO: 428403 - RNA, 61 nt, hsa
gggccugaggugcccagcucagggcagccagguggcucaugggcuguagugagccagcucc

SEQ ID NO: 428404 - RNA, 61 nt, hsa
acucagcccuuuauggcccauggggaacuccguggcucagggagagcugaacuccaggggu

SEQ ID NO: 428405 - RNA, 61 nt, hsa
auuauaaauucuuaguucagggcugggcgcgguggcucaugccuguaacccuagcacuuug

SEQ ID NO: 428406 - RNA, 61 nt, hsa
uuuuaaaaccuuaaaugucuggccgggugugguggcucaucccuauaauccuacacuuugg

SEQ ID NO: 428407 - RNA, 61 nt, hsa
uaauucccccuucucuggugccauaaauuauguggcucauaguaggugcaccauccaagga

SEQ ID NO: 428408 - RNA, 61 nt, hsa
gagacuccgucucaaaacaaaacaaaaguggguggcucacggguccggagguuaugucuuc

SEQ ID NO: 428409 - RNA, 61 nt, hsa
gguccuuaaaacugggcgguggccgggcgugguggcucacgcugaggucaggaguucgaga

SEQ ID NO: 428410 - RNA, 64 nt, hsa; identical to SEQ ID NO: 171895

SEQ ID NO: 428411 - RNA, 64 nt, hsa; identical to SEQ ID NO: 171896

SEQ ID NO: 428412 - RNA, 64 nt, hsa; identical to SEQ ID NO: 171897

SEQ ID NO: 428413 - RNA, 64 nt, hsa; identical to SEQ ID NO: 171898

SEQ ID NO: 428414 - RNA, 64 nt, hsa; identical to SEQ ID NO: 171899

SEQ ID NO: 428415 - RNA, 64 nt, hsa; identical to SEQ ID NO: 171900

SEQ ID NO: 428416 - RNA, 64 nt, hsa
aaggcugcccccugccccagggcucuucagaaagcaucugcaugugaacaccaucaugccuuua

SEQ ID NO: 428417 - RNA, 64 nt, hsa
agaagaggaaaggccagacuuugcuuaccaucagcaucugcaaugggccaaacacaccucaaau

SEQ ID NO: 428418 - RNA, 64 nt, hsa
uugcuuguagaaaacaugguaggcuuccccaaggcaucugcagggaacuuuggcagcuuggggc

SEQ ID NO: 428419 - RNA, 64 nt, hsa
auugcugccugcccucucuccuccugaacucucucaucugcaguggggcaucgucugucuugcc

SEQ ID NO: 428420 - RNA, 64 nt, hsa
cucauuuugucugguccugaucccagacucaccccaucugcagcaagacccuuggcuggcuucc

SEQ ID NO: 428421 - RNA, 64 nt, hsa
gugccaacauguggggcgaguacugggacaaccucaucugcacgguaaggguacacaagagggc

SEQ ID NO: 428422 - RNA, 64 nt, hsa
cauaggccgacccuuccuuaggccucagcuuucccaucugcacccugcagcaucucuaagggcc

SEQ ID NO: 428423 - RNA, 64 nt, hsa
accacuggagagacacucagaaggacuucccugacaucugcaccaaggagagucuggacaaagc

SEQ ID NO: 428424 - RNA, 64 nt, hsa
acacuucauccugaugccaagauuuuuuggagaacaucugcacuuucuuauauauauauauaau

SEQ ID NO: 428425 - RNA, 64 nt, hsa
ucucacucacuaucuugucucucauacacauauccaucugcagaccauggucccuaaaccugca

SEQ ID NO: 428426 - RNA, 64 nt, hsa
ccucagaugagggggccccaaaauugauagugcacaucugcacgcuuucugcgaggccucagaa

SEQ ID NO: 428427 - RNA, 64 nt, hsa
uugcuagcuuguaaaaggcgaaugugaaauauugcaucugcauuuuccaaggcugauucgugua

SEQ ID NO: 428428 - RNA, 64 nt, hsa
aaccgagacucuucucuguuuccugccaagaccucaucugcacuaaugccuucucccugaccuu

SEQ ID NO: 428429 - RNA, 64 nt, hsa
ucccagauaugguccgccuuuggcauuguguguacaucugcaguuuugcaugguggguuguuaa

SEQ ID NO: 428430 - RNA, 64 nt, hsa
agaacccaucccucugguggguaccucuggcacccaucugcaaauaucucccucucuccaacaa

SEQ ID NO: 428431 - RNA, 64 nt, hsa
gaagucacuuauccucuuggagccucaguuuccucaucugcagaauaaugacugacuugucuaa

SEQ ID NO: 428432 - RNA, 64 nt, hsa
gaaauuaauguuacauuuuccagcuguaaacagacaucugcauuuccuagugagcugccaggag

SEQ ID NO: 428433 - RNA, 64 nt, hsa
ucuguagccccuccgcucuacucauuccuuccaccaucugcagagauuugaaguuuggggcuau

SEQ ID NO: 428434 - RNA, 64 nt, hsa
gaaacaugacagugcuuaucucaaacagauuacccaucugcagaacuaaggaaagcaauuuaug

SEQ ID NO: 428435 - RNA, 64 nt, hsa
ucacuugagucuaggaguucggggcugcagcuaucaucugcagcuauaaucauagcucacugca

SEQ ID NO: 428436 - RNA, 64 nt, hsa
ugaguaauggauuaagugaaaauccaggaguauccaucugcaguuaugugcugaggugauaauu

SEQ ID NO: 428437 - RNA, 64 nt, hsa
guuguguaguuacaucaauuugaugcaugcuuuccaucugcacuccagacggcuuucucaguuc

SEQ ID NO: 428438 - RNA, 64 nt, hsa
aagaagguugucagcugcagccacuuucugccagcaucugcagccacuuucugccagcaucugc

SEQ ID NO: 428439 - RNA, 64 nt, hsa
cuuucugccagcaucugcagccacuuucugccagcaucugcagccagcaagcugggacuggcag

SEQ ID NO: 428440 - RNA, 64 nt, hsa
cauuuuuaggucuuugugccaccaccacgaggggcaucugcaaagagggcaacgcuagacacag

SEQ ID NO: 428441 - RNA, 64 nt, hsa
ccugggccucuguuccuccaaagaccugccugcccaucugcauaggagaugaaggcugggguua

SEQ ID NO: 428442 - RNA, 64 nt, hsa
ccuacugcaucaucugcgucagccgguccuagcccaucugcagggugaaagaacucaucaagag

SEQ ID NO: 428443 - RNA, 64 nt, hsa
ucucuaagggcaauggcauugcucccuacccauucaucugcaugagcuacucuuggcuuccuua

SEQ ID NO: 428444 - RNA, 64 nt, hsa; identical to SEQ ID NO: 146830

SEQ ID NO: 428445 - RNA, 64 nt, hsa; identical to SEQ ID NO: 146831

SEQ ID NO: 428446 - RNA, 64 nt, hsa; identical to SEQ ID NO: 146832

SEQ ID NO: 428447 - RNA, 64 nt, hsa; identical to SEQ ID NO: 146833

SEQ ID NO: 428448 - RNA, 64 nt, hsa; identical to SEQ ID NO: 146834

SEQ ID NO: 428449 - RNA, 64 nt, hsa; identical to SEQ ID NO: 146835

SEQ ID NO: 428450 - RNA, 64 nt, hsa; identical to SEQ ID NO: 146836

SEQ ID NO: 428451 - RNA, 64 nt, hsa; identical to SEQ ID NO: 146837

SEQ ID NO: 428452 - RNA, 64 nt, hsa; identical to SEQ ID NO: 146838

SEQ ID NO: 428453 - RNA, 64 nt, hsa; identical to SEQ ID NO: 146839

SEQ ID NO: 428454 - RNA, 64 nt, hsa; identical to SEQ ID NO: 146840

SEQ ID NO: 428455 - RNA, 64 nt, hsa; identical to SEQ ID NO: 146841

SEQ ID NO: 428456 - RNA, 64 nt, hsa; identical to SEQ ID NO: 146842

SEQ ID NO: 428457 - RNA, 64 nt, hsa; identical to SEQ ID NO: 146843

SEQ ID NO: 428458 - RNA, 64 nt, hsa; identical to SEQ ID NO: 146844

SEQ ID NO: 428459 - RNA, 64 nt, hsa; identical to SEQ ID NO: 146845

SEQ ID NO: 428460 - RNA, 64 nt, hsa; identical to SEQ ID NO: 146846

SEQ ID NO: 428461 - RNA, 64 nt, hsa; identical to SEQ ID NO: 146847

SEQ ID NO: 428462 - RNA, 64 nt, hsa; identical to SEQ ID NO: 146848

SEQ ID NO: 428463 - RNA, 64 nt, hsa; identical to SEQ ID NO: 146849

SEQ ID NO: 428464 - RNA, 64 nt, hsa; identical to SEQ ID NO: 146850

SEQ ID NO: 428465 - RNA, 64 nt, hsa; identical to SEQ ID NO: 146851

SEQ ID NO: 428466 - RNA, 64 nt, hsa; identical to SEQ ID NO: 146852

SEQ ID NO: 428467 - RNA, 64 nt, hsa; identical to SEQ ID NO: 146853

SEQ ID NO: 428468 - RNA, 64 nt, hsa; identical to SEQ ID NO: 146854

SEQ ID NO: 428469 - RNA, 64 nt, hsa; identical to SEQ ID NO: 146855

SEQ ID NO: 428470 - RNA, 64 nt, hsa; identical to SEQ ID NO: 146856

SEQ ID NO: 428471 - RNA, 64 nt, hsa; identical to SEQ ID NO: 146857

SEQ ID NO: 428472 - RNA, 64 nt, hsa; identical to SEQ ID NO: 146858

SEQ ID NO: 428473 - RNA, 64 nt, hsa; identical to SEQ ID NO: 146859

SEQ ID NO: 428474 - RNA, 64 nt, hsa; identical to SEQ ID NO: 146860

SEQ ID NO: 428475 - RNA, 64 nt, hsa; identical to SEQ ID NO: 146861

SEQ ID NO: 428476 - RNA, 64 nt, hsa; identical to SEQ ID NO: 146862

SEQ ID NO: 428477 - RNA, 64 nt, hsa; identical to SEQ ID NO: 146863

SEQ ID NO: 428478 - RNA, 64 nt, hsa; identical to SEQ ID NO: 146864

SEQ ID NO: 428479 - RNA, 64 nt, hsa; identical to SEQ ID NO: 146865

SEQ ID NO: 428480 - RNA, 64 nt, hsa; identical to SEQ ID NO: 146866

SEQ ID NO: 428481 - RNA, 64 nt, hsa; identical to SEQ ID NO: 146867

SEQ ID NO: 428482 - RNA, 64 nt, hsa; identical to SEQ ID NO: 146868

SEQ ID NO: 428483 - RNA, 64 nt, hsa; identical to SEQ ID NO: 146869

SEQ ID NO: 428484 - RNA, 64 nt, hsa; identical to SEQ ID NO: 146870

SEQ ID NO: 428485 - RNA, 64 nt, hsa; identical to SEQ ID NO: 146871

SEQ ID NO: 428486 - RNA, 64 nt, hsa; identical to SEQ ID NO: 146872

SEQ ID NO: 428487 - RNA, 64 nt, hsa; identical to SEQ ID NO: 146873

SEQ ID NO: 428488 - RNA, 64 nt, hsa; identical to SEQ ID NO: 146874

SEQ ID NO: 428489 - RNA, 64 nt, hsa; identical to SEQ ID NO: 146875

SEQ ID NO: 428490 - RNA, 64 nt, hsa; identical to SEQ ID NO: 146876

SEQ ID NO: 428491 - RNA, 64 nt, hsa; identical to SEQ ID NO: 146877

SEQ ID NO: 428492 - RNA, 64 nt, hsa; identical to SEQ ID NO: 146878

SEQ ID NO: 428493 - RNA, 64 nt, hsa; identical to SEQ ID NO: 85756

SEQ ID NO: 428494 - RNA, 64 nt, hsa; identical to SEQ ID NO: 85757

SEQ ID NO: 428495 - RNA, 64 nt, hsa; identical to SEQ ID NO: 85758

SEQ ID NO: 428496 - RNA, 64 nt, hsa; identical to SEQ ID NO: 85759

SEQ ID NO: 428497 - RNA, 64 nt, hsa; identical to SEQ ID NO: 85760

SEQ ID NO: 428498 - RNA, 64 nt, hsa; identical to SEQ ID NO: 85761

SEQ ID NO: 428499 - RNA, 64 nt, hsa; identical to SEQ ID NO: 85762

SEQ ID NO: 428500 - RNA, 64 nt, hsa; identical to SEQ ID NO: 85763

SEQ ID NO: 428501 - RNA, 64 nt, hsa; identical to SEQ ID NO: 85764

SEQ ID NO: 428502 - RNA, 64 nt, hsa; identical to SEQ ID NO: 85765

SEQ ID NO: 428503 - RNA, 64 nt, hsa; identical to SEQ ID NO: 85766

SEQ ID NO: 428504 - RNA, 64 nt, hsa; identical to SEQ ID NO: 85767

SEQ ID NO: 428505 - RNA, 64 nt, hsa; identical to SEQ ID NO: 85768

SEQ ID NO: 428506 - RNA, 64 nt, hsa; identical to SEQ ID NO: 85769

SEQ ID NO: 428507 - RNA, 64 nt, hsa; identical to SEQ ID NO: 110836

SEQ ID NO: 428508 - RNA, 64 nt, hsa; identical to SEQ ID NO: 110837

SEQ ID NO: 428509 - RNA, 64 nt, hsa; identical to SEQ ID NO: 110838

SEQ ID NO: 428510 - RNA, 64 nt, hsa; identical to SEQ ID NO: 110839

SEQ ID NO: 428511 - RNA, 64 nt, hsa; identical to SEQ ID NO: 110840

SEQ ID NO: 428512 - RNA, 64 nt, hsa; identical to SEQ ID NO: 110841

SEQ ID NO: 428513 - RNA, 64 nt, hsa; identical to SEQ ID NO: 110842

SEQ ID NO: 428514 - RNA, 64 nt, hsa; identical to SEQ ID NO: 110843

SEQ ID NO: 428515 - RNA, 64 nt, hsa; identical to SEQ ID NO: 110844

SEQ ID NO: 428516 - RNA, 64 nt, hsa; identical to SEQ ID NO: 110845

SEQ ID NO: 428517 - RNA, 64 nt, hsa; identical to SEQ ID NO: 110846

SEQ ID NO: 428518 - RNA, 64 nt, hsa; identical to SEQ ID NO: 110847

SEQ ID NO: 428519 - RNA, 64 nt, hsa; identical to SEQ ID NO: 110848

SEQ ID NO: 428520 - RNA, 64 nt, hsa; identical to SEQ ID NO: 110849

SEQ ID NO: 428521 - RNA, 64 nt, hsa; identical to SEQ ID NO: 110850

SEQ ID NO: 428522 - RNA, 64 nt, hsa; identical to SEQ ID NO: 110851

SEQ ID NO: 428523 - RNA, 64 nt, hsa; identical to SEQ ID NO: 110852

SEQ ID NO: 428524 - RNA, 64 nt, hsa; identical to SEQ ID NO: 110853

SEQ ID NO: 428525 - RNA, 64 nt, hsa; identical to SEQ ID NO: 110854

SEQ ID NO: 428526 - RNA, 64 nt, hsa; identical to SEQ ID NO: 110855

SEQ ID NO: 428527 - RNA, 64 nt, hsa; identical to SEQ ID NO: 110856

SEQ ID NO: 428528 - RNA, 64 nt, hsa; identical to SEQ ID NO: 110857

SEQ ID NO: 428529 - RNA, 50 nt, hsa; identical to SEQ ID NO: 110858

SEQ ID NO: 428530 - RNA, 64 nt, hsa; identical to SEQ ID NO: 110859

SEQ ID NO: 428531 - RNA, 64 nt, hsa; identical to SEQ ID NO: 110860

SEQ ID NO: 428532 - RNA, 64 nt, hsa; identical to SEQ ID NO: 110861

SEQ ID NO: 428533 - RNA, 64 nt, hsa; identical to SEQ ID NO: 110862

SEQ ID NO: 428534 - RNA, 64 nt, hsa; identical to SEQ ID NO: 110863

SEQ ID NO: 428535 - RNA, 64 nt, hsa; identical to SEQ ID NO: 110864

SEQ ID NO: 428536 - RNA, 64 nt, hsa; identical to SEQ ID NO: 110865

SEQ ID NO: 428537 - RNA, 64 nt, hsa; identical to SEQ ID NO: 110866

SEQ ID NO: 428538 - RNA, 64 nt, hsa; identical to SEQ ID NO: 110867

SEQ ID NO: 428539 - RNA, 61 nt, hsa; identical to SEQ ID NO: 110868

SEQ ID NO: 428540 - RNA, 64 nt, hsa; identical to SEQ ID NO: 110869

SEQ ID NO: 428541 - RNA, 64 nt, hsa; identical to SEQ ID NO: 110870

SEQ ID NO: 428542 - RNA, 64 nt, hsa; identical to SEQ ID NO: 110871

SEQ ID NO: 428543 - RNA, 64 nt, hsa; identical to SEQ ID NO: 110872

SEQ ID NO: 428544 - RNA, 64 nt, hsa; identical to SEQ ID NO: 110873

SEQ ID NO: 428545 - RNA, 64 nt, hsa; identical to SEQ ID NO: 110874

SEQ ID NO: 428546 - RNA, 64 nt, hsa; identical to SEQ ID NO: 110875

SEQ ID NO: 428547 - RNA, 64 nt, hsa; identical to SEQ ID NO: 110876

SEQ ID NO: 428548 - RNA, 64 nt, hsa; identical to SEQ ID NO: 110877

SEQ ID NO: 428549 - RNA, 64 nt, hsa; identical to SEQ ID NO: 110878

SEQ ID NO: 428550 - RNA, 64 nt, hsa; identical to SEQ ID NO: 110879

SEQ ID NO: 428551 - RNA, 64 nt, hsa; identical to SEQ ID NO: 110880

SEQ ID NO: 428552 - RNA, 64 nt, hsa; identical to SEQ ID NO: 110881

SEQ ID NO: 428553 - RNA, 55 nt, hsa; identical to SEQ ID NO: 110882

SEQ ID NO: 428554 - RNA, 64 nt, hsa; identical to SEQ ID NO: 110883

SEQ ID NO: 428555 - RNA, 64 nt, hsa; identical to SEQ ID NO: 110884

SEQ ID NO: 428556 - RNA, 64 nt, hsa; identical to SEQ ID NO: 110885

SEQ ID NO: 428557 - RNA, 64 nt, hsa; identical to SEQ ID NO: 110886

SEQ ID NO: 428558 - RNA, 64 nt, hsa; identical to SEQ ID NO: 110887

SEQ ID NO: 428559 - RNA, 64 nt, hsa; identical to SEQ ID NO: 110888

SEQ ID NO: 428560 - RNA, 64 nt, hsa; identical to SEQ ID NO: 110889

SEQ ID NO: 428561 - RNA, 64 nt, hsa; identical to SEQ ID NO: 110890

SEQ ID NO: 428562 - RNA, 61 nt, hsa; identical to SEQ ID NO: 110891

SEQ ID NO: 428563 - RNA, 64 nt, hsa; identical to SEQ ID NO: 110892

SEQ ID NO: 428564 - RNA, 64 nt, hsa; identical to SEQ ID NO: 110893

SEQ ID NO: 428565 - RNA, 64 nt, hsa; identical to SEQ ID NO: 110894

SEQ ID NO: 428566 - RNA, 64 nt, hsa; identical to SEQ ID NO: 110895

SEQ ID NO: 428567 - RNA, 64 nt, hsa; identical to SEQ ID NO: 110896

SEQ ID NO: 428568 - RNA, 64 nt, hsa; identical to SEQ ID NO: 110897

SEQ ID NO: 428569 - RNA, 64 nt, hsa; identical to SEQ ID NO: 110898

SEQ ID NO: 428570 - RNA, 64 nt, hsa; identical to SEQ ID NO: 110899

SEQ ID NO: 428571 - RNA, 64 nt, hsa; identical to SEQ ID NO: 110900

SEQ ID NO: 428572 - RNA, 64 nt, hsa; identical to SEQ ID NO: 110901

SEQ ID NO: 428573 - RNA, 64 nt, hsa; identical to SEQ ID NO: 110902

SEQ ID NO: 428574 - RNA, 64 nt, hsa; identical to SEQ ID NO: 110903

SEQ ID NO: 428575 - RNA, 64 nt, hsa; identical to SEQ ID NO: 110904

SEQ ID NO: 428576 - RNA, 64 nt, hsa; identical to SEQ ID NO: 110905

SEQ ID NO: 428577 - RNA, 64 nt, hsa; identical to SEQ ID NO: 110906

SEQ ID NO: 428578 - RNA, 64 nt, hsa; identical to SEQ ID NO: 110907

SEQ ID NO: 428579 - RNA, 64 nt, hsa; identical to SEQ ID NO: 110908

SEQ ID NO: 428580 - RNA, 64 nt, hsa; identical to SEQ ID NO: 110909

SEQ ID NO: 428581 - RNA, 64 nt, hsa; identical to SEQ ID NO: 110910

SEQ ID NO: 428582 - RNA, 64 nt, hsa; identical to SEQ ID NO: 110911

SEQ ID NO: 428583 - RNA, 64 nt, hsa; identical to SEQ ID NO: 110912

SEQ ID NO: 428584 - RNA, 64 nt, hsa; identical to SEQ ID NO: 110913

SEQ ID NO: 428585 - RNA, 64 nt, hsa; identical to SEQ ID NO: 110914

SEQ ID NO: 428586 - RNA, 64 nt, hsa; identical to SEQ ID NO: 110915

SEQ ID NO: 428587 - RNA, 64 nt, hsa; identical to SEQ ID NO: 110916

SEQ ID NO: 428588 - RNA, 64 nt, hsa; identical to SEQ ID NO: 84269

SEQ ID NO: 428589 - RNA, 64 nt, hsa; identical to SEQ ID NO: 84270

SEQ ID NO: 428590 - RNA, 64 nt, hsa; identical to SEQ ID NO: 84271

SEQ ID NO: 428591 - RNA, 64 nt, hsa; identical to SEQ ID NO: 84272

SEQ ID NO: 428592 - RNA, 64 nt, hsa; identical to SEQ ID NO: 84273

SEQ ID NO: 428593 - RNA, 64 nt, hsa; identical to SEQ ID NO: 84274

SEQ ID NO: 428594 - RNA, 64 nt, hsa; identical to SEQ ID NO: 84275

SEQ ID NO: 428595 - RNA, 64 nt, hsa; identical to SEQ ID NO: 84276

SEQ ID NO: 428596 - RNA, 64 nt, hsa; identical to SEQ ID NO: 84277

SEQ ID NO: 428597 - RNA, 64 nt, hsa; identical to SEQ ID NO: 84278

SEQ ID NO: 428598 - RNA, 64 nt, hsa; identical to SEQ ID NO: 84279

SEQ ID NO: 428599 - RNA, 64 nt, hsa; identical to SEQ ID NO: 84280

SEQ ID NO: 428600 - RNA, 64 nt, hsa; identical to SEQ ID NO: 84281

SEQ ID NO: 428601 - RNA, 64 nt, hsa; identical to SEQ ID NO: 84282

SEQ ID NO: 428602 - RNA, 64 nt, hsa; identical to SEQ ID NO: 84283

SEQ ID NO: 428603 - RNA, 64 nt, hsa; identical to SEQ ID NO: 84284

SEQ ID NO: 428604 - RNA, 64 nt, hsa; identical to SEQ ID NO: 84285

SEQ ID NO: 428605 - RNA, 64 nt, hsa; identical to SEQ ID NO: 84286

SEQ ID NO: 428606 - RNA, 64 nt, hsa; identical to SEQ ID NO: 84287

SEQ ID NO: 428607 - RNA, 64 nt, hsa; identical to SEQ ID NO: 84288

SEQ ID NO: 428608 - RNA, 64 nt, hsa; identical to SEQ ID NO: 127802

SEQ ID NO: 428609 - RNA, 64 nt, hsa; identical to SEQ ID NO: 127803

SEQ ID NO: 428610 - RNA, 64 nt, hsa; identical to SEQ ID NO: 127804

SEQ ID NO: 428611 - RNA, 64 nt, hsa; identical to SEQ ID NO: 127805

SEQ ID NO: 428612 - RNA, 64 nt, hsa; identical to SEQ ID NO: 127806

SEQ ID NO: 428613 - RNA, 64 nt, hsa; identical to SEQ ID NO: 127807

SEQ ID NO: 428614 - RNA, 64 nt, hsa; identical to SEQ ID NO: 127808

SEQ ID NO: 428615 - RNA, 64 nt, hsa; identical to SEQ ID NO: 127809

SEQ ID NO: 428616 - RNA, 64 nt, hsa; identical to SEQ ID NO: 127810

SEQ ID NO: 428617 - RNA, 64 nt, hsa; identical to SEQ ID NO: 127811

SEQ ID NO: 428618 - RNA, 64 nt, hsa; identical to SEQ ID NO: 127812

SEQ ID NO: 428619 - RNA, 64 nt, hsa; identical to SEQ ID NO: 127813

SEQ ID NO: 428620 - RNA, 64 nt, hsa; identical to SEQ ID NO: 127814

SEQ ID NO: 428621 - RNA, 64 nt, hsa; identical to SEQ ID NO: 127815

SEQ ID NO: 428622 - RNA, 64 nt, hsa; identical to SEQ ID NO: 127816

SEQ ID NO: 428623 - RNA, 64 nt, hsa; identical to SEQ ID NO: 127817

SEQ ID NO: 428624 - RNA, 64 nt, hsa; identical to SEQ ID NO: 127818

SEQ ID NO: 428625 - RNA, 64 nt, hsa; identical to SEQ ID NO: 127819

SEQ ID NO: 428626 - RNA, 64 nt, hsa; identical to SEQ ID NO: 127820

SEQ ID NO: 428627 - RNA, 64 nt, hsa; identical to SEQ ID NO: 127821

SEQ ID NO: 428628 - RNA, 64 nt, hsa; identical to SEQ ID NO: 127822

SEQ ID NO: 428629 - RNA, 64 nt, hsa; identical to SEQ ID NO: 127823

SEQ ID NO: 428630 - RNA, 64 nt, hsa; identical to SEQ ID NO: 127824

SEQ ID NO: 428631 - RNA, 64 nt, hsa; identical to SEQ ID NO: 127825

SEQ ID NO: 428632 - RNA, 64 nt, hsa; identical to SEQ ID NO: 127826

SEQ ID NO: 428633 - RNA, 64 nt, hsa; identical to SEQ ID NO: 127827

SEQ ID NO: 428634 - RNA, 64 nt, hsa; identical to SEQ ID NO: 127828

SEQ ID NO: 428635 - RNA, 64 nt, hsa; identical to SEQ ID NO: 127829

SEQ ID NO: 428636 - RNA, 64 nt, hsa; identical to SEQ ID NO: 127830

SEQ ID NO: 428637 - RNA, 64 nt, hsa; identical to SEQ ID NO: 127831

SEQ ID NO: 428638 - RNA, 64 nt, hsa; identical to SEQ ID NO: 127832

SEQ ID NO: 428639 - RNA, 64 nt, hsa; identical to SEQ ID NO: 127833

SEQ ID NO: 428640 - RNA, 64 nt, hsa; identical to SEQ ID NO: 127834

SEQ ID NO: 428641 - RNA, 64 nt, hsa; identical to SEQ ID NO: 127835

SEQ ID NO: 428642 - RNA, 64 nt, hsa; identical to SEQ ID NO: 127836

SEQ ID NO: 428643 - RNA, 64 nt, hsa; identical to SEQ ID NO: 127837

SEQ ID NO: 428644 - RNA, 64 nt, hsa; identical to SEQ ID NO: 127838

SEQ ID NO: 428645 - RNA, 64 nt, hsa; identical to SEQ ID NO: 127839

SEQ ID NO: 428646 - RNA, 64 nt, hsa; identical to SEQ ID NO: 127840

SEQ ID NO: 428647 - RNA, 64 nt, hsa; identical to SEQ ID NO: 127841

SEQ ID NO: 428648 - RNA, 64 nt, hsa; identical to SEQ ID NO: 127842

SEQ ID NO: 428649 - RNA, 64 nt, hsa; identical to SEQ ID NO: 127843

SEQ ID NO: 428650 - RNA, 64 nt, hsa; identical to SEQ ID NO: 127844

SEQ ID NO: 428651 - RNA, 64 nt, hsa; identical to SEQ ID NO: 127845

SEQ ID NO: 428652 - RNA, 64 nt, hsa; identical to SEQ ID NO: 127846

SEQ ID NO: 428653 - RNA, 64 nt, hsa; identical to SEQ ID NO: 127847

SEQ ID NO: 428654 - RNA, 64 nt, hsa; identical to SEQ ID NO: 127848

SEQ ID NO: 428655 - RNA, 64 nt, hsa; identical to SEQ ID NO: 127849

SEQ ID NO: 428656 - RNA, 64 nt, hsa; identical to SEQ ID NO: 127850

SEQ ID NO: 428657 - RNA, 64 nt, hsa; identical to SEQ ID NO: 127851

SEQ ID NO: 428658 - RNA, 64 nt, hsa; identical to SEQ ID NO: 127852

SEQ ID NO: 428659 - RNA, 64 nt, hsa; identical to SEQ ID NO: 127853

SEQ ID NO: 428660 - RNA, 64 nt, hsa; identical to SEQ ID NO: 127854

SEQ ID NO: 428661 - RNA, 64 nt, hsa; identical to SEQ ID NO: 127855

SEQ ID NO: 428662 - RNA, 64 nt, hsa; identical to SEQ ID NO: 127856

SEQ ID NO: 428663 - RNA, 64 nt, hsa; identical to SEQ ID NO: 127857

SEQ ID NO: 428664 - RNA, 64 nt, hsa; identical to SEQ ID NO: 127858

SEQ ID NO: 428665 - RNA, 64 nt, hsa; identical to SEQ ID NO: 127859

SEQ ID NO: 428666 - RNA, 64 nt, hsa; identical to SEQ ID NO: 127860

SEQ ID NO: 428667 - RNA, 64 nt, hsa; identical to SEQ ID NO: 127861

SEQ ID NO: 428668 - RNA, 64 nt, hsa; identical to SEQ ID NO: 127862

SEQ ID NO: 428669 - RNA, 64 nt, hsa; identical to SEQ ID NO: 127863

SEQ ID NO: 428670 - RNA, 64 nt, hsa; identical to SEQ ID NO: 127864

SEQ ID NO: 428671 - RNA, 64 nt, hsa; identical to SEQ ID NO: 127865

SEQ ID NO: 428672 - RNA, 64 nt, hsa; identical to SEQ ID NO: 127866

SEQ ID NO: 428673 - RNA, 64 nt, hsa; identical to SEQ ID NO: 127867

SEQ ID NO: 428674 - RNA, 64 nt, hsa; identical to SEQ ID NO: 127868

SEQ ID NO: 428675 - RNA, 64 nt, hsa; identical to SEQ ID NO: 127869

SEQ ID NO: 428676 - RNA, 64 nt, hsa; identical to SEQ ID NO: 127870

SEQ ID NO: 428677 - RNA, 64 nt, hsa; identical to SEQ ID NO: 127871

SEQ ID NO: 428678 - RNA, 64 nt, hsa; identical to SEQ ID NO: 127872

SEQ ID NO: 428679 - RNA, 64 nt, hsa; identical to SEQ ID NO: 127873

SEQ ID NO: 428680 - RNA, 64 nt, hsa; identical to SEQ ID NO: 127874

SEQ ID NO: 428681 - RNA, 64 nt, hsa; identical to SEQ ID NO: 127875

SEQ ID NO: 428682 - RNA, 64 nt, hsa; identical to SEQ ID NO: 127876

SEQ ID NO: 428683 - RNA, 64 nt, hsa; identical to SEQ ID NO: 127877

SEQ ID NO: 428684 - RNA, 64 nt, hsa; identical to SEQ ID NO: 127878

SEQ ID NO: 428685 - RNA, 52 nt, hsa; identical to SEQ ID NO: 127879

SEQ ID NO: 428686 - RNA, 64 nt, hsa; identical to SEQ ID NO: 127880

SEQ ID NO: 428687 - RNA, 64 nt, hsa; identical to SEQ ID NO: 127881

SEQ ID NO: 428688 - RNA, 64 nt, hsa; identical to SEQ ID NO: 127882

SEQ ID NO: 428689 - RNA, 64 nt, hsa; identical to SEQ ID NO: 127883

SEQ ID NO: 428690 - RNA, 64 nt, hsa; identical to SEQ ID NO: 127884

SEQ ID NO: 428691 - RNA, 64 nt, hsa; identical to SEQ ID NO: 127885

SEQ ID NO: 428692 - RNA, 64 nt, hsa; identical to SEQ ID NO: 127886

SEQ ID NO: 428693 - RNA, 64 nt, hsa; identical to SEQ ID NO: 127887

SEQ ID NO: 428694 - RNA, 64 nt, hsa; identical to SEQ ID NO: 127888

SEQ ID NO: 428695 - RNA, 64 nt, hsa; identical to SEQ ID NO: 127889

SEQ ID NO: 428696 - RNA, 64 nt, hsa; identical to SEQ ID NO: 127890

SEQ ID NO: 428697 - RNA, 64 nt, hsa; identical to SEQ ID NO: 127891

SEQ ID NO: 428698 - RNA, 64 nt, hsa; identical to SEQ ID NO: 127892

SEQ ID NO: 428699 - RNA, 64 nt, hsa; identical to SEQ ID NO: 127893

SEQ ID NO: 428700 - RNA, 64 nt, hsa; identical to SEQ ID NO: 127894

SEQ ID NO: 428701 - RNA, 64 nt, hsa; identical to SEQ ID NO: 127895

SEQ ID NO: 428702 - RNA, 64 nt, hsa; identical to SEQ ID NO: 127896

SEQ ID NO: 428703 - RNA, 64 nt, hsa; identical to SEQ ID NO: 127897

SEQ ID NO: 428704 - RNA, 64 nt, hsa; identical to SEQ ID NO: 127898

SEQ ID NO: 428705 - RNA, 64 nt, hsa; identical to SEQ ID NO: 127899

SEQ ID NO: 428706 - RNA, 64 nt, hsa; identical to SEQ ID NO: 127900

SEQ ID NO: 428707 - RNA, 64 nt, hsa; identical to SEQ ID NO: 127901

SEQ ID NO: 428708 - RNA, 64 nt, hsa; identical to SEQ ID NO: 127902

SEQ ID NO: 428709 - RNA, 64 nt, hsa; identical to SEQ ID NO: 127903

SEQ ID NO: 428710 - RNA, 64 nt, hsa; identical to SEQ ID NO: 127904

SEQ ID NO: 428711 - RNA, 64 nt, hsa; identical to SEQ ID NO: 127905

SEQ ID NO: 428712 - RNA, 64 nt, hsa; identical to SEQ ID NO: 127906

SEQ ID NO: 428713 - RNA, 64 nt, hsa; identical to SEQ ID NO: 127907

SEQ ID NO: 428714 - RNA, 64 nt, hsa; identical to SEQ ID NO: 127908

SEQ ID NO: 428715 - RNA, 64 nt, hsa; identical to SEQ ID NO: 127909

SEQ ID NO: 428716 - RNA, 64 nt, hsa; identical to SEQ ID NO: 127910

SEQ ID NO: 428717 - RNA, 64 nt, hsa; identical to SEQ ID NO: 127826

SEQ ID NO: 428718 - RNA, 64 nt, hsa; identical to SEQ ID NO: 127912

SEQ ID NO: 428719 - RNA, 64 nt, hsa; identical to SEQ ID NO: 127913

SEQ ID NO: 428720 - RNA, 64 nt, hsa; identical to SEQ ID NO: 127914

SEQ ID NO: 428721 - RNA, 64 nt, hsa; identical to SEQ ID NO: 127915

SEQ ID NO: 428722 - RNA, 64 nt, hsa; identical to SEQ ID NO: 127916

SEQ ID NO: 428723 - RNA, 64 nt, hsa; identical to SEQ ID NO: 127917

SEQ ID NO: 428724 - RNA, 64 nt, hsa; identical to SEQ ID NO: 127918

SEQ ID NO: 428725 - RNA, 64 nt, hsa; identical to SEQ ID NO: 127919

SEQ ID NO: 428726 - RNA, 64 nt, hsa; identical to SEQ ID NO: 127920

SEQ ID NO: 428727 - RNA, 64 nt, hsa; identical to SEQ ID NO: 127921

SEQ ID NO: 428728 - RNA, 64 nt, hsa; identical to SEQ ID NO: 127922

SEQ ID NO: 428729 - RNA, 64 nt, hsa; identical to SEQ ID NO: 127923

SEQ ID NO: 428730 - RNA, 64 nt, hsa; identical to SEQ ID NO: 127924

SEQ ID NO: 428731 - RNA, 64 nt, hsa; identical to SEQ ID NO: 127925

SEQ ID NO: 428732 - RNA, 64 nt, hsa; identical to SEQ ID NO: 127926

SEQ ID NO: 428733 - RNA, 64 nt, hsa; identical to SEQ ID NO: 127927

SEQ ID NO: 428734 - RNA, 64 nt, hsa; identical to SEQ ID NO: 127928

SEQ ID NO: 428735 - RNA, 64 nt, hsa; identical to SEQ ID NO: 127929

SEQ ID NO: 428736 - RNA, 64 nt, hsa; identical to SEQ ID NO: 127930

SEQ ID NO: 428737 - RNA, 64 nt, hsa; identical to SEQ ID NO: 127931

SEQ ID NO: 428738 - RNA, 64 nt, hsa; identical to SEQ ID NO: 127932

SEQ ID NO: 428739 - RNA, 64 nt, hsa; identical to SEQ ID NO: 127933

SEQ ID NO: 428740 - RNA, 64 nt, hsa; identical to SEQ ID NO: 127934

SEQ ID NO: 428741 - RNA, 64 nt, hsa; identical to SEQ ID NO: 127935

SEQ ID NO: 428742 - RNA, 64 nt, hsa; identical to SEQ ID NO: 127936

SEQ ID NO: 428743 - RNA, 64 nt, hsa; identical to SEQ ID NO: 127937

SEQ ID NO: 428744 - RNA, 64 nt, hsa; identical to SEQ ID NO: 127938

SEQ ID NO: 428745 - RNA, 64 nt, hsa; identical to SEQ ID NO: 127939

SEQ ID NO: 428746 - RNA, 64 nt, hsa; identical to SEQ ID NO: 127940

SEQ ID NO: 428747 - RNA, 64 nt, hsa; identical to SEQ ID NO: 127941

SEQ ID NO: 428748 - RNA, 64 nt, hsa; identical to SEQ ID NO: 127942

SEQ ID NO: 428749 - RNA, 64 nt, hsa; identical to SEQ ID NO: 127943

SEQ ID NO: 428750 - RNA, 64 nt, hsa; identical to SEQ ID NO: 127944

SEQ ID NO: 428751 - RNA, 64 nt, hsa; identical to SEQ ID NO: 127945

SEQ ID NO: 428752 - RNA, 64 nt, hsa; identical to SEQ ID NO: 127946

SEQ ID NO: 428753 - RNA, 64 nt, hsa; identical to SEQ ID NO: 127947

SEQ ID NO: 428754 - RNA, 64 nt, hsa; identical to SEQ ID NO: 127948

SEQ ID NO: 428755 - RNA, 64 nt, hsa; identical to SEQ ID NO: 127949

SEQ ID NO: 428756 - RNA, 64 nt, hsa; identical to SEQ ID NO: 127950

SEQ ID NO: 428757 - RNA, 64 nt, hsa; identical to SEQ ID NO: 127951

SEQ ID NO: 428758 - RNA, 64 nt, hsa; identical to SEQ ID NO: 127952

SEQ ID NO: 428759 - RNA, 64 nt, hsa; identical to SEQ ID NO: 127953

SEQ ID NO: 428760 - RNA, 64 nt, hsa; identical to SEQ ID NO: 127954

SEQ ID NO: 428761 - RNA, 64 nt, hsa; identical to SEQ ID NO: 127955

SEQ ID NO: 428762 - RNA, 64 nt, hsa; identical to SEQ ID NO: 127956

SEQ ID NO: 428763 - RNA, 64 nt, hsa; identical to SEQ ID NO: 127957

SEQ ID NO: 428764 - RNA, 64 nt, hsa; identical to SEQ ID NO: 127958

SEQ ID NO: 428765 - RNA, 64 nt, hsa; identical to SEQ ID NO: 127959

SEQ ID NO: 428766 - RNA, 64 nt, hsa; identical to SEQ ID NO: 127960

SEQ ID NO: 428767 - RNA, 64 nt, hsa; identical to SEQ ID NO: 127961

SEQ ID NO: 428768 - RNA, 64 nt, hsa; identical to SEQ ID NO: 127962

SEQ ID NO: 428769 - RNA, 64 nt, hsa; identical to SEQ ID NO: 127963

SEQ ID NO: 428770 - RNA, 64 nt, hsa; identical to SEQ ID NO: 127964

SEQ ID NO: 428771 - RNA, 64 nt, hsa; identical to SEQ ID NO: 127965

SEQ ID NO: 428772 - RNA, 64 nt, hsa; identical to SEQ ID NO: 127966

SEQ ID NO: 428773 - RNA, 64 nt, hsa; identical to SEQ ID NO: 127967

SEQ ID NO: 428774 - RNA, 64 nt, hsa; identical to SEQ ID NO: 127968

SEQ ID NO: 428775 - RNA, 64 nt, hsa; identical to SEQ ID NO: 127969

SEQ ID NO: 428776 - RNA, 64 nt, hsa; identical to SEQ ID NO: 127970

SEQ ID NO: 428777 - RNA, 64 nt, hsa; identical to SEQ ID NO: 127971

SEQ ID NO: 428778 - RNA, 64 nt, hsa; identical to SEQ ID NO: 127972

SEQ ID NO: 428779 - RNA, 64 nt, hsa; identical to SEQ ID NO: 127973

SEQ ID NO: 428780 - RNA, 64 nt, hsa; identical to SEQ ID NO: 127974

SEQ ID NO: 428781 - RNA, 64 nt, hsa; identical to SEQ ID NO: 127975

SEQ ID NO: 428782 - RNA, 64 nt, hsa; identical to SEQ ID NO: 127976

SEQ ID NO: 428783 - RNA, 64 nt, hsa; identical to SEQ ID NO: 127977

SEQ ID NO: 428784 - RNA, 64 nt, hsa; identical to SEQ ID NO: 127978

SEQ ID NO: 428785 - RNA, 64 nt, hsa; identical to SEQ ID NO: 127979

SEQ ID NO: 428786 - RNA, 64 nt, hsa; identical to SEQ ID NO: 127980

SEQ ID NO: 428787 - RNA, 64 nt, hsa; identical to SEQ ID NO: 127981

SEQ ID NO: 428788 - RNA, 64 nt, hsa; identical to SEQ ID NO: 127982

SEQ ID NO: 428789 - RNA, 64 nt, hsa; identical to SEQ ID NO: 127983

SEQ ID NO: 428790 - RNA, 64 nt, hsa; identical to SEQ ID NO: 127984

SEQ ID NO: 428791 - RNA, 64 nt, hsa; identical to SEQ ID NO: 127985

SEQ ID NO: 428792 - RNA, 64 nt, hsa; identical to SEQ ID NO: 127986

SEQ ID NO: 428793 - RNA, 64 nt, hsa; identical to SEQ ID NO: 127987

SEQ ID NO: 428794 - RNA, 64 nt, hsa; identical to SEQ ID NO: 127988

SEQ ID NO: 428795 - RNA, 64 nt, hsa; identical to SEQ ID NO: 127989

SEQ ID NO: 428796 - RNA, 64 nt, hsa; identical to SEQ ID NO: 127990

SEQ ID NO: 428797 - RNA, 64 nt, hsa; identical to SEQ ID NO: 127991

SEQ ID NO: 428798 - RNA, 64 nt, hsa; identical to SEQ ID NO: 127992

SEQ ID NO: 428799 - RNA, 64 nt, hsa; identical to SEQ ID NO: 127993

SEQ ID NO: 428800 - RNA, 64 nt, hsa; identical to SEQ ID NO: 127994

SEQ ID NO: 428801 - RNA, 64 nt, hsa; identical to SEQ ID NO: 127995

SEQ ID NO: 428802 - RNA, 64 nt, hsa; identical to SEQ ID NO: 127996

SEQ ID NO: 428803 - RNA, 64 nt, hsa; identical to SEQ ID NO: 127997

SEQ ID NO: 428804 - RNA, 64 nt, hsa; identical to SEQ ID NO: 127998

SEQ ID NO: 428805 - RNA, 64 nt, hsa; identical to SEQ ID NO: 127999

SEQ ID NO: 428806 - RNA, 64 nt, hsa; identical to SEQ ID NO: 128000

SEQ ID NO: 428807 - RNA, 64 nt, hsa; identical to SEQ ID NO: 128001

SEQ ID NO: 428808 - RNA, 64 nt, hsa; identical to SEQ ID NO: 128002

SEQ ID NO: 428809 - RNA, 64 nt, hsa; identical to SEQ ID NO: 128003

SEQ ID NO: 428810 - RNA, 64 nt, hsa; identical to SEQ ID NO: 128004

SEQ ID NO: 428811 - RNA, 64 nt, hsa; identical to SEQ ID NO: 128005

SEQ ID NO: 428812 - RNA, 64 nt, hsa; identical to SEQ ID NO: 128006

SEQ ID NO: 428813 - RNA, 64 nt, hsa; identical to SEQ ID NO: 128007

SEQ ID NO: 428814 - RNA, 64 nt, hsa; identical to SEQ ID NO: 128008

SEQ ID NO: 428815 - RNA, 64 nt, hsa; identical to SEQ ID NO: 128009

SEQ ID NO: 428816 - RNA, 64 nt, hsa; identical to SEQ ID NO: 128010

SEQ ID NO: 428817 - RNA, 64 nt, hsa; identical to SEQ ID NO: 128011

SEQ ID NO: 428818 - RNA, 64 nt, hsa; identical to SEQ ID NO: 128012

SEQ ID NO: 428819 - RNA, 64 nt, hsa; identical to SEQ ID NO: 128013

SEQ ID NO: 428820 - RNA, 64 nt, hsa; identical to SEQ ID NO: 128014

SEQ ID NO: 428821 - RNA, 64 nt, hsa; identical to SEQ ID NO: 128015

SEQ ID NO: 428822 - RNA, 64 nt, hsa; identical to SEQ ID NO: 128016

SEQ ID NO: 428823 - RNA, 64 nt, hsa; identical to SEQ ID NO: 128017

SEQ ID NO: 428824 - RNA, 64 nt, hsa; identical to SEQ ID NO: 128018

SEQ ID NO: 428825 - RNA, 64 nt, hsa; identical to SEQ ID NO: 128019

SEQ ID NO: 428826 - RNA, 64 nt, hsa; identical to SEQ ID NO: 128020

SEQ ID NO: 428827 - RNA, 64 nt, hsa; identical to SEQ ID NO: 128021

SEQ ID NO: 428828 - RNA, 64 nt, hsa; identical to SEQ ID NO: 128022

SEQ ID NO: 428829 - RNA, 64 nt, hsa; identical to SEQ ID NO: 128023

SEQ ID NO: 428830 - RNA, 64 nt, hsa; identical to SEQ ID NO: 128024

SEQ ID NO: 428831 - RNA, 64 nt, hsa; identical to SEQ ID NO: 128025

SEQ ID NO: 428832 - RNA, 64 nt, hsa; identical to SEQ ID NO: 128026

SEQ ID NO: 428833 - RNA, 64 nt, hsa; identical to SEQ ID NO: 128027

SEQ ID NO: 428834 - RNA, 64 nt, hsa; identical to SEQ ID NO: 128028

SEQ ID NO: 428835 - RNA, 64 nt, hsa; identical to SEQ ID NO: 128029

SEQ ID NO: 428836 - RNA, 63 nt, hsa
gacaguuucugauugcccugagcaccaggucucaucuugcaucucauccuggccuggagaaca

SEQ ID NO: 428837 - RNA, 63 nt, hsa
ggugcuuauuuaucuguuugccaugcagaaaauaucuugcacaaaauuaccucuguuaaggaa

SEQ ID NO: 428838 - RNA, 63 nt, hsa
aguugggauacuuuaaucagaaaaaaagaacuuaucuugcagcauuuuaucaacaaauuucau

SEQ ID NO: 428839 - RNA, 63 nt, hsa
cuaacaacucacugcagugcucuucauagacacaucuugcagcauuuuucuuaaggcuaugcu

SEQ ID NO: 428840 - RNA, 63 nt, hsa
aagcugcauuuuuaggauugcccaucuuaagagaucuugcaggaagagauuguauuagauauu

SEQ ID NO: 428841 - RNA, 63 nt, hsa
uuuaauuuacauucauaaacuacuauauuucccaucuugcaaaucauuuuaugucucaucugu

SEQ ID NO: 428842 - RNA, 63 nt, hsa
uuuuuccuagucauugggaauguagagcaguguaucuugcaugucaucggaagaauagauuuu

SEQ ID NO: 428843 - RNA, 63 nt, hsa
gugauuuuuccaguauuaaacaugcaugcauuaaucuugcaguuuauuuucucauuguguaug

SEQ ID NO: 428844 - RNA, 63 nt, hsa
uuuucuagucuguccacacagggauuaccugucaucuugcaugcaaucaggagaaucucauag

SEQ ID NO: 428845 - RNA, 63 nt, hsa
ccgggucuccugcugcacagagcugaacuuuguaucuugcaaugcgcuggcugccucccugug

SEQ ID NO: 428846 - RNA, 63 nt, hsa
aacuggaaacagaauuggaaaacugccugacuuaucuugcaucccuuugaaugaguuuacaga

SEQ ID NO: 428847 - RNA, 63 nt, hsa
cuuauccuuuugaaaaggucuucugacacacuuaucuugcacaaagaaaaagaaaauuucuuu

SEQ ID NO: 428848 - RNA, 64 nt, hsa
gugaggcuggggucucugcaggggaggucacuggaacagcgagcaagggacuggugccucgcug

SEQ ID NO: 428849 - RNA, 64 nt, hsa
uggaggccagccugugcagaaggcugcagcugacaacagcgaccccaccugccauuaccuucag

SEQ ID NO: 428850 - RNA, 64 nt, hsa
uggauuuuuucuggggccucaauccagucuugauaacagcgaggaaagagguauugaagaaaca

SEQ ID NO: 428851 - RNA, 64 nt, hsa
gaccaugggcuacuacugggcauuagugcaauauaacagcgauaauaaaauucucuauuagucu

SEQ ID NO: 428852 - RNA, 64 nt, hsa
gcggggggugggggucagaugcacugaaguagccaacagcgaagccaguccagaagaggggucc

SEQ ID NO: 428853 - RNA, 64 nt, hsa
gaccccuccucacuggccaucccucgugguccccaacagcgacauagcccaucccugccugguc

SEQ ID NO: 428854 - RNA, 64 nt, hsa
uacuguacaacccgacuucauaauggugcuuucaaacagcgagaugaguaaaaacaucagcuuc

SEQ ID NO: 428855 - RNA, 64 nt, hsa
aggugaauuccuggucuuggcagauggcucugggaacagcgagggagcacagaagucguggccu

SEQ ID NO: 428856 - RNA, 64 nt, hsa
uaccuugauugccuuacaaaguuauuuguuuacaaacagcgaccauauaaaagccuccugcccc

SEQ ID NO: 428857 - RNA, 64 nt, hsa
ccaccaggaggccugcagauccagccuuccugucaacagcgacaggaaaucucuagguugguga

SEQ ID NO: 428858 - RNA, 64 nt, hsa
gcuccugcagccuggggaggagugugacgacgguaacagcgaugugggugacgacugcauccgu

SEQ ID NO: 428859 - RNA, 64 nt, hsa
gaggcccuccugugcugggggaaugagcccagagaacagcgaaguagcuugcucccugugucca

SEQ ID NO: 428860 - RNA, 64 nt, hsa
guuguucuauuuuguacagacaaguuggaaaaacaacagcgacaaaaaagucaagaaacuuugu

SEQ ID NO: 428861 - RNA, 64 nt, hsa
uaaucagugcacaggaguauaaaauauuauuuuaaacagcgaaauuaauaauauaaaaugccaa

SEQ ID NO: 428862 - RNA, 64 nt, hsa
ccaggauuugcucugccccaaacgagcuguucauaacagcgauuuugccuaacauuauaucaua

SEQ ID NO: 428863 - RNA, 64 nt, hsa
ccucuucuauuguuuuuuaaccuuacagguccccaacagcgauacugcuguuucucgagguaag

SEQ ID NO: 428864 - RNA, 64 nt, hsa
uggagguauucugaaggucagaagagagauauacaacagcgaggcuuggugauaacguauagaa

SEQ ID NO: 428865 - RNA, 64 nt, hsa
gcacaagugauccuuggcuuucagaauuugcaagaacagcgauuugaauuuugggggggucugc

SEQ ID NO: 428866 - RNA, 64 nt, hsa
uucuuuuuuuuaaguucuauuuuaaaagcuaucaaacagcgacauagccauacaucugacugcc

SEQ ID NO: 428867 - RNA, 64 nt, hsa
uuuaaagguucagaggaauccauaccaaaguucuaacagcgaguaggagguauagaugagagau

SEQ ID NO: 428868 - RNA, 64 nt, hsa
agccaagaucgugccacugcacucuauccuggguaacagcgagacucugucuuaaaaauaauaa

SEQ ID NO: 428869 - RNA, 64 nt, hsa
agugacugugaccacuguccguguugccuucuugaacagcgauuccccccaaccccuucaccaa

SEQ ID NO: 428870 - RNA, 64 nt, hsa
uuuuaagcaagggcgccucaccugcucuucaagaaacagcgagagggagacccagggggcugaa

SEQ ID NO: 428871 - RNA, 64 nt, hsa
uugcagaaagguguugaaaugcuucucuagcccaaacagcgacaugcuaaaguccccuucuuca

SEQ ID NO: 428872 - RNA, 64 nt, hsa
aaugucuuuugcccguuuugauuacgugcaugcaaacagcgauuugcaaagaccguaugaugau

SEQ ID NO: 428873 - RNA, 64 nt, hsa
gaggccuagccaacaacgaagggacggauuuuaaaacagcgagaacugggugccaagaaacacu

SEQ ID NO: 428874 - RNA, 64 nt, hsa
ugugaaauuaaaccaaguacuggaaacguaacuaaacagcgaaccauguagcuucaccugacuc

SEQ ID NO: 428875 - RNA, 64 nt, hsa
caauaugacacuuguaaauuguuguuucaaaaugaacagcgaagccuuaacuuuaaaugacauu

SEQ ID NO: 428876 - RNA, 64 nt, hsa
cucccacacuuuucuuugaugggagguuucaauaaacagcgauaagaacucuagccaugauguu

SEQ ID NO: 428877 - RNA, 64 nt, hsa
ggaauaguucauagggaagggacaacauggaagaaacagcgauuuaaauuguauugaacagggc

SEQ ID NO: 428878 - RNA, 64 nt, hsa
cauuccccaguuaaagugugucucuguaccuuacaacagcgauucaggacccaagugugaacaa

SEQ ID NO: 428879 - RNA, 64 nt, hsa
ggggagauggagauuugacuguuuaaaaacugaaaacagcgaggagucuuucuagaacuuuuga

SEQ ID NO: 428880 - RNA, 64 nt, hsa
gacuuuuuuuucauacauuuaguaugaaaacuugaacagcgaaagcagagcauguuauuuauau

SEQ ID NO: 428881 - RNA, 64 nt, hsa
uaaacuuguagacuaaaccaaguauuguaaaauaaacagcgauaacagugauaguuuuuaacuc

SEQ ID NO: 428882 - RNA, 64 nt, hsa
gacuuucacaaauaucuuuuuaaaaaucaaaaccaacagcgaucucaagcuuaaucuccucuuc

SEQ ID NO: 428883 - RNA, 64 nt, hsa
agugagcugagauugcgccacuguacuccugggcaacagcgagacuccgucucaaaaaaaaaaa

SEQ ID NO: 428884 - RNA, 64 nt, hsa
ugggcacaugagugagggcucuggcuuacugggaaacagcgauugaccugugcuucugacagcc

SEQ ID NO: 428885 - RNA, 64 nt, hsa
gacgcauuuuucuguugagcuaugcagucgucaaaacagcgauagacagcauaggagguuugaa

SEQ ID NO: 428886 - RNA, 64 nt, hsa
auauuuguaaauuguguuuuuaauuaaacuuuggaacagcgaauuuggauguuccagagguugg

SEQ ID NO: 428887 - RNA, 64 nt, hsa
uuuaaauuguagcuucagaacacuuuugguucagaacagcgauugaccaguaacugugagauca

SEQ ID NO: 428888 - RNA, 64 nt, hsa
aauggaccaagagccugcagggaacagaacagugaacagcgaggauucugaugaacaagaccau

SEQ ID NO: 428889 - RNA, 64 nt, hsa
uacaauccagagacagaaaacaaaaucuagaugcaacagcgaaacaaagaacccauuuccuucc

SEQ ID NO: 428890 - RNA, 64 nt, hsa
gcgccugucgcccaucuccgugcucuucuuugacaacagcgacaacguggugcugcggcaguau

SEQ ID NO: 428891 - RNA, 64 nt, hsa
acucuggccugcguacuccucacucagaaacaagaacagcgacagcccuucucgagcagaugac

SEQ ID NO: 428892 - RNA, 64 nt, hsa
ggaacauaagaccgcaauucuaaguuucuagauaaacagcgaucuccaagucaagacugaggau

SEQ ID NO: 428893 - RNA, 64 nt, hsa
aggccaguuaauuuaaaaaaaacagucgcuaguuaacagcgacagagcccagcacccugggguc

SEQ ID NO: 428894 - RNA, 64 nt, hsa
gggcggcgaagaggacccgcaggcugcaaggagcaacagcgauggguaggcacauucaaaacca

SEQ ID NO: 428895 - RNA, 64 nt, hsa
ccaaaacaaaucacgagaagagagaaggggacagaacagcgagagcaaccuggaaaaucggucu

SEQ ID NO: 428896 - RNA, 64 nt, hsa
gcgguuacugcgugauucuaaagcugccacucggaacagcgaguccucugccgucgagagcagg

SEQ ID NO: 428897 - RNA, 64 nt, hsa
ugccaggagauugugauugggagaggguaaggcaaacagcgacugccagaaagaccuuuugcag

SEQ ID NO: 428898 - RNA, 64 nt, hsa
agcuaagaucgcgccacuguacuccagccugggcaacagcgagacuccaucucaaaaaaaaagg

SEQ ID NO: 428899 - RNA, 64 nt, hsa
ucuguggcaaaaagagucagacauuucuuuggaaaacagcgaacagccuuagagcucuuguguu

SEQ ID NO: 428900 - RNA, 64 nt, hsa; identical to SEQ ID NO: 218520

SEQ ID NO: 428901 - RNA, 64 nt, hsa; identical to SEQ ID NO: 218521

SEQ ID NO: 428902 - RNA, 64 nt, hsa; identical to SEQ ID NO: 218522

SEQ ID NO: 428903 - RNA, 64 nt, hsa; identical to SEQ ID NO: 218523

SEQ ID NO: 428904 - RNA, 64 nt, hsa; identical to SEQ ID NO: 218524

SEQ ID NO: 428905 - RNA, 64 nt, hsa; identical to SEQ ID NO: 218525

SEQ ID NO: 428906 - RNA, 64 nt, hsa; identical to SEQ ID NO: 218526

SEQ ID NO: 428907 - RNA, 64 nt, hsa; identical to SEQ ID NO: 218527

SEQ ID NO: 428908 - RNA, 64 nt, hsa; identical to SEQ ID NO: 218528

SEQ ID NO: 428909 - RNA, 64 nt, hsa; identical to SEQ ID NO: 218529

SEQ ID NO: 428910 - RNA, 64 nt, hsa; identical to SEQ ID NO: 218530

SEQ ID NO: 428911 - RNA, 64 nt, hsa; identical to SEQ ID NO: 218531

SEQ ID NO: 428912 - RNA, 64 nt, hsa; identical to SEQ ID NO: 218532

SEQ ID NO: 428913 - RNA, 64 nt, hsa; identical to SEQ ID NO: 218533

SEQ ID NO: 428914 - RNA, 64 nt, hsa; identical to SEQ ID NO: 218534

SEQ ID NO: 428915 - RNA, 64 nt, hsa; identical to SEQ ID NO: 218535

SEQ ID NO: 428916 - RNA, 64 nt, hsa; identical to SEQ ID NO: 218536

SEQ ID NO: 428917 - RNA, 64 nt, hsa; identical to SEQ ID NO: 218537

SEQ ID NO: 428918 - RNA, 64 nt, hsa; identical to SEQ ID NO: 218538

SEQ ID NO: 428919 - RNA, 61 nt, hsa; identical to SEQ ID NO: 218539

SEQ ID NO: 428920 - RNA, 64 nt, hsa; identical to SEQ ID NO: 218540

SEQ ID NO: 428921 - RNA, 64 nt, hsa; identical to SEQ ID NO: 218541

SEQ ID NO: 428922 - RNA, 64 nt, hsa; identical to SEQ ID NO: 218542

SEQ ID NO: 428923 - RNA, 64 nt, hsa; identical to SEQ ID NO: 218543

SEQ ID NO: 428924 - RNA, 64 nt, hsa; identical to SEQ ID NO: 218544

SEQ ID NO: 428925 - RNA, 64 nt, hsa; identical to SEQ ID NO: 218545

SEQ ID NO: 428926 - RNA, 64 nt, hsa; identical to SEQ ID NO: 218546

SEQ ID NO: 428927 - RNA, 64 nt, hsa; identical to SEQ ID NO: 218547

SEQ ID NO: 428928 - RNA, 64 nt, hsa; identical to SEQ ID NO: 218548

SEQ ID NO: 428929 - RNA, 64 nt, hsa; identical to SEQ ID NO: 218549

SEQ ID NO: 428930 - RNA, 64 nt, hsa; identical to SEQ ID NO: 218550

SEQ ID NO: 428931 - RNA, 64 nt, hsa; identical to SEQ ID NO: 218551

SEQ ID NO: 428932 - RNA, 64 nt, hsa; identical to SEQ ID NO: 218552

SEQ ID NO: 428933 - RNA, 64 nt, hsa; identical to SEQ ID NO: 218553

SEQ ID NO: 428934 - RNA, 63 nt, hsa; identical to SEQ ID NO: 218554

SEQ ID NO: 428935 - RNA, 64 nt, hsa; identical to SEQ ID NO: 218555

SEQ ID NO: 428936 - RNA, 64 nt, hsa; identical to SEQ ID NO: 218556

SEQ ID NO: 428937 - RNA, 64 nt, hsa; identical to SEQ ID NO: 218557

SEQ ID NO: 428938 - RNA, 64 nt, hsa; identical to SEQ ID NO: 218558

SEQ ID NO: 428939 - RNA, 64 nt, hsa; identical to SEQ ID NO: 218559

SEQ ID NO: 428940 - RNA, 64 nt, hsa; identical to SEQ ID NO: 218560

SEQ ID NO: 428941 - RNA, 64 nt, hsa; identical to SEQ ID NO: 218561

SEQ ID NO: 428942 - RNA, 64 nt, hsa; identical to SEQ ID NO: 218562

SEQ ID NO: 428943 - RNA, 64 nt, hsa; identical to SEQ ID NO: 218563

SEQ ID NO: 428944 - RNA, 64 nt, hsa; identical to SEQ ID NO: 218564

SEQ ID NO: 428945 - RNA, 64 nt, hsa; identical to SEQ ID NO: 218565

SEQ ID NO: 428946 - RNA, 64 nt, hsa; identical to SEQ ID NO: 218566

SEQ ID NO: 428947 - RNA, 64 nt, hsa; identical to SEQ ID NO: 218567

SEQ ID NO: 428948 - RNA, 64 nt, hsa; identical to SEQ ID NO: 218568

SEQ ID NO: 428949 - RNA, 64 nt, hsa; identical to SEQ ID NO: 218569

SEQ ID NO: 428950 - RNA, 64 nt, hsa; identical to SEQ ID NO: 218570

SEQ ID NO: 428951 - RNA, 64 nt, hsa; identical to SEQ ID NO: 218571

SEQ ID NO: 428952 - RNA, 64 nt, hsa; identical to SEQ ID NO: 218572

SEQ ID NO: 428953 - RNA, 64 nt, hsa; identical to SEQ ID NO: 218573

SEQ ID NO: 428954 - RNA, 64 nt, hsa; identical to SEQ ID NO: 218574

SEQ ID NO: 428955 - RNA, 64 nt, hsa; identical to SEQ ID NO: 218575

SEQ ID NO: 428956 - RNA, 64 nt, hsa; identical to SEQ ID NO: 218576

SEQ ID NO: 428957 - RNA, 64 nt, hsa; identical to SEQ ID NO: 218577

SEQ ID NO: 428958 - RNA, 64 nt, hsa; identical to SEQ ID NO: 218578

SEQ ID NO: 428959 - RNA, 64 nt, hsa; identical to SEQ ID NO: 218579

SEQ ID NO: 428960 - RNA, 64 nt, hsa; identical to SEQ ID NO: 218580

SEQ ID NO: 428961 - RNA, 64 nt, hsa; identical to SEQ ID NO: 218581

SEQ ID NO: 428962 - RNA, 64 nt, hsa; identical to SEQ ID NO: 218582

SEQ ID NO: 428963 - RNA, 64 nt, hsa; identical to SEQ ID NO: 218583

SEQ ID NO: 428964 - RNA, 64 nt, hsa; identical to SEQ ID NO: 218584

SEQ ID NO: 428965 - RNA, 64 nt, hsa; identical to SEQ ID NO: 218585

SEQ ID NO: 428966 - RNA, 64 nt, hsa; identical to SEQ ID NO: 218586

SEQ ID NO: 428967 - RNA, 64 nt, hsa; identical to SEQ ID NO: 218587

SEQ ID NO: 428968 - RNA, 64 nt, hsa; identical to SEQ ID NO: 218588

SEQ ID NO: 428969 - RNA, 64 nt, hsa; identical to SEQ ID NO: 218589

SEQ ID NO: 428970 - RNA, 64 nt, hsa; identical to SEQ ID NO: 218590

SEQ ID NO: 428971 - RNA, 64 nt, hsa; identical to SEQ ID NO: 218591

SEQ ID NO: 428972 - RNA, 64 nt, hsa; identical to SEQ ID NO: 218592

SEQ ID NO: 428973 - RNA, 64 nt, hsa; identical to SEQ ID NO: 218593

SEQ ID NO: 428974 - RNA, 64 nt, hsa; identical to SEQ ID NO: 218594

SEQ ID NO: 428975 - RNA, 64 nt, hsa; identical to SEQ ID NO: 218595

SEQ ID NO: 428976 - RNA, 64 nt, hsa; identical to SEQ ID NO: 218596

SEQ ID NO: 428977 - RNA, 64 nt, hsa; identical to SEQ ID NO: 218597

SEQ ID NO: 428978 - RNA, 64 nt, hsa; identical to SEQ ID NO: 218598

SEQ ID NO: 428979 - RNA, 64 nt, hsa; identical to SEQ ID NO: 218599

SEQ ID NO: 428980 - RNA, 64 nt, hsa; identical to SEQ ID NO: 218600

SEQ ID NO: 428981 - RNA, 64 nt, hsa; identical to SEQ ID NO: 218601

SEQ ID NO: 428982 - RNA, 64 nt, hsa; identical to SEQ ID NO: 218602

SEQ ID NO: 428983 - RNA, 64 nt, hsa; identical to SEQ ID NO: 218603

SEQ ID NO: 428984 - RNA, 64 nt, hsa; identical to SEQ ID NO: 218604

SEQ ID NO: 428985 - RNA, 64 nt, hsa; identical to SEQ ID NO: 218605

SEQ ID NO: 428986 - RNA, 64 nt, hsa; identical to SEQ ID NO: 218606

SEQ ID NO: 428987 - RNA, 64 nt, hsa; identical to SEQ ID NO: 218607

SEQ ID NO: 428988 - RNA, 64 nt, hsa; identical to SEQ ID NO: 218608

SEQ ID NO: 428989 - RNA, 64 nt, hsa; identical to SEQ ID NO: 218609

SEQ ID NO: 428990 - RNA, 64 nt, hsa; identical to SEQ ID NO: 218610

SEQ ID NO: 428991 - RNA, 64 nt, hsa; identical to SEQ ID NO: 218611

SEQ ID NO: 428992 - RNA, 64 nt, hsa; identical to SEQ ID NO: 218612

SEQ ID NO: 428993 - RNA, 62 nt, hsa; identical to SEQ ID NO: 218613

SEQ ID NO: 428994 - RNA, 64 nt, hsa; identical to SEQ ID NO: 218614

SEQ ID NO: 428995 - RNA, 64 nt, hsa; identical to SEQ ID NO: 218615

SEQ ID NO: 428996 - RNA, 64 nt, hsa; identical to SEQ ID NO: 218616

SEQ ID NO: 428997 - RNA, 64 nt, hsa; identical to SEQ ID NO: 218617

SEQ ID NO: 428998 - RNA, 64 nt, hsa; identical to SEQ ID NO: 218618

SEQ ID NO: 428999 - RNA, 64 nt, hsa; identical to SEQ ID NO: 218619

SEQ ID NO: 429000 - RNA, 64 nt, hsa; identical to SEQ ID NO: 218620

SEQ ID NO: 429001 - RNA, 64 nt, hsa; identical to SEQ ID NO: 218621

SEQ ID NO: 429002 - RNA, 64 nt, hsa; identical to SEQ ID NO: 218622

SEQ ID NO: 429003 - RNA, 64 nt, hsa; identical to SEQ ID NO: 218623

SEQ ID NO: 429004 - RNA, 64 nt, hsa; identical to SEQ ID NO: 218624

SEQ ID NO: 429005 - RNA, 64 nt, hsa; identical to SEQ ID NO: 218625

SEQ ID NO: 429006 - RNA, 64 nt, hsa; identical to SEQ ID NO: 218626

SEQ ID NO: 429007 - RNA, 64 nt, hsa; identical to SEQ ID NO: 218627

SEQ ID NO: 429008 - RNA, 64 nt, hsa; identical to SEQ ID NO: 218628

SEQ ID NO: 429009 - RNA, 64 nt, hsa; identical to SEQ ID NO: 218629

SEQ ID NO: 429010 - RNA, 64 nt, hsa; identical to SEQ ID NO: 218630

SEQ ID NO: 429011 - RNA, 64 nt, hsa; identical to SEQ ID NO: 218631

SEQ ID NO: 429012 - RNA, 64 nt, hsa; identical to SEQ ID NO: 218632

SEQ ID NO: 429013 - RNA, 64 nt, hsa; identical to SEQ ID NO: 218633

SEQ ID NO: 429014 - RNA, 64 nt, hsa; identical to SEQ ID NO: 218634

SEQ ID NO: 429015 - RNA, 64 nt, hsa; identical to SEQ ID NO: 218635

SEQ ID NO: 429016 - RNA, 64 nt, hsa; identical to SEQ ID NO: 218636

SEQ ID NO: 429017 - RNA, 64 nt, hsa; identical to SEQ ID NO: 218637

SEQ ID NO: 429018 - RNA, 64 nt, hsa; identical to SEQ ID NO: 218638

SEQ ID NO: 429019 - RNA, 64 nt, hsa; identical to SEQ ID NO: 218639

SEQ ID NO: 429020 - RNA, 64 nt, hsa; identical to SEQ ID NO: 218640

SEQ ID NO: 429021 - RNA, 64 nt, hsa; identical to SEQ ID NO: 218641

SEQ ID NO: 429022 - RNA, 64 nt, hsa; identical to SEQ ID NO: 218642

SEQ ID NO: 429023 - RNA, 64 nt, hsa; identical to SEQ ID NO: 218643

SEQ ID NO: 429024 - RNA, 64 nt, hsa; identical to SEQ ID NO: 218644

SEQ ID NO: 429025 - RNA, 64 nt, hsa; identical to SEQ ID NO: 218645

SEQ ID NO: 429026 - RNA, 64 nt, hsa; identical to SEQ ID NO: 218646

SEQ ID NO: 429027 - RNA, 64 nt, hsa; identical to SEQ ID NO: 218647

SEQ ID NO: 429028 - RNA, 64 nt, hsa; identical to SEQ ID NO: 218648

SEQ ID NO: 429029 - RNA, 64 nt, hsa; identical to SEQ ID NO: 218649

SEQ ID NO: 429030 - RNA, 64 nt, hsa; identical to SEQ ID NO: 218650

SEQ ID NO: 429031 - RNA, 64 nt, hsa; identical to SEQ ID NO: 218651

SEQ ID NO: 429032 - RNA, 64 nt, hsa; identical to SEQ ID NO: 218652

SEQ ID NO: 429033 - RNA, 64 nt, hsa; identical to SEQ ID NO: 218653

SEQ ID NO: 429034 - RNA, 64 nt, hsa; identical to SEQ ID NO: 218654

SEQ ID NO: 429035 - RNA, 64 nt, hsa; identical to SEQ ID NO: 218655

SEQ ID NO: 429036 - RNA, 64 nt, hsa; identical to SEQ ID NO: 218656

SEQ ID NO: 429037 - RNA, 64 nt, hsa; identical to SEQ ID NO: 218657

SEQ ID NO: 429038 - RNA, 64 nt, hsa; identical to SEQ ID NO: 218658

SEQ ID NO: 429039 - RNA, 64 nt, hsa; identical to SEQ ID NO: 218659

SEQ ID NO: 429040 - RNA, 64 nt, hsa; identical to SEQ ID NO: 218660

SEQ ID NO: 429041 - RNA, 64 nt, hsa; identical to SEQ ID NO: 218661

SEQ ID NO: 429042 - RNA, 61 nt, hsa; identical to SEQ ID NO: 218662

SEQ ID NO: 429043 - RNA, 64 nt, hsa; identical to SEQ ID NO: 218663

SEQ ID NO: 429044 - RNA, 64 nt, hsa; identical to SEQ ID NO: 218664

SEQ ID NO: 429045 - RNA, 64 nt, hsa; identical to SEQ ID NO: 218665

SEQ ID NO: 429046 - RNA, 64 nt, hsa; identical to SEQ ID NO: 218666

SEQ ID NO: 429047 - RNA, 64 nt, hsa; identical to SEQ ID NO: 218667

SEQ ID NO: 429048 - RNA, 64 nt, hsa; identical to SEQ ID NO: 218668

SEQ ID NO: 429049 - RNA, 64 nt, hsa; identical to SEQ ID NO: 218669

SEQ ID NO: 429050 - RNA, 64 nt, hsa; identical to SEQ ID NO: 218670

SEQ ID NO: 429051 - RNA, 64 nt, hsa; identical to SEQ ID NO: 218671

SEQ ID NO: 429052 - RNA, 64 nt, hsa; identical to SEQ ID NO: 218672

SEQ ID NO: 429053 - RNA, 64 nt, hsa; identical to SEQ ID NO: 218673

SEQ ID NO: 429054 - RNA, 64 nt, hsa; identical to SEQ ID NO: 218674

SEQ ID NO: 429055 - RNA, 64 nt, hsa; identical to SEQ ID NO: 218675

SEQ ID NO: 429056 - RNA, 64 nt, hsa; identical to SEQ ID NO: 218676

SEQ ID NO: 429057 - RNA, 64 nt, hsa; identical to SEQ ID NO: 218677

SEQ ID NO: 429058 - RNA, 64 nt, hsa; identical to SEQ ID NO: 218678

SEQ ID NO: 429059 - RNA, 64 nt, hsa; identical to SEQ ID NO: 218679

SEQ ID NO: 429060 - RNA, 64 nt, hsa; identical to SEQ ID NO: 218680

SEQ ID NO: 429061 - RNA, 64 nt, hsa; identical to SEQ ID NO: 218681

SEQ ID NO: 429062 - RNA, 64 nt, hsa; identical to SEQ ID NO: 218682

SEQ ID NO: 429063 - RNA, 64 nt, hsa; identical to SEQ ID NO: 218683

SEQ ID NO: 429064 - RNA, 64 nt, hsa; identical to SEQ ID NO: 218684

SEQ ID NO: 429065 - RNA, 64 nt, hsa; identical to SEQ ID NO: 218685

SEQ ID NO: 429066 - RNA, 59 nt, hsa; identical to SEQ ID NO: 218686

SEQ ID NO: 429067 - RNA, 64 nt, hsa; identical to SEQ ID NO: 218687

SEQ ID NO: 429068 - RNA, 64 nt, hsa; identical to SEQ ID NO: 218688

SEQ ID NO: 429069 - RNA, 64 nt, hsa; identical to SEQ ID NO: 218689

SEQ ID NO: 429070 - RNA, 64 nt, hsa; identical to SEQ ID NO: 218690

SEQ ID NO: 429071 - RNA, 64 nt, hsa; identical to SEQ ID NO: 218691

SEQ ID NO: 429072 - RNA, 64 nt, hsa; identical to SEQ ID NO: 218692

SEQ ID NO: 429073 - RNA, 64 nt, hsa; identical to SEQ ID NO: 218693

SEQ ID NO: 429074 - RNA, 64 nt, hsa; identical to SEQ ID NO: 218694

SEQ ID NO: 429075 - RNA, 64 nt, hsa; identical to SEQ ID NO: 218695

SEQ ID NO: 429076 - RNA, 64 nt, hsa; identical to SEQ ID NO: 218696

SEQ ID NO: 429077 - RNA, 64 nt, hsa; identical to SEQ ID NO: 218697

SEQ ID NO: 429078 - RNA, 64 nt, hsa; identical to SEQ ID NO: 218698

SEQ ID NO: 429079 - RNA, 64 nt, hsa; identical to SEQ ID NO: 218699

SEQ ID NO: 429080 - RNA, 64 nt, hsa; identical to SEQ ID NO: 218700

SEQ ID NO: 429081 - RNA, 64 nt, hsa; identical to SEQ ID NO: 218701

SEQ ID NO: 429082 - RNA, 64 nt, hsa; identical to SEQ ID NO: 218702

SEQ ID NO: 429083 - RNA, 64 nt, hsa; identical to SEQ ID NO: 218703

SEQ ID NO: 429084 - RNA, 64 nt, hsa; identical to SEQ ID NO: 218704

SEQ ID NO: 429085 - RNA, 64 nt, hsa; identical to SEQ ID NO: 218705

SEQ ID NO: 429086 - RNA, 64 nt, hsa; identical to SEQ ID NO: 218706

SEQ ID NO: 429087 - RNA, 64 nt, hsa; identical to SEQ ID NO: 218707

SEQ ID NO: 429088 - RNA, 64 nt, hsa; identical to SEQ ID NO: 218708

SEQ ID NO: 429089 - RNA, 64 nt, hsa; identical to SEQ ID NO: 218709

SEQ ID NO: 429090 - RNA, 64 nt, hsa; identical to SEQ ID NO: 218710

SEQ ID NO: 429091 - RNA, 64 nt, hsa; identical to SEQ ID NO: 218711

SEQ ID NO: 429092 - RNA, 64 nt, hsa; identical to SEQ ID NO: 218712

SEQ ID NO: 429093 - RNA, 64 nt, hsa; identical to SEQ ID NO: 218713

SEQ ID NO: 429094 - RNA, 64 nt, hsa; identical to SEQ ID NO: 218714

SEQ ID NO: 429095 - RNA, 64 nt, hsa; identical to SEQ ID NO: 218715

SEQ ID NO: 429096 - RNA, 64 nt, hsa; identical to SEQ ID NO: 218716

SEQ ID NO: 429097 - RNA, 64 nt, hsa; identical to SEQ ID NO: 218717

SEQ ID NO: 429098 - RNA, 64 nt, hsa; identical to SEQ ID NO: 218718

SEQ ID NO: 429099 - RNA, 64 nt, hsa; identical to SEQ ID NO: 218719

SEQ ID NO: 429100 - RNA, 64 nt, hsa; identical to SEQ ID NO: 218720

SEQ ID NO: 429101 - RNA, 64 nt, hsa; identical to SEQ ID NO: 218721

SEQ ID NO: 429102 - RNA, 64 nt, hsa; identical to SEQ ID NO: 218722

SEQ ID NO: 429103 - RNA, 64 nt, hsa; identical to SEQ ID NO: 218723

SEQ ID NO: 429104 - RNA, 64 nt, hsa; identical to SEQ ID NO: 218724

SEQ ID NO: 429105 - RNA, 64 nt, hsa; identical to SEQ ID NO: 218725

SEQ ID NO: 429106 - RNA, 64 nt, hsa; identical to SEQ ID NO: 218726

SEQ ID NO: 429107 - RNA, 64 nt, hsa; identical to SEQ ID NO: 218727

SEQ ID NO: 429108 - RNA, 64 nt, hsa; identical to SEQ ID NO: 218728

SEQ ID NO: 429109 - RNA, 64 nt, hsa; identical to SEQ ID NO: 218729

SEQ ID NO: 429110 - RNA, 64 nt, hsa; identical to SEQ ID NO: 218730

SEQ ID NO: 429111 - RNA, 64 nt, hsa; identical to SEQ ID NO: 218731

SEQ ID NO: 429112 - RNA, 64 nt, hsa; identical to SEQ ID NO: 218732

SEQ ID NO: 429113 - RNA, 64 nt, hsa; identical to SEQ ID NO: 218733

SEQ ID NO: 429114 - RNA, 64 nt, hsa; identical to SEQ ID NO: 218734

SEQ ID NO: 429115 - RNA, 64 nt, hsa; identical to SEQ ID NO: 218735

SEQ ID NO: 429116 - RNA, 64 nt, hsa; identical to SEQ ID NO: 218736

SEQ ID NO: 429117 - RNA, 64 nt, hsa; identical to SEQ ID NO: 218737

SEQ ID NO: 429118 - RNA, 64 nt, hsa; identical to SEQ ID NO: 218738

SEQ ID NO: 429119 - RNA, 64 nt, hsa; identical to SEQ ID NO: 218739

SEQ ID NO: 429120 - RNA, 64 nt, hsa; identical to SEQ ID NO: 218740

SEQ ID NO: 429121 - RNA, 64 nt, hsa; identical to SEQ ID NO: 218741

SEQ ID NO: 429122 - RNA, 64 nt, hsa; identical to SEQ ID NO: 218742

SEQ ID NO: 429123 - RNA, 64 nt, hsa; identical to SEQ ID NO: 218743

SEQ ID NO: 429124 - RNA, 64 nt, hsa; identical to SEQ ID NO: 218744

SEQ ID NO: 429125 - RNA, 64 nt, hsa; identical to SEQ ID NO: 218745

SEQ ID NO: 429126 - RNA, 64 nt, hsa; identical to SEQ ID NO: 218746

SEQ ID NO: 429127 - RNA, 64 nt, hsa; identical to SEQ ID NO: 218747

SEQ ID NO: 429128 - RNA, 64 nt, hsa; identical to SEQ ID NO: 218748

SEQ ID NO: 429129 - RNA, 64 nt, hsa; identical to SEQ ID NO: 218749

SEQ ID NO: 429130 - RNA, 64 nt, hsa; identical to SEQ ID NO: 218750

SEQ ID NO: 429131 - RNA, 64 nt, hsa; identical to SEQ ID NO: 218751

SEQ ID NO: 429132 - RNA, 64 nt, hsa; identical to SEQ ID NO: 218752

SEQ ID NO: 429133 - RNA, 64 nt, hsa; identical to SEQ ID NO: 218753

SEQ ID NO: 429134 - RNA, 64 nt, hsa; identical to SEQ ID NO: 218754

SEQ ID NO: 429135 - RNA, 64 nt, hsa; identical to SEQ ID NO: 218755

SEQ ID NO: 429136 - RNA, 64 nt, hsa; identical to SEQ ID NO: 218756

SEQ ID NO: 429137 - RNA, 64 nt, hsa; identical to SEQ ID NO: 218757

SEQ ID NO: 429138 - RNA, 64 nt, hsa; identical to SEQ ID NO: 218758

SEQ ID NO: 429139 - RNA, 64 nt, hsa; identical to SEQ ID NO: 218759

SEQ ID NO: 429140 - RNA, 64 nt, hsa; identical to SEQ ID NO: 218760

SEQ ID NO: 429141 - RNA, 64 nt, hsa; identical to SEQ ID NO: 218761

SEQ ID NO: 429142 - RNA, 64 nt, hsa; identical to SEQ ID NO: 218762

SEQ ID NO: 429143 - RNA, 64 nt, hsa; identical to SEQ ID NO: 218763

SEQ ID NO: 429144 - RNA, 64 nt, hsa; identical to SEQ ID NO: 218764

SEQ ID NO: 429145 - RNA, 64 nt, hsa; identical to SEQ ID NO: 218765

SEQ ID NO: 429146 - RNA, 64 nt, hsa; identical to SEQ ID NO: 218766

SEQ ID NO: 429147 - RNA, 64 nt, hsa; identical to SEQ ID NO: 218767

SEQ ID NO: 429148 - RNA, 64 nt, hsa; identical to SEQ ID NO: 218768

SEQ ID NO: 429149 - RNA, 64 nt, hsa; identical to SEQ ID NO: 218769

SEQ ID NO: 429150 - RNA, 64 nt, hsa; identical to SEQ ID NO: 218770

SEQ ID NO: 429151 - RNA, 64 nt, hsa; identical to SEQ ID NO: 218771

SEQ ID NO: 429152 - RNA, 64 nt, hsa; identical to SEQ ID NO: 218772

SEQ ID NO: 429153 - RNA, 64 nt, hsa; identical to SEQ ID NO: 218773

SEQ ID NO: 429154 - RNA, 64 nt, hsa; identical to SEQ ID NO: 218774

SEQ ID NO: 429155 - RNA, 64 nt, hsa; identical to SEQ ID NO: 218775

SEQ ID NO: 429156 - RNA, 64 nt, hsa; identical to SEQ ID NO: 218776

SEQ ID NO: 429157 - RNA, 64 nt, hsa; identical to SEQ ID NO: 218777

SEQ ID NO: 429158 - RNA, 64 nt, hsa; identical to SEQ ID NO: 218778

SEQ ID NO: 429159 - RNA, 64 nt, hsa; identical to SEQ ID NO: 218779

SEQ ID NO: 429160 - RNA, 64 nt, hsa; identical to SEQ ID NO: 218780

SEQ ID NO: 429161 - RNA, 64 nt, hsa; identical to SEQ ID NO: 218781

SEQ ID NO: 429162 - RNA, 64 nt, hsa; identical to SEQ ID NO: 218782

SEQ ID NO: 429163 - RNA, 64 nt, hsa; identical to SEQ ID NO: 218783

SEQ ID NO: 429164 - RNA, 64 nt, hsa; identical to SEQ ID NO: 218784

SEQ ID NO: 429165 - RNA, 64 nt, hsa; identical to SEQ ID NO: 218785

SEQ ID NO: 429166 - RNA, 64 nt, hsa; identical to SEQ ID NO: 218786

SEQ ID NO: 429167 - RNA, 64 nt, hsa; identical to SEQ ID NO: 218787

SEQ ID NO: 429168 - RNA, 64 nt, hsa; identical to SEQ ID NO: 218788

SEQ ID NO: 429169 - RNA, 64 nt, hsa; identical to SEQ ID NO: 218789

SEQ ID NO: 429170 - RNA, 64 nt, hsa; identical to SEQ ID NO: 218790

SEQ ID NO: 429171 - RNA, 64 nt, hsa; identical to SEQ ID NO: 218791

SEQ ID NO: 429172 - RNA, 64 nt, hsa; identical to SEQ ID NO: 218792

SEQ ID NO: 429173 - RNA, 64 nt, hsa; identical to SEQ ID NO: 218793

SEQ ID NO: 429174 - RNA, 64 nt, hsa; identical to SEQ ID NO: 218794

SEQ ID NO: 429175 - RNA, 64 nt, hsa; identical to SEQ ID NO: 218795

SEQ ID NO: 429176 - RNA, 64 nt, hsa; identical to SEQ ID NO: 218796

SEQ ID NO: 429177 - RNA, 64 nt, hsa; identical to SEQ ID NO: 218797

SEQ ID NO: 429178 - RNA, 64 nt, hsa; identical to SEQ ID NO: 218798

SEQ ID NO: 429179 - RNA, 64 nt, hsa; identical to SEQ ID NO: 218799

SEQ ID NO: 429180 - RNA, 64 nt, hsa; identical to SEQ ID NO: 218800

SEQ ID NO: 429181 - RNA, 64 nt, hsa; identical to SEQ ID NO: 218801

SEQ ID NO: 429182 - RNA, 64 nt, hsa; identical to SEQ ID NO: 218802

SEQ ID NO: 429183 - RNA, 64 nt, hsa; identical to SEQ ID NO: 218803

SEQ ID NO: 429184 - RNA, 64 nt, hsa; identical to SEQ ID NO: 218804

SEQ ID NO: 429185 - RNA, 64 nt, hsa; identical to SEQ ID NO: 218805

SEQ ID NO: 429186 - RNA, 64 nt, hsa; identical to SEQ ID NO: 218806

SEQ ID NO: 429187 - RNA, 64 nt, hsa; identical to SEQ ID NO: 218807

SEQ ID NO: 429188 - RNA, 64 nt, hsa; identical to SEQ ID NO: 218808

SEQ ID NO: 429189 - RNA, 59 nt, hsa; identical to SEQ ID NO: 218809

SEQ ID NO: 429190 - RNA, 64 nt, hsa; identical to SEQ ID NO: 218810

SEQ ID NO: 429191 - RNA, 64 nt, hsa; identical to SEQ ID NO: 218811

SEQ ID NO: 429192 - RNA, 64 nt, hsa
ucauaaguaaaccuaguaaaaccuuguucuauuuuucaaucaucaaaaaguaauuauaaauacg

SEQ ID NO: 429193 - RNA, 64 nt, hsa
ugcaaacccuggugguauuuuauuuuggcuucauuucaaucauugaaguauauucuuauuggaa

SEQ ID NO: 429194 - RNA, 64 nt, hsa
uuuuagauaaaucagaacucuccuuaaaaugcauuucaaucagaagcaaaguacacccauuauu

SEQ ID NO: 429195 - RNA, 64 nt, hsa
ggcuguugucauggcugaguaguuuuuugaugaauucaaucaaugcagagaacgcuuuuagaua

SEQ ID NO: 429196 - RNA, 64 nt, hsa
uugcuauaagcuuggugaaaugaaaauggaacauuucaaucaaacauuuccuauauaacaauua

SEQ ID NO: 429197 - RNA, 64 nt, hsa
aauuaccuuuugauuuguaacacuacuucugcuguucaaucaagagucuugguagauaagaaaa

SEQ ID NO: 429198 - RNA, 64 nt, hsa
gauuaagcaaugcagccuagaagcaaugguucuguucaaucauucagauguuaguggaagcaua

SEQ ID NO: 429199 - RNA, 64 nt, hsa
uucuuuuccccuucaguagaauuagauuuuguuuuucaaucaugauuucaaaugcaauccuaag

SEQ ID NO: 429200 - RNA, 64 nt, hsa
aagccagaaaccugugucaucuuuucaccccaccuucaaucaacaaguccucaaucaacaaguc

SEQ ID NO: 429201 - RNA, 64 nt, hsa
gaaugccucucccuccgcaucucaucuuucucuuuucaaucaggcuuuuccaaaggguuguaua

SEQ ID NO: 429202 - RNA, 64 nt, hsa
aacuuuguggcugaggggucaguuaccagugaccuucaaucaacuccaucacuucuuaaaucgg

SEQ ID NO: 429203 - RNA, 64 nt, hsa
aggaagggaagcuuuuuuuuuucuuuuuuuuuuuuucaaucacacuuuguggaaaaacauuucc

SEQ ID NO: 429204 - RNA, 64 nt, hsa
uauagcuacaccuuuaauaaaaugaaggaaugucuucaaucauauuuuagugggcuauuuauaa

SEQ ID NO: 429205 - RNA, 64 nt, hsa
uucuuagcaaugaaauugcuguuaaaacacaaauuucaaucaaauacuuuuguguauagaaaau

SEQ ID NO: 429206 - RNA, 64 nt, hsa
gauucaaucaagauccgugcucgcagugggcugauucaaucaagauguauguuugcuauguucu

SEQ ID NO: 429207 - RNA, 64 nt, hsa
uguauguagaccuaaaacuacaccaauaggcugauucaaucaagauccgugcucgcagugggcu

SEQ ID NO: 429208 - RNA, 64 nt, hsa
acugauagaccaaaaaacuacaccaguagguugauucaaucaagauguauguagaccuaaaacu

SEQ ID NO: 429209 - RNA, 64 nt, hsa; identical to SEQ ID NO: 285072

SEQ ID NO: 429210 - RNA, 64 nt, hsa; identical to SEQ ID NO: 285073

SEQ ID NO: 429211 - RNA, 64 nt, hsa; identical to SEQ ID NO: 285074

SEQ ID NO: 429212 - RNA, 64 nt, hsa; identical to SEQ ID NO: 285075

SEQ ID NO: 429213 - RNA, 64 nt, hsa; identical to SEQ ID NO: 285076

SEQ ID NO: 429214 - RNA, 64 nt, hsa; identical to SEQ ID NO: 285077

SEQ ID NO: 429215 - RNA, 64 nt, hsa; identical to SEQ ID NO: 285078

SEQ ID NO: 429216 - RNA, 64 nt, hsa; identical to SEQ ID NO: 285079

SEQ ID NO: 429217 - RNA, 64 nt, hsa; identical to SEQ ID NO: 285080

SEQ ID NO: 429218 - RNA, 64 nt, hsa; identical to SEQ ID NO: 285081

SEQ ID NO: 429219 - RNA, 64 nt, hsa; identical to SEQ ID NO: 285082

SEQ ID NO: 429220 - RNA, 64 nt, hsa; identical to SEQ ID NO: 285083

SEQ ID NO: 429221 - RNA, 64 nt, hsa; identical to SEQ ID NO: 285084

SEQ ID NO: 429222 - RNA, 64 nt, hsa; identical to SEQ ID NO: 285085

SEQ ID NO: 429223 - RNA, 64 nt, hsa; identical to SEQ ID NO: 285086

SEQ ID NO: 429224 - RNA, 64 nt, hsa; identical to SEQ ID NO: 285087

SEQ ID NO: 429225 - RNA, 64 nt, hsa; identical to SEQ ID NO: 285088

SEQ ID NO: 429226 - RNA, 64 nt, hsa; identical to SEQ ID NO: 285089

SEQ ID NO: 429227 - RNA, 64 nt, hsa; identical to SEQ ID NO: 285090

SEQ ID NO: 429228 - RNA, 64 nt, hsa; identical to SEQ ID NO: 285091

SEQ ID NO: 429229 - RNA, 62 nt, hsa; identical to SEQ ID NO: 285092

SEQ ID NO: 429230 - RNA, 64 nt, hsa; identical to SEQ ID NO: 285093

SEQ ID NO: 429231 - RNA, 64 nt, hsa; identical to SEQ ID NO: 285094

SEQ ID NO: 429232 - RNA, 64 nt, hsa; identical to SEQ ID NO: 285095

SEQ ID NO: 429233 - RNA, 64 nt, hsa; identical to SEQ ID NO: 285096

SEQ ID NO: 429234 - RNA, 64 nt, hsa; identical to SEQ ID NO: 285097

SEQ ID NO: 429235 - RNA, 64 nt, hsa; identical to SEQ ID NO: 285098

SEQ ID NO: 429236 - RNA, 64 nt, hsa; identical to SEQ ID NO: 285099

SEQ ID NO: 429237 - RNA, 64 nt, hsa; identical to SEQ ID NO: 285100

SEQ ID NO: 429238 - RNA, 64 nt, hsa; identical to SEQ ID NO: 285101

SEQ ID NO: 429239 - RNA, 64 nt, hsa; identical to SEQ ID NO: 175362

SEQ ID NO: 429240 - RNA, 64 nt, hsa; identical to SEQ ID NO: 175363

SEQ ID NO: 429241 - RNA, 64 nt, hsa; identical to SEQ ID NO: 175364

SEQ ID NO: 429242 - RNA, 64 nt, hsa; identical to SEQ ID NO: 175365

SEQ ID NO: 429243 - RNA, 64 nt, hsa; identical to SEQ ID NO: 175366

SEQ ID NO: 429244 - RNA, 64 nt, hsa; identical to SEQ ID NO: 175367

SEQ ID NO: 429245 - RNA, 64 nt, hsa; identical to SEQ ID NO: 175368

SEQ ID NO: 429246 - RNA, 64 nt, hsa; identical to SEQ ID NO: 175369

SEQ ID NO: 429247 - RNA, 64 nt, hsa; identical to SEQ ID NO: 175370

SEQ ID NO: 429248 - RNA, 64 nt, hsa; identical to SEQ ID NO: 175371

SEQ ID NO: 429249 - RNA, 64 nt, hsa; identical to SEQ ID NO: 175372

SEQ ID NO: 429250 - RNA, 64 nt, hsa; identical to SEQ ID NO: 175373

SEQ ID NO: 429251 - RNA, 64 nt, hsa; identical to SEQ ID NO: 175374

SEQ ID NO: 429252 - RNA, 64 nt, hsa; identical to SEQ ID NO: 175375

SEQ ID NO: 429253 - RNA, 64 nt, hsa; identical to SEQ ID NO: 175376

SEQ ID NO: 429254 - RNA, 64 nt, hsa; identical to SEQ ID NO: 175377

SEQ ID NO: 429255 - RNA, 64 nt, hsa; identical to SEQ ID NO: 175378

SEQ ID NO: 429256 - RNA, 64 nt, hsa; identical to SEQ ID NO: 175379

SEQ ID NO: 429257 - RNA, 54 nt, hsa; identical to SEQ ID NO: 175380

SEQ ID NO: 429258 - RNA, 64 nt, hsa; identical to SEQ ID NO: 175381

SEQ ID NO: 429259 - RNA, 64 nt, hsa; identical to SEQ ID NO: 175382

SEQ ID NO: 429260 - RNA, 64 nt, hsa
cucuauaagcaccgccccagcucugacaaaaccccgccuccaggucggcaggcuccgccuucuu

SEQ ID NO: 429261 - RNA, 64 nt, hsa
cuggggccgucagacuuggauacaucguaaacuccgccuccacggaacgucucgccuugcgagc

SEQ ID NO: 429262 - RNA, 64 nt, hsa
ucacagaggggcucgguggcccagguggugguuccgccuccaggggcagggccuuguccugggu

SEQ ID NO: 429263 - RNA, 64 nt, hsa
gcagaggaaggcuacuugagccggacaccaagcccgccuccagcaccaagggcgggcagcaccc

SEQ ID NO: 429264 - RNA, 64 nt, hsa
ucccggggccaggacagacaaaccagagccucugcgccuccacagggaaaaggcaaggcuucca

SEQ ID NO: 429265 - RNA, 64 nt, hsa
gccuggcugcaggugcuuucccgcccccugaggacgccuccacgccauucgccaucccgcgcac

SEQ ID NO: 429266 - RNA, 64 nt, hsa
cggcugugcugucagcggggccuggcgguggaagcgccuccagugugcaugagcgugucugaag

SEQ ID NO: 429267 - RNA, 64 nt, hsa
cgcagccacaugcccuggcugccaugggccagaccgccuccaccucccccgcccgccuggccug

SEQ ID NO: 429268 - RNA, 64 nt, hsa; identical to SEQ ID NO: 243440

SEQ ID NO: 429269 - RNA, 64 nt, hsa; identical to SEQ ID NO: 243441

SEQ ID NO: 429270 - RNA, 64 nt, hsa; identical to SEQ ID NO: 243442

SEQ ID NO: 429271 - RNA, 64 nt, hsa; identical to SEQ ID NO: 243443

SEQ ID NO: 429272 - RNA, 64 nt, hsa; identical to SEQ ID NO: 243444

SEQ ID NO: 429273 - RNA, 64 nt, hsa; identical to SEQ ID NO: 243445

SEQ ID NO: 429274 - RNA, 64 nt, hsa; identical to SEQ ID NO: 243446

SEQ ID NO: 429275 - RNA, 64 nt, hsa; identical to SEQ ID NO: 243447

SEQ ID NO: 429276 - RNA, 64 nt, hsa; identical to SEQ ID NO: 243448

SEQ ID NO: 429277 - RNA, 64 nt, hsa; identical to SEQ ID NO: 243449

SEQ ID NO: 429278 - RNA, 64 nt, hsa; identical to SEQ ID NO: 243450

SEQ ID NO: 429279 - RNA, 64 nt, hsa; identical to SEQ ID NO: 243451

SEQ ID NO: 429280 - RNA, 64 nt, hsa; identical to SEQ ID NO: 243452

SEQ ID NO: 429281 - RNA, 64 nt, hsa; identical to SEQ ID NO: 243453

SEQ ID NO: 429282 - RNA, 64 nt, hsa; identical to SEQ ID NO: 243454

SEQ ID NO: 429283 - RNA, 64 nt, hsa; identical to SEQ ID NO: 243455

SEQ ID NO: 429284 - RNA, 64 nt, hsa; identical to SEQ ID NO: 243456

SEQ ID NO: 429285 - RNA, 64 nt, hsa; identical to SEQ ID NO: 243457

SEQ ID NO: 429286 - RNA, 62 nt, hsa
agugggagaucaaguuggggaacagauggcugaggcugcagacucaggcccaggacacucaa

SEQ ID NO: 429287 - RNA, 62 nt, hsa
aggugggaggaucgcuugagcccaagagguugaggcugcagugagccaugaucgcaccacug

SEQ ID NO: 429288 - RNA, 62 nt, hsa
aaagggacagauugaggaggaagugggcucugaggcugcagggcuggaaguccuugcccacu

SEQ ID NO: 429289 - RNA, 62 nt, hsa
aaaacccaguuuucccucugggagccuaaaccaggcugcaucggaggccaggacccggauca

SEQ ID NO: 429290 - RNA, 62 nt, hsa
ugguuugucucuuuuggaaaacaaaaaucagaaggcugcauucuagagggcagagaaauucc

SEQ ID NO: 429291 - RNA, 62 nt, hsa
ucucucuucuccuuguccuagucagaugaaggaggcugcacuacaaacccaaauucugcaaa

SEQ ID NO: 429292 - RNA, 62 nt, hsa
cuccagaagcaccucaacaaugucaguggcugaggcugcacucagagggaugacugcugggg

SEQ ID NO: 429293 - RNA, 62 nt, hsa
aauggcgcaccaagagcagggcugugugugggaggcugcagccaggauugccucagcuccuc

SEQ ID NO: 429294 - RNA, 62 nt, hsa
cacgcacacaggagggaggccuagcugcucagaggcugcagggagggcccaggagccggcug

SEQ ID NO: 429295 - RNA, 62 nt, hsa
uuaggaaugacuaaacaagauaauggcaguuuaggcugcacaacugguaaaaugacuguaga

SEQ ID NO: 429296 - RNA, 62 nt, hsa
gguggaggggauugcuugagccugggaagcugaggcugcaguagccaugacugcaccacugc

SEQ ID NO: 429297 - RNA, 62 nt, hsa
gaaaauggguuuuucuuuucuauugcauagucaggcugcaaauuuccaaacuuuuaugcuuu

SEQ ID NO: 429298 - RNA, 62 nt, hsa
ggaguggcugggacacaagacaccaagucccuaggcugcacacacaugucaggggcugcccu

SEQ ID NO: 429299 - RNA, 62 nt, hsa
agcaggggagggaguaagaaauccuggagaugaggcugcaguuuuaaauggggccucacugg

SEQ ID NO: 429300 - RNA, 62 nt, hsa
gcccagcagcugugaacuccccuuauagccucaggcugcaguguccuucccagcugugugag

SEQ ID NO: 429301 - RNA, 62 nt, hsa
ucuuccaaaccuaccaugaaacccuggugugcaggcugcacucaaugaccucaacccaacac

SEQ ID NO: 429302 - RNA, 62 nt, hsa
cuccagccgagucuggccaauuugccauggggaggcugcaguguccaagccugcuggaaacu

SEQ ID NO: 429303 - RNA, 62 nt, hsa
ccugccugagaugguguggccacagcaguggaaggcugcacacaggcacauuccuucuucca

SEQ ID NO: 429304 - RNA, 62 nt, hsa
aggcaggagaaucgcuugagccccaggcuucgaggcugcagugagcuaugauuacgacacug

SEQ ID NO: 429305 - RNA, 62 nt, hsa
agcuuuuugaaauguuaagauguguuuggagaaggcugcaugacuuuguuuuucccuuuuag

SEQ ID NO: 429306 - RNA, 62 nt, hsa
uuuuuuugagacagagucucacucuguugcccaggcugcagugcaguggugugaucuuggcu

SEQ ID NO: 429307 - RNA, 62 nt, hsa
uuguuuugagacagagucuugcucugucgccgaggcugcagugcagcggugcgaucucugcu

SEQ ID NO: 429308 - RNA, 62 nt, hsa
ggccauguugccuugacacagucacaguguagaggcugcaggugcacacgugggcuccagug

SEQ ID NO: 429309 - RNA, 62 nt, hsa
ucugccccuacaucucagcugaaucuccagggaggcugcagagcaucguggagaccacuuuc

SEQ ID NO: 429310 - RNA, 62 nt, hsa
agcagacccccgccauccucgcagagugggagaggcugcagcaaggcuuugccucugcagac

SEQ ID NO: 429311 - RNA, 62 nt, hsa
ucccugucaggggcccaggcugccaucacuggaggcugcagggaccaagaggccaucaccgu

SEQ ID NO: 429312 - RNA, 62 nt, hsa
gccaucccagauugcaacugccucccuguuacaggcugcauagggaauauuggcuucccagc

SEQ ID NO: 429313 - RNA, 62 nt, hsa
gcuggccccaggcacacuccucaucaauucucaggcugcagggacaaacuuuccgauagggc

SEQ ID NO: 429314 - RNA, 62 nt, hsa
aaggaaaugauaugguacccagacacugggcuaggcugcaacuuuaucucauuuaauacucc

SEQ ID NO: 429315 - RNA, 62 nt, hsa
uuuuagguaauaauuagaacaguucccuucagaggcugcauuugccuucuucugccaccuaa

SEQ ID NO: 429316 - RNA, 62 nt, hsa
cuagaggagggcaucugucugugggagcccagaggcugcagggaggaggaggagggagguau

SEQ ID NO: 429317 - RNA, 62 nt, hsa
aguggagaaacuaggagacugggacaagcaaaaggcugcaaacaacccagaagcccauccuc

SEQ ID NO: 429318 - RNA, 62 nt, hsa
gauucugugucagagcccagcccaggaguuugaggcugcaaugagccaugauuucccacugc

SEQ ID NO: 429319 - RNA, 62 nt, hsa
aggugggagaauugcuugagcuugggaagucgaggcugcagucagcccugauugugccagug

SEQ ID NO: 429320 - RNA, 62 nt, hsa
ccuccucaccccaccccaggcccuugguguccaggcugcacccacagaugucuguugccaaa

SEQ ID NO: 429321 - RNA, 62 nt, hsa
ggucggagauuggccuugccugucgaggcaagaggcugcagaggcggggacacaccuguguc

SEQ ID NO: 429322 - RNA, 62 nt, hsa
ugagaggcuggugguugccucccguccugggcaggcugcagccucaugccaugucucucucc

SEQ ID NO: 429323 - RNA, 62 nt, hsa
ucucucucccacuaccugaugggcacauggacaggcugcagagggcuccagguucugggccc

SEQ ID NO: 429324 - RNA, 62 nt, hsa
agaaguguguacggcuugagguuucagcauccaggcugcagaccccacgcagugucucauac

SEQ ID NO: 429325 - RNA, 50 nt, hsa
ccacugugugcucagcgugaaggcugcauagaaguguguacggcuugagg

SEQ ID NO: 429326 - RNA, 62 nt, hsa
cugcucaucuugcugaugcaaacuaggaaguuaggcugcaucucggaguggcuuucgcugga

SEQ ID NO: 429327 - RNA, 62 nt, hsa
cuucuccccgcgcuugggacucugacaucuuaaggcugcacggucguguccuugucugggug

SEQ ID NO: 429328 - RNA, 62 nt, hsa
auugagucaggcagcuggaggguuguggcccgaggcugcagucagagguauacuucccauag

SEQ ID NO: 429329 - RNA, 62 nt, hsa
aucuguauuuugagcuuagugcuaggacugagaggcugcaccauagggaauguaugggagau

SEQ ID NO: 429330 - RNA, 62 nt, hsa
gagcagcauuucuccuccccagaggaccucgaaggcugcaacggcccugccccaagccccag

SEQ ID NO: 429331 - RNA, 62 nt, hsa
gcauaugaagagccacgcagagcaggagaagaaggcugcagcgcugaggcugaaggagaaag

SEQ ID NO: 429332 - RNA, 62 nt, hsa
aggcuuagugguacguugggguuucccacgcuaggcugcauagcauuauaaccugggaacgu

SEQ ID NO: 429333 - RNA, 62 nt, hsa
aggugggaagauucuuugagcccaggaguucaaggcugcagugaauucugaucgcaccacug

SEQ ID NO: 429334 - RNA, 62 nt, hsa
gagggccccacugugaggcgugggugugagccaggcugcaggaggaacugggccuccgcuuc

SEQ ID NO: 429335 - RNA, 62 nt, hsa
uugccuucauguuagcuuccggcuccccucccaggcugcagacucugaccuguggcaucagg

SEQ ID NO: 429336 - RNA, 62 nt, hsa
aggucauuucacuuuucugaaaaccucacaucaggcugcauccucuucugucccuggcacca

SEQ ID NO: 429337 - RNA, 62 nt, hsa
aagcugcuucaaccugaguccggcucuucagcaggcugcacaaguggaagcaacuaauucug

SEQ ID NO: 429338 - RNA, 62 nt, hsa
acccugggcuuucuagucuuucagaauccagcaggcugcaugaagaccugcccccugauuga

SEQ ID NO: 429339 - RNA, 62 nt, hsa
gcuucuaaagagcaaccaccccgaggaccuucaggcugcaaaccgguuaaucaagaauuugg

SEQ ID NO: 429340 - RNA, 62 nt, hsa
caccuucgagcacuauguggagcucagcaacaaggcugcacagcucaacggugagcagaugg

SEQ ID NO: 429341 - RNA, 62 nt, hsa
aggcaggagaaucacuggaaccugggagccggaggcugcagugagccaagaucgcaccauug

SEQ ID NO: 429342 - RNA, 62 nt, hsa
ucaugucucugguggugcuggggcuggccugcaggcugcagucccuggaaaaacagucacug

SEQ ID NO: 429343 - RNA, 62 nt, hsa
gcccucuccccuuuugugcuuauuuauuuaauaggcugcagugucgcuuaugaaaguacgau

SEQ ID NO: 429344 - RNA, 62 nt, hsa
uggccacuccucgguggcagggccuuucccugaggcugcaggccgugggcuggcagcccguc

SEQ ID NO: 429345 - RNA, 62 nt, hsa
ucgcugaggcaacgugagaacaggcuaugggaaggcugcaaaggcugagaaaugcaaaggcu

SEQ ID NO: 429346 - RNA, 62 nt, hsa
cugauguggccgaagcagguguccaggcagguaggcugcagccaggagcucccuggcaccgc

SEQ ID NO: 429347 - RNA, 62 nt, hsa
aggcaggaggauugcuugagcucaggaguucaaggcugcagagagcuaugaucaucccacug

SEQ ID NO: 429348 - RNA, 62 nt, hsa
agccaggaggaucacuugagcccgggagguugaggcugcaguggggggucauaaucaugcca

SEQ ID NO: 429349 - RNA, 62 nt, hsa
gguccacacugagauucugaagcuuuucccacaggcugcagggcaggaaaggugagacgggc

SEQ ID NO: 429350 - RNA, 62 nt, hsa
acaaagccaacugcuggagagguggaacugaaaggcugcaguucaguuuugggccaccuggg

SEQ ID NO: 429351 - RNA, 62 nt, hsa
gggaaggaccugaugagaacagaauagcugggaggcugcagagggugcugggagccccuaga

SEQ ID NO: 429352 - RNA, 62 nt, hsa
cccuggaguccuggaguuaagggaugaaggcaaggcugcaggucuggcccaggggaauuaaa

SEQ ID NO: 429353 - RNA, 62 nt, hsa
cccuguaaagguggcugggagagaagccagccaggcugcacuugcagaacauucccugcucu

SEQ ID NO: 429354 - RNA, 62 nt, hsa
ggucugguuaagagucucacuagggccaaggcaggcugcagaacuuucccucuuccucucau

SEQ ID NO: 429355 - RNA, 62 nt, hsa
agcugcccauugcucccaagaggaggagagggaggcugcagaugccugggacucagaccagg

SEQ ID NO: 429356 - RNA, 62 nt, hsa
cuacugugacuugcuuuagggugucaggguccaggcugcaggggcugggccaauuuguggag

SEQ ID NO: 429357 - RNA, 62 nt, hsa
gguacagcccaggcggucacugcccaccugccaggcugcagggacaguugggugugagaaua

SEQ ID NO: 429358 - RNA, 62 nt, hsa
aacaccucuuuucccuugugugagggcaaaccaggcugcaggugggguuuucacuuccuagg

SEQ ID NO: 429359 - RNA, 62 nt, hsa
gcugucccuuugccacaagucuguggggcaagaggcugcaauauuccguccugggugucugg

SEQ ID NO: 429360 - RNA, 62 nt, hsa
ccccaagaaaggcuuccccgacacccagacagaggcugcagggcuggggcugggugagggug

SEQ ID NO: 429361 - RNA, 62 nt, hsa
agaaaagagguuggauuggcucacgguucugcaggcugcacaggaagcauggcagcaucugc

SEQ ID NO: 429362 - RNA, 62 nt, hsa
aggugggaagaucauuugagcccaggaggcugaggcugcaaugagcuauaauuauugcacca

SEQ ID NO: 429363 - RNA, 62 nt, hsa
ccaaggcuccacucuguagccaggugcaccucaggcugcacaaauaccccaccagaauguca

SEQ ID NO: 429364 - RNA, 62 nt, hsa
aggcaggagaaucgcuugaacccgggaggcagaggcugcaguaagccgagaucgugccacug

SEQ ID NO: 429365 - RNA, 64 nt, hsa; identical to SEQ ID NO: 132769

SEQ ID NO: 429366 - RNA, 64 nt, hsa; identical to SEQ ID NO: 132770

SEQ ID NO: 429367 - RNA, 64 nt, hsa; identical to SEQ ID NO: 132771

SEQ ID NO: 429368 - RNA, 64 nt, hsa; identical to SEQ ID NO: 132772

SEQ ID NO: 429369 - RNA, 64 nt, hsa; identical to SEQ ID NO: 132773

SEQ ID NO: 429370 - RNA, 64 nt, hsa; identical to SEQ ID NO: 132774

SEQ ID NO: 429371 - RNA, 64 nt, hsa; identical to SEQ ID NO: 132775

SEQ ID NO: 429372 - RNA, 64 nt, hsa; identical to SEQ ID NO: 132776

SEQ ID NO: 429373 - RNA, 64 nt, hsa; identical to SEQ ID NO: 132777

SEQ ID NO: 429374 - RNA, 64 nt, hsa; identical to SEQ ID NO: 132778

SEQ ID NO: 429375 - RNA, 64 nt, hsa; identical to SEQ ID NO: 132779

SEQ ID NO: 429376 - RNA, 64 nt, hsa; identical to SEQ ID NO: 132780

SEQ ID NO: 429377 - RNA, 64 nt, hsa; identical to SEQ ID NO: 132781

SEQ ID NO: 429378 - RNA, 64 nt, hsa; identical to SEQ ID NO: 132782

SEQ ID NO: 429379 - RNA, 64 nt, hsa; identical to SEQ ID NO: 132783

SEQ ID NO: 429380 - RNA, 64 nt, hsa; identical to SEQ ID NO: 132784

SEQ ID NO: 429381 - RNA, 64 nt, hsa; identical to SEQ ID NO: 132785

SEQ ID NO: 429382 - RNA, 64 nt, hsa; identical to SEQ ID NO: 132786

SEQ ID NO: 429383 - RNA, 64 nt, hsa; identical to SEQ ID NO: 132787

SEQ ID NO: 429384 - RNA, 64 nt, hsa; identical to SEQ ID NO: 132788

SEQ ID NO: 429385 - RNA, 64 nt, hsa; identical to SEQ ID NO: 132789

SEQ ID NO: 429386 - RNA, 64 nt, hsa; identical to SEQ ID NO: 132790

SEQ ID NO: 429387 - RNA, 64 nt, hsa; identical to SEQ ID NO: 132791

SEQ ID NO: 429388 - RNA, 64 nt, hsa; identical to SEQ ID NO: 132792

SEQ ID NO: 429389 - RNA, 64 nt, hsa; identical to SEQ ID NO: 132793

SEQ ID NO: 429390 - RNA, 64 nt, hsa; identical to SEQ ID NO: 132794

SEQ ID NO: 429391 - RNA, 64 nt, hsa; identical to SEQ ID NO: 132795

SEQ ID NO: 429392 - RNA, 64 nt, hsa; identical to SEQ ID NO: 132796

SEQ ID NO: 429393 - RNA, 64 nt, hsa; identical to SEQ ID NO: 132797

SEQ ID NO: 429394 - RNA, 64 nt, hsa; identical to SEQ ID NO: 132798

SEQ ID NO: 429395 - RNA, 64 nt, hsa; identical to SEQ ID NO: 132799

SEQ ID NO: 429396 - RNA, 64 nt, hsa
ggauggcuucuggaaaucuguggccacucgagugcccaaggagcccccugagauucgaauccuc

SEQ ID NO: 429397 - RNA, 64 nt, hsa
uucugccuuuagccuggaccaaagggaagugaggcccaaggagcuuacccaagcuguggcagcc

SEQ ID NO: 429398 - RNA, 64 nt, hsa
ccuacacaggucccgagccaacggggcuuucauacccaaggaucuguuuccuugcugaaaauga

SEQ ID NO: 429399 - RNA, 64 nt, hsa
cucagccaaccuccucagggcgcccuggcuucuccccaaggagaugaggagcggugaugccagc

SEQ ID NO: 429400 - RNA, 64 nt, hsa
ugaguccuucagggaaggaaccacagagucccuucccaaggaauguaggucguuucuguguucu

SEQ ID NO: 429401 - RNA, 64 nt, hsa
uaaaucuuucaauguuauuuucucccauccuuggcccaaggaacuaugcuaagugaaacguggg

SEQ ID NO: 429402 - RNA, 64 nt, hsa
cgucuuagcuucaauccuggcagcaccugguagacccaaggacuuggguggaucaggacaccug

SEQ ID NO: 429403 - RNA, 64 nt, hsa
gaagaagagaagcuuccggcaacccugcaacccacccaaggaggcuacuggaucggggauuccc

SEQ ID NO: 429404 - RNA, 64 nt, hsa
cugcacugaaaccauuucuaaccacaacccuuggcccaaggacuugguacaggaagggagaagg

SEQ ID NO: 429405 - RNA, 64 nt, hsa
ucagcagguggccuggccacucuggagaaagaaacccaaggaaagugagcacccaacuggaugc

SEQ ID NO: 429406 - RNA, 64 nt, hsa
guuucaaacugaggaagcuacaacacagugaagacccaaggaaggccuaugaaaagguccugau

SEQ ID NO: 429407 - RNA, 64 nt, hsa
cugcaugcaggcaccagagcagggacugagaaaccccaaggaugggucaucuaagugcugucca

SEQ ID NO: 429408 - RNA, 64 nt, hsa
uccauuugggggguccugcuacacuccaccgauccccaaggaaguauaauaaacgauacccagc

SEQ ID NO: 429409 - RNA, 64 nt, hsa
gcaacaaaguauagaaacauguucauugcacacacccaaggagaagagcucaagcgcuuggaag

SEQ ID NO: 429410 - RNA, 64 nt, hsa
gccugcccaguguggaugucucuuacagagggggcccaaggaaucaccaccccgcuucagugua

SEQ ID NO: 429411 - RNA, 64 nt, hsa
gauuacuuagaagacauuuuuguacaugcucuuccccaaggauuguacguauuauacaaauaga

SEQ ID NO: 429412 - RNA, 64 nt, hsa
acuuugcuccaggcaucacugauucccucucccacccaaggagaacguuugguacaaucgacau

SEQ ID NO: 429413 - RNA, 64 nt, hsa
guggccacuggcacuugccugcugcuuggagugccccaaggagguggcuguuaaccacccgccc

SEQ ID NO: 429414 - RNA, 64 nt, hsa
auuguguggucauguuuacauugugacauccagccccaaggauggcugggaguugcucaggcau

SEQ ID NO: 429415 - RNA, 64 nt, hsa
gaggucucuaucccaucccuuccuguuacugcggcccaaggacaggaaacaacuuuuccaaaau

SEQ ID NO: 429416 - RNA, 64 nt, hsa
caccugcacugccccccacauucucccagccccccccaaggacccccucuccuugacccccagu

SEQ ID NO: 429417 - RNA, 64 nt, hsa
cagaggggacccuccagaagcccagccggcuucccccaaggacucccccuucgcugggagugga

SEQ ID NO: 429418 - RNA, 64 nt, hsa
ugggcuucacacaagaaccaccucucccgcaguucccaaggacuugucauuucauguucuuauu

SEQ ID NO: 429419 - RNA, 64 nt, hsa
uuauuuuagaccuguuuuguaaauaaagcuguuucccaaggaaagagaugaauauuuaacacuc

SEQ ID NO: 429420 - RNA, 64 nt, hsa
cucacauccauucccaucuuucgggcuccuuaggcccaaggauggcaugugacuggucccugca

SEQ ID NO: 429421 - RNA, 64 nt, hsa
guagccauuuuccucuuaagguuuccucuacaaccccaaggacuuucaugauuauccucaggga

SEQ ID NO: 429422 - RNA, 64 nt, hsa
accauggggguggugcugacucagccgccuauuccccaaggagcuucagggcaguccuucuggc

SEQ ID NO: 429423 - RNA, 64 nt, hsa
gggagggauaucaacuuggaggagaacaccuagacccaaggacuuuuuucugcccaaggaacac

SEQ ID NO: 429424 - RNA, 64 nt, hsa
gaggagaacaccuagacccaaggacuuuuuucugcccaaggaacacaguuuccuucagcuccca

SEQ ID NO: 429425 - RNA, 64 nt, hsa
aguccauuccccuuuucccuccugugcucugucccccaaggagucauggaacucaggguacugg

SEQ ID NO: 429426 - RNA, 64 nt, hsa
gcagcugucuacuggcugcaugugcugugaauaucccaaggaacuggcuguggaaugcguguuu

SEQ ID NO: 429427 - RNA, 64 nt, hsa
ucuuuguaggaauuauguuucgcagaaaaguguccccaaggaagugccaccagguacuaagucc

SEQ ID NO: 429428 - RNA, 64 nt, hsa
ucagcggaaauucuccaggcaaaugaccuccucacccaaggaguucugcuguacaaacagguga

SEQ ID NO: 429429 - RNA, 64 nt, hsa
ucuucacuucugggaaauugaagugucuucuguucccaaggaagcuccuuccuguuuguuuugu

SEQ ID NO: 429430 - RNA, 64 nt, hsa
auggagaguggggagaggcacuuaaucuguaacccccaaggaggaaauaacuaagagauucuuc

SEQ ID NO: 429431 - RNA, 64 nt, hsa
gaggggcacggggccuccgagcuccagcuccguucccaaggauacucgugaagaccccaucugu

SEQ ID NO: 429432 - RNA, 64 nt, hsa
cacuuacccccaucuuucucccucggggagacgacccaaggaauuucagaguauuuuguuuggc

SEQ ID NO: 429433 - RNA, 64 nt, hsa
ggacuggacacccacgugcagcggguuuggcucauuugaaaaugaggguccgugguagcugugc

SEQ ID NO: 429434 - RNA, 64 nt, hsa
cgugaauaaccagcgcuccaaaguguuuuucugcuuugaaaaaaaaaaauuccacaagcuuuua

SEQ ID NO: 429435 - RNA, 64 nt, hsa
uuggcaguaguuuauuuugcuucaaauaaacuuauuugaaaaguugucucaagucaaauggauu

SEQ ID NO: 429436 - RNA, 64 nt, hsa
gaaaagggaauaucagcaccuuccuaguuugggauuugaaaaguggaauuaauugcaguaggga

SEQ ID NO: 429437 - RNA, 64 nt, hsa
ucauaaauauuacuuaaucaggccugauucuacuuuugaaaauuacaguucuugaaaugcagau

SEQ ID NO: 429438 - RNA, 64 nt, hsa
aaauuacaguucuugaaaugcagauaauguuuacuuugaaaacaaaugucaugaaugauuucca

SEQ ID NO: 429439 - RNA, 64 nt, hsa
ggguuaccuuaaaaaguugauuuccuugaagcaguuugaaaauuugaauugagucuuaacuuua

SEQ ID NO: 429440 - RNA, 64 nt, hsa
caggcaguaucgauuuuaugaagagaaagugaaguuugaaaacuuuucaaacuuuucuaguuac

SEQ ID NO: 429441 - RNA, 64 nt, hsa
uacagauauaucaaaucacaugaaauauuuaaaguuugaaaauuauaauuaccuauaaagcugu

SEQ ID NO: 429442 - RNA, 64 nt, hsa
auuaccuauaaagcugugaaaaauagaaguauaauuugaaaaaacauuucacuuaucagagauu

SEQ ID NO: 429443 - RNA, 64 nt, hsa
aauaaccgguuaauuuauuuccacacaguuuguuuuugaaaaagagcuuucauaauguauaacc

SEQ ID NO: 429444 - RNA, 64 nt, hsa
uuugauaauugauggucagagccagcacuggaauuuugaaaacaaauaaggugauuaucuauuu

SEQ ID NO: 429445 - RNA, 64 nt, hsa
ucuuccagacaccagaagaaauggccuucaauuauuugaaaagagacacagagacaccucuggc

SEQ ID NO: 429446 - RNA, 64 nt, hsa
uuaaaucuugcaauuguaugugugauuauggaguuuugaaaacguuacauuuuuuaaaucuuaa

SEQ ID NO: 429447 - RNA, 64 nt, hsa
aaaaacuuuuuacuugguuauuuguuuuucaacauuugaaaaauacuuaagcucccuauguauc

SEQ ID NO: 429448 - RNA, 64 nt, hsa
gccaguagugugauuguuuuucaauuuuucccacuuugaaaacuuacaccuaaaggccuguagg

SEQ ID NO: 429449 - RNA, 64 nt, hsa
ugagaaggucccagccuuucucaaauauucugauuuugaaaauauguauccaaagugggaggcc

SEQ ID NO: 429450 - RNA, 64 nt, hsa
uuaauaacacuuuuccccaaaauggugcuuuggauuugaaaagggucugauggggagaaggaga

SEQ ID NO: 429451 - RNA, 64 nt, hsa
auuucugcaccugaauguauguuugaugcuuugauuugaaaauguucuucccuguuauuuacau

SEQ ID NO: 429452 - RNA, 64 nt, hsa
uggguuuuuaaaauucuuaccuccaucaugcaauuuugaaaauuguguccagaauuaaaagugc

SEQ ID NO: 429453 - RNA, 64 nt, hsa
gugaguuuuuuuuuugccuuagcaaagggugguguuugaaaaaaaaaauguguagccccuuuuu

SEQ ID NO: 429454 - RNA, 64 nt, hsa
uucuuuguuucuaaguauaagaaugugaagaauauuugaaaacucaaugaaauaauucucagcu

SEQ ID NO: 429455 - RNA, 64 nt, hsa
ucaugaugugugcuaaaauuuuauuuacuugaauuuugaaaacugagcuguguuagggauuaaa

SEQ ID NO: 429456 - RNA, 64 nt, hsa
aaauuguuugcuuagaguuuuuaaaaaccuagucuuugaaaagcaguuugugcuauacuuuucc

SEQ ID NO: 429457 - RNA, 64 nt, hsa
aaaaaagaauaaauaaauguuuugauuguuugaauuugaaaaauacacacgaauguccucagua

SEQ ID NO: 429458 - RNA, 64 nt, hsa
uuuauuugaaagauuccguuuauccugccauugcuuugaaaagcagcaggaaacgaaauccuuu

SEQ ID NO: 429459 - RNA, 64 nt, hsa
cacagaaauguucaaaaucauaguuuuaauguguuuugaaaaggccacacaauuauacuuuauc

SEQ ID NO: 429460 - RNA, 63 nt, hsa
uacuagcuaacuaauucugucauuaaacucauauuuugaaaauauucagacaauguugaaaau

SEQ ID NO: 429461 - RNA, 64 nt, hsa
cuuuuagcacauguguaagacacugugcaaauuuuuugaaaauagagcaauacuuuuuguggaa

SEQ ID NO: 429462 - RNA, 64 nt, hsa
uaucuuguagaucuaaugggucugggauaaaaacuuugaaaagugucaauauuccauguaugcu

SEQ ID NO: 429463 - RNA, 64 nt, hsa
uaauuaauuuaaugcugaggagaguuugacagauuuugaaaaugaguaaaggcaaaaaaaauuu

SEQ ID NO: 429464 - RNA, 64 nt, hsa
cccucucuaacacaaaacuuauuggguaagugacuuugaaaaguuuuguggcaccugacccacc

SEQ ID NO: 429465 - RNA, 64 nt, hsa
acuuuguuaucagaaccagauuccugccggcuccuuugaaaacaggucauauugugcucuucug

SEQ ID NO: 429466 - RNA, 64 nt, hsa
aagaugcuauguaagguuauggaagauucugcucuuugaaaaccauccaugaccccaagccuca

SEQ ID NO: 429467 - RNA, 64 nt, hsa
gauuuuugcauuuaaguuguuugaaggcauguauuuugaaaaauaucuguuacaaauuuauaau

SEQ ID NO: 429468 - RNA, 64 nt, hsa
agacuaugaaauacauaaaccauauaucaaguuauuugaaaaauaccuauuuuuuuccaaagug

SEQ ID NO: 429469 - RNA, 64 nt, hsa
ggaaaaagaaacaggguuuugaacucuguuaacauuugaaaaauauauuuucaaauucacuuuc

SEQ ID NO: 429470 - RNA, 64 nt, hsa
aguaaucauuguuucauuuucauuuuuacgagaguuugaaaauagacacacuguuaacacuucu

SEQ ID NO: 429471 - RNA, 64 nt, hsa
acuuccaaccagguauaucuuugcaaagaaucuuuuugaaaaugguucccucagugacaucgag

SEQ ID NO: 429472 - RNA, 64 nt, hsa
acuuugccauuguuuucuuuuguaccugaagcauuuugaaaauaaaguuuacuuaaguuaugcu

SEQ ID NO: 429473 - RNA, 64 nt, hsa
cccagauguagcucucagcagugcuguugagacuuuugaaaacaacuuugguacacaaaggcag

SEQ ID NO: 429474 - RNA, 64 nt, hsa
auugcuuuacuuaauagguugaauaugguaggucuuugaaaauaugaugauucaauuuucucaa

SEQ ID NO: 429475 - RNA, 64 nt, hsa
gucuuuguuaguggagaccgcuaaacuaaugauguuugaaaacaguuccucuguuuuagauugg

SEQ ID NO: 429476 - RNA, 64 nt, hsa
gcagugauauuauuuccauaacuuaaaaagugaguuugaaaaagaaaaucuccagcaagcaucu

SEQ ID NO: 429477 - RNA, 64 nt, hsa
cuaagagaaaccuugcaaacucuauaaagaaacuuuugaaaaaguguacaugaagaauguagcc

SEQ ID NO: 429478 - RNA, 64 nt, hsa
aaucaaggaucuuuuggaccuggcuaauggaguguuugaaaacugacaucagauuucuuaaugu

SEQ ID NO: 429479 - RNA, 64 nt, hsa
agaauguaagcuaaacagauuuuuucuguugcucuuugaaaacuaugagcccuggccagcuuaa

SEQ ID NO: 429480 - RNA, 64 nt, hsa
cuauuacuuucuguucccaauguccuucuagugguuugaaaauguuaaaacaucccuaaaaucu

SEQ ID NO: 429481 - RNA, 64 nt, hsa
gacucagaagaugaagacuuugaaauccugucccuuugaaaauccuggggucggggguggcacc

SEQ ID NO: 429482 - RNA, 64 nt, hsa
caccuugaccaaaggggagcuuugucucguguguuuugaaaaaggcuuaaugaagagaauguug

SEQ ID NO: 429483 - RNA, 64 nt, hsa
ucuucuuuuaauauuuugauuuguuuuccuuuaguuugaaaaguuguauaauacuuaacugacu

SEQ ID NO: 429484 - RNA, 64 nt, hsa
auuucugaaaguaucagucuucugaauucugaguuuugaaaauauauuuugaggagaaaaagac

SEQ ID NO: 429485 - RNA, 64 nt, hsa
cuauuuaauuugaauagugaaguuuugaaaauacuuugaaaaagagaaguaaaaguuuaacuuu

SEQ ID NO: 429486 - RNA, 64 nt, hsa
auuaaaauauccuauuuaauuugaauagugaaguuuugaaaauacuuugaaaaagagaaguaaa

SEQ ID NO: 429487 - RNA, 64 nt, hsa
uuuguguuaagugacugagaagauguuaauuacuuuugaaaaaggaucaugguuuuugcucuac

SEQ ID NO: 429488 - RNA, 64 nt, hsa
uaugauaaguuccaaaaauaccauuuaucuacuauuugaaaaaagaagaggauaucccuuccua

SEQ ID NO: 429489 - RNA, 64 nt, hsa
uauuugaaaaugauauuaguuaucaacuuugcaguuugaaaaacauguauuguguguaaagguu

SEQ ID NO: 429490 - RNA, 64 nt, hsa
gaaucauguaauauuuaagguuauacuaugccuauuugaaaaugauauuaguuaucaacuuugc

SEQ ID NO: 429491 - RNA, 64 nt, hsa
agcagaguuuccaaaucagauuccucaaaccaccuuugaaaagccacagagucuugaguuccua

SEQ ID NO: 429492 - RNA, 64 nt, hsa
augugucuuuuauugugggucauagucacugaaguuugaaaaacauugacucagaacaucucau

SEQ ID NO: 429493 - RNA, 64 nt, hsa
gagccacaaacaguaaagcccuaucaguauaaaauuugaaaaaaaaaaaaaagaugauuguauu

SEQ ID NO: 429494 - RNA, 64 nt, hsa
gucaaauauuggugcacuuuaauacuaucacaucuuugaaaacucaauuugaguuuuaccaauu

SEQ ID NO: 429495 - RNA, 64 nt, hsa
auuucuauaauaaauuaacaagauucaccuaaccuuugaaaauaaaguaguauugaagacuuac

SEQ ID NO: 429496 - RNA, 64 nt, hsa
aacacagaaacuuaauuauugugaacuuuugcuguuugaaaaucuuagacauucauucuuaagu

SEQ ID NO: 429497 - RNA, 64 nt, hsa
uuugucacaggguguucuuuuuuaugaagaaaaauuugaaaaugauaaaagcuaagaugccuuc

SEQ ID NO: 429498 - RNA, 64 nt, hsa
gugguguuuguauuaugcuuaugacuauguaugguuugaaaauauuuucauuauacaugaaauu

SEQ ID NO: 429499 - RNA, 64 nt, hsa
ccuuaaguauaucauguaaagaaaugucuuaauuuuugaaaaaaguacauauuuauuuucuuuu

SEQ ID NO: 429500 - RNA, 64 nt, hsa
gaguaaaaaaaaaaacaauuacuggcucacuggcuuugaaaagucacuuacuauuguugcugaa

SEQ ID NO: 429501 - RNA, 64 nt, hsa
uacauaaaggcuaacuaugagcuugcucauuaauuuugaaaagauguaccugguggauaucuag

SEQ ID NO: 429502 - RNA, 64 nt, hsa
agauucucagaucuuuauucuaacaauuacaugauuugaaaacaguacucaaugagacuggaaa

SEQ ID NO: 429503 - RNA, 64 nt, hsa
gugaugaaaagcaauacgaaaagacaauguaaacuuugaaaaggauuuuagagggaaaauugca

SEQ ID NO: 429504 - RNA, 64 nt, hsa
augauggagugccucccuuuuccuuuuuucacuuuuugaaaaagauguuuuggguaguaguuua

SEQ ID NO: 429505 - RNA, 64 nt, hsa
augauaugaggaugguauaacuauguaaauuguuuuugaaaauaauuuguuuccccacaacuuu

SEQ ID NO: 429506 - RNA, 64 nt, hsa
accaguaaggaagcaacuaaauuuuguuuuguucuuugaaaaaggcuaaccugagcuagguaaa

SEQ ID NO: 429507 - RNA, 64 nt, hsa
aguaaaauuuuauuuuaauuaaaaucaauucauguuugaaaaaggauuuaaaguagcuucuaau

SEQ ID NO: 429508 - RNA, 64 nt, hsa
acuugccaguaccaacugggaugugugccuucaauuugaaaauuguauguuuuauuuuuuaaau

SEQ ID NO: 429509 - RNA, 64 nt, hsa
gaauuugaacuuuauguugaggacaugacauugguuugaaaauauaaacugcuuuugagcaguu

SEQ ID NO: 429510 - RNA, 64 nt, hsa
augagcauuuaaaaaaauaaguaaaucuaggcuauuugaaaaauacaguugagccagugagcac

SEQ ID NO: 429511 - RNA, 64 nt, hsa
uaacuuguuacuaaugcuaacuuuuaaaaauguuuuugaaaauugcaauuucuacaaauaaaug

SEQ ID NO: 429512 - RNA, 64 nt, hsa
uuuguguguguuuguuggccacuuguaugucuucuuugaaaacugacuucuaaucuugaggccu

SEQ ID NO: 429513 - RNA, 54 nt, hsa
uguggaugaguaaccacuaaucccuuugaaaaucaaguaguagagccaaguugg

SEQ ID NO: 429514 - RNA, 64 nt, hsa
uuaauucaagaaugcaguuuuaccaaaagaaaaauuugaaaauuucuauucaggcuacuggaau

SEQ ID NO: 429515 - RNA, 64 nt, hsa
cucuuaauuuauaagaagauaguugcaguuaaauuuugaaaaugguuguaaugagccaugaagu

SEQ ID NO: 429516 - RNA, 64 nt, hsa
uaacugcauacguuuugguguugcuuuucaaauguuugaaaacaaaaaaaauguuaagaaaugg

SEQ ID NO: 429517 - RNA, 64 nt, hsa
ucccuguacucugacccauagcacucuuguuugcuuugaaaauauuuguccaauugaguagcug

SEQ ID NO: 429518 - RNA, 64 nt, hsa
uuggaauaugaacuuugguucuucaugagugcauuuugaaaaagaaaaaaaguacacauucaga

SEQ ID NO: 429519 - RNA, 64 nt, hsa
ccauuuauaugcuacaaauuagucugauuccaucuuugaaaaugucuuaaaguauaaaauaauu

SEQ ID NO: 429520 - RNA, 64 nt, hsa
gaagauaacuuuuacuuaaauaugaaaauuauaguuugaaaauuaggcucaagcaaauaucaaa

SEQ ID NO: 429521 - RNA, 64 nt, hsa
uacaccaggauaaaucuuauuuaaaggaagccuguuugaaaaucaccaacuuuaacuuauugcu

SEQ ID NO: 429522 - RNA, 64 nt, hsa
uauuaaaacagaauaccauagaguaauugcauuauuugaaaauucucucauuuuacaaugcacu

SEQ ID NO: 429523 - RNA, 64 nt, hsa
aaugcacuucaccaaugaaacagcuaauuuccauuuugaaaauuaaaagaaaacagcacagaga

SEQ ID NO: 429524 - RNA, 64 nt, hsa
ugucuauuugcauauaacccugaaaacauuauuauuugaaaacuuuucuauaucucaaauuaau

SEQ ID NO: 429525 - RNA, 64 nt, hsa
aaaaacauucuauauuuguagcagaaaucagugguuugaaaagucauacuuugcagauaugaac

SEQ ID NO: 429526 - RNA, 64 nt, hsa
uaaaauaauagcaaguguagagaagagccguugcuuugaaaauacauaccacauuuguuauaaa

SEQ ID NO: 429527 - RNA, 64 nt, hsa
aacauguuuaaauguccauuuuuauucauuaugcuuugaaaaauaauuauggggaaauacaugu

SEQ ID NO: 429528 - RNA, 64 nt, hsa
uaacuuguuuaaauguccauuuuuauucuuuauguuugaaaauaaauuauggggauccuauuua

SEQ ID NO: 429529 - RNA, 64 nt, hsa
acccauaagaguucacaugaaaaaaaucaauuuauuugaaaaggcaagaugcaggagagaggaa

SEQ ID NO: 429530 - RNA, 64 nt, hsa
uuaaccacuuuugucauuuguuuuuuggaguaguuuugaaaaguguuuuauauugagugcacuu

SEQ ID NO: 429531 - RNA, 64 nt, hsa
uguugcagaagcauagauuuaauugcaucuuuauuuugaaaaacaaaugaaaauugaugggguu

SEQ ID NO: 429532 - RNA, 64 nt, hsa
guaagacugcugacucuuugaaaaucugagguauuuugaaaaauucugugauaguugcuauuaa

SEQ ID NO: 429533 - RNA, 64 nt, hsa
gaaaauauauucuaguagguaagacugcugacucuuugaaaaucugagguauuuugaaaaauuc

SEQ ID NO: 429534 - RNA, 64 nt, hsa
cucuguaaacuauuccuaaaauguguaugauauauuugaaaaggcuuccauuaauauaauagcu

SEQ ID NO: 429535 - RNA, 64 nt, hsa
uuauacauaacaccuuuugcauuauuucuuauguuuugaaaagaaaauagcuuuuuauacuuuu

SEQ ID NO: 429536 - RNA, 64 nt, hsa
aagguauuuaauuuccaaccacacuucuuauuuuuuugaaaagacaauuuuccauuucaguauu

SEQ ID NO: 429537 - RNA, 64 nt, hsa
aaaaucccagaaauguauuuuaaagaauuucagguuugaaaacucaaaccaacaggaagauauc

SEQ ID NO: 429538 - RNA, 64 nt, hsa
uuauuaauaugaguuacugaaggugauggagguauuugaaaauuuuacuuccauaggacauacu

SEQ ID NO: 429539 - RNA, 64 nt, hsa
uuaucaacuuuagcuaguaucuucaaacuuucacuuugaaaaaugagaauuuuauauucuaagc

SEQ ID NO: 429540 - RNA, 64 nt, hsa
gagcacccuucuccacucagcuccaaagcgaaucuuugaaaacacccacucggcucccaucucu

SEQ ID NO: 429541 - RNA, 64 nt, hsa
cgcgugugaaaggcagaacuaacgugcggaaacauuugaaaacaacucugaaugugcgguucgg

SEQ ID NO: 429542 - RNA, 64 nt, hsa
ugcaaguuccaugagaguaauauauugauaugauuuugaaaagaauuguugauaguuacaucuu

SEQ ID NO: 429543 - RNA, 64 nt, hsa
agugucagggaauaaacaugguggguagauuagguuugaaaaaaacuuccuuagagguauuuau

SEQ ID NO: 429544 - RNA, 64 nt, hsa
aauacuuuugcaaguguuggggagaucgguauguuuugaaaagaguaauuuaacuuuugggugc

SEQ ID NO: 429545 - RNA, 64 nt, hsa
guaaaaugugguaaaaugugauacgcacaaacccuuugaaaauagcaaaacaaacaugcccuuu

SEQ ID NO: 429546 - RNA, 64 nt, hsa
uuuguggucagcacaacaaggaacaaaacaaagcuuugaaaaaacuuuaacaugaaaaaacgca

SEQ ID NO: 429547 - RNA, 64 nt, hsa
cacguuguaaagagggaugauuuccuucuuuugauuugaaaauuugcacaugcucaaugcuuac

SEQ ID NO: 429548 - RNA, 64 nt, hsa
agaaaaauuaauggcauuuuaaagguuaaaacauuuugaaaaauuauuagcauguaacaaagaa

SEQ ID NO: 429549 - RNA, 64 nt, hsa
uccagcucaggaugaaaggauagacacaaaauuguuugaaaaacauuuuccaggccuggcucca

SEQ ID NO: 429550 - RNA, 64 nt, hsa
uaaaagcauacuugaaauagguggagcuuuuucuuuugaaaauauauauucacaauuuuaauau

SEQ ID NO: 429551 - RNA, 64 nt, hsa
auaugcacuucuuuucugaagaugcuuccgaagauuugaaaauaggauccaaaacacggcuggg

SEQ ID NO: 429552 - RNA, 64 nt, hsa
uauauaaauaauucagagggguuuuucauuuacuuuugaaaagaaauuucuuuaacaggauugc

SEQ ID NO: 429553 - RNA, 64 nt, hsa
ucacagcuuucauccaagcuuggugauaaucaauuuugaaaauacaguggacugaaaagcaaau

SEQ ID NO: 429554 - RNA, 64 nt, hsa
aauugucugccaauaccaaggauauucuuguauauuugaaaaauaacuuauuauuugaauuguu

SEQ ID NO: 429555 - RNA, 64 nt, hsa
acaaguuucagcagucuagccuuuggaugaccuauuugaaaaccacugaaagucguggaggaau

SEQ ID NO: 429556 - RNA, 64 nt, hsa
uuucuggcuuuuauuaauaugucuuaauuuugaguuugaaaauguuaagugcaauaaaaacaua

SEQ ID NO: 429557 - RNA, 64 nt, hsa
caaaugaaauuaaagcaacaauaauuuugaagcauuugaaaaagccaaaguguacgguagaaau

SEQ ID NO: 429558 - RNA, 64 nt, hsa
cacauucucagcugaugcaguccaggcuccaugcuuugaaaaccacuggucuagcuuuagauag

SEQ ID NO: 429559 - RNA, 64 nt, hsa
gaagcucuccaggugauuccaaugugcagacaaauuugaaaacugaaccaaccacaggaacauc

SEQ ID NO: 429560 - RNA, 64 nt, hsa
uuugcuuuuuuuuuauauaacacuuaaagguuucuuugaaaacccuccuuuccuuaaagcacau

SEQ ID NO: 429561 - RNA, 64 nt, hsa
uguaaacuccauauuuauuguauucauauuagucuuugaaaaugggucuguccuccuuguguaa

SEQ ID NO: 429562 - RNA, 64 nt, hsa
uggcccuugguaaaauuuugacaaucauaagucauuugaaaagaacagacuuacuaaaaucaaa

SEQ ID NO: 429563 - RNA, 64 nt, hsa
ccacaacaaauaccaagcaucaaaagcacuuucauuugaaaauuauuauguuguaauuuuucag

SEQ ID NO: 429564 - RNA, 64 nt, hsa
aucucacuuugugcuguauuaaaaaaaccuccauuuugaaaaucuacguuguacagaagcacau

SEQ ID NO: 429565 - RNA, 64 nt, hsa
gugccaucaugauuaaugaaaacuaucuuuugaguuugaaaagaaauuaauuugcaguguuugg

SEQ ID NO: 429566 - RNA, 64 nt, hsa
aauuuuuuuuuauauuuccuccgacuuaccucuuuuugaaaagagaguuuuuauuaagugaacc

SEQ ID NO: 429567 - RNA, 64 nt, hsa
uauugaugauuuucauuaagaguuucagauuaacuuugaaaaauauuccacaugguaaucuuau

SEQ ID NO: 429568 - RNA, 64 nt, hsa
gagcuagaaauagaacaauccaucagcaugagacuuugaaaaaaaaacacaugaucagcuucuc

SEQ ID NO: 429569 - RNA, 64 nt, hsa
uuucugauguggagauauguuauuaaugaagugguuugaaaauuuguuauauuaaaagugcaca

SEQ ID NO: 429570 - RNA, 64 nt, hsa
uguuuuguuuugagguuuagaaaggagacuguacuuugaaaauggaucuuguuugauucuguag

SEQ ID NO: 429571 - RNA, 64 nt, hsa
aacugcugugguugcugcugcuucgagaaaauuuuuugaaaaaucagcaguucugaugccuuga

SEQ ID NO: 429572 - RNA, 64 nt, hsa
cacauuaugcaaaucucuuuagcacuauuuuaaguuugaaaacuuuaacaaugaaggggaaggg

SEQ ID NO: 429573 - RNA, 64 nt, hsa
gcagguucuaaagaaaucuagaugagagaaaguauuugaaaaugauuuuuaaauguuuuuuaaa

SEQ ID NO: 429574 - RNA, 64 nt, hsa
aucaaauaaguaauagacaucaccagcaaugaauuuugaaaagcaaaaaauacuauuaaccuau

SEQ ID NO: 429575 - RNA, 64 nt, hsa
uaacauuuaaaaauuaaucaguuacaguaaagacuuugaaaaagaaauguacuuguuaggaagu

SEQ ID NO: 429576 - RNA, 64 nt, hsa
ucuuacuaacauaaauaucucaaguagaaaaguuuuugaaaacuaacauuuaaaaauuaaucag

SEQ ID NO: 429577 - RNA, 64 nt, hsa
aaauguuuggaacucugaaggauuuagacaagguuuugaaaaggauaaucauggguuagaagga

SEQ ID NO: 429578 - RNA, 64 nt, hsa
ucuagcaugaaagucccacuuugauuauugcuuauuugaaaacaguauucccaacuuuuguaaa

SEQ ID NO: 429579 - RNA, 64 nt, hsa
auuuaacugcuaauugagucugauaaaagucuucuuugaaaaaaguuuuuacuucuaagauuug

SEQ ID NO: 429580 - RNA, 64 nt, hsa
acaaaacaaagcaaaauauugaugaucaggcagauuugaaaacagugacauugcuugaucucug

SEQ ID NO: 429581 - RNA, 64 nt, hsa
uauaccuauauauucuuuguguuuauuuaaaaguuuugaaaauaugcaguacuguuuauauuuu

SEQ ID NO: 429582 - RNA, 64 nt, hsa
ucauggucacuaauuuucaacuagcaucagguauuuugaaaacgugugucuggauauuaacucu

SEQ ID NO: 429583 - RNA, 64 nt, hsa
uauuauguagggaccuuaugcaauuucuuuuucuuuugaaaaguuaucuacugcccuucuugga

SEQ ID NO: 429584 - RNA, 64 nt, hsa
agaggaacgggaaaagcuuuuugcuuauuugucuuuugaaaauuaaggcugggcgcgguggcuc

SEQ ID NO: 429585 - RNA, 64 nt, hsa
gaauuuuaucuuuuuuuuaaccuuauuaaaagccuuugaaaacacagcucuuucaugacaaaau

SEQ ID NO: 429586 - RNA, 64 nt, hsa
gauuuauuucaaauaguuuggaaauuguuguacuuuugaaaacaugcuguuccuguaguuuuuu

SEQ ID NO: 429587 - RNA, 64 nt, hsa
aacacgucuaauauauacuauuuuauugguuuauuuugaaaaacauggguauagaauuauuuaa

SEQ ID NO: 429588 - RNA, 64 nt, hsa
aaccaacaacauuaugguauuugugugacuuuuauuugaaaaaaugugagcaguaauuuggguu

SEQ ID NO: 429589 - RNA, 64 nt, hsa
cgggugucuccccaggugaguccauccacacacguuugaaaaacacuauuagucuuucuaacac

SEQ ID NO: 429590 - RNA, 64 nt, hsa
aauaaaaugauuaaugcauuuaucaauaaaagccuuugaaaauacuuuggauaauaaauuggag

SEQ ID NO: 429591 - RNA, 64 nt, hsa
aguuuuaacaaauuaaaaaaucaaaucauguacauuugaaaauauuugcacacauuuaaaaaua

SEQ ID NO: 429592 - RNA, 64 nt, hsa
gcauacuuuuuuauuaguuguaggaauacagcuuuuugaaaaagcuauaaaguuuaaauuaacu

SEQ ID NO: 429593 - RNA, 64 nt, hsa
uaaaacuggaccuguauuauccugaauacacuauuuugaaaauuuuuaaaaaugacuucuuuau

SEQ ID NO: 429594 - RNA, 64 nt, hsa
uuuuuauuaaauagugugaaaauauaaugggcauuuugaaaacuuuuagaaaaaaguaguacuu

SEQ ID NO: 429595 - RNA, 64 nt, hsa
gaacacauuaauguugaauuuuacagacaguauauuugaaaaaaauugauuccauguagucuuc

SEQ ID NO: 429596 - RNA, 64 nt, hsa
uaguaugucauuguaacuagccaauaucacagcuuuugaaaaauuaaaaaaucacacuauauua

SEQ ID NO: 429597 - RNA, 64 nt, hsa
uaggguagaauuuuguucaguuuggauuuaaucuuuugaaaaguaaauuccuuguuuacugguu

SEQ ID NO: 429598 - RNA, 64 nt, hsa
aaacaucuucuguguaugaagcaaaugucgauguuuugaaaaaagcuaggagaugacuuugaau

SEQ ID NO: 429599 - RNA, 64 nt, hsa
uggcaugagccaaagagucugucuuaauguuacuuuugaaaaucugcugagcggccaccauaug

SEQ ID NO: 429600 - RNA, 64 nt, hsa
cauuaauuguacaauaugcauuuucaguaaaauauuugaaaacuguaaauggcuuggcauuuuc

SEQ ID NO: 429601 - RNA, 64 nt, hsa
cauuacaggaauuguauguucacuucgaaucauguuugaaaaaacguuguauccuuauuuugua

SEQ ID NO: 429602 - RNA, 64 nt, hsa
agacuagauguuuuucugaagaucaauuagacauuuugaaaaugauuuaaaguguuuuccuuaa

SEQ ID NO: 429603 - RNA, 64 nt, hsa
auaacaggauuucuguauacugugcaaucaguucuuugaaaaaaaagucaaaagauagagaaua

SEQ ID NO: 429604 - RNA, 64 nt, hsa
aguaauacaaugaaaagcaaaauuguuccuuuuuuuugaaaauuuuauauacuuuauaaugaua

SEQ ID NO: 429605 - RNA, 64 nt, hsa
uaaugaauaugcuuucauuaaauagggagguagauuugaaaaaaccguuauaaagaaaugugcc

SEQ ID NO: 429606 - RNA, 64 nt, hsa
uuuugaaggguuuaugugcaaagugaaaacaaauuuugaaaaauaagacaaauccauucucuuc

SEQ ID NO: 429607 - RNA, 64 nt, hsa
uaauuuuauuauauuuuguuguuacuguauuauauuugaaaaccuucaaauuagaauacauugu

SEQ ID NO: 429608 - RNA, 64 nt, hsa
ugauauuucugugaacagagaggccaugggaagauuugaaaauuauuaaagaaaaauuccuaca

SEQ ID NO: 429609 - RNA, 64 nt, hsa
agauuauuuuaucugguauggugcuaauauuuuauuugaaaaaaguuacugcaacuuaacuuaa

SEQ ID NO: 429610 - RNA, 64 nt, hsa
cuguagaacugauuuuacaaauuaauauuugugcuuugaaaaaaaguuucuauuuaguuauuua

SEQ ID NO: 429611 - RNA, 64 nt, hsa
uuauuugcccaguuuuuaauuacacugagauaauuuugaaaagaaauagaaauuaagcuacuau

SEQ ID NO: 429612 - RNA, 64 nt, hsa
uuguuacuuauaucaauuuaaaauuugcuagugguuugaaaauaauaauguacugacuacaugu

SEQ ID NO: 429613 - RNA, 64 nt, hsa
aagaacaaaaaagaagagcaagagaaaaagcaaauuugaaaaauccucagaucauguaucuaga

SEQ ID NO: 429614 - RNA, 64 nt, hsa
auuugccuagaccacuuccuaaauccaaagcaucuuugaaaaguccugcgcugcggaggacagg

SEQ ID NO: 429615 - RNA, 64 nt, hsa
uaaaaaacauuucuauuugguccaugcaguuuuauuugaaaauagucugucaaaaucagaacuc

SEQ ID NO: 429616 - RNA, 64 nt, hsa
caagcaaagaacuguaaccgaaagaaguaagagauuugaaaagacgauagaguuaaaacaauau

SEQ ID NO: 429617 - RNA, 64 nt, hsa
guaagcaaacuuuuuguguuaucuggcacaggccuuugaaaagacuauaauucuacuuuguuua

SEQ ID NO: 429618 - RNA, 64 nt, hsa
auugucaaaauuuccagauuacugguaaaaauuauuugaaaacaaacuuauggguaauaaaggc

SEQ ID NO: 429619 - RNA, 64 nt, hsa
auacaguacugccaccagauuuuuuauuacaucauuugaaaauuagcaguaugcuuaaugaaaa

SEQ ID NO: 429620 - RNA, 64 nt, hsa
uuuugauuuuauguacaaugauuuauacucuccuuuugaaaagauaccauaaagcacauaagcu

SEQ ID NO: 429621 - RNA, 64 nt, hsa
uauuuuucuagucaaaaacguguuucccccaguguuugaaaacucguccgaaucuuuucaguau

SEQ ID NO: 429622 - RNA, 64 nt, hsa
cuuuugaaaauuaguaugguaauuaaauguacuuuuugaaaauuaauagaauuauuuaaauuac

SEQ ID NO: 429623 - RNA, 64 nt, hsa
ugaaagauuacuucugacauuccauugcucuucuuuugaaaauuaguaugguaauuaaauguac

SEQ ID NO: 429624 - RNA, 64 nt, hsa
ggcaugauuauuagaaacuauuuaagcuuuuuucuuugaaaaacaagcuccuuuuacagaauau

SEQ ID NO: 429625 - RNA, 64 nt, hsa
ccagcaggcugggugcguuaaaaagcccaaguauuuugaaaaaacucgaacagauuugacaagg

SEQ ID NO: 429626 - RNA, 64 nt, hsa
ccuacgguaagacuuaagcaaagccuuuuucauauuugaaaauguggaaagaaaagauguuccu

SEQ ID NO: 429627 - RNA, 64 nt, hsa
gagaacaaacguuagaaaaucacuucagauuguguuugaaaauuauauacugagcauacuaauu

SEQ ID NO: 429628 - RNA, 64 nt, hsa
ugggagucuguuggagcaagaggaacaugcuuguuuugaaaacucgagaugaugagggugguac

SEQ ID NO: 429629 - RNA, 64 nt, hsa
gacuuugucuuauaaacauuuuuucauuuuuuauuuugaaaaauugcaaaucuacagcaaaagu

SEQ ID NO: 429630 - RNA, 64 nt, hsa
cugugacaagaaauuuaaagaaucaaaacgaugguuugaaaaggaaaccuaugauacaugcagg

SEQ ID NO: 429631 - RNA, 64 nt, hsa
augauguggguaggucccaguaaacccauuauaauuugaaaauaucacauugaaaaugcauuua

SEQ ID NO: 429632 - RNA, 64 nt, hsa
cugauuaucauucuuuauuaacccuccuuggaauuuugaaaaccucgauuaaaguugccaaauu

SEQ ID NO: 429633 - RNA, 64 nt, hsa
uuaugauggaugugaaaaucuacggccaaauacuuuugaaaacaccuuucuauauugcacagug

SEQ ID NO: 429634 - RNA, 64 nt, hsa
auagaaaaauauuacuuuaagaugacuuguuuccuuugaaaauaccuguguacugaggguuaug

SEQ ID NO: 429635 - RNA, 64 nt, hsa
ugcuuuuccuaagacuucuaguauguaugaauucuuugaaaauuauauuacuuuuauuucuacu

SEQ ID NO: 429636 - RNA, 64 nt, hsa
auagaacauuuguaugaaaagacauuuaguaugcuuugaaaaaaacucagcuuuuaguuuuuuu

SEQ ID NO: 429637 - RNA, 64 nt, hsa
auauaauguacaguauaaagaggaauauugugcuuuugaaaagaguauacuuuuuacuuuuauu

SEQ ID NO: 429638 - RNA, 64 nt, hsa
uuuuuuauuacuaaaaauagcacauuugaguacauuugaaaaguagaaaaauuagaaauuauua

SEQ ID NO: 429639 - RNA, 64 nt, hsa
gcacacauacauacauauguauacacacacauaauuugaaaacugauuggcacuucaacgaugc

SEQ ID NO: 429640 - RNA, 64 nt, hsa
auaaccuuguaaagguaaaucuaauguauaaauuuuugaaaaauuuugcaccacuggucauagc

SEQ ID NO: 429641 - RNA, 64 nt, hsa
ccuucacuauuccucacucaagauuaagacauuuuuugaaaagcaguagaguuugcuuaaaaua

SEQ ID NO: 429642 - RNA, 64 nt, hsa
aauuaaaacacuacuguaauguuaauuuccugguuuugaaaaucauauuaugguuauguacauu

SEQ ID NO: 429643 - RNA, 64 nt, hsa
augcauauauacauguaucuguaugugaauagacuuugaaaaaauacagaauaaacuucauggu

SEQ ID NO: 429644 - RNA, 64 nt, hsa
agcaagaugucacaccuuguuguacaugagaaacuuugaaaauggaucuucauauagaaucagu

SEQ ID NO: 429645 - RNA, 64 nt, hsa
augagcucucuuguuuuuuuguuacuauuauuccuuugaaaaaaagacaaaauaucuaaaaaau

SEQ ID NO: 429646 - RNA, 64 nt, hsa
uucugauuccacuuucaaagucuuggauauauucuuugaaaaaugaguaguauggaauauuaag

SEQ ID NO: 429647 - RNA, 64 nt, hsa
ugcagcccucgccccucccugagaagaagcuggauuugaaaaucccucacaggcccuaacaugu

SEQ ID NO: 429648 - RNA, 64 nt, hsa
gugcacacugcagguugacuuaauuuauuuauuuuuugaaaagaagagacagaaaauaccuuau

SEQ ID NO: 429649 - RNA, 64 nt, hsa
uaggguauauucuuuuguauaaaacaaacagguuuuugaaaauauuacuguauaguuguucagc

SEQ ID NO: 429650 - RNA, 51 nt, hsa
acauuucuaaacuugccugaguuugaaaauuuguuaacaauacauuaaaau

SEQ ID NO: 429651 - RNA, 64 nt, hsa
auuuauuuccacuuuagaaaaguuagcacaugcuuuugaaaaucugugauuucauuuuauuagg

SEQ ID NO: 429652 - RNA, 64 nt, hsa
uuccucuagucgccagcucaucagaaaaacauacuuugaaaagaugcuugagauuuuccugcug

SEQ ID NO: 429653 - RNA, 64 nt, hsa
uacuuaaagaaaaguaguuuauauacaauuauuuuuugaaaauucacuugaaacuuguccauau

SEQ ID NO: 429654 - RNA, 64 nt, hsa
uuuuuucugcagcgcaugauaccaacagcacaacuuugaaaacuguuaaguauuuugaacugga

SEQ ID NO: 429655 - RNA, 64 nt, hsa
uacaauauguauaauuuuuaaaauguuuuauuauuuugaaaauaauguuguaauucaugccagg

SEQ ID NO: 429656 - RNA, 64 nt, hsa
ggcaauauugccaugguuuuacucaugugcagguuuugaaaauguacaauauguauaauuuuua

SEQ ID NO: 429657 - RNA, 64 nt, hsa
ggcgaacugcauuuuucuguuacacugguaaucauuugaaaauugauuuaccucaguguuuaac

SEQ ID NO: 429658 - RNA, 64 nt, hsa
uuuucauucagauucuuuguucguagagcaguuauuugaaaaacaguuauggaacacaaaacau

SEQ ID NO: 429659 - RNA, 64 nt, hsa
aacaauauuaaacaacaugaaacugcagucuguuuuugaaaaugagaauguccuaagugauuca

SEQ ID NO: 429660 - RNA, 64 nt, hsa
auaaauaugcaugcuuuuuguaauuaacuggugcuuugaaaaucuuuuuuaagggagaaaaauc

SEQ ID NO: 429661 - RNA, 64 nt, hsa
acauguauguggacugucaacaaaaauaacauuuuuugaaaagcuuuuauuuucaacauguaaa

SEQ ID NO: 429662 - RNA, 64 nt, hsa
gcuaauuuggcaagagaaacaguuuauuaauguuuuugaaaagauaagucauauucauacuuaa

SEQ ID NO: 429663 - RNA, 64 nt, hsa
ugagacuuguucuacuuuggagaacagguuaccuuuugaaaaugagguugaguuucuuccuuuc

SEQ ID NO: 429664 - RNA, 64 nt, hsa
ucacuucacauuggaugacaccauguucuuccucuuugaaaagaaaaggggaaugugucccacu

SEQ ID NO: 429665 - RNA, 64 nt, hsa
accguagggcuuuucucaaauagaaaagccagauuuugaaaaaauuuuaaagauaaaauaggac

SEQ ID NO: 429666 - RNA, 64 nt, hsa
ucuccagguauagagaaccauccagauguucacuuuugaaaauaucuaaugaugcaaaguuuua

SEQ ID NO: 429667 - RNA, 64 nt, hsa
gaaaguuuguuucucauuuucugcaaauucuuacuuugaaaaugaaucaccacauaguaugucc

SEQ ID NO: 429668 - RNA, 64 nt, hsa
uuuucuuuauuccuggcagugucaggaauauugguuugaaaagcuguuggccuaucuggaguuu

SEQ ID NO: 429669 - RNA, 64 nt, hsa
uaauuguccauucuugcuugacucuacuauuaaguuugaaaauaguuaccuucaaaggccaaga

SEQ ID NO: 429670 - RNA, 64 nt, hsa
uaaugauuauauaaaauacauaauauuuuucaauuuugaaaacucuaauuguccauucuugcuu

SEQ ID NO: 429671 - RNA, 64 nt, hsa
cagagaacaucagaaauuuucuaaaaugggucacuuugaaaagaauucuuuuucucacuauuaa

SEQ ID NO: 429672 - RNA, 64 nt, hsa
gcagugauuuuuccaggcuuccauuuagcaaauguuugaaaacucuagauuuuucucauaucag

SEQ ID NO: 429673 - RNA, 64 nt, hsa
auucaguggaggcuuuuguuuguguguguguggcuuugaaaacaaauuauuugagaaagaccau

SEQ ID NO: 429674 - RNA, 64 nt, hsa
aagcacaugaguaguuggcucugaacuuuguguauuugaaaaaggaaaauucaguggaggcuuu

SEQ ID NO: 429675 - RNA, 64 nt, hsa
ucacauuuuauauuuuuucuucacaauucuaaccuuugaaaauauuauaacuggauauuucuuc

SEQ ID NO: 429676 - RNA, 64 nt, hsa
uuaauaaaaaaauugugaaacagcauauuacaaguuugaaaauucagggcuggugaaaaaaauc

SEQ ID NO: 429677 - RNA, 64 nt, hsa
uugaagccaaaucuguugucauguuaguaaaugauuugaaaacugaauguaauacuugaguaga

SEQ ID NO: 429678 - RNA, 64 nt, hsa
uggagauacauguuagugguuaacuguuaagagcuuugaaaacacugcacauaucuguacaagc

SEQ ID NO: 429679 - RNA, 64 nt, hsa
aauauugcaaguggaugaguuggaaauuaugcacuuugaaaaacauucacuuuguuuaagcuua

SEQ ID NO: 429680 - RNA, 64 nt, hsa
uaaauuuuuauaaaauacucuugcaaaaaguuuauuugaaaaauuucuagauggucucaugagu

SEQ ID NO: 429681 - RNA, 64 nt, hsa
ccuuuuauuucuuuauuuuuugcuuauacuuguuuuugaaaaccuccucugaguuugaagggac

SEQ ID NO: 429682 - RNA, 64 nt, hsa
uuccaaguuuaaacucuuuccugcaggugauuacuuugaaaaagguugguccagaccauuuuga

SEQ ID NO: 429683 - RNA, 51 nt, hsa
uuggagaaguaaagaagugaauuugaaaauuugucuguauuuaauggccug

SEQ ID NO: 429684 - RNA, 64 nt, hsa
cugaguuucucuuucucucuuuuuaacuuuauuuuuugaaaaacccgguagacuuuuugugggg

SEQ ID NO: 429685 - RNA, 64 nt, hsa
guauagcagaaaaugaaacaugcaacaaaagcacuuugaaaaauauauaaggaauuguugagcc

SEQ ID NO: 429686 - RNA, 64 nt, hsa
aguacauuuuucuauguuuuaccacaaguuacaauuugaaaagaaaacuauuuuuuuuaaauau

SEQ ID NO: 429687 - RNA, 64 nt, hsa
uucuuuccagcauugugcuuuuucccugggcuuauuugaaaauuuuacuguuuuauacaagcuc

SEQ ID NO: 429688 - RNA, 64 nt, hsa
gaaaaaaacuggcuucauuucugugaaauugcucuuugaaaauuucuuuuuacacguguaagcc

SEQ ID NO: 429689 - RNA, 64 nt, hsa
agagaccuucacacagcaugagggcuguuggcauuuugaaaaagguuaauaaguagaagcauac

SEQ ID NO: 429690 - RNA, 64 nt, hsa
augguuuugaagcaacuguuuaauuuuuaaaauuuuugaaaacuugcuaauaaccuuuuguuca

SEQ ID NO: 429691 - RNA, 64 nt, hsa
aaaauaaauauucuuccugauuaaaaaaauuuuuuuugaaaaaaacaaggccagccccaaccuu

SEQ ID NO: 429692 - RNA, 64 nt, hsa
acguggccuauagcuucccuuccggaaagcuugcuuugaaaaacuuaaaaagcccccguuuaca

SEQ ID NO: 429693 - RNA, 64 nt, hsa
aagcgggcuggagauuuuuuccaauauuguuuucuuugaaaaugaaaggggaucaucuauuuua

SEQ ID NO: 429694 - RNA, 64 nt, hsa
gaucaucuauuuuaguuuuggggucugggaacuuuuugaaaauuuaauuuguggaccaauguuu

SEQ ID NO: 429695 - RNA, 64 nt, hsa
cugacaguacccgacuguuuauuggaucuauugauuugaaaagaauuuguuaggauagaucuua

SEQ ID NO: 429696 - RNA, 64 nt, hsa
caaguguuuuguauuuuauagugaguugcauguuuuugaaaaaaagugcugaaaaugggaugug

SEQ ID NO: 429697 - RNA, 64 nt, hsa
auuguuagcaaacuauuucagugauaauguucauuuugaaaauauguacuguauaacauuaaga

SEQ ID NO: 429698 - RNA, 64 nt, hsa
uuuagagaagcccaguaguuuuuauuguuggauuuuugaaaaaaccucuaccaagaauguggug

SEQ ID NO: 429699 - RNA, 64 nt, hsa
aaagugaugauauauuauuuugugaaacuuuguguuugaaaauguuuauuucuguuuauggugu

SEQ ID NO: 429700 - RNA, 64 nt, hsa
uucauggugaauauaugugauaacaucuuuauacuuugaaaaauguuccacuuacccuucagau

SEQ ID NO: 429701 - RNA, 64 nt, hsa
cuuuucaggaccuucacugcauuaaaacaauauuuuugaaaauuuaguacaguuuagaaagagc

SEQ ID NO: 429702 - RNA, 64 nt, hsa
cugcucuucaccaagaaaacccaaacaggacacuuuugaaaacaggacucagcaucgcuuucaa

SEQ ID NO: 429703 - RNA, 64 nt, hsa
cauugagauuauguuaaaagccuuggcuuaagaauuugaaaauuucuuuagccuguagcaaccu

SEQ ID NO: 429704 - RNA, 64 nt, hsa
ggaauagaacuuacuuaaaaauuggggagauuuauuugaaaaccagcuguaaguugugcauuga

SEQ ID NO: 429705 - RNA, 64 nt, hsa
auauuucuuuacuguuuugugagguaauacugauuuugaaaauauauauaagcuaaaaacagua

SEQ ID NO: 429706 - RNA, 64 nt, hsa
uugacaguaaaaacaacaaaccaggauucuacuguuugaaaagaaguuucguuuuaauuuugga

SEQ ID NO: 429707 - RNA, 64 nt, hsa
uaagaaucccuuuucauggucugaucuuaaguuguuugaaaaaagauucacgcuucugcaucca

SEQ ID NO: 429708 - RNA, 64 nt, hsa
caguauagagauugauuucaagggaguuacauuauuugaaaaguuaugacuuucagccuuugag

SEQ ID NO: 429709 - RNA, 64 nt, hsa
uaccacaauuaaagauuaugcuccccuuuucuuguuugaaaacaguuauuuggugacuagaaag

SEQ ID NO: 429710 - RNA, 64 nt, hsa
agcacaguaugaugguuuaaauaguucucuaauuuuugaaaaaucgugccaagcaauaagauuu

SEQ ID NO: 429711 - RNA, 64 nt, hsa
auuuguuuaauaauaaccuauuucaagucugaguuuugaaaauuuacauuucccaaguauugca

SEQ ID NO: 429712 - RNA, 64 nt, hsa
uugucugaugugaaaaagccuugguauuuuacauuuugaaaauucaaagaagcuuaauauaaaa

SEQ ID NO: 429713 - RNA, 64 nt, hsa
ccccccccaaaauccucauguuucugcuucauauuuugaaaaauaacaauuaaaacagacagcu

SEQ ID NO: 429714 - RNA, 64 nt, hsa
aaaagaccccggagagggaagaaaaucucaguauuuugaaaauugagauuacuucagagccuua

SEQ ID NO: 429715 - RNA, 64 nt, hsa
ucaauggauucuuuaguggaaggauuuaugcuucuuugaaaaccagugugugacucacuguaga

SEQ ID NO: 429716 - RNA, 64 nt, hsa
uuggagagguguguuaggauaauuguccaguuaauuugaaaaggccccagaugaaucaauaaau

SEQ ID NO: 429717 - RNA, 64 nt, hsa
ccguguuaccaaauuaccauuucagugagaagcuuuugaaaagucuucugacuuccagucuuuc

SEQ ID NO: 429718 - RNA, 64 nt, hsa
uuacacuucaagcuaaacaccaaaugggugauauuuugaaaaaaguuuguguuuuacugucuua

SEQ ID NO: 429719 - RNA, 64 nt, hsa
cuaccuuuacagaaccacagaucacuuauuauacuuugaaaaauugcuuugaaaaaugcuuuuc

SEQ ID NO: 429720 - RNA, 64 nt, hsa
accacagaucacuuauuauacuuugaaaaauugcuuugaaaaaugcuuuuccaguucuuagaaa

SEQ ID NO: 429721 - RNA, 64 nt, hsa
aaaaaggaguuuuaguagacaguauuauacuaucuuugaaaaucaaggagaaguuuaugcaacu

SEQ ID NO: 429722 - RNA, 64 nt, hsa
aucagcucuaaaaccaaagcugauuuuuagaaaauuugaaaauguaaaucagcccuauccauac

SEQ ID NO: 429723 - RNA, 64 nt, hsa
cauagacuuauauuuuauaaucagaauauguugcuuugaaaaagccucuaauggacugaccuua

SEQ ID NO: 429724 - RNA, 64 nt, hsa
uguuaaugguuaauguucccaaaccagagaaugcuuugaaaauguaucauucaguguaaauuaa

SEQ ID NO: 429725 - RNA, 64 nt, hsa
cuuuaaaaacucacuuacguuuguccuuuuucacuuugaaaaguuggaaggaucugcugaggcc

SEQ ID NO: 429726 - RNA, 64 nt, hsa
caaaugaaaagggcuauuaaaauauuuuuacaccuuugaaaauugcaggcuugguacaaagagg

SEQ ID NO: 429727 - RNA, 64 nt, hsa
auguacuugaaauauuuucauuaucauacuauucuuugaaaaaaaagaugcuuacuguauacuu

SEQ ID NO: 429728 - RNA, 64 nt, hsa
uauuuauuuuaaaaaauuauguuuucaucauucauuugaaaaugaaaaagccccaaagugagaa

SEQ ID NO: 429729 - RNA, 64 nt, hsa
gauagaucccacguugaugucugaacgaccgucuuuugaaaacucaucgggagugaauggcauc

SEQ ID NO: 429730 - RNA, 64 nt, hsa
aguuuaaaaaucagaaagacauucuuaguuaaucuuugaaaacucauacagugguauugcuagu

SEQ ID NO: 429731 - RNA, 64 nt, hsa; identical to SEQ ID NO: 429722

SEQ ID NO: 429732 - RNA, 64 nt, hsa; identical to SEQ ID NO: 429721

SEQ ID NO: 429733 - RNA, 64 nt, hsa
cauucaacuuuuuuucuugcagcaccgaggcacauuugaaaagauggaauugaagucguuuugu

SEQ ID NO: 429734 - RNA, 64 nt, hsa
agauaaagacuacagaaggaaagagaucuugccuuuugaaaagaugaaggaacaaagguugaga

SEQ ID NO: 429735 - RNA, 64 nt, hsa
ucacauuuauuaaauguuacuacauuucugaauuuuugaaaaauguauuuuaucauuaaauggc

SEQ ID NO: 429736 - RNA, 64 nt, hsa
agaucaugagcccuuuuucuccaguaguacaggcuuugaaaacuacuucuauuaaguuauugau

SEQ ID NO: 429737 - RNA, 64 nt, hsa
uucuuuccugcauuguuuuagucaaguaauggcuuuugaaaaaguaaaguucaauaauaacuaa

SEQ ID NO: 429738 - RNA, 64 nt, hsa
ugaggaggaucagccacacaauccagugcuucaguuugaaaauguaaaauucuaacccuaaagu

SEQ ID NO: 429739 - RNA, 64 nt, hsa
uacacaucaaccuccauguccuuaguccuggguuuuugaaaaagugcuaaaacggacaaguaga

SEQ ID NO: 429740 - RNA, 64 nt, hsa
aaccaacagguuuuuuuuguuuccaagagaguuauuugaaaaguuaacagaacaaugagauaac

SEQ ID NO: 429741 - RNA, 64 nt, hsa
cucuuuuacaauccuaaucauauuggguaauguuuuugaaaagcuaaugaagcuauugagaaag

SEQ ID NO: 429742 - RNA, 64 nt, hsa
uaucauucaaaacaaccauccugcucauaacaucuuugaaaagaaaaauauauaugugcaguau

SEQ ID NO: 429743 - RNA, 64 nt, hsa
gaaucguaaguuagcaaaagaaauuuuuuucaccuuugaaaaucacgugauguuaaaggacaaa

SEQ ID NO: 429744 - RNA, 64 nt, hsa
aaauagggaacuccagacugacacagcaguuguuuuugaaaaggaaauaaacuuugaugaauua

SEQ ID NO: 429745 - RNA, 64 nt, hsa
aggagagaugaccccuacccccucaucccccaguuuugaaaaggucuaagcaagugagucuggu

SEQ ID NO: 429746 - RNA, 64 nt, hsa
ugagaugcuucacuuuccuucucuguaaccagacuuugaaaaauuguucguuucaucaggcucu

SEQ ID NO: 429747 - RNA, 64 nt, hsa
gauguuggaaauuugggauuuugcaguuuugucuuuugaaaaugaucaagucuugucaguucgu

SEQ ID NO: 429748 - RNA, 64 nt, hsa
cagugggggagauaaauguuugcuccuaauucucuuugaaaacugggccucccugcucugugau

SEQ ID NO: 429749 - RNA, 64 nt, hsa
gaagcaucaaaauauacuuuuggaaguagaugacuuugaaaacagaaaugguacugauggccuc

SEQ ID NO: 429750 - RNA, 64 nt, hsa
augggagacugaagugugcagguucuucuauguuuuugaaaagaagguggggucuuggauauca

SEQ ID NO: 429751 - RNA, 64 nt, hsa
cguuacuagaaacuauggaaaacuggaaaauaacuuugaaaaaauuggauaaaguauaggaggg

SEQ ID NO: 429752 - RNA, 64 nt, hsa
uuugccuauuuauaauuaaaguauuuuucuuuaguuugaaaauguguauuaaaguuacauuuuu

SEQ ID NO: 429753 - RNA, 64 nt, hsa
cagggaaguuuuuuccacucuuuucucugugcauuuugaaaauuagucaaaauggacucuuuuc

SEQ ID NO: 429754 - RNA, 64 nt, hsa
cuuuuuugcagaacauuccuugaaaauauaagguuuugaaaagacauaauuuuacuugaaucuu

SEQ ID NO: 429755 - RNA, 64 nt, hsa
cuuuuguuguuguucaaacgggauucacagaguauuugaaaaauguauauauauuaagagguca

SEQ ID NO: 429756 - RNA, 64 nt, hsa
uaaaacauuaucuugucacuguaguuugguuuuauuugaaaaccugacaaaaaaaaaguuccag

SEQ ID NO: 429757 - RNA, 64 nt, hsa
aaaguaugucuuuaaaguauagaagagcauuuauuuugaaaaaaacauuacacauaugaagagg

SEQ ID NO: 429758 - RNA, 64 nt, hsa
uuggaggguuauaauuacauucaaaguacuuuuuuuugaaaauacagauuuuuuuuaaaaguga

SEQ ID NO: 429759 - RNA, 64 nt, hsa
ugugaaauagaaguguaugaauugcugcgacaauuuugaaaagaauagaggaaacacccucacu

SEQ ID NO: 429760 - RNA, 64 nt, hsa
aaaauuaacauucuaaaggauuuaaauacuggaauuugaaaagccaaacugugaaaccauuggg

SEQ ID NO: 429761 - RNA, 64 nt, hsa
aaaguaugcuuaacuuuuugaaaaaauuagauuuuuugaaaagugaguaauaauguaauucaac

SEQ ID NO: 429762 - RNA, 64 nt, hsa
uuugcaguuauugcauucaaaguaugcuuaacuuuuugaaaaaauuagauuuuuugaaaaguga

SEQ ID NO: 429763 - RNA, 64 nt, hsa
agaaauucuacaaaccagaaagaugugacagugcuuugaaaacaccucaaacuuuucaaaacau

SEQ ID NO: 429764 - RNA, 64 nt, hsa
agucggauucaauggacggucacagugcuauuacuuugaaaacccugcugauucugaaaagugu

SEQ ID NO: 429765 - RNA, 64 nt, hsa
cugauucugaaaagugucagaaguuaccauuugauuugaaaaauccguauccucugcuucuggu

SEQ ID NO: 429766 - RNA, 64 nt, hsa
aauaauuuaauugauggcauauaagaauaugcaguuugaaaaagccaaacucuucucuccacuu

SEQ ID NO: 429767 - RNA, 64 nt, hsa
ucugauuggcugguaccgagagcuguggguaaaauuugaaaauuguauuuagaauaagaaauuu

SEQ ID NO: 429768 - RNA, 64 nt, hsa
caaggucaugacuauccuagaacucucugugguuuuugaaaaucauugaauucuauuaauguag

SEQ ID NO: 429769 - RNA, 64 nt, hsa
gacuucaugugcccccaauuuuucacuauuguuauuugaaaaaauauuuuuauuuguaagaguu

SEQ ID NO: 429770 - RNA, 64 nt, hsa
augcaucuuugauguguuguucuuggcaauaaauuuugaaaaguaauauuuauuaaauuuuuuu

SEQ ID NO: 429771 - RNA, 64 nt, hsa
cauuacuuguugccuauaagccaaaauuaagguguuugaaaauaguuuauuuuaaaacaauagg

SEQ ID NO: 429772 - RNA, 64 nt, hsa
acugcauuuugguuuugccuauaccauccugauuuuugaaaagugaauuauaaacacaaaauug

SEQ ID NO: 429773 - RNA, 64 nt, hsa
gcaugaagucuguuaaagccauugucagcaaagcuuugaaaauaaaggacuucacaaaaacggu

SEQ ID NO: 429774 - RNA, 64 nt, hsa
acccuuuccucuagaugguaguugucacguuaucuuugaaaacucuuggacugcuccugaggag

SEQ ID NO: 429775 - RNA, 64 nt, hsa
agccuaaaauuuguuucucucuugaagaggauucuuugaaaagguccugcagagaaaucaguac

SEQ ID NO: 429776 - RNA, 64 nt, hsa
auuuuucaaauuuggcagacacuuuuuuuuuuuuuuugaaaaucuuuccuuccagaucuguugc

SEQ ID NO: 429777 - RNA, 64 nt, hsa
gcgaaccaguuucuuacauguucuaacguuugacuuugaaaacaguuuaaaacacgugugcuug

SEQ ID NO: 429778 - RNA, 64 nt, hsa
acuuacguauguuuguacuugguuuuacagcuccuuugaaaacucuguguuuggaauaucucua

SEQ ID NO: 429779 - RNA, 64 nt, hsa
ugucucuguguaguuccagcaaaucaagcugagcuuugaaaaaguuugucuuaguuuugugaag

SEQ ID NO: 429780 - RNA, 64 nt, hsa
aaaaaaagcaugguauaauugaaacuuuuuucauuuugaaaaguauugguuacuggugauguug

SEQ ID NO: 429781 - RNA, 64 nt, hsa
uaugaacuugagaucuguauaaauaagagcaugauuugaaaaaaagcaugguauaauugaaacu

SEQ ID NO: 429782 - RNA, 64 nt, hsa
agacaagaugcucaguugacacauuugaaaaguguuugaaaaauucuugugcaaaugaucaaga

SEQ ID NO: 429783 - RNA, 64 nt, hsa
uuucucugcuaagacaagaugcucaguugacacauuugaaaaguguuugaaaaauucuugugca

SEQ ID NO: 429784 - RNA, 64 nt, hsa
uggcaacagacucaugacaaaggauucaagauuguuugaaaaaaaaaaaaggggagcagggagg

SEQ ID NO: 429785 - RNA, 64 nt, hsa
cugauugacuggcuaguggccuggccauugguauuuugaaaaaucccuccaagugauucuuuua

SEQ ID NO: 429786 - RNA, 64 nt, hsa
gaaagaucaaauuaaauaauagaugugaaaaugcuuugaaaauguuuuuaagugcuaugcauau

SEQ ID NO: 429787 - RNA, 64 nt, hsa
aauccauaagcagguuauuuuuauuuuuuuacuguuugaaaagaaauaaguagugucauucaua

SEQ ID NO: 429788 - RNA, 64 nt, hsa
gacuucuuuauuucagagcucuggagacaccuaguuugaaaaauguuauucuguuuuuuuguga

SEQ ID NO: 429789 - RNA, 64 nt, hsa
ugaaaugcaauguauuucuuuuguaaucagugcauuugaaaauucaagccagcauauuccuagu

SEQ ID NO: 429790 - RNA, 64 nt, hsa
ugcacaaggggaaauuuggcuugcaauucaucacuuugaaaaggcugucacccuugacccaaac

SEQ ID NO: 429791 - RNA, 64 nt, hsa
uagucuguugaaaauguuuuccaaacaauguuacuuugaaaauugaguuuauguuugaccuaaa

SEQ ID NO: 429792 - RNA, 64 nt, hsa
uaacuauaaauuuugugaaugcauuuuccugguguuugaaaaagaagggggggagaauuccagg

SEQ ID NO: 429793 - RNA, 64 nt, hsa
uuguguugcuauuuacauaugaauuacugauuauuuugaaaagacgguguuaugcuuggguguu

SEQ ID NO: 429794 - RNA, 64 nt, hsa
uuucaaagaaguucaagaauuuucaaguugagccuuugaaaaucccauaaauugguuuuagcua

SEQ ID NO: 429795 - RNA, 64 nt, hsa
cagaaauaaacccauauaaauaugcucagcugauuuugaaaaagugaaaaagcaauucaaugga

SEQ ID NO: 429796 - RNA, 64 nt, hsa
acggacuuaaaugugauacauaaaacuagauaacuuugaaaaaagccacaggagaaaaaucuuc

SEQ ID NO: 429797 - RNA, 64 nt, hsa
agguggaaggaaacauaguagcaauggauacuuuuuugaaaaauuauugcauuaccaagaaaca

SEQ ID NO: 429798 - RNA, 64 nt, hsa
ggugcaugcaagagcauucuuaggagaccacuguuuugaaaaacuuuugacuuguacguguuag

SEQ ID NO: 429799 - RNA, 64 nt, hsa
aguguuauauaucuuugguuuuuuuaauaaaaucuuugaaaaccuaccucuuugucccguuguc

SEQ ID NO: 429800 - RNA, 64 nt, hsa
aaaaaacacacacacacaaaugaaauuuuuaaucuuugaaaauuauuuuuaagcgaauugggga

SEQ ID NO: 429801 - RNA, 64 nt, hsa
cuuaacaagcaauccucugucaaaaucugagguauuugaaaauaauuauccucuuaaccuucuc

SEQ ID NO: 429802 - RNA, 64 nt, hsa
aguacuggaaauugaaaaacgaaaaucguguguguuugaaaagaagaaugcaacuuguauauuu

SEQ ID NO: 429803 - RNA, 64 nt, hsa
uuuaagcaaccagaauuccacacuguaggaagguuuugaaaauuguuucguuauagauuuuauc

SEQ ID NO: 429804 - RNA, 64 nt, hsa
aaauggcuaccuauuaaagucccaguugaaauuuuuugaaaaaauacaccucccacaguucaca

SEQ ID NO: 429805 - RNA, 64 nt, hsa; identical to SEQ ID NO: 238476

SEQ ID NO: 429806 - RNA, 64 nt, hsa; identical to SEQ ID NO: 238477

SEQ ID NO: 429807 - RNA, 53 nt, hsa; identical to SEQ ID NO: 238478

SEQ ID NO: 429808 - RNA, 64 nt, hsa; identical to SEQ ID NO: 238479

SEQ ID NO: 429809 - RNA, 64 nt, hsa; identical to SEQ ID NO: 238480

SEQ ID NO: 429810 - RNA, 64 nt, hsa; identical to SEQ ID NO: 238481

SEQ ID NO: 429811 - RNA, 64 nt, hsa; identical to SEQ ID NO: 238482

SEQ ID NO: 429812 - RNA, 64 nt, hsa; identical to SEQ ID NO: 238483

SEQ ID NO: 429813 - RNA, 64 nt, hsa; identical to SEQ ID NO: 238484

SEQ ID NO: 429814 - RNA, 64 nt, hsa; identical to SEQ ID NO: 238485

SEQ ID NO: 429815 - RNA, 64 nt, hsa; identical to SEQ ID NO: 238486

SEQ ID NO: 429816 - RNA, 64 nt, hsa; identical to SEQ ID NO: 238487

SEQ ID NO: 429817 - RNA, 64 nt, hsa; identical to SEQ ID NO: 238488

SEQ ID NO: 429818 - RNA, 64 nt, hsa; identical to SEQ ID NO: 238489

SEQ ID NO: 429819 - RNA, 64 nt, hsa; identical to SEQ ID NO: 175479

SEQ ID NO: 429820 - RNA, 64 nt, hsa; identical to SEQ ID NO: 175480

SEQ ID NO: 429821 - RNA, 64 nt, hsa; identical to SEQ ID NO: 175481

SEQ ID NO: 429822 - RNA, 64 nt, hsa; identical to SEQ ID NO: 175482

SEQ ID NO: 429823 - RNA, 64 nt, hsa; identical to SEQ ID NO: 175483

SEQ ID NO: 429824 - RNA, 64 nt, hsa; identical to SEQ ID NO: 175484

SEQ ID NO: 429825 - RNA, 64 nt, hsa; identical to SEQ ID NO: 175485

SEQ ID NO: 429826 - RNA, 64 nt, hsa; identical to SEQ ID NO: 175486

SEQ ID NO: 429827 - RNA, 64 nt, hsa; identical to SEQ ID NO: 175487

SEQ ID NO: 429828 - RNA, 64 nt, hsa; identical to SEQ ID NO: 175488

SEQ ID NO: 429829 - RNA, 64 nt, hsa; identical to SEQ ID NO: 175489

SEQ ID NO: 429830 - RNA, 64 nt, hsa; identical to SEQ ID NO: 175490

SEQ ID NO: 429831 - RNA, 64 nt, hsa; identical to SEQ ID NO: 175491

SEQ ID NO: 429832 - RNA, 64 nt, hsa; identical to SEQ ID NO: 175492

SEQ ID NO: 429833 - RNA, 64 nt, hsa; identical to SEQ ID NO: 175493

SEQ ID NO: 429834 - RNA, 64 nt, hsa; identical to SEQ ID NO: 175494

SEQ ID NO: 429835 - RNA, 64 nt, hsa; identical to SEQ ID NO: 175495

SEQ ID NO: 429836 - RNA, 64 nt, hsa; identical to SEQ ID NO: 175496

SEQ ID NO: 429837 - RNA, 64 nt, hsa; identical to SEQ ID NO: 175497

SEQ ID NO: 429838 - RNA, 64 nt, hsa; identical to SEQ ID NO: 175498

SEQ ID NO: 429839 - RNA, 64 nt, hsa; identical to SEQ ID NO: 175499

SEQ ID NO: 429840 - RNA, 64 nt, hsa; identical to SEQ ID NO: 175500

SEQ ID NO: 429841 - RNA, 64 nt, hsa; identical to SEQ ID NO: 175501

SEQ ID NO: 429842 - RNA, 64 nt, hsa; identical to SEQ ID NO: 175502

SEQ ID NO: 429843 - RNA, 64 nt, hsa; identical to SEQ ID NO: 175503

SEQ ID NO: 429844 - RNA, 64 nt, hsa; identical to SEQ ID NO: 175504

SEQ ID NO: 429845 - RNA, 64 nt, hsa; identical to SEQ ID NO: 175505

SEQ ID NO: 429846 - RNA, 64 nt, hsa; identical to SEQ ID NO: 175506

SEQ ID NO: 429847 - RNA, 64 nt, hsa; identical to SEQ ID NO: 175507

SEQ ID NO: 429848 - RNA, 64 nt, hsa; identical to SEQ ID NO: 175508

SEQ ID NO: 429849 - RNA, 64 nt, hsa; identical to SEQ ID NO: 175509

SEQ ID NO: 429850 - RNA, 64 nt, hsa; identical to SEQ ID NO: 175510

SEQ ID NO: 429851 - RNA, 64 nt, hsa; identical to SEQ ID NO: 175511

SEQ ID NO: 429852 - RNA, 64 nt, hsa; identical to SEQ ID NO: 175512

SEQ ID NO: 429853 - RNA, 64 nt, hsa; identical to SEQ ID NO: 175513

SEQ ID NO: 429854 - RNA, 64 nt, hsa; identical to SEQ ID NO: 175514

SEQ ID NO: 429855 - RNA, 64 nt, hsa; identical to SEQ ID NO: 175515

SEQ ID NO: 429856 - RNA, 64 nt, hsa; identical to SEQ ID NO: 175516

SEQ ID NO: 429857 - RNA, 64 nt, hsa; identical to SEQ ID NO: 175517

SEQ ID NO: 429858 - RNA, 64 nt, hsa; identical to SEQ ID NO: 175518

SEQ ID NO: 429859 - RNA, 64 nt, hsa; identical to SEQ ID NO: 175519

SEQ ID NO: 429860 - RNA, 64 nt, hsa; identical to SEQ ID NO: 175520

SEQ ID NO: 429861 - RNA, 64 nt, hsa; identical to SEQ ID NO: 175521

SEQ ID NO: 429862 - RNA, 64 nt, hsa; identical to SEQ ID NO: 175522

SEQ ID NO: 429863 - RNA, 64 nt, hsa; identical to SEQ ID NO: 175523

SEQ ID NO: 429864 - RNA, 64 nt, hsa; identical to SEQ ID NO: 175524

SEQ ID NO: 429865 - RNA, 64 nt, hsa; identical to SEQ ID NO: 175525

SEQ ID NO: 429866 - RNA, 64 nt, hsa; identical to SEQ ID NO: 175526

SEQ ID NO: 429867 - RNA, 64 nt, hsa; identical to SEQ ID NO: 175527

SEQ ID NO: 429868 - RNA, 64 nt, hsa; identical to SEQ ID NO: 175528

SEQ ID NO: 429869 - RNA, 64 nt, hsa; identical to SEQ ID NO: 175529

SEQ ID NO: 429870 - RNA, 64 nt, hsa; identical to SEQ ID NO: 175530

SEQ ID NO: 429871 - RNA, 64 nt, hsa; identical to SEQ ID NO: 175531

SEQ ID NO: 429872 - RNA, 64 nt, hsa; identical to SEQ ID NO: 175532

SEQ ID NO: 429873 - RNA, 64 nt, hsa; identical to SEQ ID NO: 175533

SEQ ID NO: 429874 - RNA, 64 nt, hsa; identical to SEQ ID NO: 175534

SEQ ID NO: 429875 - RNA, 64 nt, hsa; identical to SEQ ID NO: 175535

SEQ ID NO: 429876 - RNA, 64 nt, hsa; identical to SEQ ID NO: 175536

SEQ ID NO: 429877 - RNA, 64 nt, hsa; identical to SEQ ID NO: 175537

SEQ ID NO: 429878 - RNA, 64 nt, hsa; identical to SEQ ID NO: 175538

SEQ ID NO: 429879 - RNA, 53 nt, hsa; identical to SEQ ID NO: 175539

SEQ ID NO: 429880 - RNA, 64 nt, hsa; identical to SEQ ID NO: 175540

SEQ ID NO: 429881 - RNA, 64 nt, hsa; identical to SEQ ID NO: 175541

SEQ ID NO: 429882 - RNA, 64 nt, hsa; identical to SEQ ID NO: 175542

SEQ ID NO: 429883 - RNA, 64 nt, hsa; identical to SEQ ID NO: 175543

SEQ ID NO: 429884 - RNA, 64 nt, hsa; identical to SEQ ID NO: 175544

SEQ ID NO: 429885 - RNA, 64 nt, hsa; identical to SEQ ID NO: 175545

SEQ ID NO: 429886 - RNA, 64 nt, hsa; identical to SEQ ID NO: 175546

SEQ ID NO: 429887 - RNA, 64 nt, hsa; identical to SEQ ID NO: 175547

SEQ ID NO: 429888 - RNA, 64 nt, hsa; identical to SEQ ID NO: 175548

SEQ ID NO: 429889 - RNA, 64 nt, hsa; identical to SEQ ID NO: 175549

SEQ ID NO: 429890 - RNA, 64 nt, hsa; identical to SEQ ID NO: 175550

SEQ ID NO: 429891 - RNA, 64 nt, hsa; identical to SEQ ID NO: 175551

SEQ ID NO: 429892 - RNA, 64 nt, hsa; identical to SEQ ID NO: 175552

SEQ ID NO: 429893 - RNA, 64 nt, hsa; identical to SEQ ID NO: 175553

SEQ ID NO: 429894 - RNA, 64 nt, hsa; identical to SEQ ID NO: 175554

SEQ ID NO: 429895 - RNA, 64 nt, hsa; identical to SEQ ID NO: 175555

SEQ ID NO: 429896 - RNA, 64 nt, hsa; identical to SEQ ID NO: 175556

SEQ ID NO: 429897 - RNA, 64 nt, hsa; identical to SEQ ID NO: 175557

SEQ ID NO: 429898 - RNA, 64 nt, hsa; identical to SEQ ID NO: 175558

SEQ ID NO: 429899 - RNA, 64 nt, hsa; identical to SEQ ID NO: 175559

SEQ ID NO: 429900 - RNA, 64 nt, hsa; identical to SEQ ID NO: 175560

SEQ ID NO: 429901 - RNA, 64 nt, hsa; identical to SEQ ID NO: 175561

SEQ ID NO: 429902 - RNA, 64 nt, hsa; identical to SEQ ID NO: 175562

SEQ ID NO: 429903 - RNA, 64 nt, hsa; identical to SEQ ID NO: 175563

SEQ ID NO: 429904 - RNA, 64 nt, hsa; identical to SEQ ID NO: 175564

SEQ ID NO: 429905 - RNA, 64 nt, hsa; identical to SEQ ID NO: 175565

SEQ ID NO: 429906 - RNA, 64 nt, hsa; identical to SEQ ID NO: 175566

SEQ ID NO: 429907 - RNA, 64 nt, hsa
augauuguaugaaguuuuaaaaaaaacuacagcagccaaagaaacuauauauauauauauauau

SEQ ID NO: 429908 - RNA, 64 nt, hsa
ucugggaauaucauagaguaacaagugcuggucagccaaagaaacauucacugcuggugaacca

SEQ ID NO: 429909 - RNA, 64 nt, hsa
cccaaggcccacuguccagcugcagaaauucguugccaaagauuggacagagacaccgaaggaa

SEQ ID NO: 429910 - RNA, 64 nt, hsa
uuuugcuccuccuguugccugagccccaucucaagccaaagaugagucagugguucugcuagga

SEQ ID NO: 429911 - RNA, 64 nt, hsa
auuuuugcuuacagaaaaacggggggagaauuaagccaaagaaguauauuuaugaaucagcaaa

SEQ ID NO: 429912 - RNA, 64 nt, hsa
aguucugaugcauuaauaaaagcagccaaauagggccaaagagaaaaauaacaggacucuguac

SEQ ID NO: 429913 - RNA, 64 nt, hsa
cuuuacauaugaagguuuaaaaauacaucauguggccaaagaaugagaaaggacagaauuaacc

SEQ ID NO: 429914 - RNA, 64 nt, hsa
caauauuacuuaaaaaguagaacagucaaugcaugccaaagaaccauaaacuagcagaggacau

SEQ ID NO: 429915 - RNA, 64 nt, hsa
aaaggguggaggguaaucucuacuuuccuauacugccaaagaaugugaggaagaaaugggacuc

SEQ ID NO: 429916 - RNA, 64 nt, hsa
caguaaaugaagaccauggaagaaaagaaggaaugccaaagaucgaggaaaucuaccaagacua

SEQ ID NO: 429917 - RNA, 64 nt, hsa
gugcugggauuacaggcaugagccaccaugcccagccaaagaucauuuuuuuauauagacuuca

SEQ ID NO: 429918 - RNA, 64 nt, hsa
acccgccgcauuacauuuccuaaaacauacugcugccaaagaccaacuguagaauccuuaaguc

SEQ ID NO: 429919 - RNA, 64 nt, hsa
cauuuuguaaugugguuuaacauccuuguuguuugccaaagaaauuucauuuggcugugaauau

SEQ ID NO: 429920 - RNA, 64 nt, hsa
acucuguuucugcaggggaugauauuggugaguugccaaagaagcaauacagcauaucugcuuu

SEQ ID NO: 429921 - RNA, 64 nt, hsa
uaugcauuuauacacuacgaguugaucucggccagccaaagacacacgacaaaagagacaaucg

SEQ ID NO: 429922 - RNA, 64 nt, hsa
uguauguagaagcaugaagucuuaaggacaaagugccaaagaaaguggucuuaagaaauguaua

SEQ ID NO: 429923 - RNA, 64 nt, hsa; identical to SEQ ID NO: 411830

SEQ ID NO: 429924 - RNA, 64 nt, hsa; identical to SEQ ID NO: 411831

SEQ ID NO: 429925 - RNA, 64 nt, hsa; identical to SEQ ID NO: 411832

SEQ ID NO: 429926 - RNA, 64 nt, hsa; identical to SEQ ID NO: 411833

SEQ ID NO: 429927 - RNA, 64 nt, hsa; identical to SEQ ID NO: 411834

SEQ ID NO: 429928 - RNA, 64 nt, hsa; identical to SEQ ID NO: 411835

SEQ ID NO: 429929 - RNA, 64 nt, hsa; identical to SEQ ID NO: 411836

SEQ ID NO: 429930 - RNA, 64 nt, hsa; identical to SEQ ID NO: 411837

SEQ ID NO: 429931 - RNA, 64 nt, hsa; identical to SEQ ID NO: 411838

SEQ ID NO: 429932 - RNA, 64 nt, hsa; identical to SEQ ID NO: 411839

SEQ ID NO: 429933 - RNA, 64 nt, hsa; identical to SEQ ID NO: 411840

SEQ ID NO: 429934 - RNA, 64 nt, hsa; identical to SEQ ID NO: 411841

SEQ ID NO: 429935 - RNA, 64 nt, hsa; identical to SEQ ID NO: 411842

SEQ ID NO: 429936 - RNA, 64 nt, hsa; identical to SEQ ID NO: 411843

SEQ ID NO: 429937 - RNA, 64 nt, hsa; identical to SEQ ID NO: 411844

SEQ ID NO: 429938 - RNA, 64 nt, hsa; identical to SEQ ID NO: 411845

SEQ ID NO: 429939 - RNA, 64 nt, hsa; identical to SEQ ID NO: 411846

SEQ ID NO: 429940 - RNA, 64 nt, hsa; identical to SEQ ID NO: 411847

SEQ ID NO: 429941 - RNA, 64 nt, hsa; identical to SEQ ID NO: 411848

SEQ ID NO: 429942 - RNA, 64 nt, hsa; identical to SEQ ID NO: 411849

SEQ ID NO: 429943 - RNA, 64 nt, hsa; identical to SEQ ID NO: 411850

SEQ ID NO: 429944 - RNA, 64 nt, hsa; identical to SEQ ID NO: 411851

SEQ ID NO: 429945 - RNA, 64 nt, hsa; identical to SEQ ID NO: 411852

SEQ ID NO: 429946 - RNA, 64 nt, hsa; identical to SEQ ID NO: 411853

SEQ ID NO: 429947 - RNA, 64 nt, hsa; identical to SEQ ID NO: 411854

SEQ ID NO: 429948 - RNA, 64 nt, hsa; identical to SEQ ID NO: 411855

SEQ ID NO: 429949 - RNA, 64 nt, hsa; identical to SEQ ID NO: 411856

SEQ ID NO: 429950 - RNA, 64 nt, hsa
agagaucacaggcacaaguugaaacaaacuaacaugacaagaaagcuauagaaaaaauaaacau

SEQ ID NO: 429951 - RNA, 64 nt, hsa
auaaaauccaggccuagacucaagguauuguaaaugacaagauaccaaauacaagauuuuaaaa

SEQ ID NO: 429952 - RNA, 64 nt, hsa
ggaaauaguccuccaaaaaguccacuuguaccagugacaagaagucacuuguauagugaccaag

SEQ ID NO: 429953 - RNA, 64 nt, hsa
agagcaaauucugucccccccucacucccccaagugacaagauacuaaugaagaaaguucuuca

SEQ ID NO: 429954 - RNA, 64 nt, hsa
ggaauacucuauauauugacaagaguuuauauauugacaagaguuuauauauuugucaaaacuc

SEQ ID NO: 429955 - RNA, 64 nt, hsa
gaaauguuuuggggugguggaauacucuauauauugacaagaguuuauauauugacaagaguuu

SEQ ID NO: 429956 - RNA, 64 nt, hsa
uauucguguggcuagaauugguugguuggucacuugacaagaaaaaccauacuuaccugggcca

SEQ ID NO: 429957 - RNA, 64 nt, hsa
guaaacguuccuuguuucuuuucucccaugacacugacaagaggaauuaccaccucagccucuu

SEQ ID NO: 429958 - RNA, 64 nt, hsa; identical to SEQ ID NO: 141383

SEQ ID NO: 429959 - RNA, 64 nt, hsa; identical to SEQ ID NO: 141384

SEQ ID NO: 429960 - RNA, 64 nt, hsa; identical to SEQ ID NO: 141385

SEQ ID NO: 429961 - RNA, 64 nt, hsa; identical to SEQ ID NO: 141386

SEQ ID NO: 429962 - RNA, 64 nt, hsa; identical to SEQ ID NO: 141387

SEQ ID NO: 429963 - RNA, 64 nt, hsa; identical to SEQ ID NO: 141388

SEQ ID NO: 429964 - RNA, 64 nt, hsa; identical to SEQ ID NO: 141389

SEQ ID NO: 429965 - RNA, 64 nt, hsa; identical to SEQ ID NO: 141390

SEQ ID NO: 429966 - RNA, 64 nt, hsa; identical to SEQ ID NO: 141391

SEQ ID NO: 429967 - RNA, 64 nt, hsa; identical to SEQ ID NO: 141392

SEQ ID NO: 429968 - RNA, 64 nt, hsa; identical to SEQ ID NO: 141393

SEQ ID NO: 429969 - RNA, 64 nt, hsa; identical to SEQ ID NO: 141394

SEQ ID NO: 429970 - RNA, 64 nt, hsa; identical to SEQ ID NO: 141395

SEQ ID NO: 429971 - RNA, 64 nt, hsa; identical to SEQ ID NO: 141396

SEQ ID NO: 429972 - RNA, 64 nt, hsa; identical to SEQ ID NO: 141397

SEQ ID NO: 429973 - RNA, 64 nt, hsa; identical to SEQ ID NO: 141398

SEQ ID NO: 429974 - RNA, 64 nt, hsa; identical to SEQ ID NO: 141399

SEQ ID NO: 429975 - RNA, 64 nt, hsa; identical to SEQ ID NO: 141400

SEQ ID NO: 429976 - RNA, 64 nt, hsa; identical to SEQ ID NO: 52330

SEQ ID NO: 429977 - RNA, 64 nt, hsa; identical to SEQ ID NO: 52331

SEQ ID NO: 429978 - RNA, 64 nt, hsa; identical to SEQ ID NO: 52332

SEQ ID NO: 429979 - RNA, 64 nt, hsa; identical to SEQ ID NO: 52333

SEQ ID NO: 429980 - RNA, 64 nt, hsa; identical to SEQ ID NO: 52334

SEQ ID NO: 429981 - RNA, 64 nt, hsa; identical to SEQ ID NO: 52335

SEQ ID NO: 429982 - RNA, 64 nt, hsa; identical to SEQ ID NO: 52336

SEQ ID NO: 429983 - RNA, 63 nt, hsa; identical to SEQ ID NO: 52337

SEQ ID NO: 429984 - RNA, 64 nt, hsa; identical to SEQ ID NO: 52338

SEQ ID NO: 429985 - RNA, 64 nt, hsa; identical to SEQ ID NO: 52339

SEQ ID NO: 429986 - RNA, 64 nt, hsa; identical to SEQ ID NO: 52340

SEQ ID NO: 429987 - RNA, 64 nt, hsa; identical to SEQ ID NO: 52341

SEQ ID NO: 429988 - RNA, 64 nt, hsa; identical to SEQ ID NO: 52342

SEQ ID NO: 429989 - RNA, 64 nt, hsa; identical to SEQ ID NO: 52343

SEQ ID NO: 429990 - RNA, 64 nt, hsa; identical to SEQ ID NO: 52344

SEQ ID NO: 429991 - RNA, 64 nt, hsa; identical to SEQ ID NO: 52345

SEQ ID NO: 429992 - RNA, 64 nt, hsa; identical to SEQ ID NO: 52346

SEQ ID NO: 429993 - RNA, 64 nt, hsa; identical to SEQ ID NO: 52347

SEQ ID NO: 429994 - RNA, 64 nt, hsa; identical to SEQ ID NO: 52348

SEQ ID NO: 429995 - RNA, 64 nt, hsa; identical to SEQ ID NO: 52349

SEQ ID NO: 429996 - RNA, 64 nt, hsa; identical to SEQ ID NO: 52350

SEQ ID NO: 429997 - RNA, 64 nt, hsa; identical to SEQ ID NO: 52351

SEQ ID NO: 429998 - RNA, 64 nt, hsa; identical to SEQ ID NO: 52352

SEQ ID NO: 429999 - RNA, 64 nt, hsa; identical to SEQ ID NO: 52353

SEQ ID NO: 430000 - RNA, 64 nt, hsa; identical to SEQ ID NO: 52354

SEQ ID NO: 430001 - RNA, 64 nt, hsa; identical to SEQ ID NO: 52355

SEQ ID NO: 430002 - RNA, 64 nt, hsa; identical to SEQ ID NO: 52356

SEQ ID NO: 430003 - RNA, 64 nt, hsa; identical to SEQ ID NO: 52357

SEQ ID NO: 430004 - RNA, 64 nt, hsa; identical to SEQ ID NO: 52358

SEQ ID NO: 430005 - RNA, 64 nt, hsa; identical to SEQ ID NO: 52359

SEQ ID NO: 430006 - RNA, 64 nt, hsa; identical to SEQ ID NO: 52360

SEQ ID NO: 430007 - RNA, 59 nt, hsa; identical to SEQ ID NO: 52361

SEQ ID NO: 430008 - RNA, 64 nt, hsa; identical to SEQ ID NO: 52362

SEQ ID NO: 430009 - RNA, 64 nt, hsa; identical to SEQ ID NO: 52363

SEQ ID NO: 430010 - RNA, 64 nt, hsa; identical to SEQ ID NO: 52364

SEQ ID NO: 430011 - RNA, 64 nt, hsa; identical to SEQ ID NO: 52365

SEQ ID NO: 430012 - RNA, 64 nt, hsa; identical to SEQ ID NO: 52366

SEQ ID NO: 430013 - RNA, 64 nt, hsa; identical to SEQ ID NO: 52367

SEQ ID NO: 430014 - RNA, 64 nt, hsa; identical to SEQ ID NO: 52368

SEQ ID NO: 430015 - RNA, 64 nt, hsa; identical to SEQ ID NO: 52369

SEQ ID NO: 430016 - RNA, 64 nt, hsa; identical to SEQ ID NO: 52370

SEQ ID NO: 430017 - RNA, 64 nt, hsa; identical to SEQ ID NO: 52371

SEQ ID NO: 430018 - RNA, 64 nt, hsa; identical to SEQ ID NO: 52372

SEQ ID NO: 430019 - RNA, 64 nt, hsa; identical to SEQ ID NO: 52373

SEQ ID NO: 430020 - RNA, 64 nt, hsa; identical to SEQ ID NO: 52374

SEQ ID NO: 430021 - RNA, 64 nt, hsa; identical to SEQ ID NO: 52375

SEQ ID NO: 430022 - RNA, 64 nt, hsa; identical to SEQ ID NO: 97332

SEQ ID NO: 430023 - RNA, 64 nt, hsa; identical to SEQ ID NO: 97333

SEQ ID NO: 430024 - RNA, 64 nt, hsa; identical to SEQ ID NO: 97334

SEQ ID NO: 430025 - RNA, 64 nt, hsa; identical to SEQ ID NO: 97335

SEQ ID NO: 430026 - RNA, 64 nt, hsa; identical to SEQ ID NO: 97336

SEQ ID NO: 430027 - RNA, 64 nt, hsa; identical to SEQ ID NO: 97337

SEQ ID NO: 430028 - RNA, 64 nt, hsa; identical to SEQ ID NO: 97338

SEQ ID NO: 430029 - RNA, 64 nt, hsa; identical to SEQ ID NO: 97339

SEQ ID NO: 430030 - RNA, 64 nt, hsa; identical to SEQ ID NO: 97340

SEQ ID NO: 430031 - RNA, 64 nt, hsa; identical to SEQ ID NO: 97341

SEQ ID NO: 430032 - RNA, 64 nt, hsa; identical to SEQ ID NO: 97342

SEQ ID NO: 430033 - RNA, 64 nt, hsa; identical to SEQ ID NO: 97343

SEQ ID NO: 430034 - RNA, 64 nt, hsa; identical to SEQ ID NO: 97344

SEQ ID NO: 430035 - RNA, 64 nt, hsa; identical to SEQ ID NO: 97345

SEQ ID NO: 430036 - RNA, 64 nt, hsa; identical to SEQ ID NO: 97346

SEQ ID NO: 430037 - RNA, 64 nt, hsa; identical to SEQ ID NO: 97347

SEQ ID NO: 430038 - RNA, 64 nt, hsa; identical to SEQ ID NO: 97348

SEQ ID NO: 430039 - RNA, 64 nt, hsa; identical to SEQ ID NO: 97349

SEQ ID NO: 430040 - RNA, 64 nt, hsa; identical to SEQ ID NO: 97350

SEQ ID NO: 430041 - RNA, 64 nt, hsa; identical to SEQ ID NO: 97351

SEQ ID NO: 430042 - RNA, 64 nt, hsa; identical to SEQ ID NO: 97352

SEQ ID NO: 430043 - RNA, 64 nt, hsa; identical to SEQ ID NO: 97353

SEQ ID NO: 430044 - RNA, 64 nt, hsa; identical to SEQ ID NO: 97354

SEQ ID NO: 430045 - RNA, 64 nt, hsa; identical to SEQ ID NO: 97355

SEQ ID NO: 430046 - RNA, 64 nt, hsa; identical to SEQ ID NO: 97356

SEQ ID NO: 430047 - RNA, 64 nt, hsa; identical to SEQ ID NO: 97357

SEQ ID NO: 430048 - RNA, 64 nt, hsa; identical to SEQ ID NO: 97358

SEQ ID NO: 430049 - RNA, 64 nt, hsa; identical to SEQ ID NO: 97359

SEQ ID NO: 430050 - RNA, 64 nt, hsa; identical to SEQ ID NO: 97360

SEQ ID NO: 430051 - RNA, 64 nt, hsa; identical to SEQ ID NO: 97361

SEQ ID NO: 430052 - RNA, 64 nt, hsa; identical to SEQ ID NO: 97362

SEQ ID NO: 430053 - RNA, 64 nt, hsa; identical to SEQ ID NO: 97363

SEQ ID NO: 430054 - RNA, 64 nt, hsa; identical to SEQ ID NO: 97364

SEQ ID NO: 430055 - RNA, 64 nt, hsa; identical to SEQ ID NO: 97365

SEQ ID NO: 430056 - RNA, 64 nt, hsa; identical to SEQ ID NO: 97366

SEQ ID NO: 430057 - RNA, 64 nt, hsa; identical to SEQ ID NO: 97367

SEQ ID NO: 430058 - RNA, 64 nt, hsa; identical to SEQ ID NO: 97368

SEQ ID NO: 430059 - RNA, 64 nt, hsa; identical to SEQ ID NO: 97369

SEQ ID NO: 430060 - RNA, 64 nt, hsa; identical to SEQ ID NO: 97370

SEQ ID NO: 430061 - RNA, 64 nt, hsa; identical to SEQ ID NO: 97371

SEQ ID NO: 430062 - RNA, 64 nt, hsa; identical to SEQ ID NO: 97372

SEQ ID NO: 430063 - RNA, 64 nt, hsa; identical to SEQ ID NO: 97373

SEQ ID NO: 430064 - RNA, 64 nt, hsa; identical to SEQ ID NO: 97374

SEQ ID NO: 430065 - RNA, 64 nt, hsa; identical to SEQ ID NO: 97375

SEQ ID NO: 430066 - RNA, 64 nt, hsa; identical to SEQ ID NO: 97376

SEQ ID NO: 430067 - RNA, 64 nt, hsa; identical to SEQ ID NO: 97377

SEQ ID NO: 430068 - RNA, 64 nt, hsa; identical to SEQ ID NO: 97378

SEQ ID NO: 430069 - RNA, 64 nt, hsa; identical to SEQ ID NO: 97379

SEQ ID NO: 430070 - RNA, 64 nt, hsa; identical to SEQ ID NO: 97380

SEQ ID NO: 430071 - RNA, 64 nt, hsa; identical to SEQ ID NO: 97381

SEQ ID NO: 430072 - RNA, 64 nt, hsa; identical to SEQ ID NO: 97382

SEQ ID NO: 430073 - RNA, 64 nt, hsa; identical to SEQ ID NO: 97383

SEQ ID NO: 430074 - RNA, 64 nt, hsa; identical to SEQ ID NO: 97384

SEQ ID NO: 430075 - RNA, 64 nt, hsa; identical to SEQ ID NO: 97385

SEQ ID NO: 430076 - RNA, 64 nt, hsa; identical to SEQ ID NO: 97386

SEQ ID NO: 430077 - RNA, 64 nt, hsa; identical to SEQ ID NO: 97387

SEQ ID NO: 430078 - RNA, 64 nt, hsa; identical to SEQ ID NO: 97388

SEQ ID NO: 430079 - RNA, 64 nt, hsa; identical to SEQ ID NO: 97389

SEQ ID NO: 430080 - RNA, 64 nt, hsa; identical to SEQ ID NO: 97390

SEQ ID NO: 430081 - RNA, 64 nt, hsa; identical to SEQ ID NO: 97391

SEQ ID NO: 430082 - RNA, 64 nt, hsa; identical to SEQ ID NO: 97392

SEQ ID NO: 430083 - RNA, 64 nt, hsa; identical to SEQ ID NO: 97393

SEQ ID NO: 430084 - RNA, 64 nt, hsa; identical to SEQ ID NO: 97394

SEQ ID NO: 430085 - RNA, 64 nt, hsa; identical to SEQ ID NO: 45477

SEQ ID NO: 430086 - RNA, 64 nt, hsa; identical to SEQ ID NO: 45478

SEQ ID NO: 430087 - RNA, 64 nt, hsa; identical to SEQ ID NO: 45479

SEQ ID NO: 430088 - RNA, 64 nt, hsa; identical to SEQ ID NO: 45480

SEQ ID NO: 430089 - RNA, 64 nt, hsa; identical to SEQ ID NO: 45481

SEQ ID NO: 430090 - RNA, 64 nt, hsa; identical to SEQ ID NO: 45482

SEQ ID NO: 430091 - RNA, 64 nt, hsa; identical to SEQ ID NO: 45483

SEQ ID NO: 430092 - RNA, 64 nt, hsa; identical to SEQ ID NO: 45484

SEQ ID NO: 430093 - RNA, 64 nt, hsa; identical to SEQ ID NO: 45485

SEQ ID NO: 430094 - RNA, 64 nt, hsa; identical to SEQ ID NO: 45486

SEQ ID NO: 430095 - RNA, 64 nt, hsa; identical to SEQ ID NO: 45487

SEQ ID NO: 430096 - RNA, 56 nt, hsa; identical to SEQ ID NO: 45488

SEQ ID NO: 430097 - RNA, 64 nt, hsa; identical to SEQ ID NO: 45489

SEQ ID NO: 430098 - RNA, 64 nt, hsa; identical to SEQ ID NO: 45490

SEQ ID NO: 430099 - RNA, 64 nt, hsa; identical to SEQ ID NO: 45491

SEQ ID NO: 430100 - RNA, 64 nt, hsa; identical to SEQ ID NO: 45492

SEQ ID NO: 430101 - RNA, 64 nt, hsa; identical to SEQ ID NO: 45493

SEQ ID NO: 430102 - RNA, 64 nt, hsa; identical to SEQ ID NO: 45494

SEQ ID NO: 430103 - RNA, 64 nt, hsa; identical to SEQ ID NO: 45495

SEQ ID NO: 430104 - RNA, 64 nt, hsa; identical to SEQ ID NO: 45496

SEQ ID NO: 430105 - RNA, 64 nt, hsa; identical to SEQ ID NO: 45497

SEQ ID NO: 430106 - RNA, 64 nt, hsa; identical to SEQ ID NO: 45498

SEQ ID NO: 430107 - RNA, 64 nt, hsa; identical to SEQ ID NO: 45499

SEQ ID NO: 430108 - RNA, 64 nt, hsa; identical to SEQ ID NO: 45500

SEQ ID NO: 430109 - RNA, 64 nt, hsa; identical to SEQ ID NO: 45501

SEQ ID NO: 430110 - RNA, 64 nt, hsa; identical to SEQ ID NO: 45502

SEQ ID NO: 430111 - RNA, 64 nt, hsa; identical to SEQ ID NO: 45503

SEQ ID NO: 430112 - RNA, 64 nt, hsa; identical to SEQ ID NO: 45504

SEQ ID NO: 430113 - RNA, 64 nt, hsa; identical to SEQ ID NO: 45505

SEQ ID NO: 430114 - RNA, 64 nt, hsa; identical to SEQ ID NO: 45506

SEQ ID NO: 430115 - RNA, 64 nt, hsa; identical to SEQ ID NO: 45507

SEQ ID NO: 430116 - RNA, 64 nt, hsa; identical to SEQ ID NO: 45508

SEQ ID NO: 430117 - RNA, 64 nt, hsa; identical to SEQ ID NO: 45509

SEQ ID NO: 430118 - RNA, 64 nt, hsa; identical to SEQ ID NO: 45510

SEQ ID NO: 430119 - RNA, 64 nt, hsa; identical to SEQ ID NO: 45511

SEQ ID NO: 430120 - RNA, 64 nt, hsa; identical to SEQ ID NO: 45512

SEQ ID NO: 430121 - RNA, 64 nt, hsa; identical to SEQ ID NO: 45513

SEQ ID NO: 430122 - RNA, 64 nt, hsa; identical to SEQ ID NO: 45514

SEQ ID NO: 430123 - RNA, 64 nt, hsa; identical to SEQ ID NO: 45515

SEQ ID NO: 430124 - RNA, 64 nt, hsa; identical to SEQ ID NO: 45516

SEQ ID NO: 430125 - RNA, 64 nt, hsa; identical to SEQ ID NO: 45517

SEQ ID NO: 430126 - RNA, 64 nt, hsa; identical to SEQ ID NO: 45518

SEQ ID NO: 430127 - RNA, 64 nt, hsa; identical to SEQ ID NO: 45519

SEQ ID NO: 430128 - RNA, 64 nt, hsa; identical to SEQ ID NO: 45520

SEQ ID NO: 430129 - RNA, 64 nt, hsa; identical to SEQ ID NO: 45521

SEQ ID NO: 430130 - RNA, 64 nt, hsa; identical to SEQ ID NO: 45522

SEQ ID NO: 430131 - RNA, 64 nt, hsa; identical to SEQ ID NO: 45523

SEQ ID NO: 430132 - RNA, 64 nt, hsa; identical to SEQ ID NO: 45524

SEQ ID NO: 430133 - RNA, 64 nt, hsa; identical to SEQ ID NO: 45525

SEQ ID NO: 430134 - RNA, 64 nt, hsa; identical to SEQ ID NO: 45526

SEQ ID NO: 430135 - RNA, 64 nt, hsa; identical to SEQ ID NO: 45527

SEQ ID NO: 430136 - RNA, 64 nt, hsa; identical to SEQ ID NO: 45528

SEQ ID NO: 430137 - RNA, 64 nt, hsa; identical to SEQ ID NO: 45529

SEQ ID NO: 430138 - RNA, 64 nt, hsa; identical to SEQ ID NO: 45530

SEQ ID NO: 430139 - RNA, 64 nt, hsa; identical to SEQ ID NO: 45531

SEQ ID NO: 430140 - RNA, 64 nt, hsa; identical to SEQ ID NO: 45532

SEQ ID NO: 430141 - RNA, 64 nt, hsa; identical to SEQ ID NO: 45533

SEQ ID NO: 430142 - RNA, 64 nt, hsa; identical to SEQ ID NO: 45534

SEQ ID NO: 430143 - RNA, 64 nt, hsa; identical to SEQ ID NO: 45535

SEQ ID NO: 430144 - RNA, 64 nt, hsa; identical to SEQ ID NO: 45536

SEQ ID NO: 430145 - RNA, 64 nt, hsa; identical to SEQ ID NO: 45537

SEQ ID NO: 430146 - RNA, 64 nt, hsa; identical to SEQ ID NO: 45538

SEQ ID NO: 430147 - RNA, 64 nt, hsa; identical to SEQ ID NO: 45539

SEQ ID NO: 430148 - RNA, 64 nt, hsa; identical to SEQ ID NO: 45540

SEQ ID NO: 430149 - RNA, 64 nt, hsa; identical to SEQ ID NO: 45541

SEQ ID NO: 430150 - RNA, 64 nt, hsa; identical to SEQ ID NO: 45542

SEQ ID NO: 430151 - RNA, 64 nt, hsa; identical to SEQ ID NO: 45543

SEQ ID NO: 430152 - RNA, 64 nt, hsa; identical to SEQ ID NO: 45544

SEQ ID NO: 430153 - RNA, 64 nt, hsa; identical to SEQ ID NO: 45545

SEQ ID NO: 430154 - RNA, 64 nt, hsa; identical to SEQ ID NO: 45546

SEQ ID NO: 430155 - RNA, 64 nt, hsa; identical to SEQ ID NO: 45547

SEQ ID NO: 430156 - RNA, 64 nt, hsa; identical to SEQ ID NO: 45548

SEQ ID NO: 430157 - RNA, 64 nt, hsa; identical to SEQ ID NO: 45549

SEQ ID NO: 430158 - RNA, 64 nt, hsa; identical to SEQ ID NO: 45550

SEQ ID NO: 430159 - RNA, 64 nt, hsa; identical to SEQ ID NO: 45551

SEQ ID NO: 430160 - RNA, 64 nt, hsa; identical to SEQ ID NO: 45552

SEQ ID NO: 430161 - RNA, 64 nt, hsa; identical to SEQ ID NO: 45553

SEQ ID NO: 430162 - RNA, 64 nt, hsa; identical to SEQ ID NO: 45554

SEQ ID NO: 430163 - RNA, 64 nt, hsa; identical to SEQ ID NO: 45555

SEQ ID NO: 430164 - RNA, 64 nt, hsa; identical to SEQ ID NO: 45556

SEQ ID NO: 430165 - RNA, 64 nt, hsa; identical to SEQ ID NO: 45557

SEQ ID NO: 430166 - RNA, 64 nt, hsa; identical to SEQ ID NO: 45558

SEQ ID NO: 430167 - RNA, 64 nt, hsa; identical to SEQ ID NO: 45559

SEQ ID NO: 430168 - RNA, 64 nt, hsa; identical to SEQ ID NO: 45560

SEQ ID NO: 430169 - RNA, 64 nt, hsa; identical to SEQ ID NO: 45561

SEQ ID NO: 430170 - RNA, 64 nt, hsa; identical to SEQ ID NO: 45562

SEQ ID NO: 430171 - RNA, 64 nt, hsa; identical to SEQ ID NO: 45563

SEQ ID NO: 430172 - RNA, 64 nt, hsa; identical to SEQ ID NO: 45564

SEQ ID NO: 430173 - RNA, 64 nt, hsa; identical to SEQ ID NO: 45565

SEQ ID NO: 430174 - RNA, 64 nt, hsa; identical to SEQ ID NO: 45566

SEQ ID NO: 430175 - RNA, 64 nt, hsa; identical to SEQ ID NO: 45567

SEQ ID NO: 430176 - RNA, 64 nt, hsa; identical to SEQ ID NO: 45568

SEQ ID NO: 430177 - RNA, 64 nt, hsa; identical to SEQ ID NO: 45569

SEQ ID NO: 430178 - RNA, 64 nt, hsa; identical to SEQ ID NO: 45570

SEQ ID NO: 430179 - RNA, 64 nt, hsa; identical to SEQ ID NO: 45571

SEQ ID NO: 430180 - RNA, 64 nt, hsa; identical to SEQ ID NO: 45572

SEQ ID NO: 430181 - RNA, 64 nt, hsa; identical to SEQ ID NO: 45573

SEQ ID NO: 430182 - RNA, 64 nt, hsa; identical to SEQ ID NO: 45574

SEQ ID NO: 430183 - RNA, 64 nt, hsa; identical to SEQ ID NO: 45575

SEQ ID NO: 430184 - RNA, 64 nt, hsa; identical to SEQ ID NO: 45576

SEQ ID NO: 430185 - RNA, 64 nt, hsa; identical to SEQ ID NO: 45577

SEQ ID NO: 430186 - RNA, 64 nt, hsa; identical to SEQ ID NO: 45578

SEQ ID NO: 430187 - RNA, 64 nt, hsa; identical to SEQ ID NO: 45579

SEQ ID NO: 430188 - RNA, 64 nt, hsa; identical to SEQ ID NO: 45580

SEQ ID NO: 430189 - RNA, 64 nt, hsa; identical to SEQ ID NO: 45581

SEQ ID NO: 430190 - RNA, 64 nt, hsa; identical to SEQ ID NO: 45582

SEQ ID NO: 430191 - RNA, 64 nt, hsa; identical to SEQ ID NO: 45583

SEQ ID NO: 430192 - RNA, 64 nt, hsa; identical to SEQ ID NO: 45584

SEQ ID NO: 430193 - RNA, 64 nt, hsa; identical to SEQ ID NO: 45585

SEQ ID NO: 430194 - RNA, 64 nt, hsa; identical to SEQ ID NO: 45586

SEQ ID NO: 430195 - RNA, 64 nt, hsa; identical to SEQ ID NO: 45587

SEQ ID NO: 430196 - RNA, 64 nt, hsa; identical to SEQ ID NO: 45588

SEQ ID NO: 430197 - RNA, 64 nt, hsa; identical to SEQ ID NO: 45589

SEQ ID NO: 430198 - RNA, 64 nt, hsa; identical to SEQ ID NO: 45590

SEQ ID NO: 430199 - RNA, 64 nt, hsa; identical to SEQ ID NO: 45591

SEQ ID NO: 430200 - RNA, 64 nt, hsa; identical to SEQ ID NO: 45592

SEQ ID NO: 430201 - RNA, 64 nt, hsa; identical to SEQ ID NO: 45593

SEQ ID NO: 430202 - RNA, 64 nt, hsa; identical to SEQ ID NO: 45594

SEQ ID NO: 430203 - RNA, 64 nt, hsa; identical to SEQ ID NO: 45595

SEQ ID NO: 430204 - RNA, 64 nt, hsa; identical to SEQ ID NO: 45596

SEQ ID NO: 430205 - RNA, 64 nt, hsa; identical to SEQ ID NO: 45597

SEQ ID NO: 430206 - RNA, 64 nt, hsa; identical to SEQ ID NO: 45598

SEQ ID NO: 430207 - RNA, 64 nt, hsa; identical to SEQ ID NO: 45599

SEQ ID NO: 430208 - RNA, 64 nt, hsa; identical to SEQ ID NO: 45600

SEQ ID NO: 430209 - RNA, 64 nt, hsa; identical to SEQ ID NO: 45601

SEQ ID NO: 430210 - RNA, 64 nt, hsa; identical to SEQ ID NO: 45602

SEQ ID NO: 430211 - RNA, 64 nt, hsa; identical to SEQ ID NO: 45603

SEQ ID NO: 430212 - RNA, 64 nt, hsa; identical to SEQ ID NO: 45604

SEQ ID NO: 430213 - RNA, 64 nt, hsa; identical to SEQ ID NO: 45605

SEQ ID NO: 430214 - RNA, 64 nt, hsa; identical to SEQ ID NO: 45606

SEQ ID NO: 430215 - RNA, 64 nt, hsa; identical to SEQ ID NO: 45607

SEQ ID NO: 430216 - RNA, 64 nt, hsa; identical to SEQ ID NO: 45608

SEQ ID NO: 430217 - RNA, 64 nt, hsa; identical to SEQ ID NO: 45609

SEQ ID NO: 430218 - RNA, 64 nt, hsa; identical to SEQ ID NO: 45610

SEQ ID NO: 430219 - RNA, 64 nt, hsa; identical to SEQ ID NO: 45611

SEQ ID NO: 430220 - RNA, 64 nt, hsa; identical to SEQ ID NO: 45612

SEQ ID NO: 430221 - RNA, 64 nt, hsa; identical to SEQ ID NO: 45613

SEQ ID NO: 430222 - RNA, 64 nt, hsa; identical to SEQ ID NO: 45614

SEQ ID NO: 430223 - RNA, 64 nt, hsa; identical to SEQ ID NO: 45615

SEQ ID NO: 430224 - RNA, 64 nt, hsa; identical to SEQ ID NO: 45616

SEQ ID NO: 430225 - RNA, 64 nt, hsa; identical to SEQ ID NO: 45617

SEQ ID NO: 430226 - RNA, 64 nt, hsa; identical to SEQ ID NO: 45618

SEQ ID NO: 430227 - RNA, 64 nt, hsa; identical to SEQ ID NO: 45619

SEQ ID NO: 430228 - RNA, 64 nt, hsa; identical to SEQ ID NO: 45620

SEQ ID NO: 430229 - RNA, 64 nt, hsa; identical to SEQ ID NO: 45621

SEQ ID NO: 430230 - RNA, 64 nt, hsa; identical to SEQ ID NO: 45622

SEQ ID NO: 430231 - RNA, 64 nt, hsa; identical to SEQ ID NO: 45623

SEQ ID NO: 430232 - RNA, 64 nt, hsa; identical to SEQ ID NO: 45624

SEQ ID NO: 430233 - RNA, 64 nt, hsa; identical to SEQ ID NO: 45625

SEQ ID NO: 430234 - RNA, 64 nt, hsa; identical to SEQ ID NO: 45626

SEQ ID NO: 430235 - RNA, 64 nt, hsa; identical to SEQ ID NO: 45627

SEQ ID NO: 430236 - RNA, 64 nt, hsa; identical to SEQ ID NO: 45628

SEQ ID NO: 430237 - RNA, 64 nt, hsa; identical to SEQ ID NO: 45629

SEQ ID NO: 430238 - RNA, 64 nt, hsa; identical to SEQ ID NO: 45630

SEQ ID NO: 430239 - RNA, 64 nt, hsa; identical to SEQ ID NO: 45631

SEQ ID NO: 430240 - RNA, 64 nt, hsa; identical to SEQ ID NO: 45632

SEQ ID NO: 430241 - RNA, 64 nt, hsa; identical to SEQ ID NO: 45633

SEQ ID NO: 430242 - RNA, 64 nt, hsa; identical to SEQ ID NO: 45634

SEQ ID NO: 430243 - RNA, 64 nt, hsa; identical to SEQ ID NO: 45635

SEQ ID NO: 430244 - RNA, 64 nt, hsa; identical to SEQ ID NO: 45636

SEQ ID NO: 430245 - RNA, 64 nt, hsa; identical to SEQ ID NO: 45637

SEQ ID NO: 430246 - RNA, 64 nt, hsa; identical to SEQ ID NO: 45638

SEQ ID NO: 430247 - RNA, 64 nt, hsa; identical to SEQ ID NO: 45639

SEQ ID NO: 430248 - RNA, 64 nt, hsa; identical to SEQ ID NO: 45640

SEQ ID NO: 430249 - RNA, 64 nt, hsa; identical to SEQ ID NO: 45641

SEQ ID NO: 430250 - RNA, 64 nt, hsa; identical to SEQ ID NO: 45642

SEQ ID NO: 430251 - RNA, 64 nt, hsa; identical to SEQ ID NO: 45643

SEQ ID NO: 430252 - RNA, 64 nt, hsa; identical to SEQ ID NO: 45644

SEQ ID NO: 430253 - RNA, 64 nt, hsa; identical to SEQ ID NO: 45645

SEQ ID NO: 430254 - RNA, 64 nt, hsa; identical to SEQ ID NO: 45646

SEQ ID NO: 430255 - RNA, 64 nt, hsa; identical to SEQ ID NO: 45647

SEQ ID NO: 430256 - RNA, 64 nt, hsa; identical to SEQ ID NO: 45648

SEQ ID NO: 430257 - RNA, 64 nt, hsa; identical to SEQ ID NO: 45649

SEQ ID NO: 430258 - RNA, 64 nt, hsa; identical to SEQ ID NO: 45650

SEQ ID NO: 430259 - RNA, 64 nt, hsa; identical to SEQ ID NO: 45651

SEQ ID NO: 430260 - RNA, 64 nt, hsa; identical to SEQ ID NO: 45652

SEQ ID NO: 430261 - RNA, 64 nt, hsa; identical to SEQ ID NO: 45653

SEQ ID NO: 430262 - RNA, 64 nt, hsa; identical to SEQ ID NO: 45654

SEQ ID NO: 430263 - RNA, 64 nt, hsa; identical to SEQ ID NO: 45655

SEQ ID NO: 430264 - RNA, 64 nt, hsa
agcaagauggguguccuuccaggccucuuccccuuuccuccaucucuggcaacaguucuugggg

SEQ ID NO: 430265 - RNA, 64 nt, hsa
gcugcaauuuuauuuuaauuugagaaauaaagauuuccuccaagccacaugaggacucuggcac

SEQ ID NO: 430266 - RNA, 55 nt, hsa
agagugaguccaaggugugaccagcuuccuccagaccccuguggcagaccggggg

SEQ ID NO: 430267 - RNA, 64 nt, hsa
aacaccccugugcaaauuuuaaaaaggaacccuuuuccuccagacagauacagccccaaaccag

SEQ ID NO: 430268 - RNA, 64 nt, hsa
cgcugcucguucuccuuuucuguucaugcacacauuccuccaugggguggggaaggcaggcaug

SEQ ID NO: 430269 - RNA, 64 nt, hsa
aaagcuugaaaaggcgcagagcccuauaccucauuuccuccaugauaaaaggauccaagugagg

SEQ ID NO: 430270 - RNA, 64 nt, hsa
ggggauuuuccccuuuuucuacccacuccuuugcuuccuccaagacuuacccaacuccuucccc

SEQ ID NO: 430271 - RNA, 64 nt, hsa
ugcaggugacauacagaugggcuaaggugaggccuuccuccaacauggggcccuggcugagagu

SEQ ID NO: 430272 - RNA, 64 nt, hsa
acaaguggaggaggaggagggggugagaacaccuuuccuccagcccugugccacacuccuucua

SEQ ID NO: 430273 - RNA, 64 nt, hsa
ggagauagggaagcccagccaggacugacccuccuuccuccagccugcccugacccaccuggca

SEQ ID NO: 430274 - RNA, 64 nt, hsa
augagggacugaggcccacgagucuuuccagcucuuccuccauucuggccagucccugcauccu

SEQ ID NO: 430275 - RNA, 64 nt, hsa
cagcuaggucgcggcagcagugauggauuuauaguuccuccaaacaaagaugggaccccucccg

SEQ ID NO: 430276 - RNA, 64 nt, hsa
agauacuagcauugcacauauagucugcuuucuguuccuccagaauuugaguccuguuaaugua

SEQ ID NO: 430277 - RNA, 64 nt, hsa
cucuuccuccaucuucauuucccuccuuuuccuguuccuccaauccccagauccaccacuccug

SEQ ID NO: 430278 - RNA, 64 nt, hsa
ccuuucauguguguuuuuccucacacagaaccucuuccuccaucuucauuucccuccuuuuccu

SEQ ID NO: 430279 - RNA, 64 nt, hsa
cuuccugguugcaagagggaugugccuccauuauuuccuccacaguuuugguauuugucagaca

SEQ ID NO: 430280 - RNA, 64 nt, hsa
ccucuacccuuggaaucagagcaaugugucuucuuuccuccaaccucuuaccuuagaugcaucc

SEQ ID NO: 430281 - RNA, 64 nt, hsa
agaagagggggcuuuccaucccacccuggcuuccuuccuccacccaguggagacccccccaagg

SEQ ID NO: 430282 - RNA, 64 nt, hsa
ucaccgcgcaugugcaugccgugcgggcagacucuuccuccacacagcagacacggaccuaugg

SEQ ID NO: 430283 - RNA, 64 nt, hsa
uuuucugggauuucuuuuucucuucuuucugcucuuccuccacugcugaacuggucccuaacug

SEQ ID NO: 430284 - RNA, 64 nt, hsa
gcccacauuuuaaguauauuccuucaagugaguuuuccuccagccccugagaguugcugucucc

SEQ ID NO: 430285 - RNA, 64 nt, hsa
uccucacagugguucuguaccaaaacuugccaaauuccuccauggccaaguguuaaaaucugug

SEQ ID NO: 430286 - RNA, 64 nt, hsa
uugagaccuagacucuguaaaaauaauccuagucuuccuccaggggucaguuccucacaguggu

SEQ ID NO: 430287 - RNA, 64 nt, hsa
ccagagugaccguggcacuuggguguacagguaauuccuccagagcuguuugcuggcuucagga

SEQ ID NO: 430288 - RNA, 64 nt, hsa
guauugcauucugccguguuuauagguguucacuuuccuccagagcugauuaacuacugacaug

SEQ ID NO: 430289 - RNA, 64 nt, hsa
uguaucuggauuguaaugugaaucuuuaggguaauuccuccagugaccugucaaggcuuaugcu

SEQ ID NO: 430290 - RNA, 64 nt, hsa
cuggcgguucauuucaugaucaguguuaagcauuuuccuccaugggaaggaagcaugggauaua

SEQ ID NO: 430291 - RNA, 64 nt, hsa
auaggagaccuaucgucuuggaacuugccauucuuuccuccagaacaaaauguuaacuuucuaa

SEQ ID NO: 430292 - RNA, 64 nt, hsa
uuuccccguaguauaccauccagcuucccuccccuuccuccaaaacccucccucccaccucccc

SEQ ID NO: 430293 - RNA, 64 nt, hsa
cuuuuuguuuguuuuccuucuccucuccugcauuuuccuccaucuccagguacaguucggggug

SEQ ID NO: 430294 - RNA, 64 nt, hsa
caucuccagguacaguucgggguguggaugccucuuccuccacaagggcacaguguuguggagg

SEQ ID NO: 430295 - RNA, 64 nt, hsa
gggggagcccagggccccugugaccccuccuuucuuccuccaauccccaguuuguauuuagcug

SEQ ID NO: 430296 - RNA, 64 nt, hsa
uauuagcuuuuguuuacaccguggaauugaccccuuccuccaggggucuugggugggggagccc

SEQ ID NO: 430297 - RNA, 64 nt, hsa
gaagcuguugccuuauuaaugauuaucuuaaaauuuccuccauuggggcagcgugggccaaauu

SEQ ID NO: 430298 - RNA, 64 nt, hsa
agagggaacugugcccaguauacuguuuuuuuucuuccuccaauaaaagugguguagugccgaa

SEQ ID NO: 430299 - RNA, 64 nt, hsa
uugaaaaggaauuagagggucagaaacacccagguuccuccagaaagcuccuuggagcccaaca

SEQ ID NO: 430300 - RNA, 64 nt, hsa
gagaagacauauugacucugacuggacacccugauuccuccaaauauauauaccacuguguauu

SEQ ID NO: 430301 - RNA, 64 nt, hsa
gcugcccuggaagcaccugcuuggcccugccaccuuccuccaggggagggccagauggcauccu

SEQ ID NO: 430302 - RNA, 64 nt, hsa
guaacugcaggacugcgccuacugagugacccauuuccuccaggaggaaaggcaagacacgcuu

SEQ ID NO: 430303 - RNA, 64 nt, hsa
ggacccuuugggacaguuacuucugggacccccuuuccuccacagagcccuucucccugguuuc

SEQ ID NO: 430304 - RNA, 64 nt, hsa
ccccuaccacaaaccaggcuggaacccaagccccuuccuccacagcugccuucaguggguagaa

SEQ ID NO: 430305 - RNA, 64 nt, hsa
ugcuccggggccuggggccuccuugccuggcuucuuccuccagcuauccucagggaagcuggag

SEQ ID NO: 430306 - RNA, 64 nt, hsa
ggcccaguagagcugcccuuccccagauggaagcuuccuccaaccuucaguuuggccagugggu

SEQ ID NO: 430307 - RNA, 64 nt, hsa
aagugguaggucuugcugauugcauccacauucauuccuccauuuccuuucccagcaacccccc

SEQ ID NO: 430308 - RNA, 64 nt, hsa
gcuucuccugagacagaggacucagaaguggccuuuccuccaaagccugcucagacacaggucu

SEQ ID NO: 430309 - RNA, 64 nt, hsa
gaucgauuccccaaccacagcaaaggcaacacucuuccuccagagaucaccaagccccucuuac

SEQ ID NO: 430310 - RNA, 64 nt, hsa
cagauggcggucuccuggcagccuccccucagucuuccuccacccgcucuuccuucccagccug

SEQ ID NO: 430311 - RNA, 64 nt, hsa
gugggcacacagacagcccgcuuuguucuuucauuuccuccagcacuuucuuuccgccugaguc

SEQ ID NO: 430312 - RNA, 64 nt, hsa
uuucccuuggauucaagugaaaacuguugcauuauuccuccauccugucuggaauacaccaggu

SEQ ID NO: 430313 - RNA, 64 nt, hsa
uuaacuuuguaauuuauggaguauugugcacaacuuccuccaccuuucccuuggauucaaguga

SEQ ID NO: 430314 - RNA, 64 nt, hsa
ugaagcaagggaggcaaucacacugaagcgggucuuccuccaggaacggggucccacaggcgug

SEQ ID NO: 430315 - RNA, 64 nt, hsa
cucugacuguccugaacgcugucguucugucuguuuccuccaugcuugugaacugcacaacuug

SEQ ID NO: 430316 - RNA, 64 nt, hsa
ccugcuaccgccagagagguggacccacuccggauuccuccacaccacccacacaccagucggc

SEQ ID NO: 430317 - RNA, 64 nt, hsa
cuuauugacccuuccucaggccucccgaaccgacuuccuccaggcgcugugcccccaggagcuc

SEQ ID NO: 430318 - RNA, 64 nt, hsa
ugggguugcugugggagguacgccugggccucuguuccuccaaagaccugccugcccaucugca

SEQ ID NO: 430319 - RNA, 64 nt, hsa
guucaucuugccccuuuaguucucaugcacagaauuccuccauagcaggcuguuggcauagcug

SEQ ID NO: 430320 - RNA, 64 nt, hsa
ccugguccucccuggcuccuagauccagaccaccuuccuccaggugugggagccuugccuuauc

SEQ ID NO: 430321 - RNA, 64 nt, hsa
cggacgggcuccugacacggcuuuaaucaggaguuuccuccauaaacuauuauuuucagaauaa

SEQ ID NO: 430322 - RNA, 64 nt, hsa
ggggucagaagagagggugaguccuccagaacucuuccuccaaggacagaaggcuccugccccc

SEQ ID NO: 430323 - RNA, 64 nt, hsa
ccuuuuguucauuucauccuuucacuucuuucccuuccuccauccuccuccuuccuaguucauc

SEQ ID NO: 430324 - RNA, 64 nt, hsa
ggcuugcugagaaccccauggacaguggagagcgggauucgaaccaagggcuggacucccacac

SEQ ID NO: 430325 - RNA, 64 nt, hsa
gacaguucuuugcacacaaguuuuacaccucucuggauucgaaguuuguauuguauucauaguu

SEQ ID NO: 430326 - RNA, 64 nt, hsa
aagcaggggccggacuugggggaaauguugccauggauucgaugggacuuuggggaccuguguc

SEQ ID NO: 430327 - RNA, 64 nt, hsa
cuguugccuguggagucucugcugaaaugaaucaggauucgagcucuaggaugagacagaaaau

SEQ ID NO: 430328 - RNA, 64 nt, hsa
aacucccugaccccgaugugauuuuucuccccggggauucgagagccaugcgugggacacugga

SEQ ID NO: 430329 - RNA, 64 nt, hsa
ugugcucuggcaccaucagccuguuccagaaggaggauucgagcaucaggcuaagacccugugu

SEQ ID NO: 430330 - RNA, 64 nt, hsa
ugcaacuguagggaacaccauuuaugcagugggaggauucgauggcaaugaauuucugaauacg

SEQ ID NO: 430331 - RNA, 64 nt, hsa
gcaguagcuagagggacagguuuccuuccaggaaggauucgaguuccugugccuguggguauua

SEQ ID NO: 430332 - RNA, 64 nt, hsa
ucuuuugaguuguugaguauauuugagauugauuggauucgaccucuuguugaacugaaaacuu

SEQ ID NO: 430333 - RNA, 64 nt, hsa
uuaccccugcacuauuucagugcaccacagaauaggauucgagauuuacauaugccuguuugug

SEQ ID NO: 430334 - RNA, 64 nt, hsa
ggugggugcacacugcaugcuugggggugccaagggauucgagaccuccaacauacuugucuga

SEQ ID NO: 430335 - RNA, 64 nt, hsa
ucccuucuaguucugagaugcuuugaggguaacuggauucgauuuugggauaucuuuucucaca

SEQ ID NO: 430336 - RNA, 55 nt, hsa
uggaagacagcuuccuguaacuggcggauucgagggguuccuuccacuucugggg

SEQ ID NO: 430337 - RNA, 64 nt, hsa
auggaugguuccaugagcccccagaugaaaaccuggauucgacagggaagagcuuggauccccg

SEQ ID NO: 430338 - RNA, 64 nt, hsa
gcugacacggacuguaggugcuuuuuguucagguggauucgaaggaguuagagaugugauuucc

SEQ ID NO: 430339 - RNA, 64 nt, hsa
uagggaccacaaaagggaacaagcaaaaaaguuuggauucgauaaagugauauguaauaguugc

SEQ ID NO: 430340 - RNA, 64 nt, hsa
uaguaucuauguagguucagucagauccaaccauggauucgagguauuauacuguauaacccua

SEQ ID NO: 430341 - RNA, 64 nt, hsa
ucaaaauugcacaaacauggugcucuaccaggaaggauucgagguagauaggcucaggccacac

SEQ ID NO: 430342 - RNA, 64 nt, hsa
caaagcacaguacuguuagcuguuuuuguggacaggauucgauuaaguauucccucuugucaaa

SEQ ID NO: 430343 - RNA, 64 nt, hsa
gaggcagcuaggcuguagauggaagaugguccugggauucgaacaccgcugggaucuggccagg

SEQ ID NO: 430344 - RNA, 64 nt, hsa
gcacacaucaugggcuuuggaggcacacaagccuggauucgaaucugggcucuuucacauacua

SEQ ID NO: 430345 - RNA, 64 nt, hsa
uucagccucuagaaugguaacaaaucagccaauuggauucgaaacaaagaagacuauguaaaac

SEQ ID NO: 430346 - RNA, 64 nt, hsa
ggugggauauuugauaggauccauaucuaauaauggauucgaacucuccaaacuacaccaauua

SEQ ID NO: 430347 - RNA, 64 nt, hsa
augcuccugcaccugcaccaccaagguugaugccggauucgaagccaggaaggcccagucccuc

SEQ ID NO: 430348 - RNA, 64 nt, hsa
ucacccccgugaccucucccagccagggcugagaggauucgagguggcugggaggguuuccagg

SEQ ID NO: 430349 - RNA, 64 nt, hsa
uacccauguguacagccuacccaugcagggacugggauucgaggacuuccaggcgcauagggua

SEQ ID NO: 430350 - RNA, 64 nt, hsa
acaucacauaguaacugccgguccagaaugugacggauucgacucuauucauuuucaaauaaag

SEQ ID NO: 430351 - RNA, 64 nt, hsa
ggagaggaggagcagagagcuggguccugggcugggauucgagcccugggcgggggucagucaa

SEQ ID NO: 430352 - RNA, 64 nt, hsa
acggucaaccccaauuaccaauuuaguugaggcuggauucgauugcucaguucaccugccacgu

SEQ ID NO: 430353 - RNA, 64 nt, hsa
uagaggugugcuguguuaaaagagccagauaaauggauucgagccacuuguaggcacauuagcu

SEQ ID NO: 430354 - RNA, 64 nt, hsa
acccacggccccggaaccgcggcgacuggaggcuggauucgaggccggaaacgccgggaccccu

SEQ ID NO: 430355 - RNA, 64 nt, hsa
agcgugcuucauuugacacccagagucugacuuuggauucgaacuaaacccaggcaacaggcga

SEQ ID NO: 430356 - RNA, 64 nt, hsa
ccucaggaaaagccaaaaccgaggcccauugcccggauucgacacaaaagagggucccugcucu

SEQ ID NO: 430357 - RNA, 64 nt, hsa
ggugucgcaugaagagcuugcuucacacacaacaggauucgauacuuugccaauucaaggcccu

SEQ ID NO: 430358 - RNA, 64 nt, hsa
uaucuuugaaauuuugcaugaaaaggaaaugaauggauucgaaugaaauuguccuuuagagcau

SEQ ID NO: 430359 - RNA, 64 nt, hsa
gcuguugguaccuguguauuuggaauauuuuaggggauucgaauuuuuuuuaacccacauuaca

SEQ ID NO: 430360 - RNA, 64 nt, hsa
cugaugagcugcagguuuuuugaacucacuucuggaggugcagagccacaaacgcacuuucggg

SEQ ID NO: 430361 - RNA, 64 nt, hsa
ccaauuaaauauaacuccgccaguguaagggugugaggugcaguuguccaggagacgauuuugu

SEQ ID NO: 430362 - RNA, 64 nt, hsa
ucagauggcaagggcagugcguggaaaggccggggaggugcagaaaccagagcccagggcaaug

SEQ ID NO: 430363 - RNA, 64 nt, hsa
cggagugcucugggagccaggccagggugugagggaggugcagaggcauccggggcgggagcaa

SEQ ID NO: 430364 - RNA, 64 nt, hsa
aucauauuucauaccgauuccauuauguuuucgugaggugcauuauguuuucaugaggugcaca

SEQ ID NO: 430365 - RNA, 64 nt, hsa
cauuauguuuucgugaggugcauuauguuuucaugaggugcacaaaucauuaauuauagugcau

SEQ ID NO: 430366 - RNA, 64 nt, hsa
gaaggcaccagaggugaagcugcccagggcuccggaggugcagcuaaaggccaccaaggcagaa

SEQ ID NO: 430367 - RNA, 64 nt, hsa
gccugagauggcugugcccgaugugcaccuccccgaggugcagcugccgaaagugucagagauu

SEQ ID NO: 430368 - RNA, 64 nt, hsa
gccugaaauggccgugcccgaugugcaccucccagaggugcagcugcccaaagucugugaaaug

SEQ ID NO: 430369 - RNA, 64 nt, hsa
gccugagauggcugugccagagguucgacuccccgaggugcagcugccaaaagucucagagaug

SEQ ID NO: 430370 - RNA, 64 nt, hsa
gucagagguggcugugccagaggugcggcuuccagaggugcagcugccgaaagugccagagaug

SEQ ID NO: 430371 - RNA, 64 nt, hsa
ccucaggucgcuggagugcaccagucuuggggaagaggugcaggagaagcuguguuuuuuaucu

SEQ ID NO: 430372 - RNA, 64 nt, hsa
caccuuggguugcuggagcucaccagucuugagggaggugcaggggaaacuguguuuuuuaucu

SEQ ID NO: 430373 - RNA, 64 nt, hsa
cccccugggcucugccccagcucuggcuuccagaaaaccccagcauccuuuucugcagaggggc

SEQ ID NO: 430374 - RNA, 64 nt, hsa
uuaggaguucgagaccagccuggccaacaugguaaaaccccaucucuacuaaaaauacagaaau

SEQ ID NO: 430375 - RNA, 64 nt, hsa
uagagggcccuugucugagaaaccccaaaccaggaaaccccaccuacccaaccauccacccaag

SEQ ID NO: 430376 - RNA, 64 nt, hsa
ccagggcacccucccuagagggcccuugucugagaaaccccaaaccaggaaaccccaccuaccc

SEQ ID NO: 430377 - RNA, 64 nt, hsa
uacaaaggccuagaccagccugggcaacauggugaaaccccaucucuacaaaaaauuuuuaaaa

SEQ ID NO: 430378 - RNA, 64 nt, hsa
ucaggagaucaagaccauccuggccaacauggugaaaccccaucucuacugaauacacaaaaau

SEQ ID NO: 430379 - RNA, 64 nt, hsa
ucaagagaucaagaccauccucgccaacaaggugaaaccccaccucuauuaaaaauacaaaaau

SEQ ID NO: 430380 - RNA, 64 nt, hsa
ucaggaguucgagagcagccuggccaauaugaugaaaccccaucucuacuaaaaauacaaaaau

SEQ ID NO: 430381 - RNA, 64 nt, hsa
ccucugaaguaauucccagaauacgguccuuccuaaaccccagaaauugccuuuuucagaguuu

SEQ ID NO: 430382 - RNA, 64 nt, hsa
uuaaaccauguguagagcuuuaaaaacagaaaaaaaaccccauauacuuaugaccaucuuaaau

SEQ ID NO: 430383 - RNA, 64 nt, hsa
accuugaucuaccauccauccucuuccccaauccaaaccccacagucucuucucucccacaccc

SEQ ID NO: 430384 - RNA, 64 nt, hsa
uuaauauuuaaaauucaaauauuaaaacucaaauaaaccccaaagaacuuuuggaaaacaaaag

SEQ ID NO: 430385 - RNA, 64 nt, hsa
acaggauuuugagaacagcuuggacaucaugacgaaaccccaucuccacaaaaaaauucaaaaa

SEQ ID NO: 430386 - RNA, 64 nt, hsa
uccggaguucgaggcugguuuggccagcauggcgaaaccccaucucuacuaaaaauacaaaaaa

SEQ ID NO: 430387 - RNA, 64 nt, hsa
uuaccugcaugcaggcaccagagcagggacugagaaaccccaaggaugggucaucuaagugcug

SEQ ID NO: 430388 - RNA, 64 nt, hsa
gucauuuccuuuuuguauuuuuaaacaagaaagaaaaccccaguccucauuugccuucccuacc

SEQ ID NO: 430389 - RNA, 64 nt, hsa
ccuugguacccauucccauuucacaaacuccuccaaaccccaaaccccaaacggaaaucucugg

SEQ ID NO: 430390 - RNA, 64 nt, hsa
acccauucccauuucacaaacuccuccaaaccccaaaccccaaacggaaaucucugggacaaug

SEQ ID NO: 430391 - RNA, 64 nt, hsa
gcacaguacugggaaaugggagcauaguacugggaaaccccagaccuggauucugaguuuuuca

SEQ ID NO: 430392 - RNA, 64 nt, hsa
ucaggugccccugugauccaggucuucuacccugaaaccccacccuccaucaagguccugccug

SEQ ID NO: 430393 - RNA, 64 nt, hsa
ucaagaugacaugacaucacucccaauucucuccaaaccccagagaaauacugacgaaguuuuc

SEQ ID NO: 430394 - RNA, 64 nt, hsa
uauguucaucuuguaaucauagcaaaaagucugcaaaccccagggucaagccugcucugccaca

SEQ ID NO: 430395 - RNA, 64 nt, hsa
ucaugucccaaggcauaacuucccaacauuuaagaaaccccaauagacaccucugcccuggcca

SEQ ID NO: 430396 - RNA, 64 nt, hsa
uuaggaguucaagaccagccuggccaacauggugaaaccccaucucuacuaaaaauacaaaaaa

SEQ ID NO: 430397 - RNA, 64 nt, hsa
ccuuauuacacauaagauaauucauagcggagagaaaccccacaaaugugaagaauguggcaga

SEQ ID NO: 430398 - RNA, 64 nt, hsa
ccuuaguacacauaagaaaauucauacuggggagaaaccccacaaauguggagaaugcggaaaa

SEQ ID NO: 430399 - RNA, 64 nt, hsa
ccuuucugcacauaauauaauucauacuggagagaaaccccacaaauaugaagaaugugguaau

SEQ ID NO: 430400 - RNA, 64 nt, hsa
ccaggaguucgagaccagccuggucaagauggugaaaccccaucucuacuaaaauuacaaaaau

SEQ ID NO: 430401 - RNA, 64 nt, hsa
ucaggaguuugaaaccagccuggccaacauggugaaaccccaucucuacuaaaaaaacaaaacu

SEQ ID NO: 430402 - RNA, 64 nt, hsa
cugcuucaaaugcacacaggccuaguugaaguuuaaaccccagcaaaacauuccucccuguaaa

SEQ ID NO: 430403 - RNA, 64 nt, hsa
cauugaaugggggugggggcucguguguccugggaaaccccaucagucccuucauuucuugaga

SEQ ID NO: 430404 - RNA, 64 nt, hsa
ucgggaguucgagaccagccuuaccaacauggagaaaccccaucucuacuaaaaauacaaaauu

SEQ ID NO: 430405 - RNA, 62 nt, hsa; identical to SEQ ID NO: 296757

SEQ ID NO: 430406 - RNA, 64 nt, hsa
ugauuggcaaaaaagauuggcacaaagcaugaagaaaccccauuuuucccaggguaaucaugaa

SEQ ID NO: 430407 - RNA, 64 nt, hsa
augaucuguugauaucuuugaaucucuucccuccaaaccccaaguaaguuguccuucaacuguu

SEQ ID NO: 430408 - RNA, 64 nt, hsa
gcacgcugucucagaaaacgaaaacggaggaaaaaaaccccaaaccccaaacaaucuuaauaaa

SEQ ID NO: 430409 - RNA, 64 nt, hsa
gucucagaaaacgaaaacggaggaaaaaaaccccaaaccccaaacaaucuuaauaaacacgacu

SEQ ID NO: 430410 - RNA, 64 nt, hsa
ugggagaggccggccucaaaucuuuccauuuaacaaaccccagugauggguauggacagcaugc

SEQ ID NO: 430411 - RNA, 64 nt, hsa
gggucccaaggccccgcagcuuccucccccgaccaaaccccaagaccuggaucccaggagacaa

SEQ ID NO: 430412 - RNA, 64 nt, hsa
ccaggaguugaaguccagccuaagcaacauagugaaaccccaucuccaaaaauauaauaauaau

SEQ ID NO: 430413 - RNA, 64 nt, hsa
ucaggagauccagcccauccuggccaacauggugaaaccccaucucuacuaaaaauacaaaaau

SEQ ID NO: 430414 - RNA, 64 nt, hsa
ucaggagcucgagaccagccuggccaacacggugaaaccccaucucuacuaaaaaaaaauacaa

SEQ ID NO: 430415 - RNA, 64 nt, hsa
ucaggagcucaagaccagccuggccaacauggugaaaccccaucucuacuaaaaaaaaaaaaaa

SEQ ID NO: 430416 - RNA, 64 nt, hsa
ucaggaguuccagaccagccuggccaacauggcgaaaccccaucucuacuaaaaauacaaaaau

SEQ ID NO: 430417 - RNA, 64 nt, hsa
ucaggaguucgagaccagccuggccaauauggugaaaccccaucucuacuaaaaauauaaaaau

SEQ ID NO: 430418 - RNA, 64 nt, hsa
uaauuggugugugguauagaagaaaaacggguucaaaccccacuucugccaccuaccagcuaua

SEQ ID NO: 430419 - RNA, 64 nt, hsa
uuaggaguuugagaccagccuggccaacauggugaaaccccaucucuacuaaaaaaaaaaaaaa

SEQ ID NO: 430420 - RNA, 64 nt, hsa
ugcuagcaauaguuggcuucuccccugucaguggaaaccccacuucugcccggcccuugagcuu

SEQ ID NO: 430421 - RNA, 64 nt, hsa
uuuguauguacccugugcuuaauucuauaacaguaaaccccauacgcaggugggagggaggaac

SEQ ID NO: 430422 - RNA, 64 nt, hsa
ugaucugcuucccuaaauuacuuuuuuagagcccaaaccccagguuuagggugaggguuuguaa

SEQ ID NO: 430423 - RNA, 64 nt, hsa
accugacccuguguguacaauccaggaaaaaaacaaaccccacucagaaacagagaaaacuggg

SEQ ID NO: 430424 - RNA, 64 nt, hsa
uaugcagaauggaugagugguaccgccaaaauucaaaccccagacucccgaacucaugcucaga

SEQ ID NO: 430425 - RNA, 64 nt, hsa
ucaggaguucgagaccagccugaccaauauggugaaaccccaucucuacuaaaaauagaaaaau

SEQ ID NO: 430426 - RNA, 64 nt, hsa
cucuguuugcagacgauaugauucuauaucuagaaaaccccaugaucuuggcccaaaagcuccu

SEQ ID NO: 430427 - RNA, 64 nt, hsa
aaucaacucaagauggauuaaagacuuaaauguaaaaccccaaacuauaaaaacucuggaagau

SEQ ID NO: 430428 - RNA, 64 nt, hsa
ucaggaguucgagaccauccugucuaacacggugaaaccccaucucuacuaaaaauacaaaaaa

SEQ ID NO: 430429 - RNA, 64 nt, hsa
ucaggaguucaagaccagccuggccaacauggugaaaccccaucucuacuaaaaauacaaaaau

SEQ ID NO: 430430 - RNA, 64 nt, hsa
ccgcgagacaggccaggcucguggcucggaagacaaaccccacacacacucaaggggucgaaaa

SEQ ID NO: 430431 - RNA, 64 nt, hsa
gacaaaccccacacacacucaaggggucgaaaacaaaccccacacgagggcucucaccuccuuc

SEQ ID NO: 430432 - RNA, 64 nt, hsa
cacauccaggugaugugcucugguauggaauuugaaaccccaauggggccuuggcacuaagacu

SEQ ID NO: 430433 - RNA, 64 nt, hsa
agcuggcucgaugauguuaacaguauuaaaaauuaaaccccauaaaccaacuaagccuuaugga

SEQ ID NO: 430434 - RNA, 64 nt, hsa
ccaggaguucaacaccagccugagcaacaugguaaaaccccaucucuaccaaaaauacaaaaau

SEQ ID NO: 430435 - RNA, 64 nt, hsa
ucuaguuacagaacgguuucuuucucccccaaagaaaccccaucgccaucagcacucacucccc

SEQ ID NO: 430436 - RNA, 64 nt, hsa
acuggaguuugagaccacccuggccaacauggugaaaccccaucucuacuaaaacaaaaauuag

SEQ ID NO: 430437 - RNA, 64 nt, hsa
ucaggaguucgagaccagccuggccaacauagugaaaccccaucucuacuaaaaauacagaaau

SEQ ID NO: 430438 - RNA, 64 nt, hsa
ucagaaguucaagagcacccuggcuaacauggugaaaccccaucucuacuaaaaauacaaaagu

SEQ ID NO: 430439 - RNA, 64 nt, hsa
ucaggagaucgagaccguccuggcuaacacggugaaaccccaucucuacuaaaaauauaaaaua

SEQ ID NO: 430440 - RNA, 64 nt, hsa
gaagucaggagagaccagccuggccagcauagugaaaccccaucucuacuaaaaauacaaacuu

SEQ ID NO: 430441 - RNA, 64 nt, hsa
ucgggaguucgagaccagccugaccaacauggagaaaccccaauuguacuaaaaauacaaaauu

SEQ ID NO: 430442 - RNA, 64 nt, hsa
uuugcuccuugaguuuucaagaugaaauaaggagaaaccccauaacuuuuuagcucucuuuuaa

SEQ ID NO: 430443 - RNA, 64 nt, hsa
ucaggaguucgagaccagccugaccaacauggagaaaccccaucucuacuaaaaauacaaaauu

SEQ ID NO: 430444 - RNA, 64 nt, hsa
aaaauugcaugagauuagcaaaauuauuaauuuaaaaccccaaaguaaauugcaaauuuuaaaa

SEQ ID NO: 430445 - RNA, 64 nt, hsa
cuuuccaguauugguacaucuuggcuucuggcccaaaccccaagcagaaaagaaaauggaauaa

SEQ ID NO: 430446 - RNA, 64 nt, hsa
uucugcuguggauaucaaggaaauaauaaagcagaaaccccaagaaauuugcaacuuaacaguu

SEQ ID NO: 430447 - RNA, 64 nt, hsa
uguuaguacaaguugaacuugauugugccaacugaaaccccagagguuuguauaucaguagaau

SEQ ID NO: 430448 - RNA, 64 nt, hsa
ccaggaguucaagaucagccugggcaauauagugaaaccccaucucuuaaagaaaaaguuagcc

SEQ ID NO: 430449 - RNA, 64 nt, hsa
aucaguuucagacauuuucaccacuccaaaaaagaaaccccacaucgacuagcaguuacucauu

SEQ ID NO: 430450 - RNA, 64 nt, hsa; identical to SEQ ID NO: 211561

SEQ ID NO: 430451 - RNA, 64 nt, hsa; identical to SEQ ID NO: 211562

SEQ ID NO: 430452 - RNA, 64 nt, hsa; identical to SEQ ID NO: 76474

SEQ ID NO: 430453 - RNA, 64 nt, hsa; identical to SEQ ID NO: 76475

SEQ ID NO: 430454 - RNA, 64 nt, hsa; identical to SEQ ID NO: 76476

SEQ ID NO: 430455 - RNA, 64 nt, hsa; identical to SEQ ID NO: 76477

SEQ ID NO: 430456 - RNA, 64 nt, hsa; identical to SEQ ID NO: 76478

SEQ ID NO: 430457 - RNA, 64 nt, hsa; identical to SEQ ID NO: 76479

SEQ ID NO: 430458 - RNA, 64 nt, hsa; identical to SEQ ID NO: 76480

SEQ ID NO: 430459 - RNA, 64 nt, hsa; identical to SEQ ID NO: 76481

SEQ ID NO: 430460 - RNA, 64 nt, hsa; identical to SEQ ID NO: 76482

SEQ ID NO: 430461 - RNA, 64 nt, hsa; identical to SEQ ID NO: 76483

SEQ ID NO: 430462 - RNA, 64 nt, hsa; identical to SEQ ID NO: 327831

SEQ ID NO: 430463 - RNA, 64 nt, hsa; identical to SEQ ID NO: 327832

SEQ ID NO: 430464 - RNA, 64 nt, hsa; identical to SEQ ID NO: 327833

SEQ ID NO: 430465 - RNA, 64 nt, hsa; identical to SEQ ID NO: 327834

SEQ ID NO: 430466 - RNA, 64 nt, hsa; identical to SEQ ID NO: 87052

SEQ ID NO: 430467 - RNA, 64 nt, hsa; identical to SEQ ID NO: 87053

SEQ ID NO: 430468 - RNA, 64 nt, hsa; identical to SEQ ID NO: 87054

SEQ ID NO: 430469 - RNA, 64 nt, hsa; identical to SEQ ID NO: 87055

SEQ ID NO: 430470 - RNA, 64 nt, hsa; identical to SEQ ID NO: 87056

SEQ ID NO: 430471 - RNA, 64 nt, hsa; identical to SEQ ID NO: 87057

SEQ ID NO: 430472 - RNA, 64 nt, hsa; identical to SEQ ID NO: 87058

SEQ ID NO: 430473 - RNA, 64 nt, hsa; identical to SEQ ID NO: 87059

SEQ ID NO: 430474 - RNA, 64 nt, hsa; identical to SEQ ID NO: 87060

SEQ ID NO: 430475 - RNA, 64 nt, hsa; identical to SEQ ID NO: 87061

SEQ ID NO: 430476 - RNA, 64 nt, hsa; identical to SEQ ID NO: 87062

SEQ ID NO: 430477 - RNA, 64 nt, hsa; identical to SEQ ID NO: 87063

SEQ ID NO: 430478 - RNA, 64 nt, hsa; identical to SEQ ID NO: 87064

SEQ ID NO: 430479 - RNA, 64 nt, hsa; identical to SEQ ID NO: 87065

SEQ ID NO: 430480 - RNA, 64 nt, hsa; identical to SEQ ID NO: 87066

SEQ ID NO: 430481 - RNA, 64 nt, hsa; identical to SEQ ID NO: 87067

SEQ ID NO: 430482 - RNA, 64 nt, hsa; identical to SEQ ID NO: 87068

SEQ ID NO: 430483 - RNA, 64 nt, hsa; identical to SEQ ID NO: 87069

SEQ ID NO: 430484 - RNA, 64 nt, hsa; identical to SEQ ID NO: 87070

SEQ ID NO: 430485 - RNA, 64 nt, hsa; identical to SEQ ID NO: 87071

SEQ ID NO: 430486 - RNA, 64 nt, hsa; identical to SEQ ID NO: 87072

SEQ ID NO: 430487 - RNA, 64 nt, hsa; identical to SEQ ID NO: 87073

SEQ ID NO: 430488 - RNA, 64 nt, hsa; identical to SEQ ID NO: 87074

SEQ ID NO: 430489 - RNA, 64 nt, hsa; identical to SEQ ID NO: 87075

SEQ ID NO: 430490 - RNA, 64 nt, hsa; identical to SEQ ID NO: 87076

SEQ ID NO: 430491 - RNA, 64 nt, hsa; identical to SEQ ID NO: 87077

SEQ ID NO: 430492 - RNA, 52 nt, hsa; identical to SEQ ID NO: 87078

SEQ ID NO: 430493 - RNA, 64 nt, hsa; identical to SEQ ID NO: 87079

SEQ ID NO: 430494 - RNA, 64 nt, hsa; identical to SEQ ID NO: 87080

SEQ ID NO: 430495 - RNA, 64 nt, hsa; identical to SEQ ID NO: 87081

SEQ ID NO: 430496 - RNA, 64 nt, hsa; identical to SEQ ID NO: 87082

SEQ ID NO: 430497 - RNA, 64 nt, hsa; identical to SEQ ID NO: 87083

SEQ ID NO: 430498 - RNA, 64 nt, hsa; identical to SEQ ID NO: 87084

SEQ ID NO: 430499 - RNA, 64 nt, hsa; identical to SEQ ID NO: 87085

SEQ ID NO: 430500 - RNA, 64 nt, hsa; identical to SEQ ID NO: 87086

SEQ ID NO: 430501 - RNA, 64 nt, hsa; identical to SEQ ID NO: 87087

SEQ ID NO: 430502 - RNA, 64 nt, hsa; identical to SEQ ID NO: 87088

SEQ ID NO: 430503 - RNA, 64 nt, hsa; identical to SEQ ID NO: 87089

SEQ ID NO: 430504 - RNA, 64 nt, hsa; identical to SEQ ID NO: 87090

SEQ ID NO: 430505 - RNA, 64 nt, hsa; identical to SEQ ID NO: 87091

SEQ ID NO: 430506 - RNA, 64 nt, hsa; identical to SEQ ID NO: 87092

SEQ ID NO: 430507 - RNA, 64 nt, hsa; identical to SEQ ID NO: 87093

SEQ ID NO: 430508 - RNA, 64 nt, hsa; identical to SEQ ID NO: 87094

SEQ ID NO: 430509 - RNA, 64 nt, hsa; identical to SEQ ID NO: 87095

SEQ ID NO: 430510 - RNA, 64 nt, hsa; identical to SEQ ID NO: 87096

SEQ ID NO: 430511 - RNA, 64 nt, hsa; identical to SEQ ID NO: 195747

SEQ ID NO: 430512 - RNA, 64 nt, hsa; identical to SEQ ID NO: 195748

SEQ ID NO: 430513 - RNA, 64 nt, hsa; identical to SEQ ID NO: 195749

SEQ ID NO: 430514 - RNA, 64 nt, hsa; identical to SEQ ID NO: 195750

SEQ ID NO: 430515 - RNA, 64 nt, hsa; identical to SEQ ID NO: 195751

SEQ ID NO: 430516 - RNA, 64 nt, hsa; identical to SEQ ID NO: 195752

SEQ ID NO: 430517 - RNA, 64 nt, hsa; identical to SEQ ID NO: 224132

SEQ ID NO: 430518 - RNA, 64 nt, hsa; identical to SEQ ID NO: 224133

SEQ ID NO: 430519 - RNA, 64 nt, hsa; identical to SEQ ID NO: 224134

SEQ ID NO: 430520 - RNA, 64 nt, hsa; identical to SEQ ID NO: 224135

SEQ ID NO: 430521 - RNA, 64 nt, hsa; identical to SEQ ID NO: 224136

SEQ ID NO: 430522 - RNA, 64 nt, hsa; identical to SEQ ID NO: 224137

SEQ ID NO: 430523 - RNA, 64 nt, hsa; identical to SEQ ID NO: 224138

SEQ ID NO: 430524 - RNA, 64 nt, hsa; identical to SEQ ID NO: 224139

SEQ ID NO: 430525 - RNA, 64 nt, hsa; identical to SEQ ID NO: 224140

SEQ ID NO: 430526 - RNA, 64 nt, hsa; identical to SEQ ID NO: 224141

SEQ ID NO: 430527 - RNA, 64 nt, hsa; identical to SEQ ID NO: 224142

SEQ ID NO: 430528 - RNA, 64 nt, hsa; identical to SEQ ID NO: 224143

SEQ ID NO: 430529 - RNA, 64 nt, hsa; identical to SEQ ID NO: 224144

SEQ ID NO: 430530 - RNA, 64 nt, hsa; identical to SEQ ID NO: 224145

SEQ ID NO: 430531 - RNA, 64 nt, hsa; identical to SEQ ID NO: 224146

SEQ ID NO: 430532 - RNA, 64 nt, hsa; identical to SEQ ID NO: 224147

SEQ ID NO: 430533 - RNA, 64 nt, hsa; identical to SEQ ID NO: 224148

SEQ ID NO: 430534 - RNA, 64 nt, hsa; identical to SEQ ID NO: 224149

SEQ ID NO: 430535 - RNA, 64 nt, hsa; identical to SEQ ID NO: 224150

SEQ ID NO: 430536 - RNA, 64 nt, hsa; identical to SEQ ID NO: 224151

SEQ ID NO: 430537 - RNA, 64 nt, hsa; identical to SEQ ID NO: 224152

SEQ ID NO: 430538 - RNA, 64 nt, hsa; identical to SEQ ID NO: 224153

SEQ ID NO: 430539 - RNA, 64 nt, hsa; identical to SEQ ID NO: 224154

SEQ ID NO: 430540 - RNA, 64 nt, hsa; identical to SEQ ID NO: 224155

SEQ ID NO: 430541 - RNA, 64 nt, hsa; identical to SEQ ID NO: 224156

SEQ ID NO: 430542 - RNA, 64 nt, hsa; identical to SEQ ID NO: 224157

SEQ ID NO: 430543 - RNA, 64 nt, hsa; identical to SEQ ID NO: 224158

SEQ ID NO: 430544 - RNA, 64 nt, hsa; identical to SEQ ID NO: 224159

SEQ ID NO: 430545 - RNA, 64 nt, hsa; identical to SEQ ID NO: 224160

SEQ ID NO: 430546 - RNA, 64 nt, hsa; identical to SEQ ID NO: 224161

SEQ ID NO: 430547 - RNA, 64 nt, hsa; identical to SEQ ID NO: 224162

SEQ ID NO: 430548 - RNA, 64 nt, hsa; identical to SEQ ID NO: 224163

SEQ ID NO: 430549 - RNA, 64 nt, hsa; identical to SEQ ID NO: 224164

SEQ ID NO: 430550 - RNA, 64 nt, hsa; identical to SEQ ID NO: 224165

SEQ ID NO: 430551 - RNA, 64 nt, hsa; identical to SEQ ID NO: 224166

SEQ ID NO: 430552 - RNA, 64 nt, hsa; identical to SEQ ID NO: 224167

SEQ ID NO: 430553 - RNA, 64 nt, hsa; identical to SEQ ID NO: 224168

SEQ ID NO: 430554 - RNA, 64 nt, hsa; identical to SEQ ID NO: 224169

SEQ ID NO: 430555 - RNA, 64 nt, hsa; identical to SEQ ID NO: 224170

SEQ ID NO: 430556 - RNA, 64 nt, hsa; identical to SEQ ID NO: 224171

SEQ ID NO: 430557 - RNA, 64 nt, hsa; identical to SEQ ID NO: 224172

SEQ ID NO: 430558 - RNA, 64 nt, hsa; identical to SEQ ID NO: 224173

SEQ ID NO: 430559 - RNA, 64 nt, hsa; identical to SEQ ID NO: 224174

SEQ ID NO: 430560 - RNA, 64 nt, hsa; identical to SEQ ID NO: 224175

SEQ ID NO: 430561 - RNA, 64 nt, hsa; identical to SEQ ID NO: 224176

SEQ ID NO: 430562 - RNA, 64 nt, hsa; identical to SEQ ID NO: 195747

SEQ ID NO: 430563 - RNA, 64 nt, hsa; identical to SEQ ID NO: 195748

SEQ ID NO: 430564 - RNA, 64 nt, hsa; identical to SEQ ID NO: 195749

SEQ ID NO: 430565 - RNA, 64 nt, hsa; identical to SEQ ID NO: 195750

SEQ ID NO: 430566 - RNA, 64 nt, hsa; identical to SEQ ID NO: 195751

SEQ ID NO: 430567 - RNA, 64 nt, hsa; identical to SEQ ID NO: 195752

SEQ ID NO: 430568 - RNA, 64 nt, hsa; identical to SEQ ID NO: 224132

SEQ ID NO: 430569 - RNA, 64 nt, hsa; identical to SEQ ID NO: 224133

SEQ ID NO: 430570 - RNA, 64 nt, hsa; identical to SEQ ID NO: 224134

SEQ ID NO: 430571 - RNA, 64 nt, hsa; identical to SEQ ID NO: 224135

SEQ ID NO: 430572 - RNA, 64 nt, hsa; identical to SEQ ID NO: 224136

SEQ ID NO: 430573 - RNA, 64 nt, hsa; identical to SEQ ID NO: 224137

SEQ ID NO: 430574 - RNA, 64 nt, hsa; identical to SEQ ID NO: 224138

SEQ ID NO: 430575 - RNA, 64 nt, hsa; identical to SEQ ID NO: 224139

SEQ ID NO: 430576 - RNA, 64 nt, hsa; identical to SEQ ID NO: 224140

SEQ ID NO: 430577 - RNA, 64 nt, hsa; identical to SEQ ID NO: 224141

SEQ ID NO: 430578 - RNA, 64 nt, hsa; identical to SEQ ID NO: 224142

SEQ ID NO: 430579 - RNA, 64 nt, hsa; identical to SEQ ID NO: 224143

SEQ ID NO: 430580 - RNA, 64 nt, hsa; identical to SEQ ID NO: 224144

SEQ ID NO: 430581 - RNA, 64 nt, hsa; identical to SEQ ID NO: 224145

SEQ ID NO: 430582 - RNA, 64 nt, hsa; identical to SEQ ID NO: 224146

SEQ ID NO: 430583 - RNA, 64 nt, hsa; identical to SEQ ID NO: 224147

SEQ ID NO: 430584 - RNA, 64 nt, hsa; identical to SEQ ID NO: 224148

SEQ ID NO: 430585 - RNA, 64 nt, hsa; identical to SEQ ID NO: 224149

SEQ ID NO: 430586 - RNA, 64 nt, hsa; identical to SEQ ID NO: 224150

SEQ ID NO: 430587 - RNA, 64 nt, hsa; identical to SEQ ID NO: 224151

SEQ ID NO: 430588 - RNA, 64 nt, hsa; identical to SEQ ID NO: 224152

SEQ ID NO: 430589 - RNA, 64 nt, hsa; identical to SEQ ID NO: 224153

SEQ ID NO: 430590 - RNA, 64 nt, hsa; identical to SEQ ID NO: 224154

SEQ ID NO: 430591 - RNA, 64 nt, hsa; identical to SEQ ID NO: 224155

SEQ ID NO: 430592 - RNA, 64 nt, hsa; identical to SEQ ID NO: 224156

SEQ ID NO: 430593 - RNA, 64 nt, hsa; identical to SEQ ID NO: 224157

SEQ ID NO: 430594 - RNA, 64 nt, hsa; identical to SEQ ID NO: 224158

SEQ ID NO: 430595 - RNA, 64 nt, hsa; identical to SEQ ID NO: 224159

SEQ ID NO: 430596 - RNA, 64 nt, hsa; identical to SEQ ID NO: 224160

SEQ ID NO: 430597 - RNA, 64 nt, hsa; identical to SEQ ID NO: 224161

SEQ ID NO: 430598 - RNA, 64 nt, hsa; identical to SEQ ID NO: 224162

SEQ ID NO: 430599 - RNA, 64 nt, hsa; identical to SEQ ID NO: 224163

SEQ ID NO: 430600 - RNA, 64 nt, hsa; identical to SEQ ID NO: 224164

SEQ ID NO: 430601 - RNA, 64 nt, hsa; identical to SEQ ID NO: 224165

SEQ ID NO: 430602 - RNA, 64 nt, hsa; identical to SEQ ID NO: 224166

SEQ ID NO: 430603 - RNA, 64 nt, hsa; identical to SEQ ID NO: 224167

SEQ ID NO: 430604 - RNA, 64 nt, hsa; identical to SEQ ID NO: 224168

SEQ ID NO: 430605 - RNA, 64 nt, hsa; identical to SEQ ID NO: 224169

SEQ ID NO: 430606 - RNA, 64 nt, hsa; identical to SEQ ID NO: 224170

SEQ ID NO: 430607 - RNA, 64 nt, hsa; identical to SEQ ID NO: 224171

SEQ ID NO: 430608 - RNA, 64 nt, hsa; identical to SEQ ID NO: 224172

SEQ ID NO: 430609 - RNA, 64 nt, hsa; identical to SEQ ID NO: 224173

SEQ ID NO: 430610 - RNA, 64 nt, hsa; identical to SEQ ID NO: 224174

SEQ ID NO: 430611 - RNA, 64 nt, hsa; identical to SEQ ID NO: 224175

SEQ ID NO: 430612 - RNA, 64 nt, hsa; identical to SEQ ID NO: 224176

SEQ ID NO: 430613 - RNA, 64 nt, hsa; identical to SEQ ID NO: 355748

SEQ ID NO: 430614 - RNA, 64 nt, hsa; identical to SEQ ID NO: 355749

SEQ ID NO: 430615 - RNA, 64 nt, hsa; identical to SEQ ID NO: 355750

SEQ ID NO: 430616 - RNA, 64 nt, hsa; identical to SEQ ID NO: 355751

SEQ ID NO: 430617 - RNA, 64 nt, hsa; identical to SEQ ID NO: 355752

SEQ ID NO: 430618 - RNA, 64 nt, hsa; identical to SEQ ID NO: 355753

SEQ ID NO: 430619 - RNA, 64 nt, hsa; identical to SEQ ID NO: 355754

SEQ ID NO: 430620 - RNA, 64 nt, hsa; identical to SEQ ID NO: 355755

SEQ ID NO: 430621 - RNA, 64 nt, hsa; identical to SEQ ID NO: 355756

SEQ ID NO: 430622 - RNA, 64 nt, hsa; identical to SEQ ID NO: 355757

SEQ ID NO: 430623 - RNA, 64 nt, hsa; identical to SEQ ID NO: 355758

SEQ ID NO: 430624 - RNA, 64 nt, hsa; identical to SEQ ID NO: 355759

SEQ ID NO: 430625 - RNA, 64 nt, hsa; identical to SEQ ID NO: 355760

SEQ ID NO: 430626 - RNA, 64 nt, hsa; identical to SEQ ID NO: 355761

SEQ ID NO: 430627 - RNA, 64 nt, hsa; identical to SEQ ID NO: 355762

SEQ ID NO: 430628 - RNA, 64 nt, hsa; identical to SEQ ID NO: 355763

SEQ ID NO: 430629 - RNA, 64 nt, hsa; identical to SEQ ID NO: 355764

SEQ ID NO: 430630 - RNA, 64 nt, hsa; identical to SEQ ID NO: 355765

SEQ ID NO: 430631 - RNA, 64 nt, hsa; identical to SEQ ID NO: 355766

SEQ ID NO: 430632 - RNA, 64 nt, hsa; identical to SEQ ID NO: 355767

SEQ ID NO: 430633 - RNA, 64 nt, hsa; identical to SEQ ID NO: 355768

SEQ ID NO: 430634 - RNA, 64 nt, hsa; identical to SEQ ID NO: 355769

SEQ ID NO: 430635 - RNA, 64 nt, hsa; identical to SEQ ID NO: 355770

SEQ ID NO: 430636 - RNA, 64 nt, hsa; identical to SEQ ID NO: 355771

SEQ ID NO: 430637 - RNA, 64 nt, hsa; identical to SEQ ID NO: 355772

SEQ ID NO: 430638 - RNA, 64 nt, hsa; identical to SEQ ID NO: 355773

SEQ ID NO: 430639 - RNA, 64 nt, hsa; identical to SEQ ID NO: 355774

SEQ ID NO: 430640 - RNA, 64 nt, hsa; identical to SEQ ID NO: 355775

SEQ ID NO: 430641 - RNA, 64 nt, hsa; identical to SEQ ID NO: 355776

SEQ ID NO: 430642 - RNA, 64 nt, hsa; identical to SEQ ID NO: 355777

SEQ ID NO: 430643 - RNA, 64 nt, hsa; identical to SEQ ID NO: 355778

SEQ ID NO: 430644 - RNA, 64 nt, hsa; identical to SEQ ID NO: 355779

SEQ ID NO: 430645 - RNA, 64 nt, hsa; identical to SEQ ID NO: 355780

SEQ ID NO: 430646 - RNA, 62 nt, hsa; identical to SEQ ID NO: 355781

SEQ ID NO: 430647 - RNA, 64 nt, hsa; identical to SEQ ID NO: 355782

SEQ ID NO: 430648 - RNA, 64 nt, hsa; identical to SEQ ID NO: 355783

SEQ ID NO: 430649 - RNA, 64 nt, hsa; identical to SEQ ID NO: 355784

SEQ ID NO: 430650 - RNA, 64 nt, hsa; identical to SEQ ID NO: 175895

SEQ ID NO: 430651 - RNA, 64 nt, hsa; identical to SEQ ID NO: 175896

SEQ ID NO: 430652 - RNA, 64 nt, hsa; identical to SEQ ID NO: 175897

SEQ ID NO: 430653 - RNA, 64 nt, hsa; identical to SEQ ID NO: 175898

SEQ ID NO: 430654 - RNA, 64 nt, hsa; identical to SEQ ID NO: 175899

SEQ ID NO: 430655 - RNA, 64 nt, hsa; identical to SEQ ID NO: 175900

SEQ ID NO: 430656 - RNA, 64 nt, hsa; identical to SEQ ID NO: 175901

SEQ ID NO: 430657 - RNA, 64 nt, hsa; identical to SEQ ID NO: 175902

SEQ ID NO: 430658 - RNA, 64 nt, hsa; identical to SEQ ID NO: 175903

SEQ ID NO: 430659 - RNA, 64 nt, hsa; identical to SEQ ID NO: 175904

SEQ ID NO: 430660 - RNA, 64 nt, hsa; identical to SEQ ID NO: 175905

SEQ ID NO: 430661 - RNA, 64 nt, hsa; identical to SEQ ID NO: 175906

SEQ ID NO: 430662 - RNA, 64 nt, hsa; identical to SEQ ID NO: 175907

SEQ ID NO: 430663 - RNA, 64 nt, hsa; identical to SEQ ID NO: 175908

SEQ ID NO: 430664 - RNA, 64 nt, hsa; identical to SEQ ID NO: 175909

SEQ ID NO: 430665 - RNA, 64 nt, hsa; identical to SEQ ID NO: 175910

SEQ ID NO: 430666 - RNA, 64 nt, hsa; identical to SEQ ID NO: 175911

SEQ ID NO: 430667 - RNA, 64 nt, hsa; identical to SEQ ID NO: 175912

SEQ ID NO: 430668 - RNA, 64 nt, hsa; identical to SEQ ID NO: 175913

SEQ ID NO: 430669 - RNA, 64 nt, hsa; identical to SEQ ID NO: 175914

SEQ ID NO: 430670 - RNA, 64 nt, hsa; identical to SEQ ID NO: 175915

SEQ ID NO: 430671 - RNA, 64 nt, hsa; identical to SEQ ID NO: 175916

SEQ ID NO: 430672 - RNA, 64 nt, hsa; identical to SEQ ID NO: 175917

SEQ ID NO: 430673 - RNA, 64 nt, hsa; identical to SEQ ID NO: 175918

SEQ ID NO: 430674 - RNA, 64 nt, hsa; identical to SEQ ID NO: 175919

SEQ ID NO: 430675 - RNA, 64 nt, hsa; identical to SEQ ID NO: 175920

SEQ ID NO: 430676 - RNA, 64 nt, hsa; identical to SEQ ID NO: 175921

SEQ ID NO: 430677 - RNA, 64 nt, hsa; identical to SEQ ID NO: 175922

SEQ ID NO: 430678 - RNA, 64 nt, hsa; identical to SEQ ID NO: 175923

SEQ ID NO: 430679 - RNA, 64 nt, hsa; identical to SEQ ID NO: 175924

SEQ ID NO: 430680 - RNA, 64 nt, hsa; identical to SEQ ID NO: 175925

SEQ ID NO: 430681 - RNA, 64 nt, hsa; identical to SEQ ID NO: 175926

SEQ ID NO: 430682 - RNA, 64 nt, hsa; identical to SEQ ID NO: 175927

SEQ ID NO: 430683 - RNA, 64 nt, hsa; identical to SEQ ID NO: 175928

SEQ ID NO: 430684 - RNA, 64 nt, hsa; identical to SEQ ID NO: 175929

SEQ ID NO: 430685 - RNA, 64 nt, hsa; identical to SEQ ID NO: 175930

SEQ ID NO: 430686 - RNA, 64 nt, hsa; identical to SEQ ID NO: 175931

SEQ ID NO: 430687 - RNA, 64 nt, hsa; identical to SEQ ID NO: 175932

SEQ ID NO: 430688 - RNA, 64 nt, hsa; identical to SEQ ID NO: 175933

SEQ ID NO: 430689 - RNA, 64 nt, hsa; identical to SEQ ID NO: 175934

SEQ ID NO: 430690 - RNA, 64 nt, hsa; identical to SEQ ID NO: 175935

SEQ ID NO: 430691 - RNA, 64 nt, hsa; identical to SEQ ID NO: 175936

SEQ ID NO: 430692 - RNA, 64 nt, hsa; identical to SEQ ID NO: 175937

SEQ ID NO: 430693 - RNA, 64 nt, hsa; identical to SEQ ID NO: 175938

SEQ ID NO: 430694 - RNA, 64 nt, hsa; identical to SEQ ID NO: 175939

SEQ ID NO: 430695 - RNA, 64 nt, hsa; identical to SEQ ID NO: 175940

SEQ ID NO: 430696 - RNA, 64 nt, hsa; identical to SEQ ID NO: 175941

SEQ ID NO: 430697 - RNA, 64 nt, hsa; identical to SEQ ID NO: 175942

SEQ ID NO: 430698 - RNA, 64 nt, hsa; identical to SEQ ID NO: 175943

SEQ ID NO: 430699 - RNA, 64 nt, hsa; identical to SEQ ID NO: 175944

SEQ ID NO: 430700 - RNA, 64 nt, hsa; identical to SEQ ID NO: 175945

SEQ ID NO: 430701 - RNA, 64 nt, hsa; identical to SEQ ID NO: 175946

SEQ ID NO: 430702 - RNA, 64 nt, hsa; identical to SEQ ID NO: 175947

SEQ ID NO: 430703 - RNA, 64 nt, hsa; identical to SEQ ID NO: 175948

SEQ ID NO: 430704 - RNA, 64 nt, hsa; identical to SEQ ID NO: 175949

SEQ ID NO: 430705 - RNA, 64 nt, hsa; identical to SEQ ID NO: 175950

SEQ ID NO: 430706 - RNA, 64 nt, hsa; identical to SEQ ID NO: 175951

SEQ ID NO: 430707 - RNA, 64 nt, hsa; identical to SEQ ID NO: 175952

SEQ ID NO: 430708 - RNA, 64 nt, hsa; identical to SEQ ID NO: 175953

SEQ ID NO: 430709 - RNA, 62 nt, hsa; identical to SEQ ID NO: 175954

SEQ ID NO: 430710 - RNA, 64 nt, hsa; identical to SEQ ID NO: 175955

SEQ ID NO: 430711 - RNA, 64 nt, hsa; identical to SEQ ID NO: 175956

SEQ ID NO: 430712 - RNA, 64 nt, hsa; identical to SEQ ID NO: 175957

SEQ ID NO: 430713 - RNA, 64 nt, hsa; identical to SEQ ID NO: 175958

SEQ ID NO: 430714 - RNA, 64 nt, hsa; identical to SEQ ID NO: 175959

SEQ ID NO: 430715 - RNA, 64 nt, hsa; identical to SEQ ID NO: 175960

SEQ ID NO: 430716 - RNA, 64 nt, hsa; identical to SEQ ID NO: 175961

SEQ ID NO: 430717 - RNA, 64 nt, hsa; identical to SEQ ID NO: 175962

SEQ ID NO: 430718 - RNA, 64 nt, hsa; identical to SEQ ID NO: 175963

SEQ ID NO: 430719 - RNA, 64 nt, hsa; identical to SEQ ID NO: 175964

SEQ ID NO: 430720 - RNA, 64 nt, hsa; identical to SEQ ID NO: 175965

SEQ ID NO: 430721 - RNA, 64 nt, hsa; identical to SEQ ID NO: 175966

SEQ ID NO: 430722 - RNA, 64 nt, hsa; identical to SEQ ID NO: 175967

SEQ ID NO: 430723 - RNA, 64 nt, hsa; identical to SEQ ID NO: 175968

SEQ ID NO: 430724 - RNA, 64 nt, hsa; identical to SEQ ID NO: 175969

SEQ ID NO: 430725 - RNA, 64 nt, hsa; identical to SEQ ID NO: 175970

SEQ ID NO: 430726 - RNA, 64 nt, hsa; identical to SEQ ID NO: 175971

SEQ ID NO: 430727 - RNA, 64 nt, hsa; identical to SEQ ID NO: 175972

SEQ ID NO: 430728 - RNA, 64 nt, hsa; identical to SEQ ID NO: 175973

SEQ ID NO: 430729 - RNA, 64 nt, hsa; identical to SEQ ID NO: 175974

SEQ ID NO: 430730 - RNA, 64 nt, hsa; identical to SEQ ID NO: 175975

SEQ ID NO: 430731 - RNA, 64 nt, hsa; identical to SEQ ID NO: 175976

SEQ ID NO: 430732 - RNA, 64 nt, hsa; identical to SEQ ID NO: 175977

SEQ ID NO: 430733 - RNA, 64 nt, hsa; identical to SEQ ID NO: 175978

SEQ ID NO: 430734 - RNA, 64 nt, hsa; identical to SEQ ID NO: 175979

SEQ ID NO: 430735 - RNA, 64 nt, hsa; identical to SEQ ID NO: 175980

SEQ ID NO: 430736 - RNA, 64 nt, hsa; identical to SEQ ID NO: 175981

SEQ ID NO: 430737 - RNA, 64 nt, hsa; identical to SEQ ID NO: 175982

SEQ ID NO: 430738 - RNA, 64 nt, hsa; identical to SEQ ID NO: 175983

SEQ ID NO: 430739 - RNA, 64 nt, hsa; identical to SEQ ID NO: 175984

SEQ ID NO: 430740 - RNA, 64 nt, hsa; identical to SEQ ID NO: 175985

SEQ ID NO: 430741 - RNA, 64 nt, hsa; identical to SEQ ID NO: 175986

SEQ ID NO: 430742 - RNA, 64 nt, hsa; identical to SEQ ID NO: 175987

SEQ ID NO: 430743 - RNA, 64 nt, hsa; identical to SEQ ID NO: 175988

SEQ ID NO: 430744 - RNA, 64 nt, hsa; identical to SEQ ID NO: 175989

SEQ ID NO: 430745 - RNA, 64 nt, hsa; identical to SEQ ID NO: 175990

SEQ ID NO: 430746 - RNA, 64 nt, hsa; identical to SEQ ID NO: 175991

SEQ ID NO: 430747 - RNA, 64 nt, hsa; identical to SEQ ID NO: 175992

SEQ ID NO: 430748 - RNA, 64 nt, hsa; identical to SEQ ID NO: 175993

SEQ ID NO: 430749 - RNA, 64 nt, hsa; identical to SEQ ID NO: 175994

SEQ ID NO: 430750 - RNA, 64 nt, hsa; identical to SEQ ID NO: 175995

SEQ ID NO: 430751 - RNA, 64 nt, hsa; identical to SEQ ID NO: 175996

SEQ ID NO: 430752 - RNA, 64 nt, hsa; identical to SEQ ID NO: 175997

SEQ ID NO: 430753 - RNA, 62 nt, hsa; identical to SEQ ID NO: 175998

SEQ ID NO: 430754 - RNA, 64 nt, hsa; identical to SEQ ID NO: 175999

SEQ ID NO: 430755 - RNA, 64 nt, hsa; identical to SEQ ID NO: 176000

SEQ ID NO: 430756 - RNA, 64 nt, hsa; identical to SEQ ID NO: 176001

SEQ ID NO: 430757 - RNA, 64 nt, hsa; identical to SEQ ID NO: 176002

SEQ ID NO: 430758 - RNA, 64 nt, hsa; identical to SEQ ID NO: 176003

SEQ ID NO: 430759 - RNA, 64 nt, hsa; identical to SEQ ID NO: 176004

SEQ ID NO: 430760 - RNA, 64 nt, hsa; identical to SEQ ID NO: 176005

SEQ ID NO: 430761 - RNA, 64 nt, hsa; identical to SEQ ID NO: 176006

SEQ ID NO: 430762 - RNA, 64 nt, hsa; identical to SEQ ID NO: 176007

SEQ ID NO: 430763 - RNA, 64 nt, hsa; identical to SEQ ID NO: 176008

SEQ ID NO: 430764 - RNA, 64 nt, hsa; identical to SEQ ID NO: 176009

SEQ ID NO: 430765 - RNA, 64 nt, hsa; identical to SEQ ID NO: 176010

SEQ ID NO: 430766 - RNA, 64 nt, hsa; identical to SEQ ID NO: 176011

SEQ ID NO: 430767 - RNA, 64 nt, hsa; identical to SEQ ID NO: 176012

SEQ ID NO: 430768 - RNA, 64 nt, hsa; identical to SEQ ID NO: 176013

SEQ ID NO: 430769 - RNA, 64 nt, hsa; identical to SEQ ID NO: 176014

SEQ ID NO: 430770 - RNA, 64 nt, hsa; identical to SEQ ID NO: 176015

SEQ ID NO: 430771 - RNA, 64 nt, hsa; identical to SEQ ID NO: 176016

SEQ ID NO: 430772 - RNA, 64 nt, hsa; identical to SEQ ID NO: 176017

SEQ ID NO: 430773 - RNA, 64 nt, hsa; identical to SEQ ID NO: 176018

SEQ ID NO: 430774 - RNA, 64 nt, hsa; identical to SEQ ID NO: 176019

SEQ ID NO: 430775 - RNA, 64 nt, hsa; identical to SEQ ID NO: 176020

SEQ ID NO: 430776 - RNA, 64 nt, hsa; identical to SEQ ID NO: 176021

SEQ ID NO: 430777 - RNA, 64 nt, hsa; identical to SEQ ID NO: 176022

SEQ ID NO: 430778 - RNA, 64 nt, hsa; identical to SEQ ID NO: 176023

SEQ ID NO: 430779 - RNA, 64 nt, hsa; identical to SEQ ID NO: 176024

SEQ ID NO: 430780 - RNA, 64 nt, hsa; identical to SEQ ID NO: 176025

SEQ ID NO: 430781 - RNA, 64 nt, hsa; identical to SEQ ID NO: 176026

SEQ ID NO: 430782 - RNA, 64 nt, hsa; identical to SEQ ID NO: 176027

SEQ ID NO: 430783 - RNA, 64 nt, hsa; identical to SEQ ID NO: 176028

SEQ ID NO: 430784 - RNA, 64 nt, hsa; identical to SEQ ID NO: 176029

SEQ ID NO: 430785 - RNA, 59 nt, hsa; identical to SEQ ID NO: 176030

SEQ ID NO: 430786 - RNA, 56 nt, hsa; identical to SEQ ID NO: 176031

SEQ ID NO: 430787 - RNA, 64 nt, hsa; identical to SEQ ID NO: 176032

SEQ ID NO: 430788 - RNA, 64 nt, hsa; identical to SEQ ID NO: 176033

SEQ ID NO: 430789 - RNA, 64 nt, hsa; identical to SEQ ID NO: 176034

SEQ ID NO: 430790 - RNA, 64 nt, hsa; identical to SEQ ID NO: 176035

SEQ ID NO: 430791 - RNA, 64 nt, hsa; identical to SEQ ID NO: 176036

SEQ ID NO: 430792 - RNA, 64 nt, hsa; identical to SEQ ID NO: 176037

SEQ ID NO: 430793 - RNA, 64 nt, hsa; identical to SEQ ID NO: 176038

SEQ ID NO: 430794 - RNA, 64 nt, hsa; identical to SEQ ID NO: 176039

SEQ ID NO: 430795 - RNA, 64 nt, hsa; identical to SEQ ID NO: 176040

SEQ ID NO: 430796 - RNA, 64 nt, hsa; identical to SEQ ID NO: 176041

SEQ ID NO: 430797 - RNA, 64 nt, hsa; identical to SEQ ID NO: 176042

SEQ ID NO: 430798 - RNA, 64 nt, hsa; identical to SEQ ID NO: 176043

SEQ ID NO: 430799 - RNA, 64 nt, hsa; identical to SEQ ID NO: 176044

SEQ ID NO: 430800 - RNA, 64 nt, hsa; identical to SEQ ID NO: 176045

SEQ ID NO: 430801 - RNA, 64 nt, hsa; identical to SEQ ID NO: 176046

SEQ ID NO: 430802 - RNA, 64 nt, hsa; identical to SEQ ID NO: 176047

SEQ ID NO: 430803 - RNA, 64 nt, hsa; identical to SEQ ID NO: 176048

SEQ ID NO: 430804 - RNA, 64 nt, hsa; identical to SEQ ID NO: 176049

SEQ ID NO: 430805 - RNA, 64 nt, hsa; identical to SEQ ID NO: 176050

SEQ ID NO: 430806 - RNA, 64 nt, hsa; identical to SEQ ID NO: 176051

SEQ ID NO: 430807 - RNA, 64 nt, hsa; identical to SEQ ID NO: 176052

SEQ ID NO: 430808 - RNA, 64 nt, hsa; identical to SEQ ID NO: 176053

SEQ ID NO: 430809 - RNA, 64 nt, hsa; identical to SEQ ID NO: 176054

SEQ ID NO: 430810 - RNA, 64 nt, hsa; identical to SEQ ID NO: 176055

SEQ ID NO: 430811 - RNA, 64 nt, hsa; identical to SEQ ID NO: 176056

SEQ ID NO: 430812 - RNA, 64 nt, hsa; identical to SEQ ID NO: 176057

SEQ ID NO: 430813 - RNA, 64 nt, hsa; identical to SEQ ID NO: 176058

SEQ ID NO: 430814 - RNA, 64 nt, hsa; identical to SEQ ID NO: 176059

SEQ ID NO: 430815 - RNA, 64 nt, hsa; identical to SEQ ID NO: 176060

SEQ ID NO: 430816 - RNA, 64 nt, hsa; identical to SEQ ID NO: 176061

SEQ ID NO: 430817 - RNA, 64 nt, hsa; identical to SEQ ID NO: 176062

SEQ ID NO: 430818 - RNA, 64 nt, hsa; identical to SEQ ID NO: 176063

SEQ ID NO: 430819 - RNA, 64 nt, hsa; identical to SEQ ID NO: 176064

SEQ ID NO: 430820 - RNA, 64 nt, hsa; identical to SEQ ID NO: 176065

SEQ ID NO: 430821 - RNA, 64 nt, hsa; identical to SEQ ID NO: 176066

SEQ ID NO: 430822 - RNA, 64 nt, hsa; identical to SEQ ID NO: 176067

SEQ ID NO: 430823 - RNA, 64 nt, hsa; identical to SEQ ID NO: 176068

SEQ ID NO: 430824 - RNA, 64 nt, hsa; identical to SEQ ID NO: 176069

SEQ ID NO: 430825 - RNA, 64 nt, hsa; identical to SEQ ID NO: 176070

SEQ ID NO: 430826 - RNA, 64 nt, hsa; identical to SEQ ID NO: 176071

SEQ ID NO: 430827 - RNA, 64 nt, hsa; identical to SEQ ID NO: 176072

SEQ ID NO: 430828 - RNA, 64 nt, hsa; identical to SEQ ID NO: 176073

SEQ ID NO: 430829 - RNA, 64 nt, hsa; identical to SEQ ID NO: 176074

SEQ ID NO: 430830 - RNA, 64 nt, hsa; identical to SEQ ID NO: 176075

SEQ ID NO: 430831 - RNA, 64 nt, hsa
ugaacuggccugugcaaugggcauggagcacaaggggucacagcaugccuccugccuuaccgug

SEQ ID NO: 430832 - RNA, 64 nt, hsa
uugugccaguauucaagugguauagcucugagcagggucacauuuggccaaaccugacacuguc

SEQ ID NO: 430833 - RNA, 64 nt, hsa
ucuuagcaaccugcccuuuuauucaugccauuuggggucacagaugccuagcuggacacagcuc

SEQ ID NO: 430834 - RNA, 64 nt, hsa
ccucacaaccuuucugcuggggcugaaguuucuggggucacauggucagaaggggcugagcugg

SEQ ID NO: 430835 - RNA, 64 nt, hsa
cuuucuagagcaaauuucucuuucuagaaggggagggucacagggucacagauucaccaaagcu

SEQ ID NO: 430836 - RNA, 64 nt, hsa
agcaaauuucucuuucuagaaggggagggucacagggucacagauucaccaaagcugaaagggc

SEQ ID NO: 430837 - RNA, 64 nt, hsa
gcuggacuucuaauauauagaacugugagauaaugggucacauuggcuggaugugguggcucau

SEQ ID NO: 430838 - RNA, 64 nt, hsa
ugagacuccaucauaaauaaauaaauaaauaaaugggucacauuaagccuuuaaguuuguggua

SEQ ID NO: 430839 - RNA, 61 nt, hsa
ugaagggcuaguggcacugccaggggaagggagugcguaggcuuccagugaugguugggga

SEQ ID NO: 430840 - RNA, 61 nt, hsa
aauucuucaggguaucuuauauuuuugacugagugcguaguacccauuagacagcuggaga

SEQ ID NO: 430841 - RNA, 61 nt, hsa
aaaugcuaacaagcgugcagaaacaccagagagugcguauccugcucagaaccauucacau

SEQ ID NO: 430842 - RNA, 61 nt, hsa
uguauuucugccauguaccuaaugauuauucagugcguauauaucugaaaagucauguugc

SEQ ID NO: 430843 - RNA, 61 nt, hsa
ugaggcccacugucuaccuugccagauccucagugcguaucgccaaugcaggaugcuccuu

SEQ ID NO: 430844 - RNA, 61 nt, hsa
uuucuggaaguuuauaucuaaaaauguuaauagugcguaccucuaggaagugggccuggaa

SEQ ID NO: 430845 - RNA, 61 nt, hsa
ccuaagaguacacauggaggguaaauauuaaagugcguauuauguacaucuagaauccaug

SEQ ID NO: 430846 - RNA, 54 nt, hsa; identical to SEQ ID NO: 263969

SEQ ID NO: 430847 - RNA, 61 nt, hsa
ugucaggacauuccuuuuccaauugugugucagugcguauuguaauaaaacuacugauuua

SEQ ID NO: 430848 - RNA, 61 nt, hsa
uuggguuuuuucauaucuguacauaaugccgagugcguaaggaaaccguggcgucgcgcac

SEQ ID NO: 430849 - RNA, 61 nt, hsa
caaauggcagugugcugucaccugcaacagaagugcguaccagaaguaugacucaugcaaa

SEQ ID NO: 430850 - RNA, 61 nt, hsa
aggaauacauuuuuuuacugccuuaaccuguagugcguagaauaugcaucaauuucuugaa

SEQ ID NO: 430851 - RNA, 61 nt, hsa
ccuucaaacugucccagguccugcgcagcucagugcguaucuucuugcuuccaugugucuu

SEQ ID NO: 430852 - RNA, 61 nt, hsa
gccaaagaugauaaagggggaaaugguuuuuagugcguauauuauacugccucuuaggugu

SEQ ID NO: 430853 - RNA, 61 nt, hsa
gaccugggggugugucuggggguggggugugagugcguaugaaagugugugucugcugggg

SEQ ID NO: 430854 - RNA, 61 nt, hsa
ugccacaucacuuccuucuugaaagccuaagagugcguaugcgugugugugugugugugug

SEQ ID NO: 430855 - RNA, 61 nt, hsa
gagaaucucaaugccaguaguacuggauaauagugcguauugcuucugguggcauuacccu

SEQ ID NO: 430856 - RNA, 61 nt, hsa
gaaagucuugccucauugaguguuuuucccuagugcguaguuggagucugucccugucuug

SEQ ID NO: 430857 - RNA, 61 nt, hsa
gggaaugaacaugaauuagggaacuucaaauagugcguagacuuuucccuacuuaccauug

SEQ ID NO: 430858 - RNA, 61 nt, hsa
uaugggagacacaccaacuacucuucaaaucagugcguaccugcucuacgcgugaagguac

SEQ ID NO: 430859 - RNA, 61 nt, hsa
guaaauguggauagaaagcucagugugaggcagugcguagaccuaacgucuaccuuuacau

SEQ ID NO: 430860 - RNA, 61 nt, hsa
cacuucaauuaaugcugcgcuucgcuuggugagugcguacuuuuucuaccuguacacauuc

SEQ ID NO: 430861 - RNA, 61 nt, hsa
gaagggagugggcggagauauguaaauagaaagugcguacaguuagaacguccggcacgua

SEQ ID NO: 430862 - RNA, 61 nt, hsa
gacauauucuacuuagacguuaaacuguacaagugcguacaaugugaccuucucuaaaugc

SEQ ID NO: 430863 - RNA, 61 nt, hsa
cgcccacccagcgucgacccuugacccacgaagugcguagcaugcaguauuuaaagcagug

SEQ ID NO: 430864 - RNA, 61 nt, hsa
aauagggacaaacaaaucuugaggaagcccaagugcguaccuuuauuuuugcccccaccac

SEQ ID NO: 430865 - RNA, 62 nt, hsa
cugaagggcuaguggcacugccaggggaagggagugcguaggcuuccagugaugguugggga

SEQ ID NO: 430866 - RNA, 62 nt, hsa
gaauucuucaggguaucuuauauuuuugacugagugcguaguacccauuagacagcuggaga

SEQ ID NO: 430867 - RNA, 62 nt, hsa
gaaaugcuaacaagcgugcagaaacaccagagagugcguauccugcucagaaccauucacau

SEQ ID NO: 430868 - RNA, 62 nt, hsa
guguauuucugccauguaccuaaugauuauucagugcguauauaucugaaaagucauguugc

SEQ ID NO: 430869 - RNA, 62 nt, hsa
cugaggcccacugucuaccuugccagauccucagugcguaucgccaaugcaggaugcuccuu

SEQ ID NO: 430870 - RNA, 62 nt, hsa
auuucuggaaguuuauaucuaaaaauguuaauagugcguaccucuaggaagugggccuggaa

SEQ ID NO: 430871 - RNA, 62 nt, hsa
gccuaagaguacacauggaggguaaauauuaaagugcguauuauguacaucuagaauccaug

SEQ ID NO: 430872 - RNA, 54 nt, hsa; identical to SEQ ID NO: 263969

SEQ ID NO: 430873 - RNA, 62 nt, hsa
augucaggacauuccuuuuccaauugugugucagugcguauuguaauaaaacuacugauuua

SEQ ID NO: 430874 - RNA, 62 nt, hsa
guuggguuuuuucauaucuguacauaaugccgagugcguaaggaaaccguggcgucgcgcac

SEQ ID NO: 430875 - RNA, 62 nt, hsa
gcaaauggcagugugcugucaccugcaacagaagugcguaccagaaguaugacucaugcaaa

SEQ ID NO: 430876 - RNA, 62 nt, hsa
caggaauacauuuuuuuacugccuuaaccuguagugcguagaauaugcaucaauuucuugaa

SEQ ID NO: 430877 - RNA, 62 nt, hsa
gccuucaaacugucccagguccugcgcagcucagugcguaucuucuugcuuccaugugucuu

SEQ ID NO: 430878 - RNA, 62 nt, hsa
agccaaagaugauaaagggggaaaugguuuuuagugcguauauuauacugccucuuaggugu

SEQ ID NO: 430879 - RNA, 62 nt, hsa
agaccugggggugugucuggggguggggugugagugcguaugaaagugugugucugcugggg

SEQ ID NO: 430880 - RNA, 62 nt, hsa
cugccacaucacuuccuucuugaaagccuaagagugcguaugcgugugugugugugugugug

SEQ ID NO: 430881 - RNA, 62 nt, hsa
ugagaaucucaaugccaguaguacuggauaauagugcguauugcuucugguggcauuacccu

SEQ ID NO: 430882 - RNA, 62 nt, hsa
agaaagucuugccucauugaguguuuuucccuagugcguaguuggagucugucccugucuug

SEQ ID NO: 430883 - RNA, 62 nt, hsa
ugggaaugaacaugaauuagggaacuucaaauagugcguagacuuuucccuacuuaccauug

SEQ ID NO: 430884 - RNA, 62 nt, hsa
guaugggagacacaccaacuacucuucaaaucagugcguaccugcucuacgcgugaagguac

SEQ ID NO: 430885 - RNA, 62 nt, hsa
uguaaauguggauagaaagcucagugugaggcagugcguagaccuaacgucuaccuuuacau

SEQ ID NO: 430886 - RNA, 62 nt, hsa
ucacuucaauuaaugcugcgcuucgcuuggugagugcguacuuuuucuaccuguacacauuc

SEQ ID NO: 430887 - RNA, 62 nt, hsa
ggaagggagugggcggagauauguaaauagaaagugcguacaguuagaacguccggcacgua

SEQ ID NO: 430888 - RNA, 62 nt, hsa
agacauauucuacuuagacguuaaacuguacaagugcguacaaugugaccuucucuaaaugc

SEQ ID NO: 430889 - RNA, 62 nt, hsa
acgcccacccagcgucgacccuugacccacgaagugcguagcaugcaguauuuaaagcagug

SEQ ID NO: 430890 - RNA, 62 nt, hsa
gaauagggacaaacaaaucuugaggaagcccaagugcguaccuuuauuuuugcccccaccac

SEQ ID NO: 430891 - RNA, 64 nt, hsa; identical to SEQ ID NO: 263962

SEQ ID NO: 430892 - RNA, 64 nt, hsa; identical to SEQ ID NO: 263963

SEQ ID NO: 430893 - RNA, 64 nt, hsa; identical to SEQ ID NO: 263964

SEQ ID NO: 430894 - RNA, 64 nt, hsa; identical to SEQ ID NO: 263965

SEQ ID NO: 430895 - RNA, 64 nt, hsa; identical to SEQ ID NO: 263966

SEQ ID NO: 430896 - RNA, 64 nt, hsa; identical to SEQ ID NO: 263967

SEQ ID NO: 430897 - RNA, 64 nt, hsa; identical to SEQ ID NO: 263968

SEQ ID NO: 430898 - RNA, 54 nt, hsa; identical to SEQ ID NO: 263969

SEQ ID NO: 430899 - RNA, 64 nt, hsa; identical to SEQ ID NO: 263970

SEQ ID NO: 430900 - RNA, 64 nt, hsa; identical to SEQ ID NO: 263971

SEQ ID NO: 430901 - RNA, 64 nt, hsa; identical to SEQ ID NO: 263972

SEQ ID NO: 430902 - RNA, 64 nt, hsa; identical to SEQ ID NO: 263973

SEQ ID NO: 430903 - RNA, 64 nt, hsa; identical to SEQ ID NO: 263974

SEQ ID NO: 430904 - RNA, 64 nt, hsa; identical to SEQ ID NO: 263975

SEQ ID NO: 430905 - RNA, 64 nt, hsa; identical to SEQ ID NO: 263976

SEQ ID NO: 430906 - RNA, 64 nt, hsa; identical to SEQ ID NO: 263977

SEQ ID NO: 430907 - RNA, 64 nt, hsa; identical to SEQ ID NO: 263978

SEQ ID NO: 430908 - RNA, 64 nt, hsa; identical to SEQ ID NO: 263979

SEQ ID NO: 430909 - RNA, 64 nt, hsa; identical to SEQ ID NO: 263980

SEQ ID NO: 430910 - RNA, 64 nt, hsa; identical to SEQ ID NO: 263981

SEQ ID NO: 430911 - RNA, 64 nt, hsa; identical to SEQ ID NO: 263982

SEQ ID NO: 430912 - RNA, 64 nt, hsa; identical to SEQ ID NO: 263983

SEQ ID NO: 430913 - RNA, 64 nt, hsa; identical to SEQ ID NO: 263984

SEQ ID NO: 430914 - RNA, 64 nt, hsa; identical to SEQ ID NO: 263985

SEQ ID NO: 430915 - RNA, 64 nt, hsa; identical to SEQ ID NO: 263986

SEQ ID NO: 430916 - RNA, 64 nt, hsa; identical to SEQ ID NO: 263987

SEQ ID NO: 430917 - RNA, 64 nt, hsa; identical to SEQ ID NO: 107934

SEQ ID NO: 430918 - RNA, 64 nt, hsa; identical to SEQ ID NO: 107935

SEQ ID NO: 430919 - RNA, 64 nt, hsa; identical to SEQ ID NO: 107936

SEQ ID NO: 430920 - RNA, 64 nt, hsa; identical to SEQ ID NO: 107937

SEQ ID NO: 430921 - RNA, 64 nt, hsa; identical to SEQ ID NO: 107938

SEQ ID NO: 430922 - RNA, 64 nt, hsa; identical to SEQ ID NO: 107939

SEQ ID NO: 430923 - RNA, 64 nt, hsa; identical to SEQ ID NO: 107940

SEQ ID NO: 430924 - RNA, 64 nt, hsa; identical to SEQ ID NO: 107941

SEQ ID NO: 430925 - RNA, 64 nt, hsa; identical to SEQ ID NO: 107942

SEQ ID NO: 430926 - RNA, 64 nt, hsa; identical to SEQ ID NO: 107943

SEQ ID NO: 430927 - RNA, 64 nt, hsa; identical to SEQ ID NO: 107944

SEQ ID NO: 430928 - RNA, 64 nt, hsa; identical to SEQ ID NO: 107945

SEQ ID NO: 430929 - RNA, 64 nt, hsa; identical to SEQ ID NO: 107946

SEQ ID NO: 430930 - RNA, 64 nt, hsa; identical to SEQ ID NO: 107947

SEQ ID NO: 430931 - RNA, 64 nt, hsa; identical to SEQ ID NO: 107948

SEQ ID NO: 430932 - RNA, 64 nt, hsa; identical to SEQ ID NO: 107949

SEQ ID NO: 430933 - RNA, 64 nt, hsa; identical to SEQ ID NO: 107950

SEQ ID NO: 430934 - RNA, 64 nt, hsa; identical to SEQ ID NO: 107951

SEQ ID NO: 430935 - RNA, 64 nt, hsa; identical to SEQ ID NO: 107952

SEQ ID NO: 430936 - RNA, 64 nt, hsa; identical to SEQ ID NO: 107953

SEQ ID NO: 430937 - RNA, 64 nt, hsa; identical to SEQ ID NO: 107954

SEQ ID NO: 430938 - RNA, 64 nt, hsa; identical to SEQ ID NO: 107955

SEQ ID NO: 430939 - RNA, 64 nt, hsa; identical to SEQ ID NO: 107956

SEQ ID NO: 430940 - RNA, 64 nt, hsa; identical to SEQ ID NO: 107957

SEQ ID NO: 430941 - RNA, 64 nt, hsa; identical to SEQ ID NO: 107958

SEQ ID NO: 430942 - RNA, 64 nt, hsa; identical to SEQ ID NO: 107959

SEQ ID NO: 430943 - RNA, 64 nt, hsa; identical to SEQ ID NO: 107960

SEQ ID NO: 430944 - RNA, 64 nt, hsa; identical to SEQ ID NO: 107961

SEQ ID NO: 430945 - RNA, 64 nt, hsa; identical to SEQ ID NO: 107962

SEQ ID NO: 430946 - RNA, 64 nt, hsa; identical to SEQ ID NO: 107963

SEQ ID NO: 430947 - RNA, 64 nt, hsa; identical to SEQ ID NO: 107964

SEQ ID NO: 430948 - RNA, 64 nt, hsa; identical to SEQ ID NO: 107965

SEQ ID NO: 430949 - RNA, 64 nt, hsa; identical to SEQ ID NO: 107966

SEQ ID NO: 430950 - RNA, 64 nt, hsa; identical to SEQ ID NO: 107967

SEQ ID NO: 430951 - RNA, 64 nt, hsa; identical to SEQ ID NO: 107968

SEQ ID NO: 430952 - RNA, 64 nt, hsa; identical to SEQ ID NO: 107969

SEQ ID NO: 430953 - RNA, 64 nt, hsa; identical to SEQ ID NO: 107970

SEQ ID NO: 430954 - RNA, 64 nt, hsa; identical to SEQ ID NO: 107971

SEQ ID NO: 430955 - RNA, 64 nt, hsa; identical to SEQ ID NO: 107972

SEQ ID NO: 430956 - RNA, 64 nt, hsa; identical to SEQ ID NO: 107973

SEQ ID NO: 430957 - RNA, 61 nt, hsa; identical to SEQ ID NO: 430839

SEQ ID NO: 430958 - RNA, 61 nt, hsa; identical to SEQ ID NO: 430840

SEQ ID NO: 430959 - RNA, 61 nt, hsa; identical to SEQ ID NO: 430841

SEQ ID NO: 430960 - RNA, 61 nt, hsa; identical to SEQ ID NO: 430842

SEQ ID NO: 430961 - RNA, 61 nt, hsa; identical to SEQ ID NO: 430843

SEQ ID NO: 430962 - RNA, 61 nt, hsa; identical to SEQ ID NO: 430844

SEQ ID NO: 430963 - RNA, 61 nt, hsa; identical to SEQ ID NO: 430845

SEQ ID NO: 430964 - RNA, 54 nt, hsa; identical to SEQ ID NO: 263969

SEQ ID NO: 430965 - RNA, 61 nt, hsa; identical to SEQ ID NO: 430847

SEQ ID NO: 430966 - RNA, 61 nt, hsa; identical to SEQ ID NO: 430848

SEQ ID NO: 430967 - RNA, 61 nt, hsa; identical to SEQ ID NO: 430849

SEQ ID NO: 430968 - RNA, 61 nt, hsa; identical to SEQ ID NO: 430850

SEQ ID NO: 430969 - RNA, 61 nt, hsa; identical to SEQ ID NO: 430851

SEQ ID NO: 430970 - RNA, 61 nt, hsa; identical to SEQ ID NO: 430852

SEQ ID NO: 430971 - RNA, 61 nt, hsa; identical to SEQ ID NO: 430853

SEQ ID NO: 430972 - RNA, 61 nt, hsa; identical to SEQ ID NO: 430854

SEQ ID NO: 430973 - RNA, 61 nt, hsa; identical to SEQ ID NO: 430855

SEQ ID NO: 430974 - RNA, 61 nt, hsa; identical to SEQ ID NO: 430856

SEQ ID NO: 430975 - RNA, 61 nt, hsa; identical to SEQ ID NO: 430857

SEQ ID NO: 430976 - RNA, 61 nt, hsa; identical to SEQ ID NO: 430858

SEQ ID NO: 430977 - RNA, 61 nt, hsa; identical to SEQ ID NO: 430859

SEQ ID NO: 430978 - RNA, 61 nt, hsa; identical to SEQ ID NO: 430860

SEQ ID NO: 430979 - RNA, 61 nt, hsa; identical to SEQ ID NO: 430861

SEQ ID NO: 430980 - RNA, 61 nt, hsa; identical to SEQ ID NO: 430862

SEQ ID NO: 430981 - RNA, 61 nt, hsa; identical to SEQ ID NO: 430863

SEQ ID NO: 430982 - RNA, 61 nt, hsa; identical to SEQ ID NO: 430864

SEQ ID NO: 430983 - RNA, 62 nt, hsa; identical to SEQ ID NO: 430865

SEQ ID NO: 430984 - RNA, 62 nt, hsa; identical to SEQ ID NO: 430866

SEQ ID NO: 430985 - RNA, 62 nt, hsa; identical to SEQ ID NO: 430867

SEQ ID NO: 430986 - RNA, 62 nt, hsa; identical to SEQ ID NO: 430868

SEQ ID NO: 430987 - RNA, 62 nt, hsa; identical to SEQ ID NO: 430869

SEQ ID NO: 430988 - RNA, 62 nt, hsa; identical to SEQ ID NO: 430870

SEQ ID NO: 430989 - RNA, 62 nt, hsa; identical to SEQ ID NO: 430871

SEQ ID NO: 430990 - RNA, 54 nt, hsa; identical to SEQ ID NO: 263969

SEQ ID NO: 430991 - RNA, 62 nt, hsa; identical to SEQ ID NO: 430873

SEQ ID NO: 430992 - RNA, 62 nt, hsa; identical to SEQ ID NO: 430874

SEQ ID NO: 430993 - RNA, 62 nt, hsa; identical to SEQ ID NO: 430875

SEQ ID NO: 430994 - RNA, 62 nt, hsa; identical to SEQ ID NO: 430876

SEQ ID NO: 430995 - RNA, 62 nt, hsa; identical to SEQ ID NO: 430877

SEQ ID NO: 430996 - RNA, 62 nt, hsa; identical to SEQ ID NO: 430878

SEQ ID NO: 430997 - RNA, 62 nt, hsa; identical to SEQ ID NO: 430879

SEQ ID NO: 430998 - RNA, 62 nt, hsa; identical to SEQ ID NO: 430880

SEQ ID NO: 430999 - RNA, 62 nt, hsa; identical to SEQ ID NO: 430881

SEQ ID NO: 431000 - RNA, 62 nt, hsa; identical to SEQ ID NO: 430882

SEQ ID NO: 431001 - RNA, 62 nt, hsa; identical to SEQ ID NO: 430883

SEQ ID NO: 431002 - RNA, 62 nt, hsa; identical to SEQ ID NO: 430884

SEQ ID NO: 431003 - RNA, 62 nt, hsa; identical to SEQ ID NO: 430885

SEQ ID NO: 431004 - RNA, 62 nt, hsa; identical to SEQ ID NO: 430886

SEQ ID NO: 431005 - RNA, 62 nt, hsa; identical to SEQ ID NO: 430887

SEQ ID NO: 431006 - RNA, 62 nt, hsa; identical to SEQ ID NO: 430888

SEQ ID NO: 431007 - RNA, 62 nt, hsa; identical to SEQ ID NO: 430889

SEQ ID NO: 431008 - RNA, 62 nt, hsa; identical to SEQ ID NO: 430890

SEQ ID NO: 431009 - RNA, 64 nt, hsa; identical to SEQ ID NO: 263962

SEQ ID NO: 431010 - RNA, 64 nt, hsa; identical to SEQ ID NO: 263963

SEQ ID NO: 431011 - RNA, 64 nt, hsa; identical to SEQ ID NO: 263964

SEQ ID NO: 431012 - RNA, 64 nt, hsa; identical to SEQ ID NO: 263965

SEQ ID NO: 431013 - RNA, 64 nt, hsa; identical to SEQ ID NO: 263966

SEQ ID NO: 431014 - RNA, 64 nt, hsa; identical to SEQ ID NO: 263967

SEQ ID NO: 431015 - RNA, 64 nt, hsa; identical to SEQ ID NO: 263968

SEQ ID NO: 431016 - RNA, 54 nt, hsa; identical to SEQ ID NO: 263969

SEQ ID NO: 431017 - RNA, 64 nt, hsa; identical to SEQ ID NO: 263970

SEQ ID NO: 431018 - RNA, 64 nt, hsa; identical to SEQ ID NO: 263971

SEQ ID NO: 431019 - RNA, 64 nt, hsa; identical to SEQ ID NO: 263972

SEQ ID NO: 431020 - RNA, 64 nt, hsa; identical to SEQ ID NO: 263973

SEQ ID NO: 431021 - RNA, 64 nt, hsa; identical to SEQ ID NO: 263974

SEQ ID NO: 431022 - RNA, 64 nt, hsa; identical to SEQ ID NO: 263975

SEQ ID NO: 431023 - RNA, 64 nt, hsa; identical to SEQ ID NO: 263976

SEQ ID NO: 431024 - RNA, 64 nt, hsa; identical to SEQ ID NO: 263977

SEQ ID NO: 431025 - RNA, 64 nt, hsa; identical to SEQ ID NO: 263978

SEQ ID NO: 431026 - RNA, 64 nt, hsa; identical to SEQ ID NO: 263979

SEQ ID NO: 431027 - RNA, 64 nt, hsa; identical to SEQ ID NO: 263980

SEQ ID NO: 431028 - RNA, 64 nt, hsa; identical to SEQ ID NO: 263981

SEQ ID NO: 431029 - RNA, 64 nt, hsa; identical to SEQ ID NO: 263982

SEQ ID NO: 431030 - RNA, 64 nt, hsa; identical to SEQ ID NO: 263983

SEQ ID NO: 431031 - RNA, 64 nt, hsa; identical to SEQ ID NO: 263984

SEQ ID NO: 431032 - RNA, 64 nt, hsa; identical to SEQ ID NO: 263985

SEQ ID NO: 431033 - RNA, 64 nt, hsa; identical to SEQ ID NO: 263986

SEQ ID NO: 431034 - RNA, 64 nt, hsa; identical to SEQ ID NO: 263987

SEQ ID NO: 431035 - RNA, 64 nt, hsa; identical to SEQ ID NO: 246823

SEQ ID NO: 431036 - RNA, 64 nt, hsa; identical to SEQ ID NO: 246824

SEQ ID NO: 431037 - RNA, 64 nt, hsa; identical to SEQ ID NO: 246825

SEQ ID NO: 431038 - RNA, 64 nt, hsa; identical to SEQ ID NO: 246826

SEQ ID NO: 431039 - RNA, 64 nt, hsa; identical to SEQ ID NO: 246827

SEQ ID NO: 431040 - RNA, 64 nt, hsa; identical to SEQ ID NO: 246828

SEQ ID NO: 431041 - RNA, 64 nt, hsa; identical to SEQ ID NO: 246829

SEQ ID NO: 431042 - RNA, 50 nt, hsa; identical to SEQ ID NO: 246830

SEQ ID NO: 431043 - RNA, 64 nt, hsa; identical to SEQ ID NO: 246831

SEQ ID NO: 431044 - RNA, 64 nt, hsa; identical to SEQ ID NO: 246832

SEQ ID NO: 431045 - RNA, 64 nt, hsa; identical to SEQ ID NO: 246833

SEQ ID NO: 431046 - RNA, 64 nt, hsa; identical to SEQ ID NO: 246834

SEQ ID NO: 431047 - RNA, 64 nt, hsa; identical to SEQ ID NO: 246835

SEQ ID NO: 431048 - RNA, 64 nt, hsa; identical to SEQ ID NO: 246836

SEQ ID NO: 431049 - RNA, 64 nt, hsa; identical to SEQ ID NO: 246837

SEQ ID NO: 431050 - RNA, 64 nt, hsa; identical to SEQ ID NO: 246838

SEQ ID NO: 431051 - RNA, 64 nt, hsa; identical to SEQ ID NO: 246839

SEQ ID NO: 431052 - RNA, 64 nt, hsa; identical to SEQ ID NO: 246840

SEQ ID NO: 431053 - RNA, 64 nt, hsa; identical to SEQ ID NO: 246841

SEQ ID NO: 431054 - RNA, 64 nt, hsa; identical to SEQ ID NO: 246842

SEQ ID NO: 431055 - RNA, 64 nt, hsa; identical to SEQ ID NO: 246843

SEQ ID NO: 431056 - RNA, 64 nt, hsa; identical to SEQ ID NO: 246844

SEQ ID NO: 431057 - RNA, 64 nt, hsa; identical to SEQ ID NO: 246845

SEQ ID NO: 431058 - RNA, 64 nt, hsa; identical to SEQ ID NO: 246846

SEQ ID NO: 431059 - RNA, 64 nt, hsa; identical to SEQ ID NO: 246847

SEQ ID NO: 431060 - RNA, 64 nt, hsa; identical to SEQ ID NO: 246848

SEQ ID NO: 431061 - RNA, 64 nt, hsa; identical to SEQ ID NO: 246849

SEQ ID NO: 431062 - RNA, 64 nt, hsa; identical to SEQ ID NO: 246850

SEQ ID NO: 431063 - RNA, 64 nt, hsa; identical to SEQ ID NO: 246851

SEQ ID NO: 431064 - RNA, 64 nt, hsa; identical to SEQ ID NO: 246852

SEQ ID NO: 431065 - RNA, 64 nt, hsa; identical to SEQ ID NO: 246853

SEQ ID NO: 431066 - RNA, 64 nt, hsa; identical to SEQ ID NO: 246854

SEQ ID NO: 431067 - RNA, 64 nt, hsa; identical to SEQ ID NO: 246855

SEQ ID NO: 431068 - RNA, 64 nt, hsa; identical to SEQ ID NO: 246856

SEQ ID NO: 431069 - RNA, 64 nt, hsa; identical to SEQ ID NO: 246857

SEQ ID NO: 431070 - RNA, 64 nt, hsa; identical to SEQ ID NO: 246858

SEQ ID NO: 431071 - RNA, 64 nt, hsa; identical to SEQ ID NO: 246859

SEQ ID NO: 431072 - RNA, 64 nt, hsa; identical to SEQ ID NO: 246860

SEQ ID NO: 431073 - RNA, 64 nt, hsa; identical to SEQ ID NO: 246861

SEQ ID NO: 431074 - RNA, 64 nt, hsa; identical to SEQ ID NO: 246862

SEQ ID NO: 431075 - RNA, 64 nt, hsa; identical to SEQ ID NO: 246863

SEQ ID NO: 431076 - RNA, 64 nt, hsa; identical to SEQ ID NO: 246864

SEQ ID NO: 431077 - RNA, 64 nt, hsa; identical to SEQ ID NO: 246865

SEQ ID NO: 431078 - RNA, 64 nt, hsa; identical to SEQ ID NO: 246866

SEQ ID NO: 431079 - RNA, 64 nt, hsa; identical to SEQ ID NO: 246867

SEQ ID NO: 431080 - RNA, 64 nt, hsa; identical to SEQ ID NO: 246868

SEQ ID NO: 431081 - RNA, 64 nt, hsa; identical to SEQ ID NO: 246869

SEQ ID NO: 431082 - RNA, 64 nt, hsa; identical to SEQ ID NO: 246870

SEQ ID NO: 431083 - RNA, 64 nt, hsa; identical to SEQ ID NO: 246871

SEQ ID NO: 431084 - RNA, 64 nt, hsa; identical to SEQ ID NO: 246872

SEQ ID NO: 431085 - RNA, 64 nt, hsa; identical to SEQ ID NO: 246873

SEQ ID NO: 431086 - RNA, 64 nt, hsa; identical to SEQ ID NO: 246874

SEQ ID NO: 431087 - RNA, 64 nt, hsa; identical to SEQ ID NO: 246875

SEQ ID NO: 431088 - RNA, 64 nt, hsa; identical to SEQ ID NO: 246876

SEQ ID NO: 431089 - RNA, 52 nt, hsa; identical to SEQ ID NO: 246877

SEQ ID NO: 431090 - RNA, 64 nt, hsa; identical to SEQ ID NO: 246878

SEQ ID NO: 431091 - RNA, 64 nt, hsa; identical to SEQ ID NO: 246879

SEQ ID NO: 431092 - RNA, 64 nt, hsa; identical to SEQ ID NO: 246880

SEQ ID NO: 431093 - RNA, 64 nt, hsa; identical to SEQ ID NO: 246881

SEQ ID NO: 431094 - RNA, 64 nt, hsa; identical to SEQ ID NO: 246882

SEQ ID NO: 431095 - RNA, 64 nt, hsa; identical to SEQ ID NO: 246883

SEQ ID NO: 431096 - RNA, 64 nt, hsa; identical to SEQ ID NO: 246884

SEQ ID NO: 431097 - RNA, 64 nt, hsa; identical to SEQ ID NO: 246885

SEQ ID NO: 431098 - RNA, 64 nt, hsa; identical to SEQ ID NO: 246886

SEQ ID NO: 431099 - RNA, 64 nt, hsa; identical to SEQ ID NO: 246887

SEQ ID NO: 431100 - RNA, 64 nt, hsa; identical to SEQ ID NO: 246888

SEQ ID NO: 431101 - RNA, 64 nt, hsa; identical to SEQ ID NO: 246889

SEQ ID NO: 431102 - RNA, 64 nt, hsa; identical to SEQ ID NO: 246890

SEQ ID NO: 431103 - RNA, 64 nt, hsa; identical to SEQ ID NO: 246891

SEQ ID NO: 431104 - RNA, 64 nt, hsa; identical to SEQ ID NO: 246892

SEQ ID NO: 431105 - RNA, 64 nt, hsa; identical to SEQ ID NO: 246893

SEQ ID NO: 431106 - RNA, 64 nt, hsa; identical to SEQ ID NO: 246894

SEQ ID NO: 431107 - RNA, 64 nt, hsa; identical to SEQ ID NO: 246895

SEQ ID NO: 431108 - RNA, 64 nt, hsa; identical to SEQ ID NO: 246896

SEQ ID NO: 431109 - RNA, 64 nt, hsa; identical to SEQ ID NO: 246897

SEQ ID NO: 431110 - RNA, 57 nt, hsa; identical to SEQ ID NO: 246898

SEQ ID NO: 431111 - RNA, 64 nt, hsa; identical to SEQ ID NO: 246899

SEQ ID NO: 431112 - RNA, 54 nt, hsa; identical to SEQ ID NO: 246900

SEQ ID NO: 431113 - RNA, 64 nt, hsa; identical to SEQ ID NO: 246901

SEQ ID NO: 431114 - RNA, 64 nt, hsa; identical to SEQ ID NO: 246823

SEQ ID NO: 431115 - RNA, 64 nt, hsa; identical to SEQ ID NO: 246824

SEQ ID NO: 431116 - RNA, 64 nt, hsa; identical to SEQ ID NO: 246825

SEQ ID NO: 431117 - RNA, 64 nt, hsa; identical to SEQ ID NO: 246826

SEQ ID NO: 431118 - RNA, 64 nt, hsa; identical to SEQ ID NO: 246827

SEQ ID NO: 431119 - RNA, 64 nt, hsa; identical to SEQ ID NO: 246828

SEQ ID NO: 431120 - RNA, 64 nt, hsa; identical to SEQ ID NO: 246829

SEQ ID NO: 431121 - RNA, 50 nt, hsa; identical to SEQ ID NO: 246830

SEQ ID NO: 431122 - RNA, 64 nt, hsa; identical to SEQ ID NO: 246831

SEQ ID NO: 431123 - RNA, 64 nt, hsa; identical to SEQ ID NO: 246832

SEQ ID NO: 431124 - RNA, 64 nt, hsa; identical to SEQ ID NO: 246833

SEQ ID NO: 431125 - RNA, 64 nt, hsa; identical to SEQ ID NO: 246834

SEQ ID NO: 431126 - RNA, 64 nt, hsa; identical to SEQ ID NO: 246835

SEQ ID NO: 431127 - RNA, 64 nt, hsa; identical to SEQ ID NO: 246836

SEQ ID NO: 431128 - RNA, 64 nt, hsa; identical to SEQ ID NO: 246837

SEQ ID NO: 431129 - RNA, 64 nt, hsa; identical to SEQ ID NO: 246838

SEQ ID NO: 431130 - RNA, 64 nt, hsa; identical to SEQ ID NO: 246839

SEQ ID NO: 431131 - RNA, 64 nt, hsa; identical to SEQ ID NO: 246840

SEQ ID NO: 431132 - RNA, 64 nt, hsa; identical to SEQ ID NO: 246841

SEQ ID NO: 431133 - RNA, 64 nt, hsa; identical to SEQ ID NO: 246842

SEQ ID NO: 431134 - RNA, 64 nt, hsa; identical to SEQ ID NO: 246843

SEQ ID NO: 431135 - RNA, 64 nt, hsa; identical to SEQ ID NO: 246844

SEQ ID NO: 431136 - RNA, 64 nt, hsa; identical to SEQ ID NO: 246845

SEQ ID NO: 431137 - RNA, 64 nt, hsa; identical to SEQ ID NO: 246846

SEQ ID NO: 431138 - RNA, 64 nt, hsa; identical to SEQ ID NO: 246847

SEQ ID NO: 431139 - RNA, 64 nt, hsa; identical to SEQ ID NO: 246848

SEQ ID NO: 431140 - RNA, 64 nt, hsa; identical to SEQ ID NO: 246849

SEQ ID NO: 431141 - RNA, 64 nt, hsa; identical to SEQ ID NO: 246850

SEQ ID NO: 431142 - RNA, 64 nt, hsa; identical to SEQ ID NO: 246851

SEQ ID NO: 431143 - RNA, 64 nt, hsa; identical to SEQ ID NO: 246852

SEQ ID NO: 431144 - RNA, 64 nt, hsa; identical to SEQ ID NO: 246853

SEQ ID NO: 431145 - RNA, 64 nt, hsa; identical to SEQ ID NO: 246854

SEQ ID NO: 431146 - RNA, 64 nt, hsa; identical to SEQ ID NO: 246855

SEQ ID NO: 431147 - RNA, 64 nt, hsa; identical to SEQ ID NO: 246856

SEQ ID NO: 431148 - RNA, 64 nt, hsa; identical to SEQ ID NO: 246857

SEQ ID NO: 431149 - RNA, 64 nt, hsa; identical to SEQ ID NO: 246858

SEQ ID NO: 431150 - RNA, 64 nt, hsa; identical to SEQ ID NO: 246859

SEQ ID NO: 431151 - RNA, 64 nt, hsa; identical to SEQ ID NO: 246860

SEQ ID NO: 431152 - RNA, 64 nt, hsa; identical to SEQ ID NO: 246861

SEQ ID NO: 431153 - RNA, 64 nt, hsa; identical to SEQ ID NO: 246862

SEQ ID NO: 431154 - RNA, 64 nt, hsa; identical to SEQ ID NO: 246863

SEQ ID NO: 431155 - RNA, 64 nt, hsa; identical to SEQ ID NO: 246864

SEQ ID NO: 431156 - RNA, 64 nt, hsa; identical to SEQ ID NO: 246865

SEQ ID NO: 431157 - RNA, 64 nt, hsa; identical to SEQ ID NO: 246866

SEQ ID NO: 431158 - RNA, 64 nt, hsa; identical to SEQ ID NO: 246867

SEQ ID NO: 431159 - RNA, 64 nt, hsa; identical to SEQ ID NO: 246868

SEQ ID NO: 431160 - RNA, 64 nt, hsa; identical to SEQ ID NO: 246869

SEQ ID NO: 431161 - RNA, 64 nt, hsa; identical to SEQ ID NO: 246870

SEQ ID NO: 431162 - RNA, 64 nt, hsa; identical to SEQ ID NO: 246871

SEQ ID NO: 431163 - RNA, 64 nt, hsa; identical to SEQ ID NO: 246872

SEQ ID NO: 431164 - RNA, 64 nt, hsa; identical to SEQ ID NO: 246873

SEQ ID NO: 431165 - RNA, 64 nt, hsa; identical to SEQ ID NO: 246874

SEQ ID NO: 431166 - RNA, 64 nt, hsa; identical to SEQ ID NO: 246875

SEQ ID NO: 431167 - RNA, 64 nt, hsa; identical to SEQ ID NO: 246876

SEQ ID NO: 431168 - RNA, 52 nt, hsa; identical to SEQ ID NO: 246877

SEQ ID NO: 431169 - RNA, 64 nt, hsa; identical to SEQ ID NO: 246878

SEQ ID NO: 431170 - RNA, 64 nt, hsa; identical to SEQ ID NO: 246879

SEQ ID NO: 431171 - RNA, 64 nt, hsa; identical to SEQ ID NO: 246880

SEQ ID NO: 431172 - RNA, 64 nt, hsa; identical to SEQ ID NO: 246881

SEQ ID NO: 431173 - RNA, 64 nt, hsa; identical to SEQ ID NO: 246882

SEQ ID NO: 431174 - RNA, 64 nt, hsa; identical to SEQ ID NO: 246883

SEQ ID NO: 431175 - RNA, 64 nt, hsa; identical to SEQ ID NO: 246884

SEQ ID NO: 431176 - RNA, 64 nt, hsa; identical to SEQ ID NO: 246885

SEQ ID NO: 431177 - RNA, 64 nt, hsa; identical to SEQ ID NO: 246886

SEQ ID NO: 431178 - RNA, 64 nt, hsa; identical to SEQ ID NO: 246887

SEQ ID NO: 431179 - RNA, 64 nt, hsa; identical to SEQ ID NO: 246888

SEQ ID NO: 431180 - RNA, 64 nt, hsa; identical to SEQ ID NO: 246889

SEQ ID NO: 431181 - RNA, 64 nt, hsa; identical to SEQ ID NO: 246890

SEQ ID NO: 431182 - RNA, 64 nt, hsa; identical to SEQ ID NO: 246891

SEQ ID NO: 431183 - RNA, 64 nt, hsa; identical to SEQ ID NO: 246892

SEQ ID NO: 431184 - RNA, 64 nt, hsa; identical to SEQ ID NO: 246893

SEQ ID NO: 431185 - RNA, 64 nt, hsa; identical to SEQ ID NO: 246894

SEQ ID NO: 431186 - RNA, 64 nt, hsa; identical to SEQ ID NO: 246895

SEQ ID NO: 431187 - RNA, 64 nt, hsa; identical to SEQ ID NO: 246896

SEQ ID NO: 431188 - RNA, 64 nt, hsa; identical to SEQ ID NO: 246897

SEQ ID NO: 431189 - RNA, 57 nt, hsa; identical to SEQ ID NO: 246898

SEQ ID NO: 431190 - RNA, 64 nt, hsa; identical to SEQ ID NO: 246899

SEQ ID NO: 431191 - RNA, 54 nt, hsa; identical to SEQ ID NO: 246900

SEQ ID NO: 431192 - RNA, 64 nt, hsa; identical to SEQ ID NO: 246901

SEQ ID NO: 431193 - RNA, 50 nt, hsa; identical to SEQ ID NO: 313501

SEQ ID NO: 431194 - RNA, 64 nt, hsa
caccccaucggcuuccauaucuuccaggucccagaggguggaaggagccaggacgcacccccac

SEQ ID NO: 431195 - RNA, 64 nt, hsa
uuguguggggccuugcgguucagagcucuuggcgaggguggagggaggagugucauuucuaugu

SEQ ID NO: 431196 - RNA, 64 nt, hsa
auguaaaaauaaauaucgcuuagaaugcaggagaaggguggagaggaggcaggggccgaggggg

SEQ ID NO: 431197 - RNA, 64 nt, hsa
ccagccagaccagcagagcagggagccacuugccaggguggaggaggagcauuguccaggcaug

SEQ ID NO: 431198 - RNA, 64 nt, hsa
uccagcugagacaggaguccggacagaggugggcaggguggauggcuucgggcagggaaggcgg

SEQ ID NO: 431199 - RNA, 64 nt, hsa
ucagacaaguguuuuggaaagagcacccucgagaaggguggaugacagggcagagcaggaagga

SEQ ID NO: 431200 - RNA, 64 nt, hsa
gcugauggcagcuggggcuaggggaagggcuuugaggguggaaggaugggauggguuccagagg

SEQ ID NO: 431201 - RNA, 64 nt, hsa
agugggacguguuucugucauaaugcaggcaugaaggguggagugaagucaggucauaaguuuc

SEQ ID NO: 431202 - RNA, 64 nt, hsa
ucuaagugggggcuucuacaggcuuuugggaaguaggguggauguggguagggcugggaggagg

SEQ ID NO: 431203 - RNA, 64 nt, hsa
gguccaggccucuaaggcuucucucccuggagugaggguggaggugagggagagcuggcacaag

SEQ ID NO: 431204 - RNA, 64 nt, hsa
caaucuucagcaccaccucuaagaucucugagagaggguggaucagccucuguguaaacaaaaa

SEQ ID NO: 431205 - RNA, 64 nt, hsa
acugagacuguuggcuccaccuccaagcugagcuaggguggagggcagggugggcaggaaguga

SEQ ID NO: 431206 - RNA, 64 nt, hsa
cccuggcacaguguuauguggacugggccacgauaggguggagugagcuagugaagaaggcaga

SEQ ID NO: 431207 - RNA, 64 nt, hsa
aggucacagccugcugggcugggucgcguagcccaggguggaggcagaacgaugcugcuguggu

SEQ ID NO: 431208 - RNA, 64 nt, hsa
auuuacaacuaggccagggauuagccacugugggaggguggacaggcaaugguucaguggccug

SEQ ID NO: 431209 - RNA, 64 nt, hsa
accuugucaccaucaggccuuucuggcuccugauaggguggagcaaaaguggaaaggaaaggaa

SEQ ID NO: 431210 - RNA, 64 nt, hsa
guuggggcccugccagaguuaaagcagugacuggaggguggacugggggguugcagcaucuuua

SEQ ID NO: 431211 - RNA, 64 nt, hsa
cucugcaugucgggcuuaaggucaccagccgggcaggguggaaggagcuugccucuuugagaaa

SEQ ID NO: 431212 - RNA, 64 nt, hsa
cagggcaauugucagucuuuuuagagaaggggccaggguggaacaaucccagugaguaaauuau

SEQ ID NO: 431213 - RNA, 64 nt, hsa
ucgcagacccaagagcuuggcacauuuccggguuaggguggaaugggcuuugcagggaagaggg

SEQ ID NO: 431214 - RNA, 64 nt, hsa
gcucaguucucagucagacgugcagcauggcugcaggguggaccagcugccuggcauucaggcc

SEQ ID NO: 431215 - RNA, 64 nt, hsa
ccauuucauaauucucaagauuuuucuaaauacagccuuuaaauuugacucaaauggaaauugu

SEQ ID NO: 431216 - RNA, 64 nt, hsa
cuuuaagcaucuuugaugaauacucugcaaaguagccuuuaaaaaaauguaaauuuuuuaaaaa

SEQ ID NO: 431217 - RNA, 64 nt, hsa
acucagggauagcaguaccauuuuacuuccgcaagccuuuaacugcaagaugaagcugcaaagg

SEQ ID NO: 431218 - RNA, 64 nt, hsa
ucccagugagaacucucaagaccucuucccccuugccuuuaaccuuuucugcagugaucuaaga

SEQ ID NO: 431219 - RNA, 64 nt, hsa
uauuaguucccugucucuugaaaaaugcccauuugccuuuaaaaaaaaaaguuacagaaauacu

SEQ ID NO: 431220 - RNA, 64 nt, hsa
cuaugaauguacugcauguuaccaucuuacuugagccuuuaauggacuuauuucuucaaauccu

SEQ ID NO: 431221 - RNA, 64 nt, hsa
ggagagaaacuucacaugugaaccguguggcaaagccuuuaaaugguccucaacccuuaaugaa

SEQ ID NO: 431222 - RNA, 64 nt, hsa
uguaauuucuguugaaagacuucagaaaauauaggccuuuaaagugaagaagaguauucuuaag

SEQ ID NO: 431223 - RNA, 64 nt, hsa
ccuuugcauuugauuucuaaacauuccuucauaugccuuuaaugaaagccagcaauuaucccau

SEQ ID NO: 431224 - RNA, 64 nt, hsa
gaaugagguuuuaugaauauucauguuuuugaaggccuuuaauuucugucugcauauuagcuuu

SEQ ID NO: 431225 - RNA, 64 nt, hsa
ggagagaaacuacaaaugugaagaauguguuaaagccuuuaacaagucuucaacuuuuucugca

SEQ ID NO: 431226 - RNA, 64 nt, hsa
agaaaagccauacaaaugagaagaauguggcaaugccuuuaaucaguccucacaccuuucuaca

SEQ ID NO: 431227 - RNA, 64 nt, hsa
aaagaaacccuacaaauguaaaaaacguggcaaugccuuuaacugguccucacaccuugcuaca

SEQ ID NO: 431228 - RNA, 64 nt, hsa
ugaaaaauccuagaaaugugaaaaauaucacaaagccuuuaaaugguugucacacuugauugua

SEQ ID NO: 431229 - RNA, 64 nt, hsa
caauuuuugucaagagaucuuucagaaaauauaagccuuuaaagugaagaagaggagccaguug

SEQ ID NO: 431230 - RNA, 64 nt, hsa
agagaaagccuacaaaugugaagaauguggcaaagccuuuaaccaguuuucaacccuuauuaca

SEQ ID NO: 431231 - RNA, 64 nt, hsa
ggagaaaccccacaaauguggagaaugcggaaaagccuuuaacugguccucaacucuuauuaca

SEQ ID NO: 431232 - RNA, 64 nt, hsa
uggaggugauucagaaccuuuuaaagugauuuuugccuuuaaagauacagugugaaaauuugcu

SEQ ID NO: 431233 - RNA, 64 nt, hsa
auucagugaaugcagaacaaaugaagggaaaagugccuuuaaaauuaccucacugugggcugga

SEQ ID NO: 431234 - RNA, 64 nt, hsa
gaauagaauaaguacaugcugcuguaauaaaauugccuuuaaucacuuaacaagccuaaccuug

SEQ ID NO: 431235 - RNA, 64 nt, hsa
aaucaccuacaccagagagccauuuugguauuuugccuuuaaauaaaaagccuccuuuaucugg

SEQ ID NO: 431236 - RNA, 64 nt, hsa
auaaaaauauugcuaaucuucugcuuauuuuucagccuuuaaagucugaaauacuauaaaacac

SEQ ID NO: 431237 - RNA, 64 nt, hsa
agcuaauauagcuuguuuuguugaaauucugcaugccuuuaaaucacuagcaaagcaaauauua

SEQ ID NO: 431238 - RNA, 64 nt, hsa
ucaagcuuagaugagaaauuuuuuucauauacuggccuuuaaaucauuaauggacaauuggcua

SEQ ID NO: 431239 - RNA, 64 nt, hsa
ugaaagaauguauuguaaauuggcauacaauacugccuuuaauagaaaaccuaaaugcuggggc

SEQ ID NO: 431240 - RNA, 64 nt, hsa
acaaaaaccccacaagugugaaaaacauggcaaagccuuuaagaagcccucaauucuuaacaga

SEQ ID NO: 431241 - RNA, 64 nt, hsa
ugagaaauccuagaaaucugaagagugagauaaagccuuuaaaugguugucacacuucauugua

SEQ ID NO: 431242 - RNA, 64 nt, hsa
ugagaaauccuagaaaugugaagaaugugacaaagccuuuaaauggcugucacacuugauugua

SEQ ID NO: 431243 - RNA, 64 nt, hsa
agggaauuccuauaauuguguggaauguggcaaagccuuuaaccaguccuuaaggcuuacuaca

SEQ ID NO: 431244 - RNA, 64 nt, hsa
aaucaccuacaccagagagcuauuuugguauuuugccuuuaaauaaaaagccuccuccauaugg

SEQ ID NO: 431245 - RNA, 64 nt, hsa; identical to SEQ ID NO: 431234

SEQ ID NO: 431246 - RNA, 64 nt, hsa; identical to SEQ ID NO: 117515

SEQ ID NO: 431247 - RNA, 64 nt, hsa; identical to SEQ ID NO: 117516

SEQ ID NO: 431248 - RNA, 64 nt, hsa; identical to SEQ ID NO: 117517

SEQ ID NO: 431249 - RNA, 64 nt, hsa; identical to SEQ ID NO: 117518

SEQ ID NO: 431250 - RNA, 64 nt, hsa; identical to SEQ ID NO: 117519

SEQ ID NO: 431251 - RNA, 64 nt, hsa; identical to SEQ ID NO: 117520

SEQ ID NO: 431252 - RNA, 64 nt, hsa; identical to SEQ ID NO: 117521

SEQ ID NO: 431253 - RNA, 64 nt, hsa; identical to SEQ ID NO: 117522

SEQ ID NO: 431254 - RNA, 64 nt, hsa; identical to SEQ ID NO: 117523

SEQ ID NO: 431255 - RNA, 64 nt, hsa; identical to SEQ ID NO: 117524

SEQ ID NO: 431256 - RNA, 64 nt, hsa; identical to SEQ ID NO: 117525

SEQ ID NO: 431257 - RNA, 64 nt, hsa; identical to SEQ ID NO: 117526

SEQ ID NO: 431258 - RNA, 64 nt, hsa; identical to SEQ ID NO: 117527

SEQ ID NO: 431259 - RNA, 64 nt, hsa; identical to SEQ ID NO: 117528

SEQ ID NO: 431260 - RNA, 64 nt, hsa; identical to SEQ ID NO: 117529

SEQ ID NO: 431261 - RNA, 64 nt, hsa; identical to SEQ ID NO: 117530

SEQ ID NO: 431262 - RNA, 64 nt, hsa; identical to SEQ ID NO: 117531

SEQ ID NO: 431263 - RNA, 64 nt, hsa; identical to SEQ ID NO: 117532

SEQ ID NO: 431264 - RNA, 64 nt, hsa; identical to SEQ ID NO: 22031

SEQ ID NO: 431265 - RNA, 64 nt, hsa; identical to SEQ ID NO: 22032

SEQ ID NO: 431266 - RNA, 64 nt, hsa; identical to SEQ ID NO: 22033

SEQ ID NO: 431267 - RNA, 64 nt, hsa; identical to SEQ ID NO: 22034

SEQ ID NO: 431268 - RNA, 64 nt, hsa; identical to SEQ ID NO: 22035

SEQ ID NO: 431269 - RNA, 64 nt, hsa; identical to SEQ ID NO: 22036

SEQ ID NO: 431270 - RNA, 64 nt, hsa; identical to SEQ ID NO: 22037

SEQ ID NO: 431271 - RNA, 64 nt, hsa; identical to SEQ ID NO: 22038

SEQ ID NO: 431272 - RNA, 64 nt, hsa; identical to SEQ ID NO: 22039

SEQ ID NO: 431273 - RNA, 64 nt, hsa; identical to SEQ ID NO: 22040

SEQ ID NO: 431274 - RNA, 64 nt, hsa; identical to SEQ ID NO: 22041

SEQ ID NO: 431275 - RNA, 64 nt, hsa; identical to SEQ ID NO: 22042

SEQ ID NO: 431276 - RNA, 64 nt, hsa; identical to SEQ ID NO: 22043

SEQ ID NO: 431277 - RNA, 64 nt, hsa; identical to SEQ ID NO: 22044

SEQ ID NO: 431278 - RNA, 64 nt, hsa; identical to SEQ ID NO: 22045

SEQ ID NO: 431279 - RNA, 64 nt, hsa; identical to SEQ ID NO: 22046

SEQ ID NO: 431280 - RNA, 64 nt, hsa; identical to SEQ ID NO: 22047

SEQ ID NO: 431281 - RNA, 64 nt, hsa; identical to SEQ ID NO: 22048

SEQ ID NO: 431282 - RNA, 64 nt, hsa; identical to SEQ ID NO: 22049

SEQ ID NO: 431283 - RNA, 64 nt, hsa; identical to SEQ ID NO: 22050

SEQ ID NO: 431284 - RNA, 64 nt, hsa; identical to SEQ ID NO: 22051

SEQ ID NO: 431285 - RNA, 64 nt, hsa; identical to SEQ ID NO: 22052

SEQ ID NO: 431286 - RNA, 64 nt, hsa; identical to SEQ ID NO: 22053

SEQ ID NO: 431287 - RNA, 64 nt, hsa; identical to SEQ ID NO: 22054

SEQ ID NO: 431288 - RNA, 64 nt, hsa; identical to SEQ ID NO: 22055

SEQ ID NO: 431289 - RNA, 64 nt, hsa; identical to SEQ ID NO: 22056

SEQ ID NO: 431290 - RNA, 64 nt, hsa; identical to SEQ ID NO: 22057

SEQ ID NO: 431291 - RNA, 64 nt, hsa; identical to SEQ ID NO: 22058

SEQ ID NO: 431292 - RNA, 64 nt, hsa; identical to SEQ ID NO: 22059

SEQ ID NO: 431293 - RNA, 64 nt, hsa; identical to SEQ ID NO: 22060

SEQ ID NO: 431294 - RNA, 64 nt, hsa; identical to SEQ ID NO: 22061

SEQ ID NO: 431295 - RNA, 64 nt, hsa; identical to SEQ ID NO: 22062

SEQ ID NO: 431296 - RNA, 64 nt, hsa; identical to SEQ ID NO: 22063

SEQ ID NO: 431297 - RNA, 64 nt, hsa; identical to SEQ ID NO: 22064

SEQ ID NO: 431298 - RNA, 64 nt, hsa; identical to SEQ ID NO: 22065

SEQ ID NO: 431299 - RNA, 64 nt, hsa; identical to SEQ ID NO: 22066

SEQ ID NO: 431300 - RNA, 64 nt, hsa; identical to SEQ ID NO: 22067

SEQ ID NO: 431301 - RNA, 52 nt, hsa; identical to SEQ ID NO: 22068

SEQ ID NO: 431302 - RNA, 64 nt, hsa; identical to SEQ ID NO: 22069

SEQ ID NO: 431303 - RNA, 64 nt, hsa; identical to SEQ ID NO: 22070

SEQ ID NO: 431304 - RNA, 64 nt, hsa; identical to SEQ ID NO: 22071

SEQ ID NO: 431305 - RNA, 64 nt, hsa; identical to SEQ ID NO: 22072

SEQ ID NO: 431306 - RNA, 64 nt, hsa; identical to SEQ ID NO: 22073

SEQ ID NO: 431307 - RNA, 64 nt, hsa; identical to SEQ ID NO: 22074

SEQ ID NO: 431308 - RNA, 64 nt, hsa; identical to SEQ ID NO: 22075

SEQ ID NO: 431309 - RNA, 64 nt, hsa; identical to SEQ ID NO: 22076

SEQ ID NO: 431310 - RNA, 64 nt, hsa; identical to SEQ ID NO: 22077

SEQ ID NO: 431311 - RNA, 64 nt, hsa; identical to SEQ ID NO: 22078

SEQ ID NO: 431312 - RNA, 64 nt, hsa; identical to SEQ ID NO: 22079

SEQ ID NO: 431313 - RNA, 64 nt, hsa; identical to SEQ ID NO: 22080

SEQ ID NO: 431314 - RNA, 64 nt, hsa; identical to SEQ ID NO: 22081

SEQ ID NO: 431315 - RNA, 64 nt, hsa; identical to SEQ ID NO: 22082

SEQ ID NO: 431316 - RNA, 53 nt, hsa; identical to SEQ ID NO: 22083

SEQ ID NO: 431317 - RNA, 64 nt, hsa; identical to SEQ ID NO: 22084

SEQ ID NO: 431318 - RNA, 64 nt, hsa; identical to SEQ ID NO: 22085

SEQ ID NO: 431319 - RNA, 64 nt, hsa; identical to SEQ ID NO: 22086

SEQ ID NO: 431320 - RNA, 64 nt, hsa; identical to SEQ ID NO: 22087

SEQ ID NO: 431321 - RNA, 64 nt, hsa; identical to SEQ ID NO: 22088

SEQ ID NO: 431322 - RNA, 64 nt, hsa; identical to SEQ ID NO: 22089

SEQ ID NO: 431323 - RNA, 64 nt, hsa; identical to SEQ ID NO: 22090

SEQ ID NO: 431324 - RNA, 64 nt, hsa; identical to SEQ ID NO: 22091

SEQ ID NO: 431325 - RNA, 62 nt, hsa
aagauuuugaaguuuaaaaguacuuaaacuauuuggcaaagauuuguuuuuaaaaaucuauu

SEQ ID NO: 431326 - RNA, 62 nt, hsa
agagggcugguuagccggaaaaggccucgggcuuggcaaauggaagaacuugagugagaguu

SEQ ID NO: 431327 - RNA, 62 nt, hsa
cacggcgauugagaagccaaucagugaacccuuuggcaaagcccccauccacaccuggcacu

SEQ ID NO: 431328 - RNA, 62 nt, hsa
ccaguugugacaaccaaaaauaucuccagaccuuggcaaauguuaucugugggggaaaauug

SEQ ID NO: 431329 - RNA, 62 nt, hsa
uucguucgagaaacuucauuuaucuccuauaauuggcaaacuuaaaaaugcagcagaaacuu

SEQ ID NO: 431330 - RNA, 62 nt, hsa
ucagacuuuucuuuuuuucuagauuguuaaaauuggcaaaugaacuuuuuuaaaaaucaucu

SEQ ID NO: 431331 - RNA, 62 nt, hsa
uuuauugucagaauuuagacugaaacuacacauuggcaaauagcgugggauagauuuguuuc

SEQ ID NO: 431332 - RNA, 62 nt, hsa
uuguacacaaucucauuucauauguuugcauuuuggcaaagaacuuaauaaaauuguucagu

SEQ ID NO: 431333 - RNA, 62 nt, hsa
aagcuacaugccaaugauaggugcaaagaauauuggcaaaaggugcuuuaccuugagccauu

SEQ ID NO: 431334 - RNA, 62 nt, hsa
agucacucaacuuacaacuuuauuuauguggcuuggcaaaaaucacuauaaggcagcucuaa

SEQ ID NO: 431335 - RNA, 62 nt, hsa
augaaucacugagaaaaagugaaaaacuugaguuggcaaagaugcagagcagcagugcagau

SEQ ID NO: 431336 - RNA, 62 nt, hsa
cccuauugcugcuugaggcaacucaucuuagguuggcaaaaaggcaggauggccgggcgcgg

SEQ ID NO: 431337 - RNA, 62 nt, hsa
gcaagaggggguggagggguguggcagugguuuuggcaaacgcuaaagagcccuugccuccc

SEQ ID NO: 431338 - RNA, 62 nt, hsa
gucauccacuuuuucagguaaacauuuuucauuuggcaaauggcauaauuauuugaaaguga

SEQ ID NO: 431339 - RNA, 62 nt, hsa
auaacagcuugguguguagcaucugcagccacuuggcaaaugaguuuacaguauugucuccu

SEQ ID NO: 431340 - RNA, 62 nt, hsa
uggcuguaaggcauuuucaucuuuccuucggguuggcaaaauauuuuaaagguaaaacaugc

SEQ ID NO: 431341 - RNA, 62 nt, hsa
auuaaagcagggauaugcuguauuuuauaaaauuggcaaaauuagagaaauauaguucacaa

SEQ ID NO: 431342 - RNA, 62 nt, hsa
uuguugauugucuuucuucauagcuucucugcuuggcaaagagaugggagggggccagauac

SEQ ID NO: 431343 - RNA, 62 nt, hsa
aaaggcuggacuaaauggcugcagaacucccuuuggcaaaaggcaugcgcucacugcuugcu

SEQ ID NO: 431344 - RNA, 62 nt, hsa
ccuuuggggaaaaggaggccauucugggccccuuggcaaaccucaccacucacagaggcucc

SEQ ID NO: 431345 - RNA, 62 nt, hsa
aagggagagaauaagaacggcgguaacaguuauuggcaaaaagcaugaaaagagaaagcacu

SEQ ID NO: 431346 - RNA, 62 nt, hsa
gguuguccuuuuggguuaaaucuggcccuuccuuggcaaaagcaaaaauucucccugugaga

SEQ ID NO: 431347 - RNA, 62 nt, hsa
uuucuagggauuuguguggaucagauacauacuuggcaaauuuuugaguuuuacauucuuac

SEQ ID NO: 431348 - RNA, 62 nt, hsa
uucuggauauuagaucuuuguuggaugcauaguuggcaaauauuuucuaccauucuguaggu

SEQ ID NO: 431349 - RNA, 62 nt, hsa
uuuucaggaauacauuuggaaauucaaaacaauuggcaaacuuuguauuaauguguuaagug

SEQ ID NO: 431350 - RNA, 62 nt, hsa
gcuuuuaaugauaucugggauuucuguggaacuuggcaaauuuucagagcaccuucacucac

SEQ ID NO: 431351 - RNA, 62 nt, hsa
cacucauggguaauaaccaagauggagucccuuuggcaaaacuuaggcaugcacagcuguag

SEQ ID NO: 431352 - RNA, 62 nt, hsa
uagagacucguguccugagugggucugagaauuuggcaaagacuuacugguugguguucuug

SEQ ID NO: 431353 - RNA, 62 nt, hsa
agggauguccgcuauauccaaaauuacagcuauuggcaaauaaacgagauggauaaaggugu

SEQ ID NO: 431354 - RNA, 62 nt, hsa
uuaacuuaguaaacccaaauuuaggauuuacauuggcaaauuuuucagugauuuuuaacgug

SEQ ID NO: 431355 - RNA, 62 nt, hsa
caacaaaucugucugcuuccucacauuagucauuggcaaauaagcauucugucucuuuggcu

SEQ ID NO: 431356 - RNA, 62 nt, hsa
ugucacagugaacaaauccagggagcugauaauuggcaaaagaccacuuuuaccacucaggc

SEQ ID NO: 431357 - RNA, 62 nt, hsa
uguuuuaguuuggugccaaggcucaggcuguauuggcaaauucccgaaaguuuucccacuuu

SEQ ID NO: 431358 - RNA, 62 nt, hsa
guagucaucaacaauuugaccagggccuuuauuuggcaaauaacugagccaaccagaauaaa

SEQ ID NO: 431359 - RNA, 62 nt, hsa
acccaccuuccacaacucagucugcaccucaguuggcaaaggagacuggauggccaucuuuc

SEQ ID NO: 431360 - RNA, 62 nt, hsa
ugugaccuugggcuucaguuucugcaucugcauuggcaaaauagaagugauaguaguaggua

SEQ ID NO: 431361 - RNA, 62 nt, hsa
guucagggaacuacuuauuagcuguagaguccuuggcaaaucacaacauucugggccuuuua

SEQ ID NO: 431362 - RNA, 62 nt, hsa
uuagaaaugcauaaaaccucgagacaugguuuuuggcaaaaacuccaugacuuuaaacuagc

SEQ ID NO: 431363 - RNA, 62 nt, hsa
cgugcucuuuuaaaauaagcuuucucagaauguuggcaaaucacuucaauccucaaaucagu

SEQ ID NO: 431364 - RNA, 62 nt, hsa
cuauuuucaaauugugcaaugucugaauggaauuggcaaaugaggugaggagaugggguaac

SEQ ID NO: 431365 - RNA, 62 nt, hsa
aucucuguuaagaagaaguaauacgauuauuuuuggcaaaaauuucacaagacuuauuuuaa

SEQ ID NO: 431366 - RNA, 62 nt, hsa
uuuguuuuuaaguuuguuuuugacauguuuauuuggcaaauuuuauaaugaaguuuuaaguu

SEQ ID NO: 431367 - RNA, 62 nt, hsa
uuuuccuuuucauuuucauguuauuuucauuauuggcaaagaaaaucaaaauguuuauagcc

SEQ ID NO: 431368 - RNA, 62 nt, hsa
uucucaacagaugcaaaaugcaaaauaaaauauuggcaaacaauacagcaacaaauaauuua

SEQ ID NO: 431369 - RNA, 62 nt, hsa
gucaaucgaggaaugccagaugugcacgguuuuuggcaaaguagggggcacauuuccauuau

SEQ ID NO: 431370 - RNA, 62 nt, hsa
cccagaggguccccagggacucugcaguguccuuggcaaauccccacuguacucaaugcccu

SEQ ID NO: 431371 - RNA, 62 nt, hsa
uaagagacaaauuuuaacuuuuaauuuuuauuuuggcaaaacugucaaaugagaaaaaugau

SEQ ID NO: 431372 - RNA, 62 nt, hsa
aacacuuuggcuuuuucuccauucacgcugauuuggcaaaaggccagagaugggccuccuuc

SEQ ID NO: 431373 - RNA, 62 nt, hsa
gccucauguaaacccacacuggagcgauauuguuggcaaaacuuaaucaugauuguuuugua

SEQ ID NO: 431374 - RNA, 62 nt, hsa
uuauucuaaaugaguucuaaaaacauaauauuuuggcaaaaauugaaaaaagcuggagacau

SEQ ID NO: 431375 - RNA, 62 nt, hsa
uucugaaaauauguuggauagaaagucacucuuuggcaaaaguguuagaauuugcuuuugug

SEQ ID NO: 431376 - RNA, 62 nt, hsa
guuugggaaucaccaaaggcuuuuagaguucuuuggcaaaauaaaaauauuugacuaaucaa

SEQ ID NO: 431377 - RNA, 62 nt, hsa
uuguaaauucuuaaaacuuucuaaaugcauaauuggcaaaaaaaaaaacccacuguuaccag

SEQ ID NO: 431378 - RNA, 62 nt, hsa
agcauguugcugccagaauacaagcauugcuuuuggcaaauuaaagugcaugucauuucuua

SEQ ID NO: 431379 - RNA, 62 nt, hsa
aauauuuuccaaagagugauagucuuuugcuuuuggcaaaacucuacuuaauccaauggguu

SEQ ID NO: 431380 - RNA, 62 nt, hsa
auuuagaaaaaaacaacaaagcaaaaccuaucuuggcaaaaaaaggaagugagucagagccc

SEQ ID NO: 431381 - RNA, 62 nt, hsa
ucauuuggccucucugcccguggaugugagaauuggcaaacuaauguuguuugggucuaucu

SEQ ID NO: 431382 - RNA, 62 nt, hsa
gugguagagguagaaagcagcaccuuuccuaauuggcaaaugaucagacuaaugugugcuaa

SEQ ID NO: 431383 - RNA, 62 nt, hsa
cacuacuaaaaaacaguguggaauagacauuauuggcaaaauugcucaucccuaauccugaa

SEQ ID NO: 431384 - RNA, 62 nt, hsa
uaaaaaccaguuaauucuauuuuucaagguuuuuggcaaagcacaucaauguuagacuaguu

SEQ ID NO: 431385 - RNA, 62 nt, hsa
gggcaaagcagacauuuuaguauacagagugauuggcaaauauuuucaagauuuaauaugag

SEQ ID NO: 431386 - RNA, 62 nt, hsa
uuguuuggucaguacuguuagcucauuugaaguuggcaaaaacaaauacaaacaagcaaaaa

SEQ ID NO: 431387 - RNA, 62 nt, hsa
acuggucugucuuuggauaauaggaauucaauuuggcaaaacaaaauguaaugucagacuuu

SEQ ID NO: 431388 - RNA, 62 nt, hsa
acuucagaccaacuucauacuaauggaacauuuuggcaaauguauauucagauguacacuaa

SEQ ID NO: 431389 - RNA, 62 nt, hsa
aaggagaagaguauuuuuaacacuuaaauuucuuggcaaauuuuaaaacauuuuuuagucug

SEQ ID NO: 431390 - RNA, 62 nt, hsa
gggccccucucucgggggaaccggacagcagcuuggcaaaggccucccuaaaaggccgcauu

SEQ ID NO: 431391 - RNA, 62 nt, hsa
agagaaucaagaaauaauaagguauaacaagcuuggcaaaguguuggcuuuuuaaaaaaaaa

SEQ ID NO: 431392 - RNA, 62 nt, hsa
auaaguucaguauuuccgaaucagacaucgccuuggcaaagacacuaaagcguuacacuuua

SEQ ID NO: 431393 - RNA, 62 nt, hsa
gcaucuuugccgcugugcucuucgcagacuguuuggcaaaaggugcuuugaccucauccccc

SEQ ID NO: 431394 - RNA, 62 nt, hsa
aacguuucacauuaaauggugugaagcguuguuuggcaaaccaacagcuuuggcuucuggug

SEQ ID NO: 431395 - RNA, 62 nt, hsa
auguuuggagacauaaugaaagcgauuaacauuuggcaaaauauaauaaagccuuuuuguaa

SEQ ID NO: 431396 - RNA, 62 nt, hsa
aaaaaaaaaaacauguauuuuagaguucaucuuuggcaaaaucuuugguucaggguacuagu

SEQ ID NO: 431397 - RNA, 62 nt, hsa
aucaaaguggcaaaaauaaaaaaaaucaaguauuggcaaagauguggggaaaauucucauaa

SEQ ID NO: 431398 - RNA, 62 nt, hsa
aaauuuaauaucccuuuggccuguuuuagauuuuggcaaagccaggcccauagugcuugcug

SEQ ID NO: 431399 - RNA, 62 nt, hsa
cccuugcccuucucuugcuuugucaugcucgcuuggcaaaaccucaucucugacuaaaugca

SEQ ID NO: 431400 - RNA, 62 nt, hsa
auagggccuaguacagaaggugcacacaaauguuggcaaagucaaaaccccaugaauuaaaa

SEQ ID NO: 431401 - RNA, 62 nt, hsa
cuuugcaucuuuugugucuuucuuaucaugauuuggcaaaaugcaucaccuuugaaaauauu

SEQ ID NO: 431402 - RNA, 62 nt, hsa
aaagaacagauuuuauauuucuuccucuaaucuuggcaaaugaccuuuaccuuuuggaaaga

SEQ ID NO: 431403 - RNA, 62 nt, hsa
ccaaaccugacacugucuugcugcauucuccuuuggcaaacaucagggucagaauucaggau

SEQ ID NO: 431404 - RNA, 62 nt, hsa
gccaccucugucauuuguugugaugucuuuucuuggcaaaagccuuguguauauuuguauau

SEQ ID NO: 431405 - RNA, 62 nt, hsa
gagaaaaaggggacaccuaguuugguugucauuuggcaaaggagaugacuuaaaauccgcuu

SEQ ID NO: 431406 - RNA, 62 nt, hsa
uagaaauaggaagaugcaaaggaacaaugguguuggcaaagucuucuuugaauaucagggac

SEQ ID NO: 431407 - RNA, 62 nt, hsa
gauguaucuguacauagaccauuugccuuauauuggcaaauguaaguuguuucuaugaaaca

SEQ ID NO: 431408 - RNA, 62 nt, hsa
aaugcacagggcagcccagggagaucacaccuuuggcaaaguccagacaaggcccacugcag

SEQ ID NO: 431409 - RNA, 62 nt, hsa
aauuucuugaagugauuuaucuaaaauaaagguuggcaaacuuuuucuguaaagggccagau

SEQ ID NO: 431410 - RNA, 62 nt, hsa
aauuuccuuucgcuuucauuauuuuucuuuuuuuggcaaaggcuugguacccaaggugcggu

SEQ ID NO: 431411 - RNA, 62 nt, hsa
aaaaagauauaaacuauaacuguccguuacuuuuggcaaaagauacaaccacauaauguaua

SEQ ID NO: 431412 - RNA, 62 nt, hsa
aaauagcguuuuugguuuuaucucauauuuucuuggcaaaauugagagaaauuaggaacacu

SEQ ID NO: 431413 - RNA, 62 nt, hsa
acauuuuaucauguuucuuuugaauauaugaauuggcaaaggacuugaugaaacugaguacu

SEQ ID NO: 431414 - RNA, 62 nt, hsa
caaguguaauagaaauuauguagcuccuuauguuggcaaaggagcucuauauaguuucacuu

SEQ ID NO: 431415 - RNA, 62 nt, hsa
uaaaguuaggaaagggaguaggcaggcauguguuggcaaaggcuguuaauaguaguuaagug

SEQ ID NO: 431416 - RNA, 62 nt, hsa
uguucuuacauaggcauugcucuaguuugucuuuggcaaaaaaaaaaaaaaaaaaaaguaaa

SEQ ID NO: 431417 - RNA, 62 nt, hsa
uauuacguuuguauaguaaguuuguaaacugcuuggcaaacugauuaagaaauaauuugcaa

SEQ ID NO: 431418 - RNA, 62 nt, hsa
uuaaagugguuuuaaaggggucuaaaaagauuuuggcaaaacauauuugcagauguagauua

SEQ ID NO: 431419 - RNA, 62 nt, hsa
gaaccugugaaaugcuuuaccuuguuuacaguuuggcaaaguugcaguuuguucuuguuuuu

SEQ ID NO: 431420 - RNA, 62 nt, hsa
aauacuucagugagauuaaguauaaacaguuuuuggcaaaaaacaacacagucuacucuuuc

SEQ ID NO: 431421 - RNA, 62 nt, hsa
agaauaaaagaugauuucucaaaaauagcugauuggcaaaauaucgucaucuugacaauauu

SEQ ID NO: 431422 - RNA, 62 nt, hsa
ugauuacuuuggucauacuauuuaccaaauuguuggcaaacuugauguaaccuuauauggug

SEQ ID NO: 431423 - RNA, 62 nt, hsa
aucuaaaauauuuuuaaauguauguauuuuaauuggcaaauaauacuuguauauauuguuua

SEQ ID NO: 431424 - RNA, 62 nt, hsa
uuuuaucuucccuaggaaaaaagaacugagcauuggcaaaaagcugaggaugacaagcuuag

SEQ ID NO: 431425 - RNA, 62 nt, hsa
gcguuuuagaggacuuggcauaaaaugaaagauuggcaaaggcccuugaggggcuuggggau

SEQ ID NO: 431426 - RNA, 62 nt, hsa
ccuccccauuuuagcugacuuucccagggucguuggcaaauuuuuuguucugucuuuuccuu

SEQ ID NO: 431427 - RNA, 62 nt, hsa
aguaacugcaggacaugauuauugaggcuugauuggcaaauacgacuucuacauccauauuc

SEQ ID NO: 431428 - RNA, 62 nt, hsa
acuauauuaagcagcccagccuuuaaaaguuuuuggcaaaaacucuuugccauuuuugguug

SEQ ID NO: 431429 - RNA, 62 nt, hsa
gcuuccagcucuuaaaauucuuuaucuuuuucuuggcaaaaccagaauuaagaguguaagau

SEQ ID NO: 431430 - RNA, 62 nt, hsa
ucuuuccccacccccaucacagggcuuucaguuuggcaaaggaaaagcagauaaaaacagaa

SEQ ID NO: 431431 - RNA, 62 nt, hsa
gccuuuaagccuuuuuuuucuuuuuuuuuuuuuuggcaaaugaauguaccauuucaacuuug

SEQ ID NO: 431432 - RNA, 62 nt, hsa
agaaacaaaacuucagauuucagaauuuguuauuggcaaaauuuauucucauuauaccugcu

SEQ ID NO: 431433 - RNA, 62 nt, hsa
gaauguuuuauugucauuaugugaaaccaauauuggcaaauaguacuuuaaugaugaaguaa

SEQ ID NO: 431434 - RNA, 62 nt, hsa
uguauguuggaacgugccccagaaugaggcaguuggcaaacuucucaggacaaugaauccuu

SEQ ID NO: 431435 - RNA, 62 nt, hsa
cccccauuauuuggccaggaauugagcuuggcuuggcaaaguuccuuuuacccuguucuguu

SEQ ID NO: 431436 - RNA, 62 nt, hsa
caagaaaaggaauuuuccuguuaaauuaaacauuggcaaaaggaaauggaauaguauaaaca

SEQ ID NO: 431437 - RNA, 62 nt, hsa
aagaaaaagaggaaauauauauauuuuuaaguuuggcaaaauccugaguaguguaguccuau

SEQ ID NO: 431438 - RNA, 60 nt, hsa
ucacaggacagcgucgcugaagcuccacuguuggcaaagucuuggcagugguacauuauu

SEQ ID NO: 431439 - RNA, 62 nt, hsa
acggggauguuccacacaaacuuaaauuacuguuggcaaaacaauagggggagauuagacaa

SEQ ID NO: 431440 - RNA, 62 nt, hsa
cacaauucccuuucccuuaggauagggcuauauuggcaaaaugccgcccgaacagacugcug

SEQ ID NO: 431441 - RNA, 62 nt, hsa
cucugccaaauaccuuaauuggugaugccuucuuggcaaagaguacaccacuguaagauauu

SEQ ID NO: 431442 - RNA, 62 nt, hsa
aaaacgucaauuuauauugaacuuggaggaguuuggcaaagucugaauaggucaaccugcag

SEQ ID NO: 431443 - RNA, 62 nt, hsa
aaaauuuagcuacuuucaaaugagacuugaauuuggcaaauuucuaagauggacauucauau

SEQ ID NO: 431444 - RNA, 62 nt, hsa
uucuuuugaauacuuaaugacagaacaaauacuuggcaaacuccuuugcucugcugucaucc

SEQ ID NO: 431445 - RNA, 62 nt, hsa
agaaugagaauuaaagagaaaacaaaagaaucuuggcaaaauuuucccucugaaauuacaaa

SEQ ID NO: 431446 - RNA, 62 nt, hsa
aauacccugucuuuaaaaauaaaagcuauuacuuggcaaauucugagguaaguguaugaucu

SEQ ID NO: 431447 - RNA, 62 nt, hsa
ugucauagggagcccuuugcacuccucguguguuggcaaacgcaguuaauaaagcaguguuu

SEQ ID NO: 431448 - RNA, 62 nt, hsa
aguaaugaauuaaagcaacaaaaagauauugauuggcaaaaagcaagauauaagagauucau

SEQ ID NO: 431449 - RNA, 62 nt, hsa
ccccuugcucccuucaaugcuagaaaaucgaguuggcaaaaugggguuugggccccucagag

SEQ ID NO: 431450 - RNA, 62 nt, hsa
acauuucuguguagguuugggaauauaguuacuuggcaaagucuuucaggaaggaagcccuu

SEQ ID NO: 431451 - RNA, 62 nt, hsa
gguuucauuuugcuuugggcuuacuuagaguuuuggcaaaugcagaguuauguaacgaaccc

SEQ ID NO: 431452 - RNA, 62 nt, hsa
uggagugaacacaauuauguaccaaauuuaacuuggcaaacuuucuauugccugucccaugu

SEQ ID NO: 431453 - RNA, 62 nt, hsa
ucuauuuuaagaaucauauuuuaggauuauuuuuggcaaauacagugagcacuuauguaacc

SEQ ID NO: 431454 - RNA, 62 nt, hsa
agagaaugaagauauauuuuaaaauucuggauuuggcaaaauuuaggcuagucuuuacuuuu

SEQ ID NO: 431455 - RNA, 62 nt, hsa
ucuauuuuacgauuguagaauucuuagaguuuuuggcaaauuuaaaauuuguuuuuuuccau

SEQ ID NO: 431456 - RNA, 62 nt, hsa
cuaucuagcaacccuaacaguaagaaaucuuguuggcaaaucagaugcagcuguuuuaacua

SEQ ID NO: 431457 - RNA, 62 nt, hsa
caucucuuaccaaccuuuacccaacuccuggguuggcaaacagcugaccaaacugccaucac

SEQ ID NO: 431458 - RNA, 62 nt, hsa
uucccagaaaaaaaaaaacuuacacuugggacuuggcaaauuccuagucacaauuuuuuuca

SEQ ID NO: 431459 - RNA, 62 nt, hsa
ugaaauaaaaagugagcaaguaauagauuuucuuggcaaaucuaaugauucagcccacagga

SEQ ID NO: 431460 - RNA, 62 nt, hsa
uauuauauggacucuuuaaaaugauugacagauuggcaaauucuuaaaucuuuguacauugu

SEQ ID NO: 431461 - RNA, 62 nt, hsa
agcaaucccucagcauuguuuuucucagcuucuuggcaaaaauuaaaacaacaacaacaaca

SEQ ID NO: 431462 - RNA, 62 nt, hsa
gcuuccucauuccuugucuugauaaaguggaauuggcaaacuagaauuuaguuuguacucag

SEQ ID NO: 431463 - RNA, 62 nt, hsa
uugugauaaaauguuuuagauuugugcacccauuggcaaaacaggaaaguuuccagauaggu

SEQ ID NO: 431464 - RNA, 62 nt, hsa
uaaacaauguggucuaauuuagugucucucccuuggcaaauguaaguuuucuaaguuggcca

SEQ ID NO: 431465 - RNA, 62 nt, hsa
cauggacuagaaaaggaccauuagaucagggguuggcaaacuauggcccacgaaucaaaccu

SEQ ID NO: 431466 - RNA, 62 nt, hsa
ugcgcguucuaagacuuuuggcggagacuuucuuggcaaaacccauuccccaaagcuacgcu

SEQ ID NO: 431467 - RNA, 62 nt, hsa
guauuuggguuacagucaaccuauuuggauacuuggcaaaagauucuugcugucagcauaua

SEQ ID NO: 431468 - RNA, 62 nt, hsa
uuuuugaaauuuaaaagcuuauauuuucuaacuuggcaaaagacuuauccuuagaaagagaa

SEQ ID NO: 431469 - RNA, 62 nt, hsa
acuuaauauauaauuuacuguauaaaguaauuuuggcaaaauauaagugauuuuuuucugga

SEQ ID NO: 431470 - RNA, 62 nt, hsa
aaugggaauauaauauugucucuuuuuuaaguuuggcaaacagaauguucauacugaugugu

SEQ ID NO: 431471 - RNA, 62 nt, hsa
uagguccuaaaagucaagguacuucaguuuauuuggcaaacaugacaacauuuuuuuuggcc

SEQ ID NO: 431472 - RNA, 62 nt, hsa
uauauuuugauauuaggugguucuacacauaguuggcaaaaugacuugguaaauuuguaaug

SEQ ID NO: 431473 - RNA, 62 nt, hsa
uuuuuuaauuuuauuauuauuaauuuuuuuuguuggcaaaagaaucucaggaacggcccugg

SEQ ID NO: 431474 - RNA, 62 nt, hsa
cccaggacuagagcacaacauaauuuuuauuuuuggcaaagccagaaaaagaucuuucauuu

SEQ ID NO: 431475 - RNA, 62 nt, hsa
gccggucaugagccacgauaaaaaaugccaguuuggcaaacucagcacuccuguucccugcu

SEQ ID NO: 431476 - RNA, 62 nt, hsa
uaacaauaaaaaaaguaucaauaaaauaauuauuggcaaauaaauuggugaguugaagcagc

SEQ ID NO: 431477 - RNA, 62 nt, hsa
aagacaguuccaucuuccuuuagacuccagccuuggcaaaaucaccuucccuuuaccaggga

SEQ ID NO: 431478 - RNA, 62 nt, hsa
uccauacugaaaaaaugcugagccagccaucuuuggcaaaggucccugagcucuugcuaucu

SEQ ID NO: 431479 - RNA, 62 nt, hsa
aagugaugcucaucacuuccacucacaucucauuggcaaaagcuggucauuuugccacacuu

SEQ ID NO: 431480 - RNA, 62 nt, hsa
uuuuuuuggucuuaaaagcuuaacauguaaaauuggcaaaaaaaauuuuuuaccuuuuauaa

SEQ ID NO: 431481 - RNA, 62 nt, hsa
uuucuccagugcucaacuguuagauauuaaucuuggcaaacugcuuaaucuuguggauuuug

SEQ ID NO: 431482 - RNA, 62 nt, hsa
ugucuaauguauuucaaaaucacccaaaacuuuuggcaaauaaaagcauuuaaaaagaccuu

SEQ ID NO: 431483 - RNA, 62 nt, hsa
caaaugggugugacgcgguuccagauguggauuuggcaaaaccucauuuaaguaaaagguua

SEQ ID NO: 431484 - RNA, 62 nt, hsa
gcugauuuuuauuucuuugggggcuuuuuuucuuggcaaauacuaaaaaucucgucaaugua

SEQ ID NO: 431485 - RNA, 62 nt, hsa
cguauuaaguaaugucuuucccucuugcuucuuuggcaaauguugauacacaguguuuggac

SEQ ID NO: 431486 - RNA, 62 nt, hsa
aaaauugcuacuuuuucacuuuggauuuguuuuuggcaaaauuuuagucuaaacagacaucu

SEQ ID NO: 431487 - RNA, 62 nt, hsa
uacuugagauccugguaauuggucauaaauaauuggcaaaauaacaaauugugaaaauagaa

SEQ ID NO: 431488 - RNA, 62 nt, hsa
uugaaaagaaauggacuuaaaguaucucuguuuuggcaaaauucagguucaggggcuggaug

SEQ ID NO: 431489 - RNA, 62 nt, hsa
cacaguagauaaugaaagaguccuccagugucuuggcaaaauguucuaguauagcuggauac

SEQ ID NO: 431490 - RNA, 62 nt, hsa
aaggaacuguguagccagcagggaccuaaacuuuggcaaaaagugaacacaauucaaauacg

SEQ ID NO: 431491 - RNA, 62 nt, hsa
uacuguuuuaaguauuuagguugcaauuaacuuuggcaaagucagucgacauaagcccugug

SEQ ID NO: 431492 - RNA, 62 nt, hsa
cccucaaacuugcauuccacuauauuuauuuuuuggcaaaagaugagcuguauuuguuugaa

SEQ ID NO: 431493 - RNA, 62 nt, hsa
auauagugccauugaaauagacugaaauuaucuuggcaaaaguuagacaaccaaagacgacu

SEQ ID NO: 431494 - RNA, 62 nt, hsa
aagagaagggcuuacaggcauggacaugcagguuggcaaacgggcuugacuuuggcugauuu

SEQ ID NO: 431495 - RNA, 62 nt, hsa
cucugcaggaaauggcuguggaguguggcaguuuggcaaacucuccaccacacguaaugaaa

SEQ ID NO: 431496 - RNA, 62 nt, hsa
aguuuugccuaauggcaaaaccagccaucccauuggcaaaagagucaacaguaucuguguuu

SEQ ID NO: 431497 - RNA, 62 nt, hsa
cuaugaaugauuuugagccuuuuuuuuuaagcuuggcaaacaucccagcuaaucaaaauagu

SEQ ID NO: 431498 - RNA, 62 nt, hsa
aaaaaaggagcaaagaaugcauaagcuauguguuggcaaaaguaauuuauauuaaaauuuug

SEQ ID NO: 431499 - RNA, 62 nt, hsa
ugauccauuguaucaguaccucacaaucagaguuggcaaaugauggaugagugauucaagca

SEQ ID NO: 431500 - RNA, 62 nt, hsa
gcaagccacacgggcagucacagagggcacccuuggcaaaccuuuauaguccuggccagacc

SEQ ID NO: 431501 - RNA, 62 nt, hsa
uugccuugucuuaaaguuucugaguccuaauuuuggcaaaauaaauaacuuaugguaaucug

SEQ ID NO: 431502 - RNA, 62 nt, hsa
acacgcccuucaaaaccuguugaauaauuugauuggcaaauacuaucugucaccaagucccu

SEQ ID NO: 431503 - RNA, 62 nt, hsa
uuacacuguacuuucugccacacacugccuuguuggcaaaguauccaucuugucuaucuccc

SEQ ID NO: 431504 - RNA, 62 nt, hsa
uucaucauagaggcccggggcugguccgaugguuggcaaaacuugacuccggcccagucccc

SEQ ID NO: 431505 - RNA, 62 nt, hsa
ucagaaauaccaaccauaaaaauguaaucuaguuggcaaaggugugcgcuaaaacacggaac

SEQ ID NO: 431506 - RNA, 62 nt, hsa
ggccacaaaaaugccauaaugccuguugguauuuggcaaagcacugacccguguccuccguu

SEQ ID NO: 431507 - RNA, 62 nt, hsa
aauuacgucaucacccagcugauuccgggugguuggcaaacucaucgugucuguccugagag

SEQ ID NO: 431508 - RNA, 62 nt, hsa
agggcuagcucggcuuaagggaacucuccccauuggcaaaccggacccggccgccgccagga

SEQ ID NO: 431509 - RNA, 62 nt, hsa
agccaaaauauuaacuuuaaugaaacauugacuuggcaaaugaauuuccuauaaauuaucau

SEQ ID NO: 431510 - RNA, 62 nt, hsa
uguugaucuugaaauaucucaggauagcacuuuuggcaaacucuuagccaaggcuucuucau

SEQ ID NO: 431511 - RNA, 62 nt, hsa
aaaaucuacuuuuugguguacaguucugaguuuuggcaaaugcagucaagucacuaccacca

SEQ ID NO: 431512 - RNA, 62 nt, hsa
cuuccuauguuuguaaaauauuuaagaaaaaauuggcaaacaauuaaugcuuaauauuuugg

SEQ ID NO: 431513 - RNA, 62 nt, hsa
gugaaggggcuggauugggcguggugaggauguuggcaaaccagugcaugcaccugguugga

SEQ ID NO: 431514 - RNA, 62 nt, hsa
uacucaccucacucucaacagcuuauugguauuuggcaaaccugguauccugcagccgagca

SEQ ID NO: 431515 - RNA, 60 nt, hsa
uuuuuugacaguucuguugaguuggaagaauuggcaaaauaucuggaccauuaagaaaac

SEQ ID NO: 431516 - RNA, 62 nt, hsa
uccaguuuauugauuucacaauagggguuaaauuggcaaacauucauauuuuuacuucauuu

SEQ ID NO: 431517 - RNA, 62 nt, hsa
uaacaaaaaaacacuuuucuaaggacugaagauuggcaaaaacuaaaauaaauuaaaacugc

SEQ ID NO: 431518 - RNA, 62 nt, hsa
cccucccacacagaaaguguuagauagggaaauuggcaaaaagaauaguuaagucaggaaug

SEQ ID NO: 431519 - RNA, 62 nt, hsa
aauuuuuaaaaauuauuaucaggggagaaaaauuggcaaaacuauuauauguaagggaaaua

SEQ ID NO: 431520 - RNA, 62 nt, hsa
agugugauguguguuauccuaggaaaugagaguuggcaaacaacuucucauuuugaauagag

SEQ ID NO: 431521 - RNA, 62 nt, hsa
acucuuggugcuacaaaacccugaccagacacuuggcaaauuuaccucuuucuucaaaagaa

SEQ ID NO: 431522 - RNA, 62 nt, hsa
cuauuugcuuuaaguuguauguauuucugaacuuggcaaaauuggaaauuaaaauuuuuaaa

SEQ ID NO: 431523 - RNA, 62 nt, hsa
gcguuguauuugauaccccucccccccuuuuuuuggcaaaggaggggaaaggaagguuuaaa

SEQ ID NO: 431524 - RNA, 62 nt, hsa
aaagccuacuuucaaguaaauauagcauuccuuuggcaaaaagaaaaaaaaaguaaaagaaa

SEQ ID NO: 431525 - RNA, 62 nt, hsa
acuuucacaaacauugggaacuaaauuuagaauuggcaaaagucuagaagauggguaucaaa

SEQ ID NO: 431526 - RNA, 62 nt, hsa
uguuuguuuaccugucuugggcuuuguugcuuuuggcaaaagguacuucaaacaagggaggg

SEQ ID NO: 431527 - RNA, 62 nt, hsa
cucggacucuugaagaaucucuuuagauuuuguuggcaaaagccuuauagaagcaguaagag

SEQ ID NO: 431528 - RNA, 62 nt, hsa
uuaaggcaaaaaccauccagcagacuuuaauuuuggcaaacauuuuagaagcuugugaacac

SEQ ID NO: 431529 - RNA, 62 nt, hsa
gugcaucucuuguuggacauaggcaaaauaacuuggcaaacuuaguucuggugauuucuuga

SEQ ID NO: 431530 - RNA, 62 nt, hsa
auaacugcuuuguuugcaagauuaaauuaguguuggcaaaauaaaguucuaaagauaauacu

SEQ ID NO: 431531 - RNA, 62 nt, hsa
ugcaugguguagaacuuucuccaauagucacauuggcaaagggagaacuggggugggcgggg

SEQ ID NO: 431532 - RNA, 62 nt, hsa
uuuaucaugugcaucuguaucacaggaguauuuuggcaaaaugauucuguaccaaaaaggag

SEQ ID NO: 431533 - RNA, 62 nt, hsa
cuuacagauuuuuuuugaauuugugaaaguuuuuggcaaaaaugcaaauaagguuauguuag

SEQ ID NO: 431534 - RNA, 62 nt, hsa
agggugccucugcauguccuccaaggcaaaguuuggcaaacuguggcccccccacugucaua

SEQ ID NO: 431535 - RNA, 62 nt, hsa; identical to SEQ ID NO: 431534

SEQ ID NO: 431536 - RNA, 62 nt, hsa
ccuugggcaagacauugggcucuaggaugcaauuggcaaauacguccccguuacucaaaucc

SEQ ID NO: 431537 - RNA, 62 nt, hsa
aucauggauggaaggccauuuguacaugucccuuggcaaaauucuuucuggugucuccuaac

SEQ ID NO: 431538 - RNA, 62 nt, hsa
agcuagagcagguccugccagcacccagcaacuuggcaaagcaaccaggguaggggagaacc

SEQ ID NO: 431539 - RNA, 62 nt, hsa
cuccauaaggaggggccaaauugggaggccuuuuggcaaacagugucuauuuuacagagagg

SEQ ID NO: 431540 - RNA, 62 nt, hsa
ggaaaacgaacuaagacagacgcuaggccauguuggcaaaguagcaucuuggugacuaaggu

SEQ ID NO: 431541 - RNA, 62 nt, hsa
uggugguaacagugguagagucauguuugcacuuggcaaaaagaaucccaauguuugacaaa

SEQ ID NO: 431542 - RNA, 62 nt, hsa
auccauauuuauacuaucgcagaaguaagcauuuggcaaacguucagccauuagcacucauu

SEQ ID NO: 431543 - RNA, 62 nt, hsa
auguuauuauguaauuaggacacauuuaaaauuuggcaaauaaugcauauaaugaaaucaau

SEQ ID NO: 431544 - RNA, 62 nt, hsa
ccucacagauuuuuuugaauuugugaaaguuuuuggcaaaacuacaaauaggauuauguuag

SEQ ID NO: 431545 - RNA, 62 nt, hsa
ggggguaggaaaaugacugauuguugggcccuuuggcaaaagcuggugccugguaaguagaa

SEQ ID NO: 431546 - RNA, 62 nt, hsa
ucugaggcuggccgucuuucgggguguuccuuuuggcaaauauacacuguaaucuugagucu

SEQ ID NO: 431547 - RNA, 62 nt, hsa
uuuaagucuguauaaaggaggagaguuacugauuggcaaaaaagauuggcacaaagcaugaa

SEQ ID NO: 431548 - RNA, 62 nt, hsa
auaggauagucugaccuucuagcauagucuuuuuggcaaaugauuuguguuuucagugugug

SEQ ID NO: 431549 - RNA, 62 nt, hsa
gggccuauuggguuacauaagugacuuuuuguuuggcaaauguuacuccuguauugaguaag

SEQ ID NO: 431550 - RNA, 62 nt, hsa
gcuaggucagagcuuagugauucacacugaaauuggcaaauuggauuuaacccaauuaauag

SEQ ID NO: 431551 - RNA, 62 nt, hsa
auuucugcugccagucacaaucuaaauuaauuuuggcaaaagauuggguacuuaguuuccug

SEQ ID NO: 431552 - RNA, 62 nt, hsa
aaugcuaggugaaaucuaggaggaaggcauacuuggcaaaccacauguauaauaugcuacuu

SEQ ID NO: 431553 - RNA, 62 nt, hsa
guacaucauauuggaaggguuaaccuguuacuuuggcaaaugaguauuuuuuugcuagcacc

SEQ ID NO: 431554 - RNA, 62 nt, hsa
auaagagaagaagccaauggaaaugaaagagauuggcaaaggggaaggaugaugccauguag

SEQ ID NO: 431555 - RNA, 62 nt, hsa
agggacucagggauggggacugccaggggcaguuggcaaaaguccaaguagagauuacaccc

SEQ ID NO: 431556 - RNA, 62 nt, hsa
uaggccugucccuugccucugcccuggauugguuggcaaacuaaaggacuugauguacauaa

SEQ ID NO: 431557 - RNA, 62 nt, hsa
ucaucauaagaacuuuauauaaaggcauuacauuggcaaauaagguuuggaagcagaagagc

SEQ ID NO: 431558 - RNA, 62 nt, hsa
caguacagggcaggagcugcugugguguucccuuggcaaaugaaaguuuuauuuucguuugg

SEQ ID NO: 431559 - RNA, 62 nt, hsa
uguucuaaauuuucaaggaucuaaaccagggauuggcaaacguuuuuccagggaguaaauau

SEQ ID NO: 431560 - RNA, 62 nt, hsa
uaaaaccuugaguaucuuuucagaccuuuuucuuggcaaaugaauccauauugacauauuug

SEQ ID NO: 431561 - RNA, 62 nt, hsa
uguagaccacaucaggguggggugggggucacuuggcaaaaagggccgaggucuggugaugu

SEQ ID NO: 431562 - RNA, 62 nt, hsa
uaacuuuguguucccagguccuagcucaggaguuggcaaauaagaauuaaaugucugcuaca

SEQ ID NO: 431563 - RNA, 62 nt, hsa
aaaucuugaccauagaaaaauacagucauucauuggcaaagauguacaguggugguuuagug

SEQ ID NO: 431564 - RNA, 62 nt, hsa
uaaggcuuggagcaagagagaauuugugucuauuggcaaagaacuaagccaggaagacaugg

SEQ ID NO: 431565 - RNA, 62 nt, hsa
caacuacuuggugcguaauuguuuccuaguaauuggcaaaggcuccuuguaagauuucacug

SEQ ID NO: 431566 - RNA, 62 nt, hsa
gggaucuacugauugcgggcucugcaagacccuuggcaaacuggcuucugauccauaucaua

SEQ ID NO: 431567 - RNA, 62 nt, hsa
aacaguaauaacuucuugaaaauccaauaaaauuggcaaaagauugugaaaauucuggaaga

SEQ ID NO: 431568 - RNA, 62 nt, hsa
cuccacaugcagggaguggcacuuccaaaaaauuggcaaagcggaaugcggcggccaaaaug

SEQ ID NO: 431569 - RNA, 62 nt, hsa
aaccuuucccagacucccaagaagagaagagauuggcaaauggggcuccugggcccaguccu

SEQ ID NO: 431570 - RNA, 62 nt, hsa
gggagguuaugcaguugagaaaagagaugucauuggcaaagcuggguuauuucaaagaggaa

SEQ ID NO: 431571 - RNA, 62 nt, hsa
auucaucuuguaucauuauaggcagaagguauuuggcaaauuuuuauguauuguuuuaugua

SEQ ID NO: 431572 - RNA, 62 nt, hsa
guugcaacuuagguggggguuggagucgaaaguuggcaaauggggccaaggcugcacaaagu

SEQ ID NO: 431573 - RNA, 62 nt, hsa
guagugguagauuucuccacaggauagcgcaauuggcaaaucaugcuugguuguguuaggcc

SEQ ID NO: 431574 - RNA, 62 nt, hsa
uaaaacagaucccuucugccccauauuccgucuuggcaaaauaguggagaacgcaggacaca

SEQ ID NO: 431575 - RNA, 62 nt, hsa
cacacuggcagugaauuuuuugugcuacaaacuuggcaaaagucugugaaaagaaguuucaa

SEQ ID NO: 431576 - RNA, 62 nt, hsa
ugucaggcuacacauaaaagccacuucaaagauuggcaaaaaaugguuacagguauucugcu

SEQ ID NO: 431577 - RNA, 62 nt, hsa
uaaaacauuaaaauucaaauaauuauaagcauuuggcaaaaacaagagaaaagaaacuugcc

SEQ ID NO: 431578 - RNA, 62 nt, hsa
cuguuagaggccaacaauucuaguauggcuuguuggcaaagagugcuacaccguuucaauga

SEQ ID NO: 431579 - RNA, 62 nt, hsa
ugcagaaccucaccucuaguugagaccaagaauuggcaaauuugcaugagcuccuggaaaga

SEQ ID NO: 431580 - RNA, 62 nt, hsa
augucuugccaugaauuucaaaauauaagacauuggcaaagccuccuacagaaucaucaaag

SEQ ID NO: 431581 - RNA, 62 nt, hsa
gguuucugugaagaaccauuucccauguuuucuuggcaaaauaaugcuguauuccauaugua

SEQ ID NO: 431582 - RNA, 62 nt, hsa
ugcaggcacaagccaccaugccuggcuguuuuuuggcaaaucuugauugugauaagcccccc

SEQ ID NO: 431583 - RNA, 62 nt, hsa
auccugugagcacuacucugaagguuuguguuuuggcaaaucuuuuuucuuuuuugagacag

SEQ ID NO: 431584 - RNA, 62 nt, hsa
uaaguuuauacuauauaauuucuuaaugaacauuggcaaauagaguagcuaagagauugaca

SEQ ID NO: 431585 - RNA, 62 nt, hsa
cugagaucuggugucagaguucucugcuccuguuggcaaaucgcaccuuaucugaacauuug

SEQ ID NO: 431586 - RNA, 62 nt, hsa
gcucacagaaucccaguagcacaaauugggcuuuggcaaaucguguauuuuguguauagaag

SEQ ID NO: 431587 - RNA, 62 nt, hsa
aaacgccuacaaaccuccaugugguagcuccuuuggcaaauguccugcuguggcguuuuaug

SEQ ID NO: 431588 - RNA, 62 nt, hsa
acaguaccuuccuuucuagaaacaauuuuagauuggcaaaagugcaauguuuucuucacuca

SEQ ID NO: 431589 - RNA, 62 nt, hsa
auuuccagaauuuuuuuuuuuuuuuuuuuuuuuuggcaaauguuuacauucaauuaagggga

SEQ ID NO: 431590 - RNA, 62 nt, hsa
uucuuuugccacaucccuauagaccacuggguuuggcaaaacucaggcagaaguggagaccu

SEQ ID NO: 431591 - RNA, 62 nt, hsa
ucuaucuuguaaauauuguuuugcauugucuguuggcaaauuugugaacugucaugauacgc

SEQ ID NO: 431592 - RNA, 62 nt, hsa
aguuacaucuuaagugaccuacaggguauauguuggcaaaagcagacuguguauaugucuua

SEQ ID NO: 431593 - RNA, 62 nt, hsa
uuuuucuaagccuauaugaaaugaaaaauauauuggcaaaauaaauguuuaaaccuuuuacg

SEQ ID NO: 431594 - RNA, 62 nt, hsa
ggaaaaacauaauucuuucaaacgguguguauuuggcaaagagcucuucaaaucugggagag

SEQ ID NO: 431595 - RNA, 62 nt, hsa
ccagugucuuuuaauuucuucuucuuuuccuuuuggcaaagcagauauaacccucagcaugc

SEQ ID NO: 431596 - RNA, 62 nt, hsa
aggacaggccugcugacaaggcugagucuaccuuggcaaagaccaagauauuuuuucccggg

SEQ ID NO: 431597 - RNA, 62 nt, hsa
aggacaggccugcugacaaggcugagucuaccuuggcaaagaccaagauauuuuuuccuggg

SEQ ID NO: 431598 - RNA, 62 nt, hsa
auucagguguuguuuacagacuaacaaauguguuggcaaaucccugguuagaugcacuuccu

SEQ ID NO: 431599 - RNA, 62 nt, hsa
gauguggauuauuguuagaaucugcaacuucauuggcaaauuauuucaaguauuuuucuaua

SEQ ID NO: 431600 - RNA, 62 nt, hsa
cuagugcaguuacccccucucaguaauuauguuuggcaaauaugaaauacaaggaucuggca

SEQ ID NO: 431601 - RNA, 62 nt, hsa
acacccaguucugaauaacuugaagaacaggcuuggcaaagaaguaaguuuauccaaaucuu

SEQ ID NO: 431602 - RNA, 62 nt, hsa
caauuucugucuggccuuuugucucauccuucuuggcaaaaguagcuuuugaacugauauaa

SEQ ID NO: 431603 - RNA, 62 nt, hsa
uuaacaaaaaggacuuuucuaaggacugaagauuggcaaaaacgaaaagcuucuuccuccaa

SEQ ID NO: 431604 - RNA, 62 nt, hsa
ucuggugcagaggguuaacagcauaacccuuguuggcaaaauggaauagauguuaagaccuc

SEQ ID NO: 431605 - RNA, 62 nt, hsa
ccugagacuugccauaagaaacugcugaguacuuggcaaacccuuucauaguuuuguucucc

SEQ ID NO: 431606 - RNA, 62 nt, hsa
cuuaacuugagaccuucccuucaaaucuaaaauuggcaaaaagucacuuaaaauaguggacu

SEQ ID NO: 431607 - RNA, 62 nt, hsa
agauaggaugggaaagcuaacaaauuaaaguuuuggcaaaaaggaauauauguaaauagcua

SEQ ID NO: 431608 - RNA, 62 nt, hsa
agccaccauguucaaccaucugucaugacuguuuggcaaauggaaaccgcuggagaaacaaa

SEQ ID NO: 431609 - RNA, 62 nt, hsa
accauacugagauccuuuuuaaaacugucagauuggcaaagaucaaaaagcuuguuaagacu

SEQ ID NO: 431610 - RNA, 62 nt, hsa
cucagccgcaaaauucuuuaugaauuuuacacuuggcaaauguuaaugacggaagccauagu

SEQ ID NO: 431611 - RNA, 62 nt, hsa
ucaaggcugucugaugcagaugauugcauuuuuuggcaaauuuuagaagcauuuauugcuuu

SEQ ID NO: 431612 - RNA, 62 nt, hsa
uugugaaagcgcccuucuuauguuaggaggccuuggcaaaauuggauuucuucaaaaauaca

SEQ ID NO: 431613 - RNA, 62 nt, hsa
auuaaauugcucacaagguaaaauuguauuguuuggcaaaaucacaaguaacaauccuguga

SEQ ID NO: 431614 - RNA, 59 nt, hsa
uaccaaagcugcugauuugaagaaccucuuuggcaaauauggaaagguacauucuuuuu

SEQ ID NO: 431615 - RNA, 62 nt, hsa
ugcgccauuuuuuacuuaaugcagcuguuaaauuggcaaagcucuaaaaugcacugcugcca

SEQ ID NO: 431616 - RNA, 62 nt, hsa
agcaauuccaugaguaaugcuaucguuacuucuuggcaaagaacucccgugacucaucgagg

SEQ ID NO: 431617 - RNA, 62 nt, hsa
uugcacacuaguagagaauagagucuaugccuuuggcaaauuuaacugggaguuuggauucc

SEQ ID NO: 431618 - RNA, 62 nt, hsa
ccccuucgcuccugugucuugcaauggcagccuuggcaaacgcuaaaugaaaaucgugacaa

SEQ ID NO: 431619 - RNA, 62 nt, hsa
auguaaaggcuucauccuuuguauguaaccauuuggcaaaaguaugcaggaacauaaaauaa

SEQ ID NO: 431620 - RNA, 62 nt, hsa
gauaucagaggcuaaauuuugaaauaaaauauuuggcaaauuccuccacauuagugucaaug

SEQ ID NO: 431621 - RNA, 62 nt, hsa
uuaguuguaugucaucucuucucuagcaggaauuggcaaacuuuuuuguaaagggguagaaa

SEQ ID NO: 431622 - RNA, 62 nt, hsa
ucagguucuguccugaaagcuuugccucuuucuuggcaaaguuucugguauggucaagcuug

SEQ ID NO: 431623 - RNA, 62 nt, hsa
auuagucagacuaaaguuuucacuguguuuguuuggcaaaacaaauuaaacaaaaaguaagg

SEQ ID NO: 431624 - RNA, 62 nt, hsa
uagcauuccuccaccucaggccuuggguagauuuggcaaaagaacaggagcagcauaggcug

SEQ ID NO: 431625 - RNA, 62 nt, hsa
gaaccagaaccaacugcucaggcucacaaaaguuggcaaaaugcgggcugggcaggcagcuc

SEQ ID NO: 431626 - RNA, 62 nt, hsa
ccuucauuucagguuacucguucuucagcaaguuggcaaaacagacaucaugcuggugagug

SEQ ID NO: 431627 - RNA, 62 nt, hsa
uuuugggaagaauccaguauuauccacaauuauuggcaaaguuuaaauguauuuuacauaac

SEQ ID NO: 431628 - RNA, 62 nt, hsa
aaaugcuuacuuugcuucccagagucagagaauuggcaaagguuccuaaaugguaaucuggc

SEQ ID NO: 431629 - RNA, 62 nt, hsa
auaagaauucccauugcccagccucagugcauuuggcaaaugcuuacuuugcuucccagagu

SEQ ID NO: 431630 - RNA, 62 nt, hsa
uuucagcaaagaauuuugggggguuuuguguguuggcaaaagagcuacucagaaauggacaa

SEQ ID NO: 431631 - RNA, 62 nt, hsa
gaguaacuugcuugaggucacacagcuggcuguuggcaaagcugggauuagaacccucaacc

SEQ ID NO: 431632 - RNA, 62 nt, hsa
uggcgagggagaugacuccuuguagcugauacuuggcaaaagugucacugaaagacaagcua

SEQ ID NO: 431633 - RNA, 62 nt, hsa
cgguucagaacagcaaccaaauaaaacugaacuuggcaaaaaagaacuuugccgagaaaauu

SEQ ID NO: 431634 - RNA, 62 nt, hsa
uuccuuccccccaguaaggcuggaagaggcucuuggcaaacuucuuagugcaagcaaugguu

SEQ ID NO: 431635 - RNA, 62 nt, hsa
caaaccauaacagaaaaaaauaagacccaauauuggcaaagagacuacugaaaaaacauucc

SEQ ID NO: 431636 - RNA, 62 nt, hsa
gucugagugggaaacauccuggauuuuguuacuuggcaaacagcugguguaaaccuacagcc

SEQ ID NO: 431637 - RNA, 62 nt, hsa
agaauuuuucucuuaacucagcuuuugcuacuuuggcaaaaacuagcgagggguagcagaaa

SEQ ID NO: 431638 - RNA, 62 nt, hsa
acagaauguuuaaaagaaaaacucugcuagucuuggcaaacauuuggccaugugaggcaugu

SEQ ID NO: 431639 - RNA, 62 nt, hsa
acccaccuauugcuggacuucuguuguacaaguuggcaaacacuggcuggaacugggcugca

SEQ ID NO: 431640 - RNA, 62 nt, hsa
agaacuaggacugaacuauuuuaaauaaaauauuggcaaaagaauauagagcaucaaaaaau

SEQ ID NO: 431641 - RNA, 62 nt, hsa
uggggagggagaugacuccuuguagcugauacuuggcaaaagugucacugagaggcaagcua

SEQ ID NO: 431642 - RNA, 60 nt, hsa
ucccuuuuaaccuccuaauaaauaucauuuccuuggcaaagcagaugccuuuuucauuug

SEQ ID NO: 431643 - RNA, 62 nt, hsa
auagcuuaaaugacugcaguaaccagguaauauuggcaaaggcaucucaggaacaucaccuu

SEQ ID NO: 431644 - RNA, 62 nt, hsa
uuucuugucacacaccugagcacuuccucccguuggcaaacagaaguucaggaugagacccu

SEQ ID NO: 431645 - RNA, 62 nt, hsa
acacuccaguugcagaccaucgcacaccaaauuuggcaaaacagcccucagacugucaggca

SEQ ID NO: 431646 - RNA, 62 nt, hsa
cggugagggagaugacuccuuguagcugacauuuggcaaaagcgucacugaaaggcaagcua

SEQ ID NO: 431647 - RNA, 62 nt, hsa
acugucuggauugccugcugcaaagcuuugauuuggcaaaggagaccauggaagaaucaugg

SEQ ID NO: 431648 - RNA, 62 nt, hsa
uauugguuccauccaacaccugaaaagcaaauuuggcaaagacuaccugcuggagaugaagc

SEQ ID NO: 431649 - RNA, 62 nt, hsa
cuaacuuuuuacuuguuuaagcuuugccucaguuggcaaacuucauuuuaugugccauuuug

SEQ ID NO: 431650 - RNA, 62 nt, hsa
aagacauuuuuccugauauguagagcagucuguuggcaaaaaugcauauauuuucuuucaua

SEQ ID NO: 431651 - RNA, 62 nt, hsa
ggcuuagcuucugcccagcuuuauugcugcuauuggcaaagagcacaggacucagcccucgu

SEQ ID NO: 431652 - RNA, 62 nt, hsa
cggugccuucuagucuuuugauaauuaaaccuuuggcaaaacucgaauguuugguuagcaac

SEQ ID NO: 431653 - RNA, 62 nt, hsa
auguggaaguuaacccuuaccaaaaaaggaaguuggcaaaaacagccuucuagcacacuuuu

SEQ ID NO: 431654 - RNA, 62 nt, hsa
acaaggaagucagcucuuucacuuuuuacaaguuggcaaaaacagacuuccggggaauuucg

SEQ ID NO: 431655 - RNA, 62 nt, hsa
cuuuaccacuuugcuuauuuuuaaaaaauuuauuggcaaaacuggggauuuuguuuguaacu

SEQ ID NO: 431656 - RNA, 62 nt, hsa
uuuuaugagcaaucccuuaugcauagacuaccuuggcaaaagagcauuagcaagugucacug

SEQ ID NO: 431657 - RNA, 62 nt, hsa
ccuugcagauaaaaucuggggggauuuuugcauuggcaaagucaaugcggguuggggaacga

SEQ ID NO: 431658 - RNA, 62 nt, hsa
gaauaaauacaauuuaaaagucagaaaucaguuuggcaaaguguacuuucuuaauuucuauu

SEQ ID NO: 431659 - RNA, 62 nt, hsa
cugggccccugucgucaggaccuccugaggcuuuggcaaauaaaccuccuaaaaugauacaa

SEQ ID NO: 431660 - RNA, 62 nt, hsa
cuucagucuuggauuacaucaaguuuauaauuuuggcaaauuguuaagacacugugaaguca

SEQ ID NO: 431661 - RNA, 62 nt, hsa
cacauuuaacuacuguaaggagaggagcggcguuggcaaaugugaaccaugagaauaucagu

SEQ ID NO: 431662 - RNA, 62 nt, hsa
agcauuuauacuugagaagaaauguacaaauauuggcaaaguaaaaaauccauuaacaccug

SEQ ID NO: 431663 - RNA, 62 nt, hsa
uucucauaauuccaccucugccuaugugguguuuggcaaaacaugccccugugccuugguuu

SEQ ID NO: 431664 - RNA, 62 nt, hsa
uccuaauauaaaaacaguaaaagcuuaugcauuuggcaaagucucggaucagggucuacggg

SEQ ID NO: 431665 - RNA, 62 nt, hsa
ugauuaagaaaugggucuugaguccugugcuguuggcaaagugccaggcacaguuggggagg

SEQ ID NO: 431666 - RNA, 62 nt, hsa
uucacuguucgucugcugucugugucuucuauuuggcaaacagcaaugaucuuccaauaaaa

SEQ ID NO: 431667 - RNA, 62 nt, hsa
ccucaaaggaaagaaaacagggcaugcgcuuguuggcaaaacgcagggccggcucccaaaaa

SEQ ID NO: 431668 - RNA, 62 nt, hsa
ccagaaaccccucccuuccccacauggaggccuuggcaaauguuaauuuuccuagaaaaucc

SEQ ID NO: 431669 - RNA, 62 nt, hsa
ucuguuuacauguuguuuauugaggagguguuuuggcaaaaaaguuuuguuuuguuuuuuuc

SEQ ID NO: 431670 - RNA, 62 nt, hsa
uuuggauuaaaauauucuagcaaaagaaauaauuggcaaagagagcuggaaacuaaauuggc

SEQ ID NO: 431671 - RNA, 62 nt, hsa
auacaaaagaaaaaugaggaugaauaacaaguuuggcaaaaugaugguaaccuaagucuugg

SEQ ID NO: 431672 - RNA, 62 nt, hsa
ggccucucccucccucccucccucucugucccuuggcaaauggacaccaggggcuucucccc

SEQ ID NO: 431673 - RNA, 62 nt, hsa
uguaggaaacccaaccuucuugucauugaaauuuggcaaagcugacuuugggaaagagggac

SEQ ID NO: 431674 - RNA, 62 nt, hsa
gaguuugaauuuuuuggucuucuccugguuuuuuggcaaauuaggggggcccggggcucaag

SEQ ID NO: 431675 - RNA, 62 nt, hsa
aauaucagagaauuuaaugaaggaaagaagccuuggcaaaaugauggaugagagcuuucugu

SEQ ID NO: 431676 - RNA, 62 nt, hsa
uaauucacaccauaaagauugugaagugguuauuggcaaacguuuguaaaugugaccaugua

SEQ ID NO: 431677 - RNA, 62 nt, hsa
aauuauuucuuauuggggagauuacagguaguuuggcaaagcauugaaguacaaagguacau

SEQ ID NO: 431678 - RNA, 62 nt, hsa
augcuuaaaauacuguaaauaugcagugagguuuggcaaaaucuauuccaugugugauuugc

SEQ ID NO: 431679 - RNA, 62 nt, hsa
caacccugagaaaggguccagccacuacccuguuggcaaacauucccuuccauggucagccu

SEQ ID NO: 431680 - RNA, 62 nt, hsa
aucgcagugauaguugacuuuggauacaagguuuggcaaaaaaaaaaauauuaacaaaauau

SEQ ID NO: 431681 - RNA, 62 nt, hsa
agaugggugacuggggacccuucuuaaaaccuuuggcaaaggugccaucggcagggcuuggc

SEQ ID NO: 431682 - RNA, 62 nt, hsa
uugccagaggcuuuucauuaguuuuguuuugauuggcaaauacuauuguggaaagaacauau

SEQ ID NO: 431683 - RNA, 62 nt, hsa
uaacacuuaagggagacaaaggcuguguccauuuggcaaaacuuccuuggccacgagacucu

SEQ ID NO: 431684 - RNA, 62 nt, hsa
gcguuuuuauuagcgguccugaguaauuucccuuggcaaaauucccaguuuugccacucucu

SEQ ID NO: 431685 - RNA, 62 nt, hsa
uugcugcuuuuucugcgcuucaguaacaaguguuggcaaacgagacuuucuccuggccccug

SEQ ID NO: 431686 - RNA, 62 nt, hsa
auguugccauaauuaccaucaaguacacacuguuggcaaaaggcuaacaccugacuuuagaa

SEQ ID NO: 431687 - RNA, 62 nt, hsa
cauuucguuuauuuuauuuuuguaauagucaguuggcaaagcaaacugauuuuuuagacuau

SEQ ID NO: 431688 - RNA, 62 nt, hsa
agccaccagagagcuacauuuuaaaggcugucuuggcaaaaauacuccauuugggaacucac

SEQ ID NO: 431689 - RNA, 62 nt, hsa
agcagucagaagaccuggucgucgucuugacuuuggcaaaugagccggagccccuugggcag

SEQ ID NO: 431690 - RNA, 62 nt, hsa
ugggcuugcccucccuuggcguccgucacccuuuggcaaauauagaauauuucacauucuca

SEQ ID NO: 431691 - RNA, 62 nt, hsa
cuuauuuuuguuauccgagaccuuugcaaacauuggcaaauagcaucaauuaccuacuguau

SEQ ID NO: 431692 - RNA, 62 nt, hsa
aagugcaugggggacccugugcaucugugcauuuggcaaaaugucuuaacaaaucagaucag

SEQ ID NO: 431693 - RNA, 62 nt, hsa
accagcuaaucaucucuguugcacauguuuaauuggcaaaaagcaauucaugauaaauaaaa

SEQ ID NO: 431694 - RNA, 62 nt, hsa
ccaaaaccaucaccauguaccauguguuagaguuggcaaaaugugauugacuagagauggac

SEQ ID NO: 431695 - RNA, 62 nt, hsa
cacagaccugucuccugggugcauccuuagccuuggcaaaauaaacuucuccauugaucgag

SEQ ID NO: 431696 - RNA, 62 nt, hsa
ucccagggcaggggacaggccaccaaggaccuuuggcaaaugaagguuuacauuucuguagu

SEQ ID NO: 431697 - RNA, 62 nt, hsa
uacaaaucaguaacaugaagaacacucaaaaauuggcaaaugucaucaguguuuuaaacaga

SEQ ID NO: 431698 - RNA, 62 nt, hsa
uggucugaugggcaugaagcaucucagacuccuuggcaaaaaacggaguccgcaggccgcag

SEQ ID NO: 431699 - RNA, 62 nt, hsa
uccugagucugugucacaguguguccucaaccuuggcaaaauaaacuuucuaaauuaacuga

SEQ ID NO: 431700 - RNA, 62 nt, hsa
ccugaggcugugucacuggcauguccuuaaccuuggcaaaauaaacuuucuaaauugaaacc

SEQ ID NO: 431701 - RNA, 62 nt, hsa
ucaaagagcucuuggccaucccucaccaaacuuuggcaaaagaugguguuaguccccuucuc

SEQ ID NO: 431702 - RNA, 62 nt, hsa
aaaagcaacucuuugccaccuacucugcccuuuuggcaaaguuaccuugaacaaagaaucuu

SEQ ID NO: 431703 - RNA, 62 nt, hsa
augccuaggcaggaggagggcuuccugccuguuuggcaaagucccaggcagaggccaaggau

SEQ ID NO: 431704 - RNA, 62 nt, hsa
cguggaguuguacugcuuccaguuccugcccuuuggcaaaggccucaucaagaagugccgga

SEQ ID NO: 431705 - RNA, 62 nt, hsa
auuuuuguuuuuaaauuauuuauauuacugaauuggcaaaauuacaguucacacugcagagc

SEQ ID NO: 431706 - RNA, 62 nt, hsa
aacugcccccccagcccugacauguucuuuuuuuggcaaacauacauaauguuacaucauac

SEQ ID NO: 431707 - RNA, 62 nt, hsa
gguagcuggggagcccuauugcugcuaagucauuggcaaagugacaaagcaauuuacugaug

SEQ ID NO: 431708 - RNA, 62 nt, hsa
gugagcuugugugcuuuuggagagaauguugauuggcaaaagcagcacaguauuaauauuua

SEQ ID NO: 431709 - RNA, 62 nt, hsa
auuagggauucuauuugaguugcguuuaucuguuggcaaaaauaucuuuuucaaggcaucag

SEQ ID NO: 431710 - RNA, 62 nt, hsa
uuaaaacauuugaacuugccuaguuagugugguuggcaaauuuaggagcuuguucccauugc

SEQ ID NO: 431711 - RNA, 62 nt, hsa
uagauauucagagagaagaacaaauggcuggcuuggcaaauccccaucugagauaaaguaaa

SEQ ID NO: 431712 - RNA, 62 nt, hsa
gaaucacauacagugcugcuggcuuuuugugcuuggcaaaugagugacaauagaagaaauaa

SEQ ID NO: 431713 - RNA, 62 nt, hsa
cucagcaccuggauggacucccacuguuugcuuuggcaaaugccgaggaguccucgguagac

SEQ ID NO: 431714 - RNA, 62 nt, hsa
aauucacaacuuagcauuuugccaucugaagcuuggcaaacuaguaucugcuguaaaacaac

SEQ ID NO: 431715 - RNA, 62 nt, hsa
cacguaccacuggugguacugugugccauaauuuggcaaaugcuggccuuuauggacgagca

SEQ ID NO: 431716 - RNA, 62 nt, hsa
ugcuauucugguucuaaguacauauuagucccuuggcaaaucuguucuuucaaagcauaccu

SEQ ID NO: 431717 - RNA, 62 nt, hsa
acauucaugaagacugaagccccacaguggaauuggcaaacccacugcagccccugagagga

SEQ ID NO: 431718 - RNA, 62 nt, hsa
cuuagggauucugauuucaaagacauaaagaauuggcaaaacucuucuuacagaacuuaaaa

SEQ ID NO: 431719 - RNA, 62 nt, hsa
cauuaaccccuaauucacucuucuuaaauagcuuggcaaauaagacuuuaccuuuaaaugaa

SEQ ID NO: 431720 - RNA, 62 nt, hsa
uaaaaaucaggccaaaaaucaggccaaaugacuuggcaaauaauugacaaagugguuuucac

SEQ ID NO: 431721 - RNA, 62 nt, hsa
aaauucccuuaaauuuguauggcacuggaacuuuggcaaagcacuuuugacaaguugugucu

SEQ ID NO: 431722 - RNA, 62 nt, hsa
aaaaaaaaaauaaaagguauucccagguauguuuggcaaaauaaaauaaagguaauuaaaaa

SEQ ID NO: 431723 - RNA, 64 nt, hsa; identical to SEQ ID NO: 189259

SEQ ID NO: 431724 - RNA, 64 nt, hsa; identical to SEQ ID NO: 189260

SEQ ID NO: 431725 - RNA, 64 nt, hsa; identical to SEQ ID NO: 189261

SEQ ID NO: 431726 - RNA, 64 nt, hsa; identical to SEQ ID NO: 189262

SEQ ID NO: 431727 - RNA, 56 nt, hsa; identical to SEQ ID NO: 189263

SEQ ID NO: 431728 - RNA, 64 nt, hsa; identical to SEQ ID NO: 189264

SEQ ID NO: 431729 - RNA, 64 nt, hsa; identical to SEQ ID NO: 189265

SEQ ID NO: 431730 - RNA, 64 nt, hsa; identical to SEQ ID NO: 189266

SEQ ID NO: 431731 - RNA, 64 nt, hsa; identical to SEQ ID NO: 189267

SEQ ID NO: 431732 - RNA, 64 nt, hsa; identical to SEQ ID NO: 189268

SEQ ID NO: 431733 - RNA, 64 nt, hsa; identical to SEQ ID NO: 189269

SEQ ID NO: 431734 - RNA, 64 nt, hsa; identical to SEQ ID NO: 189270

SEQ ID NO: 431735 - RNA, 64 nt, hsa; identical to SEQ ID NO: 189271

SEQ ID NO: 431736 - RNA, 64 nt, hsa; identical to SEQ ID NO: 189272

SEQ ID NO: 431737 - RNA, 64 nt, hsa; identical to SEQ ID NO: 189273

SEQ ID NO: 431738 - RNA, 64 nt, hsa; identical to SEQ ID NO: 189274

SEQ ID NO: 431739 - RNA, 64 nt, hsa; identical to SEQ ID NO: 189275

SEQ ID NO: 431740 - RNA, 64 nt, hsa; identical to SEQ ID NO: 189276

SEQ ID NO: 431741 - RNA, 64 nt, hsa; identical to SEQ ID NO: 189277

SEQ ID NO: 431742 - RNA, 64 nt, hsa; identical to SEQ ID NO: 189278

SEQ ID NO: 431743 - RNA, 64 nt, hsa; identical to SEQ ID NO: 189279

SEQ ID NO: 431744 - RNA, 64 nt, hsa; identical to SEQ ID NO: 189280

SEQ ID NO: 431745 - RNA, 64 nt, hsa; identical to SEQ ID NO: 156991

SEQ ID NO: 431746 - RNA, 64 nt, hsa; identical to SEQ ID NO: 156992

SEQ ID NO: 431747 - RNA, 64 nt, hsa; identical to SEQ ID NO: 156993

SEQ ID NO: 431748 - RNA, 64 nt, hsa; identical to SEQ ID NO: 156994

SEQ ID NO: 431749 - RNA, 64 nt, hsa; identical to SEQ ID NO: 156995

SEQ ID NO: 431750 - RNA, 64 nt, hsa; identical to SEQ ID NO: 156996

SEQ ID NO: 431751 - RNA, 64 nt, hsa; identical to SEQ ID NO: 156997

SEQ ID NO: 431752 - RNA, 64 nt, hsa; identical to SEQ ID NO: 156998

SEQ ID NO: 431753 - RNA, 64 nt, hsa; identical to SEQ ID NO: 156999

SEQ ID NO: 431754 - RNA, 64 nt, hsa; identical to SEQ ID NO: 157000

SEQ ID NO: 431755 - RNA, 64 nt, hsa; identical to SEQ ID NO: 157001

SEQ ID NO: 431756 - RNA, 64 nt, hsa; identical to SEQ ID NO: 157002

SEQ ID NO: 431757 - RNA, 64 nt, hsa; identical to SEQ ID NO: 157003

SEQ ID NO: 431758 - RNA, 64 nt, hsa; identical to SEQ ID NO: 157004

SEQ ID NO: 431759 - RNA, 64 nt, hsa; identical to SEQ ID NO: 157005

SEQ ID NO: 431760 - RNA, 64 nt, hsa; identical to SEQ ID NO: 157006

SEQ ID NO: 431761 - RNA, 64 nt, hsa; identical to SEQ ID NO: 157007

SEQ ID NO: 431762 - RNA, 64 nt, hsa; identical to SEQ ID NO: 157008

SEQ ID NO: 431763 - RNA, 64 nt, hsa; identical to SEQ ID NO: 157009

SEQ ID NO: 431764 - RNA, 64 nt, hsa; identical to SEQ ID NO: 157010

SEQ ID NO: 431765 - RNA, 64 nt, hsa; identical to SEQ ID NO: 157011

SEQ ID NO: 431766 - RNA, 64 nt, hsa; identical to SEQ ID NO: 157012

SEQ ID NO: 431767 - RNA, 64 nt, hsa; identical to SEQ ID NO: 157013

SEQ ID NO: 431768 - RNA, 64 nt, hsa; identical to SEQ ID NO: 157014

SEQ ID NO: 431769 - RNA, 64 nt, hsa; identical to SEQ ID NO: 157015

SEQ ID NO: 431770 - RNA, 64 nt, hsa; identical to SEQ ID NO: 157016

SEQ ID NO: 431771 - RNA, 64 nt, hsa; identical to SEQ ID NO: 157017

SEQ ID NO: 431772 - RNA, 64 nt, hsa; identical to SEQ ID NO: 157018

SEQ ID NO: 431773 - RNA, 64 nt, hsa; identical to SEQ ID NO: 157019

SEQ ID NO: 431774 - RNA, 64 nt, hsa; identical to SEQ ID NO: 157020

SEQ ID NO: 431775 - RNA, 64 nt, hsa; identical to SEQ ID NO: 157021

SEQ ID NO: 431776 - RNA, 64 nt, hsa; identical to SEQ ID NO: 157022

SEQ ID NO: 431777 - RNA, 64 nt, hsa; identical to SEQ ID NO: 157023

SEQ ID NO: 431778 - RNA, 64 nt, hsa; identical to SEQ ID NO: 157024

SEQ ID NO: 431779 - RNA, 64 nt, hsa; identical to SEQ ID NO: 157025

SEQ ID NO: 431780 - RNA, 64 nt, hsa; identical to SEQ ID NO: 157026

SEQ ID NO: 431781 - RNA, 64 nt, hsa; identical to SEQ ID NO: 157027

SEQ ID NO: 431782 - RNA, 64 nt, hsa; identical to SEQ ID NO: 157028

SEQ ID NO: 431783 - RNA, 64 nt, hsa; identical to SEQ ID NO: 157029

SEQ ID NO: 431784 - RNA, 64 nt, hsa; identical to SEQ ID NO: 157030

SEQ ID NO: 431785 - RNA, 64 nt, hsa; identical to SEQ ID NO: 157031

SEQ ID NO: 431786 - RNA, 64 nt, hsa; identical to SEQ ID NO: 157032

SEQ ID NO: 431787 - RNA, 64 nt, hsa; identical to SEQ ID NO: 157033

SEQ ID NO: 431788 - RNA, 64 nt, hsa; identical to SEQ ID NO: 157034

SEQ ID NO: 431789 - RNA, 64 nt, hsa; identical to SEQ ID NO: 157035

SEQ ID NO: 431790 - RNA, 64 nt, hsa; identical to SEQ ID NO: 157036

SEQ ID NO: 431791 - RNA, 64 nt, hsa; identical to SEQ ID NO: 157037

SEQ ID NO: 431792 - RNA, 64 nt, hsa; identical to SEQ ID NO: 157038

SEQ ID NO: 431793 - RNA, 64 nt, hsa; identical to SEQ ID NO: 157039

SEQ ID NO: 431794 - RNA, 64 nt, hsa; identical to SEQ ID NO: 157040

SEQ ID NO: 431795 - RNA, 64 nt, hsa; identical to SEQ ID NO: 157041

SEQ ID NO: 431796 - RNA, 64 nt, hsa; identical to SEQ ID NO: 157042

SEQ ID NO: 431797 - RNA, 64 nt, hsa; identical to SEQ ID NO: 157043

SEQ ID NO: 431798 - RNA, 64 nt, hsa; identical to SEQ ID NO: 157044

SEQ ID NO: 431799 - RNA, 64 nt, hsa; identical to SEQ ID NO: 157045

SEQ ID NO: 431800 - RNA, 64 nt, hsa; identical to SEQ ID NO: 157046

SEQ ID NO: 431801 - RNA, 64 nt, hsa; identical to SEQ ID NO: 157047

SEQ ID NO: 431802 - RNA, 64 nt, hsa; identical to SEQ ID NO: 157048

SEQ ID NO: 431803 - RNA, 64 nt, hsa; identical to SEQ ID NO: 157049

SEQ ID NO: 431804 - RNA, 64 nt, hsa; identical to SEQ ID NO: 157050

SEQ ID NO: 431805 - RNA, 64 nt, hsa; identical to SEQ ID NO: 157051

SEQ ID NO: 431806 - RNA, 64 nt, hsa; identical to SEQ ID NO: 157052

SEQ ID NO: 431807 - RNA, 64 nt, hsa; identical to SEQ ID NO: 157053

SEQ ID NO: 431808 - RNA, 64 nt, hsa; identical to SEQ ID NO: 157054

SEQ ID NO: 431809 - RNA, 64 nt, hsa; identical to SEQ ID NO: 157055

SEQ ID NO: 431810 - RNA, 64 nt, hsa; identical to SEQ ID NO: 157056

SEQ ID NO: 431811 - RNA, 64 nt, hsa; identical to SEQ ID NO: 157057

SEQ ID NO: 431812 - RNA, 64 nt, hsa; identical to SEQ ID NO: 157058

SEQ ID NO: 431813 - RNA, 64 nt, hsa; identical to SEQ ID NO: 157059

SEQ ID NO: 431814 - RNA, 64 nt, hsa; identical to SEQ ID NO: 157060

SEQ ID NO: 431815 - RNA, 64 nt, hsa; identical to SEQ ID NO: 157061

SEQ ID NO: 431816 - RNA, 64 nt, hsa; identical to SEQ ID NO: 157062

SEQ ID NO: 431817 - RNA, 64 nt, hsa; identical to SEQ ID NO: 157063

SEQ ID NO: 431818 - RNA, 64 nt, hsa; identical to SEQ ID NO: 157064

SEQ ID NO: 431819 - RNA, 64 nt, hsa; identical to SEQ ID NO: 157065

SEQ ID NO: 431820 - RNA, 64 nt, hsa; identical to SEQ ID NO: 157066

SEQ ID NO: 431821 - RNA, 64 nt, hsa; identical to SEQ ID NO: 157067

SEQ ID NO: 431822 - RNA, 64 nt, hsa; identical to SEQ ID NO: 157068

SEQ ID NO: 431823 - RNA, 64 nt, hsa; identical to SEQ ID NO: 157069

SEQ ID NO: 431824 - RNA, 64 nt, hsa; identical to SEQ ID NO: 157070

SEQ ID NO: 431825 - RNA, 64 nt, hsa; identical to SEQ ID NO: 157071

SEQ ID NO: 431826 - RNA, 64 nt, hsa; identical to SEQ ID NO: 157072

SEQ ID NO: 431827 - RNA, 64 nt, hsa; identical to SEQ ID NO: 157073

SEQ ID NO: 431828 - RNA, 64 nt, hsa; identical to SEQ ID NO: 157074

SEQ ID NO: 431829 - RNA, 64 nt, hsa; identical to SEQ ID NO: 157075

SEQ ID NO: 431830 - RNA, 64 nt, hsa; identical to SEQ ID NO: 157076

SEQ ID NO: 431831 - RNA, 64 nt, hsa; identical to SEQ ID NO: 157077

SEQ ID NO: 431832 - RNA, 64 nt, hsa; identical to SEQ ID NO: 157078

SEQ ID NO: 431833 - RNA, 64 nt, hsa; identical to SEQ ID NO: 157079

SEQ ID NO: 431834 - RNA, 64 nt, hsa; identical to SEQ ID NO: 157080

SEQ ID NO: 431835 - RNA, 64 nt, hsa; identical to SEQ ID NO: 157081

SEQ ID NO: 431836 - RNA, 64 nt, hsa; identical to SEQ ID NO: 157082

SEQ ID NO: 431837 - RNA, 64 nt, hsa; identical to SEQ ID NO: 157083

SEQ ID NO: 431838 - RNA, 64 nt, hsa; identical to SEQ ID NO: 157084

SEQ ID NO: 431839 - RNA, 64 nt, hsa; identical to SEQ ID NO: 157085

SEQ ID NO: 431840 - RNA, 64 nt, hsa; identical to SEQ ID NO: 157086

SEQ ID NO: 431841 - RNA, 64 nt, hsa; identical to SEQ ID NO: 157087

SEQ ID NO: 431842 - RNA, 64 nt, hsa; identical to SEQ ID NO: 157088

SEQ ID NO: 431843 - RNA, 64 nt, hsa; identical to SEQ ID NO: 157089

SEQ ID NO: 431844 - RNA, 64 nt, hsa; identical to SEQ ID NO: 157090

SEQ ID NO: 431845 - RNA, 64 nt, hsa; identical to SEQ ID NO: 157091

SEQ ID NO: 431846 - RNA, 64 nt, hsa; identical to SEQ ID NO: 157092

SEQ ID NO: 431847 - RNA, 64 nt, hsa; identical to SEQ ID NO: 157093

SEQ ID NO: 431848 - RNA, 64 nt, hsa; identical to SEQ ID NO: 157094

SEQ ID NO: 431849 - RNA, 64 nt, hsa; identical to SEQ ID NO: 157095

SEQ ID NO: 431850 - RNA, 64 nt, hsa; identical to SEQ ID NO: 157096

SEQ ID NO: 431851 - RNA, 64 nt, hsa; identical to SEQ ID NO: 157097

SEQ ID NO: 431852 - RNA, 64 nt, hsa; identical to SEQ ID NO: 157098

SEQ ID NO: 431853 - RNA, 64 nt, hsa; identical to SEQ ID NO: 157099

SEQ ID NO: 431854 - RNA, 64 nt, hsa; identical to SEQ ID NO: 157100

SEQ ID NO: 431855 - RNA, 64 nt, hsa; identical to SEQ ID NO: 157101

SEQ ID NO: 431856 - RNA, 64 nt, hsa; identical to SEQ ID NO: 157102

SEQ ID NO: 431857 - RNA, 64 nt, hsa; identical to SEQ ID NO: 157103

SEQ ID NO: 431858 - RNA, 64 nt, hsa; identical to SEQ ID NO: 157104

SEQ ID NO: 431859 - RNA, 64 nt, hsa; identical to SEQ ID NO: 157105

SEQ ID NO: 431860 - RNA, 64 nt, hsa; identical to SEQ ID NO: 157106

SEQ ID NO: 431861 - RNA, 64 nt, hsa; identical to SEQ ID NO: 157107

SEQ ID NO: 431862 - RNA, 64 nt, hsa; identical to SEQ ID NO: 157108

SEQ ID NO: 431863 - RNA, 64 nt, hsa; identical to SEQ ID NO: 157109

SEQ ID NO: 431864 - RNA, 64 nt, hsa; identical to SEQ ID NO: 157110

SEQ ID NO: 431865 - RNA, 64 nt, hsa; identical to SEQ ID NO: 157111

SEQ ID NO: 431866 - RNA, 64 nt, hsa; identical to SEQ ID NO: 157112

SEQ ID NO: 431867 - RNA, 64 nt, hsa; identical to SEQ ID NO: 157113

SEQ ID NO: 431868 - RNA, 64 nt, hsa; identical to SEQ ID NO: 157114

SEQ ID NO: 431869 - RNA, 64 nt, hsa; identical to SEQ ID NO: 157115

SEQ ID NO: 431870 - RNA, 64 nt, hsa; identical to SEQ ID NO: 157116

SEQ ID NO: 431871 - RNA, 64 nt, hsa; identical to SEQ ID NO: 157117

SEQ ID NO: 431872 - RNA, 64 nt, hsa; identical to SEQ ID NO: 157118

SEQ ID NO: 431873 - RNA, 64 nt, hsa; identical to SEQ ID NO: 157119

SEQ ID NO: 431874 - RNA, 64 nt, hsa; identical to SEQ ID NO: 157120

SEQ ID NO: 431875 - RNA, 50 nt, hsa; identical to SEQ ID NO: 157121

SEQ ID NO: 431876 - RNA, 52 nt, hsa; identical to SEQ ID NO: 157122

SEQ ID NO: 431877 - RNA, 54 nt, hsa; identical to SEQ ID NO: 157123

SEQ ID NO: 431878 - RNA, 56 nt, hsa; identical to SEQ ID NO: 157124

SEQ ID NO: 431879 - RNA, 58 nt, hsa; identical to SEQ ID NO: 157125

SEQ ID NO: 431880 - RNA, 60 nt, hsa; identical to SEQ ID NO: 157126

SEQ ID NO: 431881 - RNA, 62 nt, hsa; identical to SEQ ID NO: 157127

SEQ ID NO: 431882 - RNA, 64 nt, hsa; identical to SEQ ID NO: 157128

SEQ ID NO: 431883 - RNA, 64 nt, hsa; identical to SEQ ID NO: 157129

SEQ ID NO: 431884 - RNA, 64 nt, hsa; identical to SEQ ID NO: 157130

SEQ ID NO: 431885 - RNA, 64 nt, hsa; identical to SEQ ID NO: 157131

SEQ ID NO: 431886 - RNA, 64 nt, hsa; identical to SEQ ID NO: 157132

SEQ ID NO: 431887 - RNA, 64 nt, hsa; identical to SEQ ID NO: 157133

SEQ ID NO: 431888 - RNA, 64 nt, hsa; identical to SEQ ID NO: 157134

SEQ ID NO: 431889 - RNA, 64 nt, hsa; identical to SEQ ID NO: 157135

SEQ ID NO: 431890 - RNA, 64 nt, hsa; identical to SEQ ID NO: 157136

SEQ ID NO: 431891 - RNA, 64 nt, hsa; identical to SEQ ID NO: 157137

SEQ ID NO: 431892 - RNA, 64 nt, hsa; identical to SEQ ID NO: 157138

SEQ ID NO: 431893 - RNA, 64 nt, hsa; identical to SEQ ID NO: 157139

SEQ ID NO: 431894 - RNA, 64 nt, hsa; identical to SEQ ID NO: 157140

SEQ ID NO: 431895 - RNA, 64 nt, hsa; identical to SEQ ID NO: 157141

SEQ ID NO: 431896 - RNA, 64 nt, hsa; identical to SEQ ID NO: 157142

SEQ ID NO: 431897 - RNA, 64 nt, hsa; identical to SEQ ID NO: 157143

SEQ ID NO: 431898 - RNA, 64 nt, hsa; identical to SEQ ID NO: 157144

SEQ ID NO: 431899 - RNA, 64 nt, hsa; identical to SEQ ID NO: 157145

SEQ ID NO: 431900 - RNA, 64 nt, hsa; identical to SEQ ID NO: 157146

SEQ ID NO: 431901 - RNA, 64 nt, hsa; identical to SEQ ID NO: 157147

SEQ ID NO: 431902 - RNA, 64 nt, hsa; identical to SEQ ID NO: 157148

SEQ ID NO: 431903 - RNA, 64 nt, hsa; identical to SEQ ID NO: 157149

SEQ ID NO: 431904 - RNA, 64 nt, hsa; identical to SEQ ID NO: 157150

SEQ ID NO: 431905 - RNA, 64 nt, hsa; identical to SEQ ID NO: 157151

SEQ ID NO: 431906 - RNA, 64 nt, hsa; identical to SEQ ID NO: 157152

SEQ ID NO: 431907 - RNA, 64 nt, hsa; identical to SEQ ID NO: 157153

SEQ ID NO: 431908 - RNA, 64 nt, hsa; identical to SEQ ID NO: 157154

SEQ ID NO: 431909 - RNA, 64 nt, hsa; identical to SEQ ID NO: 157155

SEQ ID NO: 431910 - RNA, 64 nt, hsa; identical to SEQ ID NO: 157156

SEQ ID NO: 431911 - RNA, 64 nt, hsa; identical to SEQ ID NO: 157157

SEQ ID NO: 431912 - RNA, 64 nt, hsa; identical to SEQ ID NO: 157158

SEQ ID NO: 431913 - RNA, 64 nt, hsa; identical to SEQ ID NO: 157159

SEQ ID NO: 431914 - RNA, 64 nt, hsa; identical to SEQ ID NO: 157160

SEQ ID NO: 431915 - RNA, 64 nt, hsa; identical to SEQ ID NO: 157161

SEQ ID NO: 431916 - RNA, 64 nt, hsa; identical to SEQ ID NO: 157162

SEQ ID NO: 431917 - RNA, 64 nt, hsa; identical to SEQ ID NO: 157163

SEQ ID NO: 431918 - RNA, 64 nt, hsa; identical to SEQ ID NO: 157164

SEQ ID NO: 431919 - RNA, 64 nt, hsa; identical to SEQ ID NO: 157165

SEQ ID NO: 431920 - RNA, 64 nt, hsa; identical to SEQ ID NO: 157166

SEQ ID NO: 431921 - RNA, 64 nt, hsa; identical to SEQ ID NO: 157167

SEQ ID NO: 431922 - RNA, 64 nt, hsa; identical to SEQ ID NO: 157168

SEQ ID NO: 431923 - RNA, 64 nt, hsa; identical to SEQ ID NO: 157169

SEQ ID NO: 431924 - RNA, 64 nt, hsa; identical to SEQ ID NO: 157170

SEQ ID NO: 431925 - RNA, 64 nt, hsa; identical to SEQ ID NO: 157171

SEQ ID NO: 431926 - RNA, 64 nt, hsa; identical to SEQ ID NO: 157172

SEQ ID NO: 431927 - RNA, 64 nt, hsa; identical to SEQ ID NO: 157173

SEQ ID NO: 431928 - RNA, 64 nt, hsa; identical to SEQ ID NO: 157174

SEQ ID NO: 431929 - RNA, 64 nt, hsa; identical to SEQ ID NO: 157175

SEQ ID NO: 431930 - RNA, 64 nt, hsa; identical to SEQ ID NO: 157176

SEQ ID NO: 431931 - RNA, 64 nt, hsa; identical to SEQ ID NO: 157177

SEQ ID NO: 431932 - RNA, 64 nt, hsa; identical to SEQ ID NO: 157178

SEQ ID NO: 431933 - RNA, 64 nt, hsa; identical to SEQ ID NO: 157179

SEQ ID NO: 431934 - RNA, 64 nt, hsa; identical to SEQ ID NO: 157180

SEQ ID NO: 431935 - RNA, 64 nt, hsa; identical to SEQ ID NO: 157181

SEQ ID NO: 431936 - RNA, 64 nt, hsa; identical to SEQ ID NO: 157182

SEQ ID NO: 431937 - RNA, 64 nt, hsa; identical to SEQ ID NO: 157183

SEQ ID NO: 431938 - RNA, 64 nt, hsa; identical to SEQ ID NO: 157184

SEQ ID NO: 431939 - RNA, 64 nt, hsa; identical to SEQ ID NO: 157185

SEQ ID NO: 431940 - RNA, 64 nt, hsa; identical to SEQ ID NO: 157186

SEQ ID NO: 431941 - RNA, 64 nt, hsa; identical to SEQ ID NO: 157187

SEQ ID NO: 431942 - RNA, 64 nt, hsa; identical to SEQ ID NO: 157188

SEQ ID NO: 431943 - RNA, 64 nt, hsa; identical to SEQ ID NO: 157189

SEQ ID NO: 431944 - RNA, 64 nt, hsa; identical to SEQ ID NO: 157190

SEQ ID NO: 431945 - RNA, 64 nt, hsa; identical to SEQ ID NO: 157191

SEQ ID NO: 431946 - RNA, 64 nt, hsa; identical to SEQ ID NO: 157192

SEQ ID NO: 431947 - RNA, 64 nt, hsa; identical to SEQ ID NO: 157193

SEQ ID NO: 431948 - RNA, 64 nt, hsa; identical to SEQ ID NO: 157194

SEQ ID NO: 431949 - RNA, 64 nt, hsa; identical to SEQ ID NO: 157195

SEQ ID NO: 431950 - RNA, 64 nt, hsa; identical to SEQ ID NO: 157196

SEQ ID NO: 431951 - RNA, 64 nt, hsa; identical to SEQ ID NO: 157197

SEQ ID NO: 431952 - RNA, 64 nt, hsa; identical to SEQ ID NO: 157198

SEQ ID NO: 431953 - RNA, 64 nt, hsa; identical to SEQ ID NO: 157199

SEQ ID NO: 431954 - RNA, 64 nt, hsa; identical to SEQ ID NO: 157200

SEQ ID NO: 431955 - RNA, 64 nt, hsa; identical to SEQ ID NO: 157201

SEQ ID NO: 431956 - RNA, 64 nt, hsa; identical to SEQ ID NO: 157202

SEQ ID NO: 431957 - RNA, 64 nt, hsa; identical to SEQ ID NO: 157203

SEQ ID NO: 431958 - RNA, 64 nt, hsa; identical to SEQ ID NO: 157204

SEQ ID NO: 431959 - RNA, 64 nt, hsa; identical to SEQ ID NO: 157205

SEQ ID NO: 431960 - RNA, 64 nt, hsa; identical to SEQ ID NO: 157206

SEQ ID NO: 431961 - RNA, 64 nt, hsa; identical to SEQ ID NO: 157207

SEQ ID NO: 431962 - RNA, 64 nt, hsa; identical to SEQ ID NO: 157208

SEQ ID NO: 431963 - RNA, 64 nt, hsa; identical to SEQ ID NO: 157209

SEQ ID NO: 431964 - RNA, 64 nt, hsa; identical to SEQ ID NO: 157210

SEQ ID NO: 431965 - RNA, 64 nt, hsa; identical to SEQ ID NO: 157211

SEQ ID NO: 431966 - RNA, 64 nt, hsa; identical to SEQ ID NO: 157212

SEQ ID NO: 431967 - RNA, 64 nt, hsa; identical to SEQ ID NO: 157213

SEQ ID NO: 431968 - RNA, 64 nt, hsa; identical to SEQ ID NO: 157214

SEQ ID NO: 431969 - RNA, 64 nt, hsa; identical to SEQ ID NO: 157215

SEQ ID NO: 431970 - RNA, 64 nt, hsa; identical to SEQ ID NO: 157216

SEQ ID NO: 431971 - RNA, 64 nt, hsa; identical to SEQ ID NO: 157217

SEQ ID NO: 431972 - RNA, 64 nt, hsa; identical to SEQ ID NO: 157218

SEQ ID NO: 431973 - RNA, 64 nt, hsa; identical to SEQ ID NO: 157219

SEQ ID NO: 431974 - RNA, 64 nt, hsa; identical to SEQ ID NO: 157220

SEQ ID NO: 431975 - RNA, 64 nt, hsa; identical to SEQ ID NO: 157221

SEQ ID NO: 431976 - RNA, 64 nt, hsa; identical to SEQ ID NO: 157222

SEQ ID NO: 431977 - RNA, 64 nt, hsa; identical to SEQ ID NO: 157223

SEQ ID NO: 431978 - RNA, 64 nt, hsa; identical to SEQ ID NO: 157224

SEQ ID NO: 431979 - RNA, 64 nt, hsa; identical to SEQ ID NO: 157225

SEQ ID NO: 431980 - RNA, 64 nt, hsa; identical to SEQ ID NO: 157226

SEQ ID NO: 431981 - RNA, 64 nt, hsa; identical to SEQ ID NO: 157227

SEQ ID NO: 431982 - RNA, 64 nt, hsa; identical to SEQ ID NO: 157228

SEQ ID NO: 431983 - RNA, 64 nt, hsa; identical to SEQ ID NO: 157229

SEQ ID NO: 431984 - RNA, 64 nt, hsa; identical to SEQ ID NO: 157230

SEQ ID NO: 431985 - RNA, 64 nt, hsa; identical to SEQ ID NO: 157231

SEQ ID NO: 431986 - RNA, 63 nt, hsa; identical to SEQ ID NO: 157232

SEQ ID NO: 431987 - RNA, 64 nt, hsa; identical to SEQ ID NO: 157233

SEQ ID NO: 431988 - RNA, 64 nt, hsa; identical to SEQ ID NO: 157234

SEQ ID NO: 431989 - RNA, 64 nt, hsa; identical to SEQ ID NO: 157235

SEQ ID NO: 431990 - RNA, 64 nt, hsa; identical to SEQ ID NO: 157236

SEQ ID NO: 431991 - RNA, 64 nt, hsa; identical to SEQ ID NO: 157237

SEQ ID NO: 431992 - RNA, 64 nt, hsa; identical to SEQ ID NO: 157238

SEQ ID NO: 431993 - RNA, 64 nt, hsa; identical to SEQ ID NO: 157239

SEQ ID NO: 431994 - RNA, 64 nt, hsa; identical to SEQ ID NO: 157240

SEQ ID NO: 431995 - RNA, 64 nt, hsa; identical to SEQ ID NO: 157241

SEQ ID NO: 431996 - RNA, 64 nt, hsa; identical to SEQ ID NO: 157242

SEQ ID NO: 431997 - RNA, 64 nt, hsa; identical to SEQ ID NO: 157243

SEQ ID NO: 431998 - RNA, 64 nt, hsa; identical to SEQ ID NO: 157244

SEQ ID NO: 431999 - RNA, 64 nt, hsa; identical to SEQ ID NO: 157245

SEQ ID NO: 432000 - RNA, 64 nt, hsa; identical to SEQ ID NO: 157246

SEQ ID NO: 432001 - RNA, 64 nt, hsa; identical to SEQ ID NO: 157247

SEQ ID NO: 432002 - RNA, 64 nt, hsa; identical to SEQ ID NO: 157248

SEQ ID NO: 432003 - RNA, 64 nt, hsa; identical to SEQ ID NO: 157249

SEQ ID NO: 432004 - RNA, 64 nt, hsa; identical to SEQ ID NO: 157250

SEQ ID NO: 432005 - RNA, 64 nt, hsa; identical to SEQ ID NO: 157251

SEQ ID NO: 432006 - RNA, 64 nt, hsa; identical to SEQ ID NO: 157252

SEQ ID NO: 432007 - RNA, 64 nt, hsa; identical to SEQ ID NO: 157253

SEQ ID NO: 432008 - RNA, 64 nt, hsa; identical to SEQ ID NO: 157254

SEQ ID NO: 432009 - RNA, 64 nt, hsa; identical to SEQ ID NO: 157255

SEQ ID NO: 432010 - RNA, 64 nt, hsa; identical to SEQ ID NO: 157256

SEQ ID NO: 432011 - RNA, 64 nt, hsa; identical to SEQ ID NO: 157257

SEQ ID NO: 432012 - RNA, 64 nt, hsa; identical to SEQ ID NO: 157258

SEQ ID NO: 432013 - RNA, 64 nt, hsa; identical to SEQ ID NO: 157259

SEQ ID NO: 432014 - RNA, 64 nt, hsa; identical to SEQ ID NO: 157260

SEQ ID NO: 432015 - RNA, 64 nt, hsa; identical to SEQ ID NO: 157261

SEQ ID NO: 432016 - RNA, 64 nt, hsa; identical to SEQ ID NO: 157262

SEQ ID NO: 432017 - RNA, 64 nt, hsa; identical to SEQ ID NO: 157263

SEQ ID NO: 432018 - RNA, 64 nt, hsa; identical to SEQ ID NO: 157264

SEQ ID NO: 432019 - RNA, 64 nt, hsa; identical to SEQ ID NO: 157265

SEQ ID NO: 432020 - RNA, 64 nt, hsa; identical to SEQ ID NO: 157266

SEQ ID NO: 432021 - RNA, 64 nt, hsa; identical to SEQ ID NO: 157267

SEQ ID NO: 432022 - RNA, 64 nt, hsa; identical to SEQ ID NO: 157268

SEQ ID NO: 432023 - RNA, 64 nt, hsa; identical to SEQ ID NO: 157269

SEQ ID NO: 432024 - RNA, 64 nt, hsa; identical to SEQ ID NO: 157270

SEQ ID NO: 432025 - RNA, 64 nt, hsa; identical to SEQ ID NO: 157271

SEQ ID NO: 432026 - RNA, 64 nt, hsa; identical to SEQ ID NO: 157272

SEQ ID NO: 432027 - RNA, 64 nt, hsa; identical to SEQ ID NO: 157273

SEQ ID NO: 432028 - RNA, 64 nt, hsa; identical to SEQ ID NO: 157274

SEQ ID NO: 432029 - RNA, 64 nt, hsa; identical to SEQ ID NO: 157275

SEQ ID NO: 432030 - RNA, 64 nt, hsa; identical to SEQ ID NO: 157276

SEQ ID NO: 432031 - RNA, 64 nt, hsa; identical to SEQ ID NO: 157277

SEQ ID NO: 432032 - RNA, 64 nt, hsa; identical to SEQ ID NO: 157278

SEQ ID NO: 432033 - RNA, 64 nt, hsa; identical to SEQ ID NO: 157279

SEQ ID NO: 432034 - RNA, 64 nt, hsa; identical to SEQ ID NO: 157280

SEQ ID NO: 432035 - RNA, 64 nt, hsa; identical to SEQ ID NO: 157281

SEQ ID NO: 432036 - RNA, 64 nt, hsa; identical to SEQ ID NO: 157282

SEQ ID NO: 432037 - RNA, 64 nt, hsa; identical to SEQ ID NO: 157283

SEQ ID NO: 432038 - RNA, 64 nt, hsa; identical to SEQ ID NO: 157284

SEQ ID NO: 432039 - RNA, 64 nt, hsa; identical to SEQ ID NO: 157285

SEQ ID NO: 432040 - RNA, 64 nt, hsa; identical to SEQ ID NO: 157286

SEQ ID NO: 432041 - RNA, 64 nt, hsa; identical to SEQ ID NO: 157287

SEQ ID NO: 432042 - RNA, 64 nt, hsa; identical to SEQ ID NO: 157288

SEQ ID NO: 432043 - RNA, 64 nt, hsa; identical to SEQ ID NO: 157289

SEQ ID NO: 432044 - RNA, 64 nt, hsa; identical to SEQ ID NO: 157290

SEQ ID NO: 432045 - RNA, 64 nt, hsa; identical to SEQ ID NO: 157291

SEQ ID NO: 432046 - RNA, 64 nt, hsa; identical to SEQ ID NO: 157292

SEQ ID NO: 432047 - RNA, 64 nt, hsa; identical to SEQ ID NO: 157293

SEQ ID NO: 432048 - RNA, 64 nt, hsa; identical to SEQ ID NO: 157294

SEQ ID NO: 432049 - RNA, 64 nt, hsa; identical to SEQ ID NO: 157295

SEQ ID NO: 432050 - RNA, 64 nt, hsa; identical to SEQ ID NO: 157296

SEQ ID NO: 432051 - RNA, 64 nt, hsa; identical to SEQ ID NO: 157297

SEQ ID NO: 432052 - RNA, 64 nt, hsa; identical to SEQ ID NO: 157298

SEQ ID NO: 432053 - RNA, 64 nt, hsa; identical to SEQ ID NO: 157299

SEQ ID NO: 432054 - RNA, 64 nt, hsa; identical to SEQ ID NO: 157300

SEQ ID NO: 432055 - RNA, 64 nt, hsa; identical to SEQ ID NO: 157301

SEQ ID NO: 432056 - RNA, 64 nt, hsa; identical to SEQ ID NO: 157302

SEQ ID NO: 432057 - RNA, 64 nt, hsa; identical to SEQ ID NO: 157303

SEQ ID NO: 432058 - RNA, 64 nt, hsa; identical to SEQ ID NO: 157304

SEQ ID NO: 432059 - RNA, 64 nt, hsa; identical to SEQ ID NO: 157305

SEQ ID NO: 432060 - RNA, 64 nt, hsa; identical to SEQ ID NO: 157306

SEQ ID NO: 432061 - RNA, 64 nt, hsa; identical to SEQ ID NO: 157307

SEQ ID NO: 432062 - RNA, 64 nt, hsa; identical to SEQ ID NO: 157308

SEQ ID NO: 432063 - RNA, 64 nt, hsa; identical to SEQ ID NO: 157309

SEQ ID NO: 432064 - RNA, 64 nt, hsa; identical to SEQ ID NO: 157310

SEQ ID NO: 432065 - RNA, 64 nt, hsa; identical to SEQ ID NO: 157311

SEQ ID NO: 432066 - RNA, 64 nt, hsa; identical to SEQ ID NO: 157312

SEQ ID NO: 432067 - RNA, 64 nt, hsa; identical to SEQ ID NO: 157313

SEQ ID NO: 432068 - RNA, 64 nt, hsa; identical to SEQ ID NO: 157314

SEQ ID NO: 432069 - RNA, 64 nt, hsa; identical to SEQ ID NO: 157315

SEQ ID NO: 432070 - RNA, 64 nt, hsa; identical to SEQ ID NO: 157316

SEQ ID NO: 432071 - RNA, 64 nt, hsa; identical to SEQ ID NO: 157317

SEQ ID NO: 432072 - RNA, 64 nt, hsa; identical to SEQ ID NO: 157318

SEQ ID NO: 432073 - RNA, 64 nt, hsa; identical to SEQ ID NO: 157319

SEQ ID NO: 432074 - RNA, 64 nt, hsa; identical to SEQ ID NO: 157320

SEQ ID NO: 432075 - RNA, 64 nt, hsa; identical to SEQ ID NO: 157321

SEQ ID NO: 432076 - RNA, 64 nt, hsa; identical to SEQ ID NO: 157322

SEQ ID NO: 432077 - RNA, 64 nt, hsa; identical to SEQ ID NO: 157323

SEQ ID NO: 432078 - RNA, 64 nt, hsa; identical to SEQ ID NO: 157324

SEQ ID NO: 432079 - RNA, 64 nt, hsa; identical to SEQ ID NO: 157325

SEQ ID NO: 432080 - RNA, 64 nt, hsa; identical to SEQ ID NO: 157326

SEQ ID NO: 432081 - RNA, 64 nt, hsa; identical to SEQ ID NO: 157327

SEQ ID NO: 432082 - RNA, 64 nt, hsa; identical to SEQ ID NO: 157328

SEQ ID NO: 432083 - RNA, 64 nt, hsa; identical to SEQ ID NO: 157329

SEQ ID NO: 432084 - RNA, 64 nt, hsa; identical to SEQ ID NO: 157330

SEQ ID NO: 432085 - RNA, 64 nt, hsa; identical to SEQ ID NO: 157331

SEQ ID NO: 432086 - RNA, 64 nt, hsa; identical to SEQ ID NO: 157332

SEQ ID NO: 432087 - RNA, 64 nt, hsa; identical to SEQ ID NO: 157333

SEQ ID NO: 432088 - RNA, 64 nt, hsa; identical to SEQ ID NO: 157334

SEQ ID NO: 432089 - RNA, 64 nt, hsa; identical to SEQ ID NO: 157335

SEQ ID NO: 432090 - RNA, 64 nt, hsa; identical to SEQ ID NO: 157336

SEQ ID NO: 432091 - RNA, 64 nt, hsa; identical to SEQ ID NO: 157337

SEQ ID NO: 432092 - RNA, 64 nt, hsa; identical to SEQ ID NO: 157338

SEQ ID NO: 432093 - RNA, 64 nt, hsa; identical to SEQ ID NO: 157339

SEQ ID NO: 432094 - RNA, 64 nt, hsa; identical to SEQ ID NO: 157340

SEQ ID NO: 432095 - RNA, 64 nt, hsa; identical to SEQ ID NO: 157341

SEQ ID NO: 432096 - RNA, 64 nt, hsa; identical to SEQ ID NO: 157342

SEQ ID NO: 432097 - RNA, 64 nt, hsa; identical to SEQ ID NO: 157343

SEQ ID NO: 432098 - RNA, 64 nt, hsa; identical to SEQ ID NO: 157344

SEQ ID NO: 432099 - RNA, 64 nt, hsa; identical to SEQ ID NO: 157345

SEQ ID NO: 432100 - RNA, 64 nt, hsa; identical to SEQ ID NO: 157346

SEQ ID NO: 432101 - RNA, 64 nt, hsa; identical to SEQ ID NO: 157347

SEQ ID NO: 432102 - RNA, 64 nt, hsa; identical to SEQ ID NO: 157348

SEQ ID NO: 432103 - RNA, 64 nt, hsa; identical to SEQ ID NO: 157349

SEQ ID NO: 432104 - RNA, 64 nt, hsa; identical to SEQ ID NO: 157350

SEQ ID NO: 432105 - RNA, 64 nt, hsa; identical to SEQ ID NO: 157351

SEQ ID NO: 432106 - RNA, 64 nt, hsa; identical to SEQ ID NO: 157352

SEQ ID NO: 432107 - RNA, 64 nt, hsa; identical to SEQ ID NO: 157353

SEQ ID NO: 432108 - RNA, 64 nt, hsa; identical to SEQ ID NO: 157354

SEQ ID NO: 432109 - RNA, 64 nt, hsa; identical to SEQ ID NO: 157355

SEQ ID NO: 432110 - RNA, 64 nt, hsa; identical to SEQ ID NO: 157356

SEQ ID NO: 432111 - RNA, 64 nt, hsa; identical to SEQ ID NO: 157357

SEQ ID NO: 432112 - RNA, 64 nt, hsa; identical to SEQ ID NO: 157358

SEQ ID NO: 432113 - RNA, 64 nt, hsa; identical to SEQ ID NO: 157359

SEQ ID NO: 432114 - RNA, 64 nt, hsa; identical to SEQ ID NO: 157360

SEQ ID NO: 432115 - RNA, 64 nt, hsa; identical to SEQ ID NO: 157361

SEQ ID NO: 432116 - RNA, 64 nt, hsa; identical to SEQ ID NO: 157362

SEQ ID NO: 432117 - RNA, 64 nt, hsa; identical to SEQ ID NO: 157363

SEQ ID NO: 432118 - RNA, 64 nt, hsa; identical to SEQ ID NO: 157364

SEQ ID NO: 432119 - RNA, 64 nt, hsa; identical to SEQ ID NO: 157365

SEQ ID NO: 432120 - RNA, 64 nt, hsa; identical to SEQ ID NO: 157366

SEQ ID NO: 432121 - RNA, 64 nt, hsa; identical to SEQ ID NO: 157367

SEQ ID NO: 432122 - RNA, 64 nt, hsa; identical to SEQ ID NO: 157368

SEQ ID NO: 432123 - RNA, 64 nt, hsa; identical to SEQ ID NO: 157369

SEQ ID NO: 432124 - RNA, 64 nt, hsa; identical to SEQ ID NO: 157370

SEQ ID NO: 432125 - RNA, 64 nt, hsa; identical to SEQ ID NO: 157371

SEQ ID NO: 432126 - RNA, 64 nt, hsa; identical to SEQ ID NO: 157372

SEQ ID NO: 432127 - RNA, 64 nt, hsa; identical to SEQ ID NO: 157373

SEQ ID NO: 432128 - RNA, 64 nt, hsa; identical to SEQ ID NO: 157374

SEQ ID NO: 432129 - RNA, 64 nt, hsa; identical to SEQ ID NO: 157375

SEQ ID NO: 432130 - RNA, 64 nt, hsa; identical to SEQ ID NO: 157376

SEQ ID NO: 432131 - RNA, 64 nt, hsa; identical to SEQ ID NO: 157377

SEQ ID NO: 432132 - RNA, 64 nt, hsa; identical to SEQ ID NO: 157378

SEQ ID NO: 432133 - RNA, 64 nt, hsa; identical to SEQ ID NO: 157379

SEQ ID NO: 432134 - RNA, 64 nt, hsa; identical to SEQ ID NO: 157380

SEQ ID NO: 432135 - RNA, 64 nt, hsa; identical to SEQ ID NO: 157381

SEQ ID NO: 432136 - RNA, 64 nt, hsa; identical to SEQ ID NO: 157382

SEQ ID NO: 432137 - RNA, 64 nt, hsa; identical to SEQ ID NO: 157383

SEQ ID NO: 432138 - RNA, 64 nt, hsa; identical to SEQ ID NO: 157384

SEQ ID NO: 432139 - RNA, 64 nt, hsa; identical to SEQ ID NO: 157385

SEQ ID NO: 432140 - RNA, 64 nt, hsa; identical to SEQ ID NO: 157386

SEQ ID NO: 432141 - RNA, 64 nt, hsa; identical to SEQ ID NO: 157387

SEQ ID NO: 432142 - RNA, 64 nt, hsa; identical to SEQ ID NO: 157388

SEQ ID NO: 432143 - RNA, 64 nt, hsa; identical to SEQ ID NO: 157389

SEQ ID NO: 432144 - RNA, 64 nt, hsa; identical to SEQ ID NO: 157390

SEQ ID NO: 432145 - RNA, 64 nt, hsa; identical to SEQ ID NO: 157391

SEQ ID NO: 432146 - RNA, 64 nt, hsa; identical to SEQ ID NO: 157392

SEQ ID NO: 432147 - RNA, 64 nt, hsa; identical to SEQ ID NO: 157393

SEQ ID NO: 432148 - RNA, 64 nt, hsa; identical to SEQ ID NO: 157394

SEQ ID NO: 432149 - RNA, 64 nt, hsa; identical to SEQ ID NO: 157395

SEQ ID NO: 432150 - RNA, 64 nt, hsa; identical to SEQ ID NO: 157396

SEQ ID NO: 432151 - RNA, 64 nt, hsa; identical to SEQ ID NO: 157397

SEQ ID NO: 432152 - RNA, 64 nt, hsa; identical to SEQ ID NO: 157398

SEQ ID NO: 432153 - RNA, 64 nt, hsa; identical to SEQ ID NO: 157399

SEQ ID NO: 432154 - RNA, 64 nt, hsa; identical to SEQ ID NO: 157400

SEQ ID NO: 432155 - RNA, 64 nt, hsa; identical to SEQ ID NO: 157401

SEQ ID NO: 432156 - RNA, 64 nt, hsa; identical to SEQ ID NO: 157402

SEQ ID NO: 432157 - RNA, 64 nt, hsa; identical to SEQ ID NO: 157403

SEQ ID NO: 432158 - RNA, 64 nt, hsa; identical to SEQ ID NO: 157404

SEQ ID NO: 432159 - RNA, 64 nt, hsa; identical to SEQ ID NO: 157405

SEQ ID NO: 432160 - RNA, 64 nt, hsa; identical to SEQ ID NO: 157406

SEQ ID NO: 432161 - RNA, 64 nt, hsa; identical to SEQ ID NO: 157407

SEQ ID NO: 432162 - RNA, 64 nt, hsa; identical to SEQ ID NO: 157408

SEQ ID NO: 432163 - RNA, 64 nt, hsa; identical to SEQ ID NO: 157409

SEQ ID NO: 432164 - RNA, 64 nt, hsa; identical to SEQ ID NO: 157410

SEQ ID NO: 432165 - RNA, 64 nt, hsa; identical to SEQ ID NO: 157411

SEQ ID NO: 432166 - RNA, 64 nt, hsa; identical to SEQ ID NO: 157412

SEQ ID NO: 432167 - RNA, 64 nt, hsa; identical to SEQ ID NO: 157413

SEQ ID NO: 432168 - RNA, 64 nt, hsa; identical to SEQ ID NO: 157414

SEQ ID NO: 432169 - RNA, 64 nt, hsa; identical to SEQ ID NO: 157415

SEQ ID NO: 432170 - RNA, 64 nt, hsa; identical to SEQ ID NO: 157416

SEQ ID NO: 432171 - RNA, 64 nt, hsa; identical to SEQ ID NO: 157417

SEQ ID NO: 432172 - RNA, 64 nt, hsa; identical to SEQ ID NO: 157418

SEQ ID NO: 432173 - RNA, 64 nt, hsa; identical to SEQ ID NO: 157419

SEQ ID NO: 432174 - RNA, 64 nt, hsa; identical to SEQ ID NO: 157420

SEQ ID NO: 432175 - RNA, 64 nt, hsa; identical to SEQ ID NO: 157421

SEQ ID NO: 432176 - RNA, 64 nt, hsa; identical to SEQ ID NO: 157422

SEQ ID NO: 432177 - RNA, 64 nt, hsa; identical to SEQ ID NO: 157423

SEQ ID NO: 432178 - RNA, 64 nt, hsa; identical to SEQ ID NO: 157424

SEQ ID NO: 432179 - RNA, 64 nt, hsa; identical to SEQ ID NO: 157425

SEQ ID NO: 432180 - RNA, 64 nt, hsa; identical to SEQ ID NO: 157426

SEQ ID NO: 432181 - RNA, 64 nt, hsa; identical to SEQ ID NO: 157427

SEQ ID NO: 432182 - RNA, 64 nt, hsa; identical to SEQ ID NO: 157428

SEQ ID NO: 432183 - RNA, 64 nt, hsa; identical to SEQ ID NO: 157429

SEQ ID NO: 432184 - RNA, 64 nt, hsa; identical to SEQ ID NO: 157430

SEQ ID NO: 432185 - RNA, 64 nt, hsa; identical to SEQ ID NO: 157431

SEQ ID NO: 432186 - RNA, 64 nt, hsa; identical to SEQ ID NO: 157432

SEQ ID NO: 432187 - RNA, 64 nt, hsa; identical to SEQ ID NO: 157433

SEQ ID NO: 432188 - RNA, 64 nt, hsa; identical to SEQ ID NO: 157434

SEQ ID NO: 432189 - RNA, 64 nt, hsa; identical to SEQ ID NO: 157435

SEQ ID NO: 432190 - RNA, 64 nt, hsa; identical to SEQ ID NO: 157436

SEQ ID NO: 432191 - RNA, 64 nt, hsa; identical to SEQ ID NO: 157437

SEQ ID NO: 432192 - RNA, 64 nt, hsa; identical to SEQ ID NO: 157438

SEQ ID NO: 432193 - RNA, 64 nt, hsa; identical to SEQ ID NO: 157439

SEQ ID NO: 432194 - RNA, 64 nt, hsa; identical to SEQ ID NO: 157440

SEQ ID NO: 432195 - RNA, 64 nt, hsa; identical to SEQ ID NO: 157441

SEQ ID NO: 432196 - RNA, 64 nt, hsa; identical to SEQ ID NO: 157442

SEQ ID NO: 432197 - RNA, 64 nt, hsa; identical to SEQ ID NO: 157443

SEQ ID NO: 432198 - RNA, 64 nt, hsa; identical to SEQ ID NO: 157444

SEQ ID NO: 432199 - RNA, 64 nt, hsa; identical to SEQ ID NO: 157445

SEQ ID NO: 432200 - RNA, 64 nt, hsa; identical to SEQ ID NO: 157446

SEQ ID NO: 432201 - RNA, 64 nt, hsa; identical to SEQ ID NO: 157447

SEQ ID NO: 432202 - RNA, 64 nt, hsa; identical to SEQ ID NO: 157448

SEQ ID NO: 432203 - RNA, 64 nt, hsa; identical to SEQ ID NO: 157449

SEQ ID NO: 432204 - RNA, 64 nt, hsa; identical to SEQ ID NO: 157450

SEQ ID NO: 432205 - RNA, 64 nt, hsa; identical to SEQ ID NO: 157451

SEQ ID NO: 432206 - RNA, 64 nt, hsa; identical to SEQ ID NO: 157452

SEQ ID NO: 432207 - RNA, 64 nt, hsa; identical to SEQ ID NO: 157453

SEQ ID NO: 432208 - RNA, 64 nt, hsa; identical to SEQ ID NO: 157454

SEQ ID NO: 432209 - RNA, 64 nt, hsa; identical to SEQ ID NO: 157455

SEQ ID NO: 432210 - RNA, 64 nt, hsa; identical to SEQ ID NO: 157456

SEQ ID NO: 432211 - RNA, 64 nt, hsa; identical to SEQ ID NO: 157457

SEQ ID NO: 432212 - RNA, 64 nt, hsa; identical to SEQ ID NO: 157458

SEQ ID NO: 432213 - RNA, 64 nt, hsa; identical to SEQ ID NO: 157459

SEQ ID NO: 432214 - RNA, 64 nt, hsa; identical to SEQ ID NO: 157460

SEQ ID NO: 432215 - RNA, 64 nt, hsa; identical to SEQ ID NO: 157461

SEQ ID NO: 432216 - RNA, 64 nt, hsa; identical to SEQ ID NO: 157462

SEQ ID NO: 432217 - RNA, 64 nt, hsa; identical to SEQ ID NO: 157463

SEQ ID NO: 432218 - RNA, 64 nt, hsa; identical to SEQ ID NO: 157464

SEQ ID NO: 432219 - RNA, 64 nt, hsa; identical to SEQ ID NO: 157465

SEQ ID NO: 432220 - RNA, 64 nt, hsa; identical to SEQ ID NO: 157466

SEQ ID NO: 432221 - RNA, 64 nt, hsa; identical to SEQ ID NO: 157467

SEQ ID NO: 432222 - RNA, 64 nt, hsa; identical to SEQ ID NO: 157468

SEQ ID NO: 432223 - RNA, 64 nt, hsa; identical to SEQ ID NO: 157469

SEQ ID NO: 432224 - RNA, 64 nt, hsa; identical to SEQ ID NO: 157470

SEQ ID NO: 432225 - RNA, 64 nt, hsa; identical to SEQ ID NO: 157471

SEQ ID NO: 432226 - RNA, 64 nt, hsa; identical to SEQ ID NO: 157472

SEQ ID NO: 432227 - RNA, 64 nt, hsa; identical to SEQ ID NO: 157473

SEQ ID NO: 432228 - RNA, 64 nt, hsa; identical to SEQ ID NO: 157474

SEQ ID NO: 432229 - RNA, 64 nt, hsa; identical to SEQ ID NO: 157475

SEQ ID NO: 432230 - RNA, 64 nt, hsa; identical to SEQ ID NO: 157476

SEQ ID NO: 432231 - RNA, 64 nt, hsa; identical to SEQ ID NO: 157477

SEQ ID NO: 432232 - RNA, 64 nt, hsa; identical to SEQ ID NO: 157478

SEQ ID NO: 432233 - RNA, 64 nt, hsa; identical to SEQ ID NO: 157479

SEQ ID NO: 432234 - RNA, 64 nt, hsa; identical to SEQ ID NO: 157480

SEQ ID NO: 432235 - RNA, 64 nt, hsa; identical to SEQ ID NO: 157481

SEQ ID NO: 432236 - RNA, 64 nt, hsa; identical to SEQ ID NO: 157482

SEQ ID NO: 432237 - RNA, 64 nt, hsa; identical to SEQ ID NO: 157483

SEQ ID NO: 432238 - RNA, 64 nt, hsa; identical to SEQ ID NO: 157484

SEQ ID NO: 432239 - RNA, 64 nt, hsa; identical to SEQ ID NO: 157485

SEQ ID NO: 432240 - RNA, 64 nt, hsa; identical to SEQ ID NO: 157486

SEQ ID NO: 432241 - RNA, 64 nt, hsa; identical to SEQ ID NO: 157487

SEQ ID NO: 432242 - RNA, 64 nt, hsa; identical to SEQ ID NO: 157488

SEQ ID NO: 432243 - RNA, 64 nt, hsa; identical to SEQ ID NO: 157489

SEQ ID NO: 432244 - RNA, 64 nt, hsa; identical to SEQ ID NO: 157490

SEQ ID NO: 432245 - RNA, 64 nt, hsa; identical to SEQ ID NO: 157491

SEQ ID NO: 432246 - RNA, 64 nt, hsa; identical to SEQ ID NO: 157492

SEQ ID NO: 432247 - RNA, 64 nt, hsa; identical to SEQ ID NO: 157493

SEQ ID NO: 432248 - RNA, 64 nt, hsa; identical to SEQ ID NO: 157494

SEQ ID NO: 432249 - RNA, 64 nt, hsa; identical to SEQ ID NO: 157495

SEQ ID NO: 432250 - RNA, 64 nt, hsa; identical to SEQ ID NO: 157496

SEQ ID NO: 432251 - RNA, 64 nt, hsa; identical to SEQ ID NO: 157497

SEQ ID NO: 432252 - RNA, 64 nt, hsa; identical to SEQ ID NO: 157498

SEQ ID NO: 432253 - RNA, 64 nt, hsa; identical to SEQ ID NO: 157499

SEQ ID NO: 432254 - RNA, 64 nt, hsa; identical to SEQ ID NO: 157500

SEQ ID NO: 432255 - RNA, 64 nt, hsa; identical to SEQ ID NO: 157501

SEQ ID NO: 432256 - RNA, 64 nt, hsa; identical to SEQ ID NO: 157502

SEQ ID NO: 432257 - RNA, 64 nt, hsa; identical to SEQ ID NO: 157503

SEQ ID NO: 432258 - RNA, 64 nt, hsa; identical to SEQ ID NO: 157504

SEQ ID NO: 432259 - RNA, 64 nt, hsa; identical to SEQ ID NO: 157505

SEQ ID NO: 432260 - RNA, 64 nt, hsa; identical to SEQ ID NO: 157506

SEQ ID NO: 432261 - RNA, 64 nt, hsa; identical to SEQ ID NO: 157507

SEQ ID NO: 432262 - RNA, 64 nt, hsa; identical to SEQ ID NO: 157508

SEQ ID NO: 432263 - RNA, 64 nt, hsa; identical to SEQ ID NO: 157509

SEQ ID NO: 432264 - RNA, 64 nt, hsa; identical to SEQ ID NO: 157510

SEQ ID NO: 432265 - RNA, 64 nt, hsa; identical to SEQ ID NO: 157511

SEQ ID NO: 432266 - RNA, 64 nt, hsa; identical to SEQ ID NO: 157512

SEQ ID NO: 432267 - RNA, 64 nt, hsa; identical to SEQ ID NO: 157513

SEQ ID NO: 432268 - RNA, 64 nt, hsa; identical to SEQ ID NO: 157514

SEQ ID NO: 432269 - RNA, 64 nt, hsa; identical to SEQ ID NO: 157515

SEQ ID NO: 432270 - RNA, 64 nt, hsa; identical to SEQ ID NO: 157516

SEQ ID NO: 432271 - RNA, 64 nt, hsa; identical to SEQ ID NO: 157517

SEQ ID NO: 432272 - RNA, 64 nt, hsa; identical to SEQ ID NO: 157518

SEQ ID NO: 432273 - RNA, 64 nt, hsa; identical to SEQ ID NO: 157519

SEQ ID NO: 432274 - RNA, 64 nt, hsa; identical to SEQ ID NO: 157520

SEQ ID NO: 432275 - RNA, 64 nt, hsa; identical to SEQ ID NO: 157521

SEQ ID NO: 432276 - RNA, 64 nt, hsa; identical to SEQ ID NO: 157522

SEQ ID NO: 432277 - RNA, 64 nt, hsa; identical to SEQ ID NO: 157523

SEQ ID NO: 432278 - RNA, 64 nt, hsa; identical to SEQ ID NO: 157524

SEQ ID NO: 432279 - RNA, 64 nt, hsa; identical to SEQ ID NO: 157525

SEQ ID NO: 432280 - RNA, 64 nt, hsa; identical to SEQ ID NO: 157526

SEQ ID NO: 432281 - RNA, 64 nt, hsa; identical to SEQ ID NO: 157527

SEQ ID NO: 432282 - RNA, 64 nt, hsa; identical to SEQ ID NO: 157528

SEQ ID NO: 432283 - RNA, 64 nt, hsa; identical to SEQ ID NO: 157529

SEQ ID NO: 432284 - RNA, 64 nt, hsa; identical to SEQ ID NO: 157530

SEQ ID NO: 432285 - RNA, 64 nt, hsa; identical to SEQ ID NO: 157531

SEQ ID NO: 432286 - RNA, 64 nt, hsa; identical to SEQ ID NO: 157532

SEQ ID NO: 432287 - RNA, 64 nt, hsa; identical to SEQ ID NO: 157533

SEQ ID NO: 432288 - RNA, 64 nt, hsa; identical to SEQ ID NO: 157534

SEQ ID NO: 432289 - RNA, 64 nt, hsa; identical to SEQ ID NO: 157535

SEQ ID NO: 432290 - RNA, 64 nt, hsa; identical to SEQ ID NO: 157536

SEQ ID NO: 432291 - RNA, 64 nt, hsa; identical to SEQ ID NO: 157537

SEQ ID NO: 432292 - RNA, 64 nt, hsa; identical to SEQ ID NO: 157538

SEQ ID NO: 432293 - RNA, 64 nt, hsa; identical to SEQ ID NO: 157539

SEQ ID NO: 432294 - RNA, 64 nt, hsa; identical to SEQ ID NO: 157540

SEQ ID NO: 432295 - RNA, 64 nt, hsa; identical to SEQ ID NO: 157541

SEQ ID NO: 432296 - RNA, 64 nt, hsa; identical to SEQ ID NO: 157542

SEQ ID NO: 432297 - RNA, 64 nt, hsa; identical to SEQ ID NO: 157543

SEQ ID NO: 432298 - RNA, 64 nt, hsa; identical to SEQ ID NO: 157544

SEQ ID NO: 432299 - RNA, 64 nt, hsa; identical to SEQ ID NO: 157545

SEQ ID NO: 432300 - RNA, 64 nt, hsa; identical to SEQ ID NO: 157546

SEQ ID NO: 432301 - RNA, 64 nt, hsa; identical to SEQ ID NO: 157547

SEQ ID NO: 432302 - RNA, 64 nt, hsa; identical to SEQ ID NO: 157548

SEQ ID NO: 432303 - RNA, 64 nt, hsa; identical to SEQ ID NO: 157549

SEQ ID NO: 432304 - RNA, 64 nt, hsa; identical to SEQ ID NO: 157550

SEQ ID NO: 432305 - RNA, 64 nt, hsa; identical to SEQ ID NO: 157551

SEQ ID NO: 432306 - RNA, 64 nt, hsa; identical to SEQ ID NO: 157552

SEQ ID NO: 432307 - RNA, 64 nt, hsa; identical to SEQ ID NO: 157553

SEQ ID NO: 432308 - RNA, 64 nt, hsa; identical to SEQ ID NO: 157554

SEQ ID NO: 432309 - RNA, 64 nt, hsa; identical to SEQ ID NO: 157555

SEQ ID NO: 432310 - RNA, 64 nt, hsa; identical to SEQ ID NO: 157556

SEQ ID NO: 432311 - RNA, 64 nt, hsa; identical to SEQ ID NO: 157557

SEQ ID NO: 432312 - RNA, 64 nt, hsa; identical to SEQ ID NO: 157558

SEQ ID NO: 432313 - RNA, 64 nt, hsa; identical to SEQ ID NO: 157559

SEQ ID NO: 432314 - RNA, 64 nt, hsa; identical to SEQ ID NO: 157560

SEQ ID NO: 432315 - RNA, 64 nt, hsa; identical to SEQ ID NO: 157561

SEQ ID NO: 432316 - RNA, 64 nt, hsa; identical to SEQ ID NO: 157562

SEQ ID NO: 432317 - RNA, 64 nt, hsa; identical to SEQ ID NO: 157563

SEQ ID NO: 432318 - RNA, 64 nt, hsa; identical to SEQ ID NO: 157564

SEQ ID NO: 432319 - RNA, 64 nt, hsa; identical to SEQ ID NO: 157565

SEQ ID NO: 432320 - RNA, 64 nt, hsa; identical to SEQ ID NO: 157566

SEQ ID NO: 432321 - RNA, 64 nt, hsa; identical to SEQ ID NO: 157567

SEQ ID NO: 432322 - RNA, 64 nt, hsa; identical to SEQ ID NO: 157568

SEQ ID NO: 432323 - RNA, 64 nt, hsa; identical to SEQ ID NO: 157569

SEQ ID NO: 432324 - RNA, 64 nt, hsa; identical to SEQ ID NO: 157570

SEQ ID NO: 432325 - RNA, 64 nt, hsa; identical to SEQ ID NO: 157571

SEQ ID NO: 432326 - RNA, 64 nt, hsa; identical to SEQ ID NO: 157572

SEQ ID NO: 432327 - RNA, 64 nt, hsa; identical to SEQ ID NO: 157573

SEQ ID NO: 432328 - RNA, 64 nt, hsa; identical to SEQ ID NO: 157574

SEQ ID NO: 432329 - RNA, 64 nt, hsa; identical to SEQ ID NO: 157575

SEQ ID NO: 432330 - RNA, 64 nt, hsa; identical to SEQ ID NO: 157576

SEQ ID NO: 432331 - RNA, 64 nt, hsa; identical to SEQ ID NO: 157577

SEQ ID NO: 432332 - RNA, 64 nt, hsa; identical to SEQ ID NO: 157578

SEQ ID NO: 432333 - RNA, 64 nt, hsa; identical to SEQ ID NO: 157579

SEQ ID NO: 432334 - RNA, 64 nt, hsa; identical to SEQ ID NO: 157580

SEQ ID NO: 432335 - RNA, 64 nt, hsa; identical to SEQ ID NO: 157581

SEQ ID NO: 432336 - RNA, 64 nt, hsa; identical to SEQ ID NO: 157582

SEQ ID NO: 432337 - RNA, 64 nt, hsa; identical to SEQ ID NO: 157583

SEQ ID NO: 432338 - RNA, 64 nt, hsa; identical to SEQ ID NO: 157584

SEQ ID NO: 432339 - RNA, 64 nt, hsa; identical to SEQ ID NO: 157585

SEQ ID NO: 432340 - RNA, 64 nt, hsa; identical to SEQ ID NO: 157586

SEQ ID NO: 432341 - RNA, 64 nt, hsa; identical to SEQ ID NO: 157587

SEQ ID NO: 432342 - RNA, 64 nt, hsa; identical to SEQ ID NO: 157588

SEQ ID NO: 432343 - RNA, 64 nt, hsa; identical to SEQ ID NO: 157589

SEQ ID NO: 432344 - RNA, 64 nt, hsa; identical to SEQ ID NO: 157590

SEQ ID NO: 432345 - RNA, 64 nt, hsa; identical to SEQ ID NO: 157591

SEQ ID NO: 432346 - RNA, 64 nt, hsa; identical to SEQ ID NO: 157592

SEQ ID NO: 432347 - RNA, 64 nt, hsa; identical to SEQ ID NO: 157593

SEQ ID NO: 432348 - RNA, 64 nt, hsa; identical to SEQ ID NO: 157594

SEQ ID NO: 432349 - RNA, 64 nt, hsa; identical to SEQ ID NO: 157595

SEQ ID NO: 432350 - RNA, 64 nt, hsa; identical to SEQ ID NO: 157596

SEQ ID NO: 432351 - RNA, 64 nt, hsa; identical to SEQ ID NO: 157597

SEQ ID NO: 432352 - RNA, 64 nt, hsa; identical to SEQ ID NO: 157598

SEQ ID NO: 432353 - RNA, 64 nt, hsa; identical to SEQ ID NO: 157599

SEQ ID NO: 432354 - RNA, 64 nt, hsa; identical to SEQ ID NO: 157600

SEQ ID NO: 432355 - RNA, 64 nt, hsa; identical to SEQ ID NO: 157601

SEQ ID NO: 432356 - RNA, 64 nt, hsa; identical to SEQ ID NO: 157602

SEQ ID NO: 432357 - RNA, 64 nt, hsa; identical to SEQ ID NO: 157603

SEQ ID NO: 432358 - RNA, 64 nt, hsa; identical to SEQ ID NO: 157604

SEQ ID NO: 432359 - RNA, 64 nt, hsa; identical to SEQ ID NO: 157605

SEQ ID NO: 432360 - RNA, 64 nt, hsa; identical to SEQ ID NO: 157606

SEQ ID NO: 432361 - RNA, 64 nt, hsa; identical to SEQ ID NO: 103765

SEQ ID NO: 432362 - RNA, 64 nt, hsa; identical to SEQ ID NO: 103766

SEQ ID NO: 432363 - RNA, 53 nt, hsa; identical to SEQ ID NO: 103767

SEQ ID NO: 432364 - RNA, 64 nt, hsa; identical to SEQ ID NO: 103768

SEQ ID NO: 432365 - RNA, 64 nt, hsa; identical to SEQ ID NO: 103769

SEQ ID NO: 432366 - RNA, 64 nt, hsa; identical to SEQ ID NO: 103770

SEQ ID NO: 432367 - RNA, 53 nt, hsa; identical to SEQ ID NO: 103771

SEQ ID NO: 432368 - RNA, 64 nt, hsa; identical to SEQ ID NO: 103772

SEQ ID NO: 432369 - RNA, 64 nt, hsa; identical to SEQ ID NO: 103773

SEQ ID NO: 432370 - RNA, 64 nt, hsa; identical to SEQ ID NO: 103774

SEQ ID NO: 432371 - RNA, 64 nt, hsa; identical to SEQ ID NO: 103775

SEQ ID NO: 432372 - RNA, 64 nt, hsa; identical to SEQ ID NO: 103776

SEQ ID NO: 432373 - RNA, 64 nt, hsa; identical to SEQ ID NO: 312698

SEQ ID NO: 432374 - RNA, 64 nt, hsa; identical to SEQ ID NO: 312699

SEQ ID NO: 432375 - RNA, 64 nt, hsa; identical to SEQ ID NO: 312700

SEQ ID NO: 432376 - RNA, 64 nt, hsa; identical to SEQ ID NO: 312701

SEQ ID NO: 432377 - RNA, 64 nt, hsa; identical to SEQ ID NO: 312702

SEQ ID NO: 432378 - RNA, 64 nt, hsa; identical to SEQ ID NO: 312703

SEQ ID NO: 432379 - RNA, 64 nt, hsa; identical to SEQ ID NO: 312704

SEQ ID NO: 432380 - RNA, 64 nt, hsa; identical to SEQ ID NO: 312705

SEQ ID NO: 432381 - RNA, 64 nt, hsa; identical to SEQ ID NO: 312706

SEQ ID NO: 432382 - RNA, 64 nt, hsa; identical to SEQ ID NO: 312707

SEQ ID NO: 432383 - RNA, 64 nt, hsa; identical to SEQ ID NO: 312708

SEQ ID NO: 432384 - RNA, 64 nt, hsa; identical to SEQ ID NO: 312709

SEQ ID NO: 432385 - RNA, 64 nt, hsa; identical to SEQ ID NO: 312710

SEQ ID NO: 432386 - RNA, 64 nt, hsa; identical to SEQ ID NO: 312711

SEQ ID NO: 432387 - RNA, 64 nt, hsa; identical to SEQ ID NO: 312712

SEQ ID NO: 432388 - RNA, 64 nt, hsa; identical to SEQ ID NO: 312713

SEQ ID NO: 432389 - RNA, 64 nt, hsa; identical to SEQ ID NO: 312714

SEQ ID NO: 432390 - RNA, 64 nt, hsa; identical to SEQ ID NO: 312715

SEQ ID NO: 432391 - RNA, 64 nt, hsa; identical to SEQ ID NO: 312716

SEQ ID NO: 432392 - RNA, 64 nt, hsa; identical to SEQ ID NO: 312717

SEQ ID NO: 432393 - RNA, 64 nt, hsa; identical to SEQ ID NO: 312718

SEQ ID NO: 432394 - RNA, 64 nt, hsa; identical to SEQ ID NO: 312719

SEQ ID NO: 432395 - RNA, 64 nt, hsa; identical to SEQ ID NO: 312720

SEQ ID NO: 432396 - RNA, 64 nt, hsa; identical to SEQ ID NO: 312721

SEQ ID NO: 432397 - RNA, 64 nt, hsa; identical to SEQ ID NO: 312722

SEQ ID NO: 432398 - RNA, 64 nt, hsa; identical to SEQ ID NO: 312723

SEQ ID NO: 432399 - RNA, 64 nt, hsa; identical to SEQ ID NO: 312724

SEQ ID NO: 432400 - RNA, 64 nt, hsa; identical to SEQ ID NO: 312725

SEQ ID NO: 432401 - RNA, 64 nt, hsa; identical to SEQ ID NO: 312726

SEQ ID NO: 432402 - RNA, 64 nt, hsa; identical to SEQ ID NO: 312727

SEQ ID NO: 432403 - RNA, 64 nt, hsa; identical to SEQ ID NO: 312728

SEQ ID NO: 432404 - RNA, 64 nt, hsa; identical to SEQ ID NO: 312729

SEQ ID NO: 432405 - RNA, 64 nt, hsa; identical to SEQ ID NO: 312730

SEQ ID NO: 432406 - RNA, 64 nt, hsa; identical to SEQ ID NO: 312731

SEQ ID NO: 432407 - RNA, 64 nt, hsa; identical to SEQ ID NO: 312732

SEQ ID NO: 432408 - RNA, 64 nt, hsa; identical to SEQ ID NO: 312733

SEQ ID NO: 432409 - RNA, 64 nt, hsa; identical to SEQ ID NO: 312734

SEQ ID NO: 432410 - RNA, 64 nt, hsa; identical to SEQ ID NO: 312735

SEQ ID NO: 432411 - RNA, 64 nt, hsa; identical to SEQ ID NO: 312736

SEQ ID NO: 432412 - RNA, 64 nt, hsa; identical to SEQ ID NO: 312737

SEQ ID NO: 432413 - RNA, 64 nt, hsa; identical to SEQ ID NO: 312738

SEQ ID NO: 432414 - RNA, 64 nt, hsa; identical to SEQ ID NO: 312739

SEQ ID NO: 432415 - RNA, 64 nt, hsa; identical to SEQ ID NO: 312740

SEQ ID NO: 432416 - RNA, 64 nt, hsa; identical to SEQ ID NO: 312741

SEQ ID NO: 432417 - RNA, 64 nt, hsa; identical to SEQ ID NO: 312742

SEQ ID NO: 432418 - RNA, 64 nt, hsa; identical to SEQ ID NO: 312743

SEQ ID NO: 432419 - RNA, 64 nt, hsa; identical to SEQ ID NO: 312744

SEQ ID NO: 432420 - RNA, 64 nt, hsa; identical to SEQ ID NO: 312745

SEQ ID NO: 432421 - RNA, 64 nt, hsa; identical to SEQ ID NO: 312746

SEQ ID NO: 432422 - RNA, 64 nt, hsa; identical to SEQ ID NO: 312747

SEQ ID NO: 432423 - RNA, 64 nt, hsa; identical to SEQ ID NO: 312748

SEQ ID NO: 432424 - RNA, 64 nt, hsa; identical to SEQ ID NO: 312749

SEQ ID NO: 432425 - RNA, 64 nt, hsa; identical to SEQ ID NO: 312750

SEQ ID NO: 432426 - RNA, 64 nt, hsa; identical to SEQ ID NO: 312751

SEQ ID NO: 432427 - RNA, 64 nt, hsa; identical to SEQ ID NO: 312752

SEQ ID NO: 432428 - RNA, 64 nt, hsa; identical to SEQ ID NO: 312753

SEQ ID NO: 432429 - RNA, 64 nt, hsa; identical to SEQ ID NO: 312754

SEQ ID NO: 432430 - RNA, 64 nt, hsa; identical to SEQ ID NO: 312755

SEQ ID NO: 432431 - RNA, 64 nt, hsa; identical to SEQ ID NO: 312756

SEQ ID NO: 432432 - RNA, 64 nt, hsa; identical to SEQ ID NO: 312757

SEQ ID NO: 432433 - RNA, 64 nt, hsa; identical to SEQ ID NO: 312758

SEQ ID NO: 432434 - RNA, 64 nt, hsa; identical to SEQ ID NO: 312759

SEQ ID NO: 432435 - RNA, 64 nt, hsa; identical to SEQ ID NO: 312760

SEQ ID NO: 432436 - RNA, 64 nt, hsa; identical to SEQ ID NO: 312761

SEQ ID NO: 432437 - RNA, 64 nt, hsa; identical to SEQ ID NO: 312762

SEQ ID NO: 432438 - RNA, 64 nt, hsa; identical to SEQ ID NO: 312763

SEQ ID NO: 432439 - RNA, 64 nt, hsa; identical to SEQ ID NO: 312764

SEQ ID NO: 432440 - RNA, 64 nt, hsa; identical to SEQ ID NO: 312765

SEQ ID NO: 432441 - RNA, 64 nt, hsa; identical to SEQ ID NO: 312766

SEQ ID NO: 432442 - RNA, 64 nt, hsa; identical to SEQ ID NO: 312767

SEQ ID NO: 432443 - RNA, 64 nt, hsa; identical to SEQ ID NO: 312768

SEQ ID NO: 432444 - RNA, 64 nt, hsa; identical to SEQ ID NO: 312769

SEQ ID NO: 432445 - RNA, 64 nt, hsa; identical to SEQ ID NO: 312770

SEQ ID NO: 432446 - RNA, 64 nt, hsa; identical to SEQ ID NO: 312771

SEQ ID NO: 432447 - RNA, 64 nt, hsa; identical to SEQ ID NO: 312772

SEQ ID NO: 432448 - RNA, 64 nt, hsa; identical to SEQ ID NO: 312773

SEQ ID NO: 432449 - RNA, 64 nt, hsa; identical to SEQ ID NO: 312774

SEQ ID NO: 432450 - RNA, 64 nt, hsa; identical to SEQ ID NO: 312775

SEQ ID NO: 432451 - RNA, 64 nt, hsa; identical to SEQ ID NO: 312776

SEQ ID NO: 432452 - RNA, 64 nt, hsa; identical to SEQ ID NO: 312777

SEQ ID NO: 432453 - RNA, 64 nt, hsa; identical to SEQ ID NO: 312778

SEQ ID NO: 432454 - RNA, 64 nt, hsa; identical to SEQ ID NO: 312779

SEQ ID NO: 432455 - RNA, 64 nt, hsa; identical to SEQ ID NO: 312780

SEQ ID NO: 432456 - RNA, 64 nt, hsa; identical to SEQ ID NO: 312781

SEQ ID NO: 432457 - RNA, 64 nt, hsa; identical to SEQ ID NO: 312782

SEQ ID NO: 432458 - RNA, 64 nt, hsa; identical to SEQ ID NO: 312783

SEQ ID NO: 432459 - RNA, 64 nt, hsa; identical to SEQ ID NO: 312784

SEQ ID NO: 432460 - RNA, 64 nt, hsa; identical to SEQ ID NO: 312785

SEQ ID NO: 432461 - RNA, 64 nt, hsa; identical to SEQ ID NO: 312786

SEQ ID NO: 432462 - RNA, 64 nt, hsa; identical to SEQ ID NO: 312787

SEQ ID NO: 432463 - RNA, 64 nt, hsa; identical to SEQ ID NO: 312788

SEQ ID NO: 432464 - RNA, 64 nt, hsa; identical to SEQ ID NO: 312789

SEQ ID NO: 432465 - RNA, 64 nt, hsa; identical to SEQ ID NO: 312790

SEQ ID NO: 432466 - RNA, 64 nt, hsa; identical to SEQ ID NO: 312791

SEQ ID NO: 432467 - RNA, 64 nt, hsa; identical to SEQ ID NO: 312792

SEQ ID NO: 432468 - RNA, 64 nt, hsa; identical to SEQ ID NO: 312793

SEQ ID NO: 432469 - RNA, 64 nt, hsa; identical to SEQ ID NO: 312794

SEQ ID NO: 432470 - RNA, 64 nt, hsa; identical to SEQ ID NO: 312795

SEQ ID NO: 432471 - RNA, 64 nt, hsa; identical to SEQ ID NO: 312796

SEQ ID NO: 432472 - RNA, 64 nt, hsa; identical to SEQ ID NO: 312797

SEQ ID NO: 432473 - RNA, 64 nt, hsa; identical to SEQ ID NO: 312798

SEQ ID NO: 432474 - RNA, 64 nt, hsa; identical to SEQ ID NO: 312799

SEQ ID NO: 432475 - RNA, 64 nt, hsa; identical to SEQ ID NO: 312800

SEQ ID NO: 432476 - RNA, 64 nt, hsa; identical to SEQ ID NO: 312801

SEQ ID NO: 432477 - RNA, 64 nt, hsa; identical to SEQ ID NO: 312802

SEQ ID NO: 432478 - RNA, 64 nt, hsa; identical to SEQ ID NO: 312803

SEQ ID NO: 432479 - RNA, 64 nt, hsa; identical to SEQ ID NO: 312804

SEQ ID NO: 432480 - RNA, 64 nt, hsa; identical to SEQ ID NO: 312805

SEQ ID NO: 432481 - RNA, 64 nt, hsa; identical to SEQ ID NO: 312806

SEQ ID NO: 432482 - RNA, 64 nt, hsa; identical to SEQ ID NO: 312807

SEQ ID NO: 432483 - RNA, 64 nt, hsa; identical to SEQ ID NO: 312808

SEQ ID NO: 432484 - RNA, 64 nt, hsa; identical to SEQ ID NO: 312809

SEQ ID NO: 432485 - RNA, 64 nt, hsa; identical to SEQ ID NO: 312810

SEQ ID NO: 432486 - RNA, 64 nt, hsa; identical to SEQ ID NO: 312811

SEQ ID NO: 432487 - RNA, 64 nt, hsa; identical to SEQ ID NO: 312812

SEQ ID NO: 432488 - RNA, 64 nt, hsa; identical to SEQ ID NO: 312813

SEQ ID NO: 432489 - RNA, 64 nt, hsa; identical to SEQ ID NO: 312814

SEQ ID NO: 432490 - RNA, 64 nt, hsa; identical to SEQ ID NO: 312815

SEQ ID NO: 432491 - RNA, 64 nt, hsa; identical to SEQ ID NO: 312816

SEQ ID NO: 432492 - RNA, 64 nt, hsa; identical to SEQ ID NO: 312817

SEQ ID NO: 432493 - RNA, 64 nt, hsa; identical to SEQ ID NO: 312818

SEQ ID NO: 432494 - RNA, 64 nt, hsa; identical to SEQ ID NO: 312819

SEQ ID NO: 432495 - RNA, 64 nt, hsa; identical to SEQ ID NO: 312820

SEQ ID NO: 432496 - RNA, 64 nt, hsa; identical to SEQ ID NO: 312821

SEQ ID NO: 432497 - RNA, 64 nt, hsa; identical to SEQ ID NO: 312822

SEQ ID NO: 432498 - RNA, 64 nt, hsa; identical to SEQ ID NO: 312823

SEQ ID NO: 432499 - RNA, 64 nt, hsa; identical to SEQ ID NO: 312824

SEQ ID NO: 432500 - RNA, 64 nt, hsa; identical to SEQ ID NO: 312825

SEQ ID NO: 432501 - RNA, 64 nt, hsa; identical to SEQ ID NO: 312826

SEQ ID NO: 432502 - RNA, 64 nt, hsa; identical to SEQ ID NO: 312827

SEQ ID NO: 432503 - RNA, 64 nt, hsa; identical to SEQ ID NO: 312828

SEQ ID NO: 432504 - RNA, 64 nt, hsa; identical to SEQ ID NO: 312829

SEQ ID NO: 432505 - RNA, 64 nt, hsa; identical to SEQ ID NO: 312830

SEQ ID NO: 432506 - RNA, 64 nt, hsa; identical to SEQ ID NO: 312831

SEQ ID NO: 432507 - RNA, 64 nt, hsa; identical to SEQ ID NO: 312832

SEQ ID NO: 432508 - RNA, 64 nt, hsa; identical to SEQ ID NO: 312833

SEQ ID NO: 432509 - RNA, 64 nt, hsa; identical to SEQ ID NO: 312834

SEQ ID NO: 432510 - RNA, 64 nt, hsa; identical to SEQ ID NO: 312835

SEQ ID NO: 432511 - RNA, 64 nt, hsa; identical to SEQ ID NO: 312836

SEQ ID NO: 432512 - RNA, 64 nt, hsa; identical to SEQ ID NO: 312837

SEQ ID NO: 432513 - RNA, 64 nt, hsa; identical to SEQ ID NO: 312838

SEQ ID NO: 432514 - RNA, 64 nt, hsa; identical to SEQ ID NO: 312839

SEQ ID NO: 432515 - RNA, 64 nt, hsa; identical to SEQ ID NO: 312840

SEQ ID NO: 432516 - RNA, 64 nt, hsa; identical to SEQ ID NO: 312841

SEQ ID NO: 432517 - RNA, 64 nt, hsa; identical to SEQ ID NO: 312842

SEQ ID NO: 432518 - RNA, 64 nt, hsa; identical to SEQ ID NO: 312843

SEQ ID NO: 432519 - RNA, 64 nt, hsa; identical to SEQ ID NO: 312844

SEQ ID NO: 432520 - RNA, 64 nt, hsa; identical to SEQ ID NO: 312845

SEQ ID NO: 432521 - RNA, 64 nt, hsa; identical to SEQ ID NO: 312846

SEQ ID NO: 432522 - RNA, 64 nt, hsa; identical to SEQ ID NO: 312847

SEQ ID NO: 432523 - RNA, 64 nt, hsa; identical to SEQ ID NO: 312848

SEQ ID NO: 432524 - RNA, 64 nt, hsa; identical to SEQ ID NO: 312849

SEQ ID NO: 432525 - RNA, 64 nt, hsa; identical to SEQ ID NO: 312850

SEQ ID NO: 432526 - RNA, 64 nt, hsa; identical to SEQ ID NO: 312851

SEQ ID NO: 432527 - RNA, 64 nt, hsa; identical to SEQ ID NO: 312852

SEQ ID NO: 432528 - RNA, 64 nt, hsa; identical to SEQ ID NO: 312853

SEQ ID NO: 432529 - RNA, 64 nt, hsa
ugcugucuuuacaugggguuuucaauuuugcaugcucgauuauucccuguacaauauuuaaaau

SEQ ID NO: 432530 - RNA, 64 nt, hsa
ugaagauguuaggacuucaaaggauuuuucuuuacucgauuaguuuuguuuaucaaaugauuuc

SEQ ID NO: 432531 - RNA, 64 nt, hsa
guaugcuugguagaagucaucgccauucuccauucucgauuaaccagggacacaaugcacagca

SEQ ID NO: 432532 - RNA, 64 nt, hsa
cuuaggggaacccugucccuccuaacaaguguaucucgauuaauaaccugccagucccagauca

SEQ ID NO: 432533 - RNA, 64 nt, hsa
auucuuuauuaacccuccuuggaauuuugaaaaccucgauuaaaguugccaaauugauuacugg

SEQ ID NO: 432534 - RNA, 64 nt, hsa
cauuuccugguuuuuuuuaccaccuuauuuaaaucucgauuaucugcucucucuuuuauauaca

SEQ ID NO: 432535 - RNA, 64 nt, hsa
aaccccgccugggccucccuuggucugcccagcccucgauuagcccugccugaaucaguagaua

SEQ ID NO: 432536 - RNA, 64 nt, hsa
aguaccaaagcauuaccgcaugguagagaacacacucgauuaaaaauguuaagcuaucugaaaa

SEQ ID NO: 432537 - RNA, 64 nt, hsa
uucucaacagauguuaagguacaacuguguuuuucucgauuaucuaaaaaccauaguacuuaaa

SEQ ID NO: 432538 - RNA, 64 nt, hsa
caccauccucaaucuggagcgggugaccgagauccucgauuacuggggacccaauuccggccca

SEQ ID NO: 432539 - RNA, 64 nt, hsa
acagcagggcguuuacauagaaagacguuuuggucucgauuagcuccgaugcuuugcacugaag

SEQ ID NO: 432540 - RNA, 64 nt, hsa
gaagacauuuucaucucuguauuauuugcaccuacucgauuaucuugcauguuggcuagacuag

SEQ ID NO: 432541 - RNA, 64 nt, hsa
auggcagucagacucaaacccgugacacuccaaacucgauuaugcuccagggcccacuuucuaa

SEQ ID NO: 432542 - RNA, 64 nt, hsa
cuuucuguaaagaaugguacaagacagguuguuacucgauuauuuauaguaaaauaugugggaa

SEQ ID NO: 432543 - RNA, 64 nt, hsa
cuaaggcuaauaaugagauguaacucaugaaugucucgauuagacuccauguaguuacuuccuu

SEQ ID NO: 432544 - RNA, 64 nt, hsa
gaugaaauuaugguuugcacugucuauuaaauaucucgauuaauuuucauacuuugcuguugug

SEQ ID NO: 432545 - RNA, 64 nt, hsa
cucggcgcccaaaucucaucaguuuuauugccugcucgauuauauagaaaaauacaaaaaaucu

SEQ ID NO: 432546 - RNA, 64 nt, hsa
ugcuuuuauuuacacgacagcgacucaaaaggcacucgauuaaugugacaaccuuuucaauaag

SEQ ID NO: 432547 - RNA, 64 nt, hsa
accuaugcacauccucccauacuuuaagucaucucucgauuauuuguaacaccuaauacaaugu

SEQ ID NO: 432548 - RNA, 64 nt, hsa; identical to SEQ ID NO: 236642

SEQ ID NO: 432549 - RNA, 64 nt, hsa; identical to SEQ ID NO: 236643

SEQ ID NO: 432550 - RNA, 64 nt, hsa; identical to SEQ ID NO: 236644

SEQ ID NO: 432551 - RNA, 64 nt, hsa; identical to SEQ ID NO: 236645

SEQ ID NO: 432552 - RNA, 64 nt, hsa
uaguuuaucuuauacuccugguuugauuugauuagcauauuaacgugaaaguaggauagcuacu

SEQ ID NO: 432553 - RNA, 64 nt, hsa
uuccuucuaaagagacuaauuugagaguacaggugcauauuaauuuucuugguucuuucagcug

SEQ ID NO: 432554 - RNA, 64 nt, hsa
gaucauuauuuuugcugcguagcuuacagacuuagcauauuaguuuuuucuacuccuacaagug

SEQ ID NO: 432555 - RNA, 64 nt, hsa
uauuuuuuauucauucaaauguauuuuuucuugugcauauuauaaaaauauauuuuaugagcuc

SEQ ID NO: 432556 - RNA, 64 nt, hsa
ucauuaaguaauuuaauaaaaaaauugugaaacagcauauuacaaguuugaaaauucagggcug

SEQ ID NO: 432557 - RNA, 64 nt, hsa
uccaguugugacccguuuuccaaccaguucugcagcauauuagauucuagacaagcaacacccc

SEQ ID NO: 432558 - RNA, 64 nt, hsa; identical to SEQ ID NO: 61116

SEQ ID NO: 432559 - RNA, 64 nt, hsa; identical to SEQ ID NO: 61117

SEQ ID NO: 432560 - RNA, 64 nt, hsa; identical to SEQ ID NO: 61118

SEQ ID NO: 432561 - RNA, 64 nt, hsa; identical to SEQ ID NO: 61119

SEQ ID NO: 432562 - RNA, 64 nt, hsa; identical to SEQ ID NO: 97063

SEQ ID NO: 432563 - RNA, 64 nt, hsa; identical to SEQ ID NO: 97064

SEQ ID NO: 432564 - RNA, 64 nt, hsa; identical to SEQ ID NO: 97065

SEQ ID NO: 432565 - RNA, 64 nt, hsa; identical to SEQ ID NO: 97066

SEQ ID NO: 432566 - RNA, 64 nt, hsa; identical to SEQ ID NO: 97067

SEQ ID NO: 432567 - RNA, 64 nt, hsa; identical to SEQ ID NO: 97068

SEQ ID NO: 432568 - RNA, 64 nt, hsa; identical to SEQ ID NO: 97069

SEQ ID NO: 432569 - RNA, 64 nt, hsa; identical to SEQ ID NO: 97070

SEQ ID NO: 432570 - RNA, 64 nt, hsa; identical to SEQ ID NO: 97071

SEQ ID NO: 432571 - RNA, 64 nt, hsa; identical to SEQ ID NO: 97072

SEQ ID NO: 432572 - RNA, 64 nt, hsa; identical to SEQ ID NO: 97073

SEQ ID NO: 432573 - RNA, 64 nt, hsa; identical to SEQ ID NO: 97074

SEQ ID NO: 432574 - RNA, 64 nt, hsa; identical to SEQ ID NO: 97075

SEQ ID NO: 432575 - RNA, 64 nt, hsa; identical to SEQ ID NO: 97076

SEQ ID NO: 432576 - RNA, 64 nt, hsa; identical to SEQ ID NO: 97077

SEQ ID NO: 432577 - RNA, 64 nt, hsa; identical to SEQ ID NO: 97078

SEQ ID NO: 432578 - RNA, 64 nt, hsa; identical to SEQ ID NO: 97079

SEQ ID NO: 432579 - RNA, 64 nt, hsa; identical to SEQ ID NO: 97080

SEQ ID NO: 432580 - RNA, 64 nt, hsa; identical to SEQ ID NO: 97081

SEQ ID NO: 432581 - RNA, 64 nt, hsa; identical to SEQ ID NO: 97082

SEQ ID NO: 432582 - RNA, 64 nt, hsa; identical to SEQ ID NO: 97083

SEQ ID NO: 432583 - RNA, 64 nt, hsa; identical to SEQ ID NO: 97084

SEQ ID NO: 432584 - RNA, 64 nt, hsa; identical to SEQ ID NO: 97085

SEQ ID NO: 432585 - RNA, 64 nt, hsa; identical to SEQ ID NO: 97086

SEQ ID NO: 432586 - RNA, 64 nt, hsa; identical to SEQ ID NO: 97087

SEQ ID NO: 432587 - RNA, 64 nt, hsa; identical to SEQ ID NO: 301756

SEQ ID NO: 432588 - RNA, 64 nt, hsa; identical to SEQ ID NO: 301757

SEQ ID NO: 432589 - RNA, 64 nt, hsa; identical to SEQ ID NO: 301758

SEQ ID NO: 432590 - RNA, 64 nt, hsa; identical to SEQ ID NO: 301759

SEQ ID NO: 432591 - RNA, 64 nt, hsa; identical to SEQ ID NO: 301760

SEQ ID NO: 432592 - RNA, 64 nt, hsa; identical to SEQ ID NO: 301761

SEQ ID NO: 432593 - RNA, 64 nt, hsa; identical to SEQ ID NO: 301762

SEQ ID NO: 432594 - RNA, 64 nt, hsa; identical to SEQ ID NO: 301763

SEQ ID NO: 432595 - RNA, 64 nt, hsa; identical to SEQ ID NO: 301764

SEQ ID NO: 432596 - RNA, 64 nt, hsa; identical to SEQ ID NO: 301765

SEQ ID NO: 432597 - RNA, 64 nt, hsa; identical to SEQ ID NO: 301766

SEQ ID NO: 432598 - RNA, 64 nt, hsa; identical to SEQ ID NO: 301767

SEQ ID NO: 432599 - RNA, 64 nt, hsa; identical to SEQ ID NO: 301768

SEQ ID NO: 432600 - RNA, 64 nt, hsa; identical to SEQ ID NO: 301769

SEQ ID NO: 432601 - RNA, 64 nt, hsa; identical to SEQ ID NO: 301770

SEQ ID NO: 432602 - RNA, 64 nt, hsa; identical to SEQ ID NO: 301771

SEQ ID NO: 432603 - RNA, 64 nt, hsa; identical to SEQ ID NO: 301772

SEQ ID NO: 432604 - RNA, 64 nt, hsa; identical to SEQ ID NO: 301773

SEQ ID NO: 432605 - RNA, 64 nt, hsa; identical to SEQ ID NO: 301774

SEQ ID NO: 432606 - RNA, 64 nt, hsa; identical to SEQ ID NO: 301775

SEQ ID NO: 432607 - RNA, 64 nt, hsa; identical to SEQ ID NO: 301776

SEQ ID NO: 432608 - RNA, 64 nt, hsa; identical to SEQ ID NO: 301777

SEQ ID NO: 432609 - RNA, 64 nt, hsa; identical to SEQ ID NO: 301778

SEQ ID NO: 432610 - RNA, 64 nt, hsa; identical to SEQ ID NO: 301779

SEQ ID NO: 432611 - RNA, 64 nt, hsa; identical to SEQ ID NO: 301780

SEQ ID NO: 432612 - RNA, 64 nt, hsa; identical to SEQ ID NO: 301781

SEQ ID NO: 432613 - RNA, 64 nt, hsa; identical to SEQ ID NO: 301782

SEQ ID NO: 432614 - RNA, 64 nt, hsa; identical to SEQ ID NO: 301783

SEQ ID NO: 432615 - RNA, 64 nt, hsa; identical to SEQ ID NO: 301784

SEQ ID NO: 432616 - RNA, 64 nt, hsa; identical to SEQ ID NO: 301785

SEQ ID NO: 432617 - RNA, 64 nt, hsa; identical to SEQ ID NO: 301786

SEQ ID NO: 432618 - RNA, 64 nt, hsa; identical to SEQ ID NO: 301787

SEQ ID NO: 432619 - RNA, 64 nt, hsa; identical to SEQ ID NO: 301788

SEQ ID NO: 432620 - RNA, 64 nt, hsa; identical to SEQ ID NO: 301789

SEQ ID NO: 432621 - RNA, 64 nt, hsa; identical to SEQ ID NO: 301790

SEQ ID NO: 432622 - RNA, 64 nt, hsa; identical to SEQ ID NO: 301791

SEQ ID NO: 432623 - RNA, 64 nt, hsa; identical to SEQ ID NO: 301792

SEQ ID NO: 432624 - RNA, 64 nt, hsa; identical to SEQ ID NO: 365461

SEQ ID NO: 432625 - RNA, 64 nt, hsa; identical to SEQ ID NO: 365462

SEQ ID NO: 432626 - RNA, 64 nt, hsa; identical to SEQ ID NO: 365463

SEQ ID NO: 432627 - RNA, 64 nt, hsa; identical to SEQ ID NO: 365464

SEQ ID NO: 432628 - RNA, 64 nt, hsa; identical to SEQ ID NO: 365465

SEQ ID NO: 432629 - RNA, 64 nt, hsa; identical to SEQ ID NO: 365466

SEQ ID NO: 432630 - RNA, 64 nt, hsa; identical to SEQ ID NO: 365467

SEQ ID NO: 432631 - RNA, 64 nt, hsa; identical to SEQ ID NO: 365468

SEQ ID NO: 432632 - RNA, 64 nt, hsa; identical to SEQ ID NO: 365469

SEQ ID NO: 432633 - RNA, 64 nt, hsa; identical to SEQ ID NO: 365470

SEQ ID NO: 432634 - RNA, 64 nt, hsa; identical to SEQ ID NO: 365471

SEQ ID NO: 432635 - RNA, 64 nt, hsa; identical to SEQ ID NO: 365472

SEQ ID NO: 432636 - RNA, 64 nt, hsa; identical to SEQ ID NO: 365473

SEQ ID NO: 432637 - RNA, 64 nt, hsa; identical to SEQ ID NO: 365474

SEQ ID NO: 432638 - RNA, 64 nt, hsa; identical to SEQ ID NO: 365475

SEQ ID NO: 432639 - RNA, 64 nt, hsa; identical to SEQ ID NO: 365476

SEQ ID NO: 432640 - RNA, 64 nt, hsa; identical to SEQ ID NO: 365477

SEQ ID NO: 432641 - RNA, 64 nt, hsa; identical to SEQ ID NO: 365478

SEQ ID NO: 432642 - RNA, 64 nt, hsa; identical to SEQ ID NO: 365479

SEQ ID NO: 432643 - RNA, 62 nt, hsa; identical to SEQ ID NO: 365480

SEQ ID NO: 432644 - RNA, 64 nt, hsa; identical to SEQ ID NO: 365481

SEQ ID NO: 432645 - RNA, 64 nt, hsa; identical to SEQ ID NO: 365482

SEQ ID NO: 432646 - RNA, 64 nt, hsa; identical to SEQ ID NO: 365483

SEQ ID NO: 432647 - RNA, 64 nt, hsa; identical to SEQ ID NO: 365484

SEQ ID NO: 432648 - RNA, 64 nt, hsa; identical to SEQ ID NO: 365485

SEQ ID NO: 432649 - RNA, 64 nt, hsa; identical to SEQ ID NO: 365486

SEQ ID NO: 432650 - RNA, 64 nt, hsa; identical to SEQ ID NO: 365487

SEQ ID NO: 432651 - RNA, 64 nt, hsa; identical to SEQ ID NO: 365488

SEQ ID NO: 432652 - RNA, 64 nt, hsa; identical to SEQ ID NO: 365489

SEQ ID NO: 432653 - RNA, 64 nt, hsa; identical to SEQ ID NO: 365490

SEQ ID NO: 432654 - RNA, 64 nt, hsa; identical to SEQ ID NO: 365491

SEQ ID NO: 432655 - RNA, 64 nt, hsa; identical to SEQ ID NO: 365492

SEQ ID NO: 432656 - RNA, 64 nt, hsa; identical to SEQ ID NO: 365493

SEQ ID NO: 432657 - RNA, 64 nt, hsa; identical to SEQ ID NO: 365494

SEQ ID NO: 432658 - RNA, 64 nt, hsa; identical to SEQ ID NO: 365495

SEQ ID NO: 432659 - RNA, 64 nt, hsa; identical to SEQ ID NO: 365496

SEQ ID NO: 432660 - RNA, 64 nt, hsa; identical to SEQ ID NO: 365497

SEQ ID NO: 432661 - RNA, 64 nt, hsa; identical to SEQ ID NO: 365498

SEQ ID NO: 432662 - RNA, 64 nt, hsa; identical to SEQ ID NO: 365499

SEQ ID NO: 432663 - RNA, 64 nt, hsa; identical to SEQ ID NO: 365500

SEQ ID NO: 432664 - RNA, 64 nt, hsa; identical to SEQ ID NO: 365501

SEQ ID NO: 432665 - RNA, 64 nt, hsa; identical to SEQ ID NO: 365502

SEQ ID NO: 432666 - RNA, 64 nt, hsa; identical to SEQ ID NO: 365503

SEQ ID NO: 432667 - RNA, 64 nt, hsa; identical to SEQ ID NO: 365504

SEQ ID NO: 432668 - RNA, 56 nt, hsa; identical to SEQ ID NO: 365505

SEQ ID NO: 432669 - RNA, 64 nt, hsa; identical to SEQ ID NO: 365506

SEQ ID NO: 432670 - RNA, 64 nt, hsa; identical to SEQ ID NO: 365507

SEQ ID NO: 432671 - RNA, 64 nt, hsa; identical to SEQ ID NO: 365508

SEQ ID NO: 432672 - RNA, 64 nt, hsa; identical to SEQ ID NO: 365509

SEQ ID NO: 432673 - RNA, 64 nt, hsa; identical to SEQ ID NO: 365510

SEQ ID NO: 432674 - RNA, 64 nt, hsa; identical to SEQ ID NO: 365511

SEQ ID NO: 432675 - RNA, 64 nt, hsa; identical to SEQ ID NO: 365512

SEQ ID NO: 432676 - RNA, 64 nt, hsa; identical to SEQ ID NO: 365513

SEQ ID NO: 432677 - RNA, 64 nt, hsa; identical to SEQ ID NO: 365514

SEQ ID NO: 432678 - RNA, 64 nt, hsa; identical to SEQ ID NO: 365515

SEQ ID NO: 432679 - RNA, 64 nt, hsa; identical to SEQ ID NO: 365516

SEQ ID NO: 432680 - RNA, 64 nt, hsa; identical to SEQ ID NO: 365517

SEQ ID NO: 432681 - RNA, 64 nt, hsa; identical to SEQ ID NO: 365518

SEQ ID NO: 432682 - RNA, 64 nt, hsa; identical to SEQ ID NO: 365519

SEQ ID NO: 432683 - RNA, 64 nt, hsa; identical to SEQ ID NO: 365520

SEQ ID NO: 432684 - RNA, 64 nt, hsa; identical to SEQ ID NO: 365521

SEQ ID NO: 432685 - RNA, 64 nt, hsa; identical to SEQ ID NO: 365522

SEQ ID NO: 432686 - RNA, 64 nt, hsa; identical to SEQ ID NO: 365523

SEQ ID NO: 432687 - RNA, 64 nt, hsa; identical to SEQ ID NO: 365524

SEQ ID NO: 432688 - RNA, 64 nt, hsa; identical to SEQ ID NO: 365525

SEQ ID NO: 432689 - RNA, 64 nt, hsa
gagggacucaacacgcugauucuccuccugccucucccgugagucuccagccugcccagcaccg

SEQ ID NO: 432690 - RNA, 64 nt, hsa
gcgcggugugggcugggccugcgcuggaagcauaucccgugaaaaguguuagugccuuagguga

SEQ ID NO: 432691 - RNA, 64 nt, hsa
aaacggcucuucauuagcuuggaguggccgcaggucccgugaccagcacccgcgagacccugug

SEQ ID NO: 432692 - RNA, 64 nt, hsa
ucuccccagguguggucacucaccugucuaccacucccgugaaauggcagcucgugccuugguc

SEQ ID NO: 432693 - RNA, 64 nt, hsa
guaauagcauuuuugccugccucgaggcagaguuucccgugagcaauaaacucagcuuuuuugu

SEQ ID NO: 432694 - RNA, 60 nt, hsa
cugcccagaugcgggucugaaccugagcccucccgugacagccggcaggcccagcccauc

SEQ ID NO: 432695 - RNA, 64 nt, hsa
ccaaacacccacauaccuggcccaaccagacuucucccgugagccaggcaaaggaaauugucau

SEQ ID NO: 432696 - RNA, 64 nt, hsa
ucuuucugccuccaccccuggguccauggagcuuucccgugauugcucuuucuggcccuagaua

SEQ ID NO: 432697 - RNA, 64 nt, hsa
gugaucucacuuaaaucuauauacaaagccuuggucccgugaaaacacucgugugcccaccagc

SEQ ID NO: 432698 - RNA, 64 nt, hsa
gccccucugcaacuggagagaaaauuaauuccuaucccgugaguggauugugagaaauuccacc

SEQ ID NO: 432699 - RNA, 64 nt, hsa
caagacauaguuucauuuuagaggacccccaaaaucccgugaauucucuggugaugauucuagc

SEQ ID NO: 432700 - RNA, 64 nt, hsa
uuaauuuuugagaucuuacugcuugucacuugaaucccgugauugucauacaucucugguauaa

SEQ ID NO: 432701 - RNA, 64 nt, hsa
aaacauuuuaaaacucuucccuuucaccuccaauucccgugaucccaaaagaagaggaagacuc

SEQ ID NO: 432702 - RNA, 64 nt, hsa
cagcaucccauauugggccagccaugagccagcuucccgugacugcucagcccuuggcucccuc

SEQ ID NO: 432703 - RNA, 64 nt, hsa
agucccagcuacucgggaggcugaggugggaggaucccgugagccugggagguggaguuugcag

SEQ ID NO: 432704 - RNA, 64 nt, hsa
cucaauccagaaggauggugugaacucgguugggucccgugacucgagcuccuaccaguggcug

SEQ ID NO: 432705 - RNA, 64 nt, hsa
uucuggcaucaccuugugccggugggggcugggcucccgugagguccuagggcagaaggaggug

SEQ ID NO: 432706 - RNA, 64 nt, hsa
cuuguguguguugucaaggggacccuccguggccucccgugagugcaugccuguagugcacagu

SEQ ID NO: 432707 - RNA, 64 nt, hsa
ucuccaucuggggaaaaaaauuaaauaaauaaacucccgugacuugcauguuugcuucugggac

SEQ ID NO: 432708 - RNA, 64 nt, hsa
agaaagagggacaagaggguucacacagcccaguucccgugacgaggcucaaaaacuugaucac

SEQ ID NO: 432709 - RNA, 64 nt, hsa
aauaucuugccaacauuguaaugacaaaauaaauucccgugaaguuccacaaccaggccgggca

SEQ ID NO: 432710 - RNA, 64 nt, hsa
ugguugggucagauuuauuuguuugauuuucauaucccgugaaaguuuuuaauucauauuuuuc

SEQ ID NO: 432711 - RNA, 64 nt, hsa
cgccaagggcuaccuuggaacgcaccgaggagcgucccgugaguucaaagcaguggccgugaug

SEQ ID NO: 432712 - RNA, 64 nt, hsa
ugcacaaacuugcacauuggaaagugcaacaaguucccgugauugcaguaaaaauauuuacuau

SEQ ID NO: 432713 - RNA, 64 nt, hsa
acaccaggcaccccugggacaccuaacgcccaguucccgugaccccaacugcaggcccccccua

SEQ ID NO: 432714 - RNA, 64 nt, hsa
gguguguguagaacugacacgcuugaagucccugucccgugacccacccucagguacuugcugu

SEQ ID NO: 432715 - RNA, 64 nt, hsa
gaagaaaugcucauaaagaggaucagaccuucuuucccgugaaaccaguauuuggcgccauaua

SEQ ID NO: 432716 - RNA, 64 nt, hsa
cgcacaguacaguuucagaggacagcagucuccuucccgugaagcucccaugugcuggaauggc

SEQ ID NO: 432717 - RNA, 64 nt, hsa
cuggagcaguucacauagaguagaauguggaauuucccgugaacgucuccuuccucccccguau

SEQ ID NO: 432718 - RNA, 64 nt, hsa
uggagcagcucagccggcguugcuggucagggucucccgugaggcuggagucagccguggguug

SEQ ID NO: 432719 - RNA, 64 nt, hsa
acugugugcgugugcguugaugggcacucaagagucccgugagucauccagcccugccuuuccc

SEQ ID NO: 432720 - RNA, 64 nt, hsa
gggggccacucauauucugggcuccuggaaccaaucccgugaaagaauuauuuuuguguuucua

SEQ ID NO: 432721 - RNA, 64 nt, hsa
cuuuccucgggccaccgugggggcaccucuggccucccgugacccccaggccgaggguccccgg

SEQ ID NO: 432722 - RNA, 64 nt, hsa
auaaugcagugucaccugugccaaccauggggugucccgugagugugaguguggcagugagaag

SEQ ID NO: 432723 - RNA, 64 nt, hsa
cggcgcuccccaaggaaugcugucccaacaagauucccgugaaagagcacccgugucgcccccu

SEQ ID NO: 432724 - RNA, 64 nt, hsa
aggcaacugaacaaaaaaaugcucacacuccacaucccgugaugcaccucccaggccccgcuca

SEQ ID NO: 432725 - RNA, 64 nt, hsa
gcaugguagaguaggaaucauagugucagugaggucccgugagucuuugugaguccuuguguca

SEQ ID NO: 432726 - RNA, 64 nt, hsa
cagauaugauuuaccaccaccacccugcccccgcucccgugaagaaagcagggcaagugcugug

SEQ ID NO: 432727 - RNA, 64 nt, hsa
ugccuccccacugcagccugcgguccugcccaccucccgugaugugugugugugugugugugug

SEQ ID NO: 432728 - RNA, 64 nt, hsa
uacagugacccugccugcucgcucuuggugugcuucccgugaccuaggaccccagggcccaccu

SEQ ID NO: 432729 - RNA, 64 nt, hsa
guuuuuccuuauguggaaccgaaaucuuucuuucucccgugaaacuuuacuacuaucagauaau

SEQ ID NO: 432730 - RNA, 64 nt, hsa
gagcuucccgggcucagcugggcuuuaucacacaucccgugaacacucauugaagucagccugu

SEQ ID NO: 432731 - RNA, 64 nt, hsa
gacugcagguggcaggggcuccuuggccuccagcucccgugacuuggaggggacugugggacug

SEQ ID NO: 432732 - RNA, 64 nt, hsa
ugaguaucguuuaaugcaaaaggacaaaaacaacucccgugauaugauugccaggagauucugu

SEQ ID NO: 432733 - RNA, 64 nt, hsa
ccucuguggaaucauguccacagggggaccugccucccgugaugucccaccuuuccuucaaggu

SEQ ID NO: 432734 - RNA, 64 nt, hsa
ccuuucacggugcuggggccagauuagggaucacucccgugaggagggccuucacccuguucua

SEQ ID NO: 432735 - RNA, 64 nt, hsa
aauaauugaaaggaaauguuugaguuuucaaagaucccgugaaauugaugccaguggaauacag

SEQ ID NO: 432736 - RNA, 64 nt, hsa
ugggaaaugcugaaagcaccaggaggaagccgguucccgugagauaaguuaacccggccugaca

SEQ ID NO: 432737 - RNA, 64 nt, hsa
cugucccugcagucucuaggccugucugagcugcucccgugaccguguccugaguggccaccuc

SEQ ID NO: 432738 - RNA, 64 nt, hsa
ugaguaaugcuaucguuacuucuuggcaaagaacucccgugacucaucgaggagcuccagcugu

SEQ ID NO: 432739 - RNA, 64 nt, hsa
ggcaacagacaaagaagaaucaaguucugugcugucccgugagugugucugaguaccauucacu

SEQ ID NO: 432740 - RNA, 64 nt, hsa
caggaacacuccuuuccugguauggaacgugagcucccgugacaugaugauaggucuucuccuu

SEQ ID NO: 432741 - RNA, 64 nt, hsa
gagagggaacuagggcaccccuuguuucuguuguucccgugaauuuuuuucgcuaugggaggca

SEQ ID NO: 432742 - RNA, 64 nt, hsa
uucuuaaacgaaggugguuaauagaaacucaggcucccgugacaaggcaggacaagagccuguu

SEQ ID NO: 432743 - RNA, 64 nt, hsa
uaucgaugacaggcugguccugaggauacagcugucccgugacugacugucuuaacugagcauu

SEQ ID NO: 432744 - RNA, 64 nt, hsa
uugccuugucaauaucagaauaggggcaucagugucccgugaaauacauuuuguugugcuauga

SEQ ID NO: 432745 - RNA, 64 nt, hsa
cauggacucugaguggcgacugccuccaccucauucccgugacucguggcaugcgcaggugcug

SEQ ID NO: 432746 - RNA, 64 nt, hsa
ugcguuucaaaacugccaugccccccugugaugcucccgugaaggaaugcacuuugccuuguaa

SEQ ID NO: 432747 - RNA, 64 nt, hsa
agccugucgccguccuguccccagccugcuugugucccgugagguugucaauaaaccugcccuc

SEQ ID NO: 432748 - RNA, 64 nt, hsa
gccuuccagccgagguuuggacaaagucucagguucccgugacucaggguaaggugcuggggcu

SEQ ID NO: 432749 - RNA, 64 nt, hsa
uggccuuucgagugccuuggagguuucccugaccucccgugaagauacagagacugucuccuuu

SEQ ID NO: 432750 - RNA, 64 nt, hsa
uuuauggauguggaaacugaggcugacuuaaacuucccgugacuuggagcucucaccucgagac

SEQ ID NO: 432751 - RNA, 64 nt, hsa
uccugauuagccucccggagggccccaguuucccucccgugaaugugaaguuccccaucuuggu

SEQ ID NO: 432752 - RNA, 64 nt, hsa
ugacaccauccagugugcauacauccaccuggugucccgugaggagugugagcaugccuacccu

SEQ ID NO: 432753 - RNA, 64 nt, hsa
ggagcuguuggagcacuccuugagcuguugaagaucccgugaucauuaccuggggagggguucc

SEQ ID NO: 432754 - RNA, 64 nt, hsa
gauaauccaguaucugccaagagcauguugggucucccgugacugcugccucaucgauacccca

SEQ ID NO: 432755 - RNA, 64 nt, hsa
caugggcagcuuccuucaggaugaucaccgaggcucccgugacuuugaacucccuacucuccag

SEQ ID NO: 432756 - RNA, 64 nt, hsa
cacaggcuuugagacgucuggacccuguccuuccucccgugagggguucuuguucuuucugacu

SEQ ID NO: 432757 - RNA, 64 nt, hsa
agagaagcaccccaccacacacacccuuccccacucccgugaugaaacagcuagguuaauagga

SEQ ID NO: 432758 - RNA, 64 nt, hsa
auagcagaaauaacagugugacauaaagugcccuuccaccuauuuuucuuugguuugcaacacc

SEQ ID NO: 432759 - RNA, 64 nt, hsa
agucaguuuggcccagcaaacauguggguacuucuccaccuagggaagccacugaagaugaguu

SEQ ID NO: 432760 - RNA, 64 nt, hsa
cucaagaugaccugaguuccuuccugccaacuguuccaccuagaauacaaguagagaagagcac

SEQ ID NO: 432761 - RNA, 64 nt, hsa
caggccacucuuuuucuaccaguuguuuuaugaauccaccuauuaauuuucauccaucuuuugg

SEQ ID NO: 432762 - RNA, 64 nt, hsa
aacuugaagcauguauuuaaugcaaauaggcacgaaggcacaggucuaaaauacuacauuguca

SEQ ID NO: 432763 - RNA, 64 nt, hsa
guguugcuguuguaacaucccagagaagaaugaaaaggcacaugcuuuuauccgugaccagauu

SEQ ID NO: 432764 - RNA, 64 nt, hsa
cuguuuugauucuuuguuguuguuuuuauuuuaaaaggcacaaacucuagauauuaguugaaug

SEQ ID NO: 432765 - RNA, 64 nt, hsa
uaacuggcugcagagaaaucuaccgagcaaggaaaaggcacacacacacguuugcagggguguc

SEQ ID NO: 432766 - RNA, 64 nt, hsa
gugggcuguggagcucucaggaagggcccugaggaaggcacacuugcuccuguuggucccuguc

SEQ ID NO: 432767 - RNA, 64 nt, hsa
gggaaggguagggcagccagagaaaggagcagagaaggcacacaaacgaggaaugaggggcuuc

SEQ ID NO: 432768 - RNA, 64 nt, hsa
ucuaguggcuuugccauaauucagugucaccaauaaggcacagcccaguuagcagcuuagcccc

SEQ ID NO: 432769 - RNA, 64 nt, hsa
cccaguuagcagcuuagccccccuagcaaaccccaaggcacaaagugggcauccugacucaucu

SEQ ID NO: 432770 - RNA, 64 nt, hsa
acaggccacagagcgcagccucugggggucccccaaggcacagcauauacagcauggucgcccc

SEQ ID NO: 432771 - RNA, 64 nt, hsa
gaggugggcgauuuggcucugacagcuggagaugaaggcacacucauaccacauacaagggagg

SEQ ID NO: 432772 - RNA, 64 nt, hsa
cucauggaaauagaaugaauagaggggcauucacaaggcacaccagugcaagcagaugacaaaa

SEQ ID NO: 432773 - RNA, 64 nt, hsa
uccgagagugggaaaaggcccgauuauuacccauaaggcacacucucuaaggccuuuuaagggg

SEQ ID NO: 432774 - RNA, 64 nt, hsa
cugugucuccccagggguuuucccugcagugaggcuuguccagaugauugagcccaggagagga

SEQ ID NO: 432775 - RNA, 64 nt, hsa
ucgaucucugcacagccgggccaaccucugaccccuuguccaugucaguaaaauaugaagguca

SEQ ID NO: 432776 - RNA, 64 nt, hsa
ugcaaaggagcugaggucaaggguggcaaaggcacuuguccaaggucgcccagcagugcugcuc

SEQ ID NO: 432777 - RNA, 64 nt, hsa
auggggcagcagguggcucuucugcuggggcugacuuguccagaaggggacaaagugcaauaca

SEQ ID NO: 432778 - RNA, 64 nt, hsa
cuuuucuccccaggguauggcuccugcugaguuucuuguccagcagggccuugacaggaaucca

SEQ ID NO: 432779 - RNA, 64 nt, hsa
uuugcugaggugccccugcccagcccuguccagccuuguccacacacacaucucacgccccugg

SEQ ID NO: 432780 - RNA, 64 nt, hsa
cuuccaccccugccugcccccacccagccugcuucuuguccagcauugauccuucuguuucaac

SEQ ID NO: 432781 - RNA, 64 nt, hsa
gaaucaccaccccgcuucaguguaaacaacgugccuuguccacuuugggcuccagagucuuuca

SEQ ID NO: 432782 - RNA, 64 nt, hsa
accaaguuuuaaaaguucaaauuccccaaaaaggcuuguccaaggcuggccccagauguguggg

SEQ ID NO: 432783 - RNA, 64 nt, hsa
ccccaggcacccauaaccuggaauucccuguuuccuuguccagggccugaggaaauggcucccc

SEQ ID NO: 432784 - RNA, 64 nt, hsa
ugagauuucugugugcugaucgcauccucaguuucuuguccaccgcuucacuggcaagaguccc

SEQ ID NO: 432785 - RNA, 64 nt, hsa
aacuucuggacaugagcguccuguuuaaauuucuuguuaauaucgugccaagccucaaaaauag

SEQ ID NO: 432786 - RNA, 64 nt, hsa
acuaaguuaauccagaccuuuaguugucccaugguguuaauaaaguugccaaagaagauguauu

SEQ ID NO: 432787 - RNA, 64 nt, hsa
ugcauuuaauguuauuucuguaaacuuugagcuuuguuaauaaacuauuaugcagcaucuacac

SEQ ID NO: 432788 - RNA, 64 nt, hsa
guugcaauuguuuugcaguguaaaauuguacauguguuaauaaucaaaaaguguugcauuuaau

SEQ ID NO: 432789 - RNA, 64 nt, hsa
auuuuuauaguaucagaacuuggguugauuucaauguuaauaaacuaggcaaaacaaauaacug

SEQ ID NO: 432790 - RNA, 64 nt, hsa
cuaaccagaugcauuguuugcuucagauccaugguguuaauaccauguauauuuuauaaagaua

SEQ ID NO: 432791 - RNA, 64 nt, hsa
uauuuauaugaaauggaaauguucauuuuuagauuguuaauagaaauuggggagcaacuuuuga

SEQ ID NO: 432792 - RNA, 64 nt, hsa
ugucuuaaacuugugggacaaaaauccuuucuucuguuaauaugucagaauguaagauuuggca

SEQ ID NO: 432793 - RNA, 64 nt, hsa
auuggugcugucaaaauauaguaauuuuuaaauuuguuaauaaugaaaacccuuaagcaugcag

SEQ ID NO: 432794 - RNA, 64 nt, hsa
agcagcagaagguuaguuuuaauuauguagcuucuguuaauauuaaguguuuuuugucuguuuu

SEQ ID NO: 432795 - RNA, 64 nt, hsa
uuuuggugguuaacuuuuacacaguucugaguacuguuaauaucuggaaaguaucuugagauau

SEQ ID NO: 432796 - RNA, 64 nt, hsa
aauugaaauagcuguaaaauaaguagauagcugcuguuaauauaauacaguacauuuugggggg

SEQ ID NO: 432797 - RNA, 64 nt, hsa
uuacaaaacuaggaauaaucaacauuguaagauauguuaauaaaaaccugcugucauuugguuu

SEQ ID NO: 432798 - RNA, 64 nt, hsa
ccauuuaaauuccuacaacuaagucucccugcuuuguuaauaguccaacaguuggguuguguaa

SEQ ID NO: 432799 - RNA, 64 nt, hsa
uacaauauagaaauuguguaauaguuauuauaaauguuaauacacaacuuucagguaauuuuaa

SEQ ID NO: 432800 - RNA, 64 nt, hsa
uuaauguuuaacacauuuucuugaguaacaguucuguuaauauuguacaagaugguacuugaau

SEQ ID NO: 432801 - RNA, 64 nt, hsa
ucagacaaauggcugauguucucuaugauauugguguuaauaucaaagaauugaaugaauacaa

SEQ ID NO: 432802 - RNA, 64 nt, hsa
aaaaugcugcauaaaaauaccaaacuucagcaacuguuaauacucagaucauauaccucuuaau

SEQ ID NO: 432803 - RNA, 64 nt, hsa
auuuuuauauggccuuguaugaggggaguuugaauguuaauaaacauguuuuccacuuuaagau

SEQ ID NO: 432804 - RNA, 64 nt, hsa
uauuuuagauguuguauacuuacguuaggcuuucuguuaauagugguuuuucuccuguugacag

SEQ ID NO: 432805 - RNA, 64 nt, hsa
ucucauuugcugccuuuucacuaagccuuuacuuuguuaauaaaaguguccauugugugauguu

SEQ ID NO: 432806 - RNA, 64 nt, hsa
uugccacucaaauugcucuacuaugcuaaguccuuguuaauagucuuacccuccuugaaacacu

SEQ ID NO: 432807 - RNA, 64 nt, hsa
cauuuugugaaauuccaguauguuuugcuuaagguguuaauaaaauuaguuugcaucauguagu

SEQ ID NO: 432808 - RNA, 64 nt, hsa
uucaguaaaaguuauggaguuaugggucuagacguguuaauaaguuagacagaacuuuggcacu

SEQ ID NO: 432809 - RNA, 64 nt, hsa
cuguguuuacacagguauaagucaguaauagcaguguuaauauuuacaggauuuuggcucgaua

SEQ ID NO: 432810 - RNA, 64 nt, hsa
uguuaauaggcuaugaagaggauguggguauugcuguuaauaaacggaggacuuugauucaaaa

SEQ ID NO: 432811 - RNA, 64 nt, hsa
aguuuuugaauuugaauaauaguuuuaccucuguuguuaauaggcuaugaagaggaugugggua

SEQ ID NO: 432812 - RNA, 64 nt, hsa
uuuauuuauuuauucauuaguuuugaagauucuauguuaauauuuuagguguaaaauaauuaag

SEQ ID NO: 432813 - RNA, 64 nt, hsa
agguagaauguuuucaaauguucuccagucauuauguuaauauuucugaggagccugcaacaug

SEQ ID NO: 432814 - RNA, 64 nt, hsa
aagauagaagguuugcagauauucucuagucauuuguuaauauuucuucgugaugacauaucac

SEQ ID NO: 432815 - RNA, 64 nt, hsa
uuauuuauuuauuuguuuguuuuagaagauucuauguuaauauuuuauguguaaaauaagguua

SEQ ID NO: 432816 - RNA, 64 nt, hsa
agaaacauaagcuuaaaguuguuuaucacugugguguuaauaaaacaguauuuucaaaaaauau

SEQ ID NO: 432817 - RNA, 64 nt, hsa
uugaggaagauugcaauggagaucaugacacuacuguuaauaaggccaggaaaacugccauuuc

SEQ ID NO: 432818 - RNA, 64 nt, hsa
uaaugauaaaauugcgauuuaucacuccuuuucauguuaauaauuugaggacuggauaaaaggu

SEQ ID NO: 432819 - RNA, 64 nt, hsa
aguuuccugguauaaaguugguuaaaauuucaucuguuaauagaucauuagguaauauaaugua

SEQ ID NO: 432820 - RNA, 64 nt, hsa
uaagacauuuagaaguaauuuuuauuauuuauauuguuaauacuuaaucacuggaaauucauuu

SEQ ID NO: 432821 - RNA, 64 nt, hsa
uaccacuauuuaguaaaaaguuuuaguuuggugcuguuaauaauaauuugcuaaaaggccuuuu

SEQ ID NO: 432822 - RNA, 64 nt, hsa
augauggauagggggcaaaucuuuuuccccuuucuguuaauagucaucacauuucuaugccaaa

SEQ ID NO: 432823 - RNA, 64 nt, hsa
auacauuucauuaagguuccaguuauaaauauuuuguuaauauuuauuaagugacuauagaaug

SEQ ID NO: 432824 - RNA, 64 nt, hsa
ggaaaauagacuucuacauaggaaagcuaaaauauguuaauauuuuuaaauuaaagguuuaaua

SEQ ID NO: 432825 - RNA, 64 nt, hsa
guuuguguagaaagaaauguguuaaacaaaauuauguuaauaaauauucccacauaauacaucu

SEQ ID NO: 432826 - RNA, 64 nt, hsa
gcacuugggaugucugagaucagugccuauggguuguuaauacuauauugcuguaugguauaug

SEQ ID NO: 432827 - RNA, 64 nt, hsa
acuaguacuauuacuaguacuaguacuaugacacuguuaauaguacuauuaacaacccauaggc

SEQ ID NO: 432828 - RNA, 64 nt, hsa
cuguuugggaugucugagaucagugccucuggguuguuaauacuguauugcuguaugguauaug

SEQ ID NO: 432829 - RNA, 64 nt, hsa
uguagaacacagaacauaaagggugagagaaaucuguuaauauaaugauaaugagaacaccuuu

SEQ ID NO: 432830 - RNA, 64 nt, hsa
aaaaauauuuuuauugagaaauagcauuuuacuuuguuaauaucuaguuuaguucauugucaag

SEQ ID NO: 432831 - RNA, 64 nt, hsa
cagcuaccucugggucauucuguaauguaaauguuguuaauaagaaugguuuuuacauaaauua

SEQ ID NO: 432832 - RNA, 64 nt, hsa
uacguacccuuaauugaguaacuacuaugguauuuguuaauauuuucuacacuaaauaccauug

SEQ ID NO: 432833 - RNA, 64 nt, hsa
uuuaaaauuguccacacacuaggaaauagaacuguguuaauauauaagaaaucuggggauaauu

SEQ ID NO: 432834 - RNA, 64 nt, hsa
cauagguagcuagaucauugcauuuguuuugaaauguuaauauguuaaauacuaaacuaauauu

SEQ ID NO: 432835 - RNA, 64 nt, hsa
uuucaggacuagggcuuucucauggaguacaguauguuaauauuuaccuauauaacuaaucugu

SEQ ID NO: 432836 - RNA, 64 nt, hsa
ggauauuguacuucacuagugcugccagaggaauuguuaauaaaagcaccuucuuuaacaauaa

SEQ ID NO: 432837 - RNA, 64 nt, hsa
augucuuucacagacuuaagggacuauguacuacuguuaauaucucuaagaacaaaacacauug

SEQ ID NO: 432838 - RNA, 64 nt, hsa
uuuauaguuguaauaucaccauguuucccauuucuguuaauacuucuaugaaccccuaaaguau

SEQ ID NO: 432839 - RNA, 64 nt, hsa
cagaaugucugguuguugggcccaggagucuucauguuaauaagcuucucccuuucgucacccc

SEQ ID NO: 432840 - RNA, 64 nt, hsa
aacauaacccaggagucuaaguuaaaucuaauauuguuaauacugaacuugcagguccagguug

SEQ ID NO: 432841 - RNA, 64 nt, hsa
uaagcauuuguaaaguuacagcaaaagauguaccuguuaauacacagaauguguacagauuauu

SEQ ID NO: 432842 - RNA, 64 nt, hsa
uguaauugucuuuuaaaauacugauauuuuuauuuguuaauaauacuuugcccucagaaagauu

SEQ ID NO: 432843 - RNA, 64 nt, hsa
caauauauuuguaaccuuaagaagaguauuuuuuuguuaauacuaagauguucaaacuuagaca

SEQ ID NO: 432844 - RNA, 64 nt, hsa
aauagaaaaugguaauaguuaacauucauugagcuguuaauauguauaaguguuugugcuaaau

SEQ ID NO: 432845 - RNA, 64 nt, hsa
ccaaguaauaacugaaggagcuaacuacccaaccuguuaauaacaggcaguaugccuaaauagg

SEQ ID NO: 432846 - RNA, 64 nt, hsa
aaggacagaugaacaaauuccugagucagaagucuguuaauauugcuguuuugaaggacaaucc

SEQ ID NO: 432847 - RNA, 64 nt, hsa
auacggacagagucugcuuagaagagauacaaguuguuaauaaaauugauccuguugauaguag

SEQ ID NO: 432848 - RNA, 64 nt, hsa
auuaacagucuguucuuccagaguccagagacauuguuaauaaagacaaugaaucaugaccgaa

SEQ ID NO: 432849 - RNA, 64 nt, hsa
uuuaugcaaaaguuuuucuuguagagaaugacaauguuaauauugcuuuaugaauuaacagucu

SEQ ID NO: 432850 - RNA, 64 nt, hsa
aaguguaaauauuuuaaaauuugacauacccuaauguuaauaauaaaaagaacuauuugcauau

SEQ ID NO: 432851 - RNA, 64 nt, hsa
aauaaaauauauauuuauuauuuuaaaugcuauguguuaauauuucacuugcuuguauuagaaa

SEQ ID NO: 432852 - RNA, 64 nt, hsa
uuggaagcacaagugcauggcacugacugaaugcuguuaauauuucuaaaaguuucuacauuca

SEQ ID NO: 432853 - RNA, 64 nt, hsa
guguguguuggaauggcugagcaaauauuaaaauuguuaauaugcagccauauauggaagguuc

SEQ ID NO: 432854 - RNA, 64 nt, hsa; identical to SEQ ID NO: 144364

SEQ ID NO: 432855 - RNA, 64 nt, hsa; identical to SEQ ID NO: 144365

SEQ ID NO: 432856 - RNA, 64 nt, hsa; identical to SEQ ID NO: 144366

SEQ ID NO: 432857 - RNA, 64 nt, hsa; identical to SEQ ID NO: 144367

SEQ ID NO: 432858 - RNA, 64 nt, hsa; identical to SEQ ID NO: 144368

SEQ ID NO: 432859 - RNA, 64 nt, hsa; identical to SEQ ID NO: 144369

SEQ ID NO: 432860 - RNA, 64 nt, hsa; identical to SEQ ID NO: 144370

SEQ ID NO: 432861 - RNA, 64 nt, hsa; identical to SEQ ID NO: 144371

SEQ ID NO: 432862 - RNA, 64 nt, hsa; identical to SEQ ID NO: 144372

SEQ ID NO: 432863 - RNA, 64 nt, hsa; identical to SEQ ID NO: 144373

SEQ ID NO: 432864 - RNA, 64 nt, hsa; identical to SEQ ID NO: 144374

SEQ ID NO: 432865 - RNA, 64 nt, hsa; identical to SEQ ID NO: 144375

SEQ ID NO: 432866 - RNA, 64 nt, hsa; identical to SEQ ID NO: 144376

SEQ ID NO: 432867 - RNA, 64 nt, hsa; identical to SEQ ID NO: 144377

SEQ ID NO: 432868 - RNA, 64 nt, hsa; identical to SEQ ID NO: 144378

SEQ ID NO: 432869 - RNA, 64 nt, hsa; identical to SEQ ID NO: 144379

SEQ ID NO: 432870 - RNA, 64 nt, hsa; identical to SEQ ID NO: 144380

SEQ ID NO: 432871 - RNA, 64 nt, hsa; identical to SEQ ID NO: 144381

SEQ ID NO: 432872 - RNA, 64 nt, hsa; identical to SEQ ID NO: 144382

SEQ ID NO: 432873 - RNA, 64 nt, hsa; identical to SEQ ID NO: 144383

SEQ ID NO: 432874 - RNA, 64 nt, hsa; identical to SEQ ID NO: 144384

SEQ ID NO: 432875 - RNA, 64 nt, hsa; identical to SEQ ID NO: 144385

SEQ ID NO: 432876 - RNA, 64 nt, hsa; identical to SEQ ID NO: 144386

SEQ ID NO: 432877 - RNA, 64 nt, hsa; identical to SEQ ID NO: 144387

SEQ ID NO: 432878 - RNA, 64 nt, hsa; identical to SEQ ID NO: 144388

SEQ ID NO: 432879 - RNA, 64 nt, hsa; identical to SEQ ID NO: 144389

SEQ ID NO: 432880 - RNA, 64 nt, hsa; identical to SEQ ID NO: 144390

SEQ ID NO: 432881 - RNA, 64 nt, hsa; identical to SEQ ID NO: 144391

SEQ ID NO: 432882 - RNA, 64 nt, hsa; identical to SEQ ID NO: 144392

SEQ ID NO: 432883 - RNA, 64 nt, hsa; identical to SEQ ID NO: 144393

SEQ ID NO: 432884 - RNA, 64 nt, hsa; identical to SEQ ID NO: 144394

SEQ ID NO: 432885 - RNA, 64 nt, hsa; identical to SEQ ID NO: 144395

SEQ ID NO: 432886 - RNA, 64 nt, hsa; identical to SEQ ID NO: 144396

SEQ ID NO: 432887 - RNA, 64 nt, hsa; identical to SEQ ID NO: 144397

SEQ ID NO: 432888 - RNA, 64 nt, hsa; identical to SEQ ID NO: 144398

SEQ ID NO: 432889 - RNA, 64 nt, hsa; identical to SEQ ID NO: 144399

SEQ ID NO: 432890 - RNA, 64 nt, hsa; identical to SEQ ID NO: 144400

SEQ ID NO: 432891 - RNA, 64 nt, hsa; identical to SEQ ID NO: 374682

SEQ ID NO: 432892 - RNA, 64 nt, hsa; identical to SEQ ID NO: 374683

SEQ ID NO: 432893 - RNA, 64 nt, hsa; identical to SEQ ID NO: 374684

SEQ ID NO: 432894 - RNA, 64 nt, hsa; identical to SEQ ID NO: 374685

SEQ ID NO: 432895 - RNA, 64 nt, hsa; identical to SEQ ID NO: 374686

SEQ ID NO: 432896 - RNA, 64 nt, hsa; identical to SEQ ID NO: 374687

SEQ ID NO: 432897 - RNA, 64 nt, hsa; identical to SEQ ID NO: 374688

SEQ ID NO: 432898 - RNA, 64 nt, hsa; identical to SEQ ID NO: 374689

SEQ ID NO: 432899 - RNA, 64 nt, hsa; identical to SEQ ID NO: 374690

SEQ ID NO: 432900 - RNA, 64 nt, hsa; identical to SEQ ID NO: 374691

SEQ ID NO: 432901 - RNA, 64 nt, hsa; identical to SEQ ID NO: 374692

SEQ ID NO: 432902 - RNA, 64 nt, hsa; identical to SEQ ID NO: 155294

SEQ ID NO: 432903 - RNA, 64 nt, hsa; identical to SEQ ID NO: 155295

SEQ ID NO: 432904 - RNA, 64 nt, hsa; identical to SEQ ID NO: 155296

SEQ ID NO: 432905 - RNA, 64 nt, hsa; identical to SEQ ID NO: 155297

SEQ ID NO: 432906 - RNA, 64 nt, hsa; identical to SEQ ID NO: 155298

SEQ ID NO: 432907 - RNA, 64 nt, hsa; identical to SEQ ID NO: 155299

SEQ ID NO: 432908 - RNA, 64 nt, hsa; identical to SEQ ID NO: 155300

SEQ ID NO: 432909 - RNA, 64 nt, hsa; identical to SEQ ID NO: 155301

SEQ ID NO: 432910 - RNA, 64 nt, hsa; identical to SEQ ID NO: 155302

SEQ ID NO: 432911 - RNA, 64 nt, hsa; identical to SEQ ID NO: 155303

SEQ ID NO: 432912 - RNA, 64 nt, hsa; identical to SEQ ID NO: 155304

SEQ ID NO: 432913 - RNA, 64 nt, hsa; identical to SEQ ID NO: 155305

SEQ ID NO: 432914 - RNA, 64 nt, hsa; identical to SEQ ID NO: 155306

SEQ ID NO: 432915 - RNA, 64 nt, hsa; identical to SEQ ID NO: 155307

SEQ ID NO: 432916 - RNA, 64 nt, hsa; identical to SEQ ID NO: 155308

SEQ ID NO: 432917 - RNA, 64 nt, hsa; identical to SEQ ID NO: 155309

SEQ ID NO: 432918 - RNA, 64 nt, hsa; identical to SEQ ID NO: 155310

SEQ ID NO: 432919 - RNA, 64 nt, hsa; identical to SEQ ID NO: 155311

SEQ ID NO: 432920 - RNA, 64 nt, hsa; identical to SEQ ID NO: 155312

SEQ ID NO: 432921 - RNA, 64 nt, hsa; identical to SEQ ID NO: 155313

SEQ ID NO: 432922 - RNA, 64 nt, hsa; identical to SEQ ID NO: 155314

SEQ ID NO: 432923 - RNA, 64 nt, hsa; identical to SEQ ID NO: 155315

SEQ ID NO: 432924 - RNA, 64 nt, hsa; identical to SEQ ID NO: 155316

SEQ ID NO: 432925 - RNA, 64 nt, hsa; identical to SEQ ID NO: 155317

SEQ ID NO: 432926 - RNA, 64 nt, hsa; identical to SEQ ID NO: 155318

SEQ ID NO: 432927 - RNA, 64 nt, hsa; identical to SEQ ID NO: 155319

SEQ ID NO: 432928 - RNA, 64 nt, hsa; identical to SEQ ID NO: 155320

SEQ ID NO: 432929 - RNA, 64 nt, hsa; identical to SEQ ID NO: 155321

SEQ ID NO: 432930 - RNA, 64 nt, hsa; identical to SEQ ID NO: 155322

SEQ ID NO: 432931 - RNA, 64 nt, hsa; identical to SEQ ID NO: 155323

SEQ ID NO: 432932 - RNA, 64 nt, hsa; identical to SEQ ID NO: 155324

SEQ ID NO: 432933 - RNA, 64 nt, hsa; identical to SEQ ID NO: 155325

SEQ ID NO: 432934 - RNA, 64 nt, hsa; identical to SEQ ID NO: 155326

SEQ ID NO: 432935 - RNA, 64 nt, hsa; identical to SEQ ID NO: 155327

SEQ ID NO: 432936 - RNA, 64 nt, hsa; identical to SEQ ID NO: 155328

SEQ ID NO: 432937 - RNA, 64 nt, hsa; identical to SEQ ID NO: 155329

SEQ ID NO: 432938 - RNA, 64 nt, hsa; identical to SEQ ID NO: 155330

SEQ ID NO: 432939 - RNA, 64 nt, hsa; identical to SEQ ID NO: 155331

SEQ ID NO: 432940 - RNA, 64 nt, hsa; identical to SEQ ID NO: 155332

SEQ ID NO: 432941 - RNA, 64 nt, hsa; identical to SEQ ID NO: 155333

SEQ ID NO: 432942 - RNA, 64 nt, hsa; identical to SEQ ID NO: 155334

SEQ ID NO: 432943 - RNA, 64 nt, hsa; identical to SEQ ID NO: 155335

SEQ ID NO: 432944 - RNA, 64 nt, hsa; identical to SEQ ID NO: 155336

SEQ ID NO: 432945 - RNA, 64 nt, hsa; identical to SEQ ID NO: 155337

SEQ ID NO: 432946 - RNA, 64 nt, hsa; identical to SEQ ID NO: 155338

SEQ ID NO: 432947 - RNA, 64 nt, hsa; identical to SEQ ID NO: 166381

SEQ ID NO: 432948 - RNA, 64 nt, hsa; identical to SEQ ID NO: 166382

SEQ ID NO: 432949 - RNA, 64 nt, hsa; identical to SEQ ID NO: 166383

SEQ ID NO: 432950 - RNA, 64 nt, hsa; identical to SEQ ID NO: 166384

SEQ ID NO: 432951 - RNA, 64 nt, hsa; identical to SEQ ID NO: 166385

SEQ ID NO: 432952 - RNA, 64 nt, hsa; identical to SEQ ID NO: 166386

SEQ ID NO: 432953 - RNA, 64 nt, hsa; identical to SEQ ID NO: 166387

SEQ ID NO: 432954 - RNA, 64 nt, hsa; identical to SEQ ID NO: 166388

SEQ ID NO: 432955 - RNA, 64 nt, hsa; identical to SEQ ID NO: 166389

SEQ ID NO: 432956 - RNA, 64 nt, hsa; identical to SEQ ID NO: 166390

SEQ ID NO: 432957 - RNA, 64 nt, hsa; identical to SEQ ID NO: 166391

SEQ ID NO: 432958 - RNA, 64 nt, hsa; identical to SEQ ID NO: 166392

SEQ ID NO: 432959 - RNA, 64 nt, hsa; identical to SEQ ID NO: 166393

SEQ ID NO: 432960 - RNA, 64 nt, hsa; identical to SEQ ID NO: 166394

SEQ ID NO: 432961 - RNA, 64 nt, hsa; identical to SEQ ID NO: 166395

SEQ ID NO: 432962 - RNA, 64 nt, hsa; identical to SEQ ID NO: 166396

SEQ ID NO: 432963 - RNA, 64 nt, hsa; identical to SEQ ID NO: 166397

SEQ ID NO: 432964 - RNA, 64 nt, hsa
ucauuuuauuuucccaccuucaaauauaaguauuaucaucuaucuguuuaucgucuaucuaucu

SEQ ID NO: 432965 - RNA, 64 nt, hsa
uauuaucaucuaucuguuuaucgucuaucuaucuaucaucuaucuaucuaucuaucaucuaucu

SEQ ID NO: 432966 - RNA, 64 nt, hsa
aucgucuaucuaucuaucaucuaucuaucuaucuaucaucuaucuaucuaucuaucuaucuauc

SEQ ID NO: 432967 - RNA, 64 nt, hsa
ucucuagauuuugaaaccaaaaaacugaacugaaaucaucuaaagaguuaaaauuucagugauc

SEQ ID NO: 432968 - RNA, 64 nt, hsa
uagucuugcgucucauccuuuaugauguugagaaaucaucuaauuucucagaacuuuuucuuau

SEQ ID NO: 432969 - RNA, 64 nt, hsa
uauuuggcuccuccauuucuggaaauugagacucaagcuuuaugaauuuaucaagaacuuaaaa

SEQ ID NO: 432970 - RNA, 64 nt, hsa
cuuuguuuuuuuuuuuuccuuaaaggcaacuaggaagcuuuacuuuccuaaaguguuuuugcca

SEQ ID NO: 432971 - RNA, 64 nt, hsa
cggaagucacaguuuguuuccuggaaacuuugacaagcuuuauuaaguugagagagagagaggg

SEQ ID NO: 432972 - RNA, 64 nt, hsa
cagcagcaguggaggugaguucuuucuuuugcggaagcuuuacauauguuuuguguaguaggaa

SEQ ID NO: 432973 - RNA, 64 nt, hsa
uuaugaaagaaagcuuuagcugucucuguuuuguaagcuuuaagcgcaacauuucuugguucca

SEQ ID NO: 432974 - RNA, 64 nt, hsa
ggggauggagaagacaauuguugcuuaugaaagaaagcuuuagcugucucuguuuuguaagcuu

SEQ ID NO: 432975 - RNA, 64 nt, hsa
cuugguuuaccccauaaucuaauuucagaaaagaaagcuuuauuuuaacacucaucugaaucaa

SEQ ID NO: 432976 - RNA, 64 nt, hsa
caguugccaaucuaaaagcacaaagacagaaguaaagcuuuaugcuaauuuuauuucaauauga

SEQ ID NO: 432977 - RNA, 64 nt, hsa
aaaaaguuaccucucaguauuuugugucacugagaagcuuuacaauggaugcuuuugaaacaag

SEQ ID NO: 432978 - RNA, 64 nt, hsa
aaagauuaaagaaacgauuaagagaaaagguuggaagcuuuauacuaaaugggcuccuucaugg

SEQ ID NO: 432979 - RNA, 64 nt, hsa
gaauauacuuuuccucaaguaauauaccuguuugaagcuuuaagagagauguuuuugguaacua

SEQ ID NO: 432980 - RNA, 64 nt, hsa
ucaauguguaaacaggaacaacuuuaugauuugaaagcuuuaaaggagauucuucucccacccc

SEQ ID NO: 432981 - RNA, 64 nt, hsa
uauuacuuuuuccuguauuuuaugcccauaaaauaagcuuuauaaaaaccaauuuccugaugga

SEQ ID NO: 432982 - RNA, 64 nt, hsa
uugucuuugugcuuuguccaucucuuccguggcgaagcuuuauaucuguuccuaaaacaguuaa

SEQ ID NO: 432983 - RNA, 64 nt, hsa
cugucuagaacgcauuuaacagguuuugucguaaaagcuuuacuaagucugguguuaacucuuu

SEQ ID NO: 432984 - RNA, 64 nt, hsa
aauguuaaugcaacuauuaccuagagugaacuuuaagcuuuauuguugaauguaauuccauuau

SEQ ID NO: 432985 - RNA, 64 nt, hsa
aauugauguucuugcuuuguguuguguucugguaaagcuuuaagugagugucuuaccccuuucc

SEQ ID NO: 432986 - RNA, 64 nt, hsa
aaagauugaauguucauguguggguuaaaaaaagaagcuuuaacacuaauuuuccaaagguuag

SEQ ID NO: 432987 - RNA, 64 nt, hsa
uaaaacgagaucagguuagcaaaugauguaaaagaagcuuuauugucuaguuguuuuuuuuccc

SEQ ID NO: 432988 - RNA, 64 nt, hsa
agugauauacuuguucguucauuucuaaaaugugaagcuuuaggaccaaauuguuagaaagcau

SEQ ID NO: 432989 - RNA, 64 nt, hsa
auuaauaguugaaauugugagguuaauguuuaaaaagcuuuacaccuguuuacaauuuggggac

SEQ ID NO: 432990 - RNA, 64 nt, hsa
aggacucaguuuugggggagggguuaucugggagaagcuuuagccuguucugagccauuaggag

SEQ ID NO: 432991 - RNA, 64 nt, hsa
uauguauccuccagcucuuaaagcuuaccugagaaagcuuuaaaugagaaaaggaccaugcgau

SEQ ID NO: 432992 - RNA, 64 nt, hsa
cacugacagaaagauuuuccugcuuucaggaaacaagcuuuauguggcccuuuucugguccccu

SEQ ID NO: 432993 - RNA, 64 nt, hsa
cuacauuuaaaaauacuucucucucuuuucuaaaaagcuuuaacuguagugccuccuaauaagc

SEQ ID NO: 432994 - RNA, 64 nt, hsa
aggugaggagguacuaaugcugguuauuuccuugaagcuuuauguggaccuauaaauaaaaauc

SEQ ID NO: 432995 - RNA, 64 nt, hsa
uucuuucuauauuauguuuucgcuuuuguauuuuaagcuuuacuuagauauucaaaaccuggua

SEQ ID NO: 432996 - RNA, 64 nt, hsa
guguucguugcacagcuguuugaaauguuuaauaaagcuuuauaaacuuuacuuugugguuuua

SEQ ID NO: 432997 - RNA, 64 nt, hsa
uguguacaaauacauguguauauuccuuuuaaagaagcuuuaucgaacguggucugauuuugag

SEQ ID NO: 432998 - RNA, 64 nt, hsa; identical to SEQ ID NO: 155383

SEQ ID NO: 432999 - RNA, 64 nt, hsa; identical to SEQ ID NO: 155384

SEQ ID NO: 433000 - RNA, 64 nt, hsa; identical to SEQ ID NO: 155385

SEQ ID NO: 433001 - RNA, 64 nt, hsa; identical to SEQ ID NO: 155386

SEQ ID NO: 433002 - RNA, 64 nt, hsa; identical to SEQ ID NO: 155387

SEQ ID NO: 433003 - RNA, 64 nt, hsa; identical to SEQ ID NO: 155388

SEQ ID NO: 433004 - RNA, 64 nt, hsa; identical to SEQ ID NO: 155389

SEQ ID NO: 433005 - RNA, 64 nt, hsa; identical to SEQ ID NO: 155390

SEQ ID NO: 433006 - RNA, 64 nt, hsa; identical to SEQ ID NO: 155391

SEQ ID NO: 433007 - RNA, 64 nt, hsa; identical to SEQ ID NO: 155392

SEQ ID NO: 433008 - RNA, 64 nt, hsa; identical to SEQ ID NO: 155393

SEQ ID NO: 433009 - RNA, 64 nt, hsa; identical to SEQ ID NO: 155394

SEQ ID NO: 433010 - RNA, 64 nt, hsa; identical to SEQ ID NO: 155395

SEQ ID NO: 433011 - RNA, 64 nt, hsa; identical to SEQ ID NO: 155396

SEQ ID NO: 433012 - RNA, 64 nt, hsa; identical to SEQ ID NO: 155397

SEQ ID NO: 433013 - RNA, 64 nt, hsa; identical to SEQ ID NO: 155398

SEQ ID NO: 433014 - RNA, 64 nt, hsa; identical to SEQ ID NO: 155399

SEQ ID NO: 433015 - RNA, 64 nt, hsa; identical to SEQ ID NO: 155400

SEQ ID NO: 433016 - RNA, 64 nt, hsa; identical to SEQ ID NO: 155401

SEQ ID NO: 433017 - RNA, 64 nt, hsa; identical to SEQ ID NO: 155402

SEQ ID NO: 433018 - RNA, 64 nt, hsa; identical to SEQ ID NO: 155403

SEQ ID NO: 433019 - RNA, 64 nt, hsa; identical to SEQ ID NO: 155404

SEQ ID NO: 433020 - RNA, 64 nt, hsa; identical to SEQ ID NO: 155405

SEQ ID NO: 433021 - RNA, 64 nt, hsa; identical to SEQ ID NO: 155406

SEQ ID NO: 433022 - RNA, 64 nt, hsa; identical to SEQ ID NO: 155407

SEQ ID NO: 433023 - RNA, 64 nt, hsa; identical to SEQ ID NO: 155408

SEQ ID NO: 433024 - RNA, 64 nt, hsa; identical to SEQ ID NO: 155409

SEQ ID NO: 433025 - RNA, 64 nt, hsa; identical to SEQ ID NO: 155410

SEQ ID NO: 433026 - RNA, 64 nt, hsa; identical to SEQ ID NO: 155411

SEQ ID NO: 433027 - RNA, 64 nt, hsa; identical to SEQ ID NO: 155412

SEQ ID NO: 433028 - RNA, 64 nt, hsa; identical to SEQ ID NO: 155413

SEQ ID NO: 433029 - RNA, 64 nt, hsa; identical to SEQ ID NO: 155414

SEQ ID NO: 433030 - RNA, 64 nt, hsa; identical to SEQ ID NO: 155415

SEQ ID NO: 433031 - RNA, 64 nt, hsa; identical to SEQ ID NO: 155416

SEQ ID NO: 433032 - RNA, 64 nt, hsa; identical to SEQ ID NO: 155417

SEQ ID NO: 433033 - RNA, 64 nt, hsa; identical to SEQ ID NO: 155418

SEQ ID NO: 433034 - RNA, 64 nt, hsa; identical to SEQ ID NO: 155419

SEQ ID NO: 433035 - RNA, 64 nt, hsa; identical to SEQ ID NO: 155420

SEQ ID NO: 433036 - RNA, 64 nt, hsa; identical to SEQ ID NO: 155421

SEQ ID NO: 433037 - RNA, 64 nt, hsa; identical to SEQ ID NO: 155422

SEQ ID NO: 433038 - RNA, 64 nt, hsa; identical to SEQ ID NO: 155423

SEQ ID NO: 433039 - RNA, 64 nt, hsa; identical to SEQ ID NO: 155424

SEQ ID NO: 433040 - RNA, 64 nt, hsa; identical to SEQ ID NO: 155425

SEQ ID NO: 433041 - RNA, 64 nt, hsa; identical to SEQ ID NO: 155426

SEQ ID NO: 433042 - RNA, 64 nt, hsa; identical to SEQ ID NO: 155427

SEQ ID NO: 433043 - RNA, 64 nt, hsa; identical to SEQ ID NO: 155428

SEQ ID NO: 433044 - RNA, 64 nt, hsa; identical to SEQ ID NO: 155429

SEQ ID NO: 433045 - RNA, 64 nt, hsa; identical to SEQ ID NO: 155430

SEQ ID NO: 433046 - RNA, 64 nt, hsa; identical to SEQ ID NO: 155431

SEQ ID NO: 433047 - RNA, 64 nt, hsa; identical to SEQ ID NO: 155432

SEQ ID NO: 433048 - RNA, 64 nt, hsa; identical to SEQ ID NO: 155433

SEQ ID NO: 433049 - RNA, 64 nt, hsa; identical to SEQ ID NO: 155434

SEQ ID NO: 433050 - RNA, 64 nt, hsa; identical to SEQ ID NO: 155435

SEQ ID NO: 433051 - RNA, 64 nt, hsa; identical to SEQ ID NO: 155436

SEQ ID NO: 433052 - RNA, 64 nt, hsa; identical to SEQ ID NO: 155437

SEQ ID NO: 433053 - RNA, 64 nt, hsa; identical to SEQ ID NO: 155438

SEQ ID NO: 433054 - RNA, 64 nt, hsa; identical to SEQ ID NO: 155439

SEQ ID NO: 433055 - RNA, 64 nt, hsa; identical to SEQ ID NO: 155440

SEQ ID NO: 433056 - RNA, 64 nt, hsa; identical to SEQ ID NO: 155441

SEQ ID NO: 433057 - RNA, 64 nt, hsa; identical to SEQ ID NO: 155442

SEQ ID NO: 433058 - RNA, 64 nt, hsa; identical to SEQ ID NO: 155443

SEQ ID NO: 433059 - RNA, 64 nt, hsa; identical to SEQ ID NO: 155444

SEQ ID NO: 433060 - RNA, 64 nt, hsa; identical to SEQ ID NO: 155445

SEQ ID NO: 433061 - RNA, 64 nt, hsa; identical to SEQ ID NO: 155446

SEQ ID NO: 433062 - RNA, 64 nt, hsa; identical to SEQ ID NO: 155447

SEQ ID NO: 433063 - RNA, 64 nt, hsa; identical to SEQ ID NO: 155448

SEQ ID NO: 433064 - RNA, 64 nt, hsa; identical to SEQ ID NO: 155449

SEQ ID NO: 433065 - RNA, 64 nt, hsa; identical to SEQ ID NO: 155450

SEQ ID NO: 433066 - RNA, 64 nt, hsa; identical to SEQ ID NO: 155451

SEQ ID NO: 433067 - RNA, 64 nt, hsa; identical to SEQ ID NO: 155452

SEQ ID NO: 433068 - RNA, 64 nt, hsa; identical to SEQ ID NO: 155453

SEQ ID NO: 433069 - RNA, 64 nt, hsa; identical to SEQ ID NO: 155454

SEQ ID NO: 433070 - RNA, 64 nt, hsa; identical to SEQ ID NO: 155455

SEQ ID NO: 433071 - RNA, 64 nt, hsa; identical to SEQ ID NO: 155456

SEQ ID NO: 433072 - RNA, 64 nt, hsa; identical to SEQ ID NO: 155457

SEQ ID NO: 433073 - RNA, 64 nt, hsa; identical to SEQ ID NO: 155458

SEQ ID NO: 433074 - RNA, 64 nt, hsa; identical to SEQ ID NO: 155459

SEQ ID NO: 433075 - RNA, 64 nt, hsa; identical to SEQ ID NO: 155460

SEQ ID NO: 433076 - RNA, 64 nt, hsa; identical to SEQ ID NO: 155461

SEQ ID NO: 433077 - RNA, 64 nt, hsa; identical to SEQ ID NO: 155462

SEQ ID NO: 433078 - RNA, 64 nt, hsa; identical to SEQ ID NO: 155463

SEQ ID NO: 433079 - RNA, 64 nt, hsa; identical to SEQ ID NO: 155464

SEQ ID NO: 433080 - RNA, 64 nt, hsa; identical to SEQ ID NO: 155465

SEQ ID NO: 433081 - RNA, 64 nt, hsa; identical to SEQ ID NO: 155466

SEQ ID NO: 433082 - RNA, 64 nt, hsa; identical to SEQ ID NO: 155467

SEQ ID NO: 433083 - RNA, 64 nt, hsa; identical to SEQ ID NO: 155468

SEQ ID NO: 433084 - RNA, 64 nt, hsa; identical to SEQ ID NO: 155469

SEQ ID NO: 433085 - RNA, 64 nt, hsa; identical to SEQ ID NO: 155470

SEQ ID NO: 433086 - RNA, 64 nt, hsa; identical to SEQ ID NO: 155471

SEQ ID NO: 433087 - RNA, 64 nt, hsa; identical to SEQ ID NO: 155472

SEQ ID NO: 433088 - RNA, 64 nt, hsa; identical to SEQ ID NO: 155473

SEQ ID NO: 433089 - RNA, 64 nt, hsa; identical to SEQ ID NO: 155474

SEQ ID NO: 433090 - RNA, 64 nt, hsa; identical to SEQ ID NO: 155475

SEQ ID NO: 433091 - RNA, 64 nt, hsa; identical to SEQ ID NO: 155476

SEQ ID NO: 433092 - RNA, 64 nt, hsa; identical to SEQ ID NO: 155477

SEQ ID NO: 433093 - RNA, 64 nt, hsa; identical to SEQ ID NO: 155478

SEQ ID NO: 433094 - RNA, 64 nt, hsa; identical to SEQ ID NO: 155479

SEQ ID NO: 433095 - RNA, 64 nt, hsa; identical to SEQ ID NO: 155480

SEQ ID NO: 433096 - RNA, 64 nt, hsa; identical to SEQ ID NO: 155481

SEQ ID NO: 433097 - RNA, 64 nt, hsa; identical to SEQ ID NO: 155482

SEQ ID NO: 433098 - RNA, 64 nt, hsa; identical to SEQ ID NO: 155483

SEQ ID NO: 433099 - RNA, 64 nt, hsa; identical to SEQ ID NO: 155484

SEQ ID NO: 433100 - RNA, 64 nt, hsa; identical to SEQ ID NO: 155485

SEQ ID NO: 433101 - RNA, 64 nt, hsa; identical to SEQ ID NO: 155486

SEQ ID NO: 433102 - RNA, 64 nt, hsa; identical to SEQ ID NO: 155487

SEQ ID NO: 433103 - RNA, 64 nt, hsa; identical to SEQ ID NO: 155488

SEQ ID NO: 433104 - RNA, 64 nt, hsa; identical to SEQ ID NO: 250794

SEQ ID NO: 433105 - RNA, 64 nt, hsa; identical to SEQ ID NO: 250795

SEQ ID NO: 433106 - RNA, 64 nt, hsa; identical to SEQ ID NO: 250796

SEQ ID NO: 433107 - RNA, 64 nt, hsa; identical to SEQ ID NO: 250797

SEQ ID NO: 433108 - RNA, 64 nt, hsa; identical to SEQ ID NO: 250798

SEQ ID NO: 433109 - RNA, 64 nt, hsa; identical to SEQ ID NO: 250799

SEQ ID NO: 433110 - RNA, 64 nt, hsa; identical to SEQ ID NO: 250800

SEQ ID NO: 433111 - RNA, 64 nt, hsa; identical to SEQ ID NO: 250801

SEQ ID NO: 433112 - RNA, 64 nt, hsa; identical to SEQ ID NO: 250802

SEQ ID NO: 433113 - RNA, 64 nt, hsa; identical to SEQ ID NO: 250803

SEQ ID NO: 433114 - RNA, 64 nt, hsa; identical to SEQ ID NO: 250804

SEQ ID NO: 433115 - RNA, 64 nt, hsa; identical to SEQ ID NO: 250805

SEQ ID NO: 433116 - RNA, 64 nt, hsa; identical to SEQ ID NO: 250806

SEQ ID NO: 433117 - RNA, 64 nt, hsa; identical to SEQ ID NO: 250807

SEQ ID NO: 433118 - RNA, 64 nt, hsa; identical to SEQ ID NO: 250808

SEQ ID NO: 433119 - RNA, 64 nt, hsa; identical to SEQ ID NO: 250809

SEQ ID NO: 433120 - RNA, 64 nt, hsa; identical to SEQ ID NO: 250810

SEQ ID NO: 433121 - RNA, 64 nt, hsa; identical to SEQ ID NO: 250811

SEQ ID NO: 433122 - RNA, 64 nt, hsa; identical to SEQ ID NO: 250812

SEQ ID NO: 433123 - RNA, 64 nt, hsa; identical to SEQ ID NO: 250813

SEQ ID NO: 433124 - RNA, 64 nt, hsa; identical to SEQ ID NO: 250814

SEQ ID NO: 433125 - RNA, 64 nt, hsa; identical to SEQ ID NO: 250815

SEQ ID NO: 433126 - RNA, 64 nt, hsa; identical to SEQ ID NO: 250816

SEQ ID NO: 433127 - RNA, 64 nt, hsa; identical to SEQ ID NO: 250817

SEQ ID NO: 433128 - RNA, 64 nt, hsa; identical to SEQ ID NO: 250818

SEQ ID NO: 433129 - RNA, 64 nt, hsa; identical to SEQ ID NO: 250819

SEQ ID NO: 433130 - RNA, 64 nt, hsa; identical to SEQ ID NO: 250820

SEQ ID NO: 433131 - RNA, 64 nt, hsa; identical to SEQ ID NO: 250821

SEQ ID NO: 433132 - RNA, 64 nt, hsa; identical to SEQ ID NO: 250822

SEQ ID NO: 433133 - RNA, 64 nt, hsa; identical to SEQ ID NO: 250823

SEQ ID NO: 433134 - RNA, 64 nt, hsa; identical to SEQ ID NO: 250824

SEQ ID NO: 433135 - RNA, 64 nt, hsa; identical to SEQ ID NO: 250825

SEQ ID NO: 433136 - RNA, 64 nt, hsa; identical to SEQ ID NO: 250826

SEQ ID NO: 433137 - RNA, 64 nt, hsa; identical to SEQ ID NO: 250827

SEQ ID NO: 433138 - RNA, 64 nt, hsa; identical to SEQ ID NO: 250828

SEQ ID NO: 433139 - RNA, 64 nt, hsa; identical to SEQ ID NO: 250829

SEQ ID NO: 433140 - RNA, 64 nt, hsa; identical to SEQ ID NO: 250830

SEQ ID NO: 433141 - RNA, 64 nt, hsa; identical to SEQ ID NO: 250831

SEQ ID NO: 433142 - RNA, 64 nt, hsa; identical to SEQ ID NO: 250832

SEQ ID NO: 433143 - RNA, 64 nt, hsa; identical to SEQ ID NO: 250833

SEQ ID NO: 433144 - RNA, 64 nt, hsa; identical to SEQ ID NO: 250834

SEQ ID NO: 433145 - RNA, 64 nt, hsa; identical to SEQ ID NO: 250835

SEQ ID NO: 433146 - RNA, 64 nt, hsa; identical to SEQ ID NO: 250836

SEQ ID NO: 433147 - RNA, 64 nt, hsa; identical to SEQ ID NO: 250837

SEQ ID NO: 433148 - RNA, 64 nt, hsa; identical to SEQ ID NO: 250838

SEQ ID NO: 433149 - RNA, 64 nt, hsa; identical to SEQ ID NO: 250839

SEQ ID NO: 433150 - RNA, 58 nt, hsa; identical to SEQ ID NO: 250840

SEQ ID NO: 433151 - RNA, 64 nt, hsa; identical to SEQ ID NO: 250841

SEQ ID NO: 433152 - RNA, 64 nt, hsa; identical to SEQ ID NO: 250842

SEQ ID NO: 433153 - RNA, 64 nt, hsa; identical to SEQ ID NO: 250843

SEQ ID NO: 433154 - RNA, 64 nt, hsa; identical to SEQ ID NO: 250844

SEQ ID NO: 433155 - RNA, 64 nt, hsa; identical to SEQ ID NO: 250845

SEQ ID NO: 433156 - RNA, 64 nt, hsa; identical to SEQ ID NO: 250846

SEQ ID NO: 433157 - RNA, 64 nt, hsa; identical to SEQ ID NO: 250847

SEQ ID NO: 433158 - RNA, 64 nt, hsa; identical to SEQ ID NO: 250848

SEQ ID NO: 433159 - RNA, 64 nt, hsa; identical to SEQ ID NO: 250849

SEQ ID NO: 433160 - RNA, 64 nt, hsa; identical to SEQ ID NO: 250850

SEQ ID NO: 433161 - RNA, 64 nt, hsa; identical to SEQ ID NO: 250851

SEQ ID NO: 433162 - RNA, 64 nt, hsa; identical to SEQ ID NO: 250852

SEQ ID NO: 433163 - RNA, 64 nt, hsa; identical to SEQ ID NO: 250853

SEQ ID NO: 433164 - RNA, 64 nt, hsa; identical to SEQ ID NO: 250854

SEQ ID NO: 433165 - RNA, 64 nt, hsa; identical to SEQ ID NO: 250855

SEQ ID NO: 433166 - RNA, 64 nt, hsa; identical to SEQ ID NO: 250856

SEQ ID NO: 433167 - RNA, 64 nt, hsa; identical to SEQ ID NO: 250857

SEQ ID NO: 433168 - RNA, 64 nt, hsa; identical to SEQ ID NO: 250858

SEQ ID NO: 433169 - RNA, 64 nt, hsa; identical to SEQ ID NO: 250859

SEQ ID NO: 433170 - RNA, 64 nt, hsa; identical to SEQ ID NO: 250860

SEQ ID NO: 433171 - RNA, 63 nt, hsa; identical to SEQ ID NO: 250861

SEQ ID NO: 433172 - RNA, 64 nt, hsa; identical to SEQ ID NO: 250862

SEQ ID NO: 433173 - RNA, 64 nt, hsa; identical to SEQ ID NO: 250863

SEQ ID NO: 433174 - RNA, 64 nt, hsa; identical to SEQ ID NO: 250864

SEQ ID NO: 433175 - RNA, 64 nt, hsa; identical to SEQ ID NO: 250865

SEQ ID NO: 433176 - RNA, 64 nt, hsa; identical to SEQ ID NO: 250866

SEQ ID NO: 433177 - RNA, 64 nt, hsa; identical to SEQ ID NO: 250867

SEQ ID NO: 433178 - RNA, 64 nt, hsa; identical to SEQ ID NO: 250868

SEQ ID NO: 433179 - RNA, 64 nt, hsa; identical to SEQ ID NO: 250869

SEQ ID NO: 433180 - RNA, 64 nt, hsa; identical to SEQ ID NO: 250870

SEQ ID NO: 433181 - RNA, 64 nt, hsa; identical to SEQ ID NO: 250871

SEQ ID NO: 433182 - RNA, 64 nt, hsa; identical to SEQ ID NO: 250872

SEQ ID NO: 433183 - RNA, 64 nt, hsa; identical to SEQ ID NO: 250873

SEQ ID NO: 433184 - RNA, 64 nt, hsa; identical to SEQ ID NO: 250874

SEQ ID NO: 433185 - RNA, 64 nt, hsa; identical to SEQ ID NO: 250875

SEQ ID NO: 433186 - RNA, 64 nt, hsa; identical to SEQ ID NO: 250876

SEQ ID NO: 433187 - RNA, 64 nt, hsa; identical to SEQ ID NO: 250877

SEQ ID NO: 433188 - RNA, 64 nt, hsa; identical to SEQ ID NO: 250878

SEQ ID NO: 433189 - RNA, 64 nt, hsa; identical to SEQ ID NO: 250879

SEQ ID NO: 433190 - RNA, 64 nt, hsa; identical to SEQ ID NO: 250880

SEQ ID NO: 433191 - RNA, 64 nt, hsa; identical to SEQ ID NO: 250881

SEQ ID NO: 433192 - RNA, 64 nt, hsa; identical to SEQ ID NO: 250882

SEQ ID NO: 433193 - RNA, 64 nt, hsa; identical to SEQ ID NO: 250883

SEQ ID NO: 433194 - RNA, 64 nt, hsa; identical to SEQ ID NO: 250884

SEQ ID NO: 433195 - RNA, 64 nt, hsa; identical to SEQ ID NO: 250885

SEQ ID NO: 433196 - RNA, 64 nt, hsa; identical to SEQ ID NO: 250886

SEQ ID NO: 433197 - RNA, 64 nt, hsa; identical to SEQ ID NO: 250887

SEQ ID NO: 433198 - RNA, 64 nt, hsa; identical to SEQ ID NO: 250888

SEQ ID NO: 433199 - RNA, 64 nt, hsa; identical to SEQ ID NO: 250889

SEQ ID NO: 433200 - RNA, 64 nt, hsa; identical to SEQ ID NO: 250890

SEQ ID NO: 433201 - RNA, 64 nt, hsa
aaaaagagauaagaggaggaagcuaauaagagacugucaagauuguauaccuucuugguuucuu

SEQ ID NO: 433202 - RNA, 64 nt, hsa
acucagagcagucuucuuagccuauggucguacgugucaagacaucacguuguaaagagggaug

SEQ ID NO: 433203 - RNA, 63 nt, hsa
cugagagcauaaaauaaaccugacuguaugaagucaauuuaagugaugagaacauuuaacuuu

SEQ ID NO: 433204 - RNA, 63 nt, hsa
cuuuggaaucgugucuuccaugcuccacuggguucaauuuaaaauaggagaggcuuucucuuc

SEQ ID NO: 433205 - RNA, 63 nt, hsa
ccguuaaagguuuuuuuuuuuauauguauuaaaucaauuuaucacuguuuaaagcuuugaaua

SEQ ID NO: 433206 - RNA, 63 nt, hsa
auuggaaauauuucuuuuuucaggaugcuauagucaauuuaguaagugaccaccaaauuguua

SEQ ID NO: 433207 - RNA, 63 nt, hsa
aaucugcuguuaggagcuccaguugcuaaaaccucaauuuaagucuuuaaaagguuguauuuu

SEQ ID NO: 433208 - RNA, 63 nt, hsa
cuugagauuaguacuucagaguacuggccuuguucaauuuaguacuucaauuaguauuaaacu

SEQ ID NO: 433209 - RNA, 63 nt, hsa
caaucuugaacucauagauuauuaucuauuaucucaauuuaguuuguuauuuauccuaguggg

SEQ ID NO: 433210 - RNA, 63 nt, hsa
uaagcccagccaaguaacugaaccauuccaacuucaauuuacuuaugaaaagaauuugaugau

SEQ ID NO: 433211 - RNA, 63 nt, hsa
ggagaugauuguagaauuauuccuagaugagugucaauuuauuuaauuccauugucauauaag

SEQ ID NO: 433212 - RNA, 63 nt, hsa
ucagcuguaucuguagaaacucuuugacgaaccucaauuuaaccaauuugaugaauacccagu

SEQ ID NO: 433213 - RNA, 63 nt, hsa
ggagacagucucaagcacuaaaaaguggcuaauucaauuuaugggguauaguggccaaauagc

SEQ ID NO: 433214 - RNA, 63 nt, hsa
aauuuuauuauuagauucuccaaaugauuuucaucaauuuaaaaucauucaauaucugacagu

SEQ ID NO: 433215 - RNA, 63 nt, hsa
ugaagguuuugaaugccaaaagauauuuuagaaucaauuuauaaagggguaauucauuaauua

SEQ ID NO: 433216 - RNA, 63 nt, hsa
caugguacacuugauuaguaauaaaaccagagaucaauuuaaauugcugauagguccugucuc

SEQ ID NO: 433217 - RNA, 63 nt, hsa
cucacuguagcauucuuuacugcagagcaaaauucaauuuaagaugggcuucucugaggucca

SEQ ID NO: 433218 - RNA, 63 nt, hsa
aaagcagacugauacuaaauuuaaaauguaguuucaauuuaauaaucacauuagguuuaauuu

SEQ ID NO: 433219 - RNA, 64 nt, hsa; identical to SEQ ID NO: 291074

SEQ ID NO: 433220 - RNA, 64 nt, hsa; identical to SEQ ID NO: 291075

SEQ ID NO: 433221 - RNA, 64 nt, hsa; identical to SEQ ID NO: 291076

SEQ ID NO: 433222 - RNA, 64 nt, hsa; identical to SEQ ID NO: 291077

SEQ ID NO: 433223 - RNA, 64 nt, hsa; identical to SEQ ID NO: 291078

SEQ ID NO: 433224 - RNA, 64 nt, hsa; identical to SEQ ID NO: 291079

SEQ ID NO: 433225 - RNA, 64 nt, hsa; identical to SEQ ID NO: 291080

SEQ ID NO: 433226 - RNA, 64 nt, hsa; identical to SEQ ID NO: 291081

SEQ ID NO: 433227 - RNA, 64 nt, hsa; identical to SEQ ID NO: 291082

SEQ ID NO: 433228 - RNA, 64 nt, hsa; identical to SEQ ID NO: 291083

SEQ ID NO: 433229 - RNA, 64 nt, hsa; identical to SEQ ID NO: 291084

SEQ ID NO: 433230 - RNA, 64 nt, hsa; identical to SEQ ID NO: 291085

SEQ ID NO: 433231 - RNA, 64 nt, hsa; identical to SEQ ID NO: 291086

SEQ ID NO: 433232 - RNA, 64 nt, hsa; identical to SEQ ID NO: 291087

SEQ ID NO: 433233 - RNA, 64 nt, hsa; identical to SEQ ID NO: 291088

SEQ ID NO: 433234 - RNA, 64 nt, hsa; identical to SEQ ID NO: 291089

SEQ ID NO: 433235 - RNA, 64 nt, hsa
uccugcuggcuccuugcuugauuucccucagcaaacccuugaacuugcuaggccaugaauacac

SEQ ID NO: 433236 - RNA, 64 nt, hsa
gugccccccaaaugaaugcauuuucuucccacuaacccuugauuuuucuucauucauggugaaa

SEQ ID NO: 433237 - RNA, 64 nt, hsa
aaacuuagauccuucucccuuuuggcccaaaagaacccuugauuuaguuccagaauccaaccag

SEQ ID NO: 433238 - RNA, 64 nt, hsa
guucacaaaagguucucauggugccugacagguuacccuugagggcuugugucuacuuuuuaaa

SEQ ID NO: 433239 - RNA, 64 nt, hsa
aguaaagcuuccaugcuucacccuugacaugauuacccuugaguaaaacaugggaauuuguagu

SEQ ID NO: 433240 - RNA, 64 nt, hsa
ggcaaaauauuucucaguaaagcuuccaugcuucacccuugacaugauuacccuugaguaaaac

SEQ ID NO: 433241 - RNA, 64 nt, hsa
aacgccuucugggcuuucuucagaggucacuucuacccuugaagcugucggcaaaagcgagcag

SEQ ID NO: 433242 - RNA, 64 nt, hsa
ugcuugacaacaaaagucagggugcagucgguccacccuugacugcucuuggcuuggucucuac

SEQ ID NO: 433243 - RNA, 64 nt, hsa; identical to SEQ ID NO: 352415

SEQ ID NO: 433244 - RNA, 64 nt, hsa; identical to SEQ ID NO: 352416

SEQ ID NO: 433245 - RNA, 64 nt, hsa; identical to SEQ ID NO: 352417

SEQ ID NO: 433246 - RNA, 64 nt, hsa; identical to SEQ ID NO: 352418

SEQ ID NO: 433247 - RNA, 64 nt, hsa; identical to SEQ ID NO: 352419

SEQ ID NO: 433248 - RNA, 64 nt, hsa; identical to SEQ ID NO: 352420

SEQ ID NO: 433249 - RNA, 64 nt, hsa; identical to SEQ ID NO: 352421

SEQ ID NO: 433250 - RNA, 64 nt, hsa; identical to SEQ ID NO: 352422

SEQ ID NO: 433251 - RNA, 64 nt, hsa; identical to SEQ ID NO: 352423

SEQ ID NO: 433252 - RNA, 64 nt, hsa; identical to SEQ ID NO: 352424

SEQ ID NO: 433253 - RNA, 64 nt, hsa; identical to SEQ ID NO: 352425

SEQ ID NO: 433254 - RNA, 64 nt, hsa; identical to SEQ ID NO: 352426

SEQ ID NO: 433255 - RNA, 64 nt, hsa; identical to SEQ ID NO: 352427

SEQ ID NO: 433256 - RNA, 64 nt, hsa; identical to SEQ ID NO: 352428

SEQ ID NO: 433257 - RNA, 64 nt, hsa; identical to SEQ ID NO: 352429

SEQ ID NO: 433258 - RNA, 64 nt, hsa; identical to SEQ ID NO: 352430

SEQ ID NO: 433259 - RNA, 64 nt, hsa; identical to SEQ ID NO: 352431

SEQ ID NO: 433260 - RNA, 64 nt, hsa; identical to SEQ ID NO: 352432

SEQ ID NO: 433261 - RNA, 64 nt, hsa; identical to SEQ ID NO: 352433

SEQ ID NO: 433262 - RNA, 64 nt, hsa; identical to SEQ ID NO: 352434

SEQ ID NO: 433263 - RNA, 64 nt, hsa; identical to SEQ ID NO: 352435

SEQ ID NO: 433264 - RNA, 64 nt, hsa; identical to SEQ ID NO: 352436

SEQ ID NO: 433265 - RNA, 64 nt, hsa; identical to SEQ ID NO: 352437

SEQ ID NO: 433266 - RNA, 64 nt, hsa; identical to SEQ ID NO: 352438

SEQ ID NO: 433267 - RNA, 64 nt, hsa; identical to SEQ ID NO: 352439

SEQ ID NO: 433268 - RNA, 64 nt, hsa; identical to SEQ ID NO: 352440

SEQ ID NO: 433269 - RNA, 64 nt, hsa; identical to SEQ ID NO: 352441

SEQ ID NO: 433270 - RNA, 64 nt, hsa; identical to SEQ ID NO: 352442

SEQ ID NO: 433271 - RNA, 64 nt, hsa; identical to SEQ ID NO: 352443

SEQ ID NO: 433272 - RNA, 64 nt, hsa; identical to SEQ ID NO: 352444

SEQ ID NO: 433273 - RNA, 64 nt, hsa; identical to SEQ ID NO: 352445

SEQ ID NO: 433274 - RNA, 64 nt, hsa; identical to SEQ ID NO: 352446

SEQ ID NO: 433275 - RNA, 64 nt, hsa; identical to SEQ ID NO: 352447

SEQ ID NO: 433276 - RNA, 64 nt, hsa; identical to SEQ ID NO: 352448

SEQ ID NO: 433277 - RNA, 64 nt, hsa; identical to SEQ ID NO: 352449

SEQ ID NO: 433278 - RNA, 64 nt, hsa; identical to SEQ ID NO: 352450

SEQ ID NO: 433279 - RNA, 64 nt, hsa; identical to SEQ ID NO: 352451

SEQ ID NO: 433280 - RNA, 64 nt, hsa; identical to SEQ ID NO: 352452

SEQ ID NO: 433281 - RNA, 64 nt, hsa; identical to SEQ ID NO: 352453

SEQ ID NO: 433282 - RNA, 64 nt, hsa; identical to SEQ ID NO: 352454

SEQ ID NO: 433283 - RNA, 64 nt, hsa; identical to SEQ ID NO: 352455

SEQ ID NO: 433284 - RNA, 64 nt, hsa; identical to SEQ ID NO: 352456

SEQ ID NO: 433285 - RNA, 64 nt, hsa; identical to SEQ ID NO: 352457

SEQ ID NO: 433286 - RNA, 64 nt, hsa; identical to SEQ ID NO: 352458

SEQ ID NO: 433287 - RNA, 64 nt, hsa; identical to SEQ ID NO: 352459

SEQ ID NO: 433288 - RNA, 64 nt, hsa; identical to SEQ ID NO: 352460

SEQ ID NO: 433289 - RNA, 64 nt, hsa; identical to SEQ ID NO: 352461

SEQ ID NO: 433290 - RNA, 64 nt, hsa; identical to SEQ ID NO: 352462

SEQ ID NO: 433291 - RNA, 64 nt, hsa; identical to SEQ ID NO: 352463

SEQ ID NO: 433292 - RNA, 64 nt, hsa; identical to SEQ ID NO: 352464

SEQ ID NO: 433293 - RNA, 64 nt, hsa; identical to SEQ ID NO: 352465

SEQ ID NO: 433294 - RNA, 64 nt, hsa; identical to SEQ ID NO: 352466

SEQ ID NO: 433295 - RNA, 64 nt, hsa; identical to SEQ ID NO: 345696

SEQ ID NO: 433296 - RNA, 64 nt, hsa; identical to SEQ ID NO: 345697

SEQ ID NO: 433297 - RNA, 64 nt, hsa; identical to SEQ ID NO: 88257

SEQ ID NO: 433298 - RNA, 64 nt, hsa; identical to SEQ ID NO: 88258

SEQ ID NO: 433299 - RNA, 64 nt, hsa; identical to SEQ ID NO: 88259

SEQ ID NO: 433300 - RNA, 64 nt, hsa; identical to SEQ ID NO: 88260

SEQ ID NO: 433301 - RNA, 64 nt, hsa; identical to SEQ ID NO: 88261

SEQ ID NO: 433302 - RNA, 64 nt, hsa; identical to SEQ ID NO: 88262

SEQ ID NO: 433303 - RNA, 64 nt, hsa; identical to SEQ ID NO: 88263

SEQ ID NO: 433304 - RNA, 64 nt, hsa; identical to SEQ ID NO: 88264

SEQ ID NO: 433305 - RNA, 64 nt, hsa; identical to SEQ ID NO: 88265

SEQ ID NO: 433306 - RNA, 64 nt, hsa; identical to SEQ ID NO: 88266

SEQ ID NO: 433307 - RNA, 64 nt, hsa; identical to SEQ ID NO: 88267

SEQ ID NO: 433308 - RNA, 64 nt, hsa; identical to SEQ ID NO: 88268

SEQ ID NO: 433309 - RNA, 64 nt, hsa; identical to SEQ ID NO: 88269

SEQ ID NO: 433310 - RNA, 64 nt, hsa; identical to SEQ ID NO: 88270

SEQ ID NO: 433311 - RNA, 64 nt, hsa; identical to SEQ ID NO: 88271

SEQ ID NO: 433312 - RNA, 64 nt, hsa; identical to SEQ ID NO: 88269

SEQ ID NO: 433313 - RNA, 64 nt, hsa; identical to SEQ ID NO: 88273

SEQ ID NO: 433314 - RNA, 64 nt, hsa; identical to SEQ ID NO: 88274

SEQ ID NO: 433315 - RNA, 64 nt, hsa; identical to SEQ ID NO: 88275

SEQ ID NO: 433316 - RNA, 64 nt, hsa; identical to SEQ ID NO: 88276

SEQ ID NO: 433317 - RNA, 64 nt, hsa; identical to SEQ ID NO: 88277

SEQ ID NO: 433318 - RNA, 64 nt, hsa; identical to SEQ ID NO: 88278

SEQ ID NO: 433319 - RNA, 64 nt, hsa; identical to SEQ ID NO: 88279

SEQ ID NO: 433320 - RNA, 64 nt, hsa; identical to SEQ ID NO: 88280

SEQ ID NO: 433321 - RNA, 64 nt, hsa; identical to SEQ ID NO: 88281

SEQ ID NO: 433322 - RNA, 64 nt, hsa; identical to SEQ ID NO: 88282

SEQ ID NO: 433323 - RNA, 64 nt, hsa; identical to SEQ ID NO: 88283

SEQ ID NO: 433324 - RNA, 64 nt, hsa; identical to SEQ ID NO: 88284

SEQ ID NO: 433325 - RNA, 64 nt, hsa; identical to SEQ ID NO: 88285

SEQ ID NO: 433326 - RNA, 64 nt, hsa; identical to SEQ ID NO: 88286

SEQ ID NO: 433327 - RNA, 64 nt, hsa; identical to SEQ ID NO: 88287

SEQ ID NO: 433328 - RNA, 64 nt, hsa; identical to SEQ ID NO: 88288

SEQ ID NO: 433329 - RNA, 64 nt, hsa; identical to SEQ ID NO: 88289

SEQ ID NO: 433330 - RNA, 64 nt, hsa; identical to SEQ ID NO: 88290

SEQ ID NO: 433331 - RNA, 64 nt, hsa; identical to SEQ ID NO: 88291

SEQ ID NO: 433332 - RNA, 64 nt, hsa; identical to SEQ ID NO: 88292

SEQ ID NO: 433333 - RNA, 64 nt, hsa; identical to SEQ ID NO: 88293

SEQ ID NO: 433334 - RNA, 64 nt, hsa; identical to SEQ ID NO: 88294

SEQ ID NO: 433335 - RNA, 64 nt, hsa; identical to SEQ ID NO: 88295

SEQ ID NO: 433336 - RNA, 64 nt, hsa; identical to SEQ ID NO: 88296

SEQ ID NO: 433337 - RNA, 64 nt, hsa; identical to SEQ ID NO: 88297

SEQ ID NO: 433338 - RNA, 64 nt, hsa; identical to SEQ ID NO: 88298

SEQ ID NO: 433339 - RNA, 64 nt, hsa; identical to SEQ ID NO: 88299

SEQ ID NO: 433340 - RNA, 64 nt, hsa; identical to SEQ ID NO: 88300

SEQ ID NO: 433341 - RNA, 64 nt, hsa; identical to SEQ ID NO: 88298

SEQ ID NO: 433342 - RNA, 64 nt, hsa; identical to SEQ ID NO: 88302

SEQ ID NO: 433343 - RNA, 64 nt, hsa; identical to SEQ ID NO: 88300

SEQ ID NO: 433344 - RNA, 64 nt, hsa; identical to SEQ ID NO: 88304

SEQ ID NO: 433345 - RNA, 64 nt, hsa; identical to SEQ ID NO: 88305

SEQ ID NO: 433346 - RNA, 64 nt, hsa; identical to SEQ ID NO: 88306

SEQ ID NO: 433347 - RNA, 64 nt, hsa; identical to SEQ ID NO: 88307

SEQ ID NO: 433348 - RNA, 64 nt, hsa; identical to SEQ ID NO: 88299

SEQ ID NO: 433349 - RNA, 64 nt, hsa; identical to SEQ ID NO: 88309

SEQ ID NO: 433350 - RNA, 64 nt, hsa; identical to SEQ ID NO: 88310

SEQ ID NO: 433351 - RNA, 64 nt, hsa; identical to SEQ ID NO: 88311

SEQ ID NO: 433352 - RNA, 64 nt, hsa; identical to SEQ ID NO: 88312

SEQ ID NO: 433353 - RNA, 64 nt, hsa; identical to SEQ ID NO: 88313

SEQ ID NO: 433354 - RNA, 64 nt, hsa; identical to SEQ ID NO: 88314

SEQ ID NO: 433355 - RNA, 64 nt, hsa; identical to SEQ ID NO: 88315

SEQ ID NO: 433356 - RNA, 64 nt, hsa; identical to SEQ ID NO: 88316

SEQ ID NO: 433357 - RNA, 64 nt, hsa; identical to SEQ ID NO: 88317

SEQ ID NO: 433358 - RNA, 64 nt, hsa; identical to SEQ ID NO: 88318

SEQ ID NO: 433359 - RNA, 64 nt, hsa; identical to SEQ ID NO: 88319

SEQ ID NO: 433360 - RNA, 64 nt, hsa; identical to SEQ ID NO: 88320

SEQ ID NO: 433361 - RNA, 64 nt, hsa; identical to SEQ ID NO: 88321

SEQ ID NO: 433362 - RNA, 64 nt, hsa; identical to SEQ ID NO: 88322

SEQ ID NO: 433363 - RNA, 64 nt, hsa; identical to SEQ ID NO: 88323

SEQ ID NO: 433364 - RNA, 64 nt, hsa; identical to SEQ ID NO: 88324

SEQ ID NO: 433365 - RNA, 64 nt, hsa; identical to SEQ ID NO: 88325

SEQ ID NO: 433366 - RNA, 64 nt, hsa; identical to SEQ ID NO: 88326

SEQ ID NO: 433367 - RNA, 64 nt, hsa; identical to SEQ ID NO: 88327

SEQ ID NO: 433368 - RNA, 64 nt, hsa; identical to SEQ ID NO: 88328

SEQ ID NO: 433369 - RNA, 64 nt, hsa; identical to SEQ ID NO: 88329

SEQ ID NO: 433370 - RNA, 64 nt, hsa; identical to SEQ ID NO: 88330

SEQ ID NO: 433371 - RNA, 64 nt, hsa; identical to SEQ ID NO: 106200

SEQ ID NO: 433372 - RNA, 64 nt, hsa; identical to SEQ ID NO: 106201

SEQ ID NO: 433373 - RNA, 64 nt, hsa; identical to SEQ ID NO: 106202

SEQ ID NO: 433374 - RNA, 64 nt, hsa; identical to SEQ ID NO: 106203

SEQ ID NO: 433375 - RNA, 64 nt, hsa; identical to SEQ ID NO: 106204

SEQ ID NO: 433376 - RNA, 64 nt, hsa; identical to SEQ ID NO: 106205

SEQ ID NO: 433377 - RNA, 64 nt, hsa; identical to SEQ ID NO: 106206

SEQ ID NO: 433378 - RNA, 64 nt, hsa; identical to SEQ ID NO: 106207

SEQ ID NO: 433379 - RNA, 64 nt, hsa; identical to SEQ ID NO: 210956

SEQ ID NO: 433380 - RNA, 64 nt, hsa; identical to SEQ ID NO: 210957

SEQ ID NO: 433381 - RNA, 64 nt, hsa; identical to SEQ ID NO: 210958

SEQ ID NO: 433382 - RNA, 64 nt, hsa; identical to SEQ ID NO: 210959

SEQ ID NO: 433383 - RNA, 64 nt, hsa; identical to SEQ ID NO: 81841

SEQ ID NO: 433384 - RNA, 64 nt, hsa; identical to SEQ ID NO: 81842

SEQ ID NO: 433385 - RNA, 64 nt, hsa; identical to SEQ ID NO: 81843

SEQ ID NO: 433386 - RNA, 64 nt, hsa; identical to SEQ ID NO: 81844

SEQ ID NO: 433387 - RNA, 64 nt, hsa; identical to SEQ ID NO: 81845

SEQ ID NO: 433388 - RNA, 64 nt, hsa; identical to SEQ ID NO: 81846

SEQ ID NO: 433389 - RNA, 64 nt, hsa; identical to SEQ ID NO: 81847

SEQ ID NO: 433390 - RNA, 64 nt, hsa; identical to SEQ ID NO: 81848

SEQ ID NO: 433391 - RNA, 64 nt, hsa; identical to SEQ ID NO: 81849

SEQ ID NO: 433392 - RNA, 64 nt, hsa; identical to SEQ ID NO: 81850

SEQ ID NO: 433393 - RNA, 64 nt, hsa; identical to SEQ ID NO: 81851

SEQ ID NO: 433394 - RNA, 61 nt, hsa; identical to SEQ ID NO: 81852

SEQ ID NO: 433395 - RNA, 64 nt, hsa; identical to SEQ ID NO: 81853

SEQ ID NO: 433396 - RNA, 51 nt, hsa; identical to SEQ ID NO: 81854

SEQ ID NO: 433397 - RNA, 64 nt, hsa; identical to SEQ ID NO: 81855

SEQ ID NO: 433398 - RNA, 64 nt, hsa; identical to SEQ ID NO: 81856

SEQ ID NO: 433399 - RNA, 64 nt, hsa; identical to SEQ ID NO: 81857

SEQ ID NO: 433400 - RNA, 64 nt, hsa; identical to SEQ ID NO: 81858

SEQ ID NO: 433401 - RNA, 64 nt, hsa; identical to SEQ ID NO: 81859

SEQ ID NO: 433402 - RNA, 64 nt, hsa; identical to SEQ ID NO: 81860

SEQ ID NO: 433403 - RNA, 64 nt, hsa; identical to SEQ ID NO: 81861

SEQ ID NO: 433404 - RNA, 64 nt, hsa; identical to SEQ ID NO: 81862

SEQ ID NO: 433405 - RNA, 64 nt, hsa; identical to SEQ ID NO: 81863

SEQ ID NO: 433406 - RNA, 64 nt, hsa; identical to SEQ ID NO: 81864

SEQ ID NO: 433407 - RNA, 64 nt, hsa; identical to SEQ ID NO: 81865

SEQ ID NO: 433408 - RNA, 64 nt, hsa; identical to SEQ ID NO: 81866

SEQ ID NO: 433409 - RNA, 64 nt, hsa; identical to SEQ ID NO: 81867

SEQ ID NO: 433410 - RNA, 64 nt, hsa; identical to SEQ ID NO: 81868

SEQ ID NO: 433411 - RNA, 64 nt, hsa; identical to SEQ ID NO: 81869

SEQ ID NO: 433412 - RNA, 64 nt, hsa; identical to SEQ ID NO: 81870

SEQ ID NO: 433413 - RNA, 64 nt, hsa; identical to SEQ ID NO: 81871

SEQ ID NO: 433414 - RNA, 64 nt, hsa; identical to SEQ ID NO: 81872

SEQ ID NO: 433415 - RNA, 64 nt, hsa; identical to SEQ ID NO: 81873

SEQ ID NO: 433416 - RNA, 64 nt, hsa; identical to SEQ ID NO: 81874

SEQ ID NO: 433417 - RNA, 64 nt, hsa; identical to SEQ ID NO: 81875

SEQ ID NO: 433418 - RNA, 64 nt, hsa; identical to SEQ ID NO: 81876

SEQ ID NO: 433419 - RNA, 64 nt, hsa; identical to SEQ ID NO: 81877

SEQ ID NO: 433420 - RNA, 64 nt, hsa; identical to SEQ ID NO: 81878

SEQ ID NO: 433421 - RNA, 64 nt, hsa; identical to SEQ ID NO: 81879

SEQ ID NO: 433422 - RNA, 64 nt, hsa; identical to SEQ ID NO: 81880

SEQ ID NO: 433423 - RNA, 64 nt, hsa; identical to SEQ ID NO: 81881

SEQ ID NO: 433424 - RNA, 64 nt, hsa; identical to SEQ ID NO: 81882

SEQ ID NO: 433425 - RNA, 64 nt, hsa; identical to SEQ ID NO: 81883

SEQ ID NO: 433426 - RNA, 64 nt, hsa; identical to SEQ ID NO: 81884

SEQ ID NO: 433427 - RNA, 64 nt, hsa; identical to SEQ ID NO: 81885

SEQ ID NO: 433428 - RNA, 64 nt, hsa; identical to SEQ ID NO: 81886

SEQ ID NO: 433429 - RNA, 64 nt, hsa; identical to SEQ ID NO: 81887

SEQ ID NO: 433430 - RNA, 64 nt, hsa; identical to SEQ ID NO: 81888

SEQ ID NO: 433431 - RNA, 64 nt, hsa; identical to SEQ ID NO: 81889

SEQ ID NO: 433432 - RNA, 64 nt, hsa; identical to SEQ ID NO: 81890

SEQ ID NO: 433433 - RNA, 64 nt, hsa; identical to SEQ ID NO: 81891

SEQ ID NO: 433434 - RNA, 64 nt, hsa; identical to SEQ ID NO: 81892

SEQ ID NO: 433435 - RNA, 64 nt, hsa; identical to SEQ ID NO: 81893

SEQ ID NO: 433436 - RNA, 64 nt, hsa; identical to SEQ ID NO: 81894

SEQ ID NO: 433437 - RNA, 64 nt, hsa; identical to SEQ ID NO: 81895

SEQ ID NO: 433438 - RNA, 64 nt, hsa; identical to SEQ ID NO: 81896

SEQ ID NO: 433439 - RNA, 64 nt, hsa; identical to SEQ ID NO: 81897

SEQ ID NO: 433440 - RNA, 64 nt, hsa; identical to SEQ ID NO: 81898

SEQ ID NO: 433441 - RNA, 64 nt, hsa; identical to SEQ ID NO: 81899

SEQ ID NO: 433442 - RNA, 64 nt, hsa; identical to SEQ ID NO: 81900

SEQ ID NO: 433443 - RNA, 64 nt, hsa; identical to SEQ ID NO: 81901

SEQ ID NO: 433444 - RNA, 64 nt, hsa; identical to SEQ ID NO: 81902

SEQ ID NO: 433445 - RNA, 64 nt, hsa; identical to SEQ ID NO: 81903

SEQ ID NO: 433446 - RNA, 64 nt, hsa; identical to SEQ ID NO: 81904

SEQ ID NO: 433447 - RNA, 64 nt, hsa; identical to SEQ ID NO: 81905

SEQ ID NO: 433448 - RNA, 64 nt, hsa; identical to SEQ ID NO: 81906

SEQ ID NO: 433449 - RNA, 64 nt, hsa; identical to SEQ ID NO: 81907

SEQ ID NO: 433450 - RNA, 64 nt, hsa; identical to SEQ ID NO: 81908

SEQ ID NO: 433451 - RNA, 64 nt, hsa; identical to SEQ ID NO: 81909

SEQ ID NO: 433452 - RNA, 64 nt, hsa; identical to SEQ ID NO: 81910

SEQ ID NO: 433453 - RNA, 64 nt, hsa; identical to SEQ ID NO: 81911

SEQ ID NO: 433454 - RNA, 64 nt, hsa; identical to SEQ ID NO: 81912

SEQ ID NO: 433455 - RNA, 64 nt, hsa; identical to SEQ ID NO: 81913

SEQ ID NO: 433456 - RNA, 64 nt, hsa; identical to SEQ ID NO: 81914

SEQ ID NO: 433457 - RNA, 64 nt, hsa; identical to SEQ ID NO: 81915

SEQ ID NO: 433458 - RNA, 64 nt, hsa; identical to SEQ ID NO: 81916

SEQ ID NO: 433459 - RNA, 64 nt, hsa; identical to SEQ ID NO: 81917

SEQ ID NO: 433460 - RNA, 64 nt, hsa; identical to SEQ ID NO: 81918

SEQ ID NO: 433461 - RNA, 64 nt, hsa; identical to SEQ ID NO: 81919

SEQ ID NO: 433462 - RNA, 64 nt, hsa; identical to SEQ ID NO: 81920

SEQ ID NO: 433463 - RNA, 64 nt, hsa; identical to SEQ ID NO: 81921

SEQ ID NO: 433464 - RNA, 64 nt, hsa; identical to SEQ ID NO: 81922

SEQ ID NO: 433465 - RNA, 64 nt, hsa; identical to SEQ ID NO: 81923

SEQ ID NO: 433466 - RNA, 64 nt, hsa; identical to SEQ ID NO: 81924

SEQ ID NO: 433467 - RNA, 64 nt, hsa; identical to SEQ ID NO: 81925

SEQ ID NO: 433468 - RNA, 64 nt, hsa; identical to SEQ ID NO: 81926

SEQ ID NO: 433469 - RNA, 64 nt, hsa; identical to SEQ ID NO: 81927

SEQ ID NO: 433470 - RNA, 64 nt, hsa; identical to SEQ ID NO: 81928

SEQ ID NO: 433471 - RNA, 64 nt, hsa; identical to SEQ ID NO: 81929

SEQ ID NO: 433472 - RNA, 64 nt, hsa; identical to SEQ ID NO: 81930

SEQ ID NO: 433473 - RNA, 64 nt, hsa; identical to SEQ ID NO: 81931

SEQ ID NO: 433474 - RNA, 64 nt, hsa; identical to SEQ ID NO: 81932

SEQ ID NO: 433475 - RNA, 64 nt, hsa; identical to SEQ ID NO: 81933

SEQ ID NO: 433476 - RNA, 64 nt, hsa; identical to SEQ ID NO: 81934

SEQ ID NO: 433477 - RNA, 64 nt, hsa; identical to SEQ ID NO: 81935

SEQ ID NO: 433478 - RNA, 64 nt, hsa; identical to SEQ ID NO: 81936

SEQ ID NO: 433479 - RNA, 64 nt, hsa; identical to SEQ ID NO: 81937

SEQ ID NO: 433480 - RNA, 64 nt, hsa; identical to SEQ ID NO: 81938

SEQ ID NO: 433481 - RNA, 64 nt, hsa; identical to SEQ ID NO: 81939

SEQ ID NO: 433482 - RNA, 64 nt, hsa; identical to SEQ ID NO: 81940

SEQ ID NO: 433483 - RNA, 64 nt, hsa; identical to SEQ ID NO: 81941

SEQ ID NO: 433484 - RNA, 64 nt, hsa; identical to SEQ ID NO: 81942

SEQ ID NO: 433485 - RNA, 64 nt, hsa; identical to SEQ ID NO: 81943

SEQ ID NO: 433486 - RNA, 64 nt, hsa; identical to SEQ ID NO: 81944

SEQ ID NO: 433487 - RNA, 64 nt, hsa
ccucguguccugcuagcugucucucuuguugauuuccgugaaaaugcaaguguuugaagucugc

SEQ ID NO: 433488 - RNA, 64 nt, hsa
uaauauaccaaaauaaaaugaaaaauugaguuuuuccgugaacuuuauacuguccagcucuguu

SEQ ID NO: 433489 - RNA, 64 nt, hsa
aaucggcagaggccuccguggugaagacagaagcuccgugaaccaacucgaggcuggagccaag

SEQ ID NO: 433490 - RNA, 64 nt, hsa
cugagucuuucuuagauuaaaucucucccaguuguccgugaagagaaagacaguauuugcagug

SEQ ID NO: 433491 - RNA, 64 nt, hsa
aaccccagacaguggacaauucuacuuugaaauauccgugaauauuuacugugggauccaauuu

SEQ ID NO: 433492 - RNA, 64 nt, hsa
ccugcuuucagagcaaaacucaagucccucuuccuccgugaagcuucucccucagcugagcagu

SEQ ID NO: 433493 - RNA, 64 nt, hsa
ggccauaguuaaaaaguaccagcucuggcugggguccgugaagcccaggccaggcagccaaauc

SEQ ID NO: 433494 - RNA, 64 nt, hsa
auauagacaccccucaccaugagcucucugugaauccgugaauuuccuaaaauuguaagcaaaa

SEQ ID NO: 433495 - RNA, 64 nt, hsa
uacccuaauagcaugaagaucgugggucuguguguccgugaagugagucccgucugccaggagc

SEQ ID NO: 433496 - RNA, 64 nt, hsa
aaucccacccccugcccugagacagugaauguaguccgugaagggagugccucucugggacccc

SEQ ID NO: 433497 - RNA, 64 nt, hsa
aauaaauuaauaaauauauucuguauuuuugcucuccgugaaaaacaaaagagccucugacauu

SEQ ID NO: 433498 - RNA, 64 nt, hsa
cugagaaagcccccucccugcucuaagaaggggcuccgugaaguucuucccagagccgcgcugc

SEQ ID NO: 433499 - RNA, 64 nt, hsa
ggaagccaccgggagauuucuggaugguggugcauccgugaaugcgcugaucguuucuuccagu

SEQ ID NO: 433500 - RNA, 64 nt, hsa
acuggguaugcagucaacaggaugggccuggagauccgugaacugcaggccacguacccaugac

SEQ ID NO: 433501 - RNA, 64 nt, hsa
cccagcggcccucuuuccugucuguguaaauuguuccgugaagccgcgcucuguuuugggaaua

SEQ ID NO: 433502 - RNA, 64 nt, hsa
uugguuucuuggucguccuuugagugacaacuucuccgugaaccugcugaagaggcagaaaggc

SEQ ID NO: 433503 - RNA, 64 nt, hsa
acuuagcaacaaaguaccuucuaauuuccaauaguccgugaaaguuggggcugaaguaccuaag

SEQ ID NO: 433504 - RNA, 64 nt, hsa
gagaccagccugggcaacauggugaaacccuaucuccgugaaaaaauaugaaaauuagccaaga

SEQ ID NO: 433505 - RNA, 64 nt, hsa
uagaaagaagcucgccccaccuccaccugugagauccgugaauucucggaauggcaggggaagc

SEQ ID NO: 433506 - RNA, 64 nt, hsa
ugagccuggggacgacauggcaggcuggucccccuccgugaaaguguggauuccuacuuccugc

SEQ ID NO: 433507 - RNA, 64 nt, hsa
gugaaguggcuauuucuuuauauuuauccacuacuccgugaaggcuucucuguucuacccguuc

SEQ ID NO: 433508 - RNA, 64 nt, hsa
gguacuguuauucauaagucauauuaacauucucuccgugaaaucaugguacagucacugccca

SEQ ID NO: 433509 - RNA, 64 nt, hsa
agggugauagcucagggaacaacaaaaaaggaauuccgugaaaacauuuuuuuuucuuugauga

SEQ ID NO: 433510 - RNA, 64 nt, hsa
cucaguccuucaccuugccaggugccguuucucuuccgugaaggccacugcccagguccccagu

SEQ ID NO: 433511 - RNA, 64 nt, hsa
ccaauguaggagcugccuuggcucagacauguuuuccgugaaaacggagcugaacaauaggcug

SEQ ID NO: 433512 - RNA, 64 nt, hsa
uggggagcgaaaguuucuuggucucagcuucauuuccgugaagggcaccgagaacucgaagccc

SEQ ID NO: 433513 - RNA, 64 nt, hsa
uuauaucuguaaaaucccuugguaaaggaaaagcuccgugaaaaugucaguuacuuuuacuaag

SEQ ID NO: 433514 - RNA, 64 nt, hsa
gaugacucuacugcguggaugguuacauuugcuuuccgugaaaugcucagaaaaugucaggaca

SEQ ID NO: 433515 - RNA, 64 nt, hsa
uccauggaugcauauaggauguuugggagcaucauccgugaagaaaaaaucaauuaaaucauug

SEQ ID NO: 433516 - RNA, 64 nt, hsa
aucaacaacacuacuucccugccggaaugaacuguccgugaauggucucugucaagcgggccgu

SEQ ID NO: 433517 - RNA, 64 nt, hsa
caagccaccacauuuuguaaugcagaguuuuuuuuccgugaaagauuucuuaaaauauuacuuu

SEQ ID NO: 433518 - RNA, 64 nt, hsa
uuugcucauaaguaaaugucuucauguugauguguccgugaaaguugugaucuguuguaauauc

SEQ ID NO: 433519 - RNA, 64 nt, hsa
agcaaaauaggguuuuucaagaucuuucugguaauccgugaauauauuuaaaaaaaaaaagucu

SEQ ID NO: 433520 - RNA, 64 nt, hsa
acgaccccaccaguggggugcccgcugccuguccuccgugaaaccagccucagaucagggcccu

SEQ ID NO: 433521 - RNA, 64 nt, hsa
agugaagcugccagagcccuccucaguggcacgcuccgugaagaaguaguacaccuugucauca

SEQ ID NO: 433522 - RNA, 64 nt, hsa
ucucuuuucuauuuauauguguggcuuaggacccuccgugaacagaugauagagggcaucucuc

SEQ ID NO: 433523 - RNA, 64 nt, hsa
uuguuucccaucacuguauccauucuaccuguccuccgugaaaauauguuuggaauauuccacu

SEQ ID NO: 433524 - RNA, 64 nt, hsa
uauccuuucuaggcuuggagauggcuuugguugguccgugaauguaguuaugagagugcugcca

SEQ ID NO: 433525 - RNA, 64 nt, hsa
accugagcaacaaugauuaugagagaggauggcuuccgugaaagaccaugccuggucuguccug

SEQ ID NO: 433526 - RNA, 64 nt, hsa
uacccugacugcacuacagugguuuaucuaugacuccgugaaggucuacuucagacuuccucgc

SEQ ID NO: 433527 - RNA, 64 nt, hsa
cccuggacaggucccaaaguuccaagcaguccuuuccgugaaagcagggguuugcaugugcuac

SEQ ID NO: 433528 - RNA, 64 nt, hsa
gggacuccggcucccuaccccaaacugaagcgcuuccgugaacacccccguccuccguaggggg

SEQ ID NO: 433529 - RNA, 64 nt, hsa
cugcugcucauggggguggggguucccaacccuuuccgugaaagggaccgugaguaguggaaac

SEQ ID NO: 433530 - RNA, 64 nt, hsa
auuuaagugcauaaagaauaguaauuuagaaguauccgugaaaaguugauaaugaaagaaauuu

SEQ ID NO: 433531 - RNA, 64 nt, hsa
ggcagcagcugggccuucgaggcgcaccuuccccuccgugaaaccuggggugggacuguccccu

SEQ ID NO: 433532 - RNA, 64 nt, hsa
aguuucacauugcaguuagccccagaaaaugaaauccgugaagucacauuccacaucuguuuca

SEQ ID NO: 433533 - RNA, 64 nt, hsa
uauucaguccuucagcucacggaagggaugcuaguccgugaaggugaccucacaguacugguua

SEQ ID NO: 433534 - RNA, 64 nt, hsa
agcacuaguauuucauguugcacacccacucagcuccgugaacuugugagaacacagccgauuc

SEQ ID NO: 433535 - RNA, 64 nt, hsa
cuuuccgagccuccaguccaaagccggcuugauuuccgugaacucuggugcuccugcaucucau

SEQ ID NO: 433536 - RNA, 64 nt, hsa
aucacgccaccuccucucugagccugucucccacuccgugaaauggguaacaucaccucgaagg

SEQ ID NO: 433537 - RNA, 64 nt, hsa
uuguuucccucccagccccaaaccuuuuguucucuccgugaaacuuaccuuucccuuuuucuuu

SEQ ID NO: 433538 - RNA, 64 nt, hsa
uguuuugauaugaaaacucucaugaauaaacaucuccgugaaacgccaaggcccucgucaaacc

SEQ ID NO: 433539 - RNA, 64 nt, hsa
ucuuagguuuacugugaagagaauguauucuguauccgugaauugcuuuaugggggggagggag

SEQ ID NO: 433540 - RNA, 64 nt, hsa
cuuugcaacccuccccaaccaaguccaccgaaaguccgugaagaaaggcuuugacuuuacccuc

SEQ ID NO: 433541 - RNA, 64 nt, hsa
aaggcuaaauaucaguguuaauuucuuguuugaauccgugaaaucaugccuguaaagcccaaac

SEQ ID NO: 433542 - RNA, 64 nt, hsa
caguccacuuugggucaugcuugcugcgagcacguccgugaacgucagcugugggccucgugca

SEQ ID NO: 433543 - RNA, 64 nt, hsa
ugauaucagagauuacuaugaauguuaguuucauuccgugaaacauuacuuccauauaaagaca

SEQ ID NO: 433544 - RNA, 64 nt, hsa
cucccaaauuugauuuuguuauuagaaaaaugauuccgugaacacagauguguuuugaagaagu

SEQ ID NO: 433545 - RNA, 64 nt, hsa
cccacaagggcucagugggcccaaacccuugaaauccgugaaaccggguggucccaagagcuag

SEQ ID NO: 433546 - RNA, 64 nt, hsa
aaaccagcagaaauggaacucugcuaaaugugcauccgugaaugcucccuugaauguggcugug

SEQ ID NO: 433547 - RNA, 64 nt, hsa
ccagcggugccugucggggaggguuccaaggugcuccgugaagagcaugggcaaguugucugac

SEQ ID NO: 433548 - RNA, 64 nt, hsa
guucucguucauuggcaacagcagaaccugccucuccgugaagucgucagccuaaaauuuguuu

SEQ ID NO: 433549 - RNA, 64 nt, hsa
gcuccugguacacggggguacacaccuguaucccuccgugaauaagcaucugguggacccccag

SEQ ID NO: 433550 - RNA, 64 nt, hsa
cugggcuuuagagcuggcuucugcccacacuuucuccgugaaaggaaaacaacuaugagucugc

SEQ ID NO: 433551 - RNA, 64 nt, hsa
agggcaacccugugacaauggcagguagugugcauccgugaauagcccagugcggggguugcuc

SEQ ID NO: 433552 - RNA, 64 nt, hsa
caguuuuccuccauguuauuuaugaauuuuauauuccgugaauguauauugucuuguaauguug

SEQ ID NO: 433553 - RNA, 64 nt, hsa
uucucugccgcccgcccacuccguuucccugugguccgugaaggacggccucaggccuuggcau

SEQ ID NO: 433554 - RNA, 64 nt, hsa
ucucccugacaacacaaaacuagagccaggggccuccgugaacucccagagcaugccugauaga

SEQ ID NO: 433555 - RNA, 64 nt, hsa
uucacgagcccaaguugaagagaagagacgcccauccgugaaggagcagaccauccauccgauc

SEQ ID NO: 433556 - RNA, 64 nt, hsa
caggcaagagggccagauaccuaacagguuuuucuccgugaaucuuaugcugaguaguuuuucc

SEQ ID NO: 433557 - RNA, 64 nt, hsa
uugcuuggauucuacgugcagcggguucucugccuccgugaagacaagcugggcuggggagaac

SEQ ID NO: 433558 - RNA, 64 nt, hsa
acaacaacaacaacaaaccacaaaauuauuugaguacugugaaggauuauuugucuaacaguuc

SEQ ID NO: 433559 - RNA, 64 nt, hsa
guuguggaaagagcguccauaggagaagugagaauacugugaaaaagggauguuagcauucauu

SEQ ID NO: 433560 - RNA, 64 nt, hsa
guucagaagauguuguuuugccaguauuagaaaauacugugagccgggcaugguggcuuacauc

SEQ ID NO: 433561 - RNA, 64 nt, hsa
uuguaaagaugguuuuacacacuauagaugucuauacugugaaaaguguuuucaauucugaaaa

SEQ ID NO: 433562 - RNA, 64 nt, hsa
gugaaccauuauuaauuuuuaagguauaauaugguacugugaugauuguguuaaaauauuuauu

SEQ ID NO: 433563 - RNA, 64 nt, hsa
uugaaaauuugaaaacuuacugaauauuuggugauacugugaaccauuauuaauuuuuaaggua

SEQ ID NO: 433564 - RNA, 64 nt, hsa
uguaaguuggaagaacacuggguugacagagaucuacugugagcuguauugggacugcuuugag

SEQ ID NO: 433565 - RNA, 64 nt, hsa
aaaaauagcuucuuccauaucagcuuauauuaaauacugugacacucugagaaaguuuaucauc

SEQ ID NO: 433566 - RNA, 64 nt, hsa
cuuguuuuaauuuuagagaaacuuugaguacagauacugugagcuuacauugaaaacagauauu

SEQ ID NO: 433567 - RNA, 64 nt, hsa
guggaaauuagagaguuguuuuauugguguuuucuacugugaguuaauuaaaaauuguuuuuau

SEQ ID NO: 433568 - RNA, 64 nt, hsa
aagggcggggucccugcagggcugaagccuaagcuacugugaggcgcucacgaguggcagcucc

SEQ ID NO: 433569 - RNA, 64 nt, hsa
cgugugaacacgugugugaguucaccauguacuguacugugauuuuuuuuuugucuuguuuugu

SEQ ID NO: 433570 - RNA, 64 nt, hsa
aauguuaagacucgugaaaagaauuacuauaagguacugugaaauaacugcgauuuugugagca

SEQ ID NO: 433571 - RNA, 64 nt, hsa
auugacauuuuaaguacaacuuuuaaggacuaauuacugugauggacacagaaauguagcugug

SEQ ID NO: 433572 - RNA, 64 nt, hsa
aguuauuauguacauuucagaauguacacauaaauacugugaugaaaaucaugugauugggauc

SEQ ID NO: 433573 - RNA, 64 nt, hsa
uaaauacugugaugaaaaucaugugauugggaucuacugugauguugucuucaaaggcaggaga

SEQ ID NO: 433574 - RNA, 64 nt, hsa
aaauuugcacacauuaugauuaaaauugggccucuacugugaugauuccuauuuccucucaugu

SEQ ID NO: 433575 - RNA, 64 nt, hsa
uaaacuaauuuaguuauccauugggggguguauuuacugugaugaagaugagacagaugccauc

SEQ ID NO: 433576 - RNA, 64 nt, hsa
guuuuccagaugucugccaacaagaaaugacucauacugugaugauaccuuuugcuuugccuug

SEQ ID NO: 433577 - RNA, 64 nt, hsa
uuauccucauucaaaagcacuggacagagaauguuacugugaauagagcacauauuacucuuuu

SEQ ID NO: 433578 - RNA, 64 nt, hsa
ucccauugguuaacaucugggugggucuauuacuuacugugaugacugcugucucagugggcau

SEQ ID NO: 433579 - RNA, 64 nt, hsa
gcugucucagugggcaugguguugauccacgggguacugugauaaccaccauggauacauuuug

SEQ ID NO: 433580 - RNA, 64 nt, hsa
aaccaccauggauacauuuugguggcccacuggguacugugaggacugcuacauugauggaugu

SEQ ID NO: 433581 - RNA, 64 nt, hsa
acaaugucuuuugcacaaacuuuguaacuuuuguuacugugaauucaaacauuacucuuuggac

SEQ ID NO: 433582 - RNA, 64 nt, hsa
uaauuaaggaaauaaaugugacucacauuucuuuuacugugacacaauaaugugauccuaaaac

SEQ ID NO: 433583 - RNA, 64 nt, hsa
uguagacaucugaagagggugcaccuuuucucuuuacugugacucaccucaaauauggcauugc

SEQ ID NO: 433584 - RNA, 64 nt, hsa
ccuaaacauuuagcgugcgguuucccaucaguuuuacugugaaugugaaaaggugaaacuguug

SEQ ID NO: 433585 - RNA, 64 nt, hsa
gaucagcagagccacccuagaucagcugaaacucuaagcacaaaaauaaaaacuuaucacugua

SEQ ID NO: 433586 - RNA, 64 nt, hsa
gcugcucagggaaacauuggcugggggcacggaauaagcacauaguaaaaagggaacaucaggg

SEQ ID NO: 433587 - RNA, 64 nt, hsa
uucuuugcaguuaagacugaagcugucaaagagguaagcacauuuuauauagacguaaggaaag

SEQ ID NO: 433588 - RNA, 64 nt, hsa
ucagagguguguuaguaaaaccugacggauuaacuaagcacacugggaugugucuccuacaguu

SEQ ID NO: 433589 - RNA, 64 nt, hsa
aaaagcacuagguauacaaguuugaaauaugauuuaagcacaguaugaugguuuaaauaguucu

SEQ ID NO: 433590 - RNA, 64 nt, hsa
gauguguaacuugugaugccuuagaaaaauauccuaagcacaaaauaaaccuuucuaaccacuu

SEQ ID NO: 433591 - RNA, 64 nt, hsa
uauguuuauugucuuguauccuuucucuggaguguaagcacaaugaagacaggaauuuuguaua

SEQ ID NO: 433592 - RNA, 64 nt, hsa
uuugcuagaacuguggaagcuucuacuccugcaguaagcacagaucgcacugccucaauaacuu

SEQ ID NO: 433593 - RNA, 64 nt, hsa
acacaaucaguguucaggcuucaguuauauaauguaagcacaacuaaaaugaaacuuguugacu

SEQ ID NO: 433594 - RNA, 64 nt, hsa
uaguccuuuguaaagcuguacagacuuugcaguuuaagcacaaugugcacauguuaguuuuaua

SEQ ID NO: 433595 - RNA, 64 nt, hsa
aaaauuccccuccauuugaauauggugguuguuauaagcacacacaagauacaugguggaagau

SEQ ID NO: 433596 - RNA, 64 nt, hsa
aucugggaugagaaacaggauuguuucacaauaguaagcacauaauuuuuaaggccaaggcaca

SEQ ID NO: 433597 - RNA, 64 nt, hsa
uucuacccucugucaguccugggggugacugggaaccagagagguugagcagaauuccuggacc

SEQ ID NO: 433598 - RNA, 64 nt, hsa
caggacgucagccagcacugcacagacagcugcgaccagagacuggaggugacccuugcccuuu

SEQ ID NO: 433599 - RNA, 64 nt, hsa
ucguaaagaauacaaaugcugcagaggaauccuuaccagagauccagaaagaacaucgcaaucu

SEQ ID NO: 433600 - RNA, 64 nt, hsa
uagaauuugauguuugaccauuuaugacuuaauuaccagagagccaguaaauuaggacaguguu

SEQ ID NO: 433601 - RNA, 64 nt, hsa
caggauguaagaggagagaggaauccacaggaccaccagagaggagagggaaccagauaugcag

SEQ ID NO: 433602 - RNA, 64 nt, hsa
accagauaugcagaucagagauagaggaaguggaaccagagagcugggagggaccaagguugua

SEQ ID NO: 433603 - RNA, 64 nt, hsa
agaagucuuaagagaugacugcucagauggagagaccagagaagagaacaagcuguugauuccu

SEQ ID NO: 433604 - RNA, 64 nt, hsa
uagcucagccauugcucagcaucagauaauucacaccagagagaaacccucugaaugugacgaa

SEQ ID NO: 433605 - RNA, 64 nt, hsa
gccaagacucauugcuggagguagagaggugucaaccagagaacagcuccccuagacauggccu

SEQ ID NO: 433606 - RNA, 64 nt, hsa
gucauuguggauagagcagccugcugcucucaggaccagagaagggaaaugacuucuccaggca

SEQ ID NO: 433607 - RNA, 64 nt, hsa
gccagccacugucagcaaagccuggagaaaugggaccagagagucugccccuaccacgucccug

SEQ ID NO: 433608 - RNA, 64 nt, hsa
uuucugcagauccagcucguggaccagcugcagcaccagagaaaagaguagcagagauggccug

SEQ ID NO: 433609 - RNA, 64 nt, hsa
gccacuuuaaaaacagcugaagugaccuuagcagaccagagauuuuauuuuuuuaaagagaaau

SEQ ID NO: 433610 - RNA, 64 nt, hsa
gguguccuggggacccaaggggugggggggucacaccagagagaggcagggggccuggccggcu

SEQ ID NO: 433611 - RNA, 64 nt, hsa
aaggccucuucuugucuuucauaggugaaaaagcaccagagaauacauacaugaagggacaaau

SEQ ID NO: 433612 - RNA, 64 nt, hsa
uagaaaauccuuuauugauuguucaacucuuaacaccagagaauucacacuggugagaaacccu

SEQ ID NO: 433613 - RNA, 64 nt, hsa
ugugugaucauaaacucauaaaaauaauuuuaagaugucggaaaaggauacuuugauuaaauaa

SEQ ID NO: 433614 - RNA, 64 nt, hsa
gcuaucgaagaaaugaagaagcacggaaguacucaugucggauucccagaaaaccugacuaaug

SEQ ID NO: 433615 - RNA, 64 nt, hsa
augcggggagggcuggugaccuccguggguuuauaugucggaaacucuucucuccaaaucccag

SEQ ID NO: 433616 - RNA, 64 nt, hsa
uuagggaaaaucagaugucucauauaauaaggugaugucggaaacacgcaaaacaaaacgaaaa

SEQ ID NO: 433617 - RNA, 64 nt, hsa
guggaggcgcagcagagggccgucccucuuccggaugucggacuaagcgaacagcgcccccacu

SEQ ID NO: 433618 - RNA, 64 nt, hsa
agggaaaacagucgaucaagggauguauuggaacaugucggaguagaaauuguuccugaugugc

SEQ ID NO: 433619 - RNA, 50 nt, hsa
cugaugugucugaggaauagaugucggaagugcaaacucuuaaaaaauug

SEQ ID NO: 433620 - RNA, 64 nt, hsa
uuagcuuauccucuuuguaguacuacuuaaaagcaugucggaauauaagaauaaaaaggauuau

SEQ ID NO: 433621 - RNA, 64 nt, hsa
agcggcgugugggagaagccacgucguguuucacaugucggagucgaaugcauuuguaaauccc

SEQ ID NO: 433622 - RNA, 64 nt, hsa
auuuugaaugucacaaauugaucaagauauuaaaaugucggauuuaucuuuccccauauccaag

SEQ ID NO: 433623 - RNA, 64 nt, hsa
ugcagugagagccacgagccaaggugggcacuugaugucggaucucuucaacaagcuggucaug

SEQ ID NO: 433624 - RNA, 64 nt, hsa
ucguaauucauagguacugacuccucagccccaaaugucggagaggaagaauucggucagccug

SEQ ID NO: 433625 - RNA, 64 nt, hsa
ugaccuaccucagguggaacggugagcagggaacaugucggaguccuucagagaaugugaugug

SEQ ID NO: 433626 - RNA, 64 nt, hsa
gaaucgucagaguccaaugugugccucuacaguaaugucggaaauaaauaccauucuugaaaua

SEQ ID NO: 433627 - RNA, 64 nt, hsa
cuucucuugugucuguugagacuuuaagggagaaaugucggaauuucagagucgccugacggca

SEQ ID NO: 433628 - RNA, 64 nt, hsa
aguggaguggaagcucuugaagcacuuucuuuucaugucggaggcugcgugugagccgguggug

SEQ ID NO: 433629 - RNA, 64 nt, hsa
cgagggauggcuuuagucuugaugaaugugaaccaugucggaauuguuagguagaaaccugggc

SEQ ID NO: 433630 - RNA, 64 nt, hsa
ugucaucucaaccccaucauccugccccuguggcaugucggaaugaaugacguccuuccuaaca

SEQ ID NO: 433631 - RNA, 64 nt, hsa; identical to SEQ ID NO: 355656

SEQ ID NO: 433632 - RNA, 64 nt, hsa; identical to SEQ ID NO: 355657

SEQ ID NO: 433633 - RNA, 64 nt, hsa; identical to SEQ ID NO: 355658

SEQ ID NO: 433634 - RNA, 64 nt, hsa; identical to SEQ ID NO: 355659

SEQ ID NO: 433635 - RNA, 64 nt, hsa; identical to SEQ ID NO: 355660

SEQ ID NO: 433636 - RNA, 64 nt, hsa; identical to SEQ ID NO: 355661

SEQ ID NO: 433637 - RNA, 64 nt, hsa; identical to SEQ ID NO: 355662

SEQ ID NO: 433638 - RNA, 64 nt, hsa; identical to SEQ ID NO: 355663

SEQ ID NO: 433639 - RNA, 64 nt, hsa; identical to SEQ ID NO: 355664

SEQ ID NO: 433640 - RNA, 64 nt, hsa; identical to SEQ ID NO: 355665

SEQ ID NO: 433641 - RNA, 64 nt, hsa; identical to SEQ ID NO: 355666

SEQ ID NO: 433642 - RNA, 64 nt, hsa; identical to SEQ ID NO: 355667

SEQ ID NO: 433643 - RNA, 64 nt, hsa; identical to SEQ ID NO: 355668

SEQ ID NO: 433644 - RNA, 64 nt, hsa; identical to SEQ ID NO: 355669

SEQ ID NO: 433645 - RNA, 64 nt, hsa; identical to SEQ ID NO: 250537

SEQ ID NO: 433646 - RNA, 64 nt, hsa; identical to SEQ ID NO: 250538

SEQ ID NO: 433647 - RNA, 64 nt, hsa; identical to SEQ ID NO: 250539

SEQ ID NO: 433648 - RNA, 64 nt, hsa; identical to SEQ ID NO: 250540

SEQ ID NO: 433649 - RNA, 64 nt, hsa; identical to SEQ ID NO: 250541

SEQ ID NO: 433650 - RNA, 64 nt, hsa; identical to SEQ ID NO: 250542

SEQ ID NO: 433651 - RNA, 64 nt, hsa; identical to SEQ ID NO: 250543

SEQ ID NO: 433652 - RNA, 64 nt, hsa; identical to SEQ ID NO: 250544

SEQ ID NO: 433653 - RNA, 64 nt, hsa; identical to SEQ ID NO: 250545

SEQ ID NO: 433654 - RNA, 64 nt, hsa; identical to SEQ ID NO: 250546

SEQ ID NO: 433655 - RNA, 64 nt, hsa; identical to SEQ ID NO: 250547

SEQ ID NO: 433656 - RNA, 64 nt, hsa; identical to SEQ ID NO: 250548

SEQ ID NO: 433657 - RNA, 64 nt, hsa; identical to SEQ ID NO: 250549

SEQ ID NO: 433658 - RNA, 64 nt, hsa; identical to SEQ ID NO: 250550

SEQ ID NO: 433659 - RNA, 64 nt, hsa; identical to SEQ ID NO: 250551

SEQ ID NO: 433660 - RNA, 64 nt, hsa; identical to SEQ ID NO: 250552

SEQ ID NO: 433661 - RNA, 64 nt, hsa; identical to SEQ ID NO: 250553

SEQ ID NO: 433662 - RNA, 64 nt, hsa; identical to SEQ ID NO: 250554

SEQ ID NO: 433663 - RNA, 64 nt, hsa; identical to SEQ ID NO: 250555

SEQ ID NO: 433664 - RNA, 64 nt, hsa; identical to SEQ ID NO: 250556

SEQ ID NO: 433665 - RNA, 64 nt, hsa; identical to SEQ ID NO: 250557

SEQ ID NO: 433666 - RNA, 64 nt, hsa; identical to SEQ ID NO: 250558

SEQ ID NO: 433667 - RNA, 64 nt, hsa; identical to SEQ ID NO: 250559

SEQ ID NO: 433668 - RNA, 64 nt, hsa; identical to SEQ ID NO: 250560

SEQ ID NO: 433669 - RNA, 64 nt, hsa; identical to SEQ ID NO: 250561

SEQ ID NO: 433670 - RNA, 64 nt, hsa; identical to SEQ ID NO: 250562

SEQ ID NO: 433671 - RNA, 64 nt, hsa; identical to SEQ ID NO: 250563

SEQ ID NO: 433672 - RNA, 64 nt, hsa; identical to SEQ ID NO: 250564

SEQ ID NO: 433673 - RNA, 64 nt, hsa; identical to SEQ ID NO: 250565

SEQ ID NO: 433674 - RNA, 64 nt, hsa; identical to SEQ ID NO: 250566

SEQ ID NO: 433675 - RNA, 64 nt, hsa; identical to SEQ ID NO: 250567

SEQ ID NO: 433676 - RNA, 64 nt, hsa; identical to SEQ ID NO: 250568

SEQ ID NO: 433677 - RNA, 64 nt, hsa; identical to SEQ ID NO: 250569

SEQ ID NO: 433678 - RNA, 64 nt, hsa; identical to SEQ ID NO: 250570

SEQ ID NO: 433679 - RNA, 64 nt, hsa; identical to SEQ ID NO: 250571

SEQ ID NO: 433680 - RNA, 64 nt, hsa; identical to SEQ ID NO: 250572

SEQ ID NO: 433681 - RNA, 64 nt, hsa; identical to SEQ ID NO: 250573

SEQ ID NO: 433682 - RNA, 64 nt, hsa; identical to SEQ ID NO: 250574

SEQ ID NO: 433683 - RNA, 64 nt, hsa; identical to SEQ ID NO: 250575

SEQ ID NO: 433684 - RNA, 64 nt, hsa; identical to SEQ ID NO: 250576

SEQ ID NO: 433685 - RNA, 64 nt, hsa; identical to SEQ ID NO: 250577

SEQ ID NO: 433686 - RNA, 64 nt, hsa; identical to SEQ ID NO: 250578

SEQ ID NO: 433687 - RNA, 64 nt, hsa; identical to SEQ ID NO: 250579

SEQ ID NO: 433688 - RNA, 64 nt, hsa; identical to SEQ ID NO: 250580

SEQ ID NO: 433689 - RNA, 62 nt, hsa; identical to SEQ ID NO: 250581

SEQ ID NO: 433690 - RNA, 64 nt, hsa; identical to SEQ ID NO: 250582

SEQ ID NO: 433691 - RNA, 64 nt, hsa; identical to SEQ ID NO: 250583

SEQ ID NO: 433692 - RNA, 64 nt, hsa; identical to SEQ ID NO: 250584

SEQ ID NO: 433693 - RNA, 64 nt, hsa; identical to SEQ ID NO: 250585

SEQ ID NO: 433694 - RNA, 64 nt, hsa; identical to SEQ ID NO: 250586

SEQ ID NO: 433695 - RNA, 64 nt, hsa; identical to SEQ ID NO: 250587

SEQ ID NO: 433696 - RNA, 64 nt, hsa; identical to SEQ ID NO: 396745

SEQ ID NO: 433697 - RNA, 64 nt, hsa; identical to SEQ ID NO: 396746

SEQ ID NO: 433698 - RNA, 64 nt, hsa; identical to SEQ ID NO: 396747

SEQ ID NO: 433699 - RNA, 64 nt, hsa; identical to SEQ ID NO: 396748

SEQ ID NO: 433700 - RNA, 64 nt, hsa; identical to SEQ ID NO: 396749

SEQ ID NO: 433701 - RNA, 64 nt, hsa; identical to SEQ ID NO: 396750

SEQ ID NO: 433702 - RNA, 64 nt, hsa; identical to SEQ ID NO: 396751

SEQ ID NO: 433703 - RNA, 64 nt, hsa; identical to SEQ ID NO: 396752

SEQ ID NO: 433704 - RNA, 64 nt, hsa; identical to SEQ ID NO: 396753

SEQ ID NO: 433705 - RNA, 64 nt, hsa; identical to SEQ ID NO: 396754

SEQ ID NO: 433706 - RNA, 64 nt, hsa; identical to SEQ ID NO: 396755

SEQ ID NO: 433707 - RNA, 64 nt, hsa; identical to SEQ ID NO: 396756

SEQ ID NO: 433708 - RNA, 64 nt, hsa; identical to SEQ ID NO: 396757

SEQ ID NO: 433709 - RNA, 64 nt, hsa; identical to SEQ ID NO: 396758

SEQ ID NO: 433710 - RNA, 64 nt, hsa; identical to SEQ ID NO: 396759

SEQ ID NO: 433711 - RNA, 64 nt, hsa; identical to SEQ ID NO: 396760

SEQ ID NO: 433712 - RNA, 64 nt, hsa; identical to SEQ ID NO: 396761

SEQ ID NO: 433713 - RNA, 64 nt, hsa; identical to SEQ ID NO: 396762

SEQ ID NO: 433714 - RNA, 64 nt, hsa; identical to SEQ ID NO: 396763

SEQ ID NO: 433715 - RNA, 64 nt, hsa; identical to SEQ ID NO: 396764

SEQ ID NO: 433716 - RNA, 64 nt, hsa; identical to SEQ ID NO: 53335

SEQ ID NO: 433717 - RNA, 64 nt, hsa; identical to SEQ ID NO: 53336

SEQ ID NO: 433718 - RNA, 64 nt, hsa; identical to SEQ ID NO: 53337

SEQ ID NO: 433719 - RNA, 64 nt, hsa; identical to SEQ ID NO: 53338

SEQ ID NO: 433720 - RNA, 64 nt, hsa; identical to SEQ ID NO: 53339

SEQ ID NO: 433721 - RNA, 64 nt, hsa; identical to SEQ ID NO: 53340

SEQ ID NO: 433722 - RNA, 64 nt, hsa; identical to SEQ ID NO: 53341

SEQ ID NO: 433723 - RNA, 64 nt, hsa; identical to SEQ ID NO: 53342

SEQ ID NO: 433724 - RNA, 51 nt, hsa; identical to SEQ ID NO: 53343

SEQ ID NO: 433725 - RNA, 64 nt, hsa; identical to SEQ ID NO: 53344

SEQ ID NO: 433726 - RNA, 64 nt, hsa; identical to SEQ ID NO: 53345

SEQ ID NO: 433727 - RNA, 64 nt, hsa; identical to SEQ ID NO: 53346

SEQ ID NO: 433728 - RNA, 64 nt, hsa; identical to SEQ ID NO: 53347

SEQ ID NO: 433729 - RNA, 64 nt, hsa; identical to SEQ ID NO: 53348

SEQ ID NO: 433730 - RNA, 64 nt, hsa; identical to SEQ ID NO: 53349

SEQ ID NO: 433731 - RNA, 64 nt, hsa; identical to SEQ ID NO: 53350

SEQ ID NO: 433732 - RNA, 64 nt, hsa; identical to SEQ ID NO: 53351

SEQ ID NO: 433733 - RNA, 64 nt, hsa; identical to SEQ ID NO: 53352

SEQ ID NO: 433734 - RNA, 64 nt, hsa; identical to SEQ ID NO: 53353

SEQ ID NO: 433735 - RNA, 64 nt, hsa; identical to SEQ ID NO: 53354

SEQ ID NO: 433736 - RNA, 64 nt, hsa; identical to SEQ ID NO: 53355

SEQ ID NO: 433737 - RNA, 64 nt, hsa; identical to SEQ ID NO: 53356

SEQ ID NO: 433738 - RNA, 64 nt, hsa; identical to SEQ ID NO: 53357

SEQ ID NO: 433739 - RNA, 64 nt, hsa; identical to SEQ ID NO: 53358

SEQ ID NO: 433740 - RNA, 64 nt, hsa; identical to SEQ ID NO: 53359

SEQ ID NO: 433741 - RNA, 64 nt, hsa; identical to SEQ ID NO: 53360

SEQ ID NO: 433742 - RNA, 64 nt, hsa; identical to SEQ ID NO: 53361

SEQ ID NO: 433743 - RNA, 64 nt, hsa; identical to SEQ ID NO: 53362

SEQ ID NO: 433744 - RNA, 64 nt, hsa; identical to SEQ ID NO: 53363

SEQ ID NO: 433745 - RNA, 64 nt, hsa; identical to SEQ ID NO: 53364

SEQ ID NO: 433746 - RNA, 64 nt, hsa; identical to SEQ ID NO: 53365

SEQ ID NO: 433747 - RNA, 64 nt, hsa; identical to SEQ ID NO: 53366

SEQ ID NO: 433748 - RNA, 64 nt, hsa; identical to SEQ ID NO: 53367

SEQ ID NO: 433749 - RNA, 64 nt, hsa; identical to SEQ ID NO: 53368

SEQ ID NO: 433750 - RNA, 64 nt, hsa; identical to SEQ ID NO: 53369

SEQ ID NO: 433751 - RNA, 64 nt, hsa; identical to SEQ ID NO: 53370

SEQ ID NO: 433752 - RNA, 64 nt, hsa; identical to SEQ ID NO: 53371

SEQ ID NO: 433753 - RNA, 64 nt, hsa; identical to SEQ ID NO: 53372

SEQ ID NO: 433754 - RNA, 64 nt, hsa
ggugccucucuccuuccucaggguacugcagaagggagcgaacaggguacuguucgcucuuguc

SEQ ID NO: 433755 - RNA, 64 nt, hsa
gcaggaacaccagacaugaacagguugaagaacuggagcgaagugcacaccucaccauccuuca

SEQ ID NO: 433756 - RNA, 64 nt, hsa
uaaggguuggaguuagaggagcccugucuaaagcggagcgaaaaggccagaauggguccccuac

SEQ ID NO: 433757 - RNA, 64 nt, hsa
caaaucccuuccuggagacuaaaccuggugcucaggagcgaaggacugugaacuuguggccuga

SEQ ID NO: 433758 - RNA, 64 nt, hsa
ccgguaggcugcgucgcccgagccccgggagagaggagcgaagauccggaacucgccaacucac

SEQ ID NO: 433759 - RNA, 64 nt, hsa
uuaagagaggaaauguacaucuuguauaacuuagggagcgaagaaaauguaggcgcgaaaguga

SEQ ID NO: 433760 - RNA, 64 nt, hsa
ggaagguuuucuuuauauacuauucccaccauggggagcgaaaacguuaaaaucacaaggaauu

SEQ ID NO: 433761 - RNA, 64 nt, hsa
aaaugaaccccuauugggcaccucugugaugccaggagcgaacuggugagcccagcgcccuggg

SEQ ID NO: 433762 - RNA, 64 nt, hsa
ccagcuccugauuccccauagguaacaucccuuaggagcgaagaguucaauuaguaauguuuau

SEQ ID NO: 433763 - RNA, 64 nt, hsa
uguaugucauaguaugucgucacauaaaagggagggagcgaaaaaccauuacauuaagauaaua

SEQ ID NO: 433764 - RNA, 64 nt, hsa
auucuccaaaggaccugaaagagcaaaagaggugggagcgaaagccuuaaggaucccacgacuu

SEQ ID NO: 433765 - RNA, 64 nt, hsa
uuuuauccaagaaauuaaccauuuucuaaaucauggagcgaauaauuuucaauaacagauccaa

SEQ ID NO: 433766 - RNA, 64 nt, hsa
cucccccagacacagcccaggucccuccgcggcuggagcgaagccuucugcagcaggaacucug

SEQ ID NO: 433767 - RNA, 64 nt, hsa
aaaugugaaucucgacaaaucgaggacugaagagggagcgaacgagcgaacaacugagcccaag

SEQ ID NO: 433768 - RNA, 64 nt, hsa
ggugacugcuguaggcugucccagugcgaggccgggagcgaauggaaaagcugaggcuuugccu

SEQ ID NO: 433769 - RNA, 64 nt, hsa
caauacaagaaaagggauccccagguaaucugguggagcgaauacugcaauaaauuuuuuuacu

SEQ ID NO: 433770 - RNA, 64 nt, hsa
gaggauguggguugggacagguaguaccuaaagaggagcgaagggauuuauacaacauuuuuau

SEQ ID NO: 433771 - RNA, 64 nt, hsa
cucagugccucgugugcucaguggucaugggaaaggagcgaaggaaccauccuugguucuccca

SEQ ID NO: 433772 - RNA, 64 nt, hsa
ccaagggcucaaagacgcacucuuccacccuuuuggagcgaauuuagaaccucagcccuaucuc

SEQ ID NO: 433773 - RNA, 64 nt, hsa
agagccaggugcugcucagcagaggauaugggugggagcgaaaguuguaacaaguggggguggg

SEQ ID NO: 433774 - RNA, 64 nt, hsa
agaggugggcagcagcucagccuccccccgcuggggagcgaaaguuucuuggucucagcuucau

SEQ ID NO: 433775 - RNA, 64 nt, hsa
gccaugggaaggagcccaggggagcuggccugggggagcgaagcccauguucgcuuccugacuu

SEQ ID NO: 433776 - RNA, 64 nt, hsa
caggaggaaagaauugcuccaaaaaucugcacgcggagcgaaacaguuugaaagggacugaggc

SEQ ID NO: 433777 - RNA, 64 nt, hsa
agacccaaagcaggacgggagacaacugcuuggaggagcgaagagcccuggcauuuuaucucug

SEQ ID NO: 433778 - RNA, 64 nt, hsa
gugugcgcaccuccccggcccuggcccaccuucuggagcgaacugcaccgugguccagcagagg

SEQ ID NO: 433779 - RNA, 64 nt, hsa
ccagagcccuuggacuggcacagggacccucgauggagcgaagcccucaaacgggaugcuuucu

SEQ ID NO: 433780 - RNA, 64 nt, hsa
guaaccaaaggacuguuuucucuacacaaagucaggagcgaauaccaaccuuuauuugcacuug

SEQ ID NO: 433781 - RNA, 64 nt, hsa
uggaaaagucucccaaaccuucagagaguggaugggagcgaaguaaggagaccccaccugagca

SEQ ID NO: 433782 - RNA, 64 nt, hsa
cagcggaggagaccagcucagaggcccaggaaucggagcgaagcagagagguggagaacuggga

SEQ ID NO: 433783 - RNA, 64 nt, hsa
auccuuucagaauguagcacucacgcccuaauaaggagcgaauccuacauccaccaaggcgggc

SEQ ID NO: 433784 - RNA, 64 nt, hsa
ggagcccgggaagcugcucgccucggcagccauaggagcgaacacugcugcucucucgcuggcc

SEQ ID NO: 433785 - RNA, 64 nt, hsa
aacuucaagccgguaacugcacacaacaggccugggagcgaacugugugaaggaccuuaauuca

SEQ ID NO: 433786 - RNA, 64 nt, hsa
augcaugaugaacucaccuaauuaugaggugggaggagcgaaaucuaaauuucuuuugcuauag

SEQ ID NO: 433787 - RNA, 64 nt, hsa
uuuugagagccaaaggcuggcgcuucugacuucaggagcgaaaggaggaggccuaguuugggcc

SEQ ID NO: 433788 - RNA, 64 nt, hsa
cccugccccaggacuucaucggagcaggcaggguggagcgaaggagcuccuuagcccaccuggu

SEQ ID NO: 433789 - RNA, 64 nt, hsa
ucuucagggaaaucaacaagccaacagacaagaaggagcgaaaguauauuuuauuugaugguga

SEQ ID NO: 433790 - RNA, 64 nt, hsa
agaaccaccacuguccucgaugugucccaagccuggagcgaauccguccucuuggcucucccag

SEQ ID NO: 433791 - RNA, 64 nt, hsa
augaaauuaaagucugaggacgagagcacgccugggagcgaaagcuggccuuuuuucuacgaau

SEQ ID NO: 433792 - RNA, 64 nt, hsa
guggagugugugucuuuccucccugaagcugugcggagcgaacuggcgccuccgagggacgcgg

SEQ ID NO: 433793 - RNA, 64 nt, hsa
ggcacggaggggcaucccucccugccggccucagggagcgaacguggaugaaaaccacagggau

SEQ ID NO: 433794 - RNA, 64 nt, hsa
ggggcaucggcaaggccaagcugcgcagcaugaaggagcgaaagcuggagaagaagcagcagaa

SEQ ID NO: 433795 - RNA, 64 nt, hsa
cuggauacagacuucucccaggauccucucuuugggagcgaagccagaggaucccuacagcacu

SEQ ID NO: 433796 - RNA, 64 nt, hsa
ucuacacaaggcagaagaggcacggguuuuucugggagcgaauaucaagugccugagagcaacu

SEQ ID NO: 433797 - RNA, 64 nt, hsa
gucugcagaagaucagcagcuucuuaccugugcgggagcgaaaaagcugggcuucaacauggca

SEQ ID NO: 433798 - RNA, 64 nt, hsa
acgaacucuaugccguaugauuucaguagaacagggagcgaagcaaaaccacccggcccacaag

SEQ ID NO: 433799 - RNA, 64 nt, hsa
cuaccccuuaagagaucuccuugccugggugggaggagcgaaaguggggguguccuggggagac

SEQ ID NO: 433800 - RNA, 64 nt, hsa
cucaauucuuaacagauauaagauguuucauacuggagcgaaacuacaauccugaaugauguca

SEQ ID NO: 433801 - RNA, 64 nt, hsa
cgagcccuacagagugaggacacugaagugugcaggagcgaagguuaacaguaggggagauugu

SEQ ID NO: 433802 - RNA, 64 nt, hsa
aaggaaagggcaguggacgugcugcgcauguucgggagcgaacucccccgaagaaggaccagug

SEQ ID NO: 433803 - RNA, 64 nt, hsa
uaggaucugaaucauguucuggguaaggggacgaggagcgaacacugcacuaagauuugguuug

SEQ ID NO: 433804 - RNA, 64 nt, hsa
caccauuggggcgggguaggcagcuagaggcgcaggagcgaauccagguuccuugcgugguucc

SEQ ID NO: 433805 - RNA, 64 nt, hsa
uaugaucgcgccacuguacuccauccugggugauggagcgaagaaccugucucuuaaaaaaaaa

SEQ ID NO: 433806 - RNA, 64 nt, hsa
cgcccagcuggcccucucugaccuugggggaucaggagcgaaguugggcgggacuucagagauc

SEQ ID NO: 433807 - RNA, 64 nt, hsa
agcugaagcaggaccugcaggaagcacgcgaggcggagcgaagagccaagcagaagcuccugga

SEQ ID NO: 433808 - RNA, 64 nt, hsa
acuuuaaaagaagaaacaaagaggggaagauaugggagcgaauuuauuccaagaaucuacaaug

SEQ ID NO: 433809 - RNA, 64 nt, hsa
uguagaguggucagaacugugugguugguuugagggagcgaauucggggaaggcacuuggugau

SEQ ID NO: 433810 - RNA, 64 nt, hsa
gggcucagccugcacccacuuggagccccugcaaggagcgaaccggucagcaccaaguaacacc

SEQ ID NO: 433811 - RNA, 64 nt, hsa
gagacuuuaaaagaagaaacauggagaagaugugggagcgaauuuauugcaggaauccacaaug

SEQ ID NO: 433812 - RNA, 64 nt, hsa
uuaugcgucuccagggaagccucggugccagaguggugggcagaucugaccauccccacagacc

SEQ ID NO: 433813 - RNA, 64 nt, hsa
acgaggcauuccugcucauucccucugcuuagcuggugggcaggggagagagggaaaugccaaa

SEQ ID NO: 433814 - RNA, 64 nt, hsa
gaagaaggaaaggcacagguggagaacaguaaaaggugggcagaugucuuugaagaaaugcuca

SEQ ID NO: 433815 - RNA, 64 nt, hsa
ugugcuuggcuugcuugugcagcuccaggcacccggugggcacucuggugguguuuguggugaa

SEQ ID NO: 433816 - RNA, 64 nt, hsa
gugggaaguguuuacacauggagagaugccccauggugggcaggcagaugaugaaguacuggca

SEQ ID NO: 433817 - RNA, 64 nt, hsa
gggcggcuuuuauauguaauugcagcguggggugggugggcaugggagguaggggugggcccug

SEQ ID NO: 433818 - RNA, 64 nt, hsa
ggugagaggcagugggcaagugaucuuggagaugggugggcaggugauucugugggcaggggau

SEQ ID NO: 433819 - RNA, 64 nt, hsa
uugcucagucuucugaacuccagggaccagcccuggugggcaugggguggggagcagggaguug

SEQ ID NO: 433820 - RNA, 64 nt, hsa
ucucuugccugaggcuugaaucugacaaacccuuggugggcacugcucccuuagguucuucccc

SEQ ID NO: 433821 - RNA, 64 nt, hsa
ccaggcuccaggaaguugagggacccacaggagaggugggcagagcuggaguucucauccaggg

SEQ ID NO: 433822 - RNA, 64 nt, hsa
auuaacaugugccaggucuuaggaugugucuuggggugggcacaguacccggugacucuugggg

SEQ ID NO: 433823 - RNA, 64 nt, hsa
cugaugaacaaaucugcaccccacuucagaccucggugggcauucacaccaccccccaugccac

SEQ ID NO: 433824 - RNA, 64 nt, hsa
gcugugacgggguggccagcagggacgcgccccaggugggcagcuguggcagagcagcgacccg

SEQ ID NO: 433825 - RNA, 64 nt, hsa
gccgugacggggcggccagcagggacgcgccccaggugggcagcuguggcagagcagucccgac

SEQ ID NO: 433826 - RNA, 64 nt, hsa
ccaccuggagaggguugggaagccuuccgucugcggugggcaggcagccucacccugggcccac

SEQ ID NO: 433827 - RNA, 64 nt, hsa
gcgcucaggguggcuugcagucccuggcccuucuggugggcauuugguauguccuuucucuugg

SEQ ID NO: 433828 - RNA, 64 nt, hsa
acagcucggccgccccuccacuuguggaagcuguggugggcagagccccaaaacaagcagccuu

SEQ ID NO: 433829 - RNA, 64 nt, hsa
ugcacauucaccgcagcugccagccaggggucugggugggcaccacccugacccacagcgucac

SEQ ID NO: 433830 - RNA, 64 nt, hsa
gcgcgcagcagcaggcgaacucccagaaggugguggugggcacugugagaacguggccugcccu

SEQ ID NO: 433831 - RNA, 64 nt, hsa
gucugccugggcgaaugcagugggacggaccuggggugggcacucaccucagcagagccucaau

SEQ ID NO: 433832 - RNA, 64 nt, hsa
aagcaagugggguggcaugggagagaagggaggaggugggcacagguggugagcuuaugugugg

SEQ ID NO: 433833 - RNA, 64 nt, hsa
gagcccauggugggcagugggcaaggcgguggguggugggcaaggugggaccuccugcagccug

SEQ ID NO: 433834 - RNA, 64 nt, hsa
cagagccacagaccucaggguggagugagcccauggugggcagugggcaaggcgguggguggug

SEQ ID NO: 433835 - RNA, 64 nt, hsa
aagggcugcaggcccaguucucaugcugcccuugggugggcaucuguuaacagaggagaacguc

SEQ ID NO: 433836 - RNA, 64 nt, hsa
gagcuugucauaugcaaguccugucaagaaaacaggugggcaugguggcucaggucuguagucu

SEQ ID NO: 433837 - RNA, 64 nt, hsa
ucacgccuguaaccccagcacuuugggaggccaaggugggcagaucacgaggucaagagaucga

SEQ ID NO: 433838 - RNA, 64 nt, hsa
cuacuaaaaauacaaaaaauuagccgggugugguggugggcaccugucgucccagcuacuaggg

SEQ ID NO: 433839 - RNA, 64 nt, hsa
cccuggcccccuccaccccugcugggccagagcgggugggcagugucaaggcccgcugucuccc

SEQ ID NO: 433840 - RNA, 64 nt, hsa
ugugcuuggcuguuggugcacaugguuggcacacggugggcagagggcagagaaugccacugcu

SEQ ID NO: 433841 - RNA, 64 nt, hsa
ggcuucucugccgaugggcccggguugggguuaaggugggcauccuccagguacaacgagccug

SEQ ID NO: 433842 - RNA, 64 nt, hsa
ccucuugggagggcuuugucccugccucugagcuggugggcaggauggcuggguggcccccaga

SEQ ID NO: 433843 - RNA, 64 nt, hsa
cucuuccccucuaaugcucacgcucccaacacaaggugggcagggaggcaccauucaggaaccu

SEQ ID NO: 433844 - RNA, 64 nt, hsa
ucuggaggccucugggccuccucuaacaggggcuggugggcaccaagagccaauggaguagacc

SEQ ID NO: 433845 - RNA, 64 nt, hsa
ucacgccuguaaucccagcucuuugggaggccgaggugggcagaucacgaggucaggagaucga

SEQ ID NO: 433846 - RNA, 64 nt, hsa
gggacugcugucccuuguacaguuuucugucacuggugggcacuggacaggcauagcagacucu

SEQ ID NO: 433847 - RNA, 64 nt, hsa
aauguucuguuuuggccaccaggaaaugggguggggugggcauacacagagaggaccccucucu

SEQ ID NO: 433848 - RNA, 64 nt, hsa
ucaugccuguaaucccagcacuuugggaggcugaggugggcagaucaccugaggucaggaguuc

SEQ ID NO: 433849 - RNA, 64 nt, hsa
ccacuacugucuuuaagaugcagaguggaggggaggugggcacccacccugcgauucuccaccc

SEQ ID NO: 433850 - RNA, 64 nt, hsa
guccuuuuccuccuuggagccugggccagcucaaggugggcacgggggcccagacaguacucuc

SEQ ID NO: 433851 - RNA, 64 nt, hsa
augacugcucacccacuuccaccgugggguugggggugggcaacagaggaggggagcaaguagg

SEQ ID NO: 433852 - RNA, 64 nt, hsa
ccccgcacgcgggagccacgaaccucggggugggggugggcagugagugcaggggauggggugg

SEQ ID NO: 433853 - RNA, 64 nt, hsa
ugccugauugugaaccauguccaccaguaucuggggugggcacguggucggggacccucagcag

SEQ ID NO: 433854 - RNA, 64 nt, hsa
aggaggugcucgguugacaccaucagggagggagggugggcacugcugggcugaguucaccccc

SEQ ID NO: 433855 - RNA, 64 nt, hsa
ucacaccugcaaucccagcacuuuggaaggccgaggugggcagaucaucugaggccaggaguuc

SEQ ID NO: 433856 - RNA, 64 nt, hsa
ucuaccaaaaauacaaaaauuagccaggcgugguggugggcaccuguacuggggaggugcccac

SEQ ID NO: 433857 - RNA, 64 nt, hsa
agccccuaguuccaacacugaggacgcgugacauggugggcaccggaaaggaggggacuucucc

SEQ ID NO: 433858 - RNA, 64 nt, hsa
cccuuauuuuuaugcaauaacugagcuugaugggggugggcagggggccaguugagccaagccc

SEQ ID NO: 433859 - RNA, 64 nt, hsa
cggcaucaaagauaggagaguuucuuuuuuuuuaggugggcauuauuuaugaccuuuucuuugg

SEQ ID NO: 433860 - RNA, 64 nt, hsa
ucacgccuguaaugccagcacuuugggaggcugaggugggcagaucaugaggucaacagauuga

SEQ ID NO: 433861 - RNA, 64 nt, hsa; identical to SEQ ID NO: 106142

SEQ ID NO: 433862 - RNA, 64 nt, hsa; identical to SEQ ID NO: 106143

SEQ ID NO: 433863 - RNA, 55 nt, hsa; identical to SEQ ID NO: 106144

SEQ ID NO: 433864 - RNA, 64 nt, hsa; identical to SEQ ID NO: 106145

SEQ ID NO: 433865 - RNA, 64 nt, hsa; identical to SEQ ID NO: 106146

SEQ ID NO: 433866 - RNA, 64 nt, hsa; identical to SEQ ID NO: 106147

SEQ ID NO: 433867 - RNA, 64 nt, hsa; identical to SEQ ID NO: 106148

SEQ ID NO: 433868 - RNA, 64 nt, hsa; identical to SEQ ID NO: 106149

SEQ ID NO: 433869 - RNA, 64 nt, hsa; identical to SEQ ID NO: 106150

SEQ ID NO: 433870 - RNA, 64 nt, hsa; identical to SEQ ID NO: 106151

SEQ ID NO: 433871 - RNA, 64 nt, hsa; identical to SEQ ID NO: 106152

SEQ ID NO: 433872 - RNA, 64 nt, hsa; identical to SEQ ID NO: 106153

SEQ ID NO: 433873 - RNA, 64 nt, hsa; identical to SEQ ID NO: 106154

SEQ ID NO: 433874 - RNA, 64 nt, hsa; identical to SEQ ID NO: 106155

SEQ ID NO: 433875 - RNA, 64 nt, hsa; identical to SEQ ID NO: 106156

SEQ ID NO: 433876 - RNA, 64 nt, hsa; identical to SEQ ID NO: 106157

SEQ ID NO: 433877 - RNA, 64 nt, hsa; identical to SEQ ID NO: 106158

SEQ ID NO: 433878 - RNA, 64 nt, hsa; identical to SEQ ID NO: 106159

SEQ ID NO: 433879 - RNA, 64 nt, hsa; identical to SEQ ID NO: 106160

SEQ ID NO: 433880 - RNA, 64 nt, hsa; identical to SEQ ID NO: 106161

SEQ ID NO: 433881 - RNA, 64 nt, hsa; identical to SEQ ID NO: 106162

SEQ ID NO: 433882 - RNA, 64 nt, hsa; identical to SEQ ID NO: 106163

SEQ ID NO: 433883 - RNA, 64 nt, hsa; identical to SEQ ID NO: 245914

SEQ ID NO: 433884 - RNA, 64 nt, hsa; identical to SEQ ID NO: 245915

SEQ ID NO: 433885 - RNA, 64 nt, hsa; identical to SEQ ID NO: 250961

SEQ ID NO: 433886 - RNA, 64 nt, hsa; identical to SEQ ID NO: 250962

SEQ ID NO: 433887 - RNA, 64 nt, hsa; identical to SEQ ID NO: 250963

SEQ ID NO: 433888 - RNA, 64 nt, hsa; identical to SEQ ID NO: 250964

SEQ ID NO: 433889 - RNA, 64 nt, hsa; identical to SEQ ID NO: 250965

SEQ ID NO: 433890 - RNA, 64 nt, hsa; identical to SEQ ID NO: 250966

SEQ ID NO: 433891 - RNA, 64 nt, hsa; identical to SEQ ID NO: 250967

SEQ ID NO: 433892 - RNA, 64 nt, hsa; identical to SEQ ID NO: 250968

SEQ ID NO: 433893 - RNA, 64 nt, hsa; identical to SEQ ID NO: 250969

SEQ ID NO: 433894 - RNA, 64 nt, hsa; identical to SEQ ID NO: 250970

SEQ ID NO: 433895 - RNA, 64 nt, hsa; identical to SEQ ID NO: 250971

SEQ ID NO: 433896 - RNA, 64 nt, hsa; identical to SEQ ID NO: 250972

SEQ ID NO: 433897 - RNA, 64 nt, hsa; identical to SEQ ID NO: 250973

SEQ ID NO: 433898 - RNA, 64 nt, hsa; identical to SEQ ID NO: 250974

SEQ ID NO: 433899 - RNA, 64 nt, hsa; identical to SEQ ID NO: 250975

SEQ ID NO: 433900 - RNA, 64 nt, hsa; identical to SEQ ID NO: 250976

SEQ ID NO: 433901 - RNA, 64 nt, hsa; identical to SEQ ID NO: 250977

SEQ ID NO: 433902 - RNA, 64 nt, hsa; identical to SEQ ID NO: 250978

SEQ ID NO: 433903 - RNA, 64 nt, hsa; identical to SEQ ID NO: 250979

SEQ ID NO: 433904 - RNA, 64 nt, hsa; identical to SEQ ID NO: 250980

SEQ ID NO: 433905 - RNA, 64 nt, hsa; identical to SEQ ID NO: 250981

SEQ ID NO: 433906 - RNA, 64 nt, hsa; identical to SEQ ID NO: 250982

SEQ ID NO: 433907 - RNA, 64 nt, hsa; identical to SEQ ID NO: 250983

SEQ ID NO: 433908 - RNA, 64 nt, hsa; identical to SEQ ID NO: 250984

SEQ ID NO: 433909 - RNA, 64 nt, hsa; identical to SEQ ID NO: 250985

SEQ ID NO: 433910 - RNA, 64 nt, hsa; identical to SEQ ID NO: 250986

SEQ ID NO: 433911 - RNA, 64 nt, hsa
uuacaaaacuauaaauauuugugucuccacauaccaucuucaucuucacacauucacugugcuu

SEQ ID NO: 433912 - RNA, 64 nt, hsa
aacuauaaauauuugugucuccacauaccaucuucaucuucacacauucacugugcuuuccucc

SEQ ID NO: 433913 - RNA, 64 nt, hsa
aaacuguuggucucacucugucucucuaccuggucaucuucaaggcuaagaaaacaaacaagcu

SEQ ID NO: 433914 - RNA, 64 nt, hsa
gaacagguggaggaaagggguugcaggugaccagcaucuucaaucuaguuaccaccagcuuggc

SEQ ID NO: 433915 - RNA, 64 nt, hsa
gauuccucuuccaauuccuccucuucuucagaaucaucuucagaaagugaacuugaacaugaga

SEQ ID NO: 433916 - RNA, 64 nt, hsa
aauaaauacagugaucauucacaguguaguagaucaucuucauauacuucuauuagcagugaug

SEQ ID NO: 433917 - RNA, 64 nt, hsa
ggcuuggacugugaaaagaaauguggccccuuuccaucuucaagagagauggaauuaaugaugg

SEQ ID NO: 433918 - RNA, 64 nt, hsa
guuuaaaauauaaaagaaaacuuugcccccuuugcaucuucauaaaccugcugcggcagacucc

SEQ ID NO: 433919 - RNA, 64 nt, hsa
uagauguaaaaauucagguuauauauaggauugccaucuucagaggugaugcugaacugugagg

SEQ ID NO: 433920 - RNA, 64 nt, hsa
gaauaagucaugccuuaacauccaaauaagaguucaucuucagagugguucuuuugggagcacu

SEQ ID NO: 433921 - RNA, 64 nt, hsa
uucauauucaucaaugcugauaauuguccaaaggcaucuucacuaugucugcuaaauaacaucc

SEQ ID NO: 433922 - RNA, 64 nt, hsa
cccaauaaccugaaaaaguuugacuuugaugugacaucuucauauucaucaaugcugauaauug

SEQ ID NO: 433923 - RNA, 64 nt, hsa
ggaccucgcuuuccaucuguucuuguugcaaugccaucuucaaaccguuuuauuuauugaagug

SEQ ID NO: 433924 - RNA, 61 nt, hsa
uccacagaaaaaccuucuaaugucgggacaucaucuucaccucucucugaaguuaacucca

SEQ ID NO: 433925 - RNA, 64 nt, hsa
uaggcagugcuugaaugagaaaaggcuccuggugcaucuucaaaaugaguccuaaagaacauac

SEQ ID NO: 433926 - RNA, 60 nt, hsa
aaggaggcuguuccugcuaaucucccaugucaucuucaaccuucuucagaagcucacugc

SEQ ID NO: 433927 - RNA, 64 nt, hsa
ccacccgagacuggacagaugggguguugucaaacaucuucagggaaaucaacaagccaacaga

SEQ ID NO: 433928 - RNA, 64 nt, hsa
aagaccuaccucccacuccgucaaaguuccauuacaucuucaaccuucgagaucucucacgggu

SEQ ID NO: 433929 - RNA, 64 nt, hsa
auugggggaagggaggcgaaggccugagguuuuccaucuucauucucuuuuguuauuaggagaa

SEQ ID NO: 433930 - RNA, 64 nt, hsa
aucagcuuagaguguucaacugauccuuccccaccaucuucagaucuguuccucuggagcuuga

SEQ ID NO: 433931 - RNA, 64 nt, hsa
auaacagaguuagagacuugagucugauuucagucaucuucagggaccagucugauguuguagc

SEQ ID NO: 433932 - RNA, 64 nt, hsa
aaaucagaacuuccuuccccaccagggaggacaacaucuucaugcugugauugaagcauccauu

SEQ ID NO: 433933 - RNA, 64 nt, hsa
caaagucagagcgauaggaaagcacccugcccuucaucuucauguucucccaaauggaacuuag

SEQ ID NO: 433934 - RNA, 64 nt, hsa
gugacuguuuuucuucauaaaguucugcguuuggcaucuucacucuuuccaaaauguaucugua

SEQ ID NO: 433935 - RNA, 64 nt, hsa
cgugaccccgcgaccucuccaucuucagcuucuucaucuucaccagaggaaucacucuugugga

SEQ ID NO: 433936 - RNA, 64 nt, hsa
ucccgcacgcacaaucgugaccccgcgaccucuccaucuucagcuucuucaucuucaccagagg

SEQ ID NO: 433937 - RNA, 64 nt, hsa
acauugaaguguuuaaaagagccauguccaaacccaucuucauggauagcucagagguauccuc

SEQ ID NO: 433938 - RNA, 64 nt, hsa
guaaggaagagggaccuccagcuuccacaaacaccaucuucagcuguaugaaagggacgguugu

SEQ ID NO: 433939 - RNA, 64 nt, hsa
uaauuuauuauaaaggccugacccucuauugucccaucuucacccccauuccagagcagaggag

SEQ ID NO: 433940 - RNA, 64 nt, hsa
uauuacuauucugaaggguaguguuguugguuuucaucuucaagaaguugauuccaaaacugag

SEQ ID NO: 433941 - RNA, 64 nt, hsa
uucucuuggguuuucuucauuucuuuucauaauucaucuucaagcuauagauccauccuucuuc

SEQ ID NO: 433942 - RNA, 64 nt, hsa
ugaagcugacacaauuaaggaugaauuaccauaacaucuucauuuuuccucauuucauugccuc

SEQ ID NO: 433943 - RNA, 63 nt, hsa
ggugcuuuggauuugaaaagggucugauggggagaaggagaacguaucauccuagcuuccucu

SEQ ID NO: 433944 - RNA, 63 nt, hsa
ugcuguucccuuugcucuugauuaggagagauggaaggagaugagcucccauaacugaauugg

SEQ ID NO: 433945 - RNA, 63 nt, hsa
cucacuccuuuuacucacugggcucaugacagugaaggagaugcuccaucugcuucucccccu

SEQ ID NO: 433946 - RNA, 63 nt, hsa
uaagcaaucauuuuuccccccagaaguuacuuagaaggagaacugggaacacuuggggucucu

SEQ ID NO: 433947 - RNA, 63 nt, hsa
uguagcuccagcuugucucccuggcuucucuuugaaggagaaaaauguaaaauaugcacugag

SEQ ID NO: 433948 - RNA, 63 nt, hsa
uuugcagaggggcggggggugaggcuuagcccagaaggagaacugagcaggaaaccaaggcuc

SEQ ID NO: 433949 - RNA, 63 nt, hsa
cccuuucugccguuaauaagaaggagaauagcugaaggagagagauauuuuauuaauuuccug

SEQ ID NO: 433950 - RNA, 63 nt, hsa
cagcaaucaacaagcccuuucugccguuaauaagaaggagaauagcugaaggagagagauauu

SEQ ID NO: 433951 - RNA, 63 nt, hsa
uggcccugccagcugguaguccaucagcacaaugaaggagacuuggagaagaggaagaauaac

SEQ ID NO: 433952 - RNA, 63 nt, hsa
gaaggcggggcaggcagccuguugcaggcaggggaaggagaagagacugaggggcugugaccu

SEQ ID NO: 433953 - RNA, 63 nt, hsa
acuggaaagguccccuuccccaggggagccugcgaaggagagguucuguagaauccaagccca

SEQ ID NO: 433954 - RNA, 63 nt, hsa
gaggugucaaauacaaauaaaucugggcuuagggaaggagagaccuuauuccaaagcacgauu

SEQ ID NO: 433955 - RNA, 63 nt, hsa
agguuuucuguugcacaaggacgggucaggaaggaaggagaggcuuuuccagaaacaaaaaau

SEQ ID NO: 433956 - RNA, 63 nt, hsa
ggguaagauuggccagagguaggaauguggggagaaggagaggcugaaaagaaagcagaggag

SEQ ID NO: 433957 - RNA, 63 nt, hsa
ucugucucgaaagaaagaaagaaaaaaaggaaggaaggagaaggaaggaaggagaagaaaagg

SEQ ID NO: 433958 - RNA, 63 nt, hsa
aagaaagaaaaaaaggaaggaaggagaaggaaggaaggagaagaaaagguaccuguucuacgu

SEQ ID NO: 433959 - RNA, 63 nt, hsa
aaaagaaagaaagaaaagaagaagaaaagagaagaaggagaaggagaugaaggaggaggagga

SEQ ID NO: 433960 - RNA, 63 nt, hsa
aagaaagaaaagaagaagaaaagagaagaaggagaaggagaugaaggaggaggaggaggagaa

SEQ ID NO: 433961 - RNA, 63 nt, hsa
gaaggagaaggagaugaaggaggaggaggaggagaaggagaagaagaagaagaagaagaccac

SEQ ID NO: 433962 - RNA, 63 nt, hsa
uuacguccaccaaagacccguguuggggguacugaaggagaggcccugggggacccucugaag

SEQ ID NO: 433963 - RNA, 63 nt, hsa
uaugucaucugcuucuccccuguuggggcuaaggaaggagauagguggcuccuaaaagaggag

SEQ ID NO: 433964 - RNA, 63 nt, hsa
uuucugaaaaauacauuuagauuaguuuaguuugaaggagaggugggcugauggcugaguugu

SEQ ID NO: 433965 - RNA, 63 nt, hsa
uauucccucaaaucccuccucuuacuccaugcugaaggagaaguacucucagaugcauuaugu

SEQ ID NO: 433966 - RNA, 63 nt, hsa
cucaaccaucccacuaaguuauagccaagaagggaaggagacacggggauuugggguucucug

SEQ ID NO: 433967 - RNA, 63 nt, hsa
ugcuuugggcuuucuccuucuguggccccggaggaaggagagacugaggcaaggcaaagugau

SEQ ID NO: 433968 - RNA, 63 nt, hsa
acccaguuagccaagauguuggaugcguugcuagaaggagaaauagaagaccuugaccugcug

SEQ ID NO: 433969 - RNA, 63 nt, hsa
auauuguuuggagacuuccagauggcucugcacgaaggagaaccacgcauuuaugaagacauc

SEQ ID NO: 433970 - RNA, 63 nt, hsa
aauguaaaacuuuuaagguauaucauuauaacugaaggagaaggugccccaaaaugcaagauu

SEQ ID NO: 433971 - RNA, 63 nt, hsa
cuuguaacuccaccaacccaucagaaggagaaggaaggagacucaccucugccucaaugugaa

SEQ ID NO: 433972 - RNA, 63 nt, hsa
ccuucccuggcuuguaacuccaccaacccaucagaaggagaaggaaggagacucaccucugcc

SEQ ID NO: 433973 - RNA, 63 nt, hsa
gccagaggggcagccaccuugcaugagggugaggaaggagaagcccagccagccucuacccau

SEQ ID NO: 433974 - RNA, 63 nt, hsa
cugggccacuugcuuaauugcauuucuggcagggaaggagaggagggauggagaagcucugcu

SEQ ID NO: 433975 - RNA, 63 nt, hsa
ugagcuccugggcaagaacaccuuugaguuccugaaggagaauaacuuccagccuuacccccu

SEQ ID NO: 433976 - RNA, 63 nt, hsa
uugggaugagaacagcucugacggccgguaugugaaggagaacugcaaaccucugaaggucag

SEQ ID NO: 433977 - RNA, 63 nt, hsa
aacccaggagguagcuggcagaguagcugucaggaaggagaaagguucuuucuggcugguugu

SEQ ID NO: 433978 - RNA, 63 nt, hsa
caguucugaggagaggaggucuucaguacuauugaaggagacauugaucuucuggauguacag

SEQ ID NO: 433979 - RNA, 63 nt, hsa
gaccuggaaugggggccuuugucaaacacuguugaaggagaggcugaugugucugugauggug

SEQ ID NO: 433980 - RNA, 63 nt, hsa
cccugccugacgauguaucgaaaagaugagagugaaggagacuuugugcagcaggaaacgggu

SEQ ID NO: 433981 - RNA, 63 nt, hsa
aggccacucucuucccuuucuuggugaaguaaggaaggagaaagugguuacuagccaggcaua

SEQ ID NO: 433982 - RNA, 63 nt, hsa
ccagacugugaccaggaaacagcucaucccagagaaggagaugcuuaacaaaaaaaaauugaa

SEQ ID NO: 433983 - RNA, 63 nt, hsa
auaaaaccuagugagcuaaaggcuuugucugcagaaggagaucaagaggcuggggguaaggcc

SEQ ID NO: 433984 - RNA, 63 nt, hsa
gacccccaggggcugacauucuagggggagauagaaggagacaaacguagaagguagaauaag

SEQ ID NO: 433985 - RNA, 63 nt, hsa
gggagugcugagugccacaggaagucagacaaggaaggagaguguggggcaggugccguuuaa

SEQ ID NO: 433986 - RNA, 63 nt, hsa
acuugcucugaacugcacccaggaggugacugggaaggagaaaaccagcaaaggaagcucugc

SEQ ID NO: 433987 - RNA, 63 nt, hsa
cacauccccugacgaagcuuguccagauggcaggaaggagaacggaugcuugucuggccauga

SEQ ID NO: 433988 - RNA, 63 nt, hsa
ugaaagcugugcucagaggaggugagaggagaggaaggagaaaacugcaucauaacuuuacag

SEQ ID NO: 433989 - RNA, 63 nt, hsa
uauuuuuuccuuucaaaucagacgaugagacuagaaggagaaauacuuucugucuuauuaaaa

SEQ ID NO: 433990 - RNA, 63 nt, hsa
gccccugugggacucauccuugcccaggugagggaaggagacaggaugaggucucgacccugu

SEQ ID NO: 433991 - RNA, 63 nt, hsa
uccccaaaggaaccgcccagugcagguauuucagaaggagaaggcuggagaaggacaugagau

SEQ ID NO: 433992 - RNA, 64 nt, hsa
ggauaauuaaaaauaauguaaugugccuagcacacuaccugaaaacgauggcauuuguucuuau

SEQ ID NO: 433993 - RNA, 64 nt, hsa
ucuucuucaaacaguaucuuggugggugacuuggcuaccugaaaaaucuuaggaggaauagcuc

SEQ ID NO: 433994 - RNA, 64 nt, hsa
uugugcuggaugaguggcugccucaguagcaaaacuaccugacaguauuugacaguguccuuuc

SEQ ID NO: 433995 - RNA, 64 nt, hsa
cuaucuauuaaaccauucugcaaauacgguuuuucuaccugauugcauauagcauaugugucau

SEQ ID NO: 433996 - RNA, 64 nt, hsa
accuggagcggcuauuccaggagcugcggccacucuaccugaaccugcacaccuacgugcgcag

SEQ ID NO: 433997 - RNA, 64 nt, hsa
uugcccuggagaagaucgccuucauccccuuuggcuaccugauggaccuccuucgcuggaaggu

SEQ ID NO: 433998 - RNA, 64 nt, hsa
aaggcugugaagaaaauucauuuuacauuggguagacaguaaaaaacaaguaaaauaacuugac

SEQ ID NO: 433999 - RNA, 64 nt, hsa
cauuauuugaaagacugggaauuuaaugguuagggacaguaaaucuacuucuuuuuccagggac

SEQ ID NO: 434000 - RNA, 64 nt, hsa
aguuacacguaaaguagaagaaucuagugcgugggacaguaaaggauccuuucucguacagaau

SEQ ID NO: 434001 - RNA, 64 nt, hsa
uaaaaauaaguuuuaucuuaaaaucauauuugaagacaguaagacaguaaacuauuuuaggaag

SEQ ID NO: 434002 - RNA, 64 nt, hsa
aguuuuaucuuaaaaucauauuugaagacaguaagacaguaaacuauuuuaggaagucaacccc

SEQ ID NO: 434003 - RNA, 64 nt, hsa
ucugggggaagccagugauccagccccaccaaggggccuccagagaccccaggaacaauaagug

SEQ ID NO: 434004 - RNA, 64 nt, hsa
aggaguaaugucccuccagcaacguucccccuauggccuccagcagagcugaucugccucucac

SEQ ID NO: 434005 - RNA, 64 nt, hsa
gagcuuagccuugugcccugcccccaucuccccaggccuccagccucucccggcugccugccgc

SEQ ID NO: 434006 - RNA, 64 nt, hsa
ggaacuccacucuccuucgugucucucccaccccggccuccacucccccaccugacaauggcag

SEQ ID NO: 434007 - RNA, 64 nt, hsa
aaaagcccuagacuggugcuaaugucaaaccacuggccuccacucaggccuccaucuucucaug

SEQ ID NO: 434008 - RNA, 64 nt, hsa
cuggugcuaaugucaaaccacuggccuccacucaggccuccaucuucucaugcccucuuaccag

SEQ ID NO: 434009 - RNA, 64 nt, hsa
ggaaguccauauggacaacaggugggaguuuuggggccuccagggcagcaggcaccaccuccau

SEQ ID NO: 434010 - RNA, 64 nt, hsa
agcaugggcagcaugcagccacuucacccuggggggccuccaccccaccaucuuccgccaggug

SEQ ID NO: 434011 - RNA, 64 nt, hsa
acugcacagacacacgcauuguaaggccgcuuguggccuccagcgugcacucuuguuuacguca

SEQ ID NO: 434012 - RNA, 64 nt, hsa
ucucccccuucccuuguggggcacagcuggccugggccuccaauccugcggagcuuuccugggu

SEQ ID NO: 434013 - RNA, 64 nt, hsa
aggacugagccacccaaggagguggggacugcucggccuccaccgcuguuccgcugcagccccg

SEQ ID NO: 434014 - RNA, 64 nt, hsa
agcacacggggaggacguuggggacccuggguggggccuccaggugcagcuguggauggaagac

SEQ ID NO: 434015 - RNA, 64 nt, hsa
ggugcugcgaggugcucaccucacagagucuggaggccuccaggaucaacugugggcaaagugc

SEQ ID NO: 434016 - RNA, 64 nt, hsa
uuugcuuuguuaauuacaugucagacuccuagagggccuccagacuaauaggaagcauuucugu

SEQ ID NO: 434017 - RNA, 64 nt, hsa
gugggugugucugaggggguguguuugggagccuggccuccaaaagccagugucuggguuggag

SEQ ID NO: 434018 - RNA, 64 nt, hsa
ggcagccuccuggugcugggcucccugccucuggggccuccaguccuucacucagugucauccc

SEQ ID NO: 434019 - RNA, 64 nt, hsa
agaaguguucagacagaacuagggacaacagaggggccuccaugguggcaugggucagcagagc

SEQ ID NO: 434020 - RNA, 64 nt, hsa
guguguucugagagccccagguccuuggggcacgggccuccagggcccuguaagguggacucug

SEQ ID NO: 434021 - RNA, 64 nt, hsa
caagggucacccagcaaguuuuggcuaagagccuggccuccagccccagcaguguggcccagag

SEQ ID NO: 434022 - RNA, 64 nt, hsa
aucaucccuuugucugcauugacggcccugugacggccuccagcccacaggccugcuuucuccu

SEQ ID NO: 434023 - RNA, 64 nt, hsa
acauggcaucccugaccuccaaauggucuguuuuggccuccauuccuauauccuuuaaaugacu

SEQ ID NO: 434024 - RNA, 64 nt, hsa
cggggaccacaucaagcuucaggccgacagcuucggccuccacaucguccccgucugaccccac

SEQ ID NO: 434025 - RNA, 64 nt, hsa
ggcgccgugagggggauucggcccagcucgucccggccuccaccaagccagccccgaagcccgc

SEQ ID NO: 434026 - RNA, 64 nt, hsa
ugaacuggcugguguuugcagucccacguggcauggccuccagcccaacccacaguggagacug

SEQ ID NO: 434027 - RNA, 64 nt, hsa
gcacaugcauguaaaccagggaccuucagcucacggccuccaggccugggccaguucuugcugc

SEQ ID NO: 434028 - RNA, 64 nt, hsa
agggacagcacgaaugacucacauguuucagacaggccuccacggcuauggagagaaggcugga

SEQ ID NO: 434029 - RNA, 64 nt, hsa
guaacugcagggucacaggcaucccgggagaaugggccuccacccucagccagcccucacugcu

SEQ ID NO: 434030 - RNA, 64 nt, hsa
ccucuucccuaccuccuccacuagccgcaggaagggccuccagcacccacaacugcccuuccuc

SEQ ID NO: 434031 - RNA, 64 nt, hsa
ccagccagauguggucaccucaguccagcucuggggccuccaggccauguggcuguucccacgg

SEQ ID NO: 434032 - RNA, 64 nt, hsa
ugaccaccuaugggggccgggcaggagccucuggggccuccacuccgacaucaggaccugagau

SEQ ID NO: 434033 - RNA, 64 nt, hsa
cugcuaggaggcaacucgucacacccaagcugcuggccuccagucccaucucccccaacacaug

SEQ ID NO: 434034 - RNA, 64 nt, hsa
gggccccagccuuccaccugugcuagcagccuggggccuccacucuggccggaggaaggaccgc

SEQ ID NO: 434035 - RNA, 64 nt, hsa
ucaaacuccugacuucaggugauccgccuaccuuggccuccaaaagugcugggauuacaggcau

SEQ ID NO: 434036 - RNA, 64 nt, hsa
gucauacuagagacaggggucucgcugaacuccuggccuccagugauccuccauccucggccuc

SEQ ID NO: 434037 - RNA, 64 nt, hsa
uugugucgcucgggucggaacucuuuaggccucuggccuccacccucccccaacagcagggaug

SEQ ID NO: 434038 - RNA, 64 nt, hsa
agugcugggauuauaggcgugagccaccgcgcccggccuccaguucauuuuaaaaccaugaaac

SEQ ID NO: 434039 - RNA, 64 nt, hsa
uguucuuccagaaccugcacgccugcgacucgggggccuccauccgauggcaggugguggacag

SEQ ID NO: 434040 - RNA, 64 nt, hsa
ugugaggaaggggcccugccacucuccccaagagggccuccauguuucgaggugccucaacaug

SEQ ID NO: 434041 - RNA, 64 nt, hsa
agugcugggauuacaggccugagccaccgcguccggccuccauaaaugacuuuuaaagggguug

SEQ ID NO: 434042 - RNA, 64 nt, hsa
ucguucuccacagcucccuucccuugccccuucgggccuccaggauauguuugcgggggugggu

SEQ ID NO: 434043 - RNA, 64 nt, hsa
ggggccuccacgccagcgccgggaaggcugcuggggccuccacaccugccucaucacggcggcg

SEQ ID NO: 434044 - RNA, 64 nt, hsa
caacguggcccugcuucaggugauccgcgggaggggccuccacgccagcgccgggaaggcugcu

SEQ ID NO: 434045 - RNA, 64 nt, hsa
cagauaggccaaaguagcaagcuaaugaucagucacucacuauucccagaagagccuguguuuu

SEQ ID NO: 434046 - RNA, 64 nt, hsa
auugucuaacacuccuuucuauucucucccuacuacucacuaucaauucauccccauaugaauc

SEQ ID NO: 434047 - RNA, 64 nt, hsa
ugaagaauuguauuucaagauucaaacaauaaccagcaauuaaacuuuuuucuacaauguauuu

SEQ ID NO: 434048 - RNA, 64 nt, hsa
guuuaaguacuaaacugcagccuuuucugucgccagcaauuaaagaccaccaaucuuguuuguc

SEQ ID NO: 434049 - RNA, 64 nt, hsa
uggagaacuuuaguuucaaguacuacauugugaaagcaauuauuuuguuucuaguuuuuauaaa

SEQ ID NO: 434050 - RNA, 64 nt, hsa
gaguuacuucaaucauuuucacaggcagccaacaagcaauuaagagcaguuauaauagaggaag

SEQ ID NO: 434051 - RNA, 64 nt, hsa
caguuagguuuucucaaauugcaaaauuugccuuagcaauuaucuuugaacaucccgaaccaga

SEQ ID NO: 434052 - RNA, 64 nt, hsa
uuuuucaaagugugaaaaccuuuagacuuuuuuuagcaauuaguuugacauucgcuacuauagu

SEQ ID NO: 434053 - RNA, 64 nt, hsa
aaaugauuuaguucaaauacugaaauacuuaaugagcaauuacuugauuuuuaaugaugacuuc

SEQ ID NO: 434054 - RNA, 64 nt, hsa
uuuaaaaggauuccuuuaagcaugucagaugaaaagcaauuaggauuaaaaguuuccauuuaau

SEQ ID NO: 434055 - RNA, 64 nt, hsa
cucacuucauauguuuaaagaaugaguaaaagaaagcaauuacuacugcuaaaugugggaaaua

SEQ ID NO: 434056 - RNA, 64 nt, hsa
ggaauggaagaguaaauuacaugacacaaaaaggagcaauuaaaucuaaaauaaggguaauucu

SEQ ID NO: 434057 - RNA, 64 nt, hsa
gggcagcugauaauuuaaaucuggaugggcagcuugcacucaccaauagaccaaaagacaucuu

SEQ ID NO: 434058 - RNA, 64 nt, hsa
aaacauuguuugccaaauccugguggcaaauacuugcacucaguauuucacacagcugccaacg

SEQ ID NO: 434059 - RNA, 64 nt, hsa
aacaaauuguguuugcuuuaagaaaaauguuuauugcacucaugucauaggguuaauuggaggu

SEQ ID NO: 434060 - RNA, 64 nt, hsa
aguugcccuauauaugcauguuauccauuauaaaugcacucagcagcuaagagaaauuugagag

SEQ ID NO: 434061 - RNA, 64 nt, hsa
ggggccgccgcagaugggcucaggaagccccaggugcacucagcgagagcccugccuuucaguu

SEQ ID NO: 434062 - RNA, 64 nt, hsa
cuccacuaaggagggaggggcugucugcagcagcugcacucagcaccuaggccaggguggggcc

SEQ ID NO: 434063 - RNA, 64 nt, hsa
ggaagccccccgaccacgcggacgcucgcugggcugcacucagcaggcugcuugagugggagcu

SEQ ID NO: 434064 - RNA, 64 nt, hsa
ccauaccaauuucaauaacaaucuugccugucauugcacucagaaucuuaagaucauguuucaa

SEQ ID NO: 434065 - RNA, 64 nt, hsa
ggcaggugucacagccaugugugcuccccacuguugcacucaggcacagcagcaccuccaggcu

SEQ ID NO: 434066 - RNA, 64 nt, hsa
ccucucccacacggggcccugcaggcuguggauaugcacucagaggacuaagggggugcucugc

SEQ ID NO: 434067 - RNA, 64 nt, hsa; identical to SEQ ID NO: 39347

SEQ ID NO: 434068 - RNA, 64 nt, hsa; identical to SEQ ID NO: 39348

SEQ ID NO: 434069 - RNA, 64 nt, hsa; identical to SEQ ID NO: 39349

SEQ ID NO: 434070 - RNA, 64 nt, hsa; identical to SEQ ID NO: 39350

SEQ ID NO: 434071 - RNA, 64 nt, hsa; identical to SEQ ID NO: 39351

SEQ ID NO: 434072 - RNA, 64 nt, hsa; identical to SEQ ID NO: 39352

SEQ ID NO: 434073 - RNA, 64 nt, hsa; identical to SEQ ID NO: 39353

SEQ ID NO: 434074 - RNA, 64 nt, hsa; identical to SEQ ID NO: 39354

SEQ ID NO: 434075 - RNA, 64 nt, hsa; identical to SEQ ID NO: 39355

SEQ ID NO: 434076 - RNA, 64 nt, hsa; identical to SEQ ID NO: 39356

SEQ ID NO: 434077 - RNA, 64 nt, hsa; identical to SEQ ID NO: 39357

SEQ ID NO: 434078 - RNA, 64 nt, hsa; identical to SEQ ID NO: 39358

SEQ ID NO: 434079 - RNA, 64 nt, hsa; identical to SEQ ID NO: 39359

SEQ ID NO: 434080 - RNA, 64 nt, hsa; identical to SEQ ID NO: 39360

SEQ ID NO: 434081 - RNA, 64 nt, hsa; identical to SEQ ID NO: 39361

SEQ ID NO: 434082 - RNA, 64 nt, hsa; identical to SEQ ID NO: 39362

SEQ ID NO: 434083 - RNA, 64 nt, hsa; identical to SEQ ID NO: 39363

SEQ ID NO: 434084 - RNA, 64 nt, hsa; identical to SEQ ID NO: 39364

SEQ ID NO: 434085 - RNA, 64 nt, hsa; identical to SEQ ID NO: 39365

SEQ ID NO: 434086 - RNA, 64 nt, hsa; identical to SEQ ID NO: 39366

SEQ ID NO: 434087 - RNA, 64 nt, hsa; identical to SEQ ID NO: 39367

SEQ ID NO: 434088 - RNA, 64 nt, hsa; identical to SEQ ID NO: 39368

SEQ ID NO: 434089 - RNA, 64 nt, hsa; identical to SEQ ID NO: 39369

SEQ ID NO: 434090 - RNA, 64 nt, hsa; identical to SEQ ID NO: 39370

SEQ ID NO: 434091 - RNA, 64 nt, hsa; identical to SEQ ID NO: 39371

SEQ ID NO: 434092 - RNA, 64 nt, hsa; identical to SEQ ID NO: 39372

SEQ ID NO: 434093 - RNA, 64 nt, hsa; identical to SEQ ID NO: 39373

SEQ ID NO: 434094 - RNA, 64 nt, hsa; identical to SEQ ID NO: 39374

SEQ ID NO: 434095 - RNA, 64 nt, hsa; identical to SEQ ID NO: 39375

SEQ ID NO: 434096 - RNA, 64 nt, hsa; identical to SEQ ID NO: 39376

SEQ ID NO: 434097 - RNA, 64 nt, hsa; identical to SEQ ID NO: 39377

SEQ ID NO: 434098 - RNA, 64 nt, hsa; identical to SEQ ID NO: 39378

SEQ ID NO: 434099 - RNA, 64 nt, hsa; identical to SEQ ID NO: 39379

SEQ ID NO: 434100 - RNA, 64 nt, hsa; identical to SEQ ID NO: 39380

SEQ ID NO: 434101 - RNA, 64 nt, hsa; identical to SEQ ID NO: 39381

SEQ ID NO: 434102 - RNA, 64 nt, hsa; identical to SEQ ID NO: 39382

SEQ ID NO: 434103 - RNA, 64 nt, hsa; identical to SEQ ID NO: 39383

SEQ ID NO: 434104 - RNA, 64 nt, hsa; identical to SEQ ID NO: 39384

SEQ ID NO: 434105 - RNA, 64 nt, hsa; identical to SEQ ID NO: 39385

SEQ ID NO: 434106 - RNA, 64 nt, hsa; identical to SEQ ID NO: 39386

SEQ ID NO: 434107 - RNA, 64 nt, hsa; identical to SEQ ID NO: 39387

SEQ ID NO: 434108 - RNA, 64 nt, hsa; identical to SEQ ID NO: 39388

SEQ ID NO: 434109 - RNA, 64 nt, hsa; identical to SEQ ID NO: 39389

SEQ ID NO: 434110 - RNA, 64 nt, hsa; identical to SEQ ID NO: 39390

SEQ ID NO: 434111 - RNA, 64 nt, hsa; identical to SEQ ID NO: 39391

SEQ ID NO: 434112 - RNA, 64 nt, hsa; identical to SEQ ID NO: 39392

SEQ ID NO: 434113 - RNA, 64 nt, hsa; identical to SEQ ID NO: 39393

SEQ ID NO: 434114 - RNA, 64 nt, hsa; identical to SEQ ID NO: 39394

SEQ ID NO: 434115 - RNA, 64 nt, hsa; identical to SEQ ID NO: 39395

SEQ ID NO: 434116 - RNA, 64 nt, hsa; identical to SEQ ID NO: 39396

SEQ ID NO: 434117 - RNA, 64 nt, hsa; identical to SEQ ID NO: 39397

SEQ ID NO: 434118 - RNA, 64 nt, hsa; identical to SEQ ID NO: 39398

SEQ ID NO: 434119 - RNA, 64 nt, hsa; identical to SEQ ID NO: 39399

SEQ ID NO: 434120 - RNA, 64 nt, hsa; identical to SEQ ID NO: 39400

SEQ ID NO: 434121 - RNA, 64 nt, hsa; identical to SEQ ID NO: 39401

SEQ ID NO: 434122 - RNA, 64 nt, hsa; identical to SEQ ID NO: 39402

SEQ ID NO: 434123 - RNA, 64 nt, hsa; identical to SEQ ID NO: 39403

SEQ ID NO: 434124 - RNA, 64 nt, hsa; identical to SEQ ID NO: 39404

SEQ ID NO: 434125 - RNA, 64 nt, hsa; identical to SEQ ID NO: 39405

SEQ ID NO: 434126 - RNA, 64 nt, hsa; identical to SEQ ID NO: 39406

SEQ ID NO: 434127 - RNA, 64 nt, hsa; identical to SEQ ID NO: 39407

SEQ ID NO: 434128 - RNA, 64 nt, hsa; identical to SEQ ID NO: 39408

SEQ ID NO: 434129 - RNA, 64 nt, hsa; identical to SEQ ID NO: 39409

SEQ ID NO: 434130 - RNA, 64 nt, hsa; identical to SEQ ID NO: 39410

SEQ ID NO: 434131 - RNA, 64 nt, hsa; identical to SEQ ID NO: 39411

SEQ ID NO: 434132 - RNA, 64 nt, hsa; identical to SEQ ID NO: 39412

SEQ ID NO: 434133 - RNA, 64 nt, hsa; identical to SEQ ID NO: 39413

SEQ ID NO: 434134 - RNA, 64 nt, hsa; identical to SEQ ID NO: 39414

SEQ ID NO: 434135 - RNA, 64 nt, hsa; identical to SEQ ID NO: 39415

SEQ ID NO: 434136 - RNA, 64 nt, hsa; identical to SEQ ID NO: 39416

SEQ ID NO: 434137 - RNA, 64 nt, hsa; identical to SEQ ID NO: 39417

SEQ ID NO: 434138 - RNA, 64 nt, hsa; identical to SEQ ID NO: 39418

SEQ ID NO: 434139 - RNA, 64 nt, hsa; identical to SEQ ID NO: 39419

SEQ ID NO: 434140 - RNA, 64 nt, hsa; identical to SEQ ID NO: 39420

SEQ ID NO: 434141 - RNA, 64 nt, hsa; identical to SEQ ID NO: 39421

SEQ ID NO: 434142 - RNA, 64 nt, hsa; identical to SEQ ID NO: 39422

SEQ ID NO: 434143 - RNA, 64 nt, hsa; identical to SEQ ID NO: 39423

SEQ ID NO: 434144 - RNA, 64 nt, hsa; identical to SEQ ID NO: 39424

SEQ ID NO: 434145 - RNA, 64 nt, hsa; identical to SEQ ID NO: 39425

SEQ ID NO: 434146 - RNA, 64 nt, hsa; identical to SEQ ID NO: 39426

SEQ ID NO: 434147 - RNA, 64 nt, hsa; identical to SEQ ID NO: 39427

SEQ ID NO: 434148 - RNA, 64 nt, hsa; identical to SEQ ID NO: 39428

SEQ ID NO: 434149 - RNA, 64 nt, hsa; identical to SEQ ID NO: 39429

SEQ ID NO: 434150 - RNA, 64 nt, hsa; identical to SEQ ID NO: 39430

SEQ ID NO: 434151 - RNA, 64 nt, hsa; identical to SEQ ID NO: 39431

SEQ ID NO: 434152 - RNA, 64 nt, hsa; identical to SEQ ID NO: 39432

SEQ ID NO: 434153 - RNA, 64 nt, hsa; identical to SEQ ID NO: 39433

SEQ ID NO: 434154 - RNA, 64 nt, hsa; identical to SEQ ID NO: 39434

SEQ ID NO: 434155 - RNA, 64 nt, hsa; identical to SEQ ID NO: 39435

SEQ ID NO: 434156 - RNA, 64 nt, hsa; identical to SEQ ID NO: 39436

SEQ ID NO: 434157 - RNA, 64 nt, hsa; identical to SEQ ID NO: 39437

SEQ ID NO: 434158 - RNA, 64 nt, hsa; identical to SEQ ID NO: 39438

SEQ ID NO: 434159 - RNA, 64 nt, hsa; identical to SEQ ID NO: 39439

SEQ ID NO: 434160 - RNA, 64 nt, hsa; identical to SEQ ID NO: 39440

SEQ ID NO: 434161 - RNA, 64 nt, hsa; identical to SEQ ID NO: 39441

SEQ ID NO: 434162 - RNA, 64 nt, hsa; identical to SEQ ID NO: 39442

SEQ ID NO: 434163 - RNA, 64 nt, hsa; identical to SEQ ID NO: 39443

SEQ ID NO: 434164 - RNA, 64 nt, hsa; identical to SEQ ID NO: 39444

SEQ ID NO: 434165 - RNA, 64 nt, hsa; identical to SEQ ID NO: 39445

SEQ ID NO: 434166 - RNA, 64 nt, hsa; identical to SEQ ID NO: 39446

SEQ ID NO: 434167 - RNA, 64 nt, hsa; identical to SEQ ID NO: 39447

SEQ ID NO: 434168 - RNA, 64 nt, hsa; identical to SEQ ID NO: 39448

SEQ ID NO: 434169 - RNA, 64 nt, hsa; identical to SEQ ID NO: 39449

SEQ ID NO: 434170 - RNA, 64 nt, hsa; identical to SEQ ID NO: 39450

SEQ ID NO: 434171 - RNA, 64 nt, hsa; identical to SEQ ID NO: 39451

SEQ ID NO: 434172 - RNA, 64 nt, hsa; identical to SEQ ID NO: 39452

SEQ ID NO: 434173 - RNA, 64 nt, hsa; identical to SEQ ID NO: 39453

SEQ ID NO: 434174 - RNA, 64 nt, hsa; identical to SEQ ID NO: 39454

SEQ ID NO: 434175 - RNA, 64 nt, hsa; identical to SEQ ID NO: 39455

SEQ ID NO: 434176 - RNA, 64 nt, hsa; identical to SEQ ID NO: 39456

SEQ ID NO: 434177 - RNA, 64 nt, hsa; identical to SEQ ID NO: 39457

SEQ ID NO: 434178 - RNA, 64 nt, hsa; identical to SEQ ID NO: 39458

SEQ ID NO: 434179 - RNA, 64 nt, hsa; identical to SEQ ID NO: 39459

SEQ ID NO: 434180 - RNA, 64 nt, hsa; identical to SEQ ID NO: 39460

SEQ ID NO: 434181 - RNA, 64 nt, hsa; identical to SEQ ID NO: 39461

SEQ ID NO: 434182 - RNA, 64 nt, hsa; identical to SEQ ID NO: 39462

SEQ ID NO: 434183 - RNA, 64 nt, hsa; identical to SEQ ID NO: 39463

SEQ ID NO: 434184 - RNA, 64 nt, hsa; identical to SEQ ID NO: 39464

SEQ ID NO: 434185 - RNA, 64 nt, hsa; identical to SEQ ID NO: 39465

SEQ ID NO: 434186 - RNA, 64 nt, hsa; identical to SEQ ID NO: 39466

SEQ ID NO: 434187 - RNA, 64 nt, hsa; identical to SEQ ID NO: 39467

SEQ ID NO: 434188 - RNA, 64 nt, hsa; identical to SEQ ID NO: 39468

SEQ ID NO: 434189 - RNA, 64 nt, hsa; identical to SEQ ID NO: 39469

SEQ ID NO: 434190 - RNA, 64 nt, hsa; identical to SEQ ID NO: 39470

SEQ ID NO: 434191 - RNA, 64 nt, hsa; identical to SEQ ID NO: 39471

SEQ ID NO: 434192 - RNA, 64 nt, hsa; identical to SEQ ID NO: 39472

SEQ ID NO: 434193 - RNA, 64 nt, hsa; identical to SEQ ID NO: 39473

SEQ ID NO: 434194 - RNA, 64 nt, hsa; identical to SEQ ID NO: 39474

SEQ ID NO: 434195 - RNA, 64 nt, hsa; identical to SEQ ID NO: 39475

SEQ ID NO: 434196 - RNA, 64 nt, hsa; identical to SEQ ID NO: 39476

SEQ ID NO: 434197 - RNA, 64 nt, hsa; identical to SEQ ID NO: 39477

SEQ ID NO: 434198 - RNA, 64 nt, hsa; identical to SEQ ID NO: 39478

SEQ ID NO: 434199 - RNA, 64 nt, hsa; identical to SEQ ID NO: 39479

SEQ ID NO: 434200 - RNA, 64 nt, hsa; identical to SEQ ID NO: 39480

SEQ ID NO: 434201 - RNA, 64 nt, hsa; identical to SEQ ID NO: 39481

SEQ ID NO: 434202 - RNA, 64 nt, hsa; identical to SEQ ID NO: 39482

SEQ ID NO: 434203 - RNA, 64 nt, hsa; identical to SEQ ID NO: 39483

SEQ ID NO: 434204 - RNA, 64 nt, hsa; identical to SEQ ID NO: 39484

SEQ ID NO: 434205 - RNA, 64 nt, hsa; identical to SEQ ID NO: 39485

SEQ ID NO: 434206 - RNA, 64 nt, hsa; identical to SEQ ID NO: 39486

SEQ ID NO: 434207 - RNA, 64 nt, hsa; identical to SEQ ID NO: 39487

SEQ ID NO: 434208 - RNA, 64 nt, hsa; identical to SEQ ID NO: 39488

SEQ ID NO: 434209 - RNA, 64 nt, hsa; identical to SEQ ID NO: 39489

SEQ ID NO: 434210 - RNA, 64 nt, hsa; identical to SEQ ID NO: 39490

SEQ ID NO: 434211 - RNA, 64 nt, hsa; identical to SEQ ID NO: 39491

SEQ ID NO: 434212 - RNA, 64 nt, hsa; identical to SEQ ID NO: 39492

SEQ ID NO: 434213 - RNA, 64 nt, hsa; identical to SEQ ID NO: 39493

SEQ ID NO: 434214 - RNA, 64 nt, hsa; identical to SEQ ID NO: 39494

SEQ ID NO: 434215 - RNA, 64 nt, hsa; identical to SEQ ID NO: 39495

SEQ ID NO: 434216 - RNA, 64 nt, hsa; identical to SEQ ID NO: 39496

SEQ ID NO: 434217 - RNA, 64 nt, hsa; identical to SEQ ID NO: 39497

SEQ ID NO: 434218 - RNA, 64 nt, hsa; identical to SEQ ID NO: 39498

SEQ ID NO: 434219 - RNA, 64 nt, hsa; identical to SEQ ID NO: 39499

SEQ ID NO: 434220 - RNA, 64 nt, hsa; identical to SEQ ID NO: 39500

SEQ ID NO: 434221 - RNA, 64 nt, hsa; identical to SEQ ID NO: 39501

SEQ ID NO: 434222 - RNA, 64 nt, hsa; identical to SEQ ID NO: 39502

SEQ ID NO: 434223 - RNA, 64 nt, hsa; identical to SEQ ID NO: 39503

SEQ ID NO: 434224 - RNA, 64 nt, hsa; identical to SEQ ID NO: 39504

SEQ ID NO: 434225 - RNA, 64 nt, hsa; identical to SEQ ID NO: 39505

SEQ ID NO: 434226 - RNA, 64 nt, hsa; identical to SEQ ID NO: 39506

SEQ ID NO: 434227 - RNA, 64 nt, hsa; identical to SEQ ID NO: 39507

SEQ ID NO: 434228 - RNA, 64 nt, hsa; identical to SEQ ID NO: 39508

SEQ ID NO: 434229 - RNA, 64 nt, hsa; identical to SEQ ID NO: 39509

SEQ ID NO: 434230 - RNA, 64 nt, hsa; identical to SEQ ID NO: 39510

SEQ ID NO: 434231 - RNA, 64 nt, hsa; identical to SEQ ID NO: 39511

SEQ ID NO: 434232 - RNA, 64 nt, hsa; identical to SEQ ID NO: 39512

SEQ ID NO: 434233 - RNA, 64 nt, hsa; identical to SEQ ID NO: 39513

SEQ ID NO: 434234 - RNA, 64 nt, hsa; identical to SEQ ID NO: 39514

SEQ ID NO: 434235 - RNA, 64 nt, hsa; identical to SEQ ID NO: 39515

SEQ ID NO: 434236 - RNA, 64 nt, hsa; identical to SEQ ID NO: 39516

SEQ ID NO: 434237 - RNA, 64 nt, hsa; identical to SEQ ID NO: 39517

SEQ ID NO: 434238 - RNA, 64 nt, hsa; identical to SEQ ID NO: 39518

SEQ ID NO: 434239 - RNA, 64 nt, hsa; identical to SEQ ID NO: 39519

SEQ ID NO: 434240 - RNA, 64 nt, hsa; identical to SEQ ID NO: 39520

SEQ ID NO: 434241 - RNA, 64 nt, hsa; identical to SEQ ID NO: 39521

SEQ ID NO: 434242 - RNA, 64 nt, hsa; identical to SEQ ID NO: 39522

SEQ ID NO: 434243 - RNA, 64 nt, hsa; identical to SEQ ID NO: 39523

SEQ ID NO: 434244 - RNA, 64 nt, hsa; identical to SEQ ID NO: 39524

SEQ ID NO: 434245 - RNA, 64 nt, hsa; identical to SEQ ID NO: 39525

SEQ ID NO: 434246 - RNA, 64 nt, hsa; identical to SEQ ID NO: 39526

SEQ ID NO: 434247 - RNA, 64 nt, hsa; identical to SEQ ID NO: 39527

SEQ ID NO: 434248 - RNA, 64 nt, hsa; identical to SEQ ID NO: 39528

SEQ ID NO: 434249 - RNA, 64 nt, hsa; identical to SEQ ID NO: 39529

SEQ ID NO: 434250 - RNA, 64 nt, hsa; identical to SEQ ID NO: 39530

SEQ ID NO: 434251 - RNA, 64 nt, hsa; identical to SEQ ID NO: 39531

SEQ ID NO: 434252 - RNA, 64 nt, hsa; identical to SEQ ID NO: 39532

SEQ ID NO: 434253 - RNA, 64 nt, hsa; identical to SEQ ID NO: 39533

SEQ ID NO: 434254 - RNA, 64 nt, hsa; identical to SEQ ID NO: 39534

SEQ ID NO: 434255 - RNA, 64 nt, hsa; identical to SEQ ID NO: 39535

SEQ ID NO: 434256 - RNA, 64 nt, hsa; identical to SEQ ID NO: 39536

SEQ ID NO: 434257 - RNA, 64 nt, hsa; identical to SEQ ID NO: 39537

SEQ ID NO: 434258 - RNA, 64 nt, hsa; identical to SEQ ID NO: 39538

SEQ ID NO: 434259 - RNA, 64 nt, hsa; identical to SEQ ID NO: 39539

SEQ ID NO: 434260 - RNA, 64 nt, hsa; identical to SEQ ID NO: 39540

SEQ ID NO: 434261 - RNA, 64 nt, hsa; identical to SEQ ID NO: 39541

SEQ ID NO: 434262 - RNA, 64 nt, hsa; identical to SEQ ID NO: 39542

SEQ ID NO: 434263 - RNA, 64 nt, hsa; identical to SEQ ID NO: 39543

SEQ ID NO: 434264 - RNA, 64 nt, hsa; identical to SEQ ID NO: 39544

SEQ ID NO: 434265 - RNA, 64 nt, hsa; identical to SEQ ID NO: 39545

SEQ ID NO: 434266 - RNA, 64 nt, hsa; identical to SEQ ID NO: 39546

SEQ ID NO: 434267 - RNA, 64 nt, hsa; identical to SEQ ID NO: 39547

SEQ ID NO: 434268 - RNA, 64 nt, hsa; identical to SEQ ID NO: 39548

SEQ ID NO: 434269 - RNA, 64 nt, hsa; identical to SEQ ID NO: 39549

SEQ ID NO: 434270 - RNA, 64 nt, hsa; identical to SEQ ID NO: 39550

SEQ ID NO: 434271 - RNA, 64 nt, hsa; identical to SEQ ID NO: 39551

SEQ ID NO: 434272 - RNA, 64 nt, hsa; identical to SEQ ID NO: 39552

SEQ ID NO: 434273 - RNA, 64 nt, hsa; identical to SEQ ID NO: 39553

SEQ ID NO: 434274 - RNA, 64 nt, hsa; identical to SEQ ID NO: 39554

SEQ ID NO: 434275 - RNA, 64 nt, hsa; identical to SEQ ID NO: 39555

SEQ ID NO: 434276 - RNA, 64 nt, hsa; identical to SEQ ID NO: 39556

SEQ ID NO: 434277 - RNA, 64 nt, hsa; identical to SEQ ID NO: 39557

SEQ ID NO: 434278 - RNA, 64 nt, hsa; identical to SEQ ID NO: 39558

SEQ ID NO: 434279 - RNA, 64 nt, hsa; identical to SEQ ID NO: 39559

SEQ ID NO: 434280 - RNA, 64 nt, hsa; identical to SEQ ID NO: 39560

SEQ ID NO: 434281 - RNA, 64 nt, hsa; identical to SEQ ID NO: 39561

SEQ ID NO: 434282 - RNA, 64 nt, hsa; identical to SEQ ID NO: 39562

SEQ ID NO: 434283 - RNA, 64 nt, hsa; identical to SEQ ID NO: 39563

SEQ ID NO: 434284 - RNA, 64 nt, hsa; identical to SEQ ID NO: 39564

SEQ ID NO: 434285 - RNA, 64 nt, hsa; identical to SEQ ID NO: 39565

SEQ ID NO: 434286 - RNA, 64 nt, hsa; identical to SEQ ID NO: 39566

SEQ ID NO: 434287 - RNA, 64 nt, hsa; identical to SEQ ID NO: 39567

SEQ ID NO: 434288 - RNA, 64 nt, hsa; identical to SEQ ID NO: 39568

SEQ ID NO: 434289 - RNA, 64 nt, hsa; identical to SEQ ID NO: 39569

SEQ ID NO: 434290 - RNA, 64 nt, hsa; identical to SEQ ID NO: 39570

SEQ ID NO: 434291 - RNA, 64 nt, hsa; identical to SEQ ID NO: 39571

SEQ ID NO: 434292 - RNA, 64 nt, hsa; identical to SEQ ID NO: 39572

SEQ ID NO: 434293 - RNA, 64 nt, hsa; identical to SEQ ID NO: 39573

SEQ ID NO: 434294 - RNA, 64 nt, hsa; identical to SEQ ID NO: 39574

SEQ ID NO: 434295 - RNA, 64 nt, hsa; identical to SEQ ID NO: 39575

SEQ ID NO: 434296 - RNA, 64 nt, hsa; identical to SEQ ID NO: 39576

SEQ ID NO: 434297 - RNA, 64 nt, hsa; identical to SEQ ID NO: 39577

SEQ ID NO: 434298 - RNA, 64 nt, hsa; identical to SEQ ID NO: 39578

SEQ ID NO: 434299 - RNA, 64 nt, hsa; identical to SEQ ID NO: 39579

SEQ ID NO: 434300 - RNA, 64 nt, hsa; identical to SEQ ID NO: 39580

SEQ ID NO: 434301 - RNA, 64 nt, hsa; identical to SEQ ID NO: 39581

SEQ ID NO: 434302 - RNA, 64 nt, hsa; identical to SEQ ID NO: 39582

SEQ ID NO: 434303 - RNA, 64 nt, hsa; identical to SEQ ID NO: 39583

SEQ ID NO: 434304 - RNA, 64 nt, hsa; identical to SEQ ID NO: 39584

SEQ ID NO: 434305 - RNA, 64 nt, hsa; identical to SEQ ID NO: 39585

SEQ ID NO: 434306 - RNA, 64 nt, hsa; identical to SEQ ID NO: 39586

SEQ ID NO: 434307 - RNA, 64 nt, hsa; identical to SEQ ID NO: 39587

SEQ ID NO: 434308 - RNA, 64 nt, hsa; identical to SEQ ID NO: 39588

SEQ ID NO: 434309 - RNA, 64 nt, hsa; identical to SEQ ID NO: 39589

SEQ ID NO: 434310 - RNA, 64 nt, hsa; identical to SEQ ID NO: 39590

SEQ ID NO: 434311 - RNA, 64 nt, hsa; identical to SEQ ID NO: 39591

SEQ ID NO: 434312 - RNA, 64 nt, hsa; identical to SEQ ID NO: 39592

SEQ ID NO: 434313 - RNA, 64 nt, hsa; identical to SEQ ID NO: 39593

SEQ ID NO: 434314 - RNA, 64 nt, hsa; identical to SEQ ID NO: 39594

SEQ ID NO: 434315 - RNA, 64 nt, hsa; identical to SEQ ID NO: 39595

SEQ ID NO: 434316 - RNA, 64 nt, hsa; identical to SEQ ID NO: 39596

SEQ ID NO: 434317 - RNA, 64 nt, hsa; identical to SEQ ID NO: 39597

SEQ ID NO: 434318 - RNA, 64 nt, hsa; identical to SEQ ID NO: 39598

SEQ ID NO: 434319 - RNA, 64 nt, hsa; identical to SEQ ID NO: 39599

SEQ ID NO: 434320 - RNA, 64 nt, hsa; identical to SEQ ID NO: 39600

SEQ ID NO: 434321 - RNA, 64 nt, hsa; identical to SEQ ID NO: 39601

SEQ ID NO: 434322 - RNA, 64 nt, hsa; identical to SEQ ID NO: 39602

SEQ ID NO: 434323 - RNA, 64 nt, hsa; identical to SEQ ID NO: 39603

SEQ ID NO: 434324 - RNA, 64 nt, hsa; identical to SEQ ID NO: 39604

SEQ ID NO: 434325 - RNA, 64 nt, hsa; identical to SEQ ID NO: 39605

SEQ ID NO: 434326 - RNA, 64 nt, hsa; identical to SEQ ID NO: 39606

SEQ ID NO: 434327 - RNA, 64 nt, hsa; identical to SEQ ID NO: 39607

SEQ ID NO: 434328 - RNA, 64 nt, hsa; identical to SEQ ID NO: 39608

SEQ ID NO: 434329 - RNA, 64 nt, hsa; identical to SEQ ID NO: 39609

SEQ ID NO: 434330 - RNA, 64 nt, hsa; identical to SEQ ID NO: 39610

SEQ ID NO: 434331 - RNA, 64 nt, hsa; identical to SEQ ID NO: 39611

SEQ ID NO: 434332 - RNA, 64 nt, hsa; identical to SEQ ID NO: 39612

SEQ ID NO: 434333 - RNA, 64 nt, hsa; identical to SEQ ID NO: 39613

SEQ ID NO: 434334 - RNA, 64 nt, hsa; identical to SEQ ID NO: 39614

SEQ ID NO: 434335 - RNA, 64 nt, hsa; identical to SEQ ID NO: 39615

SEQ ID NO: 434336 - RNA, 64 nt, hsa; identical to SEQ ID NO: 39616

SEQ ID NO: 434337 - RNA, 64 nt, hsa; identical to SEQ ID NO: 39617

SEQ ID NO: 434338 - RNA, 64 nt, hsa; identical to SEQ ID NO: 39618

SEQ ID NO: 434339 - RNA, 64 nt, hsa; identical to SEQ ID NO: 39619

SEQ ID NO: 434340 - RNA, 64 nt, hsa; identical to SEQ ID NO: 39620

SEQ ID NO: 434341 - RNA, 64 nt, hsa; identical to SEQ ID NO: 39621

SEQ ID NO: 434342 - RNA, 64 nt, hsa; identical to SEQ ID NO: 39622

SEQ ID NO: 434343 - RNA, 64 nt, hsa; identical to SEQ ID NO: 39623

SEQ ID NO: 434344 - RNA, 64 nt, hsa; identical to SEQ ID NO: 39624

SEQ ID NO: 434345 - RNA, 64 nt, hsa; identical to SEQ ID NO: 39625

SEQ ID NO: 434346 - RNA, 64 nt, hsa; identical to SEQ ID NO: 39626

SEQ ID NO: 434347 - RNA, 64 nt, hsa; identical to SEQ ID NO: 39627

SEQ ID NO: 434348 - RNA, 64 nt, hsa; identical to SEQ ID NO: 39628

SEQ ID NO: 434349 - RNA, 64 nt, hsa; identical to SEQ ID NO: 39629

SEQ ID NO: 434350 - RNA, 64 nt, hsa; identical to SEQ ID NO: 39630

SEQ ID NO: 434351 - RNA, 64 nt, hsa; identical to SEQ ID NO: 39631

SEQ ID NO: 434352 - RNA, 64 nt, hsa; identical to SEQ ID NO: 39632

SEQ ID NO: 434353 - RNA, 64 nt, hsa; identical to SEQ ID NO: 39633

SEQ ID NO: 434354 - RNA, 64 nt, hsa; identical to SEQ ID NO: 39634

SEQ ID NO: 434355 - RNA, 64 nt, hsa; identical to SEQ ID NO: 39635

SEQ ID NO: 434356 - RNA, 64 nt, hsa; identical to SEQ ID NO: 39636

SEQ ID NO: 434357 - RNA, 64 nt, hsa; identical to SEQ ID NO: 39637

SEQ ID NO: 434358 - RNA, 64 nt, hsa; identical to SEQ ID NO: 39638

SEQ ID NO: 434359 - RNA, 64 nt, hsa; identical to SEQ ID NO: 39639

SEQ ID NO: 434360 - RNA, 64 nt, hsa; identical to SEQ ID NO: 39640

SEQ ID NO: 434361 - RNA, 64 nt, hsa; identical to SEQ ID NO: 39641

SEQ ID NO: 434362 - RNA, 64 nt, hsa; identical to SEQ ID NO: 39642

SEQ ID NO: 434363 - RNA, 64 nt, hsa; identical to SEQ ID NO: 39643

SEQ ID NO: 434364 - RNA, 64 nt, hsa; identical to SEQ ID NO: 39644

SEQ ID NO: 434365 - RNA, 64 nt, hsa; identical to SEQ ID NO: 39645

SEQ ID NO: 434366 - RNA, 64 nt, hsa; identical to SEQ ID NO: 39646

SEQ ID NO: 434367 - RNA, 64 nt, hsa; identical to SEQ ID NO: 39647

SEQ ID NO: 434368 - RNA, 64 nt, hsa; identical to SEQ ID NO: 39648

SEQ ID NO: 434369 - RNA, 64 nt, hsa; identical to SEQ ID NO: 39649

SEQ ID NO: 434370 - RNA, 64 nt, hsa; identical to SEQ ID NO: 39650

SEQ ID NO: 434371 - RNA, 64 nt, hsa; identical to SEQ ID NO: 39651

SEQ ID NO: 434372 - RNA, 64 nt, hsa; identical to SEQ ID NO: 39652

SEQ ID NO: 434373 - RNA, 64 nt, hsa; identical to SEQ ID NO: 39653

SEQ ID NO: 434374 - RNA, 64 nt, hsa; identical to SEQ ID NO: 39654

SEQ ID NO: 434375 - RNA, 64 nt, hsa; identical to SEQ ID NO: 39655

SEQ ID NO: 434376 - RNA, 64 nt, hsa; identical to SEQ ID NO: 39656

SEQ ID NO: 434377 - RNA, 64 nt, hsa; identical to SEQ ID NO: 39657

SEQ ID NO: 434378 - RNA, 64 nt, hsa; identical to SEQ ID NO: 39658

SEQ ID NO: 434379 - RNA, 64 nt, hsa; identical to SEQ ID NO: 39659

SEQ ID NO: 434380 - RNA, 64 nt, hsa; identical to SEQ ID NO: 39660

SEQ ID NO: 434381 - RNA, 64 nt, hsa; identical to SEQ ID NO: 39661

SEQ ID NO: 434382 - RNA, 64 nt, hsa; identical to SEQ ID NO: 39662

SEQ ID NO: 434383 - RNA, 64 nt, hsa; identical to SEQ ID NO: 39663

SEQ ID NO: 434384 - RNA, 64 nt, hsa; identical to SEQ ID NO: 39664

SEQ ID NO: 434385 - RNA, 64 nt, hsa; identical to SEQ ID NO: 39665

SEQ ID NO: 434386 - RNA, 64 nt, hsa; identical to SEQ ID NO: 39666

SEQ ID NO: 434387 - RNA, 64 nt, hsa; identical to SEQ ID NO: 39667

SEQ ID NO: 434388 - RNA, 64 nt, hsa; identical to SEQ ID NO: 39668

SEQ ID NO: 434389 - RNA, 64 nt, hsa; identical to SEQ ID NO: 39669

SEQ ID NO: 434390 - RNA, 64 nt, hsa; identical to SEQ ID NO: 39670

SEQ ID NO: 434391 - RNA, 64 nt, hsa; identical to SEQ ID NO: 39671

SEQ ID NO: 434392 - RNA, 64 nt, hsa; identical to SEQ ID NO: 39672

SEQ ID NO: 434393 - RNA, 64 nt, hsa; identical to SEQ ID NO: 39673

SEQ ID NO: 434394 - RNA, 64 nt, hsa; identical to SEQ ID NO: 39674

SEQ ID NO: 434395 - RNA, 64 nt, hsa; identical to SEQ ID NO: 39675

SEQ ID NO: 434396 - RNA, 64 nt, hsa; identical to SEQ ID NO: 39676

SEQ ID NO: 434397 - RNA, 64 nt, hsa; identical to SEQ ID NO: 39677

SEQ ID NO: 434398 - RNA, 64 nt, hsa; identical to SEQ ID NO: 39678

SEQ ID NO: 434399 - RNA, 64 nt, hsa; identical to SEQ ID NO: 39679

SEQ ID NO: 434400 - RNA, 64 nt, hsa; identical to SEQ ID NO: 39680

SEQ ID NO: 434401 - RNA, 64 nt, hsa; identical to SEQ ID NO: 39681

SEQ ID NO: 434402 - RNA, 64 nt, hsa; identical to SEQ ID NO: 39682

SEQ ID NO: 434403 - RNA, 64 nt, hsa; identical to SEQ ID NO: 39683

SEQ ID NO: 434404 - RNA, 64 nt, hsa; identical to SEQ ID NO: 39684

SEQ ID NO: 434405 - RNA, 64 nt, hsa; identical to SEQ ID NO: 39685

SEQ ID NO: 434406 - RNA, 64 nt, hsa; identical to SEQ ID NO: 39686

SEQ ID NO: 434407 - RNA, 64 nt, hsa; identical to SEQ ID NO: 39687

SEQ ID NO: 434408 - RNA, 64 nt, hsa; identical to SEQ ID NO: 39688

SEQ ID NO: 434409 - RNA, 64 nt, hsa; identical to SEQ ID NO: 39689

SEQ ID NO: 434410 - RNA, 64 nt, hsa; identical to SEQ ID NO: 39690

SEQ ID NO: 434411 - RNA, 64 nt, hsa; identical to SEQ ID NO: 39691

SEQ ID NO: 434412 - RNA, 64 nt, hsa; identical to SEQ ID NO: 39692

SEQ ID NO: 434413 - RNA, 64 nt, hsa; identical to SEQ ID NO: 39693

SEQ ID NO: 434414 - RNA, 64 nt, hsa; identical to SEQ ID NO: 39694

SEQ ID NO: 434415 - RNA, 64 nt, hsa; identical to SEQ ID NO: 39695

SEQ ID NO: 434416 - RNA, 64 nt, hsa; identical to SEQ ID NO: 39696

SEQ ID NO: 434417 - RNA, 64 nt, hsa; identical to SEQ ID NO: 39697

SEQ ID NO: 434418 - RNA, 64 nt, hsa; identical to SEQ ID NO: 39698

SEQ ID NO: 434419 - RNA, 64 nt, hsa; identical to SEQ ID NO: 39699

SEQ ID NO: 434420 - RNA, 64 nt, hsa; identical to SEQ ID NO: 39700

SEQ ID NO: 434421 - RNA, 64 nt, hsa; identical to SEQ ID NO: 39701

SEQ ID NO: 434422 - RNA, 64 nt, hsa; identical to SEQ ID NO: 39702

SEQ ID NO: 434423 - RNA, 64 nt, hsa; identical to SEQ ID NO: 39703

SEQ ID NO: 434424 - RNA, 64 nt, hsa; identical to SEQ ID NO: 39704

SEQ ID NO: 434425 - RNA, 64 nt, hsa; identical to SEQ ID NO: 39705

SEQ ID NO: 434426 - RNA, 64 nt, hsa; identical to SEQ ID NO: 39706

SEQ ID NO: 434427 - RNA, 64 nt, hsa; identical to SEQ ID NO: 39707

SEQ ID NO: 434428 - RNA, 64 nt, hsa; identical to SEQ ID NO: 39708

SEQ ID NO: 434429 - RNA, 64 nt, hsa; identical to SEQ ID NO: 39709

SEQ ID NO: 434430 - RNA, 64 nt, hsa; identical to SEQ ID NO: 39710

SEQ ID NO: 434431 - RNA, 64 nt, hsa; identical to SEQ ID NO: 39711

SEQ ID NO: 434432 - RNA, 64 nt, hsa; identical to SEQ ID NO: 39712

SEQ ID NO: 434433 - RNA, 64 nt, hsa; identical to SEQ ID NO: 39713

SEQ ID NO: 434434 - RNA, 64 nt, hsa; identical to SEQ ID NO: 39714

SEQ ID NO: 434435 - RNA, 64 nt, hsa; identical to SEQ ID NO: 39715

SEQ ID NO: 434436 - RNA, 64 nt, hsa; identical to SEQ ID NO: 39716

SEQ ID NO: 434437 - RNA, 64 nt, hsa; identical to SEQ ID NO: 39717

SEQ ID NO: 434438 - RNA, 64 nt, hsa; identical to SEQ ID NO: 39718

SEQ ID NO: 434439 - RNA, 64 nt, hsa; identical to SEQ ID NO: 39719

SEQ ID NO: 434440 - RNA, 64 nt, hsa; identical to SEQ ID NO: 39720

SEQ ID NO: 434441 - RNA, 64 nt, hsa; identical to SEQ ID NO: 39721

SEQ ID NO: 434442 - RNA, 64 nt, hsa; identical to SEQ ID NO: 39722

SEQ ID NO: 434443 - RNA, 64 nt, hsa; identical to SEQ ID NO: 39723

SEQ ID NO: 434444 - RNA, 64 nt, hsa; identical to SEQ ID NO: 39724

SEQ ID NO: 434445 - RNA, 64 nt, hsa; identical to SEQ ID NO: 39725

SEQ ID NO: 434446 - RNA, 64 nt, hsa; identical to SEQ ID NO: 39726

SEQ ID NO: 434447 - RNA, 64 nt, hsa; identical to SEQ ID NO: 39727

SEQ ID NO: 434448 - RNA, 64 nt, hsa; identical to SEQ ID NO: 39728

SEQ ID NO: 434449 - RNA, 64 nt, hsa; identical to SEQ ID NO: 39729

SEQ ID NO: 434450 - RNA, 64 nt, hsa; identical to SEQ ID NO: 39730

SEQ ID NO: 434451 - RNA, 64 nt, hsa; identical to SEQ ID NO: 39731

SEQ ID NO: 434452 - RNA, 64 nt, hsa; identical to SEQ ID NO: 39732

SEQ ID NO: 434453 - RNA, 64 nt, hsa; identical to SEQ ID NO: 39733

SEQ ID NO: 434454 - RNA, 64 nt, hsa; identical to SEQ ID NO: 39734

SEQ ID NO: 434455 - RNA, 64 nt, hsa; identical to SEQ ID NO: 39735

SEQ ID NO: 434456 - RNA, 64 nt, hsa; identical to SEQ ID NO: 39736

SEQ ID NO: 434457 - RNA, 64 nt, hsa; identical to SEQ ID NO: 39737

SEQ ID NO: 434458 - RNA, 64 nt, hsa; identical to SEQ ID NO: 39738

SEQ ID NO: 434459 - RNA, 64 nt, hsa; identical to SEQ ID NO: 39739

SEQ ID NO: 434460 - RNA, 64 nt, hsa; identical to SEQ ID NO: 39740

SEQ ID NO: 434461 - RNA, 64 nt, hsa; identical to SEQ ID NO: 39741

SEQ ID NO: 434462 - RNA, 64 nt, hsa; identical to SEQ ID NO: 39742

SEQ ID NO: 434463 - RNA, 64 nt, hsa; identical to SEQ ID NO: 39743

SEQ ID NO: 434464 - RNA, 64 nt, hsa; identical to SEQ ID NO: 39744

SEQ ID NO: 434465 - RNA, 64 nt, hsa; identical to SEQ ID NO: 39745

SEQ ID NO: 434466 - RNA, 64 nt, hsa; identical to SEQ ID NO: 39746

SEQ ID NO: 434467 - RNA, 64 nt, hsa; identical to SEQ ID NO: 39747

SEQ ID NO: 434468 - RNA, 64 nt, hsa; identical to SEQ ID NO: 39748

SEQ ID NO: 434469 - RNA, 64 nt, hsa; identical to SEQ ID NO: 39749

SEQ ID NO: 434470 - RNA, 64 nt, hsa; identical to SEQ ID NO: 39750

SEQ ID NO: 434471 - RNA, 64 nt, hsa; identical to SEQ ID NO: 39751

SEQ ID NO: 434472 - RNA, 64 nt, hsa; identical to SEQ ID NO: 39752

SEQ ID NO: 434473 - RNA, 64 nt, hsa; identical to SEQ ID NO: 39753

SEQ ID NO: 434474 - RNA, 64 nt, hsa; identical to SEQ ID NO: 39754

SEQ ID NO: 434475 - RNA, 64 nt, hsa; identical to SEQ ID NO: 39755

SEQ ID NO: 434476 - RNA, 64 nt, hsa; identical to SEQ ID NO: 39756

SEQ ID NO: 434477 - RNA, 64 nt, hsa; identical to SEQ ID NO: 39757

SEQ ID NO: 434478 - RNA, 64 nt, hsa; identical to SEQ ID NO: 39758

SEQ ID NO: 434479 - RNA, 64 nt, hsa; identical to SEQ ID NO: 39759

SEQ ID NO: 434480 - RNA, 64 nt, hsa; identical to SEQ ID NO: 39760

SEQ ID NO: 434481 - RNA, 64 nt, hsa; identical to SEQ ID NO: 39761

SEQ ID NO: 434482 - RNA, 64 nt, hsa; identical to SEQ ID NO: 39762

SEQ ID NO: 434483 - RNA, 64 nt, hsa; identical to SEQ ID NO: 39763

SEQ ID NO: 434484 - RNA, 64 nt, hsa; identical to SEQ ID NO: 39764

SEQ ID NO: 434485 - RNA, 64 nt, hsa; identical to SEQ ID NO: 39765

SEQ ID NO: 434486 - RNA, 64 nt, hsa; identical to SEQ ID NO: 39766

SEQ ID NO: 434487 - RNA, 64 nt, hsa; identical to SEQ ID NO: 39767

SEQ ID NO: 434488 - RNA, 64 nt, hsa; identical to SEQ ID NO: 39768

SEQ ID NO: 434489 - RNA, 64 nt, hsa; identical to SEQ ID NO: 39769

SEQ ID NO: 434490 - RNA, 64 nt, hsa; identical to SEQ ID NO: 39770

SEQ ID NO: 434491 - RNA, 64 nt, hsa; identical to SEQ ID NO: 39771

SEQ ID NO: 434492 - RNA, 64 nt, hsa; identical to SEQ ID NO: 39772

SEQ ID NO: 434493 - RNA, 64 nt, hsa; identical to SEQ ID NO: 39773

SEQ ID NO: 434494 - RNA, 64 nt, hsa; identical to SEQ ID NO: 39774

SEQ ID NO: 434495 - RNA, 64 nt, hsa; identical to SEQ ID NO: 39775

SEQ ID NO: 434496 - RNA, 64 nt, hsa; identical to SEQ ID NO: 39776

SEQ ID NO: 434497 - RNA, 64 nt, hsa; identical to SEQ ID NO: 39777

SEQ ID NO: 434498 - RNA, 64 nt, hsa; identical to SEQ ID NO: 39778

SEQ ID NO: 434499 - RNA, 64 nt, hsa; identical to SEQ ID NO: 39779

SEQ ID NO: 434500 - RNA, 64 nt, hsa; identical to SEQ ID NO: 39780

SEQ ID NO: 434501 - RNA, 64 nt, hsa; identical to SEQ ID NO: 39781

SEQ ID NO: 434502 - RNA, 64 nt, hsa; identical to SEQ ID NO: 39782

SEQ ID NO: 434503 - RNA, 64 nt, hsa; identical to SEQ ID NO: 39783

SEQ ID NO: 434504 - RNA, 64 nt, hsa; identical to SEQ ID NO: 39784

SEQ ID NO: 434505 - RNA, 64 nt, hsa; identical to SEQ ID NO: 39785

SEQ ID NO: 434506 - RNA, 64 nt, hsa; identical to SEQ ID NO: 39786

SEQ ID NO: 434507 - RNA, 64 nt, hsa; identical to SEQ ID NO: 39787

SEQ ID NO: 434508 - RNA, 64 nt, hsa; identical to SEQ ID NO: 39788

SEQ ID NO: 434509 - RNA, 64 nt, hsa; identical to SEQ ID NO: 39789

SEQ ID NO: 434510 - RNA, 64 nt, hsa; identical to SEQ ID NO: 39790

SEQ ID NO: 434511 - RNA, 64 nt, hsa; identical to SEQ ID NO: 39791

SEQ ID NO: 434512 - RNA, 64 nt, hsa; identical to SEQ ID NO: 39792

SEQ ID NO: 434513 - RNA, 64 nt, hsa; identical to SEQ ID NO: 39793

SEQ ID NO: 434514 - RNA, 64 nt, hsa; identical to SEQ ID NO: 39794

SEQ ID NO: 434515 - RNA, 64 nt, hsa; identical to SEQ ID NO: 39795

SEQ ID NO: 434516 - RNA, 64 nt, hsa; identical to SEQ ID NO: 39796

SEQ ID NO: 434517 - RNA, 64 nt, hsa; identical to SEQ ID NO: 39797

SEQ ID NO: 434518 - RNA, 64 nt, hsa; identical to SEQ ID NO: 39798

SEQ ID NO: 434519 - RNA, 64 nt, hsa; identical to SEQ ID NO: 39799

SEQ ID NO: 434520 - RNA, 64 nt, hsa; identical to SEQ ID NO: 39800

SEQ ID NO: 434521 - RNA, 64 nt, hsa; identical to SEQ ID NO: 39801

SEQ ID NO: 434522 - RNA, 64 nt, hsa; identical to SEQ ID NO: 39802

SEQ ID NO: 434523 - RNA, 64 nt, hsa; identical to SEQ ID NO: 39803

SEQ ID NO: 434524 - RNA, 64 nt, hsa; identical to SEQ ID NO: 39804

SEQ ID NO: 434525 - RNA, 64 nt, hsa; identical to SEQ ID NO: 39805

SEQ ID NO: 434526 - RNA, 64 nt, hsa; identical to SEQ ID NO: 39806

SEQ ID NO: 434527 - RNA, 64 nt, hsa; identical to SEQ ID NO: 39807

SEQ ID NO: 434528 - RNA, 64 nt, hsa; identical to SEQ ID NO: 39808

SEQ ID NO: 434529 - RNA, 64 nt, hsa; identical to SEQ ID NO: 39809

SEQ ID NO: 434530 - RNA, 64 nt, hsa; identical to SEQ ID NO: 39810

SEQ ID NO: 434531 - RNA, 64 nt, hsa; identical to SEQ ID NO: 39811

SEQ ID NO: 434532 - RNA, 64 nt, hsa; identical to SEQ ID NO: 39812

SEQ ID NO: 434533 - RNA, 64 nt, hsa; identical to SEQ ID NO: 39813

SEQ ID NO: 434534 - RNA, 64 nt, hsa; identical to SEQ ID NO: 39814

SEQ ID NO: 434535 - RNA, 64 nt, hsa; identical to SEQ ID NO: 39815

SEQ ID NO: 434536 - RNA, 64 nt, hsa; identical to SEQ ID NO: 39816

SEQ ID NO: 434537 - RNA, 64 nt, hsa; identical to SEQ ID NO: 39817

SEQ ID NO: 434538 - RNA, 64 nt, hsa; identical to SEQ ID NO: 39818

SEQ ID NO: 434539 - RNA, 64 nt, hsa; identical to SEQ ID NO: 39819

SEQ ID NO: 434540 - RNA, 64 nt, hsa; identical to SEQ ID NO: 39820

SEQ ID NO: 434541 - RNA, 64 nt, hsa; identical to SEQ ID NO: 39821

SEQ ID NO: 434542 - RNA, 64 nt, hsa; identical to SEQ ID NO: 39822

SEQ ID NO: 434543 - RNA, 64 nt, hsa; identical to SEQ ID NO: 39823

SEQ ID NO: 434544 - RNA, 64 nt, hsa; identical to SEQ ID NO: 39824

SEQ ID NO: 434545 - RNA, 64 nt, hsa; identical to SEQ ID NO: 39825

SEQ ID NO: 434546 - RNA, 64 nt, hsa; identical to SEQ ID NO: 39826

SEQ ID NO: 434547 - RNA, 64 nt, hsa; identical to SEQ ID NO: 39827

SEQ ID NO: 434548 - RNA, 64 nt, hsa; identical to SEQ ID NO: 39828

SEQ ID NO: 434549 - RNA, 64 nt, hsa; identical to SEQ ID NO: 39829

SEQ ID NO: 434550 - RNA, 64 nt, hsa; identical to SEQ ID NO: 39830

SEQ ID NO: 434551 - RNA, 64 nt, hsa; identical to SEQ ID NO: 39831

SEQ ID NO: 434552 - RNA, 64 nt, hsa; identical to SEQ ID NO: 39832

SEQ ID NO: 434553 - RNA, 64 nt, hsa; identical to SEQ ID NO: 39833

SEQ ID NO: 434554 - RNA, 64 nt, hsa; identical to SEQ ID NO: 39834

SEQ ID NO: 434555 - RNA, 64 nt, hsa; identical to SEQ ID NO: 39835

SEQ ID NO: 434556 - RNA, 64 nt, hsa; identical to SEQ ID NO: 39836

SEQ ID NO: 434557 - RNA, 64 nt, hsa; identical to SEQ ID NO: 39837

SEQ ID NO: 434558 - RNA, 64 nt, hsa; identical to SEQ ID NO: 39838

SEQ ID NO: 434559 - RNA, 64 nt, hsa; identical to SEQ ID NO: 39839

SEQ ID NO: 434560 - RNA, 64 nt, hsa; identical to SEQ ID NO: 39840

SEQ ID NO: 434561 - RNA, 64 nt, hsa; identical to SEQ ID NO: 39841

SEQ ID NO: 434562 - RNA, 64 nt, hsa; identical to SEQ ID NO: 39842

SEQ ID NO: 434563 - RNA, 64 nt, hsa; identical to SEQ ID NO: 39843

SEQ ID NO: 434564 - RNA, 64 nt, hsa; identical to SEQ ID NO: 39844

SEQ ID NO: 434565 - RNA, 64 nt, hsa; identical to SEQ ID NO: 39845

SEQ ID NO: 434566 - RNA, 64 nt, hsa; identical to SEQ ID NO: 39846

SEQ ID NO: 434567 - RNA, 64 nt, hsa; identical to SEQ ID NO: 39847

SEQ ID NO: 434568 - RNA, 64 nt, hsa; identical to SEQ ID NO: 39848

SEQ ID NO: 434569 - RNA, 64 nt, hsa; identical to SEQ ID NO: 39849

SEQ ID NO: 434570 - RNA, 64 nt, hsa; identical to SEQ ID NO: 39850

SEQ ID NO: 434571 - RNA, 64 nt, hsa; identical to SEQ ID NO: 39851

SEQ ID NO: 434572 - RNA, 64 nt, hsa; identical to SEQ ID NO: 39852

SEQ ID NO: 434573 - RNA, 64 nt, hsa; identical to SEQ ID NO: 39853

SEQ ID NO: 434574 - RNA, 64 nt, hsa; identical to SEQ ID NO: 39854

SEQ ID NO: 434575 - RNA, 64 nt, hsa; identical to SEQ ID NO: 39855

SEQ ID NO: 434576 - RNA, 64 nt, hsa; identical to SEQ ID NO: 39856

SEQ ID NO: 434577 - RNA, 64 nt, hsa; identical to SEQ ID NO: 39857

SEQ ID NO: 434578 - RNA, 64 nt, hsa; identical to SEQ ID NO: 39858

SEQ ID NO: 434579 - RNA, 64 nt, hsa; identical to SEQ ID NO: 39859

SEQ ID NO: 434580 - RNA, 64 nt, hsa; identical to SEQ ID NO: 39860

SEQ ID NO: 434581 - RNA, 64 nt, hsa; identical to SEQ ID NO: 39861

SEQ ID NO: 434582 - RNA, 64 nt, hsa; identical to SEQ ID NO: 39862

SEQ ID NO: 434583 - RNA, 64 nt, hsa; identical to SEQ ID NO: 39863

SEQ ID NO: 434584 - RNA, 64 nt, hsa; identical to SEQ ID NO: 39864

SEQ ID NO: 434585 - RNA, 64 nt, hsa; identical to SEQ ID NO: 39865

SEQ ID NO: 434586 - RNA, 64 nt, hsa; identical to SEQ ID NO: 39866

SEQ ID NO: 434587 - RNA, 64 nt, hsa; identical to SEQ ID NO: 39867

SEQ ID NO: 434588 - RNA, 64 nt, hsa; identical to SEQ ID NO: 39868

SEQ ID NO: 434589 - RNA, 64 nt, hsa; identical to SEQ ID NO: 39869

SEQ ID NO: 434590 - RNA, 64 nt, hsa; identical to SEQ ID NO: 39870

SEQ ID NO: 434591 - RNA, 64 nt, hsa; identical to SEQ ID NO: 39871

SEQ ID NO: 434592 - RNA, 64 nt, hsa; identical to SEQ ID NO: 39872

SEQ ID NO: 434593 - RNA, 64 nt, hsa; identical to SEQ ID NO: 39873

SEQ ID NO: 434594 - RNA, 64 nt, hsa; identical to SEQ ID NO: 39874

SEQ ID NO: 434595 - RNA, 64 nt, hsa; identical to SEQ ID NO: 39875

SEQ ID NO: 434596 - RNA, 64 nt, hsa; identical to SEQ ID NO: 39876

SEQ ID NO: 434597 - RNA, 64 nt, hsa; identical to SEQ ID NO: 39877

SEQ ID NO: 434598 - RNA, 64 nt, hsa; identical to SEQ ID NO: 39878

SEQ ID NO: 434599 - RNA, 64 nt, hsa; identical to SEQ ID NO: 39879

SEQ ID NO: 434600 - RNA, 64 nt, hsa; identical to SEQ ID NO: 39880

SEQ ID NO: 434601 - RNA, 64 nt, hsa; identical to SEQ ID NO: 39881

SEQ ID NO: 434602 - RNA, 64 nt, hsa; identical to SEQ ID NO: 39882

SEQ ID NO: 434603 - RNA, 64 nt, hsa; identical to SEQ ID NO: 39883

SEQ ID NO: 434604 - RNA, 64 nt, hsa; identical to SEQ ID NO: 39884

SEQ ID NO: 434605 - RNA, 64 nt, hsa; identical to SEQ ID NO: 39885

SEQ ID NO: 434606 - RNA, 64 nt, hsa; identical to SEQ ID NO: 39886

SEQ ID NO: 434607 - RNA, 64 nt, hsa; identical to SEQ ID NO: 39887

SEQ ID NO: 434608 - RNA, 64 nt, hsa; identical to SEQ ID NO: 39888

SEQ ID NO: 434609 - RNA, 64 nt, hsa; identical to SEQ ID NO: 39889

SEQ ID NO: 434610 - RNA, 64 nt, hsa; identical to SEQ ID NO: 39890

SEQ ID NO: 434611 - RNA, 64 nt, hsa; identical to SEQ ID NO: 39891

SEQ ID NO: 434612 - RNA, 64 nt, hsa; identical to SEQ ID NO: 39892

SEQ ID NO: 434613 - RNA, 64 nt, hsa; identical to SEQ ID NO: 39893

SEQ ID NO: 434614 - RNA, 64 nt, hsa; identical to SEQ ID NO: 39894

SEQ ID NO: 434615 - RNA, 64 nt, hsa; identical to SEQ ID NO: 39895

SEQ ID NO: 434616 - RNA, 64 nt, hsa; identical to SEQ ID NO: 39896

SEQ ID NO: 434617 - RNA, 64 nt, hsa; identical to SEQ ID NO: 39897

SEQ ID NO: 434618 - RNA, 64 nt, hsa; identical to SEQ ID NO: 39898

SEQ ID NO: 434619 - RNA, 64 nt, hsa; identical to SEQ ID NO: 39899

SEQ ID NO: 434620 - RNA, 64 nt, hsa; identical to SEQ ID NO: 39900

SEQ ID NO: 434621 - RNA, 64 nt, hsa; identical to SEQ ID NO: 39901

SEQ ID NO: 434622 - RNA, 64 nt, hsa; identical to SEQ ID NO: 39902

SEQ ID NO: 434623 - RNA, 64 nt, hsa; identical to SEQ ID NO: 39903

SEQ ID NO: 434624 - RNA, 64 nt, hsa; identical to SEQ ID NO: 39904

SEQ ID NO: 434625 - RNA, 64 nt, hsa; identical to SEQ ID NO: 39905

SEQ ID NO: 434626 - RNA, 64 nt, hsa; identical to SEQ ID NO: 39906

SEQ ID NO: 434627 - RNA, 64 nt, hsa; identical to SEQ ID NO: 39907

SEQ ID NO: 434628 - RNA, 64 nt, hsa; identical to SEQ ID NO: 39908

SEQ ID NO: 434629 - RNA, 64 nt, hsa; identical to SEQ ID NO: 39909

SEQ ID NO: 434630 - RNA, 64 nt, hsa; identical to SEQ ID NO: 39910

SEQ ID NO: 434631 - RNA, 64 nt, hsa; identical to SEQ ID NO: 39911

SEQ ID NO: 434632 - RNA, 64 nt, hsa; identical to SEQ ID NO: 39912

SEQ ID NO: 434633 - RNA, 64 nt, hsa; identical to SEQ ID NO: 39913

SEQ ID NO: 434634 - RNA, 64 nt, hsa; identical to SEQ ID NO: 39914

SEQ ID NO: 434635 - RNA, 64 nt, hsa; identical to SEQ ID NO: 39915

SEQ ID NO: 434636 - RNA, 64 nt, hsa; identical to SEQ ID NO: 39916

SEQ ID NO: 434637 - RNA, 64 nt, hsa; identical to SEQ ID NO: 39917

SEQ ID NO: 434638 - RNA, 64 nt, hsa; identical to SEQ ID NO: 39918

SEQ ID NO: 434639 - RNA, 64 nt, hsa; identical to SEQ ID NO: 39919

SEQ ID NO: 434640 - RNA, 64 nt, hsa; identical to SEQ ID NO: 39920

SEQ ID NO: 434641 - RNA, 64 nt, hsa; identical to SEQ ID NO: 39921

SEQ ID NO: 434642 - RNA, 64 nt, hsa; identical to SEQ ID NO: 39922

SEQ ID NO: 434643 - RNA, 64 nt, hsa; identical to SEQ ID NO: 39923

SEQ ID NO: 434644 - RNA, 64 nt, hsa; identical to SEQ ID NO: 39924

SEQ ID NO: 434645 - RNA, 64 nt, hsa; identical to SEQ ID NO: 39925

SEQ ID NO: 434646 - RNA, 64 nt, hsa; identical to SEQ ID NO: 39926

SEQ ID NO: 434647 - RNA, 64 nt, hsa; identical to SEQ ID NO: 39927

SEQ ID NO: 434648 - RNA, 64 nt, hsa; identical to SEQ ID NO: 39928

SEQ ID NO: 434649 - RNA, 64 nt, hsa; identical to SEQ ID NO: 39929

SEQ ID NO: 434650 - RNA, 64 nt, hsa; identical to SEQ ID NO: 39930

SEQ ID NO: 434651 - RNA, 64 nt, hsa; identical to SEQ ID NO: 39931

SEQ ID NO: 434652 - RNA, 64 nt, hsa; identical to SEQ ID NO: 39932

SEQ ID NO: 434653 - RNA, 64 nt, hsa; identical to SEQ ID NO: 39933

SEQ ID NO: 434654 - RNA, 64 nt, hsa; identical to SEQ ID NO: 39934

SEQ ID NO: 434655 - RNA, 64 nt, hsa; identical to SEQ ID NO: 39935

SEQ ID NO: 434656 - RNA, 64 nt, hsa; identical to SEQ ID NO: 39936

SEQ ID NO: 434657 - RNA, 64 nt, hsa; identical to SEQ ID NO: 39937

SEQ ID NO: 434658 - RNA, 64 nt, hsa; identical to SEQ ID NO: 39938

SEQ ID NO: 434659 - RNA, 64 nt, hsa; identical to SEQ ID NO: 39939

SEQ ID NO: 434660 - RNA, 64 nt, hsa; identical to SEQ ID NO: 39940

SEQ ID NO: 434661 - RNA, 64 nt, hsa; identical to SEQ ID NO: 39941

SEQ ID NO: 434662 - RNA, 64 nt, hsa; identical to SEQ ID NO: 39942

SEQ ID NO: 434663 - RNA, 64 nt, hsa; identical to SEQ ID NO: 39943

SEQ ID NO: 434664 - RNA, 64 nt, hsa; identical to SEQ ID NO: 39944

SEQ ID NO: 434665 - RNA, 64 nt, hsa; identical to SEQ ID NO: 39945

SEQ ID NO: 434666 - RNA, 64 nt, hsa; identical to SEQ ID NO: 39946

SEQ ID NO: 434667 - RNA, 64 nt, hsa; identical to SEQ ID NO: 39947

SEQ ID NO: 434668 - RNA, 64 nt, hsa; identical to SEQ ID NO: 39948

SEQ ID NO: 434669 - RNA, 64 nt, hsa; identical to SEQ ID NO: 39949

SEQ ID NO: 434670 - RNA, 64 nt, hsa; identical to SEQ ID NO: 39950

SEQ ID NO: 434671 - RNA, 64 nt, hsa; identical to SEQ ID NO: 39951

SEQ ID NO: 434672 - RNA, 64 nt, hsa; identical to SEQ ID NO: 39952

SEQ ID NO: 434673 - RNA, 64 nt, hsa; identical to SEQ ID NO: 39953

SEQ ID NO: 434674 - RNA, 64 nt, hsa; identical to SEQ ID NO: 39954

SEQ ID NO: 434675 - RNA, 64 nt, hsa; identical to SEQ ID NO: 39955

SEQ ID NO: 434676 - RNA, 64 nt, hsa; identical to SEQ ID NO: 39956

SEQ ID NO: 434677 - RNA, 64 nt, hsa; identical to SEQ ID NO: 39957

SEQ ID NO: 434678 - RNA, 64 nt, hsa; identical to SEQ ID NO: 39958

SEQ ID NO: 434679 - RNA, 64 nt, hsa; identical to SEQ ID NO: 39959

SEQ ID NO: 434680 - RNA, 64 nt, hsa; identical to SEQ ID NO: 39960

SEQ ID NO: 434681 - RNA, 64 nt, hsa; identical to SEQ ID NO: 39961

SEQ ID NO: 434682 - RNA, 64 nt, hsa; identical to SEQ ID NO: 39962

SEQ ID NO: 434683 - RNA, 64 nt, hsa; identical to SEQ ID NO: 39963

SEQ ID NO: 434684 - RNA, 64 nt, hsa; identical to SEQ ID NO: 39964

SEQ ID NO: 434685 - RNA, 64 nt, hsa; identical to SEQ ID NO: 39965

SEQ ID NO: 434686 - RNA, 64 nt, hsa; identical to SEQ ID NO: 39966

SEQ ID NO: 434687 - RNA, 64 nt, hsa; identical to SEQ ID NO: 39967

SEQ ID NO: 434688 - RNA, 64 nt, hsa; identical to SEQ ID NO: 39968

SEQ ID NO: 434689 - RNA, 64 nt, hsa; identical to SEQ ID NO: 39969

SEQ ID NO: 434690 - RNA, 64 nt, hsa; identical to SEQ ID NO: 39970

SEQ ID NO: 434691 - RNA, 64 nt, hsa; identical to SEQ ID NO: 39971

SEQ ID NO: 434692 - RNA, 64 nt, hsa; identical to SEQ ID NO: 39972

SEQ ID NO: 434693 - RNA, 64 nt, hsa; identical to SEQ ID NO: 39973

SEQ ID NO: 434694 - RNA, 64 nt, hsa; identical to SEQ ID NO: 39974

SEQ ID NO: 434695 - RNA, 64 nt, hsa; identical to SEQ ID NO: 39975

SEQ ID NO: 434696 - RNA, 64 nt, hsa; identical to SEQ ID NO: 39976

SEQ ID NO: 434697 - RNA, 64 nt, hsa; identical to SEQ ID NO: 39977

SEQ ID NO: 434698 - RNA, 64 nt, hsa; identical to SEQ ID NO: 39978

SEQ ID NO: 434699 - RNA, 64 nt, hsa; identical to SEQ ID NO: 39979

SEQ ID NO: 434700 - RNA, 64 nt, hsa; identical to SEQ ID NO: 39980

SEQ ID NO: 434701 - RNA, 64 nt, hsa; identical to SEQ ID NO: 39981

SEQ ID NO: 434702 - RNA, 64 nt, hsa; identical to SEQ ID NO: 39982

SEQ ID NO: 434703 - RNA, 64 nt, hsa; identical to SEQ ID NO: 39983

SEQ ID NO: 434704 - RNA, 64 nt, hsa; identical to SEQ ID NO: 39984

SEQ ID NO: 434705 - RNA, 64 nt, hsa; identical to SEQ ID NO: 39985

SEQ ID NO: 434706 - RNA, 64 nt, hsa; identical to SEQ ID NO: 39986

SEQ ID NO: 434707 - RNA, 64 nt, hsa; identical to SEQ ID NO: 39987

SEQ ID NO: 434708 - RNA, 64 nt, hsa; identical to SEQ ID NO: 39988

SEQ ID NO: 434709 - RNA, 64 nt, hsa; identical to SEQ ID NO: 39989

SEQ ID NO: 434710 - RNA, 64 nt, hsa; identical to SEQ ID NO: 39990

SEQ ID NO: 434711 - RNA, 64 nt, hsa; identical to SEQ ID NO: 39991

SEQ ID NO: 434712 - RNA, 64 nt, hsa; identical to SEQ ID NO: 39992

SEQ ID NO: 434713 - RNA, 64 nt, hsa; identical to SEQ ID NO: 39993

SEQ ID NO: 434714 - RNA, 64 nt, hsa; identical to SEQ ID NO: 39994

SEQ ID NO: 434715 - RNA, 64 nt, hsa; identical to SEQ ID NO: 39995

SEQ ID NO: 434716 - RNA, 64 nt, hsa; identical to SEQ ID NO: 39996

SEQ ID NO: 434717 - RNA, 64 nt, hsa; identical to SEQ ID NO: 39997

SEQ ID NO: 434718 - RNA, 64 nt, hsa; identical to SEQ ID NO: 39998

SEQ ID NO: 434719 - RNA, 64 nt, hsa; identical to SEQ ID NO: 39999

SEQ ID NO: 434720 - RNA, 64 nt, hsa; identical to SEQ ID NO: 40000

SEQ ID NO: 434721 - RNA, 64 nt, hsa; identical to SEQ ID NO: 40001

SEQ ID NO: 434722 - RNA, 64 nt, hsa; identical to SEQ ID NO: 40002

SEQ ID NO: 434723 - RNA, 64 nt, hsa; identical to SEQ ID NO: 40003

SEQ ID NO: 434724 - RNA, 64 nt, hsa; identical to SEQ ID NO: 40004

SEQ ID NO: 434725 - RNA, 64 nt, hsa; identical to SEQ ID NO: 40005

SEQ ID NO: 434726 - RNA, 64 nt, hsa; identical to SEQ ID NO: 40006

SEQ ID NO: 434727 - RNA, 64 nt, hsa; identical to SEQ ID NO: 40007

SEQ ID NO: 434728 - RNA, 64 nt, hsa; identical to SEQ ID NO: 40008

SEQ ID NO: 434729 - RNA, 64 nt, hsa; identical to SEQ ID NO: 40009

SEQ ID NO: 434730 - RNA, 64 nt, hsa; identical to SEQ ID NO: 40010

SEQ ID NO: 434731 - RNA, 64 nt, hsa; identical to SEQ ID NO: 40011

SEQ ID NO: 434732 - RNA, 64 nt, hsa; identical to SEQ ID NO: 40012

SEQ ID NO: 434733 - RNA, 64 nt, hsa; identical to SEQ ID NO: 40013

SEQ ID NO: 434734 - RNA, 64 nt, hsa; identical to SEQ ID NO: 40014

SEQ ID NO: 434735 - RNA, 64 nt, hsa; identical to SEQ ID NO: 40015

SEQ ID NO: 434736 - RNA, 64 nt, hsa; identical to SEQ ID NO: 40016

SEQ ID NO: 434737 - RNA, 64 nt, hsa; identical to SEQ ID NO: 40017

SEQ ID NO: 434738 - RNA, 64 nt, hsa; identical to SEQ ID NO: 40018

SEQ ID NO: 434739 - RNA, 64 nt, hsa; identical to SEQ ID NO: 40019

SEQ ID NO: 434740 - RNA, 64 nt, hsa; identical to SEQ ID NO: 40020

SEQ ID NO: 434741 - RNA, 64 nt, hsa; identical to SEQ ID NO: 40021

SEQ ID NO: 434742 - RNA, 64 nt, hsa; identical to SEQ ID NO: 40022

SEQ ID NO: 434743 - RNA, 64 nt, hsa; identical to SEQ ID NO: 40023

SEQ ID NO: 434744 - RNA, 64 nt, hsa; identical to SEQ ID NO: 40024

SEQ ID NO: 434745 - RNA, 64 nt, hsa; identical to SEQ ID NO: 40025

SEQ ID NO: 434746 - RNA, 64 nt, hsa; identical to SEQ ID NO: 40026

SEQ ID NO: 434747 - RNA, 64 nt, hsa; identical to SEQ ID NO: 40027

SEQ ID NO: 434748 - RNA, 64 nt, hsa; identical to SEQ ID NO: 40028

SEQ ID NO: 434749 - RNA, 64 nt, hsa; identical to SEQ ID NO: 40029

SEQ ID NO: 434750 - RNA, 64 nt, hsa; identical to SEQ ID NO: 40030

SEQ ID NO: 434751 - RNA, 64 nt, hsa; identical to SEQ ID NO: 40031

SEQ ID NO: 434752 - RNA, 64 nt, hsa; identical to SEQ ID NO: 40032

SEQ ID NO: 434753 - RNA, 64 nt, hsa; identical to SEQ ID NO: 40033

SEQ ID NO: 434754 - RNA, 64 nt, hsa; identical to SEQ ID NO: 40034

SEQ ID NO: 434755 - RNA, 64 nt, hsa; identical to SEQ ID NO: 40035

SEQ ID NO: 434756 - RNA, 64 nt, hsa; identical to SEQ ID NO: 40036

SEQ ID NO: 434757 - RNA, 64 nt, hsa; identical to SEQ ID NO: 40037

SEQ ID NO: 434758 - RNA, 64 nt, hsa; identical to SEQ ID NO: 40038

SEQ ID NO: 434759 - RNA, 64 nt, hsa; identical to SEQ ID NO: 40039

SEQ ID NO: 434760 - RNA, 64 nt, hsa; identical to SEQ ID NO: 40040

SEQ ID NO: 434761 - RNA, 64 nt, hsa; identical to SEQ ID NO: 40041

SEQ ID NO: 434762 - RNA, 64 nt, hsa; identical to SEQ ID NO: 40042

SEQ ID NO: 434763 - RNA, 64 nt, hsa; identical to SEQ ID NO: 40043

SEQ ID NO: 434764 - RNA, 64 nt, hsa; identical to SEQ ID NO: 40044

SEQ ID NO: 434765 - RNA, 64 nt, hsa; identical to SEQ ID NO: 40045

SEQ ID NO: 434766 - RNA, 64 nt, hsa; identical to SEQ ID NO: 40046

SEQ ID NO: 434767 - RNA, 64 nt, hsa; identical to SEQ ID NO: 40047

SEQ ID NO: 434768 - RNA, 64 nt, hsa; identical to SEQ ID NO: 40048

SEQ ID NO: 434769 - RNA, 64 nt, hsa; identical to SEQ ID NO: 40049

SEQ ID NO: 434770 - RNA, 64 nt, hsa; identical to SEQ ID NO: 40050

SEQ ID NO: 434771 - RNA, 64 nt, hsa; identical to SEQ ID NO: 40051

SEQ ID NO: 434772 - RNA, 64 nt, hsa; identical to SEQ ID NO: 40052

SEQ ID NO: 434773 - RNA, 64 nt, hsa; identical to SEQ ID NO: 40053

SEQ ID NO: 434774 - RNA, 64 nt, hsa; identical to SEQ ID NO: 40054

SEQ ID NO: 434775 - RNA, 64 nt, hsa; identical to SEQ ID NO: 40055

SEQ ID NO: 434776 - RNA, 64 nt, hsa; identical to SEQ ID NO: 40056

SEQ ID NO: 434777 - RNA, 64 nt, hsa; identical to SEQ ID NO: 40057

SEQ ID NO: 434778 - RNA, 64 nt, hsa; identical to SEQ ID NO: 40058

SEQ ID NO: 434779 - RNA, 64 nt, hsa; identical to SEQ ID NO: 40059

SEQ ID NO: 434780 - RNA, 64 nt, hsa; identical to SEQ ID NO: 40060

SEQ ID NO: 434781 - RNA, 64 nt, hsa; identical to SEQ ID NO: 40061

SEQ ID NO: 434782 - RNA, 64 nt, hsa; identical to SEQ ID NO: 40062

SEQ ID NO: 434783 - RNA, 64 nt, hsa; identical to SEQ ID NO: 40063

SEQ ID NO: 434784 - RNA, 64 nt, hsa; identical to SEQ ID NO: 40064

SEQ ID NO: 434785 - RNA, 64 nt, hsa; identical to SEQ ID NO: 40065

SEQ ID NO: 434786 - RNA, 64 nt, hsa; identical to SEQ ID NO: 40066

SEQ ID NO: 434787 - RNA, 64 nt, hsa; identical to SEQ ID NO: 40067

SEQ ID NO: 434788 - RNA, 64 nt, hsa; identical to SEQ ID NO: 40068

SEQ ID NO: 434789 - RNA, 64 nt, hsa; identical to SEQ ID NO: 40069

SEQ ID NO: 434790 - RNA, 64 nt, hsa; identical to SEQ ID NO: 40070

SEQ ID NO: 434791 - RNA, 64 nt, hsa; identical to SEQ ID NO: 40071

SEQ ID NO: 434792 - RNA, 64 nt, hsa; identical to SEQ ID NO: 40072

SEQ ID NO: 434793 - RNA, 64 nt, hsa; identical to SEQ ID NO: 40073

SEQ ID NO: 434794 - RNA, 64 nt, hsa; identical to SEQ ID NO: 40074

SEQ ID NO: 434795 - RNA, 64 nt, hsa; identical to SEQ ID NO: 40075

SEQ ID NO: 434796 - RNA, 64 nt, hsa; identical to SEQ ID NO: 40076

SEQ ID NO: 434797 - RNA, 64 nt, hsa; identical to SEQ ID NO: 40077

SEQ ID NO: 434798 - RNA, 64 nt, hsa; identical to SEQ ID NO: 40078

SEQ ID NO: 434799 - RNA, 64 nt, hsa; identical to SEQ ID NO: 40079

SEQ ID NO: 434800 - RNA, 64 nt, hsa; identical to SEQ ID NO: 40080

SEQ ID NO: 434801 - RNA, 64 nt, hsa; identical to SEQ ID NO: 40081

SEQ ID NO: 434802 - RNA, 64 nt, hsa; identical to SEQ ID NO: 40082

SEQ ID NO: 434803 - RNA, 64 nt, hsa; identical to SEQ ID NO: 40083

SEQ ID NO: 434804 - RNA, 64 nt, hsa; identical to SEQ ID NO: 40084

SEQ ID NO: 434805 - RNA, 64 nt, hsa; identical to SEQ ID NO: 40085

SEQ ID NO: 434806 - RNA, 64 nt, hsa; identical to SEQ ID NO: 40086

SEQ ID NO: 434807 - RNA, 64 nt, hsa; identical to SEQ ID NO: 40087

SEQ ID NO: 434808 - RNA, 64 nt, hsa; identical to SEQ ID NO: 40088

SEQ ID NO: 434809 - RNA, 64 nt, hsa; identical to SEQ ID NO: 40089

SEQ ID NO: 434810 - RNA, 64 nt, hsa; identical to SEQ ID NO: 40090

SEQ ID NO: 434811 - RNA, 64 nt, hsa; identical to SEQ ID NO: 40091

SEQ ID NO: 434812 - RNA, 64 nt, hsa; identical to SEQ ID NO: 40092

SEQ ID NO: 434813 - RNA, 64 nt, hsa; identical to SEQ ID NO: 40093

SEQ ID NO: 434814 - RNA, 64 nt, hsa; identical to SEQ ID NO: 40094

SEQ ID NO: 434815 - RNA, 64 nt, hsa; identical to SEQ ID NO: 40095

SEQ ID NO: 434816 - RNA, 64 nt, hsa; identical to SEQ ID NO: 40096

SEQ ID NO: 434817 - RNA, 64 nt, hsa; identical to SEQ ID NO: 40097

SEQ ID NO: 434818 - RNA, 64 nt, hsa; identical to SEQ ID NO: 40098

SEQ ID NO: 434819 - RNA, 64 nt, hsa; identical to SEQ ID NO: 40099

SEQ ID NO: 434820 - RNA, 64 nt, hsa; identical to SEQ ID NO: 40100

SEQ ID NO: 434821 - RNA, 64 nt, hsa; identical to SEQ ID NO: 40101

SEQ ID NO: 434822 - RNA, 64 nt, hsa; identical to SEQ ID NO: 40102

SEQ ID NO: 434823 - RNA, 64 nt, hsa; identical to SEQ ID NO: 40103

SEQ ID NO: 434824 - RNA, 64 nt, hsa; identical to SEQ ID NO: 40104

SEQ ID NO: 434825 - RNA, 64 nt, hsa; identical to SEQ ID NO: 40105

SEQ ID NO: 434826 - RNA, 64 nt, hsa; identical to SEQ ID NO: 40106

SEQ ID NO: 434827 - RNA, 64 nt, hsa; identical to SEQ ID NO: 40107

SEQ ID NO: 434828 - RNA, 64 nt, hsa; identical to SEQ ID NO: 40108

SEQ ID NO: 434829 - RNA, 64 nt, hsa; identical to SEQ ID NO: 40109

SEQ ID NO: 434830 - RNA, 64 nt, hsa; identical to SEQ ID NO: 40110

SEQ ID NO: 434831 - RNA, 64 nt, hsa; identical to SEQ ID NO: 40111

SEQ ID NO: 434832 - RNA, 64 nt, hsa; identical to SEQ ID NO: 40112

SEQ ID NO: 434833 - RNA, 64 nt, hsa; identical to SEQ ID NO: 40113

SEQ ID NO: 434834 - RNA, 64 nt, hsa; identical to SEQ ID NO: 40114

SEQ ID NO: 434835 - RNA, 64 nt, hsa; identical to SEQ ID NO: 40115

SEQ ID NO: 434836 - RNA, 64 nt, hsa; identical to SEQ ID NO: 40116

SEQ ID NO: 434837 - RNA, 64 nt, hsa; identical to SEQ ID NO: 40117

SEQ ID NO: 434838 - RNA, 64 nt, hsa; identical to SEQ ID NO: 40118

SEQ ID NO: 434839 - RNA, 64 nt, hsa; identical to SEQ ID NO: 40119

SEQ ID NO: 434840 - RNA, 64 nt, hsa; identical to SEQ ID NO: 40120

SEQ ID NO: 434841 - RNA, 64 nt, hsa; identical to SEQ ID NO: 40121

SEQ ID NO: 434842 - RNA, 64 nt, hsa; identical to SEQ ID NO: 40122

SEQ ID NO: 434843 - RNA, 64 nt, hsa; identical to SEQ ID NO: 40123

SEQ ID NO: 434844 - RNA, 64 nt, hsa; identical to SEQ ID NO: 40124

SEQ ID NO: 434845 - RNA, 64 nt, hsa; identical to SEQ ID NO: 40125

SEQ ID NO: 434846 - RNA, 64 nt, hsa; identical to SEQ ID NO: 40126

SEQ ID NO: 434847 - RNA, 64 nt, hsa; identical to SEQ ID NO: 40127

SEQ ID NO: 434848 - RNA, 64 nt, hsa; identical to SEQ ID NO: 40128

SEQ ID NO: 434849 - RNA, 64 nt, hsa; identical to SEQ ID NO: 40129

SEQ ID NO: 434850 - RNA, 64 nt, hsa; identical to SEQ ID NO: 40130

SEQ ID NO: 434851 - RNA, 64 nt, hsa; identical to SEQ ID NO: 40131

SEQ ID NO: 434852 - RNA, 64 nt, hsa; identical to SEQ ID NO: 40132

SEQ ID NO: 434853 - RNA, 64 nt, hsa; identical to SEQ ID NO: 40133

SEQ ID NO: 434854 - RNA, 64 nt, hsa; identical to SEQ ID NO: 40134

SEQ ID NO: 434855 - RNA, 64 nt, hsa; identical to SEQ ID NO: 40135

SEQ ID NO: 434856 - RNA, 64 nt, hsa; identical to SEQ ID NO: 40136

SEQ ID NO: 434857 - RNA, 64 nt, hsa; identical to SEQ ID NO: 40137

SEQ ID NO: 434858 - RNA, 64 nt, hsa; identical to SEQ ID NO: 40138

SEQ ID NO: 434859 - RNA, 64 nt, hsa; identical to SEQ ID NO: 40139

SEQ ID NO: 434860 - RNA, 64 nt, hsa; identical to SEQ ID NO: 40140

SEQ ID NO: 434861 - RNA, 64 nt, hsa; identical to SEQ ID NO: 40141

SEQ ID NO: 434862 - RNA, 64 nt, hsa; identical to SEQ ID NO: 40142

SEQ ID NO: 434863 - RNA, 64 nt, hsa; identical to SEQ ID NO: 40143

SEQ ID NO: 434864 - RNA, 64 nt, hsa; identical to SEQ ID NO: 40144

SEQ ID NO: 434865 - RNA, 64 nt, hsa; identical to SEQ ID NO: 40145

SEQ ID NO: 434866 - RNA, 64 nt, hsa; identical to SEQ ID NO: 40146

SEQ ID NO: 434867 - RNA, 64 nt, hsa; identical to SEQ ID NO: 40147

SEQ ID NO: 434868 - RNA, 64 nt, hsa; identical to SEQ ID NO: 40148

SEQ ID NO: 434869 - RNA, 64 nt, hsa; identical to SEQ ID NO: 40149

SEQ ID NO: 434870 - RNA, 64 nt, hsa; identical to SEQ ID NO: 40150

SEQ ID NO: 434871 - RNA, 64 nt, hsa; identical to SEQ ID NO: 40151

SEQ ID NO: 434872 - RNA, 64 nt, hsa; identical to SEQ ID NO: 40152

SEQ ID NO: 434873 - RNA, 64 nt, hsa; identical to SEQ ID NO: 40153

SEQ ID NO: 434874 - RNA, 64 nt, hsa; identical to SEQ ID NO: 40154

SEQ ID NO: 434875 - RNA, 64 nt, hsa; identical to SEQ ID NO: 40155

SEQ ID NO: 434876 - RNA, 64 nt, hsa; identical to SEQ ID NO: 40156

SEQ ID NO: 434877 - RNA, 64 nt, hsa; identical to SEQ ID NO: 40157

SEQ ID NO: 434878 - RNA, 64 nt, hsa; identical to SEQ ID NO: 40158

SEQ ID NO: 434879 - RNA, 64 nt, hsa; identical to SEQ ID NO: 40159

SEQ ID NO: 434880 - RNA, 64 nt, hsa; identical to SEQ ID NO: 40160

SEQ ID NO: 434881 - RNA, 64 nt, hsa; identical to SEQ ID NO: 40161

SEQ ID NO: 434882 - RNA, 64 nt, hsa; identical to SEQ ID NO: 40162

SEQ ID NO: 434883 - RNA, 64 nt, hsa; identical to SEQ ID NO: 40163

SEQ ID NO: 434884 - RNA, 64 nt, hsa; identical to SEQ ID NO: 40164

SEQ ID NO: 434885 - RNA, 64 nt, hsa; identical to SEQ ID NO: 40165

SEQ ID NO: 434886 - RNA, 64 nt, hsa; identical to SEQ ID NO: 40166

SEQ ID NO: 434887 - RNA, 64 nt, hsa; identical to SEQ ID NO: 40167

SEQ ID NO: 434888 - RNA, 64 nt, hsa; identical to SEQ ID NO: 40168

SEQ ID NO: 434889 - RNA, 64 nt, hsa; identical to SEQ ID NO: 40169

SEQ ID NO: 434890 - RNA, 64 nt, hsa; identical to SEQ ID NO: 40170

SEQ ID NO: 434891 - RNA, 64 nt, hsa; identical to SEQ ID NO: 40171

SEQ ID NO: 434892 - RNA, 64 nt, hsa; identical to SEQ ID NO: 40172

SEQ ID NO: 434893 - RNA, 64 nt, hsa; identical to SEQ ID NO: 40173

SEQ ID NO: 434894 - RNA, 64 nt, hsa; identical to SEQ ID NO: 40174

SEQ ID NO: 434895 - RNA, 64 nt, hsa; identical to SEQ ID NO: 40175

SEQ ID NO: 434896 - RNA, 64 nt, hsa; identical to SEQ ID NO: 40176

SEQ ID NO: 434897 - RNA, 64 nt, hsa; identical to SEQ ID NO: 40177

SEQ ID NO: 434898 - RNA, 64 nt, hsa; identical to SEQ ID NO: 40178

SEQ ID NO: 434899 - RNA, 64 nt, hsa; identical to SEQ ID NO: 40179

SEQ ID NO: 434900 - RNA, 64 nt, hsa; identical to SEQ ID NO: 40180

SEQ ID NO: 434901 - RNA, 64 nt, hsa; identical to SEQ ID NO: 40181

SEQ ID NO: 434902 - RNA, 64 nt, hsa; identical to SEQ ID NO: 40182

SEQ ID NO: 434903 - RNA, 64 nt, hsa; identical to SEQ ID NO: 40183

SEQ ID NO: 434904 - RNA, 64 nt, hsa; identical to SEQ ID NO: 40184

SEQ ID NO: 434905 - RNA, 64 nt, hsa; identical to SEQ ID NO: 40185

SEQ ID NO: 434906 - RNA, 64 nt, hsa; identical to SEQ ID NO: 40186

SEQ ID NO: 434907 - RNA, 64 nt, hsa; identical to SEQ ID NO: 40187

SEQ ID NO: 434908 - RNA, 64 nt, hsa; identical to SEQ ID NO: 40188

SEQ ID NO: 434909 - RNA, 64 nt, hsa; identical to SEQ ID NO: 40189

SEQ ID NO: 434910 - RNA, 64 nt, hsa; identical to SEQ ID NO: 40190

SEQ ID NO: 434911 - RNA, 64 nt, hsa; identical to SEQ ID NO: 40191

SEQ ID NO: 434912 - RNA, 64 nt, hsa; identical to SEQ ID NO: 40192

SEQ ID NO: 434913 - RNA, 64 nt, hsa; identical to SEQ ID NO: 40193

SEQ ID NO: 434914 - RNA, 64 nt, hsa; identical to SEQ ID NO: 40194

SEQ ID NO: 434915 - RNA, 64 nt, hsa; identical to SEQ ID NO: 40195

SEQ ID NO: 434916 - RNA, 64 nt, hsa; identical to SEQ ID NO: 40196

SEQ ID NO: 434917 - RNA, 64 nt, hsa; identical to SEQ ID NO: 40197

SEQ ID NO: 434918 - RNA, 64 nt, hsa; identical to SEQ ID NO: 40198

SEQ ID NO: 434919 - RNA, 64 nt, hsa; identical to SEQ ID NO: 40199

SEQ ID NO: 434920 - RNA, 64 nt, hsa; identical to SEQ ID NO: 40200

SEQ ID NO: 434921 - RNA, 64 nt, hsa; identical to SEQ ID NO: 40201

SEQ ID NO: 434922 - RNA, 64 nt, hsa; identical to SEQ ID NO: 40202

SEQ ID NO: 434923 - RNA, 64 nt, hsa; identical to SEQ ID NO: 40203

SEQ ID NO: 434924 - RNA, 64 nt, hsa; identical to SEQ ID NO: 40204

SEQ ID NO: 434925 - RNA, 64 nt, hsa; identical to SEQ ID NO: 40205

SEQ ID NO: 434926 - RNA, 64 nt, hsa; identical to SEQ ID NO: 40206

SEQ ID NO: 434927 - RNA, 64 nt, hsa; identical to SEQ ID NO: 40207

SEQ ID NO: 434928 - RNA, 64 nt, hsa; identical to SEQ ID NO: 40208

SEQ ID NO: 434929 - RNA, 64 nt, hsa; identical to SEQ ID NO: 40209

SEQ ID NO: 434930 - RNA, 64 nt, hsa; identical to SEQ ID NO: 40210

SEQ ID NO: 434931 - RNA, 64 nt, hsa; identical to SEQ ID NO: 40211

SEQ ID NO: 434932 - RNA, 64 nt, hsa; identical to SEQ ID NO: 40212

SEQ ID NO: 434933 - RNA, 64 nt, hsa; identical to SEQ ID NO: 40213

SEQ ID NO: 434934 - RNA, 64 nt, hsa; identical to SEQ ID NO: 40214

SEQ ID NO: 434935 - RNA, 64 nt, hsa; identical to SEQ ID NO: 40215

SEQ ID NO: 434936 - RNA, 64 nt, hsa; identical to SEQ ID NO: 40216

SEQ ID NO: 434937 - RNA, 64 nt, hsa; identical to SEQ ID NO: 40217

SEQ ID NO: 434938 - RNA, 64 nt, hsa; identical to SEQ ID NO: 40218

SEQ ID NO: 434939 - RNA, 64 nt, hsa; identical to SEQ ID NO: 40219

SEQ ID NO: 434940 - RNA, 64 nt, hsa; identical to SEQ ID NO: 40220

SEQ ID NO: 434941 - RNA, 64 nt, hsa; identical to SEQ ID NO: 40221

SEQ ID NO: 434942 - RNA, 64 nt, hsa; identical to SEQ ID NO: 40222

SEQ ID NO: 434943 - RNA, 64 nt, hsa; identical to SEQ ID NO: 40223

SEQ ID NO: 434944 - RNA, 64 nt, hsa; identical to SEQ ID NO: 40224

SEQ ID NO: 434945 - RNA, 64 nt, hsa; identical to SEQ ID NO: 40225

SEQ ID NO: 434946 - RNA, 64 nt, hsa; identical to SEQ ID NO: 40226

SEQ ID NO: 434947 - RNA, 64 nt, hsa; identical to SEQ ID NO: 40227

SEQ ID NO: 434948 - RNA, 64 nt, hsa; identical to SEQ ID NO: 40228

SEQ ID NO: 434949 - RNA, 64 nt, hsa; identical to SEQ ID NO: 40229

SEQ ID NO: 434950 - RNA, 64 nt, hsa; identical to SEQ ID NO: 40230

SEQ ID NO: 434951 - RNA, 64 nt, hsa; identical to SEQ ID NO: 40231

SEQ ID NO: 434952 - RNA, 64 nt, hsa; identical to SEQ ID NO: 40232

SEQ ID NO: 434953 - RNA, 64 nt, hsa; identical to SEQ ID NO: 40233

SEQ ID NO: 434954 - RNA, 64 nt, hsa; identical to SEQ ID NO: 40234

SEQ ID NO: 434955 - RNA, 64 nt, hsa; identical to SEQ ID NO: 40235

SEQ ID NO: 434956 - RNA, 64 nt, hsa; identical to SEQ ID NO: 40236

SEQ ID NO: 434957 - RNA, 64 nt, hsa; identical to SEQ ID NO: 40237

SEQ ID NO: 434958 - RNA, 64 nt, hsa; identical to SEQ ID NO: 40238

SEQ ID NO: 434959 - RNA, 64 nt, hsa; identical to SEQ ID NO: 40239

SEQ ID NO: 434960 - RNA, 64 nt, hsa; identical to SEQ ID NO: 40240

SEQ ID NO: 434961 - RNA, 64 nt, hsa; identical to SEQ ID NO: 40241

SEQ ID NO: 434962 - RNA, 64 nt, hsa; identical to SEQ ID NO: 40242

SEQ ID NO: 434963 - RNA, 64 nt, hsa; identical to SEQ ID NO: 40243

SEQ ID NO: 434964 - RNA, 64 nt, hsa; identical to SEQ ID NO: 40244

SEQ ID NO: 434965 - RNA, 64 nt, hsa; identical to SEQ ID NO: 40245

SEQ ID NO: 434966 - RNA, 64 nt, hsa; identical to SEQ ID NO: 40246

SEQ ID NO: 434967 - RNA, 64 nt, hsa; identical to SEQ ID NO: 40247

SEQ ID NO: 434968 - RNA, 64 nt, hsa; identical to SEQ ID NO: 40248

SEQ ID NO: 434969 - RNA, 64 nt, hsa; identical to SEQ ID NO: 40249

SEQ ID NO: 434970 - RNA, 64 nt, hsa; identical to SEQ ID NO: 40250

SEQ ID NO: 434971 - RNA, 64 nt, hsa; identical to SEQ ID NO: 40251

SEQ ID NO: 434972 - RNA, 64 nt, hsa; identical to SEQ ID NO: 40252

SEQ ID NO: 434973 - RNA, 64 nt, hsa; identical to SEQ ID NO: 40253

SEQ ID NO: 434974 - RNA, 64 nt, hsa; identical to SEQ ID NO: 40254

SEQ ID NO: 434975 - RNA, 64 nt, hsa; identical to SEQ ID NO: 40255

SEQ ID NO: 434976 - RNA, 64 nt, hsa; identical to SEQ ID NO: 40256

SEQ ID NO: 434977 - RNA, 64 nt, hsa; identical to SEQ ID NO: 40257

SEQ ID NO: 434978 - RNA, 64 nt, hsa; identical to SEQ ID NO: 40258

SEQ ID NO: 434979 - RNA, 64 nt, hsa; identical to SEQ ID NO: 40259

SEQ ID NO: 434980 - RNA, 64 nt, hsa; identical to SEQ ID NO: 40260

SEQ ID NO: 434981 - RNA, 64 nt, hsa; identical to SEQ ID NO: 40261

SEQ ID NO: 434982 - RNA, 64 nt, hsa; identical to SEQ ID NO: 40262

SEQ ID NO: 434983 - RNA, 64 nt, hsa; identical to SEQ ID NO: 40263

SEQ ID NO: 434984 - RNA, 64 nt, hsa; identical to SEQ ID NO: 40264

SEQ ID NO: 434985 - RNA, 64 nt, hsa; identical to SEQ ID NO: 40265

SEQ ID NO: 434986 - RNA, 64 nt, hsa; identical to SEQ ID NO: 40266

SEQ ID NO: 434987 - RNA, 64 nt, hsa; identical to SEQ ID NO: 40267

SEQ ID NO: 434988 - RNA, 64 nt, hsa; identical to SEQ ID NO: 40268

SEQ ID NO: 434989 - RNA, 64 nt, hsa; identical to SEQ ID NO: 40269

SEQ ID NO: 434990 - RNA, 64 nt, hsa; identical to SEQ ID NO: 40270

SEQ ID NO: 434991 - RNA, 64 nt, hsa; identical to SEQ ID NO: 40271

SEQ ID NO: 434992 - RNA, 64 nt, hsa; identical to SEQ ID NO: 40272

SEQ ID NO: 434993 - RNA, 64 nt, hsa; identical to SEQ ID NO: 40273

SEQ ID NO: 434994 - RNA, 64 nt, hsa; identical to SEQ ID NO: 40274

SEQ ID NO: 434995 - RNA, 64 nt, hsa; identical to SEQ ID NO: 40275

SEQ ID NO: 434996 - RNA, 64 nt, hsa; identical to SEQ ID NO: 40276

SEQ ID NO: 434997 - RNA, 64 nt, hsa; identical to SEQ ID NO: 40277

SEQ ID NO: 434998 - RNA, 64 nt, hsa; identical to SEQ ID NO: 40278

SEQ ID NO: 434999 - RNA, 64 nt, hsa; identical to SEQ ID NO: 40279

SEQ ID NO: 435000 - RNA, 64 nt, hsa; identical to SEQ ID NO: 40280

SEQ ID NO: 435001 - RNA, 64 nt, hsa; identical to SEQ ID NO: 40281

SEQ ID NO: 435002 - RNA, 64 nt, hsa; identical to SEQ ID NO: 40282

SEQ ID NO: 435003 - RNA, 64 nt, hsa; identical to SEQ ID NO: 40283

SEQ ID NO: 435004 - RNA, 64 nt, hsa; identical to SEQ ID NO: 40284

SEQ ID NO: 435005 - RNA, 64 nt, hsa; identical to SEQ ID NO: 40285

SEQ ID NO: 435006 - RNA, 64 nt, hsa; identical to SEQ ID NO: 40286

SEQ ID NO: 435007 - RNA, 64 nt, hsa; identical to SEQ ID NO: 40287

SEQ ID NO: 435008 - RNA, 64 nt, hsa; identical to SEQ ID NO: 40288

SEQ ID NO: 435009 - RNA, 64 nt, hsa; identical to SEQ ID NO: 40289

SEQ ID NO: 435010 - RNA, 64 nt, hsa; identical to SEQ ID NO: 40290

SEQ ID NO: 435011 - RNA, 64 nt, hsa; identical to SEQ ID NO: 40291

SEQ ID NO: 435012 - RNA, 64 nt, hsa; identical to SEQ ID NO: 40292

SEQ ID NO: 435013 - RNA, 64 nt, hsa; identical to SEQ ID NO: 40293

SEQ ID NO: 435014 - RNA, 64 nt, hsa; identical to SEQ ID NO: 40294

SEQ ID NO: 435015 - RNA, 64 nt, hsa; identical to SEQ ID NO: 40295

SEQ ID NO: 435016 - RNA, 64 nt, hsa; identical to SEQ ID NO: 40296

SEQ ID NO: 435017 - RNA, 64 nt, hsa; identical to SEQ ID NO: 40297

SEQ ID NO: 435018 - RNA, 64 nt, hsa; identical to SEQ ID NO: 40298

SEQ ID NO: 435019 - RNA, 64 nt, hsa; identical to SEQ ID NO: 40299

SEQ ID NO: 435020 - RNA, 64 nt, hsa; identical to SEQ ID NO: 40300

SEQ ID NO: 435021 - RNA, 64 nt, hsa; identical to SEQ ID NO: 40301

SEQ ID NO: 435022 - RNA, 64 nt, hsa; identical to SEQ ID NO: 40302

SEQ ID NO: 435023 - RNA, 64 nt, hsa; identical to SEQ ID NO: 40303

SEQ ID NO: 435024 - RNA, 64 nt, hsa; identical to SEQ ID NO: 40304

SEQ ID NO: 435025 - RNA, 64 nt, hsa; identical to SEQ ID NO: 40305

SEQ ID NO: 435026 - RNA, 64 nt, hsa; identical to SEQ ID NO: 40306

SEQ ID NO: 435027 - RNA, 64 nt, hsa; identical to SEQ ID NO: 40307

SEQ ID NO: 435028 - RNA, 64 nt, hsa; identical to SEQ ID NO: 40308

SEQ ID NO: 435029 - RNA, 64 nt, hsa; identical to SEQ ID NO: 40309

SEQ ID NO: 435030 - RNA, 64 nt, hsa; identical to SEQ ID NO: 40310

SEQ ID NO: 435031 - RNA, 64 nt, hsa; identical to SEQ ID NO: 40311

SEQ ID NO: 435032 - RNA, 64 nt, hsa; identical to SEQ ID NO: 40312

SEQ ID NO: 435033 - RNA, 64 nt, hsa; identical to SEQ ID NO: 40313

SEQ ID NO: 435034 - RNA, 64 nt, hsa; identical to SEQ ID NO: 40314

SEQ ID NO: 435035 - RNA, 64 nt, hsa; identical to SEQ ID NO: 40315

SEQ ID NO: 435036 - RNA, 64 nt, hsa; identical to SEQ ID NO: 40316

SEQ ID NO: 435037 - RNA, 64 nt, hsa; identical to SEQ ID NO: 40317

SEQ ID NO: 435038 - RNA, 64 nt, hsa; identical to SEQ ID NO: 40318

SEQ ID NO: 435039 - RNA, 64 nt, hsa; identical to SEQ ID NO: 40319

SEQ ID NO: 435040 - RNA, 64 nt, hsa; identical to SEQ ID NO: 40320

SEQ ID NO: 435041 - RNA, 64 nt, hsa; identical to SEQ ID NO: 40321

SEQ ID NO: 435042 - RNA, 64 nt, hsa; identical to SEQ ID NO: 40322

SEQ ID NO: 435043 - RNA, 64 nt, hsa; identical to SEQ ID NO: 40323

SEQ ID NO: 435044 - RNA, 64 nt, hsa; identical to SEQ ID NO: 40324

SEQ ID NO: 435045 - RNA, 64 nt, hsa; identical to SEQ ID NO: 40325

SEQ ID NO: 435046 - RNA, 64 nt, hsa; identical to SEQ ID NO: 40326

SEQ ID NO: 435047 - RNA, 64 nt, hsa; identical to SEQ ID NO: 40327

SEQ ID NO: 435048 - RNA, 64 nt, hsa; identical to SEQ ID NO: 40328

SEQ ID NO: 435049 - RNA, 64 nt, hsa; identical to SEQ ID NO: 40329

SEQ ID NO: 435050 - RNA, 64 nt, hsa; identical to SEQ ID NO: 40330

SEQ ID NO: 435051 - RNA, 64 nt, hsa; identical to SEQ ID NO: 40331

SEQ ID NO: 435052 - RNA, 64 nt, hsa; identical to SEQ ID NO: 40332

SEQ ID NO: 435053 - RNA, 64 nt, hsa; identical to SEQ ID NO: 40333

SEQ ID NO: 435054 - RNA, 64 nt, hsa; identical to SEQ ID NO: 40334

SEQ ID NO: 435055 - RNA, 64 nt, hsa; identical to SEQ ID NO: 40335

SEQ ID NO: 435056 - RNA, 64 nt, hsa; identical to SEQ ID NO: 40336

SEQ ID NO: 435057 - RNA, 64 nt, hsa; identical to SEQ ID NO: 40337

SEQ ID NO: 435058 - RNA, 64 nt, hsa; identical to SEQ ID NO: 40338

SEQ ID NO: 435059 - RNA, 64 nt, hsa; identical to SEQ ID NO: 40339

SEQ ID NO: 435060 - RNA, 64 nt, hsa; identical to SEQ ID NO: 40340

SEQ ID NO: 435061 - RNA, 64 nt, hsa; identical to SEQ ID NO: 40341

SEQ ID NO: 435062 - RNA, 64 nt, hsa; identical to SEQ ID NO: 40342

SEQ ID NO: 435063 - RNA, 64 nt, hsa; identical to SEQ ID NO: 40343

SEQ ID NO: 435064 - RNA, 64 nt, hsa; identical to SEQ ID NO: 40344

SEQ ID NO: 435065 - RNA, 64 nt, hsa; identical to SEQ ID NO: 40345

SEQ ID NO: 435066 - RNA, 64 nt, hsa; identical to SEQ ID NO: 40346

SEQ ID NO: 435067 - RNA, 64 nt, hsa; identical to SEQ ID NO: 40347

SEQ ID NO: 435068 - RNA, 64 nt, hsa; identical to SEQ ID NO: 40348

SEQ ID NO: 435069 - RNA, 64 nt, hsa; identical to SEQ ID NO: 40349

SEQ ID NO: 435070 - RNA, 64 nt, hsa; identical to SEQ ID NO: 40350

SEQ ID NO: 435071 - RNA, 64 nt, hsa; identical to SEQ ID NO: 40351

SEQ ID NO: 435072 - RNA, 64 nt, hsa; identical to SEQ ID NO: 40352

SEQ ID NO: 435073 - RNA, 64 nt, hsa; identical to SEQ ID NO: 40353

SEQ ID NO: 435074 - RNA, 64 nt, hsa; identical to SEQ ID NO: 40354

SEQ ID NO: 435075 - RNA, 64 nt, hsa; identical to SEQ ID NO: 40355

SEQ ID NO: 435076 - RNA, 64 nt, hsa; identical to SEQ ID NO: 40356

SEQ ID NO: 435077 - RNA, 64 nt, hsa; identical to SEQ ID NO: 40357

SEQ ID NO: 435078 - RNA, 64 nt, hsa; identical to SEQ ID NO: 40358

SEQ ID NO: 435079 - RNA, 64 nt, hsa; identical to SEQ ID NO: 40359

SEQ ID NO: 435080 - RNA, 64 nt, hsa; identical to SEQ ID NO: 40360

SEQ ID NO: 435081 - RNA, 64 nt, hsa; identical to SEQ ID NO: 40361

SEQ ID NO: 435082 - RNA, 64 nt, hsa; identical to SEQ ID NO: 40362

SEQ ID NO: 435083 - RNA, 64 nt, hsa; identical to SEQ ID NO: 40363

SEQ ID NO: 435084 - RNA, 64 nt, hsa; identical to SEQ ID NO: 40364

SEQ ID NO: 435085 - RNA, 64 nt, hsa; identical to SEQ ID NO: 40365

SEQ ID NO: 435086 - RNA, 64 nt, hsa; identical to SEQ ID NO: 40366

SEQ ID NO: 435087 - RNA, 64 nt, hsa; identical to SEQ ID NO: 40367

SEQ ID NO: 435088 - RNA, 64 nt, hsa; identical to SEQ ID NO: 40368

SEQ ID NO: 435089 - RNA, 64 nt, hsa; identical to SEQ ID NO: 40369

SEQ ID NO: 435090 - RNA, 64 nt, hsa; identical to SEQ ID NO: 40370

SEQ ID NO: 435091 - RNA, 64 nt, hsa; identical to SEQ ID NO: 40371

SEQ ID NO: 435092 - RNA, 64 nt, hsa; identical to SEQ ID NO: 40372

SEQ ID NO: 435093 - RNA, 64 nt, hsa; identical to SEQ ID NO: 40373

SEQ ID NO: 435094 - RNA, 64 nt, hsa; identical to SEQ ID NO: 40374

SEQ ID NO: 435095 - RNA, 64 nt, hsa; identical to SEQ ID NO: 40375

SEQ ID NO: 435096 - RNA, 64 nt, hsa; identical to SEQ ID NO: 40376

SEQ ID NO: 435097 - RNA, 64 nt, hsa; identical to SEQ ID NO: 40377

SEQ ID NO: 435098 - RNA, 64 nt, hsa; identical to SEQ ID NO: 40378

SEQ ID NO: 435099 - RNA, 64 nt, hsa; identical to SEQ ID NO: 40379

SEQ ID NO: 435100 - RNA, 64 nt, hsa; identical to SEQ ID NO: 40380

SEQ ID NO: 435101 - RNA, 64 nt, hsa; identical to SEQ ID NO: 40381

SEQ ID NO: 435102 - RNA, 64 nt, hsa; identical to SEQ ID NO: 40382

SEQ ID NO: 435103 - RNA, 64 nt, hsa; identical to SEQ ID NO: 40383

SEQ ID NO: 435104 - RNA, 64 nt, hsa; identical to SEQ ID NO: 40384

SEQ ID NO: 435105 - RNA, 64 nt, hsa; identical to SEQ ID NO: 40385

SEQ ID NO: 435106 - RNA, 64 nt, hsa; identical to SEQ ID NO: 40386

SEQ ID NO: 435107 - RNA, 64 nt, hsa; identical to SEQ ID NO: 40387

SEQ ID NO: 435108 - RNA, 64 nt, hsa; identical to SEQ ID NO: 40388

SEQ ID NO: 435109 - RNA, 64 nt, hsa; identical to SEQ ID NO: 40389

SEQ ID NO: 435110 - RNA, 64 nt, hsa; identical to SEQ ID NO: 40390

SEQ ID NO: 435111 - RNA, 64 nt, hsa; identical to SEQ ID NO: 40391

SEQ ID NO: 435112 - RNA, 64 nt, hsa; identical to SEQ ID NO: 40392

SEQ ID NO: 435113 - RNA, 64 nt, hsa; identical to SEQ ID NO: 40393

SEQ ID NO: 435114 - RNA, 64 nt, hsa; identical to SEQ ID NO: 40394

SEQ ID NO: 435115 - RNA, 64 nt, hsa; identical to SEQ ID NO: 40395

SEQ ID NO: 435116 - RNA, 64 nt, hsa; identical to SEQ ID NO: 40396

SEQ ID NO: 435117 - RNA, 64 nt, hsa; identical to SEQ ID NO: 40397

SEQ ID NO: 435118 - RNA, 64 nt, hsa; identical to SEQ ID NO: 40398

SEQ ID NO: 435119 - RNA, 64 nt, hsa; identical to SEQ ID NO: 40399

SEQ ID NO: 435120 - RNA, 64 nt, hsa; identical to SEQ ID NO: 40400

SEQ ID NO: 435121 - RNA, 64 nt, hsa; identical to SEQ ID NO: 40401

SEQ ID NO: 435122 - RNA, 64 nt, hsa; identical to SEQ ID NO: 40402

SEQ ID NO: 435123 - RNA, 64 nt, hsa; identical to SEQ ID NO: 40403

SEQ ID NO: 435124 - RNA, 64 nt, hsa; identical to SEQ ID NO: 40404

SEQ ID NO: 435125 - RNA, 64 nt, hsa; identical to SEQ ID NO: 40405

SEQ ID NO: 435126 - RNA, 64 nt, hsa; identical to SEQ ID NO: 40406

SEQ ID NO: 435127 - RNA, 64 nt, hsa; identical to SEQ ID NO: 40407

SEQ ID NO: 435128 - RNA, 64 nt, hsa; identical to SEQ ID NO: 40408

SEQ ID NO: 435129 - RNA, 64 nt, hsa; identical to SEQ ID NO: 40409

SEQ ID NO: 435130 - RNA, 64 nt, hsa; identical to SEQ ID NO: 40410

SEQ ID NO: 435131 - RNA, 64 nt, hsa; identical to SEQ ID NO: 40411

SEQ ID NO: 435132 - RNA, 64 nt, hsa; identical to SEQ ID NO: 40412

SEQ ID NO: 435133 - RNA, 64 nt, hsa; identical to SEQ ID NO: 40413

SEQ ID NO: 435134 - RNA, 64 nt, hsa; identical to SEQ ID NO: 40414

SEQ ID NO: 435135 - RNA, 64 nt, hsa; identical to SEQ ID NO: 40415

SEQ ID NO: 435136 - RNA, 64 nt, hsa; identical to SEQ ID NO: 40416

SEQ ID NO: 435137 - RNA, 64 nt, hsa; identical to SEQ ID NO: 40417

SEQ ID NO: 435138 - RNA, 64 nt, hsa; identical to SEQ ID NO: 40418

SEQ ID NO: 435139 - RNA, 64 nt, hsa; identical to SEQ ID NO: 40419

SEQ ID NO: 435140 - RNA, 64 nt, hsa; identical to SEQ ID NO: 40420

SEQ ID NO: 435141 - RNA, 64 nt, hsa; identical to SEQ ID NO: 40421

SEQ ID NO: 435142 - RNA, 64 nt, hsa; identical to SEQ ID NO: 40422

SEQ ID NO: 435143 - RNA, 64 nt, hsa; identical to SEQ ID NO: 40423

SEQ ID NO: 435144 - RNA, 64 nt, hsa; identical to SEQ ID NO: 40424

SEQ ID NO: 435145 - RNA, 64 nt, hsa; identical to SEQ ID NO: 40425

SEQ ID NO: 435146 - RNA, 64 nt, hsa; identical to SEQ ID NO: 40426

SEQ ID NO: 435147 - RNA, 64 nt, hsa; identical to SEQ ID NO: 40427

SEQ ID NO: 435148 - RNA, 64 nt, hsa; identical to SEQ ID NO: 40428

SEQ ID NO: 435149 - RNA, 64 nt, hsa; identical to SEQ ID NO: 40429

SEQ ID NO: 435150 - RNA, 64 nt, hsa; identical to SEQ ID NO: 40430

SEQ ID NO: 435151 - RNA, 64 nt, hsa; identical to SEQ ID NO: 40431

SEQ ID NO: 435152 - RNA, 64 nt, hsa; identical to SEQ ID NO: 40432

SEQ ID NO: 435153 - RNA, 64 nt, hsa; identical to SEQ ID NO: 40433

SEQ ID NO: 435154 - RNA, 64 nt, hsa; identical to SEQ ID NO: 40434

SEQ ID NO: 435155 - RNA, 64 nt, hsa; identical to SEQ ID NO: 40435

SEQ ID NO: 435156 - RNA, 64 nt, hsa; identical to SEQ ID NO: 40436

SEQ ID NO: 435157 - RNA, 64 nt, hsa; identical to SEQ ID NO: 40437

SEQ ID NO: 435158 - RNA, 64 nt, hsa; identical to SEQ ID NO: 40438

SEQ ID NO: 435159 - RNA, 64 nt, hsa; identical to SEQ ID NO: 40439

SEQ ID NO: 435160 - RNA, 64 nt, hsa; identical to SEQ ID NO: 40440

SEQ ID NO: 435161 - RNA, 64 nt, hsa; identical to SEQ ID NO: 40441

SEQ ID NO: 435162 - RNA, 64 nt, hsa; identical to SEQ ID NO: 40442

SEQ ID NO: 435163 - RNA, 64 nt, hsa; identical to SEQ ID NO: 40443

SEQ ID NO: 435164 - RNA, 64 nt, hsa; identical to SEQ ID NO: 40444

SEQ ID NO: 435165 - RNA, 64 nt, hsa; identical to SEQ ID NO: 40445

SEQ ID NO: 435166 - RNA, 64 nt, hsa; identical to SEQ ID NO: 40446

SEQ ID NO: 435167 - RNA, 64 nt, hsa; identical to SEQ ID NO: 40447

SEQ ID NO: 435168 - RNA, 64 nt, hsa; identical to SEQ ID NO: 40448

SEQ ID NO: 435169 - RNA, 64 nt, hsa; identical to SEQ ID NO: 40449

SEQ ID NO: 435170 - RNA, 64 nt, hsa; identical to SEQ ID NO: 40450

SEQ ID NO: 435171 - RNA, 64 nt, hsa; identical to SEQ ID NO: 40451

SEQ ID NO: 435172 - RNA, 64 nt, hsa; identical to SEQ ID NO: 40452

SEQ ID NO: 435173 - RNA, 64 nt, hsa; identical to SEQ ID NO: 40453

SEQ ID NO: 435174 - RNA, 64 nt, hsa; identical to SEQ ID NO: 40454

SEQ ID NO: 435175 - RNA, 64 nt, hsa; identical to SEQ ID NO: 40455

SEQ ID NO: 435176 - RNA, 64 nt, hsa; identical to SEQ ID NO: 40456

SEQ ID NO: 435177 - RNA, 64 nt, hsa; identical to SEQ ID NO: 40457

SEQ ID NO: 435178 - RNA, 64 nt, hsa; identical to SEQ ID NO: 40458

SEQ ID NO: 435179 - RNA, 64 nt, hsa; identical to SEQ ID NO: 40459

SEQ ID NO: 435180 - RNA, 64 nt, hsa; identical to SEQ ID NO: 40460

SEQ ID NO: 435181 - RNA, 64 nt, hsa; identical to SEQ ID NO: 40461

SEQ ID NO: 435182 - RNA, 64 nt, hsa; identical to SEQ ID NO: 40462

SEQ ID NO: 435183 - RNA, 64 nt, hsa; identical to SEQ ID NO: 40463

SEQ ID NO: 435184 - RNA, 64 nt, hsa; identical to SEQ ID NO: 40464

SEQ ID NO: 435185 - RNA, 64 nt, hsa; identical to SEQ ID NO: 40465

SEQ ID NO: 435186 - RNA, 64 nt, hsa; identical to SEQ ID NO: 40466

SEQ ID NO: 435187 - RNA, 64 nt, hsa; identical to SEQ ID NO: 40467

SEQ ID NO: 435188 - RNA, 64 nt, hsa; identical to SEQ ID NO: 40468

SEQ ID NO: 435189 - RNA, 64 nt, hsa; identical to SEQ ID NO: 40469

SEQ ID NO: 435190 - RNA, 64 nt, hsa; identical to SEQ ID NO: 40470

SEQ ID NO: 435191 - RNA, 64 nt, hsa; identical to SEQ ID NO: 40471

SEQ ID NO: 435192 - RNA, 64 nt, hsa; identical to SEQ ID NO: 40472

SEQ ID NO: 435193 - RNA, 64 nt, hsa; identical to SEQ ID NO: 40473

SEQ ID NO: 435194 - RNA, 64 nt, hsa; identical to SEQ ID NO: 40474

SEQ ID NO: 435195 - RNA, 64 nt, hsa; identical to SEQ ID NO: 40475

SEQ ID NO: 435196 - RNA, 64 nt, hsa; identical to SEQ ID NO: 40476

SEQ ID NO: 435197 - RNA, 64 nt, hsa; identical to SEQ ID NO: 40477

SEQ ID NO: 435198 - RNA, 64 nt, hsa; identical to SEQ ID NO: 40478

SEQ ID NO: 435199 - RNA, 64 nt, hsa; identical to SEQ ID NO: 40479

SEQ ID NO: 435200 - RNA, 64 nt, hsa; identical to SEQ ID NO: 40480

SEQ ID NO: 435201 - RNA, 64 nt, hsa; identical to SEQ ID NO: 40481

SEQ ID NO: 435202 - RNA, 64 nt, hsa; identical to SEQ ID NO: 40482

SEQ ID NO: 435203 - RNA, 64 nt, hsa; identical to SEQ ID NO: 40483

SEQ ID NO: 435204 - RNA, 64 nt, hsa; identical to SEQ ID NO: 40484

SEQ ID NO: 435205 - RNA, 64 nt, hsa; identical to SEQ ID NO: 40485

SEQ ID NO: 435206 - RNA, 64 nt, hsa; identical to SEQ ID NO: 40486

SEQ ID NO: 435207 - RNA, 64 nt, hsa; identical to SEQ ID NO: 40487

SEQ ID NO: 435208 - RNA, 64 nt, hsa; identical to SEQ ID NO: 40488

SEQ ID NO: 435209 - RNA, 64 nt, hsa; identical to SEQ ID NO: 40489

SEQ ID NO: 435210 - RNA, 64 nt, hsa; identical to SEQ ID NO: 40490

SEQ ID NO: 435211 - RNA, 64 nt, hsa; identical to SEQ ID NO: 40491

SEQ ID NO: 435212 - RNA, 64 nt, hsa; identical to SEQ ID NO: 40492

SEQ ID NO: 435213 - RNA, 64 nt, hsa; identical to SEQ ID NO: 40493

SEQ ID NO: 435214 - RNA, 64 nt, hsa; identical to SEQ ID NO: 40494

SEQ ID NO: 435215 - RNA, 64 nt, hsa; identical to SEQ ID NO: 40495

SEQ ID NO: 435216 - RNA, 64 nt, hsa; identical to SEQ ID NO: 40496

SEQ ID NO: 435217 - RNA, 64 nt, hsa; identical to SEQ ID NO: 40497

SEQ ID NO: 435218 - RNA, 64 nt, hsa; identical to SEQ ID NO: 40498

SEQ ID NO: 435219 - RNA, 64 nt, hsa; identical to SEQ ID NO: 40499

SEQ ID NO: 435220 - RNA, 64 nt, hsa; identical to SEQ ID NO: 40500

SEQ ID NO: 435221 - RNA, 64 nt, hsa; identical to SEQ ID NO: 40501

SEQ ID NO: 435222 - RNA, 64 nt, hsa; identical to SEQ ID NO: 40502

SEQ ID NO: 435223 - RNA, 64 nt, hsa; identical to SEQ ID NO: 40503

SEQ ID NO: 435224 - RNA, 64 nt, hsa; identical to SEQ ID NO: 40504

SEQ ID NO: 435225 - RNA, 64 nt, hsa; identical to SEQ ID NO: 40505

SEQ ID NO: 435226 - RNA, 64 nt, hsa; identical to SEQ ID NO: 40506

SEQ ID NO: 435227 - RNA, 64 nt, hsa; identical to SEQ ID NO: 40507

SEQ ID NO: 435228 - RNA, 64 nt, hsa; identical to SEQ ID NO: 40508

SEQ ID NO: 435229 - RNA, 64 nt, hsa; identical to SEQ ID NO: 40509

SEQ ID NO: 435230 - RNA, 64 nt, hsa; identical to SEQ ID NO: 40510

SEQ ID NO: 435231 - RNA, 64 nt, hsa; identical to SEQ ID NO: 40511

SEQ ID NO: 435232 - RNA, 64 nt, hsa; identical to SEQ ID NO: 40512

SEQ ID NO: 435233 - RNA, 64 nt, hsa; identical to SEQ ID NO: 40513

SEQ ID NO: 435234 - RNA, 64 nt, hsa; identical to SEQ ID NO: 40514

SEQ ID NO: 435235 - RNA, 64 nt, hsa; identical to SEQ ID NO: 40515

SEQ ID NO: 435236 - RNA, 64 nt, hsa; identical to SEQ ID NO: 40516

SEQ ID NO: 435237 - RNA, 64 nt, hsa; identical to SEQ ID NO: 40517

SEQ ID NO: 435238 - RNA, 64 nt, hsa; identical to SEQ ID NO: 40518

SEQ ID NO: 435239 - RNA, 64 nt, hsa; identical to SEQ ID NO: 40519

SEQ ID NO: 435240 - RNA, 64 nt, hsa; identical to SEQ ID NO: 40520

SEQ ID NO: 435241 - RNA, 64 nt, hsa; identical to SEQ ID NO: 40521

SEQ ID NO: 435242 - RNA, 64 nt, hsa; identical to SEQ ID NO: 40522

SEQ ID NO: 435243 - RNA, 64 nt, hsa; identical to SEQ ID NO: 40523

SEQ ID NO: 435244 - RNA, 64 nt, hsa; identical to SEQ ID NO: 40524

SEQ ID NO: 435245 - RNA, 64 nt, hsa; identical to SEQ ID NO: 40525

SEQ ID NO: 435246 - RNA, 64 nt, hsa; identical to SEQ ID NO: 40526

SEQ ID NO: 435247 - RNA, 64 nt, hsa; identical to SEQ ID NO: 40527

SEQ ID NO: 435248 - RNA, 64 nt, hsa; identical to SEQ ID NO: 40528

SEQ ID NO: 435249 - RNA, 64 nt, hsa; identical to SEQ ID NO: 40529

SEQ ID NO: 435250 - RNA, 64 nt, hsa; identical to SEQ ID NO: 40530

SEQ ID NO: 435251 - RNA, 64 nt, hsa; identical to SEQ ID NO: 40531

SEQ ID NO: 435252 - RNA, 64 nt, hsa; identical to SEQ ID NO: 40532

SEQ ID NO: 435253 - RNA, 64 nt, hsa; identical to SEQ ID NO: 40533

SEQ ID NO: 435254 - RNA, 64 nt, hsa; identical to SEQ ID NO: 40534

SEQ ID NO: 435255 - RNA, 64 nt, hsa; identical to SEQ ID NO: 40535

SEQ ID NO: 435256 - RNA, 64 nt, hsa; identical to SEQ ID NO: 40536

SEQ ID NO: 435257 - RNA, 64 nt, hsa; identical to SEQ ID NO: 40537

SEQ ID NO: 435258 - RNA, 64 nt, hsa; identical to SEQ ID NO: 40538

SEQ ID NO: 435259 - RNA, 64 nt, hsa; identical to SEQ ID NO: 40539

SEQ ID NO: 435260 - RNA, 64 nt, hsa; identical to SEQ ID NO: 40540

SEQ ID NO: 435261 - RNA, 64 nt, hsa; identical to SEQ ID NO: 40541

SEQ ID NO: 435262 - RNA, 64 nt, hsa; identical to SEQ ID NO: 40542

SEQ ID NO: 435263 - RNA, 64 nt, hsa; identical to SEQ ID NO: 40543

SEQ ID NO: 435264 - RNA, 64 nt, hsa; identical to SEQ ID NO: 40544

SEQ ID NO: 435265 - RNA, 64 nt, hsa; identical to SEQ ID NO: 40545

SEQ ID NO: 435266 - RNA, 64 nt, hsa; identical to SEQ ID NO: 40546

SEQ ID NO: 435267 - RNA, 64 nt, hsa; identical to SEQ ID NO: 40547

SEQ ID NO: 435268 - RNA, 64 nt, hsa; identical to SEQ ID NO: 40548

SEQ ID NO: 435269 - RNA, 64 nt, hsa; identical to SEQ ID NO: 40549

SEQ ID NO: 435270 - RNA, 64 nt, hsa; identical to SEQ ID NO: 40550

SEQ ID NO: 435271 - RNA, 64 nt, hsa; identical to SEQ ID NO: 40551

SEQ ID NO: 435272 - RNA, 64 nt, hsa; identical to SEQ ID NO: 40552

SEQ ID NO: 435273 - RNA, 64 nt, hsa; identical to SEQ ID NO: 40553

SEQ ID NO: 435274 - RNA, 64 nt, hsa; identical to SEQ ID NO: 40554

SEQ ID NO: 435275 - RNA, 64 nt, hsa; identical to SEQ ID NO: 40555

SEQ ID NO: 435276 - RNA, 64 nt, hsa; identical to SEQ ID NO: 40556

SEQ ID NO: 435277 - RNA, 64 nt, hsa; identical to SEQ ID NO: 40557

SEQ ID NO: 435278 - RNA, 64 nt, hsa; identical to SEQ ID NO: 40558

SEQ ID NO: 435279 - RNA, 64 nt, hsa; identical to SEQ ID NO: 40559

SEQ ID NO: 435280 - RNA, 64 nt, hsa; identical to SEQ ID NO: 40560

SEQ ID NO: 435281 - RNA, 64 nt, hsa; identical to SEQ ID NO: 40561

SEQ ID NO: 435282 - RNA, 64 nt, hsa; identical to SEQ ID NO: 40562

SEQ ID NO: 435283 - RNA, 64 nt, hsa; identical to SEQ ID NO: 40563

SEQ ID NO: 435284 - RNA, 64 nt, hsa; identical to SEQ ID NO: 40564

SEQ ID NO: 435285 - RNA, 64 nt, hsa; identical to SEQ ID NO: 40565

SEQ ID NO: 435286 - RNA, 64 nt, hsa; identical to SEQ ID NO: 40566

SEQ ID NO: 435287 - RNA, 64 nt, hsa; identical to SEQ ID NO: 40567

SEQ ID NO: 435288 - RNA, 64 nt, hsa; identical to SEQ ID NO: 40568

SEQ ID NO: 435289 - RNA, 64 nt, hsa; identical to SEQ ID NO: 40569

SEQ ID NO: 435290 - RNA, 64 nt, hsa; identical to SEQ ID NO: 40570

SEQ ID NO: 435291 - RNA, 64 nt, hsa; identical to SEQ ID NO: 40571

SEQ ID NO: 435292 - RNA, 64 nt, hsa; identical to SEQ ID NO: 40572

SEQ ID NO: 435293 - RNA, 64 nt, hsa; identical to SEQ ID NO: 40573

SEQ ID NO: 435294 - RNA, 64 nt, hsa; identical to SEQ ID NO: 40574

SEQ ID NO: 435295 - RNA, 64 nt, hsa; identical to SEQ ID NO: 40575

SEQ ID NO: 435296 - RNA, 64 nt, hsa; identical to SEQ ID NO: 40576

SEQ ID NO: 435297 - RNA, 64 nt, hsa; identical to SEQ ID NO: 40577

SEQ ID NO: 435298 - RNA, 64 nt, hsa; identical to SEQ ID NO: 40578

SEQ ID NO: 435299 - RNA, 64 nt, hsa; identical to SEQ ID NO: 40579

SEQ ID NO: 435300 - RNA, 64 nt, hsa; identical to SEQ ID NO: 40580

SEQ ID NO: 435301 - RNA, 64 nt, hsa; identical to SEQ ID NO: 40581

SEQ ID NO: 435302 - RNA, 64 nt, hsa; identical to SEQ ID NO: 40582

SEQ ID NO: 435303 - RNA, 64 nt, hsa; identical to SEQ ID NO: 40583

SEQ ID NO: 435304 - RNA, 64 nt, hsa; identical to SEQ ID NO: 40584

SEQ ID NO: 435305 - RNA, 64 nt, hsa; identical to SEQ ID NO: 40585

SEQ ID NO: 435306 - RNA, 64 nt, hsa; identical to SEQ ID NO: 40586

SEQ ID NO: 435307 - RNA, 64 nt, hsa; identical to SEQ ID NO: 40587

SEQ ID NO: 435308 - RNA, 64 nt, hsa; identical to SEQ ID NO: 40588

SEQ ID NO: 435309 - RNA, 64 nt, hsa; identical to SEQ ID NO: 40589

SEQ ID NO: 435310 - RNA, 64 nt, hsa; identical to SEQ ID NO: 40590

SEQ ID NO: 435311 - RNA, 64 nt, hsa; identical to SEQ ID NO: 40591

SEQ ID NO: 435312 - RNA, 64 nt, hsa; identical to SEQ ID NO: 40592

SEQ ID NO: 435313 - RNA, 64 nt, hsa; identical to SEQ ID NO: 40593

SEQ ID NO: 435314 - RNA, 64 nt, hsa; identical to SEQ ID NO: 40594

SEQ ID NO: 435315 - RNA, 64 nt, hsa; identical to SEQ ID NO: 40595

SEQ ID NO: 435316 - RNA, 64 nt, hsa; identical to SEQ ID NO: 40596

SEQ ID NO: 435317 - RNA, 64 nt, hsa; identical to SEQ ID NO: 40597

SEQ ID NO: 435318 - RNA, 64 nt, hsa; identical to SEQ ID NO: 40598

SEQ ID NO: 435319 - RNA, 64 nt, hsa; identical to SEQ ID NO: 40599

SEQ ID NO: 435320 - RNA, 64 nt, hsa; identical to SEQ ID NO: 40600

SEQ ID NO: 435321 - RNA, 64 nt, hsa; identical to SEQ ID NO: 40601

SEQ ID NO: 435322 - RNA, 64 nt, hsa; identical to SEQ ID NO: 40602

SEQ ID NO: 435323 - RNA, 64 nt, hsa; identical to SEQ ID NO: 40603

SEQ ID NO: 435324 - RNA, 64 nt, hsa; identical to SEQ ID NO: 40604

SEQ ID NO: 435325 - RNA, 64 nt, hsa; identical to SEQ ID NO: 40605

SEQ ID NO: 435326 - RNA, 64 nt, hsa; identical to SEQ ID NO: 40606

SEQ ID NO: 435327 - RNA, 64 nt, hsa; identical to SEQ ID NO: 40607

SEQ ID NO: 435328 - RNA, 64 nt, hsa; identical to SEQ ID NO: 40608

SEQ ID NO: 435329 - RNA, 64 nt, hsa; identical to SEQ ID NO: 40609

SEQ ID NO: 435330 - RNA, 64 nt, hsa; identical to SEQ ID NO: 40610

SEQ ID NO: 435331 - RNA, 64 nt, hsa; identical to SEQ ID NO: 40611

SEQ ID NO: 435332 - RNA, 64 nt, hsa; identical to SEQ ID NO: 40612

SEQ ID NO: 435333 - RNA, 64 nt, hsa; identical to SEQ ID NO: 40613

SEQ ID NO: 435334 - RNA, 64 nt, hsa; identical to SEQ ID NO: 40614

SEQ ID NO: 435335 - RNA, 64 nt, hsa; identical to SEQ ID NO: 40615

SEQ ID NO: 435336 - RNA, 64 nt, hsa; identical to SEQ ID NO: 40616

SEQ ID NO: 435337 - RNA, 64 nt, hsa; identical to SEQ ID NO: 40617

SEQ ID NO: 435338 - RNA, 64 nt, hsa; identical to SEQ ID NO: 40618

SEQ ID NO: 435339 - RNA, 64 nt, hsa; identical to SEQ ID NO: 40619

SEQ ID NO: 435340 - RNA, 64 nt, hsa; identical to SEQ ID NO: 40620

SEQ ID NO: 435341 - RNA, 64 nt, hsa; identical to SEQ ID NO: 40621

SEQ ID NO: 435342 - RNA, 64 nt, hsa; identical to SEQ ID NO: 40622

SEQ ID NO: 435343 - RNA, 64 nt, hsa; identical to SEQ ID NO: 40623

SEQ ID NO: 435344 - RNA, 64 nt, hsa; identical to SEQ ID NO: 40624

SEQ ID NO: 435345 - RNA, 64 nt, hsa; identical to SEQ ID NO: 40625

SEQ ID NO: 435346 - RNA, 64 nt, hsa; identical to SEQ ID NO: 40626

SEQ ID NO: 435347 - RNA, 64 nt, hsa; identical to SEQ ID NO: 40627

SEQ ID NO: 435348 - RNA, 64 nt, hsa; identical to SEQ ID NO: 40628

SEQ ID NO: 435349 - RNA, 64 nt, hsa; identical to SEQ ID NO: 40629

SEQ ID NO: 435350 - RNA, 64 nt, hsa; identical to SEQ ID NO: 40630

SEQ ID NO: 435351 - RNA, 64 nt, hsa; identical to SEQ ID NO: 40631

SEQ ID NO: 435352 - RNA, 64 nt, hsa; identical to SEQ ID NO: 40632

SEQ ID NO: 435353 - RNA, 64 nt, hsa; identical to SEQ ID NO: 40633

SEQ ID NO: 435354 - RNA, 64 nt, hsa; identical to SEQ ID NO: 40634

SEQ ID NO: 435355 - RNA, 64 nt, hsa; identical to SEQ ID NO: 40635

SEQ ID NO: 435356 - RNA, 64 nt, hsa; identical to SEQ ID NO: 40636

SEQ ID NO: 435357 - RNA, 64 nt, hsa; identical to SEQ ID NO: 40637

SEQ ID NO: 435358 - RNA, 64 nt, hsa; identical to SEQ ID NO: 40638

SEQ ID NO: 435359 - RNA, 64 nt, hsa; identical to SEQ ID NO: 40639

SEQ ID NO: 435360 - RNA, 64 nt, hsa; identical to SEQ ID NO: 40640

SEQ ID NO: 435361 - RNA, 64 nt, hsa; identical to SEQ ID NO: 40641

SEQ ID NO: 435362 - RNA, 64 nt, hsa; identical to SEQ ID NO: 40642

SEQ ID NO: 435363 - RNA, 64 nt, hsa; identical to SEQ ID NO: 40643

SEQ ID NO: 435364 - RNA, 64 nt, hsa; identical to SEQ ID NO: 40644

SEQ ID NO: 435365 - RNA, 64 nt, hsa; identical to SEQ ID NO: 40645

SEQ ID NO: 435366 - RNA, 64 nt, hsa; identical to SEQ ID NO: 40646

SEQ ID NO: 435367 - RNA, 64 nt, hsa; identical to SEQ ID NO: 40647

SEQ ID NO: 435368 - RNA, 64 nt, hsa; identical to SEQ ID NO: 40648

SEQ ID NO: 435369 - RNA, 64 nt, hsa; identical to SEQ ID NO: 40649

SEQ ID NO: 435370 - RNA, 64 nt, hsa; identical to SEQ ID NO: 40650

SEQ ID NO: 435371 - RNA, 64 nt, hsa; identical to SEQ ID NO: 40651

SEQ ID NO: 435372 - RNA, 64 nt, hsa; identical to SEQ ID NO: 40652

SEQ ID NO: 435373 - RNA, 64 nt, hsa; identical to SEQ ID NO: 40653

SEQ ID NO: 435374 - RNA, 64 nt, hsa; identical to SEQ ID NO: 40654

SEQ ID NO: 435375 - RNA, 64 nt, hsa; identical to SEQ ID NO: 40655

SEQ ID NO: 435376 - RNA, 64 nt, hsa; identical to SEQ ID NO: 40656

SEQ ID NO: 435377 - RNA, 64 nt, hsa; identical to SEQ ID NO: 40657

SEQ ID NO: 435378 - RNA, 64 nt, hsa; identical to SEQ ID NO: 40658

SEQ ID NO: 435379 - RNA, 64 nt, hsa; identical to SEQ ID NO: 40659

SEQ ID NO: 435380 - RNA, 64 nt, hsa; identical to SEQ ID NO: 40660

SEQ ID NO: 435381 - RNA, 64 nt, hsa; identical to SEQ ID NO: 40661

SEQ ID NO: 435382 - RNA, 64 nt, hsa; identical to SEQ ID NO: 40662

SEQ ID NO: 435383 - RNA, 64 nt, hsa; identical to SEQ ID NO: 40663

SEQ ID NO: 435384 - RNA, 64 nt, hsa; identical to SEQ ID NO: 40664

SEQ ID NO: 435385 - RNA, 64 nt, hsa; identical to SEQ ID NO: 40665

SEQ ID NO: 435386 - RNA, 64 nt, hsa; identical to SEQ ID NO: 40666

SEQ ID NO: 435387 - RNA, 64 nt, hsa; identical to SEQ ID NO: 40667

SEQ ID NO: 435388 - RNA, 64 nt, hsa; identical to SEQ ID NO: 40668

SEQ ID NO: 435389 - RNA, 64 nt, hsa; identical to SEQ ID NO: 40669

SEQ ID NO: 435390 - RNA, 64 nt, hsa; identical to SEQ ID NO: 40670

SEQ ID NO: 435391 - RNA, 64 nt, hsa; identical to SEQ ID NO: 40671

SEQ ID NO: 435392 - RNA, 64 nt, hsa; identical to SEQ ID NO: 40672

SEQ ID NO: 435393 - RNA, 64 nt, hsa; identical to SEQ ID NO: 40673

SEQ ID NO: 435394 - RNA, 64 nt, hsa; identical to SEQ ID NO: 40674

SEQ ID NO: 435395 - RNA, 64 nt, hsa; identical to SEQ ID NO: 40675

SEQ ID NO: 435396 - RNA, 64 nt, hsa; identical to SEQ ID NO: 40676

SEQ ID NO: 435397 - RNA, 64 nt, hsa; identical to SEQ ID NO: 40677

SEQ ID NO: 435398 - RNA, 64 nt, hsa; identical to SEQ ID NO: 40678

SEQ ID NO: 435399 - RNA, 64 nt, hsa; identical to SEQ ID NO: 40679

SEQ ID NO: 435400 - RNA, 64 nt, hsa; identical to SEQ ID NO: 40680

SEQ ID NO: 435401 - RNA, 64 nt, hsa; identical to SEQ ID NO: 40681

SEQ ID NO: 435402 - RNA, 64 nt, hsa; identical to SEQ ID NO: 40682

SEQ ID NO: 435403 - RNA, 64 nt, hsa; identical to SEQ ID NO: 40683

SEQ ID NO: 435404 - RNA, 64 nt, hsa; identical to SEQ ID NO: 40684

SEQ ID NO: 435405 - RNA, 64 nt, hsa; identical to SEQ ID NO: 40685

SEQ ID NO: 435406 - RNA, 64 nt, hsa; identical to SEQ ID NO: 40686

SEQ ID NO: 435407 - RNA, 64 nt, hsa; identical to SEQ ID NO: 40687

SEQ ID NO: 435408 - RNA, 64 nt, hsa; identical to SEQ ID NO: 40688

SEQ ID NO: 435409 - RNA, 64 nt, hsa; identical to SEQ ID NO: 40689

SEQ ID NO: 435410 - RNA, 64 nt, hsa; identical to SEQ ID NO: 40690

SEQ ID NO: 435411 - RNA, 64 nt, hsa; identical to SEQ ID NO: 40691

SEQ ID NO: 435412 - RNA, 64 nt, hsa; identical to SEQ ID NO: 40692

SEQ ID NO: 435413 - RNA, 64 nt, hsa; identical to SEQ ID NO: 40693

SEQ ID NO: 435414 - RNA, 64 nt, hsa; identical to SEQ ID NO: 40694

SEQ ID NO: 435415 - RNA, 64 nt, hsa; identical to SEQ ID NO: 40695

SEQ ID NO: 435416 - RNA, 64 nt, hsa; identical to SEQ ID NO: 40696

SEQ ID NO: 435417 - RNA, 64 nt, hsa; identical to SEQ ID NO: 40697

SEQ ID NO: 435418 - RNA, 64 nt, hsa; identical to SEQ ID NO: 40698

SEQ ID NO: 435419 - RNA, 64 nt, hsa; identical to SEQ ID NO: 40699

SEQ ID NO: 435420 - RNA, 64 nt, hsa; identical to SEQ ID NO: 40700

SEQ ID NO: 435421 - RNA, 64 nt, hsa; identical to SEQ ID NO: 40701

SEQ ID NO: 435422 - RNA, 64 nt, hsa; identical to SEQ ID NO: 40702

SEQ ID NO: 435423 - RNA, 64 nt, hsa; identical to SEQ ID NO: 40703

SEQ ID NO: 435424 - RNA, 64 nt, hsa; identical to SEQ ID NO: 40704

SEQ ID NO: 435425 - RNA, 64 nt, hsa; identical to SEQ ID NO: 40705

SEQ ID NO: 435426 - RNA, 64 nt, hsa; identical to SEQ ID NO: 40706

SEQ ID NO: 435427 - RNA, 64 nt, hsa; identical to SEQ ID NO: 40707

SEQ ID NO: 435428 - RNA, 64 nt, hsa; identical to SEQ ID NO: 40708

SEQ ID NO: 435429 - RNA, 64 nt, hsa; identical to SEQ ID NO: 40709

SEQ ID NO: 435430 - RNA, 64 nt, hsa; identical to SEQ ID NO: 40710

SEQ ID NO: 435431 - RNA, 64 nt, hsa; identical to SEQ ID NO: 40711

SEQ ID NO: 435432 - RNA, 64 nt, hsa; identical to SEQ ID NO: 40712

SEQ ID NO: 435433 - RNA, 64 nt, hsa; identical to SEQ ID NO: 40713

SEQ ID NO: 435434 - RNA, 64 nt, hsa; identical to SEQ ID NO: 40714

SEQ ID NO: 435435 - RNA, 64 nt, hsa; identical to SEQ ID NO: 40715

SEQ ID NO: 435436 - RNA, 64 nt, hsa; identical to SEQ ID NO: 40716

SEQ ID NO: 435437 - RNA, 64 nt, hsa; identical to SEQ ID NO: 40717

SEQ ID NO: 435438 - RNA, 64 nt, hsa; identical to SEQ ID NO: 40718

SEQ ID NO: 435439 - RNA, 64 nt, hsa; identical to SEQ ID NO: 40719

SEQ ID NO: 435440 - RNA, 64 nt, hsa; identical to SEQ ID NO: 40720

SEQ ID NO: 435441 - RNA, 64 nt, hsa; identical to SEQ ID NO: 40721

SEQ ID NO: 435442 - RNA, 64 nt, hsa; identical to SEQ ID NO: 40722

SEQ ID NO: 435443 - RNA, 64 nt, hsa; identical to SEQ ID NO: 40723

SEQ ID NO: 435444 - RNA, 64 nt, hsa; identical to SEQ ID NO: 40724

SEQ ID NO: 435445 - RNA, 64 nt, hsa; identical to SEQ ID NO: 40725

SEQ ID NO: 435446 - RNA, 64 nt, hsa; identical to SEQ ID NO: 40726

SEQ ID NO: 435447 - RNA, 64 nt, hsa; identical to SEQ ID NO: 40727

SEQ ID NO: 435448 - RNA, 64 nt, hsa; identical to SEQ ID NO: 40728

SEQ ID NO: 435449 - RNA, 64 nt, hsa; identical to SEQ ID NO: 40729

SEQ ID NO: 435450 - RNA, 64 nt, hsa; identical to SEQ ID NO: 40730

SEQ ID NO: 435451 - RNA, 64 nt, hsa; identical to SEQ ID NO: 40731

SEQ ID NO: 435452 - RNA, 64 nt, hsa; identical to SEQ ID NO: 40732

SEQ ID NO: 435453 - RNA, 64 nt, hsa; identical to SEQ ID NO: 40733

SEQ ID NO: 435454 - RNA, 64 nt, hsa; identical to SEQ ID NO: 40734

SEQ ID NO: 435455 - RNA, 64 nt, hsa; identical to SEQ ID NO: 40735

SEQ ID NO: 435456 - RNA, 64 nt, hsa; identical to SEQ ID NO: 40736

SEQ ID NO: 435457 - RNA, 64 nt, hsa; identical to SEQ ID NO: 40737

SEQ ID NO: 435458 - RNA, 64 nt, hsa; identical to SEQ ID NO: 40738

SEQ ID NO: 435459 - RNA, 64 nt, hsa; identical to SEQ ID NO: 40739

SEQ ID NO: 435460 - RNA, 64 nt, hsa; identical to SEQ ID NO: 40740

SEQ ID NO: 435461 - RNA, 64 nt, hsa; identical to SEQ ID NO: 40741

SEQ ID NO: 435462 - RNA, 64 nt, hsa; identical to SEQ ID NO: 40742

SEQ ID NO: 435463 - RNA, 64 nt, hsa; identical to SEQ ID NO: 40743

SEQ ID NO: 435464 - RNA, 64 nt, hsa; identical to SEQ ID NO: 40744

SEQ ID NO: 435465 - RNA, 64 nt, hsa; identical to SEQ ID NO: 40745

SEQ ID NO: 435466 - RNA, 64 nt, hsa; identical to SEQ ID NO: 40746

SEQ ID NO: 435467 - RNA, 64 nt, hsa; identical to SEQ ID NO: 40747

SEQ ID NO: 435468 - RNA, 64 nt, hsa; identical to SEQ ID NO: 40748

SEQ ID NO: 435469 - RNA, 64 nt, hsa; identical to SEQ ID NO: 40749

SEQ ID NO: 435470 - RNA, 64 nt, hsa; identical to SEQ ID NO: 40750

SEQ ID NO: 435471 - RNA, 64 nt, hsa; identical to SEQ ID NO: 40751

SEQ ID NO: 435472 - RNA, 64 nt, hsa; identical to SEQ ID NO: 40752

SEQ ID NO: 435473 - RNA, 64 nt, hsa; identical to SEQ ID NO: 40753

SEQ ID NO: 435474 - RNA, 64 nt, hsa; identical to SEQ ID NO: 40754

SEQ ID NO: 435475 - RNA, 64 nt, hsa; identical to SEQ ID NO: 40755

SEQ ID NO: 435476 - RNA, 64 nt, hsa; identical to SEQ ID NO: 40756

SEQ ID NO: 435477 - RNA, 64 nt, hsa; identical to SEQ ID NO: 40757

SEQ ID NO: 435478 - RNA, 64 nt, hsa; identical to SEQ ID NO: 40758

SEQ ID NO: 435479 - RNA, 64 nt, hsa; identical to SEQ ID NO: 40759

SEQ ID NO: 435480 - RNA, 64 nt, hsa; identical to SEQ ID NO: 40760

SEQ ID NO: 435481 - RNA, 64 nt, hsa; identical to SEQ ID NO: 40761

SEQ ID NO: 435482 - RNA, 64 nt, hsa; identical to SEQ ID NO: 40762

SEQ ID NO: 435483 - RNA, 64 nt, hsa; identical to SEQ ID NO: 40763

SEQ ID NO: 435484 - RNA, 64 nt, hsa; identical to SEQ ID NO: 40764

SEQ ID NO: 435485 - RNA, 64 nt, hsa; identical to SEQ ID NO: 40765

SEQ ID NO: 435486 - RNA, 64 nt, hsa; identical to SEQ ID NO: 40766

SEQ ID NO: 435487 - RNA, 64 nt, hsa; identical to SEQ ID NO: 40767

SEQ ID NO: 435488 - RNA, 64 nt, hsa; identical to SEQ ID NO: 40768

SEQ ID NO: 435489 - RNA, 64 nt, hsa; identical to SEQ ID NO: 40769

SEQ ID NO: 435490 - RNA, 64 nt, hsa; identical to SEQ ID NO: 40770

SEQ ID NO: 435491 - RNA, 64 nt, hsa; identical to SEQ ID NO: 40771

SEQ ID NO: 435492 - RNA, 64 nt, hsa; identical to SEQ ID NO: 40772

SEQ ID NO: 435493 - RNA, 64 nt, hsa; identical to SEQ ID NO: 40773

SEQ ID NO: 435494 - RNA, 64 nt, hsa; identical to SEQ ID NO: 40774

SEQ ID NO: 435495 - RNA, 64 nt, hsa; identical to SEQ ID NO: 40775

SEQ ID NO: 435496 - RNA, 64 nt, hsa; identical to SEQ ID NO: 40776

SEQ ID NO: 435497 - RNA, 64 nt, hsa; identical to SEQ ID NO: 40777

SEQ ID NO: 435498 - RNA, 64 nt, hsa; identical to SEQ ID NO: 40778

SEQ ID NO: 435499 - RNA, 64 nt, hsa; identical to SEQ ID NO: 40779

SEQ ID NO: 435500 - RNA, 64 nt, hsa; identical to SEQ ID NO: 40780

SEQ ID NO: 435501 - RNA, 64 nt, hsa; identical to SEQ ID NO: 40781

SEQ ID NO: 435502 - RNA, 64 nt, hsa; identical to SEQ ID NO: 40782

SEQ ID NO: 435503 - RNA, 64 nt, hsa; identical to SEQ ID NO: 40783

SEQ ID NO: 435504 - RNA, 64 nt, hsa; identical to SEQ ID NO: 40784

SEQ ID NO: 435505 - RNA, 64 nt, hsa; identical to SEQ ID NO: 40785

SEQ ID NO: 435506 - RNA, 64 nt, hsa; identical to SEQ ID NO: 40786

SEQ ID NO: 435507 - RNA, 64 nt, hsa; identical to SEQ ID NO: 40787

SEQ ID NO: 435508 - RNA, 64 nt, hsa; identical to SEQ ID NO: 40788

SEQ ID NO: 435509 - RNA, 64 nt, hsa; identical to SEQ ID NO: 40789

SEQ ID NO: 435510 - RNA, 64 nt, hsa; identical to SEQ ID NO: 40790

SEQ ID NO: 435511 - RNA, 64 nt, hsa; identical to SEQ ID NO: 40791

SEQ ID NO: 435512 - RNA, 64 nt, hsa; identical to SEQ ID NO: 40792

SEQ ID NO: 435513 - RNA, 64 nt, hsa; identical to SEQ ID NO: 40793

SEQ ID NO: 435514 - RNA, 64 nt, hsa; identical to SEQ ID NO: 40794

SEQ ID NO: 435515 - RNA, 64 nt, hsa; identical to SEQ ID NO: 40795

SEQ ID NO: 435516 - RNA, 64 nt, hsa; identical to SEQ ID NO: 40796

SEQ ID NO: 435517 - RNA, 64 nt, hsa; identical to SEQ ID NO: 40797

SEQ ID NO: 435518 - RNA, 64 nt, hsa; identical to SEQ ID NO: 40798

SEQ ID NO: 435519 - RNA, 64 nt, hsa; identical to SEQ ID NO: 40799

SEQ ID NO: 435520 - RNA, 64 nt, hsa; identical to SEQ ID NO: 40800

SEQ ID NO: 435521 - RNA, 64 nt, hsa; identical to SEQ ID NO: 40801

SEQ ID NO: 435522 - RNA, 64 nt, hsa; identical to SEQ ID NO: 40802

SEQ ID NO: 435523 - RNA, 64 nt, hsa; identical to SEQ ID NO: 40803

SEQ ID NO: 435524 - RNA, 64 nt, hsa; identical to SEQ ID NO: 40804

SEQ ID NO: 435525 - RNA, 64 nt, hsa; identical to SEQ ID NO: 40805

SEQ ID NO: 435526 - RNA, 64 nt, hsa; identical to SEQ ID NO: 40806

SEQ ID NO: 435527 - RNA, 64 nt, hsa; identical to SEQ ID NO: 40807

SEQ ID NO: 435528 - RNA, 64 nt, hsa; identical to SEQ ID NO: 40808

SEQ ID NO: 435529 - RNA, 64 nt, hsa; identical to SEQ ID NO: 40809

SEQ ID NO: 435530 - RNA, 64 nt, hsa; identical to SEQ ID NO: 40810

SEQ ID NO: 435531 - RNA, 64 nt, hsa; identical to SEQ ID NO: 40811

SEQ ID NO: 435532 - RNA, 64 nt, hsa; identical to SEQ ID NO: 40812

SEQ ID NO: 435533 - RNA, 64 nt, hsa; identical to SEQ ID NO: 40813

SEQ ID NO: 435534 - RNA, 64 nt, hsa; identical to SEQ ID NO: 40814

SEQ ID NO: 435535 - RNA, 64 nt, hsa; identical to SEQ ID NO: 40815

SEQ ID NO: 435536 - RNA, 64 nt, hsa; identical to SEQ ID NO: 40816

SEQ ID NO: 435537 - RNA, 64 nt, hsa; identical to SEQ ID NO: 40817

SEQ ID NO: 435538 - RNA, 64 nt, hsa; identical to SEQ ID NO: 40818

SEQ ID NO: 435539 - RNA, 64 nt, hsa; identical to SEQ ID NO: 40819

SEQ ID NO: 435540 - RNA, 64 nt, hsa; identical to SEQ ID NO: 40820

SEQ ID NO: 435541 - RNA, 64 nt, hsa; identical to SEQ ID NO: 40821

SEQ ID NO: 435542 - RNA, 64 nt, hsa; identical to SEQ ID NO: 40822

SEQ ID NO: 435543 - RNA, 64 nt, hsa; identical to SEQ ID NO: 40823

SEQ ID NO: 435544 - RNA, 64 nt, hsa; identical to SEQ ID NO: 40824

SEQ ID NO: 435545 - RNA, 64 nt, hsa; identical to SEQ ID NO: 40825

SEQ ID NO: 435546 - RNA, 64 nt, hsa; identical to SEQ ID NO: 40826

SEQ ID NO: 435547 - RNA, 64 nt, hsa; identical to SEQ ID NO: 40827

SEQ ID NO: 435548 - RNA, 64 nt, hsa; identical to SEQ ID NO: 40828

SEQ ID NO: 435549 - RNA, 64 nt, hsa; identical to SEQ ID NO: 40829

SEQ ID NO: 435550 - RNA, 64 nt, hsa; identical to SEQ ID NO: 40830

SEQ ID NO: 435551 - RNA, 64 nt, hsa; identical to SEQ ID NO: 40831

SEQ ID NO: 435552 - RNA, 64 nt, hsa; identical to SEQ ID NO: 40832

SEQ ID NO: 435553 - RNA, 64 nt, hsa; identical to SEQ ID NO: 40833

SEQ ID NO: 435554 - RNA, 64 nt, hsa; identical to SEQ ID NO: 40834

SEQ ID NO: 435555 - RNA, 64 nt, hsa; identical to SEQ ID NO: 40835

SEQ ID NO: 435556 - RNA, 64 nt, hsa; identical to SEQ ID NO: 40836

SEQ ID NO: 435557 - RNA, 64 nt, hsa; identical to SEQ ID NO: 40837

SEQ ID NO: 435558 - RNA, 64 nt, hsa; identical to SEQ ID NO: 40838

SEQ ID NO: 435559 - RNA, 64 nt, hsa; identical to SEQ ID NO: 40839

SEQ ID NO: 435560 - RNA, 64 nt, hsa; identical to SEQ ID NO: 40840

SEQ ID NO: 435561 - RNA, 64 nt, hsa; identical to SEQ ID NO: 40841

SEQ ID NO: 435562 - RNA, 64 nt, hsa; identical to SEQ ID NO: 40842

SEQ ID NO: 435563 - RNA, 64 nt, hsa; identical to SEQ ID NO: 40843

SEQ ID NO: 435564 - RNA, 64 nt, hsa; identical to SEQ ID NO: 40844

SEQ ID NO: 435565 - RNA, 64 nt, hsa; identical to SEQ ID NO: 40845

SEQ ID NO: 435566 - RNA, 64 nt, hsa; identical to SEQ ID NO: 40846

SEQ ID NO: 435567 - RNA, 64 nt, hsa; identical to SEQ ID NO: 40847

SEQ ID NO: 435568 - RNA, 64 nt, hsa; identical to SEQ ID NO: 40848

SEQ ID NO: 435569 - RNA, 64 nt, hsa; identical to SEQ ID NO: 40849

SEQ ID NO: 435570 - RNA, 64 nt, hsa; identical to SEQ ID NO: 40850

SEQ ID NO: 435571 - RNA, 64 nt, hsa; identical to SEQ ID NO: 40851

SEQ ID NO: 435572 - RNA, 64 nt, hsa; identical to SEQ ID NO: 40852

SEQ ID NO: 435573 - RNA, 64 nt, hsa; identical to SEQ ID NO: 40853

SEQ ID NO: 435574 - RNA, 64 nt, hsa; identical to SEQ ID NO: 40854

SEQ ID NO: 435575 - RNA, 64 nt, hsa; identical to SEQ ID NO: 40855

SEQ ID NO: 435576 - RNA, 64 nt, hsa; identical to SEQ ID NO: 40856

SEQ ID NO: 435577 - RNA, 64 nt, hsa; identical to SEQ ID NO: 40857

SEQ ID NO: 435578 - RNA, 64 nt, hsa; identical to SEQ ID NO: 40858

SEQ ID NO: 435579 - RNA, 64 nt, hsa; identical to SEQ ID NO: 40859

SEQ ID NO: 435580 - RNA, 64 nt, hsa; identical to SEQ ID NO: 40860

SEQ ID NO: 435581 - RNA, 64 nt, hsa; identical to SEQ ID NO: 40861

SEQ ID NO: 435582 - RNA, 64 nt, hsa; identical to SEQ ID NO: 40862

SEQ ID NO: 435583 - RNA, 64 nt, hsa; identical to SEQ ID NO: 40863

SEQ ID NO: 435584 - RNA, 64 nt, hsa; identical to SEQ ID NO: 40864

SEQ ID NO: 435585 - RNA, 64 nt, hsa; identical to SEQ ID NO: 40865

SEQ ID NO: 435586 - RNA, 64 nt, hsa; identical to SEQ ID NO: 40866

SEQ ID NO: 435587 - RNA, 64 nt, hsa; identical to SEQ ID NO: 40867

SEQ ID NO: 435588 - RNA, 64 nt, hsa; identical to SEQ ID NO: 40868

SEQ ID NO: 435589 - RNA, 64 nt, hsa; identical to SEQ ID NO: 40869

SEQ ID NO: 435590 - RNA, 64 nt, hsa; identical to SEQ ID NO: 40870

SEQ ID NO: 435591 - RNA, 64 nt, hsa; identical to SEQ ID NO: 40871

SEQ ID NO: 435592 - RNA, 64 nt, hsa; identical to SEQ ID NO: 40872

SEQ ID NO: 435593 - RNA, 64 nt, hsa; identical to SEQ ID NO: 40873

SEQ ID NO: 435594 - RNA, 64 nt, hsa; identical to SEQ ID NO: 40874

SEQ ID NO: 435595 - RNA, 64 nt, hsa; identical to SEQ ID NO: 40875

SEQ ID NO: 435596 - RNA, 64 nt, hsa; identical to SEQ ID NO: 40876

SEQ ID NO: 435597 - RNA, 64 nt, hsa; identical to SEQ ID NO: 40877

SEQ ID NO: 435598 - RNA, 64 nt, hsa; identical to SEQ ID NO: 40878

SEQ ID NO: 435599 - RNA, 64 nt, hsa; identical to SEQ ID NO: 40879

SEQ ID NO: 435600 - RNA, 64 nt, hsa; identical to SEQ ID NO: 40880

SEQ ID NO: 435601 - RNA, 64 nt, hsa; identical to SEQ ID NO: 40881

SEQ ID NO: 435602 - RNA, 64 nt, hsa; identical to SEQ ID NO: 40882

SEQ ID NO: 435603 - RNA, 64 nt, hsa; identical to SEQ ID NO: 40883

SEQ ID NO: 435604 - RNA, 64 nt, hsa; identical to SEQ ID NO: 40884

SEQ ID NO: 435605 - RNA, 64 nt, hsa; identical to SEQ ID NO: 40885

SEQ ID NO: 435606 - RNA, 64 nt, hsa; identical to SEQ ID NO: 40886

SEQ ID NO: 435607 - RNA, 64 nt, hsa; identical to SEQ ID NO: 40887

SEQ ID NO: 435608 - RNA, 64 nt, hsa; identical to SEQ ID NO: 40888

SEQ ID NO: 435609 - RNA, 64 nt, hsa; identical to SEQ ID NO: 40889

SEQ ID NO: 435610 - RNA, 64 nt, hsa; identical to SEQ ID NO: 40890

SEQ ID NO: 435611 - RNA, 64 nt, hsa; identical to SEQ ID NO: 40891

SEQ ID NO: 435612 - RNA, 64 nt, hsa; identical to SEQ ID NO: 40892

SEQ ID NO: 435613 - RNA, 64 nt, hsa; identical to SEQ ID NO: 40893

SEQ ID NO: 435614 - RNA, 64 nt, hsa; identical to SEQ ID NO: 40894

SEQ ID NO: 435615 - RNA, 64 nt, hsa; identical to SEQ ID NO: 40895

SEQ ID NO: 435616 - RNA, 64 nt, hsa; identical to SEQ ID NO: 40896

SEQ ID NO: 435617 - RNA, 64 nt, hsa; identical to SEQ ID NO: 40897

SEQ ID NO: 435618 - RNA, 64 nt, hsa; identical to SEQ ID NO: 40898

SEQ ID NO: 435619 - RNA, 64 nt, hsa; identical to SEQ ID NO: 40899

SEQ ID NO: 435620 - RNA, 64 nt, hsa; identical to SEQ ID NO: 40900

SEQ ID NO: 435621 - RNA, 64 nt, hsa; identical to SEQ ID NO: 40901

SEQ ID NO: 435622 - RNA, 64 nt, hsa; identical to SEQ ID NO: 40902

SEQ ID NO: 435623 - RNA, 64 nt, hsa; identical to SEQ ID NO: 40903

SEQ ID NO: 435624 - RNA, 64 nt, hsa; identical to SEQ ID NO: 40904

SEQ ID NO: 435625 - RNA, 64 nt, hsa; identical to SEQ ID NO: 40905

SEQ ID NO: 435626 - RNA, 64 nt, hsa; identical to SEQ ID NO: 40906

SEQ ID NO: 435627 - RNA, 64 nt, hsa; identical to SEQ ID NO: 40907

SEQ ID NO: 435628 - RNA, 64 nt, hsa; identical to SEQ ID NO: 40908

SEQ ID NO: 435629 - RNA, 64 nt, hsa; identical to SEQ ID NO: 40909

SEQ ID NO: 435630 - RNA, 64 nt, hsa; identical to SEQ ID NO: 40910

SEQ ID NO: 435631 - RNA, 64 nt, hsa; identical to SEQ ID NO: 40911

SEQ ID NO: 435632 - RNA, 64 nt, hsa; identical to SEQ ID NO: 40912

SEQ ID NO: 435633 - RNA, 64 nt, hsa; identical to SEQ ID NO: 40913

SEQ ID NO: 435634 - RNA, 64 nt, hsa; identical to SEQ ID NO: 40914

SEQ ID NO: 435635 - RNA, 64 nt, hsa; identical to SEQ ID NO: 40915

SEQ ID NO: 435636 - RNA, 64 nt, hsa; identical to SEQ ID NO: 40916

SEQ ID NO: 435637 - RNA, 64 nt, hsa; identical to SEQ ID NO: 40917

SEQ ID NO: 435638 - RNA, 64 nt, hsa; identical to SEQ ID NO: 40918

SEQ ID NO: 435639 - RNA, 64 nt, hsa; identical to SEQ ID NO: 40919

SEQ ID NO: 435640 - RNA, 64 nt, hsa; identical to SEQ ID NO: 40920

SEQ ID NO: 435641 - RNA, 64 nt, hsa; identical to SEQ ID NO: 40921

SEQ ID NO: 435642 - RNA, 64 nt, hsa; identical to SEQ ID NO: 40922

SEQ ID NO: 435643 - RNA, 64 nt, hsa; identical to SEQ ID NO: 40923

SEQ ID NO: 435644 - RNA, 64 nt, hsa; identical to SEQ ID NO: 40924

SEQ ID NO: 435645 - RNA, 64 nt, hsa; identical to SEQ ID NO: 40925

SEQ ID NO: 435646 - RNA, 64 nt, hsa; identical to SEQ ID NO: 40926

SEQ ID NO: 435647 - RNA, 64 nt, hsa; identical to SEQ ID NO: 40927

SEQ ID NO: 435648 - RNA, 64 nt, hsa; identical to SEQ ID NO: 40928

SEQ ID NO: 435649 - RNA, 64 nt, hsa; identical to SEQ ID NO: 40929

SEQ ID NO: 435650 - RNA, 64 nt, hsa; identical to SEQ ID NO: 40930

SEQ ID NO: 435651 - RNA, 64 nt, hsa; identical to SEQ ID NO: 40931

SEQ ID NO: 435652 - RNA, 64 nt, hsa; identical to SEQ ID NO: 40932

SEQ ID NO: 435653 - RNA, 64 nt, hsa; identical to SEQ ID NO: 40933

SEQ ID NO: 435654 - RNA, 64 nt, hsa; identical to SEQ ID NO: 40934

SEQ ID NO: 435655 - RNA, 64 nt, hsa; identical to SEQ ID NO: 40935

SEQ ID NO: 435656 - RNA, 64 nt, hsa; identical to SEQ ID NO: 40936

SEQ ID NO: 435657 - RNA, 64 nt, hsa; identical to SEQ ID NO: 40937

SEQ ID NO: 435658 - RNA, 64 nt, hsa; identical to SEQ ID NO: 40938

SEQ ID NO: 435659 - RNA, 64 nt, hsa; identical to SEQ ID NO: 40939

SEQ ID NO: 435660 - RNA, 64 nt, hsa; identical to SEQ ID NO: 40940

SEQ ID NO: 435661 - RNA, 64 nt, hsa; identical to SEQ ID NO: 40941

SEQ ID NO: 435662 - RNA, 64 nt, hsa; identical to SEQ ID NO: 40942

SEQ ID NO: 435663 - RNA, 64 nt, hsa; identical to SEQ ID NO: 40943

SEQ ID NO: 435664 - RNA, 64 nt, hsa; identical to SEQ ID NO: 40944

SEQ ID NO: 435665 - RNA, 64 nt, hsa; identical to SEQ ID NO: 40945

SEQ ID NO: 435666 - RNA, 64 nt, hsa; identical to SEQ ID NO: 40946

SEQ ID NO: 435667 - RNA, 64 nt, hsa; identical to SEQ ID NO: 40947

SEQ ID NO: 435668 - RNA, 64 nt, hsa; identical to SEQ ID NO: 40948

SEQ ID NO: 435669 - RNA, 64 nt, hsa; identical to SEQ ID NO: 40949

SEQ ID NO: 435670 - RNA, 64 nt, hsa; identical to SEQ ID NO: 40950

SEQ ID NO: 435671 - RNA, 64 nt, hsa; identical to SEQ ID NO: 40951

SEQ ID NO: 435672 - RNA, 64 nt, hsa; identical to SEQ ID NO: 40952

SEQ ID NO: 435673 - RNA, 64 nt, hsa; identical to SEQ ID NO: 40953

SEQ ID NO: 435674 - RNA, 64 nt, hsa; identical to SEQ ID NO: 40954

SEQ ID NO: 435675 - RNA, 64 nt, hsa; identical to SEQ ID NO: 40955

SEQ ID NO: 435676 - RNA, 64 nt, hsa; identical to SEQ ID NO: 40956

SEQ ID NO: 435677 - RNA, 64 nt, hsa; identical to SEQ ID NO: 40957

SEQ ID NO: 435678 - RNA, 64 nt, hsa; identical to SEQ ID NO: 40958

SEQ ID NO: 435679 - RNA, 64 nt, hsa; identical to SEQ ID NO: 40959

SEQ ID NO: 435680 - RNA, 64 nt, hsa; identical to SEQ ID NO: 40960

SEQ ID NO: 435681 - RNA, 64 nt, hsa; identical to SEQ ID NO: 40961

SEQ ID NO: 435682 - RNA, 64 nt, hsa; identical to SEQ ID NO: 40962

SEQ ID NO: 435683 - RNA, 64 nt, hsa; identical to SEQ ID NO: 40963

SEQ ID NO: 435684 - RNA, 64 nt, hsa; identical to SEQ ID NO: 40964

SEQ ID NO: 435685 - RNA, 64 nt, hsa; identical to SEQ ID NO: 40965

SEQ ID NO: 435686 - RNA, 64 nt, hsa; identical to SEQ ID NO: 40966

SEQ ID NO: 435687 - RNA, 64 nt, hsa; identical to SEQ ID NO: 40967

SEQ ID NO: 435688 - RNA, 64 nt, hsa; identical to SEQ ID NO: 40968

SEQ ID NO: 435689 - RNA, 64 nt, hsa; identical to SEQ ID NO: 40969

SEQ ID NO: 435690 - RNA, 64 nt, hsa; identical to SEQ ID NO: 40970

SEQ ID NO: 435691 - RNA, 64 nt, hsa; identical to SEQ ID NO: 40971

SEQ ID NO: 435692 - RNA, 64 nt, hsa; identical to SEQ ID NO: 40972

SEQ ID NO: 435693 - RNA, 64 nt, hsa; identical to SEQ ID NO: 40973

SEQ ID NO: 435694 - RNA, 64 nt, hsa; identical to SEQ ID NO: 40974

SEQ ID NO: 435695 - RNA, 64 nt, hsa; identical to SEQ ID NO: 40975

SEQ ID NO: 435696 - RNA, 64 nt, hsa; identical to SEQ ID NO: 40976

SEQ ID NO: 435697 - RNA, 64 nt, hsa; identical to SEQ ID NO: 40977

SEQ ID NO: 435698 - RNA, 64 nt, hsa; identical to SEQ ID NO: 40978

SEQ ID NO: 435699 - RNA, 64 nt, hsa; identical to SEQ ID NO: 40979

SEQ ID NO: 435700 - RNA, 64 nt, hsa; identical to SEQ ID NO: 40980

SEQ ID NO: 435701 - RNA, 64 nt, hsa; identical to SEQ ID NO: 40981

SEQ ID NO: 435702 - RNA, 64 nt, hsa; identical to SEQ ID NO: 40982

SEQ ID NO: 435703 - RNA, 64 nt, hsa; identical to SEQ ID NO: 40983

SEQ ID NO: 435704 - RNA, 64 nt, hsa; identical to SEQ ID NO: 40984

SEQ ID NO: 435705 - RNA, 64 nt, hsa; identical to SEQ ID NO: 40985

SEQ ID NO: 435706 - RNA, 64 nt, hsa; identical to SEQ ID NO: 40986

SEQ ID NO: 435707 - RNA, 64 nt, hsa; identical to SEQ ID NO: 40987

SEQ ID NO: 435708 - RNA, 64 nt, hsa; identical to SEQ ID NO: 40988

SEQ ID NO: 435709 - RNA, 64 nt, hsa; identical to SEQ ID NO: 40989

SEQ ID NO: 435710 - RNA, 64 nt, hsa; identical to SEQ ID NO: 40990

SEQ ID NO: 435711 - RNA, 64 nt, hsa; identical to SEQ ID NO: 40991

SEQ ID NO: 435712 - RNA, 64 nt, hsa; identical to SEQ ID NO: 40992

SEQ ID NO: 435713 - RNA, 64 nt, hsa; identical to SEQ ID NO: 40993

SEQ ID NO: 435714 - RNA, 64 nt, hsa; identical to SEQ ID NO: 40994

SEQ ID NO: 435715 - RNA, 64 nt, hsa; identical to SEQ ID NO: 40995

SEQ ID NO: 435716 - RNA, 64 nt, hsa; identical to SEQ ID NO: 40996

SEQ ID NO: 435717 - RNA, 64 nt, hsa; identical to SEQ ID NO: 40997

SEQ ID NO: 435718 - RNA, 64 nt, hsa; identical to SEQ ID NO: 40998

SEQ ID NO: 435719 - RNA, 64 nt, hsa; identical to SEQ ID NO: 40999

SEQ ID NO: 435720 - RNA, 64 nt, hsa; identical to SEQ ID NO: 41000

SEQ ID NO: 435721 - RNA, 64 nt, hsa; identical to SEQ ID NO: 41001

SEQ ID NO: 435722 - RNA, 64 nt, hsa; identical to SEQ ID NO: 41002

SEQ ID NO: 435723 - RNA, 64 nt, hsa; identical to SEQ ID NO: 41003

SEQ ID NO: 435724 - RNA, 64 nt, hsa; identical to SEQ ID NO: 41004

SEQ ID NO: 435725 - RNA, 64 nt, hsa; identical to SEQ ID NO: 41005

SEQ ID NO: 435726 - RNA, 64 nt, hsa; identical to SEQ ID NO: 41006

SEQ ID NO: 435727 - RNA, 63 nt, hsa; identical to SEQ ID NO: 41007

SEQ ID NO: 435728 - RNA, 64 nt, hsa; identical to SEQ ID NO: 41008

SEQ ID NO: 435729 - RNA, 64 nt, hsa; identical to SEQ ID NO: 41009

SEQ ID NO: 435730 - RNA, 64 nt, hsa; identical to SEQ ID NO: 41010

SEQ ID NO: 435731 - RNA, 64 nt, hsa; identical to SEQ ID NO: 41011

SEQ ID NO: 435732 - RNA, 64 nt, hsa; identical to SEQ ID NO: 41012

SEQ ID NO: 435733 - RNA, 64 nt, hsa; identical to SEQ ID NO: 41013

SEQ ID NO: 435734 - RNA, 64 nt, hsa; identical to SEQ ID NO: 41014

SEQ ID NO: 435735 - RNA, 64 nt, hsa; identical to SEQ ID NO: 41015

SEQ ID NO: 435736 - RNA, 64 nt, hsa; identical to SEQ ID NO: 41016

SEQ ID NO: 435737 - RNA, 64 nt, hsa; identical to SEQ ID NO: 41017

SEQ ID NO: 435738 - RNA, 64 nt, hsa; identical to SEQ ID NO: 41018

SEQ ID NO: 435739 - RNA, 64 nt, hsa; identical to SEQ ID NO: 41019

SEQ ID NO: 435740 - RNA, 64 nt, hsa; identical to SEQ ID NO: 41020

SEQ ID NO: 435741 - RNA, 64 nt, hsa; identical to SEQ ID NO: 41021

SEQ ID NO: 435742 - RNA, 64 nt, hsa; identical to SEQ ID NO: 41022

SEQ ID NO: 435743 - RNA, 64 nt, hsa; identical to SEQ ID NO: 41023

SEQ ID NO: 435744 - RNA, 64 nt, hsa; identical to SEQ ID NO: 41024

SEQ ID NO: 435745 - RNA, 64 nt, hsa; identical to SEQ ID NO: 41025

SEQ ID NO: 435746 - RNA, 64 nt, hsa; identical to SEQ ID NO: 41026

SEQ ID NO: 435747 - RNA, 64 nt, hsa; identical to SEQ ID NO: 41027

SEQ ID NO: 435748 - RNA, 64 nt, hsa; identical to SEQ ID NO: 41028

SEQ ID NO: 435749 - RNA, 64 nt, hsa; identical to SEQ ID NO: 41029

SEQ ID NO: 435750 - RNA, 64 nt, hsa; identical to SEQ ID NO: 41030

SEQ ID NO: 435751 - RNA, 64 nt, hsa; identical to SEQ ID NO: 41031

SEQ ID NO: 435752 - RNA, 64 nt, hsa; identical to SEQ ID NO: 41032

SEQ ID NO: 435753 - RNA, 64 nt, hsa; identical to SEQ ID NO: 41033

SEQ ID NO: 435754 - RNA, 64 nt, hsa; identical to SEQ ID NO: 41034

SEQ ID NO: 435755 - RNA, 64 nt, hsa; identical to SEQ ID NO: 41035

SEQ ID NO: 435756 - RNA, 64 nt, hsa; identical to SEQ ID NO: 41036

SEQ ID NO: 435757 - RNA, 64 nt, hsa; identical to SEQ ID NO: 41037

SEQ ID NO: 435758 - RNA, 64 nt, hsa; identical to SEQ ID NO: 41038

SEQ ID NO: 435759 - RNA, 64 nt, hsa; identical to SEQ ID NO: 41039

SEQ ID NO: 435760 - RNA, 64 nt, hsa; identical to SEQ ID NO: 41040

SEQ ID NO: 435761 - RNA, 64 nt, hsa; identical to SEQ ID NO: 41041

SEQ ID NO: 435762 - RNA, 64 nt, hsa; identical to SEQ ID NO: 41042

SEQ ID NO: 435763 - RNA, 64 nt, hsa; identical to SEQ ID NO: 41043

SEQ ID NO: 435764 - RNA, 64 nt, hsa; identical to SEQ ID NO: 41044

SEQ ID NO: 435765 - RNA, 64 nt, hsa; identical to SEQ ID NO: 41045

SEQ ID NO: 435766 - RNA, 64 nt, hsa; identical to SEQ ID NO: 41046

SEQ ID NO: 435767 - RNA, 64 nt, hsa; identical to SEQ ID NO: 41047

SEQ ID NO: 435768 - RNA, 64 nt, hsa; identical to SEQ ID NO: 41048

SEQ ID NO: 435769 - RNA, 64 nt, hsa; identical to SEQ ID NO: 41049

SEQ ID NO: 435770 - RNA, 64 nt, hsa; identical to SEQ ID NO: 41050

SEQ ID NO: 435771 - RNA, 64 nt, hsa; identical to SEQ ID NO: 41051

SEQ ID NO: 435772 - RNA, 64 nt, hsa; identical to SEQ ID NO: 41052

SEQ ID NO: 435773 - RNA, 64 nt, hsa; identical to SEQ ID NO: 41053

SEQ ID NO: 435774 - RNA, 64 nt, hsa; identical to SEQ ID NO: 41054

SEQ ID NO: 435775 - RNA, 64 nt, hsa; identical to SEQ ID NO: 41055

SEQ ID NO: 435776 - RNA, 64 nt, hsa; identical to SEQ ID NO: 41056

SEQ ID NO: 435777 - RNA, 64 nt, hsa; identical to SEQ ID NO: 41057

SEQ ID NO: 435778 - RNA, 64 nt, hsa; identical to SEQ ID NO: 41058

SEQ ID NO: 435779 - RNA, 64 nt, hsa; identical to SEQ ID NO: 41059

SEQ ID NO: 435780 - RNA, 64 nt, hsa; identical to SEQ ID NO: 41060

SEQ ID NO: 435781 - RNA, 64 nt, hsa; identical to SEQ ID NO: 41061

SEQ ID NO: 435782 - RNA, 64 nt, hsa; identical to SEQ ID NO: 41062

SEQ ID NO: 435783 - RNA, 64 nt, hsa; identical to SEQ ID NO: 41063

SEQ ID NO: 435784 - RNA, 64 nt, hsa; identical to SEQ ID NO: 41064

SEQ ID NO: 435785 - RNA, 64 nt, hsa; identical to SEQ ID NO: 41065

SEQ ID NO: 435786 - RNA, 64 nt, hsa; identical to SEQ ID NO: 41066

SEQ ID NO: 435787 - RNA, 64 nt, hsa; identical to SEQ ID NO: 41067

SEQ ID NO: 435788 - RNA, 64 nt, hsa; identical to SEQ ID NO: 41068

SEQ ID NO: 435789 - RNA, 64 nt, hsa; identical to SEQ ID NO: 41069

SEQ ID NO: 435790 - RNA, 64 nt, hsa; identical to SEQ ID NO: 41070

SEQ ID NO: 435791 - RNA, 64 nt, hsa; identical to SEQ ID NO: 41071

SEQ ID NO: 435792 - RNA, 64 nt, hsa; identical to SEQ ID NO: 41072

SEQ ID NO: 435793 - RNA, 64 nt, hsa; identical to SEQ ID NO: 41073

SEQ ID NO: 435794 - RNA, 64 nt, hsa; identical to SEQ ID NO: 41074

SEQ ID NO: 435795 - RNA, 64 nt, hsa; identical to SEQ ID NO: 41075

SEQ ID NO: 435796 - RNA, 64 nt, hsa; identical to SEQ ID NO: 41076

SEQ ID NO: 435797 - RNA, 64 nt, hsa; identical to SEQ ID NO: 41077

SEQ ID NO: 435798 - RNA, 64 nt, hsa; identical to SEQ ID NO: 41078

SEQ ID NO: 435799 - RNA, 64 nt, hsa; identical to SEQ ID NO: 41079

SEQ ID NO: 435800 - RNA, 64 nt, hsa; identical to SEQ ID NO: 41080

SEQ ID NO: 435801 - RNA, 64 nt, hsa; identical to SEQ ID NO: 41081

SEQ ID NO: 435802 - RNA, 64 nt, hsa; identical to SEQ ID NO: 41082

SEQ ID NO: 435803 - RNA, 64 nt, hsa; identical to SEQ ID NO: 41083

SEQ ID NO: 435804 - RNA, 64 nt, hsa; identical to SEQ ID NO: 41084

SEQ ID NO: 435805 - RNA, 64 nt, hsa; identical to SEQ ID NO: 41085

SEQ ID NO: 435806 - RNA, 64 nt, hsa; identical to SEQ ID NO: 41086

SEQ ID NO: 435807 - RNA, 64 nt, hsa; identical to SEQ ID NO: 41087

SEQ ID NO: 435808 - RNA, 64 nt, hsa; identical to SEQ ID NO: 41088

SEQ ID NO: 435809 - RNA, 64 nt, hsa; identical to SEQ ID NO: 41089

SEQ ID NO: 435810 - RNA, 64 nt, hsa; identical to SEQ ID NO: 41090

SEQ ID NO: 435811 - RNA, 64 nt, hsa; identical to SEQ ID NO: 41091

SEQ ID NO: 435812 - RNA, 64 nt, hsa; identical to SEQ ID NO: 41092

SEQ ID NO: 435813 - RNA, 64 nt, hsa; identical to SEQ ID NO: 41093

SEQ ID NO: 435814 - RNA, 64 nt, hsa; identical to SEQ ID NO: 41094

SEQ ID NO: 435815 - RNA, 64 nt, hsa; identical to SEQ ID NO: 41095

SEQ ID NO: 435816 - RNA, 64 nt, hsa; identical to SEQ ID NO: 41096

SEQ ID NO: 435817 - RNA, 64 nt, hsa; identical to SEQ ID NO: 41097

SEQ ID NO: 435818 - RNA, 64 nt, hsa; identical to SEQ ID NO: 41098

SEQ ID NO: 435819 - RNA, 64 nt, hsa; identical to SEQ ID NO: 41099

SEQ ID NO: 435820 - RNA, 64 nt, hsa; identical to SEQ ID NO: 41100

SEQ ID NO: 435821 - RNA, 64 nt, hsa; identical to SEQ ID NO: 41101

SEQ ID NO: 435822 - RNA, 64 nt, hsa; identical to SEQ ID NO: 41102

SEQ ID NO: 435823 - RNA, 64 nt, hsa; identical to SEQ ID NO: 41103

SEQ ID NO: 435824 - RNA, 64 nt, hsa; identical to SEQ ID NO: 41104

SEQ ID NO: 435825 - RNA, 64 nt, hsa; identical to SEQ ID NO: 41105

SEQ ID NO: 435826 - RNA, 64 nt, hsa; identical to SEQ ID NO: 41106

SEQ ID NO: 435827 - RNA, 64 nt, hsa; identical to SEQ ID NO: 41107

SEQ ID NO: 435828 - RNA, 64 nt, hsa; identical to SEQ ID NO: 41108

SEQ ID NO: 435829 - RNA, 64 nt, hsa; identical to SEQ ID NO: 41109

SEQ ID NO: 435830 - RNA, 64 nt, hsa; identical to SEQ ID NO: 41110

SEQ ID NO: 435831 - RNA, 64 nt, hsa; identical to SEQ ID NO: 41111

SEQ ID NO: 435832 - RNA, 64 nt, hsa; identical to SEQ ID NO: 41112

SEQ ID NO: 435833 - RNA, 64 nt, hsa; identical to SEQ ID NO: 41113

SEQ ID NO: 435834 - RNA, 64 nt, hsa; identical to SEQ ID NO: 41114

SEQ ID NO: 435835 - RNA, 64 nt, hsa; identical to SEQ ID NO: 41115

SEQ ID NO: 435836 - RNA, 64 nt, hsa; identical to SEQ ID NO: 41116

SEQ ID NO: 435837 - RNA, 64 nt, hsa; identical to SEQ ID NO: 41117

SEQ ID NO: 435838 - RNA, 64 nt, hsa; identical to SEQ ID NO: 41118

SEQ ID NO: 435839 - RNA, 64 nt, hsa; identical to SEQ ID NO: 41119

SEQ ID NO: 435840 - RNA, 64 nt, hsa; identical to SEQ ID NO: 41120

SEQ ID NO: 435841 - RNA, 64 nt, hsa; identical to SEQ ID NO: 41121

SEQ ID NO: 435842 - RNA, 64 nt, hsa; identical to SEQ ID NO: 41122

SEQ ID NO: 435843 - RNA, 64 nt, hsa; identical to SEQ ID NO: 41123

SEQ ID NO: 435844 - RNA, 64 nt, hsa; identical to SEQ ID NO: 41124

SEQ ID NO: 435845 - RNA, 64 nt, hsa; identical to SEQ ID NO: 41125

SEQ ID NO: 435846 - RNA, 64 nt, hsa; identical to SEQ ID NO: 41126

SEQ ID NO: 435847 - RNA, 64 nt, hsa; identical to SEQ ID NO: 41127

SEQ ID NO: 435848 - RNA, 64 nt, hsa; identical to SEQ ID NO: 41128

SEQ ID NO: 435849 - RNA, 64 nt, hsa; identical to SEQ ID NO: 41129

SEQ ID NO: 435850 - RNA, 64 nt, hsa; identical to SEQ ID NO: 41130

SEQ ID NO: 435851 - RNA, 64 nt, hsa; identical to SEQ ID NO: 41131

SEQ ID NO: 435852 - RNA, 64 nt, hsa; identical to SEQ ID NO: 41132

SEQ ID NO: 435853 - RNA, 64 nt, hsa; identical to SEQ ID NO: 41133

SEQ ID NO: 435854 - RNA, 64 nt, hsa; identical to SEQ ID NO: 41134

SEQ ID NO: 435855 - RNA, 64 nt, hsa; identical to SEQ ID NO: 41135

SEQ ID NO: 435856 - RNA, 64 nt, hsa; identical to SEQ ID NO: 41136

SEQ ID NO: 435857 - RNA, 64 nt, hsa; identical to SEQ ID NO: 41137

SEQ ID NO: 435858 - RNA, 64 nt, hsa; identical to SEQ ID NO: 41138

SEQ ID NO: 435859 - RNA, 64 nt, hsa; identical to SEQ ID NO: 41139

SEQ ID NO: 435860 - RNA, 64 nt, hsa; identical to SEQ ID NO: 41140

SEQ ID NO: 435861 - RNA, 64 nt, hsa; identical to SEQ ID NO: 41141

SEQ ID NO: 435862 - RNA, 64 nt, hsa; identical to SEQ ID NO: 41142

SEQ ID NO: 435863 - RNA, 64 nt, hsa; identical to SEQ ID NO: 41143

SEQ ID NO: 435864 - RNA, 64 nt, hsa; identical to SEQ ID NO: 41144

SEQ ID NO: 435865 - RNA, 64 nt, hsa; identical to SEQ ID NO: 41145

SEQ ID NO: 435866 - RNA, 64 nt, hsa; identical to SEQ ID NO: 41146

SEQ ID NO: 435867 - RNA, 64 nt, hsa; identical to SEQ ID NO: 41147

SEQ ID NO: 435868 - RNA, 64 nt, hsa; identical to SEQ ID NO: 41148

SEQ ID NO: 435869 - RNA, 64 nt, hsa; identical to SEQ ID NO: 41149

SEQ ID NO: 435870 - RNA, 64 nt, hsa; identical to SEQ ID NO: 41150

SEQ ID NO: 435871 - RNA, 64 nt, hsa; identical to SEQ ID NO: 41151

SEQ ID NO: 435872 - RNA, 64 nt, hsa; identical to SEQ ID NO: 41152

SEQ ID NO: 435873 - RNA, 64 nt, hsa; identical to SEQ ID NO: 41153

SEQ ID NO: 435874 - RNA, 64 nt, hsa; identical to SEQ ID NO: 41154

SEQ ID NO: 435875 - RNA, 64 nt, hsa; identical to SEQ ID NO: 41155

SEQ ID NO: 435876 - RNA, 64 nt, hsa; identical to SEQ ID NO: 41156

SEQ ID NO: 435877 - RNA, 64 nt, hsa; identical to SEQ ID NO: 41157

SEQ ID NO: 435878 - RNA, 64 nt, hsa; identical to SEQ ID NO: 41158

SEQ ID NO: 435879 - RNA, 64 nt, hsa; identical to SEQ ID NO: 41159

SEQ ID NO: 435880 - RNA, 64 nt, hsa; identical to SEQ ID NO: 41160

SEQ ID NO: 435881 - RNA, 64 nt, hsa; identical to SEQ ID NO: 41161

SEQ ID NO: 435882 - RNA, 64 nt, hsa; identical to SEQ ID NO: 41162

SEQ ID NO: 435883 - RNA, 64 nt, hsa; identical to SEQ ID NO: 41163

SEQ ID NO: 435884 - RNA, 64 nt, hsa; identical to SEQ ID NO: 41164

SEQ ID NO: 435885 - RNA, 64 nt, hsa; identical to SEQ ID NO: 41165

SEQ ID NO: 435886 - RNA, 64 nt, hsa; identical to SEQ ID NO: 41166

SEQ ID NO: 435887 - RNA, 64 nt, hsa; identical to SEQ ID NO: 41167

SEQ ID NO: 435888 - RNA, 64 nt, hsa; identical to SEQ ID NO: 41168

SEQ ID NO: 435889 - RNA, 64 nt, hsa; identical to SEQ ID NO: 41169

SEQ ID NO: 435890 - RNA, 64 nt, hsa; identical to SEQ ID NO: 41170

SEQ ID NO: 435891 - RNA, 64 nt, hsa; identical to SEQ ID NO: 41171

SEQ ID NO: 435892 - RNA, 64 nt, hsa; identical to SEQ ID NO: 41172

SEQ ID NO: 435893 - RNA, 64 nt, hsa; identical to SEQ ID NO: 41173

SEQ ID NO: 435894 - RNA, 64 nt, hsa; identical to SEQ ID NO: 41174

SEQ ID NO: 435895 - RNA, 64 nt, hsa; identical to SEQ ID NO: 41175

SEQ ID NO: 435896 - RNA, 64 nt, hsa; identical to SEQ ID NO: 41176

SEQ ID NO: 435897 - RNA, 64 nt, hsa; identical to SEQ ID NO: 41177

SEQ ID NO: 435898 - RNA, 64 nt, hsa; identical to SEQ ID NO: 41178

SEQ ID NO: 435899 - RNA, 64 nt, hsa; identical to SEQ ID NO: 41179

SEQ ID NO: 435900 - RNA, 64 nt, hsa; identical to SEQ ID NO: 41180

SEQ ID NO: 435901 - RNA, 64 nt, hsa; identical to SEQ ID NO: 41181

SEQ ID NO: 435902 - RNA, 64 nt, hsa; identical to SEQ ID NO: 41182

SEQ ID NO: 435903 - RNA, 64 nt, hsa; identical to SEQ ID NO: 41183

SEQ ID NO: 435904 - RNA, 64 nt, hsa; identical to SEQ ID NO: 41184

SEQ ID NO: 435905 - RNA, 64 nt, hsa; identical to SEQ ID NO: 41185

SEQ ID NO: 435906 - RNA, 64 nt, hsa; identical to SEQ ID NO: 41186

SEQ ID NO: 435907 - RNA, 64 nt, hsa; identical to SEQ ID NO: 41187

SEQ ID NO: 435908 - RNA, 64 nt, hsa; identical to SEQ ID NO: 41188

SEQ ID NO: 435909 - RNA, 64 nt, hsa; identical to SEQ ID NO: 41189

SEQ ID NO: 435910 - RNA, 64 nt, hsa; identical to SEQ ID NO: 41190

SEQ ID NO: 435911 - RNA, 64 nt, hsa; identical to SEQ ID NO: 41191

SEQ ID NO: 435912 - RNA, 64 nt, hsa; identical to SEQ ID NO: 41192

SEQ ID NO: 435913 - RNA, 64 nt, hsa; identical to SEQ ID NO: 41193

SEQ ID NO: 435914 - RNA, 64 nt, hsa; identical to SEQ ID NO: 41194

SEQ ID NO: 435915 - RNA, 64 nt, hsa; identical to SEQ ID NO: 41195

SEQ ID NO: 435916 - RNA, 64 nt, hsa; identical to SEQ ID NO: 41196

SEQ ID NO: 435917 - RNA, 64 nt, hsa; identical to SEQ ID NO: 41197

SEQ ID NO: 435918 - RNA, 64 nt, hsa; identical to SEQ ID NO: 41198

SEQ ID NO: 435919 - RNA, 64 nt, hsa; identical to SEQ ID NO: 41199

SEQ ID NO: 435920 - RNA, 64 nt, hsa; identical to SEQ ID NO: 41200

SEQ ID NO: 435921 - RNA, 64 nt, hsa; identical to SEQ ID NO: 41201

SEQ ID NO: 435922 - RNA, 64 nt, hsa; identical to SEQ ID NO: 41202

SEQ ID NO: 435923 - RNA, 64 nt, hsa; identical to SEQ ID NO: 41203

SEQ ID NO: 435924 - RNA, 64 nt, hsa; identical to SEQ ID NO: 41204

SEQ ID NO: 435925 - RNA, 64 nt, hsa; identical to SEQ ID NO: 41205

SEQ ID NO: 435926 - RNA, 64 nt, hsa; identical to SEQ ID NO: 41206

SEQ ID NO: 435927 - RNA, 64 nt, hsa; identical to SEQ ID NO: 41207

SEQ ID NO: 435928 - RNA, 64 nt, hsa; identical to SEQ ID NO: 41208

SEQ ID NO: 435929 - RNA, 64 nt, hsa; identical to SEQ ID NO: 41209

SEQ ID NO: 435930 - RNA, 64 nt, hsa; identical to SEQ ID NO: 41210

SEQ ID NO: 435931 - RNA, 64 nt, hsa; identical to SEQ ID NO: 41211

SEQ ID NO: 435932 - RNA, 64 nt, hsa; identical to SEQ ID NO: 41212

SEQ ID NO: 435933 - RNA, 64 nt, hsa; identical to SEQ ID NO: 41213

SEQ ID NO: 435934 - RNA, 64 nt, hsa; identical to SEQ ID NO: 41214

SEQ ID NO: 435935 - RNA, 64 nt, hsa; identical to SEQ ID NO: 41215

SEQ ID NO: 435936 - RNA, 64 nt, hsa; identical to SEQ ID NO: 41216

SEQ ID NO: 435937 - RNA, 64 nt, hsa; identical to SEQ ID NO: 41217

SEQ ID NO: 435938 - RNA, 64 nt, hsa; identical to SEQ ID NO: 41218

SEQ ID NO: 435939 - RNA, 64 nt, hsa; identical to SEQ ID NO: 41219

SEQ ID NO: 435940 - RNA, 64 nt, hsa; identical to SEQ ID NO: 41220

SEQ ID NO: 435941 - RNA, 64 nt, hsa; identical to SEQ ID NO: 41221

SEQ ID NO: 435942 - RNA, 64 nt, hsa; identical to SEQ ID NO: 41222

SEQ ID NO: 435943 - RNA, 64 nt, hsa; identical to SEQ ID NO: 41223

SEQ ID NO: 435944 - RNA, 64 nt, hsa; identical to SEQ ID NO: 41224

SEQ ID NO: 435945 - RNA, 64 nt, hsa; identical to SEQ ID NO: 41225

SEQ ID NO: 435946 - RNA, 64 nt, hsa; identical to SEQ ID NO: 41226

SEQ ID NO: 435947 - RNA, 64 nt, hsa; identical to SEQ ID NO: 41227

SEQ ID NO: 435948 - RNA, 64 nt, hsa; identical to SEQ ID NO: 41228

SEQ ID NO: 435949 - RNA, 64 nt, hsa; identical to SEQ ID NO: 41229

SEQ ID NO: 435950 - RNA, 64 nt, hsa; identical to SEQ ID NO: 41230

SEQ ID NO: 435951 - RNA, 64 nt, hsa; identical to SEQ ID NO: 41231

SEQ ID NO: 435952 - RNA, 64 nt, hsa; identical to SEQ ID NO: 41232

SEQ ID NO: 435953 - RNA, 64 nt, hsa; identical to SEQ ID NO: 41233

SEQ ID NO: 435954 - RNA, 64 nt, hsa; identical to SEQ ID NO: 41234

SEQ ID NO: 435955 - RNA, 64 nt, hsa; identical to SEQ ID NO: 41235

SEQ ID NO: 435956 - RNA, 62 nt, hsa; identical to SEQ ID NO: 41236

SEQ ID NO: 435957 - RNA, 60 nt, hsa; identical to SEQ ID NO: 41237

SEQ ID NO: 435958 - RNA, 58 nt, hsa; identical to SEQ ID NO: 41238

SEQ ID NO: 435959 - RNA, 56 nt, hsa; identical to SEQ ID NO: 41239

SEQ ID NO: 435960 - RNA, 54 nt, hsa; identical to SEQ ID NO: 41240

SEQ ID NO: 435961 - RNA, 64 nt, hsa; identical to SEQ ID NO: 41241

SEQ ID NO: 435962 - RNA, 64 nt, hsa; identical to SEQ ID NO: 41242

SEQ ID NO: 435963 - RNA, 64 nt, hsa; identical to SEQ ID NO: 41243

SEQ ID NO: 435964 - RNA, 64 nt, hsa; identical to SEQ ID NO: 41244

SEQ ID NO: 435965 - RNA, 64 nt, hsa; identical to SEQ ID NO: 41245

SEQ ID NO: 435966 - RNA, 64 nt, hsa; identical to SEQ ID NO: 41246

SEQ ID NO: 435967 - RNA, 64 nt, hsa; identical to SEQ ID NO: 41247

SEQ ID NO: 435968 - RNA, 64 nt, hsa; identical to SEQ ID NO: 41248

SEQ ID NO: 435969 - RNA, 64 nt, hsa; identical to SEQ ID NO: 41249

SEQ ID NO: 435970 - RNA, 64 nt, hsa; identical to SEQ ID NO: 41250

SEQ ID NO: 435971 - RNA, 64 nt, hsa; identical to SEQ ID NO: 41251

SEQ ID NO: 435972 - RNA, 64 nt, hsa; identical to SEQ ID NO: 41252

SEQ ID NO: 435973 - RNA, 64 nt, hsa; identical to SEQ ID NO: 41253

SEQ ID NO: 435974 - RNA, 64 nt, hsa; identical to SEQ ID NO: 41254

SEQ ID NO: 435975 - RNA, 64 nt, hsa; identical to SEQ ID NO: 41255

SEQ ID NO: 435976 - RNA, 64 nt, hsa; identical to SEQ ID NO: 41256

SEQ ID NO: 435977 - RNA, 64 nt, hsa; identical to SEQ ID NO: 41257

SEQ ID NO: 435978 - RNA, 64 nt, hsa; identical to SEQ ID NO: 41258

SEQ ID NO: 435979 - RNA, 64 nt, hsa; identical to SEQ ID NO: 41259

SEQ ID NO: 435980 - RNA, 64 nt, hsa; identical to SEQ ID NO: 41260

SEQ ID NO: 435981 - RNA, 64 nt, hsa; identical to SEQ ID NO: 41261

SEQ ID NO: 435982 - RNA, 64 nt, hsa; identical to SEQ ID NO: 41262

SEQ ID NO: 435983 - RNA, 64 nt, hsa; identical to SEQ ID NO: 41263

SEQ ID NO: 435984 - RNA, 64 nt, hsa; identical to SEQ ID NO: 41264

SEQ ID NO: 435985 - RNA, 64 nt, hsa; identical to SEQ ID NO: 41265

SEQ ID NO: 435986 - RNA, 64 nt, hsa; identical to SEQ ID NO: 41266

SEQ ID NO: 435987 - RNA, 64 nt, hsa; identical to SEQ ID NO: 41267

SEQ ID NO: 435988 - RNA, 64 nt, hsa; identical to SEQ ID NO: 41268

SEQ ID NO: 435989 - RNA, 64 nt, hsa; identical to SEQ ID NO: 41269

SEQ ID NO: 435990 - RNA, 64 nt, hsa; identical to SEQ ID NO: 41270

SEQ ID NO: 435991 - RNA, 64 nt, hsa; identical to SEQ ID NO: 41271

SEQ ID NO: 435992 - RNA, 64 nt, hsa; identical to SEQ ID NO: 41272

SEQ ID NO: 435993 - RNA, 64 nt, hsa; identical to SEQ ID NO: 41273

SEQ ID NO: 435994 - RNA, 64 nt, hsa; identical to SEQ ID NO: 41274

SEQ ID NO: 435995 - RNA, 64 nt, hsa; identical to SEQ ID NO: 41275

SEQ ID NO: 435996 - RNA, 64 nt, hsa; identical to SEQ ID NO: 41276

SEQ ID NO: 435997 - RNA, 64 nt, hsa; identical to SEQ ID NO: 41277

SEQ ID NO: 435998 - RNA, 64 nt, hsa; identical to SEQ ID NO: 41278

SEQ ID NO: 435999 - RNA, 64 nt, hsa; identical to SEQ ID NO: 41279

SEQ ID NO: 436000 - RNA, 64 nt, hsa; identical to SEQ ID NO: 41280

SEQ ID NO: 436001 - RNA, 64 nt, hsa; identical to SEQ ID NO: 41281

SEQ ID NO: 436002 - RNA, 64 nt, hsa; identical to SEQ ID NO: 41282

SEQ ID NO: 436003 - RNA, 64 nt, hsa; identical to SEQ ID NO: 41283

SEQ ID NO: 436004 - RNA, 64 nt, hsa; identical to SEQ ID NO: 41284

SEQ ID NO: 436005 - RNA, 64 nt, hsa; identical to SEQ ID NO: 41285

SEQ ID NO: 436006 - RNA, 64 nt, hsa; identical to SEQ ID NO: 41286

SEQ ID NO: 436007 - RNA, 64 nt, hsa; identical to SEQ ID NO: 41287

SEQ ID NO: 436008 - RNA, 64 nt, hsa; identical to SEQ ID NO: 41288

SEQ ID NO: 436009 - RNA, 64 nt, hsa; identical to SEQ ID NO: 41289

SEQ ID NO: 436010 - RNA, 64 nt, hsa; identical to SEQ ID NO: 41290

SEQ ID NO: 436011 - RNA, 64 nt, hsa; identical to SEQ ID NO: 41291

SEQ ID NO: 436012 - RNA, 64 nt, hsa; identical to SEQ ID NO: 41292

SEQ ID NO: 436013 - RNA, 64 nt, hsa; identical to SEQ ID NO: 41293

SEQ ID NO: 436014 - RNA, 64 nt, hsa; identical to SEQ ID NO: 41294

SEQ ID NO: 436015 - RNA, 64 nt, hsa; identical to SEQ ID NO: 41295

SEQ ID NO: 436016 - RNA, 64 nt, hsa; identical to SEQ ID NO: 41296

SEQ ID NO: 436017 - RNA, 64 nt, hsa; identical to SEQ ID NO: 41297

SEQ ID NO: 436018 - RNA, 64 nt, hsa; identical to SEQ ID NO: 41298

SEQ ID NO: 436019 - RNA, 64 nt, hsa; identical to SEQ ID NO: 41299

SEQ ID NO: 436020 - RNA, 64 nt, hsa; identical to SEQ ID NO: 41300

SEQ ID NO: 436021 - RNA, 64 nt, hsa; identical to SEQ ID NO: 41301

SEQ ID NO: 436022 - RNA, 64 nt, hsa; identical to SEQ ID NO: 41302

SEQ ID NO: 436023 - RNA, 64 nt, hsa; identical to SEQ ID NO: 41303

SEQ ID NO: 436024 - RNA, 64 nt, hsa; identical to SEQ ID NO: 41304

SEQ ID NO: 436025 - RNA, 64 nt, hsa; identical to SEQ ID NO: 41305

SEQ ID NO: 436026 - RNA, 64 nt, hsa; identical to SEQ ID NO: 41306

SEQ ID NO: 436027 - RNA, 64 nt, hsa; identical to SEQ ID NO: 41307

SEQ ID NO: 436028 - RNA, 64 nt, hsa; identical to SEQ ID NO: 41308

SEQ ID NO: 436029 - RNA, 64 nt, hsa; identical to SEQ ID NO: 41309

SEQ ID NO: 436030 - RNA, 64 nt, hsa; identical to SEQ ID NO: 41310

SEQ ID NO: 436031 - RNA, 64 nt, hsa; identical to SEQ ID NO: 41311

SEQ ID NO: 436032 - RNA, 64 nt, hsa; identical to SEQ ID NO: 41312

SEQ ID NO: 436033 - RNA, 64 nt, hsa; identical to SEQ ID NO: 41313

SEQ ID NO: 436034 - RNA, 64 nt, hsa; identical to SEQ ID NO: 41314

SEQ ID NO: 436035 - RNA, 64 nt, hsa; identical to SEQ ID NO: 41315

SEQ ID NO: 436036 - RNA, 64 nt, hsa; identical to SEQ ID NO: 41316

SEQ ID NO: 436037 - RNA, 64 nt, hsa; identical to SEQ ID NO: 41317

SEQ ID NO: 436038 - RNA, 64 nt, hsa; identical to SEQ ID NO: 41318

SEQ ID NO: 436039 - RNA, 64 nt, hsa; identical to SEQ ID NO: 41319

SEQ ID NO: 436040 - RNA, 64 nt, hsa; identical to SEQ ID NO: 41320

SEQ ID NO: 436041 - RNA, 64 nt, hsa; identical to SEQ ID NO: 41321

SEQ ID NO: 436042 - RNA, 64 nt, hsa; identical to SEQ ID NO: 41322

SEQ ID NO: 436043 - RNA, 64 nt, hsa; identical to SEQ ID NO: 41323

SEQ ID NO: 436044 - RNA, 64 nt, hsa; identical to SEQ ID NO: 41324

SEQ ID NO: 436045 - RNA, 64 nt, hsa; identical to SEQ ID NO: 41325

SEQ ID NO: 436046 - RNA, 64 nt, hsa; identical to SEQ ID NO: 41326

SEQ ID NO: 436047 - RNA, 64 nt, hsa; identical to SEQ ID NO: 41327

SEQ ID NO: 436048 - RNA, 64 nt, hsa; identical to SEQ ID NO: 41328

SEQ ID NO: 436049 - RNA, 64 nt, hsa; identical to SEQ ID NO: 41329

SEQ ID NO: 436050 - RNA, 64 nt, hsa; identical to SEQ ID NO: 41330

SEQ ID NO: 436051 - RNA, 64 nt, hsa; identical to SEQ ID NO: 41331

SEQ ID NO: 436052 - RNA, 64 nt, hsa; identical to SEQ ID NO: 41332

SEQ ID NO: 436053 - RNA, 64 nt, hsa; identical to SEQ ID NO: 41333

SEQ ID NO: 436054 - RNA, 64 nt, hsa; identical to SEQ ID NO: 41334

SEQ ID NO: 436055 - RNA, 64 nt, hsa; identical to SEQ ID NO: 41335

SEQ ID NO: 436056 - RNA, 64 nt, hsa; identical to SEQ ID NO: 41336

SEQ ID NO: 436057 - RNA, 64 nt, hsa; identical to SEQ ID NO: 41337

SEQ ID NO: 436058 - RNA, 64 nt, hsa; identical to SEQ ID NO: 41338

SEQ ID NO: 436059 - RNA, 64 nt, hsa; identical to SEQ ID NO: 41339

SEQ ID NO: 436060 - RNA, 64 nt, hsa; identical to SEQ ID NO: 41340

SEQ ID NO: 436061 - RNA, 64 nt, hsa; identical to SEQ ID NO: 41341

SEQ ID NO: 436062 - RNA, 64 nt, hsa; identical to SEQ ID NO: 41342

SEQ ID NO: 436063 - RNA, 64 nt, hsa; identical to SEQ ID NO: 41343

SEQ ID NO: 436064 - RNA, 64 nt, hsa; identical to SEQ ID NO: 41344

SEQ ID NO: 436065 - RNA, 64 nt, hsa; identical to SEQ ID NO: 41345

SEQ ID NO: 436066 - RNA, 64 nt, hsa; identical to SEQ ID NO: 41346

SEQ ID NO: 436067 - RNA, 64 nt, hsa; identical to SEQ ID NO: 41347

SEQ ID NO: 436068 - RNA, 64 nt, hsa; identical to SEQ ID NO: 41348

SEQ ID NO: 436069 - RNA, 64 nt, hsa; identical to SEQ ID NO: 41349

SEQ ID NO: 436070 - RNA, 64 nt, hsa; identical to SEQ ID NO: 41350

SEQ ID NO: 436071 - RNA, 64 nt, hsa; identical to SEQ ID NO: 41351

SEQ ID NO: 436072 - RNA, 64 nt, hsa; identical to SEQ ID NO: 41352

SEQ ID NO: 436073 - RNA, 64 nt, hsa; identical to SEQ ID NO: 41353

SEQ ID NO: 436074 - RNA, 64 nt, hsa; identical to SEQ ID NO: 41354

SEQ ID NO: 436075 - RNA, 64 nt, hsa; identical to SEQ ID NO: 41355

SEQ ID NO: 436076 - RNA, 64 nt, hsa; identical to SEQ ID NO: 41356

SEQ ID NO: 436077 - RNA, 64 nt, hsa; identical to SEQ ID NO: 41357

SEQ ID NO: 436078 - RNA, 64 nt, hsa; identical to SEQ ID NO: 41358

SEQ ID NO: 436079 - RNA, 64 nt, hsa; identical to SEQ ID NO: 41359

SEQ ID NO: 436080 - RNA, 64 nt, hsa; identical to SEQ ID NO: 41360

SEQ ID NO: 436081 - RNA, 64 nt, hsa; identical to SEQ ID NO: 41361

SEQ ID NO: 436082 - RNA, 64 nt, hsa; identical to SEQ ID NO: 41362

SEQ ID NO: 436083 - RNA, 64 nt, hsa; identical to SEQ ID NO: 41363

SEQ ID NO: 436084 - RNA, 64 nt, hsa; identical to SEQ ID NO: 41364

SEQ ID NO: 436085 - RNA, 64 nt, hsa; identical to SEQ ID NO: 41365

SEQ ID NO: 436086 - RNA, 64 nt, hsa; identical to SEQ ID NO: 41366

SEQ ID NO: 436087 - RNA, 64 nt, hsa; identical to SEQ ID NO: 41367

SEQ ID NO: 436088 - RNA, 64 nt, hsa; identical to SEQ ID NO: 41368

SEQ ID NO: 436089 - RNA, 64 nt, hsa; identical to SEQ ID NO: 41369

SEQ ID NO: 436090 - RNA, 64 nt, hsa; identical to SEQ ID NO: 41370

SEQ ID NO: 436091 - RNA, 64 nt, hsa; identical to SEQ ID NO: 41371

SEQ ID NO: 436092 - RNA, 64 nt, hsa; identical to SEQ ID NO: 41372

SEQ ID NO: 436093 - RNA, 64 nt, hsa; identical to SEQ ID NO: 41373

SEQ ID NO: 436094 - RNA, 64 nt, hsa; identical to SEQ ID NO: 41374

SEQ ID NO: 436095 - RNA, 64 nt, hsa; identical to SEQ ID NO: 41375

SEQ ID NO: 436096 - RNA, 64 nt, hsa; identical to SEQ ID NO: 41376

SEQ ID NO: 436097 - RNA, 64 nt, hsa; identical to SEQ ID NO: 41377

SEQ ID NO: 436098 - RNA, 64 nt, hsa; identical to SEQ ID NO: 41378

SEQ ID NO: 436099 - RNA, 64 nt, hsa; identical to SEQ ID NO: 41379

SEQ ID NO: 436100 - RNA, 64 nt, hsa; identical to SEQ ID NO: 41380

SEQ ID NO: 436101 - RNA, 64 nt, hsa; identical to SEQ ID NO: 41381

SEQ ID NO: 436102 - RNA, 64 nt, hsa; identical to SEQ ID NO: 41382

SEQ ID NO: 436103 - RNA, 64 nt, hsa; identical to SEQ ID NO: 41383

SEQ ID NO: 436104 - RNA, 64 nt, hsa; identical to SEQ ID NO: 41384

SEQ ID NO: 436105 - RNA, 64 nt, hsa; identical to SEQ ID NO: 41385

SEQ ID NO: 436106 - RNA, 64 nt, hsa; identical to SEQ ID NO: 41386

SEQ ID NO: 436107 - RNA, 64 nt, hsa; identical to SEQ ID NO: 41387

SEQ ID NO: 436108 - RNA, 64 nt, hsa; identical to SEQ ID NO: 41388

SEQ ID NO: 436109 - RNA, 64 nt, hsa; identical to SEQ ID NO: 41389

SEQ ID NO: 436110 - RNA, 64 nt, hsa; identical to SEQ ID NO: 41390

SEQ ID NO: 436111 - RNA, 64 nt, hsa; identical to SEQ ID NO: 41391

SEQ ID NO: 436112 - RNA, 64 nt, hsa; identical to SEQ ID NO: 41392

SEQ ID NO: 436113 - RNA, 64 nt, hsa; identical to SEQ ID NO: 41393

SEQ ID NO: 436114 - RNA, 64 nt, hsa; identical to SEQ ID NO: 41394

SEQ ID NO: 436115 - RNA, 64 nt, hsa; identical to SEQ ID NO: 41395

SEQ ID NO: 436116 - RNA, 64 nt, hsa; identical to SEQ ID NO: 41396

SEQ ID NO: 436117 - RNA, 64 nt, hsa; identical to SEQ ID NO: 41397

SEQ ID NO: 436118 - RNA, 64 nt, hsa; identical to SEQ ID NO: 41398

SEQ ID NO: 436119 - RNA, 64 nt, hsa; identical to SEQ ID NO: 41399

SEQ ID NO: 436120 - RNA, 64 nt, hsa; identical to SEQ ID NO: 41400

SEQ ID NO: 436121 - RNA, 64 nt, hsa; identical to SEQ ID NO: 41401

SEQ ID NO: 436122 - RNA, 64 nt, hsa; identical to SEQ ID NO: 41402

SEQ ID NO: 436123 - RNA, 64 nt, hsa; identical to SEQ ID NO: 41403

SEQ ID NO: 436124 - RNA, 64 nt, hsa; identical to SEQ ID NO: 41404

SEQ ID NO: 436125 - RNA, 64 nt, hsa; identical to SEQ ID NO: 41405

SEQ ID NO: 436126 - RNA, 64 nt, hsa; identical to SEQ ID NO: 41406

SEQ ID NO: 436127 - RNA, 64 nt, hsa; identical to SEQ ID NO: 41407

SEQ ID NO: 436128 - RNA, 64 nt, hsa; identical to SEQ ID NO: 41408

SEQ ID NO: 436129 - RNA, 64 nt, hsa; identical to SEQ ID NO: 41409

SEQ ID NO: 436130 - RNA, 64 nt, hsa; identical to SEQ ID NO: 41410

SEQ ID NO: 436131 - RNA, 64 nt, hsa; identical to SEQ ID NO: 41411

SEQ ID NO: 436132 - RNA, 64 nt, hsa; identical to SEQ ID NO: 41412

SEQ ID NO: 436133 - RNA, 64 nt, hsa; identical to SEQ ID NO: 41413

SEQ ID NO: 436134 - RNA, 64 nt, hsa; identical to SEQ ID NO: 41414

SEQ ID NO: 436135 - RNA, 64 nt, hsa; identical to SEQ ID NO: 41415

SEQ ID NO: 436136 - RNA, 64 nt, hsa; identical to SEQ ID NO: 41416

SEQ ID NO: 436137 - RNA, 64 nt, hsa; identical to SEQ ID NO: 41417

SEQ ID NO: 436138 - RNA, 64 nt, hsa; identical to SEQ ID NO: 41418

SEQ ID NO: 436139 - RNA, 64 nt, hsa; identical to SEQ ID NO: 41419

SEQ ID NO: 436140 - RNA, 64 nt, hsa; identical to SEQ ID NO: 41420

SEQ ID NO: 436141 - RNA, 64 nt, hsa; identical to SEQ ID NO: 41421

SEQ ID NO: 436142 - RNA, 64 nt, hsa; identical to SEQ ID NO: 41422

SEQ ID NO: 436143 - RNA, 64 nt, hsa; identical to SEQ ID NO: 41423

SEQ ID NO: 436144 - RNA, 64 nt, hsa; identical to SEQ ID NO: 41424

SEQ ID NO: 436145 - RNA, 64 nt, hsa; identical to SEQ ID NO: 41425

SEQ ID NO: 436146 - RNA, 64 nt, hsa; identical to SEQ ID NO: 41426

SEQ ID NO: 436147 - RNA, 64 nt, hsa; identical to SEQ ID NO: 41427

SEQ ID NO: 436148 - RNA, 64 nt, hsa; identical to SEQ ID NO: 41428

SEQ ID NO: 436149 - RNA, 64 nt, hsa; identical to SEQ ID NO: 41429

SEQ ID NO: 436150 - RNA, 64 nt, hsa; identical to SEQ ID NO: 41430

SEQ ID NO: 436151 - RNA, 64 nt, hsa; identical to SEQ ID NO: 41431

SEQ ID NO: 436152 - RNA, 64 nt, hsa; identical to SEQ ID NO: 41432

SEQ ID NO: 436153 - RNA, 64 nt, hsa; identical to SEQ ID NO: 41433

SEQ ID NO: 436154 - RNA, 64 nt, hsa; identical to SEQ ID NO: 41434

SEQ ID NO: 436155 - RNA, 64 nt, hsa; identical to SEQ ID NO: 41435

SEQ ID NO: 436156 - RNA, 64 nt, hsa; identical to SEQ ID NO: 41436

SEQ ID NO: 436157 - RNA, 64 nt, hsa; identical to SEQ ID NO: 41437

SEQ ID NO: 436158 - RNA, 64 nt, hsa; identical to SEQ ID NO: 41438

SEQ ID NO: 436159 - RNA, 64 nt, hsa; identical to SEQ ID NO: 41439

SEQ ID NO: 436160 - RNA, 64 nt, hsa; identical to SEQ ID NO: 41440

SEQ ID NO: 436161 - RNA, 64 nt, hsa; identical to SEQ ID NO: 41441

SEQ ID NO: 436162 - RNA, 64 nt, hsa; identical to SEQ ID NO: 41442

SEQ ID NO: 436163 - RNA, 64 nt, hsa; identical to SEQ ID NO: 41443

SEQ ID NO: 436164 - RNA, 64 nt, hsa; identical to SEQ ID NO: 41444

SEQ ID NO: 436165 - RNA, 64 nt, hsa; identical to SEQ ID NO: 41445

SEQ ID NO: 436166 - RNA, 64 nt, hsa; identical to SEQ ID NO: 41446

SEQ ID NO: 436167 - RNA, 64 nt, hsa; identical to SEQ ID NO: 41447

SEQ ID NO: 436168 - RNA, 64 nt, hsa; identical to SEQ ID NO: 41448

SEQ ID NO: 436169 - RNA, 64 nt, hsa; identical to SEQ ID NO: 41449

SEQ ID NO: 436170 - RNA, 64 nt, hsa; identical to SEQ ID NO: 41450

SEQ ID NO: 436171 - RNA, 64 nt, hsa; identical to SEQ ID NO: 41451

SEQ ID NO: 436172 - RNA, 64 nt, hsa; identical to SEQ ID NO: 41452

SEQ ID NO: 436173 - RNA, 64 nt, hsa; identical to SEQ ID NO: 41453

SEQ ID NO: 436174 - RNA, 64 nt, hsa; identical to SEQ ID NO: 41454

SEQ ID NO: 436175 - RNA, 64 nt, hsa; identical to SEQ ID NO: 41455

SEQ ID NO: 436176 - RNA, 64 nt, hsa; identical to SEQ ID NO: 41456

SEQ ID NO: 436177 - RNA, 64 nt, hsa; identical to SEQ ID NO: 41457

SEQ ID NO: 436178 - RNA, 64 nt, hsa; identical to SEQ ID NO: 41458

SEQ ID NO: 436179 - RNA, 64 nt, hsa; identical to SEQ ID NO: 41459

SEQ ID NO: 436180 - RNA, 64 nt, hsa; identical to SEQ ID NO: 41460

SEQ ID NO: 436181 - RNA, 64 nt, hsa; identical to SEQ ID NO: 41461

SEQ ID NO: 436182 - RNA, 64 nt, hsa; identical to SEQ ID NO: 41462

SEQ ID NO: 436183 - RNA, 64 nt, hsa; identical to SEQ ID NO: 41463

SEQ ID NO: 436184 - RNA, 64 nt, hsa; identical to SEQ ID NO: 41464

SEQ ID NO: 436185 - RNA, 64 nt, hsa; identical to SEQ ID NO: 41465

SEQ ID NO: 436186 - RNA, 64 nt, hsa; identical to SEQ ID NO: 41466

SEQ ID NO: 436187 - RNA, 64 nt, hsa; identical to SEQ ID NO: 41467

SEQ ID NO: 436188 - RNA, 64 nt, hsa; identical to SEQ ID NO: 41468

SEQ ID NO: 436189 - RNA, 64 nt, hsa; identical to SEQ ID NO: 41469

SEQ ID NO: 436190 - RNA, 64 nt, hsa; identical to SEQ ID NO: 41470

SEQ ID NO: 436191 - RNA, 64 nt, hsa; identical to SEQ ID NO: 41471

SEQ ID NO: 436192 - RNA, 64 nt, hsa; identical to SEQ ID NO: 41472

SEQ ID NO: 436193 - RNA, 64 nt, hsa; identical to SEQ ID NO: 41473

SEQ ID NO: 436194 - RNA, 64 nt, hsa; identical to SEQ ID NO: 41474

SEQ ID NO: 436195 - RNA, 64 nt, hsa; identical to SEQ ID NO: 41475

SEQ ID NO: 436196 - RNA, 64 nt, hsa; identical to SEQ ID NO: 41476

SEQ ID NO: 436197 - RNA, 64 nt, hsa; identical to SEQ ID NO: 41477

SEQ ID NO: 436198 - RNA, 64 nt, hsa; identical to SEQ ID NO: 41478

SEQ ID NO: 436199 - RNA, 64 nt, hsa; identical to SEQ ID NO: 41479

SEQ ID NO: 436200 - RNA, 64 nt, hsa; identical to SEQ ID NO: 41480

SEQ ID NO: 436201 - RNA, 64 nt, hsa; identical to SEQ ID NO: 41481

SEQ ID NO: 436202 - RNA, 64 nt, hsa; identical to SEQ ID NO: 41482

SEQ ID NO: 436203 - RNA, 64 nt, hsa; identical to SEQ ID NO: 41483

SEQ ID NO: 436204 - RNA, 64 nt, hsa; identical to SEQ ID NO: 41484

SEQ ID NO: 436205 - RNA, 64 nt, hsa; identical to SEQ ID NO: 41485

SEQ ID NO: 436206 - RNA, 64 nt, hsa; identical to SEQ ID NO: 41486

SEQ ID NO: 436207 - RNA, 64 nt, hsa; identical to SEQ ID NO: 41487

SEQ ID NO: 436208 - RNA, 64 nt, hsa; identical to SEQ ID NO: 41488

SEQ ID NO: 436209 - RNA, 64 nt, hsa; identical to SEQ ID NO: 41489

SEQ ID NO: 436210 - RNA, 64 nt, hsa; identical to SEQ ID NO: 41490

SEQ ID NO: 436211 - RNA, 64 nt, hsa; identical to SEQ ID NO: 41491

SEQ ID NO: 436212 - RNA, 64 nt, hsa; identical to SEQ ID NO: 41492

SEQ ID NO: 436213 - RNA, 64 nt, hsa; identical to SEQ ID NO: 41493

SEQ ID NO: 436214 - RNA, 64 nt, hsa; identical to SEQ ID NO: 41494

SEQ ID NO: 436215 - RNA, 64 nt, hsa; identical to SEQ ID NO: 41495

SEQ ID NO: 436216 - RNA, 64 nt, hsa; identical to SEQ ID NO: 41496

SEQ ID NO: 436217 - RNA, 64 nt, hsa; identical to SEQ ID NO: 41497

SEQ ID NO: 436218 - RNA, 64 nt, hsa; identical to SEQ ID NO: 41498

SEQ ID NO: 436219 - RNA, 64 nt, hsa; identical to SEQ ID NO: 41499

SEQ ID NO: 436220 - RNA, 64 nt, hsa; identical to SEQ ID NO: 41500

SEQ ID NO: 436221 - RNA, 64 nt, hsa; identical to SEQ ID NO: 41501

SEQ ID NO: 436222 - RNA, 64 nt, hsa; identical to SEQ ID NO: 41502

SEQ ID NO: 436223 - RNA, 64 nt, hsa; identical to SEQ ID NO: 41503

SEQ ID NO: 436224 - RNA, 64 nt, hsa; identical to SEQ ID NO: 41504

SEQ ID NO: 436225 - RNA, 64 nt, hsa; identical to SEQ ID NO: 41505

SEQ ID NO: 436226 - RNA, 64 nt, hsa; identical to SEQ ID NO: 41506

SEQ ID NO: 436227 - RNA, 64 nt, hsa; identical to SEQ ID NO: 41507

SEQ ID NO: 436228 - RNA, 64 nt, hsa; identical to SEQ ID NO: 41508

SEQ ID NO: 436229 - RNA, 64 nt, hsa; identical to SEQ ID NO: 41509

SEQ ID NO: 436230 - RNA, 64 nt, hsa; identical to SEQ ID NO: 41510

SEQ ID NO: 436231 - RNA, 64 nt, hsa; identical to SEQ ID NO: 41511

SEQ ID NO: 436232 - RNA, 64 nt, hsa; identical to SEQ ID NO: 41512

SEQ ID NO: 436233 - RNA, 64 nt, hsa; identical to SEQ ID NO: 41513

SEQ ID NO: 436234 - RNA, 64 nt, hsa; identical to SEQ ID NO: 41514

SEQ ID NO: 436235 - RNA, 64 nt, hsa; identical to SEQ ID NO: 41515

SEQ ID NO: 436236 - RNA, 64 nt, hsa; identical to SEQ ID NO: 41516

SEQ ID NO: 436237 - RNA, 64 nt, hsa; identical to SEQ ID NO: 41517

SEQ ID NO: 436238 - RNA, 64 nt, hsa; identical to SEQ ID NO: 41518

SEQ ID NO: 436239 - RNA, 64 nt, hsa; identical to SEQ ID NO: 41519

SEQ ID NO: 436240 - RNA, 64 nt, hsa; identical to SEQ ID NO: 41520

SEQ ID NO: 436241 - RNA, 64 nt, hsa; identical to SEQ ID NO: 41521

SEQ ID NO: 436242 - RNA, 64 nt, hsa; identical to SEQ ID NO: 41522

SEQ ID NO: 436243 - RNA, 64 nt, hsa; identical to SEQ ID NO: 41523

SEQ ID NO: 436244 - RNA, 64 nt, hsa; identical to SEQ ID NO: 41524

SEQ ID NO: 436245 - RNA, 64 nt, hsa; identical to SEQ ID NO: 41525

SEQ ID NO: 436246 - RNA, 64 nt, hsa; identical to SEQ ID NO: 41526

SEQ ID NO: 436247 - RNA, 64 nt, hsa; identical to SEQ ID NO: 41527

SEQ ID NO: 436248 - RNA, 64 nt, hsa; identical to SEQ ID NO: 41528

SEQ ID NO: 436249 - RNA, 64 nt, hsa; identical to SEQ ID NO: 41529

SEQ ID NO: 436250 - RNA, 64 nt, hsa; identical to SEQ ID NO: 41530

SEQ ID NO: 436251 - RNA, 64 nt, hsa; identical to SEQ ID NO: 41531

SEQ ID NO: 436252 - RNA, 64 nt, hsa; identical to SEQ ID NO: 41532

SEQ ID NO: 436253 - RNA, 64 nt, hsa; identical to SEQ ID NO: 41533

SEQ ID NO: 436254 - RNA, 64 nt, hsa; identical to SEQ ID NO: 41534

SEQ ID NO: 436255 - RNA, 64 nt, hsa; identical to SEQ ID NO: 41535

SEQ ID NO: 436256 - RNA, 64 nt, hsa; identical to SEQ ID NO: 41536

SEQ ID NO: 436257 - RNA, 64 nt, hsa; identical to SEQ ID NO: 41537

SEQ ID NO: 436258 - RNA, 64 nt, hsa; identical to SEQ ID NO: 41538

SEQ ID NO: 436259 - RNA, 64 nt, hsa; identical to SEQ ID NO: 41539

SEQ ID NO: 436260 - RNA, 64 nt, hsa; identical to SEQ ID NO: 41540

SEQ ID NO: 436261 - RNA, 64 nt, hsa; identical to SEQ ID NO: 41541

SEQ ID NO: 436262 - RNA, 64 nt, hsa; identical to SEQ ID NO: 41542

SEQ ID NO: 436263 - RNA, 64 nt, hsa; identical to SEQ ID NO: 41543

SEQ ID NO: 436264 - RNA, 64 nt, hsa; identical to SEQ ID NO: 41544

SEQ ID NO: 436265 - RNA, 64 nt, hsa; identical to SEQ ID NO: 41545

SEQ ID NO: 436266 - RNA, 64 nt, hsa; identical to SEQ ID NO: 41546

SEQ ID NO: 436267 - RNA, 64 nt, hsa; identical to SEQ ID NO: 41547

SEQ ID NO: 436268 - RNA, 64 nt, hsa; identical to SEQ ID NO: 41548

SEQ ID NO: 436269 - RNA, 64 nt, hsa; identical to SEQ ID NO: 41549

SEQ ID NO: 436270 - RNA, 64 nt, hsa; identical to SEQ ID NO: 41550

SEQ ID NO: 436271 - RNA, 64 nt, hsa; identical to SEQ ID NO: 41551

SEQ ID NO: 436272 - RNA, 64 nt, hsa; identical to SEQ ID NO: 41552

SEQ ID NO: 436273 - RNA, 64 nt, hsa; identical to SEQ ID NO: 41553

SEQ ID NO: 436274 - RNA, 64 nt, hsa; identical to SEQ ID NO: 41554

SEQ ID NO: 436275 - RNA, 64 nt, hsa; identical to SEQ ID NO: 41555

SEQ ID NO: 436276 - RNA, 64 nt, hsa; identical to SEQ ID NO: 41556

SEQ ID NO: 436277 - RNA, 64 nt, hsa; identical to SEQ ID NO: 41557

SEQ ID NO: 436278 - RNA, 64 nt, hsa; identical to SEQ ID NO: 41558

SEQ ID NO: 436279 - RNA, 64 nt, hsa; identical to SEQ ID NO: 41559

SEQ ID NO: 436280 - RNA, 64 nt, hsa; identical to SEQ ID NO: 41560

SEQ ID NO: 436281 - RNA, 64 nt, hsa; identical to SEQ ID NO: 41561

SEQ ID NO: 436282 - RNA, 64 nt, hsa; identical to SEQ ID NO: 41562

SEQ ID NO: 436283 - RNA, 64 nt, hsa; identical to SEQ ID NO: 41563

SEQ ID NO: 436284 - RNA, 64 nt, hsa; identical to SEQ ID NO: 41564

SEQ ID NO: 436285 - RNA, 64 nt, hsa; identical to SEQ ID NO: 41565

SEQ ID NO: 436286 - RNA, 64 nt, hsa; identical to SEQ ID NO: 41566

SEQ ID NO: 436287 - RNA, 64 nt, hsa; identical to SEQ ID NO: 41567

SEQ ID NO: 436288 - RNA, 64 nt, hsa; identical to SEQ ID NO: 41568

SEQ ID NO: 436289 - RNA, 64 nt, hsa; identical to SEQ ID NO: 41569

SEQ ID NO: 436290 - RNA, 64 nt, hsa; identical to SEQ ID NO: 41570

SEQ ID NO: 436291 - RNA, 64 nt, hsa; identical to SEQ ID NO: 41571

SEQ ID NO: 436292 - RNA, 64 nt, hsa; identical to SEQ ID NO: 41572

SEQ ID NO: 436293 - RNA, 64 nt, hsa; identical to SEQ ID NO: 41573

SEQ ID NO: 436294 - RNA, 64 nt, hsa; identical to SEQ ID NO: 41574

SEQ ID NO: 436295 - RNA, 64 nt, hsa; identical to SEQ ID NO: 41575

SEQ ID NO: 436296 - RNA, 64 nt, hsa; identical to SEQ ID NO: 41576

SEQ ID NO: 436297 - RNA, 64 nt, hsa; identical to SEQ ID NO: 41577

SEQ ID NO: 436298 - RNA, 64 nt, hsa; identical to SEQ ID NO: 41578

SEQ ID NO: 436299 - RNA, 64 nt, hsa; identical to SEQ ID NO: 41579

SEQ ID NO: 436300 - RNA, 64 nt, hsa; identical to SEQ ID NO: 41580

SEQ ID NO: 436301 - RNA, 64 nt, hsa; identical to SEQ ID NO: 41581

SEQ ID NO: 436302 - RNA, 64 nt, hsa; identical to SEQ ID NO: 41582

SEQ ID NO: 436303 - RNA, 64 nt, hsa; identical to SEQ ID NO: 41583

SEQ ID NO: 436304 - RNA, 64 nt, hsa; identical to SEQ ID NO: 41584

SEQ ID NO: 436305 - RNA, 64 nt, hsa; identical to SEQ ID NO: 41585

SEQ ID NO: 436306 - RNA, 64 nt, hsa; identical to SEQ ID NO: 41586

SEQ ID NO: 436307 - RNA, 64 nt, hsa; identical to SEQ ID NO: 41587

SEQ ID NO: 436308 - RNA, 64 nt, hsa; identical to SEQ ID NO: 41588

SEQ ID NO: 436309 - RNA, 64 nt, hsa; identical to SEQ ID NO: 41589

SEQ ID NO: 436310 - RNA, 64 nt, hsa; identical to SEQ ID NO: 41590

SEQ ID NO: 436311 - RNA, 64 nt, hsa; identical to SEQ ID NO: 41591

SEQ ID NO: 436312 - RNA, 64 nt, hsa; identical to SEQ ID NO: 41592

SEQ ID NO: 436313 - RNA, 64 nt, hsa; identical to SEQ ID NO: 41593

SEQ ID NO: 436314 - RNA, 64 nt, hsa; identical to SEQ ID NO: 41594

SEQ ID NO: 436315 - RNA, 64 nt, hsa; identical to SEQ ID NO: 41595

SEQ ID NO: 436316 - RNA, 64 nt, hsa; identical to SEQ ID NO: 41596

SEQ ID NO: 436317 - RNA, 64 nt, hsa; identical to SEQ ID NO: 41597

SEQ ID NO: 436318 - RNA, 64 nt, hsa; identical to SEQ ID NO: 41598

SEQ ID NO: 436319 - RNA, 64 nt, hsa; identical to SEQ ID NO: 41599

SEQ ID NO: 436320 - RNA, 64 nt, hsa; identical to SEQ ID NO: 41600

SEQ ID NO: 436321 - RNA, 64 nt, hsa; identical to SEQ ID NO: 41601

SEQ ID NO: 436322 - RNA, 64 nt, hsa; identical to SEQ ID NO: 41602

SEQ ID NO: 436323 - RNA, 64 nt, hsa; identical to SEQ ID NO: 41603

SEQ ID NO: 436324 - RNA, 64 nt, hsa; identical to SEQ ID NO: 41604

SEQ ID NO: 436325 - RNA, 64 nt, hsa; identical to SEQ ID NO: 41605

SEQ ID NO: 436326 - RNA, 64 nt, hsa; identical to SEQ ID NO: 41606

SEQ ID NO: 436327 - RNA, 64 nt, hsa; identical to SEQ ID NO: 41607

SEQ ID NO: 436328 - RNA, 64 nt, hsa; identical to SEQ ID NO: 41608

SEQ ID NO: 436329 - RNA, 64 nt, hsa; identical to SEQ ID NO: 41609

SEQ ID NO: 436330 - RNA, 64 nt, hsa; identical to SEQ ID NO: 41610

SEQ ID NO: 436331 - RNA, 64 nt, hsa; identical to SEQ ID NO: 41611

SEQ ID NO: 436332 - RNA, 64 nt, hsa; identical to SEQ ID NO: 41612

SEQ ID NO: 436333 - RNA, 64 nt, hsa; identical to SEQ ID NO: 41613

SEQ ID NO: 436334 - RNA, 64 nt, hsa; identical to SEQ ID NO: 41614

SEQ ID NO: 436335 - RNA, 64 nt, hsa; identical to SEQ ID NO: 41615

SEQ ID NO: 436336 - RNA, 64 nt, hsa; identical to SEQ ID NO: 41616

SEQ ID NO: 436337 - RNA, 64 nt, hsa; identical to SEQ ID NO: 41617

SEQ ID NO: 436338 - RNA, 64 nt, hsa; identical to SEQ ID NO: 41618

SEQ ID NO: 436339 - RNA, 64 nt, hsa; identical to SEQ ID NO: 41619

SEQ ID NO: 436340 - RNA, 64 nt, hsa; identical to SEQ ID NO: 41620

SEQ ID NO: 436341 - RNA, 64 nt, hsa; identical to SEQ ID NO: 41621

SEQ ID NO: 436342 - RNA, 63 nt, hsa; identical to SEQ ID NO: 41622

SEQ ID NO: 436343 - RNA, 64 nt, hsa; identical to SEQ ID NO: 41623

SEQ ID NO: 436344 - RNA, 64 nt, hsa; identical to SEQ ID NO: 41624

SEQ ID NO: 436345 - RNA, 64 nt, hsa; identical to SEQ ID NO: 41625

SEQ ID NO: 436346 - RNA, 64 nt, hsa; identical to SEQ ID NO: 41626

SEQ ID NO: 436347 - RNA, 64 nt, hsa; identical to SEQ ID NO: 41627

SEQ ID NO: 436348 - RNA, 64 nt, hsa; identical to SEQ ID NO: 41628

SEQ ID NO: 436349 - RNA, 64 nt, hsa; identical to SEQ ID NO: 41629

SEQ ID NO: 436350 - RNA, 64 nt, hsa; identical to SEQ ID NO: 41630

SEQ ID NO: 436351 - RNA, 64 nt, hsa; identical to SEQ ID NO: 41631

SEQ ID NO: 436352 - RNA, 64 nt, hsa; identical to SEQ ID NO: 41632

SEQ ID NO: 436353 - RNA, 64 nt, hsa; identical to SEQ ID NO: 41633

SEQ ID NO: 436354 - RNA, 64 nt, hsa; identical to SEQ ID NO: 41634

SEQ ID NO: 436355 - RNA, 64 nt, hsa; identical to SEQ ID NO: 41635

SEQ ID NO: 436356 - RNA, 64 nt, hsa; identical to SEQ ID NO: 41636

SEQ ID NO: 436357 - RNA, 64 nt, hsa; identical to SEQ ID NO: 41637

SEQ ID NO: 436358 - RNA, 64 nt, hsa; identical to SEQ ID NO: 41638

SEQ ID NO: 436359 - RNA, 64 nt, hsa; identical to SEQ ID NO: 41639

SEQ ID NO: 436360 - RNA, 64 nt, hsa; identical to SEQ ID NO: 41640

SEQ ID NO: 436361 - RNA, 64 nt, hsa; identical to SEQ ID NO: 41641

SEQ ID NO: 436362 - RNA, 64 nt, hsa; identical to SEQ ID NO: 41642

SEQ ID NO: 436363 - RNA, 64 nt, hsa; identical to SEQ ID NO: 41643

SEQ ID NO: 436364 - RNA, 64 nt, hsa; identical to SEQ ID NO: 41644

SEQ ID NO: 436365 - RNA, 64 nt, hsa; identical to SEQ ID NO: 41645

SEQ ID NO: 436366 - RNA, 64 nt, hsa; identical to SEQ ID NO: 41646

SEQ ID NO: 436367 - RNA, 64 nt, hsa; identical to SEQ ID NO: 41647

SEQ ID NO: 436368 - RNA, 64 nt, hsa; identical to SEQ ID NO: 41648

SEQ ID NO: 436369 - RNA, 64 nt, hsa; identical to SEQ ID NO: 41649

SEQ ID NO: 436370 - RNA, 64 nt, hsa; identical to SEQ ID NO: 41650

SEQ ID NO: 436371 - RNA, 64 nt, hsa; identical to SEQ ID NO: 41651

SEQ ID NO: 436372 - RNA, 64 nt, hsa; identical to SEQ ID NO: 41652

SEQ ID NO: 436373 - RNA, 64 nt, hsa; identical to SEQ ID NO: 41653

SEQ ID NO: 436374 - RNA, 64 nt, hsa; identical to SEQ ID NO: 41654

SEQ ID NO: 436375 - RNA, 64 nt, hsa; identical to SEQ ID NO: 41655

SEQ ID NO: 436376 - RNA, 64 nt, hsa; identical to SEQ ID NO: 41656

SEQ ID NO: 436377 - RNA, 64 nt, hsa; identical to SEQ ID NO: 41657

SEQ ID NO: 436378 - RNA, 64 nt, hsa; identical to SEQ ID NO: 41658

SEQ ID NO: 436379 - RNA, 64 nt, hsa; identical to SEQ ID NO: 41659

SEQ ID NO: 436380 - RNA, 64 nt, hsa; identical to SEQ ID NO: 41660

SEQ ID NO: 436381 - RNA, 64 nt, hsa; identical to SEQ ID NO: 41661

SEQ ID NO: 436382 - RNA, 64 nt, hsa; identical to SEQ ID NO: 41662

SEQ ID NO: 436383 - RNA, 64 nt, hsa; identical to SEQ ID NO: 41663

SEQ ID NO: 436384 - RNA, 64 nt, hsa; identical to SEQ ID NO: 41664

SEQ ID NO: 436385 - RNA, 64 nt, hsa; identical to SEQ ID NO: 41665

SEQ ID NO: 436386 - RNA, 64 nt, hsa; identical to SEQ ID NO: 41666

SEQ ID NO: 436387 - RNA, 64 nt, hsa; identical to SEQ ID NO: 41667

SEQ ID NO: 436388 - RNA, 64 nt, hsa; identical to SEQ ID NO: 41668

SEQ ID NO: 436389 - RNA, 64 nt, hsa; identical to SEQ ID NO: 41669

SEQ ID NO: 436390 - RNA, 64 nt, hsa; identical to SEQ ID NO: 41670

SEQ ID NO: 436391 - RNA, 64 nt, hsa; identical to SEQ ID NO: 41671

SEQ ID NO: 436392 - RNA, 64 nt, hsa; identical to SEQ ID NO: 41672

SEQ ID NO: 436393 - RNA, 64 nt, hsa; identical to SEQ ID NO: 41673

SEQ ID NO: 436394 - RNA, 64 nt, hsa; identical to SEQ ID NO: 41674

SEQ ID NO: 436395 - RNA, 64 nt, hsa; identical to SEQ ID NO: 41675

SEQ ID NO: 436396 - RNA, 64 nt, hsa; identical to SEQ ID NO: 41676

SEQ ID NO: 436397 - RNA, 64 nt, hsa; identical to SEQ ID NO: 41677

SEQ ID NO: 436398 - RNA, 64 nt, hsa; identical to SEQ ID NO: 41678

SEQ ID NO: 436399 - RNA, 64 nt, hsa; identical to SEQ ID NO: 41679

SEQ ID NO: 436400 - RNA, 64 nt, hsa; identical to SEQ ID NO: 41680

SEQ ID NO: 436401 - RNA, 64 nt, hsa; identical to SEQ ID NO: 41681

SEQ ID NO: 436402 - RNA, 64 nt, hsa; identical to SEQ ID NO: 41682

SEQ ID NO: 436403 - RNA, 64 nt, hsa; identical to SEQ ID NO: 41683

SEQ ID NO: 436404 - RNA, 64 nt, hsa; identical to SEQ ID NO: 41684

SEQ ID NO: 436405 - RNA, 64 nt, hsa; identical to SEQ ID NO: 41685

SEQ ID NO: 436406 - RNA, 64 nt, hsa; identical to SEQ ID NO: 41686

SEQ ID NO: 436407 - RNA, 64 nt, hsa; identical to SEQ ID NO: 41687

SEQ ID NO: 436408 - RNA, 64 nt, hsa; identical to SEQ ID NO: 41688

SEQ ID NO: 436409 - RNA, 64 nt, hsa; identical to SEQ ID NO: 41689

SEQ ID NO: 436410 - RNA, 64 nt, hsa; identical to SEQ ID NO: 41690

SEQ ID NO: 436411 - RNA, 64 nt, hsa; identical to SEQ ID NO: 41691

SEQ ID NO: 436412 - RNA, 64 nt, hsa; identical to SEQ ID NO: 41692

SEQ ID NO: 436413 - RNA, 64 nt, hsa; identical to SEQ ID NO: 41693

SEQ ID NO: 436414 - RNA, 64 nt, hsa; identical to SEQ ID NO: 41694

SEQ ID NO: 436415 - RNA, 64 nt, hsa; identical to SEQ ID NO: 41695

SEQ ID NO: 436416 - RNA, 64 nt, hsa; identical to SEQ ID NO: 41696

SEQ ID NO: 436417 - RNA, 64 nt, hsa; identical to SEQ ID NO: 41697

SEQ ID NO: 436418 - RNA, 64 nt, hsa; identical to SEQ ID NO: 41698

SEQ ID NO: 436419 - RNA, 64 nt, hsa; identical to SEQ ID NO: 41699

SEQ ID NO: 436420 - RNA, 64 nt, hsa; identical to SEQ ID NO: 41700

SEQ ID NO: 436421 - RNA, 64 nt, hsa; identical to SEQ ID NO: 41701

SEQ ID NO: 436422 - RNA, 64 nt, hsa; identical to SEQ ID NO: 41702

SEQ ID NO: 436423 - RNA, 64 nt, hsa; identical to SEQ ID NO: 41703

SEQ ID NO: 436424 - RNA, 64 nt, hsa; identical to SEQ ID NO: 41704

SEQ ID NO: 436425 - RNA, 64 nt, hsa; identical to SEQ ID NO: 41705

SEQ ID NO: 436426 - RNA, 64 nt, hsa; identical to SEQ ID NO: 41706

SEQ ID NO: 436427 - RNA, 64 nt, hsa; identical to SEQ ID NO: 41707

SEQ ID NO: 436428 - RNA, 64 nt, hsa; identical to SEQ ID NO: 41708

SEQ ID NO: 436429 - RNA, 64 nt, hsa; identical to SEQ ID NO: 41709

SEQ ID NO: 436430 - RNA, 64 nt, hsa; identical to SEQ ID NO: 41710

SEQ ID NO: 436431 - RNA, 64 nt, hsa; identical to SEQ ID NO: 41711

SEQ ID NO: 436432 - RNA, 64 nt, hsa; identical to SEQ ID NO: 41712

SEQ ID NO: 436433 - RNA, 64 nt, hsa; identical to SEQ ID NO: 41713

SEQ ID NO: 436434 - RNA, 64 nt, hsa; identical to SEQ ID NO: 41714

SEQ ID NO: 436435 - RNA, 64 nt, hsa; identical to SEQ ID NO: 41715

SEQ ID NO: 436436 - RNA, 64 nt, hsa; identical to SEQ ID NO: 41716

SEQ ID NO: 436437 - RNA, 64 nt, hsa; identical to SEQ ID NO: 41717

SEQ ID NO: 436438 - RNA, 64 nt, hsa; identical to SEQ ID NO: 41718

SEQ ID NO: 436439 - RNA, 64 nt, hsa; identical to SEQ ID NO: 41719

SEQ ID NO: 436440 - RNA, 64 nt, hsa; identical to SEQ ID NO: 41720

SEQ ID NO: 436441 - RNA, 64 nt, hsa; identical to SEQ ID NO: 41721

SEQ ID NO: 436442 - RNA, 64 nt, hsa; identical to SEQ ID NO: 41722

SEQ ID NO: 436443 - RNA, 64 nt, hsa; identical to SEQ ID NO: 41723

SEQ ID NO: 436444 - RNA, 64 nt, hsa; identical to SEQ ID NO: 41724

SEQ ID NO: 436445 - RNA, 64 nt, hsa; identical to SEQ ID NO: 41725

SEQ ID NO: 436446 - RNA, 64 nt, hsa; identical to SEQ ID NO: 41726

SEQ ID NO: 436447 - RNA, 64 nt, hsa; identical to SEQ ID NO: 41727

SEQ ID NO: 436448 - RNA, 64 nt, hsa; identical to SEQ ID NO: 41728

SEQ ID NO: 436449 - RNA, 64 nt, hsa; identical to SEQ ID NO: 41729

SEQ ID NO: 436450 - RNA, 64 nt, hsa; identical to SEQ ID NO: 41730

SEQ ID NO: 436451 - RNA, 64 nt, hsa; identical to SEQ ID NO: 41731

SEQ ID NO: 436452 - RNA, 64 nt, hsa; identical to SEQ ID NO: 41732

SEQ ID NO: 436453 - RNA, 64 nt, hsa; identical to SEQ ID NO: 41733

SEQ ID NO: 436454 - RNA, 64 nt, hsa; identical to SEQ ID NO: 41734

SEQ ID NO: 436455 - RNA, 64 nt, hsa; identical to SEQ ID NO: 41735

SEQ ID NO: 436456 - RNA, 64 nt, hsa; identical to SEQ ID NO: 41736

SEQ ID NO: 436457 - RNA, 64 nt, hsa; identical to SEQ ID NO: 41737

SEQ ID NO: 436458 - RNA, 64 nt, hsa; identical to SEQ ID NO: 41738

SEQ ID NO: 436459 - RNA, 64 nt, hsa; identical to SEQ ID NO: 41739

SEQ ID NO: 436460 - RNA, 64 nt, hsa; identical to SEQ ID NO: 41740

SEQ ID NO: 436461 - RNA, 64 nt, hsa; identical to SEQ ID NO: 41741

SEQ ID NO: 436462 - RNA, 64 nt, hsa; identical to SEQ ID NO: 41742

SEQ ID NO: 436463 - RNA, 64 nt, hsa; identical to SEQ ID NO: 41743

SEQ ID NO: 436464 - RNA, 64 nt, hsa; identical to SEQ ID NO: 41744

SEQ ID NO: 436465 - RNA, 64 nt, hsa; identical to SEQ ID NO: 41745

SEQ ID NO: 436466 - RNA, 64 nt, hsa; identical to SEQ ID NO: 41746

SEQ ID NO: 436467 - RNA, 64 nt, hsa; identical to SEQ ID NO: 41747

SEQ ID NO: 436468 - RNA, 64 nt, hsa; identical to SEQ ID NO: 41748

SEQ ID NO: 436469 - RNA, 64 nt, hsa; identical to SEQ ID NO: 41749

SEQ ID NO: 436470 - RNA, 64 nt, hsa; identical to SEQ ID NO: 41750

SEQ ID NO: 436471 - RNA, 64 nt, hsa; identical to SEQ ID NO: 41751

SEQ ID NO: 436472 - RNA, 64 nt, hsa; identical to SEQ ID NO: 41752

SEQ ID NO: 436473 - RNA, 64 nt, hsa; identical to SEQ ID NO: 41753

SEQ ID NO: 436474 - RNA, 64 nt, hsa; identical to SEQ ID NO: 41754

SEQ ID NO: 436475 - RNA, 64 nt, hsa; identical to SEQ ID NO: 41755

SEQ ID NO: 436476 - RNA, 64 nt, hsa; identical to SEQ ID NO: 41756

SEQ ID NO: 436477 - RNA, 64 nt, hsa; identical to SEQ ID NO: 41757

SEQ ID NO: 436478 - RNA, 64 nt, hsa; identical to SEQ ID NO: 41758

SEQ ID NO: 436479 - RNA, 64 nt, hsa; identical to SEQ ID NO: 41759

SEQ ID NO: 436480 - RNA, 64 nt, hsa; identical to SEQ ID NO: 41760

SEQ ID NO: 436481 - RNA, 64 nt, hsa; identical to SEQ ID NO: 41761

SEQ ID NO: 436482 - RNA, 64 nt, hsa; identical to SEQ ID NO: 41762

SEQ ID NO: 436483 - RNA, 64 nt, hsa; identical to SEQ ID NO: 41763

SEQ ID NO: 436484 - RNA, 64 nt, hsa; identical to SEQ ID NO: 41764

SEQ ID NO: 436485 - RNA, 64 nt, hsa; identical to SEQ ID NO: 41765

SEQ ID NO: 436486 - RNA, 64 nt, hsa; identical to SEQ ID NO: 41766

SEQ ID NO: 436487 - RNA, 64 nt, hsa; identical to SEQ ID NO: 41767

SEQ ID NO: 436488 - RNA, 64 nt, hsa; identical to SEQ ID NO: 41768

SEQ ID NO: 436489 - RNA, 64 nt, hsa; identical to SEQ ID NO: 41769

SEQ ID NO: 436490 - RNA, 64 nt, hsa; identical to SEQ ID NO: 41770

SEQ ID NO: 436491 - RNA, 64 nt, hsa; identical to SEQ ID NO: 41771

SEQ ID NO: 436492 - RNA, 64 nt, hsa; identical to SEQ ID NO: 41772

SEQ ID NO: 436493 - RNA, 64 nt, hsa; identical to SEQ ID NO: 41773

SEQ ID NO: 436494 - RNA, 64 nt, hsa; identical to SEQ ID NO: 41774

SEQ ID NO: 436495 - RNA, 64 nt, hsa; identical to SEQ ID NO: 41775

SEQ ID NO: 436496 - RNA, 64 nt, hsa; identical to SEQ ID NO: 41776

SEQ ID NO: 436497 - RNA, 64 nt, hsa; identical to SEQ ID NO: 41777

SEQ ID NO: 436498 - RNA, 64 nt, hsa; identical to SEQ ID NO: 41778

SEQ ID NO: 436499 - RNA, 64 nt, hsa; identical to SEQ ID NO: 41779

SEQ ID NO: 436500 - RNA, 64 nt, hsa; identical to SEQ ID NO: 41780

SEQ ID NO: 436501 - RNA, 64 nt, hsa; identical to SEQ ID NO: 41781

SEQ ID NO: 436502 - RNA, 64 nt, hsa; identical to SEQ ID NO: 41782

SEQ ID NO: 436503 - RNA, 64 nt, hsa; identical to SEQ ID NO: 41783

SEQ ID NO: 436504 - RNA, 64 nt, hsa; identical to SEQ ID NO: 41784

SEQ ID NO: 436505 - RNA, 64 nt, hsa; identical to SEQ ID NO: 41785

SEQ ID NO: 436506 - RNA, 64 nt, hsa; identical to SEQ ID NO: 41786

SEQ ID NO: 436507 - RNA, 64 nt, hsa; identical to SEQ ID NO: 41787

SEQ ID NO: 436508 - RNA, 64 nt, hsa; identical to SEQ ID NO: 41788

SEQ ID NO: 436509 - RNA, 64 nt, hsa; identical to SEQ ID NO: 41789

SEQ ID NO: 436510 - RNA, 64 nt, hsa; identical to SEQ ID NO: 41790

SEQ ID NO: 436511 - RNA, 64 nt, hsa; identical to SEQ ID NO: 41791

SEQ ID NO: 436512 - RNA, 64 nt, hsa; identical to SEQ ID NO: 41792

SEQ ID NO: 436513 - RNA, 64 nt, hsa; identical to SEQ ID NO: 41793

SEQ ID NO: 436514 - RNA, 64 nt, hsa; identical to SEQ ID NO: 41794

SEQ ID NO: 436515 - RNA, 64 nt, hsa; identical to SEQ ID NO: 41795

SEQ ID NO: 436516 - RNA, 64 nt, hsa; identical to SEQ ID NO: 41796

SEQ ID NO: 436517 - RNA, 64 nt, hsa; identical to SEQ ID NO: 41797

SEQ ID NO: 436518 - RNA, 64 nt, hsa; identical to SEQ ID NO: 41798

SEQ ID NO: 436519 - RNA, 64 nt, hsa; identical to SEQ ID NO: 41799

SEQ ID NO: 436520 - RNA, 64 nt, hsa; identical to SEQ ID NO: 41800

SEQ ID NO: 436521 - RNA, 64 nt, hsa; identical to SEQ ID NO: 41801

SEQ ID NO: 436522 - RNA, 64 nt, hsa; identical to SEQ ID NO: 41802

SEQ ID NO: 436523 - RNA, 64 nt, hsa; identical to SEQ ID NO: 41803

SEQ ID NO: 436524 - RNA, 64 nt, hsa; identical to SEQ ID NO: 41804

SEQ ID NO: 436525 - RNA, 64 nt, hsa; identical to SEQ ID NO: 41805

SEQ ID NO: 436526 - RNA, 64 nt, hsa; identical to SEQ ID NO: 41806

SEQ ID NO: 436527 - RNA, 64 nt, hsa; identical to SEQ ID NO: 41807

SEQ ID NO: 436528 - RNA, 64 nt, hsa; identical to SEQ ID NO: 41808

SEQ ID NO: 436529 - RNA, 64 nt, hsa; identical to SEQ ID NO: 41809

SEQ ID NO: 436530 - RNA, 64 nt, hsa; identical to SEQ ID NO: 41810

SEQ ID NO: 436531 - RNA, 64 nt, hsa; identical to SEQ ID NO: 41811

SEQ ID NO: 436532 - RNA, 64 nt, hsa; identical to SEQ ID NO: 41812

SEQ ID NO: 436533 - RNA, 64 nt, hsa; identical to SEQ ID NO: 41813

SEQ ID NO: 436534 - RNA, 64 nt, hsa; identical to SEQ ID NO: 41814

SEQ ID NO: 436535 - RNA, 64 nt, hsa; identical to SEQ ID NO: 41815

SEQ ID NO: 436536 - RNA, 64 nt, hsa; identical to SEQ ID NO: 41816

SEQ ID NO: 436537 - RNA, 64 nt, hsa; identical to SEQ ID NO: 41817

SEQ ID NO: 436538 - RNA, 64 nt, hsa; identical to SEQ ID NO: 41818

SEQ ID NO: 436539 - RNA, 64 nt, hsa; identical to SEQ ID NO: 41819

SEQ ID NO: 436540 - RNA, 64 nt, hsa; identical to SEQ ID NO: 41820

SEQ ID NO: 436541 - RNA, 64 nt, hsa; identical to SEQ ID NO: 41821

SEQ ID NO: 436542 - RNA, 64 nt, hsa; identical to SEQ ID NO: 41822

SEQ ID NO: 436543 - RNA, 64 nt, hsa; identical to SEQ ID NO: 41823

SEQ ID NO: 436544 - RNA, 64 nt, hsa; identical to SEQ ID NO: 41824

SEQ ID NO: 436545 - RNA, 64 nt, hsa; identical to SEQ ID NO: 41825

SEQ ID NO: 436546 - RNA, 64 nt, hsa; identical to SEQ ID NO: 41826

SEQ ID NO: 436547 - RNA, 64 nt, hsa; identical to SEQ ID NO: 41827

SEQ ID NO: 436548 - RNA, 64 nt, hsa; identical to SEQ ID NO: 41828

SEQ ID NO: 436549 - RNA, 64 nt, hsa; identical to SEQ ID NO: 41829

SEQ ID NO: 436550 - RNA, 64 nt, hsa; identical to SEQ ID NO: 41830

SEQ ID NO: 436551 - RNA, 64 nt, hsa; identical to SEQ ID NO: 41831

SEQ ID NO: 436552 - RNA, 64 nt, hsa; identical to SEQ ID NO: 41832

SEQ ID NO: 436553 - RNA, 64 nt, hsa; identical to SEQ ID NO: 41833

SEQ ID NO: 436554 - RNA, 64 nt, hsa; identical to SEQ ID NO: 41834

SEQ ID NO: 436555 - RNA, 64 nt, hsa; identical to SEQ ID NO: 41835

SEQ ID NO: 436556 - RNA, 64 nt, hsa; identical to SEQ ID NO: 41836

SEQ ID NO: 436557 - RNA, 64 nt, hsa; identical to SEQ ID NO: 41837

SEQ ID NO: 436558 - RNA, 64 nt, hsa; identical to SEQ ID NO: 41838

SEQ ID NO: 436559 - RNA, 64 nt, hsa; identical to SEQ ID NO: 41839

SEQ ID NO: 436560 - RNA, 64 nt, hsa; identical to SEQ ID NO: 41840

SEQ ID NO: 436561 - RNA, 64 nt, hsa; identical to SEQ ID NO: 41841

SEQ ID NO: 436562 - RNA, 64 nt, hsa; identical to SEQ ID NO: 41842

SEQ ID NO: 436563 - RNA, 64 nt, hsa; identical to SEQ ID NO: 41843

SEQ ID NO: 436564 - RNA, 64 nt, hsa; identical to SEQ ID NO: 41844

SEQ ID NO: 436565 - RNA, 64 nt, hsa; identical to SEQ ID NO: 41845

SEQ ID NO: 436566 - RNA, 64 nt, hsa; identical to SEQ ID NO: 41846

SEQ ID NO: 436567 - RNA, 64 nt, hsa; identical to SEQ ID NO: 41847

SEQ ID NO: 436568 - RNA, 64 nt, hsa; identical to SEQ ID NO: 41848

SEQ ID NO: 436569 - RNA, 64 nt, hsa; identical to SEQ ID NO: 41849

SEQ ID NO: 436570 - RNA, 64 nt, hsa; identical to SEQ ID NO: 41850

SEQ ID NO: 436571 - RNA, 64 nt, hsa; identical to SEQ ID NO: 41851

SEQ ID NO: 436572 - RNA, 64 nt, hsa; identical to SEQ ID NO: 41852

SEQ ID NO: 436573 - RNA, 64 nt, hsa; identical to SEQ ID NO: 41853

SEQ ID NO: 436574 - RNA, 64 nt, hsa; identical to SEQ ID NO: 41854

SEQ ID NO: 436575 - RNA, 64 nt, hsa; identical to SEQ ID NO: 41855

SEQ ID NO: 436576 - RNA, 64 nt, hsa; identical to SEQ ID NO: 41856

SEQ ID NO: 436577 - RNA, 64 nt, hsa; identical to SEQ ID NO: 41857

SEQ ID NO: 436578 - RNA, 64 nt, hsa; identical to SEQ ID NO: 41858

SEQ ID NO: 436579 - RNA, 64 nt, hsa; identical to SEQ ID NO: 41859

SEQ ID NO: 436580 - RNA, 64 nt, hsa; identical to SEQ ID NO: 41860

SEQ ID NO: 436581 - RNA, 64 nt, hsa; identical to SEQ ID NO: 41861

SEQ ID NO: 436582 - RNA, 64 nt, hsa; identical to SEQ ID NO: 41862

SEQ ID NO: 436583 - RNA, 64 nt, hsa; identical to SEQ ID NO: 41863

SEQ ID NO: 436584 - RNA, 64 nt, hsa; identical to SEQ ID NO: 41864

SEQ ID NO: 436585 - RNA, 64 nt, hsa; identical to SEQ ID NO: 41865

SEQ ID NO: 436586 - RNA, 64 nt, hsa; identical to SEQ ID NO: 41866

SEQ ID NO: 436587 - RNA, 64 nt, hsa; identical to SEQ ID NO: 41867

SEQ ID NO: 436588 - RNA, 64 nt, hsa; identical to SEQ ID NO: 41868

SEQ ID NO: 436589 - RNA, 64 nt, hsa; identical to SEQ ID NO: 41869

SEQ ID NO: 436590 - RNA, 64 nt, hsa; identical to SEQ ID NO: 41870

SEQ ID NO: 436591 - RNA, 64 nt, hsa; identical to SEQ ID NO: 41871

SEQ ID NO: 436592 - RNA, 64 nt, hsa; identical to SEQ ID NO: 41872

SEQ ID NO: 436593 - RNA, 64 nt, hsa; identical to SEQ ID NO: 41873

SEQ ID NO: 436594 - RNA, 64 nt, hsa; identical to SEQ ID NO: 41874

SEQ ID NO: 436595 - RNA, 64 nt, hsa; identical to SEQ ID NO: 41875

SEQ ID NO: 436596 - RNA, 64 nt, hsa; identical to SEQ ID NO: 41876

SEQ ID NO: 436597 - RNA, 64 nt, hsa; identical to SEQ ID NO: 41877

SEQ ID NO: 436598 - RNA, 64 nt, hsa; identical to SEQ ID NO: 41878

SEQ ID NO: 436599 - RNA, 64 nt, hsa; identical to SEQ ID NO: 41879

SEQ ID NO: 436600 - RNA, 64 nt, hsa; identical to SEQ ID NO: 41880

SEQ ID NO: 436601 - RNA, 64 nt, hsa; identical to SEQ ID NO: 41881

SEQ ID NO: 436602 - RNA, 64 nt, hsa; identical to SEQ ID NO: 41882

SEQ ID NO: 436603 - RNA, 64 nt, hsa; identical to SEQ ID NO: 41883

SEQ ID NO: 436604 - RNA, 64 nt, hsa; identical to SEQ ID NO: 41884

SEQ ID NO: 436605 - RNA, 64 nt, hsa; identical to SEQ ID NO: 41885

SEQ ID NO: 436606 - RNA, 64 nt, hsa; identical to SEQ ID NO: 41886

SEQ ID NO: 436607 - RNA, 64 nt, hsa; identical to SEQ ID NO: 41887

SEQ ID NO: 436608 - RNA, 64 nt, hsa; identical to SEQ ID NO: 41888

SEQ ID NO: 436609 - RNA, 64 nt, hsa; identical to SEQ ID NO: 41889

SEQ ID NO: 436610 - RNA, 64 nt, hsa; identical to SEQ ID NO: 41890

SEQ ID NO: 436611 - RNA, 64 nt, hsa; identical to SEQ ID NO: 41891

SEQ ID NO: 436612 - RNA, 64 nt, hsa; identical to SEQ ID NO: 41892

SEQ ID NO: 436613 - RNA, 64 nt, hsa; identical to SEQ ID NO: 41893

SEQ ID NO: 436614 - RNA, 64 nt, hsa; identical to SEQ ID NO: 41894

SEQ ID NO: 436615 - RNA, 64 nt, hsa; identical to SEQ ID NO: 41895

SEQ ID NO: 436616 - RNA, 64 nt, hsa; identical to SEQ ID NO: 41896

SEQ ID NO: 436617 - RNA, 64 nt, hsa; identical to SEQ ID NO: 41897

SEQ ID NO: 436618 - RNA, 64 nt, hsa; identical to SEQ ID NO: 41898

SEQ ID NO: 436619 - RNA, 64 nt, hsa; identical to SEQ ID NO: 41899

SEQ ID NO: 436620 - RNA, 64 nt, hsa; identical to SEQ ID NO: 41900

SEQ ID NO: 436621 - RNA, 64 nt, hsa; identical to SEQ ID NO: 41901

SEQ ID NO: 436622 - RNA, 64 nt, hsa; identical to SEQ ID NO: 41902

SEQ ID NO: 436623 - RNA, 64 nt, hsa; identical to SEQ ID NO: 41903

SEQ ID NO: 436624 - RNA, 64 nt, hsa; identical to SEQ ID NO: 41904

SEQ ID NO: 436625 - RNA, 64 nt, hsa; identical to SEQ ID NO: 41905

SEQ ID NO: 436626 - RNA, 64 nt, hsa; identical to SEQ ID NO: 41906

SEQ ID NO: 436627 - RNA, 64 nt, hsa; identical to SEQ ID NO: 41907

SEQ ID NO: 436628 - RNA, 64 nt, hsa; identical to SEQ ID NO: 41908

SEQ ID NO: 436629 - RNA, 64 nt, hsa; identical to SEQ ID NO: 41909

SEQ ID NO: 436630 - RNA, 64 nt, hsa; identical to SEQ ID NO: 41910

SEQ ID NO: 436631 - RNA, 64 nt, hsa; identical to SEQ ID NO: 41911

SEQ ID NO: 436632 - RNA, 64 nt, hsa; identical to SEQ ID NO: 41912

SEQ ID NO: 436633 - RNA, 64 nt, hsa; identical to SEQ ID NO: 41913

SEQ ID NO: 436634 - RNA, 64 nt, hsa; identical to SEQ ID NO: 41914

SEQ ID NO: 436635 - RNA, 64 nt, hsa; identical to SEQ ID NO: 41915

SEQ ID NO: 436636 - RNA, 64 nt, hsa; identical to SEQ ID NO: 41916

SEQ ID NO: 436637 - RNA, 64 nt, hsa; identical to SEQ ID NO: 41917

SEQ ID NO: 436638 - RNA, 64 nt, hsa; identical to SEQ ID NO: 41918

SEQ ID NO: 436639 - RNA, 64 nt, hsa; identical to SEQ ID NO: 41919

SEQ ID NO: 436640 - RNA, 64 nt, hsa; identical to SEQ ID NO: 41920

SEQ ID NO: 436641 - RNA, 64 nt, hsa; identical to SEQ ID NO: 41921

SEQ ID NO: 436642 - RNA, 64 nt, hsa; identical to SEQ ID NO: 41922

SEQ ID NO: 436643 - RNA, 64 nt, hsa; identical to SEQ ID NO: 41923

SEQ ID NO: 436644 - RNA, 64 nt, hsa; identical to SEQ ID NO: 41924

SEQ ID NO: 436645 - RNA, 64 nt, hsa; identical to SEQ ID NO: 41925

SEQ ID NO: 436646 - RNA, 64 nt, hsa; identical to SEQ ID NO: 41926

SEQ ID NO: 436647 - RNA, 64 nt, hsa; identical to SEQ ID NO: 41927

SEQ ID NO: 436648 - RNA, 64 nt, hsa; identical to SEQ ID NO: 41928

SEQ ID NO: 436649 - RNA, 64 nt, hsa; identical to SEQ ID NO: 41929

SEQ ID NO: 436650 - RNA, 64 nt, hsa; identical to SEQ ID NO: 41930

SEQ ID NO: 436651 - RNA, 64 nt, hsa; identical to SEQ ID NO: 41931

SEQ ID NO: 436652 - RNA, 64 nt, hsa; identical to SEQ ID NO: 41932

SEQ ID NO: 436653 - RNA, 64 nt, hsa; identical to SEQ ID NO: 41933

SEQ ID NO: 436654 - RNA, 64 nt, hsa; identical to SEQ ID NO: 41934

SEQ ID NO: 436655 - RNA, 64 nt, hsa; identical to SEQ ID NO: 41935

SEQ ID NO: 436656 - RNA, 64 nt, hsa; identical to SEQ ID NO: 41936

SEQ ID NO: 436657 - RNA, 64 nt, hsa; identical to SEQ ID NO: 41937

SEQ ID NO: 436658 - RNA, 64 nt, hsa; identical to SEQ ID NO: 41938

SEQ ID NO: 436659 - RNA, 64 nt, hsa; identical to SEQ ID NO: 41939

SEQ ID NO: 436660 - RNA, 64 nt, hsa; identical to SEQ ID NO: 41940

SEQ ID NO: 436661 - RNA, 64 nt, hsa; identical to SEQ ID NO: 41941

SEQ ID NO: 436662 - RNA, 64 nt, hsa; identical to SEQ ID NO: 41942

SEQ ID NO: 436663 - RNA, 64 nt, hsa; identical to SEQ ID NO: 41943

SEQ ID NO: 436664 - RNA, 64 nt, hsa; identical to SEQ ID NO: 41944

SEQ ID NO: 436665 - RNA, 64 nt, hsa; identical to SEQ ID NO: 41945

SEQ ID NO: 436666 - RNA, 64 nt, hsa; identical to SEQ ID NO: 41946

SEQ ID NO: 436667 - RNA, 64 nt, hsa; identical to SEQ ID NO: 41947

SEQ ID NO: 436668 - RNA, 64 nt, hsa; identical to SEQ ID NO: 41948

SEQ ID NO: 436669 - RNA, 64 nt, hsa; identical to SEQ ID NO: 41949

SEQ ID NO: 436670 - RNA, 64 nt, hsa; identical to SEQ ID NO: 41950

SEQ ID NO: 436671 - RNA, 64 nt, hsa; identical to SEQ ID NO: 41951

SEQ ID NO: 436672 - RNA, 64 nt, hsa; identical to SEQ ID NO: 41952

SEQ ID NO: 436673 - RNA, 64 nt, hsa; identical to SEQ ID NO: 41953

SEQ ID NO: 436674 - RNA, 64 nt, hsa; identical to SEQ ID NO: 41954

SEQ ID NO: 436675 - RNA, 64 nt, hsa; identical to SEQ ID NO: 41955

SEQ ID NO: 436676 - RNA, 64 nt, hsa; identical to SEQ ID NO: 41956

SEQ ID NO: 436677 - RNA, 64 nt, hsa; identical to SEQ ID NO: 41957

SEQ ID NO: 436678 - RNA, 64 nt, hsa; identical to SEQ ID NO: 41958

SEQ ID NO: 436679 - RNA, 64 nt, hsa; identical to SEQ ID NO: 41959

SEQ ID NO: 436680 - RNA, 64 nt, hsa; identical to SEQ ID NO: 41960

SEQ ID NO: 436681 - RNA, 64 nt, hsa; identical to SEQ ID NO: 41961

SEQ ID NO: 436682 - RNA, 64 nt, hsa; identical to SEQ ID NO: 41962

SEQ ID NO: 436683 - RNA, 64 nt, hsa; identical to SEQ ID NO: 41963

SEQ ID NO: 436684 - RNA, 64 nt, hsa; identical to SEQ ID NO: 41964

SEQ ID NO: 436685 - RNA, 64 nt, hsa; identical to SEQ ID NO: 41965

SEQ ID NO: 436686 - RNA, 64 nt, hsa; identical to SEQ ID NO: 41966

SEQ ID NO: 436687 - RNA, 64 nt, hsa; identical to SEQ ID NO: 41967

SEQ ID NO: 436688 - RNA, 64 nt, hsa; identical to SEQ ID NO: 41968

SEQ ID NO: 436689 - RNA, 64 nt, hsa; identical to SEQ ID NO: 41969

SEQ ID NO: 436690 - RNA, 64 nt, hsa; identical to SEQ ID NO: 41970

SEQ ID NO: 436691 - RNA, 64 nt, hsa; identical to SEQ ID NO: 41971

SEQ ID NO: 436692 - RNA, 64 nt, hsa; identical to SEQ ID NO: 41972

SEQ ID NO: 436693 - RNA, 64 nt, hsa; identical to SEQ ID NO: 41973

SEQ ID NO: 436694 - RNA, 64 nt, hsa; identical to SEQ ID NO: 41974

SEQ ID NO: 436695 - RNA, 64 nt, hsa; identical to SEQ ID NO: 41975

SEQ ID NO: 436696 - RNA, 64 nt, hsa; identical to SEQ ID NO: 41976

SEQ ID NO: 436697 - RNA, 64 nt, hsa; identical to SEQ ID NO: 41977

SEQ ID NO: 436698 - RNA, 64 nt, hsa; identical to SEQ ID NO: 41978

SEQ ID NO: 436699 - RNA, 64 nt, hsa; identical to SEQ ID NO: 41979

SEQ ID NO: 436700 - RNA, 64 nt, hsa; identical to SEQ ID NO: 41980

SEQ ID NO: 436701 - RNA, 64 nt, hsa; identical to SEQ ID NO: 41981

SEQ ID NO: 436702 - RNA, 64 nt, hsa; identical to SEQ ID NO: 41982

SEQ ID NO: 436703 - RNA, 64 nt, hsa; identical to SEQ ID NO: 41983

SEQ ID NO: 436704 - RNA, 64 nt, hsa; identical to SEQ ID NO: 41984

SEQ ID NO: 436705 - RNA, 64 nt, hsa; identical to SEQ ID NO: 41985

SEQ ID NO: 436706 - RNA, 64 nt, hsa; identical to SEQ ID NO: 41986

SEQ ID NO: 436707 - RNA, 64 nt, hsa; identical to SEQ ID NO: 41987

SEQ ID NO: 436708 - RNA, 64 nt, hsa; identical to SEQ ID NO: 41988

SEQ ID NO: 436709 - RNA, 64 nt, hsa; identical to SEQ ID NO: 41989

SEQ ID NO: 436710 - RNA, 64 nt, hsa; identical to SEQ ID NO: 41990

SEQ ID NO: 436711 - RNA, 64 nt, hsa; identical to SEQ ID NO: 41991

SEQ ID NO: 436712 - RNA, 64 nt, hsa; identical to SEQ ID NO: 41992

SEQ ID NO: 436713 - RNA, 64 nt, hsa; identical to SEQ ID NO: 41993

SEQ ID NO: 436714 - RNA, 64 nt, hsa; identical to SEQ ID NO: 41994

SEQ ID NO: 436715 - RNA, 64 nt, hsa; identical to SEQ ID NO: 41995

SEQ ID NO: 436716 - RNA, 64 nt, hsa; identical to SEQ ID NO: 41996

SEQ ID NO: 436717 - RNA, 64 nt, hsa; identical to SEQ ID NO: 41997

SEQ ID NO: 436718 - RNA, 64 nt, hsa; identical to SEQ ID NO: 41998

SEQ ID NO: 436719 - RNA, 64 nt, hsa; identical to SEQ ID NO: 41999

SEQ ID NO: 436720 - RNA, 64 nt, hsa; identical to SEQ ID NO: 42000

SEQ ID NO: 436721 - RNA, 64 nt, hsa; identical to SEQ ID NO: 42001

SEQ ID NO: 436722 - RNA, 64 nt, hsa; identical to SEQ ID NO: 42002

SEQ ID NO: 436723 - RNA, 64 nt, hsa; identical to SEQ ID NO: 42003

SEQ ID NO: 436724 - RNA, 64 nt, hsa; identical to SEQ ID NO: 42004

SEQ ID NO: 436725 - RNA, 64 nt, hsa; identical to SEQ ID NO: 42005

SEQ ID NO: 436726 - RNA, 64 nt, hsa; identical to SEQ ID NO: 42006

SEQ ID NO: 436727 - RNA, 64 nt, hsa; identical to SEQ ID NO: 42007

SEQ ID NO: 436728 - RNA, 64 nt, hsa; identical to SEQ ID NO: 42008

SEQ ID NO: 436729 - RNA, 64 nt, hsa; identical to SEQ ID NO: 42009

SEQ ID NO: 436730 - RNA, 64 nt, hsa; identical to SEQ ID NO: 42010

SEQ ID NO: 436731 - RNA, 64 nt, hsa; identical to SEQ ID NO: 42011

SEQ ID NO: 436732 - RNA, 64 nt, hsa; identical to SEQ ID NO: 42012

SEQ ID NO: 436733 - RNA, 64 nt, hsa; identical to SEQ ID NO: 42013

SEQ ID NO: 436734 - RNA, 64 nt, hsa; identical to SEQ ID NO: 42014

SEQ ID NO: 436735 - RNA, 64 nt, hsa; identical to SEQ ID NO: 42015

SEQ ID NO: 436736 - RNA, 64 nt, hsa; identical to SEQ ID NO: 42016

SEQ ID NO: 436737 - RNA, 64 nt, hsa; identical to SEQ ID NO: 42017

SEQ ID NO: 436738 - RNA, 64 nt, hsa; identical to SEQ ID NO: 42018

SEQ ID NO: 436739 - RNA, 64 nt, hsa; identical to SEQ ID NO: 42019

SEQ ID NO: 436740 - RNA, 64 nt, hsa; identical to SEQ ID NO: 42020

SEQ ID NO: 436741 - RNA, 64 nt, hsa; identical to SEQ ID NO: 42021

SEQ ID NO: 436742 - RNA, 64 nt, hsa; identical to SEQ ID NO: 42022

SEQ ID NO: 436743 - RNA, 64 nt, hsa; identical to SEQ ID NO: 42023

SEQ ID NO: 436744 - RNA, 64 nt, hsa; identical to SEQ ID NO: 42024

SEQ ID NO: 436745 - RNA, 64 nt, hsa; identical to SEQ ID NO: 42025

SEQ ID NO: 436746 - RNA, 64 nt, hsa; identical to SEQ ID NO: 42026

SEQ ID NO: 436747 - RNA, 64 nt, hsa; identical to SEQ ID NO: 42027

SEQ ID NO: 436748 - RNA, 64 nt, hsa; identical to SEQ ID NO: 42028

SEQ ID NO: 436749 - RNA, 64 nt, hsa; identical to SEQ ID NO: 42029

SEQ ID NO: 436750 - RNA, 64 nt, hsa; identical to SEQ ID NO: 42030

SEQ ID NO: 436751 - RNA, 64 nt, hsa; identical to SEQ ID NO: 42031

SEQ ID NO: 436752 - RNA, 64 nt, hsa; identical to SEQ ID NO: 42032

SEQ ID NO: 436753 - RNA, 64 nt, hsa; identical to SEQ ID NO: 42033

SEQ ID NO: 436754 - RNA, 64 nt, hsa; identical to SEQ ID NO: 42034

SEQ ID NO: 436755 - RNA, 64 nt, hsa; identical to SEQ ID NO: 42035

SEQ ID NO: 436756 - RNA, 64 nt, hsa; identical to SEQ ID NO: 42036

SEQ ID NO: 436757 - RNA, 64 nt, hsa; identical to SEQ ID NO: 42037

SEQ ID NO: 436758 - RNA, 64 nt, hsa; identical to SEQ ID NO: 42038

SEQ ID NO: 436759 - RNA, 64 nt, hsa; identical to SEQ ID NO: 42039

SEQ ID NO: 436760 - RNA, 64 nt, hsa; identical to SEQ ID NO: 42040

SEQ ID NO: 436761 - RNA, 64 nt, hsa; identical to SEQ ID NO: 42041

SEQ ID NO: 436762 - RNA, 64 nt, hsa; identical to SEQ ID NO: 42042

SEQ ID NO: 436763 - RNA, 64 nt, hsa; identical to SEQ ID NO: 42043

SEQ ID NO: 436764 - RNA, 64 nt, hsa; identical to SEQ ID NO: 42044

SEQ ID NO: 436765 - RNA, 64 nt, hsa; identical to SEQ ID NO: 42045

SEQ ID NO: 436766 - RNA, 64 nt, hsa; identical to SEQ ID NO: 42046

SEQ ID NO: 436767 - RNA, 64 nt, hsa; identical to SEQ ID NO: 42047

SEQ ID NO: 436768 - RNA, 64 nt, hsa; identical to SEQ ID NO: 42048

SEQ ID NO: 436769 - RNA, 64 nt, hsa; identical to SEQ ID NO: 42049

SEQ ID NO: 436770 - RNA, 64 nt, hsa; identical to SEQ ID NO: 42050

SEQ ID NO: 436771 - RNA, 64 nt, hsa; identical to SEQ ID NO: 42051

SEQ ID NO: 436772 - RNA, 64 nt, hsa; identical to SEQ ID NO: 42052

SEQ ID NO: 436773 - RNA, 64 nt, hsa; identical to SEQ ID NO: 42053

SEQ ID NO: 436774 - RNA, 64 nt, hsa; identical to SEQ ID NO: 42054

SEQ ID NO: 436775 - RNA, 64 nt, hsa; identical to SEQ ID NO: 42055

SEQ ID NO: 436776 - RNA, 64 nt, hsa; identical to SEQ ID NO: 42056

SEQ ID NO: 436777 - RNA, 64 nt, hsa; identical to SEQ ID NO: 42057

SEQ ID NO: 436778 - RNA, 64 nt, hsa; identical to SEQ ID NO: 42058

SEQ ID NO: 436779 - RNA, 64 nt, hsa; identical to SEQ ID NO: 42059

SEQ ID NO: 436780 - RNA, 64 nt, hsa; identical to SEQ ID NO: 42060

SEQ ID NO: 436781 - RNA, 64 nt, hsa; identical to SEQ ID NO: 42061

SEQ ID NO: 436782 - RNA, 64 nt, hsa; identical to SEQ ID NO: 42062

SEQ ID NO: 436783 - RNA, 64 nt, hsa; identical to SEQ ID NO: 42063

SEQ ID NO: 436784 - RNA, 64 nt, hsa; identical to SEQ ID NO: 42064

SEQ ID NO: 436785 - RNA, 64 nt, hsa; identical to SEQ ID NO: 42065

SEQ ID NO: 436786 - RNA, 64 nt, hsa; identical to SEQ ID NO: 42066

SEQ ID NO: 436787 - RNA, 64 nt, hsa; identical to SEQ ID NO: 42067

SEQ ID NO: 436788 - RNA, 64 nt, hsa; identical to SEQ ID NO: 42068

SEQ ID NO: 436789 - RNA, 64 nt, hsa; identical to SEQ ID NO: 42069

SEQ ID NO: 436790 - RNA, 64 nt, hsa; identical to SEQ ID NO: 42070

SEQ ID NO: 436791 - RNA, 64 nt, hsa; identical to SEQ ID NO: 42071

SEQ ID NO: 436792 - RNA, 64 nt, hsa; identical to SEQ ID NO: 42072

SEQ ID NO: 436793 - RNA, 64 nt, hsa; identical to SEQ ID NO: 42073

SEQ ID NO: 436794 - RNA, 64 nt, hsa; identical to SEQ ID NO: 42074

SEQ ID NO: 436795 - RNA, 64 nt, hsa; identical to SEQ ID NO: 42075

SEQ ID NO: 436796 - RNA, 64 nt, hsa; identical to SEQ ID NO: 42076

SEQ ID NO: 436797 - RNA, 64 nt, hsa; identical to SEQ ID NO: 42077

SEQ ID NO: 436798 - RNA, 64 nt, hsa; identical to SEQ ID NO: 42078

SEQ ID NO: 436799 - RNA, 64 nt, hsa; identical to SEQ ID NO: 42079

SEQ ID NO: 436800 - RNA, 64 nt, hsa; identical to SEQ ID NO: 42080

SEQ ID NO: 436801 - RNA, 64 nt, hsa; identical to SEQ ID NO: 42081

SEQ ID NO: 436802 - RNA, 64 nt, hsa; identical to SEQ ID NO: 42082

SEQ ID NO: 436803 - RNA, 64 nt, hsa; identical to SEQ ID NO: 42083

SEQ ID NO: 436804 - RNA, 64 nt, hsa; identical to SEQ ID NO: 42084

SEQ ID NO: 436805 - RNA, 64 nt, hsa; identical to SEQ ID NO: 42085

SEQ ID NO: 436806 - RNA, 64 nt, hsa; identical to SEQ ID NO: 42086

SEQ ID NO: 436807 - RNA, 64 nt, hsa; identical to SEQ ID NO: 42087

SEQ ID NO: 436808 - RNA, 64 nt, hsa; identical to SEQ ID NO: 42088

SEQ ID NO: 436809 - RNA, 64 nt, hsa; identical to SEQ ID NO: 42089

SEQ ID NO: 436810 - RNA, 64 nt, hsa; identical to SEQ ID NO: 42090

SEQ ID NO: 436811 - RNA, 64 nt, hsa; identical to SEQ ID NO: 42091

SEQ ID NO: 436812 - RNA, 64 nt, hsa; identical to SEQ ID NO: 42092

SEQ ID NO: 436813 - RNA, 64 nt, hsa; identical to SEQ ID NO: 42093

SEQ ID NO: 436814 - RNA, 64 nt, hsa; identical to SEQ ID NO: 42094

SEQ ID NO: 436815 - RNA, 64 nt, hsa; identical to SEQ ID NO: 42095

SEQ ID NO: 436816 - RNA, 64 nt, hsa; identical to SEQ ID NO: 42096

SEQ ID NO: 436817 - RNA, 64 nt, hsa; identical to SEQ ID NO: 42097

SEQ ID NO: 436818 - RNA, 64 nt, hsa; identical to SEQ ID NO: 42098

SEQ ID NO: 436819 - RNA, 64 nt, hsa; identical to SEQ ID NO: 42099

SEQ ID NO: 436820 - RNA, 64 nt, hsa; identical to SEQ ID NO: 42100

SEQ ID NO: 436821 - RNA, 64 nt, hsa; identical to SEQ ID NO: 42101

SEQ ID NO: 436822 - RNA, 64 nt, hsa; identical to SEQ ID NO: 41907

SEQ ID NO: 436823 - RNA, 64 nt, hsa; identical to SEQ ID NO: 41906

SEQ ID NO: 436824 - RNA, 64 nt, hsa; identical to SEQ ID NO: 41905

SEQ ID NO: 436825 - RNA, 64 nt, hsa; identical to SEQ ID NO: 41904

SEQ ID NO: 436826 - RNA, 64 nt, hsa; identical to SEQ ID NO: 42106

SEQ ID NO: 436827 - RNA, 64 nt, hsa; identical to SEQ ID NO: 42107

SEQ ID NO: 436828 - RNA, 64 nt, hsa; identical to SEQ ID NO: 42108

SEQ ID NO: 436829 - RNA, 64 nt, hsa; identical to SEQ ID NO: 42109

SEQ ID NO: 436830 - RNA, 64 nt, hsa; identical to SEQ ID NO: 42110

SEQ ID NO: 436831 - RNA, 64 nt, hsa; identical to SEQ ID NO: 42111

SEQ ID NO: 436832 - RNA, 64 nt, hsa; identical to SEQ ID NO: 42112

SEQ ID NO: 436833 - RNA, 64 nt, hsa; identical to SEQ ID NO: 42113

SEQ ID NO: 436834 - RNA, 64 nt, hsa; identical to SEQ ID NO: 42114

SEQ ID NO: 436835 - RNA, 64 nt, hsa; identical to SEQ ID NO: 42115

SEQ ID NO: 436836 - RNA, 64 nt, hsa; identical to SEQ ID NO: 42116

SEQ ID NO: 436837 - RNA, 64 nt, hsa; identical to SEQ ID NO: 42117

SEQ ID NO: 436838 - RNA, 64 nt, hsa; identical to SEQ ID NO: 42118

SEQ ID NO: 436839 - RNA, 64 nt, hsa; identical to SEQ ID NO: 42119

SEQ ID NO: 436840 - RNA, 64 nt, hsa; identical to SEQ ID NO: 42120

SEQ ID NO: 436841 - RNA, 64 nt, hsa; identical to SEQ ID NO: 42121

SEQ ID NO: 436842 - RNA, 64 nt, hsa; identical to SEQ ID NO: 42122

SEQ ID NO: 436843 - RNA, 64 nt, hsa; identical to SEQ ID NO: 42123

SEQ ID NO: 436844 - RNA, 64 nt, hsa; identical to SEQ ID NO: 42124

SEQ ID NO: 436845 - RNA, 64 nt, hsa; identical to SEQ ID NO: 42125

SEQ ID NO: 436846 - RNA, 64 nt, hsa; identical to SEQ ID NO: 42126

SEQ ID NO: 436847 - RNA, 64 nt, hsa; identical to SEQ ID NO: 42127

SEQ ID NO: 436848 - RNA, 64 nt, hsa; identical to SEQ ID NO: 42128

SEQ ID NO: 436849 - RNA, 64 nt, hsa; identical to SEQ ID NO: 42129

SEQ ID NO: 436850 - RNA, 64 nt, hsa; identical to SEQ ID NO: 42130

SEQ ID NO: 436851 - RNA, 64 nt, hsa; identical to SEQ ID NO: 42131

SEQ ID NO: 436852 - RNA, 64 nt, hsa; identical to SEQ ID NO: 42132

SEQ ID NO: 436853 - RNA, 64 nt, hsa; identical to SEQ ID NO: 42133

SEQ ID NO: 436854 - RNA, 64 nt, hsa; identical to SEQ ID NO: 42134

SEQ ID NO: 436855 - RNA, 64 nt, hsa; identical to SEQ ID NO: 42135

SEQ ID NO: 436856 - RNA, 64 nt, hsa; identical to SEQ ID NO: 42136

SEQ ID NO: 436857 - RNA, 64 nt, hsa; identical to SEQ ID NO: 42137

SEQ ID NO: 436858 - RNA, 64 nt, hsa; identical to SEQ ID NO: 42138

SEQ ID NO: 436859 - RNA, 64 nt, hsa; identical to SEQ ID NO: 42139

SEQ ID NO: 436860 - RNA, 64 nt, hsa; identical to SEQ ID NO: 42140

SEQ ID NO: 436861 - RNA, 64 nt, hsa; identical to SEQ ID NO: 42141

SEQ ID NO: 436862 - RNA, 64 nt, hsa; identical to SEQ ID NO: 42142

SEQ ID NO: 436863 - RNA, 64 nt, hsa; identical to SEQ ID NO: 42143

SEQ ID NO: 436864 - RNA, 64 nt, hsa; identical to SEQ ID NO: 42144

SEQ ID NO: 436865 - RNA, 64 nt, hsa; identical to SEQ ID NO: 42145

SEQ ID NO: 436866 - RNA, 64 nt, hsa; identical to SEQ ID NO: 42146

SEQ ID NO: 436867 - RNA, 64 nt, hsa; identical to SEQ ID NO: 42147

SEQ ID NO: 436868 - RNA, 64 nt, hsa; identical to SEQ ID NO: 42148

SEQ ID NO: 436869 - RNA, 64 nt, hsa; identical to SEQ ID NO: 42149

SEQ ID NO: 436870 - RNA, 64 nt, hsa; identical to SEQ ID NO: 42150

SEQ ID NO: 436871 - RNA, 64 nt, hsa; identical to SEQ ID NO: 42151

SEQ ID NO: 436872 - RNA, 64 nt, hsa; identical to SEQ ID NO: 42152

SEQ ID NO: 436873 - RNA, 64 nt, hsa; identical to SEQ ID NO: 42153

SEQ ID NO: 436874 - RNA, 64 nt, hsa; identical to SEQ ID NO: 42154

SEQ ID NO: 436875 - RNA, 64 nt, hsa; identical to SEQ ID NO: 42155

SEQ ID NO: 436876 - RNA, 64 nt, hsa; identical to SEQ ID NO: 42156

SEQ ID NO: 436877 - RNA, 64 nt, hsa; identical to SEQ ID NO: 42157

SEQ ID NO: 436878 - RNA, 64 nt, hsa; identical to SEQ ID NO: 42158

SEQ ID NO: 436879 - RNA, 64 nt, hsa; identical to SEQ ID NO: 42159

SEQ ID NO: 436880 - RNA, 64 nt, hsa; identical to SEQ ID NO: 42160

SEQ ID NO: 436881 - RNA, 64 nt, hsa; identical to SEQ ID NO: 42161

SEQ ID NO: 436882 - RNA, 64 nt, hsa; identical to SEQ ID NO: 42162

SEQ ID NO: 436883 - RNA, 64 nt, hsa; identical to SEQ ID NO: 42163

SEQ ID NO: 436884 - RNA, 64 nt, hsa; identical to SEQ ID NO: 42164

SEQ ID NO: 436885 - RNA, 64 nt, hsa; identical to SEQ ID NO: 42165

SEQ ID NO: 436886 - RNA, 64 nt, hsa; identical to SEQ ID NO: 42166

SEQ ID NO: 436887 - RNA, 64 nt, hsa; identical to SEQ ID NO: 42167

SEQ ID NO: 436888 - RNA, 64 nt, hsa; identical to SEQ ID NO: 42168

SEQ ID NO: 436889 - RNA, 64 nt, hsa; identical to SEQ ID NO: 42169

SEQ ID NO: 436890 - RNA, 64 nt, hsa; identical to SEQ ID NO: 42170

SEQ ID NO: 436891 - RNA, 64 nt, hsa; identical to SEQ ID NO: 42171

SEQ ID NO: 436892 - RNA, 64 nt, hsa; identical to SEQ ID NO: 42172

SEQ ID NO: 436893 - RNA, 64 nt, hsa; identical to SEQ ID NO: 42173

SEQ ID NO: 436894 - RNA, 64 nt, hsa; identical to SEQ ID NO: 42174

SEQ ID NO: 436895 - RNA, 64 nt, hsa; identical to SEQ ID NO: 42175

SEQ ID NO: 436896 - RNA, 64 nt, hsa; identical to SEQ ID NO: 42176

SEQ ID NO: 436897 - RNA, 64 nt, hsa; identical to SEQ ID NO: 42177

SEQ ID NO: 436898 - RNA, 64 nt, hsa; identical to SEQ ID NO: 42178

SEQ ID NO: 436899 - RNA, 64 nt, hsa; identical to SEQ ID NO: 42179

SEQ ID NO: 436900 - RNA, 64 nt, hsa; identical to SEQ ID NO: 42180

SEQ ID NO: 436901 - RNA, 64 nt, hsa; identical to SEQ ID NO: 42181

SEQ ID NO: 436902 - RNA, 64 nt, hsa; identical to SEQ ID NO: 42182

SEQ ID NO: 436903 - RNA, 64 nt, hsa; identical to SEQ ID NO: 42183

SEQ ID NO: 436904 - RNA, 64 nt, hsa; identical to SEQ ID NO: 42184

SEQ ID NO: 436905 - RNA, 64 nt, hsa; identical to SEQ ID NO: 42185

SEQ ID NO: 436906 - RNA, 64 nt, hsa; identical to SEQ ID NO: 42186

SEQ ID NO: 436907 - RNA, 64 nt, hsa; identical to SEQ ID NO: 42187

SEQ ID NO: 436908 - RNA, 64 nt, hsa; identical to SEQ ID NO: 42188

SEQ ID NO: 436909 - RNA, 64 nt, hsa; identical to SEQ ID NO: 42189

SEQ ID NO: 436910 - RNA, 64 nt, hsa; identical to SEQ ID NO: 42190

SEQ ID NO: 436911 - RNA, 64 nt, hsa; identical to SEQ ID NO: 42191

SEQ ID NO: 436912 - RNA, 64 nt, hsa; identical to SEQ ID NO: 42192

SEQ ID NO: 436913 - RNA, 64 nt, hsa; identical to SEQ ID NO: 42193

SEQ ID NO: 436914 - RNA, 64 nt, hsa; identical to SEQ ID NO: 42194

SEQ ID NO: 436915 - RNA, 64 nt, hsa; identical to SEQ ID NO: 42195

SEQ ID NO: 436916 - RNA, 64 nt, hsa; identical to SEQ ID NO: 42196

SEQ ID NO: 436917 - RNA, 64 nt, hsa; identical to SEQ ID NO: 42197

SEQ ID NO: 436918 - RNA, 64 nt, hsa; identical to SEQ ID NO: 42198

SEQ ID NO: 436919 - RNA, 64 nt, hsa; identical to SEQ ID NO: 42199

SEQ ID NO: 436920 - RNA, 64 nt, hsa; identical to SEQ ID NO: 42200

SEQ ID NO: 436921 - RNA, 64 nt, hsa; identical to SEQ ID NO: 42201

SEQ ID NO: 436922 - RNA, 64 nt, hsa; identical to SEQ ID NO: 42202

SEQ ID NO: 436923 - RNA, 64 nt, hsa; identical to SEQ ID NO: 42203

SEQ ID NO: 436924 - RNA, 64 nt, hsa; identical to SEQ ID NO: 42204

SEQ ID NO: 436925 - RNA, 64 nt, hsa; identical to SEQ ID NO: 42205

SEQ ID NO: 436926 - RNA, 64 nt, hsa; identical to SEQ ID NO: 42206

SEQ ID NO: 436927 - RNA, 64 nt, hsa; identical to SEQ ID NO: 42207

SEQ ID NO: 436928 - RNA, 64 nt, hsa; identical to SEQ ID NO: 42208

SEQ ID NO: 436929 - RNA, 64 nt, hsa; identical to SEQ ID NO: 42209

SEQ ID NO: 436930 - RNA, 64 nt, hsa; identical to SEQ ID NO: 42210

SEQ ID NO: 436931 - RNA, 64 nt, hsa; identical to SEQ ID NO: 42211

SEQ ID NO: 436932 - RNA, 64 nt, hsa; identical to SEQ ID NO: 42212

SEQ ID NO: 436933 - RNA, 64 nt, hsa; identical to SEQ ID NO: 42213

SEQ ID NO: 436934 - RNA, 64 nt, hsa; identical to SEQ ID NO: 42214

SEQ ID NO: 436935 - RNA, 64 nt, hsa; identical to SEQ ID NO: 42215

SEQ ID NO: 436936 - RNA, 64 nt, hsa; identical to SEQ ID NO: 42216

SEQ ID NO: 436937 - RNA, 64 nt, hsa; identical to SEQ ID NO: 42217

SEQ ID NO: 436938 - RNA, 64 nt, hsa; identical to SEQ ID NO: 42218

SEQ ID NO: 436939 - RNA, 64 nt, hsa; identical to SEQ ID NO: 42219

SEQ ID NO: 436940 - RNA, 64 nt, hsa; identical to SEQ ID NO: 42220

SEQ ID NO: 436941 - RNA, 64 nt, hsa; identical to SEQ ID NO: 42221

SEQ ID NO: 436942 - RNA, 64 nt, hsa; identical to SEQ ID NO: 42222

SEQ ID NO: 436943 - RNA, 64 nt, hsa; identical to SEQ ID NO: 42223

SEQ ID NO: 436944 - RNA, 64 nt, hsa; identical to SEQ ID NO: 42224

SEQ ID NO: 436945 - RNA, 64 nt, hsa; identical to SEQ ID NO: 42225

SEQ ID NO: 436946 - RNA, 64 nt, hsa; identical to SEQ ID NO: 42226

SEQ ID NO: 436947 - RNA, 64 nt, hsa; identical to SEQ ID NO: 42227

SEQ ID NO: 436948 - RNA, 64 nt, hsa; identical to SEQ ID NO: 42228

SEQ ID NO: 436949 - RNA, 64 nt, hsa; identical to SEQ ID NO: 42229

SEQ ID NO: 436950 - RNA, 64 nt, hsa; identical to SEQ ID NO: 42230

SEQ ID NO: 436951 - RNA, 64 nt, hsa; identical to SEQ ID NO: 42231

SEQ ID NO: 436952 - RNA, 64 nt, hsa; identical to SEQ ID NO: 42232

SEQ ID NO: 436953 - RNA, 64 nt, hsa; identical to SEQ ID NO: 42233

SEQ ID NO: 436954 - RNA, 64 nt, hsa; identical to SEQ ID NO: 42234

SEQ ID NO: 436955 - RNA, 64 nt, hsa; identical to SEQ ID NO: 42235

SEQ ID NO: 436956 - RNA, 64 nt, hsa
uggccccaauacccauuuuggaagccccuguggccguguggaugucgguaacaguuguauaaaa

SEQ ID NO: 436957 - RNA, 64 nt, hsa
ggaacaaggugggagagagaguuugagacagcuccguguggagagcuuagccccuggaggcagc

SEQ ID NO: 436958 - RNA, 64 nt, hsa; identical to SEQ ID NO: 275123

SEQ ID NO: 436959 - RNA, 64 nt, hsa; identical to SEQ ID NO: 275124

SEQ ID NO: 436960 - RNA, 64 nt, hsa; identical to SEQ ID NO: 275125

SEQ ID NO: 436961 - RNA, 64 nt, hsa; identical to SEQ ID NO: 275126

SEQ ID NO: 436962 - RNA, 64 nt, hsa; identical to SEQ ID NO: 275127

SEQ ID NO: 436963 - RNA, 64 nt, hsa; identical to SEQ ID NO: 275128

SEQ ID NO: 436964 - RNA, 64 nt, hsa; identical to SEQ ID NO: 275129

SEQ ID NO: 436965 - RNA, 64 nt, hsa; identical to SEQ ID NO: 275130

SEQ ID NO: 436966 - RNA, 64 nt, hsa; identical to SEQ ID NO: 275131

SEQ ID NO: 436967 - RNA, 64 nt, hsa; identical to SEQ ID NO: 275132

SEQ ID NO: 436968 - RNA, 64 nt, hsa; identical to SEQ ID NO: 275133

SEQ ID NO: 436969 - RNA, 64 nt, hsa; identical to SEQ ID NO: 275134

SEQ ID NO: 436970 - RNA, 64 nt, hsa; identical to SEQ ID NO: 275135

SEQ ID NO: 436971 - RNA, 64 nt, hsa; identical to SEQ ID NO: 275136

SEQ ID NO: 436972 - RNA, 64 nt, hsa; identical to SEQ ID NO: 275137

SEQ ID NO: 436973 - RNA, 64 nt, hsa; identical to SEQ ID NO: 275138

SEQ ID NO: 436974 - RNA, 64 nt, hsa; identical to SEQ ID NO: 275139

SEQ ID NO: 436975 - RNA, 64 nt, hsa; identical to SEQ ID NO: 275140

SEQ ID NO: 436976 - RNA, 64 nt, hsa; identical to SEQ ID NO: 275141

SEQ ID NO: 436977 - RNA, 64 nt, hsa; identical to SEQ ID NO: 275142

SEQ ID NO: 436978 - RNA, 64 nt, hsa; identical to SEQ ID NO: 275143

SEQ ID NO: 436979 - RNA, 64 nt, hsa; identical to SEQ ID NO: 275144

SEQ ID NO: 436980 - RNA, 64 nt, hsa; identical to SEQ ID NO: 275145

SEQ ID NO: 436981 - RNA, 64 nt, hsa; identical to SEQ ID NO: 275146

SEQ ID NO: 436982 - RNA, 64 nt, hsa; identical to SEQ ID NO: 275147

SEQ ID NO: 436983 - RNA, 64 nt, hsa; identical to SEQ ID NO: 275148

SEQ ID NO: 436984 - RNA, 64 nt, hsa; identical to SEQ ID NO: 275149

SEQ ID NO: 436985 - RNA, 64 nt, hsa; identical to SEQ ID NO: 275150

SEQ ID NO: 436986 - RNA, 64 nt, hsa; identical to SEQ ID NO: 275151

SEQ ID NO: 436987 - RNA, 64 nt, hsa; identical to SEQ ID NO: 275152

SEQ ID NO: 436988 - RNA, 64 nt, hsa; identical to SEQ ID NO: 275153

SEQ ID NO: 436989 - RNA, 64 nt, hsa; identical to SEQ ID NO: 275154

SEQ ID NO: 436990 - RNA, 64 nt, hsa; identical to SEQ ID NO: 275155

SEQ ID NO: 436991 - RNA, 64 nt, hsa; identical to SEQ ID NO: 275156

SEQ ID NO: 436992 - RNA, 64 nt, hsa; identical to SEQ ID NO: 275157

SEQ ID NO: 436993 - RNA, 64 nt, hsa; identical to SEQ ID NO: 275158

SEQ ID NO: 436994 - RNA, 64 nt, hsa; identical to SEQ ID NO: 275159

SEQ ID NO: 436995 - RNA, 64 nt, hsa; identical to SEQ ID NO: 275160

SEQ ID NO: 436996 - RNA, 64 nt, hsa; identical to SEQ ID NO: 275161

SEQ ID NO: 436997 - RNA, 64 nt, hsa; identical to SEQ ID NO: 275162

SEQ ID NO: 436998 - RNA, 64 nt, hsa; identical to SEQ ID NO: 275163

SEQ ID NO: 436999 - RNA, 64 nt, hsa; identical to SEQ ID NO: 275164

SEQ ID NO: 437000 - RNA, 64 nt, hsa; identical to SEQ ID NO: 275165

SEQ ID NO: 437001 - RNA, 64 nt, hsa; identical to SEQ ID NO: 275166

SEQ ID NO: 437002 - RNA, 64 nt, hsa; identical to SEQ ID NO: 275167

SEQ ID NO: 437003 - RNA, 64 nt, hsa; identical to SEQ ID NO: 275168

SEQ ID NO: 437004 - RNA, 64 nt, hsa; identical to SEQ ID NO: 275169

SEQ ID NO: 437005 - RNA, 64 nt, hsa; identical to SEQ ID NO: 275170

SEQ ID NO: 437006 - RNA, 64 nt, hsa; identical to SEQ ID NO: 275171

SEQ ID NO: 437007 - RNA, 64 nt, hsa; identical to SEQ ID NO: 275172

SEQ ID NO: 437008 - RNA, 64 nt, hsa; identical to SEQ ID NO: 275173

SEQ ID NO: 437009 - RNA, 64 nt, hsa; identical to SEQ ID NO: 275174

SEQ ID NO: 437010 - RNA, 64 nt, hsa; identical to SEQ ID NO: 275175

SEQ ID NO: 437011 - RNA, 64 nt, hsa; identical to SEQ ID NO: 275176

SEQ ID NO: 437012 - RNA, 64 nt, hsa; identical to SEQ ID NO: 275177

SEQ ID NO: 437013 - RNA, 64 nt, hsa; identical to SEQ ID NO: 275178

SEQ ID NO: 437014 - RNA, 64 nt, hsa; identical to SEQ ID NO: 275179

SEQ ID NO: 437015 - RNA, 64 nt, hsa; identical to SEQ ID NO: 275180

SEQ ID NO: 437016 - RNA, 64 nt, hsa; identical to SEQ ID NO: 275181

SEQ ID NO: 437017 - RNA, 64 nt, hsa; identical to SEQ ID NO: 275182

SEQ ID NO: 437018 - RNA, 64 nt, hsa; identical to SEQ ID NO: 275183

SEQ ID NO: 437019 - RNA, 64 nt, hsa; identical to SEQ ID NO: 275184

SEQ ID NO: 437020 - RNA, 64 nt, hsa; identical to SEQ ID NO: 275185

SEQ ID NO: 437021 - RNA, 64 nt, hsa; identical to SEQ ID NO: 275186

SEQ ID NO: 437022 - RNA, 64 nt, hsa; identical to SEQ ID NO: 275187

SEQ ID NO: 437023 - RNA, 64 nt, hsa; identical to SEQ ID NO: 275188

SEQ ID NO: 437024 - RNA, 64 nt, hsa; identical to SEQ ID NO: 275189

SEQ ID NO: 437025 - RNA, 64 nt, hsa; identical to SEQ ID NO: 183694

SEQ ID NO: 437026 - RNA, 64 nt, hsa; identical to SEQ ID NO: 183695

SEQ ID NO: 437027 - RNA, 64 nt, hsa; identical to SEQ ID NO: 183696

SEQ ID NO: 437028 - RNA, 64 nt, hsa; identical to SEQ ID NO: 183697

SEQ ID NO: 437029 - RNA, 64 nt, hsa; identical to SEQ ID NO: 183698

SEQ ID NO: 437030 - RNA, 64 nt, hsa; identical to SEQ ID NO: 183699

SEQ ID NO: 437031 - RNA, 64 nt, hsa; identical to SEQ ID NO: 183700

SEQ ID NO: 437032 - RNA, 64 nt, hsa; identical to SEQ ID NO: 183701

SEQ ID NO: 437033 - RNA, 64 nt, hsa; identical to SEQ ID NO: 183702

SEQ ID NO: 437034 - RNA, 64 nt, hsa; identical to SEQ ID NO: 183703

SEQ ID NO: 437035 - RNA, 64 nt, hsa; identical to SEQ ID NO: 183704

SEQ ID NO: 437036 - RNA, 64 nt, hsa; identical to SEQ ID NO: 183705

SEQ ID NO: 437037 - RNA, 64 nt, hsa; identical to SEQ ID NO: 183706

SEQ ID NO: 437038 - RNA, 64 nt, hsa; identical to SEQ ID NO: 183707

SEQ ID NO: 437039 - RNA, 64 nt, hsa; identical to SEQ ID NO: 183708

SEQ ID NO: 437040 - RNA, 64 nt, hsa; identical to SEQ ID NO: 183709

SEQ ID NO: 437041 - RNA, 64 nt, hsa; identical to SEQ ID NO: 183710

SEQ ID NO: 437042 - RNA, 64 nt, hsa; identical to SEQ ID NO: 183711

SEQ ID NO: 437043 - RNA, 64 nt, hsa; identical to SEQ ID NO: 183712

SEQ ID NO: 437044 - RNA, 64 nt, hsa; identical to SEQ ID NO: 183713

SEQ ID NO: 437045 - RNA, 64 nt, hsa; identical to SEQ ID NO: 183714

SEQ ID NO: 437046 - RNA, 64 nt, hsa; identical to SEQ ID NO: 183715

SEQ ID NO: 437047 - RNA, 64 nt, hsa; identical to SEQ ID NO: 183716

SEQ ID NO: 437048 - RNA, 64 nt, hsa; identical to SEQ ID NO: 183717

SEQ ID NO: 437049 - RNA, 64 nt, hsa; identical to SEQ ID NO: 183718

SEQ ID NO: 437050 - RNA, 64 nt, hsa; identical to SEQ ID NO: 183719

SEQ ID NO: 437051 - RNA, 64 nt, hsa; identical to SEQ ID NO: 183720

SEQ ID NO: 437052 - RNA, 64 nt, hsa; identical to SEQ ID NO: 183721

SEQ ID NO: 437053 - RNA, 64 nt, hsa; identical to SEQ ID NO: 183722

SEQ ID NO: 437054 - RNA, 64 nt, hsa; identical to SEQ ID NO: 183723

SEQ ID NO: 437055 - RNA, 64 nt, hsa; identical to SEQ ID NO: 183724

SEQ ID NO: 437056 - RNA, 64 nt, hsa; identical to SEQ ID NO: 183725

SEQ ID NO: 437057 - RNA, 64 nt, hsa; identical to SEQ ID NO: 183726

SEQ ID NO: 437058 - RNA, 64 nt, hsa; identical to SEQ ID NO: 183727

SEQ ID NO: 437059 - RNA, 64 nt, hsa; identical to SEQ ID NO: 183728

SEQ ID NO: 437060 - RNA, 64 nt, hsa; identical to SEQ ID NO: 183729

SEQ ID NO: 437061 - RNA, 64 nt, hsa; identical to SEQ ID NO: 183730

SEQ ID NO: 437062 - RNA, 64 nt, hsa; identical to SEQ ID NO: 183731

SEQ ID NO: 437063 - RNA, 64 nt, hsa; identical to SEQ ID NO: 183732

SEQ ID NO: 437064 - RNA, 64 nt, hsa; identical to SEQ ID NO: 183733

SEQ ID NO: 437065 - RNA, 64 nt, hsa; identical to SEQ ID NO: 183734

SEQ ID NO: 437066 - RNA, 64 nt, hsa; identical to SEQ ID NO: 183735

SEQ ID NO: 437067 - RNA, 64 nt, hsa
aaacagcuucacuccucaggaaguaccauggacagacgccuaccaggggugacaaagcagugca

SEQ ID NO: 437068 - RNA, 64 nt, hsa
agaggcaccaggcaguaacuuccaugaugacacugacgccuauaccugagcucuaggcugccug

SEQ ID NO: 437069 - RNA, 64 nt, hsa
guauuugaacuuagggcaaaucagagucuacacagacgccuacagaaaguuucaggaagaggca

SEQ ID NO: 437070 - RNA, 54 nt, hsa
ucgcagccuaucgcuccugacacggacgccuauccagaagccagccggcuggca

SEQ ID NO: 437071 - RNA, 64 nt, hsa
gccccucaggugcccccacacacagccuucccuugacgccuacauuucuaggcacaugugaggc

SEQ ID NO: 437072 - RNA, 64 nt, hsa
gaccaagaaaucaggagaguucaagugaugagcagacgccuagucgggaugaugauagccaguc

SEQ ID NO: 437073 - RNA, 64 nt, hsa
gcccaggccacagccagccugucguguccagccugacgccuacuggggcagggcagcaggcuuu

SEQ ID NO: 437074 - RNA, 64 nt, hsa
gugcuaagugcuuacuucgggauagcaggggccggacgccuauacaccugucugcugccugugg

SEQ ID NO: 437075 - RNA, 64 nt, hsa
guuuguaaacaugaggucagacauguguaagguagacgccuauggccacuggcuugaccaccuu

SEQ ID NO: 437076 - RNA, 64 nt, hsa
ugacgggcggcguucccacccacaccuucgacgcgacgccuacgaccccccucgcccgccgccu

SEQ ID NO: 437077 - RNA, 64 nt, hsa
uacuaguaguccaggcuugauuuggagggugaaugacgccuagcaagauguauuguacuugugu

SEQ ID NO: 437078 - RNA, 64 nt, hsa
uguccaggccucagagucccgcucuguucauacagacgccuauggcccugcuucuuccucccag

SEQ ID NO: 437079 - RNA, 64 nt, hsa
auuucucaguccugaagaauaaggaaaacaaagcgacgccuauuuuguauaaaguuuccgacuc

SEQ ID NO: 437080 - RNA, 64 nt, hsa
guguggcugcaucuugcugcuaaugugugauguugacgccuaacugaauuugaacagcucacca

SEQ ID NO: 437081 - RNA, 64 nt, hsa
acugguuuuacagcucuggugugugauguuaccagacgccuaggcccucuccuguugcucuguc

SEQ ID NO: 437082 - RNA, 64 nt, hsa
agucgaaguugaaaggaagcuuucccccgccaaggacgccuaccccgaaaccggccccgacgcc

SEQ ID NO: 437083 - RNA, 64 nt, hsa
cugugacacaguggccauuguaguuuaucccgaagacgccuauguacguaaguuugcauuuccu

SEQ ID NO: 437084 - RNA, 64 nt, hsa
gggccccccucagccccugccuccaucugccugagacgccuauuuuuuuuuuuuuuuuuuaaac

SEQ ID NO: 437085 - RNA, 64 nt, hsa
agucggggcuggauggccgggggcuucugggcccgacgccuagugcagccccuggggucguggu

SEQ ID NO: 437086 - RNA, 64 nt, hsa
ggacuccuccgcgagccccaucgucgcgccuguggacgccuaggcaagagcggcccucugcagc

SEQ ID NO: 437087 - RNA, 64 nt, hsa
cugucgaggcgggccgagucuucccuuauccccagacgccuagcgggcaggguugggcugaauc

SEQ ID NO: 437088 - RNA, 64 nt, hsa
cuccaagcaaggaagaaaaaacaaacucugcucagacgccuaugaaacaccugaaugaacuuug

SEQ ID NO: 437089 - RNA, 64 nt, hsa
caguagccuaguuuccacagcacgauaacaccaugacgccuacugcuguucccaccuugggauu

SEQ ID NO: 437090 - RNA, 64 nt, hsa
gagcucaagaucaauuggucauagaacagcauuugacgccuagaacuaugaccaccucaugguc

SEQ ID NO: 437091 - RNA, 64 nt, hsa
cccaccuugggagaggacgaugacuugggagggacgcgugaagggagaagggguccucccauga

SEQ ID NO: 437092 - RNA, 64 nt, hsa
uguaauuuguaagaccaaauucauacuaauuacccgcgugaaagguguuuguuuuuaacaacau

SEQ ID NO: 437093 - RNA, 52 nt, hsa
cagccuaugccucccacuaggccgcgugaagguucccggaggaugggucuca

SEQ ID NO: 437094 - RNA, 64 nt, hsa
guucacauguucuggcucuguacuccacgcuuaucgcgugaacccucacauguuggacuuucac

SEQ ID NO: 437095 - RNA, 64 nt, hsa
ccccgaaaggagaaaaguacucccaggaaacagacgcgugaaaacugagccccagaagaggcac

SEQ ID NO: 437096 - RNA, 64 nt, hsa
ccagcaggauugcuccaggauuuuguguuuaccucgcgugaaguucagcacgugcugucgugua

SEQ ID NO: 437097 - RNA, 64 nt, hsa
uucuccgcagugcagagcagcuugccgaggaccccgcgugaagaaagccagcgaggggggcuuc

SEQ ID NO: 437098 - RNA, 64 nt, hsa
cuucuuccacggggcuugacaccagagcagcccccgcgugaaaugagaaggcaugcuuagcacu

SEQ ID NO: 437099 - RNA, 64 nt, hsa
cacacacacagaaauaucgaccaucacccucccccgcgugaacugggaugcaaguugcuaaccg

SEQ ID NO: 437100 - RNA, 64 nt, hsa
caacuacucuucaaaucagugcguaccugcucuacgcgugaagguacagaaaaccuccacggcc

SEQ ID NO: 437101 - RNA, 64 nt, hsa
ccaucccccaccagacugcuuagcgucugagauccgcgugaaaaguccucugcccacgagagca

SEQ ID NO: 437102 - RNA, 64 nt, hsa
uccggagagacagugacagccuccgucagacucccgcgugaagaugucacaagggauuggcaau

SEQ ID NO: 437103 - RNA, 64 nt, hsa
gcccagaacuggcugauuucagggauacccaggacgcgugaaacacagaagaaacgugauccca

SEQ ID NO: 437104 - RNA, 64 nt, hsa
ccaugucuguguuguggacauuccgcggcaugaccgcgugaacugcacgguggagcugccucag

SEQ ID NO: 437105 - RNA, 64 nt, hsa; identical to SEQ ID NO: 416970

SEQ ID NO: 437106 - RNA, 64 nt, hsa; identical to SEQ ID NO: 416971

SEQ ID NO: 437107 - RNA, 64 nt, hsa; identical to SEQ ID NO: 416972

SEQ ID NO: 437108 - RNA, 64 nt, hsa; identical to SEQ ID NO: 416973

SEQ ID NO: 437109 - RNA, 64 nt, hsa; identical to SEQ ID NO: 416974

SEQ ID NO: 437110 - RNA, 64 nt, hsa; identical to SEQ ID NO: 416975

SEQ ID NO: 437111 - RNA, 64 nt, hsa; identical to SEQ ID NO: 416976

SEQ ID NO: 437112 - RNA, 64 nt, hsa; identical to SEQ ID NO: 416977

SEQ ID NO: 437113 - RNA, 64 nt, hsa; identical to SEQ ID NO: 416978

SEQ ID NO: 437114 - RNA, 64 nt, hsa; identical to SEQ ID NO: 416979

SEQ ID NO: 437115 - RNA, 64 nt, hsa; identical to SEQ ID NO: 416980

SEQ ID NO: 437116 - RNA, 64 nt, hsa; identical to SEQ ID NO: 416981

SEQ ID NO: 437117 - RNA, 64 nt, hsa; identical to SEQ ID NO: 416982

SEQ ID NO: 437118 - RNA, 64 nt, hsa; identical to SEQ ID NO: 416983

SEQ ID NO: 437119 - RNA, 51 nt, hsa; identical to SEQ ID NO: 416984

SEQ ID NO: 437120 - RNA, 64 nt, hsa; identical to SEQ ID NO: 416985

SEQ ID NO: 437121 - RNA, 64 nt, hsa; identical to SEQ ID NO: 416986

SEQ ID NO: 437122 - RNA, 64 nt, hsa; identical to SEQ ID NO: 416987

SEQ ID NO: 437123 - RNA, 64 nt, hsa; identical to SEQ ID NO: 416988

SEQ ID NO: 437124 - RNA, 60 nt, hsa; identical to SEQ ID NO: 416989

SEQ ID NO: 437125 - RNA, 64 nt, hsa; identical to SEQ ID NO: 416990

SEQ ID NO: 437126 - RNA, 64 nt, hsa; identical to SEQ ID NO: 416991

SEQ ID NO: 437127 - RNA, 64 nt, hsa; identical to SEQ ID NO: 416992

SEQ ID NO: 437128 - RNA, 64 nt, hsa; identical to SEQ ID NO: 416993

SEQ ID NO: 437129 - RNA, 64 nt, hsa; identical to SEQ ID NO: 416994

SEQ ID NO: 437130 - RNA, 64 nt, hsa; identical to SEQ ID NO: 416995

SEQ ID NO: 437131 - RNA, 64 nt, hsa; identical to SEQ ID NO: 416996

SEQ ID NO: 437132 - RNA, 64 nt, hsa; identical to SEQ ID NO: 416997

SEQ ID NO: 437133 - RNA, 64 nt, hsa; identical to SEQ ID NO: 416998

SEQ ID NO: 437134 - RNA, 64 nt, hsa; identical to SEQ ID NO: 416999

SEQ ID NO: 437135 - RNA, 64 nt, hsa; identical to SEQ ID NO: 417000

SEQ ID NO: 437136 - RNA, 64 nt, hsa; identical to SEQ ID NO: 417001

SEQ ID NO: 437137 - RNA, 64 nt, hsa; identical to SEQ ID NO: 417002

SEQ ID NO: 437138 - RNA, 64 nt, hsa; identical to SEQ ID NO: 417003

SEQ ID NO: 437139 - RNA, 64 nt, hsa; identical to SEQ ID NO: 417004

SEQ ID NO: 437140 - RNA, 64 nt, hsa; identical to SEQ ID NO: 417005

SEQ ID NO: 437141 - RNA, 64 nt, hsa; identical to SEQ ID NO: 417006

SEQ ID NO: 437142 - RNA, 64 nt, hsa; identical to SEQ ID NO: 417007

SEQ ID NO: 437143 - RNA, 64 nt, hsa; identical to SEQ ID NO: 417008

SEQ ID NO: 437144 - RNA, 64 nt, hsa; identical to SEQ ID NO: 417009

SEQ ID NO: 437145 - RNA, 64 nt, hsa; identical to SEQ ID NO: 417010

SEQ ID NO: 437146 - RNA, 64 nt, hsa; identical to SEQ ID NO: 417011

SEQ ID NO: 437147 - RNA, 64 nt, hsa; identical to SEQ ID NO: 417012

SEQ ID NO: 437148 - RNA, 64 nt, hsa; identical to SEQ ID NO: 417013

SEQ ID NO: 437149 - RNA, 64 nt, hsa; identical to SEQ ID NO: 417014

SEQ ID NO: 437150 - RNA, 64 nt, hsa; identical to SEQ ID NO: 417015

SEQ ID NO: 437151 - RNA, 64 nt, hsa; identical to SEQ ID NO: 417016

SEQ ID NO: 437152 - RNA, 64 nt, hsa; identical to SEQ ID NO: 417017

SEQ ID NO: 437153 - RNA, 64 nt, hsa; identical to SEQ ID NO: 417018

SEQ ID NO: 437154 - RNA, 64 nt, hsa; identical to SEQ ID NO: 417019

SEQ ID NO: 437155 - RNA, 64 nt, hsa; identical to SEQ ID NO: 417020

SEQ ID NO: 437156 - RNA, 64 nt, hsa; identical to SEQ ID NO: 417021

SEQ ID NO: 437157 - RNA, 64 nt, hsa; identical to SEQ ID NO: 417022

SEQ ID NO: 437158 - RNA, 64 nt, hsa; identical to SEQ ID NO: 417023

SEQ ID NO: 437159 - RNA, 64 nt, hsa; identical to SEQ ID NO: 417024

SEQ ID NO: 437160 - RNA, 64 nt, hsa; identical to SEQ ID NO: 417025

SEQ ID NO: 437161 - RNA, 64 nt, hsa; identical to SEQ ID NO: 417026

SEQ ID NO: 437162 - RNA, 64 nt, hsa; identical to SEQ ID NO: 417027

SEQ ID NO: 437163 - RNA, 64 nt, hsa; identical to SEQ ID NO: 417028

SEQ ID NO: 437164 - RNA, 64 nt, hsa; identical to SEQ ID NO: 417029

SEQ ID NO: 437165 - RNA, 64 nt, hsa; identical to SEQ ID NO: 417030

SEQ ID NO: 437166 - RNA, 64 nt, hsa; identical to SEQ ID NO: 417031

SEQ ID NO: 437167 - RNA, 64 nt, hsa; identical to SEQ ID NO: 417032

SEQ ID NO: 437168 - RNA, 57 nt, hsa
cagacagccacauugggcagcgcccuuccucuccacccucccagaccugccucuucc

SEQ ID NO: 437169 - RNA, 57 nt, hsa
cccugcuuccaccucaccccacuuaucccucuccauaaccccacccuugcccacccc

SEQ ID NO: 437170 - RNA, 57 nt, hsa
ggcaggagauggccaaucaugcgcccaccucuccagugcugccugcagucagcucgg

SEQ ID NO: 437171 - RNA, 57 nt, hsa
acuaggaaaaggaaccaacuguaggcaccucuccagggccuagggagacaagugucc

SEQ ID NO: 437172 - RNA, 57 nt, hsa
guccuucagacccugcccgaacucccaccucuccauggccugccuagccaggcuggc

SEQ ID NO: 437173 - RNA, 57 nt, hsa
gcgugugaugcuaccucuccucccgucccucuccaggggccccgcauacacacggcc

SEQ ID NO: 437174 - RNA, 57 nt, hsa
ggugcacauuugccucucacaugcugcccucuccacccacccagggacaccccacgg

SEQ ID NO: 437175 - RNA, 57 nt, hsa
aaauauuauuuuaacaaaaguuacauuccucuccacaaugaggcuaaaugucaccca

SEQ ID NO: 437176 - RNA, 57 nt, hsa
cuaguacuaccugaaggcucuccuaacccucuccacacauuccauuuacagaguaug

SEQ ID NO: 437177 - RNA, 57 nt, hsa
cgggcuuccugcuggggcggccagcacccucuccacgugcagaccccaugcgucccg

SEQ ID NO: 437178 - RNA, 57 nt, hsa
ccagccacaggcugggugcacguccugccucuccagccccacagggcagcagcauga

SEQ ID NO: 437179 - RNA, 57 nt, hsa
uuucuaaucaggcaggcgucugucaacccucuccacuucugggcugaagccucccca

SEQ ID NO: 437180 - RNA, 57 nt, hsa
gcgccggaucugggcgaccacguuuugccucuccaaaaagagcuuccuuucgugacg

SEQ ID NO: 437181 - RNA, 57 nt, hsa
uucacagucagcugcucaacggaauggccucuccacaccagggauccuuagcaccca

SEQ ID NO: 437182 - RNA, 57 nt, hsa
uuagaagaauugauccuauuuugaaccccucuccaguaucuucacacucuugucaac

SEQ ID NO: 437183 - RNA, 57 nt, hsa
guuuuucuccuagucccucuccugccaccucuccaagacuuccgugggacacccacu

SEQ ID NO: 437184 - RNA, 57 nt, hsa
agcaccugaggcggguuuccuggguccccucuccagcaagccuccaccagcaagcuc

SEQ ID NO: 437185 - RNA, 57 nt, hsa
aggaggaauuaguugggaugccaauuuccucuccacugcuggacaugagauggagag

SEQ ID NO: 437186 - RNA, 57 nt, hsa
auguuaugcuggugguuaaggccagggccucuccaaccacugugccacugacuugcu

SEQ ID NO: 437187 - RNA, 57 nt, hsa
gugcguggugucagaucccauccugcuccucuccagaguuuccggucaccuccgugu

SEQ ID NO: 437188 - RNA, 57 nt, hsa
gugcguggugucagaucccauccugcuccucuccagcauuuccucucaccuccgugu

SEQ ID NO: 437189 - RNA, 57 nt, hsa
gugcguggugucagaucccauccugcuccucuccagaguuuccucucaccuccgugu

SEQ ID NO: 437190 - RNA, 57 nt, hsa
ccuccccggguuggcucucccuggagaccucuccaucauucccgaaaaguggaugga

SEQ ID NO: 437191 - RNA, 57 nt, hsa
ccagcccuuggugugcccacccagccuccucuccagcaccuugcugugcugcccucu

SEQ ID NO: 437192 - RNA, 57 nt, hsa
augggagucaggacccucuccacucucccucuccacuccccuuccuguucucaccug

SEQ ID NO: 437193 - RNA, 57 nt, hsa
ccagaugaagccuaugggagucaggacccucuccacucucccucuccacuccccuuc

SEQ ID NO: 437194 - RNA, 57 nt, hsa
agauuuccuuucuguggugagggagaaccucuccaaagaggaagcaggcauaugagu

SEQ ID NO: 437195 - RNA, 57 nt, hsa
caggaaucucuguuccuucucugucugccucuccacagcccgugauccccugcuucu

SEQ ID NO: 437196 - RNA, 57 nt, hsa
cacccagcccuauccauucucuccuucccucuccagccugcuguauaaguaacaugu

SEQ ID NO: 437197 - RNA, 57 nt, hsa
gcugagacaucccucaucuagucuugaccucuccagcaucccagccucagaagccuu

SEQ ID NO: 437198 - RNA, 57 nt, hsa
ccgccauggucacccucaggaacccacccucuccacacccagccugucccacuggcu

SEQ ID NO: 437199 - RNA, 57 nt, hsa
agguuuuggcuggucagugugccaagaccucuccagcuucucauucaugaugaccuc

SEQ ID NO: 437200 - RNA, 57 nt, hsa
auucucugcagcuuucucaaggggaacccucuccagcuucccuggugugacccuucu

SEQ ID NO: 437201 - RNA, 57 nt, hsa
gccuccuaaaagguuuaaauguccacgccucuccaguugcugaaguagggucugaga

SEQ ID NO: 437202 - RNA, 57 nt, hsa
gugggcaguccugguguagagcacaagccucuccacccuagagaaaugccucuguac

SEQ ID NO: 437203 - RNA, 57 nt, hsa
cuggucaucggcuugcccaggcuccagccucuccagauucugaggggucucagccca

SEQ ID NO: 437204 - RNA, 57 nt, hsa
uauccucuguauucaguaaacaggcugccucuccagggagggcugccauucauucca

SEQ ID NO: 437205 - RNA, 57 nt, hsa
aaucagaccaccgaagcucacucccuuccucuccaucucucccucucuccaagacuc

SEQ ID NO: 437206 - RNA, 57 nt, hsa
aagcaaggcagccgugcuguucuaguuccucuccauccgccaccuccccucccgcug

SEQ ID NO: 437207 - RNA, 57 nt, hsa
aaggccuaaaaggucaccccucggcccccucuccaaaagaagggcaugggcaccccc

SEQ ID NO: 437208 - RNA, 57 nt, hsa
cccgcacgcacaaucgugaccccgcgaccucuccaucuucagcuucuucaucuucac

SEQ ID NO: 437209 - RNA, 57 nt, hsa
acccucuuccuuccccagccagggcagccucuccacaucuuucccugacucuuggau

SEQ ID NO: 437210 - RNA, 57 nt, hsa
aggacccugaggauggggacuccacagccucuccaaguucagagugagauucugcau

SEQ ID NO: 437211 - RNA, 57 nt, hsa
gagguaggcuguggggugggcuggaguccucuccagagaggcucaacaaggaaaaau

SEQ ID NO: 437212 - RNA, 57 nt, hsa
cuucucccaccccuuggccccucacauccucuccaggaagggagugaggggcuguga

SEQ ID NO: 437213 - RNA, 57 nt, hsa
ccagaugagaguacaccccaacagcacccucuccagaugcagccccaucuccucagc

SEQ ID NO: 437214 - RNA, 57 nt, hsa
ccagaugagaguacaccccaacagcacccucuccagaugagaguacaccccaacagc

SEQ ID NO: 437215 - RNA, 57 nt, hsa; identical to SEQ ID NO: 437214

SEQ ID NO: 437216 - RNA, 57 nt, hsa
uccagaugggagugcccccaacagcacccucuccagaugagaguacaccccaacagc

SEQ ID NO: 437217 - RNA, 57 nt, hsa
cuucccaggaguacaccccaacagcacccucuccagaugggagugcccccaacagca

SEQ ID NO: 437218 - RNA, 57 nt, hsa
uuccuuagcugauuguucccacuugcaccucuccaccuuuggcacuagaacuccuga

SEQ ID NO: 437219 - RNA, 57 nt, hsa
gaaucgggagccacacuuggcccucuuccucuccaaagcgccagaaccuccuucucu

SEQ ID NO: 437220 - RNA, 57 nt, hsa
cuugguucauggaggcuccuacucugcccucuccaagcuccccuggcggcuccccac

SEQ ID NO: 437221 - RNA, 57 nt, hsa
gccccuguuugaagaccucccuucuugccucuccagacguguuccccgaggagaucu

SEQ ID NO: 437222 - RNA, 57 nt, hsa
uccagguugacagccuucucugaacgaccucuccauuacucucaugcuuugcucaug

SEQ ID NO: 437223 - RNA, 57 nt, hsa
uuuuacugccuucugucuuucuucccgccucuccagguugacagccuucucugaacg

SEQ ID NO: 437224 - RNA, 57 nt, hsa
ccucacucagcuccugccucccucuccccucuccaccaugggcugcaguauagacag

SEQ ID NO: 437225 - RNA, 57 nt, hsa
uccuucuguccgucagaaucuccgcugccucuccagcccuuuugcagcccuguuuau

SEQ ID NO: 437226 - RNA, 64 nt, hsa; identical to SEQ ID NO: 165193

SEQ ID NO: 437227 - RNA, 64 nt, hsa; identical to SEQ ID NO: 165194

SEQ ID NO: 437228 - RNA, 64 nt, hsa; identical to SEQ ID NO: 165195

SEQ ID NO: 437229 - RNA, 64 nt, hsa; identical to SEQ ID NO: 165196

SEQ ID NO: 437230 - RNA, 64 nt, hsa; identical to SEQ ID NO: 165197

SEQ ID NO: 437231 - RNA, 64 nt, hsa; identical to SEQ ID NO: 165198

SEQ ID NO: 437232 - RNA, 64 nt, hsa; identical to SEQ ID NO: 165199

SEQ ID NO: 437233 - RNA, 64 nt, hsa; identical to SEQ ID NO: 165200

SEQ ID NO: 437234 - RNA, 64 nt, hsa; identical to SEQ ID NO: 165201

SEQ ID NO: 437235 - RNA, 64 nt, hsa; identical to SEQ ID NO: 165202

SEQ ID NO: 437236 - RNA, 64 nt, hsa; identical to SEQ ID NO: 411269

SEQ ID NO: 437237 - RNA, 64 nt, hsa; identical to SEQ ID NO: 411270

SEQ ID NO: 437238 - RNA, 64 nt, hsa; identical to SEQ ID NO: 411271

SEQ ID NO: 437239 - RNA, 64 nt, hsa; identical to SEQ ID NO: 411272

SEQ ID NO: 437240 - RNA, 64 nt, hsa; identical to SEQ ID NO: 411273

SEQ ID NO: 437241 - RNA, 64 nt, hsa; identical to SEQ ID NO: 411274

SEQ ID NO: 437242 - RNA, 64 nt, hsa; identical to SEQ ID NO: 411275

SEQ ID NO: 437243 - RNA, 64 nt, hsa; identical to SEQ ID NO: 411276

SEQ ID NO: 437244 - RNA, 64 nt, hsa; identical to SEQ ID NO: 411277

SEQ ID NO: 437245 - RNA, 64 nt, hsa; identical to SEQ ID NO: 411278

SEQ ID NO: 437246 - RNA, 64 nt, hsa; identical to SEQ ID NO: 411279

SEQ ID NO: 437247 - RNA, 64 nt, hsa; identical to SEQ ID NO: 411280

SEQ ID NO: 437248 - RNA, 64 nt, hsa; identical to SEQ ID NO: 411281

SEQ ID NO: 437249 - RNA, 64 nt, hsa; identical to SEQ ID NO: 411282

SEQ ID NO: 437250 - RNA, 64 nt, hsa; identical to SEQ ID NO: 411283

SEQ ID NO: 437251 - RNA, 64 nt, hsa; identical to SEQ ID NO: 411284

SEQ ID NO: 437252 - RNA, 64 nt, hsa; identical to SEQ ID NO: 411285

SEQ ID NO: 437253 - RNA, 64 nt, hsa; identical to SEQ ID NO: 411286

SEQ ID NO: 437254 - RNA, 64 nt, hsa; identical to SEQ ID NO: 411287

SEQ ID NO: 437255 - RNA, 64 nt, hsa; identical to SEQ ID NO: 411288

SEQ ID NO: 437256 - RNA, 64 nt, hsa; identical to SEQ ID NO: 411289

SEQ ID NO: 437257 - RNA, 64 nt, hsa; identical to SEQ ID NO: 411290

SEQ ID NO: 437258 - RNA, 64 nt, hsa; identical to SEQ ID NO: 411291

SEQ ID NO: 437259 - RNA, 64 nt, hsa; identical to SEQ ID NO: 411292

SEQ ID NO: 437260 - RNA, 64 nt, hsa; identical to SEQ ID NO: 411293

SEQ ID NO: 437261 - RNA, 64 nt, hsa; identical to SEQ ID NO: 411294

SEQ ID NO: 437262 - RNA, 64 nt, hsa; identical to SEQ ID NO: 411295

SEQ ID NO: 437263 - RNA, 64 nt, hsa; identical to SEQ ID NO: 411296

SEQ ID NO: 437264 - RNA, 64 nt, hsa; identical to SEQ ID NO: 411297

SEQ ID NO: 437265 - RNA, 64 nt, hsa; identical to SEQ ID NO: 411298

SEQ ID NO: 437266 - RNA, 64 nt, hsa; identical to SEQ ID NO: 411299

SEQ ID NO: 437267 - RNA, 64 nt, hsa; identical to SEQ ID NO: 411300

SEQ ID NO: 437268 - RNA, 64 nt, hsa; identical to SEQ ID NO: 411301

SEQ ID NO: 437269 - RNA, 64 nt, hsa; identical to SEQ ID NO: 411302

SEQ ID NO: 437270 - RNA, 64 nt, hsa; identical to SEQ ID NO: 411303

SEQ ID NO: 437271 - RNA, 64 nt, hsa; identical to SEQ ID NO: 411304

SEQ ID NO: 437272 - RNA, 64 nt, hsa; identical to SEQ ID NO: 411305

SEQ ID NO: 437273 - RNA, 64 nt, hsa; identical to SEQ ID NO: 411306

SEQ ID NO: 437274 - RNA, 64 nt, hsa; identical to SEQ ID NO: 411307

SEQ ID NO: 437275 - RNA, 64 nt, hsa; identical to SEQ ID NO: 411308

SEQ ID NO: 437276 - RNA, 64 nt, hsa; identical to SEQ ID NO: 411309

SEQ ID NO: 437277 - RNA, 64 nt, hsa; identical to SEQ ID NO: 411310

SEQ ID NO: 437278 - RNA, 64 nt, hsa; identical to SEQ ID NO: 411311

SEQ ID NO: 437279 - RNA, 64 nt, hsa; identical to SEQ ID NO: 411312

SEQ ID NO: 437280 - RNA, 64 nt, hsa; identical to SEQ ID NO: 411313

SEQ ID NO: 437281 - RNA, 64 nt, hsa; identical to SEQ ID NO: 411314

SEQ ID NO: 437282 - RNA, 64 nt, hsa; identical to SEQ ID NO: 411315

SEQ ID NO: 437283 - RNA, 64 nt, hsa; identical to SEQ ID NO: 411316

SEQ ID NO: 437284 - RNA, 64 nt, hsa; identical to SEQ ID NO: 411317

SEQ ID NO: 437285 - RNA, 64 nt, hsa; identical to SEQ ID NO: 411318

SEQ ID NO: 437286 - RNA, 64 nt, hsa; identical to SEQ ID NO: 411319

SEQ ID NO: 437287 - RNA, 64 nt, hsa; identical to SEQ ID NO: 411320

SEQ ID NO: 437288 - RNA, 64 nt, hsa; identical to SEQ ID NO: 411321

SEQ ID NO: 437289 - RNA, 64 nt, hsa; identical to SEQ ID NO: 411322

SEQ ID NO: 437290 - RNA, 64 nt, hsa; identical to SEQ ID NO: 411323

SEQ ID NO: 437291 - RNA, 64 nt, hsa; identical to SEQ ID NO: 411324

SEQ ID NO: 437292 - RNA, 64 nt, hsa; identical to SEQ ID NO: 411325

SEQ ID NO: 437293 - RNA, 64 nt, hsa; identical to SEQ ID NO: 411326

SEQ ID NO: 437294 - RNA, 64 nt, hsa; identical to SEQ ID NO: 411327

SEQ ID NO: 437295 - RNA, 64 nt, hsa; identical to SEQ ID NO: 411328

SEQ ID NO: 437296 - RNA, 64 nt, hsa; identical to SEQ ID NO: 411329

SEQ ID NO: 437297 - RNA, 64 nt, hsa; identical to SEQ ID NO: 411330

SEQ ID NO: 437298 - RNA, 64 nt, hsa; identical to SEQ ID NO: 411331

SEQ ID NO: 437299 - RNA, 52 nt, hsa; identical to SEQ ID NO: 264778

SEQ ID NO: 437300 - RNA, 64 nt, hsa; identical to SEQ ID NO: 411333

SEQ ID NO: 437301 - RNA, 64 nt, hsa; identical to SEQ ID NO: 411334

SEQ ID NO: 437302 - RNA, 64 nt, hsa; identical to SEQ ID NO: 411335

SEQ ID NO: 437303 - RNA, 64 nt, hsa; identical to SEQ ID NO: 411336

SEQ ID NO: 437304 - RNA, 64 nt, hsa; identical to SEQ ID NO: 411337

SEQ ID NO: 437305 - RNA, 64 nt, hsa; identical to SEQ ID NO: 411338

SEQ ID NO: 437306 - RNA, 64 nt, hsa; identical to SEQ ID NO: 411339

SEQ ID NO: 437307 - RNA, 64 nt, hsa; identical to SEQ ID NO: 411340

SEQ ID NO: 437308 - RNA, 64 nt, hsa; identical to SEQ ID NO: 411341

SEQ ID NO: 437309 - RNA, 64 nt, hsa; identical to SEQ ID NO: 411342

SEQ ID NO: 437310 - RNA, 64 nt, hsa; identical to SEQ ID NO: 411343

SEQ ID NO: 437311 - RNA, 64 nt, hsa; identical to SEQ ID NO: 411344

SEQ ID NO: 437312 - RNA, 64 nt, hsa; identical to SEQ ID NO: 411345

SEQ ID NO: 437313 - RNA, 64 nt, hsa; identical to SEQ ID NO: 411346

SEQ ID NO: 437314 - RNA, 64 nt, hsa; identical to SEQ ID NO: 411347

SEQ ID NO: 437315 - RNA, 64 nt, hsa; identical to SEQ ID NO: 411348

SEQ ID NO: 437316 - RNA, 64 nt, hsa; identical to SEQ ID NO: 411349

SEQ ID NO: 437317 - RNA, 64 nt, hsa
gucuucaugacccuucaacccugauuacuacagaauuccagaauguuaggcucuccagggcuuc

SEQ ID NO: 437318 - RNA, 64 nt, hsa
acucagaaaugucucacagcccagcuggguugcaauuccagaaugcugggaguuuuacagugcc

SEQ ID NO: 437319 - RNA, 64 nt, hsa
uuacugcacugcugagaacuaauuaaaauuauauauuccagauuguaaaacauguuuauuucuu

SEQ ID NO: 437320 - RNA, 64 nt, hsa
aaaucacuauauacaauacacccuuaauuuguucauuccagaaacauacugagaugucagcuac

SEQ ID NO: 437321 - RNA, 64 nt, hsa
ucuugugaguggauuacagguuuuugaucccaaaauuccagagcuuucaacucucugaauuugu

SEQ ID NO: 437322 - RNA, 64 nt, hsa
aaauaauauagucauuagccaccuaaacauuuuaauuccagauauuauuuaauuccauauaaua

SEQ ID NO: 437323 - RNA, 64 nt, hsa
auuacccaaauauaaccauuuaaagaaagaaugcauuccagaacaaauuguuuacauaaguucc

SEQ ID NO: 437324 - RNA, 64 nt, hsa
auuuuuaaccacuugccucuuucuccagcagcugauuccagaacaaaucauuauguuuccuaac

SEQ ID NO: 437325 - RNA, 64 nt, hsa
ccaggguuauuuguucagguucuuccuuguuaggauuccagacuggaaaguuggaagucucagg

SEQ ID NO: 437326 - RNA, 64 nt, hsa
ugccaauuugggauuuucaaauauuuaauucuaaauuccagauuuuaaggaagauuuuucaaga

SEQ ID NO: 437327 - RNA, 64 nt, hsa
augauaaaacauauccaaagcacccaaaccugugauuccagaaaaguagauccuauuuuuguuu

SEQ ID NO: 437328 - RNA, 64 nt, hsa
ucagcugugggcucagaaacugcuagguaaaagaauuccagaaggaggccagggcauaaguugg

SEQ ID NO: 437329 - RNA, 64 nt, hsa
gagugaagaugccgaggaugaacuugcauugaacauuccagaugugugagaucauguguauuac

SEQ ID NO: 437330 - RNA, 64 nt, hsa
cagugaagauggagaaggugaacuugcuuugaauauuccagauguguuuggucgugcguauggc

SEQ ID NO: 437331 - RNA, 64 nt, hsa
uugagcagcugcuagauaucuuaucagagcucagauuccagauuucacaucccagcagccgguu

SEQ ID NO: 437332 - RNA, 64 nt, hsa
gugcaccuccugcaaagcuggcagaggcccuggaauuccagaucaccugaggggaaaggguugu

SEQ ID NO: 437333 - RNA, 64 nt, hsa
cuagagcuggagugaggaguagaggucuccggcuauuccagaaagaaaagugagccacaugcag

SEQ ID NO: 437334 - RNA, 64 nt, hsa
gaaaugcauguuuagugagcacuaauacaaucuuauuccagaagacuguuuuuaguagcuuauu

SEQ ID NO: 437335 - RNA, 64 nt, hsa
gcagcauucuggaggggagagcuuugugcuugucauuccagagugcugaggccagggcugaugg

SEQ ID NO: 437336 - RNA, 64 nt, hsa
aaucugcuagaaaguuaggggguucuuauuuugcauuccagaaucuugacuuucugauugguga

SEQ ID NO: 437337 - RNA, 64 nt, hsa
auagugagaaaucaacaaaaagcaaaauaagacaauuccagacacuccugaauuuacuuggauu

SEQ ID NO: 437338 - RNA, 64 nt, hsa
guaccuaccacaugggaaccguuuguccacacucauuccagagaaaaccgaguccucucaguug

SEQ ID NO: 437339 - RNA, 64 nt, hsa
guuuuucauuauuuuaaguugaauuugaauaaagauuccagaaauaaacauggagcucaguauu

SEQ ID NO: 437340 - RNA, 64 nt, hsa
acuguugaacaaagggaagauuugaacaguguaaauuccagaguugagaaagcauuuagcaugg

SEQ ID NO: 437341 - RNA, 64 nt, hsa
ccacccuuucugaaagcaaacagugcugcucuuuauuccagacaaggcaggaaagucugaguug

SEQ ID NO: 437342 - RNA, 64 nt, hsa
gcguggguuaccuuaucacccuggagcacuugguauuccagaccccugacaugaggaaugcagg

SEQ ID NO: 437343 - RNA, 64 nt, hsa
auauggcucauugacuuuuccauuacaucugaggauuccagaguccucuguucaucccugggau

SEQ ID NO: 437344 - RNA, 64 nt, hsa
gucccgccaccuuugcuucccgcuccuucuggacauuccagagcccugcaccaaacccuuacuu

SEQ ID NO: 437345 - RNA, 64 nt, hsa
ccugggccacugaggagaggggagagagcuggugauuccagaagggugacccggacagccuagc

SEQ ID NO: 437346 - RNA, 64 nt, hsa
ugaauaacaauauuuuuccaaauugaaaguaaauauuccagaaguugauagccugguuaaaagu

SEQ ID NO: 437347 - RNA, 64 nt, hsa
aaagaggucuucauuuagacaugugauuucuaaaauuccagaaagcaaaauugauaagauguua

SEQ ID NO: 437348 - RNA, 64 nt, hsa
aaaaacaaaaaaaaaccaccaaauccccaaauucauuccagaucuauuuuucuaccagagagag

SEQ ID NO: 437349 - RNA, 64 nt, hsa
acagcaaguggauccuggcaacugcagcugcuggauuccagauucuggguccccaaucccucug

SEQ ID NO: 437350 - RNA, 64 nt, hsa
ucuaucccugccaaggugaccuuggaggcugcuuauuccagacuggguugauagaaggucacua

SEQ ID NO: 437351 - RNA, 64 nt, hsa
caggguucaauuaguaaaacagaagccacacuguauuccagaugauagaggcuuacucagccug

SEQ ID NO: 437352 - RNA, 64 nt, hsa
ggcuugucuaaccccagguuuucugcucuguccaauuccagagcugucuggugaucacuuuaug

SEQ ID NO: 437353 - RNA, 64 nt, hsa
uuauuguaaaagugacaugaaaauuacaacagauauuccagaccaaaauaauacaacaauccca

SEQ ID NO: 437354 - RNA, 64 nt, hsa
acccuugacucaacggggacaacuccagaaggucauuccagauccagagauccccaucgaacug

SEQ ID NO: 437355 - RNA, 64 nt, hsa
cuugagagaacaguguugcugcuggcagagaugcauuccagagaugcacuccgcucuggaacuc

SEQ ID NO: 437356 - RNA, 64 nt, hsa
uugauuucaaagcaagucaaccugcuuuuuucuguuuuuacaguggaaucuaggaggccacuua

SEQ ID NO: 437357 - RNA, 64 nt, hsa
ggugcccgccaccacacccggcuaauuuuuuguguuuuuacaaaauacaaaaaaguagagacag

SEQ ID NO: 437358 - RNA, 64 nt, hsa
aauacauuauacuuuauaacuaauagauaacaguuuuuuacauauuaaauauguucuacuuaaa

SEQ ID NO: 437359 - RNA, 64 nt, hsa
ucaaacaauaggaaacuuuuuuuuuuuuuuuuuuuuuuuacaguuuaguguaucugguuucuac

SEQ ID NO: 437360 - RNA, 64 nt, hsa
guacagccaguucuuuuaugcaaaaaucuaugcauuuuuacaaucuuauauuaaacugguauuu

SEQ ID NO: 437361 - RNA, 64 nt, hsa
gggccccacgucucugucucugguaccucccgcuuuuuuacacugcaugguucccacgucucug

SEQ ID NO: 437362 - RNA, 64 nt, hsa
ggcccagcuguggguccugaagguaccucccgguuuuuuacaccgcaugggccccacgucucug

SEQ ID NO: 437363 - RNA, 64 nt, hsa
auaaauacugacaccagucuagaagacauucuacuuuuuacaauaaauuucauuuguaauuuua

SEQ ID NO: 437364 - RNA, 64 nt, hsa
uaaaugucaagcacaacccaaaaucuugaaggaguuuuuacagugcuuuuguggaacaguuuau

SEQ ID NO: 437365 - RNA, 64 nt, hsa
auggcaaccauaacuuuugaaccaaaaaaaauuguuuuuacaucuuuaugcugaaaauguguuu

SEQ ID NO: 437366 - RNA, 64 nt, hsa
cucaugcagauugcugauguuuuauuaaaccuuauuuuuacaaaaaugaccauaaaucuuugcu

SEQ ID NO: 437367 - RNA, 64 nt, hsa
aacgcuuugaaaccuuuagagggaagauccucauuuuuuacaauuuuguuccuuuucaucauag

SEQ ID NO: 437368 - RNA, 64 nt, hsa
uccaaaaauaauuguccuuuuuucuuucuuucuuuuuuuacaauaaggcucuugaaaauuguca

SEQ ID NO: 437369 - RNA, 64 nt, hsa
aucaaagcaauaggauuugauuugauuagguaucuuuuuacaccaguauguuauuuuuaaccaa

SEQ ID NO: 437370 - RNA, 64 nt, hsa
uauuuugcuauaaaaucggugcaguuuuuuaugguuuuuacacuucucuuuaauucccaccuaa

SEQ ID NO: 437371 - RNA, 64 nt, hsa
uauccuugaugucugucuauuauucauucaacucuuuuuacagaccucaguauuagucugugac

SEQ ID NO: 437372 - RNA, 64 nt, hsa
uaaacuagcuuuguggaagauaaaucgugcacuauuuuuacacauaaauaguuauaucaauguc

SEQ ID NO: 437373 - RNA, 64 nt, hsa
ucacucugaucuaagaaauuauugaaauugacccuuuuuacacaaaugucuuuaaaaaaaaaaa

SEQ ID NO: 437374 - RNA, 64 nt, hsa
uguggacacacucaacuuugauauucaggagauguuuuuacaaaaugacuaauugaaaaaaguu

SEQ ID NO: 437375 - RNA, 64 nt, hsa
uuuuuugcacaaaccaaaaguuuaauguuaauucuuuuuacaaaacuauuuacuguaguguauu

SEQ ID NO: 437376 - RNA, 64 nt, hsa
auccauucuauuuuuaacuuccauaucugccauauuuuuacaaaauuuguucuagugcauuucc

SEQ ID NO: 437377 - RNA, 64 nt, hsa
ccugugugucuuuuuuuacuuaugccgucucauauuuuuacaaauaauuaucacaauguacuau

SEQ ID NO: 437378 - RNA, 64 nt, hsa
gggaauaauuagaaacacacuuuugcacauauauuuuuuacaaacagaugaaaaaaguuaacau

SEQ ID NO: 437379 - RNA, 64 nt, hsa
ugauuagaugguuauauuacaaucauuuuauauuuuuuuacaugauuaacauucacuuauggau

SEQ ID NO: 437380 - RNA, 64 nt, hsa
aauaagugucuccuuuuuuauuuacuuugguauauuuuuacacuaaggacauuucaaauuaagu

SEQ ID NO: 437381 - RNA, 64 nt, hsa
cuguagugauuccuggggccagaguggcauuauguuuuuacaaaauaaugacauaugucacaug

SEQ ID NO: 437382 - RNA, 64 nt, hsa
ggauaguuuuguuuaaauucuugcagauuacauguuuuuacaguggccugcuauugaggaaagg

SEQ ID NO: 437383 - RNA, 64 nt, hsa
uaccuaaaugaaucauggaaacacucuuuaugauuuuuuacaacaccagauaugcaggugaauu

SEQ ID NO: 437384 - RNA, 64 nt, hsa
agcgacagauucuccuugaugguacacuuucuaguuuuuacacagugauuuagguccacguucc

SEQ ID NO: 437385 - RNA, 64 nt, hsa
aauuuuuauuaccaauauauaagaauguaauuuauuuuuacauaauuaucuuaugucuaguaau

SEQ ID NO: 437386 - RNA, 64 nt, hsa
uaaauuuaaaacuaauuuggggaagaaucuguauuuuuuacaauaccuaguguucuugccagua

SEQ ID NO: 437387 - RNA, 64 nt, hsa
aaggugcuuuagcuaucaguaguaccaaaggaucuuuuuacaaggcuuccugugguauugacuc

SEQ ID NO: 437388 - RNA, 64 nt, hsa
cguuaugcuaagaggaaaucacugaggccauaucuuuuuacaaucugaaaaaaaaguaguaaaa

SEQ ID NO: 437389 - RNA, 64 nt, hsa
cuuggcagaguaugacgaugguauuuaucuguauuuuuuacaguuaugcauccuguauaaauac

SEQ ID NO: 437390 - RNA, 64 nt, hsa
gauacaaaaugcugagguaauaauuauaguaugauuuuuacaauaauuaaugugugucugaaga

SEQ ID NO: 437391 - RNA, 64 nt, hsa
ucuugcuucuuuuuuauuacuguuaugauuuugcuuuuuacagauguuggacgauuuuuucuuc

SEQ ID NO: 437392 - RNA, 64 nt, hsa
auuugggguucuaaacaguuaugaaaguaagugauuuuuacaugauuccagaauaacacuugua

SEQ ID NO: 437393 - RNA, 64 nt, hsa
uucugucuuaaucacaaauucauauuuuuacacauuuuuacaauauugccucagauuauguuaa

SEQ ID NO: 437394 - RNA, 64 nt, hsa
uuucaaaguguucugucuuaaucacaaauucauauuuuuacacauuuuuacaauauugccucag

SEQ ID NO: 437395 - RNA, 64 nt, hsa
gccagaaaaaugugcuucauuccccccugguuaauuuuuacacacccuaggaaacauuuccaag

SEQ ID NO: 437396 - RNA, 64 nt, hsa
auauuguuaugaagcacuuuuuaccaacggucaguuuuuacauuuuauagcugcgugcgaaagg

SEQ ID NO: 437397 - RNA, 64 nt, hsa
gggagaauaguugagaucuggaaagcauagacauuuuuuacacucuggauagacuuuauucuug

SEQ ID NO: 437398 - RNA, 64 nt, hsa
cuuauagaaauguucacgacaaauucauuuguguuuuuuacaugucaauaauguaugcuaaauu

SEQ ID NO: 437399 - RNA, 64 nt, hsa
uuuuguuuguuuuguuuuuuuguuuuuguuuuuguuuuuacacucgcugcucucaauaaauaag

SEQ ID NO: 437400 - RNA, 64 nt, hsa
guuuuuacacucgcugcucucaauaaauaagccuuuuuuacaaccuguuucugagauucauucc

SEQ ID NO: 437401 - RNA, 64 nt, hsa
uuaaccuauaaauaaccccuuucaauauaccugguuuuuacagcauugcaaaaucuguaaaaau

SEQ ID NO: 437402 - RNA, 64 nt, hsa
ggaaaaauuauugcccuguggacuccuuuaauuuuuuuuacauuagacgaagcuucuccuguuu

SEQ ID NO: 437403 - RNA, 64 nt, hsa
agagaaguagcauauggaaaacuauaaugugucuuuuuuacaaugacuucagcucuguuuuuag

SEQ ID NO: 437404 - RNA, 64 nt, hsa
aauaaaugccauauuucaaacaaaacacguaauuuuuuuacaguauguuuuauuaccuuuugau

SEQ ID NO: 437405 - RNA, 64 nt, hsa
uugacucuuagaugcuauugaucuguagcaccauuuuuuacaaacgacuaaggaaaaaaccugc

SEQ ID NO: 437406 - RNA, 64 nt, hsa
uguguuuuauacaaaaauggaauugauaaaccauuuuuuacaaaauuaauuugucucaaaacug

SEQ ID NO: 437407 - RNA, 64 nt, hsa
gccucuuuguaaguacaguaaaauaauccaccguuuuuuacagacccuagucaaaggguuaaaa

SEQ ID NO: 437408 - RNA, 64 nt, hsa
gucaauauauugguggguuuaaaacuuugcugcuuuuuuacauaaagccugugccuuuccuaga

SEQ ID NO: 437409 - RNA, 64 nt, hsa
uauuuuuaucauuauuugggguuugaaaaauuuuuuuuuacaccuucuaauuucuuuauuucuc

SEQ ID NO: 437410 - RNA, 64 nt, hsa
aauaaccaugaaugacugaauaguuuaguccagauuuuuacagaggauacaucuauuuuuauca

SEQ ID NO: 437411 - RNA, 64 nt, hsa
auguuacucuuagcauugauuuuguauguuagacuuuuuacauuguuuaucuaauauuauuuau

SEQ ID NO: 437412 - RNA, 64 nt, hsa
aaaaauuaaguuauacauaaaauucauauuaaacuuuuuacagaaagcauacaugauaaacagu

SEQ ID NO: 437413 - RNA, 64 nt, hsa
ccacuaacauauggcuauugcucuaugauuuuuuuuuuuacauuaggaggcagugauauugugg

SEQ ID NO: 437414 - RNA, 64 nt, hsa
aaguggccucgaguacuugguaaguuacuuaaaauuuuuacaaaaauaucccacucaaugccaa

SEQ ID NO: 437415 - RNA, 64 nt, hsa
caccagacuguagcaucauaaaguuaauuuacaguuuuuacaacauugcuucuacauucuuacu

SEQ ID NO: 437416 - RNA, 64 nt, hsa
aaucuuauaaaacccuugaaaauaaacagucucuuuuuuacaaagccuguguuagagcacagau

SEQ ID NO: 437417 - RNA, 64 nt, hsa
auaacauuuacauugucaaccuuuauugacuuuguuuuuacaauaaaaaauauuuuacaacuua

SEQ ID NO: 437418 - RNA, 64 nt, hsa
gcuuuuauuuuagucacuaaaacuaaaguuuuuauuuuuacauugugauuuuuacauuaaaaua

SEQ ID NO: 437419 - RNA, 64 nt, hsa
cacuaaaacuaaaguuuuuauuuuuacauugugauuuuuacauuaaaauauuaacuuuuuuuaa

SEQ ID NO: 437420 - RNA, 64 nt, hsa
ucaauaacuucagauucuaagaguggauuuuuuuuuuuuacaugggcuccuauuuuuuccccua

SEQ ID NO: 437421 - RNA, 64 nt, hsa
aaaauuauaaauuuuuuuguuuguaauuucagguuuuuuacauuuuaacaaaauauuuuaaaag

SEQ ID NO: 437422 - RNA, 64 nt, hsa
ugugucuuuucauaagguuuuacaaugguuuauuuuuuuacaagguuuacgugucucaaagcac

SEQ ID NO: 437423 - RNA, 64 nt, hsa
acaaaaaugguagaugguauuuuaaacagguacauuuuuacaguguuuucuuaucaauuugcua

SEQ ID NO: 437424 - RNA, 64 nt, hsa
acacguuauauguuuccaaaucuguguauugugauuuuuacauacuaaugaauauaaacaggug

SEQ ID NO: 437425 - RNA, 64 nt, hsa
uuugguguuaguauuucacacucaguucucccuuuuuuuacauaaggauugaguuucuuuuuau

SEQ ID NO: 437426 - RNA, 64 nt, hsa
agagcaaaugaaaaauuucaacuuguauauucauuuuuuacauuuugcuuugacuuuuaaauuu

SEQ ID NO: 437427 - RNA, 64 nt, hsa
caugauuugcaugguuuaaucagauuuuuuuuuuuuuuuacaccauauuagcuaccuuuucaau

SEQ ID NO: 437428 - RNA, 64 nt, hsa
aaaguuaccagaggucaaugaauaaucaaaacauuuuuuacaguacaccuuuccuggaugauau

SEQ ID NO: 437429 - RNA, 64 nt, hsa
aagaaucaccguugacgcaucuugauuugguugguuuuuacauguguaaagaagguggggucuc

SEQ ID NO: 437430 - RNA, 64 nt, hsa
auuuuugagguuuuuggaaguuacuauuuggccauuuuuacaaauggauuuugcauuaacagga

SEQ ID NO: 437431 - RNA, 64 nt, hsa
uaugaaaaucaguccauccuuguuauaaaaaauuuuuuuacaauuguaauuauauugauguuca

SEQ ID NO: 437432 - RNA, 64 nt, hsa
aaaaauuaagaguguguuuacaacuguuuucucuuuuuuacaguacauguauuuaaaucauugc

SEQ ID NO: 437433 - RNA, 64 nt, hsa
cauuaauuuuugcauugcuucaguuugccaaguguuuuuacaucaucucauuugaucucaaaac

SEQ ID NO: 437434 - RNA, 64 nt, hsa
ggggcccgagagaaggaacagcuguggaacaggcuuuuuacaccccaagugcaugggguugcuc

SEQ ID NO: 437435 - RNA, 64 nt, hsa
gagcccauaaaugacuuaaaucagcuuuacaucauuuuuacauaucaagugguuucauguuaaa

SEQ ID NO: 437436 - RNA, 64 nt, hsa
guggcaguugugaggaaaagccagucaaaugaccuuuuuacaaaagaaaugcaguggucacuuc

SEQ ID NO: 437437 - RNA, 64 nt, hsa
cccccauguaugccuauauguguauuguauacuuuuuuuacauaauuggagucauacuguaaac

SEQ ID NO: 437438 - RNA, 64 nt, hsa
gauuuugauagugccauuuauuguuaaagauuuauuuuuacaaaguaaauucaggguuuuagau

SEQ ID NO: 437439 - RNA, 64 nt, hsa
aauuuaaaaagcuagaaaauucauguaguuacuuuuuuuacauauauaaucuguuaaugaauua

SEQ ID NO: 437440 - RNA, 64 nt, hsa
aauuuuagagccaaauuuuucuaucuuguuggauuuuuuacaguguuuaagauagacacuuaag

SEQ ID NO: 437441 - RNA, 64 nt, hsa
ucaagacaacuaaaacaaaugauaaaaauguuuauuuuuacacuccagcauaucgggugaguuu

SEQ ID NO: 437442 - RNA, 64 nt, hsa
caaagaaauagagauaaucaugauuauaccuuuauuuuuacaggaagagaugauguaacuagag

SEQ ID NO: 437443 - RNA, 64 nt, hsa
auaaaccaauuuuauaaucuuuaaauuuaucaacuuuuuacauuuguguuauuuucagucaggg

SEQ ID NO: 437444 - RNA, 64 nt, hsa
uccaacuucuauguuuaucuuuguuacuuucacuuuuuuacaaccuggccagaggcauuuuuua

SEQ ID NO: 437445 - RNA, 64 nt, hsa
aaguagaucauggcagcaugaauuccaacucacuuuuuuacaacuccaacuucuauguuuaucu

SEQ ID NO: 437446 - RNA, 64 nt, hsa
uucuccaugauuugggguuuuuuuucguuguuguuuuuuacacuucuuaaccuguugaucuauu

SEQ ID NO: 437447 - RNA, 64 nt, hsa
auguucuuuuguauuuggguauuuuucaucuuaauuuuuacagcauauacucuucuuaccagua

SEQ ID NO: 437448 - RNA, 64 nt, hsa
uuuugucauuuuuuacaucaacuucauggucuuguuuuuacaugguaauugcauguacuuagga

SEQ ID NO: 437449 - RNA, 64 nt, hsa
uuuucuaguuuuggugacuuagugauuuugucauuuuuuacaucaacuucauggucuuguuuuu

SEQ ID NO: 437450 - RNA, 64 nt, hsa
uuagaucucuucaguguuuauugguuaguuuuuuuuuuuacaauuauauaugaugcuauuguuu

SEQ ID NO: 437451 - RNA, 64 nt, hsa
auucugaaaagcaaacaugaaaaacugaacacaguuuuuacagauauacaauauggagugacuu

SEQ ID NO: 437452 - RNA, 64 nt, hsa
guuguuuuuucuuaauguaagaaaaauuguauuuuuuuuacaaguaucuucaaacugaaucuuu

SEQ ID NO: 437453 - RNA, 64 nt, hsa
uuucacuuuacuacagugauauaaaaaccagcaguuuuuacacuaaauuuuuuaaagaaauauu

SEQ ID NO: 437454 - RNA, 64 nt, hsa
uaaagagauuucauugcaauguaauaacuacaguuuuuuacaaauuggaacagcuuuggugugu

SEQ ID NO: 437455 - RNA, 64 nt, hsa
uguauuccaaaaacgaguuuauauuuucaaacgguuuuuacagcuuagacuuuguacuuacugc

SEQ ID NO: 437456 - RNA, 64 nt, hsa
cuauaaacacagacccccuugucuuugccucugauuuuuacacaguguagaguggccagcagug

SEQ ID NO: 437457 - RNA, 64 nt, hsa
gacuucacugcuccuuuacgauauuccaaauaguuuuuuacauuggaaaaacuaauucuuggga

SEQ ID NO: 437458 - RNA, 64 nt, hsa
uguaguuuaaaaauaggaccauguaugagacacuuuuuuacaaaaagugccguauauacauaug

SEQ ID NO: 437459 - RNA, 64 nt, hsa
gugcuaaccauggcaagcaaacauuuacauuuguuuuuuacaauaaauuucuuuuaaaauauac

SEQ ID NO: 437460 - RNA, 64 nt, hsa
aaauuuuagauuauuuuuauuaccauguacugaauuuuuacauccugauaccuuuuccuucucc

SEQ ID NO: 437461 - RNA, 64 nt, hsa
gaauuaagaaagccucgucgugaaagcacuuaauuuuuuacaguuagcacuucaacauagcucu

SEQ ID NO: 437462 - RNA, 64 nt, hsa
uuucagauguuaaugugaaagaaaggguguugcauuuuuacauuucccuaaugaucuugcuaau

SEQ ID NO: 437463 - RNA, 64 nt, hsa
cuucuuaagagaaacugaagaguuuguucagcaguuuuuacaagaauucgggaccuccgcuugc

SEQ ID NO: 437464 - RNA, 64 nt, hsa
uguaaguauuuuaaugaguaaauagaauuaaccuuuuuuacaaaugaaaugauaggcaucuaug

SEQ ID NO: 437465 - RNA, 64 nt, hsa
aaacaggugguuggcugcauuuuuuaagcccaguuuuuuacauuuuaaauugucuuuauugugu

SEQ ID NO: 437466 - RNA, 64 nt, hsa
ucauauuuuacgcucgaggguuuuuaccgguuccuuuuuacacuccuuaaaacaguuuuuaagu

SEQ ID NO: 437467 - RNA, 64 nt, hsa
augccuacaccuagguuuauuuauuaaaagcgcuuuuuuacauuccuugcaauacugaugguga

SEQ ID NO: 437468 - RNA, 64 nt, hsa
aaagaccuuuguagauucaacaauuaugauaggauuuuuacagacaccuauuuugggcucaguu

SEQ ID NO: 437469 - RNA, 64 nt, hsa
uaugucuguauugaagagaaagccaguuuugaguuuuuuacacuugcacaucauuaucugugcc

SEQ ID NO: 437470 - RNA, 64 nt, hsa
ccgcccuuuggcccggccucugcucugucuccuuuuuuuacauaagaaccaauccguguuucac

SEQ ID NO: 437471 - RNA, 64 nt, hsa
cugguaagggcaauuagccucgcuuaaguugccuuuuuuacacaccaaaacuuuuuacaugaag

SEQ ID NO: 437472 - RNA, 64 nt, hsa
ccucgcuuaaguugccuuuuuuacacaccaaaacuuuuuacaugaagggcugguuucacaugaa

SEQ ID NO: 437473 - RNA, 64 nt, hsa
uggguggccuuuuuuuaccgauccccuuuuuuauuuuuuacaaccggaccuccacccccaacuu

SEQ ID NO: 437474 - RNA, 64 nt, hsa
uauaauuuuaguggaauuguuauugagaauaaaauuuuuacaaucauaacuggcuuuuuccaag

SEQ ID NO: 437475 - RNA, 64 nt, hsa
uuuguuuuucuuuuuuuucuuucuuuuuuuuuuuuuuuuacaauuuugaggucuucguguucaa

SEQ ID NO: 437476 - RNA, 64 nt, hsa
ccacagggagagacaugggcgaaugagugagaaauuuuuacaaaauuacgaugucauuuggguc

SEQ ID NO: 437477 - RNA, 64 nt, hsa
gcauuauauguuucaaccuagucuaagugggucuuuuuuacauuuuucaagaacggauuuccug

SEQ ID NO: 437478 - RNA, 64 nt, hsa
gaaaacacucccccccccccccuuuuuuuuuuuuuuuuuacauuuuaggacacugugaggggaa

SEQ ID NO: 437479 - RNA, 64 nt, hsa
caaacuuaaauguuggugcgugcuuuuuuuuuuuuuuuuacacugaauacuugcugugugcaau

SEQ ID NO: 437480 - RNA, 64 nt, hsa
uuacugaaucuuuaaaacuguguauuugaccuuuuuuuuacaacacuggugacagucauauggu

SEQ ID NO: 437481 - RNA, 64 nt, hsa
gaaacuguguucucccugcucgggggcccauguuuuuuuacacgccugccuccuguccccuuau

SEQ ID NO: 437482 - RNA, 64 nt, hsa
ccaggucuggaucgauucacuugccgggagagacuuuuuacaacucaucugcagcuccgggugc

SEQ ID NO: 437483 - RNA, 64 nt, hsa
aacaaauucauuuaaacaaacuuauuauuauuauuuuuuacaaaauauauauauggagaugcuc

SEQ ID NO: 437484 - RNA, 64 nt, hsa
gaaugaauuauuauuauuuuuauuuuucuuuuuuuuuuuacauuuuguauagaaacaaauucau

SEQ ID NO: 437485 - RNA, 64 nt, hsa
uccaaggaagugcuuugcacacuuucuuugcuccuuuuuacagucuuugucuuugcagcaagca

SEQ ID NO: 437486 - RNA, 64 nt, hsa
guuaacuguucuauucugauacuacgcguguuguuuuuuacaacagguauguuuuuguuucaga

SEQ ID NO: 437487 - RNA, 64 nt, hsa
caccaaaaaucaaggacaaaaauaaguguguuuguuuuuacaggugugaaagucacagcuugua

SEQ ID NO: 437488 - RNA, 64 nt, hsa
gcagguuuguauauaaaaugaaaagcuauacuacuuuuuacaaaagggcaaacugggcugaugu

SEQ ID NO: 437489 - RNA, 64 nt, hsa
cgcuuuuauuaauuuuuugaagaaguacacagaauuuuuacagaauguaguauuuugauaucau

SEQ ID NO: 437490 - RNA, 64 nt, hsa
uacaaacacauguacuucuguauacauuuacauauuuuuacaauucauacuuuaauuucuaggc

SEQ ID NO: 437491 - RNA, 64 nt, hsa
uuuggguuacaguauuuuuauucauauuuaaacauuuuuacaaaauaaauaaaguguuuuacau

SEQ ID NO: 437492 - RNA, 64 nt, hsa
cuaagacuuucuaugugguuugggcucccucuuauuuuuacaaguuucauuuuuaaaaguaggc

SEQ ID NO: 437493 - RNA, 64 nt, hsa
uguggcuuggacuuacguuuauugucaaggggaguuuuuacauggaaaugacaaugggaaaauu

SEQ ID NO: 437494 - RNA, 64 nt, hsa
uaagaagaugaaauuacucuggauguuugguauuuuuuuacauuaaaacaaacuaaagcaaaau

SEQ ID NO: 437495 - RNA, 64 nt, hsa
aaaaauguaguuacacguuaaaaucugcaaaugguuuuuacaccucugauuuuaacaugaacuu

SEQ ID NO: 437496 - RNA, 64 nt, hsa
uguggccagaaugcggugaucaaaacgcuccaucuuuuuacaguggcauaggaagacggcaaaa

SEQ ID NO: 437497 - RNA, 64 nt, hsa
cuagguuuaggcccuuguacauuuugcccauaacuuuuuacaaaguacuucuuuuauugcacau

SEQ ID NO: 437498 - RNA, 64 nt, hsa
ugucuugcaguuuuugaaaauguuucaagucuaguuuuuacaagcacauuacaguaauugcagg

SEQ ID NO: 437499 - RNA, 64 nt, hsa
aaauaucauucgucagggaaauauaguuguaauauuuuuacaggauauuccuagguaaaugaag

SEQ ID NO: 437500 - RNA, 64 nt, hsa
agacuucuagaaaaccugagaggaaaaagaauucuuuuuacaggaggcagcagaaaacugucug

SEQ ID NO: 437501 - RNA, 64 nt, hsa
acagugaaucuccuaauuuuagcaucuuuuuuuuuuuuuacaaucauucagauugugaauucag

SEQ ID NO: 437502 - RNA, 64 nt, hsa; identical to SEQ ID NO: 189516

SEQ ID NO: 437503 - RNA, 64 nt, hsa; identical to SEQ ID NO: 189517

SEQ ID NO: 437504 - RNA, 63 nt, hsa
guggucuucaagacgacagcucuguaucugccaugugaagagaauuaacaauaaaagugugaa

SEQ ID NO: 437505 - RNA, 63 nt, hsa
uaucugccaugugaagagaauuaacaauaaaagugugaagagcgauugugaggaacaagccug

SEQ ID NO: 437506 - RNA, 63 nt, hsa
aguauuccagagcugcuauuagaagcugcuuccugugaagaucaaaucuuccugaguaauuaa

SEQ ID NO: 437507 - RNA, 63 nt, hsa
uuauaauauaaugguaauucauuuuugauguuuugugaagaauuuaaauuuaaacgaauguuc

SEQ ID NO: 437508 - RNA, 63 nt, hsa
gccgaugugaagaugaaugaauguaacuccuggugugaagaugaauguaaacccuggcgacag

SEQ ID NO: 437509 - RNA, 63 nt, hsa
uuucucgguaaccacggcagagagcagcgccgaugugaagaugaaugaauguaacuccuggug

SEQ ID NO: 437510 - RNA, 63 nt, hsa
guucuucagagagcuuccaccagcugcugaguuugugaagacaguggaguucacaagacuacg

SEQ ID NO: 437511 - RNA, 63 nt, hsa
cugaagcaguggguucagcuggucaucuugucaugugaagaccaucuuccuacagagucuagg

SEQ ID NO: 437512 - RNA, 63 nt, hsa
uucuaugguauaucccagucucuugcaaacgauugugaagaaugccaguguuguuuaagauuc

SEQ ID NO: 437513 - RNA, 63 nt, hsa
ggccagcaaaaugcuggcaguuuucuuuaucuuugugaagaacaggcccuuccuguuugggga

SEQ ID NO: 437514 - RNA, 63 nt, hsa
gagaaaauuuauacuguagagaaacccuggaaaugugaagaacguggcaaaguucuuuaccuc

SEQ ID NO: 437515 - RNA, 63 nt, hsa
aagagaauucauaccggagagaaacuguacaaaugugaagaauauggcaaagccugugaaugg

SEQ ID NO: 437516 - RNA, 63 nt, hsa
augagaacucauacuggaggaaagucuuacaaaugugaagaauguggcagucuuuaaaucuuc

SEQ ID NO: 437517 - RNA, 63 nt, hsa
cugaaauuccguaaguacauagucaaaacacaaugugaagaauuuguuuaaaaacauccugua

SEQ ID NO: 437518 - RNA, 63 nt, hsa
aacaaaguuuacuucaacuaaaauguuucuuccugugaagacauaugguaucauuuuaauuua

SEQ ID NO: 437519 - RNA, 63 nt, hsa
uucuguacuuugcccucaugaguuccaauguugugugaagacaggcagaugcugcacagugaa

SEQ ID NO: 437520 - RNA, 63 nt, hsa
aggccuuguuuuucagcuucaucugcaguucuaugugaagauugauaaaucaguuuuuacuug

SEQ ID NO: 437521 - RNA, 63 nt, hsa
auaggaaaauucauacuggagagaaacuacaaaugugaagaauguguuaaagccuuuaacaag

SEQ ID NO: 437522 - RNA, 63 nt, hsa
aagauaauuuauacuggagaggaacucuauaguugugaagaauguggcaaagcuuuuaaccaa

SEQ ID NO: 437523 - RNA, 63 nt, hsa
acagaaauucauacuggagagaaagccuacaauugugaagaauguggcaaagcuuuuaaccuu

SEQ ID NO: 437524 - RNA, 63 nt, hsa
aagaaaauuuacacuagagagaaagccuacaaaugugaagaauguggcaaagccuuuaaccag

SEQ ID NO: 437525 - RNA, 63 nt, hsa
aagauaauucauagcggagagaaaccccacaaaugugaagaauguggcagagcuuuuaaccag

SEQ ID NO: 437526 - RNA, 63 nt, hsa
aagauaauucacaguggagaaaaacccuacaaaugugaagaauguggcaaagcuuuuaaccag

SEQ ID NO: 437527 - RNA, 63 nt, hsa
aagaagauucauacuagagagaaacccuacaaaugugaagaauguggcauaucuuuuaaccag

SEQ ID NO: 437528 - RNA, 63 nt, hsa
aagaaaauucaaacuggagagaaacucuacaaaugugaagaauguggcaaagcuuuuaaccaa

SEQ ID NO: 437529 - RNA, 63 nt, hsa
aagaaaauucauacuggagagaaaccuuacaagugugaagaauguggcaaaacuucuaaccau

SEQ ID NO: 437530 - RNA, 63 nt, hsa
aagagaauucauacuggagagaaacccuacaaaugugaagaauguggcaaagcuuuuaaccaa

SEQ ID NO: 437531 - RNA, 63 nt, hsa
aaagcggcuuucuaauagagagauuaguaaauaugugaagaaaaagaccugcauuuggcagga

SEQ ID NO: 437532 - RNA, 63 nt, hsa
uucuccauccucccaggaaccgaacauaucauuugugaagaauuauucagugaauuuguccau

SEQ ID NO: 437533 - RNA, 63 nt, hsa
gaaucuacagaacaaagaacggcaugugaauucugugaagaaugaaguggaggaaguaacuuu

SEQ ID NO: 437534 - RNA, 63 nt, hsa
uuuaacaaaacaagaaagaaacguacuuaacugugugaagaaauggaaucagcuuuuaauaaa

SEQ ID NO: 437535 - RNA, 63 nt, hsa
gaacaccaacuuaagaauuugggggauuaaagaugugaagaccacagucuuggguuuucauau

SEQ ID NO: 437536 - RNA, 63 nt, hsa
uuuuugagacagaguuucgaucuauuuuaaguaugugaagaaaaucuacuuguaaaaggcuca

SEQ ID NO: 437537 - RNA, 63 nt, hsa
aaugacacuaaacuccaugauauuuaaggauagugugaagaucuuuggcaugauuuaaagguu

SEQ ID NO: 437538 - RNA, 63 nt, hsa
ugaagaucuuuggcaugauuuaaagguugaguaugugaagauauaaguaagugaacuaccaug

SEQ ID NO: 437539 - RNA, 63 nt, hsa
aacaaauuaucuaaaaaaaaucuauccuguacaugugaagaucuaggcucgccuccauguuac

SEQ ID NO: 437540 - RNA, 63 nt, hsa
agaaucaagcugguguggggcuuuuauugauagugugaagauuguacacuauauuacaugauc

SEQ ID NO: 437541 - RNA, 63 nt, hsa
agaaucaagcuggcauggggcuuuuauugacagugugaagauuguacacuacauuacaugauc

SEQ ID NO: 437542 - RNA, 63 nt, hsa
acagauuaucugaaaaaaaaucuauccuguacgugugaagaucuaggccugccuccauguuac

SEQ ID NO: 437543 - RNA, 63 nt, hsa
aguagcucuacagccuggccucaacucuaaaagugugaagaaugcaaugggcagagaccuacc

SEQ ID NO: 437544 - RNA, 63 nt, hsa
uucccuuuacugaauaagaugacacguggugauugugaagaugguaauuugcugcuaauagag

SEQ ID NO: 437545 - RNA, 63 nt, hsa
ggcaugguggcuuauggaaaagaggugagccuuugugaagaacauaauggaaaagugcaugua

SEQ ID NO: 437546 - RNA, 63 nt, hsa
ccaaucuccauuacauagggacuguacagagccugugaagauguaugaaugguaucuuuuaua

SEQ ID NO: 437547 - RNA, 63 nt, hsa
uugucuuuuuguggguucaagagcccucugacuugugaagaauuugcugcccucuuaagagcu

SEQ ID NO: 437548 - RNA, 63 nt, hsa
ggaauuucacuuaaaaggaaggucauuuggagaugugaagauacacugcuuuaaggaagcagg

SEQ ID NO: 437549 - RNA, 63 nt, hsa
uuucuuuaaagaacugcucaauauucaaucuguugugaagaaccugauuugcacucuguagug

SEQ ID NO: 437550 - RNA, 63 nt, hsa
ggcaugaaaggaagaggaaugaggauugagacaugugaagacauugugcauuauaucaaugug

SEQ ID NO: 437551 - RNA, 63 nt, hsa
auauauauauauauauaacuugaacuucauaaaugugaagauuaccacuucuuuuuauggcca

SEQ ID NO: 437552 - RNA, 63 nt, hsa
acuuucaaaacuacauuuuaaagggaauguguaugugaagagcacuaccaacaucgcuuuugu

SEQ ID NO: 437553 - RNA, 63 nt, hsa
gugagccacacgccacagucagcgucugcugcuugugaagaaauagccuaccagguacaggau

SEQ ID NO: 437554 - RNA, 63 nt, hsa
uacaccuuuaagaauguuucugaaguuacguuuugugaagagcaaagcacuuggaaucuccgu

SEQ ID NO: 437555 - RNA, 63 nt, hsa
guaauauugacggugauaugaaaacuuuuguuaugugaagauauuuaagucagaaaauuguua

SEQ ID NO: 437556 - RNA, 63 nt, hsa
uugauuuaugcugggcaguggaacgauuuccaaugugaagacgucaauaacuucauuugcgaa

SEQ ID NO: 437557 - RNA, 63 nt, hsa
gagaaagaaauuuuugaggaugcaaagcuuuucugugaagacaagucuucacaucuuguuuuc

SEQ ID NO: 437558 - RNA, 63 nt, hsa
gcuucuuguuguugcuucuguuauuucugucauugugaagacggauccagacacagaagaaca

SEQ ID NO: 437559 - RNA, 63 nt, hsa
aagauaauuaaugcuggagagaaacccuacaaaugugaagaauguggcaaagauuucuauuga

SEQ ID NO: 437560 - RNA, 63 nt, hsa
aagauaauucauauuggagagaaauucuacagaugugaagaauguggcaaaggcuuuaauuag

SEQ ID NO: 437561 - RNA, 63 nt, hsa
aaaauaauucauaaaggagauaaauuauacaaaugugaagaauguggcaaagcuuuuaacaaa

SEQ ID NO: 437562 - RNA, 63 nt, hsa
aagauaacucauacuggagaaaaaucuuacaaaugugaagaauguggcaaagccuuuauccag

SEQ ID NO: 437563 - RNA, 63 nt, hsa
aacauaauuaaugauggagagaaaccauacaacugugaagaauguggcaaagcuuuuaaccag

SEQ ID NO: 437564 - RNA, 63 nt, hsa
aaaauaauucauacaggagagaaacccuacaaaugugaagaaugugacaaagccuuuaaccag

SEQ ID NO: 437565 - RNA, 63 nt, hsa
aacauaauucauaauggagaaaaacccuacaaaugugaagaaugugucaaagcuuuuaacugu

SEQ ID NO: 437566 - RNA, 63 nt, hsa
auaagggaauucauaauagagaaacccuacaaaugugaagaacguggccuggcuuuuaacaaa

SEQ ID NO: 437567 - RNA, 63 nt, hsa
acacauaauuuauacuggacagaaauccuaaagugugaagaaugucacaaagcccuuaauaag

SEQ ID NO: 437568 - RNA, 63 nt, hsa
aacauaaaucauaguguugagaaauccuagaaaugugaagaaugugauaaaguuuuaaauggu

SEQ ID NO: 437569 - RNA, 63 nt, hsa
aaaaaaauucauacuggagggaacuccugugacugugaagaauauggcaaagccuuuaauaaa

SEQ ID NO: 437570 - RNA, 63 nt, hsa
aaaagaaaucauaugaaugagaaauccuagaaaugugaagaaugugacaaagccuuuaaaugg

SEQ ID NO: 437571 - RNA, 63 nt, hsa
aagacaacucauacuggagagaaaccaugcaugugugaagaaugugggaaagccucuaacaga

SEQ ID NO: 437572 - RNA, 63 nt, hsa
aagggaauuuauacaggagggaaacccuacaaaugugaagaauguggcaagccuuuuagcugu

SEQ ID NO: 437573 - RNA, 53 nt, hsa
auacuggagagaaucccuaaaaaugugaagaaugugguaaauccuucagcuga

SEQ ID NO: 437574 - RNA, 63 nt, hsa
augaguuuuagccagucucaagaggcagaguucugugaagaggaacagugugguuugggaaag

SEQ ID NO: 437575 - RNA, 63 nt, hsa
aaauggaaaaaaacauaaaaagcagaauuuuaaugugaagacauuuuuugcuauaaucauuag

SEQ ID NO: 437576 - RNA, 63 nt, hsa
ugccugucuuuaccgcaaucucuaaacacaaauugugaagauuucauggacacugaucacuuc

SEQ ID NO: 437577 - RNA, 63 nt, hsa
gacuggcugaagccauggcagaagaacguggauugugaagauuucauggacauuuauuaguuc

SEQ ID NO: 437578 - RNA, 63 nt, hsa
guauggcuuuuguguaguuagggguuuuuuaagugugaagaaagguaugugggcuuuaaaagu

SEQ ID NO: 437579 - RNA, 63 nt, hsa
gccgucuugaagcaggguacacacguuagguauugugaagaacaucaauccgaacuuuucuuc

SEQ ID NO: 437580 - RNA, 63 nt, hsa
auaagaugguguguauguaagaaauuuguaaaaugugaagagcuaucuacacuaaguucguaa

SEQ ID NO: 437581 - RNA, 63 nt, hsa
ggggacuaugagaucaaaauauuuuuauuauaaugugaagacauugucuuuucacucuaucuc

SEQ ID NO: 437582 - RNA, 63 nt, hsa
aaaacggugguucagcuuguagagccaugacucugugaagaugaauguugucucuuaacuugg

SEQ ID NO: 437583 - RNA, 63 nt, hsa
ggucauucugaauaucagccuuuuauaauuuuaugugaagaggaagaaauauagcuuauuuua

SEQ ID NO: 437584 - RNA, 64 nt, hsa
uauggugacuuuagcuacagcauuuccuauacccagagcuaaacacuggaauaauacugacauc

SEQ ID NO: 437585 - RNA, 64 nt, hsa
ugcuuauuguaacugacaacuguuuucaacuccaagagcuaaacuauuggcaguucauguuaag

SEQ ID NO: 437586 - RNA, 64 nt, hsa
aaggcacauaccaccaaguucaaugagaaauauuagagcuaaccguacucucuucucugcguac

SEQ ID NO: 437587 - RNA, 64 nt, hsa
auagaaaacaguggguacuugcuuuuggcaggauagagcuaagagaauugggcauuaguauuuc

SEQ ID NO: 437588 - RNA, 64 nt, hsa
accuggcuuuccuuuuuaaaagauauuuuacugaagagcuaaaaacuggccagugugggguuag

SEQ ID NO: 437589 - RNA, 64 nt, hsa
aaacaaaagucucuauauucuuugccuauuccaaagagcuaaaaaagucuaacccaggaaagcu

SEQ ID NO: 437590 - RNA, 64 nt, hsa
cuaagacuggauugauuguggacuuuuauacuauauugcagaaaccaauaucuguuucuuggug

SEQ ID NO: 437591 - RNA, 64 nt, hsa
ggacugcuguuuggucaaagaauaccuucuuagcauugcagaaagguggucagaugaccagugu

SEQ ID NO: 437592 - RNA, 64 nt, hsa
gauuuacagaccaaggugugguggaggagguagaauugcagaucagauaaaaagugagcuuaca

SEQ ID NO: 437593 - RNA, 64 nt, hsa
ucuguggcccauugucauuguuuccucaugaaacauugcagaguuugaauccucaguaacucuc

SEQ ID NO: 437594 - RNA, 64 nt, hsa
aaaaaaaaagaaaagaaaaaaggcauaaaucuuuauugcagauuuauuuucauugcaaacuuua

SEQ ID NO: 437595 - RNA, 64 nt, hsa
auauuacugaacucaguguccaguauaaugcagaauugcagaguguagaaugguacugauuugc

SEQ ID NO: 437596 - RNA, 64 nt, hsa
cauacacacacacacacacacucugacugucuuuauugcagaagacaguguguugccuuaccca

SEQ ID NO: 437597 - RNA, 64 nt, hsa
cacacacacacacacacacacacacacagucuuuauugcagaagacaguguguugccuuaccag

SEQ ID NO: 437598 - RNA, 64 nt, hsa
cacauacacacacauacacacacacagagucuuuauugcagaagacaguguguugccuuauagg

SEQ ID NO: 437599 - RNA, 64 nt, hsa
uauuuauuuaaacuaauguucucuuaauuugaccauugcagauuugggugacuuuuuuuuaacc

SEQ ID NO: 437600 - RNA, 64 nt, hsa
cuagccccacucccccauguguauacacaaggaaauugcagaccaauuaguugucuuggccuga

SEQ ID NO: 437601 - RNA, 64 nt, hsa
cgcaucaaucuguguucagguccaggguuacauaauugcagaagcacaagccauacaucgcagg

SEQ ID NO: 437602 - RNA, 64 nt, hsa
acaguauauuuuguaaauauaaguacuaguccuaauugcagaaagagcgucaguuucaccuccc

SEQ ID NO: 437603 - RNA, 64 nt, hsa
gccagaucccugagagucuuucuggcugguuugagucucucaaaucauggauuaggaguaaaga

SEQ ID NO: 437604 - RNA, 64 nt, hsa
accccaaacacaacucaacuucccacaccaccaugucucucaccacaccuucugggccucauua

SEQ ID NO: 437605 - RNA, 64 nt, hsa
gguagccuaagcugauuuucugcugguuacacgugucucucacaccacauuuccucaaagcuaa

SEQ ID NO: 437606 - RNA, 64 nt, hsa
agaauguaucuggcuucauauuuucaagucacaugucucucagaccccuggauucagaacccaa

SEQ ID NO: 437607 - RNA, 64 nt, hsa
uucaggcaaggacaagccagcuucagagaauagugaggagaagcugaucaguaaguuugacaag

SEQ ID NO: 437608 - RNA, 64 nt, hsa
cuguaguuuuuaaaaauguuuuuaguuaaacguugaggagaaaaaaaaaaaaggcuuuuccccc

SEQ ID NO: 437609 - RNA, 64 nt, hsa
caggcuaagucaggaacaucggaugccagggagggaggagaaagccgaagcgaaaggggucagg

SEQ ID NO: 437610 - RNA, 64 nt, hsa
aagggaauuuuagugacaccuuaugccauuucaagaggagaaaugcaggcuggcagagcaauuu

SEQ ID NO: 437611 - RNA, 64 nt, hsa
gacaacagaagccccaugccgccuguccaguucggaggagaacuagcugcugccuugccuuccg

SEQ ID NO: 437612 - RNA, 64 nt, hsa
gugcgaguuccuccugcauaugaaccgaggggaggaggagaagcugagcacgugugacauugcc

SEQ ID NO: 437613 - RNA, 64 nt, hsa
uggaugcuguuuuuauugggcaugucaucuaagagaggagaaauagcuggguuuugggucuaau

SEQ ID NO: 437614 - RNA, 64 nt, hsa
ugaaacuuaucucaaauggagauuuuggugggaggaggagaaaacaauuguuuuuaaaucacac

SEQ ID NO: 437615 - RNA, 64 nt, hsa
uuuaaaccagcaggauacaaguugcaaaugaaaugaggagaaacaguuucaacucugaaaguga

SEQ ID NO: 437616 - RNA, 64 nt, hsa
cagcaagcauuuaucagaaauagaaucacaauaggaggagaauuugacugucugauauuaugau

SEQ ID NO: 437617 - RNA, 64 nt, hsa
aaccuugcuuggaaaccccacaugcaaacgucaugaggagaauuaaaggaguauuaucaguaau

SEQ ID NO: 437618 - RNA, 64 nt, hsa
cagucaacugaccaaacacugcuuugaauuauaggaggagaacaauaaccuaccauccgcaagc

SEQ ID NO: 437619 - RNA, 64 nt, hsa
gcgcaggcagggagaagggccgggggggguaggagaggagaaaaaaaaagugaaaaaaagaaac

SEQ ID NO: 437620 - RNA, 64 nt, hsa
uguccacccuccggcccccgucuuguaaaaaggggaggagaauuagccaaacacuguaagcuuu

SEQ ID NO: 437621 - RNA, 64 nt, hsa
ccggcacagcagcucccucaaggaggagaagagugaggagaaaggaaacucaagucucaccauu

SEQ ID NO: 437622 - RNA, 64 nt, hsa
gggcaggucuguccggcacagcagcucccucaaggaggagaagagugaggagaaaggaaacuca

SEQ ID NO: 437623 - RNA, 64 nt, hsa
aaucaaggccccagaguguguaugcuuccagguggaggagaaaggggaaucucccaaaauuuaa

SEQ ID NO: 437624 - RNA, 64 nt, hsa
acaccauucuggaaguuuggcugcccacaggcaggaggagaagcaugaagagaaaaccuguuug

SEQ ID NO: 437625 - RNA, 63 nt, hsa
aggacuuccugggcccauaggugaagccuucuggaggagaaggugacguggcccagcguccaa

SEQ ID NO: 437626 - RNA, 64 nt, hsa
gacucagcuccaggcugcuuggcagcccagccuggaggagaaggcuaaugacggaggggccccu

SEQ ID NO: 437627 - RNA, 64 nt, hsa
ggaugaaagaggagccaggccuugggcuccugaugaggagaaaggggccccaccggggucuaau

SEQ ID NO: 437628 - RNA, 64 nt, hsa
agaauucugaacuuuaucuguucuguuucugugggaggagaaggggaaguauguuuuggggggc

SEQ ID NO: 437629 - RNA, 64 nt, hsa
cauagguuugaacagugggagauaccagaggugggaggagaaaaaguuauuuauuaccguuccc

SEQ ID NO: 437630 - RNA, 64 nt, hsa
guguaauauauguuuaacuggagucccagaaggagaggagaaaaugaagaggcaugaagaagua

SEQ ID NO: 437631 - RNA, 64 nt, hsa
ggcggcaccagcaccuucgcuuugcaucucgguagaggagaaacggcagcacagcccaaggacc

SEQ ID NO: 437632 - RNA, 64 nt, hsa
ucaugccucgagcuuggcaaccgaaaacccgagggaggagaagggaccugccuugugacaucuc

SEQ ID NO: 437633 - RNA, 64 nt, hsa
ucucaugcugcccuugggugggcaucuguuaacagaggagaacgucuggguggcggcagcagcu

SEQ ID NO: 437634 - RNA, 64 nt, hsa
aaccugccucugaccuggcuugcaaugcauaggugaggagaagcagagagcuugucauaugcaa

SEQ ID NO: 437635 - RNA, 64 nt, hsa
agaccucccuucagccugagccaagcugcauugggaggagaaggcagggugagggaucugggag

SEQ ID NO: 437636 - RNA, 64 nt, hsa
guagccacuugguucuuagggggccccaagaggagaggagaagugcugagguugauguuacgac

SEQ ID NO: 437637 - RNA, 64 nt, hsa
cucaagcuggacuguggguuccaaauuacucauagaggagaaaaccagagaaagaugaagagga

SEQ ID NO: 437638 - RNA, 64 nt, hsa
gcuucaggguaggugggcacaggcuuggacuagagaggagaaagauugguguaaucugcuuucc

SEQ ID NO: 437639 - RNA, 64 nt, hsa
caaacugaugggcucuuugcgccgugcagggugggaggagaagaccaaacgaaguaacgucugu

SEQ ID NO: 437640 - RNA, 64 nt, hsa
acagaaaaugaugcaauguaugaaaaacugcuuugaggagaaaaacaacacaguguguuuuugg

SEQ ID NO: 437641 - RNA, 64 nt, hsa
cuggggagaagacaaaauugguguuuagauucuggaggagaaaaaaugaguuacaaugucaggu

SEQ ID NO: 437642 - RNA, 64 nt, hsa
aauucuaaauuaccauuuacuuccagauagagcagaggagaaacaccucacugcaguuucaaca

SEQ ID NO: 437643 - RNA, 64 nt, hsa
uccagcuauguaucgggaaccaugaucuauuuaugaggagaaggaaagccgauucuuuggaagu

SEQ ID NO: 437644 - RNA, 64 nt, hsa
uuuggaaguucagcagaugaaagcccaggccagggaggagaaggcuagaaagcaggugagcaca

SEQ ID NO: 437645 - RNA, 64 nt, hsa
gcagcgcaucaaggccacagcgauucgcacggaggaggagaagcgccugauggagcagaaggug

SEQ ID NO: 437646 - RNA, 64 nt, hsa
gcagaaucuuaaaugguaccauuggugucacugggaggagaaauugggguguguuacuguuuac

SEQ ID NO: 437647 - RNA, 64 nt, hsa
guuuccagaugcuacuaucauucacgauggccaugaggagaagauggaaaauggucagaucaca

SEQ ID NO: 437648 - RNA, 64 nt, hsa
ggaggaaaaggaggaagaggaggacaaaaagggggaggagaagguucuucguccaaaggaggaa

SEQ ID NO: 437649 - RNA, 64 nt, hsa
uaauuggagcauuugcacugagaccccugccagagaggagaaaacccuuucaagggaaauuuua

SEQ ID NO: 437650 - RNA, 64 nt, hsa
cuuaucagauagaaauggagucaugugcugcugcuucaucuagcagagguuggccucuggcucu

SEQ ID NO: 437651 - RNA, 64 nt, hsa
uaugcuuuauagcuguauaaacaucgugauuauauucaucuacuuagaaauuguuuuauuuuua

SEQ ID NO: 437652 - RNA, 64 nt, hsa
uuuuuuuuuuuuuuuuuaacacagguugaaacauuucaucuauuaucucugccucauuucugga

SEQ ID NO: 437653 - RNA, 59 nt, hsa
agaagaaaggagcaaguuagaaaacaagcuucaucuaaagacucucaugucaaugugga

SEQ ID NO: 437654 - RNA, 64 nt, hsa
caggagccuguaaucccagcuacacaggaggcugaggcacgagaaucacuugaacucaggagau

SEQ ID NO: 437655 - RNA, 64 nt, hsa
cucaugccuauaauccuagcuacuugggaggcugaggcacgagacuugcuuaauaccugggagg

SEQ ID NO: 437656 - RNA, 64 nt, hsa
acagccgccuaaggcccgcggcucaugugcugcccgcccccauauuuauucacugauagagaau

SEQ ID NO: 437657 - RNA, 64 nt, hsa
ccuugggcgcacucuucagcgucuccuccuccugcgcccccacugcgucugcccaggaacagca

SEQ ID NO: 437658 - RNA, 64 nt, hsa
gguccgugugagcaggcccaccuggcuccagacccgcccccaaccugagacagaaccaggcuga

SEQ ID NO: 437659 - RNA, 64 nt, hsa
acccccacccccguuugcugggggcuccuccagccgcccccaugggaagaggccugguaccgcc

SEQ ID NO: 437660 - RNA, 64 nt, hsa
gccccugccacagggcacuggaauggacagcaggcgcccccagaugcagguaccucccuugguc

SEQ ID NO: 437661 - RNA, 64 nt, hsa
aggaccagggcgagcccuggagcgccggagcggacgcccccagggagcuggggacacccccaug

SEQ ID NO: 437662 - RNA, 64 nt, hsa
acugcacgagugucugugaggcgcugcgcggacucgcccccaggaacgcucuccucgagcccuc

SEQ ID NO: 437663 - RNA, 64 nt, hsa
guauuuccuuccacuguagcuauuagcggcuccucgcccccaccaguguagcaucuuccucugc

SEQ ID NO: 437664 - RNA, 64 nt, hsa
ucccugccggggccugcuggccccuguaaggucccgcccccaaagacccuggggccagcggggc

SEQ ID NO: 437665 - RNA, 64 nt, hsa
ccccaggugggccuuguacccccagcucuggcagcgcccccaggauugaacguggggagcccca

SEQ ID NO: 437666 - RNA, 64 nt, hsa
uggguccuguggaggccagcagcgguguggcccccgcccccaggcugccugugucuucaccugu

SEQ ID NO: 437667 - RNA, 64 nt, hsa
agggcaggggaagcggagaccagggugcaggcuccgcccccacccaaggccgggcccagccaga

SEQ ID NO: 437668 - RNA, 64 nt, hsa
gagaggcagccccggccugaccggccccccgccccgcccccaccccgcccccaggccuaaaugu

SEQ ID NO: 437669 - RNA, 64 nt, hsa
ccggccugaccggccccccgccccgcccccaccccgcccccaggccuaaaugugcacagcaugc

SEQ ID NO: 437670 - RNA, 64 nt, hsa
cacgagggaggggagucgggccccaggucgcccccgcccccagcccugcaugcaggugcccucg

SEQ ID NO: 437671 - RNA, 64 nt, hsa
gguaguuuccuccccccuuucccggcgccccucccgcccccauucaacaucucucauccuaucc

SEQ ID NO: 437672 - RNA, 64 nt, hsa
ggcgcgccccugcggcucccgaggguccaggccccgcccccaaaggaccaggacucgccccaaa

SEQ ID NO: 437673 - RNA, 64 nt, hsa
ccagggucgacccugcccccuugggcucaggccccgcccccaggauccuacggauugagguccu

SEQ ID NO: 437674 - RNA, 64 nt, hsa
uguccccccaaccuaaccagaccuggugccuugacgcccccaccccagcugggacgguacagag

SEQ ID NO: 437675 - RNA, 64 nt, hsa
uggggcuggacaucacugcaguccagugcaaagccgcccccagagcccagguguccccccaacc

SEQ ID NO: 437676 - RNA, 64 nt, hsa
gcugccugucucuuagaugcacuuucuuuuuccaccagcacauccuucaacacacagaauuuca

SEQ ID NO: 437677 - RNA, 64 nt, hsa
aacagaagggccuguaggcccuggugaacugaauccagcacaggccuccccuguaacacaacag

SEQ ID NO: 437678 - RNA, 64 nt, hsa
uccaggauuagcucccaagugcgcugagacccagccagcacacuucuggcccuucucccugccu

SEQ ID NO: 437679 - RNA, 64 nt, hsa
uccugccucuguucccuuuucucuccuugaaaguccagcacaccauucuuguccuuccccaguu

SEQ ID NO: 437680 - RNA, 64 nt, hsa
acggaaggacaugcuguccagacugugaugacugccagcacagggcaucucgggcuuggcuggu

SEQ ID NO: 437681 - RNA, 64 nt, hsa
cccucccugcaguugaggaagagccacuuuccugccagcacauguuucugggucuuggagguca

SEQ ID NO: 437682 - RNA, 64 nt, hsa
uugaauugggaacuuuggagucuugucucccaucccagcacauugaggauguaguuggugaaug

SEQ ID NO: 437683 - RNA, 64 nt, hsa
agaaucuacagaccuggcuccucggaucugaagcccagcacaaaauaaucuccccguccaagga

SEQ ID NO: 437684 - RNA, 64 nt, hsa
gugggaaugcaguggguggggcuguacacacccuccagcacagacuguucccuccaagguccuc

SEQ ID NO: 437685 - RNA, 64 nt, hsa
uccuuagcagcucaggcgcagcccuagugggagcccagcacacugcuucucggaggccaggccc

SEQ ID NO: 437686 - RNA, 64 nt, hsa
gcccccagccaguucucagaaacguggcuggggcccagcacagcagccugcaagggccccuguu

SEQ ID NO: 437687 - RNA, 64 nt, hsa
agaguauggaggcugagccaggccuuggguuuccccagcacagccuccugucgcugcaugcgac

SEQ ID NO: 437688 - RNA, 64 nt, hsa
ggugacugaagucgugcuuuuccugugugugcugccagcacagggcuguaaaugcagauauugc

SEQ ID NO: 437689 - RNA, 64 nt, hsa
uaaccugcaccccucccugcaagggguucagagcccagcacaggagcuuucucuggcagaauug

SEQ ID NO: 437690 - RNA, 64 nt, hsa
augcaggggcucccuccagcacacagcccucaccccagcacagccagcaaggacacgcucuccc

SEQ ID NO: 437691 - RNA, 64 nt, hsa
aggaagcccaccgugccccaugcaggggcucccuccagcacacagcccucaccccagcacagcc

SEQ ID NO: 437692 - RNA, 64 nt, hsa
ugcauuccccccuccacaccauccuagcgaggcaccagcacaccuaaucacagcaaagcccaga

SEQ ID NO: 437693 - RNA, 64 nt, hsa
acaugagacaaagcugacuguucacacugauugcccagcacauaccgucuugccaguuucuucu

SEQ ID NO: 437694 - RNA, 64 nt, hsa
cuccccauguauuccccaccuguguuccguuugaccagcacagaaauauuaaacguccucuauu

SEQ ID NO: 437695 - RNA, 64 nt, hsa
aagccaaagauggccccugacaccucccccagccccagcacaccagccugcaccucuuaucccg

SEQ ID NO: 437696 - RNA, 64 nt, hsa
ugacccccgccaggggagaccaggcuggcuggauccagcacaucuccccaguggcagccucgcc

SEQ ID NO: 437697 - RNA, 64 nt, hsa
uccccccuccaccuucgccaccucccgcucgugcccagcacaagugagccugguguggaaacca

SEQ ID NO: 437698 - RNA, 64 nt, hsa
auuucccuccucagugugcacccuuugaagggacccagcacagggucuugggccugggcagucu

SEQ ID NO: 437699 - RNA, 64 nt, hsa
uggaccugcaggcccuccuaggcccacuuccuccccagcacaguguguguucccgggcgugugu

SEQ ID NO: 437700 - RNA, 64 nt, hsa
gcugaucaacagaaggaaauggucugaagucugaccagcacaaggaaggaggcuggcuggcuca

SEQ ID NO: 437701 - RNA, 64 nt, hsa
cgaccugugucaaauccguccauugaucugcccuccagcacacauuuacugagcuucuguuacg

SEQ ID NO: 437702 - RNA, 64 nt, hsa
uuagugagugaauguuuguaaaacaggauagugcccagcacauacuaguaacaaauguaaaaua

SEQ ID NO: 437703 - RNA, 64 nt, hsa
acgaaaccauaucgcaaaccagagcugcuggaaaccagcacacgcaaaagaugacgcccagcac

SEQ ID NO: 437704 - RNA, 64 nt, hsa
gcugcuggaaaccagcacacgcaaaagaugacgcccagcacagcagcaggacacaccaugugcc

SEQ ID NO: 437705 - RNA, 64 nt, hsa
agccaccaacuucagugccuuucuguaccccaagccagcacaagauuggaccaauccuuuuugc

SEQ ID NO: 437706 - RNA, 64 nt, hsa
uccucuaaaggggaggcauuaaaauucacugugcccagcacaugggugguacacuaauuaugac

SEQ ID NO: 437707 - RNA, 64 nt, hsa
uguguguguguguguacuuguaugcacguaggcaccagcacaaagaucugaaugaugcacccca

SEQ ID NO: 437708 - RNA, 64 nt, hsa
uaauacccucuuggaaaaagagcuugccccuccuccagcacacuagagcucuggccuugugugu

SEQ ID NO: 437709 - RNA, 64 nt, hsa
gccugggucucugucccagacucgccacucucgaccagcacaagcuuugcccaaggacuaagcu

SEQ ID NO: 437710 - RNA, 64 nt, hsa
gggaccccagcgccuaccaccucaacagacaccuccagcacagcuucaccaggggcuuuucagg

SEQ ID NO: 437711 - RNA, 64 nt, hsa
uccagccggccggggaugugagucaucccuugguccagcacauccacgcuguauacgccaccca

SEQ ID NO: 437712 - RNA, 64 nt, hsa
acugggccaaaggcucacuaccccugugcguuguccagcacacagacacuaugugcauuauuug

SEQ ID NO: 437713 - RNA, 64 nt, hsa
caagcuaagauccacuggcuuggaauucucccugccagcacagcagucugaagucaaccuggga

SEQ ID NO: 437714 - RNA, 64 nt, hsa
cugccugccagcucugaagagagcagcaguucuuccagcacagcgcuugagcucugcuaaggga

SEQ ID NO: 437715 - RNA, 64 nt, hsa
ccugcgcuagucucccccgaggguuuaggcuggcccagcacauccuguccuccugagcucgcgu

SEQ ID NO: 437716 - RNA, 64 nt, hsa
cauuuuugguuuuuagcuuguucaaaaacagaggccagcacagaugacauuuuagauacacucu

SEQ ID NO: 437717 - RNA, 64 nt, hsa
aggugcuggagaggaaagcagggagccacugcauccagcacauggggugccugggccucagaug

SEQ ID NO: 437718 - RNA, 64 nt, hsa
uguucuucucugagcagcuccuccccggagucccccagcacagucccaggagaugacaggaagg

SEQ ID NO: 437719 - RNA, 64 nt, hsa; identical to SEQ ID NO: 150696

SEQ ID NO: 437720 - RNA, 64 nt, hsa; identical to SEQ ID NO: 150697

SEQ ID NO: 437721 - RNA, 64 nt, hsa; identical to SEQ ID NO: 150698

SEQ ID NO: 437722 - RNA, 64 nt, hsa; identical to SEQ ID NO: 150699

SEQ ID NO: 437723 - RNA, 64 nt, hsa; identical to SEQ ID NO: 318262

SEQ ID NO: 437724 - RNA, 64 nt, hsa; identical to SEQ ID NO: 318263

SEQ ID NO: 437725 - RNA, 60 nt, hsa; identical to SEQ ID NO: 318264

SEQ ID NO: 437726 - RNA, 64 nt, hsa; identical to SEQ ID NO: 318265

SEQ ID NO: 437727 - RNA, 64 nt, hsa; identical to SEQ ID NO: 318266

SEQ ID NO: 437728 - RNA, 64 nt, hsa; identical to SEQ ID NO: 318267

SEQ ID NO: 437729 - RNA, 64 nt, hsa; identical to SEQ ID NO: 318268

SEQ ID NO: 437730 - RNA, 64 nt, hsa; identical to SEQ ID NO: 318269

SEQ ID NO: 437731 - RNA, 64 nt, hsa; identical to SEQ ID NO: 318270

SEQ ID NO: 437732 - RNA, 64 nt, hsa; identical to SEQ ID NO: 318271

SEQ ID NO: 437733 - RNA, 64 nt, hsa; identical to SEQ ID NO: 318272

SEQ ID NO: 437734 - RNA, 64 nt, hsa; identical to SEQ ID NO: 318273

SEQ ID NO: 437735 - RNA, 64 nt, hsa; identical to SEQ ID NO: 318274

SEQ ID NO: 437736 - RNA, 64 nt, hsa; identical to SEQ ID NO: 318275

SEQ ID NO: 437737 - RNA, 64 nt, hsa; identical to SEQ ID NO: 318276

SEQ ID NO: 437738 - RNA, 64 nt, hsa; identical to SEQ ID NO: 318277

SEQ ID NO: 437739 - RNA, 64 nt, hsa; identical to SEQ ID NO: 318278

SEQ ID NO: 437740 - RNA, 64 nt, hsa; identical to SEQ ID NO: 318279

SEQ ID NO: 437741 - RNA, 64 nt, hsa
aucuuguauauuaaaaaucaaaagaugaggcuuucuuacauauacaucuuaguugauuauuaaa

SEQ ID NO: 437742 - RNA, 64 nt, hsa
uuuuuuuugguauauauaaccagguacaccagagcuuacauauguuugaguuagacucuuaaaa

SEQ ID NO: 437743 - RNA, 64 nt, hsa
cuggaacuugcuucacagcccugaggaagguggacuuacauaagcagcuguauuccauuagaug

SEQ ID NO: 437744 - RNA, 64 nt, hsa
ugcccucaaacagaacagcuccccuuguagcugucuuacauauugggguucaggguaagauuuu

SEQ ID NO: 437745 - RNA, 64 nt, hsa
uaaagacaggcuccugagaaaugcaacaaguggucuuacauauacaugagaacuuagacacaag

SEQ ID NO: 437746 - RNA, 64 nt, hsa
uuguaguucuaguuucagugacuuguuauaucuacuuacauacaacagggaggcaagaggauuc

SEQ ID NO: 437747 - RNA, 64 nt, hsa
gaaaaugcacuuaaaccuguuucuaaauuauauauucaguuauauuauauuuggcuuuagaugg

SEQ ID NO: 437748 - RNA, 64 nt, hsa
auacguauguaagcucuuauuuuucaauuggcaauucaguuaauuuuuaaauguuuacauaaug

SEQ ID NO: 437749 - RNA, 64 nt, hsa
gcacugaagagaaucuaggguguuugauaucuguuucaguuagggcuaaugggaaaugucuagu

SEQ ID NO: 437750 - RNA, 64 nt, hsa
aauauaaaauaguuauguaacugugauuuugguuuucaguuaugugacuuguuuuuuccaccug

SEQ ID NO: 437751 - RNA, 64 nt, hsa
guugacaggaugguuuaaaauaagacgugaagguuucaguuaccugcucuagacuuugccugag

SEQ ID NO: 437752 - RNA, 64 nt, hsa
agucccuaugucaccacauugcuugagaugaucauucaguuacuugucaggauuucuccucuuc

SEQ ID NO: 437753 - RNA, 64 nt, hsa
uacuacacugccaguuguauaaaaguacagcacauucaguuauguacaguauguaauacugaua

SEQ ID NO: 437754 - RNA, 64 nt, hsa
cucauauuuaugauuguccuauaugaaaaacaacuucaguuaaaacuauaaugugugauucugu

SEQ ID NO: 437755 - RNA, 64 nt, hsa
uuacuuuauuuucaaaguuauuuaguuguucauuuucaguuauuuauauguaguuguuuuguuu

SEQ ID NO: 437756 - RNA, 64 nt, hsa
ucuuuguagcuuucugguuauuuaauuuuauaguuucaguuacugguuuauaguuacuuuauuu

SEQ ID NO: 437757 - RNA, 64 nt, hsa
uaauuuauucuggaugauauucuccaaaauucaauucaguuauuauauucauuuagcauuaagu

SEQ ID NO: 437758 - RNA, 64 nt, hsa
uuauagaaaucaguaucaauuccucccauuucaauucaguuaagacuucugugauagauguuua

SEQ ID NO: 437759 - RNA, 64 nt, hsa
acucauuguaugaauucuuuuucaugguaguucauucaguuauguguuuauuuacuacauaguu

SEQ ID NO: 437760 - RNA, 64 nt, hsa
uuuuucagaaaaauuauuuuaaaagaacucagcauucaguuagauagaauacacaccauccugg

SEQ ID NO: 437761 - RNA, 64 nt, hsa
gaauuuucaacaaaauguaauuaaagucuauguuuucaguuaugacucagguuaagaaaugugu

SEQ ID NO: 437762 - RNA, 64 nt, hsa
uuaaaagagcauuugguaguaaucuaacuuuuuguucaguuaauaagugguugauaaaguuucc

SEQ ID NO: 437763 - RNA, 64 nt, hsa
aagaacaaagaaguauccauauuaaguuuagauuuucaguuaauuuuugagacugaguaguauu

SEQ ID NO: 437764 - RNA, 64 nt, hsa
ucuucuaguaaugcaguucaugggcuuuagguacuucaguuaugaaguaggcuuuucaugggga

SEQ ID NO: 437765 - RNA, 64 nt, hsa
ucauuucuccuccaugauggaagcccagugauuguucaguuaacgcauuguacagaguguauuu

SEQ ID NO: 437766 - RNA, 64 nt, hsa
ugaaaggucgcagaaauugauuucuauuuuuaauuucaguuaguaucgggggaaaaaaauccag

SEQ ID NO: 437767 - RNA, 64 nt, hsa
gaaacccuacaaaugcaaggaaugugggaaagccuucaguuaccacuguacugcucaaaaacau

SEQ ID NO: 437768 - RNA, 64 nt, hsa
gaagccauauaaauguaagaaaugugggaaacccuucaguuaucugcagucuuuuaaaaaacau

SEQ ID NO: 437769 - RNA, 64 nt, hsa
uguaggccauuuucuuauaacauuucaguuacuuuucaguuaauuauuccuuuaaaaagaaaau

SEQ ID NO: 437770 - RNA, 64 nt, hsa
aguagugaaauuguaggccauuuucuuauaacauuucaguuacuuuucaguuaauuauuccuuu

SEQ ID NO: 437771 - RNA, 64 nt, hsa
uuuuccucguuaccaauauuacaacagcauuguuuucaguuauuuuucauugcagauacgaaga

SEQ ID NO: 437772 - RNA, 64 nt, hsa
auucuguuucuuuaagaagaugcagucauggucuuucaguuauguauauuuguuuuccuuguuu

SEQ ID NO: 437773 - RNA, 64 nt, hsa; identical to SEQ ID NO: 225321

SEQ ID NO: 437774 - RNA, 64 nt, hsa; identical to SEQ ID NO: 225322

SEQ ID NO: 437775 - RNA, 64 nt, hsa; identical to SEQ ID NO: 225323

SEQ ID NO: 437776 - RNA, 64 nt, hsa; identical to SEQ ID NO: 225324

SEQ ID NO: 437777 - RNA, 64 nt, hsa; identical to SEQ ID NO: 225325

SEQ ID NO: 437778 - RNA, 64 nt, hsa; identical to SEQ ID NO: 225326

SEQ ID NO: 437779 - RNA, 64 nt, hsa; identical to SEQ ID NO: 225327

SEQ ID NO: 437780 - RNA, 64 nt, hsa; identical to SEQ ID NO: 225328

SEQ ID NO: 437781 - RNA, 64 nt, hsa; identical to SEQ ID NO: 225329

SEQ ID NO: 437782 - RNA, 64 nt, hsa; identical to SEQ ID NO: 225330

SEQ ID NO: 437783 - RNA, 64 nt, hsa; identical to SEQ ID NO: 225331

SEQ ID NO: 437784 - RNA, 64 nt, hsa; identical to SEQ ID NO: 225332

SEQ ID NO: 437785 - RNA, 64 nt, hsa; identical to SEQ ID NO: 225333

SEQ ID NO: 437786 - RNA, 64 nt, hsa; identical to SEQ ID NO: 225334

SEQ ID NO: 437787 - RNA, 64 nt, hsa; identical to SEQ ID NO: 225335

SEQ ID NO: 437788 - RNA, 64 nt, hsa; identical to SEQ ID NO: 225336

SEQ ID NO: 437789 - RNA, 64 nt, hsa; identical to SEQ ID NO: 225337

SEQ ID NO: 437790 - RNA, 64 nt, hsa; identical to SEQ ID NO: 225338

SEQ ID NO: 437791 - RNA, 64 nt, hsa; identical to SEQ ID NO: 225339

SEQ ID NO: 437792 - RNA, 64 nt, hsa; identical to SEQ ID NO: 225340

SEQ ID NO: 437793 - RNA, 64 nt, hsa; identical to SEQ ID NO: 225341

SEQ ID NO: 437794 - RNA, 64 nt, hsa; identical to SEQ ID NO: 225342

SEQ ID NO: 437795 - RNA, 64 nt, hsa; identical to SEQ ID NO: 225343

SEQ ID NO: 437796 - RNA, 64 nt, hsa; identical to SEQ ID NO: 225344

SEQ ID NO: 437797 - RNA, 64 nt, hsa; identical to SEQ ID NO: 225345

SEQ ID NO: 437798 - RNA, 64 nt, hsa; identical to SEQ ID NO: 225346

SEQ ID NO: 437799 - RNA, 64 nt, hsa; identical to SEQ ID NO: 225347

SEQ ID NO: 437800 - RNA, 64 nt, hsa; identical to SEQ ID NO: 225348

SEQ ID NO: 437801 - RNA, 64 nt, hsa; identical to SEQ ID NO: 225349

SEQ ID NO: 437802 - RNA, 64 nt, hsa; identical to SEQ ID NO: 225350

SEQ ID NO: 437803 - RNA, 64 nt, hsa; identical to SEQ ID NO: 225351

SEQ ID NO: 437804 - RNA, 64 nt, hsa; identical to SEQ ID NO: 225352

SEQ ID NO: 437805 - RNA, 64 nt, hsa; identical to SEQ ID NO: 225353

SEQ ID NO: 437806 - RNA, 64 nt, hsa; identical to SEQ ID NO: 225354

SEQ ID NO: 437807 - RNA, 64 nt, hsa; identical to SEQ ID NO: 225355

SEQ ID NO: 437808 - RNA, 64 nt, hsa; identical to SEQ ID NO: 225356

SEQ ID NO: 437809 - RNA, 64 nt, hsa; identical to SEQ ID NO: 225357

SEQ ID NO: 437810 - RNA, 64 nt, hsa; identical to SEQ ID NO: 225358

SEQ ID NO: 437811 - RNA, 64 nt, hsa; identical to SEQ ID NO: 225359

SEQ ID NO: 437812 - RNA, 64 nt, hsa; identical to SEQ ID NO: 225360

SEQ ID NO: 437813 - RNA, 64 nt, hsa; identical to SEQ ID NO: 225361

SEQ ID NO: 437814 - RNA, 64 nt, hsa; identical to SEQ ID NO: 225362

SEQ ID NO: 437815 - RNA, 64 nt, hsa; identical to SEQ ID NO: 225363

SEQ ID NO: 437816 - RNA, 64 nt, hsa; identical to SEQ ID NO: 225364

SEQ ID NO: 437817 - RNA, 64 nt, hsa; identical to SEQ ID NO: 225365

SEQ ID NO: 437818 - RNA, 64 nt, hsa; identical to SEQ ID NO: 225366

SEQ ID NO: 437819 - RNA, 64 nt, hsa; identical to SEQ ID NO: 225367

SEQ ID NO: 437820 - RNA, 64 nt, hsa; identical to SEQ ID NO: 225368

SEQ ID NO: 437821 - RNA, 64 nt, hsa; identical to SEQ ID NO: 225369

SEQ ID NO: 437822 - RNA, 64 nt, hsa; identical to SEQ ID NO: 225370

SEQ ID NO: 437823 - RNA, 64 nt, hsa; identical to SEQ ID NO: 225371

SEQ ID NO: 437824 - RNA, 64 nt, hsa; identical to SEQ ID NO: 225372

SEQ ID NO: 437825 - RNA, 64 nt, hsa; identical to SEQ ID NO: 225373

SEQ ID NO: 437826 - RNA, 64 nt, hsa; identical to SEQ ID NO: 225374

SEQ ID NO: 437827 - RNA, 64 nt, hsa; identical to SEQ ID NO: 225375

SEQ ID NO: 437828 - RNA, 64 nt, hsa; identical to SEQ ID NO: 225376

SEQ ID NO: 437829 - RNA, 64 nt, hsa; identical to SEQ ID NO: 225377

SEQ ID NO: 437830 - RNA, 64 nt, hsa; identical to SEQ ID NO: 225378

SEQ ID NO: 437831 - RNA, 64 nt, hsa; identical to SEQ ID NO: 225379

SEQ ID NO: 437832 - RNA, 64 nt, hsa; identical to SEQ ID NO: 225380

SEQ ID NO: 437833 - RNA, 64 nt, hsa; identical to SEQ ID NO: 225381

SEQ ID NO: 437834 - RNA, 64 nt, hsa; identical to SEQ ID NO: 225382

SEQ ID NO: 437835 - RNA, 64 nt, hsa; identical to SEQ ID NO: 225383

SEQ ID NO: 437836 - RNA, 64 nt, hsa; identical to SEQ ID NO: 225384

SEQ ID NO: 437837 - RNA, 64 nt, hsa; identical to SEQ ID NO: 225385

SEQ ID NO: 437838 - RNA, 64 nt, hsa; identical to SEQ ID NO: 225386

SEQ ID NO: 437839 - RNA, 64 nt, hsa; identical to SEQ ID NO: 225387

SEQ ID NO: 437840 - RNA, 64 nt, hsa; identical to SEQ ID NO: 225388

SEQ ID NO: 437841 - RNA, 64 nt, hsa; identical to SEQ ID NO: 225389

SEQ ID NO: 437842 - RNA, 64 nt, hsa; identical to SEQ ID NO: 225390

SEQ ID NO: 437843 - RNA, 64 nt, hsa; identical to SEQ ID NO: 225391

SEQ ID NO: 437844 - RNA, 64 nt, hsa; identical to SEQ ID NO: 225392

SEQ ID NO: 437845 - RNA, 64 nt, hsa; identical to SEQ ID NO: 225393

SEQ ID NO: 437846 - RNA, 64 nt, hsa; identical to SEQ ID NO: 225394

SEQ ID NO: 437847 - RNA, 64 nt, hsa; identical to SEQ ID NO: 225395

SEQ ID NO: 437848 - RNA, 64 nt, hsa; identical to SEQ ID NO: 225396

SEQ ID NO: 437849 - RNA, 64 nt, hsa; identical to SEQ ID NO: 225397

SEQ ID NO: 437850 - RNA, 64 nt, hsa; identical to SEQ ID NO: 225398

SEQ ID NO: 437851 - RNA, 64 nt, hsa; identical to SEQ ID NO: 225399

SEQ ID NO: 437852 - RNA, 64 nt, hsa; identical to SEQ ID NO: 225400

SEQ ID NO: 437853 - RNA, 64 nt, hsa; identical to SEQ ID NO: 225401

SEQ ID NO: 437854 - RNA, 64 nt, hsa; identical to SEQ ID NO: 225402

SEQ ID NO: 437855 - RNA, 64 nt, hsa; identical to SEQ ID NO: 225403

SEQ ID NO: 437856 - RNA, 64 nt, hsa; identical to SEQ ID NO: 225404

SEQ ID NO: 437857 - RNA, 64 nt, hsa; identical to SEQ ID NO: 225405

SEQ ID NO: 437858 - RNA, 64 nt, hsa; identical to SEQ ID NO: 225406

SEQ ID NO: 437859 - RNA, 64 nt, hsa; identical to SEQ ID NO: 225407

SEQ ID NO: 437860 - RNA, 64 nt, hsa; identical to SEQ ID NO: 225408

SEQ ID NO: 437861 - RNA, 64 nt, hsa; identical to SEQ ID NO: 225409

SEQ ID NO: 437862 - RNA, 64 nt, hsa; identical to SEQ ID NO: 225410

SEQ ID NO: 437863 - RNA, 64 nt, hsa
uucugacccacagcacccgcgccucagaagcuacggucacaacuaaaggaguccagggacuugc

SEQ ID NO: 437864 - RNA, 64 nt, hsa
acaauuuuuuauuguuaaauuugugguaauacauggucacaaccguggaucaaacaaggucagu

SEQ ID NO: 437865 - RNA, 64 nt, hsa; identical to SEQ ID NO: 73420

SEQ ID NO: 437866 - RNA, 64 nt, hsa; identical to SEQ ID NO: 73421

SEQ ID NO: 437867 - RNA, 64 nt, hsa
uuuuaagauuuuuggguccugagccagccgugguggcucacaccuguaaucccagcacuuuggg

SEQ ID NO: 437868 - RNA, 64 nt, hsa
cugcaucuccuggauuagccuuucacauguugcuggcucacauuagugccaguuagugccuucg

SEQ ID NO: 437869 - RNA, 64 nt, hsa
ugucacccaggcuggaauacagugguacagucacggcucacaaaagccuugaccuccugggcuc

SEQ ID NO: 437870 - RNA, 64 nt, hsa
acauagaaaauguuuugaauaggccaggcgcaguggcucacaccuguaaucccagcacguuggg

SEQ ID NO: 437871 - RNA, 64 nt, hsa
uaagcuuaaacaaauaacuuuggccgggcacgguggcucacaccuauaaucccagcacuauggg

SEQ ID NO: 437872 - RNA, 64 nt, hsa
ucaggaaucaaaagauaaaggggccgggugugguggcucacaccuguaaucccagcacuuuggg

SEQ ID NO: 437873 - RNA, 64 nt, hsa
acugggaaaugggagcacaguacugggaaaugggggcucacagcacugcaaaaugggagcacag

SEQ ID NO: 437874 - RNA, 64 nt, hsa
cuugcugcuuaagagcugaugggccgggcauguuggcucacaccugugagcacaguacugggaa

SEQ ID NO: 437875 - RNA, 64 nt, hsa
aagugcuuagaacaggaccuaggcccugugcaauggcucacaccuguaauuccaacacuuuggg

SEQ ID NO: 437876 - RNA, 64 nt, hsa
uggaaagaauugugaaaauuggguugggcgccguggcucacaccuguaauccuagcgcuuuggg

SEQ ID NO: 437877 - RNA, 64 nt, hsa
cucaaaaaaaaaagaguucuagcccaggagcgguggcucacacuuguaaucccagcacuuuggg

SEQ ID NO: 437878 - RNA, 64 nt, hsa
ucauucucuauaagaguucuaggcggggcgugguggcucacacuuguaaucccagcacuuuggg

SEQ ID NO: 437879 - RNA, 64 nt, hsa
ugucucaaaaaaaugcagacuggccaggcacaguggcucacaccuguaauccgacuguaagcuc

SEQ ID NO: 437880 - RNA, 64 nt, hsa
gggcugcuuguuaaaaaugcaggccaggugcgguggcucacaccuguaaucccagcgcuuuggg

SEQ ID NO: 437881 - RNA, 64 nt, hsa
gcuauaaaguuaagugucccucaggcagggagagggcucacagagucuccucuguacguggcca

SEQ ID NO: 437882 - RNA, 64 nt, hsa
gguuuugccauccacaaucccuccuacagggccuggcucacaaaaagagugcaacaaaugcuuc

SEQ ID NO: 437883 - RNA, 64 nt, hsa
accaaugaggaaagagagaggcaggucugggccaggcucacagggacuccggcauagcagaccc

SEQ ID NO: 437884 - RNA, 64 nt, hsa
cucaccaagccuagccacucucgcggcucugaguggcucacaggcuugugagggccccgucgcu

SEQ ID NO: 437885 - RNA, 64 nt, hsa
cucuaaaaugcaauaauaaugggccaggugaaguggcucacaccuguaaucccagcacugugga

SEQ ID NO: 437886 - RNA, 64 nt, hsa
uaaauaaauaaauaaaaugcgggccaggcacaguggcucacaccuguaaucccagcacuauggg

SEQ ID NO: 437887 - RNA, 64 nt, hsa
aagacacagaaauauagugcagagugggaaucggggcucacagccuucagagcugagcuugaac

SEQ ID NO: 437888 - RNA, 64 nt, hsa
agauuaguccuaaaugccuuuuggagguuguaauggcucacagauuggccuuagaugcaucccg

SEQ ID NO: 437889 - RNA, 64 nt, hsa
gaaugcgagaaauauaaaucaggccaggcacgguggcucacaccuguaaucccaguacuuuggg

SEQ ID NO: 437890 - RNA, 64 nt, hsa
uguuuugaaauugaagagagaggccaggcgcgguggcucacaccuguaaucccagcacuuuggg

SEQ ID NO: 437891 - RNA, 64 nt, hsa
ccugcaagcacacauggcaaggagggcuuuagcaggcucacauaaccgaguggcaaggccccug

SEQ ID NO: 437892 - RNA, 64 nt, hsa
ccccgccccugcccccaagcagcacugggcuacuggcucacagaagcaccuuugguucugcagg

SEQ ID NO: 437893 - RNA, 64 nt, hsa; identical to SEQ ID NO: 128854

SEQ ID NO: 437894 - RNA, 64 nt, hsa; identical to SEQ ID NO: 128855

SEQ ID NO: 437895 - RNA, 64 nt, hsa; identical to SEQ ID NO: 128856

SEQ ID NO: 437896 - RNA, 64 nt, hsa; identical to SEQ ID NO: 128857

SEQ ID NO: 437897 - RNA, 64 nt, hsa; identical to SEQ ID NO: 128858

SEQ ID NO: 437898 - RNA, 64 nt, hsa; identical to SEQ ID NO: 128859

SEQ ID NO: 437899 - RNA, 64 nt, hsa; identical to SEQ ID NO: 128860

SEQ ID NO: 437900 - RNA, 64 nt, hsa; identical to SEQ ID NO: 128861

SEQ ID NO: 437901 - RNA, 64 nt, hsa; identical to SEQ ID NO: 128862

SEQ ID NO: 437902 - RNA, 64 nt, hsa; identical to SEQ ID NO: 128863

SEQ ID NO: 437903 - RNA, 64 nt, hsa; identical to SEQ ID NO: 128864

SEQ ID NO: 437904 - RNA, 64 nt, hsa; identical to SEQ ID NO: 128865

SEQ ID NO: 437905 - RNA, 64 nt, hsa; identical to SEQ ID NO: 128866

SEQ ID NO: 437906 - RNA, 64 nt, hsa; identical to SEQ ID NO: 128867

SEQ ID NO: 437907 - RNA, 64 nt, hsa; identical to SEQ ID NO: 128868

SEQ ID NO: 437908 - RNA, 64 nt, hsa; identical to SEQ ID NO: 128869

SEQ ID NO: 437909 - RNA, 64 nt, hsa; identical to SEQ ID NO: 128870

SEQ ID NO: 437910 - RNA, 64 nt, hsa; identical to SEQ ID NO: 128871

SEQ ID NO: 437911 - RNA, 64 nt, hsa; identical to SEQ ID NO: 128872

SEQ ID NO: 437912 - RNA, 64 nt, hsa; identical to SEQ ID NO: 128873

SEQ ID NO: 437913 - RNA, 64 nt, hsa; identical to SEQ ID NO: 128874

SEQ ID NO: 437914 - RNA, 64 nt, hsa; identical to SEQ ID NO: 128875

SEQ ID NO: 437915 - RNA, 64 nt, hsa; identical to SEQ ID NO: 128876

SEQ ID NO: 437916 - RNA, 64 nt, hsa; identical to SEQ ID NO: 128877

SEQ ID NO: 437917 - RNA, 64 nt, hsa; identical to SEQ ID NO: 128878

SEQ ID NO: 437918 - RNA, 64 nt, hsa; identical to SEQ ID NO: 128879

SEQ ID NO: 437919 - RNA, 64 nt, hsa; identical to SEQ ID NO: 128880

SEQ ID NO: 437920 - RNA, 64 nt, hsa; identical to SEQ ID NO: 128881

SEQ ID NO: 437921 - RNA, 64 nt, hsa; identical to SEQ ID NO: 128882

SEQ ID NO: 437922 - RNA, 64 nt, hsa; identical to SEQ ID NO: 128883

SEQ ID NO: 437923 - RNA, 64 nt, hsa; identical to SEQ ID NO: 128884

SEQ ID NO: 437924 - RNA, 64 nt, hsa; identical to SEQ ID NO: 128885

SEQ ID NO: 437925 - RNA, 64 nt, hsa; identical to SEQ ID NO: 128886

SEQ ID NO: 437926 - RNA, 64 nt, hsa
uucaacuugauuaucuugugaaacgaugagaguaaguugcaaccuugugacugaaaacuugaaa

SEQ ID NO: 437927 - RNA, 64 nt, hsa
uggguauuuaucuccuuguauuuuaaauauauguaguugcaaauagcaccaggaauuagauuuc

SEQ ID NO: 437928 - RNA, 64 nt, hsa
aguaggaggggguaugugucucaggcuuuucugaaguugcaagacuuaaagaaauaauccaucu

SEQ ID NO: 437929 - RNA, 64 nt, hsa
augggugccuugaggaaaagcaguuacacaguugaguugcaagcugaauuggcuguguucaagg

SEQ ID NO: 437930 - RNA, 64 nt, hsa
aauuuuuauccaguacuuuauagauucaacucuaaguugcaagcgaagucaaaacugaugaaaa

SEQ ID NO: 437931 - RNA, 64 nt, hsa
ccacaacaugugggaauuccagaagauaaauucaaguugcaauuucaguggggacauagccaaa

SEQ ID NO: 437932 - RNA, 64 nt, hsa
cugcacucucauugucaagguuagauauauccccaguugcaaaacagccagacuugagcugugc

SEQ ID NO: 437933 - RNA, 64 nt, hsa
aaaugaaaagaccaaaaucuucaggcaaaaagcaaguugcaaaauuagaaaccauuggcuaaaa

SEQ ID NO: 437934 - RNA, 60 nt, hsa; identical to SEQ ID NO: 37632

SEQ ID NO: 437935 - RNA, 60 nt, hsa; identical to SEQ ID NO: 37633

SEQ ID NO: 437936 - RNA, 60 nt, hsa; identical to SEQ ID NO: 37634

SEQ ID NO: 437937 - RNA, 60 nt, hsa; identical to SEQ ID NO: 37635

SEQ ID NO: 437938 - RNA, 60 nt, hsa; identical to SEQ ID NO: 37636

SEQ ID NO: 437939 - RNA, 60 nt, hsa; identical to SEQ ID NO: 37637

SEQ ID NO: 437940 - RNA, 60 nt, hsa; identical to SEQ ID NO: 37638

SEQ ID NO: 437941 - RNA, 60 nt, hsa; identical to SEQ ID NO: 37639

SEQ ID NO: 437942 - RNA, 60 nt, hsa; identical to SEQ ID NO: 37640

SEQ ID NO: 437943 - RNA, 60 nt, hsa; identical to SEQ ID NO: 37641

SEQ ID NO: 437944 - RNA, 60 nt, hsa; identical to SEQ ID NO: 37642

SEQ ID NO: 437945 - RNA, 60 nt, hsa; identical to SEQ ID NO: 37643

SEQ ID NO: 437946 - RNA, 60 nt, hsa; identical to SEQ ID NO: 37644

SEQ ID NO: 437947 - RNA, 60 nt, hsa; identical to SEQ ID NO: 37645

SEQ ID NO: 437948 - RNA, 60 nt, hsa; identical to SEQ ID NO: 37646

SEQ ID NO: 437949 - RNA, 60 nt, hsa; identical to SEQ ID NO: 37647

SEQ ID NO: 437950 - RNA, 60 nt, hsa; identical to SEQ ID NO: 37648

SEQ ID NO: 437951 - RNA, 60 nt, hsa; identical to SEQ ID NO: 37649

SEQ ID NO: 437952 - RNA, 60 nt, hsa; identical to SEQ ID NO: 37650

SEQ ID NO: 437953 - RNA, 60 nt, hsa; identical to SEQ ID NO: 37651

SEQ ID NO: 437954 - RNA, 60 nt, hsa; identical to SEQ ID NO: 37652

SEQ ID NO: 437955 - RNA, 60 nt, hsa; identical to SEQ ID NO: 37653

SEQ ID NO: 437956 - RNA, 60 nt, hsa; identical to SEQ ID NO: 37654

SEQ ID NO: 437957 - RNA, 60 nt, hsa; identical to SEQ ID NO: 37655

SEQ ID NO: 437958 - RNA, 60 nt, hsa; identical to SEQ ID NO: 37656

SEQ ID NO: 437959 - RNA, 60 nt, hsa; identical to SEQ ID NO: 37657

SEQ ID NO: 437960 - RNA, 60 nt, hsa; identical to SEQ ID NO: 37658

SEQ ID NO: 437961 - RNA, 60 nt, hsa; identical to SEQ ID NO: 37659

SEQ ID NO: 437962 - RNA, 60 nt, hsa; identical to SEQ ID NO: 37660

SEQ ID NO: 437963 - RNA, 60 nt, hsa; identical to SEQ ID NO: 37661

SEQ ID NO: 437964 - RNA, 60 nt, hsa; identical to SEQ ID NO: 37662

SEQ ID NO: 437965 - RNA, 60 nt, hsa; identical to SEQ ID NO: 37663

SEQ ID NO: 437966 - RNA, 60 nt, hsa; identical to SEQ ID NO: 37664

SEQ ID NO: 437967 - RNA, 60 nt, hsa; identical to SEQ ID NO: 37665

SEQ ID NO: 437968 - RNA, 60 nt, hsa; identical to SEQ ID NO: 37666

SEQ ID NO: 437969 - RNA, 60 nt, hsa; identical to SEQ ID NO: 37667

SEQ ID NO: 437970 - RNA, 60 nt, hsa; identical to SEQ ID NO: 37668

SEQ ID NO: 437971 - RNA, 60 nt, hsa; identical to SEQ ID NO: 37669

SEQ ID NO: 437972 - RNA, 60 nt, hsa; identical to SEQ ID NO: 37670

SEQ ID NO: 437973 - RNA, 60 nt, hsa; identical to SEQ ID NO: 37671

SEQ ID NO: 437974 - RNA, 60 nt, hsa; identical to SEQ ID NO: 37672

SEQ ID NO: 437975 - RNA, 50 nt, hsa; identical to SEQ ID NO: 37673

SEQ ID NO: 437976 - RNA, 60 nt, hsa; identical to SEQ ID NO: 37674

SEQ ID NO: 437977 - RNA, 60 nt, hsa; identical to SEQ ID NO: 37675

SEQ ID NO: 437978 - RNA, 60 nt, hsa; identical to SEQ ID NO: 37676

SEQ ID NO: 437979 - RNA, 60 nt, hsa; identical to SEQ ID NO: 37677

SEQ ID NO: 437980 - RNA, 60 nt, hsa; identical to SEQ ID NO: 37678

SEQ ID NO: 437981 - RNA, 60 nt, hsa; identical to SEQ ID NO: 37679

SEQ ID NO: 437982 - RNA, 60 nt, hsa; identical to SEQ ID NO: 37680

SEQ ID NO: 437983 - RNA, 60 nt, hsa; identical to SEQ ID NO: 37681

SEQ ID NO: 437984 - RNA, 60 nt, hsa; identical to SEQ ID NO: 37682

SEQ ID NO: 437985 - RNA, 60 nt, hsa; identical to SEQ ID NO: 37683

SEQ ID NO: 437986 - RNA, 60 nt, hsa; identical to SEQ ID NO: 37684

SEQ ID NO: 437987 - RNA, 60 nt, hsa; identical to SEQ ID NO: 37685

SEQ ID NO: 437988 - RNA, 60 nt, hsa; identical to SEQ ID NO: 37686

SEQ ID NO: 437989 - RNA, 60 nt, hsa; identical to SEQ ID NO: 37687

SEQ ID NO: 437990 - RNA, 60 nt, hsa; identical to SEQ ID NO: 37688

SEQ ID NO: 437991 - RNA, 60 nt, hsa; identical to SEQ ID NO: 37689

SEQ ID NO: 437992 - RNA, 60 nt, hsa; identical to SEQ ID NO: 37690

SEQ ID NO: 437993 - RNA, 60 nt, hsa; identical to SEQ ID NO: 37691

SEQ ID NO: 437994 - RNA, 60 nt, hsa; identical to SEQ ID NO: 37692

SEQ ID NO: 437995 - RNA, 60 nt, hsa; identical to SEQ ID NO: 37693

SEQ ID NO: 437996 - RNA, 60 nt, hsa; identical to SEQ ID NO: 37694

SEQ ID NO: 437997 - RNA, 60 nt, hsa; identical to SEQ ID NO: 37695

SEQ ID NO: 437998 - RNA, 60 nt, hsa; identical to SEQ ID NO: 37696

SEQ ID NO: 437999 - RNA, 60 nt, hsa; identical to SEQ ID NO: 37697

SEQ ID NO: 438000 - RNA, 60 nt, hsa; identical to SEQ ID NO: 37698

SEQ ID NO: 438001 - RNA, 60 nt, hsa; identical to SEQ ID NO: 37699

SEQ ID NO: 438002 - RNA, 60 nt, hsa; identical to SEQ ID NO: 37700

SEQ ID NO: 438003 - RNA, 60 nt, hsa; identical to SEQ ID NO: 37701

SEQ ID NO: 438004 - RNA, 60 nt, hsa; identical to SEQ ID NO: 37702

SEQ ID NO: 438005 - RNA, 60 nt, hsa; identical to SEQ ID NO: 37703

SEQ ID NO: 438006 - RNA, 60 nt, hsa; identical to SEQ ID NO: 37704

SEQ ID NO: 438007 - RNA, 60 nt, hsa; identical to SEQ ID NO: 37705

SEQ ID NO: 438008 - RNA, 60 nt, hsa; identical to SEQ ID NO: 37706

SEQ ID NO: 438009 - RNA, 60 nt, hsa; identical to SEQ ID NO: 37707

SEQ ID NO: 438010 - RNA, 60 nt, hsa; identical to SEQ ID NO: 37708

SEQ ID NO: 438011 - RNA, 60 nt, hsa; identical to SEQ ID NO: 37709

SEQ ID NO: 438012 - RNA, 60 nt, hsa; identical to SEQ ID NO: 37710

SEQ ID NO: 438013 - RNA, 60 nt, hsa; identical to SEQ ID NO: 37711

SEQ ID NO: 438014 - RNA, 60 nt, hsa; identical to SEQ ID NO: 37712

SEQ ID NO: 438015 - RNA, 60 nt, hsa; identical to SEQ ID NO: 37713

SEQ ID NO: 438016 - RNA, 60 nt, hsa; identical to SEQ ID NO: 37714

SEQ ID NO: 438017 - RNA, 60 nt, hsa; identical to SEQ ID NO: 37715

SEQ ID NO: 438018 - RNA, 60 nt, hsa; identical to SEQ ID NO: 37716

SEQ ID NO: 438019 - RNA, 60 nt, hsa; identical to SEQ ID NO: 37717

SEQ ID NO: 438020 - RNA, 60 nt, hsa; identical to SEQ ID NO: 37718

SEQ ID NO: 438021 - RNA, 60 nt, hsa; identical to SEQ ID NO: 37719

SEQ ID NO: 438022 - RNA, 60 nt, hsa; identical to SEQ ID NO: 37720

SEQ ID NO: 438023 - RNA, 60 nt, hsa; identical to SEQ ID NO: 37721

SEQ ID NO: 438024 - RNA, 60 nt, hsa; identical to SEQ ID NO: 37722

SEQ ID NO: 438025 - RNA, 60 nt, hsa; identical to SEQ ID NO: 37723

SEQ ID NO: 438026 - RNA, 60 nt, hsa; identical to SEQ ID NO: 37724

SEQ ID NO: 438027 - RNA, 60 nt, hsa; identical to SEQ ID NO: 37725

SEQ ID NO: 438028 - RNA, 60 nt, hsa; identical to SEQ ID NO: 37726

SEQ ID NO: 438029 - RNA, 60 nt, hsa; identical to SEQ ID NO: 37727

SEQ ID NO: 438030 - RNA, 60 nt, hsa; identical to SEQ ID NO: 37728

SEQ ID NO: 438031 - RNA, 60 nt, hsa; identical to SEQ ID NO: 37729

SEQ ID NO: 438032 - RNA, 60 nt, hsa; identical to SEQ ID NO: 37730

SEQ ID NO: 438033 - RNA, 60 nt, hsa; identical to SEQ ID NO: 37731

SEQ ID NO: 438034 - RNA, 60 nt, hsa; identical to SEQ ID NO: 37732

SEQ ID NO: 438035 - RNA, 60 nt, hsa; identical to SEQ ID NO: 37733

SEQ ID NO: 438036 - RNA, 60 nt, hsa; identical to SEQ ID NO: 37734

SEQ ID NO: 438037 - RNA, 60 nt, hsa; identical to SEQ ID NO: 37735

SEQ ID NO: 438038 - RNA, 60 nt, hsa; identical to SEQ ID NO: 37736

SEQ ID NO: 438039 - RNA, 60 nt, hsa; identical to SEQ ID NO: 37737

SEQ ID NO: 438040 - RNA, 60 nt, hsa; identical to SEQ ID NO: 37738

SEQ ID NO: 438041 - RNA, 60 nt, hsa; identical to SEQ ID NO: 37739

SEQ ID NO: 438042 - RNA, 60 nt, hsa; identical to SEQ ID NO: 37740

SEQ ID NO: 438043 - RNA, 60 nt, hsa; identical to SEQ ID NO: 37741

SEQ ID NO: 438044 - RNA, 60 nt, hsa; identical to SEQ ID NO: 37742

SEQ ID NO: 438045 - RNA, 60 nt, hsa; identical to SEQ ID NO: 37743

SEQ ID NO: 438046 - RNA, 60 nt, hsa; identical to SEQ ID NO: 37744

SEQ ID NO: 438047 - RNA, 60 nt, hsa; identical to SEQ ID NO: 37745

SEQ ID NO: 438048 - RNA, 60 nt, hsa; identical to SEQ ID NO: 37746

SEQ ID NO: 438049 - RNA, 60 nt, hsa; identical to SEQ ID NO: 37747

SEQ ID NO: 438050 - RNA, 60 nt, hsa; identical to SEQ ID NO: 37748

SEQ ID NO: 438051 - RNA, 60 nt, hsa; identical to SEQ ID NO: 37749

SEQ ID NO: 438052 - RNA, 60 nt, hsa; identical to SEQ ID NO: 37750

SEQ ID NO: 438053 - RNA, 60 nt, hsa; identical to SEQ ID NO: 37751

SEQ ID NO: 438054 - RNA, 60 nt, hsa; identical to SEQ ID NO: 37752

SEQ ID NO: 438055 - RNA, 51 nt, hsa; identical to SEQ ID NO: 37753

SEQ ID NO: 438056 - RNA, 60 nt, hsa; identical to SEQ ID NO: 37754

SEQ ID NO: 438057 - RNA, 60 nt, hsa; identical to SEQ ID NO: 37755

SEQ ID NO: 438058 - RNA, 60 nt, hsa; identical to SEQ ID NO: 37756

SEQ ID NO: 438059 - RNA, 60 nt, hsa; identical to SEQ ID NO: 37757

SEQ ID NO: 438060 - RNA, 60 nt, hsa; identical to SEQ ID NO: 37758

SEQ ID NO: 438061 - RNA, 60 nt, hsa; identical to SEQ ID NO: 37759

SEQ ID NO: 438062 - RNA, 60 nt, hsa; identical to SEQ ID NO: 37760

SEQ ID NO: 438063 - RNA, 60 nt, hsa; identical to SEQ ID NO: 37761

SEQ ID NO: 438064 - RNA, 60 nt, hsa; identical to SEQ ID NO: 37762

SEQ ID NO: 438065 - RNA, 60 nt, hsa; identical to SEQ ID NO: 37763

SEQ ID NO: 438066 - RNA, 60 nt, hsa; identical to SEQ ID NO: 37764

SEQ ID NO: 438067 - RNA, 60 nt, hsa; identical to SEQ ID NO: 37765

SEQ ID NO: 438068 - RNA, 54 nt, hsa; identical to SEQ ID NO: 37766

SEQ ID NO: 438069 - RNA, 60 nt, hsa; identical to SEQ ID NO: 37767

SEQ ID NO: 438070 - RNA, 60 nt, hsa; identical to SEQ ID NO: 37768

SEQ ID NO: 438071 - RNA, 60 nt, hsa; identical to SEQ ID NO: 37769

SEQ ID NO: 438072 - RNA, 60 nt, hsa; identical to SEQ ID NO: 37770

SEQ ID NO: 438073 - RNA, 60 nt, hsa; identical to SEQ ID NO: 37771

SEQ ID NO: 438074 - RNA, 60 nt, hsa; identical to SEQ ID NO: 37772

SEQ ID NO: 438075 - RNA, 60 nt, hsa; identical to SEQ ID NO: 37773

SEQ ID NO: 438076 - RNA, 60 nt, hsa; identical to SEQ ID NO: 37774

SEQ ID NO: 438077 - RNA, 60 nt, hsa; identical to SEQ ID NO: 37775

SEQ ID NO: 438078 - RNA, 60 nt, hsa; identical to SEQ ID NO: 37776

SEQ ID NO: 438079 - RNA, 60 nt, hsa; identical to SEQ ID NO: 37777

SEQ ID NO: 438080 - RNA, 60 nt, hsa; identical to SEQ ID NO: 37778

SEQ ID NO: 438081 - RNA, 60 nt, hsa; identical to SEQ ID NO: 37779

SEQ ID NO: 438082 - RNA, 60 nt, hsa; identical to SEQ ID NO: 37780

SEQ ID NO: 438083 - RNA, 60 nt, hsa; identical to SEQ ID NO: 37781

SEQ ID NO: 438084 - RNA, 60 nt, hsa; identical to SEQ ID NO: 37782

SEQ ID NO: 438085 - RNA, 60 nt, hsa; identical to SEQ ID NO: 37783

SEQ ID NO: 438086 - RNA, 60 nt, hsa; identical to SEQ ID NO: 37784

SEQ ID NO: 438087 - RNA, 60 nt, hsa; identical to SEQ ID NO: 37785

SEQ ID NO: 438088 - RNA, 60 nt, hsa; identical to SEQ ID NO: 37786

SEQ ID NO: 438089 - RNA, 60 nt, hsa; identical to SEQ ID NO: 37787

SEQ ID NO: 438090 - RNA, 60 nt, hsa; identical to SEQ ID NO: 37788

SEQ ID NO: 438091 - RNA, 60 nt, hsa; identical to SEQ ID NO: 37789

SEQ ID NO: 438092 - RNA, 60 nt, hsa; identical to SEQ ID NO: 37790

SEQ ID NO: 438093 - RNA, 60 nt, hsa; identical to SEQ ID NO: 37791

SEQ ID NO: 438094 - RNA, 60 nt, hsa; identical to SEQ ID NO: 37792

SEQ ID NO: 438095 - RNA, 60 nt, hsa; identical to SEQ ID NO: 37793

SEQ ID NO: 438096 - RNA, 60 nt, hsa; identical to SEQ ID NO: 37794

SEQ ID NO: 438097 - RNA, 60 nt, hsa; identical to SEQ ID NO: 37795

SEQ ID NO: 438098 - RNA, 60 nt, hsa; identical to SEQ ID NO: 37796

SEQ ID NO: 438099 - RNA, 60 nt, hsa; identical to SEQ ID NO: 37797

SEQ ID NO: 438100 - RNA, 60 nt, hsa; identical to SEQ ID NO: 37798

SEQ ID NO: 438101 - RNA, 60 nt, hsa; identical to SEQ ID NO: 37799

SEQ ID NO: 438102 - RNA, 60 nt, hsa; identical to SEQ ID NO: 37800

SEQ ID NO: 438103 - RNA, 60 nt, hsa; identical to SEQ ID NO: 37801

SEQ ID NO: 438104 - RNA, 60 nt, hsa; identical to SEQ ID NO: 37802

SEQ ID NO: 438105 - RNA, 60 nt, hsa; identical to SEQ ID NO: 37803

SEQ ID NO: 438106 - RNA, 60 nt, hsa; identical to SEQ ID NO: 37804

SEQ ID NO: 438107 - RNA, 60 nt, hsa; identical to SEQ ID NO: 37805

SEQ ID NO: 438108 - RNA, 60 nt, hsa; identical to SEQ ID NO: 37806

SEQ ID NO: 438109 - RNA, 60 nt, hsa; identical to SEQ ID NO: 37807

SEQ ID NO: 438110 - RNA, 60 nt, hsa; identical to SEQ ID NO: 37808

SEQ ID NO: 438111 - RNA, 60 nt, hsa; identical to SEQ ID NO: 37809

SEQ ID NO: 438112 - RNA, 60 nt, hsa; identical to SEQ ID NO: 37810

SEQ ID NO: 438113 - RNA, 60 nt, hsa; identical to SEQ ID NO: 37811

SEQ ID NO: 438114 - RNA, 60 nt, hsa; identical to SEQ ID NO: 37812

SEQ ID NO: 438115 - RNA, 60 nt, hsa; identical to SEQ ID NO: 37813

SEQ ID NO: 438116 - RNA, 60 nt, hsa; identical to SEQ ID NO: 37814

SEQ ID NO: 438117 - RNA, 60 nt, hsa; identical to SEQ ID NO: 37815

SEQ ID NO: 438118 - RNA, 60 nt, hsa; identical to SEQ ID NO: 37816

SEQ ID NO: 438119 - RNA, 60 nt, hsa; identical to SEQ ID NO: 37817

SEQ ID NO: 438120 - RNA, 60 nt, hsa; identical to SEQ ID NO: 37818

SEQ ID NO: 438121 - RNA, 60 nt, hsa; identical to SEQ ID NO: 37819

SEQ ID NO: 438122 - RNA, 60 nt, hsa; identical to SEQ ID NO: 37820

SEQ ID NO: 438123 - RNA, 60 nt, hsa; identical to SEQ ID NO: 37821

SEQ ID NO: 438124 - RNA, 60 nt, hsa; identical to SEQ ID NO: 37822

SEQ ID NO: 438125 - RNA, 60 nt, hsa; identical to SEQ ID NO: 37823

SEQ ID NO: 438126 - RNA, 60 nt, hsa; identical to SEQ ID NO: 37824

SEQ ID NO: 438127 - RNA, 60 nt, hsa; identical to SEQ ID NO: 37825

SEQ ID NO: 438128 - RNA, 60 nt, hsa; identical to SEQ ID NO: 37826

SEQ ID NO: 438129 - RNA, 60 nt, hsa; identical to SEQ ID NO: 37827

SEQ ID NO: 438130 - RNA, 60 nt, hsa; identical to SEQ ID NO: 37828

SEQ ID NO: 438131 - RNA, 60 nt, hsa; identical to SEQ ID NO: 37829

SEQ ID NO: 438132 - RNA, 60 nt, hsa; identical to SEQ ID NO: 37830

SEQ ID NO: 438133 - RNA, 60 nt, hsa; identical to SEQ ID NO: 37831

SEQ ID NO: 438134 - RNA, 60 nt, hsa; identical to SEQ ID NO: 37832

SEQ ID NO: 438135 - RNA, 60 nt, hsa; identical to SEQ ID NO: 37833

SEQ ID NO: 438136 - RNA, 60 nt, hsa; identical to SEQ ID NO: 37834

SEQ ID NO: 438137 - RNA, 60 nt, hsa; identical to SEQ ID NO: 37835

SEQ ID NO: 438138 - RNA, 60 nt, hsa; identical to SEQ ID NO: 37836

SEQ ID NO: 438139 - RNA, 60 nt, hsa; identical to SEQ ID NO: 37837

SEQ ID NO: 438140 - RNA, 60 nt, hsa; identical to SEQ ID NO: 37838

SEQ ID NO: 438141 - RNA, 60 nt, hsa; identical to SEQ ID NO: 37839

SEQ ID NO: 438142 - RNA, 60 nt, hsa; identical to SEQ ID NO: 37840

SEQ ID NO: 438143 - RNA, 60 nt, hsa; identical to SEQ ID NO: 37841

SEQ ID NO: 438144 - RNA, 60 nt, hsa; identical to SEQ ID NO: 37842

SEQ ID NO: 438145 - RNA, 60 nt, hsa; identical to SEQ ID NO: 37843

SEQ ID NO: 438146 - RNA, 60 nt, hsa; identical to SEQ ID NO: 37844

SEQ ID NO: 438147 - RNA, 60 nt, hsa; identical to SEQ ID NO: 37845

SEQ ID NO: 438148 - RNA, 60 nt, hsa; identical to SEQ ID NO: 37846

SEQ ID NO: 438149 - RNA, 60 nt, hsa; identical to SEQ ID NO: 37847

SEQ ID NO: 438150 - RNA, 60 nt, hsa; identical to SEQ ID NO: 37848

SEQ ID NO: 438151 - RNA, 60 nt, hsa; identical to SEQ ID NO: 37849

SEQ ID NO: 438152 - RNA, 60 nt, hsa; identical to SEQ ID NO: 37850

SEQ ID NO: 438153 - RNA, 60 nt, hsa; identical to SEQ ID NO: 37851

SEQ ID NO: 438154 - RNA, 60 nt, hsa; identical to SEQ ID NO: 37852

SEQ ID NO: 438155 - RNA, 60 nt, hsa; identical to SEQ ID NO: 37853

SEQ ID NO: 438156 - RNA, 60 nt, hsa; identical to SEQ ID NO: 37854

SEQ ID NO: 438157 - RNA, 60 nt, hsa; identical to SEQ ID NO: 37855

SEQ ID NO: 438158 - RNA, 60 nt, hsa; identical to SEQ ID NO: 37856

SEQ ID NO: 438159 - RNA, 60 nt, hsa; identical to SEQ ID NO: 37857

SEQ ID NO: 438160 - RNA, 60 nt, hsa; identical to SEQ ID NO: 37858

SEQ ID NO: 438161 - RNA, 60 nt, hsa; identical to SEQ ID NO: 37859

SEQ ID NO: 438162 - RNA, 60 nt, hsa; identical to SEQ ID NO: 37860

SEQ ID NO: 438163 - RNA, 60 nt, hsa; identical to SEQ ID NO: 37861

SEQ ID NO: 438164 - RNA, 60 nt, hsa; identical to SEQ ID NO: 37862

SEQ ID NO: 438165 - RNA, 60 nt, hsa; identical to SEQ ID NO: 37863

SEQ ID NO: 438166 - RNA, 60 nt, hsa; identical to SEQ ID NO: 37864

SEQ ID NO: 438167 - RNA, 60 nt, hsa; identical to SEQ ID NO: 37865

SEQ ID NO: 438168 - RNA, 60 nt, hsa; identical to SEQ ID NO: 37866

SEQ ID NO: 438169 - RNA, 60 nt, hsa; identical to SEQ ID NO: 37867

SEQ ID NO: 438170 - RNA, 60 nt, hsa; identical to SEQ ID NO: 37868

SEQ ID NO: 438171 - RNA, 60 nt, hsa; identical to SEQ ID NO: 37869

SEQ ID NO: 438172 - RNA, 60 nt, hsa; identical to SEQ ID NO: 37870

SEQ ID NO: 438173 - RNA, 60 nt, hsa; identical to SEQ ID NO: 37871

SEQ ID NO: 438174 - RNA, 60 nt, hsa; identical to SEQ ID NO: 37872

SEQ ID NO: 438175 - RNA, 60 nt, hsa; identical to SEQ ID NO: 37873

SEQ ID NO: 438176 - RNA, 60 nt, hsa; identical to SEQ ID NO: 37874

SEQ ID NO: 438177 - RNA, 60 nt, hsa; identical to SEQ ID NO: 37875

SEQ ID NO: 438178 - RNA, 60 nt, hsa; identical to SEQ ID NO: 37876

SEQ ID NO: 438179 - RNA, 60 nt, hsa; identical to SEQ ID NO: 37877

SEQ ID NO: 438180 - RNA, 60 nt, hsa; identical to SEQ ID NO: 37878

SEQ ID NO: 438181 - RNA, 60 nt, hsa; identical to SEQ ID NO: 37879

SEQ ID NO: 438182 - RNA, 60 nt, hsa; identical to SEQ ID NO: 37880

SEQ ID NO: 438183 - RNA, 60 nt, hsa; identical to SEQ ID NO: 37881

SEQ ID NO: 438184 - RNA, 60 nt, hsa; identical to SEQ ID NO: 37882

SEQ ID NO: 438185 - RNA, 60 nt, hsa; identical to SEQ ID NO: 37883

SEQ ID NO: 438186 - RNA, 60 nt, hsa; identical to SEQ ID NO: 37884

SEQ ID NO: 438187 - RNA, 60 nt, hsa; identical to SEQ ID NO: 37885

SEQ ID NO: 438188 - RNA, 60 nt, hsa; identical to SEQ ID NO: 37886

SEQ ID NO: 438189 - RNA, 60 nt, hsa; identical to SEQ ID NO: 37887

SEQ ID NO: 438190 - RNA, 60 nt, hsa; identical to SEQ ID NO: 37888

SEQ ID NO: 438191 - RNA, 60 nt, hsa; identical to SEQ ID NO: 37889

SEQ ID NO: 438192 - RNA, 60 nt, hsa; identical to SEQ ID NO: 37890

SEQ ID NO: 438193 - RNA, 60 nt, hsa; identical to SEQ ID NO: 37891

SEQ ID NO: 438194 - RNA, 60 nt, hsa; identical to SEQ ID NO: 37892

SEQ ID NO: 438195 - RNA, 60 nt, hsa; identical to SEQ ID NO: 37893

SEQ ID NO: 438196 - RNA, 60 nt, hsa; identical to SEQ ID NO: 37894

SEQ ID NO: 438197 - RNA, 60 nt, hsa; identical to SEQ ID NO: 37895

SEQ ID NO: 438198 - RNA, 60 nt, hsa; identical to SEQ ID NO: 37896

SEQ ID NO: 438199 - RNA, 60 nt, hsa; identical to SEQ ID NO: 37897

SEQ ID NO: 438200 - RNA, 60 nt, hsa; identical to SEQ ID NO: 37898

SEQ ID NO: 438201 - RNA, 60 nt, hsa; identical to SEQ ID NO: 37899

SEQ ID NO: 438202 - RNA, 60 nt, hsa; identical to SEQ ID NO: 37900

SEQ ID NO: 438203 - RNA, 60 nt, hsa; identical to SEQ ID NO: 37901

SEQ ID NO: 438204 - RNA, 60 nt, hsa; identical to SEQ ID NO: 37902

SEQ ID NO: 438205 - RNA, 60 nt, hsa; identical to SEQ ID NO: 37903

SEQ ID NO: 438206 - RNA, 60 nt, hsa; identical to SEQ ID NO: 37904

SEQ ID NO: 438207 - RNA, 60 nt, hsa; identical to SEQ ID NO: 37905

SEQ ID NO: 438208 - RNA, 60 nt, hsa; identical to SEQ ID NO: 37906

SEQ ID NO: 438209 - RNA, 60 nt, hsa; identical to SEQ ID NO: 37907

SEQ ID NO: 438210 - RNA, 60 nt, hsa; identical to SEQ ID NO: 37908

SEQ ID NO: 438211 - RNA, 60 nt, hsa; identical to SEQ ID NO: 37909

SEQ ID NO: 438212 - RNA, 60 nt, hsa; identical to SEQ ID NO: 37910

SEQ ID NO: 438213 - RNA, 60 nt, hsa; identical to SEQ ID NO: 37911

SEQ ID NO: 438214 - RNA, 60 nt, hsa; identical to SEQ ID NO: 37912

SEQ ID NO: 438215 - RNA, 60 nt, hsa; identical to SEQ ID NO: 37913

SEQ ID NO: 438216 - RNA, 60 nt, hsa; identical to SEQ ID NO: 37914

SEQ ID NO: 438217 - RNA, 60 nt, hsa; identical to SEQ ID NO: 37915

SEQ ID NO: 438218 - RNA, 60 nt, hsa; identical to SEQ ID NO: 37916

SEQ ID NO: 438219 - RNA, 60 nt, hsa; identical to SEQ ID NO: 37917

SEQ ID NO: 438220 - RNA, 60 nt, hsa; identical to SEQ ID NO: 37918

SEQ ID NO: 438221 - RNA, 60 nt, hsa; identical to SEQ ID NO: 37919

SEQ ID NO: 438222 - RNA, 60 nt, hsa; identical to SEQ ID NO: 37920

SEQ ID NO: 438223 - RNA, 60 nt, hsa; identical to SEQ ID NO: 37921

SEQ ID NO: 438224 - RNA, 60 nt, hsa; identical to SEQ ID NO: 37922

SEQ ID NO: 438225 - RNA, 60 nt, hsa; identical to SEQ ID NO: 37923

SEQ ID NO: 438226 - RNA, 60 nt, hsa; identical to SEQ ID NO: 37924

SEQ ID NO: 438227 - RNA, 60 nt, hsa; identical to SEQ ID NO: 37925

SEQ ID NO: 438228 - RNA, 60 nt, hsa; identical to SEQ ID NO: 37926

SEQ ID NO: 438229 - RNA, 60 nt, hsa; identical to SEQ ID NO: 37927

SEQ ID NO: 438230 - RNA, 60 nt, hsa; identical to SEQ ID NO: 37928

SEQ ID NO: 438231 - RNA, 60 nt, hsa; identical to SEQ ID NO: 37929

SEQ ID NO: 438232 - RNA, 60 nt, hsa; identical to SEQ ID NO: 37930

SEQ ID NO: 438233 - RNA, 60 nt, hsa; identical to SEQ ID NO: 37931

SEQ ID NO: 438234 - RNA, 60 nt, hsa; identical to SEQ ID NO: 37932

SEQ ID NO: 438235 - RNA, 60 nt, hsa; identical to SEQ ID NO: 37933

SEQ ID NO: 438236 - RNA, 60 nt, hsa; identical to SEQ ID NO: 37934

SEQ ID NO: 438237 - RNA, 60 nt, hsa; identical to SEQ ID NO: 37935

SEQ ID NO: 438238 - RNA, 60 nt, hsa; identical to SEQ ID NO: 37936

SEQ ID NO: 438239 - RNA, 60 nt, hsa; identical to SEQ ID NO: 37937

SEQ ID NO: 438240 - RNA, 60 nt, hsa; identical to SEQ ID NO: 37938

SEQ ID NO: 438241 - RNA, 60 nt, hsa; identical to SEQ ID NO: 37939

SEQ ID NO: 438242 - RNA, 60 nt, hsa; identical to SEQ ID NO: 37940

SEQ ID NO: 438243 - RNA, 60 nt, hsa; identical to SEQ ID NO: 37941

SEQ ID NO: 438244 - RNA, 60 nt, hsa; identical to SEQ ID NO: 37942

SEQ ID NO: 438245 - RNA, 60 nt, hsa; identical to SEQ ID NO: 37943

SEQ ID NO: 438246 - RNA, 60 nt, hsa; identical to SEQ ID NO: 37944

SEQ ID NO: 438247 - RNA, 60 nt, hsa; identical to SEQ ID NO: 37945

SEQ ID NO: 438248 - RNA, 60 nt, hsa; identical to SEQ ID NO: 37946

SEQ ID NO: 438249 - RNA, 60 nt, hsa; identical to SEQ ID NO: 37947

SEQ ID NO: 438250 - RNA, 60 nt, hsa; identical to SEQ ID NO: 37948

SEQ ID NO: 438251 - RNA, 60 nt, hsa; identical to SEQ ID NO: 37949

SEQ ID NO: 438252 - RNA, 60 nt, hsa; identical to SEQ ID NO: 37950

SEQ ID NO: 438253 - RNA, 60 nt, hsa; identical to SEQ ID NO: 37951

SEQ ID NO: 438254 - RNA, 60 nt, hsa; identical to SEQ ID NO: 37952

SEQ ID NO: 438255 - RNA, 60 nt, hsa; identical to SEQ ID NO: 37953

SEQ ID NO: 438256 - RNA, 60 nt, hsa; identical to SEQ ID NO: 37954

SEQ ID NO: 438257 - RNA, 60 nt, hsa; identical to SEQ ID NO: 37955

SEQ ID NO: 438258 - RNA, 60 nt, hsa; identical to SEQ ID NO: 37956

SEQ ID NO: 438259 - RNA, 60 nt, hsa; identical to SEQ ID NO: 37957

SEQ ID NO: 438260 - RNA, 60 nt, hsa; identical to SEQ ID NO: 37958

SEQ ID NO: 438261 - RNA, 60 nt, hsa; identical to SEQ ID NO: 37959

SEQ ID NO: 438262 - RNA, 60 nt, hsa; identical to SEQ ID NO: 37960

SEQ ID NO: 438263 - RNA, 54 nt, hsa; identical to SEQ ID NO: 37961

SEQ ID NO: 438264 - RNA, 60 nt, hsa; identical to SEQ ID NO: 37962

SEQ ID NO: 438265 - RNA, 60 nt, hsa; identical to SEQ ID NO: 37963

SEQ ID NO: 438266 - RNA, 60 nt, hsa; identical to SEQ ID NO: 37964

SEQ ID NO: 438267 - RNA, 60 nt, hsa; identical to SEQ ID NO: 37965

SEQ ID NO: 438268 - RNA, 60 nt, hsa; identical to SEQ ID NO: 37966

SEQ ID NO: 438269 - RNA, 60 nt, hsa; identical to SEQ ID NO: 37967

SEQ ID NO: 438270 - RNA, 60 nt, hsa; identical to SEQ ID NO: 37968

SEQ ID NO: 438271 - RNA, 60 nt, hsa; identical to SEQ ID NO: 37969

SEQ ID NO: 438272 - RNA, 60 nt, hsa; identical to SEQ ID NO: 37970

SEQ ID NO: 438273 - RNA, 60 nt, hsa; identical to SEQ ID NO: 37971

SEQ ID NO: 438274 - RNA, 60 nt, hsa; identical to SEQ ID NO: 37972

SEQ ID NO: 438275 - RNA, 60 nt, hsa; identical to SEQ ID NO: 37973

SEQ ID NO: 438276 - RNA, 60 nt, hsa; identical to SEQ ID NO: 37974

SEQ ID NO: 438277 - RNA, 60 nt, hsa; identical to SEQ ID NO: 37975

SEQ ID NO: 438278 - RNA, 60 nt, hsa; identical to SEQ ID NO: 37976

SEQ ID NO: 438279 - RNA, 60 nt, hsa; identical to SEQ ID NO: 37977

SEQ ID NO: 438280 - RNA, 60 nt, hsa; identical to SEQ ID NO: 37978

SEQ ID NO: 438281 - RNA, 60 nt, hsa; identical to SEQ ID NO: 37979

SEQ ID NO: 438282 - RNA, 60 nt, hsa; identical to SEQ ID NO: 37980

SEQ ID NO: 438283 - RNA, 60 nt, hsa; identical to SEQ ID NO: 37981

SEQ ID NO: 438284 - RNA, 60 nt, hsa; identical to SEQ ID NO: 37982

SEQ ID NO: 438285 - RNA, 60 nt, hsa; identical to SEQ ID NO: 37983

SEQ ID NO: 438286 - RNA, 60 nt, hsa; identical to SEQ ID NO: 37984

SEQ ID NO: 438287 - RNA, 60 nt, hsa; identical to SEQ ID NO: 37985

SEQ ID NO: 438288 - RNA, 60 nt, hsa; identical to SEQ ID NO: 37986

SEQ ID NO: 438289 - RNA, 60 nt, hsa; identical to SEQ ID NO: 37987

SEQ ID NO: 438290 - RNA, 60 nt, hsa; identical to SEQ ID NO: 37988

SEQ ID NO: 438291 - RNA, 60 nt, hsa; identical to SEQ ID NO: 37989

SEQ ID NO: 438292 - RNA, 60 nt, hsa; identical to SEQ ID NO: 37990

SEQ ID NO: 438293 - RNA, 60 nt, hsa; identical to SEQ ID NO: 37991

SEQ ID NO: 438294 - RNA, 60 nt, hsa; identical to SEQ ID NO: 37992

SEQ ID NO: 438295 - RNA, 60 nt, hsa; identical to SEQ ID NO: 37993

SEQ ID NO: 438296 - RNA, 60 nt, hsa; identical to SEQ ID NO: 37994

SEQ ID NO: 438297 - RNA, 52 nt, hsa; identical to SEQ ID NO: 37995

SEQ ID NO: 438298 - RNA, 60 nt, hsa; identical to SEQ ID NO: 37996

SEQ ID NO: 438299 - RNA, 60 nt, hsa; identical to SEQ ID NO: 37997

SEQ ID NO: 438300 - RNA, 60 nt, hsa; identical to SEQ ID NO: 37998

SEQ ID NO: 438301 - RNA, 60 nt, hsa; identical to SEQ ID NO: 37999

SEQ ID NO: 438302 - RNA, 60 nt, hsa; identical to SEQ ID NO: 38000

SEQ ID NO: 438303 - RNA, 60 nt, hsa; identical to SEQ ID NO: 38001

SEQ ID NO: 438304 - RNA, 60 nt, hsa; identical to SEQ ID NO: 38002

SEQ ID NO: 438305 - RNA, 60 nt, hsa; identical to SEQ ID NO: 38003

SEQ ID NO: 438306 - RNA, 60 nt, hsa; identical to SEQ ID NO: 38004

SEQ ID NO: 438307 - RNA, 60 nt, hsa; identical to SEQ ID NO: 38005

SEQ ID NO: 438308 - RNA, 60 nt, hsa; identical to SEQ ID NO: 38006

SEQ ID NO: 438309 - RNA, 60 nt, hsa; identical to SEQ ID NO: 38007

SEQ ID NO: 438310 - RNA, 60 nt, hsa; identical to SEQ ID NO: 38008

SEQ ID NO: 438311 - RNA, 60 nt, hsa; identical to SEQ ID NO: 38009

SEQ ID NO: 438312 - RNA, 60 nt, hsa; identical to SEQ ID NO: 38010

SEQ ID NO: 438313 - RNA, 60 nt, hsa; identical to SEQ ID NO: 38011

SEQ ID NO: 438314 - RNA, 60 nt, hsa; identical to SEQ ID NO: 38012

SEQ ID NO: 438315 - RNA, 60 nt, hsa; identical to SEQ ID NO: 38013

SEQ ID NO: 438316 - RNA, 60 nt, hsa; identical to SEQ ID NO: 38014

SEQ ID NO: 438317 - RNA, 60 nt, hsa; identical to SEQ ID NO: 38015

SEQ ID NO: 438318 - RNA, 60 nt, hsa; identical to SEQ ID NO: 38016

SEQ ID NO: 438319 - RNA, 60 nt, hsa; identical to SEQ ID NO: 38017

SEQ ID NO: 438320 - RNA, 60 nt, hsa; identical to SEQ ID NO: 38018

SEQ ID NO: 438321 - RNA, 60 nt, hsa; identical to SEQ ID NO: 38019

SEQ ID NO: 438322 - RNA, 60 nt, hsa; identical to SEQ ID NO: 38020

SEQ ID NO: 438323 - RNA, 60 nt, hsa; identical to SEQ ID NO: 38021

SEQ ID NO: 438324 - RNA, 60 nt, hsa; identical to SEQ ID NO: 38022

SEQ ID NO: 438325 - RNA, 60 nt, hsa; identical to SEQ ID NO: 38023

SEQ ID NO: 438326 - RNA, 60 nt, hsa; identical to SEQ ID NO: 38024

SEQ ID NO: 438327 - RNA, 60 nt, hsa; identical to SEQ ID NO: 38025

SEQ ID NO: 438328 - RNA, 60 nt, hsa; identical to SEQ ID NO: 38026

SEQ ID NO: 438329 - RNA, 60 nt, hsa; identical to SEQ ID NO: 38027

SEQ ID NO: 438330 - RNA, 60 nt, hsa; identical to SEQ ID NO: 38028

SEQ ID NO: 438331 - RNA, 60 nt, hsa; identical to SEQ ID NO: 38029

SEQ ID NO: 438332 - RNA, 60 nt, hsa; identical to SEQ ID NO: 38030

SEQ ID NO: 438333 - RNA, 60 nt, hsa; identical to SEQ ID NO: 38031

SEQ ID NO: 438334 - RNA, 60 nt, hsa; identical to SEQ ID NO: 38032

SEQ ID NO: 438335 - RNA, 60 nt, hsa; identical to SEQ ID NO: 38033

SEQ ID NO: 438336 - RNA, 60 nt, hsa; identical to SEQ ID NO: 38034

SEQ ID NO: 438337 - RNA, 60 nt, hsa; identical to SEQ ID NO: 38035

SEQ ID NO: 438338 - RNA, 60 nt, hsa; identical to SEQ ID NO: 38036

SEQ ID NO: 438339 - RNA, 60 nt, hsa; identical to SEQ ID NO: 38037

SEQ ID NO: 438340 - RNA, 60 nt, hsa; identical to SEQ ID NO: 38038

SEQ ID NO: 438341 - RNA, 60 nt, hsa; identical to SEQ ID NO: 38039

SEQ ID NO: 438342 - RNA, 60 nt, hsa; identical to SEQ ID NO: 38040

SEQ ID NO: 438343 - RNA, 60 nt, hsa; identical to SEQ ID NO: 38041

SEQ ID NO: 438344 - RNA, 60 nt, hsa; identical to SEQ ID NO: 38042

SEQ ID NO: 438345 - RNA, 60 nt, hsa; identical to SEQ ID NO: 38043

SEQ ID NO: 438346 - RNA, 60 nt, hsa; identical to SEQ ID NO: 38044

SEQ ID NO: 438347 - RNA, 60 nt, hsa; identical to SEQ ID NO: 38045

SEQ ID NO: 438348 - RNA, 60 nt, hsa; identical to SEQ ID NO: 38046

SEQ ID NO: 438349 - RNA, 60 nt, hsa; identical to SEQ ID NO: 38047

SEQ ID NO: 438350 - RNA, 60 nt, hsa; identical to SEQ ID NO: 38048

SEQ ID NO: 438351 - RNA, 60 nt, hsa; identical to SEQ ID NO: 38049

SEQ ID NO: 438352 - RNA, 60 nt, hsa; identical to SEQ ID NO: 38050

SEQ ID NO: 438353 - RNA, 60 nt, hsa; identical to SEQ ID NO: 38051

SEQ ID NO: 438354 - RNA, 60 nt, hsa; identical to SEQ ID NO: 38052

SEQ ID NO: 438355 - RNA, 60 nt, hsa; identical to SEQ ID NO: 38053

SEQ ID NO: 438356 - RNA, 60 nt, hsa; identical to SEQ ID NO: 38054

SEQ ID NO: 438357 - RNA, 60 nt, hsa; identical to SEQ ID NO: 38055

SEQ ID NO: 438358 - RNA, 60 nt, hsa; identical to SEQ ID NO: 38056

SEQ ID NO: 438359 - RNA, 60 nt, hsa; identical to SEQ ID NO: 38057

SEQ ID NO: 438360 - RNA, 60 nt, hsa; identical to SEQ ID NO: 38058

SEQ ID NO: 438361 - RNA, 60 nt, hsa; identical to SEQ ID NO: 38059

SEQ ID NO: 438362 - RNA, 60 nt, hsa; identical to SEQ ID NO: 38060

SEQ ID NO: 438363 - RNA, 60 nt, hsa; identical to SEQ ID NO: 38061

SEQ ID NO: 438364 - RNA, 60 nt, hsa; identical to SEQ ID NO: 38062

SEQ ID NO: 438365 - RNA, 60 nt, hsa; identical to SEQ ID NO: 38063

SEQ ID NO: 438366 - RNA, 60 nt, hsa; identical to SEQ ID NO: 38064

SEQ ID NO: 438367 - RNA, 60 nt, hsa; identical to SEQ ID NO: 38065

SEQ ID NO: 438368 - RNA, 60 nt, hsa; identical to SEQ ID NO: 38066

SEQ ID NO: 438369 - RNA, 60 nt, hsa; identical to SEQ ID NO: 38067

SEQ ID NO: 438370 - RNA, 60 nt, hsa; identical to SEQ ID NO: 38068

SEQ ID NO: 438371 - RNA, 60 nt, hsa; identical to SEQ ID NO: 38069

SEQ ID NO: 438372 - RNA, 60 nt, hsa; identical to SEQ ID NO: 38070

SEQ ID NO: 438373 - RNA, 60 nt, hsa; identical to SEQ ID NO: 38071

SEQ ID NO: 438374 - RNA, 60 nt, hsa; identical to SEQ ID NO: 38072

SEQ ID NO: 438375 - RNA, 60 nt, hsa; identical to SEQ ID NO: 38073

SEQ ID NO: 438376 - RNA, 60 nt, hsa; identical to SEQ ID NO: 38074

SEQ ID NO: 438377 - RNA, 60 nt, hsa; identical to SEQ ID NO: 38075

SEQ ID NO: 438378 - RNA, 60 nt, hsa; identical to SEQ ID NO: 38076

SEQ ID NO: 438379 - RNA, 60 nt, hsa; identical to SEQ ID NO: 38077

SEQ ID NO: 438380 - RNA, 60 nt, hsa; identical to SEQ ID NO: 38078

SEQ ID NO: 438381 - RNA, 60 nt, hsa; identical to SEQ ID NO: 38079

SEQ ID NO: 438382 - RNA, 60 nt, hsa; identical to SEQ ID NO: 38080

SEQ ID NO: 438383 - RNA, 60 nt, hsa; identical to SEQ ID NO: 38081

SEQ ID NO: 438384 - RNA, 60 nt, hsa; identical to SEQ ID NO: 38082

SEQ ID NO: 438385 - RNA, 60 nt, hsa; identical to SEQ ID NO: 38083

SEQ ID NO: 438386 - RNA, 60 nt, hsa; identical to SEQ ID NO: 38084

SEQ ID NO: 438387 - RNA, 60 nt, hsa; identical to SEQ ID NO: 38085

SEQ ID NO: 438388 - RNA, 60 nt, hsa; identical to SEQ ID NO: 38086

SEQ ID NO: 438389 - RNA, 60 nt, hsa; identical to SEQ ID NO: 38087

SEQ ID NO: 438390 - RNA, 60 nt, hsa; identical to SEQ ID NO: 38088

SEQ ID NO: 438391 - RNA, 60 nt, hsa; identical to SEQ ID NO: 38089

SEQ ID NO: 438392 - RNA, 60 nt, hsa; identical to SEQ ID NO: 38090

SEQ ID NO: 438393 - RNA, 60 nt, hsa; identical to SEQ ID NO: 38091

SEQ ID NO: 438394 - RNA, 60 nt, hsa; identical to SEQ ID NO: 38092

SEQ ID NO: 438395 - RNA, 60 nt, hsa; identical to SEQ ID NO: 38093

SEQ ID NO: 438396 - RNA, 60 nt, hsa; identical to SEQ ID NO: 38094

SEQ ID NO: 438397 - RNA, 60 nt, hsa; identical to SEQ ID NO: 38095

SEQ ID NO: 438398 - RNA, 60 nt, hsa; identical to SEQ ID NO: 38096

SEQ ID NO: 438399 - RNA, 60 nt, hsa; identical to SEQ ID NO: 38097

SEQ ID NO: 438400 - RNA, 60 nt, hsa; identical to SEQ ID NO: 38098

SEQ ID NO: 438401 - RNA, 60 nt, hsa; identical to SEQ ID NO: 38099

SEQ ID NO: 438402 - RNA, 60 nt, hsa; identical to SEQ ID NO: 38100

SEQ ID NO: 438403 - RNA, 60 nt, hsa; identical to SEQ ID NO: 38101

SEQ ID NO: 438404 - RNA, 60 nt, hsa; identical to SEQ ID NO: 38102

SEQ ID NO: 438405 - RNA, 60 nt, hsa; identical to SEQ ID NO: 38103

SEQ ID NO: 438406 - RNA, 60 nt, hsa; identical to SEQ ID NO: 38104

SEQ ID NO: 438407 - RNA, 60 nt, hsa; identical to SEQ ID NO: 38105

SEQ ID NO: 438408 - RNA, 60 nt, hsa; identical to SEQ ID NO: 38106

SEQ ID NO: 438409 - RNA, 60 nt, hsa; identical to SEQ ID NO: 38107

SEQ ID NO: 438410 - RNA, 60 nt, hsa; identical to SEQ ID NO: 38108

SEQ ID NO: 438411 - RNA, 60 nt, hsa; identical to SEQ ID NO: 38109

SEQ ID NO: 438412 - RNA, 60 nt, hsa; identical to SEQ ID NO: 38110

SEQ ID NO: 438413 - RNA, 60 nt, hsa; identical to SEQ ID NO: 38111

SEQ ID NO: 438414 - RNA, 60 nt, hsa; identical to SEQ ID NO: 38112

SEQ ID NO: 438415 - RNA, 60 nt, hsa; identical to SEQ ID NO: 38113

SEQ ID NO: 438416 - RNA, 60 nt, hsa; identical to SEQ ID NO: 38114

SEQ ID NO: 438417 - RNA, 60 nt, hsa; identical to SEQ ID NO: 38115

SEQ ID NO: 438418 - RNA, 60 nt, hsa; identical to SEQ ID NO: 38116

SEQ ID NO: 438419 - RNA, 60 nt, hsa; identical to SEQ ID NO: 38117

SEQ ID NO: 438420 - RNA, 60 nt, hsa; identical to SEQ ID NO: 38118

SEQ ID NO: 438421 - RNA, 60 nt, hsa; identical to SEQ ID NO: 38119

SEQ ID NO: 438422 - RNA, 60 nt, hsa; identical to SEQ ID NO: 38120

SEQ ID NO: 438423 - RNA, 60 nt, hsa; identical to SEQ ID NO: 38121

SEQ ID NO: 438424 - RNA, 60 nt, hsa; identical to SEQ ID NO: 38122

SEQ ID NO: 438425 - RNA, 60 nt, hsa; identical to SEQ ID NO: 38123

SEQ ID NO: 438426 - RNA, 60 nt, hsa; identical to SEQ ID NO: 38124

SEQ ID NO: 438427 - RNA, 60 nt, hsa; identical to SEQ ID NO: 38125

SEQ ID NO: 438428 - RNA, 60 nt, hsa; identical to SEQ ID NO: 38126

SEQ ID NO: 438429 - RNA, 60 nt, hsa; identical to SEQ ID NO: 38127

SEQ ID NO: 438430 - RNA, 60 nt, hsa; identical to SEQ ID NO: 38128

SEQ ID NO: 438431 - RNA, 60 nt, hsa; identical to SEQ ID NO: 38129

SEQ ID NO: 438432 - RNA, 60 nt, hsa; identical to SEQ ID NO: 38130

SEQ ID NO: 438433 - RNA, 60 nt, hsa; identical to SEQ ID NO: 38131

SEQ ID NO: 438434 - RNA, 60 nt, hsa; identical to SEQ ID NO: 38132

SEQ ID NO: 438435 - RNA, 60 nt, hsa; identical to SEQ ID NO: 38133

SEQ ID NO: 438436 - RNA, 60 nt, hsa; identical to SEQ ID NO: 38134

SEQ ID NO: 438437 - RNA, 60 nt, hsa; identical to SEQ ID NO: 38135

SEQ ID NO: 438438 - RNA, 60 nt, hsa; identical to SEQ ID NO: 38136

SEQ ID NO: 438439 - RNA, 60 nt, hsa; identical to SEQ ID NO: 38137

SEQ ID NO: 438440 - RNA, 60 nt, hsa; identical to SEQ ID NO: 38138

SEQ ID NO: 438441 - RNA, 60 nt, hsa; identical to SEQ ID NO: 38139

SEQ ID NO: 438442 - RNA, 64 nt, hsa
acuuggcuucuuuaaccaagaauauuauuggaaaauucucuaaaaguuaauaggguaaauucuc

SEQ ID NO: 438443 - RNA, 64 nt, hsa
uuauuggaaaauucucuaaaaguuaauaggguaaauucucuauuuuuuguaauguguucgguga

SEQ ID NO: 438444 - RNA, 64 nt, hsa
gaccucagaguuccuguaucagggagauugucugauucucuaauaaaagacacauugcugaccu

SEQ ID NO: 438445 - RNA, 64 nt, hsa
uuuaaaaaaacaagaaaugcauguuucaaauaaaauucucuauuguaaauaaaauuuuuucuuu

SEQ ID NO: 438446 - RNA, 64 nt, hsa
gauuguaauaauguuacaugaucauggguguggcauucucuaacaaaugaugugaaaggaaagu

SEQ ID NO: 438447 - RNA, 64 nt, hsa
aagguuuacaaauuaaaugcuugauuuuuaauguauucucuacuguuuugauuuuuggauuuuc

SEQ ID NO: 438448 - RNA, 64 nt, hsa
uaucagauucauucauucagugaagcagccucugauucucuaagagucacgaaugucuuagugu

SEQ ID NO: 438449 - RNA, 64 nt, hsa
uuguucucuuguucauaacauuucucugcaaagaauucucuauggagugaagcgaaugaaguga

SEQ ID NO: 438450 - RNA, 64 nt, hsa; identical to SEQ ID NO: 204913

SEQ ID NO: 438451 - RNA, 64 nt, hsa; identical to SEQ ID NO: 204914

SEQ ID NO: 438452 - RNA, 64 nt, hsa; identical to SEQ ID NO: 204915

SEQ ID NO: 438453 - RNA, 64 nt, hsa; identical to SEQ ID NO: 204916

SEQ ID NO: 438454 - RNA, 64 nt, hsa; identical to SEQ ID NO: 204917

SEQ ID NO: 438455 - RNA, 64 nt, hsa; identical to SEQ ID NO: 204918

SEQ ID NO: 438456 - RNA, 64 nt, hsa; identical to SEQ ID NO: 204919

SEQ ID NO: 438457 - RNA, 64 nt, hsa; identical to SEQ ID NO: 204920

SEQ ID NO: 438458 - RNA, 64 nt, hsa; identical to SEQ ID NO: 204921

SEQ ID NO: 438459 - RNA, 64 nt, hsa; identical to SEQ ID NO: 204922

SEQ ID NO: 438460 - RNA, 64 nt, hsa; identical to SEQ ID NO: 204923

SEQ ID NO: 438461 - RNA, 64 nt, hsa; identical to SEQ ID NO: 204924

SEQ ID NO: 438462 - RNA, 64 nt, hsa; identical to SEQ ID NO: 204925

SEQ ID NO: 438463 - RNA, 64 nt, hsa; identical to SEQ ID NO: 204926

SEQ ID NO: 438464 - RNA, 64 nt, hsa; identical to SEQ ID NO: 204927

SEQ ID NO: 438465 - RNA, 64 nt, hsa; identical to SEQ ID NO: 204928

SEQ ID NO: 438466 - RNA, 64 nt, hsa; identical to SEQ ID NO: 204929

SEQ ID NO: 438467 - RNA, 64 nt, hsa; identical to SEQ ID NO: 204930

SEQ ID NO: 438468 - RNA, 64 nt, hsa; identical to SEQ ID NO: 204931

SEQ ID NO: 438469 - RNA, 64 nt, hsa; identical to SEQ ID NO: 204932

SEQ ID NO: 438470 - RNA, 64 nt, hsa; identical to SEQ ID NO: 204933

SEQ ID NO: 438471 - RNA, 64 nt, hsa; identical to SEQ ID NO: 204934

SEQ ID NO: 438472 - RNA, 64 nt, hsa; identical to SEQ ID NO: 204935

SEQ ID NO: 438473 - RNA, 64 nt, hsa; identical to SEQ ID NO: 204936

SEQ ID NO: 438474 - RNA, 64 nt, hsa; identical to SEQ ID NO: 204937

SEQ ID NO: 438475 - RNA, 64 nt, hsa; identical to SEQ ID NO: 204938

SEQ ID NO: 438476 - RNA, 64 nt, hsa; identical to SEQ ID NO: 204939

SEQ ID NO: 438477 - RNA, 64 nt, hsa; identical to SEQ ID NO: 204940

SEQ ID NO: 438478 - RNA, 64 nt, hsa; identical to SEQ ID NO: 204941

SEQ ID NO: 438479 - RNA, 64 nt, hsa
ccugaggaggauugagggugaaagucucccacgaguacacuaaaccuaggucuggucaccaaua

SEQ ID NO: 438480 - RNA, 64 nt, hsa
caacuuucuccuuguauuucaaaggccaggccauguacacuaacguccuugaaauuugcaguuc

SEQ ID NO: 438481 - RNA, 64 nt, hsa
aaugugcaccugagggugcuuuguguaauauauuguacacuacagcaucuuauauuuuuugagu

SEQ ID NO: 438482 - RNA, 64 nt, hsa
aauaugucaagggagucaauuucugaccaaucaaguacacuaaauuagaauauuuuuaaaguau

SEQ ID NO: 438483 - RNA, 64 nt, hsa
acuauuuugaaugaaucagaaugucaacuuguauguacacuauaucuacacuuacucauuauuu

SEQ ID NO: 438484 - RNA, 64 nt, hsa
ccuuaugagaaaaccuguguggacaucccuugguguacacuaagacagagcagagcccagcgcu

SEQ ID NO: 438485 - RNA, 64 nt, hsa
uaucuaguagagcuuguuuaggaaacugagaaacguacacuaucauugcuaaacuaacaguccu

SEQ ID NO: 438486 - RNA, 64 nt, hsa
cuguuaucuuuuaagacauuuuaaugacucaaagguacacuauacauuuaccauuauuuauacc

SEQ ID NO: 438487 - RNA, 64 nt, hsa
caaaauugcaaauaaauaagcuaugaacuuugauguacacuauaaaucuccuuaauucuauaaa

SEQ ID NO: 438488 - RNA, 64 nt, hsa
acucugaagauguauauguaguuuaaagcaguuuguacacuaaaacuaaguuuuuggcugacug

SEQ ID NO: 438489 - RNA, 64 nt, hsa
acuuccuuuuaggcgauggcaggucaugaaauagguacacuaauaauuuucuaucaaccuuaaa

SEQ ID NO: 438490 - RNA, 64 nt, hsa
uaaaaagcaccuuauccuuucucccauaaccuuuguacacuaaaaaaugaaagaauuuagaaug

SEQ ID NO: 438491 - RNA, 64 nt, hsa
acuauugcaaaacggguguauuauccagguacucguacacuauuuuuuuguacugcugguccug

SEQ ID NO: 438492 - RNA, 64 nt, hsa
uuuuccugcuuccuaccucaagaucuuggcaaugguacacuacaaaugugcugaguuagaauua

SEQ ID NO: 438493 - RNA, 64 nt, hsa
cuaauggaacauuuuggcaaauguauauucagauguacacuaauauauuaucuauuaaaauauu

SEQ ID NO: 438494 - RNA, 64 nt, hsa
guuugacaauuaguaagcaaugaguauaucaucaguacacuagcuuuuuauuaauccauguaca

SEQ ID NO: 438495 - RNA, 64 nt, hsa
acaaaccaaauuaaaagaaauuguuuuucuuucaguacacuaagguguguguuuucaaaaccaa

SEQ ID NO: 438496 - RNA, 64 nt, hsa
ucuugggccauggacauccccacuuccagcccauguacacuaguggcccacgaccaaggggucu

SEQ ID NO: 438497 - RNA, 64 nt, hsa
ugcaagcuuguucagggggcugagaagauccugaguacacuaggugcaaaccagaacucuuggu

SEQ ID NO: 438498 - RNA, 64 nt, hsa
uuuuuucuuuuucauuuuuuuaaaagauugagugguacacuaauaaaugagaguuugaaauuag

SEQ ID NO: 438499 - RNA, 64 nt, hsa
cauucugauuuuaguauauguguuguggaagugaguacacuaucauccacuuuuaaugacagaa

SEQ ID NO: 438500 - RNA, 64 nt, hsa
caagagguauaucgaugauggaaauuagccacauguacacuacauuuuuucuaauaaagccauu

SEQ ID NO: 438501 - RNA, 64 nt, hsa
aacccacuguacuuggggccugcaauggcuguguguacacuacaucuaaugcccaaaugccagc

SEQ ID NO: 438502 - RNA, 64 nt, hsa
uaguaauaugacaaagugauccuucauuaucacgguacacuauuguuuacuuuucaucuguaaa

SEQ ID NO: 438503 - RNA, 64 nt, hsa
acauauguauccauuuagagcuaaaggaaucaguguacacuacagcuaauccuaauaaauccga

SEQ ID NO: 438504 - RNA, 64 nt, hsa
ccaaacuauucuauggccauuacuaacacgcauuguacacuaucuaucugccuuuaccuacaua

SEQ ID NO: 438505 - RNA, 64 nt, hsa
agauguguuuuguucaaaauuuaaauuuguugugguacacuaucuuauguaaccugucugguga

SEQ ID NO: 438506 - RNA, 64 nt, hsa
ugugggagguaaggaaaaggauuuagagguaaaaguacacuaaguuugcaacauuuauugagau

SEQ ID NO: 438507 - RNA, 64 nt, hsa
gguauguccuaacauggaguuaacuggaauagcaguacacuagcaaguaucugugaauccuuag

SEQ ID NO: 438508 - RNA, 64 nt, hsa
uauucaaauguaauuaugaggugaaacaauuauuguacacuaacauauuuagaagcugaacuua

SEQ ID NO: 438509 - RNA, 64 nt, hsa
uucuacuaagcuaaaaauuccuuuuuaucaaaguguacacuacugaugcuguuuguuguacuga

SEQ ID NO: 438510 - RNA, 64 nt, hsa
uuacaggaauguuaaauacuuagacagaucuuaaguacacuagaauuaucugucccugaaauaa

SEQ ID NO: 438511 - RNA, 64 nt, hsa
uuuaacugaaaaagaaauaucuaagcuguacaugguacacuagaauuuucugaaagcagaaaac

SEQ ID NO: 438512 - RNA, 64 nt, hsa
accauuaacuuauaucccaaguccauuuuuuccuguacacuacaaacaaaagauauauuagaga

SEQ ID NO: 438513 - RNA, 64 nt, hsa
cccguucuacucaccuaagugccgccugacccuuguacacuaggagcuggccucccaccucugc

SEQ ID NO: 438514 - RNA, 64 nt, hsa
cugagaagugggagcacaguacugagaaaugggaguacacuacugagaaaugggagcacaguac

SEQ ID NO: 438515 - RNA, 64 nt, hsa
ucguguggaucuugccacauuucugaucagagguguacacuaacauuucccccgagcucuuggc

SEQ ID NO: 438516 - RNA, 64 nt, hsa
guuucuccccaaaucuagaaauuuuaguucauauguacacuagccagugguuguggacaaccau

SEQ ID NO: 438517 - RNA, 64 nt, hsa
uauuauuuuccaguaaauaugcuucaaaccaugaguacacuauuaggcccuacaacuuuguuuu

SEQ ID NO: 438518 - RNA, 64 nt, hsa
uguguuuucucuuggcucuuugggucuuucccggguacacuagauggcuccaucccaaggcauc

SEQ ID NO: 438519 - RNA, 63 nt, hsa
uuuauggcuucggcggcugagcuuaccucuacaguacacuaccgcaaaaccaacggcccuuuu

SEQ ID NO: 438520 - RNA, 64 nt, hsa
uccuuuauuucuacaucuaaaauaagaacauauuguacacuauuauauaauacagaauugucuu

SEQ ID NO: 438521 - RNA, 64 nt, hsa
acaaugguauucaacauucuauauacuguguuuaguacacuaauuuugaagccaauauuucugu

SEQ ID NO: 438522 - RNA, 64 nt, hsa
ggaacuggugaauaauaauuaacuauugugaacaguacacuauaccauacuuccuuagcuuaua

SEQ ID NO: 438523 - RNA, 64 nt, hsa
uuuaguaggggacaagaagucuguucuucagugaguacacuagagauuuacucuggugacugcc

SEQ ID NO: 438524 - RNA, 64 nt, hsa
acuguuuuuaucacugauuuauuuugugaaaguuguacacuaauguucuaugucaaaaucaaaa

SEQ ID NO: 438525 - RNA, 64 nt, hsa
aaacccaaaauguaguucucuauuaaccugaaauguacacuagcccagaacaguuuaaugguac

SEQ ID NO: 438526 - RNA, 64 nt, hsa
ggaugcuagaggugaauauuugggucauuuacauguacacuacauagcaaguugauacucaugu

SEQ ID NO: 438527 - RNA, 64 nt, hsa
augagcauuuagcacaauuugagacugaaauuuaguacacuauguucuaggucagucuaacagu

SEQ ID NO: 438528 - RNA, 64 nt, hsa
guuccaaugauaauuauuacuuuuauauuucaaaguacacuaagaucguugaagagcaauagaa

SEQ ID NO: 438529 - RNA, 64 nt, hsa
ucaaaacagcaggaaauuuuuaaacuuuuauauuguacacuauuuuugcauaaaauaagagcug

SEQ ID NO: 438530 - RNA, 64 nt, hsa
cugguguggggcuuuuauugauagugugaagauuguacacuauauuacaugaucagaucauaca

SEQ ID NO: 438531 - RNA, 64 nt, hsa
agaagucuggcuuugcucuauuaagauuggaaauguacacuaccaaacacucaguccacuguug

SEQ ID NO: 438532 - RNA, 64 nt, hsa
agagcguccugcggucucgcuggcacagcgccccguacacuaggggguccuacagcuacguggc

SEQ ID NO: 438533 - RNA, 64 nt, hsa
cuggcauggggcuuuuauugacagugugaagauuguacacuacauuacaugaucagaucauaca

SEQ ID NO: 438534 - RNA, 64 nt, hsa
auucuagucuauuuguugaugcuugugucaaacaguacacuaucuuaauuauuguacauuuaua

SEQ ID NO: 438535 - RNA, 64 nt, hsa
aaauaaaauauaugugcuuauuaaauaaugcacaguacacuagauuauagaguuuauuuuugcu

SEQ ID NO: 438536 - RNA, 64 nt, hsa
ccaagauagagcuacaaacucagcuguacaguucguacacuaaacucuucuugcuuuugcauua

SEQ ID NO: 438537 - RNA, 64 nt, hsa
augucccugcuauuucuggauuuaugaggcaaugguacacuaaagaauggaaucaguucaguga

SEQ ID NO: 438538 - RNA, 64 nt, hsa
accuucaauccagaguuacacaaaaaggagauauguacacuagagacaucaaaccaggggacau

SEQ ID NO: 438539 - RNA, 64 nt, hsa
acuugcuuuccagucugauucacguuagcaguguguacacuacuguaucaucaucagcuucauc

SEQ ID NO: 438540 - RNA, 64 nt, hsa
aaugaaauaugcaaaugauccaaugcauacaguaguacacuauuuaaugguuauacauggcaua

SEQ ID NO: 438541 - RNA, 64 nt, hsa
uaguucagaaauaauucucccagcuuuauaaauaguacacuaaacauaguuuaacuuuuuuuaa

SEQ ID NO: 438542 - RNA, 64 nt, hsa
uuuaugacagugcauaauuugcaaaauaaaaaauguacacuagcauaauauuuguggcauaucc

SEQ ID NO: 438543 - RNA, 64 nt, hsa
guucugaggauugauacguuuugaguauguauuuguacacuaucuggcacauaugcgcucaaua

SEQ ID NO: 438544 - RNA, 64 nt, hsa
acuggauggauggucuuuuauaaggcauuuaaggguacacuacuguguuucacugaccauacau

SEQ ID NO: 438545 - RNA, 64 nt, hsa
uuuaaaaaaauaacuacaguauagcgcugguacaguacacuaaaagacuuugauaaaaagaaac

SEQ ID NO: 438546 - RNA, 64 nt, hsa
ucacagcaccuggcccgccaagguugggaggauuguacacuacuuucauuuaaaggggaaaguu

SEQ ID NO: 438547 - RNA, 64 nt, hsa
auuugauguauuuacucaaaacacaauuugcacuguacacuagugaauugacguuuaugauuua

SEQ ID NO: 438548 - RNA, 64 nt, hsa
aucauauuaaaagugaauucuucuagaggcuuguguacacuacugguuguuuuaguugggccuu

SEQ ID NO: 438549 - RNA, 64 nt, hsa
ccuacacauuucccaucaaucagaaaauagacagguacacuaaagggacccugagaacuccucu

SEQ ID NO: 438550 - RNA, 64 nt, hsa
uuauucuuuagucagaucuaaauauaccgcuucuguacacuaauguuuauagguauuuauagca

SEQ ID NO: 438551 - RNA, 64 nt, hsa
gcuguuauuaaugccuuuuuguuuuccauugaguguacacuacugaauaaguguaggaguuuua

SEQ ID NO: 438552 - RNA, 64 nt, hsa
uggaacaccuaucagggagcagaaaaggggugcaguacacuaagugaacccagauucuggauuc

SEQ ID NO: 438553 - RNA, 64 nt, hsa
aauaaaaccgaggguuguugauuuugcugugacaguacacuaaaucaauacuauaucuuauaca

SEQ ID NO: 438554 - RNA, 64 nt, hsa
uuguuuuuaacuuauuuuuuuuuuaacaacuguaguacacuacccugagacacugcaucucgau

SEQ ID NO: 438555 - RNA, 64 nt, hsa
ugaccuugcugggcacagaaaacacccucguggaguacacuaauuugaacuggacuggucucag

SEQ ID NO: 438556 - RNA, 64 nt, hsa
uagagucagaccagaaugaaaaugccaggagcugguacacuacagauguaguaagaaccuggga

SEQ ID NO: 438557 - RNA, 64 nt, hsa
ggcauuaaaauucacugugcccagcacaugggugguacacuaauuaugacuucccccagcucug

SEQ ID NO: 438558 - RNA, 64 nt, hsa
aaguuccaggggagcccaggaccccuggggaccuguacacuagcaggaugggucuugggaguug

SEQ ID NO: 438559 - RNA, 64 nt, hsa
cuccggucauuugugccuuucucuugucaucucuguacacuacuuauauucacuguggguuggg

SEQ ID NO: 438560 - RNA, 64 nt, hsa
ccuuucccaccacaaauuaucaacugguugauguguacacuaauuacauuucaggaggacuuaa

SEQ ID NO: 438561 - RNA, 64 nt, hsa
uuauguuuauuucauguggugaauaugcaaggcgguacacuacgcacuggacagcaucagaaau

SEQ ID NO: 438562 - RNA, 64 nt, hsa
uaaaacuuauuuugcaauuaauacguauuuuacaguacacuaauaugcauauauguuguauuuu

SEQ ID NO: 438563 - RNA, 64 nt, hsa
gacaccgccuucucaagccugucuauaaaaucugguacacuaugacgagggucagauuucccau

SEQ ID NO: 438564 - RNA, 64 nt, hsa
cugauauuuucuuaaaagaucuaguguccuuuuuguacacuaaacaggugaaugcugacuuuuu

SEQ ID NO: 438565 - RNA, 64 nt, hsa
gcagguaagcuuuacagcuuucagaggaguuguaguacacuacagaaauaugucuucuuuccag

SEQ ID NO: 438566 - RNA, 64 nt, hsa
ggcauugcaaugaagugcuuuguaucaggaaaguguacacuauugaccuuuuuuccuguucaca

SEQ ID NO: 438567 - RNA, 64 nt, hsa
acccaggcacagccccgccaccauggaucuccguguacacuaucaauaaaaguggguuuguuac

SEQ ID NO: 438568 - RNA, 64 nt, hsa; identical to SEQ ID NO: 392709

SEQ ID NO: 438569 - RNA, 64 nt, hsa; identical to SEQ ID NO: 392710

SEQ ID NO: 438570 - RNA, 64 nt, hsa; identical to SEQ ID NO: 392711

SEQ ID NO: 438571 - RNA, 64 nt, hsa; identical to SEQ ID NO: 392712

SEQ ID NO: 438572 - RNA, 64 nt, hsa; identical to SEQ ID NO: 392713

SEQ ID NO: 438573 - RNA, 64 nt, hsa; identical to SEQ ID NO: 392714

SEQ ID NO: 438574 - RNA, 64 nt, hsa; identical to SEQ ID NO: 392715

SEQ ID NO: 438575 - RNA, 64 nt, hsa; identical to SEQ ID NO: 392716

SEQ ID NO: 438576 - RNA, 64 nt, hsa; identical to SEQ ID NO: 438479

SEQ ID NO: 438577 - RNA, 64 nt, hsa; identical to SEQ ID NO: 438480

SEQ ID NO: 438578 - RNA, 64 nt, hsa; identical to SEQ ID NO: 438481
